United States Patent 7,795,419 (VIRAL AND VIRAL ASSOCIATED MIRNAS AND USES THEREOF) - sequence listing, part 15

SEQ ID NO: 428060 - RNA, 64 nt, Human
uucuaauguuuuucuuuaucccuuuaauacagaacccucccaaacauuggcuaguacaacuuga

SEQ ID NO: 428061 - RNA, 64 nt, Human
cucuggguagagggcaacgccugcagccccucuucccucccacaugguuuaacuguaauagcgu

SEQ ID NO: 428062 - RNA, 64 nt, Human
cacagcucagcugcccaucccagucccucgccgucccucccaggucgggcaguggaggcugcug

SEQ ID NO: 428063 - RNA, 64 nt, Human
gugugucucggugacguuuucuaucagacgugcucccucccauccuccagcccugcccacccuc

SEQ ID NO: 428064 - RNA, 64 nt, Human
gccuccagcaccaagggcgggcagcacccuccgacccucccaugcgggugcacacgaaggguga

SEQ ID NO: 428065 - RNA, 64 nt, Human
ccagcuccucuaggggcagccuccgucauccaugcccucccaggacccuccacucacugcugug

SEQ ID NO: 428066 - RNA, 64 nt, Human
uggccacagcccugccuccgcccucaccuacaugcccucccagccccucccaucucuggacgag

SEQ ID NO: 428067 - RNA, 64 nt, Human
ccugccuccgcccucaccuacaugcccucccagccccucccaucucuggacgaggccuccuucc

SEQ ID NO: 428068 - RNA, 64 nt, Human
cuuccugcccuugaacccccucccugucccagggcccucccagcccauugcugccaagguggag

SEQ ID NO: 428069 - RNA, 64 nt, Human
aagaaaaacauccugggaaauccagcuaccagggcccucccaguggaggcaucuuacauuuagg

SEQ ID NO: 428070 - RNA, 64 nt, Human
ccccaaacccacacugaugcgaagcuguucuugacccucccauagcaucaacucaguucagcuc

SEQ ID NO: 428071 - RNA, 64 nt, Human
ggagcccagaguugggcacuggcaaaugucuccucccucccaugcuccuuggcuucugaaggcu

SEQ ID NO: 428072 - RNA, 64 nt, Human
ccuuaauaaaaaggacaaauggauacagccuugacccucccagugaggagaccccaauucagca

SEQ ID NO: 428073 - RNA, 64 nt, Human
aagggguguccuaaagugccucccccuguauucccccucccagggcagccccugcccagcacaa

SEQ ID NO: 428074 - RNA, 64 nt, Human
uagcaagggggcuagaggagggagauuccaccuccccucccaagugacccuccuccugccucug

SEQ ID NO: 428075 - RNA, 64 nt, Human
ugaauuccugggaucaagcaauccuuccaccuugcccucccaaaguguugggauuauaggcaug

SEQ ID NO: 428076 - RNA, 64 nt, Human
agugggcagugaagaugaagccccaugcucaguccccucccaucccccacgcagcuccacccca

SEQ ID NO: 428077 - RNA, 64 nt, Human
cugugaagcuccucaagugaccacccucuacugacccucccagggcauuccagcucaagcugcu

SEQ ID NO: 428078 - RNA, 64 nt, Human
guugguacuuaccugucucaccuacccuccaguccccucccagcuccgcucacagggcucucau

SEQ ID NO: 428079 - RNA, 64 nt, Human
uggggggaaaugccacugcuuuuagcaaaagccucccucccagaauuagccagcuugccuccug

SEQ ID NO: 428080 - RNA, 57 nt, Human
agcugggggcccgggcgugacugugcccccucccacccugcgggccaggguccuguc

SEQ ID NO: 428081 - RNA, 64 nt, Human
ugaaguacuaacuuuccaaggccugccuuccccucccucccacuggagaagccgccagccccuu

SEQ ID NO: 428082 - RNA, 64 nt, Human
ugcaaauacucuugguugacauccccuuccucagcccucccagccuacuccccaucccagcuuu

SEQ ID NO: 428083 - RNA, 64 nt, Human
ucuuccugacuucuugugugccucccuuuccuuucccucccacaaagccaacacucugugacca

SEQ ID NO: 428084 - RNA, 64 nt, Human
accccaugucaggcugucccaugguguguucugccccucccaccuguccccgccuccaacugcg

SEQ ID NO: 428085 - RNA, 64 nt, Human
guacuuacugugcugagagcuuuccucgcagaggcccucccaacgaacagcucucucagaagca

SEQ ID NO: 428086 - RNA, 64 nt, Human
acuguacucucucuccuaccugccucccugcagucccucccauggaugacucaggccucccaga

SEQ ID NO: 428087 - RNA, 64 nt, Human
gguucagaaccucugcagggaagggggaagaaaacccucccauuaggaagcaugcuuuugcagu

SEQ ID NO: 428088 - RNA, 64 nt, Human
gguggggacuugggcugggauggggacggcauaccccucccaggccucucccucugccuuucug

SEQ ID NO: 428089 - RNA, 64 nt, Human
gcaauucccaggaucucuccuucccuggaucccucccucccaggucugggcugugcaguuccuc

SEQ ID NO: 428090 - RNA, 64 nt, Human
ugcccccuucucccacacugcuaggugggccagccccucccaccacagcaggugucauauaugg

SEQ ID NO: 428091 - RNA, 64 nt, Human
aguggccuuggcaaugucugugccaccuccugagcccucccagcauguccucacaugcucaugc

SEQ ID NO: 428092 - RNA, 64 nt, Human
uuccccuaagcacacagggguuaaagcugugugucccucccaguggcuguggcagugacaguga

SEQ ID NO: 428093 - RNA, 64 nt, Human
ggaaauugcaccuuacagacaguggagggguguccccucccacaggcaagaaccagaggcccag

SEQ ID NO: 428094 - RNA, 64 nt, Human
cuucacucaauuaaaaaaaaauuauucuccaguccccucccacuuugcuucuuguaugcauugu

SEQ ID NO: 428095 - RNA, 64 nt, Human
acagcuugcucaggccccaggguggcugccucggcccucccagcucuuacacucagcuccagug

SEQ ID NO: 428096 - RNA, 64 nt, Human
agucuccccaccucuucccugaagagacaggcaccccucccagccguggucaacggagggagug

SEQ ID NO: 428097 - RNA, 64 nt, Human
ggagcugggcagagccugggcugguggggugccacccucccacaagggcugggcugagacccag

SEQ ID NO: 428098 - RNA, 64 nt, Human
guuuguguucguguuuuguuuguuucacuuguuucccucccagccccaaaccuuuuguucucuc

SEQ ID NO: 428099 - RNA, 64 nt, Human
ggaggcucuggaggcacacaggaugcagccuucccccucccaggccuggcuuauuccaagaggc

SEQ ID NO: 428100 - RNA, 64 nt, Human
auugggauggggcugaggaacaugcucccucccucccucccauaaaaugccugcucuucaccuc

SEQ ID NO: 428101 - RNA, 64 nt, Human
uauagaacuguuugaauugcagccauccccugcccccucccaggcugaagaucuguucuuuuua

SEQ ID NO: 428102 - RNA, 64 nt, Human
uccugcccccaagucauuuccguccccccccaggcccucccaccaccccauuuuauuuuauaug

SEQ ID NO: 428103 - RNA, 64 nt, Human
gccauggaugccucaucaccaacccugaccuucccccucccaacccuuuauucauccucacucc

SEQ ID NO: 428104 - RNA, 64 nt, Human
ccguccccccugucccugucccccuucccccgaccccucccagauccuggggaccaauaaagcc

SEQ ID NO: 428105 - RNA, 64 nt, Human
agagagaacgugugugugugugucggugaucacacccucccauccuuccugccuccugccccaa

SEQ ID NO: 428106 - RNA, 64 nt, Human
cucccuucagcucugggaggcaggcgcagugccccccucccaugggcuggcccaggaccguggg

SEQ ID NO: 428107 - RNA, 64 nt, Human
cugcccucagcccccgaccuuauuuauuacccuccccucccacacccccaaucuaccuggugau

SEQ ID NO: 428108 - RNA, 64 nt, Human
ggcugaauucucggugauaaaggcgcccacuggacccucccaacgcccaaugcuuugcuuuucu

SEQ ID NO: 428109 - RNA, 64 nt, Human
agacaguggucaacaggaagacccagcagcuccacccucccaagugacaggccauuuucggacg

SEQ ID NO: 428110 - RNA, 64 nt, Human
caucucaggcacuucugcaucacggaagaccuggcccucccagccguccuggggaugcucaggg

SEQ ID NO: 428111 - RNA, 64 nt, Human
uauauauauauauauauacacaaaugcacagucccccucccacuccguuaccuaacuguacguc

SEQ ID NO: 428112 - RNA, 64 nt, Human
ggccaugcugugggggaccugcuccucacagagccccucccaaggaucgggcggaagcugcugg

SEQ ID NO: 428113 - RNA, 64 nt, Human
ugucaagaggguugucauuaauacaucuaggguacccucccaugucaugaaguuaccuagucag

SEQ ID NO: 428114 - RNA, 64 nt, Human
aaggcuucucuccaagugugccaggccaggacagcccucccagccaugaauccuuacucagcua

SEQ ID NO: 428115 - RNA, 64 nt, Human
gcuccugguggggaauggcuggggcugggcaggacccucccacacaccugcacccuagcuucgu

SEQ ID NO: 428116 - RNA, 64 nt, Human
accaggcaucgagcuagcucccugcacggccgcacccucccagagaacuccuugaggagaacaa

SEQ ID NO: 428117 - RNA, 64 nt, Human
gccacaagcugaccccuucgugguuauagcccugcccucccaagucccacccucuucccauguc

SEQ ID NO: 428118 - RNA, 64 nt, Human
cugaauugcccaagcccuuggcuccccccggccucccucccaccccuucuuauuuauuuccuuu

SEQ ID NO: 428119 - RNA, 64 nt, Human
uguccaaugugaggacugccugggcagggucugccccucccaccccucucugcccugggagccc

SEQ ID NO: 428120 - RNA, 64 nt, Human
agggagggccaggaccauccuccuaccccucauacccucccagcauauacaaaaggggagguuu

SEQ ID NO: 428121 - RNA, 64 nt, Human
ugugggguacucaacugacauucccaugggguuucccucccaucugccugauccaccuccuccu

SEQ ID NO: 428122 - RNA, 64 nt, Human
cccacugguuccuucuuccugggucuucagcauucccucccaucaugcccggucccaccccucc

SEQ ID NO: 428123 - RNA, 64 nt, Human
aggcacagccagugcauuccugccugcggacaggcccucccagcagcuuugccgccucuccauc

SEQ ID NO: 428124 - RNA, 64 nt, Human
ucgccccuucccuuucaucugaaagaagauaccucccucccaguccaccucauuuagaaaacca

SEQ ID NO: 428125 - RNA, 64 nt, Human
gaaugcaagcuguaggugggugggugaguguguccccucccacacugcucucugguggguuugg

SEQ ID NO: 428126 - RNA, 64 nt, Human
uuccggguugcugugacagccgguagagccucugcccucccaaaacuaagcgggggggcguggg

SEQ ID NO: 428127 - RNA, 64 nt, Human
gaguggugggacaacugcagccagagacucucuccccucccaccaugggccccucugcccaugu

SEQ ID NO: 428128 - RNA, 64 nt, Human
aagaaaaacauccugggaaauccagcuaccauggcccucccaguggaggcaucuuacauuuagg

SEQ ID NO: 428129 - RNA, 64 nt, Human
gggcugcucucaaaccaugucccaucuucagcaucccucccaccaacuuacuccccugugguga

SEQ ID NO: 428130 - RNA, 64 nt, Human
guauacgcugaagcugacuuccgucuguguccugcccucccauccagcacucucuauggaaaua

SEQ ID NO: 428131 - RNA, 64 nt, Human
caacccaugcccgcuagaaaccugcugcgagggccccucccagaggagccccgccccuguaaga

SEQ ID NO: 428132 - RNA, 64 nt, Human
gcuguuguuugggaaacagggaagcauuggggaccccucccaacuuuucuucccaguaacgccu

SEQ ID NO: 428133 - RNA, 64 nt, Human
cagaccccagaucacaaagccaaccaugcccagccccucccagcacccccagccccacgaccau

SEQ ID NO: 428134 - RNA, 64 nt, Human; identical to SEQ ID NO: 428133

SEQ ID NO: 428135 - RNA, 64 nt, Human
gugguguacaagcauuuguuccaugccugcugugcccucccauagcacugccucuuccagggcc

SEQ ID NO: 428136 - RNA, 64 nt, Human
cagaccccagaucacaaagccaaccaugcccggccccucccagcacccccagccccacgaccau

SEQ ID NO: 428137 - RNA, 64 nt, Human
agcccaugccacccccauccugggcacaguuacacccucccaugcagugggagaaacacagacc

SEQ ID NO: 428138 - RNA, 64 nt, Human
cccacucuugcucuacgaggagcaagugccugcccccucccagcagccagcccugccaaaguug

SEQ ID NO: 428139 - RNA, 64 nt, Human
uaaaagcacacucauccccucacuugccgcgucgcccucccaggcucucaacaggggagagugu

SEQ ID NO: 428140 - RNA, 64 nt, Human
gucauucuuuucucuuggaaagguaggaggcugccccucccaugcucuccugcuuucucccugu

SEQ ID NO: 428141 - RNA, 64 nt, Human
ggggcugacccaggcuggaggacagggccagccacccucccacggccugggaggaagagaggcc

SEQ ID NO: 428142 - RNA, 64 nt, Human
uuuccuccucucuagaaccuccuucuguuggaggcccucccaucuccccgcugaaaccugcgcu

SEQ ID NO: 428143 - RNA, 50 nt, Human
gggagaccgacguccuuuagcccucccaggccccacggcagcacuuaugg

SEQ ID NO: 428144 - RNA, 64 nt, Human
ccuggaaaaggcuagggagcuggggcuggggcuccccucccaugaccaggcaguggucacccca

SEQ ID NO: 428145 - RNA, 64 nt, Human
uccuaccuccccugccugagcccucacuccacagcccucccagguaccuagcagaggcugucag

SEQ ID NO: 428146 - RNA, 64 nt, Human
ugcaccagaaauaguacucacugccucagacagucccucccacagucuacucugucuccacccc

SEQ ID NO: 428147 - RNA, 64 nt, Human
ggagcuguuccauuggguccucuuggugucguuucccucccaacagagcugggcuacccccccu

SEQ ID NO: 428148 - RNA, 64 nt, Human
aaagaaaguggcaggcaaacacaacucuugacugcccucccacccuccuaccuguucaguacuc

SEQ ID NO: 428149 - RNA, 64 nt, Human
gcccgugcucaacaccgccugggccacagcuaggcccucccaccggcucgcugcagagccgggc

SEQ ID NO: 428150 - RNA, 64 nt, Human
aauggggcagggugcucuggacucuuacccccuccccucccaucuguggcuuggcucugcugug

SEQ ID NO: 428151 - RNA, 64 nt, Human
cagggucaggagagaccccucuguauccccaggucccucccagaacugacuccuaaggucucca

SEQ ID NO: 428152 - RNA, 64 nt, Human
gaaaaugaaugugaaacuaggaaauaaaaugugccccucccagucugggaggaggauguugcag

SEQ ID NO: 428153 - RNA, 64 nt, Human
ucgcucucgcucucucucgcugcguccucauuuccccucccaauccucucuccccucugcaacc

SEQ ID NO: 428154 - RNA, 64 nt, Human
acccgggggggaagaagcaaagccaucucccacccccucccagccuucucauuucugcuuucuu

SEQ ID NO: 428155 - RNA, 64 nt, Human
gcuuccuguaaacucccuccaucccaaccuggcucccucccacccaaccaacuuuccccccaac

SEQ ID NO: 428156 - RNA, 64 nt, Human
cagaaccacaacagguuggucaucaggauggccacccucccaggaucauccuuccucuguuccu

SEQ ID NO: 428157 - RNA, 64 nt, Human
uaaaucuccuccucuucuuccuguccaugccggccccucccagcaccagcucugcucaggcccc

SEQ ID NO: 428158 - RNA, 64 nt, Human
agaaacagcauccugggaaauccagcuaccauggcccucccaguggaggcaucuuacauuuagg

SEQ ID NO: 428159 - RNA, 64 nt, Human
cuagcgagggaccuccgcugcaucucagcaaagccccucccaggguuugaucgauugagcagga

SEQ ID NO: 428160 - RNA, 64 nt, Human
cucccugccucccacccucaucucucuacccuaccccucccaucggggcugugcuggggcuugg

SEQ ID NO: 428161 - RNA, 64 nt, Human
ccgcccgcccacaggccugaggucugggaccuuucccucccaggaguccccuagguggcugggg

SEQ ID NO: 428162 - RNA, 64 nt, Human
agcccgggucaggcuggggaggaacagaacugggcccucccagagcaccuccgcuuccccccug

SEQ ID NO: 428163 - RNA, 64 nt, Human
auccugaggacagaaaaagcugggucuugcugugcccucccaggcuuaguguucccucccucaa

SEQ ID NO: 428164 - RNA, 64 nt, Human
ccuugggugcaggcagggcugggacacgcggcuucccucccagucccugccuuggcaccgucac

SEQ ID NO: 428165 - RNA, 64 nt, Human
gaagguccuuuuugggggacuuugacagccauaucccucccagcacaccaggcgccaggugagc

SEQ ID NO: 428166 - RNA, 64 nt, Human
uccccauaccaaagugcugacaggcccuccgugccccucccacccugguccgccucccuggccu

SEQ ID NO: 428167 - RNA, 64 nt, Human
gauuuuggugacuugacuuauggaggcuggaaagcccucccacuaaaauugauaaaccgaacgc

SEQ ID NO: 428168 - RNA, 64 nt, Human
gccauaguuauuuuucucaaaauuuagugaaaaucccucccauguagacauguugcacauuuuu

SEQ ID NO: 428169 - RNA, 64 nt, Human
uccaagccgucaucaucauccucaggacccaggacccucccauggccgggacagcccaucagag

SEQ ID NO: 428170 - RNA, 64 nt, Human
ugcugggugagacagugggcccucguccccuccccccucccaauucucugccccaggcuaauau

SEQ ID NO: 428171 - RNA, 64 nt, Human
ccaaaaggagaagaacaucugagaaccuccucggcccucccagucccucgcugcacaaauacuc

SEQ ID NO: 428172 - RNA, 64 nt, Human
caaccaacuaucuaaauggacauuugggggaauucccucccaaauuugauuuuguuauuagaaa

SEQ ID NO: 428173 - RNA, 64 nt, Human
gcucucuauagcaccagggcucacgugggaaccccccucccacccaccgccacaauaaagaucg

SEQ ID NO: 428174 - RNA, 55 nt, Human
aggccaagggccgccccugaaccgccccucccacagcgcuggccgggaccccgag

SEQ ID NO: 428175 - RNA, 64 nt, Human
auugccuuccacauauguaagucucugggcggcgcccucccagcucccugccucuguuucccca

SEQ ID NO: 428176 - RNA, 64 nt, Human
acaaucaacucaagguacgcccacugcaaggccucccucccaccgcggccccugccuggccacc

SEQ ID NO: 428177 - RNA, 64 nt, Human
gcaacacacccagccgccugguacuuccuccagccccucccagucagcccucccguccucgggg

SEQ ID NO: 428178 - RNA, 64 nt, Human
ggggcccugccugccgcggggccuccccacaagccccucccaaagcgccggccgacucgcuguc

SEQ ID NO: 428179 - RNA, 64 nt, Human
uuugaguccucgggcccagaaucguaucccaaagcccucccauggccuagaaaauaaauaaguu

SEQ ID NO: 428180 - RNA, 64 nt, Human
uuaacucagccgaggugggaaauggugucccugucccucccaaagcacagagcacagaaaugag

SEQ ID NO: 428181 - RNA, 64 nt, Human
agaugccugaggaccucgacaggggucacccccucccucccaccccuggacugggcugggggug

SEQ ID NO: 428182 - RNA, 64 nt, Human
ggucccuccaaaacucuggucaguucaaggaugccccucccaggcuaugcuuuucuauaacuuu

SEQ ID NO: 428183 - RNA, 64 nt, Human
gcaguggggaagggggccaagguauuggaggacucccucccagcuuuggaagccucauccgcgu

SEQ ID NO: 428184 - RNA, 64 nt, Human
uccagguuggucuugaacuccuggccucaagcaucccucccagcuugaagugucaauaaaggaa

SEQ ID NO: 428185 - RNA, 64 nt, Human
cccccucacacugaguucacagugcgcccucccucccucccaucuggggguagugccuuaugcu

SEQ ID NO: 428186 - RNA, 64 nt, Human
aacccgcccagccucccgcggggccacacacuuccccucccaacacacacacacaccugccauc

SEQ ID NO: 428187 - RNA, 64 nt, Human
gggacuugaggggggccccagggguucucaggaccccucccaccaccucccagugcuuccacgu

SEQ ID NO: 428188 - RNA, 64 nt, Human
gccuguucugagugagccccucacucagccggggcccucccaccuccaacgccccgcccacgcc

SEQ ID NO: 428189 - RNA, 64 nt, Human
accagauggaggggcccucccuggucucuggccacccucccagccucugcccagggaccccugc

SEQ ID NO: 428190 - RNA, 64 nt, Human
cggccguggcgggucccacgcgccgggcgcggcccccucccaaacugugacugguauuuauugg

SEQ ID NO: 428191 - RNA, 64 nt, Human
uccaaguccugggaaugugcggggccagucccugcccucccaggaggggugguagccguuccca

SEQ ID NO: 428192 - RNA, 64 nt, Human
cuagaagaaauggauaaauuccucaacacguacacccucccaagacuaaaccaggaagaaguug

SEQ ID NO: 428193 - RNA, 64 nt, Human
ugccaucuugccccuagccugggggcucccuagccccucccagagcaucucacccccacccuca

SEQ ID NO: 428194 - RNA, 64 nt, Human
ccccauguucuucugucuccaggaagggcagcggcccucccaucacuggaagucugcagugggg

SEQ ID NO: 428195 - RNA, 50 nt, Human
guggggaccugugugucugacccucccaccagucaugcaaccugagauuu

SEQ ID NO: 428196 - RNA, 64 nt, Human
caugagcgcacacacaagacugagggacugucggcccucccagguggugucaacacaacaucac

SEQ ID NO: 428197 - RNA, 64 nt, Human
guaaaaggaagggguuggauugcaauaucugaagcccucccagguguuaacauuccaagacucu

SEQ ID NO: 428198 - RNA, 64 nt, Human
aggcacggggaggguuuucuccucacccccucugcccucccaacuuggguuguacuuucuaaga

SEQ ID NO: 428199 - RNA, 64 nt, Human
ccucuucugagcacagauguucccccaucucgcucccucccaggacucugaccccagcauucuc

SEQ ID NO: 428200 - RNA, 64 nt, Human
ccggaaugccacccacaucuuccauuuccauguccccucccagagcugguggacccagggaaca

SEQ ID NO: 428201 - RNA, 64 nt, Human
aaugugaacguccuuccuugacugucuagccacucccucccagaaaaacuggcucugauuggaa

SEQ ID NO: 428202 - RNA, 64 nt, Human
augagggagaaaggagaaggggaggaaacuucuccccucccaccuucaccuuuagcuucuugaa

SEQ ID NO: 428203 - RNA, 64 nt, Human
ugacuugucaucaagagucaccucagcugcgccccccucccauccuuuccuaugagaagccacu

SEQ ID NO: 428204 - RNA, 64 nt, Human
cauuugcaaggugaacacuuccuucuagggagcacccucccaccccccaccccccccacacaca

SEQ ID NO: 428205 - RNA, 58 nt, Human
acaagggcuccgccgagugagccggccccccucccauggcccugcuguggcuccccag

SEQ ID NO: 428206 - RNA, 64 nt, Human
aggggagaggggccagggaaguggaugucuccuccccucccaccccacccuguuguagccccuc

SEQ ID NO: 428207 - RNA, 64 nt, Human
gagcuucccucugggacuaaaggaguguccuuuacccucccagccuccaggcucuggcagaaau

SEQ ID NO: 428208 - RNA, 64 nt, Human
ucaacuccugaccucaggugauccacccaccuugcccucccaaagugcuaggauuacaggcgug

SEQ ID NO: 428209 - RNA, 64 nt, Human
gccuuuccucuguuuuccucuuccugucuccccucccucccaccuuuuucuuuccuucccaauu

SEQ ID NO: 428210 - RNA, 64 nt, Human
gcauuccagcucugcccccgcggguucuagacgccccucccaagcguuccuggccuucugaacu

SEQ ID NO: 428211 - RNA, 64 nt, Human
agaaacugugagcaccuccacugacagaggcggccccucccacggcucccaauaaaaaugugaa

SEQ ID NO: 428212 - RNA, 64 nt, Human
uuuuuccugaugcucucccucccuucaucauccgcccucccacuacaagccccaguguguguug

SEQ ID NO: 428213 - RNA, 64 nt, Human
cagggugcacagcagggcgggguaggaccccagccccucccaaaacagccucuccuucucccau

SEQ ID NO: 428214 - RNA, 64 nt, Human
ucccagcgccacuuggccucuuccucuccuccuucccucccaucguccuccuccaccugcgccu

SEQ ID NO: 428215 - RNA, 64 nt, Human
cccaggguggucucaaacuccugugcucaagugacccucccaccucauucucaaguggcugcaa

SEQ ID NO: 428216 - RNA, 64 nt, Human
cugaaauacgucccaccugugcagcuaugugacucccucccacacacgcuuaagacaccucugc

SEQ ID NO: 428217 - RNA, 64 nt, Human
cuugggggaagggacgucagcaagguggcucugacccucccaggugacucugccaagcagcugu

SEQ ID NO: 428218 - RNA, 64 nt, Human
gcuggggaggggcacaggacccugcccucguguucccucccagcccgcaguauuucagggacag

SEQ ID NO: 428219 - RNA, 50 nt, Human
uggugggagaccacgccugacccucccaucuccccucuguacauagguca

SEQ ID NO: 428220 - RNA, 64 nt, Human
gggguggcucagagauaggacccugguuuuaaaucccucccagccuggugcuggugaugggccc

SEQ ID NO: 428221 - RNA, 64 nt, Human
gcccuggcucagcucccgcggccccgcccguccccccucccaggacuggucuguugucuuuuca

SEQ ID NO: 428222 - RNA, 64 nt, Human
ccugcauccccacacuucacagcaucuuccaucccccucccaccuucuaggcgaauagucccca

SEQ ID NO: 428223 - RNA, 64 nt, Human
ggauucccccucaccccaccucugcauggccacccccucccagcccuguggggaaacuguuccc

SEQ ID NO: 428224 - RNA, 64 nt, Human
cuugccccugaccccccugccgugccucccgcagcccucccaugccguuccacuccucccugcc

SEQ ID NO: 428225 - RNA, 64 nt, Human
aguugggagaagcccagccccucccccucgagaccccucccaugucccuuccuggccuggccgg

SEQ ID NO: 428226 - RNA, 64 nt, Human
auccugucccuccaccccacccuccaccucaauccccucccaucuuccccagaccuaccucacc

SEQ ID NO: 428227 - RNA, 64 nt, Human
uaaccucagagccaggagccuggggcuggggccucccucccaggcccuguuuagcuguuuagcu

SEQ ID NO: 428228 - RNA, 64 nt, Human
cccgaugggauggcuuggggggcuccagggggugcccucccagacccccuugcccaggccuccc

SEQ ID NO: 428229 - RNA, 64 nt, Human
gcaaacagcacaaggcgugagcccaccccgccugcccucccacccccuccccgggcagcagaga

SEQ ID NO: 428230 - RNA, 64 nt, Human
uaacugucaaugguuauggguccuauaaaaaugccccucccagauaaagcuucagcguuggccu

SEQ ID NO: 428231 - RNA, 64 nt, Human
ccgcggggcauccagcucggccccuuggccgccccccucccaggccccagcgucuucuccccag

SEQ ID NO: 428232 - RNA, 64 nt, Human
ccagugccucccucccuccuuccucuacucccaccccucccauguccccccauuccucaaaucc

SEQ ID NO: 428233 - RNA, 64 nt, Human
cuuccucuuuccccacagccccccagccccucagcccucccagcccacuucugccuguuuuaaa

SEQ ID NO: 428234 - RNA, 64 nt, Human
aggaagauucuuagguccucuucaauccagcagccccucccagaggugugaucagcaggaugcu

SEQ ID NO: 428235 - RNA, 64 nt, Human
gcaggcgagaugcccagaggugaucccugcccgccccucccaccucccuucccacacagcccau

SEQ ID NO: 428236 - RNA, 64 nt, Human
ccuuuuuccaccaacuucccaccccuguuucucccccucccagugcguucucucugugacucuc

SEQ ID NO: 428237 - RNA, 64 nt, Human
acagaagguuuauugguuccucuugggaaggguccccucccaccaccuguccagaagcugccuu

SEQ ID NO: 428238 - RNA, 64 nt, Human
caucacugggggcugcgcuagcugggcuggcauucccucccaaccugaacugcuccucagagcc

SEQ ID NO: 428239 - RNA, 64 nt, Human
ggguccaaaccugagugagggccagccaugccuccccucccauuccucuggucccugccuuggu

SEQ ID NO: 428240 - RNA, 64 nt, Human
gcgacaggaccgggacagcaggccccuugacagccccucccacaggaugugggcucugaggccu

SEQ ID NO: 428241 - RNA, 64 nt, Human
cccugaggcccugcugauccgcaccccauuccuccccucccauggccaaaaaccccacugucuc

SEQ ID NO: 428242 - RNA, 64 nt, Human
ccaggccagggauugcccaacacuccuagggcagcccucccagcgccccauggggucgcccaug

SEQ ID NO: 428243 - RNA, 64 nt, Human
cgcccgguggacgucagggacucggggggcaggccccucccaccuccugacacccuggccagcg

SEQ ID NO: 428244 - RNA, 64 nt, Human
ccaagaucuuuucccuuccccaggccccucggcucccucccagaucccacccccagccccacug

SEQ ID NO: 428245 - RNA, 64 nt, Human
ucuacauagucaccguccgcuuuuccugaguucucccucccaauuggcuccagcuuccuggggg

SEQ ID NO: 428246 - RNA, 52 nt, Human
aggagauugggcggauuugagccccucccagagauggcaauaaaacugacuc

SEQ ID NO: 428247 - RNA, 64 nt, Human
uaguuacaaagauuuuuuaaaaagcuacauaugccccucccaaaccgggaaccucaagaucucc

SEQ ID NO: 428248 - RNA, 64 nt, Human
cuaaagagccaugaguccuggaggaggagaggaccccucccaaaggacuggagacaaaacccuc

SEQ ID NO: 428249 - RNA, 64 nt, Human
uuuagggaagcuggagccaucucugcacuaacugcccucccaaauaucuugguucagacagcuc

SEQ ID NO: 428250 - RNA, 64 nt, Human
gccaugacaaacaccaggaugcaugcuccuuguccccucccacccgccucaugacccagccuca

SEQ ID NO: 428251 - RNA, 64 nt, Human
acauacagauaaagcacugaaaacaccacagugacccucccaccccccaccaauauguaauucu

SEQ ID NO: 428252 - RNA, 64 nt, Human
ccaucucggcucuuccaggcgucuccaccuacugcccucccaucuacacuugacuguagacugg

SEQ ID NO: 428253 - RNA, 64 nt, Human
gcauacaagggcucacaauuuggcuuuuuugggucccucccagcuuuagguuaugaagauuuua

SEQ ID NO: 428254 - RNA, 64 nt, Human
ccuuggcccugcgcaucauggacucucucagcuucccucccaggaucaguuucuacacaacucu

SEQ ID NO: 428255 - RNA, 64 nt, Human
uuguccaagaaggcuggacgagagaccuucuguccccucccagagggggaacccuggcacuggc

SEQ ID NO: 428256 - RNA, 64 nt, Human
gaccacagcaaccagcuccacggccugaugcagccccucccagccucucccgcuaggagagucc

SEQ ID NO: 428257 - RNA, 64 nt, Human
ucagcccuuugcugauuucaugauuucucacccucccucccauauguagggugugauucuguuu

SEQ ID NO: 428258 - RNA, 64 nt, Human
cagccugcacuggagucugaggccugggaccccccccucccacccccuaacccauguuucucau

SEQ ID NO: 428259 - RNA, 64 nt, Human
ccuggcaagcugggggcccaucgccguggggagucccucccaccacccucgccgcaggcagcug

SEQ ID NO: 428260 - RNA, 64 nt, Human
gccuggaauggcccagaccccagccuccccuccucccucccauccucacccaggccaaggccca

SEQ ID NO: 428261 - RNA, 64 nt, Human
uuugcccccacaagccuggucaucagccaggcagcccucccagugcccaagggccaccaacccc

SEQ ID NO: 428262 - RNA, 64 nt, Human
gggcucugagcuggauugauggggccagucuccccccucccaucuugaggucguucuccacauu

SEQ ID NO: 428263 - RNA, 64 nt, Human
uuauuuuuaguucaguuuaaaauguugauaccuucccucccaggcuccuuaccuuggucuuuuc

SEQ ID NO: 428264 - RNA, 64 nt, Human
gguggaauauuucauggacaaauuuuuuuuucuccccucccaaauuuaguuccucaucacaaaa

SEQ ID NO: 428265 - RNA, 64 nt, Human
gcaccucucccgcgccccagagccggaaauuucucccucccagaccccgcgcugcucuucuaac

SEQ ID NO: 428266 - RNA, 64 nt, Human
gagaagcuucucuagacuuggcuccaaacaucuccccucccaagacaucugccugcccacaggc

SEQ ID NO: 428267 - RNA, 64 nt, Human
caaauggguacaauguucccuuguggccaaauuucccucccagggagcaauuucagugcuagga

SEQ ID NO: 428268 - RNA, 64 nt, Human
gcuaaaagguaugaaguauuauguagggauacgucccucccauucugucccacagccaccaccu

SEQ ID NO: 428269 - RNA, 50 nt, Human
ucagccuccaggcuguuuagcccucccagauagcugccccugccacgcag

SEQ ID NO: 428270 - RNA, 64 nt, Human
caccaaaccuccucuugcacuuucccucuggcuucccucccagccuuccuugguuuggauguuu

SEQ ID NO: 428271 - RNA, 64 nt, Human
gucggaaaugaccagacacugaccauccacucuacccucccacccccuucucugcuccaccaca

SEQ ID NO: 428272 - RNA, 64 nt, Human
gccaccuccagccucugccagcaaugagcugucccccucccacccuacacaguagcuggucagg

SEQ ID NO: 428273 - RNA, 64 nt, Human
cuccgaggcugggccugagcugggugccccgucgcccucccaggccacuaggcucugacucuuc

SEQ ID NO: 428274 - RNA, 64 nt, Human
ucuggcuguggcucaagauuuggccccaugcagacccucccaaaggauacugccuucucaagau

SEQ ID NO: 428275 - RNA, 64 nt, Human
acccccaccuuguggcucugcacaccaaggagcccccucccagacaggaaggagaagaggcagg

SEQ ID NO: 428276 - RNA, 64 nt, Human
aagccuugcuuuuaacaccccugcaaaacccccacccucccaagauguucacaaaaggugagaa

SEQ ID NO: 428277 - RNA, 64 nt, Human
cauaauucuggggucaggccaggccuggguccugcccucccauggggugacucaugaccccucc

SEQ ID NO: 428278 - RNA, 64 nt, Human
ggauuucugucucugggacccucgcugcaccuaccccucccauugcaaagccaacuuggacugg

SEQ ID NO: 428279 - RNA, 64 nt, Human
ccggacagugccucacucaccugggacugguauccccucccaggguccaccaagggcuccugcu

SEQ ID NO: 428280 - RNA, 64 nt, Human
ggcggggggcgcagcaacgcaucguguggcccuccccucccaccucccuguguauaaauauuua

SEQ ID NO: 428281 - RNA, 64 nt, Human
cugauuuuuuagacuauuuaucuuccuucccuuccccucccaccccgcucuccucucugccccc

SEQ ID NO: 428282 - RNA, 64 nt, Human
cgugccaaauccugggcauccccagcccccuggccccucccacaucccccguguauucaggacc

SEQ ID NO: 428283 - RNA, 64 nt, Human
aggcagagcccaaucagggucucgugcugcccuucccucccacagccuggcagccauccagagg

SEQ ID NO: 428284 - RNA, 64 nt, Human
gcucugcaggaugaggaagacaggccaaucccuucccucccagaagcuggccgcccagcaggag

SEQ ID NO: 428285 - RNA, 64 nt, Human
cccugccgaggugugaccccaccugcucuuuccucccucccaguauggccccaccugcucuuuc

SEQ ID NO: 428286 - RNA, 64 nt, Human
gcggagguccugggcagccugucccugagccggccccucccaggggucugagauccaugaggug

SEQ ID NO: 428287 - RNA, 64 nt, Human
ggggagaggccuucccagggccacuccccuuacacccucccagaggccugagcaaccccucucu

SEQ ID NO: 428288 - RNA, 64 nt, Human
ucucugcguacguucgaguauacguugcccauaucccucccauauuuucuuuuugcugcuuuug

SEQ ID NO: 428289 - RNA, 64 nt, Human
gccgcuuagacaauguugcccagaguccuguuuacccucccaggguucauucuucccaagaacu

SEQ ID NO: 428290 - RNA, 64 nt, Human
ugguuaagaaguagaaaauuuaguuuagggaaagcccucccacaggugggaaauugcucucccc

SEQ ID NO: 428291 - RNA, 64 nt, Human
acagaggaccaccuccccauacagagagaggcuucccucccagccucaguuuacccguaaaugc

SEQ ID NO: 428292 - RNA, 64 nt, Human
ggggucugaggcccaggacccaccccccugccaccccucccaccccacucccugcucaguaccu

SEQ ID NO: 428293 - RNA, 64 nt, Human
agugaggccaagggguccuggccggguuggggagcccucccauaacccugucuugggcuccaac

SEQ ID NO: 428294 - RNA, 64 nt, Human
uggugggcuccacccacuagaugccaguggcacccccucccagagaugacaaacgaaaaugucu

SEQ ID NO: 428295 - RNA, 64 nt, Human
ccccagcugacccuaauuuauucucagcaccacccccucccaggucauugugucuguuuccgag

SEQ ID NO: 428296 - RNA, 64 nt, Human
cccaucugcacccccaucauagguagagaccccacccucccaucgguccuacauggggcugugc

SEQ ID NO: 428297 - RNA, 64 nt, Human
cugcugauggaguccucgcugcucaugcccacagcccucccagagugcuaugcgaguggcugcc

SEQ ID NO: 428298 - RNA, 64 nt, Human
cggcccagucugcacggcccaucugcuucaccuucccucccagccacgugccaguggccacagc

SEQ ID NO: 428299 - RNA, 64 nt, Human
cuguucccugggggccagccagggcccuuugugccccucccagcacaggccugaugcagguguc

SEQ ID NO: 428300 - RNA, 64 nt, Human
aucugagguggcccugcagccccccaccuucuggcccucccaccagaggcccagcuaccaaggc

SEQ ID NO: 428301 - RNA, 64 nt, Human
gcaguacaucuugugcaugcaaaaaugaauucaccccucccaccucuuucuucaauuaauggaa

SEQ ID NO: 428302 - RNA, 64 nt, Human
gcaugguggggccccugaccaaccuacacaaguucccucccacaaguggacaucagugucuucu

SEQ ID NO: 428303 - RNA, 64 nt, Human
aacucuuacgcucugguucagcugccucugcacccccucccacccccagcacacacacaaguug

SEQ ID NO: 428304 - RNA, 64 nt, Human
cguagcgcucauggugcggcaggcucguggccuccccucccagaagcgccucuuccccuggaag

SEQ ID NO: 428305 - RNA, 64 nt, Human
agcagcccucagcacccccucccuccccaccuggcccucccaggacagcucucgccccccacaa

SEQ ID NO: 428306 - RNA, 64 nt, Human
gggacccggggaagguuugagggcccuugcaacccccucccagcaguggcugggcacucuuugc

SEQ ID NO: 428307 - RNA, 64 nt, Human
ucugucugcucuguugucuguucuuucccugacucccucccaccgaaggccugauggcuacuca

SEQ ID NO: 428308 - RNA, 64 nt, Human
aaacugcucuuauugugccaauaugcccuccaaacccucccaggauucaaagcuagguuuggcu

SEQ ID NO: 428309 - RNA, 64 nt, Human
uuugauucucuaaggagcacgaaagggggaaugccccucccaggaguuuaugggagaagggacu

SEQ ID NO: 428310 - RNA, 64 nt, Human
gcuggccaugugagcaccccaugaagggaccgcccccucccaaggauggucccuuugggugcag

SEQ ID NO: 428311 - RNA, 64 nt, Human
uaaccgucuguccuagccccucccuaaucccuggcccucccagcugucugggacuucaguggac

SEQ ID NO: 428312 - RNA, 64 nt, Human
uuugaggcuuucuguugccauggugaugguguagcccucccacuuugcuguuccuuacuuuacu

SEQ ID NO: 428313 - RNA, 64 nt, Human
gucccgcuguuuccugugcauucgugacccgcuucccucccacccugucuccugucuccaucgu

SEQ ID NO: 428314 - RNA, 64 nt, Human
ggagcucagcguccgcuacucagcccagccaaaacccucccagacgucuccucuccugccuggg

SEQ ID NO: 428315 - RNA, 64 nt, Human
auauggaguagcugaucagcccacacuugccccgcccucccacaccugcuugggaggccagaga

SEQ ID NO: 428316 - RNA, 64 nt, Human
uucaguaaggcuggagcugcgagccaguuugcugcccucccagauccuguguccauucugaaga

SEQ ID NO: 428317 - RNA, 64 nt, Human
accaguuuuauggcuuuauuacaaacugcugggucccucccauuuucaacuugauugaugggau

SEQ ID NO: 428318 - RNA, 64 nt, Human
cuacugcccccauucauccuggcuuuccacagcccccucccacacaguuggacccgugauucuc

SEQ ID NO: 428319 - RNA, 64 nt, Human
ucuaugauauucugggaccucagugauuuugguccccucccacuucucuaguucgucauccucc

SEQ ID NO: 428320 - RNA, 64 nt, Human
agucugacagccagagcguuagaggggccagcggcccucccaggcgaucuugugucuacucuag

SEQ ID NO: 428321 - RNA, 64 nt, Human
guggugcugcugcugauccggggaccgcugucuucccucccauacgccuuucaucccuccuucu

SEQ ID NO: 428322 - RNA, 64 nt, Human
ggggagacccugcuucuaucuuggcugccaucaucccucccagccuauuucugcuccucucuuc

SEQ ID NO: 428323 - RNA, 64 nt, Human
cagcguggacccuggugucuauggugaagcugggcccucccacccugagccuuccuagacccuu

SEQ ID NO: 428324 - RNA, 64 nt, Human
agagccucugccgggggugggaugccaggacacccccucccacacucaggacagagccaacccu

SEQ ID NO: 428325 - RNA, 64 nt, Human
gcacccuuggccugaguaaacuuggaaaggggcucccucccagagaagggacuacucucuucac

SEQ ID NO: 428326 - RNA, 64 nt, Human
gugccagggggcucagcugcuucagggaaugugucccucccaccaugggccagagcuucagccc

SEQ ID NO: 428327 - RNA, 64 nt, Human
aagaccacagacgggcacacagacuggagaaaaccccucccacggugcccaaacaccagucacc

SEQ ID NO: 428328 - RNA, 64 nt, Human
uuugggggggggcggacaggagaugggugcaacucccucccauccuacucucacagaagggccu

SEQ ID NO: 428329 - RNA, 64 nt, Human
gcagcgagggggcccagcuggcgagacuguagcccccucccacucccacacucacucuugcaga

SEQ ID NO: 428330 - RNA, 64 nt, Human
uggcuagagugggaagagggggcuggccauggggcccucccagaaccucagcauuuccuuccag

SEQ ID NO: 428331 - RNA, 64 nt, Human
ggcggccugcagacccugccaggggguuugaggacccucccagguuucccacugcggaacagga

SEQ ID NO: 428332 - RNA, 64 nt, Human
agcugaccaguguccacuccucauccugacuccacccucccacuccuuggauuucuccuggagc

SEQ ID NO: 428333 - RNA, 64 nt, Human
uacagacuggcugggccccacccccugcguguggcccucccacaguauuuugugcaaugaagcc

SEQ ID NO: 428334 - RNA, 64 nt, Human
auagcuuaaaacaaagaauauacauucuuuucaccccucccagucuacccauccagccuucaug

SEQ ID NO: 428335 - RNA, 64 nt, Human
aucuucuccaggaugucaacugaccuaaaauuugcccucccaucccguuuagaguuauuuaggc

SEQ ID NO: 428336 - RNA, 64 nt, Human
ucuccuuucuuuuucuucuucccucccuaucuaacccucccauggcaccuucagacuuugcuuc

SEQ ID NO: 428337 - RNA, 64 nt, Human
cauccaggagaaaaaggcaggagcagcaagugaccccucccaagcucccaucuauggggcuuag

SEQ ID NO: 428338 - RNA, 64 nt, Human
ccaacucagagcacagccaaucuccaggcucccucccucccagauccaggaacacaugcacaca

SEQ ID NO: 428339 - RNA, 64 nt, Human
uuuacaaauuuuccccuuucccuuuaccuccuuucccucccaucuucuuucauuaaccccuccu

SEQ ID NO: 428340 - RNA, 64 nt, Human
acaaaucuuacaguccaaggcauuaaccucaaggcccucccagcaccccauucuuguauacaca

SEQ ID NO: 428341 - RNA, 64 nt, Human
gguaaauguugaaaaaagaagcaugccuccuucucccucccacccaccucaagcaguugaacac

SEQ ID NO: 428342 - RNA, 64 nt, Human
caaacuccugaccucaagagauccacucgccuugcccucccaaagugcugggauuacaggcuug

SEQ ID NO: 428343 - RNA, 64 nt, Human
aagucaaaacuauagccauauccaaaucuuuucccccucccaagaguucucagugucuacaugu

SEQ ID NO: 428344 - RNA, 64 nt, Human
ugcuucccuguccccgcccccucuguggcauugucccucccacucuuauuuuucuaccaauugc

SEQ ID NO: 428345 - RNA, 64 nt, Human
uguagugguagcgacuuuccugcuaugcaggaaucccucccaugacguguauguuuuacaugau

SEQ ID NO: 428346 - RNA, 64 nt, Human
cgccgucucauccucaucugagcggggcuccucgcccucccacuccgccaccuccguccacacc

SEQ ID NO: 428347 - RNA, 64 nt, Human
cuccccucagcccccuugcaaguucauggccugucccucccagaccccugcuccacuggcccuu

SEQ ID NO: 428348 - RNA, 64 nt, Human
uggaggguggcgcccugcguaacccucgcccugucccucccacucccugggggcgcuguuccac

SEQ ID NO: 428349 - RNA, 64 nt, Human
cccccaccaacucucgcguguuggagagaaggggcccucccagcacaaaguugcauuccucccc

SEQ ID NO: 428350 - RNA, 64 nt, Human
guggccugagggcugucgagugagcugccccagccccucccagcccuugcccagccugggggag

SEQ ID NO: 428351 - RNA, 64 nt, Human
ccugccuccaugauucaguuaccucccacugggucccucccacaacguguggcaauugugggag

SEQ ID NO: 428352 - RNA, 64 nt, Human
ugauucuuaugauugauuucucaaacuagcuuuucccucccaaguccaggacccauuaauuucc

SEQ ID NO: 428353 - RNA, 64 nt, Human
auuuuugauaccaaacaugaauuuucaguucccucccucccagccccccaauuuccugcgggcg

SEQ ID NO: 428354 - RNA, 64 nt, Human
gaccagucaggaugaggccccgccuuuucccccacccucccaugagacugcccugcccagguau

SEQ ID NO: 428355 - RNA, 64 nt, Human
guugcccaugucugauugggggcucuagccccuucccucccagcucagucaauacuugaacucc

SEQ ID NO: 428356 - RNA, 64 nt, Human
cagccccagcaccaccaggucucccgggaagccacccucccagcucugaggacugcaccauugc

SEQ ID NO: 428357 - RNA, 64 nt, Human
accaucuccugaguuuugguuuguaaucuuuugucccucccacccccacagaagauuucuaagu

SEQ ID NO: 428358 - RNA, 64 nt, Human
uaacuaauucuguggcuguugugagucuucagcacccucccauguaccuuauaucccucucuga

SEQ ID NO: 428359 - RNA, 64 nt, Human
auguggcucgcagaugcauccugcaucccagucccccucccagcacccccagccauccccccug

SEQ ID NO: 428360 - RNA, 64 nt, Human
gaggggagggugcugggccugacauggcuauauacccucccaggaguaaaagccaagcaagagg

SEQ ID NO: 428361 - RNA, 64 nt, Human
ccucaaggugccuggcuggggccucugcaccccacccucccaccugcccaccuggcccugccuu

SEQ ID NO: 428362 - RNA, 64 nt, Human
ggagggaaggcggagcugaggacagccagcuccgcccucccaaggcugugcguuccugagggcc

SEQ ID NO: 428363 - RNA, 64 nt, Human
ccccccugcuucaggaacacccgccagggcccaccccucccaccccgucccagcauucgcacuu

SEQ ID NO: 428364 - RNA, 64 nt, Human
cugcuauaagaaaagcagacgcagcagcugggaccccucccaaccucaaugcccugccauuaaa

SEQ ID NO: 428365 - RNA, 64 nt, Human
cgaccagggugagaauaaagacgucuccucaggacccucccaggagaguacauggcauugagac

SEQ ID NO: 428366 - RNA, 64 nt, Human
gccuugggcugcuaugggggauggcaccucucagcccucccaggaaacacacagagcucugggc

SEQ ID NO: 428367 - RNA, 64 nt, Human
cccgcggcgccgccuccucccuggucccucgaaaucguggcaucucacuucugagaacgaaauc

SEQ ID NO: 428368 - RNA, 64 nt, Human
ggucacacacgcgcccgguggagcacgagagaccucguggcagcaugugaucuggaaggcaggc

SEQ ID NO: 428369 - RNA, 64 nt, Human
gccggggcuugucuuauguuuccaucuguuuucuucguggcauucaauuucauuuuuuuccuuu

SEQ ID NO: 428370 - RNA, 64 nt, Human
cuuuaacaagcuauucuguuuugugucaauugguucguggcaggaagcuauuagaagucaaacg

SEQ ID NO: 428371 - RNA, 64 nt, Human
uggggaggugacuugcaugguggggacaaggcugucguggcaaccuugggaucgaguuugagac

SEQ ID NO: 428372 - RNA, 64 nt, Human
ccccugcccugcugccgccucccagccuggggggucguggcagauaaucagccucuuaaagcug

SEQ ID NO: 428373 - RNA, 64 nt, Human
guuuuugaaguguugaagcugugcuccccuuaaaucguggcaggagagauuaagguaauuacaa

SEQ ID NO: 428374 - RNA, 64 nt, Human
uaaugugaagguuuguaaauaguccaugaugaugucguggcagagucugauuucuauauagagg

SEQ ID NO: 428375 - RNA, 64 nt, Human
caccaccagguggauguggagcaggagagcuggaucguggcauuuguuucuggguucugcagcu

SEQ ID NO: 428376 - RNA, 64 nt, Human
gucucugcccaccagaugccagcacucccaccauucguggcaaccaaggaugucuccagacacu

SEQ ID NO: 428377 - RNA, 64 nt, Human
augggcuucugugagacuuaucacacauaguguaucguggcaugaagcccggcacauagcaggc

SEQ ID NO: 428378 - RNA, 64 nt, Human
gccguagauauacuuuagguuaguauuucuacauucguggcaagcauuuugguaacaccagugg

SEQ ID NO: 428379 - RNA, 64 nt, Human
uuaaacaggaaauuaaacacugcaaaaggaguguucguggcaguguuccucugaccccugaccu

SEQ ID NO: 428380 - RNA, 64 nt, Human
uuuacuguauauuuaaaauuauaaauuaauguuuucguggcauguaaauuuuuaugguacagau

SEQ ID NO: 428381 - RNA, 64 nt, Human
aacagcugaucagaggacucuaucuaaauugugaucguggcagauagagauggagucauguacu

SEQ ID NO: 428382 - RNA, 64 nt, Human
agaggguagguaccagaagacccagaaacucuuaucguggcacuguugcagcuuccucugcccu

SEQ ID NO: 428383 - RNA, 64 nt, Human
ggaagauggcuuauugguuuuaaccagauugucaucguggcacugucugugaagacggauucaa

SEQ ID NO: 428384 - RNA, 64 nt, Human
aagugaaugucagccuaagaggccaagcugcagaucguggcaacagaugagcucuguuaaccuc

SEQ ID NO: 428385 - RNA, 64 nt, Human
cuaaacaggacacaggggucugauuugaagccccucguggcagggcguuuucuguccuguggug

SEQ ID NO: 428386 - RNA, 64 nt, Human
acuuauuuucaaaggaacacugagcaauaaaguaucguggcauuuaugcaaaaaaaaaaguuaa

SEQ ID NO: 428387 - RNA, 64 nt, Human
aggcccaggucccgaaagaugcagugacuuuuugucguggcagccaguggugacuggauugacc

SEQ ID NO: 428388 - RNA, 64 nt, Human
uuaguaacacggacaaggcuccucgccaaggaacucguggcagaagagggcagcaguuggcagu

SEQ ID NO: 428389 - RNA, 64 nt, Human
caguuaccugcacaccgagucacggacuccugcaucguggcacuccucucgcaugguguggagg

SEQ ID NO: 428390 - RNA, 64 nt, Human
caucucuacuaaaauuacaaaaauuagccgggugucguggcacacaccuguaaucccagcuauu

SEQ ID NO: 428391 - RNA, 64 nt, Human
ucaacaaauugggcaaugcuugugugauucacaaucguggcauuuaaagugcacaaaguacaaa

SEQ ID NO: 428392 - RNA, 64 nt, Human
gaaccugggagguggagguuucagugagcugagaucguggcauugcacucuagccugggcaacc

SEQ ID NO: 428393 - RNA, 64 nt, Human
ucggguggcaccucgcuggccaggcucucccgagucguggcaccuccacaaugugaauuuucug

SEQ ID NO: 428394 - RNA, 64 nt, Human
uuaauuuucuuaguaaaaagaauaacagaaugcaucguggcaauccuuaagcaacauuaucuau

SEQ ID NO: 428395 - RNA, 64 nt, Human
gcccagggcaguggcuuuccugaggcagcagccuucguggcaagaacuagcgugagcccagcca

SEQ ID NO: 428396 - RNA, 64 nt, Human
gccccagcugcucuucuagggaccuauggggccuucguggcaucucugugcugugugcugggga

SEQ ID NO: 428397 - RNA, 64 nt, Human
agcauacaggaggaucaaaggaggugacggagcaucguggcacggcagucucaaugggucagaa

SEQ ID NO: 428398 - RNA, 64 nt, Human
gcagagaugaggcgggugguggacagcugggcugucguggcagggucugcacagggccaugucc

SEQ ID NO: 428399 - RNA, 64 nt, Human
guaggccaaccaagcacuucaugaagaggaggccucguggcauauucaguuuacaccugaaaua

SEQ ID NO: 428400 - RNA, 64 nt, Human
ggggcuggggcaggaggcuccuggagcgcuggauucguggcacagucugaggcccugagaggga

SEQ ID NO: 428401 - RNA, 64 nt, Human
caaugguggucuuggcaacagaaugcucagccccucguggcaggacuugacaagggcaagcuug

SEQ ID NO: 428402 - RNA, 64 nt, Human
auuccgugggucccugugacauauugcauuaagaucguggcacuugcuuuuuugucuuucacau

SEQ ID NO: 428403 - RNA, 64 nt, Human
ccgggagcccgccccgcuucccccagagacuguaucguggcaccguggcgcguggcgcuggagc

SEQ ID NO: 428404 - RNA, 64 nt, Human
ggcagcugagaaugcccagaaagugccagaagcaucguggcauuuccagaaccauggauucugc

SEQ ID NO: 428405 - RNA, 64 nt, Human
uuugcacucugucccucaacacuagaaaugcugcucguggcacaaucuaagucauuacccgaag

SEQ ID NO: 428406 - RNA, 64 nt, Human
ccacguuaauaaagccaaaagcagcgggugcuauucguggcaacacacuucacugaacccacuu

SEQ ID NO: 428407 - RNA, 64 nt, Human
uuaccuauggaagugguucuauguccauucucauucguggcauguuuugauuuguagcacugag

SEQ ID NO: 428408 - RNA, 64 nt, Human
auuggucucaaagauucagucacagcuguuguuuucguggcauuuggcaccucugucccaggug

SEQ ID NO: 428409 - RNA, 64 nt, Human
uauuauaauauugaucaguuuuaugccgcauuguucguggcaguagaccacaucuguucgucug

SEQ ID NO: 428410 - RNA, 64 nt, Human
ggacagugugggugggagaccagggcuuugcaauucguggcauccuuuaggauaagagggcugc

SEQ ID NO: 428411 - RNA, 64 nt, Human
ucgcggggauuguggggggcaguagcuggcuguuucguggcauuucuguggcucugcaguguuc

SEQ ID NO: 428412 - RNA, 64 nt, Human
acuguuccagcccaggccaagcacagggucuggcucguggcaaaccuugaauaaauauuuguug

SEQ ID NO: 428413 - RNA, 64 nt, Human
ccuggggcgcaacuggacaugccacuccccggccucguggcagugauggccccugcagaggcag

SEQ ID NO: 428414 - RNA, 64 nt, Human
ccucuucccugucuacugcucaggcucucccacuucguggcauccauguaaaguagguggcagg

SEQ ID NO: 428415 - RNA, 64 nt, Human
ccauuggauucacugucaguggagauacuaccucucguggcaaccauagagaucgagcuucagg

SEQ ID NO: 428416 - RNA, 64 nt, Human
ccugagaugcaggugaugccauuacagaaccaaaucguggcacguauugcugugucuccucuca

SEQ ID NO: 428417 - RNA, 64 nt, Human
ccacugaugcagcuuagaaccacaccccugagagucguggcaaaccuuucacaaccuggaaaau

SEQ ID NO: 428418 - RNA, 64 nt, Human
aggggugcacaguccacagcugaagagcaagguuucguggcagcacggcccggccccucacccu

SEQ ID NO: 428419 - RNA, 64 nt, Human
ugaguggcgacugccuccaccucauucccgugacucguggcaugcgcaggugcuggagcuuggc

SEQ ID NO: 428420 - RNA, 64 nt, Human
caacagucugagcaagagaccugcagccccuguuucguggcagacagcaggugccuggcgguga

SEQ ID NO: 428421 - RNA, 64 nt, Human
cagagguagacaggucaccuuacuaccuccucccucguggcagggcucaaacugaaagagugug

SEQ ID NO: 428422 - RNA, 64 nt, Human
uugaguguuacucguuacuguugaggucagugcuucguggcaaauggcuguacuggauauccca

SEQ ID NO: 428423 - RNA, 62 nt, Human
cuccaaucgaagacuauuaaaagaaguggcugucguggcaagguagaccacaaugcuggauc

SEQ ID NO: 428424 - RNA, 64 nt, Human
gguuuuuccucugugacugggccgucuuggugucucguggcacgcgucacaguggugcuagucu

SEQ ID NO: 428425 - RNA, 64 nt, Human
ccgcuacugaguacuuggaauccuguguccugucucguggcaacaaggcuauguucuguuagga

SEQ ID NO: 428426 - RNA, 64 nt, Human
cuuucaugccuacacaccccucauuaaagcagagucguggcaucucacccagggugucugugug

SEQ ID NO: 428427 - RNA, 64 nt, Human
gaggacaucucggucguuugaggggcauggccagucguggcaggccggccuucagcguccgguc

SEQ ID NO: 428428 - RNA, 64 nt, Human
acaucccagugggcucugacccccugaucucaacucguggcacuaacuuggaaaaggguugauu

SEQ ID NO: 428429 - RNA, 64 nt, Human
uguagccauuucagcugucuuuugauuaauguuuucguggcacacauauuuccauccuuuuaug

SEQ ID NO: 428430 - RNA, 64 nt, Human
uggaauaagcuggacgucggcgcaaucuugcucuucguggcagggcugaccugcaggugagugg

SEQ ID NO: 428431 - RNA, 64 nt, Human
cgccuccuccgccuccuccacgagagaaggacagucguggcagccgggggccguggccacauua

SEQ ID NO: 428432 - RNA, 64 nt, Human
aggauacguggcuuuaguaagcagaccaagcgcuucguggcagggaaagcagcgugcggggaag

SEQ ID NO: 428433 - RNA, 64 nt, Human
ccucccgccgccacugcccaaccuuuccugauaaucguggcaugcgcccuuuccucuucccugc

SEQ ID NO: 428434 - RNA, 64 nt, Human
uuggaauuuucugggcccaguucccacgugccuuucguggcagucuaaccucaggccauucucu

SEQ ID NO: 428435 - RNA, 64 nt, Human
ugugcauggcauggagaaugcagaggugagccugucguggcaggacugcaccaguguauccaca

SEQ ID NO: 428436 - RNA, 64 nt, Human
ugagauuuuaggggaauucuaauguuguacccuuucguggcagcuuugacuguuggcauagcca

SEQ ID NO: 428437 - RNA, 62 nt, Human
guagcucaccccggucacgcaugaaggcaaaagcaggucagaagcgaauacucugccauuau

SEQ ID NO: 428438 - RNA, 62 nt, Human
ugccucaccucccgcaggccgccacacuuauugcaggucagugauccuuuggaguuugaauu

SEQ ID NO: 428439 - RNA, 62 nt, Human
ggaccaaccuucagcucuggaaccuucauaaagcaggucagcguggccugauugucccagga

SEQ ID NO: 428440 - RNA, 62 nt, Human
auauaccucaggcugaaauuuggggugggauagcaggucaguugaucuucugcaggaaggug

SEQ ID NO: 428441 - RNA, 62 nt, Human
uuucuaccagggcaccagaucccuuccauggagcaggucaucucggguucacugggccaggg

SEQ ID NO: 428442 - RNA, 62 nt, Human
aaagugauuuuuaugcucgcacuauaaauauggcaggucaguucauucuuuugggaagucag

SEQ ID NO: 428443 - RNA, 62 nt, Human
auuggucuuuuauccuggcucugaaugacccugcaggucaucaugguuuucuuuuuuuauug

SEQ ID NO: 428444 - RNA, 62 nt, Human
gugccagcccucacccauacaccuccagggcugcaggucauuagccagaauaaaggaugucc

SEQ ID NO: 428445 - RNA, 62 nt, Human
agcugccuaguaggcugaagcuucaggacucugcaggucaaggauaugugaugagcaccggc

SEQ ID NO: 428446 - RNA, 62 nt, Human
ggaggccucugguuggcucucucaggaagagggcaggucagggauugggcgguguaaauuga

SEQ ID NO: 428447 - RNA, 62 nt, Human
cugccccuccaaguuggggacggagauggggagcaggucaggcccucccuaggccuguuugu

SEQ ID NO: 428448 - RNA, 62 nt, Human
ccauucaguguuuccugggccucugcucagaggcaggucaccacugggcccuguggaucaau

SEQ ID NO: 428449 - RNA, 62 nt, Human
gcuccaccaauugagucucucccaccaugcaugcaggucacugugugugugcaugugugccu

SEQ ID NO: 428450 - RNA, 62 nt, Human
ugcuuuauuaggugacuuccuuuuaggcgauggcaggucaugaaauagguacacuaauaauu

SEQ ID NO: 428451 - RNA, 62 nt, Human
cagguccagucacugcaaaagugaccaagccagcaggucacccuuaacuucagaaacaauua

SEQ ID NO: 428452 - RNA, 62 nt, Human
auguggcaacacuguuuugugauuuuauuugugcaggucaugcacacaguuuugauaaaggg

SEQ ID NO: 428453 - RNA, 62 nt, Human
cuggagucuggaguguggagccccacagucuugcaggucacaugcucuccuugcacaucugg

SEQ ID NO: 428454 - RNA, 62 nt, Human
ugaaccaaguggcagccccaggggccugcccugcaggucacagcuaaacaagucuggcagaa

SEQ ID NO: 428455 - RNA, 62 nt, Human
ggcuucccuuucuugaggaccuuguguuccuggcaggucacuugcuugugguguuuucguuu

SEQ ID NO: 428456 - RNA, 62 nt, Human
aacaauuugucuuucuguucgcugaauauauugcaggucaugcucccaugccccccuuucua

SEQ ID NO: 428457 - RNA, 62 nt, Human
gugugucagaaccaacgaguguaauggagagggcaggucaucucuuauuguuucuaaaacaa

SEQ ID NO: 428458 - RNA, 62 nt, Human
cugcaaccuucccuagcccccucaauagaugagcaggucaggcuguggcccuuaccucaccc

SEQ ID NO: 428459 - RNA, 62 nt, Human
gaugacuuauaugagggcagauucaagagccagcaggucaaaaaggccaacacaaccauaag

SEQ ID NO: 428460 - RNA, 62 nt, Human
uccaaggucccauuuucccccuguguuuucacgcaggucauauugucaguccuacaaaaaua

SEQ ID NO: 428461 - RNA, 62 nt, Human
gucuggacacugccacauggagccacugucaugcaggucauaucagaucugagugccccaca

SEQ ID NO: 428462 - RNA, 62 nt, Human
gaugcuuagggaaagacccugcucaggacccagcaggucagcaccccagagcagacugauag

SEQ ID NO: 428463 - RNA, 62 nt, Human
gucaaggguagaaguuaaaggagaaucugaaggcaggucagggaaaagaagaacuggaaaug

SEQ ID NO: 428464 - RNA, 62 nt, Human
ggagaaggaacaaggcuauuugaaaacagaaggcaggucaaggguagaaguuaaaggagaau

SEQ ID NO: 428465 - RNA, 62 nt, Human
uauccuguucuguaagaucagauguuuuuauugcaggucaauauaauacugccagagacaga

SEQ ID NO: 428466 - RNA, 62 nt, Human
ggccuggcagggggugaaggcaggaguugggggcaggucaggaccaggacccagggagaggc

SEQ ID NO: 428467 - RNA, 62 nt, Human
uagacauuuaucaaagaaguuaaaaugguguggcaggucauuaggauuaggcagaaucucuc

SEQ ID NO: 428468 - RNA, 62 nt, Human
auaagacccauaggcaaacuucgagcccaucagcaggucaacccuaugcugggaaagugagg

SEQ ID NO: 428469 - RNA, 62 nt, Human
ccccaacaguugguugucuugucuuccagggugcaggucacugagugacuuccccagggugc

SEQ ID NO: 428470 - RNA, 62 nt, Human
uccauccccuuacuuucugccauggaguuccagcaggucacucucccuggcacaccuuccag

SEQ ID NO: 428471 - RNA, 62 nt, Human
uuauuuagauacuuucuuccuucacucacccagcaggucaguuuucugugcaaacaaaccug

SEQ ID NO: 428472 - RNA, 62 nt, Human
gaugaaaauaggaagugcccuggagggggccagcaggucacggggcagaaucucucagguug

SEQ ID NO: 428473 - RNA, 62 nt, Human
auuauguauugguggggcuggguaccaaugcugcaggucaacagcuaugcugguaggcuccu

SEQ ID NO: 428474 - RNA, 62 nt, Human
ucacgauaaaaguuaaacaaagaaagcuguaugcaggucauauaugcaugagaauucaacua

SEQ ID NO: 428475 - RNA, 62 nt, Human
guaaauccuugccgccugcugaaacauggugugcaggucaacggagaauacuagcugcuccu

SEQ ID NO: 428476 - RNA, 62 nt, Human
ucuuccucuguuacauccugcuacacucauccgcaggucaccuuaguucaccuacccugagu

SEQ ID NO: 428477 - RNA, 62 nt, Human
gguaaacuaaccugguauuuuaagagaaaacugcaggucaguuuggaaugaagaaauugugg

SEQ ID NO: 428478 - RNA, 62 nt, Human
agacccuuaauugauagaccauaccagguucugcaggucagcaucauuguguaaugagagug

SEQ ID NO: 428479 - RNA, 62 nt, Human
cugggggaucaccagccccaaggucccgaagggcaggucagagggagagaggcuggagaccu

SEQ ID NO: 428480 - RNA, 62 nt, Human
ucgcggaucacaccacacugggcacgugguuugcaggucaaaggggcguuuuaaagcagcug

SEQ ID NO: 428481 - RNA, 62 nt, Human
ccggagugaccuggacguggccagaucuucucgcaggucacaagaagccagugagcccuugc

SEQ ID NO: 428482 - RNA, 62 nt, Human
gaguguucccacuggagucucugguagaauuagcaggucaugcugucaaaaucauggacaaa

SEQ ID NO: 428483 - RNA, 62 nt, Human
ugacuguccugcucacccacagccgaucugcugcaggucagcaacugugucgugagcagcug

SEQ ID NO: 428484 - RNA, 62 nt, Human
gcagggccugcugguguguuggagccugcagggcaggucaggcugguucagaggcccaugcu

SEQ ID NO: 428485 - RNA, 62 nt, Human
agaugcauauaaaggguggaaugggagccauggcaggucauagaguccucucaaugggaacc

SEQ ID NO: 428486 - RNA, 62 nt, Human
gggaaggccccuacuuuugcacuucuccaagugcaggucacaccaggggcagacccugucgc

SEQ ID NO: 428487 - RNA, 62 nt, Human
ccacccuccccuuaaacccucugccuuugaaagcaggucauguucacugcgaugcuggacac

SEQ ID NO: 428488 - RNA, 62 nt, Human
auuucaguuuuauaacagacuuuaccuuccuggcaggucauuguaguuaauuaugucucuag

SEQ ID NO: 428489 - RNA, 62 nt, Human
guuuucuguuuaaaucauuguauaaaguaauugcaggucagaauuauaccacagaacuguuu

SEQ ID NO: 428490 - RNA, 62 nt, Human
acuauguugaugauucauaucaaauucucaaugcaggucauuacuguaaguuuuccauuuuu

SEQ ID NO: 428491 - RNA, 62 nt, Human
aauugguggagagaagcucugaggcacgucaugcaggucaagaaagcuuucuuugcaguagc

SEQ ID NO: 428492 - RNA, 62 nt, Human
cgugugguggcuccaagccaagcaccuggcaugcaggucagcccuucccagcgggcguggcg

SEQ ID NO: 428493 - RNA, 62 nt, Human
cuauaucuugguagauguauuucaucccuagagcaggucagccuccuuccccuaaugcgaau

SEQ ID NO: 428494 - RNA, 62 nt, Human
agcccaaagccugaggacagaaagacccugaugcaggucagcccauggaggcagaugcccuu

SEQ ID NO: 428495 - RNA, 62 nt, Human
auuugggguaagaggaagugagaucuccgcuugcaggucagccccugccuugcagggcgggc

SEQ ID NO: 428496 - RNA, 62 nt, Human
uucugaugcaucguuuucuuugcugugccaaagcaggucagaagagggagaggaggggcugg

SEQ ID NO: 428497 - RNA, 62 nt, Human
uacaggaucuucaguuauucgaggggaaugaggcaggucaagccgaugcuagccacuaguuu

SEQ ID NO: 428498 - RNA, 62 nt, Human
ccucacucaacacuuugaauacuuauuguuuggcaggucauccacacacuucugcccccacu

SEQ ID NO: 428499 - RNA, 62 nt, Human
uugcguggggcauguaggugggggaggcgucugcaggucaccuggggggcccagcccucucc

SEQ ID NO: 428500 - RNA, 62 nt, Human
agccagcaaggggccgugccagugcccagagagcaggucagacaacaggcaacccugaggca

SEQ ID NO: 428501 - RNA, 62 nt, Human
gagguggcucgacugcucaaccucaccgagaggcaggucaagaucugguuccagaaccgcag

SEQ ID NO: 428502 - RNA, 62 nt, Human
ugcugggcaugcuucguagagggccaggagcagcaggucaugugcacaugccguugcagcac

SEQ ID NO: 428503 - RNA, 62 nt, Human
auuuaagccuacuccugacuaacuuggcauuugcaggucaagcaggaagcaguugacaagac

SEQ ID NO: 428504 - RNA, 62 nt, Human
uccuccuuccagaugcccgagcaccgugucgggcaggucagcgcgguccugacuccgucaag

SEQ ID NO: 428505 - RNA, 62 nt, Human
auccacuucaucaccuaugaguuccugcaggagcaggucaacccccaccggaccuacaaccc

SEQ ID NO: 428506 - RNA, 62 nt, Human
gcgugcacaucugcuguggucugaagugguuugcaggucagccuccucucccuaguguagag

SEQ ID NO: 428507 - RNA, 62 nt, Human
agccaagcccagaggcaguggcuggggucccugcaggucaugaggggccuaugccuuuacuc

SEQ ID NO: 428508 - RNA, 62 nt, Human
uacaugcgucaagauuuguagcaguaauaacugcaggucacuuguauguaauggaugugagg

SEQ ID NO: 428509 - RNA, 62 nt, Human
uguuuauguaacauaguccagagaacugacaugcaggucaaaagucagauacgcaaccuccu

SEQ ID NO: 428510 - RNA, 62 nt, Human
gucucuccacccugcaggggcccagacugccugcaggucaggcacaggggcaucuaccuaga

SEQ ID NO: 428511 - RNA, 62 nt, Human
ggguuaggugacuaaaagggcuucggccacaggcaggucacagaaaggcagguuucauuucu

SEQ ID NO: 428512 - RNA, 62 nt, Human
auuaaaccugcuuggcuguguuuauccgcagggcaggucacagauaggguuggcugugccac

SEQ ID NO: 428513 - RNA, 62 nt, Human
gacuuggccccuccaccugucccuaacggacggcaggucaggaaagccaggacucaggggag

SEQ ID NO: 428514 - RNA, 62 nt, Human
cuugcucaggcucagagggaccucaccccugagcaggucaggacucagaacagucuggcguc

SEQ ID NO: 428515 - RNA, 62 nt, Human
acugccccgguacgagggggcccaagacccuggcaggucaggggcccuggccaagccagauc

SEQ ID NO: 428516 - RNA, 62 nt, Human
auccuggcaagaaagcuugagucucaaggguggcaggucacugucacugccgacaucccucc

SEQ ID NO: 428517 - RNA, 62 nt, Human
aaauuugccaucaccuuuugugugguggccuggcaggucauauacuuuuuuuuggcauauac

SEQ ID NO: 428518 - RNA, 62 nt, Human
aucagugaagcagcagugaaaccaggggcucugcaggucacuugggacggacgccaccagac

SEQ ID NO: 428519 - RNA, 62 nt, Human
gcuccugcuaugguuccacagggcuucuucucgcaggucagcuccuuagagaggucucccag

SEQ ID NO: 428520 - RNA, 62 nt, Human
auauuagauuucuuuccccaagggauuauguggcaggucauuauggccuucuuuuuuuuggc

SEQ ID NO: 428521 - RNA, 62 nt, Human
aaaaggaaauccaagcccugagguaggaaugagcaggucagauucaaggcagugaggucagg

SEQ ID NO: 428522 - RNA, 51 nt, Human
ccaccucugaggucaacuaaggcaggucacucagagaucaggaccagugcu

SEQ ID NO: 428523 - RNA, 62 nt, Human
auucuugcuaacauagcaguacuuugcugugagcaggucagcaggaacccuuuucugcaguc

SEQ ID NO: 428524 - RNA, 62 nt, Human
acaacagcagugagccagaggagcacaggcgggcaggucacugcagagacugauggaaguua

SEQ ID NO: 428525 - RNA, 62 nt, Human
uguugggagguaaugcugccccacgugcuggugcaggucaguauccugggacuuggaagcug

SEQ ID NO: 428526 - RNA, 62 nt, Human
gcggagacagucgccagcagcugggcuggggugcaggucaucacaggacggcuccugggcag

SEQ ID NO: 428527 - RNA, 62 nt, Human
aaauuaaauaaacagaauguccccaggagucagcaggucacagucuggcuuugugaugguug

SEQ ID NO: 428528 - RNA, 62 nt, Human
gugggucacccccccagauccaaggagaaacugcaggucaagggcugauaacggccaugcag

SEQ ID NO: 428529 - RNA, 62 nt, Human
gacauaaggaaaguaagugcucagaaaaaugugcaggucaauaaguugcaaaaguuggggcu

SEQ ID NO: 428530 - RNA, 55 nt, Human
gcaggaguuccgauaagugaagugagcaggucaacaguaggacuggggcagaagc

SEQ ID NO: 428531 - RNA, 62 nt, Human
cgcauccgucgccugccaaacugaaggcuacugcaggucacugaguugccugccauccaaag

SEQ ID NO: 428532 - RNA, 62 nt, Human
cucaagugaaacaagguugacaaacucacuucgcaggucacaugccuauacaucacuuauua

SEQ ID NO: 428533 - RNA, 62 nt, Human
ugcacucccccggggugucgcucuccccuccugcaggucagcagcugauccugauccaccuc

SEQ ID NO: 428534 - RNA, 62 nt, Human
aaguuuuuggaccuucuguuccaaaaccuuuugcaggucaaucuuuguauuugaaaugaucc

SEQ ID NO: 428535 - RNA, 62 nt, Human
ccugaagcaagcaaagaauauggcaguguaaugcaggucauuuagaaaaaaacaauguuggg

SEQ ID NO: 428536 - RNA, 62 nt, Human
gcaucaucacuuuccauuagcuguauuggcuugcaggucacauuuuuacuaccagcuuuaga

SEQ ID NO: 428537 - RNA, 62 nt, Human
aucccaaauaggagaaccucucacaagcuggggcaggucaccuuaucuuuguaagaugagga

SEQ ID NO: 428538 - RNA, 62 nt, Human
agcuucaugccucuuccacacagcguuuccaugcaggucaggggaugggaggggucccugag

SEQ ID NO: 428539 - RNA, 62 nt, Human
auugcuguaaagauguaaguuguguauguuuggcaggucacauugaauggcagugauaauga

SEQ ID NO: 428540 - RNA, 62 nt, Human
gaccaggccauggaugaaggacaaagaccagggcaggucacggguuucccaauuccccagca

SEQ ID NO: 428541 - RNA, 62 nt, Human
augagccagguacauaacgcggcacauuuucugcaggucagcaguaagguuucaagguacag

SEQ ID NO: 428542 - RNA, 62 nt, Human
gccuuaugggcugaaguguucucuagaauccagcaggucacacugggggcuucaggugacga

SEQ ID NO: 428543 - RNA, 62 nt, Human
uuagaccuuuaauucuagcacuuugaauucgagcaggucagcgucuucucucgccacgacgg

SEQ ID NO: 428544 - RNA, 62 nt, Human
caucaguuuuguuuacucauccuccaggaacugcaggucaaguugucagguuauuuauuuua

SEQ ID NO: 428545 - RNA, 62 nt, Human
uuucuaugccugaggugcccggggaggcugcagcaggucagcgagugaguggaggggaaguc

SEQ ID NO: 428546 - RNA, 62 nt, Human
cuguuuuagucagagaccacccaacuuagcgugcaggucaccggaguggguggagggucaga

SEQ ID NO: 428547 - RNA, 62 nt, Human
auggucacucugccaucuuggugguugguggggcaggucauuuggaaauaaagaaugugaua

SEQ ID NO: 428548 - RNA, 62 nt, Human
cagguccaacuccuggcaaccgcgggcucaaggcaggucauuggaauccacguuuuggccac

SEQ ID NO: 428549 - RNA, 62 nt, Human
gggccugaggucaucggcguggcccaaggcuggcaggucaaccucgcgcuugcuggccaguc

SEQ ID NO: 428550 - RNA, 62 nt, Human
gcccgcacgggcacuuuuguuggaaacagugggcaggucauggggccuccucaucagagggu

SEQ ID NO: 428551 - RNA, 62 nt, Human
ugcaauggggaaaugacuuauaaagucacccagcaggucaacaaugggcccacgaccaagac

SEQ ID NO: 428552 - RNA, 62 nt, Human
uggucacaucagaggucaacagcagaacagaggcaggucaggguuguccgcucugauuagca

SEQ ID NO: 428553 - RNA, 62 nt, Human
gaggccugguuugucaggcaauaugcccuugagcaggucacccccugggaaugggggguacu

SEQ ID NO: 428554 - RNA, 62 nt, Human
agauaaaugcgucuuuaaaaauagucucuguggcaggucacugggggacaauguacagcauu

SEQ ID NO: 428555 - RNA, 62 nt, Human
uagaggccuauuaaacaugacguuauccaauugcaggucaacuuauaguuguagccuuacaa

SEQ ID NO: 428556 - RNA, 62 nt, Human
cuuaaagauugaaaagauaacauguaggccaggcaggucacugcacaacuaaagcaaaccag

SEQ ID NO: 428557 - RNA, 62 nt, Human
uuacacuuugccgggaccaucagggccgccaagcaggucaggggcugggggcugggggcugg

SEQ ID NO: 428558 - RNA, 62 nt, Human
aaccucauggcccgagcugaauacuugaaggagcaggucaaggugggcacaugggggccacg

SEQ ID NO: 428559 - RNA, 62 nt, Human
agcucugcugcucacuugcuguguggccucaagcaggucacuggccucucugggccucaguc

SEQ ID NO: 428560 - RNA, 62 nt, Human
ccuugcccaguggccuguggcgcccaaagcuggcaggucaggcaagcagccugcaccacccu

SEQ ID NO: 428561 - RNA, 62 nt, Human
uacugugcagacugaccaccggccucccgccugcaggucagaggcucugacacugucugguu

SEQ ID NO: 428562 - RNA, 62 nt, Human
agaggcccaagggcaauaauaagguggaauuugcaggucagcccaggaauuggcagaggaag

SEQ ID NO: 428563 - RNA, 62 nt, Human
ucacaauuacaccacuuuagacccuauguguagcaggucacaacuuacccuuguguguuuag

SEQ ID NO: 428564 - RNA, 62 nt, Human
ccuggccauagaaugauggaaagggaaggucagcaggucaaagcaggaucagccaacaaccu

SEQ ID NO: 428565 - RNA, 62 nt, Human
ccagcucuccugauacucgggauccucaggacgcaggucacauucaccugugggcagaggga

SEQ ID NO: 428566 - RNA, 62 nt, Human
cucucuugacagggagcucacuaccucacaaggcaggucauuucauugugggaucuauagaa

SEQ ID NO: 428567 - RNA, 62 nt, Human
uuacugaacaccacucugugcuaagcccuagagcaggucaaaaacauaaaaucccugccuuc

SEQ ID NO: 428568 - RNA, 62 nt, Human
ccacccuccucagaggcccggggaagggaagagcaggucaguacagagguucugucuacagg

SEQ ID NO: 428569 - RNA, 62 nt, Human
gggggcccuaagggagggacuaaggcuccaaggcaggucacuuuuccuuaggcuguucuacu

SEQ ID NO: 428570 - RNA, 62 nt, Human
aguguuuauguaauaguucuauccuuuugccugcaggucaguuguaauaaaucuaggaugug

SEQ ID NO: 428571 - RNA, 62 nt, Human
ugggcugggucuaggucccucauuaaagaacugcaggucauccagcacccuaaagucugcuu

SEQ ID NO: 428572 - RNA, 62 nt, Human
gguuucucccaguucucuagggaaggccaccugcaggucacugaaacuucaagcaccaggga

SEQ ID NO: 428573 - RNA, 62 nt, Human
agugcccgucggcgucccccgggccccccacugcaggucaccuccgaccucucgcuguagcc

SEQ ID NO: 428574 - RNA, 54 nt, Human
agcaguccacagcagucugagcuggcaggucauggagcagcccccaaagagcug

SEQ ID NO: 428575 - RNA, 62 nt, Human
cccuauauuacucuccugggaucugaguuucugcaggucauuuguauguaggaccaggagua

SEQ ID NO: 428576 - RNA, 62 nt, Human
ggggguccuggcuccccugucccugcagcccugcaggucagugcaugaucuggguucguguc

SEQ ID NO: 428577 - RNA, 62 nt, Human
gcucuggacaagccgcccuucaggcugggguagcaggucaguccaggcaggaagcagcaccu

SEQ ID NO: 428578 - RNA, 62 nt, Human
ggcuggggucuaaccuugaacccucaccacgugcaggucacacacagugaagccacuuguaa

SEQ ID NO: 428579 - RNA, 62 nt, Human
uggcacccucuggggucccccuuuucucccaggcaggucaucuuuucugggagaugcuuccc

SEQ ID NO: 428580 - RNA, 62 nt, Human
gaucucuaguuuuugugguuuaauuuuuaguagcaggucaaaaaccugcccuccugugacuu

SEQ ID NO: 428581 - RNA, 62 nt, Human
caaagcuuccuaugagaagcuucugagauguagcaggucacagaaguguucaccuguuucau

SEQ ID NO: 428582 - RNA, 62 nt, Human
acuuuccugguugcacaaaaggauuucagaaagcaggucaacuaugagguggaucggagauu

SEQ ID NO: 428583 - RNA, 62 nt, Human
acuccccaccccagagucccacauucccugaggcaggucacacgucucuuuaugaugaggau

SEQ ID NO: 428584 - RNA, 62 nt, Human
uugucugcauaacaggagcucugcaggagucugcaggucacccggagcaggacggggaggag

SEQ ID NO: 428585 - RNA, 62 nt, Human
cuaacguccacuagcuuacugaguuaucaggugcaggucagacucuuggcuacagugagagg

SEQ ID NO: 428586 - RNA, 55 nt, Human
auccaaaguuuauggacuaaaugcugcaggucagcagaaauuugcacuaauaaua

SEQ ID NO: 428587 - RNA, 62 nt, Human
gccccggugcccgcagaagacgcuuuuccccagcaggucacccacggccccggaaccgcggc

SEQ ID NO: 428588 - RNA, 62 nt, Human
ugcuccugggaggugagcgugcacaggugugugcaggucaggaggugccguccaggugugcg

SEQ ID NO: 428589 - RNA, 62 nt, Human
agauuuuaaucaaacacgaccagguccgaaaugcaggucaugagugugaaauucucaaauuu

SEQ ID NO: 428590 - RNA, 62 nt, Human
cuagaagccccucugggcaugggguggacauggcaggucagccuguggaacuugcgcaggug

SEQ ID NO: 428591 - RNA, 62 nt, Human
gggagcuggauguguugcccaaggugugcagggcaggucagggaagggcaggguccccuaag

SEQ ID NO: 428592 - RNA, 62 nt, Human
uugagcaauaggcaggcaccaccguccccagagcaggucagcgucucgagaggccccuggac

SEQ ID NO: 428593 - RNA, 62 nt, Human
ccgaauccggcuucggaugaggugagggaggagcaggucaggaggggggcccucguagggac

SEQ ID NO: 428594 - RNA, 62 nt, Human
ucauuauaaaauuuugucguaaacauuaaagugcaggucagugaacaauauucaauguauca

SEQ ID NO: 428595 - RNA, 62 nt, Human
uaaccuagaauucagaugauccuggaauuaaggcaggucagaggacuguaaugauagaauua

SEQ ID NO: 428596 - RNA, 62 nt, Human
cgugaccugccuggccuccccugucucagggagcaggucacaggucaccauggggaauucua

SEQ ID NO: 428597 - RNA, 62 nt, Human
guggcaaauuuuucagagaucguucacauauugcaggucaucggugaacucauacuggagag

SEQ ID NO: 428598 - RNA, 62 nt, Human
cgggauucgggucucuaagaugucuuaugaaugcaggucagagggucacauguuaacacuag

SEQ ID NO: 428599 - RNA, 62 nt, Human
uggagaggcaggcauaggcagggaaccgagcagcaggucagagcaggcgagcugacauucug

SEQ ID NO: 428600 - RNA, 62 nt, Human
ugguuugacuauauuguuagcugccacaguaagcaggucauuguauagguaaaugccugcac

SEQ ID NO: 428601 - RNA, 62 nt, Human
uuuaagaaguaccugcaagaaaccuacucaaagcaggucaccagccaggagcccugacccag

SEQ ID NO: 428602 - RNA, 62 nt, Human
gaacugaaggaucacuggguugcagacacauugcaggucagcuucuuccucugcccaguccu

SEQ ID NO: 428603 - RNA, 62 nt, Human
ugagaccucucuggagacccagauccccuagagcaggucagagaccauccagaaucccagaa

SEQ ID NO: 428604 - RNA, 62 nt, Human
guguuuuucuuuauuauuacuuuuuuuuuucugcaggucaguaaaaggauuuaaguugcacu

SEQ ID NO: 428605 - RNA, 62 nt, Human
cuuuucuggcaaauaacaguaaagaugguuuagcaggucaccuaguugggucagaagagucg

SEQ ID NO: 428606 - RNA, 62 nt, Human
agcgcgacccugcaggugcuggacgcggugcagcaggucacgaggcccccaugucugcaccc

SEQ ID NO: 428607 - RNA, 62 nt, Human
gguccuuacgcugggcugucuggucagcacgugcaggucagggcagguccucugagccggcg

SEQ ID NO: 428608 - RNA, 62 nt, Human
uugacuuuggcaaaugagccggagccccuugggcaggucacacaaccugucccagcgaggga

SEQ ID NO: 428609 - RNA, 62 nt, Human
aggugcaggacugucggggcgagguggccgaggcaggucaaagcugaaaaguggaaucggag

SEQ ID NO: 428610 - RNA, 62 nt, Human
ccaggggagggccccggguucggcggccagaggcaggucagggguccccucucccucucccu

SEQ ID NO: 428611 - RNA, 62 nt, Human
ggcugagcuggaggugggcagggcugcuccaggcaggucagagcagugcagggggaggagag

SEQ ID NO: 428612 - RNA, 62 nt, Human
aggccagccccgaagucgccacguggccuggggcaggucacuuuaccucuguggaccuguuu

SEQ ID NO: 428613 - RNA, 62 nt, Human
uggcauacacuguuauucaugguuaagguaaagcaggucaagggauggcauugaaaaaauau

SEQ ID NO: 428614 - RNA, 62 nt, Human
ggcuacuggcucacagaagcaccuuugguucugcaggucaugccccucccugcagggaaggg

SEQ ID NO: 428615 - RNA, 62 nt, Human
aguucucccaccuuugcucauuuguaaaaugggcaggucaaucuucccaccccaccgugugg

SEQ ID NO: 428616 - RNA, 62 nt, Human
caauaauguuagggacauuauaugauuuccacgcaggucacaccaucugggccugagguagc

SEQ ID NO: 428617 - RNA, 62 nt, Human
auaaaacagccaugcucccaggugcaugauucgcaggucagcuauuuccaggugaagugcuu

SEQ ID NO: 428618 - RNA, 62 nt, Human
cccgggcugagcccuggauuggguaucguggggcaggucacccuggccacgaugcccccggc

SEQ ID NO: 428619 - RNA, 62 nt, Human
gaccagggaggccaagcagccgagcgagagcagcaggucacgcagaaaaaacugagcagcgc

SEQ ID NO: 428620 - RNA, 62 nt, Human
ggaaaagccucuuuguuaucggccuugugucagcaggucauggucccuagagacuaccuagu

SEQ ID NO: 428621 - RNA, 62 nt, Human
uguccucuucugcagguccagcccuggcgagggcaggucagaggaagugaagaaaucaagag

SEQ ID NO: 428622 - RNA, 62 nt, Human
ucucuucagaaaacaauacugcugaccaucaagcaggucauaaacagaaacaucagaagaga

SEQ ID NO: 428623 - RNA, 64 nt, Human
guggguuccuccucccaccuggcuuugaggcugucgucgauaucauaguacuuuacauggauuc

SEQ ID NO: 428624 - RNA, 64 nt, Human
uaguaaacuguguuaauugguaaugacuauuuaucgucgauacucuguagcuguguaaguuuug

SEQ ID NO: 428625 - RNA, 64 nt, Human
ugcaacacgaagcuuccagaaccauaaaauaucccgucgauaaggaaagaaaaugucguuguug

SEQ ID NO: 428626 - RNA, 64 nt, Human
ccucccccuggaacugggacuggucucggucugcugacgucagggucagcucccccgcggagcu

SEQ ID NO: 428627 - RNA, 64 nt, Human
acaugaagcaugggaagcgcacccugucguucagugacgucauucuucuccaggcuggcccgcc

SEQ ID NO: 428628 - RNA, 64 nt, Human
gugcugugagcuguccguggugcugaauucacugugacgucacuccugucucucuuugcuuucu

SEQ ID NO: 428629 - RNA, 64 nt, Human
auccucugcccuuacacccaugacugaggaccaaugacgucauguggcuuuugcaauucacgcc

SEQ ID NO: 428630 - RNA, 64 nt, Human
aggguccccuggggccccuucugcccagucccugugacgucacacugcacacacucaccaccca

SEQ ID NO: 428631 - RNA, 64 nt, Human
ccaaguccagaaggaaggaauggagcugagcaacugacgucaaauccccaagucgacucaagag

SEQ ID NO: 428632 - RNA, 64 nt, Human
ucaccuggaaucagauuauuaagggaauaagccaugacgucaauagcagcccagggcacuucag

SEQ ID NO: 428633 - RNA, 64 nt, Human
ccauagagccugcaaauggauccuccugugagagugacgucaccuccuuuccagagccauuagu

SEQ ID NO: 428634 - RNA, 64 nt, Human
aacuccauuccucauauuaaacuauuacuucucaugacgucaccauuuuuaacugacaggauua

SEQ ID NO: 428635 - RNA, 64 nt, Human
ucuccauaccccgagagcauuugccugccuguccuggacggacuccuacacugggcaguuugcc

SEQ ID NO: 428636 - RNA, 64 nt, Human
uugaauuccucuguuccuuagagcuuguguuacuuggacggaauugccaacacccuuuuuuaua

SEQ ID NO: 428637 - RNA, 64 nt, Human
gggguggggguggauggauagauggauggauggauggacggauggggugggggaaggaaggaaa

SEQ ID NO: 428638 - RNA, 64 nt, Human
guguguaguauuuucccagucagcuuugccauacugacgucaaucauuugagagaaauuauuca

SEQ ID NO: 428639 - RNA, 64 nt, Human
aaacaacaaugagugcuugagauaaaagaaagugugacgucauggucacugguacucaggcacu

SEQ ID NO: 428640 - RNA, 64 nt, Human
aggcagcagacaaagucgucuuccuucuuuccaaugacgucaacagugugugcgaugguaccug

SEQ ID NO: 428641 - RNA, 64 nt, Human
cguagcagguggugugggugcucgggaguggaggugacgucagcagcgcucucugaccgcgggu

SEQ ID NO: 428642 - RNA, 64 nt, Human
uggcucaccgugaggcagccgcgggagggagcgcugacgucacagaagcgaaggcuugaugcug

SEQ ID NO: 428643 - RNA, 64 nt, Human
cugacaaugggacaaccagggacugcucaugcugugacgucacauccucucaccaugcguuagc

SEQ ID NO: 428644 - RNA, 64 nt, Human
cagcacuuuggcaggccgaggcagguggaucaccugacgucaguaguuugagaccagccuggcc

SEQ ID NO: 428645 - RNA, 64 nt, Human
caaggcuuuaggagacccuaaagucuguuggcugugacgucauuauaccuaaaaucugcaucau

SEQ ID NO: 428646 - RNA, 64 nt, Human
agccucaaggucucccaguccagaaacagucuggugacgucaugcccuucucaugugggcagcu

SEQ ID NO: 428647 - RNA, 64 nt, Human
gcuggcauuugaauguuuccaaaucuauuuuaucugacgucaugaacacacaggcaaugauuuu

SEQ ID NO: 428648 - RNA, 64 nt, Human
gcaucacucuccacaaaaagaacagcagcgguucugacgucauggugagugacugccgaaguaa

SEQ ID NO: 428649 - RNA, 64 nt, Human
agggaaggugaguguggguccuuccuaaucccucugacgucaugucauauagguggcugccucc

SEQ ID NO: 428650 - RNA, 64 nt, Human
ugaggauuuuauuuucucccuuacuacgcuugcuugacgucacucucucucgaccuccaaacag

SEQ ID NO: 428651 - RNA, 64 nt, Human
ugauuuacuccacuuuuuaugccuuccauugugaugacgucaaacacagugaaagccuucaguc

SEQ ID NO: 428652 - RNA, 64 nt, Human
aucugugccaacucuaccuucucacuuuuaccucugacgucauucuuuuuuucugaaagaggua

SEQ ID NO: 428653 - RNA, 64 nt, Human
gcccgccagcacaguggcggcaacauugaagacguggacggaggaggggccccgacgacaggug

SEQ ID NO: 428654 - RNA, 64 nt, Human
uuccccaguaaaaccuggggaguucugcguugaguggacggacuuauuccugugaagcggcaua

SEQ ID NO: 428655 - RNA, 64 nt, Human
gugcugcuuugcuuuucaucaccgucccgcacaguggacggagguccccgguugcuggucaggu

SEQ ID NO: 428656 - RNA, 64 nt, Human
ggagccugccaagagguacuguaauggguaauucugacgucagcgcaccaaaacuauccugauu

SEQ ID NO: 428657 - RNA, 64 nt, Human
guuugguuugcuuuugacagcuucauuuuauuuuugacgucacuuuuuggccauguaaacuauu

SEQ ID NO: 428658 - RNA, 64 nt, Human
ucuggaagcacauuugagccuccaggcuucuccuugacgucauuccucuccuuccuugcugcaa

SEQ ID NO: 428659 - RNA, 64 nt, Human
cuggcuggcccgucauguuccucaaaagcacccuugacgucaagucuccuuccccuuuccccac

SEQ ID NO: 428660 - RNA, 64 nt, Human
guuucgccauuuggccaggcuggucuugaacuccugacgucaagugaucugccugccuuggucu

SEQ ID NO: 428661 - RNA, 64 nt, Human
caugagaaagaugucuauguagcugaaaauaaaaugacgucacaagacaauuggugugucauug

SEQ ID NO: 428662 - RNA, 64 nt, Human
auuuuggcaaacauuuuagaagcuugugaacacaugacgucagaucaaagaaaacagaucuucu

SEQ ID NO: 428663 - RNA, 64 nt, Human
cccagaguucacagauguugaaguuucugaagguugacgucacuggaagucugaccacaaacaa

SEQ ID NO: 428664 - RNA, 64 nt, Human
acuauggucgguuucaggaauuucaaaagaaaucugacgucaaugcaauuauccauuauuuaaa

SEQ ID NO: 428665 - RNA, 64 nt, Human
gcucagugggugcccugagcggggucucucagacugacgucaggccuuggugggcugcacucuc

SEQ ID NO: 428666 - RNA, 64 nt, Human
uuuguucugaacuuuccuguuaccuuuucagggcugacgucacauguagguggcguguaugagu

SEQ ID NO: 428667 - RNA, 64 nt, Human
uccugugugugagauguauucccauaaucaaaguugacgucaaacaucuuacuacaaaaauuca

SEQ ID NO: 428668 - RNA, 64 nt, Human
gagauacaaagcaaggagcuggugagcccagcguugacgucaggcaggcuaugcccuuccgugg

SEQ ID NO: 428669 - RNA, 64 nt, Human
gcucugggcuggucacuccgaagaagaggauuugugacgucacuuagagaagcaccuugcuagc

SEQ ID NO: 428670 - RNA, 64 nt, Human
cccugggccuuccgcggcgauggcgcugcgcuaaugacgucauaggcccggacucgcgugagug

SEQ ID NO: 428671 - RNA, 64 nt, Human
uuguaagugaucagaaaccaucuguaucaaagucuggacggaagauuaaaggaaggggcacaau

SEQ ID NO: 428672 - RNA, 64 nt, Human
uaagaugguuacagcuauguaaccuguauuauucuggacggacuuauuaaaauacaaacagaca

SEQ ID NO: 428673 - RNA, 64 nt, Human
aguucccguguaaagcacgggacggaagugcuucuggacggaagugguggcuguggaaggcgua

SEQ ID NO: 428674 - RNA, 64 nt, Human
ccagaaucuuggaacaccuggcaugugacccuagugacgucacagaccugagaugaagauucau

SEQ ID NO: 428675 - RNA, 64 nt, Human
cguuucugguuggcucagcggguuucuagggcugugacgucauggggcagcuuucggaaaauga

SEQ ID NO: 428676 - RNA, 64 nt, Human
aguccagcucgguucauuagcgauccauguaaucugacgucaucuugucucgaagucucuuuuu

SEQ ID NO: 428677 - RNA, 64 nt, Human
cauugcuguucuacuuuuugguacagguauauuuugacgucacugauauuuuuuauacagugau

SEQ ID NO: 428678 - RNA, 64 nt, Human
cucuuuaugauauugugauagggaaaaaaaucauugacgucauagaauauucuucuuccucuca

SEQ ID NO: 428679 - RNA, 64 nt, Human
uuucaccacguuggccaggcuggucuuguacuccugacgucaggugauccacccgccucggcuu

SEQ ID NO: 428680 - RNA, 64 nt, Human
uuccaggcuccagaaaaaaugaaugaacucaccuugacgucaaugcaauugaaucaccguuguc

SEQ ID NO: 428681 - RNA, 64 nt, Human
acaggcucugccacacccgugacuucauccacacugacgucacccgcgggggcucccccugcac

SEQ ID NO: 428682 - RNA, 64 nt, Human
augaugaaucggccaacagccagcccuugccagcugacgucacagucuaagaugggaaacugug

SEQ ID NO: 428683 - RNA, 64 nt, Human
gguguuucagugcggagugccaagaguccuauccugacgucaggcucugggugucaaccucuga

SEQ ID NO: 428684 - RNA, 64 nt, Human
cuaccugcugggaugggggucagccucucuuuggugacgucacguucucugggauccugaggac

SEQ ID NO: 428685 - RNA, 64 nt, Human
cugugcgugucuggaacagucccauuaggagaggugacgucauuugcuuaaaguuuuccaagcu

SEQ ID NO: 428686 - RNA, 64 nt, Human
cccucaguggacugccugcucccacagccugggcugacgucagaggccgaggccaggaacugag

SEQ ID NO: 428687 - RNA, 64 nt, Human
acuugacaauuguauugcgauggcgugggcugcgugacgucaccuccggucgugucucuggucu

SEQ ID NO: 428688 - RNA, 64 nt, Human
ugugcucuccgagagaaaaccaaggugugucaaaugacgucaagucucuauuuaaaaauaauuu

SEQ ID NO: 428689 - RNA, 64 nt, Human
cuggaugggaagaccuggagggcagccacacagcuggacggaugcugccacaucugggcauaca

SEQ ID NO: 428690 - RNA, 64 nt, Human
uucugaaaaaaauuauuccuaaacucucuaaguguggacggagaaugagcaagccccagaagua

SEQ ID NO: 428691 - RNA, 64 nt, Human
augccuauaaucccaggacuuugggaagcugagguggacggaucauuugaggucaggaguucaa

SEQ ID NO: 428692 - RNA, 64 nt, Human
uucuccguacccgcaacguggucaucugugcccgugacgucaccugugcccgugcguggcgucc

SEQ ID NO: 428693 - RNA, 64 nt, Human
cuggcaggcuuccaaacugaggaaagcuggagccugacgucagagcuuuuaacucggacaucac

SEQ ID NO: 428694 - RNA, 64 nt, Human
ggacagaggucaauccuugaugcuccagcacaggugacgucacuaauugucacuuuccaguuug

SEQ ID NO: 428695 - RNA, 64 nt, Human
ggggauggacacccccagcugacuguuggcucucugacgucaacccaagcucuggggaugggug

SEQ ID NO: 428696 - RNA, 64 nt, Human
ggcgcaaccuggugggggcccccagcagggacacugacgucaggacccgagccuccagccugag

SEQ ID NO: 428697 - RNA, 64 nt, Human
cagcacgucgcacacagacauggggaacuuggcaugacgucacaccgagaugcagcaacgacgu

SEQ ID NO: 428698 - RNA, 64 nt, Human
ggccgcggagaugacgucacgcaagcaacggcgcugacgucacauaucaccguggugauggcgu

SEQ ID NO: 428699 - RNA, 64 nt, Human
acgaucccucacccagagcacacggccgcggagaugacgucacgcaagcaacggcgcugacguc

SEQ ID NO: 428700 - RNA, 64 nt, Human
ggagcagggacacgcccuucagagcccgucucuaugacgucaccgacagccaucaccuccuucu

SEQ ID NO: 428701 - RNA, 64 nt, Human
aucacaguaauuauugauuuguacaaaaaucacuugacgucauaaccuuaaagugacacugcuc

SEQ ID NO: 428702 - RNA, 64 nt, Human
guauuuuccacaaugaugaugauuucagcagggaugacgucaucaucacauucagggcuauuuu

SEQ ID NO: 428703 - RNA, 64 nt, Human
gacuauugcuuauuuuuguuuuuaaagaccuacuugacgucauguggacagugcacgugccuua

SEQ ID NO: 428704 - RNA, 64 nt, Human
uaggguccauuccaagauugucaguugccguuagugacgucaggcccuguaaccuguguccugu

SEQ ID NO: 428705 - RNA, 64 nt, Human
uuagagggaggagaaugagccucggccucuuccgugacgucacuggaccacugggcaaugaugg

SEQ ID NO: 428706 - RNA, 64 nt, Human
ucacuccacauugaccccucccuagccuggcaggugacgucaggguccuucacagacaaacacg

SEQ ID NO: 428707 - RNA, 64 nt, Human
ggcccggaucuccaggcccuggggagggagccucuggacggacaguggggacauuguggguuug

SEQ ID NO: 428708 - RNA, 64 nt, Human
auuauugugaugauucauuuagcauaaagagagguggacggaaggguuuuccuauguaucaaaa

SEQ ID NO: 428709 - RNA, 64 nt, Human
uuucugugaaaacauuuugcucuuuggccugguguggacggaaaggguggccaaauggauugag

SEQ ID NO: 428710 - RNA, 64 nt, Human
agccaaagugacuaucucuuaagagaagauaaugugacgucaagggaaguuggaaggcauggau

SEQ ID NO: 428711 - RNA, 64 nt, Human
caggcgagagagaaacagcuacugcgugcgugcgcgcacgcauacacacacacacacacacacu

SEQ ID NO: 428712 - RNA, 64 nt, Human
caucuccugcccucucuccuuccuccccaucucucgcacgcagucuagagauggacugagccuu

SEQ ID NO: 428713 - RNA, 64 nt, Human
cacacacacacacgcacacaugcgugugcacccgcgcacgcacauacacacacacauauagcag

SEQ ID NO: 428714 - RNA, 64 nt, Human
augaacacuuugugaaacaaaucguaaguauguacgcacgcauaucaaacuaugcucugaggau

SEQ ID NO: 428715 - RNA, 64 nt, Human
uguaugugugugugugugugugugugugugcgcgcgcacgcacgccuugagcagucagcauugc

SEQ ID NO: 428716 - RNA, 64 nt, Human
cacacaugcacgcacacacacauacacacaugcacgcacgcacgcaugcacaccaauuuauguu

SEQ ID NO: 428717 - RNA, 64 nt, Human
caugcacgcacacacacauacacacaugcacgcacgcacgcaugcacaccaauuuauguuuuua

SEQ ID NO: 428718 - RNA, 64 nt, Human
uguugcuggaacauuucuaaaagacagugaugaccgcacgcauucauaaagcaaaggaguacua

SEQ ID NO: 428719 - RNA, 64 nt, Human
gucuucaagccuggcccagugagagugaggcccccgcacgcaagccucagccacucccaggggc

SEQ ID NO: 428720 - RNA, 64 nt, Human
gcaccugguaccaaggguaacccggcuccugguauggacggaugcgcaggauuuaggauaagcu

SEQ ID NO: 428721 - RNA, 64 nt, Human
cuucuucggagaagugaaauauaacauuacucaguggacggagaaaucuguuuuguuacagaga

SEQ ID NO: 428722 - RNA, 64 nt, Human
gcuggaggaccacggacauuggacucacuguggcuggacggaggggacccguggaugggggggc

SEQ ID NO: 428723 - RNA, 64 nt, Human
acgcaugcacagauaugcuguccggacacacacacgcacgcagauaugcugccuggacacacac

SEQ ID NO: 428724 - RNA, 64 nt, Human
gcacacacgugcagauaugcuguccggauacacacgcacgcacacaugcagauaugcugccugg

SEQ ID NO: 428725 - RNA, 64 nt, Human
gcgucugcucugguaggacugucagacgcacacgcgcacgcaccuagacacacccacucaugua

SEQ ID NO: 428726 - RNA, 64 nt, Human
cccaaagcuuaagucucugcaggcguggcacgcacgcacgcacccacccacgcgcacuuacacg

SEQ ID NO: 428727 - RNA, 64 nt, Human
guaucccaaagcuuaagucucugcaggcguggcacgcacgcacgcacccacccacgcgcacuua

SEQ ID NO: 428728 - RNA, 64 nt, Human
ucagaguugugugugcaaugcacacccagacacacgcacgcacacacacgcgcgcgcacacaca

SEQ ID NO: 428729 - RNA, 64 nt, Human
aggagcgcaccaaagcgcagagcuugcugcccgccgcacgcacgcgcgccugcgugcggggaug

SEQ ID NO: 428730 - RNA, 64 nt, Human
ccacgacacacgcucgggcuucugguaugucugccgcacgcagggcguggagggggaccacugc

SEQ ID NO: 428731 - RNA, 64 nt, Human
cgggaaguccugagaguguguguugguggcugugcgcacgcacacaagacgggagucacccugu

SEQ ID NO: 428732 - RNA, 64 nt, Human
gcgucgccgauuagaggacgaggaggagagauuccgcacgcaaccgaaaggguccuucggggcu

SEQ ID NO: 428733 - RNA, 64 nt, Human
uggguucauuccccggcccuccgagccgcgccaacgcacgcaacccuugcugcugcccgcgcga

SEQ ID NO: 428734 - RNA, 64 nt, Human
caccagagcauuuccaacaccacagacacacacacgcacgcacacacacaaacacacaugcaca

SEQ ID NO: 428735 - RNA, 64 nt, Human
gccgaaccucaccauauggagccagacauugggacgcacgcaugugauugugugugcacgcaug

SEQ ID NO: 428736 - RNA, 64 nt, Human
gggagcuagaggguugugacccuucauacacacacgcacgcacgcacacaaacaugcacacacg

SEQ ID NO: 428737 - RNA, 64 nt, Human
gcuagaggguugugacccuucauacacacacgcacgcacgcacacaaacaugcacacacgcaug

SEQ ID NO: 428738 - RNA, 64 nt, Human
cccuuuccuagaagggcuacugcuccuggaagaguggacggauccauaauaaagacgucccaaa

SEQ ID NO: 428739 - RNA, 64 nt, Human
gaccuccaggcagcagucucugcuccagaaucucuggacggagcugcuggcagcuucugcgaga

SEQ ID NO: 428740 - RNA, 64 nt, Human
uccugcugaacguguauuucaguguuucacuuacuggacggauaacaagaaaaaaauccuaaca

SEQ ID NO: 428741 - RNA, 64 nt, Human
acaccccaacaugccugcaccugcagcgcgcacacgcacgcacacacacauacagagcucucug

SEQ ID NO: 428742 - RNA, 64 nt, Human
uggaaaguugcugggcccccgcccccggcucccccgcacgcaugcauccacugcggccggagga

SEQ ID NO: 428743 - RNA, 64 nt, Human
caaaagccauaagccugaagauuggcccugugcacgcacgcacacacacacacacacacacaca

SEQ ID NO: 428744 - RNA, 64 nt, Human
ucgccgauccguggggcccccugugcccgccacacgcacgcacacacucuuacacgagagcaca

SEQ ID NO: 428745 - RNA, 64 nt, Human
ggcaggggggcggcgggugggcccgccccacgcacgcacgcacacucggggacuuugugcaugc

SEQ ID NO: 428746 - RNA, 64 nt, Human
cccgggcaggggggcggcgggugggcccgccccacgcacgcacgcacacucggggacuuugugc

SEQ ID NO: 428747 - RNA, 64 nt, Human
caggccauccuagaccagccagcuccagcugauccgcacgcagccacuucggcuaccuucuacu

SEQ ID NO: 428748 - RNA, 64 nt, Human
cugggacacacacacacacacacacacacacacacgcacgcacacgcacacaucuuaccucuca

SEQ ID NO: 428749 - RNA, 64 nt, Human
cccgccccucccccaucgugcugcaugaccuccacgcacgcacguccagggacagacuggaaug

SEQ ID NO: 428750 - RNA, 64 nt, Human
ccugaacucagaaggcugugugucuucugccccacgcacgcacccguaucugcccuccuugcug

SEQ ID NO: 428751 - RNA, 64 nt, Human
cacgcagacaggucgauuugcccaggcccgcgcccgcacgcacgcacgcacacggccccgcaca

SEQ ID NO: 428752 - RNA, 64 nt, Human
cagacaggucgauuugcccaggcccgcgcccgcacgcacgcacgcacacggccccgcacacagc

SEQ ID NO: 428753 - RNA, 64 nt, Human
caggucgauuugcccaggcccgcgcccgcacgcacgcacgcacacggccccgcacacagccccg

SEQ ID NO: 428754 - RNA, 64 nt, Human
ccugcccaccacgcacucccggagagcacggaaccgcacgcacgucaggcaccggcuggggauc

SEQ ID NO: 428755 - RNA, 64 nt, Human
aggcagggagaggccggcuggagccaggcccccucgcacgcagcccccaaaucauggacgcacc

SEQ ID NO: 428756 - RNA, 64 nt, Human
uggauguaguuuuuuuuuguuuuuuuuuuguuuuuggacggagucuuagucugucacugaggcu

SEQ ID NO: 428757 - RNA, 64 nt, Human
ccacagagauacacagauauauacacacaguggauggacggacaagacaggcagagaucuauaa

SEQ ID NO: 428758 - RNA, 64 nt, Human
ucaaugagaagccuucucacugaaagagcugcccuggacggaaaaugaguagugagaugaugcu

SEQ ID NO: 428759 - RNA, 64 nt, Human
acuccuguaaucccagcacuuugguaggccgagguggacggaucacccgaggucaggaguuuga

SEQ ID NO: 428760 - RNA, 64 nt, Human
ggaugguucggcaaagcagccugaguuauuuuuguggacggaaucggaacacgcuggcuccaua

SEQ ID NO: 428761 - RNA, 64 nt, Human
cugggccuuuccagcccaacccacugucuugcaguggacggagagccuuggcgagggcagcagg

SEQ ID NO: 428762 - RNA, 64 nt, Human
accugacagccgagggacacgagcaucacucugcuggacggaccauuaggggccuugccaaggu

SEQ ID NO: 428763 - RNA, 64 nt, Human
uacuguaaguaugaaaugaaagaaaaacaaucauuggacggaaaaggacaacccauauguucca

SEQ ID NO: 428764 - RNA, 64 nt, Human
uuugguagacgcggugggggcgggguggggggucuggacggagucucuauuuaaggagaaauca

SEQ ID NO: 428765 - RNA, 64 nt, Human
gagcuggagggaggggcgggagagaggcaagggguggacggagccaaaggccgugccugguggg

SEQ ID NO: 428766 - RNA, 64 nt, Human
aggcgucuggucaacuuagcacaagggcagugccuggacggacccggagcccccgcauaucagc

SEQ ID NO: 428767 - RNA, 64 nt, Human
gagggaccuccccacaccuacuccaaagaacagcuggacggagcugagaggagacccuagcauc

SEQ ID NO: 428768 - RNA, 64 nt, Human
gaacaguagccagugucuggcaggcuccagaggguggacggagcggggcccauucucaggucaa

SEQ ID NO: 428769 - RNA, 64 nt, Human
cugaaguaggcgcccccgggacugggcuaggaguuggacggaauggaggauggaggacagcgag

SEQ ID NO: 428770 - RNA, 64 nt, Human
ccaacgaccauggagagaugggccguugccaugguggacggacucccgggcugggcuuuugaau

SEQ ID NO: 428771 - RNA, 64 nt, Human
cucugaucaaauuggcuacaaucuuggagcugcuuggacggauuccuuggcagccggguuagca

SEQ ID NO: 428772 - RNA, 64 nt, Human
uggaggagaaagccauucuggacaccaggggaccuggacggaggguccccacagcccgugcccc

SEQ ID NO: 428773 - RNA, 52 nt, Human
uggauggcugugacuucuaggauggacggaaccaugcacagcaggcugggaa

SEQ ID NO: 428774 - RNA, 64 nt, Human
accuccauuucagcauguggcucgcguggacagguggacggacgcuguggccgcauggaaccuu

SEQ ID NO: 428775 - RNA, 64 nt, Human
cugcgguuuccuauuuauguggccauguuccuccuggacggaucucccuguguguuucaagcug

SEQ ID NO: 428776 - RNA, 64 nt, Human
ccugaagccccucccugagugguccccaccuuucuggacggaaccacguacuuuuuacauacau

SEQ ID NO: 428777 - RNA, 64 nt, Human
agcuccagguccuggagccacguccagcacagaguggacggauucaccguggccgacucuuuuc

SEQ ID NO: 428778 - RNA, 64 nt, Human
cagaagccauagacgagacguagguagccguaguuggacggacgggcagggccggcggggcagc

SEQ ID NO: 428779 - RNA, 64 nt, Human
cauauggaggacagguggacaugguccugagcucuggacggagcaggcacccugaucucauucu

SEQ ID NO: 428780 - RNA, 64 nt, Human
ucgcccuccuagggccuggguacagggcaugaguuggacggaccccaggguuauuauugccuuu

SEQ ID NO: 428781 - RNA, 59 nt, Human
aauucuuccuggagaggugauggcuggccuggacggaccagccccguccacagaacucu

SEQ ID NO: 428782 - RNA, 64 nt, Human
cacauuuugcacugguuuauggcgauuguuuucuuggacggauaguguaaaauaaacuucucug

SEQ ID NO: 428783 - RNA, 64 nt, Human
ccaacagagcucaggacagcccacagggaggugguggacggacuguaauugauagauugauuau

SEQ ID NO: 428784 - RNA, 64 nt, Human
cuuuccugcccucccccaacccucccuuggcggcuggacggaggggggacuugcuaggagcgga

SEQ ID NO: 428785 - RNA, 64 nt, Human
ccugauaaaccaacuaacuuugguggaauccuuguggacggaagagcuaaagauucucagggca

SEQ ID NO: 428786 - RNA, 64 nt, Human
ucuccaccucagcauugcaucguaucaucauuuucgcuacgaauuuauuuuucaacaauaagcu

SEQ ID NO: 428787 - RNA, 64 nt, Human
caucacuugagcccaggaguuggaggcugcagugcgcuacgaucacaccacugcacaccagccu

SEQ ID NO: 428788 - RNA, 64 nt, Human
ccagacccgggaagggaaguccgcagccgacgcccgcuacgaagcagccugcaacaggcuggcc

SEQ ID NO: 428789 - RNA, 64 nt, Human
uuccagaagaaccaguggaagaauuuaaauuuggcgcuacgaucaaaacuacugaauuaguaga

SEQ ID NO: 428790 - RNA, 64 nt, Human
cccucgggggacuggacacacauccugccagaggcgcuacgaagcuuugcccagaugaagccag

SEQ ID NO: 428791 - RNA, 64 nt, Human
gaacauccggcauucaggccgcgaugacaccucccgcuacgaugagagguaagauugggcgacc

SEQ ID NO: 428792 - RNA, 64 nt, Human
ccagcagcuggagcugggccgcuuccugaggagccgcuacgaggccuuccugaguccggaguac

SEQ ID NO: 428793 - RNA, 64 nt, Human
ugauaaugcuaauuuuauuauaguaaugugacuuggauucaauuuuaaggcauauuuaacaaaa

SEQ ID NO: 428794 - RNA, 64 nt, Human
gccucccuuugguaaaucugccuuauccuucuuuaccuggcaaagagccaaucauguuaacucu

SEQ ID NO: 428795 - RNA, 64 nt, Human
ucuaacgccagcacacuauuuacaagauggacuuaccuggcagacuugcccaggucaccaagca

SEQ ID NO: 428796 - RNA, 64 nt, Human
uggauuaauagagaaauuuugauaagaauggagacgcuacgacagauguaggaagucaucuacc

SEQ ID NO: 428797 - RNA, 64 nt, Human
gcaguaaauuggcaccgugucacacuguuuccugggauucaaguaugcaaccagaacacaggag

SEQ ID NO: 428798 - RNA, 64 nt, Human
cucccuuggaggccucauuccagcgccccaaggaggauucaaacuguuggggcuggaagaacuu

SEQ ID NO: 428799 - RNA, 64 nt, Human
cgcacuggucacacaucuguaagugggagaggcaggauucaacagaucugucugucuugagucu

SEQ ID NO: 428800 - RNA, 64 nt, Human
guuaagagaauaaacuagaucuagaaucagagcuggauucaauuccuguccuucacauuuacua

SEQ ID NO: 428801 - RNA, 64 nt, Human
ugaauguaggauucuucaguauguggaaagacaaggauucaacguguggucauaugauaaauaa

SEQ ID NO: 428802 - RNA, 64 nt, Human
cuuguccagcuaacucagcuguuuauaauugaagggauucaacaaaauuaucucuagcaucagg

SEQ ID NO: 428803 - RNA, 64 nt, Human
ucgugugugugggugggggcagccuccaccuccuggauucaagagauuccaggggugcagcaag

SEQ ID NO: 428804 - RNA, 64 nt, Human
cucuccuuugcucucugcagcuguaagccagaggggauucaagguaaauaggcuuuacaggcuc

SEQ ID NO: 428805 - RNA, 64 nt, Human
uuuggcuguuuuuguaguuggauuguuuguauuaggauucaagcaaggcccauauauugcauuu

SEQ ID NO: 428806 - RNA, 64 nt, Human
uagauuccucuggugcuggucuccaggcugacaaggauucaaaguugucucugaaacuccucuu

SEQ ID NO: 428807 - RNA, 64 nt, Human
ucccgagguccagagccccaccuccuaacaccauggauucaaagugcucagggaauuugccucu

SEQ ID NO: 428808 - RNA, 64 nt, Human
uucugcugucuccgcguaggcagcuucggggcaaggauucaacuccccaggccucccacgguug

SEQ ID NO: 428809 - RNA, 63 nt, Human
augugggguugcugaagaugccuugaggugaaaugggggcaggaaagccacaucuugcucugc

SEQ ID NO: 428810 - RNA, 63 nt, Human
cauugaaauuucuugguuaaguuuaauuuucucugggggcaugaucucacaaagaauacucaa

SEQ ID NO: 428811 - RNA, 63 nt, Human
uaauggaaguggauugaauacagcagucucaacugggggcaauuuugccccccagaggacauu

SEQ ID NO: 428812 - RNA, 63 nt, Human
agaaagaagcuuuugauuagauguacaauacauugggggcagaagaucugggaucaauuaaga

SEQ ID NO: 428813 - RNA, 64 nt, Human
gggugacagagcaagacccugucuuaaaaaaagaggauucaacacauauuuuuauauuauguua

SEQ ID NO: 428814 - RNA, 64 nt, Human
ccuaaggacucagauuguaucuuuguacagaagaggauucaaaacgccacguguaguggcucau

SEQ ID NO: 428815 - RNA, 64 nt, Human
uaauuugacuguaacacauuuguuucaagucuuuggauucaaacaaccggauuguauuaaaauu

SEQ ID NO: 428816 - RNA, 64 nt, Human
uucaugaucacacagcuaauaagugguggucccaggauucaacccaagaagucuguuagaaucc

SEQ ID NO: 428817 - RNA, 64 nt, Human
caaggagcauauuuugcucuuaggauggucuuugggauucaagaauagaauaauaaauccaaac

SEQ ID NO: 428818 - RNA, 64 nt, Human
acacgagcuagcuucugcaauguuuaucuagaauggauucaacacugugcacggaaaagacaag

SEQ ID NO: 428819 - RNA, 64 nt, Human
uucugaaacucacagaagucacgugauggagagaggauucaaagccagggccucagacccucac

SEQ ID NO: 428820 - RNA, 64 nt, Human
auaagccauuuggagucaugauugguggucaaguggauucaagcuaaaauacuaagaccagcau

SEQ ID NO: 428821 - RNA, 64 nt, Human
uuugccaugcuggccaggcuggucucgaacugcuggauucaagugauccgcccaucuccgucuc

SEQ ID NO: 428822 - RNA, 64 nt, Human
gcgcgaucucagcucacugcaaccucugccucccggauucaagugauucuccugucucagccuc

SEQ ID NO: 428823 - RNA, 64 nt, Human
ucuuacucugaaacauggccuguuugggagugcgggauucaaagguggucccacggcugccccu

SEQ ID NO: 428824 - RNA, 64 nt, Human
gacuuugaaacaucucucucucucauaacucccuggauucaaguagcacauugguaauagguau

SEQ ID NO: 428825 - RNA, 64 nt, Human
caaaccuucauuccuugaaucaaggagcacuacuggauucaacugccaaaauuuuuuaaagguu

SEQ ID NO: 428826 - RNA, 64 nt, Human
uucugagaccacccagugaauaggcacuacccugggauucaagacagucuuuuguaacuggcac

SEQ ID NO: 428827 - RNA, 64 nt, Human
auccccucagucugaaucuucucauugucuuauaggauucaagaaauggaaggaugauucuugu

SEQ ID NO: 428828 - RNA, 64 nt, Human
ggaaaacagcucaguuugggaaguaucagagaugggauucaaacccagauccucugguccaagu

SEQ ID NO: 428829 - RNA, 63 nt, Human
cuccucagaucuguuugugccuuucaaaaguacugggggcagauucucaaaacucuuagauug

SEQ ID NO: 428830 - RNA, 57 nt, Human
ugcugcugccagagagaugagcugcccaccuggcaguggccgcagccuggcccucug

SEQ ID NO: 428831 - RNA, 64 nt, Human
ucauuuaacauccugaccugguaagcugccacacaccuggcaguggggagcaucgcuguuucca

SEQ ID NO: 428832 - RNA, 64 nt, Human
uuugguguuaaaaaaaaaaaccuguaagucuguaaccuggcaacauuuuacaacccuguauuuu

SEQ ID NO: 428833 - RNA, 64 nt, Human
ucccacuuccccuccccuuuccucuccagcauuaggauucaagggaaauuugcaugaagccaau

SEQ ID NO: 428834 - RNA, 64 nt, Human
ucaguuuaaagugaaagaaaaaucuguaauacaaggauucaaaauaugugagggugcauaggua

SEQ ID NO: 428835 - RNA, 64 nt, Human
cugcccaggaguggccaguguucggcguugcucgggauucaagauaccaccaguucagagcuaa

SEQ ID NO: 428836 - RNA, 64 nt, Human
acacagccagcccaagaugacuuaucuggguuuaggauucaauaguauucacuaacugcuuauu

SEQ ID NO: 428837 - RNA, 64 nt, Human
agauuuaaaggacaugcugggugcccagcaggauggauucaagggaaaccuacauuaaggaaaa

SEQ ID NO: 428838 - RNA, 64 nt, Human
gcgcgaucucggcucacugcaaccuccaccucccggauucaagcgauucuccugccucagccuc

SEQ ID NO: 428839 - RNA, 64 nt, Human
gcacuugcuuuaucuccuugggcauucguacuuaggauucaauagaaacauguacaggguaaac

SEQ ID NO: 428840 - RNA, 64 nt, Human
uguggaccugacaguuaaaaauauaaagaaccuaggauucaauuccaacuuucucuguuugccu

SEQ ID NO: 428841 - RNA, 64 nt, Human
cauuuugcaucagccuggagugaaccaugaacuuggauucaagacugucuuuucuauagcaagu

SEQ ID NO: 428842 - RNA, 64 nt, Human
uaagaccauauuguaagagucuuguuaaaaugauggauucaacuucugccucggaugagagguu

SEQ ID NO: 428843 - RNA, 64 nt, Human
auguaccccauggauuuaaucuuaucuaccccguggauucaaucuucuuaucagaagguucuuu

SEQ ID NO: 428844 - RNA, 64 nt, Human
ccggcccaguucagggacagaauuauaguguuugggauucaaaccaacagucugucaguguaca

SEQ ID NO: 428845 - RNA, 64 nt, Human
gcaugaucucagcucacugcaaccucugccuucuggauucaagugauucuugugccuuagccuc

SEQ ID NO: 428846 - RNA, 64 nt, Human
gucagcccacuguauuuguguguuccacaucuguggauucaaccaacugcagaucaaaaauauu

SEQ ID NO: 428847 - RNA, 64 nt, Human
gugcaauuucagcucacugcaaucucugccacccggauucaagcaauucuccugucucagccuc

SEQ ID NO: 428848 - RNA, 64 nt, Human
cucccuucuccaugaugugacuuccggagauaaaggauucaaaagauaaagacaaaguacgcuc

SEQ ID NO: 428849 - RNA, 64 nt, Human
uccucgcucaacuccuuggccucuucuugcuuugaccuggcagauaucagccucaacauugagu

SEQ ID NO: 428850 - RNA, 64 nt, Human
gcuguauaaagcugcagcuuucaacagguuuuaaaccuggcauuaaaauguaauggcaaaacca

SEQ ID NO: 428851 - RNA, 64 nt, Human
gggaaaggaggaacaauuaggacguggcaaugagaccuggcagggcagaguacaagcccagcac

SEQ ID NO: 428852 - RNA, 64 nt, Human
auguaaaugacgaguuaaugggugcagccaaccaaccuggcacauguauucauauguaacaaac

SEQ ID NO: 428853 - RNA, 64 nt, Human
acaguuggcccucugugguuaguuccacaucuguggauucaaccaaccaaggacggaaaaugcu

SEQ ID NO: 428854 - RNA, 64 nt, Human
uucucggccaucgacugcagaugaugaaagagcgggauucaacuuuguuuucuuuuccuguggc

SEQ ID NO: 428855 - RNA, 64 nt, Human
aaagcacaauucauuuguaaugcauauccaucuuggauucaauccaaggugcuuuagcuaucag

SEQ ID NO: 428856 - RNA, 64 nt, Human
ucuauucuugggauaaauaauaguaaauucuauaggauucaauacuuaguuugcaaaagcacuu

SEQ ID NO: 428857 - RNA, 64 nt, Human
uuaacauggaauuuaauuuaugugaaagaguucuggauucaaaugucaguucauaauauaugga

SEQ ID NO: 428858 - RNA, 64 nt, Human
augagcauuuaaaaacuguuuacagccaccauagggauucaaaagaauuuggaauaaacuuuga

SEQ ID NO: 428859 - RNA, 64 nt, Human
uuguggaggauauguguuuagagaugcgagcuggggauucaacagguaagagggagagagauca

SEQ ID NO: 428860 - RNA, 64 nt, Human
gcucuuuuaucaucagaauaggaaaaauugucauggauucaaguuauuaaaagcauaaguuugg

SEQ ID NO: 428861 - RNA, 64 nt, Human
uuacauccuagggcaugaggggaguaucuuucagggauucaaauggaauuuuuaccuguuacuu

SEQ ID NO: 428862 - RNA, 64 nt, Human
uguaacuuucugguuauauacugcuuauaucuguggauucaaguuacugaagugaauaccaaua

SEQ ID NO: 428863 - RNA, 64 nt, Human
gaagaaaaccuacgcuucaggcucagagaaaccuggauucaaauccugccucucucacuuggaa

SEQ ID NO: 428864 - RNA, 64 nt, Human
uugcaaugucagcucacugcaaccuccaccuccuggauucaagugauucucgagccuuaagcuc

SEQ ID NO: 428865 - RNA, 64 nt, Human
gccugugacucugaacagcaggaccuuggugacuggauucaacuugcuugggagggucugugcu

SEQ ID NO: 428866 - RNA, 64 nt, Human
uucuguguaaacucagauaagucaccuuucucugggauucaaauuuuugcaucaguuaaaaaaa

SEQ ID NO: 428867 - RNA, 64 nt, Human
ccccuccucagagggggcagauagaaacugggacggauucaagucacaugcacgcggauagcag

SEQ ID NO: 428868 - RNA, 64 nt, Human
accagauugucaucguggcacugucugugaagacggauucaaauguuuucauguaacuauguaa

SEQ ID NO: 428869 - RNA, 64 nt, Human
ugcuuguauuuacucacgugguuaaaaaauuauuaccuggcaaacugaguugccggucauauug

SEQ ID NO: 428870 - RNA, 64 nt, Human
cugaagguuuuccaaagggcuuggcuccagagccaccuggcagacugcccguggcccugcuguc

SEQ ID NO: 428871 - RNA, 64 nt, Human
uccucaaaaguuuuucugaucccucgccuugcacaccuggcaugcaucaggcacaucuguccua

SEQ ID NO: 428872 - RNA, 64 nt, Human
caacaauguuguuuuaagacucuuaaaauacgguaccuggcaauguuuauuucauaaagaauug

SEQ ID NO: 428873 - RNA, 64 nt, Human
aauuauuauauucuaguuuggaguacuugcuguaggauucaagcugucuuugcacuagcucuaa

SEQ ID NO: 428874 - RNA, 64 nt, Human
aucaccagcuuuuuuucauucuuaacucuuuaaaggauucaaacgcaacucaaaucugugcugg

SEQ ID NO: 428875 - RNA, 64 nt, Human
cucugacuguuggaaucccacgcaccauucaguaggauucaauucaauguggaaccauucaaca

SEQ ID NO: 428876 - RNA, 64 nt, Human
cugagggcaccuagacucuacagccaggcggccaggauucaacucccugccuggaucucaccag

SEQ ID NO: 428877 - RNA, 64 nt, Human
guccacugaacaaggcuaguuccugcaccacccaggauucaaaggaaagacgaagggagcagaa

SEQ ID NO: 428878 - RNA, 64 nt, Human
gggacuagaaauuauuugaaguuuucuuuauuacggauucaaagacuuauuuugaaaguuggaa

SEQ ID NO: 428879 - RNA, 64 nt, Human
gauaagagaggugcauguugguauuuaaaguaguggauucaaagaacuuagauuauaaauaaga

SEQ ID NO: 428880 - RNA, 64 nt, Human
gauguaaugcacauuauuggcguaucuuuaaguuggauucaaauggccauuuuucuccaauuuu

SEQ ID NO: 428881 - RNA, 64 nt, Human
gugcgaucucagcucacugcaaccucugccuccuggauucaagcgauucuccugucccagccuc

SEQ ID NO: 428882 - RNA, 64 nt, Human
gcaugaucugggcucacugcaaccuccuccuccuggauucaagcaauucucuugcuucagccuc

SEQ ID NO: 428883 - RNA, 64 nt, Human
caccucugaauccccaccaggcgccuuccuggguggauucaacaagaugauuuugcccuuuccc

SEQ ID NO: 428884 - RNA, 64 nt, Human
cuuuggaacaaaucccccccacuccaaaguccauggauucaauggacucauccauuugugagga

SEQ ID NO: 428885 - RNA, 64 nt, Human
uaucucaaaaaaaauaaaaagaauuaugaaaguuggauucaaauuuuggguauauuacuaagua

SEQ ID NO: 428886 - RNA, 64 nt, Human
aaauuugcaacauauaaaguaguuugaucuaagaggauucaacaccuuuguuuuguugcucagu

SEQ ID NO: 428887 - RNA, 64 nt, Human
gaguucccaagaaaggaaaccuuuucuuguaucuggauucaaauuuauuuccaauguuucaagc

SEQ ID NO: 428888 - RNA, 64 nt, Human
uucacagcuaaucaggcauuuugaaagcuuaauuggauucaaaaaccauaauguuggaauuugg

SEQ ID NO: 428889 - RNA, 64 nt, Human
acuacacuggguccguguucccgcuaugacaaugaccuggcaccaaugggcaguguuccccuuu

SEQ ID NO: 428890 - RNA, 64 nt, Human
cccuccuccccugcaagagugguccuaggagaggaccuggcacaccuuagguugacauucagaa

SEQ ID NO: 428891 - RNA, 64 nt, Human
ucaacagagaagccuccaccugaggauggggaggaccuggcaggcagcuuccacggcagggcug

SEQ ID NO: 428892 - RNA, 64 nt, Human
guuucaggauucucuagaguuaauaacauuuguaaccuggcacaguuucccucauccuguggaa

SEQ ID NO: 428893 - RNA, 64 nt, Human
agugaaauggcaguuagaccaacagaggcuugaaggauucaaguacaaguaauauuuuguauaa

SEQ ID NO: 428894 - RNA, 64 nt, Human
aagcucucaaaguguugaguggggcccuuaaacuggauucaaaaaaugcucuaaacauaggaau

SEQ ID NO: 428895 - RNA, 64 nt, Human
gagugaaguuuuauaaauauuuaauauuuauuuuggauucaaauuguauuuacauaucagggaa

SEQ ID NO: 428896 - RNA, 64 nt, Human
cgugaucuuggguuacugcaaccucugccccucgggauucaagugauucuacugccucagccuc

SEQ ID NO: 428897 - RNA, 64 nt, Human
ugaggggggggugggugagagagacaggcagcucggauucaacuaccuuagauaauauuucuga

SEQ ID NO: 428898 - RNA, 64 nt, Human
ggaaggccaaggcaggaggaccgcuugaguccagggauucaaggccaaccugggcaauagagcg

SEQ ID NO: 428899 - RNA, 64 nt, Human
acuacuucuggaaaagguuuucucaaaggcccaaggauucaagcaaagggaaguggaaucuugu

SEQ ID NO: 428900 - RNA, 64 nt, Human
uauauucauaaguucuaaaauccuucauuaugagggauucaaaguauuuauaaaaacacugccc

SEQ ID NO: 428901 - RNA, 64 nt, Human
aacacacauugauugagugccugcuggguacaagggauucaauuuaugccuauugauaucugcg

SEQ ID NO: 428902 - RNA, 64 nt, Human
cauacccggcuaauuuuuauauuuuuagagacagggauucaacauguugguuaggcuggucuug

SEQ ID NO: 428903 - RNA, 64 nt, Human
agagggguccaaauggugaaugcucauccugccuggauucaaggaauuagcucagagauuggcc

SEQ ID NO: 428904 - RNA, 64 nt, Human
gaaacccugaauagaaacaaaacuuuugaaugcuggauucaaaaaaaaaaaaaaguuaucugga

SEQ ID NO: 428905 - RNA, 64 nt, Human
gcaagcucagggugcucccuccucagucuuugggggauucaaaugcaugauauuguauguaccu

SEQ ID NO: 428906 - RNA, 64 nt, Human
ugauuguuaagcauuucauauuuuaauuuaaauuggauucaaccacaauaaagaaaaugagaaa

SEQ ID NO: 428907 - RNA, 64 nt, Human
caaagcaaaaggaccauuuaaaguaaaauagcuuggauucaaucaugugacuuuuaaauuggcu

SEQ ID NO: 428908 - RNA, 64 nt, Human
ggaaagaaaagaauguacauuaccugguuuccugggauucaaaccugcauauugugauuuuaau

SEQ ID NO: 428909 - RNA, 64 nt, Human
cagcugaagaaccgccguucccuugaaagggaacaccuggcauucugugguguuucgugcuguc

SEQ ID NO: 428910 - RNA, 64 nt, Human
cccugggccccucuuauuccucuaggcaagcaggaccuggcaucaugguggauauggugcagag

SEQ ID NO: 428911 - RNA, 64 nt, Human
cuccuuccaggagaucaugcacgcccugaagaugaccuggcacgugcacugcuuuaccugugcu

SEQ ID NO: 428912 - RNA, 64 nt, Human
uugcacucggugcagcgguuaugcuuaugaaaauaccuggcagcuuugugcaaugaauuaaugu

SEQ ID NO: 428913 - RNA, 64 nt, Human
agcuccgguuucuauuauugugacuugaaugucaggauucaagggcucagugucaaagauaauu

SEQ ID NO: 428914 - RNA, 64 nt, Human
cccaaagggugaacuaaaguuuaaggagaugagaggauucaaggagcccguuggugacgccuuu

SEQ ID NO: 428915 - RNA, 64 nt, Human
gaagaauacauauacuuauauucggggauaugaaggauucaaugaaugaucucuagaaagauuu

SEQ ID NO: 428916 - RNA, 64 nt, Human
aucucaaaaaaaaagaaaagaagguccagcuuuuggauucaaugagugggaaauacauugugcc

SEQ ID NO: 428917 - RNA, 64 nt, Human
gguccaggccuugcuggguacuucugagcccuugggauucaaaguggcagccauggggccacug

SEQ ID NO: 428918 - RNA, 64 nt, Human
aaagcaaacauccuuaacugacccuaacguguauggauucaacuuugauuauucaacaaaauca

SEQ ID NO: 428919 - RNA, 64 nt, Human
uaauuaaagaggauccaccccaggguuauuuugaggauucaaaaaggcaugcaacacaccugga

SEQ ID NO: 428920 - RNA, 64 nt, Human
uaagacccguggccgucaaggacugguucgggguggauucaacaaaacugccagcuuuuaugua

SEQ ID NO: 428921 - RNA, 64 nt, Human
cugcacaaacccuuaaugaacacugucuuuucauggauucaaggaauuccaguuuuaucuauua

SEQ ID NO: 428922 - RNA, 64 nt, Human
aggauuuccucaaauuuuaaauauguaacuucagggauucaauccccaaauguuuauuaaguag

SEQ ID NO: 428923 - RNA, 64 nt, Human
aagaugauuguacaagaguauuuucagacuaauuggauucaagguuauauucuuuuaaguguug

SEQ ID NO: 428924 - RNA, 64 nt, Human
caagauauuuaaagcaaauacaaaacagaacagaggauucaaaccgcaaguaugggagauuuag

SEQ ID NO: 428925 - RNA, 64 nt, Human
gcgcgaucucggcucacugcaaacucugccuccuggauucaagcgauucuccugccucagccuc

SEQ ID NO: 428926 - RNA, 64 nt, Human
uuaacaauugcucagccacaauucucggauauagggauucaaaagacaggacacagaacuaaca

SEQ ID NO: 428927 - RNA, 64 nt, Human
ugcugcugaccaguugucuuagaaauggucaauuggauucaacuuuaguccucuccuucccccu

SEQ ID NO: 428928 - RNA, 64 nt, Human
gucagccuuucaaauccauggguucuguguccguggauucaaccaaccuuggaucaaaaauauu

SEQ ID NO: 428929 - RNA, 63 nt, Human
acagguaccauuuaggaaauaccgaugccuuugugggggcagaaucacauggcaaaagcuuug

SEQ ID NO: 428930 - RNA, 63 nt, Human
ucccugccucucacugccauaagaauaucagccugggggcaguccagacgcagcccuuuguca

SEQ ID NO: 428931 - RNA, 63 nt, Human
aaggggagaagaauacuuuucuucaacaaauuuugggggcaggagaucccuucaagaggcugc

SEQ ID NO: 428932 - RNA, 63 nt, Human
gguaucuuuucaacuauuguuuuauccugucuuugggggcaaugugucaaaaguccccucagg

SEQ ID NO: 428933 - RNA, 64 nt, Human
aagcuucacuucucugauuggcuuccaaccacugggauucaaagagaauccaagguucugccua

SEQ ID NO: 428934 - RNA, 64 nt, Human
gcuggggucugggaggaauggacagacagaggaugagcucuacccagggccugcaggaccugcc

SEQ ID NO: 428935 - RNA, 64 nt, Human
ucccgcuugcugccuucagccagggcgcuccucagagcucuauuuuccugcagacaccagcucu

SEQ ID NO: 428936 - RNA, 64 nt, Human
gagaaccuacaugucagguucuggaguuggcccugagcucuauccaccaagccagcaccccacc

SEQ ID NO: 428937 - RNA, 64 nt, Human
gccccagcuccucucugcaacccagcccucuccugagcucuaggcugggauuacacccgcugga

SEQ ID NO: 428938 - RNA, 64 nt, Human
uucauuaacaaaauguaugucugguuccccaguagagcucuacugccucaacccaaggggauuu

SEQ ID NO: 428939 - RNA, 64 nt, Human
uuuuuuuuuaggauagggccuugcucugucaccugagcucuagugcaguagugcaaucacagcu

SEQ ID NO: 428940 - RNA, 64 nt, Human
uccauccgacaccugaaucauuccauguaaaacagagcucuaagaugauccuuuaagcaagcag

SEQ ID NO: 428941 - RNA, 64 nt, Human
auuaacugaaggcuuuucuuuuauuacaucuaaagagcucuacauaaacagguaacauucaaua

SEQ ID NO: 428942 - RNA, 64 nt, Human
ggaggaagacaguuguguuuucucuuuaaaccuugagcucuagccgaugcauuugucaggaaau

SEQ ID NO: 428943 - RNA, 64 nt, Human
guuguggacugaauugcgucaaauucauauguuggagcucuaaccccuaaugugacuguaauug

SEQ ID NO: 428944 - RNA, 64 nt, Human
ucuagcaucucugccucaugucuugaaucugcuugagcucuaagaugaaccuggggacaaagug

SEQ ID NO: 428945 - RNA, 64 nt, Human
gcgcucaggacgugaugagguacucgugguucuggagcucuagaaacacuucugaugcaugaaa

SEQ ID NO: 428946 - RNA, 64 nt, Human
ccgagcccgggaggcugcccugagcaggagcauggagcucuacaggaaugcaccccccaccgcc

SEQ ID NO: 428947 - RNA, 64 nt, Human
caucauuauuauugcucuccacuguauccccucuaccuggcaugugcuugucaaguucuaguug

SEQ ID NO: 428948 - RNA, 64 nt, Human
cccuccucugaagacugccucuggccugcagcugaccuggcaaccauucaggcacaugaaggug

SEQ ID NO: 428949 - RNA, 64 nt, Human
uaauacuaacccuuuucucaggauaacugucuacaccuggcaguuuucucugacgugcuguuca

SEQ ID NO: 428950 - RNA, 64 nt, Human
ccaaaauuuccacugccaggaagugguagugaugggauucaaaccuggguggcccugagaccag

SEQ ID NO: 428951 - RNA, 64 nt, Human
gaauuuccccaucuuucucuucuuuccaucguguggauucaauaguguggauuugaaggcugcc

SEQ ID NO: 428952 - RNA, 64 nt, Human
aaacuguuagaugcacacuguugauuuucaugguggauucaagaacucccuagugaggagcuga

SEQ ID NO: 428953 - RNA, 64 nt, Human
gugcaagcucagcuuacuguaaccucugccuccuggauucaaguguuaguagcugggauuacaa

SEQ ID NO: 428954 - RNA, 64 nt, Human
gggacgagaaggacucauccagcaaaguugccugggauucaaaauaaaggcauugcagaccgca

SEQ ID NO: 428955 - RNA, 54 nt, Human
aggggcagucuccucaguaaucuaggauucaaugauagguaugauuccaguuua

SEQ ID NO: 428956 - RNA, 64 nt, Human
gauauuagucaaugguaccuaguaauuugcugaaggauucaaaucacaaucauauuucauaccg

SEQ ID NO: 428957 - RNA, 64 nt, Human
gggaagggaaacauuuggguugaugaggcagaggggauucaaaugugugagaggcuagauucaa

SEQ ID NO: 428958 - RNA, 64 nt, Human
aguuaaauugugcgcuguauuuugcagauuauggggauucaaauucuaguaauaggcuuuuuua

SEQ ID NO: 428959 - RNA, 64 nt, Human
ggucaaagguuaaauuuaucucuaaaaaauggcaggauucaaaguuguacauacaugugauuac

SEQ ID NO: 428960 - RNA, 54 nt, Human
aggggcagucuccucaguaaucuaggauucaaugacagguacgauuccaguuua

SEQ ID NO: 428961 - RNA, 54 nt, Human
gacaacagccuccccaguaaucuaggauucaaugacagguaugauuccacuuua

SEQ ID NO: 428962 - RNA, 64 nt, Human
agaccuccccagugacagccuccccagucaucuaggauucaaugacagguaugauuccaguuua

SEQ ID NO: 428963 - RNA, 64 nt, Human
guuagaaauuuucuuuguggcagucauuuauuaaggauucaacucgugauacaccaaaagaaga

SEQ ID NO: 428964 - RNA, 64 nt, Human
ucuuaaaugcuacaugcaacucccagauuccaaaggauucaaguucuaauuauaaccuuugaag

SEQ ID NO: 428965 - RNA, 64 nt, Human
agggaaagagaauaaauuuuagauuauagaacauggauucaaaagugacuggaacaaauuggcu

SEQ ID NO: 428966 - RNA, 64 nt, Human
gaaaaaagaaagaaagaaaaaaggcagaagcccuggauucaaauccgccacacauucaguuucu

SEQ ID NO: 428967 - RNA, 51 nt, Human
ugggucagcugaccagguagaggauucaagacucaauguggaaaaaauauu

SEQ ID NO: 428968 - RNA, 63 nt, Human
cauguugaggguuuugcuggguucucaggcuagugggggcauuaggaacagaccucucauucu

SEQ ID NO: 428969 - RNA, 63 nt, Human
accugccccaccccauccccgcgguugaggcugugggggcagcagaucaggagcccacugaua

SEQ ID NO: 428970 - RNA, 64 nt, Human
guacguuuucuuccaggagacaucaggucccccuggauucaaauuaagugcaauauuuugcaaa

SEQ ID NO: 428971 - RNA, 64 nt, Human
gugguaugguuguauacacaugcugccuucuuggggauucaaaaacagguuuuugauuuugaau

SEQ ID NO: 428972 - RNA, 64 nt, Human
guuugccugacugccuuaugcugguaaagaaaagggauucaacugucucuuuuccaaauaaaaa

SEQ ID NO: 428973 - RNA, 64 nt, Human
ccugucagccaggccugccaggucuucacguugaggauucaacuggccaaucacaggacaggug

SEQ ID NO: 428974 - RNA, 64 nt, Human
aaucuuauacagaagaaacuaacuuagaaacaaaggauucaauauuugcuuauuuauucuuugu

SEQ ID NO: 428975 - RNA, 64 nt, Human
uucacuccagcaucaacaaguggggaauucugauggauucaauucgacuucuuuccaugggcgu

SEQ ID NO: 428976 - RNA, 64 nt, Human
cagacuggguuaagcuaccaaaaaugacaaccagggauucaaaaaaaauuuuuggucauuaaau

SEQ ID NO: 428977 - RNA, 64 nt, Human
uacaauuuguauuacuuucucuguaguuccuaauggauucaauuacggacucuggauauuugca

SEQ ID NO: 428978 - RNA, 64 nt, Human
auguucauguaauguuuggagaguuuuguauuauggauucaacuuauauauaauauauauaagg

SEQ ID NO: 428979 - RNA, 64 nt, Human
acaguuuaacacggccugauucaagacucugauaggauucaaacagauaccgguuaaccaugac

SEQ ID NO: 428980 - RNA, 64 nt, Human
auuucaaaaaaaauguauagaaacuuguauuuggggauucaaaggggauugcuacaccauguag

SEQ ID NO: 428981 - RNA, 64 nt, Human
ucagugagcuaugauuggagggcuuaggucuggaggauucaagaguggaagaggaauuuaaggg

SEQ ID NO: 428982 - RNA, 64 nt, Human
uuugguguuuguuuaauuagcaauagggaugguaggauucaaaugugugucauuuagaagugga

SEQ ID NO: 428983 - RNA, 64 nt, Human
auccccaguuaguuuuuauauaaauaaucuauagggauucaaaaggugucacaguccacuuaau

SEQ ID NO: 428984 - RNA, 64 nt, Human
gcgcaaucucggcucacugcaaccuccgccuccuggauucaaacaauucuccugccucagccuc

SEQ ID NO: 428985 - RNA, 64 nt, Human
cagggaugugucagcccccagccacggggacgcgggauucaagaaugaaguaaauacagucaca

SEQ ID NO: 428986 - RNA, 63 nt, Human
aauaaacuguuauugcauuauaggccccuuuguugggggcagccuguugguccacaccuacuu

SEQ ID NO: 428987 - RNA, 63 nt, Human
gagacaagcucccguggaaaacagacaggagcaugggggcagcugucauggcuguggcgggca

SEQ ID NO: 428988 - RNA, 63 nt, Human
ucuggaauggacugaguccaucguggaaagggcugggggcaggaggagguggggaggggcacu

SEQ ID NO: 428989 - RNA, 63 nt, Human
gacaagucuguggcccagacaggaugccaagucugggggcagcagcaggguccuugagagaac

SEQ ID NO: 428990 - RNA, 64 nt, Human
gccagcccucgguaucugcagguuucucauccauggauucaaccaacugcaaauggaaaauacg

SEQ ID NO: 428991 - RNA, 64 nt, Human
gagaugcaaauucugagcccuuggaguucccaguggauucaaggaaggaagugggaacaagguu

SEQ ID NO: 428992 - RNA, 64 nt, Human
ggucagaccauaaacugcauuuuugauucuuuguggauucaaacccuaggauccaucagucuug

SEQ ID NO: 428993 - RNA, 64 nt, Human
guugaaauaacaacagacaauauuuuagaaggacggauucaaguaccuuuuccuacacagguaa

SEQ ID NO: 428994 - RNA, 64 nt, Human
cauacccggaagaaagaccuauaugaugcgguuuggauucaaguauccugguuagcaagaccac

SEQ ID NO: 428995 - RNA, 64 nt, Human
aucggugagcacuguagccugcgucauggcucaaggauucaaugcauuuuuaagaauuuauuau

SEQ ID NO: 428996 - RNA, 51 nt, Human
cucaagggggcauggaguaauggauucaaagagauucugucuuaccggugc

SEQ ID NO: 428997 - RNA, 64 nt, Human
gaguauugugcacaacuuccuccaccuuucccuuggauucaagugaaaacuguugcauuauucc

SEQ ID NO: 428998 - RNA, 64 nt, Human
auugucucaaugcaaucaaaucaucuuuuacuggggauucaaauaaaauguagcaaauaagaga

SEQ ID NO: 428999 - RNA, 64 nt, Human
gagaaacagguagaccccacagaggagaaggaggggauucaacagcuuuauugucuggaagcag

SEQ ID NO: 429000 - RNA, 57 nt, Human
aauggucguuauugaaaugaaggcuguggauucaaggcucccugccccccagaucau

SEQ ID NO: 429001 - RNA, 64 nt, Human
cucacuggaucccaauccuuggagcuggaucauuggauucaaaucauaauguggauaggauagg

SEQ ID NO: 429002 - RNA, 64 nt, Human
aaagcggaguuggguuugccuuauuuugcucauuggauucaaguucuuuugcauaguuuucuuc

SEQ ID NO: 429003 - RNA, 64 nt, Human
ucucccucuacucacaauacuaaagggaaaaaauggauucaaagcuaggauuucagggcccagc

SEQ ID NO: 429004 - RNA, 64 nt, Human
gcuucagcuucagaagcuguuuguggcauuuguaggauucaaacucauggaaaauucccuccuc

SEQ ID NO: 429005 - RNA, 64 nt, Human
gaaagcaguagacuggaggcuucuacagacuguaggauucaagucugcagggcaggcacucggg

SEQ ID NO: 429006 - RNA, 63 nt, Human
uccuucccuucuguaacuuggagcaggaagucaugggggcagagagggaaaggaggugguuac

SEQ ID NO: 429007 - RNA, 63 nt, Human
uggaagaggccugcucccuggcucugggucugcugggggcacaguaaaucagucuuggcaccc

SEQ ID NO: 429008 - RNA, 63 nt, Human
ggggccugggaggggcaauccucaaaugcggggugggggcagcacaggagggcggccuccuuc

SEQ ID NO: 429009 - RNA, 63 nt, Human
guacagaaaggaaauauucagagacuuuagcauugggggcagauaucuuggccugguuauggg

SEQ ID NO: 429010 - RNA, 64 nt, Human
gcuggccuuugcgccucuagaggcagccacucauggauucaaguccuggcuccgccucuuccau

SEQ ID NO: 429011 - RNA, 64 nt, Human
uccuuccccuccauagggccaggcauuuuuuucuggauucaaacaggcaacaaugaccuuuuau

SEQ ID NO: 429012 - RNA, 64 nt, Human
gcagcagguuugauauucagaaagaaauaugcauggauucaauaaguauauacaucugagcaca

SEQ ID NO: 429013 - RNA, 64 nt, Human
gugcgaucgcggcucaccgcaaccuccgccucccggauucaagcaauucuccugccgcagccuc

SEQ ID NO: 429014 - RNA, 64 nt, Human
ccugaggccaucccacuaacaggagccaggguuaggauucaaaccccauccaacuggucccaga

SEQ ID NO: 429015 - RNA, 64 nt, Human
guagagacaggguuucaccuggucuuaaacucuuggauucaagcgauccucccaccuuggccuu

SEQ ID NO: 429016 - RNA, 64 nt, Human
auaaucaaccugggguucgaaaucagugagaccuggauucaaauucugccuugaaauauuguga

SEQ ID NO: 429017 - RNA, 64 nt, Human
uuuguuuuauaguuauuuacgauuucguuuguuuggauucaagcuuaguuuguuaauauguaua

SEQ ID NO: 429018 - RNA, 64 nt, Human
cuugaucaaaggaauuuuauacauugacucagucggauucaauggacggucacagugcuauuac

SEQ ID NO: 429019 - RNA, 64 nt, Human
acccagcaucaccagcuagaaaguggcagagccaggauucaacccuggcuugucuaaccccagg

SEQ ID NO: 429020 - RNA, 64 nt, Human
ggugauccacccaccugggccucccauagugcugggauucaauuuuuuuuuuuuuuuuuucaaa

SEQ ID NO: 429021 - RNA, 64 nt, Human
gcuaggaucacaccacuaauaagcaacagagccaggauucaaacccagguguggcuccagagcc

SEQ ID NO: 429022 - RNA, 64 nt, Human
cugaagccccuccuugggccggguuguaucaggaggauucaaccccgcuaacauguggggugcc

SEQ ID NO: 429023 - RNA, 64 nt, Human
uuugccauguugcccaggcuggucucgaauuccuggauucaagugauccucccaccucagccuc

SEQ ID NO: 429024 - RNA, 64 nt, Human
gcacgaucucagcucacugcaaccuccaucuccuggauucaaacaauucuccugccucagccuc

SEQ ID NO: 429025 - RNA, 64 nt, Human
gagcuuugggccucaguugcccuggcagaaaaauggauucaacuuggccuuucugaaggcaaga

SEQ ID NO: 429026 - RNA, 63 nt, Human
accuccagcagaagaaaaucaggugucuggucuugggggcacugugcucacuucuagagagaa

SEQ ID NO: 429027 - RNA, 63 nt, Human
agugugugaguggucaccuacuaaacccagcucugggggcagagcugucuuccccaucucugg

SEQ ID NO: 429028 - RNA, 63 nt, Human
gcgggacuccucccuggggguggggcuccuaccugggggcagaacuccuaccugaaggcaggg

SEQ ID NO: 429029 - RNA, 63 nt, Human
aguaugguggugucuagcacugaauggggaaacugggggcagcaacacuuauagccaguuaaa

SEQ ID NO: 429030 - RNA, 64 nt, Human
ccccuauaaccaacacucaacuacaaauaggcugggauucaauguggagugguggauuuccuga

SEQ ID NO: 429031 - RNA, 64 nt, Human
aacaggcuucucuuggcaacagacucaugacaaaggauucaagauuguuugaaaaaaaaaaaag

SEQ ID NO: 429032 - RNA, 64 nt, Human
ggcagccguuguuugcggagcccaggcugacuccggauucaacguugcuggggagagaaaagca

SEQ ID NO: 429033 - RNA, 64 nt, Human
cuuauugugccaauaugcccuccaaacccucccaggauucaaagcuagguuuggcugucuguga

SEQ ID NO: 429034 - RNA, 64 nt, Human
gugauuuguauuugucuccccgcugaaaagaacaggauucaaguccagaguuuucaucuucagc

SEQ ID NO: 429035 - RNA, 64 nt, Human
uaaugcaguuggccgacugggacuuuucaacauuggauucaauggucaaggagaauauuucuga

SEQ ID NO: 429036 - RNA, 64 nt, Human
guggcuuaagagccaaaacugaaauaaaucauuuggauucaaguucaccuguguugugugugca

SEQ ID NO: 429037 - RNA, 64 nt, Human
aguuagggacucugguggcacuacacggggugcuggauucaaaucucaccucuauggaugaugu

SEQ ID NO: 429038 - RNA, 64 nt, Human
caucacuggggucacacucaugugguuguuuucuggauucaauuccuccugggcuauuggccaa

SEQ ID NO: 429039 - RNA, 64 nt, Human
gcaccaucuuggcucacugcaaccucugccuaccggauucaaggaauucucccugccucagccu

SEQ ID NO: 429040 - RNA, 64 nt, Human
gggaaaugagaucccagaguuauuucccaacccaggauucaacaucaauuggguuuugaucuca

SEQ ID NO: 429041 - RNA, 64 nt, Human
gcaugaucucagcucacugcaaccucugccuucuggauucaagugauucuccugccucagccuc

SEQ ID NO: 429042 - RNA, 64 nt, Human
gugugaucucggcucacugcaaccuccaccucccggauucaagugauucuccagccucagccuc

SEQ ID NO: 429043 - RNA, 64 nt, Human
aggauugaugugaagaaauaaagaggcagaagauggauucaauagcucacuaaaauuuuauaua

SEQ ID NO: 429044 - RNA, 64 nt, Human
uugcaucuuaaggacaugaauauucucccauaacggauucaacuaugagaagagaaguggcagc

SEQ ID NO: 429045 - RNA, 64 nt, Human
caguuccccacaaagcaccagagguaggagaccuggauucaagugccagcucugccacugaccc

SEQ ID NO: 429046 - RNA, 63 nt, Human
gagcaagggagauccuggaguuaagacagguguugggggcagccuguauuuuacccuaggggc

SEQ ID NO: 429047 - RNA, 63 nt, Human
gcuccccacgagucaccugcaagccccagggccugggggcagugacuggcaggugcagauggg

SEQ ID NO: 429048 - RNA, 63 nt, Human
auuucccaugaggggccggggcagguggcugggugggggcacaggcuggaguauucuuaguuc

SEQ ID NO: 429049 - RNA, 63 nt, Human
gguucccaacccugcaugcacauucgaaucaccugggggcacaaugccuaggcuccaacccca

SEQ ID NO: 429050 - RNA, 64 nt, Human
ucaugccuccugacucccaaucaguuucacaaagggauucaaucuguuuauauacguuacauuc

SEQ ID NO: 429051 - RNA, 64 nt, Human
cucucuuauuuccauaacacauuugcaucuuucuggauucaagcuuggugguuuucuuuccuaa

SEQ ID NO: 429052 - RNA, 63 nt, Human
cugaugggcacaggaggcaccaauagcgauuauugggggcaaugcgaggucuccuccuaugcc

SEQ ID NO: 429053 - RNA, 63 nt, Human
uccugcugacuggccgaagucuuuuuuaccuccugggggcagggcagacgccgugugucuguu

SEQ ID NO: 429054 - RNA, 63 nt, Human
gauguugaguuuugggauuguuacugguugaagugggggcagaugccugucaccaagguguug

SEQ ID NO: 429055 - RNA, 63 nt, Human
gggaggccaggauggcacuguuggcaccgagguugggggcagaggcccaucuggccugaacug

SEQ ID NO: 429056 - RNA, 63 nt, Human
ccccagaucucuggggcccagccaggcagggugugggggcagcugugccaaucuaccucacag

SEQ ID NO: 429057 - RNA, 63 nt, Human
gggaccaguaggugcccuuccagccugaagaucugggggcacaguauagccacaugagcccca

SEQ ID NO: 429058 - RNA, 63 nt, Human
cccuuccugaccuguccuuuucccacaggccucugggggcagguggcaaggccuggccgggcc

SEQ ID NO: 429059 - RNA, 63 nt, Human
ucccuucucucuuucuaaggacccaaauuucccugggggcauccugcuuccugaaagcuguug

SEQ ID NO: 429060 - RNA, 63 nt, Human
ucaccagguuguagaaguugacaggcagugccaugggggcaacagccaaaauagggggguaau

SEQ ID NO: 429061 - RNA, 63 nt, Human
aaccaugcucuguccaaaugcaagugaggguucugggggcaaccaggaggggggaaucacccu

SEQ ID NO: 429062 - RNA, 63 nt, Human
ggcuccaguagagaaggcaggguugguggugggugggggcagccuguaucagacaaagguaaa

SEQ ID NO: 429063 - RNA, 63 nt, Human
aguguggagagacacauaagccuuacuguccucugggggcaggagccgagccuuuuuguugcu

SEQ ID NO: 429064 - RNA, 63 nt, Human
gaucugggaccucccuccagaauuuccuccagaugggggcagugcccagggagggguuauuug

SEQ ID NO: 429065 - RNA, 63 nt, Human
accccaucagcagugguucuccuacuuucucagugggggcauauccucaagggagaauguugu

SEQ ID NO: 429066 - RNA, 63 nt, Human
guaaggaacugcguuccgccccucaggcccccaugggggcagggaucggcuuggaaaucaacg

SEQ ID NO: 429067 - RNA, 63 nt, Human
uuagcuguuuuucucauuuguugguguguggggugggggcagggguagggcgggagagcgaug

SEQ ID NO: 429068 - RNA, 63 nt, Human
ugagcugggacagguucugguaaaugccaaguaugggggcaucugggcccagggcagcugggg

SEQ ID NO: 429069 - RNA, 63 nt, Human
acagggcauauucuuugcuuccaagauuuggguugggggcacuagggguucagagccuggcag

SEQ ID NO: 429070 - RNA, 63 nt, Human
cuucugcugccuuugccugguccuccagguugcugggggcaccacagacaucaagauuccagu

SEQ ID NO: 429071 - RNA, 63 nt, Human
ugccugaccaucuguguagcuggugugggaaucugggggcauuggagggaggggguuuuauuu

SEQ ID NO: 429072 - RNA, 63 nt, Human
agccuaucaggaaacaggcagaccagggccccgugggggcagcccagaccaguacccuuaccg

SEQ ID NO: 429073 - RNA, 63 nt, Human
uugggccccuuggccccuuccgguucugcuuccugggggcaggguuccugccuuggaccccca

SEQ ID NO: 429074 - RNA, 63 nt, Human
agccccggggcuuggcucccccagcucugagcgugggggcauaggcaggaccccccuuguggu

SEQ ID NO: 429075 - RNA, 63 nt, Human
cuccuacagcccccugccugauccccugcuggcugggggcagcucccaggauauccugccuuc

SEQ ID NO: 429076 - RNA, 63 nt, Human
gaaaucagaggggagcuauccaaaaugggaguuugggggcagcuaaaguugacaugcgaauaa

SEQ ID NO: 429077 - RNA, 63 nt, Human
ggguccugcagggggaggaggacuuggagggucugggggcagcuguccugaaccgacugaccc

SEQ ID NO: 429078 - RNA, 63 nt, Human
ggggagcagcggcugggagugagcagggcagggugggggcagggugggggcacgaagugggcc

SEQ ID NO: 429079 - RNA, 63 nt, Human
gcugggagugagcagggcagggugggggcagggugggggcacgaagugggcccugggugaccc

SEQ ID NO: 429080 - RNA, 63 nt, Human
uuuguuuguuuguuuuaggaggaugguguauggugggggcaauaaaugagguuuuuugcauuc

SEQ ID NO: 429081 - RNA, 63 nt, Human
cucccagcagacugguggcaugcccaguggcuuugggggcaaggauagaaaugccaucaggaa

SEQ ID NO: 429082 - RNA, 56 nt, Human; identical to SEQ ID NO: 47008

SEQ ID NO: 429083 - RNA, 63 nt, Human
caguccauuugucuguguggcaggcuggcuggcugggggcaucugccugucuaugugcuguug

SEQ ID NO: 429084 - RNA, 63 nt, Human
guuggaggacaccccucgccaucucgcccuugcugggggcacgggaguggggggggugacaug

SEQ ID NO: 429085 - RNA, 63 nt, Human
auuguauaugcucucacucugaaauuccaagguugggggcaaugaugaaacuuuguacaguau

SEQ ID NO: 429086 - RNA, 63 nt, Human
acaggauggcacccagagccgcaggacggagacugggggcagcccucacccaacucacaacag

SEQ ID NO: 429087 - RNA, 63 nt, Human
acuacuuuuuuuauaucaaauuuaagcuggauuugggggcauaaccuaauuugagccaacucc

SEQ ID NO: 429088 - RNA, 63 nt, Human
gcauuuucuucugucaggaauggggaaggggagugggggcacaaucugagaaaggacaccugu

SEQ ID NO: 429089 - RNA, 63 nt, Human
uuguaaagccuccaguguccauuccaucccugaugggggcauaguuugagacugcagagugag

SEQ ID NO: 429090 - RNA, 63 nt, Human
aggcccuucuccacccgcaggugggccaagcucugggggcagguggagagggcgggcagggga

SEQ ID NO: 429091 - RNA, 63 nt, Human
cuucucucuucucucaaccccuuuguaaugguuugggggcagacucuuaaguauauugugagu

SEQ ID NO: 429092 - RNA, 63 nt, Human
cuuucuccuuuuggauugaggcuauguacuuggugggggcaggggagggaauauauuauaaua

SEQ ID NO: 429093 - RNA, 63 nt, Human
ugugcagcauuguuggcuguuccugcaguagaaugggggcagcaccuccuaagaaggcaccuc

SEQ ID NO: 429094 - RNA, 63 nt, Human
auggggaagggggacaagggucagucugucgggugggggcagaaaucaaaucagcccaaggau

SEQ ID NO: 429095 - RNA, 63 nt, Human
caucuuggugaaguugccccugggaagggcagcugggggcaguggcgccaguucccuuccaug

SEQ ID NO: 429096 - RNA, 63 nt, Human
gacggugggaagaugccuuacgucugaucuugaugggggcacuggccuggagccugggcccac

SEQ ID NO: 429097 - RNA, 63 nt, Human
cccacccaggcuucaccagcccugugcgggcucugggggcagagguggcagaaauggugcugg

SEQ ID NO: 429098 - RNA, 63 nt, Human
accuuuagccuuuuucuuccuuugcaaaggccuugggggcacuggcugggagucagcaagcga

SEQ ID NO: 429099 - RNA, 63 nt, Human
guuucauuccaaaguguauauuggguucagacuugggggcagaaguucagacacaccgugcuc

SEQ ID NO: 429100 - RNA, 63 nt, Human
uuauacugccgagucugggggcuuguuuugguuugggggcagccauccuccaccagaaagggg

SEQ ID NO: 429101 - RNA, 63 nt, Human
guuguuuaagauucggcaguuuguguggggaggugggggcaggaugggguuugguugccaaaa

SEQ ID NO: 429102 - RNA, 63 nt, Human
uugggggagguagggccuuacgcuuguccucagugggggcaguuugccuuagaugacagcugg

SEQ ID NO: 429103 - RNA, 63 nt, Human
gaaugguugcacguuaaaaauuaaaagaaggaaugggggcagaaugccauauuuuugagggcu

SEQ ID NO: 429104 - RNA, 63 nt, Human
cuggaagccagaagggcuugaggccucuaugggugggggcagaaggcagagccugugucccag

SEQ ID NO: 429105 - RNA, 63 nt, Human
cuguaucagccccaagcaggugguggucccugcugggggcagcaguaccaucuacaucuccuu

SEQ ID NO: 429106 - RNA, 63 nt, Human
uuccaggccacaaauuccaggccuaguucagucugggggcagggucaguccuucucccaggcc

SEQ ID NO: 429107 - RNA, 63 nt, Human
guuuuuucuuuucuacaucuucacagguucggcugggggcagcugauaggccuaaggccauac

SEQ ID NO: 429108 - RNA, 63 nt, Human
uugggcagacaggcugacuggcagcaccagcuuugggggcagaguccuaggaugaggcuuggg

SEQ ID NO: 429109 - RNA, 63 nt, Human
caucucuacuaaaauacaaaaauuauccgggcaugggggcacacaccgguaaucccagcuacu

SEQ ID NO: 429110 - RNA, 63 nt, Human
aacuuuggugcuccagggugggccagcugcuugugggggcaccugggaggucaaaggucucca

SEQ ID NO: 429111 - RNA, 63 nt, Human
gggccaucacaggaugccagccccugccuggguugggggcacucagccacgaccagccccuuc

SEQ ID NO: 429112 - RNA, 63 nt, Human
gccgacuuuguaccccccaaccccugaggaagaugggggcaagaagaucacgcuccccgccug

SEQ ID NO: 429113 - RNA, 63 nt, Human
gucuccccugauccagacaagugggagagcccgugggggcaggggaccuggagcugccagcac

SEQ ID NO: 429114 - RNA, 63 nt, Human
gugcucagguauguaguaaguacuguaguccugugggggcaaauguguagauauuuuuaaaca

SEQ ID NO: 429115 - RNA, 63 nt, Human
ggccagcgggcgcagggcacaccuggccaggcuugggggcagcccaucucagguggcccugca

SEQ ID NO: 429116 - RNA, 63 nt, Human
caguacuuaguccaaaggugcuaacgggggaacugggggcauugugacacccaagucugaugu

SEQ ID NO: 429117 - RNA, 63 nt, Human
ugaugugcuguuuauuuaucagcuugagguccaugggggcagccuugugacuggaagggugga

SEQ ID NO: 429118 - RNA, 63 nt, Human
gaaaaucacucucgggacugccguccucgcugcugggggcauaugccccagccccuguaccac

SEQ ID NO: 429119 - RNA, 63 nt, Human
accucgggucaugauccucugcgugggagggcuugggggcagccugcuccccuucccucccug

SEQ ID NO: 429120 - RNA, 63 nt, Human
agcugggaagauggcugggaagccaggccaaagugggggcaacagcuugcuucucuuucucuu

SEQ ID NO: 429121 - RNA, 63 nt, Human
uucauuggauugggggugaguguuuuguuuuucugggggcagugugagcuuugaggguuggaa

SEQ ID NO: 429122 - RNA, 63 nt, Human
ggguagagggacauccagggaucagggcaugagugggggcaaccccccggccucugcccuggc

SEQ ID NO: 429123 - RNA, 63 nt, Human
gaggaucuaggcuaacaggagagacuccaggagugggggcagaucccaaggcagccuccugcu

SEQ ID NO: 429124 - RNA, 63 nt, Human
uauaagaacaaaaggccugggugccuacccgugugggggcacugugggaagccuuugcuaggg

SEQ ID NO: 429125 - RNA, 63 nt, Human
cuucucuccuguaccauucuguggcuucagccaugggggcaguagcccuucauuaguguagau

SEQ ID NO: 429126 - RNA, 63 nt, Human
gcuaccucgauuccuccuguguuggacagaggcugggggcagugccagccugauucuuccgac

SEQ ID NO: 429127 - RNA, 63 nt, Human
aagcaacaccuuagacagggccugaacccugggugggggcacuggaugccugaaguaaguaag

SEQ ID NO: 429128 - RNA, 63 nt, Human
ugccuccaucuaugggaguucuuucucucagagugggggcaguuucuggcccaggggucugag

SEQ ID NO: 429129 - RNA, 63 nt, Human
ggucagggcucaggcuucacuuuguaaaccaggugggggcaucucacagccugacuucccuuc

SEQ ID NO: 429130 - RNA, 63 nt, Human
cuucuuuaaauaguguuugcugaauuaagccgaugggggcaguggcguuaagugguggaaaaa

SEQ ID NO: 429131 - RNA, 63 nt, Human
uuuccucccccauccccugcagcugccuuuuuuugggggcaggguggggguugauguugaacu

SEQ ID NO: 429132 - RNA, 63 nt, Human
acacaaccacacacacacaaccacacacacaaaugggggcaaccacauccaguacaagcuuuu

SEQ ID NO: 429133 - RNA, 63 nt, Human
uuugcuggccuggcagggggugaaggcaggaguugggggcaggucaggaccaggacccaggga

SEQ ID NO: 429134 - RNA, 63 nt, Human
ccucgggauuggcggguccacuugccagggcucugggggcagauuuguggggaccucagccug

SEQ ID NO: 429135 - RNA, 63 nt, Human
gcuaaguccaacucugugcaaccuacauggaggugggggcagccgaugccugguccaggcugu

SEQ ID NO: 429136 - RNA, 63 nt, Human
gcccaggaguccccuacugcugugggcugggguugggggcacagcagccccaagccugagagg

SEQ ID NO: 429137 - RNA, 63 nt, Human
ggaaaaggcugguacaacggaggccugcgacccugggggcacaggaggcaggcauggcccugg

SEQ ID NO: 429138 - RNA, 63 nt, Human
caguagacacccugcccgugcagagagaugucaugggggcaccugcucucccugauagaugcu

SEQ ID NO: 429139 - RNA, 63 nt, Human
uugaagagaaggggauaggaauguauauuuggcugggggcauggagauguucguauguaugag

SEQ ID NO: 429140 - RNA, 63 nt, Human
gccccugcugacccuggcacccagggaccugccugggggcagagagcugucuuccuccuccga

SEQ ID NO: 429141 - RNA, 63 nt, Human
gagccggcaggugcuucucacaccaggagccucugggggcaggggcuggcuccucgccgcugu

SEQ ID NO: 429142 - RNA, 63 nt, Human
uuaggggaaguauguguggguacaugugaggacugggggcaccugaccagaaugcgcaagggc

SEQ ID NO: 429143 - RNA, 63 nt, Human
auuauuauaauauucuuuuuuuuuucuagaaacugggggcagccucaaaaucauguuaaagag

SEQ ID NO: 429144 - RNA, 63 nt, Human
ugggaggauggaaacagugcagcccaggucccaugggggcagcuccaucccagagcauuucug

SEQ ID NO: 429145 - RNA, 63 nt, Human
gauuuugauagauauccucucagcucucuucccugggggcagauauuucccaauacauaccac

SEQ ID NO: 429146 - RNA, 63 nt, Human
guucuuccaagagcuucuuagaguaguauauuuugggggcagucaaggaauaaacuacagugu

SEQ ID NO: 429147 - RNA, 55 nt, Human; identical to SEQ ID NO: 47073

SEQ ID NO: 429148 - RNA, 63 nt, Human
agauaaggaagggaaguguguggauguggauggugggggcauggacaaagcuugacacaucaa

SEQ ID NO: 429149 - RNA, 63 nt, Human
ugaugauggccuuaaagguggugagggagauacugggggcagagcagacuuugccagugcccc

SEQ ID NO: 429150 - RNA, 63 nt, Human
acagguaauagcccuagccauuggugcacaggaugggggcaaugggaggggaugcuacugaug

SEQ ID NO: 429151 - RNA, 63 nt, Human
ccgccgcagaccuggcgcccccgccuuggcuccugggggcagccagcccuggcugggagagcg

SEQ ID NO: 429152 - RNA, 63 nt, Human
ggcgccaggugcugugcugggcccuugugagugugggggcacaggcugaauuagaugagcucc

SEQ ID NO: 429153 - RNA, 63 nt, Human
ccucgugccccucggccaccugcuggcagccgaugggggcacucggacaucuacaacccugca

SEQ ID NO: 429154 - RNA, 63 nt, Human
gcaaaugaugacagcacuucugguggaugaauuugggggcacaaacagcuuuuuuccucuuuu

SEQ ID NO: 429155 - RNA, 63 nt, Human
agaaauauuacagaauaauuuaagacacuacaaugggggcaaaugaaauaggaaaauuuuuag

SEQ ID NO: 429156 - RNA, 63 nt, Human
aauacagcgacagaccuaucugaaaagucuguuugggggcauacuuuucauaucuuauugacu

SEQ ID NO: 429157 - RNA, 63 nt, Human
ggaagcucuuccuccugccccucccauuccuggugggggcagaggagugucugcagggaaaca

SEQ ID NO: 429158 - RNA, 63 nt, Human
agccucccugcugggacagggaccuauggcaccugggggcagcuuagguuuggguuaaguugu

SEQ ID NO: 429159 - RNA, 63 nt, Human
ccugguuugaauggagauucugauucaguggguugggggcagaguuucugcaguuccaucagg

SEQ ID NO: 429160 - RNA, 63 nt, Human
cucuaacaacgcaguagcauguuagauugaggaugggggcaugacacuccagugucaaaauaa

SEQ ID NO: 429161 - RNA, 63 nt, Human
aauauaauuucacucuuauuuaguauuuuuuccugggggcauuuuuacguaauuuuuuuauga

SEQ ID NO: 429162 - RNA, 63 nt, Human
cugagaaugaaaagguguuugauggacauguugugggggcaccaaugcagaacacugcacuga

SEQ ID NO: 429163 - RNA, 63 nt, Human
cuguguucuuggccugccccugagucuucuggcugggggcagguugccugggcaagaacugcu

SEQ ID NO: 429164 - RNA, 63 nt, Human
cuuuuuaaauauuuuuuaaaauuauuuaaccccugggggcagagacugaggagggaggaugau

SEQ ID NO: 429165 - RNA, 63 nt, Human
uacuguacauauccggggugugugugugugggcugggggcaacccuucuguacagagcuuccu

SEQ ID NO: 429166 - RNA, 63 nt, Human
gaggaaccacacugugcugcggaaacauagacgugggggcauaggcucccacugccaccaccg

SEQ ID NO: 429167 - RNA, 63 nt, Human
aaacagauggcacuuugaaggggccucaccgagugggggcaucaucaaaaacuuuggaguccc

SEQ ID NO: 429168 - RNA, 63 nt, Human
ucucucaaggggaggcucaacagaacauugaccugggggcaaacuuuccucuugaaugggaac

SEQ ID NO: 429169 - RNA, 63 nt, Human
ccccucagucccaggagagcuaugaggccucacugggggcagaacuuggggagaccgaagccg

SEQ ID NO: 429170 - RNA, 63 nt, Human
ggcauuccagaaagaagaguaguuaagcagaugugggggcagggcaagaggagacagcaccuu

SEQ ID NO: 429171 - RNA, 63 nt, Human
uggcgagcaagcucgcuuuuuaaaaaugaaauuugggggcaggggaaggggaggcgggaggga

SEQ ID NO: 429172 - RNA, 63 nt, Human
agaaggugguggaugcuuucuagaugucgaugcugggggcagugcuuuccauaaccaccacug

SEQ ID NO: 429173 - RNA, 63 nt, Human
gguggugaagaaaucucaaucggacaccagaggugggggcaacucugcaagcucaccugcugg

SEQ ID NO: 429174 - RNA, 63 nt, Human
uuggugaaggcaaguucaagcaccacuugagacugggggcagcauggaguagggcagggcuac

SEQ ID NO: 429175 - RNA, 63 nt, Human
uucuuagcaaaaaaugaacagugauaaguauacugggggcaaaaucagaauggaaugcucugg

SEQ ID NO: 429176 - RNA, 63 nt, Human
guguuuuuuugaggggaauuaaggaaaaauaagugggggcagguuuggagagcugcuuccagu

SEQ ID NO: 429177 - RNA, 63 nt, Human
ugccacuucugggugagauuaaggugcagggccugggggcaggaggacauaagguauagccau

SEQ ID NO: 429178 - RNA, 63 nt, Human
auucacuaaggaaggaauugggaacacaaagggugggggcaggggaguuuggggcaacugguu

SEQ ID NO: 429179 - RNA, 58 nt, Human; identical to SEQ ID NO: 47105

SEQ ID NO: 429180 - RNA, 63 nt, Human
guagggaaaugaguguucccuggaacaaggaggugggggcaguguggccccuuccccaacugg

SEQ ID NO: 429181 - RNA, 63 nt, Human
ugggaaggcugggaggccucccauccaggacacugggggcaggagugucaucuuuugggcagg

SEQ ID NO: 429182 - RNA, 63 nt, Human
ccucuguucuccagcugaaccauacccuggcugugggggcaucuguccugagcuuggcuggug

SEQ ID NO: 429183 - RNA, 63 nt, Human
auccuaagcagccccacagcccaguguucuccuugggggcaggaaccuggggaggggcccaga

SEQ ID NO: 429184 - RNA, 60 nt, Human; identical to SEQ ID NO: 47110

SEQ ID NO: 429185 - RNA, 63 nt, Human
aauuguaaauaacauaugacuucugaguacuuuugggggcacaacuguuuucuguuugcuguu

SEQ ID NO: 429186 - RNA, 63 nt, Human
caagauaaacuucuguaaccuaugcauauuuuaugggggcaguauuauuacaaauggaucuga

SEQ ID NO: 429187 - RNA, 63 nt, Human
caaugucucauaaagacucggguaguuuuucuuugggggcauugaucucaguuuuucuguaag

SEQ ID NO: 429188 - RNA, 63 nt, Human
cgaugaugggcagugggggguggaaugcaugugugggggcagagguuaugugggaaaucucug

SEQ ID NO: 429189 - RNA, 63 nt, Human
gggguggcgggcggcgggcggcgggcaggcgggugggggcacaccccucguaccugucacugg

SEQ ID NO: 429190 - RNA, 63 nt, Human
guggcugcugaacagccgcaaaccaucuucaccugggggcauugaguggcgcagagccggguu

SEQ ID NO: 429191 - RNA, 63 nt, Human
cugaauaaagugcagggcguaauagugacuggcugggggcacugggccuuuguguuuuuuuuc

SEQ ID NO: 429192 - RNA, 63 nt, Human
aaagaagagacagccauagacgaggagccagagugggggcagacuggccauuuuuauuuugaa

SEQ ID NO: 429193 - RNA, 63 nt, Human
aggggcugauccugccucagcuguguggccaugugggggcagcaggggccugggccauagcug

SEQ ID NO: 429194 - RNA, 63 nt, Human
accggccccuggcagcacagcccagggccugcaugggggcaccgggcuccaugccucuggagg

SEQ ID NO: 429195 - RNA, 63 nt, Human
agggcacccagaagagucugguguacggccucgugggggcaggggucgugcugaugcugauca

SEQ ID NO: 429196 - RNA, 63 nt, Human
cuuaaauauauuuugucaucauaaucuuuauggugggggcagacuuugcacuuacugcagugc

SEQ ID NO: 429197 - RNA, 63 nt, Human
guugaauugcuauguucaggauguucuagggggugggggcagggacucuuuucguaauaagca

SEQ ID NO: 429198 - RNA, 63 nt, Human
accugggguaagggugcgcagggaggccgggcuugggggcagccugcugcuauguccuugcug

SEQ ID NO: 429199 - RNA, 63 nt, Human
aauauccaucuacacagcacccaaggggagggcugggggcaccggcacgggggcagcgugcag

SEQ ID NO: 429200 - RNA, 63 nt, Human
gaggcccaccgaaggguacugaagagccucaccugggggcauuuuguggguggagggccagag

SEQ ID NO: 429201 - RNA, 63 nt, Human
augugguuucuuuguuguuguuuuuguuuggggugggggcaaguacaggguaauucaugagca

SEQ ID NO: 429202 - RNA, 63 nt, Human
agggguuugaaggaaguuggaaguggggaggggugggggcaucuggucucagaaauggaccag

SEQ ID NO: 429203 - RNA, 63 nt, Human
cacgcccugcuggaccggccuuaggggugaaggugggggcacagggcccaccccgcccgggac

SEQ ID NO: 429204 - RNA, 63 nt, Human
uacagcggaugucaacugguuguggugauggggugggggcagaacaugaguagcaaagaaaag

SEQ ID NO: 429205 - RNA, 63 nt, Human
agaggaaaaacuuggggaggaagaggccugcugugggggcaucggagccagccauguaagaau

SEQ ID NO: 429206 - RNA, 63 nt, Human
gaaaagagaagggcugcucagggaaacauuggcugggggcacggaauaagcacauaguaaaaa

SEQ ID NO: 429207 - RNA, 63 nt, Human
caucgccaggcggccucccugcaaaccaagggcugggggcaaaggggcaugauccaggguccc

SEQ ID NO: 429208 - RNA, 63 nt, Human
ggaauggguacugucuaggaggacugggcagggugggggcaacccagaggacccauggcuagc

SEQ ID NO: 429209 - RNA, 63 nt, Human
gagcaccuccacuucuagggaagauggacagcgugggggcacaccugggccucccggaagcug

SEQ ID NO: 429210 - RNA, 63 nt, Human
cuggaaggaauccaagcaggaguuucaucugcaugggggcacucugcaggcccuggaacauug

SEQ ID NO: 429211 - RNA, 63 nt, Human
ccacauagaaucaacauaugguagggauuacagugggggcauuucuuuauaucaccucuuaaa

SEQ ID NO: 429212 - RNA, 63 nt, Human
acaaaacagagcaagaguuauaaccuucagaugugggggcagaauaggacccauuugggcaga

SEQ ID NO: 429213 - RNA, 63 nt, Human
ugccggaacucgcuaucccuguugucuaccugcugggggcacugaccagugagcggccgcugg

SEQ ID NO: 429214 - RNA, 63 nt, Human
uuggugagaggucgcccugccucacuggcacccugggggcacagcuggaagagaggccuggcc

SEQ ID NO: 429215 - RNA, 51 nt, Human; identical to SEQ ID NO: 47141

SEQ ID NO: 429216 - RNA, 63 nt, Human
caugagcccugucugccagcccaccccagggacugggggcagcaccaggucccggggagaggg

SEQ ID NO: 429217 - RNA, 63 nt, Human
auugauacccaguuaauuuuguuugcuaaaggaugggggcaauaaucggcccuugaggagcug

SEQ ID NO: 429218 - RNA, 63 nt, Human
ccuauagcacugagcucacaugggacugggauaugggggcaucucuuccccagagaggcacuc

SEQ ID NO: 429219 - RNA, 63 nt, Human
cggaagggacucugggcugugccugaggcuggcugggggcaggacaacacagcugcuucccca

SEQ ID NO: 429220 - RNA, 63 nt, Human
ccugugccccuuuucaugguaccaggcccgcacugggggcaauugacuuccuccaauccccac

SEQ ID NO: 429221 - RNA, 63 nt, Human
uggugccagcuucugagggccugcuuggccuccugggggcaaagccccucugcccgaagcaau

SEQ ID NO: 429222 - RNA, 63 nt, Human
aagcuuuaucugucuugacuuuuuaaaaaaguuugggggcagauucugaauuggcuaaaagac

SEQ ID NO: 429223 - RNA, 58 nt, Human; identical to SEQ ID NO: 47149

SEQ ID NO: 429224 - RNA, 63 nt, Human
ugguaccagaggauggugaggcgaaggccagguugggggcaguguuguggcccuggggcccag

SEQ ID NO: 429225 - RNA, 63 nt, Human
aacaccuuauuuuaggacccuuuccguuggggaugggggcaagggugggagguuuuuagaaga

SEQ ID NO: 429226 - RNA, 63 nt, Human
uuaccauaucccuggaacuccuucucaggcuggugggggcagccuugcaagagaaacagcagc

SEQ ID NO: 429227 - RNA, 63 nt, Human
ccaggucucugccuucauuguugcuuuuucuggugggggcaaggggagcugguauggauggaa

SEQ ID NO: 429228 - RNA, 63 nt, Human
gcugcccucuccccagccuggcguggcuggggcugggggcagccuuggcccagcuccguggcu

SEQ ID NO: 429229 - RNA, 63 nt, Human
ucugggguagggagcagggcugggcaggcauucugggggcagggugggggaggggcgagagua

SEQ ID NO: 429230 - RNA, 63 nt, Human
ucuguacgcguugaacaacuugguucaagauggugggggcauuuuuagagcggcaauaauuga

SEQ ID NO: 429231 - RNA, 63 nt, Human
caauggggagccccaggugaggagagaagcaucugggggcacuccaaaaggggccugugaugu

SEQ ID NO: 429232 - RNA, 63 nt, Human
caaagcccaacagcaagggugacuccuggcaggugggggcagcaggagggcagagggcagagc

SEQ ID NO: 429233 - RNA, 63 nt, Human
ccguuccagaaccucggucaguguuucccugucugggggcagggcccagagcgagcacgcguc

SEQ ID NO: 429234 - RNA, 63 nt, Human
gggggaaauggaaaguuuuccucaaggagcagcugggggcagaauagguaguauuuaagcaaa

SEQ ID NO: 429235 - RNA, 63 nt, Human
caccugcaccacggccauggggaggcugcucccugggggcagagucucuggcagagguuauua

SEQ ID NO: 429236 - RNA, 63 nt, Human
ggcucuaacugcccccuacuggugucuggggguugggggcagccaggcacagccggcucacgg

SEQ ID NO: 429237 - RNA, 63 nt, Human
cugcccccucuuccuuagcagacgaaccaguaaugggggcaaggcuggggcaucccagcccac

SEQ ID NO: 429238 - RNA, 63 nt, Human
uggagauggacccgugaccucguggaggccgugugggggcagcagccuggccugugccauggu

SEQ ID NO: 429239 - RNA, 63 nt, Human
ggagcggaauuuaccugauuucuucagggcugcugggggcaacuggccauuugccaauuuucc

SEQ ID NO: 429240 - RNA, 54 nt, Human; identical to SEQ ID NO: 47166

SEQ ID NO: 429241 - RNA, 63 nt, Human
gaagggcagagugcugguuucuccagguuggguugggggcacugcuguccccccuccagcuag

SEQ ID NO: 429242 - RNA, 63 nt, Human
ggcugcugggggagccgugucacuccugggccaugggggcaccuccugggcacuuagguguuu

SEQ ID NO: 429243 - RNA, 63 nt, Human
gucuucuacugaaggacaguccgcugucuccagugggggcagcagcugucccccagccucgau

SEQ ID NO: 429244 - RNA, 63 nt, Human
ggggccacugggccagcgccuggcgauacugguugggggcaggaucauucugccccuugucca

SEQ ID NO: 429245 - RNA, 63 nt, Human
uuuuugaaacaaaauaauguguaauuuuccauuugggggcaaacucuauucuugugagcauua

SEQ ID NO: 429246 - RNA, 63 nt, Human
ccugggguggccuguccugcaggggcccuggaaugggggcaagcagcugggugggcagaaugc

SEQ ID NO: 429247 - RNA, 63 nt, Human
gucagaauccguuccugagcagcuccugugcccugggggcagucacagagccccccaacaccc

SEQ ID NO: 429248 - RNA, 63 nt, Human
agcuccacauucugguguaguuuaaaaugccuuugggggcaguuugaagcaguucuucaugcc

SEQ ID NO: 429249 - RNA, 63 nt, Human
uggcugacaguuaucuuccaaccccaacuggcuugggggcaggacaagggcuaggcuugaugg

SEQ ID NO: 429250 - RNA, 63 nt, Human
uuggccuggacagcacugauuuguggauguggaugggggcacguuguccgugauaaaaguaca

SEQ ID NO: 429251 - RNA, 63 nt, Human
agggacagagagaggagaggaggaagauugagcugggggcaacagccaagcucaccugggcag

SEQ ID NO: 429252 - RNA, 63 nt, Human
aucuccagagcuaccgaguucaucuguggguguugggggcaagugggggcugaaguccugugc

SEQ ID NO: 429253 - RNA, 63 nt, Human
cagcagcagccuggcugccuugucauggccuccugggggcagaaggcgauguggaccacggga

SEQ ID NO: 429254 - RNA, 63 nt, Human
ggcggaggugggguuggucuggaagaagguccaugggggcagggaguugcgaggugggguuag

SEQ ID NO: 429255 - RNA, 63 nt, Human
gagcagccuuuuaaaagcaaauugcgccauagcugggggcagcgggggugggcgaggccugag

SEQ ID NO: 429256 - RNA, 63 nt, Human
ggagggaggcaggcauagcaucugaacccagugugggggcauucacuagaaucuucaaucaac

SEQ ID NO: 429257 - RNA, 63 nt, Human
cauccacccgcuucagggaggaacuggacucucugggggcaggugccaagauuugccccccca

SEQ ID NO: 429258 - RNA, 63 nt, Human
ccuccucacuauucucaccaggccaugggacuuugggggcagugagagagagcuggaaagggg

SEQ ID NO: 429259 - RNA, 63 nt, Human
acagcucacccccaccagcaugauggccccagcugggggcaguggcaggagccuuacuuuugu

SEQ ID NO: 429260 - RNA, 63 nt, Human
ggugggccugaggcaggcagccgaccugaggccugggggcaccguggaccccuaugcccgggu

SEQ ID NO: 429261 - RNA, 63 nt, Human
ccacagaucccagagauaggggcccagucuccaugggggcaaggagcauagagauguuuucca

SEQ ID NO: 429262 - RNA, 63 nt, Human
ugggugggccacacucagccugacugcccuccaugggggcauucuggcacccccugcuccagg

SEQ ID NO: 429263 - RNA, 63 nt, Human
cuuuucccgagauucaaaucuccgauucccauuugggggcaaguuuuuuucuucaccuucaau

SEQ ID NO: 429264 - RNA, 63 nt, Human
uucggggucucagcccccaggcugugagcuccuugggggcaggcccucaauaaaugugaacug

SEQ ID NO: 429265 - RNA, 63 nt, Human
aguggguguggaauugcuuuccucgggccaccgugggggcaccucuggccucccgugaccccc

SEQ ID NO: 429266 - RNA, 63 nt, Human
cccuucugccucugccccguuggaugcccugacugggggcaggggaagagacagggcacagcu

SEQ ID NO: 429267 - RNA, 63 nt, Human
gcuucaagauccaucgccuuggccugaucgcugugggggcaggggccuggaguacgaggggca

SEQ ID NO: 429268 - RNA, 63 nt, Human
acugggaugugguagagggacugaagguaccuuugggggcaacagcacccuaguuucauucuc

SEQ ID NO: 429269 - RNA, 63 nt, Human
ccuccaggcuucacccucccugccuaagcagggugggggcagagccaugacauuuuugguuua

SEQ ID NO: 429270 - RNA, 63 nt, Human
ccuucacucuaauggacuguuccagggaagggaugggggcagcagcugcuucggauccacacu

SEQ ID NO: 429271 - RNA, 63 nt, Human
cuuccuggcccugugcuggggguggggggaagcugggggcacauguggcccuugccuucugag

SEQ ID NO: 429272 - RNA, 63 nt, Human
cugcguaggcaagaaguugaaaaacaguugauuugggggcacuuagguaccauaugccccauu

SEQ ID NO: 429273 - RNA, 63 nt, Human
gggaugccccaucccccuccccaucaccuuuggugggggcagggccugguggcaccugugcaa

SEQ ID NO: 429274 - RNA, 63 nt, Human
ccaggacauugaguuggaagacuaugaucugggugggggcaggauaacauggcuucucuuuac

SEQ ID NO: 429275 - RNA, 63 nt, Human
aggggaggacacuggugguucuacugacccaacugggggcaaagguuugaagacacagccucc

SEQ ID NO: 429276 - RNA, 63 nt, Human
aaccagcaccucccaccaaccaaccacacccggugggggcacagcacagaccccagagccagg

SEQ ID NO: 429277 - RNA, 63 nt, Human
aaccagcaccucccaccaaccagccacacccggugggggcacagcacagaccccagaggcagg

SEQ ID NO: 429278 - RNA, 63 nt, Human
aaccagcaccucccaccaaccagccacacccagugggggcacagcacagaccccagagccagg

SEQ ID NO: 429279 - RNA, 63 nt, Human
caccccacccccacaccuggacgcucgcucuggugggggcacacgcagguggaggugguugug

SEQ ID NO: 429280 - RNA, 58 nt, Human; identical to SEQ ID NO: 47206

SEQ ID NO: 429281 - RNA, 63 nt, Human
uggcggcugcugucugagccccgggagaccaggugggggcaggacuguggcccuugugggggc

SEQ ID NO: 429282 - RNA, 63 nt, Human
cagccaggaaccucucagagcugaagcaggcccugggggcagaagugccagaugacagucaga

SEQ ID NO: 429283 - RNA, 51 nt, Human; identical to SEQ ID NO: 47209

SEQ ID NO: 429284 - RNA, 63 nt, Human
ugcaucacuccacugcacaguguuagugggaccugggggcaagucccuugacuucucugagcc

SEQ ID NO: 429285 - RNA, 63 nt, Human
aaacaaguccuaucuuuuuuuuuuuggcuggggugggggcauuggucacauaugaccaguaau

SEQ ID NO: 429286 - RNA, 63 nt, Human
ugccucucagacugagaacucuuuucuucuugcugggggcauugcuaucucuaggauguuugc

SEQ ID NO: 429287 - RNA, 63 nt, Human
uguagggggggcauuuuugguugcccccaugcgugggggcacuacuaagaaugcuaaacuuag

SEQ ID NO: 429288 - RNA, 63 nt, Human
aggccucuggagaagaccuggggugggggcugaugggggcaggcccacagugagagacugccu

SEQ ID NO: 429289 - RNA, 63 nt, Human
agauggacgcugcccauccuugagccagccagcugggggcagagagguggguggcgggcaccu

SEQ ID NO: 429290 - RNA, 63 nt, Human
gcaccugcccucugcagcccucugccagccucuugggggcaguuccggccucuccgacuuccc

SEQ ID NO: 429291 - RNA, 63 nt, Human
gauuuguucagggugccaguagugggcauggggugggggcaaggcaggacaaaacauacaagu

SEQ ID NO: 429292 - RNA, 63 nt, Human
guugggaggccucucugggccuggaggugggggugggggcagccaaguccagccacucuucac

SEQ ID NO: 429293 - RNA, 63 nt, Human
gcuccucugaccucccggucucccucugcaggcugggggcagaggccugaggacaaggaagag

SEQ ID NO: 429294 - RNA, 63 nt, Human
aguguccagagcugccuccccaggagguuaaggugggggcaaaggggaagcuucaagcacuuu

SEQ ID NO: 429295 - RNA, 63 nt, Human
ugaugagucagaagauucagcagcucacagcccugggggcagcucaggcuacugcuaaggccu

SEQ ID NO: 429296 - RNA, 63 nt, Human
cccugccagccaccugcaccuguggacagugggugggggcacuacuccccacucagagcacaa

SEQ ID NO: 429297 - RNA, 63 nt, Human
guccucacaacucuuaauugggccuagugaaaaugggggcaggugagaaguccauuuugagaa

SEQ ID NO: 429298 - RNA, 63 nt, Human
aaacggggcaccacaggaucccugugcaagggcugggggcacgcucuggccccaggcuugugc

SEQ ID NO: 429299 - RNA, 63 nt, Human
ccuugcuuuguauuuaaggacuggggcauagcaugggggcagucccccagaccucuucauucc

SEQ ID NO: 429300 - RNA, 63 nt, Human
uuauuuaugggauccuggaguucugguuccuacugggggcaacccuggugaccagcaccaucu

SEQ ID NO: 429301 - RNA, 63 nt, Human
ucuucacagucaaagcauuuauauuauugggggugggggcagggaauuaaguuggugggcucg

SEQ ID NO: 429302 - RNA, 63 nt, Human
ggaguugcuguuuguuugacaaagaaacccaagugggggcagagggcagaggcuggaggcagg

SEQ ID NO: 429303 - RNA, 63 nt, Human
gauugcacugggccaucagcucaugccaggcuaugggggcagccaguuggcauugcuccccag

SEQ ID NO: 429304 - RNA, 63 nt, Human
ccgccuccuccgcuuggggggccggagagauggugggggcagcuccucuucuucugacucaga

SEQ ID NO: 429305 - RNA, 63 nt, Human
ggagagucaccgagggcccauguggcuggagguugggggcaggaucuggcccgagcucuccuc

SEQ ID NO: 429306 - RNA, 63 nt, Human
aacuggcggguggugugugugcagcaaaggcauugggggcacgggugagaugcccacugugug

SEQ ID NO: 429307 - RNA, 63 nt, Human
gccucugugccccguccuugugccaggucaaggugggggcaggcugggcccugcauuucuggg

SEQ ID NO: 429308 - RNA, 63 nt, Human
ggucuagccgggcccauugcagggggcagcacuugggggcaucuccggcacuugggugggacc

SEQ ID NO: 429309 - RNA, 63 nt, Human
ggcugccugcugugcugggagguauagggguccugggggcaggccagggcaguugacagguac

SEQ ID NO: 429310 - RNA, 63 nt, Human
cuauaacucuagcauccccaucccauuugacacugggggcaaggguucuucuugcaugugggg

SEQ ID NO: 429311 - RNA, 63 nt, Human
caaaggaccagguaauuggggaggggagagaggugggggcaagggggaaaugcccccccaucu

SEQ ID NO: 429312 - RNA, 63 nt, Human
auauuuucaaaauuacaaugcauuuauggugucugggggcaggggaacaucagaaagguuaaa

SEQ ID NO: 429313 - RNA, 63 nt, Human
ccucucugugccucaguuuccucaucugcaaaaugggggcaauaugucaucuaccuaccucaa

SEQ ID NO: 429314 - RNA, 63 nt, Human
acgauguguuuguuccagugauacugaaaguagugggggcaagaauugaguuucacaguggaa

SEQ ID NO: 429315 - RNA, 63 nt, Human
gcaccacugugugccuggcccugugcugggcacugggggcacucccugcaggagccaucaucu

SEQ ID NO: 429316 - RNA, 63 nt, Human
agugcacuggcccucuuugaaagggcuuuacagugggggcaccaagaccccaaagggcccagg

SEQ ID NO: 429317 - RNA, 63 nt, Human
uugguuggaccugcccacuccaaaaacccagugugggggcaaagggcgugggaagagcagggc

SEQ ID NO: 429318 - RNA, 63 nt, Human
agggaaugccagcaaucaggcagcacccagcugugggggcaguggggugggggagacccacau

SEQ ID NO: 429319 - RNA, 63 nt, Human
gacgcgggcacccgucaugcuuuugcugagaguugggggcauuaaccuugagcuaauguuaaa

SEQ ID NO: 429320 - RNA, 63 nt, Human
uuauuuuggagccaaaaaauugauucuggggggugggggcagcguagaagugguauauccaag

SEQ ID NO: 429321 - RNA, 63 nt, Human
gaugcuaccucacaacacaaacagguaguucguugggggcaaaugaauuagccaacuguuaac

SEQ ID NO: 429322 - RNA, 63 nt, Human
agguguauaaggaacaaugucuuauaaacagcaugggggcaaucugagaauauuccucaaaag

SEQ ID NO: 429323 - RNA, 63 nt, Human
uuuuuaaugacuccauuuaaaaauaucacagggugggggcaaggaaauuagcugagauucauc

SEQ ID NO: 429324 - RNA, 63 nt, Human
uccaauacgaguccaggggugaccgcaggauggugggggcagcgggcuucuccaccuacccca

SEQ ID NO: 429325 - RNA, 63 nt, Human
ugauuuacaccacuguaccauacugacccaggcugggggcagguguguuggagacaggcuggu

SEQ ID NO: 429326 - RNA, 63 nt, Human
ucuucucuaagaccuggaaagucagcaacccucugggggcagcaggacugggcagaucccagg

SEQ ID NO: 429327 - RNA, 63 nt, Human
agagacuuaaugguaugauguguacauagggacugggggcaggauuggggguuucggagcuug

SEQ ID NO: 429328 - RNA, 63 nt, Human
cuucccauugucaagaugugccacgggugccacugggggcacacugaacuuguagggagugug

SEQ ID NO: 429329 - RNA, 63 nt, Human
ccagccugcuccuucccaggaguggaggaggccugggggcagggagaggagugacugagcuuc

SEQ ID NO: 429330 - RNA, 63 nt, Human
acuggacagaccuugguuuguuuacauguccgaugggggcaggagcucccauccugggcagcc

SEQ ID NO: 429331 - RNA, 63 nt, Human
uuuggcuucacgccaucaggccucaagugggcaugggggcagggacgggcccaggaacuguug

SEQ ID NO: 429332 - RNA, 63 nt, Human
ccacugugccuucccggccucccgggcuucugcugggggcagaagaaaugccuccccaggucu

SEQ ID NO: 429333 - RNA, 63 nt, Human
ccuccacacaggcauccucagggcacagggcccugggggcaccuuccuccuuucguauuuguu

SEQ ID NO: 429334 - RNA, 63 nt, Human
aguuuuagaaagugaaaaaaguuaaaaaagaaaugggggcaguggguuauuagaaauaacaua

SEQ ID NO: 429335 - RNA, 63 nt, Human
uuucuuacaugcauauauugcaucguggugaagugggggcaguuccuuuugauugcugaguag

SEQ ID NO: 429336 - RNA, 63 nt, Human
gggaagccuaggcugccucaauggaggagucgcugggggcauuuucacccacaauucuggcca

SEQ ID NO: 429337 - RNA, 63 nt, Human
cagaacugugaauggccugcuccaggccauggcugggggcagggagugaggggacaauuucug

SEQ ID NO: 429338 - RNA, 63 nt, Human
uuuuuagauucuucugcucccuagugaccuaccugggggcaaagaaauugcaaggacuuuuuu

SEQ ID NO: 429339 - RNA, 63 nt, Human
uaacuucugagcccaccucccaggguaggcaccugggggcaugcaggugcccaccucccaggg

SEQ ID NO: 429340 - RNA, 63 nt, Human
gcaugcaggugcccaccucccaggguaggcaccugggggcaugcagguacccaccucuuucuc

SEQ ID NO: 429341 - RNA, 63 nt, Human
aucugggagggaagaugggugcugggagaggguugggggcagggggcaaggaaaauugcuacc

SEQ ID NO: 429342 - RNA, 63 nt, Human
ugcuagcugagcacuuccacaagggcauaccccugggggcaggggcuggggcugagaacugca

SEQ ID NO: 429343 - RNA, 63 nt, Human
uccucaucaccugugucuuugcugcuuuuguuuugggggcauucauugcagguguggcaguau

SEQ ID NO: 429344 - RNA, 63 nt, Human
ccuggagccagaggguuuucuaaaugagauaacugggggcaaagguugggauaggcgcagcag

SEQ ID NO: 429345 - RNA, 63 nt, Human
augagcauucaagugauucugaugcaggugagcugggggcauacagggaggaacacugcccug

SEQ ID NO: 429346 - RNA, 63 nt, Human
cuguccaggcuccauucagguccugcuguacucugggggcagggagaggcuagaggggcagga

SEQ ID NO: 429347 - RNA, 63 nt, Human
gcacuuucccggggagagaaccaguaugagaagugggggcagggcacacauucaucuuuguag

SEQ ID NO: 429348 - RNA, 63 nt, Human
aaugagaagccauccauggaaauuugaacugagugggggcagagaaagagugcagaucccuuu

SEQ ID NO: 429349 - RNA, 63 nt, Human
ucaggaaggcuucuugcuuacaggaaugaaggcugggggcauuuugcuggggggagaugaggc

SEQ ID NO: 429350 - RNA, 63 nt, Human
uggcuggugcuguaacaaagacccaugugaugcugggggcagagacagaggagaagcuguuug

SEQ ID NO: 429351 - RNA, 63 nt, Human
ccgggccacucugcuagaguccauccgccaagcugggggcaucggcaaggccaagcugcgcag

SEQ ID NO: 429352 - RNA, 63 nt, Human
ccgagauguggcccuugcacuagcagcucuggaugggggcaggagccuggaagagcuaacucg

SEQ ID NO: 429353 - RNA, 63 nt, Human
acccugacccuggcucaccccucuuccuaggccugggggcaggcaguuccuaccauguacccc

SEQ ID NO: 429354 - RNA, 63 nt, Human
gccagugccccccugaggacuagggcaggcagcugggggcacuugguuccauggagccuggau

SEQ ID NO: 429355 - RNA, 63 nt, Human
accuccacacagccgaagcacccggcaucuuggugggggcaccuuuuuaaacauuuuuuuuuu

SEQ ID NO: 429356 - RNA, 63 nt, Human
ccuagagguuuuguucguacucuuaacagggagugggggcaggaagaguccuguacuaugcag

SEQ ID NO: 429357 - RNA, 63 nt, Human
caagggauguaagggauauggcuugaggagggaugggggcaggaaugagggaaggucuugggu

SEQ ID NO: 429358 - RNA, 63 nt, Human
gccuuagcucuagagugagggguggguggaaccugggggcaccucguucacccuguccccacu

SEQ ID NO: 429359 - RNA, 63 nt, Human
cauucauccuucguaucacugcagaagcaacagugggggcacagggagggaacucuugacacu

SEQ ID NO: 429360 - RNA, 63 nt, Human
caaaugcuuggugguucgacuucucccucugucugggggcaggcucagcaucugcccacuggu

SEQ ID NO: 429361 - RNA, 63 nt, Human
gccaagggcugaaggagguacccucuuggcagaugggggcaucacuugcuuccuuugggaagc

SEQ ID NO: 429362 - RNA, 63 nt, Human
aggcuuugcuggcuguggugauggggauugaguugggggcaagggucccugccuagacuguug

SEQ ID NO: 429363 - RNA, 63 nt, Human
ucucacagacccuagguauccacagcugugacaugggggcaagcggcuuuguuucagccuaac

SEQ ID NO: 429364 - RNA, 63 nt, Human
caucuggaccaguagcccaucccgcaguuuucuugggggcagaggaaaacgcuucuuucuccu

SEQ ID NO: 429365 - RNA, 63 nt, Human
cuuugcucaguggaucacacacauggaaggugaugggggcauggguggagggucccuaauucu

SEQ ID NO: 429366 - RNA, 63 nt, Human
uuuauuuuaaugaaguguuauacaaucaagaaaugggggcaagggccugccccccacucccuc

SEQ ID NO: 429367 - RNA, 63 nt, Human
ugggagggaggaacaccggugccucggucacucugggggcaguuuagaugcugugaaauuaaa

SEQ ID NO: 429368 - RNA, 63 nt, Human
gcagccuccuuccuguaggcgagggcccaagucugggggcagaaccugaguguggauggggcg

SEQ ID NO: 429369 - RNA, 63 nt, Human
gcugcacaccgugaagauguggagggcguagggugggggcagugaggaauggguccguacagc

SEQ ID NO: 429370 - RNA, 63 nt, Human
gucugcucugccucgguuuccccaucuggaaaaugggggcagggguccugaccuaccucaggu

SEQ ID NO: 429371 - RNA, 63 nt, Human
ugcuuggaugcgagcuuggccuugggccggugcugggggcacagcugucugccaggcacucuc

SEQ ID NO: 429372 - RNA, 63 nt, Human
accagccgcccagaucaugccgccgcagcugguugggggcaccaucuggacggggaugguucc

SEQ ID NO: 429373 - RNA, 63 nt, Human
acucagugcugguuuguaaauggugaggggacuugggggcaucccagagugcucccuccaggc

SEQ ID NO: 429374 - RNA, 63 nt, Human
auauuuuuggaauaaugugaaucaaccgaaaacugggggcaaggcagaggacagguuuucuca

SEQ ID NO: 429375 - RNA, 63 nt, Human
ucccuaacucccugaccugagaacccuggggccugggggcaguuugagccuccucucccuucu

SEQ ID NO: 429376 - RNA, 63 nt, Human
ugcucugcccucagaccuggccaggugaugcucugggggcagcaucuccccaccgagagaagc

SEQ ID NO: 429377 - RNA, 63 nt, Human
ugaucccugccugugagccacaccuccuagcucugggggcaaaggggcuuaguaaaggaaugc

SEQ ID NO: 429378 - RNA, 63 nt, Human
uccaaucagaagucucacugguggggcugggggugggggcaggcaggaggcauggaugggaac

SEQ ID NO: 429379 - RNA, 63 nt, Human
ucgguucuucagcuccugaugggggcuguguaaugggggcagaggccagggaaaaagaugcug

SEQ ID NO: 429380 - RNA, 63 nt, Human
gcuucuuauccugugccucucccaucuccugggugggggcaucaaagcauuucuccccuuagc

SEQ ID NO: 429381 - RNA, 63 nt, Human
caagguggcucuuggaaccugggaggcagcaucugggggcaguggauagaacacccggccugu

SEQ ID NO: 429382 - RNA, 63 nt, Human
acccuccccaccucaccaacuuuggucccucucugggggcaugaaugguuaacaaacaccaga

SEQ ID NO: 429383 - RNA, 63 nt, Human
caccagagcaguacuccaauauuggagagucgcugggggcacagggcuuugaaucaggguagu

SEQ ID NO: 429384 - RNA, 63 nt, Human
gugcugcucuagggcagggaauuaugggagaagugggggcagcccaggcgguuucacgcccca

SEQ ID NO: 429385 - RNA, 63 nt, Human
guaauuucaggggagcaucaguggaggaggcagugggggcagcagcagccuccugaccaaugc

SEQ ID NO: 429386 - RNA, 63 nt, Human
ucaccucccugaugccugcuuucaguugaggguugggggcaaugaugagcauaugaauuuuuu

SEQ ID NO: 429387 - RNA, 63 nt, Human
auauguccgcagaauggacuugauagcaaacacugggggcaccuuaagauuuugcaccuguaa

SEQ ID NO: 429388 - RNA, 63 nt, Human
gacacugcaauuggcaccgaagcccagagggucugggggcacaagacugacgccaggguauga

SEQ ID NO: 429389 - RNA, 63 nt, Human
ggagaggccggugcacagggccccgccaggggcugggggcaucccggcuuccacaaugcagcu

SEQ ID NO: 429390 - RNA, 63 nt, Human
acuggaguuuugcugcuaaagaacucuucucucugggggcagagcuucuauuuauggcacaua

SEQ ID NO: 429391 - RNA, 63 nt, Human
cacgcaugugcagauggcaccacggccggcaccugggggcacacacaugcaggcggcgugguc

SEQ ID NO: 429392 - RNA, 63 nt, Human
gggacagacuggaauguaugucauuuggggucuugggggcagggcucccacgaggccauccuc

SEQ ID NO: 429393 - RNA, 63 nt, Human
cuacagugaugggauuugcauuuuagggugauuugggggcagaaauaacugcugaugguagcu

SEQ ID NO: 429394 - RNA, 63 nt, Human
caucggccugaggggcagccugguggccagagcugggggcacacagaauaguuuuguauaaua

SEQ ID NO: 429395 - RNA, 63 nt, Human
aggagacgagagaauaugaagucuccaucuaggugggggcagucuagggaagucaacucagac

SEQ ID NO: 429396 - RNA, 63 nt, Human
ccuagugccccaucauauuaacugucaguauuuugggggcauuagguuaauagacuuaauugc

SEQ ID NO: 429397 - RNA, 63 nt, Human
acugucagcaugaugucagaggccagaguuuggugggggcagauggcagggcgacccaaaaga

SEQ ID NO: 429398 - RNA, 63 nt, Human
gguacaaagaaggaauagaagauuccguggccuugggggcaggagagagacacucuccaugaa

SEQ ID NO: 429399 - RNA, 63 nt, Human
cagaaagccugaggcgugcccagagcacaagacugggggcaacuguagaugugguuucuaguc

SEQ ID NO: 429400 - RNA, 63 nt, Human
ggcuggcuaacuaggaccucucgaaagucucugugggggcaugagggagaaaaggccauuggg

SEQ ID NO: 429401 - RNA, 63 nt, Human
augcugaaacaggagagaaaggggauguauccaugggggcagggcaugacuuugucccauuuc

SEQ ID NO: 429402 - RNA, 63 nt, Human
cagcagugggaccagggccucgcagcagcaaggugggggcaagcagaaugccucccaggauuu

SEQ ID NO: 429403 - RNA, 63 nt, Human
ccaaccagagauccccuuccuugcugagaggguugggggcaggaggagauuuggcagugccug

SEQ ID NO: 429404 - RNA, 63 nt, Human
ugugucaccggggcaacugccugggggcggggaugggggcaggguggaagcggcuccccauuu

SEQ ID NO: 429405 - RNA, 63 nt, Human
cagcucuuccuugccagagaugaucugacccggugggggcagcuggaaagcaacacuggcccc

SEQ ID NO: 429406 - RNA, 63 nt, Human
uuccuccacagugguccaaggagcaguccucagugggggcaggugugggcccuaccccuaagc

SEQ ID NO: 429407 - RNA, 63 nt, Human
ccuuccaucucuuccuucagaaguuucgucuaaugggggcagucuccccuuccuggcacauug

SEQ ID NO: 429408 - RNA, 63 nt, Human
uaacucuuuaugaccuucacucagcuguggauuugggggcacuuugugggagacuuggcuuuu

SEQ ID NO: 429409 - RNA, 63 nt, Human
cuauaggugccuugcucuucugucggaggcugcugggggcaagagcagcugcacaaggccagg

SEQ ID NO: 429410 - RNA, 63 nt, Human
ugggacauugugggaaaggcuuuggccauggucugggggcagagaacaaggggggagacacaa

SEQ ID NO: 429411 - RNA, 63 nt, Human
ccagaaaaggaaagggcuuggugguacaugaagugggggcagugggcagggugcccugggggg

SEQ ID NO: 429412 - RNA, 63 nt, Human
auugaggguggaaggugggcugugaagacuuuuugggggcauccuggagucugugaaugaagc

SEQ ID NO: 429413 - RNA, 63 nt, Human
ugcucccuggacuucuccuggguugugcuuuuuugggggcaacauaccuuggacaaagcugag

SEQ ID NO: 429414 - RNA, 63 nt, Human
uucugugggcacacacucuguuucagacugggcugggggcacacgugcugggugagacagugg

SEQ ID NO: 429415 - RNA, 63 nt, Human
uacagagauguguuggagagcacgucgugaccuugggggcaaggaauccagaaagguaggaag

SEQ ID NO: 429416 - RNA, 63 nt, Human
gcagaauauugaccaguaagaggguaaauaaagugggggcaaccccuggauaugaauguuacc

SEQ ID NO: 429417 - RNA, 63 nt, Human
cuucccacauacccagaggagagcauaugccugugggggcagugcugauggcauccagaguca

SEQ ID NO: 429418 - RNA, 63 nt, Human
ccucucauuggaaguggcaaggggcuucccuccugggggcagcuacacucguccccagaggca

SEQ ID NO: 429419 - RNA, 63 nt, Human
ucugauggcucaggaggacuuguggggagaggcugggggcacccauguggugggcucugugca

SEQ ID NO: 429420 - RNA, 63 nt, Human
aacaccaaaggcgcagaagccggcuggccguggugggggcagcguaggcguagcaucccucuc

SEQ ID NO: 429421 - RNA, 63 nt, Human
ugggguaggggaggguggcagguauaagacuucugggggcaccccaagaccccagacacccaa

SEQ ID NO: 429422 - RNA, 63 nt, Human
agagaggcagguccuaaaggagggggggucuccugggggcagaccgagggucucggaggauag

SEQ ID NO: 429423 - RNA, 63 nt, Human
guccauggagcugagggucggaggaaccuuccuugggggcagcagcccuucccgggggccuac

SEQ ID NO: 429424 - RNA, 63 nt, Human
ucugcugccuguuuggggaggggggcggugaggugggggcagcggccccgcaccccuccuccu

SEQ ID NO: 429425 - RNA, 63 nt, Human
gaguaugcugaaauccgggucaagugaaggagcugggggcagccugcguggcugaccccccuc

SEQ ID NO: 429426 - RNA, 63 nt, Human
acauugacacuggaugggcugcagcagaggcacugggggcagcgggggccagggaaguccccg

SEQ ID NO: 429427 - RNA, 63 nt, Human
acuuggaguggcgagcuggggcccgauggggcuugggggcagaguagacaucuagccucccua

SEQ ID NO: 429428 - RNA, 54 nt, Human; identical to SEQ ID NO: 47354

SEQ ID NO: 429429 - RNA, 63 nt, Human
cgccacaccugcugugucccgagagucuccagaugggggcaucagggugagguccgggacucu

SEQ ID NO: 429430 - RNA, 63 nt, Human
aucugcagauccugccccaagaagcugggguggugggggcaguaauuccugccccccucucug

SEQ ID NO: 429431 - RNA, 63 nt, Human
gggcggggcuugugggaggggcggggcuaagaaugggggcagugggggaaggaaggggagagg

SEQ ID NO: 429432 - RNA, 63 nt, Human
cuaaagccucccuucucccauacugggugaugcugggggcagagaugagucaggccuaaggcu

SEQ ID NO: 429433 - RNA, 63 nt, Human
cuuauaguacccccucaggacauggacaguaugugggggcaggaagguuaucuccucccgggu

SEQ ID NO: 429434 - RNA, 63 nt, Human
augggagcaaauugcccuggaccuuugccugaaugggggcaggaaaggugagguguugcuggc

SEQ ID NO: 429435 - RNA, 63 nt, Human
cuagcuuguuacagcugccucuguccccacaugugggggcaccuucuccaguaggauucggaa

SEQ ID NO: 429436 - RNA, 63 nt, Human
uuuaucaucaccucaguuucccugaauuauauuugggggcaaagauuguccccucugcuguuc

SEQ ID NO: 429437 - RNA, 63 nt, Human
ggacagagaggaaggagguggagcagcuggggcugggggcacagccugggcauucugugggga

SEQ ID NO: 429438 - RNA, 63 nt, Human
caucauaggagcagcucgcuggccagaaggggaugggggcaucccugugccucacucagcucc

SEQ ID NO: 429439 - RNA, 63 nt, Human
cuggucuuucccugauguucucguggcugcuguugggggcagagauugacgcccccggucuuu

SEQ ID NO: 429440 - RNA, 63 nt, Human
agcaagauggagggauggggcucucuccugggaugggggcagguguuccugaauaccgacagg

SEQ ID NO: 429441 - RNA, 63 nt, Human
ccucuuuccacgaugccgcugggcgacguggcgugggggcagggggacggugggggagcccuc

SEQ ID NO: 429442 - RNA, 63 nt, Human
gggacucuauggaaaacuggcagccauugggugugggggcagucuguaaaucagucaccugug

SEQ ID NO: 429443 - RNA, 63 nt, Human
aggaugacgcuguaaacauagcccacgcuguccugggggcacugggaagccuagauaaggccg

SEQ ID NO: 429444 - RNA, 63 nt, Human
ggauuggggaggaggggaugggcagcggaggguugggggcauggucugcaggcucaucugugu

SEQ ID NO: 429445 - RNA, 63 nt, Human
ccgggacuucugguagaggcggcugggggagggugggggcagggcuggcugggggcuucuccc

SEQ ID NO: 429446 - RNA, 63 nt, Human
aaucuuugcacuuccauuuccugcccucuaauuugggggcagcaguuugugcuuuguaagcuu

SEQ ID NO: 429447 - RNA, 63 nt, Human
cugacaaacucugucugccgccagaaggaaugcugggggcagucaugucccaggucccgugcu

SEQ ID NO: 429448 - RNA, 63 nt, Human
cagaaggaacaaggcccccagagggaggucaccugggggcagcuggugccgggucuucaccca

SEQ ID NO: 429449 - RNA, 63 nt, Human
ccaccuggugccgugggagccacccccaggugcugggggcacagccccuccccacuccggcca

SEQ ID NO: 429450 - RNA, 63 nt, Human
ccccagaggaccgagagaguggagagugcggcgugggggcacugaccaggcccaaggaggguc

SEQ ID NO: 429451 - RNA, 63 nt, Human
ggagcccucgcggcaagcagggugggggggacuugggggcaugccgggcccucacucucucgc

SEQ ID NO: 429452 - RNA, 63 nt, Human
augcuacugaccagggcagagcuggggagggcgugggggcaguaaagccucugcuacagccgg

SEQ ID NO: 429453 - RNA, 63 nt, Human
ccagggcuggccucaguuucuccucaacaggccugggggcagcccuuccccugccuagucccc

SEQ ID NO: 429454 - RNA, 63 nt, Human
cccuccccacccggcauccaccugcauccccucugggggcaggagcccacccccagcaccccc

SEQ ID NO: 429455 - RNA, 63 nt, Human
gccuucaagcaucccugcaacugccacagcaggugggggcagggcucgugggacccucuggac

SEQ ID NO: 429456 - RNA, 63 nt, Human
gacccccccucaccccaggacccuaggagggggugggggcagguagggggagauggccuugcu

SEQ ID NO: 429457 - RNA, 63 nt, Human
agaccgggcuugggagaggggcgcagcuaagacugggggcaggauggcggaaaggaaggggcg

SEQ ID NO: 429458 - RNA, 63 nt, Human
ggggaggccuuggccugugacagcccccaggccugggggcacagauccccccagcaaggauaa

SEQ ID NO: 429459 - RNA, 63 nt, Human
uuaccagccuugauggcagcgggaaucuggugcugggggcagccggugcagccccggggagcc

SEQ ID NO: 429460 - RNA, 63 nt, Human
uagggauucugugucuuugugucauaacuuugaugggggcagugagggagacagccccaaccc

SEQ ID NO: 429461 - RNA, 63 nt, Human
uuauccggcccagaccaaagauucccucaucccugggggcagcccugccgcugugucuccuuu

SEQ ID NO: 429462 - RNA, 63 nt, Human
gcacauguagccgcugagaccugcuguuucugcugggggcaggcuccucuucccccagccccg

SEQ ID NO: 429463 - RNA, 63 nt, Human
aagugcugauggucuuggucccagccagggucgugggggcagccacucucuccaaagcauagu

SEQ ID NO: 429464 - RNA, 63 nt, Human
cccacagggugacucugggggaccccuggucugugggggcauccugcagggcauuguguccug

SEQ ID NO: 429465 - RNA, 63 nt, Human
cuuucuuugcauccacaauguggggucggagcuugggggcagguccugggagugggaagccuc

SEQ ID NO: 429466 - RNA, 63 nt, Human
caaaucuuccguccucccguggaucucccggggugggggcagggcgggucccacgauggcccc

SEQ ID NO: 429467 - RNA, 63 nt, Human
acuaguuuuuagcccuuuuuguuggggguggggugggggcagaggagaggcggauacagaaac

SEQ ID NO: 429468 - RNA, 63 nt, Human
gcuguccccaucagcaaccauguucuugcaggcugggggcaagggauucugcucauguguuug

SEQ ID NO: 429469 - RNA, 63 nt, Human
gguuccuuuuccgcccgccacccugccuuuccuugggggcagcugucucucuguacaugagca

SEQ ID NO: 429470 - RNA, 63 nt, Human
gacugagcacccucuggauucugaaucucaagaugggggcagggcugugcuugaaggcccugc

SEQ ID NO: 429471 - RNA, 63 nt, Human
gaagguuuuaacauugaaagugagcggaggacuugggggcagagcagcacaaagaaacagccu

SEQ ID NO: 429472 - RNA, 63 nt, Human
agaauaucaauguaaaauuggaaaauaaggaacugggggcauuuguuuaggccaugacuucua

SEQ ID NO: 429473 - RNA, 63 nt, Human
ccaugccaggcacugugcuugcuaauugcuuuaugggggcauucucuuauuuauuccccagcc

SEQ ID NO: 429474 - RNA, 63 nt, Human
ucauaccguguaccucaguucccucuugcucagugggggcagagccaccugacucuugcaggg

SEQ ID NO: 429475 - RNA, 63 nt, Human
uaagccuaggccuaggcaguccacuucgggaggugggggcacuccacacuggggggcccugca

SEQ ID NO: 429476 - RNA, 63 nt, Human
aggccugaugcuccuguuuggguccagggccccugggggcagaccggugauccuuaccagugg

SEQ ID NO: 429477 - RNA, 63 nt, Human
cuccugccggaaagcccugcaacauucuaggguugggggcagggccauccacgguuucugggc

SEQ ID NO: 429478 - RNA, 63 nt, Human
cugcucaacaugaaacugggcacccaaaacucaugggggcacaauccuggggcaccugcagga

SEQ ID NO: 429479 - RNA, 63 nt, Human
gucacgagcccauucucauguuuacagggguugugggggcagagggggucugugaaucugaga

SEQ ID NO: 429480 - RNA, 63 nt, Human
ccagacugggcccagggucucccauagacagccugggggcaaguuagcacuuuauucccgcag

SEQ ID NO: 429481 - RNA, 63 nt, Human
aacagacuucucgccauagucgagcucucccgcugggggcacugcggggaggcgaggccucgg

SEQ ID NO: 429482 - RNA, 63 nt, Human
gaggaaguagcugucguggccugaagaaauucaugggggcagcccuuaaaucccuucccugug

SEQ ID NO: 429483 - RNA, 63 nt, Human
uguggggcuugguggaggggccccaggauuuguugggggcaaaggggguggcgggaccguucc

SEQ ID NO: 429484 - RNA, 63 nt, Human
caaugcccaggaagcaggcacauugccaaggacugggggcaucuugacuaggaagcuccucgu

SEQ ID NO: 429485 - RNA, 63 nt, Human
accacaccgcuguccccuuagccccaagggcccugggggcagccacccucccgccugucggcc

SEQ ID NO: 429486 - RNA, 63 nt, Human
accugggagacuccugaaaaucagccuaaugucugggggcagcuggcgcugaggcugugcaga

SEQ ID NO: 429487 - RNA, 63 nt, Human
acacgccucugccccauugcucugcagccagcuugggggcaggaguccuggacucucagaucc

SEQ ID NO: 429488 - RNA, 63 nt, Human
uaaaaggagggaauaggaggagggcagggugagugggggcaauccuagguggugggggaguca

SEQ ID NO: 429489 - RNA, 63 nt, Human
aaggaggcuggcagguauggaaggguuuguggcugggggcaggagggcccuaccugauuggug

SEQ ID NO: 429490 - RNA, 63 nt, Human
ugccguggaaguacugugugugaauagcaguagugggggcaaaagcaaucuucucauuuggaa

SEQ ID NO: 429491 - RNA, 63 nt, Human
uuaaagggacauuguaggagguacucaaggguuugggggcaaaacccugaauccagccagucg

SEQ ID NO: 429492 - RNA, 63 nt, Human
ccuucuggccagcuccagcccccucacccuugcugggggcauaucucucauacccaccugcug

SEQ ID NO: 429493 - RNA, 63 nt, Human
cgguccacuggccgccuuguguugcuggagacgugggggcagggaggggacagugugggccug

SEQ ID NO: 429494 - RNA, 63 nt, Human
ggacuuccugcuacaguagcuguggggagcuggugggggcauccuugaggaccuccaccuggg

SEQ ID NO: 429495 - RNA, 63 nt, Human
caucccuucuggugugggcaucgcuacguguuuugggggcagcguuucacggcggugcccuug

SEQ ID NO: 429496 - RNA, 63 nt, Human
ccagcgucauccuccagaaccucacaucugaacugggggcaggugcauaccuuggggagggag

SEQ ID NO: 429497 - RNA, 63 nt, Human
cauucagcacaggugccaaaauaugcuucauuuugggggcagaucuauuuugacaguauuuga

SEQ ID NO: 429498 - RNA, 63 nt, Human
caucgcuguggccaguggagagccacuccccucugggggcagucgccgagagccuccuucccc

SEQ ID NO: 429499 - RNA, 63 nt, Human
cccgcaguggggaugcagcuguuggacagguauugggggcaagguugguagggaggacagacu

SEQ ID NO: 429500 - RNA, 63 nt, Human
cuagagguggaggucuaggugucugaagugccuugggggcacccucauuuuguuuccauucca

SEQ ID NO: 429501 - RNA, 63 nt, Human
guauucucuggccacauucaagucccccauuggugggggcagagaaguaggaccaggccaucc

SEQ ID NO: 429502 - RNA, 63 nt, Human
ugucuuuccagcauccacucucccuuguccuccugggggcauaucucagucaggcagcggcuu

SEQ ID NO: 429503 - RNA, 63 nt, Human
guggggccugaggaggucauaaucucuucugagugggggcaggucgauucuugcacaaggugg

SEQ ID NO: 429504 - RNA, 63 nt, Human
ccccgccgccagguggcccacaugggaccagcaugggggcagguuaucuguuggccugaagag

SEQ ID NO: 429505 - RNA, 63 nt, Human
gcaaagcagcucugaccgaauucuaggcaggggugggggcaccugccugggcccuggguccag

SEQ ID NO: 429506 - RNA, 63 nt, Human
ugccuguggcggaaggaacugcccaguccucccugggggcagguagaccuguggggauggcuc

SEQ ID NO: 429507 - RNA, 63 nt, Human
caggauaagguccccugacagugaguuguguggugggggcagccucugccucaaaaauucacc

SEQ ID NO: 429508 - RNA, 63 nt, Human
ucccuggcccguccuccucccacccccucccccugggggcaaaucaggacacaacagagggca

SEQ ID NO: 429509 - RNA, 63 nt, Human
accgguguggccugggcuggagugcacucucccugggggcagcuggggccucgcaauucuugc

SEQ ID NO: 429510 - RNA, 63 nt, Human
agaggcagagagaggucugggaacugcaccagcugggggcaugggguggagaacacugggcag

SEQ ID NO: 429511 - RNA, 63 nt, Human
gguagcccucuuucugugaaugggguggggcugugggggcagcugggguuggaggaugagagc

SEQ ID NO: 429512 - RNA, 63 nt, Human
cccccgcccauugcuuuggagcacagaugacucugggggcagaggugggcucuguuuaggagg

SEQ ID NO: 429513 - RNA, 63 nt, Human
ucaaaucuaggggcgucuucuuuggacccacaaugggggcaagccuuaauaauauggaaggga

SEQ ID NO: 429514 - RNA, 63 nt, Human
uuuguuauuccuuuugcagauugggauguguuuugggggcagggguuaguucuucaggucggc

SEQ ID NO: 429515 - RNA, 63 nt, Human
ucaaggguucugugaggagaggacccaggagugugggggcauuuggggggugaaguggccccc

SEQ ID NO: 429516 - RNA, 63 nt, Human
gucaccaggccuccccuccuggcccaggugugcugggggcaccgugccccccaccccccugcc

SEQ ID NO: 429517 - RNA, 63 nt, Human
ccucguugccaagcuccuccuguccccuuguucugggggcaggcgcugugcuucugugaggug

SEQ ID NO: 429518 - RNA, 63 nt, Human
cucccaggcuccuggcuccaccagccaaggaggugggggcaagggucagggcaaugggggaca

SEQ ID NO: 429519 - RNA, 63 nt, Human
gcccaggacauggcugagagguggucagcaggcugggggcauggagcagagagggcuugggua

SEQ ID NO: 429520 - RNA, 63 nt, Human
aagcuuugagcaggggagugaggcagccagaagugggggcagaggaggguggcucuguuuccc

SEQ ID NO: 429521 - RNA, 63 nt, Human
gcugcaugagacauugacaccagaaagcccucuugggggcacugcucccuaccccagggcccu

SEQ ID NO: 429522 - RNA, 63 nt, Human
agaggcccagaagugccagccuggggagccguuugggggcagccccuucugcccaccccaucc

SEQ ID NO: 429523 - RNA, 63 nt, Human
uuggacaaaagggcccaugcugcagccacugacugggggcagagcucuggguggaagagggaa

SEQ ID NO: 429524 - RNA, 63 nt, Human
auaucgacgcgaagugcuuaacacagccgggcuugggggcagucaggaggaagcuggccaucc

SEQ ID NO: 429525 - RNA, 63 nt, Human
gccgcuuacucucagcggaugcagcugcucacuugggggcacuggccucuuagguuuuaacga

SEQ ID NO: 429526 - RNA, 63 nt, Human
acagggacgacccggggcgggcugaugucuucuugggggcagaccagagagcucaaguuucag

SEQ ID NO: 429527 - RNA, 63 nt, Human
aagcuguguuuccuaaugaguuugcuacugcugugggggcauguggguggguaaaugauguaa

SEQ ID NO: 429528 - RNA, 63 nt, Human
gcaugcugccccagcacuggagaagcagcgcugugggggcaaucugucacacucucagagucu

SEQ ID NO: 429529 - RNA, 63 nt, Human
ugaagacuucccucaccauuggaucaagcuccuugggggcauaugaucaccagggcacacagu

SEQ ID NO: 429530 - RNA, 63 nt, Human
uaucaauucucaugaguguauuauaaucucuggugggggcaagugucuggaaggccugagggg

SEQ ID NO: 429531 - RNA, 63 nt, Human
uccagaauggaauuuugcuacauggggucugggugggggcaaagagacccagucaauuacaug

SEQ ID NO: 429532 - RNA, 63 nt, Human
cuagaccacuuuauaccuucgcaguguggucucugggggcaaaaaacuaaugaaaacaaucuc

SEQ ID NO: 429533 - RNA, 63 nt, Human
ccgagccagccacugaggggagcuggcagagccugggggcacagggugcaaagccaggcacug

SEQ ID NO: 429534 - RNA, 63 nt, Human
ccuggcugacugccuuagcagugggggugggggugggggcaggggcaggggcuuuauguguuu

SEQ ID NO: 429535 - RNA, 63 nt, Human
aacaggggccaaacuggugggaggcagagguggugggggcagggaugauaggcccuggaugug

SEQ ID NO: 429536 - RNA, 63 nt, Human
gucaaauaauuugcaaccagcuuaugagggcaaugggggcaccuaaacucuugaugaaagaac

SEQ ID NO: 429537 - RNA, 63 nt, Human
uaaccuaauucagguugcaguuuuaauauucauugggggcaguggaauugcauguguaaauua

SEQ ID NO: 429538 - RNA, 63 nt, Human
ggugcuggcugcggggauccagacagggcacauugggggcauggaagugccagggugguuuuc

SEQ ID NO: 429539 - RNA, 63 nt, Human
ugcuaauuacaaguuauaaaucaaacggagagaugggggcauggagauaguuuuuacguacug

SEQ ID NO: 429540 - RNA, 63 nt, Human
acccccaagucuguccccaggcucugcccugccugggggcaguggcuccccuccccuguugcc

SEQ ID NO: 429541 - RNA, 63 nt, Human
cccaaguaaagugaccaugccaguggccagcacugggggcacaccugugaugggcaccccuuc

SEQ ID NO: 429542 - RNA, 63 nt, Human
gucuccgaaaugcugucuuucuugcucccugacugggggcagacaugguggggucuccucagg

SEQ ID NO: 429543 - RNA, 63 nt, Human
ggcagaguggaacccugccuccaugccagcaucugggggcaaggaaggcuggcaucauccagu

SEQ ID NO: 429544 - RNA, 63 nt, Human
ugaaggcccugggaaugcagguucuagaaggggugggggcauggggcccaggagguugcuaga

SEQ ID NO: 429545 - RNA, 63 nt, Human
uguugccugagaagaaaccuuggggugccagggugggggcagaagcaugggcuggguuccggu

SEQ ID NO: 429546 - RNA, 63 nt, Human
gcugccuggggagcugaggcguuaccgcuguguugggggcagcuuggugucaggugcagcagg

SEQ ID NO: 429547 - RNA, 63 nt, Human
aggaugaacggacgcccacagaggccugcggggugggggcaucgcugccuggggagcugaggc

SEQ ID NO: 429548 - RNA, 64 nt, Human
aaagugccuuuuagaggcugggcaugguggcucacgcuuguaaucccagcacuuugggaggcca

SEQ ID NO: 429549 - RNA, 64 nt, Human
ggccagaaaccuugagcuuaggugccuggggaccagcuucgacauucucuccaguuucugauuc

SEQ ID NO: 429550 - RNA, 64 nt, Human
ggugaaacaaaccaguauguucccuguucucuugagcuucgacucuucugugcgcuacugcugc

SEQ ID NO: 429551 - RNA, 64 nt, Human
gcucugaugacuugugcacauccccaaggguaagagcuucgaucucugcacagccgggccaacc

SEQ ID NO: 429552 - RNA, 64 nt, Human
aaaaauacaaaauuuagccgggcaugguagcaggcgcuuguaaucccagcuacuugggaggcug

SEQ ID NO: 429553 - RNA, 64 nt, Human
aaaaaaaaaaagccaggccgagcguguuggcucacgcuuguaaucccagcacuuugggaggccg

SEQ ID NO: 429554 - RNA, 64 nt, Human
aagggaagagguggaggucaggcacgguggcucacgcuuguaaucccagcacuuugggaggccg

SEQ ID NO: 429555 - RNA, 64 nt, Human
gcccacuuucuuuuuaaugggguugcuuguuuuucgcuuguaaauuuuuugaagcuucuuauag

SEQ ID NO: 429556 - RNA, 64 nt, Human
uggggcucacacgcuagggugagaugucagaaagcgcuuguauuuuaaacaaccaaaaagaauu

SEQ ID NO: 429557 - RNA, 64 nt, Human
gcugagauauggacucucuaaggaaggggccgaacgcuuguaauuggaauacauggaaauauuu

SEQ ID NO: 429558 - RNA, 64 nt, Human
gaagacauuuugacuggcugggugcgguggcucacgcuuguaaucccagcacuuugggaggcug

SEQ ID NO: 429559 - RNA, 64 nt, Human
aaucccauuauucagagcgcguauggaguggaaacgcuuguaaggcuucaccagguaagcggug

SEQ ID NO: 429560 - RNA, 64 nt, Human
aaucccauuauucagagcgcguauggaguggaaacgcuuguaggguuucaccagguaagcggug

SEQ ID NO: 429561 - RNA, 64 nt, Human; identical to SEQ ID NO: 429560

SEQ ID NO: 429562 - RNA, 64 nt, Human; identical to SEQ ID NO: 429560

SEQ ID NO: 429563 - RNA, 64 nt, Human
ggauacugucagcaugaguacauauuucaacccacgcuuguaaaagacauaagaguuuauaaag

SEQ ID NO: 429564 - RNA, 64 nt, Human
ugggggccaaaugacagaaccccgguugaaaguccgcuuguaaaagcacaagugagaggcagca

SEQ ID NO: 429565 - RNA, 64 nt, Human
aaaaauacaaaaauuagcccggcauguuggugcacgcuuguaaucccagcuacucaggagucug

SEQ ID NO: 429566 - RNA, 64 nt, Human
cagcguguguguccaccuuccugagugauguguucgcuuguagggugcuggcugaauagacucu

SEQ ID NO: 429567 - RNA, 64 nt, Human
guucuccucuuugcaguggcagggccgagcugcuagcuucgacagugagagcucgugcccaucu

SEQ ID NO: 429568 - RNA, 64 nt, Human
gccccagaaagcugaggagugugggcuggcagagagcuucgagggcaaggccacccgcgggggc

SEQ ID NO: 429569 - RNA, 64 nt, Human
ccauacaguuaucuccccugcccugguuacagacagcuucgagaaccagaggagaagagcauag

SEQ ID NO: 429570 - RNA, 51 nt, Human
ccugcgacuccgaccucuagacgcuuguagagccuggggggcgccgggugg

SEQ ID NO: 429571 - RNA, 64 nt, Human
uguaauggacagaacugaugcagaugguugaaugcgcuuguacuauaugcuaaaauauggaaaa

SEQ ID NO: 429572 - RNA, 64 nt, Human
agaagaaacaaacauaguggguauaaucauggaucgcuuguaccccugugaaaauauauuuuuu

SEQ ID NO: 429573 - RNA, 64 nt, Human
aaaaauaugaaaauuaguugggugugguggcaugcgcuuguagucucagcuacuccggaggcug

SEQ ID NO: 429574 - RNA, 64 nt, Human
gaguguaaacacaccuaacuuuaagaaaaagaaccgcuuguaugauuuucaaaagaacauuuag

SEQ ID NO: 429575 - RNA, 64 nt, Human
cuguucuccaugcaaaguuaagaucgaauccauccgcuuguaggggaaaaaaaggaaaaaaauu

SEQ ID NO: 429576 - RNA, 64 nt, Human
ucacugucuaccccagcccagcccagcccucugccgcuuguacauacgccauggggacccugag

SEQ ID NO: 429577 - RNA, 64 nt, Human
uaaauacaaaaaauuauccuggcggaguuaugcacgcuuguagucccaacuaccugggaggcug

SEQ ID NO: 429578 - RNA, 64 nt, Human
aagauacaaacaauuagccgggcgugguggggugcgcuuguaaucccagcuacucaggaggcug

SEQ ID NO: 429579 - RNA, 64 nt, Human
gaacuacccagaggaggccgggcaugguggcucacgcuuguaaucccagcacuuugggaggccg

SEQ ID NO: 429580 - RNA, 64 nt, Human
ucacucugggcacacucugccagcaaagaggacucgcuuguaaauaccaggauuuuuuuuuuuu

SEQ ID NO: 429581 - RNA, 64 nt, Human
augauguuguaaggguaccuuaaaacaagagacucgcuuguauuuuaagagaaccaaguggcca

SEQ ID NO: 429582 - RNA, 64 nt, Human
auaaauuauauucauggccgggcgcgguggcucacgcuuguaaucccagcacuuugggaggccg

SEQ ID NO: 429583 - RNA, 64 nt, Human
cccccuucccccagcccauccauuaggccagcaacgcuuguagaacucacucugggcuguaacg

SEQ ID NO: 429584 - RNA, 64 nt, Human
aaacaagguauuuuucgggccaggcgguggcucacgcuuguaaucgcagcacuuugggaggcug

SEQ ID NO: 429585 - RNA, 64 nt, Human
ucuuuggacguggcagaaccuuacauauucugugagcuucgaugagccagagugauaucauaac

SEQ ID NO: 429586 - RNA, 64 nt, Human
ccuccugagccgcaacggcucugaggucucggccagcuucgacggcugggccaccgucucggug

SEQ ID NO: 429587 - RNA, 64 nt, Human
ugccauuugcaagagucuggaauugucaggucucagcuucgaaaaguccugguuccacugacag

SEQ ID NO: 429588 - RNA, 64 nt, Human
agggugucugcuuuuggccaggcgcaguggcucacgcuuguaaucccagcacuuugggaggccg

SEQ ID NO: 429589 - RNA, 64 nt, Human
agaggcggaagagcagucaggcuugaggagcuggcgcuuguaauguuuauccguuuaaacauuu

SEQ ID NO: 429590 - RNA, 64 nt, Human
aagaaaguccauuuaggccggacgcgguggcuuacgcuuguaaucccagcacuuugggaggcug

SEQ ID NO: 429591 - RNA, 64 nt, Human
agcaaguggacaaguggccgcugugcgggccccucgcuuguagugagcuguugcagcuuacggu

SEQ ID NO: 429592 - RNA, 64 nt, Human
ccuaaagaagugcuuggcuggggaugguggcucacgcuuguaaucccaguacuuugggaggcca

SEQ ID NO: 429593 - RNA, 64 nt, Human
aaaaauacaaaaauuagccgggugugguggggugcgcuuguaaucccagcuacucgggaggcug

SEQ ID NO: 429594 - RNA, 64 nt, Human
auaugucucugauggggcugcaagugcuaccucgcgcuuguacacugcugcuguggggcuccgc

SEQ ID NO: 429595 - RNA, 64 nt, Human
gucccagcuacucgggagcccaacgcacgagaaccgcuuguacccaggagguggagguugcagu

SEQ ID NO: 429596 - RNA, 64 nt, Human
aucccagcuacucaggaggcugaggcaggagaaucgcuuguacccaggaggcggagguuguagu

SEQ ID NO: 429597 - RNA, 64 nt, Human
caaacgagaacagggaaacauugaagaggcaguucgcuuguaucguaaagcauuagaaguaugu

SEQ ID NO: 429598 - RNA, 64 nt, Human
agauuaauuuauacccuauaaaauaaaacuuguuagcuucgaugaagucacuucaucuucucuc

SEQ ID NO: 429599 - RNA, 64 nt, Human
agacacagcagggccaacaaccugugcccaggccagcuucgagcuacaugcaucuagggcggag

SEQ ID NO: 429600 - RNA, 64 nt, Human
ccauugggagcagagcugauauuaaagcauguuuagcuucgaaguuuuacuuuuuuaaagcuga

SEQ ID NO: 429601 - RNA, 64 nt, Human
ucagugggaggacuuuuucaccccuggcauuagcagcuucgaccucauuuuccagaugcaccag

SEQ ID NO: 429602 - RNA, 64 nt, Human
gaaaucccaaaaccuccagcccgggaacacuauaagcuucgaccauucaggaaucugcccugca

SEQ ID NO: 429603 - RNA, 64 nt, Human
cucccuacuugggucuucaggagcugguccaaggagcuucgaaucuaagucaucuagaaugacc

SEQ ID NO: 429604 - RNA, 64 nt, Human
ugagcaggccuaggcaggcccgggccuguuggcaagcuucgaucucacacacacagaaacauac

SEQ ID NO: 429605 - RNA, 64 nt, Human
ggaccccuuugcugaccucugccaggacccacacagcuucgauggaucucaguguuuguuaaca

SEQ ID NO: 429606 - RNA, 64 nt, Human
cgcccuccccccaccacagaaucuaagaccuuucagcuucgagccagggggcgggggaucccga

SEQ ID NO: 429607 - RNA, 64 nt, Human
uucaagggcaaagucuacuggcgccucaaccagcagcuucgaguagagaaaggcuaucccagaa

SEQ ID NO: 429608 - RNA, 64 nt, Human
auagucuuugagcuacuaaaaagcagaauuccggagcuucgagauaucuuauucuaggaaaaug

SEQ ID NO: 429609 - RNA, 64 nt, Human
guagauggccgcccugcucccccaaugaaaggccagcuucgaagaaaagcugaaagggagacgu

SEQ ID NO: 429610 - RNA, 64 nt, Human
uucuccugugucccaaaccccagggggccccagcagcuucgaaccuacaccugagggcuaccag

SEQ ID NO: 429611 - RNA, 64 nt, Human
aaaagcacgaccuacugcacgaagggaagauccaagcuucgaaagauaucccaaaaauuucagu

SEQ ID NO: 429612 - RNA, 64 nt, Human
uaaaauguuuauacauaaaaccaccaaaauacauagcuucgacaagauggaaguuuauuucucu

SEQ ID NO: 429613 - RNA, 64 nt, Human
cucccuguguucugggcuggggccaccuuugugcagcuucgaggacaggaaaggccccaaucuu

SEQ ID NO: 429614 - RNA, 64 nt, Human
gcuggcagcugagcucagagguucacacaggugcagcuucgaggcccacagucugcgaccuucu

SEQ ID NO: 429615 - RNA, 64 nt, Human
ugccucugguauccuuccuuuugaaacgaagcucagcuucgaagaugugaacaagaauaaaagg

SEQ ID NO: 429616 - RNA, 64 nt, Human
agaacugggaugucuuggcuuguauguuuuuugaagcuucgauuaugauuuuuaaacaauaaaa

SEQ ID NO: 429617 - RNA, 60 nt, Human
accuggagcugagugccugagggguccagaagcuucgaggcccagcgaccucggugggcc

SEQ ID NO: 429618 - RNA, 60 nt, Human
accuggagcugagugccugagggguccagaagcuucgaggcccagcgaccucagugggcc

SEQ ID NO: 429619 - RNA, 64 nt, Human
ggccuggaacccaugucagucucucaccaccuccagcuucgaugauguggguguccugcagaag

SEQ ID NO: 429620 - RNA, 64 nt, Human
cuggagaaaacuaccagugugaacaacguggccaagcuucgacaaugcucacacccuauugcac

SEQ ID NO: 429621 - RNA, 64 nt, Human
guuuugguauuuaguaggaaaugaaguguuucgaagcuucgagagaagcuucaaaauugucaca

SEQ ID NO: 429622 - RNA, 64 nt, Human
uggaaggagcagggguuggagaaaggcaucccaaagcuucgauggagagcagggaagggggacc

SEQ ID NO: 429623 - RNA, 64 nt, Human
aaguucucuggaauuaauuauuuuaacuuggccuagcuucgacugucaagguggcuguuauaaa

SEQ ID NO: 429624 - RNA, 64 nt, Human
acugcagcacagugaaugauaugcacucaccauuagcuucgacacagggacugagggagacagg

SEQ ID NO: 429625 - RNA, 64 nt, Human
cugcaggcagcuuggaaguuucuuccccgaguggagcuucgacccacccacuccaggaacccag

SEQ ID NO: 429626 - RNA, 64 nt, Human
uuucaucaagcuuuucuaagcuuaaauauugcauagcuucgagcuguauggacuauauuaugaa

SEQ ID NO: 429627 - RNA, 64 nt, Human
ucucagcacaagagcgcuuccuuugcacagaaugagcuucgagcuuuguucagacuaaaugaau

SEQ ID NO: 429628 - RNA, 64 nt, Human
uccugggugcagagucggccauugaaaacucaagagcuucgagagccaguguugucagcagcca

SEQ ID NO: 429629 - RNA, 64 nt, Human
aauuuauagaucuaacuuucauaggcaaaacaaaagcuucgagcuguugcgugugugagucugu

SEQ ID NO: 429630 - RNA, 64 nt, Human
ugggugcaggcugugaauuugucucucagucacugauugccacugccaucuggaaauguuugcu

SEQ ID NO: 429631 - RNA, 64 nt, Human
cgccagugacagaagcugugaguggaagacgagggauugccaucgccuaugaggaugagggaag

SEQ ID NO: 429632 - RNA, 64 nt, Human
auuuauuaguuugacuauuugauguuuuuauagugauugccaacuuuaaaaaguaggcuguuca

SEQ ID NO: 429633 - RNA, 64 nt, Human
ccguacaaacucagauccuugguaccccuaaaaagauugccaauuuucuucaucuuugccauau

SEQ ID NO: 429634 - RNA, 64 nt, Human
ugccauuucauaagaauuccgauauauacuugaugauugccaaggggaugaaaggaaacaacag

SEQ ID NO: 429635 - RNA, 64 nt, Human
cacccacccuaggcuuccuccuggaugugauggggauugccagagaggcucuuagcauaaaagg

SEQ ID NO: 429636 - RNA, 64 nt, Human
gucuaauggucacagagcacuguagcacuuaacagauugccauggacaccaguugcgaagggaa

SEQ ID NO: 429637 - RNA, 64 nt, Human
uggcuguuuaaucuuugaagcauuuugggcuuaagauugccagcagcacacaucagaugcaguc

SEQ ID NO: 429638 - RNA, 64 nt, Human
ucugaauagucuucagagauaggccugugggccagauugccauccccuauggaccagaagccaa

SEQ ID NO: 429639 - RNA, 64 nt, Human
ggacuaagguuccuuggauuauaugacuuguuaagauugccacaguuccgaucucaacagugug

SEQ ID NO: 429640 - RNA, 64 nt, Human
accuaauucuucaguucacugcccaugugauacugauugccacauuaagguugaacagcauggc

SEQ ID NO: 429641 - RNA, 51 nt, Human
cuaugauucaacucuuuuaaugauugccaguaaugcaagaaacacuccuug

SEQ ID NO: 429642 - RNA, 64 nt, Human
ccaguugucuuucauaaucaauguuuagauaaaugauugccacuuuuuauaugguuguuuaguu

SEQ ID NO: 429643 - RNA, 64 nt, Human
cagcugacaugaugugucacuagcucugugggaugauugccacauacauggaacaccugggagu

SEQ ID NO: 429644 - RNA, 64 nt, Human
gcauaaaguaaguaaggugcaaugaagaaguguugauugccaaauugacauguugucacauucu

SEQ ID NO: 429645 - RNA, 64 nt, Human
uggccucccuacagccuggaagaaggaggguccugauugccaaggaaaccuccucauugggcua

SEQ ID NO: 429646 - RNA, 64 nt, Human
uagccgaggagguagucacgcggcacgcgccggugauugccacgaugugauugcaauacucuua

SEQ ID NO: 429647 - RNA, 64 nt, Human
cuguccugugaauuuuaaaaagcuaucccauaucgauugccaaagagcaucuaccuuaccuccu

SEQ ID NO: 429648 - RNA, 64 nt, Human
gaccagccuuaacucuggguuugaauccuaaggagauugccacagugagacuuaaggaaauguu

SEQ ID NO: 429649 - RNA, 64 nt, Human
gaguucuuuucccugagaaaggagaaaaagaugggauugccacucacccacccacacugguaag

SEQ ID NO: 429650 - RNA, 64 nt, Human
agagcacauguuggucuccucuuagugugaacgagauugccaggcccuuuucuccuaugcacac

SEQ ID NO: 429651 - RNA, 64 nt, Human
augaauacaacagaauugagguugaaaaauauuugauugccacauuccuuuaagcaucuuugau

SEQ ID NO: 429652 - RNA, 64 nt, Human
aaguucagcaucaccugcuuugaaauuagccuuagauugccaaccaauagaugagaauuuugag

SEQ ID NO: 429653 - RNA, 64 nt, Human
aagcaugcacagaaauuuggguaauguuugaguagauugccaagcgcuacugugauucaugaau

SEQ ID NO: 429654 - RNA, 64 nt, Human
cuguggccugggggacaucugugucacaguauaggauugccauucagguguuuuguaccuauuu

SEQ ID NO: 429655 - RNA, 64 nt, Human
acgggggcugccuggucacgcgcggcaccaaguggauugccaacaacuggauuaauguggaccc

SEQ ID NO: 429656 - RNA, 64 nt, Human
uuauuaauauugcccuaaguacaacuaggcaagugauugccaccuaaaucagaagacguucuaa

SEQ ID NO: 429657 - RNA, 64 nt, Human
gcauacuauacuguauaacauguuauucaaaagggauugccauuucugagacacaguaacaaaa

SEQ ID NO: 429658 - RNA, 64 nt, Human
gauuugguacagaguaugucaggaagacaacucagauugccauuuuaaauaaaguuguacauga

SEQ ID NO: 429659 - RNA, 64 nt, Human
uucaguagaguauggaauaaucuuaccugcucuggauugccaugagcaggugaaaaugaaggcu

SEQ ID NO: 429660 - RNA, 64 nt, Human
uuaugugaguguuguuuuaaucagagauguacaugauugccaaucugcauuucuuaccagugug

SEQ ID NO: 429661 - RNA, 64 nt, Human
ucguaucauuguaaucaaagaaguaaggagguaagauugccacgugccugcugguacugugaug

SEQ ID NO: 429662 - RNA, 64 nt, Human
uuugguuugguuguaauauauuguacuuuauuaagauugccaaaaacuguuaaaauuuaaaaaa

SEQ ID NO: 429663 - RNA, 64 nt, Human
ggggggcaucucuuaauccugggguaaaaggagagauugccauacuuagacucacugugagucu

SEQ ID NO: 429664 - RNA, 64 nt, Human
gcacuguagauguaaaaauucagguuauauauaggauugccaucuucagaggugaugcugaacu

SEQ ID NO: 429665 - RNA, 64 nt, Human
uagacaaaauccaucagggaaugcugcaggaaacgauugccaacuauacgaauggcuucgagga

SEQ ID NO: 429666 - RNA, 51 nt, Human
acaagaaaccuaaaguguagagauugccauuuuuauuugugauuuuuuuuu

SEQ ID NO: 429667 - RNA, 64 nt, Human
ucuauggaacccagcaucauguggcucagucucugauugccaacucuuccucuuucuucuucuu

SEQ ID NO: 429668 - RNA, 64 nt, Human
ccaggugaagcuggccuguuuucuaaaggaaaaugauugccacaaggcaagaggaugcaucuuu

SEQ ID NO: 429669 - RNA, 64 nt, Human
uugucagaaauaagcauuucuuuguuuaauuaaggauugccagcuucaguuaagacaagaccua

SEQ ID NO: 429670 - RNA, 64 nt, Human
uaauggugcauuuauuauguucaaguuauuucaggauugccauaugugcaaacaaaucaugcaa

SEQ ID NO: 429671 - RNA, 64 nt, Human
cuccaccuucaucuugcagagccagcugaucucagauugccaagaaacuagaagccacuugcac

SEQ ID NO: 429672 - RNA, 64 nt, Human
uuuuauuguaacaaaaccucuuuaagcaauuggugauugccaugggacuuuucccaugucuucu

SEQ ID NO: 429673 - RNA, 64 nt, Human
agcaccaaagucgcagggccaguugcaggccgcugauugccauguugauuuuuaaccugauauu

SEQ ID NO: 429674 - RNA, 64 nt, Human
ccccauguauuuucauaaaggguuggaaacuauugauugccaacuuuuuaaggaugguagggau

SEQ ID NO: 429675 - RNA, 64 nt, Human
cccucagccccaaggaccggcccuccuucagugagauugccagcgcccugggagacagcaccgu

SEQ ID NO: 429676 - RNA, 64 nt, Human
auacacauugaaauacuuuaauaauguugcgauggauugccacagugugaaggaaaugcagugu

SEQ ID NO: 429677 - RNA, 64 nt, Human
ccagguuauuuacuucugaagcauuggaguuaucgauugccauugccccaugguucucacucuu

SEQ ID NO: 429678 - RNA, 64 nt, Human
gggguugcuccccuugccaaccucacacugcuaugauugccaacuccagcggucccaugucagc

SEQ ID NO: 429679 - RNA, 64 nt, Human
agacaucuuucaaccaccuuuuaggcugcauauggauugccaagucagcauaugaggaauuaaa

SEQ ID NO: 429680 - RNA, 64 nt, Human
uggggucagucaguguuggagagcccacauaugggauugccacuagcuucuucugccaauauca

SEQ ID NO: 429681 - RNA, 64 nt, Human
aaguggcugaaauuuugucuauugucuuagaauugauugccagaaauugcaagauguaauauau

SEQ ID NO: 429682 - RNA, 64 nt, Human
gccuaaacccacauuuucucuuuuaauauuuuaugauugccaucaaagaagaagaaaaagaagg

SEQ ID NO: 429683 - RNA, 64 nt, Human
uaauugacuaaagcauuccaguguccucuuucuagauugccagcucaugacauggugcuuauaa

SEQ ID NO: 429684 - RNA, 64 nt, Human
ucaaugacuguaaauugcgauaaggaaauguacugauugccaauacaccccacccucauuacau

SEQ ID NO: 429685 - RNA, 64 nt, Human
auuugguaggaaagggucaguuucucacuugacagauugccauauuuuuuuuucugggagaugu

SEQ ID NO: 429686 - RNA, 64 nt, Human
acauagacuagaacagaaauuagaagcauaguaagauugccaaaaucagagaaucuugcaaagu

SEQ ID NO: 429687 - RNA, 64 nt, Human
gaauuggucuacagguauauuccugggaugaaaggauugccaaacccaaauauagacuagauua

SEQ ID NO: 429688 - RNA, 64 nt, Human
ugaaucagaaucaccuggagggcucaugcaaucagauugccagaucucgccucagcguuucugg

SEQ ID NO: 429689 - RNA, 64 nt, Human
gaagccagaaugacacaaagcaaugcaaagacaagauugccaugcaaauggaugguuuuggaca

SEQ ID NO: 429690 - RNA, 64 nt, Human
uuucagcacccauaccacaauuaauauuaggcuggauugccaugggaaacauuuuuuggcauua

SEQ ID NO: 429691 - RNA, 64 nt, Human
uauggauaaguggaauuguacauuuuuuaaacuugauugccauuaaagcagaaauuauaagguu

SEQ ID NO: 429692 - RNA, 64 nt, Human
ugagaauauaacucuguguaggucacuggaaagugauugccauagggcugggagagaagcauug

SEQ ID NO: 429693 - RNA, 64 nt, Human
aagagucaucuaguagagaacucaucagagugcggauugccaagacccuucuccagagauuaug

SEQ ID NO: 429694 - RNA, 64 nt, Human
gggacagauuugaggacugaagcuggggcuuggggauugccacuaaguacagcugacgguuucu

SEQ ID NO: 429695 - RNA, 64 nt, Human
aacucuuuucuucuaaggacugagacuuccaggggauugccaucuuaccugucucuucuccaug

SEQ ID NO: 429696 - RNA, 64 nt, Human
agcuccuacugccaucauacuaaucaugcaaaaagauugccaaaucauguuugguaggaggacu

SEQ ID NO: 429697 - RNA, 64 nt, Human
cuagacccguguuuuuaaaggagggaacuuuggggauugccagccccugcuccuccucccaggg

SEQ ID NO: 429698 - RNA, 64 nt, Human
caaagguuauuauuuccuuuccaugguuauggucgauugccaacagccuuauaaagaaaaagaa

SEQ ID NO: 429699 - RNA, 64 nt, Human
uguaccguagacuucacaguuuucaguuuuuaaugauugccaguggaggggcuucuucagcaca

SEQ ID NO: 429700 - RNA, 64 nt, Human
uccugagagaggcagauuugagugaggugcauaggauugccaaaacuuucgugaguaucuuuca

SEQ ID NO: 429701 - RNA, 64 nt, Human
ugugugcauucauucuguagguaaaauucuuaaggauugccaugucaguccuucaguuguacag

SEQ ID NO: 429702 - RNA, 64 nt, Human
uucuaacuagaaggcucucauaaguuucuguuaugauugccauuucaauaaaugacauuaaaaa

SEQ ID NO: 429703 - RNA, 64 nt, Human
augugcuaauuuuucacaauuauugaccuguauugauugccacuguaguuugguauuucccuuu

SEQ ID NO: 429704 - RNA, 64 nt, Human
guauguguguuuauguguuggguagggaggugacgauugccacucauaaaauaaaggauuuuau

SEQ ID NO: 429705 - RNA, 64 nt, Human
uggugacagcauguagauuugggcagugaacagggauugccaugccccagucuucgcaccucgc

SEQ ID NO: 429706 - RNA, 64 nt, Human
cggggccugggcucccgggcccgaggaggaaaaggauugccaaggcuccagggcaccccucaaa

SEQ ID NO: 429707 - RNA, 64 nt, Human
augagugugacuggguguguuucuuuaggguucugauugccaguuauuuucaucaauaagucuu

SEQ ID NO: 429708 - RNA, 64 nt, Human
cucuagaucaagaugcugacuauuagggggcagugauugccaucuggggaccugucaggcuuug

SEQ ID NO: 429709 - RNA, 64 nt, Human
ugacaaaggaaacucagucuucuuggggaagaaggauugccauuagugacuuggaccaguuaga

SEQ ID NO: 429710 - RNA, 64 nt, Human
ggugcugugaggacacaccugggucugugccugagauugccaggcaagauuaaggaaaguuuuc

SEQ ID NO: 429711 - RNA, 64 nt, Human
aagggggccuggcacgguuggccaggcucugccugauugccagccagcgggcaucugaagccgg

SEQ ID NO: 429712 - RNA, 64 nt, Human
ucuauauguuucaaaaccacuugccauccuguuagauugccaguuccugggaccaggccucaga

SEQ ID NO: 429713 - RNA, 64 nt, Human
agucucagggaccaaucccugccucugcccaucagauugccaauuuggggagacagcaauauca

SEQ ID NO: 429714 - RNA, 64 nt, Human
acuuacaaaggcacuauaacaauuacagaaucaugauugccaugggccacuuuauuuacaugaa

SEQ ID NO: 429715 - RNA, 64 nt, Human
uugagcccugaguggcuaggggaaaugggaagaggauugccauggccuggccaucuuguugcug

SEQ ID NO: 429716 - RNA, 64 nt, Human
uguauaacuuagcaucaguaguucaauaaauuuggauugccaugcaagggcuugcauuauaauu

SEQ ID NO: 429717 - RNA, 64 nt, Human
ccgggcucccacugcccccugagauguacacccugauugccaggaaaacagacugcuguguuca

SEQ ID NO: 429718 - RNA, 64 nt, Human
aagcucuuugucaaauagguaguaguuagaacuggauugccauuuucauuauauaauacuuugu

SEQ ID NO: 429719 - RNA, 64 nt, Human
uuauuaaauguguugguccauugaaaguuacauggauugccaauuuuuaaaacacuaaaguuga

SEQ ID NO: 429720 - RNA, 64 nt, Human
uaaugcaaaaggacaaaaacaacucccgugauaugauugccaggagauucuguuuccccauuuc

SEQ ID NO: 429721 - RNA, 64 nt, Human
ccguccucuucccugcacaagugugucgaucuuagauugccacugcuuucauugaagacccuca

SEQ ID NO: 429722 - RNA, 64 nt, Human
guuugaaugcauaccaguguuuuuauuguuuugagauugccaauuuuccugauuuccuuaaggu

SEQ ID NO: 429723 - RNA, 64 nt, Human
ggaacaacuccauuuuaucuaaaaaaguucuugugauugccaguuuauuugcagucucuuaaug

SEQ ID NO: 429724 - RNA, 64 nt, Human
ucaaucauuuuauagucuauggcaauauccaagagauugccaagaguagaagacagaauauuuc

SEQ ID NO: 429725 - RNA, 64 nt, Human
augacuaaaaauaucacacugaauaagagagcaggauugccagguauuuuucuauuucucuccu

SEQ ID NO: 429726 - RNA, 64 nt, Human
ggcauagcuggccacagugcuacaccaccugccugauugccaagggugcccagcacguggcccc

SEQ ID NO: 429727 - RNA, 64 nt, Human
uucuucucaagcacugacacucauuaccgucugugauugccauuucuucccaaggccagucuga

SEQ ID NO: 429728 - RNA, 64 nt, Human
aaggaaauaucauuuauuuaagcagccuaucagugauugccauuagacuguugaauacuguuac

SEQ ID NO: 429729 - RNA, 64 nt, Human
uugagugaaacacaauacuuaauguauuguacuagauugccaaauucauaaaauguuaauggaa

SEQ ID NO: 429730 - RNA, 64 nt, Human
accauuccaggacaauuuuuggucccauuuugaggauugccauaguugcaaguccuuaggaucu

SEQ ID NO: 429731 - RNA, 64 nt, Human
uagagaaguccugauggaugaacuuuugaugaaagauugccaacagcugcuuuauuggaaauga

SEQ ID NO: 429732 - RNA, 64 nt, Human
caacauggaaugaaauaaaaaauaaauaauaaaagauugccaugaaucuugcaaaaaagguauu

SEQ ID NO: 429733 - RNA, 64 nt, Human
ucaaugcuuuaucugauaugcugagaaauuauuagauugccaauacucaugugcguuucaugug

SEQ ID NO: 429734 - RNA, 64 nt, Human
uuauuuuaaaaaucuagcuucccuuuuugauuaagauugccaucuugcuuuuaggcaaaacaaa

SEQ ID NO: 429735 - RNA, 64 nt, Human
uuuaacagaacccaagugaacagaggagaaaugagauugccagaaagugauuaacuuuggccgu

SEQ ID NO: 429736 - RNA, 64 nt, Human
aagggauauuugguuuggccaucucuggaugccugauugccaagcucaggaccaggcaauguga

SEQ ID NO: 429737 - RNA, 64 nt, Human
ggucccaagccucuuuugccauggucaguguucagauugccauuagaaugccuuaggguuuucu

SEQ ID NO: 429738 - RNA, 64 nt, Human
aaaccggccuaauuuuucugacugauauggaaacgauugccaacacauacuucuacuuuuaaau

SEQ ID NO: 429739 - RNA, 64 nt, Human
uuuauugagaaaaugauucacgaauuccaaaucagauugccaggaagaaauaggacgugacggu

SEQ ID NO: 429740 - RNA, 64 nt, Human
aauuccacauagcucugggccuuuuuuguauucugauugccacguuaaucuguaaucguuaagu

SEQ ID NO: 429741 - RNA, 64 nt, Human
ucaacuuggauggcucgcauaugacaggaaacuggauugccaaggcauggcagacugagcugga

SEQ ID NO: 429742 - RNA, 64 nt, Human
aaaaaauuuguccgcguugcaaacuauuauaaaugauugccacauugcaagcuauuauuuucuc

SEQ ID NO: 429743 - RNA, 64 nt, Human
auuacucuguaaacaaaguuauccuuacuugggagauugccacagccugcugcugaguugaguu

SEQ ID NO: 429744 - RNA, 64 nt, Human
cacugccccgugugaauguagcuuccaccucauggauugccacagcucaacucgggggcgccug

SEQ ID NO: 429745 - RNA, 64 nt, Human
augucaacuaugagauccccucacugaagaagcagauugccaagugccagcagcugcagcaaga

SEQ ID NO: 429746 - RNA, 64 nt, Human
ugcuuugggaaguccuugccccugagcacugccugauugccagggccuguggaggucuaggccg

SEQ ID NO: 429747 - RNA, 64 nt, Human
ucugcccugcuuagauuuuaaaaguauaagcauggauugccaauuccacuugauguaaacaaaa

SEQ ID NO: 429748 - RNA, 64 nt, Human
uggcugaugucaaucucccugcagcacagcuccagauugccauggggauuccucuauauagaau

SEQ ID NO: 429749 - RNA, 64 nt, Human
ccccaccccaaaaagggcaagagcuguggaaaaugauugccaaaugagauggcugguuagagca

SEQ ID NO: 429750 - RNA, 64 nt, Human
gaacaauaaaagacguugccuauaacagugacuugauugccaaggaauguaaauuaccuuaaac

SEQ ID NO: 429751 - RNA, 64 nt, Human
uauguuaaugcaaucuugaaaugacugaaagguagauugccagcacagugaguuucccagccug

SEQ ID NO: 429752 - RNA, 64 nt, Human
acaguucgcugucuuugguuggcugaaacuuagugauugccacaagaguaggguaccgucuguu

SEQ ID NO: 429753 - RNA, 64 nt, Human
uugaauccaggaggcggagguugcagugagccgagauugccacugcacuccagccugggcaaca

SEQ ID NO: 429754 - RNA, 64 nt, Human
aaaagaaucacagucauauauuuacuguuauauagauugccacauucuaaaauucaaauacggu

SEQ ID NO: 429755 - RNA, 64 nt, Human
uggcaggcaucgccauucuugcugaaccguuugugauugccauuugagcucuggaagccucuau

SEQ ID NO: 429756 - RNA, 64 nt, Human
uuaccuucuucauagguuuuuuuuuuuuuuaugugauugccauagugggauauucccucuccca

SEQ ID NO: 429757 - RNA, 64 nt, Human
cugggggcugcucaccucccuggcuccuggagcugauugccaaagaguuuuuucuuccucaucc

SEQ ID NO: 429758 - RNA, 64 nt, Human
aucucuuaaaaaaaaaggaaagaaaacuugaugugauugccauagguggaauaauccaacauaa

SEQ ID NO: 429759 - RNA, 64 nt, Human
ccuuucgauagcaucugauauuuguuguuaaaaugauugccauuaucaucauuacauacuguua

SEQ ID NO: 429760 - RNA, 64 nt, Human
auaagaaaacuuuucugauauuccucuaguuuuggauugccaaaauauucacaguagaggaaaa

SEQ ID NO: 429761 - RNA, 64 nt, Human
aaaaauuaugguuaauaaaauaucaccacauuuggauugccaauuuucaaagauucugaguggc

SEQ ID NO: 429762 - RNA, 64 nt, Human
ccagaggugggugcagcugaaaguaaacagaauggauugccaguuacauguaugccugcccagu

SEQ ID NO: 429763 - RNA, 64 nt, Human
gaggugacugguauagucugaugagaaagauguggauugccauaauaccucaaagauacacuug

SEQ ID NO: 429764 - RNA, 64 nt, Human
aggauggauauaaaaauaaaucagaagaacuucugauugccagaggcuuuucauuaguuuuguu

SEQ ID NO: 429765 - RNA, 64 nt, Human
ucccugaucaaggauguaauucuaauuaacuguugauugccaaacauuucacucugcugugccg

SEQ ID NO: 429766 - RNA, 64 nt, Human
ugccccaggauaaggaaaaccugagcccacaucugauugccaacggcuguagccuucuaacagu

SEQ ID NO: 429767 - RNA, 64 nt, Human
ccaacuccauuuugccaggauuuuguugugcugagauugccaaucacgguuaaacacaaagugu

SEQ ID NO: 429768 - RNA, 64 nt, Human
aaguaauuuccccacucugagugaauacuuugaugauugccaacaguggcuaauaaaaugacgg

SEQ ID NO: 429769 - RNA, 64 nt, Human
acacugcagcugcccuguaaauguucagcucagcgauugccaaauaccaguuagggaagaacac

SEQ ID NO: 429770 - RNA, 64 nt, Human
aggcggagcgaagagccaagcagaagcuccuggagauugccaccaagcccacguacccggugag

SEQ ID NO: 429771 - RNA, 64 nt, Human
guggggagggggugccaccagggcugucggccaggauugccacuccuguuucagaggaagcagg

SEQ ID NO: 429772 - RNA, 64 nt, Human
gagagaagggaccaccccauucuucucaagcaaggauugccagcgcgcgcugacacagugaugg

SEQ ID NO: 429773 - RNA, 64 nt, Human
cauaaaaucacaaaacuacaggacaguacaaacagauugccagagaaaucugggucaaagaaag

SEQ ID NO: 429774 - RNA, 64 nt, Human
auugaauaacuagugauacccucaauaaaacagggauugccaagaagggaacaaucaccccaaa

SEQ ID NO: 429775 - RNA, 64 nt, Human
uuauaggucaaaucuaauuacaacaaccaagauggauugccaaacucuucugcuugguuggaau

SEQ ID NO: 429776 - RNA, 64 nt, Human
ucuggcaagcauauaaaguauacuuguauguaaugauugccaagguaacagaauugcugacauc

SEQ ID NO: 429777 - RNA, 64 nt, Human
cuaaaacugcuuugaguuguuuggaugauuaagagauugccauuuuuaucuuggaagaacuagu

SEQ ID NO: 429778 - RNA, 64 nt, Human; identical to SEQ ID NO: 250067

SEQ ID NO: 429779 - RNA, 64 nt, Human; identical to SEQ ID NO: 250068

SEQ ID NO: 429780 - RNA, 64 nt, Human; identical to SEQ ID NO: 250069

SEQ ID NO: 429781 - RNA, 53 nt, Human; identical to SEQ ID NO: 250070

SEQ ID NO: 429782 - RNA, 64 nt, Human; identical to SEQ ID NO: 250071

SEQ ID NO: 429783 - RNA, 64 nt, Human; identical to SEQ ID NO: 250072

SEQ ID NO: 429784 - RNA, 64 nt, Human; identical to SEQ ID NO: 250073

SEQ ID NO: 429785 - RNA, 64 nt, Human; identical to SEQ ID NO: 250077

SEQ ID NO: 429786 - RNA, 64 nt, Human; identical to SEQ ID NO: 250078

SEQ ID NO: 429787 - RNA, 64 nt, Human; identical to SEQ ID NO: 250079

SEQ ID NO: 429788 - RNA, 54 nt, Human; identical to SEQ ID NO: 250080

SEQ ID NO: 429789 - RNA, 64 nt, Human; identical to SEQ ID NO: 250081

SEQ ID NO: 429790 - RNA, 64 nt, Human; identical to SEQ ID NO: 250082

SEQ ID NO: 429791 - RNA, 64 nt, Human; identical to SEQ ID NO: 250083

SEQ ID NO: 429792 - RNA, 64 nt, Human; identical to SEQ ID NO: 250084

SEQ ID NO: 429793 - RNA, 64 nt, Human; identical to SEQ ID NO: 250085

SEQ ID NO: 429794 - RNA, 64 nt, Human; identical to SEQ ID NO: 250086

SEQ ID NO: 429795 - RNA, 64 nt, Human; identical to SEQ ID NO: 250087

SEQ ID NO: 429796 - RNA, 64 nt, Human; identical to SEQ ID NO: 250088

SEQ ID NO: 429797 - RNA, 64 nt, Human; identical to SEQ ID NO: 250089

SEQ ID NO: 429798 - RNA, 64 nt, Human; identical to SEQ ID NO: 250090

SEQ ID NO: 429799 - RNA, 64 nt, Human; identical to SEQ ID NO: 250091

SEQ ID NO: 429800 - RNA, 64 nt, Human; identical to SEQ ID NO: 250095

SEQ ID NO: 429801 - RNA, 64 nt, Human; identical to SEQ ID NO: 250096

SEQ ID NO: 429802 - RNA, 64 nt, Human; identical to SEQ ID NO: 250097

SEQ ID NO: 429803 - RNA, 64 nt, Human; identical to SEQ ID NO: 250098

SEQ ID NO: 429804 - RNA, 64 nt, Human; identical to SEQ ID NO: 250099

SEQ ID NO: 429805 - RNA, 64 nt, Human; identical to SEQ ID NO: 250100

SEQ ID NO: 429806 - RNA, 64 nt, Human; identical to SEQ ID NO: 250101

SEQ ID NO: 429807 - RNA, 64 nt, Human; identical to SEQ ID NO: 250102

SEQ ID NO: 429808 - RNA, 64 nt, Human; identical to SEQ ID NO: 250103

SEQ ID NO: 429809 - RNA, 64 nt, Human; identical to SEQ ID NO: 250104

SEQ ID NO: 429810 - RNA, 64 nt, Human; identical to SEQ ID NO: 250105

SEQ ID NO: 429811 - RNA, 64 nt, Human; identical to SEQ ID NO: 250106

SEQ ID NO: 429812 - RNA, 64 nt, Human; identical to SEQ ID NO: 250107

SEQ ID NO: 429813 - RNA, 64 nt, Human; identical to SEQ ID NO: 250108

SEQ ID NO: 429814 - RNA, 64 nt, Human; identical to SEQ ID NO: 250109

SEQ ID NO: 429815 - RNA, 64 nt, Human; identical to SEQ ID NO: 250113

SEQ ID NO: 429816 - RNA, 64 nt, Human; identical to SEQ ID NO: 250114

SEQ ID NO: 429817 - RNA, 64 nt, Human; identical to SEQ ID NO: 250115

SEQ ID NO: 429818 - RNA, 64 nt, Human; identical to SEQ ID NO: 250116

SEQ ID NO: 429819 - RNA, 64 nt, Human; identical to SEQ ID NO: 250117

SEQ ID NO: 429820 - RNA, 64 nt, Human; identical to SEQ ID NO: 250118

SEQ ID NO: 429821 - RNA, 64 nt, Human; identical to SEQ ID NO: 250119

SEQ ID NO: 429822 - RNA, 64 nt, Human; identical to SEQ ID NO: 250120

SEQ ID NO: 429823 - RNA, 61 nt, Human; identical to SEQ ID NO: 250121

SEQ ID NO: 429824 - RNA, 64 nt, Human; identical to SEQ ID NO: 250122

SEQ ID NO: 429825 - RNA, 64 nt, Human; identical to SEQ ID NO: 250123

SEQ ID NO: 429826 - RNA, 64 nt, Human; identical to SEQ ID NO: 250124

SEQ ID NO: 429827 - RNA, 64 nt, Human; identical to SEQ ID NO: 250125

SEQ ID NO: 429828 - RNA, 64 nt, Human; identical to SEQ ID NO: 250126

SEQ ID NO: 429829 - RNA, 64 nt, Human; identical to SEQ ID NO: 250127

SEQ ID NO: 429830 - RNA, 64 nt, Human; identical to SEQ ID NO: 250131

SEQ ID NO: 429831 - RNA, 64 nt, Human; identical to SEQ ID NO: 250132

SEQ ID NO: 429832 - RNA, 51 nt, Human; identical to SEQ ID NO: 250133

SEQ ID NO: 429833 - RNA, 64 nt, Human; identical to SEQ ID NO: 250134

SEQ ID NO: 429834 - RNA, 64 nt, Human; identical to SEQ ID NO: 250135

SEQ ID NO: 429835 - RNA, 64 nt, Human; identical to SEQ ID NO: 250136

SEQ ID NO: 429836 - RNA, 64 nt, Human; identical to SEQ ID NO: 250137

SEQ ID NO: 429837 - RNA, 64 nt, Human; identical to SEQ ID NO: 250138

SEQ ID NO: 429838 - RNA, 64 nt, Human; identical to SEQ ID NO: 250139

SEQ ID NO: 429839 - RNA, 64 nt, Human; identical to SEQ ID NO: 250140

SEQ ID NO: 429840 - RNA, 64 nt, Human; identical to SEQ ID NO: 250141

SEQ ID NO: 429841 - RNA, 64 nt, Human; identical to SEQ ID NO: 250142

SEQ ID NO: 429842 - RNA, 64 nt, Human; identical to SEQ ID NO: 250143

SEQ ID NO: 429843 - RNA, 64 nt, Human; identical to SEQ ID NO: 250144

SEQ ID NO: 429844 - RNA, 64 nt, Human; identical to SEQ ID NO: 250145

SEQ ID NO: 429845 - RNA, 64 nt, Human; identical to SEQ ID NO: 250149

SEQ ID NO: 429846 - RNA, 64 nt, Human; identical to SEQ ID NO: 250150

SEQ ID NO: 429847 - RNA, 64 nt, Human; identical to SEQ ID NO: 250151

SEQ ID NO: 429848 - RNA, 64 nt, Human; identical to SEQ ID NO: 250152

SEQ ID NO: 429849 - RNA, 64 nt, Human; identical to SEQ ID NO: 250153

SEQ ID NO: 429850 - RNA, 64 nt, Human; identical to SEQ ID NO: 250154

SEQ ID NO: 429851 - RNA, 64 nt, Human; identical to SEQ ID NO: 250155

SEQ ID NO: 429852 - RNA, 64 nt, Human; identical to SEQ ID NO: 250156

SEQ ID NO: 429853 - RNA, 64 nt, Human; identical to SEQ ID NO: 250157

SEQ ID NO: 429854 - RNA, 64 nt, Human; identical to SEQ ID NO: 250158

SEQ ID NO: 429855 - RNA, 64 nt, Human; identical to SEQ ID NO: 250159

SEQ ID NO: 429856 - RNA, 50 nt, Human; identical to SEQ ID NO: 250160

SEQ ID NO: 429857 - RNA, 64 nt, Human; identical to SEQ ID NO: 250161

SEQ ID NO: 429858 - RNA, 64 nt, Human; identical to SEQ ID NO: 250162

SEQ ID NO: 429859 - RNA, 64 nt, Human; identical to SEQ ID NO: 250163

SEQ ID NO: 429860 - RNA, 64 nt, Human; identical to SEQ ID NO: 250167

SEQ ID NO: 429861 - RNA, 64 nt, Human; identical to SEQ ID NO: 250168

SEQ ID NO: 429862 - RNA, 64 nt, Human; identical to SEQ ID NO: 250169

SEQ ID NO: 429863 - RNA, 64 nt, Human; identical to SEQ ID NO: 250170

SEQ ID NO: 429864 - RNA, 64 nt, Human; identical to SEQ ID NO: 250171

SEQ ID NO: 429865 - RNA, 64 nt, Human; identical to SEQ ID NO: 250172

SEQ ID NO: 429866 - RNA, 64 nt, Human; identical to SEQ ID NO: 250173

SEQ ID NO: 429867 - RNA, 64 nt, Human; identical to SEQ ID NO: 250174

SEQ ID NO: 429868 - RNA, 64 nt, Human; identical to SEQ ID NO: 250175

SEQ ID NO: 429869 - RNA, 64 nt, Human; identical to SEQ ID NO: 250176

SEQ ID NO: 429870 - RNA, 64 nt, Human; identical to SEQ ID NO: 250177

SEQ ID NO: 429871 - RNA, 64 nt, Human; identical to SEQ ID NO: 250178

SEQ ID NO: 429872 - RNA, 64 nt, Human; identical to SEQ ID NO: 250179

SEQ ID NO: 429873 - RNA, 64 nt, Human; identical to SEQ ID NO: 250180

SEQ ID NO: 429874 - RNA, 64 nt, Human; identical to SEQ ID NO: 250181

SEQ ID NO: 429875 - RNA, 64 nt, Human; identical to SEQ ID NO: 250185

SEQ ID NO: 429876 - RNA, 64 nt, Human; identical to SEQ ID NO: 250186

SEQ ID NO: 429877 - RNA, 64 nt, Human; identical to SEQ ID NO: 250187

SEQ ID NO: 429878 - RNA, 64 nt, Human; identical to SEQ ID NO: 250188

SEQ ID NO: 429879 - RNA, 64 nt, Human; identical to SEQ ID NO: 250189

SEQ ID NO: 429880 - RNA, 64 nt, Human; identical to SEQ ID NO: 250190

SEQ ID NO: 429881 - RNA, 64 nt, Human; identical to SEQ ID NO: 250191

SEQ ID NO: 429882 - RNA, 64 nt, Human; identical to SEQ ID NO: 250192

SEQ ID NO: 429883 - RNA, 64 nt, Human; identical to SEQ ID NO: 250193

SEQ ID NO: 429884 - RNA, 64 nt, Human; identical to SEQ ID NO: 250194

SEQ ID NO: 429885 - RNA, 64 nt, Human; identical to SEQ ID NO: 250195

SEQ ID NO: 429886 - RNA, 64 nt, Human; identical to SEQ ID NO: 250196

SEQ ID NO: 429887 - RNA, 64 nt, Human; identical to SEQ ID NO: 250197

SEQ ID NO: 429888 - RNA, 64 nt, Human; identical to SEQ ID NO: 250198

SEQ ID NO: 429889 - RNA, 64 nt, Human; identical to SEQ ID NO: 250199

SEQ ID NO: 429890 - RNA, 64 nt, Human; identical to SEQ ID NO: 249744

SEQ ID NO: 429891 - RNA, 64 nt, Human; identical to SEQ ID NO: 249745

SEQ ID NO: 429892 - RNA, 64 nt, Human; identical to SEQ ID NO: 249746

SEQ ID NO: 429893 - RNA, 64 nt, Human; identical to SEQ ID NO: 249747

SEQ ID NO: 429894 - RNA, 64 nt, Human; identical to SEQ ID NO: 249748

SEQ ID NO: 429895 - RNA, 64 nt, Human; identical to SEQ ID NO: 249749

SEQ ID NO: 429896 - RNA, 64 nt, Human; identical to SEQ ID NO: 249750

SEQ ID NO: 429897 - RNA, 64 nt, Human; identical to SEQ ID NO: 249751

SEQ ID NO: 429898 - RNA, 64 nt, Human; identical to SEQ ID NO: 249752

SEQ ID NO: 429899 - RNA, 64 nt, Human; identical to SEQ ID NO: 249753

SEQ ID NO: 429900 - RNA, 64 nt, Human; identical to SEQ ID NO: 249754

SEQ ID NO: 429901 - RNA, 64 nt, Human; identical to SEQ ID NO: 249755

SEQ ID NO: 429902 - RNA, 64 nt, Human; identical to SEQ ID NO: 249756

SEQ ID NO: 429903 - RNA, 64 nt, Human; identical to SEQ ID NO: 249757

SEQ ID NO: 429904 - RNA, 64 nt, Human; identical to SEQ ID NO: 250203

SEQ ID NO: 429905 - RNA, 64 nt, Human; identical to SEQ ID NO: 250223

SEQ ID NO: 429906 - RNA, 64 nt, Human; identical to SEQ ID NO: 250224

SEQ ID NO: 429907 - RNA, 64 nt, Human; identical to SEQ ID NO: 250225

SEQ ID NO: 429908 - RNA, 64 nt, Human; identical to SEQ ID NO: 250226

SEQ ID NO: 429909 - RNA, 64 nt, Human; identical to SEQ ID NO: 250227

SEQ ID NO: 429910 - RNA, 64 nt, Human; identical to SEQ ID NO: 250228

SEQ ID NO: 429911 - RNA, 64 nt, Human; identical to SEQ ID NO: 250229

SEQ ID NO: 429912 - RNA, 64 nt, Human; identical to SEQ ID NO: 250230

SEQ ID NO: 429913 - RNA, 64 nt, Human; identical to SEQ ID NO: 250231

SEQ ID NO: 429914 - RNA, 64 nt, Human; identical to SEQ ID NO: 250232

SEQ ID NO: 429915 - RNA, 64 nt, Human; identical to SEQ ID NO: 250233

SEQ ID NO: 429916 - RNA, 64 nt, Human; identical to SEQ ID NO: 250234

SEQ ID NO: 429917 - RNA, 64 nt, Human; identical to SEQ ID NO: 250235

SEQ ID NO: 429918 - RNA, 64 nt, Human; identical to SEQ ID NO: 250236

SEQ ID NO: 429919 - RNA, 64 nt, Human; identical to SEQ ID NO: 250237

SEQ ID NO: 429920 - RNA, 64 nt, Human; identical to SEQ ID NO: 250241

SEQ ID NO: 429921 - RNA, 64 nt, Human; identical to SEQ ID NO: 250242

SEQ ID NO: 429922 - RNA, 64 nt, Human; identical to SEQ ID NO: 250243

SEQ ID NO: 429923 - RNA, 64 nt, Human; identical to SEQ ID NO: 250244

SEQ ID NO: 429924 - RNA, 64 nt, Human; identical to SEQ ID NO: 250245

SEQ ID NO: 429925 - RNA, 64 nt, Human; identical to SEQ ID NO: 250246

SEQ ID NO: 429926 - RNA, 64 nt, Human; identical to SEQ ID NO: 250247

SEQ ID NO: 429927 - RNA, 64 nt, Human; identical to SEQ ID NO: 250248

SEQ ID NO: 429928 - RNA, 64 nt, Human; identical to SEQ ID NO: 250249

SEQ ID NO: 429929 - RNA, 64 nt, Human; identical to SEQ ID NO: 250250

SEQ ID NO: 429930 - RNA, 64 nt, Human; identical to SEQ ID NO: 250251

SEQ ID NO: 429931 - RNA, 52 nt, Human; identical to SEQ ID NO: 250252

SEQ ID NO: 429932 - RNA, 64 nt, Human; identical to SEQ ID NO: 250253

SEQ ID NO: 429933 - RNA, 64 nt, Human; identical to SEQ ID NO: 250254

SEQ ID NO: 429934 - RNA, 64 nt, Human; identical to SEQ ID NO: 250255

SEQ ID NO: 429935 - RNA, 64 nt, Human; identical to SEQ ID NO: 250259

SEQ ID NO: 429936 - RNA, 64 nt, Human; identical to SEQ ID NO: 250260

SEQ ID NO: 429937 - RNA, 64 nt, Human; identical to SEQ ID NO: 250261

SEQ ID NO: 429938 - RNA, 64 nt, Human; identical to SEQ ID NO: 250262

SEQ ID NO: 429939 - RNA, 64 nt, Human; identical to SEQ ID NO: 250263

SEQ ID NO: 429940 - RNA, 64 nt, Human; identical to SEQ ID NO: 250264

SEQ ID NO: 429941 - RNA, 64 nt, Human; identical to SEQ ID NO: 250265

SEQ ID NO: 429942 - RNA, 64 nt, Human; identical to SEQ ID NO: 250266

SEQ ID NO: 429943 - RNA, 64 nt, Human; identical to SEQ ID NO: 250267

SEQ ID NO: 429944 - RNA, 64 nt, Human; identical to SEQ ID NO: 250268

SEQ ID NO: 429945 - RNA, 64 nt, Human; identical to SEQ ID NO: 250269

SEQ ID NO: 429946 - RNA, 64 nt, Human; identical to SEQ ID NO: 250270

SEQ ID NO: 429947 - RNA, 64 nt, Human; identical to SEQ ID NO: 250271

SEQ ID NO: 429948 - RNA, 61 nt, Human; identical to SEQ ID NO: 250272

SEQ ID NO: 429949 - RNA, 64 nt, Human; identical to SEQ ID NO: 250273

SEQ ID NO: 429950 - RNA, 64 nt, Human; identical to SEQ ID NO: 250277

SEQ ID NO: 429951 - RNA, 64 nt, Human; identical to SEQ ID NO: 250278

SEQ ID NO: 429952 - RNA, 64 nt, Human; identical to SEQ ID NO: 250279

SEQ ID NO: 429953 - RNA, 64 nt, Human; identical to SEQ ID NO: 250280

SEQ ID NO: 429954 - RNA, 64 nt, Human; identical to SEQ ID NO: 250281

SEQ ID NO: 429955 - RNA, 64 nt, Human; identical to SEQ ID NO: 250282

SEQ ID NO: 429956 - RNA, 64 nt, Human; identical to SEQ ID NO: 250283

SEQ ID NO: 429957 - RNA, 64 nt, Human; identical to SEQ ID NO: 250284

SEQ ID NO: 429958 - RNA, 64 nt, Human; identical to SEQ ID NO: 250285

SEQ ID NO: 429959 - RNA, 64 nt, Human; identical to SEQ ID NO: 250286

SEQ ID NO: 429960 - RNA, 64 nt, Human; identical to SEQ ID NO: 250287

SEQ ID NO: 429961 - RNA, 64 nt, Human; identical to SEQ ID NO: 250288

SEQ ID NO: 429962 - RNA, 64 nt, Human; identical to SEQ ID NO: 250289

SEQ ID NO: 429963 - RNA, 64 nt, Human; identical to SEQ ID NO: 250290

SEQ ID NO: 429964 - RNA, 64 nt, Human; identical to SEQ ID NO: 250291

SEQ ID NO: 429965 - RNA, 64 nt, Human; identical to SEQ ID NO: 250295

SEQ ID NO: 429966 - RNA, 64 nt, Human; identical to SEQ ID NO: 250296

SEQ ID NO: 429967 - RNA, 64 nt, Human; identical to SEQ ID NO: 250297

SEQ ID NO: 429968 - RNA, 64 nt, Human; identical to SEQ ID NO: 250298

SEQ ID NO: 429969 - RNA, 64 nt, Human; identical to SEQ ID NO: 250299

SEQ ID NO: 429970 - RNA, 64 nt, Human; identical to SEQ ID NO: 250300

SEQ ID NO: 429971 - RNA, 64 nt, Human; identical to SEQ ID NO: 250301

SEQ ID NO: 429972 - RNA, 64 nt, Human; identical to SEQ ID NO: 250302

SEQ ID NO: 429973 - RNA, 64 nt, Human; identical to SEQ ID NO: 250303

SEQ ID NO: 429974 - RNA, 64 nt, Human; identical to SEQ ID NO: 250304

SEQ ID NO: 429975 - RNA, 64 nt, Human; identical to SEQ ID NO: 250305

SEQ ID NO: 429976 - RNA, 64 nt, Human; identical to SEQ ID NO: 250306

SEQ ID NO: 429977 - RNA, 64 nt, Human; identical to SEQ ID NO: 250307

SEQ ID NO: 429978 - RNA, 64 nt, Human; identical to SEQ ID NO: 250308

SEQ ID NO: 429979 - RNA, 64 nt, Human; identical to SEQ ID NO: 250309

SEQ ID NO: 429980 - RNA, 64 nt, Human; identical to SEQ ID NO: 250313

SEQ ID NO: 429981 - RNA, 64 nt, Human; identical to SEQ ID NO: 250314

SEQ ID NO: 429982 - RNA, 64 nt, Human; identical to SEQ ID NO: 250315

SEQ ID NO: 429983 - RNA, 64 nt, Human; identical to SEQ ID NO: 250316

SEQ ID NO: 429984 - RNA, 64 nt, Human; identical to SEQ ID NO: 250317

SEQ ID NO: 429985 - RNA, 64 nt, Human; identical to SEQ ID NO: 250318

SEQ ID NO: 429986 - RNA, 64 nt, Human; identical to SEQ ID NO: 250319

SEQ ID NO: 429987 - RNA, 64 nt, Human; identical to SEQ ID NO: 250320

SEQ ID NO: 429988 - RNA, 64 nt, Human; identical to SEQ ID NO: 250321

SEQ ID NO: 429989 - RNA, 64 nt, Human; identical to SEQ ID NO: 250322

SEQ ID NO: 429990 - RNA, 64 nt, Human; identical to SEQ ID NO: 250323

SEQ ID NO: 429991 - RNA, 64 nt, Human; identical to SEQ ID NO: 250324

SEQ ID NO: 429992 - RNA, 64 nt, Human; identical to SEQ ID NO: 250325

SEQ ID NO: 429993 - RNA, 64 nt, Human; identical to SEQ ID NO: 250326

SEQ ID NO: 429994 - RNA, 64 nt, Human; identical to SEQ ID NO: 250327

SEQ ID NO: 429995 - RNA, 64 nt, Human; identical to SEQ ID NO: 250331

SEQ ID NO: 429996 - RNA, 64 nt, Human; identical to SEQ ID NO: 250332

SEQ ID NO: 429997 - RNA, 64 nt, Human; identical to SEQ ID NO: 250333

SEQ ID NO: 429998 - RNA, 64 nt, Human; identical to SEQ ID NO: 250334

SEQ ID NO: 429999 - RNA, 64 nt, Human; identical to SEQ ID NO: 250335

SEQ ID NO: 430000 - RNA, 64 nt, Human; identical to SEQ ID NO: 250336

SEQ ID NO: 430001 - RNA, 64 nt, Human; identical to SEQ ID NO: 250337

SEQ ID NO: 430002 - RNA, 64 nt, Human; identical to SEQ ID NO: 250338

SEQ ID NO: 430003 - RNA, 64 nt, Human; identical to SEQ ID NO: 250339

SEQ ID NO: 430004 - RNA, 64 nt, Human; identical to SEQ ID NO: 250340

SEQ ID NO: 430005 - RNA, 64 nt, Human; identical to SEQ ID NO: 250341

SEQ ID NO: 430006 - RNA, 64 nt, Human; identical to SEQ ID NO: 250342

SEQ ID NO: 430007 - RNA, 64 nt, Human; identical to SEQ ID NO: 250343

SEQ ID NO: 430008 - RNA, 64 nt, Human; identical to SEQ ID NO: 250344

SEQ ID NO: 430009 - RNA, 64 nt, Human; identical to SEQ ID NO: 250345

SEQ ID NO: 430010 - RNA, 64 nt, Human; identical to SEQ ID NO: 250349

SEQ ID NO: 430011 - RNA, 55 nt, Human; identical to SEQ ID NO: 250350

SEQ ID NO: 430012 - RNA, 64 nt, Human; identical to SEQ ID NO: 250351

SEQ ID NO: 430013 - RNA, 64 nt, Human; identical to SEQ ID NO: 250352

SEQ ID NO: 430014 - RNA, 64 nt, Human; identical to SEQ ID NO: 250353

SEQ ID NO: 430015 - RNA, 64 nt, Human; identical to SEQ ID NO: 250354

SEQ ID NO: 430016 - RNA, 64 nt, Human; identical to SEQ ID NO: 250355

SEQ ID NO: 430017 - RNA, 64 nt, Human; identical to SEQ ID NO: 250356

SEQ ID NO: 430018 - RNA, 64 nt, Human; identical to SEQ ID NO: 250357

SEQ ID NO: 430019 - RNA, 64 nt, Human; identical to SEQ ID NO: 250358

SEQ ID NO: 430020 - RNA, 64 nt, Human; identical to SEQ ID NO: 250359

SEQ ID NO: 430021 - RNA, 64 nt, Human; identical to SEQ ID NO: 250360

SEQ ID NO: 430022 - RNA, 64 nt, Human; identical to SEQ ID NO: 250361

SEQ ID NO: 430023 - RNA, 64 nt, Human; identical to SEQ ID NO: 250362

SEQ ID NO: 430024 - RNA, 64 nt, Human; identical to SEQ ID NO: 250363

SEQ ID NO: 430025 - RNA, 64 nt, Human; identical to SEQ ID NO: 250367

SEQ ID NO: 430026 - RNA, 64 nt, Human; identical to SEQ ID NO: 250368

SEQ ID NO: 430027 - RNA, 64 nt, Human; identical to SEQ ID NO: 250369

SEQ ID NO: 430028 - RNA, 64 nt, Human; identical to SEQ ID NO: 250370

SEQ ID NO: 430029 - RNA, 64 nt, Human; identical to SEQ ID NO: 250371

SEQ ID NO: 430030 - RNA, 64 nt, Human; identical to SEQ ID NO: 250372

SEQ ID NO: 430031 - RNA, 64 nt, Human; identical to SEQ ID NO: 250373

SEQ ID NO: 430032 - RNA, 64 nt, Human; identical to SEQ ID NO: 250374

SEQ ID NO: 430033 - RNA, 64 nt, Human; identical to SEQ ID NO: 250375

SEQ ID NO: 430034 - RNA, 64 nt, Human; identical to SEQ ID NO: 250376

SEQ ID NO: 430035 - RNA, 64 nt, Human; identical to SEQ ID NO: 250377

SEQ ID NO: 430036 - RNA, 64 nt, Human; identical to SEQ ID NO: 250378

SEQ ID NO: 430037 - RNA, 64 nt, Human; identical to SEQ ID NO: 250379

SEQ ID NO: 430038 - RNA, 64 nt, Human; identical to SEQ ID NO: 250380

SEQ ID NO: 430039 - RNA, 64 nt, Human; identical to SEQ ID NO: 250381

SEQ ID NO: 430040 - RNA, 64 nt, Human; identical to SEQ ID NO: 250385

SEQ ID NO: 430041 - RNA, 64 nt, Human; identical to SEQ ID NO: 250386

SEQ ID NO: 430042 - RNA, 64 nt, Human; identical to SEQ ID NO: 250387

SEQ ID NO: 430043 - RNA, 64 nt, Human; identical to SEQ ID NO: 250388

SEQ ID NO: 430044 - RNA, 64 nt, Human; identical to SEQ ID NO: 250389

SEQ ID NO: 430045 - RNA, 64 nt, Human; identical to SEQ ID NO: 250390

SEQ ID NO: 430046 - RNA, 64 nt, Human; identical to SEQ ID NO: 250391

SEQ ID NO: 430047 - RNA, 64 nt, Human; identical to SEQ ID NO: 250392

SEQ ID NO: 430048 - RNA, 64 nt, Human; identical to SEQ ID NO: 250393

SEQ ID NO: 430049 - RNA, 64 nt, Human; identical to SEQ ID NO: 250394

SEQ ID NO: 430050 - RNA, 64 nt, Human; identical to SEQ ID NO: 250395

SEQ ID NO: 430051 - RNA, 64 nt, Human; identical to SEQ ID NO: 250396

SEQ ID NO: 430052 - RNA, 64 nt, Human; identical to SEQ ID NO: 250397

SEQ ID NO: 430053 - RNA, 64 nt, Human; identical to SEQ ID NO: 250398

SEQ ID NO: 430054 - RNA, 64 nt, Human; identical to SEQ ID NO: 250399

SEQ ID NO: 430055 - RNA, 59 nt, Human; identical to SEQ ID NO: 250403

SEQ ID NO: 430056 - RNA, 64 nt, Human; identical to SEQ ID NO: 250404

SEQ ID NO: 430057 - RNA, 64 nt, Human; identical to SEQ ID NO: 250405

SEQ ID NO: 430058 - RNA, 64 nt, Human; identical to SEQ ID NO: 250406

SEQ ID NO: 430059 - RNA, 64 nt, Human; identical to SEQ ID NO: 250407

SEQ ID NO: 430060 - RNA, 64 nt, Human; identical to SEQ ID NO: 250408

SEQ ID NO: 430061 - RNA, 64 nt, Human; identical to SEQ ID NO: 250409

SEQ ID NO: 430062 - RNA, 64 nt, Human; identical to SEQ ID NO: 250410

SEQ ID NO: 430063 - RNA, 64 nt, Human; identical to SEQ ID NO: 250411

SEQ ID NO: 430064 - RNA, 64 nt, Human; identical to SEQ ID NO: 250412

SEQ ID NO: 430065 - RNA, 64 nt, Human; identical to SEQ ID NO: 250413

SEQ ID NO: 430066 - RNA, 64 nt, Human; identical to SEQ ID NO: 250414

SEQ ID NO: 430067 - RNA, 64 nt, Human; identical to SEQ ID NO: 250415

SEQ ID NO: 430068 - RNA, 64 nt, Human; identical to SEQ ID NO: 250416

SEQ ID NO: 430069 - RNA, 64 nt, Human; identical to SEQ ID NO: 250417

SEQ ID NO: 430070 - RNA, 64 nt, Human; identical to SEQ ID NO: 250421

SEQ ID NO: 430071 - RNA, 64 nt, Human; identical to SEQ ID NO: 250422

SEQ ID NO: 430072 - RNA, 64 nt, Human; identical to SEQ ID NO: 250423

SEQ ID NO: 430073 - RNA, 64 nt, Human; identical to SEQ ID NO: 250424

SEQ ID NO: 430074 - RNA, 64 nt, Human; identical to SEQ ID NO: 250425

SEQ ID NO: 430075 - RNA, 64 nt, Human; identical to SEQ ID NO: 250426

SEQ ID NO: 430076 - RNA, 64 nt, Human; identical to SEQ ID NO: 250427

SEQ ID NO: 430077 - RNA, 64 nt, Human; identical to SEQ ID NO: 250428

SEQ ID NO: 430078 - RNA, 64 nt, Human; identical to SEQ ID NO: 250429

SEQ ID NO: 430079 - RNA, 64 nt, Human; identical to SEQ ID NO: 250430

SEQ ID NO: 430080 - RNA, 64 nt, Human; identical to SEQ ID NO: 250431

SEQ ID NO: 430081 - RNA, 64 nt, Human; identical to SEQ ID NO: 250432

SEQ ID NO: 430082 - RNA, 64 nt, Human; identical to SEQ ID NO: 250433

SEQ ID NO: 430083 - RNA, 64 nt, Human; identical to SEQ ID NO: 250434

SEQ ID NO: 430084 - RNA, 64 nt, Human; identical to SEQ ID NO: 250435

SEQ ID NO: 430085 - RNA, 64 nt, Human; identical to SEQ ID NO: 250439

SEQ ID NO: 430086 - RNA, 64 nt, Human; identical to SEQ ID NO: 250440

SEQ ID NO: 430087 - RNA, 64 nt, Human; identical to SEQ ID NO: 250441

SEQ ID NO: 430088 - RNA, 64 nt, Human; identical to SEQ ID NO: 250442

SEQ ID NO: 430089 - RNA, 64 nt, Human; identical to SEQ ID NO: 250443

SEQ ID NO: 430090 - RNA, 64 nt, Human; identical to SEQ ID NO: 250444

SEQ ID NO: 430091 - RNA, 64 nt, Human; identical to SEQ ID NO: 250445

SEQ ID NO: 430092 - RNA, 64 nt, Human; identical to SEQ ID NO: 250446

SEQ ID NO: 430093 - RNA, 64 nt, Human; identical to SEQ ID NO: 250447

SEQ ID NO: 430094 - RNA, 64 nt, Human; identical to SEQ ID NO: 250448

SEQ ID NO: 430095 - RNA, 64 nt, Human; identical to SEQ ID NO: 250449

SEQ ID NO: 430096 - RNA, 64 nt, Human; identical to SEQ ID NO: 250450

SEQ ID NO: 430097 - RNA, 64 nt, Human; identical to SEQ ID NO: 250451

SEQ ID NO: 430098 - RNA, 64 nt, Human; identical to SEQ ID NO: 250452

SEQ ID NO: 430099 - RNA, 64 nt, Human; identical to SEQ ID NO: 250453

SEQ ID NO: 430100 - RNA, 64 nt, Human; identical to SEQ ID NO: 250457

SEQ ID NO: 430101 - RNA, 64 nt, Human; identical to SEQ ID NO: 250458

SEQ ID NO: 430102 - RNA, 64 nt, Human; identical to SEQ ID NO: 250459

SEQ ID NO: 430103 - RNA, 64 nt, Human; identical to SEQ ID NO: 250460

SEQ ID NO: 430104 - RNA, 64 nt, Human; identical to SEQ ID NO: 250461

SEQ ID NO: 430105 - RNA, 64 nt, Human; identical to SEQ ID NO: 250462

SEQ ID NO: 430106 - RNA, 64 nt, Human; identical to SEQ ID NO: 250463

SEQ ID NO: 430107 - RNA, 64 nt, Human; identical to SEQ ID NO: 250464

SEQ ID NO: 430108 - RNA, 64 nt, Human; identical to SEQ ID NO: 250465

SEQ ID NO: 430109 - RNA, 64 nt, Human; identical to SEQ ID NO: 250466

SEQ ID NO: 430110 - RNA, 64 nt, Human; identical to SEQ ID NO: 250467

SEQ ID NO: 430111 - RNA, 64 nt, Human; identical to SEQ ID NO: 250468

SEQ ID NO: 430112 - RNA, 64 nt, Human; identical to SEQ ID NO: 250469

SEQ ID NO: 430113 - RNA, 64 nt, Human; identical to SEQ ID NO: 250470

SEQ ID NO: 430114 - RNA, 64 nt, Human; identical to SEQ ID NO: 250471

SEQ ID NO: 430115 - RNA, 64 nt, Human; identical to SEQ ID NO: 250475

SEQ ID NO: 430116 - RNA, 64 nt, Human; identical to SEQ ID NO: 250476

SEQ ID NO: 430117 - RNA, 64 nt, Human; identical to SEQ ID NO: 250477

SEQ ID NO: 430118 - RNA, 64 nt, Human; identical to SEQ ID NO: 250478

SEQ ID NO: 430119 - RNA, 64 nt, Human; identical to SEQ ID NO: 250479

SEQ ID NO: 430120 - RNA, 64 nt, Human; identical to SEQ ID NO: 250480

SEQ ID NO: 430121 - RNA, 64 nt, Human; identical to SEQ ID NO: 250481

SEQ ID NO: 430122 - RNA, 64 nt, Human; identical to SEQ ID NO: 250482

SEQ ID NO: 430123 - RNA, 64 nt, Human; identical to SEQ ID NO: 250483

SEQ ID NO: 430124 - RNA, 64 nt, Human; identical to SEQ ID NO: 250484

SEQ ID NO: 430125 - RNA, 64 nt, Human; identical to SEQ ID NO: 250485

SEQ ID NO: 430126 - RNA, 64 nt, Human; identical to SEQ ID NO: 250486

SEQ ID NO: 430127 - RNA, 64 nt, Human; identical to SEQ ID NO: 250487

SEQ ID NO: 430128 - RNA, 64 nt, Human; identical to SEQ ID NO: 250488

SEQ ID NO: 430129 - RNA, 64 nt, Human; identical to SEQ ID NO: 250489

SEQ ID NO: 430130 - RNA, 64 nt, Human; identical to SEQ ID NO: 250493

SEQ ID NO: 430131 - RNA, 64 nt, Human; identical to SEQ ID NO: 250494

SEQ ID NO: 430132 - RNA, 64 nt, Human; identical to SEQ ID NO: 250495

SEQ ID NO: 430133 - RNA, 64 nt, Human; identical to SEQ ID NO: 250496

SEQ ID NO: 430134 - RNA, 64 nt, Human; identical to SEQ ID NO: 250497

SEQ ID NO: 430135 - RNA, 64 nt, Human; identical to SEQ ID NO: 250498

SEQ ID NO: 430136 - RNA, 64 nt, Human; identical to SEQ ID NO: 250499

SEQ ID NO: 430137 - RNA, 64 nt, Human; identical to SEQ ID NO: 250500

SEQ ID NO: 430138 - RNA, 64 nt, Human; identical to SEQ ID NO: 250501

SEQ ID NO: 430139 - RNA, 64 nt, Human; identical to SEQ ID NO: 250502

SEQ ID NO: 430140 - RNA, 64 nt, Human; identical to SEQ ID NO: 250503

SEQ ID NO: 430141 - RNA, 64 nt, Human; identical to SEQ ID NO: 250504

SEQ ID NO: 430142 - RNA, 64 nt, Human; identical to SEQ ID NO: 250505

SEQ ID NO: 430143 - RNA, 64 nt, Human; identical to SEQ ID NO: 250506

SEQ ID NO: 430144 - RNA, 64 nt, Human; identical to SEQ ID NO: 250507

SEQ ID NO: 430145 - RNA, 64 nt, Human; identical to SEQ ID NO: 250511

SEQ ID NO: 430146 - RNA, 50 nt, Human; identical to SEQ ID NO: 250512

SEQ ID NO: 430147 - RNA, 64 nt, Human; identical to SEQ ID NO: 250513

SEQ ID NO: 430148 - RNA, 64 nt, Human; identical to SEQ ID NO: 250514

SEQ ID NO: 430149 - RNA, 64 nt, Human; identical to SEQ ID NO: 250515

SEQ ID NO: 430150 - RNA, 64 nt, Human; identical to SEQ ID NO: 250516

SEQ ID NO: 430151 - RNA, 64 nt, Human; identical to SEQ ID NO: 250517

SEQ ID NO: 430152 - RNA, 64 nt, Human; identical to SEQ ID NO: 250518

SEQ ID NO: 430153 - RNA, 64 nt, Human; identical to SEQ ID NO: 250519

SEQ ID NO: 430154 - RNA, 64 nt, Human; identical to SEQ ID NO: 250520

SEQ ID NO: 430155 - RNA, 64 nt, Human; identical to SEQ ID NO: 250521

SEQ ID NO: 430156 - RNA, 64 nt, Human; identical to SEQ ID NO: 250522

SEQ ID NO: 430157 - RNA, 64 nt, Human; identical to SEQ ID NO: 250523

SEQ ID NO: 430158 - RNA, 64 nt, Human; identical to SEQ ID NO: 250524

SEQ ID NO: 430159 - RNA, 64 nt, Human; identical to SEQ ID NO: 250525

SEQ ID NO: 430160 - RNA, 64 nt, Human; identical to SEQ ID NO: 250529

SEQ ID NO: 430161 - RNA, 64 nt, Human; identical to SEQ ID NO: 250530

SEQ ID NO: 430162 - RNA, 64 nt, Human; identical to SEQ ID NO: 250531

SEQ ID NO: 430163 - RNA, 64 nt, Human; identical to SEQ ID NO: 250532

SEQ ID NO: 430164 - RNA, 64 nt, Human; identical to SEQ ID NO: 250533

SEQ ID NO: 430165 - RNA, 64 nt, Human; identical to SEQ ID NO: 250534

SEQ ID NO: 430166 - RNA, 64 nt, Human; identical to SEQ ID NO: 250535

SEQ ID NO: 430167 - RNA, 64 nt, Human; identical to SEQ ID NO: 250536

SEQ ID NO: 430168 - RNA, 64 nt, Human; identical to SEQ ID NO: 250537

SEQ ID NO: 430169 - RNA, 64 nt, Human; identical to SEQ ID NO: 250538

SEQ ID NO: 430170 - RNA, 64 nt, Human; identical to SEQ ID NO: 250539

SEQ ID NO: 430171 - RNA, 64 nt, Human; identical to SEQ ID NO: 250540

SEQ ID NO: 430172 - RNA, 64 nt, Human; identical to SEQ ID NO: 250541

SEQ ID NO: 430173 - RNA, 64 nt, Human; identical to SEQ ID NO: 250542

SEQ ID NO: 430174 - RNA, 64 nt, Human; identical to SEQ ID NO: 250543

SEQ ID NO: 430175 - RNA, 64 nt, Human; identical to SEQ ID NO: 250547

SEQ ID NO: 430176 - RNA, 64 nt, Human; identical to SEQ ID NO: 250548

SEQ ID NO: 430177 - RNA, 64 nt, Human; identical to SEQ ID NO: 250549

SEQ ID NO: 430178 - RNA, 64 nt, Human; identical to SEQ ID NO: 250550

SEQ ID NO: 430179 - RNA, 64 nt, Human; identical to SEQ ID NO: 250551

SEQ ID NO: 430180 - RNA, 64 nt, Human; identical to SEQ ID NO: 250552

SEQ ID NO: 430181 - RNA, 64 nt, Human; identical to SEQ ID NO: 250553

SEQ ID NO: 430182 - RNA, 64 nt, Human; identical to SEQ ID NO: 250554

SEQ ID NO: 430183 - RNA, 64 nt, Human; identical to SEQ ID NO: 250555

SEQ ID NO: 430184 - RNA, 64 nt, Human; identical to SEQ ID NO: 250556

SEQ ID NO: 430185 - RNA, 64 nt, Human; identical to SEQ ID NO: 250557

SEQ ID NO: 430186 - RNA, 64 nt, Human; identical to SEQ ID NO: 250558

SEQ ID NO: 430187 - RNA, 64 nt, Human; identical to SEQ ID NO: 250559

SEQ ID NO: 430188 - RNA, 64 nt, Human; identical to SEQ ID NO: 250560

SEQ ID NO: 430189 - RNA, 64 nt, Human; identical to SEQ ID NO: 250561

SEQ ID NO: 430190 - RNA, 64 nt, Human; identical to SEQ ID NO: 250564

SEQ ID NO: 430191 - RNA, 64 nt, Human; identical to SEQ ID NO: 250565

SEQ ID NO: 430192 - RNA, 64 nt, Human; identical to SEQ ID NO: 250566

SEQ ID NO: 430193 - RNA, 64 nt, Human; identical to SEQ ID NO: 250567

SEQ ID NO: 430194 - RNA, 64 nt, Human; identical to SEQ ID NO: 250568

SEQ ID NO: 430195 - RNA, 64 nt, Human; identical to SEQ ID NO: 250569

SEQ ID NO: 430196 - RNA, 64 nt, Human; identical to SEQ ID NO: 250570

SEQ ID NO: 430197 - RNA, 64 nt, Human; identical to SEQ ID NO: 250571

SEQ ID NO: 430198 - RNA, 64 nt, Human; identical to SEQ ID NO: 250572

SEQ ID NO: 430199 - RNA, 64 nt, Human; identical to SEQ ID NO: 250573

SEQ ID NO: 430200 - RNA, 64 nt, Human; identical to SEQ ID NO: 250574

SEQ ID NO: 430201 - RNA, 64 nt, Human; identical to SEQ ID NO: 250575

SEQ ID NO: 430202 - RNA, 64 nt, Human; identical to SEQ ID NO: 250576

SEQ ID NO: 430203 - RNA, 64 nt, Human; identical to SEQ ID NO: 250577

SEQ ID NO: 430204 - RNA, 64 nt, Human; identical to SEQ ID NO: 250578

SEQ ID NO: 430205 - RNA, 64 nt, Human; identical to SEQ ID NO: 250582

SEQ ID NO: 430206 - RNA, 64 nt, Human; identical to SEQ ID NO: 250583

SEQ ID NO: 430207 - RNA, 64 nt, Human; identical to SEQ ID NO: 250584

SEQ ID NO: 430208 - RNA, 64 nt, Human; identical to SEQ ID NO: 250585

SEQ ID NO: 430209 - RNA, 64 nt, Human; identical to SEQ ID NO: 250586

SEQ ID NO: 430210 - RNA, 64 nt, Human; identical to SEQ ID NO: 250587

SEQ ID NO: 430211 - RNA, 64 nt, Human; identical to SEQ ID NO: 250588

SEQ ID NO: 430212 - RNA, 64 nt, Human; identical to SEQ ID NO: 250589

SEQ ID NO: 430213 - RNA, 64 nt, Human; identical to SEQ ID NO: 250590

SEQ ID NO: 430214 - RNA, 64 nt, Human; identical to SEQ ID NO: 250591

SEQ ID NO: 430215 - RNA, 64 nt, Human; identical to SEQ ID NO: 250592

SEQ ID NO: 430216 - RNA, 64 nt, Human; identical to SEQ ID NO: 250593

SEQ ID NO: 430217 - RNA, 64 nt, Human; identical to SEQ ID NO: 250594

SEQ ID NO: 430218 - RNA, 64 nt, Human; identical to SEQ ID NO: 250595

SEQ ID NO: 430219 - RNA, 64 nt, Human; identical to SEQ ID NO: 250596

SEQ ID NO: 430220 - RNA, 64 nt, Human; identical to SEQ ID NO: 250600

SEQ ID NO: 430221 - RNA, 64 nt, Human; identical to SEQ ID NO: 250601

SEQ ID NO: 430222 - RNA, 64 nt, Human; identical to SEQ ID NO: 250602

SEQ ID NO: 430223 - RNA, 64 nt, Human; identical to SEQ ID NO: 250603

SEQ ID NO: 430224 - RNA, 64 nt, Human; identical to SEQ ID NO: 250604

SEQ ID NO: 430225 - RNA, 58 nt, Human; identical to SEQ ID NO: 250605

SEQ ID NO: 430226 - RNA, 64 nt, Human; identical to SEQ ID NO: 250606

SEQ ID NO: 430227 - RNA, 64 nt, Human; identical to SEQ ID NO: 250607

SEQ ID NO: 430228 - RNA, 64 nt, Human; identical to SEQ ID NO: 250608

SEQ ID NO: 430229 - RNA, 64 nt, Human; identical to SEQ ID NO: 250609

SEQ ID NO: 430230 - RNA, 64 nt, Human; identical to SEQ ID NO: 250610

SEQ ID NO: 430231 - RNA, 64 nt, Human; identical to SEQ ID NO: 250611

SEQ ID NO: 430232 - RNA, 64 nt, Human; identical to SEQ ID NO: 250612

SEQ ID NO: 430233 - RNA, 64 nt, Human; identical to SEQ ID NO: 250613

SEQ ID NO: 430234 - RNA, 64 nt, Human; identical to SEQ ID NO: 250614

SEQ ID NO: 430235 - RNA, 64 nt, Human; identical to SEQ ID NO: 250618

SEQ ID NO: 430236 - RNA, 64 nt, Human; identical to SEQ ID NO: 250619

SEQ ID NO: 430237 - RNA, 64 nt, Human; identical to SEQ ID NO: 250620

SEQ ID NO: 430238 - RNA, 64 nt, Human; identical to SEQ ID NO: 250621

SEQ ID NO: 430239 - RNA, 64 nt, Human; identical to SEQ ID NO: 250622

SEQ ID NO: 430240 - RNA, 64 nt, Human; identical to SEQ ID NO: 250623

SEQ ID NO: 430241 - RNA, 64 nt, Human; identical to SEQ ID NO: 250624

SEQ ID NO: 430242 - RNA, 64 nt, Human; identical to SEQ ID NO: 250625

SEQ ID NO: 430243 - RNA, 64 nt, Human; identical to SEQ ID NO: 250626

SEQ ID NO: 430244 - RNA, 64 nt, Human; identical to SEQ ID NO: 250627

SEQ ID NO: 430245 - RNA, 64 nt, Human; identical to SEQ ID NO: 250628

SEQ ID NO: 430246 - RNA, 64 nt, Human; identical to SEQ ID NO: 250629

SEQ ID NO: 430247 - RNA, 64 nt, Human; identical to SEQ ID NO: 250630

SEQ ID NO: 430248 - RNA, 64 nt, Human; identical to SEQ ID NO: 250631

SEQ ID NO: 430249 - RNA, 64 nt, Human; identical to SEQ ID NO: 250632

SEQ ID NO: 430250 - RNA, 64 nt, Human; identical to SEQ ID NO: 250636

SEQ ID NO: 430251 - RNA, 64 nt, Human; identical to SEQ ID NO: 250637

SEQ ID NO: 430252 - RNA, 64 nt, Human; identical to SEQ ID NO: 250638

SEQ ID NO: 430253 - RNA, 64 nt, Human; identical to SEQ ID NO: 250639

SEQ ID NO: 430254 - RNA, 64 nt, Human; identical to SEQ ID NO: 250640

SEQ ID NO: 430255 - RNA, 64 nt, Human; identical to SEQ ID NO: 250641

SEQ ID NO: 430256 - RNA, 63 nt, Human; identical to SEQ ID NO: 250642

SEQ ID NO: 430257 - RNA, 64 nt, Human; identical to SEQ ID NO: 250643

SEQ ID NO: 430258 - RNA, 64 nt, Human; identical to SEQ ID NO: 250644

SEQ ID NO: 430259 - RNA, 64 nt, Human; identical to SEQ ID NO: 250645

SEQ ID NO: 430260 - RNA, 64 nt, Human; identical to SEQ ID NO: 250646

SEQ ID NO: 430261 - RNA, 64 nt, Human; identical to SEQ ID NO: 250647

SEQ ID NO: 430262 - RNA, 64 nt, Human; identical to SEQ ID NO: 250648

SEQ ID NO: 430263 - RNA, 64 nt, Human; identical to SEQ ID NO: 250649

SEQ ID NO: 430264 - RNA, 64 nt, Human; identical to SEQ ID NO: 250650

SEQ ID NO: 430265 - RNA, 64 nt, Human; identical to SEQ ID NO: 250654

SEQ ID NO: 430266 - RNA, 64 nt, Human; identical to SEQ ID NO: 250655

SEQ ID NO: 430267 - RNA, 64 nt, Human; identical to SEQ ID NO: 250656

SEQ ID NO: 430268 - RNA, 64 nt, Human; identical to SEQ ID NO: 250657

SEQ ID NO: 430269 - RNA, 64 nt, Human; identical to SEQ ID NO: 250658

SEQ ID NO: 430270 - RNA, 64 nt, Human; identical to SEQ ID NO: 250659

SEQ ID NO: 430271 - RNA, 64 nt, Human; identical to SEQ ID NO: 250660

SEQ ID NO: 430272 - RNA, 64 nt, Human; identical to SEQ ID NO: 250661

SEQ ID NO: 430273 - RNA, 64 nt, Human; identical to SEQ ID NO: 250662

SEQ ID NO: 430274 - RNA, 64 nt, Human; identical to SEQ ID NO: 250663

SEQ ID NO: 430275 - RNA, 64 nt, Human; identical to SEQ ID NO: 250664

SEQ ID NO: 430276 - RNA, 64 nt, Human; identical to SEQ ID NO: 250665

SEQ ID NO: 430277 - RNA, 64 nt, Human; identical to SEQ ID NO: 250666

SEQ ID NO: 430278 - RNA, 64 nt, Human; identical to SEQ ID NO: 250667

SEQ ID NO: 430279 - RNA, 64 nt, Human; identical to SEQ ID NO: 250668

SEQ ID NO: 430280 - RNA, 55 nt, Human; identical to SEQ ID NO: 250672

SEQ ID NO: 430281 - RNA, 64 nt, Human; identical to SEQ ID NO: 250673

SEQ ID NO: 430282 - RNA, 64 nt, Human; identical to SEQ ID NO: 250674

SEQ ID NO: 430283 - RNA, 64 nt, Human; identical to SEQ ID NO: 250675

SEQ ID NO: 430284 - RNA, 64 nt, Human; identical to SEQ ID NO: 250676

SEQ ID NO: 430285 - RNA, 56 nt, Human; identical to SEQ ID NO: 250677

SEQ ID NO: 430286 - RNA, 64 nt, Human; identical to SEQ ID NO: 250678

SEQ ID NO: 430287 - RNA, 64 nt, Human; identical to SEQ ID NO: 250679

SEQ ID NO: 430288 - RNA, 64 nt, Human; identical to SEQ ID NO: 250680

SEQ ID NO: 430289 - RNA, 64 nt, Human; identical to SEQ ID NO: 250681

SEQ ID NO: 430290 - RNA, 64 nt, Human; identical to SEQ ID NO: 250682

SEQ ID NO: 430291 - RNA, 64 nt, Human; identical to SEQ ID NO: 250683

SEQ ID NO: 430292 - RNA, 64 nt, Human; identical to SEQ ID NO: 250684

SEQ ID NO: 430293 - RNA, 64 nt, Human; identical to SEQ ID NO: 250685

SEQ ID NO: 430294 - RNA, 64 nt, Human; identical to SEQ ID NO: 250686

SEQ ID NO: 430295 - RNA, 64 nt, Human; identical to SEQ ID NO: 250690

SEQ ID NO: 430296 - RNA, 64 nt, Human; identical to SEQ ID NO: 250691

SEQ ID NO: 430297 - RNA, 64 nt, Human; identical to SEQ ID NO: 250692

SEQ ID NO: 430298 - RNA, 64 nt, Human; identical to SEQ ID NO: 250693

SEQ ID NO: 430299 - RNA, 64 nt, Human; identical to SEQ ID NO: 250694

SEQ ID NO: 430300 - RNA, 64 nt, Human; identical to SEQ ID NO: 250695

SEQ ID NO: 430301 - RNA, 64 nt, Human; identical to SEQ ID NO: 250696

SEQ ID NO: 430302 - RNA, 64 nt, Human; identical to SEQ ID NO: 250697

SEQ ID NO: 430303 - RNA, 64 nt, Human; identical to SEQ ID NO: 250698

SEQ ID NO: 430304 - RNA, 64 nt, Human; identical to SEQ ID NO: 250699

SEQ ID NO: 430305 - RNA, 62 nt, Human; identical to SEQ ID NO: 250700

SEQ ID NO: 430306 - RNA, 64 nt, Human; identical to SEQ ID NO: 250701

SEQ ID NO: 430307 - RNA, 61 nt, Human; identical to SEQ ID NO: 250702

SEQ ID NO: 430308 - RNA, 64 nt, Human; identical to SEQ ID NO: 250703

SEQ ID NO: 430309 - RNA, 64 nt, Human; identical to SEQ ID NO: 250704

SEQ ID NO: 430310 - RNA, 64 nt, Human; identical to SEQ ID NO: 250708

SEQ ID NO: 430311 - RNA, 64 nt, Human; identical to SEQ ID NO: 250709

SEQ ID NO: 430312 - RNA, 64 nt, Human; identical to SEQ ID NO: 250710

SEQ ID NO: 430313 - RNA, 64 nt, Human; identical to SEQ ID NO: 250711

SEQ ID NO: 430314 - RNA, 64 nt, Human; identical to SEQ ID NO: 250712

SEQ ID NO: 430315 - RNA, 64 nt, Human; identical to SEQ ID NO: 250713

SEQ ID NO: 430316 - RNA, 64 nt, Human; identical to SEQ ID NO: 250714

SEQ ID NO: 430317 - RNA, 64 nt, Human; identical to SEQ ID NO: 250715

SEQ ID NO: 430318 - RNA, 64 nt, Human; identical to SEQ ID NO: 250716

SEQ ID NO: 430319 - RNA, 64 nt, Human; identical to SEQ ID NO: 250717

SEQ ID NO: 430320 - RNA, 64 nt, Human; identical to SEQ ID NO: 250718

SEQ ID NO: 430321 - RNA, 64 nt, Human; identical to SEQ ID NO: 250719

SEQ ID NO: 430322 - RNA, 64 nt, Human; identical to SEQ ID NO: 250720

SEQ ID NO: 430323 - RNA, 64 nt, Human; identical to SEQ ID NO: 250721

SEQ ID NO: 430324 - RNA, 64 nt, Human; identical to SEQ ID NO: 250722

SEQ ID NO: 430325 - RNA, 64 nt, Human; identical to SEQ ID NO: 250726

SEQ ID NO: 430326 - RNA, 64 nt, Human; identical to SEQ ID NO: 250727

SEQ ID NO: 430327 - RNA, 64 nt, Human; identical to SEQ ID NO: 250728

SEQ ID NO: 430328 - RNA, 64 nt, Human; identical to SEQ ID NO: 250729

SEQ ID NO: 430329 - RNA, 64 nt, Human; identical to SEQ ID NO: 250730

SEQ ID NO: 430330 - RNA, 64 nt, Human; identical to SEQ ID NO: 250731

SEQ ID NO: 430331 - RNA, 64 nt, Human; identical to SEQ ID NO: 250732

SEQ ID NO: 430332 - RNA, 64 nt, Human; identical to SEQ ID NO: 250733

SEQ ID NO: 430333 - RNA, 64 nt, Human; identical to SEQ ID NO: 250734

SEQ ID NO: 430334 - RNA, 64 nt, Human; identical to SEQ ID NO: 250735

SEQ ID NO: 430335 - RNA, 64 nt, Human; identical to SEQ ID NO: 250736

SEQ ID NO: 430336 - RNA, 64 nt, Human; identical to SEQ ID NO: 250737

SEQ ID NO: 430337 - RNA, 64 nt, Human; identical to SEQ ID NO: 250738

SEQ ID NO: 430338 - RNA, 64 nt, Human; identical to SEQ ID NO: 250739

SEQ ID NO: 430339 - RNA, 64 nt, Human; identical to SEQ ID NO: 250740

SEQ ID NO: 430340 - RNA, 64 nt, Human; identical to SEQ ID NO: 250744

SEQ ID NO: 430341 - RNA, 64 nt, Human; identical to SEQ ID NO: 250745

SEQ ID NO: 430342 - RNA, 64 nt, Human; identical to SEQ ID NO: 250746

SEQ ID NO: 430343 - RNA, 64 nt, Human; identical to SEQ ID NO: 250747

SEQ ID NO: 430344 - RNA, 64 nt, Human; identical to SEQ ID NO: 250748

SEQ ID NO: 430345 - RNA, 64 nt, Human; identical to SEQ ID NO: 250749

SEQ ID NO: 430346 - RNA, 64 nt, Human; identical to SEQ ID NO: 250750

SEQ ID NO: 430347 - RNA, 64 nt, Human; identical to SEQ ID NO: 250751

SEQ ID NO: 430348 - RNA, 64 nt, Human; identical to SEQ ID NO: 250752

SEQ ID NO: 430349 - RNA, 64 nt, Human; identical to SEQ ID NO: 250753

SEQ ID NO: 430350 - RNA, 64 nt, Human; identical to SEQ ID NO: 250754

SEQ ID NO: 430351 - RNA, 64 nt, Human; identical to SEQ ID NO: 250755

SEQ ID NO: 430352 - RNA, 64 nt, Human; identical to SEQ ID NO: 250756

SEQ ID NO: 430353 - RNA, 64 nt, Human; identical to SEQ ID NO: 250757

SEQ ID NO: 430354 - RNA, 64 nt, Human; identical to SEQ ID NO: 250758

SEQ ID NO: 430355 - RNA, 64 nt, Human; identical to SEQ ID NO: 250762

SEQ ID NO: 430356 - RNA, 64 nt, Human; identical to SEQ ID NO: 250763

SEQ ID NO: 430357 - RNA, 64 nt, Human; identical to SEQ ID NO: 250764

SEQ ID NO: 430358 - RNA, 64 nt, Human; identical to SEQ ID NO: 250765

SEQ ID NO: 430359 - RNA, 64 nt, Human; identical to SEQ ID NO: 250766

SEQ ID NO: 430360 - RNA, 64 nt, Human; identical to SEQ ID NO: 250767

SEQ ID NO: 430361 - RNA, 64 nt, Human; identical to SEQ ID NO: 250768

SEQ ID NO: 430362 - RNA, 64 nt, Human; identical to SEQ ID NO: 250769

SEQ ID NO: 430363 - RNA, 64 nt, Human; identical to SEQ ID NO: 250770

SEQ ID NO: 430364 - RNA, 64 nt, Human; identical to SEQ ID NO: 250771

SEQ ID NO: 430365 - RNA, 64 nt, Human; identical to SEQ ID NO: 250772

SEQ ID NO: 430366 - RNA, 64 nt, Human; identical to SEQ ID NO: 250773

SEQ ID NO: 430367 - RNA, 64 nt, Human; identical to SEQ ID NO: 250774

SEQ ID NO: 430368 - RNA, 64 nt, Human; identical to SEQ ID NO: 250775

SEQ ID NO: 430369 - RNA, 64 nt, Human; identical to SEQ ID NO: 250776

SEQ ID NO: 430370 - RNA, 64 nt, Human; identical to SEQ ID NO: 250780

SEQ ID NO: 430371 - RNA, 64 nt, Human; identical to SEQ ID NO: 250781

SEQ ID NO: 430372 - RNA, 64 nt, Human; identical to SEQ ID NO: 250782

SEQ ID NO: 430373 - RNA, 64 nt, Human; identical to SEQ ID NO: 250783

SEQ ID NO: 430374 - RNA, 64 nt, Human; identical to SEQ ID NO: 250784

SEQ ID NO: 430375 - RNA, 64 nt, Human; identical to SEQ ID NO: 250785

SEQ ID NO: 430376 - RNA, 64 nt, Human; identical to SEQ ID NO: 250786

SEQ ID NO: 430377 - RNA, 64 nt, Human; identical to SEQ ID NO: 250787

SEQ ID NO: 430378 - RNA, 64 nt, Human; identical to SEQ ID NO: 250788

SEQ ID NO: 430379 - RNA, 64 nt, Human; identical to SEQ ID NO: 250789

SEQ ID NO: 430380 - RNA, 64 nt, Human; identical to SEQ ID NO: 250790

SEQ ID NO: 430381 - RNA, 64 nt, Human; identical to SEQ ID NO: 250791

SEQ ID NO: 430382 - RNA, 64 nt, Human; identical to SEQ ID NO: 250792

SEQ ID NO: 430383 - RNA, 64 nt, Human; identical to SEQ ID NO: 250793

SEQ ID NO: 430384 - RNA, 64 nt, Human; identical to SEQ ID NO: 250794

SEQ ID NO: 430385 - RNA, 64 nt, Human; identical to SEQ ID NO: 250798

SEQ ID NO: 430386 - RNA, 64 nt, Human; identical to SEQ ID NO: 250799

SEQ ID NO: 430387 - RNA, 64 nt, Human; identical to SEQ ID NO: 250800

SEQ ID NO: 430388 - RNA, 64 nt, Human; identical to SEQ ID NO: 250801

SEQ ID NO: 430389 - RNA, 64 nt, Human; identical to SEQ ID NO: 250802

SEQ ID NO: 430390 - RNA, 64 nt, Human; identical to SEQ ID NO: 250803

SEQ ID NO: 430391 - RNA, 64 nt, Human; identical to SEQ ID NO: 250804

SEQ ID NO: 430392 - RNA, 64 nt, Human; identical to SEQ ID NO: 250805

SEQ ID NO: 430393 - RNA, 64 nt, Human; identical to SEQ ID NO: 250806

SEQ ID NO: 430394 - RNA, 64 nt, Human; identical to SEQ ID NO: 250807

SEQ ID NO: 430395 - RNA, 64 nt, Human; identical to SEQ ID NO: 250808

SEQ ID NO: 430396 - RNA, 64 nt, Human; identical to SEQ ID NO: 250809

SEQ ID NO: 430397 - RNA, 64 nt, Human; identical to SEQ ID NO: 250810

SEQ ID NO: 430398 - RNA, 64 nt, Human; identical to SEQ ID NO: 250811

SEQ ID NO: 430399 - RNA, 64 nt, Human; identical to SEQ ID NO: 250812

SEQ ID NO: 430400 - RNA, 64 nt, Human; identical to SEQ ID NO: 250816

SEQ ID NO: 430401 - RNA, 64 nt, Human; identical to SEQ ID NO: 250817

SEQ ID NO: 430402 - RNA, 64 nt, Human; identical to SEQ ID NO: 250818

SEQ ID NO: 430403 - RNA, 64 nt, Human; identical to SEQ ID NO: 250819

SEQ ID NO: 430404 - RNA, 64 nt, Human; identical to SEQ ID NO: 250820

SEQ ID NO: 430405 - RNA, 64 nt, Human; identical to SEQ ID NO: 250821

SEQ ID NO: 430406 - RNA, 64 nt, Human; identical to SEQ ID NO: 250822

SEQ ID NO: 430407 - RNA, 64 nt, Human; identical to SEQ ID NO: 250823

SEQ ID NO: 430408 - RNA, 64 nt, Human; identical to SEQ ID NO: 250824

SEQ ID NO: 430409 - RNA, 64 nt, Human; identical to SEQ ID NO: 250825

SEQ ID NO: 430410 - RNA, 64 nt, Human; identical to SEQ ID NO: 250826

SEQ ID NO: 430411 - RNA, 64 nt, Human; identical to SEQ ID NO: 250827

SEQ ID NO: 430412 - RNA, 64 nt, Human; identical to SEQ ID NO: 250828

SEQ ID NO: 430413 - RNA, 64 nt, Human; identical to SEQ ID NO: 250829

SEQ ID NO: 430414 - RNA, 64 nt, Human; identical to SEQ ID NO: 250830

SEQ ID NO: 430415 - RNA, 64 nt, Human; identical to SEQ ID NO: 250834

SEQ ID NO: 430416 - RNA, 64 nt, Human; identical to SEQ ID NO: 250835

SEQ ID NO: 430417 - RNA, 64 nt, Human; identical to SEQ ID NO: 250836

SEQ ID NO: 430418 - RNA, 64 nt, Human; identical to SEQ ID NO: 250837

SEQ ID NO: 430419 - RNA, 64 nt, Human; identical to SEQ ID NO: 250838

SEQ ID NO: 430420 - RNA, 64 nt, Human; identical to SEQ ID NO: 250839

SEQ ID NO: 430421 - RNA, 64 nt, Human; identical to SEQ ID NO: 429630

SEQ ID NO: 430422 - RNA, 64 nt, Human; identical to SEQ ID NO: 429631

SEQ ID NO: 430423 - RNA, 64 nt, Human; identical to SEQ ID NO: 429632

SEQ ID NO: 430424 - RNA, 64 nt, Human; identical to SEQ ID NO: 429633

SEQ ID NO: 430425 - RNA, 64 nt, Human; identical to SEQ ID NO: 429634

SEQ ID NO: 430426 - RNA, 64 nt, Human; identical to SEQ ID NO: 429635

SEQ ID NO: 430427 - RNA, 64 nt, Human; identical to SEQ ID NO: 429636

SEQ ID NO: 430428 - RNA, 64 nt, Human; identical to SEQ ID NO: 429637

SEQ ID NO: 430429 - RNA, 64 nt, Human; identical to SEQ ID NO: 429638

SEQ ID NO: 430430 - RNA, 64 nt, Human; identical to SEQ ID NO: 429639

SEQ ID NO: 430431 - RNA, 64 nt, Human; identical to SEQ ID NO: 429640

SEQ ID NO: 430432 - RNA, 51 nt, Human; identical to SEQ ID NO: 429641

SEQ ID NO: 430433 - RNA, 64 nt, Human; identical to SEQ ID NO: 429642

SEQ ID NO: 430434 - RNA, 64 nt, Human; identical to SEQ ID NO: 429643

SEQ ID NO: 430435 - RNA, 64 nt, Human; identical to SEQ ID NO: 429644

SEQ ID NO: 430436 - RNA, 64 nt, Human; identical to SEQ ID NO: 429645

SEQ ID NO: 430437 - RNA, 64 nt, Human; identical to SEQ ID NO: 429646

SEQ ID NO: 430438 - RNA, 64 nt, Human; identical to SEQ ID NO: 429647

SEQ ID NO: 430439 - RNA, 64 nt, Human; identical to SEQ ID NO: 429648

SEQ ID NO: 430440 - RNA, 64 nt, Human; identical to SEQ ID NO: 429649

SEQ ID NO: 430441 - RNA, 64 nt, Human; identical to SEQ ID NO: 429650

SEQ ID NO: 430442 - RNA, 64 nt, Human; identical to SEQ ID NO: 429651

SEQ ID NO: 430443 - RNA, 64 nt, Human; identical to SEQ ID NO: 429652

SEQ ID NO: 430444 - RNA, 64 nt, Human; identical to SEQ ID NO: 429653

SEQ ID NO: 430445 - RNA, 64 nt, Human; identical to SEQ ID NO: 429654

SEQ ID NO: 430446 - RNA, 64 nt, Human; identical to SEQ ID NO: 429655

SEQ ID NO: 430447 - RNA, 64 nt, Human; identical to SEQ ID NO: 429656

SEQ ID NO: 430448 - RNA, 64 nt, Human; identical to SEQ ID NO: 429657

SEQ ID NO: 430449 - RNA, 64 nt, Human; identical to SEQ ID NO: 429658

SEQ ID NO: 430450 - RNA, 64 nt, Human; identical to SEQ ID NO: 429659

SEQ ID NO: 430451 - RNA, 64 nt, Human; identical to SEQ ID NO: 429660

SEQ ID NO: 430452 - RNA, 64 nt, Human; identical to SEQ ID NO: 429661

SEQ ID NO: 430453 - RNA, 64 nt, Human; identical to SEQ ID NO: 429662

SEQ ID NO: 430454 - RNA, 64 nt, Human; identical to SEQ ID NO: 429663

SEQ ID NO: 430455 - RNA, 64 nt, Human; identical to SEQ ID NO: 429664

SEQ ID NO: 430456 - RNA, 64 nt, Human; identical to SEQ ID NO: 429665

SEQ ID NO: 430457 - RNA, 51 nt, Human; identical to SEQ ID NO: 429666

SEQ ID NO: 430458 - RNA, 64 nt, Human; identical to SEQ ID NO: 429667

SEQ ID NO: 430459 - RNA, 64 nt, Human; identical to SEQ ID NO: 429668

SEQ ID NO: 430460 - RNA, 64 nt, Human; identical to SEQ ID NO: 429669

SEQ ID NO: 430461 - RNA, 64 nt, Human; identical to SEQ ID NO: 429670

SEQ ID NO: 430462 - RNA, 64 nt, Human; identical to SEQ ID NO: 429671

SEQ ID NO: 430463 - RNA, 64 nt, Human; identical to SEQ ID NO: 429672

SEQ ID NO: 430464 - RNA, 64 nt, Human; identical to SEQ ID NO: 429673

SEQ ID NO: 430465 - RNA, 64 nt, Human; identical to SEQ ID NO: 429674

SEQ ID NO: 430466 - RNA, 64 nt, Human; identical to SEQ ID NO: 429675

SEQ ID NO: 430467 - RNA, 64 nt, Human; identical to SEQ ID NO: 429676

SEQ ID NO: 430468 - RNA, 64 nt, Human; identical to SEQ ID NO: 429677

SEQ ID NO: 430469 - RNA, 64 nt, Human; identical to SEQ ID NO: 429678

SEQ ID NO: 430470 - RNA, 64 nt, Human; identical to SEQ ID NO: 429679

SEQ ID NO: 430471 - RNA, 64 nt, Human; identical to SEQ ID NO: 429680

SEQ ID NO: 430472 - RNA, 64 nt, Human; identical to SEQ ID NO: 429681

SEQ ID NO: 430473 - RNA, 64 nt, Human; identical to SEQ ID NO: 429682

SEQ ID NO: 430474 - RNA, 64 nt, Human; identical to SEQ ID NO: 429683

SEQ ID NO: 430475 - RNA, 64 nt, Human; identical to SEQ ID NO: 429684

SEQ ID NO: 430476 - RNA, 64 nt, Human; identical to SEQ ID NO: 429685

SEQ ID NO: 430477 - RNA, 64 nt, Human; identical to SEQ ID NO: 429686

SEQ ID NO: 430478 - RNA, 64 nt, Human; identical to SEQ ID NO: 429687

SEQ ID NO: 430479 - RNA, 64 nt, Human; identical to SEQ ID NO: 429688

SEQ ID NO: 430480 - RNA, 64 nt, Human; identical to SEQ ID NO: 429689

SEQ ID NO: 430481 - RNA, 64 nt, Human; identical to SEQ ID NO: 429690

SEQ ID NO: 430482 - RNA, 64 nt, Human; identical to SEQ ID NO: 429691

SEQ ID NO: 430483 - RNA, 64 nt, Human; identical to SEQ ID NO: 429692

SEQ ID NO: 430484 - RNA, 64 nt, Human; identical to SEQ ID NO: 429693

SEQ ID NO: 430485 - RNA, 64 nt, Human; identical to SEQ ID NO: 429694

SEQ ID NO: 430486 - RNA, 64 nt, Human; identical to SEQ ID NO: 429695

SEQ ID NO: 430487 - RNA, 64 nt, Human; identical to SEQ ID NO: 429696

SEQ ID NO: 430488 - RNA, 64 nt, Human; identical to SEQ ID NO: 429697

SEQ ID NO: 430489 - RNA, 64 nt, Human; identical to SEQ ID NO: 429698

SEQ ID NO: 430490 - RNA, 64 nt, Human; identical to SEQ ID NO: 429699

SEQ ID NO: 430491 - RNA, 64 nt, Human; identical to SEQ ID NO: 429700

SEQ ID NO: 430492 - RNA, 64 nt, Human; identical to SEQ ID NO: 429701

SEQ ID NO: 430493 - RNA, 64 nt, Human; identical to SEQ ID NO: 429702

SEQ ID NO: 430494 - RNA, 64 nt, Human; identical to SEQ ID NO: 429703

SEQ ID NO: 430495 - RNA, 64 nt, Human; identical to SEQ ID NO: 429704

SEQ ID NO: 430496 - RNA, 64 nt, Human; identical to SEQ ID NO: 429705

SEQ ID NO: 430497 - RNA, 64 nt, Human; identical to SEQ ID NO: 429706

SEQ ID NO: 430498 - RNA, 64 nt, Human; identical to SEQ ID NO: 429707

SEQ ID NO: 430499 - RNA, 64 nt, Human; identical to SEQ ID NO: 429708

SEQ ID NO: 430500 - RNA, 64 nt, Human; identical to SEQ ID NO: 429709

SEQ ID NO: 430501 - RNA, 64 nt, Human; identical to SEQ ID NO: 429710

SEQ ID NO: 430502 - RNA, 64 nt, Human; identical to SEQ ID NO: 429711

SEQ ID NO: 430503 - RNA, 64 nt, Human; identical to SEQ ID NO: 429712

SEQ ID NO: 430504 - RNA, 64 nt, Human; identical to SEQ ID NO: 429713

SEQ ID NO: 430505 - RNA, 64 nt, Human; identical to SEQ ID NO: 429714

SEQ ID NO: 430506 - RNA, 64 nt, Human; identical to SEQ ID NO: 429715

SEQ ID NO: 430507 - RNA, 64 nt, Human; identical to SEQ ID NO: 429716

SEQ ID NO: 430508 - RNA, 64 nt, Human; identical to SEQ ID NO: 429717

SEQ ID NO: 430509 - RNA, 64 nt, Human; identical to SEQ ID NO: 429718

SEQ ID NO: 430510 - RNA, 64 nt, Human; identical to SEQ ID NO: 429719

SEQ ID NO: 430511 - RNA, 64 nt, Human; identical to SEQ ID NO: 429720

SEQ ID NO: 430512 - RNA, 64 nt, Human; identical to SEQ ID NO: 429721

SEQ ID NO: 430513 - RNA, 64 nt, Human; identical to SEQ ID NO: 429722

SEQ ID NO: 430514 - RNA, 64 nt, Human; identical to SEQ ID NO: 429723

SEQ ID NO: 430515 - RNA, 64 nt, Human; identical to SEQ ID NO: 429724

SEQ ID NO: 430516 - RNA, 64 nt, Human; identical to SEQ ID NO: 429725

SEQ ID NO: 430517 - RNA, 64 nt, Human; identical to SEQ ID NO: 429726

SEQ ID NO: 430518 - RNA, 64 nt, Human; identical to SEQ ID NO: 429727

SEQ ID NO: 430519 - RNA, 64 nt, Human; identical to SEQ ID NO: 429728

SEQ ID NO: 430520 - RNA, 64 nt, Human; identical to SEQ ID NO: 429729

SEQ ID NO: 430521 - RNA, 64 nt, Human; identical to SEQ ID NO: 429730

SEQ ID NO: 430522 - RNA, 64 nt, Human; identical to SEQ ID NO: 429731

SEQ ID NO: 430523 - RNA, 64 nt, Human; identical to SEQ ID NO: 429732

SEQ ID NO: 430524 - RNA, 64 nt, Human; identical to SEQ ID NO: 429733

SEQ ID NO: 430525 - RNA, 64 nt, Human; identical to SEQ ID NO: 429734

SEQ ID NO: 430526 - RNA, 64 nt, Human; identical to SEQ ID NO: 429735

SEQ ID NO: 430527 - RNA, 64 nt, Human; identical to SEQ ID NO: 429736

SEQ ID NO: 430528 - RNA, 64 nt, Human; identical to SEQ ID NO: 429737

SEQ ID NO: 430529 - RNA, 64 nt, Human; identical to SEQ ID NO: 429738

SEQ ID NO: 430530 - RNA, 64 nt, Human; identical to SEQ ID NO: 429739

SEQ ID NO: 430531 - RNA, 64 nt, Human; identical to SEQ ID NO: 429740

SEQ ID NO: 430532 - RNA, 64 nt, Human; identical to SEQ ID NO: 429741

SEQ ID NO: 430533 - RNA, 64 nt, Human; identical to SEQ ID NO: 429742

SEQ ID NO: 430534 - RNA, 64 nt, Human; identical to SEQ ID NO: 429743

SEQ ID NO: 430535 - RNA, 64 nt, Human; identical to SEQ ID NO: 429744

SEQ ID NO: 430536 - RNA, 64 nt, Human; identical to SEQ ID NO: 429745

SEQ ID NO: 430537 - RNA, 64 nt, Human; identical to SEQ ID NO: 429746

SEQ ID NO: 430538 - RNA, 64 nt, Human; identical to SEQ ID NO: 429747

SEQ ID NO: 430539 - RNA, 64 nt, Human; identical to SEQ ID NO: 429748

SEQ ID NO: 430540 - RNA, 64 nt, Human; identical to SEQ ID NO: 429749

SEQ ID NO: 430541 - RNA, 64 nt, Human; identical to SEQ ID NO: 429750

SEQ ID NO: 430542 - RNA, 64 nt, Human; identical to SEQ ID NO: 429751

SEQ ID NO: 430543 - RNA, 64 nt, Human; identical to SEQ ID NO: 429752

SEQ ID NO: 430544 - RNA, 64 nt, Human; identical to SEQ ID NO: 429753

SEQ ID NO: 430545 - RNA, 64 nt, Human; identical to SEQ ID NO: 429754

SEQ ID NO: 430546 - RNA, 64 nt, Human; identical to SEQ ID NO: 429755

SEQ ID NO: 430547 - RNA, 64 nt, Human; identical to SEQ ID NO: 429756

SEQ ID NO: 430548 - RNA, 64 nt, Human; identical to SEQ ID NO: 429757

SEQ ID NO: 430549 - RNA, 64 nt, Human; identical to SEQ ID NO: 429758

SEQ ID NO: 430550 - RNA, 64 nt, Human; identical to SEQ ID NO: 429759

SEQ ID NO: 430551 - RNA, 64 nt, Human; identical to SEQ ID NO: 429760

SEQ ID NO: 430552 - RNA, 64 nt, Human; identical to SEQ ID NO: 429761

SEQ ID NO: 430553 - RNA, 64 nt, Human; identical to SEQ ID NO: 429762

SEQ ID NO: 430554 - RNA, 64 nt, Human; identical to SEQ ID NO: 429763

SEQ ID NO: 430555 - RNA, 64 nt, Human; identical to SEQ ID NO: 429764

SEQ ID NO: 430556 - RNA, 64 nt, Human; identical to SEQ ID NO: 429765

SEQ ID NO: 430557 - RNA, 64 nt, Human; identical to SEQ ID NO: 429766

SEQ ID NO: 430558 - RNA, 64 nt, Human; identical to SEQ ID NO: 429767

SEQ ID NO: 430559 - RNA, 64 nt, Human; identical to SEQ ID NO: 429768

SEQ ID NO: 430560 - RNA, 64 nt, Human; identical to SEQ ID NO: 429769

SEQ ID NO: 430561 - RNA, 64 nt, Human; identical to SEQ ID NO: 429770

SEQ ID NO: 430562 - RNA, 64 nt, Human; identical to SEQ ID NO: 429771

SEQ ID NO: 430563 - RNA, 64 nt, Human; identical to SEQ ID NO: 429772

SEQ ID NO: 430564 - RNA, 64 nt, Human; identical to SEQ ID NO: 429773

SEQ ID NO: 430565 - RNA, 64 nt, Human; identical to SEQ ID NO: 429774

SEQ ID NO: 430566 - RNA, 64 nt, Human; identical to SEQ ID NO: 429775

SEQ ID NO: 430567 - RNA, 64 nt, Human; identical to SEQ ID NO: 429776

SEQ ID NO: 430568 - RNA, 64 nt, Human; identical to SEQ ID NO: 429777

SEQ ID NO: 430569 - RNA, 64 nt, Human; identical to SEQ ID NO: 250067

SEQ ID NO: 430570 - RNA, 64 nt, Human; identical to SEQ ID NO: 250068

SEQ ID NO: 430571 - RNA, 64 nt, Human; identical to SEQ ID NO: 250069

SEQ ID NO: 430572 - RNA, 53 nt, Human; identical to SEQ ID NO: 250070

SEQ ID NO: 430573 - RNA, 64 nt, Human; identical to SEQ ID NO: 250071

SEQ ID NO: 430574 - RNA, 64 nt, Human; identical to SEQ ID NO: 250072

SEQ ID NO: 430575 - RNA, 64 nt, Human; identical to SEQ ID NO: 250073

SEQ ID NO: 430576 - RNA, 64 nt, Human; identical to SEQ ID NO: 250077

SEQ ID NO: 430577 - RNA, 64 nt, Human; identical to SEQ ID NO: 250078

SEQ ID NO: 430578 - RNA, 64 nt, Human; identical to SEQ ID NO: 250079

SEQ ID NO: 430579 - RNA, 54 nt, Human; identical to SEQ ID NO: 250080

SEQ ID NO: 430580 - RNA, 64 nt, Human; identical to SEQ ID NO: 250081

SEQ ID NO: 430581 - RNA, 64 nt, Human; identical to SEQ ID NO: 250082

SEQ ID NO: 430582 - RNA, 64 nt, Human; identical to SEQ ID NO: 250083

SEQ ID NO: 430583 - RNA, 64 nt, Human; identical to SEQ ID NO: 250084

SEQ ID NO: 430584 - RNA, 64 nt, Human; identical to SEQ ID NO: 250085

SEQ ID NO: 430585 - RNA, 64 nt, Human; identical to SEQ ID NO: 250086

SEQ ID NO: 430586 - RNA, 64 nt, Human; identical to SEQ ID NO: 250087

SEQ ID NO: 430587 - RNA, 64 nt, Human; identical to SEQ ID NO: 250088

SEQ ID NO: 430588 - RNA, 64 nt, Human; identical to SEQ ID NO: 250089

SEQ ID NO: 430589 - RNA, 64 nt, Human; identical to SEQ ID NO: 250090

SEQ ID NO: 430590 - RNA, 64 nt, Human; identical to SEQ ID NO: 250091

SEQ ID NO: 430591 - RNA, 64 nt, Human; identical to SEQ ID NO: 250095

SEQ ID NO: 430592 - RNA, 64 nt, Human; identical to SEQ ID NO: 250096

SEQ ID NO: 430593 - RNA, 64 nt, Human; identical to SEQ ID NO: 250097

SEQ ID NO: 430594 - RNA, 64 nt, Human; identical to SEQ ID NO: 250098

SEQ ID NO: 430595 - RNA, 64 nt, Human; identical to SEQ ID NO: 250099

SEQ ID NO: 430596 - RNA, 64 nt, Human; identical to SEQ ID NO: 250100

SEQ ID NO: 430597 - RNA, 64 nt, Human; identical to SEQ ID NO: 250101

SEQ ID NO: 430598 - RNA, 64 nt, Human; identical to SEQ ID NO: 250102

SEQ ID NO: 430599 - RNA, 64 nt, Human; identical to SEQ ID NO: 250103

SEQ ID NO: 430600 - RNA, 64 nt, Human; identical to SEQ ID NO: 250104

SEQ ID NO: 430601 - RNA, 64 nt, Human; identical to SEQ ID NO: 250105

SEQ ID NO: 430602 - RNA, 64 nt, Human; identical to SEQ ID NO: 250106

SEQ ID NO: 430603 - RNA, 64 nt, Human; identical to SEQ ID NO: 250107

SEQ ID NO: 430604 - RNA, 64 nt, Human; identical to SEQ ID NO: 250108

SEQ ID NO: 430605 - RNA, 64 nt, Human; identical to SEQ ID NO: 250109

SEQ ID NO: 430606 - RNA, 64 nt, Human; identical to SEQ ID NO: 250113

SEQ ID NO: 430607 - RNA, 64 nt, Human; identical to SEQ ID NO: 250114

SEQ ID NO: 430608 - RNA, 64 nt, Human; identical to SEQ ID NO: 250115

SEQ ID NO: 430609 - RNA, 64 nt, Human; identical to SEQ ID NO: 250116

SEQ ID NO: 430610 - RNA, 64 nt, Human; identical to SEQ ID NO: 250117

SEQ ID NO: 430611 - RNA, 64 nt, Human; identical to SEQ ID NO: 250118

SEQ ID NO: 430612 - RNA, 64 nt, Human; identical to SEQ ID NO: 250119

SEQ ID NO: 430613 - RNA, 64 nt, Human; identical to SEQ ID NO: 250120

SEQ ID NO: 430614 - RNA, 61 nt, Human; identical to SEQ ID NO: 250121

SEQ ID NO: 430615 - RNA, 64 nt, Human; identical to SEQ ID NO: 250122

SEQ ID NO: 430616 - RNA, 64 nt, Human; identical to SEQ ID NO: 250123

SEQ ID NO: 430617 - RNA, 64 nt, Human; identical to SEQ ID NO: 250124

SEQ ID NO: 430618 - RNA, 64 nt, Human; identical to SEQ ID NO: 250125

SEQ ID NO: 430619 - RNA, 64 nt, Human; identical to SEQ ID NO: 250126

SEQ ID NO: 430620 - RNA, 64 nt, Human; identical to SEQ ID NO: 250127

SEQ ID NO: 430621 - RNA, 64 nt, Human; identical to SEQ ID NO: 250131

SEQ ID NO: 430622 - RNA, 64 nt, Human; identical to SEQ ID NO: 250132

SEQ ID NO: 430623 - RNA, 51 nt, Human; identical to SEQ ID NO: 250133

SEQ ID NO: 430624 - RNA, 64 nt, Human; identical to SEQ ID NO: 250134

SEQ ID NO: 430625 - RNA, 64 nt, Human; identical to SEQ ID NO: 250135

SEQ ID NO: 430626 - RNA, 64 nt, Human; identical to SEQ ID NO: 250136

SEQ ID NO: 430627 - RNA, 64 nt, Human; identical to SEQ ID NO: 250137

SEQ ID NO: 430628 - RNA, 64 nt, Human; identical to SEQ ID NO: 250138

SEQ ID NO: 430629 - RNA, 64 nt, Human; identical to SEQ ID NO: 250139

SEQ ID NO: 430630 - RNA, 64 nt, Human; identical to SEQ ID NO: 250140

SEQ ID NO: 430631 - RNA, 64 nt, Human; identical to SEQ ID NO: 250141

SEQ ID NO: 430632 - RNA, 64 nt, Human; identical to SEQ ID NO: 250142

SEQ ID NO: 430633 - RNA, 64 nt, Human; identical to SEQ ID NO: 250143

SEQ ID NO: 430634 - RNA, 64 nt, Human; identical to SEQ ID NO: 250144

SEQ ID NO: 430635 - RNA, 64 nt, Human; identical to SEQ ID NO: 250145

SEQ ID NO: 430636 - RNA, 64 nt, Human; identical to SEQ ID NO: 250149

SEQ ID NO: 430637 - RNA, 64 nt, Human; identical to SEQ ID NO: 250150

SEQ ID NO: 430638 - RNA, 64 nt, Human; identical to SEQ ID NO: 250151

SEQ ID NO: 430639 - RNA, 64 nt, Human; identical to SEQ ID NO: 250152

SEQ ID NO: 430640 - RNA, 64 nt, Human; identical to SEQ ID NO: 250153

SEQ ID NO: 430641 - RNA, 64 nt, Human; identical to SEQ ID NO: 250154

SEQ ID NO: 430642 - RNA, 64 nt, Human; identical to SEQ ID NO: 250155

SEQ ID NO: 430643 - RNA, 64 nt, Human; identical to SEQ ID NO: 250156

SEQ ID NO: 430644 - RNA, 64 nt, Human; identical to SEQ ID NO: 250157

SEQ ID NO: 430645 - RNA, 64 nt, Human; identical to SEQ ID NO: 250158

SEQ ID NO: 430646 - RNA, 64 nt, Human; identical to SEQ ID NO: 250159

SEQ ID NO: 430647 - RNA, 50 nt, Human; identical to SEQ ID NO: 250160

SEQ ID NO: 430648 - RNA, 64 nt, Human; identical to SEQ ID NO: 250161

SEQ ID NO: 430649 - RNA, 64 nt, Human; identical to SEQ ID NO: 250162

SEQ ID NO: 430650 - RNA, 64 nt, Human; identical to SEQ ID NO: 250163

SEQ ID NO: 430651 - RNA, 64 nt, Human; identical to SEQ ID NO: 250167

SEQ ID NO: 430652 - RNA, 64 nt, Human; identical to SEQ ID NO: 250168

SEQ ID NO: 430653 - RNA, 64 nt, Human; identical to SEQ ID NO: 250169

SEQ ID NO: 430654 - RNA, 64 nt, Human; identical to SEQ ID NO: 250170

SEQ ID NO: 430655 - RNA, 64 nt, Human; identical to SEQ ID NO: 250171

SEQ ID NO: 430656 - RNA, 64 nt, Human; identical to SEQ ID NO: 250172

SEQ ID NO: 430657 - RNA, 64 nt, Human; identical to SEQ ID NO: 250173

SEQ ID NO: 430658 - RNA, 64 nt, Human; identical to SEQ ID NO: 250174

SEQ ID NO: 430659 - RNA, 64 nt, Human; identical to SEQ ID NO: 250175

SEQ ID NO: 430660 - RNA, 64 nt, Human; identical to SEQ ID NO: 250176

SEQ ID NO: 430661 - RNA, 64 nt, Human; identical to SEQ ID NO: 250177

SEQ ID NO: 430662 - RNA, 64 nt, Human; identical to SEQ ID NO: 250178

SEQ ID NO: 430663 - RNA, 64 nt, Human; identical to SEQ ID NO: 250179

SEQ ID NO: 430664 - RNA, 64 nt, Human; identical to SEQ ID NO: 250180

SEQ ID NO: 430665 - RNA, 64 nt, Human; identical to SEQ ID NO: 250181

SEQ ID NO: 430666 - RNA, 64 nt, Human; identical to SEQ ID NO: 250185

SEQ ID NO: 430667 - RNA, 64 nt, Human; identical to SEQ ID NO: 250186

SEQ ID NO: 430668 - RNA, 64 nt, Human; identical to SEQ ID NO: 250187

SEQ ID NO: 430669 - RNA, 64 nt, Human; identical to SEQ ID NO: 250188

SEQ ID NO: 430670 - RNA, 64 nt, Human; identical to SEQ ID NO: 250189

SEQ ID NO: 430671 - RNA, 64 nt, Human; identical to SEQ ID NO: 250190

SEQ ID NO: 430672 - RNA, 64 nt, Human; identical to SEQ ID NO: 250191

SEQ ID NO: 430673 - RNA, 64 nt, Human; identical to SEQ ID NO: 250192

SEQ ID NO: 430674 - RNA, 64 nt, Human; identical to SEQ ID NO: 250193

SEQ ID NO: 430675 - RNA, 64 nt, Human; identical to SEQ ID NO: 250194

SEQ ID NO: 430676 - RNA, 64 nt, Human; identical to SEQ ID NO: 250195

SEQ ID NO: 430677 - RNA, 64 nt, Human; identical to SEQ ID NO: 250196

SEQ ID NO: 430678 - RNA, 64 nt, Human; identical to SEQ ID NO: 250197

SEQ ID NO: 430679 - RNA, 64 nt, Human; identical to SEQ ID NO: 250198

SEQ ID NO: 430680 - RNA, 64 nt, Human; identical to SEQ ID NO: 250199

SEQ ID NO: 430681 - RNA, 64 nt, Human; identical to SEQ ID NO: 249744

SEQ ID NO: 430682 - RNA, 64 nt, Human; identical to SEQ ID NO: 249745

SEQ ID NO: 430683 - RNA, 64 nt, Human; identical to SEQ ID NO: 249746

SEQ ID NO: 430684 - RNA, 64 nt, Human; identical to SEQ ID NO: 249747

SEQ ID NO: 430685 - RNA, 64 nt, Human; identical to SEQ ID NO: 249748

SEQ ID NO: 430686 - RNA, 64 nt, Human; identical to SEQ ID NO: 249749

SEQ ID NO: 430687 - RNA, 64 nt, Human; identical to SEQ ID NO: 249750

SEQ ID NO: 430688 - RNA, 64 nt, Human; identical to SEQ ID NO: 249751

SEQ ID NO: 430689 - RNA, 64 nt, Human; identical to SEQ ID NO: 249752

SEQ ID NO: 430690 - RNA, 64 nt, Human; identical to SEQ ID NO: 249753

SEQ ID NO: 430691 - RNA, 64 nt, Human; identical to SEQ ID NO: 249754

SEQ ID NO: 430692 - RNA, 64 nt, Human; identical to SEQ ID NO: 249755

SEQ ID NO: 430693 - RNA, 64 nt, Human; identical to SEQ ID NO: 249756

SEQ ID NO: 430694 - RNA, 64 nt, Human; identical to SEQ ID NO: 249757

SEQ ID NO: 430695 - RNA, 64 nt, Human; identical to SEQ ID NO: 250203

SEQ ID NO: 430696 - RNA, 64 nt, Human; identical to SEQ ID NO: 250223

SEQ ID NO: 430697 - RNA, 64 nt, Human; identical to SEQ ID NO: 250224

SEQ ID NO: 430698 - RNA, 64 nt, Human; identical to SEQ ID NO: 250225

SEQ ID NO: 430699 - RNA, 64 nt, Human; identical to SEQ ID NO: 250226

SEQ ID NO: 430700 - RNA, 64 nt, Human; identical to SEQ ID NO: 250227

SEQ ID NO: 430701 - RNA, 64 nt, Human; identical to SEQ ID NO: 250228

SEQ ID NO: 430702 - RNA, 64 nt, Human; identical to SEQ ID NO: 250229

SEQ ID NO: 430703 - RNA, 64 nt, Human; identical to SEQ ID NO: 250230

SEQ ID NO: 430704 - RNA, 64 nt, Human; identical to SEQ ID NO: 250231

SEQ ID NO: 430705 - RNA, 64 nt, Human; identical to SEQ ID NO: 250232

SEQ ID NO: 430706 - RNA, 64 nt, Human; identical to SEQ ID NO: 250233

SEQ ID NO: 430707 - RNA, 64 nt, Human; identical to SEQ ID NO: 250234

SEQ ID NO: 430708 - RNA, 64 nt, Human; identical to SEQ ID NO: 250235

SEQ ID NO: 430709 - RNA, 64 nt, Human; identical to SEQ ID NO: 250236

SEQ ID NO: 430710 - RNA, 64 nt, Human; identical to SEQ ID NO: 250237

SEQ ID NO: 430711 - RNA, 64 nt, Human; identical to SEQ ID NO: 250241

SEQ ID NO: 430712 - RNA, 64 nt, Human; identical to SEQ ID NO: 250242

SEQ ID NO: 430713 - RNA, 64 nt, Human; identical to SEQ ID NO: 250243

SEQ ID NO: 430714 - RNA, 64 nt, Human; identical to SEQ ID NO: 250244

SEQ ID NO: 430715 - RNA, 64 nt, Human; identical to SEQ ID NO: 250245

SEQ ID NO: 430716 - RNA, 64 nt, Human; identical to SEQ ID NO: 250246

SEQ ID NO: 430717 - RNA, 64 nt, Human; identical to SEQ ID NO: 250247

SEQ ID NO: 430718 - RNA, 64 nt, Human; identical to SEQ ID NO: 250248

SEQ ID NO: 430719 - RNA, 64 nt, Human; identical to SEQ ID NO: 250249

SEQ ID NO: 430720 - RNA, 64 nt, Human; identical to SEQ ID NO: 250250

SEQ ID NO: 430721 - RNA, 64 nt, Human; identical to SEQ ID NO: 250251

SEQ ID NO: 430722 - RNA, 52 nt, Human; identical to SEQ ID NO: 250252

SEQ ID NO: 430723 - RNA, 64 nt, Human; identical to SEQ ID NO: 250253

SEQ ID NO: 430724 - RNA, 64 nt, Human; identical to SEQ ID NO: 250254

SEQ ID NO: 430725 - RNA, 64 nt, Human; identical to SEQ ID NO: 250255

SEQ ID NO: 430726 - RNA, 64 nt, Human; identical to SEQ ID NO: 250259

SEQ ID NO: 430727 - RNA, 64 nt, Human; identical to SEQ ID NO: 250260

SEQ ID NO: 430728 - RNA, 64 nt, Human; identical to SEQ ID NO: 250261

SEQ ID NO: 430729 - RNA, 64 nt, Human; identical to SEQ ID NO: 250262

SEQ ID NO: 430730 - RNA, 64 nt, Human; identical to SEQ ID NO: 250263

SEQ ID NO: 430731 - RNA, 64 nt, Human; identical to SEQ ID NO: 250264

SEQ ID NO: 430732 - RNA, 64 nt, Human; identical to SEQ ID NO: 250265

SEQ ID NO: 430733 - RNA, 64 nt, Human; identical to SEQ ID NO: 250266

SEQ ID NO: 430734 - RNA, 64 nt, Human; identical to SEQ ID NO: 250267

SEQ ID NO: 430735 - RNA, 64 nt, Human; identical to SEQ ID NO: 250268

SEQ ID NO: 430736 - RNA, 64 nt, Human; identical to SEQ ID NO: 250269

SEQ ID NO: 430737 - RNA, 64 nt, Human; identical to SEQ ID NO: 250270

SEQ ID NO: 430738 - RNA, 64 nt, Human; identical to SEQ ID NO: 250271

SEQ ID NO: 430739 - RNA, 61 nt, Human; identical to SEQ ID NO: 250272

SEQ ID NO: 430740 - RNA, 64 nt, Human; identical to SEQ ID NO: 250273

SEQ ID NO: 430741 - RNA, 64 nt, Human; identical to SEQ ID NO: 250277

SEQ ID NO: 430742 - RNA, 64 nt, Human; identical to SEQ ID NO: 250278

SEQ ID NO: 430743 - RNA, 64 nt, Human; identical to SEQ ID NO: 250279

SEQ ID NO: 430744 - RNA, 64 nt, Human; identical to SEQ ID NO: 250280

SEQ ID NO: 430745 - RNA, 64 nt, Human; identical to SEQ ID NO: 250281

SEQ ID NO: 430746 - RNA, 64 nt, Human; identical to SEQ ID NO: 250282

SEQ ID NO: 430747 - RNA, 64 nt, Human; identical to SEQ ID NO: 250283

SEQ ID NO: 430748 - RNA, 64 nt, Human; identical to SEQ ID NO: 250284

SEQ ID NO: 430749 - RNA, 64 nt, Human; identical to SEQ ID NO: 250285

SEQ ID NO: 430750 - RNA, 64 nt, Human; identical to SEQ ID NO: 250286

SEQ ID NO: 430751 - RNA, 64 nt, Human; identical to SEQ ID NO: 250287

SEQ ID NO: 430752 - RNA, 64 nt, Human; identical to SEQ ID NO: 250288

SEQ ID NO: 430753 - RNA, 64 nt, Human; identical to SEQ ID NO: 250289

SEQ ID NO: 430754 - RNA, 64 nt, Human; identical to SEQ ID NO: 250290

SEQ ID NO: 430755 - RNA, 64 nt, Human; identical to SEQ ID NO: 250291

SEQ ID NO: 430756 - RNA, 64 nt, Human; identical to SEQ ID NO: 250295

SEQ ID NO: 430757 - RNA, 64 nt, Human; identical to SEQ ID NO: 250296

SEQ ID NO: 430758 - RNA, 64 nt, Human; identical to SEQ ID NO: 250297

SEQ ID NO: 430759 - RNA, 64 nt, Human; identical to SEQ ID NO: 250298

SEQ ID NO: 430760 - RNA, 64 nt, Human; identical to SEQ ID NO: 250299

SEQ ID NO: 430761 - RNA, 64 nt, Human; identical to SEQ ID NO: 250300

SEQ ID NO: 430762 - RNA, 64 nt, Human; identical to SEQ ID NO: 250301

SEQ ID NO: 430763 - RNA, 64 nt, Human; identical to SEQ ID NO: 250302

SEQ ID NO: 430764 - RNA, 64 nt, Human; identical to SEQ ID NO: 250303

SEQ ID NO: 430765 - RNA, 64 nt, Human; identical to SEQ ID NO: 250304

SEQ ID NO: 430766 - RNA, 64 nt, Human; identical to SEQ ID NO: 250305

SEQ ID NO: 430767 - RNA, 64 nt, Human; identical to SEQ ID NO: 250306

SEQ ID NO: 430768 - RNA, 64 nt, Human; identical to SEQ ID NO: 250307

SEQ ID NO: 430769 - RNA, 64 nt, Human; identical to SEQ ID NO: 250308

SEQ ID NO: 430770 - RNA, 64 nt, Human; identical to SEQ ID NO: 250309

SEQ ID NO: 430771 - RNA, 64 nt, Human; identical to SEQ ID NO: 250313

SEQ ID NO: 430772 - RNA, 64 nt, Human; identical to SEQ ID NO: 250314

SEQ ID NO: 430773 - RNA, 64 nt, Human; identical to SEQ ID NO: 250315

SEQ ID NO: 430774 - RNA, 64 nt, Human; identical to SEQ ID NO: 250316

SEQ ID NO: 430775 - RNA, 64 nt, Human; identical to SEQ ID NO: 250317

SEQ ID NO: 430776 - RNA, 64 nt, Human; identical to SEQ ID NO: 250318

SEQ ID NO: 430777 - RNA, 64 nt, Human; identical to SEQ ID NO: 250319

SEQ ID NO: 430778 - RNA, 64 nt, Human; identical to SEQ ID NO: 250320

SEQ ID NO: 430779 - RNA, 64 nt, Human; identical to SEQ ID NO: 250321

SEQ ID NO: 430780 - RNA, 64 nt, Human; identical to SEQ ID NO: 250322

SEQ ID NO: 430781 - RNA, 64 nt, Human; identical to SEQ ID NO: 250323

SEQ ID NO: 430782 - RNA, 64 nt, Human; identical to SEQ ID NO: 250324

SEQ ID NO: 430783 - RNA, 64 nt, Human; identical to SEQ ID NO: 250325

SEQ ID NO: 430784 - RNA, 64 nt, Human; identical to SEQ ID NO: 250326

SEQ ID NO: 430785 - RNA, 64 nt, Human; identical to SEQ ID NO: 250327

SEQ ID NO: 430786 - RNA, 64 nt, Human; identical to SEQ ID NO: 250331

SEQ ID NO: 430787 - RNA, 64 nt, Human; identical to SEQ ID NO: 250332

SEQ ID NO: 430788 - RNA, 64 nt, Human; identical to SEQ ID NO: 250333

SEQ ID NO: 430789 - RNA, 64 nt, Human; identical to SEQ ID NO: 250334

SEQ ID NO: 430790 - RNA, 64 nt, Human; identical to SEQ ID NO: 250335

SEQ ID NO: 430791 - RNA, 64 nt, Human; identical to SEQ ID NO: 250336

SEQ ID NO: 430792 - RNA, 64 nt, Human; identical to SEQ ID NO: 250337

SEQ ID NO: 430793 - RNA, 64 nt, Human; identical to SEQ ID NO: 250338

SEQ ID NO: 430794 - RNA, 64 nt, Human; identical to SEQ ID NO: 250339

SEQ ID NO: 430795 - RNA, 64 nt, Human; identical to SEQ ID NO: 250340

SEQ ID NO: 430796 - RNA, 64 nt, Human; identical to SEQ ID NO: 250341

SEQ ID NO: 430797 - RNA, 64 nt, Human; identical to SEQ ID NO: 250342

SEQ ID NO: 430798 - RNA, 64 nt, Human; identical to SEQ ID NO: 250343

SEQ ID NO: 430799 - RNA, 64 nt, Human; identical to SEQ ID NO: 250344

SEQ ID NO: 430800 - RNA, 64 nt, Human; identical to SEQ ID NO: 250345

SEQ ID NO: 430801 - RNA, 64 nt, Human; identical to SEQ ID NO: 250349

SEQ ID NO: 430802 - RNA, 55 nt, Human; identical to SEQ ID NO: 250350

SEQ ID NO: 430803 - RNA, 64 nt, Human; identical to SEQ ID NO: 250351

SEQ ID NO: 430804 - RNA, 64 nt, Human; identical to SEQ ID NO: 250352

SEQ ID NO: 430805 - RNA, 64 nt, Human; identical to SEQ ID NO: 250353

SEQ ID NO: 430806 - RNA, 64 nt, Human; identical to SEQ ID NO: 250354

SEQ ID NO: 430807 - RNA, 64 nt, Human; identical to SEQ ID NO: 250355

SEQ ID NO: 430808 - RNA, 64 nt, Human; identical to SEQ ID NO: 250356

SEQ ID NO: 430809 - RNA, 64 nt, Human; identical to SEQ ID NO: 250357

SEQ ID NO: 430810 - RNA, 64 nt, Human; identical to SEQ ID NO: 250358

SEQ ID NO: 430811 - RNA, 64 nt, Human; identical to SEQ ID NO: 250359

SEQ ID NO: 430812 - RNA, 64 nt, Human; identical to SEQ ID NO: 250360

SEQ ID NO: 430813 - RNA, 64 nt, Human; identical to SEQ ID NO: 250361

SEQ ID NO: 430814 - RNA, 64 nt, Human; identical to SEQ ID NO: 250362

SEQ ID NO: 430815 - RNA, 64 nt, Human; identical to SEQ ID NO: 250363

SEQ ID NO: 430816 - RNA, 64 nt, Human; identical to SEQ ID NO: 250367

SEQ ID NO: 430817 - RNA, 64 nt, Human; identical to SEQ ID NO: 250368

SEQ ID NO: 430818 - RNA, 64 nt, Human; identical to SEQ ID NO: 250369

SEQ ID NO: 430819 - RNA, 64 nt, Human; identical to SEQ ID NO: 250370

SEQ ID NO: 430820 - RNA, 64 nt, Human; identical to SEQ ID NO: 250371

SEQ ID NO: 430821 - RNA, 64 nt, Human; identical to SEQ ID NO: 250372

SEQ ID NO: 430822 - RNA, 64 nt, Human; identical to SEQ ID NO: 250373

SEQ ID NO: 430823 - RNA, 64 nt, Human; identical to SEQ ID NO: 250374

SEQ ID NO: 430824 - RNA, 64 nt, Human; identical to SEQ ID NO: 250375

SEQ ID NO: 430825 - RNA, 64 nt, Human; identical to SEQ ID NO: 250376

SEQ ID NO: 430826 - RNA, 64 nt, Human; identical to SEQ ID NO: 250377

SEQ ID NO: 430827 - RNA, 64 nt, Human; identical to SEQ ID NO: 250378

SEQ ID NO: 430828 - RNA, 64 nt, Human; identical to SEQ ID NO: 250379

SEQ ID NO: 430829 - RNA, 64 nt, Human; identical to SEQ ID NO: 250380

SEQ ID NO: 430830 - RNA, 64 nt, Human; identical to SEQ ID NO: 250381

SEQ ID NO: 430831 - RNA, 64 nt, Human; identical to SEQ ID NO: 250385

SEQ ID NO: 430832 - RNA, 64 nt, Human; identical to SEQ ID NO: 250386

SEQ ID NO: 430833 - RNA, 64 nt, Human; identical to SEQ ID NO: 250387

SEQ ID NO: 430834 - RNA, 64 nt, Human; identical to SEQ ID NO: 250388

SEQ ID NO: 430835 - RNA, 64 nt, Human; identical to SEQ ID NO: 250389

SEQ ID NO: 430836 - RNA, 64 nt, Human; identical to SEQ ID NO: 250390

SEQ ID NO: 430837 - RNA, 64 nt, Human; identical to SEQ ID NO: 250391

SEQ ID NO: 430838 - RNA, 64 nt, Human; identical to SEQ ID NO: 250392

SEQ ID NO: 430839 - RNA, 64 nt, Human; identical to SEQ ID NO: 250393

SEQ ID NO: 430840 - RNA, 64 nt, Human; identical to SEQ ID NO: 250394

SEQ ID NO: 430841 - RNA, 64 nt, Human; identical to SEQ ID NO: 250395

SEQ ID NO: 430842 - RNA, 64 nt, Human; identical to SEQ ID NO: 250396

SEQ ID NO: 430843 - RNA, 64 nt, Human; identical to SEQ ID NO: 250397

SEQ ID NO: 430844 - RNA, 64 nt, Human; identical to SEQ ID NO: 250398

SEQ ID NO: 430845 - RNA, 64 nt, Human; identical to SEQ ID NO: 250399

SEQ ID NO: 430846 - RNA, 59 nt, Human; identical to SEQ ID NO: 250403

SEQ ID NO: 430847 - RNA, 64 nt, Human; identical to SEQ ID NO: 250404

SEQ ID NO: 430848 - RNA, 64 nt, Human; identical to SEQ ID NO: 250405

SEQ ID NO: 430849 - RNA, 64 nt, Human; identical to SEQ ID NO: 250406

SEQ ID NO: 430850 - RNA, 64 nt, Human; identical to SEQ ID NO: 250407

SEQ ID NO: 430851 - RNA, 64 nt, Human; identical to SEQ ID NO: 250408

SEQ ID NO: 430852 - RNA, 64 nt, Human; identical to SEQ ID NO: 250409

SEQ ID NO: 430853 - RNA, 64 nt, Human; identical to SEQ ID NO: 250410

SEQ ID NO: 430854 - RNA, 64 nt, Human; identical to SEQ ID NO: 250411

SEQ ID NO: 430855 - RNA, 64 nt, Human; identical to SEQ ID NO: 250412

SEQ ID NO: 430856 - RNA, 64 nt, Human; identical to SEQ ID NO: 250413

SEQ ID NO: 430857 - RNA, 64 nt, Human; identical to SEQ ID NO: 250414

SEQ ID NO: 430858 - RNA, 64 nt, Human; identical to SEQ ID NO: 250415

SEQ ID NO: 430859 - RNA, 64 nt, Human; identical to SEQ ID NO: 250416

SEQ ID NO: 430860 - RNA, 64 nt, Human; identical to SEQ ID NO: 250417

SEQ ID NO: 430861 - RNA, 64 nt, Human; identical to SEQ ID NO: 250421

SEQ ID NO: 430862 - RNA, 64 nt, Human; identical to SEQ ID NO: 250422

SEQ ID NO: 430863 - RNA, 64 nt, Human; identical to SEQ ID NO: 250423

SEQ ID NO: 430864 - RNA, 64 nt, Human; identical to SEQ ID NO: 250424

SEQ ID NO: 430865 - RNA, 64 nt, Human; identical to SEQ ID NO: 250425

SEQ ID NO: 430866 - RNA, 64 nt, Human; identical to SEQ ID NO: 250426

SEQ ID NO: 430867 - RNA, 64 nt, Human; identical to SEQ ID NO: 250427

SEQ ID NO: 430868 - RNA, 64 nt, Human; identical to SEQ ID NO: 250428

SEQ ID NO: 430869 - RNA, 64 nt, Human; identical to SEQ ID NO: 250429

SEQ ID NO: 430870 - RNA, 64 nt, Human; identical to SEQ ID NO: 250430

SEQ ID NO: 430871 - RNA, 64 nt, Human; identical to SEQ ID NO: 250431

SEQ ID NO: 430872 - RNA, 64 nt, Human; identical to SEQ ID NO: 250432

SEQ ID NO: 430873 - RNA, 64 nt, Human; identical to SEQ ID NO: 250433

SEQ ID NO: 430874 - RNA, 64 nt, Human; identical to SEQ ID NO: 250434

SEQ ID NO: 430875 - RNA, 64 nt, Human; identical to SEQ ID NO: 250435

SEQ ID NO: 430876 - RNA, 64 nt, Human; identical to SEQ ID NO: 250439

SEQ ID NO: 430877 - RNA, 64 nt, Human; identical to SEQ ID NO: 250440

SEQ ID NO: 430878 - RNA, 64 nt, Human; identical to SEQ ID NO: 250441

SEQ ID NO: 430879 - RNA, 64 nt, Human; identical to SEQ ID NO: 250442

SEQ ID NO: 430880 - RNA, 64 nt, Human; identical to SEQ ID NO: 250443

SEQ ID NO: 430881 - RNA, 64 nt, Human; identical to SEQ ID NO: 250444

SEQ ID NO: 430882 - RNA, 64 nt, Human; identical to SEQ ID NO: 250445

SEQ ID NO: 430883 - RNA, 64 nt, Human; identical to SEQ ID NO: 250446

SEQ ID NO: 430884 - RNA, 64 nt, Human; identical to SEQ ID NO: 250447

SEQ ID NO: 430885 - RNA, 64 nt, Human; identical to SEQ ID NO: 250448

SEQ ID NO: 430886 - RNA, 64 nt, Human; identical to SEQ ID NO: 250449

SEQ ID NO: 430887 - RNA, 64 nt, Human; identical to SEQ ID NO: 250450

SEQ ID NO: 430888 - RNA, 64 nt, Human; identical to SEQ ID NO: 250451

SEQ ID NO: 430889 - RNA, 64 nt, Human; identical to SEQ ID NO: 250452

SEQ ID NO: 430890 - RNA, 64 nt, Human; identical to SEQ ID NO: 250453

SEQ ID NO: 430891 - RNA, 64 nt, Human; identical to SEQ ID NO: 250457

SEQ ID NO: 430892 - RNA, 64 nt, Human; identical to SEQ ID NO: 250458

SEQ ID NO: 430893 - RNA, 64 nt, Human; identical to SEQ ID NO: 250459

SEQ ID NO: 430894 - RNA, 64 nt, Human; identical to SEQ ID NO: 250460

SEQ ID NO: 430895 - RNA, 64 nt, Human; identical to SEQ ID NO: 250461

SEQ ID NO: 430896 - RNA, 64 nt, Human; identical to SEQ ID NO: 250462

SEQ ID NO: 430897 - RNA, 64 nt, Human; identical to SEQ ID NO: 250463

SEQ ID NO: 430898 - RNA, 64 nt, Human; identical to SEQ ID NO: 250464

SEQ ID NO: 430899 - RNA, 64 nt, Human; identical to SEQ ID NO: 250465

SEQ ID NO: 430900 - RNA, 64 nt, Human; identical to SEQ ID NO: 250466

SEQ ID NO: 430901 - RNA, 64 nt, Human; identical to SEQ ID NO: 250467

SEQ ID NO: 430902 - RNA, 64 nt, Human; identical to SEQ ID NO: 250468

SEQ ID NO: 430903 - RNA, 64 nt, Human; identical to SEQ ID NO: 250469

SEQ ID NO: 430904 - RNA, 64 nt, Human; identical to SEQ ID NO: 250470

SEQ ID NO: 430905 - RNA, 64 nt, Human; identical to SEQ ID NO: 250471

SEQ ID NO: 430906 - RNA, 64 nt, Human; identical to SEQ ID NO: 250475

SEQ ID NO: 430907 - RNA, 64 nt, Human; identical to SEQ ID NO: 250476

SEQ ID NO: 430908 - RNA, 64 nt, Human; identical to SEQ ID NO: 250477

SEQ ID NO: 430909 - RNA, 64 nt, Human; identical to SEQ ID NO: 250478

SEQ ID NO: 430910 - RNA, 64 nt, Human; identical to SEQ ID NO: 250479

SEQ ID NO: 430911 - RNA, 64 nt, Human; identical to SEQ ID NO: 250480

SEQ ID NO: 430912 - RNA, 64 nt, Human; identical to SEQ ID NO: 250481

SEQ ID NO: 430913 - RNA, 64 nt, Human; identical to SEQ ID NO: 250482

SEQ ID NO: 430914 - RNA, 64 nt, Human; identical to SEQ ID NO: 250483

SEQ ID NO: 430915 - RNA, 64 nt, Human; identical to SEQ ID NO: 250484

SEQ ID NO: 430916 - RNA, 64 nt, Human; identical to SEQ ID NO: 250485

SEQ ID NO: 430917 - RNA, 64 nt, Human; identical to SEQ ID NO: 250486

SEQ ID NO: 430918 - RNA, 64 nt, Human; identical to SEQ ID NO: 250487

SEQ ID NO: 430919 - RNA, 64 nt, Human; identical to SEQ ID NO: 250488

SEQ ID NO: 430920 - RNA, 64 nt, Human; identical to SEQ ID NO: 250489

SEQ ID NO: 430921 - RNA, 64 nt, Human; identical to SEQ ID NO: 250493

SEQ ID NO: 430922 - RNA, 64 nt, Human; identical to SEQ ID NO: 250494

SEQ ID NO: 430923 - RNA, 64 nt, Human; identical to SEQ ID NO: 250495

SEQ ID NO: 430924 - RNA, 64 nt, Human; identical to SEQ ID NO: 250496

SEQ ID NO: 430925 - RNA, 64 nt, Human; identical to SEQ ID NO: 250497

SEQ ID NO: 430926 - RNA, 64 nt, Human; identical to SEQ ID NO: 250498

SEQ ID NO: 430927 - RNA, 64 nt, Human; identical to SEQ ID NO: 250499

SEQ ID NO: 430928 - RNA, 64 nt, Human; identical to SEQ ID NO: 250500

SEQ ID NO: 430929 - RNA, 64 nt, Human; identical to SEQ ID NO: 250501

SEQ ID NO: 430930 - RNA, 64 nt, Human; identical to SEQ ID NO: 250502

SEQ ID NO: 430931 - RNA, 64 nt, Human; identical to SEQ ID NO: 250503

SEQ ID NO: 430932 - RNA, 64 nt, Human; identical to SEQ ID NO: 250504

SEQ ID NO: 430933 - RNA, 64 nt, Human; identical to SEQ ID NO: 250505

SEQ ID NO: 430934 - RNA, 64 nt, Human; identical to SEQ ID NO: 250506

SEQ ID NO: 430935 - RNA, 64 nt, Human; identical to SEQ ID NO: 250507

SEQ ID NO: 430936 - RNA, 64 nt, Human; identical to SEQ ID NO: 250511

SEQ ID NO: 430937 - RNA, 50 nt, Human; identical to SEQ ID NO: 250512

SEQ ID NO: 430938 - RNA, 64 nt, Human; identical to SEQ ID NO: 250513

SEQ ID NO: 430939 - RNA, 64 nt, Human; identical to SEQ ID NO: 250514

SEQ ID NO: 430940 - RNA, 64 nt, Human; identical to SEQ ID NO: 250515

SEQ ID NO: 430941 - RNA, 64 nt, Human; identical to SEQ ID NO: 250516

SEQ ID NO: 430942 - RNA, 64 nt, Human; identical to SEQ ID NO: 250517

SEQ ID NO: 430943 - RNA, 64 nt, Human; identical to SEQ ID NO: 250518

SEQ ID NO: 430944 - RNA, 64 nt, Human; identical to SEQ ID NO: 250519

SEQ ID NO: 430945 - RNA, 64 nt, Human; identical to SEQ ID NO: 250520

SEQ ID NO: 430946 - RNA, 64 nt, Human; identical to SEQ ID NO: 250521

SEQ ID NO: 430947 - RNA, 64 nt, Human; identical to SEQ ID NO: 250522

SEQ ID NO: 430948 - RNA, 64 nt, Human; identical to SEQ ID NO: 250523

SEQ ID NO: 430949 - RNA, 64 nt, Human; identical to SEQ ID NO: 250524

SEQ ID NO: 430950 - RNA, 64 nt, Human; identical to SEQ ID NO: 250525

SEQ ID NO: 430951 - RNA, 64 nt, Human; identical to SEQ ID NO: 250529

SEQ ID NO: 430952 - RNA, 64 nt, Human; identical to SEQ ID NO: 250530

SEQ ID NO: 430953 - RNA, 64 nt, Human; identical to SEQ ID NO: 250531

SEQ ID NO: 430954 - RNA, 64 nt, Human; identical to SEQ ID NO: 250532

SEQ ID NO: 430955 - RNA, 64 nt, Human; identical to SEQ ID NO: 250533

SEQ ID NO: 430956 - RNA, 64 nt, Human; identical to SEQ ID NO: 250534

SEQ ID NO: 430957 - RNA, 64 nt, Human; identical to SEQ ID NO: 250535

SEQ ID NO: 430958 - RNA, 64 nt, Human; identical to SEQ ID NO: 250536

SEQ ID NO: 430959 - RNA, 64 nt, Human; identical to SEQ ID NO: 250537

SEQ ID NO: 430960 - RNA, 64 nt, Human; identical to SEQ ID NO: 250538

SEQ ID NO: 430961 - RNA, 64 nt, Human; identical to SEQ ID NO: 250539

SEQ ID NO: 430962 - RNA, 64 nt, Human; identical to SEQ ID NO: 250540

SEQ ID NO: 430963 - RNA, 64 nt, Human; identical to SEQ ID NO: 250541

SEQ ID NO: 430964 - RNA, 64 nt, Human; identical to SEQ ID NO: 250542

SEQ ID NO: 430965 - RNA, 64 nt, Human; identical to SEQ ID NO: 250543

SEQ ID NO: 430966 - RNA, 64 nt, Human; identical to SEQ ID NO: 250547

SEQ ID NO: 430967 - RNA, 64 nt, Human; identical to SEQ ID NO: 250548

SEQ ID NO: 430968 - RNA, 64 nt, Human; identical to SEQ ID NO: 250549

SEQ ID NO: 430969 - RNA, 64 nt, Human; identical to SEQ ID NO: 250550

SEQ ID NO: 430970 - RNA, 64 nt, Human; identical to SEQ ID NO: 250551

SEQ ID NO: 430971 - RNA, 64 nt, Human; identical to SEQ ID NO: 250552

SEQ ID NO: 430972 - RNA, 64 nt, Human; identical to SEQ ID NO: 250553

SEQ ID NO: 430973 - RNA, 64 nt, Human; identical to SEQ ID NO: 250554

SEQ ID NO: 430974 - RNA, 64 nt, Human; identical to SEQ ID NO: 250555

SEQ ID NO: 430975 - RNA, 64 nt, Human; identical to SEQ ID NO: 250556

SEQ ID NO: 430976 - RNA, 64 nt, Human; identical to SEQ ID NO: 250557

SEQ ID NO: 430977 - RNA, 64 nt, Human; identical to SEQ ID NO: 250558

SEQ ID NO: 430978 - RNA, 64 nt, Human; identical to SEQ ID NO: 250559

SEQ ID NO: 430979 - RNA, 64 nt, Human; identical to SEQ ID NO: 250560

SEQ ID NO: 430980 - RNA, 64 nt, Human; identical to SEQ ID NO: 250561

SEQ ID NO: 430981 - RNA, 64 nt, Human; identical to SEQ ID NO: 250564

SEQ ID NO: 430982 - RNA, 64 nt, Human; identical to SEQ ID NO: 250565

SEQ ID NO: 430983 - RNA, 64 nt, Human; identical to SEQ ID NO: 250566

SEQ ID NO: 430984 - RNA, 64 nt, Human; identical to SEQ ID NO: 250567

SEQ ID NO: 430985 - RNA, 64 nt, Human; identical to SEQ ID NO: 250568

SEQ ID NO: 430986 - RNA, 64 nt, Human; identical to SEQ ID NO: 250569

SEQ ID NO: 430987 - RNA, 64 nt, Human; identical to SEQ ID NO: 250570

SEQ ID NO: 430988 - RNA, 64 nt, Human; identical to SEQ ID NO: 250571

SEQ ID NO: 430989 - RNA, 64 nt, Human; identical to SEQ ID NO: 250572

SEQ ID NO: 430990 - RNA, 64 nt, Human; identical to SEQ ID NO: 250573

SEQ ID NO: 430991 - RNA, 64 nt, Human; identical to SEQ ID NO: 250574

SEQ ID NO: 430992 - RNA, 64 nt, Human; identical to SEQ ID NO: 250575

SEQ ID NO: 430993 - RNA, 64 nt, Human; identical to SEQ ID NO: 250576

SEQ ID NO: 430994 - RNA, 64 nt, Human; identical to SEQ ID NO: 250577

SEQ ID NO: 430995 - RNA, 64 nt, Human; identical to SEQ ID NO: 250578

SEQ ID NO: 430996 - RNA, 64 nt, Human; identical to SEQ ID NO: 250582

SEQ ID NO: 430997 - RNA, 64 nt, Human; identical to SEQ ID NO: 250583

SEQ ID NO: 430998 - RNA, 64 nt, Human; identical to SEQ ID NO: 250584

SEQ ID NO: 430999 - RNA, 64 nt, Human; identical to SEQ ID NO: 250585

SEQ ID NO: 431000 - RNA, 64 nt, Human; identical to SEQ ID NO: 250586

SEQ ID NO: 431001 - RNA, 64 nt, Human; identical to SEQ ID NO: 250587

SEQ ID NO: 431002 - RNA, 64 nt, Human; identical to SEQ ID NO: 250588

SEQ ID NO: 431003 - RNA, 64 nt, Human; identical to SEQ ID NO: 250589

SEQ ID NO: 431004 - RNA, 64 nt, Human; identical to SEQ ID NO: 250590

SEQ ID NO: 431005 - RNA, 64 nt, Human; identical to SEQ ID NO: 250591

SEQ ID NO: 431006 - RNA, 64 nt, Human; identical to SEQ ID NO: 250592

SEQ ID NO: 431007 - RNA, 64 nt, Human; identical to SEQ ID NO: 250593

SEQ ID NO: 431008 - RNA, 64 nt, Human; identical to SEQ ID NO: 250594

SEQ ID NO: 431009 - RNA, 64 nt, Human; identical to SEQ ID NO: 250595

SEQ ID NO: 431010 - RNA, 64 nt, Human; identical to SEQ ID NO: 250596

SEQ ID NO: 431011 - RNA, 64 nt, Human; identical to SEQ ID NO: 250600

SEQ ID NO: 431012 - RNA, 64 nt, Human; identical to SEQ ID NO: 250601

SEQ ID NO: 431013 - RNA, 64 nt, Human; identical to SEQ ID NO: 250602

SEQ ID NO: 431014 - RNA, 64 nt, Human; identical to SEQ ID NO: 250603

SEQ ID NO: 431015 - RNA, 64 nt, Human; identical to SEQ ID NO: 250604

SEQ ID NO: 431016 - RNA, 58 nt, Human; identical to SEQ ID NO: 250605

SEQ ID NO: 431017 - RNA, 64 nt, Human; identical to SEQ ID NO: 250606

SEQ ID NO: 431018 - RNA, 64 nt, Human; identical to SEQ ID NO: 250607

SEQ ID NO: 431019 - RNA, 64 nt, Human; identical to SEQ ID NO: 250608

SEQ ID NO: 431020 - RNA, 64 nt, Human; identical to SEQ ID NO: 250609

SEQ ID NO: 431021 - RNA, 64 nt, Human; identical to SEQ ID NO: 250610

SEQ ID NO: 431022 - RNA, 64 nt, Human; identical to SEQ ID NO: 250611

SEQ ID NO: 431023 - RNA, 64 nt, Human; identical to SEQ ID NO: 250612

SEQ ID NO: 431024 - RNA, 64 nt, Human; identical to SEQ ID NO: 250613

SEQ ID NO: 431025 - RNA, 64 nt, Human; identical to SEQ ID NO: 250614

SEQ ID NO: 431026 - RNA, 64 nt, Human; identical to SEQ ID NO: 250618

SEQ ID NO: 431027 - RNA, 64 nt, Human; identical to SEQ ID NO: 250619

SEQ ID NO: 431028 - RNA, 64 nt, Human; identical to SEQ ID NO: 250620

SEQ ID NO: 431029 - RNA, 64 nt, Human; identical to SEQ ID NO: 250621

SEQ ID NO: 431030 - RNA, 64 nt, Human; identical to SEQ ID NO: 250622

SEQ ID NO: 431031 - RNA, 64 nt, Human; identical to SEQ ID NO: 250623

SEQ ID NO: 431032 - RNA, 64 nt, Human; identical to SEQ ID NO: 250624

SEQ ID NO: 431033 - RNA, 64 nt, Human; identical to SEQ ID NO: 250625

SEQ ID NO: 431034 - RNA, 64 nt, Human; identical to SEQ ID NO: 250626

SEQ ID NO: 431035 - RNA, 64 nt, Human; identical to SEQ ID NO: 250627

SEQ ID NO: 431036 - RNA, 64 nt, Human; identical to SEQ ID NO: 250628

SEQ ID NO: 431037 - RNA, 64 nt, Human; identical to SEQ ID NO: 250629

SEQ ID NO: 431038 - RNA, 64 nt, Human; identical to SEQ ID NO: 250630

SEQ ID NO: 431039 - RNA, 64 nt, Human; identical to SEQ ID NO: 250631

SEQ ID NO: 431040 - RNA, 64 nt, Human; identical to SEQ ID NO: 250632

SEQ ID NO: 431041 - RNA, 64 nt, Human; identical to SEQ ID NO: 250636

SEQ ID NO: 431042 - RNA, 64 nt, Human; identical to SEQ ID NO: 250637

SEQ ID NO: 431043 - RNA, 64 nt, Human; identical to SEQ ID NO: 250638

SEQ ID NO: 431044 - RNA, 64 nt, Human; identical to SEQ ID NO: 250639

SEQ ID NO: 431045 - RNA, 64 nt, Human; identical to SEQ ID NO: 250640

SEQ ID NO: 431046 - RNA, 64 nt, Human; identical to SEQ ID NO: 250641

SEQ ID NO: 431047 - RNA, 63 nt, Human; identical to SEQ ID NO: 250642

SEQ ID NO: 431048 - RNA, 64 nt, Human; identical to SEQ ID NO: 250643

SEQ ID NO: 431049 - RNA, 64 nt, Human; identical to SEQ ID NO: 250644

SEQ ID NO: 431050 - RNA, 64 nt, Human; identical to SEQ ID NO: 250645

SEQ ID NO: 431051 - RNA, 64 nt, Human; identical to SEQ ID NO: 250646

SEQ ID NO: 431052 - RNA, 64 nt, Human; identical to SEQ ID NO: 250647

SEQ ID NO: 431053 - RNA, 64 nt, Human; identical to SEQ ID NO: 250648

SEQ ID NO: 431054 - RNA, 64 nt, Human; identical to SEQ ID NO: 250649

SEQ ID NO: 431055 - RNA, 64 nt, Human; identical to SEQ ID NO: 250650

SEQ ID NO: 431056 - RNA, 64 nt, Human; identical to SEQ ID NO: 250654

SEQ ID NO: 431057 - RNA, 64 nt, Human; identical to SEQ ID NO: 250655

SEQ ID NO: 431058 - RNA, 64 nt, Human; identical to SEQ ID NO: 250656

SEQ ID NO: 431059 - RNA, 64 nt, Human; identical to SEQ ID NO: 250657

SEQ ID NO: 431060 - RNA, 64 nt, Human; identical to SEQ ID NO: 250658

SEQ ID NO: 431061 - RNA, 64 nt, Human; identical to SEQ ID NO: 250659

SEQ ID NO: 431062 - RNA, 64 nt, Human; identical to SEQ ID NO: 250660

SEQ ID NO: 431063 - RNA, 64 nt, Human; identical to SEQ ID NO: 250661

SEQ ID NO: 431064 - RNA, 64 nt, Human; identical to SEQ ID NO: 250662

SEQ ID NO: 431065 - RNA, 64 nt, Human; identical to SEQ ID NO: 250663

SEQ ID NO: 431066 - RNA, 64 nt, Human; identical to SEQ ID NO: 250664

SEQ ID NO: 431067 - RNA, 64 nt, Human; identical to SEQ ID NO: 250665

SEQ ID NO: 431068 - RNA, 64 nt, Human; identical to SEQ ID NO: 250666

SEQ ID NO: 431069 - RNA, 64 nt, Human; identical to SEQ ID NO: 250667

SEQ ID NO: 431070 - RNA, 64 nt, Human; identical to SEQ ID NO: 250668

SEQ ID NO: 431071 - RNA, 55 nt, Human; identical to SEQ ID NO: 250672

SEQ ID NO: 431072 - RNA, 64 nt, Human; identical to SEQ ID NO: 250673

SEQ ID NO: 431073 - RNA, 64 nt, Human; identical to SEQ ID NO: 250674

SEQ ID NO: 431074 - RNA, 64 nt, Human; identical to SEQ ID NO: 250675

SEQ ID NO: 431075 - RNA, 64 nt, Human; identical to SEQ ID NO: 250676

SEQ ID NO: 431076 - RNA, 56 nt, Human; identical to SEQ ID NO: 250677

SEQ ID NO: 431077 - RNA, 64 nt, Human; identical to SEQ ID NO: 250678

SEQ ID NO: 431078 - RNA, 64 nt, Human; identical to SEQ ID NO: 250679

SEQ ID NO: 431079 - RNA, 64 nt, Human; identical to SEQ ID NO: 250680

SEQ ID NO: 431080 - RNA, 64 nt, Human; identical to SEQ ID NO: 250681

SEQ ID NO: 431081 - RNA, 64 nt, Human; identical to SEQ ID NO: 250682

SEQ ID NO: 431082 - RNA, 64 nt, Human; identical to SEQ ID NO: 250683

SEQ ID NO: 431083 - RNA, 64 nt, Human; identical to SEQ ID NO: 250684

SEQ ID NO: 431084 - RNA, 64 nt, Human; identical to SEQ ID NO: 250685

SEQ ID NO: 431085 - RNA, 64 nt, Human; identical to SEQ ID NO: 250686

SEQ ID NO: 431086 - RNA, 64 nt, Human; identical to SEQ ID NO: 250690

SEQ ID NO: 431087 - RNA, 64 nt, Human; identical to SEQ ID NO: 250691

SEQ ID NO: 431088 - RNA, 64 nt, Human; identical to SEQ ID NO: 250692

SEQ ID NO: 431089 - RNA, 64 nt, Human; identical to SEQ ID NO: 250693

SEQ ID NO: 431090 - RNA, 64 nt, Human; identical to SEQ ID NO: 250694

SEQ ID NO: 431091 - RNA, 64 nt, Human; identical to SEQ ID NO: 250695

SEQ ID NO: 431092 - RNA, 64 nt, Human; identical to SEQ ID NO: 250696

SEQ ID NO: 431093 - RNA, 64 nt, Human; identical to SEQ ID NO: 250697

SEQ ID NO: 431094 - RNA, 64 nt, Human; identical to SEQ ID NO: 250698

SEQ ID NO: 431095 - RNA, 64 nt, Human; identical to SEQ ID NO: 250699

SEQ ID NO: 431096 - RNA, 62 nt, Human; identical to SEQ ID NO: 250700

SEQ ID NO: 431097 - RNA, 64 nt, Human; identical to SEQ ID NO: 250701

SEQ ID NO: 431098 - RNA, 61 nt, Human; identical to SEQ ID NO: 250702

SEQ ID NO: 431099 - RNA, 64 nt, Human; identical to SEQ ID NO: 250703

SEQ ID NO: 431100 - RNA, 64 nt, Human; identical to SEQ ID NO: 250704

SEQ ID NO: 431101 - RNA, 64 nt, Human; identical to SEQ ID NO: 250708

SEQ ID NO: 431102 - RNA, 64 nt, Human; identical to SEQ ID NO: 250709

SEQ ID NO: 431103 - RNA, 64 nt, Human; identical to SEQ ID NO: 250710

SEQ ID NO: 431104 - RNA, 64 nt, Human; identical to SEQ ID NO: 250711

SEQ ID NO: 431105 - RNA, 64 nt, Human; identical to SEQ ID NO: 250712

SEQ ID NO: 431106 - RNA, 64 nt, Human; identical to SEQ ID NO: 250713

SEQ ID NO: 431107 - RNA, 64 nt, Human; identical to SEQ ID NO: 250714

SEQ ID NO: 431108 - RNA, 64 nt, Human; identical to SEQ ID NO: 250715

SEQ ID NO: 431109 - RNA, 64 nt, Human; identical to SEQ ID NO: 250716

SEQ ID NO: 431110 - RNA, 64 nt, Human; identical to SEQ ID NO: 250717

SEQ ID NO: 431111 - RNA, 64 nt, Human; identical to SEQ ID NO: 250718

SEQ ID NO: 431112 - RNA, 64 nt, Human; identical to SEQ ID NO: 250719

SEQ ID NO: 431113 - RNA, 64 nt, Human; identical to SEQ ID NO: 250720

SEQ ID NO: 431114 - RNA, 64 nt, Human; identical to SEQ ID NO: 250721

SEQ ID NO: 431115 - RNA, 64 nt, Human; identical to SEQ ID NO: 250722

SEQ ID NO: 431116 - RNA, 64 nt, Human; identical to SEQ ID NO: 250726

SEQ ID NO: 431117 - RNA, 64 nt, Human; identical to SEQ ID NO: 250727

SEQ ID NO: 431118 - RNA, 64 nt, Human; identical to SEQ ID NO: 250728

SEQ ID NO: 431119 - RNA, 64 nt, Human; identical to SEQ ID NO: 250729

SEQ ID NO: 431120 - RNA, 64 nt, Human; identical to SEQ ID NO: 250730

SEQ ID NO: 431121 - RNA, 64 nt, Human; identical to SEQ ID NO: 250731

SEQ ID NO: 431122 - RNA, 64 nt, Human; identical to SEQ ID NO: 250732

SEQ ID NO: 431123 - RNA, 64 nt, Human; identical to SEQ ID NO: 250733

SEQ ID NO: 431124 - RNA, 64 nt, Human; identical to SEQ ID NO: 250734

SEQ ID NO: 431125 - RNA, 64 nt, Human; identical to SEQ ID NO: 250735

SEQ ID NO: 431126 - RNA, 64 nt, Human; identical to SEQ ID NO: 250736

SEQ ID NO: 431127 - RNA, 64 nt, Human; identical to SEQ ID NO: 250737

SEQ ID NO: 431128 - RNA, 64 nt, Human; identical to SEQ ID NO: 250738

SEQ ID NO: 431129 - RNA, 64 nt, Human; identical to SEQ ID NO: 250739

SEQ ID NO: 431130 - RNA, 64 nt, Human; identical to SEQ ID NO: 250740

SEQ ID NO: 431131 - RNA, 64 nt, Human; identical to SEQ ID NO: 250744

SEQ ID NO: 431132 - RNA, 64 nt, Human; identical to SEQ ID NO: 250745

SEQ ID NO: 431133 - RNA, 64 nt, Human; identical to SEQ ID NO: 250746

SEQ ID NO: 431134 - RNA, 64 nt, Human; identical to SEQ ID NO: 250747

SEQ ID NO: 431135 - RNA, 64 nt, Human; identical to SEQ ID NO: 250748

SEQ ID NO: 431136 - RNA, 64 nt, Human; identical to SEQ ID NO: 250749

SEQ ID NO: 431137 - RNA, 64 nt, Human; identical to SEQ ID NO: 250750

SEQ ID NO: 431138 - RNA, 64 nt, Human; identical to SEQ ID NO: 250751

SEQ ID NO: 431139 - RNA, 64 nt, Human; identical to SEQ ID NO: 250752

SEQ ID NO: 431140 - RNA, 64 nt, Human; identical to SEQ ID NO: 250753

SEQ ID NO: 431141 - RNA, 64 nt, Human; identical to SEQ ID NO: 250754

SEQ ID NO: 431142 - RNA, 64 nt, Human; identical to SEQ ID NO: 250755

SEQ ID NO: 431143 - RNA, 64 nt, Human; identical to SEQ ID NO: 250756

SEQ ID NO: 431144 - RNA, 64 nt, Human; identical to SEQ ID NO: 250757

SEQ ID NO: 431145 - RNA, 64 nt, Human; identical to SEQ ID NO: 250758

SEQ ID NO: 431146 - RNA, 64 nt, Human; identical to SEQ ID NO: 250762

SEQ ID NO: 431147 - RNA, 64 nt, Human; identical to SEQ ID NO: 250763

SEQ ID NO: 431148 - RNA, 64 nt, Human; identical to SEQ ID NO: 250764

SEQ ID NO: 431149 - RNA, 64 nt, Human; identical to SEQ ID NO: 250765

SEQ ID NO: 431150 - RNA, 64 nt, Human; identical to SEQ ID NO: 250766

SEQ ID NO: 431151 - RNA, 64 nt, Human; identical to SEQ ID NO: 250767

SEQ ID NO: 431152 - RNA, 64 nt, Human; identical to SEQ ID NO: 250768

SEQ ID NO: 431153 - RNA, 64 nt, Human; identical to SEQ ID NO: 250769

SEQ ID NO: 431154 - RNA, 64 nt, Human; identical to SEQ ID NO: 250770

SEQ ID NO: 431155 - RNA, 64 nt, Human; identical to SEQ ID NO: 250771

SEQ ID NO: 431156 - RNA, 64 nt, Human; identical to SEQ ID NO: 250772

SEQ ID NO: 431157 - RNA, 64 nt, Human; identical to SEQ ID NO: 250773

SEQ ID NO: 431158 - RNA, 64 nt, Human; identical to SEQ ID NO: 250774

SEQ ID NO: 431159 - RNA, 64 nt, Human; identical to SEQ ID NO: 250775

SEQ ID NO: 431160 - RNA, 64 nt, Human; identical to SEQ ID NO: 250776

SEQ ID NO: 431161 - RNA, 64 nt, Human; identical to SEQ ID NO: 250780

SEQ ID NO: 431162 - RNA, 64 nt, Human; identical to SEQ ID NO: 250781

SEQ ID NO: 431163 - RNA, 64 nt, Human; identical to SEQ ID NO: 250782

SEQ ID NO: 431164 - RNA, 64 nt, Human; identical to SEQ ID NO: 250783

SEQ ID NO: 431165 - RNA, 64 nt, Human; identical to SEQ ID NO: 250784

SEQ ID NO: 431166 - RNA, 64 nt, Human; identical to SEQ ID NO: 250785

SEQ ID NO: 431167 - RNA, 64 nt, Human; identical to SEQ ID NO: 250786

SEQ ID NO: 431168 - RNA, 64 nt, Human; identical to SEQ ID NO: 250787

SEQ ID NO: 431169 - RNA, 64 nt, Human; identical to SEQ ID NO: 250788

SEQ ID NO: 431170 - RNA, 64 nt, Human; identical to SEQ ID NO: 250789

SEQ ID NO: 431171 - RNA, 64 nt, Human; identical to SEQ ID NO: 250790

SEQ ID NO: 431172 - RNA, 64 nt, Human; identical to SEQ ID NO: 250791

SEQ ID NO: 431173 - RNA, 64 nt, Human; identical to SEQ ID NO: 250792

SEQ ID NO: 431174 - RNA, 64 nt, Human; identical to SEQ ID NO: 250793

SEQ ID NO: 431175 - RNA, 64 nt, Human; identical to SEQ ID NO: 250794

SEQ ID NO: 431176 - RNA, 64 nt, Human; identical to SEQ ID NO: 250798

SEQ ID NO: 431177 - RNA, 64 nt, Human; identical to SEQ ID NO: 250799

SEQ ID NO: 431178 - RNA, 64 nt, Human; identical to SEQ ID NO: 250800

SEQ ID NO: 431179 - RNA, 64 nt, Human; identical to SEQ ID NO: 250801

SEQ ID NO: 431180 - RNA, 64 nt, Human; identical to SEQ ID NO: 250802

SEQ ID NO: 431181 - RNA, 64 nt, Human; identical to SEQ ID NO: 250803

SEQ ID NO: 431182 - RNA, 64 nt, Human; identical to SEQ ID NO: 250804

SEQ ID NO: 431183 - RNA, 64 nt, Human; identical to SEQ ID NO: 250805

SEQ ID NO: 431184 - RNA, 64 nt, Human; identical to SEQ ID NO: 250806

SEQ ID NO: 431185 - RNA, 64 nt, Human; identical to SEQ ID NO: 250807

SEQ ID NO: 431186 - RNA, 64 nt, Human; identical to SEQ ID NO: 250808

SEQ ID NO: 431187 - RNA, 64 nt, Human; identical to SEQ ID NO: 250809

SEQ ID NO: 431188 - RNA, 64 nt, Human; identical to SEQ ID NO: 250810

SEQ ID NO: 431189 - RNA, 64 nt, Human; identical to SEQ ID NO: 250811

SEQ ID NO: 431190 - RNA, 64 nt, Human; identical to SEQ ID NO: 250812

SEQ ID NO: 431191 - RNA, 64 nt, Human; identical to SEQ ID NO: 250816

SEQ ID NO: 431192 - RNA, 64 nt, Human; identical to SEQ ID NO: 250817

SEQ ID NO: 431193 - RNA, 64 nt, Human; identical to SEQ ID NO: 250818

SEQ ID NO: 431194 - RNA, 64 nt, Human; identical to SEQ ID NO: 250819

SEQ ID NO: 431195 - RNA, 64 nt, Human; identical to SEQ ID NO: 250820

SEQ ID NO: 431196 - RNA, 64 nt, Human; identical to SEQ ID NO: 250821

SEQ ID NO: 431197 - RNA, 64 nt, Human; identical to SEQ ID NO: 250822

SEQ ID NO: 431198 - RNA, 64 nt, Human; identical to SEQ ID NO: 250823

SEQ ID NO: 431199 - RNA, 64 nt, Human; identical to SEQ ID NO: 250824

SEQ ID NO: 431200 - RNA, 64 nt, Human; identical to SEQ ID NO: 250825

SEQ ID NO: 431201 - RNA, 64 nt, Human; identical to SEQ ID NO: 250826

SEQ ID NO: 431202 - RNA, 64 nt, Human; identical to SEQ ID NO: 250827

SEQ ID NO: 431203 - RNA, 64 nt, Human; identical to SEQ ID NO: 250828

SEQ ID NO: 431204 - RNA, 64 nt, Human; identical to SEQ ID NO: 250829

SEQ ID NO: 431205 - RNA, 64 nt, Human; identical to SEQ ID NO: 250830

SEQ ID NO: 431206 - RNA, 64 nt, Human; identical to SEQ ID NO: 250834

SEQ ID NO: 431207 - RNA, 64 nt, Human; identical to SEQ ID NO: 250835

SEQ ID NO: 431208 - RNA, 64 nt, Human; identical to SEQ ID NO: 250836

SEQ ID NO: 431209 - RNA, 64 nt, Human; identical to SEQ ID NO: 250837

SEQ ID NO: 431210 - RNA, 64 nt, Human; identical to SEQ ID NO: 250838

SEQ ID NO: 431211 - RNA, 64 nt, Human; identical to SEQ ID NO: 250839

SEQ ID NO: 431212 - RNA, 64 nt, Human
ccuguggagucucugcugaaaugaaucaggauucgagcucuaggaugagacagaaaaugaaagc

SEQ ID NO: 431213 - RNA, 64 nt, Human
cucucggcuucguugucuguaaauuggaugaaaagagcucuaaugccuuucaggcucuuagaag

SEQ ID NO: 431214 - RNA, 64 nt, Human
ccuagauuggaacuccgguccgguucuuucucuggagcucuagauacucacuuuuugugccccc

SEQ ID NO: 431215 - RNA, 64 nt, Human
uuggcagaauagcacgcacuagaugccugaccuugagcucuagucuccccuuuaaaucuuaccu

SEQ ID NO: 431216 - RNA, 64 nt, Human
uuucuggugaugaaugaauauuccagauuuugaggagcucuaagugguccaggaguccaaguaa

SEQ ID NO: 431217 - RNA, 64 nt, Human
ccugcagcuaauuuagcugaucucuaauuuaacugagcucuaauuuagcugaucagauuuugcu

SEQ ID NO: 431218 - RNA, 64 nt, Human
caucucagaacacagcacaggggguaauggccuagagcucuagggacacuggcuuguugggucu

SEQ ID NO: 431219 - RNA, 64 nt, Human
aguaacuuccaugaugacacugacgccuauaccugagcucuaggcugccuggagggaaggaaca

SEQ ID NO: 431220 - RNA, 64 nt, Human
aagcuccgagccuguuuucuguaguuuauaguuagagcucuauuuuguuaugguuuuuuaaacu

SEQ ID NO: 431221 - RNA, 64 nt, Human
gcaguuugaccuuagaagaagugggaagaagaaggagcucuacagggucagcuuuguuugauuu

SEQ ID NO: 431222 - RNA, 64 nt, Human
gcuuguugguauuacccuaaacuguuuaaauaaagagcucuauuuuuaaagaaaaaagguacaa

SEQ ID NO: 431223 - RNA, 64 nt, Human
gagagacagagagauggcaagcacugagauaaauaccuggcaaaacuaaauaaauuaccaaaaa

SEQ ID NO: 431224 - RNA, 64 nt, Human
aaagcgaggggguggggggcuucccgggacgauaaccuggcaguggaaggaaagaagcaugguc

SEQ ID NO: 431225 - RNA, 64 nt, Human
caauugugaaauuauaagaccaguggauuuuuuuaccuggcacauggguugguguugaaugaag

SEQ ID NO: 431226 - RNA, 64 nt, Human
ucugggccuaccauaaauaaauaucuccuuuucugagcucuaagaauuaucagaaacaggaaag

SEQ ID NO: 431227 - RNA, 64 nt, Human
cgcaaacgugaaauucuauugaaaacagugucuugagcucuaaaguagcaacugcuggugauuu

SEQ ID NO: 431228 - RNA, 64 nt, Human
uggagcugauggcagggguuugaugaauccaaaugagcucuagacauuaucacagacugaauag

SEQ ID NO: 431229 - RNA, 64 nt, Human
ccuggcugggugugugugcaaaucugugugacuggagcucuaggggcaucucugugucugagug

SEQ ID NO: 431230 - RNA, 64 nt, Human
uuuuuuaauaaugaaaaauauuuucgugacaagugagcucuaaauucucuuuauuguaaaagag

SEQ ID NO: 431231 - RNA, 64 nt, Human
cacuuacgugaguaaauaaugcagcucagaugcugagcucuaguaggaaaugcuggcaugcuga

SEQ ID NO: 431232 - RNA, 64 nt, Human
gguucagggaaggaggggaaaagggaggugcagagagcucuaagccagugugcuuacagugagg

SEQ ID NO: 431233 - RNA, 64 nt, Human
ggaggccuucuuguuucuccagucccuggaagcugagcucuauguguauuugaugacauuguca

SEQ ID NO: 431234 - RNA, 64 nt, Human
ccacagcccugucagcaugaauuuguaaugucuugagcucuauuaugaaugugaagccuucccc

SEQ ID NO: 431235 - RNA, 64 nt, Human
uaugccauuauuuuuguauucuuuuucuuagugugagcucuaaaaucaauguucuugaaaaaga

SEQ ID NO: 431236 - RNA, 64 nt, Human
uccagugacccuggagcuagggucccccuucguggagcucuaacugauucagggccccugaagu

SEQ ID NO: 431237 - RNA, 64 nt, Human
ggcgugguuuugguugccauuccauagguuuggagagcucuagaucucuuuugugcuggguuca

SEQ ID NO: 431238 - RNA, 64 nt, Human
aaauauaucaaaucgcacugaauacucaacaccagagcucuaaugugggaaaugguucuccuuu

SEQ ID NO: 431239 - RNA, 64 nt, Human
guuucagcaagugcaaauuuuauucuaaguuucagagcucuauauuuaauuuaggucaaaugcu

SEQ ID NO: 431240 - RNA, 64 nt, Human
aaucagugaacccuuuggcaaagcccccauccacaccuggcacuccccucuaccaaucccuggc

SEQ ID NO: 431241 - RNA, 64 nt, Human
aaauagaggcuuggcuugaauguacauagaugguaccuggcauggacugauguuuuuaggcaca

SEQ ID NO: 431242 - RNA, 64 nt, Human
uggggaugccugugggauggcccacaccugggggaccuggcagauggggugaguuggguaagga

SEQ ID NO: 431243 - RNA, 64 nt, Human
gagggcuccggcccagaaugggaaccucagagaagagcucuaaggagaagaaaccccauagcgu

SEQ ID NO: 431244 - RNA, 64 nt, Human
uaugaacaacuuaaaggcacugauuucuauaauagagcucuaaaaacaugccaccaguguauga

SEQ ID NO: 431245 - RNA, 64 nt, Human
cagacagcuugacagcuggucaagacggucacgggagcucuaggugggcacaaccaaccccucu

SEQ ID NO: 431246 - RNA, 64 nt, Human
aaugucagucugguuuauauaaggcaguauuauugagcucuauuuccccaccccacuauccuca

SEQ ID NO: 431247 - RNA, 64 nt, Human
ugaagugccuggguauuuucccgucccauuugcagagcucuacuacuucauuuccacaguaagc

SEQ ID NO: 431248 - RNA, 64 nt, Human
uuggaagugugacucaaucuugccugccuucugggagcucuagaauuguucccaacccagucca

SEQ ID NO: 431249 - RNA, 64 nt, Human
aggucuagggacaggagugaauagaaagggaggagagcucuauuauguucuauacacagauuag

SEQ ID NO: 431250 - RNA, 64 nt, Human
aauagaaauuauguagcuccuuauguuggcaaaggagcucuauauaguuucacuuuguauaaaa

SEQ ID NO: 431251 - RNA, 64 nt, Human
agagggcucucucuaggcagagcguuccuggccagagcucuaccucuuugccuccugcugaccc

SEQ ID NO: 431252 - RNA, 64 nt, Human
gugcuagccucugcaacacgacacccagucugaagagcucuauacagguacuaagacuagcagg

SEQ ID NO: 431253 - RNA, 64 nt, Human
ugccuuugucugugggaaggcaaaugaugccccagagcucuaaccaaagguuuugcagccgccg

SEQ ID NO: 431254 - RNA, 64 nt, Human
cagucuaccgugguccagguuaucagcucuuuaagagcucuauuaauugccauguuuacaaaca

SEQ ID NO: 431255 - RNA, 64 nt, Human
uaaaaauuauguauuguggcauaauccuuuuuuugagcucuacagagaacagucuuuugguaau

SEQ ID NO: 431256 - RNA, 64 nt, Human
aauuacauuaaguauuaaugaggggaaaggaaaugagcucuacgaggauuucacccugcauggg

SEQ ID NO: 431257 - RNA, 64 nt, Human
agaguagggcccugacaggccuuccuccucucaaaccuggcagaugggggccucucuggaagag

SEQ ID NO: 431258 - RNA, 64 nt, Human
cugcuccaucccccugccucccauucugcaccacaccuggcauggugcagggagacaucugcac

SEQ ID NO: 431259 - RNA, 64 nt, Human
ccgaagcugugugcucaccugguuggcucaucaaaccuggcaacccuguggccugucugccgga

SEQ ID NO: 431260 - RNA, 64 nt, Human
gggacagggugggugcucucagaugccauggguugagcucuacugagagccaaggccccuagaa

SEQ ID NO: 431261 - RNA, 64 nt, Human
gggcuugauuaagggcccacgugacaugagaagggagcucuagggaagccguuucauucuucug

SEQ ID NO: 431262 - RNA, 64 nt, Human
uaagcuuuuacagaacaugcuuaauuuugauauugagcucuaaaugcaaaacucuuuuauacug

SEQ ID NO: 431263 - RNA, 64 nt, Human
aacagggaaaaaugaaagaaaugucuugguuacugagcucuaaauagacagguuugauggcacu

SEQ ID NO: 431264 - RNA, 64 nt, Human
uccagcagacuuuucauuaugacuuacauggcaggagcucuaauuaugcuuuaaaaaucuguug

SEQ ID NO: 431265 - RNA, 64 nt, Human
aagcaauuucuccagacuuaaaacaugaugaguugagcucuaucuucauguacucauccugaau

SEQ ID NO: 431266 - RNA, 64 nt, Human
uucagcuccuguuucaggaucuguccugguuccugagcucuaggcugcuaagcugagccacaca

SEQ ID NO: 431267 - RNA, 64 nt, Human
uuaacgucauagacaguuggcccucuguauccgugagcucuauaucugugaauucaaccaaguu

SEQ ID NO: 431268 - RNA, 64 nt, Human
cccauggaaaucacucuccuguugacuauuuccagagcucuagguguuuaggcagcguguggug

SEQ ID NO: 431269 - RNA, 64 nt, Human
ugaaagacccauuuccaggacugaaccuaggucagagcucuaaauugguccuucuauuuuucaa

SEQ ID NO: 431270 - RNA, 64 nt, Human
agaacaacaacugccccucauguacgccaaggaugagcucuagaucauuugagaggcacagugu

SEQ ID NO: 431271 - RNA, 64 nt, Human
gguccuucggggcgaugcucccucagccucagaggagcucuacccugcucccugcuuuggcuga

SEQ ID NO: 431272 - RNA, 64 nt, Human
ccugacagacaaccacuacgcgggccguacagaggagcucuagagggcugcguggcauccuccu

SEQ ID NO: 431273 - RNA, 64 nt, Human
acaauuaaaauugcaguguuccucucugggaugagagcucuaaagcagaguaagauuacguucu

SEQ ID NO: 431274 - RNA, 62 nt, Human
agggacgggaggaagcauccgaaaccuaggauucguccuacgauucugaaccugugccaaua

SEQ ID NO: 431275 - RNA, 62 nt, Human
uccagcguucccgccauugucauggcgggucuucguccuaaacugagaagaaaagcauuccu

SEQ ID NO: 431276 - RNA, 62 nt, Human
cagaaauauugcuaguuuaauauugugucaggucguccuauuaaccaggagcagaugacagu

SEQ ID NO: 431277 - RNA, 64 nt, Human
cuugcauaaacucaaccagcugccuuuuuaaagggagcucuaguccuuuuuguguaauucacuu

SEQ ID NO: 431278 - RNA, 64 nt, Human
gcuuaauuucuucgccuuccacauguuaacaguagagcucuaugcacuccggcugcaaucguau

SEQ ID NO: 431279 - RNA, 64 nt, Human
uuaugaucaguaguugauuuugagaaagcucuaugagcucuaaguaacugcaugguuuuuuguu

SEQ ID NO: 431280 - RNA, 64 nt, Human
gagugccuuucucucucggcuuuuuuuccccccugagcucuaguuuuaaacuuucuccuguuaa

SEQ ID NO: 431281 - RNA, 64 nt, Human
aaaaaacacacaucuuauggcauucaccuucuuggagcucuaggacagugguucucaaaauuuu

SEQ ID NO: 431282 - RNA, 64 nt, Human
aguggcacuaccccaccuggcagcaccuagaccugagcucuacaaaaacacacugcuucacuuu

SEQ ID NO: 431283 - RNA, 64 nt, Human
cuuuuuaaguuuuuuuuccacagguauuuuuccugagcucuauaccaugcauuuagcugccuag

SEQ ID NO: 431284 - RNA, 64 nt, Human
aacaaaaaaaaaauuaaaaaaaaaaacagaaauagagcucuaaguuaugugaaauuugauuuga

SEQ ID NO: 431285 - RNA, 64 nt, Human
guuuaagccuguuuuuuuaaaauauuauugcaaagagcucuauuuguagaagcaaauuauaggc

SEQ ID NO: 431286 - RNA, 64 nt, Human
gugaccuccuucugcaaaguggcagggaccggcagagcucuacaggccugcagccccuaagugc

SEQ ID NO: 431287 - RNA, 64 nt, Human
gaauugucuaggguguucuguacuuagaaaguaagagcucuaaguaccuuuccuacauuuucuu

SEQ ID NO: 431288 - RNA, 64 nt, Human
uggucuuggggacgggaagggaacccucuuccaggagcucuaaggguacuugggaaucaauugu

SEQ ID NO: 431289 - RNA, 64 nt, Human
augauuauuuugugcuacauacagguuggcuaaugagcucuaguguuaaacuaccugauuaauu

SEQ ID NO: 431290 - RNA, 64 nt, Human
uggcucaggaaugcugucagaccagccagccagcgagcucuaggcaaaaggacauggaaacugu

SEQ ID NO: 431291 - RNA, 62 nt, Human
ggccgugauucuggaaaaccuuggaugggccuucguccuaugucagccuucccuuugauccu

SEQ ID NO: 431292 - RNA, 60 nt, Human
gugggagaaguucagugugaccugggucugucguccuagaggcaaguggagaaugguaug

SEQ ID NO: 431293 - RNA, 62 nt, Human
acugguuucuagcacuaccggucacggccaugucguccuagaaggguccagaagauuauuuu

SEQ ID NO: 431294 - RNA, 64 nt, Human
aacagggauuaaaaauaaggauaaacacuaauaagagcucuagaaaaaagggaacagaaagucu

SEQ ID NO: 431295 - RNA, 64 nt, Human
caaaaaugacugaagaacagugaacaaauaaaaagagcucuauuaggaaccaauauucugcaau

SEQ ID NO: 431296 - RNA, 64 nt, Human
ucuccaaacacuuuuggauuaggguacaauauuagagcucuaaaaaggaauaguagaauaacuu

SEQ ID NO: 431297 - RNA, 64 nt, Human
uggaccaguacucccccagcuuucccgacacccggagcucuacgugcuccucaggggaggauuc

SEQ ID NO: 431298 - RNA, 64 nt, Human
agauccaugugauuauuaaaaugacuguagcugagagcucuaauuuuccugucuugaaacugua

SEQ ID NO: 431299 - RNA, 64 nt, Human
auaaaaaccacuuuuauugcgguuugacugcauugagcucuaggauauuaaaugauaucacuaa

SEQ ID NO: 431300 - RNA, 64 nt, Human
cacuacaugacuccaaguauaugagaaaaggacagagcucuaauugauaacucuguaguucaaa

SEQ ID NO: 431301 - RNA, 64 nt, Human
cauauguuaucccuugauuuuuuuaaauaacugagagcucuauuuauuuaugggauuauuaagu

SEQ ID NO: 431302 - RNA, 61 nt, Human
auacuaagaagaaugaauaaauuuacgugaugagcucuacaaggccaaaaauuuuuuuucu

SEQ ID NO: 431303 - RNA, 64 nt, Human
aucuacuaacaaggauccuuuaaaacugccaagggagcucuaacuugaagccacauccuacaga

SEQ ID NO: 431304 - RNA, 64 nt, Human
gggcuguauucacgccauugguuggaagcuaccagagcucuauccccauccaggucuugacuca

SEQ ID NO: 431305 - RNA, 64 nt, Human
uuaauuuagguuucuuuuuuucuucuucauuucggagcucuaagguguaugcaguugugacccc

SEQ ID NO: 431306 - RNA, 60 nt, Human
acgaucucuuuguauuuuaaucuuguggaugagcucuaaguacaugcccaguggauacuc

SEQ ID NO: 431307 - RNA, 64 nt, Human
uuucuucagucauguuagaguagcacaugaaugugagcucuauaaggacagguacuauauuucc

SEQ ID NO: 431308 - RNA, 64 nt, Human
ccuuccuacggggaaucuguguaugggcccaguuccccgcgaguuccugugguaaggcuuucug

SEQ ID NO: 431309 - RNA, 64 nt, Human
caggauccuucugcuccgcucaggacccccggagccccgcgaaaacaucugccucccaggaggg

SEQ ID NO: 431310 - RNA, 64 nt, Human
gaaaugauccccucuuugccuuggacuucuucucccccgcgaguuuuccccacuuacuuacccu

SEQ ID NO: 431311 - RNA, 64 nt, Human
ugaaauuaaaucacuugggagggacgcauagaaggagcucuaggaacacagugccagugcagaa

SEQ ID NO: 431312 - RNA, 63 nt, Human
cacuguggggugagggaaggagcgcuuggagucagagcucuagaccuuggucaacucuucacc

SEQ ID NO: 431313 - RNA, 64 nt, Human
gugauaccuuuguauguaugagacacauuccaaagagcucuaacuaugauagguccugauuacu

SEQ ID NO: 431314 - RNA, 64 nt, Human
guuuccauagccuucagauaagaugauccuuccagagcucuauguacaugcagaugugcauguu

SEQ ID NO: 431315 - RNA, 64 nt, Human
auuacuuuguuuuuguauaaguauguauaggauugagcucuaaaaccaaaccauuauaaugaua

SEQ ID NO: 431316 - RNA, 64 nt, Human
uaucuccucuaugugaacuugacuuugaaagacagagcucuagugugccagccugcuaaguccu

SEQ ID NO: 431317 - RNA, 64 nt, Human
gcuuggaguggcagucguccaaaccccaggaagagagcucuaaagauggggcuucggggguagg

SEQ ID NO: 431318 - RNA, 64 nt, Human
agagcccucccccuuggacuagagcggcugggcagagcucuaaacaggggcaggggcuccucug

SEQ ID NO: 431319 - RNA, 64 nt, Human
uggcaaugauuuggcaacagugcgggugguccucgagcucuauuuuuacugucugguauuuaaa

SEQ ID NO: 431320 - RNA, 64 nt, Human
gguucuuggaaaaauggauccccagugaaaacuagagcucuaagcccauucagcccauuucaca

SEQ ID NO: 431321 - RNA, 64 nt, Human
agcagcugguaaaggggugcuggaggccauggaggagcucuagaaacauuagcaugggcugauc

SEQ ID NO: 431322 - RNA, 64 nt, Human
uugguauuacauuacugcuaugcaccacuugaaggagcucuaucaccagccucaaacccgaaag

SEQ ID NO: 431323 - RNA, 64 nt, Human
ugacauuuugcaaacaaauaaauuguaaucaaaagagcucuaaauuuguaauuucuuucuccuu

SEQ ID NO: 431324 - RNA, 64 nt, Human
gccuuucucuaugcccuuaagggcugacuugccugagcucuaucaccugagcuccccugcccuc

SEQ ID NO: 431325 - RNA, 50 nt, Human
cggggccugaagccacguagccccgcgaugccagaggaggggcacugggu

SEQ ID NO: 431326 - RNA, 64 nt, Human
ugugguuuacugcauuaaggccagaugcuuaauugagcucuaggguggcugguuaguauuaaua

SEQ ID NO: 431327 - RNA, 55 nt, Human
aggaccuaaaagaccugugacuagugagcucuaggcuguagaaauuuaaaaacua

SEQ ID NO: 431328 - RNA, 64 nt, Human
agacuauuuuccagggaugccugaguggugcacugagcucuagacccuuacucagugccuucga

SEQ ID NO: 431329 - RNA, 64 nt, Human
uuauuaaauuuguaaugcaggauuagaagaagcagagcucuaguuuagccuuucuugucucaca

SEQ ID NO: 431330 - RNA, 64 nt, Human
gcucagcuccuggggugauaucuagccugcuugugagcucuagcagggauaaggagagcugaga

SEQ ID NO: 431331 - RNA, 64 nt, Human; identical to SEQ ID NO: 431330

SEQ ID NO: 431332 - RNA, 64 nt, Human
aacaaacaugaguagucugcauaucgaauaucuagagcucuaaacccccaauacuuaaaagucu

SEQ ID NO: 431333 - RNA, 64 nt, Human
gauggaacucaagguggagcucagccuuuccaaugagcucuaagcauguagauagccugagcug

SEQ ID NO: 431334 - RNA, 64 nt, Human
gcaguuaauguaccauuuauuugcuugaugaagggagcucuauuuucuuuaccagaaauguugc

SEQ ID NO: 431335 - RNA, 64 nt, Human
uguaucuuucuuaauauuuauuuuuuacaucucagagcucuacaauuuguuuccuucaagcuua

SEQ ID NO: 431336 - RNA, 64 nt, Human
ugcugggaggcugaagcugacacucuggugagcugagcucuagagggauggcuuuucaucuuuu

SEQ ID NO: 431337 - RNA, 64 nt, Human
aauuaaacuaauuaauagcuuuggacacuuaaaagagcucuaaauuugcuuguacauaaaggcu

SEQ ID NO: 431338 - RNA, 64 nt, Human
cucauucaaggcaaguaaaugaauggaauuaucugagcucuauggcacugguuguuuagaguga

SEQ ID NO: 431339 - RNA, 64 nt, Human
agccaccagugcccugacagaggaaguggagagcgagcucuaucgcaucggccagcagcugggg

SEQ ID NO: 431340 - RNA, 64 nt, Human; identical to SEQ ID NO: 58121

SEQ ID NO: 431341 - RNA, 64 nt, Human
gggccuuuucuagcccacccaaaggacaaauggggagcucuagagugggagaaagaaugaugga

SEQ ID NO: 431342 - RNA, 64 nt, Human
uccuuugcugugacaucaccacucuuuccugaugcucaggaaagcauauugcuccaauucaaaa

SEQ ID NO: 431343 - RNA, 64 nt, Human
aucaggagugugguaguggauuagugaaagucuccucaggaaaucugaagucuguauauugauu

SEQ ID NO: 431344 - RNA, 64 nt, Human
guguuuuccaagcaaaaugccucucccauccucucucaggaagcuucuagagacuuuaugcccu

SEQ ID NO: 431345 - RNA, 64 nt, Human
gcugauguagagcuauugggaaagaacuuccaaacucaggaaguuugcagagagcagacagcua

SEQ ID NO: 431346 - RNA, 64 nt, Human
ucaggaucuugugccuggaaauagccugagguggcucaggaagcggagaaagggugccagacca

SEQ ID NO: 431347 - RNA, 64 nt, Human
agcuaaaucacaaaacauccaauuucucuguuuccucaggaagucauuacugcgccaccacauc

SEQ ID NO: 431348 - RNA, 64 nt, Human
gcccaucccagcccguuucugcccaccaguuguucucaggaaccuuacccaugcuccagcgucc

SEQ ID NO: 431349 - RNA, 64 nt, Human
accuagugagcccucuggcucugggagccccuaucucaggaauuuucagggucauuugugacuu

SEQ ID NO: 431350 - RNA, 64 nt, Human
caggcugaggcaacauggaucagugugugucccccucaggaauguauccacaguggccuuccuu

SEQ ID NO: 431351 - RNA, 64 nt, Human
cagugcuuuguuauguuuuauuaacuggcccugucucaggaacaucuuaacagauggcaaaaaa

SEQ ID NO: 431352 - RNA, 64 nt, Human
aaguucuagaauuuuuuaaagguauucauggugacucaggaauacacacauacacacacacaca

SEQ ID NO: 431353 - RNA, 64 nt, Human
gugccuugcucauuugaaaauggacagaaugugucucaggaaaacagcuaguagacaugaauuu

SEQ ID NO: 431354 - RNA, 64 nt, Human
gugaggaaaaugauugacaaagcccaacaaugaucucaggaauuacauuuuccaacagaccaaa

SEQ ID NO: 431355 - RNA, 64 nt, Human
auggugaaaggguuugauauggagaaacaaaauccucaggaaauuagauaaauaaaaauuuaua

SEQ ID NO: 431356 - RNA, 64 nt, Human; identical to SEQ ID NO: 58128

SEQ ID NO: 431357 - RNA, 64 nt, Human; identical to SEQ ID NO: 58135

SEQ ID NO: 431358 - RNA, 64 nt, Human; identical to SEQ ID NO: 58142

SEQ ID NO: 431359 - RNA, 64 nt, Human; identical to SEQ ID NO: 58148

SEQ ID NO: 431360 - RNA, 64 nt, Human
gauaaaauucggcgcuauugcccccguagcucuggagcucuaaaccgucuaucugcuucugugc

SEQ ID NO: 431361 - RNA, 64 nt, Human
aaggaauuauagacccccagggucagccaguuaagagcucuacccacaccugucaaccccucuc

SEQ ID NO: 431362 - RNA, 64 nt, Human
ugugcuuuuauguugggacagcugccuaaauuaggagcucuagaccuguuauugguucccaacu

SEQ ID NO: 431363 - RNA, 64 nt, Human
aauccuuccuuuccugcucuugguuuucccaggugagcucuaugcccucaguggcuggauugca

SEQ ID NO: 431364 - RNA, 64 nt, Human
caagcucuccauggcccacagcaggcacaggucugagcucuauguccuugaccuugguccauuu

SEQ ID NO: 431365 - RNA, 64 nt, Human
guucugggugggaguggggagggcgaggggccuagagcucuaauuguuuguuuuggaagaaaaa

SEQ ID NO: 431366 - RNA, 64 nt, Human
cccagugaacgcuaagaaguuucagacaagcagagagcucuauuuuuagaagaaauauguuaca

SEQ ID NO: 431367 - RNA, 64 nt, Human
uggcagaguaucaaaagggggaaaaugacaaagugagcucuaagaaaaugugaggcuacuucua

SEQ ID NO: 431368 - RNA, 64 nt, Human
cacucaguucaaccaauccgcugccuucuguucugagcucuaaagcugcuaauucucccagucu

SEQ ID NO: 431369 - RNA, 64 nt, Human
uugggauuuacuaguagccaaaaggaaugaaagagagcucuaaccagauggaacacuggaacau

SEQ ID NO: 431370 - RNA, 64 nt, Human
agccaacauuuaaugagcaccuacuuuauguauggagcucuaacccauggguccaugggaauaa

SEQ ID NO: 431371 - RNA, 64 nt, Human
uccucuucuuuucccagagcuccaccccaaccaggagcucuaguuaauggagagcucccagcac

SEQ ID NO: 431372 - RNA, 64 nt, Human
guggagaucuaaaggcagugauugauuucacagggagcucuaaucucugugauuacaugguccu

SEQ ID NO: 431373 - RNA, 64 nt, Human
uuauggacaauauuauuuucauuggaugauucuggagcucuauuaggagaaaaguaaucauuuu

SEQ ID NO: 431374 - RNA, 64 nt, Human; identical to SEQ ID NO: 58155

SEQ ID NO: 431375 - RNA, 64 nt, Human; identical to SEQ ID NO: 58161

SEQ ID NO: 431376 - RNA, 64 nt, Human; identical to SEQ ID NO: 58168

SEQ ID NO: 431377 - RNA, 64 nt, Human
gggaaggcugggucccagcugggaguaugggugugagcucuauagaccaucccucucugcaauc

SEQ ID NO: 431378 - RNA, 64 nt, Human
uuccaauguuagguuugcuacaagaugguuacuggagcucuagcugccuauuuuguguuuaggg

SEQ ID NO: 431379 - RNA, 64 nt, Human
ugaaccggcacauuccuuuccuuuaggccguccagagcucuaguccacacccaauacuuuagag

SEQ ID NO: 431380 - RNA, 64 nt, Human
ucucaguuuauuuaagaugcuuuuguugcgagcggagcucuagagugaagccuccugugugugu

SEQ ID NO: 431381 - RNA, 64 nt, Human
caauuaaucaacauguauauuuucucuauacauagagcucuauuucucuacgguuuuauaaaag

SEQ ID NO: 431382 - RNA, 64 nt, Human
auagacucuaaugcaauaaucacauaaauauagcgagcucuacuaaguacagguguguauaaug

SEQ ID NO: 431383 - RNA, 64 nt, Human
auuucagaaucggcaaugccuggcccacuccugagagcucuaguuuucuaguuuuccauuucca

SEQ ID NO: 431384 - RNA, 64 nt, Human
ucacucuggccucgcugagcggcugcccgaggaggagcucuaggccgacgcccaccgcaggccu

SEQ ID NO: 431385 - RNA, 64 nt, Human
gcagagcgccaagucccgaguggccuucuuugaagagcucuagcaggugacccagccaccccag

SEQ ID NO: 431386 - RNA, 64 nt, Human
ugcagguacuggaaaaccuccaucuuggcucccagagcucuaggaacucuucaucacaacuaga

SEQ ID NO: 431387 - RNA, 64 nt, Human
acugucagaaaaagcuagcacuaacucguguuuggagcucuauccauauuuuacugaucucuuu

SEQ ID NO: 431388 - RNA, 64 nt, Human
agauuguuugauagugauaaguuacauuuauguggagcucuaugguuuugagagcacuuuuaca

SEQ ID NO: 431389 - RNA, 64 nt, Human
uuauauagaguaccuauuauuauaugccacaauagagcucuaugagaaacagugucuugcggug

SEQ ID NO: 431390 - RNA, 64 nt, Human
caauuccuuguaggaguauaggccggucuaaagugagcucuaugggcagaucuaccccuuacuu

SEQ ID NO: 431391 - RNA, 64 nt, Human; identical to SEQ ID NO: 58176

SEQ ID NO: 431392 - RNA, 64 nt, Human; identical to SEQ ID NO: 58184

SEQ ID NO: 431393 - RNA, 64 nt, Human; identical to SEQ ID NO: 58190

SEQ ID NO: 431394 - RNA, 64 nt, Human
uaagaugccuuuggcuuguacagugugauucaucgagcucuaucaacacugguaacuaagaccu

SEQ ID NO: 431395 - RNA, 64 nt, Human
ucucagaugaaggcaaagcuuugauccgacaucugagcucuagccuaagaaggagaguugagau

SEQ ID NO: 431396 - RNA, 64 nt, Human
auggggacaauuagcauaacuaaacaaagauuaugagcucuacuuauuccgugagaauacccug

SEQ ID NO: 431397 - RNA, 64 nt, Human
ccacuaacaucccagacuuuaaaauucaguaaaucagauguacaccgagccugcagucucgcua

SEQ ID NO: 431398 - RNA, 64 nt, Human
cucaugucucaauucuuuguauaugcauucuuuucagauguauuaaacaaacaaaaacccuuca

SEQ ID NO: 431399 - RNA, 64 nt, Human
uauuuggucgacuuuugugaaugugugacauaaacagauguaaugcaugucacagugacggaga

SEQ ID NO: 431400 - RNA, 64 nt, Human
aaggaagaugaugcuuaguuccugauagaugcuacagauguaguuuggcauuucaguuuuuguc

SEQ ID NO: 431401 - RNA, 64 nt, Human
cagccaauacaauuagucaaaccacuguuauuaacagauguagcaacaugagaaacgcuuaugu

SEQ ID NO: 431402 - RNA, 64 nt, Human
uucuaaaaugauuggaacaaagacuaaguugugccagauguaaaucaaccccucuuuuaguuua

SEQ ID NO: 431403 - RNA, 64 nt, Human
gauaaugauuuccucugaauuauaauaacauagccagauguagucucacacuguuuuucauacu

SEQ ID NO: 431404 - RNA, 64 nt, Human
gaacagaacaagcaaaaugaccagcugcuuagucaccuggcaaagcaggugagcaaccucauca

SEQ ID NO: 431405 - RNA, 64 nt, Human
guuucucgcauaggaccuuuccaccacagccagcaccuggcaucgcaccauucugacucgguuu

SEQ ID NO: 431406 - RNA, 64 nt, Human
auuuuaguguacauuuacgucccugcccucuuugaccuggcaauauaguguuguauaauguaaa

SEQ ID NO: 431407 - RNA, 64 nt, Human
agucaugagaacagaaagugcaauauuuccuuucaccuggcaggggaggggggauuuauuucug

SEQ ID NO: 431408 - RNA, 64 nt, Human
agcacucccuaauuuaugugcuauauaaauaugucagauguacauagagaucuauuuuuucuaa

SEQ ID NO: 431409 - RNA, 64 nt, Human
cccuggcucucugguccuuguugcucuaacaguccagauguacacccagccucagggggaaggc

SEQ ID NO: 431410 - RNA, 63 nt, Human
ugaaggcaaaauuguuguaacacuacagcugagcagauguaauagaaauaaaccuaugaauaa

SEQ ID NO: 431411 - RNA, 64 nt, Human
ugccaguaaaauuuuuuuagugguauucuguuuacagauguauuaggaccauugaugcauuaca

SEQ ID NO: 431412 - RNA, 64 nt, Human
uagcugaguuggaacacuguggauauucugagaucagauguaguauguuugaagacuguuauuu

SEQ ID NO: 431413 - RNA, 64 nt, Human
cacguucuagugauuuggggcaugggcuuaauagcagauguacaguguauuccugcauuauugu

SEQ ID NO: 431414 - RNA, 64 nt, Human
aggcggcaccaaugagaaaggaaugcagacccuccagauguauccuugggaaaagcaguaaacc

SEQ ID NO: 431415 - RNA, 64 nt, Human
ccuguauuaugugaacagucuuauucuauguacacagauguaauuaaaauuguaauccuaacaa

SEQ ID NO: 431416 - RNA, 64 nt, Human
aguauucuucaucagcauuuaauaaauguauaggcagauguaagguaauuucuguguauuuuga

SEQ ID NO: 431417 - RNA, 64 nt, Human
uagacaguaagaagaaagcagccucauugauccgcagauguaggggccucuuggcagaggcugg

SEQ ID NO: 431418 - RNA, 64 nt, Human
cccuucauuuaauuuucucauagauuuaaguaaacagauguauuuugcacagugcacuuauguc

SEQ ID NO: 431419 - RNA, 64 nt, Human
guucucuccucuuuauauccugagacuuugacaccagauguagauauuuaucuggagcuggaaa

SEQ ID NO: 431420 - RNA, 64 nt, Human
caggguccugugugguuacaucuuggaaaaaaugcagauguauuucacucuccccggucagcuc

SEQ ID NO: 431421 - RNA, 64 nt, Human
auucauuuacucaccauauuugaauuggccugaacagauguaaaucgggaaggaugggaaaaac

SEQ ID NO: 431422 - RNA, 64 nt, Human
ugucuuccauggagccucaggugcucccccucucaccuggcagccccuucagcugcuagugaua

SEQ ID NO: 431423 - RNA, 64 nt, Human
aauuugacucuccuuucagcuguucacauaaagcaccuggcaaagcauuuuaccuguuaggggg

SEQ ID NO: 431424 - RNA, 64 nt, Human
ucugcccagauuccaugcuuucuauaacuggaggaccuggcaaaccugccgcaugcugcacaca

SEQ ID NO: 431425 - RNA, 64 nt, Human
guuugcaucuacauauauuuguacaucuauaugacagauguauuuuaaaaguuucaucuugaag

SEQ ID NO: 431426 - RNA, 64 nt, Human
agcucccaaagagagggcugcucagggggcuucccagauguagcucucagcagugcuguugaga

SEQ ID NO: 431427 - RNA, 64 nt, Human
cagucugugaguuuauuuggagauaaggucucugcagauguaguuaguuaagacaaggucaugc

SEQ ID NO: 431428 - RNA, 64 nt, Human
uauacaggaauauuuuaauaaguguaucaccaugcagauguagaagagagcgaaagugauugug

SEQ ID NO: 431429 - RNA, 64 nt, Human
cacuaaugcgcaguguuuauuaaaggaacaugcacagauguaucuguauauagguauugauaua

SEQ ID NO: 431430 - RNA, 64 nt, Human
acgaaaaaaaacucagcuucuguuguuuaucaggcagauguacaggauaaugguauaaaucaaa

SEQ ID NO: 431431 - RNA, 64 nt, Human
uaaauuaugacucauuuuaagugaccuuuaaaaucagauguauuuauuaugcuuguguaauuau

SEQ ID NO: 431432 - RNA, 64 nt, Human
auauuuagggaaagccggguggggggaggggauacagauguagaagguggguagggcuacaggg

SEQ ID NO: 431433 - RNA, 64 nt, Human
uacuauagaucagucucaugggccaucucuuccucagauguaaaugauaucugguuaaguguua

SEQ ID NO: 431434 - RNA, 64 nt, Human
uuuaugagauguacaaguaagugucuuaucuguacagauguaaauguugaugaaaaugcaauug

SEQ ID NO: 431435 - RNA, 64 nt, Human
ugauaggauuugcucacauaguuccugcaaacuucagauguacaaguugcacuuguacuuuuau

SEQ ID NO: 431436 - RNA, 64 nt, Human
acucagaguucugaagggggccagauguugggugcagauguagaagcagccagucacagaccca

SEQ ID NO: 431437 - RNA, 64 nt, Human
guuugcauuuacauauauuuguacaucuguaugacagauguauuuuaaaaguuucaacuugaag

SEQ ID NO: 431438 - RNA, 52 nt, Human
caaguuuucacuccagcuaacacagauguaaaagacuuuuuuuuauacgaua

SEQ ID NO: 431439 - RNA, 64 nt, Human
aaccaugaccaucuuugagccuuccuaguccuccaccuggcacaguauuugaaauggcaaagga

SEQ ID NO: 431440 - RNA, 64 nt, Human
accccugcuuccugguucucagucccaccccaaaaccuggcacccagaacaguuggaagugugg

SEQ ID NO: 431441 - RNA, 64 nt, Human
gaacuggaagaaacacacuggauuggguaugucuaccuggcagauacucagaaauguaguuugc

SEQ ID NO: 431442 - RNA, 64 nt, Human
guagagagggacagaaggggcgguucagccaagacagauguagacggaguuggagcuggguauu

SEQ ID NO: 431443 - RNA, 64 nt, Human
ucauacuaauggaacauuuuggcaaauguauauucagauguacacuaauauauuaucuauuaaa

SEQ ID NO: 431444 - RNA, 64 nt, Human
uaacuaguaauaccaaagacuauuucaaaauguccagauguaggggaagagauguuuacaguau

SEQ ID NO: 431445 - RNA, 64 nt, Human
ccucaucaccuuggccucaacuaauuaggccaaacagauguacuucacucaaggagaaccaauc

SEQ ID NO: 431446 - RNA, 64 nt, Human
aaagugaauguuuuuguaacauuuaagcauauuucagauguaaauaaaagauuguaaaauauac

SEQ ID NO: 431447 - RNA, 64 nt, Human
cuguuuggccaaccaugaaaauuaaagagugaagcagauguaauggccugacauuccaaaaacu

SEQ ID NO: 431448 - RNA, 64 nt, Human
caaaaugugcggacugaaucccagagaacacuggcagauguauacaguauauggauuguaucgc

SEQ ID NO: 431449 - RNA, 64 nt, Human
ccauucuucuuuagggcaguauaugaaauccuagcagauguaaaauggaaaagaauccuaaugc

SEQ ID NO: 431450 - RNA, 64 nt, Human
ccauauguguuugguuucaaugguuuuuuauauucagauguauauauggugcucacuuuaggau

SEQ ID NO: 431451 - RNA, 64 nt, Human
ugccgaacaucugacuagccacaaguauguuacccagauguagaauuuucaucacuaaacagua

SEQ ID NO: 431452 - RNA, 64 nt, Human
cuguuguagacuuaauugaaucacauuuugggaccagauguauuuggggauagaauucuuuaaa

SEQ ID NO: 431453 - RNA, 64 nt, Human
aucacagaccuuuccaaauguuuguauauguaaucagauguacauuuauauugaaaaacaaaug

SEQ ID NO: 431454 - RNA, 64 nt, Human
guugaugaauuuuguucagaguuucauccuaauccagauguauuaaaaauauauaaaaguguaa

SEQ ID NO: 431455 - RNA, 64 nt, Human
cccuuauuuaucaugccuuuguucucuuuucccucagauguauauuucuuuaaaaauaauuuuc

SEQ ID NO: 431456 - RNA, 64 nt, Human
gacugacccuccuuccuccagccugcccugacccaccuggcaaagcagggcacauggggaggaa

SEQ ID NO: 431457 - RNA, 64 nt, Human
agcgccucagcacaggugucagggugcaaggaagaccuggcaauggacagcaggaggcagguuc

SEQ ID NO: 431458 - RNA, 64 nt, Human
ggaggaggaagacccucaguuauuuugucacccaaccuggcauaggacucuuugguccuacccg

SEQ ID NO: 431459 - RNA, 64 nt, Human
aggggucuaaaaagauuuuggcaaaacauauuugcagauguagauuagcuggugaagaaaauua

SEQ ID NO: 431460 - RNA, 64 nt, Human
ucaaucccaguugaauuaauuggcaugaagaguacagauguaaucacaaguaaugcaagacuca

SEQ ID NO: 431461 - RNA, 64 nt, Human
aacaaaacuaaaaccgcaugauaacuagagaauacagauguaugcucuccccucucagaugcga

SEQ ID NO: 431462 - RNA, 64 nt, Human
cagugaguauggcccgaugcuuucuguggcuaaacagauguaaugggaagaaauaaaagccuac

SEQ ID NO: 431463 - RNA, 64 nt, Human
ucuucauuguuggguugauuccccaaaaccuugacagauguaucgauggaauaaaaguauguuu

SEQ ID NO: 431464 - RNA, 64 nt, Human
ggggccgccugaggccugugcgcuguuguccucgcagauguacuuauuuuuguucauguuacgg

SEQ ID NO: 431465 - RNA, 64 nt, Human
augcccccagaaaggugggugguggagacggcaccagauguaccaguuuucugcaguuccuuau

SEQ ID NO: 431466 - RNA, 64 nt, Human
caggauuuuacagauaaauagaugcugauucaugcagauguaguacuaagucugagauauugaa

SEQ ID NO: 431467 - RNA, 64 nt, Human
caaauaacagaccagcuucuuuuucuugcaguuacagauguaauuuccuuuuuguugucaaaca

SEQ ID NO: 431468 - RNA, 64 nt, Human
uuguggcuucauugaauauuuaugaagauaaugucagauguagacaaaaauaacacaauaacag

SEQ ID NO: 431469 - RNA, 64 nt, Human
auucuuucaguuuuacacaauuaaaguauacacacagauguagcuuaucuguuuuuuucuuaaa

SEQ ID NO: 431470 - RNA, 64 nt, Human
ucggacaaaauuuaacguugauguaaugaaauuccagauguaggcauuccccccaggucuuuuc

SEQ ID NO: 431471 - RNA, 64 nt, Human
caguguuuauuucucaagaguaauauucggccaacagauguaaauaauagcacuagccacucuu

SEQ ID NO: 431472 - RNA, 64 nt, Human
aauuaguuggcagagaaaaugcugccuagugcuacagauguacauuaaauaccagccagcagga

SEQ ID NO: 431473 - RNA, 64 nt, Human
cugucaggaugccuguggucaugcucucagcuccaccuggcaugagaagggauccuggccucug

SEQ ID NO: 431474 - RNA, 64 nt, Human
gauaagaaauggaagccccugcaagguguggggaaccuggcagcaccuaaugcugccacaucca

SEQ ID NO: 431475 - RNA, 64 nt, Human
auagagcugggacuucccauguggcccacaucugaccuggcagcccauguauuccggucauuag

SEQ ID NO: 431476 - RNA, 64 nt, Human
cuaggauuacaggcaugagccacugugcuugguccagauguauuacuuuuuauguuugguauua

SEQ ID NO: 431477 - RNA, 64 nt, Human
aaaagugauuaagaggaguuuaagcuaucauuuccagauguauuucuauaaauaaaaacauaag

SEQ ID NO: 431478 - RNA, 64 nt, Human
gcuccacuucacaugcuggagaccggcguagggacagauguauucauccugguguuacugaaaa

SEQ ID NO: 431479 - RNA, 64 nt, Human
augagaaaagaugucuuaaucauccuuaugaaaacagauguaaacaacuauauuucaacuaacu

SEQ ID NO: 431480 - RNA, 64 nt, Human
auaucaagaaaaucaggggcugcuccuuguaauacagauguaguacgcacuugccgcuaagccu

SEQ ID NO: 431481 - RNA, 64 nt, Human
aaaggagauacuugaauuguuauuuaaaucaaaccagauguaaaacacucacauacaaguucau

SEQ ID NO: 431482 - RNA, 64 nt, Human
cccaaauaggucacauucacgcauaucagauggacagauguaucauuuugggguccaccauuca

SEQ ID NO: 431483 - RNA, 64 nt, Human
cacccaaacuuuauugauucaccuccuaaaacaacagauguacgacuugcauaccugcuuuuua

SEQ ID NO: 431484 - RNA, 64 nt, Human
uuaugccaauaaugauuuuaaugaaggcucuuuucagauguaaccuuaugaaggaaauaucugc

SEQ ID NO: 431485 - RNA, 64 nt, Human
uucccucugaaauuacaaacuuuaggaacuuuuccagauguaucgaauuuaauuugacauugau

SEQ ID NO: 431486 - RNA, 64 nt, Human
agugaagcaaucuuguauuuuuaauauuuaaaggcagauguacgcuuuaaauuggucuccauuu

SEQ ID NO: 431487 - RNA, 64 nt, Human
acuuggcagcugugccagaaaccaaagccaggcccagauguagggggagggcacgagagcugaa

SEQ ID NO: 431488 - RNA, 64 nt, Human
auggaugauuggccagaaaugaagaagaaguuugcagauguauuugcagagaagacgaaggcag

SEQ ID NO: 431489 - RNA, 64 nt, Human
auaaccacauuuaaugggaaaaacggcaguaucacagauguaaauuaacucaccagauuuacug

SEQ ID NO: 431490 - RNA, 64 nt, Human
uucugagugaacccacagcagucgcagaaugagcaccuggcaggguggguuuccuaggaauaau

SEQ ID NO: 431491 - RNA, 64 nt, Human
uagggucagggcuuauagcaggaugucuggcugcaccuggcaugacuguuuguuucuccaagcc

SEQ ID NO: 431492 - RNA, 64 nt, Human
guugugugcaaauccagcuuccauccccuccccaaccuggcaggauucuccauguguaaacuuc

SEQ ID NO: 431493 - RNA, 64 nt, Human
uuuuagucccaggaccagacauccccagacuccacagauguaaugaaguccccgaauguaucug

SEQ ID NO: 431494 - RNA, 64 nt, Human
ggccauagaccagagcaacacauugaaauguauacagauguacuagcuaaagucucuuuaugug

SEQ ID NO: 431495 - RNA, 64 nt, Human
ccgcagggcacagagaagccucuucugccccugccagauguauggccggcagcuucccccucuc

SEQ ID NO: 431496 - RNA, 64 nt, Human
guuacacuuuuauggcuuuuaauuuucgauuugacagauguaagaagcagcaugaauaguuuau

SEQ ID NO: 431497 - RNA, 64 nt, Human
gagcuuucagguguuacucagcugcauaguuacgcagauguaaugcacauuauuggcguaucuu

SEQ ID NO: 431498 - RNA, 64 nt, Human
ucucagcuuggugaggcuccaaaagagaauaugucagauguauuccuacuuccaaaccugucuu

SEQ ID NO: 431499 - RNA, 64 nt, Human
agccuucacaggauaagaggacugggaauaaagucagauguaaugugacccuagaaaacuguag

SEQ ID NO: 431500 - RNA, 64 nt, Human
uucuucuuugagaaguuuuuccuuucuccgcaaccagauguacauauuugaacucucuuuguac

SEQ ID NO: 431501 - RNA, 64 nt, Human
auaaugauauuuuuguauagaagagucaacuguucagauguaagauguugaaaaauguuaaaau

SEQ ID NO: 431502 - RNA, 64 nt, Human
gcaggcuuuggaguuguuuccauggugauggggccagauguauaguauucaguauauauuuugu

SEQ ID NO: 431503 - RNA, 64 nt, Human
gaaccguaacucuuuggaacaaaccaaaauauagcagauguaauuguacaguuccugauuaaac

SEQ ID NO: 431504 - RNA, 64 nt, Human
gaacgugacuaacaaagacuaaugugcacauuaacagauguacuuuuuaagguuuuaugggagg

SEQ ID NO: 431505 - RNA, 64 nt, Human
uuuauuuggauuuuuaaauacauuuuuaaaauuucagauguaauuuaacaucacauuuguuuuu

SEQ ID NO: 431506 - RNA, 64 nt, Human
uucagauuucucagauuugaaaaaggcucuaucucagauguaguaaauuauuuccuuucaguuu

SEQ ID NO: 431507 - RNA, 63 nt, Human
aauuugaaauggacaucuaauccagugcagaugaccuggcauguggaguuacagagggauccc

SEQ ID NO: 431508 - RNA, 64 nt, Human
uccgauuccauacuguuuucugucauuagauaucaccuggcaaguuucugccuaauuaaggaga

SEQ ID NO: 431509 - RNA, 64 nt, Human
cucccauuccauacuguuuuugucauuggauaucaccuggcaaguuucugccuaacuaaagaga

SEQ ID NO: 431510 - RNA, 64 nt, Human
aaacaauguugggcauugagguguaaauuuugcccagauguauacccagugugaaauaucuucu

SEQ ID NO: 431511 - RNA, 64 nt, Human
ucuuuauagaaacgauucugcugguuuugaagaacagauguauuacacuaacuguaaaaguagu

SEQ ID NO: 431512 - RNA, 64 nt, Human
uugauauuucaucuauguuugaaaugugagaauucagauguaauuuuuuaccuugauuuggcau

SEQ ID NO: 431513 - RNA, 64 nt, Human
gucauucucagaauuguugucuucaaagcauugucagauguagagugcucagauguggcucuua

SEQ ID NO: 431514 - RNA, 64 nt, Human
gauuucuuucacuucugauccuuuuccuuuuucucagauguagcugagucuugaucauuuuaag

SEQ ID NO: 431515 - RNA, 64 nt, Human
ggaugguuaugucaaagucauaguucauccuauccagauguagcauucaugguaaacuuuuaag

SEQ ID NO: 431516 - RNA, 64 nt, Human
acuaugcagucuuuuuuaagagagcagagaguaucagauguacaauuauggaaauaagaacauu

SEQ ID NO: 431517 - RNA, 64 nt, Human
uagacucauaguugaaauuagugcagaaagaacucagauguacuagauuuucauuguucauuga

SEQ ID NO: 431518 - RNA, 64 nt, Human
ugcucuucagccauaguggaucacucaccauucccagauguaccaggcucucgcacaccucugc

SEQ ID NO: 431519 - RNA, 64 nt, Human
ggccacacgaauagaaggcugucgugaaucacaucagauguaaaaucauuccuucuguuuacuc

SEQ ID NO: 431520 - RNA, 64 nt, Human
aggcgggcaccgucauucgcugccauuggcuucucagauguauuucaaggacuaaagugggcuc

SEQ ID NO: 431521 - RNA, 64 nt, Human
ugcagucuucucuucgcucuucagccugaagguccagauguagcuggggccucucaguuugguu

SEQ ID NO: 431522 - RNA, 64 nt, Human
aaguggcuagguugguagaaucaaaaacaagggccagauguauuuaagggguauucagaugcca

SEQ ID NO: 431523 - RNA, 64 nt, Human
uaacggugccagaaaagucacuggacaaagaacacagauguaucgucagacaugagaauaauaa

SEQ ID NO: 431524 - RNA, 64 nt, Human
uuugagagacuguucccaggaggcccaaccgcagaccuggcaaguggacagugcaguguggaga

SEQ ID NO: 431525 - RNA, 64 nt, Human
uggccugcaggccugcaggggaggcagcaaagggaccuggcaguugcaacacaguaagucagga

SEQ ID NO: 431526 - RNA, 64 nt, Human
guggugaaggaccuggagccggaacugcugcggcaccuggcaaaaggcauggccucccugauga

SEQ ID NO: 431527 - RNA, 64 nt, Human
aacuaaggcuucagccauaauauggaggagggagcagauguaagcucccaagagccugggggau

SEQ ID NO: 431528 - RNA, 64 nt, Human
ccuugugccuuccgccucucaaauauucagaaagcagauguaugcugggcacgguggugacuca

SEQ ID NO: 431529 - RNA, 64 nt, Human
auaaauuuaaauacuauaagaccuggcugaaucccagauguaucaauaaauuguuauaguagcu

SEQ ID NO: 431530 - RNA, 64 nt, Human
augauuccaauguguuggaaaguuuaccuugucucagauguaacugguaaaggcugauuucuaa

SEQ ID NO: 431531 - RNA, 64 nt, Human
gcucaaccuaaaugaauucaagguagagagaauccagauguauuuaauguuuauggcacaaacu

SEQ ID NO: 431532 - RNA, 64 nt, Human
cgcgguuccaaccacaguggugaagcagcgcuugcagauguacaacucgcagcaccggucagca

SEQ ID NO: 431533 - RNA, 64 nt, Human
uucuauauuguuaucaguccaggaaacagguaaacagauguaauuagagacauuggcucuuugu

SEQ ID NO: 431534 - RNA, 64 nt, Human
cuucauuuaccagugcaggaagucucauaaaacucagauguacucccacaaaaauuuuauuggc

SEQ ID NO: 431535 - RNA, 64 nt, Human
ugcccucuguaaauguguugagugauauagcuaucagauguauugaaggcaaaguucucgcaga

SEQ ID NO: 431536 - RNA, 64 nt, Human
auucuauccguugaucuuaguggugaaaacuuaucagauguagacuuccuagaugauucuucaa

SEQ ID NO: 431537 - RNA, 64 nt, Human
gacaggcauuuccuccucccgcuucuugaccccacagauguauuccagcagagagcaacacacc

SEQ ID NO: 431538 - RNA, 64 nt, Human
uguauaaaguugaguacuuagaaaaaagacaaaccagauguaauauauuuuguggauguuuuua

SEQ ID NO: 431539 - RNA, 64 nt, Human
guaagaugucacugucuggguuccagcccucccucagauguacuuuggcuucaaugauuggcaa

SEQ ID NO: 431540 - RNA, 64 nt, Human
guucauuaacauucucugauagaauucuggucaucagauguacugcaauggaacaaaacucauc

SEQ ID NO: 431541 - RNA, 64 nt, Human
gaggauuacaggaaagcaccuguccuggcucuguaccuggcacguaguaggugcucaguucaug

SEQ ID NO: 431542 - RNA, 64 nt, Human
gagaaguaagaggcuaccucuuaccuaacaucugaccuggcaucuaauucugauucuggcuuua

SEQ ID NO: 431543 - RNA, 64 nt, Human
cuugaggguuugggguucaaagucagcccaucccaccuggcaaaauccuccuggaaggaggacc

SEQ ID NO: 431544 - RNA, 64 nt, Human
uaaagacagcccauuuuugucauuuccauuaccacagauguaagaaagugauaagccauggcca

SEQ ID NO: 431545 - RNA, 64 nt, Human
ugaccaacaauauccuuauuuuaggugccacuagcagauguaagcguauacuuaguugccguua

SEQ ID NO: 431546 - RNA, 64 nt, Human
aaaauuuuuucagauggacaaaauguauaugguacagauguaaaguuuucuauguaaaaaauuc

SEQ ID NO: 431547 - RNA, 64 nt, Human
agagugugaaaucucagauacuuaugaaaucucacagauguaaggacucaaguguagaagaaaa

SEQ ID NO: 431548 - RNA, 64 nt, Human
auugcauugugcccaaguaauaauaaaacuauuucagauguauuauaugauugagcaaaugaga

SEQ ID NO: 431549 - RNA, 64 nt, Human
uccuuuuauuuuguguauuuuauuuccuaaguuucagauguaauaucuguuguuuccuaacaug

SEQ ID NO: 431550 - RNA, 64 nt, Human
ugaugucagacaccaucuguagugagcagcgcaccagauguagcgugcuacagucagcuuuagc

SEQ ID NO: 431551 - RNA, 64 nt, Human
uagcuuuggauuuuaacauguuuuucugaaugaccagauguaggcuuagccaguuuauuuucuc

SEQ ID NO: 431552 - RNA, 64 nt, Human
ccuccuggacuuccugaggacucgacauuguccacagauguacuggccauuacaugaaacaaga

SEQ ID NO: 431553 - RNA, 64 nt, Human
acgugccuuguccacuuugggcuccagagucuuucagauguacuaagcugcugacaucauccac

SEQ ID NO: 431554 - RNA, 64 nt, Human
aggcaugcacgcuugugguugugguuuuauauuacagauguagaacaaugguuauguuucccga

SEQ ID NO: 431555 - RNA, 64 nt, Human
uuuuuaaaaauuagaugcaaacuagaucuguaugcagauguaguuuuuagcagggcaaacagug

SEQ ID NO: 431556 - RNA, 64 nt, Human
uacuuuauuuuuuaaaaaugacagaacuuuuguucagauguaaaagacaaaauugcacuuuaau

SEQ ID NO: 431557 - RNA, 64 nt, Human
gcauuugagguguagugaaaucuuugcuguucaccagauguaauguuuuaguuccuuacaaaca

SEQ ID NO: 431558 - RNA, 64 nt, Human
cugaagugaccacuuuucuucucuuugaggcacuaccuggcagcaccaucuaaaccuguaucau

SEQ ID NO: 431559 - RNA, 64 nt, Human
gcugaacaguaacuaacuggaaaauuagauaagcaccuggcaucuaauggcaggcaggcacuca

SEQ ID NO: 431560 - RNA, 64 nt, Human
acggccuggcaugcagcuuguccuugcuccuggaaccuggcaggcccugcccagccagccaucg

SEQ ID NO: 431561 - RNA, 64 nt, Human
ccagugucuuuuacaaaaacagauggcauagugucagauguaccuuacucucugcuacuguaca

SEQ ID NO: 431562 - RNA, 64 nt, Human
gacuccaaaugccucaaguuauguauaccugucccagauguaaacuucauuguccuuuguugga

SEQ ID NO: 431563 - RNA, 64 nt, Human
ucacaggcaaaauuugauuuggcuaaaauaggcucagauguauuugugugcccgugugugugug

SEQ ID NO: 431564 - RNA, 64 nt, Human
gacuuuacccauguuauuuucuugguuuuuauuucagauguagauuuuguuuuugagguaaauu

SEQ ID NO: 431565 - RNA, 64 nt, Human
aggcaauuuuagcaaagcugugcuauuugcuugucagauguacacaacuuccuuaaagucaaau

SEQ ID NO: 431566 - RNA, 64 nt, Human
guagaaacucuaagagaccauuaccauuuauucacagauguauaggggauguauucuaaaaacu

SEQ ID NO: 431567 - RNA, 64 nt, Human
aaugaagauguaucuaccagugucauucaauuagcagauguauauguaugcauaauuaauuugg

SEQ ID NO: 431568 - RNA, 64 nt, Human
agacuuaccaaagguaauacucgugaguagguggcagauguagcaaaaacuucacaacaauuca

SEQ ID NO: 431569 - RNA, 64 nt, Human
aaauagccaggcccucucucccucaagaaaugcccagauguagaaauucaucagugccuauugg

SEQ ID NO: 431570 - RNA, 64 nt, Human
aauuuuuaaaagauucaauggcuuguucauccuccagauguagcuauugauguacacuucgcaa

SEQ ID NO: 431571 - RNA, 64 nt, Human
gucugucagcacacauggaaagcccccauuugcacagauguagaacuuuaauaauccagaugca

SEQ ID NO: 431572 - RNA, 64 nt, Human
cuccuuuacuccaaacucagcccuccaguuucuucagauguaaacccuguuaacgucacuguuu

SEQ ID NO: 431573 - RNA, 64 nt, Human
aucauugguagcuuuuauaugcaaauggucauuucagauguaugguguuuuuacacuacaaaga

SEQ ID NO: 431574 - RNA, 64 nt, Human
auuucaugacacugguguauucacucauguguuccagauguauucuaauuguguaugaaaugua

SEQ ID NO: 431575 - RNA, 64 nt, Human
ccuuuugucugccucuuagacuucugcuuuccacaccuggcacugcugugcugugcccaaguug

SEQ ID NO: 431576 - RNA, 64 nt, Human
ggguuguggagggaaauuggcucagagauggacaaccuggcaacugugagucccugcuucccga

SEQ ID NO: 431577 - RNA, 64 nt, Human
gugaaggucgguggguuaacugugugccuacugaaccuggcaaauaaacaucacccugcaaagc

SEQ ID NO: 431578 - RNA, 64 nt, Human
accuaucugcagucccccagcacacaaggaagaccagauguagcuacaggaugaugaaacaugg

SEQ ID NO: 431579 - RNA, 64 nt, Human
gguggcccuucccggcugcggagagcccgccccacagauguauuuauuguacaaaccaugugag

SEQ ID NO: 431580 - RNA, 64 nt, Human
agagugagcuggucaaugcaacauugggaaacggcagauguaggugagaaguuaaguauuuaau

SEQ ID NO: 431581 - RNA, 64 nt, Human
gaaauuguacuuagauuuaagaaaaagagaaaaucagauguauuuauuugacuucauuccguau

SEQ ID NO: 431582 - RNA, 64 nt, Human
gaaaugccuaaaagacuuuauuguucuaauuauccagauguaccuuuguaaaauagcucuuuua

SEQ ID NO: 431583 - RNA, 64 nt, Human
gacagucuguacccagaggccacccagaagcccucagauguacauacacagaugccagucagcu

SEQ ID NO: 431584 - RNA, 64 nt, Human
augcccaugaacaaguuaguuucucauagcuuuacagauguagauauaaauauaaauauaugua

SEQ ID NO: 431585 - RNA, 64 nt, Human
aguuagaucuagguccuucuaucucgucccucuacagauguauuuuccacuugcauaauucaug

SEQ ID NO: 431586 - RNA, 64 nt, Human
gaauguauuuaucugaagaucaaaacaaacaauccagauguauaaguacuaggcagaagccaau

SEQ ID NO: 431587 - RNA, 64 nt, Human
gguacccaugaaugugagcuuaccagggucuuugcagauguaauuaguuaaguuaaggugagau

SEQ ID NO: 431588 - RNA, 64 nt, Human
aaauaaauaauuuucauuuugcacugaggauauucagauguaugugcccuucuucacacagaca

SEQ ID NO: 431589 - RNA, 64 nt, Human
acuuaugagugccuggaguaugccguccacugugcagauguaggacaggggcuaaucacuuaga

SEQ ID NO: 431590 - RNA, 64 nt, Human
guugaaauccauuaaauuagagaagucucacuaacagauguauuuaaauauagguacaacaaau

SEQ ID NO: 431591 - RNA, 64 nt, Human
aaacaauaguucacuccauuugguccuuucuccacagauguaauuauguuuucaacucaggaac

SEQ ID NO: 431592 - RNA, 64 nt, Human
cugcccuggccuccugcagacagauagugggguuaccuggcaaggccuggugagagccagugaa

SEQ ID NO: 431593 - RNA, 64 nt, Human
uaggagggagggaaggacaccguccuaggguauaaccuggcaauaaaccgugccucucacugug

SEQ ID NO: 431594 - RNA, 64 nt, Human
gcucuggcuaggaccccaguaagauuguggcaagaccuggcacuccuccaagcuuggcacagug

SEQ ID NO: 431595 - RNA, 64 nt, Human
cauauuugauguguaaugcagguuaauuacaacacagauguaccgaaacacuuaauugugaacc

SEQ ID NO: 431596 - RNA, 64 nt, Human
guaggucggggagaggguaagggaauagaucacucagauguauuuuagauaagcuauuuagccu

SEQ ID NO: 431597 - RNA, 64 nt, Human
gaaaucuuuuauuuuuuuacucugagaccagcaccagauguaaguaagcaucucauauauuuca

SEQ ID NO: 431598 - RNA, 64 nt, Human
ucaucuauccaccuggcuuucuccuuauuguuuacagauguaguucuuguuagaggaugccgcu

SEQ ID NO: 431599 - RNA, 64 nt, Human
cuuuauacgcagcucaguuucccgggagucgccacagauguacccacuagcccagguugcugug

SEQ ID NO: 431600 - RNA, 64 nt, Human
gucguggagagcuaggagcaaagccuguucauggcagauguaggagggacugucgcugcuucgu

SEQ ID NO: 431601 - RNA, 64 nt, Human
uuucuuuuuauauggauuccuuuaaaacuuauuccagauguaguuccuuccaauuaaauauuug

SEQ ID NO: 431602 - RNA, 64 nt, Human
cuaauuucaaagggcuagaguuaguacuacuuaccagauguaauuauguuuuggaaauguacau

SEQ ID NO: 431603 - RNA, 64 nt, Human
caagcaugcuuagcaauguucuaaucacuauggacagauguaaaagaaacuauacaucauuuuu

SEQ ID NO: 431604 - RNA, 64 nt, Human
aaguguguaaguaaaguguuaugguaggguucuucagauguaauauuuuacugguacuauuuau

SEQ ID NO: 431605 - RNA, 64 nt, Human
cacacaucguugccgcagcggugggaaggaaaggcagauguaaaugauguguugguuuacaggg

SEQ ID NO: 431606 - RNA, 64 nt, Human
auuugaacaaaagacuuacuuacaaaguugcuggcagauguauuugaugguuacucuuuuguaa

SEQ ID NO: 431607 - RNA, 64 nt, Human
gugcaggggcauagaauaaaauauuaaauauuggcagauguaugaaaagaagugugaguuaaaa

SEQ ID NO: 431608 - RNA, 64 nt, Human
uauguauuuuuauauaauaucuaaaguuauauuucagauguaauguuuucuuugcaaaguauug

SEQ ID NO: 431609 - RNA, 64 nt, Human
aguuacauuuuuuuucuaaauauaauaaaaacuuaccuggcaucagccucauaccuaaaacucc

SEQ ID NO: 431610 - RNA, 64 nt, Human
uauggaccuggccccauggcuuugcauguuagagaccuggcagacuaaagucucuaguguuugu

SEQ ID NO: 431611 - RNA, 64 nt, Human
aguuucucuaauguugauuguuagccgauuuguaaccuggcauuuacuuagcaacugccuuauc

SEQ ID NO: 431612 - RNA, 64 nt, Human
aucuaauuaaccucaguuguauaugaauaacccacagauguacugaauuacuuuuggugcuauc

SEQ ID NO: 431613 - RNA, 64 nt, Human
ggucaucuuucacaaggcucaagacuucaaccugcagauguaucuuuuucccuccaguuuuucc

SEQ ID NO: 431614 - RNA, 64 nt, Human
auuuguuuggaaucgugccacugcuggucugcgccagauguaccguccuuuccaauacgauuuu

SEQ ID NO: 431615 - RNA, 64 nt, Human
uaacuuguuaccauuguaauauuaacuaaauaaacagauguauuaugcuguugcaaguuguuuu

SEQ ID NO: 431616 - RNA, 64 nt, Human
cuggauuaguucuuuuacuucaguguuuaauaagcagauguauguaugcaugguuauacuauuu

SEQ ID NO: 431617 - RNA, 64 nt, Human
uguaaucuuggacaagacuuuaaaucauauuuuacagauguagaagaaauuuauucaaaagugu

SEQ ID NO: 431618 - RNA, 64 nt, Human
uauucuauaguuuuuuuauguagucuacauuucucagauguauccccauucgguuuuauucuca

SEQ ID NO: 431619 - RNA, 64 nt, Human
cauacugucaaguuguaaagauugagagggcaaacagauguaaacaucacuuguaggugauuaa

SEQ ID NO: 431620 - RNA, 64 nt, Human
ugagacaucuagggaguccauacacaucagugagcagauguaguuugcuuauuuauagcauguu

SEQ ID NO: 431621 - RNA, 64 nt, Human
gacacacacauugauccuccuccucagcuccuugcagauguagcccuugcccaucuucacagac

SEQ ID NO: 431622 - RNA, 64 nt, Human
auguuuaauaaaaaauagagucugccucguacuacagauguaacucauuuguauauugcagaca

SEQ ID NO: 431623 - RNA, 64 nt, Human
agcuguguaaaccaguuucucauugcauaagauacagauguaaauugcauggagagguugauau

SEQ ID NO: 431624 - RNA, 64 nt, Human
ccucccuuucucuaagaggccaucucuaagaugucagauguagaggagagagagcgagagaaca

SEQ ID NO: 431625 - RNA, 64 nt, Human
auagccuugagugaccaacuuuuuuuuuaaagcacagauguaauugucuaauguucugauggga

SEQ ID NO: 431626 - RNA, 64 nt, Human
aucaucucuuccaucuuuggguccuuagugcaauaccuggcagcuagccagugcucagcuaaau

SEQ ID NO: 431627 - RNA, 64 nt, Human
cugcccaagaggcugaggcaugagaaucgcuugaaccuggcaggcggagguugcagugagccga

SEQ ID NO: 431628 - RNA, 64 nt, Human
uguuggcgaucugagugcaguguggcaagugcacaccuggcaucccugcgucagaucgcgcacc

SEQ ID NO: 431629 - RNA, 64 nt, Human
gaaauugguggcuucauucuagauguagcuugugcagauguagcaggaaaauaggaaaaccuac

SEQ ID NO: 431630 - RNA, 64 nt, Human
ucaugccaagaacaagccagcaaagcucuuucaccagauguagacuguagcccugcugccuucc

SEQ ID NO: 431631 - RNA, 64 nt, Human
uucccugaggagcugggacaugcugggcaguugucagauguaaaggcacagcuggagcagaggg

SEQ ID NO: 431632 - RNA, 64 nt, Human
cacgccuugaggucagaggccuggcccuucuuuacagauguagauagcaggguaggacgcccag

SEQ ID NO: 431633 - RNA, 64 nt, Human
aaguaaucaagaccugcuccuaagcauaugagaccagauguaauuaaucaauggcaaugcagaa

SEQ ID NO: 431634 - RNA, 64 nt, Human
gugcuuucugugccuaguaauuuuugucagaugccagauguaacauuuaccuuguugggugcug

SEQ ID NO: 431635 - RNA, 64 nt, Human
gaccagaaugaaaaugccaggagcugguacacuacagauguaguaagaaccugggauauuccug

SEQ ID NO: 431636 - RNA, 64 nt, Human
guccggcaggaucuuccgccagcgccuccaccuucagauguaccuccagccuuucacuccucgg

SEQ ID NO: 431637 - RNA, 64 nt, Human
auaguacuguggcuucagauuuaguaccuaugaacagauguacaagacauuuauuacacuuuuu

SEQ ID NO: 431638 - RNA, 59 nt, Human
cagucacaaacggguccugagcagugaggcagauguauaauaauaggcccucuuggaac

SEQ ID NO: 431639 - RNA, 64 nt, Human
gcugcugcgccugaugcugggacagccccgcucccagauguaaagaacgcgacuuccacaaacc

SEQ ID NO: 431640 - RNA, 64 nt, Human
gcugcugugccugaugugggaacagcucuucucccagauguaaauagaacaaccugcacaaccu

SEQ ID NO: 431641 - RNA, 64 nt, Human
gcugcugcgacugaugccaggacaaccuuucucccagauguaaacagagagacauguacaaacc

SEQ ID NO: 431642 - RNA, 64 nt, Human
gcugcugugccugaugccaggacagcugugcucucagauguaaauagagcaaccuauauaaacc

SEQ ID NO: 431643 - RNA, 64 nt, Human
cguguccugcuguacccaacugacuugcuuagguaccuggcagcugugaccacagcucaaguaa

SEQ ID NO: 431644 - RNA, 64 nt, Human
ccuccaccuugcuaucugcaccaggaggcucuccaccuggcagccagagguccccagugggccg

SEQ ID NO: 431645 - RNA, 64 nt, Human
cccuggccuggacagccuccuucagcccuucuguaccuggcagcccugggccccaggcccuggg

SEQ ID NO: 431646 - RNA, 64 nt, Human
cugcaaaucuuggaauuuuguuuuuugcuguuuccagauguaucuauaaauaucuauacauuau

SEQ ID NO: 431647 - RNA, 64 nt, Human
ucuauacauaauggcugaagccaaacuugucuugcagauguagaaauuguugcuuuguuucucu

SEQ ID NO: 431648 - RNA, 64 nt, Human
uaauguggcauacacaguggguuugguuguaaggcagauguaauagaugacuucaaaagccugc

SEQ ID NO: 431649 - RNA, 64 nt, Human
auaagcacagauugaauuguacaguuugcagaugcagauguaaaugcaugggacaugcaugaua

SEQ ID NO: 431650 - RNA, 64 nt, Human
aacauuacauccaaucaaagugucauuugcaacccagauguaaaacucuaaugauuuggccaug

SEQ ID NO: 431651 - RNA, 64 nt, Human
uugacuauaggcuuaauguaaaaaggaaucuugccagauguagcuacuuaaggaaaaaaggguu

SEQ ID NO: 431652 - RNA, 64 nt, Human
uuaccaaaaacagagagaacgagccugaauacagcagauguaggggacagccgugggaccgcgu

SEQ ID NO: 431653 - RNA, 64 nt, Human
ugcuguaguuugguugggauuauuguuggcauuacagauguaaaagauugacuagcccauaggc

SEQ ID NO: 431654 - RNA, 64 nt, Human
acacuuaagcccucgugcacacacacaaauuauucagauguacacccacccacauaucuuacag

SEQ ID NO: 431655 - RNA, 64 nt, Human
cccuaccuuccacgcgcugcgcagccucgaccagcagauguaccucuguuacucucagccugga

SEQ ID NO: 431656 - RNA, 64 nt, Human
uuggcagccgcgcaggagcauguaggcaggcucucagauguagguggcaaguggcacagcucca

SEQ ID NO: 431657 - RNA, 64 nt, Human
guccaagaacgaaccugccaucacaucucacugccagauguauaaagcaccugcaugcucagac

SEQ ID NO: 431658 - RNA, 64 nt, Human
acacaaacccagauggggcugugccgcuguuuuccagauguauucauucaacaaauauuuguag

SEQ ID NO: 431659 - RNA, 64 nt, Human
agggaggucaacgugaguuuggaucucuuguacgcagauguaaucauucacauguaaaaauaac

SEQ ID NO: 431660 - RNA, 64 nt, Human
ccugaagacauuccuggaggacacucccaucagaaccuggcagccccaaaacuggggucagccu

SEQ ID NO: 431661 - RNA, 64 nt, Human
ucugacauggggaccauaacaggugaucacugauaccuggcaaagacuggggcccucuccuuuc

SEQ ID NO: 431662 - RNA, 64 nt, Human
uccgguuuugcuguuauucaaaagugggaaauguaccuggcacguuugaaaauaaaaaaucuga

SEQ ID NO: 431663 - RNA, 64 nt, Human
ugacuguuaccuucuguggcagaaagggacagugcagauguauguaaguuaaggacuuugagau

SEQ ID NO: 431664 - RNA, 64 nt, Human
uacugagucugcagcgggggagugaacaagugugcagauguaaguucuuacaugauaagcagau

SEQ ID NO: 431665 - RNA, 64 nt, Human
uuucaaugucaaagcgccaauuuauaaaacgcugcagauguagagguuaugugcaacugaucug

SEQ ID NO: 431666 - RNA, 64 nt, Human
uuccuuuuuaauaacuuauuuuauacauauugugcagauguaaaucuuguaauuaauggucaaa

SEQ ID NO: 431667 - RNA, 64 nt, Human
ucuuauauacaaugaaaaaaauaacuuucuucugcagauguaagcacuggcuuuuauaagagca

SEQ ID NO: 431668 - RNA, 64 nt, Human
gagauauaacaauaagugauuaacuguucacuuucagauguaauggcaaacaauuguuaaaagu

SEQ ID NO: 431669 - RNA, 64 nt, Human
uucacagacugagucuccacaacaccaaaauauccagauguaaaccccaaacuuguacacaaaa

SEQ ID NO: 431670 - RNA, 64 nt, Human
ugacuuuguauagagaauuuaaguagaaaaguugcagauguauugacuguaccacagacacaau

SEQ ID NO: 431671 - RNA, 64 nt, Human
guaaaaaccccaugacuuucucuucgugcauaaacagauguauuuuugauuucagggaauucuu

SEQ ID NO: 431672 - RNA, 64 nt, Human
agauggcauaggccuuagcaguaacggguagcagcagauguaguuucagacuuggaguaaaacu

SEQ ID NO: 431673 - RNA, 64 nt, Human
aaagccacgucccaagccaccuggcccgauuccacagauguaugugcggccagugacuucccca

SEQ ID NO: 431674 - RNA, 64 nt, Human
uugauaggauacauacugaaaucagcaaacaaaacagauguauagauuagaguguggagaaaac

SEQ ID NO: 431675 - RNA, 64 nt, Human
agaguucaaacagauacagcaugguccagagucccagauguacaaaaacagggauucaucacaa

SEQ ID NO: 431676 - RNA, 64 nt, Human
gaggggugcagagagauaaucaccgcaccguuuccagauguaauacugcaaagaaaaccgauga

SEQ ID NO: 431677 - RNA, 64 nt, Human
uaugguuguuggaggguuccuagugaguugggggaccuggcaauagagcugcuugguuggagga

SEQ ID NO: 431678 - RNA, 64 nt, Human
aaugaaauuuauaggaagaagguuuuugcucaguaccuggcaugcaacagacauuggauaaaug

SEQ ID NO: 431679 - RNA, 64 nt, Human
gcucccagcagccgcugaccauagccagcaaaagaccuggcagguccugaaucaaaacaacaga

SEQ ID NO: 431680 - RNA, 64 nt, Human
gaggggugcagagagaucaucacggcacgguuuccagauguaauacugcaaggaaaaaugauga

SEQ ID NO: 431681 - RNA, 64 nt, Human
cuagggggcugcuggugggaaaugggagccagggcagauguaugcauuccuuugugucccugua

SEQ ID NO: 431682 - RNA, 64 nt, Human
gaagaagcagcugaaggagcagcaggagaugcagcagauguacgacaugaucaugcagcacaag

SEQ ID NO: 431683 - RNA, 64 nt, Human
auucacagguagucauuuugggaaagccucuugccagauguaggcccuuaagauaucugcaaag

SEQ ID NO: 431684 - RNA, 64 nt, Human
cacauaagaaaaugcaugcugaagagaaaccacacagauguaagguuuaugacaagauuuuuga

SEQ ID NO: 431685 - RNA, 64 nt, Human
guccuuagaaaaaugggaaauuuggucacagaggcagauguacagagggaagacgaugugaaga

SEQ ID NO: 431686 - RNA, 64 nt, Human
auucuuuuggauugcuacguaaucucacuuaauacagauguaucaugauugauugaaucauugc

SEQ ID NO: 431687 - RNA, 64 nt, Human
uuuauauguaugaauauuucauaguuuugcauaucagauguaggcauacagacaaauacauaaa

SEQ ID NO: 431688 - RNA, 64 nt, Human
cucacucuccccugaaguuuagggucccaucucccagauguaaguuguuuugcaaacucaguuu

SEQ ID NO: 431689 - RNA, 64 nt, Human
gaagucuguuaaaucaugacugaaaaaaaucaaucagauguaucuucaaaaaguggagucccag

SEQ ID NO: 431690 - RNA, 64 nt, Human
auugagacugcuugauucaagucuggugcuuugccagauguauuaauuuccauaaaugcuuugu

SEQ ID NO: 431691 - RNA, 64 nt, Human
acuggucucagaggagggauagagacgcagauuucagauguaagaagcccgauccacauugcau

SEQ ID NO: 431692 - RNA, 64 nt, Human
agccacuaucaaaugcugugaagagaaauguacccagauguaucauuauccuugugcugcagga

SEQ ID NO: 431693 - RNA, 64 nt, Human
uuuucagguagcuagccaaauuaaugcauaauuucagauguagaaguaggguuugcgugugugu

SEQ ID NO: 431694 - RNA, 64 nt, Human
cagacuaaagagaauggagaacuauuguggugcaaccuggcaaaucccucagaggacagagcua

SEQ ID NO: 431695 - RNA, 64 nt, Human
cuauguguaugcaaguacaaguauauaauaugucaccuggcacauucauuuucucaguugaaga

SEQ ID NO: 431696 - RNA, 64 nt, Human
caaagugcugggauuacuagacguaagccaccacaccuggcaauucccugcuuuuuugacaaca

SEQ ID NO: 431697 - RNA, 64 nt, Human
gaaaugaagccuuuugauaugcauucgcuauucccagauguacgccaugccuuuuccauguccc

SEQ ID NO: 431698 - RNA, 64 nt, Human
uagagaaauuuugauaagaauggagacgcuacgacagauguaggaagucaucuaccuuugauau

SEQ ID NO: 431699 - RNA, 64 nt, Human
agccccuugagcagcccauggcuuagcagacccccagauguaggucaguggccuuaccugucuc

SEQ ID NO: 431700 - RNA, 64 nt, Human
guguacaccaugcccauguauauacaaguacacacagauguacacacagauguacacaugcucc

SEQ ID NO: 431701 - RNA, 64 nt, Human
cccauguauauacaaguacacacagauguacacacagauguacacaugcuccagccccagcucu

SEQ ID NO: 431702 - RNA, 64 nt, Human
agcugauuuguauauuuauuaugacaauuucuggcagauguagguaaagaggaaaaggauccuu

SEQ ID NO: 431703 - RNA, 64 nt, Human
gagcccuuccccuguguccugccaccaugugggucagauguacucucugucacaugaggagagu

SEQ ID NO: 431704 - RNA, 64 nt, Human
aagucacauugaugaaauguugaaauguacuaaucagauguauucuguuuauauuauacauaua

SEQ ID NO: 431705 - RNA, 64 nt, Human
uaugucuuaaauuuauuuaaaacuuuuuuuaauccagauguagacuauauucuaaaaaauaaaa

SEQ ID NO: 431706 - RNA, 64 nt, Human
cuuucuuauuuaagaaaccuagaucaaguuuuuacagauguaaauaaaaguugaauaguuuacc

SEQ ID NO: 431707 - RNA, 64 nt, Human
caagauaacaugcugacuaguaaccaugaagauucagauguaccucagcaaugcgccagagcaa

SEQ ID NO: 431708 - RNA, 57 nt, Human
caagauacgcugaagugugaggaaaugcagauguacgugacaaugagacugaccuuu

SEQ ID NO: 431709 - RNA, 64 nt, Human
gcuucucugaggaagcugggguucaugacaauggcagauguaaaguuauucuugaagucagauu

SEQ ID NO: 431710 - RNA, 64 nt, Human
aauaacugggucaccaguguuucuugagccauuucagauguauguaaaacacaaaauaugccaa

SEQ ID NO: 431711 - RNA, 64 nt, Human
uccuugagucacuuuaauaucccuggugcauaggaccuggcaugcgucaggcugcucgggaaau

SEQ ID NO: 431712 - RNA, 64 nt, Human
guaaugagcuuaagaaauuuguggaaaauaacucaccuggcaucuuacaucugaaauaaggaau

SEQ ID NO: 431713 - RNA, 64 nt, Human
gggaaccaauuccuuuccccuuuaggcacccucuaccuggcagcucuuaaaacuaagaaaaaau

SEQ ID NO: 431714 - RNA, 64 nt, Human
auugcuagagcaucauccuuagaaaucagugccccagauguacauguguugagcguauucuuga

SEQ ID NO: 431715 - RNA, 64 nt, Human
uacuugggacauggaaacucguuggauggcugggcagauguaagccuguccaugcagucagccg

SEQ ID NO: 431716 - RNA, 64 nt, Human
auauagaucucuaucucuuagcaaaggugaaugccagauguaaauggcgccucugggcaaagga

SEQ ID NO: 431717 - RNA, 64 nt, Human
uuugaaacagcugcagcaagaguuggcacuuauucagauguaucuucaaccucuguuauucugg

SEQ ID NO: 431718 - RNA, 64 nt, Human
uuuacaugacaauuuguaaucauaagagaugguucagauguauaacagaaugggaaagccagca

SEQ ID NO: 431719 - RNA, 64 nt, Human
ugagauauaaauuagaauggcaugugcugcaaggcagauguaugggagccaaucauuuggcuag

SEQ ID NO: 431720 - RNA, 64 nt, Human
ccagggagagauccagagaguuuucaaguuuuugcagauguaggugguuccagcuuuucuuucu

SEQ ID NO: 431721 - RNA, 64 nt, Human
ucccauuuacucuugagacuacuucaauuaguuccccuacuacacuuugcuagugaaacugccc

SEQ ID NO: 431722 - RNA, 64 nt, Human
cacagcuuccucucuuguccccacuacagguuuucccuacuaaacaaagguguuggagagcagc

SEQ ID NO: 431723 - RNA, 64 nt, Human
uugcacaguguaauccuacaccuuuugcuaacaccccuacuaggucccagagggccagaaacac

SEQ ID NO: 431724 - RNA, 64 nt, Human
gaggggaaaccuagcaaacuaagagugauaagggcccuacuacacuggcuuuuuuaggcuuaga

SEQ ID NO: 431725 - RNA, 64 nt, Human
ggaguucaagaucagccugaccaacauggagaaacccuacuaaaaauacaaaguuagccaggca

SEQ ID NO: 431726 - RNA, 64 nt, Human
guuuugaaagaauacauuaaaauaaaaaacuugccccuacuagguaagaacuuuauaaugaaga

SEQ ID NO: 431727 - RNA, 64 nt, Human
auacaggagagauguauuauuuccccccuucagccccuacuaaacucuuaagccuccccuucca

SEQ ID NO: 431728 - RNA, 64 nt, Human
uaaacagggagacgugugauauacucccucccuucccuacuauugccucucugaccuuuuuaaa

SEQ ID NO: 431729 - RNA, 64 nt, Human
aacacuggaaaugacuguuccagagagcgggcagaccuggcagagcgccccuggcgccugagac

SEQ ID NO: 431730 - RNA, 64 nt, Human
gcaauucagucccucuccccaaagacuagacgugaccuggcagauuagcaggauccucuuggcc

SEQ ID NO: 431731 - RNA, 64 nt, Human
ggaggguaggauucugcagccuguguugcucucuaccuggcagcagacugugcaggagccccaa

SEQ ID NO: 431732 - RNA, 64 nt, Human
agcauugccuuggcauaacaagggcccaucgauucccuacuaaugagaggcagggagagcaugg

SEQ ID NO: 431733 - RNA, 64 nt, Human
gugacuuuuuaaaaaagcugucaaauaggugugacccuacuaauaauuauuagaaauacauuua

SEQ ID NO: 431734 - RNA, 64 nt, Human
uuucuaauucguuucuagaaauguuugcuuauuucccuacuaaaauuuguaucugaucaaagca

SEQ ID NO: 431735 - RNA, 64 nt, Human
ggggccacccauaccuggaaauaggccauagggccccuacuacugccaacaagccauggccuac

SEQ ID NO: 431736 - RNA, 64 nt, Human
aggugagaucuuuacgccuuuuauaacaugccaucccuacuaauaggauauugacuuggauagc

SEQ ID NO: 431737 - RNA, 64 nt, Human
aaaccucauugcuuuauaaaccccuuagaacucucccuacuagcuggaaacucuggugacguga

SEQ ID NO: 431738 - RNA, 64 nt, Human
agucguacuaugguuuugccuugucacugugaggcccuacuagguguaagcauucucucugaau

SEQ ID NO: 431739 - RNA, 64 nt, Human
auuacugaaaccaaaauauauuugcuucaucugccccuacuaaccaucccccugccugcugccu

SEQ ID NO: 431740 - RNA, 64 nt, Human
ccugcccugcgugcugguuccuucagaccccuaacccuacuaaccagcaggcucaucucaccuc

SEQ ID NO: 431741 - RNA, 64 nt, Human
cugauauuuuguauuuauguguuugucugucucccccuacuagaauguaagcuccauggggcag

SEQ ID NO: 431742 - RNA, 64 nt, Human
uucucacucaggcuauugccaucugggauucucucccuacuacagcuggcaaaguugguuugca

SEQ ID NO: 431743 - RNA, 64 nt, Human
aggcauccauuuugccuuuuaaacaacuaggauucccuacuaaccuccaccagcaaccuggacu

SEQ ID NO: 431744 - RNA, 64 nt, Human
cagaauuaaagucaauguuuccugacucccaggccccuacuauuccaggccaucacacuggccu

SEQ ID NO: 431745 - RNA, 64 nt, Human
acauuacacugcauaaagauauccagcuuggguacccuacuaaaacaacaucaccaucuuuuuc

SEQ ID NO: 431746 - RNA, 64 nt, Human
gcccgcuagcugugagguucauugcuacccucggcccuacuagcccucucuucccccuugugca

SEQ ID NO: 431747 - RNA, 64 nt, Human
gcuuuccaucuguuacuguccuucauucuuggcucccuacuaucuauaaacagcugcugugaag

SEQ ID NO: 431748 - RNA, 64 nt, Human
guuugcucauuuaagaauuugaaacguuaugaugaccuggcaacaaaaaguaaugaagaaaauu

SEQ ID NO: 431749 - RNA, 64 nt, Human
uucaacgcagauuuuaauguuuacuuaaauauaaaccuggcacuuuacaaacaaauaaacauug

SEQ ID NO: 431750 - RNA, 64 nt, Human
auguuugucacaugugaugaagacaaauauguauaccuggcauagagaaaaauauauaccuggu

SEQ ID NO: 431751 - RNA, 64 nt, Human
cuacucgggaggcugaggcaggagaaucucuugaaccuggcaaguguagguugcagugagcuga

SEQ ID NO: 431752 - RNA, 64 nt, Human
ccucugcuccccaggggaguugugucuguaaucgcccuacuauucaguggcgagaaauaaaguu

SEQ ID NO: 431753 - RNA, 64 nt, Human
acaacucugcaugagauguagacuuaagcuuuaucccuacuaggcuugcuccacuuucauccuc

SEQ ID NO: 431754 - RNA, 64 nt, Human
ugucugcagggcaucaaggggcaggugugucucacccuacuaagaauuggcagaaauguuuuaa

SEQ ID NO: 431755 - RNA, 64 nt, Human
agacgcuucccuucccuuccccuagggaaugugucccuacuauaguaaacucuuccuuaagaga

SEQ ID NO: 431756 - RNA, 64 nt, Human
caguaauuuuauuuuuguuuuucccuaaauguuucccuacuagucuuuuuggaaaacauguuug

SEQ ID NO: 431757 - RNA, 64 nt, Human
aaauuccuuguuaagacacaaggaaaaagaauggcccuacuauuaucaugcaaaaaugcuuugu

SEQ ID NO: 431758 - RNA, 64 nt, Human
ugucaugcccacaaucccuuucuaaggaagacugcccuacuauagcaguuuuuauauuugucaa

SEQ ID NO: 431759 - RNA, 64 nt, Human
ugcacugccaccuggcuauagcuacacuggucuucccuacuacacaggcaugcccagugccuuc

SEQ ID NO: 431760 - RNA, 64 nt, Human
auuuuauuuucucacuauguaugcagacuggacccccuacuacuauuugucaccucacccacag

SEQ ID NO: 431761 - RNA, 64 nt, Human
ucccagccuuuuuaaggagacacacucauucauccccuacuaugugcuggcagcuuuaccuuug

SEQ ID NO: 431762 - RNA, 64 nt, Human
cccaacuuuccaaagacccugagacaagucaggacccuacuacucuccccugcugcuuuccuga

SEQ ID NO: 431763 - RNA, 64 nt, Human
gugcuuucccaguggggagcagucuggcccugcccccuacuaaagccucugcucucagcacuuu

SEQ ID NO: 431764 - RNA, 64 nt, Human
aaaaauucuuguugaaauauuuugaaaacaaauucccuacuaucaucacaugccuccccaaccc

SEQ ID NO: 431765 - RNA, 64 nt, Human
uugcagaaaugucaauauauuuuaugacaugguucccuacuagggauuauacaguauuugcuga

SEQ ID NO: 431766 - RNA, 64 nt, Human
ggcccuccucagacaauuuaucucccagcaaugacccuacuacacucgcguacugugaauuugg

SEQ ID NO: 431767 - RNA, 64 nt, Human
gcgucugucgaacaaacagaggucuggugguuuucccuacuauccucccacucgagaguucacu

SEQ ID NO: 431768 - RNA, 64 nt, Human
gacucagaugaagucagggauagaagacccuuggaccuggcagguuaaugcugauuauuccuug

SEQ ID NO: 431769 - RNA, 64 nt, Human
uguggcuguaucagcucccuacaaguucguuuacaccuggcagcacggcagccacacaccggua

SEQ ID NO: 431770 - RNA, 64 nt, Human
ggcaaguuugcugggaagucaaauaauacauuccaccuggcagcugaaggcagccagucagucu

SEQ ID NO: 431771 - RNA, 64 nt, Human
accccucccccagacucgugccuugccucucaggaccuggcacaguggcuggccuuauggagua

SEQ ID NO: 431772 - RNA, 64 nt, Human
ugauuccaauucuuuguaauugucuucagagcagcccuacuagcacauaccgcgugguguuugu

SEQ ID NO: 431773 - RNA, 64 nt, Human
cuacuugcaguacaucaaaggaauggaugguggacccuacuauucauguuuugagacauaaaug

SEQ ID NO: 431774 - RNA, 64 nt, Human
caauguaauugucuaacacuccuuucuauucucucccuacuacucacuaucaauucauccccau

SEQ ID NO: 431775 - RNA, 64 nt, Human
aaacaggggacccccucaccuccugggcagugaccccuacuaggcucccauuccagguacuagc

SEQ ID NO: 431776 - RNA, 64 nt, Human
agaguggauaaugcuuagaauucuuuauugguggcccuacuauggugaugaucuagaacugacu

SEQ ID NO: 431777 - RNA, 64 nt, Human
uagcauagcuuaagagcaaccucagagauuugagcccuacuaagugacugaccacuguuuagag

SEQ ID NO: 431778 - RNA, 64 nt, Human
guuugacuuucugcgcuucgaccacuaccucaaccccuacuauaaguucauccagaaagccaug

SEQ ID NO: 431779 - RNA, 64 nt, Human
cuuuccgaaggccaugaucuagagauagaaaaaucccuacuaagucccaacaggagaaagacag

SEQ ID NO: 431780 - RNA, 64 nt, Human
aggcagaggauguucuggaccucccccucuuggucccuacuagagaccucucaacagaucugug

SEQ ID NO: 431781 - RNA, 64 nt, Human
uaaaguaaugaaugacguuuuaaggaaucccuaacccuacuaucagaaaagguguuuguuaaag

SEQ ID NO: 431782 - RNA, 64 nt, Human
ccccugcccugcugcccccaacagcgucuggcuccccuacuaacgucccccucuucgcccuugc

SEQ ID NO: 431783 - RNA, 64 nt, Human
cuaaaggcuuuagaaauuacaacauaucagguuccccuacuacugaaguagccuuccgugagaa

SEQ ID NO: 431784 - RNA, 64 nt, Human
guugagucuuaaugagggauacaggaggaaaaaucccuacuagaguccugugggcugaaauauc

SEQ ID NO: 431785 - RNA, 64 nt, Human
agaacuuucuuagccuuccuggagauggcuacaucccuacuaauauaauuuuaaaaugagaacu

SEQ ID NO: 431786 - RNA, 64 nt, Human
ccaacccagccuggucaacauggugaaacccugucccuacuaaagauacaaacaauuagccggg

SEQ ID NO: 431787 - RNA, 64 nt, Human
aaaaaaccauuucaguguacauuguguacuaauucccuacuagccaguuugggacauuggcuga

SEQ ID NO: 431788 - RNA, 64 nt, Human
aagcaaacugcuccggguaccaggacuuccuccaaccuggcaagggugugcgcugaggcggggc

SEQ ID NO: 431789 - RNA, 64 nt, Human
gagcccugaggagaugcuuuuccacuuuggaaugaccuggcagaucaacgggacaggccuccuu

SEQ ID NO: 431790 - RNA, 64 nt, Human
ucagccuccugaguagcugggaugacaggcgugcaccuggcagcuuuuucaaaguguugauggu

SEQ ID NO: 431791 - RNA, 64 nt, Human
ucucaggaaccuuacccaugcuccagcguccuucaccuggcacaggacaugcaagauaaauagg

SEQ ID NO: 431792 - RNA, 64 nt, Human
ugagaccagcuuggccaacauggugaaaccuugucccuacuaaaaauacaaaaauuagcaggga

SEQ ID NO: 431793 - RNA, 64 nt, Human
ccguguugcaguucaggacuccuugcuucuuggacccuacuauuuauccuggacuagcuugggu

SEQ ID NO: 431794 - RNA, 64 nt, Human
gagacccugucucaaccaccaccaccaccaccaccccuacuaccccuguauucaagguaaaaau

SEQ ID NO: 431795 - RNA, 64 nt, Human
agguaugcacccauguggcagccaggcagcggagcccuacuagacugccagucucaugcaccca

SEQ ID NO: 431796 - RNA, 64 nt, Human
uggagagggagcuggggcgcauggggaagcaggucccuacuaucaaccgggaguuugggguccu

SEQ ID NO: 431797 - RNA, 64 nt, Human
gugccugcagccuucauaagcacacacguccauucccuacuaaggcccagaccuccugguaucu

SEQ ID NO: 431798 - RNA, 64 nt, Human
cucuuauuccaggagaagggggcucugccccaggcccuacuacccauuguucccuuccucuucc

SEQ ID NO: 431799 - RNA, 64 nt, Human
aaguuuauugagaacuuguuucauaaauggauaucccuacuaugacugugaaaacaugucaagu

SEQ ID NO: 431800 - RNA, 64 nt, Human
gcgcgcuucccgucucuccucuccccauucugugcccuacuauuuucaacaaaacaaaacaaac

SEQ ID NO: 431801 - RNA, 64 nt, Human
cuacgugcuggcccgagggggacugcaaguggagcccuacuacccccgaagucugcaggacugg

SEQ ID NO: 431802 - RNA, 64 nt, Human
auccuaaaggggaucccugcccccaugggaggcccccuacuagaaggacgugaaagcagcuuuu

SEQ ID NO: 431803 - RNA, 64 nt, Human
acaccaugauguaggcauaaauggaaaacaaaaacccuacuauuucaaauauauuguacuuuuu

SEQ ID NO: 431804 - RNA, 64 nt, Human
uucagccacaaaacugucauucacucuaggggaccccuacuaaaggguaacuucaggugugcag

SEQ ID NO: 431805 - RNA, 64 nt, Human
ggaggggaagggaugguagagauagacagcucuccccuacuagguugggucauuuccccuaaua

SEQ ID NO: 431806 - RNA, 64 nt, Human
uacucccaccccaagggaaaauuuuagacaugaacccuacuauuuaguuauucuaaaauagaaa

SEQ ID NO: 431807 - RNA, 64 nt, Human
aguagcuccccuccauccuuguagacgcuccagucccuacuacugugacggcauuuccaucccu

SEQ ID NO: 431808 - RNA, 64 nt, Human
uaaaaugaguaaguugacgauguuuuaagauugcaccuggcagugugccuuuuugcacaaauau

SEQ ID NO: 431809 - RNA, 64 nt, Human
agcuggugacauguuccuggaagcucugggcuacaccuggcaugacacuugcuuuguaugcuca

SEQ ID NO: 431810 - RNA, 64 nt, Human
cguuccuauugucauuaaagguaucacggucgccaccuggcauuccuucugaccacagcaucau

SEQ ID NO: 431811 - RNA, 64 nt, Human
caauuugaaauggacaucuaauccagugcagaugaccuggcauguggaguuacagagggauccc

SEQ ID NO: 431812 - RNA, 64 nt, Human
ucccgaugggcacaaauggaaggugcgcacuugccccuacuauugcccuuuuaagggccaaagc

SEQ ID NO: 431813 - RNA, 64 nt, Human
gugucuauucccuggaauucacccucucauguuucccuacuaacaucccaauaaaguccucuuc

SEQ ID NO: 431814 - RNA, 64 nt, Human
guggcaccacccuccuugcuggggguagaugagacccuacuacugaacuccaguuuugaucucg

SEQ ID NO: 431815 - RNA, 64 nt, Human
ucguacccucaucuguaacaugcgugucgauagacccuacuacucaggguugaugagaagauua

SEQ ID NO: 431816 - RNA, 64 nt, Human
auuacacagccauaaaaaggaaugaagcagugaucccuacuacacuguggaugaaccuugaaug

SEQ ID NO: 431817 - RNA, 64 nt, Human
uccuuccuuauaagugaacucaugcagaagaaaacccuacuagugccgugacuauggaaaugcc

SEQ ID NO: 431818 - RNA, 55 nt, Human
aagugguucuguauggcuaggaccacccuacuacacgcucagcugccaacagugg

SEQ ID NO: 431819 - RNA, 64 nt, Human
cgagaccagccugaccaacauggagaaaccccgucccuacuaaaaauacaaaauuagccaggua

SEQ ID NO: 431820 - RNA, 64 nt, Human
gaacgagagcaagaaaaagaugauguagauguugcccuacuaccuaccauuguggaaaagguga

SEQ ID NO: 431821 - RNA, 64 nt, Human
ccucaaggauguacugcgcacugaccgggcccaccccuacuaugcggggccugaggauggccca

SEQ ID NO: 431822 - RNA, 64 nt, Human
uccucacaacacccucuucacccuccacgccacccccuacuacucacucucacccuagcaagga

SEQ ID NO: 431823 - RNA, 64 nt, Human
ucaauaaugcuaaaauuagcuacaauucugcugacccuacuauuaaagaaucuggaugcuggac

SEQ ID NO: 431824 - RNA, 64 nt, Human
aucccuccugucccacuccucucuaccaaccccacccuacuagcuaggucuucaguguuuuaca

SEQ ID NO: 431825 - RNA, 64 nt, Human
ccuucaaaacaaucugcauuaagaagauauugugcccuacuagacagcuuucauucacuuuauu

SEQ ID NO: 431826 - RNA, 64 nt, Human
augggcagaccccucagugagcugcagguaucucaccuggcagccguccaguacugcuggcuuc

SEQ ID NO: 431827 - RNA, 64 nt, Human
caccgcagcagcaaggaaagcucacgaaccccaaaccuggcaagucaccugcagcccaugguga

SEQ ID NO: 431828 - RNA, 64 nt, Human
ugaucaagaugagcacggaggcucgugucccagcaccuggcacacaguaagugccugguaaaua

SEQ ID NO: 431829 - RNA, 64 nt, Human
auccuacccagcguggcccaggccgggaagagccaccuggcagggcucacacuccugggcucug

SEQ ID NO: 431830 - RNA, 64 nt, Human
ccuuccuuuaaucaaaggcugaaaucucugccugaccuggcagccuggcucccucugggucaua

SEQ ID NO: 431831 - RNA, 64 nt, Human
gggacaguggucuaauucaacucugugucccagcaccuggcacaccagaagugccaugcucaga

SEQ ID NO: 431832 - RNA, 64 nt, Human
ggaccagggccuucuggaggaguggcacuaccccaccuggcagcaccuagaccugagcucuaca

SEQ ID NO: 431833 - RNA, 64 nt, Human
caccuucauguaaggaugucuuauuaagccugugaccuggcaaguguuuuguuugguauguaca

SEQ ID NO: 431834 - RNA, 64 nt, Human
ucaugcuguugcgugugguggcuccaagccaagcaccuggcaugcaggucagcccuucccagcg

SEQ ID NO: 431835 - RNA, 64 nt, Human
auuggugguugcagggccccagagggcuggggugaccuggcaucccggggcuccccacgggcug

SEQ ID NO: 431836 - RNA, 50 nt, Human
ccaaacacgaugaacucuaaaccuggcaugaaccagauggugccagggag

SEQ ID NO: 431837 - RNA, 64 nt, Human
gaggccaaggguuuggucuaagcugugcccugccaccuggcaggaggcccacucacugcccaag

SEQ ID NO: 431838 - RNA, 64 nt, Human
cccggggcagcuggcaggagagagccuuggccugaccuggcacagaaagggcagcuucagucuc

SEQ ID NO: 431839 - RNA, 64 nt, Human
gcugugagggucccggugagauggagugggucacaccuggcaagcuggaagaaaguucccuggg

SEQ ID NO: 431840 - RNA, 64 nt, Human
aguaagacauuuuaauagagaagaucaaaauguuaccuggcaguuggggaauaaucugacuucg

SEQ ID NO: 431841 - RNA, 64 nt, Human
caggcugaggugucuuaagccuuuugcucacaaaaccuggcacaauggcuaauucccagagugu

SEQ ID NO: 431842 - RNA, 64 nt, Human
aguaguagccaguagggccgugggcucggcccggaccuggcauccggacuuggacucggggcca

SEQ ID NO: 431843 - RNA, 64 nt, Human
ucuagauugacgugggccagccuccuugagacacaccuggcacccgucaucggccagcggugga

SEQ ID NO: 431844 - RNA, 50 nt, Human
ccaaacaggaugaacucuaaaccuggcacgaaccagauggugccagggag

SEQ ID NO: 431845 - RNA, 64 nt, Human
uuccucccaggcccaguggguggaaucuguccccaccuggcacugaggagaaugguagagagga

SEQ ID NO: 431846 - RNA, 64 nt, Human
agagcuuugccuauggggcacaguaggccuaguaaccuggcauguuugauauauguagguaaag

SEQ ID NO: 431847 - RNA, 64 nt, Human
gggagggucacccauugcccaaggaagugcauccaccuggcaggugaccuggaggaguagcuuc

SEQ ID NO: 431848 - RNA, 64 nt, Human
ugucccugcugaaacuuuuaacuggaaaccucacaccuggcaggcagcacucucugcagccgug

SEQ ID NO: 431849 - RNA, 64 nt, Human
gggcguuacugccaaaacuccagaggcaaaguggaccuggcaaccacaagacccuccccauaag

SEQ ID NO: 431850 - RNA, 64 nt, Human
uagcuucuuuuaccaaccugagaaaauuaggaugaccuggcaaauaagaucuugaauaggccaa

SEQ ID NO: 431851 - RNA, 64 nt, Human
cugaauucuacugagucccuggcaagacugucuuaccuggcagcaaacugcugccugauuuguu

SEQ ID NO: 431852 - RNA, 64 nt, Human
uccccaaaaccucagaaaccucauaauucuuaacaccuggcauuuccauuucuaaagauggaca

SEQ ID NO: 431853 - RNA, 64 nt, Human
aucugaggggcugccugggaaggcgagucuggggaccuggcacugggaggcagggcucucccgu

SEQ ID NO: 431854 - RNA, 64 nt, Human
augcaggacacuuugaguguuacaaaaucuguagaccuggcaguagggucaugauguugggaag

SEQ ID NO: 431855 - RNA, 64 nt, Human
cugggaaugguggcggacgggcagcgugggugggaccuggcacuucgugguggcugagccaucc

SEQ ID NO: 431856 - RNA, 64 nt, Human
acagaaugagauaauuuauguaaagcaguagaguaccuggcacaaagcaaacaauaaauauuau

SEQ ID NO: 431857 - RNA, 64 nt, Human
gcaggugucaggcauggcacugggcacaacagggaccuggcaggagaaacagaccacagagagg

SEQ ID NO: 431858 - RNA, 64 nt, Human
gaaauuauucacgaaggugaccacugucuuucugaccuggcacagaggaaauguuggcugugaa

SEQ ID NO: 431859 - RNA, 64 nt, Human
augccauguaaaaauuaauuccauuuucgaagccaccuggcagacagguuuagcuguuucauca

SEQ ID NO: 431860 - RNA, 64 nt, Human
ccuggcuucucuggggcacuuggggcuauguacaaccuggcacgauccagaaagggugcaaaca

SEQ ID NO: 431861 - RNA, 64 nt, Human
ucuucuguuuugcaaaugucugugaaucugagcaaccuggcauucugcuuacuggccagaaagc

SEQ ID NO: 431862 - RNA, 64 nt, Human
aacagaggacaacccugagguguggcauaugggcaccuggcacugggagucgggggagcacguc

SEQ ID NO: 431863 - RNA, 64 nt, Human
ggggcuuggaaccucugaagguggggagcggaacaccuggcauccuuccccagcacuugcauua

SEQ ID NO: 431864 - RNA, 64 nt, Human
ggguaguguguguaugugugugugucagagggagaccuggcaggcaccucuuugagaguagcug

SEQ ID NO: 431865 - RNA, 64 nt, Human
gaucacuugggaucuuugacacuugaaaaauuacaccuggcagcugcguuuaagccuuccccca

SEQ ID NO: 431866 - RNA, 64 nt, Human
gaaaaaaagcccacauuugagguggcucaucuagaccuggcaagaauguauauagaagcaggca

SEQ ID NO: 431867 - RNA, 64 nt, Human
ccaaguucaucccagagcguggggcccgcugggcaccuggcaccuggccugcagaugcugcuac

SEQ ID NO: 431868 - RNA, 64 nt, Human
aguugauuugugaguaggcacucuuuaauccauuaccuggcacuagcaacauuagaauuuuaaa

SEQ ID NO: 431869 - RNA, 64 nt, Human
agcugggacuuaaaugacucacuuagaacaaaguaccuggcauugaagccucccagacccagcc

SEQ ID NO: 431870 - RNA, 64 nt, Human
cagggauuuguggggucagggaggggcagggggcaccuggcagcauauuuucugugacaaugug

SEQ ID NO: 431871 - RNA, 64 nt, Human
uagcaaaugcacuaauguauuccgggggacugucaccuggcaccacuggggcacucugcuggcu

SEQ ID NO: 431872 - RNA, 64 nt, Human
gucacaguuacuguaacagguaguguguauuugcaccuggcaucgugcagccugcacgucaaca

SEQ ID NO: 431873 - RNA, 64 nt, Human
ggggcaaacuucucuucagccccauggauccuuaaccuggcagcccguuuuggggugcuuucuu

SEQ ID NO: 431874 - RNA, 64 nt, Human
aagcccugaugaccugguucuucugaggcccucaaccuggcaucuuaggguauggucaggcaac

SEQ ID NO: 431875 - RNA, 64 nt, Human
ucaaugcagugaggcucucugggugaggcucccaaccuggcaguccccagccucccagcaucug

SEQ ID NO: 431876 - RNA, 64 nt, Human
gugggaucugaggcacucucucgaaugccgucacaccuggcagccuggaagccacaggcauccg

SEQ ID NO: 431877 - RNA, 64 nt, Human
ggguuguugcugcuuugcuucguguuuucuucuaaccuggcaaggagagagccaggcccugguc

SEQ ID NO: 431878 - RNA, 64 nt, Human
ccuggaaugaugcagcucagucaaggagcagcagaccuggcacuggaacaggguugaaaaccca

SEQ ID NO: 431879 - RNA, 64 nt, Human
agaguguuuguaguaauuaauuaccuuguacaggaccuggcacuuaguagcauucuucaaaugu

SEQ ID NO: 431880 - RNA, 64 nt, Human
uuagauuaaauguauguaagacacuuggcacaaaaccuggcacauaguaaaggcucaauaaaaa

SEQ ID NO: 431881 - RNA, 64 nt, Human
agggccucugccaaggaaauaauauggaccauuuaccuggcaggcagucugcucucucucagga

SEQ ID NO: 431882 - RNA, 64 nt, Human
aaauccuaauuaaaaauagaggucgacaugagauaccuggcauuuugggaagugaccaaagaug

SEQ ID NO: 431883 - RNA, 64 nt, Human
guucuggaaggagcaaggccaccagguccagagaaccuggcaugcaauggacauggaagcugaa

SEQ ID NO: 431884 - RNA, 64 nt, Human
acaacaaccccaggagaugggaccugaucaugcaaccuggcacuggaaaagaaaucagcgggau

SEQ ID NO: 431885 - RNA, 64 nt, Human
gggcugagcauguagacuagcagcuuuuuaucaaaccuggcauugucagguugaacuuauaaau

SEQ ID NO: 431886 - RNA, 64 nt, Human
cccuggcccaggaaagagggacuaccugacccucaccuggcaccccccugcugcugcccaagcc

SEQ ID NO: 431887 - RNA, 64 nt, Human
gaagcaaagaaggccagcaacauuggcacaugccaccuggcaaaggacccuugaguaagugaag

SEQ ID NO: 431888 - RNA, 64 nt, Human
uuuggcaacaagaaggcuuggaucugagucuucuaccuggcaggaugccaauccuguuuguugu

SEQ ID NO: 431889 - RNA, 64 nt, Human
ucuaguuauucagaggaguaagauggugauguucaccuggcaaucagcugaguugagacuuugg

SEQ ID NO: 431890 - RNA, 64 nt, Human
ucaccugcugucacugacuuugugcaggccaaggaccuggcagggccagacgcuguaccaucac

SEQ ID NO: 431891 - RNA, 64 nt, Human
aacaacuguggugggggcuggcagcagaccccccaccuggcagggcuucuaaugcucaggguuc

SEQ ID NO: 431892 - RNA, 64 nt, Human
aaugcugaaggggcagccagucaccagagcgcccaccuggcacaccccccucaccccagcccug

SEQ ID NO: 431893 - RNA, 64 nt, Human
uuccaccaagaaaacaaacaagcaccuaccauagaccuggcagaauaaauaaggaaauccuuaa

SEQ ID NO: 431894 - RNA, 64 nt, Human
caguuauaccucaguguuguagcaguacugugauaccuggcacagugcuuugaucuuacgaugc

SEQ ID NO: 431895 - RNA, 64 nt, Human
uugguuguaucuaacuuuuaagggacagagcuuuaccuggcagugauaaagaugggcuguggag

SEQ ID NO: 431896 - RNA, 64 nt, Human
uuggacaagagggucuggcugggaggugggccagaccuggcagcacugaaugugggcugugggc

SEQ ID NO: 431897 - RNA, 64 nt, Human
augcaagcagaguaccagggguuccaucauaucaaccuggcaaugcacuuggugguugugugac

SEQ ID NO: 431898 - RNA, 64 nt, Human
auguggagaagagugcccugcuuugcaaacaucaaccuggcaaaaaugcaacaaaugaauuuuc

SEQ ID NO: 431899 - RNA, 64 nt, Human
gaagaaggucugagaagucacugagguucuucccaccuggcagucucaggcagugcccauuccu

SEQ ID NO: 431900 - RNA, 64 nt, Human
cccccagguacauacuuuuacuuauugugggauaaccuggcacuaguaggcagguaaagucaca

SEQ ID NO: 431901 - RNA, 64 nt, Human
auaauuuuccugcuucacuguuauuuuuaauuuaaccuggcaaauuaagugagacuugaacaaa

SEQ ID NO: 431902 - RNA, 64 nt, Human
ucauaugaagaguuuggcacggaggcugagaaugaccuggcauagaugguuugccaguuaggau

SEQ ID NO: 431903 - RNA, 64 nt, Human
aguugacuucuugacucucuccccuacacccacuaccuggcauccaggaccaaauaccuggacu

SEQ ID NO: 431904 - RNA, 64 nt, Human
cccccaccccgccgaccauccaagggagagugagaccuggcagccacaacugcagucccauccu

SEQ ID NO: 431905 - RNA, 64 nt, Human
ccucaccccuuaccaaugagggcaggggaagaccaccuggcaugagggagaggggcugagggau

SEQ ID NO: 431906 - RNA, 64 nt, Human
gcuguguaugugaaccacccaugugagggaauaaaccuggcacuaggucuugugguuugucugc

SEQ ID NO: 431907 - RNA, 64 nt, Human
guccagcagggcugucagcuuccuguguggcagcaccuggcacacuggcucuggccagcauuau

SEQ ID NO: 431908 - RNA, 64 nt, Human
aaagucguguuaauacucaugauaauuauuagggaccuggcagcgugauuggaguauggauguu

SEQ ID NO: 431909 - RNA, 64 nt, Human
ucagauuccugauccacaccccaacccaacaaccaccuggcaauaugacucacuugaccccuau

SEQ ID NO: 431910 - RNA, 64 nt, Human
ccgcauuggcuuuacacaaacacagacaaauuccaccuggcaccuguuuuuggcugggccaagg

SEQ ID NO: 431911 - RNA, 64 nt, Human
aaauaaggaaggaacguucaucacuuuaaacugaaccuggcaaguuaauuuccucaggaauggg

SEQ ID NO: 431912 - RNA, 64 nt, Human
uccggagaaugcuggauggaacaggaaaccaaucaccuggcaccacuuucaagaugcuucaugg

SEQ ID NO: 431913 - RNA, 64 nt, Human
ggaaacugucuaggauucagcugaaccaccaggaaccuggcaacaucacgauuuaagcuaaggu

SEQ ID NO: 431914 - RNA, 64 nt, Human
ugcaguagcaucauugcccuagaugccccaggagaccuggcaccaugaggauuacagacagugg

SEQ ID NO: 431915 - RNA, 64 nt, Human
ggguucucaguaggaaugcuggugcugucuaaagaccuggcauuaauggaggcggaggagcagc

SEQ ID NO: 431916 - RNA, 64 nt, Human
cuccaucuccacccugcugguccugcucccauacaccuggcacuggccuuggccacccacuucu

SEQ ID NO: 431917 - RNA, 64 nt, Human
ccccagcuaagaaccuggaacuuggggaguuaagaccuggcagcucuggacagccccacccugg

SEQ ID NO: 431918 - RNA, 64 nt, Human
auaaguaauucucaagaaagcccucauuuuuauaaccuggcaaaaucuuguuaaugucauugcu

SEQ ID NO: 431919 - RNA, 64 nt, Human
aauaaccuuguuuucacuuggauaggcucaaccuaccuggcauauuuauuuugcagucuuguug

SEQ ID NO: 431920 - RNA, 64 nt, Human
uuacuguuaguauccguugcaucuaguguggugcaccuggcacacaguaggcacucaauaaaua

SEQ ID NO: 431921 - RNA, 64 nt, Human
cucaggaagcgacgugaccccugccccagcuggaaccuggcagaggccuuaggaccccguucca

SEQ ID NO: 431922 - RNA, 64 nt, Human
gccccagcagcuggauucucaggcugggccccucaccuggcagaguccauaguggagggggccu

SEQ ID NO: 431923 - RNA, 64 nt, Human
augaaaaagucuaucugguaguggguaaacguagaccuggcacuguuccacgcgggcgccccaa

SEQ ID NO: 431924 - RNA, 64 nt, Human
gcuggcagcagccugucaccgugcgaccgugaccaccuggcaugggcuucguggccugcucuca

SEQ ID NO: 431925 - RNA, 64 nt, Human
uaauuaucaccaaaaugugaaugguacauacaaaaccuggcauuuucuugugauaaguuuacau

SEQ ID NO: 431926 - RNA, 64 nt, Human
uuuuugauacaguauucugucaguaauuuauuagaccuggcagcuuugggugagcuuagauuuu

SEQ ID NO: 431927 - RNA, 64 nt, Human
uucaauaguagguaauuccuuagagauacaguauaccuggcaauucacaaauagccauugaaca

SEQ ID NO: 431928 - RNA, 64 nt, Human
aaaaaaauguauugugguuuaugcgaacagaccaaccuggcauuacaguuggccucuccuugag

SEQ ID NO: 431929 - RNA, 64 nt, Human
cauguugguaaaauccucuccagaaucuuggaacaccuggcaugugacccuagugacgucacag

SEQ ID NO: 431930 - RNA, 64 nt, Human
cuuucaugucacucacuauaaaauaggucucuuaaccuggcaccaguauaacuauaaagcacua

SEQ ID NO: 431931 - RNA, 64 nt, Human
aguggccacagcaccccgaagggagcaucuguuuaccuggcaguggcucucagagcagcagaac

SEQ ID NO: 431932 - RNA, 64 nt, Human
guauuuuauaaagauuaauaacagaccuacucuuaccuggcaguuuacuuaacuuacuguuuug

SEQ ID NO: 431933 - RNA, 64 nt, Human
aggcugcucaggucuccaagcgccguaggaggucaccuggcagugacuguagggagcuggguca

SEQ ID NO: 431934 - RNA, 64 nt, Human
agagccuccugccugaaccacgugaacugucaucaccuggcaaccccagccccagccucagccc

SEQ ID NO: 431935 - RNA, 64 nt, Human
uaugugauuggugucaaacuuaaggagauucaagaccuggcagaaaauguaagaggauuuuugc

SEQ ID NO: 431936 - RNA, 64 nt, Human
acccccaggaugaaaacaccguucuucaucuuuaaccuggcagaaacugcucacaugccuucaa

SEQ ID NO: 431937 - RNA, 64 nt, Human
agauagaccucaauaaaagacauaauauuucuccaccuggcagaaaaguaacugccaaguaaga

SEQ ID NO: 431938 - RNA, 64 nt, Human
agaaccuagaagggcuagaaccuggagggcuagaaccuggcagguuagaaccuagaagggcuag

SEQ ID NO: 431939 - RNA, 64 nt, Human
uagaacauggagagcuagaacccggcaggcuagaaccuggcaagcuagaaccuggagggaauga

SEQ ID NO: 431940 - RNA, 64 nt, Human
cagagauuuugugucuaugguugugggucuggaaaccuggcaggaaccacuucuagaguaccuu

SEQ ID NO: 431941 - RNA, 64 nt, Human
agguggcccaguguggggucauagggcuugauagaccuggcacugccuaucugcacuuccaggu

SEQ ID NO: 431942 - RNA, 64 nt, Human
gcccuuguccccgaggagugucccgcgcagccacaccuggcaacagcagugugggcugcagggc

SEQ ID NO: 431943 - RNA, 64 nt, Human
aagaaugaauuagagugaaggaaagcugugugacaccuggcauuccucuguucauggagcuucu

SEQ ID NO: 431944 - RNA, 64 nt, Human
ccccugauccugugaaguaaggaugugggggaagaccuggcaaggacacagaugaaacacaaac

SEQ ID NO: 431945 - RNA, 64 nt, Human
aauacuguacauaaaaugucauuuauauuuuccaaccuggcaugggugucuguugcaaaggggu

SEQ ID NO: 431946 - RNA, 64 nt, Human; identical to SEQ ID NO: 431943

SEQ ID NO: 431947 - RNA, 64 nt, Human
aagaaugaauuagagugaaggaaagcugugugacaccuggcauuccucucuguucauggagcuu

SEQ ID NO: 431948 - RNA, 64 nt, Human
agaaauacccaaagcaggccugcuuaagcccacuaccuggcauauaaacuuauaguaacacuuu

SEQ ID NO: 431949 - RNA, 64 nt, Human
uuuggauuucuccagucaaagcucacagaaaaaaaccuggcacuuugauuuucaugggaugguc

SEQ ID NO: 431950 - RNA, 64 nt, Human
gaguugcugagggcagguccccgagggggaugagaccuggcaacauccaugccuucucauucuc

SEQ ID NO: 431951 - RNA, 64 nt, Human
gaugaguuuugugagagaacagagagaccauuguaccuggcacaagggcuguucaugaaaaggg

SEQ ID NO: 431952 - RNA, 64 nt, Human
aaauacaaaaaauuagccagguguagggguaggcaccuggcaucccagcuacuccaggggcuga

SEQ ID NO: 431953 - RNA, 64 nt, Human
gaaaaccaccuucguuuucaagguucugacaaacaccuggcaugacagaauggaauucguuccc

SEQ ID NO: 431954 - RNA, 64 nt, Human
gugccuuaugugguggugguugugcccagcacagaccuggcaggguucuugccguggcucuucc

SEQ ID NO: 431955 - RNA, 64 nt, Human
gcuguucucgugguaguucauucggccuaaauagaccuggcauuaaauuucaagaaggauuugg

SEQ ID NO: 431956 - RNA, 64 nt, Human
aagcagcacucaggagaggggagaaaggaggugcaccuggcagcccacauuuuuguugcucccc

SEQ ID NO: 431957 - RNA, 64 nt, Human
cugcaggagccgccugccaagcuccccuuccuacaccuggcacacuggggucugcacaaggcuu

SEQ ID NO: 431958 - RNA, 64 nt, Human
cuccgguuuucucuaccacauccuuagagccaucaccuggcacgcaggcgccuuacauucuacg

SEQ ID NO: 431959 - RNA, 64 nt, Human
gguucuuagaaaucucuccugccagacuucccagaccuggcaaagguuuagaaacuguugcuaa

SEQ ID NO: 431960 - RNA, 64 nt, Human
agccucccaguaggaggccccagccaugccuucaaccuggcaggagguguagccacuccucauc

SEQ ID NO: 431961 - RNA, 64 nt, Human
ugaggcuuaaggcagcuggacucucuugcuggugaccuggcauccucaauuguuuccuccugaa

SEQ ID NO: 431962 - RNA, 64 nt, Human
ggugcucauccccacccccagcgacuuccguccuaccuggcaugcugcagcccucugccggcug

SEQ ID NO: 431963 - RNA, 64 nt, Human
aauuuuauugccuguguuuucaggcuucagagguaccuggcaccuuacucaagcaaaaacaaaa

SEQ ID NO: 431964 - RNA, 64 nt, Human
auggggacuguggugccaucuuugcuucaucaggaccuggcagccuugggugagggcaggugcu

SEQ ID NO: 431965 - RNA, 64 nt, Human
gagcggagcggcucccuuuucagccuugugagucaccuggcaggccccagcugggcuggcuguc

SEQ ID NO: 431966 - RNA, 64 nt, Human
ucucuucucuaucccuagaguaagaccaacuugaaccuggcauauaguagcugcuuaauaaaua

SEQ ID NO: 431967 - RNA, 64 nt, Human
guggcuggcaggagucccagcugcuugcuuuaggaccuggcagcuuuucuugccgucccucccc

SEQ ID NO: 431968 - RNA, 64 nt, Human
ugaauaagaagagauaaaauuugccuuaaaacuuaccuggcaguggcuuugcugcacggucuga

SEQ ID NO: 431969 - RNA, 64 nt, Human
ucuggggucagggauguccccgcuccugugucgcaccuggcaccugcucgggagcgcaccucac

SEQ ID NO: 431970 - RNA, 64 nt, Human
ccaguuuacgcugagucaguccauacagcaagacaccuggcacuuggcagguacuccuggaugu

SEQ ID NO: 431971 - RNA, 64 nt, Human
ccccaacccuuugcggcucuguacacauuuuuaaaccuggcaaaagaugaagagaauauuguaa

SEQ ID NO: 431972 - RNA, 64 nt, Human
gcugcccugucuucucuuacuuuacuuuaucaauaccuggcaaacugaccagaauuaccuuccu

SEQ ID NO: 431973 - RNA, 64 nt, Human
augaaggucagauuuucuugucaguuucugagaaaccuggcagccugcuguuaacaacacaggc

SEQ ID NO: 431974 - RNA, 64 nt, Human
uggguuuuuuguuuguuuuuauuguuuuugcuaaaccuggcaacccuaccgaguagggauuagc

SEQ ID NO: 431975 - RNA, 64 nt, Human
ggaggcuccagucagacccgccagauccuugggcaccuggcacucaagcacuuugcacgauguc

SEQ ID NO: 431976 - RNA, 64 nt, Human
cgcgaaggcuguaggcacaccgcggccagcaggcaccuggcacccaccuucccugcugccagga

SEQ ID NO: 431977 - RNA, 64 nt, Human
aucuuuuuaaaaagauacuucuguaacuuaagaaaccuggcauuuaaaucauauuuugucuuua

SEQ ID NO: 431978 - RNA, 64 nt, Human
gggccaaauagcuaugcagagcagagaugccuucaccuggcaccaacuugucuuccuuucucuc

SEQ ID NO: 431979 - RNA, 64 nt, Human
cuuuucuucccaguaacgccugcuguuuacugccaccuggcacuggugacuacagacguucuca

SEQ ID NO: 431980 - RNA, 64 nt, Human
guggaggguuugcggguccugccugugcuggggcaccuggcaccguggaucuuaaaacuugcca

SEQ ID NO: 431981 - RNA, 64 nt, Human
uggugucucacacuuguauccuucugcccucgagaccuggcacagcaguaucccuugaagaaau

SEQ ID NO: 431982 - RNA, 64 nt, Human
ggcaaagacuaccugcuggagaugaagcugaagaaccuggcacaaauggagccccuccaugcag

SEQ ID NO: 431983 - RNA, 64 nt, Human
agcagccucccaccagcgaucccuuggggcgggcaccuggcagugagggacagagcuagugggg

SEQ ID NO: 431984 - RNA, 64 nt, Human
aacuuacaguuuccuuuaaaaaaaaaaaaaguaaaccuggcagcuauagaauacacuaugugca

SEQ ID NO: 431985 - RNA, 64 nt, Human
uguguguaguguguguugggugugggguguguacaccuggcaucuguggcauguguucugguca

SEQ ID NO: 431986 - RNA, 64 nt, Human
ucaggaaagagguugugagcugauuggauuaaagaccuggcacuucaguaacucagcacgcuuc

SEQ ID NO: 431987 - RNA, 64 nt, Human
cugacaguuacaugguaacagugaauggcuuaguaccuggcaaagaaaguaaaauuguuuuuuc

SEQ ID NO: 431988 - RNA, 63 nt, Human
uuugcuacugacucauuggacugaaagcugaaguaccuggcaaaaaaaaaaaaaagaaaaaaa

SEQ ID NO: 431989 - RNA, 64 nt, Human
uucuuaaguucgggaaacaaaguucggggaaaauaccuggcaugaaacuguaguuagggauaca

SEQ ID NO: 431990 - RNA, 64 nt, Human
ccaaaaugcugggauuacaggcaugagccaccacaccuggcaaggguaccugacauucuaagau

SEQ ID NO: 431991 - RNA, 64 nt, Human
uagaauccacucuaucagcauaguccagaagaauaccuggcaguagaagaaaugaauauucaag

SEQ ID NO: 431992 - RNA, 64 nt, Human
agccucucgccugcacugaugcagacaaaaucucaccuggcaggcccaacccccccccaccccu

SEQ ID NO: 431993 - RNA, 64 nt, Human
cugaguagcugggaccauaggcucacaacaccacaccuggcaaauuugauuuuuuuuuuuuuuc

SEQ ID NO: 431994 - RNA, 64 nt, Human
ggccgccuaguacacacccaccuggccgagcuguaccuggcacggcccauccuggacugagaaa

SEQ ID NO: 431995 - RNA, 64 nt, Human
uuaaagaacgaaaagcgggccggcucggcuucugaccuggcaccgcugcuacggcggccuagca

SEQ ID NO: 431996 - RNA, 64 nt, Human
ugaggcugaagccauuucacauuucaccccuaccaccuggcaggugcacaccaugugcaugagu

SEQ ID NO: 431997 - RNA, 64 nt, Human
ggaagcugcaccuuugggaagaauuccucuccagaccuggcagagccugguguggggucugaga

SEQ ID NO: 431998 - RNA, 64 nt, Human
ggccagaacugagcgcuguggggagcgcgcccggaccuggcaguggagccaccgagcgagcagc

SEQ ID NO: 431999 - RNA, 64 nt, Human
accaauuuucaccaugauuuuaaaaauuaaaaaaaccuggcagagcccgacuagaaagggacgg

SEQ ID NO: 432000 - RNA, 64 nt, Human
ccugaggcuuugucccuucccaauaaagccugcuaccuggcaguaccccugaagagaucugcgu

SEQ ID NO: 432001 - RNA, 64 nt, Human
aaagaaagggggaaagucuaugaacgacuuuucaaccuggcaauuccauauacaauguuaaacu

SEQ ID NO: 432002 - RNA, 64 nt, Human
agccucccaaagugcugggauuacaggccacuacaccuggcacauuugaguauuuuuuuuuuuu

SEQ ID NO: 432003 - RNA, 64 nt, Human
caucuaucacacaggcuuucaggacagacuuguaaccuggcauguaccuauugacuguauccuc

SEQ ID NO: 432004 - RNA, 64 nt, Human
cauuacucugcgguggugccagagguuuuaggaaaccuggcauggugcuuucaggucuggggcu

SEQ ID NO: 432005 - RNA, 64 nt, Human
aagguuuguaacaaggcuuuugggagugauucacaccuggcacaccauacuagaauucacacug

SEQ ID NO: 432006 - RNA, 64 nt, Human
aagguuuaugacaagauuuuugaauauaauucauaccuggcaaaacauauuagaauucaaacug

SEQ ID NO: 432007 - RNA, 64 nt, Human
cacaaaggcuuuccuuggccacagugggaccuucaccuggcaccucuauccuguaauugcacau

SEQ ID NO: 432008 - RNA, 64 nt, Human
ccagugagcucgccauucacugauuggaagagugaccuggcaucuuggaaaucauugugugucu

SEQ ID NO: 432009 - RNA, 64 nt, Human
cucacagucuuuuggugguugauggccacugcaaaccuggcaccaucagaucucuucugaucuc

SEQ ID NO: 432010 - RNA, 64 nt, Human
cccacccagcgccgccgccgcuggcucucggggcaccuggcaggaggcgggugugugaauagca

SEQ ID NO: 432011 - RNA, 64 nt, Human
cuucugccugcaccccugcaguuugagacaggagaccuggcacuggaugcagaaacaguucacc

SEQ ID NO: 432012 - RNA, 64 nt, Human
ccguaugugguucugggucccagggagccuuggaaccuggcacccuggggugguuuaauucauc

SEQ ID NO: 432013 - RNA, 64 nt, Human
agagaacucuuuuucucccuuguacuuuuuuuugaccuggcaucuuuuuauagggaaaaauggc

SEQ ID NO: 432014 - RNA, 64 nt, Human
agggaccguccuucuccccuacccagggaacuggaccuggcagggcaccgugcucauguggcuc

SEQ ID NO: 432015 - RNA, 64 nt, Human
gcaggaaggugaugcccacuggaacucuccucacaccuggcagcuucauggauguuguaucuga

SEQ ID NO: 432016 - RNA, 64 nt, Human
acauaaccugcaugaaucaguuuugggggaauggaccuggcauggggauggguucaggccaggu

SEQ ID NO: 432017 - RNA, 64 nt, Human
agcuaccuggacuccaggacccuggagaagggagaccuggcaguggagggaggcugugcugugu

SEQ ID NO: 432018 - RNA, 64 nt, Human
cgggauccuugugcagggaagagcugcccugggcaccuggcaccacaagaccauguuuucuaag

SEQ ID NO: 432019 - RNA, 64 nt, Human
uuguuuggguuuguuuugguggaaaacaucacaaaccuggcacaccauuugaauaucccuaaua

SEQ ID NO: 432020 - RNA, 64 nt, Human
acugggguggaggcggcaggaaggggcggcccuuaccuggcaggucugggcgcaccuuuagcag

SEQ ID NO: 432021 - RNA, 64 nt, Human
cuggcugcugggucugccgucgguccugcugcuaaccuggcaccagagccucugcccggggagc

SEQ ID NO: 432022 - RNA, 64 nt, Human
cuuugaguccagugugcacgagucgacaagcaguaccuggcaugcaggagcacucaugggugag

SEQ ID NO: 432023 - RNA, 64 nt, Human
ggguuccggaacauucauucccccaccggugaggaccuggcaugcagcgaagcagcccagcccg

SEQ ID NO: 432024 - RNA, 64 nt, Human
gaggccggacucagacacauaggcggggggcggcaccuggcaucagcaauacgcagucuguggg

SEQ ID NO: 432025 - RNA, 64 nt, Human
uuauccgaccccuguggcucauuuuucucuucugaccuggcagcuuuccuuguuguucuaagcc

SEQ ID NO: 432026 - RNA, 64 nt, Human
gggaacccugagcuccaagcgugcugugcgucugaccuggcaugauuucuauuuauuaugauau

SEQ ID NO: 432027 - RNA, 64 nt, Human
gucccacgucaccauuucaucucauuguaggcucaccuggcacaguggccaagcaggaaggggc

SEQ ID NO: 432028 - RNA, 64 nt, Human
accccgucguauacccuggaugaacgaauuaauuaccuggcaccaccucgucugggcucccugc

SEQ ID NO: 432029 - RNA, 64 nt, Human
cugugaagcaggaaggccagggagguccccggggaccuggcauucuggggagacccugcuucua

SEQ ID NO: 432030 - RNA, 64 nt, Human
guugagagccaggggcuggugugugggagcugcuaccuggcaguuucucgaggggucaccgagc

SEQ ID NO: 432031 - RNA, 64 nt, Human
aggagcgucucaagugaacagugggagccugcccaccuggcacugcacuggaguugucucuuac

SEQ ID NO: 432032 - RNA, 64 nt, Human
gcucuccugugcggcgucugauuucucggugcuaaccuggcagcuguggggcccuuaggagccc

SEQ ID NO: 432033 - RNA, 64 nt, Human
ucggcggcggaggcucaggguggggagcaggccuaccuggcaggccuggcagggcaguaccacu

SEQ ID NO: 432034 - RNA, 64 nt, Human
ggccauugaucguaguugcauuuuauucgucauuaccuggcagaggcaaagaaaggugagaccc

SEQ ID NO: 432035 - RNA, 64 nt, Human
auugguccuguccaauucuacugaauggggguggaccuggcauuuaucuggccaaaaacaggag

SEQ ID NO: 432036 - RNA, 64 nt, Human
cacuuuuucuuuaguuucuuugcucuacgugggcaccuggcacuaagggaguaccuuauuaucc

SEQ ID NO: 432037 - RNA, 64 nt, Human
auccacuggagcaccuugauagguuuucaaaaauaccuggcaagaaaucuggaaauucuauaau

SEQ ID NO: 432038 - RNA, 64 nt, Human
gcaggcaaacuugaggaagcccugguucuauuucaccuggcaggggagccuauaaggagagcga

SEQ ID NO: 432039 - RNA, 64 nt, Human
uggccagcuggaagggacuucagcaaccaagaccaccuggcaacaggcucagugggggucaggu

SEQ ID NO: 432040 - RNA, 64 nt, Human
uguuuggccagugacagugugagagauggaguugaccuggcaaugaucuguggcuaacaugccg

SEQ ID NO: 432041 - RNA, 64 nt, Human
agccucaaagugcaccgacuaguugcuugccuauaccuggcaccucauuaagaugcugggcagc

SEQ ID NO: 432042 - RNA, 64 nt, Human
ggccuccuuccuccccugccugcagcuggcuuccaccuggcacgugccugcugcuuccugagag

SEQ ID NO: 432043 - RNA, 64 nt, Human
ggcuuaaaauugacagcaucuggauuaugaauacaccuggcacccuggcuaccagaauuucaua

SEQ ID NO: 432044 - RNA, 64 nt, Human
auggaacaaucacugaauaauuuaaaaagaguuuaccuggcagagugugucaugccugcaaucc

SEQ ID NO: 432045 - RNA, 62 nt, Human
ggccggcaugccccgaucuuucacacacuggugacccugagagaggagggaggagggaaccu

SEQ ID NO: 432046 - RNA, 62 nt, Human
gugcaaagcaggggcauuggggacugucuugagacccugagggggucaagccccuccuuccc

SEQ ID NO: 432047 - RNA, 62 nt, Human
ggccaauggggagcuggauugagcagaacccagacccugaguccuugggccagcucuuggcu

SEQ ID NO: 432048 - RNA, 62 nt, Human
gcuuggcacuuuaaagcauuaacagcaggugugacccugagggcuccuccauggugcugcau

SEQ ID NO: 432049 - RNA, 62 nt, Human
ugacaggauggacuuuuaaugggcacuucugggacccugaagagacuucuucccuucaggcu

SEQ ID NO: 432050 - RNA, 62 nt, Human
gucuguguccguugugaucacaggccuugcuagacccugaucaucugguucuccucucauua

SEQ ID NO: 432051 - RNA, 62 nt, Human
ucucgcaccagccaagccuuaacugccugccugacccugaaccagaacccagcugaacugcc

SEQ ID NO: 432052 - RNA, 62 nt, Human
gagagcaaaguaguuauccaauggugagacgagacccugacgcucauagaggccauuccuuc

SEQ ID NO: 432053 - RNA, 62 nt, Human
gaucagugggcacaguucuucagcuacauugagacccugaaaugaacaauuauauucugacu

SEQ ID NO: 432054 - RNA, 62 nt, Human
uuugacuuaaaugaauuuaaaaugagccaaaggacccugaaaagaagacauguugauuuccc

SEQ ID NO: 432055 - RNA, 62 nt, Human
guacuuuggaacgacaaaaugaaacagaacuugacccugagcuuaaauaacaaaacugugcc

SEQ ID NO: 432056 - RNA, 62 nt, Human
ugcccuuucauugggguguauacauaucaggggacccugagguggcaccguacucaguguug

SEQ ID NO: 432057 - RNA, 62 nt, Human
cucucccgccuucucccucgagcagcagcaaggacccugacgcuguccccgauaacucccua

SEQ ID NO: 432058 - RNA, 62 nt, Human
ccuugauagucacugggcucccugugacuucugacccugacaccccucccuuggacucugcc

SEQ ID NO: 432059 - RNA, 62 nt, Human
ggaaacagugaucaccccggacgggcguccaggacccugagggccauggccaaaaggcuccu

SEQ ID NO: 432060 - RNA, 62 nt, Human
ccagucuggauccaggucugcaaggccagcccgacccugacacugcacgugggcguaguggg

SEQ ID NO: 432061 - RNA, 62 nt, Human
caggugggcaaucauuuugaauacuguucugugacccugacugcuaguucugaggacacugg

SEQ ID NO: 432062 - RNA, 62 nt, Human
gcaauugcccuguaacuuaucuagaaagaaaagacccugagacuccagaaucugcuguugcc

SEQ ID NO: 432063 - RNA, 62 nt, Human
ucuuuucugaccaguugccacaugacuugcuugacccugagccuguggaaauggcauaggga

SEQ ID NO: 432064 - RNA, 62 nt, Human
cuuaaugugacaccugagaccuuuagacaguugacccugaauuaaauagucacaugguaaca

SEQ ID NO: 432065 - RNA, 62 nt, Human
acaacuugcaauaaugaaauuccuuaugucaggacccugaaaauaagcacauuugaaaacuc

SEQ ID NO: 432066 - RNA, 62 nt, Human
cagucaguaccuggacucgccucuacccagcagacccugacuccagcagauucuggcccagg

SEQ ID NO: 432067 - RNA, 62 nt, Human
uacgugauccuucugccaaaaugucgaaaucagacccugacaaacuggccaccguccgaaua

SEQ ID NO: 432068 - RNA, 54 nt, Human
acucuggaggcugcugcugaaguggacccugagccuagaagagcagaauccagg

SEQ ID NO: 432069 - RNA, 62 nt, Human
uuagacccuuuggccuugggguccauccuggagacccugaggucuaagcuacagccccucag

SEQ ID NO: 432070 - RNA, 62 nt, Human
agaucaacgugcuagagaaaaucaaugagaaagacccugacaacaagaaguaagcaagcaag

SEQ ID NO: 432071 - RNA, 62 nt, Human
gccccugccugccccuuuggugcccaggcacagacccugauaguggguuugggucaccuugg

SEQ ID NO: 432072 - RNA, 62 nt, Human
caaaaugaagcugaaggcucacauguuaaaaugacccugaauagaauaggaagaacaauguu

SEQ ID NO: 432073 - RNA, 62 nt, Human
uaaaguugugugggaaaagaaggcucuuuggggacccugacaugaagaaguccacuaagugg

SEQ ID NO: 432074 - RNA, 62 nt, Human
aagagaggagcaaguagcccuguccugacauugacccugauuugaccccucuucuuauaagg

SEQ ID NO: 432075 - RNA, 62 nt, Human
agacuaaaauugggaacuuauuugcaauuuuugacccugaccacuaacuagugauucuucuc

SEQ ID NO: 432076 - RNA, 62 nt, Human
gccuggguaauauaggaagacccugucuugaagacccugaccucaagugauccacccaccuc

SEQ ID NO: 432077 - RNA, 62 nt, Human
uaacucaucacccuuuuucacuaugacccuuagacccugaguauuuucaaauauaugauugc

SEQ ID NO: 432078 - RNA, 62 nt, Human
cagaaucgcucaucggcgaggcucagcagaaagacccugaaggcaggcugcaaaugacccag

SEQ ID NO: 432079 - RNA, 62 nt, Human
auaacagccagucucaccccagucuaaucauggacccugauaauauugcuugauuuuuccua

SEQ ID NO: 432080 - RNA, 62 nt, Human
acagucgaaaugagcaacucaccuuacccucugacccugauuagacaggaucaauuguaaag

SEQ ID NO: 432081 - RNA, 62 nt, Human
caucagaguucuuaagggacuggguaaggccugacccugaaaugaccauggauauuuuucua

SEQ ID NO: 432082 - RNA, 62 nt, Human
gagggucugggggcagcuguccugaaccgacugacccugaggaggccgcuuagugcugcuuu

SEQ ID NO: 432083 - RNA, 62 nt, Human
uuugaaaaagcagaagucaacuuuugggccgagacccugaucuuugugaaauaccucugcaa

SEQ ID NO: 432084 - RNA, 62 nt, Human
uauugcuuuucugucuucuucaaccugggagagacccugaauuugaguguguucucuaauca

SEQ ID NO: 432085 - RNA, 62 nt, Human
acaacguguaaaguacugaaucugaguaggcugacccugagaagggacaauuaaagagacaa

SEQ ID NO: 432086 - RNA, 62 nt, Human
cagaccagaucccguaggcagccccacagaccgacccugaccccacucacagccacccugaa

SEQ ID NO: 432087 - RNA, 62 nt, Human
ugggagggcgccgagcccaccgucgcccccuagacccugacagcugcagcugccuugccuug

SEQ ID NO: 432088 - RNA, 62 nt, Human
aaucaacuuagguauacaauauaaaaaauaaagacccugaaaauuguuuuggauacuguguu

SEQ ID NO: 432089 - RNA, 62 nt, Human
cucuucagcacaaaaggaauagaucuaugauugacccugauuuuaauugugaaauuauauga

SEQ ID NO: 432090 - RNA, 62 nt, Human
ggacacuggcuggaaccccggaaugagccuucgacccugaaauccuuggggugccucgagga

SEQ ID NO: 432091 - RNA, 62 nt, Human
gucuguuugacagacuuugguaacaauccaaagacccugagggucugagcagcuagaagucc

SEQ ID NO: 432092 - RNA, 62 nt, Human
caggagacgacaggcgagagaggagccagacagacccugaaaagaaggacggguuggggccg

SEQ ID NO: 432093 - RNA, 62 nt, Human
uuuaauuugucacucggaacuucaggauggaggacccugacccuaaaccuccuucagaucuc

SEQ ID NO: 432094 - RNA, 62 nt, Human
gauccugccccaaaugcggucggagcgccagugacccugaggaagcccgucccuuaucccug

SEQ ID NO: 432095 - RNA, 62 nt, Human
gguuugacaugacaaggaaaggacuuccugcugacccugagagccucuggggugccgcggca

SEQ ID NO: 432096 - RNA, 62 nt, Human
ugugcacuugguucucagucaucucugcaagggacccugacgccugggagaucagagccacu

SEQ ID NO: 432097 - RNA, 62 nt, Human
uggggguggcugggcucccccaggacagaggggacccugagguuggcaaggcucucaccacu

SEQ ID NO: 432098 - RNA, 62 nt, Human
gccugugcaggucugacaccggcucccacggggacccugaggaccgugcagggaugccaagc

SEQ ID NO: 432099 - RNA, 62 nt, Human
gcgaaccuccccacaccucccucaccgcgcaggacccugagugaggaggaggagcuggaaac

SEQ ID NO: 432100 - RNA, 62 nt, Human
ugggaggucacugcucucagaggacagcaagggacccugagcucugcaagcugugaucuguc

SEQ ID NO: 432101 - RNA, 62 nt, Human
caggagcaaugggcagugagguggacagcccagacccugaaaggacguguggagacagcagc

SEQ ID NO: 432102 - RNA, 62 nt, Human
ugggagagggacuuggaggacccaccugugaggacccugaccuggccaucuugagggguuuu

SEQ ID NO: 432103 - RNA, 62 nt, Human
ugggguggguagcugggggcccggacacuugggacccugaccccuuugucccugcacucagc

SEQ ID NO: 432104 - RNA, 62 nt, Human
uguugagccuaauauuuguugagauuuugcaggacccugaucuuuugugguccuguaaaaga

SEQ ID NO: 432105 - RNA, 62 nt, Human
uugcauauuuauauaaucucugacuuguaauggacccugacuggaaugugaucccucaggaa

SEQ ID NO: 432106 - RNA, 62 nt, Human
aagaaugaaaaguacacacccauggaauucaagacccugaacaagaauaacuugaucccuga

SEQ ID NO: 432107 - RNA, 62 nt, Human
cacgcauugguguuaacauuuuaaucuuagaagacccugacccacugaggguuuguugugag

SEQ ID NO: 432108 - RNA, 62 nt, Human
aggagauuuuauuauaucuggagacccugagagacccugagaccuggggcacccuggcuggc

SEQ ID NO: 432109 - RNA, 62 nt, Human
uggccugaacaggagauuuuauuauaucuggagacccugagagacccugagaccuggggcac

SEQ ID NO: 432110 - RNA, 62 nt, Human
ccugggacccccuccccacugccugcacagaggacccugacccucggccagcaggguggccc

SEQ ID NO: 432111 - RNA, 62 nt, Human
gcaaggccauagaaucuagauggcccugucuugacccugaaaugaaccuuaagccuuagaac

SEQ ID NO: 432112 - RNA, 62 nt, Human
aaugcaaauucucaggccccaaccugaaggaggacccugaauuugagauccccggggcuggg

SEQ ID NO: 432113 - RNA, 62 nt, Human
uguaugccuaccauaugccagauuuuauccuagacccugaggauauagcuuuuuaaaacccc

SEQ ID NO: 432114 - RNA, 62 nt, Human
gggaguggccuggaccugcccugggccacacugacccugauacaggcauggcagaagaaugg

SEQ ID NO: 432115 - RNA, 62 nt, Human
cagggguccuguuaacgucaucucaggguccagacccugaagauuucagaggcugcaggacu

SEQ ID NO: 432116 - RNA, 62 nt, Human
ccuccauucuuccugggugcagaacuguagaagacccugaggacuccugggcuagugugagc

SEQ ID NO: 432117 - RNA, 62 nt, Human
ucuccaggacaucgggcugcgugaaguccagugacccugaggggauuuuggccaaaggaaac

SEQ ID NO: 432118 - RNA, 62 nt, Human
augcaucugauuugguauugugauuuacuucagacccugaaaccaaauaucugaucuuccau

SEQ ID NO: 432119 - RNA, 62 nt, Human
cugcagccucugcucagaacgcccuuccuccagacccugacaccugagcugggguugcaaag

SEQ ID NO: 432120 - RNA, 62 nt, Human
ccuuugccuuccacccccaccauccagguggagacccugagaaggacccugggagcucuggg

SEQ ID NO: 432121 - RNA, 62 nt, Human
aaacgucuuaacacuugagugaaucuucaaaggacccugacauuaaaugcugaggcuuuaau

SEQ ID NO: 432122 - RNA, 62 nt, Human
cagagaccucucuucuggauuugucccauggggacccugagacuacuaaagcugcuuucuuc

SEQ ID NO: 432123 - RNA, 62 nt, Human
ugacucucggggggagaaggggcucccaacaugacccugaguccccuggauuuugcauucac

SEQ ID NO: 432124 - RNA, 62 nt, Human
cgagccugguagggaagggacccgcguggcgcgacccugaccgaucccaccucaacagcucc

SEQ ID NO: 432125 - RNA, 62 nt, Human
ucaugccugcuugacugauaagccauuagcuagacccugacuauguaacgcuaaagauuuua

SEQ ID NO: 432126 - RNA, 61 nt, Human
aauuuccuuauuaaaguuauauuuuucuauaagacccugacauauguauguuacuuauaau

SEQ ID NO: 432127 - RNA, 62 nt, Human
guccccucaccuccucuaagguugggcagggugacccugaagugagcacagccuagggcuga

SEQ ID NO: 432128 - RNA, 62 nt, Human
ccaucacccggaaggaugcccacaaggcagcugacccugaaagcagccucccccucauggag

SEQ ID NO: 432129 - RNA, 62 nt, Human
ucggggugcccucauggucaggugcuggugaggacccugaucuggguugcagacugcugacu

SEQ ID NO: 432130 - RNA, 62 nt, Human
uuuuuguguucuaauuguuuuugagauauaaagacccugaaaaagcccauuuuagaaccugu

SEQ ID NO: 432131 - RNA, 62 nt, Human
uuuaagguuuugaucuuuucaaaacuaaaacagacccugaguuaauuggguugaaaauuugg

SEQ ID NO: 432132 - RNA, 62 nt, Human
augaccugguagucuuagcagggggagcccucgacccugaaugugaacuugaacuggagugc

SEQ ID NO: 432133 - RNA, 62 nt, Human
caugcuggcuggcgggacaggugggcaggacugacccugaggaggccuugccugcagggucu

SEQ ID NO: 432134 - RNA, 62 nt, Human
ucaugcacccugaucuuaggguuagaauacuugacccugauaccugcaccaugcuucauggu

SEQ ID NO: 432135 - RNA, 62 nt, Human
ccugagaggugucccaucuuauugcuguugaggacccugaaacaccguuguuuaaagacuuc

SEQ ID NO: 432136 - RNA, 62 nt, Human
ugguuguuggggcagagccaguggaggugagugacccugagacuaaugaacaucccaccuaa

SEQ ID NO: 432137 - RNA, 62 nt, Human
ucacgcccagagagagaaaaaguuaagcugcugacccugaaggcaagggagagcaggcugca

SEQ ID NO: 432138 - RNA, 62 nt, Human
gcugucugaagcccaaagccugaggacagaaagacccugaugcaggucagcccauggaggca

SEQ ID NO: 432139 - RNA, 62 nt, Human
gcaggggccugggccauagcugggggaggccagacccugagggcuuugcagggcggccagug

SEQ ID NO: 432140 - RNA, 62 nt, Human
guacuggacagaucaucgggcgggugaacgcagacccugacuaccugccccgcaccauggac

SEQ ID NO: 432141 - RNA, 62 nt, Human
aaaagugcacuuaagagaugggauuacaaguggacccugacuuucccuaaggacuuccacuu

SEQ ID NO: 432142 - RNA, 62 nt, Human
auaguaauuuccagcccuccuugagacacauagacccugaaacaaagguaagaagggccugg

SEQ ID NO: 432143 - RNA, 62 nt, Human
auagccaaaaccugacugugcacuuacuauaggacccugaccugccugggucucccugucuc

SEQ ID NO: 432144 - RNA, 62 nt, Human
cccaggaguccagccugggcaaaauagcgagagacccugaaucugaaaguaaugauaaaaua

SEQ ID NO: 432145 - RNA, 62 nt, Human
guuuaaucauggccugagcagaaauacugaaagacccugagaccuggaugaugucuuugagc

SEQ ID NO: 432146 - RNA, 62 nt, Human
ggcuagaguuugccaggagggaggaaaccagugacccugaaaacugagggugccucaggagc

SEQ ID NO: 432147 - RNA, 62 nt, Human
gugcuggcauuuucagcagauccucauguguugacccugaugucuuuagcagaggccucuag

SEQ ID NO: 432148 - RNA, 62 nt, Human
aaggcauuuuccuugggagagaaggggaaauggacccugacccccuugauccccaaagaagc

SEQ ID NO: 432149 - RNA, 62 nt, Human
aggcugcagcagcagcugacccaggcccaagagacccugaagagccugggugcccugaagaa

SEQ ID NO: 432150 - RNA, 62 nt, Human
guuucuuguuuauaguccaaacuggguuauuugacccugaucuuguguacagcccacacccu

SEQ ID NO: 432151 - RNA, 62 nt, Human
uuagcguuguuuuguggauaagaaaaaugcuugacccugaaauauuuucuacuuuaaauugu

SEQ ID NO: 432152 - RNA, 62 nt, Human
guggcgggaggggagccagauccccgagggaggacccugagggccgcgaagcauccgagccc

SEQ ID NO: 432153 - RNA, 62 nt, Human
uuuugcccaggucuggguauugcuccugcccagacccugacaucccuuuccacugugugugu

SEQ ID NO: 432154 - RNA, 62 nt, Human
ugccggugcuuccaacaaggacagcccuccuugacccugaaaggaacacuggcuugaaggac

SEQ ID NO: 432155 - RNA, 62 nt, Human
gucuucacagcuuuggggaauuuuggccaggagacccugaaacaugaaaccaaacaggcuuu

SEQ ID NO: 432156 - RNA, 62 nt, Human
cccugcagcgcuacuuucugccagcggacgcggacccugacaccuacagcugaccggacugg

SEQ ID NO: 432157 - RNA, 62 nt, Human
ugaccucggugaccacucuucuuuaagccauagacccugaggcccugggcugggugcuggga

SEQ ID NO: 432158 - RNA, 62 nt, Human
aaaaugaauauuuggauccauguuccucuugugacccugagucuucaugcaaggagaucuga

SEQ ID NO: 432159 - RNA, 62 nt, Human
acccacugguuuccccaacaggcugcguaagggacccugagccacagugaguuggucaaaug

SEQ ID NO: 432160 - RNA, 62 nt, Human
gugguggccaggugacauuuucugugcguuuugacccugaggcaucugaggagaggccacau

SEQ ID NO: 432161 - RNA, 62 nt, Human
cuccugcuuccuccagggaacccaacagucaugacccugauaguuucccauaacaaccuggg

SEQ ID NO: 432162 - RNA, 62 nt, Human
uuacaaagaggccagcuaauagcagaaaucaugacccugaaagagagaugaaauucaagcug

SEQ ID NO: 432163 - RNA, 62 nt, Human
ucccucuccccagcugcaaacugagugugccggacccugaggagaggcuggacucggggcau

SEQ ID NO: 432164 - RNA, 62 nt, Human
accccacuaagccguugagucucuuccuggaagacccugagggccggcagcuuugccuagga

SEQ ID NO: 432165 - RNA, 62 nt, Human
ccaagauuccugaucaugacgggaagcugagugacccugaggccuuaagcuuccccagucuu

SEQ ID NO: 432166 - RNA, 57 nt, Human
agugggaaggcgccgugugacagagccgacccugaggauggcacuguccaaggaaac

SEQ ID NO: 432167 - RNA, 62 nt, Human
cgguguaugccaaguggcccccgggaggacgggacccugagccugugugugucgggcagcug

SEQ ID NO: 432168 - RNA, 62 nt, Human
cccccagaaauacccacagcauagugaccucagacccugauacucaccacaaaacuuuuaag

SEQ ID NO: 432169 - RNA, 62 nt, Human
cucaccuuggaggccacacccaacuuuccaaagacccugagacaagucaggacccuacuacu

SEQ ID NO: 432170 - RNA, 62 nt, Human
cucagcugcacugcccgaaaagcauuugggcagacccugagcagaauacuggucucaggcca

SEQ ID NO: 432171 - RNA, 62 nt, Human
aagccucugagggauugaggggcccuggccaggacccugaccuccgccccugcccccgcucc

SEQ ID NO: 432172 - RNA, 62 nt, Human
ccaaggagcuucgaaucuaagucaucuagaaugacccugaaaugacugacagccccgggccc

SEQ ID NO: 432173 - RNA, 62 nt, Human
cgggagcugcucaucagccgcaacuuccugccgacccugaugcgggugggccgagcagugug

SEQ ID NO: 432174 - RNA, 62 nt, Human
guguguggaaaguggccagcauucugccugcagacccugagcacugagucaacaagguuugu

SEQ ID NO: 432175 - RNA, 62 nt, Human
gaagccaucgcgcuccuugcggaggugaagaggacccugaguccccaccugcggcuccccug

SEQ ID NO: 432176 - RNA, 62 nt, Human
uugugcaguauuuuuugacuuaaacagaguaugacccugaaaaauaaaagaaucuuuuuuuu

SEQ ID NO: 432177 - RNA, 62 nt, Human
cgucugucucucucgcucauguaauauacucugacccugaguggaaagggguuuuuguucug

SEQ ID NO: 432178 - RNA, 62 nt, Human
agcagcuuugaaagcagacugagaugaguugagacccugaaucccugggcuguuguuccugu

SEQ ID NO: 432179 - RNA, 62 nt, Human
ccaaggccugcuuugaaaaggugcuugaaguggacccugaaaacccugaauccagcgcuggg

SEQ ID NO: 432180 - RNA, 62 nt, Human
ucugucugaacucugcugugaucccaugaugugacccugaugggcuggacuugccccuccgg

SEQ ID NO: 432181 - RNA, 62 nt, Human
ugaguucauuagcauuuccugaaugagccaaugacccugagaaggucccucccaucugccag

SEQ ID NO: 432182 - RNA, 62 nt, Human
cccugggaacagcaggcucugcuguuucuagugacccugagauguaaacagcaagugggggc

SEQ ID NO: 432183 - RNA, 62 nt, Human
cgagggaggguugccugggaaccccaggaauugacccugaguuuuaaauucgaaaauaaagu

SEQ ID NO: 432184 - RNA, 62 nt, Human
uucuccucugauagggugcagcucacaccagugacccugacugugccacgcugcucgggaga

SEQ ID NO: 432185 - RNA, 62 nt, Human
ugaauucccucacucgucucccccaacagcuggacccugaccagcucccccucccuccccuu

SEQ ID NO: 432186 - RNA, 62 nt, Human
guuccugucccagaauggacccagggacaagagacccugagagcccugggacugggaguguc

SEQ ID NO: 432187 - RNA, 62 nt, Human
uagagacuggaacacuagacaagccagaacuugacccugagcugaccagccgugagcauguu

SEQ ID NO: 432188 - RNA, 62 nt, Human
uuccacgguccagcuagugccgcucagcccuagacccugacuuugcaggcucagcugcuguu

SEQ ID NO: 432189 - RNA, 62 nt, Human
guguggggaccgggcucugacagcccugcggagacccugaguccgggaggcaccguccggcg

SEQ ID NO: 432190 - RNA, 62 nt, Human
guaaggagacucuucuaagucuucaucucagagacccugaguucccacucagacccacucag

SEQ ID NO: 432191 - RNA, 62 nt, Human
cuagcccugggggaaugugaucuaccugaugcgacccugaguucuccccagagccuccuccu

SEQ ID NO: 432192 - RNA, 62 nt, Human
uugugguucccuaaagacaaguacauaaaggugacccugaugaaaccuugaaguucugaaau

SEQ ID NO: 432193 - RNA, 62 nt, Human
cuuguuagugcacuugaaagugggagaaugcugacccugaugacuuguacugauuccugagc

SEQ ID NO: 432194 - RNA, 62 nt, Human
cccgcccuggccaugugaucguguuggugacagacccugaugugcuggugcuguguccccaa

SEQ ID NO: 432195 - RNA, 62 nt, Human
ugaguucucuuccaguuugcagguguuccugugacccugacacccuccuucugcacaugggg

SEQ ID NO: 432196 - RNA, 62 nt, Human
ggcuaccaggccgacagcuacauccuccaacugacccugaucaacgaagagggauucaugug

SEQ ID NO: 432197 - RNA, 62 nt, Human
ugguaaacguggcagagcagaaugggaggcuggacccugaggaagggccccucuccuggcau

SEQ ID NO: 432198 - RNA, 62 nt, Human
ccggccugagcccccugccauagggaggggaggacccugagggcucagccagggaggggucc

SEQ ID NO: 432199 - RNA, 62 nt, Human
gaucuccagaaagccgccuguccuuccagcaugacccugagaccucuguguugguccugcgc

SEQ ID NO: 432200 - RNA, 62 nt, Human
ucucuggcaacacccuugucuccagcucagcagacccugaaggacacuuugagacaccaauc

SEQ ID NO: 432201 - RNA, 62 nt, Human
auaaagcacugacaucuccuuccuaauaaauagacccugaguucuguacaugccugacuccu

SEQ ID NO: 432202 - RNA, 62 nt, Human
ugaaguggccagaagggucauucggggcgggagacccugagccugcugagaaauccuuuuag

SEQ ID NO: 432203 - RNA, 62 nt, Human
uaggaccuuaagaaggagcucaugugagucaggacccugaauguuaggccucguuagcucua

SEQ ID NO: 432204 - RNA, 62 nt, Human
cagucucagccuucaaagcacuugacaucagggacccugaacccuuccccugggaggugagg

SEQ ID NO: 432205 - RNA, 62 nt, Human
ucacauuacauguuuaaucuggaaaccaaagagacccugaagaauauuugaugugaugauuc

SEQ ID NO: 432206 - RNA, 62 nt, Human
uacucugacaucacggaaaguguugaaccugggacccugaggaauucaccaggaguaaaugg

SEQ ID NO: 432207 - RNA, 62 nt, Human
gggagcacccuggcaccugggagcacagugaagacccugagagcauccuggcaccugggagc

SEQ ID NO: 432208 - RNA, 62 nt, Human
acgagagaaaguugagaagaacacgaagcacagacccugaugugauaaaacauuuugugguu

SEQ ID NO: 432209 - RNA, 62 nt, Human
aagucccuuccuauucuccugccaugggugcagacccugaacccacaccugggcaucagggc

SEQ ID NO: 432210 - RNA, 62 nt, Human
gcccuuuuccccguccaggccuugggggcucggacccugaacucagacucuacagauugccc

SEQ ID NO: 432211 - RNA, 62 nt, Human
gcccucacuacuggccaccugaccucacaccugacccugaccccuccucaccuauucucuuc

SEQ ID NO: 432212 - RNA, 62 nt, Human
gccccauagcagccauaccuggagcuggaucugacccugauuggggagagcugagugcugag

SEQ ID NO: 432213 - RNA, 62 nt, Human
cacccagacccaccacccguacacccucagcagacccugaagacuugcuuuuaaacaaagaa

SEQ ID NO: 432214 - RNA, 62 nt, Human
augacaguauuuuuucugaccaggagcugaaagacccugacauucaugauccaaagauauaa

SEQ ID NO: 432215 - RNA, 62 nt, Human
aaaucccugggucuagaaugggaacuggagaggacccugagaggagacgggcugggcggcga

SEQ ID NO: 432216 - RNA, 62 nt, Human
cuaaugcaguuuugcacaagguagaaguuagugacccugagaccaucuuaccacccuggacc

SEQ ID NO: 432217 - RNA, 62 nt, Human
aaauagaaaagggucagggcauggagaaaggugacccugaucccaaaccugcccucccaagu

SEQ ID NO: 432218 - RNA, 62 nt, Human
cagcccucugccgcuuguacauacgccauggggacccugaggaacugaggccacgucaaucc

SEQ ID NO: 432219 - RNA, 62 nt, Human
cccugauuuaggagaagccaggaauuucccaggacccugaaggggccaugauggcaacagau

SEQ ID NO: 432220 - RNA, 62 nt, Human
ggcaugucagacagaacuugaaugugucaggugacccugaugaaaacauagcaucucaggag

SEQ ID NO: 432221 - RNA, 62 nt, Human
cucuucucugguucauguccaccacugacugggacccugaagaggcauuucagaguguugga

SEQ ID NO: 432222 - RNA, 62 nt, Human
gguucuaaccaucaacaauugcaugguuaaaugacccugaacuaaaacugauggguucccua

SEQ ID NO: 432223 - RNA, 62 nt, Human
acagcgccguaagcacagugggugugaugcgugacccugaaugacacacuacagaaugugag

SEQ ID NO: 432224 - RNA, 62 nt, Human
gcagacaugugagaaguaagaaagaaacuaaagacccugaaugaauuugcagauuacccaug

SEQ ID NO: 432225 - RNA, 62 nt, Human
cacgcuccacucugcagcuuggacacccaguagacccugaauuucacucucucuaaaagguu

SEQ ID NO: 432226 - RNA, 62 nt, Human
ggaagagccugcaugucgcuggcccaaggcuggacccugaagcugauggaaccaccuaauac

SEQ ID NO: 432227 - RNA, 62 nt, Human
aucaaucagaaaauagacagguacacuaaagggacccugagaacuccucuuguaauuucaac

SEQ ID NO: 432228 - RNA, 62 nt, Human
gcuaaaaggaaucuaaucuuguugaggguagagacccugagacagugugaggggguggggac

SEQ ID NO: 432229 - RNA, 62 nt, Human
cuagcaguaaagagacauuggucaauugcucugacccugaugaauuauuaaacugagaucau

SEQ ID NO: 432230 - RNA, 62 nt, Human
aggagcugcggaaucagggcucaacacagggugacccugagaggaaccaacuccagguagag

SEQ ID NO: 432231 - RNA, 62 nt, Human
auuaaugucuguacgucaccuuuccuaguucugacccugagcccuggggaacaggaaagcgu

SEQ ID NO: 432232 - RNA, 62 nt, Human
acuacugcagugcaaccugggugacagagugagacccugacucagaaagaaccacuugccca

SEQ ID NO: 432233 - RNA, 62 nt, Human
gacugcugguuucucgcagccauugccugccugacccugaaccagcaccuucuuuuccgagu

SEQ ID NO: 432234 - RNA, 62 nt, Human
aguaccgucugaagcuccuggaggaggacgaugacccugaugacucggaggugauuugcagc

SEQ ID NO: 432235 - RNA, 62 nt, Human
aaccccgggaccgcccagccccgcaaagcaaagacccugacuucuccugcucuugagccagc

SEQ ID NO: 432236 - RNA, 62 nt, Human
uuggaauguggaucugguagugagccaucuuggacccugaagaggaggcaacacaccauugu

SEQ ID NO: 432237 - RNA, 62 nt, Human
accacuggauugcugacagauagaggaggugggacccugacuaucaccccuaaucugcagug

SEQ ID NO: 432238 - RNA, 62 nt, Human
cugggguggaggcccaggcagaacccugcauggacccugacuugggucccgucgugagcaga

SEQ ID NO: 432239 - RNA, 62 nt, Human
uuaugaggcccuucuaccaggguccggugggcgacccugacaaguaccgccugucucaggau

SEQ ID NO: 432240 - RNA, 62 nt, Human
guuucugucugggccuaucagguccauacuuagacccugagcaucuucuucauucagauuug

SEQ ID NO: 432241 - RNA, 62 nt, Human
ccccccuccccaggcuucaguuccuucccccugacccugacuccuugaacgucacugaaaac

SEQ ID NO: 432242 - RNA, 62 nt, Human
acagucccugccaauggacuaacuugucuuuggacccugaggcccagagggccugcaaggga

SEQ ID NO: 432243 - RNA, 62 nt, Human
cgccugcuuggguucugccaugccuggagcaugacccugagaucgugacaccacuugagugg

SEQ ID NO: 432244 - RNA, 62 nt, Human
uagugcugggacuagcccagaaacuugaaugggacccugagagagccagggguccccugagg

SEQ ID NO: 432245 - RNA, 62 nt, Human
aauuccagcaguaauuuaaaggcuuucagagagacccugagucuucucuucagguucacaaa

SEQ ID NO: 432246 - RNA, 62 nt, Human
agugucaguuccacgguuuccugccucccugagacccugaguccugccaucuaacugugauc

SEQ ID NO: 432247 - RNA, 62 nt, Human
aacauccuuaccuucacuguggccuuguuggugacccugaguuucuccuccaucaguacuuc

SEQ ID NO: 432248 - RNA, 60 nt, Human
uuucccuccagucauuguaguauuguuugugacccugagaaggcaaaagaaagaaccacu

SEQ ID NO: 432249 - RNA, 62 nt, Human
gcggcuauugcugaaccccuguccauccacgggacccugaaacuccacuuggccuaucugcu

SEQ ID NO: 432250 - RNA, 62 nt, Human
cagccccuggagcugcgcuugugguggagcuggacccugaaauuaccuggaccuuuuuuuua

SEQ ID NO: 432251 - RNA, 62 nt, Human
caaaagcagcccucugccuccuccccagggaagacccugaccguguacauagcccuggugcu

SEQ ID NO: 432252 - RNA, 62 nt, Human
ggugucguggguguuacgugcaggaacguggagacccugacgugggcucacugcguuugguu

SEQ ID NO: 432253 - RNA, 62 nt, Human
cucugggcccugaaccccugcuggggcuccacgacccugagagaaggggugagaagaaucau

SEQ ID NO: 432254 - RNA, 62 nt, Human
uccuguaccagcaguuugggagugccguccacgacccugacagucccagcccugcugcccca

SEQ ID NO: 432255 - RNA, 62 nt, Human
ggggcaggagggagaggagggaaaguauuucugacccugaugccaacagccggguggcuguc

SEQ ID NO: 432256 - RNA, 62 nt, Human
gagggugcagacugaugcucuucccugauggagacccugagaucuuccccacccccaaucau

SEQ ID NO: 432257 - RNA, 62 nt, Human
cgccauggcugucucaaaccaagcaaaggaaggacccugaggccuucacgcuaaccguccuc

SEQ ID NO: 432258 - RNA, 62 nt, Human
accuucaccuggaugugcagccccuuccuggugacccugaucacccucuggguguacgugua

SEQ ID NO: 432259 - RNA, 62 nt, Human
gggacagaguugaucguccaccuggccauuuugacccugaguggacagucacagccucagcu

SEQ ID NO: 432260 - RNA, 62 nt, Human
aaaagucugccccagaaacucucacacuuccagacccugagaaaaaagccacccugaauuua

SEQ ID NO: 432261 - RNA, 62 nt, Human
agccacguaggaacuuucuugagggauagguggacccugacaucccuguggccuugcccaag

SEQ ID NO: 432262 - RNA, 62 nt, Human
ccagauuccuccccagcagccgggucucuccagacccugauucggugccuuucuguuuacca

SEQ ID NO: 432263 - RNA, 60 nt, Human
agaaggucagagcccagugaagaucugggagacccugaacucagaaggcugugugucuuc

SEQ ID NO: 432264 - RNA, 62 nt, Human
ccccaguagccucaagcagcaccaauggggaugacccugacaggugcccucaggggucuggg

SEQ ID NO: 432265 - RNA, 62 nt, Human
ccagcaccccaccacagggcuagaggcccuaagacccugaaaaaggggcgggcaguagggaa

SEQ ID NO: 432266 - RNA, 62 nt, Human
uccucugcuuggggaguucuccaggagcuccggacccugagucaauguugggaggaagggua

SEQ ID NO: 432267 - RNA, 62 nt, Human
gaagagcagggccagccccggucagcaaggaagacccugagcaggaccguggaucaccugca

SEQ ID NO: 432268 - RNA, 62 nt, Human
cauuucauuuauuaaaguaucacaggcaagcugacccugauucuuuguaccaaaguuaagua

SEQ ID NO: 432269 - RNA, 62 nt, Human
augcccagcucagaggguuguucuccuagacugacccugaucagucuaagauggguggggac

SEQ ID NO: 432270 - RNA, 62 nt, Human
ucacuuauaccaugagugugccacuuucauuggacccugacuguauacagaaugaaaggcag

SEQ ID NO: 432271 - RNA, 62 nt, Human
caaaucaagagaacugacuugcaagcuaccuugacccugaauuuugcuguaguuggugcuca

SEQ ID NO: 432272 - RNA, 62 nt, Human
agccuggggucccuccacaccuuggcuuuuaugacccugauggcuucugaaacaggaaaaga

SEQ ID NO: 432273 - RNA, 62 nt, Human
aggggagagggaagcugcuuacuuuggggguagacccugaagccccuccuccuucccccaca

SEQ ID NO: 432274 - RNA, 62 nt, Human
ccugggggaggcuauaggauauaagcauuagggacccugaggcuuuaagugguuucuauuuc

SEQ ID NO: 432275 - RNA, 62 nt, Human
gcccacacuuuggaggggguccauguccaagagacccugacaaggaaggaguugagcccugg

SEQ ID NO: 432276 - RNA, 62 nt, Human
cgauauuucaggaagacuggcagauuggaccagacccugaauucuucuagcuccuccaaucc

SEQ ID NO: 432277 - RNA, 62 nt, Human
acguuucugaacuaagcaaggacaaauucagagacccugagcuuuagaaagacaagugggug

SEQ ID NO: 432278 - RNA, 62 nt, Human
ugacaggcaaaugcauuuccucuggaguuugagacccugacaaacaacagguggcaucuggu

SEQ ID NO: 432279 - RNA, 62 nt, Human
uccucagucucuccuuccccuugaaguagggggacccugaauuugcccauccaccuggguca

SEQ ID NO: 432280 - RNA, 62 nt, Human
uaagccacugcgcccggccuugcaugcucuuugacccugaauuugaccuacuugcuggggua

SEQ ID NO: 432281 - RNA, 62 nt, Human
cuugagcauggauacagccaggcccagagcaagacccugaagacccccaaccacggccuaaa

SEQ ID NO: 432282 - RNA, 62 nt, Human
ugcauuuuugcugagaccagcugggucauggagacccugacccagcagcucuagaggaauua

SEQ ID NO: 432283 - RNA, 62 nt, Human
ccagggugauuucaagccagggaagcaacugggacccugaaaacugucccuccccagcccgc

SEQ ID NO: 432284 - RNA, 62 nt, Human
ccuaauaccucuaccuuuccagccaaggcauggacccugacaccugccaacagccccucugc

SEQ ID NO: 432285 - RNA, 62 nt, Human
gagguucgagaucaaccugggcaagagagugagacccugacucuacgaaaauuaaaaguuag

SEQ ID NO: 432286 - RNA, 62 nt, Human
acacuccucugaagucuguguucaagaauuaugacccugaaggccgaggaacaaucucucag

SEQ ID NO: 432287 - RNA, 62 nt, Human
ggagggaugggagucccugcugaauaucuggagacccugacagguugcccugggcucugggu

SEQ ID NO: 432288 - RNA, 62 nt, Human
cuacucaggaagcugaggcagaaagaucccuugacccugagagguagaggcugcauugagcc

SEQ ID NO: 432289 - RNA, 62 nt, Human
accuugccuccccuccucuccugcccagcucugacccugaugcuuaauaaacgcagcgacgu

SEQ ID NO: 432290 - RNA, 62 nt, Human
gaacuggauccaaaaaaccauucaggccaagugacccugacaugugacaucuaccucccgac

SEQ ID NO: 432291 - RNA, 62 nt, Human
uccaaauccagacgcaggcccugaaaugaggggacccugacuggagaggugggggccaccaa

SEQ ID NO: 432292 - RNA, 62 nt, Human
ucccaauuugccacuugguauugaguacacuggacccugaccacuggcucuugggcaaacgu

SEQ ID NO: 432293 - RNA, 62 nt, Human
ucuauagguuuggcggggggccacagggaggggacccugacaauaaagagauuggaucccaa

SEQ ID NO: 432294 - RNA, 62 nt, Human
ucauucccaguaauucccuaccaaaugguggggacccugagcccagcucugaccagguagag

SEQ ID NO: 432295 - RNA, 62 nt, Human
aaguagccaugguaaggaggcuucauggggcagacccugaaagaucaaaacugcauuugcaa

SEQ ID NO: 432296 - RNA, 62 nt, Human
ucucaaccuuugcuaugguuauucugucuagagacccugagccaacuuucaaauugacgcau

SEQ ID NO: 432297 - RNA, 62 nt, Human
agaggccaggcccgauccuaccaccucgccuugacccugaagucagagcaggccagccaagc

SEQ ID NO: 432298 - RNA, 62 nt, Human
ggggaaacgugugugucaguuggaccaugugggacccugauggaccugaaagaccaggaucg

SEQ ID NO: 432299 - RNA, 62 nt, Human
ucugcuuuuacuuggggugggggggcggggcugacccugaacccucccccccgccaggucgg

SEQ ID NO: 432300 - RNA, 62 nt, Human
aucuguuuggggcauuggagggaaaaggaaaggacccugaagccaauaucugauucucggcu

SEQ ID NO: 432301 - RNA, 62 nt, Human
gcacuucccaacaauggccugcuguucacauggacccugagcaaggaaggagggagggaggg

SEQ ID NO: 432302 - RNA, 62 nt, Human
gcuuccuccaccaaaaaugcccaauucaggcagacccugaccucucccucaggcagcccaac

SEQ ID NO: 432303 - RNA, 62 nt, Human
uggaguccagaccugggcccugguucccccaggacccugaggguuuccaccuuggcgcgcag

SEQ ID NO: 432304 - RNA, 62 nt, Human
ccugccgucuccaacagggcaugucccgggaggacccugagugccagauuccccuggacgcu

SEQ ID NO: 432305 - RNA, 62 nt, Human
ugcugccguuccggugucagcgucgcccccgugacccugaggucgucaaugaugaguccucu

SEQ ID NO: 432306 - RNA, 59 nt, Human
accgccccucuucccaguagcucuucuaugacccugacgagugcgggcugaugaagaag

SEQ ID NO: 432307 - RNA, 62 nt, Human
ggacaagcaugcuuggaaccucagaaaagccggacccugaagcgccccacgguccuggagcc

SEQ ID NO: 432308 - RNA, 62 nt, Human
cucaccucccuggggaugaggggccaggccaugacccugaaagccuagcccuggccuugacc

SEQ ID NO: 432309 - RNA, 62 nt, Human
accuugcugugucuucucaagcuuuuaaaauugacccugaacgugugacaggguccuauggu

SEQ ID NO: 432310 - RNA, 62 nt, Human
ccagcguuguggccugagggaggcccugcugggacccugaucugggccuuccugucccaggg

SEQ ID NO: 432311 - RNA, 62 nt, Human
gucacguugggagaagagagagagugccaggagacccugagggcagccgguuccuacuuugg

SEQ ID NO: 432312 - RNA, 62 nt, Human
accagugggaagagggugagggcugauccagagacccugagccuacagcaaggcuguggugg

SEQ ID NO: 432313 - RNA, 62 nt, Human
uuggaguggaugcccuggggcuucacauuuaugacccugagaacagacugacccccaagauc

SEQ ID NO: 432314 - RNA, 62 nt, Human
gggauuauaggacucuccccaucucgggcccugacccugacccuugccaccaacccaaagac

SEQ ID NO: 432315 - RNA, 62 nt, Human
guggagcugggcaggcuugacugcuccuggcugacccugagcucucgcaguuggagggaagc

SEQ ID NO: 432316 - RNA, 62 nt, Human
agccgggguggggguggggguggggggggcaggacccugagaugccaccaggaccugauggg

SEQ ID NO: 432317 - RNA, 62 nt, Human
aaaugcaaagauguccacacuguuuuaaacuugacccugaugaaaaugugagcacuguuagc

SEQ ID NO: 432318 - RNA, 62 nt, Human
ucaaggcaacuuuggcuggcagucucugagaugacccugaaugauccccaccuccugguauu

SEQ ID NO: 432319 - RNA, 62 nt, Human
uugcacacuugaagcuguugcugcgacacgcugacccugacuuuuaucaauaccugcaagag

SEQ ID NO: 432320 - RNA, 62 nt, Human
gaaaccagcuggugauuuaugaagagaucagagacccugaggaagaugaugaguaacuccgu

SEQ ID NO: 432321 - RNA, 62 nt, Human
gaaaacagcuggugauuuaugaagagaucagcgacccugaggaagaugacgaguaacuccgu

SEQ ID NO: 432322 - RNA, 62 nt, Human
cugaucuugaguuuggaacugacaaguugugugacccugagcaagucaguuaaccuaucuga

SEQ ID NO: 432323 - RNA, 62 nt, Human
cacagggaauggccacaaaccugcccgccuaagacccugaauccguacuugggucacaugac

SEQ ID NO: 432324 - RNA, 62 nt, Human
auguuuugguccacuuuuccaguauuuuaguggacccugaaaugugugugaugugacauuug

SEQ ID NO: 432325 - RNA, 62 nt, Human
uuuugucuuagccacaagaauuccgaggucuugacccugaugaucaaccugccuccccucca

SEQ ID NO: 432326 - RNA, 62 nt, Human
gagcggcccacggccaggucggagcaguacuugacccugagcggcgcccacgaccucagcga

SEQ ID NO: 432327 - RNA, 62 nt, Human
uaauagucacaggagcugcagcucagcagagagacccugaacucugcuaagggaaggucuug

SEQ ID NO: 432328 - RNA, 62 nt, Human
caacaguugugacaguggcugagccuagcacagacccugacagagaccccccucggccucaa

SEQ ID NO: 432329 - RNA, 62 nt, Human
uguguggguacccccccuucuacgacgagagcgacccugagcucuucagccagauccugagg

SEQ ID NO: 432330 - RNA, 64 nt, Human; identical to SEQ ID NO: 58197

SEQ ID NO: 432331 - RNA, 64 nt, Human; identical to SEQ ID NO: 58205

SEQ ID NO: 432332 - RNA, 64 nt, Human; identical to SEQ ID NO: 58210

SEQ ID NO: 432333 - RNA, 64 nt, Human
gacacccaggaggaauugaaagaggcuuccucuucucaggaagaagccauuuccuucucauaua

SEQ ID NO: 432334 - RNA, 64 nt, Human
aagauaagaaaaucuccauguuguauccauuuggcucaggaagauucuuugccuuaccuuucuu

SEQ ID NO: 432335 - RNA, 64 nt, Human
ccaagaaagggaauaugaauguauauccaagucacucaggaacuuuuaugcaggugcuagaaac

SEQ ID NO: 432336 - RNA, 51 nt, Human
ccgagauugcugaugagugagcucaggaacuaaccuaccccaacucugccc

SEQ ID NO: 432337 - RNA, 64 nt, Human
gugggacaggcuuaggggaaagagcuuguccuaucucaggaacaaaauuauaggcugugggcag

SEQ ID NO: 432338 - RNA, 64 nt, Human
cguagcaggguggugaggaggguggcugugggggcucaggaagcucgcccaggggccaaugugg

SEQ ID NO: 432339 - RNA, 64 nt, Human
cugcaguugagggggcgaagaagaacccuguguucucaggaagacugccuccaccaccgcuacc

SEQ ID NO: 432340 - RNA, 64 nt, Human
gagucagaaagcaagaccaggaagcaaauagcagcucaggaaaucccacgguugacuugccuug

SEQ ID NO: 432341 - RNA, 64 nt, Human
agacaggaaaggguagcagaaaacagcuucacuccucaggaaguaccauggacagacgccuacc

SEQ ID NO: 432342 - RNA, 64 nt, Human
uaccauguuggacauuugccccuaucaguugcuccucaggaaucuucugguacagguuaacauc

SEQ ID NO: 432343 - RNA, 64 nt, Human
agggcuggggucagccacugccaauccugccuuacucaggaaggcaggaggaaagagacugccu

SEQ ID NO: 432344 - RNA, 64 nt, Human
gccuucuucccaacccuucuugaacugucguuuccucaggaacugggucuuccugauuguugaa

SEQ ID NO: 432345 - RNA, 64 nt, Human
aagaagaaaacuauagcaggguacaaugcuugggcucaggaaguuucucugugcaacuagaaaa

SEQ ID NO: 432346 - RNA, 64 nt, Human
gaccucagguuccuaagacuucaguccuggucugcucaggaauugaagauguaaggaauugaag

SEQ ID NO: 432347 - RNA, 64 nt, Human
cuggugcacucugcuaguuguuaucucuguagggcucaggaagcuggaaggaggaagggagggu

SEQ ID NO: 432348 - RNA, 62 nt, Human
gacaaucuugcaacacccgggcauguuugucgucguccuacaaaugaggaaaccgagccuau

SEQ ID NO: 432349 - RNA, 62 nt, Human; identical to SEQ ID NO: 431293

SEQ ID NO: 432350 - RNA, 62 nt, Human
gaaggugguggacacucgugauggaauggaaaucguccuaccgugcagccacacccugcccu

SEQ ID NO: 432351 - RNA, 64 nt, Human; identical to SEQ ID NO: 58218

SEQ ID NO: 432352 - RNA, 64 nt, Human
uauaccagaggguuaguuggggaaaaacuucauucucaggaaaagacuugaaugauuaugugac

SEQ ID NO: 432353 - RNA, 64 nt, Human
ugacugcauugaggcgcucuauucuucuucaccucucaggaacugacuuuuauuuuuucuguca

SEQ ID NO: 432354 - RNA, 64 nt, Human
uuccuugugacaagaaauuugcaagcuuuucaaucucaggaauacuggauucuauagccaagaa

SEQ ID NO: 432355 - RNA, 64 nt, Human
cuuccccaaaccaugugcuuauuagaugguuccacucaggaagcaaggaagcuaaaacucaagu

SEQ ID NO: 432356 - RNA, 64 nt, Human
uccuaaaaggcagaguacaaaguaagccauguaucucaggaagguaacuucauuuugucuauuu

SEQ ID NO: 432357 - RNA, 64 nt, Human
ucucuuuuaaacuauuauaugauucauaaugguucucaggaauuaauaaaugauuacuguguuu

SEQ ID NO: 432358 - RNA, 64 nt, Human
guugaucaaugcaucaguuaagaaauaaugccaccucaggaauuaacuggcauugggaacauuu

SEQ ID NO: 432359 - RNA, 64 nt, Human
uaacggggagaggugccuggcuucuaccugggugcucaggaauguuccucgucaccccugccac

SEQ ID NO: 432360 - RNA, 64 nt, Human
aauacaauacaguacucaguuaggcagugcaguacucaggaaugcagcacaguacucaggcagu

SEQ ID NO: 432361 - RNA, 64 nt, Human
cuuggcagggccuuggaggccucugguuggcucucucaggaagagggcaggucagggauugggc

SEQ ID NO: 432362 - RNA, 64 nt, Human
guuccagccccagguauuaggacucagggcuccccucaggaagcugggcccagcugggauugcc

SEQ ID NO: 432363 - RNA, 64 nt, Human
gaucuggggagagcggcuggagaaagaugcaguccucaggaagggggccgccacccuccccuau

SEQ ID NO: 432364 - RNA, 64 nt, Human
cgcugacccugcgggcaucugacuggucuuccagcucaggaaaaagaauuugaaagaggcuuag

SEQ ID NO: 432365 - RNA, 64 nt, Human
ggguguggugccggcaucugcucuuggugagggccucaggaagcuuagaaucauggcagaaggg

SEQ ID NO: 432366 - RNA, 56 nt, Human
uaaugauuuucuagacauaguccucacucaggaacugaaaguucugugaagaauuu

SEQ ID NO: 432367 - RNA, 64 nt, Human; identical to SEQ ID NO: 58226

SEQ ID NO: 432368 - RNA, 64 nt, Human; identical to SEQ ID NO: 58233

SEQ ID NO: 432369 - RNA, 64 nt, Human; identical to SEQ ID NO: 58239

SEQ ID NO: 432370 - RNA, 64 nt, Human
accuuccagugucucccuccagcccagcccugaccucaggaagugucagagcauggccaguagu

SEQ ID NO: 432371 - RNA, 64 nt, Human
gugaaaucugucccgugggaauccugaagucugacucaggaaugcccagaccugucccuguccc

SEQ ID NO: 432372 - RNA, 64 nt, Human
uauccuuuaccccaccuuauacacacgaggcuuucucaggaaguggcucugccaggcaggacua

SEQ ID NO: 432373 - RNA, 64 nt, Human
uggaaugcugcccugaggguggggcuggcucuuacucaggaaacugcugugcccaacccaugga

SEQ ID NO: 432374 - RNA, 64 nt, Human
acucagcccucgauagucuagagcccacccccuccucaggaacucaagagcucagcauuuauaa

SEQ ID NO: 432375 - RNA, 64 nt, Human
acaagcugaauauuuaguagaaaugaugcuucugcucaggaauggcccacaaaucuguaauuug

SEQ ID NO: 432376 - RNA, 64 nt, Human
aaguaguagucagaaaauuguuaauuuccuaaagcucaggaaacuagggugucacuuuuuuugc

SEQ ID NO: 432377 - RNA, 64 nt, Human
cauguaauaaagcauuggcuaaaucuuaaagaaucucaggaagaacagacuuccuccuaagaag

SEQ ID NO: 432378 - RNA, 64 nt, Human
gcaauagauuuugccuucaaggguuccuguggaucucaggaaggcaucaguguugauuaacacu

SEQ ID NO: 432379 - RNA, 64 nt, Human
uugugcaacaaagaugcauuuaccucuguaucaacucaggaaaucucauaagcugguaccacuc

SEQ ID NO: 432380 - RNA, 64 nt, Human
caagugugguggugugcaccuauagucccagcuacucaggaagcugagacaagaggaucaauug

SEQ ID NO: 432381 - RNA, 64 nt, Human
acugucuccugacagccagcacuguguauuaucacucaggaaccagcggaucugcaaagaccua

SEQ ID NO: 432382 - RNA, 64 nt, Human
ucaaaagucaccucucagagaccuacgucauccacucaggaauucgcgccucucauacuugccu

SEQ ID NO: 432383 - RNA, 64 nt, Human
auccugucuuugggggcaaugugucaaaaguccccucaggaauuuucagaggaaagaacauuuu

SEQ ID NO: 432384 - RNA, 64 nt, Human
ggguuguucuauacaccuguguccuuaccccaggcucaggaacugccagggagggaagaugagg

SEQ ID NO: 432385 - RNA, 64 nt, Human
aaaacaggcugauuucaauuaggcagcacuucccaaagugcacugaggaagguggccccaagag

SEQ ID NO: 432386 - RNA, 64 nt, Human
caagaaaucugaaugaucuggaccaggggucagcaaagugcagccuacaagcuauugcagucag

SEQ ID NO: 432387 - RNA, 64 nt, Human
uguauuaucuuccauaagugccagaaauugguacaaagugcagugccagcugcuccccagggca

SEQ ID NO: 432388 - RNA, 64 nt, Human
cugacucuuuuucuuguuuugucugccauucuugaaagugcaucuugagagcccccauuuguug

SEQ ID NO: 432389 - RNA, 64 nt, Human
ggaauugaauagcagagagcaaaccaaucagucccucaggaaagggaagaaaaagaagaggugg

SEQ ID NO: 432390 - RNA, 64 nt, Human
uuaggccugccgcaggccccacccucaagcauuccucaggaagcgucucacucugggagccuug

SEQ ID NO: 432391 - RNA, 64 nt, Human
uugcuaggauuaagguuauucuaauugcuuuacucucaggaaaguguaauaacgcaugggaauu

SEQ ID NO: 432392 - RNA, 64 nt, Human
ugcaaccacuuacccuuucucugaaaaaccuguucucaggaaggaucugauaaacucauuuacu

SEQ ID NO: 432393 - RNA, 64 nt, Human
gagggcagucccccauggggugccgagccaacgccucaggaaucaggaggccagccugguacca

SEQ ID NO: 432394 - RNA, 64 nt, Human
cuggccucccuuccccagaggcugguguccagaacucaggaaugggccugguaggccccaggcc

SEQ ID NO: 432395 - RNA, 64 nt, Human
ucccuucccuuucaagcauaaguccaaauagacucucaggaaugaagauuugugaagacaucag

SEQ ID NO: 432396 - RNA, 64 nt, Human
cucaggcccaggaggugggagaaggucacagagccucaggaauuuccaagucagaguccccuuu

SEQ ID NO: 432397 - RNA, 64 nt, Human
gaggcucagggaaaggccagugugaaccgaggggcucaggaaaacgggaccggccaggccaccu

SEQ ID NO: 432398 - RNA, 64 nt, Human
uccucugacaaguuaccucaccuaauuuuugcuucucaggaaugagaaucuuuggccacuggag

SEQ ID NO: 432399 - RNA, 64 nt, Human
gcaggaaauccgaauugcccauaugcucuugggccucaggaagagguugaacaaaaacaaauuc

SEQ ID NO: 432400 - RNA, 64 nt, Human
auugccagccucauuccaugccacuaugagucaacucaggaaaacugcgagugcauuugaggcu

SEQ ID NO: 432401 - RNA, 64 nt, Human
uuauggugcaguaauuuuccggggaaaguaaagccucaggaaugcccacgccuuucuuccaaag

SEQ ID NO: 432402 - RNA, 64 nt, Human
aauuaaagcuuuagguuccaagaagauucugggacucaggaagaaaaagugccaucaggugacc

SEQ ID NO: 432403 - RNA, 64 nt, Human
agaaauuaauuuagcuucaauaauugugacuggccucaggaauucucccuuccacaccugccca

SEQ ID NO: 432404 - RNA, 64 nt, Human
cuauuaagaaaaaaaauguuaacauuaugauuuaaaagugcauuaaccuuaaucuagauaauaa

SEQ ID NO: 432405 - RNA, 64 nt, Human
uuuuggaaauacagugaccucuugcagugucacaaaagugcaaagugauauuagcugucaucug

SEQ ID NO: 432406 - RNA, 64 nt, Human
auagcugugccauaagugcuugugagguauuugcaaagugcaugauaguaaugcucggaguuuu

SEQ ID NO: 432407 - RNA, 64 nt, Human
acaacaauguguuguaaaaaugucuuucauguaaaaagugcaguaaauauuuacuauuuauaau

SEQ ID NO: 432408 - RNA, 64 nt, Human
ggcaagacgagaaacucugaagaaagcucugacucucaggaaguuaucuggaaagauaccugga

SEQ ID NO: 432409 - RNA, 64 nt, Human
auuauguuuaacuggaguugucaaguaugagucccucaggaaaaaaaaaaaauucuguuuuaaa

SEQ ID NO: 432410 - RNA, 64 nt, Human
aaccccaucucccacucagaaaucaccucccagccucaggaagaguagaaauuggguggugcuc

SEQ ID NO: 432411 - RNA, 64 nt, Human
acucugggaggcugaggugggcggaucacuugagcucaggaauucaaggucagccugggcaaca

SEQ ID NO: 432412 - RNA, 64 nt, Human
caggagucaccagggcacagcccuccaggcccgccucaggaaggaaugaaaggaaugccaucau

SEQ ID NO: 432413 - RNA, 64 nt, Human
gucaucacucaagcucccguaaggauauuaccgucucaggaaaggaucaggacuccaugucaca

SEQ ID NO: 432414 - RNA, 64 nt, Human
ccaggcaaacgcacacuagugucugacuggaaagcucaggaauuuuaaucuugcacuguuuccc

SEQ ID NO: 432415 - RNA, 64 nt, Human
uguaggaacuuuucuuuggcagaccaagugaagacucaggaauggugugcauuauaaaugacac

SEQ ID NO: 432416 - RNA, 64 nt, Human
aaaguuuaaagcuuugcugaaaacugaauucauucucaggaauuucauaaaucuucuccccagg

SEQ ID NO: 432417 - RNA, 64 nt, Human
guaggaggugcuuuuaaugugcugauaaaccaaccucaggaagguauuauguacagaagauucc

SEQ ID NO: 432418 - RNA, 64 nt, Human
uaaugcuugaguaucucuucuuucccuuuccugucucaggaaucagcugagaauucauucgauu

SEQ ID NO: 432419 - RNA, 64 nt, Human
agauugcacaucauucuuuaaggcauacuuuuaccucaggaaacuuacucuaguauguucucau

SEQ ID NO: 432420 - RNA, 64 nt, Human
ccuuucaagaauauuagauaauuggagcugaguacucaggaacuugacuguaguagaauacugc

SEQ ID NO: 432421 - RNA, 64 nt, Human
cuuccuuguuuuaaaaaaugaucauuuggguucacucaggaaaugcaugucaggaaacuuguau

SEQ ID NO: 432422 - RNA, 64 nt, Human
aucuaaugcuaugcuggauaugaacuuuuggggccucaggaaagaaaaaccaggaacuaguuuc

SEQ ID NO: 432423 - RNA, 64 nt, Human
ucuauuuuuguuuauuuaagcaacacuuaauguaaaagugcaacaggcaauugaauccaaauuu

SEQ ID NO: 432424 - RNA, 64 nt, Human
ucuaaugaaacaaaaauguuucucaaaaucuagaaaagugcauauaaauuuuuguucauuuaga

SEQ ID NO: 432425 - RNA, 64 nt, Human
gguuugauggagccucauuucccuuugugaacacaaagugcaaaaugaauucuuuuuaauuuua

SEQ ID NO: 432426 - RNA, 64 nt, Human
aaccuuaaguuuuuauuugagaaugugaaaguacaaagugcaguagacuucaacaaucuugagu

SEQ ID NO: 432427 - RNA, 64 nt, Human
acggucgccucaugaaaguguguagcagguggcucucaggaaaaauaccaagucuggaucaucc

SEQ ID NO: 432428 - RNA, 64 nt, Human
ggcacaguuuucugagaaagacuauucaaacagucucaggaaaucaaauaugcaaagcacugac

SEQ ID NO: 432429 - RNA, 64 nt, Human
aaagucacuaacaaccaaacaaaaacagaaacuucucaggaaauuagaucgacuggagaagaaa

SEQ ID NO: 432430 - RNA, 64 nt, Human
gcgccucaguccaucccauuuuagucuuuaaacccucaggaagucacagucuccggacaccaca

SEQ ID NO: 432431 - RNA, 64 nt, Human
uuauccuguauuccuuuggcuuggcaucuuuuagcucaggaagguagaagagaucugugcccau

SEQ ID NO: 432432 - RNA, 64 nt, Human
gccguggcuaggauuccacuuccugugucaugaccucaggaaauaaacguccuugacuuuauaa

SEQ ID NO: 432433 - RNA, 64 nt, Human
cgguucccacccggggccaaccucuccacgcgcacucaggaaagugaccagugaccacuggcgu

SEQ ID NO: 432434 - RNA, 64 nt, Human
cauccccacaccccauugccacuuauuuauucaucucaggaaauaaagaaaggucuuggaaagu

SEQ ID NO: 432435 - RNA, 64 nt, Human
gagagaaucagaccuggguggaacucuccugcuccucaggaacuaugggagccucagacucauu

SEQ ID NO: 432436 - RNA, 64 nt, Human
gaggaggaggaggagauugaugacaagcaaguuacucaggaaucaaaagagaaaaaaguuucug

SEQ ID NO: 432437 - RNA, 64 nt, Human
ugcuuuucucuguugccacauuuuccucagguuacucaggaaaaugcuccagcaugugcgagca

SEQ ID NO: 432438 - RNA, 64 nt, Human
uggugacuuggaaggccgcuucugcaaggcaagucucaggaacccaugcagguacaucgcuugc

SEQ ID NO: 432439 - RNA, 64 nt, Human
agagauuguguucuuccucucucaggggugauaacucaggaagccucuggguugggaagaccau

SEQ ID NO: 432440 - RNA, 64 nt, Human
gagaucugggcuggagcuagggggucaauggaugcucaggaagagcugggccuuuggcacuugu

SEQ ID NO: 432441 - RNA, 64 nt, Human
ugugucucuucaauaccuuugguuuugggaagaucucaggaacggccugccucaccgucuaugg

SEQ ID NO: 432442 - RNA, 64 nt, Human
agggaauuccugcuaugacagcuggcuagcauuccucaggaaggacaugggugccccccacccc

SEQ ID NO: 432443 - RNA, 64 nt, Human
aucuaaucuaauaauugugccccgcaguugugccaaagugcauagucugaguaaaaucuaggug

SEQ ID NO: 432444 - RNA, 64 nt, Human
uucugacuggaaaaucuugucauucuaacacugaaaagugcacacgcaugacaaaauguagaca

SEQ ID NO: 432445 - RNA, 64 nt, Human
agggugcauccaguauaccauugagcauuguaaccucaggaaacaguuuauuuuggguucugau

SEQ ID NO: 432446 - RNA, 64 nt, Human
aaugcaaagugucauucucuggaauugcaccuggcucaggaaaggacugucuuuguacuugaau

SEQ ID NO: 432447 - RNA, 64 nt, Human
aaaguggcuaccaaccagggucccaaagcccaaccucaggaagaaggcccuacagauuugccau

SEQ ID NO: 432448 - RNA, 64 nt, Human
ugcagucaaggccaaccuaggcagcagccaccuucucaggaaacaaggccuuggagaaaucagu

SEQ ID NO: 432449 - RNA, 64 nt, Human
cuuuugucaccuuacguuucauagcuuuaguauacucaggaaaagaaugaccaucuuuuguaga

SEQ ID NO: 432450 - RNA, 64 nt, Human
cuggccccccagguaggcggagagcagucccucccucaggaacuggaggaggggacuccaggaa

SEQ ID NO: 432451 - RNA, 64 nt, Human
auuauggauacguguuuugaauugcaaacuauuccucaggaauuccaauuaaauuuauuuuacu

SEQ ID NO: 432452 - RNA, 64 nt, Human
gucccuguaucugcgccacugccgcaagggaagccucaggaaccagcaccuggaggccaggaua

SEQ ID NO: 432453 - RNA, 64 nt, Human
ccuguugguguucugaugccuguucagcuuuguccucaggaagguuuggucaucuugguucugc

SEQ ID NO: 432454 - RNA, 64 nt, Human
ugcaggcagaggagauugggucuugacugguguccucaggaaggaagccccugggauggagugc

SEQ ID NO: 432455 - RNA, 64 nt, Human
gcgguacagggagggaacuggugcauauuuuagccucaggaauaaagauuugucugcucaacuc

SEQ ID NO: 432456 - RNA, 64 nt, Human
agugaaacagaauuugaacuguaagcaagcauuucucaggaaguccuggaagauagcaugcgug

SEQ ID NO: 432457 - RNA, 64 nt, Human
ugacuuguaauggacccugacuggaaugugaucccucaggaacuuaguagccugagucuuucag

SEQ ID NO: 432458 - RNA, 64 nt, Human
uuagucagccccggcagcagggcagccaugggaacucaggaaaagcaggaacccuuuccaaaag

SEQ ID NO: 432459 - RNA, 64 nt, Human
uauuuccaaagccaccucauuuccaaacaucucacucaggaagggaggcucaauguaaccucag

SEQ ID NO: 432460 - RNA, 64 nt, Human
gugaauaaaaugaaugaauuacaaugaacaaagaaaagugcaaaauaacacuaacaaguaaaua

SEQ ID NO: 432461 - RNA, 64 nt, Human
aacgcuaugauauauaacagcucuagcuagugguaaagugcacagucccagcuuaauucagggc

SEQ ID NO: 432462 - RNA, 64 nt, Human
uugucucuacuguguacucugaucguaucuuuccaaagugcagacucuugugaaguuuucuuaa

SEQ ID NO: 432463 - RNA, 64 nt, Human
gauggagcagaaugagcagaugcagaucaccagcaaagugcacugaugugugagcucuuaagac

SEQ ID NO: 432464 - RNA, 64 nt, Human
uacaggacugucugucuccugccccaugaugacccucaggaauugcaaaggcucugcugucaca

SEQ ID NO: 432465 - RNA, 64 nt, Human
guuugaugaaaauaucugaagcuauuauggaaauaccauguaauagggagaguugaacaugaau

SEQ ID NO: 432466 - RNA, 64 nt, Human
gguagaaucauaccccauggauaccacauauuaaaccauguauaucuguggaauacucaaugug

SEQ ID NO: 432467 - RNA, 64 nt, Human
uuauuucuagucuuguacuucuggcuuaaguauaaccauguaagaauuauaaauuuuaguuuuc

SEQ ID NO: 432468 - RNA, 64 nt, Human
cuucugggaguggaggucucaggcucaauccggaaccauguacguacaguuuugcuuauuauuu

SEQ ID NO: 432469 - RNA, 64 nt, Human
aaucugaaaauaugucaaauuacguguuuuuaugaccauguaauguuuuaaaggcaccuacuug

SEQ ID NO: 432470 - RNA, 64 nt, Human
aaaucuacagcaaaaguaaaacaguagagugaacaccauguaacccucaccugguguuaacauu

SEQ ID NO: 432471 - RNA, 64 nt, Human
ucauuuucaucuuguuuucuucuugcuaagucuuaccauguaccugcuuuggcaaucauugcaa

SEQ ID NO: 432472 - RNA, 64 nt, Human; identical to SEQ ID NO: 432469

SEQ ID NO: 432473 - RNA, 64 nt, Human
guuuggcugugcgugugaacacgugugugaguucaccauguacuguacugugauuuuuuuuuug

SEQ ID NO: 432474 - RNA, 64 nt, Human
gugacaugguaaaaguacaugguacuuuuacaguaccauguacuguacaaaauaaaggucucuu

SEQ ID NO: 432475 - RNA, 64 nt, Human
auauauugugaagugugaaaaaguagguugcugaaccauguauauaguauguuccccuuugugu

SEQ ID NO: 432476 - RNA, 64 nt, Human
ccaauuucaagcuuauuuuaggaagccuugaacuaccauguauccuggcuccuagcugaguuua

SEQ ID NO: 432477 - RNA, 64 nt, Human
gaagccaucagcaucuggcaggcacaccugagucaccauguagcgcugcuacuggagguagaga

SEQ ID NO: 432478 - RNA, 64 nt, Human
ugugccuauuaccucagcauuucucacaaaguguaccauguagcauguuuuguguauauaaaag

SEQ ID NO: 432479 - RNA, 64 nt, Human
cuccaggcuuggcugagacggacgguagacuuccaccauguaccgaucacaucccagcucugca

SEQ ID NO: 432480 - RNA, 64 nt, Human
acagcccccucgccccugccucccuugccccuaccccggcgaagcauguuccccccgacgcccc

SEQ ID NO: 432481 - RNA, 64 nt, Human
uccuuguguuuuguccugccucuuguuucugugccccggcgaggccggagagcuggugacuuug

SEQ ID NO: 432482 - RNA, 64 nt, Human
gcucacuuuaagaacuuuuaccgacuccaaaaaucucaggaauuaaacuuuuaacaguuacagc

SEQ ID NO: 432483 - RNA, 64 nt, Human
caggauucuuccuucagugcugaggcaggucgggcucaggaacugcagggacgugaacaugcgc

SEQ ID NO: 432484 - RNA, 64 nt, Human
cuuaaaaaaaugaauuaugaccuguuaggcugagcucaggaauuguccaaaaaggaaaaagcaa

SEQ ID NO: 432485 - RNA, 64 nt, Human
aguuaguaauuucauuuuaaaauuucuguagaagcucaggaauuaugauuaaucaccaucugcc

SEQ ID NO: 432486 - RNA, 64 nt, Human
uaugcaaacuugccuccugcuguuaucugugaagcucaggaaauccaaacauuuguguuucaac

SEQ ID NO: 432487 - RNA, 64 nt, Human
aagaauuaagaugaucccaauaaaagaaaaauugcucaggaaacugaaccuuuuucugaaccaa

SEQ ID NO: 432488 - RNA, 64 nt, Human
augaccuaucuuaagugauuuucccacaaucaaacucaggaacaauagauuauuucuguuuuac

SEQ ID NO: 432489 - RNA, 64 nt, Human
cagaugugguggcgcacaccuguaaucccagcuacucaggaagcugaggcaggaaaaucgcuug

SEQ ID NO: 432490 - RNA, 64 nt, Human
cgacauucaggauuuaagucugagguagucaacccucaggaaaaaaaaaauggcuuaucugaaa

SEQ ID NO: 432491 - RNA, 64 nt, Human
gacagucuuuccccagcaggggucaggggggccccucaggaagccuaaggucgugcuagugugg

SEQ ID NO: 432492 - RNA, 64 nt, Human
cuucaacaggggcaagaggaggggccggccccuccucaggaagcugguaugaguaaggccuuga

SEQ ID NO: 432493 - RNA, 64 nt, Human
aauauagaacuguuggguucuguuacuucugacacucaggaagauacuauugguguauuaauuu

SEQ ID NO: 432494 - RNA, 64 nt, Human
ccuuguuaggauuccagacuggaaaguuggaagucucaggaaaugcauguuuccaugaguuuuu

SEQ ID NO: 432495 - RNA, 64 nt, Human
ugaacaaaacugaccuugacuacucaguccagcgcucaggaauaucguaaccaguuuuuucacc

SEQ ID NO: 432496 - RNA, 64 nt, Human
cuugcacugcuauuuacuagcagugagaagaaaccucaggaaaggauaugaaaaagcaaguggc

SEQ ID NO: 432497 - RNA, 64 nt, Human
uuuaggugagauaauauauucacaaugauacacaaaagugcacacugugugcucccuuuaccau

SEQ ID NO: 432498 - RNA, 64 nt, Human
uuuucauuaauuuuugaagauacuuguggcuggaaaagugcauuccuuguuaauaaacuuuuua

SEQ ID NO: 432499 - RNA, 64 nt, Human
gccuuuuuuuuuuuuaaguagaaaaauuguuuccaaagugcaugucacaugccacaaccacggu

SEQ ID NO: 432500 - RNA, 64 nt, Human
cccuagaaaaaaauuguucuuauuguugaauaaaaaagugcacagugugauuguuuacaaaaug

SEQ ID NO: 432501 - RNA, 64 nt, Human
agcuuuaaaaguuuccgucacacacaauucucuucucaggaaguauuucucauuuaggucuuca

SEQ ID NO: 432502 - RNA, 64 nt, Human
aacccccaaaugcccuugggaggaacaacaugagcucaggaagccucucuuucuucacuuacca

SEQ ID NO: 432503 - RNA, 64 nt, Human
gggagauuccagaucacacaucacacucuggggacucaggaaccaugccccuuccccaggcccc

SEQ ID NO: 432504 - RNA, 64 nt, Human
uugggacuguggaagcaucagaugccagcacugacucaggaacagcaagucagggcagagagga

SEQ ID NO: 432505 - RNA, 64 nt, Human
uccaguccugauagucuguggauuucggauccuucucaggaagcuucaugucuaauggagacua

SEQ ID NO: 432506 - RNA, 64 nt, Human
cugggggaaaagccuggguuggguuuagaaagaucucaggaaaaugaguuucucuucccucagg

SEQ ID NO: 432507 - RNA, 64 nt, Human
cagcugagagagagucacagaaaggccagagggucucaggaaggucuggaggucacagcugggc

SEQ ID NO: 432508 - RNA, 64 nt, Human
acaacacacagagcacaaauaugcuccugacggacucaggaaaaugccaacagcagagcacccu

SEQ ID NO: 432509 - RNA, 64 nt, Human
caggcgaaguggcacacaucuguggucccaggugcucaggaagcugaggugggaggaucacuug

SEQ ID NO: 432510 - RNA, 64 nt, Human
cagcugaguucagcagaaaggaggaauccuggcccucaggaagaagauagucacauguuuuucu

SEQ ID NO: 432511 - RNA, 64 nt, Human
agauugcugcugcccuuagggucucagcucccuccucaggaaucccucuuaggaaggacccuca

SEQ ID NO: 432512 - RNA, 64 nt, Human
uccaccccacgcugaugcagaagcucccagaacacucaggaaacuucuccggacagagcccucc

SEQ ID NO: 432513 - RNA, 64 nt, Human
uggccaggcuuccacauuccugaagcacacagaucucaggaaagguuauuuuugcacuucauau

SEQ ID NO: 432514 - RNA, 64 nt, Human
aaagcaguuagacuauggagagccgacccagccccucaggaacccucauccuucaaagacagcc

SEQ ID NO: 432515 - RNA, 64 nt, Human
cucugguuggauggaaaucaacugucagaauuaccucaggaaauaggaaaucugaagaaccugc

SEQ ID NO: 432516 - RNA, 64 nt, Human
aaauauuuaaaccugcugaaggauuuauuuauaaaaagugcaauuuuucaaaacacauuauuau

SEQ ID NO: 432517 - RNA, 64 nt, Human
uuaggaaaaguaaaauccaaaauguuagcaaaacaaagugcaauauuaaauguuugcuuuauag

SEQ ID NO: 432518 - RNA, 64 nt, Human
auggaaguuuuccauucacuggggaaaggagggaaaagugcauuuauuuuuauacagaguuacu

SEQ ID NO: 432519 - RNA, 64 nt, Human
guguauuugugucuuguuugcauacugcauaccaaaagugcaguugucauuuguucccaaguga

SEQ ID NO: 432520 - RNA, 64 nt, Human
auaauauucuucaagaaauaauguugaaagccuacucaggaauaaucuuccuuaacucuuuaaa

SEQ ID NO: 432521 - RNA, 64 nt, Human
ugggcauggcagugcgugccugcaaucccagcuacucaggaagcugaggcaggagaaucgcuug

SEQ ID NO: 432522 - RNA, 64 nt, Human
ccgcugggcugacagacuccucaucuucaggagacucaggaauggagcggcacaggggucucuc

SEQ ID NO: 432523 - RNA, 64 nt, Human
uauaaccuuucagcacauuccaagguuuuaguuacucaggaaggaguuaauuaaaaugauuuua

SEQ ID NO: 432524 - RNA, 64 nt, Human
uauuauuauuaauuuuuuuuguuggcaaaagaaucucaggaacggcccugggccaccuacuaua

SEQ ID NO: 432525 - RNA, 64 nt, Human
aucucuuuaguuagugauuauauuucacccaucucucaggaaucaucuccuuugcagaaugaug

SEQ ID NO: 432526 - RNA, 64 nt, Human
gggggagggaaagggagaggggaagggcaggggacucaggaagcaggggguccccauccccagc

SEQ ID NO: 432527 - RNA, 64 nt, Human
cucccucacauccuguuucugacuuuggaauggacucaggaaaacuaggccccucuuuaaaccg

SEQ ID NO: 432528 - RNA, 64 nt, Human
gucucgccuugcgagcaagcucggaauccaguuccucaggaaccccuccaaaacccacaccccc

SEQ ID NO: 432529 - RNA, 64 nt, Human
cuuccaggccggcucuaagagaaaggcccaucuacucaggaagagggccagggccuuggguucu

SEQ ID NO: 432530 - RNA, 64 nt, Human
cuaggcauggugcuuuuucuguggucuuuugcaucucaggaagauaaccaacaguaaucccuug

SEQ ID NO: 432531 - RNA, 64 nt, Human
uuuuuuucucaguggcccaugucacaaacccuaucucaggaauuucuucugaauguucaauuuu

SEQ ID NO: 432532 - RNA, 64 nt, Human
gugagcuguggaaugagagagaaaaccauggcugcucaggaaggaaguggagaaucucucagca

SEQ ID NO: 432533 - RNA, 64 nt, Human
ugguguuaugauguugcacugugucugaggaaugcucaggaaaucuugugggaaaaaaaugggg

SEQ ID NO: 432534 - RNA, 64 nt, Human
cacuaucuuuuguucuaccuguauugucugacuucucaggaagaucgugaacauaacugagggc

SEQ ID NO: 432535 - RNA, 64 nt, Human
cagaaugacugaaaauuugaaagaaaagccuauaaaagugcacauacgcaacuguguucucugu

SEQ ID NO: 432536 - RNA, 64 nt, Human
ucccauaauuuauuuauucuucuucaauguuuguaaagugcaugagucauguucacacuugaag

SEQ ID NO: 432537 - RNA, 64 nt, Human
ugcucucuucuucacguaggcuccuguuaaaaacaaagugcagucagauucuaagcccuguuca

SEQ ID NO: 432538 - RNA, 64 nt, Human
caguugcauagauuuuaauuuauacauaucaagaaaagugcaauuucaugcugaaugaagcgua

SEQ ID NO: 432539 - RNA, 64 nt, Human
gguaaccuccaaaccugaauuagacagagacucacucaggaagugacaggcccaucauaucaaa

SEQ ID NO: 432540 - RNA, 64 nt, Human
caaacagcgcaauuccaagcucgagagcuucagccucaggaaagaacuuccccuucccugucuc

SEQ ID NO: 432541 - RNA, 64 nt, Human
ggugggaccuccccuuucuuugggcuucaguucacucaggaagaaaugaggcugucgccaucuu

SEQ ID NO: 432542 - RNA, 64 nt, Human
uccuaguguuucuuuguggucugugucaccguaucucaggaaguccagccacuugacuggcaca

SEQ ID NO: 432543 - RNA, 64 nt, Human
uguucugcugucuuucuaauccagccaacgucugcucaggaaguggggccagcuccacugggac

SEQ ID NO: 432544 - RNA, 64 nt, Human
uggguuucucggauccgugcccuggaauaccuggcucaggaaugcugucagaccagccagccag

SEQ ID NO: 432545 - RNA, 64 nt, Human
gcacuuaugauauaaacagaggaccagcuccauucucaggaaagaaauguugugauggcaagcc

SEQ ID NO: 432546 - RNA, 64 nt, Human
uuguuaaagauuguuuauaugcuuacaaagauuucucaggaagacagcagagcagaggaaucua

SEQ ID NO: 432547 - RNA, 53 nt, Human
cucagucaagacggaaguaaaggcucaggaaacagcccaccacagaggcagau

SEQ ID NO: 432548 - RNA, 64 nt, Human
gaaaguaggauauagcgaaaggcgaguccaggagcucaggaagaagagaugcacuauauguuua

SEQ ID NO: 432549 - RNA, 64 nt, Human
acaacuuggugcaugccugcuccuaaaagaaauacucaggaauugucucauaaaguccucaccu

SEQ ID NO: 432550 - RNA, 64 nt, Human
aaacgccugagccugccugugucccccacuuccacucaggaaauugggcugcccccaaccuggc

SEQ ID NO: 432551 - RNA, 64 nt, Human
gccagcccuacaucuucagcucccauagcgcuggcucaggaagaaaccccaagcagcauucagc

SEQ ID NO: 432552 - RNA, 64 nt, Human
aaugauuugggucucaacugaagaugaagcucaacucaggaagagauuuaucuguauauacaca

SEQ ID NO: 432553 - RNA, 64 nt, Human
gcagauuugccuaaggaugccaauguuuuuaauucucaggaacugugaauauguuaugccacau

SEQ ID NO: 432554 - RNA, 64 nt, Human
gccauuucagcccccuguauucucaugauuuucucucaggaagcacacacugugaauggcagac

SEQ ID NO: 432555 - RNA, 64 nt, Human
cacucaauuguggagaagaaaaaaggugcuguagaaagugcaccagguguuaauuuugauccgg

SEQ ID NO: 432556 - RNA, 64 nt, Human
ccauggaaaagguuagucucauuuagaaaaaucgaaagugcacagcacuuaaagggaauauaug

SEQ ID NO: 432557 - RNA, 64 nt, Human
ugaauaugucaccuugcucccaagacacggcccucucaggaagcucccggaguccccgccucuc

SEQ ID NO: 432558 - RNA, 64 nt, Human
ccugucuccaguuccucuccccucaggaggccaccucaggaaggauuuugacaggugaccauaa

SEQ ID NO: 432559 - RNA, 64 nt, Human
ucacguauuuucugggcucuugcaagucacccaucucaggaaaaaggagguuggcaacuaaaga

SEQ ID NO: 432560 - RNA, 64 nt, Human
gaguagggagugggggagguggguccaagucucccucaggaaggccuuuucuaucggcagcaau

SEQ ID NO: 432561 - RNA, 64 nt, Human
ccugagggcugacccugcucaggacacugucugucucaggaacucauggcagugguuuaccuug

SEQ ID NO: 432562 - RNA, 64 nt, Human
uuugcuacauguaauucaaaagcaucucgcuuuucucaggaaccaaaggcuuaugauguaggac

SEQ ID NO: 432563 - RNA, 64 nt, Human
gccgugccuggauccugaaauagaggcuaaauuacucaggaagaacacccucuaaaugggaaag

SEQ ID NO: 432564 - RNA, 64 nt, Human
uaugaauuuugcugcauacagaaagugcccuuuccucaggaaguugcuguguuucauuucuuug

SEQ ID NO: 432565 - RNA, 64 nt, Human
gguaaaauuuuccuguuuuucccccuuugaaaaacucaggaaaaaaggaagauugaacuaauaa

SEQ ID NO: 432566 - RNA, 64 nt, Human
auuggcugcagaauuuguuucaauugaaaauagacucaggaagauugcugcucagaauaucaua

SEQ ID NO: 432567 - RNA, 64 nt, Human
cugaccgcccagacccugucccccgaucccccagcucaggaaggaaagcccagcccuuucugga

SEQ ID NO: 432568 - RNA, 64 nt, Human
agauagaauauaauuaacuccaugagaaugguuacucaggaacuaguuaaagagcaaacccauu

SEQ ID NO: 432569 - RNA, 64 nt, Human
uucaaacauuugucagagaagaaaaacgugaggacucaggaaaaauaaauaaauaaaagaacag

SEQ ID NO: 432570 - RNA, 64 nt, Human
ccucccuuuaguuuguugggggauauaaauuauucucaggaagaauauaaugaacuguacaguu

SEQ ID NO: 432571 - RNA, 64 nt, Human
gccccugcuaauggaguacagccgccaggagcuacucaggaaggugggagagagccaagcccug

SEQ ID NO: 432572 - RNA, 64 nt, Human
cuaguuagaaaaauuauguguugaaauaaguggaaaagugcaauccauccacccuuaugauuaa

SEQ ID NO: 432573 - RNA, 64 nt, Human
uaguugcauaagcauugcucaagaggaaaauccaaaagugcagcaggagaacucuuuucccuga

SEQ ID NO: 432574 - RNA, 64 nt, Human
gaguuucugauuuuguauuauguccuaagacuugaaagugcauuugucuaguugccaaaaguuc

SEQ ID NO: 432575 - RNA, 64 nt, Human
gaccagcucagccugagcuuugguuuuuagaaauaaagugcaugaauugcugcuaugcuguauc

SEQ ID NO: 432576 - RNA, 64 nt, Human
cuuuucaauaauauuuuaaauacaguuuuucuuccucaggaaaucugaaauacaauugcuguug

SEQ ID NO: 432577 - RNA, 64 nt, Human
uauagugagggagguuggcauggagacuaaaauucucaggaaaaugagauccguguuagauuag

SEQ ID NO: 432578 - RNA, 64 nt, Human
guuagauuagaaguccugaugugaaaugggaggacucaggaaggaggaucgucuuuaccugagg

SEQ ID NO: 432579 - RNA, 64 nt, Human
guucuucaugauccacacuuugggcuuaguauuucucaggaagagcuauggcccagaaacaaca

SEQ ID NO: 432580 - RNA, 64 nt, Human
ccuccuguuccagcuccugcugcugcucugaggacucaggaacaccuucgagcuuugcagaccu

SEQ ID NO: 432581 - RNA, 64 nt, Human
cgggcugagaacccugcguggggacagggcucgccucaggaaugggcuguuuuuggccuaaccc

SEQ ID NO: 432582 - RNA, 64 nt, Human
gcuuauaaauggaaccagagcagaaguccccagacucaggaagucaacagagugggcagggaca

SEQ ID NO: 432583 - RNA, 64 nt, Human
cucagagggggcagguggccuggagagagaggggcucaggaacugggagccucguggguggggc

SEQ ID NO: 432584 - RNA, 64 nt, Human
uuaccacccagggggccacaagccagccugcugucucaggaagcuguagaaggaguguuuguca

SEQ ID NO: 432585 - RNA, 64 nt, Human
caacuuucuccuuauugacaaucccauaauaaaacucaggaaccaaggcaaaaugaauuggcuu

SEQ ID NO: 432586 - RNA, 64 nt, Human
caugugugauguuguuuccuuacuacugccucaccucaggaagcacauaaugucuacuugucuc

SEQ ID NO: 432587 - RNA, 64 nt, Human
gcccuucuaucccagauuaccuaaauguucccuucucaggaauucugucucaucaguucuucac

SEQ ID NO: 432588 - RNA, 64 nt, Human
gcugcugccuuccauuccucagcugaaagaacaucucaggaagcacuggacacagugauucugc

SEQ ID NO: 432589 - RNA, 64 nt, Human
uggcuaucccugaggagucaccauaaggagaaaacucaggaauucugagucuucccugcuacag

SEQ ID NO: 432590 - RNA, 64 nt, Human
cuucacaaaaaaccuuaagggaaaucugauggugcucaggaaucuaacucucccuaaaccaucc

SEQ ID NO: 432591 - RNA, 64 nt, Human
cuaucuuugucuaaacaagguaauuuuuuuuuguaaagugcaauguccugcaugcauaaugaac

SEQ ID NO: 432592 - RNA, 64 nt, Human
uaauaaauaaucagacauggucccauuugcaggaaaagugcagacucugaguguuccagggaaa

SEQ ID NO: 432593 - RNA, 64 nt, Human
ccaagaaguccuggauuuccaagauccgcgucugaaagugcaguacaucguuuguaccugaaac

SEQ ID NO: 432594 - RNA, 64 nt, Human
acaccucugucccucaaaauugauaauuacguuuaaagugcagucauuugugguuagaaucuug

SEQ ID NO: 432595 - RNA, 64 nt, Human
ccugcuguguuccagaucacagaggcagccaaggcucaggaaaaacuggggcuuugcuuauggu

SEQ ID NO: 432596 - RNA, 64 nt, Human
aacaauaaauuggaacaccuccucaaaccuaccacucaggaauguuugcuggggccgaaagaac

SEQ ID NO: 432597 - RNA, 64 nt, Human
auggcucuuccugggucaaccgugaccugucuggcucaggaaugggcucuggcugcugggggag

SEQ ID NO: 432598 - RNA, 64 nt, Human
gaucugcuagugcuguaauauuguaaauacuggacucaggaacuuuuguuaggaaaaaauugaa

SEQ ID NO: 432599 - RNA, 64 nt, Human
gcaccuaggccaggguggggccgccgcagaugggcucaggaagccccaggugcacucagcgaga

SEQ ID NO: 432600 - RNA, 64 nt, Human
gagcacgccugagccuccggggccacgcuucguucucaggaacaaaaccugaggcagcccuuug

SEQ ID NO: 432601 - RNA, 64 nt, Human
gaaaguacuguugcacaaaggcugcaaagcuggacucaggaauguccuccaaccagcagcgcug

SEQ ID NO: 432602 - RNA, 64 nt, Human
aagggagugggaggcuuccaacauaguauugaaucucaggaaaaacuauucuuucaugucugau

SEQ ID NO: 432603 - RNA, 64 nt, Human
agcaguacaauaaaaguaaaccacaaaaaaauaccucaggaaagaauagaaagaaagucuaucu

SEQ ID NO: 432604 - RNA, 64 nt, Human
guacucuagccuggaagacagagugagaccccaucucaggaaaaaagaaaaaaaaaaagauguc

SEQ ID NO: 432605 - RNA, 64 nt, Human
gagaaauauuauguugauaguuguuucauauucucucaggaacuuuaauguucccgacucgggu

SEQ ID NO: 432606 - RNA, 64 nt, Human
guucagagugaaaaccuuuugugaugguugaugucucaggaauaagcuggaucuccaauguuuu

SEQ ID NO: 432607 - RNA, 64 nt, Human
cggucacagcccccuacacucaaggcugagaggccucaggaaagucauuccuuuuuaaaaauaa

SEQ ID NO: 432608 - RNA, 64 nt, Human
uagccucccaaauucggaaauccaauccaacggucucaggaauguuuuccaucccgccacgcgc

SEQ ID NO: 432609 - RNA, 64 nt, Human
gcagcucccaucccagucuggggccauuugcagacucaggaaaggauuucuacaguguucuaua

SEQ ID NO: 432610 - RNA, 64 nt, Human
gaaucaucuuccacaacaaggaauuaaaguaauuaaagugcaaguucaaugaucguuuucacuu

SEQ ID NO: 432611 - RNA, 64 nt, Human
uauuaaugaagugguuugaaaauuuguuauauuaaaagugcacaaaaacugagagugaaaauaa

SEQ ID NO: 432612 - RNA, 64 nt, Human
aaccaauccacagccuggaguaccuuucaaggucaaagugcauggccagcuccauugagacauu

SEQ ID NO: 432613 - RNA, 64 nt, Human
cugaccucaggugauccaccugccucggccucccaaagugcagggcuuacaggugugagccaca

SEQ ID NO: 432614 - RNA, 64 nt, Human
ccgcugccugacuggagcuggccgcugugguggacucaggaaccacuuuuaauacugcaacugc

SEQ ID NO: 432615 - RNA, 64 nt, Human
aauggaaacuuuuacccauguaauucuagcugaacucaggaaaaagaagggggaaaggacucug

SEQ ID NO: 432616 - RNA, 64 nt, Human
aaggcaucagaagaaguaacaguuggcagagggucucaggaaaaacaucuuccuucugaucuuu

SEQ ID NO: 432617 - RNA, 64 nt, Human
uuugagaauuuaauguuuaacuguaccccuuucccucaggaagauuuaacauuugcuugggaau

SEQ ID NO: 432618 - RNA, 64 nt, Human
ccugucucuggugaacaaacuuccucucuggccucucaggaaucaggguggacauggcucacaa

SEQ ID NO: 432619 - RNA, 64 nt, Human
gaaguaccuuuaagguagaccuuuucagggugcccucaggaaagggcccugcucauguuuuuuu

SEQ ID NO: 432620 - RNA, 64 nt, Human
ggugccuucugccucugcccugaucgucacaacccucaggaaccaccgacagaaagaaagaaac

SEQ ID NO: 432621 - RNA, 64 nt, Human
uuuuggaagaaugguuaacuuuuuuauaaucuuacucaggaaaacuaacuauuuguucauuaga

SEQ ID NO: 432622 - RNA, 64 nt, Human
gcggcuccagugggggaccccucuucuccaaccacucaggaaaccuccuugguaaccagcucuu

SEQ ID NO: 432623 - RNA, 64 nt, Human
gacaagcccacagcccagauuccgguucucccaacucaggaagagcaugcccugcccucugggg

SEQ ID NO: 432624 - RNA, 64 nt, Human
acuuuucuguguuaacucacuuauuaugguauaacucaggaacaggucucaggauggagagaag

SEQ ID NO: 432625 - RNA, 64 nt, Human
ucacuuucucccuauuguucuuucaaauccuguucucaggaaagaaacugccacuaauucauuc

SEQ ID NO: 432626 - RNA, 64 nt, Human
agagagaaacacuucugcugucaccuugaaugaacucaggaauagcuucccucuggacuguaga

SEQ ID NO: 432627 - RNA, 64 nt, Human
aaaagggccagugccaaggggcaccaagaaccugcucaggaagccuuuugauggcaagaucacc

SEQ ID NO: 432628 - RNA, 64 nt, Human
cccagaaauaucuucagaaguacgugaguuguuccucaggaauagauuuuucauaaagcagaau

SEQ ID NO: 432629 - RNA, 64 nt, Human
guguagguacugcagggccugugcucagcugugaaccccguauccugggccccacugccgggac

SEQ ID NO: 432630 - RNA, 64 nt, Human
augugcggggccuggacuugccuaggauuucccgaccccguacaaaccaaguugcccucuccga

SEQ ID NO: 432631 - RNA, 64 nt, Human
agcacgcgucuggcggcugcugucguuguguucuaccccguacugacccaacaccacaagggcu

SEQ ID NO: 432632 - RNA, 64 nt, Human
caggcuguggcuugcacuccagccgcucuagucucucaggaauuugcuuguuacuuguacugug

SEQ ID NO: 432633 - RNA, 64 nt, Human
acccugacuuugcaggcucagcugcuguucuaaccucaggaaugcaucuaccugagaggcuccu

SEQ ID NO: 432634 - RNA, 64 nt, Human
gcguggcaagggcaugcucuggggcagugugucccucaggaaccaggguccucccuccccuuuc

SEQ ID NO: 432635 - RNA, 64 nt, Human
cccauuuggagggccugggccuggcucccucacucucaggaaaugcugacccaugggcaggaga

SEQ ID NO: 432636 - RNA, 64 nt, Human
cauauauauuuuaaaagacuguuuacugcaguugcucaggaacugcuuuugauucacauuaagc

SEQ ID NO: 432637 - RNA, 64 nt, Human
aauuauuucucaaagauuuauagcacacacuauucucaggaauucuguauuacaugaaugcugc

SEQ ID NO: 432638 - RNA, 64 nt, Human
guccuuuuuauggaguuaacggggaggaagaccccucaggaaaacgaaaguaaauuguuaaggc

SEQ ID NO: 432639 - RNA, 64 nt, Human
uucagguaaucccucaauggcugcuuugaacuuacucaggaaagccagcccccauaauauugua

SEQ ID NO: 432640 - RNA, 64 nt, Human
aggugggggcggugagggcuccacguugucagcgcucaggaaugugcuccggcagagugcugaa

SEQ ID NO: 432641 - RNA, 64 nt, Human
uguaugaaauguauguacacauaagugugugugucucaggaaguaggaaauaaaaauggaagcu

SEQ ID NO: 432642 - RNA, 64 nt, Human
caagaaggccacagagguacuuuuccuuuuuuagcucaggaaaauaugucaggcucaaaccacu

SEQ ID NO: 432643 - RNA, 64 nt, Human
gccccugagggcacuguggucacacugggcccuccucaggaacucucccugcgcagaggcgugu

SEQ ID NO: 432644 - RNA, 64 nt, Human
cuccgggacguucucggcucugugcguucagucccucaggaaccguggaccuuaauuuaccuug

SEQ ID NO: 432645 - RNA, 64 nt, Human
cugcaggggaagggcuggcugggguccccgagaucucaggaauuuuuguaggggauugaagcca

SEQ ID NO: 432646 - RNA, 64 nt, Human
ggcaagggugggucccuugaccuuugcacgccuccucaggaacccccuuucccgggugagcccc

SEQ ID NO: 432647 - RNA, 64 nt, Human
uugauuccuaagguuuccagugugucaccaacaaaaagugcauugauagggaccuuugucucuu

SEQ ID NO: 432648 - RNA, 64 nt, Human
agggcagagaacuguguggcaucuccuuauaguaaaagugcaaucauauggauggcuaacuuug

SEQ ID NO: 432649 - RNA, 64 nt, Human
uaugaaaaaaauuauacgcuaugggauacuggcaaaagugcacauauuucauaaccaaauuagu

SEQ ID NO: 432650 - RNA, 64 nt, Human
acugaccaaaagucaguguugcagagauuucucuaccccguaugguauuuuguuagauuguuca

SEQ ID NO: 432651 - RNA, 64 nt, Human
aauggagagugggaagagccuggaaagauguggccucaggaaaagggaugagagaaaggaggug

SEQ ID NO: 432652 - RNA, 64 nt, Human
auccuuagcugaagcggggagacucacucuccaucucaggaaauucuagcccuugcccucaggg

SEQ ID NO: 432653 - RNA, 64 nt, Human
gagccugcaaaugaucacuguaaacuggcucugucucaggaauucacccaggcagccuggaguc

SEQ ID NO: 432654 - RNA, 64 nt, Human
acacuggccuccauucugacaucugggcuggggccucaggaaccacaagagauagcaauguguu

SEQ ID NO: 432655 - RNA, 64 nt, Human
acuuugggaggccgaggcagguggaucauuugagcucaggaauucaagaccagccuggguaaua

SEQ ID NO: 432656 - RNA, 64 nt, Human
gcuuauggaaccuggucacucccuggcugcuucacucaggaaagggaacuaaaaccagaauaca

SEQ ID NO: 432657 - RNA, 64 nt, Human
auuguucauuaaaucccauuugagguauaagucacucaggaaguuaaaauaucucuacacguau

SEQ ID NO: 432658 - RNA, 64 nt, Human
auuuuaccuuuuacuuugugcuuuuuguguuuuacucaggaaguccuccccuacaucuguuuuc

SEQ ID NO: 432659 - RNA, 64 nt, Human
accaacauuuuuuuuuccagaaaaugguaagguacucaggaaucuggagacaagauauuguaag

SEQ ID NO: 432660 - RNA, 64 nt, Human
aauucaccucuucuuuucaccucuuuaaccacuccucaggaacagaacacuucuaggacugggg

SEQ ID NO: 432661 - RNA, 64 nt, Human
uggucuucggagcuggguuggccccuucuuugggcucaggaagcagccuuagcacacgggccuc

SEQ ID NO: 432662 - RNA, 64 nt, Human
agccaggguccucucucaaccacuagacuuggcucucaggaacucugcuuccuggcccagcgcu

SEQ ID NO: 432663 - RNA, 64 nt, Human
cauuguuugcaggacgaaaacuucugaguuacagcucaggaaaagccugcugaauuuauguugu

SEQ ID NO: 432664 - RNA, 64 nt, Human
ccugcuaggauguuguaucagaaucaugugagaacucaggaagagguagagcagaaauaaaaag

SEQ ID NO: 432665 - RNA, 64 nt, Human
agccugcuccucugcucucuggguuacugaggggcucaggaaggggccccucgagccuuccugg

SEQ ID NO: 432666 - RNA, 64 nt, Human
uuguuaugugauguuaccagccugaaaugcgaucaccccguaggaaauaaagcaggcaucucug

SEQ ID NO: 432667 - RNA, 64 nt, Human
ucauuggccugcguugcuggggcuuugaaccaccaccccguacuuuguuuugccuguagagugu

SEQ ID NO: 432668 - RNA, 64 nt, Human
cagccucccaaagugcugggauuacaggugugagccaccgcacccggcuggccaaucuuaucag

SEQ ID NO: 432669 - RNA, 64 nt, Human
caggaagcagagguugcagugagcugagaucacaccaccgcacuccagccugggugacagagug

SEQ ID NO: 432670 - RNA, 64 nt, Human
aagccauggagugagacccaggagccggacacuucucaggaaauggcuuuucccaacccccagc

SEQ ID NO: 432671 - RNA, 64 nt, Human
ccuuacaaaacaagccuuucaaacaaucauuguccucaggaaaguuguugagcuuccuccagcu

SEQ ID NO: 432672 - RNA, 64 nt, Human
aucucucugggugccccaguuagagcugccacagcucaggaaaaagaugaggcauaacgaccuu

SEQ ID NO: 432673 - RNA, 64 nt, Human
cagaaguaacugaaguagaucaggaaggggcugccucaggaaaauuccuagauccuaggaauuc

SEQ ID NO: 432674 - RNA, 64 nt, Human
gguccuuucuccacagauguaauuauguuuucaacucaggaacuauggcaaggaacuuucccca

SEQ ID NO: 432675 - RNA, 64 nt, Human
aacagccacauccuccuauaccuagacaucucaucucaggaaguggugguggggguagucagaa

SEQ ID NO: 432676 - RNA, 64 nt, Human
uuuuaaguucacagaaaacuuaauaauucaaauucucaggaauuaaggacucaccauaacauug

SEQ ID NO: 432677 - RNA, 64 nt, Human
acccacccuucagcuuaagccacuccccuugccucucaggaauuuugccaggauggggcacagc

SEQ ID NO: 432678 - RNA, 64 nt, Human
caucacuuuaaacugaaccuggcaaguuaauuuccucaggaauggggauguauuuuuuuaagca

SEQ ID NO: 432679 - RNA, 64 nt, Human
uguuuucauugauuucccacauguaguccuuuugcucaggaagucuuuggggaaauuaaggauc

SEQ ID NO: 432680 - RNA, 64 nt, Human
cggggcuccagccaggagcgcuccaggggagucucucaggaaaaagaagcccagaucucuucag

SEQ ID NO: 432681 - RNA, 64 nt, Human
uugauguguggaggggaagcaagauggguaagggcucaggaaguugcuccaagaacaguagcug

SEQ ID NO: 432682 - RNA, 64 nt, Human
aagcaggaggagguaaugcgggagaagcagcuggcucaggaagccaagaaacuggaugccaagg

SEQ ID NO: 432683 - RNA, 63 nt, Human
caccccagccugagcaacaagagcgaaacuccaucucaggaaaaaaaaaaaaaaaaaaaguau

SEQ ID NO: 432684 - RNA, 64 nt, Human
ccagaucauccccagagagagcccccacaagcuccucaggaaacaggauugcugaugucuggga

SEQ ID NO: 432685 - RNA, 64 nt, Human
uggccuaucaaaguguugggauuacaggcuugagccaccgcacccggccgagaauauguguugu

SEQ ID NO: 432686 - RNA, 64 nt, Human
uagccucccagagugcugggauuacaggcgugagccaccgcacccagccuaauuugccuuuuga

SEQ ID NO: 432687 - RNA, 64 nt, Human
agccucccaaauugcugggauuuacaggcaugagccaccgcacccagccuacaauaauuuucuu

SEQ ID NO: 432688 - RNA, 64 nt, Human
cagccauguagacaagcccuggucaucucagcagccaccgcacaacaccccugguggaagacac

SEQ ID NO: 432689 - RNA, 64 nt, Human
gaggggaguaggguuccagcucugggacauugugcucaggaauuugaaaacgcugcuauacuua

SEQ ID NO: 432690 - RNA, 64 nt, Human
ccugaccaaugugugaaguaugcacuuggccugacucaggaagccaggugagaaaaccaugguc

SEQ ID NO: 432691 - RNA, 64 nt, Human
auguauauguguacacaugccuauucugccauuucucaggaaaggguggaguauguaucauaug

SEQ ID NO: 432692 - RNA, 64 nt, Human
aucaucccuuccauugccacacccuagauccagccucaggaacuaacaaguuuugagaaaagca

SEQ ID NO: 432693 - RNA, 64 nt, Human
uguaugagucucuuucuaugaacugaacacaaaacucaggaauugguggcuuaauuuuagauca

SEQ ID NO: 432694 - RNA, 64 nt, Human
uuaguacauacauuuauuauuuuaaugagaaugccucaggaaaagacuaguauuugggcaauau

SEQ ID NO: 432695 - RNA, 64 nt, Human
gcagaggcccaauaaaugaacaaauguacauacacucaggaagguaguacaagauacuccauac

SEQ ID NO: 432696 - RNA, 64 nt, Human
uuauucacaggucugugagggacugcaaagcuuacucaggaaaugaaaacaaaugauggucaug

SEQ ID NO: 432697 - RNA, 64 nt, Human
agccccugccucuccauuauuuauuugcucugcucucaggaagcgacgugaccccugccccagc

SEQ ID NO: 432698 - RNA, 64 nt, Human
cccacugcuucuauggggcucucucuucugccuucucaggaaagcuggugucugauuuuggcca

SEQ ID NO: 432699 - RNA, 64 nt, Human
aauggccacauauuuucaagauauuuuuguuaugcucaggaaucucuuguauauuuuacuauuu

SEQ ID NO: 432700 - RNA, 64 nt, Human
ccgugaccaccuggcaugggcuucguggccugcucucaggaagugggucaagcccugggaaccc

SEQ ID NO: 432701 - RNA, 64 nt, Human
uuggagccgggucuagagggaacccucuaucagccucaggaaaacaagaccucugugcaccuca

SEQ ID NO: 432702 - RNA, 64 nt, Human
ccuuguuuguaaacugauaacuuuuuugcuucuucucaggaauacaguuuucaacuguugucuu

SEQ ID NO: 432703 - RNA, 64 nt, Human
uacaaaccuuucaaaccuguauuccuucuuuauacucaggaaaaugucaccaagcacccuccuc

SEQ ID NO: 432704 - RNA, 64 nt, Human
aucucuagacucacccagaucccagcuuggugggaaagugcagaagaauugcaaaacugacauc

SEQ ID NO: 432705 - RNA, 64 nt, Human
uuacaaaaggcagcccuuuggguacuacugcugcaaagugcaaauacuccaagcuucaagugau

SEQ ID NO: 432706 - RNA, 64 nt, Human
caguauuugacccauuuuaauguguacaacuuuaaaagugcagcaauuuauuaauuaaucuuau

SEQ ID NO: 432707 - RNA, 64 nt, Human
caacaacaaugaaaaccaacaccaacucaacaacaaagugcaauacaggcugaaccuggcccaa

SEQ ID NO: 432708 - RNA, 64 nt, Human
auguuuuguucaagucagcaagcucuaugugagucucaggaagugaauuaaauuuggaccuuau

SEQ ID NO: 432709 - RNA, 64 nt, Human
agaugucuuuucccauuuaucuaaauauggacugcucaggaaacgagacuuuccauuacaagua

SEQ ID NO: 432710 - RNA, 64 nt, Human
agcacaauuaagugaauugagucccuggucuagccucaggaacugaaacuucuuuggggcuugu

SEQ ID NO: 432711 - RNA, 64 nt, Human
uacacauacaccuguuauaagguguuuaauauagcucaggaaagugagcauuuugugagaaaaa

SEQ ID NO: 432712 - RNA, 64 nt, Human
ccgggaaggcaaauggaacaggaauggagccugucucaggaaggccagcugcagguccuccaga

SEQ ID NO: 432713 - RNA, 64 nt, Human
ccaagcagggggccacagggugggcuguggagcucucaggaagggcccugaggaaggcacacuu

SEQ ID NO: 432714 - RNA, 64 nt, Human
agggccgccggaagcugguguccugucauuuucucucaggaaagguuuucaaaguucugcccau

SEQ ID NO: 432715 - RNA, 64 nt, Human
uuuaucuguggucugcugcccagaaacaucucuucucaggaaaggaucuuccccugguuacuua

SEQ ID NO: 432716 - RNA, 64 nt, Human
caagggucccgaugagggucccauggccugcucccucaggaacagcuccagcaccaauaaagag

SEQ ID NO: 432717 - RNA, 64 nt, Human
acugcugaggcuucauaaucauggcucuuagaaacucaggaaagaggagauaauguggauuaaa

SEQ ID NO: 432718 - RNA, 64 nt, Human
uucaaagaagcuuaauauaaaaguuugcauucuacucaggaaaaagcaucuucuuguauauguc

SEQ ID NO: 432719 - RNA, 64 nt, Human
acuuacuuaaucuuuucaguuuuccaguuuacgucucaggaaugaaguguagucuaugguugac

SEQ ID NO: 432720 - RNA, 64 nt, Human
aggagagaagugcugaauguuccguguggagaugcucaggaaaguuauuugaguuaaauugcug

SEQ ID NO: 432721 - RNA, 64 nt, Human
gccacccuuggucucaugccccgccauggucacccucaggaacccacccucuccacacccagcc

SEQ ID NO: 432722 - RNA, 64 nt, Human
ccgcccaggugcugggaauggcacggagcagagacucaggaacacuugaugaauaaaugaguga

SEQ ID NO: 432723 - RNA, 64 nt, Human
ugggccuuguacugucuguguuuuuaaaaccacuaaagugcaagaauuacauugcacuguuucu

SEQ ID NO: 432724 - RNA, 64 nt, Human
aggaggacuuugggccaauuucggaggagagaagaaagugcaacguggggagagggaagugaau

SEQ ID NO: 432725 - RNA, 64 nt, Human
gagaggcacuguuaaaaauuauugggaaagauuuaaagugcaggcugcaauuaaaacauggaga

SEQ ID NO: 432726 - RNA, 64 nt, Human
uaaaaauaauaaaugcucaugauagaaaauuuggaaagugcaaauaagcaaaaaugaaaacaau

SEQ ID NO: 432727 - RNA, 64 nt, Human
ugauuucuguuuuguuuaaaaaauucuuacaaaccucaggaaaacugugcccuccgccggcuac

SEQ ID NO: 432728 - RNA, 64 nt, Human
cugagcauguccacagguggccuccagcacaccccucaggaagcuguggaggcuggauuccagg

SEQ ID NO: 432729 - RNA, 64 nt, Human
gcccgugccuggggucccgcggccgcuucuucaucucaggaaucucucggaccgcggauccuca

SEQ ID NO: 432730 - RNA, 64 nt, Human
cucugagugggguugcugccuguauucccuguuucucaggaacuuacaugggucuggggaggcu

SEQ ID NO: 432731 - RNA, 64 nt, Human
uucccuucauccuauccucuuugcuugcucucaccucaggaauugcuuggauugcuacauggac

SEQ ID NO: 432732 - RNA, 64 nt, Human
cucucuacccacagauggcccugggaaucaauuccucaggaauugcccucaagaacucugcuuc

SEQ ID NO: 432733 - RNA, 64 nt, Human
cagacgugguggcaugcgccuguaaucccagcuacucaggaagcugaggcgagagaaucgcuug

SEQ ID NO: 432734 - RNA, 64 nt, Human
agggugccauucauugucuuucucuccuagcccccucaggaaagaaggacuauauuuguacugu

SEQ ID NO: 432735 - RNA, 64 nt, Human
cccuucaagacgaggggcagggaaggacaggacccucaggaauucagugccuucaacaacguga

SEQ ID NO: 432736 - RNA, 64 nt, Human
uggaagggccaauggagaaaaugaauggacaaagcucaggaauccuacgcuauguagaaugucu

SEQ ID NO: 432737 - RNA, 64 nt, Human
acggucuuuuccuccuuuacccuguggauauacacucaggaauaaucugacauuuuagaaaagc

SEQ ID NO: 432738 - RNA, 64 nt, Human
gcagagaaagccacacucugaauacauuuuaugucucaggaauucacauuccagguucaggaau

SEQ ID NO: 432739 - RNA, 64 nt, Human
gggcuuccucacaaugcaggauccucuuugcugacucaggaauacuccauauuuuagacuacug

SEQ ID NO: 432740 - RNA, 64 nt, Human
uaaaauggaggccagugccauuucagaggggaggcucaggaaggcuucuugcuuacaggaauga

SEQ ID NO: 432741 - RNA, 64 nt, Human
auugacucaaaacucuccaaguacauaucaaaaucucaggaagggaaaaaagagucuaaagaac

SEQ ID NO: 432742 - RNA, 64 nt, Human
ucugagaaaugcggacaccccgagcgagcaccccaaagugcacaaagcugaguaaaaagcugcc

SEQ ID NO: 432743 - RNA, 64 nt, Human
aguuggcuugcauuuuaggggccauuuuguauaaaaagugcauaugauuaaaauuagacucagu

SEQ ID NO: 432744 - RNA, 64 nt, Human
uguuucuugaaugcuuugucaaauuaagaaaguuaaagugcaauaauguuugaagacaauaagu

SEQ ID NO: 432745 - RNA, 64 nt, Human
uggccucccaaacugcugagauuacagaugugagccaccgcacccuaccucauuuucuguaaca

SEQ ID NO: 432746 - RNA, 64 nt, Human
cugucccucucugcuuucucuguagggcccagcucucaggaauacaaaguugagccacgguccu

SEQ ID NO: 432747 - RNA, 64 nt, Human
accugagccccaucuccaguauuuccuuuggauacucaggaaugggaaaaggacagcacaggau

SEQ ID NO: 432748 - RNA, 64 nt, Human
ccuuucucuucucuuccccaguggggagggaucacucaggaaaacaggaaaggagguuccagcc

SEQ ID NO: 432749 - RNA, 64 nt, Human
ccuugugagguuguggacaacuggaagauucugacucaggaauccagaacuaggucuaccuuca

SEQ ID NO: 432750 - RNA, 64 nt, Human
ugggauuucucaggcugccagggcaggcccaggccucaggaagaaggggaggccccuggccucu

SEQ ID NO: 432751 - RNA, 64 nt, Human
cuucucucuggccuuucccgaggccugugagugccucaggaagcagcugggcccucugggaagg

SEQ ID NO: 432752 - RNA, 64 nt, Human
aacagcuccagguacccaccgggggaugugccugcucaggaaaccucuuugcuccacacagcau

SEQ ID NO: 432753 - RNA, 64 nt, Human
caugaagcucagcaguagaagcguaaugauuucccucaggaaaaacuucugacagcuagguuuu

SEQ ID NO: 432754 - RNA, 64 nt, Human
ucauaguuguccccauugucuacccacacaaauccucaggaaaccaaccaccgcccagguggcc

SEQ ID NO: 432755 - RNA, 64 nt, Human
uuucuauuccugucccaaaucaaagagcaugguucucaggaaaaccaguuccccaguuuaaaaa

SEQ ID NO: 432756 - RNA, 64 nt, Human
gcauaacagcacauucaucccuuugguuugggaucucaggaauacagucccaugcaaagauucu

SEQ ID NO: 432757 - RNA, 64 nt, Human
auagaaauagggauuggagacaguaaccuugaagcucaggaaacuguccuggcugggcugaguc

SEQ ID NO: 432758 - RNA, 64 nt, Human
cccaagacugugggauaaaccaccauugcuaguccucaggaauuagaccauauuuaguauagga

SEQ ID NO: 432759 - RNA, 64 nt, Human
gugccucuaggcagugacuagggugcccccaccccucaggaagaacacaggugggcuccuagca

SEQ ID NO: 432760 - RNA, 64 nt, Human
agccuccccuuccccgaggugugguggcugcagucucaggaagagcuugguacuuguggggacu

SEQ ID NO: 432761 - RNA, 64 nt, Human
aaaaaaacuuaaguagauaggagcuuauggucaaaaagugcaaaaaaaaaaacaaaaaaaaagc

SEQ ID NO: 432762 - RNA, 64 nt, Human
uugugacauuucauuucaguaaggaaaagauaacaaagugcaauuaucagcauuuuuuuuuccu

SEQ ID NO: 432763 - RNA, 64 nt, Human
auauaagucacuuuacagugcuacuucacacuuaaaagugcaugguauuuuucaugguauuuug

SEQ ID NO: 432764 - RNA, 64 nt, Human
ugaucaguuaaaaaagaauguuacaguaacaaauaaagugcaguuuaaaacccaacucuuacuc

SEQ ID NO: 432765 - RNA, 64 nt, Human
uuuggguccaagaguuucccaaacagccacgccucucaggaacccaccuggcgguuccgugagc

SEQ ID NO: 432766 - RNA, 64 nt, Human
ggguguaggagagcucugguggccccuccguaaacucaggaagugucaggugauuuccuaggga

SEQ ID NO: 432767 - RNA, 64 nt, Human
cccaggggcgucaguuuuacggacucaaggucaccucaggaagaggcagggccagguuuuggga

SEQ ID NO: 432768 - RNA, 64 nt, Human
ggcucgaagcagucucuguuuccagcacugcacccucaggaagucgcccgccccaggacacgca

SEQ ID NO: 432769 - RNA, 64 nt, Human
gcacuccagccugggcaacagagcaagacucugucucaggaaaaaaaaaaaaaaaaaagaaaag

SEQ ID NO: 432770 - RNA, 64 nt, Human
uuuaagaagcaaauuauuuaguagcagaacuuaucucaggaaaggaaaauaugcaugguuggug

SEQ ID NO: 432771 - RNA, 64 nt, Human
agagauguucgcuggaucccaggcccuggcaccccucaggaaauacaagaaaaagaauauucac

SEQ ID NO: 432772 - RNA, 64 nt, Human
aaaguaaaguguuauugaaugugugggguuuccccucaggaauuugucuaacacauuucaagga

SEQ ID NO: 432773 - RNA, 64 nt, Human
ccuggggacgugccccaccugcgugccggcugagcucaggaaccccugccugccccccgggugg

SEQ ID NO: 432774 - RNA, 64 nt, Human
ccagugaaauguacugaguggauuccgucuucuacucaggaauggaaugugugacacaggccug

SEQ ID NO: 432775 - RNA, 64 nt, Human
ggaaugcuggauguguagaggguuuagucccgagcucaggaaaugagagccuauaagugcccag

SEQ ID NO: 432776 - RNA, 64 nt, Human
aggggucaccgugcugggagcagccuccuugggccucaggaaaccaccaagugccucggauggu

SEQ ID NO: 432777 - RNA, 64 nt, Human
ugugggcacagaggugacagugucucugcaggcacucaggaagcuguucuaccuuggaacucca

SEQ ID NO: 432778 - RNA, 64 nt, Human
ccuuccucuccugucucccuccucugcccgggagcucaggaaccgaggcagggaaggaucccau

SEQ ID NO: 432779 - RNA, 64 nt, Human
auucaaguauccugguuagcaagaccacucccaccucaggaagcuaguauucaugcccaggauc

SEQ ID NO: 432780 - RNA, 64 nt, Human
caucacuucuguucucacagguacugagcugucaaaagugcaugaaggccucucacuguacucu

SEQ ID NO: 432781 - RNA, 64 nt, Human
gcugucauugcacauaagcuuccauuuuaauuuuaaagugcaaaagggccagcguggcucuaaa

SEQ ID NO: 432782 - RNA, 64 nt, Human
guugaucuuuuuuuuugucguagauuugucuguaaaagugcaggaacaguuauucuaugagaac

SEQ ID NO: 432783 - RNA, 64 nt, Human
aaaugaugagagagagagaaauuauauacuaugaaaagugcacccccacacucugcuagaggaa

SEQ ID NO: 432784 - RNA, 64 nt, Human
ccauucucaggugaagccuggcuuggucccguuccucaggaaaaggauggaccuucucuucuuc

SEQ ID NO: 432785 - RNA, 64 nt, Human
uaguucugugauguguuuaccucuuuuuucaggccucaggaacucuucuauuuccuucccuaau

SEQ ID NO: 432786 - RNA, 64 nt, Human
gccuuccgacaccacugggaaccaagggcccucacucaggaacccuggagacagaagucaggug

SEQ ID NO: 432787 - RNA, 64 nt, Human
ggaacauugcucgaugcucccaucugguggcggccucaggaacccacgggaaccuggaaggagg

SEQ ID NO: 432788 - RNA, 64 nt, Human
uuuaacugguggcuuaaugacucugcaccuuuuucucaggaauucugccuaaguugucugccuu

SEQ ID NO: 432789 - RNA, 64 nt, Human
uaugaugcuaauguguuuuccacuguacccucaucucaggaauaaaacugcuuuaacggagaug

SEQ ID NO: 432790 - RNA, 64 nt, Human
acaauggaugaaguccgagaauuugaacgagccacucaggaagccaccaacaagaaaaucggca

SEQ ID NO: 432791 - RNA, 64 nt, Human
auggaguuggagaucauuauucuaagugaaauaacucaggaauggagaaccaaauauuguacau

SEQ ID NO: 432792 - RNA, 64 nt, Human
uaccucugcaggccucuuugcucuccccucuugccucaggaaacccgguggcaccuguggcucc

SEQ ID NO: 432793 - RNA, 64 nt, Human
uggaugccugccgguccccgagcaagccugggaacucaggaaaauucacaggacuugggagauu

SEQ ID NO: 432794 - RNA, 64 nt, Human
ggccaccuuuucucagcuucugaggcugcgaugccucaggaacuccaguuuacagagaccagug

SEQ ID NO: 432795 - RNA, 64 nt, Human
uggcauuuuccagggcaggagaaaguaugagagccucaggaaaccccaucaaggaccgaguaug

SEQ ID NO: 432796 - RNA, 64 nt, Human
ggagggcagcuugccuggaccccuaacggcuguucucaggaacagguucccaggccuggggugu

SEQ ID NO: 432797 - RNA, 64 nt, Human
guuuguuuaaaucugagcaugcaucuuuaaacagcucaggaagaaauagcuuaagaagaaguga

SEQ ID NO: 432798 - RNA, 64 nt, Human
ucuuccacguggccuuugccuggccccacgugcucucaggaaccuggucccacugggaacagac

SEQ ID NO: 432799 - RNA, 64 nt, Human; identical to SEQ ID NO: 58230

SEQ ID NO: 432800 - RNA, 64 nt, Human; identical to SEQ ID NO: 58231

SEQ ID NO: 432801 - RNA, 64 nt, Human; identical to SEQ ID NO: 58232

SEQ ID NO: 432802 - RNA, 64 nt, Human
caauauuauugguauuaaugugcuuuuuuuguauaaagugcaaacauuucgucccaaagucuaa

SEQ ID NO: 432803 - RNA, 64 nt, Human
aaaaauuucagagaugauuuuguuuguggcuuuucucaggaaaagccugaguuugcugcaguau

SEQ ID NO: 432804 - RNA, 64 nt, Human
cauucuuuauucucuaacaggguuuuaagcccagcucaggaacaguucaggagcuaaauuuccg

SEQ ID NO: 432805 - RNA, 64 nt, Human
cuggguguggugacgcuugccuguaucccagcuacucaggaagcugagacacgagaaucacuug

SEQ ID NO: 432806 - RNA, 64 nt, Human
ccuccuggucuccaccucugucauuccgucaauucucaggaaaguuuugcaggaaucucucccg

SEQ ID NO: 432807 - RNA, 64 nt, Human
ugcgugauuucgugucggcuccccaggcuguggccucaggaaucaacuuaggcaguucccaaca

SEQ ID NO: 432808 - RNA, 64 nt, Human
gacugcaguaaccagguaauauuggcaaaggcaucucaggaacaucaccuuagugaggaaacaa

SEQ ID NO: 432809 - RNA, 64 nt, Human
aguauuucauugguaccugguacugauuauggcacucaggaaaguaucucguuacuggaaguua

SEQ ID NO: 432810 - RNA, 64 nt, Human
aaaauuccguuugguagacuccuuccaaugaaaucucaggaauaauuaaacucuagggggacuu

SEQ ID NO: 432811 - RNA, 64 nt, Human
caggaccaggcagaaggcgccuccguccuagccacucaggaaucaucgaggagcacagggaaaa

SEQ ID NO: 432812 - RNA, 64 nt, Human
ggaaggcagcagagcggacuggugaggagcacagcucaggaacuagacugccuggguuccaauc

SEQ ID NO: 432813 - RNA, 64 nt, Human
uccagcuucaacaguacuucuuuuguccauaaaucucaggaauguuuuaggcagaaaacugguu

SEQ ID NO: 432814 - RNA, 64 nt, Human
ugacucuggggugcagcuucacccaccaggccagcucaggaauucccuggaaaagggaaaugug

SEQ ID NO: 432815 - RNA, 64 nt, Human
ggaacaccuggagguguaugcugccgucaaggggcucaggaaagcggacgcgaggcucgccauc

SEQ ID NO: 432816 - RNA, 64 nt, Human
ggggagacagccuuggugcagcaagaacauucaacucaggaagcauuugacucguuguacuuca

SEQ ID NO: 432817 - RNA, 64 nt, Human
uguuaaagaaaaauauuucaagaacaaaucuucucucaggaaaauugccuuucucuauuuguua

SEQ ID NO: 432818 - RNA, 64 nt, Human
agagacuaauuccaaccuucuaaauuuggcuaguaaagugcaauaaaggcauugauaaguucug

SEQ ID NO: 432819 - RNA, 64 nt, Human
aaauccauggaugagaagugcaaugggcauaguaaaagugcaugaauuuaucuuaguggcugug

SEQ ID NO: 432820 - RNA, 64 nt, Human
guggacuggcuggcucuguuagaacucuguccaaaaagugcauggaauauaacuuguaaagcuu

SEQ ID NO: 432821 - RNA, 64 nt, Human
ccaggcccagccuucuuagccccaacuugggaacaaagugcaacaugggaucauggguuggggu

SEQ ID NO: 432822 - RNA, 64 nt, Human
gaucaagaugaguucagcuagaagucauaccacccucaggaaucagcuaaguaauuauuacuug

SEQ ID NO: 432823 - RNA, 64 nt, Human
guuuggcagcagcuuugaacguagcgccugugaacucaggaaugcacaguugacuugggaagca

SEQ ID NO: 432824 - RNA, 64 nt, Human
uugcaaagggccaaauuuccccaaacugaacgggcucaggaaauguuccuuuacacucagaaca

SEQ ID NO: 432825 - RNA, 64 nt, Human
caaaagccagccauauauuuucagaaucuauauccucaggaaaugguccuuuuuuuuucuauaa

SEQ ID NO: 432826 - RNA, 64 nt, Human
cacguggugagaggagcaggccuacuuguuuguucucaggaaacuuaaugaauagauuacugau

SEQ ID NO: 432827 - RNA, 64 nt, Human
cuuugagaaacugaugaagccaggcaccuccuuccucaggaaaaugcugguguacaaauacaca

SEQ ID NO: 432828 - RNA, 64 nt, Human
ucucuaguuucugaggugaauugauuccagcacccucaggaauaccuauauucagagauauuca

SEQ ID NO: 432829 - RNA, 64 nt, Human
cacuguccccaugucccacccacguccuacggcacucaggaagcacuuggugaggacgagcccu

SEQ ID NO: 432830 - RNA, 64 nt, Human
ugcagggcccucguccgggugugccccaaauaaacucaggaacgccccggugcucgccgcaugu

SEQ ID NO: 432831 - RNA, 64 nt, Human
cagucugggccgugacucugggugagucgugugacucaggaauggggguagauccauguccucc

SEQ ID NO: 432832 - RNA, 64 nt, Human
gaagaaguccauucugcagcuguuagaucugccucucaggaaaaaguacuaacuuguucuuuuu

SEQ ID NO: 432833 - RNA, 64 nt, Human
ucccguucggaccagccucagggcugcacguuaccucaggaaugggccccaccaugaaggggcc

SEQ ID NO: 432834 - RNA, 64 nt, Human
aaauacuuagcgguucuacuuaugaguaugaaugcucaggaaauacgcacuaggauauuuacug

SEQ ID NO: 432835 - RNA, 64 nt, Human
acccuccuuucauuugcuagaaggacucacuagacucaggaaagcuguuaggcucacaguuaca

SEQ ID NO: 432836 - RNA, 64 nt, Human
ucuccccugggguggggacucggggucaggggagcucaggaaugugggguuguggaggggcugg

SEQ ID NO: 432837 - RNA, 64 nt, Human
auauguaauagccacacuucacuguuuuaaaauaaaagugcaauuucaaguucuuuuuucccca

SEQ ID NO: 432838 - RNA, 64 nt, Human
cucaaaaauguacacccauuuaguuugugguagcaaagugcaaugcgaaauugaaugagaaacu

SEQ ID NO: 432839 - RNA, 64 nt, Human
uagucuuccuuuuguagcgcaugguugggaggaaaaagugcaugcaucauuccuucacucuucu

SEQ ID NO: 432840 - RNA, 64 nt, Human
aagaacauugacuuacucuauaucaauugaggggaaagugcaguaccgucaucuucaagccuug

SEQ ID NO: 432841 - RNA, 64 nt, Human
gcaucuuucuccuuaguuuacagugcaauuuuaucucaggaauuauuuuuaaaaggaggagggg

SEQ ID NO: 432842 - RNA, 64 nt, Human
auccgugaaaccggguggucccaagagcuagaaacucaggaaaccccaggugcucagggccccg

SEQ ID NO: 432843 - RNA, 64 nt, Human
ggcaccuuggggcuucccugccgcauccucuccccucaggaaggggacugaccugggcuugggg

SEQ ID NO: 432844 - RNA, 53 nt, Human
gcccaaaagagucacagugacaccucaggaagauguccuuccuggggaagaag

SEQ ID NO: 432845 - RNA, 64 nt, Human
gaggcacagagcucgccagcgucccuggaguccccucaggaauggaaaguggagugcccuuguc

SEQ ID NO: 432846 - RNA, 64 nt, Human
agaggaccuccuuucucccacagaaucccagauccucaggaaaagccaaaaccgaggcccauug

SEQ ID NO: 432847 - RNA, 64 nt, Human
cagaagcgauggcugaccagauugaaccccgaaacucaggaagagugaaaugcuacacgacaac

SEQ ID NO: 432848 - RNA, 64 nt, Human
gggggccuguucugagcacauuuuccuguaagcacucaggaagaaugaagcuuccuguguccuu

SEQ ID NO: 432849 - RNA, 64 nt, Human
gggggccuguucccagcacauuuuccuguaagcacucaggaauaaugaagcuuccuguguccuu

SEQ ID NO: 432850 - RNA, 64 nt, Human
ggcauugcugauuuugucugcccaauccauccugcucaggaaaccacaaccuugcaguauuuuu

SEQ ID NO: 432851 - RNA, 64 nt, Human
aaucccagcacuuagggugggcaaauugcuugaccucaggaauuugaggccugccugggcaaaa

SEQ ID NO: 432852 - RNA, 64 nt, Human
gugucaaaaaaauaaaaaauaaaaaaucuaagggcucaggaaccaguuuggacuugauuuugaa

SEQ ID NO: 432853 - RNA, 64 nt, Human
acuuugggaagccaaggagggaggaucacuugaacucaggaauucgagaccagccugggcuaca

SEQ ID NO: 432854 - RNA, 64 nt, Human
ugguccuugcuggccugcccaggaggcauggauacucaggaaggaacacacacccauuaucugu

SEQ ID NO: 432855 - RNA, 64 nt, Human
caacguuguccucaugacaaccagacuuccaguucucaggaacuucucauugugggccagaagu

SEQ ID NO: 432856 - RNA, 64 nt, Human
agugacuaccugcuggucaccccuccauccccugcucaggaagagauaccggaauuuuggacuc

SEQ ID NO: 432857 - RNA, 64 nt, Human; identical to SEQ ID NO: 58241

SEQ ID NO: 432858 - RNA, 64 nt, Human
aauggcacuuugauucccauuugggaugagcccucucaggaauccuguggggaaggggggugau

SEQ ID NO: 432859 - RNA, 64 nt, Human
gacugagccgcccgccucugccgcccaccaccaucucaggaaaggcuguugugcuggugcccgu

SEQ ID NO: 432860 - RNA, 64 nt, Human
ccugaaccaggccugucaccuacccucccugcagcucaggaaggcugucagacaggcugggggc

SEQ ID NO: 432861 - RNA, 64 nt, Human
ugagugugguggcacaugccugugaucccagcuacucaggaagcugaggcagaaagaucccuug

SEQ ID NO: 432862 - RNA, 64 nt, Human
uuuuacaaaagagggagcagcaauggccuagagucucaggaacaagacaggugcacugaggaga

SEQ ID NO: 432863 - RNA, 64 nt, Human
cacuacgcuguccuacacuuccacaaggugcaaccucaggaaccaaaggucaccgacacugagu

SEQ ID NO: 432864 - RNA, 64 nt, Human
auaaugaccaaaaaauggagaaaaaguaggcugacucaggaaacacuuagaaaguacagccaua

SEQ ID NO: 432865 - RNA, 64 nt, Human
ugguugaggggccuugagggaaaucuaauuugagcucaggaagaugcacauuccuuguggaugu

SEQ ID NO: 432866 - RNA, 64 nt, Human
gguggcucacacacucucauucacacacacaaaucucaggaacaaacggucccagaguccuccg

SEQ ID NO: 432867 - RNA, 64 nt, Human
uguccccuuggcucuucagacagggccagcccugcucaggaagucucuggcugucuucaugugg

SEQ ID NO: 432868 - RNA, 64 nt, Human
ccaucucaucugcaggcugggaggcagggcuggacucaggaacccacagcuuacugaaaaagcc

SEQ ID NO: 432869 - RNA, 64 nt, Human
aggcagggaaucgaaacgacagugcuggaggagacucaggaagcagaggcgucccugccgcugc

SEQ ID NO: 432870 - RNA, 64 nt, Human
ucuuuuugacucuugcaauccacaaucugacauucucaggaagcccccaaguugauauuucuau

SEQ ID NO: 432871 - RNA, 64 nt, Human
ucugccacacuggugcaccuugcuggcacggugccucaggaagguggcgacucaggugggccuu

SEQ ID NO: 432872 - RNA, 64 nt, Human
ccuccccgugacugcaauagaacccucuggggagcucaggaaggggugugcugaguucuauaau

SEQ ID NO: 432873 - RNA, 64 nt, Human
agccccguauauuuaauuuauuuuguuaaacaugaaagugcauccuuucccuccaggcuggugu

SEQ ID NO: 432874 - RNA, 64 nt, Human
ucugcagggcacuccccuguuuccuaagaacgaaaaagugcaauaaaggccauucguuaccuac

SEQ ID NO: 432875 - RNA, 64 nt, Human
uuaugacaauggaucuaaaaugucagcaucaugcaaagugcaacggaauagugaauuuugcucu

SEQ ID NO: 432876 - RNA, 64 nt, Human
cccagugaaaagcaaaccagaacaaaacaaaaagccaccgcaauaauucgguaaggacaggaua

SEQ ID NO: 432877 - RNA, 64 nt, Human
agccuggguuucccugcuggcagacggcagaucccucaggaaaccugcuccacuugucaggguc

SEQ ID NO: 432878 - RNA, 64 nt, Human
acaccuuuguuccagccugguuuccugggcugggcucaggaaagcugccaaauucaguccuaug

SEQ ID NO: 432879 - RNA, 64 nt, Human
ggcgggcuuggaacccggugcucccucugucauccucaggaaccaacaauucgucggaggcauc

SEQ ID NO: 432880 - RNA, 64 nt, Human
uucacaacaguuuggaugcccuaaacuucuguagcucaggaacaucacugguguauuuguuuuu

SEQ ID NO: 432881 - RNA, 64 nt, Human
cugcucugucgucucuccacagcaccuuugugaacucaggaaugugcgccagugggaagggcuc

SEQ ID NO: 432882 - RNA, 64 nt, Human
ggaugugagggccaaaagggacuguaacuccugucucaggaauggggauagaugggagguucuu

SEQ ID NO: 432883 - RNA, 64 nt, Human
ucgaagaauaaaauaugagagcaauauuuaaauucucaggaauugacuuauacucuugagaaug

SEQ ID NO: 432884 - RNA, 64 nt, Human
gugggccuuuugacugaguggcagaaggaaacugcucaggaagagaaacaggugacugauggga

SEQ ID NO: 432885 - RNA, 64 nt, Human
gagcgaccacauccuggagaagccaggagaaaagcucaggaagagccugcagguggaaggagag

SEQ ID NO: 432886 - RNA, 64 nt, Human
gcaggagcccagcgccagcuggggcagcuccgggcucaggaagccggccugcagcaggagcaga

SEQ ID NO: 432887 - RNA, 64 nt, Human
auggacgaagcgugggaccccagcacgggcugcccucaggaagaccaguguugcccgaggaggg

SEQ ID NO: 432888 - RNA, 64 nt, Human
cccuccgacagcuccaauacugugacccuccuuccucaggaagcgcguugaacccacagcacuc

SEQ ID NO: 432889 - RNA, 64 nt, Human
aguaaaagaauggacacucaggcacagaguggcccucaggaaggaggucuuuguuuguaggaug

SEQ ID NO: 432890 - RNA, 64 nt, Human
gggaagccccuucuccggggaccuuaucuguggacucaggaaugaugguguuuauugcaaaugc

SEQ ID NO: 432891 - RNA, 64 nt, Human
agcuauuuaacacaaauccuaagauuuuuuucugcucaggaaggggugaaauagcuggcagaua

SEQ ID NO: 432892 - RNA, 64 nt, Human
gagguguuaauaaaauccucaucggaaaagauccaaagugcaaggauuugauuauaaacauaau

SEQ ID NO: 432893 - RNA, 64 nt, Human
ggauuacaguauacuuuuguguguguaaaagcacaaagugcauguguacucacuucuggccaua

SEQ ID NO: 432894 - RNA, 64 nt, Human
cugggcaucagccuuuguacucuguuuuuuuaagaaagugcagaaucaacuugaagcaagcuuu

SEQ ID NO: 432895 - RNA, 64 nt, Human
auuugguauucacaucucagagaacuacaacacaaaagugcagacuuauauuugagaauuaaug

SEQ ID NO: 432896 - RNA, 64 nt, Human
aagcauucuggcaucccagugaagagcucaggcccucaggaagugucugcugaauggaauggcc

SEQ ID NO: 432897 - RNA, 64 nt, Human
gauguugggaccuuuagcccauagcggaugccuccucaggaauauucucgauuuaauaagcuaa

SEQ ID NO: 432898 - RNA, 64 nt, Human
gaagucccacagucuugcauuugcaagcuagagacucaggaaagacaguggcauaaugcagucu

SEQ ID NO: 432899 - RNA, 64 nt, Human
uuugaucuugaagccaugagcauguuaaauagagcucaggaaaggguauguagcaguuuuuuaa

SEQ ID NO: 432900 - RNA, 64 nt, Human
guggaggggauaacuuucauaucuggcucaacaucucaggaaaaucugugauuauuuguguguu

SEQ ID NO: 432901 - RNA, 64 nt, Human
ucagguagauuaagguaucuuuuuauucauugcccucaggaaaguuaagguaucaaugagaccc

SEQ ID NO: 432902 - RNA, 64 nt, Human
ucccgcucuguuucagggucuuuuaguugaagcacucaggaaauauacuaaugcaggcccagac

SEQ ID NO: 432903 - RNA, 64 nt, Human
acuuuaagaggcugaggcaggaggaucacuugagcucaggaauucgagaccagccugggucaca

SEQ ID NO: 432904 - RNA, 64 nt, Human
uguggagcagccacccacugcugccccaagcucacucaggaauucacacccgccugguuucuug

SEQ ID NO: 432905 - RNA, 64 nt, Human
gcaguggccauucuuguaguuauagcuuugcguacucaggaaggcccuucucccgacugcggcc

SEQ ID NO: 432906 - RNA, 64 nt, Human
caggcuuauaauuucgaacucuucuggaaggucacucaggaacacccucccugccugugcaaag

SEQ ID NO: 432907 - RNA, 64 nt, Human
ccucugcaagcucugucuucacggcaugugcuuucucaggaaccuuucaagcggccagaacccc

SEQ ID NO: 432908 - RNA, 64 nt, Human
uucugcuguguuugaaguauguuuagucagcaugcucaggaaauaaaugugaauugcccuugag

SEQ ID NO: 432909 - RNA, 64 nt, Human
ugguagcaguucccugaccaagggcaaggugugucucaggaaggugguucugugcaugccuggg

SEQ ID NO: 432910 - RNA, 64 nt, Human
gcagcagaaggggcugggcaggggcgguggaggacucaggaacugcccggggagaguggguaug

SEQ ID NO: 432911 - RNA, 64 nt, Human; identical to SEQ ID NO: 58198

SEQ ID NO: 432912 - RNA, 64 nt, Human; identical to SEQ ID NO: 58199

SEQ ID NO: 432913 - RNA, 64 nt, Human; identical to SEQ ID NO: 58200

SEQ ID NO: 432914 - RNA, 64 nt, Human; identical to SEQ ID NO: 58201

SEQ ID NO: 432915 - RNA, 64 nt, Human
cugugcaggcgcccuuggaucucaguuucccucacucaggaacucuguuucugaagucuucagu

SEQ ID NO: 432916 - RNA, 64 nt, Human
aaccuugugaggaggugggggagccaugucugugcucaggaagagggaaggggauggggguggc

SEQ ID NO: 432917 - RNA, 64 nt, Human
cucagagagguuuuccugugcucgcccuguuucucucaggaagccuugcucuuuuccaucaugc

SEQ ID NO: 432918 - RNA, 64 nt, Human
cagucccucucccagcauugcugugcauggcucccucaggaagaagcucuggaguggggccgag

SEQ ID NO: 432919 - RNA, 64 nt, Human
ccucugcaagcucuguccucauggcauguacuuucucaggaaccuuucaagcggccagaacccc

SEQ ID NO: 432920 - RNA, 64 nt, Human
gaacucgacuugucugaaauccacauuccagaggcucaggaaguggaaauggccucaggucauu

SEQ ID NO: 432921 - RNA, 64 nt, Human
gguggggugggaagagaggaggccaggccaggcccucaggaauucccugguuuccacugggcca

SEQ ID NO: 432922 - RNA, 64 nt, Human
ccugcccgcccuccucgcagcucugcucuguguccucaggaagucacagagucuacugaggcaa

SEQ ID NO: 432923 - RNA, 64 nt, Human
cggcccuugggggugacccccggcaucuaccccacucaggaaaccuugacuucugaauuccuau

SEQ ID NO: 432924 - RNA, 64 nt, Human
cucccuuguguccgggagaacaucaaugcuuuuccucaggaaauucggcaagacuuggagaaaa

SEQ ID NO: 432925 - RNA, 64 nt, Human
ggagauguacagccugaaggaugagaugggcaaccucaggaaguuacuagagucuaccccaucg

SEQ ID NO: 432926 - RNA, 64 nt, Human
agggccugagggagccccuggcuuuccccucagccucaggaaagguggucaggaaaacucuggc

SEQ ID NO: 432927 - RNA, 64 nt, Human
cagaccagaauggggacaucuuguggucugcugccucaggaaucuccugaccacuuguaguccc

SEQ ID NO: 432928 - RNA, 64 nt, Human
auaaacuaaguucuuuaugauauuugagcaacaacucaggaauauaacauauaagggagauguu

SEQ ID NO: 432929 - RNA, 64 nt, Human
uuucaaacaguaacaucuggagccuggagauauccucaggaagcacaucuguagugcacuccca

SEQ ID NO: 432930 - RNA, 64 nt, Human; identical to SEQ ID NO: 58202

SEQ ID NO: 432931 - RNA, 64 nt, Human; identical to SEQ ID NO: 58203

SEQ ID NO: 432932 - RNA, 64 nt, Human; identical to SEQ ID NO: 58204

SEQ ID NO: 432933 - RNA, 64 nt, Human; identical to SEQ ID NO: 58206

SEQ ID NO: 432934 - RNA, 64 nt, Human
aacucauugauuggguuucuacuucuuucaaggacucaggaaauuucacuuugaacugaggcca

SEQ ID NO: 432935 - RNA, 64 nt, Human
caugagcauguacaaccucuggagcuagaagcuccucaggaaagccaguucuccaaguucuuaa

SEQ ID NO: 432936 - RNA, 64 nt, Human
aggauggaggccuggcuuagaucuuucauuccaccucaggaaugagguugugaucuuuccuguc

SEQ ID NO: 432937 - RNA, 64 nt, Human
aauaucgacgguaaacuacuauuuuguagagaaacucaggaagauuuaaauguugauuugacag

SEQ ID NO: 432938 - RNA, 64 nt, Human
aaugcagauguacgugacaaugagacugaccuuucucaggaauauuuggagcugugcaaauguu

SEQ ID NO: 432939 - RNA, 64 nt, Human
ucuaccuuccuggcaagaggcagaccccggggcccucaggaaggagggaguuggcagcgggggc

SEQ ID NO: 432940 - RNA, 64 nt, Human
uggucuugaacuccugaccucgugauccacccaccucaggaagugcugggauuacaggcgugug

SEQ ID NO: 432941 - RNA, 64 nt, Human
uccaaaauaaaugaugucaccacaaugguguauacucaggaauguguacauuguaaguuacuug

SEQ ID NO: 432942 - RNA, 64 nt, Human
ccucaggcacaaaauuuaagggggcuccaaaaaacucaggaaucaagaucagcaauacagucug

SEQ ID NO: 432943 - RNA, 64 nt, Human
gcauugagacuuaugaaggcauuaggauagauagcucaggaauguaaagguucagaaaaggucu

SEQ ID NO: 432944 - RNA, 64 nt, Human
uggacuccuaccuaucugugcauuuuaccggcaccucaggaaaggagggugaccagguugucuu

SEQ ID NO: 432945 - RNA, 64 nt, Human; identical to SEQ ID NO: 432937

SEQ ID NO: 432946 - RNA, 64 nt, Human; identical to SEQ ID NO: 358040

SEQ ID NO: 432947 - RNA, 64 nt, Human; identical to SEQ ID NO: 358041

SEQ ID NO: 432948 - RNA, 64 nt, Human; identical to SEQ ID NO: 58211

SEQ ID NO: 432949 - RNA, 64 nt, Human; identical to SEQ ID NO: 58212

SEQ ID NO: 432950 - RNA, 64 nt, Human; identical to SEQ ID NO: 58213

SEQ ID NO: 432951 - RNA, 64 nt, Human; identical to SEQ ID NO: 58214

SEQ ID NO: 432952 - RNA, 64 nt, Human; identical to SEQ ID NO: 358042

SEQ ID NO: 432953 - RNA, 64 nt, Human; identical to SEQ ID NO: 358043

SEQ ID NO: 432954 - RNA, 64 nt, Human; identical to SEQ ID NO: 358044

SEQ ID NO: 432955 - RNA, 64 nt, Human; identical to SEQ ID NO: 358045

SEQ ID NO: 432956 - RNA, 64 nt, Human; identical to SEQ ID NO: 358046

SEQ ID NO: 432957 - RNA, 64 nt, Human; identical to SEQ ID NO: 358047

SEQ ID NO: 432958 - RNA, 64 nt, Human; identical to SEQ ID NO: 358048

SEQ ID NO: 432959 - RNA, 64 nt, Human; identical to SEQ ID NO: 358049

SEQ ID NO: 432960 - RNA, 64 nt, Human; identical to SEQ ID NO: 358050

SEQ ID NO: 432961 - RNA, 64 nt, Human; identical to SEQ ID NO: 358051

SEQ ID NO: 432962 - RNA, 64 nt, Human; identical to SEQ ID NO: 358052

SEQ ID NO: 432963 - RNA, 64 nt, Human; identical to SEQ ID NO: 358053

SEQ ID NO: 432964 - RNA, 64 nt, Human; identical to SEQ ID NO: 358054

SEQ ID NO: 432965 - RNA, 64 nt, Human; identical to SEQ ID NO: 358055

SEQ ID NO: 432966 - RNA, 64 nt, Human; identical to SEQ ID NO: 358056

SEQ ID NO: 432967 - RNA, 64 nt, Human; identical to SEQ ID NO: 358057

SEQ ID NO: 432968 - RNA, 64 nt, Human; identical to SEQ ID NO: 58207

SEQ ID NO: 432969 - RNA, 64 nt, Human; identical to SEQ ID NO: 58208

SEQ ID NO: 432970 - RNA, 64 nt, Human; identical to SEQ ID NO: 58209

SEQ ID NO: 432971 - RNA, 64 nt, Human
auuaucguacugguaaaaugcauucaaaauaauuaaagugcauguauuuuccuuguaaacacca

SEQ ID NO: 432972 - RNA, 64 nt, Human; identical to SEQ ID NO: 358058

SEQ ID NO: 432973 - RNA, 64 nt, Human; identical to SEQ ID NO: 358059

SEQ ID NO: 432974 - RNA, 64 nt, Human; identical to SEQ ID NO: 358060

SEQ ID NO: 432975 - RNA, 64 nt, Human; identical to SEQ ID NO: 358061

SEQ ID NO: 432976 - RNA, 64 nt, Human; identical to SEQ ID NO: 358062

SEQ ID NO: 432977 - RNA, 64 nt, Human; identical to SEQ ID NO: 358063

SEQ ID NO: 432978 - RNA, 64 nt, Human; identical to SEQ ID NO: 358064

SEQ ID NO: 432979 - RNA, 64 nt, Human; identical to SEQ ID NO: 358065

SEQ ID NO: 432980 - RNA, 64 nt, Human; identical to SEQ ID NO: 358066

SEQ ID NO: 432981 - RNA, 64 nt, Human; identical to SEQ ID NO: 358067

SEQ ID NO: 432982 - RNA, 64 nt, Human; identical to SEQ ID NO: 358068

SEQ ID NO: 432983 - RNA, 64 nt, Human; identical to SEQ ID NO: 358069

SEQ ID NO: 432984 - RNA, 64 nt, Human; identical to SEQ ID NO: 358070

SEQ ID NO: 432985 - RNA, 64 nt, Human; identical to SEQ ID NO: 358071

SEQ ID NO: 432986 - RNA, 64 nt, Human; identical to SEQ ID NO: 358072

SEQ ID NO: 432987 - RNA, 64 nt, Human; identical to SEQ ID NO: 358073

SEQ ID NO: 432988 - RNA, 64 nt, Human; identical to SEQ ID NO: 58219

SEQ ID NO: 432989 - RNA, 64 nt, Human; identical to SEQ ID NO: 58220

SEQ ID NO: 432990 - RNA, 53 nt, Human; identical to SEQ ID NO: 58221

SEQ ID NO: 432991 - RNA, 64 nt, Human; identical to SEQ ID NO: 58222

SEQ ID NO: 432992 - RNA, 64 nt, Human; identical to SEQ ID NO: 358074

SEQ ID NO: 432993 - RNA, 64 nt, Human; identical to SEQ ID NO: 358075

SEQ ID NO: 432994 - RNA, 64 nt, Human; identical to SEQ ID NO: 358076

SEQ ID NO: 432995 - RNA, 64 nt, Human; identical to SEQ ID NO: 358077

SEQ ID NO: 432996 - RNA, 64 nt, Human; identical to SEQ ID NO: 358078

SEQ ID NO: 432997 - RNA, 64 nt, Human; identical to SEQ ID NO: 358079

SEQ ID NO: 432998 - RNA, 64 nt, Human; identical to SEQ ID NO: 358080

SEQ ID NO: 432999 - RNA, 64 nt, Human; identical to SEQ ID NO: 358081

SEQ ID NO: 433000 - RNA, 64 nt, Human; identical to SEQ ID NO: 358082

SEQ ID NO: 433001 - RNA, 64 nt, Human; identical to SEQ ID NO: 358083

SEQ ID NO: 433002 - RNA, 52 nt, Human; identical to SEQ ID NO: 358084

SEQ ID NO: 433003 - RNA, 64 nt, Human; identical to SEQ ID NO: 358085

SEQ ID NO: 433004 - RNA, 64 nt, Human; identical to SEQ ID NO: 358086

SEQ ID NO: 433005 - RNA, 64 nt, Human; identical to SEQ ID NO: 358087

SEQ ID NO: 433006 - RNA, 64 nt, Human; identical to SEQ ID NO: 358088

SEQ ID NO: 433007 - RNA, 64 nt, Human; identical to SEQ ID NO: 358089

SEQ ID NO: 433008 - RNA, 64 nt, Human; identical to SEQ ID NO: 58223

SEQ ID NO: 433009 - RNA, 64 nt, Human; identical to SEQ ID NO: 58224

SEQ ID NO: 433010 - RNA, 64 nt, Human; identical to SEQ ID NO: 58225

SEQ ID NO: 433011 - RNA, 64 nt, Human
guucgaaagagugaauauuuugccauguucaguuaaagugcacagucuguuacagguugacaca

SEQ ID NO: 433012 - RNA, 64 nt, Human; identical to SEQ ID NO: 358090

SEQ ID NO: 433013 - RNA, 64 nt, Human; identical to SEQ ID NO: 358091

SEQ ID NO: 433014 - RNA, 64 nt, Human; identical to SEQ ID NO: 358092

SEQ ID NO: 433015 - RNA, 64 nt, Human; identical to SEQ ID NO: 358093

SEQ ID NO: 433016 - RNA, 64 nt, Human; identical to SEQ ID NO: 358094

SEQ ID NO: 433017 - RNA, 64 nt, Human; identical to SEQ ID NO: 358095

SEQ ID NO: 433018 - RNA, 64 nt, Human; identical to SEQ ID NO: 358096

SEQ ID NO: 433019 - RNA, 64 nt, Human; identical to SEQ ID NO: 358097

SEQ ID NO: 433020 - RNA, 64 nt, Human; identical to SEQ ID NO: 358098

SEQ ID NO: 433021 - RNA, 64 nt, Human; identical to SEQ ID NO: 358099

SEQ ID NO: 433022 - RNA, 64 nt, Human; identical to SEQ ID NO: 358100

SEQ ID NO: 433023 - RNA, 64 nt, Human; identical to SEQ ID NO: 358101

SEQ ID NO: 433024 - RNA, 64 nt, Human; identical to SEQ ID NO: 358102

SEQ ID NO: 433025 - RNA, 64 nt, Human; identical to SEQ ID NO: 358103

SEQ ID NO: 433026 - RNA, 64 nt, Human; identical to SEQ ID NO: 358104

SEQ ID NO: 433027 - RNA, 64 nt, Human; identical to SEQ ID NO: 358105

SEQ ID NO: 433028 - RNA, 64 nt, Human; identical to SEQ ID NO: 58215

SEQ ID NO: 433029 - RNA, 64 nt, Human; identical to SEQ ID NO: 58216

SEQ ID NO: 433030 - RNA, 64 nt, Human; identical to SEQ ID NO: 58217

SEQ ID NO: 433031 - RNA, 64 nt, Human; identical to SEQ ID NO: 358106

SEQ ID NO: 433032 - RNA, 64 nt, Human; identical to SEQ ID NO: 358107

SEQ ID NO: 433033 - RNA, 64 nt, Human; identical to SEQ ID NO: 358108

SEQ ID NO: 433034 - RNA, 64 nt, Human; identical to SEQ ID NO: 358109

SEQ ID NO: 433035 - RNA, 64 nt, Human; identical to SEQ ID NO: 358110

SEQ ID NO: 433036 - RNA, 64 nt, Human; identical to SEQ ID NO: 358111

SEQ ID NO: 433037 - RNA, 64 nt, Human; identical to SEQ ID NO: 358112

SEQ ID NO: 433038 - RNA, 64 nt, Human; identical to SEQ ID NO: 358113

SEQ ID NO: 433039 - RNA, 64 nt, Human; identical to SEQ ID NO: 358114

SEQ ID NO: 433040 - RNA, 64 nt, Human; identical to SEQ ID NO: 358115

SEQ ID NO: 433041 - RNA, 64 nt, Human; identical to SEQ ID NO: 358116

SEQ ID NO: 433042 - RNA, 64 nt, Human; identical to SEQ ID NO: 358117

SEQ ID NO: 433043 - RNA, 64 nt, Human; identical to SEQ ID NO: 358118

SEQ ID NO: 433044 - RNA, 64 nt, Human; identical to SEQ ID NO: 358119

SEQ ID NO: 433045 - RNA, 64 nt, Human; identical to SEQ ID NO: 358120

SEQ ID NO: 433046 - RNA, 64 nt, Human; identical to SEQ ID NO: 358121

SEQ ID NO: 433047 - RNA, 64 nt, Human; identical to SEQ ID NO: 58227

SEQ ID NO: 433048 - RNA, 64 nt, Human; identical to SEQ ID NO: 58228

SEQ ID NO: 433049 - RNA, 64 nt, Human; identical to SEQ ID NO: 58229

SEQ ID NO: 433050 - RNA, 64 nt, Human; identical to SEQ ID NO: 358122

SEQ ID NO: 433051 - RNA, 64 nt, Human; identical to SEQ ID NO: 358123

SEQ ID NO: 433052 - RNA, 64 nt, Human; identical to SEQ ID NO: 358124

SEQ ID NO: 433053 - RNA, 64 nt, Human; identical to SEQ ID NO: 358125

SEQ ID NO: 433054 - RNA, 64 nt, Human; identical to SEQ ID NO: 358126

SEQ ID NO: 433055 - RNA, 64 nt, Human; identical to SEQ ID NO: 358127

SEQ ID NO: 433056 - RNA, 64 nt, Human; identical to SEQ ID NO: 358128

SEQ ID NO: 433057 - RNA, 64 nt, Human; identical to SEQ ID NO: 358129

SEQ ID NO: 433058 - RNA, 64 nt, Human; identical to SEQ ID NO: 358130

SEQ ID NO: 433059 - RNA, 64 nt, Human; identical to SEQ ID NO: 358131

SEQ ID NO: 433060 - RNA, 64 nt, Human; identical to SEQ ID NO: 358132

SEQ ID NO: 433061 - RNA, 64 nt, Human; identical to SEQ ID NO: 358133

SEQ ID NO: 433062 - RNA, 64 nt, Human; identical to SEQ ID NO: 358134

SEQ ID NO: 433063 - RNA, 64 nt, Human; identical to SEQ ID NO: 358135

SEQ ID NO: 433064 - RNA, 64 nt, Human; identical to SEQ ID NO: 358136

SEQ ID NO: 433065 - RNA, 64 nt, Human; identical to SEQ ID NO: 358137

SEQ ID NO: 433066 - RNA, 57 nt, Human; identical to SEQ ID NO: 358138

SEQ ID NO: 433067 - RNA, 64 nt, Human; identical to SEQ ID NO: 58234

SEQ ID NO: 433068 - RNA, 64 nt, Human; identical to SEQ ID NO: 58235

SEQ ID NO: 433069 - RNA, 64 nt, Human; identical to SEQ ID NO: 358139

SEQ ID NO: 433070 - RNA, 64 nt, Human; identical to SEQ ID NO: 358140

SEQ ID NO: 433071 - RNA, 64 nt, Human; identical to SEQ ID NO: 358141

SEQ ID NO: 433072 - RNA, 64 nt, Human; identical to SEQ ID NO: 358142

SEQ ID NO: 433073 - RNA, 64 nt, Human; identical to SEQ ID NO: 358143

SEQ ID NO: 433074 - RNA, 64 nt, Human; identical to SEQ ID NO: 358144

SEQ ID NO: 433075 - RNA, 64 nt, Human; identical to SEQ ID NO: 358145

SEQ ID NO: 433076 - RNA, 64 nt, Human; identical to SEQ ID NO: 358146

SEQ ID NO: 433077 - RNA, 64 nt, Human; identical to SEQ ID NO: 358147

SEQ ID NO: 433078 - RNA, 64 nt, Human; identical to SEQ ID NO: 358148

SEQ ID NO: 433079 - RNA, 64 nt, Human; identical to SEQ ID NO: 358149

SEQ ID NO: 433080 - RNA, 64 nt, Human; identical to SEQ ID NO: 358150

SEQ ID NO: 433081 - RNA, 64 nt, Human; identical to SEQ ID NO: 358151

SEQ ID NO: 433082 - RNA, 64 nt, Human; identical to SEQ ID NO: 358152

SEQ ID NO: 433083 - RNA, 64 nt, Human; identical to SEQ ID NO: 358153

SEQ ID NO: 433084 - RNA, 64 nt, Human; identical to SEQ ID NO: 358154

SEQ ID NO: 433085 - RNA, 64 nt, Human; identical to SEQ ID NO: 58236

SEQ ID NO: 433086 - RNA, 64 nt, Human; identical to SEQ ID NO: 58237

SEQ ID NO: 433087 - RNA, 64 nt, Human; identical to SEQ ID NO: 58238

SEQ ID NO: 433088 - RNA, 64 nt, Human; identical to SEQ ID NO: 58240

SEQ ID NO: 433089 - RNA, 64 nt, Human; identical to SEQ ID NO: 358155

SEQ ID NO: 433090 - RNA, 64 nt, Human; identical to SEQ ID NO: 358156

SEQ ID NO: 433091 - RNA, 64 nt, Human; identical to SEQ ID NO: 358157

SEQ ID NO: 433092 - RNA, 64 nt, Human; identical to SEQ ID NO: 358158

SEQ ID NO: 433093 - RNA, 64 nt, Human; identical to SEQ ID NO: 358159

SEQ ID NO: 433094 - RNA, 64 nt, Human; identical to SEQ ID NO: 358160

SEQ ID NO: 433095 - RNA, 64 nt, Human; identical to SEQ ID NO: 358161

SEQ ID NO: 433096 - RNA, 64 nt, Human; identical to SEQ ID NO: 358162

SEQ ID NO: 433097 - RNA, 64 nt, Human; identical to SEQ ID NO: 358163

SEQ ID NO: 433098 - RNA, 64 nt, Human; identical to SEQ ID NO: 358164

SEQ ID NO: 433099 - RNA, 64 nt, Human; identical to SEQ ID NO: 358165

SEQ ID NO: 433100 - RNA, 64 nt, Human; identical to SEQ ID NO: 358166

SEQ ID NO: 433101 - RNA, 64 nt, Human; identical to SEQ ID NO: 358167

SEQ ID NO: 433102 - RNA, 64 nt, Human; identical to SEQ ID NO: 358168

SEQ ID NO: 433103 - RNA, 64 nt, Human; identical to SEQ ID NO: 358169

SEQ ID NO: 433104 - RNA, 64 nt, Human; identical to SEQ ID NO: 358170

SEQ ID NO: 433105 - RNA, 64 nt, Human
uuuuccccaccagggucuuguuuaaaggggugagccaccgcacccaguccugagggguggccuc

SEQ ID NO: 433106 - RNA, 64 nt, Human
cccugguggaggcugcugugggacggucaggccaccaccgcaaagaggcagccggagcuucugc

SEQ ID NO: 433107 - RNA, 64 nt, Human
cagccucucagagugcugggaucacaggcgugagccaccgcacccagccuuuuaccaugugggu

SEQ ID NO: 433108 - RNA, 64 nt, Human; identical to SEQ ID NO: 358171

SEQ ID NO: 433109 - RNA, 64 nt, Human; identical to SEQ ID NO: 358172

SEQ ID NO: 433110 - RNA, 64 nt, Human; identical to SEQ ID NO: 358173

SEQ ID NO: 433111 - RNA, 64 nt, Human; identical to SEQ ID NO: 358174

SEQ ID NO: 433112 - RNA, 64 nt, Human; identical to SEQ ID NO: 358175

SEQ ID NO: 433113 - RNA, 63 nt, Human; identical to SEQ ID NO: 358176

SEQ ID NO: 433114 - RNA, 64 nt, Human; identical to SEQ ID NO: 358177

SEQ ID NO: 433115 - RNA, 64 nt, Human; identical to SEQ ID NO: 358178

SEQ ID NO: 433116 - RNA, 64 nt, Human; identical to SEQ ID NO: 358179

SEQ ID NO: 433117 - RNA, 64 nt, Human; identical to SEQ ID NO: 358180

SEQ ID NO: 433118 - RNA, 64 nt, Human; identical to SEQ ID NO: 358181

SEQ ID NO: 433119 - RNA, 64 nt, Human; identical to SEQ ID NO: 358182

SEQ ID NO: 433120 - RNA, 64 nt, Human; identical to SEQ ID NO: 358183

SEQ ID NO: 433121 - RNA, 64 nt, Human; identical to SEQ ID NO: 358184

SEQ ID NO: 433122 - RNA, 64 nt, Human; identical to SEQ ID NO: 358185

SEQ ID NO: 433123 - RNA, 64 nt, Human; identical to SEQ ID NO: 358186

SEQ ID NO: 433124 - RNA, 64 nt, Human
uggcugugugugguggucaccagguccugugagcaaagugcagguuaugcaagucgccaggcag

SEQ ID NO: 433125 - RNA, 64 nt, Human
guauauauuuuaugugauuuauuccuacuaaaugaaagugcacuacugccucauguaaagacuc

SEQ ID NO: 433126 - RNA, 64 nt, Human; identical to SEQ ID NO: 358187

SEQ ID NO: 433127 - RNA, 64 nt, Human; identical to SEQ ID NO: 358188

SEQ ID NO: 433128 - RNA, 64 nt, Human; identical to SEQ ID NO: 358189

SEQ ID NO: 433129 - RNA, 64 nt, Human; identical to SEQ ID NO: 358190

SEQ ID NO: 433130 - RNA, 64 nt, Human; identical to SEQ ID NO: 358191

SEQ ID NO: 433131 - RNA, 64 nt, Human; identical to SEQ ID NO: 358192

SEQ ID NO: 433132 - RNA, 64 nt, Human; identical to SEQ ID NO: 358193

SEQ ID NO: 433133 - RNA, 64 nt, Human; identical to SEQ ID NO: 358194

SEQ ID NO: 433134 - RNA, 64 nt, Human; identical to SEQ ID NO: 358195

SEQ ID NO: 433135 - RNA, 64 nt, Human; identical to SEQ ID NO: 358196

SEQ ID NO: 433136 - RNA, 64 nt, Human; identical to SEQ ID NO: 358197

SEQ ID NO: 433137 - RNA, 64 nt, Human; identical to SEQ ID NO: 358198

SEQ ID NO: 433138 - RNA, 64 nt, Human; identical to SEQ ID NO: 358199

SEQ ID NO: 433139 - RNA, 64 nt, Human; identical to SEQ ID NO: 358200

SEQ ID NO: 433140 - RNA, 64 nt, Human; identical to SEQ ID NO: 358201

SEQ ID NO: 433141 - RNA, 64 nt, Human; identical to SEQ ID NO: 358202

SEQ ID NO: 433142 - RNA, 64 nt, Human; identical to SEQ ID NO: 58149

SEQ ID NO: 433143 - RNA, 64 nt, Human; identical to SEQ ID NO: 58150

SEQ ID NO: 433144 - RNA, 64 nt, Human; identical to SEQ ID NO: 58151

SEQ ID NO: 433145 - RNA, 64 nt, Human; identical to SEQ ID NO: 358203

SEQ ID NO: 433146 - RNA, 64 nt, Human; identical to SEQ ID NO: 358204

SEQ ID NO: 433147 - RNA, 64 nt, Human; identical to SEQ ID NO: 358205

SEQ ID NO: 433148 - RNA, 64 nt, Human; identical to SEQ ID NO: 358206

SEQ ID NO: 433149 - RNA, 64 nt, Human; identical to SEQ ID NO: 358207

SEQ ID NO: 433150 - RNA, 64 nt, Human; identical to SEQ ID NO: 358208

SEQ ID NO: 433151 - RNA, 64 nt, Human; identical to SEQ ID NO: 358209

SEQ ID NO: 433152 - RNA, 64 nt, Human; identical to SEQ ID NO: 358210

SEQ ID NO: 433153 - RNA, 64 nt, Human; identical to SEQ ID NO: 358211

SEQ ID NO: 433154 - RNA, 64 nt, Human; identical to SEQ ID NO: 358212

SEQ ID NO: 433155 - RNA, 64 nt, Human; identical to SEQ ID NO: 358213

SEQ ID NO: 433156 - RNA, 64 nt, Human; identical to SEQ ID NO: 358214

SEQ ID NO: 433157 - RNA, 64 nt, Human; identical to SEQ ID NO: 358215

SEQ ID NO: 433158 - RNA, 64 nt, Human; identical to SEQ ID NO: 358216

SEQ ID NO: 433159 - RNA, 64 nt, Human; identical to SEQ ID NO: 358217

SEQ ID NO: 433160 - RNA, 64 nt, Human; identical to SEQ ID NO: 358218

SEQ ID NO: 433161 - RNA, 64 nt, Human; identical to SEQ ID NO: 58152

SEQ ID NO: 433162 - RNA, 64 nt, Human; identical to SEQ ID NO: 58153

SEQ ID NO: 433163 - RNA, 64 nt, Human; identical to SEQ ID NO: 58154

SEQ ID NO: 433164 - RNA, 60 nt, Human
caacuugugcaaaaagauagaaucaaucauaaagugcacaccuuuauucagaacuuuagu

SEQ ID NO: 433165 - RNA, 64 nt, Human; identical to SEQ ID NO: 358219

SEQ ID NO: 433166 - RNA, 64 nt, Human; identical to SEQ ID NO: 358220

SEQ ID NO: 433167 - RNA, 64 nt, Human; identical to SEQ ID NO: 358221

SEQ ID NO: 433168 - RNA, 64 nt, Human; identical to SEQ ID NO: 358222

SEQ ID NO: 433169 - RNA, 64 nt, Human; identical to SEQ ID NO: 358223

SEQ ID NO: 433170 - RNA, 64 nt, Human; identical to SEQ ID NO: 358224

SEQ ID NO: 433171 - RNA, 64 nt, Human; identical to SEQ ID NO: 358225

SEQ ID NO: 433172 - RNA, 64 nt, Human; identical to SEQ ID NO: 358226

SEQ ID NO: 433173 - RNA, 64 nt, Human; identical to SEQ ID NO: 358227

SEQ ID NO: 433174 - RNA, 64 nt, Human; identical to SEQ ID NO: 358228

SEQ ID NO: 433175 - RNA, 64 nt, Human; identical to SEQ ID NO: 358229

SEQ ID NO: 433176 - RNA, 64 nt, Human; identical to SEQ ID NO: 358230

SEQ ID NO: 433177 - RNA, 64 nt, Human; identical to SEQ ID NO: 358231

SEQ ID NO: 433178 - RNA, 64 nt, Human; identical to SEQ ID NO: 358232

SEQ ID NO: 433179 - RNA, 64 nt, Human; identical to SEQ ID NO: 358233

SEQ ID NO: 433180 - RNA, 64 nt, Human; identical to SEQ ID NO: 358234

SEQ ID NO: 433181 - RNA, 51 nt, Human; identical to SEQ ID NO: 358235

SEQ ID NO: 433182 - RNA, 64 nt, Human; identical to SEQ ID NO: 58156

SEQ ID NO: 433183 - RNA, 64 nt, Human; identical to SEQ ID NO: 58157

SEQ ID NO: 433184 - RNA, 64 nt, Human; identical to SEQ ID NO: 358236

SEQ ID NO: 433185 - RNA, 64 nt, Human; identical to SEQ ID NO: 358237

SEQ ID NO: 433186 - RNA, 64 nt, Human; identical to SEQ ID NO: 358238

SEQ ID NO: 433187 - RNA, 64 nt, Human; identical to SEQ ID NO: 358239

SEQ ID NO: 433188 - RNA, 64 nt, Human; identical to SEQ ID NO: 358240

SEQ ID NO: 433189 - RNA, 64 nt, Human; identical to SEQ ID NO: 358241

SEQ ID NO: 433190 - RNA, 64 nt, Human; identical to SEQ ID NO: 358242

SEQ ID NO: 433191 - RNA, 64 nt, Human; identical to SEQ ID NO: 358243

SEQ ID NO: 433192 - RNA, 64 nt, Human; identical to SEQ ID NO: 358244

SEQ ID NO: 433193 - RNA, 64 nt, Human; identical to SEQ ID NO: 358245

SEQ ID NO: 433194 - RNA, 64 nt, Human; identical to SEQ ID NO: 358246

SEQ ID NO: 433195 - RNA, 64 nt, Human; identical to SEQ ID NO: 358247

SEQ ID NO: 433196 - RNA, 64 nt, Human; identical to SEQ ID NO: 358248

SEQ ID NO: 433197 - RNA, 64 nt, Human; identical to SEQ ID NO: 358249

SEQ ID NO: 433198 - RNA, 64 nt, Human; identical to SEQ ID NO: 358250

SEQ ID NO: 433199 - RNA, 64 nt, Human; identical to SEQ ID NO: 358251

SEQ ID NO: 433200 - RNA, 64 nt, Human; identical to SEQ ID NO: 58158

SEQ ID NO: 433201 - RNA, 64 nt, Human; identical to SEQ ID NO: 58159

SEQ ID NO: 433202 - RNA, 64 nt, Human; identical to SEQ ID NO: 58160

SEQ ID NO: 433203 - RNA, 64 nt, Human; identical to SEQ ID NO: 358252

SEQ ID NO: 433204 - RNA, 64 nt, Human; identical to SEQ ID NO: 358253

SEQ ID NO: 433205 - RNA, 64 nt, Human; identical to SEQ ID NO: 358254

SEQ ID NO: 433206 - RNA, 64 nt, Human; identical to SEQ ID NO: 358255

SEQ ID NO: 433207 - RNA, 64 nt, Human; identical to SEQ ID NO: 358256

SEQ ID NO: 433208 - RNA, 64 nt, Human; identical to SEQ ID NO: 358257

SEQ ID NO: 433209 - RNA, 64 nt, Human; identical to SEQ ID NO: 358258

SEQ ID NO: 433210 - RNA, 64 nt, Human; identical to SEQ ID NO: 358259

SEQ ID NO: 433211 - RNA, 64 nt, Human; identical to SEQ ID NO: 358260

SEQ ID NO: 433212 - RNA, 64 nt, Human; identical to SEQ ID NO: 358261

SEQ ID NO: 433213 - RNA, 64 nt, Human; identical to SEQ ID NO: 358262

SEQ ID NO: 433214 - RNA, 64 nt, Human; identical to SEQ ID NO: 358263

SEQ ID NO: 433215 - RNA, 64 nt, Human; identical to SEQ ID NO: 358264

SEQ ID NO: 433216 - RNA, 64 nt, Human; identical to SEQ ID NO: 358265

SEQ ID NO: 433217 - RNA, 64 nt, Human; identical to SEQ ID NO: 358266

SEQ ID NO: 433218 - RNA, 64 nt, Human; identical to SEQ ID NO: 358267

SEQ ID NO: 433219 - RNA, 64 nt, Human; identical to SEQ ID NO: 58162

SEQ ID NO: 433220 - RNA, 64 nt, Human; identical to SEQ ID NO: 58163

SEQ ID NO: 433221 - RNA, 64 nt, Human; identical to SEQ ID NO: 58164

SEQ ID NO: 433222 - RNA, 64 nt, Human; identical to SEQ ID NO: 358268

SEQ ID NO: 433223 - RNA, 64 nt, Human; identical to SEQ ID NO: 358269

SEQ ID NO: 433224 - RNA, 64 nt, Human; identical to SEQ ID NO: 358270

SEQ ID NO: 433225 - RNA, 64 nt, Human; identical to SEQ ID NO: 358271

SEQ ID NO: 433226 - RNA, 64 nt, Human; identical to SEQ ID NO: 358272

SEQ ID NO: 433227 - RNA, 64 nt, Human; identical to SEQ ID NO: 358273

SEQ ID NO: 433228 - RNA, 64 nt, Human; identical to SEQ ID NO: 358274

SEQ ID NO: 433229 - RNA, 64 nt, Human; identical to SEQ ID NO: 358275

SEQ ID NO: 433230 - RNA, 64 nt, Human; identical to SEQ ID NO: 358276

SEQ ID NO: 433231 - RNA, 64 nt, Human; identical to SEQ ID NO: 358277

SEQ ID NO: 433232 - RNA, 64 nt, Human; identical to SEQ ID NO: 358278

SEQ ID NO: 433233 - RNA, 64 nt, Human; identical to SEQ ID NO: 358279

SEQ ID NO: 433234 - RNA, 64 nt, Human; identical to SEQ ID NO: 358280

SEQ ID NO: 433235 - RNA, 64 nt, Human; identical to SEQ ID NO: 358281

SEQ ID NO: 433236 - RNA, 64 nt, Human; identical to SEQ ID NO: 358282

SEQ ID NO: 433237 - RNA, 64 nt, Human; identical to SEQ ID NO: 358283

SEQ ID NO: 433238 - RNA, 64 nt, Human; identical to SEQ ID NO: 58165

SEQ ID NO: 433239 - RNA, 64 nt, Human; identical to SEQ ID NO: 58166

SEQ ID NO: 433240 - RNA, 64 nt, Human; identical to SEQ ID NO: 58167

SEQ ID NO: 433241 - RNA, 64 nt, Human; identical to SEQ ID NO: 358284

SEQ ID NO: 433242 - RNA, 64 nt, Human; identical to SEQ ID NO: 358285

SEQ ID NO: 433243 - RNA, 64 nt, Human; identical to SEQ ID NO: 358286

SEQ ID NO: 433244 - RNA, 64 nt, Human; identical to SEQ ID NO: 358287

SEQ ID NO: 433245 - RNA, 64 nt, Human; identical to SEQ ID NO: 358288

SEQ ID NO: 433246 - RNA, 64 nt, Human; identical to SEQ ID NO: 358289

SEQ ID NO: 433247 - RNA, 64 nt, Human; identical to SEQ ID NO: 358290

SEQ ID NO: 433248 - RNA, 64 nt, Human; identical to SEQ ID NO: 358291

SEQ ID NO: 433249 - RNA, 62 nt, Human; identical to SEQ ID NO: 358292

SEQ ID NO: 433250 - RNA, 64 nt, Human; identical to SEQ ID NO: 358293

SEQ ID NO: 433251 - RNA, 64 nt, Human; identical to SEQ ID NO: 358294

SEQ ID NO: 433252 - RNA, 64 nt, Human; identical to SEQ ID NO: 358295

SEQ ID NO: 433253 - RNA, 64 nt, Human; identical to SEQ ID NO: 358296

SEQ ID NO: 433254 - RNA, 64 nt, Human; identical to SEQ ID NO: 358297

SEQ ID NO: 433255 - RNA, 64 nt, Human; identical to SEQ ID NO: 358298

SEQ ID NO: 433256 - RNA, 64 nt, Human; identical to SEQ ID NO: 358299

SEQ ID NO: 433257 - RNA, 64 nt, Human; identical to SEQ ID NO: 58169

SEQ ID NO: 433258 - RNA, 64 nt, Human; identical to SEQ ID NO: 58170

SEQ ID NO: 433259 - RNA, 64 nt, Human; identical to SEQ ID NO: 58171

SEQ ID NO: 433260 - RNA, 64 nt, Human; identical to SEQ ID NO: 58172

SEQ ID NO: 433261 - RNA, 64 nt, Human; identical to SEQ ID NO: 358300

SEQ ID NO: 433262 - RNA, 64 nt, Human; identical to SEQ ID NO: 358301

SEQ ID NO: 433263 - RNA, 64 nt, Human; identical to SEQ ID NO: 358302

SEQ ID NO: 433264 - RNA, 64 nt, Human; identical to SEQ ID NO: 358303

SEQ ID NO: 433265 - RNA, 64 nt, Human; identical to SEQ ID NO: 358304

SEQ ID NO: 433266 - RNA, 64 nt, Human; identical to SEQ ID NO: 358305

SEQ ID NO: 433267 - RNA, 55 nt, Human; identical to SEQ ID NO: 358306

SEQ ID NO: 433268 - RNA, 64 nt, Human; identical to SEQ ID NO: 358307

SEQ ID NO: 433269 - RNA, 64 nt, Human; identical to SEQ ID NO: 358308

SEQ ID NO: 433270 - RNA, 64 nt, Human; identical to SEQ ID NO: 358309

SEQ ID NO: 433271 - RNA, 64 nt, Human; identical to SEQ ID NO: 358310

SEQ ID NO: 433272 - RNA, 64 nt, Human; identical to SEQ ID NO: 358311

SEQ ID NO: 433273 - RNA, 64 nt, Human; identical to SEQ ID NO: 358312

SEQ ID NO: 433274 - RNA, 64 nt, Human; identical to SEQ ID NO: 358313

SEQ ID NO: 433275 - RNA, 64 nt, Human; identical to SEQ ID NO: 358314

SEQ ID NO: 433276 - RNA, 64 nt, Human; identical to SEQ ID NO: 358315

SEQ ID NO: 433277 - RNA, 64 nt, Human; identical to SEQ ID NO: 58173

SEQ ID NO: 433278 - RNA, 64 nt, Human; identical to SEQ ID NO: 58174

SEQ ID NO: 433279 - RNA, 64 nt, Human; identical to SEQ ID NO: 58175

SEQ ID NO: 433280 - RNA, 64 nt, Human; identical to SEQ ID NO: 358316

SEQ ID NO: 433281 - RNA, 64 nt, Human; identical to SEQ ID NO: 358317

SEQ ID NO: 433282 - RNA, 64 nt, Human; identical to SEQ ID NO: 358318

SEQ ID NO: 433283 - RNA, 64 nt, Human; identical to SEQ ID NO: 358319

SEQ ID NO: 433284 - RNA, 64 nt, Human; identical to SEQ ID NO: 358320

SEQ ID NO: 433285 - RNA, 64 nt, Human; identical to SEQ ID NO: 358321

SEQ ID NO: 433286 - RNA, 64 nt, Human; identical to SEQ ID NO: 358322

SEQ ID NO: 433287 - RNA, 64 nt, Human; identical to SEQ ID NO: 358323

SEQ ID NO: 433288 - RNA, 64 nt, Human; identical to SEQ ID NO: 358324

SEQ ID NO: 433289 - RNA, 64 nt, Human; identical to SEQ ID NO: 358325

SEQ ID NO: 433290 - RNA, 64 nt, Human; identical to SEQ ID NO: 358326

SEQ ID NO: 433291 - RNA, 64 nt, Human; identical to SEQ ID NO: 358327

SEQ ID NO: 433292 - RNA, 64 nt, Human; identical to SEQ ID NO: 358328

SEQ ID NO: 433293 - RNA, 64 nt, Human; identical to SEQ ID NO: 358329

SEQ ID NO: 433294 - RNA, 64 nt, Human; identical to SEQ ID NO: 358330

SEQ ID NO: 433295 - RNA, 64 nt, Human; identical to SEQ ID NO: 358331

SEQ ID NO: 433296 - RNA, 64 nt, Human
caucaugcaauuuugaaaauuguguccagaauuaaaagugcauagaaauagccuuuacaauugu

SEQ ID NO: 433297 - RNA, 64 nt, Human
uuacacacacucagguugagucauucuaacuauaaaagugcaaugacuaagauccuucacuucu

SEQ ID NO: 433298 - RNA, 64 nt, Human
uuacucuuagaaucgcaugcuguagaaaugcucaaaagugcauaugggacucaguccuuaggug

SEQ ID NO: 433299 - RNA, 64 nt, Human; identical to SEQ ID NO: 358332

SEQ ID NO: 433300 - RNA, 64 nt, Human; identical to SEQ ID NO: 358333

SEQ ID NO: 433301 - RNA, 64 nt, Human; identical to SEQ ID NO: 358334

SEQ ID NO: 433302 - RNA, 64 nt, Human; identical to SEQ ID NO: 358335

SEQ ID NO: 433303 - RNA, 64 nt, Human; identical to SEQ ID NO: 358336

SEQ ID NO: 433304 - RNA, 64 nt, Human; identical to SEQ ID NO: 358337

SEQ ID NO: 433305 - RNA, 64 nt, Human; identical to SEQ ID NO: 358338

SEQ ID NO: 433306 - RNA, 64 nt, Human; identical to SEQ ID NO: 358339

SEQ ID NO: 433307 - RNA, 64 nt, Human; identical to SEQ ID NO: 358340

SEQ ID NO: 433308 - RNA, 64 nt, Human; identical to SEQ ID NO: 358341

SEQ ID NO: 433309 - RNA, 53 nt, Human; identical to SEQ ID NO: 358342

SEQ ID NO: 433310 - RNA, 64 nt, Human; identical to SEQ ID NO: 358343

SEQ ID NO: 433311 - RNA, 64 nt, Human; identical to SEQ ID NO: 358344

SEQ ID NO: 433312 - RNA, 64 nt, Human; identical to SEQ ID NO: 358345

SEQ ID NO: 433313 - RNA, 64 nt, Human; identical to SEQ ID NO: 358346

SEQ ID NO: 433314 - RNA, 64 nt, Human; identical to SEQ ID NO: 358346

SEQ ID NO: 433315 - RNA, 55 nt, Human; identical to SEQ ID NO: 58177

SEQ ID NO: 433316 - RNA, 64 nt, Human; identical to SEQ ID NO: 58178

SEQ ID NO: 433317 - RNA, 64 nt, Human; identical to SEQ ID NO: 58179

SEQ ID NO: 433318 - RNA, 64 nt, Human; identical to SEQ ID NO: 58180

SEQ ID NO: 433319 - RNA, 64 nt, Human; identical to SEQ ID NO: 86684

SEQ ID NO: 433320 - RNA, 64 nt, Human; identical to SEQ ID NO: 86685

SEQ ID NO: 433321 - RNA, 64 nt, Human; identical to SEQ ID NO: 86686

SEQ ID NO: 433322 - RNA, 64 nt, Human; identical to SEQ ID NO: 86687

SEQ ID NO: 433323 - RNA, 64 nt, Human; identical to SEQ ID NO: 86688

SEQ ID NO: 433324 - RNA, 54 nt, Human; identical to SEQ ID NO: 58181

SEQ ID NO: 433325 - RNA, 64 nt, Human; identical to SEQ ID NO: 58182

SEQ ID NO: 433326 - RNA, 54 nt, Human; identical to SEQ ID NO: 58183

SEQ ID NO: 433327 - RNA, 64 nt, Human; identical to SEQ ID NO: 86689

SEQ ID NO: 433328 - RNA, 64 nt, Human; identical to SEQ ID NO: 86690

SEQ ID NO: 433329 - RNA, 64 nt, Human; identical to SEQ ID NO: 86691

SEQ ID NO: 433330 - RNA, 64 nt, Human; identical to SEQ ID NO: 86692

SEQ ID NO: 433331 - RNA, 64 nt, Human; identical to SEQ ID NO: 86693

SEQ ID NO: 433332 - RNA, 64 nt, Human; identical to SEQ ID NO: 86694

SEQ ID NO: 433333 - RNA, 64 nt, Human; identical to SEQ ID NO: 86695

SEQ ID NO: 433334 - RNA, 64 nt, Human; identical to SEQ ID NO: 86696

SEQ ID NO: 433335 - RNA, 64 nt, Human; identical to SEQ ID NO: 86697

SEQ ID NO: 433336 - RNA, 64 nt, Human; identical to SEQ ID NO: 86698

SEQ ID NO: 433337 - RNA, 64 nt, Human; identical to SEQ ID NO: 86699

SEQ ID NO: 433338 - RNA, 64 nt, Human; identical to SEQ ID NO: 86700

SEQ ID NO: 433339 - RNA, 64 nt, Human; identical to SEQ ID NO: 86701

SEQ ID NO: 433340 - RNA, 64 nt, Human; identical to SEQ ID NO: 86702

SEQ ID NO: 433341 - RNA, 64 nt, Human; identical to SEQ ID NO: 86703

SEQ ID NO: 433342 - RNA, 64 nt, Human; identical to SEQ ID NO: 86704

SEQ ID NO: 433343 - RNA, 64 nt, Human; identical to SEQ ID NO: 58147

SEQ ID NO: 433344 - RNA, 64 nt, Human; identical to SEQ ID NO: 58185

SEQ ID NO: 433345 - RNA, 64 nt, Human; identical to SEQ ID NO: 58186

SEQ ID NO: 433346 - RNA, 64 nt, Human; identical to SEQ ID NO: 86705

SEQ ID NO: 433347 - RNA, 64 nt, Human; identical to SEQ ID NO: 86706

SEQ ID NO: 433348 - RNA, 64 nt, Human; identical to SEQ ID NO: 86707

SEQ ID NO: 433349 - RNA, 64 nt, Human; identical to SEQ ID NO: 86708

SEQ ID NO: 433350 - RNA, 64 nt, Human; identical to SEQ ID NO: 86709

SEQ ID NO: 433351 - RNA, 64 nt, Human; identical to SEQ ID NO: 86710

SEQ ID NO: 433352 - RNA, 64 nt, Human; identical to SEQ ID NO: 86711

SEQ ID NO: 433353 - RNA, 64 nt, Human; identical to SEQ ID NO: 86712

SEQ ID NO: 433354 - RNA, 64 nt, Human; identical to SEQ ID NO: 86713

SEQ ID NO: 433355 - RNA, 64 nt, Human; identical to SEQ ID NO: 86714

SEQ ID NO: 433356 - RNA, 64 nt, Human; identical to SEQ ID NO: 86715

SEQ ID NO: 433357 - RNA, 64 nt, Human; identical to SEQ ID NO: 86716

SEQ ID NO: 433358 - RNA, 64 nt, Human; identical to SEQ ID NO: 86717

SEQ ID NO: 433359 - RNA, 64 nt, Human; identical to SEQ ID NO: 86718

SEQ ID NO: 433360 - RNA, 64 nt, Human; identical to SEQ ID NO: 86719

SEQ ID NO: 433361 - RNA, 64 nt, Human; identical to SEQ ID NO: 86720

SEQ ID NO: 433362 - RNA, 64 nt, Human; identical to SEQ ID NO: 58187

SEQ ID NO: 433363 - RNA, 64 nt, Human; identical to SEQ ID NO: 58188

SEQ ID NO: 433364 - RNA, 64 nt, Human; identical to SEQ ID NO: 58189

SEQ ID NO: 433365 - RNA, 64 nt, Human; identical to SEQ ID NO: 86721

SEQ ID NO: 433366 - RNA, 64 nt, Human; identical to SEQ ID NO: 86722

SEQ ID NO: 433367 - RNA, 64 nt, Human; identical to SEQ ID NO: 86723

SEQ ID NO: 433368 - RNA, 64 nt, Human; identical to SEQ ID NO: 86724

SEQ ID NO: 433369 - RNA, 64 nt, Human; identical to SEQ ID NO: 86725

SEQ ID NO: 433370 - RNA, 64 nt, Human; identical to SEQ ID NO: 86726

SEQ ID NO: 433371 - RNA, 64 nt, Human; identical to SEQ ID NO: 86727

SEQ ID NO: 433372 - RNA, 64 nt, Human; identical to SEQ ID NO: 86728

SEQ ID NO: 433373 - RNA, 64 nt, Human; identical to SEQ ID NO: 86729

SEQ ID NO: 433374 - RNA, 64 nt, Human; identical to SEQ ID NO: 86730

SEQ ID NO: 433375 - RNA, 64 nt, Human; identical to SEQ ID NO: 86731

SEQ ID NO: 433376 - RNA, 64 nt, Human; identical to SEQ ID NO: 86732

SEQ ID NO: 433377 - RNA, 64 nt, Human; identical to SEQ ID NO: 86733

SEQ ID NO: 433378 - RNA, 64 nt, Human; identical to SEQ ID NO: 86734

SEQ ID NO: 433379 - RNA, 64 nt, Human; identical to SEQ ID NO: 86735

SEQ ID NO: 433380 - RNA, 64 nt, Human; identical to SEQ ID NO: 86736

SEQ ID NO: 433381 - RNA, 64 nt, Human; identical to SEQ ID NO: 58191

SEQ ID NO: 433382 - RNA, 64 nt, Human; identical to SEQ ID NO: 58192

SEQ ID NO: 433383 - RNA, 64 nt, Human; identical to SEQ ID NO: 58193

SEQ ID NO: 433384 - RNA, 64 nt, Human; identical to SEQ ID NO: 86737

SEQ ID NO: 433385 - RNA, 64 nt, Human; identical to SEQ ID NO: 86738

SEQ ID NO: 433386 - RNA, 64 nt, Human; identical to SEQ ID NO: 86739

SEQ ID NO: 433387 - RNA, 64 nt, Human; identical to SEQ ID NO: 86740

SEQ ID NO: 433388 - RNA, 64 nt, Human; identical to SEQ ID NO: 86741

SEQ ID NO: 433389 - RNA, 64 nt, Human; identical to SEQ ID NO: 86742

SEQ ID NO: 433390 - RNA, 64 nt, Human; identical to SEQ ID NO: 86743

SEQ ID NO: 433391 - RNA, 64 nt, Human; identical to SEQ ID NO: 86744

SEQ ID NO: 433392 - RNA, 64 nt, Human; identical to SEQ ID NO: 86745

SEQ ID NO: 433393 - RNA, 64 nt, Human; identical to SEQ ID NO: 86746

SEQ ID NO: 433394 - RNA, 64 nt, Human; identical to SEQ ID NO: 86747

SEQ ID NO: 433395 - RNA, 64 nt, Human; identical to SEQ ID NO: 86748

SEQ ID NO: 433396 - RNA, 64 nt, Human; identical to SEQ ID NO: 86749

SEQ ID NO: 433397 - RNA, 64 nt, Human; identical to SEQ ID NO: 86750

SEQ ID NO: 433398 - RNA, 64 nt, Human; identical to SEQ ID NO: 86751

SEQ ID NO: 433399 - RNA, 64 nt, Human; identical to SEQ ID NO: 86752

SEQ ID NO: 433400 - RNA, 64 nt, Human; identical to SEQ ID NO: 86753

SEQ ID NO: 433401 - RNA, 64 nt, Human; identical to SEQ ID NO: 86754

SEQ ID NO: 433402 - RNA, 64 nt, Human; identical to SEQ ID NO: 86755

SEQ ID NO: 433403 - RNA, 64 nt, Human; identical to SEQ ID NO: 86756

SEQ ID NO: 433404 - RNA, 59 nt, Human; identical to SEQ ID NO: 86757

SEQ ID NO: 433405 - RNA, 64 nt, Human; identical to SEQ ID NO: 86758

SEQ ID NO: 433406 - RNA, 64 nt, Human; identical to SEQ ID NO: 86759

SEQ ID NO: 433407 - RNA, 64 nt, Human; identical to SEQ ID NO: 86760

SEQ ID NO: 433408 - RNA, 52 nt, Human; identical to SEQ ID NO: 86761

SEQ ID NO: 433409 - RNA, 64 nt, Human; identical to SEQ ID NO: 86762

SEQ ID NO: 433410 - RNA, 64 nt, Human; identical to SEQ ID NO: 86763

SEQ ID NO: 433411 - RNA, 64 nt, Human; identical to SEQ ID NO: 86764

SEQ ID NO: 433412 - RNA, 64 nt, Human; identical to SEQ ID NO: 86765

SEQ ID NO: 433413 - RNA, 64 nt, Human; identical to SEQ ID NO: 86766

SEQ ID NO: 433414 - RNA, 64 nt, Human; identical to SEQ ID NO: 86767

SEQ ID NO: 433415 - RNA, 64 nt, Human; identical to SEQ ID NO: 86768

SEQ ID NO: 433416 - RNA, 64 nt, Human; identical to SEQ ID NO: 86769

SEQ ID NO: 433417 - RNA, 64 nt, Human; identical to SEQ ID NO: 86770

SEQ ID NO: 433418 - RNA, 64 nt, Human; identical to SEQ ID NO: 86771

SEQ ID NO: 433419 - RNA, 64 nt, Human; identical to SEQ ID NO: 86772

SEQ ID NO: 433420 - RNA, 64 nt, Human; identical to SEQ ID NO: 86773

SEQ ID NO: 433421 - RNA, 64 nt, Human; identical to SEQ ID NO: 86774

SEQ ID NO: 433422 - RNA, 64 nt, Human; identical to SEQ ID NO: 86775

SEQ ID NO: 433423 - RNA, 64 nt, Human; identical to SEQ ID NO: 86776

SEQ ID NO: 433424 - RNA, 64 nt, Human; identical to SEQ ID NO: 86777

SEQ ID NO: 433425 - RNA, 64 nt, Human; identical to SEQ ID NO: 86778

SEQ ID NO: 433426 - RNA, 64 nt, Human; identical to SEQ ID NO: 86779

SEQ ID NO: 433427 - RNA, 64 nt, Human; identical to SEQ ID NO: 86780

SEQ ID NO: 433428 - RNA, 64 nt, Human; identical to SEQ ID NO: 86781

SEQ ID NO: 433429 - RNA, 64 nt, Human; identical to SEQ ID NO: 86782

SEQ ID NO: 433430 - RNA, 64 nt, Human; identical to SEQ ID NO: 86783

SEQ ID NO: 433431 - RNA, 64 nt, Human; identical to SEQ ID NO: 86784

SEQ ID NO: 433432 - RNA, 64 nt, Human; identical to SEQ ID NO: 86785

SEQ ID NO: 433433 - RNA, 64 nt, Human
agaggcugcuggcugaccuccugcacaacgucagccagaacaucgcggccgagacccgggcuga

SEQ ID NO: 433434 - RNA, 64 nt, Human
gaaagucuuaagcaaaauacucccaggucucacuccagaacauaaaaauggugugugaucaaau

SEQ ID NO: 433435 - RNA, 64 nt, Human
gggggucggagacaccgcugcuuagcacccccagccagaacacccugagggucucggggcucug

SEQ ID NO: 433436 - RNA, 64 nt, Human
gugucacacuguuuccugggauucaaguaugcaaccagaacacaggagaagaaaagcuccagga

SEQ ID NO: 433437 - RNA, 64 nt, Human
agcuggaacccgaggggccggggaagcugccagcccagaacaccccuaaugagggugugagaag

SEQ ID NO: 433438 - RNA, 64 nt, Human
cuguuuucaagggcaagugcuuguugaagucuugccagaacaaacugaucacaagaagacagca

SEQ ID NO: 433439 - RNA, 64 nt, Human
ugaagguagcugccuccugaaagccagcauuaagccagaacacccagguucaagcaaaagaccc

SEQ ID NO: 433440 - RNA, 64 nt, Human
uuggggauuuuucuuuauagugagcugugggaacccagaacacacacguuuucccuacagcaga

SEQ ID NO: 433441 - RNA, 64 nt, Human
caucucuacuacuguuuauuuuucccugcugugcccagaacauuggcguagacacaguaagaac

SEQ ID NO: 433442 - RNA, 64 nt, Human
ggaucuuagagcuaaaaaggacuguaaaaauuacccagaacagcguccucagacuuaaccuucu

SEQ ID NO: 433443 - RNA, 64 nt, Human
ccucaggugauacuaugaccaugaguagcaucagccagaacaugagagggagaacuaacucaag

SEQ ID NO: 433444 - RNA, 64 nt, Human
aguuucugccucacucaucccuccuguacccuggccagaacaucucacugauacucgaauucuu

SEQ ID NO: 433445 - RNA, 64 nt, Human
agugugaccccagaagccacgaugugcucuguauccagaacacacuuggcagauggaggaagca

SEQ ID NO: 433446 - RNA, 64 nt, Human
caauguaaaugacaaaacauaauuccugagaggcccagaacaaacuggagucuagccuggaguu

SEQ ID NO: 433447 - RNA, 64 nt, Human; identical to SEQ ID NO: 58116

SEQ ID NO: 433448 - RNA, 64 nt, Human; identical to SEQ ID NO: 58117

SEQ ID NO: 433449 - RNA, 64 nt, Human
caaauuugcaauuucuuaagauuucuaaaauuuaccagaacaguuuagccuggggguuaauagu

SEQ ID NO: 433450 - RNA, 64 nt, Human
uuacuacuguggaaaaauauuuaagauaguuuugccagaacaguuuguacagacguaugcuuau

SEQ ID NO: 433451 - RNA, 64 nt, Human
uuugcaaagauaggcaaaaaggauugaauccauaccagaacacguagacaggcuguaauauuca

SEQ ID NO: 433452 - RNA, 64 nt, Human
guuccuucaucaucgaaauagugauuaagugaucccagaacaaggaauacuagaguaaaaagca

SEQ ID NO: 433453 - RNA, 64 nt, Human
aguggggacaggaaggaccacucccuaaguaaucccagaacaauggcuauucaugugggaaaaa

SEQ ID NO: 433454 - RNA, 64 nt, Human
ugcgcuuucucagcccugggaggggcgccugaacccagaacauuucccuaaccccaaccuggua

SEQ ID NO: 433455 - RNA, 64 nt, Human
aacaccucagagggcugcccuccagaggcugcacccagaacagugggacaugagcaggggugug

SEQ ID NO: 433456 - RNA, 64 nt, Human
gccuggaaaagaaccagaaggaggcugggcagaaccagaacaaccugcacuucugccaaggcca

SEQ ID NO: 433457 - RNA, 63 nt, Human
ccuucccuagaaaggccugacccuccuuacccaccagaacagggguuuugaugcccucacuag

SEQ ID NO: 433458 - RNA, 64 nt, Human
acagauacuacaauuccagaauccuggcuaugacccagaacacuguccagauuccuggcucccu

SEQ ID NO: 433459 - RNA, 64 nt, Human
agcaucugaaaggaaugaugcagaugagaagcacccagaacaugcugagcagaacaucagaaaa

SEQ ID NO: 433460 - RNA, 64 nt, Human
gucaggcugcucgggaaaugugggaacuggacacccagaacacugcugugcuggggcuauuugg

SEQ ID NO: 433461 - RNA, 64 nt, Human
ccaaccccaucucagagcucagaggguacaagcuccagaacaguaaccaagugggaaaauaaag

SEQ ID NO: 433462 - RNA, 64 nt, Human
acaggaguuauuggauuuagaguuacugcuaaccccagaacagaaucuguucuuuuaccuuuga

SEQ ID NO: 433463 - RNA, 64 nt, Human
uuuggaagauagcuauaugguaacucaucauuaaccagaacaccucuccccucaaauuccguga

SEQ ID NO: 433464 - RNA, 64 nt, Human
uagucccagcucauagguguucauacuguuacauccagaacauuugucaggcucucugucagcu

SEQ ID NO: 433465 - RNA, 64 nt, Human; identical to SEQ ID NO: 58118

SEQ ID NO: 433466 - RNA, 64 nt, Human; identical to SEQ ID NO: 58119

SEQ ID NO: 433467 - RNA, 64 nt, Human; identical to SEQ ID NO: 58120

SEQ ID NO: 433468 - RNA, 60 nt, Human
acccgcugagcacagcaugaggccagggccccagaacacagugccuggcaaggccucugc

SEQ ID NO: 433469 - RNA, 64 nt, Human
uucuucgcaaccgcaauccggagcgcggcaguauccagaacaauaagcagguccugcggaacuu

SEQ ID NO: 433470 - RNA, 64 nt, Human
aauuuuaaaaagaaaaguaauuaccuuuguguuuccagaacacuauaauugggguguaucuuaa

SEQ ID NO: 433471 - RNA, 64 nt, Human
uuuuccuguugaauguauuuuuaugagauuuuaaccagaacaaaggcagauaaacaggcauucc

SEQ ID NO: 433472 - RNA, 64 nt, Human
uccucuuccuccucuuccuucuccuccuccauccccagaacaaaccgaaaucaggauacccaac

SEQ ID NO: 433473 - RNA, 64 nt, Human
aacauauuacuuugaauucaaauugucaugaaaaccagaacaguguuuguccauguugcaugua

SEQ ID NO: 433474 - RNA, 64 nt, Human
cuccaggacuucuccaacuuacuauuagacuaaaccagaacaagcaacaaacuguauuuaugca

SEQ ID NO: 433475 - RNA, 64 nt, Human
cccccacccaacuuucuuaggagugaucugguggccagaacaggauuuugcacggccccuuuua

SEQ ID NO: 433476 - RNA, 64 nt, Human
gcagaugccaaaauacucuucugaaaacagcaacccagaacaagacuuaaagcugacaucagag

SEQ ID NO: 433477 - RNA, 64 nt, Human
uuguaagaacaaucauaaaaggacuuguuagucuccagaacaucugcuaaaaugcaaguauaug

SEQ ID NO: 433478 - RNA, 64 nt, Human
ugaguuuaugggaaugccuuuucccucuggcacuccagaacaaaccucuauauguugcugaaac

SEQ ID NO: 433479 - RNA, 64 nt, Human
guaauguaugcaacugcaaacguuacaacugcagccagaacaauggcuggguggaucgcacgua

SEQ ID NO: 433480 - RNA, 64 nt, Human
uguauguuaccuuuuccaccucucauuguuuuccccagaacauuguagauggggguuggcagag

SEQ ID NO: 433481 - RNA, 64 nt, Human
cuggcgaugugggcauccugggguucuuagggucccagaacaagccccaggcaagcuggaacuu

SEQ ID NO: 433482 - RNA, 64 nt, Human
ucagggucaacucccaggccucagaugcaggggcccagaacaccugcucucaccugagccccag

SEQ ID NO: 433483 - RNA, 64 nt, Human
caccugcucucaccugaaccccaggugaaggggcccagaacaccugcucucaccugagccccag

SEQ ID NO: 433484 - RNA, 64 nt, Human; identical to SEQ ID NO: 58122

SEQ ID NO: 433485 - RNA, 64 nt, Human; identical to SEQ ID NO: 58123

SEQ ID NO: 433486 - RNA, 64 nt, Human; identical to SEQ ID NO: 58124

SEQ ID NO: 433487 - RNA, 64 nt, Human
cuugaagauacagguaccccacgaagucucagugccagaacauaagcccugaagugggcagggg

SEQ ID NO: 433488 - RNA, 64 nt, Human
ccaggaaccuugccuucgucaucuguggauccauccagaacagcgguaucugaagcccaggcca

SEQ ID NO: 433489 - RNA, 64 nt, Human
agcagcaagggccaugggguggugcuucccuggaccagaacagacuggaaacugggcagcaagc

SEQ ID NO: 433490 - RNA, 64 nt, Human
gcuccacucucugguuucuaauaaacagggaucuccagaacacuggugguggacacagcuuucc

SEQ ID NO: 433491 - RNA, 64 nt, Human
caaugagggcgaaugacauuacagcuugaccucuccagaacacuaauauccuaaaauacagaac

SEQ ID NO: 433492 - RNA, 64 nt, Human
agcuagcaucuaauuugcacaacuagaacacaucccagaacaauuacugaaaagcugaaauuua

SEQ ID NO: 433493 - RNA, 64 nt, Human
uaagaauuuccaucaauaauuuaugaauaaguuuccagaacaaauuuccuaauaacacaaucag

SEQ ID NO: 433494 - RNA, 64 nt, Human
agcaugagaccuggguuuaugcagaucucuacugccagaacaugaauucagguaaccugguguc

SEQ ID NO: 433495 - RNA, 64 nt, Human
uccugguucucagucccaccccaaaaccuggcacccagaacaguuggaaguguggaaaggaggu

SEQ ID NO: 433496 - RNA, 64 nt, Human
uugccuguuuucggaucugugguuccuuugaaagccagaacaauggaucggcuuccuuacccag

SEQ ID NO: 433497 - RNA, 52 nt, Human
agcgaaaggaaaaagucuagacccagaacaaucaggagauuggaagcaaauu

SEQ ID NO: 433498 - RNA, 64 nt, Human
ccaccacacuuggccuacauuuuuucuuuauauaccagaacaucuauaacaggcaccuuaucua

SEQ ID NO: 433499 - RNA, 64 nt, Human
ccuuuucuuuacccuuuugucuuuuaaaauaaucccagaacaccaaaaauaaaaacaaacaaua

SEQ ID NO: 433500 - RNA, 64 nt, Human
uggaaugcuuuguaauacuugcaugcuucuuagaccagaacauguagguccccuugugucucaa

SEQ ID NO: 433501 - RNA, 64 nt, Human
uuuuaguauauauagcccaaaaugguaacugucuccagaacagcaaccacauugaauucuugug

SEQ ID NO: 433502 - RNA, 64 nt, Human
ccuucuaaaaacucaugugcagguuugauaaacaccagaacagaagacagugaugcuguauuau

SEQ ID NO: 433503 - RNA, 64 nt, Human; identical to SEQ ID NO: 58125

SEQ ID NO: 433504 - RNA, 64 nt, Human; identical to SEQ ID NO: 58126

SEQ ID NO: 433505 - RNA, 64 nt, Human; identical to SEQ ID NO: 58127

SEQ ID NO: 433506 - RNA, 64 nt, Human
aaaugccuuuguuuuuuuguuauuauuuucuuagccagaacaucucucuuugaacucacacuga

SEQ ID NO: 433507 - RNA, 64 nt, Human
acaaguuuucuguuacuuuuuaaaaagaaaaaauccagaacauaagaacuauauuaugaacaca

SEQ ID NO: 433508 - RNA, 64 nt, Human
acacguugugcuuuuucugggcuucccuuaucccccagaacacucuaccaaccucggggaacuc

SEQ ID NO: 433509 - RNA, 64 nt, Human
cccugguagcauuugcucagagccuacgcuugguccagaacaucaaacuccaaacccuggggac

SEQ ID NO: 433510 - RNA, 64 nt, Human
gccuccugccuuaccguggcaguacggagacaguccagaacauggucuucuugccacggggugu

SEQ ID NO: 433511 - RNA, 64 nt, Human
uaccaaaucuguacuugggagcagccugcuggauccagaacaugacaacagagagcugcgucca

SEQ ID NO: 433512 - RNA, 64 nt, Human
uacuauaaaggacacaaagagaaaacuuuaccuuccagaacaaaaugacuccugaugaacagug

SEQ ID NO: 433513 - RNA, 64 nt, Human
uaucccacagcaaucggaguucuugaagaagaaaccagaacaaauaaaauagaaacaauaauca

SEQ ID NO: 433514 - RNA, 64 nt, Human
gcucuaaaagcaccuccuugucacuuuauuacucccagaacaacaacuauccugacuucuaaua

SEQ ID NO: 433515 - RNA, 64 nt, Human
uagcuucccuucccucccccuucacccacucccuccagaacauuuaguguagaugaaaaugugg

SEQ ID NO: 433516 - RNA, 64 nt, Human
acagacucccacugucuccagaagucguggccuuccagaacagucugccccucaaggaagggug

SEQ ID NO: 433517 - RNA, 64 nt, Human
agaggcauagauccuauccugggagaguuuagauccagaacaucuuggagauacacaguagauu

SEQ ID NO: 433518 - RNA, 64 nt, Human
ggcgcugguguguuugccagagacccagcagggaccagaacagaugaaaauccugccaucuugg

SEQ ID NO: 433519 - RNA, 64 nt, Human
ugcaagacaacauagccacagguggggauuaggaccagaacaucuuuggggugcuguuauucug

SEQ ID NO: 433520 - RNA, 64 nt, Human
ucaugccuguuggggaucaggcagccuccugaugccagaacaccucaggcagagcccuacucag

SEQ ID NO: 433521 - RNA, 64 nt, Human
guuucccucugcuguggcggugacugcuucuggaccagaacagcuccagcucccagguauuuuc

SEQ ID NO: 433522 - RNA, 54 nt, Human; identical to SEQ ID NO: 58194

SEQ ID NO: 433523 - RNA, 64 nt, Human; identical to SEQ ID NO: 58195

SEQ ID NO: 433524 - RNA, 64 nt, Human; identical to SEQ ID NO: 58196

SEQ ID NO: 433525 - RNA, 64 nt, Human
ugugauuguugaaguacaaaaggaacuaugaaaaccagaacaaauuuuaacaaaaggacaacca

SEQ ID NO: 433526 - RNA, 64 nt, Human
ucuaacacaacgccaacagaagcacauuugucuuccagaacaccgugccuuagaaaugcuuuag

SEQ ID NO: 433527 - RNA, 64 nt, Human
gcugcccaaaugcacgcacacgcacagagacaugccagaacauacaaggacaugcugccugaac

SEQ ID NO: 433528 - RNA, 64 nt, Human
augguguguguguccagaggugugugugaggcugccagaacaagugcugggucugucacagaga

SEQ ID NO: 433529 - RNA, 64 nt, Human
caccugccuguucaguggaggccagggcagcagcccagaacagcacaugugggggagguggccc

SEQ ID NO: 433530 - RNA, 64 nt, Human
uuacuaaaauuacaaggaccugcuuuuuaaaaggccagaacaauugucugaaauuaguaacaau

SEQ ID NO: 433531 - RNA, 64 nt, Human
acaaugaauaguuuuucauuguaccaugaaauauccagaacauacuuauauguaaaguauuauu

SEQ ID NO: 433532 - RNA, 64 nt, Human
aucaucagcaggagaugagacuaugaauuggcauccagaacaggagauuuagagcaaaaucuaa

SEQ ID NO: 433533 - RNA, 64 nt, Human
uggcuggagagcugaucagccaggcacagaaucuccagaacaaccuagagagugaaugcuaauu

SEQ ID NO: 433534 - RNA, 64 nt, Human
cauuucacagagguuuaaauacuguggagugacaccagaacacagccaaagaggcuagaagcaa

SEQ ID NO: 433535 - RNA, 64 nt, Human
cugccuggcauuacuccuccaaagacugcugcccccagaacaggcagggggugugggagggcca

SEQ ID NO: 433536 - RNA, 64 nt, Human
ggaacuaaucagacguggaccucaacuucugauuccagaacacgccggagauugcugcugcuuu

SEQ ID NO: 433537 - RNA, 64 nt, Human
uucucucccuaagaacauuagauauuuuaguuuuccagaacaaaagcuuuaaacuucugcagua

SEQ ID NO: 433538 - RNA, 64 nt, Human
uuuuuuuuuuuuugcucauauucacauauguaaaccagaacauucuauguacuacaaaccuggu

SEQ ID NO: 433539 - RNA, 64 nt, Human
cauuuuauuaaguaugauugacacagcccaugggccagaacacacucuacaaaaugacuaggau

SEQ ID NO: 433540 - RNA, 64 nt, Human
caagcugcucaucuguuaguaagugauguucacuccagaacacauucaugaugagaacuuucua

SEQ ID NO: 433541 - RNA, 64 nt, Human; identical to SEQ ID NO: 58129

SEQ ID NO: 433542 - RNA, 64 nt, Human; identical to SEQ ID NO: 58130

SEQ ID NO: 433543 - RNA, 64 nt, Human; identical to SEQ ID NO: 58131

SEQ ID NO: 433544 - RNA, 64 nt, Human
ugcaaucaaaagacuggugguuaagcuuguaaaaccagaacaucuuuuggcauuccacuaagua

SEQ ID NO: 433545 - RNA, 64 nt, Human
agcuggagggucagccaccaagcugggagcugagccagaacaggagugaugucucugcccuucc

SEQ ID NO: 433546 - RNA, 64 nt, Human
ccaugcuuggagcauuggguaucugaugucugcaccagaacaagagaaccucugacgguggaga

SEQ ID NO: 433547 - RNA, 64 nt, Human
uuucucuuccuuuggugggaagaaugagaguuauccagaacaauuaggaucugucaugaccaga

SEQ ID NO: 433548 - RNA, 64 nt, Human
cuguugggacuugggauucugacucaccccaaacccagaacaugaagaagaccuuuacaguuug

SEQ ID NO: 433549 - RNA, 64 nt, Human
uuuacccagugguuagguugcauuucuaccccauccagaacauucuuggaagagcacccggagc

SEQ ID NO: 433550 - RNA, 64 nt, Human
aaaagccagaggguucaccuagucagacgaaacuccagaacagugcuuguggagggccugacug

SEQ ID NO: 433551 - RNA, 64 nt, Human
acccaaauauaaccauuuaaagaaagaaugcauuccagaacaaauuguuuacauaaguuccuau

SEQ ID NO: 433552 - RNA, 64 nt, Human
uuuaaccacuugccucuuucuccagcagcugauuccagaacaaaucauuauguuuccuaacugu

SEQ ID NO: 433553 - RNA, 64 nt, Human
acaauuccccuguggccugcuggacugguuggaaccagaacaggcuaaggcauacaguucuuga

SEQ ID NO: 433554 - RNA, 64 nt, Human
auaagaacugaccaauagcuccaagugucacacaccagaacauuaagccuaaguccucaauuca

SEQ ID NO: 433555 - RNA, 64 nt, Human
cuguuucuccuugguuaaaauuauacuugaaggcccagaacacucauggcacauuuguuuaaua

SEQ ID NO: 433556 - RNA, 64 nt, Human
uuuucagaaugccaaaugaaggcuaaaauuuuggccagaacauuacaaaaguuuuaaaucguag

SEQ ID NO: 433557 - RNA, 64 nt, Human
gccuaaaggaggaaaagucccaccaacuaccagaccagaacacgagccccucugggcagcagga

SEQ ID NO: 433558 - RNA, 64 nt, Human
acauuccccaaucaauacacacacacugcagaacccagaacagaaggccacaggcuggcacuac

SEQ ID NO: 433559 - RNA, 64 nt, Human
uaaggacucgguucuguguugggaccccaaaaaaccagaacaaguucugugugccuccuuucag

SEQ ID NO: 433560 - RNA, 64 nt, Human; identical to SEQ ID NO: 58132

SEQ ID NO: 433561 - RNA, 64 nt, Human; identical to SEQ ID NO: 58133

SEQ ID NO: 433562 - RNA, 64 nt, Human; identical to SEQ ID NO: 58134

SEQ ID NO: 433563 - RNA, 64 nt, Human
gcacuccauccucauguauccuuuuucacggggaccagaacacugguacgucaucaccaaagcc

SEQ ID NO: 433564 - RNA, 64 nt, Human
ucugugaggagcugugggaaguguggguuugucuccagaacagaagagaaugauggauauucug

SEQ ID NO: 433565 - RNA, 64 nt, Human
cuggugcguuguggucuccgguggggccagauccccagaacagggagagacugcauacaagucu

SEQ ID NO: 433566 - RNA, 64 nt, Human
uuucucuugggguuguaagguagucuccugcuuuccagaacacuuuauuauauuucacuuauag

SEQ ID NO: 433567 - RNA, 64 nt, Human
ucuccuuaaaaaccgauauuuuuuuaucauggaaccagaacaucugucaugcaguguugucccu

SEQ ID NO: 433568 - RNA, 64 nt, Human
agcggugcugcccgugccgccugaagagcugcagccagaacagguggcugagcuguggggccgg

SEQ ID NO: 433569 - RNA, 64 nt, Human
agucacauguuuuucuuccuuguccccacggcccccagaacaacauucucccugcuggcagccc

SEQ ID NO: 433570 - RNA, 64 nt, Human
caugagcaggcgacucaguggcccaaaacaggacccagaacauucauccguaaauggaaucuga

SEQ ID NO: 433571 - RNA, 64 nt, Human
cuuugacguccaccccacgcugaugcagaagcucccagaacacucaggaaacuucuccggacag

SEQ ID NO: 433572 - RNA, 64 nt, Human
gaucucagcacugaacgauuucaagcccuacgcaccagaacagaaggaggguggaggaagugau

SEQ ID NO: 433573 - RNA, 64 nt, Human
uuacuucugcuauuccggagcccaugccuagaagccagaacaacuccauguuacacugaguuca

SEQ ID NO: 433574 - RNA, 64 nt, Human
aucaagaaagaggugacuucuguuguaaaauaauccagaacacuucaaaauuauuccuaaauca

SEQ ID NO: 433575 - RNA, 64 nt, Human
cuagauugguccuugugaggggaguuuuaagaauccagaacaucuugcucuugaucagcacauc

SEQ ID NO: 433576 - RNA, 64 nt, Human
guaugcaucucuauauauauuuucccucucaaaaccagaacaucaacagugcuguuucugacac

SEQ ID NO: 433577 - RNA, 64 nt, Human
aauuaggaccacaugugagauguuuacaagacacccagaacagugguaaagugugcauacuaga

SEQ ID NO: 433578 - RNA, 64 nt, Human
aaugcuugucagacacaugcccuucggcagcauuccagaacaggagggaagagaaagagaaaac

SEQ ID NO: 433579 - RNA, 64 nt, Human; identical to SEQ ID NO: 58136

SEQ ID NO: 433580 - RNA, 64 nt, Human; identical to SEQ ID NO: 58137

SEQ ID NO: 433581 - RNA, 55 nt, Human; identical to SEQ ID NO: 58138

SEQ ID NO: 433582 - RNA, 64 nt, Human
acacuacuugcacuggaucuuacgcaaaaaagaaccagaacacacaguguggacaacugcccau

SEQ ID NO: 433583 - RNA, 64 nt, Human
uaauggccucaacaccuucugaacguggauagugccagaacacuuaggagggugucuuuggacc

SEQ ID NO: 433584 - RNA, 64 nt, Human
ugucugugaaauaccucuacuuucccucccauauccagaacaaaaugauacuugacauccuucc

SEQ ID NO: 433585 - RNA, 64 nt, Human
gggaggggcugggggucaguccagcccgggccucccagaacaccaggcccguguggguggcacc

SEQ ID NO: 433586 - RNA, 64 nt, Human
cauuuggggaagccaagcaaggauaguaaauugaccagaacacaguugugggaauuuggucuga

SEQ ID NO: 433587 - RNA, 64 nt, Human
auuauauacaagguuuuaaguaaacauaaaauuuccagaacaaaaauaaaaaauuuaaaauuca

SEQ ID NO: 433588 - RNA, 64 nt, Human
cacuguaggcagcagugacuaagcacuggcaguuccagaacauuuacccagguauauguuacua

SEQ ID NO: 433589 - RNA, 64 nt, Human
gacaauagugcaugagagucuagagaaguagugaccagaacagggcagaguagguccccuccau

SEQ ID NO: 433590 - RNA, 64 nt, Human
gcugagucuagugccccuauuauuaacaauucccccagaacauggaaauaaccauuguuuacag

SEQ ID NO: 433591 - RNA, 64 nt, Human
uaaggacuuccacuuuguucaagaaagcuguaucccagaacacuagacacuucaaauuguuuug

SEQ ID NO: 433592 - RNA, 64 nt, Human
aggcgcuccuagucuggucagugccaagaggcuaccagaacauggggcagguggcugguguugg

SEQ ID NO: 433593 - RNA, 64 nt, Human
agagauaguaaugcucaggacaggagcggcagccccagaacaggccacucauuuagaauucuag

SEQ ID NO: 433594 - RNA, 64 nt, Human
agagggcagagggguaggcagagccuuuggaugaccagaacaagguucccucugagaauuccaa

SEQ ID NO: 433595 - RNA, 64 nt, Human
ccuuccaacgcaucacccgccucaaacugcugcuccagaacauucugaagagaacacagccugg

SEQ ID NO: 433596 - RNA, 64 nt, Human
cacauccucacacccaaagaaguuuguaaauguuccagaacaaccuagagaacaccugaguacu

SEQ ID NO: 433597 - RNA, 64 nt, Human
ggaacagcuaaggaauaauuuuaauaaaagugaaccagaacaaaucacucauuuaaaaaguaau

SEQ ID NO: 433598 - RNA, 64 nt, Human
ccaucccagaagcucauucucagaugcacaacagccagaacagucucaagcagcauucuagagc

SEQ ID NO: 433599 - RNA, 64 nt, Human
gcacaaaguaagccucaccuuugccuuccaacugccagaacauggauuccacugaaauagagug

SEQ ID NO: 433600 - RNA, 64 nt, Human
ggauuucuacuuuggucuucaagaaagcugugccccagaacaccagagauuucaacuuagucaa

SEQ ID NO: 433601 - RNA, 64 nt, Human
ggacuucugguuugcucuucaagaaagcugugccccagaacaccagagaccucaaauuacuuua

SEQ ID NO: 433602 - RNA, 64 nt, Human
aaguugaaacaggggcccaucaucaugucuguuuccagaacagugccuuggucaucccacaucc

SEQ ID NO: 433603 - RNA, 64 nt, Human
cccagaucacauuccaguuccuucauuccuucuuccagaacaucuggguccucccuccucugug

SEQ ID NO: 433604 - RNA, 64 nt, Human
cccaggggccggccuccucugccugguaaugacuccagaacaacaacugggaagaaacuugaag

SEQ ID NO: 433605 - RNA, 61 nt, Human
ggggaggucuuuuuaguuaagcuggcaauuaccagaacaauuauguuucuugcuguauuau

SEQ ID NO: 433606 - RNA, 64 nt, Human
uguaguucucuauuaaccugaaauguacacuagcccagaacaguuuaaugguacuuacugagcu

SEQ ID NO: 433607 - RNA, 64 nt, Human
uguguugcuauuauauuuggcaggaacccagaguccagaacauuucaucuaugauggguuagau

SEQ ID NO: 433608 - RNA, 64 nt, Human
agaaggaaaugcagggcacaugaucuggcccuccccagaacaaucuggauuucacggagacagc

SEQ ID NO: 433609 - RNA, 64 nt, Human
aagugacccuguccagugucugcuugccauccugccagaacaggcccucaagcccaagagccau

SEQ ID NO: 433610 - RNA, 64 nt, Human
caagaaucacauucguuucccagugaaaagcaaaccagaacaaaacaaaaagccaccgcaauaa

SEQ ID NO: 433611 - RNA, 64 nt, Human
augcuucugggggcccugccuccccauugugugcccagaacaucccuggccccaccccgccacu

SEQ ID NO: 433612 - RNA, 64 nt, Human
auuauccuuucuuuuucaaucccauugcuaacacccagaacauauuuucuguucaaugcaaaua

SEQ ID NO: 433613 - RNA, 64 nt, Human
ucgauuaucauaaauucacaaaauauuuuugcaaccagaacacaaaagcaggcuagucagcuaa

SEQ ID NO: 433614 - RNA, 62 nt, Human; identical to SEQ ID NO: 432350

SEQ ID NO: 433615 - RNA, 64 nt, Human
cgcccucagccgcggagccucugcggaggcugagccccgcgaccggagcgccgcucuccgcuuc

SEQ ID NO: 433616 - RNA, 64 nt, Human
ggaggggcagaguuaaacauuagccacaauggccccccgcgaagugagucauacuccccacaag

SEQ ID NO: 433617 - RNA, 64 nt, Human
uuuugaccaaacaguagauauuuucuauuuuucaccagaacacauaaaaacacuuuuuuucuuu

SEQ ID NO: 433618 - RNA, 64 nt, Human
accucgauuaaaguugccaaauugauuacuggauccagaacacaauuuuccccucagaacagau

SEQ ID NO: 433619 - RNA, 64 nt, Human
agaaaaggaaucagagaaucuacaacauagggccccagaacaacaguuucacuuuguggcuuuu

SEQ ID NO: 433620 - RNA, 64 nt, Human
ggugauucaaaguguuguguuccuggcugaugauccagaacaguggcucguaucccaaaucugu

SEQ ID NO: 433621 - RNA, 64 nt, Human
ccuaguccgccuucguucaagggucaggaauggaccagaacagauggguucuggaggccccuga

SEQ ID NO: 433622 - RNA, 64 nt, Human
cuagucccaugaagucucaccuuguugacuuccaccagaacaaaaccuguuaauucagcuugac

SEQ ID NO: 433623 - RNA, 64 nt, Human
guggcccagagaagcuuccagcacagcccucuacccagaacauccgggcuggagggaggcuccc

SEQ ID NO: 433624 - RNA, 64 nt, Human
cgcuguccauugccacggccaugagggcuggagaccagaacagcauggcccgaagcgugcgggg

SEQ ID NO: 433625 - RNA, 55 nt, Human
uugccugccucaucucuugaacucuccagaacaacucuaugaggaagaugccagu

SEQ ID NO: 433626 - RNA, 64 nt, Human
agugguucuggaaucaauguuuuccagucccaucccagaacaucaguuguaagauaaguacaau

SEQ ID NO: 433627 - RNA, 64 nt, Human
aaugucuggagagccgaguugcagugcuggaaguccagaacaagaagcuuauagaggaacuuga

SEQ ID NO: 433628 - RNA, 64 nt, Human
agagauugguuuguuuacugugcaucccuggugcccagaacagggcauggcauauuguuggugc

SEQ ID NO: 433629 - RNA, 64 nt, Human
uuuguuaaguucagccauuauuacuuuugguaucccagaacaugacaaauuaugaauaaaacaa

SEQ ID NO: 433630 - RNA, 64 nt, Human
agaccuaucgucuuggaacuugccauucuuuccuccagaacaaaauguuaacuuucuaacacau

SEQ ID NO: 433631 - RNA, 60 nt, Human
uagaugagagcucugucugagcccagccucccagaacaaaugcucuuccaagccagccua

SEQ ID NO: 433632 - RNA, 64 nt, Human
cuuuuacgagugcuaaguguaggauauuuugucaccagaacacaaugcuaccgccccaaaguaa

SEQ ID NO: 433633 - RNA, 62 nt, Human; identical to SEQ ID NO: 431276

SEQ ID NO: 433634 - RNA, 62 nt, Human
cuaagaaggcaguaauugaaugcugcccuggcucguccuagaaucauuucuccuccaugaug

SEQ ID NO: 433635 - RNA, 62 nt, Human; identical to SEQ ID NO: 432348

SEQ ID NO: 433636 - RNA, 64 nt, Human
cuucugcccuccucuugcacuuggguucugacucccagaacaaagaacuugggagaacaguacg

SEQ ID NO: 433637 - RNA, 64 nt, Human
aagccuagucuugucucucaagagcaucucggacccagaacauucuccaguagugcauucaguu

SEQ ID NO: 433638 - RNA, 64 nt, Human
ugaccagucuagguugaaagauaggcagccuuacccagaacacaacauuagcagcugggaaggu

SEQ ID NO: 433639 - RNA, 64 nt, Human
uggggccacaccccaaaacucuacacccucugccccagaacaauucugcagaguggugaaguuc

SEQ ID NO: 433640 - RNA, 64 nt, Human
caacccugcuaacaugguuuugcacaucuagcauccagaacagugagaauguauuucugcuguu

SEQ ID NO: 433641 - RNA, 64 nt, Human
gggcaguuggcaaaaguccaaguagagauuacacccagaacaccauuccuuccaggagcaguag

SEQ ID NO: 433642 - RNA, 61 nt, Human
cuccucccauugauuuauaagaaucacguguccagaacacucugauucacagccaaggauc

SEQ ID NO: 433643 - RNA, 64 nt, Human
uucacuugaaaucaugucccuauuucuaccccggccagaacauggacagaggccagaagccuuc

SEQ ID NO: 433644 - RNA, 64 nt, Human
gccagccugccagaggcaaaugcaaaagagguccccagaacacagccagcugggcagccccuua

SEQ ID NO: 433645 - RNA, 64 nt, Human
caucucgggcacaggcccaccccgccccaccccuccagaacacggcucacgcuuaccucaacca

SEQ ID NO: 433646 - RNA, 64 nt, Human
gaagguuuggaauauauauauuuaagcuuuauuuccagaacagugaggguuaggucuugggaaa

SEQ ID NO: 433647 - RNA, 64 nt, Human
uucugcccuugccaacggagagcgccugccccucccagaacacacuccaucagcuuaggggcug

SEQ ID NO: 433648 - RNA, 64 nt, Human
gcuggagacuggaccgcugacugcaccagcgcccccagaacauacacugugaacucaaucucca

SEQ ID NO: 433649 - RNA, 64 nt, Human
ccugucagucugcuccccaucccccagccuggggccagaacagccuaccccaggacaggagucc

SEQ ID NO: 433650 - RNA, 64 nt, Human
uccaacauuagcucuaauuaguucauuuccaaucccagaacacauggagggaaucggacaggug

SEQ ID NO: 433651 - RNA, 64 nt, Human
acucccugacaaaagugaagaauuaacuucuccuccagaacaagugcaauucagaaggcagcuc

SEQ ID NO: 433652 - RNA, 64 nt, Human
cccugccggcacggcucccccuccuggaccagucccccgcgagcccggagaaggggagacccgu

SEQ ID NO: 433653 - RNA, 64 nt, Human
caguggaggcgggacgcccuccaucuccucggagccccgcgagguccggcccagcaacuucccg

SEQ ID NO: 433654 - RNA, 64 nt, Human
cccauuggaugaaguggugcccucuccucuggucccccgcgaaaagguaaauacacccaaaggg

SEQ ID NO: 433655 - RNA, 64 nt, Human
gaaggggagcucugagacagagcaaacacccaccccagaacaagccgacacacagggagacggg

SEQ ID NO: 433656 - RNA, 64 nt, Human
ccggaagggagcccccugcuccucccaacaaacuccagaacagcagaaagcgggugcuguagag

SEQ ID NO: 433657 - RNA, 64 nt, Human
aauuaaauacucuauuguucaauucucuaaaaucccagaacacaaucagaaauagcucaggcag

SEQ ID NO: 433658 - RNA, 64 nt, Human
cuacagaucaaagacuccuccaaaaagcacaagcccagaacaugggucaccaauggggggugga

SEQ ID NO: 433659 - RNA, 64 nt, Human
ucagaauaauuauugcauaguagaauuuauuacuccagaacagaaagaccuuacuucauuucaa

SEQ ID NO: 433660 - RNA, 64 nt, Human
auucugggggcuucugagagagcccagccugaugccagaacaaaggacagagaauuuaagcaca

SEQ ID NO: 433661 - RNA, 64 nt, Human
gucauuacaauuacauugcaugaggaaaauuuuuccagaacaacaguguggaauaguucugaau

SEQ ID NO: 433662 - RNA, 64 nt, Human
aggauacaaaaaaaaacauuuaaaaauccgagacccagaacacuucuggucccaagcauuucag

SEQ ID NO: 433663 - RNA, 64 nt, Human
aaauugcugguagaucuacugacuguagccaucaccagaacacuuaguuucuucccagacauga

SEQ ID NO: 433664 - RNA, 64 nt, Human
accucucaacuuuuauugcuguauucuagucagaccagaacauacuuccacuacaucaguuacu

SEQ ID NO: 433665 - RNA, 64 nt, Human
uuuuuaucgaugacuugguggcuuuuccuugaauccagaacacaaccuuguuuguggugucccc

SEQ ID NO: 433666 - RNA, 64 nt, Human
caaauccuaggcuccugggaggcccuggcagaagccagaacacauggcugggccuuuccagccc

SEQ ID NO: 433667 - RNA, 64 nt, Human
ccuuccuucccuagcugugucuuggucuucaaucccagaacaggaccugugagcagcugcauug

SEQ ID NO: 433668 - RNA, 64 nt, Human
ggaaagggaagcacaugaucaugggaaugauagcccagaacaaaaagaaaucuugucuuaccac

SEQ ID NO: 433669 - RNA, 64 nt, Human
cauuuacaugucauuugacugucucacuuuuuacccagaacaguaacaacccacaccgucuucc

SEQ ID NO: 433670 - RNA, 64 nt, Human
uccugcccuuuuggcuugcagacugccuucuaucccagaacagcugagaaaucuaugaagcuga

SEQ ID NO: 433671 - RNA, 55 nt, Human; identical to SEQ ID NO: 58139

SEQ ID NO: 433672 - RNA, 64 nt, Human; identical to SEQ ID NO: 58140

SEQ ID NO: 433673 - RNA, 64 nt, Human; identical to SEQ ID NO: 58141

SEQ ID NO: 433674 - RNA, 64 nt, Human
uucaguaguguuuguguugugcgcucaccccauuccagaacaaauccaagaggccaguccucca

SEQ ID NO: 433675 - RNA, 64 nt, Human
uucuacggggaggagggggggaucaucaggaagcccagaacacuaacaagcgguucucccaucu

SEQ ID NO: 433676 - RNA, 64 nt, Human
ccaauuuguccaaagaguugaaaucacuuuaaugccagaacaugguaaauuugcagccauuuca

SEQ ID NO: 433677 - RNA, 64 nt, Human
gacucugagccaacagcuggaccgugucucauccccagaacaugccgucuguccccaccgggga

SEQ ID NO: 433678 - RNA, 64 nt, Human
cugacacauuagccuugaacaaccagauggugacccagaacaggacuccacacagcguuugcca

SEQ ID NO: 433679 - RNA, 64 nt, Human
ggagauuacaguguuuuucugaccuaguucaagaccagaacaugggucauaggguuuuuauuca

SEQ ID NO: 433680 - RNA, 64 nt, Human
ggaaguucauagccaggauagggcgggagaggcaccagaacauuucucuccacugacuuucuca

SEQ ID NO: 433681 - RNA, 64 nt, Human
uggguaacucaagcagcuauucuuucuguagggaccagaacacgagaauuugaagagcauggca

SEQ ID NO: 433682 - RNA, 64 nt, Human
cacagaguuaaaacuugggauuccccuggcccccccagaacacuuguauauuguuuguuugagg

SEQ ID NO: 433683 - RNA, 64 nt, Human
uucgggcccuacgcgcagcuccugcagguggcuuccagaacaucgccugucuccguagcaaugc

SEQ ID NO: 433684 - RNA, 64 nt, Human
auuaucacuuccugauucuuaagcuucaucagcaccagaacacuuaauucucuucaauuuccuu

SEQ ID NO: 433685 - RNA, 64 nt, Human
guuauuucaagcucaaacucugaauaugauuaaaccagaacaccccacccccaacugccaaaaa

SEQ ID NO: 433686 - RNA, 64 nt, Human
gugacugcagugcuguaaacuuaacuguucuuugccagaacacaagacaccaaauugaacucac

SEQ ID NO: 433687 - RNA, 64 nt, Human
aaaauugguuuucacucauuugauugguuugagcccagaacagccuacaggggaaaaacaagcu

SEQ ID NO: 433688 - RNA, 64 nt, Human
ccucggacaccaccauggucagcgaccuggucucccagaacaucaaugucuuccugcggaacac

SEQ ID NO: 433689 - RNA, 64 nt, Human
ucuccucggguggguccagcaggggcccugcccaccagaacacaguccgugcugugcugcgcua

SEQ ID NO: 433690 - RNA, 64 nt, Human
agucacuucuuggcugugcagcaggucccccccuccccgcgauaugcuggaggguaggauucug

SEQ ID NO: 433691 - RNA, 64 nt, Human
agcagcgcccgaggccagggccgccgaagggcagccccgcgaccaccccugugcgcgcguucgc

SEQ ID NO: 433692 - RNA, 64 nt, Human
cagccucaaauuccagaaguggaggcuccagccuccccgcgaggguccagccccacagucuucu

SEQ ID NO: 433693 - RNA, 64 nt, Human
uuugcauauuucuguaauauugcaguccccagauccagaacaugggaaguuagggaaaaugugu

SEQ ID NO: 433694 - RNA, 64 nt, Human
acuugccagucucuccagugugggcaccagccggccagaacagaugcgagcaguccaugacucu

SEQ ID NO: 433695 - RNA, 64 nt, Human
ucacugaugugguuguuguaucccucauccaaccccagaacacuuucuguaaucugaguuuuuu

SEQ ID NO: 433696 - RNA, 64 nt, Human
gcuaauuuacuggacaaagaauuccaaagcaaaaccagaacaguaugaauuugagcaggucuca

SEQ ID NO: 433697 - RNA, 64 nt, Human
aucaaucccuuuuugaaacaacucacggagaaaaccagaacauaaauggccuccugccagcucc

SEQ ID NO: 433698 - RNA, 64 nt, Human
cugucuucccuuccaucguggggugccccaggcaccagaacaugauggggggcaugcgucagau

SEQ ID NO: 433699 - RNA, 64 nt, Human
ucugcuguccuugccuuccauuuccccucugcacccagaacagugguggcaacauucauugcca

SEQ ID NO: 433700 - RNA, 64 nt, Human
acaugugccagccaggcagagucuugugcuguucccagaacaggacgacagugaaaagaacacu

SEQ ID NO: 433701 - RNA, 64 nt, Human
aauggcuuuuaaggaaggacuaagugacuuaugaccagaacaagggagcagccugagucagucu

SEQ ID NO: 433702 - RNA, 64 nt, Human
acagauacuaaaagucucuucugaaaacagcaauccagaacaagacuuaaagcugacaucagag

SEQ ID NO: 433703 - RNA, 64 nt, Human
cugcacuguuaggugauggcacacagagcaugucccagaacauuucugugcuuaauuacccaac

SEQ ID NO: 433704 - RNA, 64 nt, Human
cugaggguaaaaagcugggauugguaggcuggguccagaacacugaccggggcacagugcaagg

SEQ ID NO: 433705 - RNA, 64 nt, Human
ggaauucuaucacuauagguuaguuuucuuuguuccagaacaucaugaaagcggcgucauguac

SEQ ID NO: 433706 - RNA, 64 nt, Human
uccauuuugaggaaucacagauaucgaagagaugccagaacacuagaagaugaagaagagaugu

SEQ ID NO: 433707 - RNA, 64 nt, Human
gccuugcugcccugucugcugauucugagaaaucccagaacagcccauuaccaguggggcugca

SEQ ID NO: 433708 - RNA, 64 nt, Human
ggcguccucaacggggagccccaaauguccacgcccagaacaacaguuggcaggacagguguga

SEQ ID NO: 433709 - RNA, 54 nt, Human
agggcgaggacgaggcguagaugcccccgcgagacggguuagggaaagcggagg

SEQ ID NO: 433710 - RNA, 64 nt, Human
caugaugagcccuguuccugcucaucaugaagauccccgcgauacuucaacgccuucugacuuc

SEQ ID NO: 433711 - RNA, 64 nt, Human
gcggcagcagagcuggcacaccgauucugggaagccccgcgaaugauggcuuuugaauuaauga

SEQ ID NO: 433712 - RNA, 64 nt, Human
aguagggacauugcagaagcuugaaaggccaauaccagaacacaggcugaugcuucugagaaag

SEQ ID NO: 433713 - RNA, 64 nt, Human
cugaguauugcagcugcauuugcccaaagggaauccagaacaagucccucccuguauuuuguuc

SEQ ID NO: 433714 - RNA, 64 nt, Human
caggggagucaaagggccagaacuccuugggggaccagaacaugguuuuccuucugccuaucuu

SEQ ID NO: 433715 - RNA, 64 nt, Human
accuaaucagcuuacaguuugaaaaccuagcucuccagaacaugagaugagccagccgagccag

SEQ ID NO: 433716 - RNA, 64 nt, Human
cagaaaugcagaauuucuggggcugcuccuaggaccagaacaagugaaggguccuggugcuuaa

SEQ ID NO: 433717 - RNA, 64 nt, Human
gccucauuucagcccagggugcucauccaggggcccagaacagucccaccugugcugcugugcc

SEQ ID NO: 433718 - RNA, 64 nt, Human
ccuuccaaggugucugguugcccugccucuggcuccagaacagaaagggagccucacgcuggcu

SEQ ID NO: 433719 - RNA, 64 nt, Human
ccaagggccagggcaccugggagacgggaggauuccagaacagcagcacugagcucccacccgc

SEQ ID NO: 433720 - RNA, 64 nt, Human
uucuuugguaagagaaagcaggucuuaaugucugccagaacacaauuuauaugccuuauuggcu

SEQ ID NO: 433721 - RNA, 64 nt, Human
aaccaacacacgggauacaauaacucucuguuaaccagaacaccgucauuugaccaagcccuac

SEQ ID NO: 433722 - RNA, 64 nt, Human
ugggggugaggacacauugccccaugagacagucccagaacacggcagcugcuggcugugacaa

SEQ ID NO: 433723 - RNA, 64 nt, Human
gaaagauauagcauagugguucucagcacagucuccagaacagaagcaucuguaguaccuggua

SEQ ID NO: 433724 - RNA, 64 nt, Human
gagaguuauauucccuuauuuauugauauuuaguccagaacaccaguucuaacgaagcaugcgu

SEQ ID NO: 433725 - RNA, 64 nt, Human
acuauauauugagugacuuucugaacaaauuuauccagaacauccauagcccaauaagcuuuug

SEQ ID NO: 433726 - RNA, 64 nt, Human
agggcaaggacaggcucugaguguccaguggcagccagaacaggugacacagagcaggggcuuc

SEQ ID NO: 433727 - RNA, 64 nt, Human
caaaacaaacaaacaaaaaaaacccaacaacaacccagaacaaagcaaaacccagcagacugua

SEQ ID NO: 433728 - RNA, 64 nt, Human
ugaacaccgcgaacagccucugucugggugggacccccgcgagugcauccagcagcaguagcag

SEQ ID NO: 433729 - RNA, 64 nt, Human
cugcauuuccucgcagccucucagugcccuccagccccgcgaccauguggccacaauccacgcu

SEQ ID NO: 433730 - RNA, 64 nt, Human
ccagguuuaaccguugcgucaccgggacccgagcccccgcgaugcccugggggccgugcucacu

SEQ ID NO: 433731 - RNA, 64 nt, Human
uucaaagaaaacuuuuucuauugcuaggagccugccagaacaaaggccaauauauaauguugug

SEQ ID NO: 433732 - RNA, 64 nt, Human
cacugagaaaugucuuuaguucagugagaagaaaccagaacacuuguuccuaguguuguguugu

SEQ ID NO: 433733 - RNA, 64 nt, Human
cugucgcugccuccauggcagcagccagggacccccagaacaagaagaccccgcaggaucccuc

SEQ ID NO: 433734 - RNA, 64 nt, Human
ucuagagugggagaaagaaugauggaagaagaguccagaacaggccagaaagugaauccaggga

SEQ ID NO: 433735 - RNA, 64 nt, Human
cuggguggccuggccuggccugaccaaugagaggccagaacacucuggaacaucggaagaggag

SEQ ID NO: 433736 - RNA, 64 nt, Human
cccugagggccuggccacaugggaccaagcggaaccagaacaaggucccgacagggguagacgu

SEQ ID NO: 433737 - RNA, 64 nt, Human
uuguccagaccuggucggggcccacuggaagcauccagaacagcaccaccaucuagcggccgcu

SEQ ID NO: 433738 - RNA, 64 nt, Human
gggauuugaauagugguuuuucucuagcuuuuugccagaacaaaggaggguacauuacuuaaac

SEQ ID NO: 433739 - RNA, 64 nt, Human
auguuggcaccaguucccccuggaugggcuauagccagaacauuuacuucaacucuaccuuagu

SEQ ID NO: 433740 - RNA, 64 nt, Human
cagugcggaggggucacacauugcaaaacacugcccagaacaguaaaaagagccugcaugccau

SEQ ID NO: 433741 - RNA, 64 nt, Human
guggaggcgugugcaggcuuggaagaagaacucuccagaacauggaacuuaacccucuuuugua

SEQ ID NO: 433742 - RNA, 64 nt, Human
gaugcucuuuaagaaguucgcaccccugcugacaccagaacagcccaaaucagaguucccaggg

SEQ ID NO: 433743 - RNA, 64 nt, Human
gagagcccaggagccagucucuggcuguggcuccccagaacaggauccccagaagcaggcugaa

SEQ ID NO: 433744 - RNA, 64 nt, Human
uguuccaaguuugucaaugagguuuauggagccuccagaacagaugccaucuuccugaauguug

SEQ ID NO: 433745 - RNA, 64 nt, Human
gacugaaagcugauuucucugugagacugaaaucccagaacauuguuugccaguaucucaacca

SEQ ID NO: 433746 - RNA, 57 nt, Human
cuguuaguugggucagguaacuuuaucccagaacauccaagcuggacgggaccuuga

SEQ ID NO: 433747 - RNA, 64 nt, Human
cauggaauccacgcgcuccagggacucugcccgcccccgcgacuggagacggcaucucguucac

SEQ ID NO: 433748 - RNA, 64 nt, Human
cguuucuuuuuaccuuuuuuggcacucccucugaccccgcgaugaguguuuugguggcagaggu

SEQ ID NO: 433749 - RNA, 64 nt, Human
guguggccacagcggacaugguaugcccggaugcccccgcgagccccagcgcccuggcagucag

SEQ ID NO: 433750 - RNA, 64 nt, Human
aaauauuaguuuacauaggaaugaaauauguaacccagaacaaauaacauccuucauuacucau

SEQ ID NO: 433751 - RNA, 64 nt, Human
ggacccaguuuccuuucuuagcugaugucuuuggccagaacaccgugggcuguuacuugcuuug

SEQ ID NO: 433752 - RNA, 64 nt, Human
uggaaaucucuguggucugcaagugcuucccagcccagaacagggguggauuccccaaccucaa

SEQ ID NO: 433753 - RNA, 64 nt, Human
agccugcagagccauuuuccagaccugugauugcccagaacacauaguccccacguuucuaauu

SEQ ID NO: 433754 - RNA, 64 nt, Human
ugggaacauugaaguuuauuuggauaucaaggucccagaacaaggaagucacuuuucaguggau

SEQ ID NO: 433755 - RNA, 64 nt, Human
guuacauaaaccagagaugauaaaacagauacuuccagaacauagugugcuucaaaacauuaau

SEQ ID NO: 433756 - RNA, 64 nt, Human
uugagauugguucugcucuuuucuucauuucuuuccagaacaacucuuucccaccccaacacca

SEQ ID NO: 433757 - RNA, 64 nt, Human
aggcaucauaggggcuggcacaggagcccugcugccagaacaggccuccauaccaggcaugugu

SEQ ID NO: 433758 - RNA, 64 nt, Human
acuccaacuucuaggguucuuggaaagauaaggaccagaacaagcucauagcaaauugaggggc

SEQ ID NO: 433759 - RNA, 64 nt, Human
gcagggccugaauacuggcccuggacucccuuuuccagaacaccagguguggccaccuggggcu

SEQ ID NO: 433760 - RNA, 64 nt, Human
acggcaauguuccucccuccaacugucccuggagccagaacacucacagagacaccccugagag

SEQ ID NO: 433761 - RNA, 64 nt, Human
gaugccaaggaugcugucaagcauacuguacugcccagaacaguggcccauagcagggaccugc

SEQ ID NO: 433762 - RNA, 64 nt, Human
cuaacaucagcucauugucaaggccacccccaccccagaacagaaccgugucucugauaaaggu

SEQ ID NO: 433763 - RNA, 64 nt, Human
gucacauaguguacuguccuuuuauaugaaauuuccagaacaggccaaucugaagagauguaua

SEQ ID NO: 433764 - RNA, 64 nt, Human
ucacugcagguaaugccuuucccuucaggaagccccagaacacccacaggucuugguaacaaac

SEQ ID NO: 433765 - RNA, 64 nt, Human
ccguccccucccuuccuuauuuauuccugcugccccagaacauaggucuuggaauaaaauggcu

SEQ ID NO: 433766 - RNA, 64 nt, Human
agggccgaggucugagcucucguccugccguggcccccgcgauggccuggggugcaagcuuggg

SEQ ID NO: 433767 - RNA, 64 nt, Human
accagaccuuccauguccucgggcagcugcaacuccccgcgagaccccgcagcugggugggaug

SEQ ID NO: 433768 - RNA, 64 nt, Human
ccgacaggggcgagggcugcuuccucgcggcagcccccgcgaagaaaucucgagagaacuggca

SEQ ID NO: 433769 - RNA, 64 nt, Human
ucauucaugaggguggugaggacacagacugcgaccagaacagaaauaugaaaaugugaaugac

SEQ ID NO: 433770 - RNA, 64 nt, Human
gauccacccuggccucuuuuuacccacugacuccccagaacaacccuuccaggcuucucuuguc

SEQ ID NO: 433771 - RNA, 64 nt, Human
aagaaggugauucccccugcccuugcccccuuccccagaacaaaacauguugaucaugugcaau

SEQ ID NO: 433772 - RNA, 64 nt, Human
ggagauggcagugcaggcuggaaccugggcugccccagaacacaguccauuacgauagaaacac

SEQ ID NO: 433773 - RNA, 64 nt, Human
cuuacagccuccggcggcucacagggcuagaaguccagaacauguaugugggaccccagaccau

SEQ ID NO: 433774 - RNA, 64 nt, Human
agccucacgggguuggcuguuccagacucagguuccagaacagcccucggccuccgaggcuccc

SEQ ID NO: 433775 - RNA, 64 nt, Human
uuauauaaauuccacauuuuuaugcaacuaaucuccagaacauuuuuccucuuaccaagaagua

SEQ ID NO: 433776 - RNA, 64 nt, Human
accaaaucuugguggaagagcccaggggcuggucccagaacaggcagucucacaagcacgcagc

SEQ ID NO: 433777 - RNA, 64 nt, Human
acagcagugccugcgucccgcuccacggagucuuccagaacaccucccucugaacuaaucccgg

SEQ ID NO: 433778 - RNA, 64 nt, Human
aguaauugugagccuaucaacauaguguagucagccagaacauuaaaguuucuuuguuucaacu

SEQ ID NO: 433779 - RNA, 64 nt, Human
aacuuuccucccucaauagugaagugucaaccauccagaacacaagguaggaugugacaaaugg

SEQ ID NO: 433780 - RNA, 64 nt, Human
ggaaucgaaaguucuagaaacugccuugaaagauccagaacaaaaaguccugaaaauccaaaac

SEQ ID NO: 433781 - RNA, 64 nt, Human
gucacauaguguacuguccuuuuauacgaaauuuccagaacaggccaaucugaagagaugcaua

SEQ ID NO: 433782 - RNA, 64 nt, Human
cggacgggggucccgagguggaaaccauugcccuccagaacaaccgugagaaccaggcauucag

SEQ ID NO: 433783 - RNA, 64 nt, Human
cugucccaccgccuccugccucucuccucucuccccagaacauccagagucuguccccugugaa

SEQ ID NO: 433784 - RNA, 64 nt, Human
uacucacacugaaacaugaggaagcagguagaucccagaacagacaaaauuuuccuaaaaacau

SEQ ID NO: 433785 - RNA, 50 nt, Human
ucccgcacgcacaaucgugaccccgcgaccucuccaucuucagcuucuuc

SEQ ID NO: 433786 - RNA, 64 nt, Human
ccucaccccgacccccacccucacuccuaccccaccccgcgaucgucaggggugccacgguggg

SEQ ID NO: 433787 - RNA, 64 nt, Human
ccacuccccccgccucgacggcaccacuggccggccccgcgaaagacugcgcgugcguagagca

SEQ ID NO: 433788 - RNA, 64 nt, Human
ugaagggugggggcugcggaucccagggacugccccagaacacaaaccuaaguccugugccugu

SEQ ID NO: 433789 - RNA, 64 nt, Human
ggacugaagggggaccccaaaacuggcucaccccccagaacacccuccucccagggaggguccu

SEQ ID NO: 433790 - RNA, 64 nt, Human
aggagugugagcaugccuacccuggccagaucacccagaacauguugugugcuggggaugagaa

SEQ ID NO: 433791 - RNA, 64 nt, Human
agaauuagagaauuuauuugugucagaaaauacuccagaacaaccaccccauauuaugauuagc

SEQ ID NO: 433792 - RNA, 64 nt, Human
ucuucugcaaagaaugcauucucccccaguccacccagaacacacagccuccauccagguacug

SEQ ID NO: 433793 - RNA, 64 nt, Human
cugcugugccuccagacugcagagcucucagaacccagaacagagacgaaaaggcuaccucucc

SEQ ID NO: 433794 - RNA, 64 nt, Human
cuacugucugaaccccuugucccugucaaauaaaccagaacaaaugcccagggauccuaccucu

SEQ ID NO: 433795 - RNA, 64 nt, Human
cccuuacacuguuguacuuccgugggcccuccuuccagaacaaggacaacaaggacaagguuga

SEQ ID NO: 433796 - RNA, 64 nt, Human
aauagugucaguuauuucuuaaguaacucaguacccagaacagccaguuuuacugugauucaga

SEQ ID NO: 433797 - RNA, 64 nt, Human
ccuccccaccccucccccaucuccucuuugaaagccagaacaagagagcgcuccucucccagau

SEQ ID NO: 433798 - RNA, 64 nt, Human
cuggugccggcgugauugccccgggcacccccagccagaacacgcagugccagccgugcccccc

SEQ ID NO: 433799 - RNA, 64 nt, Human
aguagaggaaauggacaaggucaguuugaauaucccagaacacagugcucugucuccucccacc

SEQ ID NO: 433800 - RNA, 64 nt, Human
uuucacucucagcauuccaagaucuuagcccuucccagaacagaacgcuugcaucuaccuccuc

SEQ ID NO: 433801 - RNA, 64 nt, Human
ccagugucugaacucccugucccugucaaauaaaccagaacaaaugcccauggauccugccucu

SEQ ID NO: 433802 - RNA, 64 nt, Human
ucccuaccgaaggagacaccuuuuccccccugacccagaacagccuuuaaaucacaagcaaaau

SEQ ID NO: 433803 - RNA, 64 nt, Human
gucccugccuccuggacauuaggaagcccaaaggccagaacaaaaacacaugccuaguggggga

SEQ ID NO: 433804 - RNA, 64 nt, Human; identical to SEQ ID NO: 58143

SEQ ID NO: 433805 - RNA, 64 nt, Human; identical to SEQ ID NO: 58144

SEQ ID NO: 433806 - RNA, 64 nt, Human; identical to SEQ ID NO: 58145

SEQ ID NO: 433807 - RNA, 64 nt, Human
cuuucaggauuucagucacaucuuccugcuuuguccagaacacauugaccaagcuccugaaaga

SEQ ID NO: 433808 - RNA, 58 nt, Human
cuggaaacgcaaggaaauaaucuaucucccagaacagaacaugugccaaugggcgauc

SEQ ID NO: 433809 - RNA, 64 nt, Human
aaauucuuaaacuuggagcaacaauaaaaagcuuccagaacagaucauauuauguucacugucu

SEQ ID NO: 433810 - RNA, 64 nt, Human
agcgugaacuaaaguucacaggcagaucacugauccagaacacuucaagaacucgucaaacagc

SEQ ID NO: 433811 - RNA, 64 nt, Human
ccagaaagaguuuaagaaaaucucagcucaggagccagaacagaaaagaucaauagcuuuagcc

SEQ ID NO: 433812 - RNA, 64 nt, Human
uggaaacaaagcaggaccagcaggcacagcaccuccagaacagugccccggaugaccagaggcc

SEQ ID NO: 433813 - RNA, 64 nt, Human
agguggauauugcucucuuacgguguuggggaugccagaacaccacuugguuuuauuuuucuaa

SEQ ID NO: 433814 - RNA, 64 nt, Human
cuucucuuuucucucuuguggaauugcauucaaaccagaacagugccuuagaauggaugugccc

SEQ ID NO: 433815 - RNA, 62 nt, Human
ggguauaccauauguauuagucccccagugcuccagaacagcgggagcacugugcugugcuc

SEQ ID NO: 433816 - RNA, 64 nt, Human
agcgccuccgggcccccccgcccccgucccccaaccagaacaacaacgccauagacagcggcau

SEQ ID NO: 433817 - RNA, 64 nt, Human
gagacaaaaaauacaguagagacagaaacgaagcccagaacaaagaugaaacuugaauuaccau

SEQ ID NO: 433818 - RNA, 64 nt, Human
uucaaaagaaacuugccuuuuacauuauuguguuccagaacauuaagugacuguagguacuggg

SEQ ID NO: 433819 - RNA, 64 nt, Human
uuuuuuuaaaaaagaggacuugcaucagcugccuccagaacaauuuuaagaaaauaacaaagau

SEQ ID NO: 433820 - RNA, 64 nt, Human
cuauaccuuccucgcaacuaccugugaugucugaccagaacauuagcaaggccaaggaacuuua

SEQ ID NO: 433821 - RNA, 64 nt, Human
uuuguuuuagccauuuucuuuaauuaccaguuuuccagaacacucuuagcuauguugacaugag

SEQ ID NO: 433822 - RNA, 64 nt, Human
ucuuucuagaagcucaggguuuucuuagugccucccagaacauuuuguaguuaauugggaaaaa

SEQ ID NO: 433823 - RNA, 62 nt, Human; identical to SEQ ID NO: 431275

SEQ ID NO: 433824 - RNA, 62 nt, Human
ugaugcuugaaauuuuuguaugaauuauuuugucguccuacccuuuuccuccaaaacaaaaa

SEQ ID NO: 433825 - RNA, 62 nt, Human
uuaaucugucaauuauuucagucaucaucucaucguccuagaaagccuggucauuuuacugu

SEQ ID NO: 433826 - RNA, 64 nt, Human
uugcagaaauaugcuucugguccaacuuguacauccagaacaaaagggccccucuaguagcugu

SEQ ID NO: 433827 - RNA, 64 nt, Human
caauguuuugcuuuugcucgaugcagacagggggccagaacaccacacauuucacugucugucu

SEQ ID NO: 433828 - RNA, 64 nt, Human
cuguggcuguuccuuauccuaaugaugcgcuuuugucccguaaauguuaacacucaugaagcau

SEQ ID NO: 433829 - RNA, 64 nt, Human
aauuauguauggugaaguggaguguauuguguaggucccguauuuaaugccucugacugccuuu

SEQ ID NO: 433830 - RNA, 64 nt, Human
aagcugcugaaacuguaauuuucaugauauaauagucccguauauauguaauaguaggucuccu

SEQ ID NO: 433831 - RNA, 64 nt, Human
gagaggcuaacggacaucagcugcagccaggcaugucccguaugccaaaagagggugcugcccc

SEQ ID NO: 433832 - RNA, 64 nt, Human
cuacuaguuuucuugacagauuuguauucccagugucccguauugccacucaaauugcucuacu

SEQ ID NO: 433833 - RNA, 64 nt, Human
uccuuuuaaaaugauuaggauuauugaaauguaugucccguaaauuugguuuuugggcagacuu

SEQ ID NO: 433834 - RNA, 64 nt, Human
aagagagaugauugccuauuuaccguuugacagagucccguagaugagcaauggggaacugguu

SEQ ID NO: 433835 - RNA, 64 nt, Human
augccgagagcgggcugugggcggagcugggucagucccguauuuauuuugcuuugagaagagg

SEQ ID NO: 433836 - RNA, 64 nt, Human
cuuuuccuuuucuacucuuuucuuccgcgcuccugucccguaaacgccugcgcuuccuuuaagg

SEQ ID NO: 433837 - RNA, 62 nt, Human
acuccgucaccauauccauauggaauaagggcucguccuaccuaaagcuuccugccaauaau

SEQ ID NO: 433838 - RNA, 62 nt, Human
ccggaaaggaauuuggggaucaagaacuuagcucguccuacccccauguugaguucugcccu

SEQ ID NO: 433839 - RNA, 62 nt, Human
ucccccacacagggcucugguuuucacucgcuucguccuagauaguuuaaaugggaaucgga

SEQ ID NO: 433840 - RNA, 64 nt, Human
uuuccugaaaauucugcuuuugagaaugcuuucugucccguaauuguguaugucuuucuuucca

SEQ ID NO: 433841 - RNA, 64 nt, Human
cccccaaaaugaaguuaccuuccaaguuggacacgucccguaguugggcauaugucuaacuaaa

SEQ ID NO: 433842 - RNA, 64 nt, Human
uccaggacacugucauuuuaguggucugagucaagucccguauacauucaagaacagggcauag

SEQ ID NO: 433843 - RNA, 64 nt, Human
cuccuaucucaacucuguuuauuugaugaguucugucccguaaaucauauuucccuuacaauua

SEQ ID NO: 433844 - RNA, 64 nt, Human
ccaucagccugcugggacacacggguccuccugagucccguagccucauuucuuacagacgggg

SEQ ID NO: 433845 - RNA, 64 nt, Human
uucugaagccguguggaaaacugacucugugugggucccguaucccuguggcauccagaccugg

SEQ ID NO: 433846 - RNA, 64 nt, Human
gaccuucacgaagggauggcucuccaguccuugggucccguagcacacaguuacaguguccuaa

SEQ ID NO: 433847 - RNA, 64 nt, Human
acaagguggggggccccacucuuucucuccugcagucccguagcuggggccuccuuccuucuca

SEQ ID NO: 433848 - RNA, 64 nt, Human
aaccccucucagagccucaagagggguagcucggcugccggaagagaggggugcccuaucccug

SEQ ID NO: 433849 - RNA, 64 nt, Human
caugcagguggugggacacugggcagcaaggcugcugccggaaucacuucuccaaucaguguuu

SEQ ID NO: 433850 - RNA, 64 nt, Human
uacaagugccgaauaaaaaaaaagccucccaccucugccggauaggcagaguuuuguaugcuuu

SEQ ID NO: 433851 - RNA, 60 nt, Human
acgaggucccagccgagugaggcgcugcagcugccggacucuucugcuugucacuuguca

SEQ ID NO: 433852 - RNA, 64 nt, Human
gcgcccguucugccugggaccccgggaaccucuccugccggaagccggacggcagggaugggcc

SEQ ID NO: 433853 - RNA, 64 nt, Human
uuggauccaugagcuauacagcugcaugcuuugacugccggaaaaauuaaucuugcuucuucau

SEQ ID NO: 433854 - RNA, 64 nt, Human
cucucucaaacugucuuuucucacugcuuugacucugccggacuuugucacccccacgaccugg

SEQ ID NO: 433855 - RNA, 62 nt, Human
cauuuaucucccaugacagaaauaaauuuaccucguccuacauuuucauugcucaaguccaa

SEQ ID NO: 433856 - RNA, 62 nt, Human
gucuugacaaaacagaagaaaaacaagccuccucguccuagucuuuucuagcaaagggauaa

SEQ ID NO: 433857 - RNA, 62 nt, Human; identical to SEQ ID NO: 431291

SEQ ID NO: 433858 - RNA, 62 nt, Human
aauguuacaguuuauauuguggaauaaauccuucguccuaacauaacacuaaaugcugauua

SEQ ID NO: 433859 - RNA, 64 nt, Human
cgcucuccugcaccucccgccugcguugugccuccugccggagagucugcuuccugagcuuuuc

SEQ ID NO: 433860 - RNA, 58 nt, Human
auguggaugucuugccuugaagauaaggcugccggacaaagcaaguugaagagaugag

SEQ ID NO: 433861 - RNA, 64 nt, Human
cuggcuuuugggagugcuauggcaaguagaaguucugccggauggaaagaggcugccccauuug

SEQ ID NO: 433862 - RNA, 64 nt, Human
cccggaguuccccugcuccccaccuccagucguccugccggaccuccaccuggagcugucaccc

SEQ ID NO: 433863 - RNA, 64 nt, Human
cuggggccugggucaagggccagucagcaggaggcugccggaacaacagcggcuuucccagcaa

SEQ ID NO: 433864 - RNA, 64 nt, Human
ugcgggcaccuacaagguugugcccuccaccuaccugccggacacagagggggccuucacagug

SEQ ID NO: 433865 - RNA, 64 nt, Human
ggacaccggccagcuugucugguguccagcagcccugccggacuuggccuccuguccugucguu

SEQ ID NO: 433866 - RNA, 64 nt, Human
ccuccaugagucugacaucucggaaacugagcagcugccggacgccugggucaggaauccaaga

SEQ ID NO: 433867 - RNA, 64 nt, Human
cauuuuaaaauucagcauugcucaacuuaccugacugccggaccccuucacccaugauucuaug

SEQ ID NO: 433868 - RNA, 64 nt, Human
cugggacaaccucaucugcacggugggagaccugcugccggaagucaucccagugcacauggca

SEQ ID NO: 433869 - RNA, 64 nt, Human
ggacaugcagggcucacaggagacagggcucaggcugccggagcuccaaccaaacucuguccca

SEQ ID NO: 433870 - RNA, 64 nt, Human
ugcaccccugaaccucaagaucacgguccagccucugccggagccccagucuccgcaguggaga

SEQ ID NO: 433871 - RNA, 64 nt, Human
augugccuaugugaccagcucacuugcagacacccugccggaagcagagcuuaaucuuccuagg

SEQ ID NO: 433872 - RNA, 64 nt, Human
uacacauuuaauucaguuucucuucccuaagaggcugccggaguuggggccuccuccagcagag

SEQ ID NO: 433873 - RNA, 64 nt, Human
cucagauuguggggcacauuguguagccugacuucugccggagcucccaguccaggaggaaaga

SEQ ID NO: 433874 - RNA, 64 nt, Human
ccgcugcagagccgcaccuccauugugcaggcagcugccggaggggugccaggagggggcagca

SEQ ID NO: 433875 - RNA, 64 nt, Human
ccccgcgccggaguccaggggccccuucuggacgccccgcgacucuggcgaaauaaagcgagug

SEQ ID NO: 433876 - RNA, 64 nt, Human
uauaauauuuagcgaacucggucucccucagaucccccgcgagggaggcugcuggacccacccc

SEQ ID NO: 433877 - RNA, 64 nt, Human
gcccggggcaacuccgagugggugcucaagucccccccgcgacccacccgcggaguggggggcc

SEQ ID NO: 433878 - RNA, 64 nt, Human
gaguccgcaguugcccuuguucggaauccacguuccccgcgaucccgggagcuggaggcgcaug

SEQ ID NO: 433879 - RNA, 64 nt, Human
gcccacccagccccaaagccaccggcaugugaagcugccggaaaguggacaggccagaccaggg

SEQ ID NO: 433880 - RNA, 64 nt, Human
ugagcgcgggggcugccagaagcgggaggggucacugccggaagagcagcugcccuccgacccc

SEQ ID NO: 433881 - RNA, 64 nt, Human
uuggcucaucaaaccuggcaacccuguggccugucugccggagcugacuggauccacucaucaa

SEQ ID NO: 433882 - RNA, 64 nt, Human
aggcccucgggaaguuccgcguccucugugggggcugccggaagacacggccccaggagucagg

SEQ ID NO: 433883 - RNA, 56 nt, Human
gugacccaguacgacccugaagaggacugccggaagauggccaaggaauauggaga

SEQ ID NO: 433884 - RNA, 64 nt, Human
ggggagagucacccugagccagcccuucccuggacugccggaaucccagcauuagcuuccugcu

SEQ ID NO: 433885 - RNA, 64 nt, Human
gaauggagcuggugagaucaacaacacuacuucccugccggaaugaacuguccgugaauggucu

SEQ ID NO: 433886 - RNA, 64 nt, Human
uuuuaaaggugacuugucaggaguugagacuucccugccggauucuauuuugaaaguaaauggu

SEQ ID NO: 433887 - RNA, 60 nt, Human
guguuccacuuacuucuugagguacaaaaacugccggagauucuggguaagccuagauug

SEQ ID NO: 433888 - RNA, 64 nt, Human
uagcugcaagguauaauugauggauucuuccauccugccggaugagugugggugugauacagcc

SEQ ID NO: 433889 - RNA, 64 nt, Human
aaauuguggggaaucaguuucagccuuccaugugcugccggaacucgggccuuuuuacgcgguu

SEQ ID NO: 433890 - RNA, 64 nt, Human
ugccggugggcccacagcccgagccagcccagagcugccggaagggccgcccuucccggcccug

SEQ ID NO: 433891 - RNA, 64 nt, Human
ccgagccccuccccguggggcacccaggagggcccugccggaaugugcagccuguggguagucg

SEQ ID NO: 433892 - RNA, 64 nt, Human
gccauggcugccagacacugcugcaacugaccagcugccggaagauucuggagccacuaacauu

SEQ ID NO: 433893 - RNA, 64 nt, Human
ccacagaugucuguugccaaacagccugcccucccugccggagccggcucugccagccccagau

SEQ ID NO: 433894 - RNA, 64 nt, Human
uccaccaagccagccccgaagcccgccagccacccugccggacucgggcgcgaccugcuggcgc

SEQ ID NO: 433895 - RNA, 62 nt, Human; identical to SEQ ID NO: 433824

SEQ ID NO: 433896 - RNA, 62 nt, Human; identical to SEQ ID NO: 433825

SEQ ID NO: 433897 - RNA, 60 nt, Human; identical to SEQ ID NO: 431292

SEQ ID NO: 433898 - RNA, 62 nt, Human
cuucccagaggacuggcccuacgugcucucucucguccuaccuaucaaugcccagcauggca

SEQ ID NO: 433899 - RNA, 64 nt, Human
acacuuaccccauggcugcacaguuggugggguccugccggagaggaagagacacucagaccag

SEQ ID NO: 433900 - RNA, 58 nt, Human
aggacucacaaacugcaugauggccgcccugccggaggacacuguaguuuuugagaag

SEQ ID NO: 433901 - RNA, 64 nt, Human
cggggaaccagcucaccucugguugcuguagcuccugccggaggcaugucuacuugugaucccg

SEQ ID NO: 433902 - RNA, 64 nt, Human
cuccccuuuugagggguuucggcccagccccagccugccggagcccacggagcuaccucuaccu

SEQ ID NO: 433903 - RNA, 64 nt, Human
gagcuucggggccuccucagugaaggugguggggcugccggaucugggcuguggggcccuuggg

SEQ ID NO: 433904 - RNA, 64 nt, Human
gcgagcccguccucaugacgcaggcgccacccugcugccggagccgggcuucggcagucuucuc

SEQ ID NO: 433905 - RNA, 64 nt, Human
auucugcgcaguuccacuaacaccaggccacacccugccggacaacuccagcuggcuguacuga

SEQ ID NO: 433906 - RNA, 64 nt, Human
caccacccuuucagaggcgugaggcccuggggcccugccggaagggagcccccugcuccuccca

SEQ ID NO: 433907 - RNA, 64 nt, Human
cucaccaggccuggggagcugggacggggccccgcugccggaccugcagcccuggacagauggg

SEQ ID NO: 433908 - RNA, 64 nt, Human
cugcuguaauuuugguugcuuuugcccuguugaucugccggagucuugaaauucagcugauugg

SEQ ID NO: 433909 - RNA, 64 nt, Human
cccaggccagugcugugagcaggcggggaggaggcugccggagggagcccugagccuggcaggu

SEQ ID NO: 433910 - RNA, 64 nt, Human
aauaaucuguucucagaacagacuuuucaaccugcugccggauuucuccauucagcuggaugau

SEQ ID NO: 433911 - RNA, 64 nt, Human
ucccugagagccacaggugccuggaggagcugugcugccggaaaaagccgggggccugcaucac

SEQ ID NO: 433912 - RNA, 64 nt, Human
agcggcguuauuuuuacagacccucaaaaauccucugccggaagcagaagcugggaaaauugag

SEQ ID NO: 433913 - RNA, 64 nt, Human
ucagauuguuccauuaucuguacucccaacaacccugccggauauauuuguuggcuuucacuca

SEQ ID NO: 433914 - RNA, 64 nt, Human
ugaccagccaugaaaccagaggcgccaucccauucugccggaggacagccagcggcugcuuugu

SEQ ID NO: 433915 - RNA, 64 nt, Human
cggcgccccggacgccgcgauuuugccuuugguuccccgcgaaguccgaggccuggcucuggag

SEQ ID NO: 433916 - RNA, 64 nt, Human
ccgcccgggucccugcagcgcuuccucccgcagcccccgcgaccgauccgaccgcgucgcugcc

SEQ ID NO: 433917 - RNA, 64 nt, Human
acacgcagggggcucggaggacucaggccgcagcccccgcgacggagggcagggcccacccugc

SEQ ID NO: 433918 - RNA, 64 nt, Human
aagugugauuuuccugagucucccuucguuggaucugccggaagacuugucggggaaccuuuag

SEQ ID NO: 433919 - RNA, 64 nt, Human
cgggacccagggcccucggugggagccaugccgucugccggacccggaggccgaggccaugugc

SEQ ID NO: 433920 - RNA, 64 nt, Human
ucugugaacgagggccgcuggguacgggguugcucugccggaggcugccgcaacuucccaggug

SEQ ID NO: 433921 - RNA, 64 nt, Human
cgccgcggaguacgcgaacgcacuggagaaggggcugccggacccagugcucuaccuggcggag

SEQ ID NO: 433922 - RNA, 64 nt, Human
cggggccuuaugcugccaugcacugcccuggcuccugccggacccccagggugggccguggcag

SEQ ID NO: 433923 - RNA, 64 nt, Human
uucaaccuugcgggcugugcugaguuccagagagcugccggaauuccagguuugacucuccagc

SEQ ID NO: 433924 - RNA, 64 nt, Human
gcuguucuuuuuuuggagcccuucucagucaagucugccggaugucuuucuuuaccuaccccuc

SEQ ID NO: 433925 - RNA, 64 nt, Human
agagggcuguccuggccgaaagggaccuccagcgcugccggaaccacagggaggagucaguggc

SEQ ID NO: 433926 - RNA, 64 nt, Human
gucccccaggagacauagccaggaggccgaguggcugccggaggagcaugcgcagaggccaguu

SEQ ID NO: 433927 - RNA, 64 nt, Human
acaccgugccccgcugaccccacuggccccuggccugccggacacagcaccgugccaaccccac

SEQ ID NO: 433928 - RNA, 64 nt, Human
ccccuaccccccaccccgauccccgcucccaacacugccggagucgcgucaugccaugcccccu

SEQ ID NO: 433929 - RNA, 64 nt, Human
ccucccugccugggugucgggccaccagaaggcucugccggacgccaagaagacggucucuggg

SEQ ID NO: 433930 - RNA, 64 nt, Human
cucuggacccaccuggcgccacagaggaagcugccugccggaggacccccaccugagagaugga

SEQ ID NO: 433931 - RNA, 64 nt, Human
agccguaacccuggccugcaggcgggagcgcucccugccggacucuuccacguggccuuugccu

SEQ ID NO: 433932 - RNA, 64 nt, Human
ggcgguguuagauugugaggcacguacauggggccugccggaaugacuuaaauauuugucucca

SEQ ID NO: 433933 - RNA, 64 nt, Human
ggcccuaacccugcccuccaccgccggcuccacacugccggaagcagccuuccugcucggugca

SEQ ID NO: 433934 - RNA, 62 nt, Human; identical to SEQ ID NO: 433634

SEQ ID NO: 433935 - RNA, 62 nt, Human; identical to SEQ ID NO: 432348

SEQ ID NO: 433936 - RNA, 62 nt, Human; identical to SEQ ID NO: 431293

SEQ ID NO: 433937 - RNA, 62 nt, Human; identical to SEQ ID NO: 432350

SEQ ID NO: 433938 - RNA, 64 nt, Human
acucccagggcuccgcgcccaagugagggggccccugccggagccucagacacacuccaguuca

SEQ ID NO: 433939 - RNA, 64 nt, Human
cagcaaggccaccucuccccgggcccccgcgccucugccggacacggaccggccccucagcccc

SEQ ID NO: 433940 - RNA, 64 nt, Human
cagcccugcugcccuggccugucacuccccaccccugccggagaccucccuucccugggccccu

SEQ ID NO: 433941 - RNA, 64 nt, Human
ggccgugguggccuucugaggaccccgagcggcgcugccggagcccagagcgcgcgucgaaccg

SEQ ID NO: 433942 - RNA, 64 nt, Human
ugaacgacgugagaggcaucucccagccccucugcugccggacagcgcacuccagggcaggacg

SEQ ID NO: 433943 - RNA, 64 nt, Human
gcgcccuggugcuggcugaccacccccugcccuccugccggacccuggggccucccaccccagc

SEQ ID NO: 433944 - RNA, 64 nt, Human
uggagccuggcuccccucuucguuccuucccuggcugccggaggagaccccacuaacccagccu

SEQ ID NO: 433945 - RNA, 64 nt, Human
ucugcgcacgcaggauucaguguggggacggccccugccggauaggccuagcccuggcccaggu

SEQ ID NO: 433946 - RNA, 64 nt, Human
gcagcgcccuguggccuuuuagauccagaccucccugccggaugccccgaggcgggaggccggc

SEQ ID NO: 433947 - RNA, 52 nt, Human
ccgaggccacuacccccugacacugccggaagagcacagggacacagccaga

SEQ ID NO: 433948 - RNA, 64 nt, Human
ggccugagcaggugggcguggauguggauacugccugccggaggcugggcuuccuccucuguuc

SEQ ID NO: 433949 - RNA, 64 nt, Human
cgaggugcagcugccgaaagugucagagauucggcugccggaaaugcaagugccgaagguuccc

SEQ ID NO: 433950 - RNA, 64 nt, Human
ggacggacccagccuggcuaagggaaccauuucacugccggacuuaggcuggcaaugcccccuu

SEQ ID NO: 433951 - RNA, 64 nt, Human
ccucagcccauggucgcccuccugugccccucuccugccggaaagcccugcaacauucuagggu

SEQ ID NO: 433952 - RNA, 64 nt, Human
uuuaagcuccuuuuagcucaaugggauggggaaccugccggaguccagaggcugcugugaccaa

SEQ ID NO: 433953 - RNA, 64 nt, Human
ucuagauuccagacccugcugccagagagaccugcugccggagagaaggggaggaggacuccag

SEQ ID NO: 433954 - RNA, 62 nt, Human; identical to SEQ ID NO: 431274

SEQ ID NO: 433955 - RNA, 62 nt, Human; identical to SEQ ID NO: 433855

SEQ ID NO: 433956 - RNA, 62 nt, Human; identical to SEQ ID NO: 433856

SEQ ID NO: 433957 - RNA, 64 nt, Human; identical to SEQ ID NO: 58146

SEQ ID NO: 433958 - RNA, 64 nt, Human
cuuguucccgccggccagguccuaucaaaggaggcugccggaacucaagaggcagaaaaagacc

SEQ ID NO: 433959 - RNA, 64 nt, Human
ggagacccaggaaucucaucugagaacccacucucugccggagaaccccauggugacacauuuu

SEQ ID NO: 433960 - RNA, 64 nt, Human
ccccuaugggugggugugcgauggaaauguguuccugccggagucugaggcaccagggugugcu

SEQ ID NO: 433961 - RNA, 64 nt, Human
guaaauacgaacugcgccauggagaggagaggcacugccggagcccuugccagaucucccuccc

SEQ ID NO: 433962 - RNA, 64 nt, Human
auugugaagaagugaaaccuuucccuuuucccaucugccggacgaaccacaacagcguucccca

SEQ ID NO: 433963 - RNA, 64 nt, Human
ugaaacuuugaagggcaacaaacaaccauccacacugccggacccuaggcuguucagggaggca

SEQ ID NO: 433964 - RNA, 64 nt, Human
cuccuugggaaucugcagagggcucugggacucacugccggaugugaaauccaggcgucagcug

SEQ ID NO: 433965 - RNA, 64 nt, Human
cuuggaguaaauacagcucuguguucccuagcagcugccggaggauuuggcugaugaaguaccu

SEQ ID NO: 433966 - RNA, 64 nt, Human
cagccuccugaguagcugggauuacaggugugcaccaccguacccagcuaauuuuuguauuuua

SEQ ID NO: 433967 - RNA, 64 nt, Human
uuguagauuuccucgccuaugauguccuugaccuccaccguauauuugagcccaacugcuugga

SEQ ID NO: 433968 - RNA, 64 nt, Human
uccuucgucaugacacuucucaauaaaacguaucccaccguauuguaaucaugguacuuguuuu

SEQ ID NO: 433969 - RNA, 62 nt, Human; identical to SEQ ID NO: 433858

SEQ ID NO: 433970 - RNA, 62 nt, Human
auugcuaagcauuguuucccugguaauucuucucguccuaaucucaaucuuacuguacugga

SEQ ID NO: 433971 - RNA, 62 nt, Human
gugggaguuauuaucugagacauuccugcuugucguccuaacaacgcugaugaaacguaaaa

SEQ ID NO: 433972 - RNA, 62 nt, Human
cuucagugguuaauuauaaaaguuguguuacuucguccuaaauuaaauugauagaaagauuu

SEQ ID NO: 433973 - RNA, 64 nt, Human
ggcuuuguguguugcauauuuaauauuucuacuaccaccguaugucaacuggguaaagccuucc

SEQ ID NO: 433974 - RNA, 64 nt, Human
uugcugaauaguguaccgguaauauauuguauuuccaccguacucugugaaucuaauuauuauu

SEQ ID NO: 433975 - RNA, 64 nt, Human
aucuacuuuucaccuugccguaucugauucuucaccaccguauucucagucacuuccacuaaac

SEQ ID NO: 433976 - RNA, 64 nt, Human
ccuggaaauccugccaccaaccaggacacagcagccaccguauugaucagagagccuguuuccu

SEQ ID NO: 433977 - RNA, 64 nt, Human
aaagaaguacugaugacuuuucaaaacaaaugaaccaccguagcugacagagaaccguaucgua

SEQ ID NO: 433978 - RNA, 64 nt, Human
gauggaagaaauagggaaagagcccuuuuauagcccaccguaguggugggugacuggccucuag

SEQ ID NO: 433979 - RNA, 64 nt, Human
cucuuauuuggaauacuucugugcauuugucuguccaccguaauuuuagaaaagcauauccaua

SEQ ID NO: 433980 - RNA, 64 nt, Human
aaauucaaguugucaugccugauaauuucagaugccaccguauagcaaagggugaacauguuuu

SEQ ID NO: 433981 - RNA, 52 nt, Human
acuaccggauuucugccuagggccaccguagggccugacuccuucugccagu

SEQ ID NO: 433982 - RNA, 64 nt, Human
aggcgcacacccaugcagccccugauguucuguuccaccguaguugauucucaguagaguuggg

SEQ ID NO: 433983 - RNA, 64 nt, Human
aggaauggcagccugcagcaacuggaacaaggccccaccguaaagcucugugugucccagguaa

SEQ ID NO: 433984 - RNA, 64 nt, Human
agucuccccgagucacagugccgaucccacccacccaccguagggugcacagcaaggcauccca

SEQ ID NO: 433985 - RNA, 64 nt, Human
agcugggcccaguccucucaucccaagagcagagccaccguagccggaguccuagccucccaaa

SEQ ID NO: 433986 - RNA, 64 nt, Human
caagcauuugauaauucauccuuuaagaaaaacaccaccguacacugcuugaagaguuccucuu

SEQ ID NO: 433987 - RNA, 64 nt, Human
gagcuaaccugggaggugcugaaggggcauugggccaccguaagcaagggaaaaagggcagauc

SEQ ID NO: 433988 - RNA, 64 nt, Human
agcccagcagcccgaggccgcccgcgacuagcccccaccguaguauuuauaguuaaauuaaggg

SEQ ID NO: 433989 - RNA, 62 nt, Human; identical to SEQ ID NO: 433970

SEQ ID NO: 433990 - RNA, 62 nt, Human; identical to SEQ ID NO: 433971

SEQ ID NO: 433991 - RNA, 62 nt, Human; identical to SEQ ID NO: 433972

SEQ ID NO: 433992 - RNA, 64 nt, Human
cuccccaugggcacaguggugacccccuugauucccaccguacaacccccuccaccccccacuc

SEQ ID NO: 433993 - RNA, 64 nt, Human
agaagauccuagggcccaucccaucacacaugauccaccguaccagguaaggaccccaguagcc

SEQ ID NO: 433994 - RNA, 64 nt, Human
cagccuccuaaagcacugggauuacaggugugaaccaccguacccagccuaucuuuuugauacu

SEQ ID NO: 433995 - RNA, 64 nt, Human
uccuguuacuaaucacuaaagaaaccggaugcugccaccguaggauuuaagcaguagugcuucc

SEQ ID NO: 433996 - RNA, 64 nt, Human
aucucuucuaaaccaauaauugaccucuaggcacccaccguaauacugcuaccuucagggcaga

SEQ ID NO: 433997 - RNA, 64 nt, Human
cgagcacgaacuagaccaagcgaagggcagcccaccaccguauaucaaaccucacuuccgaaug

SEQ ID NO: 433998 - RNA, 64 nt, Human
uggacacacacagcuucuagugauuucuggggccccaccguaaagugagcaugcuuucugaacu

SEQ ID NO: 433999 - RNA, 64 nt, Human
cauucacaucuagacuuugaguucccugcaucugccaccguaguuucuagcaggaguagugggg

SEQ ID NO: 434000 - RNA, 64 nt, Human
ucagucucugggcaaucaucaucuuugccucuagccaccguagauaaggugugaagggacugcu

SEQ ID NO: 434001 - RNA, 64 nt, Human
cagccucccgaguagcugggauuacaggcacccgccaccguaccuggcuaauuuuuguauuuuu

SEQ ID NO: 434002 - RNA, 64 nt, Human
auugcccgguacuaggaaggagugagguguguucccaccguacacuucccacacgagcugcggc

SEQ ID NO: 434003 - RNA, 64 nt, Human
caggaggcggagguugcacugagccgagaucacaccaccguacuccagucugagcgacagagca

SEQ ID NO: 434004 - RNA, 64 nt, Human
auuucuuccagcaugaucgcgcccugcucccgugccaccguagucccuggcagacaggcagggc

SEQ ID NO: 434005 - RNA, 64 nt, Human
uuguugucugcuggggggccauagcuggcacugcccaccguaaaggcccucgcacauuuucccc

SEQ ID NO: 434006 - RNA, 64 nt, Human
uggccucccaaagugcugggauuacaggccugagccaccguaucuggcccaaaacacaaauuua

SEQ ID NO: 434007 - RNA, 64 nt, Human
agaauggggugcauuuggugcugaggcuuugaagccaccguauuuuucguuaccugugacuaug

SEQ ID NO: 434008 - RNA, 62 nt, Human; identical to SEQ ID NO: 433898

SEQ ID NO: 434009 - RNA, 62 nt, Human; identical to SEQ ID NO: 433837

SEQ ID NO: 434010 - RNA, 62 nt, Human; identical to SEQ ID NO: 433838

SEQ ID NO: 434011 - RNA, 62 nt, Human; identical to SEQ ID NO: 433839

SEQ ID NO: 434012 - RNA, 64 nt, Human
ccaccucccaaagugcuaggauuacaggcgugagccaccguacccagccuggucccauaucaua

SEQ ID NO: 434013 - RNA, 64 nt, Human
gaaaucuuaacacauauauugauucaugucaccaccaccguaaucgagauucagaauguugcau

SEQ ID NO: 434014 - RNA, 64 nt, Human
uuugauaucauguucuuuucauagucguauuuugccaccguaaacauaaaaaaaaaaaaaaaga

SEQ ID NO: 434015 - RNA, 62 nt, Human; identical to SEQ ID NO: 431274

SEQ ID NO: 434016 - RNA, 62 nt, Human; identical to SEQ ID NO: 433855

SEQ ID NO: 434017 - RNA, 62 nt, Human; identical to SEQ ID NO: 433856

SEQ ID NO: 434018 - RNA, 62 nt, Human; identical to SEQ ID NO: 431291

SEQ ID NO: 434019 - RNA, 62 nt, Human; identical to SEQ ID NO: 433858

SEQ ID NO: 434020 - RNA, 62 nt, Human; identical to SEQ ID NO: 433970

SEQ ID NO: 434021 - RNA, 62 nt, Human; identical to SEQ ID NO: 433971

SEQ ID NO: 434022 - RNA, 62 nt, Human; identical to SEQ ID NO: 433972

SEQ ID NO: 434023 - RNA, 62 nt, Human; identical to SEQ ID NO: 431275

SEQ ID NO: 434024 - RNA, 62 nt, Human; identical to SEQ ID NO: 433824

SEQ ID NO: 434025 - RNA, 62 nt, Human; identical to SEQ ID NO: 433825

SEQ ID NO: 434026 - RNA, 60 nt, Human; identical to SEQ ID NO: 431292

SEQ ID NO: 434027 - RNA, 62 nt, Human; identical to SEQ ID NO: 433898

SEQ ID NO: 434028 - RNA, 62 nt, Human; identical to SEQ ID NO: 433837

SEQ ID NO: 434029 - RNA, 62 nt, Human; identical to SEQ ID NO: 433838

SEQ ID NO: 434030 - RNA, 62 nt, Human; identical to SEQ ID NO: 433839

SEQ ID NO: 434031 - RNA, 62 nt, Human; identical to SEQ ID NO: 431276

SEQ ID NO: 434032 - RNA, 62 nt, Human; identical to SEQ ID NO: 433634

SEQ ID NO: 434033 - RNA, 64 nt, Human
auaccacugagggagagacccuuucugaaagaaguauggccaaaagcacuuuaaugcugcugac

SEQ ID NO: 434034 - RNA, 64 nt, Human
gugccaccgcgcccggccaagaugggaguauuuuuauggccauuuuacagaugggagaacaguc

SEQ ID NO: 434035 - RNA, 64 nt, Human
uucagccagacuccaugacucaucugaucccuuuuauggccaaaucauccuucagaguagggaa

SEQ ID NO: 434036 - RNA, 64 nt, Human
aagggaaggaagauuccuguggcauguugauuucuauggccaacuuucucucuuuguaaaacaa

SEQ ID NO: 434037 - RNA, 64 nt, Human
ugggauggguucguguccagucccgggggucugauauggccaucacaggcuggguguucccagc

SEQ ID NO: 434038 - RNA, 64 nt, Human
ggagagccuugauuuaggcuacggccucacucucuauggccacccuaagaggaaaggcuacuuc

SEQ ID NO: 434039 - RNA, 64 nt, Human
auaacgcaggucccuuuucuuggaaggcuuguacuauggccaugacagugacauugcccucacc

SEQ ID NO: 434040 - RNA, 64 nt, Human
uacagucuguuuuuaaaaccauaggugggacagcuauggccaauaggcuauaaagagacauuua

SEQ ID NO: 434041 - RNA, 64 nt, Human
uugucuucaaccuggccuguccagcccuuccagauauggccaaacccauggccuggaugggcuu

SEQ ID NO: 434042 - RNA, 64 nt, Human
aggagcuguuggccugggugggcaggaacugcaguauggccaugggcugagcaggcugagcacc

SEQ ID NO: 434043 - RNA, 64 nt, Human
gcugagcaggcugagcaccucagccuuuagggcuuauggccaggggacacuguaugacucuccu

SEQ ID NO: 434044 - RNA, 55 nt, Human
ggucccacucaagguccuaacuggcuauggccacagcuggaacuacccgagaagu

SEQ ID NO: 434045 - RNA, 55 nt, Human
acuuuacaggggcuguuuagaaauauauggccaaaucuguaacccggaaacagca

SEQ ID NO: 434046 - RNA, 64 nt, Human
caucgcuguuuuguccuagagugaacuuguggcuuauggccagugcuguuugguggucugccuu

SEQ ID NO: 434047 - RNA, 64 nt, Human
uaugaacuacaaagcuucuaucccaggagguggcuauggccacccguucugcuggccuggaucu

SEQ ID NO: 434048 - RNA, 64 nt, Human
cuggggcgcugcuccccacaguccaaauaagcugaaagugcagcucgcugcaggccccagagcg

SEQ ID NO: 434049 - RNA, 64 nt, Human
aucuuauuucuuuuaugauuggugcaaauuggcuaaagugcauuuuuaaauuuccucuacuuaa

SEQ ID NO: 434050 - RNA, 64 nt, Human
ccuggagcugccagaagaaaugagguaccuuuucaaagugcagccgagagugagaaccaaguga

SEQ ID NO: 434051 - RNA, 64 nt, Human
agguauggggguagccccaaaaggaggaaucuccuauggccaauaagguaucuugacuuuauca

SEQ ID NO: 434052 - RNA, 64 nt, Human
uucucuagucuagccuuccacauucuuagauuaauauggccaacccuguacacaucacuacacu

SEQ ID NO: 434053 - RNA, 64 nt, Human
cuaacugauggcuccuccguagugcucccaauccuauggccaugacugcugaaccugacaggcg

SEQ ID NO: 434054 - RNA, 64 nt, Human
uugagggaaaaaacucaauguuuggcuuuuuuauuauggccacucgagucaggaugcucuauuu

SEQ ID NO: 434055 - RNA, 64 nt, Human
uggggaggagagcucugggaacagccgcucacaauauggccaucagguaccuggggggagaagu

SEQ ID NO: 434056 - RNA, 64 nt, Human
uuuaauaugugaccaagaacacaaggagcauccauauggccaaauaaauacacugaauuuuaga

SEQ ID NO: 434057 - RNA, 64 nt, Human
guaggucuauauggaaaaguuaccauuaggaaaauauggccauacugcuuuuuuaccccugcac

SEQ ID NO: 434058 - RNA, 64 nt, Human
ggauggcauugaaucuauaaauuaccuugggcaguauggccauuuucacgauauugauucuucc

SEQ ID NO: 434059 - RNA, 64 nt, Human
aagugaaaaacaugacccagaggacagcacagacuauggccauggcucacaugguuuacauccu

SEQ ID NO: 434060 - RNA, 64 nt, Human
aaagaaaaagacaccguccuuuaaagugcugcaguauggccagacgugguggcucacaccugca

SEQ ID NO: 434061 - RNA, 64 nt, Human
gauugcuucauuugcuggguguggaaagaguugcuauggccaggcauaugggauuuggaagcuc

SEQ ID NO: 434062 - RNA, 64 nt, Human
ccuaugccuaugauaagguagcagucugcauucuuauggccauuagauguuacaaacuccuugc

SEQ ID NO: 434063 - RNA, 64 nt, Human
auuuaaaacagcuuaauuugguacagguuacacauauggccauuuauguaaagucccucuaaga

SEQ ID NO: 434064 - RNA, 64 nt, Human
cagcagcagggagcugccuaaacaccuccuuggauauggccaggacccacagggacacagggca

SEQ ID NO: 434065 - RNA, 64 nt, Human
uaagggguuaagggaggguacuguugacaccagcuauggccaauagcugggcuguccugagggg

SEQ ID NO: 434066 - RNA, 64 nt, Human
uuuaucuacuccagaagucucuacaauagaaaaaaaagugcagugcuucuaggauauaaaauuc

SEQ ID NO: 434067 - RNA, 64 nt, Human
cuuccacauuuguaucaccuuugcuaucuuggggaaagugcaaaggacaaacaucucaauugua

SEQ ID NO: 434068 - RNA, 64 nt, Human
uuuuuuuuuuuuaaauuggcuuuggccaguagcuaaagugcaagacugaauuaaugagaagaua

SEQ ID NO: 434069 - RNA, 64 nt, Human
guguuggugaaauugcuguggggguaucgggggauauggccaguaaaguauugagagacuaaca

SEQ ID NO: 434070 - RNA, 64 nt, Human
uuucacaagauucucuacuuaugugauaggaggguauggccaguuauucaucuaacuggacuca

SEQ ID NO: 434071 - RNA, 64 nt, Human
ugguucacuggcuuaagagguuucucagaauaucuauggccacagcagcauaccaguuuccauc

SEQ ID NO: 434072 - RNA, 64 nt, Human
aggcagacuccacacagagaggauaugaugagaauauggccaucaccugaaaaguuuucuuauc

SEQ ID NO: 434073 - RNA, 64 nt, Human
uggagaaaaccaucaaggucgaggaagcccuggguauggccauuaccaucugauuagaagauga

SEQ ID NO: 434074 - RNA, 64 nt, Human
guacuaaagugacaaaucggaauaauauaauugguauggccauuagguucaguccuugaagaua

SEQ ID NO: 434075 - RNA, 64 nt, Human
uccagcccuuugaaaccccuuagagagaagcauauauggccacaaagcacagaggcuuagguuu

SEQ ID NO: 434076 - RNA, 64 nt, Human
uuaccucacaguccccacccuuucaaaguugacauauggccaucccauuggccagaauccacag

SEQ ID NO: 434077 - RNA, 64 nt, Human
uggaauuuuaugucaugcuaagguauguguuacauauggccaaguggaaaauauaucugaagag

SEQ ID NO: 434078 - RNA, 64 nt, Human
cuuuggcaagaaaaauaacauuaaccucauuguuuauggccaugcuuugugcauaaucaaaguu

SEQ ID NO: 434079 - RNA, 64 nt, Human
auguuuuggguggauugccuaggaaagcaagucauauggccauugauaguucucauguaauuag

SEQ ID NO: 434080 - RNA, 64 nt, Human
ucuuagcuguauacagauucuagccaaacuauucuauggccauuacuaacacgcauuguacacu

SEQ ID NO: 434081 - RNA, 64 nt, Human
uccuaaucuagcuugccauuauuguguguguaauuauggccaaaaggacauaggagauggacua

SEQ ID NO: 434082 - RNA, 64 nt, Human
cacccccaggaaggaguuugagguucauugucauuauggccacaguuuggugcuugugcacggg

SEQ ID NO: 434083 - RNA, 64 nt, Human
aaacaugaggucagacauguguaagguagacgccuauggccacuggcuugaccaccuuggaagu

SEQ ID NO: 434084 - RNA, 64 nt, Human
cccucccauguugcaugccuauguacucuacgccaaagugcagcccuuccuccugaagccucug

SEQ ID NO: 434085 - RNA, 64 nt, Human
cgcuuccugcauuagcaaauuuuacuuacagucaaaagugcagauuuauacuccugacgugucu

SEQ ID NO: 434086 - RNA, 64 nt, Human
uguacucucaauaauucuacagaaauaaaacuguaaagugcaaugugaaaucaaagauuauagu

SEQ ID NO: 434087 - RNA, 64 nt, Human
ccgaguugucagaaauaacuggaagaauacaauauauggccauuauggagccaggggcuaguug

SEQ ID NO: 434088 - RNA, 64 nt, Human
uauuguacggugcagcuagagaauuauaguucacuauggccauucucuacauaaacauuaagau

SEQ ID NO: 434089 - RNA, 64 nt, Human
auuugguauaugcugaagucugccaaggguacauuauggccauuuuuaauuuacagcuaaaaua

SEQ ID NO: 434090 - RNA, 64 nt, Human
uuguccugacuauguuucacauuugugaauuagguauggccaccuggugaauucaguuguuaag

SEQ ID NO: 434091 - RNA, 64 nt, Human
uuuagucagugguuuuuccauagugcuuuuuuccuauggccagugcaaauuguguuagcacacu

SEQ ID NO: 434092 - RNA, 64 nt, Human
agaaggugcaggcuuuccugagucuuagaccagauauggccaguugcgcagguuucugccaacu

SEQ ID NO: 434093 - RNA, 64 nt, Human
uuucaugacucaaaaaugagcugagaaggaguguuauggccaggugcggcgucaugcaccuaua

SEQ ID NO: 434094 - RNA, 64 nt, Human
gcgugugcacugucugcuguggggaugguguguuuauggccauguaaguggcagguguguguaa

SEQ ID NO: 434095 - RNA, 64 nt, Human
aaacuugugaaaaucugaacauaggggagugagguauggccacugaggauuuuugcuugcuuaa

SEQ ID NO: 434096 - RNA, 64 nt, Human
gaacccugaggaguggagucauacgcgaaggccauauggccaucgugucagcagagagagucuc

SEQ ID NO: 434097 - RNA, 64 nt, Human
aauuggagcagcuuuuggcugcguaacugugaacuauggccauauauaauuuuuuuucauuaau

SEQ ID NO: 434098 - RNA, 64 nt, Human
ugcagaauuuaagaaauuauguuuugugguaaucuauggccaacgauguuagaaccuagcgcaa

SEQ ID NO: 434099 - RNA, 64 nt, Human
ugacccucacagggagggauaauuuagacucugguauggccaaagauuugagcacaaaggcaac

SEQ ID NO: 434100 - RNA, 64 nt, Human
gaaugggagcugcaaacgcgguccucggacucacuauggccagaaagcaaucuuguuucucccc

SEQ ID NO: 434101 - RNA, 64 nt, Human
cauugugaaacugcuaauauuagcuugucauaauuauggccauaaacuaauuuuucuauaaaag

SEQ ID NO: 434102 - RNA, 64 nt, Human
uugaguuggccaagaaauaaauucacauccucagaaagugcagcauggaggaaaaucugaacuc

SEQ ID NO: 434103 - RNA, 64 nt, Human
ggcuaaaaaauaaccuuguguaugcuaccaacuuaaagugcauuauuuugugucacuuuuuuuu

SEQ ID NO: 434104 - RNA, 64 nt, Human
ugagccuggggucacagggggugucgggcggaggaaagugcaucccccagagcuuggguuccuc

SEQ ID NO: 434105 - RNA, 64 nt, Human
aacauauuaacaaaauugggugcauucagggugguauggccauagaccagagcaacacauugaa

SEQ ID NO: 434106 - RNA, 64 nt, Human
uguguguguuuucuggauuuucucucucucuucuuauggccauuucaccuuauuacugauuggg

SEQ ID NO: 434107 - RNA, 64 nt, Human
agcugugccuauagaagcucuuuucaacauucuuuauggccagcagcccuugguuggugcagau

SEQ ID NO: 434108 - RNA, 64 nt, Human
aauaauugccacauuuauuguccucaaaauugcuuauggccauguauaaccaauuaauucugag

SEQ ID NO: 434109 - RNA, 64 nt, Human
ugucacugucaagauauauugcagauuacuuaaauauggccaucaaaacaaaaguuacaacacg

SEQ ID NO: 434110 - RNA, 64 nt, Human
aaacauacucauagauguuaugcaaaaaaaagucuauggccagguaugcauggaaaauguggga

SEQ ID NO: 434111 - RNA, 64 nt, Human
uauuuuccuuuuccuuuuuuuaaaaaaaauaaguuauggccaucuuagugggugugaaguggua

SEQ ID NO: 434112 - RNA, 64 nt, Human
auuuacauaguagcauguaucaacacuucauuuuuauggccaaauaaaauuguauuauguguuu

SEQ ID NO: 434113 - RNA, 64 nt, Human
gacccaucuuucucacacggauuuagucccacccuauggccacuggccguaucugagggcugcu

SEQ ID NO: 434114 - RNA, 64 nt, Human
uguguguguguguguguguguguuuaacagagaauauggccagugcuugaguucuuucuccuuc

SEQ ID NO: 434115 - RNA, 64 nt, Human
guuaaacacugaucuuugcuaaugguggagccacuauggccaaugccuggcugcaggcaucagu

SEQ ID NO: 434116 - RNA, 64 nt, Human
uuggucauuuuauguuaagggaagaauuccaggguauggccauggaguguacaaguaugugggc

SEQ ID NO: 434117 - RNA, 64 nt, Human
gugucaauguaaagccaaaaccaucuucuguguuuauggccaaucuauucucaaaguuaaaagu

SEQ ID NO: 434118 - RNA, 64 nt, Human
cuguuagugggagagaucgcuggcaccauagccuuauggccaacagguggucuguggugaaagg

SEQ ID NO: 434119 - RNA, 64 nt, Human
gaaguuaacugauuuaugauuguuaacacauaaauauggccacuuauccauuugccucaacuuc

SEQ ID NO: 434120 - RNA, 64 nt, Human
acacaaagcccaucagugggcauuaaaaauauuaaaagugcagacuuuuacuguccuuaagugc

SEQ ID NO: 434121 - RNA, 64 nt, Human
uuguaaaauaaauaaaaguauauacaacuuuuaaaaagugcaacccuggcuaaauuccacuccu

SEQ ID NO: 434122 - RNA, 64 nt, Human
uggauuuggcaugucuucccaucaguucaggucaaaagugcauuguugugagauuuauuaaaaa

SEQ ID NO: 434123 - RNA, 64 nt, Human
agcuucaguccauccauguuagauggacagaaauuauggccaguugaaaauaccagcuuugguu

SEQ ID NO: 434124 - RNA, 64 nt, Human
aaauauaauuuuuuaaaaauugacuagcaaaaucuauggccacacugagaagccuuugaaaaug

SEQ ID NO: 434125 - RNA, 64 nt, Human
cacagccaucugcgggggugaugugaaaaaggacuauggccacauucaaucgcccaacuaccca

SEQ ID NO: 434126 - RNA, 64 nt, Human
uuucuggaguuuguuuugcagggauagcugggaguauggccacccugcuccacgaugcgguaau

SEQ ID NO: 434127 - RNA, 64 nt, Human
ucucgcuggccaacaucagcggccggcugucggguauggccaaugccuuccggacgguguacca

SEQ ID NO: 434128 - RNA, 64 nt, Human
uaauggucucuagcaaaugugugguaaacauucauauggccauuaauuuuaacauuaaaucgua

SEQ ID NO: 434129 - RNA, 64 nt, Human
uccaagaugcccagaucuuuuaccagucacacccuauggccauggcuauacuuggaaguucucc

SEQ ID NO: 434130 - RNA, 64 nt, Human
ggacuaacccaaugccugugaagcagucagcccuuauggccaauaacuuuucaccaaugagccu

SEQ ID NO: 434131 - RNA, 64 nt, Human
acuuaaguccagaagccuccuguuggccuuggaauauggccaaggcucucucugucccuguaaa

SEQ ID NO: 434132 - RNA, 64 nt, Human
gauugcauugggaccagucauuuccuaagcuacauauggccaucuugacaguguuuuuucuuuu

SEQ ID NO: 434133 - RNA, 64 nt, Human
uuuauuaaaaauguuucauuguaucacauagaaauauggccaggaaggacuugagaagacaguu

SEQ ID NO: 434134 - RNA, 64 nt, Human
agccuguugcugagcccgguggucuggauuggaguauggccagggcaggaguacacagaauaga

SEQ ID NO: 434135 - RNA, 64 nt, Human
gccccuuggcugcaguuaggaccucaguggcugguauggccaagcugcuagaagaugcugcugu

SEQ ID NO: 434136 - RNA, 64 nt, Human
cagaaaaaauucaaaugcacuuauguucucauucuauggccauuguguugccucuguuacuguu

SEQ ID NO: 434137 - RNA, 64 nt, Human
aucugggaauagcagcgguaucccuccacccaaguauggccaccuguuugucuucauauagaac

SEQ ID NO: 434138 - RNA, 64 nt, Human
uuuugugauccuuuaauauuauccaugcuuuuauaaagugcaguacacauuuugacauugccac

SEQ ID NO: 434139 - RNA, 64 nt, Human
ucuucugcuggggcugacuuguccagaaggggacaaagugcaauacagagccuucccuacccug

SEQ ID NO: 434140 - RNA, 64 nt, Human
aaguaugcaggcguuuacgugauugugccauuccaaagugcaucagaacugucauucccuucua

SEQ ID NO: 434141 - RNA, 64 nt, Human
cacucccacaccucccuuccagcaggccagugguuauggccagcacggcuacaguacaggugag

SEQ ID NO: 434142 - RNA, 64 nt, Human
guccuccacaucaauuuccaaacaaugaauuagguauggccauucaucacuguucaguaguuuc

SEQ ID NO: 434143 - RNA, 64 nt, Human
uggccucuuuguagaacccugugguauagaggaguauggccacugccccacuauuuuuauuuuc

SEQ ID NO: 434144 - RNA, 64 nt, Human
ggcugggccgucguggagguggccccaggagucauauggccauacucagacacaccuugugugg

SEQ ID NO: 434145 - RNA, 64 nt, Human
cuuccugcauaggacuggaagaccgaaguuuuuuuauggccauauuuucuacugcaauucugaa

SEQ ID NO: 434146 - RNA, 64 nt, Human
ugguaucuguuggugcauacuuguguuccacaguuauggccauauacacagagguaguauauga

SEQ ID NO: 434147 - RNA, 64 nt, Human
uguuaaaucgguaccugauaauguacccaaauacuauggccagauaauaaauugugcugcaaac

SEQ ID NO: 434148 - RNA, 64 nt, Human
gcaauauucuagcuauuguaacuucuaaaaaugguauggccauuagaucugugcuuuuuaucuc

SEQ ID NO: 434149 - RNA, 64 nt, Human
guaccaacacugaaucuuacagcaguuaucuuucuauggccauuagguaccuagcagaugugca

SEQ ID NO: 434150 - RNA, 64 nt, Human
uuccucugacuguuuccuggcauauaugcaugaauauggccauuauugaacuaucacuucagua

SEQ ID NO: 434151 - RNA, 64 nt, Human
auaccccuucuauuuccugacauaaauaaauggcuauggccauuuacagcugaaccacgucuuc

SEQ ID NO: 434152 - RNA, 64 nt, Human
aaauagcacuucagaccuuauagaaccauauagauauggccaaggaauagcaggauucacuauu

SEQ ID NO: 434153 - RNA, 64 nt, Human
uuucaaaaacacacagcuucaacaauugucaccauauggccaauuugcaacaaugggacucuua

SEQ ID NO: 434154 - RNA, 64 nt, Human
ggacccaguggcagggcacagggccuggcccauguauggccaggaaguagcacaggcugagugc

SEQ ID NO: 434155 - RNA, 64 nt, Human
guaauaagccaagggcuaggcucuuguuugaguuuauggccaccuggaauuuucagucaucuca

SEQ ID NO: 434156 - RNA, 64 nt, Human
uucuggcaauuguagauuuaguuugacgcuccccaaagugcaugagacacaugcuaaaauuaca

SEQ ID NO: 434157 - RNA, 64 nt, Human
cugucaacuaaauuugaguguuaacggucuuuuuaaagugcauuuaaauacaaaccaggaauuu

SEQ ID NO: 434158 - RNA, 64 nt, Human
ucuuugaagagaaucccaaaaguuaguucaucuuaaagugcaauauuguuuaaucuuaaaacug

SEQ ID NO: 434159 - RNA, 64 nt, Human
aucaagcaguuauuugauuugugcucacuuuugauauggccaauaaaaccauaccgacugagcu

SEQ ID NO: 434160 - RNA, 64 nt, Human
uuacccaaggcguuuggcucagagggcuacagacuauggccagaacucaucuguugauugcuag

SEQ ID NO: 434161 - RNA, 64 nt, Human
ccauggcccagccccaaggccaggcugucuacccuauggccacagcaggaggucagcccagggc

SEQ ID NO: 434162 - RNA, 64 nt, Human
guagaacugcccauuuccauggugcaaaaacucuuauggccaaauucaaacuauaaacaugaug

SEQ ID NO: 434163 - RNA, 64 nt, Human
acuugaccacaucccaggauuuauggugucugucuauggccacagccaaccagaaugagugggu

SEQ ID NO: 434164 - RNA, 64 nt, Human
uaccguuaccuacuguugucauuguuauuacagcuauggccacuauuauuaaagagcuguguaa

SEQ ID NO: 434165 - RNA, 64 nt, Human
cuucuugguguucugucaugggccaugggcuugcuauggccagccuuacugaggccaagcagcu

SEQ ID NO: 434166 - RNA, 64 nt, Human
augagauagcugguguuagggcuaucucaggcaauauggccacaccugggucuuuaugcaugaa

SEQ ID NO: 434167 - RNA, 64 nt, Human
agacuauagucuaugcuuagagaucuugucugguuauggccauuguuuuuuacuacuuugauca

SEQ ID NO: 434168 - RNA, 64 nt, Human
uuagucucucuacaugggaagauguugugcuuacuauggccagucacuuugacaaagaaaagcc

SEQ ID NO: 434169 - RNA, 64 nt, Human
aggugacagaaggaccagcccuugagggagaacuuauggccacagcccauccauaguaacugac

SEQ ID NO: 434170 - RNA, 64 nt, Human
cagggcagggcccaccugguagaaguguucuggauauggccaggguggguguguggcuaagugg

SEQ ID NO: 434171 - RNA, 64 nt, Human
caaagauaaacauggccaaaaauaaauaaauaaauauggccauauguccguuguugcuuagucu

SEQ ID NO: 434172 - RNA, 64 nt, Human
cuaaaaggugguaccaggcaucccuuuccuggcuuauggccaagcccuacccggccagcagucg

SEQ ID NO: 434173 - RNA, 64 nt, Human
gaugugggugcaggcaugcacacacacgauggaauauggccauuccuacacaggugggguagag

SEQ ID NO: 434174 - RNA, 64 nt, Human
ccucuuuguccagccuugauuuacagugcaggguaaagugcagaccuuaaaaacagcuaaguac

SEQ ID NO: 434175 - RNA, 64 nt, Human
auccuuuaaaaaauuuuagaacuuuuuuaaaaucaaagugcagauugcuuguauguaaaaccca

SEQ ID NO: 434176 - RNA, 64 nt, Human
uaauguuaggaagaugauaaaaauucgcucuuuuaaagugcagcuuauuauucucaauugcuaa

SEQ ID NO: 434177 - RNA, 64 nt, Human
agauuauuauauaugacauaucuauagcuauguguauggccauagauguauuucuguguguaca

SEQ ID NO: 434178 - RNA, 64 nt, Human
ggagaguuuuuccagauuuuagauuuuucuagguuauggccauuuugugucuuuugagguugug

SEQ ID NO: 434179 - RNA, 64 nt, Human
uugucuguauuuaauggccugaacugagaguugauauggccaaagggagagaggccuuuuaaaa

SEQ ID NO: 434180 - RNA, 64 nt, Human
cugcaggagccaucaucugugaaaaggagcacuguauggccacagaagggcagcagcugcguca

SEQ ID NO: 434181 - RNA, 64 nt, Human
acauagcgagacccuaucuaaaauaacaauaauauauggccaggcgggauggcucacgccugua

SEQ ID NO: 434182 - RNA, 64 nt, Human
auaaaaggaugaaaacaagugucuucacuaagcguauggccaauaaaugggacccaaacguuca

SEQ ID NO: 434183 - RNA, 64 nt, Human
cagaugugacuguauaacuuucccagguucuguuuauggccacauuuaauaucuucagcucuuu

SEQ ID NO: 434184 - RNA, 64 nt, Human
uccugggccaggggcccuccugugcacuguuagcuauggccacgggagccuccagagcugccug

SEQ ID NO: 434185 - RNA, 64 nt, Human
auguucaaacaccuuuuaguauugauagcuuacauauggccaaaggaauacaguuuauagcaaa

SEQ ID NO: 434186 - RNA, 64 nt, Human
ucaacaaucuacugaguggccaugggcauguggauauggccaugaaugagcaagauccucucug

SEQ ID NO: 434187 - RNA, 64 nt, Human
ggaaacaauguacagaaaaacaauaaacugguuguauggccauagcuauccgaaaagcaagaga

SEQ ID NO: 434188 - RNA, 64 nt, Human
auccuaaaagacuaccuuugaaacaggauucuuguauggccaggauccugucugggaaccagaa

SEQ ID NO: 434189 - RNA, 64 nt, Human
aguuuuuuucugggaaucaaauuucugugguuuuuauggccagaaauuuuaaggacuugugugu

SEQ ID NO: 434190 - RNA, 64 nt, Human
agcugcagguaccagccacucggccccaggggguuauggccacagagggauaggcacagucucc

SEQ ID NO: 434191 - RNA, 64 nt, Human
caaugcccuagaacagcuaugaagcagaauaccauauggccaccuggacauugggacuugggaa

SEQ ID NO: 434192 - RNA, 64 nt, Human
uccgcaugaaacacugcaccaggcagggcuuugcaaagugcaagguauccccaguccaaguaua

SEQ ID NO: 434193 - RNA, 64 nt, Human
uggauaagcguggguggaggaagauccaaacagaaaagugcaaaguuauuccccaucuuccaag

SEQ ID NO: 434194 - RNA, 64 nt, Human
aaagucacguuucauaaucugcaauauuuuugucaaagugcacacuguacuuucuucuuaaaaa

SEQ ID NO: 434195 - RNA, 64 nt, Human
agguuuuuuuuuuuuuuuuuuuuucccuaaaugguauggccaaaagucagaguuaaaauauaua

SEQ ID NO: 434196 - RNA, 64 nt, Human
ugcgucuauuucagggucuuccauuuuugugguuuauggccaugcuugccaguuuugguggggu

SEQ ID NO: 434197 - RNA, 64 nt, Human
aacuuccuugaggagaagugaaguuucacugugguauggccauugaaaaacaaaaacucuucuu

SEQ ID NO: 434198 - RNA, 64 nt, Human
uuccuguccuaccugccucuuuggcuuggaccuauauggccaugcucuggcucuacccuuggga

SEQ ID NO: 434199 - RNA, 64 nt, Human
ucuuguaagguuaccguuucuaagaguugugcuuuauggccacugagagaauucagaauaaauu

SEQ ID NO: 434200 - RNA, 64 nt, Human
uuuuaaaaacaacuggaggcaucuuuguacauauuauggccaguuguacagaaucgcuuucugu

SEQ ID NO: 434201 - RNA, 64 nt, Human
auucuguguucagaaagacuaugagaccugaacauauggccaagaggaaagaagagugacguug

SEQ ID NO: 434202 - RNA, 64 nt, Human
ccuaauguggaacugguuguccauuguuugggccuauggccaagucacccagcuguggaagcag

SEQ ID NO: 434203 - RNA, 64 nt, Human
cagagcagccaauggguacugagcuggcugagccuauggccaaugaguauuccugcuaugcuca

SEQ ID NO: 434204 - RNA, 64 nt, Human
uugacauuuacaggagggcccggagaaacugagguauggccaugcccuagacccuccccaagga

SEQ ID NO: 434205 - RNA, 64 nt, Human
aagcaucuauaaauugacuucuuuuucuuaguuguauggccaggcaguccccauuuuaggaguu

SEQ ID NO: 434206 - RNA, 64 nt, Human
accugcugccuuggggacccuggacgugccgacauauggccauugagcuccaacccacacauuc

SEQ ID NO: 434207 - RNA, 64 nt, Human
gaacuucauaaaugugaagauuaccacuucuuuuuauggccaguccuuaucagaaguguuucag

SEQ ID NO: 434208 - RNA, 64 nt, Human
uucucaggccucagauaaaaccaucuccgcaucauauggccagugaccgcuuucucccuucaag

SEQ ID NO: 434209 - RNA, 64 nt, Human
gggaugagggagucacuguggguggccacagggcuauggccaagcguucccuggccgucuuccu

SEQ ID NO: 434210 - RNA, 64 nt, Human
uauaaacaauguucaggagaguaaaaauucauauaaagugcaauugcacaaauacaagccaagc

SEQ ID NO: 434211 - RNA, 64 nt, Human
uacaaaaggauuguuuuaauccccauuauucuggaaagugcauccuagucucccagucuauaac

SEQ ID NO: 434212 - RNA, 64 nt, Human
gcaagugcccuugagaacuuguagagggaguaaaaaagugcauggauaaaugacugcagcaaau

SEQ ID NO: 434213 - RNA, 64 nt, Human
uuagcagcaugcuuuuugaagauuaacucgacaauauggccagcuaaugaaauuaaaaaggauu

SEQ ID NO: 434214 - RNA, 64 nt, Human
cgcaagagaggccagaaugacagcugacagggucuauggccaucgggucgucuccgaagauuug

SEQ ID NO: 434215 - RNA, 64 nt, Human
augucaugcucuauuuauagaauaucaaaauauuuauggccagaaguucugucaauguguugau

SEQ ID NO: 434216 - RNA, 64 nt, Human
gggcccagggacucugaacccuccugaugaccccuauggccaacaucaacccggcaccacccca

SEQ ID NO: 434217 - RNA, 64 nt, Human
uuccccacgguaggaacauagcguguuuauauuuuauggccaaacuauuuugaauuuuguuguc

SEQ ID NO: 434218 - RNA, 64 nt, Human
aucgcuccgccuguccccaacccagucccauuuuuauggccaaacugauucugaaacaaaauga

SEQ ID NO: 434219 - RNA, 64 nt, Human
gauuuuguuuauggccaguuucucauugccuguuuauggccagauuuggggggccuguucccag

SEQ ID NO: 434220 - RNA, 64 nt, Human
cacgagcaugucacagugcugcagagauuuuguuuauggccaguuucucauugccuguuuaugg

SEQ ID NO: 434221 - RNA, 54 nt, Human
gcagagcuuauaagaucuaacccuuauggccaggugcaguggcucacguaugua

SEQ ID NO: 434222 - RNA, 64 nt, Human
guccccauugcgggcccgggaggggaaugguuucuauggccaaaguuugguuuucucaacacug

SEQ ID NO: 434223 - RNA, 64 nt, Human
cugacaggauggcccccaggaucgcucucuuugguauggccaaagucacuuccucgucuccucc

SEQ ID NO: 434224 - RNA, 64 nt, Human
caaaaggaaaaucaguaauuuugcagcagagaaauauggccaacuccaccuuaaccaaguggcu

SEQ ID NO: 434225 - RNA, 64 nt, Human
aauaaggucaucaguauuauguucuaaauaaacuuauggccauacaugagaaauguaccuugca

SEQ ID NO: 434226 - RNA, 64 nt, Human
cgcgccuggccacuccgaaggcuuuucaccccauuauggccaaauaguauagggccacugggga

SEQ ID NO: 434227 - RNA, 55 nt, Human
ugugccuuguggugagauaauaaauuauggccaugggaaacauuguauauuuagu

SEQ ID NO: 434228 - RNA, 64 nt, Human
augaaacuccuuuugucuauaaccaggcccuggcaaagugcaaacaggaugcaacugcaguggc

SEQ ID NO: 434229 - RNA, 64 nt, Human
uuaaauauacauuauaaagagcaagcauagauggaaagugcauauugaacacaucugugcauuu

SEQ ID NO: 434230 - RNA, 64 nt, Human
agccucccacuguggugccugggagugaccugguaaagugcaacgugccaugugcaugcugagc

SEQ ID NO: 434231 - RNA, 64 nt, Human
cuugaugguguuuaugaacaugccguagugccuuuauggccaguuugaguccugccuacuuuga

SEQ ID NO: 434232 - RNA, 64 nt, Human
uuuuuuaaaaaaaaauaagaaaaugcuaaauauuuauggccauguaaacguucugacaacuggu

SEQ ID NO: 434233 - RNA, 64 nt, Human
aaaguauaguuuuauauuugaaauguaugcaaauuauggccauauggcugauuggaauguacua

SEQ ID NO: 434234 - RNA, 64 nt, Human
agaaaccaaacacaacaaaauggcuuguugccaauauggccacaacauugccagcaaauacugc

SEQ ID NO: 434235 - RNA, 64 nt, Human
uuugaauuacgguuauuuaaaaacuaacauuugcuauggccaaaguguuuacaauaagcaauaa

SEQ ID NO: 434236 - RNA, 64 nt, Human
cagggcagccugagcgugcuuuccaaaacccaaauauggccacgcucccccucgguucaaaacc

SEQ ID NO: 434237 - RNA, 64 nt, Human
uuggcuugaaaagcauccaagggugcacagggaguauggccaacuggaccuguugucaccuuaa

SEQ ID NO: 434238 - RNA, 64 nt, Human
gucaggcuuuagauuagaccagcaguuuucaaaguauggccaauggaccccuggguuccuugag

SEQ ID NO: 434239 - RNA, 64 nt, Human
ucuucucacaaaucucuuuuuuuguuuuugaaaauauggccauuuuucauaaaauguuauuugu

SEQ ID NO: 434240 - RNA, 64 nt, Human
cacccugggaacagagcccuacagccagggcuuauauggccagcgggacuccaaccgggguagc

SEQ ID NO: 434241 - RNA, 64 nt, Human
uuggaaucuuuguccacacagcagucaaggcaguuauggccaaucagcugagggugucauguga

SEQ ID NO: 434242 - RNA, 64 nt, Human
uccaccuuuugguggcuauuggcauuuuuuggcuuauggccacauuucucuuucugcugugucu

SEQ ID NO: 434243 - RNA, 64 nt, Human
gcauuuuccugauugaugaaaaaaauaacucaguuauggccaucuaccccugcuagaagguuac

SEQ ID NO: 434244 - RNA, 64 nt, Human
guuuaccuaagccuuuaaggcugugucaccaagguauggccacaaggaagaauaguguacagag

SEQ ID NO: 434245 - RNA, 64 nt, Human
uguauguguguggaucuguacacacacacguauauauggccagaugcguauuucaauaaggaac

SEQ ID NO: 434246 - RNA, 64 nt, Human
gcugccagaauacaagcauugcuuuuggcaaauuaaagugcaugucauuucuuaauacacuaga

SEQ ID NO: 434247 - RNA, 64 nt, Human
ucuggaacuccuguccccuuagucaugagaacagaaagugcaauauuuccuuucaccuggcagg

SEQ ID NO: 434248 - RNA, 64 nt, Human
uccuggcuaacacggugaaaccccgucucuacuaaaagugcaaaaauuagccgggcgugguggc

SEQ ID NO: 434249 - RNA, 64 nt, Human
cuuacuuuuaaucgaguauaaggaaauguuucuuuauggccauuuuggagggagcaggggauga

SEQ ID NO: 434250 - RNA, 64 nt, Human
cucuuaagcauuuaccauuauuguaaguagccuuuauggccaaagcuguaaguuaagaauuaua

SEQ ID NO: 434251 - RNA, 64 nt, Human
agaacaucuuaaagcauuaaagcauaguuuuuuguauggccaaccuuacuaaauuaaguucuga

SEQ ID NO: 434252 - RNA, 64 nt, Human
cacacacugaugcuuagauguuccaguaaucuaauauggccacaguagucuugaugaccaaagu

SEQ ID NO: 434253 - RNA, 64 nt, Human
agaggagagauauuuugauucucauugccauucuuauggccacaagcaaaguaaugguucucau

SEQ ID NO: 434254 - RNA, 64 nt, Human
uggaaagugagaauuaaagucccucgccgcuuggaaagugcagccuucuacagguagagccacc

SEQ ID NO: 434255 - RNA, 64 nt, Human
uuguuuguuuauacaaauaucugauuugcaagaaaaagugcaugggagggguuuuagugguuua

SEQ ID NO: 434256 - RNA, 64 nt, Human
cccuacuacacuuugcuagugaaacugcccaggcaaagugcaccucaaaucuucuaauuccaag

SEQ ID NO: 434257 - RNA, 64 nt, Human
gaaucaaucaaaacaaucgaauuuugaauugaguaaagugcaauuucauuggauagcuaaauau

SEQ ID NO: 434258 - RNA, 64 nt, Human
ggaaaaauuuauuucaauaccuuuuagauuucauaaagugcaguguauauaaugccuacugaaa

SEQ ID NO: 434259 - RNA, 64 nt, Human
uuucugcugacuguguggguggaaugucccaagaaaagugcaucugggaauugccaguccagcu

SEQ ID NO: 434260 - RNA, 64 nt, Human
uuuucuucucauucuucuaaaacuacugccuuucaaagugcacacacacgcguccacauacacu

SEQ ID NO: 434261 - RNA, 64 nt, Human
cuuuuugccguguaugaggagugcuagaaaaugcaaagugcaauauuuucccuaaccuucaaau

SEQ ID NO: 434262 - RNA, 64 nt, Human
acccagcgcaaaggcacuggccgcacuugcaggaaaagugcaacuuaaagcaguaccuucauuc

SEQ ID NO: 434263 - RNA, 64 nt, Human
uauuauuuguauguauuaaacuuuucauuacacuaaagugcauuauuuuauugagcaaguaucc

SEQ ID NO: 434264 - RNA, 64 nt, Human
cggcccuacuucagucugaguuacucgggagggaaaagugcagcuccucugaucaucugcccca

SEQ ID NO: 434265 - RNA, 64 nt, Human
uuuguuacgugugauuuuucuauuucucuagcccaaagugcauuacagaagauacaccuauaga

SEQ ID NO: 434266 - RNA, 64 nt, Human
gcuuugaacuuacaagauuacacuaaccauuuuuaaagugcacaaaaauauuauuauuagucuu

SEQ ID NO: 434267 - RNA, 64 nt, Human
cuugccauggaagauacuagcccagccuagcagaaaagugcaauauguauagcauacuuugaca

SEQ ID NO: 434268 - RNA, 64 nt, Human
uaccuggaaucaucuuaguugggugagacucuuuaaagugcauccaugaagaaaccuguccauc

SEQ ID NO: 434269 - RNA, 64 nt, Human
cuggaaaaucccuaguuguuugaauuaacugaauaaagugcagggcguaauagugacuggcugg

SEQ ID NO: 434270 - RNA, 64 nt, Human
cugucaaaagaucuuucagacaauauaagccugcaaagugcagcagaguauuuauuuugaagag

SEQ ID NO: 434271 - RNA, 64 nt, Human
auuugccuauguucaaauauguuuaauaaugaccaaagugcauucugaguuuuuucaaggaaug

SEQ ID NO: 434272 - RNA, 64 nt, Human
cuacgagaacucuucugaugauggaauuucgauuaaagugcacugaaagaugcuucuguguuug

SEQ ID NO: 434273 - RNA, 64 nt, Human
accaauucuucaaccagaaaaaccuauuguucuaaaagugcacuuaagagaugggauuacaagu

SEQ ID NO: 434274 - RNA, 64 nt, Human
caagacggaaaaggacuuucuucuguuuucuuccaaagugcaaccacaguggagagcccacggu

SEQ ID NO: 434275 - RNA, 64 nt, Human
auuucucuucuuugaccgugcuaggaauuccaggaaagugcauuccugcccuggugaccuuuuc

SEQ ID NO: 434276 - RNA, 64 nt, Human
ugugaaaauaaauggaaguugguugauugucuagaaagugcaagaagauggcccugcuccuuuu

SEQ ID NO: 434277 - RNA, 64 nt, Human
ugagaaaacaggcucaggguuucaugacuuguugaaagugcagaaauggaaugcuggcccccug

SEQ ID NO: 434278 - RNA, 64 nt, Human
cuuaccuguacacugacuugagaccaguugaauaaaagugcacaccuuaaaaaugaggccaagu

SEQ ID NO: 434279 - RNA, 64 nt, Human
accugcucuuggucauuggaaauuuacacugaacaaagugcaauuaacuguagaacaguuuuau

SEQ ID NO: 434280 - RNA, 64 nt, Human
aaugcuuugugcuucugacuaucaauaccuaaagaaagugcaucagugaagagaugcaagacuu

SEQ ID NO: 434281 - RNA, 64 nt, Human
auuucaugacugaugcacaaauuuuaaugauuaaaaagugcaggagcccuaaaugucagugcag

SEQ ID NO: 434282 - RNA, 64 nt, Human
cagucaaaugauauguuaauaugaacuggaaugcaaagugcauacuuuuucauucaaaaugggu

SEQ ID NO: 434283 - RNA, 64 nt, Human
acuuuuuccuuuuuucucacaugguuugaaacuuaaagugcacaucacugaaauaaugagauuu

SEQ ID NO: 434284 - RNA, 64 nt, Human
aucaaaucaguaacuggucauggucaugcaucuaaaagugcauggaagaucauuuauuacuuuu

SEQ ID NO: 434285 - RNA, 64 nt, Human
uuacaagaguauaguauauuuauuugaaaugggaaaagugcauuuuacuguauuuuguguauuu

SEQ ID NO: 434286 - RNA, 64 nt, Human
uuagaguguguuuauucuucucuacuugauuuccaaagugcaacauuuuccgaugcuuuagaaa

SEQ ID NO: 434287 - RNA, 64 nt, Human
gagggagacuuucuuccucaguggcggagagaagaaagugcauuuauugucuuuccaccuauug

SEQ ID NO: 434288 - RNA, 64 nt, Human
uuugucugaaggauuuuaaaugcuguaugucauuaaagugcacuguguccugaaguuuucauua

SEQ ID NO: 434289 - RNA, 64 nt, Human
ggcaaugcuugugugauucacaaucguggcauuuaaagugcacaaaguacaaaggaauuuauac

SEQ ID NO: 434290 - RNA, 64 nt, Human
auaaauucuuuuaauuuauguucaauauauauaaaaagugcaucuguuuuguuuuucccuuuuu

SEQ ID NO: 434291 - RNA, 64 nt, Human
guuauuccucuguguucacuucgccuugcucuugaaagugcaguauuuuucuacaucaugucaa

SEQ ID NO: 434292 - RNA, 64 nt, Human
agaaccguuguuaauuuuaaaacuagcaaucuauaaagugcaccaggucaacuugaauaaaaac

SEQ ID NO: 434293 - RNA, 64 nt, Human
aucaagagcaaaacugcacaaacuugcacauuggaaagugcaacaaguucccgugauugcagua

SEQ ID NO: 434294 - RNA, 64 nt, Human
auaaaucagcaaggguauuuuagcuaauagaauaaaagugcaacagaagaauuugauuagucua

SEQ ID NO: 434295 - RNA, 64 nt, Human
cacgagagugguccuucccuuugccugugguguaaaagugcaucacacagguauugcuuuuuaa

SEQ ID NO: 434296 - RNA, 64 nt, Human
guacucauucauuccuguuaagcugccaaaaauuaaagugcaauauuguauauuuuuaagaaca

SEQ ID NO: 434297 - RNA, 64 nt, Human
ugugaacuaaaaaaaugggaagcccuccccaaaaaaagugcauaaaauguuauuuuugcauggc

SEQ ID NO: 434298 - RNA, 64 nt, Human
auuugcuuuaccuuguuaauauuaucuaggggaaaaagugcaaauugcuccauguucuucucuc

SEQ ID NO: 434299 - RNA, 64 nt, Human
aaggccugugugcuuguaauaacuaacauaacugaaagugcaaaugucauucuaagauucccau

SEQ ID NO: 434300 - RNA, 64 nt, Human
ggucaagcccagaaagugauaagugcagggaggaaaagugcaaguccauuauguaauagugaca

SEQ ID NO: 434301 - RNA, 64 nt, Human
uuuuuaccaaauaaccaaaaauuuuuagucugucaaagugcacagguauguucucagaacauuu

SEQ ID NO: 434302 - RNA, 64 nt, Human
aaggcuguauauauuuguuuauuuaaggugacugaaagugcaaagaggaaauggacagcaugca

SEQ ID NO: 434303 - RNA, 64 nt, Human
aucuuaguuaccaaacuaugaagugaaggcuuuaaaagugcauuauuuuaaggauaauaaauuu

SEQ ID NO: 434304 - RNA, 64 nt, Human
cucugauccugcaucccacucccugggagccaauaaagugcauuuucacaggccuggccuuggc

SEQ ID NO: 434305 - RNA, 64 nt, Human
cgcauggacccgagaggcgacgacacgagugaauaaagugcacauggacccugcgcguccuccc

SEQ ID NO: 434306 - RNA, 64 nt, Human
agauccggcuuggacaggcaccugagauggugccaaagugcagcugacucuucccacgacagcc

SEQ ID NO: 434307 - RNA, 60 nt, Human
ugcucuggacauauaacugacugcccacggaaagugcagaaugcuccuccaccucacucu

SEQ ID NO: 434308 - RNA, 64 nt, Human
uuagggugcacuguaaccauuacagagcuugugaaaagugcagaaaccugagccucaccuuaug

SEQ ID NO: 434309 - RNA, 64 nt, Human
aaaauaaaauuuuuuccuuuuuuuuuuuaaccggaaagugcauuugcuuggguguaauccuaaa

SEQ ID NO: 434310 - RNA, 64 nt, Human
uuuaacuacuauauugauuguccuuuaaaaaagaaaagugcauauuuauccaaaauguguauuu

SEQ ID NO: 434311 - RNA, 64 nt, Human
cacuguugaugugguucuuuuguguuaaaaaaaaaaagugcaacuaucaaaacuaaaaaauuau

SEQ ID NO: 434312 - RNA, 64 nt, Human
uaacaacugaaagcauuuuaauggacuauuuauuaaagugcaaacaaacucagcaauccuuaug

SEQ ID NO: 434313 - RNA, 64 nt, Human
ccuguuaacuuuuaaaaagucguaaguuuggaugaaagugcaagauguggaacaucaacuaccu

SEQ ID NO: 434314 - RNA, 64 nt, Human
agucccgguauuagggaauaguuucagcucuuucaaagugcacaguguuacagucgaaugggcu

SEQ ID NO: 434315 - RNA, 64 nt, Human
caggggucguuugcuuuucaggguuuucugagggaaagugcauaugaaauccuugacuggaccu

SEQ ID NO: 434316 - RNA, 64 nt, Human
uugugcagacugaaggaacacuguaguauaccccaaagugcauuugccuaggacuucucagcuu

SEQ ID NO: 434317 - RNA, 64 nt, Human
ucuucuuaaaggucaagucugcucucccucgccuaaagugcagcagcagcuccucucaagcuca

SEQ ID NO: 434318 - RNA, 64 nt, Human
guaguuuguaaaaguauuuuaacagcucugcggcaaagugcaaaugaaaagucuugauggcaug

SEQ ID NO: 434319 - RNA, 64 nt, Human
agaaaaaccaucauguuuugaggauacauuugugaaagugcaggcaugccaaugacuacucagu

SEQ ID NO: 434320 - RNA, 64 nt, Human
cccaaaaaucccaggggcaaaauaaaguucaacaaaagugcaaaauaugacaaaaauagguaca

SEQ ID NO: 434321 - RNA, 64 nt, Human
caaugacauaaggauguuuccaagaggaggcaauaaagugcaugguaauucauauccugcuucu

SEQ ID NO: 434322 - RNA, 64 nt, Human
ggguuuuguaaaaucagcaaaggcaguguuucaaaaagugcaaaaaaaaagauucuguuauaaa

SEQ ID NO: 434323 - RNA, 64 nt, Human
uguugugaaaggaaggaggggacugaaaucucccaaagugcaaauuggagaguguuuaaucuuu

SEQ ID NO: 434324 - RNA, 64 nt, Human
aggcagcggaaccaucuauuguuuuguuugccagaaagugcacccuguauggucuccugucuaa

SEQ ID NO: 434325 - RNA, 64 nt, Human
uauuuauguuagcuccaagcggaccggugguucaaaagugcauuauuuaguuugagcucuguag

SEQ ID NO: 434326 - RNA, 64 nt, Human
ggcugcaaaacucugaagauuccccaugcaugggaaagugcaaguggaugcauuccugagucuu

SEQ ID NO: 434327 - RNA, 64 nt, Human
gugaggacaguguugggaggcccaggggcccaguaaagugcauuugacauugaaccugccuggu

SEQ ID NO: 434328 - RNA, 64 nt, Human
cgagagccuaauuuuguaggacuuaaucuguugaaaagugcaguuacuucuggaaauuaaccuc

SEQ ID NO: 434329 - RNA, 64 nt, Human
uuaaauaagguagaauggaaaaaacccagagagcaaagugcauuacuuaaagaugcaguauaua

SEQ ID NO: 434330 - RNA, 64 nt, Human
uuuuuaccaauaauaauuuaucaaaauaagagggaaagugcaaucaaaucugaauuauuuuacu

SEQ ID NO: 434331 - RNA, 64 nt, Human
guucucaggccaaggucucgcccaccaaagccagaaagugcaagcacccgucuacccagcucua

SEQ ID NO: 434332 - RNA, 64 nt, Human
uauacccacacaccugucuacagugucauucaauaaagugcacgugcuugugaugaugcuguga

SEQ ID NO: 434333 - RNA, 64 nt, Human
cgucuccacccaggccggacacagacaugagacaaaagugcaccgaggcacgcucugccccgug

SEQ ID NO: 434334 - RNA, 64 nt, Human
acuauuacuugaacuuuccaaaaccuaaagaggaaaagugcaaugcguguuguacauacagagg

SEQ ID NO: 434335 - RNA, 64 nt, Human
ccugaccucucccaaauugggaagaccagaggagaaagugcaaaacuguccccauuuggaaugc

SEQ ID NO: 434336 - RNA, 64 nt, Human
cacuacauguugcuuuggcaacagcuauaguaucaaagugcauuacugguggaguuuuacaguc

SEQ ID NO: 434337 - RNA, 64 nt, Human
uaaaaggcuugugcuaucuuuccagugaaaacugaaagugcauuauuauggaagaauguauuug

SEQ ID NO: 434338 - RNA, 64 nt, Human
caguauaucaaagagcuugauaauuuaguugucaaaagugcaucggcgacauuaucuuuaauug

SEQ ID NO: 434339 - RNA, 64 nt, Human
cuucccuuauauauugaggcuaugggguaggagaaaagugcacaacccaccacccccuuuacuc

SEQ ID NO: 434340 - RNA, 64 nt, Human
ucauuucaaaagugaccaagggaaucuccgcacaaaagugcagauugaggaauugugauggguc

SEQ ID NO: 434341 - RNA, 64 nt, Human
uauccucacacgcuuuucuacaauggcauucaauaaagugcacguguuucuggugcugcugcga

SEQ ID NO: 434342 - RNA, 64 nt, Human
cuaauaauaucccacugggagaaaggaguuuugcaaagugcaaggaccuaaaacaucucaucag

SEQ ID NO: 434343 - RNA, 64 nt, Human
gacggacucauuuugaauugaguuucaaacuuugaaagugcaaggauuuaauuuuuaaguugaa

SEQ ID NO: 434344 - RNA, 64 nt, Human
aaaucaguuucugccucuuuuuggaaaagaaaacaaagugcaauuguuuuuuacuggaaaguua

SEQ ID NO: 434345 - RNA, 64 nt, Human
ugaagacucuagaaaagcaaagccggauuucuggaaagugcagaauucuuuugguucuuugguu

SEQ ID NO: 434346 - RNA, 64 nt, Human
cagagcuguccucuucucuagaguggagguuuucaaagugcaucaucagcauuaccugugaacu

SEQ ID NO: 434347 - RNA, 64 nt, Human
uccuuguaaccaucaguccaagguucaguucacuaaagugcauguucuaaaacaagagcuaucc

SEQ ID NO: 434348 - RNA, 64 nt, Human
cugccuuuuauacugucuaaaaaagcaaaguuuuaaagugcaauuuuaaaacuguaaauuacau

SEQ ID NO: 434349 - RNA, 64 nt, Human
guaaggaguuucagccgccuccgcaggaacccccaaagugcagauuccggagcagacacauccg

SEQ ID NO: 434350 - RNA, 64 nt, Human
gaauugagccaacuguuauagaaaauugguucagaaagugcaaucuugccagauuucuagcaaa

SEQ ID NO: 434351 - RNA, 64 nt, Human
aguuucuaauauuaaucuccagguguaagauuuuaaagugcaauuaaaugccaaaaucucuucu

SEQ ID NO: 434352 - RNA, 64 nt, Human
ggaauguagauauuguaaagcuuuuugugaauuaaaagugcaaaauaaagcaaccacauuuaag

SEQ ID NO: 434353 - RNA, 64 nt, Human
guggacugaaucugcuuguugaucaguguugaagaaagugcaaaaggaacuuuuauauauuuga

SEQ ID NO: 434354 - RNA, 64 nt, Human
uugcucgggucccuucaccuccucgcccuuucuuaaagugcaguucuuagcccucuagaaacga

SEQ ID NO: 434355 - RNA, 64 nt, Human
agagcaaacuuagcagcucugacuaacaggcugcaaagugcaaguucagauucuguggcagaga

SEQ ID NO: 434356 - RNA, 64 nt, Human
ggcagagagcaaaaaggggaaauaugucugggaaaaagugcacgugaagaaacaaagaaggaca

SEQ ID NO: 434357 - RNA, 64 nt, Human
ccccuuuuucccgcccccagauugauaaguaaugaaagugcacugcagugagggucaaaggaga

SEQ ID NO: 434358 - RNA, 64 nt, Human
ugucuaccugcucguucccaauguaucuuaaugaaaagugcaaaagaaaaaccuaccaauuaac

SEQ ID NO: 434359 - RNA, 64 nt, Human
auguuccuaaauuuuuguaaucuuacuguaaaaaaaagugcacugaacuucaaaacaaaacaaa

SEQ ID NO: 434360 - RNA, 64 nt, Human
auuacuagaguggugguucuacucuaagauuucaaaagugcauuuaaaaucauacauguucccg

SEQ ID NO: 434361 - RNA, 64 nt, Human
ggaacgcugucaaggacauuaucaggauaucugcaaagugcaauuucaacauguaccauuaacu

SEQ ID NO: 434362 - RNA, 64 nt, Human
uacccucauacguuauugcauuugaucuucacagaaagugcauuuuaaccaguacucugggugc

SEQ ID NO: 434363 - RNA, 64 nt, Human
guuucauuugugauaugaagggagagaagaaagaaaagugcauagccauucuguaacaauauug

SEQ ID NO: 434364 - RNA, 64 nt, Human
auuuuagauggcgucuuuucagucuacucuaccuaaagugcacuaccaucuaagaagacgagca

SEQ ID NO: 434365 - RNA, 64 nt, Human
gagaugagaaaaaaauucaccuuacagugcuaagaaagugcauuagaauggaauugcccuuucc

SEQ ID NO: 434366 - RNA, 64 nt, Human
gcaaguguugaacucuuucugcuuguuuugauucaaagugcaguuacugauguuguuuugauua

SEQ ID NO: 434367 - RNA, 64 nt, Human
uaccuuccuuucuagaaacaauuuuagauuggcaaaagugcaauguuuucuucacucaaaaaau

SEQ ID NO: 434368 - RNA, 64 nt, Human
uguuguuuauuuauaagguaauuguguguggggaaaagugcaguauuuaccuguugaauucagc

SEQ ID NO: 434369 - RNA, 64 nt, Human
gugacagcugccucgggaagccaaguugggcuuuaaagugcagggccugcugauguugagugcu

SEQ ID NO: 434370 - RNA, 64 nt, Human
acagaacuuuaugcuuaauuuagauccuuucugcaaagugcacugaauugcugaaaguugacuu

SEQ ID NO: 434371 - RNA, 64 nt, Human
uuaacuuguguucagccuuuuuguaacuuuuuugaaagugcaaacaauucuuuggauuauuaaa

SEQ ID NO: 434372 - RNA, 64 nt, Human
cuacugugaugauuccuauuuccucucauguuuuaaagugcaaacuaacauuuaagugaacauu

SEQ ID NO: 434373 - RNA, 64 nt, Human
agugagaauuuaugaacauuaauucauuuuaagaaaagugcagccaggcgcaguggcucaugcc

SEQ ID NO: 434374 - RNA, 64 nt, Human
guguauauaaugguuguguuuucauggggcuaugaaagugcacguuaaaccugagcgccuuuac

SEQ ID NO: 434375 - RNA, 64 nt, Human
gacuuugaaaaaauaucuuaacgacauggggcaaaaagugcaaucuaaaugguagccuuuacua

SEQ ID NO: 434376 - RNA, 64 nt, Human
caagguuaaaccucuuggcaguuacccuuuucacaaagugcacagugggaaucgagaaucgaua

SEQ ID NO: 434377 - RNA, 64 nt, Human
uuacuguuggcuacaucauuuuguguugaauaauaaagugcaauacuuuauucuccauaauuaa

SEQ ID NO: 434378 - RNA, 64 nt, Human
uaugcucacuggaaacaaacaaaaagcagcugaaaaagugcaucaacuccucuuuuucugagaa

SEQ ID NO: 434379 - RNA, 64 nt, Human
aaauaauauuuaaagagcacaagaaaaauuuuuuaaagugcacuaaaaugaccuuuuaagaaug

SEQ ID NO: 434380 - RNA, 64 nt, Human
auuagaugugguuuuuaauuuuguguugcuaaaaaaagugcaugauggugagagcccaaguuau

SEQ ID NO: 434381 - RNA, 64 nt, Human
uaugccaaccaaaacuucguuucugcaugucagaaaagugcaguagaagcaaagcuacuggaac

SEQ ID NO: 434382 - RNA, 64 nt, Human
uuaaaacagugugugccaccuaaggcuggaugggaaagugcagucuuguuguucauauaaaaac

SEQ ID NO: 434383 - RNA, 64 nt, Human
acugaagcuaugcugggcaauucuggcaaucauuaaagugcauagauuucuaucuuaaacuaau

SEQ ID NO: 434384 - RNA, 64 nt, Human
uauaaaaaaguaugaauaaagcaaacuauuuuauaaagugcacuguuuaaagcauuugcacugu

SEQ ID NO: 434385 - RNA, 64 nt, Human
gcccaccugccggccccggccgccccuccucgugaaagugcauuuuuguaaauguguacauauu

SEQ ID NO: 434386 - RNA, 64 nt, Human
ggaaaucgcaugacuauaacuuaagucuuucuucaaagugcaugcagucuuuugcgauaccuca

SEQ ID NO: 434387 - RNA, 64 nt, Human
cuggcaauggcuacuuaggauugaucuaagggccaaagugcagggugggugaacuuuauuguac

SEQ ID NO: 434388 - RNA, 64 nt, Human
agguuugaauuuauuaggacacgaacuaaaaauaaaagugcacuaggggacaguugauuucaau

SEQ ID NO: 434389 - RNA, 64 nt, Human
aaaagaggugagccuuugugaagaacauaauggaaaagugcauguacgggaaauaacagcacuu

SEQ ID NO: 434390 - RNA, 64 nt, Human
gugcucacucucagagccauggauuaccuggaacaaagugcagauuagugcccacgguccuuuc

SEQ ID NO: 434391 - RNA, 64 nt, Human
caagaaugcauaacacaaugacaacauggugagaaaagugcaguacuacuuccaagguagcuag

SEQ ID NO: 434392 - RNA, 64 nt, Human
uucacucagaccagggaucuuccuuaggagggucaaagugcagaucagaccaugcagguaaggu

SEQ ID NO: 434393 - RNA, 64 nt, Human
ccaaugagauugaaacuuuggaauugacaguucuaaagugcauuugggagagugaaugugugag

SEQ ID NO: 434394 - RNA, 64 nt, Human
ucuuuuuuugguaaauuuuugaaaaauauugcuaaaagugcauuuaaggagauugggagacaau

SEQ ID NO: 434395 - RNA, 64 nt, Human
uuguuguuuguuuauuauaaacaaaaagcaugugaaagugcacuuaagauagaguuuuuauuaa

SEQ ID NO: 434396 - RNA, 64 nt, Human
uguuguucucguuguuguuuuaaguuuacuggggaaagugcauuuggccaaaugaaaugguagu

SEQ ID NO: 434397 - RNA, 64 nt, Human; identical to SEQ ID NO: 434386

SEQ ID NO: 434398 - RNA, 64 nt, Human
auuguggggagagaaaucuuaagucauaaugaauaaagugcaaacagaagugcauccugauuau

SEQ ID NO: 434399 - RNA, 64 nt, Human
aagcuuaggggcaagguucauucuccugcuuuaaaaagugcaugaacuguagugcuuuaaacaa

SEQ ID NO: 434400 - RNA, 64 nt, Human
agaaauaugcagguauauaagaccacgauuuucuaaagugcauauuagaauuuuuguuuuugua

SEQ ID NO: 434401 - RNA, 64 nt, Human
guuuaaacacacagagacacacacacacguuuccaaagugcagcagugucucuuucagucuaca

SEQ ID NO: 434402 - RNA, 64 nt, Human
ugugcccacagcacaaagccaggcuucacucccaaaagugcagccaggcccuggagggugaucc

SEQ ID NO: 434403 - RNA, 64 nt, Human
ugggcgcuaauccuccugagugcuggaccucauuaaagugcauggaaaucacuggugugcaucg

SEQ ID NO: 434404 - RNA, 64 nt, Human
ccaggcaugguuggauaggggcagggcacucauuaaagugcaucacagccagagccuguugugu

SEQ ID NO: 434405 - RNA, 64 nt, Human
aagggcgacgggagagacacaggauaaaagguuaaaagugcagaggcagagucuggggcucagg

SEQ ID NO: 434406 - RNA, 64 nt, Human
cuggccucaaaugaucuucccacuucagccucccaaagugcagggauuacaggcacaagccacc

SEQ ID NO: 434407 - RNA, 64 nt, Human
agguagaugcagcucuuacagauauuuacuugguaaagugcaguggggaagagggaaugcuagg

SEQ ID NO: 434408 - RNA, 64 nt, Human
augcuaucuucaaaacguuagagaaaguucuucaaaagugcagcccagagcugcugggcccacu

SEQ ID NO: 434409 - RNA, 64 nt, Human
cugaggugugacauggcccccaagcagagcggguaaagugcaauggguaagggagggaagggga

SEQ ID NO: 434410 - RNA, 64 nt, Human
aaaccagcagggaguuagcacugaacugcuuuuaaaagugcacauuaaaaaggaaaguuugcca

SEQ ID NO: 434411 - RNA, 64 nt, Human
gcaaauccuccugaggaggccuugcugaaguuagaaagugcauccacuuuggggcgaaaacuag

SEQ ID NO: 434412 - RNA, 64 nt, Human; identical to SEQ ID NO: 434403

SEQ ID NO: 434413 - RNA, 64 nt, Human
cugaccucaggugaugcacccaccucagccucccaaagugcagggauuacaggcaugagccacc

SEQ ID NO: 434414 - RNA, 64 nt, Human
aggggcuaccaggaaagcgccuccaacccuagcaaaagugcaagauggggagugagaggcuggg

SEQ ID NO: 434415 - RNA, 60 nt, Human
caacagaaaaugaagccugaaccuccuuaaaaagugcauaugucgaaugaccaaauaacu

SEQ ID NO: 434416 - RNA, 64 nt, Human
auagucuccaugauuuucaaaauugauucccuuuaaagugcaaaauggucaccuucuaaaagau

SEQ ID NO: 434417 - RNA, 64 nt, Human
aggcagaaugccucauaaauuagccuucgaaagaaaagugcacgcucagacaguguguggaggg

SEQ ID NO: 434418 - RNA, 64 nt, Human
acuccucacccgcuagucuggcuguuaagaggagaaagugcacugccuuccagcccaggaggag

SEQ ID NO: 434419 - RNA, 64 nt, Human
gcuucaguagagccacaauauguaucuuugcuguaaagugcaaggaaauuuuaaauucugggac

SEQ ID NO: 434420 - RNA, 64 nt, Human
cacccugauauugcuucuccucugaaugcucugaaaagugcaggugcccaaggcaugacuugca

SEQ ID NO: 434421 - RNA, 64 nt, Human
gauguuagcuagucuuucaaaagccauugcuacaaaagugcaaauuucucauuuccuguggguc

SEQ ID NO: 434422 - RNA, 64 nt, Human
cuuagccucagcaggagccuggccuguaacuuauaaagugcaccucgcccccgcaagccccagc

SEQ ID NO: 434423 - RNA, 64 nt, Human
agaagcagcaucuucccauuuccucaguacccacaaagugcagcccacauuggaccccagacac

SEQ ID NO: 434424 - RNA, 64 nt, Human
ugcccugcugggagagauggagaagcuagaaggcaaagugcacaugaaggugagagaggcaggg

SEQ ID NO: 434425 - RNA, 64 nt, Human
uacaauaauaauuaagggcagaaauuauacuuaaaaagugcagauccuuguucuuugacaauuu

SEQ ID NO: 434426 - RNA, 64 nt, Human
gugaaggaaaccgugguuacugaggcccuguugaaaagugcacgucuuguccaauaaaucacgc

SEQ ID NO: 434427 - RNA, 64 nt, Human
gguaugggccacaggacacacuugcucgagaaccaaagugcauuugggugacauuugaagauug

SEQ ID NO: 434428 - RNA, 64 nt, Human
aaaugcaguagagggcuuuuguuggcagaacaauaaagugcauuugcucaggccccugaugccu

SEQ ID NO: 434429 - RNA, 64 nt, Human
uuaucuuugaccaaccgaacaugaccaaaaaccaaaagugcauucaaccuuaccaaaaaaaaaa

SEQ ID NO: 434430 - RNA, 64 nt, Human
uauuuuucuuccauguauacaauaauuuuuuuaaaaagugcaauuugcguugcagcaaucagug

SEQ ID NO: 434431 - RNA, 64 nt, Human
uuuguucuguguaaaaaaauauggagagugaaacaaagugcagacauucaaagaaauaagaaau

SEQ ID NO: 434432 - RNA, 64 nt, Human
uacuaaauugcuuccagguaauuuuugauuuccuaaagugcacugagguuaucuggaagauugg

SEQ ID NO: 434433 - RNA, 64 nt, Human
uuaacgguggugaaaaggggacaguuuuuacccuaaagugcaaaagugaaacauacaaaauaag

SEQ ID NO: 434434 - RNA, 64 nt, Human
uggguauacuggaauccgaugccguuucuacaguaaagugcaaucuucguuguuuuuguauuua

SEQ ID NO: 434435 - RNA, 64 nt, Human
aucaaaaaacagaaaaacaaaaaaaagaaagaaaaaagugcaacuugagggacgacuuucuuua

SEQ ID NO: 434436 - RNA, 64 nt, Human
gcucagacaauauuuaaggacauuucagcgagacaaagugcauguuuuuaucgaguacccugug

SEQ ID NO: 434437 - RNA, 64 nt, Human
gaaaaccucauguucucucuuuccccaaacuaagaaagugcacugcaugcuguuuucacuuauu

SEQ ID NO: 434438 - RNA, 64 nt, Human
ggggggccgggugggccgggcgugacgcgcggucaaagugcaaugauuuuucaguucgguuggc

SEQ ID NO: 434439 - RNA, 64 nt, Human
uccuguauuuuguaacacuuuagaagaauacagaaaagugcaguaauucucuuucuccauagua

SEQ ID NO: 434440 - RNA, 64 nt, Human
auaaucaaugaaguagcugagaaaacuaagucagaaagugcauuaaacugaaucacaauguaaa

SEQ ID NO: 434441 - RNA, 64 nt, Human
agauuccuccucucugggcagcgcaucuuugaaaaaagugcagauaaaacccucaucucccugg

SEQ ID NO: 434442 - RNA, 64 nt, Human
acugaagcucuguuuacacauaagaguguuccccaaagugcacuuucucuggggccuuuuaggc

SEQ ID NO: 434443 - RNA, 64 nt, Human
cuggggcacccuccgacggcagagccuccuucagaaagugcagcucaagucuuaaagacaccaa

SEQ ID NO: 434444 - RNA, 64 nt, Human
cauuuggcgugcauccuuacaauaccaugugaagaaagugcacgcugaauagaaacuauaaaug

SEQ ID NO: 434445 - RNA, 64 nt, Human
accuccuucauuauaaaauuuugucguaaacauuaaagugcaggucagugaacaauauucaaug

SEQ ID NO: 434446 - RNA, 64 nt, Human
auccuccacgcacccccaccuaucguugguucgcaaagugcaaagcuuucuugugcaugacgcc

SEQ ID NO: 434447 - RNA, 64 nt, Human
ugauccuuaaaaugaccuucgagcauauucuaauaaagugcauugccaguuuucugucucauuu

SEQ ID NO: 434448 - RNA, 64 nt, Human
auugagacacugucaagauuaaguuauaccagcaaaagugcaguagugucacuuuuuuccuguc

SEQ ID NO: 434449 - RNA, 64 nt, Human
uugaaaacucacuuccugaagcagcuugagcuccaaagugcacaucugguuccaacuugccuga

SEQ ID NO: 434450 - RNA, 64 nt, Human
gguuucuuuucauaagcaaaaaguaccucuucuuaaagugcacuuugcagacguuucacuccuu

SEQ ID NO: 434451 - RNA, 64 nt, Human
uccuauuaagccucuugguaagaggcauuuguuaaaagugcaagcuuacuccugcuucugggga

SEQ ID NO: 434452 - RNA, 64 nt, Human
augaucuaaacacgaggaaacauuauucauuggaaaagugcaugguguguauuuuagggauuau

SEQ ID NO: 434453 - RNA, 64 nt, Human
uucuuuucaaucccacugcagugagaaggcaaccaaagugcaggacaucaaaaacaaccugaaa

SEQ ID NO: 434454 - RNA, 64 nt, Human
guugccaugauuuuuuuuuuuucaacaaaaaaccaaagugcauuguacgcccuuuggccagucu

SEQ ID NO: 434455 - RNA, 64 nt, Human
guuccagcucuuugaaauagucugugugaaggugaaagugcaguucaguaauaaacuguguuua

SEQ ID NO: 434456 - RNA, 64 nt, Human
uggcccuuuuccuagucccugcaaccuguuucauaaagugcaauggggaaagcaggacuguuga

SEQ ID NO: 434457 - RNA, 64 nt, Human
ggcugaggguucugcuguccugugccaccccauuaaagugcaguucccuccgggccauucugaa

SEQ ID NO: 434458 - RNA, 64 nt, Human
acagaccacacacagcacuaacacaugcacacacaaagugcauaggccacacagcacaugcaca

SEQ ID NO: 434459 - RNA, 64 nt, Human
ugaaaaucagugaguccucccuggcauccucgugaaagugcacacacuucauggagggacuccu

SEQ ID NO: 434460 - RNA, 64 nt, Human
guuuuuauagaagugguguuuuuuuuccaaaaacaaagugcaaagcugcuugaaucaggaggag

SEQ ID NO: 434461 - RNA, 64 nt, Human
aucugauuuacacuguuuuguuuuuuaagaaacaaaagugcauaguuuagauuuuuuuuuuguu

SEQ ID NO: 434462 - RNA, 64 nt, Human
gugcugaggagcugacuugcccuuguuuacuuacaaagugcauuguagguaaacaugagccuug

SEQ ID NO: 434463 - RNA, 64 nt, Human
ccuuuuauuuaaguugugauuaccugcugcaugaaaagugcaugggggacccugugcaucugug

SEQ ID NO: 434464 - RNA, 64 nt, Human
uauucagauugacaagguagacauggauuugaugaaagugcaaagugcccucauuuguggccca

SEQ ID NO: 434465 - RNA, 64 nt, Human
ucacaggcuauugcauuuuuacugauuuucuacaaaagugcaugggggggauuaauuaaaccuu

SEQ ID NO: 434466 - RNA, 64 nt, Human
guuauuuuuuucuuucuuuuuuaaaaaaauauguaaagugcagucuucuguauuccugcauauu

SEQ ID NO: 434467 - RNA, 64 nt, Human
cucaaccuaucccguuccuucugccuacaaauaaaaagugcaggcuggaaugaucucagucaca

SEQ ID NO: 434468 - RNA, 64 nt, Human
ccaggccugcucggugacugaccccaucauacccaaagugcaaucucacggccagguucuaugc

SEQ ID NO: 434469 - RNA, 64 nt, Human
cagcccauccugaggaaagccuccuauggaauguaaagugcaaucauuucuucagauauaagac

SEQ ID NO: 434470 - RNA, 64 nt, Human
uuacacucacauucccuuuuugccccuuaaauagaaagugcagguaaagguuuauacaacaaga

SEQ ID NO: 434471 - RNA, 64 nt, Human
uguaaaacauuuagaauagcucguguuauggaaaaaagugcacugaauuuauuagacaaacuua

SEQ ID NO: 434472 - RNA, 64 nt, Human
uuacaguggcauaggaagacggcaaaaauuuccuaaagugcaauagauuuucaaguguauugug

SEQ ID NO: 434473 - RNA, 64 nt, Human
auuuugccuguaugguacuguuuuguuuguuaauaaagugcacugccacccccaaugcagacuc

SEQ ID NO: 434474 - RNA, 64 nt, Human
uucccuggcauucgaggagcccuuugaacuuuccaaagugcagccacagcuacaaugcuguuaa

SEQ ID NO: 434475 - RNA, 64 nt, Human
gcgugugugguccccagccccagacuggauuggaaaagugcauggugggggccucggggcuguc

SEQ ID NO: 434476 - RNA, 64 nt, Human
agauguaauuuuaagaguugcuccuagcaaguuaaaagugcauauaaaauaugcaacucuuagu

SEQ ID NO: 434477 - RNA, 64 nt, Human
ugaauuucaacgccugccuuuggcacucugacuuaaagugcaaaaagcuucuguggcgaggcau

SEQ ID NO: 434478 - RNA, 64 nt, Human
uucuuaaaaaaauaauaaaacuacagacaaaaacaaagugcaaacaacugagacagcaaaugaa

SEQ ID NO: 434479 - RNA, 64 nt, Human
uuacaguggcacuucauaggcacacucuaaggagaaagugcagaguagaauuccuucagggcau

SEQ ID NO: 434480 - RNA, 64 nt, Human
acgcgccugauggauagugaaccuauucaucaaaaaagugcacugcucuucugucuauuguacc

SEQ ID NO: 434481 - RNA, 64 nt, Human
ugauucuuuccaagaugaacuugaagauuacauaaaagugcagaaagccagaggacuagagcca

SEQ ID NO: 434482 - RNA, 64 nt, Human
ccucaguuauaaagugaaucucagauagaaauuaaaagugcaguuguguuaagacucuuucaua

SEQ ID NO: 434483 - RNA, 64 nt, Human
guagugcuuucggcccaguucuggccucagccucaaagugcaccgacuaguugcuugccuauac

SEQ ID NO: 434484 - RNA, 64 nt, Human
uuucaauggcauaagaaguugacaaaaauuucuuaaagugcaauagauuuucaaguguauugug

SEQ ID NO: 434485 - RNA, 64 nt, Human
gaagagccagcuggcgugucgggaaggauccaggaucugcaaacacaacugcucaggccuucuc

SEQ ID NO: 434486 - RNA, 64 nt, Human
uggguuuucucuuuggugguuucuaaagugccuuaucugcaaacaacuucuuuucuccuucagg

SEQ ID NO: 434487 - RNA, 64 nt, Human
ugcccuugccacccgugguuggaucuuguuuuauaucugcaaauaaauagcuuguuuggaagca

SEQ ID NO: 434488 - RNA, 64 nt, Human
acuggccuguccugcucagcuugggccagugacaaucugcaaggcugaacaacagccccugggg

SEQ ID NO: 434489 - RNA, 64 nt, Human
ucucucgauagaaacuacgcccgccgacagaaacaucugcaaagauacagucugacucaguggg

SEQ ID NO: 434490 - RNA, 64 nt, Human
ccccugugugacaucacagggccucaguuucccuaucugcaaaaugggaugauauggagguuca

SEQ ID NO: 434491 - RNA, 64 nt, Human
cacauggagaacuaaaucuuuuguaguagcugagaucugcaauauauaacgggacagucaaagg

SEQ ID NO: 434492 - RNA, 64 nt, Human
cuguuucaugauguauuuucaaauagaguucaggaucugcaauucaguucaacacaaguuuguu

SEQ ID NO: 434493 - RNA, 64 nt, Human
acaggaaaugcuaagguaccuucucuguggaacaaucugcaaugucuaaaucgccuuaaaagag

SEQ ID NO: 434494 - RNA, 64 nt, Human
cauuucaguuaagcugcucagcagauauggauggaucugcaaucacauaccuaauguggagcug

SEQ ID NO: 434495 - RNA, 64 nt, Human
ccgucuauauaagggaaugucuuccuuccuaucuaucugcaaaauggaaaucuagaccuccuuc

SEQ ID NO: 434496 - RNA, 57 nt, Human
gaaacucugaccagagcuagagacaccaucugcaaugaucucuacaucuaugauacu

SEQ ID NO: 434497 - RNA, 64 nt, Human
acuucagguaucucugacauaccugacaauguuaaucugcaacugggauuacacuggaacuaca

SEQ ID NO: 434498 - RNA, 64 nt, Human
ugccuguggauucuccuuguaguccagaucuacuaucugcaacucuuuaacggcacuugagaua

SEQ ID NO: 434499 - RNA, 64 nt, Human
cucaugugaaacaaacagcugacguccucucucgaucugcaagccuuucaccaaccaaauaguu

SEQ ID NO: 434500 - RNA, 64 nt, Human
ugagcucagagaagcuccgugggccuguuucccaaucugcaaagugugaagggauuagauggga

SEQ ID NO: 434501 - RNA, 64 nt, Human
ugcagagggcugggcacggugguuuauggcuguaaucugcaaacucugggaggcugagguggga

SEQ ID NO: 434502 - RNA, 64 nt, Human
gcuauguucucauccuacaguugguuugguaaugaucugcaagucccggagagcaacagcacag

SEQ ID NO: 434503 - RNA, 64 nt, Human
gcuaccacccaagcccccuccuucuuuguguggaaucugcaauagugggcugacucccuccagc

SEQ ID NO: 434504 - RNA, 64 nt, Human
auggaucucuaaacugaaugcacuuguuuuauucaucugcaaagagccauguauucaacaucga

SEQ ID NO: 434505 - RNA, 64 nt, Human
auuaaacuauaauucuguucuuaaaagaaaauuuaucugcaaaugugcaaguucugagauauua

SEQ ID NO: 434506 - RNA, 64 nt, Human
cuggccauuuugccuuucugacauuuccuugggaaucugcaagaaccuccccuuuccccuccca

SEQ ID NO: 434507 - RNA, 64 nt, Human
ccagcacuguguauuaucacucaggaaccagcggaucugcaaagaccuacaaucaaaagcaaau

SEQ ID NO: 434508 - RNA, 64 nt, Human
augcaagagaagcaauucgucaguuucacuggguaucugcaaggcuuauugauuauucuaaucu

SEQ ID NO: 434509 - RNA, 64 nt, Human
cugcugcuuuuggugcucucaccuuaucuggaagaucugcaaacauuaccuaaauaggcuggca

SEQ ID NO: 434510 - RNA, 64 nt, Human
guucacauguuugcagugaaaagcagugucuuugaucugcaacagcaaauccucagagaaaaag

SEQ ID NO: 434511 - RNA, 64 nt, Human
aucuuacuacuacaaagaaaaaaaaacccaaccaaucugcaauucaaaucagaaaguuuggaca

SEQ ID NO: 434512 - RNA, 64 nt, Human
aagcaaagacaauguucuuuaccacacguuucacaucugcaacauccuucaauugcgggaaaag

SEQ ID NO: 434513 - RNA, 64 nt, Human
gaagaggaaaggccagacuuugcuuaccaucagcaucugcaaugggccaaacacaccucaaauu

SEQ ID NO: 434514 - RNA, 64 nt, Human
cuuauagaauaaaagcuauaaaguauauauuaggaucugcaaacaaugaagaauuauguaauau

SEQ ID NO: 434515 - RNA, 64 nt, Human
uuuuuguuuucuucaaaaaagcuguaagagaauuaucugcaacuugauucuuggcaggaaauaa

SEQ ID NO: 434516 - RNA, 64 nt, Human
aaccucagcuguuaaccaaggggaaauacaucagaucugcaacacagaaaugcucugccugaaa

SEQ ID NO: 434517 - RNA, 64 nt, Human
caauagaaaauugcuguagguaaaucucacauuuaucugcaacaaaauauagauuuaauuuuua

SEQ ID NO: 434518 - RNA, 64 nt, Human
cgugcacacaggacucucauuacuuuuuuauggaaucugcaagguguuuuuaggcuuuuuaauc

SEQ ID NO: 434519 - RNA, 64 nt, Human
caaauuguuuuuauguuaaaagucacguuucauaaucugcaauauuuuugucaaagugcacacu

SEQ ID NO: 434520 - RNA, 64 nt, Human
agugucacaaaagugcaaagugauauuagcugucaucugcaauacagaaucucauugcuuuugc

SEQ ID NO: 434521 - RNA, 64 nt, Human
uuaauguggauuucauugaguugauuuuuugauaaucugcaaucuggauaauuuguacugcuaa

SEQ ID NO: 434522 - RNA, 64 nt, Human
aagaaaaauguuuuaaagaugccagggguacugaaucugcaaagcaaaugagcagccaaggacc

SEQ ID NO: 434523 - RNA, 64 nt, Human
ucuauacuuuaagauacucuauuuuuaaaacacuaucugcaaacucaggacacuuuaacagggc

SEQ ID NO: 434524 - RNA, 64 nt, Human
aauccuucagcagaauauuaagaaauaaagcaugaucugcaauggaaagguuuuuuuggcacua

SEQ ID NO: 434525 - RNA, 64 nt, Human
auauucucuuccuauugacuugcugccucaacagaucugcaaaggacaaccagccagguaugau

SEQ ID NO: 434526 - RNA, 64 nt, Human
auacgcauuucaugaagaaccauuggaaagaggaaucugcaaucugggagcuuaagagcaaaug

SEQ ID NO: 434527 - RNA, 64 nt, Human
aacaaaauagaguggacucuuuuagagcaucuauaucugcaaccuguaaaugguaaaaugucug

SEQ ID NO: 434528 - RNA, 64 nt, Human
auacacacauacagcuacggauauaaugaaaauuaucugcaaacaccuaaauuaaagagaaaaa

SEQ ID NO: 434529 - RNA, 64 nt, Human
uucacacuucgcuccuuuaaagaagcgaccccagaucugcaagggaguagauucugcuaucuug

SEQ ID NO: 434530 - RNA, 64 nt, Human
cucuaagaaaaucaaccauuaaucucucauuuucaucugcaaauugaagcaacaguuuaguuuc

SEQ ID NO: 434531 - RNA, 64 nt, Human
ugucuccacucauuuuugacccaguuuggaauguaucugcaauuguguggcucaacacuuuagg

SEQ ID NO: 434532 - RNA, 64 nt, Human
cccucuccuggugcuccaagcaguuugaagcccaaucugcaaggacauuucucaagggccaugu

SEQ ID NO: 434533 - RNA, 64 nt, Human
gccugggugguuugagaagagacaacccaguuugaucugcaauacaaggauccauucguaaucu

SEQ ID NO: 434534 - RNA, 64 nt, Human
ccucaugccccacaggagccccaguggugacuggaucugcaaggguuaucucccgcccucuggg

SEQ ID NO: 434535 - RNA, 64 nt, Human
acagagucccuaaagcuagucuaguuuuugccacaucugcaaugauuauuguuuaauuucaaaa

SEQ ID NO: 434536 - RNA, 64 nt, Human
guguuucuggagaauguucuuucacaucacuggaaucugcaauucaagaagugacaagggagaa

SEQ ID NO: 434537 - RNA, 64 nt, Human
cuauggaaacuuagcuucaaagaaaaugcaauguaucugcaauuagguguucauuuuuuacuac

SEQ ID NO: 434538 - RNA, 64 nt, Human
uuuguuuaaaauaagugaauaagcgauauuuauuaucugcaagguuuuuuuguguguguuuuug

SEQ ID NO: 434539 - RNA, 64 nt, Human
aacacuaacggccauccggcccaaggaugccaggaucugcaaagcacugcucgaagacuuuucu

SEQ ID NO: 434540 - RNA, 64 nt, Human
cucggucauaucauugagaucaccguaccagcaaaucugcaaaccaagcacuuuguuaaucucc

SEQ ID NO: 434541 - RNA, 64 nt, Human
aaaaaauaauugagacugaaagaaacuaagauuuaucugcaaggauuuuuuaaaaauuggcauu

SEQ ID NO: 434542 - RNA, 64 nt, Human
uucucaccugugaguucuugcagguggcgacuucaucugcaaggucacuuacauagccccacuc

SEQ ID NO: 434543 - RNA, 64 nt, Human
augacgagaccucagauguguugacguaagcucuaucugcaauguuuuuguguagaguggcgau

SEQ ID NO: 434544 - RNA, 64 nt, Human
uauauaauuuuauagcucaguuuacccaguauucaucugcaaagccagauugcucucauugcuu

SEQ ID NO: 434545 - RNA, 64 nt, Human
uuaaaucaauuuaucacuguuuaaagcuuugaauaucugcaaucuuugccaagguacuuuuuua

SEQ ID NO: 434546 - RNA, 64 nt, Human
uugauucauuccugagaauggcuuaguccugagaaucugcaaagucucugaagagaacucucuc

SEQ ID NO: 434547 - RNA, 64 nt, Human
agcauagucuuauuaaccaugucuguuggucaaaaucugcaaacucuaaaagaagaaaagaaga

SEQ ID NO: 434548 - RNA, 64 nt, Human
aauaccagauucucggugcauuguucaugucuguaucugcaagccuguucugccauugcagugu

SEQ ID NO: 434549 - RNA, 64 nt, Human
aaaacaaaacaaaacaaaaaagaggcacuagucuaucugcaauuacucaacgaggcauuuucau

SEQ ID NO: 434550 - RNA, 64 nt, Human
cagcucauaaaugaaauugaaaaugguauuaaagaucugcaacuacuauccaacuuauauuucu

SEQ ID NO: 434551 - RNA, 64 nt, Human
gaaggaauaucauuuacagacauuaaacauccauaucugcaauguguaccaaaguuauaucaug

SEQ ID NO: 434552 - RNA, 64 nt, Human
auaccuucuuuccuuguuagguaguuaugaguaaaucugcaaaaggcaaugaaaaugccuuaaa

SEQ ID NO: 434553 - RNA, 64 nt, Human
uuaaaaucuacuacaagcauuaccuaacauggugaucugcaaguaguaggcacccaauaaauau

SEQ ID NO: 434554 - RNA, 64 nt, Human
aguucaagucaaauucugagccugggggguccucaucugcaaagcauggagaguggcaucuucu

SEQ ID NO: 434555 - RNA, 64 nt, Human
ccugaaagaugcccuauccaugagaugccuuuucaucugcaaacucugcaaaaugugucucaug

SEQ ID NO: 434556 - RNA, 64 nt, Human
uaauguaugaugagguuaacacugaaauauuaaaaucugcaaaugcacauuaaugcaaauuaaa

SEQ ID NO: 434557 - RNA, 64 nt, Human
uacuaauggguacucugaacucauuaacauugacaucugcaacaggaggcaacagggaaaaaau

SEQ ID NO: 434558 - RNA, 64 nt, Human
aaaucaauguagagauaauguaaacugaaaaaaaaucugcaagauaauguaacugaauguuuua

SEQ ID NO: 434559 - RNA, 64 nt, Human
uguuaacaggguuauuacaaagcacauuuucugaaucugcaaucauuccuuugacaauuacugg

SEQ ID NO: 434560 - RNA, 64 nt, Human
aaacaaguacugguugacuuucuaauuagagagcaucugcaacaaaaagucauuuuucuggagu

SEQ ID NO: 434561 - RNA, 64 nt, Human
gguauuucucuugauugagcagcuagacaaaauaaucugcaaauuuaaauguggcgcauuugac

SEQ ID NO: 434562 - RNA, 64 nt, Human
auguggauaacuuuacagaaauggacuggagcucaucugcaaaaggccucuuguaaagacuggu

SEQ ID NO: 434563 - RNA, 64 nt, Human
cuucugccauuuuccuccuucacucguccugaaaaucugcaaguuacauaauaaaacuuuagau

SEQ ID NO: 434564 - RNA, 64 nt, Human
gaaagaaaaaaaaaguuugcacuaauugagguacaucugcaagugagacuuuuugucaggaaaa

SEQ ID NO: 434565 - RNA, 64 nt, Human
aacugaaaucaucuaaagaguuaaaauuucagugaucugcaauuaauuacauuguggaagauua

SEQ ID NO: 434566 - RNA, 64 nt, Human
uaccauuuauguggcagaaguucuguucccuauaaucugcaaugcugaaguaucucuauucaau

SEQ ID NO: 434567 - RNA, 64 nt, Human
gaggucugguggggcugggggagcacccaggcggaucugcaagcaccucggagcacccaccgcu

SEQ ID NO: 434568 - RNA, 64 nt, Human
gaccugcgagggagaagacacugagaagccagugaucugcaagcauuugcucuuguuuccacau

SEQ ID NO: 434569 - RNA, 64 nt, Human
aguuuuagccaaagguguacuuacuuccuuauuuaucugcaaaaggauggaaacugugggaguc

SEQ ID NO: 434570 - RNA, 64 nt, Human
uuucaaccccuaaugcauuuaagaagcugauaaaaucugcaacacuccugcuguuggcuggagc

SEQ ID NO: 434571 - RNA, 64 nt, Human
caaaaccugggauaucaauuaauuugaaaacauaaucugcaaagaaugagaaggagucagaaac

SEQ ID NO: 434572 - RNA, 64 nt, Human
ugacaguugaaaugagaucaguguaucaaaguaaaucugcaaauuccuucuaaauuucaugugc

SEQ ID NO: 434573 - RNA, 64 nt, Human
ucuuuaaaauauaucucuagaacuuaaagcugaaaucugcaaaucuguuugugugaugaaacua

SEQ ID NO: 434574 - RNA, 64 nt, Human
auuuucaacguaauugucuauuuuuuucccucccaucugcaacagaauacauuuuuuucagccu

SEQ ID NO: 434575 - RNA, 64 nt, Human
gggagaauguuuguaacuuaaucagaaaaaaaauaucugcaaaauguacuccaucauuuugaug

SEQ ID NO: 434576 - RNA, 64 nt, Human
aauagugaaaaggcucagaccgaccgauggcaagaucugcaagcgucucaaagcccaggcagaa

SEQ ID NO: 434577 - RNA, 64 nt, Human
caccgaccuugcaaauacugaaauuggaagagggaucugcaagugcaggguguugguuaaaguu

SEQ ID NO: 434578 - RNA, 64 nt, Human
cagcagaaaaugacuguagguaaaucucacauuuaucugcaacaaaauauagauuuaauuuuua

SEQ ID NO: 434579 - RNA, 64 nt, Human
uccuuuuuaucuuuucaguacauagugcugaaaaaucugcaacuucuuggaucauauuuaauga

SEQ ID NO: 434580 - RNA, 64 nt, Human
uucaacauagauuuuuuuguguguguggaaauaaaucugcaauuggaaacaaaaauguacuggu

SEQ ID NO: 434581 - RNA, 64 nt, Human
gauagaagcuacuuuuuaaagaauaucccacugcaucugcaaauuuaguuuuggguuuuuuuau

SEQ ID NO: 434582 - RNA, 64 nt, Human
aagauacaguguucaguauuauugaaauaugggcaucugcaacacauacccccuauuauuucua

SEQ ID NO: 434583 - RNA, 64 nt, Human
aaugucucaugauaucacguuuaccauuuacaccaucugcaaccauaugcuauuaauaaaaugg

SEQ ID NO: 434584 - RNA, 64 nt, Human
uuuuaacuuuuauauuuuaugcacuagacaauggaucugcaacuuuggacuaaggucauucaau

SEQ ID NO: 434585 - RNA, 64 nt, Human
cucagccuccugaguagcugggacuacagcaaaaaucugcaauuggcauuucccaugugaugcu

SEQ ID NO: 434586 - RNA, 64 nt, Human
cccuaguucaguaucuuuuauguaaauuacaaacaucugcaacauuauguaucauaugcagaua

SEQ ID NO: 434587 - RNA, 64 nt, Human
aaaccuuucaaguaggggaugguacauuuauuucaucugcaaaugauaauaaauccuuuguuau

SEQ ID NO: 434588 - RNA, 64 nt, Human
agcauuucaauauuauugaaugguuuucauuuuaaucugcaaugucucauaaagacucggguag

SEQ ID NO: 434589 - RNA, 64 nt, Human
uugacauucaaauggaaggaaccaccugaauuauaucugcaaacaaaauggaaauaguuguuga

SEQ ID NO: 434590 - RNA, 64 nt, Human
gguuuauaccccuuuggcacacccucucuguccaaucugcaagucccagggagcucugcauacc

SEQ ID NO: 434591 - RNA, 64 nt, Human
aauuuuaacacauauuccugaugaaaucauuauuaucugcaaugcuuucauucugcuuuuucuc

SEQ ID NO: 434592 - RNA, 64 nt, Human
ggugacuaagcucgcagcaagcggcuaccccccgaucugcaaaagggccucucccuuuguguuc

SEQ ID NO: 434593 - RNA, 64 nt, Human
auguuaaaaucaugcacuugaaaagcaaaccuuaaucugcaaagacagcagcaagcauuauacg

SEQ ID NO: 434594 - RNA, 64 nt, Human
ggaggauuguucacucacuguuaccuguguuaguaucugcaaaugcaugaaugguugaacuccc

SEQ ID NO: 434595 - RNA, 64 nt, Human
aaaugucauaggaauaaaaaaauuaucuuuucauaucugcaagauuuuuuucaucaauaaaaau

SEQ ID NO: 434596 - RNA, 64 nt, Human
ugggccuaauccugccucaucauucuuggcaggaaucugcaaauggaaacauugugaguaucag

SEQ ID NO: 434597 - RNA, 64 nt, Human
gacucguccgcugucuuuggaccgcuguguuucaaucugcaaaauggggauggggaagguucaa

SEQ ID NO: 434598 - RNA, 64 nt, Human
uuccuguagaacugagaaauaagauugacuuugaaucugcaacaagaucugaaauaaaugagaa

SEQ ID NO: 434599 - RNA, 64 nt, Human
ccauccaccuucccuucuacaaggacuccauuggaucugcaagaacacuggaccuuuggguucu

SEQ ID NO: 434600 - RNA, 64 nt, Human
agaagcccauguuuugagauuuugcucaugaaccaucugcaacuugcuucaucauaagaauaau

SEQ ID NO: 434601 - RNA, 64 nt, Human
ucucuguacacugccccaggacugucauuuuggcaucugcaaaggaaucacuuuagaaagccag

SEQ ID NO: 434602 - RNA, 64 nt, Human
ggaaagaagaugaccugucaggaguucauugcaaaucugcaagggguaaaugaggguguugauu

SEQ ID NO: 434603 - RNA, 64 nt, Human
cagccuuccuagggaacagaaauugggugagccaaucugcaauuucuacuacaggcauugagac

SEQ ID NO: 434604 - RNA, 64 nt, Human
uauugagaucagcauucaaaauaguucuauuucuaucugcaaauaguuucaaaugaguuuaaaa

SEQ ID NO: 434605 - RNA, 64 nt, Human
uuuugucucucuuuagguacuccaauucagaaugaucugcaagaauuuuuugcauuaauugauu

SEQ ID NO: 434606 - RNA, 64 nt, Human
uaauuauaaauaucauuguacauagcauguuuauaucugcaaaaaaccuaauagcuaauuaauc

SEQ ID NO: 434607 - RNA, 64 nt, Human
cauuucagaaauuauuuugauaaguguugcuggaaucugcaacgcugauuuuuuuuugcauucu

SEQ ID NO: 434608 - RNA, 64 nt, Human
agucugaucuugaucuuaaacucaguaagccacuaucugcaauuuuguacauuauauaguauuu

SEQ ID NO: 434609 - RNA, 64 nt, Human
agcuccuugacccccaucuaggugccaaauguucaucugcaaccgcuaugcagucuggugagag

SEQ ID NO: 434610 - RNA, 64 nt, Human
ggugcacugaagagccacccuguggaaacacuacaucugcaauaucuuaauccuacucagugaa

SEQ ID NO: 434611 - RNA, 64 nt, Human
cacaagcuaagaaacugaguuuaacagcccaguuaucugcaacaugucaauuaccuuugcuccu

SEQ ID NO: 434612 - RNA, 64 nt, Human
aaagaccaggagaggacacagugagaaggcaguuaucugcaagcaaagagagaggcuucagaag

SEQ ID NO: 434613 - RNA, 64 nt, Human
acagacuugucaagguuugcuacguccucugggcaucugcaaaaggcccugcucucuggagugu

SEQ ID NO: 434614 - RNA, 64 nt, Human
uauucuuucuuuuaauaagagcauuguccuauaaaucugcaauauuuucacgcccaugaaacug

SEQ ID NO: 434615 - RNA, 64 nt, Human
aacaguguagccuggccuguacagguacuggaugaucugcaagacaggcucagccauacucuua

SEQ ID NO: 434616 - RNA, 64 nt, Human
auucgugacauccacccccugggcaagugagagcaucugcaaaaugcaaagagaacuaccucau

SEQ ID NO: 434617 - RNA, 64 nt, Human
agaagaggaacggaaaugggacgucuuccuuaacaucugcaaacaaggaggcgcugggauauca

SEQ ID NO: 434618 - RNA, 64 nt, Human
ggaucccuucuucuuccuagcuuucaguuuccuuaucugcaaaguggaaggucagaccagauga

SEQ ID NO: 434619 - RNA, 64 nt, Human
uuguguaaauugaucucuauaccucagcuucuucaucugcaaagugagauaauuguacuauucu

SEQ ID NO: 434620 - RNA, 64 nt, Human
cccacccagagguggcccucccaggcugguauuuaucugcaagguuguagucaagagguuuuuc

SEQ ID NO: 434621 - RNA, 64 nt, Human
aauauauucccagauuauccuuguaaugacacgaaucugcaauaaaagccaucagugcuauuug

SEQ ID NO: 434622 - RNA, 64 nt, Human
gccccagcccaaccucugggaacaggcagcuccuaucugcaaacuguguucacccuuuuguaaa

SEQ ID NO: 434623 - RNA, 64 nt, Human
uuacggaaaacaccaguucacuaaaagcaccgaaaucugcaaagccugucuuccgcuagaacaa

SEQ ID NO: 434624 - RNA, 64 nt, Human
ccucuaagauguugggauugauauacgugauuuaaucugcaauagguggaauaaccaggggaac

SEQ ID NO: 434625 - RNA, 64 nt, Human
ucacccuguugcuuccuucacagcaugucucaccaucugcaaccaucuuucuguuugucgucuu

SEQ ID NO: 434626 - RNA, 64 nt, Human
ugaguaacugaagaacauuuuuaauucuuuaggaaucugcaaugagugauuacaugcuuguaau

SEQ ID NO: 434627 - RNA, 64 nt, Human
caaauuguucucuuuuuuuuuuuaacuaaaacaaaucugcaaugaaucuagaugcaauuaauuu

SEQ ID NO: 434628 - RNA, 64 nt, Human
gacauggauaucacaggaugaagguagaacuauaaucugcaauucucuaugacacagcuuuaac

SEQ ID NO: 434629 - RNA, 64 nt, Human
ccauagaccugacgucccagaauccaugcuucucaucugcaaaaugaaaaugucaauacuuacu

SEQ ID NO: 434630 - RNA, 64 nt, Human
caacagcaaugugacggauuuuugcagauucaaaaucugcaaugguuauuuacaagucaaucua

SEQ ID NO: 434631 - RNA, 64 nt, Human
auucggcauuugcuaaaugacaguuacuacaucaaucugcaacuaucaaaaaugaggggaaaag

SEQ ID NO: 434632 - RNA, 64 nt, Human
acuucaugcaauuugaaauuccauauaaguuuuuaucugcaaguuacagcuugugugguuuguc

SEQ ID NO: 434633 - RNA, 64 nt, Human
uuaaggagaguuguucaggucacugcacaaauauaucugcaauuauucauacucuguaacacuu

SEQ ID NO: 434634 - RNA, 64 nt, Human
ccagucacuuaacuuguuagccauccauuaucgcaucugcaaaauggggauuaagaauagaauc

SEQ ID NO: 434635 - RNA, 64 nt, Human
auggccucaaaacaauguauguuuggaguuccaaaucugcaaguggccaaccuagagauucacu

SEQ ID NO: 434636 - RNA, 64 nt, Human
gaaaugcauugccagaaagcaccaguagccuccuaucugcaagcagaguagugcucugcucugg

SEQ ID NO: 434637 - RNA, 64 nt, Human
acugcugggugugggaggugcuugaugaaaugagaucugcaaauuguuaauagugauuccugag

SEQ ID NO: 434638 - RNA, 64 nt, Human
ucccacugcuagagcuuccuguuaagcaagugugaucugcaacauuuuuucaacuuuugcuagc

SEQ ID NO: 434639 - RNA, 64 nt, Human
uacuagucaugauguguguuguauuuuaaaaauuaucugcaaccuuaauucagcugaaguacuu

SEQ ID NO: 434640 - RNA, 64 nt, Human
gauggaauguuccaguuaugauggacacuucgugaucugcaaugacuguugauucagcacauua

SEQ ID NO: 434641 - RNA, 64 nt, Human
cccuuugucuugacuuaucuccugcaacugacucaucugcaacauucacaccauugcuuccuug

SEQ ID NO: 434642 - RNA, 64 nt, Human
augucauguuuugauuauaggcuuuggucuuuucaucugcaaagccuuuuuuuuuugcucuuua

SEQ ID NO: 434643 - RNA, 64 nt, Human
uaaauuacauguacacauguauucacuuuuuagaaucugcaauuauaccuucuguaacaguggc

SEQ ID NO: 434644 - RNA, 64 nt, Human
gaacccaucccucugguggguaccucuggcacccaucugcaaauaucucccucucuccaacaaa

SEQ ID NO: 434645 - RNA, 64 nt, Human
uuuauauuuuuuuaaacuaccgaagacauucauuaucugcaaauuaagacucaccuucacuuuc

SEQ ID NO: 434646 - RNA, 64 nt, Human
gggaaaaacguuugcagaaauguaaguaaagccaaucugcaaaacuguauagcuuugacaauuc

SEQ ID NO: 434647 - RNA, 64 nt, Human
uguuugcuguggaacuacauuacuguacaggguuaucugcaagugaggugugucacaaugagau

SEQ ID NO: 434648 - RNA, 64 nt, Human
uagggagggagaggcaccaugcaugugggugauuaucugcaagccuguuugccgugaugcugga

SEQ ID NO: 434649 - RNA, 64 nt, Human
cuuccaaccccacuccccguucagcacagccgccaucugcaaggaaggccuaaucauguuacaa

SEQ ID NO: 434650 - RNA, 64 nt, Human
aagaaggaaagaagaauaaagaagagaaacguucaucugcaaaguaugaagcuguaauucugaa

SEQ ID NO: 434651 - RNA, 64 nt, Human
ccucaucuuggagcuuuuucaaaagcggggcuucaucugcaaagggcccuuucaucuugaaguu

SEQ ID NO: 434652 - RNA, 64 nt, Human
gguguaccucaaaguagcugcuaaccuuauguguaucugcaacacccugaaaaauuaucuaaua

SEQ ID NO: 434653 - RNA, 64 nt, Human
uuuacuaccuacugcucaguagucaucucuguaaaucugcaauuucuaccaaaaugugugaucg

SEQ ID NO: 434654 - RNA, 64 nt, Human
ugcccaugaccuguaauuguaaagaagcuuggacaucugcaaaugauauuuaaaccaucuuggc

SEQ ID NO: 434655 - RNA, 64 nt, Human
cuggucuccugaguuguuaauuaggugaaaaaagaucugcaauggcccccucccuuuccuaauc

SEQ ID NO: 434656 - RNA, 64 nt, Human
uucaucaauugcuuuauucuguaucugcgaaguaaucugcaaucucuuuuguucuuuuuaaaau

SEQ ID NO: 434657 - RNA, 64 nt, Human
gcuauccguaugugguggauuagaaauguguuaaaucugcaaaagguauaaagaugucaguuua

SEQ ID NO: 434658 - RNA, 64 nt, Human
ucaagguaccaggcccgcagcacuaacagaucacaucugcaacccugaacgugcagguuggaga

SEQ ID NO: 434659 - RNA, 64 nt, Human
ucucaaguugaccguggugcuguuucuggaaggcaucugcaacuccaaguccaugcagaacucu

SEQ ID NO: 434660 - RNA, 64 nt, Human
auuggggccaguguaaggucgaucccagaggcugaucugcaaaucaagcuacauguauuugugu

SEQ ID NO: 434661 - RNA, 64 nt, Human
gcccuggacuagugaaagaauggacucuaucuuuaucugcaagaggaacuaaggccuucucuca

SEQ ID NO: 434662 - RNA, 64 nt, Human
aaauggggaacgcugucaaggacauuaucaggauaucugcaaagugcaauuucaacauguacca

SEQ ID NO: 434663 - RNA, 64 nt, Human
cuccaggccugaguguuuuuguguccagcucaguaucugcaacaagaaguuucccacuugugga

SEQ ID NO: 434664 - RNA, 64 nt, Human
uuugggcuagguaggcacauaucaguuggaccacaucugcaauacuggauuuuacugaaaucuu

SEQ ID NO: 434665 - RNA, 64 nt, Human
aagucacuucaccucucugugccucaguuuccucaucugcaaaaugggggcaauaugucaucua

SEQ ID NO: 434666 - RNA, 64 nt, Human
cuuacaaaacuaccccgcauucaguuuucacauuaucugcaagcugaaacuuauuuuuaaguuu

SEQ ID NO: 434667 - RNA, 64 nt, Human
cccaagagccauuuauccuugagacucagaccacaucugcaaccaaaucagcauccugucauuu

SEQ ID NO: 434668 - RNA, 64 nt, Human
ggguagagguagaaagguuuaauuaacccuggagaucugcaaauggagggaggggugaaggagg

SEQ ID NO: 434669 - RNA, 64 nt, Human
uaccuaaaacaggggacagcuuuuggaagaugacaucugcaaugcuuuucaucuuuaccaacgg

SEQ ID NO: 434670 - RNA, 64 nt, Human
gauuuagagcaggucuuuuuuuuucuucauuguaaucugcaaaauguagaaauaaauuacuuaa

SEQ ID NO: 434671 - RNA, 64 nt, Human
uauaaaugaccaagguccucagacugcuuuuagcaucugcaacuuaaaaaaaugggaguuagaa

SEQ ID NO: 434672 - RNA, 64 nt, Human
aguuuucaccauuuguccucagucuccuuuaugcaucugcaacuuuaaggcauaguccaucgau

SEQ ID NO: 434673 - RNA, 64 nt, Human
gucaagacaaccccuuucugcuuucuuauguagcaucugcaaagccgauucauguacugaugcc

SEQ ID NO: 434674 - RNA, 64 nt, Human
uaacagcugaaagucaaagucaguggcuaguaccaucugcaauaggauuuaggaaguuuugauc

SEQ ID NO: 434675 - RNA, 64 nt, Human
aaugcuuuagaaauuuuaacuccggggagccauaaucugcaacuucauuuucccccauagaaga

SEQ ID NO: 434676 - RNA, 64 nt, Human
ugcaguuucucuaccugcccccagagcugaggccaucugcaagccccugcccauggcccaaugg

SEQ ID NO: 434677 - RNA, 64 nt, Human
caaucauucaacagauaguucagaaacacuuuuuaucugcaaggcacuauucuagauccagaag

SEQ ID NO: 434678 - RNA, 64 nt, Human
ugagaauaagaaauuacucucaagaacuucagaaaucugcaacauaauuuuauaaauauauaaa

SEQ ID NO: 434679 - RNA, 64 nt, Human
cacuuaaaaaucuaagauguggauuauuguuagaaucugcaacuucauuggcaaauuauuucaa

SEQ ID NO: 434680 - RNA, 64 nt, Human
gcugauuaccugucuuauguaacuacuugagaccaucugcaagagacaugauuuagugugucug

SEQ ID NO: 434681 - RNA, 64 nt, Human
uugcagugauugguugucuuuuucuagacuugggaucugcaagaaggccaauugccuaaaauuu

SEQ ID NO: 434682 - RNA, 64 nt, Human
auuuucaggucagcugauuagccaccuuaguuccaucugcaacuuuaguucccacuggcugugu

SEQ ID NO: 434683 - RNA, 64 nt, Human
uuuggccuggagauggcagaagugaaagcuggccaucugcaaaaagcagauaagugaguuugaa

SEQ ID NO: 434684 - RNA, 64 nt, Human
cuccagcguugcaagugcaaggccaguggaguuaaucugcaacgugcacgagggcgugugucag

SEQ ID NO: 434685 - RNA, 64 nt, Human
ccaacaaauuauugauagcugauaauguuucauuaucugcaacugcuugauaaguauguugcau

SEQ ID NO: 434686 - RNA, 64 nt, Human
cagugaagauaugugauauggauguuugaagcuaaucugcaacagccuucugauggccaugaaa

SEQ ID NO: 434687 - RNA, 64 nt, Human
gagcuuuuuuguuucuuggguuuuuaaaaugugaaucugcaaugaucauaaaaauuaaaaugug

SEQ ID NO: 434688 - RNA, 64 nt, Human
ugaggauuucaucuaccauuucacaaaguuggagaucugcaaccucacggccgaugcucugcag

SEQ ID NO: 434689 - RNA, 64 nt, Human
gauccugaaagggguuaaaucuacuuugaaaugaaucugcaaucaguauuucaaagcuuuucug

SEQ ID NO: 434690 - RNA, 64 nt, Human
caguuugguaaauuguuauguuaacaauuaugacaucugcaauguuuuauaaagcaacuaauuu

SEQ ID NO: 434691 - RNA, 64 nt, Human
uucuguuauguucuguuuucugguugccaguuugaucugcaaaguauuuuucagugcagguaaa

SEQ ID NO: 434692 - RNA, 64 nt, Human
uuugaacuccugcuggaauacaaaauucuugagcaucugcaaacuaaaaauugacuugagguuu

SEQ ID NO: 434693 - RNA, 64 nt, Human
cacccccaaacagugacauuuauuuuucucaugaaucugcaaugugggcagagauuggaauggg

SEQ ID NO: 434694 - RNA, 64 nt, Human
uuuacuuugggaaauaucuuggaucuuaauuaucaucugcaaguuucaagaaguauucugccaa

SEQ ID NO: 434695 - RNA, 64 nt, Human
acuugcgacaccucaagguguucucuguagcucaaucugcaaacaugccaggccucagggaucc

SEQ ID NO: 434696 - RNA, 64 nt, Human
guacuuuuugaaacgugacugcguugugugaacaaucugcaauuuuucaguccgugagauccug

SEQ ID NO: 434697 - RNA, 64 nt, Human
ccccaugggcugagccaagugugcccacggcugcaucugcaaagggacgucggagaagugcagc

SEQ ID NO: 434698 - RNA, 64 nt, Human
gaacuucaggagcuucuuaggucuugccacaaaaaucugcaaauuugauaauucuccugaauuc

SEQ ID NO: 434699 - RNA, 64 nt, Human
aagaaccugccugauggggagugucggcugugaaaucugcaaaaagagcugacauuccagcugc

SEQ ID NO: 434700 - RNA, 64 nt, Human
agaucuucaaguggauuuuuagcaaauuuagcucaucugcaaaagaugaaguuaaacuccucua

SEQ ID NO: 434701 - RNA, 64 nt, Human; identical to SEQ ID NO: 434700

SEQ ID NO: 434702 - RNA, 64 nt, Human
cgccccgggaagccaccaaaccuugcuuuuucucaucugcaaaauggggacaauggggauaaug

SEQ ID NO: 434703 - RNA, 64 nt, Human
caagucuuucugaucaccccaaguagcaugacugaucugcaauuuaaaauuccugugaucugua

SEQ ID NO: 434704 - RNA, 64 nt, Human
ugcuugcccaguaguucuggaggaaggcccgggaaucugcaaaugagcgcauuccccaggcagu

SEQ ID NO: 434705 - RNA, 64 nt, Human
uuugcagagauaaaccaauaaauccacaccguacaucugcaauaugaauucaagaaaggaaaua

SEQ ID NO: 434706 - RNA, 64 nt, Human
cgugcugcugcccaggcuggagugcaguggcacgaucugcaaacuccgccuccuggguucaagu

SEQ ID NO: 434707 - RNA, 64 nt, Human
auguuaaaggacaaaugcccacucuucuauucugaucugcaaauagcuuaaaugucucuugcaa

SEQ ID NO: 434708 - RNA, 64 nt, Human
acggcaagcacauauaaaaugauuuuuguaggucaucugcaaguucauggaagagcugggccua

SEQ ID NO: 434709 - RNA, 64 nt, Human
auaguucucaaaguguguuccccggacaagcagcaucugcaacacuuaggaaggucuucgaaau

SEQ ID NO: 434710 - RNA, 64 nt, Human
cuaaagaaaaaaaugggauuuguuuucucggcagaucugcaaggcuggcuuuaagagcacaagg

SEQ ID NO: 434711 - RNA, 64 nt, Human
gugaauugacauaaucuuggguaauggaacggagaucugcaacauaucuuuuaacaacacuuuu

SEQ ID NO: 434712 - RNA, 64 nt, Human
gaacgacaaucgaugugacguugacaauuacuggaucugcaaaaagcccgcagccugcuucaga

SEQ ID NO: 434713 - RNA, 64 nt, Human
cucagaucuauccuuuccuggccuugacuuccccaucugcaaaucagggucauuggcucacccu

SEQ ID NO: 434714 - RNA, 64 nt, Human
caagaccaguccgagcaacauagcaaaagcccuuaucugcaaaaaauucaaaaauuagccaggu

SEQ ID NO: 434715 - RNA, 64 nt, Human
cuggguuagcuuuccacagacauaaauauaguccaucugcaaucacaagcacauagccagguaa

SEQ ID NO: 434716 - RNA, 64 nt, Human
aagauccuagauccuaagggucgaaagcucuagaaucugcaauucaaaaguuccaagagucuaa

SEQ ID NO: 434717 - RNA, 60 nt, Human
gggagaagggggcuccgugaguggccugcuaucugcaaugaccaccauagcuuaacccca

SEQ ID NO: 434718 - RNA, 64 nt, Human
acagaauccuuggaauuuucuauauagaaaugucaucugcaaauacagaccauuuuuuaucuuu

SEQ ID NO: 434719 - RNA, 64 nt, Human
ccucaggcccugcccgacccuggggagagagggcaucugcaauaggaggggacccgagccuguc

SEQ ID NO: 434720 - RNA, 64 nt, Human
gauguugggaaaucaugugaacaucuaucuccaaaucugcaagcuccuguuuuacuguagaagg

SEQ ID NO: 434721 - RNA, 64 nt, Human
uuacaagaaagaaagggacaggcucuggcuuguuaucugcaacaggaacauguccuuaaggcac

SEQ ID NO: 434722 - RNA, 64 nt, Human
uuaugagaaagaaagggacaggcucuggcuuguuaucugcaacaggaauauguccuuaaggcac

SEQ ID NO: 434723 - RNA, 64 nt, Human
uaaauguaagcaauaugggaacaucuucaaugacaucugcaaccauugucgagauucuucguag

SEQ ID NO: 434724 - RNA, 64 nt, Human
aagccaagugcccucucugaaccucaguuuccucaucugcaaaaugggaacaaugacgugccua

SEQ ID NO: 434725 - RNA, 64 nt, Human
ggaaagccucuugccagauguaggcccuuaagauaucugcaaagaagaguaauuucaugaaugc

SEQ ID NO: 434726 - RNA, 64 nt, Human
uuuuaaaaauacuauguauguaaaauauuuauucaucugcaauuuggcuucccuaacuuaacau

SEQ ID NO: 434727 - RNA, 64 nt, Human
cacaucugguuccaacuugccugaugcuuagcucaucugcaaauaugugaucagugccgguaau

SEQ ID NO: 434728 - RNA, 64 nt, Human
gcucuuccacccugcucgugcugcccagaggcugaucugcaaaccugggcaguauuccacacug

SEQ ID NO: 434729 - RNA, 64 nt, Human
cuuuacauugucaugaacuggauugauaacccucaucugcaauauuuucaccccuaaaauuuuu

SEQ ID NO: 434730 - RNA, 64 nt, Human
uccugaguaggaguccaggacucccacugucucaaucugcaaauuguuccuauccagguucagg

SEQ ID NO: 434731 - RNA, 64 nt, Human
caggucggcggguguucccaggaagaggaaguaaaucugcaacccuggggaggaccccaacuca

SEQ ID NO: 434732 - RNA, 64 nt, Human
auuauuacugaaugucagucauuuccccuacuugaucugcaaugccaauaucaagggccaugua

SEQ ID NO: 434733 - RNA, 64 nt, Human
acaccaaaggcuuugacgguuucuccaaguaaggaucugcaaaucuugaaucguccucaaaaug

SEQ ID NO: 434734 - RNA, 64 nt, Human
uugauguuugugacaagaaaaugagaaaguuaguaucugcaauacagagcuuguuccuguucag

SEQ ID NO: 434735 - RNA, 64 nt, Human
uugaggcaagaggauuucuggauauuagucacccaucugcaagaaaaaugcugaggccucgggu

SEQ ID NO: 434736 - RNA, 64 nt, Human
ucaauccucuucucuucaccaguuuccaggacucaucugcaacauuugcaaucuuuuugcacua

SEQ ID NO: 434737 - RNA, 64 nt, Human
uccucggccccuccucagccaccugaguugcucuaucugcaagccugacucugccagccucccc

SEQ ID NO: 434738 - RNA, 64 nt, Human
gcugugauuguacuguacauaaaacauaugaggaaucugcaaggaacacuacaguuguguaaag

SEQ ID NO: 434739 - RNA, 64 nt, Human
uaaagacauauuugcacaaaaccuuuguuuaaagaucugcaauauuauauauauaaauauauau

SEQ ID NO: 434740 - RNA, 64 nt, Human
aacaauagcuuggaauggcuugaaaucacaaaggaucugcaagaugaacuguaagcucccccuu

SEQ ID NO: 434741 - RNA, 64 nt, Human
uauaaaagaaacagcuauuuaaugaaauuuugauaucugcaaauuuuuguugauauguaaugcu

SEQ ID NO: 434742 - RNA, 64 nt, Human
uaugcuuuauuuggcuuuauuuuacaaguacaguaucugcaaaaaacaaaguaaccuuuuuuca

SEQ ID NO: 434743 - RNA, 64 nt, Human
auuuuuaggucuuugugccaccaccacgaggggcaucugcaaagagggcaacgcuagacacaga

SEQ ID NO: 434744 - RNA, 64 nt, Human
ucaggugcagcauacauaaccaguaagagacuaaaucugcaauauauaaagagcuccuacaaau

SEQ ID NO: 434745 - RNA, 64 nt, Human
caggggugcggcacggaggagcgcaugcgugcuuaucugcaauggaggcgcucuggaggcugug

SEQ ID NO: 434746 - RNA, 64 nt, Human
acgaagacucaagacccucaggacuggccauauaaucugcaagguccaguaugaaauaagaaua

SEQ ID NO: 434747 - RNA, 64 nt, Human
ggcguauggcccugagcugggcuuuauauuuuauaucugcaaauaaaucacauuuuaucuuaua

SEQ ID NO: 434748 - RNA, 64 nt, Human
ggaagagggaagagauccuaauggaggcgccuccaucugcaaccacaguuguaaggcucauggc

SEQ ID NO: 434749 - RNA, 64 nt, Human
ugcccucggccugguccagcaugaaggcguuuccaucugcaaggaugcacgguacccuccccga

SEQ ID NO: 434750 - RNA, 64 nt, Human
uaaaacugaaaaaaaaauguaguuacacguuaaaaucugcaaaugguuuuuacaccucugauuu

SEQ ID NO: 434751 - RNA, 64 nt, Human
ggcucugucacccaggcuggagugcaguggcgugaucugcaaccucugccccccggguucaagc

SEQ ID NO: 434752 - RNA, 64 nt, Human
ggugaaggcaacaugaugccagauuugagaaaggaucugcaaaauaaagauaccacaauucauc

SEQ ID NO: 434753 - RNA, 64 nt, Human
caacgaggccuggacaaacaagcccugaggagggaucugcaacaacccugaagacaacaaggaa

SEQ ID NO: 434754 - RNA, 64 nt, Human
cgguguaggcgaacuucccucauuucucucugcaaucugcaaauaacuccuccauugaaauaac

SEQ ID NO: 434755 - RNA, 64 nt, Human
gaaugugaccugaaaugcaaguacaucagaacauaucugcaauacccaagccacagggaagaac

SEQ ID NO: 434756 - RNA, 64 nt, Human
aaucuccucaccucaugagucuuaacuuaauuacaucugcaaggcccccuucuccaaauaagau

SEQ ID NO: 434757 - RNA, 64 nt, Human
ugauuuauuuaucuuggggaaagugaaaaauguaaucugcaaguuaaugacccuauuggcuugu

SEQ ID NO: 434758 - RNA, 64 nt, Human
ggcaucccuccuguugcuagcagccuuuugaccuaucugcaaugcaguguucucaguaggaaau

SEQ ID NO: 434759 - RNA, 64 nt, Human
agguuuuuaccccuucuaaaauaaguuuuauuccaucugcaaauugcugcaauauuauaguaau

SEQ ID NO: 434760 - RNA, 64 nt, Human
agcaucuugaacaggaauauuaagauaaaugugaaucugcaauggcugaaaagaguugugagcu

SEQ ID NO: 434761 - RNA, 64 nt, Human
ccuuccugcuguuacaugcagccacuuaggacaaaucugcaaagcauguuuugcauguaaaagc

SEQ ID NO: 434762 - RNA, 50 nt, Human
augaucucacugagcucuaaaucugcaaucccagagaauccugacaaagc

SEQ ID NO: 434763 - RNA, 64 nt, Human
gagaaauuaucauuuuaaagggcauagcacagcaaucugcaacaauauguaaaguugauauuga

SEQ ID NO: 434764 - RNA, 64 nt, Human
uguguaaugcuucucucugugccucagcuuccugaucugcaaaauugguuuaauaauaaugccu

SEQ ID NO: 434765 - RNA, 64 nt, Human
cuggccauuuugccuuucugacauuuccuugggaaucugcaagaaccuccccuuucccuucccc

SEQ ID NO: 434766 - RNA, 64 nt, Human
caaucuuggagucaaaaggcaaaucauuuggacaaucugcaaaauggagagaauacaauaacua

SEQ ID NO: 434767 - RNA, 64 nt, Human
acaaauaaucgagacugaaagaauguuaagauuuaucugcaaggauuuuuaaaaaauugaaacu

SEQ ID NO: 434768 - RNA, 64 nt, Human; identical to SEQ ID NO: 434767

SEQ ID NO: 434769 - RNA, 64 nt, Human
gaagaaauugaaggguuacucaaauacaguugcaaucugcaaucugcuguugagucagggcuuu

SEQ ID NO: 434770 - RNA, 63 nt, Human
ucagcugggauccuggaccugggaggccccugugagggccagcucuggaaaaaccugggaguu

SEQ ID NO: 434771 - RNA, 63 nt, Human
ccugcugggaauaggcugagcaugcaaugacaugagggccaaggcuugugggaaaaugacagc

SEQ ID NO: 434772 - RNA, 63 nt, Human
agaccaccuagggcggggcugggugggagaugggagggccaacugcgagcugcuccacuucuc

SEQ ID NO: 434773 - RNA, 63 nt, Human
cagcccaugcgagcccuucuccugcugcucugggagggccaguuccacauugagccagccugg

SEQ ID NO: 434774 - RNA, 63 nt, Human
cuggccagcacucuagcuccugaccuuugacccgagggccaccucaaccccagcuucugacgu

SEQ ID NO: 434775 - RNA, 63 nt, Human
cucagucaggcuucagagcagcccuggagacaggagggccauguuaaaagcuuuuucacaguu

SEQ ID NO: 434776 - RNA, 63 nt, Human
gaggugggggauugagggagggacagaguguuggagggccagagacuaguccugagauggaaa

SEQ ID NO: 434777 - RNA, 63 nt, Human
ggaggccaguggagcugccugguguccacgggggagggccaaggccugcugagcugauucucc

SEQ ID NO: 434778 - RNA, 63 nt, Human
cagcucgguuuccuuuucuagaauggaaauagugagggccaaugcccaggguuggagggagga

SEQ ID NO: 434779 - RNA, 63 nt, Human
cucagccucauucagcauggguccuugaugccagagggccagcaggcuccuggcugugcccag

SEQ ID NO: 434780 - RNA, 63 nt, Human
acggcuaagggcacgaagacgauaucugguagagagggccagagaugcccgcgugguagggcu

SEQ ID NO: 434781 - RNA, 63 nt, Human
ugaagaagaguguggaggaagcuauuaccaggggagggccagggcucugaggagugggcgcug

SEQ ID NO: 434782 - RNA, 63 nt, Human
uggcggagaugcuucuaaggcauggucgggggagagggccaacaacugucccuccuugagcac

SEQ ID NO: 434783 - RNA, 63 nt, Human
gcugagaggcuccuucuaccugccgcaggguaggagggccaggcaaaguucaccagcuugcuc

SEQ ID NO: 434784 - RNA, 58 nt, Human
gugccauggaguccucuuaaagagggacgagggccagacugaagcagcacaaggccgg

SEQ ID NO: 434785 - RNA, 63 nt, Human
ccagacccugcaguuugagaucugaugcuuccugagggccaaggcauugcuguaagaaaaggu

SEQ ID NO: 434786 - RNA, 63 nt, Human
agcaguuguagcaggccugaccacagauucccagagggccagguguggauccacaggacuuga

SEQ ID NO: 434787 - RNA, 63 nt, Human
uacaccuuuugcuaacaccccuacuaggucccagagggccagaaacaccugacuuaccucuga

SEQ ID NO: 434788 - RNA, 63 nt, Human
gggaggagguggagcagcgggcguccccgaagugagggccaggcccuucccggcugcgaggac

SEQ ID NO: 434789 - RNA, 63 nt, Human
gccuccucacuggugaaacccaggauguagauagagggccacacccacccuguccagaguaga

SEQ ID NO: 434790 - RNA, 63 nt, Human
cagugaucaccccggacgggcguccaggacccugagggccauggccaaaaggcuccugagugu

SEQ ID NO: 434791 - RNA, 63 nt, Human
cugcaaagcccuuggaacacccuggaugcuguugagggccaagagaucuguguggcuccuggg

SEQ ID NO: 434792 - RNA, 63 nt, Human
guggucucauaauuccauuuguggagagaacaggagggccagauagauagguccuagcagaag

SEQ ID NO: 434793 - RNA, 63 nt, Human
cugggacacggcaccccccugggccuggagggagagggccaauccagacacacucacacucuc

SEQ ID NO: 434794 - RNA, 63 nt, Human
gcgagccugcgucugucucagcuguccagcgcugagggccagggucuugugcuguggggcugg

SEQ ID NO: 434795 - RNA, 63 nt, Human
ucugggcugccggguucuagucuccuuugcacugagggccacacuauuaccaugagaagaggg

SEQ ID NO: 434796 - RNA, 62 nt, Human
ucaaggucuccgccuuguaaaaccacuggacagagggccagaguggguaguggggaaugaag

SEQ ID NO: 434797 - RNA, 63 nt, Human
gcucaggaucucucccaaggcuaccuacugcaggagggccaacaggugagaugggaagaaugg

SEQ ID NO: 434798 - RNA, 63 nt, Human
accugcaggaacaauauuccuguagccauggaagagggccaaggcucagucacuccuuggaug

SEQ ID NO: 434799 - RNA, 63 nt, Human
aauaaaugcgaacaugcauacauaaauguggcugagggccacuuuugccaucacugugcucca

SEQ ID NO: 434800 - RNA, 63 nt, Human
uccccgggccuggccaacccugcugugcagggugagggccaugcaugcaguaugaggggucua

SEQ ID NO: 434801 - RNA, 63 nt, Human
acuugcuaaagcacuuugcacuuaauggcuguugagggccacuuuuuuuuuauacugcacagu

SEQ ID NO: 434802 - RNA, 63 nt, Human
uaauauuuuaagugucuucugugguauaugugggagggccauuaaggaguggguuucacuccc

SEQ ID NO: 434803 - RNA, 63 nt, Human
ugucuuuuagguuuguuugaagagacuguaccagagggccagggaggaggagaaaggaauuga

SEQ ID NO: 434804 - RNA, 63 nt, Human
guugaauuuguggauguggaacccauggauacagagggccaacuguauuuaggauaauuucau

SEQ ID NO: 434805 - RNA, 63 nt, Human
ggucacaggaugcacugucagcaucaggucccagagggccaccguguccauuacagcagaguc

SEQ ID NO: 434806 - RNA, 63 nt, Human
agggaaagagaagcccaaccucugugaucauaugagggccaaggcugagcaguguagacagag

SEQ ID NO: 434807 - RNA, 63 nt, Human
uccugggagaggccugggggcggugcucacugggagggccaggacucaguuccugcucucauc

SEQ ID NO: 434808 - RNA, 63 nt, Human
uaggagaggaaccgcagguggugagcggcuggggagggccaggacagccggggcugggugcug

SEQ ID NO: 434809 - RNA, 63 nt, Human
gccgagggcugcgccccgugcugccuccccccagagggccacccgcugugcucguggacugag

SEQ ID NO: 434810 - RNA, 63 nt, Human
cuugguguuugacuguuguaauggaguaaagaagagggccagcuuaauuuaaaaauaaaguga

SEQ ID NO: 434811 - RNA, 63 nt, Human
ggcaccaucugcccagcuccaaggacccuuggugagggccagccugccuucugcaugagagga

SEQ ID NO: 434812 - RNA, 63 nt, Human
aaauccuccuccuucccuuuuuucuggagucuugagggccagaguuuuuguuuuuguuuuugu

SEQ ID NO: 434813 - RNA, 63 nt, Human
gguccagaugagggccaggaaggggaggagagugagggccaagaacgagccuuaagggagcag

SEQ ID NO: 434814 - RNA, 63 nt, Human
gaccacaaggcagcagaaagcgcggguccagaugagggccaggaaggggaggagagugagggc

SEQ ID NO: 434815 - RNA, 63 nt, Human
cugcagagugagagugacguuuucuuagggcuggagggccaguucccacucaaggcucccucg

SEQ ID NO: 434816 - RNA, 63 nt, Human
ugugauaaugugaaaugagaaguauuuacauuggagggccaauggcugguccuucaagugcug

SEQ ID NO: 434817 - RNA, 63 nt, Human
gccccuccccagcgucccagggcucugguucuggagggccacuuugucaagguguuucaguuu

SEQ ID NO: 434818 - RNA, 63 nt, Human
cccauuucacccccucugcagacaccaauguccgagggccacccaggacaggacgggggucag

SEQ ID NO: 434819 - RNA, 63 nt, Human
gccagaggcaccuggaacccuggacuucacugggagggccaacuuggaggaucagugcuggcu

SEQ ID NO: 434820 - RNA, 63 nt, Human
aagagggcaccaaagaaaaggguaagugcaucugagggccaaaagagauguauaagccuuuua

SEQ ID NO: 434821 - RNA, 63 nt, Human
cagcuccugcaccacggacacagaaugucuggagagggccagcaggcccucugaggguucugg

SEQ ID NO: 434822 - RNA, 63 nt, Human
gcauccccuagagagagugaggugcagggacccgagggccagguuagcacagcgcuggcccca

SEQ ID NO: 434823 - RNA, 63 nt, Human
ucaauaaagaggaagcaaacagccaggcucccugagggccaggcccccagaccaucuuggguu

SEQ ID NO: 434824 - RNA, 63 nt, Human
cauccuggcuccccaggguggcaggagcugagggagggccacacacuggcaagauuucaagac

SEQ ID NO: 434825 - RNA, 63 nt, Human
gaggaggccaccugaccaaaugccgccaaccccgagggccaguuucuugucgaauugguacgg

SEQ ID NO: 434826 - RNA, 63 nt, Human
acuuuccaugggaaacuuucccuuuuguaaguugagggccagggguagggauauuuuuuaguu

SEQ ID NO: 434827 - RNA, 63 nt, Human
agaaagaagccgaaggcucuuagggagcagccagagggccaagugaccaagaggauggggccu

SEQ ID NO: 434828 - RNA, 63 nt, Human
agagagaugggcuugcucucucugugcacccaggagggccacgcacuuaaaacuguguuugug

SEQ ID NO: 434829 - RNA, 63 nt, Human
ccccuguccccgcaucuccccugggaccagcuggagggccacaugcacacacagccuagcugc

SEQ ID NO: 434830 - RNA, 63 nt, Human
ggccaaguguguugcuucagcaaaccggaccaggagggccagggccggauguggggacccucu

SEQ ID NO: 434831 - RNA, 63 nt, Human
cuaggucuuaagagccaaaggaaggaagugguugagggccaggaaagagaaggaaugucaugc

SEQ ID NO: 434832 - RNA, 63 nt, Human
gagggcuggcagcugaacgcacuugcagcguccgagggccaccgggcuggcauuuugugaccc

SEQ ID NO: 434833 - RNA, 63 nt, Human
gaggaugaccagggaagcccccugauaagccaagagggccagcacagcccuugcucccaggcu

SEQ ID NO: 434834 - RNA, 63 nt, Human
agaaagcuauggauucccuggaugaaauccaaggagggccaucuucagaauggaaaaaugcaa

SEQ ID NO: 434835 - RNA, 63 nt, Human
accaagacucugcacaaccagauugcuugugcagagggccacaauaaguguauguuuuauauu

SEQ ID NO: 434836 - RNA, 63 nt, Human
cagacaccagccuuuaggguggccuugggaggagagggccaggcuguccugggugugagagaa

SEQ ID NO: 434837 - RNA, 63 nt, Human
gagaaaugagaaagagucugugggugggccucugagggccacagaaaaccagacaccccacau

SEQ ID NO: 434838 - RNA, 63 nt, Human
cagguuacaugaaacauugaaagacuuguuacagagggccaugauauuuuucaaagaaaugug

SEQ ID NO: 434839 - RNA, 63 nt, Human
ggagcaccuuccucuccagccagaggcugaccugagggccacuguccucagaugacaccaccc

SEQ ID NO: 434840 - RNA, 63 nt, Human
ggugcuguguuuucauagcauggagucggaggagagggccauuuagcagggggagcagaagag

SEQ ID NO: 434841 - RNA, 63 nt, Human
cauaguuuucucucucuuuaaagagaauaaauagagggccaggugugguggcucacgccugug

SEQ ID NO: 434842 - RNA, 63 nt, Human
gacugcugcccccagaacaggcagggggugugggagggccaguuucccgccacuggguccaag

SEQ ID NO: 434843 - RNA, 63 nt, Human
cacaucccucgggaacucugccccucugacaaugagggccacagagaaggugguguuuccaug

SEQ ID NO: 434844 - RNA, 63 nt, Human
augggcacugggcucgccuugcacgcccaccaggagggccaggggcauacgcaguccugacgu

SEQ ID NO: 434845 - RNA, 63 nt, Human
gccagcugccagugcagguggagggcuguaggggagggccagugcccagacagggucaugggg

SEQ ID NO: 434846 - RNA, 63 nt, Human
cagaagggagaaggcugugcuagaggagccagugagggccagcauggggugggcuucacuaag

SEQ ID NO: 434847 - RNA, 63 nt, Human
gaguggucucagugagaagguagaugccaacuggagggccagaccuguguccugcccaugucc

SEQ ID NO: 434848 - RNA, 63 nt, Human
gucugaggggcccugcuccaagccugcaggaccgagggccacagccggacaggggguagcccc

SEQ ID NO: 434849 - RNA, 63 nt, Human
acaaaagugauuaugucacgagaggagaggcuggagggccaugggaguucccagcuggcucac

SEQ ID NO: 434850 - RNA, 63 nt, Human
cuauuuuuuaccucaccuggaaacuaccauugugagggccaucccccaggcacugcacagcac

SEQ ID NO: 434851 - RNA, 63 nt, Human
uggaggagaaggacauuuuacugcagugagaaugagggccaagaaagagucaggccuuaauuu

SEQ ID NO: 434852 - RNA, 63 nt, Human
uuuguuuuaaauacgcacuacaugugguuuauagagggccaagacuuggcaacagaagcaguu

SEQ ID NO: 434853 - RNA, 63 nt, Human
gaacccagauggcaauccaucccgguucucucugagggccacgggcuuggguaguggaaaggg

SEQ ID NO: 434854 - RNA, 63 nt, Human
acaaugacccagaagacagccaugccuccgaaagagggccagguccuaagcugcugcuugugc

SEQ ID NO: 434855 - RNA, 63 nt, Human
cuguuuuauaaaagugaaauauccaguauuucagagggccaggcaagagcacuucagaugagg

SEQ ID NO: 434856 - RNA, 63 nt, Human
acauuucugggggugucgucacugccguccccggagggccagauacggccccgcccaaagggu

SEQ ID NO: 434857 - RNA, 63 nt, Human
gcacgacagcagaaggauguugcuuuuuuaagggagggccagaaagaaaguuaguggauugca

SEQ ID NO: 434858 - RNA, 63 nt, Human
gaguggucgagugaagauugaaaauuaaccucugagggccagcacagcagcucaugccuguaa

SEQ ID NO: 434859 - RNA, 63 nt, Human
ggguguagauuaccugccacuuccaggagcccagagggccaagagagacauugccuccaccuc

SEQ ID NO: 434860 - RNA, 63 nt, Human
acuggcguuggggaguugguuccugagaggucugagggccagagcugcccucuacauuaacau

SEQ ID NO: 434861 - RNA, 63 nt, Human
uugcucuucugucugucaucuugcaggaugcccgagggccagaugggcuuagcuaggccaaag

SEQ ID NO: 434862 - RNA, 63 nt, Human
agggaguggggacagugcaggcaguauuggcaggagggccagugcagaagggcugguagcuca

SEQ ID NO: 434863 - RNA, 63 nt, Human
uggucuggguuuggcaggcacugccugcuacuugagggccaggaugcucccccagggaagaaa

SEQ ID NO: 434864 - RNA, 63 nt, Human
gcacauccuuggaggcgagaugagcuccuugcagagggccagaguaagugcaagucauggagu

SEQ ID NO: 434865 - RNA, 63 nt, Human
cgggcuaggaggaggggguaggugaugggggacgagggccaggcacccacauccccaauaaag

SEQ ID NO: 434866 - RNA, 63 nt, Human
uaccucgcagauuugcugagucugucuugugcagagggccagagaauggcuuaugggggccca

SEQ ID NO: 434867 - RNA, 63 nt, Human
gugccagggaacaggggccggccugggggcugggagggccaggggcaccucccucccacccuu

SEQ ID NO: 434868 - RNA, 63 nt, Human
cggcucuaagagaaaggcccaucuacucaggaagagggccagggccuuggguucuggggauug

SEQ ID NO: 434869 - RNA, 63 nt, Human
guggccuuggguccgggucucacugagcagcccgagggccacuccagcccggcuggggaagag

SEQ ID NO: 434870 - RNA, 63 nt, Human
cgggcaccagcgccacuuaugugccucugcuccgagggccagugggcugcagggccugcuugg

SEQ ID NO: 434871 - RNA, 63 nt, Human
ggagacccaaaugccuuuacuuuauucucuggggagggccagcggcucgcaucccccucaucu

SEQ ID NO: 434872 - RNA, 55 nt, Human
gcaagaagccugggcccugagccaggagggccagccagaggucuggucaggcugu

SEQ ID NO: 434873 - RNA, 63 nt, Human
ggaggagcauuguccaggcauggccuguggcccgagggccaaccaccgagcaggcacagcaca

SEQ ID NO: 434874 - RNA, 63 nt, Human
gaugaaaauaaggaugauggggacgggguccaggagggccacugggaaggcacuauccagaaa

SEQ ID NO: 434875 - RNA, 63 nt, Human
gcacaagccucagggaaggggaagcaggaugcggagggccaaagcccgggaccucuacuugaa

SEQ ID NO: 434876 - RNA, 63 nt, Human
uugggauuuuauuuuuguggcgggcgggggugggagggccauuuugucacuuugccucaguug

SEQ ID NO: 434877 - RNA, 63 nt, Human
gcaucuguaaguugcacucaggaggguuuaggggagggccaugggcaggcuggauacccaguc

SEQ ID NO: 434878 - RNA, 63 nt, Human
cuuagauccccucaacugucuacuuguugcagugagggccaauaauuaugaaauugucaggcu

SEQ ID NO: 434879 - RNA, 63 nt, Human
uguaguguuggcccagagugugguuacugcccugagggccaugaaagccacagaggaugggcu

SEQ ID NO: 434880 - RNA, 63 nt, Human
caugucacggcaaggacugccgcauuggugauggagggccagcugaggggaaguugcugguga

SEQ ID NO: 434881 - RNA, 63 nt, Human
ccugggggagccuacuggggacugagcccccaggagggccagcauguggagagucgcugcggc

SEQ ID NO: 434882 - RNA, 63 nt, Human
gaccauggcccgcagaggcacugccacagcugugagggccaagaugcuguccccccauccaaa

SEQ ID NO: 434883 - RNA, 63 nt, Human
cggaggagguucccuugcugggcaugcuucguagagggccaggagcagcaggucaugugcaca

SEQ ID NO: 434884 - RNA, 63 nt, Human
ugucucccacuuugcaaccuauguggcagccaugagggccaucaacaucgcagaugagcugcc

SEQ ID NO: 434885 - RNA, 63 nt, Human
ugaagagccucaccugggggcauuuuguggguggagggccagaguguguauacccaggcuugu

SEQ ID NO: 434886 - RNA, 63 nt, Human
caaaacuagaauuguugcaucccucaauugaaugagggccauaucccugugguauuccuuucc

SEQ ID NO: 434887 - RNA, 63 nt, Human
ccucauaccugucacauuggugaucucacagaggagggccaugccgcugaaaagggaaggaga

SEQ ID NO: 434888 - RNA, 63 nt, Human
gaguuuugguaccagaggcuagaguggacaaaugagggccagggaggaaccggaaaaugggag

SEQ ID NO: 434889 - RNA, 63 nt, Human
agaauauaguauagaguuugccucaacacaugugagggccaaauaaccugcuagcuaggcagu

SEQ ID NO: 434890 - RNA, 63 nt, Human
gcgaaaagacuccugguuccccuguugauuugugagggccaaguuugcuaguagaaaucgaca

SEQ ID NO: 434891 - RNA, 63 nt, Human
ugaauuuauccuaguauuuuucuuuaccugaaggagggccauuuauuuuuaauuucacuacau

SEQ ID NO: 434892 - RNA, 63 nt, Human
ggcgugguacgugugcgccaggacucgggcgcugagggccacucacacagcugcuaccacgac

SEQ ID NO: 434893 - RNA, 63 nt, Human
cucugccaugcacacaggaggagagcuggaccugagggccaccgcagcggugcacacauuccu

SEQ ID NO: 434894 - RNA, 63 nt, Human
ccuaacuguaucuugaggugguaguaaaacacagagggccaguaacgggucguaaugacuuau

SEQ ID NO: 434895 - RNA, 63 nt, Human
gguuauaaauucaaagagcuugaaaagauugaagagggccaaacacugaugauuuguggaaaa

SEQ ID NO: 434896 - RNA, 63 nt, Human
gauauuuuuauaaaaaaguaccacugagucagugagggccacagauugguauuaaugagauac

SEQ ID NO: 434897 - RNA, 63 nt, Human
ucuggaaaugguagacuguguugggauuggggggagggccaugggagggguacaucgucaaca

SEQ ID NO: 434898 - RNA, 63 nt, Human
ggguggaagucaguuggccucccugguucugcagagggccagaagaaugagagagaggaagac

SEQ ID NO: 434899 - RNA, 63 nt, Human
uaguugcugagaggggcuggggagauggggcgggagggccagacucagugcugcuguggagcu

SEQ ID NO: 434900 - RNA, 63 nt, Human
guggugagcuccugccugcuggagguugccauggagggccauuccugcccggcaacagcaccg

SEQ ID NO: 434901 - RNA, 63 nt, Human
uggcuuaaagccagaaagagcugagggaguuaagagggccaaccuuagggcacgugggcauua

SEQ ID NO: 434902 - RNA, 63 nt, Human
ggagguccaggccugggcucucgggcccuccuagagggccauuggagcuugcagcucagaccc

SEQ ID NO: 434903 - RNA, 63 nt, Human
aucuuuuauaagaacaguacagauuguucucaagagggccaucagaaggaagccaaagaguuc

SEQ ID NO: 434904 - RNA, 63 nt, Human
guguugguuugaacccugugagccugagacagagagggccaggcaccaaccacaaggcgggaa

SEQ ID NO: 434905 - RNA, 63 nt, Human
gagcuuaaaggcccuggguccugccaguuccaggagggccaugucugugccucuguguacccc

SEQ ID NO: 434906 - RNA, 63 nt, Human
gaaugggcccagugggggcugggcaggcccauugagggccaccgccgagguuucuccuagggc

SEQ ID NO: 434907 - RNA, 63 nt, Human
gcccggcaggcguccugggacagcucaguguuggagggccaccugaaccacgagccagggcug

SEQ ID NO: 434908 - RNA, 63 nt, Human
ggagcugaaggugggggugacacugggaggugggagggccaggccaacuggcugcggccauca

SEQ ID NO: 434909 - RNA, 63 nt, Human
cugcccccaccucgaaacccacaguccccaguggagggccacuacucauccccauugguuucc

SEQ ID NO: 434910 - RNA, 63 nt, Human
cacugauauuuaauccuuaaaaccccuuuaaaugagggccaguauuaucucugcuuucagaag

SEQ ID NO: 434911 - RNA, 63 nt, Human
uggcacauuuaccuguugcuccguccagauguugagggccagucuaggcugacacauccuacc

SEQ ID NO: 434912 - RNA, 63 nt, Human
cacgcacauccagcccugguaccugcggguggagagggccaucaccgaggccuccccagcgca

SEQ ID NO: 434913 - RNA, 63 nt, Human
cugcaucaggcucucugggagaggaggggccuggagggccaggagucccagacucacgcaccc

SEQ ID NO: 434914 - RNA, 63 nt, Human
auugcggagaacaggacagugcccgguccccuugagggccaucacacccagacccaacggguu

SEQ ID NO: 434915 - RNA, 63 nt, Human
gucugccauuccugcuuggggacugguggggaagagggccaggacaucuucugagccaggacg

SEQ ID NO: 434916 - RNA, 63 nt, Human
aaaaucgcgaguguuucgcggguaacugggguugagggccaaaauauuuggaaugaaggacuu

SEQ ID NO: 434917 - RNA, 63 nt, Human
uccccaacaacccagagcagguguugcagacaggagggccacagcguguggaaguaaagacuu

SEQ ID NO: 434918 - RNA, 63 nt, Human
gguccccccuccauaaggacgucaaacuuccaggagggccaguguuccuagugugggccagga

SEQ ID NO: 434919 - RNA, 63 nt, Human
agugaaggcuucucucugugggaugggaugguggagggccacaugggaggcucacccccuucu

SEQ ID NO: 434920 - RNA, 63 nt, Human
ccugugguggcauugggagaguucccccaugaugagggccaagauagaaucuguaccacucag

SEQ ID NO: 434921 - RNA, 63 nt, Human
caggcccgugccugguuuugcgucuguuccccugagggccaucgucauccuggagcuucaaug

SEQ ID NO: 434922 - RNA, 63 nt, Human
ccuuguuugggguucuguggguuugggugggaagagggccaucugccugaauguaaccugcua

SEQ ID NO: 434923 - RNA, 63 nt, Human
ugcugggguccccucauccacuugagggcgccugagggccaggagcagcaggcaaggagccug

SEQ ID NO: 434924 - RNA, 63 nt, Human
aaccaggcagagugggaacuugaaacuguugcugagggccacccggggcuucuugguccacuc

SEQ ID NO: 434925 - RNA, 63 nt, Human
aaccaggacccagaagcaccuccuuuguagacagagggccacggcugcgugcgauccaggccc

SEQ ID NO: 434926 - RNA, 63 nt, Human
gugaaagagcaucaggagauacugacuguaccugagggccaaaacaggagcagguaacgaacc

SEQ ID NO: 434927 - RNA, 63 nt, Human
auaaugugaaauauuuuuuuguggugauaaaaagagggccaaggagguaugagccaucagacu

SEQ ID NO: 434928 - RNA, 63 nt, Human
cuugagcugcuuuggagacucggcugccagagggagggccaugggccgaggccuggcauucac

SEQ ID NO: 434929 - RNA, 63 nt, Human
cauggccuugccucgguggcccugacugucagggagggccagggaggcagagcgggagggagu

SEQ ID NO: 434930 - RNA, 63 nt, Human
cugcgccuuccccccuaccgccucaccucacaggagggccaggcauguauuccucagaggcga

SEQ ID NO: 434931 - RNA, 63 nt, Human
ccaggacccgucccaauaaccacccacggccaggagggccaaggccccgugcuggauauuuaa

SEQ ID NO: 434932 - RNA, 63 nt, Human
ucuccacccccccgggacuguuggggggauucugagggccagagggggauauauaugauuccc

SEQ ID NO: 434933 - RNA, 63 nt, Human
cucgugcugggcucugcccugggcagacaggcagagggccagagcagaggacacauggccuug

SEQ ID NO: 434934 - RNA, 63 nt, Human
gacacagcugggucuggaccccacggggcuggggagggccaugugcaauauuuggaggguuuu

SEQ ID NO: 434935 - RNA, 63 nt, Human
uggagccugagggugccugcccugcucuggagggagggccaggagcugccacacccccaaguc

SEQ ID NO: 434936 - RNA, 63 nt, Human
agggacagccuggggcugacagggcuccccuccgagggccaguuucaggucuggaaggggagg

SEQ ID NO: 434937 - RNA, 63 nt, Human
cuacugugagccccgggccagagaagagcccgggagggccaggggcgugcaugccaggccggg

SEQ ID NO: 434938 - RNA, 63 nt, Human
gauuguggucacauuggggcuuguuuaggauuggagggccaggucaccuccccagccacccuc

SEQ ID NO: 434939 - RNA, 63 nt, Human
ccuuuuguucuggguggaagcagcggugccgcggagggccagccagauccggacccuucccuu

SEQ ID NO: 434940 - RNA, 63 nt, Human
cuucgguuuguugaacuuuggcagccaguuggugagggccagauguuauucccuuucuuaaag

SEQ ID NO: 434941 - RNA, 63 nt, Human
ggugaguccugccccggcugugccagggugagggagggccaagcccaggaggauuugucugag

SEQ ID NO: 434942 - RNA, 53 nt, Human
ccaagggugccaagcugugaugagagggccaccgcagagcccaggaggcagca

SEQ ID NO: 434943 - RNA, 63 nt, Human
cacaguaaauacuaagauggcauuucuaucucagagggccaaagugaaucacaccaguuucug

SEQ ID NO: 434944 - RNA, 63 nt, Human
cuccugcuccccucgccugcacacccccuuucagagggccacuggguuaggaccugaggaccu

SEQ ID NO: 434945 - RNA, 63 nt, Human
ucccaccccauuaagacucaccaggagaggucugagggccauucagaacccacuccugagugg

SEQ ID NO: 434946 - RNA, 63 nt, Human
uguuccugcaccacaucagauaagcaugugaaggagggccaacuggcagcugcgggacccuug

SEQ ID NO: 434947 - RNA, 63 nt, Human
agaguggguguuccuucgagccccuuccacucagagggccacacccagcgaugccagugaagg

SEQ ID NO: 434948 - RNA, 63 nt, Human
ggagaguaaauaaucuagaggcaagaguucagugagggccaagggggacccccagaaaaaggu

SEQ ID NO: 434949 - RNA, 63 nt, Human
uuugcugauggagggcacucaagggcugggugagagggccacguguuugguauuacauuacug

SEQ ID NO: 434950 - RNA, 63 nt, Human
aauucuccuuguaagccuugaagaaguaugugagagggccacauuggcuaaaaccuaaaggug

SEQ ID NO: 434951 - RNA, 63 nt, Human
accucacuggucccucucccggaggcccuuguagagggccacguccauaaauuuucuuaugga

SEQ ID NO: 434952 - RNA, 63 nt, Human
gccuccuccccaccuccccacccuggaaccccugagggccaaacagcagaguggagcugagcu

SEQ ID NO: 434953 - RNA, 63 nt, Human
gucaccucugugacggucaccacugcucccuuggagggccacuugaguuacuguugcuuccuc

SEQ ID NO: 434954 - RNA, 63 nt, Human
guccccguuacucuuagagaaaggaguuggggugagggccagagcuggcaguggaaacuuguu

SEQ ID NO: 434955 - RNA, 63 nt, Human
agucuguuucaggccaggaggaggggauuugcugagggccaaggggguucugggacagagucu

SEQ ID NO: 434956 - RNA, 63 nt, Human
augucaggcuggccccgaaucauagcucccugagagggccaagcagagaguacuggaaaccuc

SEQ ID NO: 434957 - RNA, 57 nt, Human
ugauuguugcagaggccuagaugcucugagggccauucacaauucucagggcucagc

SEQ ID NO: 434958 - RNA, 63 nt, Human
ugaguacuugcugaaguaguugccuuguauuuugagggccaugguggaugaaaaugaugucug

SEQ ID NO: 434959 - RNA, 63 nt, Human
cacauuuccuuggguuggagcaacagucccagagagggccacggugggagcugcgcccuccuu

SEQ ID NO: 434960 - RNA, 63 nt, Human
ucauucuuaccaccuggccugcaaaguuugcaggagggccagguauauucacuugugucuucu

SEQ ID NO: 434961 - RNA, 63 nt, Human
cccccuguccccaccccaggagaguaaggggacgagggccagcucucuggcaucaggcugcuu

SEQ ID NO: 434962 - RNA, 63 nt, Human
gauuguuguggucaaugaaauacccaguuucuggagggccaggugggaaaugcuuucacugga

SEQ ID NO: 434963 - RNA, 63 nt, Human
cuguggcaacuguaaucacagagccagaagccagagggccagggauaugagaggcugacaaac

SEQ ID NO: 434964 - RNA, 63 nt, Human
ccuuucuaacgagagucucaaacaagcggaggcgagggccaauucaaccccauucuuuccagc

SEQ ID NO: 434965 - RNA, 63 nt, Human
aguucuccuguggcaguggcgauguggcauccagagggccauuguuucuacuuuugugggacu

SEQ ID NO: 434966 - RNA, 63 nt, Human
cuucauguggcuucccuuuucuuuguucaagaugagggccaggaggggaaacaucacaccugc

SEQ ID NO: 434967 - RNA, 63 nt, Human
ccugccucugccuccaggcaugcguuuccccgugagggccaaugcaccuccccccacccccca

SEQ ID NO: 434968 - RNA, 63 nt, Human
acaaagcucaauaggagggauguuccaguggaugagggccaccaggaagcacagguccaaggc

SEQ ID NO: 434969 - RNA, 63 nt, Human
ccacucuauugaauggcauggcccagacccucggagggccaggcaacaggcuagcaaggccca

SEQ ID NO: 434970 - RNA, 63 nt, Human
auaauccgaaaaguucgcuuugauauauuccuggagggccaagcccaucuauuuacaaaaggu

SEQ ID NO: 434971 - RNA, 63 nt, Human
aggguguuuuggguggcauagagguuuuguauugagggccagugaugauguuuugauauuuau

SEQ ID NO: 434972 - RNA, 63 nt, Human
caguuccucccaaccaaccagucuucacuucaagagggccacacugcaaccucagcuuaacau

SEQ ID NO: 434973 - RNA, 63 nt, Human
gaauuaagagauaugauguauaaaauagacaucgagggccauuaagagaguaaauacuuaaaa

SEQ ID NO: 434974 - RNA, 63 nt, Human
auuuugaugcaaaggaacggcccugggaccucagagggccacagaugggcuuccugggccuag

SEQ ID NO: 434975 - RNA, 63 nt, Human
uucucagcuccagcuucaaaccucgagucucgagagggccacggggugguuuuuaugaccgga

SEQ ID NO: 434976 - RNA, 63 nt, Human
aggcuucugagcuucuccuguacugugcaucgugagggccagagacaggaauguaaggauugg

SEQ ID NO: 434977 - RNA, 63 nt, Human
aaugugcuucugcuucuacagcaauggcugcaggagggccauugggcaugucaggguuuggcc

SEQ ID NO: 434978 - RNA, 63 nt, Human
cagagacaauacaaaaccccucacuuccucugagagggccaaaugcugugagucugaaguaug

SEQ ID NO: 434979 - RNA, 63 nt, Human
cuggagcaagucucccagaugauucuaauacaggagggccagaggccaaacuugaagaacugc

SEQ ID NO: 434980 - RNA, 63 nt, Human
gcugaagccucuguccacacaugcacaccagaugagggccaugugcgcacacgagguggcugu

SEQ ID NO: 434981 - RNA, 63 nt, Human
caguauacaagauuauacaaucucuuuauuacugagggccaccaaauagccuaggaagugccc

SEQ ID NO: 434982 - RNA, 63 nt, Human
ucccagccaaaugucugugcucucugugucacugagggccacagguuccucuaacaucuguca

SEQ ID NO: 434983 - RNA, 63 nt, Human
ggccuggcccguggagcugccacgcaggugccugagggccaggugccacgcaggugucugagg

SEQ ID NO: 434984 - RNA, 63 nt, Human
ccuccucgugaccucggccagcuggacccacaugagggccaccucuggaaccuucuucgaggc

SEQ ID NO: 434985 - RNA, 63 nt, Human
acauguaccaccuacaagugucagaagacacuggagggccaugauggcaucgugcuggcucuc

SEQ ID NO: 434986 - RNA, 63 nt, Human
cagcauagcuacaggaaaagucagcccuugacugagggccagaucaucccuggagugcaccuc

SEQ ID NO: 434987 - RNA, 63 nt, Human
agccugggcacccgcggggccgucccgccugcagagggccacucggggggguuuccaggcuua

SEQ ID NO: 434988 - RNA, 63 nt, Human
gcaccugcuuggcccugccaccuuccuccaggggagggccagauggcauccuggcuuggggcg

SEQ ID NO: 434989 - RNA, 63 nt, Human
gcaguggagaucaggagugacagaucacagggugagggccaccuccacacccacccccucugg

SEQ ID NO: 434990 - RNA, 63 nt, Human
cagggagccuuccuggucccaggaccucugguggagggccauggcguggaccuucacccuucu

SEQ ID NO: 434991 - RNA, 63 nt, Human
cuaggcagagaggaggagagguguugccggcuggagggccaaccagugaacaccagcugugaa

SEQ ID NO: 434992 - RNA, 63 nt, Human
agaaguugggcagagagaggcagggaggccagugagggccagggagugaguguuagaagaagc

SEQ ID NO: 434993 - RNA, 63 nt, Human
auacacuuuggccuuccuuuccccagcgccccugagggccagaggcagaugugggcugcaggc

SEQ ID NO: 434994 - RNA, 63 nt, Human
gggggcucugcuuugcgucuaaccuuugugggggagggccagcaaggcaguccccccacgccc

SEQ ID NO: 434995 - RNA, 63 nt, Human
caccgcaacaagcgggccgccccagccaccuccgagggccagagcaagcgcuguaaacccuga

SEQ ID NO: 434996 - RNA, 63 nt, Human
uuugcacugaggacacagaucccggggagcugugagggccaccggugggcaguggguggaucc

SEQ ID NO: 434997 - RNA, 63 nt, Human
cgcucaguauuacuuucugccgcugucaaggccgagggccaggcagaauggcugcacguaggu

SEQ ID NO: 434998 - RNA, 63 nt, Human
uagaguaguugaaaucuuuaggaaugaacuucugagggccaaaaaaugugacugacgggaaca

SEQ ID NO: 434999 - RNA, 63 nt, Human
augcuagggacgcuugagugagggagguggugugagggccagguuuccugaaaggcgggaguc

SEQ ID NO: 435000 - RNA, 63 nt, Human
ucuccgcagaaggcuugccggagacgccguggggagggccauuugaacauuacauccaaucaa

SEQ ID NO: 435001 - RNA, 63 nt, Human
ugggacauaagccuuugccccacaagcuguggagagggccaaaaccaagcugcuugagcccac

SEQ ID NO: 435002 - RNA, 63 nt, Human
gaggacuuguauggagaaauuuaagucuucacugagggccacuuuacaaaggaaauuugaaua

SEQ ID NO: 435003 - RNA, 63 nt, Human
cccuucggugugaccggcagccuggcugaccgugagggccagagagagccuucacggacggcg

SEQ ID NO: 435004 - RNA, 63 nt, Human
ugaaaacucugguacgaaucucaucccucaacugagggccagggacccaggugugccugugcu

SEQ ID NO: 435005 - RNA, 63 nt, Human
acaccugggggacagaggcagauaagaaggugcgagggccacagcccugggaggggguccuga

SEQ ID NO: 435006 - RNA, 63 nt, Human
gcugcuguguugguugaggaaaaccucgggccugagggccaggccggagcccaggucucugcu

SEQ ID NO: 435007 - RNA, 63 nt, Human
uagaugacugaguuuuccuuuaggaaaacucccgagggccaaacuggaaacauaagagugacu

SEQ ID NO: 435008 - RNA, 63 nt, Human
gcaaagaaguggccuccuggggggccaggccacgagggccagggcuucugccugaagauggag

SEQ ID NO: 435009 - RNA, 63 nt, Human
uaccuguacuaugaugggcuucuguucucugcugagggccaauacccuacuguggggagagau

SEQ ID NO: 435010 - RNA, 63 nt, Human
uaggcucugaaaucuugggcaaaaugacaaggggagggccaggauuccucucucaggucacuc

SEQ ID NO: 435011 - RNA, 63 nt, Human
uaacaaugcccagugacugucgcacuugaguuugagggccagugggccugaugaacgcucaga

SEQ ID NO: 435012 - RNA, 63 nt, Human
gacugggaagaucuagccuaaagaggcuucucugagggccagggcccuacagcaugccccuac

SEQ ID NO: 435013 - RNA, 63 nt, Human
acaugcugucuggcccuggggaucuucccacaggagggccagcgcuguggaccuuacaacgcc

SEQ ID NO: 435014 - RNA, 63 nt, Human
cccucuguugccaucagcuugauuggcuuccccgagggccagcagggcugggggcuccggaga

SEQ ID NO: 435015 - RNA, 63 nt, Human
cuuuggggagggacccauguccauggcuucguugagggccauccauaugccagcugggggcca

SEQ ID NO: 435016 - RNA, 63 nt, Human
agggugguucuggagccauugugggugagggucgagggccaccgaggucccgcgcaccgcugc

SEQ ID NO: 435017 - RNA, 63 nt, Human
uaacuaaugggauccagcagggccauuucuccagagggccaguauccuauuaggagacucuug

SEQ ID NO: 435018 - RNA, 63 nt, Human
uagcgggcuggguggaccccucgccuccuccccgagggccaaugccgcggacacguuuucacu

SEQ ID NO: 435019 - RNA, 63 nt, Human
cuuccagaaaggccaggcggaagccaaggucaagagggccaucccuaagccuccgcgccaggc

SEQ ID NO: 435020 - RNA, 63 nt, Human
uccccagaccaacccugggaccuauacagaacagagggccagagcuagggcugcugcuucugc

SEQ ID NO: 435021 - RNA, 63 nt, Human
aggcuggagaagacaccagggcugacuuugaccgagggccauggacgcgacaggccuguggcc

SEQ ID NO: 435022 - RNA, 63 nt, Human
agaucauggcuuuuggagggaggugaguuuagggagggccaggaccauccuccuaccccucau

SEQ ID NO: 435023 - RNA, 63 nt, Human
accgagggucccugcaggcucccugggcagggagagggccaaggacaauugggagggcagcag

SEQ ID NO: 435024 - RNA, 63 nt, Human
ccugcccaccgggcuccacuuggagaucagcaggagggccagugugggaccccugcugccacc

SEQ ID NO: 435025 - RNA, 63 nt, Human
uaaaguagaaggaucaggacuggcaggggauaugagggccaguguagagauuaaacagaauaa

SEQ ID NO: 435026 - RNA, 63 nt, Human
gcacauauguuuggagaaauagaggagagaaaagagggccacguaacugagagcuuacagugc

SEQ ID NO: 435027 - RNA, 63 nt, Human
augaaaacauucaagcagaacuagguagaaacagagggccaaaauugaaugcuaugcuuagau

SEQ ID NO: 435028 - RNA, 63 nt, Human
acuccugaugcccauuggucaccagauaucucugagggccaagcuaugcccaggaauguguca

SEQ ID NO: 435029 - RNA, 63 nt, Human
cacacucucccucaucuuucgugcccauucacugagggccagaaugacugcucacccacuucc

SEQ ID NO: 435030 - RNA, 63 nt, Human
ggaggggaagcuuuauuuauagaaaugacaauagagggccacggggaggcccccccagaagca

SEQ ID NO: 435031 - RNA, 63 nt, Human
uucguugugcagccuggccccccagggaccccagagggccagggcgcuagaugcaaggugcua

SEQ ID NO: 435032 - RNA, 63 nt, Human
cuggcugagggcguuaggggcugugccucuugugagggccauuugggaccucccuggggcacu

SEQ ID NO: 435033 - RNA, 63 nt, Human
gucugacugcuugguggcaggcacccugccugugagggccacuuuccucuucuaguagcuguu

SEQ ID NO: 435034 - RNA, 63 nt, Human
uucuuuagccgggcagcuguuugggggacaagagagggccagggucugugcuucugcucccgg

SEQ ID NO: 435035 - RNA, 63 nt, Human
gcgccauuuuugugcuuuuauguuuaauuuuaugagggccacgggucuguguucgacucagcc

SEQ ID NO: 435036 - RNA, 63 nt, Human
uccaacucucgggacgccaaggccgcaggacuggagggccaggccccgccacccccacgggag

SEQ ID NO: 435037 - RNA, 63 nt, Human
gcggccucagaccuagaagcucaaccccccuaugagggccacguccugggguagcuccugacc

SEQ ID NO: 435038 - RNA, 63 nt, Human
cacgcaggaaccgacacucagacacaaggcaaagagggccacaggacccgggaaauacacaca

SEQ ID NO: 435039 - RNA, 63 nt, Human
agggaaugagccaggcacgggggcaugggcagagagggccacggggcagggcccacugaggga

SEQ ID NO: 435040 - RNA, 63 nt, Human
cuccacacagccggagcugcccuagggagccuggagggccagcuuguaaagaugaugggguuu

SEQ ID NO: 435041 - RNA, 63 nt, Human
ggacucccacaacaacaaaagcuugaagcuguggagggccacgguggcguggcucuccucgca

SEQ ID NO: 435042 - RNA, 63 nt, Human
gaauuuggguaaaggcagagggaagggguggaggagggccagcucaguugccgaaacucugga

SEQ ID NO: 435043 - RNA, 63 nt, Human
aaggcagccgaacugaggauuuagacugguucugagggccagggcaaaugaaggcgcaugucu

SEQ ID NO: 435044 - RNA, 63 nt, Human
aguaucucugagggagucccagacacaggcagagagggccacauaucgugugccagaggcuga

SEQ ID NO: 435045 - RNA, 63 nt, Human
cccaccccaccccaccauguccccauuacaccagagggccaucgugacguagacaggaugcca

SEQ ID NO: 435046 - RNA, 63 nt, Human
ucuggcgccuccaauccagacccaccacagcuggagggccaggccuccucuuccccaggcugc

SEQ ID NO: 435047 - RNA, 63 nt, Human
gcacaccucacacgggaccacagccgcgcugccgagggccaagcacaaagguuccagugagcg

SEQ ID NO: 435048 - RNA, 63 nt, Human
agcccagccuguggcugcccccgacaccaggaggagggccaggagaguuccagggggcugagg

SEQ ID NO: 435049 - RNA, 63 nt, Human
augggcuggaaggagggcgaggggcugggcucagagggccagggcaucaagaacccagugaac

SEQ ID NO: 435050 - RNA, 63 nt, Human
cugaagguguccacagccgggcagguggucacugagggccaugacgcggggcugaggaugccu

SEQ ID NO: 435051 - RNA, 63 nt, Human
caggggggcccgaggcaggguccaaaccugagugagggccagccaugccuccccucccauucc

SEQ ID NO: 435052 - RNA, 63 nt, Human
ccccaaggucuacucccuccucaccccacccuggagggccaggggaguggagagagcuccuga

SEQ ID NO: 435053 - RNA, 63 nt, Human
guugugagccgcuagugauggagagcagagggagagggccaggcuccagacucccacacgccc

SEQ ID NO: 435054 - RNA, 63 nt, Human
ccagcuggacaaauugcagggaggggagggagcgagggccaacccggccccucuguccccuug

SEQ ID NO: 435055 - RNA, 63 nt, Human
ucauuaagaguagugaugggaagauuacagucugagggccaaacgugccugcuuccuguuuuu

SEQ ID NO: 435056 - RNA, 63 nt, Human
uucuccaguuguauggagccucuucugccaagagagggccaugcaauucaucccagaggaacc

SEQ ID NO: 435057 - RNA, 63 nt, Human
uuugcccauccucuuugcccccucaggagugcugagggccaguguugacccacacuacccucc

SEQ ID NO: 435058 - RNA, 63 nt, Human
cacacccuucacccucuguguccugguccuucugagggccacugcagaugacucuccuuugaa

SEQ ID NO: 435059 - RNA, 63 nt, Human
cacuccagugguaucagucucuuuauuggaugugagggccaaaagggacuguaacuccugucu

SEQ ID NO: 435060 - RNA, 63 nt, Human
uaaguggggaggagggucagcuaagagaagugggagggccagagcuuuuugguucugauuuac

SEQ ID NO: 435061 - RNA, 63 nt, Human
uugccuagaauaggcugcaugguguaugucagugagggccacgaggcgucggcuuuagacaca

SEQ ID NO: 435062 - RNA, 63 nt, Human
ucuucacccgcugcagccguuccgucccaaacagagggccacacagauaccccacguucuaua

SEQ ID NO: 435063 - RNA, 63 nt, Human
uagaaaauuagauuuugcuaugagccauuuccugagggccaauuuaauacucgugugacucuu

SEQ ID NO: 435064 - RNA, 63 nt, Human
ucucugggcccuugugcuuccuguggguggggugagggccaaaggcuaugguuuccugccucc

SEQ ID NO: 435065 - RNA, 63 nt, Human
ucucaugcccaggugggugcucugggcuggagcgagggccagguuuugggccgaggcuucccc

SEQ ID NO: 435066 - RNA, 63 nt, Human
aaaggaagggcagacccgugucuuuccaugcccgagggccacgacgucacuaugcagggcaca

SEQ ID NO: 435067 - RNA, 63 nt, Human
ggguaggagcagcuuugugucacuaaagaaagugagggccacugucuccggcgggugaggcug

SEQ ID NO: 435068 - RNA, 63 nt, Human
cccuggagccaccgcggguccuuccccggccccgagggccaaggggguccccgcccgccagug

SEQ ID NO: 435069 - RNA, 63 nt, Human
acuguggguaccuggugaucagggcaagcuguggagggccagggguggggcugagacugggcu

SEQ ID NO: 435070 - RNA, 63 nt, Human
ggccugggcacuugugcacccauguaggagcaugagggccacacucuuuucaccucaaagccc

SEQ ID NO: 435071 - RNA, 63 nt, Human
aagguaggccaacugcaccccugucgccuggaggagggccagcucgcugcccgagcucuggcc

SEQ ID NO: 435072 - RNA, 63 nt, Human
ggggugggguacaaccaccaugacaacugccgggagggccacgcaggucguggucaccugcca

SEQ ID NO: 435073 - RNA, 63 nt, Human
gcuggcacugaagauggcugaggagucagagaggagggccaaagaggcagaucagcugaagca

SEQ ID NO: 435074 - RNA, 63 nt, Human
cugucacaggacccaccuccaugccaggcaacagagggccacagaaccacccccacggcucac

SEQ ID NO: 435075 - RNA, 63 nt, Human
agggaaaugacccacagggaucgcagcugcagggagggccagggagguugggggugggaguga

SEQ ID NO: 435076 - RNA, 63 nt, Human
ccucagccaggaccaucgcccuuucucagagcagagggccagguauagaaaccgcagugggcc

SEQ ID NO: 435077 - RNA, 63 nt, Human
uccccagggccuuuguggacuagccaaggcugugagggccagaauaaacaacugcucaacaaa

SEQ ID NO: 435078 - RNA, 63 nt, Human
ugaugccaaagccccauggauucaggugcagaagagggccaggacuaggucuucugcccuuuc

SEQ ID NO: 435079 - RNA, 63 nt, Human
augaacugacauuccacauccugcccacccucugagggccaagcugccuggccacugggcugg

SEQ ID NO: 435080 - RNA, 63 nt, Human
ugcaucccaagccccucaugcuccugccuuccugagggccagaggggagccccaggacccauu

SEQ ID NO: 435081 - RNA, 63 nt, Human
ccccugggaaaaccgaagccagcaagaccaggagagggccaccucacugggccugccuccccc

SEQ ID NO: 435082 - RNA, 63 nt, Human
auuguuuccuccuuaaaucguuuagcauggcaugagggccacauuccauggacgggaagaccc

SEQ ID NO: 435083 - RNA, 63 nt, Human
agcgaugcugaguuucacacguaccugaaccacgagggccagcucucccgacccgaggaguug

SEQ ID NO: 435084 - RNA, 63 nt, Human
cuugccucacccauccucgcugucauggaccaugagggccaugccuuuguuugcuuuuguggc

SEQ ID NO: 435085 - RNA, 63 nt, Human
caucggccccaccagaucuccauucuuugccaugagggccaacacaugagaccccaccucccu

SEQ ID NO: 435086 - RNA, 63 nt, Human
caugaacaggcagauugaaaucaccagugacaugagggccauucuuguggacugguuggugga

SEQ ID NO: 435087 - RNA, 63 nt, Human
gcugggucugugaaaaacaguggacagcaccccgagggccacaggugagggacacuaccacug

SEQ ID NO: 435088 - RNA, 63 nt, Human
uucucacucaccauccuguugggauuaacaguugagggccaucgcugccuaaacauuuagcgu

SEQ ID NO: 435089 - RNA, 63 nt, Human
guucuuuggguaaauugaggaacauggaaaauggagggccaccacuuagguuccauggagaau

SEQ ID NO: 435090 - RNA, 63 nt, Human
uuucaacucuucccugaacuuccugcuuccucagagggccauugaacucugagagauuugggg

SEQ ID NO: 435091 - RNA, 63 nt, Human
gguugcagauguccuugaagagagugaggcauugagggccaauaggagcaauggggucccugg

SEQ ID NO: 435092 - RNA, 63 nt, Human
gagugguugguaaaaucaauagauuucaggcaagagggccagauaccuaacagguuuuucucc

SEQ ID NO: 435093 - RNA, 63 nt, Human
guuugaacagggcaguuuagguucuagguaguggagggccagguggggcucgaggaacguagu

SEQ ID NO: 435094 - RNA, 63 nt, Human
cgagagcgacccugagcucuucagccagauccugagggccagcuaugaguuugacucuccuuu

SEQ ID NO: 435095 - RNA, 63 nt, Human
gccagcuccgcccucccaaggcugugcguuccugagggccaggucgggggcaggcauggaggg

SEQ ID NO: 435096 - RNA, 63 nt, Human
ccacuugguccccagccauggacucuauacagugagggccacucaccgaccugagucaguguc

SEQ ID NO: 435097 - RNA, 63 nt, Human; identical to SEQ ID NO: 435088

SEQ ID NO: 435098 - RNA, 64 nt, Human
ucuuaccgugccuauuaccaagcgaguguuuguaaccauguaguuuuggaacccacugcaaaau

SEQ ID NO: 435099 - RNA, 64 nt, Human
gcagcugcccugauggugcaggugcagggaggugaccauguaacucugaccaaucugggaagug

SEQ ID NO: 435100 - RNA, 64 nt, Human
gcauuuauccuucauaccaauuguaacaucugacaccauguagaagcuaaaaguuuagagggag

SEQ ID NO: 435101 - RNA, 64 nt, Human
gguaucgucuuucagaaugucuccuggcauccuaaccauguaauaugacaauuggggguggggu

SEQ ID NO: 435102 - RNA, 64 nt, Human
uuuaaaaucacaaacauuaacggcaguaggcaccaccauguaaaagugagcucagacgucucua

SEQ ID NO: 435103 - RNA, 64 nt, Human
aaucugaaagccaugcgugucgguguauauaggaaccauguacagagcccagagaagcccccua

SEQ ID NO: 435104 - RNA, 64 nt, Human
uccagaguagugacauuucugugcuccuaccaucaccauguaagaauucccgggagcuccaugc

SEQ ID NO: 435105 - RNA, 64 nt, Human
aguauaugugcagucuugcuuacaaggagggguuaccauguaucacaccuaaucuucccaaugu

SEQ ID NO: 435106 - RNA, 64 nt, Human
caauacggguggugcugauuauuauaguacauauaccauguaaacucucaaacucuauuuagcu

SEQ ID NO: 435107 - RNA, 64 nt, Human
ugggcauagggacccaucauugaugacugaugaaaccauguaauaaagcaucucuggggagggc

SEQ ID NO: 435108 - RNA, 64 nt, Human
gucccuacauagcaauuuucuguggcacugagaaaccauguaugaccacaauaaaaauccauuu

SEQ ID NO: 435109 - RNA, 64 nt, Human
aagagauguucaauuucaauaaaauaaauauaaaaccauguaacagaaugcuucugaguauuca

SEQ ID NO: 435110 - RNA, 64 nt, Human
uuguaaagauugagcauuggaagggguaucagagaccauguaguucaacuuuccacucaaagua

SEQ ID NO: 435111 - RNA, 64 nt, Human
caccuccuagguaggcucaaagguagacccguuuccaccgcagcaggugaacaugaccguguuu

SEQ ID NO: 435112 - RNA, 64 nt, Human
gccucugcucugaccucagcagcuacaccuaaccccaccgcacccuacccagugucgauaucca

SEQ ID NO: 435113 - RNA, 64 nt, Human
ugcccgcgugucagacuccaucccuccucugccgccaccgcagcagccacaggcagaggaggac

SEQ ID NO: 435114 - RNA, 64 nt, Human
ugcccuuuaauacacuccuaucaucagcacuuccaccauguauuacaagucuugacccaucccu

SEQ ID NO: 435115 - RNA, 64 nt, Human
cagcauacuucaaaacuguuuguuaucucuuguuaccauguauguauaaauggaccuuuuauaa

SEQ ID NO: 435116 - RNA, 64 nt, Human
aauacuucucucagcaguugaucaaauacaauagaccauguaagcuggggccgcucauccacuu

SEQ ID NO: 435117 - RNA, 64 nt, Human
gcuccugcgggcucaccaggcugcuggcuccgguaccauguaaaccuaggaagguaaaggagca

SEQ ID NO: 435118 - RNA, 64 nt, Human
cucacuggagacucagaaggggaagcauugggaaaccauguauguuucauuucugguuuaacca

SEQ ID NO: 435119 - RNA, 64 nt, Human
auaacuacuucugaacuccugagaucuaguggauaccauguauccuggaagauaggacacuuuc

SEQ ID NO: 435120 - RNA, 64 nt, Human
cggccugguuucgccuggucgugucuuuaugagcaccauguaagccuccuuguauugagauaau

SEQ ID NO: 435121 - RNA, 64 nt, Human
gaucauuucagagugugcgaaauaauagucuuuaaccauguaauuaaauauguguguuuauugu

SEQ ID NO: 435122 - RNA, 64 nt, Human
ugagaauaaugaaaaucauauuucagaaaauauuaccauguaaauauguacauauguagucuag

SEQ ID NO: 435123 - RNA, 64 nt, Human
aggaaagugguuuagcacgaagaggccccuuauuaccauguaucccacugauaggagguguugg

SEQ ID NO: 435124 - RNA, 64 nt, Human
gaugcauuguuugcuucagauccaugguguuaauaccauguauauuuuauaaagauaauuuggc

SEQ ID NO: 435125 - RNA, 64 nt, Human
uucuccccugcagcuuccucugcuucuggaaugaaccauguauccuggagacccucccaaugga

SEQ ID NO: 435126 - RNA, 64 nt, Human
uaacgcuacggccccaggucacugcgaggcacuuaccauguagauacgggcucaaaagucaccu

SEQ ID NO: 435127 - RNA, 64 nt, Human
auuauggaagauuuuaaauucacaauagaaacucaccauguaaaagagucaucugguagauuuu

SEQ ID NO: 435128 - RNA, 64 nt, Human
cuauauaaagcaaauaaacuuaaaacacuuuguaaccauguauuuacucugccaggugccuaua

SEQ ID NO: 435129 - RNA, 64 nt, Human
uucuuccuagcccuucuuacaaacaaguuugaggaccauguagccuuuaagaaggaauuaagag

SEQ ID NO: 435130 - RNA, 64 nt, Human
ugaccguggccaccuggacccaggccaggcccggcccggcgaguggucaagggacagggaccac

SEQ ID NO: 435131 - RNA, 64 nt, Human
agaguugcugguagcaggcucccuccuucugcagcccggcgaaugggggcgcugggcucuguuc

SEQ ID NO: 435132 - RNA, 64 nt, Human
gagaauggggccgcuugggggagggaagaggcagcccggcgaggggcaagcgggggacccagcc

SEQ ID NO: 435133 - RNA, 64 nt, Human
ucucugaagacaguagccaagauuauucacacauaccauguauuauuuuauaugagauaauuua

SEQ ID NO: 435134 - RNA, 64 nt, Human
auguuaaagcaagugugguuuauuuauggcaugaaccauguaacuugaaauaugaacuuacaag

SEQ ID NO: 435135 - RNA, 64 nt, Human
caugaagaaagaaauugauagguguaaaugagagaccauguaaaauauguaaauucuaguaccu

SEQ ID NO: 435136 - RNA, 64 nt, Human
ucaugaaugcaugcucaguuuauuaaaauccauaaccauguaauucuuguaauauguugauuca

SEQ ID NO: 435137 - RNA, 64 nt, Human
cagcaaaaacaaaaccaccaccaccccagagaaaaccauguacuaauuggagugggguaccccc

SEQ ID NO: 435138 - RNA, 64 nt, Human
agcucagcccauuucuuuauugcaucuguuauucaccauguaauucagguaccacguauuccag

SEQ ID NO: 435139 - RNA, 64 nt, Human
acuucugccuuauggcuagggaacugucaugucuaccauguauuguacauaugacuuuauguau

SEQ ID NO: 435140 - RNA, 64 nt, Human
acaggggugaagggauguuguuucuuaaauaccuaccauguaugaagcuauacacagcauauac

SEQ ID NO: 435141 - RNA, 64 nt, Human
aaaaagaaugcaggagugaaauaaccaagucaaaaccauguacuaucuccuuggggguuaggga

SEQ ID NO: 435142 - RNA, 64 nt, Human
aauccacagccaacaaacauagaaacgacaaaucaccauguaacaaccagagaugacugaaacc

SEQ ID NO: 435143 - RNA, 64 nt, Human
uggcaacaaacuacuuuuucaaaccuaaauaggaaccauguaauuucucaaaagugauugaaca

SEQ ID NO: 435144 - RNA, 60 nt, Human
cagcccaaaaugcugaguagcccugaggacaccauguacuauaaccaguuaaaugugagu

SEQ ID NO: 435145 - RNA, 64 nt, Human
ggauuuuuggagaauccaucaugauugguguaaaaccauguauugacaaaguaaguuauuggug

SEQ ID NO: 435146 - RNA, 64 nt, Human
aagucuuacagugccauggcccacauuccaacuuaccauguacuuagugacuugacugagaagu

SEQ ID NO: 435147 - RNA, 64 nt, Human
ugcaaguuuagcuugaauuaagggauuuggggggaccauguaacuuaauuacugcuaguuuuga

SEQ ID NO: 435148 - RNA, 64 nt, Human
uacaggugugucauuuccuuuaauaggaccagggaccauguaacugaggugaggguuguaguag

SEQ ID NO: 435149 - RNA, 64 nt, Human
agggacaggggaccaaggucagggccccccugccccaccgcacccccagaauauaagcuaucaa

SEQ ID NO: 435150 - RNA, 64 nt, Human
uuuacagaggcacccuggugccccgccuggcagaccaccgcacacagaucaagcggggcagcac

SEQ ID NO: 435151 - RNA, 64 nt, Human
cuggccccgcuagcggggccaggagccgggccucccaccgcagcgucccccgccgcgccagucc

SEQ ID NO: 435152 - RNA, 64 nt, Human
aauaaguggcacagcuaauauucccaguaaagauaccauguauaauuuucuacaaccuaagaug

SEQ ID NO: 435153 - RNA, 64 nt, Human
ugucucacuugugcaguguugacaguucauauguaccauguacaugaagaagcuaaauccuuua

SEQ ID NO: 435154 - RNA, 64 nt, Human
uugagaaagacaauuuuaauguuuacaacaauaaaccauguaaaugaacagaauuuugucuucu

SEQ ID NO: 435155 - RNA, 64 nt, Human
ugauucaguuuuuugguuuuuaauaaaucagaagaccauguagaaaacuuuuacaucugccuug

SEQ ID NO: 435156 - RNA, 64 nt, Human
uuaauagugaguuucaggccccugggcauuuuguaccauguaauuauccucuggugaugcuguu

SEQ ID NO: 435157 - RNA, 64 nt, Human
caugggauaauuagcaggcuggucuaccaccuggaccauguaacucuaguguccuuccugauuc

SEQ ID NO: 435158 - RNA, 64 nt, Human
uuuaagguaaauacggguauuguuuuuaauuauuaccauguauuaaauugugggcuuugaaacc

SEQ ID NO: 435159 - RNA, 64 nt, Human
uucacuugauuaaauuuuuuuguuguuguauuaaaccauguacguugcagcuuaacaauaaaaa

SEQ ID NO: 435160 - RNA, 64 nt, Human
aauagccaguauuaucuugcccuuuugaacauuuaccauguacucuagcaagacuggucccucu

SEQ ID NO: 435161 - RNA, 64 nt, Human
uacauuucagcugcaagucagcaauuucccagguaccauguaagcuauaaaacagucauucuua

SEQ ID NO: 435162 - RNA, 64 nt, Human
aaaauguugagucaauuggaauguaauuuauuaaaccauguauuuaaagagauauuuuucuuua

SEQ ID NO: 435163 - RNA, 64 nt, Human
ucagcgugcuaaucaauggcugcagaaaccuaacaccauguaccagcaguggagcugaucccua

SEQ ID NO: 435164 - RNA, 64 nt, Human
caagugucauuuuuuuuuguagagggugauauauaccauguaaaugaacaaagacauuuuaaau

SEQ ID NO: 435165 - RNA, 64 nt, Human
gauauuucucaacacuuaaauucauaaaauuaagaccauguaaggguauguuuuuagagaaaug

SEQ ID NO: 435166 - RNA, 64 nt, Human
ucuuugcucauucacucaguaauacugagcacuuaccauguaccagaauuuuacuaggcacaac

SEQ ID NO: 435167 - RNA, 63 nt, Human
cugcagaagaaugugucugauccucauuuuucaaccauguauucuacucauguugccauuuaa

SEQ ID NO: 435168 - RNA, 64 nt, Human
ccauggcucuggucacccugacccucugcccugcccaccgcaggucccccggggucccggaagc

SEQ ID NO: 435169 - RNA, 64 nt, Human
agcugggcccccugggcagguuccccaccccgccccaccgcauccuucucggagcuggugccug

SEQ ID NO: 435170 - RNA, 64 nt, Human
cagccucccaaagcguugggauuauaggcgugagccaccgcaccuggccagggaaccuucuuua

SEQ ID NO: 435171 - RNA, 64 nt, Human
caggacauggacuggucucucagaccccugggccaccauguaggccaccacuccaggccgugga

SEQ ID NO: 435172 - RNA, 64 nt, Human
aauuuauuuuuugcccuuauucauuucuccagcuaccauguacuauuguuuaauguucaguuug

SEQ ID NO: 435173 - RNA, 64 nt, Human
gccucccaaaguguugggauuacaggcaugagccaccauguagccugaaguuuuucuuagaucc

SEQ ID NO: 435174 - RNA, 64 nt, Human
ccuggaacacagcucugaagagaguuuaguaaguaccauguagguucuggauucuaagcuuaca

SEQ ID NO: 435175 - RNA, 64 nt, Human
gggaccugaaauagucccuccguucuccccuuugaccauguaauaaaugaaccagaagcacuga

SEQ ID NO: 435176 - RNA, 64 nt, Human
auuuauagaaauuuugguacaguguacauugaaaaccauguaaaauauugaagugucuaacaaa

SEQ ID NO: 435177 - RNA, 64 nt, Human
ccugggcagccacuucauauaaagguuacuccagaccauguacaaaacacagccacucuugaaa

SEQ ID NO: 435178 - RNA, 64 nt, Human
uagcaauauagacauucacagcagcucuguggauaccauguaauugucagguaauuucagaaug

SEQ ID NO: 435179 - RNA, 64 nt, Human
guuuuaagcugcaaugcaguagucacgggugguaaccauguagucagguauuguuauuaguacc

SEQ ID NO: 435180 - RNA, 64 nt, Human
uuuacguugaaucagaugcuuugaguuuaaacccaccauguauggaagagcaagaaaagagaaa

SEQ ID NO: 435181 - RNA, 64 nt, Human
acuuuuuuguagcaaauguuaaaaaucacgaguuaccauguauagaauguggacugucauguug

SEQ ID NO: 435182 - RNA, 64 nt, Human
ccuauugggagacaugaaacauauguaauugacuaccauguaauagaacaaacccugccaagug

SEQ ID NO: 435183 - RNA, 64 nt, Human
gaugaguucaugauuuaaaagcaacaaaagggauaccauguagaauugugcaauagucuagcca

SEQ ID NO: 435184 - RNA, 64 nt, Human
uuuaugcauggaagcaucaauaaauuguuuaaaaaccauguauaguaaauucagcuuaacccgu

SEQ ID NO: 435185 - RNA, 64 nt, Human
agugagacagacagauaugaccaaauuuauacaaaccauguaccaacacuugaaagaugggugg

SEQ ID NO: 435186 - RNA, 64 nt, Human
ucaucacaagaagggaguguuucuugugccauuaaccauguaguuuguaccaucacuaaaugcu

SEQ ID NO: 435187 - RNA, 64 nt, Human
cagccucccacagugcugggauuacaggcgugagccaccgcacccggcuugcaauuuagaaagg

SEQ ID NO: 435188 - RNA, 64 nt, Human
cuguucuugggugcauguggguuuucgguuccuggcgguccaggacggggcgggggcuccccuc

SEQ ID NO: 435189 - RNA, 64 nt, Human
aaguagggagaggaauggucucuccccauuccaagcgguccacccaacauggacagucaaggaa

SEQ ID NO: 435190 - RNA, 64 nt, Human
uuagaaagaacauuuuaaaacaaucaguuaauuuaccauguaaaauugcuguaaaugauaaugu

SEQ ID NO: 435191 - RNA, 64 nt, Human
guuauugcuugucagguggacuguuuuggauuuaaccauguaauccaugggaccaauugagagu

SEQ ID NO: 435192 - RNA, 64 nt, Human
guugagugaagcguauuugaaguaacugagaauuaccauguacaucauauuugggauaacauuu

SEQ ID NO: 435193 - RNA, 64 nt, Human
gaauacugcauaugccaaauagcuuuuauaguaaaccauguaaugaacucaaauuuaaauggug

SEQ ID NO: 435194 - RNA, 64 nt, Human
agcuuaauuuuuacauuauacuuaauuuucuaaaaccauguaacuccauugaacacauuuuuca

SEQ ID NO: 435195 - RNA, 64 nt, Human
uguauuaaauagaucaccagcuaguuucagaguuaccauguacguauuccacuagcuggguucu

SEQ ID NO: 435196 - RNA, 64 nt, Human
aaaaacuuuauccauuuccauucuuuauacaaauaccauguaauguguacauauuuaacuaaag

SEQ ID NO: 435197 - RNA, 64 nt, Human
uauuaauuccaggugauuuguuuuuucacaguaaaccauguaaguggaagcuuuacugccaaug

SEQ ID NO: 435198 - RNA, 64 nt, Human
auaauauauugaguaaaagaguauauauguauauaccauguauaugacaggauguuuguccugg

SEQ ID NO: 435199 - RNA, 64 nt, Human
agaaauuuuguaagaaggcaauauuaaccuaaucaccauguaagcacucuggaugauggauucc

SEQ ID NO: 435200 - RNA, 64 nt, Human
auugaauuucuaaauauuuguugugccugucuuuaccauguaacuuaauguuugcaaggccaga

SEQ ID NO: 435201 - RNA, 64 nt, Human
aggaaguaacugaaggccgucucaucccauguccaccauguaggggagggacuuuguucaggaa

SEQ ID NO: 435202 - RNA, 64 nt, Human
agaaaagaagagagaguggcuuugucaguauaaaaccauguaaagucaucaucaagucaucugg

SEQ ID NO: 435203 - RNA, 64 nt, Human
uucuucagauuacaugggauuguaguugggaguuaccauguaacucaaacauaauuaacaugua

SEQ ID NO: 435204 - RNA, 64 nt, Human
uauguugcauuccacuucauuugaaaauaaugaaaccauguaccacuguuuacaucaucuguag

SEQ ID NO: 435205 - RNA, 64 nt, Human
ugacauuagccagugggggcuuaugguugugugaaccauguaugaaaauccagugggccccaac

SEQ ID NO: 435206 - RNA, 64 nt, Human
cugccccuugggccucccacucccauggcucugggcgguccagaaggagcaggcccugggccuc

SEQ ID NO: 435207 - RNA, 64 nt, Human; identical to SEQ ID NO: 303763

SEQ ID NO: 435208 - RNA, 58 nt, Human
ucaccccuggcuuuuaaaaaaaacgaaauaccgacaagccacaaggaccaauguaggu

SEQ ID NO: 435209 - RNA, 64 nt, Human
uguguggcaaucagccccuaccacgagcauuaauaccauguaaagcuggcuuucuggagucugc

SEQ ID NO: 435210 - RNA, 64 nt, Human
gauuuaagaaucuccuccuaccuccugacucagcaccauguaaucauuaaacucucugcugcaa

SEQ ID NO: 435211 - RNA, 64 nt, Human
uuaccuguaauacagucuuguuugucuguuuacaaccauguauuuauugcaauguacauacugu

SEQ ID NO: 435212 - RNA, 64 nt, Human
auuauugaaagccuaugaauuuaaaaccagguuuaccauguaauuuguuuuuaaauuuauguau

SEQ ID NO: 435213 - RNA, 64 nt, Human
gccaacuaggcugagcaaugacagaaccagcugcaccauguaccccaccuucaguuuaaaagaa

SEQ ID NO: 435214 - RNA, 64 nt, Human
ucucuuuauaauuuuacaaauaaaggaaaaaagaaccauguaagauaugugugcccuuccucag

SEQ ID NO: 435215 - RNA, 64 nt, Human
uacauauuguauagauaaaugagugacauuucauaccauguauauauagagauguucuauaagu

SEQ ID NO: 435216 - RNA, 64 nt, Human
gugcgcugggaggcgcaucugcagcacuuacaggaccauguaccgcguuauguggcgggaggug

SEQ ID NO: 435217 - RNA, 64 nt, Human
uuguauuauauuuuauauuuuguaaauacuguauaccauguauuauguguauauuguucauacu

SEQ ID NO: 435218 - RNA, 64 nt, Human
aaguuugcuuucaauaacaguaauguauaauaaaaccauguaaaguuuuguuguauuuugauuc

SEQ ID NO: 435219 - RNA, 64 nt, Human
ugucuuuuuuuuuuuuuuuuaaagaaaaguuauuaccauguauuuugugaggcagguuuacaac

SEQ ID NO: 435220 - RNA, 64 nt, Human
caugccauuccgaccuucaccaagcuuagaagccaccauguauguggaagcagguugcuucaag

SEQ ID NO: 435221 - RNA, 64 nt, Human
gaucauuauauaagaagggaaaugccuggcagacaccauguaaguuauaagugucugucuuauc

SEQ ID NO: 435222 - RNA, 64 nt, Human
ugacugaccuggauauccaugagcugcacugaucaccauguaaggucacauuuaguaaaugcug

SEQ ID NO: 435223 - RNA, 64 nt, Human
ccaaagaagaaauuaaccugcacuuucaaaaaguaccauguauaggaaugaaacauugaggucc

SEQ ID NO: 435224 - RNA, 64 nt, Human
cuuugguuaccagagaaauuuucuuagucauuagaccauguaacaguaauauaucauauguaaa

SEQ ID NO: 435225 - RNA, 58 nt, Human
uucuagugaaguuaaacaaacauugggauaccgacacagacaacuugagacaguuuuu

SEQ ID NO: 435226 - RNA, 58 nt, Human
agccaugcauuuauuauuaaacauuuucuaccgacaaggcacugugcuagguacugua

SEQ ID NO: 435227 - RNA, 58 nt, Human
guaguuggagcauuggggauguuuuucuuaccgacaagcacagucagguugaagaccu

SEQ ID NO: 435228 - RNA, 64 nt, Human
uauuaguugauugcuguaacuuuuucauuuucaaaccauguacaauucuuguauagaccaacuu

SEQ ID NO: 435229 - RNA, 64 nt, Human
cauuuucaugcuuccagguaaaaacagauauuguaccauguaccuaauccaaauaucauauaaa

SEQ ID NO: 435230 - RNA, 64 nt, Human
aguuuuuaaaauacugauacauccauuuugauauaccauguauucacacuuuaaaaaauacaca

SEQ ID NO: 435231 - RNA, 64 nt, Human
uguuuaggugaucucaaauuaggaaaugcauuuaaccauguaaaagaugagugcuaaaguaagc

SEQ ID NO: 435232 - RNA, 64 nt, Human
cuauuaaaugucucuccucuuucucugggucaagaccauguaauuuuaugcuucagagaugaag

SEQ ID NO: 435233 - RNA, 64 nt, Human
uguuuugaguaagaauaauuaaaccauaaggaagaccauguauaaaacugauggaaauaauagu

SEQ ID NO: 435234 - RNA, 64 nt, Human
ccaauaccuggucuuccuucccggcuuaaggaguaccauguacuuagccacaggcagaauagcu

SEQ ID NO: 435235 - RNA, 64 nt, Human
uccuuuugauuuucaaaguuuauaugugaaguucaccauguauguggugaauuucguaagguac

SEQ ID NO: 435236 - RNA, 64 nt, Human
acagaugauuccuucaacagacugcuauauauucaccauguaaacugcagccaccuuuagugau

SEQ ID NO: 435237 - RNA, 64 nt, Human
ugcuaauguuuuauucaauguaaaggaagaccaaaccauguaccuuaugaagaccuuuguuuua

SEQ ID NO: 435238 - RNA, 64 nt, Human
ccugguuccugaggcacauccuaacgcaagucugaccauguaugucugcgccccugucccccac

SEQ ID NO: 435239 - RNA, 64 nt, Human
aaauuccuuuacuguuaucccccccaccaccaggaccauguagggugcagucuuuacucccuaa

SEQ ID NO: 435240 - RNA, 64 nt, Human
guguggcuuuuggcugcagauguuaaauuuugauaccauguaaaccuacccagcuucucagacu

SEQ ID NO: 435241 - RNA, 64 nt, Human
aagguguaagaaauaggauaaaaagaaggucagcaccauguaccaggaauagcuuuacuuucca

SEQ ID NO: 435242 - RNA, 64 nt, Human
uggaauagaauugguauaaauucauaauuucuaaaccauguauauguacguuuauauguauuau

SEQ ID NO: 435243 - RNA, 64 nt, Human
gccaaaaagccuacaacauagaugcauuuagcaaaccauguacaaaucaaucacuauaauaaac

SEQ ID NO: 435244 - RNA, 64 nt, Human
uggaaugggggcuccuuggggccagcccaguguggcucaccacacucuucuuuuuuuuuuuuuu

SEQ ID NO: 435245 - RNA, 64 nt, Human
cagcugcugccccagccacagcugcacugacugugcucaccacacaucuggggcagccuucccu

SEQ ID NO: 435246 - RNA, 57 nt, Human
cauggcugucggggacaugagcuccaugcucaccagccucgccgaggagagcaaguu

SEQ ID NO: 435247 - RNA, 64 nt, Human
acuaacaaguugaugacauggauguauucauaagaccauguaauauugaugugauuguugucgc

SEQ ID NO: 435248 - RNA, 64 nt, Human
gcucugcucagcacgggcacugccacuugguguggcucaccagggcaccagccucgcagaaggc

SEQ ID NO: 435249 - RNA, 64 nt, Human
cccauuuuauuuccuguccuuagugucugaagaugcucaccaguuuucuguguacaguaaggca

SEQ ID NO: 435250 - RNA, 64 nt, Human
uuaaagccuucagacugucaagacgacaugagcagcucaccauaugauaaaaauacauaaauuu

SEQ ID NO: 435251 - RNA, 64 nt, Human
uggaacauguuauagggugagucccuggaucuuugcucaccagauccaagcacugcuucucggu

SEQ ID NO: 435252 - RNA, 64 nt, Human
gggaaaacugcuccucauuaucaucacuauuauugcucaccacuguauccccucuacuuggcaa

SEQ ID NO: 435253 - RNA, 64 nt, Human
ucccacuuugucauuaaaaucacaugucuaacuggcucaccacauagugugcuuugauuguauu

SEQ ID NO: 435254 - RNA, 64 nt, Human
aaggaguaaaacaaucuugucuauuugucauccagcucaccaguuaucaacugacgaccuauca

SEQ ID NO: 435255 - RNA, 64 nt, Human
caugaguccuucaaggaagacagagugagccaaugcucaccagccccagagucagagcuggcca

SEQ ID NO: 435256 - RNA, 64 nt, Human
uaagcggcacucauuuugcggaggccaugcgggugcucaccacccccaugcacacgccaucugu

SEQ ID NO: 435257 - RNA, 64 nt, Human
guuugucucauggucagcucgccucucaaagauggcucaccaaucaccugccuguuuuuacuua

SEQ ID NO: 435258 - RNA, 64 nt, Human
aguggccugggaaugggguggauugugagaaagugcucaccaucuauacacccuguauguccag

SEQ ID NO: 435259 - RNA, 64 nt, Human
cuuccacacagcaagccuaccuuucuccauccaugcucaccauagcccccuuccuugugaccug

SEQ ID NO: 435260 - RNA, 64 nt, Human
acccccuaccaguucccaaguccauguguaccccgcucaccacgggaacggccccccccaacca

SEQ ID NO: 435261 - RNA, 64 nt, Human
acaggaaucauuccuggguuucugucccucugaggcucaccagguguaguuggccuuguucuuu

SEQ ID NO: 435262 - RNA, 64 nt, Human
uuucccagcacugaauguuuuacuagcacugggugcucaccaugcaacugaagaaaauguggaa

SEQ ID NO: 435263 - RNA, 64 nt, Human
aggaagcugccuaaggagcccgaagaauucugcugcucaccaggacccagcucugggagugcag

SEQ ID NO: 435264 - RNA, 64 nt, Human
gaagcccgacacggccugagcguccagaaauggugcucaccaugcuuccagcuaacaggucuag

SEQ ID NO: 435265 - RNA, 64 nt, Human
augggaaugguugguguggccugagauacccauugcucaccaggccucacugggcccacagcug

SEQ ID NO: 435266 - RNA, 64 nt, Human
gggccucguguucaucaagacaccccucugcccagcucaccacaucuucaucaccagcaaacgc

SEQ ID NO: 435267 - RNA, 64 nt, Human
gccaucuguguaacuucaggaucuguucuguuucaccauguaacacacaauacaugcaugcauu

SEQ ID NO: 435268 - RNA, 64 nt, Human
ccacuccgcacaucagugcugugaaggcaaccucaccauguauuuucuucauaaucuauggaaa

SEQ ID NO: 435269 - RNA, 64 nt, Human
uaaaccaaguacuggaaacguaacuaaacagcgaaccauguagcuucaccugacucagugcugg

SEQ ID NO: 435270 - RNA, 64 nt, Human
ccagucuuuaucucuaacugccccuuauuugaucaccauguacuaggagcucugauagccagcu

SEQ ID NO: 435271 - RNA, 64 nt, Human
aucugacugggccuaaauuaaguagcuuaaugaaaccauguaauuacuuguucuccuuucuuuu

SEQ ID NO: 435272 - RNA, 64 nt, Human
auugaaauaaucaugcaugaagcgccaaagaugcaccauguagaauuuucacuuuguacuggca

SEQ ID NO: 435273 - RNA, 64 nt, Human
aacuuccaaauccccuaagcagaccacugauaaaaccauguagaaaauuuguuauuuugcaacc

SEQ ID NO: 435274 - RNA, 64 nt, Human
uaugaacucuguuuucuuucuaaugagauauuaaaccauguaaagaacauaaauaacaaaucuc

SEQ ID NO: 435275 - RNA, 64 nt, Human
cugagacaaauggaggccuguccugaccugucucaccauguacauagcuugauaaagggccaau

SEQ ID NO: 435276 - RNA, 64 nt, Human
cgugaaggaaagcuacugcccccuagugccccacaccauguacugccugccccuguggcagggc

SEQ ID NO: 435277 - RNA, 64 nt, Human
agaagguuucuggagcaguggacugccacaagccaccauguaaccccucucaccugccgugcgu

SEQ ID NO: 435278 - RNA, 64 nt, Human
uuucucacugcugucagccaagucaugguugguaaccauguagguucuugggagggaaugggac

SEQ ID NO: 435279 - RNA, 64 nt, Human
cugcuggucucuggcagucuccuugauuuuggguaccauguauauuuuccgcuuugacuuuaac

SEQ ID NO: 435280 - RNA, 64 nt, Human
cacagcaagcaugucccugccucccaugaaucuuaccauguaaauccaaaucucugcaauccug

SEQ ID NO: 435281 - RNA, 64 nt, Human
uguagugagaaaugcauuaacauguugaaugccuaccauguaccaaauuuugugcauauauuuu

SEQ ID NO: 435282 - RNA, 64 nt, Human
caaaugauguuuucaggugucauggacuguugccaccauguauucauccagaguucuuaaaguu

SEQ ID NO: 435283 - RNA, 64 nt, Human
ugcucuucguggcagggcugaccugcaggcucaucccggcgacgcuguaccccgggcgcgucau

SEQ ID NO: 435284 - RNA, 64 nt, Human
cgggcuggcugaggguccgaaaagccugcaggggcccggcgagccccaggaagagccucagcuc

SEQ ID NO: 435285 - RNA, 64 nt, Human
uggccuuguucucucuaugguaaagauauuauucaccauguaaaacaaaaaacaauauuuauug

SEQ ID NO: 435286 - RNA, 64 nt, Human
guuaaaguaaacuaucuuauccauauuauuucauaccauguaggugaggauuuuuaacuuuugc

SEQ ID NO: 435287 - RNA, 64 nt, Human
aagcagaacccacagccuuauuacaccugucuacaccauguacugagcuaaccacuucuaagaa

SEQ ID NO: 435288 - RNA, 64 nt, Human
guuaccucaauucuguucauugcagugcccguaaaccauguagaaagcucccagcacugaaagg

SEQ ID NO: 435289 - RNA, 64 nt, Human
auuuuguuaagaaguugaacuaugacuggaguaaaccauguauucccuuaucuuuuacuuuuuu

SEQ ID NO: 435290 - RNA, 64 nt, Human
caaacuuucaggcacuuuucaaauuuaauaaggaaccauguaaugguagcaguaccucccuaaa

SEQ ID NO: 435291 - RNA, 64 nt, Human
uauacuuguuauuaguaauuuuuucuuuugcauuaccauguaaaauuuagacauuugaauuuug

SEQ ID NO: 435292 - RNA, 64 nt, Human
agauuauuugguaaaguauacuaaaagccuuaaaaccauguaugugcgcuguuugaacccguaa

SEQ ID NO: 435293 - RNA, 64 nt, Human
ggggggagggagcuauuagagaaggaugaggcagaccauguacaguuaaaauuauaaaaugggg

SEQ ID NO: 435294 - RNA, 64 nt, Human
ucuagaauugauguuguaauuaaugcaagauauuaccauguacaugguaccaccaucuuacugu

SEQ ID NO: 435295 - RNA, 64 nt, Human
agaccucaagucugccucuacugugucucacaucaccauguagaagaaugggcguacaguauau

SEQ ID NO: 435296 - RNA, 64 nt, Human
auguaaccacugugggggugggggaggauggugaaccauguauuucagugaaauauuuaauaua

SEQ ID NO: 435297 - RNA, 64 nt, Human
gggagugugguuggagauagaaaggcuccuccccaccauguaauggcuuccucucagaauuuua

SEQ ID NO: 435298 - RNA, 64 nt, Human
gugagguccauguuggugcccuucagaguagagaaccauguaaacauuaggaaugaacagaggc

SEQ ID NO: 435299 - RNA, 64 nt, Human
cugucaggcuuuuauuuaaaauuguuuaacauguaccauguacaugucauuacuauauuucaau

SEQ ID NO: 435300 - RNA, 64 nt, Human
ugaguuuuguagcaguguacccacgcuggguauuaccauguaaauaaucugugagugaaaguug

SEQ ID NO: 435301 - RNA, 64 nt, Human
aauaaaaauaucuuuuuugaaaauaauuuaauauaccauguaauuuaccaguugaagauguucg

SEQ ID NO: 435302 - RNA, 64 nt, Human
ugcaagcaggcuaucaauuuuaauaauaguccauaccauguauguguuucugucagcagaaugu

SEQ ID NO: 435303 - RNA, 64 nt, Human
agguacuucaaaagcccaguaaugguggucagauaccauguagauggauacagauuguugacuc

SEQ ID NO: 435304 - RNA, 64 nt, Human
uucugggccauuagaacagauaaaugcgaaggaaaccauguauauucaccacuaggacagguua

SEQ ID NO: 435305 - RNA, 64 nt, Human
uauuuuguaucuuaaaauguaguuuaaaaauaggaccauguaugagacacuuuuuuacaaaaag

SEQ ID NO: 435306 - RNA, 64 nt, Human
guugggucccagcucugccuguguggagauagucaccauguaccucugacaacaaguuuuagug

SEQ ID NO: 435307 - RNA, 64 nt, Human
cuuuacaugaggacucuauucuuuaacucccauuaccauguaauggcaguuauauuuugcaguu

SEQ ID NO: 435308 - RNA, 64 nt, Human
aaauaucucauguaucccauaaauauauacaccuaccauguacccauaaaaauuuaaaaagaaa

SEQ ID NO: 435309 - RNA, 64 nt, Human
caaaaccuaacaaaccuugauguaccaguccaauaccauguagcgcugagugauaaaguuaaaa

SEQ ID NO: 435310 - RNA, 64 nt, Human
augaaccauucacagugcaagaaggauaccaaauaccauguacauaauucuugcuaugaaaagu

SEQ ID NO: 435311 - RNA, 64 nt, Human
uuaauuucuauuuaaauuuuagauuauuuuuauuaccauguacugaauuuuuacauccugauac

SEQ ID NO: 435312 - RNA, 55 nt, Human
cugugcacuuugacgguuagaugccaccauguagggauuaucgcgagugguugac

SEQ ID NO: 435313 - RNA, 64 nt, Human
uagggaacaugguuugacucaucuuauaugggaaaccauguagcagugagucauaucuuaauau

SEQ ID NO: 435314 - RNA, 64 nt, Human
aaauagucuagaaguuaaggggauggucacauuuaccauguauuguguuauuagcaguuaaauu

SEQ ID NO: 435315 - RNA, 64 nt, Human
gcuacuuuauccauugauuuuuaacaugguucccaccauguaagacuggugcuuuagcaucuau

SEQ ID NO: 435316 - RNA, 64 nt, Human
ugucugucuuuucuagggaaagcaucucuggcucaccauguaacaucuggcuuggagcaagugg

SEQ ID NO: 435317 - RNA, 64 nt, Human
uauaugcaauuuucauugaacuuaaagagugaaaaccauguaaacuauugaaacuauuguaauc

SEQ ID NO: 435318 - RNA, 64 nt, Human
cagccuacugcagaagugcagggcaccaguaaacaccauguauuauugaagaugaaucuguuug

SEQ ID NO: 435319 - RNA, 64 nt, Human
aguaguauaggaaaaaacuuaaaaaaacaaaaaaaccauguaguauuuucugauuuuuuuuucc

SEQ ID NO: 435320 - RNA, 64 nt, Human
uuuuauagccuuuuggaaguucaaagaugaaagcaccauguaucaggauuuccgcauuauaaaa

SEQ ID NO: 435321 - RNA, 64 nt, Human
uaaauagcuacucuuagaaaagagggauaagcagaccauguagguuuucugucucucaaaucuu

SEQ ID NO: 435322 - RNA, 64 nt, Human
gugagggguuucuuuuggaaauaauuacuuuugaaccauguaugugguauguauauuuucagug

SEQ ID NO: 435323 - RNA, 64 nt, Human
aacuuguauuuggggauucaaaggggauugcuacaccauguagaaaaaguauguagaaaaaaag

SEQ ID NO: 435324 - RNA, 64 nt, Human
ccauuuguaauuuguaaaauguucucuuaugaucaccauguauuuuguaaauaauaaaauagua

SEQ ID NO: 435325 - RNA, 64 nt, Human
caucaagcucaacguucuggaguggcugcagcucaccauguaugccugaaccaggcuggccuca

SEQ ID NO: 435326 - RNA, 64 nt, Human
ggaagaaaauucagacucauuugaauauuuguaaaccauguaauauauaaauaaccacuuucaa

SEQ ID NO: 435327 - RNA, 64 nt, Human
uaggacuuacuuaauagcacugugcagggaggaaaccauguauagcuuguacauauuuuaaacc

SEQ ID NO: 435328 - RNA, 64 nt, Human
uaguauuucucucagcagauauuucuuugguacuaccauguauuguguaacuuuugggaaagua

SEQ ID NO: 435329 - RNA, 64 nt, Human
auggaccauggcaggauacaacugauuguguggcaccauguauuagcagugggaauauguauca

SEQ ID NO: 435330 - RNA, 64 nt, Human
uguuuuuuuccuccuucuuucccaaucccucucaaccauguauuuauuuauauauguauguauu

SEQ ID NO: 435331 - RNA, 64 nt, Human
ggcccguaacagaaccaguguguguauaacgaaaaccauguauaaaaugggccuaucacccuug

SEQ ID NO: 435332 - RNA, 64 nt, Human
ugugcauuugucauccccacuccaucaaucccugaccauguaaggcuuuuuuauuuuaaaaaaa

SEQ ID NO: 435333 - RNA, 64 nt, Human
ccagggcccaggccugucuggggugggcgcugccgcucaccacucagggaggaccugggccccu

SEQ ID NO: 435334 - RNA, 64 nt, Human
uucacucaaggaaaacaccaucucaacuuugcccgcucaccaugucccuugcccccauguagcc

SEQ ID NO: 435335 - RNA, 64 nt, Human
auccagaaaaccaaccugcccuccccaaauaugugcucaccagcagcaacaggcuaucugaguc

SEQ ID NO: 435336 - RNA, 64 nt, Human
ccccucuuccuaggccugggggcaggcaguuccuaccauguaccccucucaggcugccugccug

SEQ ID NO: 435337 - RNA, 64 nt, Human
auaucuuccuuuaaccaaacugaaguacauaaagaccauguacauguauucaucaaacguuuau

SEQ ID NO: 435338 - RNA, 64 nt, Human
uuuuucaccuuuuaguuuuuacucuaauuuuguaaccauguauaugcuagcaguccacuucuac

SEQ ID NO: 435339 - RNA, 64 nt, Human
cucaugaggccuggagaaaaguaucaaaggucucaccauguaagagugauuuccgauuucucuc

SEQ ID NO: 435340 - RNA, 64 nt, Human
aauccaaggcuuuagccaggagcggaaacugacuaccauguaauuaucaaaguaaaauugggca

SEQ ID NO: 435341 - RNA, 64 nt, Human
cacucaauguccacuuucuuugacuuacaguauaaccauguagccaauuguggcccacuaaaau

SEQ ID NO: 435342 - RNA, 64 nt, Human
uaacacgaacuuuuguacagaauugugaguugugaccauguaacaugagagguuuugcuagggc

SEQ ID NO: 435343 - RNA, 64 nt, Human
cccugccccaggcuaaggguggccagagaaggucaccauguaccacacaccaaagaaggggguc

SEQ ID NO: 435344 - RNA, 64 nt, Human
ccccuccgcgcaggccuccggggggccggggcuuaccauguaggggaggggagaucuauccaca

SEQ ID NO: 435345 - RNA, 64 nt, Human
ccugaggcuucuguucaauuucauagacuccuuuaccauguaaaauuugucugauauuugauuu

SEQ ID NO: 435346 - RNA, 64 nt, Human
uuuuacaugugaaaacuguagccuuggucucuuaaccauguaauacauaaguuuuguuagaggu

SEQ ID NO: 435347 - RNA, 64 nt, Human
uuuccuauauuccaaauuccauuaaggucagcccaccauguaauuuucucaucagaaaugccua

SEQ ID NO: 435348 - RNA, 64 nt, Human
cuggauaauuguucaucuuugcuuuagcuuagauaccauguaguggucuguggcuacaggaagc

SEQ ID NO: 435349 - RNA, 64 nt, Human
agguggugacuaaauauacagucauugaauaaauaccauguagcaaguguacuuuguggagugu

SEQ ID NO: 435350 - RNA, 64 nt, Human
cuucacccacuggaaagaaccaccaucugcucuaaccauguagacuuauugcggccugguuucu

SEQ ID NO: 435351 - RNA, 64 nt, Human
aguuugggucauauaaagccaaccauuuuugaggaccauguaccuagugcuuugaaaacucuaa

SEQ ID NO: 435352 - RNA, 64 nt, Human
aaccagaucgggaggacuguggccagcaauuaacaccauguagacuuccuuaguucuuaagugg

SEQ ID NO: 435353 - RNA, 64 nt, Human
cuuauccuuuugaaauaccucacccugccacuccaccauguaugaucauuccagagaucuuugu

SEQ ID NO: 435354 - RNA, 64 nt, Human
cuucacucauccagccaccuaaaaacauuuacugaccauguacuacgugccagcucuaguuuuc

SEQ ID NO: 435355 - RNA, 64 nt, Human
ucuuuuuuagcuguaccuacguacuuauaucagcaccauguauguaggugugauaguacuuuca

SEQ ID NO: 435356 - RNA, 64 nt, Human
gcugacagcuuuuugaaagccgagcuguuucugaaccauguacauacauguucugaaacuuucu

SEQ ID NO: 435357 - RNA, 64 nt, Human
aagagaucuuuugcuagcuauugggguuugggaaaccauguacuauuacuuaaagguuguguaa

SEQ ID NO: 435358 - RNA, 64 nt, Human
gauuacuuccuggcugucuaauaauugaaccauaaccauguaauauuauguaaaggccuggaaa

SEQ ID NO: 435359 - RNA, 64 nt, Human
aaggauuguauauauaccucucgaccacguaggaaccauguaggggucucuagcuauuucugug

SEQ ID NO: 435360 - RNA, 64 nt, Human
ggggagcaccccacucaacuacucagaauuuuaaaccauguaagcucucuucuucucgaaaagg

SEQ ID NO: 435361 - RNA, 64 nt, Human
gauguugguuguugucaggggaccuucagucauuaccauguaggccucuuuacaaggcccagcu

SEQ ID NO: 435362 - RNA, 64 nt, Human
uauguaaggagguguuuuucaccacucuaucucuaccauguagaauugugcuuggcucauaaua

SEQ ID NO: 435363 - RNA, 64 nt, Human
ugacacccuggccagcgcgggggacuuucucugcaccauguagcauacuggacucccagcccug

SEQ ID NO: 435364 - RNA, 64 nt, Human
uggugguuuccccugcucuucucucuugccugccaccauguaagaugugccugguuccccuucc

SEQ ID NO: 435365 - RNA, 64 nt, Human
uugaugaauaguuguuuuauuauuuuuuuuuaccaccauguaucuaaccagaugaaaguuguuu

SEQ ID NO: 435366 - RNA, 64 nt, Human
ccuaggggcccaguaaggacagugcccgccagggaccauguauguaucauggcggaagaguugg

SEQ ID NO: 435367 - RNA, 64 nt, Human
gugaagugguuauuggcaaacguuuguaaaugugaccauguauaaaguauuuauacucuuuaau

SEQ ID NO: 435368 - RNA, 64 nt, Human
ucaacguugguacauuuucaucacccccaguaaaaccccguacccuuggucugucacuccugcu

SEQ ID NO: 435369 - RNA, 64 nt, Human
gccgagcuuacugugaguguggagauguuaucccaccauguaaagucgccugcgcaggggaggg

SEQ ID NO: 435370 - RNA, 64 nt, Human
aaaaaaaaaaauuuugugagugacucgguguaaaaccauguaguuuuaacagaaccagaggguu

SEQ ID NO: 435371 - RNA, 64 nt, Human
acgcauugaucucagaggcggaggccugcacuugaccauguagguggcagagaucgugggcugg

SEQ ID NO: 435372 - RNA, 64 nt, Human
augagcuuaguaccuccaacuuccuuucuuuccuaccauguaacccugcuuugggaauauggau

SEQ ID NO: 435373 - RNA, 64 nt, Human
ugcuuuugugucucacaaaaacagagcuugucucaccauguauuucucaauaaaccugcauuag

SEQ ID NO: 435374 - RNA, 64 nt, Human
aucuggcuucacauacacagagucuuugcuaugcaccauguacuguucuaagcuucuuaaaaau

SEQ ID NO: 435375 - RNA, 64 nt, Human
uggccugguauaugauagagauugauauuaauguaccauguauguuaaugugaaucugugggca

SEQ ID NO: 435376 - RNA, 64 nt, Human
ccccagaucccucauuugauacuccaaaaccaucaccauguaccauguguuagaguuggcaaaa

SEQ ID NO: 435377 - RNA, 64 nt, Human
aggcugagagcuguauaaaacauuuuggacugugaccauguaccuuccuuuuuaagaaaaauaa

SEQ ID NO: 435378 - RNA, 64 nt, Human
uccuugugcccgggauugggcuaugcuggguaccaccauguacucaggcaugguggguuuugaa

SEQ ID NO: 435379 - RNA, 64 nt, Human
gauggguccuugcuucucagcuguguccgaccccaccauguaauaaaacccaaaggaacagccc

SEQ ID NO: 435380 - RNA, 64 nt, Human
aggccccugacuuuuacuuugugguucucuaaaaaccauguacacacuuucacucuauuguaac

SEQ ID NO: 435381 - RNA, 64 nt, Human
agucaacaacuuagccaccacuuccccgcaauggaccauguaacaaauaccucagcaggcccug

SEQ ID NO: 435382 - RNA, 64 nt, Human
cuuauguggugcuuggaaaauguuuuuaaccuugaccauguauuauguuuauaauuaaaaaccc

SEQ ID NO: 435383 - RNA, 64 nt, Human
gugcuaaauuugucaccguaucauaugugcauuuaccauguauauuguacacauucacucccuu

SEQ ID NO: 435384 - RNA, 64 nt, Human
auuaauggagagccaaaggggaguuggugggaacaccauguauaacauauuuguauguaaaaug

SEQ ID NO: 435385 - RNA, 64 nt, Human
auuuuccuuuucuagcuucauaggaauauugugagcucaccaugcuguggagguugggaaagag

SEQ ID NO: 435386 - RNA, 64 nt, Human
auugcccaggcuggagugcaauggcacgaucucagcucaccacaaccuccaccuccuggguuua

SEQ ID NO: 435387 - RNA, 64 nt, Human
cacacccaggagacuaauaauaguaaccccagccaccauguacuuaguuuuaucccugcuacug

SEQ ID NO: 435388 - RNA, 64 nt, Human
uucuuaguccaacauagauauuuucuuucuccugaccauguauuuuaaaauauagucuauuucu

SEQ ID NO: 435389 - RNA, 64 nt, Human
uacuuaucuuacaagguugcaagagcucaaggagaccauguauguaaaguuccugcuguaaaua

SEQ ID NO: 435390 - RNA, 64 nt, Human
gcaggaagugggaaggacucacaucauaaaaaggaccauguagcuuuuucccugaaagcuucuc

SEQ ID NO: 435391 - RNA, 63 nt, Human
ccucagacaacuacuggugagcaagcuggacccaccauguacaguguguuauaguguuaaucc

SEQ ID NO: 435392 - RNA, 58 nt, Human
gucuagugucuccaaacugaggaaaguuaccauguagagcuugacuuuagaaguggug

SEQ ID NO: 435393 - RNA, 64 nt, Human
ucuuaacuuggacagggaaauggucuaacucuaaaccauguaacugaccuuaguaaaguccuug

SEQ ID NO: 435394 - RNA, 64 nt, Human
ugcaaaguaaggaggacuaagggaaaaugaugguaccauguaacagaaugagagcuaauuccaa

SEQ ID NO: 435395 - RNA, 64 nt, Human
gucauauaugaauuuaaaccuaguaccauccaaaaccauguaauggauuuuaagaaucuguuag

SEQ ID NO: 435396 - RNA, 64 nt, Human
uuaaguugagugaacaucggccaugaaaauccaucacgaauacuuuuggaucaauagucuauuu

SEQ ID NO: 435397 - RNA, 64 nt, Human
ugugugguuguagcaaggacucagccucauguagcacgaauaggggugugguucauggcguguu

SEQ ID NO: 435398 - RNA, 64 nt, Human
ucuugaagaauagcuggcagagugguauaaaagacacgaauaucuccuggucuauaaggauacu

SEQ ID NO: 435399 - RNA, 64 nt, Human
cagugcuucuugguucccaggaugccacuuccuccacgaauagcuaccuguugaagugauauuc

SEQ ID NO: 435400 - RNA, 64 nt, Human
cacguggcaucugauuaccuguggucacugaacacacgaauaacuuggauagcaaauccugaga

SEQ ID NO: 435401 - RNA, 64 nt, Human
uuugacauugccacaguuuacagugucauucuuccacgaauagguaauugauagaguuuauggg

SEQ ID NO: 435402 - RNA, 64 nt, Human
uccuaggugccgaccaacccccaggauggcggaagcucaccaggccguggccuuccaguucacg

SEQ ID NO: 435403 - RNA, 64 nt, Human
acaucacaauguaaauaucauuuuugauguuccagcucaccagaagauucuuacacuuggggua

SEQ ID NO: 435404 - RNA, 64 nt, Human; identical to SEQ ID NO: 323240

SEQ ID NO: 435405 - RNA, 64 nt, Human
ugaaaauuaguuaaaauaugcaguuuuuugagcccacgaauaguugucauuuccuuuaugugcc

SEQ ID NO: 435406 - RNA, 64 nt, Human
cuccaggguuauucuccuccucgagucacagucacacgaauaccugccuucucuggcuuuccug

SEQ ID NO: 435407 - RNA, 64 nt, Human
gcacaugcaucaacaaauuacaacauguuuuguacacgaauaaacccauuacaagaauguaauu

SEQ ID NO: 435408 - RNA, 64 nt, Human
guacuguaauuuugaauggaacugaaaaauuaugcacgaauaaaguacuuuucucaugccauac

SEQ ID NO: 435409 - RNA, 64 nt, Human
uuuaugguauuugguacaacuggcugauacuaagcacgaauagauauugauguuauggagugcu

SEQ ID NO: 435410 - RNA, 64 nt, Human
gucagggcaccuuuuccucagagcaauccggccacacgaauagaaggcugucgugaaucacauc

SEQ ID NO: 435411 - RNA, 64 nt, Human
gugacccagccgccucgacuucggcccgcuugcucacgaauaaagaacucagaguugugugugc

SEQ ID NO: 435412 - RNA, 64 nt, Human
cuuguguuguuuuuccuuuuuaaacccccaugaacacgaauacucugaaaaaaauaaaaagcuu

SEQ ID NO: 435413 - RNA, 64 nt, Human
gugcuuguuugaauuuucugauaucugauuuucacacgaauauacuuuuuguuuguuuuccuuu

SEQ ID NO: 435414 - RNA, 64 nt, Human
caccugugcuguggaguggcauuuuagaugcccucacgaauaugaagcuuagcacagcucuagu

SEQ ID NO: 435415 - RNA, 64 nt, Human
aaauaaccuacuccuauauacugaccugccuguccacgaauaauuguaaaggguuuuugcaugu

SEQ ID NO: 435416 - RNA, 64 nt, Human
caggccuauuucaucacaagaacacacacauauacacgaauagacaucaaacucaaugcuuuau

SEQ ID NO: 435417 - RNA, 64 nt, Human
acgaaaaaaaagguagaucuugaauguguuguagcacgaauaaauugcuguacuucauuaagcu

SEQ ID NO: 435418 - RNA, 64 nt, Human
cuuaauccuuuuaaaaaaaaugcauuuacguaaacacgaauacugaaauuguuggauuuuuuaa

SEQ ID NO: 435419 - RNA, 64 nt, Human
ucuaaagaagaggacagaauauacuggacuuaaccacgaauacccuugaguguccaaauuggga

SEQ ID NO: 435420 - RNA, 64 nt, Human
aguguccuucuuaacagacucaaaccacauggaccacgaauauucuuucuguccagaagggcua

SEQ ID NO: 435421 - RNA, 64 nt, Human
caccugaagggaauuugaggaccgccgccagggcaccccguacauacacacagcugcuuuugug

SEQ ID NO: 435422 - RNA, 64 nt, Human
acuugggauuucuugauaguccuucaccccugaaaccccguauuuacuuaacaagauuuagcuc

SEQ ID NO: 435423 - RNA, 64 nt, Human
uguauuuucucucuccuggacaacuuccccaggaaccccguaccagccuguugaucaucaauaa

SEQ ID NO: 435424 - RNA, 64 nt, Human
aauacgacaaucagaauacaaaccaguaaggcaacacgaauaaacuaagaaaaagguaagaacu

SEQ ID NO: 435425 - RNA, 64 nt, Human
auucuguagagagggagucaggaugcugucuucccacgaauaguacucaguaacaaaccaauug

SEQ ID NO: 435426 - RNA, 64 nt, Human
ucuggcccucuaccccugaucugacauccccacucacgaauauuaugcccaguuucugccucug

SEQ ID NO: 435427 - RNA, 64 nt, Human
ggaacuugcgcaggugcgaguggccagcagaggucacgaauaaacugcaucucugcgccuggcu

SEQ ID NO: 435428 - RNA, 64 nt, Human
ucgguuauccaccccuaccucccagugucuaagccacgaauaaugguaugcuguugcugauguu

SEQ ID NO: 435429 - RNA, 64 nt, Human
cuuacuacagaaaugaggaggaugcuaaaaaugucacgaauauggacauaucaucuguggacug

SEQ ID NO: 435430 - RNA, 64 nt, Human
uggaugcccucaggggugcugaccccugccaggccacgaauaucaggcuagagacccauggcca

SEQ ID NO: 435431 - RNA, 64 nt, Human
aauggcauuauuugaucugaaauguuugagaagacacgaauaaaguuacuugggcagacuuggc

SEQ ID NO: 435432 - RNA, 64 nt, Human
augcuagaaaacacacaugaauuuucuauaaaaucacgaauaugaaguaccagguuuagucuua

SEQ ID NO: 435433 - RNA, 64 nt, Human
auuaucuuccacacaugaauuuucucucuccuggcacgaauauaaagcacaucucuuaacugca

SEQ ID NO: 435434 - RNA, 64 nt, Human
ucgugcuggaggaacuugcugcugugccugcgucgcggcggauccgcggggacccugccgaggg

SEQ ID NO: 435435 - RNA, 64 nt, Human
ccguugaccaggcugccuucuugagugaggugcugcggcggaccugccacguuccaggugaguu

SEQ ID NO: 435436 - RNA, 64 nt, Human
ccaagaaacucaagagccuccguaccuccccugggcggcggaggggcauugcacuuccgggaag

SEQ ID NO: 435437 - RNA, 64 nt, Human
gggacuuucuuaaaggccuagucuaugggauggggcggcggagggaauuuuuugagaaauaaaa

SEQ ID NO: 435438 - RNA, 64 nt, Human
aagauuccaaguucucaccucuuaaagaaaacccaccccguagauucccaucauacacuuccuu

SEQ ID NO: 435439 - RNA, 64 nt, Human
aacaaaacaaaaaacaagaaaaaaaaaacacaaaaccccguaaaaucacaaagaaaauccaaca

SEQ ID NO: 435440 - RNA, 64 nt, Human
accccuaccccacgcuacccagggcccagcggccaccccguaccacuguugaugugaagcaccu

SEQ ID NO: 435441 - RNA, 64 nt, Human
uguaauauaugcaacuagaaugucugccuuuucaaccccguauuauuguauuuuauagagcuuu

SEQ ID NO: 435442 - RNA, 64 nt, Human
accaccucgaccagugacaggccagcagcagagggcggcggaggaaggguuagggguucauucu

SEQ ID NO: 435443 - RNA, 64 nt, Human
gcccugccgccgccucccgggucucaggccuccagcggcggaggcgcaggcgaccgggccuccc

SEQ ID NO: 435444 - RNA, 64 nt, Human
aggaggcugaagcaggauaaucgcuugaacccgggcggcggagauugcagugagccgaggucau

SEQ ID NO: 435445 - RNA, 64 nt, Human
guacauugccguccugcagagauccaggcugcacgcggcggacugggcaggccgggcccgggca

SEQ ID NO: 435446 - RNA, 64 nt, Human
cccgggcccagcgcggccagugcuccuccugcacgcggcggacucggaggcgcagcggcgccug

SEQ ID NO: 435447 - RNA, 52 nt, Human
ccuuccggugguuucagugacggcggcggaacccaaagcugcccucuccgug

SEQ ID NO: 435448 - RNA, 64 nt, Human
auaccugagccgcuuguuaggucgccgcacccucgcggcggaugucucuuggucuguuucuccg

SEQ ID NO: 435449 - RNA, 64 nt, Human
ggcgccuucucugaaaacaaugcugagaaugagagcggcggagacaagccccccaucgauccca

SEQ ID NO: 435450 - RNA, 64 nt, Human
aggaggcugaggcaggagaaucgccugaacccgggcggcggagguuguagugagccaagaucca

SEQ ID NO: 435451 - RNA, 64 nt, Human
cgacacccccuggccugugccaggcucacgggcggcggcggaccccgaccuccaguugccuaca

SEQ ID NO: 435452 - RNA, 64 nt, Human
acccaccuaauucgaugaaggcugccaacggggagcggcggaaagccuguaagccugcaagccu

SEQ ID NO: 435453 - RNA, 64 nt, Human
accagccacagcccaaacacaucaaacuugcuaagcggcggauacccccagcuucuaagguggg

SEQ ID NO: 435454 - RNA, 64 nt, Human
ggaggcauccaaaauaaggcggggcacagugugggcggcggagucccugagccuugagcuccgc

SEQ ID NO: 435455 - RNA, 64 nt, Human
ucugccugcgggaugagaccuuggcaggcgggcagcggcggaaacucagcucaagguucccggu

SEQ ID NO: 435456 - RNA, 64 nt, Human; identical to SEQ ID NO: 323250

SEQ ID NO: 435457 - RNA, 64 nt, Human; identical to SEQ ID NO: 323257

SEQ ID NO: 435458 - RNA, 64 nt, Human
cagcaauaagcugauagauggacuuuccacuguaggaguggacauuucaagccaacugagccuu

SEQ ID NO: 435459 - RNA, 64 nt, Human
cccagccaggaggugggguguggacccggcccuggcggcggagucagggucccaagaucccacc

SEQ ID NO: 435460 - RNA, 64 nt, Human
gcuccaggcagugggaagccaauggagggauuaagcggcggaagcuucuuagaagaggcagggg

SEQ ID NO: 435461 - RNA, 64 nt, Human
uggguucccauaguccugggagagugucugcagggcggcggagggcagagcagggcaggggagg

SEQ ID NO: 435462 - RNA, 54 nt, Human
ucaggagcuaccggagcugagcccgcggcggacugccccaggacugcgggaagg

SEQ ID NO: 435463 - RNA, 64 nt, Human
auugcccaguccccgauggcugcgcacacaggaggcggcggagcacaaggcaagugaguuugca

SEQ ID NO: 435464 - RNA, 64 nt, Human
ggagacuugagguaggagaaucacuugaaccucagcggcggagguugcagugagucgagaucgc

SEQ ID NO: 435465 - RNA, 64 nt, Human
uuggaaacuccguuccuacaaaacccucuuugaugcggcggagacgauggucagccuucagcug

SEQ ID NO: 435466 - RNA, 64 nt, Human
ggggcggcggccgcgguccugccacacaagcugggcggcggaggccacgcagccgggccuucuu

SEQ ID NO: 435467 - RNA, 64 nt, Human
cugagaagcuuauccgagagaaagaugaggagcugcggcggaugcaggagaugcuacacaaaau

SEQ ID NO: 435468 - RNA, 64 nt, Human
cacaccuguaaccccagcacuuugggaggcuaaggcggcggaucacuugaggucaggaguucaa

SEQ ID NO: 435469 - RNA, 64 nt, Human
guguauuuaacagggaggggaagagggggcgaucgcggcggagcuggccccgccgccugguacu

SEQ ID NO: 435470 - RNA, 56 nt, Human
cggggcugucccaguauuaaaagguggcggcggaagagcuaagcaacguggcuuag

SEQ ID NO: 435471 - RNA, 64 nt, Human
ccguggaacggugacggccaccccgggacugcaggcggcggaugucaggcccugucugggccag

SEQ ID NO: 435472 - RNA, 64 nt, Human
gccugucacgcuaucagcaguucaaggauuuccagcggcggauccugguggccaccaaucuguu

SEQ ID NO: 435473 - RNA, 64 nt, Human
aaaaacaucaaugaguaggcauuuuauagcuuuaaccccguaugaguuucaagcuguguuuccu

SEQ ID NO: 435474 - RNA, 64 nt, Human
caugcaagggugacaucgacaaccacguaccaagccaccgcagcugcugccacucugcugccug

SEQ ID NO: 435475 - RNA, 64 nt, Human
ugacacugcacgugggcguaguggggagcacccuggaguggagaugauugucagcgggcucaca

SEQ ID NO: 435476 - RNA, 64 nt, Human
gacgccgggacccccaggagaccaggucuggcucgcggcggacguccccaggggucacccugca

SEQ ID NO: 435477 - RNA, 64 nt, Human
augugucuuaaggcaggacgacuuggaaaaaaaggcggcggacaguuggccagagggauggaga

SEQ ID NO: 435478 - RNA, 64 nt, Human
ugcggcccaaggcuccggaccacacuggcccccugcggcggaggccaacgcagggcaccaccac

SEQ ID NO: 435479 - RNA, 60 nt, Human
cggaccacgcugaccuguagguccgggggcgcggcggagcugggaccuaccugccugagu

SEQ ID NO: 435480 - RNA, 64 nt, Human
cagcccaggccguggugaggaggcggaggcaucggcggcggaggcucaggguggggagcaggcc

SEQ ID NO: 435481 - RNA, 64 nt, Human
cuggacuaaaaaugcagaaauuuacccaggcacggcggcggacgcccaucaucccagcuacuug

SEQ ID NO: 435482 - RNA, 64 nt, Human
guguauuccuugggggaugguuugggccgaauggggaguggaauauuugacauuuuuccuguuu

SEQ ID NO: 435483 - RNA, 64 nt, Human
caaggaacugguagggaaguggcgccugucuccuggaguggaagaggccugcucccuggcucug

SEQ ID NO: 435484 - RNA, 64 nt, Human
agggaauuuauugccucuuucacauugaaacccaggaguggauaacacuggcuucaggcaaagc

SEQ ID NO: 435485 - RNA, 64 nt, Human; identical to SEQ ID NO: 435434

SEQ ID NO: 435486 - RNA, 64 nt, Human; identical to SEQ ID NO: 435435

SEQ ID NO: 435487 - RNA, 64 nt, Human; identical to SEQ ID NO: 435436

SEQ ID NO: 435488 - RNA, 64 nt, Human; identical to SEQ ID NO: 435437

SEQ ID NO: 435489 - RNA, 64 nt, Human; identical to SEQ ID NO: 435442

SEQ ID NO: 435490 - RNA, 64 nt, Human; identical to SEQ ID NO: 435443

SEQ ID NO: 435491 - RNA, 64 nt, Human; identical to SEQ ID NO: 435444

SEQ ID NO: 435492 - RNA, 64 nt, Human; identical to SEQ ID NO: 435445

SEQ ID NO: 435493 - RNA, 64 nt, Human; identical to SEQ ID NO: 435446

SEQ ID NO: 435494 - RNA, 64 nt, Human
agagucugcagccaucagcaaggaggaccaggaacccggcgacugaggugcuuccaggugggga

SEQ ID NO: 435495 - RNA, 64 nt, Human
cugguaauaagccucgcagcccagguccagagcccccggcgagccggucccauaaccggccccc

SEQ ID NO: 435496 - RNA, 64 nt, Human
ccgcgucccccaugccagcccccaacgcagggcgcccggcgaagccacgggacuggcgggagga

SEQ ID NO: 435497 - RNA, 52 nt, Human; identical to SEQ ID NO: 435447

SEQ ID NO: 435498 - RNA, 64 nt, Human; identical to SEQ ID NO: 435448

SEQ ID NO: 435499 - RNA, 64 nt, Human; identical to SEQ ID NO: 435449

SEQ ID NO: 435500 - RNA, 64 nt, Human; identical to SEQ ID NO: 435450

SEQ ID NO: 435501 - RNA, 64 nt, Human; identical to SEQ ID NO: 435451

SEQ ID NO: 435502 - RNA, 64 nt, Human; identical to SEQ ID NO: 435452

SEQ ID NO: 435503 - RNA, 64 nt, Human; identical to SEQ ID NO: 435453

SEQ ID NO: 435504 - RNA, 64 nt, Human; identical to SEQ ID NO: 435454

SEQ ID NO: 435505 - RNA, 64 nt, Human; identical to SEQ ID NO: 435455

SEQ ID NO: 435506 - RNA, 64 nt, Human; identical to SEQ ID NO: 435459

SEQ ID NO: 435507 - RNA, 64 nt, Human; identical to SEQ ID NO: 435460

SEQ ID NO: 435508 - RNA, 64 nt, Human; identical to SEQ ID NO: 435461

SEQ ID NO: 435509 - RNA, 54 nt, Human; identical to SEQ ID NO: 435462

SEQ ID NO: 435510 - RNA, 64 nt, Human; identical to SEQ ID NO: 435463

SEQ ID NO: 435511 - RNA, 64 nt, Human
aggccgggagcgcgcgcggacuggcgucuccccucccggcgauccgcccccagcacuggggagg

SEQ ID NO: 435512 - RNA, 64 nt, Human
cucuaaaaaagucuuccgcuugauuuugcacaaucccggcgauacuccuggcgauacugacuag

SEQ ID NO: 435513 - RNA, 64 nt, Human
uguauuuuauuggacaggucagacucgccgggggcccggcgaggguaugucagugucacuggau

SEQ ID NO: 435514 - RNA, 64 nt, Human; identical to SEQ ID NO: 435464

SEQ ID NO: 435515 - RNA, 64 nt, Human; identical to SEQ ID NO: 435465

SEQ ID NO: 435516 - RNA, 64 nt, Human; identical to SEQ ID NO: 435466

SEQ ID NO: 435517 - RNA, 64 nt, Human; identical to SEQ ID NO: 435467

SEQ ID NO: 435518 - RNA, 64 nt, Human; identical to SEQ ID NO: 435468

SEQ ID NO: 435519 - RNA, 64 nt, Human; identical to SEQ ID NO: 435469

SEQ ID NO: 435520 - RNA, 56 nt, Human; identical to SEQ ID NO: 435470

SEQ ID NO: 435521 - RNA, 64 nt, Human; identical to SEQ ID NO: 435471

SEQ ID NO: 435522 - RNA, 64 nt, Human; identical to SEQ ID NO: 435472

SEQ ID NO: 435523 - RNA, 64 nt, Human; identical to SEQ ID NO: 435476

SEQ ID NO: 435524 - RNA, 64 nt, Human; identical to SEQ ID NO: 435477

SEQ ID NO: 435525 - RNA, 64 nt, Human; identical to SEQ ID NO: 435478

SEQ ID NO: 435526 - RNA, 60 nt, Human; identical to SEQ ID NO: 435479

SEQ ID NO: 435527 - RNA, 64 nt, Human; identical to SEQ ID NO: 435480

SEQ ID NO: 435528 - RNA, 64 nt, Human
uaggucuguucagagucugugccccuggaccuggggaguggauaucagaugggauaucuccuuc

SEQ ID NO: 435529 - RNA, 64 nt, Human
agccaguuauuaggaagagcaagcucaccacagaggaguggaacugaggccccccagauguugc

SEQ ID NO: 435530 - RNA, 64 nt, Human
ugaaggccacaaggcacugggcaccaguccuuuuggaguggaccuuuugcaaaaggccuuguca

SEQ ID NO: 435531 - RNA, 64 nt, Human; identical to SEQ ID NO: 435481

SEQ ID NO: 435532 - RNA, 64 nt, Human
ccguccggaacaccaccuccaccgggcugcaguucccggcgagcggcgccccgacugcggggcc

SEQ ID NO: 435533 - RNA, 64 nt, Human
uuuuucguuguuugcuuuagguuuuugaaacagccccggcgacgccucuauuggcucucggccu

SEQ ID NO: 435534 - RNA, 62 nt, Human
ccagcagagugagcuguugacucgaucgaaaccccggcgaaagaaaucaaacccccaacuuc

SEQ ID NO: 435535 - RNA, 64 nt, Human
cuuggaaccuaaauugaacugccaaguacugcgcaugcaagagacccuuuauuggccuuacagu

SEQ ID NO: 435536 - RNA, 64 nt, Human
cgugggagauuuuggccccaacccacacaggccaaugcaagaggccaaggcuggagaggcgugc

SEQ ID NO: 435537 - RNA, 64 nt, Human
ugcagaucucacaucaaggagagggaaaagcacaaugcaagaaccuaacuaacgugaugauaug

SEQ ID NO: 435538 - RNA, 64 nt, Human
ucuacccaucuauuuggaaagcacuggaauucagaugcaagagaacaauguuucuucaguggca

SEQ ID NO: 435539 - RNA, 64 nt, Human
agaaggaggaagagcaugaaggaucuuauaagaaaugcaagaggauauugauaggugugaacua

SEQ ID NO: 435540 - RNA, 52 nt, Human
caugcacugcaagcagcuaaacaugcaagaucaugaagaguguaaccaaagu

SEQ ID NO: 435541 - RNA, 64 nt, Human
ugauauuacuucgcuauuaaauaaagaaaauuggaugcaagacaauggagaaacuuuaaaacua

SEQ ID NO: 435542 - RNA, 64 nt, Human
uucuuguuuguuugagcuuagggaugagauacuuaugcaagauauuuuugaaguaaauuaaaca

SEQ ID NO: 435543 - RNA, 64 nt, Human
cggcuggccugcucucacgugucuguguaagaucaugcaagagaaaucacagugccuucuacag

SEQ ID NO: 435544 - RNA, 64 nt, Human
uaauuuuaaagucaguguacugcaaggaagcuggaugcaagauagauacuauauuaaacuguac

SEQ ID NO: 435545 - RNA, 64 nt, Human
ucagaggcaggucaccacugggcccuguggaucaaugcaagaugacaaaggcuuuuuuuuuuuu

SEQ ID NO: 435546 - RNA, 64 nt, Human
gauuccugacuuagggguggcuuuuguuuacaagaugcaagaggggaaaccuguccccgacuca

SEQ ID NO: 435547 - RNA, 64 nt, Human
gaagacauggagacuccugcccuguuguguauagaugcaagauauuuauauauauuuuugguug

SEQ ID NO: 435548 - RNA, 64 nt, Human
ucagaggagagauagccuguggcccuguccugccaugcaagaacucaucacuguggcugucugg

SEQ ID NO: 435549 - RNA, 64 nt, Human
agcaggcauugcaggcgggaagaugccagaaauuaugcaagaagugaggugucauuauccagga

SEQ ID NO: 435550 - RNA, 64 nt, Human
aggaccuagguguuugggguacacugccacccagggaguggaucaaaaauauacauagaaagag

SEQ ID NO: 435551 - RNA, 64 nt, Human
cggcggcccccguagcagguggugugggugcucgggaguggaggugacgucagcagcgcucucu

SEQ ID NO: 435552 - RNA, 64 nt, Human
cagcuuagacaccuccaagaaccaggccccgcugaugcaagauggcagaucugauacccauuag

SEQ ID NO: 435553 - RNA, 64 nt, Human
gauuauucuaaucuaauaagacaaguuuguggaaaugcaagaugaauacaagccuuggguccau

SEQ ID NO: 435554 - RNA, 64 nt, Human
gagguaggaaagagaagauguucuuauucagauaaugcaagagaagcaauucgucaguuucacu

SEQ ID NO: 435555 - RNA, 64 nt, Human
ccuugaguaaaugucugggaaagcaugaagcuugaugcaagaacccuguuguacuggcguuuuc

SEQ ID NO: 435556 - RNA, 64 nt, Human
auuuacaucuguauauacacuaugauuagaaaauaugcaagaaauuguuuuuccauguuaagaa

SEQ ID NO: 435557 - RNA, 64 nt, Human
caucuggaaacauaugagaaaggucagcaaacagaugcaagaccuauaaggcuagucauugagc

SEQ ID NO: 435558 - RNA, 64 nt, Human
agugauccuacuauaugacggaaacuuuggcuggaugcaagagcuuuaaauugguagaaaaguc

SEQ ID NO: 435559 - RNA, 64 nt, Human
ccuucacccgagguccugcccaagcacaggccagaugcaagaauggggaaaagucugguccuga

SEQ ID NO: 435560 - RNA, 64 nt, Human
uaaauccaaacuuggucauucccauuuugaagagaugcaagagggcccagugaggacauccgcc

SEQ ID NO: 435561 - RNA, 64 nt, Human
gaaugaagcugcuuuugaauuuuguuauguugaaaugcaagaaauaacaaugauggcagcaauu

SEQ ID NO: 435562 - RNA, 64 nt, Human
aaucuguaccaauuugcaauagaaagccuucaguaugcaagaaguuugcauggguauuaagaac

SEQ ID NO: 435563 - RNA, 62 nt, Human
cuaugauucaacucuuuuaaugauugccaguaaugcaagaaacacuccuugagagggagggg

SEQ ID NO: 435564 - RNA, 64 nt, Human
auggugcauuugauugaagcagcuugucuuuauuaugcaagacuguguagaguuuuuuuuuuuu

SEQ ID NO: 435565 - RNA, 64 nt, Human
acucucuaagauuuaguaagugaaaaaaaguaggaugcaagaguuuuuauaguugauuccauuu

SEQ ID NO: 435566 - RNA, 64 nt, Human
auaaacuuaacucuacaaaagcaaacucuaaugcaugcaagaaucauuagguuggcagguauau

SEQ ID NO: 435567 - RNA, 64 nt, Human
gcauccccagcauuuccugaguuauaaggccacaggaguggauagcuguuuucaccuaaaggaa

SEQ ID NO: 435568 - RNA, 64 nt, Human
ggagguucucagagccaaguccucccucucuacuggaguggaaggucuauuggccaacaauccu

SEQ ID NO: 435569 - RNA, 64 nt, Human
ggaaggaaauaaguuccuuuauuuuuucuuuucuaugcaagauaagagauuaccaacauuacuu

SEQ ID NO: 435570 - RNA, 64 nt, Human
agggcuuuugaugaggacaagugacaguaggaagaugcaagagccuuuaguaccaagguucuca

SEQ ID NO: 435571 - RNA, 64 nt, Human
agugagacaucccugugagcagauacaauagccaaugcaagaaucuguguguuccuugcuguac

SEQ ID NO: 435572 - RNA, 64 nt, Human
uauuuuucuuacucuaaaauaugugguagauaguaugcaagaaaagccgggugcgguggcucag

SEQ ID NO: 435573 - RNA, 64 nt, Human
gaagaagggaaauucacacugugcguuuuagaguaugcaagaagaauauaaauaaauaaaaaua

SEQ ID NO: 435574 - RNA, 64 nt, Human
ucuccuggaagauugguuuaaaaagaaaaguguaaugcaagaauuuaaagaaauauuuuuaaag

SEQ ID NO: 435575 - RNA, 55 nt, Human
ccccagaaacccggaccugaauguaaugcaagaaugaacagaacaagcaaaauga

SEQ ID NO: 435576 - RNA, 64 nt, Human
cuuugacuccaggucucacauccaggucauacugaugcaagaaguggguucccauggucuuggg

SEQ ID NO: 435577 - RNA, 64 nt, Human
aaauguuguuuguuugcaaauaucaaacauuguuaugcaagaaauuauuaauuacaaaaugaag

SEQ ID NO: 435578 - RNA, 64 nt, Human
gaaguuuucuagauugucacaugcuuugugacuaaugcaagaaagcaaguccuguguuguauuu

SEQ ID NO: 435579 - RNA, 54 nt, Human
cuggaucccccaucaguugacccaaugcaagaaucucagacacacaugacgcac

SEQ ID NO: 435580 - RNA, 64 nt, Human
agcuacagaaaggagguuuaggauugcagagaagaugcaagagcacuuuggcccaauucuccag

SEQ ID NO: 435581 - RNA, 64 nt, Human
acauuccccaguaccuucaguuccaggauuuaaaaugcaagaaaaaacauuuuuacugcugcuu

SEQ ID NO: 435582 - RNA, 64 nt, Human
caacaugccuccugcccugcuaaagacagugcggaugcaagagcaccuggccaagcgagagcag

SEQ ID NO: 435583 - RNA, 64 nt, Human
cuagauuaucuacaugagaauauacuaauuuuauaugcaagaaaaaaagcacaguauuuuuuaa

SEQ ID NO: 435584 - RNA, 64 nt, Human
aagacaucacaaucccauuauucagagcgcguauggaguggaaacgcuuguaggguuucaccag

SEQ ID NO: 435585 - RNA, 64 nt, Human
guuuuuuguagaagaaagauacaagugaaaauuaggaguggauuggagaaauuggggggaaaua

SEQ ID NO: 435586 - RNA, 64 nt, Human
ccauuccaccgaaguguaaacuagcauccaccaaaugcaagaagaauaaacauggauuuucauc

SEQ ID NO: 435587 - RNA, 64 nt, Human
uuggcaggcucguuguaccucuuggaaaaccucaaugcaagauaguguuucagugcuggcauau

SEQ ID NO: 435588 - RNA, 64 nt, Human
auguccaguuuauacaguuuacaaaauauagcagaugcaagauuaugggggaaauccuauauuc

SEQ ID NO: 435589 - RNA, 64 nt, Human
auacuuuauuuuugugaguuggcuacuauuuacgaugcaagagaauaaaugugagcaaauauug

SEQ ID NO: 435590 - RNA, 64 nt, Human
acuggaaaggugucauuaaugacccaguguuagaaugcaagaggucagguuauucuagcccuca

SEQ ID NO: 435591 - RNA, 64 nt, Human
aaguuccuucaucauccuggaagagccuuuugccaugcaagacaacauagccacagguggggau

SEQ ID NO: 435592 - RNA, 64 nt, Human
ucugaacuuugcaacuucauccagugcaaguuugaugcaagaauguauuaggacauaaaauaga

SEQ ID NO: 435593 - RNA, 64 nt, Human
auuggcaugaagaguacagauguaaucacaaguaaugcaagacucacugaggaauacaagccaa

SEQ ID NO: 435594 - RNA, 64 nt, Human
uuccacuuccaugcuaucggauguguugggcuccaugcaagaacuuggaagaaaaacaggcagg

SEQ ID NO: 435595 - RNA, 64 nt, Human
cccaugcuccagcguccuucaccuggcacaggacaugcaagauaaauagggcaggcacguguuu

SEQ ID NO: 435596 - RNA, 64 nt, Human
acuacuucaguuuauuccagcaagaaagauugugaugcaagauuucuuucuuccugagacaaaa

SEQ ID NO: 435597 - RNA, 64 nt, Human
aucaguuuauuccagcaagaaagaaaagauuguuaugcaagauuucuuucuuccugugacaaaa

SEQ ID NO: 435598 - RNA, 64 nt, Human
uuucuaguuuuccuuacaggacgugauaggcugcaugcaagaggcauacagaaaauggaaauag

SEQ ID NO: 435599 - RNA, 64 nt, Human
ucagcauuguuuggccaaacuuguuaaaacuguaaugcaagaaccaaaugcacugugauguggc

SEQ ID NO: 435600 - RNA, 64 nt, Human
aacuuggaaugaagccaccagucauuuuuuaagaaugcaagaugaaaaaaucagguaaaaucua

SEQ ID NO: 435601 - RNA, 64 nt, Human
cacccguccaggacagaaccgugcauaggcaaaaggaguggagcacagcguccggcccagugug

SEQ ID NO: 435602 - RNA, 64 nt, Human
ccagaaaauaagacaggccacaggagggcagaguggaguggaaauaccccuaaguuggaaccaa

SEQ ID NO: 435603 - RNA, 64 nt, Human
cggguugcaaugacaaggggggcaaaugaaaucaaugcaagauuucuuaauaaugggcagacag

SEQ ID NO: 435604 - RNA, 64 nt, Human
uucaguuuauuccagcaagaaagaaaagauuguuaugcaagauuucuuucuuccugugacaaaa

SEQ ID NO: 435605 - RNA, 64 nt, Human
aaauuagagcuguaaggaaaaugaaaagccacaaaugcaagacuguucuuaaauggaaggcaua

SEQ ID NO: 435606 - RNA, 64 nt, Human
uaaaguuaguaucauuaaacaaauugucuauuaaaugcaagacgugguaauauacagaauuuau

SEQ ID NO: 435607 - RNA, 64 nt, Human
gcccccaaggagggggugaaauaugaucuaacuuaugcaagagccuauaauuagucccagucuc

SEQ ID NO: 435608 - RNA, 64 nt, Human
gagagagagagagaaagaaugagaaagaaaaggaaugcaagagaaggagauguaaugacagaga

SEQ ID NO: 435609 - RNA, 64 nt, Human
aauuccuucaucuuucagguuaaggaaacgauccaugcaagagaggcccaaucucaacuguaga

SEQ ID NO: 435610 - RNA, 64 nt, Human
guguguaaugauugauaaagguuguaaauuuuaaaugcaagaugacgcuuacguucuguaaacc

SEQ ID NO: 435611 - RNA, 64 nt, Human
cauccacaauaaccaagauauuuuuaucccaagaaugcaagauuucagaaaaugaaaaaucugu

SEQ ID NO: 435612 - RNA, 64 nt, Human
cucuuccauaagggauccucacccuuccacuuucaugcaagaaggcccaguugccacagauuau

SEQ ID NO: 435613 - RNA, 64 nt, Human
gaguuauugcuauuuuugcugugauaaugguauuaugcaagaccauauucucaauuauuuggau

SEQ ID NO: 435614 - RNA, 64 nt, Human
gacuuggugacguucuuccuagcaguguuaauacaugcaagaaguaagagcauuuguggcuuga

SEQ ID NO: 435615 - RNA, 64 nt, Human
ggguccacagacacccccaagaagagcggauugaaugcaagagaucuaugaaguuggauggggg

SEQ ID NO: 435616 - RNA, 64 nt, Human
auguggggaguguccccacccaaugcuuuggaaaaugcaagaucuaaauuauuguaaccuuuau

SEQ ID NO: 435617 - RNA, 54 nt, Human
auaucucuucagcacagugaagcgggaguggaagaaggaucuaaagggaaaaac

SEQ ID NO: 435618 - RNA, 64 nt, Human
ggugacccagacuugagaggucguuugggcuuuaggaguggagcacguuucugugaacguuaac

SEQ ID NO: 435619 - RNA, 64 nt, Human
auguagcacgccaugcugggccagcagugucauaggaguggagggggauaaguggggacugggg

SEQ ID NO: 435620 - RNA, 64 nt, Human
caaggaaggaaacucugguacgguggcacccucaggaguggaggacagugaacuuccuugaaga

SEQ ID NO: 435621 - RNA, 64 nt, Human
uuaccacaguuuuaagaguuucaguuaccauuguaugcaagagccaagcacugaauaccuacau

SEQ ID NO: 435622 - RNA, 64 nt, Human
uuggugaauguguuccagaagacuggaacauaauaugcaagauugguaaacaggcaggagccag

SEQ ID NO: 435623 - RNA, 64 nt, Human
aaauguauuuuuuuacuuauguaguuuuuguuuuaugcaagaaacagaccugugccuucaaagc

SEQ ID NO: 435624 - RNA, 64 nt, Human
auaugugguaaaacccagaaagcauccaucaugaaugcaagauacuuucaauaaaaaguaaguu

SEQ ID NO: 435625 - RNA, 64 nt, Human
aaaggaaauuugaguuuaaauagaaacaugauaaaugcaagaaagaaaacauuuugauuuuaac

SEQ ID NO: 435626 - RNA, 64 nt, Human
agccagccaacucuuucucucugggcuucgggcuaugcaagagcguugucuaccuucuuucuuu

SEQ ID NO: 435627 - RNA, 64 nt, Human
uucacacaaugaauuucauaccuagcguggagcuaugcaagaagcagccaccagagggccccaa

SEQ ID NO: 435628 - RNA, 64 nt, Human
cccagcccaaccgagggcggcccuuggcggcaacaugcaagaaggagggacugucgaacccaag

SEQ ID NO: 435629 - RNA, 64 nt, Human
ccgcauccuugcccaccucacaggcaccgaguucaugcaagacccggaugaggagcaccugaag

SEQ ID NO: 435630 - RNA, 64 nt, Human
uccuugcccauaguaaaacagcuugaaauaucccaugcaagagaguaguuucaagugggcaacu

SEQ ID NO: 435631 - RNA, 64 nt, Human
caaggaaauacuacuacugguaauaaaacuacacaugcaagaugucagauaagaaauagguuua

SEQ ID NO: 435632 - RNA, 64 nt, Human
ucaccaggcagugugcuuccuuccuugcaugaggaugcaagaugcaacaguuugucuuucacau

SEQ ID NO: 435633 - RNA, 64 nt, Human
ucgugcuuucucaaacugaccugcugaugagaaaaugcaagacaauuuuugauacuggaacuau

SEQ ID NO: 435634 - RNA, 64 nt, Human
aaaccaccugaaugaaccuugaaugcacaaguaaaugcaagacgucuggauaccuucaagcuuu

SEQ ID NO: 435635 - RNA, 64 nt, Human
caacuuugauguuugcacuaagauuuuauuuggaaugcaagagagguugaaagaggauucagua

SEQ ID NO: 435636 - RNA, 64 nt, Human
uagguuugaacgaccaagugcaugcuggccacugggaguggaucgguggugaaccuguugccuu

SEQ ID NO: 435637 - RNA, 64 nt, Human
aggggaguguuagcagcgaggccuuccucacucaggaguggaaacucagaugugucacucagac

SEQ ID NO: 435638 - RNA, 64 nt, Human
uagucuuuuuugcauuacuuuguaaccuuuuucuaugcaagagucuuuacauaccacuaauuaa

SEQ ID NO: 435639 - RNA, 64 nt, Human
gguugauagccagucacugccuuaagaacauuugaugcaagauggccagcacugaacuuuugag

SEQ ID NO: 435640 - RNA, 64 nt, Human
cuauaacagaauaugugaaaugaauuuggaaauaaugcaagaaggcagaacucaaucauuuaaa

SEQ ID NO: 435641 - RNA, 64 nt, Human
uaagucugaauguuuucaugcaucuuuuucuuaaaugcaagagcuucuacugacucuuaacaag

SEQ ID NO: 435642 - RNA, 64 nt, Human
gaugcaacuagaggcuauuauccuaagcaaccuaaugcaagaacagaaaaccacauacugcauc

SEQ ID NO: 435643 - RNA, 64 nt, Human
agguuuuaauaaaccagccauagaggucaagaacaugcaagaccaguauucuaaaguuuugcaa

SEQ ID NO: 435644 - RNA, 64 nt, Human
agguuuuaauaaagcagccauggaggcuaagaacaugcaagaccaauauucuaaaguuuugcaa

SEQ ID NO: 435645 - RNA, 64 nt, Human
aacaaaacaaaaagucuuuuguuugugaacacugaugcaagaaacuuguuaaaugaaaggacuc

SEQ ID NO: 435646 - RNA, 64 nt, Human
ugcaguuacuugaugcgacuaaaaaguagaauaaaugcaagagauaauaauaugugaaucuuga

SEQ ID NO: 435647 - RNA, 64 nt, Human
cuauuuuaauguguauuugucacaauaacagaacaugcaagaacaaucauuauuuuauuuuaua

SEQ ID NO: 435648 - RNA, 64 nt, Human
caccuuccuuucuuccacaaacacauauugauagaugcaagagacucuuauuuagaaggcgugg

SEQ ID NO: 435649 - RNA, 64 nt, Human
uggaaauauuuugaauauuaauuuauuuuuaaagaugcaagauaggacuuugugcaauguauuu

SEQ ID NO: 435650 - RNA, 64 nt, Human
uuucuuuuuuuauuaaacagauaucuucaguuuaaugcaagagaacauuuuacuguuguacaau

SEQ ID NO: 435651 - RNA, 64 nt, Human
cauagcacgagccauguaagcuucuuuuuuuucuaugcaagaguauugauguaugugcugaauc

SEQ ID NO: 435652 - RNA, 64 nt, Human
aagaaggaucuuugaauacucuauugcugauauaaugcaagauuuaaauuuauacauauaacua

SEQ ID NO: 435653 - RNA, 64 nt, Human
gggaaaucuuuuagcugcuguuuuuagacuccaaggaguggaaauuauguggaagaagcaaacc

SEQ ID NO: 435654 - RNA, 64 nt, Human
aaacuaaauuauuucccuagaaaggaagaugaaaggaguggagugugguuuggcagaacaacug

SEQ ID NO: 435655 - RNA, 64 nt, Human
gucaagaauacugauuuacuauaaugauauauacaugcaagauauuuaacuuaauaucuuagac

SEQ ID NO: 435656 - RNA, 64 nt, Human
cguccauguucuaugugaccagacugcacaggaaaugcaagagaaacugcagaauuuugcacag

SEQ ID NO: 435657 - RNA, 64 nt, Human
ugugaauucuuccuuagacaugcagagaaaauguaugcaagagaccaaaaagauggcuccaagc

SEQ ID NO: 435658 - RNA, 64 nt, Human
uaucaauaccuaaagaaagugcaucagugaagagaugcaagacuuucaacugacuggcaaaaag

SEQ ID NO: 435659 - RNA, 64 nt, Human
auuucagcuuuggcucuggcugcuuuuuagaauaaugcaagauaaaaaucacaccugagggcug

SEQ ID NO: 435660 - RNA, 64 nt, Human
cugugagaaaacccugugauuagagggcaacuuaaugcaagaucuguggcucuauguugagagc

SEQ ID NO: 435661 - RNA, 64 nt, Human
caaggaaaccgccuaguuuacuguuuugaaaucaaugcaagagugauugcagcuuuauguucau

SEQ ID NO: 435662 - RNA, 64 nt, Human
guuaaguaauuacugaacuuuaaauggaaauaguaugcaagaaacucaggcauugaacuugaag

SEQ ID NO: 435663 - RNA, 64 nt, Human
agaacgaaauaaccuuuauugaaauaaagauacuaugcaagaaaauguacaguugucgaagugg

SEQ ID NO: 435664 - RNA, 64 nt, Human
uuucucacuuauuuuugcggugaaagucgagggcaugcaagaguuucucuuccagaagccaaga

SEQ ID NO: 435665 - RNA, 64 nt, Human
guuaagucacaaggugcugcuuuucagauccacuaugcaagaggggaggguggggccacgugaa

SEQ ID NO: 435666 - RNA, 64 nt, Human
auuucaucccagaaacuccagacuuguagucuccaugcaagauuucuuugucggcggcuugaua

SEQ ID NO: 435667 - RNA, 64 nt, Human
guagagaaaacaucuuaagagagcaagcuccaauaugcaagagcuuaucgauccuguacaucua

SEQ ID NO: 435668 - RNA, 64 nt, Human
aaaacgcagaaccuuaagauuguccacauccuucaugcaagacugcugccuucauguaacccug

SEQ ID NO: 435669 - RNA, 64 nt, Human
ggguaauaaaguggggaaaaggaacgucuucucaaugcaagaacauaagcuuucucguauauac

SEQ ID NO: 435670 - RNA, 64 nt, Human
aaaauuuguguucacgggaugcaccaaaguguguaccccguaagcaugaaaccaguguuuuuug

SEQ ID NO: 435671 - RNA, 64 nt, Human
ggagccagaggguggaaauggccucuaagcuagcaccccguaagaagagccuaccugaccgacu

SEQ ID NO: 435672 - RNA, 64 nt, Human
gcauuuuuuauucacaauuggaaacacaaauguaaugcaagaauaaaaaauauuuuggggcaga

SEQ ID NO: 435673 - RNA, 64 nt, Human
aucuucuggugaaggaaauuaaugauguaagaaaaugcaagaggcucaacuucucuuccaaaaa

SEQ ID NO: 435674 - RNA, 64 nt, Human
uucucacauucuagacaaugauggacaaagacgcaugcaagacucagacccggggaauggugug

SEQ ID NO: 435675 - RNA, 64 nt, Human
cuacuugaugacugcagucgucaaggggcuccugaugcaagaugccccuuccauuuuaagucug

SEQ ID NO: 435676 - RNA, 64 nt, Human
ccagccucaccagcgcuugaagccugaacccaagaugcaagaaggaggcuaugcucaggggccc

SEQ ID NO: 435677 - RNA, 64 nt, Human
uuuauaauggaacagaacauugguagguaacaagaugcaagaggaugucaauacaagauugucu

SEQ ID NO: 435678 - RNA, 64 nt, Human
ucggggccucaggcuucucagcugggaagagaggaugcaagaccagacugaagaacacgguuga

SEQ ID NO: 435679 - RNA, 64 nt, Human
ccauucaccacugcguccugggcuuuacgagaccaugcaagacggggguuagugaggaaggagg

SEQ ID NO: 435680 - RNA, 64 nt, Human
agaaagaauaaaagcuggagagagagugaagugaaugcaagauaaaaagugggauggaagaauu

SEQ ID NO: 435681 - RNA, 64 nt, Human
aaagauuuuguugaaaguuuuaguguugucugaaaugcaagagggaaggugauugguagugagu

SEQ ID NO: 435682 - RNA, 64 nt, Human
cugggaagucaaugugaaaaacauugcugcauucaugcaagacugaaauuuauuauuagacaaa

SEQ ID NO: 435683 - RNA, 64 nt, Human
aauaccaaggaggaaauacccuuuguuuuuaaugaugcaagaguggacguaaugcuaguuggca

SEQ ID NO: 435684 - RNA, 64 nt, Human
uacagaugucuucaagaccuggggugaguuaucaaugcaagaaugguucuuagaaaucugauga

SEQ ID NO: 435685 - RNA, 64 nt, Human
auuguuaugcaugaaaccagugguagaagaaacaaugcaagacauacauuuccacuauggucgg

SEQ ID NO: 435686 - RNA, 64 nt, Human
uaauuacguaauguaaaagcccaacaaacacuuuaugcaagauuggaauguaucuucaaauuca

SEQ ID NO: 435687 - RNA, 64 nt, Human
ucgcaaauauaaauugcacaugcagaaggcacagaccccguagcgcaugccaacuugcagggac

SEQ ID NO: 435688 - RNA, 64 nt, Human
ggcucuguacuggccacacuuacuauugacagucaccccguaagguucacaaaccaccccauug

SEQ ID NO: 435689 - RNA, 64 nt, Human
uuggcucaucaauuguaacaaaugaaccauaaugaugcaagauguuaauaauuggggagccugu

SEQ ID NO: 435690 - RNA, 64 nt, Human
cuaaaaaauggaaagauguugaugacuugaagugaugcaagaauggacaagucagggaagucau

SEQ ID NO: 435691 - RNA, 64 nt, Human
augcuugacgugaggcccgacacuaggauucucaaugcaagaauccaguaccuugcacauagaa

SEQ ID NO: 435692 - RNA, 64 nt, Human
cauaguaaugagugaguucucacucugguuguuuaugcaagagcugguuguuuaaaagagccug

SEQ ID NO: 435693 - RNA, 64 nt, Human
cucaguuccuguagaaaacgaacuguaaaagaccaugcaagaggcaaaauaaaacuugaaguga

SEQ ID NO: 435694 - RNA, 64 nt, Human
aauuucuugauuugaaaaugugugugcucuauugaugcaagacaagucauccuuccuacuguca

SEQ ID NO: 435695 - RNA, 64 nt, Human
ccaguggcggggcccagcgcccagcaggacacccaugcaagaggcugagccccccaacauccaa

SEQ ID NO: 435696 - RNA, 64 nt, Human
cucuuuuaucagaucacaaacuccuagagucuacaugcaagacuaguaaagucuuauggagucu

SEQ ID NO: 435697 - RNA, 64 nt, Human
uguaacuugauuucuuaucuguguuuguguuggcaugcaagauuuagguacuuaucaaagauaa

SEQ ID NO: 435698 - RNA, 57 nt, Human
gcccugcuggcagagcgugaacgccugaugcaagaugggcaucggcagcggggccug

SEQ ID NO: 435699 - RNA, 64 nt, Human
gagcgaccuuugaccccaaccacugagguucucuaugcaagauggagagaggaugcacccugug

SEQ ID NO: 435700 - RNA, 64 nt, Human
ccucgucgacuccacagggaccuuucagacaaaaaugcaagaagcagcggccuccccugucccc

SEQ ID NO: 435701 - RNA, 64 nt, Human
uuuccaaagcgagaggagccuucugagcagaaguaugcaagacugauucuguuuggaacaguuu

SEQ ID NO: 435702 - RNA, 64 nt, Human
auugcugagacauuaauaaugaccucuuagugcaaugcaagaugguguccucggauaaugaucu

SEQ ID NO: 435703 - RNA, 64 nt, Human
uggcuaacacggugaaaacccaucucuacuaaaaaugcaagaaaauuagcccggcacgguggcu

SEQ ID NO: 435704 - RNA, 64 nt, Human
gacccccagggacccuugccccaggacaccgccuaccccguacagaccccuucacuccggggug

SEQ ID NO: 435705 - RNA, 64 nt, Human
cucagggcuccuugccuuucccccccaccagcacaccccguacccugccuggaaucccagcacc

SEQ ID NO: 435706 - RNA, 64 nt, Human
augaaggccaucuuguagauuacauuuaucauuaaugcaagaauaaagacaauuccuccuguca

SEQ ID NO: 435707 - RNA, 64 nt, Human
auaggagcaaaucuaucuuuauauuuuuauuagaaugcaagaauuuugcacauuaacuggaaaa

SEQ ID NO: 435708 - RNA, 64 nt, Human
caccuuggugcacuuucuucggaugaagaguuuaaugcaagaguagguguaagauauuuaaauu

SEQ ID NO: 435709 - RNA, 64 nt, Human
cguguuccucuuuaaauuguuuuugguugaacaaaugcaagauugaacaaaauuaaaaauucau

SEQ ID NO: 435710 - RNA, 64 nt, Human
auagaagauaauauauuuaauggcacugagaaacaugcaagauacaggaaaaaugaaaauguua

SEQ ID NO: 435711 - RNA, 64 nt, Human
agcaaauacugaacuuucucagauauggcauuagaugcaagacaaccuccuagggauugaugcc

SEQ ID NO: 435712 - RNA, 64 nt, Human
agauaaguuuguuuacuuaugcccuccggaaaucaugcaagacugcucccugcaaaggggggcg

SEQ ID NO: 435713 - RNA, 64 nt, Human
cucuaagcucucucaguuccuucccuuccacaaaaugcaagagcaaaagcaaacuacaaacagg

SEQ ID NO: 435714 - RNA, 64 nt, Human
ucuaguacuuauuacaugcugcuauacacaagcaaugcaagaaaaaaacuuacuggguagguga

SEQ ID NO: 435715 - RNA, 64 nt, Human
aguuggaaugauuuuuagguugaguauuuacacaaugcaagaaaacaccuuuuuacaaauggaa

SEQ ID NO: 435716 - RNA, 64 nt, Human
gcuggaugccccauggcaauugucaaggcucuugaugcaagagcccagggggcuauuguaaaaa

SEQ ID NO: 435717 - RNA, 64 nt, Human
ugcacacuuauacccccagccacucaggaggcugaugcaagaggaucgcuugagcccaggaguu

SEQ ID NO: 435718 - RNA, 64 nt, Human
ucacuuuugaaaucuagaauugauguuguaauuaaugcaagauauuaccauguacaugguacca

SEQ ID NO: 435719 - RNA, 64 nt, Human
auaucauuauaacugaaggagaaggugccccaaaaugcaagauuuuccacaagauucccagaga

SEQ ID NO: 435720 - RNA, 64 nt, Human
aggcgucagaaguaggaagggcaggggaacaggaaugcaagauuaaggaaaccgcagcugagca

SEQ ID NO: 435721 - RNA, 64 nt, Human
gccuaaacacuauuucauuuauuuauguuuggaaaccccguaaacauuuuuguuugcaaucuug

SEQ ID NO: 435722 - RNA, 64 nt, Human
uccugccccgugccuaggucagggguccuggaauaccccguagcucuggcaccaccacacuggc

SEQ ID NO: 435723 - RNA, 64 nt, Human
gggagaugccuggguccuguucuuccuacauaaaaugcaagaaaacagcauggccaguaaacug

SEQ ID NO: 435724 - RNA, 64 nt, Human
aauguguuuuuaacacaugaaaauauuaaaggauaugcaagagaaauuuuucaagcagugugau

SEQ ID NO: 435725 - RNA, 64 nt, Human
aagggcucguccuaccuaaagcuuccugccaauaaugcaagaagccagcugcaauuucccagaa

SEQ ID NO: 435726 - RNA, 64 nt, Human
ccugcagaagcauuuuuaauaccucauucugucuaugcaagaugaaaauccauggaguuuuuuc

SEQ ID NO: 435727 - RNA, 64 nt, Human
aaaauggaaacguuaagaaguuggaauguuggagaugcaagaauuuccaagaacuuucuuagcc

SEQ ID NO: 435728 - RNA, 64 nt, Human
cucaaaacauccuugacuguccccugguacacauaugcaagagacuuuaugcguaagaguggag

SEQ ID NO: 435729 - RNA, 64 nt, Human
ugaaggcuaaaaagcaacaggccauugugaaccaaugcaagacgcccucuaucauggugaaaag

SEQ ID NO: 435730 - RNA, 64 nt, Human
guuauugaccgguuucaguguuguauauauaaauaugcaagaugugccuuacaaugaaguuguu

SEQ ID NO: 435731 - RNA, 64 nt, Human
caaaaucuguacaaaaaucuguuuuuacaucauaaugcaagaauuggaaauuuuucuaugguag

SEQ ID NO: 435732 - RNA, 64 nt, Human
uguagggggcauagaggauucuugaaaaaaaaaaaugcaagagugauuuucuguuacauucaau

SEQ ID NO: 435733 - RNA, 64 nt, Human
uucugcuuuucaaauucauaacauugaucuuuuuaugcaagauuuccauuuacaguugaauaag

SEQ ID NO: 435734 - RNA, 64 nt, Human
uuccaucaccccaaccucuccuuucugugcauucaugcaagaguuucuuguaagccaucagaag

SEQ ID NO: 435735 - RNA, 64 nt, Human
uccucacucuguaguguuuguggggauagguuccaugcaagaacaccuuccuccuccauccccc

SEQ ID NO: 435736 - RNA, 64 nt, Human
gaggaagcaaggaagcaaacagucugagaaaaugaugcaagaaaaucaaaugggaaucugggga

SEQ ID NO: 435737 - RNA, 64 nt, Human
uaaauuacccaguaucaaguauuucuuuauagcaaugcaagaauggccuaaaacacaaggcaaa

SEQ ID NO: 435738 - RNA, 64 nt, Human
gaaguugcugugcccacauuguuugaacucgcguaccccguagauacauugugcaacguucuuc

SEQ ID NO: 435739 - RNA, 64 nt, Human
gcugccccaucccucccccaaccccuguauccccaccccguacucccaccccucccacaacccc

SEQ ID NO: 435740 - RNA, 64 nt, Human
augggcuaucagggaggaagauguucaauagaacaugcaagaauuucuggaagaaaggcugugg

SEQ ID NO: 435741 - RNA, 64 nt, Human
agaauucacauccugggugggacagagcaggacaaugcaagauuccaucccacuacucagaaug

SEQ ID NO: 435742 - RNA, 64 nt, Human
uguggcaugaauacuuuuuguaaugauugauuaaaugcaagauaguuuaucuaacuucgugcgg

SEQ ID NO: 435743 - RNA, 64 nt, Human
ccccuuuaaauaaaaauauuagaucaaauacuauaugcaagaaaucauagcaaaguuuuuuuuu

SEQ ID NO: 435744 - RNA, 64 nt, Human
aauuggaaaacuugacuaugaucuggaacagauaaugcaagaaggaacacauaaguaaguugcu

SEQ ID NO: 435745 - RNA, 64 nt, Human
ugugaauuucugucucaaaauguauaauauagaaaugcaagaaaaaaacaaauguacagauugu

SEQ ID NO: 435746 - RNA, 64 nt, Human
acuucuucauuccuuuaaaaacuacaucuuuccuaugcaagagugucucacaugugcuuaaccg

SEQ ID NO: 435747 - RNA, 64 nt, Human
gggcccagaggagcuggugcugaccuagcuagggaugcaagagugagcaagcagcacccccacc

SEQ ID NO: 435748 - RNA, 64 nt, Human
agauccuugacuucuguuccucucucuccugcagaugcaagagcuccugggcaggggugccugg

SEQ ID NO: 435749 - RNA, 64 nt, Human
gaaucguacuuuauauuuccaaauuuaaauuuaaaugcaagaucuuucaacauaaacagaagau

SEQ ID NO: 435750 - RNA, 64 nt, Human
ugacacaguugauuuuauucacaccauuagggguaugcaagaugucccuguuuuauaaacauaa

SEQ ID NO: 435751 - RNA, 64 nt, Human
agcuguguuccuuucaguaguugccaucuuggccaugcaagaaaagaaaagaaggcauuuacuc

SEQ ID NO: 435752 - RNA, 64 nt, Human
gcagcuuggagaacuccgcuggauggggagucucaugcaagacuucacugcagccuuucacagg

SEQ ID NO: 435753 - RNA, 64 nt, Human
cuccucccuugccaccgucuugguggcaguagcgaugcaagaaugaugggagcuuuccgagagc

SEQ ID NO: 435754 - RNA, 64 nt, Human
uuuagccauugauguucacacguggcaucagcccaugcaagauagguuucuguauuuauauauu

SEQ ID NO: 435755 - RNA, 64 nt, Human
uaaagggagauuugcuauuauuaguggaauguugaccccguauguagagaaacaguacgugccu

SEQ ID NO: 435756 - RNA, 64 nt, Human
uuuaggaucgcccucccauccucucacccacuggaccccguaggaguccugaccccagaugccc

SEQ ID NO: 435757 - RNA, 64 nt, Human
acaacaugggugaaccuagaaaauacugaucuaaaugcaagaagccaggcacaaaaggccacau

SEQ ID NO: 435758 - RNA, 64 nt, Human
uuagcacuucaaagacgaggaaguaaggaagggaaugcaagacuagugcauaaaaaugcaauag

SEQ ID NO: 435759 - RNA, 64 nt, Human
gacuuuaaaaaaaaucuuugauuugcacuguuauaugcaagaaguggugaaucacacugagaua

SEQ ID NO: 435760 - RNA, 64 nt, Human
gucuucauuuauugcccaguccauuuaaagacccaugcaagagccugguuugucaucccugccc

SEQ ID NO: 435761 - RNA, 64 nt, Human
acugucuugauaauuagccugaccagcaggaugaaugcaagacugacagugauggacucuguga

SEQ ID NO: 435762 - RNA, 64 nt, Human
acauuucucugagcagucagggugggaagaaagaaugcaagaguggacugaaugugccuaaugg

SEQ ID NO: 435763 - RNA, 64 nt, Human
aguggaggcgggggugaauucuuaggucgagcugaugcaagaaacuccgguagccagccucugu

SEQ ID NO: 435764 - RNA, 64 nt, Human
agaaaagcuaaagcaaaaacacuggcauaugaccaugcaagacugucagugccaacaaagacaa

SEQ ID NO: 435765 - RNA, 64 nt, Human
uuaaaaaauguuacauauuguaugcacugugcugaugcaagaauucuacauuuuaaugaguuau

SEQ ID NO: 435766 - RNA, 64 nt, Human
ucuccaucuccaagcagacaaccuuugucuuuacaugcaagagggauccaauuaugacaggcug

SEQ ID NO: 435767 - RNA, 64 nt, Human
cagcacuucugacuuuuuuuuuuuugguacaacaaugcaagaugcucugauagcauuugcuaac

SEQ ID NO: 435768 - RNA, 64 nt, Human
cuuucuuaacauucccacgugcccagggcuguucaugcaagauuuuaauggugacuuguccugg

SEQ ID NO: 435769 - RNA, 64 nt, Human
uuggauaaggaauuauagaccucuaguagcugaaaugcaagaccccaagaggaaguucagaucu

SEQ ID NO: 435770 - RNA, 59 nt, Human
cugaguuggagaaacaguagcguccagguaugcaagagaccgcggaacauugcacuaaa

SEQ ID NO: 435771 - RNA, 64 nt, Human
cccccagcuagucccugagcaauacggcagacagaugcaagaccauuuuucuccaagccauggg

SEQ ID NO: 435772 - RNA, 64 nt, Human
ccgggacccaugugacccagcggccccucgcgcuggaguggaggaugccuucuacacguuggug

SEQ ID NO: 435773 - RNA, 64 nt, Human
aagucagaguaggaugcacaguacaaaggaggggggaguggaggccugagagggaaguuucugg

SEQ ID NO: 435774 - RNA, 64 nt, Human
aaagcauucauaucugccaagauccuuugaauacaugcaagaacacacaauggagagaaacccu

SEQ ID NO: 435775 - RNA, 64 nt, Human
gcagcaccugauucucacagcaacaugugacaacaugcaagaaguacugccaauacugccaacc

SEQ ID NO: 435776 - RNA, 64 nt, Human
cagcugggacaaaugaauuuaaaaaaucagaaaaaugcaagauuuauaugcaugaaguuaaaac

SEQ ID NO: 435777 - RNA, 64 nt, Human
uuuucaauaaaguagaaagugguaaagauucaacaugcaagauuguacuuauugggcuucagaa

SEQ ID NO: 435778 - RNA, 50 nt, Human
cucacaguggagaaagguaaaugcaagauaugugggaaagaauuucugua

SEQ ID NO: 435779 - RNA, 64 nt, Human
caugacaaugcacacuggagauggaccucacaaaaugcaagauaugugggaaagccuuuguuua

SEQ ID NO: 435780 - RNA, 64 nt, Human
agggucagauuucccauucagacgccccucucccaugcaagagaaagagcuguucuccuuucuc

SEQ ID NO: 435781 - RNA, 64 nt, Human
ccuguugcaggaagccccuccuguuagcagcgggaugcaagaugcugucucggggcucuccuua

SEQ ID NO: 435782 - RNA, 64 nt, Human
acaguauuuauuauaaauuacuaccgugacugggaugcaagagaauuaggacuauaauuuuccu

SEQ ID NO: 435783 - RNA, 64 nt, Human
ucuguuauuugcaauuaaagcaaguuuuuaaaaaaugcaagaggcaguuguuagucuucagggc

SEQ ID NO: 435784 - RNA, 64 nt, Human
ucggacuuggcacuccuggacaaccuggacccagaugcaagacacugugccaccgccuucccug

SEQ ID NO: 435785 - RNA, 64 nt, Human
ugcuuuuuuaaaaucguucauagacuucuguaaaaugcaagauaaauuaaaguuauuauaacag

SEQ ID NO: 435786 - RNA, 64 nt, Human
aguuacaagacugauuuaaaccgucucugauuuaaugcaagauauauugugucuauaaagguuu

SEQ ID NO: 435787 - RNA, 64 nt, Human
guaccauagcauuguacuugccucuuuagcugguaugcaagauuugcuaagcaauaaucuuccg

SEQ ID NO: 435788 - RNA, 64 nt, Human
aucuguuuucugaaaucuuuuaagcuaaaaucacaugcaagaauugacuuugcagcuacuaauu

SEQ ID NO: 435789 - RNA, 64 nt, Human
gaacaccucagcugcuguaagcuucuccucucucaccccguaaacugacaagcaugaugaaaaa

SEQ ID NO: 435790 - RNA, 64 nt, Human
aaaauccuugauacuguugccugccuuuuuagucaccccguaacaagggcacacauccaggacu

SEQ ID NO: 435791 - RNA, 64 nt, Human
uugcuugagcccaggaguugaagaacguggcgaaaccccguaucuauuauuuaaaaaaauugaa

SEQ ID NO: 435792 - RNA, 64 nt, Human
aucucuggcuauuagcacuguucacuacauuaacaugcaagagagagagaagccuuguuacauu

SEQ ID NO: 435793 - RNA, 64 nt, Human
guuuuaguauacaugccaugccagaagauaguguaugcaagaagucuugggaccagaaaauggc

SEQ ID NO: 435794 - RNA, 64 nt, Human
caacugaaaccccagagguuuguauaucaguagaaugcaagaacauuguuaaaggugcuuacga

SEQ ID NO: 435795 - RNA, 64 nt, Human
aagcagccaaaccuuuccuguaacagagacggucaugcaagaaagcagacagcaagggcuugca

SEQ ID NO: 435796 - RNA, 64 nt, Human
acugugcaguagccguuugugguuuaaagcaaacaugcaagaugaaccugagggaugauagaau

SEQ ID NO: 435797 - RNA, 64 nt, Human
aguccugauggagcaagaggcccacgccuaggggaugcaagaacaacccguuucuuaaauguua

SEQ ID NO: 435798 - RNA, 64 nt, Human
cuccacucccugaggccacuuagccugagacaugaugcaagagcugcaggccggggggcucagu

SEQ ID NO: 435799 - RNA, 64 nt, Human
ccugccaugaugagugugaagaaaucauuucucuaugcaagacuggcauccugggacugcacga

SEQ ID NO: 435800 - RNA, 64 nt, Human
cugccauaagcgugcuuucauuuucaaguagcauaugcaagaguccaaacaggcuacccaaugu

SEQ ID NO: 435801 - RNA, 64 nt, Human
auuacuuuuauuauauuguuuacaaauauauuucaugcaagaaacagaaaaaaaaaaaaacccu

SEQ ID NO: 435802 - RNA, 64 nt, Human
agauaaacuauaggauagauagaaugguuauuuuaugcaagaaauauuguaccgcaaggguggu

SEQ ID NO: 435803 - RNA, 64 nt, Human
cuauuugcuguaaugucaagaaaauguucaccagaugcaagaauguaccuuuucuuuuuagaaa

SEQ ID NO: 435804 - RNA, 64 nt, Human
ucccacuggugauauggcuguaggaucccccuugaugcaagagguaggcuccccgaaagacccu

SEQ ID NO: 435805 - RNA, 64 nt, Human
aaaguaguuagccaauaugcaaucacugaaaacuaugcaagagaaauuccaaccguccugaccu

SEQ ID NO: 435806 - RNA, 64 nt, Human
ugaagcugguggaucucuaccuaaugaaggcaguaugcaagaaggauaaguuacaacuccuugg

SEQ ID NO: 435807 - RNA, 64 nt, Human
ccauccucccagccagcuacaguagggccuccucaccccguaccccacagcuagacagugucag

SEQ ID NO: 435808 - RNA, 64 nt, Human
cauagcagggauucuuagcuagguguccccaugaaccccguaaaguucuacacaaagucuugca

SEQ ID NO: 435809 - RNA, 64 nt, Human
ucuagagagccacauccuguugacugaaaguggcaugcaagauaaauuuauuugcuguuccuug

SEQ ID NO: 435810 - RNA, 64 nt, Human
ccuaggcggcuucuuccugucagucggagguggcaugcaagaugaagcucucuuugcucuuccu

SEQ ID NO: 435811 - RNA, 64 nt, Human
ucuugaggaacggaucagaugucuauauugcugaaugcaagaaguggggcagcagcaguggaga

SEQ ID NO: 435812 - RNA, 64 nt, Human
cacugucugucaccuuccuguauuuccacagagcaugcaagaacuucuacaaaacuucuauacc

SEQ ID NO: 435813 - RNA, 64 nt, Human
aguuaaacaagaguugggaaacagguggagaauaaugcaagagaguuuguaauuaagugccaau

SEQ ID NO: 435814 - RNA, 64 nt, Human
gccucagcugggacccaccguguagacacacgacaugcaagaguugcagcggcugcuccaacuc

SEQ ID NO: 435815 - RNA, 64 nt, Human
uauagucugccuuuaagggaguuuuagaaccaacaugcaagacauugaaagaaaucuugcaaga

SEQ ID NO: 435816 - RNA, 64 nt, Human
gucuguaggccaacaagaagguuccuuuacccccaugcaagacacuuaugagaacacauuacaa

SEQ ID NO: 435817 - RNA, 64 nt, Human
guggccuauuucccccgucagguugcacaggugcaugcaagagcauucuuaggagaccacuguu

SEQ ID NO: 435818 - RNA, 64 nt, Human
cuccccagugcugucugagcgcucccugcuggcuaugcaagaggacgcggccccggggggcucg

SEQ ID NO: 435819 - RNA, 64 nt, Human
auuuucucaaacuaagugcuugcuguucccaaauaugcaagaauaacuuuuacacuuuuuccuu

SEQ ID NO: 435820 - RNA, 64 nt, Human
aaagugaacauaacugaacacaaguauuuuuucaaugcaagaugaggaugaaaauuuuacauuu

SEQ ID NO: 435821 - RNA, 64 nt, Human
ugaaaucggguuaaagugaugaugauaaaauagcaugcaagaaacaagcuccuuccaucagacu

SEQ ID NO: 435822 - RNA, 64 nt, Human
ugcuugaaaguacuggagcacguggucagggucaaugcaagaguucucauuuccuacccauccc

SEQ ID NO: 435823 - RNA, 64 nt, Human
uuccacaacauccccugggucagacccaccagguaccccguaggaauuuccaguuucccuugau

SEQ ID NO: 435824 - RNA, 64 nt, Human
auggcugauggcugagagcccaccaaccuuccccaccccguaucaguuugaccacgggccuuuu

SEQ ID NO: 435825 - RNA, 64 nt, Human
gccugggcuuccccuuuauuucccuuuuccauuuaccccguaaugugucucuacagcuaccuua

SEQ ID NO: 435826 - RNA, 64 nt, Human
gucugcaucuccaucuuaccccuugccugacuguaccccguagaccccuguuucuccuccugca

SEQ ID NO: 435827 - RNA, 64 nt, Human; identical to SEQ ID NO: 388109

SEQ ID NO: 435828 - RNA, 64 nt, Human; identical to SEQ ID NO: 388113

SEQ ID NO: 435829 - RNA, 64 nt, Human; identical to SEQ ID NO: 388114

SEQ ID NO: 435830 - RNA, 64 nt, Human; identical to SEQ ID NO: 388115

SEQ ID NO: 435831 - RNA, 64 nt, Human; identical to SEQ ID NO: 388116

SEQ ID NO: 435832 - RNA, 64 nt, Human; identical to SEQ ID NO: 388117

SEQ ID NO: 435833 - RNA, 64 nt, Human; identical to SEQ ID NO: 388118

SEQ ID NO: 435834 - RNA, 64 nt, Human; identical to SEQ ID NO: 388119

SEQ ID NO: 435835 - RNA, 64 nt, Human; identical to SEQ ID NO: 388120

SEQ ID NO: 435836 - RNA, 64 nt, Human; identical to SEQ ID NO: 388121

SEQ ID NO: 435837 - RNA, 64 nt, Human; identical to SEQ ID NO: 388122

SEQ ID NO: 435838 - RNA, 64 nt, Human; identical to SEQ ID NO: 388123

SEQ ID NO: 435839 - RNA, 64 nt, Human; identical to SEQ ID NO: 388124

SEQ ID NO: 435840 - RNA, 64 nt, Human; identical to SEQ ID NO: 388125

SEQ ID NO: 435841 - RNA, 64 nt, Human; identical to SEQ ID NO: 388126

SEQ ID NO: 435842 - RNA, 64 nt, Human
uuggcauuaucaggauucguguuuugugggggugggaguggagaguaggguggucuugugaguu

SEQ ID NO: 435843 - RNA, 64 nt, Human
gaagcagccccaugugcuucccugcccccgaccuggaguggauaagacaagagggguauuuugg

SEQ ID NO: 435844 - RNA, 64 nt, Human
acuggaaagucaccuggucgagucuagggaggagggaguggaagggucucugcuucuguacaaa

SEQ ID NO: 435845 - RNA, 57 nt, Human; identical to SEQ ID NO: 388127

SEQ ID NO: 435846 - RNA, 64 nt, Human; identical to SEQ ID NO: 388131

SEQ ID NO: 435847 - RNA, 64 nt, Human; identical to SEQ ID NO: 388132

SEQ ID NO: 435848 - RNA, 64 nt, Human; identical to SEQ ID NO: 388133

SEQ ID NO: 435849 - RNA, 64 nt, Human; identical to SEQ ID NO: 388134

SEQ ID NO: 435850 - RNA, 64 nt, Human; identical to SEQ ID NO: 388135

SEQ ID NO: 435851 - RNA, 64 nt, Human; identical to SEQ ID NO: 388136

SEQ ID NO: 435852 - RNA, 64 nt, Human; identical to SEQ ID NO: 388137

SEQ ID NO: 435853 - RNA, 64 nt, Human; identical to SEQ ID NO: 388138

SEQ ID NO: 435854 - RNA, 64 nt, Human; identical to SEQ ID NO: 388139

SEQ ID NO: 435855 - RNA, 64 nt, Human; identical to SEQ ID NO: 388140

SEQ ID NO: 435856 - RNA, 64 nt, Human; identical to SEQ ID NO: 388141

SEQ ID NO: 435857 - RNA, 64 nt, Human; identical to SEQ ID NO: 388142

SEQ ID NO: 435858 - RNA, 64 nt, Human; identical to SEQ ID NO: 388143

SEQ ID NO: 435859 - RNA, 64 nt, Human; identical to SEQ ID NO: 388144

SEQ ID NO: 435860 - RNA, 64 nt, Human
aaaccacucuugaacuuugaggguuucuguucuaggaguggacuagaaguuuaagcccagaguc

SEQ ID NO: 435861 - RNA, 64 nt, Human
ugagcucuucauuuauuuugacugugauuuauuuggaguggaggcauuguuuuuaagaaaaaca

SEQ ID NO: 435862 - RNA, 64 nt, Human
gcguggagggcgugggagcgugggaggcgggaguggaguggaagaagagggagagguggagcaa

SEQ ID NO: 435863 - RNA, 64 nt, Human; identical to SEQ ID NO: 388145

SEQ ID NO: 435864 - RNA, 64 nt, Human; identical to SEQ ID NO: 388149

SEQ ID NO: 435865 - RNA, 64 nt, Human; identical to SEQ ID NO: 388150

SEQ ID NO: 435866 - RNA, 64 nt, Human; identical to SEQ ID NO: 388151

SEQ ID NO: 435867 - RNA, 64 nt, Human; identical to SEQ ID NO: 388152

SEQ ID NO: 435868 - RNA, 58 nt, Human; identical to SEQ ID NO: 388153

SEQ ID NO: 435869 - RNA, 64 nt, Human; identical to SEQ ID NO: 388154

SEQ ID NO: 435870 - RNA, 64 nt, Human; identical to SEQ ID NO: 388155

SEQ ID NO: 435871 - RNA, 64 nt, Human; identical to SEQ ID NO: 388156

SEQ ID NO: 435872 - RNA, 59 nt, Human; identical to SEQ ID NO: 388157

SEQ ID NO: 435873 - RNA, 64 nt, Human; identical to SEQ ID NO: 388158

SEQ ID NO: 435874 - RNA, 64 nt, Human; identical to SEQ ID NO: 388159

SEQ ID NO: 435875 - RNA, 64 nt, Human; identical to SEQ ID NO: 388160

SEQ ID NO: 435876 - RNA, 64 nt, Human; identical to SEQ ID NO: 388161

SEQ ID NO: 435877 - RNA, 64 nt, Human; identical to SEQ ID NO: 388162

SEQ ID NO: 435878 - RNA, 64 nt, Human
aacuaaaaugaugaacuauuuuauguagacauuaggaguggaucggaauacuucugcuuucugg

SEQ ID NO: 435879 - RNA, 64 nt, Human
ccucugccccucaccaaaaccugcggggcugcuuggaguggaaagcagggagcaguguucagag

SEQ ID NO: 435880 - RNA, 64 nt, Human
gagaagcguccguccucgagccaggcgggaggagggaguggagagacugacuggccgugauggg

SEQ ID NO: 435881 - RNA, 64 nt, Human; identical to SEQ ID NO: 388163

SEQ ID NO: 435882 - RNA, 64 nt, Human; identical to SEQ ID NO: 388167

SEQ ID NO: 435883 - RNA, 64 nt, Human; identical to SEQ ID NO: 388168

SEQ ID NO: 435884 - RNA, 64 nt, Human; identical to SEQ ID NO: 388169

SEQ ID NO: 435885 - RNA, 64 nt, Human; identical to SEQ ID NO: 388170

SEQ ID NO: 435886 - RNA, 64 nt, Human; identical to SEQ ID NO: 388171

SEQ ID NO: 435887 - RNA, 64 nt, Human; identical to SEQ ID NO: 388172

SEQ ID NO: 435888 - RNA, 64 nt, Human; identical to SEQ ID NO: 388173

SEQ ID NO: 435889 - RNA, 64 nt, Human; identical to SEQ ID NO: 388174

SEQ ID NO: 435890 - RNA, 64 nt, Human; identical to SEQ ID NO: 388175

SEQ ID NO: 435891 - RNA, 64 nt, Human; identical to SEQ ID NO: 388176

SEQ ID NO: 435892 - RNA, 64 nt, Human; identical to SEQ ID NO: 388177

SEQ ID NO: 435893 - RNA, 64 nt, Human; identical to SEQ ID NO: 388178

SEQ ID NO: 435894 - RNA, 64 nt, Human; identical to SEQ ID NO: 388179

SEQ ID NO: 435895 - RNA, 64 nt, Human; identical to SEQ ID NO: 388180

SEQ ID NO: 435896 - RNA, 64 nt, Human
guccuccuuccuggcgggggugggccguggagucggaguggacaccgcucaguauuacuuucug

SEQ ID NO: 435897 - RNA, 64 nt, Human
ucagugccuggaaggcaggugugcccgucagcggggaguggaacucaucaggcuugccaagagg

SEQ ID NO: 435898 - RNA, 64 nt, Human
aggcaggcacuggcuggcucagcuccacucggguggaguggaaguggccagaccauuuagacgg

SEQ ID NO: 435899 - RNA, 64 nt, Human; identical to SEQ ID NO: 388181

SEQ ID NO: 435900 - RNA, 64 nt, Human; identical to SEQ ID NO: 388184

SEQ ID NO: 435901 - RNA, 64 nt, Human; identical to SEQ ID NO: 388185

SEQ ID NO: 435902 - RNA, 64 nt, Human; identical to SEQ ID NO: 388186

SEQ ID NO: 435903 - RNA, 64 nt, Human; identical to SEQ ID NO: 388187

SEQ ID NO: 435904 - RNA, 64 nt, Human; identical to SEQ ID NO: 388188

SEQ ID NO: 435905 - RNA, 64 nt, Human; identical to SEQ ID NO: 388189

SEQ ID NO: 435906 - RNA, 64 nt, Human; identical to SEQ ID NO: 388190

SEQ ID NO: 435907 - RNA, 64 nt, Human; identical to SEQ ID NO: 388191

SEQ ID NO: 435908 - RNA, 64 nt, Human; identical to SEQ ID NO: 388192

SEQ ID NO: 435909 - RNA, 64 nt, Human; identical to SEQ ID NO: 388193

SEQ ID NO: 435910 - RNA, 64 nt, Human; identical to SEQ ID NO: 388194

SEQ ID NO: 435911 - RNA, 64 nt, Human; identical to SEQ ID NO: 388195

SEQ ID NO: 435912 - RNA, 64 nt, Human; identical to SEQ ID NO: 388196

SEQ ID NO: 435913 - RNA, 64 nt, Human; identical to SEQ ID NO: 388197

SEQ ID NO: 435914 - RNA, 64 nt, Human
cuuugagacugggucucgcuuuguugcccaggcuggaguggaguggcgugaucuuggcuuacug

SEQ ID NO: 435915 - RNA, 64 nt, Human
gugauuaaacuauuuaauugugugucuauauuuuggaguggaauaauuucuucauuaaaaaaug

SEQ ID NO: 435916 - RNA, 64 nt, Human
gaaaggugacgugcaaaacugccuauuacucccaggaguggaggauaauuucauauuucaugga

SEQ ID NO: 435917 - RNA, 64 nt, Human; identical to SEQ ID NO: 388198

SEQ ID NO: 435918 - RNA, 64 nt, Human; identical to SEQ ID NO: 388202

SEQ ID NO: 435919 - RNA, 64 nt, Human; identical to SEQ ID NO: 388203

SEQ ID NO: 435920 - RNA, 64 nt, Human; identical to SEQ ID NO: 388204

SEQ ID NO: 435921 - RNA, 64 nt, Human; identical to SEQ ID NO: 388205

SEQ ID NO: 435922 - RNA, 64 nt, Human; identical to SEQ ID NO: 388206

SEQ ID NO: 435923 - RNA, 64 nt, Human; identical to SEQ ID NO: 388207

SEQ ID NO: 435924 - RNA, 64 nt, Human; identical to SEQ ID NO: 388208

SEQ ID NO: 435925 - RNA, 64 nt, Human; identical to SEQ ID NO: 388209

SEQ ID NO: 435926 - RNA, 64 nt, Human; identical to SEQ ID NO: 388210

SEQ ID NO: 435927 - RNA, 64 nt, Human; identical to SEQ ID NO: 388211

SEQ ID NO: 435928 - RNA, 64 nt, Human; identical to SEQ ID NO: 388212

SEQ ID NO: 435929 - RNA, 64 nt, Human; identical to SEQ ID NO: 388213

SEQ ID NO: 435930 - RNA, 64 nt, Human; identical to SEQ ID NO: 388214

SEQ ID NO: 435931 - RNA, 64 nt, Human; identical to SEQ ID NO: 388215

SEQ ID NO: 435932 - RNA, 64 nt, Human
cuacucccuccucaccccacccuggagggccaggggaguggagagagcuccugaugucuuaguu

SEQ ID NO: 435933 - RNA, 64 nt, Human
uaaagaaauauaaaggguuugggagcaaaaagagggaguggaucuauuuuagaugagcccaggu

SEQ ID NO: 435934 - RNA, 64 nt, Human
uggucacuaaauuugaaguuccaguccucccuuuggaguggacauuuaaaaucugcagccauuc

SEQ ID NO: 435935 - RNA, 64 nt, Human; identical to SEQ ID NO: 388216

SEQ ID NO: 435936 - RNA, 64 nt, Human; identical to SEQ ID NO: 388220

SEQ ID NO: 435937 - RNA, 64 nt, Human; identical to SEQ ID NO: 388221

SEQ ID NO: 435938 - RNA, 64 nt, Human; identical to SEQ ID NO: 388222

SEQ ID NO: 435939 - RNA, 64 nt, Human; identical to SEQ ID NO: 388223

SEQ ID NO: 435940 - RNA, 64 nt, Human; identical to SEQ ID NO: 388224

SEQ ID NO: 435941 - RNA, 64 nt, Human; identical to SEQ ID NO: 388225

SEQ ID NO: 435942 - RNA, 64 nt, Human; identical to SEQ ID NO: 388226

SEQ ID NO: 435943 - RNA, 64 nt, Human; identical to SEQ ID NO: 388227

SEQ ID NO: 435944 - RNA, 59 nt, Human; identical to SEQ ID NO: 388228

SEQ ID NO: 435945 - RNA, 64 nt, Human; identical to SEQ ID NO: 388229

SEQ ID NO: 435946 - RNA, 64 nt, Human; identical to SEQ ID NO: 388230

SEQ ID NO: 435947 - RNA, 64 nt, Human; identical to SEQ ID NO: 388231

SEQ ID NO: 435948 - RNA, 64 nt, Human; identical to SEQ ID NO: 388232

SEQ ID NO: 435949 - RNA, 64 nt, Human; identical to SEQ ID NO: 388233

SEQ ID NO: 435950 - RNA, 64 nt, Human
augucaucucccgaauugcugucacuuuggcgagggaguggauauagggcaugucacaaaagaa

SEQ ID NO: 435951 - RNA, 64 nt, Human
aggguuccgcuuaaagaccgccucuuacuggccaggaguggacuugguuagggcuaccuucuca

SEQ ID NO: 435952 - RNA, 64 nt, Human
auuuaaaacuagaaaaacuauuccuaaucaacauggaguggagaguuuauucacugucuuaucu

SEQ ID NO: 435953 - RNA, 64 nt, Human; identical to SEQ ID NO: 388234

SEQ ID NO: 435954 - RNA, 64 nt, Human; identical to SEQ ID NO: 388238

SEQ ID NO: 435955 - RNA, 64 nt, Human; identical to SEQ ID NO: 388239

SEQ ID NO: 435956 - RNA, 64 nt, Human; identical to SEQ ID NO: 388240

SEQ ID NO: 435957 - RNA, 64 nt, Human; identical to SEQ ID NO: 388241

SEQ ID NO: 435958 - RNA, 64 nt, Human; identical to SEQ ID NO: 388242

SEQ ID NO: 435959 - RNA, 64 nt, Human; identical to SEQ ID NO: 388243

SEQ ID NO: 435960 - RNA, 64 nt, Human; identical to SEQ ID NO: 388244

SEQ ID NO: 435961 - RNA, 64 nt, Human; identical to SEQ ID NO: 388245

SEQ ID NO: 435962 - RNA, 64 nt, Human; identical to SEQ ID NO: 388246

SEQ ID NO: 435963 - RNA, 64 nt, Human; identical to SEQ ID NO: 388247

SEQ ID NO: 435964 - RNA, 64 nt, Human; identical to SEQ ID NO: 388248

SEQ ID NO: 435965 - RNA, 64 nt, Human; identical to SEQ ID NO: 388249

SEQ ID NO: 435966 - RNA, 64 nt, Human; identical to SEQ ID NO: 388250

SEQ ID NO: 435967 - RNA, 64 nt, Human; identical to SEQ ID NO: 388251

SEQ ID NO: 435968 - RNA, 64 nt, Human
ccuugacaaauugguaggauuuggucaggcacuaggaguggagcaugagcucuggggacagaca

SEQ ID NO: 435969 - RNA, 64 nt, Human; identical to SEQ ID NO: 314328

SEQ ID NO: 435970 - RNA, 64 nt, Human; identical to SEQ ID NO: 314335

SEQ ID NO: 435971 - RNA, 64 nt, Human; identical to SEQ ID NO: 388252

SEQ ID NO: 435972 - RNA, 64 nt, Human; identical to SEQ ID NO: 388256

SEQ ID NO: 435973 - RNA, 64 nt, Human; identical to SEQ ID NO: 388257

SEQ ID NO: 435974 - RNA, 64 nt, Human; identical to SEQ ID NO: 388258

SEQ ID NO: 435975 - RNA, 64 nt, Human; identical to SEQ ID NO: 388259

SEQ ID NO: 435976 - RNA, 64 nt, Human; identical to SEQ ID NO: 388260

SEQ ID NO: 435977 - RNA, 64 nt, Human; identical to SEQ ID NO: 388261

SEQ ID NO: 435978 - RNA, 64 nt, Human; identical to SEQ ID NO: 388262

SEQ ID NO: 435979 - RNA, 64 nt, Human; identical to SEQ ID NO: 388263

SEQ ID NO: 435980 - RNA, 64 nt, Human; identical to SEQ ID NO: 388264

SEQ ID NO: 435981 - RNA, 64 nt, Human; identical to SEQ ID NO: 388265

SEQ ID NO: 435982 - RNA, 64 nt, Human; identical to SEQ ID NO: 388266

SEQ ID NO: 435983 - RNA, 64 nt, Human; identical to SEQ ID NO: 388267

SEQ ID NO: 435984 - RNA, 64 nt, Human; identical to SEQ ID NO: 388268

SEQ ID NO: 435985 - RNA, 64 nt, Human; identical to SEQ ID NO: 388269

SEQ ID NO: 435986 - RNA, 58 nt, Human; identical to SEQ ID NO: 162154

SEQ ID NO: 435987 - RNA, 64 nt, Human; identical to SEQ ID NO: 313165

SEQ ID NO: 435988 - RNA, 64 nt, Human; identical to SEQ ID NO: 314083

SEQ ID NO: 435989 - RNA, 64 nt, Human; identical to SEQ ID NO: 388270

SEQ ID NO: 435990 - RNA, 64 nt, Human; identical to SEQ ID NO: 388274

SEQ ID NO: 435991 - RNA, 64 nt, Human; identical to SEQ ID NO: 388275

SEQ ID NO: 435992 - RNA, 64 nt, Human; identical to SEQ ID NO: 388276

SEQ ID NO: 435993 - RNA, 64 nt, Human; identical to SEQ ID NO: 388277

SEQ ID NO: 435994 - RNA, 64 nt, Human; identical to SEQ ID NO: 388278

SEQ ID NO: 435995 - RNA, 64 nt, Human; identical to SEQ ID NO: 388279

SEQ ID NO: 435996 - RNA, 64 nt, Human; identical to SEQ ID NO: 388280

SEQ ID NO: 435997 - RNA, 64 nt, Human; identical to SEQ ID NO: 388281

SEQ ID NO: 435998 - RNA, 64 nt, Human; identical to SEQ ID NO: 388282

SEQ ID NO: 435999 - RNA, 64 nt, Human; identical to SEQ ID NO: 388283

SEQ ID NO: 436000 - RNA, 64 nt, Human; identical to SEQ ID NO: 388284

SEQ ID NO: 436001 - RNA, 64 nt, Human; identical to SEQ ID NO: 388285

SEQ ID NO: 436002 - RNA, 64 nt, Human; identical to SEQ ID NO: 388286

SEQ ID NO: 436003 - RNA, 64 nt, Human; identical to SEQ ID NO: 388287

SEQ ID NO: 436004 - RNA, 64 nt, Human; identical to SEQ ID NO: 314103

SEQ ID NO: 436005 - RNA, 64 nt, Human; identical to SEQ ID NO: 314254

SEQ ID NO: 436006 - RNA, 64 nt, Human; identical to SEQ ID NO: 388288

SEQ ID NO: 436007 - RNA, 64 nt, Human; identical to SEQ ID NO: 388292

SEQ ID NO: 436008 - RNA, 64 nt, Human; identical to SEQ ID NO: 388293

SEQ ID NO: 436009 - RNA, 64 nt, Human; identical to SEQ ID NO: 388294

SEQ ID NO: 436010 - RNA, 64 nt, Human; identical to SEQ ID NO: 388295

SEQ ID NO: 436011 - RNA, 64 nt, Human; identical to SEQ ID NO: 388296

SEQ ID NO: 436012 - RNA, 64 nt, Human; identical to SEQ ID NO: 388297

SEQ ID NO: 436013 - RNA, 64 nt, Human; identical to SEQ ID NO: 388298

SEQ ID NO: 436014 - RNA, 64 nt, Human; identical to SEQ ID NO: 388299

SEQ ID NO: 436015 - RNA, 64 nt, Human; identical to SEQ ID NO: 388300

SEQ ID NO: 436016 - RNA, 64 nt, Human; identical to SEQ ID NO: 388301

SEQ ID NO: 436017 - RNA, 64 nt, Human; identical to SEQ ID NO: 388302

SEQ ID NO: 436018 - RNA, 64 nt, Human; identical to SEQ ID NO: 388303

SEQ ID NO: 436019 - RNA, 64 nt, Human; identical to SEQ ID NO: 388304

SEQ ID NO: 436020 - RNA, 64 nt, Human; identical to SEQ ID NO: 388305

SEQ ID NO: 436021 - RNA, 63 nt, Human
uuuuauaguggcuuucugauuuuugguaguccauugaagaagggaguuugaaaguuguuguau

SEQ ID NO: 436022 - RNA, 63 nt, Human
guggaaugugguugaagaaagugggccaggugguugaagaaagccaugugggagcucagcaaa

SEQ ID NO: 436023 - RNA, 64 nt, Human; identical to SEQ ID NO: 388306

SEQ ID NO: 436024 - RNA, 64 nt, Human; identical to SEQ ID NO: 388310

SEQ ID NO: 436025 - RNA, 64 nt, Human; identical to SEQ ID NO: 388311

SEQ ID NO: 436026 - RNA, 64 nt, Human; identical to SEQ ID NO: 388312

SEQ ID NO: 436027 - RNA, 64 nt, Human; identical to SEQ ID NO: 388313

SEQ ID NO: 436028 - RNA, 64 nt, Human; identical to SEQ ID NO: 388314

SEQ ID NO: 436029 - RNA, 64 nt, Human; identical to SEQ ID NO: 388315

SEQ ID NO: 436030 - RNA, 64 nt, Human; identical to SEQ ID NO: 388316

SEQ ID NO: 436031 - RNA, 64 nt, Human; identical to SEQ ID NO: 388317

SEQ ID NO: 436032 - RNA, 64 nt, Human; identical to SEQ ID NO: 388318

SEQ ID NO: 436033 - RNA, 64 nt, Human; identical to SEQ ID NO: 388319

SEQ ID NO: 436034 - RNA, 64 nt, Human; identical to SEQ ID NO: 388320

SEQ ID NO: 436035 - RNA, 64 nt, Human; identical to SEQ ID NO: 388321

SEQ ID NO: 436036 - RNA, 64 nt, Human; identical to SEQ ID NO: 388322

SEQ ID NO: 436037 - RNA, 64 nt, Human; identical to SEQ ID NO: 388323

SEQ ID NO: 436038 - RNA, 63 nt, Human
uaggaucaggggccucuguuggauuuguguuucuugaagaauagcuggcagagugguauaaaa

SEQ ID NO: 436039 - RNA, 63 nt, Human
ucucagauaaagugaccaggcucacaacuguuuuugaagaagggaaauucacacugugcguuu

SEQ ID NO: 436040 - RNA, 63 nt, Human
ggugaauugagucguauucugucacauaauauuuugaagaaaacuuggcugucgaaacauuuu

SEQ ID NO: 436041 - RNA, 64 nt, Human; identical to SEQ ID NO: 388324

SEQ ID NO: 436042 - RNA, 64 nt, Human; identical to SEQ ID NO: 388328

SEQ ID NO: 436043 - RNA, 64 nt, Human; identical to SEQ ID NO: 388329

SEQ ID NO: 436044 - RNA, 64 nt, Human; identical to SEQ ID NO: 388330

SEQ ID NO: 436045 - RNA, 64 nt, Human; identical to SEQ ID NO: 388331

SEQ ID NO: 436046 - RNA, 64 nt, Human; identical to SEQ ID NO: 388332

SEQ ID NO: 436047 - RNA, 64 nt, Human; identical to SEQ ID NO: 388333

SEQ ID NO: 436048 - RNA, 64 nt, Human; identical to SEQ ID NO: 388334

SEQ ID NO: 436049 - RNA, 64 nt, Human; identical to SEQ ID NO: 388335

SEQ ID NO: 436050 - RNA, 64 nt, Human; identical to SEQ ID NO: 388336

SEQ ID NO: 436051 - RNA, 64 nt, Human; identical to SEQ ID NO: 388337

SEQ ID NO: 436052 - RNA, 64 nt, Human; identical to SEQ ID NO: 388338

SEQ ID NO: 436053 - RNA, 64 nt, Human; identical to SEQ ID NO: 388339

SEQ ID NO: 436054 - RNA, 64 nt, Human; identical to SEQ ID NO: 388340

SEQ ID NO: 436055 - RNA, 64 nt, Human; identical to SEQ ID NO: 388341

SEQ ID NO: 436056 - RNA, 63 nt, Human
cuguaucguucagucucuuguggcaauagcacuuugaagaaaauagagaauuuaauauauggu

SEQ ID NO: 436057 - RNA, 63 nt, Human
uucaauauagaaggaauuagcuauuaaagguauuugaagaaacuauagguauaguggugaaua

SEQ ID NO: 436058 - RNA, 63 nt, Human
gacugggguacuuuaaagaaaugcaaauagcaauugaagaaccacugcugcaggugguagccc

SEQ ID NO: 436059 - RNA, 64 nt, Human; identical to SEQ ID NO: 388342

SEQ ID NO: 436060 - RNA, 64 nt, Human; identical to SEQ ID NO: 388345

SEQ ID NO: 436061 - RNA, 64 nt, Human; identical to SEQ ID NO: 388346

SEQ ID NO: 436062 - RNA, 64 nt, Human; identical to SEQ ID NO: 388347

SEQ ID NO: 436063 - RNA, 64 nt, Human; identical to SEQ ID NO: 388348

SEQ ID NO: 436064 - RNA, 64 nt, Human; identical to SEQ ID NO: 388349

SEQ ID NO: 436065 - RNA, 64 nt, Human; identical to SEQ ID NO: 388350

SEQ ID NO: 436066 - RNA, 64 nt, Human; identical to SEQ ID NO: 388351

SEQ ID NO: 436067 - RNA, 64 nt, Human; identical to SEQ ID NO: 388352

SEQ ID NO: 436068 - RNA, 64 nt, Human; identical to SEQ ID NO: 388353

SEQ ID NO: 436069 - RNA, 64 nt, Human; identical to SEQ ID NO: 388354

SEQ ID NO: 436070 - RNA, 64 nt, Human; identical to SEQ ID NO: 388355

SEQ ID NO: 436071 - RNA, 64 nt, Human; identical to SEQ ID NO: 388356

SEQ ID NO: 436072 - RNA, 64 nt, Human; identical to SEQ ID NO: 388357

SEQ ID NO: 436073 - RNA, 64 nt, Human; identical to SEQ ID NO: 388358

SEQ ID NO: 436074 - RNA, 63 nt, Human
gauucuugagcacuugaacaaugacugaugugauugaagaacccaucuuucaauucaauuaaa

SEQ ID NO: 436075 - RNA, 63 nt, Human
ucccaggagagacuuguagguacaaucuaggccuugaagaaacaaaggcuggaauaucugccc

SEQ ID NO: 436076 - RNA, 63 nt, Human
ccuuuacccuccucuauuucuuuaaucuguuguuugaagaaccgcauuuugaggguguaacca

SEQ ID NO: 436077 - RNA, 64 nt, Human; identical to SEQ ID NO: 388359

SEQ ID NO: 436078 - RNA, 64 nt, Human; identical to SEQ ID NO: 388363

SEQ ID NO: 436079 - RNA, 64 nt, Human; identical to SEQ ID NO: 388364

SEQ ID NO: 436080 - RNA, 64 nt, Human; identical to SEQ ID NO: 388365

SEQ ID NO: 436081 - RNA, 64 nt, Human; identical to SEQ ID NO: 388366

SEQ ID NO: 436082 - RNA, 64 nt, Human; identical to SEQ ID NO: 388367

SEQ ID NO: 436083 - RNA, 64 nt, Human; identical to SEQ ID NO: 388368

SEQ ID NO: 436084 - RNA, 64 nt, Human; identical to SEQ ID NO: 388369

SEQ ID NO: 436085 - RNA, 64 nt, Human; identical to SEQ ID NO: 388370

SEQ ID NO: 436086 - RNA, 64 nt, Human; identical to SEQ ID NO: 388371

SEQ ID NO: 436087 - RNA, 64 nt, Human; identical to SEQ ID NO: 388372

SEQ ID NO: 436088 - RNA, 64 nt, Human; identical to SEQ ID NO: 388373

SEQ ID NO: 436089 - RNA, 64 nt, Human; identical to SEQ ID NO: 388374

SEQ ID NO: 436090 - RNA, 64 nt, Human; identical to SEQ ID NO: 388375

SEQ ID NO: 436091 - RNA, 63 nt, Human; identical to SEQ ID NO: 388376

SEQ ID NO: 436092 - RNA, 63 nt, Human
aauacugucuaggaaaauaagaauuagguuucuuugaagaaggaaucuuuuauaacaccuuaa

SEQ ID NO: 436093 - RNA, 63 nt, Human
gcauguaucuacguaggucauguaagcaaaggcuugaagaacagcuaaucugagauuuagaag

SEQ ID NO: 436094 - RNA, 63 nt, Human
ggcaagaguuguuccugcccuucccuuugugacuugaagaacccugacuuuguuucugcaaag

SEQ ID NO: 436095 - RNA, 64 nt, Human; identical to SEQ ID NO: 388377

SEQ ID NO: 436096 - RNA, 64 nt, Human; identical to SEQ ID NO: 388381

SEQ ID NO: 436097 - RNA, 64 nt, Human; identical to SEQ ID NO: 388382

SEQ ID NO: 436098 - RNA, 64 nt, Human; identical to SEQ ID NO: 388383

SEQ ID NO: 436099 - RNA, 64 nt, Human; identical to SEQ ID NO: 388384

SEQ ID NO: 436100 - RNA, 64 nt, Human; identical to SEQ ID NO: 388385

SEQ ID NO: 436101 - RNA, 64 nt, Human; identical to SEQ ID NO: 388386

SEQ ID NO: 436102 - RNA, 64 nt, Human; identical to SEQ ID NO: 388387

SEQ ID NO: 436103 - RNA, 64 nt, Human; identical to SEQ ID NO: 388388

SEQ ID NO: 436104 - RNA, 64 nt, Human; identical to SEQ ID NO: 388389

SEQ ID NO: 436105 - RNA, 64 nt, Human; identical to SEQ ID NO: 388390

SEQ ID NO: 436106 - RNA, 64 nt, Human; identical to SEQ ID NO: 388391

SEQ ID NO: 436107 - RNA, 64 nt, Human; identical to SEQ ID NO: 388392

SEQ ID NO: 436108 - RNA, 64 nt, Human; identical to SEQ ID NO: 388393

SEQ ID NO: 436109 - RNA, 64 nt, Human; identical to SEQ ID NO: 388394

SEQ ID NO: 436110 - RNA, 64 nt, Human
cgugccuuugggugcuccccucucguggucguucuggcccgaggcccuuagaguauggaggcug

SEQ ID NO: 436111 - RNA, 64 nt, Human
caaggccucucagacccagaugugacgggguguguggcccgaggaagcuggacagcggcagugg

SEQ ID NO: 436112 - RNA, 64 nt, Human
ggguggaggaggagcauuguccaggcauggccuguggcccgagggccaaccaccgagcaggcac

SEQ ID NO: 436113 - RNA, 64 nt, Human; identical to SEQ ID NO: 388395

SEQ ID NO: 436114 - RNA, 64 nt, Human; identical to SEQ ID NO: 388399

SEQ ID NO: 436115 - RNA, 64 nt, Human; identical to SEQ ID NO: 388400

SEQ ID NO: 436116 - RNA, 64 nt, Human; identical to SEQ ID NO: 388401

SEQ ID NO: 436117 - RNA, 64 nt, Human; identical to SEQ ID NO: 388402

SEQ ID NO: 436118 - RNA, 64 nt, Human; identical to SEQ ID NO: 388403

SEQ ID NO: 436119 - RNA, 64 nt, Human; identical to SEQ ID NO: 388404

SEQ ID NO: 436120 - RNA, 64 nt, Human; identical to SEQ ID NO: 388405

SEQ ID NO: 436121 - RNA, 64 nt, Human; identical to SEQ ID NO: 388406

SEQ ID NO: 436122 - RNA, 57 nt, Human; identical to SEQ ID NO: 388407

SEQ ID NO: 436123 - RNA, 64 nt, Human; identical to SEQ ID NO: 388408

SEQ ID NO: 436124 - RNA, 64 nt, Human; identical to SEQ ID NO: 388409

SEQ ID NO: 436125 - RNA, 64 nt, Human; identical to SEQ ID NO: 388410

SEQ ID NO: 436126 - RNA, 64 nt, Human; identical to SEQ ID NO: 388411

SEQ ID NO: 436127 - RNA, 64 nt, Human; identical to SEQ ID NO: 388412

SEQ ID NO: 436128 - RNA, 64 nt, Human
gccacggccaugagggcuggagaccagaacagcauggcccgaagcgugcggggccccggaugac

SEQ ID NO: 436129 - RNA, 64 nt, Human
accgggccgccaggaucccuccccgcggcggcgauggcccgagccaugagagugaggacuuucc

SEQ ID NO: 436130 - RNA, 64 nt, Human
cagagaugucuuugugaugugaugcuuagcaguuuggcccgaagaaggaaaauauccaguacca

SEQ ID NO: 436131 - RNA, 64 nt, Human; identical to SEQ ID NO: 388413

SEQ ID NO: 436132 - RNA, 64 nt, Human; identical to SEQ ID NO: 388417

SEQ ID NO: 436133 - RNA, 64 nt, Human; identical to SEQ ID NO: 388418

SEQ ID NO: 436134 - RNA, 64 nt, Human; identical to SEQ ID NO: 388419

SEQ ID NO: 436135 - RNA, 64 nt, Human; identical to SEQ ID NO: 388420

SEQ ID NO: 436136 - RNA, 64 nt, Human; identical to SEQ ID NO: 388421

SEQ ID NO: 436137 - RNA, 55 nt, Human; identical to SEQ ID NO: 388422

SEQ ID NO: 436138 - RNA, 64 nt, Human; identical to SEQ ID NO: 388423

SEQ ID NO: 436139 - RNA, 64 nt, Human; identical to SEQ ID NO: 388424

SEQ ID NO: 436140 - RNA, 64 nt, Human; identical to SEQ ID NO: 388425

SEQ ID NO: 436141 - RNA, 64 nt, Human; identical to SEQ ID NO: 388426

SEQ ID NO: 436142 - RNA, 64 nt, Human; identical to SEQ ID NO: 388427

SEQ ID NO: 436143 - RNA, 64 nt, Human; identical to SEQ ID NO: 388428

SEQ ID NO: 436144 - RNA, 64 nt, Human; identical to SEQ ID NO: 388429

SEQ ID NO: 436145 - RNA, 64 nt, Human; identical to SEQ ID NO: 388430

SEQ ID NO: 436146 - RNA, 64 nt, Human
guccuacacccccgagugaagcugcugcccugccuggcccgaccuguacauaggacccccgacc

SEQ ID NO: 436147 - RNA, 64 nt, Human
acucccagcgugggccagaggcagcucgugugccuggcccgagcccugcuccgcaagagccgca

SEQ ID NO: 436148 - RNA, 64 nt, Human
uggccucugauuucauugugggugcauccacagguggcccgagcuguucuuucagcugcuccaa

SEQ ID NO: 436149 - RNA, 64 nt, Human; identical to SEQ ID NO: 388431

SEQ ID NO: 436150 - RNA, 64 nt, Human; identical to SEQ ID NO: 388435

SEQ ID NO: 436151 - RNA, 64 nt, Human; identical to SEQ ID NO: 388436

SEQ ID NO: 436152 - RNA, 64 nt, Human; identical to SEQ ID NO: 388437

SEQ ID NO: 436153 - RNA, 64 nt, Human; identical to SEQ ID NO: 388438

SEQ ID NO: 436154 - RNA, 64 nt, Human; identical to SEQ ID NO: 388439

SEQ ID NO: 436155 - RNA, 64 nt, Human; identical to SEQ ID NO: 388440

SEQ ID NO: 436156 - RNA, 64 nt, Human; identical to SEQ ID NO: 388441

SEQ ID NO: 436157 - RNA, 64 nt, Human; identical to SEQ ID NO: 388442

SEQ ID NO: 436158 - RNA, 64 nt, Human; identical to SEQ ID NO: 388443

SEQ ID NO: 436159 - RNA, 64 nt, Human; identical to SEQ ID NO: 388444

SEQ ID NO: 436160 - RNA, 64 nt, Human; identical to SEQ ID NO: 388445

SEQ ID NO: 436161 - RNA, 64 nt, Human; identical to SEQ ID NO: 388446

SEQ ID NO: 436162 - RNA, 64 nt, Human; identical to SEQ ID NO: 388447

SEQ ID NO: 436163 - RNA, 64 nt, Human; identical to SEQ ID NO: 388448

SEQ ID NO: 436164 - RNA, 63 nt, Human
caggucaccugaaauugaaauugagccacuuccuugaagaaucaaaauuccuguuaauaaaag

SEQ ID NO: 436165 - RNA, 63 nt, Human
aaauuuuguuucauauuaggaauaaaguuuauuuugaagaaagauauuguuucuuuagucuca

SEQ ID NO: 436166 - RNA, 63 nt, Human
uacuguaacuuuuuuaaauuaagacaaaaagccuugaagaaaaugacuuuauuuuucuaagug

SEQ ID NO: 436167 - RNA, 64 nt, Human; identical to SEQ ID NO: 388449

SEQ ID NO: 436168 - RNA, 64 nt, Human; identical to SEQ ID NO: 388453

SEQ ID NO: 436169 - RNA, 64 nt, Human; identical to SEQ ID NO: 388454

SEQ ID NO: 436170 - RNA, 64 nt, Human; identical to SEQ ID NO: 388455

SEQ ID NO: 436171 - RNA, 64 nt, Human; identical to SEQ ID NO: 388456

SEQ ID NO: 436172 - RNA, 64 nt, Human; identical to SEQ ID NO: 388457

SEQ ID NO: 436173 - RNA, 64 nt, Human; identical to SEQ ID NO: 388458

SEQ ID NO: 436174 - RNA, 64 nt, Human; identical to SEQ ID NO: 388459

SEQ ID NO: 436175 - RNA, 64 nt, Human; identical to SEQ ID NO: 388460

SEQ ID NO: 436176 - RNA, 64 nt, Human; identical to SEQ ID NO: 388461

SEQ ID NO: 436177 - RNA, 64 nt, Human; identical to SEQ ID NO: 388462

SEQ ID NO: 436178 - RNA, 64 nt, Human; identical to SEQ ID NO: 388463

SEQ ID NO: 436179 - RNA, 64 nt, Human; identical to SEQ ID NO: 388464

SEQ ID NO: 436180 - RNA, 57 nt, Human; identical to SEQ ID NO: 388465

SEQ ID NO: 436181 - RNA, 64 nt, Human; identical to SEQ ID NO: 388466

SEQ ID NO: 436182 - RNA, 63 nt, Human
aucuaguuuuuccaaaaaugauaguaauaucuuuugaagaacuaugcuuuuucaaaagcaaaa

SEQ ID NO: 436183 - RNA, 63 nt, Human
ucuguugggucugggacauuuaguuuaguuuuuuugaagaauuacaaaucagaagaaaaagca

SEQ ID NO: 436184 - RNA, 63 nt, Human
uaaauaggauuguguguauauuugggauaucuauugaagaaaaaaagaaaaccccuuaaagau

SEQ ID NO: 436185 - RNA, 64 nt, Human; identical to SEQ ID NO: 388467

SEQ ID NO: 436186 - RNA, 64 nt, Human; identical to SEQ ID NO: 388471

SEQ ID NO: 436187 - RNA, 64 nt, Human; identical to SEQ ID NO: 388472

SEQ ID NO: 436188 - RNA, 64 nt, Human; identical to SEQ ID NO: 388473

SEQ ID NO: 436189 - RNA, 64 nt, Human; identical to SEQ ID NO: 388474

SEQ ID NO: 436190 - RNA, 64 nt, Human; identical to SEQ ID NO: 388475

SEQ ID NO: 436191 - RNA, 64 nt, Human; identical to SEQ ID NO: 388476

SEQ ID NO: 436192 - RNA, 64 nt, Human; identical to SEQ ID NO: 388477

SEQ ID NO: 436193 - RNA, 64 nt, Human; identical to SEQ ID NO: 388478

SEQ ID NO: 436194 - RNA, 64 nt, Human; identical to SEQ ID NO: 388479

SEQ ID NO: 436195 - RNA, 64 nt, Human; identical to SEQ ID NO: 388480

SEQ ID NO: 436196 - RNA, 64 nt, Human; identical to SEQ ID NO: 388481

SEQ ID NO: 436197 - RNA, 64 nt, Human; identical to SEQ ID NO: 388482

SEQ ID NO: 436198 - RNA, 64 nt, Human; identical to SEQ ID NO: 388483

SEQ ID NO: 436199 - RNA, 64 nt, Human; identical to SEQ ID NO: 388484

SEQ ID NO: 436200 - RNA, 63 nt, Human
aagauucuggaagguccauguagagggcagacauugaagaaagaaacuuaaaauccagguugu

SEQ ID NO: 436201 - RNA, 63 nt, Human
uucugaguugauaguuuacauuacaauuaggucuugaagaagagcucacagagaaaaaacuac

SEQ ID NO: 436202 - RNA, 63 nt, Human
gcaacccauccagugccagcuuugagauugcacuugaagaaaggugcauggacccccugcugc

SEQ ID NO: 436203 - RNA, 64 nt, Human; identical to SEQ ID NO: 388485

SEQ ID NO: 436204 - RNA, 64 nt, Human; identical to SEQ ID NO: 388489

SEQ ID NO: 436205 - RNA, 64 nt, Human; identical to SEQ ID NO: 388490

SEQ ID NO: 436206 - RNA, 64 nt, Human; identical to SEQ ID NO: 388491

SEQ ID NO: 436207 - RNA, 64 nt, Human; identical to SEQ ID NO: 388492

SEQ ID NO: 436208 - RNA, 64 nt, Human; identical to SEQ ID NO: 388493

SEQ ID NO: 436209 - RNA, 64 nt, Human; identical to SEQ ID NO: 388494

SEQ ID NO: 436210 - RNA, 64 nt, Human; identical to SEQ ID NO: 388495

SEQ ID NO: 436211 - RNA, 64 nt, Human; identical to SEQ ID NO: 388496

SEQ ID NO: 436212 - RNA, 64 nt, Human; identical to SEQ ID NO: 388497

SEQ ID NO: 436213 - RNA, 64 nt, Human; identical to SEQ ID NO: 388498

SEQ ID NO: 436214 - RNA, 64 nt, Human; identical to SEQ ID NO: 388499

SEQ ID NO: 436215 - RNA, 64 nt, Human; identical to SEQ ID NO: 388500

SEQ ID NO: 436216 - RNA, 64 nt, Human; identical to SEQ ID NO: 388501

SEQ ID NO: 436217 - RNA, 64 nt, Human; identical to SEQ ID NO: 388502

SEQ ID NO: 436218 - RNA, 63 nt, Human
cuauuaacagccagagucauaaaugaaaugaaauugaagaauucauucaaaugcucuuuuccc

SEQ ID NO: 436219 - RNA, 63 nt, Human
uagaacauguagacacuugagaaauguuucuguuugaagaaaauagagggagaaacagaaguc

SEQ ID NO: 436220 - RNA, 63 nt, Human
guccccuuucagagauauaauaagcccaacaaguugaagaagcuggcggaucuagugaccaga

SEQ ID NO: 436221 - RNA, 64 nt, Human; identical to SEQ ID NO: 388503

SEQ ID NO: 436222 - RNA, 64 nt, Human; identical to SEQ ID NO: 388505

SEQ ID NO: 436223 - RNA, 64 nt, Human; identical to SEQ ID NO: 388506

SEQ ID NO: 436224 - RNA, 64 nt, Human; identical to SEQ ID NO: 388507

SEQ ID NO: 436225 - RNA, 64 nt, Human; identical to SEQ ID NO: 388508

SEQ ID NO: 436226 - RNA, 64 nt, Human; identical to SEQ ID NO: 388509

SEQ ID NO: 436227 - RNA, 59 nt, Human; identical to SEQ ID NO: 388510

SEQ ID NO: 436228 - RNA, 64 nt, Human; identical to SEQ ID NO: 388511

SEQ ID NO: 436229 - RNA, 64 nt, Human; identical to SEQ ID NO: 388512

SEQ ID NO: 436230 - RNA, 64 nt, Human; identical to SEQ ID NO: 388513

SEQ ID NO: 436231 - RNA, 64 nt, Human; identical to SEQ ID NO: 388514

SEQ ID NO: 436232 - RNA, 64 nt, Human; identical to SEQ ID NO: 388515

SEQ ID NO: 436233 - RNA, 64 nt, Human; identical to SEQ ID NO: 388516

SEQ ID NO: 436234 - RNA, 64 nt, Human; identical to SEQ ID NO: 388517

SEQ ID NO: 436235 - RNA, 64 nt, Human; identical to SEQ ID NO: 388518

SEQ ID NO: 436236 - RNA, 59 nt, Human
ugcggucccagauagccugaauccugcccggaguggaagcugaagccugcacagugucc

SEQ ID NO: 436237 - RNA, 64 nt, Human
aguuguggccccagccccucucccugugcuguguggaguggacacccugacccccgaagcgggg

SEQ ID NO: 436238 - RNA, 64 nt, Human
agcugcacugcugccugggauugcagcugaggugggaguggagaaugguucccaggaagacagu

SEQ ID NO: 436239 - RNA, 64 nt, Human; identical to SEQ ID NO: 388519

SEQ ID NO: 436240 - RNA, 64 nt, Human; identical to SEQ ID NO: 388523

SEQ ID NO: 436241 - RNA, 64 nt, Human; identical to SEQ ID NO: 388524

SEQ ID NO: 436242 - RNA, 64 nt, Human; identical to SEQ ID NO: 388525

SEQ ID NO: 436243 - RNA, 64 nt, Human; identical to SEQ ID NO: 388526

SEQ ID NO: 436244 - RNA, 64 nt, Human; identical to SEQ ID NO: 388527

SEQ ID NO: 436245 - RNA, 64 nt, Human; identical to SEQ ID NO: 388528

SEQ ID NO: 436246 - RNA, 58 nt, Human; identical to SEQ ID NO: 388529

SEQ ID NO: 436247 - RNA, 64 nt, Human; identical to SEQ ID NO: 388530

SEQ ID NO: 436248 - RNA, 64 nt, Human; identical to SEQ ID NO: 388531

SEQ ID NO: 436249 - RNA, 64 nt, Human; identical to SEQ ID NO: 388532

SEQ ID NO: 436250 - RNA, 64 nt, Human; identical to SEQ ID NO: 388533

SEQ ID NO: 436251 - RNA, 64 nt, Human; identical to SEQ ID NO: 388534

SEQ ID NO: 436252 - RNA, 64 nt, Human
uuggaaaagcuacuuuuuuccuaaagaacagaguggaguggauauauucacuuuuuuuuucuaa

SEQ ID NO: 436253 - RNA, 64 nt, Human
aguuugaaauguuuccaaauaaauauuggcaaggggaguggaaaugacaccaagaagccccuca

SEQ ID NO: 436254 - RNA, 64 nt, Human
uuuaggacccaagguggucuuggagaggagguguggaguggaggggucagcagggggguugggu

SEQ ID NO: 436255 - RNA, 64 nt, Human; identical to SEQ ID NO: 388109

SEQ ID NO: 436256 - RNA, 64 nt, Human; identical to SEQ ID NO: 388113

SEQ ID NO: 436257 - RNA, 64 nt, Human; identical to SEQ ID NO: 388114

SEQ ID NO: 436258 - RNA, 64 nt, Human; identical to SEQ ID NO: 388115

SEQ ID NO: 436259 - RNA, 64 nt, Human; identical to SEQ ID NO: 388116

SEQ ID NO: 436260 - RNA, 64 nt, Human; identical to SEQ ID NO: 388117

SEQ ID NO: 436261 - RNA, 64 nt, Human; identical to SEQ ID NO: 388118

SEQ ID NO: 436262 - RNA, 64 nt, Human; identical to SEQ ID NO: 388119

SEQ ID NO: 436263 - RNA, 64 nt, Human; identical to SEQ ID NO: 388120

SEQ ID NO: 436264 - RNA, 64 nt, Human; identical to SEQ ID NO: 388121

SEQ ID NO: 436265 - RNA, 64 nt, Human; identical to SEQ ID NO: 388122

SEQ ID NO: 436266 - RNA, 64 nt, Human; identical to SEQ ID NO: 388123

SEQ ID NO: 436267 - RNA, 64 nt, Human; identical to SEQ ID NO: 388124

SEQ ID NO: 436268 - RNA, 63 nt, Human
uagagucaaaagaaaaccacugcaacagacucauugaagaaaaugacaaguaucaaagacauu

SEQ ID NO: 436269 - RNA, 63 nt, Human
cuggccugacauucuuuaugaaauuuagaauuguugaagaacuauaacauuucaguaggguuc

SEQ ID NO: 436270 - RNA, 63 nt, Human
uauccuuccuuguuccuaccagugucugcuauuuugaagaagcuagggucuggagggacagag

SEQ ID NO: 436271 - RNA, 64 nt, Human; identical to SEQ ID NO: 388125

SEQ ID NO: 436272 - RNA, 64 nt, Human; identical to SEQ ID NO: 388126

SEQ ID NO: 436273 - RNA, 57 nt, Human; identical to SEQ ID NO: 388127

SEQ ID NO: 436274 - RNA, 64 nt, Human; identical to SEQ ID NO: 388131

SEQ ID NO: 436275 - RNA, 64 nt, Human; identical to SEQ ID NO: 388132

SEQ ID NO: 436276 - RNA, 64 nt, Human; identical to SEQ ID NO: 388133

SEQ ID NO: 436277 - RNA, 64 nt, Human; identical to SEQ ID NO: 388134

SEQ ID NO: 436278 - RNA, 64 nt, Human; identical to SEQ ID NO: 388135

SEQ ID NO: 436279 - RNA, 64 nt, Human; identical to SEQ ID NO: 388136

SEQ ID NO: 436280 - RNA, 64 nt, Human; identical to SEQ ID NO: 388137

SEQ ID NO: 436281 - RNA, 64 nt, Human; identical to SEQ ID NO: 388138

SEQ ID NO: 436282 - RNA, 64 nt, Human; identical to SEQ ID NO: 388139

SEQ ID NO: 436283 - RNA, 64 nt, Human; identical to SEQ ID NO: 388140

SEQ ID NO: 436284 - RNA, 64 nt, Human; identical to SEQ ID NO: 388141

SEQ ID NO: 436285 - RNA, 64 nt, Human; identical to SEQ ID NO: 388142

SEQ ID NO: 436286 - RNA, 64 nt, Human
cagaagcaagggaguaucagacuaugaugaugcuggaguggacuucuguucagggaacauuuug

SEQ ID NO: 436287 - RNA, 64 nt, Human
gcacucaugccaccugccagguaguguaguaucaggaguggagacaaagugggcucuggguugg

SEQ ID NO: 436288 - RNA, 64 nt, Human
ugagcucagaggaugugcugccagcaggguguacggaguggaggguacagacgcuugccuaucu

SEQ ID NO: 436289 - RNA, 64 nt, Human; identical to SEQ ID NO: 388143

SEQ ID NO: 436290 - RNA, 64 nt, Human; identical to SEQ ID NO: 388144

SEQ ID NO: 436291 - RNA, 64 nt, Human; identical to SEQ ID NO: 388145

SEQ ID NO: 436292 - RNA, 64 nt, Human; identical to SEQ ID NO: 388149

SEQ ID NO: 436293 - RNA, 64 nt, Human; identical to SEQ ID NO: 388150

SEQ ID NO: 436294 - RNA, 64 nt, Human; identical to SEQ ID NO: 388151

SEQ ID NO: 436295 - RNA, 64 nt, Human; identical to SEQ ID NO: 388152

SEQ ID NO: 436296 - RNA, 58 nt, Human; identical to SEQ ID NO: 388153

SEQ ID NO: 436297 - RNA, 64 nt, Human; identical to SEQ ID NO: 388154

SEQ ID NO: 436298 - RNA, 64 nt, Human; identical to SEQ ID NO: 388155

SEQ ID NO: 436299 - RNA, 64 nt, Human; identical to SEQ ID NO: 388156

SEQ ID NO: 436300 - RNA, 59 nt, Human; identical to SEQ ID NO: 388157

SEQ ID NO: 436301 - RNA, 64 nt, Human; identical to SEQ ID NO: 388158

SEQ ID NO: 436302 - RNA, 64 nt, Human; identical to SEQ ID NO: 388159

SEQ ID NO: 436303 - RNA, 64 nt, Human; identical to SEQ ID NO: 388160

SEQ ID NO: 436304 - RNA, 64 nt, Human; identical to SEQ ID NO: 314325

SEQ ID NO: 436305 - RNA, 64 nt, Human; identical to SEQ ID NO: 314326

SEQ ID NO: 436306 - RNA, 64 nt, Human; identical to SEQ ID NO: 314327

SEQ ID NO: 436307 - RNA, 64 nt, Human; identical to SEQ ID NO: 388161

SEQ ID NO: 436308 - RNA, 64 nt, Human; identical to SEQ ID NO: 388162

SEQ ID NO: 436309 - RNA, 64 nt, Human; identical to SEQ ID NO: 388163

SEQ ID NO: 436310 - RNA, 64 nt, Human; identical to SEQ ID NO: 388167

SEQ ID NO: 436311 - RNA, 64 nt, Human; identical to SEQ ID NO: 388168

SEQ ID NO: 436312 - RNA, 64 nt, Human; identical to SEQ ID NO: 388169

SEQ ID NO: 436313 - RNA, 64 nt, Human; identical to SEQ ID NO: 388170

SEQ ID NO: 436314 - RNA, 64 nt, Human; identical to SEQ ID NO: 388171

SEQ ID NO: 436315 - RNA, 64 nt, Human; identical to SEQ ID NO: 388172

SEQ ID NO: 436316 - RNA, 64 nt, Human; identical to SEQ ID NO: 388173

SEQ ID NO: 436317 - RNA, 64 nt, Human; identical to SEQ ID NO: 388174

SEQ ID NO: 436318 - RNA, 64 nt, Human; identical to SEQ ID NO: 388175

SEQ ID NO: 436319 - RNA, 64 nt, Human; identical to SEQ ID NO: 388176

SEQ ID NO: 436320 - RNA, 64 nt, Human; identical to SEQ ID NO: 388177

SEQ ID NO: 436321 - RNA, 64 nt, Human; identical to SEQ ID NO: 388178

SEQ ID NO: 436322 - RNA, 63 nt, Human
gaauauaauaaagcagagugacuaaaggcauaauugaagaaugaaugggacccggauuugggg

SEQ ID NO: 436323 - RNA, 63 nt, Human
auuuguugaaauaacuugaaaaggaaccauuucuugaagaaacugaaguaauagcaauaagau

SEQ ID NO: 436324 - RNA, 63 nt, Human
ccaggauuucuaaucaaaagggaaaagaagauguugaagaauacaguuaggcaccagaagaac

SEQ ID NO: 436325 - RNA, 64 nt, Human; identical to SEQ ID NO: 388179

SEQ ID NO: 436326 - RNA, 64 nt, Human; identical to SEQ ID NO: 388180

SEQ ID NO: 436327 - RNA, 64 nt, Human; identical to SEQ ID NO: 388181

SEQ ID NO: 436328 - RNA, 64 nt, Human; identical to SEQ ID NO: 388184

SEQ ID NO: 436329 - RNA, 64 nt, Human; identical to SEQ ID NO: 388185

SEQ ID NO: 436330 - RNA, 64 nt, Human; identical to SEQ ID NO: 388186

SEQ ID NO: 436331 - RNA, 64 nt, Human; identical to SEQ ID NO: 388187

SEQ ID NO: 436332 - RNA, 64 nt, Human; identical to SEQ ID NO: 388188

SEQ ID NO: 436333 - RNA, 64 nt, Human; identical to SEQ ID NO: 388189

SEQ ID NO: 436334 - RNA, 64 nt, Human; identical to SEQ ID NO: 388190

SEQ ID NO: 436335 - RNA, 64 nt, Human; identical to SEQ ID NO: 388191

SEQ ID NO: 436336 - RNA, 64 nt, Human; identical to SEQ ID NO: 388192

SEQ ID NO: 436337 - RNA, 64 nt, Human; identical to SEQ ID NO: 388193

SEQ ID NO: 436338 - RNA, 64 nt, Human; identical to SEQ ID NO: 388194

SEQ ID NO: 436339 - RNA, 64 nt, Human; identical to SEQ ID NO: 388195

SEQ ID NO: 436340 - RNA, 63 nt, Human
uguacccaucacuguuggucuacacccaguuuguugaagaacugcggguucacgagccauuug

SEQ ID NO: 436341 - RNA, 63 nt, Human
gacuuucugacuaggaaaccaugugguuugaacuugaagaaaaauguagacccaucuggguua

SEQ ID NO: 436342 - RNA, 63 nt, Human
caaacaaauagucuaucaaccccagacacugguuugaagaauguuaagacuugacaguggaac

SEQ ID NO: 436343 - RNA, 64 nt, Human; identical to SEQ ID NO: 388196

SEQ ID NO: 436344 - RNA, 64 nt, Human; identical to SEQ ID NO: 388197

SEQ ID NO: 436345 - RNA, 64 nt, Human; identical to SEQ ID NO: 388198

SEQ ID NO: 436346 - RNA, 64 nt, Human; identical to SEQ ID NO: 388202

SEQ ID NO: 436347 - RNA, 64 nt, Human; identical to SEQ ID NO: 388203

SEQ ID NO: 436348 - RNA, 64 nt, Human; identical to SEQ ID NO: 388204

SEQ ID NO: 436349 - RNA, 64 nt, Human; identical to SEQ ID NO: 388205

SEQ ID NO: 436350 - RNA, 64 nt, Human; identical to SEQ ID NO: 388206

SEQ ID NO: 436351 - RNA, 64 nt, Human; identical to SEQ ID NO: 388207

SEQ ID NO: 436352 - RNA, 64 nt, Human; identical to SEQ ID NO: 388208

SEQ ID NO: 436353 - RNA, 64 nt, Human; identical to SEQ ID NO: 388209

SEQ ID NO: 436354 - RNA, 64 nt, Human; identical to SEQ ID NO: 388210

SEQ ID NO: 436355 - RNA, 64 nt, Human; identical to SEQ ID NO: 388211

SEQ ID NO: 436356 - RNA, 64 nt, Human; identical to SEQ ID NO: 388212

SEQ ID NO: 436357 - RNA, 64 nt, Human; identical to SEQ ID NO: 388213

SEQ ID NO: 436358 - RNA, 64 nt, Human
ggcugaggaggcuccaggccugaggaccaagggauggcccgacucggcgguuugcggaggaugc

SEQ ID NO: 436359 - RNA, 64 nt, Human
aucagcuaccuguagggccuggggaaagccaggauggcccgaggaagaggcagaagccgugggu

SEQ ID NO: 436360 - RNA, 64 nt, Human; identical to SEQ ID NO: 388214

SEQ ID NO: 436361 - RNA, 64 nt, Human; identical to SEQ ID NO: 388215

SEQ ID NO: 436362 - RNA, 64 nt, Human; identical to SEQ ID NO: 388216

SEQ ID NO: 436363 - RNA, 64 nt, Human; identical to SEQ ID NO: 388220

SEQ ID NO: 436364 - RNA, 64 nt, Human; identical to SEQ ID NO: 388221

SEQ ID NO: 436365 - RNA, 64 nt, Human; identical to SEQ ID NO: 388222

SEQ ID NO: 436366 - RNA, 64 nt, Human; identical to SEQ ID NO: 388223

SEQ ID NO: 436367 - RNA, 64 nt, Human; identical to SEQ ID NO: 388224

SEQ ID NO: 436368 - RNA, 64 nt, Human; identical to SEQ ID NO: 388225

SEQ ID NO: 436369 - RNA, 64 nt, Human; identical to SEQ ID NO: 388226

SEQ ID NO: 436370 - RNA, 64 nt, Human; identical to SEQ ID NO: 388227

SEQ ID NO: 436371 - RNA, 59 nt, Human; identical to SEQ ID NO: 388228

SEQ ID NO: 436372 - RNA, 64 nt, Human; identical to SEQ ID NO: 388229

SEQ ID NO: 436373 - RNA, 64 nt, Human; identical to SEQ ID NO: 388230

SEQ ID NO: 436374 - RNA, 64 nt, Human; identical to SEQ ID NO: 388231

SEQ ID NO: 436375 - RNA, 63 nt, Human
ugcauguaaagcaucauugaaucaauggaucuguugaagaacucagcugcuggaaaccaugca

SEQ ID NO: 436376 - RNA, 63 nt, Human
ucuguuacauaagucauuuuccccuuagagugcuugaagaaaugccaccuacagguuguguac

SEQ ID NO: 436377 - RNA, 63 nt, Human
acacaugagcccuggaugaguaugguaggggguuugaagaauccccuguccaccucccaaauc

SEQ ID NO: 436378 - RNA, 64 nt, Human; identical to SEQ ID NO: 388232

SEQ ID NO: 436379 - RNA, 64 nt, Human; identical to SEQ ID NO: 388233

SEQ ID NO: 436380 - RNA, 64 nt, Human; identical to SEQ ID NO: 388234

SEQ ID NO: 436381 - RNA, 64 nt, Human; identical to SEQ ID NO: 388238

SEQ ID NO: 436382 - RNA, 64 nt, Human; identical to SEQ ID NO: 388239

SEQ ID NO: 436383 - RNA, 64 nt, Human; identical to SEQ ID NO: 388240

SEQ ID NO: 436384 - RNA, 64 nt, Human; identical to SEQ ID NO: 388241

SEQ ID NO: 436385 - RNA, 64 nt, Human; identical to SEQ ID NO: 388242

SEQ ID NO: 436386 - RNA, 64 nt, Human; identical to SEQ ID NO: 388243

SEQ ID NO: 436387 - RNA, 64 nt, Human; identical to SEQ ID NO: 388244

SEQ ID NO: 436388 - RNA, 64 nt, Human; identical to SEQ ID NO: 388245

SEQ ID NO: 436389 - RNA, 64 nt, Human; identical to SEQ ID NO: 388246

SEQ ID NO: 436390 - RNA, 64 nt, Human; identical to SEQ ID NO: 388247

SEQ ID NO: 436391 - RNA, 64 nt, Human; identical to SEQ ID NO: 388248

SEQ ID NO: 436392 - RNA, 64 nt, Human; identical to SEQ ID NO: 388249

SEQ ID NO: 436393 - RNA, 63 nt, Human
aucuaacuggcauuuguguuucuugcgaguauuuugaagaaacaggccguugaccccaucuuu

SEQ ID NO: 436394 - RNA, 63 nt, Human
cuauacuucccuuuuugaauaccauuugguguuuugaagaauuaacagcuuugugaacguggc

SEQ ID NO: 436395 - RNA, 63 nt, Human
ugaagacuuugucuaagccucauuauacugaaguugaagaaaccaaaugagcuccacccucac

SEQ ID NO: 436396 - RNA, 64 nt, Human; identical to SEQ ID NO: 388250

SEQ ID NO: 436397 - RNA, 64 nt, Human; identical to SEQ ID NO: 388251

SEQ ID NO: 436398 - RNA, 64 nt, Human; identical to SEQ ID NO: 388252

SEQ ID NO: 436399 - RNA, 64 nt, Human; identical to SEQ ID NO: 388256

SEQ ID NO: 436400 - RNA, 64 nt, Human; identical to SEQ ID NO: 388257

SEQ ID NO: 436401 - RNA, 64 nt, Human; identical to SEQ ID NO: 388258

SEQ ID NO: 436402 - RNA, 64 nt, Human; identical to SEQ ID NO: 388259

SEQ ID NO: 436403 - RNA, 64 nt, Human; identical to SEQ ID NO: 388260

SEQ ID NO: 436404 - RNA, 64 nt, Human; identical to SEQ ID NO: 388261

SEQ ID NO: 436405 - RNA, 64 nt, Human; identical to SEQ ID NO: 388262

SEQ ID NO: 436406 - RNA, 64 nt, Human; identical to SEQ ID NO: 388263

SEQ ID NO: 436407 - RNA, 64 nt, Human; identical to SEQ ID NO: 388264

SEQ ID NO: 436408 - RNA, 64 nt, Human; identical to SEQ ID NO: 388265

SEQ ID NO: 436409 - RNA, 64 nt, Human; identical to SEQ ID NO: 388266

SEQ ID NO: 436410 - RNA, 64 nt, Human; identical to SEQ ID NO: 388267

SEQ ID NO: 436411 - RNA, 63 nt, Human
aacauauuuauggcauuuucuugaagagugugguugaagaaauauuucuccuuuuguuuuucu

SEQ ID NO: 436412 - RNA, 63 nt, Human
gggauuuguuuuuuacaucuccuuuuuccuuccuugaagaaaaauucuuggcugucccaagga

SEQ ID NO: 436413 - RNA, 63 nt, Human
acaaaccauuuguuaaccagcuguccugggcuauugaagaagauuucauuuuccgcgcaucca

SEQ ID NO: 436414 - RNA, 64 nt, Human; identical to SEQ ID NO: 388268

SEQ ID NO: 436415 - RNA, 64 nt, Human; identical to SEQ ID NO: 388269

SEQ ID NO: 436416 - RNA, 64 nt, Human; identical to SEQ ID NO: 388270

SEQ ID NO: 436417 - RNA, 64 nt, Human; identical to SEQ ID NO: 388274

SEQ ID NO: 436418 - RNA, 64 nt, Human; identical to SEQ ID NO: 388275

SEQ ID NO: 436419 - RNA, 64 nt, Human; identical to SEQ ID NO: 388276

SEQ ID NO: 436420 - RNA, 64 nt, Human; identical to SEQ ID NO: 388277

SEQ ID NO: 436421 - RNA, 64 nt, Human; identical to SEQ ID NO: 388278

SEQ ID NO: 436422 - RNA, 64 nt, Human; identical to SEQ ID NO: 388279

SEQ ID NO: 436423 - RNA, 64 nt, Human; identical to SEQ ID NO: 388280

SEQ ID NO: 436424 - RNA, 64 nt, Human; identical to SEQ ID NO: 388281

SEQ ID NO: 436425 - RNA, 64 nt, Human; identical to SEQ ID NO: 388282

SEQ ID NO: 436426 - RNA, 64 nt, Human; identical to SEQ ID NO: 388283

SEQ ID NO: 436427 - RNA, 64 nt, Human; identical to SEQ ID NO: 388284

SEQ ID NO: 436428 - RNA, 64 nt, Human; identical to SEQ ID NO: 388285

SEQ ID NO: 436429 - RNA, 63 nt, Human
ccuaaccuucaaaugugggagcuuggaucaauguugaagaauaauuuucaucauagugaaaau

SEQ ID NO: 436430 - RNA, 63 nt, Human
uuuucauacagaagacuuuuuuguuguuguucuuugaagaacagucuguaguauuugaagggu

SEQ ID NO: 436431 - RNA, 63 nt, Human
ccuuaaagacacgcauuccaaaguggaaugugguugaagaaagugggccaggugguugaagaa

SEQ ID NO: 436432 - RNA, 64 nt, Human; identical to SEQ ID NO: 388286

SEQ ID NO: 436433 - RNA, 64 nt, Human; identical to SEQ ID NO: 388287

SEQ ID NO: 436434 - RNA, 64 nt, Human; identical to SEQ ID NO: 388288

SEQ ID NO: 436435 - RNA, 64 nt, Human; identical to SEQ ID NO: 388292

SEQ ID NO: 436436 - RNA, 64 nt, Human; identical to SEQ ID NO: 388293

SEQ ID NO: 436437 - RNA, 64 nt, Human; identical to SEQ ID NO: 388294

SEQ ID NO: 436438 - RNA, 64 nt, Human; identical to SEQ ID NO: 388295

SEQ ID NO: 436439 - RNA, 64 nt, Human; identical to SEQ ID NO: 388296

SEQ ID NO: 436440 - RNA, 64 nt, Human; identical to SEQ ID NO: 388297

SEQ ID NO: 436441 - RNA, 64 nt, Human; identical to SEQ ID NO: 388298

SEQ ID NO: 436442 - RNA, 64 nt, Human; identical to SEQ ID NO: 388299

SEQ ID NO: 436443 - RNA, 64 nt, Human; identical to SEQ ID NO: 388300

SEQ ID NO: 436444 - RNA, 64 nt, Human; identical to SEQ ID NO: 388301

SEQ ID NO: 436445 - RNA, 64 nt, Human; identical to SEQ ID NO: 388302

SEQ ID NO: 436446 - RNA, 64 nt, Human; identical to SEQ ID NO: 388303

SEQ ID NO: 436447 - RNA, 63 nt, Human
ggaaccugugguuuuaacaaaccaauacacauauugaagaagucauuuuaauucagugaaacg

SEQ ID NO: 436448 - RNA, 63 nt, Human
auggauuaacaugaaaguuauccaggcgcagaguugaagaagcauaagcaagacaaaaacaga

SEQ ID NO: 436449 - RNA, 63 nt, Human
gugagucaccaugcccagccccaaagccauuucuugaagaauuucucgcaaacucacaacccu

SEQ ID NO: 436450 - RNA, 64 nt, Human; identical to SEQ ID NO: 388304

SEQ ID NO: 436451 - RNA, 64 nt, Human; identical to SEQ ID NO: 388305

SEQ ID NO: 436452 - RNA, 64 nt, Human; identical to SEQ ID NO: 388306

SEQ ID NO: 436453 - RNA, 64 nt, Human; identical to SEQ ID NO: 388310

SEQ ID NO: 436454 - RNA, 64 nt, Human; identical to SEQ ID NO: 388311

SEQ ID NO: 436455 - RNA, 64 nt, Human; identical to SEQ ID NO: 388312

SEQ ID NO: 436456 - RNA, 64 nt, Human; identical to SEQ ID NO: 388313

SEQ ID NO: 436457 - RNA, 64 nt, Human; identical to SEQ ID NO: 388314

SEQ ID NO: 436458 - RNA, 64 nt, Human; identical to SEQ ID NO: 388315

SEQ ID NO: 436459 - RNA, 64 nt, Human; identical to SEQ ID NO: 388316

SEQ ID NO: 436460 - RNA, 64 nt, Human; identical to SEQ ID NO: 388317

SEQ ID NO: 436461 - RNA, 64 nt, Human; identical to SEQ ID NO: 388318

SEQ ID NO: 436462 - RNA, 64 nt, Human; identical to SEQ ID NO: 388319

SEQ ID NO: 436463 - RNA, 64 nt, Human; identical to SEQ ID NO: 388320

SEQ ID NO: 436464 - RNA, 64 nt, Human; identical to SEQ ID NO: 388321

SEQ ID NO: 436465 - RNA, 64 nt, Human
cagccccaucucuuucgccugcacacuuggaacucagcaagaagggacuguuucuaggugggcu

SEQ ID NO: 436466 - RNA, 64 nt, Human
aaguggguguuggccaggcacaucccaucucaggcagcaagacaaucuuucacucacugacggc

SEQ ID NO: 436467 - RNA, 64 nt, Human
ucccuucugccuucaccuuugccguggguggacacagcaagaaggcccucaucagaugcuggcc

SEQ ID NO: 436468 - RNA, 64 nt, Human; identical to SEQ ID NO: 388322

SEQ ID NO: 436469 - RNA, 64 nt, Human; identical to SEQ ID NO: 388323

SEQ ID NO: 436470 - RNA, 64 nt, Human; identical to SEQ ID NO: 388324

SEQ ID NO: 436471 - RNA, 64 nt, Human; identical to SEQ ID NO: 388328

SEQ ID NO: 436472 - RNA, 64 nt, Human; identical to SEQ ID NO: 388329

SEQ ID NO: 436473 - RNA, 64 nt, Human; identical to SEQ ID NO: 388330

SEQ ID NO: 436474 - RNA, 64 nt, Human; identical to SEQ ID NO: 388331

SEQ ID NO: 436475 - RNA, 64 nt, Human; identical to SEQ ID NO: 388332

SEQ ID NO: 436476 - RNA, 64 nt, Human; identical to SEQ ID NO: 388333

SEQ ID NO: 436477 - RNA, 64 nt, Human; identical to SEQ ID NO: 388334

SEQ ID NO: 436478 - RNA, 64 nt, Human; identical to SEQ ID NO: 388335

SEQ ID NO: 436479 - RNA, 64 nt, Human; identical to SEQ ID NO: 388336

SEQ ID NO: 436480 - RNA, 64 nt, Human; identical to SEQ ID NO: 388337

SEQ ID NO: 436481 - RNA, 64 nt, Human; identical to SEQ ID NO: 388338

SEQ ID NO: 436482 - RNA, 64 nt, Human; identical to SEQ ID NO: 388339

SEQ ID NO: 436483 - RNA, 64 nt, Human
uuacuccuauuaccucauuuuggcguuguuucugggaguggaaugcuuugcaugcauugguacg

SEQ ID NO: 436484 - RNA, 64 nt, Human
guccaucuuccaggagagacggucucggguccagggaguggagggggcugccccugccgugcag

SEQ ID NO: 436485 - RNA, 64 nt, Human
gggccucagggaggacuugggcaccuacgccgagggaguggagcuccugggugcguguccagau

SEQ ID NO: 436486 - RNA, 64 nt, Human; identical to SEQ ID NO: 388340

SEQ ID NO: 436487 - RNA, 64 nt, Human; identical to SEQ ID NO: 388341

SEQ ID NO: 436488 - RNA, 64 nt, Human; identical to SEQ ID NO: 388342

SEQ ID NO: 436489 - RNA, 64 nt, Human; identical to SEQ ID NO: 388345

SEQ ID NO: 436490 - RNA, 64 nt, Human; identical to SEQ ID NO: 388346

SEQ ID NO: 436491 - RNA, 64 nt, Human; identical to SEQ ID NO: 388347

SEQ ID NO: 436492 - RNA, 64 nt, Human; identical to SEQ ID NO: 388348

SEQ ID NO: 436493 - RNA, 64 nt, Human; identical to SEQ ID NO: 388349

SEQ ID NO: 436494 - RNA, 64 nt, Human; identical to SEQ ID NO: 388350

SEQ ID NO: 436495 - RNA, 64 nt, Human; identical to SEQ ID NO: 388351

SEQ ID NO: 436496 - RNA, 64 nt, Human; identical to SEQ ID NO: 388352

SEQ ID NO: 436497 - RNA, 64 nt, Human; identical to SEQ ID NO: 388353

SEQ ID NO: 436498 - RNA, 64 nt, Human; identical to SEQ ID NO: 388354

SEQ ID NO: 436499 - RNA, 64 nt, Human; identical to SEQ ID NO: 388355

SEQ ID NO: 436500 - RNA, 64 nt, Human; identical to SEQ ID NO: 388356

SEQ ID NO: 436501 - RNA, 64 nt, Human
gggguccggagggagucagggauggagggcagagggaguggauguggggguuugaggacgugug

SEQ ID NO: 436502 - RNA, 64 nt, Human
guacauacauguauuucucuuguguauauacuuaggaguggaaucgcugggucuuagagcaugu

SEQ ID NO: 436503 - RNA, 64 nt, Human
cagacugguuggacuuguucgucuggacgacacuggaguggaacacugccucccacuuucuugg

SEQ ID NO: 436504 - RNA, 64 nt, Human; identical to SEQ ID NO: 388357

SEQ ID NO: 436505 - RNA, 64 nt, Human; identical to SEQ ID NO: 388358

SEQ ID NO: 436506 - RNA, 64 nt, Human; identical to SEQ ID NO: 388359

SEQ ID NO: 436507 - RNA, 64 nt, Human; identical to SEQ ID NO: 388363

SEQ ID NO: 436508 - RNA, 64 nt, Human; identical to SEQ ID NO: 388364

SEQ ID NO: 436509 - RNA, 64 nt, Human; identical to SEQ ID NO: 388365

SEQ ID NO: 436510 - RNA, 64 nt, Human; identical to SEQ ID NO: 388366

SEQ ID NO: 436511 - RNA, 64 nt, Human; identical to SEQ ID NO: 388367

SEQ ID NO: 436512 - RNA, 64 nt, Human; identical to SEQ ID NO: 388368

SEQ ID NO: 436513 - RNA, 64 nt, Human; identical to SEQ ID NO: 388369

SEQ ID NO: 436514 - RNA, 64 nt, Human; identical to SEQ ID NO: 388370

SEQ ID NO: 436515 - RNA, 64 nt, Human; identical to SEQ ID NO: 388371

SEQ ID NO: 436516 - RNA, 64 nt, Human; identical to SEQ ID NO: 388372

SEQ ID NO: 436517 - RNA, 64 nt, Human; identical to SEQ ID NO: 388373

SEQ ID NO: 436518 - RNA, 64 nt, Human; identical to SEQ ID NO: 388374

SEQ ID NO: 436519 - RNA, 64 nt, Human
gccuccaccggugauacccaggcagauauggucuggaguggaccuccagcaaacuccagcagac

SEQ ID NO: 436520 - RNA, 64 nt, Human
aacaguaauugggacagaaacuccagguaaauggggaguggagaagacugcaguaaauuagaug

SEQ ID NO: 436521 - RNA, 64 nt, Human
augggaugcgguggguugcccaauaaacggcuguggaguggaaauuccuccagagccaaaaagg

SEQ ID NO: 436522 - RNA, 64 nt, Human; identical to SEQ ID NO: 388375

SEQ ID NO: 436523 - RNA, 63 nt, Human; identical to SEQ ID NO: 388376

SEQ ID NO: 436524 - RNA, 64 nt, Human; identical to SEQ ID NO: 388377

SEQ ID NO: 436525 - RNA, 64 nt, Human; identical to SEQ ID NO: 388381

SEQ ID NO: 436526 - RNA, 64 nt, Human; identical to SEQ ID NO: 388382

SEQ ID NO: 436527 - RNA, 64 nt, Human; identical to SEQ ID NO: 388383

SEQ ID NO: 436528 - RNA, 64 nt, Human; identical to SEQ ID NO: 388384

SEQ ID NO: 436529 - RNA, 64 nt, Human; identical to SEQ ID NO: 388385

SEQ ID NO: 436530 - RNA, 64 nt, Human; identical to SEQ ID NO: 388386

SEQ ID NO: 436531 - RNA, 64 nt, Human; identical to SEQ ID NO: 388387

SEQ ID NO: 436532 - RNA, 64 nt, Human; identical to SEQ ID NO: 388388

SEQ ID NO: 436533 - RNA, 64 nt, Human; identical to SEQ ID NO: 388389

SEQ ID NO: 436534 - RNA, 64 nt, Human; identical to SEQ ID NO: 388390

SEQ ID NO: 436535 - RNA, 64 nt, Human; identical to SEQ ID NO: 388391

SEQ ID NO: 436536 - RNA, 64 nt, Human; identical to SEQ ID NO: 388392

SEQ ID NO: 436537 - RNA, 64 nt, Human
ggcagacauuuauggacacccgccacguggucccggaguggaacggugccucccacugcagccu

SEQ ID NO: 436538 - RNA, 64 nt, Human
ccacuuccaagaugugcccaggaugugaggagcuggaguggaagcugcaccuuugggaagaauu

SEQ ID NO: 436539 - RNA, 64 nt, Human
cagaacaggcagucucacaagcacgcagcacacuggaguggacgccugugcccacccgagccug

SEQ ID NO: 436540 - RNA, 64 nt, Human; identical to SEQ ID NO: 388393

SEQ ID NO: 436541 - RNA, 64 nt, Human; identical to SEQ ID NO: 388394

SEQ ID NO: 436542 - RNA, 64 nt, Human; identical to SEQ ID NO: 388395

SEQ ID NO: 436543 - RNA, 64 nt, Human; identical to SEQ ID NO: 388399

SEQ ID NO: 436544 - RNA, 64 nt, Human; identical to SEQ ID NO: 388400

SEQ ID NO: 436545 - RNA, 64 nt, Human; identical to SEQ ID NO: 388401

SEQ ID NO: 436546 - RNA, 64 nt, Human; identical to SEQ ID NO: 388402

SEQ ID NO: 436547 - RNA, 64 nt, Human; identical to SEQ ID NO: 388403

SEQ ID NO: 436548 - RNA, 64 nt, Human; identical to SEQ ID NO: 388404

SEQ ID NO: 436549 - RNA, 64 nt, Human; identical to SEQ ID NO: 388405

SEQ ID NO: 436550 - RNA, 64 nt, Human; identical to SEQ ID NO: 388406

SEQ ID NO: 436551 - RNA, 57 nt, Human; identical to SEQ ID NO: 388407

SEQ ID NO: 436552 - RNA, 64 nt, Human; identical to SEQ ID NO: 388408

SEQ ID NO: 436553 - RNA, 64 nt, Human; identical to SEQ ID NO: 388409

SEQ ID NO: 436554 - RNA, 64 nt, Human; identical to SEQ ID NO: 388410

SEQ ID NO: 436555 - RNA, 63 nt, Human
cuaggcccggcaggaacaccagacaugaacagguugaagaacuggagcgaagugcacaccuca

SEQ ID NO: 436556 - RNA, 63 nt, Human
aacauucugauuuuacauguaaaacaagaaaaguugaagaagauaugugaagaaaaauguauu

SEQ ID NO: 436557 - RNA, 63 nt, Human
guuucuaccaagucccauuagaagagcuguucuuugaagaaucauauucaaccuucuaccaaa

SEQ ID NO: 436558 - RNA, 64 nt, Human; identical to SEQ ID NO: 388411

SEQ ID NO: 436559 - RNA, 64 nt, Human; identical to SEQ ID NO: 388412

SEQ ID NO: 436560 - RNA, 64 nt, Human; identical to SEQ ID NO: 388413

SEQ ID NO: 436561 - RNA, 64 nt, Human; identical to SEQ ID NO: 388417

SEQ ID NO: 436562 - RNA, 64 nt, Human; identical to SEQ ID NO: 388418

SEQ ID NO: 436563 - RNA, 64 nt, Human; identical to SEQ ID NO: 388419

SEQ ID NO: 436564 - RNA, 64 nt, Human; identical to SEQ ID NO: 388420

SEQ ID NO: 436565 - RNA, 64 nt, Human; identical to SEQ ID NO: 388421

SEQ ID NO: 436566 - RNA, 55 nt, Human; identical to SEQ ID NO: 388422

SEQ ID NO: 436567 - RNA, 64 nt, Human; identical to SEQ ID NO: 388423

SEQ ID NO: 436568 - RNA, 64 nt, Human; identical to SEQ ID NO: 388424

SEQ ID NO: 436569 - RNA, 64 nt, Human; identical to SEQ ID NO: 388425

SEQ ID NO: 436570 - RNA, 64 nt, Human; identical to SEQ ID NO: 388426

SEQ ID NO: 436571 - RNA, 64 nt, Human; identical to SEQ ID NO: 388427

SEQ ID NO: 436572 - RNA, 64 nt, Human; identical to SEQ ID NO: 388428

SEQ ID NO: 436573 - RNA, 64 nt, Human
agccuggugucuauaccaaagucugccacuacuuggaguggaucagggaaaccaugaagaggaa

SEQ ID NO: 436574 - RNA, 64 nt, Human
ggaggguauuuauuggucagggugugggaucugaggaguggagggaaaggguccugcuuucucc

SEQ ID NO: 436575 - RNA, 64 nt, Human
aguggauggguucugggguggcuccugagguagaggaguggagaacuggcucuuaagagcacag

SEQ ID NO: 436576 - RNA, 64 nt, Human; identical to SEQ ID NO: 388429

SEQ ID NO: 436577 - RNA, 64 nt, Human; identical to SEQ ID NO: 388430

SEQ ID NO: 436578 - RNA, 64 nt, Human; identical to SEQ ID NO: 388431

SEQ ID NO: 436579 - RNA, 64 nt, Human; identical to SEQ ID NO: 388435

SEQ ID NO: 436580 - RNA, 64 nt, Human; identical to SEQ ID NO: 388436

SEQ ID NO: 436581 - RNA, 64 nt, Human; identical to SEQ ID NO: 388437

SEQ ID NO: 436582 - RNA, 64 nt, Human; identical to SEQ ID NO: 388438

SEQ ID NO: 436583 - RNA, 64 nt, Human; identical to SEQ ID NO: 388439

SEQ ID NO: 436584 - RNA, 64 nt, Human; identical to SEQ ID NO: 388440

SEQ ID NO: 436585 - RNA, 64 nt, Human; identical to SEQ ID NO: 388441

SEQ ID NO: 436586 - RNA, 64 nt, Human; identical to SEQ ID NO: 388442

SEQ ID NO: 436587 - RNA, 64 nt, Human; identical to SEQ ID NO: 388443

SEQ ID NO: 436588 - RNA, 64 nt, Human; identical to SEQ ID NO: 388444

SEQ ID NO: 436589 - RNA, 64 nt, Human; identical to SEQ ID NO: 388445

SEQ ID NO: 436590 - RNA, 64 nt, Human; identical to SEQ ID NO: 388446

SEQ ID NO: 436591 - RNA, 64 nt, Human
ccugacagacgcgggcagugaugagcccuguucuggaguggaaagagcacgauagagcaccagg

SEQ ID NO: 436592 - RNA, 64 nt, Human
uggcccuucucaugcccaagacaguuguuucacaggaguggaagugugggugaugcaaguagaa

SEQ ID NO: 436593 - RNA, 52 nt, Human
cugcugugaagauagacugauuggaguggaccacggccaagcuugcuccguc

SEQ ID NO: 436594 - RNA, 64 nt, Human; identical to SEQ ID NO: 388447

SEQ ID NO: 436595 - RNA, 64 nt, Human; identical to SEQ ID NO: 388448

SEQ ID NO: 436596 - RNA, 64 nt, Human; identical to SEQ ID NO: 388449

SEQ ID NO: 436597 - RNA, 64 nt, Human; identical to SEQ ID NO: 388453

SEQ ID NO: 436598 - RNA, 64 nt, Human; identical to SEQ ID NO: 388454

SEQ ID NO: 436599 - RNA, 64 nt, Human; identical to SEQ ID NO: 388455

SEQ ID NO: 436600 - RNA, 64 nt, Human; identical to SEQ ID NO: 388456

SEQ ID NO: 436601 - RNA, 64 nt, Human; identical to SEQ ID NO: 388457

SEQ ID NO: 436602 - RNA, 64 nt, Human; identical to SEQ ID NO: 388458

SEQ ID NO: 436603 - RNA, 64 nt, Human; identical to SEQ ID NO: 388459

SEQ ID NO: 436604 - RNA, 64 nt, Human; identical to SEQ ID NO: 388460

SEQ ID NO: 436605 - RNA, 64 nt, Human; identical to SEQ ID NO: 388461

SEQ ID NO: 436606 - RNA, 64 nt, Human; identical to SEQ ID NO: 388462

SEQ ID NO: 436607 - RNA, 64 nt, Human; identical to SEQ ID NO: 388463

SEQ ID NO: 436608 - RNA, 64 nt, Human; identical to SEQ ID NO: 388464

SEQ ID NO: 436609 - RNA, 64 nt, Human
agccucugcugacagcaccucagcuaccagguggggaguggaaauucagccugcuuagaggacu

SEQ ID NO: 436610 - RNA, 64 nt, Human
aacaaacccagguuggcgacugcaacaggaacuuggaguggagaggaaaagcaucagaaagagg

SEQ ID NO: 436611 - RNA, 64 nt, Human
auacaaacugguauucuguucuggaggaaagggaggaguggaggugggcugggcccucucuucu

SEQ ID NO: 436612 - RNA, 57 nt, Human; identical to SEQ ID NO: 388465

SEQ ID NO: 436613 - RNA, 64 nt, Human; identical to SEQ ID NO: 388466

SEQ ID NO: 436614 - RNA, 64 nt, Human; identical to SEQ ID NO: 388467

SEQ ID NO: 436615 - RNA, 64 nt, Human; identical to SEQ ID NO: 388471

SEQ ID NO: 436616 - RNA, 64 nt, Human; identical to SEQ ID NO: 388472

SEQ ID NO: 436617 - RNA, 64 nt, Human; identical to SEQ ID NO: 388473

SEQ ID NO: 436618 - RNA, 64 nt, Human; identical to SEQ ID NO: 388474

SEQ ID NO: 436619 - RNA, 64 nt, Human; identical to SEQ ID NO: 388475

SEQ ID NO: 436620 - RNA, 64 nt, Human; identical to SEQ ID NO: 388476

SEQ ID NO: 436621 - RNA, 64 nt, Human; identical to SEQ ID NO: 388477

SEQ ID NO: 436622 - RNA, 64 nt, Human; identical to SEQ ID NO: 388478

SEQ ID NO: 436623 - RNA, 64 nt, Human; identical to SEQ ID NO: 388479

SEQ ID NO: 436624 - RNA, 64 nt, Human; identical to SEQ ID NO: 388480

SEQ ID NO: 436625 - RNA, 64 nt, Human; identical to SEQ ID NO: 388481

SEQ ID NO: 436626 - RNA, 64 nt, Human; identical to SEQ ID NO: 388482

SEQ ID NO: 436627 - RNA, 64 nt, Human
agaaggcggccguggcaugggcaggguauagugaggaguggaaggagacgugugccugguaaua

SEQ ID NO: 436628 - RNA, 64 nt, Human
aagcacuuugacacuacccccugccgagagaagaggaguggaugagccugcggguuugccucaa

SEQ ID NO: 436629 - RNA, 64 nt, Human
ccauagggacagcagcaccagcccuguggggcauggaguggaagcccagaagggcuucugcaag

SEQ ID NO: 436630 - RNA, 64 nt, Human; identical to SEQ ID NO: 388483

SEQ ID NO: 436631 - RNA, 64 nt, Human; identical to SEQ ID NO: 388484

SEQ ID NO: 436632 - RNA, 64 nt, Human; identical to SEQ ID NO: 388485

SEQ ID NO: 436633 - RNA, 64 nt, Human; identical to SEQ ID NO: 388489

SEQ ID NO: 436634 - RNA, 64 nt, Human; identical to SEQ ID NO: 388490

SEQ ID NO: 436635 - RNA, 64 nt, Human; identical to SEQ ID NO: 388491

SEQ ID NO: 436636 - RNA, 64 nt, Human; identical to SEQ ID NO: 388492

SEQ ID NO: 436637 - RNA, 64 nt, Human; identical to SEQ ID NO: 388493

SEQ ID NO: 436638 - RNA, 64 nt, Human; identical to SEQ ID NO: 388494

SEQ ID NO: 436639 - RNA, 64 nt, Human; identical to SEQ ID NO: 388495

SEQ ID NO: 436640 - RNA, 64 nt, Human; identical to SEQ ID NO: 388496

SEQ ID NO: 436641 - RNA, 64 nt, Human; identical to SEQ ID NO: 388497

SEQ ID NO: 436642 - RNA, 64 nt, Human; identical to SEQ ID NO: 388498

SEQ ID NO: 436643 - RNA, 64 nt, Human; identical to SEQ ID NO: 388499

SEQ ID NO: 436644 - RNA, 64 nt, Human; identical to SEQ ID NO: 388500

SEQ ID NO: 436645 - RNA, 64 nt, Human
ucucuuuuucuggagauaguuuucacuuuuaguuggaguggaaaucccuuuauauuuacauuga

SEQ ID NO: 436646 - RNA, 64 nt, Human
ugacuugggauaggacugagugguaggaggagggggaguggaggggcauagccuuucccuaauu

SEQ ID NO: 436647 - RNA, 64 nt, Human
augcuggggaaauggaaccauggugcaguaguguggaguggaugaguguuccaugagccuagga

SEQ ID NO: 436648 - RNA, 64 nt, Human; identical to SEQ ID NO: 388501

SEQ ID NO: 436649 - RNA, 64 nt, Human; identical to SEQ ID NO: 388502

SEQ ID NO: 436650 - RNA, 64 nt, Human; identical to SEQ ID NO: 388503

SEQ ID NO: 436651 - RNA, 64 nt, Human; identical to SEQ ID NO: 388505

SEQ ID NO: 436652 - RNA, 64 nt, Human; identical to SEQ ID NO: 388506

SEQ ID NO: 436653 - RNA, 64 nt, Human; identical to SEQ ID NO: 388507

SEQ ID NO: 436654 - RNA, 64 nt, Human; identical to SEQ ID NO: 388508

SEQ ID NO: 436655 - RNA, 64 nt, Human; identical to SEQ ID NO: 388509

SEQ ID NO: 436656 - RNA, 59 nt, Human; identical to SEQ ID NO: 388510

SEQ ID NO: 436657 - RNA, 64 nt, Human; identical to SEQ ID NO: 388511

SEQ ID NO: 436658 - RNA, 64 nt, Human; identical to SEQ ID NO: 388512

SEQ ID NO: 436659 - RNA, 64 nt, Human; identical to SEQ ID NO: 388513

SEQ ID NO: 436660 - RNA, 64 nt, Human; identical to SEQ ID NO: 388514

SEQ ID NO: 436661 - RNA, 64 nt, Human; identical to SEQ ID NO: 388515

SEQ ID NO: 436662 - RNA, 64 nt, Human; identical to SEQ ID NO: 388516

SEQ ID NO: 436663 - RNA, 64 nt, Human
ggagugggaggcuccccugcccuccuucuccuuaggaguggaggagauguguguucugcuccuc

SEQ ID NO: 436664 - RNA, 50 nt, Human
ugauggagggcgugcaguaaggaguggacagucgccucuaccaagaucgc

SEQ ID NO: 436665 - RNA, 64 nt, Human
agaacaggggcacccuccaaacacugggcucugaggaguggaguucucuguucuagagugacag

SEQ ID NO: 436666 - RNA, 64 nt, Human; identical to SEQ ID NO: 388517

SEQ ID NO: 436667 - RNA, 64 nt, Human; identical to SEQ ID NO: 388518

SEQ ID NO: 436668 - RNA, 64 nt, Human; identical to SEQ ID NO: 388519

SEQ ID NO: 436669 - RNA, 64 nt, Human; identical to SEQ ID NO: 388523

SEQ ID NO: 436670 - RNA, 64 nt, Human; identical to SEQ ID NO: 388524

SEQ ID NO: 436671 - RNA, 64 nt, Human; identical to SEQ ID NO: 388525

SEQ ID NO: 436672 - RNA, 64 nt, Human; identical to SEQ ID NO: 388526

SEQ ID NO: 436673 - RNA, 64 nt, Human; identical to SEQ ID NO: 388527

SEQ ID NO: 436674 - RNA, 64 nt, Human; identical to SEQ ID NO: 388528

SEQ ID NO: 436675 - RNA, 58 nt, Human; identical to SEQ ID NO: 388529

SEQ ID NO: 436676 - RNA, 64 nt, Human; identical to SEQ ID NO: 388530

SEQ ID NO: 436677 - RNA, 64 nt, Human; identical to SEQ ID NO: 388531

SEQ ID NO: 436678 - RNA, 64 nt, Human; identical to SEQ ID NO: 388532

SEQ ID NO: 436679 - RNA, 64 nt, Human; identical to SEQ ID NO: 388533

SEQ ID NO: 436680 - RNA, 64 nt, Human; identical to SEQ ID NO: 388534

SEQ ID NO: 436681 - RNA, 63 nt, Human
cuccuaggauguguguucauggcauuauagcuuuugaagaaaggccagugauccagcaaaggg

SEQ ID NO: 436682 - RNA, 63 nt, Human
auuuguaaugcaaugugucacuugaaaagagauuugaagaaacugacaacuucaaaaacaaau

SEQ ID NO: 436683 - RNA, 63 nt, Human
acaggccauuucauugagggaaaacauaauaucuugaagaauauuguuaaaaccuuacuuaaa

SEQ ID NO: 436684 - RNA, 64 nt, Human
acgaaucacacaacaaaaaggaggagagauauuuuggguucagaagaaguaaaugauaauguag

SEQ ID NO: 436685 - RNA, 64 nt, Human
ggcaccaucuuggcucacugcaaccucuaccuccuggguucaagcaaaucuccugccucagccu

SEQ ID NO: 436686 - RNA, 64 nt, Human
uggggcuaguuggcacugccauguaucucaggcuuggguucacaccaucacccuuucuucccuc

SEQ ID NO: 436687 - RNA, 64 nt, Human
ggcacgaucucggcucacugcaaccucugccuccuggguucaagcaauucucccaccucagccu

SEQ ID NO: 436688 - RNA, 64 nt, Human
ggcgcgaucucggcucacugcaaccuccgccuccuggguucaagcaguucucuugccucagccu

SEQ ID NO: 436689 - RNA, 64 nt, Human
uggcccaucagggcucacuguaaccuccgacuccuggguucaagugacccucccaccucagccu

SEQ ID NO: 436690 - RNA, 64 nt, Human
ggcaugaucucagcucucugcaaccuccaccuccuggguucaagacaauccuccaaacacagac

SEQ ID NO: 436691 - RNA, 64 nt, Human
uggcguaucuccacucaccacaaccuccgccuccuggguucaagggauucuccugucuuagccu

SEQ ID NO: 436692 - RNA, 64 nt, Human
ccagaucaauauuuuaggauacuagauguuuuaauggguucagaauccaguuuguaggaagauu

SEQ ID NO: 436693 - RNA, 64 nt, Human
ucuccuuagcagagcuuccaccugccauccgucuuggguucagugagcuucaaggcucacaaug

SEQ ID NO: 436694 - RNA, 64 nt, Human
aauuuauuuuuaaauaagguuggagaugucaaguuggguucacuugccaugcaggaagaggccc

SEQ ID NO: 436695 - RNA, 64 nt, Human
aacugucucguaaugaauuucugcuguccuccugggaguggacggccgggucccgucccccggg

SEQ ID NO: 436696 - RNA, 64 nt, Human
gcccccuuucugguugaagggaagccagaccaguggaguggaagcucuugaagcacuuucuuuu

SEQ ID NO: 436697 - RNA, 64 nt, Human
uccacagaauaaaaagggcacagagcugcugcuuggaguggaugcccuggggcuucacauuuau

SEQ ID NO: 436698 - RNA, 64 nt, Human
cucauguuuuuccgacacuccugggucagacuccuggguucaugacuuacuugcuagcgucccu

SEQ ID NO: 436699 - RNA, 64 nt, Human
uguugauuuagaacuuaaaauagauguguaaauuuggguucaaaauguagauuugaguccaguu

SEQ ID NO: 436700 - RNA, 64 nt, Human
ccuaccuuaaaacaacacacgagaagaguuaaacuggguucauuuuaaugaucaauuuaccugc

SEQ ID NO: 436701 - RNA, 64 nt, Human
ggcacgaucucggcucacugcacccucugccucuuggguucaagcgauucuccugccucagccu

SEQ ID NO: 436702 - RNA, 64 nt, Human
ggcacaaucucagcucacugcaaccuccaccuccuggguucaagcgauucuccugccucagccu

SEQ ID NO: 436703 - RNA, 64 nt, Human
uggggaggaagggccaggagagagaucuagaaaguggguucacuagagcugggaaacagggagc

SEQ ID NO: 436704 - RNA, 64 nt, Human
gagccauaguuacccugccaagaagaguagaaaauggguucaacuccuguuucgcuccaccaac

SEQ ID NO: 436705 - RNA, 64 nt, Human
ggcucugugugcccucacuagauaguuuuucuucuggguucaaccacuuuagccagaauuugau

SEQ ID NO: 436706 - RNA, 64 nt, Human
ugccugaugucagcucccugcaaccuccgccuccuggguucaagcgauucuccugccucagccu

SEQ ID NO: 436707 - RNA, 64 nt, Human
ggcgcaaucucggcucauagcaagcuccgccuccuggguucaugccauucuccugccucagccu

SEQ ID NO: 436708 - RNA, 64 nt, Human
ucuguugaccaggcuggagugcaguggugagaucuggguucacugcaaccucugccuccugggc

SEQ ID NO: 436709 - RNA, 64 nt, Human
aaguggugucauaggaaugaaggacugugggcgcuggguucaaauuccaguucuaugcaccacu

SEQ ID NO: 436710 - RNA, 64 nt, Human
cuguacugaugucacaacuuugcaagcucugccuuggguucagcccaucugggcucaaauucca

SEQ ID NO: 436711 - RNA, 64 nt, Human
ggcuugaucuuggcuaacugcaacuuccaccuccuggguucaagcaauucuccugccucagccu

SEQ ID NO: 436712 - RNA, 64 nt, Human
uuacugagcacaggacagaggcaauauacaacucuggguucacacacaagcugagaugagaaga

SEQ ID NO: 436713 - RNA, 64 nt, Human
ugagucaggcugggggacuuguuugaaagaaagaggaguggaaaaugguuccaggagggaagag

SEQ ID NO: 436714 - RNA, 64 nt, Human
uuccacccccaggagggcggggguggguggagcaggaguggaggcagccugcagaggaagggug

SEQ ID NO: 436715 - RNA, 64 nt, Human
ucgguccccagggcgcagcuguuggggcugcgggggaguggagcccccgugccccugcuuuucc

SEQ ID NO: 436716 - RNA, 64 nt, Human
ggcaggaucucagaucacugcaaccucugccuccuggguucaagcgauuuuccugcuucaucuu

SEQ ID NO: 436717 - RNA, 64 nt, Human
gguguuaccucagcucacugcagccuccaccuccuggguucaagcgauucuccugccucagccu

SEQ ID NO: 436718 - RNA, 64 nt, Human
ggcgcaaucucggcucacuguaaucuccgccuccuggguucaagggauucuccugccucagccu

SEQ ID NO: 436719 - RNA, 64 nt, Human
aacuagaaagaugaaaacuuuuacauuuuucugauggguucaugucucugauugggucagcugg

SEQ ID NO: 436720 - RNA, 64 nt, Human
gaccguuagucucuaagcuuuaccaggagcagccuggguucagccagucagugacugguggguu

SEQ ID NO: 436721 - RNA, 64 nt, Human
ggaacuugggagaugauggugcagaugaugaaacuggguucaucccaguuccaaagacucagag

SEQ ID NO: 436722 - RNA, 64 nt, Human
ccacaaagccuugaccaugguucaugaaaccguuuggguucauuuaaauuugucugaaucauua

SEQ ID NO: 436723 - RNA, 64 nt, Human
ggugugaucucggcucacugcaaccuccgccuccuggguucaggagauucuccucugucagcgu

SEQ ID NO: 436724 - RNA, 64 nt, Human
ggcgcgaucucggcucacugcaaccuccgccuccuggguucacgcgauucuccugccucagccu

SEQ ID NO: 436725 - RNA, 64 nt, Human
ggcgcgaacucggcucacugcaaccuccgccuccuggguucaagcaauucuccuuccucagccu

SEQ ID NO: 436726 - RNA, 64 nt, Human
ucagaggaggaugaccgugcuugaggaggaagaauggguucaagaucaucauauucaucagaag

SEQ ID NO: 436727 - RNA, 64 nt, Human
ggcgugaccucagcucacugcgaccuccaccuccuggguucaagcgauucuccugccucagccu

SEQ ID NO: 436728 - RNA, 64 nt, Human
ggcaugaucuuggcucacugcaaccuccgccuccuggguucaagugauucuucugccuccaccc

SEQ ID NO: 436729 - RNA, 64 nt, Human
gcaaugaccucggcucacugcaaccucugccuccuggguucaagugauucuccagccucagccu

SEQ ID NO: 436730 - RNA, 64 nt, Human
ucucccuauguuguccagccuagucucaaacuccuggguucaagcaauccucccaccucggccu

SEQ ID NO: 436731 - RNA, 64 nt, Human
augagauagccaagaagcaucaugucaguaacugggaguggagagggaguuuuguuuugaaacu

SEQ ID NO: 436732 - RNA, 64 nt, Human
cagggcauggggggcaguggugagcuaaggcugaggaguggagaugaccagaauauaagggugc

SEQ ID NO: 436733 - RNA, 64 nt, Human
gagcccuuccucucagcccccauguugggagaggggaguggauucuugcugcugguaugagacu

SEQ ID NO: 436734 - RNA, 64 nt, Human
uuagaucuaaggaaauacuacagagauauuuucauggguucaguaacuuuucauuuuauaacau

SEQ ID NO: 436735 - RNA, 64 nt, Human
ugugucaucuuggcucacugcaaccuccgccuccuggguucaagggauucuccugccucagccu

SEQ ID NO: 436736 - RNA, 64 nt, Human
ggacgcguauguagggcccguaccuacuggcaguuggguucagggaaaugggauugacuuggcc

SEQ ID NO: 436737 - RNA, 64 nt, Human
acucacuauguuguccaagcuggucucaaacuccuggguucaagccauccucccaccucagccu

SEQ ID NO: 436738 - RNA, 64 nt, Human
ugugcuuuggugucuauaaguacauauguggauauggguucauuuuaucccuaaacuuaguacc

SEQ ID NO: 436739 - RNA, 64 nt, Human
cuuauuuauaccucucacucaauuguuaauucuuuggguucagucucaugccauauuuacuccu

SEQ ID NO: 436740 - RNA, 64 nt, Human
uggaugcuuuggaaucgugucuuccaugcuccacuggguucaauuuaaaauaggagaggcuuuc

SEQ ID NO: 436741 - RNA, 64 nt, Human
uggguucugugaagcaaaccacuguagcuuuagcuggguucagucauaugacucguugguggaa

SEQ ID NO: 436742 - RNA, 64 nt, Human
gagaagagagaggcaugugugccggcauccuugauggguucaaagagaaagguuggagaugaua

SEQ ID NO: 436743 - RNA, 64 nt, Human
aaacagagauccugagucauguguuccaguggcuuggguucacagugcauauacacaauaaugu

SEQ ID NO: 436744 - RNA, 64 nt, Human
uuuccauuugcaacaggaagacacuggcuuuacauggguucaauuggacaauuauuuuugcucu

SEQ ID NO: 436745 - RNA, 64 nt, Human
ggcgcaaucuuaacucauugcaaccuccaccuucuggguucaagcgauucucuuuauucagccc

SEQ ID NO: 436746 - RNA, 64 nt, Human
auuacagauaaaauguaaacuguuucuuuaaaauuggguucacagcgugcuaaaauaacagauu

SEQ ID NO: 436747 - RNA, 64 nt, Human
ucaaagacugugcuacgggaguucugaacauggcuggguucaugaaggcaaauguauggaugag

SEQ ID NO: 436748 - RNA, 64 nt, Human
agucgguucuggccuaacgcaugucccaacaccuuggguucauuugcccggugaacucacuuua

SEQ ID NO: 436749 - RNA, 64 nt, Human
augcauagcuaggagaugucaaaagcccauaugaggaguggaccaagcagcaguggcgguuucu

SEQ ID NO: 436750 - RNA, 64 nt, Human
cccuuuuguuuuugggacaacgcugcuuagauauggaguggaggugauuuacugcugaauuaaa

SEQ ID NO: 436751 - RNA, 64 nt, Human
ccuaucuguaccaaagaggaguauggugggagagggaguggagugcaguguggcuugggccugg

SEQ ID NO: 436752 - RNA, 64 nt, Human
ggcaccaucuuggcucacugcaaccucugcuuccuggguucaagugauucucuugccuuagccu

SEQ ID NO: 436753 - RNA, 64 nt, Human
ggagaauuaugugagauuuccacauuauguuuacuggguucaauacuguccuugcuuguuuuau

SEQ ID NO: 436754 - RNA, 64 nt, Human
uuguacauauauacauguacauaucuguuuaguuuggguucauuucuauaacauuuuguaagaa

SEQ ID NO: 436755 - RNA, 64 nt, Human
ugcugguccgugggacggugcccaagccagaggcuggguucauuuguguaacgacaauaaacgg

SEQ ID NO: 436756 - RNA, 64 nt, Human
guauuuugaaaaugcuuuagaaagguuuugagcauggguucauccuauucuuucgaaagaagaa

SEQ ID NO: 436757 - RNA, 64 nt, Human
gacacagucuuggcucacugcaacuucugccucuuggguucaagugauucuccugccucagccu

SEQ ID NO: 436758 - RNA, 64 nt, Human
gaacagggaauugauagcugcugagcugaagcaguggguucagcuggucaucuugucaugugaa

SEQ ID NO: 436759 - RNA, 64 nt, Human
ugucgaaacuuccuuguuuuaaaaaaugaucauuuggguucacucaggaaaugcaugucaggaa

SEQ ID NO: 436760 - RNA, 64 nt, Human
aacccaauacauauuguacugcucagugauuaaauggguucacuuccucgugagcccucgguaa

SEQ ID NO: 436761 - RNA, 64 nt, Human
uccugcagugaccugccugccuauggaauggagcuggguucaucucaucacauuagauuauccc

SEQ ID NO: 436762 - RNA, 64 nt, Human
cauagguuuggagagcucuagaucucuuuugugcuggguucaguggcucuucaggggacaggaa

SEQ ID NO: 436763 - RNA, 64 nt, Human
uagaaccccuggcaguguugucagcucaaccugguggguucaguucuguccugaggcuucugcu

SEQ ID NO: 436764 - RNA, 64 nt, Human
auuggggcuccuccaugacuagugggaauuacuguggguucagaagacccuugucugguauuug

SEQ ID NO: 436765 - RNA, 64 nt, Human
augucauaaaguuuauuccuguguauacacacucuggguucaggagguuuugugcuuacauuuc

SEQ ID NO: 436766 - RNA, 64 nt, Human
ugaacuaugugccugugagcucuucagagcugguuggguucaccaccuucauaagaccugccuc

SEQ ID NO: 436767 - RNA, 64 nt, Human
agcuggugcggcugcggaauccguggggccagguggaguggaacgguucuuggagugauaggua

SEQ ID NO: 436768 - RNA, 64 nt, Human
ggagacgacucagggaucgcgggggcggggagguggaguggagaggcccgcucucacaccgggu

SEQ ID NO: 436769 - RNA, 64 nt, Human
uuuugagacugagucucauucuaucacccaggcuggaguggagugguaugaucuugacucacug

SEQ ID NO: 436770 - RNA, 64 nt, Human
ggcgugaucucagcucacugcaaccuccaccuccuggguucaagugauucuugugccucagccu

SEQ ID NO: 436771 - RNA, 64 nt, Human
caugaagccaccaguuucauuccaaaguguauauuggguucagacuugggggcagaaguucaga

SEQ ID NO: 436772 - RNA, 64 nt, Human
gugacccuuccaggguaccacugagggaagggccuggguucaagccucccggaaccuccccuuu

SEQ ID NO: 436773 - RNA, 64 nt, Human
ggcgccaucucggcucacugcaaccucugccuccuggguucacguaauccuccugaguagcugg

SEQ ID NO: 436774 - RNA, 64 nt, Human
ucuuugcaagaaagucagaccuguuucuuguaacuggguucaaaaagaaaaaaauaauaaaaau

SEQ ID NO: 436775 - RNA, 64 nt, Human
gucuaauugucuuggacauuuugggaagauauauuggguucacauucuggaguucucuuuauuu

SEQ ID NO: 436776 - RNA, 64 nt, Human
auguaguacagaaaagaauguacauuuagacauuuggguucaguugcuuguagucuguaaauuu

SEQ ID NO: 436777 - RNA, 64 nt, Human
guugggggaaguucugccuuucugaucaaucuuuuggguucacguggaaaccaggacuuggcaa

SEQ ID NO: 436778 - RNA, 64 nt, Human
ggcacguucucagcucacugcaaccuccgccucuuggguucaagcaauucugcugcaucagccu

SEQ ID NO: 436779 - RNA, 64 nt, Human
agguuauaugucuuagaaaacaaaaauacuuguuuggguucaguuuuggaucugggcuuguucu

SEQ ID NO: 436780 - RNA, 64 nt, Human
ggugugaucuuggcucacugcaaccucccccuccuggguucaagcgauucuccuccuucagacu

SEQ ID NO: 436781 - RNA, 64 nt, Human
ggugcuaucucagcucacugcaagcuccaccuccuggguucaugccauucuucugccucagccu

SEQ ID NO: 436782 - RNA, 64 nt, Human
acgacccuugagaagcugccauaucuucaggccauggguucaccagcccugaaggcaccuguca

SEQ ID NO: 436783 - RNA, 64 nt, Human
ggguugggccuguggccccccaaacuaggggguguggguucaucacaguguugccuuuugucuc

SEQ ID NO: 436784 - RNA, 64 nt, Human
ccacuugguggcacaagagguagggaggggaguauggguucauuuggcuucgcauuaugcaagg

SEQ ID NO: 436785 - RNA, 64 nt, Human
gggucacagugaauuucacauccccucucaaccaggaguggagggcuaggucccuuccccaugg

SEQ ID NO: 436786 - RNA, 64 nt, Human
uggcauuugcucugagcaucagucacggguagguggaguggagaggcugguuacagcuucaguc

SEQ ID NO: 436787 - RNA, 64 nt, Human
uauacaguguguaguuuguuucuguuguucacuuggaguggauccagcuucacugucaugugcg

SEQ ID NO: 436788 - RNA, 64 nt, Human
ggcgcgaucucggcucuaugcaaccuccaccuccuggguucaugccauucuccugccucagccu

SEQ ID NO: 436789 - RNA, 64 nt, Human
ggcgugaucucggcucacugcaaccucugccuccuggguucaagcgauucuccugccucagccu

SEQ ID NO: 436790 - RNA, 64 nt, Human
aaccuaagcuaccuuuaacaacguagaauuuagauggguucauauaugugagaaaaaccugaau

SEQ ID NO: 436791 - RNA, 64 nt, Human
uuauuauuguauuuuuuaccuuaaugaaagauuuuggguucaaauaucuuucuauauuaaaagc

SEQ ID NO: 436792 - RNA, 64 nt, Human
gacaugaucucagcucacugcaaccuccgcuuccuggguucaagcaauucucaugccucagccu

SEQ ID NO: 436793 - RNA, 64 nt, Human
uucaaaucuauuuugggucauuuuuauguaccuuuggguucaggcauuauuugggggguuuugu

SEQ ID NO: 436794 - RNA, 64 nt, Human
aagggacccugagcucugcaagcugugaucugucuggguucaugguuuuucucaaaucccaggc

SEQ ID NO: 436795 - RNA, 64 nt, Human
ucaggcacauggaacacagugcuauucaugaagguggguucaccaugccccagacgccagaagg

SEQ ID NO: 436796 - RNA, 64 nt, Human
gggaaagagagguaggagaggcugcgaggaagcuuggguucaagcgucacucaucuguacauag

SEQ ID NO: 436797 - RNA, 64 nt, Human
guuucaccauguuggccaggcuggucucgaacucuggguucaagaaauccucccaccuugccuc

SEQ ID NO: 436798 - RNA, 64 nt, Human
ggugcaaucucaguucagugcaaucuccgccuccuggguucaaaugauucuccugccucagccu

SEQ ID NO: 436799 - RNA, 64 nt, Human
uggcuccuucacagggaugguagcugaccggugauggguucauuugucaccuuggacugugagc

SEQ ID NO: 436800 - RNA, 64 nt, Human
gugguuaaaacaggggcuggcgaguugacaacuguggguucaaaucccagcucuaccacuuacu

SEQ ID NO: 436801 - RNA, 64 nt, Human
ggcacgaucucagcucacugcagccuccuccucuuggguucaagcaauucuccugccucagccu

SEQ ID NO: 436802 - RNA, 64 nt, Human
guugcgaucuuggcucacugcaaccuccaccugcuggguucaagcaauucuccugccucagccu

SEQ ID NO: 436803 - RNA, 64 nt, Human
uggccucccaaggugcuaggauuacaggcaugagccaccgcaccgggcccuccuugccuguuuu

SEQ ID NO: 436804 - RNA, 64 nt, Human
uucaaaaggcccacaugauacaauuagagaauucccaccgcacaaaaaaaguuccuaaguaugu

SEQ ID NO: 436805 - RNA, 64 nt, Human
gccagggacagguuucucccuggauacucuuggcccaccgcagaucuguagccagucagaggag

SEQ ID NO: 436806 - RNA, 64 nt, Human
uuuacaggugagagaaccaagucucacagaggccuggguucaagucccaccucugccacuaacu

SEQ ID NO: 436807 - RNA, 64 nt, Human
augggugcuuagaaaguuuauuucaggaggaaaauggguucacacaaaaagcaaacuacauucu

SEQ ID NO: 436808 - RNA, 64 nt, Human
gucacaucuauccacacugucaaacagguugguguggguucauuggcauucuuugcaauacugc

SEQ ID NO: 436809 - RNA, 64 nt, Human
ggcaugaucucagcucacugcaaccuccaccuccuggguucaagcauuucuccugccucagccu

SEQ ID NO: 436810 - RNA, 64 nt, Human
cacuaguaaaaaaaacaaagauauucaaacugcuuggguucaaaugguauacaauuugccagcu

SEQ ID NO: 436811 - RNA, 64 nt, Human
caguacaagccuugaacaucguccugcuucccaguggguucagaccucaccucucagggagcga

SEQ ID NO: 436812 - RNA, 64 nt, Human
ggugcgaucuuggcucacugcaaccugcgccuccuggguucaagcaauucuccugccucagccu

SEQ ID NO: 436813 - RNA, 64 nt, Human
gauuuagauauaugccugugacaggaauagauucuggguucagggguccccaucugucaaauga

SEQ ID NO: 436814 - RNA, 64 nt, Human
uccaagaugauaguuuuagcuagcuuaugaacauuggguucacaaggcauuggguaaguuagau

SEQ ID NO: 436815 - RNA, 64 nt, Human
gauaguggauacauuggugucagaggaccuugacuggguucauuuuauguccagacaucacccc

SEQ ID NO: 436816 - RNA, 64 nt, Human
uuuuuuacaaauaucuuauuuuuauuuaacgacuuggguucaugucccuaauauaaguaucuug

SEQ ID NO: 436817 - RNA, 64 nt, Human
augauggaacaguaauuacuuucagaauguuguguggguucaaauucucuauguacagaugaug

SEQ ID NO: 436818 - RNA, 64 nt, Human
ggcacaaucuuagcucacugcaaccucugcuuccuggguucaaacaauucucaugccucagccu

SEQ ID NO: 436819 - RNA, 64 nt, Human
ggggugaucucaucucccugcaaccuccgccuccuggguucaagcgauucuugugccucagcuu

SEQ ID NO: 436820 - RNA, 64 nt, Human
gaauugaagagugaguaggugaagguggugcugguggguucacuuuccaaggccagacuaaaac

SEQ ID NO: 436821 - RNA, 64 nt, Human
acagcacugcuccacauggugucggcucacagagccaccgcaacucugcccagcgggagugaca

SEQ ID NO: 436822 - RNA, 64 nt, Human
cuccugcugugcuggaauuccacagggaccagggccaccgcaggggacugucucagaagacuug

SEQ ID NO: 436823 - RNA, 64 nt, Human
aucgccccaacuccaaccucucggccccaucgccccaccgcagcuacuccccuuucuuccaaac

SEQ ID NO: 436824 - RNA, 64 nt, Human
gguaugaucuuggcucacugcagccucugccuccuggguucaagcgauucuccugccucugccu

SEQ ID NO: 436825 - RNA, 64 nt, Human
ggugccaucucagcuccaugcaaccucugccuccuggguucaagcaguucucuugccucagccu

SEQ ID NO: 436826 - RNA, 64 nt, Human
uaugcagcacagaacuucauucuuauaguauucuuggguucaaccuuugaaucaauuuuaccac

SEQ ID NO: 436827 - RNA, 64 nt, Human
aaauuugugacuaaacaaagacuuucauauuaaauggguucaauugaacucauuucuuauuuuc

SEQ ID NO: 436828 - RNA, 64 nt, Human
ggcaugaucuuggcucacugcaacgucugccuccuggguucaagcaauucuccugccucagccu

SEQ ID NO: 436829 - RNA, 64 nt, Human
ggugcaaucucaccucacugcaaccuccgccuccuggguucaagcaauucuccugccucagccu

SEQ ID NO: 436830 - RNA, 64 nt, Human
ugccuuucccauccuuugguucuccuuuccagucuggguucacacccugaaaagggaugggugu

SEQ ID NO: 436831 - RNA, 64 nt, Human
cuaggagacuucccugcaaaaucucuguucacccuggguucacauccccaugagguaauauuau

SEQ ID NO: 436832 - RNA, 64 nt, Human
cuguauguuagagaaaaacuuuaugaggaugaaauggguucaagaugaauuugucaacuuuugu

SEQ ID NO: 436833 - RNA, 64 nt, Human
augagaagaccugaggauuugcagcccccagcccuggguucaagucccagcucuaccccuucuu

SEQ ID NO: 436834 - RNA, 64 nt, Human
uuuuucugauucuuuuuucagucaguuuugcuccuggguucaaguaguauuaccacccuuucac

SEQ ID NO: 436835 - RNA, 64 nt, Human
ccagauuucuggaaggagaaaaaguguagguauuuggguucauuaaucugcucacuugaggacu

SEQ ID NO: 436836 - RNA, 64 nt, Human
ucucacgacucuugucucauuuguuaucccaaccuggguucacuuggcccuucucuugcucuua

SEQ ID NO: 436837 - RNA, 64 nt, Human
agcgcagucucggcucacugcaaccucuaccuccuggguucaagcaagucuccugucucagccu

SEQ ID NO: 436838 - RNA, 64 nt, Human
gaugccaucucagcucacugcaaccuccaccuccuggguucaagugauucucgugccucagccu

SEQ ID NO: 436839 - RNA, 64 nt, Human
cggccucccaaagugcugggauuacaggugugagccaccgcacccaauccuauuagguuucuuu

SEQ ID NO: 436840 - RNA, 64 nt, Human
cuuguacaaagccggcugcccagccccagccucaccaccgcaucccaccuccugcccuccauac

SEQ ID NO: 436841 - RNA, 64 nt, Human
ugggaggcaaagguugcagugaacugagauugcgccaccgcacuccagccugggcgacagagcg

SEQ ID NO: 436842 - RNA, 64 nt, Human
acuaccauaauuuauaaucauuauuuuuuacuuuuggguucaccuagaucauaugaguugaugu

SEQ ID NO: 436843 - RNA, 64 nt, Human
caugauugagugagaguauguauaaccugguggguggguucagaguaccuuuuaaucuaguaug

SEQ ID NO: 436844 - RNA, 64 nt, Human
ggcacaaucucggcucacugcaaccuccaccuccuggguucaagcgauucuucugccucagccu

SEQ ID NO: 436845 - RNA, 64 nt, Human
gaugcgaucucagcucaccacaacuucggccuccuggguucaagcgauucuccugccucagccu

SEQ ID NO: 436846 - RNA, 64 nt, Human
ggcacaaucucggcucacugcaagcuccgccuccuggguucaagcgauucuccugccucagccu

SEQ ID NO: 436847 - RNA, 64 nt, Human
ccucaggccugggcuguagcaagcugucugcccuuggguucaagaaccagacuguggagccaaa

SEQ ID NO: 436848 - RNA, 64 nt, Human
gacacaaucucagcucacugugaccuccgccuccuggguucaagagacucuccugccucagccu

SEQ ID NO: 436849 - RNA, 64 nt, Human
ggcacgaucucaggucacugcaaccucugccuccuggguucaaacgauucuccugccucagccu

SEQ ID NO: 436850 - RNA, 64 nt, Human
ggcaaauuuugagucuucuugcauauuuggcucauggguucauaaauugaggccagagacucau

SEQ ID NO: 436851 - RNA, 64 nt, Human
ggugcgaucucagcucccugcaaccuccaccuccuggguucaaacaauucuccugccucagccu

SEQ ID NO: 436852 - RNA, 64 nt, Human
cagagcccucagcagagaauuagcagucuguugguggguucaccccaacucacagcaguagaaa

SEQ ID NO: 436853 - RNA, 64 nt, Human
ccuaaagaaauagagcccuaccagggaagaucauuggguucaaaugcugaugaguaggacauuu

SEQ ID NO: 436854 - RNA, 64 nt, Human
ggcaagaucuuggcucacugcaaccuccgccuccuggguucaagcgauucuccagccucagccu

SEQ ID NO: 436855 - RNA, 64 nt, Human
cugcuuacuagguguuugucauggaagagaagcauggguucagcagugccucucuagcagcugu

SEQ ID NO: 436856 - RNA, 64 nt, Human
ggcacuaucuuggcuuacugcaaccuccaccuccuggguucaagugauucuccugccucagccu

SEQ ID NO: 436857 - RNA, 64 nt, Human
agcuggagcuaaaggaagggcaggcccacaggggccaccgcagagccgagucggggcggcaucg

SEQ ID NO: 436858 - RNA, 64 nt, Human
uucuccccucgaagggacucucuggccaccuccuccaccgcaguccagcucccucagucuggca

SEQ ID NO: 436859 - RNA, 64 nt, Human
gucagcuccugaaacgcugcaguggaacgcgcagccaccgcaccugagacgcaggcuggcuggg

SEQ ID NO: 436860 - RNA, 64 nt, Human
ggcaugaucuuggcuuacugcaaccuccgccuccuggguucaagcaauucuguggcuucagccu

SEQ ID NO: 436861 - RNA, 64 nt, Human
ucaguaucauucauucucucuccccucacugguauggguucagagcaaugccuagggccccucu

SEQ ID NO: 436862 - RNA, 64 nt, Human
ggacaggaguuuugcccaacgcagugucauaaacuggguucaugggcuuacccauugggugugc

SEQ ID NO: 436863 - RNA, 64 nt, Human
ggugcaguuuugacucacugcaaccuccgccuccuggguucaagugauucuccugccucagccu

SEQ ID NO: 436864 - RNA, 64 nt, Human
gaagcuggaaagagagagaagggccucacagugauggguucaggacgggucaaaggcaaaggcc

SEQ ID NO: 436865 - RNA, 64 nt, Human
ugaacuguuuugguuguuuuaaacucaugaaguauggguucaguggaaauguuuggaacucuga

SEQ ID NO: 436866 - RNA, 64 nt, Human
ggcgcgaucucagcucacugcaaccuccgccuccuggguucaagcaauucucuggggcagcagu

SEQ ID NO: 436867 - RNA, 64 nt, Human
guuaacugugaacauacuuguuuuuaagugguuuuggguucaaagccaauuuggagaccuagac

SEQ ID NO: 436868 - RNA, 64 nt, Human
ggcacaaucuuggcucacugcaaccucuaccuccuggguucaagugauucucuugccucagccu

SEQ ID NO: 436869 - RNA, 64 nt, Human
gucucuccagugggagggcggcagcuccugucccuggguucaggcugugcuucuggaagcaucg

SEQ ID NO: 436870 - RNA, 64 nt, Human
gggcaggggcugggcaggaggguggggucugcuguggguucagaggacuccaccuccuggcugg

SEQ ID NO: 436871 - RNA, 64 nt, Human
ggcgugaucucagcucacugcagccuccgccuccuggguucaagugauucuagugccucagccu

SEQ ID NO: 436872 - RNA, 64 nt, Human
ggcgcgaugucggcucacugcaagcuccgccuccuggguucacgccauucuccugccucagccu

SEQ ID NO: 436873 - RNA, 64 nt, Human
uacguuuuacaacaaggcuagaguuuguaaauucuggguucauuugugaugacauaagucagca

SEQ ID NO: 436874 - RNA, 64 nt, Human
gcugagcugaacccauuuugagugacucgaggguuggguucaucugagcaagagcuggcaaagg

SEQ ID NO: 436875 - RNA, 64 nt, Human
gucccucggccacccgggggucgcucccucgugcccaccgcaccugccgagccucuuuggaccc

SEQ ID NO: 436876 - RNA, 64 nt, Human
gccgguuguaagccuugcacgggacagaccacacccaccgcaaccucauccccucagcacuaac

SEQ ID NO: 436877 - RNA, 64 nt, Human
cagccucccaaguagcugggauaacaggcgcccaccaccgcacccugcuaauuuuuuguauuuu

SEQ ID NO: 436878 - RNA, 64 nt, Human
ggcucgaucuuggcucaccacaaccucugccuccuggguucaagcaauucuccugccucagccu

SEQ ID NO: 436879 - RNA, 64 nt, Human
cgcucuguuuuguauuuauguugauuuacuaaauuggguucauuaucuuuuauuuuucaauauc

SEQ ID NO: 436880 - RNA, 64 nt, Human
ugucugugcccuggagcauucugcccaggcuacguggguucaggcagguggcagcuucccaagu

SEQ ID NO: 436881 - RNA, 64 nt, Human
uugcuaauaaugauuuuuacuuuuaagucacuuuuggguucacuaguggauuaaccagaaguga

SEQ ID NO: 436882 - RNA, 64 nt, Human
ggcacaaucucggcccgcugcagccucugccucuuggguucaagugauucuuccaccucagccu

SEQ ID NO: 436883 - RNA, 64 nt, Human
agucaugguuuggcugcauaaaaauuuucuaacuuggguucaauauuuguagugaaguaucugu

SEQ ID NO: 436884 - RNA, 64 nt, Human
gguacgaucuuggcucagugcaaccuccgccuccuggguucaagcgauucucgugccucagccu

SEQ ID NO: 436885 - RNA, 64 nt, Human
ggugcuauuucagcucaccacaaccucugccuccuggguucaagugauucuccugccuuagccu

SEQ ID NO: 436886 - RNA, 64 nt, Human
uuuauuuuuuagaaaaccugaucuucucuuuuuuuggguucauuuuguucuggguuuugguuuu

SEQ ID NO: 436887 - RNA, 64 nt, Human
ugggugaagcacuucggcucuggaguuacagaucuggguucaaggccaaauuccaccacuuacu

SEQ ID NO: 436888 - RNA, 64 nt, Human
ggugugaucccagcucacugcaaccuccgccuccuggguucacaugauucuccugccucagcuu

SEQ ID NO: 436889 - RNA, 64 nt, Human
aucuuucucauauaaguuuaaccacacuuugauuuggguucauuuuuuguuuuguuuuuuucaa

SEQ ID NO: 436890 - RNA, 64 nt, Human
gucucuuaaugcauccauagaaaaguguuaauuguggguucaaagcauucucugcaaauaggca

SEQ ID NO: 436891 - RNA, 64 nt, Human
cuaggugcugaaucuacacaucuguggggucuccuggguucagcggcuguugauucaaggucaa

SEQ ID NO: 436892 - RNA, 64 nt, Human
ggcgcgaucucggcucacugcaaccucugcccccuggguucaagcgauucuccugccucagccu

SEQ ID NO: 436893 - RNA, 64 nt, Human
ggaagacugauuuuuugagaccaucccuguguuuggaguggauaauugucccuccccucagccc

SEQ ID NO: 436894 - RNA, 64 nt, Human
ccagugauuaaaccccgguuucacucuggccccaggaguggagccuggccacuccuguuugguu

SEQ ID NO: 436895 - RNA, 64 nt, Human
caagauuucagccuggaagagggcaaaguggacgggaguggacaggaguggaugcgauaagaug

SEQ ID NO: 436896 - RNA, 64 nt, Human
gaagccuggugguuuuccucucccagugaaaaaauggguucagggucuuguccuuagcuacuag

SEQ ID NO: 436897 - RNA, 64 nt, Human
aucaauguauuaauaucuccauagcugggaaacguggguucaauuugccauugguuucugaaag

SEQ ID NO: 436898 - RNA, 64 nt, Human
ggcagcugcucggcagcccagcccugggccuggguggguucauguccaaucuuguucgaucacu

SEQ ID NO: 436899 - RNA, 64 nt, Human
agcgcagucucagaucacugcaaccuccgccuccuggguucaagcaauucuucugacucagccu

SEQ ID NO: 436900 - RNA, 64 nt, Human
cccauugucacgguguguggaggaugcuggguccuggguucaagugcacaugugagggaacccc

SEQ ID NO: 436901 - RNA, 64 nt, Human
cccuaagagcacuggccugggagucagacagaccuggguucaaguccucaguccccugcccacu

SEQ ID NO: 436902 - RNA, 64 nt, Human
uuaguuauguuggucaguguuagaggaugcauuuuggguucaucuuucuugaguggaguauugg

SEQ ID NO: 436903 - RNA, 64 nt, Human
agcaugaucucggcucacugcaaccuccgccuccuggguucaagagauucuccugccucagccu

SEQ ID NO: 436904 - RNA, 64 nt, Human
agcgugaucucggcucacugcaaccuccaccuccuggguucaagcaguucuccugccucagccu

SEQ ID NO: 436905 - RNA, 64 nt, Human
ccgccagggagcgggcccaccugagucacuuuauuggguucagucaacacuuucuugcucccug

SEQ ID NO: 436906 - RNA, 64 nt, Human
ccccaaggacacugugaucaacccgagaauguucuggguucaacucaagcaucucccuugcacc

SEQ ID NO: 436907 - RNA, 64 nt, Human
agccagcgaggggggcuucugcucccugagacucuggguucacccacagcacuuucugaggaag

SEQ ID NO: 436908 - RNA, 64 nt, Human
augaaacuuuccaaaacaaagugccaggaccagcuggguucacugauguguuuuugagauacuu

SEQ ID NO: 436909 - RNA, 64 nt, Human
ggaggaggaacagagaagccugggcugcugggacuggguucauucucaugacuuggggcugucg

SEQ ID NO: 436910 - RNA, 64 nt, Human
gggcacuccuccucaccccuccuugcuguccauauggguucaaugugaguaaccacaauuguag

SEQ ID NO: 436911 - RNA, 63 nt, Human
ggaaggcacgggggcacugagggcgcagccccuccaccgcagcccugcugcuucugaggacuu

SEQ ID NO: 436912 - RNA, 64 nt, Human
ugaccucccaaagugcuaggauaacaggugugagccaccgcacccugccaaguuauuuuaaaau

SEQ ID NO: 436913 - RNA, 64 nt, Human
cggccucccaaagugcugggauuacaggcgugagccaccgcaccuggcccuccuuuuucaucua

SEQ ID NO: 436914 - RNA, 64 nt, Human
uugucucaacccucucccuaaaaugacugagcccuggguucaucuaaugugguuuuccuuagga

SEQ ID NO: 436915 - RNA, 64 nt, Human
ggcaugaucucagcucacugcaaccuccacccacuggguucaagcgauucuucugccucagccu

SEQ ID NO: 436916 - RNA, 64 nt, Human
cccccaccgcccucuaagaacaucugccaacagcuggguucagacuucacacugugaguucaga

SEQ ID NO: 436917 - RNA, 64 nt, Human
agagaagauuacagucuuuacagucaagaagacuuggguucauauccuaacccuggaacuuacu

SEQ ID NO: 436918 - RNA, 64 nt, Human
ggcucgaucucugcucacugcaagcuccgccuccuggguucaugccauucuccugccucagccu

SEQ ID NO: 436919 - RNA, 64 nt, Human
aaagagcauaggcagacuuaaaguuggauagaccuggguucaaaucauaguucagcuuucaaua

SEQ ID NO: 436920 - RNA, 64 nt, Human
uagcuuucuagacuucuuaacagaaaaaacaguuuggguucaauagcauuuuaugauucuacaa

SEQ ID NO: 436921 - RNA, 64 nt, Human
ggugcgaucuuggcucacugcaaccucugccuccuggguucaagugauucucuugccucagucu

SEQ ID NO: 436922 - RNA, 64 nt, Human
acugggccaauucaauacaaacaaucucuuaaauuggguucaugaugcagucuccucuuuaaaa

SEQ ID NO: 436923 - RNA, 64 nt, Human
ucuucuuuuugacgugcagaaucucaguggcaucuggguucaccuccccacucugaugaucucc

SEQ ID NO: 436924 - RNA, 64 nt, Human
ggcgugaucucagcucacuacagccuccaccucguggguucaaacaguugugcugccucagcuu

SEQ ID NO: 436925 - RNA, 64 nt, Human
uguuccuuucacacuuuccuuuguugcaugcaguuggguucaaaugccaaauagugauuagaag

SEQ ID NO: 436926 - RNA, 64 nt, Human
agggacuccgagaccuccgguccgagacccugccuggguucaccccccacaacccagacccaga

SEQ ID NO: 436927 - RNA, 64 nt, Human
gacgcaaucucggcucacugcaaccuccgccuccuggguucaagcgauucuccagccucagccu

SEQ ID NO: 436928 - RNA, 64 nt, Human
cucuuucuccaugcaggucuguccacguucucuguggguucauugccggacuugagucugaguu

SEQ ID NO: 436929 - RNA, 64 nt, Human
gacagcaggagccccgccuggcccgaagccguuuccaccgcagcaggcagaggggcuggacagg

SEQ ID NO: 436930 - RNA, 64 nt, Human
cggccucccaaagugcuggaaucacaggggugagccaccgcacccagcccucucucuuccucaa

SEQ ID NO: 436931 - RNA, 64 nt, Human
gcagcucgguuucccgcggacuuggcugcugcucccaccgcaguaccgccuccuggaacggaag

SEQ ID NO: 436932 - RNA, 64 nt, Human
ggcacaaucuuggcucacugcaaccuccaccuccuggguucaaacgauucugcugccucagccu

SEQ ID NO: 436933 - RNA, 64 nt, Human
cuggccggcccaggccuccacgggggcggcaggcuggguucauuccccggcccuccgagccgcg

SEQ ID NO: 436934 - RNA, 64 nt, Human
ggcacgaucucagcucacugcaaccuacgccuucuggguucacgugauucucuugccuuagccu

SEQ ID NO: 436935 - RNA, 64 nt, Human
ggcgcgaucucggcucacugcaagcucugucuccuggguucaugccauucuccugcuucagccu

SEQ ID NO: 436936 - RNA, 64 nt, Human
ggugcaaucucagcucacugcaaucuccaccuccuggguucaagagguucuccugccucagccu

SEQ ID NO: 436937 - RNA, 64 nt, Human
ggcaugaucucgacucacugcagccuccgccuccuggguucaagugguucuccugccucagccu

SEQ ID NO: 436938 - RNA, 64 nt, Human
ggcgcaaucucggcucacugcaaccucugccuccuggguucaagcgaaccuccugccucagcau

SEQ ID NO: 436939 - RNA, 64 nt, Human
acucguaaagcugcuagggccccuagaaaccaccuggguucagccucucccacaauaagaguuc

SEQ ID NO: 436940 - RNA, 64 nt, Human
aguguuagacaacaagugaugaaaacaucucaauuggguucagaucacgaaaacacggaagaag

SEQ ID NO: 436941 - RNA, 64 nt, Human
gccaugaucucaggucgcuguaaccuccgucuccuggguucaagugauucuccagccucagccu

SEQ ID NO: 436942 - RNA, 64 nt, Human
acuaaagaauaaggccuuuagaaucugacacaucuggguucaaauucugaaacugucacuuauu

SEQ ID NO: 436943 - RNA, 64 nt, Human
ggugcugguuccaugccugcucucgaggcagcaguggguucaggcccaucagcuaccccugcag

SEQ ID NO: 436944 - RNA, 64 nt, Human
acuucaugcugggacaagcagcccaucaacgccauggguucaggcugauccaggagaugcucac

SEQ ID NO: 436945 - RNA, 64 nt, Human
ccaugacuccuccagaauuuuaguagauacaggguggguucauuaagagugauaaaagugggaa

SEQ ID NO: 436946 - RNA, 64 nt, Human
ggggcaaucuuggcucccugcaaccucugcuuccuggguucaggugauugucaguaccuuaccu

SEQ ID NO: 436947 - RNA, 64 nt, Human
aguaucugaccgaccuacgccacuggaaacacacccaccgcaaccucaagaaccagacugugca

SEQ ID NO: 436948 - RNA, 64 nt, Human
ugaggguuuguuggucacagugggagagguuucaccaccgcauucugaccuccuccucccaaaa

SEQ ID NO: 436949 - RNA, 64 nt, Human
cagccucccaaagugcugggauuacaggcaugagccaccgcacccagccugguuauuggauuua

SEQ ID NO: 436950 - RNA, 64 nt, Human
ggugcagucacggcucacugcauccucaaccuccuggguucagauuauccuuccuccucacccu

SEQ ID NO: 436951 - RNA, 64 nt, Human
ucugguacuuaaaauucuguccaaauguagaccauggguucaucuggaguuccuuguccguggg

SEQ ID NO: 436952 - RNA, 64 nt, Human
ggcaugaucucagcucacugcaaccuccgccuccuggguucaagcaagucuccugccucagccu

SEQ ID NO: 436953 - RNA, 64 nt, Human
ucuaacagaaaugggguuaugauuuugaaggcuguggguucagggagucuuugccaauccuguu

SEQ ID NO: 436954 - RNA, 64 nt, Human
ggcaugaucuuggcucacugcaugcucugccacuuggguucaagcgauucuccugccucagccu

SEQ ID NO: 436955 - RNA, 64 nt, Human
ugcugacagcuugggagcugcugugcccaggacguggguucagcgugggcgaggaaagccuggc

SEQ ID NO: 436956 - RNA, 64 nt, Human
gacuugcuguuuuguucugugguuuuccccucccuggguucagaaaugcugccugccugucugu

SEQ ID NO: 436957 - RNA, 64 nt, Human
ggcacgaucucggcucacugcaggcucugccuccuggguucacgccauucuccugccucagcuu

SEQ ID NO: 436958 - RNA, 64 nt, Human
gcaguuaaacccguggauuuuguaguuaggaaccuggguucaaacccucuuccacuaauuggcu

SEQ ID NO: 436959 - RNA, 64 nt, Human
ugcaguggcgcgaucucggcacaccuccgccuucuggguucaagcaauucuccugccucagccu

SEQ ID NO: 436960 - RNA, 58 nt, Human
ccaauuucacacaguacuaacgaagagguggguucagcuucuaucaaacaucuccaaa

SEQ ID NO: 436961 - RNA, 64 nt, Human
ggcgccaucucagcucacugcaacguccaccuccuggguucaagcgauucuccugccucagcau

SEQ ID NO: 436962 - RNA, 64 nt, Human
ggcgcaauuucggcucacugcaaccuccaccuccuggguucaagcaauucuccugccucagccu

SEQ ID NO: 436963 - RNA, 64 nt, Human
agauagcaaagcaaucuauaaacacuggaaacgcuggguucagaaaaguguuacaagaguuuua

SEQ ID NO: 436964 - RNA, 64 nt, Human
ggcaugaucucagcucacugcaaucucugccuccuggguucaagugauuccccugccuuagccu

SEQ ID NO: 436965 - RNA, 64 nt, Human
gagagggcggcaaugacacugcaccucuccuuucccaccgcauucccuggagcucccuaaauaa

SEQ ID NO: 436966 - RNA, 64 nt, Human
cagccucccaaaguguuaggauuaggggcaugagccaccgcacccagcuugcauugaauauuuu

SEQ ID NO: 436967 - RNA, 64 nt, Human
cagccuccaaaguugcuaggaccauagccaggugccaccgcaccgggcaaauuuuuguguuccu

SEQ ID NO: 436968 - RNA, 64 nt, Human
auacuuguauaacuuuguaaauaaguuuuuuuucuggguucauauauauauauauauauacaua

SEQ ID NO: 436969 - RNA, 64 nt, Human
ggugugaucucggcucacugcaaccucugccucuuggguucaagcaauucucaugccucggccu

SEQ ID NO: 436970 - RNA, 64 nt, Human
agcuguugagagcauggagccaggcugcggggucuggguucaaauccugacucuaccacuuagg

SEQ ID NO: 436971 - RNA, 64 nt, Human
caguggcuagugguggguacucaauguguacuuuuggguucacagaagcacagcacccauggga

SEQ ID NO: 436972 - RNA, 64 nt, Human
ggcacaaucucagcucacugcaagcuccgccuccuggguucacgccauucucccaccucagcuu

SEQ ID NO: 436973 - RNA, 64 nt, Human
ggcaugaucucggcucacugcaaccucuaccuccuggguucaagggauucuccugccucagccu

SEQ ID NO: 436974 - RNA, 64 nt, Human
gacacgaucuuggcucacugcaaccuccgucuccuggguucaagugauucuucugccucagccu

SEQ ID NO: 436975 - RNA, 64 nt, Human
uccagcacaguggcaugaucucagcuccgccuccuggguucacgugauucucaugccucagccu

SEQ ID NO: 436976 - RNA, 64 nt, Human
auagcuuucauuuucucauaggcuuuauaagagauggguucagugguaugagcagaggaagaga

SEQ ID NO: 436977 - RNA, 64 nt, Human
ggcgcgaucucggcucaccacaaucgcugccuccuggguucaagcaauucuccugccucagccu

SEQ ID NO: 436978 - RNA, 64 nt, Human
ggcauaaucauaccucauugcagccucagacuccuggguucaagcaauccuccugccucagccu

SEQ ID NO: 436979 - RNA, 64 nt, Human
agugacgacaucacagcucacugcagccucaaccuggguucaagugauccucucaccucagccu

SEQ ID NO: 436980 - RNA, 64 nt, Human
agugacaaccaaaagucuucaucaaacguuccccuggguucacagaucuuucugccuuuggcuu

SEQ ID NO: 436981 - RNA, 64 nt, Human
ggaagcuguugucuaggccuuccccuugugaaucuggguucauuccaauacggcaaguaagagu

SEQ ID NO: 436982 - RNA, 64 nt, Human
ggcgggaucucagcucaccgcaaccuccaccuccuggguucaagugauuuuccugccucagccu

SEQ ID NO: 436983 - RNA, 64 nt, Human
aguagggaaggaacaggacugcaaaaauccuucuccaccgcacagacugggaaccccuccuggc

SEQ ID NO: 436984 - RNA, 64 nt, Human
cagccagcagcuccagcucagagcagugccagccccaccgcaacugcacggcccugggccuggc

SEQ ID NO: 436985 - RNA, 64 nt, Human
gcagugugucuccccuggccucgccuucugcaaaccaccgcagccaccacagcgucagggugga

SEQ ID NO: 436986 - RNA, 64 nt, Human
ggcacgaucucggcucaccgcaaccuccgcccccuggguucaagcaauucuccugccucagccu

SEQ ID NO: 436987 - RNA, 64 nt, Human
cacgaucucggcucucaccgcaaccuccgucuccuggguucaagcgauucuccugccucagccu

SEQ ID NO: 436988 - RNA, 64 nt, Human
uaaauagguuguauauaaugucagguuugggucuuggguucaaguguauauauuccuguaaguu

SEQ ID NO: 436989 - RNA, 64 nt, Human
cguauuuaucucugaugugcugcuggcugaacuuuggguucauuuggggucaaagccaguuuuu

SEQ ID NO: 436990 - RNA, 64 nt, Human
ggugcaaucacagcucacugcagccucaaccuccuggguucaagcaauccuccuaccucagccu

SEQ ID NO: 436991 - RNA, 64 nt, Human
agcacgaucuuggcuaacugcaaccuccagcuccuggguucaggugauucuccugccucagccu

SEQ ID NO: 436992 - RNA, 64 nt, Human
ggcaugaucucagcucacugcaaccuucgccuccuggguucaagcgauucuccugccuccgccu

SEQ ID NO: 436993 - RNA, 64 nt, Human
ggcaccaucuccacuuaccacaacuugugccuccuggguucaagcgauucugcugccucagccu

SEQ ID NO: 436994 - RNA, 64 nt, Human
uuggcaacucagcugcugcugcuuccauguguucuggguucagaggucauggcugcaccgguca

SEQ ID NO: 436995 - RNA, 64 nt, Human
ggcaugaucuuggcucacugcaagcuccaccuccuggguucaagcgauucucuugccucagccu

SEQ ID NO: 436996 - RNA, 64 nt, Human
ggcgugaucucugcucacugcaagcuccgccaucuggguucaagcgauucuccugccucauucu

SEQ ID NO: 436997 - RNA, 64 nt, Human
ggugcgaucucggcucacugcaagcucugccuccuggguucaagugauucuccugccucagccu

SEQ ID NO: 436998 - RNA, 64 nt, Human
auaucagauaaauuaccuuagcuuuuauguagaauggguucaaaagugaguguuucuauuugag

SEQ ID NO: 436999 - RNA, 64 nt, Human
ucaaauagugcguagacuuuucccuacuuaccauuggguucaauugauguagacuguuagagca

SEQ ID NO: 437000 - RNA, 64 nt, Human
ggcacgaucucagcucauugcagccuccgccaccuggguucaagcaauucuccuaccucagcuu

SEQ ID NO: 437001 - RNA, 64 nt, Human
agcggcugcccgaggaggagcucuaggccgacgcccaccgcaggccuuacagucuucucuggac

SEQ ID NO: 437002 - RNA, 64 nt, Human
ccaucccacccaggcccccagcuccccgcgggggccaccgcagggccugugggcugggucacgu

SEQ ID NO: 437003 - RNA, 64 nt, Human
guggcaugaaguagacgccaccuggaugccccauccaccgcaugcggugcccguggcccgcccc

SEQ ID NO: 437004 - RNA, 64 nt, Human
cugaagaaccaggaugggacggggcuggaacagcuggguucagcuuuugcaggguggguacgug

SEQ ID NO: 437005 - RNA, 64 nt, Human
cagugauugucaguugauaucucugaguaacauuuggguucaguaacuacaguuuucaccauuu

SEQ ID NO: 437006 - RNA, 64 nt, Human
ggcacaaucucagcucacugcaagcuccgccuccuggguucacgccauucucccaccucagccu

SEQ ID NO: 437007 - RNA, 64 nt, Human
uaauuuccuauaagcuguaauaguggagguauuguggguucauuugaguaagcccuccaaagau

SEQ ID NO: 437008 - RNA, 64 nt, Human
uauauaucaaauuucuaaaagguaaagaauguuguggguucaugcagucacaggaaugacaauc

SEQ ID NO: 437009 - RNA, 64 nt, Human
ggugcgaucuuggcucacugcaaccuccaccuccuggguucaagcgcuucuccagccucagccu

SEQ ID NO: 437010 - RNA, 64 nt, Human
cuccuuagucuucucauagcauuaacuaaucuauuggguucauuauuggaauuaaccuggugcu

SEQ ID NO: 437011 - RNA, 64 nt, Human
ggugggaucucggcucacugcaaccuccgccuccuggguucaagugauucuccugccacagccu

SEQ ID NO: 437012 - RNA, 64 nt, Human
auauaccuuggguuugugcauguuuucugcuggguggguucagagggcaauuucucuuuuaugu

SEQ ID NO: 437013 - RNA, 64 nt, Human
cacacgaucucggcucaccgcaaccucugccuccuggguucaagcgauucuccugccucagcau

SEQ ID NO: 437014 - RNA, 64 nt, Human
aaaacaggugugagaauugugugugugaaaaagcuggguucaaauaaguugguuuguuagacau

SEQ ID NO: 437015 - RNA, 64 nt, Human
ggugugaucauagcucacugcauccuccaguuccuggguucaagccaucccuccugccucagcc

SEQ ID NO: 437016 - RNA, 64 nt, Human
ggcacgaucuuggcucacugcaagcucugccuccuggguucacgccauucuccugccucagccu

SEQ ID NO: 437017 - RNA, 64 nt, Human
uagaccucaaccaggucaucuccccguugccaaguggguucagggugagggcaauuuguaagcu

SEQ ID NO: 437018 - RNA, 64 nt, Human
ggcacuaucucagcucgcugcaaccuucaccuccuggguucaagcaauucuccugccucagccu

SEQ ID NO: 437019 - RNA, 64 nt, Human
gccuggaagagggcaaaguggacgggaguggacaggaguggaugcgauaagaugugguuugaag

SEQ ID NO: 437020 - RNA, 64 nt, Human; identical to SEQ ID NO: 436895

SEQ ID NO: 437021 - RNA, 64 nt, Human; identical to SEQ ID NO: 437019

SEQ ID NO: 437022 - RNA, 64 nt, Human
ugccuaggggaaagggagaagugagagggacaauuggguucauuuaugcccuauacaaagggca

SEQ ID NO: 437023 - RNA, 64 nt, Human
gaggugacagcuugucacaguagccaggcuuggguggguucagcacuagcucgggacggugugu

SEQ ID NO: 437024 - RNA, 64 nt, Human
ccuuagguuuaaaaagucagguuguccaucccauuggguucacugagugaaggcacauaaagca

SEQ ID NO: 437025 - RNA, 64 nt, Human
caugacaccauggagaucggggcccucuucccaguggguucacuccuuuucacaccugcugggu

SEQ ID NO: 437026 - RNA, 64 nt, Human
gggauguucuggcagcugugucauaaaaugcugcuggguucauucauucauuccauaagaaacu

SEQ ID NO: 437027 - RNA, 64 nt, Human
gcaguggcgcaaucucacugcaagcuccacuuccuggguucaugccauuuuccugccucagccu

SEQ ID NO: 437028 - RNA, 64 nt, Human
ggcgugaucuuggcucacugcaaccucugccuccuggguucaagcaauucucccaccucagccu

SEQ ID NO: 437029 - RNA, 64 nt, Human
ggcacaaucuuggcucacugcaaccuccgccuccuggguucaggcaauuuuccugccucagccu

SEQ ID NO: 437030 - RNA, 64 nt, Human
uucuuagcgucguugucacugcuucuguggcuuuuggguucaaaguagauuauauauauuccua

SEQ ID NO: 437031 - RNA, 64 nt, Human
uacucagaagaaucugugaacaaauacuugaaaauggguucaauguagacugccauuaugugug

SEQ ID NO: 437032 - RNA, 64 nt, Human
acgagagacaauacuauuucccacaggaguccauuggguucagcuuugaaagaggaauagaauc

SEQ ID NO: 437033 - RNA, 64 nt, Human
uacuugaggagggacccaacuuuccgcuaucuuuuggguucauuccaaauaguuuugugccauu

SEQ ID NO: 437034 - RNA, 64 nt, Human
guuucauuggauugugccaguuaucaguggcucuuggguucaaaguaauaaagaauuccaaaac

SEQ ID NO: 437035 - RNA, 64 nt, Human
aacuaaauuucauuauugggcaggaaggaggucauggguucauuucauuuuuguuuuuuguguu

SEQ ID NO: 437036 - RNA, 64 nt, Human
cugugcucugaagcuaggacagcuggcugagaaguggguucaggcgaagggugaagccaugugu

SEQ ID NO: 437037 - RNA, 64 nt, Human
caggagguggagguugcagugagccaagaucgcaccaccgcaugagagagagagauuacuauuu

SEQ ID NO: 437038 - RNA, 64 nt, Human
uggucucccaaagugcugggaauacaggcaugagccaccgcacucggccaggagcuaguuuuac

SEQ ID NO: 437039 - RNA, 64 nt, Human
acucacuggaugcacccaggccggcccgagccucccaccgcagacaguguggaacagagugagc

SEQ ID NO: 437040 - RNA, 64 nt, Human
aaagacggcuucagcaccauccugcaccugcugcuggguucaccccacccugcugccacagcuu

SEQ ID NO: 437041 - RNA, 64 nt, Human
ggcgugaccucugcucacuguaaccucugccuccuggguucaagugauucuucugccucagccu

SEQ ID NO: 437042 - RNA, 64 nt, Human
uacaaacgaagaguuuaagccagcaugauccagauggguucagcagucuggucagugagaaagg

SEQ ID NO: 437043 - RNA, 64 nt, Human
ggcaugaucucggcuuauugcaaccuccgcuuccuggguucaaacaauucuccugccucagccu

SEQ ID NO: 437044 - RNA, 64 nt, Human
ggugcgaucuuggcucacugcaaccucugccuccuggguucaagcaguucuccugccucagccu

SEQ ID NO: 437045 - RNA, 64 nt, Human
uuuuauaaucuuacacucacuucuugucuuuuuguggguucaagagcccucugacuugugaaga

SEQ ID NO: 437046 - RNA, 64 nt, Human
gacacgaucucagcucacugcaaccucugucuccuggguucaggugauucuccucccuagucuc

SEQ ID NO: 437047 - RNA, 64 nt, Human
ggggaggacauugccuagagggggagggacugucuggguucaggggcauggccuggagggcugg

SEQ ID NO: 437048 - RNA, 64 nt, Human
ccucucccagacuaugucaucuuguucuccugccuggguucaaacucugcauccuucucuaaca

SEQ ID NO: 437049 - RNA, 64 nt, Human
gauuccuucuaacugaaggugcaguugaauucaguggguucagaaccaagaugccaacaucggu

SEQ ID NO: 437050 - RNA, 64 nt, Human
acuguugcccaggcuggcgugcaguggugcgaucuggguucacugcaaccuccgccucuugggu

SEQ ID NO: 437051 - RNA, 64 nt, Human
ggugcgaucuggguucacugcaaccuccgccucuuggguucaagcgauucuucugcuucagccu

SEQ ID NO: 437052 - RNA, 64 nt, Human
ggcacgaucgcggcucacugcagccuccauccucuggguucaagcaauucuccugccucaggcu

SEQ ID NO: 437053 - RNA, 64 nt, Human
ggcaugauuucggcucacugcaaccucugucuccuggguucaaacgauccuacugccucauccu

SEQ ID NO: 437054 - RNA, 64 nt, Human
gacaugaucuuagcucacugcaaccuccgccuccuggguucaagugauucuccugccucagccu

SEQ ID NO: 437055 - RNA, 64 nt, Human
cgggaggcagagguugcacugagcugagauuaagccaccgcacuccagccugggcgacagagca

SEQ ID NO: 437056 - RNA, 64 nt, Human
uguguggagagggaggcggcccgcagcagaacagccaccgcacuuccuccucagcuuccucugg

SEQ ID NO: 437057 - RNA, 64 nt, Human
ugacgcugguagaggccauccagacggugcaggcccaccgcaauaucugcccuaacucaggcuu

SEQ ID NO: 437058 - RNA, 64 nt, Human
ggugugaucauagcucacugcacccucaaccuccuggguucaagcaauccuccugccucagccu

SEQ ID NO: 437059 - RNA, 64 nt, Human
cuggggcccgugcccccaccaggccagccccugcuggguucagaggccgaggaggcacuggagg

SEQ ID NO: 437060 - RNA, 64 nt, Human
gguguggucuuggcuuauugaagccucugccuccuggguucaagugauucucuugccucagccu

SEQ ID NO: 437061 - RNA, 64 nt, Human
ggcgugaucucggcucacuacaaccucgaccuccuggguucaagcgauucucccaccccagccu

SEQ ID NO: 437062 - RNA, 64 nt, Human
auaaagauugaaggaagcauggucauaguugcccuggguucagagcauaaugcauaugugaagc

SEQ ID NO: 437063 - RNA, 64 nt, Human
gccaagaggugaggcuuacuauucacuaugaaaauggguucaccaucucaagggaaaauggagg

SEQ ID NO: 437064 - RNA, 64 nt, Human
uuauauacacuguuuccuggccccagagcucauuuggguucaggcgcacuucaaaacccucccu

SEQ ID NO: 437065 - RNA, 64 nt, Human
augccaguuugacaagcacugcccagaccaaccauggguucaaacuccagcccugcccuuuggu

SEQ ID NO: 437066 - RNA, 64 nt, Human
aaagaggauauucuaggcuuugcgugcugcuagcuggguucaggcuucacccacuggaaagaac

SEQ ID NO: 437067 - RNA, 64 nt, Human
cccugggugggcguccccuggcuggccuggcuuuuggguucaagucuguauguauggagugggu

SEQ ID NO: 437068 - RNA, 64 nt, Human
ggugcaaucuuggcucacugcaaccucugccuccuggguucaauccauucuccugccucagccu

SEQ ID NO: 437069 - RNA, 64 nt, Human
ggcgcgaucucggcucacugcaaccuccaccuccuggguucaagcgauucucuugccucaaccu

SEQ ID NO: 437070 - RNA, 64 nt, Human
ggcgcgaucucggcucacugcaagcuccaccuccuggguucaugccauuuuccugcuucagccu

SEQ ID NO: 437071 - RNA, 64 nt, Human
uccucuuggugucugguuucuguccccggggcauuggguucaaggaauccauccugcaaaggcc

SEQ ID NO: 437072 - RNA, 64 nt, Human
ggcgugaucucggcccacugcaaccucugccuccuggguucaagcaauuuuccugccucagccu

SEQ ID NO: 437073 - RNA, 64 nt, Human
cucgucucccucgacagcgccccugcugucuuccccaccgcagucaccaccacccgaaaugcca

SEQ ID NO: 437074 - RNA, 64 nt, Human
uugcuccgugagcaaagccugggugcccaagcagccaccgcagcagcagaguacaaccugcaga

SEQ ID NO: 437075 - RNA, 64 nt, Human
cacagcccacguccugucagugccgccgccucgcccaccgcaugcccccucgugccagucgcgc

SEQ ID NO: 437076 - RNA, 64 nt, Human
uuucuuuuauauuagccuuaaaaaccaaaaaugcuggguucaaaguccuuagaauucccuuccu

SEQ ID NO: 437077 - RNA, 64 nt, Human
cagagcaggaauaucccauugcccccuccuccacuggguucagaggguaagaaagcacccucca

SEQ ID NO: 437078 - RNA, 64 nt, Human
gagugcaguggcacgaucugcaaacuccgccuccuggguucaagugauucuucugccucagccu

SEQ ID NO: 437079 - RNA, 64 nt, Human
aguggaaugccugguuugggggaggaggagggacuggguucagcuguggugcuuuguuguaaaa

SEQ ID NO: 437080 - RNA, 64 nt, Human
agccacagaaggucucagaucagcaucuauucuuuggguucaauaagggguucauaucuuuuuu

SEQ ID NO: 437081 - RNA, 64 nt, Human
ucucaguggauuauccggaauaacaucugaaagauggguucaucuauguuuguguuugcucuuu

SEQ ID NO: 437082 - RNA, 64 nt, Human
gcauccugucccaagcuacuguuugguggggaucuggguucaucucacccacagagggaggauc

SEQ ID NO: 437083 - RNA, 64 nt, Human
aguaguccccccuuauccacggugucacuuuccauggguucaguuaucugcggucaaccacggu

SEQ ID NO: 437084 - RNA, 64 nt, Human
caaaugggaguaauaauaauaauccuuauaaaauuggguucauaaaguuuagagaaaaggaaug

SEQ ID NO: 437085 - RNA, 64 nt, Human
ggcacgaucuuggcucacugcaaccucugccuccuggguucaagcaauucuccugccucagccu

SEQ ID NO: 437086 - RNA, 64 nt, Human
gaggcucaaccuaaggaacccuggccaugguggguggguucaccuugggcugaccacccacugg

SEQ ID NO: 437087 - RNA, 64 nt, Human
uaauuaaaaaugaaacaaagugagugcucgucacuggguucaucagagcagugugugaaauucc

SEQ ID NO: 437088 - RNA, 64 nt, Human
ggcucuccagcaaccaaaguacaacacuccaagauggguucaucuuuucuuccuuucccauuca

SEQ ID NO: 437089 - RNA, 64 nt, Human
ggugcaguuauagcacacuacagccuccaacucuuggguucaagcaacccugccucagcuaacc

SEQ ID NO: 437090 - RNA, 64 nt, Human
aaauaagccgcuuuguuuuuuaaauaugcaggcauggguucagcuuaauuccauaauucccuuc

SEQ ID NO: 437091 - RNA, 64 nt, Human
uacacagcagccuuacuucaucggcccacagacaccaccgcaguuucuucuuaaaggcucugcu

SEQ ID NO: 437092 - RNA, 64 nt, Human
ugacaggcacaacuccccgggcagaaaacgugccccaccgcaucccuaccuggaaacugaccag

SEQ ID NO: 437093 - RNA, 58 nt, Human; identical to SEQ ID NO: 361981

SEQ ID NO: 437094 - RNA, 64 nt, Human
cccaaagccuuauacuuuuugcauuggcuuuaauuggguucagcagaugccuccucugcccccc

SEQ ID NO: 437095 - RNA, 64 nt, Human
acucuggcgccuggucacugugcccuucaccuucuggguucaagugauucuccugccucagccu

SEQ ID NO: 437096 - RNA, 64 nt, Human
ggugugaucucaccucacugcagcuuccgccuccuggguucaagugauucucauggcucagccg

SEQ ID NO: 437097 - RNA, 64 nt, Human
agcaugaucagggaucacugcaaccucugccuccuggguucaagcgauucuugugccuaagcca

SEQ ID NO: 437098 - RNA, 64 nt, Human
cucauaaacugaucacgauuauaaauuaaauguuuggguucauaccccaaaagcaauauguugu

SEQ ID NO: 437099 - RNA, 64 nt, Human
cuccuccacucuccauccccuuucccuuccacuuuggguucacuuugaauuuucuccguuuuuu

SEQ ID NO: 437100 - RNA, 55 nt, Human
gcaugugggaaagccuuuaaugcucuggguucaugucagauacauuaaaauacuc

SEQ ID NO: 437101 - RNA, 64 nt, Human
ggcgugaucucggcucacugcaagcucggccuccuggguucaaaugauucuccugccucagccu

SEQ ID NO: 437102 - RNA, 64 nt, Human
aaaucagaacacaagauuggaacuuuuggaaaaauggguucaagcuuuccuauuagccauggaa

SEQ ID NO: 437103 - RNA, 64 nt, Human
ggugccaucucuguccacugcaaccuccacauccuggguucaagugauucuccugccucagccu

SEQ ID NO: 437104 - RNA, 64 nt, Human
aaaaaaaaaaaaaaagaaaagaaaaagaaaugaauggguucaaagaccauaaucaugcauauca

SEQ ID NO: 437105 - RNA, 64 nt, Human
cugggcgcugucuugugucuccuacccugaucccuggguucaacucugcucccagagcaugaag

SEQ ID NO: 437106 - RNA, 64 nt, Human
ggugcgaucuugacucacagcaaccuccgccuccuggguucaagcgauuccucugccucagccu

SEQ ID NO: 437107 - RNA, 64 nt, Human
ggugcgaucucgacucacugcaacccccgccuccuggguucaagcgauucuccugccccagccu

SEQ ID NO: 437108 - RNA, 64 nt, Human
gugcaguggagcaaucucggcucauugaaccucuuggguucaagugauucuugugccucagccu

SEQ ID NO: 437109 - RNA, 64 nt, Human
ugugugugcgcgacauggggaaagaggguggcucccaccgcaaggagacagaaggugaagacau

SEQ ID NO: 437110 - RNA, 64 nt, Human
cggaguacacagugacccaggagucugggccagcccaccgcaaagaauucaccaugaccugucg

SEQ ID NO: 437111 - RNA, 64 nt, Human
augucccgggucccccccagccugcucuagcugcccaccgcacccugaucucucuucucuaugc

SEQ ID NO: 437112 - RNA, 64 nt, Human
ggcgcgaucuuggcucacugcagccuccaccuccuggguucaagcgauucuccugccucagccu

SEQ ID NO: 437113 - RNA, 64 nt, Human
gagaaauugaauaauauaguucuauuucaacauguggguucacagauuuauucuaaccuuccaa

SEQ ID NO: 437114 - RNA, 64 nt, Human
ggcacgaucuuggcucacugcaaccuccgccuccuggguucaagcgauucuccugccucagccu

SEQ ID NO: 437115 - RNA, 64 nt, Human
ccuggcccugcugcccagugagggcuccuacggguggguucauuggccugggcccagcgagccc

SEQ ID NO: 437116 - RNA, 64 nt, Human
ggcacaaucucggcucacugcauccuccaccuccuggguucaagugauucuccugcuucagccu

SEQ ID NO: 437117 - RNA, 64 nt, Human
ggcacaaucucagcucacagcaaccucugccuccuggguucaagcgauucuccugccucagccu

SEQ ID NO: 437118 - RNA, 64 nt, Human
ggcgcgaucucagcucacugcaagcuccgccuccuggguucacgccauucuccugccucagccu

SEQ ID NO: 437119 - RNA, 64 nt, Human
gugcaguggugugauccuggcucacuguaaccucuggguucaagcaauucuucugccucagccu

SEQ ID NO: 437120 - RNA, 64 nt, Human
gcugcggucucagcucacugcaaccuccgccuccuggguucaagugauucuccugccucagccu

SEQ ID NO: 437121 - RNA, 64 nt, Human
ggcacaaucucagcucgcugcaaccucugccuccuggguucaagcaauucuccugccucagccu

SEQ ID NO: 437122 - RNA, 64 nt, Human
ggcacgaucucggcucacuguaaccuccaccuccuggguucacgcaauucuccugccucagccu

SEQ ID NO: 437123 - RNA, 64 nt, Human
ggcacgaucucaacucacugcaagcuccgccuccuggguucacaccauucuccugccucagccu

SEQ ID NO: 437124 - RNA, 64 nt, Human
aguguuuaucaaacugaagguugcagcuuguuaguggguucagaaaucaguuucuggcuagcaa

SEQ ID NO: 437125 - RNA, 64 nt, Human
gaugcaaucuuggcucacugcaaccuccgccuccuggguucaagugauucucgugcuucagccu

SEQ ID NO: 437126 - RNA, 64 nt, Human
gacaggaucagcccucacugaagcuucaaucuccuggguucaagggauccucccaccucagccu

SEQ ID NO: 437127 - RNA, 64 nt, Human
gcccaguguaaaaaugucccaaguguagccccucccaccgcagagccuguuucuaacguaccug

SEQ ID NO: 437128 - RNA, 64 nt, Human
cagccucccaaagugcugguauuacagaugugagccaccgcacccagccugaguuucucuuucu

SEQ ID NO: 437129 - RNA, 64 nt, Human
aggaagacccuccugaggagugaagagugacaugccaccgcaggauccuuugcucugcacgagu

SEQ ID NO: 437130 - RNA, 64 nt, Human
auuguagcuguggcuguacuuguaccuaaggcccuggguucaagagaguuggagaaaccccucu

SEQ ID NO: 437131 - RNA, 64 nt, Human
ggcauaaucucggcucacugcaagcccugccuccuggguucaugccauucuccugccucagccu

SEQ ID NO: 437132 - RNA, 64 nt, Human
auaugaacugauuaugaucugcauguucucucuuuggguucaagcauuuccuuacagaagagcc

SEQ ID NO: 437133 - RNA, 64 nt, Human
ggcgugaucuuggcucacagcaaccucuaccuccuggguucaagugauucucgugccucagccu

SEQ ID NO: 437134 - RNA, 64 nt, Human
uuuuuuuuuuuuuuuggaggguauuuuuuauuuguggguucaaaaaaucuguauauacagucua

SEQ ID NO: 437135 - RNA, 64 nt, Human
ccugcagaauguaaguaagcucugcuuuauaagauggguucaccuucaucgcagacugaaaguu

SEQ ID NO: 437136 - RNA, 64 nt, Human
gucucacuaaguugccaggcuggucucaagcgccuggguucaagggauccucccgccucagccu

SEQ ID NO: 437137 - RNA, 64 nt, Human
cuguggcaucuuugccuugggcugcuccucaugguggguucaggggacucagcccugaggugaa

SEQ ID NO: 437138 - RNA, 64 nt, Human
gugucccccaugaaggcagcugagcuuucagagcuggguucaaaaaaaaaaauuccagugucug

SEQ ID NO: 437139 - RNA, 64 nt, Human
ggcgcaaacuuggcucacugcaaccucugcccccuggguucaagcgauucuccugccucagccu

SEQ ID NO: 437140 - RNA, 64 nt, Human
aggggacugggggacugggagucagagcccuggcuggguucaggucccacgucuggccaggcac

SEQ ID NO: 437141 - RNA, 64 nt, Human
aaucaguuuugggggaauggaccuggcauggggauggguucaggccaggucuuuugauggccag

SEQ ID NO: 437142 - RNA, 64 nt, Human
gacagcccucgucaacagaacuuccaguggguuguggguucauuuccuuucuuuuuaagaacag

SEQ ID NO: 437143 - RNA, 64 nt, Human
uacgaaaacaguguguuugaaaacaaauuagguuuggguucaauuccuucaauuuuuaaaaaac

SEQ ID NO: 437144 - RNA, 64 nt, Human
gacacaaucucggcucacugcaaccuccacuucuuggguucaagugauucuccugucucagccu

SEQ ID NO: 437145 - RNA, 64 nt, Human
accucugguagccauagcagccccugcuucagccccaccgcaccccuccagggggccugccuuu

SEQ ID NO: 437146 - RNA, 64 nt, Human
uccuaugaaauaauugguuguuggcaccaucucaccaccgcauaucccucacccccucggcaag

SEQ ID NO: 437147 - RNA, 64 nt, Human
gcccugaccacagggugagacagcagggcccaggggaguggaccagcccccagcaaauuaucac

SEQ ID NO: 437148 - RNA, 64 nt, Human
ggcacauucucggcucacugcaacuuccgccuccuggguucaagugauucucccaccucagccu

SEQ ID NO: 437149 - RNA, 64 nt, Human
ucuggggagugaugguagcguuggugccaggccguggguucagguguggcagaagcuugcagau

SEQ ID NO: 437150 - RNA, 64 nt, Human
cgcuccagaagggauaacaaaaucaaauaguagauggguucauugggccucagaaguucugcuc

SEQ ID NO: 437151 - RNA, 64 nt, Human
uuaaaacacacaugggauucucuggucacaguuuuggguucaggcuaugcugcuuugggcaggu

SEQ ID NO: 437152 - RNA, 64 nt, Human
cgcuucugguuaggugugucagguuggcuuauuuuggguucaggccuggcguagcacccacaag

SEQ ID NO: 437153 - RNA, 64 nt, Human
cagcccacgggguacuggaagacagugguucugauggguucagcccuagagagagagagagaag

SEQ ID NO: 437154 - RNA, 64 nt, Human
gugguuauggauaaacuuugcccagcaugauuuuuggguucaucuuaucaguuccccugguggg

SEQ ID NO: 437155 - RNA, 64 nt, Human
uuccucaagcauuuauuaagcaccuacugggugcuggguucacuguguccuaggaaaccaagag

SEQ ID NO: 437156 - RNA, 64 nt, Human
uuucuaaauuaacugagaccugucucggauuuucuggguucacauuuuggaaaccaugaaugga

SEQ ID NO: 437157 - RNA, 64 nt, Human
gcgacuccacugagcagccuuuccuguugucacauggguucagagcagcugagcagggaacacg

SEQ ID NO: 437158 - RNA, 64 nt, Human
uuucccauugcuccucucugcggccagggccagguggguucauauuuacagauaugcccagcca

SEQ ID NO: 437159 - RNA, 64 nt, Human
ggcgugaucuuggcuuacugcaagcucugccuccuggguucaagcgauuccccugcuucagccu

SEQ ID NO: 437160 - RNA, 64 nt, Human
uuguuggaggaggcuguguucuaaucagaaggucuggguucaaguccuaguuccacccccuccu

SEQ ID NO: 437161 - RNA, 64 nt, Human
ggcacgaucuuggcuuacuacaaccuccgccuccuggguucaagcgauccuccugccucagccc

SEQ ID NO: 437162 - RNA, 64 nt, Human
cgcguaacgugggcgcaucccucuuuuccuucccuggguucaguguggcuggguaaggaccguc

SEQ ID NO: 437163 - RNA, 64 nt, Human
cggccucccaaagugcuuggauuacagguguaagccaccgcaccccgcccagccuggcagauuu

SEQ ID NO: 437164 - RNA, 64 nt, Human
cggccucccaaagugcuuggauuacaggcaugagccaccgcacccagcaagaguuauuuucuua

SEQ ID NO: 437165 - RNA, 64 nt, Human
uggccucccaaagugcugggauuacaggugugauccaccgcaccuggcccuaacuuuuaauaua

SEQ ID NO: 437166 - RNA, 64 nt, Human
ccucuggggauaucugcucagccaauggaaaaucuggguucaaccagccccugccauuucuuaa

SEQ ID NO: 437167 - RNA, 64 nt, Human
guugugcgucugccccacucgcuguguuuguccguggguucauacaugcauugggugcuaggcc

SEQ ID NO: 437168 - RNA, 64 nt, Human
agacauguuuuguuaaacaacaaaaagguacauauggguucacauugaaauaugucuauaugcu

SEQ ID NO: 437169 - RNA, 64 nt, Human
aaaaaccaacugugaaaggaaccaccugugugguuggguucacucauucucagauuaaauugcc

SEQ ID NO: 437170 - RNA, 64 nt, Human
ggcgcgaucucggcucaccacaacauccgccuccuggguucaagcgauucuccugccucagccu

SEQ ID NO: 437171 - RNA, 64 nt, Human
ggugcgaucucggcucacugcaaccuccgcucccuggguucaagcgauucuccugccugagccu

SEQ ID NO: 437172 - RNA, 64 nt, Human
ggagugaucucugcucacugcaaccuccgccuucuggguucaagcgauucucgugccucagcuu

SEQ ID NO: 437173 - RNA, 64 nt, Human
uuugcuguguccugcagccccuuuccgggacaccuggguucacacagcuuuuuagcuuacauaa

SEQ ID NO: 437174 - RNA, 64 nt, Human
ggcacagucuuggcucacugcaaccuccaccuccuggguucaagcaauucuccuucuucagccu

SEQ ID NO: 437175 - RNA, 64 nt, Human
agccuguccugucucuauucuaggcaagagagaguggguucaaaagacuccugggcucaccugu

SEQ ID NO: 437176 - RNA, 64 nt, Human
ccucccuguccuccccugucuccuuuccuccuccuggguucauguuguaauaaaagaagauugu

SEQ ID NO: 437177 - RNA, 64 nt, Human
acaugaucucuacccuccuaguaaggagauacaguggguucaugaaugacuauaguuagcugaa

SEQ ID NO: 437178 - RNA, 64 nt, Human
gugaucuuggcucacugcugcaaccucccccuccuggguucaagcgauucuccugccucagccu

SEQ ID NO: 437179 - RNA, 64 nt, Human
gccaacagccccaaggggagcccaauuaaauaccuggguucaguauccuaaccuguuauguccu

SEQ ID NO: 437180 - RNA, 64 nt, Human
uuuuugcuuuuagaauuuuauuaacuacaucuuuuggguucauccaucuacaaacacugauuaa

SEQ ID NO: 437181 - RNA, 64 nt, Human
aggggagggcagagggaaggcgauacauccuuccccaccgcaggcaccccgggggcuggagggg

SEQ ID NO: 437182 - RNA, 64 nt, Human
ugaccucccaaagugcugggauuacaggcaugagccaccgcacccagccugcauuccuguuuuu

SEQ ID NO: 437183 - RNA, 64 nt, Human
ucacguggacaucuuugggaggccguuauucugcccaccgcacccuccguucauccccugcccu

SEQ ID NO: 437184 - RNA, 64 nt, Human
ggcgcgaucuuggcucacugcaagcuccgccuccuggguucacgccauucuccugccucagucu

SEQ ID NO: 437185 - RNA, 64 nt, Human
gggccaagccucacccugcggugcccuaaaggagggggggcacgagccaacaccccaccccucu

SEQ ID NO: 437186 - RNA, 64 nt, Human
ccaggccggggaagguuggagcagcccccagggaggggggcacuaggugucauugugcccgaug

SEQ ID NO: 437187 - RNA, 64 nt, Human
gcaggaggcccaacuagugaaaggcuuugccuccggggggcaggugugacuuccauuucaucag

SEQ ID NO: 437188 - RNA, 64 nt, Human
gccugacuuuccuuccauugguggguggauggguggggggcauuccagagccucuaagguagcc

SEQ ID NO: 437189 - RNA, 64 nt, Human
aggcccgcccuccuggccagcagaguggggcacuggggggcaacagcaacaguuuucuugucuu

SEQ ID NO: 437190 - RNA, 64 nt, Human
gaagccaccacuauuccucucucuugcccauuguggggggcaaaggcauuggucaccaagaguc

SEQ ID NO: 437191 - RNA, 64 nt, Human
ggggacagggaaagugaagguuagggaaagcagaggggggcacuuuuuagcauucccuuucuau

SEQ ID NO: 437192 - RNA, 64 nt, Human
gacuuggagucaggcagugagacugguggggcacggggggcaguggguacuuguaaaccuuuaa

SEQ ID NO: 437193 - RNA, 64 nt, Human
gucuuuagggcuggaaggcagcaucccucugacaggggggcaguugugaggccacagagugccu

SEQ ID NO: 437194 - RNA, 64 nt, Human
acccaugcccugccaagccuggagccccuguguuggggggcaaggugggggagccuggagcccc

SEQ ID NO: 437195 - RNA, 64 nt, Human
cugcuggucucauuugggggcguucgggagguuuggggggcaucaaccccccgacugugcugcu

SEQ ID NO: 437196 - RNA, 64 nt, Human
uugccuucgugggggccaggacgggaggcaggguggggggcaggcuggaccaccaccaucugcc

SEQ ID NO: 437197 - RNA, 64 nt, Human
agaagcguaugaucccagggagggugggcuggggggggggcagcacuugccucggagccacugc

SEQ ID NO: 437198 - RNA, 64 nt, Human
uuaacuucugaaagagcugugggugguggggggcggggggcaggacugaagauuucacuacuua

SEQ ID NO: 437199 - RNA, 64 nt, Human
cggcaggggccuugucucucacugcauuuggucaggggggcaugaauaaaggcuacaggcucca

SEQ ID NO: 437200 - RNA, 64 nt, Human
ggcucaagcaccaccaaucgcuuuaaugcuucagccaccgcaugaggcccuguccaccaccuuu

SEQ ID NO: 437201 - RNA, 64 nt, Human
gccuaggauguucugggcuaauauacuuguaaaaccaccgcauucuaggguuuucuuucauuuu

SEQ ID NO: 437202 - RNA, 64 nt, Human
ccugcugugccccgacuucccacaccagccgcgcccaccgcaggugggacucagguucgcccuc

SEQ ID NO: 437203 - RNA, 64 nt, Human
cucucccggguaaugggauggcugcggucccgccggggggcagucuggaaagguuuccuaaagg

SEQ ID NO: 437204 - RNA, 64 nt, Human
acuguggacgucuuuguucagaagggaucagguuggggggcagcccccagucccuuucuguccc

SEQ ID NO: 437205 - RNA, 64 nt, Human
ucguagaaaaucuuagugucgugggaaauuuacuggggggcaaagaguacaggcaaauguggaa

SEQ ID NO: 437206 - RNA, 64 nt, Human
guuuuccaugaccuuaaggcaguaguucucaacuggggggcaauuuugcacugaagagagcauu

SEQ ID NO: 437207 - RNA, 64 nt, Human
gcgcgcucgucauuuccggacucucugcugcggaggggggcaauaccagugacacccagucauc

SEQ ID NO: 437208 - RNA, 64 nt, Human
caggcuuaucagauaauaauucuccuauauuugaggggggcaugggauaaaaagauuuaauaau

SEQ ID NO: 437209 - RNA, 64 nt, Human
uagugcuguaggcccagggggucagggaaagggaggggggcaugugagggauggaaaugaccuc

SEQ ID NO: 437210 - RNA, 64 nt, Human
aguccacaccgcugagcugaacugacaggccaguggggggcaggggugcgccuccucugcccug

SEQ ID NO: 437211 - RNA, 64 nt, Human
agaaagcuuuggaaguuuuuguagauaguagaaaggggggcaucaccugagaaagagcugauuu

SEQ ID NO: 437212 - RNA, 64 nt, Human
agccccucaccucaggaccccagagggaccagcuggggggcaggggggagaggggguaauggag

SEQ ID NO: 437213 - RNA, 64 nt, Human
ggcgccgccucuggaagaacguguacgacgagcuggggggcagcccaggcagcaccagcgcggc

SEQ ID NO: 437214 - RNA, 64 nt, Human
uagcucugagguggcacuguccagcccuggauagggggggcagugggccagcuaccguaagcaa

SEQ ID NO: 437215 - RNA, 64 nt, Human
agauagcugcuguuaauauaauacaguacauuuuggggggcauaugugugguugggggguccuu

SEQ ID NO: 437216 - RNA, 64 nt, Human
gauagucucauucugucacccagacuggagugcaggggggcaaucacggcucacuguagucucg

SEQ ID NO: 437217 - RNA, 64 nt, Human
cagaggaacaaggacacagacauucccucaguguggggggcaggggacacagggagaggauggu

SEQ ID NO: 437218 - RNA, 64 nt, Human
agcuacgggguucuuggagagucggccagacggcggggggcagcaggaacuuugccucauaccc

SEQ ID NO: 437219 - RNA, 64 nt, Human
cguacaacaaucaacugguuuucaccaaguccaaccaccgcaaugaguucuggagugcucugcu

SEQ ID NO: 437220 - RNA, 64 nt, Human
uagcucccagggguucaggugguggagcaggaagccaccgcacccccaaagucacugggcccug

SEQ ID NO: 437221 - RNA, 64 nt, Human
accagccgcaacccaagcagaugacaggcacaggccaccgcaugaggagauggagggcgggacu

SEQ ID NO: 437222 - RNA, 64 nt, Human
agaagauauacugacccccaugcaggcaggauguggggggcaagaucaggagagucaggccccu

SEQ ID NO: 437223 - RNA, 64 nt, Human
guguuuugcugcguaucuggggcgggggcagguuggggggcacaaaguuaacauauucuugguu

SEQ ID NO: 437224 - RNA, 64 nt, Human
augcauuucccagaaccgugggcguacccaccuuggggggcauguugguucuggggggaccacc

SEQ ID NO: 437225 - RNA, 64 nt, Human
uuaaaaacaacugcauuagaaauaaugcguguuuggggggcagaaugcagauuuuuuuaauuua

SEQ ID NO: 437226 - RNA, 64 nt, Human
acuucaggggauggguguggauguaauuagcucuggggggcaguuggguagaugggugggggcu

SEQ ID NO: 437227 - RNA, 64 nt, Human
uuuuuaaccauugucuuguucugugaugaggggaggggggcacaugcugagucucccaaggcug

SEQ ID NO: 437228 - RNA, 64 nt, Human
guaccaccccugcuguugccugggcagggggaagggggggcacggugccuguaauuauuaaaca

SEQ ID NO: 437229 - RNA, 64 nt, Human
uuggcuuaauuaagugugcugucugcaccugcaaggggggcacuggagaggugcacugugagaa

SEQ ID NO: 437230 - RNA, 64 nt, Human
uaaauuacaauugugcccaaugcaggguggcucuggggggcaaguaggugguacaggggauugg

SEQ ID NO: 437231 - RNA, 64 nt, Human
uaaauguauaaauauacaguauagauuuuuggguggggggcauugaguauuguuuaaaauguaa

SEQ ID NO: 437232 - RNA, 64 nt, Human
gugucagguaugcaggacaaggaaugucugcucuggggggcacaggccaacuauauggagggag

SEQ ID NO: 437233 - RNA, 64 nt, Human
aaaaucucaagccaaacucaaagaauggggugguggggggcacccugugagguggccccugaga

SEQ ID NO: 437234 - RNA, 64 nt, Human
ucagcacauugggaugcacagaaacgugagggcaggggggcaguuguggucgccccuccccagu

SEQ ID NO: 437235 - RNA, 64 nt, Human
ugacccaagccugugaugacauggugcugauucuggggggcauuaaagcugcuguuuuaaaagg

SEQ ID NO: 437236 - RNA, 64 nt, Human
caucagaagacccuggacuugucauuauuugucuggggggcacugggugaagcugaagcuguug

SEQ ID NO: 437237 - RNA, 64 nt, Human
gggaggaggccagcugaguaggcagccuggugagggggggcaggggaugggcaggaggguggga

SEQ ID NO: 437238 - RNA, 64 nt, Human
cggccucccaaagugcugggauuacaggcaugagccaccgcacccgacggucuuuucaaagcua

SEQ ID NO: 437239 - RNA, 64 nt, Human
gcugccccuugacauucaggauguagcuuccugcccaccgcauacccuggcgccucacuccuca

SEQ ID NO: 437240 - RNA, 64 nt, Human
ugggaggcagagguugcagugagccgagauugcaccaccgcacuccagccugggugacagagcg

SEQ ID NO: 437241 - RNA, 64 nt, Human
cagcccacugaccauaccucagccccuagccccuggggggcagcuuuaaccugggcauguuucc

SEQ ID NO: 437242 - RNA, 64 nt, Human
uguugggacuggcucagagcccaugggggcuggaggggggcagcugggacucuggaaucuucuu

SEQ ID NO: 437243 - RNA, 64 nt, Human
uucuccaggagcagggaggguggaggggagggauggggggcacaggagcugggagccccgucuc

SEQ ID NO: 437244 - RNA, 64 nt, Human
cugaaucugaaauauuaccccuugucuagaaaaaggggggcagucagaacagcuguuccccacu

SEQ ID NO: 437245 - RNA, 64 nt, Human
uuuaagacaaguucaacaacaaaacauuugcucuggggggcagggaaaacacagauguguugca

SEQ ID NO: 437246 - RNA, 64 nt, Human
uuccauaggaguuucuuuugauucucucaguugcggggggcaucucuuaauccugggguaaaag

SEQ ID NO: 437247 - RNA, 64 nt, Human
aaaugggauggauagauuuuuuuuuucuuuucaaggggggcaggaagguaaugguuugaguagc

SEQ ID NO: 437248 - RNA, 64 nt, Human
accacaguauucuagagacggguugcaaugacaaggggggcaaaugaaaucaaugcaagauuuc

SEQ ID NO: 437249 - RNA, 64 nt, Human
acagcagcucuuuaaguguuugcauuuucuauuuggggggcagggaacugucauucauuuugca

SEQ ID NO: 437250 - RNA, 50 nt, Human
cugaugacgccaagaaguaaggggggcagagauggaugaagagaaagccc

SEQ ID NO: 437251 - RNA, 64 nt, Human
cugacacaguaaaauuaacucugugggugggggcggggggcauagcucuaaucuaauauauaaa

SEQ ID NO: 437252 - RNA, 64 nt, Human
ggaaugaagaaauuguggggggugggggaggugcggggggcagguagggaaauaauagggaaaa

SEQ ID NO: 437253 - RNA, 64 nt, Human
gagcuuuccucuuuacuucaaacagcaaaaaaguggggggcauauuguaguccugucauuuaag

SEQ ID NO: 437254 - RNA, 64 nt, Human
caauugugagggacaugcucaccucuagccuuaaggggggcagggagugaugauuugggggagg

SEQ ID NO: 437255 - RNA, 64 nt, Human
uuauuagaaaauuuuauauacuuuuuuacauguuggggggcagaagguaaagccauguuuugac

SEQ ID NO: 437256 - RNA, 64 nt, Human
ccuggaccccguggggucagguucccugccgggcggggggcaccggugccgccccguguucucc

SEQ ID NO: 437257 - RNA, 64 nt, Human
ccaggcucaggcugcuggucccaaccucagagccccaccgcagcccaguagggaugcagcacgc

SEQ ID NO: 437258 - RNA, 64 nt, Human
cggccucccaaaguguugggauuacaggcgugagccaccgcacccggcccuuguguacauuuuu

SEQ ID NO: 437259 - RNA, 64 nt, Human
cggccucccaaagugcugggauuacagaugugagccaccgcauccagccccacacccucauuua

SEQ ID NO: 437260 - RNA, 64 nt, Human
cccccuucugggggagacuuaacagagcguggaaggggggcauucucugucaaugaugcacuaa

SEQ ID NO: 437261 - RNA, 64 nt, Human
ggagucacacaaaccaaggaaggggauuguuugaggggggcacucagucacauguggcugaggc

SEQ ID NO: 437262 - RNA, 64 nt, Human
auuacuuggucaauucaggguugaggagacuguuggggggcauuuauaauguaugaaaguuaag

SEQ ID NO: 437263 - RNA, 64 nt, Human
aacuccagguggaaguagagcuggucccucagcuggggggcagugcuguccaguggaggggagg

SEQ ID NO: 437264 - RNA, 64 nt, Human
ugucguaucucagagagggaaucuaauuguuuuuggggggcaaaagaaagcaacguuuagguau

SEQ ID NO: 437265 - RNA, 64 nt, Human
auugccacaauacccagggauuaaugcugccacaggggggcaaucuuuauuugucuuacuuccu

SEQ ID NO: 437266 - RNA, 64 nt, Human
uaugggggucauuccugccucuuggcaccagguuggggggcaugugcuuguugggcaccaaagu

SEQ ID NO: 437267 - RNA, 64 nt, Human
uugcgggguauuaagcaggaaaccacugugugguggggggcacugggcuuguuggggccagaaa

SEQ ID NO: 437268 - RNA, 64 nt, Human
cauguccucucagaaccccagccuugaaaauaguggggggcacucagaggggccaccuccucag

SEQ ID NO: 437269 - RNA, 64 nt, Human
cucugagugacagcugguggcagcacuccuugcuggggggcacuguucaacaucccucugccgu

SEQ ID NO: 437270 - RNA, 64 nt, Human
accuggugcaccuggugccgguggcuggagaccuggggggcagguggaucuggggcuguucccc

SEQ ID NO: 437271 - RNA, 64 nt, Human
gggaaggggggcuucauuaauuauuuaugguaauggggggcagaguaagaacuuuuggcauuuu

SEQ ID NO: 437272 - RNA, 64 nt, Human
uacgccuccccggccaaauucccuccucuccuccggggggcaaggauggagucugcugcagacc

SEQ ID NO: 437273 - RNA, 64 nt, Human
guggaaauggggaacucccccagagguggauacuggggggcaggccucccaagcugauggacau

SEQ ID NO: 437274 - RNA, 64 nt, Human
gucccgagaugaccgggacgccuggccccuggugggggggcagccucggaacugggaguggggg

SEQ ID NO: 437275 - RNA, 64 nt, Human
ccaugcuuuuuguuuggggagggggacauuuuuuggggggcagggacuguguucagggaaagua

SEQ ID NO: 437276 - RNA, 64 nt, Human
caaucaguagccagcaucugccuccccuucacucccaccgcaggauuugggcucuuggaauccu

SEQ ID NO: 437277 - RNA, 64 nt, Human
ugucugugagcaggccccaugcccagcacgccagccaccgcaggauaccucagucauaccaguu

SEQ ID NO: 437278 - RNA, 54 nt, Human; identical to SEQ ID NO: 361932

SEQ ID NO: 437279 - RNA, 63 nt, Human
uggaccaggacucagcaugauggacaguggaugggggggcacccacaccuuccgcgcagucgu

SEQ ID NO: 437280 - RNA, 64 nt, Human
ggauugcccaccgucuuccagacaccccaccugaggggggcaccagguuuagugcugcugcuuu

SEQ ID NO: 437281 - RNA, 53 nt, Human
gcaagucggacagcgaguagggcggggggcauggaggccaggucucaguccgc

SEQ ID NO: 437282 - RNA, 64 nt, Human
cagcccugcccugucaggcugucagacaagccccggggggcagcaggugggcucgggacgggcu

SEQ ID NO: 437283 - RNA, 64 nt, Human
uuccauuuucuauaagaaaaaggaaaaguugaggggggggcauuagugcugauagcugugugug

SEQ ID NO: 437284 - RNA, 64 nt, Human
ccuguagugcacagugucucuacaggugucuucuggggggcagaaccaauuggaaggaagaaag

SEQ ID NO: 437285 - RNA, 64 nt, Human
agaaagaggaaugaggggcagggccaggcccacgggggggcaccucaauaaacucuguugcaaa

SEQ ID NO: 437286 - RNA, 64 nt, Human
cccaugagcaagccuagguacgaagaggggugguggggggcagggccacucaacagagaggacc

SEQ ID NO: 437287 - RNA, 64 nt, Human
caugggaggaagacgauuuggggggggaggggggggggggcaggguagguggggcuuucccuaa

SEQ ID NO: 437288 - RNA, 64 nt, Human
gagcagccauguuugaagggcacaugugaugaguggggggcagcaagaugccauuucugcaucu

SEQ ID NO: 437289 - RNA, 64 nt, Human
aacaaugcaaacggggcaggggcgggggggggggggggggcagagggcagggggacgggucggg

SEQ ID NO: 437290 - RNA, 63 nt, Human
agccaggauucaagaaaugaggagccacgccuuggggggcacggugcaaagugggccuucccu

SEQ ID NO: 437291 - RNA, 64 nt, Human
gaucuacagccugccucccagguuucuggcuuguggggggcagaguuugucccucugucaucag

SEQ ID NO: 437292 - RNA, 64 nt, Human
guaucuguaacguggcgcuacucucucuaucaugggggggcauguuuugacauuaaauugacuu

SEQ ID NO: 437293 - RNA, 64 nt, Human
gaaaauguuguuaugugguuuguaugcuacuuuuggggggcagggcucauuucagcagccuaaa

SEQ ID NO: 437294 - RNA, 64 nt, Human
gaagacaucccuggagugaaggacuccucagcauggggggcaguggggcacacguuagggcugc

SEQ ID NO: 437295 - RNA, 64 nt, Human
cagccucccaaacugcugggauuacaggugugagccaccgcacguagcauuuacauuagguauu

SEQ ID NO: 437296 - RNA, 64 nt, Human
aggaccaucucucucccacuucuucuccccucccccaccgcaucuggccagauggacuguccua

SEQ ID NO: 437297 - RNA, 64 nt, Human
augugaauaucccuggccagccuuuccacggcgcccaccgcagugccgcugccuggcccucagu

SEQ ID NO: 437298 - RNA, 64 nt, Human
ugugaugcuccuuguagcaggauaccaggguacuggggggcaaugcuaugauuaacuugcuuca

SEQ ID NO: 437299 - RNA, 64 nt, Human
guugcugcuucccggcaugccuucauuuugcuauggggggcaggcaggggggauggaaaauaag

SEQ ID NO: 437300 - RNA, 64 nt, Human
aaauguauuuuuacugugauaguccaagugcccuggggggcaggugugcucuaugugguucuuc

SEQ ID NO: 437301 - RNA, 64 nt, Human
ucagaugaacaauuaugaacauccaaauuuuauuggggggcaauaaucaacugaauugcaaaau

SEQ ID NO: 437302 - RNA, 64 nt, Human
acuaacauugucaccuucuggagagagaguuaauggggggcauugaggaugauauuuuuuuaca

SEQ ID NO: 437303 - RNA, 64 nt, Human
aggcaggacaggauccuucccuaaagccuucacaggggggcacggcccugcuugcugacccccc

SEQ ID NO: 437304 - RNA, 64 nt, Human
ccaguagccugggcccacagagcugcugggauguggggggcauaucaaguugaagauggcaacu

SEQ ID NO: 437305 - RNA, 64 nt, Human
uggguguucagccugaaugcccaggagcauuucuggggggcagcuaagacuggcagcuggguug

SEQ ID NO: 437306 - RNA, 64 nt, Human
acaacuaaaggaguccagggacuugcugcaggcuggggggcacugggugguucucaccagcagg

SEQ ID NO: 437307 - RNA, 64 nt, Human
gaagccugcaaacguugucaucgaagggaaggguggggggcagcugcgguggggagcuauaaaa

SEQ ID NO: 437308 - RNA, 64 nt, Human
aucgcgaugucgcacgguaccugcgcgcggcugcggggggcaccagaggcaguaaccaugcccg

SEQ ID NO: 437309 - RNA, 64 nt, Human
gcaggauuggagacugacuugugacugcgggcugggggggcauucccaguaggaaugugaagcc

SEQ ID NO: 437310 - RNA, 64 nt, Human
caggacccccaggcccccuccccugcugcuuugcggggggcagggcagaaauggacuccuuuug

SEQ ID NO: 437311 - RNA, 64 nt, Human
acuaugcccucaaccugggagcaucuggcaggcaggggggcagguacacacacacccacaggca

SEQ ID NO: 437312 - RNA, 64 nt, Human
gaggucaguccucaccugcaggugucggggugugggggggcaaggaggggcaggcacacaccau

SEQ ID NO: 437313 - RNA, 64 nt, Human
cuggaagagggugaaaggcagggcccuuggggcuggggggcaccccagccugaaguuugugggg

SEQ ID NO: 437314 - RNA, 64 nt, Human
ucggugccaccccagugagauguccccugacccuccaccgcagaaggaaggcagggaggaggca

SEQ ID NO: 437315 - RNA, 64 nt, Human
cagccucccaaagugcugggauuacaggcaugagccaccgcacccagccuauuuuauacuuuuu

SEQ ID NO: 437316 - RNA, 64 nt, Human
ugcccaaugccuuuuugauuacaguguagcuugcccaccgcauuugucguuuuagauacuuugc

SEQ ID NO: 437317 - RNA, 64 nt, Human
agguaaagucaaaggcauggguagaagaggaccaggggggcaagagcaacaacgucauaaugga

SEQ ID NO: 437318 - RNA, 64 nt, Human
cuguuaacaucuagccuaaaguauacaacugccuggggggcaggguuaggaaucucuucacuac

SEQ ID NO: 437319 - RNA, 64 nt, Human
acacgcccauuaaagcacagcacguccugggggaggggggcauuuuuuauguuacaaaaaaaaa

SEQ ID NO: 437320 - RNA, 64 nt, Human
gcgcccgcguagacucacgcugacugcaggcagcggggggcaucgaggggugcuuagccccagg

SEQ ID NO: 437321 - RNA, 64 nt, Human
uuuuggugaaagaaaaggugcauuucaagaacuuggggggcaggaggaaagcacaauguuucuu

SEQ ID NO: 437322 - RNA, 64 nt, Human
aaccaaacaaugcugauagacucagaaaaggaguggggggcagucaccacugcugggcguggca

SEQ ID NO: 437323 - RNA, 64 nt, Human
uaaaacauacacacagcuguuagcauaaagucguggggggcauuuucuggaaugcucagcaguu

SEQ ID NO: 437324 - RNA, 64 nt, Human
ucauaccuauaaucccagcacuuugggaggccgaggggggcagaucacuugagcccaggaguuc

SEQ ID NO: 437325 - RNA, 64 nt, Human
accuguggccugcagguagcaccaucuggcuggaggggggcaccccccccauggaugcccuuca

SEQ ID NO: 437326 - RNA, 64 nt, Human
cgccccagggucugaaagggguguuugggcagcuggggggcaccggcucaggagagggccuucc

SEQ ID NO: 437327 - RNA, 64 nt, Human
caugcccggggagcugucgggaguggcgggaaauggggggcaucaccaugccugccgucggguu

SEQ ID NO: 437328 - RNA, 64 nt, Human
aaauuucaacgucauuccuucaauuaaaaaaaggggggggcaagggaggggcuuugugauaacu

SEQ ID NO: 437329 - RNA, 64 nt, Human
ucagaggaagggcacagagaggaagggaagaauuggggggcagccggagugaguggcagccucc

SEQ ID NO: 437330 - RNA, 64 nt, Human
ucagccuuaaauuaagcucuuaguuguucagcuuggggggcaacuuugauuuuucucuguguug

SEQ ID NO: 437331 - RNA, 64 nt, Human
cccuacuggaggcaaaggaaggggaggguggaugggggggcagggcucccccucgguacugcgg

SEQ ID NO: 437332 - RNA, 56 nt, Human
ccuuccacaucagccucugaagggcuggggggcagggggcaugcacccaugcaaaa

SEQ ID NO: 437333 - RNA, 64 nt, Human
uggccucccaaggugcugggauuacaagcgugagccaccgcacccggccugaaaauauuuucua

SEQ ID NO: 437334 - RNA, 64 nt, Human
ggaccaucccggccggcgcgcucaucccacccgcccaccgcagggugaacugcagcgaguacuu

SEQ ID NO: 437335 - RNA, 64 nt, Human
auucuaaggaacucagggggcacguggucaggcuccaccgcacagaagagccacagucuccaga

SEQ ID NO: 437336 - RNA, 64 nt, Human
gggguacccgcaccgggaaugagcaggcucagcaggggggcagccccaccccuagucugcccuc

SEQ ID NO: 437337 - RNA, 64 nt, Human
ccccuccuccucaccacggggcuccugugagucuggggggcaccucuuucuggccugugcaccu

SEQ ID NO: 437338 - RNA, 64 nt, Human
aagacuggagaaauaaacacugaggacuccaaaaggggggcaaggaggaagaggggcagggguu

SEQ ID NO: 437339 - RNA, 64 nt, Human
uggcagcucacagagagcagggccggcccgggauggggggcagguacuccccaccuuccugccu

SEQ ID NO: 437340 - RNA, 64 nt, Human
gguuguuuuccugucauuuugagagacuaaauguggggggcagaugucaaaauaccuguacaau

SEQ ID NO: 437341 - RNA, 64 nt, Human
cugcccggcccaggagcgcagcugcauuugggguggggggcaggaugggggagagggggagggg

SEQ ID NO: 437342 - RNA, 64 nt, Human
cugguccggaaaaaauaauaccugggggccaggcggggggcacggagccacuuccuguacagac

SEQ ID NO: 437343 - RNA, 64 nt, Human
gccccuccccacagcuucucgacugcaguggggcggggggcaccaacacuuggagauuuuuccg

SEQ ID NO: 437344 - RNA, 64 nt, Human
gaaaucaacucaagauguacacgaagguuuuuuaggggggcagauaccuucaauuuaaggcugu

SEQ ID NO: 437345 - RNA, 64 nt, Human
agcauugcucuuccuacuguacauauuggggaguggggggcagggucgggaagggacaugccag

SEQ ID NO: 437346 - RNA, 64 nt, Human
gcggcccagauugcggugugagauggugcccccuggggggcacagccagaaacugaacuggccg

SEQ ID NO: 437347 - RNA, 64 nt, Human
uagcacaaauccuagcggacccuaggagcaaagaggggggcagcccucaugccuaacagugguc

SEQ ID NO: 437348 - RNA, 64 nt, Human
uaaaacucuagaagguguuacaagggggagggaaggggggcaaaguccuugaacauuuucuuug

SEQ ID NO: 437349 - RNA, 64 nt, Human
ugaugguuuucaauagaggugacugagauuguagggggggcauuuuugguugcccccaugcgug

SEQ ID NO: 437350 - RNA, 54 nt, Human
gccagcugugcccccugugauucaggggggcaggggccagucuugugcuccugg

SEQ ID NO: 437351 - RNA, 64 nt, Human
ucagaaagucccucaggguuuguagaggacugcaggggggcauccgcugcagacucagccuuuc

SEQ ID NO: 437352 - RNA, 64 nt, Human
cagcuucccaaaguggugggauuacaggcgugagccaccgcacccggccuccauaucccccuuu

SEQ ID NO: 437353 - RNA, 64 nt, Human
cagccucccaaagugcugggauuacaggugugagccaccgcagccggaccauuuuuaguauauu

SEQ ID NO: 437354 - RNA, 64 nt, Human
cagccaugcagauaagcccuggccaucucagcagccaccgcacaaccccccuaaugaaagacac

SEQ ID NO: 437355 - RNA, 64 nt, Human
caugacugacugagucugagaaaaggcagaagaaggggggcacaagggcaccuucucccuugag

SEQ ID NO: 437356 - RNA, 64 nt, Human
ugauuccuuucugccugcagggggcuggggggguggggggcaguggauggugcccuaucugggu

SEQ ID NO: 437357 - RNA, 64 nt, Human
uauacaucaauuuaaaaagcaaaaaaaaaaaaggggggggcaaucucucucugugucuuucucu

SEQ ID NO: 437358 - RNA, 64 nt, Human
agaaauguguucauagaugaugcugaaugggggaggggggcagcacgucagagaauuuacuauu

SEQ ID NO: 437359 - RNA, 64 nt, Human
ugcggggcaagcccuuaggggccugccagggcucggggggcaaagagggacucgggaaacucag

SEQ ID NO: 437360 - RNA, 64 nt, Human
gcuccagggcugcagccacguuagagggccccuuggggggcagggccagcucuacgguuacaug

SEQ ID NO: 437361 - RNA, 64 nt, Human
cccccgcuccagaggaaggaaagcugugggggacggggggcaugcuggccucaugggcuugggg

SEQ ID NO: 437362 - RNA, 64 nt, Human
uugcuucugcccccggcacuugccauguuccaguggggggcagauccucaggacuucacgggua

SEQ ID NO: 437363 - RNA, 64 nt, Human
uugggguuagugaccuggccagagggugccaagaggggggcagaccaguggggaucugauccca

SEQ ID NO: 437364 - RNA, 64 nt, Human
uuuucaccagcacccaucgcccaagggguaccgaggggggcaagggguguccaguccaagccca

SEQ ID NO: 437365 - RNA, 64 nt, Human
augcacggugccuggggcuccugugccggugggcggggggcaugcuggccucugagcgaucagg

SEQ ID NO: 437366 - RNA, 64 nt, Human
agccaucucuuccucauauuucagcagugcagccggggggcagggaagggcaggcagggucugu

SEQ ID NO: 437367 - RNA, 64 nt, Human
aauaugugguuaaaacuuccuagguuucauuacgggggggcauuggccauuuucuuaaaaucau

SEQ ID NO: 437368 - RNA, 64 nt, Human
caguggagacuggagacagggcaaugagucugguggggggcacguggacaugccccauaggggc

SEQ ID NO: 437369 - RNA, 64 nt, Human
ccaucguggggugccccaggcaccagaacaugauggggggcaugcgucagauggaguccuaugu

SEQ ID NO: 437370 - RNA, 64 nt, Human
aaugagcaguggcaaccccuuuuggccagggccaggggggcaccagcaaggggccacccuuucc

SEQ ID NO: 437371 - RNA, 64 nt, Human
aagagggcuguggucauacacacuguguacguggccaccgcaaaggacggcgucgugcaacccu

SEQ ID NO: 437372 - RNA, 64 nt, Human
caggaggcagagguuggagugagcugagaucgcgccaccgcacuccagccugggcaacagagcg

SEQ ID NO: 437373 - RNA, 64 nt, Human
cagccucccaaagugcugggauuacaggugugagccaccgcaccuggccucuguccucuuuuag

SEQ ID NO: 437374 - RNA, 64 nt, Human
uagagccauguuuacuguuugacuguguggcacaggggggcauuuggcacagcaaaaagcccac

SEQ ID NO: 437375 - RNA, 64 nt, Human
cgugagaguuuauuuuuguacaaggggugaggguggggggcacuguacccuucuagccccauca

SEQ ID NO: 437376 - RNA, 64 nt, Human
cugagcgcccgggcuggcccggcccaccgcggggggggggcagcgggcacaggcccucugagug

SEQ ID NO: 437377 - RNA, 64 nt, Human
agauggagcagugucauugucaguggcagggcauggggggcaguggugagcuaaggcugaggag

SEQ ID NO: 437378 - RNA, 64 nt, Human
cacucuucucaugggcacagccauccuuugccggggggggcauccagccuggguggccaccccu

SEQ ID NO: 437379 - RNA, 64 nt, Human
ggagaccugcugcuccucauuggggggaucucuuggggggcagacaccaguuugccaaugaagc

SEQ ID NO: 437380 - RNA, 64 nt, Human
ccggguccugcaggaccaggugccagccacuaagggggggcaccgccgaugccagggguuuugc

SEQ ID NO: 437381 - RNA, 64 nt, Human
ggaccaggaugugucucagccuggagaaauggugggggggcagugucuagggacuagagugaga

SEQ ID NO: 437382 - RNA, 64 nt, Human
uuuaauuuuuguaagcaucaaaguugauuagagaggggggcacuuuuucuggagaauucucuua

SEQ ID NO: 437383 - RNA, 64 nt, Human
ccugagagguguuuaggcacagcagaggggacgcggggggcaagaacagcaggacgcugguuua

SEQ ID NO: 437384 - RNA, 64 nt, Human
cauuuccuuuagcccgugugccuguaacucugagggggggcacccaguggggugcugagugggc

SEQ ID NO: 437385 - RNA, 64 nt, Human
gcucagaauaaaaagaugcccucccuucuaugcaggggggcaaguuuacuggauggagaugauu

SEQ ID NO: 437386 - RNA, 59 nt, Human
ucaacaugaagaugauaugaggccggggcggggggcagggacccccgggcggccgggca

SEQ ID NO: 437387 - RNA, 64 nt, Human
cagaguauuugaauguccaccagacaccagccccggggggcacagagagaacaacauuccucuc

SEQ ID NO: 437388 - RNA, 64 nt, Human
ucugggcaucccgggugggggauuuuggggccguggggggcagucucugguaccugugugcguc

SEQ ID NO: 437389 - RNA, 64 nt, Human
caaaaacgaccaccuccaggacucagugaucccuggggggcaggcucugccagcccucggccac

SEQ ID NO: 437390 - RNA, 64 nt, Human
cggccucccgaagugcugggauuauaggugugagccaccgcacccaguugggaacaaagccuuu

SEQ ID NO: 437391 - RNA, 62 nt, Human
acaagcccgaggagaacugagacucugccuuaccaccgcagugcggggcaccucucccagcg

SEQ ID NO: 437392 - RNA, 64 nt, Human
uggccucccaaagugcugggauuacaggcgugagccaccgcacccagccagggggaauguucua

SEQ ID NO: 437393 - RNA, 64 nt, Human
aggggccagguggcacaaauaagagaggggagauggggggcagccaggagaggaggugucccuu

SEQ ID NO: 437394 - RNA, 64 nt, Human
gguuggugugcacaggcacuggcugcugugagugggggggcauggggcaguuuccuuuggugga

SEQ ID NO: 437395 - RNA, 64 nt, Human
gggcaugugugagccucaguuuccucaucuguaaggggggcaaugauaccuaccucacaggggu

SEQ ID NO: 437396 - RNA, 64 nt, Human
uccuuccuagaggcccugggggccaggcugacuuggggggcagacuugacacuaggccccacuc

SEQ ID NO: 437397 - RNA, 64 nt, Human
aggaaucugcauuuuaacuagucgcggggauuguggggggcaguagcuggcuguuucguggcau

SEQ ID NO: 437398 - RNA, 64 nt, Human
cugaaugauguucucuccgucucaucggcaguauggggggcagcugucccagugucaauguuua

SEQ ID NO: 437399 - RNA, 64 nt, Human
gggaaggaccuuggaaggggcugcucccaggccuggggggcagucgugggagccccucucagcu

SEQ ID NO: 437400 - RNA, 64 nt, Human
gaacccagggccuggccuucucucccagcagccuggggggcagggcagagccuccagucggacc

SEQ ID NO: 437401 - RNA, 64 nt, Human
cccaccucgcggcgcagccccuggagcuccugcuggggggcagggcccaucugccgccuggggc

SEQ ID NO: 437402 - RNA, 64 nt, Human
auguuuggacuugacaaaaauaggugcaaaugauggggggcaauagaagaaaaaauuugcauuu

SEQ ID NO: 437403 - RNA, 64 nt, Human
aagcguauauacuuaagaauacacaggauauuuuggggggcagagaauaaaacguuaguuaauc

SEQ ID NO: 437404 - RNA, 64 nt, Human
ccagcaucuccugagaggacgccugggcuuaccuggggggcaggaugccuggggacaguucagg

SEQ ID NO: 437405 - RNA, 64 nt, Human
ggguccaucgucagugccugagcggccagcagaaggggggcagcagccuccacugagccucugg

SEQ ID NO: 437406 - RNA, 64 nt, Human
cgccacgugcacacacacagacccacauguggguggggggcacccucacgugcuuggccucaau

SEQ ID NO: 437407 - RNA, 64 nt, Human
gucccucucaaguaucuccuggaggaagggguauggggggcagguguggggugugggguguucc

SEQ ID NO: 437408 - RNA, 64 nt, Human
gcaucuuaccauggcuggggaauugucuggugguggggggcaggggacagaggccaugaaggag

SEQ ID NO: 437409 - RNA, 64 nt, Human
cugcccuccaagaccuucuccuucaccuuuguccccaccgcagacaggaccagggauuuccaug

SEQ ID NO: 437410 - RNA, 64 nt, Human
ccugugagccggagcucaugccgaccuuuccccaccaccgcaacaagcgggccgccccagccac

SEQ ID NO: 437411 - RNA, 64 nt, Human
ggcccagaagagccccacgggcuuccugcaucuuccaccgcaccauaccuggagcccuccgagg

SEQ ID NO: 437412 - RNA, 64 nt, Human
gagugggugcuuagcagacagagugaagcuggcuggggggcacagugguguguagugcugcugu

SEQ ID NO: 437413 - RNA, 64 nt, Human
auuucuccgugguacuucaccugguggcacuuuuggggggcaauguuaacaacuaucacauuuu

SEQ ID NO: 437414 - RNA, 64 nt, Human
gcggcucuguccugugccuuaccagcccuggggaggggggcauuuggcuggaagacuggaauuu

SEQ ID NO: 437415 - RNA, 64 nt, Human
agcuggcugacgccuugagccgagggcauaugcgggggggcagccaaccagagcuggucacucc

SEQ ID NO: 437416 - RNA, 64 nt, Human
ugugaagcuugagacucuggaaagaaauggggagggggggcaggggaaauguugcccuaagaau

SEQ ID NO: 437417 - RNA, 64 nt, Human
aggaagaucccaacacugaagggguagaaggccaggggggcauggagagugcagcuccauuaua

SEQ ID NO: 437418 - RNA, 64 nt, Human
ucaccuuuuugucuuggcuuuucuuugggcugugggggggcauccauuuccagggucggggagg

SEQ ID NO: 437419 - RNA, 64 nt, Human
guuugccuucgcaccuccuccccuaaagcagcgcggggggcaaauaagaccccaccccucccug

SEQ ID NO: 437420 - RNA, 64 nt, Human
guccagagggacuggacagccagggcagggcuuuggggggcacuagaagaugagggugucggcu

SEQ ID NO: 437421 - RNA, 64 nt, Human
aagacuugagaaauuugaaaggggguggguauggggggggcaagaaagagggagggaaaucuuu

SEQ ID NO: 437422 - RNA, 64 nt, Human
gcagcccggacuuugagaaugggcucugguuugcggggggcaggcguaccagacugcaagaccc

SEQ ID NO: 437423 - RNA, 64 nt, Human
cuuguaucuuuuuuggugugugggcgggggggguggggggcaguucagugaagucuagaagacc

SEQ ID NO: 437424 - RNA, 64 nt, Human
gggucuagggagugggaaaugcgggagggaggguggggggcaggggucgggggucggguguccg

SEQ ID NO: 437425 - RNA, 64 nt, Human
aaauaaacauguuuguugaaguacuguuuguagaggggggcaaagccccaacugcaaacaaagu

SEQ ID NO: 437426 - RNA, 64 nt, Human
ccaccccugucgagccccuaaggauggggaggugggggggcaggagcuucugucccccacauuc

SEQ ID NO: 437427 - RNA, 64 nt, Human
aaccaaucgcacuuaacgacucgggccaccacugggggggcagggggagggguccaccaugauu

SEQ ID NO: 437428 - RNA, 64 nt, Human
ucugcgucuguggucugugucgcuguccccagucccaccgcaguccugccgcaggccuaacccu

SEQ ID NO: 437429 - RNA, 64 nt, Human
uggccucccaaagugcugggauuacaggcaugagccaccgcaccuggccuucccugcuuccucu

SEQ ID NO: 437430 - RNA, 64 nt, Human
ggccuggagcucuccaggaaagccaagcuggcggccaccgcaggggcccuccacauucuggccg

SEQ ID NO: 437431 - RNA, 64 nt, Human
agaaugaggaggaaggagagaaggggaggagggcggggggcaccuacuacaucgcccuccacau

SEQ ID NO: 437432 - RNA, 64 nt, Human
gagcuccucagugccgccucccugcggguaucccggggggcacuggaugcgagcccccaggucu

SEQ ID NO: 437433 - RNA, 64 nt, Human
gggauggggaggaagagagagacuguggagcucuggggggcaaccuggaggucugaaaagagga

SEQ ID NO: 437434 - RNA, 64 nt, Human
cucccaggcugcuccagacauggggguuggggauggggggcaccuugcagccccuuccugcugg

SEQ ID NO: 437435 - RNA, 64 nt, Human
gcggaagaauggagugcaauugugugagcagaaaggggggcaggaaucccgggugcuccacugc

SEQ ID NO: 437436 - RNA, 64 nt, Human
gguggaccuggagaguggaggcaccggccaggcaggggggcaggggagcucaggccuggggucu

SEQ ID NO: 437437 - RNA, 64 nt, Human
uuuuuguuuuuguuuuuguuuuuguuuuugugggggggggcaacuaaacaaacacaaaguauuc

SEQ ID NO: 437438 - RNA, 64 nt, Human
aauuugccuuuguggcaacugaagauggaagucuggggggcacagacaaccuuaucaaacaaua

SEQ ID NO: 437439 - RNA, 64 nt, Human
gagcagguugaugaugagaucccagugagaagauggggggcaacacugaccauuuggugcugag

SEQ ID NO: 437440 - RNA, 64 nt, Human
aagagacccgguaauuggagggugagccucggggggggggcaggacgccccgguuucggcacag

SEQ ID NO: 437441 - RNA, 64 nt, Human
gaauagccauucuaggcggggcuggggccaggguggggggcagucacugugggaggucccagcu

SEQ ID NO: 437442 - RNA, 64 nt, Human
cuucucucagaaucagcgagcccagcuguaggguggggggcaggcucccccauggcaggguccu

SEQ ID NO: 437443 - RNA, 64 nt, Human
cccaugccucagccucauacagaugugccaucauggggggcauggguggagcagaggggcuccc

SEQ ID NO: 437444 - RNA, 64 nt, Human
uugggaggcuggcacaggagaaucgcuugaaucuggggggcagagguugcagugagccaagauu

SEQ ID NO: 437445 - RNA, 64 nt, Human
ccccuucucucaucucuuagcuccccuccaaccuggggggcagugguguggagaagccacaggc

SEQ ID NO: 437446 - RNA, 64 nt, Human
ggggccuuggaaggcagggcgguguuggggggcuggggggcaggcugaaugugugugugugggu

SEQ ID NO: 437447 - RNA, 64 nt, Human
gauggaauuucaguucaucagauguucaccauggccaccgcagaacaccgaaguaauuccagca

SEQ ID NO: 437448 - RNA, 64 nt, Human
ucccuccucuguaaaaugggcaugauuagagugcccaccgcauuagggauguuggggugaguca

SEQ ID NO: 437449 - RNA, 64 nt, Human
ucucccaucucuccuccccucccccugggguggcccaccgcauggguacaggggguuccaggaa

SEQ ID NO: 437450 - RNA, 64 nt, Human
ucaccugacccgugccucucugacacaugucuccggggggcagccaccuggccaaugugcauuu

SEQ ID NO: 437451 - RNA, 64 nt, Human
gagccaucgcugugggaggcagcaggccccggguggggggcagaggcgcccagccuuggauggg

SEQ ID NO: 437452 - RNA, 64 nt, Human
aaucuuuuaucaacacauccaagaugacuugguuggggggcacuguaugccauaaugaauguga

SEQ ID NO: 437453 - RNA, 64 nt, Human
auacccccuucccucgaagcucccucccggugcuggggggcagcugaggggcugcaggggcagu

SEQ ID NO: 437454 - RNA, 58 nt, Human
cagcuccaggaggcagcugagggggaugggggggcagaucuuggacucaugaggaggg

SEQ ID NO: 437455 - RNA, 64 nt, Human
gguacaggggcacuucguaacccagggaaagggcggggggcauauuugcaagcgcgcucggugc

SEQ ID NO: 437456 - RNA, 64 nt, Human
uagccauggagcugagccggcgcguggccgggcuggggggcacccuggccggacucagcgugga

SEQ ID NO: 437457 - RNA, 64 nt, Human
ggaacuagccaggugggggccuuucccuuuggauggggggcauaucugacaguuauucucucca

SEQ ID NO: 437458 - RNA, 64 nt, Human
ugugcagcgugaggacgggacucuggucugcuguggggggcaugcaggacggcgccacucucug

SEQ ID NO: 437459 - RNA, 64 nt, Human
cgcccaccugguccucucccaucgcccacaaaagggggggcacgagggacgagcuuagcugagc

SEQ ID NO: 437460 - RNA, 64 nt, Human
ugcgggccccacaggagaagcggccagggcccgcggggggcaccaccuguggacagcccuccug

SEQ ID NO: 437461 - RNA, 64 nt, Human
uucacuucuguacugcacuguggcuugcccuggcggggggcaggggguuggcaggacauggcaa

SEQ ID NO: 437462 - RNA, 64 nt, Human
ccaggcgagggggacuuggggcuuccacgucccuggggggcaggggccaggccaggggggaggg

SEQ ID NO: 437463 - RNA, 64 nt, Human
cucccacccugagauugggcauggggugcgguguggggggcaugugcugccuguuguuaugggu

SEQ ID NO: 437464 - RNA, 64 nt, Human
uuguggggagggggucaguuucugggaaggguggggggggcagggaaggggaacacagauuucu

SEQ ID NO: 437465 - RNA, 64 nt, Human
gugccugcacccgcccgguggacgucagggacucggggggcaggccccucccaccuccugacac

SEQ ID NO: 437466 - RNA, 64 nt, Human
cagucugccuuaccuuuacccguccuugagaacagcgguccaggagaaucaggcagucuguggc

SEQ ID NO: 437467 - RNA, 64 nt, Human
ggucacccagcagugccgggcugggcucugcggugcgguccacgggagagcaggccuccagcug

SEQ ID NO: 437468 - RNA, 64 nt, Human
uccacucucugccccuaaagaugggaggagaccagcgguccaugggucuggccugugagucucc

SEQ ID NO: 437469 - RNA, 64 nt, Human
caggugccuuaaagggcccucguccacccaagguggggggcaggggcccucacucuccggcccu

SEQ ID NO: 437470 - RNA, 64 nt, Human
cccccuaguuagagacaguccuuccgugaggccuggggggcaucugugccuuauuuauacuuau

SEQ ID NO: 437471 - RNA, 64 nt, Human
ggugcgauccaccaggagugccgcccccuuguggggggggcagggugcugccuucccauuggac

SEQ ID NO: 437472 - RNA, 64 nt, Human
cucgcuaaagucuuaugggcguccccugggguugggggggcacaagguuuuggaggaagaagac

SEQ ID NO: 437473 - RNA, 64 nt, Human
acuuggggucuagaccaugguggugccagccuggggggggcaguggcccucagcucugcccgcu

SEQ ID NO: 437474 - RNA, 64 nt, Human
gggacaugaggugagagguauccuggccgagggcggggggcagcggggggucucccuccggacc

SEQ ID NO: 437475 - RNA, 64 nt, Human
gccugcacucgcuaaggaaggggacucgagaaugggggggcagcuugcugacccucaacugggg

SEQ ID NO: 437476 - RNA, 64 nt, Human
cacucucuuccucccacccccaagacugaguuuuggggggcaagguggagagagcuggcaacua

SEQ ID NO: 437477 - RNA, 64 nt, Human
uagcaucugacuggaaacaagcgggaauugcauuggggggcauuuucugggccaguuucccugc

SEQ ID NO: 437478 - RNA, 64 nt, Human
aauggccccguuguguguggugggggucgggguuggggggcauggugcagucggccuucacgua

SEQ ID NO: 437479 - RNA, 64 nt, Human
uaaccuuugcuuuaugcucuugugggaggcgacgggggggcaggcgggagcaggcacgggggug

SEQ ID NO: 437480 - RNA, 64 nt, Human
ccuguguaguccuuacaggcaugacuggaaaguuggggggcaucuaugguagacauggcacagc

SEQ ID NO: 437481 - RNA, 64 nt, Human
uuggaaguuuucucccccaucuucuuaagaagcaggggggcagguggaggagagugaggggaga

SEQ ID NO: 437482 - RNA, 64 nt, Human
ucaccuguccagggacagcgaagcuggggguggcggggggcauguaccacaggguggcagcagg

SEQ ID NO: 437483 - RNA, 64 nt, Human
uccuuugugccagaccaagcggcccgugggggguggggggcagggaguguaccacacagggcca

SEQ ID NO: 437484 - RNA, 64 nt, Human
cagggguguguggaaggcagugggggaguugggaggggggcagggaaaugaaauggaguuuugu

SEQ ID NO: 437485 - RNA, 64 nt, Human
cugagcccacucuacugccccagcuccguuucuaccaccgcauccucacugggcucacugcagg

SEQ ID NO: 437486 - RNA, 64 nt, Human
gccaugcacacaggaggagagcuggaccugagggccaccgcagcggugcacacauuccucuggg

SEQ ID NO: 437487 - RNA, 64 nt, Human
augugccgaucaguggagucaguaucgagccugaccaccgcaagccaggaagcaggugaagugc

SEQ ID NO: 437488 - RNA, 64 nt, Human
ugguggcaucagcccuggggccuccuggguggcaggggggcagcagcucuccuccccacucaca

SEQ ID NO: 437489 - RNA, 64 nt, Human
cggccugcaggagccgggguggggguggggguggggggggcaggacccugagaugccaccagga

SEQ ID NO: 437490 - RNA, 64 nt, Human
guguuuuugguucgauucugccucuguagcucaaggggggcagcccccagaguccugugcauuc

SEQ ID NO: 437491 - RNA, 64 nt, Human
cugaugccugcaaaagccauuuauggcuugugguggggggcacauagauuccccgguggguuag

SEQ ID NO: 437492 - RNA, 64 nt, Human
ccugcugcccgagccaggaacuguguguguugcaggggggcaguaacuccccaacucccucguu

SEQ ID NO: 437493 - RNA, 64 nt, Human
guaggcauuucccguuuuuuuuggggggggggugggggggcagggcucugcccucuugaaaggc

SEQ ID NO: 437494 - RNA, 50 nt, Human
agcagucggagcgggggugaggggggcagugugcucgugggaauggaaag

SEQ ID NO: 437495 - RNA, 64 nt, Human
guuucugggcagaguggagcugcaacccuguuguggggggcagcauuuggcagguuuucuccuu

SEQ ID NO: 437496 - RNA, 64 nt, Human
uguuauuacuugguucuugcugaccuggugaguuggggggcagggguugucuugggccagccuc

SEQ ID NO: 437497 - RNA, 64 nt, Human
uugaggggcaccacuacuccagcccagaaggaaaggggggcagcucaguggccccaagagggag

SEQ ID NO: 437498 - RNA, 64 nt, Human
cugcucacccagccuuggcccugcagggaauguuggggggcacagaggggagaagcucuuuccc

SEQ ID NO: 437499 - RNA, 64 nt, Human
uagggugguuagggaauuccaugagacaagacaaggggggcauggugugagaaaggcauggaag

SEQ ID NO: 437500 - RNA, 64 nt, Human
guagccagccagccaaggcucuguuuaugcuuuuggggggcauauauuggguuccauucucacc

SEQ ID NO: 437501 - RNA, 64 nt, Human
auacuuuuaagaagagcucuuuguuccugggggaggggggcagggggugaauuuuacuuucauc

SEQ ID NO: 437502 - RNA, 64 nt, Human
ugccagcaggugccagggcuggugaggaagagcuggggggcagagguaaagcccugcaggggag

SEQ ID NO: 437503 - RNA, 64 nt, Human
uaucaggaaagcaugucccaucagaaacacucucggggggcaaugguagcacucacccugaaac

SEQ ID NO: 437504 - RNA, 64 nt, Human
cuucugccauuucaaagacucauuucuccuauaaccaccgcaugaguugaaucaaaauuuucag

SEQ ID NO: 437505 - RNA, 64 nt, Human
uuagccuccugaguagccaggacuauggcauguaccaccgcaccugccucacauuuucuuucuc

SEQ ID NO: 437506 - RNA, 64 nt, Human
uggccucccaaagugcugggauuacaggugucagccaccgcacccagccaagcaccccuaucuc

SEQ ID NO: 437507 - RNA, 64 nt, Human
acaacaggaaaaagcaccuagaauauuuggggggggggggcaaauuaauuaaggguauuuguaa

SEQ ID NO: 437508 - RNA, 64 nt, Human
ucucuacaggucagugaagcccaggaggaccuggggggggcaagagcucaggagaaggccugcc

SEQ ID NO: 437509 - RNA, 64 nt, Human
ccucccuuucucuaauuucccccuuaacaugccuggggggcauacaauccaacccgcgcccucu

SEQ ID NO: 437510 - RNA, 64 nt, Human
cuuauuccuuuugugucauguaaauuguaacucaggggggcagaagcucuggucacccacacca

SEQ ID NO: 437511 - RNA, 64 nt, Human
agauagacacuggcauuaucccuuuaggaagaggggggggcagcaagagagccuauuugggaca

SEQ ID NO: 437512 - RNA, 64 nt, Human
cuuccacucugaggugugggaacggggagccucuggggggcaccuguuuccccagugacucaga

SEQ ID NO: 437513 - RNA, 64 nt, Human
gagucccugaauucacccaggaccauccaaggggccaccgcagcauuggccccaucaccacguc

SEQ ID NO: 437514 - RNA, 64 nt, Human
ucacgcucuccgcuccaccccuuagccugggaacccaccgcaggugugaguucugugagucacu

SEQ ID NO: 437515 - RNA, 64 nt, Human
gguggggaaguugcugggguggagaagggcuagcccaccgcagcagccucccucccucucagca

SEQ ID NO: 437516 - RNA, 64 nt, Human
cagaugaagcugggauggaggcucugaccccaccaccggccacccaucugucacccuuggacag

SEQ ID NO: 437517 - RNA, 64 nt, Human
gagaaagggauugcugaggcaccguccaggccccaccggccaggccgcgcccagcagaggcgua

SEQ ID NO: 437518 - RNA, 64 nt, Human
acuuggucugucacggcugaugaggacucccacaaccggccaaguuaugucuuauuauacaccc

SEQ ID NO: 437519 - RNA, 64 nt, Human
ggccagugugaaccgaggggcucaggaaaacgggaccggccaggccaccuccagaaacggccau

SEQ ID NO: 437520 - RNA, 64 nt, Human
gucccugcacucucagcccccgcccgucaccaccaccggccaccugaguguccgugagcgggcc

SEQ ID NO: 437521 - RNA, 64 nt, Human
ggcggugggaggguuugcugggacugauggggacaccggccagcuugucugguguccagcagcc

SEQ ID NO: 437522 - RNA, 64 nt, Human
cuaugaagcaggccuaguuucuucaucuauguuuaccggccaccaaacaccuuagggucuuaga

SEQ ID NO: 437523 - RNA, 64 nt, Human
cauuugugguuauagcuucccauaugccacauucaccggccaccuccucgccguggaacccugc

SEQ ID NO: 437524 - RNA, 64 nt, Human
ccaaaguguugggauuauaggagugagccaccacaccggccaagaugcuuuucaaacugauaca

SEQ ID NO: 437525 - RNA, 64 nt, Human
gugucuggggaggacuuugugcucagcacucugcaccggccacucuuagcccccgaggcguuga

SEQ ID NO: 437526 - RNA, 64 nt, Human
gaaccuuggaagucacaguuuggggucacuugagaccggccaggaauguuugcaugaccuaccu

SEQ ID NO: 437527 - RNA, 64 nt, Human
agaguguuaccaccagcacccagaccgaacccccaccggccaaauguggugaugccgaagaugu

SEQ ID NO: 437528 - RNA, 51 nt, Human
gggagccaguccaggagugagaccggccagaugaggcuggccaagccgggg

SEQ ID NO: 437529 - RNA, 64 nt, Human
aauaauaaaaaaguuuuggcuuuuuucuuuagaaaccggccaccugcuucccccgcgggggccg

SEQ ID NO: 437530 - RNA, 64 nt, Human
ucggagagccugccugccugggcgggcccgcccgccaccgcagccucccagcugcucuccgugu

SEQ ID NO: 437531 - RNA, 64 nt, Human
cuggucaucccggccuucccggcccacuuccuggccaccgcaggccccucgcccauggccgcug

SEQ ID NO: 437532 - RNA, 64 nt, Human
cgaccucccaaagugcugggaugacaggcaugagccaccgcacccggccaacacagauguuuau

SEQ ID NO: 437533 - RNA, 64 nt, Human
acuuuccuuccguccucaauuucuaccuccauagaccggccagaauuuagcuucacuugagaga

SEQ ID NO: 437534 - RNA, 64 nt, Human
gcuaaguccagccagcgugcagcugcauccagaaaccggccacuacccagcccaucucugccug

SEQ ID NO: 437535 - RNA, 64 nt, Human
gucccaucccccgucuguccacuaacuguaccgcaccggccauuaaaagaugaaggcagaccgc

SEQ ID NO: 437536 - RNA, 64 nt, Human
accaguacaugcuccucuguaagcagcugaacucaccggccacuucucuguuugccuauagaca

SEQ ID NO: 437537 - RNA, 64 nt, Human
auguguagccggaaggggcgcuccucccagcuguaccggccacugcaacccaugagugaguugg

SEQ ID NO: 437538 - RNA, 64 nt, Human
aaaacaguucuacucacuuccuuuuacagaauucaccggccauuuuccuguuaccugauccuuc

SEQ ID NO: 437539 - RNA, 64 nt, Human
uccuccuccucauugucgcugccaaacaggaggcaccggccacaggcccauucaucugcucgua

SEQ ID NO: 437540 - RNA, 64 nt, Human
uuccuuuccaagugucaaauaggacacccaucuuaccggccaauguccaaaauuacgguuugaa

SEQ ID NO: 437541 - RNA, 64 nt, Human
aauuccagcucgccuuguugacucgccuguguccaccggccaugaggagcccacgccuguccuc

SEQ ID NO: 437542 - RNA, 64 nt, Human
ccacugccugcccagugccaucaggaugagcaguaccggccaagcauaaugacagagagaggca

SEQ ID NO: 437543 - RNA, 64 nt, Human
ggaggcccucauguucaccagggaacaggaccacaccggccacuggaggagggcaggagcaguc

SEQ ID NO: 437544 - RNA, 64 nt, Human
cccagggcagguaucagggugaacugaucuuagcaccggccaaauaaauggaaccugcugagag

SEQ ID NO: 437545 - RNA, 64 nt, Human
aagagaccaagagaccaggcccgggcagcagccuaccggccacguggaacacuggcuccggagu

SEQ ID NO: 437546 - RNA, 64 nt, Human
ccuuugcacagaaaccaaccccugacccagcgguaccggccaagcacaaacguccuuuuugcug

SEQ ID NO: 437547 - RNA, 64 nt, Human
cccccgagagcuacagcgugugauggaaucagugaccggccagguuagccucuccccucuuggc

SEQ ID NO: 437548 - RNA, 64 nt, Human
gaaccuuuggaugcaaaugucgaugcuuaagaaaaccggccacuucagcaacagcccuuucccc

SEQ ID NO: 437549 - RNA, 64 nt, Human
gucuucccccagaggcacauuccucuccaucuuuccaccgcacaccuggaccaggcuugcaggc

SEQ ID NO: 437550 - RNA, 64 nt, Human
uagccagugccugagaagacagucccuuuucuacccaccgcacuccauaaccuccaucuucucc

SEQ ID NO: 437551 - RNA, 64 nt, Human
ccgcccgacuugcagaccuagguugagcagagcuccaccgcagucccgggugucugcggccgca

SEQ ID NO: 437552 - RNA, 64 nt, Human
cccaaacucugcaccucuuccucagcugcuccagaccggccaggguaaccagcuaaccaugccu

SEQ ID NO: 437553 - RNA, 64 nt, Human
ccagaagaccuuugcaaguuugccaccaguagauaccggccacaggcucgacaaauaguggucu

SEQ ID NO: 437554 - RNA, 64 nt, Human
cugagaauuucucccaucuuggccucuuccagaaaccggccaggcaaggaaagaggccggucac

SEQ ID NO: 437555 - RNA, 64 nt, Human
gauuaaucgauuccuuuauguuuuauaagaguuuaccggccaaagcauauugucaucuuugguc

SEQ ID NO: 437556 - RNA, 64 nt, Human
ugagguuagaguccauuuacaaagcugccaggaaaccggccacuucuaguaaaccacgucgugc

SEQ ID NO: 437557 - RNA, 64 nt, Human
gcuuaguuuccccaggacuggccuaggaaggagcaccggccacagcugcuccccgugccacuca

SEQ ID NO: 437558 - RNA, 64 nt, Human
cccagcuagcuggccagguggggaggggcuggggaccggccaggaaggaggggugacuucaucc

SEQ ID NO: 437559 - RNA, 64 nt, Human
caaaauguguggcccuguccccaagcucagcaccaccggccaugaccagagguugcucggccca

SEQ ID NO: 437560 - RNA, 64 nt, Human
ccugggcuuguugcagauggugguggccuggggcaccggccaggugggccucgguggcgaggug

SEQ ID NO: 437561 - RNA, 64 nt, Human
aacguuugucucugacaagaucagcuguaggcucaccggccagagaagaccacugugagcauuu

SEQ ID NO: 437562 - RNA, 64 nt, Human
gaaaagcaggggaaacccaaggcuuugccugcagaccggccacucugugacaacucuaccaaaa

SEQ ID NO: 437563 - RNA, 64 nt, Human
aaaauccacuaguccuaaaccggaagaggaugacaccggccauggguuaacguggcuccucagg

SEQ ID NO: 437564 - RNA, 64 nt, Human
ugucccuguugcccacugcacugaucaugaagccaccggccacugccacgcauguugcaccugu

SEQ ID NO: 437565 - RNA, 64 nt, Human
ccaugagauggggcccucaccaaaugccuuggccaccggccagcagcccucugugaugugugug

SEQ ID NO: 437566 - RNA, 64 nt, Human
uggcuugacugggcucagccacugagcugccucaaccggccaaggaacgggauuaugaugacua

SEQ ID NO: 437567 - RNA, 64 nt, Human
aucuagggcuguauuguuguccacugcaguaggcaccggccacaugugacugcuggcaugaaau

SEQ ID NO: 437568 - RNA, 64 nt, Human
uggccucccagagugcugggauuacaggcgugagccaccgcacccggccucuguguagcuuuua

SEQ ID NO: 437569 - RNA, 64 nt, Human
ccagaugggccuuggucacacuccuuggcuucucccaccgcaagcaacgcugccugccucugcc

SEQ ID NO: 437570 - RNA, 64 nt, Human
augaggcagccagccccuggcaggggcgacugugccaccgcaggcagcgcuccagucgggaaug

SEQ ID NO: 437571 - RNA, 64 nt, Human
ucaguggcuggugguggaccuggagaguggaggcaccggccaggcaggggggcaggggagcuca

SEQ ID NO: 437572 - RNA, 64 nt, Human
agaagggugggcaguuaucacuggggaagagaggaccggccaccuguccagcaugggcuccaga

SEQ ID NO: 437573 - RNA, 64 nt, Human
ucggcuuccuuccucucugcaaugaccuucaacaaccggccaccagaugucgcccuacucaccu

SEQ ID NO: 437574 - RNA, 64 nt, Human
aggucagagcgggucugauggggagcuccgucucaccggccacccgccgucaccauggcagaug

SEQ ID NO: 437575 - RNA, 64 nt, Human
ucgggaagacaccgugcccgccccaagagcaagcaccggccaugcugcagaggcaagaccucaa

SEQ ID NO: 437576 - RNA, 64 nt, Human
auugugaacugguuacuuucugucucugugcucuaccggccaaacaagggguuuggaccagacc

SEQ ID NO: 437577 - RNA, 64 nt, Human
cucugcccaggagaggggccgacccuccucgggaaccggccagccgcguggcucccagcaucca

SEQ ID NO: 437578 - RNA, 64 nt, Human
uuacagggacccaaucaauucacaaugagaaauuaccggccaggcguggugacucacgucugua

SEQ ID NO: 437579 - RNA, 64 nt, Human
ccuggacucuagccccugaccccagacucccgagaccggccaaagccaagccagccccacccuu

SEQ ID NO: 437580 - RNA, 64 nt, Human
aacccuggcugcacagucccuuugacgauaguccaccggccacccaggccugucuggggacaug

SEQ ID NO: 437581 - RNA, 64 nt, Human
aagguccccucucaguccccuucccuacacccugaccggccacugccgcacacccacccagagc

SEQ ID NO: 437582 - RNA, 64 nt, Human
acacgccggccagcccggccuacgcccaguacccaccggccaccuaugaccaguacccauacgc

SEQ ID NO: 437583 - RNA, 64 nt, Human
ccccagggaaaugggcucugggcuggcugccugcaccggccaugucgacccaggacccggacac

SEQ ID NO: 437584 - RNA, 64 nt, Human
ucuuggggcuacaguaguggguaaacaaaugcccaccggccaagaggccauuaacaaaucgucc

SEQ ID NO: 437585 - RNA, 61 nt, Human
gcuggauccacuucaucugagccgcgcggggaccggccaccuggagccuccacaccuaagc

SEQ ID NO: 437586 - RNA, 64 nt, Human
gagcuuagggucucagggugucccagaccccgacaccggccaguggcggaagugaccgcaccuc

SEQ ID NO: 437587 - RNA, 64 nt, Human
ugggaggcagagguugcagugaaccgagaucaugccaccgcacuucagccugggugacagagaa

SEQ ID NO: 437588 - RNA, 64 nt, Human
cggacucccaaagugcugggauuacaggugugagccaccgcaccuggccuaaaccagauuucuu

SEQ ID NO: 437589 - RNA, 64 nt, Human
cuuagccucccaaagugcugggauuaggugugagccaccgcaccuggccgauauuuucuuuaau

SEQ ID NO: 437590 - RNA, 64 nt, Human
ggagcgccucccuauguugccugccacucugggcaccggccagcacccucuggugagaagaggu

SEQ ID NO: 437591 - RNA, 64 nt, Human
gggucuccagccccaguccagaguugggcaccacaccggccagcaucuuccgcacaccccugca

SEQ ID NO: 437592 - RNA, 64 nt, Human
cuccuccagccccgcccucuccucauugcccagaaccggccacaccgcugaaggccaaagaggc

SEQ ID NO: 437593 - RNA, 64 nt, Human
ucucucuuuuguacucugugccuuuauuucucaaaccggccaacacuuagggaaaauagaaaag

SEQ ID NO: 437594 - RNA, 64 nt, Human
gagccacagacgcccgagacccacgccgggcgggaccggccagggaucacccccgccgacggcc

SEQ ID NO: 437595 - RNA, 64 nt, Human
cuggagaugcgugcccccggcggcuacccgcuggaccggccacucuccccagcccccuugcuuc

SEQ ID NO: 437596 - RNA, 64 nt, Human
acacgcgugauugacccuuuaacuguauccuuaaccaccgcauaugcaugccaggcugggcacg

SEQ ID NO: 437597 - RNA, 64 nt, Human
gcauaccccggccucucaguucuugagggccuccccaccgcagcagcaaggaaagcucacgaac

SEQ ID NO: 437598 - RNA, 64 nt, Human
ugagaggaacuucuagucagaugaccuugcagaaccaccgcauuccacccugcccuuuggggag

SEQ ID NO: 437599 - RNA, 64 nt, Human
uccccaaagagaugagcuuuuggggcacaacaucccaccgcagucccccucacccgacaacacc

SEQ ID NO: 437600 - RNA, 64 nt, Human
ucccuaaaacuuguuuucuccuauucacuacuccccaccgcacuuaaaaucuaugaguuuuuac

SEQ ID NO: 437601 - RNA, 64 nt, Human
cggcgucuuaguuuauuuaaacgcuuaacaucuuccaccgcaacagcuugccucuagaggggga

SEQ ID NO: 437602 - RNA, 64 nt, Human
cggcuucccaaagugcugagauuacaggugugagccaccgcacccggccaacuuucugaaauuu

SEQ ID NO: 437603 - RNA, 64 nt, Human
agccuccuuaaagugcugggauuacaggcaugagccaccgcacccagccgcuuuuuaaaauuuu

SEQ ID NO: 437604 - RNA, 64 nt, Human
guagauugaccggcuuuagacgcccaccccccacccaccgcaagcuuugagugggacaccauuc

SEQ ID NO: 437605 - RNA, 64 nt, Human
cagauaccuauuauuuuacacaauuugaccuauaggaggacacugaguaauuuacaaacacaac

SEQ ID NO: 437606 - RNA, 64 nt, Human
uguuuuggggaggaguuuuagggcuuggggagagggaggacacaucuggaggaaauggccuucu

SEQ ID NO: 437607 - RNA, 64 nt, Human
uccuccccagcugaccagaaccaggcugagcgcaggaggacaggcaccaccggaugccacacca

SEQ ID NO: 437608 - RNA, 64 nt, Human
ugggcucgcugaaccucgaggaacuccaggacgaggaggacaugggacuugcguggacagucag

SEQ ID NO: 437609 - RNA, 64 nt, Human
uggaaaacuucuuacuccauaccuuguucgauauggaggacaaauaauuggauugucugauaag

SEQ ID NO: 437610 - RNA, 64 nt, Human
cuucaacugauucagcaaggcccgcccacauuugggaggacagucugcauuacucagucuacug

SEQ ID NO: 437611 - RNA, 64 nt, Human
ggagggaggagccaaccuugcugccugcgacccuggaggacagccugacucccuggaccugccu

SEQ ID NO: 437612 - RNA, 64 nt, Human
cuccgccuccagggcgcagccuccugaguagcugggaggacaggcauaugccaccacaucacug

SEQ ID NO: 437613 - RNA, 64 nt, Human
auaggguggggcaaugugucauucugcauuggaaggaggacauuuuagagcaaggccuaagggc

SEQ ID NO: 437614 - RNA, 64 nt, Human
uaaaaaguuugcccuggaugucauauuggcaguuggaggacacaguuucuauuguaaauuugga

SEQ ID NO: 437615 - RNA, 64 nt, Human
agaucugguauuuccuggccuaaauuccccuuggggaggacagggagaugcugcaguuccaaaa

SEQ ID NO: 437616 - RNA, 64 nt, Human
acccccgacccuccacccaggggucuccccaucgggaguggagguguugguccuggaagcugac

SEQ ID NO: 437617 - RNA, 64 nt, Human
gaacagaaaccacaaguguccagcccucggugcuggaguggacguuaauugucagccaccagac

SEQ ID NO: 437618 - RNA, 64 nt, Human
ucaugccaaaaaaauccaaaacaaagaaguaccuggaguggagagaguauuccugcugaaacgc

SEQ ID NO: 437619 - RNA, 64 nt, Human
acaugguucaggcccuuggugugagagcccagggggaggacagcuugucugcugcuccaaauca

SEQ ID NO: 437620 - RNA, 64 nt, Human
augcuacaugaaauguaaaagggagcccagaaauggaggacauuucauucuuuuuccugagggg

SEQ ID NO: 437621 - RNA, 64 nt, Human
gucauagaccaaagucugcuguagaacaaauaugggaggacaaagaaucgcaaauucuucaaau

SEQ ID NO: 437622 - RNA, 64 nt, Human
cucacggaccacucgaggccugcaaaccuuccugggaggacaggcaggccagauggccccucca

SEQ ID NO: 437623 - RNA, 64 nt, Human
uggcccacugagccaccgcgcccuccugcccacgggaggacaagcaauaacucucuacaggaau

SEQ ID NO: 437624 - RNA, 64 nt, Human
cagugucucgggcacucuaaauauugaguguuauggaggacacagagguagcagaaucccaguu

SEQ ID NO: 437625 - RNA, 64 nt, Human
auauucagguggccagaagagcuugucagcaagaggaggacagaauucucccagcguuaacaca

SEQ ID NO: 437626 - RNA, 64 nt, Human
cucugcucgucgggggcugggagauguuccuggaggaggacacucccaucagaacuuggcagcc

SEQ ID NO: 437627 - RNA, 64 nt, Human
gggcucugcccgcugggggccugaagacauuccuggaggacacucccaucagaaccuggcagcc

SEQ ID NO: 437628 - RNA, 64 nt, Human
uccuggcacugcccuguggacucagcccagcuggggaggacauggcgcccggugcccuaggagc

SEQ ID NO: 437629 - RNA, 58 nt, Human
gcggaaaccagggucacugagcuacagaggaggacaugcccugggauguaguaguauc

SEQ ID NO: 437630 - RNA, 63 nt, Human
uguucucuuugcaguacugaagauaacagccagggaggacaagcagggcugggccuagggaca

SEQ ID NO: 437631 - RNA, 64 nt, Human
aggaccuugcagaggacgaagaggaggaggaugaggaggacacagaagauggcgucagcuucca

SEQ ID NO: 437632 - RNA, 64 nt, Human
ucucuugugcugugccuaguggcaccugggcuggggaggacacugccccgucuagguuuuuaua

SEQ ID NO: 437633 - RNA, 64 nt, Human
gacccuggcgucccuccaggccuugccuccugcgggaggacaguuuggcuucacuucucugacc

SEQ ID NO: 437634 - RNA, 64 nt, Human
cucguucuguagcguuuguacauaauaaaacaauggaguggagacagcucaggcucgcguguaa

SEQ ID NO: 437635 - RNA, 64 nt, Human
cuuguggaggcagguucuugggcugcuacuccagggaguggauggaauccuugguccccuaggc

SEQ ID NO: 437636 - RNA, 64 nt, Human
uggcuacaacuugaggagaaaaaucacccccaaaggaguggacauuuccuaacaauucuguaug

SEQ ID NO: 437637 - RNA, 64 nt, Human
uaacucaaaucuuucaagccccgccucuccucuuggaggacagggcagccugcagcugugucca

SEQ ID NO: 437638 - RNA, 64 nt, Human
ugcuggucaaguuguaaauuaguauagcuacuuuggaggacaauuguaaaauuuaaaucauauc

SEQ ID NO: 437639 - RNA, 64 nt, Human
cuaaccaauacauugaauguaugaugacuauuugggaggacacauuuauguacccagaggcccc

SEQ ID NO: 437640 - RNA, 64 nt, Human
agcugucauuacagacaacagguuucagugaugaggaggacaacacugccuuucaaacuuuuua

SEQ ID NO: 437641 - RNA, 64 nt, Human
acucaccucccuuccccucugcaggccgacggcaggaggacagucgggugaugguguauucugc

SEQ ID NO: 437642 - RNA, 64 nt, Human
ucaccccgucauugggcaccgcugacuccagcauggaggacaccagggagcagggccugggccu

SEQ ID NO: 437643 - RNA, 64 nt, Human
aaagcaagaagaaaagacagcagcaucaagaggaggaggacaucuuggauguaagggaugagaa

SEQ ID NO: 437644 - RNA, 64 nt, Human
uaugcuacugauaggaccaggaagagaggaacucggaggacaauagggaggggaagucuuggaa

SEQ ID NO: 437645 - RNA, 64 nt, Human
acuacacuaguccauaagcuuuacccacuaacugggaggacauucugcuaagauuccuuuuguc

SEQ ID NO: 437646 - RNA, 64 nt, Human
augccaugaaauguacuguauuguauauuacuugggaggacacuagguuuucaaagaagucugg

SEQ ID NO: 437647 - RNA, 64 nt, Human
ucaccgugcccagcacccgaagugccaaauuccaggaggacaagagccuuagccaaugacaacu

SEQ ID NO: 437648 - RNA, 64 nt, Human
acacucucgggguugucugcaggagagcaagccaggaggacaugggccuggacgacacggccuc

SEQ ID NO: 437649 - RNA, 64 nt, Human
agagggagguagaagccaucauggagggcgacgaggaggacagaggcugcugcugcugcaaacc

SEQ ID NO: 437650 - RNA, 64 nt, Human
gcacaguggcucacgccuguaaucccagcacuugggaggacaauguggguggaucacgagguca

SEQ ID NO: 437651 - RNA, 64 nt, Human
uaagugcugaacuuauuuuucaaccauuucacaaggaggacaaguugaauggaccuuuuuaaaa

SEQ ID NO: 437652 - RNA, 64 nt, Human
ugcagcagcugagggggugcccuggcacuggcugggaguggagaggcacuguggugaaauggcu

SEQ ID NO: 437653 - RNA, 64 nt, Human
aggagguuccugcucuggcaggucuaggcggaagggaguggagauggggcugguuccugcugca

SEQ ID NO: 437654 - RNA, 64 nt, Human
gcucuguauucugcaacagccuguuugggaggcuggaguggaaacaaagggugggcaucaaaga

SEQ ID NO: 437655 - RNA, 64 nt, Human
caaccccuggggaagacauuugcaacugacuuggggaggacacagcuucagcacagccucuccu

SEQ ID NO: 437656 - RNA, 64 nt, Human
gcccugggcuugccaccagcucugcccuggcuggggaggacacucggugccccacacccaguga

SEQ ID NO: 437657 - RNA, 64 nt, Human
auaaaacauuaagcggcuguuaaaagaaauaaaaggaggacacgucucugugcacuggugugga

SEQ ID NO: 437658 - RNA, 64 nt, Human
uauugcgaaugugcagaaagcaacaguuacggagggaggacaucauaaggaaguuauuaacggg

SEQ ID NO: 437659 - RNA, 64 nt, Human
uugauaaguauaugccaaaaaaugaagccgggaaggaggacaaggcccauggguggguguugag

SEQ ID NO: 437660 - RNA, 64 nt, Human
gcagagccccccaggacaggagcaacugucucagggaggacagaggaaaacaucacaagccaau

SEQ ID NO: 437661 - RNA, 64 nt, Human
agugaggaggaagggaaggcgguucagagauguuggaggacaccccucgccaucucgcccuugc

SEQ ID NO: 437662 - RNA, 64 nt, Human
cccgugaggagggggagaaggguuagacaagccuggaggacaaaacagcgggagugugggggug

SEQ ID NO: 437663 - RNA, 64 nt, Human
ucugagccuuaguuucagcugaccagaaguggcaggaggacagguggaggcgagccagauuagg

SEQ ID NO: 437664 - RNA, 64 nt, Human
cccuggcggguaaauuaggaaucugcacuauuuuggaggacaaguagcacaaacuguauaacgg

SEQ ID NO: 437665 - RNA, 64 nt, Human
uuagccaggaacgugcuuguuaaugaguaugucuggaggacagaccugcucauuaggugugcug

SEQ ID NO: 437666 - RNA, 64 nt, Human
uagaugugcaaacaagcgauugaguugggcuuuaggaggacacaucauaggagagaauccaggg

SEQ ID NO: 437667 - RNA, 64 nt, Human
aaaagcccagguucuuaaaacacgagaguucuagggaggacagcaaauggagccauucugauuc

SEQ ID NO: 437668 - RNA, 64 nt, Human
ucccagugggcauuuuuuccccuuucaggauguaggaggacauguauaguaugucaaaaacugc

SEQ ID NO: 437669 - RNA, 64 nt, Human
aagaagauucauuuaagucaggguuaccccaucaggaggacauggcacuaucuuuaaacgaaac

SEQ ID NO: 437670 - RNA, 64 nt, Human
cuuuuuuugagacggcgcaccuaucacccaggcuggaguggaguggcacgaucuuggcucacug

SEQ ID NO: 437671 - RNA, 64 nt, Human
uguguuacgggauggcuugugaaaauuauaggggggaguggaaaaccccucaagcuauugccug

SEQ ID NO: 437672 - RNA, 64 nt, Human
caaggacacgucauuguacccugagcguccccagggaguggaaauggggaagggggccuggaga

SEQ ID NO: 437673 - RNA, 64 nt, Human
uccagacaccaucaccacgcagagaggggaggugggaggacaguuagaccccugggugggcccu

SEQ ID NO: 437674 - RNA, 64 nt, Human
ugggcagggguagaauggaaggagaggcggcuggggaggacaggugguggagggccuuggcuuc

SEQ ID NO: 437675 - RNA, 64 nt, Human
auaggaccuaauguagcacagcgggacucaaagaggaggacauuuucucuugccagugcacugg

SEQ ID NO: 437676 - RNA, 64 nt, Human
auacccagccuaaguguugcccugcacuauggcuggaggacacauuugguagaggucacacugc

SEQ ID NO: 437677 - RNA, 64 nt, Human
cauaugucaaggagcacuugcaggcagaaugggaggaggacauggagcugauggaguccaggcu

SEQ ID NO: 437678 - RNA, 64 nt, Human
uguguccuauggaauccaguucugaagaggugggggaggacaacugugggaaaagcccuggggg

SEQ ID NO: 437679 - RNA, 64 nt, Human
acgcuuguucagccuuaaugugacuugaagauguggaggacaucaacuuugaaaaacuuuccau

SEQ ID NO: 437680 - RNA, 64 nt, Human
auuuccagccaucaccuuugguggggugggcuucggaggacagucugucugaaccugccagugc

SEQ ID NO: 437681 - RNA, 64 nt, Human
gaaugugcauuuuauuaauuccuuaggggcacaaggaggacaauaauagcugaucuuuugaaau

SEQ ID NO: 437682 - RNA, 64 nt, Human
gggagaagccgugugcucuucauuauuuucagcuggaggacagagcucagugccugacugccua

SEQ ID NO: 437683 - RNA, 64 nt, Human
uggaauguugagagugugguuacgaaauacguuaggaggacaaaaggaauguguaagucuuuaa

SEQ ID NO: 437684 - RNA, 64 nt, Human
aaauaacuguuaguaaguugaaggauauuggacaggaggacaguauuucagaaaaggagagguu

SEQ ID NO: 437685 - RNA, 64 nt, Human
cacuguccugugccacauggcuggacuccagccaggaggacacacggugagggcuccaggugga

SEQ ID NO: 437686 - RNA, 64 nt, Human
aacaggaaaaccacccacagcugaccggcucgguggaggacacuccugggacaggucucuuugu

SEQ ID NO: 437687 - RNA, 64 nt, Human
uaacugggcacucggaggccuuggcacggguucuggaggacagacagcaauucuaugagugcuc

SEQ ID NO: 437688 - RNA, 64 nt, Human
uccucaucugaucccccauagguggcugagcaucggaguggaguucguggggaacugcguggug

SEQ ID NO: 437689 - RNA, 64 nt, Human
aaauaaguagagaaaguuuuaaacugcagaaauuggaguggauggguucugccuuaaauuggga

SEQ ID NO: 437690 - RNA, 64 nt, Human
ucugacaucucuugacaugcccgugggugggaugggaguggaggguucauaugaguuauugaga

SEQ ID NO: 437691 - RNA, 64 nt, Human
agcucuucacgcucuaccugcugcuucaugagcgggaggacagcuucuacagccagggcauugc

SEQ ID NO: 437692 - RNA, 64 nt, Human
ggguuaggcccagccuugaugccauaugccuuggggaggacaaaacuucuugucagacauaaag

SEQ ID NO: 437693 - RNA, 64 nt, Human
gagaauaacauagcugugcuauugcacaucuguuggaggacaucccagauuugcuuauacucag

SEQ ID NO: 437694 - RNA, 64 nt, Human
ccaucaaugccugagggcagcugccagggccuguggaggacaggccagagaggaggccagcagg

SEQ ID NO: 437695 - RNA, 64 nt, Human
gggcuguuaccuuccucagggcuuagggagggagggaggacauggacagggccuuccacccugg

SEQ ID NO: 437696 - RNA, 64 nt, Human
gacaaagccuuacaaacucacuaugaagguaaagggaggacagcuugcuucuuugcccagacau

SEQ ID NO: 437697 - RNA, 64 nt, Human
aagggugggagagggcacaugggcuugagaguggggaggacacagucuggacuugauccugcua

SEQ ID NO: 437698 - RNA, 64 nt, Human
ucuccaaggcauuuccacacuauugguggcaccuggaggacaugcaccaaggcuugccagagcc

SEQ ID NO: 437699 - RNA, 64 nt, Human
augaaauauaguugcauauauggacaccgacuugggaggacagguccugaauguccuuucucca

SEQ ID NO: 437700 - RNA, 64 nt, Human
ggccagggcugcugccugccagccuggggucccuggaggacaggucacaucugaucccuuuggg

SEQ ID NO: 437701 - RNA, 64 nt, Human
uaucucugucugcccauaucaaaauuauaaaugaggaggacagcaggccccaagaaaguaggga

SEQ ID NO: 437702 - RNA, 64 nt, Human
caugagcuauggagucagauaguuguugggagggggaggacaagaagucuauuguuuggacugu

SEQ ID NO: 437703 - RNA, 64 nt, Human
cgaggaaugugguggccacgcgauggagcuggccggaggacaggucaggugagggggccgaccc

SEQ ID NO: 437704 - RNA, 64 nt, Human
uuuugagacagagucucacucuguugccuaggcuggaggacaguggcacaaucauggcugauug

SEQ ID NO: 437705 - RNA, 64 nt, Human
uaaccaagucagcccaacaggcaggugccggaggggaggacagggaacaguauuuccacuuguu

SEQ ID NO: 437706 - RNA, 64 nt, Human
cauuguaaguuauucugccaccaccuaacaggacggaguggagugaguuuggauaaacggaccg

SEQ ID NO: 437707 - RNA, 64 nt, Human
uguccacauguccauuuuucagguucucuaaguuggaguggagucugggaaggguugugaauga

SEQ ID NO: 437708 - RNA, 64 nt, Human
gaaccguuucugcacuaaucuucuccacgggcacggaguggagggaacgucuugggaaagggga

SEQ ID NO: 437709 - RNA, 64 nt, Human
agguuggaaauacagccuuacucucucuagagcuggaggacagguuugugguugaggacuucuc

SEQ ID NO: 437710 - RNA, 64 nt, Human
gugaacuggggaucuuugguagccguccaugucuggaggacaagucgacaucaccauguguuac

SEQ ID NO: 437711 - RNA, 64 nt, Human
uccuuccagagcccaagaucaaugcucaaguuuuggaggacaugaucaccauccccaugguacu

SEQ ID NO: 437712 - RNA, 64 nt, Human
agcaggcucagcccccuggaagaugagcucaaggggaggacaggccuugggagggcaggcguuu

SEQ ID NO: 437713 - RNA, 64 nt, Human
caccugcaccccacucccaaguagcuugaaaaagggaggacagucuuuccccagcaggggucag

SEQ ID NO: 437714 - RNA, 64 nt, Human
gggugacaccaggacacaggaauagguucugucgggaggacagugcugaucgugucucagcauc

SEQ ID NO: 437715 - RNA, 64 nt, Human
acacgugccauccccaccccggugcuccagggaaggaggacacggacccgacgugggagguccu

SEQ ID NO: 437716 - RNA, 64 nt, Human
gggacagcacaauguuagggauuuuugucuuaaaggaggacaagcauugcuaccaaccgccuca

SEQ ID NO: 437717 - RNA, 64 nt, Human
ugaggggugccagcgugggugggcuucucaggcaggaggacaucuuggcagugcuggcuuggcc

SEQ ID NO: 437718 - RNA, 64 nt, Human
aaagcagccccuuguaagcagcucugagucuuuuggaggacagggacgguuuguggcugagaua

SEQ ID NO: 437719 - RNA, 64 nt, Human
gggagaguaggagagaccaugaguauguguaacaggaggacacagcauuauucuagugcuguac

SEQ ID NO: 437720 - RNA, 64 nt, Human
aagcgcagcagcgggagcuaggggcgggggcggaggaggacacgaacuggaaggggguucacgg

SEQ ID NO: 437721 - RNA, 64 nt, Human
cacuggaccccacuggcugagaaucugggggugaggaggacaagaaggagaggaaaauguuucc

SEQ ID NO: 437722 - RNA, 64 nt, Human
ugaggggucaggguuuaggaggguguguauguugggaggacaggcuaguugaucuguccuacuc

SEQ ID NO: 437723 - RNA, 64 nt, Human
gaggagggagcccgcucaggauggccugggcaggggaggacaucucuagagggaagcucacagc

SEQ ID NO: 437724 - RNA, 64 nt, Human
ucugugcagggcacagaaggcugggguggggggaggaguggauuccuccccacccugucccagg

SEQ ID NO: 437725 - RNA, 64 nt, Human
uguccccagguaaguaugugaugagcaaugaggaggaguggaaaacaaaacccagaaagugcgg

SEQ ID NO: 437726 - RNA, 64 nt, Human
uaaguggaagugggugaauucuacuuuuuauguuggaguggaccaaugucuaucaagagugaca

SEQ ID NO: 437727 - RNA, 64 nt, Human
ugcuuauaauguguguugugugagcguggccuugggaggacaugcgugugucagggaugaguug

SEQ ID NO: 437728 - RNA, 64 nt, Human
ggagccagacaugagguccugcacgaggguguugggaggacaccacagauucaucucagacagu

SEQ ID NO: 437729 - RNA, 64 nt, Human
cuuccuuguacaggguggugagccgccugccaguggaggacagcaccccucagcaccacccacc

SEQ ID NO: 437730 - RNA, 64 nt, Human
gggaggaaaagccugggaguggggggccucgucgggaggacaggagaccgcugcugcugcugcc

SEQ ID NO: 437731 - RNA, 64 nt, Human
agcucagggcacccagugucuuaaggaaccauuuggaggacagucugagagcaggaacuucaag

SEQ ID NO: 437732 - RNA, 64 nt, Human
agugcauuugcuuuauaagugaggguagggugagggaggacaggccaguagggggagggaaagg

SEQ ID NO: 437733 - RNA, 64 nt, Human
ucugggugagauuaaggugcagggccugggggcaggaggacauaagguauagccauaaaucaua

SEQ ID NO: 437734 - RNA, 64 nt, Human
ggggugcuuccuccucaggcccagcugcuccccuggaggacagagggagacagggcugcucccc

SEQ ID NO: 437735 - RNA, 64 nt, Human
guucucauuugaacuucaccauugugcuaucuagggaggacauauucuuaaguugccuauuaaa

SEQ ID NO: 437736 - RNA, 64 nt, Human
acacucuggugugggaaacacuuuauguagggugggaggacaggggaguuaaauggcugggcag

SEQ ID NO: 437737 - RNA, 64 nt, Human
ggggagauggauaugauagauuacacaguuuauuggaggacaauaagaguuauggcaaaaagca

SEQ ID NO: 437738 - RNA, 64 nt, Human
cuucaccugacuggaucaagcccacuaacaucgaggaggacagucugcauuacucagaguucac

SEQ ID NO: 437739 - RNA, 64 nt, Human
agagagcacagugaucaccagcgugagugguggaggaggacacuuggauuuuuuuuuuuguuuu

SEQ ID NO: 437740 - RNA, 64 nt, Human
gggucuugcagcccccaggcccacagccucguugggaggacaggguggcccuggggacaagagg

SEQ ID NO: 437741 - RNA, 64 nt, Human
uuuuguuucugaucuuguuuucccuguggauauuggaggacagcgagguucuuucugauacuaa

SEQ ID NO: 437742 - RNA, 64 nt, Human
ccaggagcccagccccucuggccaggacugaggaggaguggagggaagcagggagggagggagc

SEQ ID NO: 437743 - RNA, 64 nt, Human
gacaagagaaaaacaaaccugaagcugccgagcaggaguggaugcagccugaucagggucugga

SEQ ID NO: 437744 - RNA, 64 nt, Human
aagagcuuauuuaagagacgcuggagaucucugaggaguggacuuugcugguucucuccucuug

SEQ ID NO: 437745 - RNA, 64 nt, Human
uguauguuacuuuaaagaggauguguguucuaaaggaggacaugagcuguguguuuucaagaga

SEQ ID NO: 437746 - RNA, 64 nt, Human
cgagcaggcacagcacagcagugacucggugaggggaggacacccgacugugcacacuuccagg

SEQ ID NO: 437747 - RNA, 64 nt, Human
aaaaacaaggaaauccuuucaucugugacaaccuggaggacauguuaaguaaaauaagccaggc

SEQ ID NO: 437748 - RNA, 64 nt, Human
ggacacgacggccaagguggcaguuugucccacgggaggacagucguuucuuuuccagccuccu

SEQ ID NO: 437749 - RNA, 64 nt, Human
auaggaaacggaagagacuugguagacgagauaaggaggacaagagaagggacacaccccugag

SEQ ID NO: 437750 - RNA, 64 nt, Human
gacggggcagaugccaggacucagcccauccugaggaggacacguguccucauggagagggugc

SEQ ID NO: 437751 - RNA, 64 nt, Human
aacaucugucacccacuauacccaguuacuugggggaggacagacacuguggugucauuaaagu

SEQ ID NO: 437752 - RNA, 64 nt, Human
uugugccucagccauucuaguuuuguuguguguuggaggacagucuaaugaagacaggauaaau

SEQ ID NO: 437753 - RNA, 64 nt, Human
auccgguucuuggagaaacauaugaauguauucgggaggacaagggcuuccaguuuuuuucaga

SEQ ID NO: 437754 - RNA, 64 nt, Human
gugugugcacucgaugaugcggcccugcaacggaggaggacagugagacgaugccacugcgcca

SEQ ID NO: 437755 - RNA, 64 nt, Human
agcugaucccucaggucugcugcaaacacagcauggaggacacagaugacucuuugguguuggu

SEQ ID NO: 437756 - RNA, 64 nt, Human
gaguggguuaaaggaacuaacaguugucccuuuaggaggacaaaauggggucaagaggacacag

SEQ ID NO: 437757 - RNA, 64 nt, Human
agguuaaauccucaucaagagagaccaggcggcuggaggacaagcggcucuaacccugggggcg

SEQ ID NO: 437758 - RNA, 64 nt, Human
uuucucacaaugcuguaugauacuauuuaaauuuggaggacaacuuaucuucacuaagcugaau

SEQ ID NO: 437759 - RNA, 64 nt, Human
augugcagguuaauaauauuuuuuuaauagugugggaggacagaguuagaggaaucuuccuuuu

SEQ ID NO: 437760 - RNA, 64 nt, Human
agucuagagaacuaggacugcucagccuuauccuggaguggagcauuuagcccaggucuuaauu

SEQ ID NO: 437761 - RNA, 64 nt, Human
uugggaagaaaaguuucuacucagaacuggggaaggaguggaacuuaugacuugggccucuagg

SEQ ID NO: 437762 - RNA, 64 nt, Human
gcuggggguuuucagagcccuauguguggggaggggaguggauuccuucagggcaugguaccuu

SEQ ID NO: 437763 - RNA, 64 nt, Human
uuaccuugacagaaucaugggacuuugagaagagggaggacagaggccucugucgcacuaacgc

SEQ ID NO: 437764 - RNA, 64 nt, Human
guaaaggcugagaugaaguggacugaguagaacuggaggacaggagucgacgugaguuccuggg

SEQ ID NO: 437765 - RNA, 64 nt, Human
gggucuugcuggacgaguguggccuagagcugggggaggacacuccccacgugugcugggagcc

SEQ ID NO: 437766 - RNA, 64 nt, Human
aggccggccugcgcacuugcugccaccagaaacuggaggacaugauccaggagcuucagguugg

SEQ ID NO: 437767 - RNA, 64 nt, Human
aaauccaaagcaucuuugaaaaguccugcgcugcggaggacaggaagcacccccucaauagcca

SEQ ID NO: 437768 - RNA, 64 nt, Human
acgcgggcaagccuaggagaguaggaagagcuguggaggacacacucucaguuuguuuuugacu

SEQ ID NO: 437769 - RNA, 64 nt, Human
accccacuuccuucucggaaggccagcucuucuuggaggacaagacaggaccaaucaaagaggg

SEQ ID NO: 437770 - RNA, 64 nt, Human
cacagaggaugcagcccccagcugcauggaagguggaggacagaagcccuguggauccccggau

SEQ ID NO: 437771 - RNA, 64 nt, Human
aaggaaacucugguacgguggcacccucaggaguggaggacagugaacuuccuugaagagggag

SEQ ID NO: 437772 - RNA, 64 nt, Human
agccucaccuuaugagauucugauucagccagggggaggacaggaaucuguauuuuucauagca

SEQ ID NO: 437773 - RNA, 64 nt, Human
caugaguugcuuccaugaaaucuuaggagucucuggaggacagauuaaaaaccagugaucugua

SEQ ID NO: 437774 - RNA, 64 nt, Human
agcugugguccaccucaaaaaaaaggagcacucuggaggacacguuuucccaccuguuggcucc

SEQ ID NO: 437775 - RNA, 64 nt, Human
aacauauucugaaugugguuucugucuuagaccaggaggacagaguuugcuuucauauuuuccc

SEQ ID NO: 437776 - RNA, 64 nt, Human
aaaggcugcggcagcgccuuucuucuuaaagugaggaggacaaauuugcaaaagaaauaggcuu

SEQ ID NO: 437777 - RNA, 64 nt, Human
aauguacguaaugagcagggugggccccacgcugggaggacacgggcugggcugagcagggccu

SEQ ID NO: 437778 - RNA, 64 nt, Human
uuaaaauguauucaguuauuuaguggcccccacaggaguggagucuugaaaucuaauucuaaau

SEQ ID NO: 437779 - RNA, 64 nt, Human
aggccuaaucauguugugauucucuuuucuuaguggaguggaauguucuauccccacaagaagg

SEQ ID NO: 437780 - RNA, 64 nt, Human
acaguauccuccacugccaagacagccugaguuuggaguggaauaagguggaagacaaaugucu

SEQ ID NO: 437781 - RNA, 64 nt, Human
guucagaugcagccuuccagauuuagaggcacugggaggacaguggcugaguggaggcgcccag

SEQ ID NO: 437782 - RNA, 64 nt, Human
cuccucagccagcagaggcccagggcaagggacaggaggacagggguucuccuucaccacagaa

SEQ ID NO: 437783 - RNA, 64 nt, Human
gacaaaagcugcagugaaaauuuuggacucaaaaggaggacaaugccauccuucauauuccucc

SEQ ID NO: 437784 - RNA, 64 nt, Human
uuugagagggcacugucaacuuggguuuaagacaggaggacauugcaaguucacaccuuucaua

SEQ ID NO: 437785 - RNA, 64 nt, Human
auuccucuuucccaagggcauccuccuugaaagaggaggacagaccucucuggaagcagcaaga

SEQ ID NO: 437786 - RNA, 64 nt, Human
gccaggucaagaaguuuucccucuuuuguggugaggaggacacaggccugggaaaaauaggaac

SEQ ID NO: 437787 - RNA, 64 nt, Human
ugcauugcagguaagucugguuuugucccuuccaggaggacauagccugcaaagcugguugucu

SEQ ID NO: 437788 - RNA, 64 nt, Human
gacacgcucugcugaccacccagagcugggccagggaggacacgcuccacugaccacccagagc

SEQ ID NO: 437789 - RNA, 64 nt, Human
aaugacaauaagguuuucccccauuuugguuucaggaggacaugaauaguguguuuauuguaac

SEQ ID NO: 437790 - RNA, 53 nt, Human
uccuggugcaccucaucuagaagggaggacacaaggacauuggugcuucagag

SEQ ID NO: 437791 - RNA, 64 nt, Human
auggcaauaauagaagauuaugaaggauuucuauggaggacauaaaugcugcaucuuucauaau

SEQ ID NO: 437792 - RNA, 64 nt, Human
uucccaaagcgauacacuugcuuuggucaccagaggaggacagagcuuagagcagcuguggaga

SEQ ID NO: 437793 - RNA, 64 nt, Human
cugggcuggguccuggauuccagggcuauucccuggaggacagucucaguuaugggauaaggcc

SEQ ID NO: 437794 - RNA, 64 nt, Human
uaugugcucagggacgugcuucucuuguaaggcaggaggacagaagaggaccaagaagggaggg

SEQ ID NO: 437795 - RNA, 64 nt, Human
ccaaagaccuugugcccuucccaggagccgcggaggaggacagugagggaggaauggaaacgag

SEQ ID NO: 437796 - RNA, 64 nt, Human
gguggcugcugcaggagcuggugcuguuccugcuggaguggagugucuggggcuccugguacga

SEQ ID NO: 437797 - RNA, 64 nt, Human
gucuuccacacuggugcuaacuggcccaggcacuggaguggaauagaaugcagcuggaggcuac

SEQ ID NO: 437798 - RNA, 64 nt, Human
aggaaugccugugcuggggccagggguucagggaggaguggauggcacagugcugucaucccuu

SEQ ID NO: 437799 - RNA, 63 nt, Human
aggacucacaaacugcaugauggccgcccugccggaggacacuguaguuuuugagaagccugu

SEQ ID NO: 437800 - RNA, 56 nt, Human
gugucauuccccgcucaugaguguguggaggacacccugaaccccccgcuuucaaa

SEQ ID NO: 437801 - RNA, 64 nt, Human
acagucacucugaagauuuugccaacucaugaauggaggacacuucaguagucaucuagauccu

SEQ ID NO: 437802 - RNA, 64 nt, Human
accugcuggagauguaaauuugccaugacuuccuggaggacagcagcauggagaaagauccuag

SEQ ID NO: 437803 - RNA, 64 nt, Human
agguagcggauuuccugcagaacauccuggcucaggaggacacugcuaagggucucgaccccuu

SEQ ID NO: 437804 - RNA, 64 nt, Human
ggguuaaaggaguccgcagcucccacggcugcugggaggacaugguccugcccccuuccuuccu

SEQ ID NO: 437805 - RNA, 64 nt, Human
gggaugcuccuggauggagaggguuugcugcuggggaggacaugggugugugugugacugcagg

SEQ ID NO: 437806 - RNA, 64 nt, Human
gagaagagagcccgcucuccguggggcaccccauggaggacacaguaccagaguuuacagagag

SEQ ID NO: 437807 - RNA, 64 nt, Human
cagcguucugagcagagacacgcagaccagcugaggaggacaaagauaagguggcauucacccc

SEQ ID NO: 437808 - RNA, 64 nt, Human
uugcaaacaaaucuugggaagcgaggagggccggggaggacacuuccggacacgcucuucuaaa

SEQ ID NO: 437809 - RNA, 64 nt, Human
cuccuccgagccuuccuuucacacagaccaccccggaggacacguggaugauggggucagagau

SEQ ID NO: 437810 - RNA, 64 nt, Human
accaucaagggugacaccugcgacgcaaguaccaggaggacauaaccgcuguggccuguuggag

SEQ ID NO: 437811 - RNA, 64 nt, Human
ucugugcagcauccaccccugcggaucccucuggggaggacaggaaggggacucccggagaccu

SEQ ID NO: 437812 - RNA, 64 nt, Human
ugccucuggagaccccagccccagagggcuuuguggaggacaggccuugcccucaagaacgucg

SEQ ID NO: 437813 - RNA, 64 nt, Human
ugcccugagccccgguucugucagggucccuaagggaggacacucagggccuguggccaggcag

SEQ ID NO: 437814 - RNA, 64 nt, Human
uccccugugaugacuggcagcuaaggaggaccucggaguggacccgagccaggaauaacgaaug

SEQ ID NO: 437815 - RNA, 64 nt, Human
cacaggcuggccacagcugggcaaggcucuccguggaguggacucgagucccuggagcaggcag

SEQ ID NO: 437816 - RNA, 64 nt, Human
cagaggagaaggguuuccagaguugcuagguuugggaguggaaggggcaggcagugcacuugcc

SEQ ID NO: 437817 - RNA, 64 nt, Human
ugucuuucguagcagggaaaggauaugacaauggggaggacaguucuuuuggagguuggagggg

SEQ ID NO: 437818 - RNA, 64 nt, Human
ccuucuggucauuuucucagcugguuagaggcugggaggacacgcaaguucagcuccagccgac

SEQ ID NO: 437819 - RNA, 64 nt, Human
ggagguggcaagaguguggaggcugacgugugagggaggacaggcgggaggaggugugaggagg

SEQ ID NO: 437820 - RNA, 64 nt, Human
ugugacaagcucucaaaaaaugcauuucuaaauaggaggacaucaauguauugaugaagagaaa

SEQ ID NO: 437821 - RNA, 64 nt, Human
gaugguggcaugcuggugguggcgggugcuggugggaggacagugccaaccuccuccuggggau

SEQ ID NO: 437822 - RNA, 64 nt, Human
cucagccuccaaaguggagcugggagguagaaggggaggacacuggugguucuacugacccaac

SEQ ID NO: 437823 - RNA, 64 nt, Human
gcaagagcaccccaucuucagguggcggccccucggaggacaagcgcuucucggugguggauau

SEQ ID NO: 437824 - RNA, 64 nt, Human
aauuccccuuuaagaccaaggagauaaggguggaggaggacacgaaagugaacuccaccgucau

SEQ ID NO: 437825 - RNA, 64 nt, Human
aaguuuccaguggucuuauagacuccauguucuuggaggacaggcuguaugucagauuuaccuu

SEQ ID NO: 437826 - RNA, 64 nt, Human
ucgagacuugucucaugccuccaugcuugccgauggaggacagacugcaggaacuuggcccaug

SEQ ID NO: 437827 - RNA, 55 nt, Human
aagaggacuucaggaauugaccccaggaggacaccagauacagacuucagccccu

SEQ ID NO: 437828 - RNA, 64 nt, Human
gagugucuuucccaccagcccuugcccaugguggggaggacaucuggucugagucagagaucug

SEQ ID NO: 437829 - RNA, 64 nt, Human
caggcacaucuuccucccgagugacugccuccuaggaggacauuuaggggagggcagaggccug

SEQ ID NO: 437830 - RNA, 64 nt, Human
cccugccuccacccacaguggagagggcuacaaaggaggacaagacccucucaggcugucccaa

SEQ ID NO: 437831 - RNA, 64 nt, Human
ucacaggaaguggaggagccagaggugccuuuguggaggacagcaguggcugcugggagagggc

SEQ ID NO: 437832 - RNA, 64 nt, Human
uccggaagcugcucuugccauaaucaacucccugggaguggaagccagauggcagcuugagauu

SEQ ID NO: 437833 - RNA, 64 nt, Human
uaggggucuggucuccucagccuccucaucugggggaguggaauaguauccuccagguuuuuca

SEQ ID NO: 437834 - RNA, 64 nt, Human
cccaacugcagcauguucuggaagccucuccauuggaguggaaaggauggcucugggucauuug

SEQ ID NO: 437835 - RNA, 64 nt, Human
cuguucaccuuaaguaacacacaaaucgggaacaggaggacagaaccguuggcauuaucaggau

SEQ ID NO: 437836 - RNA, 64 nt, Human
cuagcuucaggcuacuugguaacuggaagaagcuggaggacagaagcaguacucaacuugcugu

SEQ ID NO: 437837 - RNA, 64 nt, Human
uggaauuagagaauacaaucaaacuuuaccacuuggaggacacgggguuaguccaggaccaaag

SEQ ID NO: 437838 - RNA, 64 nt, Human
aagagaucaagggcucuauucaggaacguuggugggaggacagagcaagugggaaggggguaug

SEQ ID NO: 437839 - RNA, 64 nt, Human
auguuucuuauuguaugucuauauauguauguggggaggacaggagugaauguucacacacuuu

SEQ ID NO: 437840 - RNA, 64 nt, Human
cucccagggagcagagucuucucaucuuuucacuggaggacaggaggcuauggggcccagcuac

SEQ ID NO: 437841 - RNA, 64 nt, Human
guucugcucucucagucaacauguggaaauccaaggaggacaaagacuccagccacgcugcuaa

SEQ ID NO: 437842 - RNA, 64 nt, Human
gaaaucguagagcagugaggcaggcugggagcauggaggacagcuuauggaaaaaguuagggcg

SEQ ID NO: 437843 - RNA, 64 nt, Human
uugcgccaugugggcaucagccacugcugucuugggaggacacuuauccuguucucuuauuucc

SEQ ID NO: 437844 - RNA, 64 nt, Human
caaggagagcggcaggaggggugggaccaggcugggaggacagagccagcagcugccaugcccu

SEQ ID NO: 437845 - RNA, 64 nt, Human
gggugccaccacccucuagccccagggcagccccggaggacaggcaagggccugagaccacugc

SEQ ID NO: 437846 - RNA, 64 nt, Human
gggggcggaagcgggagcgcaaggcugccgucgaggaggacaccucccugucggagagugaggg

SEQ ID NO: 437847 - RNA, 64 nt, Human
guggagaaggagagagaaauaugugagguaguaaggaggacagaaaacagaacagaaaagagua

SEQ ID NO: 437848 - RNA, 64 nt, Human
ucuuguucuuaaaaaagcaagugucuuugguguuggaggacaaaauccccuaccauuuucacgu

SEQ ID NO: 437849 - RNA, 64 nt, Human
gauccaagcaaaacuuuacuuucagcguuggcuuggaggacaaauaagaaaugaaacauccuau

SEQ ID NO: 437850 - RNA, 64 nt, Human
gucagagccacauucccgucacauuauaaaugaaggaguggauucuuaaauaagaccuaaccau

SEQ ID NO: 437851 - RNA, 64 nt, Human
accagagcauaaguuaaguaaguaauugaauauuggaguggagacuuauuugucuaccgaauua

SEQ ID NO: 437852 - RNA, 64 nt, Human
ugagugaaacuugcccucuggcuugauucagacuggaguggauaggauaaggaaccugacuuau

SEQ ID NO: 437853 - RNA, 64 nt, Human
gccaggaauaacgaaugacccaaggccaaggaagggaggacagagaggccccaggagugggugg

SEQ ID NO: 437854 - RNA, 64 nt, Human
gagggagggacacuuacccaaggcucuucuccuuggaggacagugggaacuggagggugagagg

SEQ ID NO: 437855 - RNA, 64 nt, Human
gccuagaagcccugagaaagaacuuaaagagcuaggaggacagaggcccccaagcugaucuggu

SEQ ID NO: 437856 - RNA, 64 nt, Human
cuuagaugugcucuuuggggaagcccaucuaacaggaggacauugguuugggggugcaccuccu

SEQ ID NO: 437857 - RNA, 64 nt, Human
gugugugugggggggggugggggugugggugcauggaggacaaccugcaacucugagcucccua

SEQ ID NO: 437858 - RNA, 64 nt, Human
aacacggaggccaccgagggggcugggccuaucaggaggacacaggcugcagccuggcacccac

SEQ ID NO: 437859 - RNA, 64 nt, Human
gacgugggccugggagauugucccagggccuuguggaggacacgggccgcaccacacagugcuc

SEQ ID NO: 437860 - RNA, 64 nt, Human
augcagcuccuuguggucugguaagaggggugcuggaggacauggacagcgacaaaccugaggc

SEQ ID NO: 437861 - RNA, 64 nt, Human
ugucugccauuacaccagaaggaugccucugauaggaggacaaccaugcaaauugugaaauagu

SEQ ID NO: 437862 - RNA, 64 nt, Human
ugggcaauugagcuguauaggggccaccuugcagggaggacagaaaacuaacauuuuggcccaa

SEQ ID NO: 437863 - RNA, 64 nt, Human
uuagcgacacacuccuuggucuugcuuaccaacuggaggacacuagguagaauaaccgaguaug

SEQ ID NO: 437864 - RNA, 64 nt, Human
caacagguaguuuguggacaggcgccuggugugaggaggacaaaauaaaccguguauuuauuac

SEQ ID NO: 437865 - RNA, 64 nt, Human
guaugaacuaaaaguaagggaaccccggggaaugggaggacaggauuuuucaaggaaccuuuuu

SEQ ID NO: 437866 - RNA, 64 nt, Human
accggccgccucguggagaaggcagugccacgugggaggacaaggccacgccggcagcuuccag

SEQ ID NO: 437867 - RNA, 64 nt, Human
uugggaauuuuauugacacaguaccauuuaauggggaggacaaaauggggcaggggagggagaa

SEQ ID NO: 437868 - RNA, 64 nt, Human
uccaccacagcccuaugagagcuuugccaacucugcgguccaugacuguucccacuuuuaauga

SEQ ID NO: 437869 - RNA, 64 nt, Human
auuuguuuacuaacucuuuaggccacugugcuuugcgguccauuaguaaacuuguguugcuaag

SEQ ID NO: 437870 - RNA, 64 nt, Human
uagcgcccaguuggguggaugccugguggcagcugcgguccacccaggagccccgaggccuucu

SEQ ID NO: 437871 - RNA, 64 nt, Human
ucuugcucuucuaggucccguuucuuccucucuuggaggacaugaaauuauagaaauguugaga

SEQ ID NO: 437872 - RNA, 64 nt, Human
agccaugaaaccagaggcgccaucccauucugccggaggacagccagcggcugcuuuguggaca

SEQ ID NO: 437873 - RNA, 60 nt, Human
acaccauagacaugagcuagggaaggcugaggaggacaggagaagggcccagacacuccc

SEQ ID NO: 437874 - RNA, 64 nt, Human
uggauguuucuucuuugacuauaacaaaaucuggggaggacaaaggugauuuuccuguguccac

SEQ ID NO: 437875 - RNA, 64 nt, Human
auuucacacaaaucagaacuuccuuccccaccagggaggacaacaucuucaugcugugauugaa

SEQ ID NO: 437876 - RNA, 64 nt, Human
aaacacaguguuuuuguaaaguguggucccaacaggaggacaauucaugaacuucgcaucaaaa

SEQ ID NO: 437877 - RNA, 64 nt, Human
ugcaaauaaaagguggugcuaugauauaugcuuaggaggacaguuuuaaugauuguacuugcau

SEQ ID NO: 437878 - RNA, 64 nt, Human
aaccaaaacaccccaacuuggcagcuuuuucuguggaggacagacggccggccggaccucugag

SEQ ID NO: 437879 - RNA, 64 nt, Human
agcuuucuugccagaacugaucucuuuuggugugggaggacaugggguaccaccuacacccaac

SEQ ID NO: 437880 - RNA, 64 nt, Human
cuuuugacaauacuguugguaccuauuacuugggggaggacauguugcagaagaccagaucauu

SEQ ID NO: 437881 - RNA, 64 nt, Human
agggagcaagagaaugcagcuggaaggcacaaggggaggacauuguggcauucagaaacugcag

SEQ ID NO: 437882 - RNA, 64 nt, Human
augcauccagucaguaauaucacugucuguauguggaggacauguucccauggaucauauguga

SEQ ID NO: 437883 - RNA, 64 nt, Human
agccucuugagggagaugagaggccucuuugugaggaggacauuagcuguguggccucucucuc

SEQ ID NO: 437884 - RNA, 64 nt, Human
cagacuugccuugaaaguguuuaaguuauucgacggaggacagaguaugugagccuuugccgaa

SEQ ID NO: 437885 - RNA, 64 nt, Human
gguuuggugauugggaauggaugggggacagugaggaggacacaccagcccauuaguuguuaau

SEQ ID NO: 437886 - RNA, 51 nt, Human
cagcaacaggacuggaaugacgcgguccagggagggcggaggcccaggaga

SEQ ID NO: 437887 - RNA, 64 nt, Human
cacuuggcuuugguguuugcacuuuacagauccugcgguccacgaggggccucaggagaggacg

SEQ ID NO: 437888 - RNA, 64 nt, Human
cgggccucacuccacucgugucugcuuuugugcagcgguccagacaguggcgacugcgcugaca

SEQ ID NO: 437889 - RNA, 64 nt, Human
uccuggugugaugagcaggaucagagugacucugggaggacagggguggggacccagaguuagc

SEQ ID NO: 437890 - RNA, 64 nt, Human
gaaaugcauccacacuuccugccuaucacgguccggaggacaccuuggauagcacgggaggaga

SEQ ID NO: 437891 - RNA, 64 nt, Human
agagaccaaguagccaaacuguaguccuucuaaaggaggacauggcagucaaaaagucugagua

SEQ ID NO: 437892 - RNA, 64 nt, Human
ugauccuaaaagguagccucuucauaggaacccaggaggacaaaaccaccaugcauuaagauuu

SEQ ID NO: 437893 - RNA, 64 nt, Human
ccaaggccuggagcuauucugguaccuuccccauggaggacacugaaaaggcuggguuggggac

SEQ ID NO: 437894 - RNA, 64 nt, Human
acugcgcugugugauguguucuaucuagccuaggggaggacauugccuagagggggagggacug

SEQ ID NO: 437895 - RNA, 64 nt, Human
ggaugguaccuggccccaaaaggaauccuggagaggaggacagugacaacaggugacuucauuc

SEQ ID NO: 437896 - RNA, 64 nt, Human
ccaauugcgagucauguagugugguagaauuaaaggaggacacgagccugcuucuguuaccucc

SEQ ID NO: 437897 - RNA, 64 nt, Human
cacgcugggaauagguuucaacauaugaauugggggaggacacauuuggaccacagcaugaacc

SEQ ID NO: 437898 - RNA, 64 nt, Human
gggacugggcuaggaguuggacggaauggaggauggaggacagcgagaagaaaggaagagaaau

SEQ ID NO: 437899 - RNA, 64 nt, Human
gcagaucccaccagggccgcauccaucucaguguggaggacagugacgggacccucaccauccu

SEQ ID NO: 437900 - RNA, 64 nt, Human
cccacccgcgcccugggacgcagccacgccaggaggaggacacggccgccgagagcaaggcaca

SEQ ID NO: 437901 - RNA, 64 nt, Human
ucggaccccgccucccgagcccggggaggggcggggaggacaaggggcgggcccgcggccucac

SEQ ID NO: 437902 - RNA, 64 nt, Human
acucagcagaagcugguaaaaacauggggagcccggaggacaggcugcuguccagggcagaggc

SEQ ID NO: 437903 - RNA, 64 nt, Human
gugagaaagagagcuucaaccucaagagggcucaggaggacaucucacggcugcggcgcaagcu

SEQ ID NO: 437904 - RNA, 64 nt, Human
gguccaggucccagccccuccucccucagacccagcgguccaaugccaccuagacucucccugu

SEQ ID NO: 437905 - RNA, 64 nt, Human
ccggcugggcccgagggucccaaggcgugcaggggcgguccagaggaggugcccgggcaggggc

SEQ ID NO: 437906 - RNA, 64 nt, Human
cacuuccaggcuugggaggaccauggggcacaaugcgguccagacccugcugcgucucccuucc

SEQ ID NO: 437907 - RNA, 64 nt, Human
ccgaggaggauuucccaguggaggugguggcgguggaggacagcagcgagcuggugacuggaag

SEQ ID NO: 437908 - RNA, 64 nt, Human
cugaagugggaacugagaagucaagauccucccuggaggacaggacugaaaaccuugccaagcu

SEQ ID NO: 437909 - RNA, 64 nt, Human
cacuacccuuggggucugggcauuccccgugucuggaggacagccccccacuguucuccucauc

SEQ ID NO: 437910 - RNA, 64 nt, Human
gcaggacuucucaccagcagucguggggaacggaggaggacauggggagguuguggggccucag

SEQ ID NO: 437911 - RNA, 64 nt, Human
uucuuugcagaccgaacagugaaaagcuuucaguggaggacaaaggagggccucacugugcggg

SEQ ID NO: 437912 - RNA, 64 nt, Human
uccugcccgugguuacuaugaauguauugcuguuggaggacaucucgauccaaagaacagccgu

SEQ ID NO: 437913 - RNA, 64 nt, Human
ggaugaugccagccccggauccgggcugcucucuggaggacaguuucuguaccacaccagggcc

SEQ ID NO: 437914 - RNA, 64 nt, Human
gaaaggaaaacgugaaaacacucaaggccuagggggaggacagguugguaaaacaugaaaaggu

SEQ ID NO: 437915 - RNA, 64 nt, Human
ugggagguggcccuaucccuaggcaguggugcuaggaggacagaaggcuauaugggcguggcag

SEQ ID NO: 437916 - RNA, 64 nt, Human
aagaggagaaagugcacugccuuccagcccaggaggaggacagcauuuuguauuuguuccacug

SEQ ID NO: 437917 - RNA, 64 nt, Human
augggcacaaaguauaaauauuuuguuucuuuauggaggacauguggaaggaguuugaggguuu

SEQ ID NO: 437918 - RNA, 64 nt, Human
aggaucaaugaccccuguaaggggccagagccuuggaggacacuaagaggaggcaggaggagca

SEQ ID NO: 437919 - RNA, 64 nt, Human
ccuccuccuuccccaagcugagaagcugagagcuggaggacaauauccagggacauggcucugg

SEQ ID NO: 437920 - RNA, 64 nt, Human
ccagaaaaaugcaagcaaguccacauggagauuuggaggacacugguuaaagaauuuauuucuu

SEQ ID NO: 437921 - RNA, 64 nt, Human
cacugagcaccacuuguccuggaggcuggaugauggaggacaucugguuauagguacuguagca

SEQ ID NO: 437922 - RNA, 64 nt, Human
caagcccuugcccagagcucucuauucuggaagagcgguccagguggggccggggacuggccac

SEQ ID NO: 437923 - RNA, 64 nt, Human
augaaaagcuaggaagcaaccuuucgccugugcagcgguccagcacuuaacucuaauacaucag

SEQ ID NO: 437924 - RNA, 64 nt, Human
ucccccgacuucagcccuuccuaaacccagaccugcgguccaggcaggcacugggcugugccca

SEQ ID NO: 437925 - RNA, 64 nt, Human
accagugguccuuccucucccaauguggccauguggaggacaggaugucuuccuggggguuggg

SEQ ID NO: 437926 - RNA, 64 nt, Human
augaugaaaggaacagaaacaguguuauuagguuggaggacaccgacuaauuugggaaacggau

SEQ ID NO: 437927 - RNA, 64 nt, Human
gugcagaagcggggaaacucaacgguguacgaguggaggacagggacagagcccucuguggugg

SEQ ID NO: 437928 - RNA, 64 nt, Human
cugggaggaaaccagcuccagauggguuuucucuggaggacaagcaguuagaggagaaaaagga

SEQ ID NO: 437929 - RNA, 64 nt, Human
cauccccaggggaauggcagcagugagguagaugggaggacauuucuggucagggaacuggcau

SEQ ID NO: 437930 - RNA, 64 nt, Human
gcaacuaugcccccgaugaggaccaagggcaccuggaggacagcuggaccgguaucugccaucc

SEQ ID NO: 437931 - RNA, 64 nt, Human
gcaugaaccuggaccccuucggcagcuacucagaggaggacauuuggugggcuuuggagcuguc

SEQ ID NO: 437932 - RNA, 64 nt, Human
gaacggaggcccagaguacuagggaaggaggaagggaggacaugccucuucuuccuccuuucuu

SEQ ID NO: 437933 - RNA, 64 nt, Human
ccaagugguuucuaugagcaucucuguuugguaaggaggacaauugucaguuuugagggggaca

SEQ ID NO: 437934 - RNA, 64 nt, Human
cccuuugccccugcuucaucccagcucuguguguggaggacaaagcuucuuccugcguggcucc

SEQ ID NO: 437935 - RNA, 64 nt, Human
cucagggaagauaagagauauggagaugggagggggaggacaaggggcagagaguagggucuag

SEQ ID NO: 437936 - RNA, 64 nt, Human
uucuaaaggucucaaaaggagcaaaguaaaccguggaggacaaagaaaaggguuguuauuuuug

SEQ ID NO: 437937 - RNA, 64 nt, Human
ucuaauuauggcccacagacugccccggagaccuggaggacagcagugcuggcacuuggguguc

SEQ ID NO: 437938 - RNA, 64 nt, Human
cucucuguguucaaacuccuuggagagacgacuaggaggacagcuugccucccaggccccuugu

SEQ ID NO: 437939 - RNA, 64 nt, Human
ugggguggaacugagugugcucuuagcucuaccgggaggacagcugccuguuuccuccccauca

SEQ ID NO: 437940 - RNA, 64 nt, Human
guuggggggucagacuugauacacuuucagguugggaguggacccaccccagggccugcugagg

SEQ ID NO: 437941 - RNA, 64 nt, Human
gcugcugggugagggccuggagauguggaacccuggaguggaagguucuccagugacagugucc

SEQ ID NO: 437942 - RNA, 64 nt, Human
auucauggagcgggaucagauuaccaggaacauaggaguggauuccugccccaaccaaaccgca

SEQ ID NO: 437943 - RNA, 64 nt, Human
ggaugguggagcagcccgggggcugacccaggcuggaggacagggccagccacccucccacggc

SEQ ID NO: 437944 - RNA, 64 nt, Human
caugggcagcaggaccauuuuucagaaucaagagggaggacagugugagaaggcgaugauccaa

SEQ ID NO: 437945 - RNA, 64 nt, Human
cgaagagcugggcaggccugcaggguguggggaaggaggacacaaccucaagaaaggaagcgug

SEQ ID NO: 437946 - RNA, 64 nt, Human
cacaaagaaggugagagagaaggaaaccuugggaggaggacauuacugguuguucuggcugguu

SEQ ID NO: 437947 - RNA, 64 nt, Human
uauucuugguucuccuuucuaacccucaguucuuggaggacaagauaccuggugauuuaaaaua

SEQ ID NO: 437948 - RNA, 64 nt, Human
ugcucccugccccagaccuguuucuucuaagggaggaggacaugguggagaccagggacaggag

SEQ ID NO: 437949 - RNA, 64 nt, Human
accaagaaauaauaguaugaagcggaugcuguuuggaggacaggaaaauuuaucgggaaaauua

SEQ ID NO: 437950 - RNA, 64 nt, Human
gggaccuaauguucucuacaugaacugcucauuuggaggacagcagugagguccugccauagag

SEQ ID NO: 437951 - RNA, 64 nt, Human
uaaugcugaauauauagaauucagaaaauuguugggaggacagcccuuuugugaaccuuguuug

SEQ ID NO: 437952 - RNA, 64 nt, Human
ucaaaauuggggcucuucaguuaaaaagggguggggaggacaaacgugucgaugugcuuuggug

SEQ ID NO: 437953 - RNA, 64 nt, Human
ggccgugccucuuugggggcuaaaggucuuggguggaggacaggccccucugcugugccccuau

SEQ ID NO: 437954 - RNA, 64 nt, Human
ugccccggcccugcuccagaacccagcccagaucggaggacaaguuccucucuagaacccaauc

SEQ ID NO: 437955 - RNA, 64 nt, Human
uuuucaggguuuuuuuuuuuuuuuuuuugcauauggaggacagguggacaugguccugagcucu

SEQ ID NO: 437956 - RNA, 64 nt, Human
cgcugguccugacgcugcccaccgucgccuuccuggaggacaagcugcucuggcaggacucacg

SEQ ID NO: 437957 - RNA, 64 nt, Human
gccaugcagcuacaccuaccggcccugggacgccggaggacagggcauuguccucagucagaua

SEQ ID NO: 437958 - RNA, 64 nt, Human
agaguucaggaacgccgggcacagaccaaagaccgcgguccagccccgcccaggcgggcaucuc

SEQ ID NO: 437959 - RNA, 64 nt, Human
cuaggagaacagucccugggucagcagccaggaggcgguccauaagaauggggacagugggcuc

SEQ ID NO: 437960 - RNA, 64 nt, Human
aucugaucacaauggcaggggacagaaugugcauggaguggagcauguguguguugggaggggg

SEQ ID NO: 437961 - RNA, 64 nt, Human
acagggaacucuccauuauuggggcaggacucagggaggacacuuggggccaugugucuggaga

SEQ ID NO: 437962 - RNA, 64 nt, Human
cauuaccgacauuaggcagaagagugggggguggggaggacaaggggguggguaaggggcucaa

SEQ ID NO: 437963 - RNA, 64 nt, Human
cucugagguguaacgggggugggcucccucccucggaggacaucgucuguguccaggucagaaa

SEQ ID NO: 437964 - RNA, 57 nt, Human
uuccuccacguuugcugugaccaacagggaggacagggccugggacuguucucccag

SEQ ID NO: 437965 - RNA, 64 nt, Human
agcgauucuccugccccagccucccaaguagcugggaggacaggugugagcugccgcacccagc

SEQ ID NO: 437966 - RNA, 64 nt, Human
cucagggacagaucugaugaucccaggaggcucuggaggacaaucuaggaccuacauuaucugg

SEQ ID NO: 437967 - RNA, 64 nt, Human
caugguggcucaugcuuguaaaccugaugcuuugggaggacaaggugguucauuggaggccagg

SEQ ID NO: 437968 - RNA, 64 nt, Human
gggagggcgggcuagaaggccaaaagaaggaugaggaggacaauaauauuuauuuuugcaucca

SEQ ID NO: 437969 - RNA, 64 nt, Human
cgacaggagccacaccagagugugcaggcuucauggaggacagaagcgacuuuugugccgggac

SEQ ID NO: 437970 - RNA, 64 nt, Human
uuuggaggcccugucucuggugguuuuuaggauuggaggacaucaugaagauggaggccuugua

SEQ ID NO: 437971 - RNA, 51 nt, Human
auaccugugaaaaugaauaguggaggacaggucuacaaguaucuacauauc

SEQ ID NO: 437972 - RNA, 64 nt, Human
gcacaggggucacaccuguaaucccagcacuuugggaggacaagguggguggaucacuugaggc

SEQ ID NO: 437973 - RNA, 64 nt, Human
gcugcuugcuucaucaaggcaugcaagccaaaagggaggacagucugcuagcaagauggaaguu

SEQ ID NO: 437974 - RNA, 64 nt, Human
cagugcuagcucugcccuggcucuccuagaagguggaggacagacacaggagaaauaaaaaaag

SEQ ID NO: 437975 - RNA, 64 nt, Human
uggaaugacaaaaacucaaauaaauguaugauuaggaggacaucauaaccuaugaaugauggaa

SEQ ID NO: 437976 - RNA, 64 nt, Human; identical to SEQ ID NO: 303760

SEQ ID NO: 437977 - RNA, 64 nt, Human; identical to SEQ ID NO: 303761

SEQ ID NO: 437978 - RNA, 64 nt, Human; identical to SEQ ID NO: 303762

SEQ ID NO: 437979 - RNA, 64 nt, Human
aaaccggcuagaugaccaucacacagcaaaggagggaguggaagagagaugagaaaauugagag

SEQ ID NO: 437980 - RNA, 64 nt, Human
cugguguugucacaacugccuggaauccgaagguggaggacaggcagccccgcgccccugagac

SEQ ID NO: 437981 - RNA, 64 nt, Human
accguuccuuccaaucccuccacucggguucuugggaggacacucauucuccaggcucggagac

SEQ ID NO: 437982 - RNA, 64 nt, Human
aggugguagaaccacuuggcugcucauuccuucuggaggacacacagucucaguccagaugccu

SEQ ID NO: 437983 - RNA, 64 nt, Human
uuuagggcugaaacacuguggaggcagugguuguggaggacauuucugugagaagucaaaccug

SEQ ID NO: 437984 - RNA, 64 nt, Human
cacacccuaggucagcgugcagagcagugaugcuggaggacacaccauggggugaagccauccc

SEQ ID NO: 437985 - RNA, 64 nt, Human
guggacauuggacaaagaggccauuuuggcugcgggaggacacucugaucucgaagccugccau

SEQ ID NO: 437986 - RNA, 64 nt, Human
uaguugugucuccccagcuagauuguaagcuccuggaggacagggaccaccucuacaaaaaaua

SEQ ID NO: 437987 - RNA, 64 nt, Human
aucagcuuccuggagcaguaaaugaagacagaguggaggacacaaauguacaaaaugcacaaga

SEQ ID NO: 437988 - RNA, 64 nt, Human
ccugcauggagaaggguucugcccugccugaggaggaggacacagcacaagggcacauugccca

SEQ ID NO: 437989 - RNA, 64 nt, Human
ucauuuaacauauaguaggauaguuuaaguguagggaggacaauuauugucugaagcuaaaaug

SEQ ID NO: 437990 - RNA, 64 nt, Human
ugguggccagcagcagcuacaacauggucauccgggaggacaaccagaccaaccgccugcagga

SEQ ID NO: 437991 - RNA, 64 nt, Human
aagcagcaauggcugcaguguccuucucaguuauggaggacaucgucucauuagggaacuuuua

SEQ ID NO: 437992 - RNA, 64 nt, Human
gcccccgcugccucuuucaggaaggagccccuuaggaggacaggccugcagcauccuggucucg

SEQ ID NO: 437993 - RNA, 64 nt, Human
ugguggguggguggugugaguggcaucuuggccuggaggacacgccuggggcagcgugucugug

SEQ ID NO: 437994 - RNA, 64 nt, Human
agcuucaucccgaugucacuccucaacugacuuaggaggacagucuugcuaccccaagucacua

SEQ ID NO: 437995 - RNA, 64 nt, Human
uuauuuuccagaaugacacccgcagcagaauguuggaguggaaaugauggcuggcuaugaagag

SEQ ID NO: 437996 - RNA, 64 nt, Human
ggcucaggccugggagucaguaguuuccuaagagggaguggaggcucggggccacucugggugc

SEQ ID NO: 437997 - RNA, 64 nt, Human
gggaaucugaggggugaugggagagaaggaaccuggaguggaaggagcagaguugcaaauuaac

SEQ ID NO: 437998 - RNA, 64 nt, Human
auuagcaauaaguuaaaccucaucuuguacuaaaggaggacacacucagggagaagaccucugu

SEQ ID NO: 437999 - RNA, 62 nt, Human
aggaggaggagaggaagugaggagaaggaaggggaggacagacguucacacugccacguaug

SEQ ID NO: 438000 - RNA, 64 nt, Human
uuucuuucuucuuugucauuugagaaaggaugcaggaggacaauucccacagauaaucugagga

SEQ ID NO: 438001 - RNA, 64 nt, Human
cacgcugggccgcggccucuggagcugggauuugggaggacacagcaggcagcgcuggccuucu

SEQ ID NO: 438002 - RNA, 64 nt, Human
cucugcaggaaaucagagcuggcagccuccagugggaggacagagccgguuuccguggcaaccc

SEQ ID NO: 438003 - RNA, 64 nt, Human
gucugagcagggcaggugcccaacaccccccaccggaggacacgcugccccucagcgaugcccc

SEQ ID NO: 438004 - RNA, 64 nt, Human
acauacacacauguauauauauauucuucauaauggaggacaauguuuugcaauauauaaauca

SEQ ID NO: 438005 - RNA, 64 nt, Human
gugucuugagaccagccugccaggcccuccagcaggaggacagagugcccuggggcauccaccu

SEQ ID NO: 438006 - RNA, 64 nt, Human
aucggaagagggaaauucagacacagaugcauagggaggacaccaugccgugacagaggcagag

SEQ ID NO: 438007 - RNA, 64 nt, Human
gcuguuggacagguauugggggcaagguugguagggaggacagacugucacuugcuguuacagg

SEQ ID NO: 438008 - RNA, 64 nt, Human
aucagucccuccugcuguugccucccugugaccuggaggacagugugugccaugucucccauac

SEQ ID NO: 438009 - RNA, 58 nt, Human
gggagccugccggcuacugagugcuccaggaggacaaggcugacaagcaauccaggga

SEQ ID NO: 438010 - RNA, 64 nt, Human
gaugcucaagguuccugggcagaccagcaccucuggaggacaauggacaaaaugucucuuagac

SEQ ID NO: 438011 - RNA, 64 nt, Human
cugggcaccaguguuuagcccuggucugcaggaaggaggacagcagacuuuaggaccccacagc

SEQ ID NO: 438012 - RNA, 58 nt, Human; identical to SEQ ID NO: 438009

SEQ ID NO: 438013 - RNA, 64 nt, Human
agccaugccuuuccuuccaucuuuuagggaacggggaguggauccaggacaggggagguuguaa

SEQ ID NO: 438014 - RNA, 64 nt, Human; identical to SEQ ID NO: 437997

SEQ ID NO: 438015 - RNA, 64 nt, Human
ggagggcguggagggcgugggagcgugggaggcgggaguggaguggaagaagagggagaggugg

SEQ ID NO: 438016 - RNA, 64 nt, Human
gccucuagcacccagaaacagggaggguccucgaggaggacacaccagggucucagccuuuugg

SEQ ID NO: 438017 - RNA, 64 nt, Human
uucgcacaacccugaagcccaaagaaacugggcuggaggacagaccucaggagcuuucauuuca

SEQ ID NO: 438018 - RNA, 64 nt, Human
ccuaaaacauuuugccuaaagcucgauggguucuggaggacaguguggcuugucacaggccuag

SEQ ID NO: 438019 - RNA, 64 nt, Human
ugcacagaugucucugauucuuguccuugcagguggaggacagggccugcuccccuaagcuggg

SEQ ID NO: 438020 - RNA, 64 nt, Human
uccacagcuccuuggugguuucaucuccucugugggaggacacaucucugcagccucaagaguu

SEQ ID NO: 438021 - RNA, 64 nt, Human
uugcagcagacaaggucuggguugggcgucugcaggaggacaccuugugggacaucugaggaca

SEQ ID NO: 438022 - RNA, 64 nt, Human
accccuccccaccucugcaggacagacaugggagggaggacagggaaggccaggcuugcucugg

SEQ ID NO: 438023 - RNA, 64 nt, Human
cucuaccuucuccggcaccaggcagccccuuaaaggaggacaaaguguguaaagcccgucugcu

SEQ ID NO: 438024 - RNA, 64 nt, Human
acugacucccauuuccuaaaggaaaugcccccggggaggacauugggaggaagauggccugagu

SEQ ID NO: 438025 - RNA, 64 nt, Human
aacacagaacccucaagacaaggaugacagagcuggaggacacaucuagcugccauugcaaccu

SEQ ID NO: 438026 - RNA, 64 nt, Human
cugagugggccucucaggucacucgugcccugcuggaggacagaggggcaccucagccgccccc

SEQ ID NO: 438027 - RNA, 64 nt, Human
caggauaaguauuuuuacauauuuuaagggugcaggaggacagcagcuaacaaggccaggaaau

SEQ ID NO: 438028 - RNA, 64 nt, Human
gcaccgggccgucucagccguguucccagggcugggaggacagcucuggcccuucuuaggccua

SEQ ID NO: 438029 - RNA, 64 nt, Human
acauguccucucugcuugguguaaaccauucuugggaggacacuuuugccaaugaacucuuucc

SEQ ID NO: 438030 - RNA, 64 nt, Human
gcaucuugcuugugagaaauggggaagaguucagggaggacacgugaccugcacaggaucacag

SEQ ID NO: 438031 - RNA, 64 nt, Human
auacuugaguuuguaauuuuuuuucccccuucugggaguggaggucucaggcucaauccggaac

SEQ ID NO: 438032 - RNA, 64 nt, Human
ucccucccuggaggcugccuccugcccuggaucuggaguggagcugcucugagauuuugaguuc

SEQ ID NO: 438033 - RNA, 64 nt, Human
cagguaauuccuccagagcuguuugcuggcuucaggaguggagugagaauuucuuuuuuaugaa

SEQ ID NO: 438034 - RNA, 64 nt, Human
ccucccucuugccccgucucaucagggagagaaaggaggacagccacagagacacaugucuuac

SEQ ID NO: 438035 - RNA, 64 nt, Human
uaagcaugcacuucauacuagcaaucacagcacaggaggacagcauuaaauuuuauauagccaa

SEQ ID NO: 438036 - RNA, 60 nt, Human
gccugacacgggaagagugacaguagggagggaggacagaccuccaccacacugacauca

SEQ ID NO: 438037 - RNA, 64 nt, Human
gguauccagggaacagaaagcaggaugcaggaugggaggacaggaaggcagccugggacauuua

SEQ ID NO: 438038 - RNA, 64 nt, Human
cacaguucugugauuucuguccuugcuuacauuuggaggacagggacaaggacugagcaaaaac

SEQ ID NO: 438039 - RNA, 64 nt, Human
aagacgaggacagggaggaggaaaaggaggaagaggaggacaaaaagggggaggagaagguucu

SEQ ID NO: 438040 - RNA, 64 nt, Human
uccccacucccgugaugaaacagcuagguuaauaggaggacagaaccaacgggucugugggacu

SEQ ID NO: 438041 - RNA, 64 nt, Human
ccucccuguccccugagguuaaggggaucuaaaaggaggacagggagggaacagaccucggcug

SEQ ID NO: 438042 - RNA, 64 nt, Human
uggccacacacuuccaugugucuuuuugccugcuggaggacacggaccauugaugcacuuggug

SEQ ID NO: 438043 - RNA, 64 nt, Human
gggccggccaggcagggcacccagacggggggcuggaggacacccucaguuugcuccacauggc

SEQ ID NO: 438044 - RNA, 64 nt, Human
ggcagggccagcgggcaggacagggaaacaggggggaggacaauggauacucaguuuuuugugu

SEQ ID NO: 438045 - RNA, 64 nt, Human
guguacuuguuggucuguaucuuaguuucuuuggggaggacagggcuguagcugugaggucuug

SEQ ID NO: 438046 - RNA, 64 nt, Human
caagagacagaagaggagacacagacacagagcaggaggacacguggagacagaggcagacugg

SEQ ID NO: 438047 - RNA, 64 nt, Human
ggccagcucauaaaaagccugaaugccaagccaaggaguggaugccuccagucauauuuagaac

SEQ ID NO: 438048 - RNA, 64 nt, Human
cccugggcucugggagcagcccgcugaguggacuggaguggagcauuggcugagagaccaggag

SEQ ID NO: 438049 - RNA, 64 nt, Human
cggagacagcucucagcaguuuguagccugauguggaguggaggguuccugcacccuacacccg

SEQ ID NO: 438050 - RNA, 64 nt, Human
guugcccaggcuggucucgaacuccugggcucaagcgguccaccugccuccgccucccaaagug

SEQ ID NO: 438051 - RNA, 64 nt, Human
ccugaagaacauggaugggaugcuggugguggaagcgguccacaaccucaaggcugucuucaag

SEQ ID NO: 438052 - RNA, 64 nt, Human
ccccacccccacccccaccaagggcgcaagaguagcgguccaagccugcaacucaucuuucauu

SEQ ID NO: 438053 - RNA, 64 nt, Human
gccucaccagcaggagcgcgugcaagccgggcaggcgguccaccuagacccacagccccucggg

SEQ ID NO: 438054 - RNA, 64 nt, Human
cucguugcacugcuccaagucuggcuguguccaggcgguccauguugaaaauggaggauggcug

SEQ ID NO: 438055 - RNA, 64 nt, Human
uucuacccaaagcauacauagucacugagcaccugcgguccauuuccucuuaaaaguuuuguuu

SEQ ID NO: 438056 - RNA, 64 nt, Human
cccggaggccguuaggcuguggagggcgaggaaggcgguccagaggcggccggcagguccacgu

SEQ ID NO: 438057 - RNA, 62 nt, Human
ggccagcccauagcaugugauuccagauuccugcgguccagccuccaacuuugguugccagc

SEQ ID NO: 438058 - RNA, 64 nt, Human
ucagguauguauuacaggaugggagcccauauaugcgguccaugaaacagauuucaaaggaaaa

SEQ ID NO: 438059 - RNA, 64 nt, Human
gcccuauucagcaccagcuccgcggacaguucccgcgguccaggcgcugucacccuugucagcc

SEQ ID NO: 438060 - RNA, 64 nt, Human
uuuuaauuaaucagucacuuguaaaagcaaacaagcgguccauccccuuuucaaggucacuuuu

SEQ ID NO: 438061 - RNA, 64 nt, Human
gccauccccaucccacaggccugcauaggcagcagcgguccaucuguuuaacagaaaugugcug

SEQ ID NO: 438062 - RNA, 64 nt, Human
uauagaagcccucuacagccugacuuucucuccagcgguccaaaguuauccccuccuuuacccc

SEQ ID NO: 438063 - RNA, 64 nt, Human
uuaccucacugggaccuguuugggggccaucccugcgguccacccucugaacccccagcauguu

SEQ ID NO: 438064 - RNA, 64 nt, Human
cugcuugcugucgccacucaugucuccuccacaugcgguccacacaucaguaagggccuggaga

SEQ ID NO: 438065 - RNA, 64 nt, Human; identical to SEQ ID NO: 295744

SEQ ID NO: 438066 - RNA, 64 nt, Human; identical to SEQ ID NO: 295745

SEQ ID NO: 438067 - RNA, 52 nt, Human; identical to SEQ ID NO: 223655

SEQ ID NO: 438068 - RNA, 64 nt, Human; identical to SEQ ID NO: 295747

SEQ ID NO: 438069 - RNA, 64 nt, Human; identical to SEQ ID NO: 295748

SEQ ID NO: 438070 - RNA, 64 nt, Human; identical to SEQ ID NO: 295749

SEQ ID NO: 438071 - RNA, 64 nt, Human; identical to SEQ ID NO: 295750

SEQ ID NO: 438072 - RNA, 64 nt, Human; identical to SEQ ID NO: 295751

SEQ ID NO: 438073 - RNA, 64 nt, Human; identical to SEQ ID NO: 295752

SEQ ID NO: 438074 - RNA, 64 nt, Human; identical to SEQ ID NO: 295753

SEQ ID NO: 438075 - RNA, 58 nt, Human
ugagcaagcaguggucaugagucugggaggaguggaaaucuucaaugaagacuuggcc

SEQ ID NO: 438076 - RNA, 56 nt, Human
agaccaguggggacagguagaagccaggaguggaugcugggcagaggccagaguag

SEQ ID NO: 438077 - RNA, 64 nt, Human
uguggauauaguuauaaucugaugggccuggcugggaguggaagaagggaagccuuuugcaaau

SEQ ID NO: 438078 - RNA, 64 nt, Human; identical to SEQ ID NO: 295754

SEQ ID NO: 438079 - RNA, 64 nt, Human; identical to SEQ ID NO: 295755

SEQ ID NO: 438080 - RNA, 64 nt, Human; identical to SEQ ID NO: 295756

SEQ ID NO: 438081 - RNA, 64 nt, Human; identical to SEQ ID NO: 295757

SEQ ID NO: 438082 - RNA, 64 nt, Human; identical to SEQ ID NO: 295758

SEQ ID NO: 438083 - RNA, 64 nt, Human; identical to SEQ ID NO: 295759

SEQ ID NO: 438084 - RNA, 64 nt, Human; identical to SEQ ID NO: 295760

SEQ ID NO: 438085 - RNA, 64 nt, Human; identical to SEQ ID NO: 295761

SEQ ID NO: 438086 - RNA, 64 nt, Human; identical to SEQ ID NO: 295762

SEQ ID NO: 438087 - RNA, 64 nt, Human; identical to SEQ ID NO: 295763

SEQ ID NO: 438088 - RNA, 64 nt, Human; identical to SEQ ID NO: 295764

SEQ ID NO: 438089 - RNA, 64 nt, Human; identical to SEQ ID NO: 295765

SEQ ID NO: 438090 - RNA, 64 nt, Human; identical to SEQ ID NO: 295766

SEQ ID NO: 438091 - RNA, 64 nt, Human; identical to SEQ ID NO: 295767

SEQ ID NO: 438092 - RNA, 64 nt, Human; identical to SEQ ID NO: 295768

SEQ ID NO: 438093 - RNA, 64 nt, Human
gguuccgcaggcagacuacacaggaugaggugguggaguggagugagagcaauuguaacgguua

SEQ ID NO: 438094 - RNA, 64 nt, Human
guggguggguauauuccucaggaguccacagacuggaguggaccuggaacuuagagacgggagg

SEQ ID NO: 438095 - RNA, 64 nt, Human
gcucccagcacugcgcaccaggucaggaggaccuggaguggacuagaaucggggcugcuggaac

SEQ ID NO: 438096 - RNA, 64 nt, Human; identical to SEQ ID NO: 295769

SEQ ID NO: 438097 - RNA, 64 nt, Human; identical to SEQ ID NO: 295770

SEQ ID NO: 438098 - RNA, 64 nt, Human; identical to SEQ ID NO: 295771

SEQ ID NO: 438099 - RNA, 64 nt, Human; identical to SEQ ID NO: 295772

SEQ ID NO: 438100 - RNA, 64 nt, Human; identical to SEQ ID NO: 295773

SEQ ID NO: 438101 - RNA, 64 nt, Human; identical to SEQ ID NO: 295774

SEQ ID NO: 438102 - RNA, 64 nt, Human; identical to SEQ ID NO: 295775

SEQ ID NO: 438103 - RNA, 64 nt, Human; identical to SEQ ID NO: 295776

SEQ ID NO: 438104 - RNA, 64 nt, Human; identical to SEQ ID NO: 295777

SEQ ID NO: 438105 - RNA, 64 nt, Human; identical to SEQ ID NO: 295778

SEQ ID NO: 438106 - RNA, 56 nt, Human; identical to SEQ ID NO: 223688

SEQ ID NO: 438107 - RNA, 64 nt, Human; identical to SEQ ID NO: 295780

SEQ ID NO: 438108 - RNA, 64 nt, Human; identical to SEQ ID NO: 295781

SEQ ID NO: 438109 - RNA, 64 nt, Human; identical to SEQ ID NO: 295782

SEQ ID NO: 438110 - RNA, 64 nt, Human; identical to SEQ ID NO: 295783

SEQ ID NO: 438111 - RNA, 64 nt, Human
uaacaccuagugauuaauuggcugagaaaacccuggaguggagggaggcucagagauacugaua

SEQ ID NO: 438112 - RNA, 64 nt, Human
ucaaagcacuaauagaccaggcaacuuaccacuuggaguggauuugccuuacuuuugcccucuc

SEQ ID NO: 438113 - RNA, 64 nt, Human
caccucaaggucaggaugagaacacacugagugaggaguggacgcuguccauugccacggccau

SEQ ID NO: 438114 - RNA, 64 nt, Human; identical to SEQ ID NO: 295784

SEQ ID NO: 438115 - RNA, 64 nt, Human; identical to SEQ ID NO: 295785

SEQ ID NO: 438116 - RNA, 64 nt, Human; identical to SEQ ID NO: 295786

SEQ ID NO: 438117 - RNA, 64 nt, Human; identical to SEQ ID NO: 295787

SEQ ID NO: 438118 - RNA, 64 nt, Human; identical to SEQ ID NO: 295788

SEQ ID NO: 438119 - RNA, 64 nt, Human; identical to SEQ ID NO: 295789

SEQ ID NO: 438120 - RNA, 64 nt, Human; identical to SEQ ID NO: 295790

SEQ ID NO: 438121 - RNA, 64 nt, Human; identical to SEQ ID NO: 295791

SEQ ID NO: 438122 - RNA, 64 nt, Human; identical to SEQ ID NO: 295792

SEQ ID NO: 438123 - RNA, 64 nt, Human; identical to SEQ ID NO: 295793

SEQ ID NO: 438124 - RNA, 64 nt, Human; identical to SEQ ID NO: 295794

SEQ ID NO: 438125 - RNA, 64 nt, Human; identical to SEQ ID NO: 295795

SEQ ID NO: 438126 - RNA, 64 nt, Human; identical to SEQ ID NO: 295796

SEQ ID NO: 438127 - RNA, 64 nt, Human; identical to SEQ ID NO: 295797

SEQ ID NO: 438128 - RNA, 64 nt, Human; identical to SEQ ID NO: 295798

SEQ ID NO: 438129 - RNA, 64 nt, Human
gccaggccugccaacucaggggacagauggagcaggaguggagaaagggaaaggcaggucuggg

SEQ ID NO: 438130 - RNA, 64 nt, Human
ggggacagaagucccccagugccugccagggccuggaguggagguucaggaccaaggggcuucu

SEQ ID NO: 438131 - RNA, 64 nt, Human
cuggguauuuauccacuaaugagucacaagaaaaggaguggauuugguaagaauagagauuugu

SEQ ID NO: 438132 - RNA, 64 nt, Human; identical to SEQ ID NO: 295799

SEQ ID NO: 438133 - RNA, 64 nt, Human; identical to SEQ ID NO: 295800

SEQ ID NO: 438134 - RNA, 64 nt, Human; identical to SEQ ID NO: 295801

SEQ ID NO: 438135 - RNA, 64 nt, Human; identical to SEQ ID NO: 295802

SEQ ID NO: 438136 - RNA, 64 nt, Human; identical to SEQ ID NO: 295803

SEQ ID NO: 438137 - RNA, 64 nt, Human; identical to SEQ ID NO: 295804

SEQ ID NO: 438138 - RNA, 64 nt, Human; identical to SEQ ID NO: 295805

SEQ ID NO: 438139 - RNA, 64 nt, Human; identical to SEQ ID NO: 295806

SEQ ID NO: 438140 - RNA, 64 nt, Human; identical to SEQ ID NO: 295807

SEQ ID NO: 438141 - RNA, 64 nt, Human; identical to SEQ ID NO: 295808

SEQ ID NO: 438142 - RNA, 64 nt, Human; identical to SEQ ID NO: 295809

SEQ ID NO: 438143 - RNA, 64 nt, Human; identical to SEQ ID NO: 295810

SEQ ID NO: 438144 - RNA, 64 nt, Human; identical to SEQ ID NO: 295811

SEQ ID NO: 438145 - RNA, 64 nt, Human; identical to SEQ ID NO: 295812

SEQ ID NO: 438146 - RNA, 64 nt, Human; identical to SEQ ID NO: 295813

SEQ ID NO: 438147 - RNA, 64 nt, Human
cccauacaaguggcaggaccaggcccaauauuaaggaguggaaaaguguaggcugcccuuggug

SEQ ID NO: 438148 - RNA, 64 nt, Human
cuuuuuaaaaggagagaggaggggugauggcaggggaguggaggguggccgggcagguccugcc

SEQ ID NO: 438149 - RNA, 64 nt, Human
ugagccaggacauguggccuggcuagugcagcauggaguggauuuuaggcucauuugcccucuc

SEQ ID NO: 438150 - RNA, 64 nt, Human; identical to SEQ ID NO: 295814

SEQ ID NO: 438151 - RNA, 64 nt, Human; identical to SEQ ID NO: 295815

SEQ ID NO: 438152 - RNA, 64 nt, Human; identical to SEQ ID NO: 295816

SEQ ID NO: 438153 - RNA, 64 nt, Human; identical to SEQ ID NO: 295817

SEQ ID NO: 438154 - RNA, 64 nt, Human; identical to SEQ ID NO: 295818

SEQ ID NO: 438155 - RNA, 64 nt, Human; identical to SEQ ID NO: 295819

SEQ ID NO: 438156 - RNA, 64 nt, Human; identical to SEQ ID NO: 295820

SEQ ID NO: 438157 - RNA, 64 nt, Human; identical to SEQ ID NO: 295821

SEQ ID NO: 438158 - RNA, 64 nt, Human; identical to SEQ ID NO: 295822

SEQ ID NO: 438159 - RNA, 64 nt, Human; identical to SEQ ID NO: 295823

SEQ ID NO: 438160 - RNA, 64 nt, Human; identical to SEQ ID NO: 295824

SEQ ID NO: 438161 - RNA, 64 nt, Human; identical to SEQ ID NO: 295825

SEQ ID NO: 438162 - RNA, 64 nt, Human; identical to SEQ ID NO: 295826

SEQ ID NO: 438163 - RNA, 64 nt, Human; identical to SEQ ID NO: 295827

SEQ ID NO: 438164 - RNA, 64 nt, Human; identical to SEQ ID NO: 295828

SEQ ID NO: 438165 - RNA, 64 nt, Human
ugcugccacaccugagccagccugcuccuucccaggaguggaggaggccugggggcagggagag

SEQ ID NO: 438166 - RNA, 64 nt, Human
agugugaaugaccuuugacuugcaugcucaacagggaguggaggagaggagacaaggcucugga

SEQ ID NO: 438167 - RNA, 64 nt, Human
aauauuuaggauugugucuugaaaacuaaguauuggaguggauuuucuucugcuuucauugaua

SEQ ID NO: 438168 - RNA, 64 nt, Human; identical to SEQ ID NO: 295829

SEQ ID NO: 438169 - RNA, 64 nt, Human; identical to SEQ ID NO: 295830

SEQ ID NO: 438170 - RNA, 64 nt, Human; identical to SEQ ID NO: 295831

SEQ ID NO: 438171 - RNA, 64 nt, Human; identical to SEQ ID NO: 295832

SEQ ID NO: 438172 - RNA, 64 nt, Human; identical to SEQ ID NO: 295833

SEQ ID NO: 438173 - RNA, 64 nt, Human; identical to SEQ ID NO: 295834

SEQ ID NO: 438174 - RNA, 64 nt, Human; identical to SEQ ID NO: 295835

SEQ ID NO: 438175 - RNA, 64 nt, Human; identical to SEQ ID NO: 295836

SEQ ID NO: 438176 - RNA, 64 nt, Human; identical to SEQ ID NO: 295837

SEQ ID NO: 438177 - RNA, 64 nt, Human; identical to SEQ ID NO: 295838

SEQ ID NO: 438178 - RNA, 64 nt, Human; identical to SEQ ID NO: 295839

SEQ ID NO: 438179 - RNA, 64 nt, Human; identical to SEQ ID NO: 295840

SEQ ID NO: 438180 - RNA, 64 nt, Human; identical to SEQ ID NO: 295841

SEQ ID NO: 438181 - RNA, 64 nt, Human; identical to SEQ ID NO: 295842

SEQ ID NO: 438182 - RNA, 64 nt, Human; identical to SEQ ID NO: 295843

SEQ ID NO: 438183 - RNA, 64 nt, Human
uuuuugagacagagucuugcccugucgccuggcuggaguggaguggcacaaucuuggcucacug

SEQ ID NO: 438184 - RNA, 64 nt, Human
uccagggaccccaguugcagggcccaagcaggugggaguggacaccaggcuucccaguggacgu

SEQ ID NO: 438185 - RNA, 64 nt, Human
guggacauggugcacuaauuucacuaccuauccaggaguggaacugguagaggaugaggaaagc

SEQ ID NO: 438186 - RNA, 64 nt, Human; identical to SEQ ID NO: 295844

SEQ ID NO: 438187 - RNA, 64 nt, Human; identical to SEQ ID NO: 295845

SEQ ID NO: 438188 - RNA, 64 nt, Human; identical to SEQ ID NO: 295846

SEQ ID NO: 438189 - RNA, 64 nt, Human; identical to SEQ ID NO: 295847

SEQ ID NO: 438190 - RNA, 64 nt, Human; identical to SEQ ID NO: 295848

SEQ ID NO: 438191 - RNA, 64 nt, Human; identical to SEQ ID NO: 295849

SEQ ID NO: 438192 - RNA, 64 nt, Human; identical to SEQ ID NO: 295850

SEQ ID NO: 438193 - RNA, 64 nt, Human; identical to SEQ ID NO: 295851

SEQ ID NO: 438194 - RNA, 64 nt, Human; identical to SEQ ID NO: 295852

SEQ ID NO: 438195 - RNA, 64 nt, Human; identical to SEQ ID NO: 295853

SEQ ID NO: 438196 - RNA, 64 nt, Human; identical to SEQ ID NO: 295854

SEQ ID NO: 438197 - RNA, 64 nt, Human; identical to SEQ ID NO: 295855

SEQ ID NO: 438198 - RNA, 64 nt, Human; identical to SEQ ID NO: 295856

SEQ ID NO: 438199 - RNA, 64 nt, Human; identical to SEQ ID NO: 295857

SEQ ID NO: 438200 - RNA, 64 nt, Human; identical to SEQ ID NO: 295858

SEQ ID NO: 438201 - RNA, 64 nt, Human
caacuaaacuacagaaucagggaaagaaccauuaggaguggaacugggggaaucugaguugugu

SEQ ID NO: 438202 - RNA, 64 nt, Human
cagccggcuucccccaaggacucccccuucgcugggaguggauuuccacacgugccuuugauuu

SEQ ID NO: 438203 - RNA, 64 nt, Human
cacauagaaaaauuucauccagccauaugccuguggaguggaauauucuguuuaguagaaaaau

SEQ ID NO: 438204 - RNA, 64 nt, Human; identical to SEQ ID NO: 295859

SEQ ID NO: 438205 - RNA, 64 nt, Human; identical to SEQ ID NO: 295859

SEQ ID NO: 438206 - RNA, 64 nt, Human; identical to SEQ ID NO: 295861

SEQ ID NO: 438207 - RNA, 64 nt, Human; identical to SEQ ID NO: 295862

SEQ ID NO: 438208 - RNA, 64 nt, Human; identical to SEQ ID NO: 295863

SEQ ID NO: 438209 - RNA, 64 nt, Human; identical to SEQ ID NO: 295864

SEQ ID NO: 438210 - RNA, 64 nt, Human; identical to SEQ ID NO: 295865

SEQ ID NO: 438211 - RNA, 64 nt, Human; identical to SEQ ID NO: 295866

SEQ ID NO: 438212 - RNA, 64 nt, Human; identical to SEQ ID NO: 295867

SEQ ID NO: 438213 - RNA, 64 nt, Human; identical to SEQ ID NO: 295868

SEQ ID NO: 438214 - RNA, 64 nt, Human; identical to SEQ ID NO: 295869

SEQ ID NO: 438215 - RNA, 64 nt, Human; identical to SEQ ID NO: 295870

SEQ ID NO: 438216 - RNA, 64 nt, Human; identical to SEQ ID NO: 295871

SEQ ID NO: 438217 - RNA, 64 nt, Human; identical to SEQ ID NO: 295872

SEQ ID NO: 438218 - RNA, 64 nt, Human; identical to SEQ ID NO: 295873

SEQ ID NO: 438219 - RNA, 64 nt, Human
guuccugcuuucugaccuggaggcugagcaggccggaguggauggaugcuguccagacguagcc

SEQ ID NO: 438220 - RNA, 64 nt, Human
agggcgcucccuggccgcagcagaugcccucccaggaguggaggggcuggagagggggaggccu

SEQ ID NO: 438221 - RNA, 64 nt, Human
gcuguucccaagugcacgaugcugcugugacugaggaguggaugaugcucguguguccucugca

SEQ ID NO: 438222 - RNA, 64 nt, Human; identical to SEQ ID NO: 295874

SEQ ID NO: 438223 - RNA, 64 nt, Human; identical to SEQ ID NO: 295875

SEQ ID NO: 438224 - RNA, 64 nt, Human; identical to SEQ ID NO: 295876

SEQ ID NO: 438225 - RNA, 64 nt, Human; identical to SEQ ID NO: 295877

SEQ ID NO: 438226 - RNA, 64 nt, Human; identical to SEQ ID NO: 295878

SEQ ID NO: 438227 - RNA, 64 nt, Human; identical to SEQ ID NO: 295879

SEQ ID NO: 438228 - RNA, 64 nt, Human; identical to SEQ ID NO: 295880

SEQ ID NO: 438229 - RNA, 64 nt, Human; identical to SEQ ID NO: 295881

SEQ ID NO: 438230 - RNA, 64 nt, Human; identical to SEQ ID NO: 295882

SEQ ID NO: 438231 - RNA, 64 nt, Human; identical to SEQ ID NO: 295883

SEQ ID NO: 438232 - RNA, 64 nt, Human; identical to SEQ ID NO: 295884

SEQ ID NO: 438233 - RNA, 64 nt, Human; identical to SEQ ID NO: 295885

SEQ ID NO: 438234 - RNA, 64 nt, Human; identical to SEQ ID NO: 295886

SEQ ID NO: 438235 - RNA, 64 nt, Human; identical to SEQ ID NO: 295887

SEQ ID NO: 438236 - RNA, 64 nt, Human; identical to SEQ ID NO: 295888

SEQ ID NO: 438237 - RNA, 58 nt, Human
uuucaugaaggggaacuauaguuauuucuaccgacacaaauauuauaauuagcaauuu

SEQ ID NO: 438238 - RNA, 58 nt, Human
ucuuccucuugcuguaggcucaaucccauaccgacaucuacaacuaaucuuucccauc

SEQ ID NO: 438239 - RNA, 58 nt, Human
uuggagcagccaagaaauaguuugguacuaccgacauugucuaauccaugucacaucc

SEQ ID NO: 438240 - RNA, 64 nt, Human; identical to SEQ ID NO: 295889

SEQ ID NO: 438241 - RNA, 64 nt, Human; identical to SEQ ID NO: 295890

SEQ ID NO: 438242 - RNA, 64 nt, Human; identical to SEQ ID NO: 295891

SEQ ID NO: 438243 - RNA, 64 nt, Human; identical to SEQ ID NO: 295892

SEQ ID NO: 438244 - RNA, 64 nt, Human; identical to SEQ ID NO: 295893

SEQ ID NO: 438245 - RNA, 64 nt, Human; identical to SEQ ID NO: 295894

SEQ ID NO: 438246 - RNA, 64 nt, Human; identical to SEQ ID NO: 295895

SEQ ID NO: 438247 - RNA, 64 nt, Human; identical to SEQ ID NO: 295896

SEQ ID NO: 438248 - RNA, 64 nt, Human; identical to SEQ ID NO: 295897

SEQ ID NO: 438249 - RNA, 64 nt, Human; identical to SEQ ID NO: 295898

SEQ ID NO: 438250 - RNA, 64 nt, Human; identical to SEQ ID NO: 295899

SEQ ID NO: 438251 - RNA, 64 nt, Human; identical to SEQ ID NO: 295900

SEQ ID NO: 438252 - RNA, 64 nt, Human; identical to SEQ ID NO: 295901

SEQ ID NO: 438253 - RNA, 64 nt, Human; identical to SEQ ID NO: 295902

SEQ ID NO: 438254 - RNA, 64 nt, Human; identical to SEQ ID NO: 295903

SEQ ID NO: 438255 - RNA, 58 nt, Human
cucuguacuauguccacuuugcaauauuuaccgacagccgucuuuuguucuuucuuuc

SEQ ID NO: 438256 - RNA, 58 nt, Human
ccuucuuaacaucacugucuugccagauuaccgacacugucacuugaccaauacugac

SEQ ID NO: 438257 - RNA, 58 nt, Human
cagcccauucauuuauuucuguuuuguuuaccgacauauucaguauuauucuuguuuu

SEQ ID NO: 438258 - RNA, 64 nt, Human; identical to SEQ ID NO: 295904

SEQ ID NO: 438259 - RNA, 64 nt, Human; identical to SEQ ID NO: 295905

SEQ ID NO: 438260 - RNA, 64 nt, Human; identical to SEQ ID NO: 295906

SEQ ID NO: 438261 - RNA, 64 nt, Human; identical to SEQ ID NO: 295907

SEQ ID NO: 438262 - RNA, 64 nt, Human; identical to SEQ ID NO: 295908

SEQ ID NO: 438263 - RNA, 64 nt, Human; identical to SEQ ID NO: 295909

SEQ ID NO: 438264 - RNA, 64 nt, Human; identical to SEQ ID NO: 295910

SEQ ID NO: 438265 - RNA, 64 nt, Human; identical to SEQ ID NO: 295911

SEQ ID NO: 438266 - RNA, 64 nt, Human; identical to SEQ ID NO: 295912

SEQ ID NO: 438267 - RNA, 64 nt, Human; identical to SEQ ID NO: 295913

SEQ ID NO: 438268 - RNA, 64 nt, Human; identical to SEQ ID NO: 295914

SEQ ID NO: 438269 - RNA, 64 nt, Human; identical to SEQ ID NO: 295915

SEQ ID NO: 438270 - RNA, 64 nt, Human; identical to SEQ ID NO: 295916

SEQ ID NO: 438271 - RNA, 64 nt, Human; identical to SEQ ID NO: 295917

SEQ ID NO: 438272 - RNA, 64 nt, Human; identical to SEQ ID NO: 295918

SEQ ID NO: 438273 - RNA, 58 nt, Human
ggguugggcccccggggccagguugaucuaccgacaccuuccacuucuuuccugggag

SEQ ID NO: 438274 - RNA, 58 nt, Human
ccuuuuauuacuguucuagagacuacacuaccgacagugugggccagccaccagccug

SEQ ID NO: 438275 - RNA, 58 nt, Human
auuuucacuauaccucuaaaaccaauuguaccgacaucacguagacaaaaacuccaga

SEQ ID NO: 438276 - RNA, 64 nt, Human; identical to SEQ ID NO: 295919

SEQ ID NO: 438277 - RNA, 64 nt, Human; identical to SEQ ID NO: 295920

SEQ ID NO: 438278 - RNA, 64 nt, Human; identical to SEQ ID NO: 295921

SEQ ID NO: 438279 - RNA, 64 nt, Human; identical to SEQ ID NO: 295922

SEQ ID NO: 438280 - RNA, 64 nt, Human; identical to SEQ ID NO: 295923

SEQ ID NO: 438281 - RNA, 64 nt, Human; identical to SEQ ID NO: 295924

SEQ ID NO: 438282 - RNA, 64 nt, Human; identical to SEQ ID NO: 295925

SEQ ID NO: 438283 - RNA, 64 nt, Human; identical to SEQ ID NO: 295926

SEQ ID NO: 438284 - RNA, 64 nt, Human; identical to SEQ ID NO: 295927

SEQ ID NO: 438285 - RNA, 64 nt, Human; identical to SEQ ID NO: 295928

SEQ ID NO: 438286 - RNA, 64 nt, Human; identical to SEQ ID NO: 295929

SEQ ID NO: 438287 - RNA, 64 nt, Human; identical to SEQ ID NO: 295930

SEQ ID NO: 438288 - RNA, 64 nt, Human; identical to SEQ ID NO: 295931

SEQ ID NO: 438289 - RNA, 64 nt, Human; identical to SEQ ID NO: 295932

SEQ ID NO: 438290 - RNA, 64 nt, Human; identical to SEQ ID NO: 295933

SEQ ID NO: 438291 - RNA, 64 nt, Human
acagacucuuaacccugguuuaccaggaccucuaggaguggauccaaucuauaucuuuacaguu

SEQ ID NO: 438292 - RNA, 64 nt, Human
caaagggcccugagucaaaaggauagccaaggguggaguggaaaaagauauggugaaggcagaa

SEQ ID NO: 438293 - RNA, 64 nt, Human
gugagacccuuggggagaacgggcuguggaugaaggaguggacugcagccuuggccuagccacu

SEQ ID NO: 438294 - RNA, 64 nt, Human; identical to SEQ ID NO: 295934

SEQ ID NO: 438295 - RNA, 64 nt, Human; identical to SEQ ID NO: 295935

SEQ ID NO: 438296 - RNA, 64 nt, Human; identical to SEQ ID NO: 295936

SEQ ID NO: 438297 - RNA, 53 nt, Human; identical to SEQ ID NO: 223846

SEQ ID NO: 438298 - RNA, 52 nt, Human; identical to SEQ ID NO: 223847

SEQ ID NO: 438299 - RNA, 64 nt, Human; identical to SEQ ID NO: 295939

SEQ ID NO: 438300 - RNA, 64 nt, Human; identical to SEQ ID NO: 295940

SEQ ID NO: 438301 - RNA, 64 nt, Human; identical to SEQ ID NO: 295941

SEQ ID NO: 438302 - RNA, 64 nt, Human; identical to SEQ ID NO: 295942

SEQ ID NO: 438303 - RNA, 64 nt, Human; identical to SEQ ID NO: 295943

SEQ ID NO: 438304 - RNA, 64 nt, Human; identical to SEQ ID NO: 295944

SEQ ID NO: 438305 - RNA, 64 nt, Human; identical to SEQ ID NO: 295945

SEQ ID NO: 438306 - RNA, 64 nt, Human; identical to SEQ ID NO: 295946

SEQ ID NO: 438307 - RNA, 64 nt, Human; identical to SEQ ID NO: 295947

SEQ ID NO: 438308 - RNA, 64 nt, Human; identical to SEQ ID NO: 295948

SEQ ID NO: 438309 - RNA, 58 nt, Human
uguagauuuuguuuuuaucauugauuuguaccgacagaaauagacauuucaucaugua

SEQ ID NO: 438310 - RNA, 58 nt, Human
uguacaaagaagcuucaaauggaauauuuaccgacauuccuuauacaugacagacacu

SEQ ID NO: 438311 - RNA, 58 nt, Human
gauacaguuuuguauuuacauauaaauauaccgacaugaucaaaacccuuuuagcuuc

SEQ ID NO: 438312 - RNA, 64 nt, Human; identical to SEQ ID NO: 295949

SEQ ID NO: 438313 - RNA, 64 nt, Human; identical to SEQ ID NO: 295950

SEQ ID NO: 438314 - RNA, 64 nt, Human; identical to SEQ ID NO: 295951

SEQ ID NO: 438315 - RNA, 64 nt, Human; identical to SEQ ID NO: 295952

SEQ ID NO: 438316 - RNA, 64 nt, Human; identical to SEQ ID NO: 295953

SEQ ID NO: 438317 - RNA, 64 nt, Human; identical to SEQ ID NO: 295954

SEQ ID NO: 438318 - RNA, 64 nt, Human; identical to SEQ ID NO: 295955

SEQ ID NO: 438319 - RNA, 64 nt, Human; identical to SEQ ID NO: 295956

SEQ ID NO: 438320 - RNA, 64 nt, Human; identical to SEQ ID NO: 295957

SEQ ID NO: 438321 - RNA, 64 nt, Human; identical to SEQ ID NO: 295958

SEQ ID NO: 438322 - RNA, 64 nt, Human; identical to SEQ ID NO: 295959

SEQ ID NO: 438323 - RNA, 64 nt, Human; identical to SEQ ID NO: 295960

SEQ ID NO: 438324 - RNA, 64 nt, Human; identical to SEQ ID NO: 295961

SEQ ID NO: 438325 - RNA, 64 nt, Human; identical to SEQ ID NO: 295962

SEQ ID NO: 438326 - RNA, 64 nt, Human; identical to SEQ ID NO: 295963

SEQ ID NO: 438327 - RNA, 58 nt, Human
cuuaaagacagacauugaggagagcaaauaccgacagcgccaccugaagguggaguug

SEQ ID NO: 438328 - RNA, 58 nt, Human
ucagcucuggguggggagcaguggccgcuaccgacagcgcaugucccgcucuuaucca

SEQ ID NO: 438329 - RNA, 58 nt, Human
uuuuuuccuuuuuuuuuuuuugucauuuuaccgacauaauacauggagccaaagaaaa

SEQ ID NO: 438330 - RNA, 64 nt, Human; identical to SEQ ID NO: 295964

SEQ ID NO: 438331 - RNA, 64 nt, Human; identical to SEQ ID NO: 295965

SEQ ID NO: 438332 - RNA, 64 nt, Human; identical to SEQ ID NO: 295966

SEQ ID NO: 438333 - RNA, 64 nt, Human; identical to SEQ ID NO: 295967

SEQ ID NO: 438334 - RNA, 64 nt, Human; identical to SEQ ID NO: 295968

SEQ ID NO: 438335 - RNA, 64 nt, Human; identical to SEQ ID NO: 295969

SEQ ID NO: 438336 - RNA, 64 nt, Human; identical to SEQ ID NO: 295970

SEQ ID NO: 438337 - RNA, 64 nt, Human; identical to SEQ ID NO: 295971

SEQ ID NO: 438338 - RNA, 64 nt, Human; identical to SEQ ID NO: 295972

SEQ ID NO: 438339 - RNA, 64 nt, Human; identical to SEQ ID NO: 295973

SEQ ID NO: 438340 - RNA, 64 nt, Human; identical to SEQ ID NO: 295974

SEQ ID NO: 438341 - RNA, 64 nt, Human; identical to SEQ ID NO: 295975

SEQ ID NO: 438342 - RNA, 64 nt, Human; identical to SEQ ID NO: 295976

SEQ ID NO: 438343 - RNA, 64 nt, Human; identical to SEQ ID NO: 295977

SEQ ID NO: 438344 - RNA, 64 nt, Human; identical to SEQ ID NO: 295978

SEQ ID NO: 438345 - RNA, 58 nt, Human
gccugucccuguccccguccccaggagguaccgacagucccugugcugguuagacacg

SEQ ID NO: 438346 - RNA, 58 nt, Human
uccugggaugggggcagguguuccugaauaccgacaggccugcuggguaaaugacuag

SEQ ID NO: 438347 - RNA, 58 nt, Human
caggaaaacgagccuaagaggacuuucauaccgacaacaucugaaaggacuagaaugu

SEQ ID NO: 438348 - RNA, 64 nt, Human; identical to SEQ ID NO: 295979

SEQ ID NO: 438349 - RNA, 64 nt, Human; identical to SEQ ID NO: 295980

SEQ ID NO: 438350 - RNA, 64 nt, Human; identical to SEQ ID NO: 295981

SEQ ID NO: 438351 - RNA, 64 nt, Human; identical to SEQ ID NO: 295982

SEQ ID NO: 438352 - RNA, 64 nt, Human; identical to SEQ ID NO: 295983

SEQ ID NO: 438353 - RNA, 64 nt, Human; identical to SEQ ID NO: 295984

SEQ ID NO: 438354 - RNA, 64 nt, Human; identical to SEQ ID NO: 295985

SEQ ID NO: 438355 - RNA, 64 nt, Human; identical to SEQ ID NO: 295986

SEQ ID NO: 438356 - RNA, 64 nt, Human; identical to SEQ ID NO: 295987

SEQ ID NO: 438357 - RNA, 64 nt, Human; identical to SEQ ID NO: 295988

SEQ ID NO: 438358 - RNA, 64 nt, Human; identical to SEQ ID NO: 295989

SEQ ID NO: 438359 - RNA, 64 nt, Human; identical to SEQ ID NO: 295990

SEQ ID NO: 438360 - RNA, 64 nt, Human; identical to SEQ ID NO: 295991

SEQ ID NO: 438361 - RNA, 64 nt, Human; identical to SEQ ID NO: 295992

SEQ ID NO: 438362 - RNA, 64 nt, Human; identical to SEQ ID NO: 295993

SEQ ID NO: 438363 - RNA, 58 nt, Human
ugagcccaauagccaaggguacaaguacuaccgacagaagcuggaggaguuccggaaa

SEQ ID NO: 438364 - RNA, 58 nt, Human
cgcuugcccucauucucaccaugugaaauaccgacacccgcuuugccuuccaccauga

SEQ ID NO: 438365 - RNA, 58 nt, Human
aggggccaguagacccccggagaagcaguaccgacaaugacgaagauaccagaucccu

SEQ ID NO: 438366 - RNA, 64 nt, Human; identical to SEQ ID NO: 295994

SEQ ID NO: 438367 - RNA, 64 nt, Human; identical to SEQ ID NO: 295995

SEQ ID NO: 438368 - RNA, 64 nt, Human; identical to SEQ ID NO: 295996

SEQ ID NO: 438369 - RNA, 64 nt, Human; identical to SEQ ID NO: 295997

SEQ ID NO: 438370 - RNA, 64 nt, Human; identical to SEQ ID NO: 295998

SEQ ID NO: 438371 - RNA, 64 nt, Human; identical to SEQ ID NO: 295999

SEQ ID NO: 438372 - RNA, 64 nt, Human; identical to SEQ ID NO: 296000

SEQ ID NO: 438373 - RNA, 64 nt, Human; identical to SEQ ID NO: 296001

SEQ ID NO: 438374 - RNA, 64 nt, Human; identical to SEQ ID NO: 296002

SEQ ID NO: 438375 - RNA, 64 nt, Human; identical to SEQ ID NO: 296003

SEQ ID NO: 438376 - RNA, 64 nt, Human; identical to SEQ ID NO: 296004

SEQ ID NO: 438377 - RNA, 64 nt, Human; identical to SEQ ID NO: 296005

SEQ ID NO: 438378 - RNA, 64 nt, Human; identical to SEQ ID NO: 296006

SEQ ID NO: 438379 - RNA, 64 nt, Human; identical to SEQ ID NO: 296007

SEQ ID NO: 438380 - RNA, 64 nt, Human; identical to SEQ ID NO: 296008

SEQ ID NO: 438381 - RNA, 64 nt, Human
cggggcggcaucgugcuggugccucuggccccguggaguggagcaggcagauaccguuaagcgc

SEQ ID NO: 438382 - RNA, 64 nt, Human
aggggagccaggguagagcaaaggagacaaagcaggaguggaaggugaggcguucuccugcuug

SEQ ID NO: 438383 - RNA, 64 nt, Human
aggaggaggagcugggcagggccugcaccagggaggaguggaggacgagguaacucagcagcaa

SEQ ID NO: 438384 - RNA, 64 nt, Human; identical to SEQ ID NO: 296009

SEQ ID NO: 438385 - RNA, 64 nt, Human; identical to SEQ ID NO: 296010

SEQ ID NO: 438386 - RNA, 64 nt, Human; identical to SEQ ID NO: 296011

SEQ ID NO: 438387 - RNA, 64 nt, Human; identical to SEQ ID NO: 296012

SEQ ID NO: 438388 - RNA, 64 nt, Human; identical to SEQ ID NO: 296013

SEQ ID NO: 438389 - RNA, 64 nt, Human; identical to SEQ ID NO: 296014

SEQ ID NO: 438390 - RNA, 64 nt, Human; identical to SEQ ID NO: 296015

SEQ ID NO: 438391 - RNA, 64 nt, Human; identical to SEQ ID NO: 296016

SEQ ID NO: 438392 - RNA, 64 nt, Human; identical to SEQ ID NO: 296017

SEQ ID NO: 438393 - RNA, 64 nt, Human; identical to SEQ ID NO: 296018

SEQ ID NO: 438394 - RNA, 64 nt, Human; identical to SEQ ID NO: 296019

SEQ ID NO: 438395 - RNA, 64 nt, Human; identical to SEQ ID NO: 296020

SEQ ID NO: 438396 - RNA, 64 nt, Human; identical to SEQ ID NO: 296021

SEQ ID NO: 438397 - RNA, 64 nt, Human; identical to SEQ ID NO: 296022

SEQ ID NO: 438398 - RNA, 64 nt, Human; identical to SEQ ID NO: 296023

SEQ ID NO: 438399 - RNA, 64 nt, Human
uggcacguaagaugaacaucccuaccaauacagagcucaccaucucuuauacuuaagugaaaaa

SEQ ID NO: 438400 - RNA, 64 nt, Human
ggaggcucccuugucucccagccccauguacaaagcucaccaagccccugcccauguacagccc

SEQ ID NO: 438401 - RNA, 64 nt, Human
uucuuuuaucacuaucucaacugaggaagaaaaggcucaccacaaguggugugaaggcuuuggg

SEQ ID NO: 438402 - RNA, 64 nt, Human; identical to SEQ ID NO: 296024

SEQ ID NO: 438403 - RNA, 64 nt, Human; identical to SEQ ID NO: 296025

SEQ ID NO: 438404 - RNA, 64 nt, Human; identical to SEQ ID NO: 296026

SEQ ID NO: 438405 - RNA, 64 nt, Human; identical to SEQ ID NO: 296027

SEQ ID NO: 438406 - RNA, 64 nt, Human; identical to SEQ ID NO: 296028

SEQ ID NO: 438407 - RNA, 64 nt, Human; identical to SEQ ID NO: 296029

SEQ ID NO: 438408 - RNA, 64 nt, Human; identical to SEQ ID NO: 296030

SEQ ID NO: 438409 - RNA, 64 nt, Human; identical to SEQ ID NO: 296031

SEQ ID NO: 438410 - RNA, 64 nt, Human; identical to SEQ ID NO: 296032

SEQ ID NO: 438411 - RNA, 64 nt, Human; identical to SEQ ID NO: 296033

SEQ ID NO: 438412 - RNA, 64 nt, Human; identical to SEQ ID NO: 296034

SEQ ID NO: 438413 - RNA, 64 nt, Human; identical to SEQ ID NO: 296035

SEQ ID NO: 438414 - RNA, 64 nt, Human; identical to SEQ ID NO: 296036

SEQ ID NO: 438415 - RNA, 64 nt, Human; identical to SEQ ID NO: 296037

SEQ ID NO: 438416 - RNA, 64 nt, Human; identical to SEQ ID NO: 296038

SEQ ID NO: 438417 - RNA, 58 nt, Human
cccuggugccaccugcagcauuucuagauaccgacaauaagggucucccuauccccaa

SEQ ID NO: 438418 - RNA, 58 nt, Human
cacacaccccuaccccacacugacugucuaccgacaaagacccuauuuccuggcaaac

SEQ ID NO: 438419 - RNA, 58 nt, Human
uagaugcaaagcagccuaacucuucaaguaccgacauuucucaccucugauuccggcu

SEQ ID NO: 438420 - RNA, 64 nt, Human; identical to SEQ ID NO: 296039

SEQ ID NO: 438421 - RNA, 64 nt, Human; identical to SEQ ID NO: 296040

SEQ ID NO: 438422 - RNA, 64 nt, Human; identical to SEQ ID NO: 296041

SEQ ID NO: 438423 - RNA, 64 nt, Human; identical to SEQ ID NO: 296042

SEQ ID NO: 438424 - RNA, 64 nt, Human; identical to SEQ ID NO: 296043

SEQ ID NO: 438425 - RNA, 64 nt, Human; identical to SEQ ID NO: 296044

SEQ ID NO: 438426 - RNA, 64 nt, Human; identical to SEQ ID NO: 296045

SEQ ID NO: 438427 - RNA, 64 nt, Human; identical to SEQ ID NO: 296046

SEQ ID NO: 438428 - RNA, 64 nt, Human; identical to SEQ ID NO: 296047

SEQ ID NO: 438429 - RNA, 64 nt, Human; identical to SEQ ID NO: 296048

SEQ ID NO: 438430 - RNA, 64 nt, Human; identical to SEQ ID NO: 296049

SEQ ID NO: 438431 - RNA, 64 nt, Human; identical to SEQ ID NO: 296050

SEQ ID NO: 438432 - RNA, 51 nt, Human; identical to SEQ ID NO: 223960

SEQ ID NO: 438433 - RNA, 64 nt, Human; identical to SEQ ID NO: 296052

SEQ ID NO: 438434 - RNA, 64 nt, Human; identical to SEQ ID NO: 296053

SEQ ID NO: 438435 - RNA, 64 nt, Human
gacaguguugggcaggucugggcguauaauuugaggaguggaugguggaugaaaagaaauaaua

SEQ ID NO: 438436 - RNA, 64 nt, Human
ggcauggucccccauuuucuuuaaggcagcaccuggaguggagagaggccacucccucuccagc

SEQ ID NO: 438437 - RNA, 64 nt, Human
ccaauucuuacggaggaauauuauuuagccagcaggaguggaguuugguuuacugauuuuacug

SEQ ID NO: 438438 - RNA, 64 nt, Human; identical to SEQ ID NO: 296054

SEQ ID NO: 438439 - RNA, 64 nt, Human; identical to SEQ ID NO: 296055

SEQ ID NO: 438440 - RNA, 64 nt, Human; identical to SEQ ID NO: 296056

SEQ ID NO: 438441 - RNA, 64 nt, Human; identical to SEQ ID NO: 296057

SEQ ID NO: 438442 - RNA, 64 nt, Human; identical to SEQ ID NO: 296058

SEQ ID NO: 438443 - RNA, 64 nt, Human; identical to SEQ ID NO: 296059

SEQ ID NO: 438444 - RNA, 64 nt, Human; identical to SEQ ID NO: 296060

SEQ ID NO: 438445 - RNA, 64 nt, Human; identical to SEQ ID NO: 296061

SEQ ID NO: 438446 - RNA, 50 nt, Human; identical to SEQ ID NO: 223971

SEQ ID NO: 438447 - RNA, 64 nt, Human; identical to SEQ ID NO: 296063

SEQ ID NO: 438448 - RNA, 64 nt, Human; identical to SEQ ID NO: 296064

SEQ ID NO: 438449 - RNA, 64 nt, Human; identical to SEQ ID NO: 296065

SEQ ID NO: 438450 - RNA, 64 nt, Human; identical to SEQ ID NO: 296066

SEQ ID NO: 438451 - RNA, 64 nt, Human; identical to SEQ ID NO: 296067

SEQ ID NO: 438452 - RNA, 64 nt, Human; identical to SEQ ID NO: 296068

SEQ ID NO: 438453 - RNA, 64 nt, Human; identical to SEQ ID NO: 435584

SEQ ID NO: 438454 - RNA, 64 nt, Human; identical to SEQ ID NO: 435584

SEQ ID NO: 438455 - RNA, 64 nt, Human
uuuuguuaccaaaggugggguagggacgggggugggaguggagcggaggccuuguuuucccgug

SEQ ID NO: 438456 - RNA, 64 nt, Human; identical to SEQ ID NO: 296069

SEQ ID NO: 438457 - RNA, 64 nt, Human; identical to SEQ ID NO: 296070

SEQ ID NO: 438458 - RNA, 64 nt, Human; identical to SEQ ID NO: 296071

SEQ ID NO: 438459 - RNA, 64 nt, Human; identical to SEQ ID NO: 296072

SEQ ID NO: 438460 - RNA, 64 nt, Human; identical to SEQ ID NO: 296073

SEQ ID NO: 438461 - RNA, 64 nt, Human; identical to SEQ ID NO: 296074

SEQ ID NO: 438462 - RNA, 64 nt, Human; identical to SEQ ID NO: 296075

SEQ ID NO: 438463 - RNA, 61 nt, Human; identical to SEQ ID NO: 296076

SEQ ID NO: 438464 - RNA, 64 nt, Human; identical to SEQ ID NO: 296077

SEQ ID NO: 438465 - RNA, 64 nt, Human; identical to SEQ ID NO: 303750

SEQ ID NO: 438466 - RNA, 64 nt, Human; identical to SEQ ID NO: 303751

SEQ ID NO: 438467 - RNA, 64 nt, Human; identical to SEQ ID NO: 303752

SEQ ID NO: 438468 - RNA, 64 nt, Human; identical to SEQ ID NO: 303753

SEQ ID NO: 438469 - RNA, 64 nt, Human; identical to SEQ ID NO: 303754

SEQ ID NO: 438470 - RNA, 64 nt, Human; identical to SEQ ID NO: 303755

SEQ ID NO: 438471 - RNA, 64 nt, Human; identical to SEQ ID NO: 303756

SEQ ID NO: 438472 - RNA, 64 nt, Human; identical to SEQ ID NO: 303757

SEQ ID NO: 438473 - RNA, 64 nt, Human; identical to SEQ ID NO: 303758

SEQ ID NO: 438474 - RNA, 64 nt, Human; identical to SEQ ID NO: 303759

SEQ ID NO: 438475 - RNA, 64 nt, Human
ggcuggggcucuccgugguguucuggacccagccccuggagacaccauucacuuuuacugcuuu

SEQ ID NO: 438476 - RNA, 64 nt, Human
cuccauggcuggucaugagagcaaaccguaguccccuggagacagcgacuccagagaaccucuu

SEQ ID NO: 438477 - RNA, 64 nt, Human
gauggauaaggaugagucuuggaguugcgggcagccuggagacucguggacuuaccgccuggag

SEQ ID NO: 438478 - RNA, 64 nt, Human
uccccgagcuaagucccagggcaucugggccuugccuggagacugggcuagcucuguaggcucg

SEQ ID NO: 438479 - RNA, 64 nt, Human
uggcagugcugaggacggguacuccagcuccaggccuggagaggcuucccagcaacaccugcag

SEQ ID NO: 438480 - RNA, 64 nt, Human
acagccagagaaugcccacugccuguaacagccaccuggagaacuucauaaagaugucucacag

SEQ ID NO: 438481 - RNA, 64 nt, Human
ccaccccuuccuguagcauauggggagacuaaggccuggagagaggggugaugccccgucccag

SEQ ID NO: 438482 - RNA, 64 nt, Human
cucagagacacgggcaagcaugccucuucccuucccuggagagaaagugugugauuucucuccc

SEQ ID NO: 438483 - RNA, 64 nt, Human
ggcacuccccucuaccaaucccuggcacaggguuccuggagagcaggugcuguacauuuuacag

SEQ ID NO: 438484 - RNA, 64 nt, Human
uggaccugauucuggccacaccccccuucagccgccuggagaaguuguauagcacuauggugcg

SEQ ID NO: 438485 - RNA, 64 nt, Human
caggugccuccucucagucaggcuucagagcagcccuggagacaggagggccauguuaaaagcu

SEQ ID NO: 438486 - RNA, 64 nt, Human
guccccaccaucagccaccacacaccucugcugcccuggagacugugcucuugaccugcuccgc

SEQ ID NO: 438487 - RNA, 64 nt, Human
ucagagcuggggauuuccugccuggaacaagggaccuggagaauguuuuugcgugggaugaugu

SEQ ID NO: 438488 - RNA, 64 nt, Human
agugagguccucauucuccagccagccucucugcccuggagaaucaugugcuauguucuaagaa

SEQ ID NO: 438489 - RNA, 64 nt, Human
ucgccgucugcccuguccaucuguccguccguucccuggagaagacacaaggguauccaugcuc

SEQ ID NO: 438490 - RNA, 64 nt, Human
gcucuggcuuccuuucauugucuuaggccuucauggaguggaugcugccuccuccuggcuguuu

SEQ ID NO: 438491 - RNA, 64 nt, Human
gcguugcugugccgcagagauccacucuguccguggaguggagcugcugguucucccaggugga

SEQ ID NO: 438492 - RNA, 64 nt, Human
agaacguguagaccccagaaugaaacaugggguuggaguggaggaggagcugucucagcaagag

SEQ ID NO: 438493 - RNA, 64 nt, Human
acuccauccuguccccaaggacucacauacagugccuggagaaagccaaagaccuuuauuucuu

SEQ ID NO: 438494 - RNA, 64 nt, Human
cuccccagcccacagugguggccucugccucuuuccuggagagagaaggacagugcacggagag

SEQ ID NO: 438495 - RNA, 64 nt, Human
agaauuuagaucuuauauugguuugcacaaguucccuggagaaaaaaauugcucuguguauauc

SEQ ID NO: 438496 - RNA, 64 nt, Human
acaacaaggcuuugggugugaagggacuccccagccuggagacccuauuuggcugaaacaguua

SEQ ID NO: 438497 - RNA, 54 nt, Human
uccgagugguggaaaccugagcugccuggagaugguugcugccauugcugcugc

SEQ ID NO: 438498 - RNA, 64 nt, Human
agcugagagguuccagcaaaagcuugaagucuugccuggagaaucccucugcucuggugucagg

SEQ ID NO: 438499 - RNA, 64 nt, Human
cccccagaccugcuccuacacugauauugaagaaccuggagaggauccuucaguucuggccauu

SEQ ID NO: 438500 - RNA, 64 nt, Human
aagcaggcagagcggggaggugccugagcuggggccuggagaggggccugggaaaggaaaacca

SEQ ID NO: 438501 - RNA, 64 nt, Human
gaaaccuguaaauaugaaagaacaaagguuauuuccuggagaaaagacaauuuauucaacacca

SEQ ID NO: 438502 - RNA, 64 nt, Human
ugggagcugucaucaccaacaggguuuacucuccccuggagagguuauuuaaauagcuguccau

SEQ ID NO: 438503 - RNA, 64 nt, Human
ugauggugcuccccuuccugccagcgucagaggcccuggagaggggcuguccauggcagcuggu

SEQ ID NO: 438504 - RNA, 64 nt, Human
uguuggccugaagggagcuuagaaugcagcccuaccuggagauagugcgggcaccuguggccaa

SEQ ID NO: 438505 - RNA, 64 nt, Human
aauuaugccaugaacaugccaugucguuuuaaugccuggagagcagauugcguaaaacaucugu

SEQ ID NO: 438506 - RNA, 64 nt, Human
gugugggggauggaggcgcguuugcucccaacauccuggagaauaaagaaggccuggagcugcu

SEQ ID NO: 438507 - RNA, 64 nt, Human
gaacuccucaagcagcgauuggagcccaagcaccccuggagaggaagggaggguccccacuggc

SEQ ID NO: 438508 - RNA, 64 nt, Human
uuuauagcugcccaagagaaaagaguguauguuuggaguggaagaaaaucgguuuugaaucuca

SEQ ID NO: 438509 - RNA, 64 nt, Human
caaggcccucuacugcccucuggguccagcagagggaguggaggaagggccacugccucccacc

SEQ ID NO: 438510 - RNA, 64 nt, Human
agagaugcccaugaagcagguccagaacuaagugggaguggaggcaggcccuccacagaagcuc

SEQ ID NO: 438511 - RNA, 64 nt, Human
ucucaggaggccaggcccuucugagcggaaccguccuggagagagccugcccucguuuccaggc

SEQ ID NO: 438512 - RNA, 64 nt, Human
ugucaugaagugcacaggagccaaaugaccgagcccuggagagccccaugguggguaggugguu

SEQ ID NO: 438513 - RNA, 64 nt, Human
ccccucugcugccggcucugggccugaggguccaccuggagaguacauuugcuuuaaugagugc

SEQ ID NO: 438514 - RNA, 64 nt, Human
acagcugccuggcuggggaggcugugcuguuuccccuggagaccugacuggucugugguuccca

SEQ ID NO: 438515 - RNA, 64 nt, Human
uucgcccugcccacuugacuucaccaaaucccuuccuggagacuaaaccuggugcucaggagcg

SEQ ID NO: 438516 - RNA, 64 nt, Human
guagucucaucccagauuacuaacccuuccugauccuggagaggcagggauaguaaauaaauug

SEQ ID NO: 438517 - RNA, 64 nt, Human
aggcccucgcccugccgccaucuaugccaguuacccuggagaggacuccugccguguccugaaa

SEQ ID NO: 438518 - RNA, 64 nt, Human
cacaggacagacccuuucuccaccacagccaaggccuggagacugggggcccagcagagccugc

SEQ ID NO: 438519 - RNA, 64 nt, Human
gccaagaggcuggaacauagugucugccucgcuuccuggagauaguaacugagcaggggcuaca

SEQ ID NO: 438520 - RNA, 64 nt, Human
ucuggcaucuuagaccuccacacccgugagaaauccuggagaggguauuuuuguagaguguaga

SEQ ID NO: 438521 - RNA, 64 nt, Human
accuuccaggcuacacucuuccaucagcaugaguccuggagagcugggggaacguaggaagagg

SEQ ID NO: 438522 - RNA, 64 nt, Human
gccaccacugaguccacucggagugcccuguguuccuggagaaggcauuccaggguugaaucuu

SEQ ID NO: 438523 - RNA, 61 nt, Human
gcaaggccgccaggcacugagcuggagcccgccuggagagacagacacgugugagugguca

SEQ ID NO: 438524 - RNA, 64 nt, Human
gcagcuuccucugcuucuggaaugaaccauguauccuggagacccucccaauggaugagagugg

SEQ ID NO: 438525 - RNA, 64 nt, Human
acauacuguauuguguucuccugcauauaucauuccuggagagagaaggggagaagaauacuuu

SEQ ID NO: 438526 - RNA, 64 nt, Human
auuguacuugucaagcaaaaucuauacuccuauuggaguggaugcugaugaacaucgaacauau

SEQ ID NO: 438527 - RNA, 64 nt, Human
augaccuaugcccaaagaacaaauacuuaacgugggaguggaaccacaugagccugcucagcuc

SEQ ID NO: 438528 - RNA, 64 nt, Human
uguuuugaccuuugcaggcgaguaaccaggcaauggaguggagugucuccuggagagagugagg

SEQ ID NO: 438529 - RNA, 64 nt, Human
ucauuuggucagaguucauauaaucugucuguucccuggagaugggaauagaggaugaugacag

SEQ ID NO: 438530 - RNA, 64 nt, Human
guugccaagaaaagggaccuaguuuagccauugcccuggagaugaaauuaauggaggcucaagg

SEQ ID NO: 438531 - RNA, 64 nt, Human
uggacucccucuacucccucuggccauagccccuccuggagauggggucaaggcagcaggacug

SEQ ID NO: 438532 - RNA, 64 nt, Human
gaauucuugggggguguuggggagagacugugggccuggagauaaaacuugucuccucuaccac

SEQ ID NO: 438533 - RNA, 64 nt, Human
ucagaauuuuagacccuuuggccuugggguccauccuggagacccugaggucuaagcuacagcc

SEQ ID NO: 438534 - RNA, 64 nt, Human
aagcugggcccaaaacuggagacuguuugucuuuccuggagaugcagaacugggcccguggagc

SEQ ID NO: 438535 - RNA, 64 nt, Human
uuuucuguggaaccucagaggccagccucgacuuccuggagacccccagguggggcuuccuuca

SEQ ID NO: 438536 - RNA, 64 nt, Human
uguuagcucaaauuuacagaugaggaaauggaggccuggagaguucaaguagcucacucuaagu

SEQ ID NO: 438537 - RNA, 64 nt, Human
gaaaagcaaacgcauuccuccucagcuccacccaccuggagacgaauguagccagagaggagga

SEQ ID NO: 438538 - RNA, 64 nt, Human
accaacugaaacauauaacguuuucaucuccuuuccuggagaaagcagcugcagagguucugua

SEQ ID NO: 438539 - RNA, 64 nt, Human
aggaguuucagagacaacuuugaauccuugucagccuggagaccagcaccagaggaaucuacaa

SEQ ID NO: 438540 - RNA, 64 nt, Human
ccugcaccgcagcuugccaucccugcccuucuguccuggagaagagacuggugcuucuccgcac

SEQ ID NO: 438541 - RNA, 64 nt, Human
acuugggaggcugaggcgcgagaaucgcuugaacccuggagauggagguugcagugagcagaga

SEQ ID NO: 438542 - RNA, 64 nt, Human
gaggucuccuagccauagaacugacuccuggaagccuggagagaagguggugacacccaugggu

SEQ ID NO: 438543 - RNA, 64 nt, Human
uaaacaauaaagacuuuaccugucuaauggaaaaccuggagaagucgucaggaaccagacuaca

SEQ ID NO: 438544 - RNA, 64 nt, Human
gucaccuccgggcuuccgcagcccccuccaaggcggaguggagccuugggaaccccucggccaa

SEQ ID NO: 438545 - RNA, 64 nt, Human
uagcccgucuggcacagaggguggaccuguuagaggaguggaggggcugccuggggaaugggac

SEQ ID NO: 438546 - RNA, 64 nt, Human
cucaugcaacucaguccccagaauggcuccacugggaguggaggaagagcucagaggcccaggu

SEQ ID NO: 438547 - RNA, 64 nt, Human
uggagaagucgucaggaaccagacuacaguggacccuggagaaccuugaagaacauuuuuccuu

SEQ ID NO: 438548 - RNA, 64 nt, Human
agggagggaagguaccagggagaaccugggagguccuggagagggcccuguccaguugggugau

SEQ ID NO: 438549 - RNA, 64 nt, Human
gcucccuccccagcugguuugggcucaaauugucccuggagacuaggguuuauguuaggguauu

SEQ ID NO: 438550 - RNA, 64 nt, Human
acccgucagucugucuccauccuuucaccccuucccuggagaugggagguggggaaugaaugga

SEQ ID NO: 438551 - RNA, 64 nt, Human
gugaguucuccaaggcccaugaggauaugacugcccuggagaaggauuacaaggaggugggcau

SEQ ID NO: 438552 - RNA, 64 nt, Human
cgggaagccaacaguguugucaggaaucugagguccuggagaggcagauguguccugaggaaca

SEQ ID NO: 438553 - RNA, 64 nt, Human
cugugggacuugaggacucgggaucuucaggacgccuggagaagggugguuuccugccacccug

SEQ ID NO: 438554 - RNA, 55 nt, Human
uggagcagagcaccaaaugaucugcccuggagaggcucugggacggguuuacuug

SEQ ID NO: 438555 - RNA, 64 nt, Human
aaauacaacacagacgauauuuaauucaccucagccuggagaggccuggggugggacagggagg

SEQ ID NO: 438556 - RNA, 64 nt, Human
cagacagagaggacuguagggagggcggcaggggccuggagauccuccugcagaccacgcccgu

SEQ ID NO: 438557 - RNA, 64 nt, Human
ugcugggagcuccacucugcuucucugacuucugccuggagacuuagggcaccagggguuucuc

SEQ ID NO: 438558 - RNA, 64 nt, Human
aggacgcggccaccccaggccuuuccagagcaaaccuggagaagauucacaauagacaggccaa

SEQ ID NO: 438559 - RNA, 64 nt, Human
cugcacacacaugucaggggcugcccugacauggccuggagacauuuuccccaugguguugggg

SEQ ID NO: 438560 - RNA, 64 nt, Human
uggauugauggaagaaaagagaaccucauccaugccuggagaacaucuagaaaaccuucagcca

SEQ ID NO: 438561 - RNA, 64 nt, Human
gagucaaccuuggcggggcgggggcugcguccaaccuggagauugcccuucccuaugccacggu

SEQ ID NO: 438562 - RNA, 64 nt, Human
agaaggcugaggcagggagaauugcuugaacccaggaguggagguugcagugagcugagaucau

SEQ ID NO: 438563 - RNA, 64 nt, Human
cucaggcuauacugaaaggguugcaguuugguuaggaguggaaauauuuuguuuguuaaugaug

SEQ ID NO: 438564 - RNA, 64 nt, Human
aaauucauccgaguggcacuggcagagaaggauaggaguggaaugcccacacagugaccaacag

SEQ ID NO: 438565 - RNA, 64 nt, Human
ggacccagugauacaaaccuguccuggaauucuaccuggagaccagagcuggccugaaaauuac

SEQ ID NO: 438566 - RNA, 64 nt, Human
gauguggaaaaaugagagaagggacacauucaacccuggagaguucaauggcugcugaagcugc

SEQ ID NO: 438567 - RNA, 64 nt, Human
uauggaaggagcaggcacuggccugagcaugcagccuggagaguguucuugucucuagcagcug

SEQ ID NO: 438568 - RNA, 64 nt, Human
aguaaagugauuguaaaaaagaaggacuagcuugccuggagaugauguuucuugcuuuuggaaa

SEQ ID NO: 438569 - RNA, 64 nt, Human
gaaagaaccaaauguaaauuuccuuagagaccauccuggagaagacaguucuaaaucggggcuu

SEQ ID NO: 438570 - RNA, 64 nt, Human
uccccuugaguaacaugcccaguuuccuuucuguccuggagacagguggccucucuggcuaugg

SEQ ID NO: 438571 - RNA, 64 nt, Human
aguuucaagaugaagaacuacaugauacaguggaccuggagaccauccccuuggaaagacaacc

SEQ ID NO: 438572 - RNA, 64 nt, Human
uuaggacuacccaugaauguuguggaaugcuacaccuggagaguucugguuuuccaccaguuuc

SEQ ID NO: 438573 - RNA, 64 nt, Human
cugaggguccagaagggccagggccuggcacccaccuggagaagcccccgcacccgagggaacc

SEQ ID NO: 438574 - RNA, 64 nt, Human
cggcccuguagucuguagugccagacugugcuggccuggagagugcuggggcagguggaggcca

SEQ ID NO: 438575 - RNA, 64 nt, Human
ggagaaaaauaaagcaggggagggaguaagaaauccuggagaugaggcugcaguuuuaaauggg

SEQ ID NO: 438576 - RNA, 64 nt, Human
uaggaggaaucugugcucuacuuaccucucaauuccuggagaugccaacuucacagacacgucu

SEQ ID NO: 438577 - RNA, 64 nt, Human
ugaccugcaccagguggcaccaaggguccugaguccuggagauguccccagaagcugcugugcc

SEQ ID NO: 438578 - RNA, 64 nt, Human
auccuagcaacagauuucucugguugucaguuucccuggagaaggcgccagauaggaaucucca

SEQ ID NO: 438579 - RNA, 64 nt, Human
gggggcuguguuugcacaaguuauuuucauguuaccuggagaguguccagaggcugcucugagg

SEQ ID NO: 438580 - RNA, 64 nt, Human
augccuauuuugcauucucuuggguauauaucuaggaguggaacugcugggucauauguuaauu

SEQ ID NO: 438581 - RNA, 64 nt, Human
uccacacggucuucacaaagaaggaagaaaagaaggaguggaggaaggugagcugcugcccaau

SEQ ID NO: 438582 - RNA, 64 nt, Human
accacgguucuugacuuaguggaauugggucgaaggaguggagaaugggagggcucgggcuacu

SEQ ID NO: 438583 - RNA, 64 nt, Human
caagcgccuggguggaggcaggguagggcaggggccuggagacgacaugguguugucuguggag

SEQ ID NO: 438584 - RNA, 64 nt, Human
ggucaaaucagcuccuucucuccaagugcacuacccuggagagugguggccacucaauaccuuu

SEQ ID NO: 438585 - RNA, 64 nt, Human
uagugcuucugagcccagcagggcuuuaccugccccuggagaguuuuagccgucuuguguuucu

SEQ ID NO: 438586 - RNA, 64 nt, Human
caugucacagugccuuaaaacaguuuucucaaauccuggagagaguucuugugguugcuuuugu

SEQ ID NO: 438587 - RNA, 64 nt, Human
gcaugagggaacagcaaggggcacgguaucacagccuggagacacccacacagauggcuggauc

SEQ ID NO: 438588 - RNA, 64 nt, Human
uagccacucuuacccaugcucuuucccuggaaucccuggagaccuguccaagaugauuuccaua

SEQ ID NO: 438589 - RNA, 64 nt, Human
aggggcucaguggggcuucucuucccuccaugagccuggagaccccaggggaggauccauuugg

SEQ ID NO: 438590 - RNA, 64 nt, Human
auaaguucuguuugugcugacagguggccuagguccuggagaugagcacccucucucuggccuu

SEQ ID NO: 438591 - RNA, 64 nt, Human
gcaaagccagaagcucuagcuuuacccagcucugccuggagacuaaggcaaauugggccauuaa

SEQ ID NO: 438592 - RNA, 64 nt, Human
guggagcugggaucuuuuagggcccugagcccugccuggagagcagcacagcucaucagucccc

SEQ ID NO: 438593 - RNA, 64 nt, Human
uauugaaugaggaccagugagcggagugaggugcccuggagaagcaggcuuugaaggcacagcg

SEQ ID NO: 438594 - RNA, 64 nt, Human
acaggcuuuccaauccuggcuggccucuaaaucaccuggagagccucgaaaaaaacagcagugg

SEQ ID NO: 438595 - RNA, 64 nt, Human
auuacuuuggcccagggaagccccugguucugucccuggagacucuggaaauccuuuugcauua

SEQ ID NO: 438596 - RNA, 64 nt, Human
caguuuggcuuuuauugccugaaccuuaugcugaccuggagaggagaugggggacagugcuguu

SEQ ID NO: 438597 - RNA, 64 nt, Human
agucugaguguucccagccaucugcuccuuaaucccuggagaggaacagagccaacuggacaca

SEQ ID NO: 438598 - RNA, 64 nt, Human
cuggccgcaggguaggggagaggcucugcaguguggaguggagccucaucgaggggcgcugggu

SEQ ID NO: 438599 - RNA, 64 nt, Human
aauuuaagacuugugcuuacaauauuuuugaccuggaguggaucuauuuacauagucauuuagg

SEQ ID NO: 438600 - RNA, 64 nt, Human
gguagagggauuucgggggccuucucagaagcaaggaguggacaagccucuugguuaaggcucc

SEQ ID NO: 438601 - RNA, 64 nt, Human
gacuuccccuucucccauccugaacauuuguaccccuggagaaguuccuuagcagggaggagga

SEQ ID NO: 438602 - RNA, 64 nt, Human
ugagcaccaggucucaucuugcaucucauccuggccuggagaacauucaguuuccuuccaaccc

SEQ ID NO: 438603 - RNA, 64 nt, Human
gaagccucacuggguaugcagucaacaggaugggccuggagauccgugaacugcaggccacgua

SEQ ID NO: 438604 - RNA, 64 nt, Human
caucaaucacuuuauuuuauuuuuuuuucuaacuccuggagacuuauuuuacugcuucauuagg

SEQ ID NO: 438605 - RNA, 64 nt, Human
auggagaggaacacaggcgcugaguauggagcagccuggagacccaccccaccugcagggcugc

SEQ ID NO: 438606 - RNA, 64 nt, Human
uagagcagggccccucuuuucagcacuuuggacaccuggagacccagcccuguuauuuaauggu

SEQ ID NO: 438607 - RNA, 64 nt, Human
agccaugaucagauguggucagacucuuucugggccuggagaccacggucacuuguugacuguc

SEQ ID NO: 438608 - RNA, 64 nt, Human
gggcucugcgagggacggugugugacaugucaugccuggagaaggaacaaggcuauuugaaaac

SEQ ID NO: 438609 - RNA, 64 nt, Human
acagaaugggcaugaccuucagcucacgagcacaccuggagaaauucagaaccagguucugaau

SEQ ID NO: 438610 - RNA, 64 nt, Human
guaagcauuuucauuaauaauaugagaaaugauaccuggagagagagauuaugagcaaauguau

SEQ ID NO: 438611 - RNA, 64 nt, Human
uucaaaaccuccaccugcccaugcugcuugcaucccuggagaaucuucuguggacaucgaccuc

SEQ ID NO: 438612 - RNA, 64 nt, Human
aaugcaaacuaaacccaaugccaacuuugugcaaccuggagaucuaguccuaagccacacaccu

SEQ ID NO: 438613 - RNA, 64 nt, Human
uaaccaaaacuccuguucugaaacugauuagaagccuggagaagauggagauuacuuguuacuu

SEQ ID NO: 438614 - RNA, 64 nt, Human
cucccaggcccuguucuggaggcuaaccuugguuccuggagagugugccccuccacccucccuc

SEQ ID NO: 438615 - RNA, 64 nt, Human
cauaugagaggccaucuaucccagccugggugauccuggagaguuucccaggguugugauaugu

SEQ ID NO: 438616 - RNA, 64 nt, Human
cuaaguuuccaacauuccucauucuaggauccuaggaguggaauuuuccauuuucuaauauacu

SEQ ID NO: 438617 - RNA, 64 nt, Human
gcccagacucagccugcccacuggugccggagacggaguggagugggccuggauccgagggaug

SEQ ID NO: 438618 - RNA, 64 nt, Human
ugcccugccuguugcaaacgugaugcucccggauggaguggagaaacuaggagacugggacaag

SEQ ID NO: 438619 - RNA, 64 nt, Human
gcacccucacugcuggugaccagccuuguaacccccuggagaugcccauguuccuuaugguagc

SEQ ID NO: 438620 - RNA, 64 nt, Human
ugcagugagccgagauugcaccacugcacuccagccuggagagcagagcaagacucugucucaa

SEQ ID NO: 438621 - RNA, 64 nt, Human
caccgggaaagcgcccccucucgagaggcuggucccuggagaacugcgaacgagcugcagaaaa

SEQ ID NO: 438622 - RNA, 64 nt, Human
aagagauauucauuggcagcucaaagacuuccacccuggagaccacacugcacacagugacuuc

SEQ ID NO: 438623 - RNA, 64 nt, Human
ugaguuggaaaaaaaauaagauaucaacugccagccuggagaaggugacaguccaagugugcaa

SEQ ID NO: 438624 - RNA, 64 nt, Human
gcuuugcaaagcacccucaaaagcugcaccacagccuggagaauaaaauauccucagcccugau

SEQ ID NO: 438625 - RNA, 64 nt, Human
augaaagagagaaggaaaaucaugccgcucaguuccuggagacagaagagccgucaucaguguc

SEQ ID NO: 438626 - RNA, 60 nt, Human
ccaccuuugcugcccacugaaugaggacucccuggagagggacacgcgagaggcaggcca

SEQ ID NO: 438627 - RNA, 64 nt, Human
agggguccgagggccguggccugcguggccauccccuggagagaggagccgcucagggugcgcg

SEQ ID NO: 438628 - RNA, 64 nt, Human
cuucacacaccacagccaggaggggccuuucccaccuggagagaaacuuccagaccagccccuc

SEQ ID NO: 438629 - RNA, 64 nt, Human
ccccucauaccacagccaagaggggccuuucucaccuggagagaaauuuccagaccauccccuc

SEQ ID NO: 438630 - RNA, 64 nt, Human
ccccucacaccacagccaagagaagccuuuccagccuggagagaaacuuccagaccagcccucu

SEQ ID NO: 438631 - RNA, 64 nt, Human
ccccucucaccacagccaggagaggccuuuaccaccuggagagaagcuuccagaccagccccuc

SEQ ID NO: 438632 - RNA, 64 nt, Human
ccccucacaccacagccaggagaggccuuucccaccuggagagaaacuuccagaccagccccuc

SEQ ID NO: 438633 - RNA, 64 nt, Human
ccccucauaccacagccaagaggggccuuucucaccuggagagaaacuuccagaccagccccuc

SEQ ID NO: 438634 - RNA, 64 nt, Human
uugccuagugcuuuucaaaacucugugcuacacaggaguggauccaggccugaaggucauacaa

SEQ ID NO: 438635 - RNA, 64 nt, Human
cagacaaagccuggaaggguguggacccagacguggaguggagugauucucuugacguuuacau

SEQ ID NO: 438636 - RNA, 64 nt, Human
ugcaggcagugugggugcauggcagcguaacuguggaguggaugggcucugcauguaaggggug

SEQ ID NO: 438637 - RNA, 64 nt, Human
ccccucacaccacagccaggagaggccuuucccgccuggagagaagcuucaggccagcuccuca

SEQ ID NO: 438638 - RNA, 64 nt, Human
cuccucacaccacagccaggagagaccuuuucugccuggagagaaacuuucagaccagccccac

SEQ ID NO: 438639 - RNA, 64 nt, Human
ccccacacaccacagccaggagaggccguuccugccuggagagaagcuuccagaccagcccuuc

SEQ ID NO: 438640 - RNA, 64 nt, Human
cccuucacaccacagccaggagaggccuuucccaccuggagagaaacuuccagaccagccccuc

SEQ ID NO: 438641 - RNA, 64 nt, Human
ggauucuggucaacugguggagauuggcugacacccuggagaagccgaaaccagagagccuuuu

SEQ ID NO: 438642 - RNA, 53 nt, Human
agaaggcaggacucaaaugaugcccuggagaugucacagauuccuggcagagc

SEQ ID NO: 438643 - RNA, 64 nt, Human
cagaggccacccuacaaguuguccucaaggucauccuggagaugggauccaggacguggggcca

SEQ ID NO: 438644 - RNA, 64 nt, Human
uccacaaucucuacgacuaaucaccuacucaaugccuggagacagauacguaguugugcuuuug

SEQ ID NO: 438645 - RNA, 64 nt, Human
ugugcucccagcacuuccuucuuuucuaacauggccuggagagagucucucucuccuugucucu

SEQ ID NO: 438646 - RNA, 64 nt, Human
ugccugggggugggguuuucccugagcggcaacuccuggagaccacauagccugaauccucaga

SEQ ID NO: 438647 - RNA, 64 nt, Human
agguugucuucacccauguauuuugcgaugucacccuggagaauguccaccuuguguucagaug

SEQ ID NO: 438648 - RNA, 64 nt, Human
ggcuggcugcucugggcagcgccuucacucugacccuggagaaccauuucauuucauccugguc

SEQ ID NO: 438649 - RNA, 64 nt, Human
uaagugaugaauuuggguuaccgucucaugugaaccuggagauucaccagucuuaacuuuuggg

SEQ ID NO: 438650 - RNA, 64 nt, Human
guggggugcuggcagccucaggagcgaucgcuccccuggagagggugauugaguguggagauca

SEQ ID NO: 438651 - RNA, 64 nt, Human
gugguaagcaaccugggcaucuuaggaagcagucccuggagaaggcauguucccagaaaggucu

SEQ ID NO: 438652 - RNA, 64 nt, Human
cgaggggagagagcugugguucuccaucauugggggaguggaagggagcucccagcgcagccgu

SEQ ID NO: 438653 - RNA, 64 nt, Human
cagaauuccuaaacuuuaaaaugguacugucugcggaguggaguauggaugguuaugucaaagu

SEQ ID NO: 438654 - RNA, 64 nt, Human
uagaggcacauacaaaaccuacauucucuaguugggaguggauuuuuaaaguuuuccuuuuauc

SEQ ID NO: 438655 - RNA, 64 nt, Human
gauucuuuccgaccaugaaauagugcauaguuugccuggagaauccacucacguucauaaagag

SEQ ID NO: 438656 - RNA, 64 nt, Human
aagaccaguuuuuuaguauccuuuccucauucauccuggagaggauugugcaggcacauuaaua

SEQ ID NO: 438657 - RNA, 64 nt, Human
cuuguggaagacugucuuggauggggaaguacuaccuggagauuucaaauucacuuggccugca

SEQ ID NO: 438658 - RNA, 64 nt, Human
ugcagcuggaggcugcuguggggaccacacugauccuggagaaaagggauggagcugaaaaaga

SEQ ID NO: 438659 - RNA, 64 nt, Human
aucuucuggauuuuugccuggacccuucugcaagccuggagacuggaccugccacauguuccaa

SEQ ID NO: 438660 - RNA, 64 nt, Human
uagagcaagagcucugggggggccggaaagucucccuggagaaggccguaauaucugggccuug

SEQ ID NO: 438661 - RNA, 64 nt, Human
agauuugcccaauuaauacuagggugcaguguauccuggagagguagggugugugggggaggaa

SEQ ID NO: 438662 - RNA, 64 nt, Human
cccagcccaggggcacccccuuccccagcccccaccuggagagacauggccccugccaagcugg

SEQ ID NO: 438663 - RNA, 64 nt, Human
agaggcccuaccacacccuaacugcaccugucucccuggagaugaaaauauaugacgcugcccu

SEQ ID NO: 438664 - RNA, 64 nt, Human
gucagugucuggcuuuuuccucugagcccagcugccuggagagggucucgcugucacuggcugg

SEQ ID NO: 438665 - RNA, 64 nt, Human
cauagcugcccuuugcuguccucagagugcauuuccuggagacggcaggcuuaggucucacuga

SEQ ID NO: 438666 - RNA, 64 nt, Human
uccaguuaguuggaguuuuuaaaggcucuguuugccuggagaagcaaggagguuagaauguaau

SEQ ID NO: 438667 - RNA, 64 nt, Human
gauggugucagggcagcuaaggacaggauaaaggccuggagagggugcuugugcccuuauguua

SEQ ID NO: 438668 - RNA, 64 nt, Human
ccaacauuaaccugcccaccccacccccgucaucccuggagaauuccagcuuugucguaucuca

SEQ ID NO: 438669 - RNA, 64 nt, Human
aauguuuaaaauguuuggaugguuuguuguucugccuggagacaaggugcuaacauagauuuaa

SEQ ID NO: 438670 - RNA, 64 nt, Human
ggcccaguccccuugccuuuuuccuguucuguuuggaguggagaagggcagcaccucuguguuu

SEQ ID NO: 438671 - RNA, 64 nt, Human
uaguguuccuaucccaggauggcuguugggauuaggaguggaaugaggaauaguuuaggaccac

SEQ ID NO: 438672 - RNA, 64 nt, Human
acuagggcugggcugggggagggcagggccggacggaguggaucgggggcggccugagcaccaa

SEQ ID NO: 438673 - RNA, 64 nt, Human
gugcuuugcuagauaggacgguuuuugcaaagcaccuggagauguuugcugggagauagacucc

SEQ ID NO: 438674 - RNA, 64 nt, Human
aacaagaugcuaguucccaugucugugaagacuuccuggagaugguguugauaaagcaauuuag

SEQ ID NO: 438675 - RNA, 64 nt, Human
cuggcauucugguaccuucacccagccugagugcccuggagagggaacaggaaaugcugaucuc

SEQ ID NO: 438676 - RNA, 64 nt, Human
ugaagagugaggauaugaguagccccaacccaaaccuggagauggggagaaaccuacagaauac

SEQ ID NO: 438677 - RNA, 64 nt, Human
uggagcaccugggccccacuggacaacacugauuccuggagagguggcugcgcccccagcuucu

SEQ ID NO: 438678 - RNA, 64 nt, Human
agagaauuuauuuccuucuccacucucuccaugcccuggagaaaaaaaaguccagaagaaauca

SEQ ID NO: 438679 - RNA, 64 nt, Human
ccugaccucugaccucaccuacagcugggauguaccuggagagauaggggguaguucucccuac

SEQ ID NO: 438680 - RNA, 64 nt, Human
guggggugggugggcaugggagguaggggugggcccuggagaugaggagggugggccauccuua

SEQ ID NO: 438681 - RNA, 64 nt, Human
gugccaagauggaagucaccuuucugggcuuucuccuggagauagcuggggcuuauggguggcu

SEQ ID NO: 438682 - RNA, 64 nt, Human
caggcgaguaaccaggcaauggaguggagugucuccuggagagagugaggagagugugugauag

SEQ ID NO: 438683 - RNA, 64 nt, Human
gagcaacaguucagagguggcguaaaucuggccaccuggagagcucgagugccaccaguaccuc

SEQ ID NO: 438684 - RNA, 64 nt, Human
ggaaaaauaugugacaagugaauguaagucugugccuggagagcuaauagugcauuagucuauc

SEQ ID NO: 438685 - RNA, 64 nt, Human
agggcccuaccauuaggcauacuuucagaagcaaccuggagaacagcuaucaaucauauucaaa

SEQ ID NO: 438686 - RNA, 64 nt, Human
cucugugcauuuaagcuacuuguagagacccaggccuggagaguagacauuuugccucugauaa

SEQ ID NO: 438687 - RNA, 64 nt, Human
gugugcaccaggguucaguagaguccacuucugcccuggagaccacaaaucaacuagcuccauu

SEQ ID NO: 438688 - RNA, 64 nt, Human
aaugcccaugagauugaaggcacaguguuugacaggaguggaaaagcgguucaucggcuguuug

SEQ ID NO: 438689 - RNA, 64 nt, Human
uccucuuugggugcacggugucaaagugugggcaggaguggagagcuggugcccucaggaggag

SEQ ID NO: 438690 - RNA, 64 nt, Human
aaggguggcggguggcugaggucacaccaccacuggaguggaugggcagugccccacauggaca

SEQ ID NO: 438691 - RNA, 64 nt, Human
aggaaauuaagcaccgauguagcacuucccacugccuggagagaaauaaaccucgcaaguuauu

SEQ ID NO: 438692 - RNA, 64 nt, Human
ucuccuccacaugcgguccacacaucaguaagggccuggagauguguaaagacacagcaagggg

SEQ ID NO: 438693 - RNA, 64 nt, Human
accggugcccaaaucuggcugguggacagaagcaccuggagaguuggagagcuuuuuaaaaaga

SEQ ID NO: 438694 - RNA, 64 nt, Human
aauuaaugcauuuucauuuccuacugauacaaggccuggagagggcuguugggggcccucaggg

SEQ ID NO: 438695 - RNA, 64 nt, Human
uuggagggaaagccagccugggggcugggaggauccuggagaaguggguggggacagaccagcc

SEQ ID NO: 438696 - RNA, 64 nt, Human
aagaagaaaaguaaaaguacccauuguuucacuuccuggagauaaccauaguugcuauuuugcu

SEQ ID NO: 438697 - RNA, 64 nt, Human
gcuguaaccuuaagcccaucaaaguuacuuccagccuggagagaaccucaccaaacagcuggug

SEQ ID NO: 438698 - RNA, 64 nt, Human
uuucuaucaaccuucaaguauccaauucagggucccuggagaucauccuaacaauguggggcug

SEQ ID NO: 438699 - RNA, 64 nt, Human
gcagagaacaaggacagaggccaggcacugaggcccuggagacagcuguuccacuugcacacac

SEQ ID NO: 438700 - RNA, 51 nt, Human
ucacagccauacaccuguagcccuggagaggcccucuggaguggccacuaa

SEQ ID NO: 438701 - RNA, 64 nt, Human
aauggcacugugauuuuggccauucaacucacuaccuggagagaacuuaguaacuguuaaaauu

SEQ ID NO: 438702 - RNA, 64 nt, Human
auaaaaguaguuaaauaacaucagaaacugaguuccuggagaacuacaguuuagcauuccucag

SEQ ID NO: 438703 - RNA, 64 nt, Human
ucugggagagaaggugacacagcugggcccagacccuggagagacagcucugcaguuucccaca

SEQ ID NO: 438704 - RNA, 64 nt, Human
aacaaggugacauuuuucugcugcccauuuguguccuggagacggugguacccugaaggcagag

SEQ ID NO: 438705 - RNA, 64 nt, Human
agggcuggcgcaggugcuuccuaaagcucaccuuccuggagaugacaugcauagaaagaggggu

SEQ ID NO: 438706 - RNA, 64 nt, Human
ucauuuuugauggcuggcucugaaagcaccauguggaguggagguggagggagcgaggaaccau

SEQ ID NO: 438707 - RNA, 64 nt, Human
acuguucaauacuguaugccuucuguauuuuaauggaguggauagcauuguuuucuuuuacaga

SEQ ID NO: 438708 - RNA, 64 nt, Human
aaaugguuguggagaaaguggccggagccucccuggaguggagcagcccugaagccugugcccc

SEQ ID NO: 438709 - RNA, 64 nt, Human
ggaggacacccgacugugcacacuuccaggccucccuggagagguguccacuccauccuucccu

SEQ ID NO: 438710 - RNA, 64 nt, Human
cccgaaaugugugacauucagcuucuaaacgaugccuggagagucuguuugcugcagacacccu

SEQ ID NO: 438711 - RNA, 64 nt, Human
ggcccccuucuccauaugccuccaaaaacaugucccuggagaguagccugcucccacacuguca

SEQ ID NO: 438712 - RNA, 64 nt, Human
ggacucucugccucacccgcuucagcccagggccccuggagacugauccccucugaguccucug

SEQ ID NO: 438713 - RNA, 64 nt, Human
ggguugaccagauguuccaaaauaucugcauccaccuggagaugcagcuaaguggguccuuaug

SEQ ID NO: 438714 - RNA, 64 nt, Human
caguuacuuacccuauucuugcuuggaacaugagccuggagacccauggcaguccauaugccuc

SEQ ID NO: 438715 - RNA, 64 nt, Human
aaagacuucaggaaauucuaaggaaauuucuguaccuggagagagaguuuaggcaaauaacaau

SEQ ID NO: 438716 - RNA, 64 nt, Human
cagaaguauagcucuuuuccuaccugaacucuucccuggagaaaagauguuggcauugcugauu

SEQ ID NO: 438717 - RNA, 64 nt, Human
accauaucuuaaguauaggaaauuugguguccaaccuggagaugauuauauauuugaaauauuu

SEQ ID NO: 438718 - RNA, 64 nt, Human
uuucagggggguugugaggccuggccaggcacccccuggagagaaguuucuggcccuggcugac

SEQ ID NO: 438719 - RNA, 64 nt, Human
agagaaguuucuggcccuggcugaccccaaagagccuggagaagcugaugcuuugcuucaaauc

SEQ ID NO: 438720 - RNA, 64 nt, Human
ucauucauuguccuauuucuaucuccacuuugugccuggagagcuuucaggggagguggaggag

SEQ ID NO: 438721 - RNA, 64 nt, Human
ggucuccacuggggauugggccccugccagacccccuggagacuaaccccaccacacccucccu

SEQ ID NO: 438722 - RNA, 64 nt, Human
cucccucccuggacccaccgaugccucucgaagcccuggagacagccguugggugagggugggg

SEQ ID NO: 438723 - RNA, 64 nt, Human; identical to SEQ ID NO: 438704

SEQ ID NO: 438724 - RNA, 64 nt, Human
cagagcuacugaccaggucggggggccgcgguggggaguggaagagccgguccugcuguccgcc

SEQ ID NO: 438725 - RNA, 64 nt, Human
uucuucagucaguggauuuuagcaaggggagguaggaguggaagagaggugugaagaaaccucu

SEQ ID NO: 438726 - RNA, 64 nt, Human
aaacauucagcacguugaagaaaguguucccaauggaguggaagaugugcuucaaacagaugac

SEQ ID NO: 438727 - RNA, 64 nt, Human
uguaguuccaguauuauaugaugacuauugauuuccuggagagguuuuuuuuuuuuuugagaca

SEQ ID NO: 438728 - RNA, 63 nt, Human
uguuugcaggauuggccuaaugaagaaguucaaccuggagagauggaaaaucagcucucauaa

SEQ ID NO: 438729 - RNA, 64 nt, Human
gagaaacacaugccccuccaaguggggucuggggccuggagagacccucccacccagcagacca

SEQ ID NO: 438730 - RNA, 64 nt, Human
uaucaacaggaacuuucucagugagccauucacuccuggagaaugguauaggaauuuggagagg

SEQ ID NO: 438731 - RNA, 64 nt, Human
auguaaggaaacuuagugggagaguaacagaaugccuggagagccugacucugagcucuugaag

SEQ ID NO: 438732 - RNA, 64 nt, Human
uacagcuaccacccuuagggguaauugguaauuaccuggagaagaauggcuuucaauacccuuu

SEQ ID NO: 438733 - RNA, 64 nt, Human
uuaaaugaugaacaugagaccgcaaaaauucacuccuggagaucuccguagacuacaaucaauc

SEQ ID NO: 438734 - RNA, 64 nt, Human
cucugugcucaugcugaagauacuccagcgccuuccuggagauagcuggaaugagagugacuuu

SEQ ID NO: 438735 - RNA, 64 nt, Human
gaacaugauagcccauugagaaggaggcaggauaccuggagauuuguggaauacaguacgaguu

SEQ ID NO: 438736 - RNA, 64 nt, Human
ccucagcggcaggccagugaaggcguuuuccuagccuggagaugggaaaauaugcuuggcagag

SEQ ID NO: 438737 - RNA, 64 nt, Human
ggcacagugcccccuucccggacggguggcaggcccuggagaggaacugagugucacccugauc

SEQ ID NO: 438738 - RNA, 64 nt, Human
agaagcugcuucugcccacaccgcagggacaagcccuggagaaaugggagcuuggggagaggau

SEQ ID NO: 438739 - RNA, 64 nt, Human
uccacacaucuucuuggucuugcauaaggcaguuccuggagacccagcacucugguucucucuc

SEQ ID NO: 438740 - RNA, 64 nt, Human
ugacucagcagccgcaucugcuaccugauuuuauccuggagaauacagugcaauauuucucuuu

SEQ ID NO: 438741 - RNA, 64 nt, Human
ugaaauuucgagguaaucuacuuuggagacucugccuggagagggucaguuccuaaguuaaaag

SEQ ID NO: 438742 - RNA, 64 nt, Human
ugagccaaagacuggaguuuuuccagcuggggugggaguggagagacaacaggaacaacgcugc

SEQ ID NO: 438743 - RNA, 64 nt, Human
aucauuuguuuuuaugucagaauuugcaaagaguggaguggacaaagcucuguauggaagacug

SEQ ID NO: 438744 - RNA, 64 nt, Human
auauuuuacuuuugagagucuuuaaagaggaaggggaguggagggaacccugagcuaggcuuca

SEQ ID NO: 438745 - RNA, 64 nt, Human
aacauaaguugagaaguagugcuugguuauuaagccuggagaguguuugaauggcaaaauacua

SEQ ID NO: 438746 - RNA, 64 nt, Human
aauaauaauucaauuaagcaaccacgaauuucacccuggagauauuuuuucuuauuugagucca

SEQ ID NO: 438747 - RNA, 64 nt, Human
ggggccauguuuggggagggaggugugccagcagccuggagagccucagucccuguagcccccu

SEQ ID NO: 438748 - RNA, 64 nt, Human
aacauggaucugaggaggggcccuugggucgggcccuggagacgacacacggcagcccacaggc

SEQ ID NO: 438749 - RNA, 64 nt, Human
ugggugagucaccaucccaaagcaggaagggugcccuggagagaaccacccuccuccuacucuu

SEQ ID NO: 438750 - RNA, 64 nt, Human
augagcuggugugagugcugccgcuacaccgagaccuggagaagaccucuugccucauggaugu

SEQ ID NO: 438751 - RNA, 64 nt, Human
uacuuucuauaaugcuguacccagauucuaagaaccuggagaaggauuagcaguucuuaguaag

SEQ ID NO: 438752 - RNA, 64 nt, Human
ugcuggaaauagcuucuauauagucagcaguucaccuggagaaagaucuuaauuccuuguuguu

SEQ ID NO: 438753 - RNA, 64 nt, Human
agugguacagccauggcuaucgucaggccuguugccuggagaucucuaaguuaaggcaacaaga

SEQ ID NO: 438754 - RNA, 64 nt, Human
cuuucucucccccagcuccagugauucacgcccgccuggagaagaaucagagcucagcucauga

SEQ ID NO: 438755 - RNA, 64 nt, Human
gcgaguguuggguccucugcuuccugagcuguccccuggagaaggucccgaggaugcugucagg

SEQ ID NO: 438756 - RNA, 64 nt, Human
gggcccccauggggagcuggagccugcccugcagccuggagaagaggguggcuguggugggcgu

SEQ ID NO: 438757 - RNA, 64 nt, Human
ccaucuucauucguggagacuguggcccugcaacccuggagaaggacuugcugguacuuaaaaa

SEQ ID NO: 438758 - RNA, 64 nt, Human
uauggacuuugaucugccauacggagguucggaaccuggagaacggcugugauaaguagguuuu

SEQ ID NO: 438759 - RNA, 64 nt, Human
agugcggcguggagacuggcaggcggggggggcgccuggagagcgaggaggcgcggccucccga

SEQ ID NO: 438760 - RNA, 64 nt, Human
agcuccaggggucagcagcuuaguguaucaacagggaguggauucaccaaauuagccauuccau

SEQ ID NO: 438761 - RNA, 64 nt, Human
accuugguccuuuuguuuuuguucuggacucuugggaguggaaaugagaaugaguuuauuccua

SEQ ID NO: 438762 - RNA, 64 nt, Human
aaguccccaaacuaccucuuguuacaguagccagggaguggaauuucgucaaccgguacuuuua

SEQ ID NO: 438763 - RNA, 64 nt, Human
uacaauuaauguugacuguuuuagauuguaagcuccuggagagcaguauugcuguaguaggaau

SEQ ID NO: 438764 - RNA, 64 nt, Human
uaaacaaugcaucauagcgagcacuuuuccuuucccuggagaaugggaugugaagcaguagacc

SEQ ID NO: 438765 - RNA, 64 nt, Human
agggagccacugagcacagcaaggcaccaaagccccuggagaaaccgccagggcgaggugcgac

SEQ ID NO: 438766 - RNA, 64 nt, Human
guugguggggaggucgggaugccugggaucccuuccuggagaggcaggcugucucuggaaaaag

SEQ ID NO: 438767 - RNA, 64 nt, Human
uggccuguugguuucccucagagggggcagguggccuggagagagaggggcucaggaacuggga

SEQ ID NO: 438768 - RNA, 64 nt, Human
ggaaggcugagcagcuugguucuccccucuggccccuggagagaagggagcauuccuagacccc

SEQ ID NO: 438769 - RNA, 64 nt, Human
cuggggcugggguggggguggcagggagcugggaccuggagagacaacuccuguaaauaaaaca

SEQ ID NO: 438770 - RNA, 64 nt, Human
aauguggcaaguuugcagaugucauagaggcuauccuggagacuuaauagacauuuuuuuguuc

SEQ ID NO: 438771 - RNA, 64 nt, Human
caagucacaugcguaaacgacacucucuggaagcccuggagacccucgcccaacuccaccagau

SEQ ID NO: 438772 - RNA, 64 nt, Human
uacaguuccccugccucuugccccggcuaguuucccuggagagaggccuagccaacaacgaagg

SEQ ID NO: 438773 - RNA, 64 nt, Human
gguuuccuggacguggaaacaaguaucugaguucccuggagaucaacgggaugagguguuacag

SEQ ID NO: 438774 - RNA, 64 nt, Human
cuuuccuucccaggcaaaacuucgagaaucaacaccuggagacagucccuccacugugaacaag

SEQ ID NO: 438775 - RNA, 64 nt, Human
acaggugggccuaauuccaaggggcccuuccuggccuggagaaggccuuuuacacacacacaac

SEQ ID NO: 438776 - RNA, 64 nt, Human
cuaaagggccauagcccagugagcagccuggagcccuggagaccccaccagccucaccagcgcu

SEQ ID NO: 438777 - RNA, 64 nt, Human
cuugugagauuaaccuugggacacaguggguuagccuggagaaaaugagaggcccugccuggac

SEQ ID NO: 438778 - RNA, 64 nt, Human
uagggauacugcucacuagcuguggagguccucaggaguggagagaaugaguaggagggcagaa

SEQ ID NO: 438779 - RNA, 64 nt, Human
aaaaagaaaaccagaagccuuauuugugauuuugggaguggaagcuuccauuuuugugucaaaa

SEQ ID NO: 438780 - RNA, 64 nt, Human
aauggcuaagauugcucuaaaauuugcaaaaugaggaguggauugcaaauaauugagggauuua

SEQ ID NO: 438781 - RNA, 64 nt, Human
gauuuggucagucacaaauucuuuuuuagccuucccuggagaaaaacaaguccccaagaaaaaa

SEQ ID NO: 438782 - RNA, 64 nt, Human
cacagggacccaagcagucgaggucuuuaaugugccuggagaugacucucugcuauucaugaau

SEQ ID NO: 438783 - RNA, 64 nt, Human
gggcccuaggccauggagaaaaccuuaaacaaacccuggagacagggagccccuucuuucucca

SEQ ID NO: 438784 - RNA, 64 nt, Human
accuucccuaccugggcucuggggaggcugugggccuggagagggaaaaggagggagggggugu

SEQ ID NO: 438785 - RNA, 64 nt, Human
cuagaguccgcaucucaucuccaaacuacacuucccuggagaacaagugccacaaaaaugaaaa

SEQ ID NO: 438786 - RNA, 64 nt, Human
uggccuccauccccucaugggugcugccauccuuccuggagagagggaggugaaagcuggugug

SEQ ID NO: 438787 - RNA, 64 nt, Human
aaaaauuuuaaaaagcaggccacugucagcaaagccuggagaaguggggccggaggcuccgccc

SEQ ID NO: 438788 - RNA, 64 nt, Human
caccaucuguacccugcuucccaaacucccaggaccuggagacaggauugucuggggccgaggg

SEQ ID NO: 438789 - RNA, 64 nt, Human
uuggagaguuguucccccagggggcucugccccaccuggagaaggaagcugccugguguggagu

SEQ ID NO: 438790 - RNA, 64 nt, Human
cgaguaccucugaucuaaacgguaaaacaagcugccuggagagcagcuguaccuaacaauacug

SEQ ID NO: 438791 - RNA, 64 nt, Human
cccaugcagcaaggcuuggaggaagcgucagugcccuggagaucccagcucgcucuccccacug

SEQ ID NO: 438792 - RNA, 64 nt, Human
cuuguccccacugaacggcaacugagacuggguaccuggagauucugaagugccuuugcugugg

SEQ ID NO: 438793 - RNA, 64 nt, Human
gaggggugcuggccuugaaaugauucccccacuuccuggagagacugagcggaguugggagccu

SEQ ID NO: 438794 - RNA, 64 nt, Human
uucgaucucacacacacagaaacauacauucgugccuggagacccugcaggccagaguccaaau

SEQ ID NO: 438795 - RNA, 64 nt, Human
uuuuaaacagcaacaauuuaaagcuaugaagucaccuggagaaaaggaacguugcucuuggaca

SEQ ID NO: 438796 - RNA, 64 nt, Human
uuuaaacuuucuagaucuaaagcuuaaggacuauggaguggaucucauugaaguuucagacaau

SEQ ID NO: 438797 - RNA, 64 nt, Human
ggagagggaggagaagccugaauuggggagcuugggaguggaagcuuuucucaugcuugugauu

SEQ ID NO: 438798 - RNA, 64 nt, Human
uaaaaugugacuuaucuccuaauaaguuauggugggaguggagcugugcaguuuccugugucuu

SEQ ID NO: 438799 - RNA, 64 nt, Human
aaagcagcaggcagaguaaaaucugcugggacugccuggagauuugucaggagcugcagacaag

SEQ ID NO: 438800 - RNA, 64 nt, Human
gugggagcuggccugggccaggacggcagguggcccuggagaugggaaagugucugugucgagg

SEQ ID NO: 438801 - RNA, 64 nt, Human
caaugucuucuagcugcuuccucaaccccuguccccuggagaccagaagcugaggcccucucag

SEQ ID NO: 438802 - RNA, 64 nt, Human
ucucuacccauucuggagaacaggucacgccuguccuggagacagugugccgggaaaagggaac

SEQ ID NO: 438803 - RNA, 64 nt, Human
ugaaacaaauaccaagguauuccuucugcugcagccuggagaccaccgagagucgagcuggggc

SEQ ID NO: 438804 - RNA, 64 nt, Human
gcauaacaauuccucuacuaacaaucagcuccuuccuggagacugcccagcuaaagcaauaugc

SEQ ID NO: 438805 - RNA, 64 nt, Human
cuauuaaaaacuacauggggaaacaggugcaaacccuggagauggauuguaagagccaguuuaa

SEQ ID NO: 438806 - RNA, 64 nt, Human
ugugaacccgcgaaggccucaggauuaugguuaaccuggagaggagcaggccauggaggcaggu

SEQ ID NO: 438807 - RNA, 64 nt, Human
acuguugccacucuccuccccagacuaugaaaucccuggagaauuuuuggugacaugcacugag

SEQ ID NO: 438808 - RNA, 64 nt, Human
cuugcgucccuguuuggccagagcaaggaucuggccuggagaggcccauccuauaccccuuauu

SEQ ID NO: 438809 - RNA, 64 nt, Human
uacgguucuuaaccucaucuguuaaguucccaugccuggagaagcuaaugccaacucaucaugu

SEQ ID NO: 438810 - RNA, 64 nt, Human
gaaggucuuuuauaaacucaauggggaccaccuuccuggagaggcugcucccuuacagaccugg

SEQ ID NO: 438811 - RNA, 64 nt, Human
agaaacuccugaucauuggccaaagggacuuaccccuggagaggccaagugccuucuaggaagu

SEQ ID NO: 438812 - RNA, 64 nt, Human
gcuucuucuucaauagaggaauuguucuggggguccuggagacuuaccauugagccaugcaauc

SEQ ID NO: 438813 - RNA, 64 nt, Human
acuguacucaggggagauggcccuaccacagccaccuggagaggguugggaagccuuccgucug

SEQ ID NO: 438814 - RNA, 64 nt, Human
ugauauauguguuggaagacugaguauugaugggggaguggaccagacaaagagguaagaugaa

SEQ ID NO: 438815 - RNA, 64 nt, Human
ggauguacuuucagaucauguaaccuauuacgaaggaguggaagaggagacaauuugaaugaau

SEQ ID NO: 438816 - RNA, 64 nt, Human
guuuaaugaagauacuaaaaauaaugcacuggaaggaguggaagaguuggaaaauuuguaacca

SEQ ID NO: 438817 - RNA, 64 nt, Human
cugccuucccggaccccuccccggguuggcucucccuggagaccucuccaucauucccgaaaag

SEQ ID NO: 438818 - RNA, 64 nt, Human
accaccuaagaugccacuuugaauucucuaagacccuggagaauugcauuucuuucacugugcu

SEQ ID NO: 438819 - RNA, 64 nt, Human
ucacaaaggagagagggaagaaaagaucuuuugcccuggagauaugguccugaaaucucucccc

SEQ ID NO: 438820 - RNA, 64 nt, Human
ugagccgggagaacagggagcuccuggagcgcagccuggagagucgggaccaccugcaccgcga

SEQ ID NO: 438821 - RNA, 64 nt, Human
aaggauagugcuggcuuccauggaaacccucacuccuggagauuccauuccauuuucaagugua

SEQ ID NO: 438822 - RNA, 64 nt, Human
ccacccucauccuuaccuccuccuacucaagcugccuggagaagaccugcucucagcugcccac

SEQ ID NO: 438823 - RNA, 64 nt, Human
ucccagccucuggauccuggggaagguuccagucccuggagaauacccagggccucaaacuuga

SEQ ID NO: 438824 - RNA, 64 nt, Human
ucagcuccagccgacuggggcauuggugguagccccuggagacauugugcaauggggcuacgag

SEQ ID NO: 438825 - RNA, 64 nt, Human
uuccgauuccauucccagccccugcguuaaggucccuggagagguggcgucagugggggugagg

SEQ ID NO: 438826 - RNA, 64 nt, Human
cacuugagcuugccacucuguauaauucuaacauccuggagaaaaauggcaguuugaccgaacc

SEQ ID NO: 438827 - RNA, 64 nt, Human
aaggagcugcugagaaggagcacuccacugugugccuggagaauggcucucacuacucaccuug

SEQ ID NO: 438828 - RNA, 64 nt, Human
gugggugucaucuccuccgaccgaggcuucucacccuggagauggcaguuacuccuggccaugg

SEQ ID NO: 438829 - RNA, 64 nt, Human
cgccaccacuaauccagacggcggcucacccuaaccuggagaagcuggguuauacccaggacau

SEQ ID NO: 438830 - RNA, 64 nt, Human
ugccugccugagguccccgcugccagucccgggcccuggagagcagaugcugucuuguuaugua

SEQ ID NO: 438831 - RNA, 64 nt, Human
cucugcccugccuacuuuuaguugacucacaggcccuggagaagcagcuaacaaugucugguua

SEQ ID NO: 438832 - RNA, 64 nt, Human
ugagugcaucaaguacaugcggcagaucucggagggaguggaguacauccacaagcagggcauc

SEQ ID NO: 438833 - RNA, 64 nt, Human
aagaacuagguaaugacuggaaugucagagugugggaguggauuaauguaagucuccucagaaa

SEQ ID NO: 438834 - RNA, 64 nt, Human
uggcaugaacugcauggaggcauaacagucagggggaguggaagagguaccaggagucacucag

SEQ ID NO: 438835 - RNA, 64 nt, Human
guauagcuugcccucacuugcucaaaaacaacuaccuggagaaaacagugccuuuccuugcccu

SEQ ID NO: 438836 - RNA, 64 nt, Human
caugugaagagucaccagcagauuccugggcucgccuggagacauuccuagucgguauuccugg

SEQ ID NO: 438837 - RNA, 64 nt, Human
acucuuccuccuggcaucaggggccaugaagcccccuggagagagauguuggagccacccauca

SEQ ID NO: 438838 - RNA, 64 nt, Human
acguuuacccacccugguucagagcccagcuucuccuggagagccggacccucagggcccugaa

SEQ ID NO: 438839 - RNA, 64 nt, Human
gcccucuggccagagggaagcgggcagcucuagcccuggagauuguggucacauuggggcuugu

SEQ ID NO: 438840 - RNA, 64 nt, Human
ugacugccaagccauggguagccuggguguaaaaccuggagaugguggaugauccccacgccac

SEQ ID NO: 438841 - RNA, 64 nt, Human
uuugacuguugacuuaauagcuccucucacucugccuggagauacuuccugccucagaugagga

SEQ ID NO: 438842 - RNA, 64 nt, Human
cugcucaaggacccucagcaacuggggccaggggccuggagacacuccauggagcucugcuugu

SEQ ID NO: 438843 - RNA, 64 nt, Human
guugccaaguugucuuugcucuuagguggguuauccuggagaaaauggacucaggagcuaauac

SEQ ID NO: 438844 - RNA, 64 nt, Human
cuauccaugggucaaaguccaccucuccugggggccuggagaggacugagccuacggaaagggg

SEQ ID NO: 438845 - RNA, 64 nt, Human
uuggaaagugugaaauuuguauuuggaaaagcugccuggagagaagaacuguguccuuuacugu

SEQ ID NO: 438846 - RNA, 64 nt, Human
uuuugccaccuuuccuguucaugacagcuacuaaccuggagacaguaacauuucauuaaccaaa

SEQ ID NO: 438847 - RNA, 64 nt, Human
ggcucuaacauuacugccuucaguaucaaggcugccuggagaaaggauggcagccucagggcuu

SEQ ID NO: 438848 - RNA, 64 nt, Human
gucaacucuucucaaaaucccaggcuggaaauuaccuggagacaagaguugaguaccguggaug

SEQ ID NO: 438849 - RNA, 64 nt, Human
ggaggauccguaagggauguccuaagagcugcacccuggagaugggguguaggaagaaguggcu

SEQ ID NO: 438850 - RNA, 64 nt, Human
uuuugcucauaauauaaauaucagauuauguuuaggaguggauuagguaauuagugucacuaca

SEQ ID NO: 438851 - RNA, 64 nt, Human
gagcucagaccccaacccuggaucccaggagaaaggaguggaccgaggaaggaaggaaggcaag

SEQ ID NO: 438852 - RNA, 64 nt, Human
uauuugaucaauguacucauuuuucuuuaugcaaggaguggaugucuuauuguaaaugaauaga

SEQ ID NO: 438853 - RNA, 64 nt, Human
uuugaaaaucccgaauuuuugacagccccucaggccuggagaguuaucuacagauguuaggaua

SEQ ID NO: 438854 - RNA, 64 nt, Human
uagcccaccucauguccagcuguccacuuuccauccuggagaaagaacagugugccucaaacuc

SEQ ID NO: 438855 - RNA, 64 nt, Human
ugcgggugucuaggacagauugcuuccacuagaaccuggagacauagcaucuuugauagcauaa

SEQ ID NO: 438856 - RNA, 62 nt, Human
guaaucccagugugcugugauuccucugcuugccuggagacguggaaccucugucucauccu

SEQ ID NO: 438857 - RNA, 64 nt, Human
gguuucuuuuuuuuuuuuuuuccuauuggaucuuccuggagaaaauacuuuuuuuuuuuuuuuu

SEQ ID NO: 438858 - RNA, 64 nt, Human
uggaggacaggaggcuauggggcccagcuacgcaccuggagauccugaacugucaagccacugg

SEQ ID NO: 438859 - RNA, 64 nt, Human
agggugggaucagcccugccaggugggccgccuuccuggagacccguagaugccagggcuggaa

SEQ ID NO: 438860 - RNA, 64 nt, Human
ugccaagcuaacuauugacuauagguuugccuuuccuggagaauuaauugagcaauugaggagu

SEQ ID NO: 438861 - RNA, 64 nt, Human
cccagucccauuccucagcuucuucacaggcacuccuggagauaugaaggauuacucuccauau

SEQ ID NO: 438862 - RNA, 64 nt, Human
agacuguggggcuucaagcaauaacaagcagaggccuggagagaggacacaaggagggugcgug

SEQ ID NO: 438863 - RNA, 64 nt, Human
uguccccuaaugauaggauauucccugcugccuaccuggagauucaguaggaucuuuugagugg

SEQ ID NO: 438864 - RNA, 64 nt, Human
gccggugggcaggcggggagagcagcuuuccuucccuggagagaaccgucuuuaccucagcucc

SEQ ID NO: 438865 - RNA, 64 nt, Human
aagcaugaggugagagaaagccacaaagucagugccuggagaaggguucagcccaacauggggc

SEQ ID NO: 438866 - RNA, 64 nt, Human
ugugaaguaauauggcccacacuuuauucaccacccuggagaaaaaaaaacccaggaauaugug

SEQ ID NO: 438867 - RNA, 64 nt, Human
aaagagcaaugacuuuauuuugcauuggagaacuccuggagauaagcuguacaaauugaaucua

SEQ ID NO: 438868 - RNA, 64 nt, Human
cugaagccggagagcugcggaagcccacucaggaggaguggaggcaggugagcguggccaggcg

SEQ ID NO: 438869 - RNA, 64 nt, Human
gcccacguuucuuuuguuaacuuaaaugaagaaaggaguggagggaggggaucuaaaacccccc

SEQ ID NO: 438870 - RNA, 64 nt, Human
uuagagagcaucugcaacaaaaagucauuuuucuggaguggaaaagcuuaaaaaaauuacugug

SEQ ID NO: 438871 - RNA, 64 nt, Human
ucuaacgcaaaccccugacuucauggaugaggaaccuggagaccaaagagacaaagggacuuuu

SEQ ID NO: 438872 - RNA, 64 nt, Human
cgcacagcacuccuguaacugucucagaaccacuccuggagaaagacuuccuugcaggagugac

SEQ ID NO: 438873 - RNA, 64 nt, Human
ggggaucuuacaacuuuacuuuguucuccagaggccuggagaacacuuagggauugugaaaaua

SEQ ID NO: 438874 - RNA, 64 nt, Human
aagcugagaacuucggaaaaggcucaucugucacccuggagaagggaaacuguacuuuucccug

SEQ ID NO: 438875 - RNA, 64 nt, Human
caacaggcuacagugucccugauucuuggaaaagccuggagaagcuggggagaugcgguucaca

SEQ ID NO: 438876 - RNA, 64 nt, Human
cgcuucccuuucuacuccagcagcaggaagauagccuggagaaggugauuaaagauacggaguc

SEQ ID NO: 438877 - RNA, 64 nt, Human
ugguugcaguccaaguacucucguuuagucugagccuggagauguucuagacuugcuucuccca

SEQ ID NO: 438878 - RNA, 64 nt, Human
acuaugacuuuaaagaucagaugccaucuuucuuccuggagaagaggagauuuucucuuuugag

SEQ ID NO: 438879 - RNA, 64 nt, Human
agauuucucuugauauaucucugugcuuuugagaccuggagaucuaauucuguuuagacauuuu

SEQ ID NO: 438880 - RNA, 64 nt, Human
cacccaggcugcguccaacagccugugacucuucccuggagaccccuucucucacacuuuuauc

SEQ ID NO: 438881 - RNA, 64 nt, Human
ugcauaagggucaaccacauuuuuccucaaguucccuggagaagaagcugaacuccugguuucu

SEQ ID NO: 438882 - RNA, 64 nt, Human
acagcccuucccccaccacugggacccuccccagccuggagaguucaucacuacguaaggaaag

SEQ ID NO: 438883 - RNA, 64 nt, Human
acccacacggugcaaaucuuugggucagugagcuccuggagaagagaggagacaugucaggaau

SEQ ID NO: 438884 - RNA, 64 nt, Human
gccugugguagacagcgugaaucaugaaaauaagccuggagaguucuguuauuaaggggcauag

SEQ ID NO: 438885 - RNA, 64 nt, Human
uccaguaaacauccagccauucagacaaagggggccuggagauacagagagcccaaauaaugcc

SEQ ID NO: 438886 - RNA, 64 nt, Human
uggcccagagccucugcuggaaggggcagcaggaggaguggaaggaaaccgcugccuuuaucuu

SEQ ID NO: 438887 - RNA, 64 nt, Human
cuaaagugaaguuuuccuaaggcaagcaagaagaggaguggaagcacaguugccuggauuugga

SEQ ID NO: 438888 - RNA, 64 nt, Human
aauaggcagcauuauuucaaacauauucaaguugggaguggagaucauugccuagaagucaaua

SEQ ID NO: 438889 - RNA, 64 nt, Human
gcaggcugccgggccccuucugcuucccuuggagccuggagauacuuuuguaacaagccagaug

SEQ ID NO: 438890 - RNA, 64 nt, Human
ggcuggggcggccaguuuugacacgccccagugcccuggagaacaaccagggucaucugcacuu

SEQ ID NO: 438891 - RNA, 64 nt, Human
ucugggugugggccccuggccgccucccuccagcccuggagaggagggcagggcugcggggagg

SEQ ID NO: 438892 - RNA, 64 nt, Human
ccucgggcagugggaagagcuccugugucaacauccuggagaacuucuacccccuggagggggg

SEQ ID NO: 438893 - RNA, 64 nt, Human
aggguuuggguagagguagaaagguuuaauuaacccuggagaucugcaaauggagggaggggug

SEQ ID NO: 438894 - RNA, 64 nt, Human
cagggaaugguucauuuacucuuaaucuuuaugcccuggagaagaccuacuugaacagggcaua

SEQ ID NO: 438895 - RNA, 64 nt, Human
cuucauuguaauggaaguuucaguugggcaugagccuggagagaugugacugucuacaguucua

SEQ ID NO: 438896 - RNA, 64 nt, Human
ugguagucaccuucaugucaucuauaauaguacuccuggagagcccuggcugccuacaccagug

SEQ ID NO: 438897 - RNA, 64 nt, Human
acacugacuccugacaaaaugcagccugcaacuuccuggagaacaacucagugucacauuaaag

SEQ ID NO: 438898 - RNA, 64 nt, Human
acuggggacacaucaaagugugguguuugguuugccuggagaugccacguugaaucaugugauu

SEQ ID NO: 438899 - RNA, 64 nt, Human
agguaagggacaaaagccuuuuaccuuuaauuuuccuggagaauuauauaaagguuuucuuaga

SEQ ID NO: 438900 - RNA, 64 nt, Human
aagaggcaaaagagaaaagacucaagaaacugauccuggagaucgagaccauccuggcuaacau

SEQ ID NO: 438901 - RNA, 64 nt, Human
ggggcugucgauuuccugccaccugggcagauaaccuggagauuuucaccuuuucuuuucagcu

SEQ ID NO: 438902 - RNA, 64 nt, Human
agaugcaagaauuuccaagaacuuucuuagccuuccuggagauggcuacaucccuacuaauaua

SEQ ID NO: 438903 - RNA, 64 nt, Human
uggccaaaagucggaaaaugagaaugaggguaauccuggagaaauugugacaacaauuugaaaa

SEQ ID NO: 438904 - RNA, 64 nt, Human
gugcugcauugccugcggucaaggccagcaagguggaguggaugccucagaacggacgagauaa

SEQ ID NO: 438905 - RNA, 64 nt, Human
agaaaauuuucuuucaacauuucuugaaggacauggaguggagauuggaucauuuaacaauaua

SEQ ID NO: 438906 - RNA, 64 nt, Human
gagaagguugauuugucuuuuagcuaucguauuuggaguggaacuauaauacaaauguauaaua

SEQ ID NO: 438907 - RNA, 64 nt, Human
gcacgcggccuugucugggugcagcugggcuuggccuggagaggacggcccugccugccucuug

SEQ ID NO: 438908 - RNA, 50 nt, Human
accccaccacgccucugugaccuggagaagauccagaacuugcgugcagc

SEQ ID NO: 438909 - RNA, 64 nt, Human
ccuguggaaguuuaggggcaaauuuguucccugaccuggagaggguuagaaagaaccaacagcu

SEQ ID NO: 438910 - RNA, 63 nt, Human
uuucacaggaaaauagacaaaauuauaagagauuccuggagacaacacaaggaaaacaauguu

SEQ ID NO: 438911 - RNA, 64 nt, Human
ggaggagcccauccccaggagacucaggcaguggccuggagaggcuuuguucuguaacggugcc

SEQ ID NO: 438912 - RNA, 64 nt, Human
uuuauugcucagaaaugaggcauauccuaaaaauccuggagagcuguauuuaaugcauuuuugc

SEQ ID NO: 438913 - RNA, 64 nt, Human
uuggauuacuggauuuuuuuuuuuuuuaaacacaccuggagaggacauuugaaaacacuguucu

SEQ ID NO: 438914 - RNA, 64 nt, Human
agagcugcgcccaucccgcagaggccccuguccaccuggagacccggagacagaggccuggaca

SEQ ID NO: 438915 - RNA, 64 nt, Human
uaaagguuaagcccugaggggucccugauaacaaccuggagaccaggauuuuauggcuccccuc

SEQ ID NO: 438916 - RNA, 64 nt, Human
aaugaauauuuauuagcugguuggagagcuagaaccuggagagcuagaaccuggagaacuagaa

SEQ ID NO: 438917 - RNA, 64 nt, Human
gcugguuggagagcuagaaccuggagagcuagaaccuggagaacuagaaccuggagggcuagaa

SEQ ID NO: 438918 - RNA, 64 nt, Human
agaaucuggagagcuagaaccuggagggcuagaaccuggagagcuagaaccuagaagggcuaga

SEQ ID NO: 438919 - RNA, 64 nt, Human
gaaccuggcagguuagaaccuagaagggcuagaaccuggagagccagaaccuggagggcuagaa

SEQ ID NO: 438920 - RNA, 64 nt, Human
agaaccuggagggaaugaaccuggagggcuagaaccuggagaaugagaaaaauuuacauggcaa

SEQ ID NO: 438921 - RNA, 64 nt, Human
cuguguagugacuuuuuaauuauaguuuucauaaccuggagaucagacuguugcuuucgcauga

SEQ ID NO: 438922 - RNA, 64 nt, Human
gggcccauaaaaauucccaguaugcauguuuuaugcucaccauuaugaauuggggucuucaaag

SEQ ID NO: 438923 - RNA, 64 nt, Human
agcgccuggggaccagacagacgcauguggcaaagcucaccaucuucacuacaaacacgccuga

SEQ ID NO: 438924 - RNA, 64 nt, Human
cugaaaggcgagcagaacucccccuggggaggaagcucaccaaaaguuuuucccaaagcucaau

SEQ ID NO: 438925 - RNA, 64 nt, Human
cucacugcccacacacggcgcaggcugcccgccuccuggagagcacacuucagcugaaacagua

SEQ ID NO: 438926 - RNA, 64 nt, Human
uccaguguaccaagcacugacuuuaugccuuuggccuggagauggcagaagugaaagcuggcca

SEQ ID NO: 438927 - RNA, 64 nt, Human
ccagaagcagaugccagugcuaugcuuccuauagccuggagaacugugagccaauuauaccucu

SEQ ID NO: 438928 - RNA, 64 nt, Human
uccucccuccuaccagaugacacagacaagaguuccuggagaaugggaguguuaagacuuuuga

SEQ ID NO: 438929 - RNA, 64 nt, Human
cuuccccaccagugaucucucccgacugcacugcccuggagaggcagcaucaggaccuaagccc

SEQ ID NO: 438930 - RNA, 64 nt, Human
gaccaucagccugccucccaguagaggcccuucaccuggagaagucagaaaucugacccaauuc

SEQ ID NO: 438931 - RNA, 64 nt, Human
gcucagggacccccaggaccaggaugugucucagccuggagaaauggugggggggcagugucua

SEQ ID NO: 438932 - RNA, 64 nt, Human
cauaaaacacuuaaguguuuucuucacuccgugaccuggagaguuuuccauuuuuuaaaauaca

SEQ ID NO: 438933 - RNA, 64 nt, Human
gcaggacagacagcguuguccaaucagggauuguccuggagaacugggugggggucugugggug

SEQ ID NO: 438934 - RNA, 64 nt, Human
aggagcagccucagaacaaagugagacaguccagccuggagaugaaaucuuacagcuggguggc

SEQ ID NO: 438935 - RNA, 64 nt, Human
guuggccauuucuguguuucccuuuaaaccagauccuggagacagugagauacucagggcguug

SEQ ID NO: 438936 - RNA, 64 nt, Human
ugaccccacuguuugaagaagaaaaggugcuuacccuggagaugcuacagagacacaguggaau

SEQ ID NO: 438937 - RNA, 64 nt, Human
aaagagaaauuguccaaagaguccucagaaccugccuggagaaaugcgcaugggggugggccug

SEQ ID NO: 438938 - RNA, 64 nt, Human
cucugagggcccagcccuccccggggcgcucugcccuggagacuccggacacugacagccgcgu

SEQ ID NO: 438939 - RNA, 64 nt, Human
acaaucaucuaaaagccagccacugucagcaaagccuggagaaaugggaccagagagucugccc

SEQ ID NO: 438940 - RNA, 64 nt, Human
guugcccaagcuggagugcaauggcgcgaucucggcucaccacaacauccgccuccuggguuca

SEQ ID NO: 438941 - RNA, 64 nt, Human
aggauggcccacaucuacgggcgcugcacgaccugcucaccaccuaugccguuacccacccaca

SEQ ID NO: 438942 - RNA, 64 nt, Human
aaugcauguaaucaacauggcuacuugcuuugaggcucaccagaauuauuuuuaagugguuuua

SEQ ID NO: 438943 - RNA, 64 nt, Human
aggagccuugguccaugcugagcauccuggaggaccuggagagcugggagaccaugaugagccu

SEQ ID NO: 438944 - RNA, 64 nt, Human
cuucacuagccucucugaagguguccuggccagcccuggagaagcacuggugucugcagcaccc

SEQ ID NO: 438945 - RNA, 64 nt, Human
caggggacagaauaacccaguggaggaugccaggccuggagacguccagccgcaggcggcugcu

SEQ ID NO: 438946 - RNA, 64 nt, Human
gagccacaggaugguaccuggccccaaaaggaauccuggagaggaggacagugacaacagguga

SEQ ID NO: 438947 - RNA, 64 nt, Human
ucaagagcuggaaccucccucagcucacuccgagccuggagaacugcaggggccaagguggagg

SEQ ID NO: 438948 - RNA, 64 nt, Human
uggugcugucugaguauccccagagcaagagagaccuggagacaccagggguggaggguccugg

SEQ ID NO: 438949 - RNA, 64 nt, Human
guggagggacagugauggccuuugacucaugaggccuggagaaaaguaucaaaggucucaccau

SEQ ID NO: 438950 - RNA, 64 nt, Human
uccuaccccggcaggggcuuccggggccuuuucaccuggagaaacauucccacuccccuuuggc

SEQ ID NO: 438951 - RNA, 64 nt, Human
cccugaaccacacgggguuuauuugcggauguucccuggagaggucgcuuugugaagaaaccau

SEQ ID NO: 438952 - RNA, 64 nt, Human
auugaccacucaaaacucagaucaucucgcccacccuggagagugcagagcuaucuguagacuu

SEQ ID NO: 438953 - RNA, 64 nt, Human
cguucaucgggaaccaggacacuuacgagacccaccuggagacuugccgcuucgagggccugaa

SEQ ID NO: 438954 - RNA, 64 nt, Human
acuccacugggguggaugggcugccugcacagccccuggagagggggccaggcacacccucaga

SEQ ID NO: 438955 - RNA, 64 nt, Human
cuucuauccccaagaaccccuucccugcuugcacccuggagagaacagcuugacucccaucaac

SEQ ID NO: 438956 - RNA, 64 nt, Human
aggauaaugguggcuccagcgacaggaggccaacccuggagaccaagaacagggcgccuggcug

SEQ ID NO: 438957 - RNA, 64 nt, Human
auuuccuuggggcugcaguuuugugguugaggggccuggagaaaaucauuuucuccccuuggca

SEQ ID NO: 438958 - RNA, 64 nt, Human
uugagcaugaaucccuggagaaaucguuuucguagcucaccaauggugaguaaagauacagcuc

SEQ ID NO: 438959 - RNA, 64 nt, Human
agaauacucacguuuuuuaacucauguagugauugcucaccacuuugcaaaguauuuuuccugc

SEQ ID NO: 438960 - RNA, 64 nt, Human
gcuagugaagaagcaggagcuucuuguuuuaauugcucaccaaugguugguucuugaguggcua

SEQ ID NO: 438961 - RNA, 64 nt, Human
gaacagccugucaccacacaauuacuuuuauaacccuggagaugaaaaucuccuuguccucaaa

SEQ ID NO: 438962 - RNA, 64 nt, Human
aauccugccaauaaauccugucuuauuuguucauccuggagaauugaagggaggucaaguuguu

SEQ ID NO: 438963 - RNA, 64 nt, Human
gggugcuucgagggugaggacuucucuggagaggccuggagaccuagcuccauguuccuccucc

SEQ ID NO: 438964 - RNA, 64 nt, Human
ggaggaucucuugaagucaagaguuugagaucagccuggagaacaaagugagacccccaucuau

SEQ ID NO: 438965 - RNA, 64 nt, Human
cagaggccgcuggucacuucgucaucauuuugccccuggagacgucuuucuuugugccuugaug

SEQ ID NO: 438966 - RNA, 64 nt, Human
ggcccuuccucuccacugccuucgauacaccgggccuggagaacuagagaaggacccggagggg

SEQ ID NO: 438967 - RNA, 64 nt, Human
uuccacaaugagcgccugauaaccaggguugguuccuggagaauucacucauugauucauuugu

SEQ ID NO: 438968 - RNA, 64 nt, Human
gauaggaacaugcacaaagcaguuaauuaggcagccuggagaaaaccagagauccaguacagaa

SEQ ID NO: 438969 - RNA, 64 nt, Human
cccgcagguggccagaggcagggguagcugaguuccuggagaccccuuuuuugcccccagguuc

SEQ ID NO: 438970 - RNA, 64 nt, Human
agcccuaaucugcccuuaggaguccaggcugcacccuggagaucccaaaccuagcccccuagug

SEQ ID NO: 438971 - RNA, 64 nt, Human
ccuuggcagaggcagggaagcucuaccgcaaggaccuggagauugugcucugcagcgagccccc

SEQ ID NO: 438972 - RNA, 64 nt, Human
uaaaaaccugcuugguguguagguuccguaucucccuggagaagcaccagcaauucucuuucuu

SEQ ID NO: 438973 - RNA, 64 nt, Human
guauauauacacgguauuuauagagagagacuauccuggagaagccucguuuugaugccauucu

SEQ ID NO: 438974 - RNA, 64 nt, Human
uaauuuauaauuuugaucgaguuucuuaaaagacccuggagaaagaguggcauuucuucuguuu

SEQ ID NO: 438975 - RNA, 64 nt, Human
cuuugaagacgcggcccugccccgacacaggcagccuggagaagcugggcaggacaaguaggac

SEQ ID NO: 438976 - RNA, 63 nt, Human
accaccgcaaagcccugugagcgucuacagacagcucaccauuuuuguccuguaucuguaaac

SEQ ID NO: 438977 - RNA, 64 nt, Human
guuggcuaugccuuuucagacauugauuuggacagcucaccaaccccugaaggggccguucagc

SEQ ID NO: 438978 - RNA, 64 nt, Human; identical to SEQ ID NO: 323239

SEQ ID NO: 438979 - RNA, 64 nt, Human
aggcugccuccuccagggcgacggccggggacugccuggagagcuccuauuucaaggagaagcc

SEQ ID NO: 438980 - RNA, 64 nt, Human
agcugagcuggggguugaauuucuccaggcacucccuggagagaggacccagugacuuguccaa

SEQ ID NO: 438981 - RNA, 64 nt, Human
uagucucccuaucccacgagggggcuuugauggcccuggagauccuacaguaaauaaaccagca

SEQ ID NO: 438982 - RNA, 64 nt, Human
uugcugcagaccaucuggggucuugcccaagcacccuggagacuuugcucccugguuuccuggu

SEQ ID NO: 438983 - RNA, 64 nt, Human
ccguggacagccucagggggcugucggccaagagccuggagaaagggagcaagcugcccccucc

SEQ ID NO: 438984 - RNA, 64 nt, Human
gagaugugcagggugggucuuggggcugggucugccuggagaccagugggcccagggggaaggg

SEQ ID NO: 438985 - RNA, 64 nt, Human
gaagccagaacuguuggaaugaauggcagcccucccuggagaggcagccuguuuacugaauaca

SEQ ID NO: 438986 - RNA, 64 nt, Human
uccugauggccugagccaggcaucuugacuggcaccuggagagcccuuaagucuguccuggcug

SEQ ID NO: 438987 - RNA, 64 nt, Human
ugcgucacagccagagggacaaagugugggugauccuggagacgccaguuuccgagauuguucu

SEQ ID NO: 438988 - RNA, 64 nt, Human
cuggggacacacuuuggaaagugggacccuccagccuggagaccccauggacugaugccuccac

SEQ ID NO: 438989 - RNA, 64 nt, Human
uggggcugcugugaggaaaaccugccauuguggcccuggagagucaccagcagcucuugggaag

SEQ ID NO: 438990 - RNA, 64 nt, Human
acugcgcggcggcccaggagcucggacugcugguccuggagagcugcccccagaagaagcugga

SEQ ID NO: 438991 - RNA, 64 nt, Human
cccccgcccacccuccugaccgcagcucccaggcccuggagaccuccaggcuuuccugcccugg

SEQ ID NO: 438992 - RNA, 64 nt, Human
gugugauguccggguccuuuaucauccuauucauccuggagaggaaaagugucgggcaaagggg

SEQ ID NO: 438993 - RNA, 64 nt, Human
cugaaaauucugauuaagccucugggcccuacagccuggagaaccuggagaauccuacacccac

SEQ ID NO: 438994 - RNA, 64 nt, Human
aagacaucacaaucccauuauucagagcgcguauggaguggaaacgcuuguaaggcuucaccag

SEQ ID NO: 438995 - RNA, 64 nt, Human; identical to SEQ ID NO: 438906

SEQ ID NO: 438996 - RNA, 64 nt, Human
cuuugaauaaaacugauaacuuauuuguauaauuggaguggagaccuaccuccauaauuagaua

SEQ ID NO: 438997 - RNA, 64 nt, Human
cugauuaagccucugggcccuacagccuggagaaccuggagaauccuacacccacagaacccgg

SEQ ID NO: 438998 - RNA, 64 nt, Human
caucccuucucccaccuccuccccucucccucccccuggagacccuggaagugguguguucaca

SEQ ID NO: 438999 - RNA, 64 nt, Human
agaucacaucuuaaauucauuucuagacucaaaaccuggagaugcagcuacuggaaugguguuu

SEQ ID NO: 439000 - RNA, 64 nt, Human
gguccuagccuggagcaggcgccugcgcccagacccuggagagccuugacccagagccugugcu

SEQ ID NO: 439001 - RNA, 64 nt, Human
cggccagagggugugcggagcugguggggaggagccuggagagaaggggcagagcugggggcug

SEQ ID NO: 439002 - RNA, 64 nt, Human
acugaugacacugagaacagaucuccaaagcuuuccuggagagucucacuccccuccuuuccca

SEQ ID NO: 439003 - RNA, 64 nt, Human
ugaaaaaccagcuuuacugaccgguucuuggaaaccuggagaacagccaacaagaggcccuuga

SEQ ID NO: 439004 - RNA, 64 nt, Human
ggccaccuccaaggacucuaaaagggggcuauucccuggagaccccagaguaggguugccaguc

SEQ ID NO: 439005 - RNA, 64 nt, Human
ggcggauaccugaaggugacuccgaguccagcccccuggagaaggggucggggguggggguaaa

SEQ ID NO: 439006 - RNA, 64 nt, Human
ggcccagggccucuggcuucccugcccaauccucccuggagaagggacaugggaaugaauugaa

SEQ ID NO: 439007 - RNA, 64 nt, Human
caccacugggaaccaagggcccucacucaggaacccuggagacagaagucaggugucaucauca

SEQ ID NO: 439008 - RNA, 64 nt, Human
gagcguccccagggaguggaaauggggaagggggccuggagaggggaggcaggggccccugugc

SEQ ID NO: 439009 - RNA, 64 nt, Human
agcagacucuggaggccugugccuugcuagcugaccuggagaugcugccugguggggaucagac

SEQ ID NO: 439010 - RNA, 64 nt, Human
uccugguuuuagacgaggccacagcugccaucgaccuggagacugacaaccucauccaggcuac

SEQ ID NO: 439011 - RNA, 64 nt, Human
ggaaggguggagguaggaacaaaauugcgccgcuccuggagaccugauaacuuaggcuugaaau

SEQ ID NO: 439012 - RNA, 64 nt, Human
ugcaucuggagccccuggggggaguggggaagagggaguggaaggacaguggcugaggggcuuc

SEQ ID NO: 439013 - RNA, 64 nt, Human
cucugcccaaacacacucccauggggcaagcacuggaguggaugcugggcuaucuugcuccccc

SEQ ID NO: 439014 - RNA, 64 nt, Human
ccuguuucaaauccacugccaauucagcuccucuggaguggagcuuucugauuucuuggagcag

SEQ ID NO: 439015 - RNA, 64 nt, Human
ucaucgaccugagggggcccaucccugcccaccuccuggagaacacguuggcucaguccugggu

SEQ ID NO: 439016 - RNA, 64 nt, Human
cagaggaugaggucaauuuccugaugcauauugcccuggagaagaucgccuucauccccuuugg

SEQ ID NO: 439017 - RNA, 64 nt, Human
agcccgacuggaucgccaucugcuacaacaacugccuggagauacucagaguguaguguuggug

SEQ ID NO: 439018 - RNA, 64 nt, Human
guaaagggguuuucuuaccaagcaucccugaccuccuggagacaccaccugcuuuccgggcggc

SEQ ID NO: 439019 - RNA, 64 nt, Human
ccugaaggguccaaggaggggcccuccccauggcccuggagagugggccugggugguaccugcu

SEQ ID NO: 439020 - RNA, 64 nt, Human
ucagccagaggggaggugggcugcacuccuccugccuggagaccaggcccccuucuugccuggu

SEQ ID NO: 439021 - RNA, 64 nt, Human
ggaggccgguggagaagccccaccuggcuuaugcccuggagaggguuuagcgggcuggguggac

SEQ ID NO: 439022 - RNA, 64 nt, Human
gaucguuccgagaggucuggagggccccgugguuccuggagaaagcaggacgcagagaagaaca

SEQ ID NO: 439023 - RNA, 64 nt, Human
ugcccgggugguuuggggguguugguguuuccucccuggagaagaugggggaggcugucccacu

SEQ ID NO: 439024 - RNA, 64 nt, Human
aaggcuuggcuccugucuucccagacccaccaugccuggagaggucaggauggaacuaccucau

SEQ ID NO: 439025 - RNA, 64 nt, Human
ugccugcugcucacagcccccgagagccccuccuccuggagaauaaaaccuuuggcagcugccc

SEQ ID NO: 439026 - RNA, 64 nt, Human
ucggagggcagcagagaggaccaagccugugucaccuggagacuaagaaauuaaguuuuguuuu

SEQ ID NO: 439027 - RNA, 64 nt, Human
ccauggguccccuacccuuccccguaggauauacccuggagaauggcaaaaugauuuaaagaga

SEQ ID NO: 439028 - RNA, 64 nt, Human
agcccggcccuggcucagggaggaccucaggguuccuggagauuccugcaguggaacuccaugc

SEQ ID NO: 439029 - RNA, 64 nt, Human
gggggucuuguguaauuugcuguuuuugggggugccuggagaugaacuggaugggccacuggag

SEQ ID NO: 439030 - RNA, 64 nt, Human
gggacuaaauugcuuauguuuauucccugucagcggaguggagaaugucauucaucaauaaacc

SEQ ID NO: 439031 - RNA, 64 nt, Human
ccagcucaguggaccguguggaacaggaacagcuggaguggaguugaggacuauuagaacuggu

SEQ ID NO: 439032 - RNA, 64 nt, Human
uauuaggaauucccaagugaauuuuauuaaugugggaguggaacagaugcuaaaagcuauccag

SEQ ID NO: 439033 - RNA, 64 nt, Human
cgggaugaccuuguaggagaucugucucccugugccuggagaguuacagccagcaaggugcccc

SEQ ID NO: 439034 - RNA, 64 nt, Human
ucuguagcagucucagagccuccccgacccacuaccuggagauagccagauagccagaugcccu

SEQ ID NO: 439035 - RNA, 64 nt, Human
cccagcuggcccaaauucagugucugaucgauaaccuggagaaccagcuggccgagauccgcug

SEQ ID NO: 439036 - RNA, 64 nt, Human
ucagccacacuggccuuucuguuccuuggacaugccuggagaccugucccugcucuuccuucuc

SEQ ID NO: 439037 - RNA, 64 nt, Human
ucuaagaugaacaggguucgccccaguccuccugccuggagacaguugaugugucaugcagagc

SEQ ID NO: 439038 - RNA, 64 nt, Human
auugggaugcaggcaaaccucugugguccuaagaccuggagaggacaggcuaagugaagugugg

SEQ ID NO: 439039 - RNA, 64 nt, Human
aggggagauaauaaggagggcugcugggugagggccuggagauguggaacccuggaguggaagg

SEQ ID NO: 439040 - RNA, 64 nt, Human
aauggucccuacacaaagaggccuugugggcaaaccuggagaacccuccuaaauccauagaguu

SEQ ID NO: 439041 - RNA, 64 nt, Human
uggccguagguuuguaacuguuucauagaagagcccuggagaagacaguagaaugagccuaucu

SEQ ID NO: 439042 - RNA, 64 nt, Human
cagugaaaauaagaugugcguauguguguguaugccuggagaauugguguuucacuucagugag

SEQ ID NO: 439043 - RNA, 64 nt, Human
uuugcguuuuuugguaaaaggagcaaagcgaggaccuggagauaaacgcuggagcaaucuccuu

SEQ ID NO: 439044 - RNA, 64 nt, Human
gaaaguugacugcugacugauugggaaagaaaauccuggagagacacuucacugcuccaaggcu

SEQ ID NO: 439045 - RNA, 64 nt, Human
aauaaaaacacuaauuuguggguauuuaagaaaaccuggagaauaaacucauacuuuaaaagau

SEQ ID NO: 439046 - RNA, 64 nt, Human
guccaggggguguggcucaguggcuggugguggaccuggagaguggaggcaccggccaggcagg

SEQ ID NO: 439047 - RNA, 64 nt, Human
ugcauucugcccuggcugcgcuggggagcuucucccuggagaagagcaccuggggcugcggcca

SEQ ID NO: 439048 - RNA, 64 nt, Human
cacagucauucacaucacugauugggugccauguggaguggacauucaaaaaccugguuccugu

SEQ ID NO: 439049 - RNA, 64 nt, Human
gccccagaggauuccauauaaaagacauuguaauggaguggauugaacucacagauggauacca

SEQ ID NO: 439050 - RNA, 64 nt, Human
aguguucccuggccucccugccaucagguugcugggaguggagauggagggauuauugagcaga

SEQ ID NO: 439051 - RNA, 64 nt, Human
gugcaccccuuccuugugaguagcucucaacuguccuggagagcagaggcuauuuggggucgga

SEQ ID NO: 439052 - RNA, 64 nt, Human
ucugucaggacuaccgugguuuguucugcagccuccuggagacaaggcgucccuucccgggagc

SEQ ID NO: 439053 - RNA, 64 nt, Human
cccugacccacugaagcuucucagcacguuccucccuggagagcgggcgccacggcugguauuc

SEQ ID NO: 439054 - RNA, 64 nt, Human
uuugcccgcccgcccccgcgcccagggccgccucccuggagaagccgcgcgucgcccaugggcc

SEQ ID NO: 439055 - RNA, 64 nt, Human
cuuuucaguggauccaaagaaucuacuccuuaaaccuggagaagaacaugagguuauuguuuca

SEQ ID NO: 439056 - RNA, 64 nt, Human
agauuggcuuggggccagaaggacccuccccaacccuggagacacccugaagguucacuggcuc

SEQ ID NO: 439057 - RNA, 64 nt, Human
agagucauuuugucuucagcaagcagggcaagcaccuggagagcaugcggcugccccugguuuc

SEQ ID NO: 439058 - RNA, 64 nt, Human
uaaacacuuuugggaaagggcuaaacaugugaggccuggagauaguugcuaaguugcuaggaac

SEQ ID NO: 439059 - RNA, 64 nt, Human
guuacuguuauuaauguuuacucugcagucugaaccuggagauuacuggaauuguuuuccaaga

SEQ ID NO: 439060 - RNA, 64 nt, Human
agcccuggacucaggcuggcagaggggcuggugcccuggagaaaauaaagagaaggcuggagag

SEQ ID NO: 439061 - RNA, 64 nt, Human
uuucauuuccuuggugggggaggggggcgguugcccuggagagggccggggucggggagguugg

SEQ ID NO: 439062 - RNA, 64 nt, Human
gguccggagggguugcgggggagcuggaaauaaaccuggagaugaugaugaugaugaugaugau

SEQ ID NO: 439063 - RNA, 64 nt, Human
uucaugucucugcucaucagcacugucccaggauccuggagagggagaacuccuggccccaggg

SEQ ID NO: 439064 - RNA, 64 nt, Human
cugcugcagauacaugcggcacagcaggcacgugccuggagagaacagcuccugagcacagcac

SEQ ID NO: 439065 - RNA, 64 nt, Human
aaggcccccuccccagucuggccuuggccuccagccuggagaagggcuaacaucagcucauugu

SEQ ID NO: 439066 - RNA, 64 nt, Human
aauccagucagaggucaaaaggaaggaagaaguuggaguggaguggggugggcaauuuccauuu

SEQ ID NO: 439067 - RNA, 64 nt, Human
cgauacggcagcucugugcccuuggccagcauguggaguggaggagaugcugccccugugguug

SEQ ID NO: 439068 - RNA, 64 nt, Human
cugucaucccaggacacuugaggcccaaggagguggaguggagagugggcucggguacauggga

SEQ ID NO: 439069 - RNA, 64 nt, Human
ccaguaugugccccucacccaggccuggcugggcccuggagaguccuguuugcacagcccaggg

SEQ ID NO: 439070 - RNA, 64 nt, Human
agauggggcuggagcuggggcuggggcugcauucccuggagacucacugcaaguuccugcccag

SEQ ID NO: 439071 - RNA, 64 nt, Human
cagcugagagguagugagaucccugcagggacucccuggagauucaggcccuggaauggggcug

SEQ ID NO: 439072 - RNA, 64 nt, Human
ggcccaaggccaacaggcauaugccucacuacugccuggagaagggagagauucagguccucca

SEQ ID NO: 439073 - RNA, 64 nt, Human
uuaaaccuggcuucugaaacgauggcaucagagcccuggagagccagcuggagacacaggcguc

SEQ ID NO: 439074 - RNA, 64 nt, Human
uuaaucuaaaaugauugugccucugcccaagcagccuggagacuuccuaugugugcauuggggu

SEQ ID NO: 439075 - RNA, 64 nt, Human
cgggggauuggguugugggcaguccccauggccgccuggagaagccgcuggggcccgggggugu

SEQ ID NO: 439076 - RNA, 64 nt, Human
cuuaugcguaugugcacggggccgcccgccuggaccuggagaagggaccuacggacgccuggaa

SEQ ID NO: 439077 - RNA, 64 nt, Human
uugagaggaguugguagacagcaagggaagggucccuggagacccccagccaaacgggucagug

SEQ ID NO: 439078 - RNA, 64 nt, Human
ggcacugauaagggaacuagcacaggggauugugccuggagacaugcccauggcugcacagaua

SEQ ID NO: 439079 - RNA, 64 nt, Human
aacgaugacuccuggauucuccuuccugggugggccuggagaaagaggcugguguuaccugaga

SEQ ID NO: 439080 - RNA, 64 nt, Human
acccagccccgcgcauccagggcuuccugagucgccuggagaacuucacgggacugucgcuggu

SEQ ID NO: 439081 - RNA, 64 nt, Human
cugguggcacucagcuuggggcugggccugcuggccuggagaccagggugccugcgggccuugg

SEQ ID NO: 439082 - RNA, 64 nt, Human
agucuagagccuuauucuccaucugauaauuuauccuggagagagacccagugguuauugugca

SEQ ID NO: 439083 - RNA, 64 nt, Human
cauuggggaaggcaggguuuuguauuguccagucccuggagaaaaucaugaaaugccugaguuc

SEQ ID NO: 439084 - RNA, 64 nt, Human
aacauuucugugaauuagcuggaguaggagucugggaguggagaccccaggaaacagcaugagg

SEQ ID NO: 439085 - RNA, 64 nt, Human
aggagcaccuaggcagggcccagcccugcuuccuggaguggauguggcccagagaaggaggcug

SEQ ID NO: 439086 - RNA, 64 nt, Human
agagagucucuguacacagccccgugaacccugaggaguggagucauacgcgaagggugugugg

SEQ ID NO: 439087 - RNA, 64 nt, Human
gcgguugugacucauugaacaucagaggacauauccuggagaaaagcccuacgaaugcauugau

SEQ ID NO: 439088 - RNA, 64 nt, Human
auguuuacauggaugucuccccagcagcuugaacccuggagagcaagaauaaucugauuuuccu

SEQ ID NO: 439089 - RNA, 64 nt, Human
aacccuguguaugugauuauucugagcuuuuuggccuggagaagggagggcgggcuagaaggcc

SEQ ID NO: 439090 - RNA, 64 nt, Human
ccacagcaccacguccucgaauucucagacgacaccuggagacugucccgacacagcgacgcuc

SEQ ID NO: 439091 - RNA, 64 nt, Human
uggccacugagacacaaaccuauuuauuucuaggccuggagaaaggagaucggacugggguucc

SEQ ID NO: 439092 - RNA, 64 nt, Human
ggugaugaggaguuggggcccugucuguccuaggccuggagagugccugucugggaaaagguca

SEQ ID NO: 439093 - RNA, 64 nt, Human
ccuuaaccucugagagucugcgcuuggccuuaguccuggagacccagccuccagggacugaacc

SEQ ID NO: 439094 - RNA, 64 nt, Human
ccagccccgggggccccccaguuacucagucuuuccuggagacagcaagaagcugcaaugugca

SEQ ID NO: 439095 - RNA, 64 nt, Human
uggaaccucgaacccgagcuccugcagaaguggcccuggagauugagggucccuggacacuccc

SEQ ID NO: 439096 - RNA, 64 nt, Human
cacuguggugguuauucccgaggagccagagaaaccuggagaagagaucagaacaccugggguc

SEQ ID NO: 439097 - RNA, 64 nt, Human
ggacagguuccuccugcgcuguaauucccugcucccuggagacugggaaaaggccgcagggcag

SEQ ID NO: 439098 - RNA, 64 nt, Human
uauucuguauuugucucccaugucuugcucuucuccuggagaauucugucuucucuuuggccau

SEQ ID NO: 439099 - RNA, 64 nt, Human
cgaggcgcuuauuuucccuuauggugaccugaguccuggagacucccauucucccccucucccu

SEQ ID NO: 439100 - RNA, 64 nt, Human
gacacugggcgccuccuccucccccuccuccucaccuggagagacuacaggaacuucaggguca

SEQ ID NO: 439101 - RNA, 64 nt, Human
uacucaggaggcuaaggcaggagaaucacuugaaccuggagacagagguugcagugagcugaga

SEQ ID NO: 439102 - RNA, 64 nt, Human
gcccgggcccgauuugcgcuuugccggacuggauggaguggaggaggcccaggccacaguacca

SEQ ID NO: 439103 - RNA, 64 nt, Human
aagcuguguggggagauaugaaugguacgggugaggaguggauaaggggugguccucaccuucc

SEQ ID NO: 439104 - RNA, 64 nt, Human
ccuccucauggcggccugugaccaaggucggggaggaguggagcuauccuuccaugaucugauc

SEQ ID NO: 439105 - RNA, 64 nt, Human
aagagaacgggaugauacaagagugugaauaaguccuggagacaggaccacuggggggccuguu

SEQ ID NO: 439106 - RNA, 64 nt, Human
ggaaacccacaagugagcaugggggaaugcccauccuggagaagaauucuugcccuccccucuc

SEQ ID NO: 439107 - RNA, 64 nt, Human
cagccaaacucucugaacucauccagccccuuccccuggagagggacugcucagccaacaccac

SEQ ID NO: 439108 - RNA, 64 nt, Human
ggguagaaaugcagcuguuaugaggaagucuuuaccuggagaugauaucucaauugguaucaaa

SEQ ID NO: 439109 - RNA, 64 nt, Human
gcuugggaggcugaggcaggagaauggugugaauccuggagacggagcuugcagggagccaaca

SEQ ID NO: 439110 - RNA, 64 nt, Human
ugaagccagcuggacuuccuggguugaauggggaccuggagaacuuuucugucuuacaagagga

SEQ ID NO: 439111 - RNA, 64 nt, Human
ccuccccagaaagaguccuuaccuuggagaggguccuggagagaauuuccucuuccccagcuaa

SEQ ID NO: 439112 - RNA, 64 nt, Human
uccucuucaucuagaaagccagccaggcagcuguccuggagacaagagcuggagacuggagguu

SEQ ID NO: 439113 - RNA, 64 nt, Human
uuaugaguggcaaauguggaaaaucuguuagcacccuggagaaaguccuugaguacacagugaa

SEQ ID NO: 439114 - RNA, 64 nt, Human
aucccagggguucagacuuuggcugagaacagccccuggagaacauggggugacugcuaccaua

SEQ ID NO: 439115 - RNA, 64 nt, Human
caagaaugggcaagaaggaucaggucagccacucccuggagacacagccuucuggcugggacug

SEQ ID NO: 439116 - RNA, 64 nt, Human
aggaagauguauagcuuuagcuuuagccuggcaaccuggagaauccacauaccuuguguauuga

SEQ ID NO: 439117 - RNA, 64 nt, Human
gugacacacacugucaagcgccauuucccucaccccuggagacuuacuguuaggugccugcccu

SEQ ID NO: 439118 - RNA, 64 nt, Human
cagccucccauugucaggcagaagcugcccaaagccuggagaaggacuuguuugcccucuuucc

SEQ ID NO: 439119 - RNA, 64 nt, Human
agcagcccuuuagcaaaaucgcccuccaguccuuccuggagaugccuucagccagcaucccaga

SEQ ID NO: 439120 - RNA, 64 nt, Human
ugccccucccaaccccucagucccuacgucaagcggaguggauaaggcugagaugagugcuggg

SEQ ID NO: 439121 - RNA, 64 nt, Human
ugcucacagccuucuacauggugcuacugcucuuggaguggacaugaccagacaccgcaccccc

SEQ ID NO: 439122 - RNA, 64 nt, Human
gaguggguccgcgcugcucugcagcaggggcuggggaguggacagcaucaggugggaaagugga

SEQ ID NO: 439123 - RNA, 64 nt, Human
ugcuuggaucccaguuggucucuggcagugggauccuggagaggagaaauccuggccucugcuc

SEQ ID NO: 439124 - RNA, 64 nt, Human
ucuuaacaaaccaacaucuuugcgaaaagauaaaccuggagauauuauaagggagagcugagcc

SEQ ID NO: 439125 - RNA, 64 nt, Human
guccaacccccgacuucaucccaaaggacagccgccuggagaugacuugaggccuuacuuaaac

SEQ ID NO: 439126 - RNA, 64 nt, Human
guuggguugucagccauggacauggauuucaaccccuggagaaaacgaugucauuguucagcag

SEQ ID NO: 439127 - RNA, 64 nt, Human
ccuggguuugucuggacaccgagagcgaccacauccuggagaagccaggagaaaagcucaggaa

SEQ ID NO: 439128 - RNA, 64 nt, Human
ucugggcagggcccucgggacaucuccacccgauccuggagagcugugaggauccauucagccu

SEQ ID NO: 439129 - RNA, 58 nt, Human
uucgagggccacggagaugagccuggacccuggagaaggaggccaggagccagccacu

SEQ ID NO: 439130 - RNA, 64 nt, Human
cucccacccccaagguguccuccacaggcagggcccuggagagacgcucccugcucuccauacu

SEQ ID NO: 439131 - RNA, 64 nt, Human
cuccccacuucuucccugccuucuagagaaagagccuggagacaauggugacaaugucuguggg

SEQ ID NO: 439132 - RNA, 64 nt, Human
uacagaggguguuagaaaacaaagggcagagaguccuggagaagguggaguagucagaaaacuu

SEQ ID NO: 439133 - RNA, 64 nt, Human
cuaggagcaagaaagucucuucggccucgggcuuccuggagaaggggacguccauuccugcugg

SEQ ID NO: 439134 - RNA, 64 nt, Human
auacuuugauuuaaaauaggccaagagaaucaggccuggagaucuagggucuuguccaaagugu

SEQ ID NO: 439135 - RNA, 64 nt, Human
uagugcuggaauggggaggggcuccccaagauggccuggagaccacccagcccugaccugggac

SEQ ID NO: 439136 - RNA, 64 nt, Human
uacugugaaauaaagaauguuaaucaacuuuggaccuggagaugauuugccuuucugaacauaa

SEQ ID NO: 439137 - RNA, 64 nt, Human
ccauaggucggggugccaagucagugcgcgaguuccuggagaagaacuauacugacgaagccau

SEQ ID NO: 439138 - RNA, 64 nt, Human
agagagucucuguacacagccccgugaacccugaggaguggagucauacacgaagggcgugugg

SEQ ID NO: 439139 - RNA, 64 nt, Human
ugucagcagagucuccaagccccacgaacccugaggaguggagucauacgcgaaggccauaugg

SEQ ID NO: 439140 - RNA, 64 nt, Human
acucacaagaccuugaucauuuucucuggguuugggaguggaguauuaugugacugggacucca

SEQ ID NO: 439141 - RNA, 64 nt, Human
cccaguuccgucucagcuaccuggacuccaggacccuggagaagggagaccuggcaguggaggg

SEQ ID NO: 439142 - RNA, 64 nt, Human
ggcaggggcuccaagccccagcguggggaagggcccuggagaagcccucauccucaugggaacc

SEQ ID NO: 439143 - RNA, 64 nt, Human
ucacuagauugacugaggaauguaugucuaaauuccuggagaagaugauauggauuggaaacug

SEQ ID NO: 439144 - RNA, 64 nt, Human
uggaaucuucucugaaaacuaauccauaaaguucccuggagaaauuggucagaaugaucuguca

SEQ ID NO: 439145 - RNA, 64 nt, Human
ccuggucuccucccaaaauacuacacauccaacuccuggagauuucaguuacuuaccugcaugu

SEQ ID NO: 439146 - RNA, 64 nt, Human
uccuccucauccucccugacccugcuccuagcacccuggagagugcacaugccccuugguccug

SEQ ID NO: 439147 - RNA, 64 nt, Human
gccccagccguagcccuugugcucaggagcugcuccuggagaguggcucccuugugggaaguga

SEQ ID NO: 439148 - RNA, 64 nt, Human
cgggcaggccgcugaccugaggucuggagaaaccccuggagaaggguguccccaccagcccaua

SEQ ID NO: 439149 - RNA, 64 nt, Human
aagcugaaauggaauaucugaagauagcucaggaccuggagauguacggugugaacuacuuugc

SEQ ID NO: 439150 - RNA, 64 nt, Human
cacgcgaggcggagcgaagagccaagcagaagcuccuggagauugccaccaagcccacguaccc

SEQ ID NO: 439151 - RNA, 64 nt, Human
gcuggucacccugagagucccaucgccugcagcaccuggagacccaccucccaccccagugcac

SEQ ID NO: 439152 - RNA, 64 nt, Human
gauucaggucaugccaaaagcucucugguuguaaccuggagacauguggaggggaauggcgaug

SEQ ID NO: 439153 - RNA, 64 nt, Human
ggagaggacccucaggccucugagggcaccaggcccuggagaagaggugcaauucagggugugu

SEQ ID NO: 439154 - RNA, 64 nt, Human
ggagggguugucaagcccacccgggaaacugagcccuggagaggggaagcagccagcccaggau

SEQ ID NO: 439155 - RNA, 64 nt, Human
gugcaugcaggggugagguauuuucacugcccucccuggagagucccuuguaaguuuggcuccu

SEQ ID NO: 439156 - RNA, 64 nt, Human
aguaaggacauucagaauaaauaucugcugcucugcucaccaauugcugcuggcagccucuccc

SEQ ID NO: 439157 - RNA, 64 nt, Human
agcuguaacguugagaaauguaacugugaaaucagcucaccaguucaagucacuagguuugcca

SEQ ID NO: 439158 - RNA, 64 nt, Human
ugcgaggcauccuggggcuggcagcaccuucccggcucaccagugccaccugcgggggagggac

SEQ ID NO: 439159 - RNA, 64 nt, Human
gugccuggcaccccugaaccaugaucugagccucccuggagaagguauuuuauaugucugcugc

SEQ ID NO: 439160 - RNA, 64 nt, Human
cuugcucugacagagauggaucugcuagaaggaaccuggagagcaggacccauggcugggcggc

SEQ ID NO: 439161 - RNA, 64 nt, Human
agccccugaggggccccgggaguggccuuggcucccuggagagcccacgucucagccacaguuc

SEQ ID NO: 439162 - RNA, 64 nt, Human
gcugcugcuggaccuaggccuggcccuccgccugccuggagaggccuggcccugggcaaacagc

SEQ ID NO: 439163 - RNA, 64 nt, Human
cuucuuccagagagaucucuuggcagagugagggccuggagauaaccagcuuuggauuaucccg

SEQ ID NO: 439164 - RNA, 64 nt, Human
uggcaauggucuccccacagaccgcaggacugagccuggagagagaaguugcuugacggaugcc

SEQ ID NO: 439165 - RNA, 64 nt, Human
uuuugcuuuguucacugcuuauuaaaauggaaauccuggagaauaguaguucuggaauauugcc

SEQ ID NO: 439166 - RNA, 64 nt, Human
gggcgcggcggagcugggaccuaccugccugaguccuggagacagaaugaagcgcucagcaucc

SEQ ID NO: 439167 - RNA, 64 nt, Human
gcugaggaccaggugucucuaaaaacccaaacauccuggagaguaugcgagaaccuaccaagaa

SEQ ID NO: 439168 - RNA, 64 nt, Human
gcugaggaccaggugucucugagaauccaaacauccuggagaguaucugagaaccaaccaagua

SEQ ID NO: 439169 - RNA, 64 nt, Human
gggggugcagaaaaugauugaugggcuggggaacccuggagagccucgacuccggaagucucaa

SEQ ID NO: 439170 - RNA, 64 nt, Human
ggaaggugcucccaucggaggggacccucagagcccuggagacugccaggugggccugcugcca

SEQ ID NO: 439171 - RNA, 64 nt, Human
ugcuggagggagaagcugucagggacccagggcgccuggagaaagaggcccuguuacuauuccu

SEQ ID NO: 439172 - RNA, 64 nt, Human
ccggccuccuguuccugcccccacccaccaccugccuggagaggaacgggucggguccgugucg

SEQ ID NO: 439173 - RNA, 64 nt, Human
cucccuagggaugggaagggggcauugaggcaagccuggagaggagcccggggagcagggucau

SEQ ID NO: 439174 - RNA, 64 nt, Human
cugaagcucuaggaauaauuuugccugcccgguugcucaccaguuguagcuugccagcucccaa

SEQ ID NO: 439175 - RNA, 64 nt, Human
ugagcacuucuggagacugcguccuguccuaucugcucaccaucacccuuccugcccgacggag

SEQ ID NO: 439176 - RNA, 64 nt, Human
guugcccaggcuggaguguagugguaugaucauagcucaccacaaccuugaacucccaggcuca

SEQ ID NO: 439177 - RNA, 64 nt, Human
auuuucuuggaaccuuugauuucaacacugagggccuggagaccucggcuccuccugcuccuga

SEQ ID NO: 439178 - RNA, 64 nt, Human
acgguucuuaauacugaagucaugauguguauuuccuggagaaauuccucuuuaaaugaacaag

SEQ ID NO: 439179 - RNA, 64 nt, Human
cccguuuggccaggcugguggcuugauggguguaccuggagagggggucuggcuuccugcccaa

SEQ ID NO: 439180 - RNA, 64 nt, Human
gcugcacugagccuucaucgcccauugcuuuaggccuggagacuuucauuuuuagugcauuuuc

SEQ ID NO: 439181 - RNA, 64 nt, Human
ccccagaauauauuuguuuuugcaccugcuucugccuggagauugaggggucugcugcaggccu

SEQ ID NO: 439182 - RNA, 64 nt, Human
auuacguacuuguugaguacaaacugcaccaagcccuggagacccauuaccaccguuaacccuc

SEQ ID NO: 439183 - RNA, 59 nt, Human
uucugucuuucaaacaguaacaucuggagccuggagauauccucaggaagcacaucugu

SEQ ID NO: 439184 - RNA, 64 nt, Human
agaaggugcacauacucccaagggccacucuugcccuggagaucuuggccuuggggccaaagac

SEQ ID NO: 439185 - RNA, 64 nt, Human
agacagcuggcggaggcugcucggcuacugguuaccuggagaaguaguauuugccuauuucccc

SEQ ID NO: 439186 - RNA, 64 nt, Human
uaaccccugcauucugcucugcucuaauacacuaccuggagaaagucuuuuccuuauuuucaau

SEQ ID NO: 439187 - RNA, 64 nt, Human
ugcuagcccuuggauaaagagcuauaugcuuuucccuggagaguggggagaugagaccaguguu

SEQ ID NO: 439188 - RNA, 64 nt, Human
gggagugaggagcaaggcaacuggcauuuguccaccuggagacagagguagcuggcagcucugg

SEQ ID NO: 439189 - RNA, 64 nt, Human
ucuucugcuuguuucuguacagggccaccagacuccuggagagaucaagcaaggagaaccuggg

SEQ ID NO: 439190 - RNA, 64 nt, Human
uggugaaagcguuccguagcucgcucuaugaaggccuggagaaaccagaauccaagaccuccau

SEQ ID NO: 439191 - RNA, 64 nt, Human
agucuuugcagcguggggccgucucacccuggagccuggagaggaucuaugcuuguuuguuuuu

SEQ ID NO: 439192 - RNA, 64 nt, Human
ccacguccuuggucaccuccccagcagcugcucugcucaccagccugaccccacccagagcagg

SEQ ID NO: 439193 - RNA, 64 nt, Human
uccugccuccuccugaguagcugggacuacaggugcucaccaccacacccggcuaauuuuuugu

SEQ ID NO: 439194 - RNA, 64 nt, Human
accaauucuuggauugaguuuggccuccaaauaugcucaccaaacacuauguugcuacccucua

SEQ ID NO: 439195 - RNA, 64 nt, Human
augcauauacaugaauauaccuugagcaugaaucccuggagaaaucguuuucguagcucaccaa

SEQ ID NO: 439196 - RNA, 64 nt, Human
cuggauccuaggccccugggaucuguacccaggaccuggagaauaccaccccacccccagccca

SEQ ID NO: 439197 - RNA, 64 nt, Human
uguuauuugaauggauucccaucuuugucucuagccuggagaagagcaaaauggagggggaggg

SEQ ID NO: 439198 - RNA, 64 nt, Human
auaagguuauuuagcacaaaguauagcagcuucaccuggagagcugcuuuugcucaguaaauuc

SEQ ID NO: 439199 - RNA, 64 nt, Human
uagccuucuuaggcaaacgccugcaaaacagaagccuggagaggggagugaccugcucagaguc

SEQ ID NO: 439200 - RNA, 64 nt, Human
acaacccuauaugccugaauacucugcaagaaggccuggagauuuugcaaaacugauuuauuga

SEQ ID NO: 439201 - RNA, 64 nt, Human
gccaaucuuuccagcccuccccuaccgaccucugccuggagacgcagcagccuguguccuccag

SEQ ID NO: 439202 - RNA, 64 nt, Human
gggccucuccaaggcugcccgugcguccugggacccuggagaaggguaaacccccgccuggcug

SEQ ID NO: 439203 - RNA, 64 nt, Human
cccuggccuguggccuuucuugugaccaucagggccuggagacccagcaaggaguugccugggu

SEQ ID NO: 439204 - RNA, 64 nt, Human
uaggugcaauuugggaaaaucagguuuauuuuuuggaguggaacuguuauaagugcuuauuuau

SEQ ID NO: 439205 - RNA, 64 nt, Human
cuccccucauugagggucacugcucaagagugcaggaguggacucuccacugaugggucucccu

SEQ ID NO: 439206 - RNA, 64 nt, Human
agaacuuaagguaaauauuuauucuuggguugguggaguggauauugccaguuaggagucaugg

SEQ ID NO: 439207 - RNA, 64 nt, Human
ccucuaguuggcaagucucacauauucaucagcaggaguggagggugggggaaaacuagaaaga

SEQ ID NO: 439208 - RNA, 64 nt, Human
uccuccacgugcccacuugggaugcagaaugcagcggagcuaggacccccuccacggccuggac

SEQ ID NO: 439209 - RNA, 64 nt, Human
cccuuguccuuccucacccccuccaauauagucucggagcuacaaccgcagcagccacuauaaa

SEQ ID NO: 439210 - RNA, 64 nt, Human
cccuggccccaacucggaguccuccagugaucuccggagcuaguucccugcccucacacccugu

SEQ ID NO: 439211 - RNA, 64 nt, Human
ugacgacugucaaggccucauuugcagaggccaccggagcuagggcacuagccugacuuuuaag

SEQ ID NO: 439212 - RNA, 64 nt, Human
ggauguuauauaaauauagauauaauuuuauuuucggagcuaagaugguguuauuuaagggugg

SEQ ID NO: 439213 - RNA, 64 nt, Human
gcucugaauugugagucugccccucaggggaauucggagcuagaggacauggaaaauaaagcca

SEQ ID NO: 439214 - RNA, 64 nt, Human
guuuguaaacaaaaccuuugggugguaaugacuacggagcuaaaguuggggugacaaggauggg

SEQ ID NO: 439215 - RNA, 64 nt, Human
ccguggcauccucucuccaggucugcucccuuaccggagcuaggauaagguagcaugagugaca

SEQ ID NO: 439216 - RNA, 64 nt, Human
ggggcaggcagggccguuuacucaccaggcccuggcucaccagcgucccggcgccuccguuagg

SEQ ID NO: 439217 - RNA, 64 nt, Human
caguggacauagaagagaagggugugaggcugcggcucaccauuguggacacaccagguuuugg

SEQ ID NO: 439218 - RNA, 64 nt, Human
aaaaaaguggagcaguggcauuuccaugccucaugcucaccaucaugagguuaacuucccgccg

SEQ ID NO: 439219 - RNA, 64 nt, Human
acugaguguggcugggcuacaucauagcucaucacggagcuacgacuuuggguacugcggacag

SEQ ID NO: 439220 - RNA, 64 nt, Human
auuguuuuugcaccagacgaacagugaggaaauucggagcuauacauaugugcagaagguuacu

SEQ ID NO: 439221 - RNA, 64 nt, Human
gguguggaggaccgagggguugggggccuucuaccggagcuacaccacgcagcugaccaugaac

SEQ ID NO: 439222 - RNA, 64 nt, Human
aagaagaacaugaaagaaauaaacaggaguucagcggagcuagcagaagacaaggcauguaggg

SEQ ID NO: 439223 - RNA, 64 nt, Human
ucucuaagugcccuugcaagagccuuuaacuuggcggagcuaaggagaucuuauucuaccaugg

SEQ ID NO: 439224 - RNA, 64 nt, Human
cugugugcagccggaggguccuaagaauggcucccggagcuaacugagggcccagccuuuuuuc

SEQ ID NO: 439225 - RNA, 64 nt, Human
cccucugcucucugaggcagccgcgccucugacucggagcuacuugaaacuucugcucuugcua

SEQ ID NO: 439226 - RNA, 64 nt, Human
gaaugaagcucuggaaauccucaccaaagcccuccggagcuaccaguuagggaucggcagggac

SEQ ID NO: 439227 - RNA, 64 nt, Human
ggguuucggcccagccccagccugccggagcccacggagcuaccucuaccuccacuccugccac

SEQ ID NO: 439228 - RNA, 64 nt, Human
gggaggagaggacugggccugauggaaguuaacccggagcuaagucacccagagcacaggagcu

SEQ ID NO: 439229 - RNA, 64 nt, Human
augcaagaugguguccucggauaaugaucugccccggagcuagggcagcaacaugaggaccaaa

SEQ ID NO: 439230 - RNA, 64 nt, Human
ugaacagggcuggagggaagggcacaggggcgcccggagcuaagauguggugcuuuucuugguu

SEQ ID NO: 439231 - RNA, 64 nt, Human
gggcugugccugcgaggccaaguugcccacccugcggagcuaggaggcgcgagcagagaacgug

SEQ ID NO: 439232 - RNA, 64 nt, Human
gaaccugagacagcuccagcuucgcagcccuucccggagcuacagggggauccucuagcauggg

SEQ ID NO: 439233 - RNA, 64 nt, Human
aggcagacagccugggccucuaacagcuuuuguccggagcuagacuucguguccuuucaguugg

SEQ ID NO: 439234 - RNA, 64 nt, Human
ccugcagaguggaagcgcccagcggccuuuccucgcucaccaggccagucucagggccucaccg

SEQ ID NO: 439235 - RNA, 64 nt, Human
gaccccgacuuuaguuugggcuguuccacgcuuggcucaccauugccgccugggacuuaaccug

SEQ ID NO: 439236 - RNA, 64 nt, Human
guuugacggaccuugugauuuguacuguuugcugcggagcuauuuaaagauuuuggaauaaaua

SEQ ID NO: 439237 - RNA, 64 nt, Human
gaccgcaugccgcuuggagaagggguggccucgccggagcuagggagcggauguggugggcugg

SEQ ID NO: 439238 - RNA, 64 nt, Human
uugcaacaagagcuucugggaagguaagcggcaucggagcuagaucacguuucacaauuagugg

SEQ ID NO: 439239 - RNA, 64 nt, Human
ugcauuuuuguuuuuaacaaauccccuccuuaaacggagcuauaagguggccaaaucugagaac

SEQ ID NO: 439240 - RNA, 64 nt, Human
cuccagucugcugcccuccaucccgacauggacccggagcuaacacuggccccuagaaucagcc

SEQ ID NO: 439241 - RNA, 64 nt, Human
gugcagccuggauccugucgaucuuuacuuguggcggagcuaauggucacauugauaguugauu

SEQ ID NO: 439242 - RNA, 64 nt, Human; identical to SEQ ID NO: 439238

SEQ ID NO: 439243 - RNA, 64 nt, Human
cagccucagccuucaggccugagcaagugcagggcggagcuaccagcccaggcucagauguugg

SEQ ID NO: 439244 - RNA, 64 nt, Human
ccgguccuuccaggcuaucacgccccaggaccugcggagcuacguuuugcagggcucaguacga

SEQ ID NO: 439245 - RNA, 64 nt, Human
ucagccugucauucucuagaacacauccaggugucggagcuaagguguucagcucggcugugac

SEQ ID NO: 439246 - RNA, 64 nt, Human
gccugccuuugcugaccguuuugggguuccccgccggagcuacaggggcauuuucuucccuaaa

SEQ ID NO: 439247 - RNA, 64 nt, Human
ggggaagcucaucccucccuccaagcccccgaugcggagcuagggcuggagcucugcccaggug

SEQ ID NO: 439248 - RNA, 64 nt, Human
ccucauuuauuuuguucuguuacauaagucauuuuccccuuagagugcuugaagaaaugccacc

SEQ ID NO: 439249 - RNA, 64 nt, Human
gcguggguggacucuggccgcggccacacuuggugcucaccagcugcuucggccuucaggugac

SEQ ID NO: 439250 - RNA, 64 nt, Human
gggggccuuggggaagggcggccuuggaucagaggcucaccacaagccuggcauuucagccagg

SEQ ID NO: 439251 - RNA, 64 nt, Human
ugcugaccccggccgcacacucgacuuuccuggugcucaccacgcagaggggcacgggccagcc

SEQ ID NO: 439252 - RNA, 64 nt, Human
ucugccuuggccucccaaagugcugaauuaagcagcucaccauccacacggcugaccucauaca

SEQ ID NO: 439253 - RNA, 64 nt, Human
gaacacuuaacaacauggggaccagucaggggaauccccuuauuucuguuuugcauaugaggaa

SEQ ID NO: 439254 - RNA, 64 nt, Human
uguucuuuuucaguuuuuaaccacuuuuagguuuuccccuuacagaaaccacagaaauauuccc

SEQ ID NO: 439255 - RNA, 64 nt, Human
aauccuggccuguagaguuagaacuaccauuuccuccccuuagcugcccuuguaugacccggau

SEQ ID NO: 439256 - RNA, 64 nt, Human
cugcaacucagcucuucccccagcacagaucuguuccccuuauccugcagaaaaucaagcccug

SEQ ID NO: 439257 - RNA, 64 nt, Human
cagcaagcuguuaacauguugcaggaaaacacucuccccuuaugccagaccagcaguaucucau

SEQ ID NO: 439258 - RNA, 64 nt, Human
uccccuccugagucagccugguguugcccuuuauuccccuuaugugcauaugauuaaagaguua

SEQ ID NO: 439259 - RNA, 64 nt, Human
uuuuaucuccaucuuuaacuuuuaaaguacuucuuccccuuauccccucaauaaagaaaggaaa

SEQ ID NO: 439260 - RNA, 64 nt, Human
caugugaaccuuaccagcccaggcggaugccccuuccccuuagcacuacccuggccuccugcau

SEQ ID NO: 439261 - RNA, 64 nt, Human
agacaaguguccucucuucugcauacauuugggcuccccuuacagagcccuuugcccuggcucu

SEQ ID NO: 439262 - RNA, 64 nt, Human
cuagaaccuagucucaugagcccuuugcauucuuuccccuuaagcaagaauagaauguagugga

SEQ ID NO: 439263 - RNA, 64 nt, Human
aaguuaauaaugugcaaaauaucuuaaacaucccuccccuuauucaacaauuauguaucaguga

SEQ ID NO: 439264 - RNA, 64 nt, Human
cauguuacccaaauuugagaagugcugcuguaauuccccuuaaaggacgggagaaagggccccg

SEQ ID NO: 439265 - RNA, 64 nt, Human
auagccaaagcuuuaaucuagccuaauuuauuuuuccccuuauauuucccuacccuacccuccc

SEQ ID NO: 439266 - RNA, 64 nt, Human
acugaaaggaaauagauuuuuuccaaaacccaguuccccuuauuuaaucuuuuuuagaaaugug

SEQ ID NO: 439267 - RNA, 64 nt, Human
guaucaucaagcucaacguucuggaguggcugcagcucaccauguaugccugaaccaggcuggc

SEQ ID NO: 439268 - RNA, 64 nt, Human
ugccgcucugcccgcuccgccuaggcuccuccgcgcucaccacucaguacggcgccgccuucug

SEQ ID NO: 439269 - RNA, 64 nt, Human
aucugggcucccuuacuugugaguaagggaucaugcucaccacuggagaagcuuacaccgggac

SEQ ID NO: 439270 - RNA, 64 nt, Human
uaaaaacuuacacucuuuuauacaagaguguauuuccccuuaauuaggaugcauguugauuaaa

SEQ ID NO: 439271 - RNA, 64 nt, Human
aaaggugacuggaaggguuccuaacccaaccuacuccccuuaggguguguauccaacccagugc

SEQ ID NO: 439272 - RNA, 64 nt, Human
ggaauagguuuuaucacaucucuuauuucucuuuuccccuuacucucuaccauuuccuuuaugu

SEQ ID NO: 439273 - RNA, 64 nt, Human
cagaauacauugacuguuuuugaaaauaguaauuuccccuuauccccuuuucauuuggaaaaga

SEQ ID NO: 439274 - RNA, 64 nt, Human
auuuuuuagugaaagacuuuugaaaagugcccuuuccccuuaagagacaguuggaauaccaguu

SEQ ID NO: 439275 - RNA, 64 nt, Human
gcagauguacaguguauuccugcauuauugugauuccccuuaaagcccaguucuugcugucuuc

SEQ ID NO: 439276 - RNA, 64 nt, Human
cccuccgucccacccccuccuucuaggauagcgcuccccuuaccccagucacuucuggggguca

SEQ ID NO: 439277 - RNA, 64 nt, Human
caaaucauacuccugcccaagaaaauacaguaguuccccuuaucugagcaguauauguucuaag

SEQ ID NO: 439278 - RNA, 64 nt, Human
uuuccauguuaagaacaaaugccauuagaagauguccccuuaauuguauugucagaguauuacu

SEQ ID NO: 439279 - RNA, 64 nt, Human
auggaauaguauccccuuauguuuaguugaaauguccccuuaacuugauauaauguguuaugcu

SEQ ID NO: 439280 - RNA, 64 nt, Human
aaucagccuaugccagggcuucaauggaauaguauccccuuauguuuaguugaaauguccccuu

SEQ ID NO: 439281 - RNA, 64 nt, Human
guaauccuggacuagcuuugcugaccugcagagcuccccuuaacuauuauuguuagauaaacag

SEQ ID NO: 439282 - RNA, 64 nt, Human
aaaagagccucagcaagagaguuuugccaacaauuccccuuaaaaggaaacagaucaacuacac

SEQ ID NO: 439283 - RNA, 64 nt, Human
uggaaucucugucaggggacaaacagcuguagcauccccuuagcaucuuucuagccaaugagcc

SEQ ID NO: 439284 - RNA, 64 nt, Human
cugcugucugucuuuucuagggaaagcaucucuggcucaccauguaacaucuggcuuggagcaa

SEQ ID NO: 439285 - RNA, 64 nt, Human
augauaaucuuuuaaagggucuacaacugaaugagcucaccauggaugaugauacugccgugcu

SEQ ID NO: 439286 - RNA, 64 nt, Human
gagagaggcgggguagguaggcagggcgucccuggcucaccaaugcgucugguccacauggcau

SEQ ID NO: 439287 - RNA, 64 nt, Human
ugucucuucaucucuccucucucuccugcaucucuccccuuacucuucaauuuauucuacuucu

SEQ ID NO: 439288 - RNA, 64 nt, Human
uggaggugagacauggccagacaugacuccugcuuccccuuaggaaguaaaucuuacuuauggu

SEQ ID NO: 439289 - RNA, 64 nt, Human
aacuaaaguaccacaauagcuguauuuuucccaauccccuuaacgaucauaaaagaggcaaguu

SEQ ID NO: 439290 - RNA, 64 nt, Human
auuuuacuccgucagaaagcagcccuccccucccuccccuuaugaggucucaggcagugguggc

SEQ ID NO: 439291 - RNA, 64 nt, Human
uacuuguuagucuacgccccacuguuuccacccauccccuuagccaaccucugucuuuuugaau

SEQ ID NO: 439292 - RNA, 64 nt, Human
uuuuuuuuuuaaaaaagcaccuuuuuuuguuguuuccccuuaauaaaagagguuucuaauuuau

SEQ ID NO: 439293 - RNA, 64 nt, Human
uaaugucuugagcucuauuaugaaugugaagccuuccccuuauccucccuguaacuugauccau

SEQ ID NO: 439294 - RNA, 64 nt, Human
gcagaaggaaagucaacacuucuugcuggcugccuccccuuagccauuaugcuaaaaacagcuu

SEQ ID NO: 439295 - RNA, 64 nt, Human
gcuuuaguguuuuguucccucugccccagagagcuccccuuagugaucucaguucaaauauuau

SEQ ID NO: 439296 - RNA, 64 nt, Human
augguggcaaauuuugugaauuguuuuucucucuuccccuuaucuggcucuaaaaccuucugcu

SEQ ID NO: 439297 - RNA, 64 nt, Human
uauaaugcuuuugaaaaauuuuccuuuuucuauauccccuuaguccagccucucuucucagaca

SEQ ID NO: 439298 - RNA, 64 nt, Human
cauugcugauagcuuuggcugcaugaguugggcuuccccuuacccagggcugcacagccaggug

SEQ ID NO: 439299 - RNA, 64 nt, Human
cugaucaucuugaaagguucuucuggaacuccuguccccuuagucaugagaacagaaagugcaa

SEQ ID NO: 439300 - RNA, 64 nt, Human
uaugacugcauuuuaagggaaaagauaaaauucuuccccuuaaaauucguuaaaguuuuugaau

SEQ ID NO: 439301 - RNA, 64 nt, Human
uaagacaugugacacauucccauugguaacaauugcucaccauggcauugucucaaaaaagacu

SEQ ID NO: 439302 - RNA, 64 nt, Human
uacauguucccacagaggugccugcuccgucuucgcucaccagacacucaggcaggcuggcuua

SEQ ID NO: 439303 - RNA, 64 nt, Human
ccuuguaggcuucuaucaaaacagcacccugcuugcucaccaggccuagagaauggcuguaggu

SEQ ID NO: 439304 - RNA, 64 nt, Human
ggcccguaacccuaguuugccugaggcccuuauguccccuuauguuccugguacuggagcuuga

SEQ ID NO: 439305 - RNA, 64 nt, Human
cuucccccugccuugugaugaugaugagugagucuccccuuaauuagacugcaaaugucacuug

SEQ ID NO: 439306 - RNA, 64 nt, Human
auagugcuucguuuuugaaguguugaagcugugcuccccuuaaaucguggcaggagagauuaag

SEQ ID NO: 439307 - RNA, 64 nt, Human
acuuauaacuugccaguuucauugguggaauaaguccccuuacucaugauucaucaauauuccu

SEQ ID NO: 439308 - RNA, 64 nt, Human
augguagaagggaaaaaagccuucauuuuugaccuccccuuacugaauaaauugaaauaugaag

SEQ ID NO: 439309 - RNA, 64 nt, Human
gagucuguaaauagugugcccagcagcugugaacuccccuuauagccucaggcugcaguguccu

SEQ ID NO: 439310 - RNA, 64 nt, Human
uucugcaggguucucccucccaccuuaaagaaguuccccuuauguggguugccuggugaauggc

SEQ ID NO: 439311 - RNA, 64 nt, Human
ugaaaaaugguuuuccuauacuggauaaagcaauuccccuuaggaaacauagccucagaguauu

SEQ ID NO: 439312 - RNA, 64 nt, Human
uuagagacagggagugaugaaucaucaccgguuguccccuuaucuaacuccauaaaagugggaa

SEQ ID NO: 439313 - RNA, 64 nt, Human
aaaaugaagcacuugguuucuuccauccuccuccuccccuuaauggauuguggcaguugaaaua

SEQ ID NO: 439314 - RNA, 64 nt, Human
guauaugccuaugguauaugugucaauuuauguguccccuuacauauacaugcacauaucuuug

SEQ ID NO: 439315 - RNA, 64 nt, Human
ccuuggcuuugaggccgaagcugcugugacuguguccccuuacugagcgcaagccacagccugu

SEQ ID NO: 439316 - RNA, 64 nt, Human
aggcaauaccuggcucaggcccagccccaauccauccccuuacuuucugccauggaguuccagc

SEQ ID NO: 439317 - RNA, 64 nt, Human
cauuuaauucucucugcuguuuggguuggguuuuuccccuuaguuaucuguggguuuccuguau

SEQ ID NO: 439318 - RNA, 64 nt, Human
ugaagcacuuagaacugauggccagcacaugagggcucaccaaguguaagccacaaauacacau

SEQ ID NO: 439319 - RNA, 64 nt, Human
ggaugucaucauucaccauuuauccaggauggccgcucaccaggcaauuugcuaggcucggggg

SEQ ID NO: 439320 - RNA, 64 nt, Human
uaaaccaaaaacaugauauuaagaaaacaggcaggcucaccauaguaaaaaugcugaaagccaa

SEQ ID NO: 439321 - RNA, 64 nt, Human
aaaacaaaaaaggcaaaacaaaacaaacucauuuuccccuuaguucccauuaaaauaugcauuu

SEQ ID NO: 439322 - RNA, 64 nt, Human
uuuuguaaaauuucuuuuuucuucuuugcuuuuuuccccuuauuugguuuaauuuuucuaaugu

SEQ ID NO: 439323 - RNA, 64 nt, Human
uuuucuaaaguguauuuucugaugugaacuuccuuccccuuacuugcuagguuucauaauuuaa

SEQ ID NO: 439324 - RNA, 64 nt, Human
auguggcagucaauggcugcagggcuggcaaaccuccccuuagccagucagcacggcauuguuc

SEQ ID NO: 439325 - RNA, 64 nt, Human
acuucgaagcagcuguuggcaaguuggccaagacuccccuuauugcugauguuuauuacauugu

SEQ ID NO: 439326 - RNA, 64 nt, Human
uaagacugguuggaagcugacugcagacuuuguuuccccuuaguaugugcuguguuguaaauuu

SEQ ID NO: 439327 - RNA, 53 nt, Human
uucuuaaaaaauauucuuaaauuuccccuuaauucaguaugauuuauccucac

SEQ ID NO: 439328 - RNA, 64 nt, Human
aaccaguaguauucacauuaaaucuugcuuuuuuuccccuuaaaaaaagaaaaaaauuaccaaa

SEQ ID NO: 439329 - RNA, 64 nt, Human
aaagaaauuuauuuuacauugacauugcauugcuuccccuuagauaccaauuuagauaacaaac

SEQ ID NO: 439330 - RNA, 64 nt, Human
gugguagguacaguucugggguacauguuaaguguccccuuauacaguggagggaagucuuccu

SEQ ID NO: 439331 - RNA, 64 nt, Human
uauuauggaaaggaguacaggaccucuucagucuuccccuuaccagagguagccucugcaaaug

SEQ ID NO: 439332 - RNA, 64 nt, Human
gaaugaaagaaaagugugugcuguccaaauuuuuuccccuuaauucuuucccucaucuucucac

SEQ ID NO: 439333 - RNA, 64 nt, Human
cagaauuauguggagucuguuacaagauuauaguuccccuuaacugcucuauagauaacagcuu

SEQ ID NO: 439334 - RNA, 64 nt, Human
cuaccuucuguucaaaucaugaaaaaagacuauuuccccuuagaauagggaagcuugcuauuuu

SEQ ID NO: 439335 - RNA, 64 nt, Human
aaugacugaggcagccuggccuugccuucacagggcucaccauacacaaguaaauaaaaaauau

SEQ ID NO: 439336 - RNA, 64 nt, Human
gugcugggauuacaggcgugagccacugcacccggcucaccacuaguuuuuagcccuuuuuguu

SEQ ID NO: 439337 - RNA, 64 nt, Human
cccguacaaacuuggacaacacggagcagggagagcucaccauggaaugaaccccccgcccaug

SEQ ID NO: 439338 - RNA, 64 nt, Human
uugcuaugccaacuaguagaaccuucuuuccuaauccccuuaucuucauggaaauggacugacu

SEQ ID NO: 439339 - RNA, 64 nt, Human
ugcuguaacaugacuaauaaaaccgaacgccuguuccccuuacccgugugggggacacgcagau

SEQ ID NO: 439340 - RNA, 64 nt, Human
guuagugucguauuuugagcugggguuuugagacuccccuuagagauagagaaacagacccaag

SEQ ID NO: 439341 - RNA, 64 nt, Human
uccuccuuacucuaagcuaaaucuaggugagguuuccccuuagggagcccagcuauuuacaaag

SEQ ID NO: 439342 - RNA, 64 nt, Human
cuagaguuggagcaagucuuccauuugcuucuuauccccuuaaaagaaugccuuccacuuccca

SEQ ID NO: 439343 - RNA, 64 nt, Human
aacuaaggauauucuuuagcaagagaaaauauuuuccccuuauccccacugcuguggagguuuc

SEQ ID NO: 439344 - RNA, 64 nt, Human
ggucacgaggguaggacccucaugaugggaugaguccccuuacaagaccucuggcuugggccgg

SEQ ID NO: 439345 - RNA, 64 nt, Human
augacaguuguuugaguuugguaccaucuuauuuuccccuuauacagauaaggaaacuggggug

SEQ ID NO: 439346 - RNA, 64 nt, Human
ugacaguuguuuugaguuucguaccaccuuauuguccccuuauacagauaaggaaacuggggug

SEQ ID NO: 439347 - RNA, 64 nt, Human
agucaaagccggaugucccaucugcucuucccguuccccuuaaggagguagcucccagcacuca

SEQ ID NO: 439348 - RNA, 64 nt, Human
gagaggcuuugccuccaccauucccaccccacccuccccuuaaacccucugccuuugaaagcag

SEQ ID NO: 439349 - RNA, 64 nt, Human
ucguacuguuugugaacuuugguuaccuucacauuccccuuacgaggguguaacaucuauuugu

SEQ ID NO: 439350 - RNA, 64 nt, Human
uacacagccuuuacucauacuauuaggcacacuuuccccuuagagcccccuaaguuuuucccag

SEQ ID NO: 439351 - RNA, 64 nt, Human
cuugcuaccgaucuggaacucaagccccaagacauccccuuagaugaucugaauacgcauucag

SEQ ID NO: 439352 - RNA, 64 nt, Human
cccauguauuacaaacaguuggcaaccuugcccugcucaccaaaugggaguugcauaccaguau

SEQ ID NO: 439353 - RNA, 64 nt, Human
gguucaccuggaaaacagagaggcugaccguggggcucaccaugcggaugcgggucacacugaa

SEQ ID NO: 439354 - RNA, 64 nt, Human
ccucaccagggucugaggggcagcucuggccagugcucaccagggccagcagggcccuaggcug

SEQ ID NO: 439355 - RNA, 64 nt, Human
uauuaaccucucuuucauauucuaaaauucauuuuccccuuauggauauuuaugguaguuuguu

SEQ ID NO: 439356 - RNA, 64 nt, Human
aagcuaaaaaauuuaccuccuuuccuuuucccuuuccccuuaaaacaccagacaaaucgauaac

SEQ ID NO: 439357 - RNA, 64 nt, Human
ccacuaaaaugacucgagaaguguuuagacaaacuccccuuaagaugugcacuccaucuuuaag

SEQ ID NO: 439358 - RNA, 64 nt, Human
gagugucagacaaggaagaagucccugggccucuuccccuuacccggcccuuagauuucaugga

SEQ ID NO: 439359 - RNA, 64 nt, Human
cuggcccuaggaaacuugaauuaaauaagccucuuccccuuaccgauccuuuuuaacacucuca

SEQ ID NO: 439360 - RNA, 64 nt, Human
guauuuugcaaagauaguuagagaaauaccuccuuccccuuagcuuuauuaagguaucauugau

SEQ ID NO: 439361 - RNA, 64 nt, Human
ccgcuccguccgugcacacacagcggugcucuucuccccuuagccacccacugcccaacccaac

SEQ ID NO: 439362 - RNA, 64 nt, Human
uggcuuuccagcaauuguuucaaaggaaaauagauccccuuaaagaaaaaauacaggcuuuagg

SEQ ID NO: 439363 - RNA, 64 nt, Human
ucuuuugagagcauucacguggucuucuugcucauccccuuauaaaugugcuuugccugccuca

SEQ ID NO: 439364 - RNA, 64 nt, Human
ccccuccgccccucggguggcccccuuugccacguccccuuagcuuagugaucaggugugagag

SEQ ID NO: 439365 - RNA, 64 nt, Human
ccuucugcugcuccuguuggcugacucaccacuguccccuuaggauuggaauucucaacuagaa

SEQ ID NO: 439366 - RNA, 64 nt, Human
uuuggacuugaagccucaaagaucaaccaaccaguccccuuauuuaguaaauaaggaaauugag

SEQ ID NO: 439367 - RNA, 64 nt, Human
gcauugagccugccuagaaagauacaguguuagcuccccuuacuucaaaguugcccuucucugu

SEQ ID NO: 439368 - RNA, 64 nt, Human
gggacggacuucuggucuucuucuuccuaauuguuccccuuauugucugugcuauuuuuaucuu

SEQ ID NO: 439369 - RNA, 64 nt, Human
gucuuuucuuucucaguaaacaguucugaaggcaggaguggaacccgggaguauuuucaugucu

SEQ ID NO: 439370 - RNA, 64 nt, Human
auuagcaucccauuugcccacacugugggaagacggaguggaccaggcuguuuuugaaguaagg

SEQ ID NO: 439371 - RNA, 64 nt, Human
guugguccuagcccauuucagcacccugccacuuggaguggaccccuccuacucuucuuagcgc

SEQ ID NO: 439372 - RNA, 64 nt, Human
ucgcugccgacagaagucacugccuaccucaggguccccuuaccugggugggaaauaaauuucu

SEQ ID NO: 439373 - RNA, 64 nt, Human
uauuccuaucuaguauacuaggcuauuuauuguauccccuuagguaaacuuauuuauuuaugcu

SEQ ID NO: 439374 - RNA, 64 nt, Human
agaauauuuuuuauaucuguucaauuuuuaucauuccccuuaucauuagaaaguuugacaaaaa

SEQ ID NO: 439375 - RNA, 64 nt, Human
agcggguggggaaacacacacagcuccugcugacuccccuuauggaucucaguuugcuccuuuu

SEQ ID NO: 439376 - RNA, 64 nt, Human
uuuuaaaauauaauuuauaacauagauugaagccuccccuuaagaaaccuuaaagaaauaagua

SEQ ID NO: 439377 - RNA, 64 nt, Human
ugagaaaauauuuccacuggauuuuuuccaccaguccccuuacagcccucauuguuuuaggaau

SEQ ID NO: 439378 - RNA, 64 nt, Human
cacacacacacacacacaugcuaggaugcggaaauccccuuaugacuugcuacuuuuugauuuu

SEQ ID NO: 439379 - RNA, 64 nt, Human
uauaaucagcaacaacacaaugacaaugacaucuuccccuuaccuuagccacuaagaagacaag

SEQ ID NO: 439380 - RNA, 64 nt, Human
gucucgccuaaucuaccuagaucagcguggcugguccccuuacugccugcuucuuagggcccuc

SEQ ID NO: 439381 - RNA, 64 nt, Human
gugggguuuucuugaacauacuugguuuccuauuuccccuuaucuuucuaaaacugccuuucug

SEQ ID NO: 439382 - RNA, 64 nt, Human
ucaguugcuuuagaaacauuagugccugccuggauccccuuaguuuugaaauauuugccauugu

SEQ ID NO: 439383 - RNA, 64 nt, Human
caugagcacuggcuccacccugaaucccagcuccuccccuuagugaccccaagucuguuucccu

SEQ ID NO: 439384 - RNA, 64 nt, Human
uuguucacaguaaugcaugucaauaauaaauguuuccccuuacugauaagcggccacuuuagga

SEQ ID NO: 439385 - RNA, 64 nt, Human
gagcacagguucucagucuaagcuauggaaaagcuccccuuauccaacagaguuuaaaaguagu

SEQ ID NO: 439386 - RNA, 64 nt, Human
aaucuauuucagggaauguucugucuagugauuugcucaccauuugauauauaaugaauuauag

SEQ ID NO: 439387 - RNA, 64 nt, Human
acaccccuucacguguauccccacacaaaugcaagcucaccaagguccccucucaguccccuuc

SEQ ID NO: 439388 - RNA, 64 nt, Human
uaaaggagaccacuuccaaagcaggugcugcauggcucaccaucauaugccccaaacaacugaa

SEQ ID NO: 439389 - RNA, 52 nt, Human
ucuccuguguuaacuuccagguuccccuuauuauuauagugccgccccccgg

SEQ ID NO: 439390 - RNA, 64 nt, Human
guucauuuguggugauauagaauuagcuuuuucauccccuuacccuuagaauccacguauuccc

SEQ ID NO: 439391 - RNA, 64 nt, Human
caaaaauuuuuguugcaacuuuucauauauauuuuccccuuaccaauuguuuuauccuuauagu

SEQ ID NO: 439392 - RNA, 64 nt, Human
cucaggaaagggcccugcucauguuuuuuuccuguccccuuagaccaaccccagguguccacug

SEQ ID NO: 439393 - RNA, 64 nt, Human
agcucuuguuugugggguaucuuuuucuuuugacuccccuuauucccucuccaagaguaguugc

SEQ ID NO: 439394 - RNA, 64 nt, Human
guggauguaaauggaacuucugcaaggcaguaauuccccuuaggccuuguuauuuauccugcau

SEQ ID NO: 439395 - RNA, 64 nt, Human
guuagucuuaaauuauaauguaaaguugacauuuuccccuuacauuucaaaggcaucacuauuu

SEQ ID NO: 439396 - RNA, 64 nt, Human
aaaggguuguuugacuagguuuugcuaccccacuuccccuuauuuugacccaucacagguuuuu

SEQ ID NO: 439397 - RNA, 64 nt, Human
uuucuauuauccuuggaagcacagaccucgggcauccccuuauugccugaugggccaacaccaa

SEQ ID NO: 439398 - RNA, 64 nt, Human
cagcccgccgccacuggagugcccuguauggaaguccccuuaauaaaccauccgucuccuucac

SEQ ID NO: 439399 - RNA, 64 nt, Human
gggaaaccaccuccauguaacccacuggauacaguccccuuaauguuuuugcuucuaaauugua

SEQ ID NO: 439400 - RNA, 64 nt, Human
gacaccuguuuaucaucuuguuuaaauguaaauguccccuuaugcuuuugaaauaaauuuccuu

SEQ ID NO: 439401 - RNA, 64 nt, Human
uuauuucuaauccuuuuccuuauuugccuucuacuccccuuaaucuaaucuaaaagcucuguuc

SEQ ID NO: 439402 - RNA, 64 nt, Human
uccaccuccccauccccuguucucccucuguugcuccccuuauaaaauugauguugucuuuacc

SEQ ID NO: 439403 - RNA, 64 nt, Human
aguguaauggaggacgggcaacgugcaugugcaggcucaccacucccaggccucugacaugagg

SEQ ID NO: 439404 - RNA, 64 nt, Human
ccacaaaaucccucuccaaccacaggacccuucggcucaccaagaacagggcccaggggaguca

SEQ ID NO: 439405 - RNA, 64 nt, Human
ugcugaaugaagaacagaaucuuggugcuuuguggcucaccacagccaucuguggggcaggcac

SEQ ID NO: 439406 - RNA, 64 nt, Human
ccgcgccaucgccccguggcccaggacggggaccuccccuuaguccguccucccaccgccgggc

SEQ ID NO: 439407 - RNA, 64 nt, Human
ucgugcagguggggcuugggaaaugcacgucccuuccccuuacuccccgccaaaacccacaucc

SEQ ID NO: 439408 - RNA, 64 nt, Human
uccuugggagcggguggagagacacccauguggcuccccuuagggccagcaccaagcaccacgc

SEQ ID NO: 439409 - RNA, 64 nt, Human
ccaaggaacucucacucuugcucaagcuguuccguccccuuaccaccccugauacaacugccag

SEQ ID NO: 439410 - RNA, 64 nt, Human
acaagagauucuauuaaaagccucuagaaguaacuccccuuaaaaugucuaguaaagcuugcac

SEQ ID NO: 439411 - RNA, 64 nt, Human
agggagagcagaggccuuugcuucucugccuacguccccuuagaugggcagcagaggcaacucc

SEQ ID NO: 439412 - RNA, 64 nt, Human
cuguaacagaaacauauuuggaauguuuuucuuuuccccuuauaaauuguaauuccugaaauac

SEQ ID NO: 439413 - RNA, 64 nt, Human
cuuuccuuucaacccacuuauuuucagaggccucuccccuuagcauccuuuaaaagguuuucug

SEQ ID NO: 439414 - RNA, 64 nt, Human
agcugccccacugggcagugcccucaggccaggauccccuuagcaggguccuucccaccagacu

SEQ ID NO: 439415 - RNA, 64 nt, Human
aaacuugcccuguuuuuguuuuuuuaguuuguuauccccuuacugagcggccucuacuaggugg

SEQ ID NO: 439416 - RNA, 64 nt, Human
cccagccaugaaggguuuugcuauuuccaaagcuuccccuuaucguccccugugauuaucuccc

SEQ ID NO: 439417 - RNA, 64 nt, Human
gccccagggagggcagggagagcaaggggcaagguccccuuaccuugugggcuugggaaacacg

SEQ ID NO: 439418 - RNA, 64 nt, Human
cucacaccauguggaaucucgugggggucggggauccccuuaagaagugguaauggggacaaga

SEQ ID NO: 439419 - RNA, 64 nt, Human
guuuuuuucauggaccaaacuuuuuuuuguacuguccccuuauugauguuacccaguuuuaaua

SEQ ID NO: 439420 - RNA, 64 nt, Human
ucucuccugaggcgagccaccuuggguugcuggagcucaccagucuugagggaggugcagggga

SEQ ID NO: 439421 - RNA, 64 nt, Human
guaguguggaugcgaggccacggcucagugaugggcucaccacccagaaguggggagagacuuu

SEQ ID NO: 439422 - RNA, 64 nt, Human
cuguaaauaauuuucuccuuuuuucucucuugaugcucaccaccaccuuuugcccccuucuguu

SEQ ID NO: 439423 - RNA, 64 nt, Human
gugaaagguacaaagcaauaagcaucaugcauccuccccuuaccccuccaacaccccucugccu

SEQ ID NO: 439424 - RNA, 64 nt, Human
guugcuuccaaagaugaauggccuucagagaaaguccccuuagugcuggcuuccucuuugcaug

SEQ ID NO: 439425 - RNA, 64 nt, Human
uuuccuuuuuuuuuuucaaguugcauauuugguuuccccuuaugauugggaaagaugaauuuuc

SEQ ID NO: 439426 - RNA, 64 nt, Human
ccaucuucauaauuugcuggagaaguguguuucuuccccuuacucucacaccugggcaaacuuu

SEQ ID NO: 439427 - RNA, 64 nt, Human
auuccccuaaccauuccucuucauaucugccucuuccccuuaccaucguaauucuccaaacugg

SEQ ID NO: 439428 - RNA, 64 nt, Human
cucucccacccacaagaacuccucccacccaacuuccccuuagagugcugugagaugagagugg

SEQ ID NO: 439429 - RNA, 64 nt, Human
uauaaauacuaaaaaauaucuuaacagauuuuuuuccccuuaaaaugaauuaucuuuccaaaga

SEQ ID NO: 439430 - RNA, 64 nt, Human
augugaaucuaugcuggugaaaacaauuuuuuguuccccuuauuaaaaccuuaguguccuuuuc

SEQ ID NO: 439431 - RNA, 64 nt, Human
auaucauuuccccccagucagcauuauuuaacacuccccuuaacugucuuugaacuuucucuuu

SEQ ID NO: 439432 - RNA, 64 nt, Human
acuuugaugcauuuauuuuuagguguuuuuuuuuuccccuuaaaaaacuugaagugauaugcag

SEQ ID NO: 439433 - RNA, 64 nt, Human
auccuucucacuuuccccacuaaaauaggauuuuuccccuuaaaacucuggagacccuaacgaa

SEQ ID NO: 439434 - RNA, 64 nt, Human
uuagaugcuggucauuuucuggagagggguccccuccccuuacgaacacagaaacccagcccac

SEQ ID NO: 439435 - RNA, 64 nt, Human
ucuuuucccuuuccaucuuucagcauagacuuaauccccuuaagcccagacaucuguugggacc

SEQ ID NO: 439436 - RNA, 64 nt, Human
gcccuaccuuaacccaaaugaaaguaaaucccuuuccccuuagccaaaauaagguuggguuuuc

SEQ ID NO: 439437 - RNA, 64 nt, Human
agggccaagcccuuuuuagugcugugcucguccagcucaccaccacagccccucucagcccuca

SEQ ID NO: 439438 - RNA, 64 nt, Human
acaucagaccaggcacucucagggccgcucuccagcucaccacagugucuccacgugccuuacc

SEQ ID NO: 439439 - RNA, 64 nt, Human
gggcuuucuaaagcaagugaccugaaggcucugggcucaccauacaacacccacguuguuuauu

SEQ ID NO: 439440 - RNA, 64 nt, Human
agauugccauuagaaugccuuaggguuuucuaauuccccuuauggauccaauccaucuccuggc

SEQ ID NO: 439441 - RNA, 64 nt, Human
acagaagcaauuuuagaauuuugcaaaauucuuuuccccuuauugagauuaauauuuaagauua

SEQ ID NO: 439442 - RNA, 64 nt, Human
aaugggcucaaacuucuaagggguacuccucucauccccuuauccuucucccucgacauuuucu

SEQ ID NO: 439443 - RNA, 64 nt, Human
aguuuuauggaagcugaaauguaauacaguagucuccccuuaucuguaagagauacauuccaag

SEQ ID NO: 439444 - RNA, 64 nt, Human
caggcacagaccaggggaggggauauuuaggggcuccccuuacaauccacaaugagcaauugcu

SEQ ID NO: 439445 - RNA, 64 nt, Human
uucacaaaaacucaaggacugcuauucuccuucuuccccuuaguuuacuccugguuuuuacccc

SEQ ID NO: 439446 - RNA, 64 nt, Human
ugaaaaccuacaggaauuuuuuuauuuuucauuuuccccuuaggcauauuuaguauuuuucccc

SEQ ID NO: 439447 - RNA, 64 nt, Human
augagauuggauuugaccccuuggcucucaaguguccccuuagaucuagaacugcuccuuggug

SEQ ID NO: 439448 - RNA, 64 nt, Human
gcaucugaagacuggguuuuuuuguuguuguuguuccccuuacagacaaaaugaagacuaucau

SEQ ID NO: 439449 - RNA, 64 nt, Human
gagucagcaguuucagauucuuacacuccauagcuccccuuaccaugagguggagcuggcuucc

SEQ ID NO: 439450 - RNA, 64 nt, Human
cuucuuuguaauacuuucuaugugacauuucucuuccccuuagaaacacugcaaauuuuaacug

SEQ ID NO: 439451 - RNA, 64 nt, Human
uggaacugagcauucuguaauauucuagggucacuccccuuagauacaaccaauguggcuauuu

SEQ ID NO: 439452 - RNA, 64 nt, Human
aucugugauaauguuugcauaucagaaugcauucuccccuuaaaaguagcaguagccacuuggu

SEQ ID NO: 439453 - RNA, 64 nt, Human
ucccaucuccugggugggggcaucaaagcauuucuccccuuagcuuucagccccccuucugacc

SEQ ID NO: 439454 - RNA, 64 nt, Human
gagugugagagggaccgugagggggcucuugaugggaguggaagaagugcugagggucugagag

SEQ ID NO: 439455 - RNA, 64 nt, Human
aagggugggagauagaaagguuaauagaguuggaggaguggaagcuauuuuguaugcaacuagu

SEQ ID NO: 439456 - RNA, 64 nt, Human
ccagaagggaauggagacauucgaggcggccucaggaguggaugcgaucugucucuccuggcuc

SEQ ID NO: 439457 - RNA, 64 nt, Human
aauguggauuuggggaccaaaggucagggacacauccccuuagaggaccugaguuugggagagu

SEQ ID NO: 439458 - RNA, 64 nt, Human
agaaagucagaugacuaccguguugguugugacuuccccuuaaguauaacuaauuugcucugug

SEQ ID NO: 439459 - RNA, 64 nt, Human
ggagaaggcuaagccgagggguccuguuugugccuccccuuagucccuucccucccgauuuccc

SEQ ID NO: 439460 - RNA, 64 nt, Human
agcagcagccuuuugcuuuuucuuuuuucuucccuccccuuaucaaggguugaaggaagggagc

SEQ ID NO: 439461 - RNA, 64 nt, Human
gcucucugccacuucgucucgcucccuacucuccuccccuuauucccgaggcccagaaaagaaa

SEQ ID NO: 439462 - RNA, 64 nt, Human
aauaccaaaaugaagcuaguuuccuaaauaaggguccccuuauuuuucugcuuuucuuccaaug

SEQ ID NO: 439463 - RNA, 64 nt, Human
ccgggaccugccaccagccccccagccugcuucuuccccuuaagcuuugugccccuggaugcgc

SEQ ID NO: 439464 - RNA, 64 nt, Human
uggauacagcccuuuuuuuuuucuuuuuuuuucuuccccuuaccuuucuucaccuugguuauuu

SEQ ID NO: 439465 - RNA, 64 nt, Human
uguuucugucuucuguuccuucuagggccaccuguccccuuaaacacagguccacguuguguca

SEQ ID NO: 439466 - RNA, 64 nt, Human
uacuucauggugauagacugaaggcugaauguuuuccccuuaagauugggaagaaggacaagga

SEQ ID NO: 439467 - RNA, 64 nt, Human
ugcuggaaggaagguuauuuuuggagccacucucuccccuuaaggauauuucccaagggccugc

SEQ ID NO: 439468 - RNA, 64 nt, Human
gugguacuggccacgccccucaaggcaaggcuccuccccuuagggggccugaucccgccccuug

SEQ ID NO: 439469 - RNA, 64 nt, Human
gaacugaccuugaccucugaucucuucacacaucuccccuuagcaucuccacuuaccuacuuuu

SEQ ID NO: 439470 - RNA, 64 nt, Human
gggaaauggccagcugugugucccaggaaauuccuccccuuauucuuccuugaagugcccgagc

SEQ ID NO: 439471 - RNA, 50 nt, Human
aggucauagccuacaacugagcucaccacaggcccuccccagcucaaccc

SEQ ID NO: 439472 - RNA, 64 nt, Human
uggccugcaggucccaguucacauguaguccccugcucaccauuggagaaucagcucacugcuc

SEQ ID NO: 439473 - RNA, 64 nt, Human
gccccaggguuggggggugccggcaucuccccuagcucaccaggccuggccucugggcagugug

SEQ ID NO: 439474 - RNA, 64 nt, Human
accuccauucccuguugcugaaggcccuccagcauccccuuaagcaucuguacauacugugucc

SEQ ID NO: 439475 - RNA, 64 nt, Human
uaccccaacuccacuagugacccucagagucuucuccccuuaggacaaggcagacaccccacca

SEQ ID NO: 439476 - RNA, 59 nt, Human
cgcagcuggcuugcagcugaugcuuacgcuccccuuacaacaccucaguguaugguugg

SEQ ID NO: 439477 - RNA, 64 nt, Human
gggggcccauguuuuuuuacacgccugccuccuguccccuuauccuuucucccucuguaaauac

SEQ ID NO: 439478 - RNA, 64 nt, Human
agccccaacaucuaaggauauacagugggcggauuccccuuaaguuccagguauguguuacacu

SEQ ID NO: 439479 - RNA, 64 nt, Human
cucagccuccccuggguugggagaaguccaucuuuccccuuagugccaccgggcugcugaguca

SEQ ID NO: 439480 - RNA, 64 nt, Human
gcaccugugcccacccccugggcuguuucccccuuccccuuaaauccggaugccucgucuugca

SEQ ID NO: 439481 - RNA, 64 nt, Human
gcucuuucugucuuccucuucucacccuccucccuccccuuagccaucacuucugggaaguaaa

SEQ ID NO: 439482 - RNA, 64 nt, Human
cccagccacagagauggauccaguuuccuggucauccccuuagcaguucacaaguuccuggcaa

SEQ ID NO: 439483 - RNA, 64 nt, Human
ggagugggguggaggcacaggccaaccugcgcucuccccuuaggggacaaacagggacccuugc

SEQ ID NO: 439484 - RNA, 64 nt, Human
uagccacuuuccccaagcagguagauagcaaauuuccccuuagagguaguuagcauggauuaua

SEQ ID NO: 439485 - RNA, 64 nt, Human
cgcuuguggagaaccaaagcccaaaagccccagauccccuuaaagcagagagggagggcaggcg

SEQ ID NO: 439486 - RNA, 64 nt, Human
aaucagauaauuaacaaugaaggaaacucuaaacuccccuuauggucuaccaguaauucauacu

SEQ ID NO: 439487 - RNA, 64 nt, Human
cagcuuuuugcacuaaagccaaaccacaccgcuguccccuuagccccaagggcccugggggcag

SEQ ID NO: 439488 - RNA, 64 nt, Human
ccugguggcagugggagcugccuguucagcuccagcucaccagccccagugcccacaggaucag

SEQ ID NO: 439489 - RNA, 64 nt, Human
ggguuccuggugccccuuuccccccacuuucagggcucaccaggcacuggcagggaggguaagg

SEQ ID NO: 439490 - RNA, 64 nt, Human
uuucucucugcaauuaccugucauagcauuuugugcucaccacgaaggauggucucugccuucu

SEQ ID NO: 439491 - RNA, 64 nt, Human
ggagagccuuugccuccaccauucccacccacccuccccuuaaacccucugccuuugaaaguag

SEQ ID NO: 439492 - RNA, 64 nt, Human
cagcacggcgcucccagaugagggccggacugccuccccuuaagcagcuguguuggagguacug

SEQ ID NO: 439493 - RNA, 64 nt, Human
ccagcaagggccagugaugauuucccccagcucauccccuuauuuucccacaacccaaccauuc

SEQ ID NO: 439494 - RNA, 64 nt, Human
gcugcugauuacacggccuggggucucugccuucuccccuuacccucccgccucccacccuccc

SEQ ID NO: 439495 - RNA, 64 nt, Human
ccuggauucaggggagaggccuucccagggccacuccccuuacacccucccagaggccugagca

SEQ ID NO: 439496 - RNA, 64 nt, Human
ucauuagugucauuucuuugucauugaggacuuuuccccuuacaacaguaacaccauuuuuuga

SEQ ID NO: 439497 - RNA, 64 nt, Human
cucugcccacccuccuguaccgucgacaagaauguccccuuaggucgcgcucuugcacacacgg

SEQ ID NO: 439498 - RNA, 64 nt, Human
uagucuguguccuccauucugcccccgcccuuccuccccuuauuuguuaaaugaagcaacauag

SEQ ID NO: 439499 - RNA, 64 nt, Human
ugggcuccucagcuacugacuucuuagcucuuaauccccuuagaauuucaucuuucucgaugag

SEQ ID NO: 439500 - RNA, 64 nt, Human
caccccagaucaccgccaggccagcccccaaugguccccuuacggacaggucccagagauggac

SEQ ID NO: 439501 - RNA, 64 nt, Human
gauguuuggagggagaggcacacgguaaauggcauccccuuaggcgccucuuugggaaaggaaa

SEQ ID NO: 439502 - RNA, 64 nt, Human
cucccucacaguuccaggagcggcuucccucgucuccccuuacuccacagggagccucccuugc

SEQ ID NO: 439503 - RNA, 64 nt, Human
ccuugacuauauuuagaggucuuuuugccucuuuuccccuuaacaaggauuucuuauggugguu

SEQ ID NO: 439504 - RNA, 64 nt, Human
ugaagucuuucguagacaccccagagcacacacauccccuuaguccaccgguuagaugucucuc

SEQ ID NO: 439505 - RNA, 64 nt, Human
cucccuguauuuccuaggaaaugaauauucaacagcucaccaacuacagaaagagcgucauguc

SEQ ID NO: 439506 - RNA, 64 nt, Human
cuugcccaauggggaauggaucuuucaccaaagagcucaccagcauuuuccacagagaugcaaa

SEQ ID NO: 439507 - RNA, 60 nt, Human
augaaggucucauccuuuaaaaaggaaauagcucaccauacuccuuuccauguacaucca

SEQ ID NO: 439508 - RNA, 64 nt, Human
gggaacacguccuaggcaggucugacgugaaaccuccccuuacccugaaccgugugacucugca

SEQ ID NO: 439509 - RNA, 64 nt, Human
ugcucaaaacagucaccaaguccucugggcuccguccccuuaaaaaauaccccaauagcuaaaa

SEQ ID NO: 439510 - RNA, 64 nt, Human
uucccuccccgauaaagaauguucuauuucugccuccccuuaaaggggagaccucagaaguaaa

SEQ ID NO: 439511 - RNA, 64 nt, Human
cauauugacaaaaugguuuccggaaauauuuguauccccuuacacugccaccagcaaggauaaa

SEQ ID NO: 439512 - RNA, 64 nt, Human
ugcagcuguuuucacuuagcauaucgugggcaucuccccuuaugauuacuaaauauuuuauuuu

SEQ ID NO: 439513 - RNA, 64 nt, Human
uuuguuggaucaacggaucauuuuaacccugacuuccccuuauucccauaaaagaaguuuucca

SEQ ID NO: 439514 - RNA, 64 nt, Human
uuggcaccuacauuuguaucaaaguauguccugauccccuuaggggauagcucauuguuuuuau

SEQ ID NO: 439515 - RNA, 64 nt, Human
uguuccagcugcucucccaaccuggaaggccgucuccccuuagccaaguccuccucaggcuugg

SEQ ID NO: 439516 - RNA, 64 nt, Human
cccucacccccacuggcccacugguggcuaggucuccccuuauccuucugguccagcgcaagga

SEQ ID NO: 439517 - RNA, 64 nt, Human
uacagacuccaacaaggccuccagcggagacaucuccccuuaugacaacaacuccccagugcug

SEQ ID NO: 439518 - RNA, 64 nt, Human
gacuuaacagaacucaacuguauaaauaguuugguccccuuaaaugccaaucuuccauauuagu

SEQ ID NO: 439519 - RNA, 64 nt, Human
gccaggagccacugcucucccccuugcccuccgguccccuuaccuacccgcgcccgucugcucu

SEQ ID NO: 439520 - RNA, 64 nt, Human
uaaaacgugaaguaauguuugaacuggaagaugagcucaccaggcaaagcuaaggaaggauaua

SEQ ID NO: 439521 - RNA, 64 nt, Human
ccaggaacugccagcuccaaaauauugggguacagcucaccaccccccacuccgccaacccauu

SEQ ID NO: 439522 - RNA, 64 nt, Human; identical to SEQ ID NO: 70864

SEQ ID NO: 439523 - RNA, 64 nt, Human; identical to SEQ ID NO: 70865

SEQ ID NO: 439524 - RNA, 64 nt, Human; identical to SEQ ID NO: 70866

SEQ ID NO: 439525 - RNA, 64 nt, Human; identical to SEQ ID NO: 70867

SEQ ID NO: 439526 - RNA, 64 nt, Human; identical to SEQ ID NO: 70868

SEQ ID NO: 439527 - RNA, 64 nt, Human; identical to SEQ ID NO: 70869

SEQ ID NO: 439528 - RNA, 64 nt, Human; identical to SEQ ID NO: 70870

SEQ ID NO: 439529 - RNA, 64 nt, Human; identical to SEQ ID NO: 70871

SEQ ID NO: 439530 - RNA, 64 nt, Human; identical to SEQ ID NO: 70872

SEQ ID NO: 439531 - RNA, 64 nt, Human; identical to SEQ ID NO: 70873

SEQ ID NO: 439532 - RNA, 64 nt, Human; identical to SEQ ID NO: 70874

SEQ ID NO: 439533 - RNA, 64 nt, Human; identical to SEQ ID NO: 70875

SEQ ID NO: 439534 - RNA, 64 nt, Human; identical to SEQ ID NO: 70876

SEQ ID NO: 439535 - RNA, 64 nt, Human
cucuucgcuccuaugcucggggccuccggcuugagcucaccaccuaccucuuuggccaggaccc

SEQ ID NO: 439536 - RNA, 64 nt, Human
uugugaucucaccauuaugacauccaucccccuagcucaccacauagcacauagaaugauauuu

SEQ ID NO: 439537 - RNA, 64 nt, Human
gcguggacucuggguuccaucccaccugcuacaugcucaccaggucuccauugaggaagaacag

SEQ ID NO: 439538 - RNA, 64 nt, Human; identical to SEQ ID NO: 70877

SEQ ID NO: 439539 - RNA, 64 nt, Human; identical to SEQ ID NO: 70878

SEQ ID NO: 439540 - RNA, 64 nt, Human; identical to SEQ ID NO: 70879

SEQ ID NO: 439541 - RNA, 64 nt, Human; identical to SEQ ID NO: 70880

SEQ ID NO: 439542 - RNA, 64 nt, Human; identical to SEQ ID NO: 70881

SEQ ID NO: 439543 - RNA, 64 nt, Human; identical to SEQ ID NO: 70882

SEQ ID NO: 439544 - RNA, 64 nt, Human; identical to SEQ ID NO: 70883

SEQ ID NO: 439545 - RNA, 64 nt, Human; identical to SEQ ID NO: 70884

SEQ ID NO: 439546 - RNA, 64 nt, Human; identical to SEQ ID NO: 70885

SEQ ID NO: 439547 - RNA, 64 nt, Human; identical to SEQ ID NO: 70886

SEQ ID NO: 439548 - RNA, 64 nt, Human; identical to SEQ ID NO: 70887

SEQ ID NO: 439549 - RNA, 64 nt, Human; identical to SEQ ID NO: 70888

SEQ ID NO: 439550 - RNA, 64 nt, Human; identical to SEQ ID NO: 70889

SEQ ID NO: 439551 - RNA, 64 nt, Human
guauauucaguccuuucaauacguccaccuggaggcucaccacuuggagagacacaggaaggua

SEQ ID NO: 439552 - RNA, 64 nt, Human
uauuuaaaccacuucccauuacugaccauuaaaagcucaccacuagaguuccugaaacagguga

SEQ ID NO: 439553 - RNA, 57 nt, Human
gccuuggacaagauuuauaauaaccuugcucaccaagcuguuccacuucucuaggua

SEQ ID NO: 439554 - RNA, 64 nt, Human; identical to SEQ ID NO: 70890

SEQ ID NO: 439555 - RNA, 64 nt, Human; identical to SEQ ID NO: 70891

SEQ ID NO: 439556 - RNA, 64 nt, Human; identical to SEQ ID NO: 70892

SEQ ID NO: 439557 - RNA, 64 nt, Human; identical to SEQ ID NO: 70893

SEQ ID NO: 439558 - RNA, 64 nt, Human; identical to SEQ ID NO: 70894

SEQ ID NO: 439559 - RNA, 64 nt, Human; identical to SEQ ID NO: 70895

SEQ ID NO: 439560 - RNA, 64 nt, Human; identical to SEQ ID NO: 70896

SEQ ID NO: 439561 - RNA, 64 nt, Human; identical to SEQ ID NO: 70897

SEQ ID NO: 439562 - RNA, 64 nt, Human; identical to SEQ ID NO: 70898

SEQ ID NO: 439563 - RNA, 64 nt, Human; identical to SEQ ID NO: 70899

SEQ ID NO: 439564 - RNA, 64 nt, Human; identical to SEQ ID NO: 70900

SEQ ID NO: 439565 - RNA, 64 nt, Human; identical to SEQ ID NO: 70901

SEQ ID NO: 439566 - RNA, 64 nt, Human; identical to SEQ ID NO: 70902

SEQ ID NO: 439567 - RNA, 64 nt, Human
uuuucauguuucugucucaaaacacuuugacaaagcucaccaacuuuaaaauauuaaguuuuua

SEQ ID NO: 439568 - RNA, 64 nt, Human
augagaagaagcagauccccuguguggucuccaugcucaccaaggaacucuacuucagucaaua

SEQ ID NO: 439569 - RNA, 64 nt, Human
auugcccaggcuagagugcaauggugcgaucuaggcucaccacaaccucugccuuccagguuca

SEQ ID NO: 439570 - RNA, 64 nt, Human; identical to SEQ ID NO: 70903

SEQ ID NO: 439571 - RNA, 64 nt, Human; identical to SEQ ID NO: 70904

SEQ ID NO: 439572 - RNA, 64 nt, Human
auggggcccugcccucccgugggaguuguggacucgagcccaggggcugcccgucacagcggug

SEQ ID NO: 439573 - RNA, 64 nt, Human
uguuguggggacugcaaaagagaaaacguccaggcgagcccaguuguccucgcccacagggucc

SEQ ID NO: 439574 - RNA, 64 nt, Human
uuuggccuuagaaucugcagaaauuaggaggcaccgagcccagcgcagcagccucggacccgga

SEQ ID NO: 439575 - RNA, 64 nt, Human
accgugugcccccugccagccccagagggaguggcgagcccagcugcccagcccugcccccccu

SEQ ID NO: 439576 - RNA, 64 nt, Human
cugcugguagaaucaggguccucgggcaugaacgcgagcccaaagugccagucugcgauuggaa

SEQ ID NO: 439577 - RNA, 64 nt, Human
uaccuguguucccucaccaggccauccugucaaacgagcccauuuucuccaaaguggaaucuga

SEQ ID NO: 439578 - RNA, 64 nt, Human
ggguggcgccgccgccgccucugucccugcccuccgagcccacugucacgcugccugguguucc

SEQ ID NO: 439579 - RNA, 64 nt, Human
cucccauuugccauccaggccucacacccacacucgagcccacccggccggccagcuuuagagg

SEQ ID NO: 439580 - RNA, 64 nt, Human
uguguuggagcucaucuuguucccugaugugucucgagcccauugguagggucauacaaagccc

SEQ ID NO: 439581 - RNA, 64 nt, Human
cucagggcaccggcaccgggcgccucucgccgcucgagcccagccucucccugccaaagcccaa

SEQ ID NO: 439582 - RNA, 64 nt, Human
ucucccuaugucccacaggagauucacagagagacgagcccaggaggcugacugagcucaaagg

SEQ ID NO: 439583 - RNA, 64 nt, Human
cucgcaugccgccaccaccucacugggagggcgccgagcccaccgucgcccccuagacccugac

SEQ ID NO: 439584 - RNA, 64 nt, Human
agaagaggugcaaggaagcgggcuccaggagcaagcucaccaggccucucagaagucccagcag

SEQ ID NO: 439585 - RNA, 64 nt, Human
uugugcauuuaucuuuguuaggaucaaagcacaagcucaccaucaaugagccuggacaaaaagg

SEQ ID NO: 439586 - RNA, 64 nt, Human
cugcauaacaacacugggccuucuuaacuaaaaugcucaccacuuagccuguuuuuuuaucccu

SEQ ID NO: 439587 - RNA, 64 nt, Human
ggauauguucugcaauucaacacauccacagguucgagcccaaacagcagaacuuuuugccaaa

SEQ ID NO: 439588 - RNA, 64 nt, Human
auucccucaaguacguccggccuggugguggguucgagcccaacuucaugcucuucgagaagug

SEQ ID NO: 439589 - RNA, 64 nt, Human
gcaacacuacuuuaugggcagggcccuagaagagcgagcccagcagcacagagaagcucugaua

SEQ ID NO: 439590 - RNA, 64 nt, Human
uggcgguccuuugauaagacccauaggcaaacuucgagcccaucagcaggucaacccuaugcug

SEQ ID NO: 439591 - RNA, 64 nt, Human
aauuugcugaagaacaucaccuaaagucugcacacgagcccauuuuuaccaagauuugaucagu

SEQ ID NO: 439592 - RNA, 64 nt, Human
agaaacugacucguuuuauuuagugccuauuuagcgagcccagaguaacguacauuugugcugu

SEQ ID NO: 439593 - RNA, 63 nt, Human
gcaaacccuucugcgccugaggcgggcgggucccgagcccaggagggaacccgcgcucaggcg

SEQ ID NO: 439594 - RNA, 64 nt, Human
ucccuggaccccugcagggcaggcagcuugggcccgagcccaagcauuuggcucugcugccccc

SEQ ID NO: 439595 - RNA, 64 nt, Human
aucacggugcgacgugagaugccugcgccagccccgagcccacuggcagccacugccauuccac

SEQ ID NO: 439596 - RNA, 64 nt, Human
cucgugauugcuuccugugaacgccucccaaggacgagcccaguguaguuguguggcgugaacu

SEQ ID NO: 439597 - RNA, 64 nt, Human
acugucuuuacgaguguuuuuuauuugggacccucgagcccagagauauuaauggauaucugua

SEQ ID NO: 439598 - RNA, 64 nt, Human
aggaugcgugccugccacuaggcaucugcauccccgagcccaagccaggagggauuucccuuag

SEQ ID NO: 439599 - RNA, 64 nt, Human
aacagagcaaaggaugguggccgcaggccccacgcgagcccacaggacaccggccccuagauuc

SEQ ID NO: 439600 - RNA, 64 nt, Human
cucccggggccaggcugcccugggagccccccuccgagcccagccagccaggcucucaggcccu

SEQ ID NO: 439601 - RNA, 64 nt, Human
ccccaacaagcgucugucccuucagccggcagagcgagcccagcguggccccucaauuugaaaa

SEQ ID NO: 439602 - RNA, 64 nt, Human
agcucuccuggcccgucuguccagccuggacucccgagcccacgaggcuguugaggccccugca

SEQ ID NO: 439603 - RNA, 64 nt, Human
gagcagaagugaccacugggacuucaggcaagaagcucaccaccaggcacacagcaaagggacu

SEQ ID NO: 439604 - RNA, 64 nt, Human
aaaaauaccaugucugugauagggaagaaggccugcucaccaaugaugaggccugugaagccac

SEQ ID NO: 439605 - RNA, 64 nt, Human
ucauccuuuaaauuguaaauuaaggauuacucaagcucaccauuauucaagauugggacucgcu

SEQ ID NO: 439606 - RNA, 64 nt, Human
uggguggcagggccuucugaaggaaacuugcaggcgagcccaacgugguggggggccuuccucc

SEQ ID NO: 439607 - RNA, 64 nt, Human
ugauguggaguggaggguuccugcacccuacacccgagcccauccagccucugggccauagacc

SEQ ID NO: 439608 - RNA, 64 nt, Human
gaagugucccaagaggcuccgaaggccuccccuccgagcccagcucuccugucuccuccacagc

SEQ ID NO: 439609 - RNA, 64 nt, Human
uacuguuagccccgguccaugcaggggguucagccgagcccaagacucaaagcugcuuuccuuu

SEQ ID NO: 439610 - RNA, 64 nt, Human
uacauuuuuuaaaguaccaaagguauuugguaagcgagcccaagucauguaauugaaacuucug

SEQ ID NO: 439611 - RNA, 64 nt, Human
uggugaguuucuaagggggaagccggccagggagcgagcccagaacggaccggacgccugugca

SEQ ID NO: 439612 - RNA, 64 nt, Human
uguggaaagucuaggggguuccauucuggccaugcgagcccagcuccuaccaacgucgguaacu

SEQ ID NO: 439613 - RNA, 64 nt, Human
gcccccaacacacgcgcacggugaagaggacgcccgagcccaccccugcugacccaggacuucc

SEQ ID NO: 439614 - RNA, 64 nt, Human
ccugccagcacaccgaugcacacaccggaaguggcgagcccaagcccuggggacagguguaggg

SEQ ID NO: 439615 - RNA, 64 nt, Human
cagguugaagucucuucccuuucuacccaguacucgagcccagggcuagaaguugaaacucacu

SEQ ID NO: 439616 - RNA, 59 nt, Human
cccaggcccugacgcuaugacacacagcgcgagcccaugagaggacagaggcgguggga

SEQ ID NO: 439617 - RNA, 64 nt, Human
gcugaggcagguggaucaccugaggucaggaguucgagcccagccugaccaauaugaugaaacc

SEQ ID NO: 439618 - RNA, 64 nt, Human
gcagaugugcccacggaggcccccagcugcccuccgagcccaggccugcagcacugaaagacga

SEQ ID NO: 439619 - RNA, 64 nt, Human
ccagugcagguaccugcgauguuuacguccacaccgagcccagugugggacugacauuucucaa

SEQ ID NO: 439620 - RNA, 64 nt, Human
cacguaaggggccggccucgcugcgcugauucgucgagcccauccggcgacagaggacagccag

SEQ ID NO: 439621 - RNA, 64 nt, Human
ucgggugcauuugagagaagccacgcuguccucucgagcccagauggaaagacguuuuugugcu

SEQ ID NO: 439622 - RNA, 64 nt, Human
ggccuucugagggcugucugauugccccugcccugcucaccacccugucacagccacucccaag

SEQ ID NO: 439623 - RNA, 64 nt, Human
ggcauggaguuaagaucccucacaggacccagaagcucaccaaaaacuauuucuucagccccuu

SEQ ID NO: 439624 - RNA, 64 nt, Human
uuuuccuggaagaugggacucugggguguguggugcucaccagagucaggccacccacugggcu

SEQ ID NO: 439625 - RNA, 55 nt, Human
ugagggaagaugagggcuaaaggugcgagcccagauggcgagccccaggggaugg

SEQ ID NO: 439626 - RNA, 64 nt, Human
gagauggguaccagcccacaguccuuaccugccacgagcccauaauugaagagucaaagucuuc

SEQ ID NO: 439627 - RNA, 58 nt, Human
ucauccucuccacaaaguagacccucuccgagcccaccagccacagaauauuauguaa

SEQ ID NO: 439628 - RNA, 64 nt, Human
uguccuuguccuggaccucagguucccagcgucccgagcccagcacugucucuucagugcccug

SEQ ID NO: 439629 - RNA, 64 nt, Human
ccagcacuuugggaggucgagguaggcagaucaccgagcccaagaguucaagacaauccuggcc

SEQ ID NO: 439630 - RNA, 64 nt, Human
gguuguuacacaaagaaaauauuggggucacuggcgagcccacccacacucaccagaaucucca

SEQ ID NO: 439631 - RNA, 64 nt, Human
uagcagaugcacgugucugucgaaucgcugccuccgagcccacccccgagcucgcaugcuguca

SEQ ID NO: 439632 - RNA, 63 nt, Human
ugcgcccgccguuuucgugagcccgagcagcggcgagcccagggcgccgggcggccgggaggc

SEQ ID NO: 439633 - RNA, 64 nt, Human
aaggaaauagaugcugaggcagucuuccugccagcgagcccacuguaucugggcccaaggccag

SEQ ID NO: 439634 - RNA, 64 nt, Human
augagaguguggagcagagucggcgagcgcaagccgagcccaucaaccuggacagcugucuccg

SEQ ID NO: 439635 - RNA, 64 nt, Human
uuccacucucuucagcucuccccucaacagcaugcgagcccauaccuucugcauuuuuccaggc

SEQ ID NO: 439636 - RNA, 64 nt, Human
cugugccgccccuggugcggacggggccugguggcgagcccaagugguugccuccuacgaggag

SEQ ID NO: 439637 - RNA, 64 nt, Human
ugugaaaagacaguggcaggcagcuggaguagagcgagcccagcagcccuaaaaggcugccuuc

SEQ ID NO: 439638 - RNA, 64 nt, Human
uuccccuuucuaaauacccucagauuccuaacaucgagcccaugcuuuguuugauuuguucuau

SEQ ID NO: 439639 - RNA, 64 nt, Human
cagcucccggcgggugcucugaggccucacuacucgagcccacccagcaucccgcgcgcccuuc

SEQ ID NO: 439640 - RNA, 64 nt, Human
aagagaacccaaaccaauaaaguuuaugcuaagucgagcccauugugaaaauuuauuaaaauga

SEQ ID NO: 439641 - RNA, 64 nt, Human
aagcaaauauuuguaaaauuaaaaacggaggaccgcucaccaaauguuugaaauguugcuuuuu

SEQ ID NO: 439642 - RNA, 64 nt, Human
ccuguugcuggccagagacugccuggucgccagcgcucaccaugggugccaggaugcuucgcag

SEQ ID NO: 439643 - RNA, 64 nt, Human
ucaaggcccuuacacccuugucccacccccagcagcucaccauggcuuuaaaacaugcugucuu

SEQ ID NO: 439644 - RNA, 64 nt, Human
agugaguacagcaagucucugcagugggggaucacgagcccacuucugagaugugacgagacuu

SEQ ID NO: 439645 - RNA, 64 nt, Human
agcaagcaccacaagaaagggaggguacgccaggcgagcccagggcacagaugcugagacagcc

SEQ ID NO: 439646 - RNA, 64 nt, Human
gaguuuaagcaggacagugugcgugcacgagcuccgagcccagcacagacaugccuggaacccc

SEQ ID NO: 439647 - RNA, 64 nt, Human
cauuguuugucauugagucuucucucagaaucagcgagcccagcuguaggguggggggcaggcu

SEQ ID NO: 439648 - RNA, 64 nt, Human
acgacccugacccggcccccuucaccccuucagccgagcccagaccuccccucuuccuggagcc

SEQ ID NO: 439649 - RNA, 64 nt, Human
cggaugcgcugaggcccggcucucccgcccugcacgagcccaggggcugagcguuccuaggcgg

SEQ ID NO: 439650 - RNA, 64 nt, Human
acuaugccaguucugaccucgcaucccccuaccccgagcccaugcagucugggaacaugccgcc

SEQ ID NO: 439651 - RNA, 64 nt, Human
gaaucccuagacccaucugaugaagaggcaucuucgagcccaaaggagucacgcuggcauauca

SEQ ID NO: 439652 - RNA, 64 nt, Human
ccugucuggguuccugaggccuggggguggcagacgagcccacggcgccguggucccagcagca

SEQ ID NO: 439653 - RNA, 64 nt, Human
gcccccgccaccuccccacuccagcagauaaggccgagcccacaccaucuggcccaggcuggcc

SEQ ID NO: 439654 - RNA, 64 nt, Human
acccucaucuuguccugagguguugagggugucacgagcccauucucauguuuacagggguugu

SEQ ID NO: 439655 - RNA, 64 nt, Human
guggaggcaacagggccaugugcugcccuguugccgagcccagcugugggcggcuccuggugcu

SEQ ID NO: 439656 - RNA, 64 nt, Human
cggaggcgguggcagacuagagucugagaugccccgagcccaggcagcuauuucagccuccugu

SEQ ID NO: 439657 - RNA, 64 nt, Human
augugucugaucuuacugugauguuuuacuguaccgagcccaauguggguccaucucaucagcc

SEQ ID NO: 439658 - RNA, 64 nt, Human
ucagaguguaaucgcauuucugcuugguagaggccgagcccagcaaagguggcuccuucugaau

SEQ ID NO: 439659 - RNA, 64 nt, Human
guucccacgugucccggggcuuuuccaggaagcccgagcccaggaccuguuggcagaguugcca

SEQ ID NO: 439660 - RNA, 64 nt, Human
acacauccucccugaggcaccugcaccugcucuagcucaccauccaugcacacaccuccuucca

SEQ ID NO: 439661 - RNA, 64 nt, Human
ucugaaagaggugcagucacucacaccugcuugcgcucaccaucaauaaaaguaauuucacccg

SEQ ID NO: 439662 - RNA, 64 nt, Human
ccaaagguucaaaaguuuucaaauaacuguggcagcucaccaaaggugggggaaagcaugauua

SEQ ID NO: 439663 - RNA, 64 nt, Human
uagccagcaacuguguccccgcucagucuuugagcgagcccauuuuguggauuguguccuaugc

SEQ ID NO: 439664 - RNA, 64 nt, Human
ggcgcugggcuccuuccccugggcuguacugagccgagcccagggguuugcagagggugggggu

SEQ ID NO: 439665 - RNA, 64 nt, Human
guguacagcuggucuuuacuccaucggcagggcccgagcccagggaccagugacuuggccugga

SEQ ID NO: 439666 - RNA, 64 nt, Human
ccuggcugaggaaugcacucacagcaccccuuuccgagcccacguguggguuggaugcaucacg

SEQ ID NO: 439667 - RNA, 64 nt, Human
ucaucguucaagcagaaugcagacaggccauucacgagcccaaguugaagagaagagacgccca

SEQ ID NO: 439668 - RNA, 64 nt, Human
ccacccuggcccgccccucgcugcugcuacuacccgagcccagcuacauuccucagcugccaag

SEQ ID NO: 439669 - RNA, 64 nt, Human
augccagacuucccauuuuacuuucugcaagcuguuucccuagcagcucccucuaggggagagg

SEQ ID NO: 439670 - RNA, 64 nt, Human
ccuuugucugucuuccucauuuuguuccuuuuuuuuucccuaaaggggagucaaguucccuggg

SEQ ID NO: 439671 - RNA, 64 nt, Human
cacucagagcuauaugguuagacguuucuccccuuuucccuaccuuccaugguccugguuggcc

SEQ ID NO: 439672 - RNA, 64 nt, Human
guaguccuugccucuuccugcuccaguagggccuuuucccuaccccagccccugugccaggcua

SEQ ID NO: 439673 - RNA, 64 nt, Human
uugggccucuggccuuccuuacuuaaugucuucuuuucccuacucuaaugcauuucuaacucac

SEQ ID NO: 439674 - RNA, 64 nt, Human
agguggaaagaaaccuuagccagcguucaaucaagcucaccaugcagggcagucacccggcagu

SEQ ID NO: 439675 - RNA, 64 nt, Human
uuggcagggccccagccccucugaccacucugcagcucaccaugcagcugaugccaaaguugug

SEQ ID NO: 439676 - RNA, 64 nt, Human
gcaccacguaagaccuccugcccuuagcucucuugcucaccacccaagaaccucaggacagaag

SEQ ID NO: 439677 - RNA, 64 nt, Human
uaucacugaaauccuuaagguugaggaggcuuuauuucccuagcacuggugaagggcuucaacu

SEQ ID NO: 439678 - RNA, 64 nt, Human
cugcugaccccugugugacaucacagggccucaguuucccuaucugcaaaaugggaugauaugg

SEQ ID NO: 439679 - RNA, 64 nt, Human
cuuacuaauaauauucuauauguacuuuauguaauuucccuaaaaagaaugaacuaccacuaca

SEQ ID NO: 439680 - RNA, 64 nt, Human
uauagugagcugugggaacccagaacacacacguuuucccuacagcagaggccaugcaguauua

SEQ ID NO: 439681 - RNA, 64 nt, Human
gggcacagcuuccucucuuguccccacuacagguuuucccuacuaaacaaagguguuggagagc

SEQ ID NO: 439682 - RNA, 64 nt, Human
cccaaaguccucuacccccucacuuuuauggcccuuucccuagauauacugcgggaucucuccu

SEQ ID NO: 439683 - RNA, 64 nt, Human
cugcugugaaaacucccagagucucuuuagggauuuucccuaagguguaccaccaggcacaccu

SEQ ID NO: 439684 - RNA, 64 nt, Human
gucucaaaaaaagaaaaagaaaaagaaaaaauauuuucccuauuagagaagagauugugguuuc

SEQ ID NO: 439685 - RNA, 64 nt, Human
ugaucccccucauuugaugagcaaaugagcuacuuuucccuagacaccaggccagcucucucuu

SEQ ID NO: 439686 - RNA, 64 nt, Human
uaugaggagugcuagaaaaugcaaagugcaauauuuucccuaaccuucaaaugugggagcuugg

SEQ ID NO: 439687 - RNA, 64 nt, Human
cacaaaauugcuuuuuccaccucggaaaugcagcuuucccuagggggaggccuacaacaggacg

SEQ ID NO: 439688 - RNA, 64 nt, Human
ggauuauguggccuuagguagcugguuguacaucuuucccuaaaucgauccauguuaccacaua

SEQ ID NO: 439689 - RNA, 64 nt, Human
augccuuuuugugcccagacuguuuuccucucucuuucccuaaugugccauaaggccucagaau

SEQ ID NO: 439690 - RNA, 64 nt, Human
auucaaucucugauaauauuugagguaaaguuccuuucccuaucuugacucacugaguuauuag

SEQ ID NO: 439691 - RNA, 64 nt, Human
cucagcccugggaggggcgccugaacccagaacauuucccuaaccccaaccugguaggacucag

SEQ ID NO: 439692 - RNA, 64 nt, Human
guguccacaacauggcugggucuucagaccccuggcucaccaugugggugucuugggcaguuuc

SEQ ID NO: 439693 - RNA, 64 nt, Human
caguuacaagaaauuaccggagaaaagcuugugagcucaccaaacaaggauuucaguguagauu

SEQ ID NO: 439694 - RNA, 64 nt, Human
augugugauguugacgccuaacugaauuugaacagcucaccacugugccuacauuuaaaaauac

SEQ ID NO: 439695 - RNA, 64 nt, Human
aaaaugccaaaaaugauguaguuguuguugcuuuuuucccuauuuuccaccccagucgcuccuu

SEQ ID NO: 439696 - RNA, 64 nt, Human
gaaccuuggcugcaagggagucugggaaaugucauuucccuagaaggaaguuagggugggugga

SEQ ID NO: 439697 - RNA, 64 nt, Human
cuuuaaucuagccuaauuuauuuuuccccuuauauuucccuacccuacccuccccccaaaaaaa

SEQ ID NO: 439698 - RNA, 64 nt, Human
cacuccaaaccugaaguuuuuuugcugcugccucuuucccuaggaaacucacacuccccuaggg

SEQ ID NO: 439699 - RNA, 64 nt, Human
caggauuuccuucaaagaaaacgacuuuccuucauuucccuaagccuguggcccaaauggugga

SEQ ID NO: 439700 - RNA, 64 nt, Human
ucuacgaaggcccugagguucccaucaacccccauuucccuaggguccuggaggaaaaagcuuu

SEQ ID NO: 439701 - RNA, 64 nt, Human
uaaguauggauuauggaagucuaguaaauauacuuuucccuauuuuuguccuuuuucagucuuu

SEQ ID NO: 439702 - RNA, 64 nt, Human
cccucuuaggccccugggagaagagcagcuuagauuucccuacuggcaagguuuuuaaaaauga

SEQ ID NO: 439703 - RNA, 64 nt, Human
ucaagauaugaauugaaucgcugcgauacuggcauuucccuacuccccaacugaguucaagggc

SEQ ID NO: 439704 - RNA, 64 nt, Human
acacuuaaugacuggaaaaaacuugcuuauugccuuucccuauauaaauauuaauugucuagaa

SEQ ID NO: 439705 - RNA, 64 nt, Human
cuacaaauuaauguugguugucaaauguaguguguuucccuaacuuucuguuuuuccugagaaa

SEQ ID NO: 439706 - RNA, 64 nt, Human
ucucaccauuuaaacugaaggacccuauauuauauuucccuaacucugaagauguauauguagu

SEQ ID NO: 439707 - RNA, 64 nt, Human
ucccuccuugaaccagugaucuaaggaccccucuuuucccuaucugccuaacagugccucacaa

SEQ ID NO: 439708 - RNA, 64 nt, Human
uaaagaugcuucuugauauuuuacuuuuguuccuuuucccuaaucauucccuuuucuccccacu

SEQ ID NO: 439709 - RNA, 64 nt, Human
uuuuuuuuuuuuugagcucaaagagaguucucauuuucccuauucaaacuaauacccaugccgu

SEQ ID NO: 439710 - RNA, 64 nt, Human
ggcuguggccagugucccuuagccaaccugcugggcucaccaguuccccgucugaucugccugu

SEQ ID NO: 439711 - RNA, 64 nt, Human
uggacucagaggacagugcacaggcuagccuggagcucaccaggccuggggagcugggacgggg

SEQ ID NO: 439712 - RNA, 64 nt, Human
uguugccaggcuggagugcaguggcgcgaucucggcucaccacaaucgcugccuccuggguuca

SEQ ID NO: 439713 - RNA, 64 nt, Human
uucuucagguaaacacugacugcgcuuguuggauuuucccuauuuuugugacuucaagaauaau

SEQ ID NO: 439714 - RNA, 64 nt, Human
uggcaaggauguguagguaaacuugguucuuuuuuuucccuaagaugacagcuugauuuuauca

SEQ ID NO: 439715 - RNA, 64 nt, Human
aaguuauuaauuucuucacaccuacccuccuuuuuuucccuaucacugaagcuuuuuagugcau

SEQ ID NO: 439716 - RNA, 64 nt, Human
ccucucuguuucuccaucuccucgucuugacuguuuucccuacuugcugacuuaaccccccaua

SEQ ID NO: 439717 - RNA, 64 nt, Human
ccugaagaacacgcagugcuaaaacugaggaugauuucccuaaugcuucugcuuggccuuaugg

SEQ ID NO: 439718 - RNA, 64 nt, Human
ggacuuuuuguaugauuaagguucuuauuggacuuuucccuagguuuuuuuuuuuuguuauugu

SEQ ID NO: 439719 - RNA, 64 nt, Human
uagagccaccgccccauugcucaaccaguauuuauuucccuaaacgacccuuccucacauuccc

SEQ ID NO: 439720 - RNA, 64 nt, Human
cuuaauagaggcagagacuggggauauaccuuuguuucccuagcauuuuuauuuauuuauuuuu

SEQ ID NO: 439721 - RNA, 64 nt, Human
uuuggaauaacuuuugugaauuauuauaaugcaguuucccuaguaauauaguacuuuucauuug

SEQ ID NO: 439722 - RNA, 64 nt, Human
agugaagauaugcaguaagagcuaccuuaaagacuuucccuagacaaagguuaaguuauuuuuu

SEQ ID NO: 439723 - RNA, 64 nt, Human
ucugaagccucuguuguggcucucacaacucaucuuucccuaagucaucaagcuccacaucacu

SEQ ID NO: 439724 - RNA, 64 nt, Human
uugaaaauuguuuugugcuguacuuuaugacuuguuucccuauggugguaaagaaugaugccau

SEQ ID NO: 439725 - RNA, 64 nt, Human
uuucacuagaauaauggcaaauacuucuaauuuuuuucccuaaacauuuuuaaaagugaaauau

SEQ ID NO: 439726 - RNA, 64 nt, Human
uuuuuuaaauggaagacuguucuaaaaucacuuuuuucccuaauccaauuuuuagaguggcuag

SEQ ID NO: 439727 - RNA, 64 nt, Human
agaacauccuccaauuccacagucucugggagacuuucccuaagaggcgacuuccucuccagcc

SEQ ID NO: 439728 - RNA, 64 nt, Human
gccacccccuuucauuucggccuaggcuuccccugcucaccacugaggccuaauacaagaguuc

SEQ ID NO: 439729 - RNA, 64 nt, Human
cucugaagccacaaaaugacuuuagacuuccagggcucaccagaucaaccucuaaauaucuuug

SEQ ID NO: 439730 - RNA, 64 nt, Human
cucugucuauaccugccccaucugagcacccauugcucaccaucagaucaaccuuugauuuuac

SEQ ID NO: 439731 - RNA, 64 nt, Human
auuuuaugaaaaacucuucuacuuucaucuauucuuucccuagaggcaaacauuucuuaaaaug

SEQ ID NO: 439732 - RNA, 64 nt, Human
ccccacccacagcugagucugugaggccccauccuuucccuacguuuucucccaucuuuuuucc

SEQ ID NO: 439733 - RNA, 64 nt, Human
cgccugagcuauuucccuugcuagugugcagauauuucccuaacauguccuuuuuuguauuugu

SEQ ID NO: 439734 - RNA, 64 nt, Human
uuguuucuaauucguuucuagaaauguuugcuuauuucccuacuaaaauuuguaucugaucaaa

SEQ ID NO: 439735 - RNA, 64 nt, Human
auuagugaauaucuuaugaauuaaggcauuccucuuucccuaaccccgauggcuccauucccaa

SEQ ID NO: 439736 - RNA, 64 nt, Human
caugcuauaaaaagaacuguuccagaaucuuuuuuuucccuaauggacgaaggaacaacacaca

SEQ ID NO: 439737 - RNA, 64 nt, Human
aaaagccacaugugggacucaaaugcaaacagacuuucccuagaggugaaauaaccaacgugga

SEQ ID NO: 439738 - RNA, 64 nt, Human
uguaauaguuuggccauuaaauaucuugcccuauuuucccuauuacugcuaguaugcuacuucu

SEQ ID NO: 439739 - RNA, 64 nt, Human
ccaucauguugcuuaauugucuucugcagcuuccuuucccuagagcuuucccuguguugcuaag

SEQ ID NO: 439740 - RNA, 64 nt, Human
accuagugucaucauuucuucauucugcauauucuuucccuaggguuucuucccaacaccaaag

SEQ ID NO: 439741 - RNA, 64 nt, Human
gguggggcagggagcacaccccaggacccucacuuuucccuaaugaacacgcaugggcugaaau

SEQ ID NO: 439742 - RNA, 64 nt, Human
uaauauucucuuaaaagcuugaaaauaaaacuucuuucccuaccauuagugucccuuuccauau

SEQ ID NO: 439743 - RNA, 64 nt, Human
ugccaaagccucacugucacccuuucugccuugguuucccuagcugagccacgcugcccaugca

SEQ ID NO: 439744 - RNA, 64 nt, Human
gggguggcauuaggaacuuacgaaaccagagaccuuucccuaugacuuggcaguaugugaauau

SEQ ID NO: 439745 - RNA, 64 nt, Human
acuuuaggaacugaauuguaccuuuguccuguccuuucccuaggaggcacagacuucggguugg

SEQ ID NO: 439746 - RNA, 64 nt, Human
uucucucucucucuauaccaucugagcacccauugcucaccaucagaucaaccucugauuuuac

SEQ ID NO: 439747 - RNA, 64 nt, Human
agcagcucugugacucccccucuuucacuucauagcucaccaggacuguuuuauaaacugcugu

SEQ ID NO: 439748 - RNA, 64 nt, Human
uaggcuggggcucagagggccggagggacugaacgcucaccacccugacccuccuuccagagca

SEQ ID NO: 439749 - RNA, 64 nt, Human
ggcuguguccugcagugggaccuugggcaacuccuuucccuaugagaagcuggcucuucugagu

SEQ ID NO: 439750 - RNA, 64 nt, Human
gagaaccccuuuaaccucugcgggacagcaugucuuucccuauccaccuucgauucuuuucucu

SEQ ID NO: 439751 - RNA, 64 nt, Human
augcaaggugaaaccguuuguuuucccucuccauuuucccuaacuaaaugaaaaggacacauuc

SEQ ID NO: 439752 - RNA, 52 nt, Human
uugaggaccucuuugagugagcuuucccuaauucuuucuccuuucucuaaug

SEQ ID NO: 439753 - RNA, 64 nt, Human
aguuuauuuuggguucugauauguagcaugguauuuucccuaaggcagaacuuuaaaaauaaag

SEQ ID NO: 439754 - RNA, 64 nt, Human
cuuuaucacaaccaccguuacaaguauacuuauauuucccuaaaauacauuuaaaacuuaccua

SEQ ID NO: 439755 - RNA, 64 nt, Human
caaacgcuaacuaauauuuuuuuuaagagauucuuuucccuaugaaugugggaaaugcaggauu

SEQ ID NO: 439756 - RNA, 64 nt, Human
ucucagcaugaaagcauugcaugaguaaagauacuuucccuaacaccgggaggcgugagcaacu

SEQ ID NO: 439757 - RNA, 64 nt, Human
aauugcagcuuaaguuagggguauguagagguauuuucccuaaagcaaaauugggacacuguua

SEQ ID NO: 439758 - RNA, 64 nt, Human
uucucucugcuaaccuuccaccuuaugcacacacuuucccuauauuuuaagauaagucugcuag

SEQ ID NO: 439759 - RNA, 64 nt, Human
cuuggaucuacuuuuuuuuagccuuauuaauauuuuucccuauuagaaaccacaauuacucccu

SEQ ID NO: 439760 - RNA, 64 nt, Human
uguuacuuacccucuccugcgagacccaggggcuuuucccuacuguucccacgcuuccucucuc

SEQ ID NO: 439761 - RNA, 64 nt, Human
uugauccuggauaguuucucuuuaaaccuuugucuuucccuauuuuguuuaguagugaugaaag

SEQ ID NO: 439762 - RNA, 64 nt, Human
cuguuuuauaucucuuuuuuauaucucuuuggcguuucccuacagaaaagaaauuggacagaac

SEQ ID NO: 439763 - RNA, 64 nt, Human
uuagacuguaaaugaguucuucuuaacuuagcuguuucccuacuucugugacuucuguguuagc

SEQ ID NO: 439764 - RNA, 64 nt, Human; identical to SEQ ID NO: 439285

SEQ ID NO: 439765 - RNA, 64 nt, Human
ccacagggccuggcuggccacgcugucccggccugcucaccaucucagugaggggcaggagcug

SEQ ID NO: 439766 - RNA, 64 nt, Human
guugaguuaguuugugaaaauaaagaacucuguagcucaccaagguggagaaacgcaauucaga

SEQ ID NO: 439767 - RNA, 64 nt, Human
uggaagaaggauccugggcuugaugaccaugaaguuucccuauaaacccucaaccaccuauuca

SEQ ID NO: 439768 - RNA, 64 nt, Human
ugucaaauucccuccaacauuguuuaaaugugccuuucccuaaauuucuauuuuaauaacugua

SEQ ID NO: 439769 - RNA, 64 nt, Human
accagcuguuucagaucuauuaauguagggaauuuuucccuaagauugaauuccuauauuuacu

SEQ ID NO: 439770 - RNA, 64 nt, Human
gcuuuuuacaugauuuugaaauagacuagaaagcuuucccuauagacauauuaauauuccaauc

SEQ ID NO: 439771 - RNA, 64 nt, Human
uaucuagagguuagcagaaaaugaaaugaaggaauuucccuaagcaguugggaagaacaaauug

SEQ ID NO: 439772 - RNA, 64 nt, Human
aggcuaauggcaggaaauggucauauuugggguuuuucccuaauuuuuuuaaacaaaaauuaca

SEQ ID NO: 439773 - RNA, 64 nt, Human
cuccuuucuagccaguuugugguacuuccuucauuuucccuagaaauguuacuuguuaaaugug

SEQ ID NO: 439774 - RNA, 64 nt, Human
uuacuuuaaguucauugcuugcuucaaacuaagguuucccuaccuucaaaaauauauauaacau

SEQ ID NO: 439775 - RNA, 64 nt, Human
ccuggacauauuuuaagauucagcauuugaaagauuucccuagccucuuccuuuuucauuagcc

SEQ ID NO: 439776 - RNA, 64 nt, Human
ucuugcugauggcugcuagauuuuaauuuauuuguuucccuacuugauaauauuagugauucug

SEQ ID NO: 439777 - RNA, 64 nt, Human
uauagcuccuuuugaccuucauuucauguauaguuuucccuauugaaucaguuuccaauuauuu

SEQ ID NO: 439778 - RNA, 64 nt, Human
ugaaaccaguuuuuaucccuucucuuuccuucccuuucccuaaaucaaaucaauauuaauugug

SEQ ID NO: 439779 - RNA, 64 nt, Human
ugguuuaguccucauugccacuuuuguccuuauguuucccuagaacacguaccucagagacuuu

SEQ ID NO: 439780 - RNA, 64 nt, Human
agaagucaagaaauggguuguuuagcuugguuuguuucccuaacuucugauuaacucucuguau

SEQ ID NO: 439781 - RNA, 64 nt, Human
cagcacaggcuuagggcaguucagaacccacuuguuucccuaucagagggacacagugaagugg

SEQ ID NO: 439782 - RNA, 64 nt, Human
ggcggaaugguggugcccacgggguugggcaagggcucaccaggaccucaacgggcaaaguugu

SEQ ID NO: 439783 - RNA, 64 nt, Human
ccucugccuuuuacucccuaucaugucacucucugcucaccauccuuaucacaauguguauuug

SEQ ID NO: 439784 - RNA, 64 nt, Human
uugccuaggcauagcccugccucaagcuaugugagcucaccagucccuccccaaaugcuuucca

SEQ ID NO: 439785 - RNA, 64 nt, Human
aauguguucuggcuguuuuauacuucaacaauuuuuucccuaagugguaagcaauuacuuuaaa

SEQ ID NO: 439786 - RNA, 64 nt, Human
cugaggcaugagugacugugcauuugagaauaguuuucccuauucuguggauacagucccagag

SEQ ID NO: 439787 - RNA, 64 nt, Human
gcacauuggaaaaguaaaccauguuucauuccuuuuucccuauuuauauugaaagaaauaggcc

SEQ ID NO: 439788 - RNA, 64 nt, Human
guaauauagaauuaguggaacauuuugauuaaucuuucccuagaagugacugaaauauuuuugu

SEQ ID NO: 439789 - RNA, 64 nt, Human
ccagguagaaaagaaaugguauguagagcuuagauuucccuauugugacagagccauggugugu

SEQ ID NO: 439790 - RNA, 64 nt, Human
uuaacuacugcucaagauauggaaguggauuguuuuucccuaaucuuccgucaaguacacaaag

SEQ ID NO: 439791 - RNA, 64 nt, Human
gggaagacauuauagagcaugaagucaccauaauuuucccuaaagcaugcuuauugacaauuga

SEQ ID NO: 439792 - RNA, 64 nt, Human
ccagaguaccuccuguguggaagggucccuggauuuucccuaacacccacccucucccccuuca

SEQ ID NO: 439793 - RNA, 64 nt, Human
gaucaguugcucucuguucaagucauuccacacauuucccuauuuuaggcuauuauaauauaga

SEQ ID NO: 439794 - RNA, 64 nt, Human
ucuggcuguccuuuuuauaaugcagagugagaacuuucccuaccguguuugauaaauguugucc

SEQ ID NO: 439795 - RNA, 64 nt, Human
gcuuucaggggagaaggaggccacuggaaaauuauuucccuaagugcaggcuguugacugcgua

SEQ ID NO: 439796 - RNA, 64 nt, Human
guuugcauuuaggauugugcuauguucuuccuucuuucccuacuuccccugucccucuucuuug

SEQ ID NO: 439797 - RNA, 64 nt, Human
acucucuagcuuaaguguaaaugaaguacaguaguuucccuacugaacccugccucuugugucc

SEQ ID NO: 439798 - RNA, 64 nt, Human
aaaucuccaagaagcaccucuauuuuauacaucauuucccuaauuuauuuuaauauggauuucu

SEQ ID NO: 439799 - RNA, 64 nt, Human
aaagaaaaaaaaaacccuaaaaccaaaaacuccuuuucccuaggaagucaaaaaugcugugauu

SEQ ID NO: 439800 - RNA, 64 nt, Human
acuuauucaaaauacagugauagaaguucagaaagcucaccaaggucaaggagcagaucuucua

SEQ ID NO: 439801 - RNA, 64 nt, Human
augugacuccagagccaguuauuaggaagagcaagcucaccacagaggaguggaacugaggccc

SEQ ID NO: 439802 - RNA, 64 nt, Human
gacaaaagccagcauacuuucccugcacccaucugcucaccagaucucaggcaggaaagccccu

SEQ ID NO: 439803 - RNA, 64 nt, Human
gaggggaggcuacauuucacaacccucuucccuauuucccuaaaaguaucuccauggaaugaac

SEQ ID NO: 439804 - RNA, 64 nt, Human
uuuaacaguuucacagcaggacacugagggaauauuucccuaucccuucaaauggacggucacu

SEQ ID NO: 439805 - RNA, 64 nt, Human
uucuuugggucuucauuugaugcauugacuuuaauuucccuauacaggaaaugauuggaauaga

SEQ ID NO: 439806 - RNA, 64 nt, Human
ucgaucuaccuugucugucagaguugaauaucucuuucccuaucaugcugcuucugaaaauuca

SEQ ID NO: 439807 - RNA, 64 nt, Human
uuggagcgaauuuagaaccucagcccuaucuccauuucccuaucuggcucuuucucucuugucc

SEQ ID NO: 439808 - RNA, 64 nt, Human
aacugccuccguuuccacacugugcaccuuucacuuucccuacccagcuuuccuacaugcugcc

SEQ ID NO: 439809 - RNA, 64 nt, Human
cgucauagaggaccaccuuuuggaucauaaauucuuucccuauaacauuccuucucugccucuc

SEQ ID NO: 439810 - RNA, 64 nt, Human
gccagcuuucuugucuauacagauccucucuuucuuucccuacgucugccuggggucuacucca

SEQ ID NO: 439811 - RNA, 64 nt, Human
aggugaauggaaauuaaugaauaaacauuuugaguuucccuaguguugaaggaagguguacuuu

SEQ ID NO: 439812 - RNA, 64 nt, Human
ugcacugcaaccauuguuuccccuagugcccucuuuucccuagggcauugcucuccuauuccca

SEQ ID NO: 439813 - RNA, 64 nt, Human
cacucagucucucauuugguaaacagaaagcuguuuucccuacaaggugcuugguggugaagcc

SEQ ID NO: 439814 - RNA, 64 nt, Human
uucacuuugugagcaaaguaaccccauaaguuuauuucccuauuucaugguauuguuuaaacuu

SEQ ID NO: 439815 - RNA, 64 nt, Human
acauuuuauggugccuaguauugacaaaauguuauuucccuacauuaaacaugacuccauagac

SEQ ID NO: 439816 - RNA, 64 nt, Human
uggggaggagcuccacuugcagggacuccuuuuauuucccuaagaaagagcugaaaugacugag

SEQ ID NO: 439817 - RNA, 64 nt, Human
agcuauggugcacucccaacaugguauccuguccuuucccuaaacaaauugcugcugcuuuuaa

SEQ ID NO: 439818 - RNA, 64 nt, Human
uccucuccugguuacuucaucacaaucuacauaggcucaccagcuagaaacauuuaugagcuua

SEQ ID NO: 439819 - RNA, 64 nt, Human
ugcaggaugggccgcgccgccguggcccgcuguggcucaccacggcccaggguggccuuggugg

SEQ ID NO: 439820 - RNA, 64 nt, Human
ccucuccauccugugcuucuguggcccccagcaagcucaccaccuccuuggaggagagagacau

SEQ ID NO: 439821 - RNA, 64 nt, Human
ggacguauucagagaguguuuguaguucaugguuuuucccuaccugcccgguuccuuuccugag

SEQ ID NO: 439822 - RNA, 64 nt, Human
acuguagcaagcuucagaaauaaaucuuuugaucuuucccuaucuugauuagauccaaagucaa

SEQ ID NO: 439823 - RNA, 64 nt, Human
gcaaaagaaucagugagguuaaaguaguggaaguuuucccuaugagccuacagucuguauuguu

SEQ ID NO: 439824 - RNA, 64 nt, Human
ucuaaccccuaaggaagugcagucuuugauuugauuucccuaguaaccuugcagauauguuuaa

SEQ ID NO: 439825 - RNA, 64 nt, Human
uuuagauuaaaaaaaaaucagaauuaugcuuaacuuucccuacaaagaaaguagaauguaaaau

SEQ ID NO: 439826 - RNA, 64 nt, Human
ugaaaugaaauugaagaauucauucaaaugcucuuuucccuauaaccucuuuucucaccaaaaa

SEQ ID NO: 439827 - RNA, 64 nt, Human
uaauucaggggcuguggauaggauuguuccucuguuucccuaaucauucaucuguucaugucuc

SEQ ID NO: 439828 - RNA, 64 nt, Human
ucaggauaauuuucuauguuggucaacuuuucguuuucccuaacucacccaguuuaguuuggga

SEQ ID NO: 439829 - RNA, 64 nt, Human
ccaggcacccaucucaaggaguggcugggagucuuuucccuaacuuguggggacaccaccaguu

SEQ ID NO: 439830 - RNA, 64 nt, Human
cgucuccaggacccagagcuguuccugcuuugaguuucccuagagcugugcggccagauagcug

SEQ ID NO: 439831 - RNA, 64 nt, Human
guauccugccaugauguuaucuccuuuuucuacuuuucccuagagucccaugcaugauaaagag

SEQ ID NO: 439832 - RNA, 64 nt, Human
guuauuuuuuaagauuagccauucucugcugcuauuucccuacauaaugucaauuuuuaaccau

SEQ ID NO: 439833 - RNA, 64 nt, Human
guugaugggcaccaugcuuucucaugaaguagcauuucccuaccaucaagccauuguuuugugc

SEQ ID NO: 439834 - RNA, 64 nt, Human
cuugaauauuuuuauauuucaccuccuccccaccuuucccuaagcaaaguuuaaacgcagauag

SEQ ID NO: 439835 - RNA, 64 nt, Human
acugcauggauucuucuaaaaaguaugucacuuauuucccuaccuuauuaagacuaaauaagug

SEQ ID NO: 439836 - RNA, 64 nt, Human
uaaagugcaauaaaggcauugauaaguucuguuagcucaccauagcacuuguaaaucaggaauu

SEQ ID NO: 439837 - RNA, 64 nt, Human
uucugcugggcaccaccaccugccugagggccuagcucaccacagcacauccuccaggaucuag

SEQ ID NO: 439838 - RNA, 64 nt, Human
gugggaggguuggcaccugcacacuccaucuccugcucaccaccugccucuaaucugagcugca

SEQ ID NO: 439839 - RNA, 64 nt, Human
uguacaucacaauaauauauaauucagucucuaguuucccuagagucauuuuugaaaccacuga

SEQ ID NO: 439840 - RNA, 64 nt, Human
aauauuugauuuaaaaacauauauuaauagauguuuucccuagcagacuuuuggagcaaaaaua

SEQ ID NO: 439841 - RNA, 64 nt, Human
uguagcuggucagccugcuucugcccccuccugauuucccuaaggagccugggaugauguuggu

SEQ ID NO: 439842 - RNA, 64 nt, Human
uuaauguauuaaugauuaccuuaaaauuaucugcuuucccuacucuuaauuuuucuuauuguua

SEQ ID NO: 439843 - RNA, 64 nt, Human
ggcuucaggaggugcccgcuggccacagccagguuuucccuaagaagauguuauuuuguugggu

SEQ ID NO: 439844 - RNA, 64 nt, Human
cuaaacaaaacuaaguuaaaugaacauuuaaaaguuucccuagcgggccauuccuuagcaaaau

SEQ ID NO: 439845 - RNA, 64 nt, Human
uauuauuauuauuauuauuauucacaacagacacuuucccuaagaaucucaaacugauuuuuaa

SEQ ID NO: 439846 - RNA, 64 nt, Human
acccuccaagaccgccccagggguuggcccaugcuuucccuaacugugcaaaaaugguuuggga

SEQ ID NO: 439847 - RNA, 64 nt, Human
auucuuguaagcacuggacugucuucaucaaguauuucccuacagaacuccucaagaaaacaga

SEQ ID NO: 439848 - RNA, 64 nt, Human
cacuuaagagaugggauuacaaguggacccugacuuucccuaaggacuuccacuuuguucaaga

SEQ ID NO: 439849 - RNA, 64 nt, Human
caucuuuacaucauagguucccaagcaacauagauuucccuaucuuucaggaaacagcaucaag

SEQ ID NO: 439850 - RNA, 64 nt, Human
uccucucugcaaagcugcuggcuuagcuugacuguuucccuauuccucuccuuagaacuuucau

SEQ ID NO: 439851 - RNA, 64 nt, Human
cuaaguucuugaccucaguaauuuuauuuuuguuuuucccuaaauguuucccuacuagucuuuu

SEQ ID NO: 439852 - RNA, 64 nt, Human
ccucaguaauuuuauuuuuguuuuucccuaaauguuucccuacuagucuuuuuggaaaacaugu

SEQ ID NO: 439853 - RNA, 64 nt, Human
gggagcaucagagaaggccaggaagaaugguguguuucccuagacucuguaaccaccucucugu

SEQ ID NO: 439854 - RNA, 64 nt, Human
aaaacuucuagguaauuugccacgcuuuuugacugcucaccaauacccuguaaaaauacguaau

SEQ ID NO: 439855 - RNA, 64 nt, Human
uauggccauugauaguucucauguaauuaguuuugcucaccacuaguacagaugacccguuuac

SEQ ID NO: 439856 - RNA, 64 nt, Human
guugcccaggcuggaguacaauggugcaaucucagcucaccacaaccucugccucccggguuca

SEQ ID NO: 439857 - RNA, 64 nt, Human
uugggcccugucuguccggacuucaacuccagccuuucccuauugcauccgacucgcucucugu

SEQ ID NO: 439858 - RNA, 64 nt, Human
ggggggaggggggggggggcaggguagguggggcuuucccuaauuuaucuucauguccagugag

SEQ ID NO: 439859 - RNA, 50 nt, Human
agaccguaaguggagccugauuucccuaaggacuucugguuugcucuuca

SEQ ID NO: 439860 - RNA, 64 nt, Human
ucuccuuucauauuucugggagacagaaaacauguuucccuacaccucuugcauuccauccuca

SEQ ID NO: 439861 - RNA, 64 nt, Human
caaugaucaaaucacugaaccaugucuccgcacauuucccuaaaaguacaauguuuagacugcu

SEQ ID NO: 439862 - RNA, 64 nt, Human
uaacucuucuauguuuauucuauucauuuguuccuuucccuaccauauuuuacacauguauuua

SEQ ID NO: 439863 - RNA, 64 nt, Human
uuuuuauuagcaguaguucuguuguccaucauguuuucccuaugagcaccccuaugcccacucu

SEQ ID NO: 439864 - RNA, 64 nt, Human
auucuuuuuugcuccucaguagauaagguguauuuuucccuaucugguuucuuucaauacuuuu

SEQ ID NO: 439865 - RNA, 64 nt, Human
cuaguuguuuuuuuucccccaagacaaaggcaaguuucccuaaguuugaguugauaguuauuaa

SEQ ID NO: 439866 - RNA, 64 nt, Human
gaaauggaaggaguucaauuuuuucuuguucuacuuucccuauucuuauggagguaaaaggaaa

SEQ ID NO: 439867 - RNA, 64 nt, Human
aaaugagggcagaggcuguggcugcaggcagacuuuucccuaccucugucauuagcaaugguug

SEQ ID NO: 439868 - RNA, 64 nt, Human
uuuucaguaaugauguauacauuguauugauuuuuuucccuaaauguguuauuuuaauaaauau

SEQ ID NO: 439869 - RNA, 64 nt, Human
ugaauucuaucuuaaaauuugcaaugaagagccuuuucccuaaauuaucccauuauguaauucu

SEQ ID NO: 439870 - RNA, 64 nt, Human
cuguggaaaaagacaaaacucauuaguagacauguuucccuauugcuuucauaggcaccaguca

SEQ ID NO: 439871 - RNA, 64 nt, Human
uucuaacaaggauguaacacagaauuggcuuuuuuuucccuagaaaaagauuguuuguuucuau

SEQ ID NO: 439872 - RNA, 64 nt, Human
cacaugauuuucuuuuguuuucuucauuucucuugcucaccaagaaguaacaaaaguauaguuu

SEQ ID NO: 439873 - RNA, 64 nt, Human
uucuuaugauugucuuguugauuaaauuguucaugcucaccaccaccaauaagguauuuuucuc

SEQ ID NO: 439874 - RNA, 64 nt, Human
cuccugccgcagggggcccugcacacugaugucagcucaccagucucuucccugacagggcagc

SEQ ID NO: 439875 - RNA, 64 nt, Human
auauucuugcuuucacaaauauaguugaacaagauuucccuaaaaauuccaccaggauuaaucu

SEQ ID NO: 439876 - RNA, 64 nt, Human
aaaaugccaugggcugcagucuucuuccaucacuuuucccuaccagguccauuaauaugcuuau

SEQ ID NO: 439877 - RNA, 64 nt, Human
aaauuguacaagauaaguuccaccugguaaugucuuucccuaauacaggguugcgcuugcauug

SEQ ID NO: 439878 - RNA, 64 nt, Human
ucaagaugaauuuaaaagucaacccuucacacaguuucccuacuguauguagaauccaggugcu

SEQ ID NO: 439879 - RNA, 64 nt, Human
uaaaacaaguggauguggugaccauccacuuguguuucccuaaugaugggcaguuggccagggc

SEQ ID NO: 439880 - RNA, 64 nt, Human
uagacaguauugccaccucuggccaaauaugcacuuucccuagaaagccauauuccagcaguga

SEQ ID NO: 439881 - RNA, 64 nt, Human
aaagagucucaaauggacaacuguccuguguugcuuucccuaggccuucagcagccuauuggcu

SEQ ID NO: 439882 - RNA, 64 nt, Human
uucugcaauaucucugaggugcaaagaaugcacuuuucccuauggggcccagaguuugccuuuu

SEQ ID NO: 439883 - RNA, 64 nt, Human
cuugaccaaguaugacaaccucuuugagacguccuuucccuacuccaugggcuggcauggugag

SEQ ID NO: 439884 - RNA, 64 nt, Human
uacuuagcuaauuuagcaguaauuggcccaguuuuuucccuaauagaaauacuuuuagauuuga

SEQ ID NO: 439885 - RNA, 64 nt, Human
uguauuuucugaugcuaucagacucuaauguuuuuuucccuaaaauauuauugccaucaugcuu

SEQ ID NO: 439886 - RNA, 64 nt, Human
augaaugacugccuucaagucucaagaaaacacuuuucccuaacuuuuagagauauuucagccc

SEQ ID NO: 439887 - RNA, 64 nt, Human
agggacggccuuuucucuuagagcagcugauaaguuucccuaccugauggcccccucugacaua

SEQ ID NO: 439888 - RNA, 64 nt, Human
auucuuugaagaaaggaagggauuaaauaauuuuuuucccuaacacuuucuugaaggucagggg

SEQ ID NO: 439889 - RNA, 64 nt, Human
cuacagccucaguagguagacacaaacauaaagauuucccuagaagacauagagugggauuuga

SEQ ID NO: 439890 - RNA, 64 nt, Human
ugucgggccuccgauuucauccucagcacguaaugcucaccaacagcacuugcacugaguugac

SEQ ID NO: 439891 - RNA, 64 nt, Human
ccaaccaacugcaaccaugaucugguacaggcaugcucaccagcccagcccagcccagcugucc

SEQ ID NO: 439892 - RNA, 64 nt, Human
gcucaggcaguaaugcucacucaccugccucucagcucaccaacuguguggcccgauuccuaac

SEQ ID NO: 439893 - RNA, 64 nt, Human
ccuucuguccccaggcaucaucccaacagcucauuuucccuaguccgccuucguucaaggguca

SEQ ID NO: 439894 - RNA, 64 nt, Human
aaguaacuuugagaggacaagauaggcaaaguuuuuucccuacaucucuuuuggccaaaagaau

SEQ ID NO: 439895 - RNA, 64 nt, Human
ccucccuacucucccugccgaggcguccauagcauuucccuaauaaauaguuuuaucagggaca

SEQ ID NO: 439896 - RNA, 64 nt, Human
cccaagggccaagggucaggggccggguccacucuuucccuaggcugagcaccucuaggcccuc

SEQ ID NO: 439897 - RNA, 64 nt, Human
ggaguguguacuuguagagagugacaagguauuguuucccuaugugcuguuugagcaguauuuu

SEQ ID NO: 439898 - RNA, 64 nt, Human
cacguuauaaucugcuuauuuuacaauauacacguuucccuaagaaaucauggcagagauguga

SEQ ID NO: 439899 - RNA, 64 nt, Human
auacuuauucccauuuuuaagcauuugcuucuguuuucccuaccuagaaugucagauguuuuuc

SEQ ID NO: 439900 - RNA, 64 nt, Human
auuuguuagcuuugaugaaagcuauguugguaucuuucccuaaucaucaaaguaaauaaaaaau

SEQ ID NO: 439901 - RNA, 64 nt, Human
gagaaacugagagcucucucauuccaggaagccuuuucccuaguggaacauucagugcagaagu

SEQ ID NO: 439902 - RNA, 64 nt, Human
ccacaccugguuuggagagucuuaauuaaggaaauuucccuaauguucauuuauuuucuaaauc

SEQ ID NO: 439903 - RNA, 64 nt, Human
ggugggucccaccaggacaguagggaaacaguuguuucccuagccauuuccgaauagcccauca

SEQ ID NO: 439904 - RNA, 64 nt, Human
ggcaccgccggcuugcgccgagcugagugccggguuucccuauuccaauccuguuugaaauggu

SEQ ID NO: 439905 - RNA, 64 nt, Human
gcaugaauuuuaguaaacuuuaaaaaauagauuuuuucccuaagaaagaauguuuguagaauuu

SEQ ID NO: 439906 - RNA, 64 nt, Human
ugguuguguuguuuaccguaaguacugaggguaguuucccuaagucuguccugagaaaaagcau

SEQ ID NO: 439907 - RNA, 64 nt, Human
accuuuuucuaguucuugaauaaauauagccugcuuucccuagaugcauuuguguaggaaguau

SEQ ID NO: 439908 - RNA, 64 nt, Human
uccaacugcaucaacuaacucucggggguguucugcucaccacaccguccuucgguucuuacug

SEQ ID NO: 439909 - RNA, 64 nt, Human
guugcccagacuggaguacaaugaugcgaucucagcucaccacaacuucggccuccuggguuca

SEQ ID NO: 439910 - RNA, 64 nt, Human
cguguuguuugaaagugccgaacaguuuagaccagcucaccaauggcuaaugugguccauuuua

SEQ ID NO: 439911 - RNA, 64 nt, Human
uucccuagaugcauuuguguaggaaguauauacauuucccuauuacucucaucagcugaagaau

SEQ ID NO: 439912 - RNA, 64 nt, Human
ggugugaggggggucccagccuuucggucuucuauuucccuauuuccagugcuuuccagccggg

SEQ ID NO: 439913 - RNA, 64 nt, Human
aucaacauaaacagucuuuggauacuaaauaaacuuucccuaacaaguguccuagcuauguuau

SEQ ID NO: 439914 - RNA, 64 nt, Human
uacugccagagaaaaaaaucguauugaauggccauuucccuacuuauaagaugucucaaucuga

SEQ ID NO: 439915 - RNA, 64 nt, Human
aaggcuuuuuuauaauagcuucuuucaaacuguauuucccuauuaucucagacauuggaucagu

SEQ ID NO: 439916 - RNA, 64 nt, Human
uuauuuuuuaaaucauggucauaauuuuucuuuuuuucccuaagugaucaacaucaaauuuuua

SEQ ID NO: 439917 - RNA, 64 nt, Human
ucaauuuaaucuuaguguucccuugaaaacuuuuuuucccuacaaaauuuuaagugaaaaauac

SEQ ID NO: 439918 - RNA, 64 nt, Human
uuaauaacuaucuagguuucaauugucuuguaucuuucccuaauucuccaaacaguucaaucuc

SEQ ID NO: 439919 - RNA, 64 nt, Human
gaauauuccacgguuugggacagcauccggaaguuuucccuaugacuuuauauuuuguauuaug

SEQ ID NO: 439920 - RNA, 64 nt, Human
cugcaaagggcaaauuauaaugucauugauauaauuucccuaguagcauuuacccuguugcaug

SEQ ID NO: 439921 - RNA, 64 nt, Human
cucacacucgacaugaaaauucagaauuuuauacuuucccuacccucuagagaaauaagaucuu

SEQ ID NO: 439922 - RNA, 64 nt, Human
cuaugugaagaaaagaaaauaaucagauuucaguuuucccuaugagaaacucugaggcagccac

SEQ ID NO: 439923 - RNA, 64 nt, Human
accucuuuccaccaugauugccuccccuugcagcuuucccuacuccugccccaacugcaguagg

SEQ ID NO: 439924 - RNA, 64 nt, Human
aguagagguuuucuagcuucuacuaagauauuucuuucccuaaccaucauacacuuggcauguu

SEQ ID NO: 439925 - RNA, 64 nt, Human
cuucaaaagguggagaugcacuuuauuuaaugucuuucccuagcuaauucuuacucucaccuua

SEQ ID NO: 439926 - RNA, 64 nt, Human
cuacauguagaaugugaugucagaacucaaacaggcucaccaggcagugugcuuccuuccuugc

SEQ ID NO: 439927 - RNA, 64 nt, Human
ccaugucacgccauccaaugacaccagcuggucagcucaccacccccucuggcuaaaacucaag

SEQ ID NO: 439928 - RNA, 64 nt, Human
uucuugacagggcggagggauuucucuuuccugagcucaccaaacuuauuccaguguugaucgc

SEQ ID NO: 439929 - RNA, 64 nt, Human
cgaguuauucaaugauaacugacaaacuaaauuauuucccuagaaaggaagaugaaaggagugg

SEQ ID NO: 439930 - RNA, 64 nt, Human
ggagaauuaguuuucuaggcucauuggcauuuaguuucccuaggaaaggggucaaaacuucaag

SEQ ID NO: 439931 - RNA, 64 nt, Human
augccaagauuaaaaggugacagguagauguuaauuucccuagauugugaaagugaucacgaca

SEQ ID NO: 439932 - RNA, 64 nt, Human
caagggcccaggggacuggaggcaggaugguggcuuucccuaccugacacagccauggcccagc

SEQ ID NO: 439933 - RNA, 64 nt, Human
caugaggccaugaggcccgcuucauccuuuucuauuucccuagaaccuuaaugguagaaggaau

SEQ ID NO: 439934 - RNA, 64 nt, Human
cguuauguguggucuuuaaccuguugucauguuuuuucccuagauguacaacacugacucauca

SEQ ID NO: 439935 - RNA, 64 nt, Human
acagcgucugucgaacaaacagaggucuggugguuuucccuacuauccucccacucgagaguuc

SEQ ID NO: 439936 - RNA, 64 nt, Human
acaccugccagcaacuugggggaauaagcgaagguuucccuacaagagggaaagaaggcaaaaa

SEQ ID NO: 439937 - RNA, 64 nt, Human
ucuaaaaucuuauuccuccucuucuccccucacuuuucccuacuuccucugcaaaaagauuuaa

SEQ ID NO: 439938 - RNA, 64 nt, Human
gauuugcuucucuuuaauacuucaacauauugaauuucccuaggaaagugacuagcuauaauga

SEQ ID NO: 439939 - RNA, 64 nt, Human
uggacuguuuccugauaaccauaagaagacccuauuucccuagauucuauuuucugaacuuggg

SEQ ID NO: 439940 - RNA, 64 nt, Human
ugugaagugguuucaugaacucuaaggaauuuguuuucccuauccuaacucaguaacagagggu

SEQ ID NO: 439941 - RNA, 64 nt, Human
cccauguuucccuaaaccucuagccugauuguucuuucccuaauucauugcacaagcuccuuug

SEQ ID NO: 439942 - RNA, 64 nt, Human
cauuugacuuuucccuguuguuugaaaucccauguuucccuaaaccucuagccugauuguucuu

SEQ ID NO: 439943 - RNA, 64 nt, Human
guugaaacuuuuaguaaguugaguaagcuauuuuuuucccuacgguaauccacaaucuguucuu

SEQ ID NO: 439944 - RNA, 64 nt, Human
ccccacaaaauuccuguuacccgcugaacuccaagcucaccaaccagauucaugagcuuucuca

SEQ ID NO: 439945 - RNA, 64 nt, Human
aacacacaucauccccaccccucccccagcgugggcucaccauucuuaguccuuucucaagugg

SEQ ID NO: 439946 - RNA, 64 nt, Human
auccaccacccagcuucaccccucacccccagcggcucaccauggggauggcagcaauaaaaua

SEQ ID NO: 439947 - RNA, 64 nt, Human
ccaguaaccccuuuccugcuuuuuccugccucuguuucccuagcaaguguggaugaaucaaaug

SEQ ID NO: 439948 - RNA, 64 nt, Human
cucuccaccaucgucuucuuggccaugggaggccuuucccuaagccagcugcccccagagccac

SEQ ID NO: 439949 - RNA, 64 nt, Human
ggggcugccuggggaaugggacagagggauucucuuucccuaauuuuuuugguuguccuuuuuc

SEQ ID NO: 439950 - RNA, 64 nt, Human
uuuccuuucucuuuuuauuaucaauauugucauuuuucccuaauaaaauauacccaggugauua

SEQ ID NO: 439951 - RNA, 64 nt, Human
ccauguuuucuuguuuaucacacauacaaguaucuuucccuauauauuuguaccacuuuugaga

SEQ ID NO: 439952 - RNA, 64 nt, Human
guguguccaguaaugaagaacaucauauaaaaucuuucccuaaaucuaagccaguggccauuuu

SEQ ID NO: 439953 - RNA, 64 nt, Human
guggaaaaccagagagauguuuccacagcagccauuucccuacccuguuuccuaacuuaugcug

SEQ ID NO: 439954 - RNA, 64 nt, Human
aaggcaucugugugaugguuccauugaugugggauuucccuacuugcuguauucucaguuucua

SEQ ID NO: 439955 - RNA, 64 nt, Human
cccuuccucaccacuucccucagucccaacuccuuuucccuauuuccuucuccuccugucuuua

SEQ ID NO: 439956 - RNA, 64 nt, Human
uagucucuuucccucacuccuguagaguaauugcuuucccuaccccuuuaaucuuuauacuacu

SEQ ID NO: 439957 - RNA, 64 nt, Human
aaaauaccuuggucauuuuuuuuauauugccuuauuucccuauggcugagccuuguugugacac

SEQ ID NO: 439958 - RNA, 64 nt, Human
cuuucccugugugaauuuuguaucuagccuaaaguuucccuaggcuuucuugucucagcaacuu

SEQ ID NO: 439959 - RNA, 64 nt, Human
auuuuagauguguaguucaccuuacaacugcaauuuucccuaugugguuuuguaaagaacucuc

SEQ ID NO: 439960 - RNA, 64 nt, Human
gcacuggaugacagaaacugaauacauugcucccuuucccuagggcaaaguucgaccucuguua

SEQ ID NO: 439961 - RNA, 64 nt, Human
agcaguauuuuccuuuuccuagugcuaaaaucccuuucccuagaaauuggcucaccuugggaaa

SEQ ID NO: 439962 - RNA, 64 nt, Human
gcaucaucuugaacauuaauccacauguuucagagcucaccaggcaguaccaaugcucuuuuca

SEQ ID NO: 439963 - RNA, 64 nt, Human
ugccucagccucccgaguagcugggauuacaggugcucaccaccacacccagcuaauuuuugua

SEQ ID NO: 439964 - RNA, 64 nt, Human
ggaggacaagagaagggacacaccccugagagaugcucaccaagcuucuauuuaucuaauuuaa

SEQ ID NO: 439965 - RNA, 64 nt, Human
cugggggucucagggagaaccuuucacggcacccuuucccuaccuuuuccuucuuuaaucuccu

SEQ ID NO: 439966 - RNA, 64 nt, Human
gggauguguggcccagagguaagaauagaauuucuuucccuaaagaacauaccuuuuguagaug

SEQ ID NO: 439967 - RNA, 64 nt, Human
cacccuaacucuccuuccuuggcucaaacaauauuuucccuauaacaaaggcaauaggacacaa

SEQ ID NO: 439968 - RNA, 64 nt, Human
uuccugcuuuguguuccucucccagcuccaucucuuucccuagggaccaggcacucauauggcg

SEQ ID NO: 439969 - RNA, 64 nt, Human
ucucuacacuaagggguauguucccucuugucccuuucccuaccuuuauauuugggguccuuuu

SEQ ID NO: 439970 - RNA, 64 nt, Human
caaucauauaagaauguauagacaagcugacauauuucccuaaggcuaacaacacccugcugaa

SEQ ID NO: 439971 - RNA, 64 nt, Human
gucaauuaagaaagccccucucucuccagagccguuucccuagcuuuuggcaccuggaugccac

SEQ ID NO: 439972 - RNA, 64 nt, Human
aaacuugacaguggcucaugcugauuuaguucauuuucccuaaaagguuugucccaagaucugc

SEQ ID NO: 439973 - RNA, 64 nt, Human
uaugagaaucaaaaugauaaaaagagccugcuuuuuucccuaaccaauauagcuaucuuaagua

SEQ ID NO: 439974 - RNA, 64 nt, Human
uugggcucuagaaagucuugccucauugaguguuuuucccuagugcguaguuggagucuguccc

SEQ ID NO: 439975 - RNA, 64 nt, Human
cuaccccacgaaacugugacuuuccaaaugagccuuucccuagggcuagaccuaagaccaggaa

SEQ ID NO: 439976 - RNA, 64 nt, Human
uugcaucccaggagauuuauaaaguuuugauauuuuucccuacucuggaauuugaacuuucuuc

SEQ ID NO: 439977 - RNA, 64 nt, Human
uuuuugagcagaucuuggaaugaaugacaugaccuuucccuagagaauaaggaugaaauaauca

SEQ ID NO: 439978 - RNA, 64 nt, Human
caugaauuagggaacuucaaauagugcguagacuuuucccuacuuaccauuggguucaauugau

SEQ ID NO: 439979 - RNA, 64 nt, Human
cacaagggauucuuuuccuaguucuauguguuuguuucccuauaugcagucuuuaaaggauuac

SEQ ID NO: 439980 - RNA, 64 nt, Human
guugcccaggcuggagugugauggcucgaucuuggcucaccacaaccucugccuccuggguuca

SEQ ID NO: 439981 - RNA, 64 nt, Human
guaccccaggccugcucugggaagucggcuccaugcucaccagcagccgcccaggcccgcagcc

SEQ ID NO: 439982 - RNA, 64 nt, Human
agcacagcacccagacuucaugcgcccguggaaugcucaccacauguuggucgaagcggccgac

SEQ ID NO: 439983 - RNA, 64 nt, Human
gaacauuuaaguaucccgaauuuucuugaauugcuuucccuauagauuaauuacaauuggauuu

SEQ ID NO: 439984 - RNA, 64 nt, Human
cuuacaugaugcgguaacuugugacuugagucuuuuucccuaauuugcuagugggaagaaaaau

SEQ ID NO: 439985 - RNA, 64 nt, Human
acucuuuucuguagaauuugacggaacacagcuauuucccuaugcaagguacagccuuacaaag

SEQ ID NO: 439986 - RNA, 64 nt, Human
uccacugcgcuuacuccucugacccuccuucuauuuucccuacccugcaacuucuauccuuucu

SEQ ID NO: 439987 - RNA, 64 nt, Human
aucauuuugagcuuuggacucaauaucuuuaguguuucccuaaaucagauuuguaggucauguu

SEQ ID NO: 439988 - RNA, 64 nt, Human
uuucuucauuauuguugcuuuuaugugaguagcauuucccuaucuugcaguucuguuaacauga

SEQ ID NO: 439989 - RNA, 64 nt, Human
cccuaucauguuguuggcucaacuguuuuuuuuuuuucccuaauagagauggaguaucgcuaug

SEQ ID NO: 439990 - RNA, 64 nt, Human
auguguuugugaauguauguguaaaagucuuucuuuucccuaauuugcuuuggugggguccuua

SEQ ID NO: 439991 - RNA, 64 nt, Human
ucuuccaucagcucucugcaaagaugauuuugcuuuucccuagugcugguauacuauagagaaa

SEQ ID NO: 439992 - RNA, 64 nt, Human
ccuuauuugggaacaaaaauugcgaagacucaucuuucccuagaacucugaauggaugaauuuu

SEQ ID NO: 439993 - RNA, 64 nt, Human
acaagcccagccccgccucagggaaaacagggccuuucccuacaggacacgccccagagcugug

SEQ ID NO: 439994 - RNA, 64 nt, Human
caagaguauuacuuaauauuuuggccuccuaaaguuucccuaguuaguacucggacuccugugc

SEQ ID NO: 439995 - RNA, 64 nt, Human
gauuuucagcuaacuugcuucugcacagacccccuuucccuauaagggcacacauucacugguc

SEQ ID NO: 439996 - RNA, 64 nt, Human
guuaaugugaaagaaaggguguugcauuuuuacauuucccuaaugaucuugcuaauaaaugcua

SEQ ID NO: 439997 - RNA, 64 nt, Human
auucuaucaauucaaguauucuuacuaugguugcuuucccuauuuguucaauagacugauaaua

SEQ ID NO: 439998 - RNA, 64 nt, Human
gugcuccuccguguggacugugccucaggccagggcucaccagcugggguccuguccggaagga

SEQ ID NO: 439999 - RNA, 64 nt, Human
ggauggccuuuccuucccucucugaugucccagugcucaccagcccugcagcccaccagacguc

SEQ ID NO: 440000 - RNA, 64 nt, Human
gguugucaucagcuugucccauucaagccaccgagcucaccacagacacaguggagccgcgcuc

SEQ ID NO: 440001 - RNA, 64 nt, Human
uuuuaauuuuaggagguuuuuuuuuuuuuuuuuuuuucccuaaaugguauggccaaaagucaga

SEQ ID NO: 440002 - RNA, 64 nt, Human
uccuaaaggaucacaguuuuuaaaaggcaaacauuuucccuaaggaaacagacacaagcuuucc

SEQ ID NO: 440003 - RNA, 64 nt, Human
auuaacauuuucccaaauaaacacuuaauucucuuuucccuaggugccaucuccucaagcuaca

SEQ ID NO: 440004 - RNA, 64 nt, Human
agacaucuggggacacagccucaguacccagucuuuucccuaguuccugaaacuuuccuaggac

SEQ ID NO: 440005 - RNA, 64 nt, Human
gccuugccuagaccaggucacacugaugcccugguuucccuaucuguaaaauggggccaaugac

SEQ ID NO: 440006 - RNA, 64 nt, Human
aaggagugcuguggcuccccuugcccugccacccuuucccuagucuuuuguagauugcacuaau

SEQ ID NO: 440007 - RNA, 64 nt, Human
ucuuucuuuuuuacuuugcacaucaguguuagccuuucccuauuucagcacaaucuuagacuca

SEQ ID NO: 440008 - RNA, 64 nt, Human
cucagcuacaucauacacugacccagagcaaagcuuucccuaugguuccaaagacaacuaguau

SEQ ID NO: 440009 - RNA, 64 nt, Human
gaguuguuuaaaggccaagaacuggaaacagccuuuucccuauuuucuguguauuggggauggg

SEQ ID NO: 440010 - RNA, 64 nt, Human
cugacuucugcuucugaaaaaaugaaguagguguuuucccuauuccucccacuaaguacaguua

SEQ ID NO: 440011 - RNA, 64 nt, Human
cuccagaccuuuuucaaguugaauuuuuuuucuuuuucccuaugucuguucuuacguauuuuuu

SEQ ID NO: 440012 - RNA, 64 nt, Human
agcaucugguugcuuuuaagccaaguacaucuaguuucccuauuaaaaaugugucugaauagcg

SEQ ID NO: 440013 - RNA, 64 nt, Human
acaagccaaguuuucgcccugucuccugagaccauuucccuacgcuuugcugcugcugagaguu

SEQ ID NO: 440014 - RNA, 64 nt, Human
caaaaauuuacuuaacuucuuucuuuugauuuuuuuucccuaaaacuaaacaucaaucauugca

SEQ ID NO: 440015 - RNA, 64 nt, Human
uggaucccacgauguuagacauagccauaucuccuuucccuacaaaagaaaagcauacuguuaa

SEQ ID NO: 440016 - RNA, 64 nt, Human
auugcccaggcuggagugcgguggugcuauuucagcucaccacaaccucugccuccuggguuca

SEQ ID NO: 440017 - RNA, 64 nt, Human
ugacagauacugaauguauacguauugugccugagcucaccagcaaacagaagcaucaagccca

SEQ ID NO: 440018 - RNA, 64 nt, Human
guugcccaggcuggagugcaauggcgcgaucuuggcucaccauaaccuccgccucccagguuca

SEQ ID NO: 440019 - RNA, 64 nt, Human
ggaaguuaccuuuugaggaaaguuaaaguacuuuuuucccuaucuguaucuauagcaacaaccc

SEQ ID NO: 440020 - RNA, 64 nt, Human
uucuaggucagucccugcagacucuucucaacucuuucccuauaggaaacuuacuccgcguccu

SEQ ID NO: 440021 - RNA, 64 nt, Human
cuaagggucuaguuguucagaauccccaaggauauuucccuaaccucacucagucacauuguag

SEQ ID NO: 440022 - RNA, 64 nt, Human
ccuugcugggggccgcccuguacccucuuucaccuuucccuaaagacccuaaaucugaggaauc

SEQ ID NO: 440023 - RNA, 64 nt, Human
agucauuguccauuuacuauaauuuaucugaccauuucccuacuguaaaauacuuaagacgguu

SEQ ID NO: 440024 - RNA, 64 nt, Human
gcuccucuccccccucuuuucccaccaacuccuauuucccuaccaaccaaggagccuccagaag

SEQ ID NO: 440025 - RNA, 64 nt, Human
cucgggcgagucacugccucucccuggcccucaguuucccuaucucgaacauggaacucauucc

SEQ ID NO: 440026 - RNA, 64 nt, Human
accagagcaucgccaggauuucuaaugcacucaguuucccuacauagcagggauucuuagcuag

SEQ ID NO: 440027 - RNA, 64 nt, Human
cuuagaacauuuuaauucaucccaacugucuuuuuuucccuaccauucagugauuacugucaag

SEQ ID NO: 440028 - RNA, 64 nt, Human
uguguaacauuuaaaguagcauggaaccuacgucuuucccuacugcuugcuggcauauaucagu

SEQ ID NO: 440029 - RNA, 64 nt, Human
uuauagacuugauuucaaauucuuaaguucagccuuucccuaucaaucacaaaucauguauugg

SEQ ID NO: 440030 - RNA, 64 nt, Human
gugaggaaagaaggcuggagcugugagauucgcuuuucccuaggcuguuccgcguggguuaccu

SEQ ID NO: 440031 - RNA, 64 nt, Human
uauagcaaggcuccuguuuauuuauucuacuuucuuucccuaauaaucaaaacaccgcguaggc

SEQ ID NO: 440032 - RNA, 64 nt, Human
aggaugguuaagccauuggauaauacugaaucuguuucccuaagugacuuaaccuuagagcaag

SEQ ID NO: 440033 - RNA, 64 nt, Human
ucuuauacauggucuuauauuuuggcugucuguuuuucccuaggaacauucauacagguugaau

SEQ ID NO: 440034 - RNA, 64 nt, Human
aauauuggaccucugggagcuaauacuccucuuugcucaccaccaugugaucauugaucagaug

SEQ ID NO: 440035 - RNA, 64 nt, Human
agaaacccugauucaggucugcaggcuccugcgggcucaccaggcugcuggcuccgguaccaug

SEQ ID NO: 440036 - RNA, 64 nt, Human
uugugcggucagucagcaucacagacacauagaugcucaccagccuggcuuagcugggaccuaa

SEQ ID NO: 440037 - RNA, 64 nt, Human
ucuuauacauggucuuauauuuuggcugucuuuuuuucccuaggaacauucauacagguugaau

SEQ ID NO: 440038 - RNA, 64 nt, Human
ccccuaaauugcaagauaaggccauguguaagauuuucccuaaaacuagaauauauuaaugcau

SEQ ID NO: 440039 - RNA, 64 nt, Human
cugcuuuuuaaauugucacuauauauuaugagcauuucccuauaauauacaauauucuuccaca

SEQ ID NO: 440040 - RNA, 64 nt, Human
gaggcugauugacgacaucuacauuucagugcuuuuucccuaagcuguuugaaaguuacgcuuu

SEQ ID NO: 440041 - RNA, 64 nt, Human
cucccagaaauagauguuuuuuaaguuuucuuuuuuucccuacagggucacccucaggaucucu

SEQ ID NO: 440042 - RNA, 64 nt, Human
cccucggccucuuccuucguuccaggcccaugauuuucccuacacuucucccuggcccaggcuc

SEQ ID NO: 440043 - RNA, 64 nt, Human
gccugcuuucuccaagacagauuuucggaacacauuucccuacccuaaagcgacaucccaguag

SEQ ID NO: 440044 - RNA, 64 nt, Human
agauucacuggagcucaggauucauguguccuucuuucccuacucuaccuucuaccuuggucug

SEQ ID NO: 440045 - RNA, 64 nt, Human
caaaagugauuaucucuuugaucuacuugccucauuucccuaucuucucccccacgguauccua

SEQ ID NO: 440046 - RNA, 64 nt, Human
cuguaguuagcuuuucaucccuaaagaaggcuccuuucccuaaggaaccauagaagagaggaag

SEQ ID NO: 440047 - RNA, 64 nt, Human
cuccccguuucaguggacccuguggccaggugcuuuucccuauccacagggguguuugugugug

SEQ ID NO: 440048 - RNA, 64 nt, Human
augaguuuuaaaucuaaaucucauucccuucuucuuucccuaccuuuuuuuucuuuuuuucuua

SEQ ID NO: 440049 - RNA, 64 nt, Human
uugagccaacuauagcucuguguuccuacugggcuuucccuaaugugguugggaguuaugcccu

SEQ ID NO: 440050 - RNA, 64 nt, Human
auacaaaugcaucuucgaguucuuugggccucacuuucccuaucugaauaauaaggauaguaau

SEQ ID NO: 440051 - RNA, 64 nt, Human
ugcugccugaguauuacuaguggacguaggauauuuucccuaccuaagaauuucacugucuuuu

SEQ ID NO: 440052 - RNA, 64 nt, Human
auuggauccaggggaccugggcucauucuucuuggcucaccaacccugcaggccucaucuuucc

SEQ ID NO: 440053 - RNA, 64 nt, Human
agucucuacugauuaucuugcugcuuaaaggccugcucaccaaucuuucuuucacaccgugugg

SEQ ID NO: 440054 - RNA, 64 nt, Human
aaagggagggugacaugcuggcuuuugugcccaagcucaccagcccugcgccaccucacugcag

SEQ ID NO: 440055 - RNA, 64 nt, Human
agaaggaucuuuucccauggcuugacuuccuucauuucccuaacugaaauacacccacucucuu

SEQ ID NO: 440056 - RNA, 64 nt, Human
aaugaagaccuaagaaaaaaauauuucaugaucauuucccuaagccauuuccagaaugguaaaa

SEQ ID NO: 440057 - RNA, 64 nt, Human
ccaauccaugcuucacucaugcaaacugcuuuauuuucccuacuugcagcgccaaguggccacu

SEQ ID NO: 440058 - RNA, 64 nt, Human
gcuucugaccugaccaugcccagauggcauaacuuuucccuaggacccucagucuccuuguuuc

SEQ ID NO: 440059 - RNA, 64 nt, Human
caguguaccaacgaauucaccaaccagggguuucuuucccuacccuuugugaaaaccaaucaau

SEQ ID NO: 440060 - RNA, 64 nt, Human
agaagcaucugggccagggcucauggcuggauaauuucccuaggcuuaacaacccaagcaagcu

SEQ ID NO: 440061 - RNA, 64 nt, Human; identical to SEQ ID NO: 440060

SEQ ID NO: 440062 - RNA, 64 nt, Human; identical to SEQ ID NO: 440060

SEQ ID NO: 440063 - RNA, 64 nt, Human
cagucuuccuucaagacuagacucacugaggcauuuucccuaaaucaaccgguagcagauacuu

SEQ ID NO: 440064 - RNA, 64 nt, Human
ucugacccucuccaccccauagugaccggcugcuuuucccuaagccaagggccucuugcggucc

SEQ ID NO: 440065 - RNA, 64 nt, Human
aguuuaagaaguaauguucuuucuuucuuucucuuuucccuaccuccugcuaacccaaccagag

SEQ ID NO: 440066 - RNA, 64 nt, Human
uuccacagaaauccuguucguauccccauuuugauuucccuaaguuccuuguucucccucuaaa

SEQ ID NO: 440067 - RNA, 64 nt, Human
cauaacagguaucauuaacugccacuuuuuauguuuucccuagaauuuguagccuugcugcuug

SEQ ID NO: 440068 - RNA, 64 nt, Human
agaaugacauggggugggugucugguguguguguuuucccuacgcaccucccauagcuauuaac

SEQ ID NO: 440069 - RNA, 64 nt, Human
cuagguggcugggggaggcaggcucacuggccauuuucccuagaguccagcacacugcaggagg

SEQ ID NO: 440070 - RNA, 64 nt, Human
gucauuuuucuucaugggagaaacagcccacagagcucaccaacaaguacuccaaaacuaagua

SEQ ID NO: 440071 - RNA, 64 nt, Human
ucacacugcacacacucaccacccaggaugcucagcucaccagagcccugaccuccgagaaaug

SEQ ID NO: 440072 - RNA, 64 nt, Human
agaggggccucaucuuccccagcccuccccaccugcucaccaauuccacuuccugccccaacug

SEQ ID NO: 440073 - RNA, 64 nt, Human
aaaauguguccugucuaaaaaugauucucuaaacuuucccuauacuuaggcauagucuucuuuc

SEQ ID NO: 440074 - RNA, 64 nt, Human
gauggaacugugacaaaagccaaauaaacauccuuuucccuaacaaaguaaauugaauaggacu

SEQ ID NO: 440075 - RNA, 64 nt, Human
aaaauuuaaaauaugaaaugaugcagaauaguuuuuucccuauugacugucagaaaauccacug

SEQ ID NO: 440076 - RNA, 64 nt, Human
accagaaaguaacuucaaauguguauuaugauaauuucccuauuuauuagaagaguuggauaaa

SEQ ID NO: 440077 - RNA, 64 nt, Human
ugaagugaauuugaaaaagaaauguuacuuaaucuuucccuaagcccauggguuacagaaugcu

SEQ ID NO: 440078 - RNA, 64 nt, Human
gcuuggaccagcggguucuuguucgggaggcaaauuucccuaggaaaaagaagacagacuuuuc

SEQ ID NO: 440079 - RNA, 53 nt, Human
cccagcaggacagcaugugagcguuucccuaugggggugucuguacguaggag

SEQ ID NO: 440080 - RNA, 64 nt, Human
uggaguggggaguugggguucucauaccagcagauuucccuagagcgugauucucccaucugag

SEQ ID NO: 440081 - RNA, 64 nt, Human
cuagugucuauucccuggaauucacccucucauguuucccuacuaacaucccaauaaaguccuc

SEQ ID NO: 440082 - RNA, 64 nt, Human
accagccccgauauucacauagguucuuuucuauuuucccuaagugucagccaacuugagaaau

SEQ ID NO: 440083 - RNA, 64 nt, Human
gaucucccuggggaguggguccugggcuuggaucuuucccuagggggcccucuuacuccuuccu

SEQ ID NO: 440084 - RNA, 64 nt, Human
gcccccuugcagaccccacccccugccugcucucuuucccuacaacuaggucagcccccagccc

SEQ ID NO: 440085 - RNA, 64 nt, Human
aaauugggcuggauugugcuuugguuaauacaucuuucccuaaagaagauaaacacaaaaucca

SEQ ID NO: 440086 - RNA, 64 nt, Human
ucuuugcagauucagccuaaaagcaaagaaaauauuucccuaaaauauuugcaaauaauguuca

SEQ ID NO: 440087 - RNA, 64 nt, Human
agucuuuuguucauucaaaucuuggauuuuuuuuuuucccuaagagauucucuuuuuaggggga

SEQ ID NO: 440088 - RNA, 64 nt, Human
aaaaaacaaaaaccaguuuaggcuggguaugguggcucaccagcacuuugggaggcugaggcag

SEQ ID NO: 440089 - RNA, 64 nt, Human
ggaaaauaaccaguuaaaccagcuacucaaggcugcucaccauacggcucuaacagauuagggg

SEQ ID NO: 440090 - RNA, 64 nt, Human
aaccguagauguccuacaggguuaccguugugcugcucaccacagagcagcugaggcauuaugc

SEQ ID NO: 440091 - RNA, 64 nt, Human
ggaggacuuggagaugcaugcacauuuaggguguuuucccuagaauuacauaaugaaaaaaaga

SEQ ID NO: 440092 - RNA, 64 nt, Human
auggugacaaugucuguggguacuuuucucaggguuucccuacccugcccuagacccaaaagug

SEQ ID NO: 440093 - RNA, 64 nt, Human
guccuaaguuggaauucucccacugcccuaaaacuuucccuaguaguccuuuaaacuccccccu

SEQ ID NO: 440094 - RNA, 64 nt, Human
gugguaggaggagggggaguggaggggcauagccuuucccuaauucugccuuaaauaaaacugc

SEQ ID NO: 440095 - RNA, 64 nt, Human
aaacuuggccuuacagggcucuaguuaugguuacuuucccuagucaaugcucugaaaauguguc

SEQ ID NO: 440096 - RNA, 64 nt, Human
ugaaaacacuugccuuacaaggcucuaauuaugauuucccuagucagugcucugaagauguguc

SEQ ID NO: 440097 - RNA, 64 nt, Human
auuuguaaaugagcagaacuguuuuguugguuuuuuucccuaaauauaaaaguccacacuucgu

SEQ ID NO: 440098 - RNA, 64 nt, Human
uccaccucuaugacagaaacacaagaaaacugucuuucccuagcuucaguuccuugggugugga

SEQ ID NO: 440099 - RNA, 64 nt, Human
aggaagugcuggugcauauuuuugaguuaaaauauuucccuauuuuaucaugauuacuaaguga

SEQ ID NO: 440100 - RNA, 64 nt, Human
gcuccugucccccgcucuccuccacucccuugccuuucccuagguuguccccucccugggcuuu

SEQ ID NO: 440101 - RNA, 64 nt, Human
cuguggaaucaucuguccuugccuuugaauuagcuuucccuaggccaugagucaacauuaguag

SEQ ID NO: 440102 - RNA, 64 nt, Human
acuggaggcagauaguugcaaaguuagucuaagguuucccuagcuguauuuagccucugacuau

SEQ ID NO: 440103 - RNA, 64 nt, Human
gcucuuaagggguuuaggugugcagaagcuuuccuuucccuacccaguaaccaugugacuacua

SEQ ID NO: 440104 - RNA, 64 nt, Human
ucagauucgguuccaguuuuauucuuguugaguuuuucccuaugaaggcuccuuuugaaugugu

SEQ ID NO: 440105 - RNA, 64 nt, Human
auccaggaagguaaccuugggcauuggcaguggguuucccuauggcuuggauccagauuagaau

SEQ ID NO: 440106 - RNA, 64 nt, Human
augauaaucuuuuaaaggcucuacaauugaaugagcucaccauggaugaugauaccgccgugcu

SEQ ID NO: 440107 - RNA, 64 nt, Human
uugaauccuagcccaucugcagagcaaugacugugcucaccaguaaaagauaaccuuucuuucu

SEQ ID NO: 440108 - RNA, 64 nt, Human
agacaagccugggaagagaauguugaggugcagagcucaccagccaaguucaugccccucucgg

SEQ ID NO: 440109 - RNA, 64 nt, Human
cccacagggaccucaacuucugggcccgggauuuuuucccuauucagcagcauuuuaaucacau

SEQ ID NO: 440110 - RNA, 64 nt, Human
caccucuccuggguguggagacagcuugguucccuuucccuagcucccuggugggugaaugcca

SEQ ID NO: 440111 - RNA, 64 nt, Human
caggaguggguggggaguggggguggggguaggguuucccuacugaagcccuugugaaucaagg

SEQ ID NO: 440112 - RNA, 64 nt, Human
uaguuauuauuuacuggugcagaugguugacauuuuucccuauuuuccucacuuuauggaagag

SEQ ID NO: 440113 - RNA, 64 nt, Human
aagcuaaucauauuuaugucugucuuucucuacuuuucccuaauucccucuccuccugacuccu

SEQ ID NO: 440114 - RNA, 64 nt, Human
uugguuuucuccugucucuggccauuucuuccaguuucccuauuucagagucuucuccucucuc

SEQ ID NO: 440115 - RNA, 64 nt, Human
guaauauugaauuuccuuuggccgauaaucaggauuucccuauaagucacuuggacauugguca

SEQ ID NO: 440116 - RNA, 64 nt, Human
uaagauuguacuuuuaucuuaaaagggugguaguuuucccuaaaauacuuauuauguaaggguc

SEQ ID NO: 440117 - RNA, 64 nt, Human; identical to SEQ ID NO: 439732

SEQ ID NO: 440118 - RNA, 64 nt, Human
ucaggaguggugaugucugaugcucaauuacuauuuucccuauaagaguuucagcaugagcuua

SEQ ID NO: 440119 - RNA, 64 nt, Human
aaaaacccuccuccuugggauuuuuuuuuuuuguuuucccuaacaauuuggacacuacaauugc

SEQ ID NO: 440120 - RNA, 64 nt, Human
gagaaguuacguaacauuuacuccuuuguaaauguuucccuaucaucagacaaaacucaauaaa

SEQ ID NO: 440121 - RNA, 64 nt, Human
ccccuuaggggauagcucauuguuuuuauucagauuucccuaauuaguggugugugaacaucuu

SEQ ID NO: 440122 - RNA, 64 nt, Human
accucuucaggaguguccugauuauguccagaauuuucccuaaaggcagggauucuuaaccugg

SEQ ID NO: 440123 - RNA, 64 nt, Human
uauagagaaaggucuaugcagaaauagguuagaguuucccuaacaaaaaagcuaacccaggucc

SEQ ID NO: 440124 - RNA, 64 nt, Human
cugcagugugacagaagggagcaugagaagcauggcucaccagccagccucuguggucuuugua

SEQ ID NO: 440125 - RNA, 64 nt, Human
ugcuagauagucagcugcuguugcagguagaaaagcucaccaaugccacauuuguucauucugu

SEQ ID NO: 440126 - RNA, 64 nt, Human
ccuuuuuguagacucuuuucuauauauugcuuaggcucaccauagcgaauucuccaguguuaaa

SEQ ID NO: 440127 - RNA, 64 nt, Human
aaaauacaguaaaaucauaauacagaaacuaaaauuucccuagguuaugacgcuuuuuagcuaa

SEQ ID NO: 440128 - RNA, 64 nt, Human
uguuuccaggcauccuuuuaggacuguguaauaguuucccuagaagcuagguagggacugagga

SEQ ID NO: 440129 - RNA, 64 nt, Human
acagaaguguggaggggggcuccugacuagacaauuucccuagcccuugugauuugaagcauga

SEQ ID NO: 440130 - RNA, 64 nt, Human
aauauuuuguuauaaauacucacaggauaccuuauuucccuagcuaucaucuccugacuuaaug

SEQ ID NO: 440131 - RNA, 64 nt, Human
uauauaaucauugucaacccuuugaugagugauauuucccuauaccuauguacccagauagaua

SEQ ID NO: 440132 - RNA, 64 nt, Human
aaugcuccucuuaaccaguuguaacaucuuaccauuucccuaacaaauugaauuaguuuaauaa

SEQ ID NO: 440133 - RNA, 64 nt, Human
uaaauguuucucacauaucucacauauaauguaauuucccuaaaugaaguugucucuacuucug

SEQ ID NO: 440134 - RNA, 62 nt, Human
cucccaaaagaggucgguaauuuuagaauuaauuucccuaaagugaauggucauugucuaau

SEQ ID NO: 440135 - RNA, 64 nt, Human
agccucauucauucacuuagaagugguaauaauuuuucccuaaugauaccacuuuucuuuuccc

SEQ ID NO: 440136 - RNA, 64 nt, Human
acaucccucacuucucuuaagccaagaaguuugcuuucccuagcugcaguguagauggcucuug

SEQ ID NO: 440137 - RNA, 64 nt, Human
gauggaaauuguuuucugauguuacugguuuucuuuucccuauuagccaaagugacuaucucuu

SEQ ID NO: 440138 - RNA, 64 nt, Human
agcuacuuguguucucuucauuugucuguaaaaauuucccuaauugauuauauaguguaagaau

SEQ ID NO: 440139 - RNA, 52 nt, Human
auuccaccacuagaguauagcuuuucccuauuuccccuccuaucccucugcc

SEQ ID NO: 440140 - RNA, 64 nt, Human
ucuggaguaacaagccucaaauggugaauaauucuuucccuaacucugguccaccugcaaccua

SEQ ID NO: 440141 - RNA, 64 nt, Human
gugaauucagguuuaacuucaccuuaguuauggugcucaccaaacgaaggguaucagcuauuuu

SEQ ID NO: 440142 - RNA, 64 nt, Human
ccuguguuuguuauaaaguaguguuuaaaaggcagcucaccauuugcugguaacuuaaugugag

SEQ ID NO: 440143 - RNA, 64 nt, Human
gucaccaugggccggaugaguugugcuccuccuggcucaccauuucccccugcucccccacagc

SEQ ID NO: 440144 - RNA, 64 nt, Human; identical to SEQ ID NO: 364936

SEQ ID NO: 440145 - RNA, 64 nt, Human; identical to SEQ ID NO: 364937

SEQ ID NO: 440146 - RNA, 64 nt, Human; identical to SEQ ID NO: 364938

SEQ ID NO: 440147 - RNA, 64 nt, Human; identical to SEQ ID NO: 363320

SEQ ID NO: 440148 - RNA, 64 nt, Human; identical to SEQ ID NO: 363321

SEQ ID NO: 440149 - RNA, 64 nt, Human; identical to SEQ ID NO: 363158

SEQ ID NO: 440150 - RNA, 64 nt, Human; identical to SEQ ID NO: 363571

SEQ ID NO: 440151 - RNA, 64 nt, Human; identical to SEQ ID NO: 363572

SEQ ID NO: 440152 - RNA, 64 nt, Human; identical to SEQ ID NO: 364878

SEQ ID NO: 440153 - RNA, 64 nt, Human; identical to SEQ ID NO: 364879

SEQ ID NO: 440154 - RNA, 64 nt, Human; identical to SEQ ID NO: 363159

SEQ ID NO: 440155 - RNA, 64 nt, Human; identical to SEQ ID NO: 363586

SEQ ID NO: 440156 - RNA, 64 nt, Human; identical to SEQ ID NO: 363369

SEQ ID NO: 440157 - RNA, 64 nt, Human
uaguuacaucuuaagaucagguuuauaaaacuguggaguggagcgguaugguauggaaugacuu

SEQ ID NO: 440158 - RNA, 64 nt, Human
ugaacuacagauguuguaguggguuuuggaggagggaguggaguaagaugcccucccacuuuua

SEQ ID NO: 440159 - RNA, 64 nt, Human
ugagagcgggcgaugaugacaguggcggcuuuguggaguggagguggggggaagguggggaaaa

SEQ ID NO: 440160 - RNA, 56 nt, Human; identical to SEQ ID NO: 363370

SEQ ID NO: 440161 - RNA, 64 nt, Human; identical to SEQ ID NO: 363173

SEQ ID NO: 440162 - RNA, 64 nt, Human; identical to SEQ ID NO: 363636

SEQ ID NO: 440163 - RNA, 64 nt, Human; identical to SEQ ID NO: 363637

SEQ ID NO: 440164 - RNA, 64 nt, Human; identical to SEQ ID NO: 363287

SEQ ID NO: 440165 - RNA, 64 nt, Human; identical to SEQ ID NO: 363288

SEQ ID NO: 440166 - RNA, 64 nt, Human; identical to SEQ ID NO: 363174

SEQ ID NO: 440167 - RNA, 64 nt, Human; identical to SEQ ID NO: 363702

SEQ ID NO: 440168 - RNA, 64 nt, Human; identical to SEQ ID NO: 363703

SEQ ID NO: 440169 - RNA, 64 nt, Human; identical to SEQ ID NO: 363704

SEQ ID NO: 440170 - RNA, 64 nt, Human; identical to SEQ ID NO: 364918

SEQ ID NO: 440171 - RNA, 64 nt, Human; identical to SEQ ID NO: 364919

SEQ ID NO: 440172 - RNA, 64 nt, Human; identical to SEQ ID NO: 363175

SEQ ID NO: 440173 - RNA, 64 nt, Human; identical to SEQ ID NO: 364880

SEQ ID NO: 440174 - RNA, 64 nt, Human; identical to SEQ ID NO: 363619

SEQ ID NO: 440175 - RNA, 64 nt, Human; identical to SEQ ID NO: 363620

SEQ ID NO: 440176 - RNA, 64 nt, Human
acuugacugagaaguuaggguagaaaacaaaaagggaguggauucugggagccucuucccuuuc

SEQ ID NO: 440177 - RNA, 64 nt, Human
cuuuggagaaagcccagcuccugugugcucacugggaguggaaucccugucuccacaucugcuc

SEQ ID NO: 440178 - RNA, 64 nt, Human
agggaccaggucacugccccuggucucucuaggaggaguggacugaauggaucguugcagagaa

SEQ ID NO: 440179 - RNA, 64 nt, Human; identical to SEQ ID NO: 363189

SEQ ID NO: 440180 - RNA, 64 nt, Human; identical to SEQ ID NO: 363190

SEQ ID NO: 440181 - RNA, 64 nt, Human; identical to SEQ ID NO: 363191

SEQ ID NO: 440182 - RNA, 64 nt, Human; identical to SEQ ID NO: 363205

SEQ ID NO: 440183 - RNA, 64 nt, Human; identical to SEQ ID NO: 363206

SEQ ID NO: 440184 - RNA, 64 nt, Human; identical to SEQ ID NO: 363207

SEQ ID NO: 440185 - RNA, 64 nt, Human; identical to SEQ ID NO: 363336

SEQ ID NO: 440186 - RNA, 55 nt, Human; identical to SEQ ID NO: 363337

SEQ ID NO: 440187 - RNA, 64 nt, Human; identical to SEQ ID NO: 363338

SEQ ID NO: 440188 - RNA, 64 nt, Human; identical to SEQ ID NO: 363354

SEQ ID NO: 440189 - RNA, 64 nt, Human; identical to SEQ ID NO: 363355

SEQ ID NO: 440190 - RNA, 64 nt, Human; identical to SEQ ID NO: 363371

SEQ ID NO: 440191 - RNA, 64 nt, Human; identical to SEQ ID NO: 363385

SEQ ID NO: 440192 - RNA, 64 nt, Human; identical to SEQ ID NO: 363386

SEQ ID NO: 440193 - RNA, 64 nt, Human; identical to SEQ ID NO: 363387

SEQ ID NO: 440194 - RNA, 64 nt, Human; identical to SEQ ID NO: 363401

SEQ ID NO: 440195 - RNA, 64 nt, Human
cugggccaccuguccuuuuccgagggugugggugggaguggauccuccgggcgcaggugccagg

SEQ ID NO: 440196 - RNA, 64 nt, Human
cagaaccaggcugggagaagggcugggaaaacugggaguggaggguggauccucauggagcagg

SEQ ID NO: 440197 - RNA, 64 nt, Human
ugauagauuaacacuguuaguguaacgugccaguggaguggaaagaccgcaacaccugaauccu

SEQ ID NO: 440198 - RNA, 64 nt, Human; identical to SEQ ID NO: 363402

SEQ ID NO: 440199 - RNA, 64 nt, Human; identical to SEQ ID NO: 363403

SEQ ID NO: 440200 - RNA, 64 nt, Human; identical to SEQ ID NO: 364900

SEQ ID NO: 440201 - RNA, 64 nt, Human; identical to SEQ ID NO: 364901

SEQ ID NO: 440202 - RNA, 64 nt, Human; identical to SEQ ID NO: 364902

SEQ ID NO: 440203 - RNA, 64 nt, Human; identical to SEQ ID NO: 364939

SEQ ID NO: 440204 - RNA, 64 nt, Human; identical to SEQ ID NO: 364940

SEQ ID NO: 440205 - RNA, 64 nt, Human; identical to SEQ ID NO: 364941

SEQ ID NO: 440206 - RNA, 64 nt, Human; identical to SEQ ID NO: 364942

SEQ ID NO: 440207 - RNA, 64 nt, Human; identical to SEQ ID NO: 364943

SEQ ID NO: 440208 - RNA, 64 nt, Human; identical to SEQ ID NO: 364944

SEQ ID NO: 440209 - RNA, 64 nt, Human; identical to SEQ ID NO: 364945

SEQ ID NO: 440210 - RNA, 64 nt, Human; identical to SEQ ID NO: 364946

SEQ ID NO: 440211 - RNA, 64 nt, Human; identical to SEQ ID NO: 364947

SEQ ID NO: 440212 - RNA, 64 nt, Human; identical to SEQ ID NO: 364948

SEQ ID NO: 440213 - RNA, 54 nt, Human; identical to SEQ ID NO: 364949

SEQ ID NO: 440214 - RNA, 64 nt, Human
uuuaaggcacaggcuguugaagcauuuucucagaggaguggaucuguagaagucugucuuucua

SEQ ID NO: 440215 - RNA, 64 nt, Human
agcugugcucuuuucugacuagauuagagcguuuggaguggaagacgucaaauguguagugaga

SEQ ID NO: 440216 - RNA, 64 nt, Human
uuuaguuguuaguugcuuugggaagccuacuuauggaguggaaaccaggagguuaucaugguag

SEQ ID NO: 440217 - RNA, 55 nt, Human; identical to SEQ ID NO: 364950

SEQ ID NO: 440218 - RNA, 64 nt, Human; identical to SEQ ID NO: 364951

SEQ ID NO: 440219 - RNA, 64 nt, Human; identical to SEQ ID NO: 364952

SEQ ID NO: 440220 - RNA, 64 nt, Human; identical to SEQ ID NO: 408836

SEQ ID NO: 440221 - RNA, 64 nt, Human; identical to SEQ ID NO: 408837

SEQ ID NO: 440222 - RNA, 64 nt, Human; identical to SEQ ID NO: 408838

SEQ ID NO: 440223 - RNA, 64 nt, Human; identical to SEQ ID NO: 408839

SEQ ID NO: 440224 - RNA, 61 nt, Human; identical to SEQ ID NO: 149671

SEQ ID NO: 440225 - RNA, 64 nt, Human; identical to SEQ ID NO: 408841

SEQ ID NO: 440226 - RNA, 64 nt, Human; identical to SEQ ID NO: 408842

SEQ ID NO: 440227 - RNA, 64 nt, Human; identical to SEQ ID NO: 408843

SEQ ID NO: 440228 - RNA, 64 nt, Human; identical to SEQ ID NO: 323241

SEQ ID NO: 440229 - RNA, 64 nt, Human; identical to SEQ ID NO: 323242

SEQ ID NO: 440230 - RNA, 64 nt, Human; identical to SEQ ID NO: 323243

SEQ ID NO: 440231 - RNA, 64 nt, Human; identical to SEQ ID NO: 408844

SEQ ID NO: 440232 - RNA, 64 nt, Human; identical to SEQ ID NO: 408845

SEQ ID NO: 440233 - RNA, 64 nt, Human; identical to SEQ ID NO: 408846

SEQ ID NO: 440234 - RNA, 64 nt, Human; identical to SEQ ID NO: 408847

SEQ ID NO: 440235 - RNA, 64 nt, Human; identical to SEQ ID NO: 408848

SEQ ID NO: 440236 - RNA, 64 nt, Human; identical to SEQ ID NO: 408849

SEQ ID NO: 440237 - RNA, 64 nt, Human; identical to SEQ ID NO: 408850

SEQ ID NO: 440238 - RNA, 64 nt, Human; identical to SEQ ID NO: 114494

SEQ ID NO: 440239 - RNA, 64 nt, Human; identical to SEQ ID NO: 114495

SEQ ID NO: 440240 - RNA, 64 nt, Human; identical to SEQ ID NO: 114496

SEQ ID NO: 440241 - RNA, 64 nt, Human; identical to SEQ ID NO: 323247

SEQ ID NO: 440242 - RNA, 64 nt, Human; identical to SEQ ID NO: 323248

SEQ ID NO: 440243 - RNA, 64 nt, Human; identical to SEQ ID NO: 323249

SEQ ID NO: 440244 - RNA, 64 nt, Human; identical to SEQ ID NO: 114497

SEQ ID NO: 440245 - RNA, 64 nt, Human; identical to SEQ ID NO: 114498

SEQ ID NO: 440246 - RNA, 64 nt, Human; identical to SEQ ID NO: 114499

SEQ ID NO: 440247 - RNA, 64 nt, Human; identical to SEQ ID NO: 114500

SEQ ID NO: 440248 - RNA, 64 nt, Human; identical to SEQ ID NO: 114501

SEQ ID NO: 440249 - RNA, 64 nt, Human
caguaccccagcucaugggggacucagcaagcaagcguggcaccaucuuggaucugagccgguc

SEQ ID NO: 440250 - RNA, 64 nt, Human
cuagugcucugaguaggaccguaaccgccuccgugcguggcauauggucccugcaugcuguuca

SEQ ID NO: 440251 - RNA, 64 nt, Human
uugaugagcugauagaugauauaugagagacuaugcguggcacaauacuuuguuacacucuuca

SEQ ID NO: 440252 - RNA, 64 nt, Human
ugaaugguuaccucacugcugaaaacccagaggggcguggcacacucgcuuguguggaaaagcc

SEQ ID NO: 440253 - RNA, 64 nt, Human
gggcaggaugugagagguggggaguacuggcugugcguggcaggacagaagcacuguaaagggc

SEQ ID NO: 440254 - RNA, 64 nt, Human
cuguaccauggaguccugcagccccuuaaccccugcguggcaacuguguacagcuuaccccugc

SEQ ID NO: 440255 - RNA, 64 nt, Human
gucaauuauuuuaagcaguuugaggggauguguaggaguggagcaugaaacaguuuauaaggcu

SEQ ID NO: 440256 - RNA, 64 nt, Human
acauauguuuucauuucuuuuagcaauauacauaggaguggaauugcuaggucuuacaguaacu

SEQ ID NO: 440257 - RNA, 64 nt, Human
agugguugggaggagcuugaccagugugccccaaggaguggaguagagcccaaucuaaguauuc

SEQ ID NO: 440258 - RNA, 64 nt, Human
uuguccuucauggguagagucaggaagcccgguggcguggcacaacacacuuuggucauuucuc

SEQ ID NO: 440259 - RNA, 64 nt, Human
ugaugucuuagaaaggaaggugaauauagucaaagcguggcauugagauaauuggacugaagac

SEQ ID NO: 440260 - RNA, 64 nt, Human
ccugcguacccacugccaggacccucucagacaagcguggcacagccaugcugaccuuccaucu

SEQ ID NO: 440261 - RNA, 64 nt, Human
gggagccagagccggugggaagcggggaggggcugcguggcacagcuagugggccucccccugc

SEQ ID NO: 440262 - RNA, 64 nt, Human
uccccauuuaccaucagcucagccccugggaagggcguggcaggggcucugcaugcccgugaca

SEQ ID NO: 440263 - RNA, 64 nt, Human
cucguguuguuauauagaccauucauuugccugagcguggcacaguuuuaaaaauaguucucuu

SEQ ID NO: 440264 - RNA, 64 nt, Human
gcccacaggucucgagacgcacaugcacgccugggcguggcagccucacagggaacacgggaca

SEQ ID NO: 440265 - RNA, 64 nt, Human
ucucuucccaucaaaucauccagcucaguguggggcguggcagggggguaaaugaagccagcca

SEQ ID NO: 440266 - RNA, 64 nt, Human
ugacuuuaacccgcccaccuguguccucccauuggcguggcauuucuuuggugucugcucagaa

SEQ ID NO: 440267 - RNA, 64 nt, Human
cugacaaagcuuggaagagccugcaggugcugcugcguggcauagcccagacacagaagaggcu

SEQ ID NO: 440268 - RNA, 64 nt, Human
gccuuaugagaacauggugugugucucugacaaugcguggcacaucuaaauugaucauucauaa

SEQ ID NO: 440269 - RNA, 64 nt, Human
cugacugaaggggcuuggcuuccacucagcaucagcguggcagucaccaccccagugaggaccu

SEQ ID NO: 440270 - RNA, 64 nt, Human
guauacauuggcuuggaauguucacaacuugcgugcguggcagcggaagacgauucccauauuc

SEQ ID NO: 440271 - RNA, 60 nt, Human
cucuguaucccaaagcuuaagucucugcaggcguggcacgcacgcacgcacccacccacg

SEQ ID NO: 440272 - RNA, 64 nt, Human
gcugggagcuugccaggaacccaguggccagggagcguggcacuuaccuuugucccuugcuuca

SEQ ID NO: 440273 - RNA, 64 nt, Human
agggaggaaacuguauccaugcaugcaugauaaugcguggcagagacugcaacagggauugugu

SEQ ID NO: 440274 - RNA, 64 nt, Human; identical to SEQ ID NO: 323251

SEQ ID NO: 440275 - RNA, 64 nt, Human; identical to SEQ ID NO: 323252

SEQ ID NO: 440276 - RNA, 64 nt, Human; identical to SEQ ID NO: 323253

SEQ ID NO: 440277 - RNA, 64 nt, Human
cuacgcgggccguacagaggagcucuagagggcugcguggcauccuccuaggggcugagaggug

SEQ ID NO: 440278 - RNA, 64 nt, Human
gaagagcugcuucugcagggaguuuucuggaauggcguggcacauauugaagcauuucucagug

SEQ ID NO: 440279 - RNA, 64 nt, Human
ugcuuguucuggaagagauucaggugaaaaguuggcguggcauguuugaggacucugcggauca

SEQ ID NO: 440280 - RNA, 64 nt, Human
acaggacacggaccuucauggaaguccuugcucugcguggcaucugucagcuuuucaccuuuca

SEQ ID NO: 440281 - RNA, 64 nt, Human
ugcaugcacaagugugugugugccugcgugcugugcguggcagggugugugugugugugucugg

SEQ ID NO: 440282 - RNA, 64 nt, Human
guuccucuggaagcugugacuggaauaaacccccgcguggcacugcugaguccucucuggcugg

SEQ ID NO: 440283 - RNA, 64 nt, Human
cagaaagacaccgcgggcggccccuccgcggaaggcguggcagggaggcagucgcccugcggug

SEQ ID NO: 440284 - RNA, 64 nt, Human
ccuaggaaugcauuguccucaccuuguuauaccugcguggcaccauggcaggauuccacauuuc

SEQ ID NO: 440285 - RNA, 64 nt, Human
aaccuucuguuacucccugggagaaaggcgcugagcguggcaugcaggugucuuugcuguguuu

SEQ ID NO: 440286 - RNA, 64 nt, Human
agcaucuacucagcaaggucacuaagcucugccagcguggcagagcaugucuuggaaccugucu

SEQ ID NO: 440287 - RNA, 64 nt, Human
cauggugauggaugauauccucuuagccuggugggcguggcaugugcuuuuuaaaacaucaucu

SEQ ID NO: 440288 - RNA, 64 nt, Human
cuggggcugcuuuuuauuguucccacggcugacagcguggcagcggagacuguggaggcagugg

SEQ ID NO: 440289 - RNA, 64 nt, Human
cagaaaaggaguggggggcagucaccacugcugggcguggcauccgccuugggccuuucuccga

SEQ ID NO: 440290 - RNA, 64 nt, Human
ucaaaaauccauuuugccuuacauaugcuaagaagcguggcauucuuucuguucauaaaacaga

SEQ ID NO: 440291 - RNA, 64 nt, Human
ugcauagaaaaggauucuggugcuuccccuguuugcguggcagcaaggguuccacgugcauuug

SEQ ID NO: 440292 - RNA, 64 nt, Human
cagcgggugugucagccucucaccggcuccccgagcguggcagccaccagguccacagaacuac

SEQ ID NO: 440293 - RNA, 64 nt, Human; identical to SEQ ID NO: 323254

SEQ ID NO: 440294 - RNA, 64 nt, Human; identical to SEQ ID NO: 323255

SEQ ID NO: 440295 - RNA, 64 nt, Human; identical to SEQ ID NO: 323256

SEQ ID NO: 440296 - RNA, 64 nt, Human
gcuccgaggcuucuccagagcugggagcuggcuggcguggcaagggcaugcucuggggcagugu

SEQ ID NO: 440297 - RNA, 64 nt, Human
uuggccuccuggcugcuuucuccccuuccccccagcguggcaggaucucuuccuguuagcaagg

SEQ ID NO: 440298 - RNA, 64 nt, Human
aaggccuuuuccagcagcugggagcucccggauugcguggcacagcugaggggccucugugaug

SEQ ID NO: 440299 - RNA, 64 nt, Human
acacaucucgugaaaacucagaaaugacaauaaagcguggcauuugccucuguauuauaaauga

SEQ ID NO: 440300 - RNA, 64 nt, Human
gguggccaccgccagagcuccuggcgacaucuuggcguggcagccucuugacucugacucuccu

SEQ ID NO: 440301 - RNA, 64 nt, Human
ggaauuuuaaaaaguuggccuaaaaauguuccaugcguggcagcaaccaugcagagugacugaa

SEQ ID NO: 440302 - RNA, 64 nt, Human
ugcgccugagcugcaugcgccaccauuuuuggcagcguggcagcuuugcaaggggcuggggccc

SEQ ID NO: 440303 - RNA, 64 nt, Human
gagcguuggaccuucaugaacaguggccuggcuggcguggcagggccaaggcccacccacugcc

SEQ ID NO: 440304 - RNA, 64 nt, Human
acacugcguagauuugccgcacuuggaccuccaugcguggcacucacccgcagucuccuggaca

SEQ ID NO: 440305 - RNA, 64 nt, Human
agaauuuuuauaccaauucugaaaaagaaaauuugcguggcauuuuuaauucauaaauuauuuu

SEQ ID NO: 440306 - RNA, 64 nt, Human
acucauacuuucccguugacacuugauccacgcagcguggcacugggacguaaguggcgcaguc

SEQ ID NO: 440307 - RNA, 64 nt, Human
agggacagcugagauugagugucaguauugcuaagcguggcauucacaauacuggcacuauaaa

SEQ ID NO: 440308 - RNA, 64 nt, Human
ucucggauaguugcuauuuuuguaaaguuuccgugcguggcacucgcuguaugaaaggagagag

SEQ ID NO: 440309 - RNA, 64 nt, Human
acaaccuuugggaacuaaacaguuuucagagauggcguggcacugcauccuugguucuugcuuu

SEQ ID NO: 440310 - RNA, 64 nt, Human
agaccacuccucaccccagcucaagccauggcaggcguggcaagcaaaguggggaggagacagu

SEQ ID NO: 440311 - RNA, 64 nt, Human
cucccugggucccccagaccucucuguguugugugcguggcagccuccaggaauaaacauucuu

SEQ ID NO: 440312 - RNA, 60 nt, Human; identical to SEQ ID NO: 323258

SEQ ID NO: 440313 - RNA, 64 nt, Human; identical to SEQ ID NO: 323259

SEQ ID NO: 440314 - RNA, 64 nt, Human; identical to SEQ ID NO: 323260

SEQ ID NO: 440315 - RNA, 64 nt, Human
gacguaccugggaguuugaaucaggcccauuugagcguggcagccguguugggugaagguccgg

SEQ ID NO: 440316 - RNA, 64 nt, Human
ggcgcggguggguuuggugaaugugggugugucagcguggcagccacguggaagcagggcaugu

SEQ ID NO: 440317 - RNA, 64 nt, Human
ugcuuacugguguuuccgacaguauuaacccagugcguggcaugucuuugaagcaaagccuguc

SEQ ID NO: 440318 - RNA, 64 nt, Human
cagagcaagccuagauccuugaaagcaaugucaggcguggcaguggggaagccauggaggcugg

SEQ ID NO: 440319 - RNA, 64 nt, Human
ggcaguggugcuaggaggacagaaggcuauaugggcguggcagaggcugguuaacaagggcuua

SEQ ID NO: 440320 - RNA, 64 nt, Human
ccaagguuuggcuuucacgcgcuccauugccccggcguggcaggccauuccaagcccuuccggg

SEQ ID NO: 440321 - RNA, 64 nt, Human
cuacaacuguugcuauguguagagggugcucagagcguggcaugagagcaaggagaccauggcu

SEQ ID NO: 440322 - RNA, 64 nt, Human
uccuugucaccccgaaccuuguaaucgugugcuggcguggcagcccuggcuaaguuaaucccca

SEQ ID NO: 440323 - RNA, 64 nt, Human
ucugagugucuggcugaucacaucagagaggucugcguggcaguuuggggcugucacgugacca

SEQ ID NO: 440324 - RNA, 64 nt, Human
ccagauccaaaccgcaggcaaacgggucgugauggcguggcaacccucacuguguuggaggaug

SEQ ID NO: 440325 - RNA, 64 nt, Human
cucuguagaggguagcuguggcuucuaggugcccgcguggcauccugugaccgaccccucccca

SEQ ID NO: 440326 - RNA, 56 nt, Human
agggcagcuguggcuucuaggggcccgcguggcauccugugaccccuccccagugc

SEQ ID NO: 440327 - RNA, 64 nt, Human
auguuuuucacaaaauguauuguucaggaugugagcguggcaaauuuguccguguucuguuuaa

SEQ ID NO: 440328 - RNA, 64 nt, Human
ccacacaggagagaauauacagccugcagagagugcguggcaauccuuacucccagccgacugu

SEQ ID NO: 440329 - RNA, 64 nt, Human
acguuugcguuuggaccugucugugcguucuccugcguggcaguccugauuuccaugcuucugg

SEQ ID NO: 440330 - RNA, 64 nt, Human
uuuggaugugcgugugugucugcgugugccaugugcguggcacgcauaugagugugugugcgug

SEQ ID NO: 440331 - RNA, 64 nt, Human
aaauuuaagaucaccuccucagcuagcuuagagugcguggcacgggccccccgcccccgagauc

SEQ ID NO: 440332 - RNA, 64 nt, Human
ggccucccacuccucccagcccgggagaugcuccgcguggcaccacccuccuugcuggggguag

SEQ ID NO: 440333 - RNA, 64 nt, Human
uugucucuaguguucagaaguuuggcugugaugugcguggcauggaaguuuuuggguguauucu

SEQ ID NO: 440334 - RNA, 64 nt, Human
ucccaugucuacuaaaauacaaaaaauuagccaggcguggcagcaugcgccuauagucccagcc

SEQ ID NO: 440335 - RNA, 64 nt, Human
uggcggggcccacucaggacagcugggggccggggcguggcagggcccucucugugccucuccu

SEQ ID NO: 440336 - RNA, 64 nt, Human
gcaggguguccugggauagguuuccuaggcaggggcguggcagagcagguaggcgcccugcagc

SEQ ID NO: 440337 - RNA, 64 nt, Human
uaccaaugccaagauaauucacucuacucagccggcguggcaaauauaaaacuuacagagcgug

SEQ ID NO: 440338 - RNA, 64 nt, Human
uugggaagggagggagagggggcgcagcucgcaggcguggcaacuugaccuugggggaauauuu

SEQ ID NO: 440339 - RNA, 64 nt, Human
uugugagcauuguguggaauuuuacaccuggccugcguggcagccucuuccaguugagguguuu

SEQ ID NO: 440340 - RNA, 64 nt, Human
ucguccuuguccugaggggccccagcuugcucgggcguggcacaguggggaauccaagggucac

SEQ ID NO: 440341 - RNA, 64 nt, Human
accagccaggccacccagccgugggaggaagggggcguggcaaggggugggcacauuggugucu

SEQ ID NO: 440342 - RNA, 64 nt, Human
cugggguggcuaucaauauuggauggcgaggacagcguggcacuggcugcgaguguuccugaga

SEQ ID NO: 440343 - RNA, 64 nt, Human
aacagugucccacugaccuccccaaguguuugcugcguggcagauuuccuguucuuguucgcag

SEQ ID NO: 440344 - RNA, 64 nt, Human
gacuugaauagacacuucaccaaagagcauacacgcguggcaaacaagcacacgaaaagacguu

SEQ ID NO: 440345 - RNA, 64 nt, Human
ggagggauuccaaaaagucucagccuccaucaaggcguggcagcucaugccgguaaucucagca

SEQ ID NO: 440346 - RNA, 64 nt, Human; identical to SEQ ID NO: 323236

SEQ ID NO: 440347 - RNA, 64 nt, Human; identical to SEQ ID NO: 323237

SEQ ID NO: 440348 - RNA, 64 nt, Human; identical to SEQ ID NO: 323238

SEQ ID NO: 440349 - RNA, 64 nt, Human; identical to SEQ ID NO: 189042

SEQ ID NO: 440350 - RNA, 64 nt, Human; identical to SEQ ID NO: 189043

SEQ ID NO: 440351 - RNA, 64 nt, Human; identical to SEQ ID NO: 189044

SEQ ID NO: 440352 - RNA, 64 nt, Human; identical to SEQ ID NO: 189048

SEQ ID NO: 440353 - RNA, 64 nt, Human; identical to SEQ ID NO: 189049

SEQ ID NO: 440354 - RNA, 64 nt, Human; identical to SEQ ID NO: 189050

SEQ ID NO: 440355 - RNA, 55 nt, Human; identical to SEQ ID NO: 189045

SEQ ID NO: 440356 - RNA, 64 nt, Human; identical to SEQ ID NO: 189051

SEQ ID NO: 440357 - RNA, 60 nt, Human; identical to SEQ ID NO: 189052

SEQ ID NO: 440358 - RNA, 64 nt, Human; identical to SEQ ID NO: 189053

SEQ ID NO: 440359 - RNA, 64 nt, Human; identical to SEQ ID NO: 189054

SEQ ID NO: 440360 - RNA, 64 nt, Human; identical to SEQ ID NO: 189055

SEQ ID NO: 440361 - RNA, 64 nt, Human; identical to SEQ ID NO: 189056

SEQ ID NO: 440362 - RNA, 64 nt, Human; identical to SEQ ID NO: 189057

SEQ ID NO: 440363 - RNA, 64 nt, Human; identical to SEQ ID NO: 189058

SEQ ID NO: 440364 - RNA, 64 nt, Human; identical to SEQ ID NO: 189059

SEQ ID NO: 440365 - RNA, 63 nt, Human
agccgagcuuugaguguacaugauugauaggacuugaagaauaaaaauagaaacaauugaccu

SEQ ID NO: 440366 - RNA, 63 nt, Human
gaauagguucuuuuuucuuuaaugucuccguauuugaagaacugagcucuguacauuauaaau

SEQ ID NO: 440367 - RNA, 63 nt, Human
uucauuuaaccagcuaggcagcauuaaauagaauugaagaaauaccauaguauuuauuuuaca

SEQ ID NO: 440368 - RNA, 54 nt, Human; identical to SEQ ID NO: 189046

SEQ ID NO: 440369 - RNA, 64 nt, Human; identical to SEQ ID NO: 189042

SEQ ID NO: 440370 - RNA, 64 nt, Human; identical to SEQ ID NO: 189043

SEQ ID NO: 440371 - RNA, 64 nt, Human; identical to SEQ ID NO: 189044

SEQ ID NO: 440372 - RNA, 64 nt, Human; identical to SEQ ID NO: 189048

SEQ ID NO: 440373 - RNA, 64 nt, Human; identical to SEQ ID NO: 189049

SEQ ID NO: 440374 - RNA, 64 nt, Human; identical to SEQ ID NO: 189050

SEQ ID NO: 440375 - RNA, 55 nt, Human; identical to SEQ ID NO: 189045

SEQ ID NO: 440376 - RNA, 64 nt, Human; identical to SEQ ID NO: 189051

SEQ ID NO: 440377 - RNA, 60 nt, Human; identical to SEQ ID NO: 189052

SEQ ID NO: 440378 - RNA, 64 nt, Human; identical to SEQ ID NO: 189053

SEQ ID NO: 440379 - RNA, 63 nt, Human
caguuugagucaacuagaauaugccuggggaccuugaagaauggcccuucaguggcccucacc

SEQ ID NO: 440380 - RNA, 63 nt, Human
cauugguugauaauuauaaugauucauuuggacuugaagaaagauuguccccaggcacaguau

SEQ ID NO: 440381 - RNA, 63 nt, Human
gucucugcagagcuucauaacugggaauuugauuugaagaaguccaugucauauguguaacua

SEQ ID NO: 440382 - RNA, 64 nt, Human; identical to SEQ ID NO: 189054

SEQ ID NO: 440383 - RNA, 64 nt, Human; identical to SEQ ID NO: 189055

SEQ ID NO: 440384 - RNA, 64 nt, Human; identical to SEQ ID NO: 189056

SEQ ID NO: 440385 - RNA, 64 nt, Human; identical to SEQ ID NO: 189057

SEQ ID NO: 440386 - RNA, 64 nt, Human; identical to SEQ ID NO: 189058

SEQ ID NO: 440387 - RNA, 64 nt, Human; identical to SEQ ID NO: 189059

SEQ ID NO: 440388 - RNA, 54 nt, Human; identical to SEQ ID NO: 189046

SEQ ID NO: 440389 - RNA, 64 nt, Human
gaguagcugggacuacagguuccuaccaccacacccggccaauuuuuguauuuuuaguagagau

SEQ ID NO: 440390 - RNA, 64 nt, Human
gauccacuuagaucagggcggaaccaucuuucacccggccaagcuccugcccagauguugaccc

SEQ ID NO: 440391 - RNA, 64 nt, Human
ucaaagugcugggauuacaggugugccaccgcgcccggccaagaugggaguauuuuuauggcca

SEQ ID NO: 440392 - RNA, 64 nt, Human
aaagugcugagauuacaggugugagccaccgcacccggccaacuuucugaaauuucaaaacuga

SEQ ID NO: 440393 - RNA, 63 nt, Human
gaucaggaaugguguggauugagaacuuguuacuugaagaaaaagaauuuugauauuggaaua

SEQ ID NO: 440394 - RNA, 63 nt, Human
cugccacucacuaggcccccacuugccucuuccuugaagaacugcaggcccuggccuccccug

SEQ ID NO: 440395 - RNA, 63 nt, Human
acaguauuucaggugccuaccacacaggaaaccuugaagaaaaucaguuucuagaagccgcug

SEQ ID NO: 440396 - RNA, 64 nt, Human
cuucccccgggguccaggggucaacugcuacaugccggccaauggcgagacggugacgcugccc

SEQ ID NO: 440397 - RNA, 64 nt, Human
gugcagcuagcggcgacccaguguacgucccgccccggccaaccaugccaagccugccugccag

SEQ ID NO: 440398 - RNA, 64 nt, Human
aaagugcugggauuacagacaugaacugccaggcccggccaaaauaaugcaccacuuuuaacag

SEQ ID NO: 440399 - RNA, 64 nt, Human
cgcaaccucgacuucucagccuccugggguuccgccggccaacacugucugucucaaauacugu

SEQ ID NO: 440400 - RNA, 64 nt, Human
cuuggucugucacggcugaugaggacucccacaaccggccaaguuaugucuuauuauacacccc

SEQ ID NO: 440401 - RNA, 64 nt, Human
uuuuccgagacggagucuugcucugccacugugcccggccaauacauuauuauuaacuuaaggc

SEQ ID NO: 440402 - RNA, 64 nt, Human
aaagugcugggaugacaggcaugagccaccgcacccggccaacacagauguuuauugaucgugg

SEQ ID NO: 440403 - RNA, 64 nt, Human
ggugacaugucuacuuuuuaauuuuuaagagcauccggccaaaugcaaaauuaguaccucaaag

SEQ ID NO: 440404 - RNA, 64 nt, Human
aaaguccucggauuacaggcaugagccaccacacccggccaaucaguccaccuuucuaggccuu

SEQ ID NO: 440405 - RNA, 64 nt, Human
ugaugucaacagaguuuuagggauaaaaugguacccggccaacaucaagugacuuuauagcugc

SEQ ID NO: 440406 - RNA, 64 nt, Human
caaaguguugggauuauaggagugagccaccacaccggccaagaugcuuuucaaacugauacag

SEQ ID NO: 440407 - RNA, 64 nt, Human
aaaaugcugggauuacaggugugagccacugugcccggccaaaagaacagaaauuauuuuaucc

SEQ ID NO: 440408 - RNA, 64 nt, Human
gaguguuaccaccagcacccagaccgaacccccaccggccaaauguggugaugccgaagauguu

SEQ ID NO: 440409 - RNA, 64 nt, Human
aaagugcugggauuacaggugugagccaccgugcccggccaaguaaaauguuuuuuaaaauggu

SEQ ID NO: 440410 - RNA, 64 nt, Human
aaagugcugggaugauaggcgugagccaccacacccggccaagcacaggcuuuugaauggucuc

SEQ ID NO: 440411 - RNA, 63 nt, Human
uugaaauuaguuuaccucauccaugcacuuuaauugaagaacugcacuuuuuuuacuucgucu

SEQ ID NO: 440412 - RNA, 63 nt, Human
accuaagcguggguggccaacaucauauaccucuugaagaagaaggagucagccaucgccaac

SEQ ID NO: 440413 - RNA, 63 nt, Human
guaguacuaagaucuuaaaaagugguaacugucuugaagaaaaaacguuuauuguuuguuugc

SEQ ID NO: 440414 - RNA, 64 nt, Human
caccacucuccucagccacauuauuggggccccacagcaagacugcuugggucucaaggaaauc

SEQ ID NO: 440415 - RNA, 64 nt, Human
aaagugcugggauuacaggcgugagccacugcgcccggccaaaaagaacauuuugucaaucuga

SEQ ID NO: 440416 - RNA, 64 nt, Human
cuugccuuggacuaucaugcuaccuuacgccuccccggccaaauucccuccucuccuccggggg

SEQ ID NO: 440417 - RNA, 64 nt, Human
acccacacccccagggacgccgcuuuccgggaucccggccaaacgccggacccucagucgcucc

SEQ ID NO: 440418 - RNA, 64 nt, Human
aaagugcugggauuacaggcaugagccacagugcccggccaaguauuuuuauauuucagaucau

SEQ ID NO: 440419 - RNA, 64 nt, Human
aaaguucuaggauuacaggugugagccaccacguccggccaauuuuucucauuucuaugccucc

SEQ ID NO: 440420 - RNA, 64 nt, Human
ccuggcuggaccaguacugcucucugcccgcucuccggccaacuguccugaacucccuacgcca

SEQ ID NO: 440421 - RNA, 64 nt, Human
guguggccggccuccuccucacccuucccggcccccggccaaggacccaggcgcugcauacagg

SEQ ID NO: 440422 - RNA, 64 nt, Human
ccugacucaucauggucacauccagcccccacccccggccaacuaaccacugcaggcuccucuu

SEQ ID NO: 440423 - RNA, 64 nt, Human
ccucccagccuucugcugcccuugcuuaacaaugccggccaacuggcgaccucacgguugcacu

SEQ ID NO: 440424 - RNA, 64 nt, Human
gaggcccccggaggcgcccaccugcccaguuagcccggccaaggacacugauggguccugcugc

SEQ ID NO: 440425 - RNA, 64 nt, Human
uccuuuccaagugucaaauaggacacccaucuuaccggccaauguccaaaauuacgguuugaac

SEQ ID NO: 440426 - RNA, 64 nt, Human
ugguggagucugccccaggcacccucugcccugcccggccaaauacccggcauuauggggacag

SEQ ID NO: 440427 - RNA, 64 nt, Human
uggaugccaacucagcccccugaccuggaggcagccggccaaggccucuagggaagagcccccc

SEQ ID NO: 440428 - RNA, 64 nt, Human
cacugccugcccagugccaucaggaugagcaguaccggccaagcauaaugacagagagaggcag

SEQ ID NO: 440429 - RNA, 64 nt, Human
aagggcggucgccucugccacugucagggaccagccggccaacgcccacccgcaaaggugucua

SEQ ID NO: 440430 - RNA, 63 nt, Human
uaauuuuggcuggaccaauauaaaaaauuguauuugaagaauugauacuuuaacuuggaccuu

SEQ ID NO: 440431 - RNA, 63 nt, Human
agaggcgcuuaguaagccuuaguaaaguugugauugaagaaacuuaauacaaaugaacuagag

SEQ ID NO: 440432 - RNA, 63 nt, Human
cuguacaguuuaaaugaaaauguuuuucuucauuugaagaaaauuuguugauaaaccauggca

SEQ ID NO: 440433 - RNA, 64 nt, Human
ccagggcagguaucagggugaacugaucuuagcaccggccaaauaaauggaaccugcugagaga

SEQ ID NO: 440434 - RNA, 64 nt, Human
caccaaacacuacccaugggggguugggagucagccggccaaacuaacacucccccuccuccac

SEQ ID NO: 440435 - RNA, 64 nt, Human
cuuugcacagaaaccaaccccugacccagcgguaccggccaagcacaaacguccuuuuugcugc

SEQ ID NO: 440436 - RNA, 64 nt, Human
guuagaauauaggucucuucucccagaaucccagccggccaauggaaaccucacgcuggguccu

SEQ ID NO: 440437 - RNA, 64 nt, Human
cuccuggacugcuucuuuuggcucuccgacaacuccggccaauaaacacuuucugaauugaguu

SEQ ID NO: 440438 - RNA, 64 nt, Human
aggcuuguggccucuugcuccuccuuccagauccccggccaagcccagucacgagaauuucagg

SEQ ID NO: 440439 - RNA, 64 nt, Human
auuaaucgauuccuuuauguuuuauaagaguuuaccggccaaagcauauugucaucuuugguca

SEQ ID NO: 440440 - RNA, 64 nt, Human
cagaggccuuaggaccccguuccaagugcacugcccggccaagccccagccucagccugcgccu

SEQ ID NO: 440441 - RNA, 64 nt, Human
cuggagcagccucugagucuuacccguaauggagccggccaacccuguguguuauguugcuguc

SEQ ID NO: 440442 - RNA, 64 nt, Human
cagcccgcccuucccuacuggugcccccuccuccccggccaaggcgccuggaccuggcgaggac

SEQ ID NO: 440443 - RNA, 64 nt, Human
aaagugcugggauuacaggcaugagccacugugcccggccaagaucuaacucacgcuuacuuuu

SEQ ID NO: 440444 - RNA, 64 nt, Human
ccuccuccccucggccuccaggaagccaccguggccggccaagcacaagcucacccacuuugga

SEQ ID NO: 440445 - RNA, 64 nt, Human
uuugccauuugcuuguacugggacauuguucuuuccggccaaggugccaccacccugccccccc

SEQ ID NO: 440446 - RNA, 64 nt, Human
cucaccucuccccagcccccgcuguuccccugccccggccaacaacgaggagucuguuccuccc

SEQ ID NO: 440447 - RNA, 64 nt, Human
gguuuuacuuuuaccuguuuugagggggauggggccggccaagccauucagagagaacaugggu

SEQ ID NO: 440448 - RNA, 64 nt, Human; identical to SEQ ID NO: 314336

SEQ ID NO: 440449 - RNA, 64 nt, Human; identical to SEQ ID NO: 314337

SEQ ID NO: 440450 - RNA, 64 nt, Human; identical to SEQ ID NO: 314338

SEQ ID NO: 440451 - RNA, 64 nt, Human; identical to SEQ ID NO: 314339

SEQ ID NO: 440452 - RNA, 64 nt, Human
agccaggaugcaaggcuccugguccuguuugcagccggccaagaggcgcugggaggggcaaaac

SEQ ID NO: 440453 - RNA, 64 nt, Human
ccaaccccacucacuuuguaacuucaucacugacccggccaauaaggacccugugcgucuucuc

SEQ ID NO: 440454 - RNA, 64 nt, Human
ccacacaggaauucugcugagguccccccuccuuccggccaauggcagaagugggggaaaauuu

SEQ ID NO: 440455 - RNA, 64 nt, Human
uaaguucuuccccagccuccagauaagagccccgccggccaaucccuucauuucaaccuaaaga

SEQ ID NO: 440456 - RNA, 64 nt, Human
ccuguguuucggaaaccagagcacagugucugccccggccaaggaguuugucaaggugucucuu

SEQ ID NO: 440457 - RNA, 64 nt, Human
ggcuugacugggcucagccacugagcugccucaaccggccaaggaacgggauuaugaugacuau

SEQ ID NO: 440458 - RNA, 64 nt, Human
aaagugcugggauuacacgcgugagccaccaugcccggccaauacuacacucuuauucugccuu

SEQ ID NO: 440459 - RNA, 64 nt, Human
guagggucaggccacggcagccuaccggcaauuuccggccaacaguuaaaugagaacaugaaaa

SEQ ID NO: 440460 - RNA, 64 nt, Human
agagugaacaagaacaccccugccgacucccagcccggccaaaaagacaaaacacauagacgca

SEQ ID NO: 440461 - RNA, 64 nt, Human
aaagugcugggauuacaggcgugagccacugugcccggccaagaauuuuuuuaucgauaacaua

SEQ ID NO: 440462 - RNA, 64 nt, Human
uugugaacugguuacuuucugucucugugcucuaccggccaaacaagggguuuggaccagaccu

SEQ ID NO: 440463 - RNA, 64 nt, Human
ccugcaggggccccacacaggcaugagggauggcccggccaaagucuaggcagaagccuccuau

SEQ ID NO: 440464 - RNA, 64 nt, Human
uagcugggacuacaggcaugcgcagccacuaugcccggccaauaagcuauauuuauucuuauuu

SEQ ID NO: 440465 - RNA, 64 nt, Human
cuggacucuagccccugaccccagacucccgagaccggccaaagccaagccagccccacccuua

SEQ ID NO: 440466 - RNA, 64 nt, Human
cugcugccugcgcccugacucccaccccaagcccccggccaagccuggacucuagccccugacc

SEQ ID NO: 440467 - RNA, 64 nt, Human
aaggagcugagauuacgaguacaccacaccaugcccggccaaauacuugguuuucaguaccaca

SEQ ID NO: 440468 - RNA, 64 nt, Human; identical to SEQ ID NO: 314340

SEQ ID NO: 440469 - RNA, 64 nt, Human; identical to SEQ ID NO: 314341

SEQ ID NO: 440470 - RNA, 64 nt, Human; identical to SEQ ID NO: 313943

SEQ ID NO: 440471 - RNA, 64 nt, Human
ccaggcgcacaggggccgccgguaacaggggccgccggccaaaggccccuuuccagucauagca

SEQ ID NO: 440472 - RNA, 64 nt, Human
ccauggaaacauuuagacacaaaccuccccagcuccggccaagccaucauuugcuaccuggagc

SEQ ID NO: 440473 - RNA, 64 nt, Human
cuuggggcuacaguaguggguaaacaaaugcccaccggccaagaggccauuaacaaaucguccu

SEQ ID NO: 440474 - RNA, 64 nt, Human
aaagugcugggauuacaggcgugagccacugagcccggccaaaaaaaaauguauuuauuaaaaa

SEQ ID NO: 440475 - RNA, 64 nt, Human
gcagcucuucaucaagagggugguccugaagacuccggccaagaggcacaagcagcucaguaug

SEQ ID NO: 440476 - RNA, 64 nt, Human
ccuguaaucccagcacuuuggaaggccaucgcgcccggccaacuuuucuuuagaaaaaugagua

SEQ ID NO: 440477 - RNA, 64 nt, Human
cucucuuuuguacucugugccuuuauuucucaaaccggccaacacuuagggaaaauagaaaaga

SEQ ID NO: 440478 - RNA, 64 nt, Human
uucucugaacccacuguggugagaagaauuugcuccggccaaauuggccguuagccaccugggu

SEQ ID NO: 440479 - RNA, 64 nt, Human
caaauguuccacaaggcgggaguguuucacuuucuggugauaaacuugauggucauuguuauga

SEQ ID NO: 440480 - RNA, 64 nt, Human
agcuaugaucagcugcaauccacccuggguaacacagcaagacucuaucucaaaaaaaagaaaa

SEQ ID NO: 440481 - RNA, 64 nt, Human
aauauagaaacucacauaacuagcccagguaacacagcaagaccccaucucuacaaaaauauua

SEQ ID NO: 440482 - RNA, 64 nt, Human
agccuugugccaaaagaaacuuuuaaaacagcuacagcaagaugagucugacuauggcuuagua

SEQ ID NO: 440483 - RNA, 64 nt, Human
gggcugcuuuggucugugggcuccuucauucccuuggugauaauuucccuuuauucugugggau

SEQ ID NO: 440484 - RNA, 64 nt, Human
uuucuauuuucuugaugcuguuuacaacauaguuuggugauauccagagcuaauguacaugcuu

SEQ ID NO: 440485 - RNA, 64 nt, Human
uauguguuuuaucuaauuauuuugguuguuaauauggugauaauggaaagucaaguuaaauuuu

SEQ ID NO: 440486 - RNA, 64 nt, Human
cagcuguugcugugguaauauuuuugacaugugauggugauagucucugguucuccccaucccc

SEQ ID NO: 440487 - RNA, 64 nt, Human
gaagccucuacuugaugagagacagaguuuuggguggugauagugaugugcugguggucauuuc

SEQ ID NO: 440488 - RNA, 64 nt, Human
uauucagaccuaagacagggaggggucagagugauggugauaaaaaaaaaaaaucaucagcaau

SEQ ID NO: 440489 - RNA, 64 nt, Human
aagguaaaacaugcuggugaaccagggguguugauggugauaagggaggaauauagaaugaaag

SEQ ID NO: 440490 - RNA, 64 nt, Human
ugacccagggauggaggcuuugagucccacaguguggugauacagagcacuaguugucacugcc

SEQ ID NO: 440491 - RNA, 64 nt, Human
gaaaaaaagaaauuuuacuuucucucaccuuaccuggugauaaguuccaaauauguuaagggcu

SEQ ID NO: 440492 - RNA, 64 nt, Human
cacuuuuaacagaacagacagaugaggacagagcuggugauaaaaaaaaaaaaaaaaaagcauu

SEQ ID NO: 440493 - RNA, 64 nt, Human
ggaaaaaacaggaauuuuaucugguuauugcaucuggugauagaggccuucaaagccuauuauu

SEQ ID NO: 440494 - RNA, 64 nt, Human
ggacaguauagauguuuguggauguagcacugaguggugauacccagaccagcagucaccccag

SEQ ID NO: 440495 - RNA, 64 nt, Human
ccuaauuuuucugagccuguuucucauuuguaaauggugauaauaccuaccucauaggguuguu

SEQ ID NO: 440496 - RNA, 64 nt, Human
caggaccugaccuuuugcaaagcaaacauagauuuggugauaagacccucugauucugugaguu

SEQ ID NO: 440497 - RNA, 64 nt, Human; identical to SEQ ID NO: 313164

SEQ ID NO: 440498 - RNA, 64 nt, Human; identical to SEQ ID NO: 314305

SEQ ID NO: 440499 - RNA, 64 nt, Human; identical to SEQ ID NO: 314306

SEQ ID NO: 440500 - RNA, 64 nt, Human
aauugggaagagugacuucugugagauggcuggcuggugauaggacuaaguucucauuguucaa

SEQ ID NO: 440501 - RNA, 64 nt, Human
uguaugucaaggcuuacuacugcuuuccaauccuuggugauaugaagacagauaagcacgcugc

SEQ ID NO: 440502 - RNA, 64 nt, Human
uauuggaugauagaagauauuuaagauaucuagauggugauauuuuccuuacaagauggguacc

SEQ ID NO: 440503 - RNA, 64 nt, Human
agaguauuuuuuucaagacauuuauuuuucagaguggugauacuuuuacuuuggauacucugug

SEQ ID NO: 440504 - RNA, 64 nt, Human
gaacaaguagacacacugugggaggaucugagcuuggugauauuuuauccccaagauaugacac

SEQ ID NO: 440505 - RNA, 64 nt, Human
gaagggaguuggugugcuauuuuugaagcagauguggugauacugagauugucuguucaguuuc

SEQ ID NO: 440506 - RNA, 64 nt, Human
uuuuucuccuuuuuuuuucuuuuuaagccauaauuggugauacugaaaacuuuggguucccauu

SEQ ID NO: 440507 - RNA, 64 nt, Human
agcccucacccuggggcuaggaaauccagggugguggugauagguauaagugguguguguaugc

SEQ ID NO: 440508 - RNA, 64 nt, Human
cccuguguccuagaaugggagaguaaguagacaguggugauaaccccacacugcuuauaagugc

SEQ ID NO: 440509 - RNA, 64 nt, Human
aaccuacucugaaagccuucagacauuaugacucuggugauaagcucuuucccucuccguuugc

SEQ ID NO: 440510 - RNA, 64 nt, Human
uguucaauauuuguagguaaagauuuauugaaaauggugauauagaccucagagcuguuaucuu

SEQ ID NO: 440511 - RNA, 64 nt, Human
guuagaacaagucuuuccaguuagagaagaggaguggugauaaagcccacugaccuucacacau

SEQ ID NO: 440512 - RNA, 53 nt, Human
caagaacuagaaauaaauaaggauggugauagagagguauaccuucauauuca

SEQ ID NO: 440513 - RNA, 64 nt, Human
uagaaaaccugacuaauggugucacugcuggcaauggugauaauggauuaauuccucaaaggaa

SEQ ID NO: 440514 - RNA, 64 nt, Human; identical to SEQ ID NO: 314307

SEQ ID NO: 440515 - RNA, 64 nt, Human; identical to SEQ ID NO: 314170

SEQ ID NO: 440516 - RNA, 64 nt, Human; identical to SEQ ID NO: 314171

SEQ ID NO: 440517 - RNA, 64 nt, Human
agaaaagaucucaagaaccagaaauaaauaaggauggugauagagagguauaccuuuauauuca

SEQ ID NO: 440518 - RNA, 64 nt, Human
uuucaauguuguauauagaaaauacagaauuucauggugauaucagaaauguaaauauuguaca

SEQ ID NO: 440519 - RNA, 64 nt, Human
guagugcucuuuaauucagcuacauauauucauguggugauagggaucaacuugacacaacuuu

SEQ ID NO: 440520 - RNA, 64 nt, Human
uagcugaauucauugugaaacaugaauucagucauggugauaauuggaaacuccuuucagguuu

SEQ ID NO: 440521 - RNA, 64 nt, Human
auucaguaguuaggggcagggaggagaaauaaaguggugauagucugguguuacagaagccacu

SEQ ID NO: 440522 - RNA, 64 nt, Human
uuagaaggauguggaguagagggaagggaaggauuggugauagcagagcuccaggccucccuuc

SEQ ID NO: 440523 - RNA, 64 nt, Human
auauuguacuuauuggaaguaauaucaaacuguauggugauaaguauuguuuugauucuuaugg

SEQ ID NO: 440524 - RNA, 64 nt, Human
uuguuucaaaagacuugcagcuaaucuaaaaaacuggugauauuuaauaugcauguauguaucu

SEQ ID NO: 440525 - RNA, 64 nt, Human
gggaacacacuagagaaccaaaaaugugauuauauggugauauaaaaaucccuuuccucugugu

SEQ ID NO: 440526 - RNA, 64 nt, Human
uagaacuuaaaaauuuuuuauacaauuacccaauuggugauaugaucuuaagcuuuugugucag

SEQ ID NO: 440527 - RNA, 64 nt, Human
uuaaucaccaacauuguuuagaauuucaagcagauggugauaauaaaaagcagaccaacuuuua

SEQ ID NO: 440528 - RNA, 64 nt, Human
ucuucacaagucuugguuaaagaaugucacauauuggugauagaaugaauucaaccugcucugu

SEQ ID NO: 440529 - RNA, 64 nt, Human
auuucaacuuauuuuaagcuuguaaaauacacuguggugauaaaauaaaagagcuggguuugac

SEQ ID NO: 440530 - RNA, 64 nt, Human
acagaguucauggagguucaccuuugugacugauuggugauaaaagauagccaagugucuuaca

SEQ ID NO: 440531 - RNA, 64 nt, Human; identical to SEQ ID NO: 314046

SEQ ID NO: 440532 - RNA, 64 nt, Human; identical to SEQ ID NO: 314047

SEQ ID NO: 440533 - RNA, 64 nt, Human; identical to SEQ ID NO: 314048

SEQ ID NO: 440534 - RNA, 64 nt, Human
ucaccuuuuucaggacauugcauuuucaggcuuguggugauaaauaagaucgaccaaugcaagu

SEQ ID NO: 440535 - RNA, 64 nt, Human
caauugguuuuauuuuuuucucuuuugaauauguuggugauaauuccgugacaguuggaagaug

SEQ ID NO: 440536 - RNA, 64 nt, Human
agguaaaagacuucuguauggauugcaguuacucuggugauaguuuucaccuuuauucugcugu

SEQ ID NO: 440537 - RNA, 64 nt, Human
acugccuuuaaaauagauuuuaucaguggagaaauggugauaguuuuuucuucaguuuucucuu

SEQ ID NO: 440538 - RNA, 61 nt, Human
cucaccuucuugaacauuagagagugcauaauggugauacuuguuuauaauucuuaugcug

SEQ ID NO: 440539 - RNA, 64 nt, Human
cccugggagucuuaaaagcagugcuuagcaacauuggugauagcauguggcugggacccagggc

SEQ ID NO: 440540 - RNA, 64 nt, Human
auauauugcucaguagagaaaaaccaugggggacuggugauauguugaucuuuuucaaaaaaau

SEQ ID NO: 440541 - RNA, 64 nt, Human
uuaaggaaaaauacguuuggaaaauaaacuguuauggugauaauuuggggaauaugugcacgcu

SEQ ID NO: 440542 - RNA, 64 nt, Human
cuuuuauguuuaaauuuugcacugcaauuuuauuuggugauaagcacaaaucucuacuccucau

SEQ ID NO: 440543 - RNA, 64 nt, Human
gacagcaguuucccugguggucagggagggguuuuggugauacccaaguuauugggaugucauc

SEQ ID NO: 440544 - RNA, 64 nt, Human
gaauaacacucugcuguaacgaagaagagcuuuguggugauaauuuuguaucuugguugcagug

SEQ ID NO: 440545 - RNA, 64 nt, Human
uuaauaagcaaacaaacacauuucuauuuauaaauggugauaaaauuccuuggcuaaaagaaua

SEQ ID NO: 440546 - RNA, 64 nt, Human
ucuaaaagggguucccaggagaccugauucccuguggugauaccuauaaagaggaucguagugu

SEQ ID NO: 440547 - RNA, 64 nt, Human
ugucuauacuccuucccuuaagggguaucauguauggugauagguaucuagagcuuaaugcuac

SEQ ID NO: 440548 - RNA, 64 nt, Human; identical to SEQ ID NO: 314049

SEQ ID NO: 440549 - RNA, 64 nt, Human; identical to SEQ ID NO: 314172

SEQ ID NO: 440550 - RNA, 64 nt, Human; identical to SEQ ID NO: 313166

SEQ ID NO: 440551 - RNA, 64 nt, Human
acucccuccagaacauuuaguguagaugaaaauguggugauagaaaugggugcaugaucuucac

SEQ ID NO: 440552 - RNA, 64 nt, Human
gucacuagucuuugaggagguuugcuccuagaacuggugauauaaagaaugaaaguagcuguau

SEQ ID NO: 440553 - RNA, 64 nt, Human
uaauuugaacuacagcuggacuccguuugugugauggugauacaugucauuaguugcaacuucu

SEQ ID NO: 440554 - RNA, 64 nt, Human
gcauacuggaagccaccucuggaaaagccucauauggugauaugccaaaauauuuaugucaaug

SEQ ID NO: 440555 - RNA, 61 nt, Human
uagacaccaaaucuggcugaaugaaauaaauuggugauaaguggaaaaaagagaaaaacca

SEQ ID NO: 440556 - RNA, 64 nt, Human
ugugcuuuuauagaaagaaauuucuucauagacguggugauauaucauuuguuggaccugcuaa

SEQ ID NO: 440557 - RNA, 64 nt, Human
ggaauuccuucauuucauaagaaccucaaaauaauggugauacauucuagccuuaagacauuug

SEQ ID NO: 440558 - RNA, 64 nt, Human
acuuauuuugugauuccuacagugaaaacauuuuuggugauaucugccugggaaaucucucuuc

SEQ ID NO: 440559 - RNA, 64 nt, Human
guaaccugaguuuauaucuggcaugaauucauuauggugauacacauaugugaauucaguacau

SEQ ID NO: 440560 - RNA, 64 nt, Human
aauuuucaguugacgaaucagcaucuuguucccauggugauaacacuaauugaauauaucuaug

SEQ ID NO: 440561 - RNA, 64 nt, Human
gaaggugguguuuccaugguagaugcuccuguucuggugauaccaaaccugcccaccccucuga

SEQ ID NO: 440562 - RNA, 64 nt, Human
gaaggucagaagagagauauacaacagcgaggcuuggugauaacguauagaauaacagacgggg

SEQ ID NO: 440563 - RNA, 64 nt, Human
gaaucucuuuaaugcauuuucuuaauucuuacaauggugauaaguuacuucaauuauaaaauug

SEQ ID NO: 440564 - RNA, 64 nt, Human
cuucauuuucugaaagucuagagaauuacaacuuuggugauaaacaaaaggagucaguuauuuu

SEQ ID NO: 440565 - RNA, 64 nt, Human; identical to SEQ ID NO: 314084

SEQ ID NO: 440566 - RNA, 64 nt, Human; identical to SEQ ID NO: 314085

SEQ ID NO: 440567 - RNA, 64 nt, Human; identical to SEQ ID NO: 314100

SEQ ID NO: 440568 - RNA, 64 nt, Human
uauagaaaugaaauuuaucuucuguuuuggucucuggugauauuuuaaacaauauuuaaaaguc

SEQ ID NO: 440569 - RNA, 64 nt, Human
ggaugguugaaaauuugaaaacuuacugaauauuuggugauacugugaaccauuauuaauuuuu

SEQ ID NO: 440570 - RNA, 64 nt, Human
aaauguuacaguuugaaguuuuccuucaugcacuuggugauaaacguuuucuaaauuuuuaguu

SEQ ID NO: 440571 - RNA, 64 nt, Human
uuuucacugaaaugauuguuuugcugguuaugcuuggugauauuuuagcgggcuuauuuuugaa

SEQ ID NO: 440572 - RNA, 64 nt, Human
uaaagccuaacuuaagaauccuggcucacuucuuuggugauacacuguagccacuagaaagaga

SEQ ID NO: 440573 - RNA, 64 nt, Human
aguuagcuuuaauuauaauuauuuuauucauaaauggugauaguccccagaucuguacaccuuu

SEQ ID NO: 440574 - RNA, 64 nt, Human
caauguagaaaaugaggaaaugccacaaauuguauggugauaaaagucacgugaaacagaguga

SEQ ID NO: 440575 - RNA, 64 nt, Human
ggaagcaggcugcgggccuuccaaaaguaaaaaauggugauaugcaaucgaagcuuauccuuag

SEQ ID NO: 440576 - RNA, 64 nt, Human
aaaugguuugugguucacagcuuucauccaagcuuggugauaaucaauuuugaaaauacagugg

SEQ ID NO: 440577 - RNA, 64 nt, Human
gaaagauuggagucaagcagauggaagaaugcaguggugauaguugucaugcgacagccugaga

SEQ ID NO: 440578 - RNA, 64 nt, Human
cauaguugagcaguagcugguagaauuaggcaguuggugauaguuuuacuuugguacaaauaaa

SEQ ID NO: 440579 - RNA, 64 nt, Human
gauguuuuuaaagcuguguaaaggaagaaugaaguggugauauuuacaaaaaaguaaaaaaaaa

SEQ ID NO: 440580 - RNA, 64 nt, Human
uggcaucaucaaagcugacauuuagaagagaugcuggugauagucaucucauccuacucaauuu

SEQ ID NO: 440581 - RNA, 64 nt, Human
uucuuuauggccagcagcccuugguuggugcagauggugauaggaccagugggucccacagcau

SEQ ID NO: 440582 - RNA, 64 nt, Human; identical to SEQ ID NO: 314101

SEQ ID NO: 440583 - RNA, 64 nt, Human; identical to SEQ ID NO: 313167

SEQ ID NO: 440584 - RNA, 64 nt, Human; identical to SEQ ID NO: 314102

SEQ ID NO: 440585 - RNA, 64 nt, Human
agggacuggugagaauggggcugaguggaggagguggugauauuuaaaccauuuggugcuuggu

SEQ ID NO: 440586 - RNA, 64 nt, Human
uguauuauuuuuaaagagaucuauacuauaaauauggugauauauuuacaaguaaucuguuaag

SEQ ID NO: 440587 - RNA, 64 nt, Human
caguagcuuuguuugauauuuaacaauaaguauauggugauauacuugaaauuuauguccagaa

SEQ ID NO: 440588 - RNA, 64 nt, Human
uaguaaaaucacaauuguggaauuacaggaauucuggugauauuaaggugaaauaacaaaacac

SEQ ID NO: 440589 - RNA, 64 nt, Human
cagccacagaagaugucauguacuguauauuaccuggugauaguugcuuuucaccccccgaguu

SEQ ID NO: 440590 - RNA, 64 nt, Human
agugaugccgucaaggcuuaguuaugaucauguguggugauaaagaccauccaccaucacccuu

SEQ ID NO: 440591 - RNA, 64 nt, Human
auuucaauguaaaacagaaaacauauugauguguuggugauaggcuugaauuauuaaaaacuuc

SEQ ID NO: 440592 - RNA, 64 nt, Human
cauuuuauugaugauugauugugguugaaaggaguggugauauuauuucgaggauccacugugu

SEQ ID NO: 440593 - RNA, 64 nt, Human
agaugaacaucuaacccacuagaggaaaccaguuuggugauauaugagacuuuauguggaguga

SEQ ID NO: 440594 - RNA, 64 nt, Human
gagcgcaagacgcccugagccucccucucacugguggugauaagaggagccgucugguguguca

SEQ ID NO: 440595 - RNA, 64 nt, Human
cugggugccccagaaauagaccucuccuguagaguggugauauacagaaugaguuucaguuugc

SEQ ID NO: 440596 - RNA, 64 nt, Human
auccugcuugccuguccauuuguggaacagcaucuggugauaugcaauuccacacugguaaccu

SEQ ID NO: 440597 - RNA, 64 nt, Human
ugaggucaggagaucaagaccauccuggccaacauggugauaccccgucucuacuaaaaauaca

SEQ ID NO: 440598 - RNA, 64 nt, Human
ucucuuagaugucccaacuucagcuguugggagauggugauauuuucaacccuacuuccuaaac

SEQ ID NO: 440599 - RNA, 63 nt, Human
ucugauuucaugaauugaaaagaaacaaauguauugaagaagugagcuacaguuuuccuuccu

SEQ ID NO: 440600 - RNA, 63 nt, Human
aacuugauacuguauuauuuuguucaauguaaauugaagaaaaucuguaaguaaguaaaccuu

SEQ ID NO: 440601 - RNA, 63 nt, Human
gaucaguauggcuugcugcuuuuauuuuuauuuuugaagaagaauagccuuuuucucugcacu

SEQ ID NO: 440602 - RNA, 64 nt, Human
ucacacaggauauucugcuguguugcaacccauguggugauaaggcucacagcccugagcucuu

SEQ ID NO: 440603 - RNA, 64 nt, Human
uuggagcagccagaccauguuuccaagagaaaccuggugauauugccagcagacccccugccau

SEQ ID NO: 440604 - RNA, 64 nt, Human
agcugaacggccuuuaaauuguuuuucauaauaguggugauauguuugcguggauacgucugua

SEQ ID NO: 440605 - RNA, 64 nt, Human
auuaucccccaaaaugcauuuagaaaacagucuuuggugauauuuauuauaugauuaucagguu

SEQ ID NO: 440606 - RNA, 64 nt, Human
auauuuucaaaugugauaaaauagcacaaguggcuggugauaaaauuugaaauuaugguuaacc

SEQ ID NO: 440607 - RNA, 64 nt, Human
uauucuugaaaagaacgugagcaggaaaaacugcuggugauacuuuuuuuaaguuuuguuuuua

SEQ ID NO: 440608 - RNA, 64 nt, Human
guccugucuuaaucuuacaugcugaaagucuucauggugauaugcacuauauucaguauacgua

SEQ ID NO: 440609 - RNA, 64 nt, Human
guauauaaauauugccauaucaugguaccuauaauggugauauauuuguuucuaugaaaaaugu

SEQ ID NO: 440610 - RNA, 64 nt, Human
uggggugugucucaggcaggcagcugcgucuuguuggugauaaccucugcugggagguuacuuu

SEQ ID NO: 440611 - RNA, 64 nt, Human
uuugacucauuaaugagcucgcuaaccuacgaucuggugauaauuuugugugcacagcccaagg

SEQ ID NO: 440612 - RNA, 64 nt, Human
uuucugcuuuacagaaaaggaaacucauucagacuggugauaucgugauguaccuaaaagucag

SEQ ID NO: 440613 - RNA, 64 nt, Human
acuguacauaauaauauguauuaaacugguaucguggugauauaauguggugcaguuacuuaua

SEQ ID NO: 440614 - RNA, 64 nt, Human
uaauauaacuugaaaauuuuuuauacugagggguuggugauaacucuugaggauguaaugcauu

SEQ ID NO: 440615 - RNA, 64 nt, Human
gugacuacuuugggagauugguagucucuuuugauggugauagugauggggugcacuaucauaa

SEQ ID NO: 440616 - RNA, 64 nt, Human; identical to SEQ ID NO: 314152

SEQ ID NO: 440617 - RNA, 64 nt, Human; identical to SEQ ID NO: 314153

SEQ ID NO: 440618 - RNA, 64 nt, Human; identical to SEQ ID NO: 313177

SEQ ID NO: 440619 - RNA, 64 nt, Human
uuauuuuccaaaguuuuuaaagaauacgggucuguggugauaaauacaguacaauccuuuuuca

SEQ ID NO: 440620 - RNA, 64 nt, Human
aucuguauaucagcucuaaagcagagauguauuauggugauacuccaagguggcauagccauuc

SEQ ID NO: 440621 - RNA, 64 nt, Human
cuucaguuaaagauauuuaaggaaaaauuugggguggugauaauauggcuuuucacagaaaggg

SEQ ID NO: 440622 - RNA, 64 nt, Human
ucagaugugcagguguuaaucuucucuaaaagccuggugauacagcucuggcuuucugagcaca

SEQ ID NO: 440623 - RNA, 64 nt, Human
uaucucgcauguuuuaucuuccaaacacagaccuuggugauaaccugugcuucaaacugucuua

SEQ ID NO: 440624 - RNA, 64 nt, Human
ugugaguggaaaugaaugcgcagcguaugacuguuggugauaaguguaucugugugagugugug

SEQ ID NO: 440625 - RNA, 64 nt, Human
uuggcaaggcuuugucucacuguacgguuuaauuuggugauaucuuaagccuuucuucccaucc

SEQ ID NO: 440626 - RNA, 64 nt, Human
auaguuugaguuagguaagcaucuuaaagcuguuuggugauaaagaaggcagcuuagauucugu

SEQ ID NO: 440627 - RNA, 64 nt, Human
agagggaccagauugggggguagguccacgggcuuggugauagaauuauuucucgauugacuuc

SEQ ID NO: 440628 - RNA, 64 nt, Human
aagccaaggugucauuuaugugucaguucauuuguggugauauagaauuagcuuuuucaucccc

SEQ ID NO: 440629 - RNA, 64 nt, Human
ccccgucucuguuccaugucuccuuuaagagcucuggugauaaggacaugaugcuuuuacugaa

SEQ ID NO: 440630 - RNA, 64 nt, Human
uuuuucuuauaugaauuuucuuuucucucuuuucuggugauagucuuuaaaaauagagauugac

SEQ ID NO: 440631 - RNA, 64 nt, Human
auuucuaacuacuuuguaacugcauggcuuaaccuggugauaaaagcaguuauuaaaagucuac

SEQ ID NO: 440632 - RNA, 64 nt, Human
guacauugugauuuaaugaaaauuugaggacacguggugauacagauagcaugugaggcaggca

SEQ ID NO: 440633 - RNA, 64 nt, Human; identical to SEQ ID NO: 314135

SEQ ID NO: 440634 - RNA, 64 nt, Human; identical to SEQ ID NO: 314136

SEQ ID NO: 440635 - RNA, 54 nt, Human; identical to SEQ ID NO: 162181

SEQ ID NO: 440636 - RNA, 64 nt, Human
aaguuucugugaccuguaguguaccauucucagguggugauaugguuuggauguuuuguccccu

SEQ ID NO: 440637 - RNA, 64 nt, Human
augucccuaagccaacaggguauaacacaggcccuggugauaaugaggguguccuaaagauccu

SEQ ID NO: 440638 - RNA, 64 nt, Human
guuguguaucucuauaaugugaaauauuuuuuuguggugauaaaaagagggccaaggagguaug

SEQ ID NO: 440639 - RNA, 64 nt, Human
agaggaaguauuguuaucccuagcaugaguguaauggugauaugaaaaacuuugucuugucauu

SEQ ID NO: 440640 - RNA, 64 nt, Human
uuaagggacauguauguggccuugccuagcccuuuggugauaaguacuuccucuaggaaaugua

SEQ ID NO: 440641 - RNA, 64 nt, Human
uuaagaucuaguucuuuuuguagguguucagcaauggugauaaagcagaauauucuccuaccuc

SEQ ID NO: 440642 - RNA, 64 nt, Human
gugauuaagucaaugaauaaaaacauuaaugcauuggugauauccagcauguuugaauuuggug

SEQ ID NO: 440643 - RNA, 64 nt, Human
auuuacaggaacugucauaguguucaguauuggguggugauaagcccauuggauuguccccuug

SEQ ID NO: 440644 - RNA, 64 nt, Human
cucucagagaauuccucuuaauuuuuaaagaugcuggugauaauaaaauucauuagaaaauuuc

SEQ ID NO: 440645 - RNA, 64 nt, Human
ggacacuuugagacaccaaucuggauugagcggguggugauaauaggggcuggaaagccagcag

SEQ ID NO: 440646 - RNA, 64 nt, Human
uuuuauauuuaagcuacaauuaaucuuuuuucuuuggugauauuuauuucuuugccuuuuuuuu

SEQ ID NO: 440647 - RNA, 64 nt, Human
uccuuccucuccccgccccuccucccuuugugccuggugauauauuuuuuuuuccucccugagu

SEQ ID NO: 440648 - RNA, 64 nt, Human
caaguaguggcauaucagucuuggagcuccuagcuggugauacggagagggcuuuggaggacuu

SEQ ID NO: 440649 - RNA, 64 nt, Human
cugcauggccccagcaaugcagucacccagggccuggugauaucuguguccucucaccccuucu

SEQ ID NO: 440650 - RNA, 64 nt, Human; identical to SEQ ID NO: 314255

SEQ ID NO: 440651 - RNA, 64 nt, Human; identical to SEQ ID NO: 313178

SEQ ID NO: 440652 - RNA, 64 nt, Human; identical to SEQ ID NO: 314154

SEQ ID NO: 440653 - RNA, 64 nt, Human
ugaacaauaggagaacagcuaaauugauaaagacuggugauaauaaaaauugaauuauguauau

SEQ ID NO: 440654 - RNA, 64 nt, Human
aauuuacuguacuccaaaugauugcuuucuuuucuggugauaucugugcuucucauaauuacug

SEQ ID NO: 440655 - RNA, 64 nt, Human
guuguaaaaccuuaacuuucuuucuccaggaggguggugauagaaacagaugguaguauuuaug

SEQ ID NO: 440656 - RNA, 64 nt, Human
auggauguuuccaaauuccacaauaagcaauauguggugauaaugaaaagaaugauucagucuu

SEQ ID NO: 440657 - RNA, 64 nt, Human
cugaggaaaauauauucaacugugaagaagacccuggugauaccuuucuaaaaagguggagucu

SEQ ID NO: 440658 - RNA, 64 nt, Human
uuuuuaaacaauaaaugucauuucaugaaaucuuuggugauaaaguauuuuggauucagagaag

SEQ ID NO: 440659 - RNA, 64 nt, Human
uaaaacaucaaaaugccaaagauuaaucugugauuggugauaacugccucguuuaaauggucac

SEQ ID NO: 440660 - RNA, 64 nt, Human
uugucucuucuguugauuuaaaaaugaucccuccuggugauaacccauuuuacagggaugaaga

SEQ ID NO: 440661 - RNA, 64 nt, Human
cgucuuguucuuuuuuuucuugacauuuugcaauuggugauauuaaguaggguaggagugcauc

SEQ ID NO: 440662 - RNA, 64 nt, Human
ccucucugggcuucaguugucucauucuguaaaauggugauauuacuggaacucaucucauagg

SEQ ID NO: 440663 - RNA, 64 nt, Human
guguguguguguggguucuuucuuauccaucucguggugauacacucugauuuucaagcuccuc

SEQ ID NO: 440664 - RNA, 64 nt, Human
uaaccaauaccaugaaugaauauacuuuaaauuuuggugauaacuguuccccauuuuuuuuuga

SEQ ID NO: 440665 - RNA, 64 nt, Human
cgaccaguuuucguuguauuguuguucaauuaaauggugauauagggaaaagagaacaaauuug

SEQ ID NO: 440666 - RNA, 64 nt, Human
aaaagugauaauuagacacuuuagaggauauacuuggugauaaugugaaugauguaaucagacu

SEQ ID NO: 440667 - RNA, 64 nt, Human; identical to SEQ ID NO: 314155

SEQ ID NO: 440668 - RNA, 64 nt, Human; identical to SEQ ID NO: 313995

SEQ ID NO: 440669 - RNA, 64 nt, Human; identical to SEQ ID NO: 313996

SEQ ID NO: 440670 - RNA, 64 nt, Human
gaauaagcagaaguuuacagcaugauaguccaaguggugauaacuuuaaauaaaacucaaauuu

SEQ ID NO: 440671 - RNA, 64 nt, Human
aggaaacaggccaaggcaggacauggcuggaccauggugauacagcucugugugauucaaguuc

SEQ ID NO: 440672 - RNA, 64 nt, Human
ugcuaguuagaaguacauauugagguuuuaaugguggugauagugaguuuuguggcaccagcug

SEQ ID NO: 440673 - RNA, 64 nt, Human
auuuguggucuauuuaauuacaaagagauugugauggugauaauuugaauaccaucuuucuaug

SEQ ID NO: 440674 - RNA, 64 nt, Human
ccaggucccaccuagugaaguaauaaaccguggguggugauagugacccagugcccucacugcc

SEQ ID NO: 440675 - RNA, 64 nt, Human
aggaaaugucucaagaaccagaaauaaauaaggguggugauagaaagguauacuuuuauauuca

SEQ ID NO: 440676 - RNA, 64 nt, Human
ccugaugauagaggaaguggaagugccuuuaggauggugauacugggggaccggguagugcugg

SEQ ID NO: 440677 - RNA, 64 nt, Human
auaauuagugcuguacauuugauugcaaacaaauuggugauacuucuaaacuauaacuauaaau

SEQ ID NO: 440678 - RNA, 64 nt, Human
ucuuuacccuuagcugaaauguuuacauagcuucuggugauaucuuuucaugauuuuauaucuc

SEQ ID NO: 440679 - RNA, 64 nt, Human
cauucuuacuuugucccaggcaugcagagaaagauggugauauuuuaggccaggaguauaccuu

SEQ ID NO: 440680 - RNA, 64 nt, Human
gucacuuuccuuuugccugaaggacuuuuucugcuggugauaaacucuuucaguguuuguauau

SEQ ID NO: 440681 - RNA, 64 nt, Human
aauuuuaaaaauauaacgagggauaaauuuuugguggugauagugucccaguacaaaaaggcug

SEQ ID NO: 440682 - RNA, 64 nt, Human
gugggugguggcucuuaaggagguguuccuaaaauggugauauccucucaaaugcugcuuguug

SEQ ID NO: 440683 - RNA, 64 nt, Human
gauuuaguggccuucauguuauucagaauuguuuuggugauaccucaccccuguaaucccagca

SEQ ID NO: 440684 - RNA, 64 nt, Human
ggaaaggagaaaaugugauugcaugugguaguuguggugauagacguuuagacaggacagguua

SEQ ID NO: 440685 - RNA, 64 nt, Human
gcacgcggcuuuaagugugcugggcagagggagguggugauauuguguggucugguuccugugu

SEQ ID NO: 440686 - RNA, 64 nt, Human
uuucugcuaauuuagugaugaagccuauccaaguuggugauagcuuauuauuuucauaaguaaa

SEQ ID NO: 440687 - RNA, 64 nt, Human
aaacagggcuucacagccaggcccagaagaggucuggugauaauggcuggcccuggguggggau

SEQ ID NO: 440688 - RNA, 64 nt, Human
agacccaggcccccugccaguugaagugagaguuuggugauacugucaagcccuauccuucucu

SEQ ID NO: 440689 - RNA, 64 nt, Human
ccuuuauaaguugcuuuccucuuacuuucaguuuuggugauaaucgucuucaaauuaaagugcu

SEQ ID NO: 440690 - RNA, 64 nt, Human
cuuugugaaaugcaguguucucucuuaacgccacuggugauaggaaguaguucccuucaguuca

SEQ ID NO: 440691 - RNA, 64 nt, Human
ugugaugucugaaaaaacagaacccgaaaagcuauggugauauguacaggcauuauuucagacu

SEQ ID NO: 440692 - RNA, 64 nt, Human
caaacauuugaaaucaacuacaaguacaugggacuggugauaaaugauccuaaacuaucaaguc

SEQ ID NO: 440693 - RNA, 64 nt, Human
ugagcucagggaauaugguucuuagccaguuucuuggugauauccaguggcacuuguaauggcg

SEQ ID NO: 440694 - RNA, 64 nt, Human
aucggacagagacuggagcccaggugacaggagauggugauaccagaagucaaggguuggggug

SEQ ID NO: 440695 - RNA, 64 nt, Human
cagaggaauugcaauuuagcaggagguccucuacuggugauacccucaccuugggguaaugguc

SEQ ID NO: 440696 - RNA, 64 nt, Human
ccauauaacaccccaccccuguucgcuuccuguauggugauaucauauguaacauuuacuccug

SEQ ID NO: 440697 - RNA, 64 nt, Human
agguuuaugauuccaaaauaaagauuuauaugacuggugauacuggcuuuacagaaauuucaga

SEQ ID NO: 440698 - RNA, 64 nt, Human
aacuaaguugaaacucuuauuagaaacuuucaguuggugauauuguauucuagaagauauaaau

SEQ ID NO: 440699 - RNA, 64 nt, Human
ucuaugaaaagcccacaccuaacauuauacuucauggugauagacugaaggcugaauguuuucc

SEQ ID NO: 440700 - RNA, 64 nt, Human
caaaaugaaccauaagaucucagauaagaagugauggugauaaaacaucaaaaagugaauggaa

SEQ ID NO: 440701 - RNA, 64 nt, Human
uuuugaguugagcuuaacucuccuugucugaacuuggugauagcaaugggaacaaaguggguag

SEQ ID NO: 440702 - RNA, 64 nt, Human
uguugauccccuucuuucccaugagagagagaacuggugauacuccaacaccguccaguugugg

SEQ ID NO: 440703 - RNA, 64 nt, Human
cuccggacccugcagcagagaggccagagguagcuggugauacccuguccuguggaaggacuuc

SEQ ID NO: 440704 - RNA, 64 nt, Human
uggucugauggaacuguguauuuauuuaaaacucuggugauaaaaauaaagcugucugaacugu

SEQ ID NO: 440705 - RNA, 64 nt, Human
ucugauuuuuuuuucuuucuuucuaaucucauuuuggugauauuuaaacaaacauaaaugauug

SEQ ID NO: 440706 - RNA, 64 nt, Human
auggccaccaucucgguuggcccuuugggugugauggugauagcauuucagugacaucuucuuu

SEQ ID NO: 440707 - RNA, 64 nt, Human
cuccacuggaaucaccuaccuugccugcacuaacuggugauaauaaagaccuuauugaucaggu

SEQ ID NO: 440708 - RNA, 64 nt, Human
uuuuuccucugacccaauuuucuuaccuauaaaauggugauaaaaaccgacagguuguucaaag

SEQ ID NO: 440709 - RNA, 64 nt, Human
agcacuggagagaauuggaauggguggcgguaauuggugauacuucuuugaauguagauuucca

SEQ ID NO: 440710 - RNA, 64 nt, Human
uuaccguuuuauguaagguaauuaugaaagacauuggugauaaggugacauuuggucacaguuc

SEQ ID NO: 440711 - RNA, 64 nt, Human
gaaaaauuguuuaguuguuuucuccccugauuaauggugauauucaaguaugauacaaaaagaa

SEQ ID NO: 440712 - RNA, 64 nt, Human; identical to SEQ ID NO: 314329

SEQ ID NO: 440713 - RNA, 64 nt, Human; identical to SEQ ID NO: 314330

SEQ ID NO: 440714 - RNA, 64 nt, Human; identical to SEQ ID NO: 314331

SEQ ID NO: 440715 - RNA, 64 nt, Human
cccaaauguaccugaacuaaaaaauguuagauguuggugauaaguugacaguuaaauaaaauuc

SEQ ID NO: 440716 - RNA, 64 nt, Human
augggaugccuuuuacuuugcuaauuuuaaaaacuggugauagaugucaaauccauuaauuuau

SEQ ID NO: 440717 - RNA, 64 nt, Human
cuacaaaaaauaaauuuaaaaaacuagccagguguggugauaugcgccuguuaucucagcagcu

SEQ ID NO: 440718 - RNA, 64 nt, Human
cacacccuguccuaggcacugagagcuggagaguuggugauaagcgagacgaacacauuuccug

SEQ ID NO: 440719 - RNA, 64 nt, Human
ggcuuuccugcaagaccacugacgagcagucccauggugauaaagggcagcccggcggguccca

SEQ ID NO: 440720 - RNA, 64 nt, Human
ucgccagugaagcugcuauggagcaacaggaaacuggugauaaagcucagcugaacgacagaag

SEQ ID NO: 440721 - RNA, 64 nt, Human
cagccauuccgcauggcugguuccugaguggcucuggugauacucuccagccaccugcugacau

SEQ ID NO: 440722 - RNA, 64 nt, Human
caucuccaccauccacccaggaggccucucccacuggugauauggcuguaggaucccccuugau

SEQ ID NO: 440723 - RNA, 64 nt, Human
gagucuugugugcauugcugugaauuagcucacuuggugauauguccuauauuggcuaaauuga

SEQ ID NO: 440724 - RNA, 64 nt, Human
cauuagugagacauauuuacaaccuagaaguaacuggugauauaucucaaauuguaauuaauaa

SEQ ID NO: 440725 - RNA, 64 nt, Human
auucccagguaggggacaauaguagcauucgcaguggugauaaugcuucaagguggauguguuu

SEQ ID NO: 440726 - RNA, 64 nt, Human
agaguacguuuuacaccccaaaggguaugccccauggugauagaaauaaaaugaacauguugua

SEQ ID NO: 440727 - RNA, 64 nt, Human
accuacauacacacaaaugaaugcauguaaaaucuggugauacugaauaaagucuguggucuag

SEQ ID NO: 440728 - RNA, 64 nt, Human
guugguuugagggagcgaauucggggaaggcacuuggugauauaacuuuguuuuguuuacagag

SEQ ID NO: 440729 - RNA, 64 nt, Human; identical to SEQ ID NO: 314332

SEQ ID NO: 440730 - RNA, 64 nt, Human; identical to SEQ ID NO: 314333

SEQ ID NO: 440731 - RNA, 64 nt, Human; identical to SEQ ID NO: 314334

SEQ ID NO: 440732 - RNA, 64 nt, Human
gugaagauucagagaaggcauccuguagucuagguggugauaccugaacugagucuugagggac

SEQ ID NO: 440733 - RNA, 61 nt, Human
ucccuccugguccuaaaugaaucagaguagauggugauaaaaagggagguuuuuucagaau

SEQ ID NO: 440734 - RNA, 64 nt, Human
auguauuggggucaaaucucuacaaauuuuucuguggugauagcaaaaucaagagauggcuuac

SEQ ID NO: 440735 - RNA, 64 nt, Human
acauucugaguauuguuuguucaccuuucagacuuggugauacuggacaugucaguguaaauaa

SEQ ID NO: 440736 - RNA, 64 nt, Human
ucaauagauggcaucccucaucaggguugccagauggugauaacaguguaaggccuugggucua

SEQ ID NO: 440737 - RNA, 64 nt, Human
aauccaagaaggagguuauguguacuucauuuauuggugauaguuggaagagacugcagacuac

SEQ ID NO: 440738 - RNA, 64 nt, Human
guauacuguauuuaucggggccccggaggggaggucgcgagagccgcgucuguguauaaaagca

SEQ ID NO: 440739 - RNA, 64 nt, Human
cuuggcugaagaacuuggccaaggaacaacugagucgcgagaacauacaaucaaguuugcugga

SEQ ID NO: 440740 - RNA, 64 nt, Human
uacgucaacaucagucaccccgauaugguggacuucgcgagagggaagaccuucuuuggggccg

SEQ ID NO: 440741 - RNA, 64 nt, Human
gacacagggaaggaggcuuggaauuaggaugggaucgcgagagagaugaaacuuggaaaauuca

SEQ ID NO: 440742 - RNA, 64 nt, Human
ugcucagcuacuucucuacccuugacauccagcuucgcgagagccuagagccagaugccuaugc

SEQ ID NO: 440743 - RNA, 64 nt, Human
aaucccagcacuuugggaggccaaggcggguggaucgcgagaucaggagcucgagaccacccug

SEQ ID NO: 440744 - RNA, 64 nt, Human
uggcucuggagcccgccugcgccccccaguggacucgcgagagggugccgcgggcgagaagggc

SEQ ID NO: 440745 - RNA, 64 nt, Human
uuucuguccccagcucuugucaccgccugagaccucgcgagacuuucggucccccccgccccuu

SEQ ID NO: 440746 - RNA, 64 nt, Human; identical to SEQ ID NO: 314322

SEQ ID NO: 440747 - RNA, 64 nt, Human; identical to SEQ ID NO: 314323

SEQ ID NO: 440748 - RNA, 64 nt, Human; identical to SEQ ID NO: 314324

SEQ ID NO: 440749 - RNA, 63 nt, Human
uuauagugagauugugaaagcaaccuuaaaguuuugaagaagacugaugagacuaggugcuuu

SEQ ID NO: 440750 - RNA, 63 nt, Human
gcaauuucuaaguuucaauccugcgcuguacaguugaagaagaguguggaggaagcuauuacc

SEQ ID NO: 440751 - RNA, 63 nt, Human
agcaacacuugagcuguucaggccaguucccuguugaagaaacaguucccuguugaagaaagu

SEQ ID NO: 440752 - RNA, 63 nt, Human
aggccaguucccuguugaagaaacaguucccuguugaagaaaguagagccugacacugcuccc

SEQ ID NO: 440753 - RNA, 63 nt, Human
aucaugcaggcacugggcuccuggaagauguccuugaagaagugacgucccugagccccaaac

SEQ ID NO: 440754 - RNA, 63 nt, Human
acagucuauagaguauuagaagauuuuuacauuuugaagaaggggagcaaaucuaaaaaaaau

SEQ ID NO: 440755 - RNA, 63 nt, Human
ccuuaagaaaaaagaaaaugagcaagcaaauauuugaagaaauguauaaaaccauagauuucu

SEQ ID NO: 440756 - RNA, 63 nt, Human
aauggcuuguugaaucucagcaguuccgccaucuugaagaaugauugauugucaaacacugac

SEQ ID NO: 440757 - RNA, 63 nt, Human
acaguaugguaguguuuauaggaauccaggauguugaagaaauggcauaaugucuauauuuug

SEQ ID NO: 440758 - RNA, 63 nt, Human
aucuaagaguuguaccaccuauauaaacauccuuugaagaagaaacuaagaagcauuugcaaa

SEQ ID NO: 440759 - RNA, 63 nt, Human
uuagaggaauccuaaagucaaaacaccagagacuugaagaacuugcaaacuggcguuuuaaaa

SEQ ID NO: 440760 - RNA, 63 nt, Human
gccuugagugugcaugaaccaaaggaaauaacauugaagaaggaaaacaauauguagaaagua

SEQ ID NO: 440761 - RNA, 63 nt, Human
ugucuagcucuuaggugaagggagucucugcuuuugaagaauggcacagguaggacagaagua

SEQ ID NO: 440762 - RNA, 63 nt, Human
uauuggucuccagagugcagcucugggagccuuuugaagaaucagcacucauuaagagcugag

SEQ ID NO: 440763 - RNA, 63 nt, Human
ugcugggagccaggagagucagcucauuaaaucuugaagaaccgcuguaugcccuuuuuccuu

SEQ ID NO: 440764 - RNA, 63 nt, Human
uucuugguugauggguuggaagucaucagagguuugaagaauuacacuggccuuuguuuuucu

SEQ ID NO: 440765 - RNA, 63 nt, Human
ggggcuacccccagaccugcuccuacacugauauugaagaaccuggagaggauccuucaguuc

SEQ ID NO: 440766 - RNA, 63 nt, Human
aauccagucuugauaacagcgaggaaagagguauugaagaaacagggguggguuugaaguacu

SEQ ID NO: 440767 - RNA, 63 nt, Human
uacucagacuguugcacucuaaaccuagggagguugaagaaugagacccuuagguuuuaacac

SEQ ID NO: 440768 - RNA, 63 nt, Human
gacgucaaaugauugccaucagaaagagacaacuugaagaaaccaacaaugacuaugaaacag

SEQ ID NO: 440769 - RNA, 63 nt, Human
gagccaccaugcucggccuaaaaaacaauuuucuugaagaauccgauuuugugcauaguaaug

SEQ ID NO: 440770 - RNA, 63 nt, Human
aaaaguugguuugaaccaacuuucuagcugcuguugaagaauauauugucagaaacacaaggc

SEQ ID NO: 440771 - RNA, 63 nt, Human
gacagggccuggagccccaucggccaagaauacuugaagaaacagaguggccucccugcugug

SEQ ID NO: 440772 - RNA, 63 nt, Human
augggaccuccacuuauuuaggccucaugugcuuugaagaagcuuugagagccaaugugucuu

SEQ ID NO: 440773 - RNA, 63 nt, Human
cacaagccucgaggugccuucuucagggccugguugaagaagaugaucaguggacagucugcu

SEQ ID NO: 440774 - RNA, 63 nt, Human
aacauggaauggaauucuggaaauuauuauucauugaagaaugcaguggccaagaaaauauca

SEQ ID NO: 440775 - RNA, 63 nt, Human
auaauaugucaccuggcacauucauuuucucaguugaagaagagaaaauuugaaaauguccuu

SEQ ID NO: 440776 - RNA, 63 nt, Human
aauauuaccgugguuuaugaacuauguucagaauugaagaaaauccuaacuuucaguuagagg

SEQ ID NO: 440777 - RNA, 63 nt, Human
caauucaagccaacuggucuaagcagcauuuaauugaagaauaugugauacagccucuucaau

SEQ ID NO: 440778 - RNA, 63 nt, Human
uucaaggcagguacccucuguguacucagaaauuugaagaaguuauuugguuuuccaaaaugc

SEQ ID NO: 440779 - RNA, 63 nt, Human
uggugcauuauuuuuucauaaacgcuaaaacauuugaagaaacaauuuaauuauuuaaaauuc

SEQ ID NO: 440780 - RNA, 63 nt, Human
cuucuccauucccacugcuucacuugccuagucuugaagaaaaaaaacaaaaaacaaaaaaaa

SEQ ID NO: 440781 - RNA, 63 nt, Human
auugcacuuuuuaauaaauauucuuaacaauuuuugaagaaggauauuuuaucucauuugaga

SEQ ID NO: 440782 - RNA, 63 nt, Human
gaauuugagauguucauagcauguuuuauuacauugaagaaacuaaaacauaaaugaaaagaa

SEQ ID NO: 440783 - RNA, 63 nt, Human
cuauuccuuaugggaucauuuuuccaggacucuuugaagaaaagaaaaaacaacuaaaaaaau

SEQ ID NO: 440784 - RNA, 63 nt, Human
cacuccaucauuuaaaaccaguauauucaguaguugaagaaagagcucucccugagucaguug

SEQ ID NO: 440785 - RNA, 63 nt, Human
aagauuggaaacacaugaggcagagggaagacauugaagaaaacaucucugcuggaauauuug

SEQ ID NO: 440786 - RNA, 63 nt, Human
uaaagaauguacagagaaauuuguagguauuuuuugaagaacauuaauuuguuaaugauaugu

SEQ ID NO: 440787 - RNA, 63 nt, Human
cuuggcccucacaccagguagguucugagacacuugaagaagcuuguggcucccaagccacaa

SEQ ID NO: 440788 - RNA, 63 nt, Human
cccuagaguguuguugagaauugugcucaaaauuugaagaaugaacaaauugaacucuuugaa

SEQ ID NO: 440789 - RNA, 63 nt, Human
cgaugaagaaugucucuagaagagaaugaaggauugaagaauucaccauuagaggacauuuag

SEQ ID NO: 440790 - RNA, 63 nt, Human
guuuuauuccugaaggaacaucaguacccgaucuugaagaaauucaagauucaaaaagaauuu

SEQ ID NO: 440791 - RNA, 63 nt, Human
cgaaacaaagcccuguggaagaaaauggaaaacuugaagaagcauuaaagucauucuguuaag

SEQ ID NO: 440792 - RNA, 63 nt, Human
acaggacuguaaagauuuguugacagcaaaauguugaagaaaaaagcuuauagaauaaaagcu

SEQ ID NO: 440793 - RNA, 63 nt, Human
aauaaacgaaauguuaaaacagggucaauccauuugaagaaaaaguuggacaaaauaaucagc

SEQ ID NO: 440794 - RNA, 63 nt, Human
cuaaaucuacucuuaaauauacaacuuuggaauuugaagaauuaaugacaacaaaagggaaaa

SEQ ID NO: 440795 - RNA, 63 nt, Human
gaaaagaaacccacuaaauuuugcuuuguuuccuugaagaauguggcaacacuguuuugugau

SEQ ID NO: 440796 - RNA, 63 nt, Human
guucucucuucuccagcuuguccauuuccccacuugaagaaaacuuuugauauauaugccuua

SEQ ID NO: 440797 - RNA, 63 nt, Human
aguacagaaaagcuuuuuguguguuuaaaaaaauugaagaaaauucaggaagaaacguguuaa

SEQ ID NO: 440798 - RNA, 63 nt, Human
ccuucaguucaccccucugcacaggccucagcuuugaagaacggagucuuugcacuuacacac

SEQ ID NO: 440799 - RNA, 63 nt, Human
uguguaacuuaugucuugaguaucugggaguaguugaagaacagauaauuccuuccaaacauc

SEQ ID NO: 440800 - RNA, 63 nt, Human
ggauaugugauacugugugguugguguggaguuuugaagaaggggcuguguuugggccacgua

SEQ ID NO: 440801 - RNA, 63 nt, Human
gcaaaauacuuguaucugacacuuaggucuuguuugaagaauuuccuuucuggaagguuuuac

SEQ ID NO: 440802 - RNA, 63 nt, Human
agaaaauuuuccagugggcacuuaauggugcccuugaagaacuuccuaauccauguacauaaa

SEQ ID NO: 440803 - RNA, 63 nt, Human
uguagauaucuuaaagguguaaaguuugcaaauuugaagaaauauauauuaacacugugguca

SEQ ID NO: 440804 - RNA, 63 nt, Human
agguggagaacaguaaaaggugggcagaugucuuugaagaaaugcucaaugucugaugcuaag

SEQ ID NO: 440805 - RNA, 63 nt, Human
uuuuauggcauuuuuuuaaagaugcccuaaguguugaagaagaguuugcaaaugcaacaaaau

SEQ ID NO: 440806 - RNA, 63 nt, Human
aauauaacgucuugagauggcacauuccuacgauugaagaaggggucuugagauccccuaaac

SEQ ID NO: 440807 - RNA, 63 nt, Human
caggaaccagacuacaguggacccuggagaaccuugaagaacauuuuuccuuuucaggaaaac

SEQ ID NO: 440808 - RNA, 63 nt, Human
aacuagaaauaaauaaggauggugauagagagguugaagaagaaaugaagaagcaugaaagua

SEQ ID NO: 440809 - RNA, 63 nt, Human
gacuaauuccacagucagaacaugcaaacuuuuuugaagaaauuacuugaauaaguaguuuuc

SEQ ID NO: 440810 - RNA, 63 nt, Human
cagagagauugaaacagaauaaacgggcuguucuugaagaagcaaaaccagaauaugcauuac

SEQ ID NO: 440811 - RNA, 63 nt, Human
gcucauuuggcugucaguuugaucgucguuagauugaagaaaacaucuagaugcagcgaucgg

SEQ ID NO: 440812 - RNA, 63 nt, Human
aaaagcuuaaagcaaggcggaacagaacugcauuugaagaaguggaagaagaccuaaggcucu

SEQ ID NO: 440813 - RNA, 63 nt, Human
gcaguuaacucuuccaagaacagaagcggcauguugaagaaaaucugggggauugggaugggg

SEQ ID NO: 440814 - RNA, 63 nt, Human
gaguguuaaauauguucccuagagaaggguucuuugaagaaacacugcaauuuuggguguucu

SEQ ID NO: 440815 - RNA, 63 nt, Human
uaauacguugcaaggauuagccaaaucuucuuauugaagaaagaagaaaagugaagagugguu

SEQ ID NO: 440816 - RNA, 63 nt, Human
uuuagauuaacaaacauauuuguuaauuugaauuugaagaaaaucuugauuacuaauuacuua

SEQ ID NO: 440817 - RNA, 63 nt, Human
ucaaaaaaaaaaaaaaaaaagaaagaaauagcauugaagaaaauaccgcacaucagaggaaag

SEQ ID NO: 440818 - RNA, 63 nt, Human
aaagagaaccaugccaugcugaaaaagacaaaauugaagaagaaauguagcccccagccggua

SEQ ID NO: 440819 - RNA, 63 nt, Human
cuuaauugauaaagcucuguuuaauuuagaguuuugaagaaauagucucccuucaauuaagaa

SEQ ID NO: 440820 - RNA, 63 nt, Human
uaguaaaacuaaauguugcguggguggcaugaguugaagaaggcaaaggcuuguaaauuuacc

SEQ ID NO: 440821 - RNA, 63 nt, Human
ugccugguuuuccuacccaaauuguaccacuccuugaagaacuacaggcacaguaaaaaaaau

SEQ ID NO: 440822 - RNA, 63 nt, Human
ugcuuuggacacaguguuuuaucaccuguucauuugaagaaaaauaauaaagucagaaguuca

SEQ ID NO: 440823 - RNA, 63 nt, Human
aauucuuuuuacaaaacuauuuacuguaguguauugaagaacugcaugcagggaauugcuauu

SEQ ID NO: 440824 - RNA, 63 nt, Human
gcuaugucacuauuuuuguaaaugagguuuacguugaagaaacaguauacaagaacccugucu

SEQ ID NO: 440825 - RNA, 63 nt, Human
ugagacaacuguugaguguggcaaaauggcgccuugaagaaagaggccuaggagagcagcccu

SEQ ID NO: 440826 - RNA, 63 nt, Human
aaagagaaacuugagaaggcuugugcccaaagcuugaagaaagauuguaauagcauuuaguug

SEQ ID NO: 440827 - RNA, 63 nt, Human
cuuagguucuaucucuguagaaugucuccaagauugaagaagaaacugagcaguugaaaaaug

SEQ ID NO: 440828 - RNA, 63 nt, Human
acucaaucucagcgugugaccaauggcuucauuuugaagaaaagccacagaagauacacuucc

SEQ ID NO: 440829 - RNA, 63 nt, Human
uuuuguguuuuguuuuuuaauuuucagcaucucuugaagaaucuugcuacagccaaauggcau

SEQ ID NO: 440830 - RNA, 63 nt, Human
uuuucuuuuccagucauggcuccgaucuucaucuugaagaagagugacauugggugacugcug

SEQ ID NO: 440831 - RNA, 63 nt, Human
gaacuugcuguuuaaaaagacagaugaaauaaguugaagaaaccucauguaaugaauccacca

SEQ ID NO: 440832 - RNA, 63 nt, Human
ucauuggagaaguauuuauuuucaaauaucaaauugaagaaaaacucaauccucccaugaaaa

SEQ ID NO: 440833 - RNA, 63 nt, Human
uuggaaacuggacaggccauugccaccugcacuuugaagaagugagcaaagacguggccacau

SEQ ID NO: 440834 - RNA, 63 nt, Human
uuggaaaaaaaaagauuuaaaauaauuccugguuugaagaaauaacaaauuaaaagcuauaua

SEQ ID NO: 440835 - RNA, 63 nt, Human
ggaagaguaaguugagaagguaucaguuuaauguugaagaauugaccucagggcucaguuucc

SEQ ID NO: 440836 - RNA, 63 nt, Human
agaggcaaaggacacagaguagcuaaccuaguuuugaagaacaagaugggggguuuuaugcua

SEQ ID NO: 440837 - RNA, 63 nt, Human
aaaauguggccuguuuacaaaacauucagcacguugaagaaaguguucccaauggaguggaag

SEQ ID NO: 440838 - RNA, 63 nt, Human
ucuccugcccaauucuuggcacaggcauuauguuugaagaaaccaggauaagguacacugcuu

SEQ ID NO: 440839 - RNA, 63 nt, Human
uccucauucuggugaccaugcccagcauggcucuugaagaaaugaagagagguaucauugcug

SEQ ID NO: 440840 - RNA, 63 nt, Human
aaaaucaugcaauguuucacuuuagaauuggauuugaagaacucgacuuuaugugaucauggu

SEQ ID NO: 440841 - RNA, 63 nt, Human
uuuucuaucaucuauuccuccaagcauguuuaauugaagaaaguauuaauaucucuuuagaua

SEQ ID NO: 440842 - RNA, 63 nt, Human
aaugccaguuccacuuuaacuuuguuuuugcauuugaagaauguauguagcacuuuccuauau

SEQ ID NO: 440843 - RNA, 63 nt, Human
ucccaaaagacuccaguacuauuuuaauuuguauugaagaaguucagaaauuuaaaagcagag

SEQ ID NO: 440844 - RNA, 63 nt, Human
aguacaauucaagaaacugaguauuuaugggcauugaagaaaaaauguugagauaaaauugcu

SEQ ID NO: 440845 - RNA, 63 nt, Human
uguagaugaccuaucccacagcaaucggaguucuugaagaagaaaccagaacaaauaaaauag

SEQ ID NO: 440846 - RNA, 63 nt, Human
cuaaugcucaguucaaaaaggaaugucucaucuuugaagaaaaguauuuaaguggcuuucugc

SEQ ID NO: 440847 - RNA, 63 nt, Human
ggaaaaugccagagcuugugaacccuguuucucuugaagaacugacuagugagauggccuggg

SEQ ID NO: 440848 - RNA, 63 nt, Human
ggggauccaaccaauucaauuaaugucuucauauugaagaagagauguaccuucaauugaaaa

SEQ ID NO: 440849 - RNA, 63 nt, Human
auuaacugguaaagaacguuuauuuuauaacccuugaagaauagaaggacauaguuggauuau

SEQ ID NO: 440850 - RNA, 63 nt, Human
ucuguggauucaaccaacugcagaucaaaaauauugaagaaaaaaucgcaucuguaccaaaca

SEQ ID NO: 440851 - RNA, 63 nt, Human
uaugaauaucauugauuuuauaauuggugcuauuugaagaaaaaaauguacauuuauucauag

SEQ ID NO: 440852 - RNA, 63 nt, Human
ccuuucuugagaaagcaaagugggucccagacauugaagaaaagcauuuuuauuuguuuauuu

SEQ ID NO: 440853 - RNA, 63 nt, Human
ccuucuccaaacuuugaggcgugauuucauucauugaagaaucaauacauauuuuguuucaaa

SEQ ID NO: 440854 - RNA, 63 nt, Human
aaauuauucagugcagcccucauaguaucauacuugaagaaauugauuacaguuccacuaaau

SEQ ID NO: 440855 - RNA, 63 nt, Human
aagagugcuugaguuacagaaggcauaaguaguuugaagaaugcagcagccuuuuuguaaacu

SEQ ID NO: 440856 - RNA, 63 nt, Human
aagcugugaccugcagcucauccucacuuggcauugaagaauuccuuccagagauaaacucua

SEQ ID NO: 440857 - RNA, 63 nt, Human
caaaucuuuuuuuaaauaaguauuuuguugagguugaagaauugcuggcaauuaaaagaauag

SEQ ID NO: 440858 - RNA, 63 nt, Human
ccaaccuaaaaauaaaaaauccgaacagcauacuugaagaauguaauacucaaacucucagug

SEQ ID NO: 440859 - RNA, 63 nt, Human
aguuaagguuccauaauaaacuguuaggugcucuugaagaagaugucauggcauugccucagc

SEQ ID NO: 440860 - RNA, 63 nt, Human
cacugcugaugguuucccagagcccacacugaguugaagaaccuauuguucuucuuggcaucc

SEQ ID NO: 440861 - RNA, 63 nt, Human
ucuuaaugucugcucugagccuuaaaacacagauugaagaagaaaagaaagaaaaaacuuaaa

SEQ ID NO: 440862 - RNA, 63 nt, Human
guuugcaauaaaaagucagguuuuuuuccugauuugaagaagcaggaaaagcugacacccaga

SEQ ID NO: 440863 - RNA, 63 nt, Human
uuuuuucaugcucccuuccaggggcucagucacuugaagaaacuguugcuaaccaagcucuug

SEQ ID NO: 440864 - RNA, 63 nt, Human
gaucaauccuucuuauguuugcuuuaauguguauugaagaaaagcacuuuuuaaaaaguacuc

SEQ ID NO: 440865 - RNA, 63 nt, Human
auuccugaagacaguuuuucauaguguaggauuuugaagaaguguuuuucuuaaagcagauac

SEQ ID NO: 440866 - RNA, 63 nt, Human
aucuuucauaccauaucacacuacuaccacuuuuugaagaaucaucaaagagcaaugcaaaug

SEQ ID NO: 440867 - RNA, 63 nt, Human
auuugucauaccgcaucacacuaccacugcuuuuugaagaauuaucauaaggcaaugcagaau

SEQ ID NO: 440868 - RNA, 63 nt, Human
auucaucauaccgcaucacacuaccacugcuuuuugaagaauuaucauaaggcaauggagaau

SEQ ID NO: 440869 - RNA, 63 nt, Human
uaccuaaaauggugauuuccagccuuuacugcuuugaagaaacagaauuuguaaagguaugca

SEQ ID NO: 440870 - RNA, 63 nt, Human
uuaacccuuuaaugaacuuaucuguugaguacauugaagaauauuuuucuuccuagauuuugu

SEQ ID NO: 440871 - RNA, 63 nt, Human
uggcuuaaauuaaauuuaaacaacuaaugcucuuugaagaaucauaaucagaauaaagauaaa

SEQ ID NO: 440872 - RNA, 63 nt, Human
guaaagugggcaugauuaccaugauuuuuauaguugaagaaccuaagacacagagaccaaggc

SEQ ID NO: 440873 - RNA, 63 nt, Human
cacuugugcaugcaugugauguucuaauaccaauugaagaaccgcuguagguaccucccuaau

SEQ ID NO: 440874 - RNA, 63 nt, Human
aauauaaaguuauaguuauaucuuaaaauauaauugaagaagcauaugacauauaacuuauag

SEQ ID NO: 440875 - RNA, 63 nt, Human
ccaaacugaaauaacauuugcuguuuuauagguuugaagaacauaggaaaaacuaagagguuu

SEQ ID NO: 440876 - RNA, 63 nt, Human
accaguuguaacagucucaauuuuaacuaaaacuugaagaacuaaaacaacaaugcaaaccuu

SEQ ID NO: 440877 - RNA, 63 nt, Human
aaaagaaaacugaauuguaaagauaaaucccuuuugaagaaugacuugacacuuccacucuag

SEQ ID NO: 440878 - RNA, 63 nt, Human
gacugugaacauucuuauauuauuucauguauauugaagaacauuguuaugcaaugcuuugug

SEQ ID NO: 440879 - RNA, 63 nt, Human
aaaaagaagaaaaaagaaaggaaaagaucuucuuugaagaaaaguaugucucuggaucccugg

SEQ ID NO: 440880 - RNA, 63 nt, Human
uuugggagagauuuuuuaaaauaccacaaucauuugaagaaauguauaaauaaaaucuacuuu

SEQ ID NO: 440881 - RNA, 63 nt, Human
gacagaauuaaccaaggauucuuaauuguuaauuugaagaacacauuaaccagaaagcuuaaa

SEQ ID NO: 440882 - RNA, 63 nt, Human
aacagauaaaagaagcagaagccaaagcugcucuugaagaagaaaaacgaagacaacagguaa

SEQ ID NO: 440883 - RNA, 63 nt, Human
auucuuccaacucaugggauaaaggggacucccuugaagaauuucauguuuuugggcuguaua

SEQ ID NO: 440884 - RNA, 63 nt, Human
cucuguauggguuagauuuuccaaaaucauaauuugaagaaggccagcauuuaugguagaaua

SEQ ID NO: 440885 - RNA, 63 nt, Human
uucuauguagugugcaacucuaaugucaugcuuuugaagaagagaauagcugcccauagcagc

SEQ ID NO: 440886 - RNA, 63 nt, Human
ucacugaagcuaauguuuggaaaaaauauauacuugaagaaccaauccaagugugugccccua

SEQ ID NO: 440887 - RNA, 63 nt, Human
aaaggacaaaaauauaaaguuauuaauagccauuugaagaaggaggaauuuuagaagagguag

SEQ ID NO: 440888 - RNA, 63 nt, Human
auuacagucaaagauugugucaccucaaaggccuugaagaauauauuuucuuggugaauuuuu

SEQ ID NO: 440889 - RNA, 63 nt, Human
ucuacagaguuuauucuaguauguauuuacaucuugaagaacaagaaaguuguucuugugauu

SEQ ID NO: 440890 - RNA, 63 nt, Human
uuugcaaguaugaaucacuuaaccugcugauaguugaagaacacuuuaggaguuuuguauucu

SEQ ID NO: 440891 - RNA, 63 nt, Human
gacucugcuaauauagguauuuuagaaugugaauugaagaauggaucccaaaaacuucagaaa

SEQ ID NO: 440892 - RNA, 63 nt, Human
agucaacuuuaccauuuccguauucuccauagauugaagaaauuuauaccacauaucgcauau

SEQ ID NO: 440893 - RNA, 63 nt, Human
augaaacuucaccauauuaugaucauacauauuuugaagaacagacugaccaaagcucaccug

SEQ ID NO: 440894 - RNA, 63 nt, Human
ccccgucucccccuccaaaaaaaaaguggauauuugaagaaaagcauuccauauuuuaauacg

SEQ ID NO: 440895 - RNA, 63 nt, Human
gacaauuuuaauggaaauaacuacuguagacuauugaagaaugaucucuuugugauuuaagaa

SEQ ID NO: 440896 - RNA, 63 nt, Human
caagaaaccuugaaaagcaccugucaaauggcuuugaagaagugaugccaccaucucuagcca

SEQ ID NO: 440897 - RNA, 63 nt, Human
ccaacguucaugcauuuuuaaagacagaaggccuugaagaauuuguucuuguaaauccaacac

SEQ ID NO: 440898 - RNA, 63 nt, Human
uugaaagacaucaaugaaacagaaggggcguucuugaagaauucauaauuuuaagcaguuagu

SEQ ID NO: 440899 - RNA, 63 nt, Human
ggaagaaaaagauuaagaaaaagcaagauaauuuugaagaaggacgagaggaagaggcaugaa

SEQ ID NO: 440900 - RNA, 63 nt, Human
uugaaaaugaaacauguucuuauuuuccuuaaauugaagaaaacccuuuaguugucuacauug

SEQ ID NO: 440901 - RNA, 63 nt, Human
agaaaccuaacuuuaguagcaaaucuugauuaauugaagaaauaaaauauuucggauaagguu

SEQ ID NO: 440902 - RNA, 63 nt, Human
uuucauauauaauuauugaggacuacacaccaauugaagaaacugccauuacugugauguuuc

SEQ ID NO: 440903 - RNA, 63 nt, Human
uuuguuauccuugaaauagccuaaguaauguuauugaagaacuaaugaacagguaacauauug

SEQ ID NO: 440904 - RNA, 63 nt, Human
gcacaggaaaaguaauucagauguuaaugccacuugaagaaguugguaggcuagcaaagagga

SEQ ID NO: 440905 - RNA, 63 nt, Human
ucaaauaguacuucuaccacuguuuggagaaaauugaagaaaagaauaagaugauuaaaugaa

SEQ ID NO: 440906 - RNA, 60 nt, Human
ugauuguuccuccuaugugaaagaauugccuugaagaauuguauuaaugaagagguugga

SEQ ID NO: 440907 - RNA, 63 nt, Human
ggaggugagggccuucauuaauugagaucacgauugaagaagaucccagcucuuucuggcuga

SEQ ID NO: 440908 - RNA, 63 nt, Human
ucugugccauuucucagggaaguaagauguaaauugaagaagccucacacguaaaagaaaugu

SEQ ID NO: 440909 - RNA, 63 nt, Human
aggcucugcuauagcggaaauucuuaauaauguuugaagaagggccccaugauuucauuuugu

SEQ ID NO: 440910 - RNA, 63 nt, Human
agaguaaaauuccucuuacuguaauaaaaacaauugaagaagacuguugccacuuaaccauuc

SEQ ID NO: 440911 - RNA, 63 nt, Human
agacauaaugauuuauuugaaggcuuguuuuauuugaagaaaagcauauugccaaaaauucug

SEQ ID NO: 440912 - RNA, 63 nt, Human
agagucgggucugcuuuccaaaguauaggacauuugaagaacugguaugcuacucacugguga

SEQ ID NO: 440913 - RNA, 63 nt, Human
augaauuuucaaggaacguaucuuauauggauuuugaagaaucuuguuugcuuauaagaacuu

SEQ ID NO: 440914 - RNA, 63 nt, Human
uuacauuuagucuuccuuucgauauaaaacucuuugaagaaauaugauuuuuagaaaucagcu

SEQ ID NO: 440915 - RNA, 63 nt, Human
uucucuaaccaacuauauaucaagacccaaaaauugaagaaaaauauuguuuucucauacagu

SEQ ID NO: 440916 - RNA, 63 nt, Human
ccggagccaagacuuguggacagcacuucacaguugaagaagggccuucacacacaaaaccug

SEQ ID NO: 440917 - RNA, 63 nt, Human
uuauuugcuuugccugagcucagaucaaaauguuugaagaaaggaacuuuauuuuugcaaguu

SEQ ID NO: 440918 - RNA, 63 nt, Human
auuucacauaaaaguccagauccacagcuucucuugaagaaugaccaccuggcuacgccggcu

SEQ ID NO: 440919 - RNA, 63 nt, Human
auaggaaugacuauuacugccauauuuauuuaguugaagaaugucuuuguguuaauucauuca

SEQ ID NO: 440920 - RNA, 63 nt, Human
auccuuucauaggagaacacacugaggagauacuugaagaauuuggauucagccgcgaagaga

SEQ ID NO: 440921 - RNA, 63 nt, Human
augaauaugugauguauuuuuguccagugaaucuugaagaaaaaucuuuugguggaggugccu

SEQ ID NO: 440922 - RNA, 63 nt, Human
ucaagaauuugccacguauguucaagggugaauuugaagaauuucagaaccacugguauccag

SEQ ID NO: 440923 - RNA, 63 nt, Human
uacagggaagccaaaagaaugaucuagaguauguugaagaagauggacauguggugguacgaa

SEQ ID NO: 440924 - RNA, 63 nt, Human
ugcuugugagaacuugaacuguuuacuaguuaauugaagaaaaaguguaacacuaaggugaac

SEQ ID NO: 440925 - RNA, 63 nt, Human
ggucaaaagaauaauacaaaaauaguaaaggucuugaagaaugccagcgaagcaauucuuuuu

SEQ ID NO: 440926 - RNA, 63 nt, Human
gagacagcauaacagaugcagaacaagucauauuugaagaauguuuuguacuaaacuucauuu

SEQ ID NO: 440927 - RNA, 63 nt, Human
aucguguucauagugucuguauguaaacugaacuugaagaaaauauauugaaauuaaagcugu

SEQ ID NO: 440928 - RNA, 61 nt, Human
cuucaagacuaaugcauaauauuaaacaucauguugaagaaauaauuuuaguuucguaauu

SEQ ID NO: 440929 - RNA, 63 nt, Human
auauuuuuaugaaaaagcaguagaaaauuacuuuugaagaaaacaggcuauuuaaauauugaa

SEQ ID NO: 440930 - RNA, 63 nt, Human
ccccucccagcuuuguuugagauccugaaaaucuugaagaagguauuccucaccuuucuugcc

SEQ ID NO: 440931 - RNA, 63 nt, Human
agaagaguugaaggcaugggagccaacauuuuauugaagaagccacagaggcugaaauucaau

SEQ ID NO: 440932 - RNA, 63 nt, Human
aaagaucaaauucuauaucccagauaccuucccuugaagaaaugcagcagcugagaaguugua

SEQ ID NO: 440933 - RNA, 63 nt, Human
uuguagucuuuuaaaguuguaugaacccuuaauuugaagaacuaacuugauuucuagagaaau

SEQ ID NO: 440934 - RNA, 63 nt, Human
ccuuucauugagccuuuuauccucuguucuccuuugaagaaccccucacugucaccuucccga

SEQ ID NO: 440935 - RNA, 63 nt, Human
auaaauaugcaugauaguauaauccaguaaugguugaagaauguauuuuacuuaaagagggau

SEQ ID NO: 440936 - RNA, 64 nt, Human
uuaaagaaaaugcuuuaguuuucuucuguucuucacugucuacagugugcuuuuguauauggau

SEQ ID NO: 440937 - RNA, 64 nt, Human
ccuuuuuauuucuuacuguacugucucuuacuguacugucuaucugcaguaauugaggacccau

SEQ ID NO: 440938 - RNA, 64 nt, Human
gcaauuuuaaagucuucugaugucauaucauuucacugucuaggcuacaacaggauucuaggug

SEQ ID NO: 440939 - RNA, 64 nt, Human
cuugaauaagaaaauaaguuuuccauuccuaugaacugucuaauaucuuucuauuacagaaggg

SEQ ID NO: 440940 - RNA, 64 nt, Human
aaaauaauucagccaagucuauuugaaauagaaaacugucuauuuaauauaguaaaaucaaugc

SEQ ID NO: 440941 - RNA, 64 nt, Human
cuuauugggguugaagcucuucagaggagcuggaacugucuaccccagggacacacccauuucg

SEQ ID NO: 440942 - RNA, 64 nt, Human
cacaaguuuuagccuuuuucacaagggaacucauacugucuacacaucagaccauaguugcuua

SEQ ID NO: 440943 - RNA, 64 nt, Human
gguuauccuggagaaaauggacucaggagcuaauacugucuacaguggagcuuggugcaauuag

SEQ ID NO: 440944 - RNA, 64 nt, Human
caaaacagaaaaacagaagacaaaaaauagagaucagcaagaaaacacacgcccugcccugcca

SEQ ID NO: 440945 - RNA, 64 nt, Human
guaauucugaaguuuuuuaaauuuauggcuauuuuuacacgaugaugaauuuugacaguuugug

SEQ ID NO: 440946 - RNA, 64 nt, Human
gcuaauguuuuccacaagacugaacaacguguauuuacacgaggguagacggcagaugccugac

SEQ ID NO: 440947 - RNA, 54 nt, Human
uguauuuuucuuuccaguaaagaauugaagaaaaguuaagagcugccgaaaugc

SEQ ID NO: 440948 - RNA, 63 nt, Human
aaccuuugguuacuuuuauucuguuaaacagaauugaagaaagaguauuauaccagaguguag

SEQ ID NO: 440949 - RNA, 63 nt, Human
uucucaaucuuuauagaaacgauucugcugguuuugaagaacagauguauuacacuaacugua

SEQ ID NO: 440950 - RNA, 63 nt, Human
gugugcccgucugugacuuucuacucaccaagguugaagaaaggaaacggggaaaaucaaaag

SEQ ID NO: 440951 - RNA, 63 nt, Human
ugcauucaggacaaggguaaagcaauacuugcuuugaagaaucacauuucgacucggucugcu

SEQ ID NO: 440952 - RNA, 63 nt, Human
auaggaauaguuuguugucagaagcacuuucacuugaagaaccuaaaaugauugacucauuca

SEQ ID NO: 440953 - RNA, 63 nt, Human
guguccagugaaacuuaugacuuggauauaugguugaagaaucaaaacaaaagcaaaaaaaaa

SEQ ID NO: 440954 - RNA, 63 nt, Human
gccauguuaauuuuauugagcaugagaaaguauuugaagaaacuguugcacaacauaugauga

SEQ ID NO: 440955 - RNA, 63 nt, Human
agcuuaaucucuguacauuuuucucauuucuaauugaagaagaaagggagggcagagaggaca

SEQ ID NO: 440956 - RNA, 63 nt, Human
acauucuuucuaagcaguuuugugugggauaauuugaagaauauauuaugaguaaacuccgaa

SEQ ID NO: 440957 - RNA, 63 nt, Human
ggaagcccuccaagaaaaaaaauagaaaagcacuugaagaauauucccaauauucccggucag

SEQ ID NO: 440958 - RNA, 63 nt, Human
uaguauuauuaccuucugauauaugugucauuauugaagaaccauaccuuuuaaaguuauuau

SEQ ID NO: 440959 - RNA, 63 nt, Human
uacaaaggugcuaauuaauaguauuucagauacuugaagaauguugauggugcuagaagaauu

SEQ ID NO: 440960 - RNA, 63 nt, Human
uggaaugucagaaaugacuuuaucaucgucaucuugaagaaaaauaugaacacugaugaaggu

SEQ ID NO: 440961 - RNA, 63 nt, Human
ugaacuauuauaauauuuuugcugacuacccaguugaagaaaaguuuguuaauuggaugggau

SEQ ID NO: 440962 - RNA, 63 nt, Human
gcaccguuguaaccagagaacuauuacuaggccuugaagaaccugucuaacuggaugcucauu

SEQ ID NO: 440963 - RNA, 63 nt, Human
auggcagagaccucauguggccaguuugauugauugaagaauguaucacucuuauucaagcaa

SEQ ID NO: 440964 - RNA, 63 nt, Human
uuuaagaaacuauacacuguuucucauaaucucuugaagaagggcuucugauucuacaauuuu

SEQ ID NO: 440965 - RNA, 63 nt, Human
cucauggggaggaaaaaggaagagucaacucacuugaagaagagggucuugagaaauccuuag

SEQ ID NO: 440966 - RNA, 63 nt, Human
uaaggagucaaauuguuucuuaucauuuguucauugaagaacagagaccugucuggaaaaucg

SEQ ID NO: 440967 - RNA, 63 nt, Human
ugcccagauaaugauaauaaugcuuaauaauaauugaagaaugggaaagagaaagagacagag

SEQ ID NO: 440968 - RNA, 63 nt, Human
guuaauggauuaaaaauagagcaagaaggcaacuugaagaaacgcuucagaacucguugcuuu

SEQ ID NO: 440969 - RNA, 63 nt, Human
auaaaguugugucugauuaauauucaucuuuuauugaagaaagugccuucugauggccacaua

SEQ ID NO: 440970 - RNA, 63 nt, Human
agaguuccagaauguucuuuuguuugcuaaaccuugaagaaacaugugccucagccuagaugu

SEQ ID NO: 440971 - RNA, 63 nt, Human
auuuuacuuuuggaagacaagauuauuagaauauugaagaaaaauuggagacuuauaaucaug

SEQ ID NO: 440972 - RNA, 63 nt, Human
gacuccugauggggugagacuaucuacugucuuuugaagaauuuauauuuggaaaguaaaaaa

SEQ ID NO: 440973 - RNA, 63 nt, Human
cuacacagaaccccacuacuuaccaggcauggauugaagaagauugucuacucaaauggcauu

SEQ ID NO: 440974 - RNA, 63 nt, Human
auuuuagauguuauuaugcuaauauaguagggguugaagaaaacaaaauagcuuauuauagaa

SEQ ID NO: 440975 - RNA, 63 nt, Human
ccagaagcaagacuaauggaaauguggagagaauugaagaaagcgcacuuucacucuuaaugg

SEQ ID NO: 440976 - RNA, 63 nt, Human
cuuuaucuuuuuugacaauauacuggagaaacuuugaagaacaaguucaaacugauacauaua

SEQ ID NO: 440977 - RNA, 63 nt, Human
aaacaaaauagcaauaaaacauaaucacucuauuugaagaaaauaucuuguuuucugccaaua

SEQ ID NO: 440978 - RNA, 63 nt, Human
cugggcaggauaggaaccuucuuggagaccccuuugaagaaaaccaggcagccaagggagcca

SEQ ID NO: 440979 - RNA, 63 nt, Human
aacggucagaaauaaguccauuaucaauauaauuugaagaagauuuuuaguaguacugugaag

SEQ ID NO: 440980 - RNA, 63 nt, Human
ccuaucauguaucuucuguacccuuaccuuauuuugaagaaaauccuagacaucaaaucauuu

SEQ ID NO: 440981 - RNA, 63 nt, Human
gcuaucagauauccucucuacccucacguuauuuugaagaaaauccuaaacaucaaauacuuu

SEQ ID NO: 440982 - RNA, 63 nt, Human
aaaaaucauucuaauuacaaaguucacuguuuauugaagaacuggcaucuuaaaucagccuuc

SEQ ID NO: 440983 - RNA, 63 nt, Human
cauaguuauuuuacaaauuguuuuuacugucuuuugaagaaguucuuaaauacguuguuaaau

SEQ ID NO: 440984 - RNA, 63 nt, Human
cagccuucauuuauaaucagugagauuccccuguugaagaaacuaaauuuuauauagguaaaa

SEQ ID NO: 440985 - RNA, 63 nt, Human
aauggcuuuuuguuaauaaagaacagauuaguuuugaagaaggcaaaaauuucaguuuucuga

SEQ ID NO: 440986 - RNA, 63 nt, Human
guccuucacggcacuggaucccaucaaagaaccuugaagaaguggcugccccuugcuggaccu

SEQ ID NO: 440987 - RNA, 63 nt, Human
auguagaaaauuauaaauguuaaaaggaaguuauugaagaaaauaaaagaaauuauguuauau

SEQ ID NO: 440988 - RNA, 63 nt, Human
aacugcugugcugaucaacgggacgcuccgucuuugaagaaagaagagauggucucuccccag

SEQ ID NO: 440989 - RNA, 63 nt, Human
cagauuccaggaggcagaagauaacuaauuguguugaagaaacuuagacuucacccaccagcu

SEQ ID NO: 440990 - RNA, 63 nt, Human
agaauguuaccuaggacauuuugauguguuaaguugaagaaagguaacucguguaugaacccc

SEQ ID NO: 440991 - RNA, 63 nt, Human
aaagcaauuauucuuccuaucugauuauuuguauugaagaaaacaaauuuaccaaaagcaaaa

SEQ ID NO: 440992 - RNA, 63 nt, Human
aguuaccauuuucaguguuauuucaaagguucuuugaagaauuuuggggcagggcaucagauu

SEQ ID NO: 440993 - RNA, 63 nt, Human
caugguguuuguuucuagaacuuuugccaguccuugaagaauggguucugugucuaauccuga

SEQ ID NO: 440994 - RNA, 63 nt, Human
ccagggaguaugaaaagcuucgggacacuuacauugaagaagcagagaaguacaaaaugcaau

SEQ ID NO: 440995 - RNA, 63 nt, Human
acaaauuggcuaaaaguacugauccauuauccuuugaagaaguuuuuccucuuuuuuggcccg

SEQ ID NO: 440996 - RNA, 63 nt, Human
cugggagguccuuggcagaacucaguuaaaucuuugaagaauauuuguaguuaucuuagaaga

SEQ ID NO: 440997 - RNA, 63 nt, Human
aaacaaucauuuacuaugucauuuuucuuuaccuugaagaacauaaacuguuauuucacuucu

SEQ ID NO: 440998 - RNA, 63 nt, Human
ucuagaauacugguaaugagaaauuguuguaaauugaagaaaacaagaugcugccauauauua

SEQ ID NO: 440999 - RNA, 63 nt, Human
ucuauuaccuuaggaguuaauuaaacaugauauuugaagaauaaugaaaugcuuuauaguugu

SEQ ID NO: 441000 - RNA, 63 nt, Human
uuugaucuucuaaucugugacgaggggcaucguuugaagaacagugccauuaagacaacuaca

SEQ ID NO: 441001 - RNA, 63 nt, Human
uuuuguuaucagauaugugaaucucuucucccuuugaagaaacuauacauuuauuguuacggu

SEQ ID NO: 441002 - RNA, 63 nt, Human
gugguuucugccuaaaauuggcacauguaaguauugaagaaaaugguuauauaauucaguuga

SEQ ID NO: 441003 - RNA, 63 nt, Human
uacauuuuggaaacaacauauuacguauaaauuuugaagaauuggaauaaaauugauucauuu

SEQ ID NO: 441004 - RNA, 63 nt, Human
acgaaauccuauauccaguuuccuguaauuuaauugaagaaaaauacauccaaauaaagacuu

SEQ ID NO: 441005 - RNA, 63 nt, Human
uccacccuggcucuugucccaagugggcuacauuugaagaauucacccaggcuccagcuagau

SEQ ID NO: 441006 - RNA, 63 nt, Human
aggcauuuggaacaacaaaucuacguaguuaacuugaagaaaccgauuuuuaaaguuggugca

SEQ ID NO: 441007 - RNA, 63 nt, Human
cccauggcccuaugcggcccagccccgaaugccuugaagaagugcccccugcaccaggacucc

SEQ ID NO: 441008 - RNA, 63 nt, Human
uacaucaaguaguggaaguguuuugaaaauucuuugaagaaugugagagcuacaccuucuacc

SEQ ID NO: 441009 - RNA, 63 nt, Human
aauuuuccucauaccuuaugcuugaggauauuguugaagaacacuuccuggaacacuucucac

SEQ ID NO: 441010 - RNA, 63 nt, Human
acagcaaaacacguuuggucuguuuuuagauucuugaagaauucaauagucuuucaagauguu

SEQ ID NO: 441011 - RNA, 63 nt, Human
gcacuuaauagaauuauuuuucaccgcuacaguuugaagaauguaaauaugcaccugaguggg

SEQ ID NO: 441012 - RNA, 63 nt, Human
aaaaccaacaaaauuuucuuguucaagcgugcauugaagaaccacauuuauucaaugguugac

SEQ ID NO: 441013 - RNA, 63 nt, Human
uaagaaaaauuaaggggggauccauugaaagacuugaagaauacauauacuuauauucgggga

SEQ ID NO: 441014 - RNA, 63 nt, Human
gguguccaaacuuuuggcuucccugggccacauuugaagaagaauuuucuugggccacauaaa

SEQ ID NO: 441015 - RNA, 63 nt, Human
guuuaaaaaaaaaaaaaaccacauaacaauucuuugaagaaaggaagggauuaaauaauuuuu

SEQ ID NO: 441016 - RNA, 63 nt, Human
guccucucccaggaacauucuuagcucggacucuugaagaaucucuuuagauuuuguuggcaa

SEQ ID NO: 441017 - RNA, 63 nt, Human
auguaccuguauuaaaagauuccagucuucucuuugaagaauuuaagaaacuuauucgcaaua

SEQ ID NO: 441018 - RNA, 63 nt, Human
acugcacucuggaauuaaagggacucuuccauuuugaagaaggcauccagaagcuguaucagu

SEQ ID NO: 441019 - RNA, 63 nt, Human
uuuuaccugucacauugcauucuauugccuucuuugaagaagguggaccuuuuaaaguguuuc

SEQ ID NO: 441020 - RNA, 63 nt, Human
agcaacaaagcucagcuggggaacgagaguaauuugaagaaugcuugaagucagcgucuucca

SEQ ID NO: 441021 - RNA, 63 nt, Human
uucacuucuggugccacaacuguuuauccuuuuuugaagaaaauaagggaacagaaaugccuu

SEQ ID NO: 441022 - RNA, 63 nt, Human
cccagucuuguguuccgaagucagucggaguacuugaagaaggcccacgggcggcacggaguu

SEQ ID NO: 441023 - RNA, 63 nt, Human
cuguuugaaguuguuuauucacaucuaucuuauuugaagaaaaagacugauguaauagaucuu

SEQ ID NO: 441024 - RNA, 63 nt, Human
auuuuaaaaaaucaaaaggcacugugaacuauuuugaagaaaacacaacauuuuaauacagau

SEQ ID NO: 441025 - RNA, 63 nt, Human
cagcacccuccccgccgggucccaccuugccuuuugaagaagagcccgcauaaugaguggacg

SEQ ID NO: 441026 - RNA, 63 nt, Human
ugugaauuucuaccaaauaguagagcauaccacuugaagaaggaaagaaccgaagagcaaaca

SEQ ID NO: 441027 - RNA, 63 nt, Human
auuugcccaccugcugccuccaggaucagcaccuugaagaagugugugggcacugccacgugg

SEQ ID NO: 441028 - RNA, 63 nt, Human
ucguagaaaaacgucuuuacaaccugaauaagauugaagaauugugaacauaccauggccuau

SEQ ID NO: 441029 - RNA, 59 nt, Human
ucgccaagaccuucgcuugaugaugacuuuugaagaaacacuauuucucuuuaagaaaa

SEQ ID NO: 441030 - RNA, 63 nt, Human
uuguacuggucuguccuuuuuuccuuugccuaauugaagaaauaauugcuuguuuucuagccu

SEQ ID NO: 441031 - RNA, 63 nt, Human
uugcuuucuuuaguguuaagaccuacucauauuuugaagaaaucuugaguuaagugaguucug

SEQ ID NO: 441032 - RNA, 63 nt, Human
ccgccccugagucagccuccuugacuugauagcuugaagaauccuuuuccacugaaauagagg

SEQ ID NO: 441033 - RNA, 63 nt, Human
gauauucauugugagguucuacuagugaaauauuugaagaaacuaaauguaugucaguaugga

SEQ ID NO: 441034 - RNA, 63 nt, Human
uccagucauauuaacagaacacuccugagacaguugaagaagaaauagcacaaaucaggggua

SEQ ID NO: 441035 - RNA, 63 nt, Human
cugucuaccucacaugcaggucuagggugaggauugaagaaaauaguggugaugagggcuuua

SEQ ID NO: 441036 - RNA, 63 nt, Human
augaaggacaggaagcugaaggagaaaaguacauugaagaagcucuagccaacauguccucac

SEQ ID NO: 441037 - RNA, 63 nt, Human
gcaucauuaacaagggauaaaaguaucaauucuuugaagaaauugguuuuaaggaaacuucgg

SEQ ID NO: 441038 - RNA, 63 nt, Human
auaguaguuauuuugaagauauucaaacuuauauugaagaagugacuuuaguuccucuuguuu

SEQ ID NO: 441039 - RNA, 63 nt, Human
caaccauauuucuggaaguugagauguuucagcuugaagaaccaaaacagaaggaauauguac

SEQ ID NO: 441040 - RNA, 63 nt, Human
cugacuuugauagcuaaauuaaaccaaacccuauugaagaauugaauauaugcuacuucaaga

SEQ ID NO: 441041 - RNA, 63 nt, Human
uaacuggucuaaacuucaaauaucauuuuaccuuugaagaaaaccagaaaacauucaaaagaa

SEQ ID NO: 441042 - RNA, 63 nt, Human
uggggucaaguuggugagaggagagcucauuguuugaagaaaaaccaaaacauuuuauggcua

SEQ ID NO: 441043 - RNA, 63 nt, Human
ggaccuuugagaucauguuuguauaagcacuccuugaagaauaucuaagcuuuuucugagaug

SEQ ID NO: 441044 - RNA, 63 nt, Human
ucaugggacuucagugggaguuacacaggaauguugaagaaucauucuucuuuuucaugcauu

SEQ ID NO: 441045 - RNA, 63 nt, Human
ccaguguucccucucucccuccagggccacugcuugaagaagaauauguauguuucuaucuug

SEQ ID NO: 441046 - RNA, 63 nt, Human
gaaaauaaggguauaauuuuguaggucauaugauugaagaaaauauuauuuuaacaauguaaa

SEQ ID NO: 441047 - RNA, 63 nt, Human
gaccagccccucucuguccacuggguuuauuucuugaagaagaugcagaucugguuuuuccaa

SEQ ID NO: 441048 - RNA, 63 nt, Human
uauuucuauuuucuguaauguuuaaguaugauguugaagaaauucacauucucuuauaguuug

SEQ ID NO: 441049 - RNA, 63 nt, Human
acuuuuugaugccaaacauuauaccuuagaacauugaagaaaauauuccuaagcugaugcugg

SEQ ID NO: 441050 - RNA, 63 nt, Human
cugccuugugcccuggagugggguuucuccuuguugaagaagaggcauccuucucugaugugc

SEQ ID NO: 441051 - RNA, 63 nt, Human
cuggggcucuugcuucccgagaacgccuguggcuugaagaaccuugacugcuugguccucagg

SEQ ID NO: 441052 - RNA, 63 nt, Human
cauaucuucaagucuugaagaaguugauguuaauugaagaauucacuugucugguugaaauaa

SEQ ID NO: 441053 - RNA, 63 nt, Human
gagcaccgucuuuaauuuccauaucuucaagucuugaagaaguugauguuaauugaagaauuc

SEQ ID NO: 441054 - RNA, 63 nt, Human
aucuaccuaauuaugugaaagaagcaaaacuuuuugaagaagcaccccucuuucauguauuaa

SEQ ID NO: 441055 - RNA, 63 nt, Human
uuuguaaaauaagugugugugagacacuugcguuugaagaaagaucuaggguccugggucucu

SEQ ID NO: 441056 - RNA, 63 nt, Human
uuuucuaaaaaggcugcucacaaguucuauuucuugaagaauaaauucuaccuccuuguguug

SEQ ID NO: 441057 - RNA, 63 nt, Human
ccugcuucugggccaggccauugucacuguuaguugaagaaaaagcaguucccaggugccagc

SEQ ID NO: 441058 - RNA, 63 nt, Human
ccuugccuagaguaguaguaugaaaacuauuuguugaagaaauaaaugaauggaaagacauag

SEQ ID NO: 441059 - RNA, 63 nt, Human
aauuaacuaauaaaccugucucaaguugaggauuugaagaaagaacacagaguccaccgugcc

SEQ ID NO: 441060 - RNA, 63 nt, Human
cgcgaagacggauuucacauccacaggacggucuugaagaaaauaacacuguguauauuauuu

SEQ ID NO: 441061 - RNA, 63 nt, Human
uuuucuuccucauuuccucugccccuuaaaagauugaagaaagagaaacuugucaacucauau

SEQ ID NO: 441062 - RNA, 51 nt, Human
cuugguggugguguuucugauuugaagaaacugacauuccuuuaaaaauau

SEQ ID NO: 441063 - RNA, 63 nt, Human
ccagagaaccauucccaagccauggcaugcuccuugaagaaucucuccucucucucucucucu

SEQ ID NO: 441064 - RNA, 63 nt, Human
gagguaccuuagagggaguauuuucuuuauuuuuugaagaaaguaagauccugacucugaagc

SEQ ID NO: 441065 - RNA, 63 nt, Human
aauagcgacaguuugaguaaaagaaaagucauauugaagaagcccagaggguugugcccaggg

SEQ ID NO: 441066 - RNA, 63 nt, Human
uuuagagguagggaaaagaugaaugucagacauuugaagaacuauaguaaaaugauaaacacu

SEQ ID NO: 441067 - RNA, 63 nt, Human
accucacuuuuacaagcacugcucuagauauacuugaagaauuuaauagguacagaaguuuau

SEQ ID NO: 441068 - RNA, 63 nt, Human
accaauguccagcuacucuuuuguuuuugacacuugaagaaauggagaucgauuugauuuguu

SEQ ID NO: 441069 - RNA, 63 nt, Human
ccauaacagguacuuugaaggcaagacauaggguugaagaagcacagccagccucugaaauca

SEQ ID NO: 441070 - RNA, 63 nt, Human
ucucaccuggagcuacugggaggguaaagccauuugaagaauaaagucauccagagccucagg

SEQ ID NO: 441071 - RNA, 63 nt, Human
uuuaagauuuuaaaaaugaaaccaaaaaauaaauugaagaaaacuguaaacuuuaaagaauaa

SEQ ID NO: 441072 - RNA, 63 nt, Human
ugacucuuaauuccuauuucaauauguguuuccuugaagaauucaggauacaacuucuugugu

SEQ ID NO: 441073 - RNA, 63 nt, Human
gucuuucauguaaguuuaccuggucuuuuccuauugaagaauuuuucaucagaaacgacuggg

SEQ ID NO: 441074 - RNA, 63 nt, Human
cuguggaagcucugaccuuuuugacuucauacuuugaagaauugauguaugccucuuugccuc

SEQ ID NO: 441075 - RNA, 63 nt, Human
aaguccacuguccuccuuggcggcaaaagcccauugaagaagaaccagcccagccugcccccu

SEQ ID NO: 441076 - RNA, 63 nt, Human
ggaguugggcccuagcuuccccaaaucaguagcuugaagaaaggcaaaggagacaccuguucc

SEQ ID NO: 441077 - RNA, 63 nt, Human
cuucagcuguggguccuaaaggccuuugauccuuugaagaagaaagacaugguauuuguucag

SEQ ID NO: 441078 - RNA, 63 nt, Human
uccugaccacucuuauaaaaagcucacaaaccuuugaagaaacuggaguaggcuguuauuuca

SEQ ID NO: 441079 - RNA, 63 nt, Human
aagucuagaaugggucccuggugccuuuuuacuuugaagaaaucaguuucugccucuuuuugg

SEQ ID NO: 441080 - RNA, 63 nt, Human
ccccugcucuuggacugaauuuugugcuuuuuauugaagaauuuuauuguuuuuaucuuaaaa

SEQ ID NO: 441081 - RNA, 63 nt, Human
cuuagcauguuagguguauuaaccucaucagucuugaagaacauguggcucaugaguauaaca

SEQ ID NO: 441082 - RNA, 63 nt, Human
auuaagugagacuugaacaaaauuuuguucaucuugaagaauguauaguggcuuagguuauuu

SEQ ID NO: 441083 - RNA, 63 nt, Human
aagcucagccugggcuucagcaauugacaaaauuugaagaaauauuaaacaaaaauaacaaaa

SEQ ID NO: 441084 - RNA, 63 nt, Human
guggaucucuacuuguuggguguuaugaauucuuugaagaaauauauuuugaagagguguggg

SEQ ID NO: 441085 - RNA, 63 nt, Human
ggguaccuuucccagggguguccaccagaagaguugaagaagaggugagaagaucccaaggug

SEQ ID NO: 441086 - RNA, 63 nt, Human
uuaaaaauuguuuuaaacuacaucuugaaaauauugaagaauuuguuuuagguagagugguca

SEQ ID NO: 441087 - RNA, 63 nt, Human
gaauguuuaacuguuuuguuuacccauauuuucuugaagaauuuacaagauugaaaaaguacu

SEQ ID NO: 441088 - RNA, 63 nt, Human
guaucuauaugacuaugcguggcuggaaccacauugaagaauguuagaguaaugaaauggagg

SEQ ID NO: 441089 - RNA, 63 nt, Human
uucucuguauuagacucacacacaucaguccaguugaagaauugguuuaaacuuuuaaaugag

SEQ ID NO: 441090 - RNA, 63 nt, Human
gaauguucuguaaggacuggaaacacuagaaucuugaagaaacgccuggcuagaggugagggu

SEQ ID NO: 441091 - RNA, 63 nt, Human
cagaccguuaacacauuaaagagucugauuuuguugaagaaaauauuugcaauaaauucaaga

SEQ ID NO: 441092 - RNA, 63 nt, Human
ccccucuacagugccugguagacaagugcuacauugaagaacacaaaccucuuguuaagacuu

SEQ ID NO: 441093 - RNA, 63 nt, Human
gcugucuuuggaagagaagugcaaggcuuuccuuugaagaauuuaaauuaguccgguaggaug

SEQ ID NO: 441094 - RNA, 61 nt, Human
uuuuuguguacuuuuuucaauaaaauaucaaaguugaagaacuuuucuucuaaaaccacac

SEQ ID NO: 441095 - RNA, 63 nt, Human
caaacacuacaaacuucaucccaacuugcucacuugaagaagugugauuccagcaccguuucu

SEQ ID NO: 441096 - RNA, 63 nt, Human
aucauacugagguguuagaucaaauaucucuaauugaagaacaugugagguugaaagagcacc

SEQ ID NO: 441097 - RNA, 63 nt, Human
guguaauguuuuauugcauugauaauguuucuguugaagaaaccguuauacuugaauucaggu

SEQ ID NO: 441098 - RNA, 63 nt, Human
uuaaguaaaaaagaaaaaucagaacagggcuauuugaagaauuauuuuauacacagauucugc

SEQ ID NO: 441099 - RNA, 63 nt, Human
agaacaccccaugcgugcugagaggcgagcuccuugaagaaggggcuguucuuccaggaggcc

SEQ ID NO: 441100 - RNA, 63 nt, Human
auuggugcuuugugucuagggcagaguauguucuugaagaaaggcaaaucugacuuuuucugu

SEQ ID NO: 441101 - RNA, 63 nt, Human
uuuuuuuggaaggggguuauauaugagaguucauugaagaaguccagugaggcugaaguaaag

SEQ ID NO: 441102 - RNA, 63 nt, Human
acuacauucaaaguauuuuauaaauacuaacccuugaagaaagcaguuauauucccauuuuau

SEQ ID NO: 441103 - RNA, 63 nt, Human
auauguuagacuuaggaugauaccuucagccacuugaagaagaaauagaaggcgcucauucca

SEQ ID NO: 441104 - RNA, 63 nt, Human
uacuuucucccugacuaccaaauggagugacgguugaagaaucaagcucauaauaugauacac

SEQ ID NO: 441105 - RNA, 63 nt, Human
ucauuuaaaauauuguguuauuuauaaagucauuugaagaauauucagcacaaaauuaaauua

SEQ ID NO: 441106 - RNA, 63 nt, Human
gaacccuugcaagaagaauucuccuuguaagccuugaagaaguaugugagagggccacauugg

SEQ ID NO: 441107 - RNA, 63 nt, Human
ugaagcuggaacgugugaauuauuaggaauucuuugaagaacucugcauugagaauuauuuuu

SEQ ID NO: 441108 - RNA, 63 nt, Human
uauaggagaugagggaaugagagaaaauauuuuuugaagaagcauuucuguaaaauuagaaau

SEQ ID NO: 441109 - RNA, 63 nt, Human
aaauuacuuuuuuuaaucuauuuaaaguuuggcuugaagaaugccaucucugacuauauggcc

SEQ ID NO: 441110 - RNA, 63 nt, Human
caugagauuuuuuaguaaagaugagaaagaugguugaagaaaauuagugcauaauuucucagu

SEQ ID NO: 441111 - RNA, 63 nt, Human
guacauaagaauacacauaauucaacuagagauuugaagaauuggcuuguauaguuauaacaa

SEQ ID NO: 441112 - RNA, 63 nt, Human
ugagcaucuuauggaaauuaccccaccuuugacuugaagaaaccuucaucuaaagcaagucac

SEQ ID NO: 441113 - RNA, 63 nt, Human
uguaccgaaacacuuaauugugaaccgcuaacauugaagaaauuuugacaauuccgauuugau

SEQ ID NO: 441114 - RNA, 63 nt, Human
ucaucucuauauaucuuucucuuuuuuuuuuuuuugaagaaauggauaggagaaagaucagua

SEQ ID NO: 441115 - RNA, 63 nt, Human
caaauguggacugaaucugcuuguugaucaguguugaagaaagugcaaaaggaacuuuuauau

SEQ ID NO: 441116 - RNA, 63 nt, Human
cauagauauuuugugagcauuuuuuuguuuauuuugaagaaauguggauaagauacuugguag

SEQ ID NO: 441117 - RNA, 63 nt, Human
auaagaaauguggagaaaaguaaaaaccaagcuuugaagaaacagaagaaauuaaucuuuuag

SEQ ID NO: 441118 - RNA, 63 nt, Human
agggcuacacgugauguccccaaacugcugcuauugaagaacuucccaaaacuucuuuacaaa

SEQ ID NO: 441119 - RNA, 63 nt, Human
uuacacacaaacuguuguggguuccugccaggcuugaagaaaaugaucugaauuuuuuccucc

SEQ ID NO: 441120 - RNA, 63 nt, Human
uacuauugaaucugucugauauagaucuuaggguugaagaagcuaucuuugucuauuugggcu

SEQ ID NO: 441121 - RNA, 63 nt, Human
cuggccaagguuuggggaagaacgaagccaccuuugaagaaguaaggagucguguaugguagg

SEQ ID NO: 441122 - RNA, 63 nt, Human
aaaacucuagagaagaaaagugaagaagucauguugaagaagauguaagaaugugucaagacc

SEQ ID NO: 441123 - RNA, 63 nt, Human
ugcaaaauaucacauaagacaucaugauaacauuugaagaaaaaauaaaacuguagacccuaa

SEQ ID NO: 441124 - RNA, 63 nt, Human
acucauauggcggggugggguccuagccucaguuugaagaagugggggcuggagcgggguugg

SEQ ID NO: 441125 - RNA, 63 nt, Human
auuugagauuuuuuuuugcuuuuaagagguggauugaagaauauuugaauugacuuuauauua

SEQ ID NO: 441126 - RNA, 63 nt, Human
guuugacacuugaaaaaagauacuauuuauaaguugaagaaaguuugcuguaccacaaugcgc

SEQ ID NO: 441127 - RNA, 63 nt, Human
aauuaaggguuauacucaguuuuuaacacauuguugaagaaaagguaccagcuuuggaacgag

SEQ ID NO: 441128 - RNA, 63 nt, Human
aaauaccuuuuuuuuuuuuuuguaauuuuuuccuugaagaaccaaaguauuuuuucagcuggu

SEQ ID NO: 441129 - RNA, 63 nt, Human
ugccucaggaaaagacuaguauuugggcaauauuugaagaaagaauuuaacaggcacugaugg

SEQ ID NO: 441130 - RNA, 63 nt, Human
uuuugcuuuauuuuaaaccaaauugagauuaaauugaagaaaagcaagcaaauuaauuucagc

SEQ ID NO: 441131 - RNA, 63 nt, Human
aucauuuacccuaaauaagggugguggacuaucuugaagaacccuuucaacucuaaaaauuga

SEQ ID NO: 441132 - RNA, 63 nt, Human
aaacuaacaaauguauacgguuuuaguucaguguugaagaauuuuaauacaauauuaaauuac

SEQ ID NO: 441133 - RNA, 63 nt, Human
agaugaucaguuacauucaucaguuggugaguuuugaagaauaacuacauuuuauuucaaacu

SEQ ID NO: 441134 - RNA, 57 nt, Human
uucaauccauguuauucugaugacucuuugaagaaagaacuugaaccuaaguaauau

SEQ ID NO: 441135 - RNA, 63 nt, Human
uacauauuuugaagaauuucuauaguacauauuuugaagaauuuuuauaucaaauauaccgua

SEQ ID NO: 441136 - RNA, 63 nt, Human
agauucacaaacuuuguauuuuuaguacauauuuugaagaauuucuauaguacauauuuugaa

SEQ ID NO: 441137 - RNA, 63 nt, Human
aaaaacaugucuuuucaaaaugagaggcuuucauugaagaaaagaaaaaaacaacaguuaaaa

SEQ ID NO: 441138 - RNA, 63 nt, Human
aaguugaggaauuuccucuaccaccuuuguugcuugaagaaaaacaugucuuuucaaaaugag

SEQ ID NO: 441139 - RNA, 63 nt, Human
cuuaacaaguguacugcagaauaaacuaccucuuugaagaaauugcugaaaggaaguaaaacc

SEQ ID NO: 441140 - RNA, 63 nt, Human
uuaagagaccuuuuauacuguuuuauugccuguuugaagaaauaauuuuuaucacguuuuugu

SEQ ID NO: 441141 - RNA, 63 nt, Human
cagcagaggcaguuuggaauaagcugcggcaaguugaagaagcuguguuggacgagauugccc

SEQ ID NO: 441142 - RNA, 63 nt, Human
gcauguuuucacuaauuuaaguacuugagacucuugaagaaaauucagaaugaaguucuggag

SEQ ID NO: 441143 - RNA, 63 nt, Human
uuugugcaucuaaucuuucagauuacugugaguuugaagaagucagcuuaucuuuccaaauaa

SEQ ID NO: 441144 - RNA, 63 nt, Human
uguauucaggaagcauaaaguaguaugaaagguuugaagaauuuuuuuuuacaagacuaguuc

SEQ ID NO: 441145 - RNA, 63 nt, Human
acauacacucacucugucugguauaggcuaauuuugaagaacucccauaaguuucugcugcuu

SEQ ID NO: 441146 - RNA, 58 nt, Human
aaggaagcaggacuucuuaauuacuuacuugaagaaauauuagacaaaguucauucaa

SEQ ID NO: 441147 - RNA, 63 nt, Human
uucagaauaaguagcugugguggauauuauuauuugaagaaagaaaaaacagauuuuagggug

SEQ ID NO: 441148 - RNA, 63 nt, Human
cauauuccaugaauuuuaagacccauagaaaaguugaagaaugcuuaauuuucuuauccagua

SEQ ID NO: 441149 - RNA, 63 nt, Human
gaaauguuuugaaauauacuuaaacaacaaacuuugaagaaaguguuguuauaaaauuauuga

SEQ ID NO: 441150 - RNA, 63 nt, Human
caaugccucauuguaaugggauauugaaguucauugaagaauuacuagguugccauguggcuc

SEQ ID NO: 441151 - RNA, 63 nt, Human
aaauuguggaguuagccuccugugguaaaggaauugaagaaaauauaacaccuuacacccuuu

SEQ ID NO: 441152 - RNA, 63 nt, Human
uggacccuuguguuuugaagaaaugccaacugcuugaagaaucuccuuguuauuuguauuauu

SEQ ID NO: 441153 - RNA, 63 nt, Human
gugauauuuuucuuauaauuggacccuuguguuuugaagaaaugccaacugcuugaagaaucu

SEQ ID NO: 441154 - RNA, 63 nt, Human
uggauauauuauuguaaguuguacaaauguauuuugaagaauauuuaagaaaagcacuuuugu

SEQ ID NO: 441155 - RNA, 60 nt, Human
aaacuacugucauguacugaaucuuuccuguugaagaaauccauguuauagaaaagaacu

SEQ ID NO: 441156 - RNA, 63 nt, Human
uguuugagauuuuuaauaauaaauaauaaauuuuugaagaauggaaguggauuuugugauucu

SEQ ID NO: 441157 - RNA, 63 nt, Human
gcaaagcauagagaugguggggugguggugggguugaagaaacuuguugguauaauugucaua

SEQ ID NO: 441158 - RNA, 63 nt, Human
aguacucuugggcaguaacuggacaccuuuuauuugaagaaacaaacugaagaaaaaaugcuu

SEQ ID NO: 441159 - RNA, 63 nt, Human
ugaggacaagguauacacccaguucugaauaacuugaagaacaggcuuggcaaagaaguaagu

SEQ ID NO: 441160 - RNA, 63 nt, Human
gcuuccuuugcuguuacaauaagcuugccugccuugaagaaaagaagaccagggccaaaggga

SEQ ID NO: 441161 - RNA, 63 nt, Human
caaaaacgaaaagcuucuuccuccaagagcccauugaagaagcccagugaugagacggugaga

SEQ ID NO: 441162 - RNA, 63 nt, Human
caggaaguugaguuuucaagaugccuuguugcuuugaagaagggagugaugucaauucucuug

SEQ ID NO: 441163 - RNA, 63 nt, Human
ggugacucugggauugucaccaguuguaccaauuugaagaaccuggaauuaguagaauucuag

SEQ ID NO: 441164 - RNA, 63 nt, Human
gccagcacaaagugggagcccgauaaauauuuauugaagaaaugaaaggugacaaaaggcaga

SEQ ID NO: 441165 - RNA, 63 nt, Human
aaccagaaauaaauaaggguggugauagaaagguugaagaagaaaugaagaagcacggaagua

SEQ ID NO: 441166 - RNA, 63 nt, Human
acgaaucugacuuuguccuucuaaaggauauauuugaagaaaaacaaauuguucaugaaaaug

SEQ ID NO: 441167 - RNA, 63 nt, Human
uaaggauauuagcaacaaugauaaaacuuggccuugaagaaauuuacacaacuaguuagaacu

SEQ ID NO: 441168 - RNA, 63 nt, Human
gacaugauuuuaaaaaaggaaucaauagaugcuuugaagaaaauaaaacuuauacaguugauu

SEQ ID NO: 441169 - RNA, 63 nt, Human
uuuucacauauguagguauucauuuugaguagguugaagaagaaaaaaaauauuuaaaugaau

SEQ ID NO: 441170 - RNA, 63 nt, Human
uauccuauuuugauuuuauuuaauuuuuuaaaguugaagaauuaaauauuuuaaugguucuaa

SEQ ID NO: 441171 - RNA, 63 nt, Human
uggguuuuauagcggcugauuuuugguaguccauugaagaagagaguuugaaaguuguauacu

SEQ ID NO: 441172 - RNA, 50 nt, Human
ugcacauuuucaacauguaguugaagaagccuaaauuagguacuagaaaa

SEQ ID NO: 441173 - RNA, 63 nt, Human
uucuaguuugguuuauggggccuggauucuggcuugaagaagccauauuuggcaugggugaag

SEQ ID NO: 441174 - RNA, 63 nt, Human
ggccacagugggcagauugcuugagcccaggaguugaagaacguggcgaaaccccguaucuau

SEQ ID NO: 441175 - RNA, 63 nt, Human
aguagcauuuguacacauggcccuguauuguccuugaagaacaucaauaaaauauaugguuuu

SEQ ID NO: 441176 - RNA, 63 nt, Human
gucuccauaacccccaaaguacugcuuauuuguuugaagaauccagccaucguagugcuuuag

SEQ ID NO: 441177 - RNA, 63 nt, Human
gugcguuucauguguuuuauaagguuuguuccuuugaagaauuguaguucuuagucccacagg

SEQ ID NO: 441178 - RNA, 63 nt, Human
uaaacagacuuuuuaguccaaaauuacauagcauugaagaauauauuucacugugccauaaac

SEQ ID NO: 441179 - RNA, 63 nt, Human
cagaaauuucugauccacaaugcauggauuccuuugaagaaaaaaaagaaaaagagaaaaaaa

SEQ ID NO: 441180 - RNA, 63 nt, Human
cuugucucgaagucucuuuuuuuggcccaggccuugaagaauacacugugacuuaagaagccu

SEQ ID NO: 441181 - RNA, 63 nt, Human
auuucuauuuuuauauaauguuugcacacugaauugaagaauuguugguuuuuucuuuuuuuu

SEQ ID NO: 441182 - RNA, 63 nt, Human
aggccuauuaacaucauacauugucauuagucuuugaagaaaaaauauguaaauauauaugug

SEQ ID NO: 441183 - RNA, 63 nt, Human
uuuuacaguggcuuucugauuuuugguaguccauugaagaagggaguuugaaaguuguuguau

SEQ ID NO: 441184 - RNA, 63 nt, Human
auugaauacugucuguaucuuugguuauccuguuugaagaaaaaggacaaauaaaacauggcc

SEQ ID NO: 441185 - RNA, 63 nt, Human
augauucuaauacaggagggccagaggccaaacuugaagaacugcugguguuacauguuccaa

SEQ ID NO: 441186 - RNA, 63 nt, Human
acccuaucuuccuccaucugauuccuggaaugcuugaagaaaggggaaaucuugaguaaccuc

SEQ ID NO: 441187 - RNA, 63 nt, Human
ucuuugucuaauauauuggagucuuuaaaaguguugaagaauaaaauauuaauuagaacaacu

SEQ ID NO: 441188 - RNA, 63 nt, Human
caacagaaggauccuggucccuguacgaccucauugaagaaacaccauaaguggcguggacua

SEQ ID NO: 441189 - RNA, 63 nt, Human
uguuacuuaggcauuuuaucuuggcucaaauuguugaagaaugguggcuuguuucaugguuuu

SEQ ID NO: 441190 - RNA, 63 nt, Human
ccauuagucauaaaacuacccugaccccacuguuugaagaagaaaaggugcuuacccuggaga

SEQ ID NO: 441191 - RNA, 63 nt, Human
aauaccacucuuuguguagauauuugucguauauugaagaaaaagcuaaaaagaauggaaauc

SEQ ID NO: 441192 - RNA, 63 nt, Human
uggcauuuuucuaagcaauuuauguaauuuuauuugaagaaaauguuuuguauaauguuuuuc

SEQ ID NO: 441193 - RNA, 63 nt, Human
accucaagauagcagguuuauacuuagaaauauuugaagaaaaaaaagcguuauuuauagucc

SEQ ID NO: 441194 - RNA, 63 nt, Human
aaagauccacaaagcaguauuucuaaauaugccuugaagaacuaaaugaaguguauagcacuu

SEQ ID NO: 441195 - RNA, 63 nt, Human
cccagaucuugaagaaaaucauauaaaaagcauuugaagaaauaguacgacaacuuauuuuua

SEQ ID NO: 441196 - RNA, 63 nt, Human
uacuaaaauguggccacugagucuucccagaucuugaagaaaaucauauaaaaagcauuugaa

SEQ ID NO: 441197 - RNA, 63 nt, Human
aucaucuccaaacuaaacccucacaaguaacaguugaagaaaaaauggcaagagaucauaucc

SEQ ID NO: 441198 - RNA, 63 nt, Human
acuucuacgccaccacccaaaugggucagacccuugaagaaacgucacuucaaacucagaaug

SEQ ID NO: 441199 - RNA, 63 nt, Human
cuguucccucuuugguuuucuuagcuuuugaauuugaagaaguacuuuugaagacucccauuu

SEQ ID NO: 441200 - RNA, 63 nt, Human
ucaaaagacucagacagcuuauguacagaauguuugaagaagagaauagugacaaguggggag

SEQ ID NO: 441201 - RNA, 63 nt, Human
ugcuguccugagggacccucucauuucugacauuugaagaaaacguauaaaucuuucuuaacc

SEQ ID NO: 441202 - RNA, 63 nt, Human
uaggguccagauucccacuauggcacaaaaggauugaagaaaguagugcaugagacaccugcu

SEQ ID NO: 441203 - RNA, 63 nt, Human
caggucugggacaucgugggcacugagcugaaguugaagaaggagcucacaggccucaaccac

SEQ ID NO: 441204 - RNA, 63 nt, Human
ucuuccgcagacuuggucaucgaccuauuuuuguugaagaaugaaaggcaaugacaaguuuaa

SEQ ID NO: 441205 - RNA, 63 nt, Human
gucucuuagggcaguauuuuggggaaguggggcuugaagaagcagccuaaugaaccaacauac

SEQ ID NO: 441206 - RNA, 63 nt, Human
gaaggcagccaggcuggcagauuuccaaaagacuugaagaaccaugguaugaaggugauuggc

SEQ ID NO: 441207 - RNA, 63 nt, Human
uucuucuuccuuuuucuuucuuuuuucaauuauuugaagaacuuguggcauuuguuaaagaau

SEQ ID NO: 441208 - RNA, 63 nt, Human
uccuaagcaucuccuguucugacugcucaugaauugaagaaacugacccuuguguucacucug

SEQ ID NO: 441209 - RNA, 63 nt, Human
guagcccgugcuguuuaucaagcagugcucagcuugaagaauauuccuguuuuggagacugcc

SEQ ID NO: 441210 - RNA, 63 nt, Human
ggaggccaccacuaaagcugaaugaccugugucuugaagaaguuggcuuucuuuacaugggaa

SEQ ID NO: 441211 - RNA, 63 nt, Human
guagcccaugcuguuuaucaagcaaugcucagcuugaagaauauuccuguuuuggagacugcc

SEQ ID NO: 441212 - RNA, 63 nt, Human
cagugucaguaaauacugugcauucaguagaaguugaagaaucauuguuagaagcauuuccaa

SEQ ID NO: 441213 - RNA, 63 nt, Human
uauagucucucuaggucauagcuuucauguccauugaagaauuaccaagcccagcaaguaaaa

SEQ ID NO: 441214 - RNA, 63 nt, Human
cgcugugacugggcuccgggccuuuccacuacguugaagaagaaaaccuauuuuuaaauguaa

SEQ ID NO: 441215 - RNA, 63 nt, Human
gaauccauuacuccaugcccccuugaggcacuguugaagaaaucucacuuuucagccagggua

SEQ ID NO: 441216 - RNA, 63 nt, Human
agaucccauccuccuccuucauacccaccucuguugaagaacauguaacguacuacugccauc

SEQ ID NO: 441217 - RNA, 63 nt, Human
aaugcaguaucaucugauuuacucuuugggaucuugaagaagcucuuuuggguaucaacaccu

SEQ ID NO: 441218 - RNA, 63 nt, Human
ggcucaaagacaauguuauuuuccuucccuuucuugaagaacaaaaagaaagccgggcaugac

SEQ ID NO: 441219 - RNA, 63 nt, Human
caagaacgguugaagcucuuugaauccagggacuugaagaaagacuaggugugucccauccaa

SEQ ID NO: 441220 - RNA, 63 nt, Human
uugugguauaaaguauuauaaauuguugugaauuugaagaauccgucuacuguauuauugcua

SEQ ID NO: 441221 - RNA, 63 nt, Human
gugcuuuucuauauguacccuugauaacagauuuugaagaaauccuguaagaugauaaagcau

SEQ ID NO: 441222 - RNA, 63 nt, Human
augagccuucauacauggacugagagucagagcuugaagaaaagcuuauuuauuuuccccaac

SEQ ID NO: 441223 - RNA, 63 nt, Human
ucuaccuaggcauuugguugccaagcuccagcuuugaagaaccaaauuaagcuaccaugaaaa

SEQ ID NO: 441224 - RNA, 63 nt, Human
acaucuuaggcuggccagacuucagcuguuccuuugaagaaaaagacacagacaaagugacau

SEQ ID NO: 441225 - RNA, 63 nt, Human
aggucaauguaagaagggaaagggagaagauauuugaagaaccagaauguaaauucauguguu

SEQ ID NO: 441226 - RNA, 63 nt, Human
uuucuaaggcucgccgugagccaggucuaaaguuugaagaaaaagaaaaaucuuaaaaaaaaa

SEQ ID NO: 441227 - RNA, 63 nt, Human
cagcaaaagcugaagcagucccagcugcuggcuuugaagaaagagcugauggugcagaagcag

SEQ ID NO: 441228 - RNA, 63 nt, Human
uugcuucugaaucacuguugaguucugauuguguugaagaaggguuauccuuucauuaggcaa

SEQ ID NO: 441229 - RNA, 63 nt, Human
auuuuugugcuggggugggauuaugggucaauguugaagaauuuuuaagucuguauuauguuu

SEQ ID NO: 441230 - RNA, 63 nt, Human
uucauuauagauauuugcgccugcucuguuuacuugaagaaaaaagcacccguggagaauaaa

SEQ ID NO: 441231 - RNA, 63 nt, Human
gccuccaucuggaagucugucugccuuuguuccuugaagaaugcagcauugucuuugucuguc

SEQ ID NO: 441232 - RNA, 63 nt, Human
auugcucuguacaacgcaggcaucagaagauuauugaagaagcaccugcuacuauugcuacuc

SEQ ID NO: 441233 - RNA, 63 nt, Human
aaaaaucuuguaauguuagaauuuggagggaauuugaagaaaggaacugaggcccagaaagag

SEQ ID NO: 441234 - RNA, 63 nt, Human
gcuuagcagcugcaggcaagcauuaugcugcuauugaagaagcauuagggguaugccuggcag

SEQ ID NO: 441235 - RNA, 63 nt, Human
cugucuaagaacacagaggagaauuuauuaucauugaagaauagcuuaaaugacugcaguaac

SEQ ID NO: 441236 - RNA, 63 nt, Human
uuggugcucuguguucccagaggcaggcggagguugaagaaaggaaccugggaugaggggugc

SEQ ID NO: 441237 - RNA, 63 nt, Human
agcggaaacaggugugugugaacugggcacagauugaagaaucugccccuguugaggugggug

SEQ ID NO: 441238 - RNA, 63 nt, Human
guauauuuuccguacugcagagcuuacacaaaauugaagaauguuaauguucgaguuuucuua

SEQ ID NO: 441239 - RNA, 63 nt, Human
ucacuucuaaauuuaaagaaaacaaaauuggaguugaagaauaaguagguuuccaauuggcua

SEQ ID NO: 441240 - RNA, 63 nt, Human
uucugcccucgagaccuggcacagcaguaucccuugaagaaauccugaggcuuuguagagugc

SEQ ID NO: 441241 - RNA, 63 nt, Human
ugccacuaugauuuauuggguuucuuaaaaaucuugaagaaaauaauaaaauuuaucucacaa

SEQ ID NO: 441242 - RNA, 63 nt, Human
ugaggaaauaucacacaagugucuucauugaccuugaagaaauguauauacaguugccuuaua

SEQ ID NO: 441243 - RNA, 63 nt, Human
acuuuauguacugcugucuuuuuuuuuuuucuuuugaagaacagguuucucucuguccuugac

SEQ ID NO: 441244 - RNA, 63 nt, Human
agacuuacccuggggccuggcuuaaaagcaggauugaagaaaagggacugggggaaggaaacu

SEQ ID NO: 441245 - RNA, 63 nt, Human
auuugggucuggcccauuucaggccaucuucaguugaagaaacacccucuuaggcugugcaag

SEQ ID NO: 441246 - RNA, 63 nt, Human
ccuacucaggcccuugaggcuauuaggagaugcuugaagaacucaacaaaaucccaauccaag

SEQ ID NO: 441247 - RNA, 63 nt, Human
guguuuuucagcagacggcugaugggacaggaauugaagaagagaauugacucguaugaacag

SEQ ID NO: 441248 - RNA, 63 nt, Human
ugcuguugacccaagggccgugguccacgguacuugaagaagccagagcccacauccugugca

SEQ ID NO: 441249 - RNA, 63 nt, Human
augccagaggaucaagaaaaggaucacaguuucuugaagaagcuuguuugccuuuagaagaau

SEQ ID NO: 441250 - RNA, 63 nt, Human
cgggguaagggggacaggauacuugucacauauuugaagaaauuccauacagugaaggaaauu

SEQ ID NO: 441251 - RNA, 63 nt, Human
ugaguuuuaaaucagaacaaguuaccugucacauugaagaaaaggguaggcacuaaagggaga

SEQ ID NO: 441252 - RNA, 63 nt, Human
ugaagacucuccuaucuacugcuacagauccuguugaagaaagagcuuaccccuuucccccgg

SEQ ID NO: 441253 - RNA, 63 nt, Human
agaguuuucucaggaggugcacguuucaucaauuugaagaaagacugcauuguaauugagagg

SEQ ID NO: 441254 - RNA, 63 nt, Human
aagccuaacagauugcuagacaagagaaaaaacuugaagaaaaaagaagcuuaauuucaugcu

SEQ ID NO: 441255 - RNA, 63 nt, Human
ucugugaguuuuguucucacuuccaccucuaauuugaagaacacuuuaauugacacagaauac

SEQ ID NO: 441256 - RNA, 63 nt, Human
ugaagcuaauuuuuaaaaggccugaacuauacuuugaagaaaccccuauagaaaaggaaagcu

SEQ ID NO: 441257 - RNA, 63 nt, Human
aaucucaccacccaaauggggagguauacauguuugaagaacuguguaacucaguaauugauu

SEQ ID NO: 441258 - RNA, 63 nt, Human
ugccuccucucccuggguuuuguuaauaaaauuuugaagaaaccaaggaagcugucuccacau

SEQ ID NO: 441259 - RNA, 63 nt, Human
ucauacauuuauuauuuaugacuuuaugucacauugaagaauuucuucaugauacauuuucag

SEQ ID NO: 441260 - RNA, 63 nt, Human
uaauggauggacucuucaaaacuuaccaaauaguugaagaaaccaggugccuucucaugaugg

SEQ ID NO: 441261 - RNA, 63 nt, Human
ugcuuagcugcuaauaauccugaggcauagaaauugaagaauuuguaaaaauagaauugccuu

SEQ ID NO: 441262 - RNA, 63 nt, Human
uuagaaaaaugauuccgugaacacagauguguuuugaagaaguagcacguaauggcuuuuauc

SEQ ID NO: 441263 - RNA, 63 nt, Human
aaaaaaaaggaguaaaaggggcggguuuguuuuuugaagaacugucuuggauaccuauuuaaa

SEQ ID NO: 441264 - RNA, 63 nt, Human
uuugguuccugggagaauaggcagccccacacuuugaagaauacagaccccaguaucuagucg

SEQ ID NO: 441265 - RNA, 63 nt, Human
gcaaggcccucagggagggucauccuccauguuuugaagaagagacugagguucagagaggau

SEQ ID NO: 441266 - RNA, 63 nt, Human
augagcugaguuuuuauaguuaucugaauuccauugaagaaaaccuauuuuuguaugaauaug

SEQ ID NO: 441267 - RNA, 63 nt, Human
cugugugccaggccucacagacucccaguuggguugaagaaugguugacugaguuugauucuu

SEQ ID NO: 441268 - RNA, 63 nt, Human
caggugacucugaugcaggcgccacagccacacuugaagaaacacagcucuuggguuuuuagu

SEQ ID NO: 441269 - RNA, 63 nt, Human
uccaaggagcagagaaaacuacuagaugugaacuugaagaagguugucagcugcagccacuuu

SEQ ID NO: 441270 - RNA, 63 nt, Human
gcagaaagaggcucguucuugucuuggucccuuuugaagaaugaaugaaaccuuccuaagccu

SEQ ID NO: 441271 - RNA, 63 nt, Human
gcauauucauaaaugaaauauacuccgaguuucuugaagaagagaaaaucuucucagaaucag

SEQ ID NO: 441272 - RNA, 63 nt, Human
caaucagauggagauucuagugcucaugaaaguuugaagaacacugguaauguguggaguauc

SEQ ID NO: 441273 - RNA, 62 nt, Human
agaaacagccuaccucauagcucucaagccaguugaagaaaccuugccuuuucagcuugacc

SEQ ID NO: 441274 - RNA, 63 nt, Human
aacaacacaucgauggacuuugcuucccuguucuugaagaauacuugaaugucggggggccug

SEQ ID NO: 441275 - RNA, 63 nt, Human
aagaaaauauaagcuuuuaaagugaagaguauuuugaagaagaacauuguaguagaauuguaa

SEQ ID NO: 441276 - RNA, 63 nt, Human
aaaaaauuuguuuuuugaauggguuuuucuuuuuugaagaagucuaauaaaucuagaaggaau

SEQ ID NO: 441277 - RNA, 63 nt, Human
uucaugaaugugaggucacuaguaauacagcuguugaagaauuagagggaaauaggaaaugau

SEQ ID NO: 441278 - RNA, 63 nt, Human
cuugcugcacuuauguaaacaaucagaccacauuugaagaaacuccaccuauuuugcaaacaa

SEQ ID NO: 441279 - RNA, 63 nt, Human
gguggacauuugaagaauuauauucauuccaacuugaagaauuauucaacaccuuuaacaaug

SEQ ID NO: 441280 - RNA, 63 nt, Human
ugucaagaggagcuggguguccuggguggacauuugaagaauuauauucauuccaacuugaag

SEQ ID NO: 441281 - RNA, 63 nt, Human
acugugacuuacuucucccucuuggagaaagacuugaagaauguaaugccagugacaaugccu

SEQ ID NO: 441282 - RNA, 63 nt, Human
ugaaauugcugugguuauuauucacucugcccuuugaagaacugcagaaauucauagggcaau

SEQ ID NO: 441283 - RNA, 63 nt, Human
gaccgcccccaucccggcuuucugagcugauccuugaagaagaaaucuuccauuucugcucuc

SEQ ID NO: 441284 - RNA, 63 nt, Human
gucucugcugucuucuuacuggcuguaccacuuuugaagaagcucuugaaauggcaucucgug

SEQ ID NO: 441285 - RNA, 63 nt, Human
ccauggaacuuuuaaugaaggacagugucuucuuugaagaaaaucaagcucguguuuuuauuc

SEQ ID NO: 441286 - RNA, 63 nt, Human
auuuuuauaaacaaaauuacagacugucugaaauugaagaagaaugaacuaauaauagcauuc

SEQ ID NO: 441287 - RNA, 63 nt, Human
acucauugaagacuccuuugagaaaagucuguuuugaagaaggaaaaagaaauacuguuugag

SEQ ID NO: 441288 - RNA, 63 nt, Human
cacauauaccuauaauguguguauguguauuuauugaagaaacagauaccauacucauuucua

SEQ ID NO: 441289 - RNA, 63 nt, Human
uggaagacucaccuaauuugugaccugagacuguugaagaaauagagaggagggggcccguug

SEQ ID NO: 441290 - RNA, 63 nt, Human
caucugaacaccuacauuuccuuugcagacaaauugaagaacuggugggauuuuuuucaagaa

SEQ ID NO: 441291 - RNA, 63 nt, Human
cauuuccagcugugcagcacgucucagagauucuugaagaaugaagacauuucugcucucagc

SEQ ID NO: 441292 - RNA, 63 nt, Human
cugugacuuaacuacuuuaucuccauuuuguaguugaagaaauaaguucagagagaaagauuc

SEQ ID NO: 441293 - RNA, 63 nt, Human
gagaccuggcacuggaugcagaaacaguucaccuugaagaaccucucacuucacccuggagcc

SEQ ID NO: 441294 - RNA, 63 nt, Human
acgcggagauguggcugccgcguuugcaugaauuugaagaacacaggcuuguacacagauguu

SEQ ID NO: 441295 - RNA, 63 nt, Human
ucacuagugauguguggcaaaucaaaucaacuguugaagaaggggugaguuuucugugcuaca

SEQ ID NO: 441296 - RNA, 63 nt, Human
acucugaguccucauuguucagaaaagcaccucuugaagaacugacuuccugaacucccaguc

SEQ ID NO: 441297 - RNA, 63 nt, Human
ugggggcggggggagaguuggaugugauugcccuugaagaacaaggcugaccugagagguucc

SEQ ID NO: 441298 - RNA, 63 nt, Human
cacacacagugaagcucuuuuuucaaaguaaauuugaagaaaugcuacaaguaugagaugaga

SEQ ID NO: 441299 - RNA, 63 nt, Human
uuuguuuguuuguuuguuuguguuuuuguucuuuugaagaauagagugguauuuagaaaauaa

SEQ ID NO: 441300 - RNA, 63 nt, Human
guuggcaagugcaggaacucaguuaaaaugcaguugaagaaugucaucucccgaauugcuguc

SEQ ID NO: 441301 - RNA, 63 nt, Human
gauaaauagacauaaauauauaacaaucacuucuugaagaaguauaauuguaaauaagccaug

SEQ ID NO: 441302 - RNA, 63 nt, Human
uuacuuuccuguaacugcuuuugcuuuuaaaaauugaagaaguuuuaaacagggcuuucauuu

SEQ ID NO: 441303 - RNA, 63 nt, Human
gcguuguaguaaaugcgugcuuauccucuaagcuugaagaagggagacgaaaauccauuuguu

SEQ ID NO: 441304 - RNA, 63 nt, Human
ggaacacaguaugcaggaacaucaggcaucauuuugaagaacuuugaaauagaacuuucaaag

SEQ ID NO: 441305 - RNA, 63 nt, Human
uguuugguuagagaauaaaauugguaauugcauuugaagaauguguuaaugucauaauaaagc

SEQ ID NO: 441306 - RNA, 63 nt, Human
uuuaggaaagugaaaauauuuuuguuuuuguauuugaagaagaaugaugcauuuugacaagaa

SEQ ID NO: 441307 - RNA, 63 nt, Human
aacuauugcuuuucagggaaaucauggauaggguugaagaagguuacuauuaauuguuuaaaa

SEQ ID NO: 441308 - RNA, 63 nt, Human
caauaugcaacugaucccgcuuuuauuaauuuuuugaagaaguacacagaauuuuuacagaau

SEQ ID NO: 441309 - RNA, 63 nt, Human
uucuugauaguagccaaaguuaaauguaucacauugaagaaggcuagaaaaaaagaaugagua

SEQ ID NO: 441310 - RNA, 63 nt, Human
caaccaaaauuggccuuuuucucccucuuaauauugaagaaauucccacauuucucauuuggu

SEQ ID NO: 441311 - RNA, 63 nt, Human
uuugugcaaaaaucucauaauguuuuaauaaaguugaagaauuuguguuugggccucauucaa

SEQ ID NO: 441312 - RNA, 63 nt, Human
uuuaaucucuucuauuuuguugucguugcuuguuugaagaaaaucaugacauuccaaguugac

SEQ ID NO: 441313 - RNA, 63 nt, Human
uuuuaaaaagggagugacuuucaugaagucaguuugaagaaggagguugggagcauguuggug

SEQ ID NO: 441314 - RNA, 63 nt, Human
uucuguauucucugcaacuuugcaauguuuggcuugaagaaggagcucaguaaacaucugaau

SEQ ID NO: 441315 - RNA, 63 nt, Human
uccacccucaacaggauguggugggggugaaacuugaagaauuuuuguuuccccuucucccuu

SEQ ID NO: 441316 - RNA, 63 nt, Human
gcucuccugcugugauguggaagcuucugauauuugaagaaacacgaaugucucuguagcuuc

SEQ ID NO: 441317 - RNA, 63 nt, Human
aaagucagauuucauuuucuacccuggauguacuugaagaaaaagaauuauuuuugcauauga

SEQ ID NO: 441318 - RNA, 63 nt, Human
uguuaauaagccauucaagugccuuacacagcuuugaagaaacuaggacugcagugggcucgg

SEQ ID NO: 441319 - RNA, 63 nt, Human
uugcuaaaauuacagccugaauccuuucuuuaguugaagaaaggguaugugugugcaaguggg

SEQ ID NO: 441320 - RNA, 63 nt, Human
uguuaaaacuuugaagaaauugaacaugaccuguugaagaaauugaacaugaccuguugccuu

SEQ ID NO: 441321 - RNA, 63 nt, Human
acuccuggcucucauuauuuuuauguuaaaacuuugaagaaauugaacaugaccuguugaaga

SEQ ID NO: 441322 - RNA, 63 nt, Human
ugacgccaagcuugauguguuucuguuauuguuuugaagaagguagcucuuguggaggacuug

SEQ ID NO: 441323 - RNA, 63 nt, Human
uucaagggauaaggccuucuguacuuugcuuauuugaagaaucagugguaggagcagugaagu

SEQ ID NO: 441324 - RNA, 63 nt, Human
uccccccgccaccuguacucacccucacgcucuuugaagaaaaaaaaaaaaaucaccuugugu

SEQ ID NO: 441325 - RNA, 63 nt, Human
cuuugaagauugggaaggcucagaagggcagaguugaagaaggcauaccuuuaagagaagccc

SEQ ID NO: 441326 - RNA, 63 nt, Human
cuauauuuuucaaauccuugaaucuuuuuuggguugaagaagaagaaagcauagcuuuagaau

SEQ ID NO: 441327 - RNA, 63 nt, Human
uuaaucauaaauagacuaguuaguagaagacuuuugaagaacaaaguaaaacuuuuuuuuuuc

SEQ ID NO: 441328 - RNA, 63 nt, Human
aaaaugaauuauauaaugcagccucuuaauucuuugaagaacuaaaaaauuaggaaacaaagu

SEQ ID NO: 441329 - RNA, 63 nt, Human
aucaguuugcuaacauauuuaaagucuugaauguugaagaacucaugugauuuacccuuuuca

SEQ ID NO: 441330 - RNA, 63 nt, Human
uguucuuuugaaguugaaauacccaguaaaauguugaagaaggauggaggauuucuucauauc

SEQ ID NO: 441331 - RNA, 63 nt, Human
uugaauuuugauucuccuuggcagugaacuacuuugaagaaguggucaauggguuguugcugc

SEQ ID NO: 441332 - RNA, 63 nt, Human
uuuuuuagcugucaacucauuuucaucuguuuuuugaagaaaaauggaaaaauguaaaaggca

SEQ ID NO: 441333 - RNA, 63 nt, Human
guuuggaaaauaauuucucuuguauuaucuccuuugaagaaggcaaggcugauaauaugacaa

SEQ ID NO: 441334 - RNA, 63 nt, Human
agagcuaggguggggucuggucacacacagguguugaagaaauuauaaagauaaagcugcccc

SEQ ID NO: 441335 - RNA, 63 nt, Human
uucuuuguaugacugucauagacacaugggugcuugaagaaaggagggacccggaacuugggc

SEQ ID NO: 441336 - RNA, 63 nt, Human
aaagcacuguguacccauuaagauauggcauuauugaagaaauaaaguacauuugaaaccuuc

SEQ ID NO: 441337 - RNA, 63 nt, Human
uauuuguuugccucaugccuuuauacuuugcuguugaagaaacuacuaaucucaauuuaagau

SEQ ID NO: 441338 - RNA, 63 nt, Human
ugcaaaaauauauaaugaaaaaaucacacaauuuugaagaaaacugucaaucagcuuauaacg

SEQ ID NO: 441339 - RNA, 63 nt, Human
aguacaccuaauaacguuguguuaaaaaaguguuugaagaaaaagguacaaaaauggcuuuua

SEQ ID NO: 441340 - RNA, 63 nt, Human
uuucucaugaucauauuucacccacaucucaccuugaagaaacuuacagguagacuuaccuuu

SEQ ID NO: 441341 - RNA, 54 nt, Human
ugugcaugaagaggacauaacauuuugaagaauuccuuuuguguuuuaaaaugu

SEQ ID NO: 441342 - RNA, 63 nt, Human
caguagugaauccccucauuuugugcauucacuuugaagaaaaagguuucucaaagaugcaca

SEQ ID NO: 441343 - RNA, 63 nt, Human
uuuucaauucuagaauuuuguuuauuguucuuuuugaagaaauaaagucuuggcacaucuuau

SEQ ID NO: 441344 - RNA, 63 nt, Human
caccugggguucucugugugcaaagcuguccuuuugaagaacaguuugguugaugcaugccuu

SEQ ID NO: 441345 - RNA, 63 nt, Human
cucguguaacaugaggcccauucuucacucuguuugaagaaaauagucaguguucuuaguagu

SEQ ID NO: 441346 - RNA, 63 nt, Human
acaaugcagagaggucaccuuccuucuauggccuugaagaaacccuggagaggaccaacgagg

SEQ ID NO: 441347 - RNA, 63 nt, Human
guccauacuuaaagaccaaaucauuuguuugcuuugaagaaaaagcaaaaacaagaacaaaaa

SEQ ID NO: 441348 - RNA, 63 nt, Human
uuucaauaaauuccuuguugauguacccuuaaauugaagaaauuuaagcugcaaaaccaaauc

SEQ ID NO: 441349 - RNA, 63 nt, Human
cagccagagcuauaauuguuuuuuaaaugugucuugaagaaugcacagugacaaggggaguag

SEQ ID NO: 441350 - RNA, 63 nt, Human
gggcugguuuuuaauccucauaagaaaccagccuugaagaauuaacaauucucuucauuggua

SEQ ID NO: 441351 - RNA, 63 nt, Human
auuuaaaaaucugaaguacuauagaacauuaaguugaagaauggaaauuaagaguacguauuc

SEQ ID NO: 441352 - RNA, 63 nt, Human
uugauacaauuugagggaggcagaagucugcaguugaagaaaaaaaauaagucuguuugucau

SEQ ID NO: 441353 - RNA, 63 nt, Human
uuuccuaccacuuccaguaagaaaauggguguuuugaagaaaucauuugccuuguccucacgg

SEQ ID NO: 441354 - RNA, 63 nt, Human
aguucaagaaaugaagagcuguugaugggaugauugaagaaacagcuaugagaggauuggcuc

SEQ ID NO: 441355 - RNA, 63 nt, Human
caaauucugauugguuauguaccgucaaaagacuugaagaaauuucaugauuuugcagugugg

SEQ ID NO: 441356 - RNA, 63 nt, Human
aacguaagcacaggaaagagaaaaagaaaucuguugaagaaaggacagaagaggaaaugcuuu

SEQ ID NO: 441357 - RNA, 63 nt, Human
cagaaacugaauccauguaagaaaaaauaauuguugaagaaagaaguugauagaauucaaaaa

SEQ ID NO: 441358 - RNA, 63 nt, Human
gugagaugaugguaguacugguuucuggugaaauugaagaaccccaaaugaugaggaucucuu

SEQ ID NO: 441359 - RNA, 63 nt, Human
uggagggggaggggccagaaauaggaggagguuuugaagaauaaagccucauauccaggaaaa

SEQ ID NO: 441360 - RNA, 63 nt, Human
cucaaaaagacccagccaacugucauuaacaacuugaagaaaggagcuguugaagaugugauu

SEQ ID NO: 441361 - RNA, 63 nt, Human
agauaggugagauuuaaaauaaauaggaugagguugaagaaaaguauauuggagcgcagauaa

SEQ ID NO: 441362 - RNA, 63 nt, Human
guuuggguguccuaauuuuuuuggcagugucauuugaagaauuuuuuuaaagcaguuuauuua

SEQ ID NO: 441363 - RNA, 63 nt, Human
aaggaugcuucugagugacaccuaggaaauuauuugaagaaauucuuuuuauaucuauaccug

SEQ ID NO: 441364 - RNA, 63 nt, Human
gaaaauuauauauaccuggcuuugcuuagcuuguugaagaaaguagcagaaauuaaaucuuaa

SEQ ID NO: 441365 - RNA, 63 nt, Human
aagauaggccuggaagagacuguugaugccacuuugaagaaaagaacacugagaacuagagga

SEQ ID NO: 441366 - RNA, 63 nt, Human
ucacagggcccagcuguggcaggggugagugcauugaagaaguagguuuuggagccuuccagg

SEQ ID NO: 441367 - RNA, 63 nt, Human
cagaaaauguugagaaucccaaauuugauugauuugaagaacaugugagagguuugacuagau

SEQ ID NO: 441368 - RNA, 63 nt, Human
cugggcccugccccucuccccacauguaucccucggucugaauuagacauuccugggcacagg

SEQ ID NO: 441369 - RNA, 63 nt, Human
gaauuuucccuuuuuuuuuuuuuuuuugagacacggucugacucugucacccaggcuagagua

SEQ ID NO: 441370 - RNA, 63 nt, Human
cuccugccggagagucugcuuccugagcuuuuccggucugaggauagcauugucauuucuucu

SEQ ID NO: 441371 - RNA, 59 nt, Human
ccaaccucacguuuucuuaggucugaggccggucugaggccggucagaggccaggauug

SEQ ID NO: 441372 - RNA, 63 nt, Human
acucgaguauccaacaggcagucagagcucucccggucugaaaguugcauugccacugcuaac

SEQ ID NO: 441373 - RNA, 63 nt, Human
gucccccacucugcaccccaaaugggaagcauacggucugaauaaauccaaguuuuauucucu

SEQ ID NO: 441374 - RNA, 63 nt, Human
cagggcugacugcacaaagcuggacccauccuucggucugaccuuagcauggggcuagauuaa

SEQ ID NO: 441375 - RNA, 63 nt, Human
cucgggcugcaacccugucugugccagauugcccggucugacccugcaggaagcaaagaggug

SEQ ID NO: 441376 - RNA, 63 nt, Human
gauuuuucauguaucuuauagucacucauucuucggucugaauuuuagacgaucacagaaacg

SEQ ID NO: 441377 - RNA, 63 nt, Human
gagcuggacgucgcgguguguccucugugcccacggucugagcuagcuagcgcaccgccgagu

SEQ ID NO: 441378 - RNA, 63 nt, Human
gcauauucccacauuccauuugguagcaauaugcggucugaaugcaugcauucaugaguccau

SEQ ID NO: 441379 - RNA, 63 nt, Human
caaacaauaucaauggugaugccguccccugugcggucugaugcgccuuccuccgugacgccu

SEQ ID NO: 441380 - RNA, 63 nt, Human
uauggcccagaaacaacaggggaaacuagaguucggucugacaguccuugggguuaagucucc

SEQ ID NO: 441381 - RNA, 63 nt, Human
ucugcaccgucaucuagauuguauuguacaucucggucugaacuucauccuggcaaaaacaaa

SEQ ID NO: 441382 - RNA, 63 nt, Human
caggcauccggccuugcccaggcaucucgccugcggucugaggaagggaacagaaggucauga

SEQ ID NO: 441383 - RNA, 63 nt, Human
auauacauauguuaauucuaguccuggaugacucggucugagaagauucaauuuaaaaucaga

SEQ ID NO: 441384 - RNA, 63 nt, Human
gaaugcaccuggaaugacauuuguaacagaagacggucugacuugcuuucaguauucacaagu

SEQ ID NO: 441385 - RNA, 63 nt, Human
aauaauuuguaguaaccuuacucugagguuuuacggucugauaaugaagcacuugcaugagua

SEQ ID NO: 441386 - RNA, 63 nt, Human
uuaccugagacgaccagcacugggaguuagguacggucugaaguuaugucuagauaagacuuc

SEQ ID NO: 441387 - RNA, 63 nt, Human
gacaacuguggaaaggcgagcagaaaacuccggcggucugaggccauggaggugguugcugca

SEQ ID NO: 441388 - RNA, 63 nt, Human
ucccagccacccaccccccacucccaggacuugcggucugagccuuuuuggauaauuaauaaa

SEQ ID NO: 441389 - RNA, 63 nt, Human
ugcuguuguggguugcuuugucaaucucugccccggucugauguuuccuacagggagaugccu

SEQ ID NO: 441390 - RNA, 63 nt, Human
ccuuaaaacuuaccuggcaguggcuuugcugcacggucugaaaccaccuguucccacccucuu

SEQ ID NO: 441391 - RNA, 63 nt, Human
gcccccaccucugucucccugucuucuuuagaucggucugauugauuuuaaaaguggacccaa

SEQ ID NO: 441392 - RNA, 63 nt, Human
aggacguccuuuucuaagcaacacagucuuccucggucugagagaaaagcagcccacucuugu

SEQ ID NO: 441393 - RNA, 63 nt, Human
cuuuccauggguucaguuaucugcggucaaccacggucugacaauauuaaauggaaaauucuu

SEQ ID NO: 441394 - RNA, 63 nt, Human
auuauugcaaaguaaaggaucuuugaguagguucggucugaaagguguggccuuuauauuuga

SEQ ID NO: 441395 - RNA, 63 nt, Human
cgggcacuggacccccgggccccacggaggccgcggucugaacugcuuuccaugcugccaucu

SEQ ID NO: 441396 - RNA, 63 nt, Human
caguaaacaguggagcuggaauucaaacauguacggucugacuucuugagcccauacucaaua

SEQ ID NO: 441397 - RNA, 63 nt, Human
uagucaggaugcuccuauuccuucuaaaaauuacggucugacuagugagcaaagucuugaauu

SEQ ID NO: 441398 - RNA, 63 nt, Human
gaagaagcaacaauggccaacgaagcacugaugcggucugaggagacagcugaccuguuggcu

SEQ ID NO: 441399 - RNA, 63 nt, Human
uucccguugcgcaguugaggacaccgagguucacggucugaguaacaccucauuacaccgaag

SEQ ID NO: 441400 - RNA, 63 nt, Human
cgcccucccacuccgccaccuccguccacaccucggucugaugggcgaggucagccugcugcu

SEQ ID NO: 441401 - RNA, 64 nt, Human
ugcucugcugcaggagagggggcuaaggggcuggauccaccaaggcagcucacagcgggaaaac

SEQ ID NO: 441402 - RNA, 64 nt, Human
cacgugguucuggugggaugcacagucacuccacauccaccauugaaggaaaggaaaaaagggc

SEQ ID NO: 441403 - RNA, 64 nt, Human
ccagcaaggccagggauggccggagggcugcgggcuccgcuauuugcaaauggaugccccagug

SEQ ID NO: 441404 - RNA, 64 nt, Human
caccgcgggcgggcgcggagggaggcugcguuuccuccgcuaucagucccgucgcuucgggcac

SEQ ID NO: 441405 - RNA, 64 nt, Human
ggagaccauccuggcuaacacggugagaccccgucuccgcuaaaaauacaaaaaauuagccggg

SEQ ID NO: 441406 - RNA, 64 nt, Human
ggcccugugcggccuggucuaccuguucgcgcgccuccgcuacuuccagggcuacgcgcgcucc

SEQ ID NO: 441407 - RNA, 64 nt, Human
agaaaugguguccucuaguggaagaaauaguaggcuccgcuauucagaugcagagcacugcagc

SEQ ID NO: 441408 - RNA, 64 nt, Human
acuaacgagcaauuaguaagccaugugccagaugcuccgcuaggcaccagagggauaaaaacaa

SEQ ID NO: 441409 - RNA, 64 nt, Human
ccugccaaguucauccugguggacagcgggaggccuccgcuaacuguucucuucuuuuccuuau

SEQ ID NO: 441410 - RNA, 64 nt, Human
uuaaagagaaacaaaacuguacauuuccucauugcuccgcuacagacaacccaugucauaaccu

SEQ ID NO: 441411 - RNA, 64 nt, Human
guaguuuucuaucugucaugggcucuagcaucuacuccgcuacccaauucugucaucuccaagc

SEQ ID NO: 441412 - RNA, 64 nt, Human
ggccuuccaccgggccugaaccacagcggaggagcuccgcuaagaccuccccacccccgcuggg

SEQ ID NO: 441413 - RNA, 64 nt, Human
gacagcacccuccucuccgugcuccucagcaguccuccgcuacgcacagguagcauaguuaacg

SEQ ID NO: 441414 - RNA, 64 nt, Human
ucccaugaccugugggcucugcagauggaccucucuccgcuagagaugcccuucucccaaaugg

SEQ ID NO: 441415 - RNA, 64 nt, Human
ccuuggggacugaucgccaaagcacgucaaaauucuccgcuaucucuuugacaacaccuggcug

SEQ ID NO: 441416 - RNA, 64 nt, Human
ugagaccagccuggccaacauggagaaacuccgucuccgcuaaaaauacgaaaauuagccaggc

SEQ ID NO: 441417 - RNA, 64 nt, Human
ccuguguagagacccuuccgcgccggcguucccgcuccgcuaaagauuucaaauccaggggauu

SEQ ID NO: 441418 - RNA, 64 nt, Human
agaagugguggugggggggacaaaagacaaaaaaauccaccagagcuuuguauuuuuguuacgu

SEQ ID NO: 441419 - RNA, 64 nt, Human
ggcuaaugggagacuguagagaaaaugaaaaaagauccaccagaggacaucuuggggaggggga

SEQ ID NO: 441420 - RNA, 64 nt, Human
ccaagcacuucugguacuucagucguuuuuacugauccaccaacaccuaaagaggcuaugcuac

SEQ ID NO: 441421 - RNA, 64 nt, Human
aaacagaaguaaggauggacuggauauuaccaucauccaccauccuggcuaccagauggaaccu

SEQ ID NO: 441422 - RNA, 64 nt, Human
caagaccagccuggccaacauggugaaaccucgucuccgcuagaaauacaaaaauuagccaagc

SEQ ID NO: 441423 - RNA, 64 nt, Human
cagcagcguuuccccccaacuccuuaauuuuauucuccgcuagauuuuaacguccagccuuccc

SEQ ID NO: 441424 - RNA, 64 nt, Human
cuucccugucggccgcgcaugugcucaucccacucuccgcuaagcgggaggcugcuguuagagc

SEQ ID NO: 441425 - RNA, 64 nt, Human
ggauuggcaggugugggcucccacgcccuccucccuccgcuaaggcuuccggcugagcugugcc

SEQ ID NO: 441426 - RNA, 64 nt, Human
ggguucugaagaaaauggaugugcaaaggcuuggcuccgcuacuuguaacaagcuccagcccuu

SEQ ID NO: 441427 - RNA, 64 nt, Human
uuguggguuauucuagaaauccagucuuaaaucucuccgcuaaaguggacauuccccauaaaaa

SEQ ID NO: 441428 - RNA, 63 nt, Human
caccagccaaccauuuuaagccucuaaaagaccucgggcaagucucacagaaacugagcugca

SEQ ID NO: 441429 - RNA, 63 nt, Human
gcagguggucuaagugcugacuggcuacguaguucgggcaaauccuccaaaagggaaagggag

SEQ ID NO: 441430 - RNA, 63 nt, Human
aaauaaaauugggaugagcccuaauggaggaagucgggcaaauugaaaguauaaaugaauggg

SEQ ID NO: 441431 - RNA, 63 nt, Human
caacauucuuuauauugccaaccucggagauagucgggcaaucuugugucguuauaaugagga

SEQ ID NO: 441432 - RNA, 63 nt, Human
uuuaccuguuguuggaaacuggagaaaugauugucgggcaaccguuuauuuuuuauuguauuu

SEQ ID NO: 441433 - RNA, 63 nt, Human
cccaggaaggagaugaagguagaagcaccuggcucgggcaaggcuagaaagaugcuacguugg

SEQ ID NO: 441434 - RNA, 63 nt, Human
cuucuacuuuagguucacauaccugccugcuagucgggcaacaugaaguaggacaguucuguu

SEQ ID NO: 441435 - RNA, 63 nt, Human
augagaacuuaucauguugguguguuagguaaaucgggcaaauaugauagugucuuacauugg

SEQ ID NO: 441436 - RNA, 64 nt, Human
ccucaugcuaugacuuuuuauuucucuuccugggauccaccacccucuacucucagcugacugc

SEQ ID NO: 441437 - RNA, 64 nt, Human
aaccgcugacaucuagaacugaccuaccacaagcauccaccaaaggaguuugggauugaguuuu

SEQ ID NO: 441438 - RNA, 64 nt, Human
agucaggcuggucuugaacuccugaccucaagugauccaccaccucggccucccaaaguguuga

SEQ ID NO: 441439 - RNA, 64 nt, Human
ucacagcagucuggacucugcaccaagcagcucgauccaccaacacugucaagguggagacugg

SEQ ID NO: 441440 - RNA, 59 nt, Human
accuggaaacugcuguuugacccugguauucgggcaaagaggacaugagcaagcguauc

SEQ ID NO: 441441 - RNA, 63 nt, Human
uggcuuugucccuaugacucagaggaggguuugucgggcaaauucagguggaugaaguaugug

SEQ ID NO: 441442 - RNA, 63 nt, Human
uacuucacuguaauguugcuuuucuuauuuuagucgggcaaaccucuuguugaucauagucuu

SEQ ID NO: 441443 - RNA, 63 nt, Human
aacgugaaugguacauucaucauccacccagacucgggcaaccucaccguggccaggaguguc

SEQ ID NO: 441444 - RNA, 63 nt, Human
caaacagcagaguggagcugagcuguggaccucucgggcaacucugugggugugggggcccug

SEQ ID NO: 441445 - RNA, 56 nt, Human
acaacuauagcaugcuuugaagagucucgggcaagaaacauucaugcaugaguaua

SEQ ID NO: 441446 - RNA, 63 nt, Human
aauuaguuucaaauuuaccucagcguuuguguaucgggcaaaaaucguuuugcccgauuccgu

SEQ ID NO: 441447 - RNA, 63 nt, Human
ugcugagggggccuccaggcaggacgagacuccucgggcaagggccgugcccgcccaccucug

SEQ ID NO: 441448 - RNA, 63 nt, Human
ggaggaagaaaaugaagaaggagugauugaaugucgggcaaggcacuggcugagcugcugugg

SEQ ID NO: 441449 - RNA, 63 nt, Human
cuguguuauuuuaucuuuaauuaaugagguaauucgggcaaagaguagaauuuaagacaaaac

SEQ ID NO: 441450 - RNA, 63 nt, Human
gcagaauaaggggaaacgaguggucugcucugcucgggcaaaacaagagaugcccauuacugu

SEQ ID NO: 441451 - RNA, 63 nt, Human
uuaucauccuauucauccuggagaggaaaagugucgggcaaagggggaucuggggggagcuca

SEQ ID NO: 441452 - RNA, 63 nt, Human
cccgcccagccuuugccagaucucucgugcgguucgggcaaagccgggguagaccugggcuau

SEQ ID NO: 441453 - RNA, 63 nt, Human
guuugggaugggugucuaaggcaggaguugacaucgggcaaccaaagaaaugaguuuugggga

SEQ ID NO: 441454 - RNA, 63 nt, Human
ggcaaggcccugggggucuccuuaaaugccaccucgggcaagucccagucccaguccucggcc

SEQ ID NO: 441455 - RNA, 64 nt, Human
cucagcgcugugagucgugaagacacgggagaaaauccaccauaauaaaacugacauucaauuu

SEQ ID NO: 441456 - RNA, 64 nt, Human
cauuguagggauuuuauacucaacuauacagaguauccaccaaaguccuaaucuaaaguccugc

SEQ ID NO: 441457 - RNA, 64 nt, Human
agacuuccuagccauuucauuaaaucuauucuguauccaccagguggcagcaucuugucauacg

SEQ ID NO: 441458 - RNA, 64 nt, Human
uuuccucaaagacaacaacuaccugcccuaccccauccaccaagugcgccacauggccuuccag

SEQ ID NO: 441459 - RNA, 63 nt, Human
agaggggccagaugacacccuaaagcaggcugaucgggcaaugggagguggccaggccugcca

SEQ ID NO: 441460 - RNA, 63 nt, Human
ggaacaaucucucaggaggacuuugagcgacucucgggcaauuuucccuucgccugccauggg

SEQ ID NO: 441461 - RNA, 63 nt, Human
uccugccccuucauugacaacaccuacucgugcucgggcaagcugcuggagagggagaucaag

SEQ ID NO: 441462 - RNA, 63 nt, Human
agugugcccacccguguucuccuccaaaugcugucgggcaagauagcuccuucaugcuuuucu

SEQ ID NO: 441463 - RNA, 63 nt, Human
gaccacuuaaaguaaaaacuacaugauuuauuuucgggcaauuauguuuagcuuucaucauua

SEQ ID NO: 441464 - RNA, 63 nt, Human
gcagagccucuggcacugaccagcugccuggccucgggcaagucacuucacuucucugguccu

SEQ ID NO: 441465 - RNA, 63 nt, Human
uacagccugggcucagggaauagcugucaacacucgggcaaaguuuuugucugugcaugugua

SEQ ID NO: 441466 - RNA, 63 nt, Human
cuccgcuucugucaguauuugcaaccaagguggucgggcaaaguauugccaggagauacugaa

SEQ ID NO: 441467 - RNA, 64 nt, Human
cugcccuuacauuuuuguuucuccaucuaccaccauccaccagucuauuuauuaacuuagcaag

SEQ ID NO: 441468 - RNA, 64 nt, Human
ggccgggcuagucucgaacuccugaccucaggugauccaccagccucggccucccaaaguucug

SEQ ID NO: 441469 - RNA, 64 nt, Human
guuuaaauggugcagagagaaagguugcccagacauccaccagcuuacuguguugacagauuug

SEQ ID NO: 441470 - RNA, 64 nt, Human
ucugcuugccaugucuuuucuggaacauacuugcauccaccacagcaucaauucccuugaucca

SEQ ID NO: 441471 - RNA, 64 nt, Human
gugaugacuugcaugugacuccuacuuggcuucuauccaccaacagaaauuauaccauauagug

SEQ ID NO: 441472 - RNA, 64 nt, Human
cugcugucgguccccucccugagccagcaucuccauccaccaccccgugccagcucccgugcca

SEQ ID NO: 441473 - RNA, 64 nt, Human
cagggacucaguaccugagccucaaucaagccuuauccaccaaauacacagggaagggugaugc

SEQ ID NO: 441474 - RNA, 64 nt, Human
accacaccacaugagcccaacagguccacgauggauccaccagucccaccccagccuuuuccuu

SEQ ID NO: 441475 - RNA, 64 nt, Human
agaugaaauaaguugaagaaaccucauguaaugaauccaccaggcuggcaguggugcauauaaa

SEQ ID NO: 441476 - RNA, 56 nt, Human
accauuccaccgaaguguaaacuagcauccaccaaaugcaagaagaauaaacaugg

SEQ ID NO: 441477 - RNA, 64 nt, Human
cugaaggacagcugaaccccugggguagccuccuauccaccacugcuuaagugccuaugggaau

SEQ ID NO: 441478 - RNA, 64 nt, Human
cuccucacucaccugggacagccugagaagggacauccaccaagaccuacugaucuggaguccc

SEQ ID NO: 441479 - RNA, 64 nt, Human
gccaggauggucucuuaacuccugcccucaagugauccaccagagaggagauccucggccuccc

SEQ ID NO: 441480 - RNA, 64 nt, Human
gaacaggaugauguacaaauugcucuuccagguaauccaccacgguuaacuggaaaagcacuuu

SEQ ID NO: 441481 - RNA, 64 nt, Human
uguuguuuguuugauuacuguuuacugagccuuaauccaccaaguuuauauuuagaauuuuauu

SEQ ID NO: 441482 - RNA, 64 nt, Human
uauaucguaggacucaguggggacuugcaugcacauccaccauugucucugaguaguauugaaa

SEQ ID NO: 441483 - RNA, 64 nt, Human
ucccauccccauggugcuuuggccuccucaaagcauccaccaugguggauggacugaagugugu

SEQ ID NO: 441484 - RNA, 64 nt, Human
cccacaaaguuauuuaaaagaugcccuagcagcaauccaccaguuuuucuaagcuagaaccuuu

SEQ ID NO: 441485 - RNA, 64 nt, Human
gcuccccgcuccacaagacaccugugcuuuggaaauccaccaccaaucccgaucggcucuuauu

SEQ ID NO: 441486 - RNA, 64 nt, Human
auauagucaacucuugauuauccacguguggauuauccaccaugccaggaagacccauaacugg

SEQ ID NO: 441487 - RNA, 64 nt, Human
gggugaauccgaaugacagugcagacguucucccauccaccaugucugagcuugggggaauugc

SEQ ID NO: 441488 - RNA, 64 nt, Human
uugaacuaaaauaauuuuauuaugcaaccaguuuauccaccaagaacauaagaauuuuuuauaa

SEQ ID NO: 441489 - RNA, 64 nt, Human
agggaauaagaaacccuucuucuguaucccaauaauccaccaggauaaaggagaaacuagaaau

SEQ ID NO: 441490 - RNA, 64 nt, Human
uuauugggggagggagggacaaacacucccaaucauccaccagucagacugaauguguagcugg

SEQ ID NO: 441491 - RNA, 64 nt, Human
gcuaggccaaugaaggcugaaucaaagacauuucauccaccaauaucauguguagauauuaugu

SEQ ID NO: 441492 - RNA, 64 nt, Human
aggugcccugaacucaguacagccucaucuucucauccaccaccuucuccugcuucuccuguca

SEQ ID NO: 441493 - RNA, 64 nt, Human
uugcccaggcuggucucgaacuccugaccgcgugauccaccaccucagcuucccaaaguggugg

SEQ ID NO: 441494 - RNA, 64 nt, Human
gaaaauaggauccaaaacacggcuggguuucagcauccaccaaugaacugaaaggugaauaaag

SEQ ID NO: 441495 - RNA, 64 nt, Human
ggggcuuuuucuuuaucacccucagucuuaauccauccaccagagucuagaaggccagacgggc

SEQ ID NO: 441496 - RNA, 64 nt, Human
ugauauucugaaagugaauaaaagaaauuaacuuauccaccaaccacaaaaacuggccaugcua

SEQ ID NO: 441497 - RNA, 64 nt, Human
uucuaacacccucagucagugacacacccaucccauccaccacuucccccgugugggguccaga

SEQ ID NO: 441498 - RNA, 64 nt, Human
uagaaaggauauuuuuuggagagggagugugggaauccaccaucuuguggccaccucagacauc

SEQ ID NO: 441499 - RNA, 64 nt, Human
gccucucuuagccccuuguucuucccaaugucauauccaccaggaccuggccacagcuggccug

SEQ ID NO: 441500 - RNA, 52 nt, Human
ugaaacauuugggccccugaccauccaccaagggaccacccucuuggugcuc

SEQ ID NO: 441501 - RNA, 64 nt, Human
aauggaggggccaucagaacuugaauccuuuaacauccaccaggaaguuuuaugaagagugggu

SEQ ID NO: 441502 - RNA, 64 nt, Human
cucacacccaccgcccaggucuuaacuuucuggcauccaccacuccaugucucuggauguguca

SEQ ID NO: 441503 - RNA, 64 nt, Human
gcaaaacuaaauaaauuaccaaaaaggaaaaaaaauccaccaaaccaugauaaacacaaaaugc

SEQ ID NO: 441504 - RNA, 64 nt, Human
uuagauauggcuuguggacuuccaauaucauccuauccaccaaaaucuuauuccuuaguauuaa

SEQ ID NO: 441505 - RNA, 64 nt, Human
ccugagccauggugugcuacugaaaccaauuuuuauccaccaucuaguccuuauuaaaugaaac

SEQ ID NO: 441506 - RNA, 64 nt, Human
ucuauacaggagauuggaaucuacuuugucauuuauccaccacagugacaaaggaaaaguggug

SEQ ID NO: 441507 - RNA, 64 nt, Human
auuucccuccuuuuccuguuccuccaauccccagauccaccacuccugcacaugccauacacau

SEQ ID NO: 441508 - RNA, 64 nt, Human
aguccauuuauguuaaucaaaguugaauauaaaaauccaccauugccuguuagccagucaguuu

SEQ ID NO: 441509 - RNA, 64 nt, Human
ucauagagauuucucacaaguuauuucauucauaauccaccaugaacagugacuagcuucgugc

SEQ ID NO: 441510 - RNA, 64 nt, Human
agugccaccagaauauauaaaaagggaauuuaggauccaccaucgguggccaggaaaauagcag

SEQ ID NO: 441511 - RNA, 64 nt, Human
ggcuuaguuaugaucauguguggugauaaagaccauccaccaucacccuuuuccccuuugguuu

SEQ ID NO: 441512 - RNA, 64 nt, Human
uccuuaucauauccuuuauuaauucagccaguguauccaccaguuuuuuguuuauguuuuuaag

SEQ ID NO: 441513 - RNA, 64 nt, Human
ucuguggaugcccaggggaaggcauacaggccucauccaccaggcaauagacaggagagaggug

SEQ ID NO: 441514 - RNA, 64 nt, Human
ggcuggaugguauguguuucugcugccuuauucaauccaccacuucucugugaaacacucuacc

SEQ ID NO: 441515 - RNA, 64 nt, Human
ggggacagaugaccagguguguccaccugggcauauccaccaccucccucaccaacauugcuug

SEQ ID NO: 441516 - RNA, 64 nt, Human
cauaagucugugguucuucucauucucaucuauaauccaccacuaccaagagagauuucugugu

SEQ ID NO: 441517 - RNA, 64 nt, Human
uuuuuuuuuugguccuucuuuccucuuaacguaaauccaccaccaaaauuauuaauccucuuga

SEQ ID NO: 441518 - RNA, 64 nt, Human
aaaacuuauguggaagguaaauauauuguuccccauccaccacauaacacucuccccaacacac

SEQ ID NO: 441519 - RNA, 64 nt, Human
gcucccagucucaaaggacucuggugucucacccauccaccaggcggaccuuggagaggguguc

SEQ ID NO: 441520 - RNA, 64 nt, Human
uauucaaagugauuauugauauaguuggauuaauauccaccauauuuguuauugucuucuauuu

SEQ ID NO: 441521 - RNA, 64 nt, Human
gugacuccgcaguuuguccuggagugacauacacauccaccauggaaagggaagcaucucugcc

SEQ ID NO: 441522 - RNA, 64 nt, Human
acacagaaggcucccugcugcccggagcagguacauccaccagagcaaagggaaccacuuuuau

SEQ ID NO: 441523 - RNA, 64 nt, Human
auagaaauaaguaaaaugauuuguuuuauaauuuauccaccauguccaguuugguuagcuuguu

SEQ ID NO: 441524 - RNA, 64 nt, Human
caccagguuauuggaucuguccagugagagauucauccaccaaggaugaagaaaggaggacuuu

SEQ ID NO: 441525 - RNA, 64 nt, Human
cagacagaugagagagggcaggacuucaggcuggauccaccacugggcucucccucccccagcc

SEQ ID NO: 441526 - RNA, 64 nt, Human
uuaauugccuuagguggagaacuuaauuccuaguauccaccaaacuuaacuccguaucuccaua

SEQ ID NO: 441527 - RNA, 64 nt, Human
gcugugccaucucccugugcgccugagcagaucaauccaccagugcaaaacagggcuaacggca

SEQ ID NO: 441528 - RNA, 64 nt, Human
uaacucaaauugccugaggaaaaauggaaaaauuauccaccagucgauucaaacugaauuucac

SEQ ID NO: 441529 - RNA, 64 nt, Human
ggaaccuacuacucccugggccuuagucucccaaauccaccaugcaucugccccucugagggug

SEQ ID NO: 441530 - RNA, 64 nt, Human
ucuggggaggaggacgguugacggcccugcuuggauccaccaccaggacgcugugcucggccau

SEQ ID NO: 441531 - RNA, 64 nt, Human
ggagggcaugucccuuugggagcccgccuuguggauccaccacaccccaccgagcacuagaagc

SEQ ID NO: 441532 - RNA, 64 nt, Human
gcauuuggcaucugcugcccccagggucuuccucauccaccacuucugguuccuuucaucugga

SEQ ID NO: 441533 - RNA, 64 nt, Human
ucccucagacaagcuacaaagugcccaggaugccauccaccaugguccccuucaguaccucacg

SEQ ID NO: 441534 - RNA, 64 nt, Human
ugagcuugccuauuucugccuaaucauguacauuauccaccaaaaauuaggucaucauaguuga

SEQ ID NO: 441535 - RNA, 64 nt, Human
acuucucaucucaaauccuauggccuucuggaagauccaccacuauccaaaggaaaaaguagau

SEQ ID NO: 441536 - RNA, 64 nt, Human
aaccccuacuuuacccucccacccucacuuuuaaauccaccauacugaaugccacacuauggaa

SEQ ID NO: 441537 - RNA, 64 nt, Human
aacaaaaugaugaaagauauccaaauaccagauaauccaccaggaaggcuuuuguuuaggaauu

SEQ ID NO: 441538 - RNA, 64 nt, Human
cucggccucccaaagugcugggauuaaaggugugauccaccaugcccgggcugaaauauuucuc

SEQ ID NO: 441539 - RNA, 64 nt, Human
aaaaaacaaaaaacagaaaccaaucgguaaucugauccaccacuuuucaaagcacuacuauaaa

SEQ ID NO: 441540 - RNA, 64 nt, Human
ugcgccuuaggugagaagcauaaguguaacucccauccaccagggaaguugcuuguagccccaa

SEQ ID NO: 441541 - RNA, 64 nt, Human
ugguugugguaggucaaggaaaagagccccuuugauccaccaggagcaauuaagaaagguccuu

SEQ ID NO: 441542 - RNA, 64 nt, Human
uggccccugccaccuccugccucagguguccgcuauccaccaaaagggcucccugagggucugg

SEQ ID NO: 441543 - RNA, 64 nt, Human
acaccacccagaccuaggcuucccucuucucaggauccaccacaggguuaggggacaggaagcc

SEQ ID NO: 441544 - RNA, 64 nt, Human
aggcaucacaucuugcagaucagaaugggauggaauccaccaggcuccagcucaucccuccaag

SEQ ID NO: 441545 - RNA, 64 nt, Human
accaggcacuaaucaccuggugaggauuuggcauauccaccaaaaaaugcauccgauuuaacca

SEQ ID NO: 441546 - RNA, 64 nt, Human
uagcacucacgcccuaauaaggagcgaauccuacauccaccaaggcgggcgcucuggcccuccc

SEQ ID NO: 441547 - RNA, 64 nt, Human
acauaucucagggaauggugucugugcucagcccauccaccagaagagucugcucacaagccag

SEQ ID NO: 441548 - RNA, 64 nt, Human
gcacugaaaggcaggaguguuagcaucucgcuuuauccaccauaacguaaagaacugcggugug

SEQ ID NO: 441549 - RNA, 64 nt, Human
aaaacaagaaugauaggccaggaaggcaguggggauccaccaucacauggaacuguaaggccau

SEQ ID NO: 441550 - RNA, 64 nt, Human
cuacauccaguauuacugcuaagagacauucuucauccaccaauguuguacauguaugaaaaug

SEQ ID NO: 441551 - RNA, 64 nt, Human
cuccauucccuuccugcuuuuuucauggugggggauccaccaggucaucuaggcucuggcccua

SEQ ID NO: 441552 - RNA, 64 nt, Human
gagggaaaaagagccuguuuuuaacuuccuugcuauccaccacaaaauaagcaauuauuuucuu

SEQ ID NO: 441553 - RNA, 64 nt, Human
uaaaaacuggaggucuccugauaaggagaacacaauccaccauugucauuuaaguaauaagaca

SEQ ID NO: 441554 - RNA, 64 nt, Human
aagagcagauagugccaauaucaggaaauaauuuauccaccaauuucugccugacauucagcua

SEQ ID NO: 441555 - RNA, 64 nt, Human
uucauccuaaagaaagcaaaaguuaauucaacugauccaccaauggaauuagauggguagaguu

SEQ ID NO: 441556 - RNA, 64 nt, Human
uuuucuuuuuagcuguuaaauguacuaugccaucauccaccauuuaguaaaauguagcuggccc

SEQ ID NO: 441557 - RNA, 64 nt, Human
gucuucugaagaucaaggcaagaaccucuuuagcauccaccaauuuucacugcauuuugcaugg

SEQ ID NO: 441558 - RNA, 64 nt, Human
aaguuuuucccaguucuggaacuuucuaccgaguauccaccacccuuagacacaaucccagugc

SEQ ID NO: 441559 - RNA, 64 nt, Human
gaaaaugagguugucaguuuccagcaaggcugacauccaccagacugauuucuccgauguugca

SEQ ID NO: 441560 - RNA, 64 nt, Human
aaggaccagguacaguagcugaaacccaauucagauccaccauaggauucuuugacuacauacc

SEQ ID NO: 441561 - RNA, 64 nt, Human
gauaauccacauaaacaaaaagcauggaaaauuuauccaccagaauuugcuguggagauacuuu

SEQ ID NO: 441562 - RNA, 64 nt, Human
gauucccaggccaggcucccgaccccauccaccuauccaccaccccacccaccuuugcagggaa

SEQ ID NO: 441563 - RNA, 64 nt, Human
ucaccacuccugggugcaugauugagggugaagcauccaccagcacuucaagggguccauagua

SEQ ID NO: 441564 - RNA, 64 nt, Human
uuucacuuuucccaaagauuauauaauguucauaauccaccaugaaaacagcauuggccaaagg

SEQ ID NO: 441565 - RNA, 64 nt, Human
aagccucuuguguuugugugcagagaaguauaugauccaccaugcuaaugacacuugccuuuuu

SEQ ID NO: 441566 - RNA, 64 nt, Human
aauauuuugacuagauuagacaaacaguuaauagauccaccauuaggaaucaauauauuauguc

SEQ ID NO: 441567 - RNA, 64 nt, Human
ggccucacacugcagacaccccuuuccagccacaauccaccaucauccugacgaucccacaacu

SEQ ID NO: 441568 - RNA, 64 nt, Human
caguaagugaaauacaaccuaguuuuaucaccauauccaccagcaggcauggauaauuauuuua

SEQ ID NO: 441569 - RNA, 64 nt, Human
uacaugucagguucuggaguuggcccugagcucuauccaccaagccagcaccccaccaucccuu

SEQ ID NO: 441570 - RNA, 64 nt, Human
uccuggugcuuaaacuucauuaccuucaugguaaauccaccagagggccgguuagaugcuggcc

SEQ ID NO: 441571 - RNA, 64 nt, Human
uguaucugccucuuuacuagucuaccuuagugccauccaccagcuuuacucucugacacacaca

SEQ ID NO: 441572 - RNA, 64 nt, Human
acccuuuaacaccaccagauggguguuuucccccauccaccacuggcaggguugccccuucccu

SEQ ID NO: 441573 - RNA, 64 nt, Human
caucuacacccgugucaccuacuacuuggacuggauccaccacuauguccccaagaagcccuga

SEQ ID NO: 441574 - RNA, 64 nt, Human
ccaccuauccccaaaccuguaagaacuaaugauaauccaccacccuuugcugacuccuuuuuug

SEQ ID NO: 441575 - RNA, 64 nt, Human
ccaugccaccacccaccccaaacuuccagguuccauccaccaccuugccaaugguguagcuguc

SEQ ID NO: 441576 - RNA, 64 nt, Human
cacauguuucacacaaguguagaaaaugccagggauccaccacaagauggagauggucagcaca

SEQ ID NO: 441577 - RNA, 64 nt, Human
ggcgcacaggccucuucuccccggcacuuccgagauccaccagaucgacuugaucgugcagcug

SEQ ID NO: 441578 - RNA, 64 nt, Human
cgauguagaagacacuaauugcacaaaauagcacauccaccaaacuccugccugagaauguuac

SEQ ID NO: 441579 - RNA, 64 nt, Human
uuuuaggacauguacaugaaacagugaaaaugagauccaccaacaucuuuuauuaaguucaguu

SEQ ID NO: 441580 - RNA, 64 nt, Human
gacaguagaugagucugguuaagcgaggucagacauccaccagaaucaacucagccucaggcau

SEQ ID NO: 441581 - RNA, 64 nt, Human
cucagccucccaaagugcugggauuacaggcgugauccaccacaccuggcccuugcaaucuucu

SEQ ID NO: 441582 - RNA, 64 nt, Human
uuuaauauggaaagugagaauuugaaccuucaccauccaccacucuauucagguaaaacaauga

SEQ ID NO: 441583 - RNA, 64 nt, Human
auuccugccugcagaucucccaacuugaacuauaauccaccagccagccucagccuugagcuuu

SEQ ID NO: 441584 - RNA, 64 nt, Human
caggaccuuuggcucuguccaucaccagcaaccaauccaccaacagaaugugguuucugccauc

SEQ ID NO: 441585 - RNA, 64 nt, Human
caguagaagcccuggcuggccccacuugguaccaauccaccaggcagcucagggcuccugccca

SEQ ID NO: 441586 - RNA, 64 nt, Human
uggaggauuucaucucuuguauaugaugaucuggauccaccaagacuuguuuuaugcucagggu

SEQ ID NO: 441587 - RNA, 64 nt, Human
agcuuccucaucagguuacccagaagugggucccauccaccauccaggugugcuuggauguuag

SEQ ID NO: 441588 - RNA, 64 nt, Human
gcguugccaguuccucucccacucgcucguccuuauccaccacgcuauuauaguuuccguuguc

SEQ ID NO: 441589 - RNA, 64 nt, Human
cuccacgggugucagcccagaugacuccucacccauccaccaccugcagcuugagauguuaacu

SEQ ID NO: 441590 - RNA, 64 nt, Human
uuaccuaauccuaaggauccacaguuucagcagcauccaccaaaagucacuuuuccaacuuaug

SEQ ID NO: 441591 - RNA, 64 nt, Human
auguggagaccuugcaccuuguaaucaucaauacauccaccaaaaauauauaauguaccauaua

SEQ ID NO: 441592 - RNA, 64 nt, Human
agagauaagaggacagaagaauggagaugggaaaauccaccaaauuccaacccaaacccaacuu

SEQ ID NO: 441593 - RNA, 64 nt, Human
ggagaagaggcagggucaggccucagcaucucacauccaccaccuccaggaggggagaccacug

SEQ ID NO: 441594 - RNA, 64 nt, Human
agauggcaccaacgggacccccuggcccugccucauccaccaaucucuaagccaaaccccuaaa

SEQ ID NO: 441595 - RNA, 64 nt, Human
ggcaaaccgaauccagcagcacaucaaaaagcuuauccaccaugaucaagugggcuucaucccu

SEQ ID NO: 441596 - RNA, 64 nt, Human
uuagccaggauggucuugaucuccugaccuugugauccaccagccucagccucccaaagugcug

SEQ ID NO: 441597 - RNA, 64 nt, Human
uccuuggcucuuccagguuguccuacccucuggcauccaccauagacguuuuucaaacagaaaa

SEQ ID NO: 441598 - RNA, 64 nt, Human
uccacuucccuaagucucucuucagcugugacuuauccaccacauagcccaguaagucuucagu

SEQ ID NO: 441599 - RNA, 64 nt, Human
ugaaggaaggauacacauggagaagacuguguggauccaccagaagauggccaucuacaagcca

SEQ ID NO: 441600 - RNA, 64 nt, Human
gagugccgugccguguaauaaagucccagugcucauccaccacagaugccugguccuguugcag

SEQ ID NO: 441601 - RNA, 64 nt, Human
caccaagauaccagacauuugagugaaauuuuggauccaccagaccagccaccagcuaaaugcc

SEQ ID NO: 441602 - RNA, 64 nt, Human
gggagaggcaccugcugaacccugucuucuugacauccaccaagauaccagacauuugagugaa

SEQ ID NO: 441603 - RNA, 64 nt, Human
gccugccacgcaacgucucugccuggcugagcacauccaccaaccaccugggcgagccacccug

SEQ ID NO: 441604 - RNA, 56 nt, Human
ugucuugcaguuauggcugaucagucauccaccaggaacgaagauuuccugaagaa

SEQ ID NO: 441605 - RNA, 64 nt, Human
guuccccccaucccuggaucccaagaguggugcgauccaccaggagugccgcccccuugugggg

SEQ ID NO: 441606 - RNA, 64 nt, Human
agggccugccugagucccagcucccagcuggagaauccaccagcacaagaagaggaggcagggg

SEQ ID NO: 441607 - RNA, 64 nt, Human
aucuugccucacagugacugcagcgccaagcggcauccaccaagcaucaaguuggagaaaaggg

SEQ ID NO: 441608 - RNA, 64 nt, Human
acagucguaacaguccccaggcuccagcugggcaauccaccacuuccucuuccuucugcuucug

SEQ ID NO: 441609 - RNA, 64 nt, Human
aguggagaggaaaagcaucagaaagaggcagaccauccaccaggccuuugagaaaggguagaau

SEQ ID NO: 441610 - RNA, 64 nt, Human
guagcaugcacaggaugguaaauuggauugguggauccaccauaucaugggauuuaaauuuauc

SEQ ID NO: 441611 - RNA, 64 nt, Human
gcucuucuagguagucacacuucacuaaagugucauccaccaguguguugaauccgaagaauga

SEQ ID NO: 441612 - RNA, 64 nt, Human
acucccuuccuggcugugucaccccgagcagcucauccaccauggaggucauuggccugaggca

SEQ ID NO: 441613 - RNA, 64 nt, Human
uaaauguugugaagguuaaagauaaauuaagauuauccaccaaaugcuaaaaauacugaugugu

SEQ ID NO: 441614 - RNA, 64 nt, Human
aggagacgggggagcagcacgauuuugcacaaauauccaccacuuuaaccuuagagcuuggaca

SEQ ID NO: 441615 - RNA, 64 nt, Human
cuggcuucaggggaagugcuauucacaggaccauauccaccacccucuuaaauuccuaaacaau

SEQ ID NO: 441616 - RNA, 64 nt, Human
ccagcgccuacuucugguggcucuagguccccggauccaccacccuucccccacugacucuuca

SEQ ID NO: 441617 - RNA, 64 nt, Human
auuccaggugccuuaauauaaaguuugaagcuucauccaccaaaguuaaauagagcuauuuaaa

SEQ ID NO: 441618 - RNA, 64 nt, Human
ggagggccugggccagugcacguuccagggccacauccaccacuuucccugcucuguuacauga

SEQ ID NO: 441619 - RNA, 64 nt, Human
ccugugagcucuggcucagacagcagcaagccggauccaccaacaccgcagcgccuuaugaccc

SEQ ID NO: 441620 - RNA, 64 nt, Human
accagaaagaaauugucaaaaaccaauaaaugaaauccaccaacucaccgugugugucccagcu

SEQ ID NO: 441621 - RNA, 64 nt, Human
ccuacuguucuauuauuuguuuugacuugaauuuauccaccaaagacuucauuuguguaucauc

SEQ ID NO: 441622 - RNA, 64 nt, Human
agggcugcaagccagggguccagggcccuuccguucagcccaaaugcugccccaaugcuaacuc

SEQ ID NO: 441623 - RNA, 64 nt, Human
aacacuacagagucgauacugugaguuuccaaccucagcccaucugugggcagagaaggucuag

SEQ ID NO: 441624 - RNA, 64 nt, Human
acugggccuaaggugagcugagggcuugagccccucagcccagcgggggucccuuuucaucccu

SEQ ID NO: 441625 - RNA, 64 nt, Human
cacaggcccccacgccucagagccagagugguccucagcccauuucagacugcagaugccgccc

SEQ ID NO: 441626 - RNA, 64 nt, Human
gcgggcgauuacaauccaauuaccuauugucgacucagcccacacaagcuuuucuccuccucuu

SEQ ID NO: 441627 - RNA, 64 nt, Human
uggucacgagaaaacccugggcucccacuggggcucagcccagccuccuaucuuuccuucuucu

SEQ ID NO: 441628 - RNA, 64 nt, Human
guuggacaccaucuucuaaaggcuuuugcccuacucagcccaaccuagaccuguagauuucccu

SEQ ID NO: 441629 - RNA, 64 nt, Human
caggguaagacagggcuggcaggagcagacugccucagcccaugugcccugccggccagggcgu

SEQ ID NO: 441630 - RNA, 64 nt, Human
ggguacccugagcccaccagggacaccucgcccuucagcccaccacccuggcaggcuuccaucc

SEQ ID NO: 441631 - RNA, 64 nt, Human
auugggaagucucaccaagcuagauugucuaccaucagcccagaacucuguaacuuuucagaac

SEQ ID NO: 441632 - RNA, 64 nt, Human
uggcugggcugccuagcccagcuaagaucuuccuucagcccaccucaggauccgggcuugaggg

SEQ ID NO: 441633 - RNA, 64 nt, Human
ucuuggauaugguugguuuuggcucauuucacaaucagcccaaggcugggaaagcuggaauggg

SEQ ID NO: 441634 - RNA, 64 nt, Human
cccauggcuggucagagcccugggucaaaaccacucagcccaggggaggggaugaggcauuguc

SEQ ID NO: 441635 - RNA, 64 nt, Human
uuucguccaguaccaagucccccguugcuucuggucagcccacuuguagacuuccaggggacac

SEQ ID NO: 441636 - RNA, 64 nt, Human
gaugaggcggggaggugggacccccaaacauauaucagcccaacagcccuaagucuccuucuuu

SEQ ID NO: 441637 - RNA, 64 nt, Human
aaacacaggcgcuuugcaggcugcucugagggucucagcccaucccccaggaggacugggauuu

SEQ ID NO: 441638 - RNA, 64 nt, Human
accauucugcucccccuaaaccuuuuguuugauuucagcccauguucuugacaaugcagagcaa

SEQ ID NO: 441639 - RNA, 64 nt, Human
cgagugggccacaucucacuucugcuuccucaucucagcccacucugaaaaugugcagcacccu

SEQ ID NO: 441640 - RNA, 64 nt, Human
uugcuuaauguacuccaggcuucuucagauagguucagcccacccacccccaugauuguaugaa

SEQ ID NO: 441641 - RNA, 64 nt, Human
ccguaaucccagcuacuaaggcuggaggaucacuucagcccaggaguuuaaggcugcagugagc

SEQ ID NO: 441642 - RNA, 64 nt, Human
ugcuacggccacaccagcaccuccuggcugaaggucagcccacacucugguccaugaggcagca

SEQ ID NO: 441643 - RNA, 64 nt, Human
ccauccagagaugagacucuuagaaucaaaguguucagcccaggaagucuuggagaucccaccu

SEQ ID NO: 441644 - RNA, 64 nt, Human
cuucugcaggaaucccggcuccagagcaggaaauucagcccaccagccaccucauccccaaccc

SEQ ID NO: 441645 - RNA, 64 nt, Human
uuucugugucugaaaguuuacagguuguggugcaucagcccaaacucacuggcguuguguuuuu

SEQ ID NO: 441646 - RNA, 64 nt, Human
agacccaagguaguccuggcacugcccuguggacucagcccagcuggggaggacauggcgcccg

SEQ ID NO: 441647 - RNA, 64 nt, Human
cucgcuaaccccauuacaacagcuccaggacaucucagcccagguucuagcccccacgcacccc

SEQ ID NO: 441648 - RNA, 64 nt, Human
cugaugucacaacuuugcaagcucugccuuggguucagcccaucugggcucaaauuccagccuc

SEQ ID NO: 441649 - RNA, 64 nt, Human
ucuccuuccacaaugacugcuuuguuuggaugccucagcccaggucagcuguuacuuucuuuca

SEQ ID NO: 441650 - RNA, 64 nt, Human
cgggcugagcacugugaggccuggaugugaagacucagcccagcgaagcucauucccuuacccc

SEQ ID NO: 441651 - RNA, 64 nt, Human
uuaggcugagucacuccucgggucucuccauaauucagcccaacaaugcuugguuuauuucaau

SEQ ID NO: 441652 - RNA, 64 nt, Human
ucucagaggccccucagccacuggaaccccaucuucagcccagccuguccgucccugucccggg

SEQ ID NO: 441653 - RNA, 64 nt, Human
cagggaagccccuccugccagucccuguccccuuucagcccaccagucccucucugcugccggu

SEQ ID NO: 441654 - RNA, 64 nt, Human
cugccggugaaaacagucuaguacacaggugcugucagcccagggugggagcaggaaaugauug

SEQ ID NO: 441655 - RNA, 64 nt, Human
cagcccuccuaauaccucauauuccccaucuuccucagcccagaaagcaauggggcuuuaguga

SEQ ID NO: 441656 - RNA, 64 nt, Human
cauggaggcaguggcgccuuauggauaggucaucucagcccaaagggccuccuuggcuggcaug

SEQ ID NO: 441657 - RNA, 64 nt, Human
gcaggugggggcauucuucuaggaaugaggggcaucagcccaccccaggcaccucagugggguu

SEQ ID NO: 441658 - RNA, 64 nt, Human
agggugcaggcagaugaccuggugaagaugcucuucagcccagaagagauggaccucucccagg

SEQ ID NO: 441659 - RNA, 64 nt, Human
cagucugcuucucccuguuacacacuguccgcucucagcccacucucccuguuacacacugccc

SEQ ID NO: 441660 - RNA, 64 nt, Human
cauccuuacagagcuaaguggagacguuuccagaucagcccaaguuuacuauagagacuggccc

SEQ ID NO: 441661 - RNA, 64 nt, Human
ugcuuuggggauuuuuguucggaguucuauacuaucagcccagaaagcuaucaauguccaagug

SEQ ID NO: 441662 - RNA, 64 nt, Human
aacacugcagagacaaugcugugaguuuccaaccucagcccaucugcgggcagagaaggucuag

SEQ ID NO: 441663 - RNA, 64 nt, Human
gagagugucaguuucccaaguucugagguaacucucagcccagaugugaaaugggagccuacca

SEQ ID NO: 441664 - RNA, 58 nt, Human
ucaccaacggcaucaugugacacgcuccucagcccaggaguggugggggguccagggc

SEQ ID NO: 441665 - RNA, 64 nt, Human
cccauucgcaauaaguaccaagaagcccaagauaucagcccaaaagucaaucuuaucauauuuc

SEQ ID NO: 441666 - RNA, 64 nt, Human
gaaaccucuuagagaauucaguaccaaccaagcuucagcccacuuucacacccacugggcaaua

SEQ ID NO: 441667 - RNA, 64 nt, Human
guccugaggggcaacacacaagaaccagguccccucagcccacagcacugucuuuuugcugauc

SEQ ID NO: 441668 - RNA, 64 nt, Human
gcucaguugguggagacuggggcugggacuggagucagcccagcugggaggaggggcuggggag

SEQ ID NO: 441669 - RNA, 64 nt, Human
ucaugauuuuugucgaguuuacuucaugaggaggucagcccauuggcucccaucugaaccacuu

SEQ ID NO: 441670 - RNA, 64 nt, Human
cugggugggugaaaggggcccaacccugcccacuucagcccagcccgcccaaggggacuugugc

SEQ ID NO: 441671 - RNA, 64 nt, Human
ggaaaaaauaauuauaagaugauaagcaaauguuucagcccaaugucaacccaguuaaaaaaaa

SEQ ID NO: 441672 - RNA, 64 nt, Human
uaagguacauggaacacacgggaagucugguagcucagcccauuucuuuauugcaucuguuauu

SEQ ID NO: 441673 - RNA, 64 nt, Human
gagggaggugaggacuugacuuuccucccagagcucagcccaugucacccuccaggccccagaa

SEQ ID NO: 441674 - RNA, 64 nt, Human
cucccaggaaggccuagagcagacccuuuagaaaucagcccaagggggagagcaagagaaaaca

SEQ ID NO: 441675 - RNA, 64 nt, Human
uagggccucacugcuggagcggggaaaccgcagcucagcccaggcccagcuggggagaaggcgc

SEQ ID NO: 441676 - RNA, 64 nt, Human
gucaccaguggacuguaucccugaggagaacaacucagcccacccuuccuuuuuuucuucaucc

SEQ ID NO: 441677 - RNA, 64 nt, Human
uuucuccauuucugccggggucucccccuucccuucagcccauucccccucgguuuuauccauu

SEQ ID NO: 441678 - RNA, 64 nt, Human
ccacaccccaguguggacuugggauuugcugugcucagcccagggcugauaggucccuggugaa

SEQ ID NO: 441679 - RNA, 64 nt, Human
accugggggugucccagggacucugucagugccuucagcccaccagcaggagcuuggaguuugg

SEQ ID NO: 441680 - RNA, 64 nt, Human
uauuucggcccguaucgaacuuuuguucucaguaucagcccaugguuucaggaucaaagcuguc

SEQ ID NO: 441681 - RNA, 64 nt, Human
ucuacccuuaccuugaggaaugggaaaaugaaccucagcccauuaggcaggaaaaguugauauu

SEQ ID NO: 441682 - RNA, 64 nt, Human
agaaucacauggagggcuuucuaaaacagacugcucagcccacccccaggguuucugaguucau

SEQ ID NO: 441683 - RNA, 64 nt, Human
ggcgggcagcagcuccccaucuucucuggcagacucagcccacugccuugccagucuugccagg

SEQ ID NO: 441684 - RNA, 64 nt, Human
cugcacauuguugucacccacccuccugcccuucucagcccagaugccaugccccugggcgggc

SEQ ID NO: 441685 - RNA, 64 nt, Human
uauucugccaagaauaugccuugauaguuagcccucagcccauagguguuuuuuguuuuuuaac

SEQ ID NO: 441686 - RNA, 64 nt, Human
ugagcgccacagucuaacccaagacccacccgccucagcccagcccaggcagcggggugguggu

SEQ ID NO: 441687 - RNA, 64 nt, Human
uaaucccaccacccuuugcugacucuuuuuggacucagcccaccugcacccaggugauuaaaaa

SEQ ID NO: 441688 - RNA, 64 nt, Human
ucauuaggugugcuguccccuguagccucgugagucagcccagaggaggguacaugcgacugug

SEQ ID NO: 441689 - RNA, 64 nt, Human
ugauaguuguugggaauauauaauuuacuggaccucagcccaaaucaagaugcuuaaaauugua

SEQ ID NO: 441690 - RNA, 64 nt, Human
agggucagucugucgggugggggcagaaaucaaaucagcccaaggauauaguuaggauuaauua

SEQ ID NO: 441691 - RNA, 64 nt, Human
agcuuccuguauuaauuuuaguucaguuaaugguucagcccauacaaaggugcuauccuaggga

SEQ ID NO: 441692 - RNA, 64 nt, Human
ggggcugccuaucugggcgaguagaccgccuggcucagcccacaggccugcagcaucccauagc

SEQ ID NO: 441693 - RNA, 64 nt, Human
cccuagggagugagguacgaaucugguccuauacucagcccagguacgagaaggaacucaacca

SEQ ID NO: 441694 - RNA, 64 nt, Human
uccucucuuggacugaguggguacggccagccacucagcccauuggcagcugacaacgcagaca

SEQ ID NO: 441695 - RNA, 64 nt, Human
uaauaggucuacgcuaggaccccgugcugggcucucagcccaucaugagauuuugguggauuua

SEQ ID NO: 441696 - RNA, 64 nt, Human
agacagugagcagucaaguguucaggccacacagucagcccaggaaaaagagaagcagggccaa

SEQ ID NO: 441697 - RNA, 64 nt, Human
cagaacuggagucuuuacugacccgcuuuccacaucagcccaaggucuuuuuaaugccuuuauc

SEQ ID NO: 441698 - RNA, 64 nt, Human
gggguggcuggggacagaguccagcucccuuggaucagcccagaggauucaggauaggacaaag

SEQ ID NO: 441699 - RNA, 64 nt, Human
caggcuccugguucggccuacuuucuagccucacucagcccagggauagccaguguugggagac

SEQ ID NO: 441700 - RNA, 64 nt, Human
agaacugucucauucauuuacauuucuguuacagucagcccaggagguuacagugagcucucca

SEQ ID NO: 441701 - RNA, 64 nt, Human
aauccaucacccuucgcugacucucuuuucggacucagcccaccugcacccaggugaaauaaac

SEQ ID NO: 441702 - RNA, 64 nt, Human
uuuucaauccuccuucacugucuuccuaccauguucagcccagacuccugccacauggaccagg

SEQ ID NO: 441703 - RNA, 64 nt, Human
ccugaggcagguccccagacuccaccaagccuggucagcccaaaccaccagaagcccagaauaa

SEQ ID NO: 441704 - RNA, 64 nt, Human
uaugagaauugacaauaaguauuuuuauuauaacucagcccauacauauauacuauguaugcag

SEQ ID NO: 441705 - RNA, 64 nt, Human
ugcccucauaauuuaagcaaaauccacgauaguaucagcccaagaguguguugcuauuuguaag

SEQ ID NO: 441706 - RNA, 64 nt, Human
ggggcagcuacugcgagaacuucaggccaaugucucagcccaggaaccaggcuuugcugaggug

SEQ ID NO: 441707 - RNA, 64 nt, Human
ccuaauaagagcccuggauuccaucauuaacauuucagcccauuggaugaaguggugcccucuc

SEQ ID NO: 441708 - RNA, 64 nt, Human
gcgguggaaaaacuugaggguuugggguucaaagucagcccaucccaccuggcaaaauccuccu

SEQ ID NO: 441709 - RNA, 64 nt, Human
auuccucaugcugacccuccucacgauggcugugucagcccagccccuucccuucuccaggccc

SEQ ID NO: 441710 - RNA, 64 nt, Human
guuggccuggucgcuuugauucuuccugcacagcucagcccaccccaucuguacuggaagggac

SEQ ID NO: 441711 - RNA, 64 nt, Human
guaugaguaccccuccuagaggacccagccgccaucagcccaacgggaagcaaccucccaaccc

SEQ ID NO: 441712 - RNA, 64 nt, Human
acagacuuggggcacuaugcucucaaccaguuugucagcccacuccucaggacacuuccucagg

SEQ ID NO: 441713 - RNA, 64 nt, Human
cggcugcuuuuucaaaugcuuaagccaggagugcucagcccaucaacuuccugagugucuaaag

SEQ ID NO: 441714 - RNA, 64 nt, Human
uuccccaacagcccauuugcccacuucccacugcucagcccacaccagaccuccaggagacauc

SEQ ID NO: 441715 - RNA, 64 nt, Human
guggaccagagugcuugaggcaucucaggcagccucagcccaagcuucuaccugccuuugacuu

SEQ ID NO: 441716 - RNA, 64 nt, Human
ccuugcucuuccuagaugcccaccuccuacaaucucagcccacaaguccucuccacccuagggg

SEQ ID NO: 441717 - RNA, 64 nt, Human
ugguucaauagacugccccgacagucuacaagccucagcccacugaccauaccucagccccuag

SEQ ID NO: 441718 - RNA, 64 nt, Human
gacaguacuuauuaauugagucccuaaggaauauucagcccacuacauagauagcuuuuuuuuu

SEQ ID NO: 441719 - RNA, 64 nt, Human
guaaaaauaauacaugaaucccauucacagguucucagcccaagcaacaagguaauugcgugcc

SEQ ID NO: 441720 - RNA, 64 nt, Human
ugcuguuagauuuuggcacccguuuucucagcauucagcccagggaaugugguuuucacuucuu

SEQ ID NO: 441721 - RNA, 64 nt, Human
cuuauuguuguuaguguuguuaauauucguugcuucagcccacggugccuuggucucuccacaa

SEQ ID NO: 441722 - RNA, 64 nt, Human
ucauuuucacuuuguaauuuuucuuaguauauagucagcccacuguauuuguguguuccacauc

SEQ ID NO: 441723 - RNA, 64 nt, Human
ugguuucaggcugacauauggccgcagguccaguucagcccaggucucucaugguuaucuucca

SEQ ID NO: 441724 - RNA, 64 nt, Human
aaauaaggccaaaacaagaguucugggccacagcucagcccagaggguuccuggggaugggagg

SEQ ID NO: 441725 - RNA, 64 nt, Human
gugaucuuccuuagccaaucccaguccgucugugucagcccagcucugccucgcagcccccuca

SEQ ID NO: 441726 - RNA, 64 nt, Human
guuucugcuucuuucugcucugguuugcauucaaucagcccaaguugggucacauagauggguu

SEQ ID NO: 441727 - RNA, 64 nt, Human
aaggccacugcuacaucucccagacucugggcugucagcccaugugcaccugccccccagccuu

SEQ ID NO: 441728 - RNA, 64 nt, Human
cuuccugcuucagggccgcaccgcccagacuggcucagcccaggccaccaacuucaucgccuuu

SEQ ID NO: 441729 - RNA, 64 nt, Human
cucagacuuuuuuuuuuuuaaugggauuuuuaggucagcccaggggagaaagauaacugcuaaa

SEQ ID NO: 441730 - RNA, 64 nt, Human
ccccagcucugacuucucauuacugugcugaaagucagcccacgucggagcggugaggaggagc

SEQ ID NO: 441731 - RNA, 64 nt, Human
cagcagaauccacccggugaccagugguggccccucagcccacccucccggcagcucagccugu

SEQ ID NO: 441732 - RNA, 64 nt, Human
gguuuccucagccuuccuucagccuguaauauuuucagcccacuguuuaccuugucucaauaaa

SEQ ID NO: 441733 - RNA, 64 nt, Human
aaugccaggcagaaaacuggcagugcaccucucaucagcccaggucccagugccauuggcuuca

SEQ ID NO: 441734 - RNA, 64 nt, Human
aauuuuuauuuuuuagugcauccaguuaaccaagucagcccaacaggcaggugccggaggggag

SEQ ID NO: 441735 - RNA, 64 nt, Human
gucccaggcccugcccugguccccccacaaggccucagcccagucacaacugccauuuccaguc

SEQ ID NO: 441736 - RNA, 64 nt, Human
acuaggcuggacccuucccacuacauaauagggcucagcccaggcagccagcuuugggcugagc

SEQ ID NO: 441737 - RNA, 64 nt, Human
ggagcuagggcagggaccaaaugaacagaaagucucagcccaggauggggcuucuucaacaggg

SEQ ID NO: 441738 - RNA, 64 nt, Human
uggggcugugugcaugcaggcccauguuucagccucagcccacgccaggugaaaggaucagcaa

SEQ ID NO: 441739 - RNA, 64 nt, Human
agugcacauuccauaguucuccagugcuuggcgaucagcccaauugaaggacuggcucuguacu

SEQ ID NO: 441740 - RNA, 64 nt, Human
aaguggccagagauugggcugccugugauacccaucagcccacugccccggccggcccagauag

SEQ ID NO: 441741 - RNA, 64 nt, Human
caugagaucucggcacggcaagcccagcaucgccucagcccagacaggcuccaccaggagauca

SEQ ID NO: 441742 - RNA, 64 nt, Human
agugucagaagcaagcauaaucauugcuguguccucagcccacagagcugcaucucuugaagcu

SEQ ID NO: 441743 - RNA, 64 nt, Human
acccagcugcgcccucggcucggucuccagcgccucagcccacccuucccgccacccuggccuc

SEQ ID NO: 441744 - RNA, 64 nt, Human
gcaaguaauagauuuucuuggcaaaucuaaugauucagcccacaggacuguugaaacuacugcg

SEQ ID NO: 441745 - RNA, 64 nt, Human
gacauccuuuucuguccuuccccuuccugguccuucagcccaugucaacgugacagacaccuuu

SEQ ID NO: 441746 - RNA, 64 nt, Human
gcggcggaugucucuuggucuguuucuccggcccucagcccagcgccccuccugcccgccccua

SEQ ID NO: 441747 - RNA, 64 nt, Human
uuuuuuaaggugggcagauuaguuugucaaagucucagcccaguucaauucaguugaucucgag

SEQ ID NO: 441748 - RNA, 64 nt, Human
ugguugggugaugggcucugcugacgugcagggcucagcccagggcauccaggaacaggcucca

SEQ ID NO: 441749 - RNA, 64 nt, Human
guugaguguggcugggagagugggagggaagcccucagcccaggcuguugucccuugaaaugug

SEQ ID NO: 441750 - RNA, 64 nt, Human
gcuccugccugcauuuccagagcuggugccagggucagcccagcgaggagucccugcaauaagc

SEQ ID NO: 441751 - RNA, 64 nt, Human
auggaaaguugaagggggcaagcaagaccucuccucagcccaugcccagcugucaggagagagg

SEQ ID NO: 441752 - RNA, 64 nt, Human
gccaacagcagagcacccuggugccaaggccuucucagcccaugcccuggagggcauuccccug

SEQ ID NO: 441753 - RNA, 64 nt, Human
agccacuguaggcucuaagaaccacgugcagucuucagcccauuaaauuaucgauuauuuuuua

SEQ ID NO: 441754 - RNA, 64 nt, Human
ugggaguaauacagagaaagaggugaguggagacucagcccagcugcucuugagcuuggauagu

SEQ ID NO: 441755 - RNA, 64 nt, Human
acuggcccuguaggguugagccacagacagcucuucagcccaguagcaguggagcaggcccugu

SEQ ID NO: 441756 - RNA, 64 nt, Human
ccggggaggcagggguccugcagguccuggugggucagcccagcaccugcucccagugggagcu

SEQ ID NO: 441757 - RNA, 64 nt, Human
ccaauagcucuacugcccuccccuuccccuuuacucagcccagcuggccaccuagaagucuccc

SEQ ID NO: 441758 - RNA, 64 nt, Human
gggccaccccauuucugguacccaauuugguucuucagcccaacuugcaagggguuccuucugg

SEQ ID NO: 441759 - RNA, 64 nt, Human
aacaugcaguugggucucaagaccuuuccuccaaucagcccaacccagcccagacugggcuuuu

SEQ ID NO: 441760 - RNA, 64 nt, Human
auggggcagaacgaacuuuaaguaugagaaaaguucagcccaaguaaaauaaaaacucaaucac

SEQ ID NO: 441761 - RNA, 64 nt, Human
aaggguaaaacucccagccuacccugcuccagcuucagcccagguaguuggugugucucaauau

SEQ ID NO: 441762 - RNA, 64 nt, Human
caaagcuuguaacuggcaagggaugaugucagauucagcccaagguuccuccucuccuaccaag

SEQ ID NO: 441763 - RNA, 64 nt, Human
aauauaccaguaccaauauguucuugcaauugcuucagcccaagaaagcuguguauuguuuuaa

SEQ ID NO: 441764 - RNA, 64 nt, Human
gugugacaagaugguguucugcuaauguuaaaugucagcccacagagcuaauaauaccucagua

SEQ ID NO: 441765 - RNA, 64 nt, Human
agaguggauugaaaugccagucaugccugauauuucagcccauugacuugcuggaugaaggacu

SEQ ID NO: 441766 - RNA, 59 nt, Human
uccgaggggagagggcauaaauauuccuaucagcccaagaagucuguccaaccccaaaa

SEQ ID NO: 441767 - RNA, 64 nt, Human
augcaugccaaucccuguugccgcauggagcuccucagcccacugaccucuccgugccuggugc

SEQ ID NO: 441768 - RNA, 64 nt, Human
auggggucagaccccaccccgucuaccccuccagucagcccagcgcccauccugcagcucagcu

SEQ ID NO: 441769 - RNA, 64 nt, Human
cacacuccagcuacuguguaguggcugaaauauaucagcccauguuagacagaagaagucagag

SEQ ID NO: 441770 - RNA, 64 nt, Human
agcucaccucuuggagcugcuucuccuacacuucucagcccauugcuuugccacccccucaugu

SEQ ID NO: 441771 - RNA, 64 nt, Human
ggugacacccucaacaaccaggauuugcucgaucucagcccagcaggccaggcagacacacccc

SEQ ID NO: 441772 - RNA, 64 nt, Human
gaaaugagacuugcucucuggccuuuuccuauuuucagcccauauuucaucguguaaaacgaga

SEQ ID NO: 441773 - RNA, 64 nt, Human
ccaaagccugaggacagaaagacccugaugcaggucagcccauggaggcagaugcccuugcugg

SEQ ID NO: 441774 - RNA, 64 nt, Human
cucuguggccucaggacucucugccucacccgcuucagcccagggccccuggagacugaucccc

SEQ ID NO: 441775 - RNA, 60 nt, Human
aaggggagacuacagucugagacccggggcucagcccaugcccaggccucggccggggcg

SEQ ID NO: 441776 - RNA, 64 nt, Human
aaugacuguuugccucauuuaauaguauacaggcucagcccauagacuacaguucuucagaggc

SEQ ID NO: 441777 - RNA, 64 nt, Human
cccagagagacggaagcaggugcgauacuaagccucagcccaagaauaaaagagaguucaacug

SEQ ID NO: 441778 - RNA, 64 nt, Human
ucuuucccuuuacagacggggcagaugccaggacucagcccauccugaggaggacacguguccu

SEQ ID NO: 441779 - RNA, 64 nt, Human
aauucagaaaucuuauuauuuaacccagaaguaaucagcccaguaguaacuuagguuuaauuuu

SEQ ID NO: 441780 - RNA, 64 nt, Human
aagguaaagacugccaguucuuccgccaaccccaucagcccagcccguuaaaugucaaacguca

SEQ ID NO: 441781 - RNA, 64 nt, Human
ggaucacaggucccucugcaaaacuuccuggaguucagcccagcaaggccagaccaaggaggca

SEQ ID NO: 441782 - RNA, 64 nt, Human
uaauguguuugcucuaacuucccuggcuucuccuucagcccauccacucuccucuagagcaguu

SEQ ID NO: 441783 - RNA, 64 nt, Human
ccagagcugguggaacgucucauugcuguagauaucagcccaguggaaagcacaggugucuccc

SEQ ID NO: 441784 - RNA, 64 nt, Human
uggugcugcccugccucucgugccggguguugcuucagcccagagccagagggcugggucccgg

SEQ ID NO: 441785 - RNA, 64 nt, Human
cucuuauuauauuauuaguuuugauuuaauguuuucagcccaucuccuuucauauuucugggag

SEQ ID NO: 441786 - RNA, 64 nt, Human
cucaucuguacuccccagaucuccuggcugcaaaucagcccaucggcaguguuucuugagcucc

SEQ ID NO: 441787 - RNA, 64 nt, Human
cucauagagacauauggaaaaauaacuuucagauucagcccaguucuguuuuagaguguguuua

SEQ ID NO: 441788 - RNA, 64 nt, Human
aaugcaggauuugucccacucuguuuucucccucucagcccaccacccacagcucccuucucau

SEQ ID NO: 441789 - RNA, 64 nt, Human
ugcuuggagguaccucagagagguaacccaggggucagcccaggcugcugggcuguagccaaua

SEQ ID NO: 441790 - RNA, 64 nt, Human
cggguaccauggacggccccgucagccacaccugucagcccaagcagagugauucaggggcucc

SEQ ID NO: 441791 - RNA, 64 nt, Human
aacguucugcugcucaagccagucuggcaagcacucagcccagccucgagguccuucuggggag

SEQ ID NO: 441792 - RNA, 64 nt, Human
aacuguguucuuuccucccugcccucuacugauuucagcccagccccugccuagauccuagguc

SEQ ID NO: 441793 - RNA, 64 nt, Human
caguuuucucacgugguuucuagcuucuucagacucagcccaaauuaggaagugcagaagcaca

SEQ ID NO: 441794 - RNA, 64 nt, Human
uuuuauucaaagccauuuaauaaaacacaguuggucagcccagugcaaagcuuguuaucugcca

SEQ ID NO: 441795 - RNA, 64 nt, Human
ucaaauguuugaaugaucacaaauuaagacauuaucagcccaguaaauuucuugcuuaauguuu

SEQ ID NO: 441796 - RNA, 64 nt, Human
uguaacauuacuguacagaguacaucaacuauuuucagcccaaaaaggugccaaaugcauauaa

SEQ ID NO: 441797 - RNA, 64 nt, Human
cugggaucgggguggggacagguagaccaggugcucagcccaggcacaacuucagcaggggaug

SEQ ID NO: 441798 - RNA, 64 nt, Human
ggggaccagcccugcagaccacucugacaagucuucagcccacacccugccagccccacagauu

SEQ ID NO: 441799 - RNA, 64 nt, Human
ucacagaaacugcauguggaaccacaagcagccuucagcccaagagaagucucuguuaacucua

SEQ ID NO: 441800 - RNA, 64 nt, Human
caucaucauaauccauuuucucuuugcuagaaaaucagcccauagagugcauucccaaauucua

SEQ ID NO: 441801 - RNA, 64 nt, Human
caauguccuugucucuugucuuuggccagcccccucagcccagcccaccccacccgcuguccgg

SEQ ID NO: 441802 - RNA, 64 nt, Human
uucauccagauaacuuauacauucccaagaaaguucagcccagauggaagguguucagggaaag

SEQ ID NO: 441803 - RNA, 64 nt, Human
auucuugcugcugcuuugcagagucaacagcccaucagcccauguuuuagaggggacacuuugg

SEQ ID NO: 441804 - RNA, 64 nt, Human
guggggugggggcggggcuuggggccucccuggcucagcccagugcggccuggcgcuccucccg

SEQ ID NO: 441805 - RNA, 64 nt, Human
uuucguacucucacagacugcuugaggaaggaugucagcccaaucagcgggcccugcagaguua

SEQ ID NO: 441806 - RNA, 64 nt, Human
uucuuccuuuggggguaugauguggaagcugguuucagcccaggacccaccacugaggagagga

SEQ ID NO: 441807 - RNA, 64 nt, Human
ugcagucauguugggagcagguuacaauguuacuucagcccacaguuuauuucuauacuugagu

SEQ ID NO: 441808 - RNA, 64 nt, Human
cagcacuuugggaggccaaggcagggggauuacuucagcccaggaguuccagacugccuggcua

SEQ ID NO: 441809 - RNA, 64 nt, Human
aguaucuauuuuacaaaaugcagagccaggucccucagcccagacucagucagacauguucacu

SEQ ID NO: 441810 - RNA, 64 nt, Human
acuaaaugugaaagcucaguggccgcuccuucuuucagcccaucaaccagcauuggucccauag

SEQ ID NO: 441811 - RNA, 64 nt, Human
aauacugaggacgcuuccccuuccuuguuucugcucagcccagaugcacagacacuauuggcaa

SEQ ID NO: 441812 - RNA, 64 nt, Human
ugggcacuguggcuuccuccugcgccugguugauucagcccaccucucugcaucccgcuucccg

SEQ ID NO: 441813 - RNA, 64 nt, Human
uguagccugaagaagacaagauuucuggacaagcucagcccaggaaacaaaggguaaacaaaaa

SEQ ID NO: 441814 - RNA, 64 nt, Human
aagccucugcuugggucacauugccaauguccucucagcccauacaaguggcaggaccaggccc

SEQ ID NO: 441815 - RNA, 64 nt, Human
gccuccccucgaagacaccucaauucacagacucucagcccacacaaugccccaguguccccag

SEQ ID NO: 441816 - RNA, 64 nt, Human
aaaaaaaacacuacuauuuuaaauaguggaacuuucagcccagcguuucugcaaugcagaguga

SEQ ID NO: 441817 - RNA, 64 nt, Human
cagaaucuucuggguaguccccuguugauuaucuucagcccaggcuuuugcuagauggaaugga

SEQ ID NO: 441818 - RNA, 64 nt, Human
uuaauggguauaauuuccuggcugccucccuuccucagcccauuagguuaaacaccaaagaaag

SEQ ID NO: 441819 - RNA, 64 nt, Human
gguggcccaucccgcauacccaucuucucgggcuucagcccagucccagcugaggaacaagcca

SEQ ID NO: 441820 - RNA, 64 nt, Human
gcaucagcgggaaccaccaucacaucuuuauuccucagcccagacacucgaggcacucaacaga

SEQ ID NO: 441821 - RNA, 64 nt, Human
agggacuccaggccagagggcuguucucacaaccucagcccacucucagucaaggagggcagaa

SEQ ID NO: 441822 - RNA, 64 nt, Human
cauugcugcgauaugcucuucuguuagacauuguucagcccacuuguagaagguccgugugcuu

SEQ ID NO: 441823 - RNA, 64 nt, Human
aaacaagguccaacccugcaaugaagcagccacuucagcccagagagauuauaagaacugaugu

SEQ ID NO: 441824 - RNA, 64 nt, Human
gguugaagagugacguggggcuaggugagaguccucagcccaagggaaaugaccucaacaguga

SEQ ID NO: 441825 - RNA, 64 nt, Human
ucagagguccagccucuauacccgugccccaacgucagcccaauccaccuugcagacacgagcc

SEQ ID NO: 441826 - RNA, 64 nt, Human
accggugggugcaaugcccgaggcuguggaacaaucagcccaucucuuugugaccuggagcagu

SEQ ID NO: 441827 - RNA, 64 nt, Human
acgcccauccuuaggccaaacaguacccaaggccucagcccacaccaagacuaaucucagccaa

SEQ ID NO: 441828 - RNA, 64 nt, Human
ugugagcagaggcugguuauaaauuugaacucccucagcccauuugcaacucugccucuguucu

SEQ ID NO: 441829 - RNA, 64 nt, Human
cagaaaauuguguuuugggauugaguucuuugucucagcccagaaucccagguccugggccugg

SEQ ID NO: 441830 - RNA, 64 nt, Human
uuugcaauguuguucuaagcuaucuaucuaacucucagcccaugauaaaguuccuuaagcuggu

SEQ ID NO: 441831 - RNA, 64 nt, Human
acagccccaagaccagccagaggggcucugaugaucagcccagccaguggccccggaaggugaa

SEQ ID NO: 441832 - RNA, 64 nt, Human
uaggccccuccgauugucccuuggggguuaccccucagcccaccucacuauggugcuggguaga

SEQ ID NO: 441833 - RNA, 64 nt, Human
aggacacccuggcccugcugaggcauacagagcuucagcccagcacagaagcaagacaaaauca

SEQ ID NO: 441834 - RNA, 64 nt, Human
ccacguucagggaggggccggcuggccuggaggcucagcccacccuccagcuuuuccucagggu

SEQ ID NO: 441835 - RNA, 64 nt, Human
gguuccagggaaauaccgccagaaaacaagaaggucagcccacucccagggccccacucuccuc

SEQ ID NO: 441836 - RNA, 64 nt, Human
gagccugguaaaaaacagccaagcccccaagaccucagcccaggcagaagcugcucuaggaccu

SEQ ID NO: 441837 - RNA, 64 nt, Human
ugggggucugggcugggcauccauggucacugccucagcccagccaggcugugccuuugacuuu

SEQ ID NO: 441838 - RNA, 64 nt, Human
uuuccucugauaaccacauggacacauccugaagucagcccaggcgcccugagcaucuuggggc

SEQ ID NO: 441839 - RNA, 64 nt, Human
ucuuucuccagcccugucuccaucugccccaaccucagcccaccuugucucuuggaccuauuuu

SEQ ID NO: 441840 - RNA, 64 nt, Human
caggaugugaacuuccccaucgcaaaugcaguucucagcccacugcaguggauacaaggaaggg

SEQ ID NO: 441841 - RNA, 64 nt, Human
gccaggcugucuacccuauggccacagcaggaggucagcccagggccaggagacacauggcugg

SEQ ID NO: 441842 - RNA, 64 nt, Human
agaacacugcugggcucccagguagcugaaggccucagcccacccacucccuucuucccugugu

SEQ ID NO: 441843 - RNA, 64 nt, Human
ugcaccugggcagcuccucccugugcccccagccucagcccaacuucuuacccgaaagcaucac

SEQ ID NO: 441844 - RNA, 64 nt, Human
ccauuccuauggaagucuagcaaagcaauacgacucagcccagcacucucugccccaggacuca

SEQ ID NO: 441845 - RNA, 64 nt, Human
acauauuacucacguauaccccauuuccuuccagucagcccaacauuuuccaccagucuguccc

SEQ ID NO: 441846 - RNA, 64 nt, Human
cugaggacccagcucugaaagggcacgaguucucucagcccauuccccaccuccccuuccauac

SEQ ID NO: 441847 - RNA, 64 nt, Human
aacugcuuuuggcggcgaccgucacacacuguccucagcccacugcaccuggggaagccccucg

SEQ ID NO: 441848 - RNA, 51 nt, Human
uuuugagaccuuacaaaugacucagcccacgugccacucaauacaaauguu

SEQ ID NO: 441849 - RNA, 64 nt, Human
ggaggggaggggagcucaagguuuggguggggacucagcccagaucuacgugagacauuuuucu

SEQ ID NO: 441850 - RNA, 64 nt, Human
uacguuauaauuuucuagaucagcacacacaugaucagcccacugaguuaugaagcugacaaug

SEQ ID NO: 441851 - RNA, 64 nt, Human
ggauccccagugaaaacuagagcucuaagcccauucagcccauuucacaccugaaaauguuagu

SEQ ID NO: 441852 - RNA, 64 nt, Human
gaugaaggauagaggcugagagaagaaggaagaaucagcccagcagguaugggcaucugggaaa

SEQ ID NO: 441853 - RNA, 64 nt, Human
cuuggugccaucuuccccugccgcaccggcagucucagcccagcccccaccuuuggguuguagg

SEQ ID NO: 441854 - RNA, 64 nt, Human
aaagaggagcagacaggguucccugggcccagucucagcccagccacugaugcuggaugaccuu

SEQ ID NO: 441855 - RNA, 64 nt, Human
aacugagacauaucucagggaauggugucugugcucagcccauccaccagaagagucugcucac

SEQ ID NO: 441856 - RNA, 64 nt, Human
agguuuuugguuuuauuauuauuucagaacuagcucagcccaucucuaauuauaaaacaugguu

SEQ ID NO: 441857 - RNA, 64 nt, Human
ugcucuuccugucagucucaaagcacaaggagguucagcccaggaggaagccagcugcaaugug

SEQ ID NO: 441858 - RNA, 64 nt, Human
cacagggcugcugucacuucccagggcccaggccucagcccaggccucgggaccaacucuuugu

SEQ ID NO: 441859 - RNA, 51 nt, Human
cuucaagagaagaacuuugagucagcccagaaucacacuccuguguauccc

SEQ ID NO: 441860 - RNA, 64 nt, Human
gugcugugcuucucagaggcaggauccaagcagaucagcccagccuagcccagcucaggcaggc

SEQ ID NO: 441861 - RNA, 64 nt, Human
caaaaaguccagaagccuugacagcuggcaucaaucagcccaagacccccaggggauucauggg

SEQ ID NO: 441862 - RNA, 64 nt, Human
acuugaucacuuagugcaucacagaguguggacaucagcccagggccgcguggugaaaucuggc

SEQ ID NO: 441863 - RNA, 64 nt, Human
cugcauaucugagcaaaaauagcaaaagccucucucagcccacuggccugaaucuacacuggaa

SEQ ID NO: 441864 - RNA, 64 nt, Human
acuacauuuguuuauaaccagaagcaaaauaaacucagcccacaaagcuagaaucuuuuccugg

SEQ ID NO: 441865 - RNA, 64 nt, Human
gggagggaggcuuccccagccuuaagagacccucucagcccagugacuguccccaaacccaagu

SEQ ID NO: 441866 - RNA, 64 nt, Human
caauugucuccaugggacgaucccagugggacugucagcccacagcucgaguggguuggaugcu

SEQ ID NO: 441867 - RNA, 64 nt, Human
cacaguuucauuguucugaauccugugguuucuuucagcccacuuuuaucgccuuaaccuaguu

SEQ ID NO: 441868 - RNA, 64 nt, Human
gagaaagccacaaagucagugccuggagaaggguucagcccaacauggggccccucucaucacu

SEQ ID NO: 441869 - RNA, 64 nt, Human
caaguccaacaacaguguccacacuagucaagguucagcccagaaaacagaaagcacucuagga

SEQ ID NO: 441870 - RNA, 64 nt, Human
ucgagucaccaccacagugcagcccagccccuggucagcccaauuucugccuucuugacggcga

SEQ ID NO: 441871 - RNA, 64 nt, Human
guccacaucucuucuagcuucacuggccacucacucagcccagagucccuaagugcucccccac

SEQ ID NO: 441872 - RNA, 64 nt, Human
aacaggagacccaccugaggcucagcccuagcccucagcccaccuggggaguuuacuaccuggg

SEQ ID NO: 441873 - RNA, 64 nt, Human
aagacuggaccucugugccaagcaguaucccuguucagcccaccuuaaagguguaggcacccac

SEQ ID NO: 441874 - RNA, 64 nt, Human
caacuggggugggugugagcagguggaaggagccucagcccaugccauuaccuccugcuuccuu

SEQ ID NO: 441875 - RNA, 64 nt, Human
cacaucccuguuugggggauaccauucaccgccuucagcccagaugauacuuuccuuuaaaucu

SEQ ID NO: 441876 - RNA, 64 nt, Human
agagaaugcucugaacucugcuaaggacauagagucagcccauggugauuuagcuccuugcugu

SEQ ID NO: 441877 - RNA, 64 nt, Human
cagccucccgaguagcugggauugcagguacccaucagcccaugcccagcuaauuuuguauuuu

SEQ ID NO: 441878 - RNA, 64 nt, Human
cccccaucuccaccccgcgggcucuccaggagccucagcccaccgccaguacucucccagcaac

SEQ ID NO: 441879 - RNA, 64 nt, Human
ucuccgaagagggucccuccuuuuugggggaaggucagcccagccccuccaaaggucugauguc

SEQ ID NO: 441880 - RNA, 64 nt, Human
uucuuguuuguugaauuugugaacaguauagaucucagcccaccaaugccaagacaaaauuauu

SEQ ID NO: 441881 - RNA, 64 nt, Human
ccuccagaauacucucucugggguugugagucagucagcccacaagcauucacagagugcuuac

SEQ ID NO: 441882 - RNA, 64 nt, Human
ccugggucaggaaauuacugcccacuugucaaguucagcccaccaucuguuugaagauuauaug

SEQ ID NO: 441883 - RNA, 64 nt, Human
ccuagcaacucggggcugaggugggaggauugcuucagcccaggaguuugagaccagccugggc

SEQ ID NO: 441884 - RNA, 64 nt, Human
uuagauuugggugaggacacagagccauaccauaucagcccagaucaaguagugacagaguagg

SEQ ID NO: 441885 - RNA, 64 nt, Human
aucucuuuuuuuuugagacagagucucgcuguugucagcccaggcuggagugcaauggcgcaau

SEQ ID NO: 441886 - RNA, 64 nt, Human
ucacccucugagcccucccaacacagcacacuagucagcccacugccacgaccucccugccagc

SEQ ID NO: 441887 - RNA, 64 nt, Human
aaauucuuuccacaccugucaaaccaaaaaucuaucagcccacguggugugguuggugaacagu

SEQ ID NO: 441888 - RNA, 64 nt, Human
ccacagccuggcuauacagugcauccuugaacugucagcccacagcagcaauaugcuuauucua

SEQ ID NO: 441889 - RNA, 64 nt, Human
ggauguaaagcaaacuuaauuguaauuaauuuauucagcccauuaagaaaguacuaaaguuuua

SEQ ID NO: 441890 - RNA, 52 nt, Human
agcccucucaccccuacuaggcucagcccagguggaggcgagaugagcuggc

SEQ ID NO: 441891 - RNA, 64 nt, Human
uuaugcuggaagaauggagaauggaaacaggccuucagcccauuggcugcgcuggagaggaaag

SEQ ID NO: 441892 - RNA, 64 nt, Human
agcagcagcagguaccagcacggcccugacugaaucagcccagugucccugagcagcuuagaca

SEQ ID NO: 441893 - RNA, 64 nt, Human
ccuccgcggguggcuccacgugaggccugagccuucagcccacgggccucagggccugccgccu

SEQ ID NO: 441894 - RNA, 64 nt, Human
gauguggggagguuuauugagcacaagauguauuucagcccaugcccccucccaaaaagaaauu

SEQ ID NO: 441895 - RNA, 64 nt, Human
cucaaggcaguguuccuggaggcucccaucagggucagcccaugcaccugcccugggugaggaa

SEQ ID NO: 441896 - RNA, 64 nt, Human
uguggguuauacacauggagugcuucuggaacuaucagcccacuugaccacccaguuuguggaa

SEQ ID NO: 441897 - RNA, 64 nt, Human
auauuuucugccaacucacuucuuuaaacaucuuucagcccagcgcugcggccccgggaagggc

SEQ ID NO: 441898 - RNA, 64 nt, Human
agaagugaagauaggaagcucaucagauagaacaucagcccaugagauguuugcaacaaaucuu

SEQ ID NO: 441899 - RNA, 64 nt, Human
caggucagagcccacccggcagguuucagaguggucagcccaguuuaagggugggagucuggag

SEQ ID NO: 441900 - RNA, 64 nt, Human
uagacaucugccaguaagccugcugagagaagccucagcccacucauaccuagagacgcugcug

SEQ ID NO: 441901 - RNA, 64 nt, Human
auucuuguguauucaguuaaugacaccaaaaggcucagcccaccccaacccuaucucauguuca

SEQ ID NO: 441902 - RNA, 64 nt, Human
uuacgcccccucccuguuucuuaucaccagcccaucagcccacugacucccauaugguagaaaa

SEQ ID NO: 441903 - RNA, 64 nt, Human
ggaaugcucauggccccuguggucugcuuguccuucagcccaugcccagcagauaccucucuga

SEQ ID NO: 441904 - RNA, 64 nt, Human
cggucccuguggccuucacuuuguucacuaccugucagcccagccugggugcacaguagcugca

SEQ ID NO: 441905 - RNA, 64 nt, Human
gauugaguuuucuucugugauucgguggagacuaucagcccaagaugcuuuaagugcacaacau

SEQ ID NO: 441906 - RNA, 64 nt, Human
cagugagccaaggagcagcauauaguccagagggucagcccauggggagcuuuguguuggaugg

SEQ ID NO: 441907 - RNA, 64 nt, Human
acuggugucugcagcaccccucaguuccugugccucagcccacaggccacugugauaauggucu

SEQ ID NO: 441908 - RNA, 64 nt, Human
ccaggagagacuugccgcuggcucccgccucauuucagcccagggugcucauccaggggcccag

SEQ ID NO: 441909 - RNA, 64 nt, Human
cugucccuuccgugucucacugucucuggaagcuucagcccauguguguccugguguucccagc

SEQ ID NO: 441910 - RNA, 64 nt, Human
ggcccaagggcaauaauaagguggaauuugcaggucagcccaggaauuggcagaggaaguaggu

SEQ ID NO: 441911 - RNA, 64 nt, Human
augcacacauuacaggagagagcugaacguucucucagcccagagcagcaaacacaugaaaguc

SEQ ID NO: 441912 - RNA, 64 nt, Human
cagcuacuugggaagcagaggcuggaggaucauuucagcccaggagguuguggauacagugagu

SEQ ID NO: 441913 - RNA, 64 nt, Human
ccucggggcucgggaucugcagcaucuauguggaucagcccacacccuucccagagccagggag

SEQ ID NO: 441914 - RNA, 64 nt, Human
acucagguugucugaagucacugcacagugcaucucagcccacauagugaugguuccccuguuc

SEQ ID NO: 441915 - RNA, 64 nt, Human
cccaggcuccagccucuccagauucugaggggucucagcccaccgcccuuggugccuucuuugu

SEQ ID NO: 441916 - RNA, 64 nt, Human
agaaugaaucaacugcuauccuuccccucaccccucagcccaggagggaaagggcauuuucuuu

SEQ ID NO: 441917 - RNA, 64 nt, Human
agaacauuuuagccauugauguucacacguggcaucagcccaugcaagauagguuucuguauuu

SEQ ID NO: 441918 - RNA, 64 nt, Human
caggacccguccaaagaugccccggggaggggugucagcccacguugcuggccuuuggggucaa

SEQ ID NO: 441919 - RNA, 64 nt, Human
gaucagccagcagcugugagagaggagcagguccucagcccaugccgcccacuaggccucagac

SEQ ID NO: 441920 - RNA, 64 nt, Human
ggauuuuauuacacagauaguggcggcaauggccucagcccagcccacccucaccugcuuuucc

SEQ ID NO: 441921 - RNA, 64 nt, Human
guuaugauuuccuauauuccaaauuccauuaaggucagcccaccauguaauuuucucaucagaa

SEQ ID NO: 441922 - RNA, 64 nt, Human
uuuaguacuguggugaggagcacuggggaaagccucagcccaauucgggcccuccaauuacuga

SEQ ID NO: 441923 - RNA, 64 nt, Human
uuuaguacugugcugaggagcauuggggaacgcuucagcccaauucggguccuccaauuacuga

SEQ ID NO: 441924 - RNA, 64 nt, Human
agugguuccggcugcccuuucuaggugauuggaaucagcccaucuaaagcagucuuuauaugca

SEQ ID NO: 441925 - RNA, 64 nt, Human
cugcaagccugaagcuggggagcccugcguggagucagcccaacagggacugcauuugcuccuc

SEQ ID NO: 441926 - RNA, 64 nt, Human
cagacagaacugcuggugugaaaggcagggauugucagcccaccugaggcugggaggaagcagg

SEQ ID NO: 441927 - RNA, 64 nt, Human
acccacuucuuccuggagcgucccugccuagagcucagcccacaggacugcuucaggccguggc

SEQ ID NO: 441928 - RNA, 64 nt, Human
uuuucaguucugcucuaacauggcaugcccuuucucagcccaggaaacagcaugugguucagag

SEQ ID NO: 441929 - RNA, 64 nt, Human
ucugcagcuuugguuuauaaguguuugggccuuaucagcccaucugauccagaucaauauuuuu

SEQ ID NO: 441930 - RNA, 64 nt, Human
gaggcuugucagagcugggagggguuuucgaagcucagcccaccccccucauuuuggauauagg

SEQ ID NO: 441931 - RNA, 64 nt, Human
gaaguagaaaaugauugaaagugacuuccguaucucagcccaugacucagcaaggcagaauggc

SEQ ID NO: 441932 - RNA, 64 nt, Human
uacaccaguauuugguucaagacaccaaaugucuucagcccauggcugaagaacaacagaagag

SEQ ID NO: 441933 - RNA, 64 nt, Human
gaaaaacagucacugacucaagacacugagauauucagcccacugcccaaugccugcuuccugg

SEQ ID NO: 441934 - RNA, 64 nt, Human
cucuguggcagacucagugcuguguggcgccuccucagcccagggcugaguuuuaagauuuucu

SEQ ID NO: 441935 - RNA, 64 nt, Human
uucucuuggagugagggaggcuaccuggaggggaucagcccacugacagaccuuaaucuuaauu

SEQ ID NO: 441936 - RNA, 64 nt, Human
cucucuggucccacaacgaugacucugccucuugucagcccagccaagagcccagacgaccccu

SEQ ID NO: 441937 - RNA, 64 nt, Human
gggacuggcugggcugcugcaggccgugugucugucagcccaaccuucacaucugucacguucu

SEQ ID NO: 441938 - RNA, 64 nt, Human
ggcuucugugugccuguuaaugcaguccuguuccucagcccaggcccucuuggcacagcugugg

SEQ ID NO: 441939 - RNA, 64 nt, Human
cacaaggucagaugauaaacagaagcacaggaacucagcccauggccgcaagcuggucaaggcc

SEQ ID NO: 441940 - RNA, 64 nt, Human
uggcuuugguuuucagggucuaacguagcuguccucagcccagcguaguuguaauugcuuuaaa

SEQ ID NO: 441941 - RNA, 64 nt, Human
gccuggucagcugccugcacaggcagaggugcccucagcccagauuagcaacacucauaguuuu

SEQ ID NO: 441942 - RNA, 64 nt, Human
uuuagcuugagugauggcuucagggguuggaaguucagcccaaacugaagggggccaugccuug

SEQ ID NO: 441943 - RNA, 64 nt, Human
ugccuucucaaagcagagaggcagcuuaucaaacucagcccaaaacucuguuuacauggguggg

SEQ ID NO: 441944 - RNA, 64 nt, Human
ccccacagggccaggcuggcaggggccagugggcucagcccagguaggggcaggauggagggcu

SEQ ID NO: 441945 - RNA, 64 nt, Human
cuguguaagugaagggacucauuuuucuuugcuuucagcccauguaaauaaauaauacaguauu

SEQ ID NO: 441946 - RNA, 64 nt, Human
uggggcccugagauggccccagcuccucuuguccucagcccaccccucauugugacuuaugagg

SEQ ID NO: 441947 - RNA, 64 nt, Human
aguaccagccccccagcccacccacuuggcccacucagcccauucaccaggcgcuggucucacc

SEQ ID NO: 441948 - RNA, 64 nt, Human
gaguguggcucagccaucccggcuggguuugccaucagcccaggauacucaccgugucacagcu

SEQ ID NO: 441949 - RNA, 64 nt, Human
cucccuccccucugcuggccagagggucugcaucucagcccacccccaaccccaccguuugggg

SEQ ID NO: 441950 - RNA, 64 nt, Human
ccaaccccaguucuggccacguacagccagcgggucagcccagaggcagccucagcuccagggc

SEQ ID NO: 441951 - RNA, 64 nt, Human
gaaacccaugccucccagcugagcacugggaaugucagcccaguaaguauuggccagucaggcg

SEQ ID NO: 441952 - RNA, 64 nt, Human
ucccuucucaccucuggagcugugcugcacugcuucagcccagagggcccugagagaggagcgu

SEQ ID NO: 441953 - RNA, 64 nt, Human
cuccuuuuauguguaguugucucucuucagacucucagcccagaagaaaauucuccugauaaaa

SEQ ID NO: 441954 - RNA, 64 nt, Human
cccuccaagugcuuguuauauaccuccacgggugucagcccagaugacuccucacccauccacc

SEQ ID NO: 441955 - RNA, 64 nt, Human
agguagccccugaaccauaauaggcucagaggcuucagcccagcugcauaguugaagauuuaug

SEQ ID NO: 441956 - RNA, 64 nt, Human
ucgcaaaauaaacaggauuuacugaguagagguuucagcccauuccuuggaauacuaacaggua

SEQ ID NO: 441957 - RNA, 64 nt, Human
ccccagcaagauuuuugucaagagcgagacuccaucagcccaggcagacgggagcagguucuug

SEQ ID NO: 441958 - RNA, 64 nt, Human
ggaguggguugagcugauagagaaaaaacggccuucagcccaggcugggaagcgccuucuccag

SEQ ID NO: 441959 - RNA, 64 nt, Human
ucugugaggaacaccgccuuacucugagccucgcucagcccagcugacugugccuguucugagu

SEQ ID NO: 441960 - RNA, 64 nt, Human
ggaguucuagccccaucgccgacacgccccccacucagcccagcccgccugucccuagauucag

SEQ ID NO: 441961 - RNA, 64 nt, Human
uguguccacauagagcugacgugagaaauaucuuucagcccaggagagagggguccugaucuua

SEQ ID NO: 441962 - RNA, 64 nt, Human
gaacuugacaacagcucucccuuuacccuggacuucagcccaaguuccgucuuuggucuuggug

SEQ ID NO: 441963 - RNA, 64 nt, Human
cagccaagcccagagucccccagcggcucgcaugucagcccagaccccaggguccuuggccuag

SEQ ID NO: 441964 - RNA, 64 nt, Human
gccguuuccccuccuuggcuuuaugcaaauacaaucagcccagugcaaacggcucgucuccgug

SEQ ID NO: 441965 - RNA, 57 nt, Human
uggaucacuucgauaagugagaccugcucagcccacccccacccauccucagcuacc

SEQ ID NO: 441966 - RNA, 64 nt, Human
ccauccacuccggugccuccauuuagcuggccaaucagcccaggaggggcagguuccccggggc

SEQ ID NO: 441967 - RNA, 64 nt, Human
cccuccaagagggcagcgcucccaguggugggacucagcccagacugcccuggggcagcuuccu

SEQ ID NO: 441968 - RNA, 64 nt, Human
uuauaauaaacugguaaacauuguaaccgcagauucagcccaaucugguucaacuuuguguaau

SEQ ID NO: 441969 - RNA, 64 nt, Human
cuucccuugacuggguuguguuucuuuuccugccucagcccagcucugcaaauccccucccccu

SEQ ID NO: 441970 - RNA, 64 nt, Human
cugggaggggacuucuuuuucuaaaacacaaaacucagcccagccaggcccccucccuggaggc

SEQ ID NO: 441971 - RNA, 64 nt, Human
cauccuugccuugcagcgugaccgagauaggucaucagcccagggcuucagucuuccuuuauuu

SEQ ID NO: 441972 - RNA, 64 nt, Human
gaccccugccccuccggggacaccggccccgcccucagcccacuggucccgggccgccgcggac

SEQ ID NO: 441973 - RNA, 64 nt, Human
gagcaaaaccaucaaccaccaggcagccaggccaucagcccaccuccaccucuggagggucccc

SEQ ID NO: 441974 - RNA, 64 nt, Human
gcugcagauaacuagccagacccaucccuuuauuucagcccaucccuuuauuuccuguaagaaa

SEQ ID NO: 441975 - RNA, 64 nt, Human
auguggagauagagccccagauguuucagccaucucagcccaggcaccagacaagugggugaag

SEQ ID NO: 441976 - RNA, 64 nt, Human
cguucugucuguggcacauucuuaaauauuuccaucagcccaucucaacaauauauguccuaua

SEQ ID NO: 441977 - RNA, 64 nt, Human
ggccucaguuucccuccucugcaaaacgagggggucagcccaagauucuucagucuggacuaua

SEQ ID NO: 441978 - RNA, 64 nt, Human
ugagggcccagaaagucugaucucuccagaaugaucagcccagaggaaugcugagaaaucaccu

SEQ ID NO: 441979 - RNA, 64 nt, Human
caaccauuuuccaaccauuuucugugaaaugcugucagcccaaacuccaaagggaugugcagcc

SEQ ID NO: 441980 - RNA, 64 nt, Human
uggcagaaauccugcugaaugucauucagaaaccucagcccauggucgcccuccugugccccuc

SEQ ID NO: 441981 - RNA, 64 nt, Human
uucgagauggcagauucccacugccgcugcccgcucagcccagcuguugggaacagcauggagg

SEQ ID NO: 441982 - RNA, 64 nt, Human
gcacccuggggucuuugugaauauccagacuguuucagcccagcccaucucagccaacccuccu

SEQ ID NO: 441983 - RNA, 64 nt, Human
ccucccugagccagccuccgcucaguguggcuccucagcccacagaggggagggagcauggggc

SEQ ID NO: 441984 - RNA, 64 nt, Human
ucucgcccgcaacgcuggccggcauagcguggcgucagcccagcugcaggagaagcuggcagga

SEQ ID NO: 441985 - RNA, 64 nt, Human
ggaaaaauacuuguuuauaggcugcauccuuuuuucagcccaacauuuagcuuuauggagugcc

SEQ ID NO: 441986 - RNA, 64 nt, Human
guguuuuuauguccuuuuuguuggacuugaguacucagcccaguuguucucauagaugcuuugc

SEQ ID NO: 441987 - RNA, 64 nt, Human
ucuccuccuggacuugggccugguggaagggcucucagcccagggaucagggacugggcugcuu

SEQ ID NO: 441988 - RNA, 64 nt, Human
accugugugcuugguuuacagguccagugguucuucagcccaugacagaugagaaggggcuaua

SEQ ID NO: 441989 - RNA, 64 nt, Human
cugagucccaggaaacagugcuuuccgaugagacucagcccaccauuucuccucaccugggccu

SEQ ID NO: 441990 - RNA, 64 nt, Human
uuagcugaaugucauuucguacaccacagcucagucagcccauggccuucgugaacuuugcucc

SEQ ID NO: 441991 - RNA, 64 nt, Human
aaccuagaaguggaccuugugugugugcauggugucagcccaaagccaggcugagacaguccuc

SEQ ID NO: 441992 - RNA, 64 nt, Human
uggcccaccagagccucccucagccacgccucucucagcccaggucuccugggcaucuggcccu

SEQ ID NO: 441993 - RNA, 64 nt, Human
aacaaaaccagcaucuguuacuggaacagagaccucagcccaagcucaggacaaggaggccucc

SEQ ID NO: 441994 - RNA, 64 nt, Human
cagugguagaacgcucaacuugguugcgguaccaucagcccaccugcauuuggcuuucgacuug

SEQ ID NO: 441995 - RNA, 64 nt, Human
ggagccugcaggcaggugggggcugcgucccugcucagcccauccccugccucuaucccuggcc

SEQ ID NO: 441996 - RNA, 64 nt, Human
auuugugagaccuacccuguaacgccugccccucucagcccaacaucagcuuccucuuucuccc

SEQ ID NO: 441997 - RNA, 64 nt, Human
caucugucagguuugcacaugcuguuuuuuuuucucagcccacguguucucccccacguggggu

SEQ ID NO: 441998 - RNA, 64 nt, Human
gugguuugguuuuauaauuaaucagcucguuacuucagcccaugaaaauggcauccagggcugc

SEQ ID NO: 441999 - RNA, 64 nt, Human
ugucagugccaagaggcugcgccaggccacucucucagcccagggccugcccuccuguccuccc

SEQ ID NO: 442000 - RNA, 64 nt, Human
auuguccuuguguauccugacagcgccaugugugucagcccaugucaaucaagaugggugauua

SEQ ID NO: 442001 - RNA, 64 nt, Human
cgccuacugccacagggucaaaggagguuuucgaucagcccagaccagaggcucugagcccuga

SEQ ID NO: 442002 - RNA, 64 nt, Human
ucaucucacgaagaaucccucacucuucccggguucagcccagaagcccuuccaggcaugaucu

SEQ ID NO: 442003 - RNA, 64 nt, Human
ggaagccacagcagaaauggaagaaaaacaggucucagcccaggguccucgcucacucccucac

SEQ ID NO: 442004 - RNA, 59 nt, Human
cugccauugccgccuccugaccaccaggcucagcccaccccuccaccucucucucgauu

SEQ ID NO: 442005 - RNA, 64 nt, Human
acccucacugccuccaaagcccagagccugccugucagcccagcuggagggcccgaggcugcag

SEQ ID NO: 442006 - RNA, 64 nt, Human
aaggcucgggggucaggagcucagcguccgcuacucagcccagccaaaacccucccagacgucu

SEQ ID NO: 442007 - RNA, 64 nt, Human
ggcagaguuggccccucuguggccagccuggcccucagcccagcagagagggcaucaaccaagg

SEQ ID NO: 442008 - RNA, 54 nt, Human
acccuggccauauggaguagcugaucagcccacacuugccccgcccucccacac

SEQ ID NO: 442009 - RNA, 64 nt, Human
cuaugccugccccguccucacucaguguggccucucagcccaacugcaggugguaggauagggg

SEQ ID NO: 442010 - RNA, 64 nt, Human
ggggcugcugggguuggaauguggaacugcagccucagcccaucuggcagagucccaggaacuc

SEQ ID NO: 442011 - RNA, 64 nt, Human
gucucuagcaucuccagcaggacuccaggaugguucagcccagcaccauccaaagggugggagc

SEQ ID NO: 442012 - RNA, 64 nt, Human
acccuguauccugucuccccuaauugacauucuaucagcccaacccucauucugcagggccacc

SEQ ID NO: 442013 - RNA, 64 nt, Human
cgugccccccaccccccugcccuccucaggguggucagcccaaccugucggaccuucacuucac

SEQ ID NO: 442014 - RNA, 64 nt, Human
cucuaccucccccggcaggcaauguccuggcuucucagcccagcaccaucuguuccccuagacu

SEQ ID NO: 442015 - RNA, 64 nt, Human
gagccuggacuugaccaauuaauucccuuaccuuucagcccaagauagcuacaugucuuuacuu

SEQ ID NO: 442016 - RNA, 64 nt, Human
uaacacauagccaguccuaacuccguacucugugucagcccauccccuagacacccucuguuuc

SEQ ID NO: 442017 - RNA, 64 nt, Human
cccuccacgcuuagggucugucccggguacucagucagcccagugggaucuuacccacuucccu

SEQ ID NO: 442018 - RNA, 64 nt, Human
auaaauuuagauuuuaaaauguucccuguaaaagucagcccaugacaaggaaauuuacaaaaua

SEQ ID NO: 442019 - RNA, 64 nt, Human
uuggcuaggccggucucuccugaccucagggugaucagcccaccucggccucacaaagugcugg

SEQ ID NO: 442020 - RNA, 64 nt, Human
aacugacacucccacccagucucugcuccaccuuucagcccacgucacguguaguguccauuuu

SEQ ID NO: 442021 - RNA, 64 nt, Human
uagucuuuauuuauggucgugcccuucccucuccucagcccagaguguucugcgugggugguga

SEQ ID NO: 442022 - RNA, 64 nt, Human
uuuaacauaugaauuuugggggggaugcaaucauucagcccauaauacccucuaacauauuaau

SEQ ID NO: 442023 - RNA, 64 nt, Human
gguggggcuguccaguuagcugugcccugcaccuucagcccaggaaagauuugaacagagcaaa

SEQ ID NO: 442024 - RNA, 64 nt, Human
agggucccauauugggucaagcugcuuaccugccucagcccaggauucuuuauucugggggagg

SEQ ID NO: 442025 - RNA, 64 nt, Human
acaaauaguacuuaaaaacaaaacaaacaagcacucagcccagcuccucaauacuaccuggaaa

SEQ ID NO: 442026 - RNA, 64 nt, Human
ugcuguaaaagcaaguccugcaaccaaacucccaucagcccaaucccugaucccugaucccuuc

SEQ ID NO: 442027 - RNA, 64 nt, Human
acccgccuccuuuucguaacacuguuccccccggucagcccaucuagcccuguccuccauuccu

SEQ ID NO: 442028 - RNA, 64 nt, Human
gcuauuuauugaaaggggauguggcuucacgaguucagcccauuguacgugcaggucccguggg

SEQ ID NO: 442029 - RNA, 64 nt, Human
gaaaguagugcuguaaauauucugccauaggaauacugucuacaugcuuucucauucaagaauu

SEQ ID NO: 442030 - RNA, 64 nt, Human
cuauugcacuaauucuagaugucuaauucaggauacugucuauagaaaggcauucuuaaaaguu

SEQ ID NO: 442031 - RNA, 51 nt, Human
cuccaggucccaagcgauaacacugucuaagcacccccaagccacuaucca

SEQ ID NO: 442032 - RNA, 64 nt, Human
agcuugagaaauagauuuuuuuuaucuuaaagucacugucuauuuaagauuaaacauacaauca

SEQ ID NO: 442033 - RNA, 64 nt, Human
ugccuugauaauauguuagcccauaccccaaauaacugucuauauuagacacccccagccaguu

SEQ ID NO: 442034 - RNA, 64 nt, Human
ggauucgagagccaugcgugggacacuggacccuacugucuacacgggcuugcacacagcaggu

SEQ ID NO: 442035 - RNA, 64 nt, Human
ucuugacucaacgagagcacuugaaaaugaaaugacugucuaagagaucuggucaaagcaacug

SEQ ID NO: 442036 - RNA, 64 nt, Human
caccucuucugccagccuccccacauauggcacaacugucuaaugacacgguaggccaagcuga

SEQ ID NO: 442037 - RNA, 64 nt, Human
aauuguucgaaagcccacaguuauggaaagaauuacugucuagauggucugcagaacguguuug

SEQ ID NO: 442038 - RNA, 64 nt, Human
gaagucacucacacuggccacaaggacgcuggcuacugucuauuaaaauucugauguuucugug

SEQ ID NO: 442039 - RNA, 64 nt, Human
accgccaccaccucccacaucccugagguuggcgacugucuacacuccucccccgagaccaccc

SEQ ID NO: 442040 - RNA, 64 nt, Human
ggguccaaacuguaaugcucaaaauaauaaaugcuuacacgaaaauuauuuauugagaauauuc

SEQ ID NO: 442041 - RNA, 64 nt, Human
acuuguuaaucuguugcugacuagcauuagacuguuacacgaagauaaacugaauaagcauuua

SEQ ID NO: 442042 - RNA, 60 nt, Human
aaggggaugaaaaaaaaauccuuaauucagggccgacauuaucuacuuaaacaacuuuga

SEQ ID NO: 442043 - RNA, 64 nt, Human
accuccaccuccccugagcccugugagaggcacgacugucuaugccaaugaggcucgguggggg

SEQ ID NO: 442044 - RNA, 64 nt, Human
cagacauggaggcucggcugaaccaggacuccucacugucuaccugagagaaugagcaccccuc

SEQ ID NO: 442045 - RNA, 64 nt, Human
cccugcuuaccagauaaugcuacuuuauuuauacacugucuagggcgaagacccuuauuacacg

SEQ ID NO: 442046 - RNA, 64 nt, Human
ggacauuuugucaacuauggguauugggugcuuaacugucuaauauugccaugugaauguugua

SEQ ID NO: 442047 - RNA, 64 nt, Human
uacuucuccuccucggagccccagucccauguccacugucuauuuauugcauucccuugcccca

SEQ ID NO: 442048 - RNA, 64 nt, Human
ucaugauuguuuuguaauaacaagaaggagcaucacugucuacucagaagacugagaaaccugc

SEQ ID NO: 442049 - RNA, 64 nt, Human
uuucucucuucuguccaucagccugucccucccaacugucuaggacagucuucggucaccuaaa

SEQ ID NO: 442050 - RNA, 64 nt, Human
ccuuuugaaugaugccuuuauaaaucuuucucucacugucuauuuaagugcaauuaacauaugu

SEQ ID NO: 442051 - RNA, 64 nt, Human
uguucuauaugugguccauuacugacugaaguauacugucuagaagucugaggcucaaagaaaa

SEQ ID NO: 442052 - RNA, 64 nt, Human
uaggcagaggauauguguguguguauuacaugggacugucuagagguuccauuucccaauaggg

SEQ ID NO: 442053 - RNA, 64 nt, Human
uugcaauugaaauaacaggguuaccuuaacaaugacugucuaugaugugucaguucuuaucuga

SEQ ID NO: 442054 - RNA, 64 nt, Human
uuucauguacaucuuuucaaagcuagaaauaagcacugucuaaguuuauguugcauuuuuaguc

SEQ ID NO: 442055 - RNA, 64 nt, Human
uugucauuguuauguuuuguuauugauucucauuacugucuaauuuuuuuucugguauuagucu

SEQ ID NO: 442056 - RNA, 64 nt, Human
cugcauagaggaacuagucagaaguggggaaaacacugucuaauuuuuaucagucugguauaaa

SEQ ID NO: 442057 - RNA, 64 nt, Human
gauguguuguuguuuuuaucauuggauuuuaacuuggcccgagugaaauaaucagauuuuuguc

SEQ ID NO: 442058 - RNA, 64 nt, Human
cgcgggagugcauggcagcucugggucccagaccuggcccgaccccucugcuucaccuccagcu

SEQ ID NO: 442059 - RNA, 64 nt, Human
uugcuagagucaccgucauucugaggucaaaucauggcccgaggacaagggcuguaagacaggg

SEQ ID NO: 442060 - RNA, 64 nt, Human
aaauggacagaaauaggaaauggacuuuuuccuuacugucuauaccuccugaaccuugguauug

SEQ ID NO: 442061 - RNA, 64 nt, Human
gaaaggcccagagcccugugcgggggaauguggcacugucuauccauccgguggacugggcagc

SEQ ID NO: 442062 - RNA, 64 nt, Human
ucuuuaugccuggugcaguauaauucccaaguguacugucuaccagaaaaaaaaaacaaaacua

SEQ ID NO: 442063 - RNA, 64 nt, Human
acaacuauuaguacauuaagagggaagcaaaguuacugucuauuuaaaacugcaagcaguuaac

SEQ ID NO: 442064 - RNA, 64 nt, Human
gcauaauggauaggaaugaaugaacuuuuaagauacugucuagcucuaaaauuggaagaacaaa

SEQ ID NO: 442065 - RNA, 64 nt, Human
gagccaaaaagcuuuucaucucuccagggggaaaacugucuaguucccuucugugucuaaauuu

SEQ ID NO: 442066 - RNA, 64 nt, Human
agugguccaaaaacacuuuucuguaaguuucuauacugucuaaaaccuuauggugaccagaauu

SEQ ID NO: 442067 - RNA, 64 nt, Human
uuuauuuaguguuuucucagucacaauuuucuuuacugucuagcaugaucugcaugaccuauaa

SEQ ID NO: 442068 - RNA, 64 nt, Human
aauugugaacucauugcucccuaagacugugacaacugucuaacuuuagaagugcauuucugaa

SEQ ID NO: 442069 - RNA, 64 nt, Human
ucauauaauaauuuguuuugucauauuugcuuucacugucuauuaucuguuuaagucucauaac

SEQ ID NO: 442070 - RNA, 64 nt, Human
aucaauacugauuaauugauuuauaagguucaacacugucuacccuaaauaauuuuuauaugcu

SEQ ID NO: 442071 - RNA, 64 nt, Human
aaugccaucuaucuaguucuaacagugaaguuuuacugucuauuaauauucaggguaaauagga

SEQ ID NO: 442072 - RNA, 64 nt, Human
uucuaaaagugagaguaucacacccuaaaugaacacugucuacuaagagacaucauuccauuuc

SEQ ID NO: 442073 - RNA, 64 nt, Human
uguggguagucccuccuacuaggaggcuugucauacugucuagagguugacucuuaguucugua

SEQ ID NO: 442074 - RNA, 60 nt, Human
uggcccugugcccuacaauggggccagcugggccgacagcagaauaaaggcaauaagaug

SEQ ID NO: 442075 - RNA, 60 nt, Human
guuuucugagcgggcuugugauaugcacguggccgacaugcugguuaaggugagccagcg

SEQ ID NO: 442076 - RNA, 60 nt, Human
uaguuaccgcggggaccacaucaagcuucaggccgacagcuucggccuccacaucguccc

SEQ ID NO: 442077 - RNA, 64 nt, Human
uugagaugaaaugacauacaagcuucaggguaaaacugucuacuagcaagauuaccucccucaa

SEQ ID NO: 442078 - RNA, 59 nt, Human
augucaagcuucuggagugacuagagcucacugucuacugcaacugugauuucccaugu

SEQ ID NO: 442079 - RNA, 64 nt, Human
uuuauaaguaauguuuguaucuauuucaugcuuuacugucuauauacuaauaaagaaauguuuu

SEQ ID NO: 442080 - RNA, 64 nt, Human
uguaaaagauaaugacuguauuaaacuuuguauaacugucuauugugaaaaacugaguagggua

SEQ ID NO: 442081 - RNA, 64 nt, Human
ggccggaugccauaguggaacauccagaagggcaacugucuacugucugcuuauuuaagugacu

SEQ ID NO: 442082 - RNA, 64 nt, Human
ugaaaacaccguagucugcuuuuccugaaaggugacugucuaggaugcugaaugagccaccacu

SEQ ID NO: 442083 - RNA, 64 nt, Human
aguccuacuuuuaaagaauuucuuuauaaaauuuacugucuaagauuaauagcauucgaagauc

SEQ ID NO: 442084 - RNA, 64 nt, Human
ugagacuccaugagaaagucccuuucugaggcccacugucuaccuugccagauccucagugcgu

SEQ ID NO: 442085 - RNA, 64 nt, Human
agguaggcuuaacaacuuacuugagaauuuugcaacugucuaugcagcugaaucuaaguauggu

SEQ ID NO: 442086 - RNA, 64 nt, Human
auuaguuacaaucucauguuuguguuuucuuaguacugucuauuuacaaacacguaaaaaauac

SEQ ID NO: 442087 - RNA, 64 nt, Human
uauauuauaagauuuuuaggugucuuuuaaugauacugucuaagaauaaugacguauugugaaa

SEQ ID NO: 442088 - RNA, 64 nt, Human
aacagaaaguuuauuggauuuaguacugauauuuacugucuauuuuuguuacuuuguucuuagu

SEQ ID NO: 442089 - RNA, 64 nt, Human
gaaaauaaaagaaaaauuaaaguaaagcuaaggaacugucuauaagucagaguccuguuccuac

SEQ ID NO: 442090 - RNA, 64 nt, Human
auuuuguuuaucacguuuugcacaaagcagagccacugucuaacacagcuguuaacgaaugaua

SEQ ID NO: 442091 - RNA, 60 nt, Human
ccucuuuggaugagaucaguguccacaaguggccgacauggaacaugcugagcaguggcu

SEQ ID NO: 442092 - RNA, 60 nt, Human
gcuucuuaccacugugugucagcugggauuggccgacagcgugguggugacuucuaggua

SEQ ID NO: 442093 - RNA, 60 nt, Human
aagaugggcuaugaguuuggcaaggguuugggccgacacgcggaaggccggguggagccc

SEQ ID NO: 442094 - RNA, 64 nt, Human
aaacuuuuccaaguaguaagugagacucccucuuacugucuacgaauacacaauaaagagauga

SEQ ID NO: 442095 - RNA, 64 nt, Human
cugauaaaaggaggucuacaugaaagcaaaagcuacugucuauuucugacccagcucauggaau

SEQ ID NO: 442096 - RNA, 64 nt, Human
uggaucagccaugcucagcugugacgccugaauaacugucuacuuuaucuucacugaaccacuc

SEQ ID NO: 442097 - RNA, 64 nt, Human
ugacuuaucucuugcuuucuaaaccuuguuucuaacugucuaucaaauaucuucauuagacauc

SEQ ID NO: 442098 - RNA, 64 nt, Human
ggugggaugccaucauauuuaggggugguugggaacugucuacugcuuuagcauuugugucuuc

SEQ ID NO: 442099 - RNA, 64 nt, Human
uucuggugaaucuuggucauuggguuaguauaugacugucuauaauauuuuccauuuguauuau

SEQ ID NO: 442100 - RNA, 64 nt, Human
gaaacucacaaaccuagacauggaaaaacagauuacugucuauugucagcaucauuuucaucug

SEQ ID NO: 442101 - RNA, 64 nt, Human
ugcagccagauucacuggcugaugcucacugcucacugucuauccccacgaaauuuaguuuuau

SEQ ID NO: 442102 - RNA, 64 nt, Human
aggauuguuugacuuaaucaauauuaguggaaguacugucuauguuauuagauugaguggccug

SEQ ID NO: 442103 - RNA, 64 nt, Human
uuggaauguguuguaaguuucuuugcuuacuuuuacugucuauauauauagggagcacuuuaaa

SEQ ID NO: 442104 - RNA, 64 nt, Human
ugaaguucaaggaaaguucuucucaguguaaugaacugucuagcaauauuauaguuauucuuga

SEQ ID NO: 442105 - RNA, 64 nt, Human
caguucaucacaggguucagcagaguacaagaccacugucuaauuuugacuucaugggaauuuu

SEQ ID NO: 442106 - RNA, 64 nt, Human
cacacacacacacacacaccccuaccccacacugacugucuaccgacaaagacccuauuuccug

SEQ ID NO: 442107 - RNA, 64 nt, Human
uuuacuucaaaaucccucagccuuguucuucacgacugucuauacugagagugucauguuucca

SEQ ID NO: 442108 - RNA, 64 nt, Human
augaacuuacagaauucucauccuuccacugaguccgcugaagggauuuaugugcacaaccacc

SEQ ID NO: 442109 - RNA, 64 nt, Human
gccucugccggccucccagccgggcuccugaagcccgcugaaaggucagcgacugaaggccuug

SEQ ID NO: 442110 - RNA, 64 nt, Human
cuucaaccuuaagauuuaggaaguucuuuccccaacugucuaacuuggaaagguagaugagucu

SEQ ID NO: 442111 - RNA, 64 nt, Human
auguauucuuggcuaaaggaucagcugguucaguacugucuaucaaagguagauuuuacagaga

SEQ ID NO: 442112 - RNA, 64 nt, Human
aaauguuuuaguaaaaaagagaauuguagauaauacugucuaggaaaauaagaauuagguuucu

SEQ ID NO: 442113 - RNA, 64 nt, Human
uaucaggagcugugauaaguaaguguuuacauacacugucuagugcauaaaaaccuuaguguuu

SEQ ID NO: 442114 - RNA, 64 nt, Human
cgacaacuauaauacuaacccuuuucucaggauaacugucuacaccuggcaguuuucucugacg

SEQ ID NO: 442115 - RNA, 64 nt, Human
uuuucauuauagauuaaugaacugcuggucagguacugucuacaauggcugugcauaccuauaa

SEQ ID NO: 442116 - RNA, 64 nt, Human
auucuuaugaaagugcuugagcuuuuaaccagguacugucuaacaacagucaucuuuugguucu

SEQ ID NO: 442117 - RNA, 64 nt, Human
aggaggguguguacagggcaaaaugccaaaaagcacugucuaguugaaaguucccuucuccacc

SEQ ID NO: 442118 - RNA, 64 nt, Human
uguacauuuuuaaauucuuacucuggagcaaccuacugucuaagcaguuuuguaaauguacugg

SEQ ID NO: 442119 - RNA, 64 nt, Human
aguucuuaguaacuuuacccacuagugaagagauacugucuauuuucaauguggacucggaaaa

SEQ ID NO: 442120 - RNA, 64 nt, Human
agauggggaaacuaaggucagaaggguuaacucaacugucuauugucacaugaugaauaaauag

SEQ ID NO: 442121 - RNA, 64 nt, Human
gauuucuaggauuucuaacuccagcuguucccauacugucuaguuuaaauuauggcuguuaagg

SEQ ID NO: 442122 - RNA, 64 nt, Human
cucauuuuacuuuuauuuuguguaauuugaugacacugucuaucaaaaaagagcaaaugaagca

SEQ ID NO: 442123 - RNA, 64 nt, Human
ccaucuguaugcuagagaggggugaggaauggauacugucuaacagucucugauuucaacacua

SEQ ID NO: 442124 - RNA, 64 nt, Human
caccauucucccccccucaacagcacacucagugcagcaagacugaccccugacccccucccag

SEQ ID NO: 442125 - RNA, 64 nt, Human
auggaagagaaggagcuuggaugaggaaacuguucagcaagaggaagggcuucucacacuuuca

SEQ ID NO: 442126 - RNA, 64 nt, Human
cuauuugaguuucacuuccagagaacuuguucuucagcaagaaugugucacuaguaaggacauc

SEQ ID NO: 442127 - RNA, 64 nt, Human
ugcagugcaacacuugcacuuuaauuuuccuccaacugucuaaaauuagagcaaauacauuggc

SEQ ID NO: 442128 - RNA, 64 nt, Human
gcugcaggugcagacccaaacuuagauccccucaacugucuacuuguugcagugagggccaaua

SEQ ID NO: 442129 - RNA, 64 nt, Human
acucagcuaugcuagggcuuggcuguaggugugcacugucuauuuacauccguccuuacaacca

SEQ ID NO: 442130 - RNA, 64 nt, Human
uacgggucccucuaacccaguggcuggaagaaccacugucuagagcaacuuuucuuggaacugu

SEQ ID NO: 442131 - RNA, 64 nt, Human
agaaguuucauugauauccacuggucacaucauaacugucuauagggcaauaaaaucuguguua

SEQ ID NO: 442132 - RNA, 64 nt, Human
gguucucucucugccugugagaagcggaauggguacugucuaggaggacugggcaggguggggg

SEQ ID NO: 442133 - RNA, 60 nt, Human
cugggggcggcugcuguugagucuguuuuuacugucuagcugcccaacggggccuacuca

SEQ ID NO: 442134 - RNA, 64 nt, Human
aucguguacgcuauucuagugcuuguggcccaguacugucuaugaguugucgugcuccuguuuc

SEQ ID NO: 442135 - RNA, 64 nt, Human
uguucuuugcuuuaaauuccuggcacuucuuuuuacugucuauaagagaaaaccuaucauaagc

SEQ ID NO: 442136 - RNA, 64 nt, Human
acagugaucauaucugauugauuuccauguguccacugucuagcacagggcaauaaaaaauaca

SEQ ID NO: 442137 - RNA, 64 nt, Human
gcccuccugugugccaccuuacagcucaugcagaacugucuacuugaucuggagggcauugaca

SEQ ID NO: 442138 - RNA, 64 nt, Human
auuuuaagucugucuaauggagaguuuuuuuuaaacugucuaccucauauaauacaaguauuua

SEQ ID NO: 442139 - RNA, 64 nt, Human
uucauuaucauaugaacuugucagugggaaacaaacugucuaaaaauuuuucucuuacguuuaa

SEQ ID NO: 442140 - RNA, 64 nt, Human
uagaauuaauauauuuauaaagaaagagaccaaaacugucuagaauuugaaaggguuuacauau

SEQ ID NO: 442141 - RNA, 64 nt, Human
ccagguucucacacuggcccagagaaaagagccucagcaagagaguuuugccaacaauuccccu

SEQ ID NO: 442142 - RNA, 64 nt, Human
gaacaaauuuaaggcuuaaaaaauacuuuaugagcagcaagauugcuuuaacuuuuaaaaugaa

SEQ ID NO: 442143 - RNA, 64 nt, Human
aaucccauuuaagguuagggguugguccuuaugccagcaagauuuaaccaacuguaaagauagu

SEQ ID NO: 442144 - RNA, 64 nt, Human
agccugucacuuucagcccgggacugcccagaugacugucuaaccagaccucagaaucagaaac

SEQ ID NO: 442145 - RNA, 64 nt, Human
gcauuugucuuuguaauauuuuccauaaauuuggacugucuauaucauaacuauacuugauagu

SEQ ID NO: 442146 - RNA, 64 nt, Human
aaaguugcuggugacauuucuugccaauucuaacacugucuagggaagaguuccuagucuauug

SEQ ID NO: 442147 - RNA, 64 nt, Human
gggacagucuuuagauauuauuugaaaugcuggcacugucuaucuggaucccagggcuugaacu

SEQ ID NO: 442148 - RNA, 64 nt, Human
cuuauacaauugaaacuguauucauuaaacaauaacugucuauucccucuuuuccccagccucu

SEQ ID NO: 442149 - RNA, 64 nt, Human
cugacauucauuguaaaucagugaacuguaagauacugucuaaaaaauguacauuuguaauuag

SEQ ID NO: 442150 - RNA, 64 nt, Human
gcuaaguguuuuuuuauuuuugcauauuuauugaacugucuaauugaauacagcuugcucuugu

SEQ ID NO: 442151 - RNA, 64 nt, Human
aauaucucaguuggaccauccuuaacuugauugaacugucuaggaacuuuacagauuguucugc

SEQ ID NO: 442152 - RNA, 64 nt, Human
ucaaagcccacuuuguucgcaguguagcugaaauacugucuaucucuaauaaaaacaggaggaa

SEQ ID NO: 442153 - RNA, 64 nt, Human
uacuuucugagccaaacugcuaauuuucugcggaacugucuagaagaucauucaagagacccug

SEQ ID NO: 442154 - RNA, 64 nt, Human
cagaauaaagcauuaaaauuucuuuuggggagagacugucuaguaauuuaaaauguguuaaaua

SEQ ID NO: 442155 - RNA, 64 nt, Human
uuuugugaauuuuuugguuguuguucccugaacuacugucuauauuuaaaauuagauggaaucc

SEQ ID NO: 442156 - RNA, 61 nt, Human
cagcugugaaagcaacauaaauggauuuuaaacugucuacgguucuuaaccucaucuguua

SEQ ID NO: 442157 - RNA, 64 nt, Human
agcgcaguaagggcuuggcauccgguagugaaaaacugucuaacccagcauugcccaaacuauu

SEQ ID NO: 442158 - RNA, 64 nt, Human
cggaggaaguagcuggacaggcccugccccucaccagcaagaggcaugauuggauggagcuucu

SEQ ID NO: 442159 - RNA, 64 nt, Human
gcuuucauacuccuguugguggcuauuugggaggcagcaagaugugaagacuggauguguucag

SEQ ID NO: 442160 - RNA, 64 nt, Human
uagauuuuaggauagaaaucaaaguagagcacgucagcaagagccucuuugucucacuccauca

SEQ ID NO: 442161 - RNA, 64 nt, Human
auguuauaaauuuuuauugucacuaaaaaauuuuacugucuaaauaaguaccuuuuauuggaga

SEQ ID NO: 442162 - RNA, 64 nt, Human
cuuguacacuuccccucugggaucaggugagggguccagacagcugaccagacagcuugacagc

SEQ ID NO: 442163 - RNA, 64 nt, Human
gggggcgccuuagguacuuauuccagaugccuucuccagacaaaccagaagcaacagaaaaaau

SEQ ID NO: 442164 - RNA, 64 nt, Human
ccugcccuccacagaauuggguuccaagggcuguuccagacaacugccaacgucacugagggcc

SEQ ID NO: 442165 - RNA, 64 nt, Human
ccaagccccuugucccuucuccacugccccucuuuccagacaguaaaggccauggucagugugu

SEQ ID NO: 442166 - RNA, 64 nt, Human
ccauauuguucuucaaaguggaggucuccccugauccagacaagugggagagcccgugggggca

SEQ ID NO: 442167 - RNA, 64 nt, Human
ugaaaaaauaauauauauauauauaguacaaugguccagacauaauaagagguguaaaaacuau

SEQ ID NO: 442168 - RNA, 64 nt, Human
agggcagcccagggagaucacaccuuuggcaaaguccagacaaggcccacugcaguuccuaugg

SEQ ID NO: 442169 - RNA, 64 nt, Human
ucaaaaauagcaaugccucccuaucccucacacauccagacaucaugaauuuuacaugguacuc

SEQ ID NO: 442170 - RNA, 64 nt, Human
uuuuacuaugaaaaaaaaauuaauacuacuagcuuccagacaaucaugucaaaauuuaguugaa

SEQ ID NO: 442171 - RNA, 64 nt, Human
ccaguugagguugggcaaggagacuuccaggacuuccagacagaguaccagguuuuauuuuuca

SEQ ID NO: 442172 - RNA, 64 nt, Human
cugccacacacaugcacacauaucuagcauucuuuccagacagcauccuccccgccuuccaccu

SEQ ID NO: 442173 - RNA, 64 nt, Human
gcggaggaguuuucuguguggucuccagcuccucuccagacacagagacaugggaguggggagc

SEQ ID NO: 442174 - RNA, 64 nt, Human
acacuacccaggacucuugcuaccugguuccaacuccagacaaccacuaugccaggcccggagc

SEQ ID NO: 442175 - RNA, 64 nt, Human
gcugaauuaagucuucacaaacaacacauaaagauccagacauuaggacuguauaccuuuucaa

SEQ ID NO: 442176 - RNA, 64 nt, Human
ccgggucagauccuguguccuccauaaaaaauuuuccagacaacuccaaucuguccuucuucca

SEQ ID NO: 442177 - RNA, 64 nt, Human
cuuucauccgaagaaacccacuugcuguuuccagccgcugaaucugcugagugugcagccugca

SEQ ID NO: 442178 - RNA, 64 nt, Human
agaaccuccuucuguuggaggcccucccaucuccccgcugaaaccugcgcuccuuuuuuggggg

SEQ ID NO: 442179 - RNA, 64 nt, Human
cccgcccucuccucauugcccagaaccggccacaccgcugaaggccaaagaggccacaaagaag

SEQ ID NO: 442180 - RNA, 64 nt, Human
uggugugaguccaaagaagguguuuuccugaagaacugucuauuuucucagucauuuuuaaccu

SEQ ID NO: 442181 - RNA, 64 nt, Human
auucauuacauaucugucucauucugccuuuuauacugucuaaaaaagcaaaguuuuaaagugc

SEQ ID NO: 442182 - RNA, 64 nt, Human
caaaauuccauuuacuugaucauucucaguauccacugucuauguacaauaaaggauguuuaua

SEQ ID NO: 442183 - RNA, 64 nt, Human
uuuuccagucuacuugccuaaugaauguauaggaacugucuaugaguauggaugucacucaacu

SEQ ID NO: 442184 - RNA, 64 nt, Human
ggggaugcugguacaaguugugggacugcaugcuacugucuagagcuugucucaauggaucuag

SEQ ID NO: 442185 - RNA, 64 nt, Human
aguacuauuuuugcaggguuugcacaggcccguaacugucuacuacuuugauauaaucuguaua

SEQ ID NO: 442186 - RNA, 64 nt, Human
gaaaaccuauuuuuguaaugauguuucuuuggauacugucuagucacccagaaaaauguaugga

SEQ ID NO: 442187 - RNA, 64 nt, Human
acuuaaucaauuaauuuuuuuauuguuuaaagcaacugucuauuucugcugaauuuucacauga

SEQ ID NO: 442188 - RNA, 64 nt, Human
uugagugcacuuauuuuagaauauccuagacauaacugucuaaguaaaagcgcucuauuaaucu

SEQ ID NO: 442189 - RNA, 64 nt, Human
uuuuuuucuucucagcuuuaugaagagaagggaaacugucuaggauucagcugaaccaccagga

SEQ ID NO: 442190 - RNA, 64 nt, Human
uagguagcuagucacacuuuucagaccaauucaaacugucuaugcacaaaauucccgugggccu

SEQ ID NO: 442191 - RNA, 64 nt, Human
auaguagucuaggaaaaaguugcagguaauuuaaacugucuagugguacauaguaacuaaauuu

SEQ ID NO: 442192 - RNA, 64 nt, Human
aaaacuagcugccaacccagccuguggccaggucacugucuaccccagcccagcccagcccucu

SEQ ID NO: 442193 - RNA, 64 nt, Human
agaguuaagccacuuccugggucuccuucuugugacugucuaugggugcauugccuucuggguu

SEQ ID NO: 442194 - RNA, 64 nt, Human
gggaccggccaggccaccuccagaaacggccauucagcaagacaacacgugguggcugauaccg

SEQ ID NO: 442195 - RNA, 64 nt, Human
caucaaaaaucaacagacugcacugauaauuuagcagcaagacuaugaagcagcuuucagauuc

SEQ ID NO: 442196 - RNA, 64 nt, Human
uaaaauuaaaauuguccauuuccuauauaaauaccagcaagaucacucugagauacauaaacuc

SEQ ID NO: 442197 - RNA, 64 nt, Human
aauucuccaugucucgaucgcccuuguuuacggcacugucuaaccuggauggguguuuugugag

SEQ ID NO: 442198 - RNA, 64 nt, Human
uuauuauuuauaaaucaaguuugaugaggugaucacugucuacagugguucaacuuuuaaguua

SEQ ID NO: 442199 - RNA, 64 nt, Human
ugauguucugccuuauaaaugcacaaugauuuguacugucuaauaaaaacaguguauacuuugu

SEQ ID NO: 442200 - RNA, 64 nt, Human
aaguuucaguugggcaugagccuggagagaugugacugucuacaguucuauuuguauauauaaa

SEQ ID NO: 442201 - RNA, 64 nt, Human
cuguuuauaucucuuuuauucauuuauuuaacauacugucuaauuuuaaaaauagguuuuuaaa

SEQ ID NO: 442202 - RNA, 64 nt, Human
cuguccccucuaaaguuaaagucaauacaagaaaacugucuauuuuuagccuaaaguaaaggcu

SEQ ID NO: 442203 - RNA, 64 nt, Human
aguauuaguuguauuacuaaucauauguugauuaacugucuacuuaaagucaagguaccuguau

SEQ ID NO: 442204 - RNA, 64 nt, Human
uucagugaagaugcuguaaauagguucagauuuuacugucuauggauuugggguguuacaguag

SEQ ID NO: 442205 - RNA, 64 nt, Human
uuucuacccccagagauaaauguuuguuuauaucacugucuagcuguuucaaaauuuagguccc

SEQ ID NO: 442206 - RNA, 64 nt, Human
ucauaagguucuuuagcugucacuuagggauaacacugucuaccucacagaaauguuaaacuga

SEQ ID NO: 442207 - RNA, 64 nt, Human
uucuuguuuuuucccaguuuuauauagaggaaacacugucuaugauaggauuuccaaaaguauu

SEQ ID NO: 442208 - RNA, 64 nt, Human
gacuuaccugaauaauuacuacauuagggaagcuacugucuacguuaagauaaaggguauugcc

SEQ ID NO: 442209 - RNA, 64 nt, Human
uuccuccccaccaguuucugauacuacaauuaaaacugucuacauuuacaaucuuugugucaaa

SEQ ID NO: 442210 - RNA, 64 nt, Human
gcauuacauguuguggaaucucucgagugcaaagacugucuaguuauuuaucaggcuauuucua

SEQ ID NO: 442211 - RNA, 64 nt, Human
gcuuuaauuuugcccagggacaaauuuuaauaaucagcaagacugguuugugcaaagcguugag

SEQ ID NO: 442212 - RNA, 64 nt, Human
cagguaacaaaagucaaaguauuuuaucuuuucacagcaagaacaguccauguuguauauaaua

SEQ ID NO: 442213 - RNA, 64 nt, Human
ccaccaucaauacagaaagugaccuaagauguaccagcaagaugccaucccuucuuuuugugug

SEQ ID NO: 442214 - RNA, 64 nt, Human
ggauaaggaauuaaaggagugcagcaauaacugcacugucuaaaaguuugugcuuauuuucuug

SEQ ID NO: 442215 - RNA, 64 nt, Human
gagaaagauaaugguaaguaguugcuacuggccaacugucuagcacuuaccugaaaacuuagua

SEQ ID NO: 442216 - RNA, 64 nt, Human
uucccaacccccauugugacaguuucuuuuugucacugucuagaauuuuguauuuuauuucaga

SEQ ID NO: 442217 - RNA, 64 nt, Human
agcccagacauuugaauggccuuguaaacagcucacugucuaauacucgaaggacaaguaacaa

SEQ ID NO: 442218 - RNA, 64 nt, Human
agacuccuugucugcaaagcccaagcuagaacucacugucuauggcagaaggacauccagagcc

SEQ ID NO: 442219 - RNA, 64 nt, Human
guucuuugaacguucaaaugacucaucaguaaaaacugucuacagagaaguaaauaucuauauc

SEQ ID NO: 442220 - RNA, 64 nt, Human
guaccuggaaacauagcuauuaccaucucauauuacugucuaauuaaaauaaacauaacgcaaa

SEQ ID NO: 442221 - RNA, 64 nt, Human
cucaugcccuucaguccccugcuuggcuguaugcacugucuauauugcacugagagaggaaggg

SEQ ID NO: 442222 - RNA, 64 nt, Human
aaaaaauagagcagaggguuucugcugucuccagacugucuaccaaagagaaggcgacagaugc

SEQ ID NO: 442223 - RNA, 64 nt, Human
ucuggccuagcauuucucaguguuugcuauucagacugucuaaauacagcaugugacaagcuga

SEQ ID NO: 442224 - RNA, 64 nt, Human
uucucuccccuuucaagugagcaacaccacaaugacugucuaaagcaugccuuauuuagccucu

SEQ ID NO: 442225 - RNA, 64 nt, Human
cugccuuuuuaaccacugacauguaaggaggacuacugucuagcaucagcuuauggggucagcu

SEQ ID NO: 442226 - RNA, 64 nt, Human
gauggauauuuaaaccucuauuauuuuagacaagacugucuagaacuuaaguuugaucugucag

SEQ ID NO: 442227 - RNA, 64 nt, Human
ccuaaaacagggcacugucuguguccuuccuugaacugucuacccuguugcuuuucacaaauca

SEQ ID NO: 442228 - RNA, 64 nt, Human
ggccgagcgcagacuguuuaggacucagcagacccagcaagaggcaucugcccuuuccccagcc

SEQ ID NO: 442229 - RNA, 64 nt, Human
ggagggaagccacugccaccugagacagcccaagcagcaagauaaacccgcuccacccgacccg

SEQ ID NO: 442230 - RNA, 64 nt, Human
guuaaugaaugugccaacauuuucuaggaagggacagcaagaauauucugcucuguaguuaaaa

SEQ ID NO: 442231 - RNA, 64 nt, Human
gguguccccaccgcccacuuguuugaugucacugacugucuacauguauuuauauucuugauau

SEQ ID NO: 442232 - RNA, 64 nt, Human
accccacugguucucugaugaccugggaugccuaacugucuacucccugcaagccucagagcag

SEQ ID NO: 442233 - RNA, 64 nt, Human
ggacgcccugaccagagcuguguuuguggaguccacugucuacaacgccaacgucaaccuguuc

SEQ ID NO: 442234 - RNA, 64 nt, Human
caggaaccgguuagaacagaacagagaaacccugacugucuacagauuccaacuuuaauagcaa

SEQ ID NO: 442235 - RNA, 64 nt, Human
uuggcuaauauuuuuauaacgugguucuuauuuaacugucuaguuuugauagaauuuaccaggu

SEQ ID NO: 442236 - RNA, 64 nt, Human
uuaagggggccuuggaaucuauaguauagaaugaacugucuagauggaugaauuaugauaaagg

SEQ ID NO: 442237 - RNA, 64 nt, Human
aguaaagcccaaguguucuuuagcuuuuuauaauacugucuaaauagugaccaucucaugggca

SEQ ID NO: 442238 - RNA, 64 nt, Human
cuucucauucccauguggaacaggaugcccacauacugucuaauuaauaaauuuuccauuuuuu

SEQ ID NO: 442239 - RNA, 64 nt, Human
aaaaaugugcagaaaauguauugcaucccuugauacugucuaacgaauagcacauaacucauau

SEQ ID NO: 442240 - RNA, 64 nt, Human
guuacaaaguuugcaguauaauagaguuaacaguacugucuaggcuguugcaauauauucucuu

SEQ ID NO: 442241 - RNA, 64 nt, Human
auguucuccagaaaccccaguuucugucaucuuaacugucuagucuagccguuaacuuagacaa

SEQ ID NO: 442242 - RNA, 64 nt, Human
aaggauucccuauuuaauaaauggugcugggaaaacugucuagccauaaguagaaagcugaaac

SEQ ID NO: 442243 - RNA, 64 nt, Human
aagucuaauaauuauuaaaguaccauacggaauaacugucuacuguuuacuagcauauaaaaua

SEQ ID NO: 442244 - RNA, 64 nt, Human
gcaguugguuguaaauucucccaggagcuguuuuacugucuacuuuucaggauuaaaaaaaaaa

SEQ ID NO: 442245 - RNA, 64 nt, Human
aggggggcccggggcucaagugcgggaagggggcuggcccgaggaucccauggcucucacacca

SEQ ID NO: 442246 - RNA, 64 nt, Human
cuaaguacagguguguauaauguaucagggaccauggcccgagaaagugagaaggcuuuccuga

SEQ ID NO: 442247 - RNA, 64 nt, Human
ucgcgcccauucguguuguauccuccacucacuauggcccgaggggagaggagaguuuggggca

SEQ ID NO: 442248 - RNA, 64 nt, Human
gacuuggggucccuccaccugggggccccuggacacugucuacuuggagaccacuggcccccuu

SEQ ID NO: 442249 - RNA, 64 nt, Human
ccgacuucuuuugaaaugugaacguccuuccuugacugucuagccacucccucccagaaaaacu

SEQ ID NO: 442250 - RNA, 64 nt, Human
ugggaggcuuucaugagguguguugcacuuuguaacugucuagagcucuugauggaauuauauc

SEQ ID NO: 442251 - RNA, 64 nt, Human
gguggugaaccugaagcaugcuuuaaccucuaagacugucuaacacgcguuucauucaaugucu

SEQ ID NO: 442252 - RNA, 64 nt, Human
agggucugagcccccuuaugaguacccaagaaggacugucuaugcaugcacacccacaagccua

SEQ ID NO: 442253 - RNA, 64 nt, Human
caaguuccugauaacuuuaagaucacgccacuggacugucuaugaacuugcaaacaggcugaua

SEQ ID NO: 442254 - RNA, 64 nt, Human
augguuucuauggccaaaguuugguuuucucaacacugucuaaauuuggauuaaaacuuugaac

SEQ ID NO: 442255 - RNA, 64 nt, Human
cuauggguccugcccuugagcagggaaggaacuuacugucuaauauaggaaaaacacaugagaa

SEQ ID NO: 442256 - RNA, 64 nt, Human
uugagcugacaacacuuuuccaugaccauaggucacugucuacacuggguacacuuuguaccag

SEQ ID NO: 442257 - RNA, 64 nt, Human
cauacauuuauauucagaugaaauuaugguuugcacugucuauuaaauaucucgauuaauuuuc

SEQ ID NO: 442258 - RNA, 64 nt, Human
cucagccauuguagaagaugguggcuuuaaccugacugucuaaaaauucccagcuaagccuuuu

SEQ ID NO: 442259 - RNA, 52 nt, Human
ucagagggacacugggaugaggacugucuaccucccuuccuccucugcucac

SEQ ID NO: 442260 - RNA, 64 nt, Human
agaucuauugcuucucuguauuacccacaugacaacugucuauaaugaguuuacugcuugccag

SEQ ID NO: 442261 - RNA, 64 nt, Human
aucugugagcaauguuuccuauugaauauaaacuacugucuaaaauauacauaucagcagccca

SEQ ID NO: 442262 - RNA, 64 nt, Human
uggguggacaacaaggcacagaugagggugugacuggcccgaggucacggugagugaguggcaa

SEQ ID NO: 442263 - RNA, 64 nt, Human
cucuggcugcuggagcaucugcuggcuggugggguggcccgaguuccccuucaccgcccccagg

SEQ ID NO: 442264 - RNA, 64 nt, Human
gcccugccgccacaugcaguggaggagaggccuguggcccgaagagccugguagcgccuccugg

SEQ ID NO: 442265 - RNA, 64 nt, Human
cucggggcagggguggggcaguccaguguuggggacugucuacguaugugcaaguauaucccag

SEQ ID NO: 442266 - RNA, 64 nt, Human
gggggcucaaaugcccaggaugaggggaucagugacugucuaggaggaucccuugccuuguagg

SEQ ID NO: 442267 - RNA, 64 nt, Human
caaagauuguauguaugaggcuguucaucccagcacugucuaagcuaguaaaaauuggaaacaa

SEQ ID NO: 442268 - RNA, 64 nt, Human
ggagugauaaguccagauggccuuagguguccugacugucuaggcagccaaagagcacacguua

SEQ ID NO: 442269 - RNA, 64 nt, Human
uguucacgugcuuguguccaggugugacuuguaaacugucuaguguuugcauuaaauaaaaugg

SEQ ID NO: 442270 - RNA, 64 nt, Human
ugguguaaucaugaaggagugaaacaucauagaaacugucuagcacuuccuugccagucuuuag

SEQ ID NO: 442271 - RNA, 64 nt, Human
ccuguccucuugagcugcccuugcccagcacugcacucuggagguggguggugcaggcggugga

SEQ ID NO: 442272 - RNA, 64 nt, Human
agaggcaccacggccucacccaggcaucugcuuuacucuggaccauaggaaacaagaccguuug

SEQ ID NO: 442273 - RNA, 64 nt, Human
cuuggacuuuugcccagugaagacaggcugugacacucuggaugucuugguguguguagacaca

SEQ ID NO: 442274 - RNA, 64 nt, Human
cuaauuggaauuguugaagcugcucccugguuccacucuggagaguaaucugggacaucuuagu

SEQ ID NO: 442275 - RNA, 64 nt, Human
ccagccuugaguuaucuuuaacugacuucuguccacucuggagagcagugaggaauuaaucuug

SEQ ID NO: 442276 - RNA, 64 nt, Human
gcuguggcuucaguccuggguuucugccugugugacucuggauaagucacuuccucugucugag

SEQ ID NO: 442277 - RNA, 64 nt, Human
aaggucgggcccacugcaggcagcuggcacagcguggcccgaggggcuguggaacgggucccgg

SEQ ID NO: 442278 - RNA, 64 nt, Human
gagaggcugugguuugggggagaagaaguagggguggcccgaaagggucuccgaaaugcugucu

SEQ ID NO: 442279 - RNA, 64 nt, Human
caugcguacacacacacacauuuacacacgcaggacucuggagccagaguagaggcuguggccc

SEQ ID NO: 442280 - RNA, 64 nt, Human
agagccuuauuagaaaugcagaaucugaagccccacucuggacccaggacauuuugaugagauc

SEQ ID NO: 442281 - RNA, 64 nt, Human
aggcagacagacagaaagccagaggcuuagggaaacucuggaacccagacaagaaucuuuucgc

SEQ ID NO: 442282 - RNA, 64 nt, Human
gggucucacuacaagcagccuaucugcuuaagagacucuggaguuucuuaugugcccuggugga

SEQ ID NO: 442283 - RNA, 64 nt, Human
ugcucccuggauuccugcaacucauuuuccuuccacucuggagcagggugaggggaauguuaug

SEQ ID NO: 442284 - RNA, 64 nt, Human
ucccccccugaggggccccucacucuuacccaagacucuggauuguugcacggcaaccacuccu

SEQ ID NO: 442285 - RNA, 64 nt, Human
gagcagccagcguuagaugcccccacccaccuguacucuggagagacugugcugggaacaugua

SEQ ID NO: 442286 - RNA, 64 nt, Human
uuaauauauauauaaaaccagagcugacaaugacacucuggaacauugcauaccuucuguacau

SEQ ID NO: 442287 - RNA, 64 nt, Human
cuuucagguguuguuuaacucaguuuuauuuagaacucuggauuuuuagagcuuuagaaauuug

SEQ ID NO: 442288 - RNA, 64 nt, Human
aggaaucaaggagccuccguucccaccucugaggacucuggaccccaggccauaccaggugcua

SEQ ID NO: 442289 - RNA, 64 nt, Human
gcccuaaccccucccucaauaaauacauuacuguacucuggaauuuaggcaaaaccuuaaaucu

SEQ ID NO: 442290 - RNA, 64 nt, Human
agccucgcugggcuguccccugucccuaucucucacucuggacccagggcugacauccuaauaa

SEQ ID NO: 442291 - RNA, 64 nt, Human
ggggaggagcuucucccagugugagaccccaaagacucuggaggucaucuggcggaggucucug

SEQ ID NO: 442292 - RNA, 64 nt, Human
acaauauuauuucuaaggaaucggguuuucauuuacucuggacuggugaaaauauuuuuuaaag

SEQ ID NO: 442293 - RNA, 64 nt, Human
gguguggggucggggggcgguggagaagccuuggacucuggagcccaaggagagcccugaaguc

SEQ ID NO: 442294 - RNA, 64 nt, Human
agcaucauggaugcaggggcuugucugaaaagccacucuggaccuagccugucccagaagagga

SEQ ID NO: 442295 - RNA, 64 nt, Human
uucgugccucauggaauucagucccaugcacuacacucuggaugguguaugacuggaugaaugg

SEQ ID NO: 442296 - RNA, 64 nt, Human
auauaaaaccaucaaauuuuauaauugagaugauacucuggaaaaacaugucauuucauuuuca

SEQ ID NO: 442297 - RNA, 64 nt, Human
ccugcuccaggccacuaggccucccuugcagccaacucuggaaggcagaggaguaagagaggaa

SEQ ID NO: 442298 - RNA, 64 nt, Human
uuuagucuucugagacggaggaaaacugcugaauacucuggauucaucuaugucuacaauguug

SEQ ID NO: 442299 - RNA, 56 nt, Human
uggacgaggcuauauacugaagaaggacucuggacccucgugucuuucuuuaggau

SEQ ID NO: 442300 - RNA, 64 nt, Human
ggaaagagccuggggaggagcuuaaaacucaaccacucuggaauuuacccauagaagacgggaa

SEQ ID NO: 442301 - RNA, 64 nt, Human
cugaccucuugcggucuugauuagguuucagucaacucuggaucaugucagggacugauaauuu

SEQ ID NO: 442302 - RNA, 64 nt, Human
ggacauuacugaaccugucuugcugugccucgaaacucuggagguuggagcaucaaguuccagc

SEQ ID NO: 442303 - RNA, 64 nt, Human
ucacuaggguauuuauucuuucucccauccuuacacucuggaucauugugcagacuuaaucagg

SEQ ID NO: 442304 - RNA, 64 nt, Human
cugguggggugauagggugggcuaaaaaccaugcacucuggaauuuguuguauuuucucccagu

SEQ ID NO: 442305 - RNA, 64 nt, Human
ccaggugugguggcacacaucuguagucccagcuacucuggaggcugagacaggagaaucgcuu

SEQ ID NO: 442306 - RNA, 64 nt, Human
uguaucucuuaacagguugaaguuauugcaaaacacucuggaaaguaauaauuacaucauaauc

SEQ ID NO: 442307 - RNA, 64 nt, Human
agccaccaccugugcggcgcuugcuccgaggggucagcaagagcaacugauggcugccacuucc

SEQ ID NO: 442308 - RNA, 64 nt, Human
ccgcaaucugcuccagauucaagcaguaauauuucagcaagaggagguggucaugggaagccag

SEQ ID NO: 442309 - RNA, 64 nt, Human
ccaggcgugauggcacgugucuguaaucccagcuacucuggagacugaggugggagaaucgcuu

SEQ ID NO: 442310 - RNA, 64 nt, Human
ucaucucuggaauuuggccaggcagucccagaagacucuggagugaccuccuuugccuaaaaag

SEQ ID NO: 442311 - RNA, 64 nt, Human
ugucacuggaucugggcuaaaguccuccaccaccacucuggaccuaagaccugggguuaagugu

SEQ ID NO: 442312 - RNA, 64 nt, Human
guugguuuccagccccgccccccuucccaaggcaacucuggaggguacccuagguaugcugcug

SEQ ID NO: 442313 - RNA, 64 nt, Human
uccuccuccuucaccuccaaccacugucagcagcacucuggaguuuucaaaugucacauuagcc

SEQ ID NO: 442314 - RNA, 64 nt, Human
cugcaaugacuguggaguuccauucuuggcaucuacucuggaccaaggagcaucccuaauucuu

SEQ ID NO: 442315 - RNA, 64 nt, Human
agaaaaaggagacuuuauuggucaauauuugaccacucuggacuguucuguaaaguggcuggua

SEQ ID NO: 442316 - RNA, 64 nt, Human
uugggcguaguggugcaugccuguaaucccagcuacucuggagacagguggaggggauugcuug

SEQ ID NO: 442317 - RNA, 64 nt, Human
aggaggggcgauguggcuggggagcuagggagagacucuggagguggugggucucucgggagac

SEQ ID NO: 442318 - RNA, 64 nt, Human
acuggaaugcaaguccuucuucccuuuggaauguacucuggaucccuuccccugcuuugacccc

SEQ ID NO: 442319 - RNA, 64 nt, Human
gcccgugauacagggaugaggucagcaccagcaaacucuggacugguggaagaauuccccacca

SEQ ID NO: 442320 - RNA, 64 nt, Human
augccuguuugugauuuuaucucagaauauaacaacucuggauuacauuuuccucucaacugaa

SEQ ID NO: 442321 - RNA, 64 nt, Human
ccuuuggcuacguggcuggccuuguuauuucaccacucuggauauacuggaauagaaagcaacu

SEQ ID NO: 442322 - RNA, 64 nt, Human
gaaaauugaucaaguaacauguugcauguggcuuacucuggauauaucuaagcccuucugcaca

SEQ ID NO: 442323 - RNA, 64 nt, Human
cauuugcacuuucauggacaacuuuuaauuugaucagcaagacaucuuggaacucaaucuucug

SEQ ID NO: 442324 - RNA, 57 nt, Human
auccgccagcuccaaagugagccggcccagcaagaugaaacagggcaccccagcuga

SEQ ID NO: 442325 - RNA, 57 nt, Human
auccgccagccccaaagugagccggcccagcaagaugaaacagggcaccccagcuga

SEQ ID NO: 442326 - RNA, 64 nt, Human
gcaccuaccaccugcccuggcuuucuuccccucaacucuggagccccauccccacccuccuugg

SEQ ID NO: 442327 - RNA, 64 nt, Human
gaugcuggucauccugggcauguccccaguguggacucuggacugggaagggggcaggccccuu

SEQ ID NO: 442328 - RNA, 64 nt, Human
guccccgccuaccuccacuuccuuucccuugcucacucuggauccagugacagcaggugucaug

SEQ ID NO: 442329 - RNA, 64 nt, Human
uccggagcggcucuagacaacuuuggucauaggaacucuggagguggguucuggucaucugagg

SEQ ID NO: 442330 - RNA, 64 nt, Human
agccaugaaucuacuuucuauguaagauuaaccuacucuggacauuucauauaucuggaaucau

SEQ ID NO: 442331 - RNA, 64 nt, Human
acuuucacauuaagaaugugccugaggcugcuuuacucuggaauagucucagaucuaaaauuuc

SEQ ID NO: 442332 - RNA, 64 nt, Human
cuauuugaccaaaaggaaaagaaaauaaagaagaacucuggaguggucuaagacugauaauagc

SEQ ID NO: 442333 - RNA, 64 nt, Human
ucccacucugaggcucuggccagagggagagaggacucuggaccuaggaaaagaggcuuuuggc

SEQ ID NO: 442334 - RNA, 64 nt, Human
aauuuuuuaagggaucaacuguaucacagugcccacucuggaccuaagucuaguguauccauac

SEQ ID NO: 442335 - RNA, 64 nt, Human
guagcccuggccucugccugccucccgccugugcacucuggaaccucuggccucaggggaccug

SEQ ID NO: 442336 - RNA, 64 nt, Human
ccuuuucucuugugucccuacucauugaaaccaaacucuggaaaggacccaauguaccaguauu

SEQ ID NO: 442337 - RNA, 64 nt, Human
aacuucaauauccacuucuuucagccuacuguagacucuggaaguauacuuuuugcauauguaa

SEQ ID NO: 442338 - RNA, 64 nt, Human
cagccccucuccccugccccaguccccaggggguacucuggagugagcagugccccuguggggg

SEQ ID NO: 442339 - RNA, 64 nt, Human
aaaugggaagguuugaguuccaggcagcguaugaacucuggagaggggcugccaguccucucug

SEQ ID NO: 442340 - RNA, 64 nt, Human
cgugacucaccgcugggugcuugccaaagagauagggacgcauaugcuuuuuaaagcaaucuaa

SEQ ID NO: 442341 - RNA, 64 nt, Human
uacagacacacacauguuuuucacacaggccuggcccacgcaucgacaugugugaauuugcaca

SEQ ID NO: 442342 - RNA, 64 nt, Human
aucugccuucguuugccccucugacuguuggaaucccacgcaccauucaguaggauucaauuca

SEQ ID NO: 442343 - RNA, 64 nt, Human
acacuuuugaggacaaguuacaccuccacucagcacucuggacuccacgaugccuuugagucug

SEQ ID NO: 442344 - RNA, 64 nt, Human
uaaaguguugccaccauaccuccuuccccgagugacucuggauuuggugcuggaaccagcucuc

SEQ ID NO: 442345 - RNA, 64 nt, Human
uucuuuuuacuuuuauauuuuugcuugaaucuuaacucuggaaaucaccugauguagaagaaga

SEQ ID NO: 442346 - RNA, 64 nt, Human
acagggccaccgccacagcccggcagaggggcacacucuggagaccuugcuggcagugcuagcc

SEQ ID NO: 442347 - RNA, 64 nt, Human
ugagcuccuagagaagaacaauccucauggagaaacucuggaaaccuugacaauggcaacagug

SEQ ID NO: 442348 - RNA, 64 nt, Human
gcaaacuagaauauccucagcagguggccuggccacucuggagaaagaaacccaaggaaaguga

SEQ ID NO: 442349 - RNA, 64 nt, Human
uaugaggcacuguaguauuuucacauaguauaguacucuggauguaaaagcucaaaaauuguga

SEQ ID NO: 442350 - RNA, 64 nt, Human
ugaacugaaaagauaacugagaaaaugaaagcucacucuggauuccacacugcacuguuaauaa

SEQ ID NO: 442351 - RNA, 64 nt, Human
cuccgcggcuggagcgaagccuucugcagcaggaacucuggaccccugggccucaucacagcaa

SEQ ID NO: 442352 - RNA, 64 nt, Human
gucuccgcuggcuuugaaucuuccucugggcucuacucuggagaacauaagggcugcugugguu

SEQ ID NO: 442353 - RNA, 64 nt, Human
uggcccagggaagccccugguucugucccuggagacucuggaaauccuuuugcauuaaaaggac

SEQ ID NO: 442354 - RNA, 64 nt, Human
uuugguuaugcccaucuccauagccagaccaagcacucuggaagccaggguugggugcuuauuu

SEQ ID NO: 442355 - RNA, 64 nt, Human
uaagugauggaaaucagaagggaauauagaaagaacucuggauguggagaaaugccgguaccug

SEQ ID NO: 442356 - RNA, 64 nt, Human
auuauuauuacuuuuuaaaauguuggugcaauuaacucuggaccucucuugugagccauagaga

SEQ ID NO: 442357 - RNA, 64 nt, Human
ugccagaguucaucaaggauggcuccaguacguacagcaagauuccugcccacaggaagggcca

SEQ ID NO: 442358 - RNA, 64 nt, Human
ucaggcucuuagaagccauagauuuggacaagcccagcaagauggguguccuuccaggccucuu

SEQ ID NO: 442359 - RNA, 64 nt, Human
ucuauagaggugguguaagaguggggaacagggccagcaagacagaccaccagccagaaaucuc

SEQ ID NO: 442360 - RNA, 64 nt, Human
cugggcauuguggggcacaccuguugucccagcuacucuggaggcugaguccggaggaacguuu

SEQ ID NO: 442361 - RNA, 64 nt, Human
aaugcuguguuuaaauaaauugaaaacuacguaaacucuggaaaguauucuauaagaaaaagcu

SEQ ID NO: 442362 - RNA, 64 nt, Human
uccaguguccauggaaacauucccacaugccgugacucuggacuauaucaguuuuuggaaagca

SEQ ID NO: 442363 - RNA, 64 nt, Human
cagagcccaugggggcuggaggggggcagcugggacucuggaaucuucuuuauaauaaaagccu

SEQ ID NO: 442364 - RNA, 64 nt, Human
ugguuuuuuguuucucagucugcuuuagcuuuuaacucuggaagcgcaugcacacugaacucug

SEQ ID NO: 442365 - RNA, 64 nt, Human
ccgggcgugguggugggugccuguagucccagcuacucuggaggcugaggcaggagaauggcgu

SEQ ID NO: 442366 - RNA, 64 nt, Human
guugcuguggacacccaagucgcuggagccauucacucuggagauucuagcaagaagugccaag

SEQ ID NO: 442367 - RNA, 64 nt, Human
gguccgagccucaggccaaggaccccugaugcagacucuggaaucccuggcccaaaggccuguc

SEQ ID NO: 442368 - RNA, 64 nt, Human
aagaauugcuuuucucuuaccaguaugauuuguaacucuggaacacuauucuuacagaaugccu

SEQ ID NO: 442369 - RNA, 64 nt, Human
augcauagcaagccuucgugaacggaagugacacacucuggauugaauaauacuguagccucau

SEQ ID NO: 442370 - RNA, 64 nt, Human
auaaaauccagaagcaagauuccguaagcugagaacucuggacaguugaucagcuuuaccuaug

SEQ ID NO: 442371 - RNA, 64 nt, Human
aagguucuuucccccucaguuuuguuguugucuuacucuggagaugccaaguguauuuuuucuu

SEQ ID NO: 442372 - RNA, 64 nt, Human
uauaaaacuugaaucaggauuuuaugccccacauacucuggaacuugaaguauaauauacuuaa

SEQ ID NO: 442373 - RNA, 64 nt, Human
ucucagacacacaacucugcuauaaacagcagaaacucuggacacaaacuuuuauguaagucac

SEQ ID NO: 442374 - RNA, 64 nt, Human
aaugcaucuucuuuauaaacuugacuugcuaucucagcaagauaaauuauauuaaaaaaauaag

SEQ ID NO: 442375 - RNA, 64 nt, Human
gaggcgguuaaaucccaagaucugcaggauaagucagcaagauggagucccaugagagcugaug

SEQ ID NO: 442376 - RNA, 64 nt, Human
ccaagauagcgccauugcacuccagcgugggcgacagcaagagacuucauuucgauaaauaagu

SEQ ID NO: 442377 - RNA, 64 nt, Human
gcacaagcaaaaagaugcuugauacacaaaaggaacucuggagagaaaacuacagcuucagucu

SEQ ID NO: 442378 - RNA, 64 nt, Human
ugcauggccccacuaucaauaacacaaagucuguacucuggaucuccccuaaugucccuguggu

SEQ ID NO: 442379 - RNA, 64 nt, Human
uccucccugucuuuuucagugucucauaaacgcuacucuggauuguuguaaauauuagugagau

SEQ ID NO: 442380 - RNA, 64 nt, Human
augcuuucugaagcuuuaccagcugaaaguugggacucuggagagcggaggagagagaggcaga

SEQ ID NO: 442381 - RNA, 64 nt, Human
aagaaggcaauauuaaccuaaucaccauguaagcacucuggaugauggauuccacaaaacuugg

SEQ ID NO: 442382 - RNA, 64 nt, Human
accuugcuaucaagaaaugcucgucauacaguaaacucuggaugauucuuccagauaauguccu

SEQ ID NO: 442383 - RNA, 64 nt, Human
aucauauuuuguguccccaccuugauguuacaugacucuggaacaauaugaacuggauuuaaga

SEQ ID NO: 442384 - RNA, 64 nt, Human
ccgggugugguggcgggcgccuguagucccagcuacucuggaggcugaggcaggagaauggcau

SEQ ID NO: 442385 - RNA, 64 nt, Human
gggcugaggagcucaugguagccugggcugaccuacucuggagcacggugucuuccuucuaaac

SEQ ID NO: 442386 - RNA, 64 nt, Human
cagcauguguauagaaagacuuucuuuuacgauaacucuggacuaaaaaaaucaggaucauuaa

SEQ ID NO: 442387 - RNA, 64 nt, Human
cuuuuccacauggucaucgugaaauaaaaaguccacucuggagucaaguauggaauucaauucc

SEQ ID NO: 442388 - RNA, 64 nt, Human
gauugccucuugaaguuuugacauagagacauuuacucuggagauagauaggagaacgccuggu

SEQ ID NO: 442389 - RNA, 64 nt, Human
caugauaaauuuauuauccauaauuauaggagucacucuggauuucaaaaaugucaaaaaauga

SEQ ID NO: 442390 - RNA, 64 nt, Human
ccucuuuccccacccuggcuccaugacccaccccacucuggaugccagggucacugggguuggg

SEQ ID NO: 442391 - RNA, 64 nt, Human
guagguaauaagguguccagcagaggaugaaggucagcaagauaagcagggccagucucagggc

SEQ ID NO: 442392 - RNA, 64 nt, Human
cucagacgaugcccugcugaagaugaccaucagccagcaagaguuuggccgcacugggcuuccu

SEQ ID NO: 442393 - RNA, 64 nt, Human
agaggcagcaugcuugggcugacccagcaucucccagcaagaccucaucuguggagcugccaca

SEQ ID NO: 442394 - RNA, 64 nt, Human
agagaucugucagaggaaaauggucuccacagcaacucuggagggaagcugaagacagauagcu

SEQ ID NO: 442395 - RNA, 64 nt, Human
cucugagccgugaugccaaagguugcgacuccugacucuggauaauuuuuaguugcucuuuguu

SEQ ID NO: 442396 - RNA, 64 nt, Human
acuuucugggauuauaauaguaauucccagccauacucuggacuuuauuuugcuaaccauaacu

SEQ ID NO: 442397 - RNA, 64 nt, Human
gugguacugcccuguaagaaccugcccccgcaaaacucuggagucccugggacacacccuaucc

SEQ ID NO: 442398 - RNA, 64 nt, Human
uaguugagaucuggaaagcauagacauuuuuuacacucuggauagacuuuauucuugaagauca

SEQ ID NO: 442399 - RNA, 64 nt, Human
ucggaugugguggcaggugccuguagucccagcuacucuggaggcugaggcaggagaauggcgu

SEQ ID NO: 442400 - RNA, 64 nt, Human
aaagaauacaaaugcuccaacauuauuuuuuauaacucuggauuaccgaugcugagaugugugc

SEQ ID NO: 442401 - RNA, 64 nt, Human
ucuuuguagcagaguacauaacuacauaaugccaacucuggaaucaaauuuccuuguuugaauc

SEQ ID NO: 442402 - RNA, 64 nt, Human
uauuaucuccacuuucaaucucccuccaagcucuacucuggaggagucugucccacucugucaa

SEQ ID NO: 442403 - RNA, 64 nt, Human
uuuucuuacucccaaaaaagaaugaacaccccugacucuggagugguguauacugccacaucag

SEQ ID NO: 442404 - RNA, 64 nt, Human
gccuauuguuugaggaaugcagucuuacaagccuacucuggacccagcagcugacuccuucuuc

SEQ ID NO: 442405 - RNA, 64 nt, Human
auuauucuagauggaggaggcacugaugcuuguaacucuggaaagaggccuacacccaagggcu

SEQ ID NO: 442406 - RNA, 64 nt, Human
uaagaaaaugccaucucuuuuuaguugaaggaaaacucuggaaguaggugccauuggucauucu

SEQ ID NO: 442407 - RNA, 64 nt, Human
auaauuuaaucaacuuuauugucuuaguauuuagacucuggauaacucuacaauaaugaggaaa

SEQ ID NO: 442408 - RNA, 64 nt, Human
accgcaagcauucucuuugaauucucacagaauucagcaagaaguagaaaccuguuauuuacua

SEQ ID NO: 442409 - RNA, 64 nt, Human
cgaaagaauuaagagaauaccuagaacauauccucagcaagaaacaaaaccaaacuggacucuc

SEQ ID NO: 442410 - RNA, 64 nt, Human
aaucaccuucuuuauaaagcgucagucaugcuuccagcaagaggcagcaucagucauggcuuua

SEQ ID NO: 442411 - RNA, 64 nt, Human
aggcccuaaggucucagugcauagcauaccugccacucuggauguuuuccugggcuucauaucu

SEQ ID NO: 442412 - RNA, 64 nt, Human
ggagaggaaggaggcagauucauuucuaagacgcacucuggagccauguagccuggagucaacc

SEQ ID NO: 442413 - RNA, 64 nt, Human
cacaaagaaggaagaaaagaaggaguggaggaagacucuggaacccuggaagcuguaugccaca

SEQ ID NO: 442414 - RNA, 64 nt, Human
aggaaacagcagagaacuggcuggaugaccugugacucuggagcacuggguugucuccauuguc

SEQ ID NO: 442415 - RNA, 64 nt, Human
uggugcagcugggucugggacuucacuagagcuuacucuggagcaccuauuuucugugcacaug

SEQ ID NO: 442416 - RNA, 64 nt, Human
ucuuagaggaagaaaaaagguuagggaagugucaacucuggaugaaggugauguguuugccucu

SEQ ID NO: 442417 - RNA, 64 nt, Human
ucuuuccacucuggauucagccuucuuuuucuggacucuggacuuucucuaauaauaaauaguu

SEQ ID NO: 442418 - RNA, 64 nt, Human
cugcacccuccuagggcauuguaucugucuuuccacucuggauucagccuucuuuuucuggacu

SEQ ID NO: 442419 - RNA, 64 nt, Human
ucucuauacucucuauaacaauacuuuaucaagaacucuggacaaugguauuauuuuuaaaaau

SEQ ID NO: 442420 - RNA, 64 nt, Human
gaaugauuugcaagaaguugguuuauagacguuuacucuggaggcacaagcuggcugccaugcu

SEQ ID NO: 442421 - RNA, 64 nt, Human
caucaugaacuggcuuguacauuuuuaaauucuuacucuggagcaaccuacugucuaagcaguu

SEQ ID NO: 442422 - RNA, 64 nt, Human
ugcuauauaauuauuuucaguuacuaucccugacacucuggaaucuucuccauuucucccuauc

SEQ ID NO: 442423 - RNA, 64 nt, Human
aagcuggucauuuugccacacuuaaccauaagggacucuggaagcuguagguuagcucugccca

SEQ ID NO: 442424 - RNA, 64 nt, Human
gaaauuaaauauuuaaguaagugaguguuuacucacucuggauagcuaggugauuauucagaaa

SEQ ID NO: 442425 - RNA, 64 nt, Human
aagggugauggaaagaagcagaggaaagcagaaacagcaagagugacugagaccugcugucauc

SEQ ID NO: 442426 - RNA, 64 nt, Human
gagauugugccacugcacuccagccugggugacacagcaagacuccaucucaaaaaaaaaaaaa

SEQ ID NO: 442427 - RNA, 64 nt, Human
aucucaagauauucagguggccagaagagcuugucagcaagaggaggacagaauucucccagcg

SEQ ID NO: 442428 - RNA, 64 nt, Human
cauucugggauggggaauuuguccuuacagucccacucuggagcacugucugaagaugaggaau

SEQ ID NO: 442429 - RNA, 64 nt, Human
uggcccagccuccaccagggaccccuccucaugaacucuggagcccugagaggagaggggcagc

SEQ ID NO: 442430 - RNA, 64 nt, Human
uuugauuguuuacaggauauuccaaaauaaaaggacucuggaagauuuucauugaggauaaauu

SEQ ID NO: 442431 - RNA, 64 nt, Human
caggccacucgagcacacaccuguaguaccagcuacucuggaggcugaggcaggaggaucacuu

SEQ ID NO: 442432 - RNA, 64 nt, Human
cacacacacacacacuccauucacugucuccaugacucuggaguaaacuaacgucucgaguugc

SEQ ID NO: 442433 - RNA, 64 nt, Human
cugcucuggcugaggcuggcgcgcuccacccuggacucuggacuucgcagguuccugccuguca

SEQ ID NO: 442434 - RNA, 64 nt, Human
uuuuguugggacauguggaccgugagucgcaaacacucuggagaaggcugagaugccaccauuc

SEQ ID NO: 442435 - RNA, 64 nt, Human
cguuguuguuuuauuguuaaaaguuuauuaugcaacucuggagguauagagggcauauaagcua

SEQ ID NO: 442436 - RNA, 64 nt, Human
cacaacacaauaaagucaaguuauuauugcuguuacucuggaugauauggaaaacacugccaua

SEQ ID NO: 442437 - RNA, 64 nt, Human
guuuccagagaaggagaaaauggacagucuagagacucuggagcuggauaacuaaaaauaaaaa

SEQ ID NO: 442438 - RNA, 64 nt, Human
auuuguaugcuuugaaggcugccaaagcauuuauacucuggacauaguuuuaacugcaacugcu

SEQ ID NO: 442439 - RNA, 64 nt, Human
cccuaacgggggugcggcaggagcaggaacagagacucuggaagccccccaccuuucucgcugg

SEQ ID NO: 442440 - RNA, 64 nt, Human
ccuggcgugguggugcacaccuguaaucccagcuacucuggaggcugaggcaggagaaucacuu

SEQ ID NO: 442441 - RNA, 64 nt, Human
aauauuaaaaucacugucaauauuuuuauuuuuaacucuggauuuugaauuagauuauuucugu

SEQ ID NO: 442442 - RNA, 64 nt, Human
cagggucugugugugggcagcagccccugucucucagcaagaauaaagcagcuuccugugcacc

SEQ ID NO: 442443 - RNA, 64 nt, Human
cugacccagcauccucugccuucuaggaagugcccagcaagagggaaagcagaccccuuuaguc

SEQ ID NO: 442444 - RNA, 64 nt, Human
uaaccccagaaguuugaguccagcccaggcaacacagcaagaccccaucucuauaaaaagaaaa

SEQ ID NO: 442445 - RNA, 64 nt, Human
caguuuuaagaaagaauuucugugaagugugaggacucuggagucuagcucacauaaagagagu

SEQ ID NO: 442446 - RNA, 64 nt, Human
ucuugcccucuccucaccuccuuuucucucagugacucuggaaccugaaugcagcuuacaagac

SEQ ID NO: 442447 - RNA, 64 nt, Human
ucaggagcuagcagaaaauaacucaaaguugaagacucuggaagauuuugcuuuaaccuaacuc

SEQ ID NO: 442448 - RNA, 64 nt, Human
guuucuugaacccuacuuucuggaaguggaguugacucuggaaguuuucuagcaacugaacaaa

SEQ ID NO: 442449 - RNA, 64 nt, Human
gagggccuucaguaagaccacaagucugcaggaaacucuggaaucaggaagaaaagcuauguuc

SEQ ID NO: 442450 - RNA, 64 nt, Human
uguuuauuuuucuuuaaaaauaaaggauuuuggaacucuggagaguaagaauauaguauagagu

SEQ ID NO: 442451 - RNA, 64 nt, Human
auguccuguuaaauuuacaacacuaacgauguagacucuggaaaugccuaauaagucaaagaag

SEQ ID NO: 442452 - RNA, 64 nt, Human
cugagguucucuuuuucuuggugcuuuauuagcaacucuggauauuuuuauaaaacuaguuaca

SEQ ID NO: 442453 - RNA, 64 nt, Human
ccagacaugguggcacaugccuuuagucccagcuacucuggaggcugaaguuggaggauggcuu

SEQ ID NO: 442454 - RNA, 64 nt, Human
agagcucaaagaggaauugggaaaaauaaauugaacucuggaaucuucucucucaaguccuaaa

SEQ ID NO: 442455 - RNA, 64 nt, Human
caccaccggcggaaucgcagcuucugagacuggaacucuggaggaagacuuuugccuccgucca

SEQ ID NO: 442456 - RNA, 64 nt, Human
ggagucccuaccugcuucacguuggccggcggcuacucuggaauguuuuucccuccccagaauc

SEQ ID NO: 442457 - RNA, 64 nt, Human
uuguacaucacugucauuccaaagguacaguguaacucuggauggaggaauaacuuaccuauca

SEQ ID NO: 442458 - RNA, 64 nt, Human
gcugucauaggggcagcagucucaggggguguaaacucuggaauccacuaugguuuaccuugag

SEQ ID NO: 442459 - RNA, 64 nt, Human
guguaugagcuaccagcgugcaugucagcgacccuggcccgacaggccacguccugcaaucggc

SEQ ID NO: 442460 - RNA, 64 nt, Human
guuuaagggaacccggcgcccagccaggcuccaguggcccgaacggggcggcgagggcggcgag

SEQ ID NO: 442461 - RNA, 64 nt, Human
ccgaguccagguggacucuguggauguguggauguggcccgagcaggcucaggcggccccacuc

SEQ ID NO: 442462 - RNA, 64 nt, Human
agcacuuaggaccauuugagcuugugggucacccacucuggaagaaauagucaugcuucuuuau

SEQ ID NO: 442463 - RNA, 64 nt, Human
ugaguaaaaguaaguuuugcuggauuuuuguagaacucuggacguugaggauucauuaugcugu

SEQ ID NO: 442464 - RNA, 64 nt, Human
aaguguuccuuuagacaaaguugugacccauuuuacucuggauaagggcagaaacgguucacau

SEQ ID NO: 442465 - RNA, 64 nt, Human
uuuuggaguauguuaaguugaaguaaaagcaaguacucuggagcaguucauuuuacaguaucua

SEQ ID NO: 442466 - RNA, 53 nt, Human
guaaugugaagggucccuaaaggacucuggaaagccagaagacugcaguggau

SEQ ID NO: 442467 - RNA, 64 nt, Human
ucucacuucaguuguggccucauucagcagaaugacucuggaaccauccucuguuacccgcaga

SEQ ID NO: 442468 - RNA, 64 nt, Human
cagugacugggcuuccuccgugcaguuuucugcaacucuggagaaguggaggcauacuugugug

SEQ ID NO: 442469 - RNA, 64 nt, Human
ccaggacugacuguacacucccugaucagccagcacucuggaagcuuugggaucccaggaacca

SEQ ID NO: 442470 - RNA, 64 nt, Human
cugggagcugugguccaccucaaaaaaaaggagcacucuggaggacacguuuucccaccuguug

SEQ ID NO: 442471 - RNA, 64 nt, Human
cauguggcagggaccgucuugcccugcuggccacacucuggagaagcacuucucagccaaggca

SEQ ID NO: 442472 - RNA, 64 nt, Human
agaacucagacuucuacuuuaccaaguaccacacacucuggaaugcuuuaguuuccuuuucccc

SEQ ID NO: 442473 - RNA, 64 nt, Human
ugaaaaugaaacgaaaaggaaguccccccaucagacucuggacacccaggaaucaaaagagaaa

SEQ ID NO: 442474 - RNA, 64 nt, Human
gggcugcucucagcacuucuccugcagacugaagacucuggacucauugcugauuggaacacca

SEQ ID NO: 442475 - RNA, 64 nt, Human
cggaggccaggcugcacaccuggugggagaacacacucuggaauucucuauucuccuggucggg

SEQ ID NO: 442476 - RNA, 64 nt, Human
uuguccaacccuuggcccaggacggcuuugaauauggcccgacacaaauucguaaacuuuuuaa

SEQ ID NO: 442477 - RNA, 64 nt, Human
ggugugcaguuccucuccaauugcugcguggucguggcccgaccucucacggcaugacagccuu

SEQ ID NO: 442478 - RNA, 64 nt, Human
accgucugguugucgucugucaucuccuccugucuggcccgaggccgccccgugacugugaccg

SEQ ID NO: 442479 - RNA, 64 nt, Human
aaaggaccaguugcccucauuuccaaagaacugcacucuggaauuaaagggacucuuccauuuu

SEQ ID NO: 442480 - RNA, 64 nt, Human
cauucuccagucugaacaguucagcuacagucugacucuggacaggggguuucuguugcaaaaa

SEQ ID NO: 442481 - RNA, 64 nt, Human
agguugaaccugccaacugauuaaaggacaccagacucuggaugcuuggauggaaagggaaaaa

SEQ ID NO: 442482 - RNA, 64 nt, Human
gaagagacuuuuuuuccauggugaagagcaauaaacucuggauguuugugcgcguguguggaca

SEQ ID NO: 442483 - RNA, 64 nt, Human
gagggcguuucacaccaccaacaguaagccacccacucuggagucacagaaucugccaggcggu

SEQ ID NO: 442484 - RNA, 64 nt, Human
aaguuggagcucuugcaauggaauucaagaacagacucuggaguguccauuuagacuacacuaa

SEQ ID NO: 442485 - RNA, 64 nt, Human
uguucgacauugaagggagaaaggcaagaugugcacucuggacucaagaaacucuuaguucagu

SEQ ID NO: 442486 - RNA, 64 nt, Human
ucuuucaccauagggguuauaguuggcuugugcuacucuggaaucauuuuacuguuuguuuuua

SEQ ID NO: 442487 - RNA, 64 nt, Human
agacauuuucccacagacuuccuggccuccugugacucuggaaagcaaaggauuggcuguguau

SEQ ID NO: 442488 - RNA, 64 nt, Human
gguagacaacgcccauaaacagagaugguccugaacucuggagagauccuucccugauccuuuc

SEQ ID NO: 442489 - RNA, 64 nt, Human
uuaaucaggaauauugugguaagcugggaguaucacucuggaagaaaguaacaucuccagauga

SEQ ID NO: 442490 - RNA, 64 nt, Human
gggaaugcucagaaaggaaauaauuuuaugcuggacucuggaccauauaccaucuccagcuauu

SEQ ID NO: 442491 - RNA, 64 nt, Human
uauccucauuguggaaacaagccaaaccaaaugaacucuggaaaaccuaaaacaaauguacauu

SEQ ID NO: 442492 - RNA, 64 nt, Human
ccucaagccugugcucagguugccuugaauguggacucuggaagagccaggggcccagaaugcc

SEQ ID NO: 442493 - RNA, 64 nt, Human
agguuacuuuuuauggcuuaucaaaugcuuguccuggcccgaugcaguggcucaugccuguaau

SEQ ID NO: 442494 - RNA, 64 nt, Human
uuuaaaauucaaguuauacaucuugggaguacaauggcccgacauuucuucauagguagaaaca

SEQ ID NO: 442495 - RNA, 64 nt, Human
auucuuauagagaagugaauuucacuuacuccccuggcccgaaaacuagaccaaaugaggaacu

SEQ ID NO: 442496 - RNA, 64 nt, Human
ccugcagccugcacagauucugguuugagguuugacucuggacccuggcugugccccuaggugg

SEQ ID NO: 442497 - RNA, 64 nt, Human
agggaaucggagggagcagcggaaugcggcgaagacucuggacagcgagggcacagggucccaa

SEQ ID NO: 442498 - RNA, 64 nt, Human
aaaaaaaaaaaaaagccaggcaugguggugggcuacucuggaggcccuugaggaucacuugagc

SEQ ID NO: 442499 - RNA, 64 nt, Human
aaaaugaacaaagaauuuguacuuaauggcauggacucuggagaaucuaugcgaaucaaccuuu

SEQ ID NO: 442500 - RNA, 64 nt, Human
gugaacggaaaacacagaguaaacccuagugucaacucuggacuucaguuaauaacaguguacc

SEQ ID NO: 442501 - RNA, 64 nt, Human
cuggacauggugggaugggcauguggucccagcuacucuggaagcugaggugagaggaucacuu

SEQ ID NO: 442502 - RNA, 64 nt, Human
gaugacauccuggagggagacuggauuugccugcacucuggaaggcugggaaacuccuggaaga

SEQ ID NO: 442503 - RNA, 64 nt, Human
cagcgugaucuaccacaccuggccaaucccaacuacucuggaagcugaagcagcaagaucacuu

SEQ ID NO: 442504 - RNA, 64 nt, Human
ggcauuuucuguaggauuuucuuaugcacugcacacucuggaccucaccugcagauacaguucc

SEQ ID NO: 442505 - RNA, 64 nt, Human
uggcacaaugccuggguguccucauccuugcuuuacucuggaaaguguggggauggagaggaug

SEQ ID NO: 442506 - RNA, 64 nt, Human
uuuugugagauugagagaacuaugaccugcagcaacucuggaaaccuggccugacagacaagca

SEQ ID NO: 442507 - RNA, 64 nt, Human
gauguauucucacucccuugaucucaagggcguaacucuggaagcacagcuugacuacacguca

SEQ ID NO: 442508 - RNA, 64 nt, Human
uuuucuggaugaauacugggagaauaaaaugagaacucuggagugagcuaaauugaucccaauu

SEQ ID NO: 442509 - RNA, 64 nt, Human
cugguggaggggaguuggggagcuggacuggaugacucuggaggccccuuccaaaccucaagug

SEQ ID NO: 442510 - RNA, 64 nt, Human
ugcuaggguauugagucaggcagcuggaggguuguggcccgaggcugcagucagagguauacuu

SEQ ID NO: 442511 - RNA, 64 nt, Human
cuuuucccgcaaccugggguugucgggggagcgcuggcccgacgcaguggcacugcuguggcuu

SEQ ID NO: 442512 - RNA, 64 nt, Human
agggcccauguggcuggagguugggggcaggaucuggcccgagcucuccucagaccuccccaga

SEQ ID NO: 442513 - RNA, 64 nt, Human
agcuagacugaaccauuggaaacauuuaacucagacucuggauucagagucgggaacccuuagu

SEQ ID NO: 442514 - RNA, 64 nt, Human
aaauuauaguguagaaaagaacuggaaaccaggaacucuggaguucaucagaguuauggugccg

SEQ ID NO: 442515 - RNA, 64 nt, Human
uucugccagacuacauuuuguggggagccugaggacucuggauucuuugaggggauccuggaug

SEQ ID NO: 442516 - RNA, 64 nt, Human
gucccauuauggauguugaaauggacagggaaggacucuggaagucucuuccuccuccuccucu

SEQ ID NO: 442517 - RNA, 64 nt, Human
cuauaagucccucuucuugccguuggccuuucugacucuggaaugaccacuguucauugaaaaa

SEQ ID NO: 442518 - RNA, 64 nt, Human
ugccuggccgcaguguguguguauccgauaccccacucuggaaggaaccauccaguaaaggucu

SEQ ID NO: 442519 - RNA, 64 nt, Human
cccugccccugcccagaaccaagugccauuucucacucuggagccuuaauaaacugcaauuugu

SEQ ID NO: 442520 - RNA, 64 nt, Human
gguggccauggagggucuugucugcugugauucgacucuggaugcugugagcuugaugcuggcc

SEQ ID NO: 442521 - RNA, 64 nt, Human
gaugggccugugacaccccaaagagaagaaggggacucuggauaggguccccacauccagggcg

SEQ ID NO: 442522 - RNA, 64 nt, Human
acagucuguggccguggucuuagcccccaguuccacucuggaugggccugugacaccccaaaga

SEQ ID NO: 442523 - RNA, 64 nt, Human
gccacccugcccagucuggaagaagaggaggaagacucuggagccaaggcagaggggagcuuga

SEQ ID NO: 442524 - RNA, 64 nt, Human
uuaggggaugcguugcugguucacccuguaucagacucuggagcccaugguguccaggucuauc

SEQ ID NO: 442525 - RNA, 64 nt, Human
acuuggcuggcuugcagggguccuaagaaacuccacucuggacagcgccaggaggcccuggguu

SEQ ID NO: 442526 - RNA, 64 nt, Human
ucugagaaaaaguucaaggaauaaagauuguuugacucuggagaggagaaagcuguugagauag

SEQ ID NO: 442527 - RNA, 64 nt, Human
gcagacugccccaaaugcaaguucucguacgcccuggcccgaggaggcugcaugcacuuucacu

SEQ ID NO: 442528 - RNA, 64 nt, Human
aggguaagaggaauaauauggguaaaacaagaaauggcccgauaguuucacacuauuccuauac

SEQ ID NO: 442529 - RNA, 64 nt, Human
ggaugcccuguggguaucaguucugcugacacuuuggcccgaaauagauccagugcugagcaag

SEQ ID NO: 442530 - RNA, 64 nt, Human
ccauguuuccuuuugcgugaucucuguugauggcacucuggaauuguuucaguuaagucauuuu

SEQ ID NO: 442531 - RNA, 64 nt, Human
uccuaaguguaggagagaacuuggugccucuuccacucuggagugaaguuaaugaaagucuuuu

SEQ ID NO: 442532 - RNA, 64 nt, Human
augacaaggacacuguggggucuggguccccagaacucuggagcuacaggccacucuaggccca

SEQ ID NO: 442533 - RNA, 63 nt, Human
caaagauggguuugcacuaagagagaagauggaacucuggagcacuucagagacuucccagag

SEQ ID NO: 442534 - RNA, 64 nt, Human
uuugacauauuuucuuugcccacuuuaaauaaaaacucuggagaaaguugucuguuuuggauuu

SEQ ID NO: 442535 - RNA, 64 nt, Human
uaacucccuccugccccuggucugaggaggagggacucuggaguagcagaggggcugggaaaga

SEQ ID NO: 442536 - RNA, 64 nt, Human
gccggccacaguggcucacgccuguaaucccagaacucuggaaggcugaggcaggcggaucacc

SEQ ID NO: 442537 - RNA, 64 nt, Human
uucugauuauagcaucuccuucugaguguuugggacucuggaaucugagacccauguucacauu

SEQ ID NO: 442538 - RNA, 64 nt, Human
gacugaauacaugugaacaaacagaaggaaguucacucuggagugucuuugggaggcagccauu

SEQ ID NO: 442539 - RNA, 64 nt, Human
cuggggagggaggcaggugggugguaagagggaaacucuggagagccugcacccagguacugag

SEQ ID NO: 442540 - RNA, 64 nt, Human
ccugacuggacagauggaccuggcucaagcaacuacucuggaugcacuuugcugugugggauga

SEQ ID NO: 442541 - RNA, 64 nt, Human
uacuaaugucaagcucucuaguucuuggcuccuaacucuggaucugucuuaaggugucuccacu

SEQ ID NO: 442542 - RNA, 64 nt, Human
cuggaaggcaucugcaacuccaaguccaugcagaacucuggaaggccaaguucaucgcagcaug

SEQ ID NO: 442543 - RNA, 64 nt, Human
cagauguguguucucagugaaauaacuaccuuccacucuggaaccuuauuccagcaguuguucc

SEQ ID NO: 442544 - RNA, 64 nt, Human
agagauaggguuuuuggagggcuccucugggaaauggcccgacagcauucugagguugugcaug

SEQ ID NO: 442545 - RNA, 64 nt, Human
cccccugggucucccuccgagucacucugcagcuuggcccgaccacaaacaggacagagccagg

SEQ ID NO: 442546 - RNA, 64 nt, Human
cgggagcugcuucacacugagguucagaaccucauggcccgagcugaauacuugaaggagcagg

SEQ ID NO: 442547 - RNA, 64 nt, Human
uggugaaacccagaucgcuguguuacuaaugaucacucuggaaaugcaaauagaauaggagggg

SEQ ID NO: 442548 - RNA, 64 nt, Human
cagggguagucccucucaccugcuuccucagacgacucuggaagcuucccucuaccacugggca

SEQ ID NO: 442549 - RNA, 64 nt, Human
gaacuugcagacuggauaugcaagcaaacgggcaacucuggagaaaaauaaggaaaggaaugcu

SEQ ID NO: 442550 - RNA, 64 nt, Human
uuuccuccuagcccuuccagggccuuaucauaaaacucuggauuuagaguauucauuuugaagg

SEQ ID NO: 442551 - RNA, 64 nt, Human
uguggaacuuaaaaccuugaaggucugucauaggacucuggacaaucucacaccuuagcuauuc

SEQ ID NO: 442552 - RNA, 64 nt, Human
uuuauuaaaagaguagaaaaggauugcuuaagguacucuggacuuucucuuggacauuguaaac

SEQ ID NO: 442553 - RNA, 64 nt, Human
aauagcauugaaacuaacccauacaaaauauccaacucuggauucugugaauaaguaucuugac

SEQ ID NO: 442554 - RNA, 64 nt, Human
acuaucuucauuuacuacaucauuaauugauguuacucuggaguuuagaauucuggcauugaca

SEQ ID NO: 442555 - RNA, 64 nt, Human
accuugaaggauuucgcaaguccagaaauugaggacucuggauuuuugucaacuaacucuguga

SEQ ID NO: 442556 - RNA, 64 nt, Human
aguagugcagcuaauuaacucuagauuaaaagcuacucuggaccuacaguguccggcauccaaa

SEQ ID NO: 442557 - RNA, 64 nt, Human
ccaggagauuuauaaaguuuugauauuuuucccuacucuggaauuugaacuuucuucauguuug

SEQ ID NO: 442558 - RNA, 64 nt, Human
aauuauugacagcaaugguuucccgggcccagaaacucuggaaagauuuuguccagaagaauuc

SEQ ID NO: 442559 - RNA, 64 nt, Human
aucagugcuugaccuccuguauucugaauggugaacucuggaagcagggauugugucuggcucu

SEQ ID NO: 442560 - RNA, 64 nt, Human
ccgggugcaguggcgugcaccuguaaucccagcuacucuggaggcugaggcaggagaaucaccu

SEQ ID NO: 442561 - RNA, 64 nt, Human
uuuggaguguccuggcuaccagcucucaccuacacccacgcacccccccacacacuaugcucuc

SEQ ID NO: 442562 - RNA, 64 nt, Human
ggggccuuacucccuguccccccacccacagggccccacgcaggccuggggugucugaggugcu

SEQ ID NO: 442563 - RNA, 64 nt, Human
ugaccacaaggccaacugggcgcccguccccagccccacgcacgaccccaagcccgcggaggca

SEQ ID NO: 442564 - RNA, 64 nt, Human
aauugacacuucuguaaugagaggcaaccuuauaacucuggaguuguaguuugacagaaccauc

SEQ ID NO: 442565 - RNA, 64 nt, Human
uggcucaggccuuuucccaucgacgucuagggggacucuggaccgugugaagcuaggggguguu

SEQ ID NO: 442566 - RNA, 64 nt, Human
cgcuauuuucuaagcagccagcagugaaucuaaaacucuggaagaagucuucuguuugaaaggc

SEQ ID NO: 442567 - RNA, 64 nt, Human
cuuuccccacuaaaauaggauuuuuccccuuaaaacucuggagacccuaacgaauccuauauga

SEQ ID NO: 442568 - RNA, 64 nt, Human
uuucaauugccacuuucucuucuuuugaauuugaacucuggaguuacuguucuacaguuuggcg

SEQ ID NO: 442569 - RNA, 64 nt, Human
auuuaguagcaguauagucauuaagcaaagcauuacucuggacuuuauuguccuguuucuauca

SEQ ID NO: 442570 - RNA, 64 nt, Human
auuucucucccucugccugcuguggguggugggcacucuggacacauaguccagcuuucuaaaa

SEQ ID NO: 442571 - RNA, 64 nt, Human
caccccugguggcugcaggcaccgcuggguucugacucuggaccaugcugagacaucccucauc

SEQ ID NO: 442572 - RNA, 64 nt, Human
uccucagccagcacugcagggaucccaggcccagacucuggaggccuucacugaucccagccac

SEQ ID NO: 442573 - RNA, 64 nt, Human
ggucccgcaccuauaucuggaugaagagguagaaacucuggaccucauuaaugaguuauuucuu

SEQ ID NO: 442574 - RNA, 64 nt, Human
ggcagggugaaaggguaguggcagcagggcgcccacucuggagauccucaaaaaaggcccuccu

SEQ ID NO: 442575 - RNA, 64 nt, Human
cagugauaguuuuuaacucuauggucauuguaucacucuggaaaauguggaguagcuguaauaa

SEQ ID NO: 442576 - RNA, 64 nt, Human
uguggcuaaaaagauuacagcgucaucugguugaacucuggaaaaaaaaaaaaaaaugaaaaaa

SEQ ID NO: 442577 - RNA, 64 nt, Human
cagggagugguggugcacaccuguaaucccagcuacucuggaggcugaggcaaaagaaucgcuu

SEQ ID NO: 442578 - RNA, 64 nt, Human
ggagccaauggagacugucucaagagggcacugguggcccgacagccuggcacagggcaguggg

SEQ ID NO: 442579 - RNA, 64 nt, Human
aaccccccacuccugacucugacugccacguggguggcccgaccucugaccugcugucaucgua

SEQ ID NO: 442580 - RNA, 64 nt, Human
ggaguguagagaagacagaaggaaagcugagagcuggcccgacauggucugggacacagaguug

SEQ ID NO: 442581 - RNA, 64 nt, Human
cuuucucuguaguuccuaauggauucaauuacggacucuggauauuugcacuuauguacuugau

SEQ ID NO: 442582 - RNA, 64 nt, Human
ccacacgcuaauacuuaacagggcaucauagaauacucuggauuuucuucccuucuuuuugguu

SEQ ID NO: 442583 - RNA, 64 nt, Human
aaaaagccaacagggcagggguuuuguaaguggaacucuggauugacuggucaguugcuacaau

SEQ ID NO: 442584 - RNA, 64 nt, Human
ccuuccugccgccuuacucuguacauagauuugcacucuggaguuuucuguuagguucgggaac

SEQ ID NO: 442585 - RNA, 64 nt, Human
uaaauucuauuuaaacauuuggauuaagcauauuacucuggagcuuuguauuauucuuuaaaaa

SEQ ID NO: 442586 - RNA, 63 nt, Human
ucgugccuuuaccucaguaaauguguaacacaaacucuggacauacuuucguaacugaaauga

SEQ ID NO: 442587 - RNA, 64 nt, Human
uccaggcugccugggcuuuuuguccucaugaacaacucuggagcagcugucugucccucagagg

SEQ ID NO: 442588 - RNA, 64 nt, Human
ugucuggaacacuagagaaggcuggucaguacccacucuggagcauuucucaucaguaguucac

SEQ ID NO: 442589 - RNA, 64 nt, Human
ccaggcaugguggcaagcgccuguagucccagcuacucuggaggcugaggcaggagaauggcgu

SEQ ID NO: 442590 - RNA, 64 nt, Human
caaggggugggagccuggcuuggguguggcugagacucuggacagaggcugggguccuccuggg

SEQ ID NO: 442591 - RNA, 64 nt, Human
gcaaucagucacaacucaccuagcgaccugacuuacucuggaaucuuggcgggcaucgccgacc

SEQ ID NO: 442592 - RNA, 64 nt, Human
ccacuacccccagcugcugcgaguugacaucggcacucuggaccuggccagcagccgccuggac

SEQ ID NO: 442593 - RNA, 64 nt, Human
caccccgaccgcuucccccaaguucugcuguuggacucuggacuguuuccccucucagcaucgc

SEQ ID NO: 442594 - RNA, 64 nt, Human
ccgggcgugguggcgggcgccuguagucccagcuacucuggaggcugaggcaggagaaucaauu

SEQ ID NO: 442595 - RNA, 64 nt, Human
aacuucucaguaggggaacgucagcugcuuuguguggcccgagcucuucuccguaauucaaagg

SEQ ID NO: 442596 - RNA, 64 nt, Human
ucaggaaggucagggcuuuggaacccuaaaaaguuggcccgaugacuuaaagggaaaaauaauu

SEQ ID NO: 442597 - RNA, 64 nt, Human
cacacacuggacaguagaugggccgacacacacuuggcccgaguuccuccauuucccuggccug

SEQ ID NO: 442598 - RNA, 64 nt, Human
gaugagacugugccuguuauuguuuuuuauuuuuacucuggauuuuccuugcaucugacuugcc

SEQ ID NO: 442599 - RNA, 64 nt, Human
cugggcaugguggcgcacaccuguagucccagcuacucuggaggcugaggcaggggaaucgcuu

SEQ ID NO: 442600 - RNA, 64 nt, Human
cguaucuacaucagcugaaccugaaacucaggggacucuggaacaccauggacccugggggcug

SEQ ID NO: 442601 - RNA, 64 nt, Human
gugcaucucuucuuuccuuuagucuucacagcuaacucuggagagcuucaaaacuagaaggauc

SEQ ID NO: 442602 - RNA, 64 nt, Human
gagcaggcuguaucuggauucuggcaauaaaaguacucuggaugcuguaaggugcccuggccua

SEQ ID NO: 442603 - RNA, 64 nt, Human
uaggaaaccuaacaggaugucagcagggcaguuaacucuggacucagagcccucaagggcaugu

SEQ ID NO: 442604 - RNA, 64 nt, Human
guguuguuacggaaagcagcaguguaccagugucacucuggaguacagcgggagaaacacaaaa

SEQ ID NO: 442605 - RNA, 64 nt, Human
cugaggucugcaacaccaagaaguggcucaggcaacucuggacaucucugccuauuaucagugc

SEQ ID NO: 442606 - RNA, 64 nt, Human
cccaggaucagcaugcgcaucuccaugucugcauacucuggaguucacuuucccagagcugggg

SEQ ID NO: 442607 - RNA, 64 nt, Human
uaauagaugacuucaaaagccugcuccuuacugcacucuggacaaggcccuggucuguauaguu

SEQ ID NO: 442608 - RNA, 64 nt, Human
agucacagacugacacguuucccacuguacuggaacucuggaaagaggggcuccccgaccugcc

SEQ ID NO: 442609 - RNA, 64 nt, Human
aggacaacaguucugagcuguaauuucgccuuaaacucuggacacucuauauguagugcauuuu

SEQ ID NO: 442610 - RNA, 64 nt, Human
gcccaaucucugauguuauugagcuccugcaugaacucuggaccugccugccucagacuucugu

SEQ ID NO: 442611 - RNA, 64 nt, Human
gggaaguugguaggaucucaggcuuggggccgggacucuggagugaauccccauuucucuaccg

SEQ ID NO: 442612 - RNA, 64 nt, Human
cguuucuccccggcuccucugggcuaaggcaguguggcccgaagcuuaaaaaguuacucgguac

SEQ ID NO: 442613 - RNA, 64 nt, Human
ccuccuccugcaggcuuggccuugaugaugcagcuggcccgagagcugaagacccuggcccggg

SEQ ID NO: 442614 - RNA, 64 nt, Human
cucauccucuucaagggugcccgcuacuacgugcuggcccgagggggacugcaaguggagcccu

SEQ ID NO: 442615 - RNA, 64 nt, Human
aaaaauuacuuggaaaacagugggaagugguaggacucuggaagaggccacacacccgagagcu

SEQ ID NO: 442616 - RNA, 64 nt, Human
uaaagacuuaaauguaaaaccccaaacuauaaaaacucuggaagauaaccuaggcaauaccauu

SEQ ID NO: 442617 - RNA, 64 nt, Human
gccuggccuggccugaccaaugagaggccagaacacucuggaacaucggaagaggaguucuuug

SEQ ID NO: 442618 - RNA, 64 nt, Human
aagccugcucugugucuguguugugaagcuugagacucuggaaagaaauggggagggggggcag

SEQ ID NO: 442619 - RNA, 64 nt, Human
uagagaguaaguguugaagccagagccaccuccaacucuggagccuaccaagagaacugugggg

SEQ ID NO: 442620 - RNA, 64 nt, Human
cacaacccuucagauuugccuuauuggcagcucuacucuggagguuuguuuagaagaagugugu

SEQ ID NO: 442621 - RNA, 64 nt, Human
auggacuggacaccuucacuccagcuggacaaagacucuggagagagagccauuggcuggaguu

SEQ ID NO: 442622 - RNA, 64 nt, Human
cggcaaagcccugaaccccaagcgcuaccagcagacucuggaggccugugccuugcuagcugac

SEQ ID NO: 442623 - RNA, 64 nt, Human
aagcaugcacuacuuguugaagugugaaauggagacucuggacuuuggguauuuuuguaaaacu

SEQ ID NO: 442624 - RNA, 64 nt, Human
auaauuagaacauauuugcauaagauagcuauuuacucuggaaaccaacaacuuuugagauuuc

SEQ ID NO: 442625 - RNA, 64 nt, Human
ucccuggcauuuagucaucugugauuguuuuaucacucuggacugugcagagccaccugccacc

SEQ ID NO: 442626 - RNA, 59 nt, Human
ugaggaaucuggucaagugagcgggccuuacucuggaaggaggccucagagguuucucc

SEQ ID NO: 442627 - RNA, 64 nt, Human
agcucaccuugagcagccucagaucaucucugucacucuggaagggacaccccagccagggacg

SEQ ID NO: 442628 - RNA, 64 nt, Human
gccuucuuguguuaaggggcacaagguccagaucacucuggagcaggccagcucugcuggacag

SEQ ID NO: 442629 - RNA, 64 nt, Human
ugaguuugauacuguggggauucaguuuaggcgcuggcccgaggauaucccagcggugguacuu

SEQ ID NO: 442630 - RNA, 56 nt, Human
gccagaggaacucuuccugaggcagguggcccgaggacgcucccugcuccacgucu

SEQ ID NO: 442631 - RNA, 64 nt, Human
acagcgggggucucacacuugcuguccccauccauggcccgagggggaaccugguggucucuuc

SEQ ID NO: 442632 - RNA, 62 nt, Human
cuggccugccugacuucuaaaggagcgggcccacucuggacccaccuggcgccacagaggaa

SEQ ID NO: 442633 - RNA, 64 nt, Human
ccgccgugcgucccucuuaggagagaugagucacacucuggaacuguccaagaacgaaccugcc

SEQ ID NO: 442634 - RNA, 64 nt, Human
agggcucaggcgacccucauggggaaggucacugacucuggagacugaagccccagugugcgca

SEQ ID NO: 442635 - RNA, 64 nt, Human
ggcccaggaggcuuugagaaagccuucucuguguacucuggagauagauggagaaguguuuuca

SEQ ID NO: 442636 - RNA, 64 nt, Human
cucucccucucucucaucuuacauuucucacccuacucuggauggugugugguuuuuaaagaag

SEQ ID NO: 442637 - RNA, 64 nt, Human
gaacuuuggggaaacacuuugcugaaauguugggacucuggaacuagccaagaaaagagaauau

SEQ ID NO: 442638 - RNA, 64 nt, Human
uugagucaagcccauuuccucuuagccacauaggacucuggacuggguugccggaugguuccuu

SEQ ID NO: 442639 - RNA, 64 nt, Human
agaaacugcuuuuuauacauuuuguauaaggacaacucuggaaacaagccuauuuccuccagcc

SEQ ID NO: 442640 - RNA, 64 nt, Human
caaugaacugcagcucacgagaccuuuugcagggacucuggaauguccucacgguauauugaug

SEQ ID NO: 442641 - RNA, 64 nt, Human
cuuuuucugccucaaaaccagcccuaacuggacuacucuggaugcauuuuguggugggcccccu

SEQ ID NO: 442642 - RNA, 64 nt, Human
guuguugauaucgucauauaaagccauugcaaggacucuggaaacugccgccaaugaccaauuu

SEQ ID NO: 442643 - RNA, 64 nt, Human
acagucacccauuccagacuccaguguccuuaaaacucuggagugagaggaugccagaggauca

SEQ ID NO: 442644 - RNA, 64 nt, Human
cgcccugagcgcucuucccucguuuuacauccucacucuggagauagaugggcucccucgguua

SEQ ID NO: 442645 - RNA, 59 nt, Human
guguaccauacaacaaauaacaccaggaaacucuggaaugaacaguaucacauucuagg

SEQ ID NO: 442646 - RNA, 64 nt, Human
cccauuggggccucuugaugucugggauggcacguggcccgaccuccacaagcucccucaugcu

SEQ ID NO: 442647 - RNA, 64 nt, Human
uugugugagcacaaaagccacgucccaagccaccuggcccgauuccacagauguaugugcggcc

SEQ ID NO: 442648 - RNA, 64 nt, Human
gaaggcaucuccaggcaaggaaaacugaagucauuggcccgauacaaaacauuuccugcaacga

SEQ ID NO: 442649 - RNA, 64 nt, Human
agggagaugaaguggaaagcuguuucaaaaacagacucuggacucaugauuuuguuucacggaa

SEQ ID NO: 442650 - RNA, 64 nt, Human
uguuauggucaccuggaaacagccuucuggcccaacucuggaugccuguuauacugggacaaac

SEQ ID NO: 442651 - RNA, 64 nt, Human
auucaugaaaggacacaaacacacauaagaauacacucuggagaaagaccuuauaaauguaaga

SEQ ID NO: 442652 - RNA, 64 nt, Human
auaagcaaaacagaagagucuuguuccaacagaaacucuggagcuccgugggucuuucucuucu

SEQ ID NO: 442653 - RNA, 64 nt, Human
ucccaucuugguucugacccaaauccugcucuggacucuggagaggagauugaaauauaauugc

SEQ ID NO: 442654 - RNA, 64 nt, Human
gaagggguggaggagggccagcucaguugccgaaacucuggaguggcggcuggcuagaaauugg

SEQ ID NO: 442655 - RNA, 64 nt, Human
ccgagcaugguggugcacaccaguauucccagcuacucuggaggcugaggcggaggcaggauug

SEQ ID NO: 442656 - RNA, 64 nt, Human
cccuggccagcucuucgccccucaccucuuugaaacucuggacguauuuauggcuccaccuccc

SEQ ID NO: 442657 - RNA, 64 nt, Human
aauuuaaucacuaauuaaaaaucuaucaaacaaaacucuggaccagacagauuuauaguugaag

SEQ ID NO: 442658 - RNA, 57 nt, Human
ucacacugaauagacaucagagaguucacucuggagagaggccuuaugaaugcagug

SEQ ID NO: 442659 - RNA, 64 nt, Human
cauucccaggaggagccccgcuucaccccuucugacucuggaaaccgcaccuuuaacuuugcag

SEQ ID NO: 442660 - RNA, 64 nt, Human
uguuccaguucacuuuaaagacaugaaugaacucacucuggagagaagaagcugcaugaaaauu

SEQ ID NO: 442661 - RNA, 64 nt, Human
cucaaaaaaaaaaaaaaaguacaugaaaggauucacucuggagagaagucauaugaauguaaga

SEQ ID NO: 442662 - RNA, 64 nt, Human
ccaggcaugguggugcgcaccuguagucccagcuacucuggaggcugaggcaggggaauggcuc

SEQ ID NO: 442663 - RNA, 64 nt, Human
cguccacaaaaucuguacucccagcggggguguuuggcccgaggagucaguguuauuacuggug

SEQ ID NO: 442664 - RNA, 64 nt, Human
cugccugcugccauagcagcaccuuuagcuagguuggcccgagugaggccucugugcuguccug

SEQ ID NO: 442665 - RNA, 64 nt, Human
gcaucagaacauaaugcugacaccggugucaguguggcccgagccuguguccuccccaccucgc

SEQ ID NO: 442666 - RNA, 64 nt, Human
uggcccaguuuauuucguaugcaugaaagaacucacucuggagagaaacuauaugaauguaagc

SEQ ID NO: 442667 - RNA, 64 nt, Human
guuuggaccccaccacuguugccauggugaccaaacucuggaguccgagguaacagaacaccug

SEQ ID NO: 442668 - RNA, 64 nt, Human
uuuucugccgugaaaccccagccagccacaccagacucuggaacccuuuuucgacugccccaac

SEQ ID NO: 442669 - RNA, 64 nt, Human
uugaaagcagggaugaucccauuccacccuguccacucuggaugagaauuggccaccugauggu

SEQ ID NO: 442670 - RNA, 60 nt, Human
agcuguucccaugggaauaacguccaaaacacucuggaucuuauauggagaaugacauug

SEQ ID NO: 442671 - RNA, 64 nt, Human
caaacugccccuuccauggaaaagcuggaaaaaaacucuggaacccauauccaggcuuggugag

SEQ ID NO: 442672 - RNA, 64 nt, Human
agaggagaaacacccaacacugaguggagauuugacucuggacagggccuggccuccuuagugg

SEQ ID NO: 442673 - RNA, 64 nt, Human
cccgggacaguaggucugggcggcaccacugggaacucuggacuugaguguguuugccucuucc

SEQ ID NO: 442674 - RNA, 64 nt, Human
ggggcugugccagcggcuccgcagggcccuuccaacucuggagugucuguaguucuugugaaac

SEQ ID NO: 442675 - RNA, 64 nt, Human
uggugcaacugcugcaggaugccuguaguagggaacucuggaaguguauugggcugagguggga

SEQ ID NO: 442676 - RNA, 64 nt, Human
guuaacuguaggccaauauagauuugccuuuaaaacucuggaagagcuacauagucaucauuag

SEQ ID NO: 442677 - RNA, 64 nt, Human
uuugccuuagcaaugcaucggucucugaggugacacucuggagugguugaagggccacaaggug

SEQ ID NO: 442678 - RNA, 64 nt, Human
cuggcaagggcaggccccuccucuguccaccgagacucuggacuugcucaggucccagacuggg

SEQ ID NO: 442679 - RNA, 64 nt, Human
ugcagugccaggcaggguggccaaagaggacuggacucuggaccuggagccccgugguccaguu

SEQ ID NO: 442680 - RNA, 64 nt, Human
agucaacuccugucaaaaugaaggugaacuggcauggcccgaucacuguccauaagggagaaag

SEQ ID NO: 442681 - RNA, 64 nt, Human
gauucugaggaagucuuaucuucugcagugaguauggcccgaugcuuucuguggcuaaacagau

SEQ ID NO: 442682 - RNA, 64 nt, Human
acuccugcagaguguaaucagcaccccauccaacuggcccgaaagcccagaccugcagcagaac

SEQ ID NO: 442683 - RNA, 64 nt, Human
uucagcuuaccugccacagagcuuuucugcaugaacucuggaacagaaaggcccuguaaagccc

SEQ ID NO: 442684 - RNA, 64 nt, Human
gcugcccuuugaccuuuggacgccaccuguaaucacucuggauggugucuguggaguucagguu

SEQ ID NO: 442685 - RNA, 64 nt, Human
ugugccuggaaauuaaacccugccccacuucucuacucuggaaguccccgggagccucuccuug

SEQ ID NO: 442686 - RNA, 64 nt, Human
uaaggagcuuacuaacugugguuugcacccuaacacucuggagcaacuuagucaaauaccguua

SEQ ID NO: 442687 - RNA, 64 nt, Human
gacucuggaaccucugugacgccaguucucccugacucuggaaccucugugauccuuugcaggu

SEQ ID NO: 442688 - RNA, 64 nt, Human
cauuucacucagcugcuccucucaguucucccugacucuggaaccucugugacgccaguucucc

SEQ ID NO: 442689 - RNA, 64 nt, Human
ggcccugccaaacugaccaccucccccgacugccacucuggaccuaauagcuguuccuuaggcc

SEQ ID NO: 442690 - RNA, 64 nt, Human
ccaggcgugguggcgggcgccuguagucccagcuacucuggaggcugaggcaggagaguagcgu

SEQ ID NO: 442691 - RNA, 64 nt, Human
ggggucuggggacugagcugccuccugucucuccacucuggagcccugggcucuugccuccugu

SEQ ID NO: 442692 - RNA, 64 nt, Human
aaaugacuuugauuccugcgccuuuuaguuuugaacucuggaauuccucugcccccuccccaac

SEQ ID NO: 442693 - RNA, 64 nt, Human
ccaagugcaguggcaugugcuuguaaucccagcuacucuggaggcugaggcaggagaauugcuu

SEQ ID NO: 442694 - RNA, 64 nt, Human
uccuguaugcauucauuuauuccuugcuggacaaacucuggaagcagcgugugaaacagcgggg

SEQ ID NO: 442695 - RNA, 64 nt, Human; identical to SEQ ID NO: 442319

SEQ ID NO: 442696 - RNA, 64 nt, Human
ccucacugucauuauucuuuaagaagaugaaauuacucuggauguuugguauuuuuuuacauua

SEQ ID NO: 442697 - RNA, 64 nt, Human
caggcaguguaggcgacagccucaugggccacuguggcccgauguccccuuccuucccggccau

SEQ ID NO: 442698 - RNA, 64 nt, Human
ccacaccaaggccugagacagcaggagccccgccuggcccgaagccguuuccaccgcagcaggc

SEQ ID NO: 442699 - RNA, 64 nt, Human
gagcuagucugagccggcgcgagggcacgggcuguggcccgaggaggcgguggacugaaggcau

SEQ ID NO: 442700 - RNA, 64 nt, Human
cugucuggcguuuuuguaaucauacuauuaaaugacucuggagucauguuaaugacaggauuug

SEQ ID NO: 442701 - RNA, 64 nt, Human
ugaagagaaaagaggaggacugauggaaagacagacucuggacagcugcacggcuugugaagug

SEQ ID NO: 442702 - RNA, 64 nt, Human
guuccaaaugcaauauagaaaaaaaaacccugugacucuggauuuuauuuuaaguucucuaaca

SEQ ID NO: 442703 - RNA, 64 nt, Human
uuuggcuguggaguaagagggaaugcggugaggcacucuggaauaugacccuaccagagguugg

SEQ ID NO: 442704 - RNA, 64 nt, Human
agggcugggacugguggccuuaugucaguugucuacucuggagcuugacuuggaccuccccagg

SEQ ID NO: 442705 - RNA, 64 nt, Human
cuacucuuacuauaauuuccuaaguguacaccaaacucuggauuuaaaaaucugaaguacuaua

SEQ ID NO: 442706 - RNA, 64 nt, Human
uuuaaagacuugcacaaauacggauccugcacugacucuggaaaaggcauauauguacuagugg

SEQ ID NO: 442707 - RNA, 64 nt, Human
ggggacuuggcccuucugaugaggggcccucgguacucuggauaacgaagcuugugcagagugg

SEQ ID NO: 442708 - RNA, 64 nt, Human
ugguuucguaaugugaaaucaaauacuaauuuaaacucuggagcccauaauaucuacauaaaag

SEQ ID NO: 442709 - RNA, 64 nt, Human
ucauacaaugccugaucaugcugcuccugucacccuccacgauuccacagaccaggacauucca

SEQ ID NO: 442710 - RNA, 54 nt, Human
guggucaaagcguuccauaguucccuccacgaaagcauucagaaacccuacaac

SEQ ID NO: 442711 - RNA, 64 nt, Human
uuucagugcuucuugguucccaggaugccacuuccuccacgaauagcuaccuguugaagugaua

SEQ ID NO: 442712 - RNA, 64 nt, Human
ugggaggagugaggcgugccgccggcugugggaccagcaagacugcacgugucccucuuggccu

SEQ ID NO: 442713 - RNA, 58 nt, Human
gacuguucaaaaaaucuugagcauacuccagcaagauauguuuuugguagcaaaacug

SEQ ID NO: 442714 - RNA, 64 nt, Human
aaguguggggauuacaggugcgagcuacugcucccagcaagagccaagauuuuaaccuagaucu

SEQ ID NO: 442715 - RNA, 64 nt, Human
aagggccgcuggcuuccgaacagacgugguugcucuccacgaggcgcauggggagcccgcgggc

SEQ ID NO: 442716 - RNA, 64 nt, Human
cuuggguuccuaauuccugguguuuaauaauucucuccacgaucauguuuuucugauuuuuuuu

SEQ ID NO: 442717 - RNA, 64 nt, Human
cuagcccucagcuucccacggaaucagauggauccuccacgauuacgugaauaaaaugauggaa

SEQ ID NO: 442718 - RNA, 64 nt, Human
aguacaguauacucaaggucuugcauaacccacacuccacgaaaaccgcaucguaaacagagag

SEQ ID NO: 442719 - RNA, 64 nt, Human
gaucucguggccuucccccucagacuacccaugucuccacgaaggcguccuggagucacucccc

SEQ ID NO: 442720 - RNA, 64 nt, Human
gaggacaaguuacaccuccacucagcacucuggacuccacgaugccuuugagucuguuuuccca

SEQ ID NO: 442721 - RNA, 64 nt, Human
acuaugcaacugaaaaacugaggaugauuguuagcuccacgagugcaaacugcagucaccaagu

SEQ ID NO: 442722 - RNA, 56 nt, Human
gcagcauggacaccaacuaaugcugacuccacgauccugccacccuguagcgccag

SEQ ID NO: 442723 - RNA, 64 nt, Human
ccugagauuguggcucccccucuggaggagguggcuccacgaugccuugauuuucacucaucau

SEQ ID NO: 442724 - RNA, 64 nt, Human
gcccagaguggccucagcugcacgacuccagaggcuccacgacugagcucugaggccagugccu

SEQ ID NO: 442725 - RNA, 64 nt, Human
gacaggcaucccuggguggccuuuccugcugacacuccacgagcugacccagcagaauucucug

SEQ ID NO: 442726 - RNA, 64 nt, Human
uauuagaguguuauugguagugucuagccuuuuccuccacgacauuccuugacuuaauccauuu

SEQ ID NO: 442727 - RNA, 64 nt, Human
gauggaugcuuguuucaaaggguuuccucucccucuccacgaaggcaguaccagccaguacucc

SEQ ID NO: 442728 - RNA, 64 nt, Human
cccaaucuccuuccaccucccucccucccgccagcuccacgauuuuucgguguuucucuguaca

SEQ ID NO: 442729 - RNA, 64 nt, Human
cauucagugaagggcaaacagcccauggguaguauggcccgagcacugaauucccuugcgccuu

SEQ ID NO: 442730 - RNA, 64 nt, Human
gcucacucaccugccucucagcucaccaacuguguggcccgauuccuaacaggccacacacagc

SEQ ID NO: 442731 - RNA, 64 nt, Human
gucuccucccuaugaugccagucccugcguucccuggcccgagcuggucuggggccauuaggca

SEQ ID NO: 442732 - RNA, 64 nt, Human
gcccaucugucucacccucuccuguuguauccagcuccacgacaaacuucugccuuccccaaca

SEQ ID NO: 442733 - RNA, 64 nt, Human
guguccucucuuccuacauuugucccugagaguacuccacgauuacuagguucuugauucccuu

SEQ ID NO: 442734 - RNA, 64 nt, Human
aaccacaacauaauaguugaaagaucaagauuggcuccacgaaagugauacggagguuaggaug

SEQ ID NO: 442735 - RNA, 64 nt, Human
gcccugcucgcaugccgccccgcccuccccccaccuccacgacuauuuauugagcgccuguugu

SEQ ID NO: 442736 - RNA, 64 nt, Human
uuuugcagggauagcugggaguauggccacccugcuccacgaugcgguaaugaauccagcagaa

SEQ ID NO: 442737 - RNA, 62 nt, Human
augccccggggaccuugugauccagcucacagcuccacgaagacucaaaaggaaaagccauu

SEQ ID NO: 442738 - RNA, 64 nt, Human
ugagagcguuucugucuuuugggagaguacuuuucuccacgagcccucuggccacugugggagg

SEQ ID NO: 442739 - RNA, 64 nt, Human
gccugcagaacacagaaugaaacaugcugguagacuccacgagggcagggccucuccugucgcc

SEQ ID NO: 442740 - RNA, 64 nt, Human
guucuagucauguguuuuuuaggacgauuucugucuccacgaugguggaaacaguggggaacua

SEQ ID NO: 442741 - RNA, 64 nt, Human
ucugaccucaccaagucaaguggaccacucuccacuccacgaggaugugaaacgguucuuuaaa

SEQ ID NO: 442742 - RNA, 64 nt, Human
ccuggcugcucaggagaggcgacacauuucaaaucuccacgagauauucuccacacagaaaauc

SEQ ID NO: 442743 - RNA, 64 nt, Human
uguuugcgggggaagccacacaucgcacguuuuacuccacgacgcacggggcucugcugucggg

SEQ ID NO: 442744 - RNA, 58 nt, Human
gaauuaucccgaaaaguuaacaugucaccuccacgaggccauccucugugaccgaagg

SEQ ID NO: 442745 - RNA, 64 nt, Human
agguccccagacccccugagcccucccagggacccuccacgaccagcucugggggaggcacagg

SEQ ID NO: 442746 - RNA, 64 nt, Human
uagggcuggcaaugguugccuuaacccuggcuccuggcccgagccuggggcucccugggcccug

SEQ ID NO: 442747 - RNA, 64 nt, Human
gaauggacuugcuaaaugaccuagcacuauucucuggcccgauuuaucauaucccuuuucuccu

SEQ ID NO: 442748 - RNA, 64 nt, Human
uuucuucuuucuuaaugccugaaauuuucuccauuggcccgaaagcaguaaaaauuguucauua

SEQ ID NO: 442749 - RNA, 64 nt, Human
ccuuuagguccuucugguuuggaggaaguggagccuccacgaacucucucuuacuccgaccauu

SEQ ID NO: 442750 - RNA, 64 nt, Human
uguaccuagaauagucucacugucccccguuugccuccacgagccugcuguuuccaggaaauua

SEQ ID NO: 442751 - RNA, 64 nt, Human
ggguccaccuucccaagccuccagagaguucucccuccacgauugugaaaacaaaugaaaacaa

SEQ ID NO: 442752 - RNA, 64 nt, Human
gagcacugcgcauggcuguucugcugcaacugugcuccacgaaacagaagaaaagguaaggugu

SEQ ID NO: 442753 - RNA, 64 nt, Human
guucagaauccggagcaguaaguggagaagagcucuccacgagugcucagucuuagaacuauua

SEQ ID NO: 442754 - RNA, 64 nt, Human
ccauugcccuuggcuuuuucugguaugugcugugcuccacgaccaagccgagaaaggaccuagg

SEQ ID NO: 442755 - RNA, 64 nt, Human
aggguuuaauuuuaaagacuuucugguuacacuacuccacgaacuccuccaaagauccguuauu

SEQ ID NO: 442756 - RNA, 64 nt, Human
uuuguuauaagauauugauuucauuuagauuucccuccacgaggucagcaaacuaucauguucu

SEQ ID NO: 442757 - RNA, 64 nt, Human
gcacguggacgugggcaccucaguagcggagcaucuccacgaaacggggcaccacaggaucccu

SEQ ID NO: 442758 - RNA, 64 nt, Human
cuaacucacucuagugggaccuugacuggagaaacuccacgaucuuccugaagaagagaaaugg

SEQ ID NO: 442759 - RNA, 64 nt, Human
uuaaucucccacaaggcaucuguugcuuuggguccuccacgacucuuaggcccgccucaacaac

SEQ ID NO: 442760 - RNA, 64 nt, Human
uauaaagacgggaguccugcaauuguacugcggacuccacgaguucuuuucuggugggaggacu

SEQ ID NO: 442761 - RNA, 64 nt, Human
gggcuguguccuccccuagggaugagggucgggccuccacgaugcccugggcugugugcucuua

SEQ ID NO: 442762 - RNA, 64 nt, Human
accaggucccugggaaugagcugccuaccugcugcuccacgaggaagcucaggccugcacaggc

SEQ ID NO: 442763 - RNA, 64 nt, Human
guuguccaggaugcuggcugguggaacaaccugcuggcccgaaacaaggcugccagguguggau

SEQ ID NO: 442764 - RNA, 64 nt, Human
aggacacacucugcacccccccaccccacgaccuuggcccgagccccuccgugaggaacacaau

SEQ ID NO: 442765 - RNA, 64 nt, Human
uggaggggagggagggagggagggagggagagaauggcccgagggaggagggagagaaggaggg

SEQ ID NO: 442766 - RNA, 64 nt, Human
cuucacgcacauauccguggccaccugagaccugcuccacgacccuuccaggcagagccgagag

SEQ ID NO: 442767 - RNA, 64 nt, Human
ucugccuccagcuuuccugguuagcgcaacgcggcuccacgaccacacgcacuucaggguggaa

SEQ ID NO: 442768 - RNA, 64 nt, Human
uaaacuccggagggucggacgggaccugggcucucuccacgauucuggcuguuugcccaggaac

SEQ ID NO: 442769 - RNA, 64 nt, Human
ccuguuuuaccauccugggagcaaggcccugcagcuccacgagaccuuuaccccgggaagaagc

SEQ ID NO: 442770 - RNA, 64 nt, Human
ggggcagccucugggcccugaaccccugcuggggcuccacgacccugagagaaggggugagaag

SEQ ID NO: 442771 - RNA, 64 nt, Human
cucacgcugguguuugaggcauuuccacugugaucuccacgaggggauguuuuccgggacacau

SEQ ID NO: 442772 - RNA, 64 nt, Human
ugagaaucuguccagaaguugcauaggggauggccuccacgauaaggacaugcaacacguguuu

SEQ ID NO: 442773 - RNA, 64 nt, Human
cccacccgugggccaggggcggccggacccgucccuccacgaccccgccaccccuccuaggccu

SEQ ID NO: 442774 - RNA, 64 nt, Human
aaagcugaugggcuuccucuggcccucccuuuuccuccacgaggauuaaaggauacaagcugac

SEQ ID NO: 442775 - RNA, 64 nt, Human
uccccacagagcauccuccucucaucugugacaacuccacgagcccuuaauuucuuaguccuca

SEQ ID NO: 442776 - RNA, 64 nt, Human
cuaucccguguacagagagauccagagcccuacacuccacgaccugggggcucacagcacagaa

SEQ ID NO: 442777 - RNA, 64 nt, Human
ccaccagaacuuccacagacgcccccacuagcuacuccacgaagcccccgagccucgccagacc

SEQ ID NO: 442778 - RNA, 64 nt, Human
ggccacgugggcccccagccucccccucggccgccuccacgacccggaguaggggggcucggga

SEQ ID NO: 442779 - RNA, 64 nt, Human
gacccauccccgagguccccagcgaggacacacacuccacgagagcagccccuccacucugccc

SEQ ID NO: 442780 - RNA, 64 nt, Human
cugcaugccgaccuugucccaccgggacccacaauggcccgagcccucuuugcaugggcagcca

SEQ ID NO: 442781 - RNA, 64 nt, Human
ggguggaccccgagcacgguugccugagguccgauggcccgagagcugggacucaguucuuggc

SEQ ID NO: 442782 - RNA, 64 nt, Human
aaauggauucauuuccauaaaccaaguuaaaguauggcccgaccauuuaagaaaacaaccaucu

SEQ ID NO: 442783 - RNA, 64 nt, Human
cacacacccccccacaaggaacccucaggccacccuccacgaggugugacuaacuaugcaauaa

SEQ ID NO: 442784 - RNA, 64 nt, Human
gguaggguguguauauauaaaagguuguguacaacuccacgaggugaaaaauauucaguaacuu

SEQ ID NO: 442785 - RNA, 64 nt, Human
cagccuuguaaauaaccacaagguccacucccugcuccacgaagccuuaagccauaggcccagg

SEQ ID NO: 442786 - RNA, 64 nt, Human
ugcuaaagacugcauuauuuuacuacuguaauuucuccacgacauagcauuauguacauagaug

SEQ ID NO: 442787 - RNA, 64 nt, Human
gcuaaguguguaggagccagugagcgaaucaagacuccacgaccugccagcuguuuccaggauc

SEQ ID NO: 442788 - RNA, 64 nt, Human
agcccaucccgauggaagccgccuccuccgccuccuccacgagagaaggacagucguggcagcc

SEQ ID NO: 442789 - RNA, 64 nt, Human
cgagaccagccuggccaacauggugaaaccccgucuccacgaaaaagauaaaaauaagcugggc

SEQ ID NO: 442790 - RNA, 64 nt, Human
ucagggauugccgaguccacguaacugaccuguacuccacgaggcccugugggaacgguccagg

SEQ ID NO: 442791 - RNA, 64 nt, Human
cccuguuuuugugaccaaagaggaagccauuagucuccacgaguucccgguggaacagaugaca

SEQ ID NO: 442792 - RNA, 64 nt, Human
agagaggaugccagggacaccaggccucuggccucuccacgagucacugcucuccccauuggca

SEQ ID NO: 442793 - RNA, 64 nt, Human
ggcgaggccacucgacucccggggccggggccgacuccacgaacaccagcccaaacugaagugc

SEQ ID NO: 442794 - RNA, 64 nt, Human
auggcuuguggcaguucagcuucacccucaggaguggcccgaacccugcuggacccaggcuccc

SEQ ID NO: 442795 - RNA, 64 nt, Human
gauaggaaaugaaauugccucucagugacaggaguggcccgagccugcuuccuauuuugauuuu

SEQ ID NO: 442796 - RNA, 64 nt, Human
gcgauccguacucagaacguccaggagagacgcauggcccgaagucaaagugcuggaauuuucc

SEQ ID NO: 442797 - RNA, 64 nt, Human
aaaaacaaaagcugaacagaggcggccguggccuuggcccgaggagacuaacuugcuuucuccc

SEQ ID NO: 442798 - RNA, 64 nt, Human
ggauugcaccugaauccuaucugacguuucauuccagcaagaggggcuggggaagauuacauuu

SEQ ID NO: 442799 - RNA, 64 nt, Human
gcgugcuaaaauaacagauuucucagaagucuuucagcaagauaaacauuauuaaguaacuuau

SEQ ID NO: 442800 - RNA, 64 nt, Human
ucucucaaauuaggccagauucuaaaacaugcugcagcaagaggaccccgcucucuucaggaaa

SEQ ID NO: 442801 - RNA, 64 nt, Human
auggacuguguuacaguuugucucuaacaugaaacagcaagagguagcccccucucccguccuc

SEQ ID NO: 442802 - RNA, 64 nt, Human
cugcucauuguagauggagaauucaacauaaauacagcaagaaaauguguuugggcuucugaag

SEQ ID NO: 442803 - RNA, 64 nt, Human
ucauggcgggaggugaaaggcacuucuuacauggcagcaagagaaaaugaggaagaagcaaaag

SEQ ID NO: 442804 - RNA, 64 nt, Human
cuacauguauuacaaagucucuuuggcaagauugcagcaagaucaugugcauaucaucccauug

SEQ ID NO: 442805 - RNA, 64 nt, Human
gaagacuggaucaagggguucccacuggcuccuccagcaagaccucgucuuugcuuguccugcu

SEQ ID NO: 442806 - RNA, 64 nt, Human
ucaugguuauucuacauuucuagaaaguucuuaucagcaagauggucccauaagcaaauuucuu

SEQ ID NO: 442807 - RNA, 64 nt, Human
uuuuauacccagaaguuauuucuacauuguucuacagcaagaauauucauaaaaguaucccuuu

SEQ ID NO: 442808 - RNA, 64 nt, Human
uuggucauguuuauuucuugccauauuuauaacacagcaagaguauuuacaggaaugaaguagc

SEQ ID NO: 442809 - RNA, 64 nt, Human
gcucggggugucuuccccaaggcauguggcucagcagcaagaaaggcaaguugcuccugcuggg

SEQ ID NO: 442810 - RNA, 64 nt, Human
uuucccaacccaagacuauuguaacacauaaagacagcaagaauucuuauuucuauaauaaauu

SEQ ID NO: 442811 - RNA, 64 nt, Human
cacugcauauuuuuacccuuauuuuugcuccuuacagcaagauuaguagguuauaaaaauuuaa

SEQ ID NO: 442812 - RNA, 64 nt, Human
uugucugguccugaucccagacucaccccaucugcagcaagacccuuggcuggcuuccuccgcu

SEQ ID NO: 442813 - RNA, 64 nt, Human
ugguccuauaauggauauuauucagaccuuaguacagcaagacacucuggccaccauaaaaaac

SEQ ID NO: 442814 - RNA, 64 nt, Human
gggacuggaggccagcgguguccacccuugcccucagcaagagagaaugcauucuuaaaagaaa

SEQ ID NO: 442815 - RNA, 64 nt, Human
auuuuuaaaaauacauucauugucuucagucauacagcaagacacaugagacauagauuagaaa

SEQ ID NO: 442816 - RNA, 64 nt, Human
uaaaaaaagagaauuagauuauauuggugguucucagcaagagaaggaguauguguccaaugcu

SEQ ID NO: 442817 - RNA, 64 nt, Human
gaauugcacaauccaugaacagcauuagaauuuacagcaagaacagaaauaaaauacuauauaa

SEQ ID NO: 442818 - RNA, 64 nt, Human
caccgaugaaguaaacgccuuagugcuucagacccagcaagaaauuauugguaauauuuauguc

SEQ ID NO: 442819 - RNA, 64 nt, Human
uagggagauuauaugaaggccaaaauaaugacuucagcaagagugacugaacucacucuaaggc

SEQ ID NO: 442820 - RNA, 64 nt, Human
uccagccugcuccuuuuacucuaggggccucugucagcaagaccauggggacuucaagagccug

SEQ ID NO: 442821 - RNA, 64 nt, Human
cugucccccuaaagccacagggaugggguaucuucagcaagagagagggcguuaaagauguaaa

SEQ ID NO: 442822 - RNA, 64 nt, Human
uuuuuuccucauucggcuguauaauacauaaccacagcaagacugacauccacuuaggaugaua

SEQ ID NO: 442823 - RNA, 64 nt, Human
uugagagguggggaccuaauuauuaccagaguagcagcaagagaggaaacguugugaauuaagu

SEQ ID NO: 442824 - RNA, 64 nt, Human
uuccucucucaccaccccaucucccucucuuccccagcaagaugucaauuaagcagugugaauu

SEQ ID NO: 442825 - RNA, 64 nt, Human
cacauugagaguaagcacguugcccaagguugcacagcaagaaaagggagaaguugagauucaa

SEQ ID NO: 442826 - RNA, 64 nt, Human
agcugaagcuggugcgcccugucucugugcccuccagcaagaagccacccuccuugcaggaugc

SEQ ID NO: 442827 - RNA, 64 nt, Human
ccugcauaccucuggcagcuggcccaggaagagccagcaagagcaaggcaugggagaggggagg

SEQ ID NO: 442828 - RNA, 64 nt, Human
caaagugcuuugacuucuugcuucagucaucagccagcaagagggaacaaaacuguucuuuugc

SEQ ID NO: 442829 - RNA, 64 nt, Human
accugaauguaccuacuagggcaccauaauacugcagcaagaccaaagugguaaagaaacacag

SEQ ID NO: 442830 - RNA, 64 nt, Human
cucagagagguuaugugguuuucucaaagccacacagcaagauuuggcaggugagccuuacuuc

SEQ ID NO: 442831 - RNA, 64 nt, Human
uugaagaagaugucauggcauugccucagcaccccagcaagagcauugcaucuuugcugaaucc

SEQ ID NO: 442832 - RNA, 64 nt, Human
ugggaguuggugagagcaggaggagagguggggacagcaagaagccacagauuggcaugaagga

SEQ ID NO: 442833 - RNA, 64 nt, Human
gcagacuugaagagucugaggaacugaagugggucagcaagaccucugaaauccuggguaaagg

SEQ ID NO: 442834 - RNA, 64 nt, Human
gcugcagucacauugauguaaggacuguaaacaucagcaagacuuuauaauuccuucugccuaa

SEQ ID NO: 442835 - RNA, 64 nt, Human
aaaauauuugucuccaccuuuuccccaaaagcaacagcaagacauauuuuguuagauauuuuau

SEQ ID NO: 442836 - RNA, 64 nt, Human
ugucagugacacuaggaauauaauaaagguaacacagcaagaagcacagaacuacucccucuuc

SEQ ID NO: 442837 - RNA, 64 nt, Human
aaaaccugauaggugagacuacuucaguuuauuccagcaagaaagauugugaugcaagauuucu

SEQ ID NO: 442838 - RNA, 64 nt, Human
aaaaccagauagauggguugacaucaguuuauuccagcaagaaagaaaagauuguuaugcaaga

SEQ ID NO: 442839 - RNA, 64 nt, Human
uuuguacuaauacagggagcacacuccuucaguucagcaagacauaaagccuuuugcuuuaugc

SEQ ID NO: 442840 - RNA, 64 nt, Human
auccaggagugcacagaaaagucacuggaugacacagcaagaggcaacauuuuggaagcagagg

SEQ ID NO: 442841 - RNA, 64 nt, Human
uucucucccuacuacagcuggcaaaguugguuugcagcaagaagauagugggagggggccaggc

SEQ ID NO: 442842 - RNA, 64 nt, Human
uuuauugcuauuugaagcagauguucaccaaugucagcaagaacucaaccugaauuuaaaggug

SEQ ID NO: 442843 - RNA, 53 nt, Human
cauguacccacucacagugaugccagcaagaagagacugauugaggauacuga

SEQ ID NO: 442844 - RNA, 64 nt, Human
ucauggauuuuucucuuuccucauggaugaucuucagcaagaguggacugggaagcugcaccug

SEQ ID NO: 442845 - RNA, 64 nt, Human
cugugauugcaccacuguacuccagacuggauaacagcaagagcccaucuuuuaaaaaaaguaa

SEQ ID NO: 442846 - RNA, 64 nt, Human
aaaaccagauagauaggacaacuucaguuuauuccagcaagaaagaaaagauuguuaugcaaga

SEQ ID NO: 442847 - RNA, 62 nt, Human
augaugcucuugcacuugagaugacaucuucuugcagcaagagugcugauaucccaagagga

SEQ ID NO: 442848 - RNA, 64 nt, Human
cccuugccuaggggacaguccuccuggguaagaucagcaagauaacucuucagucacauuccau

SEQ ID NO: 442849 - RNA, 64 nt, Human
aaacugaaagaaaaauaguugcuuuuuaaaaugucagcaagaaggccugccucaucuuaacaaa

SEQ ID NO: 442850 - RNA, 64 nt, Human
ucauaagcacuguggacaaaaaaagcggggaagacagcaagauuuauuggaagauacuuacagg

SEQ ID NO: 442851 - RNA, 64 nt, Human
aggcuggaaaugguuucacuugcucuuugacugucagcaagacugaagauggcuuuuccuggac

SEQ ID NO: 442852 - RNA, 64 nt, Human
agccaaacaccggcauuuuauguacuuuguccuucagcaagaaagguguggaagcaugauaugu

SEQ ID NO: 442853 - RNA, 64 nt, Human
aacuuuaugcuuccaaauaauaauguauguuagacagcaagaaaugaauacuuuaaaaagugau

SEQ ID NO: 442854 - RNA, 64 nt, Human
cugugauggcacaacugcauuucagcccgggagacagcaagauucugucucaaaaaaaaaaaaa

SEQ ID NO: 442855 - RNA, 64 nt, Human
gaagccucaacguagauuccugaacucaagguaccagcaagaaugccuucucccagugugcucu

SEQ ID NO: 442856 - RNA, 64 nt, Human
ucuaggcuucagguugcauugggguuccucuguacagcaagauguuucuugccuuuuguuaaug

SEQ ID NO: 442857 - RNA, 64 nt, Human
ucaaguuucacauccuggucaucaaaagacucgacagcaagacuuagaaugaaaaaggguacuu

SEQ ID NO: 442858 - RNA, 64 nt, Human
uccagagagaaaaaagcuaauuuuccuaaggacacagcaagaauauucauuaaggauauuuucu

SEQ ID NO: 442859 - RNA, 64 nt, Human
aacuuacuggggacaggaugugugcuaaagggcacagcaagacacugucuuuugcuuagcugac

SEQ ID NO: 442860 - RNA, 64 nt, Human
cagaggguccccacuggccgcaacggcucagugacagcaagagcaggaagagcagcaggaaggc

SEQ ID NO: 442861 - RNA, 64 nt, Human
ccuccagcccccgccaccgggcucccugggcacccagcaagaucuggggcugcagagaacagaa

SEQ ID NO: 442862 - RNA, 64 nt, Human
uuacagauaucaaagcucagcucuuugaaacauccagcaagacaggccagagugugggugagug

SEQ ID NO: 442863 - RNA, 64 nt, Human
gaaacaugggguuggaguggaggaggagcugucucagcaagaggagaccuggggcugugcaucu

SEQ ID NO: 442864 - RNA, 64 nt, Human
ccuuccaacgagcuuccggacuugucugcacccccagcaagaaggcgaguuaguuuucuagaga

SEQ ID NO: 442865 - RNA, 64 nt, Human
ccaagaucacgccacugaacuccagccugggagacagcaagacccugucugaaaaaaaaaaaga

SEQ ID NO: 442866 - RNA, 64 nt, Human
cuaugaucucaccacuacacuccagccugggugacagcaagagaucuugucucagaaauaaaua

SEQ ID NO: 442867 - RNA, 64 nt, Human
augcuuaucuaaccuccccagcagucauggguuucagcaagaaagucugugaugugaccaguug

SEQ ID NO: 442868 - RNA, 64 nt, Human
gaagguggccacauaggucucuggggugagaagacagcaagaaaacugccuaacugaagggaau

SEQ ID NO: 442869 - RNA, 64 nt, Human
ucuccuuuauugcaguucaaauccucaccauccacagcaagaugaauuuuaucagccauguuug

SEQ ID NO: 442870 - RNA, 64 nt, Human
gcucuuaaggagaauuguauuucuccagaagcugcagcaagagguacagcucaacaaaggaaaa

SEQ ID NO: 442871 - RNA, 64 nt, Human
ccucagcucuguacacaugauaugcaacaaagggcagcaagaaaugcuggguccaccuaauuua

SEQ ID NO: 442872 - RNA, 64 nt, Human
aagcuguaauucuaaaccugcacuugucccucuccagcaagaggcuagcacugaauucauucua

SEQ ID NO: 442873 - RNA, 64 nt, Human
gcuucucuagaggagaaaccgaguaaaugugcuccagcaagauagacuuuguguuauucuaucu

SEQ ID NO: 442874 - RNA, 64 nt, Human
ccugagaacucuuacuugagacaucaaaaagaagcagcaagagcuucugggacagagacugcuu

SEQ ID NO: 442875 - RNA, 58 nt, Human
accccuucggccagucuuaaacgggugucagcaagaagaaaaauuaacaaaagacaga

SEQ ID NO: 442876 - RNA, 64 nt, Human
gaauuuccaggaaauauccauccaugaauuaugccagcaagaaugaagcacagaugaaggcagc

SEQ ID NO: 442877 - RNA, 64 nt, Human
gugcugugcccaacccugcgacuagcaaggcucgcagcaagagcacagcccucaacuacuugug

SEQ ID NO: 442878 - RNA, 64 nt, Human
uugaggccagaagugcaagaccagccugcgcaaacagcaagacccugucuacaaaaaaaaaaaa

SEQ ID NO: 442879 - RNA, 64 nt, Human
uuauaaucaaaauuaguuuuauugaugcuugcugcagcaagagagacugcacaccacugggguc

SEQ ID NO: 442880 - RNA, 64 nt, Human
uucaggcuaagaagagauuucucccuguuauaagcagcaagacaaauuagccauuucacucuca

SEQ ID NO: 442881 - RNA, 64 nt, Human
uaguggauguuaagugguaucuaccugugauuuccagcaagauuacuguuaucucugcucuucc

SEQ ID NO: 442882 - RNA, 64 nt, Human
gaccguugcugcugucaugaccuagcuuugauggcagcaagaccaaaaguagaaaucccugcac

SEQ ID NO: 442883 - RNA, 64 nt, Human
aaugugggcguaagaaagcgggaagggucccccacagcaagagagagacccucccagucacuug

SEQ ID NO: 442884 - RNA, 64 nt, Human
gaaucccgaagaauguaacaagaagcaaagccuucagcaagaucauacgacucaucggacacua

SEQ ID NO: 442885 - RNA, 64 nt, Human
acggugcaaauaugacacuucuaacgauuaacaacagcaagaaaacaccugcugcugaugcaau

SEQ ID NO: 442886 - RNA, 64 nt, Human
ucaauguaaggaccuucagagcaucccaggguuacagcaagagccacugagguguggcuggcag

SEQ ID NO: 442887 - RNA, 64 nt, Human
ucuucaaacugugaagcauuuacagaaacgcauccagcaagaauauugucccuuugagcagaaa

SEQ ID NO: 442888 - RNA, 64 nt, Human
ucaguaugcugccccugucuugcugucaugaaaucagcaagagaggaugacacaucaaauaaua

SEQ ID NO: 442889 - RNA, 57 nt, Human
cguggauaagcacucugugaauuuuuacagcaagauucuaacuaacuaugaaugacu

SEQ ID NO: 442890 - RNA, 64 nt, Human
uggccuuguuagacagcacuugggccuuugccagcagcaagaggugaagcgaagccacucuuac

SEQ ID NO: 442891 - RNA, 64 nt, Human
gcucccucugcccuguacccuaggcacguggcuccagcaagagccccaggcaggacaaagggag

SEQ ID NO: 442892 - RNA, 64 nt, Human
cagcagggcagugcacccuggcaccaugcacggccagcaagaaucaaggcccgcagaugcuaag

SEQ ID NO: 442893 - RNA, 64 nt, Human
uuccagcaucccugccucuugucacaaacugccccagcaagaauuugagguucugacaacagua

SEQ ID NO: 442894 - RNA, 64 nt, Human
aagauugcaccacggcacgcuagccugggugacacagcaagacuccaucucaaaaaaaaaaaaa

SEQ ID NO: 442895 - RNA, 64 nt, Human
ccauguuugaagggcacaugugaugaguggggggcagcaagaugccauuucugcaucucccaga

SEQ ID NO: 442896 - RNA, 64 nt, Human
gggagugcuacagcagggaaccaugaaacagaaacagcaagauggaggcagccagacaccaaac

SEQ ID NO: 442897 - RNA, 64 nt, Human
agauguuccccugagcugauucccagugacagugcagcaagacuagugggacuccucuuuccca

SEQ ID NO: 442898 - RNA, 64 nt, Human
guugaguuuugacugcuuggaacuggaauccuuucagcaagacuucucuuugccucaaauaaaa

SEQ ID NO: 442899 - RNA, 64 nt, Human
uccugucucaggccucggauaggaagcugccugccagcaagaggagacugaugugccccgggug

SEQ ID NO: 442900 - RNA, 64 nt, Human
ccaugaucaugccacugcacuccauccugggugacagcaagaucuugucucaaaaaaaaaaaaa

SEQ ID NO: 442901 - RNA, 64 nt, Human
aggucagaacauaacauuucucauuuguuaaaagcagcaagaagccugguaaaacugugacuuu

SEQ ID NO: 442902 - RNA, 64 nt, Human
uuaaacauaagccagaaauuaaaaugacuauagacagcaagaauugagcuaauaauauguuuua

SEQ ID NO: 442903 - RNA, 64 nt, Human
aauugagcuaauaauauguuuuaacucuuaacaccagcaagaagucagucauuuauugaaguuu

SEQ ID NO: 442904 - RNA, 64 nt, Human
guguccuugguguccuuucuccaccaccugugagcagcaagacugccgcacgugggcgcugggu

SEQ ID NO: 442905 - RNA, 64 nt, Human
ggaggcacuuuccagcccugugcaguguugcuaccagcaagaaugaagguugugcagagcagua

SEQ ID NO: 442906 - RNA, 64 nt, Human
cacaaauaaauuuuuuuguaaacucugagcccuucagcaagagaguuuaauuauaaucauuaca

SEQ ID NO: 442907 - RNA, 64 nt, Human
uccuccagcccuggcaggcccucagccagcuucccagcaagacaaagggcacccuuguggcuuu

SEQ ID NO: 442908 - RNA, 64 nt, Human
ugacagcugaucugucggaaccaggacacaaaagcagcaagaagcggggagagagagggauaga

SEQ ID NO: 442909 - RNA, 64 nt, Human
gaagaacauaaacuguuauuucacuucuacaaaucagcaagauauuauuuauggcaagaaauau

SEQ ID NO: 442910 - RNA, 64 nt, Human
cuguguucaaaaauauauucauguaccugugauccagcaagaagggaguuccagucaagaguca

SEQ ID NO: 442911 - RNA, 64 nt, Human
gaaagaugauuugcaaugggauguaugaauacagcagcaagaaaaaaaaaugccauaauacaaa

SEQ ID NO: 442912 - RNA, 64 nt, Human
uguuuauuagaugaauuauccuauuucaguacuucagcaagagagaaccuaacuguaucuugag

SEQ ID NO: 442913 - RNA, 63 nt, Human
uggccgaaauguuauuuuaacgaggaaagaccacagcaagauucuuucauucgucuccuccua

SEQ ID NO: 442914 - RNA, 64 nt, Human
ccuccuaaaauucuagccauuugucacacaaccacagcaagaaacguguucuauaucuagagug

SEQ ID NO: 442915 - RNA, 64 nt, Human
cauccagcgacaagccaugggcaugcauacaaugcagcaagaccaacacaagagcaauauugaa

SEQ ID NO: 442916 - RNA, 64 nt, Human
ugcguguucauccugggcccagaucccccugccccagcaagacucgcagugggauggcugcugg

SEQ ID NO: 442917 - RNA, 64 nt, Human
uuccauuauuaguccuuaauuuauaaauuaggcacagcaagagauuaaacuaucauaggcaugu

SEQ ID NO: 442918 - RNA, 64 nt, Human
cuccuugaaagaggaggacagaccucucuggaagcagcaagaggaaccaguagcugugggaaag

SEQ ID NO: 442919 - RNA, 64 nt, Human
uuacaugaggcaggaauaagaagucagacagagacagcaagacaguuaacaauguagguaaaga

SEQ ID NO: 442920 - RNA, 64 nt, Human
gagaucuugccacugcacaccagccugggcaacacagcaagacucugucucaaaaauaaaugaa

SEQ ID NO: 442921 - RNA, 64 nt, Human
gcaggccgccagcaggaaggcgaaggugguaguacagcaagaggcacuggcggggcagcaggcc

SEQ ID NO: 442922 - RNA, 64 nt, Human
gaaacuguuccuccauuauuugaauuacugaagacagcaagauauuuguaaauuaucuuaaaau

SEQ ID NO: 442923 - RNA, 64 nt, Human
aaaauugcacacacucagugcagcaauauauuaccagcaagaauaaaaaagaaauccauaucuu

SEQ ID NO: 442924 - RNA, 64 nt, Human
aacacugagcaaauaaauauguugagaaugaugacagcaagauuucuccauuagagaagguauu

SEQ ID NO: 442925 - RNA, 64 nt, Human
auugacuuacauagaugauaaaagagaagccaaacagcaagaagcuguuaccacacccagggcu

SEQ ID NO: 442926 - RNA, 64 nt, Human
ugaaauacacaaaugcauuacuaucugaagauaccagcaagaguuuagucuacguguauaaggc

SEQ ID NO: 442927 - RNA, 64 nt, Human
uggugggaggcaaaaagcacuucuuacauggcggcagcaagagaaaaugagaaagaagcaaaag

SEQ ID NO: 442928 - RNA, 64 nt, Human
agggaaagaugcugccagucucuuugcuaaaacacagcaagagucaccuuuacuccaguuccca

SEQ ID NO: 442929 - RNA, 64 nt, Human
uuguggauaggaaagacuuaaccuaaaauuaaaccagcaagaaagcauuaguaaaaaucuaaca

SEQ ID NO: 442930 - RNA, 64 nt, Human
agucugaaggacccuaguuccuagaggcaucuggcagcaagaaggugaggcaucagggaacggg

SEQ ID NO: 442931 - RNA, 64 nt, Human
cugcucuaggaaggcagcaugcucagugggaacacagcaagauucagaauuuaaaguaguugcu

SEQ ID NO: 442932 - RNA, 64 nt, Human
uugaagccagaguuugagaccagccugugcaacacagcaagaccccgucucuacaaaaacuuaa

SEQ ID NO: 442933 - RNA, 64 nt, Human
cacagaaauggccagauagggccuuccuacagagcagcaagaguaggccaagcagaaagacugc

SEQ ID NO: 442934 - RNA, 64 nt, Human
uccccuuccuccccaggaagcuccugcgcuacuacagcaagaaccgcccaaccgaggcugucag

SEQ ID NO: 442935 - RNA, 64 nt, Human
accuggccaaucccaacuacucuggaagcugaagcagcaagaucacuugagcccaggaguuuaa

SEQ ID NO: 442936 - RNA, 64 nt, Human
ccggccgacccggacucccggucaccugaccccucagcaagaacagccugccugguggccuucu

SEQ ID NO: 442937 - RNA, 64 nt, Human
cucugcauaaccacaugacuuggaaugcuuaaaucagcaagaagaauaaugguggggucuuuau

SEQ ID NO: 442938 - RNA, 64 nt, Human
cauugcuuucugaaauuagggcccaauuaauaaucagcaagaauuugaucguuccaguucccac

SEQ ID NO: 442939 - RNA, 64 nt, Human
cucaccaagaaagaauucaauacugugaaauaugcagcaagaagauuggucuuuaccuaggcug

SEQ ID NO: 442940 - RNA, 64 nt, Human
aaacaggacagaguuggaagaggagacugggaggcagcaagaggggucacauaccagcucaggg

SEQ ID NO: 442941 - RNA, 64 nt, Human
gaauauggcucaguagggccugccccuucaagggcagcaagaacgaagcaggauguugucacuc

SEQ ID NO: 442942 - RNA, 64 nt, Human
uucaggcuaauacagaaaaagaugaacaaacguccagcaagauacuuuaauccucuauuuugcu

SEQ ID NO: 442943 - RNA, 64 nt, Human
auuuugaaaggauguauguuagauauauuauuugcagcaagaaguucauucugugcaauaugga

SEQ ID NO: 442944 - RNA, 64 nt, Human
uaucccuccuaaagaagugacucaccugacugaucagcaagaagccuagauugcaggccucacc

SEQ ID NO: 442945 - RNA, 64 nt, Human
ccccagagccaggaaccucucagccgaugccccucagcaagagcaccccaucuucagguagcac

SEQ ID NO: 442946 - RNA, 64 nt, Human
aaacuuugucaugguuuccauuuacuaacagcaacagcaagaaauaaaucagagagcaaggcau

SEQ ID NO: 442947 - RNA, 64 nt, Human
uaggagaauggacuaagcugaagguguacuucaccagcaagagucaacucuagaauucaggaug

SEQ ID NO: 442948 - RNA, 64 nt, Human
acacacaaaauaaagacacacaaggacgucugcgcagcaagaaaagaaucucaguugccaagca

SEQ ID NO: 442949 - RNA, 64 nt, Human
ccuauguccuauuugaguggcagcagcgccagcccagcaagaaggcuggggguugucaagguug

SEQ ID NO: 442950 - RNA, 64 nt, Human
uacaaaauuuuuccaccacacauacccucuaagccagcaagauuuccucuuugcaaaaucauau

SEQ ID NO: 442951 - RNA, 64 nt, Human
gccaaaugugcugcagcucguuuucucccaauuacagcaagacugucagccucacuagccaugu

SEQ ID NO: 442952 - RNA, 64 nt, Human
aggugggucaacuccaaggcaaauguccaagcaucagcaagacaaugacacuggaaggguccgg

SEQ ID NO: 442953 - RNA, 64 nt, Human
uugggggcuaagguuuccagucagaugaggcaaacagcaagaguaagcaguguuacuugcaggu

SEQ ID NO: 442954 - RNA, 64 nt, Human
auccccaguagauggcccugccaagaccagcacccagcaagauuauagaggaagaaauccuaaa

SEQ ID NO: 442955 - RNA, 64 nt, Human
gccugcaguuuggcuucacggcuggcuauguggacagcaagagucguuuucgcggaagccgacu

SEQ ID NO: 442956 - RNA, 64 nt, Human
gaggcccuguaaaaggagugaguuaggacagaugcagcaagauauuaggacagauuucgcccau

SEQ ID NO: 442957 - RNA, 64 nt, Human
uacaugucaggaaccuauggcuggcuuuccuuagcagcaagaacuugagagaaaaacacaucug

SEQ ID NO: 442958 - RNA, 64 nt, Human
ccugaagacacaacuugacuuauaacauagugcacagcaagagcuacauccaaguguccuauua

SEQ ID NO: 442959 - RNA, 64 nt, Human
ccuccaaggaguaagaccccuggaccaccagccccagcaagagcacaagaggaagagagagacc

SEQ ID NO: 442960 - RNA, 64 nt, Human
cugacacccacuggggugcacuuuaauguuccggcagcaagacuggggaacuucaggcucccag

SEQ ID NO: 442961 - RNA, 61 nt, Human
cugcccaagcagucuacugaauccagccuuccagcaagagauuguuuuucaaggacaagga

SEQ ID NO: 442962 - RNA, 64 nt, Human
ggcacgugcccuucaccccauuccacccuuguuccagcaagacugggauggguacaacugaacu

SEQ ID NO: 442963 - RNA, 64 nt, Human
uaaaucccuguguucuccucuguggaaaugaaggcagcaagaagcaccugaggccuugguucau

SEQ ID NO: 442964 - RNA, 64 nt, Human
cccuacaaauggguccuuugcuauccaggugagacagcaagaguguucuuaaucagauggaacc

SEQ ID NO: 442965 - RNA, 64 nt, Human
ccaccugcuucaaccugcucaagcugcccaacuacagcaagaagagcguccuccgcgagaagcu

SEQ ID NO: 442966 - RNA, 64 nt, Human
gcaagcuuccucccucagccauugauggaaaguucagcaagaucagcaacaaaaccaagaaaaa

SEQ ID NO: 442967 - RNA, 64 nt, Human
acuuguaaagaaaaagauuccaguucaguauuugcagcaagaagcuugaaugcuguucuuuuua

SEQ ID NO: 442968 - RNA, 64 nt, Human
uuaagaacaacaucugguaucccaaauuuaauuucagcaagaggaauauccuucccaacaucac

SEQ ID NO: 442969 - RNA, 64 nt, Human
cacagugugugcccagaugugccaccccugugggcagcaagaagcugggaucgcugcagccaug

SEQ ID NO: 442970 - RNA, 64 nt, Human
uuuaugugucugguagaaaccauauuuugguuaacagcaagaaaaaugcuuauaauguaguaca

SEQ ID NO: 442971 - RNA, 50 nt, Human
aaaacacaucggaaucaugacagcaagauaaccccaagacagucuuuuau

SEQ ID NO: 442972 - RNA, 64 nt, Human
ugugcacuauuuguuuaauugcaguggauuaauacagcaagagugccacauuauaacuaggcaa

SEQ ID NO: 442973 - RNA, 64 nt, Human
gaaguauguuaagcuaagcacagagaaaaaaaggcagcaagacauguuuuauaagauuuuagca

SEQ ID NO: 442974 - RNA, 64 nt, Human
guggccagggcccuggguaucauguccacaugcccagcaagagccuugccuccccugccucccc

SEQ ID NO: 442975 - RNA, 64 nt, Human
aacaaauaaaaauucccagaccacagaauuuccacagcaagaauacacuuauuuuaauuaacaa

SEQ ID NO: 442976 - RNA, 64 nt, Human
gagaucgcgccacugcacuccagccugggugacacagcaagacucuugucucaaacaaacagga

SEQ ID NO: 442977 - RNA, 64 nt, Human
agccaccgucuccagagcccugggcagcauuuuccagcaagauguacacaaucuuuugccuuua

SEQ ID NO: 442978 - RNA, 64 nt, Human
cugaggugggagggggagggugggguaggucccccagcaagaaagagggacaggagcaccccag

SEQ ID NO: 442979 - RNA, 64 nt, Human
aagugcuuggauuacaggcaugagccaccgcacccagcaagaguuauuuucuuaacuugaaauu

SEQ ID NO: 442980 - RNA, 64 nt, Human
uuauacuaaagugagaugcauuuuuucucauuuucagcaagacuccucuaagcauuuacucauu

SEQ ID NO: 442981 - RNA, 64 nt, Human
aucauucugcuuccguauuuuaauuuacugauuccagcaagaccaaaucauuguaucaaauuau

SEQ ID NO: 442982 - RNA, 64 nt, Human
uacccagacuuacagaauuauguccuccagaaaccagcaagaacacuuggaaugaacgaaugaa

SEQ ID NO: 442983 - RNA, 64 nt, Human
gcaggacugccauuaucugggguguggccucugccagcaagagaaguguccuggguguuuuuaa

SEQ ID NO: 442984 - RNA, 64 nt, Human
caaaaacugccaauaggaggacugcccgacacugcagcaagauugaggauaagauggaaggcag

SEQ ID NO: 442985 - RNA, 64 nt, Human
acugcuuucacguaaaauguccaaaucacaucuucagcaagaaagcaaccucacggauugcccc

SEQ ID NO: 442986 - RNA, 64 nt, Human
agaaaauuaaauucagcuucaggccuuuaaacugcagcaagauggugguguaggggugugggac

SEQ ID NO: 442987 - RNA, 64 nt, Human
gagcuucccucccguguguucuccgucccugccccagcaagacaacuuagaucuccaggagaac

SEQ ID NO: 442988 - RNA, 64 nt, Human
gcagcaggacacaccaugugccaggaaaugaccucagcaagaaaccucaggccgugugaagagc

SEQ ID NO: 442989 - RNA, 64 nt, Human
caugcaaaaagccaccaaaugaagggauucuauccagcaagauccuguccaagaguagccugug

SEQ ID NO: 442990 - RNA, 64 nt, Human
acacaaaugaagaagaacaaagagccugagaaagcagcaagaggacaugaugaaaaauacgugg

SEQ ID NO: 442991 - RNA, 64 nt, Human
caggugccccucuuccaaaggcagcgugccgagccagcaagaggaaggggugcugugaggcuug

SEQ ID NO: 442992 - RNA, 64 nt, Human
auucaagguauuauugauaaaccuuuucaaccagcagcaagaaguucaaauuuuuuucugucac

SEQ ID NO: 442993 - RNA, 64 nt, Human
ugcuuguaggacuguucaccaagggggauaccagcagcaagagagugcacccguuuagcccugg

SEQ ID NO: 442994 - RNA, 64 nt, Human
uuugaccuuugcauuucauauauguuagaugucucagcaagaauaucuggucuccccuaauuuu

SEQ ID NO: 442995 - RNA, 64 nt, Human
cuuuguccugauuguagcaaaucccaucucaguccagcaagacucagucaucucccuuugggau

SEQ ID NO: 442996 - RNA, 64 nt, Human
gucucuaggcuggggaaguccucuggguaggaaucagcaagaagauccuaaaacaaaagcucau

SEQ ID NO: 442997 - RNA, 64 nt, Human
ugggggcucuggaaacgcccugugucucuggcuacagcaagaccagcccaggagcccaccagca

SEQ ID NO: 442998 - RNA, 64 nt, Human
ccuuggcccaggccaagauugagaagaucaagggcagcaagaaggccaucaagguaguccccau

SEQ ID NO: 442999 - RNA, 64 nt, Human
cagaggagaagcuguuugaugcccccuuguccaucagcaagagagagcagcuggaacagcaggu

SEQ ID NO: 443000 - RNA, 64 nt, Human
cgcuuuugucaacuauccucugggcaaagguauucagcaagagguggaauggcuagacacugaa

SEQ ID NO: 443001 - RNA, 64 nt, Human
gacucccaacccuggcuuggggucaagaaacagccagcaagaguuaggggccuuagggcacugg

SEQ ID NO: 443002 - RNA, 64 nt, Human
cccuggccuuugccaucccgggaggcccccuagccagcaagagugggauugccuuuccugugga

SEQ ID NO: 443003 - RNA, 64 nt, Human
acagccaucacuucaacauugugauaauccuucacagcaagaaaccgaauaaaauacuaacauu

SEQ ID NO: 443004 - RNA, 64 nt, Human
acagcagcgaccucggccccuauccagagaggugcagcaagagagccauuucccugugacauuu

SEQ ID NO: 443005 - RNA, 64 nt, Human
accccaucccccacgcaggaccaacuaccuccgucagcaagaacccaagcccacauccaaaccu

SEQ ID NO: 443006 - RNA, 64 nt, Human
cugggcucaugccugguggugucacaucccaaggcagcaagagcauggauaccgaucacagggc

SEQ ID NO: 443007 - RNA, 64 nt, Human
uucuuaaaggcauuuugguuuuuuaaaaucuguacagcaagagcaacuuuuucugucaaauaaa

SEQ ID NO: 443008 - RNA, 64 nt, Human
ggcuguggggauagaguccugaggaauguggucacagcaagaaggcggggagcagcagagccuu

SEQ ID NO: 443009 - RNA, 64 nt, Human
aacuuuggugcacgugcccucuagccgaagucuucagcaagaggauucgcugcugguguuaauu

SEQ ID NO: 443010 - RNA, 64 nt, Human
cccaccccuccuccagggcaaccccuugguccuacagcaagaagccagaacuguuggaaugaau

SEQ ID NO: 443011 - RNA, 64 nt, Human
aguguccauccaguuuacgcugagucaguccauacagcaagacaccuggcacuuggcagguacu

SEQ ID NO: 443012 - RNA, 64 nt, Human
cuguauuuauucccccaucuucaucccaacagcccagcaagaaggaggagacagagagcuccuc

SEQ ID NO: 443013 - RNA, 64 nt, Human
uucagaauccuagcuccgggcuccacucguguggcagcaagacugcuucguuccagcguuuaga

SEQ ID NO: 443014 - RNA, 64 nt, Human
ugaguuugggagaguggugaguggaagggaggagcagcaagaagcagccuguuuucacucagcu

SEQ ID NO: 443015 - RNA, 64 nt, Human
acugggcuaugagucaccagcccacuuugugacccagcaagaccuuuccccucucugggcauca

SEQ ID NO: 443016 - RNA, 64 nt, Human
ccuuuccucucaagcccccaaagagcaaaggcaacagcaagaccagcggguucuugcaacacug

SEQ ID NO: 443017 - RNA, 64 nt, Human
acugaagaagcagauugccaagugccagcagcugcagcaagaauacagccgcaaggaggaggag

SEQ ID NO: 443018 - RNA, 64 nt, Human
ggacugaaucgccacuacagccugggugcaaaaucagcaagaaacauugaguauuuuuuuuucu

SEQ ID NO: 443019 - RNA, 64 nt, Human
cauuuaucacacaugggcacugggguugggcuaacagcaagagacaauaggccuuuguuccuau

SEQ ID NO: 443020 - RNA, 64 nt, Human
acaagguguucauuuugucacaagcuguagauaacagcaagagauggggguguauuggaauugc

SEQ ID NO: 443021 - RNA, 64 nt, Human
caagaucgcaccauugcacuccagcugggagacacagcaagacuccgucucaaaagaaaaaaaa

SEQ ID NO: 443022 - RNA, 64 nt, Human
cuuaaaguucagcguguuaaccuaacauaaaacacagcaagaaucugguugucugaacuauuuu

SEQ ID NO: 443023 - RNA, 64 nt, Human
aauauauaugggcuuaaucauuuaaaauuuguugcagcaagaacuuuccuaccuguaggcaaua

SEQ ID NO: 443024 - RNA, 64 nt, Human
ugccuugaaaucaagagacaauaacuuugaaccucagcaagaccuugaaccgccgguucauuuu

SEQ ID NO: 443025 - RNA, 64 nt, Human
uucuuccaggcgagaaaccuguggucuagaaccacagcaagaagaggaggcaugcuggccugca

SEQ ID NO: 443026 - RNA, 64 nt, Human
caaggugucggcgggacggugaggaagggggaggcagcaagagucacuuugggggaccaauauu

SEQ ID NO: 443027 - RNA, 64 nt, Human
agagggaggcacaguccacccagauccaccuuuccagcaagacccccaguggcugcccagccug

SEQ ID NO: 443028 - RNA, 64 nt, Human
gagguuaacauucaagcguuucuacuuugaaauucagcaagaguuucugggccuuauguuugag

SEQ ID NO: 443029 - RNA, 64 nt, Human
gugccgauggccccacccucaccagccugggcagcagcaagaacuauuuauuaaaaacuuaaga

SEQ ID NO: 443030 - RNA, 64 nt, Human
uacccuuucuuucccuccugcggaacagcggacccagcaagagcauccacauccucacuuuguu

SEQ ID NO: 443031 - RNA, 64 nt, Human
aguuucacacagaagaauuucaugugaauggggccagcaagagcugcccuguguccaugguggg

SEQ ID NO: 443032 - RNA, 64 nt, Human
gacggugucuccuugcaucccagccucgucuaugcagcaagagaccagggacuucaccaaaguc

SEQ ID NO: 443033 - RNA, 64 nt, Human
caagaucacgccacuacauuccagcugggcaacacagcaagacucugucucaaaaaaaaaaaaa

SEQ ID NO: 443034 - RNA, 64 nt, Human
acuuacuaucuucauagaguuauggaguggcugccagcaagagacaguguucagauguggauga

SEQ ID NO: 443035 - RNA, 64 nt, Human
aaaaguugcuuuucaaagaggaagaagaaaauagcagcaagaaauaucucuuucuguguucaag

SEQ ID NO: 443036 - RNA, 64 nt, Human
gacacuggcucagcaguuccccaggccacaguaucagcaagauaaaagugaguguguuuugucg

SEQ ID NO: 443037 - RNA, 64 nt, Human
gagugugcgcauuucagagcaugggauugaucggcagcaagaguaaagacacagcuccagaggc

SEQ ID NO: 443038 - RNA, 64 nt, Human
cauccucacucagcugcugccuacugggcauccucagcaagaugcuggagacuuuuuacccucc

SEQ ID NO: 443039 - RNA, 64 nt, Human
acugagcaacuuuaggaaaugucgguggaguguucagcaagaucagacagcaguccaggucaaa

SEQ ID NO: 443040 - RNA, 64 nt, Human
agaacaagccuaaaggauucccacagcugggagccagcaagagagcuuggagucgccucucuag

SEQ ID NO: 443041 - RNA, 64 nt, Human
ugcuuggagguggacuggggagacagccuuggugcagcaagaacauucaacucaggaagcauuu

SEQ ID NO: 443042 - RNA, 64 nt, Human
ccugagggugcccgggcaagucuugccagcaaggcagcaagacuuccugcuauccaagcccaug

SEQ ID NO: 443043 - RNA, 64 nt, Human
ugaggccaggagcucgaaaccaguccgggccacacagcaagaccccaucucuaaaaaauuaaua

SEQ ID NO: 443044 - RNA, 64 nt, Human
ggguaaggugcuggggcugccagaggaccugccccagcaagauuuuugucaagagcgagacucc

SEQ ID NO: 443045 - RNA, 64 nt, Human
guagccgaccugcaggagggccuacaaacgggcccagcaagagcugggcaacagcuggcuugug

SEQ ID NO: 443046 - RNA, 64 nt, Human
acugcacuccagccuggccaauaagaccugucuccagcaagacccugucucaaaaaaaaaaaaa

SEQ ID NO: 443047 - RNA, 64 nt, Human
uuauuaauaaaagcuuauuagaguguagaaaugccagcaagaguuaagaaagggcuuuucagga

SEQ ID NO: 443048 - RNA, 64 nt, Human
agagccagcuagcucuuucaaccacaugagguuacagcaagaagucagcagucuacagugcaaa

SEQ ID NO: 443049 - RNA, 64 nt, Human
gggggugggugguagcgcugggggugauuuuaggcagcaagaauuggagaacucacacugcgaa

SEQ ID NO: 443050 - RNA, 64 nt, Human
ggcccggacaucuggucccucagaguggcagcugcagcaagaggcagcugaagcccucgugggg

SEQ ID NO: 443051 - RNA, 64 nt, Human
cuuaaggccaggaguucgagaccagccugggcaacagcaagaccucaucucuacaaaacuuaaa

SEQ ID NO: 443052 - RNA, 64 nt, Human
aguguggcugcuguguugggcauggauggagaaucagcaagagaaaugcuguauuaggacuaau

SEQ ID NO: 443053 - RNA, 64 nt, Human
aagauggugccgcugcacuccagucugggugacacagcaagacuccaucucaaaaaaaaaaaaa

SEQ ID NO: 443054 - RNA, 64 nt, Human
cuggcugagccccugcaggagccccggccacacacagcaagaaagauacaucugaccagccuca

SEQ ID NO: 443055 - RNA, 64 nt, Human
agguggguaguuguagauaccugugugugguugucagcaagacuggauaugugugaggugucug

SEQ ID NO: 443056 - RNA, 64 nt, Human
gggggccccccaguuacucagucuuuccuggagacagcaagaagcugcaaugugcaaucccccu

SEQ ID NO: 443057 - RNA, 64 nt, Human
ugguggccccgcugugaucuggggucacccucuccagcaagagaaccccgugggguuauguauc

SEQ ID NO: 443058 - RNA, 64 nt, Human
ugagcucagccuccaaggcuuuaaagccacauuucagcaagagaaagcgcugagagcucgcagg

SEQ ID NO: 443059 - RNA, 64 nt, Human
ugagccuagacguuaaagaccagccugggcaacacagcaagacccaucucuacaagaaauuuaa

SEQ ID NO: 443060 - RNA, 64 nt, Human
cugagccucccccaccaggacugggccuccccggcagcaagaccccggcacuccccgccaggcc

SEQ ID NO: 443061 - RNA, 64 nt, Human
gagccaagaucgcgccacugcacuccagccugggcagcaagagcaaaacaaccucugucacaca

SEQ ID NO: 443062 - RNA, 64 nt, Human
aaucaaaaucugagucugagacauacacacuuuccagcaagauggguccugacucaaaacccag

SEQ ID NO: 443063 - RNA, 64 nt, Human
augacugcaucacugcacuccagccugggcaacacagcaagauccugucuaaaaauaaaaagaa

SEQ ID NO: 443064 - RNA, 64 nt, Human
uaccuaugauaaaauuuaguuuacagauuagacacagcaagagauuuaaaacaauaauaaacau

SEQ ID NO: 443065 - RNA, 64 nt, Human
uucucacucauguccccaacucaaggcuagaaaacagcaagauggagaaauaauguucugcugc

SEQ ID NO: 443066 - RNA, 64 nt, Human
ucaaugcacacagaauacaaccucaugcucccugcagcaagaccccugaaagugauucaugcuu

SEQ ID NO: 443067 - RNA, 62 nt, Human
cuguucuccguugucacugacccccgccucuucagcaagaccacagccaugacaaacaccag

SEQ ID NO: 443068 - RNA, 64 nt, Human
cuguuggaacccgugcauguagcugccgggucaucagcaagaaaugaauuggaggcaggaagag

SEQ ID NO: 443069 - RNA, 64 nt, Human
aaacacuugcacagcaaagcaagagaagucacagcagcaagacacgcacagucaaccauuuucc

SEQ ID NO: 443070 - RNA, 64 nt, Human
ccagagcucggaaucuacagcguccagccauuuccagcaagagcgcuucccauuccggagacgu

SEQ ID NO: 443071 - RNA, 64 nt, Human
gcugcccagcaccgcgcuggcuggcacugaaggacagcaagaggcacucugucuucacuugaau

SEQ ID NO: 443072 - RNA, 64 nt, Human
cagcggggaggaggagcaaggacauguaccaugccagcaagagugccaagcgggcccugagccu

SEQ ID NO: 443073 - RNA, 64 nt, Human
agaggccagcagguccacaccagccugggcaacacagcaagacaccgcaucuacagaaaaauuu

SEQ ID NO: 443074 - RNA, 64 nt, Human
cacugguagucaucugguguuuguacuauaacaacagcaagaaaaucucauuuaucuuuauaua

SEQ ID NO: 443075 - RNA, 64 nt, Human
ugaggccagguguuugaggccagccagggcaacacagcaagaccccaucucuacaaaauauuaa

SEQ ID NO: 443076 - RNA, 64 nt, Human
ggucccaucugaagcuggaguacccuggggucagcagcaagagaaagaagaggagauuuucugu

SEQ ID NO: 443077 - RNA, 64 nt, Human
auaauuucccccuuggugguuuuucagacaccugcagcaagaagaaauacugacugacuaggca

SEQ ID NO: 443078 - RNA, 64 nt, Human
ccagcccagugcgggcacagcacaacacggggagcagcaagagaugagccaggguccaggagac

SEQ ID NO: 443079 - RNA, 64 nt, Human
ugaagcuuugaaauuagacuaacaaagcuccagacagcaagagcccaggugcacugcucacacc

SEQ ID NO: 443080 - RNA, 64 nt, Human
augagauuuuuuuuuggaggggggagggucuacacagcaagagaacagaaauacugugucucau

SEQ ID NO: 443081 - RNA, 64 nt, Human
uguuuuggauguacauaauauauuuauaacaaagcagcaagagucuacuuaaccuuggcugccu

SEQ ID NO: 443082 - RNA, 64 nt, Human
gaaaccagcccugcgggcuaagcaggugcgaccccagcaagaggggugcucugggaccagacau

SEQ ID NO: 443083 - RNA, 64 nt, Human
uaaacagaagcucuaacgucagguaacaaauagacagcaagaaagguuuugcaccauccucuua

SEQ ID NO: 443084 - RNA, 64 nt, Human
uaauagcaugcugcuccuuuuugcucaguguccacagcaagaugacgugauucuuauuuucuug

SEQ ID NO: 443085 - RNA, 64 nt, Human
aaacauugaagucguuacacaccagaucacugugcagcaagagcaacugcaguuguuagaggaa

SEQ ID NO: 443086 - RNA, 64 nt, Human
uuugguuuuuaaucagauuugguuucaucagaagcagcaagaauggaccugaugucuuuaaaag

SEQ ID NO: 443087 - RNA, 64 nt, Human
uuucaccucaaagcccuugaagagugggcaaagacagcaagagagcugcagccugggcccgagc

SEQ ID NO: 443088 - RNA, 64 nt, Human
agaagggagccccaggcuggagcagcaugaggcccagcaagaagggcuuggguucugaggaagc

SEQ ID NO: 443089 - RNA, 64 nt, Human
gacgggggagcuguggaugguggcaggagugucccagcaagaaaggcggcauccgucugugccc

SEQ ID NO: 443090 - RNA, 64 nt, Human
cagcgauggugagcauuuugguuuccuuaaggcccagcaagacuuccagggacaucucugguga

SEQ ID NO: 443091 - RNA, 64 nt, Human
caagagccagggagggcagcccaggcccaagugacagcaagaacaagaaccacugccggcgugc

SEQ ID NO: 443092 - RNA, 64 nt, Human
ccugaggggcugcuggacugaccgaggggcugcccagcaagacugcagccucuuccucccucag

SEQ ID NO: 443093 - RNA, 64 nt, Human
uaguacaauuucuccaaaguacuguaccuaucuucagcaagaaugcaaaagaaaauauuuucaa

SEQ ID NO: 443094 - RNA, 64 nt, Human
gugcggcccggaguuguccaucuguccaucccaacagcaagacgaggauguggcuguugagaug

SEQ ID NO: 443095 - RNA, 64 nt, Human
cuccacugcugccuaaugcaaggcaguggcucagcagcaagaaugcugguucuacaucccgagg

SEQ ID NO: 443096 - RNA, 64 nt, Human
agggugcagugagcuccccugggaaaaccgaagccagcaagaccaggagagggccaccucacug

SEQ ID NO: 443097 - RNA, 64 nt, Human
gcuucaucagucuuugaggaaggcuauucgguaccagcaagagacacaaguuucucuuacagau

SEQ ID NO: 443098 - RNA, 64 nt, Human
ggaggagaaagacaacacuuggucuaagacacggcagcaagacaucccugcauauuguuccaga

SEQ ID NO: 443099 - RNA, 64 nt, Human
uccuuacagguugacauaacuuugaauguuuuaacagcaagaauuuuaagaaaagauaaacacc

SEQ ID NO: 443100 - RNA, 64 nt, Human
gcaauuacuuaaauuuauuuuuuugaaacagcugcagcaagaguuggcacuuauucagauguau

SEQ ID NO: 443101 - RNA, 64 nt, Human
aucuuaguuuccuggaauaauaaaguuugauguucagcaagagaacugcuugaguuuaagccau

SEQ ID NO: 443102 - RNA, 63 nt, Human
cuaugaucaugccacugcacuccagucugggugacagcaagacccugucucaagcaauuuuuu

SEQ ID NO: 443103 - RNA, 64 nt, Human
gagucuggacuggcugagauaagagccuggcaaccagcaagagcugggcuguauuuggagauca

SEQ ID NO: 443104 - RNA, 64 nt, Human
cugaagcaugaagauuccugggguggggggaaagcagcaagaaaagguagagaggaaccagauu

SEQ ID NO: 443105 - RNA, 64 nt, Human
ccagguucuagcucuggcaaaggagugcugucuacagcaagauuuuugcuuuuagaauuuuauu

SEQ ID NO: 443106 - RNA, 64 nt, Human
ggaacaccauucuucagagcacacgucuagcccucagcaagacaguuguuucuccuccuccuug

SEQ ID NO: 443107 - RNA, 64 nt, Human
uuucccagaaaaaccaguacccuugagccuuaaucagcaagaaaauaacucuggcucauacagu

SEQ ID NO: 443108 - RNA, 64 nt, Human
acacuggcauuaucccuuuaggaagaggggggggcagcaagagagccuauuugggacagcauuc

SEQ ID NO: 443109 - RNA, 64 nt, Human; identical to SEQ ID NO: 240359

SEQ ID NO: 443110 - RNA, 64 nt, Human; identical to SEQ ID NO: 240360

SEQ ID NO: 443111 - RNA, 64 nt, Human; identical to SEQ ID NO: 240361

SEQ ID NO: 443112 - RNA, 64 nt, Human; identical to SEQ ID NO: 240362

SEQ ID NO: 443113 - RNA, 64 nt, Human; identical to SEQ ID NO: 240363

SEQ ID NO: 443114 - RNA, 64 nt, Human; identical to SEQ ID NO: 240364

SEQ ID NO: 443115 - RNA, 64 nt, Human; identical to SEQ ID NO: 240365

SEQ ID NO: 443116 - RNA, 64 nt, Human; identical to SEQ ID NO: 240366

SEQ ID NO: 443117 - RNA, 64 nt, Human; identical to SEQ ID NO: 240370

SEQ ID NO: 443118 - RNA, 64 nt, Human; identical to SEQ ID NO: 240371

SEQ ID NO: 443119 - RNA, 64 nt, Human; identical to SEQ ID NO: 240372

SEQ ID NO: 443120 - RNA, 51 nt, Human; identical to SEQ ID NO: 240373

SEQ ID NO: 443121 - RNA, 64 nt, Human; identical to SEQ ID NO: 240374

SEQ ID NO: 443122 - RNA, 64 nt, Human; identical to SEQ ID NO: 240375

SEQ ID NO: 443123 - RNA, 64 nt, Human; identical to SEQ ID NO: 240376

SEQ ID NO: 443124 - RNA, 64 nt, Human; identical to SEQ ID NO: 240377

SEQ ID NO: 443125 - RNA, 64 nt, Human; identical to SEQ ID NO: 240378

SEQ ID NO: 443126 - RNA, 64 nt, Human; identical to SEQ ID NO: 240379

SEQ ID NO: 443127 - RNA, 64 nt, Human; identical to SEQ ID NO: 240380

SEQ ID NO: 443128 - RNA, 64 nt, Human; identical to SEQ ID NO: 240381

SEQ ID NO: 443129 - RNA, 64 nt, Human; identical to SEQ ID NO: 240382

SEQ ID NO: 443130 - RNA, 64 nt, Human; identical to SEQ ID NO: 240383

SEQ ID NO: 443131 - RNA, 64 nt, Human; identical to SEQ ID NO: 240384

SEQ ID NO: 443132 - RNA, 64 nt, Human; identical to SEQ ID NO: 240388

SEQ ID NO: 443133 - RNA, 64 nt, Human; identical to SEQ ID NO: 240389

SEQ ID NO: 443134 - RNA, 64 nt, Human; identical to SEQ ID NO: 240390

SEQ ID NO: 443135 - RNA, 64 nt, Human; identical to SEQ ID NO: 240391

SEQ ID NO: 443136 - RNA, 64 nt, Human; identical to SEQ ID NO: 240392

SEQ ID NO: 443137 - RNA, 64 nt, Human; identical to SEQ ID NO: 240393

SEQ ID NO: 443138 - RNA, 64 nt, Human; identical to SEQ ID NO: 240394

SEQ ID NO: 443139 - RNA, 64 nt, Human; identical to SEQ ID NO: 240395

SEQ ID NO: 443140 - RNA, 64 nt, Human; identical to SEQ ID NO: 240396

SEQ ID NO: 443141 - RNA, 64 nt, Human; identical to SEQ ID NO: 240397

SEQ ID NO: 443142 - RNA, 64 nt, Human; identical to SEQ ID NO: 240398

SEQ ID NO: 443143 - RNA, 64 nt, Human; identical to SEQ ID NO: 240399

SEQ ID NO: 443144 - RNA, 64 nt, Human; identical to SEQ ID NO: 240400

SEQ ID NO: 443145 - RNA, 64 nt, Human; identical to SEQ ID NO: 240401

SEQ ID NO: 443146 - RNA, 64 nt, Human; identical to SEQ ID NO: 240402

SEQ ID NO: 443147 - RNA, 64 nt, Human; identical to SEQ ID NO: 240406

SEQ ID NO: 443148 - RNA, 64 nt, Human; identical to SEQ ID NO: 240407

SEQ ID NO: 443149 - RNA, 64 nt, Human; identical to SEQ ID NO: 240408

SEQ ID NO: 443150 - RNA, 64 nt, Human; identical to SEQ ID NO: 240409

SEQ ID NO: 443151 - RNA, 64 nt, Human; identical to SEQ ID NO: 240410

SEQ ID NO: 443152 - RNA, 64 nt, Human; identical to SEQ ID NO: 240411

SEQ ID NO: 443153 - RNA, 64 nt, Human; identical to SEQ ID NO: 240412

SEQ ID NO: 443154 - RNA, 64 nt, Human; identical to SEQ ID NO: 240413

SEQ ID NO: 443155 - RNA, 64 nt, Human; identical to SEQ ID NO: 240414

SEQ ID NO: 443156 - RNA, 64 nt, Human; identical to SEQ ID NO: 240415

SEQ ID NO: 443157 - RNA, 64 nt, Human; identical to SEQ ID NO: 240416

SEQ ID NO: 443158 - RNA, 64 nt, Human; identical to SEQ ID NO: 240417

SEQ ID NO: 443159 - RNA, 64 nt, Human; identical to SEQ ID NO: 240418

SEQ ID NO: 443160 - RNA, 64 nt, Human; identical to SEQ ID NO: 240419

SEQ ID NO: 443161 - RNA, 64 nt, Human; identical to SEQ ID NO: 240420

SEQ ID NO: 443162 - RNA, 58 nt, Human; identical to SEQ ID NO: 240424

SEQ ID NO: 443163 - RNA, 64 nt, Human; identical to SEQ ID NO: 240425

SEQ ID NO: 443164 - RNA, 64 nt, Human; identical to SEQ ID NO: 240426

SEQ ID NO: 443165 - RNA, 64 nt, Human; identical to SEQ ID NO: 240427

SEQ ID NO: 443166 - RNA, 64 nt, Human; identical to SEQ ID NO: 240428

SEQ ID NO: 443167 - RNA, 64 nt, Human; identical to SEQ ID NO: 240429

SEQ ID NO: 443168 - RNA, 64 nt, Human; identical to SEQ ID NO: 240430

SEQ ID NO: 443169 - RNA, 64 nt, Human; identical to SEQ ID NO: 240431

SEQ ID NO: 443170 - RNA, 64 nt, Human; identical to SEQ ID NO: 240432

SEQ ID NO: 443171 - RNA, 64 nt, Human; identical to SEQ ID NO: 240433

SEQ ID NO: 443172 - RNA, 64 nt, Human; identical to SEQ ID NO: 240434

SEQ ID NO: 443173 - RNA, 55 nt, Human; identical to SEQ ID NO: 240435

SEQ ID NO: 443174 - RNA, 64 nt, Human; identical to SEQ ID NO: 240436

SEQ ID NO: 443175 - RNA, 64 nt, Human; identical to SEQ ID NO: 240437

SEQ ID NO: 443176 - RNA, 64 nt, Human; identical to SEQ ID NO: 240438

SEQ ID NO: 443177 - RNA, 64 nt, Human; identical to SEQ ID NO: 240442

SEQ ID NO: 443178 - RNA, 64 nt, Human; identical to SEQ ID NO: 240443

SEQ ID NO: 443179 - RNA, 64 nt, Human; identical to SEQ ID NO: 240444

SEQ ID NO: 443180 - RNA, 64 nt, Human; identical to SEQ ID NO: 240445

SEQ ID NO: 443181 - RNA, 64 nt, Human; identical to SEQ ID NO: 240446

SEQ ID NO: 443182 - RNA, 64 nt, Human; identical to SEQ ID NO: 240447

SEQ ID NO: 443183 - RNA, 64 nt, Human; identical to SEQ ID NO: 240448

SEQ ID NO: 443184 - RNA, 64 nt, Human; identical to SEQ ID NO: 240449

SEQ ID NO: 443185 - RNA, 61 nt, Human; identical to SEQ ID NO: 240450

SEQ ID NO: 443186 - RNA, 64 nt, Human; identical to SEQ ID NO: 240451

SEQ ID NO: 443187 - RNA, 64 nt, Human; identical to SEQ ID NO: 240452

SEQ ID NO: 443188 - RNA, 64 nt, Human; identical to SEQ ID NO: 240453

SEQ ID NO: 443189 - RNA, 64 nt, Human; identical to SEQ ID NO: 240454

SEQ ID NO: 443190 - RNA, 64 nt, Human; identical to SEQ ID NO: 240455

SEQ ID NO: 443191 - RNA, 64 nt, Human; identical to SEQ ID NO: 240456

SEQ ID NO: 443192 - RNA, 64 nt, Human; identical to SEQ ID NO: 240460

SEQ ID NO: 443193 - RNA, 64 nt, Human; identical to SEQ ID NO: 240461

SEQ ID NO: 443194 - RNA, 64 nt, Human; identical to SEQ ID NO: 240462

SEQ ID NO: 443195 - RNA, 64 nt, Human; identical to SEQ ID NO: 240463

SEQ ID NO: 443196 - RNA, 64 nt, Human; identical to SEQ ID NO: 240464

SEQ ID NO: 443197 - RNA, 64 nt, Human; identical to SEQ ID NO: 240465

SEQ ID NO: 443198 - RNA, 64 nt, Human; identical to SEQ ID NO: 240466

SEQ ID NO: 443199 - RNA, 64 nt, Human; identical to SEQ ID NO: 240467

SEQ ID NO: 443200 - RNA, 64 nt, Human; identical to SEQ ID NO: 240468

SEQ ID NO: 443201 - RNA, 64 nt, Human; identical to SEQ ID NO: 240469

SEQ ID NO: 443202 - RNA, 64 nt, Human; identical to SEQ ID NO: 240470

SEQ ID NO: 443203 - RNA, 64 nt, Human; identical to SEQ ID NO: 240471

SEQ ID NO: 443204 - RNA, 64 nt, Human; identical to SEQ ID NO: 240472

SEQ ID NO: 443205 - RNA, 64 nt, Human; identical to SEQ ID NO: 240473

SEQ ID NO: 443206 - RNA, 64 nt, Human; identical to SEQ ID NO: 240474

SEQ ID NO: 443207 - RNA, 64 nt, Human; identical to SEQ ID NO: 240478

SEQ ID NO: 443208 - RNA, 64 nt, Human; identical to SEQ ID NO: 240479

SEQ ID NO: 443209 - RNA, 64 nt, Human; identical to SEQ ID NO: 240480

SEQ ID NO: 443210 - RNA, 64 nt, Human; identical to SEQ ID NO: 240481

SEQ ID NO: 443211 - RNA, 64 nt, Human; identical to SEQ ID NO: 240482

SEQ ID NO: 443212 - RNA, 64 nt, Human; identical to SEQ ID NO: 240483

SEQ ID NO: 443213 - RNA, 64 nt, Human; identical to SEQ ID NO: 240484

SEQ ID NO: 443214 - RNA, 64 nt, Human; identical to SEQ ID NO: 240485

SEQ ID NO: 443215 - RNA, 64 nt, Human; identical to SEQ ID NO: 240486

SEQ ID NO: 443216 - RNA, 64 nt, Human; identical to SEQ ID NO: 240487

SEQ ID NO: 443217 - RNA, 64 nt, Human; identical to SEQ ID NO: 240488

SEQ ID NO: 443218 - RNA, 64 nt, Human; identical to SEQ ID NO: 240489

SEQ ID NO: 443219 - RNA, 64 nt, Human; identical to SEQ ID NO: 240490

SEQ ID NO: 443220 - RNA, 64 nt, Human; identical to SEQ ID NO: 240491

SEQ ID NO: 443221 - RNA, 64 nt, Human; identical to SEQ ID NO: 240492

SEQ ID NO: 443222 - RNA, 64 nt, Human; identical to SEQ ID NO: 240496

SEQ ID NO: 443223 - RNA, 64 nt, Human; identical to SEQ ID NO: 240497

SEQ ID NO: 443224 - RNA, 63 nt, Human; identical to SEQ ID NO: 240498

SEQ ID NO: 443225 - RNA, 64 nt, Human; identical to SEQ ID NO: 240499

SEQ ID NO: 443226 - RNA, 64 nt, Human; identical to SEQ ID NO: 240500

SEQ ID NO: 443227 - RNA, 64 nt, Human; identical to SEQ ID NO: 240501

SEQ ID NO: 443228 - RNA, 64 nt, Human; identical to SEQ ID NO: 240502

SEQ ID NO: 443229 - RNA, 64 nt, Human; identical to SEQ ID NO: 240503

SEQ ID NO: 443230 - RNA, 64 nt, Human; identical to SEQ ID NO: 240504

SEQ ID NO: 443231 - RNA, 64 nt, Human; identical to SEQ ID NO: 240505

SEQ ID NO: 443232 - RNA, 64 nt, Human; identical to SEQ ID NO: 240506

SEQ ID NO: 443233 - RNA, 64 nt, Human; identical to SEQ ID NO: 240507

SEQ ID NO: 443234 - RNA, 64 nt, Human; identical to SEQ ID NO: 240508

SEQ ID NO: 443235 - RNA, 64 nt, Human; identical to SEQ ID NO: 240509

SEQ ID NO: 443236 - RNA, 64 nt, Human; identical to SEQ ID NO: 240510

SEQ ID NO: 443237 - RNA, 64 nt, Human; identical to SEQ ID NO: 240514

SEQ ID NO: 443238 - RNA, 64 nt, Human; identical to SEQ ID NO: 240515

SEQ ID NO: 443239 - RNA, 64 nt, Human; identical to SEQ ID NO: 240516

SEQ ID NO: 443240 - RNA, 64 nt, Human; identical to SEQ ID NO: 240517

SEQ ID NO: 443241 - RNA, 64 nt, Human; identical to SEQ ID NO: 240518

SEQ ID NO: 443242 - RNA, 64 nt, Human; identical to SEQ ID NO: 240519

SEQ ID NO: 443243 - RNA, 64 nt, Human; identical to SEQ ID NO: 240520

SEQ ID NO: 443244 - RNA, 64 nt, Human; identical to SEQ ID NO: 240521

SEQ ID NO: 443245 - RNA, 64 nt, Human; identical to SEQ ID NO: 240522

SEQ ID NO: 443246 - RNA, 64 nt, Human; identical to SEQ ID NO: 240523

SEQ ID NO: 443247 - RNA, 64 nt, Human; identical to SEQ ID NO: 240524

SEQ ID NO: 443248 - RNA, 64 nt, Human; identical to SEQ ID NO: 240525

SEQ ID NO: 443249 - RNA, 64 nt, Human; identical to SEQ ID NO: 240526

SEQ ID NO: 443250 - RNA, 64 nt, Human; identical to SEQ ID NO: 240527

SEQ ID NO: 443251 - RNA, 63 nt, Human; identical to SEQ ID NO: 240528

SEQ ID NO: 443252 - RNA, 64 nt, Human; identical to SEQ ID NO: 240532

SEQ ID NO: 443253 - RNA, 64 nt, Human; identical to SEQ ID NO: 240533

SEQ ID NO: 443254 - RNA, 64 nt, Human; identical to SEQ ID NO: 240534

SEQ ID NO: 443255 - RNA, 64 nt, Human; identical to SEQ ID NO: 240535

SEQ ID NO: 443256 - RNA, 64 nt, Human; identical to SEQ ID NO: 240536

SEQ ID NO: 443257 - RNA, 64 nt, Human; identical to SEQ ID NO: 240537

SEQ ID NO: 443258 - RNA, 64 nt, Human; identical to SEQ ID NO: 240538

SEQ ID NO: 443259 - RNA, 64 nt, Human; identical to SEQ ID NO: 240539

SEQ ID NO: 443260 - RNA, 64 nt, Human; identical to SEQ ID NO: 240540

SEQ ID NO: 443261 - RNA, 64 nt, Human; identical to SEQ ID NO: 240541

SEQ ID NO: 443262 - RNA, 64 nt, Human; identical to SEQ ID NO: 240542

SEQ ID NO: 443263 - RNA, 64 nt, Human; identical to SEQ ID NO: 240543

SEQ ID NO: 443264 - RNA, 64 nt, Human; identical to SEQ ID NO: 240544

SEQ ID NO: 443265 - RNA, 64 nt, Human; identical to SEQ ID NO: 240545

SEQ ID NO: 443266 - RNA, 64 nt, Human; identical to SEQ ID NO: 240546

SEQ ID NO: 443267 - RNA, 59 nt, Human; identical to SEQ ID NO: 240549

SEQ ID NO: 443268 - RNA, 64 nt, Human; identical to SEQ ID NO: 240550

SEQ ID NO: 443269 - RNA, 64 nt, Human; identical to SEQ ID NO: 240551

SEQ ID NO: 443270 - RNA, 64 nt, Human; identical to SEQ ID NO: 240552

SEQ ID NO: 443271 - RNA, 64 nt, Human; identical to SEQ ID NO: 240553

SEQ ID NO: 443272 - RNA, 64 nt, Human; identical to SEQ ID NO: 240554

SEQ ID NO: 443273 - RNA, 64 nt, Human; identical to SEQ ID NO: 240555

SEQ ID NO: 443274 - RNA, 64 nt, Human; identical to SEQ ID NO: 240556

SEQ ID NO: 443275 - RNA, 64 nt, Human; identical to SEQ ID NO: 240557

SEQ ID NO: 443276 - RNA, 64 nt, Human; identical to SEQ ID NO: 240558

SEQ ID NO: 443277 - RNA, 64 nt, Human; identical to SEQ ID NO: 240559

SEQ ID NO: 443278 - RNA, 64 nt, Human; identical to SEQ ID NO: 240560

SEQ ID NO: 443279 - RNA, 64 nt, Human; identical to SEQ ID NO: 240561

SEQ ID NO: 443280 - RNA, 64 nt, Human; identical to SEQ ID NO: 240562

SEQ ID NO: 443281 - RNA, 64 nt, Human; identical to SEQ ID NO: 240563

SEQ ID NO: 443282 - RNA, 64 nt, Human; identical to SEQ ID NO: 240567

SEQ ID NO: 443283 - RNA, 64 nt, Human; identical to SEQ ID NO: 240568

SEQ ID NO: 443284 - RNA, 64 nt, Human; identical to SEQ ID NO: 240569

SEQ ID NO: 443285 - RNA, 64 nt, Human; identical to SEQ ID NO: 240570

SEQ ID NO: 443286 - RNA, 64 nt, Human; identical to SEQ ID NO: 240571

SEQ ID NO: 443287 - RNA, 64 nt, Human; identical to SEQ ID NO: 240572

SEQ ID NO: 443288 - RNA, 64 nt, Human; identical to SEQ ID NO: 240573

SEQ ID NO: 443289 - RNA, 64 nt, Human; identical to SEQ ID NO: 240574

SEQ ID NO: 443290 - RNA, 64 nt, Human; identical to SEQ ID NO: 240575

SEQ ID NO: 443291 - RNA, 64 nt, Human; identical to SEQ ID NO: 240576

SEQ ID NO: 443292 - RNA, 64 nt, Human; identical to SEQ ID NO: 240577

SEQ ID NO: 443293 - RNA, 64 nt, Human; identical to SEQ ID NO: 240578

SEQ ID NO: 443294 - RNA, 64 nt, Human; identical to SEQ ID NO: 240579

SEQ ID NO: 443295 - RNA, 64 nt, Human; identical to SEQ ID NO: 240580

SEQ ID NO: 443296 - RNA, 64 nt, Human; identical to SEQ ID NO: 240581

SEQ ID NO: 443297 - RNA, 64 nt, Human; identical to SEQ ID NO: 240585

SEQ ID NO: 443298 - RNA, 64 nt, Human; identical to SEQ ID NO: 240586

SEQ ID NO: 443299 - RNA, 64 nt, Human; identical to SEQ ID NO: 240587

SEQ ID NO: 443300 - RNA, 64 nt, Human; identical to SEQ ID NO: 240588

SEQ ID NO: 443301 - RNA, 64 nt, Human; identical to SEQ ID NO: 240589

SEQ ID NO: 443302 - RNA, 64 nt, Human; identical to SEQ ID NO: 240590

SEQ ID NO: 443303 - RNA, 64 nt, Human; identical to SEQ ID NO: 240591

SEQ ID NO: 443304 - RNA, 64 nt, Human; identical to SEQ ID NO: 240592

SEQ ID NO: 443305 - RNA, 64 nt, Human; identical to SEQ ID NO: 240593

SEQ ID NO: 443306 - RNA, 64 nt, Human; identical to SEQ ID NO: 240594

SEQ ID NO: 443307 - RNA, 64 nt, Human; identical to SEQ ID NO: 240595

SEQ ID NO: 443308 - RNA, 64 nt, Human; identical to SEQ ID NO: 240596

SEQ ID NO: 443309 - RNA, 64 nt, Human; identical to SEQ ID NO: 240597

SEQ ID NO: 443310 - RNA, 64 nt, Human; identical to SEQ ID NO: 240598

SEQ ID NO: 443311 - RNA, 64 nt, Human; identical to SEQ ID NO: 240599

SEQ ID NO: 443312 - RNA, 64 nt, Human; identical to SEQ ID NO: 240603

SEQ ID NO: 443313 - RNA, 64 nt, Human; identical to SEQ ID NO: 240604

SEQ ID NO: 443314 - RNA, 64 nt, Human; identical to SEQ ID NO: 240605

SEQ ID NO: 443315 - RNA, 64 nt, Human; identical to SEQ ID NO: 240606

SEQ ID NO: 443316 - RNA, 64 nt, Human; identical to SEQ ID NO: 240607

SEQ ID NO: 443317 - RNA, 64 nt, Human; identical to SEQ ID NO: 240608

SEQ ID NO: 443318 - RNA, 64 nt, Human; identical to SEQ ID NO: 240609

SEQ ID NO: 443319 - RNA, 64 nt, Human; identical to SEQ ID NO: 240610

SEQ ID NO: 443320 - RNA, 64 nt, Human; identical to SEQ ID NO: 240611

SEQ ID NO: 443321 - RNA, 60 nt, Human; identical to SEQ ID NO: 240612

SEQ ID NO: 443322 - RNA, 64 nt, Human; identical to SEQ ID NO: 240613

SEQ ID NO: 443323 - RNA, 64 nt, Human; identical to SEQ ID NO: 240614

SEQ ID NO: 443324 - RNA, 64 nt, Human; identical to SEQ ID NO: 240615

SEQ ID NO: 443325 - RNA, 64 nt, Human; identical to SEQ ID NO: 240616

SEQ ID NO: 443326 - RNA, 64 nt, Human; identical to SEQ ID NO: 240617

SEQ ID NO: 443327 - RNA, 64 nt, Human; identical to SEQ ID NO: 240621

SEQ ID NO: 443328 - RNA, 64 nt, Human; identical to SEQ ID NO: 240622

SEQ ID NO: 443329 - RNA, 64 nt, Human; identical to SEQ ID NO: 240623

SEQ ID NO: 443330 - RNA, 64 nt, Human; identical to SEQ ID NO: 240624

SEQ ID NO: 443331 - RNA, 64 nt, Human; identical to SEQ ID NO: 240625

SEQ ID NO: 443332 - RNA, 64 nt, Human; identical to SEQ ID NO: 240626

SEQ ID NO: 443333 - RNA, 64 nt, Human; identical to SEQ ID NO: 240627

SEQ ID NO: 443334 - RNA, 64 nt, Human; identical to SEQ ID NO: 240628

SEQ ID NO: 443335 - RNA, 64 nt, Human; identical to SEQ ID NO: 240629

SEQ ID NO: 443336 - RNA, 64 nt, Human; identical to SEQ ID NO: 240630

SEQ ID NO: 443337 - RNA, 64 nt, Human; identical to SEQ ID NO: 240631

SEQ ID NO: 443338 - RNA, 64 nt, Human; identical to SEQ ID NO: 240632

SEQ ID NO: 443339 - RNA, 64 nt, Human; identical to SEQ ID NO: 240633

SEQ ID NO: 443340 - RNA, 64 nt, Human; identical to SEQ ID NO: 240634

SEQ ID NO: 443341 - RNA, 64 nt, Human; identical to SEQ ID NO: 240635

SEQ ID NO: 443342 - RNA, 64 nt, Human; identical to SEQ ID NO: 240639

SEQ ID NO: 443343 - RNA, 64 nt, Human; identical to SEQ ID NO: 240640

SEQ ID NO: 443344 - RNA, 64 nt, Human; identical to SEQ ID NO: 240641

SEQ ID NO: 443345 - RNA, 64 nt, Human; identical to SEQ ID NO: 240642

SEQ ID NO: 443346 - RNA, 64 nt, Human; identical to SEQ ID NO: 240643

SEQ ID NO: 443347 - RNA, 64 nt, Human; identical to SEQ ID NO: 240644

SEQ ID NO: 443348 - RNA, 64 nt, Human; identical to SEQ ID NO: 240645

SEQ ID NO: 443349 - RNA, 64 nt, Human; identical to SEQ ID NO: 240646

SEQ ID NO: 443350 - RNA, 64 nt, Human; identical to SEQ ID NO: 240647

SEQ ID NO: 443351 - RNA, 64 nt, Human; identical to SEQ ID NO: 240648

SEQ ID NO: 443352 - RNA, 64 nt, Human; identical to SEQ ID NO: 240649

SEQ ID NO: 443353 - RNA, 64 nt, Human; identical to SEQ ID NO: 240650

SEQ ID NO: 443354 - RNA, 64 nt, Human; identical to SEQ ID NO: 240651

SEQ ID NO: 443355 - RNA, 64 nt, Human; identical to SEQ ID NO: 240652

SEQ ID NO: 443356 - RNA, 64 nt, Human; identical to SEQ ID NO: 240653

SEQ ID NO: 443357 - RNA, 64 nt, Human; identical to SEQ ID NO: 240657

SEQ ID NO: 443358 - RNA, 64 nt, Human; identical to SEQ ID NO: 240658

SEQ ID NO: 443359 - RNA, 64 nt, Human; identical to SEQ ID NO: 240659

SEQ ID NO: 443360 - RNA, 64 nt, Human; identical to SEQ ID NO: 240660

SEQ ID NO: 443361 - RNA, 64 nt, Human; identical to SEQ ID NO: 240661

SEQ ID NO: 443362 - RNA, 64 nt, Human; identical to SEQ ID NO: 240662

SEQ ID NO: 443363 - RNA, 64 nt, Human; identical to SEQ ID NO: 240663

SEQ ID NO: 443364 - RNA, 64 nt, Human; identical to SEQ ID NO: 240664

SEQ ID NO: 443365 - RNA, 64 nt, Human; identical to SEQ ID NO: 240665

SEQ ID NO: 443366 - RNA, 64 nt, Human; identical to SEQ ID NO: 240666

SEQ ID NO: 443367 - RNA, 64 nt, Human; identical to SEQ ID NO: 240667

SEQ ID NO: 443368 - RNA, 64 nt, Human; identical to SEQ ID NO: 240668

SEQ ID NO: 443369 - RNA, 64 nt, Human; identical to SEQ ID NO: 240669

SEQ ID NO: 443370 - RNA, 64 nt, Human; identical to SEQ ID NO: 240670

SEQ ID NO: 443371 - RNA, 64 nt, Human; identical to SEQ ID NO: 240671

SEQ ID NO: 443372 - RNA, 64 nt, Human; identical to SEQ ID NO: 240675

SEQ ID NO: 443373 - RNA, 64 nt, Human; identical to SEQ ID NO: 240676

SEQ ID NO: 443374 - RNA, 64 nt, Human; identical to SEQ ID NO: 240677

SEQ ID NO: 443375 - RNA, 64 nt, Human; identical to SEQ ID NO: 240678

SEQ ID NO: 443376 - RNA, 64 nt, Human; identical to SEQ ID NO: 240679

SEQ ID NO: 443377 - RNA, 64 nt, Human; identical to SEQ ID NO: 240680

SEQ ID NO: 443378 - RNA, 64 nt, Human; identical to SEQ ID NO: 240681

SEQ ID NO: 443379 - RNA, 64 nt, Human; identical to SEQ ID NO: 240682

SEQ ID NO: 443380 - RNA, 64 nt, Human; identical to SEQ ID NO: 240683

SEQ ID NO: 443381 - RNA, 64 nt, Human; identical to SEQ ID NO: 240684

SEQ ID NO: 443382 - RNA, 64 nt, Human; identical to SEQ ID NO: 240685

SEQ ID NO: 443383 - RNA, 64 nt, Human; identical to SEQ ID NO: 240686

SEQ ID NO: 443384 - RNA, 64 nt, Human; identical to SEQ ID NO: 240687

SEQ ID NO: 443385 - RNA, 64 nt, Human; identical to SEQ ID NO: 240688

SEQ ID NO: 443386 - RNA, 64 nt, Human; identical to SEQ ID NO: 240689

SEQ ID NO: 443387 - RNA, 64 nt, Human; identical to SEQ ID NO: 240693

SEQ ID NO: 443388 - RNA, 64 nt, Human; identical to SEQ ID NO: 240694

SEQ ID NO: 443389 - RNA, 64 nt, Human; identical to SEQ ID NO: 240695

SEQ ID NO: 443390 - RNA, 64 nt, Human; identical to SEQ ID NO: 240696

SEQ ID NO: 443391 - RNA, 64 nt, Human; identical to SEQ ID NO: 240697

SEQ ID NO: 443392 - RNA, 64 nt, Human; identical to SEQ ID NO: 240698

SEQ ID NO: 443393 - RNA, 64 nt, Human; identical to SEQ ID NO: 240699

SEQ ID NO: 443394 - RNA, 64 nt, Human; identical to SEQ ID NO: 240700

SEQ ID NO: 443395 - RNA, 64 nt, Human; identical to SEQ ID NO: 240701

SEQ ID NO: 443396 - RNA, 64 nt, Human; identical to SEQ ID NO: 240702

SEQ ID NO: 443397 - RNA, 64 nt, Human; identical to SEQ ID NO: 240703

SEQ ID NO: 443398 - RNA, 64 nt, Human; identical to SEQ ID NO: 240704

SEQ ID NO: 443399 - RNA, 64 nt, Human; identical to SEQ ID NO: 240705

SEQ ID NO: 443400 - RNA, 64 nt, Human; identical to SEQ ID NO: 240706

SEQ ID NO: 443401 - RNA, 64 nt, Human; identical to SEQ ID NO: 240707

SEQ ID NO: 443402 - RNA, 64 nt, Human; identical to SEQ ID NO: 240711

SEQ ID NO: 443403 - RNA, 64 nt, Human; identical to SEQ ID NO: 240712

SEQ ID NO: 443404 - RNA, 64 nt, Human; identical to SEQ ID NO: 240713

SEQ ID NO: 443405 - RNA, 64 nt, Human; identical to SEQ ID NO: 240714

SEQ ID NO: 443406 - RNA, 58 nt, Human; identical to SEQ ID NO: 240715

SEQ ID NO: 443407 - RNA, 64 nt, Human; identical to SEQ ID NO: 240716

SEQ ID NO: 443408 - RNA, 64 nt, Human; identical to SEQ ID NO: 240717

SEQ ID NO: 443409 - RNA, 64 nt, Human; identical to SEQ ID NO: 240718

SEQ ID NO: 443410 - RNA, 64 nt, Human; identical to SEQ ID NO: 240719

SEQ ID NO: 443411 - RNA, 64 nt, Human; identical to SEQ ID NO: 240720

SEQ ID NO: 443412 - RNA, 64 nt, Human; identical to SEQ ID NO: 240721

SEQ ID NO: 443413 - RNA, 64 nt, Human; identical to SEQ ID NO: 240722

SEQ ID NO: 443414 - RNA, 64 nt, Human; identical to SEQ ID NO: 240723

SEQ ID NO: 443415 - RNA, 64 nt, Human; identical to SEQ ID NO: 240724

SEQ ID NO: 443416 - RNA, 64 nt, Human; identical to SEQ ID NO: 240725

SEQ ID NO: 443417 - RNA, 64 nt, Human; identical to SEQ ID NO: 240729

SEQ ID NO: 443418 - RNA, 64 nt, Human; identical to SEQ ID NO: 240730

SEQ ID NO: 443419 - RNA, 64 nt, Human; identical to SEQ ID NO: 240731

SEQ ID NO: 443420 - RNA, 64 nt, Human; identical to SEQ ID NO: 240732

SEQ ID NO: 443421 - RNA, 64 nt, Human; identical to SEQ ID NO: 240733

SEQ ID NO: 443422 - RNA, 64 nt, Human; identical to SEQ ID NO: 240734

SEQ ID NO: 443423 - RNA, 64 nt, Human; identical to SEQ ID NO: 240735

SEQ ID NO: 443424 - RNA, 64 nt, Human; identical to SEQ ID NO: 240736

SEQ ID NO: 443425 - RNA, 64 nt, Human; identical to SEQ ID NO: 240737

SEQ ID NO: 443426 - RNA, 64 nt, Human; identical to SEQ ID NO: 240738

SEQ ID NO: 443427 - RNA, 64 nt, Human; identical to SEQ ID NO: 240739

SEQ ID NO: 443428 - RNA, 64 nt, Human; identical to SEQ ID NO: 240740

SEQ ID NO: 443429 - RNA, 64 nt, Human; identical to SEQ ID NO: 240741

SEQ ID NO: 443430 - RNA, 64 nt, Human; identical to SEQ ID NO: 240742

SEQ ID NO: 443431 - RNA, 64 nt, Human; identical to SEQ ID NO: 240743

SEQ ID NO: 443432 - RNA, 64 nt, Human; identical to SEQ ID NO: 240747

SEQ ID NO: 443433 - RNA, 64 nt, Human; identical to SEQ ID NO: 240748

SEQ ID NO: 443434 - RNA, 64 nt, Human; identical to SEQ ID NO: 240749

SEQ ID NO: 443435 - RNA, 64 nt, Human; identical to SEQ ID NO: 240750

SEQ ID NO: 443436 - RNA, 64 nt, Human; identical to SEQ ID NO: 240751

SEQ ID NO: 443437 - RNA, 64 nt, Human; identical to SEQ ID NO: 240752

SEQ ID NO: 443438 - RNA, 64 nt, Human; identical to SEQ ID NO: 240753

SEQ ID NO: 443439 - RNA, 64 nt, Human; identical to SEQ ID NO: 240754

SEQ ID NO: 443440 - RNA, 64 nt, Human; identical to SEQ ID NO: 240755

SEQ ID NO: 443441 - RNA, 64 nt, Human; identical to SEQ ID NO: 240756

SEQ ID NO: 443442 - RNA, 64 nt, Human; identical to SEQ ID NO: 240757

SEQ ID NO: 443443 - RNA, 64 nt, Human; identical to SEQ ID NO: 240758

SEQ ID NO: 443444 - RNA, 64 nt, Human; identical to SEQ ID NO: 240759

SEQ ID NO: 443445 - RNA, 64 nt, Human; identical to SEQ ID NO: 240760

SEQ ID NO: 443446 - RNA, 64 nt, Human; identical to SEQ ID NO: 240761

SEQ ID NO: 443447 - RNA, 64 nt, Human; identical to SEQ ID NO: 240765

SEQ ID NO: 443448 - RNA, 64 nt, Human; identical to SEQ ID NO: 240766

SEQ ID NO: 443449 - RNA, 64 nt, Human; identical to SEQ ID NO: 240767

SEQ ID NO: 443450 - RNA, 64 nt, Human; identical to SEQ ID NO: 240768

SEQ ID NO: 443451 - RNA, 64 nt, Human; identical to SEQ ID NO: 240769

SEQ ID NO: 443452 - RNA, 64 nt, Human; identical to SEQ ID NO: 240770

SEQ ID NO: 443453 - RNA, 64 nt, Human; identical to SEQ ID NO: 240771

SEQ ID NO: 443454 - RNA, 64 nt, Human; identical to SEQ ID NO: 240772

SEQ ID NO: 443455 - RNA, 64 nt, Human; identical to SEQ ID NO: 240773

SEQ ID NO: 443456 - RNA, 64 nt, Human; identical to SEQ ID NO: 240774

SEQ ID NO: 443457 - RNA, 64 nt, Human; identical to SEQ ID NO: 240775

SEQ ID NO: 443458 - RNA, 64 nt, Human; identical to SEQ ID NO: 240776

SEQ ID NO: 443459 - RNA, 64 nt, Human; identical to SEQ ID NO: 240777

SEQ ID NO: 443460 - RNA, 64 nt, Human; identical to SEQ ID NO: 240778

SEQ ID NO: 443461 - RNA, 64 nt, Human; identical to SEQ ID NO: 240779

SEQ ID NO: 443462 - RNA, 64 nt, Human; identical to SEQ ID NO: 240783

SEQ ID NO: 443463 - RNA, 64 nt, Human; identical to SEQ ID NO: 240784

SEQ ID NO: 443464 - RNA, 64 nt, Human; identical to SEQ ID NO: 240785

SEQ ID NO: 443465 - RNA, 64 nt, Human; identical to SEQ ID NO: 240786

SEQ ID NO: 443466 - RNA, 64 nt, Human; identical to SEQ ID NO: 240787

SEQ ID NO: 443467 - RNA, 64 nt, Human; identical to SEQ ID NO: 240788

SEQ ID NO: 443468 - RNA, 64 nt, Human; identical to SEQ ID NO: 240789

SEQ ID NO: 443469 - RNA, 64 nt, Human; identical to SEQ ID NO: 240790

SEQ ID NO: 443470 - RNA, 64 nt, Human; identical to SEQ ID NO: 240791

SEQ ID NO: 443471 - RNA, 64 nt, Human; identical to SEQ ID NO: 240792

SEQ ID NO: 443472 - RNA, 64 nt, Human; identical to SEQ ID NO: 240793

SEQ ID NO: 443473 - RNA, 64 nt, Human; identical to SEQ ID NO: 240794

SEQ ID NO: 443474 - RNA, 64 nt, Human; identical to SEQ ID NO: 240795

SEQ ID NO: 443475 - RNA, 64 nt, Human; identical to SEQ ID NO: 240796

SEQ ID NO: 443476 - RNA, 64 nt, Human; identical to SEQ ID NO: 240797

SEQ ID NO: 443477 - RNA, 64 nt, Human; identical to SEQ ID NO: 240801

SEQ ID NO: 443478 - RNA, 64 nt, Human; identical to SEQ ID NO: 240802

SEQ ID NO: 443479 - RNA, 64 nt, Human; identical to SEQ ID NO: 240803

SEQ ID NO: 443480 - RNA, 64 nt, Human; identical to SEQ ID NO: 240804

SEQ ID NO: 443481 - RNA, 64 nt, Human; identical to SEQ ID NO: 240805

SEQ ID NO: 443482 - RNA, 64 nt, Human; identical to SEQ ID NO: 240806

SEQ ID NO: 443483 - RNA, 64 nt, Human; identical to SEQ ID NO: 240807

SEQ ID NO: 443484 - RNA, 64 nt, Human; identical to SEQ ID NO: 240808

SEQ ID NO: 443485 - RNA, 64 nt, Human; identical to SEQ ID NO: 240809

SEQ ID NO: 443486 - RNA, 64 nt, Human; identical to SEQ ID NO: 240810

SEQ ID NO: 443487 - RNA, 64 nt, Human; identical to SEQ ID NO: 240811

SEQ ID NO: 443488 - RNA, 64 nt, Human; identical to SEQ ID NO: 240812

SEQ ID NO: 443489 - RNA, 64 nt, Human; identical to SEQ ID NO: 240813

SEQ ID NO: 443490 - RNA, 64 nt, Human; identical to SEQ ID NO: 240814

SEQ ID NO: 443491 - RNA, 64 nt, Human; identical to SEQ ID NO: 240815

SEQ ID NO: 443492 - RNA, 64 nt, Human; identical to SEQ ID NO: 240819

SEQ ID NO: 443493 - RNA, 64 nt, Human; identical to SEQ ID NO: 240820

SEQ ID NO: 443494 - RNA, 64 nt, Human; identical to SEQ ID NO: 240821

SEQ ID NO: 443495 - RNA, 64 nt, Human; identical to SEQ ID NO: 240822

SEQ ID NO: 443496 - RNA, 64 nt, Human; identical to SEQ ID NO: 240823

SEQ ID NO: 443497 - RNA, 64 nt, Human; identical to SEQ ID NO: 240824

SEQ ID NO: 443498 - RNA, 64 nt, Human; identical to SEQ ID NO: 240825

SEQ ID NO: 443499 - RNA, 64 nt, Human; identical to SEQ ID NO: 240826

SEQ ID NO: 443500 - RNA, 64 nt, Human; identical to SEQ ID NO: 240827

SEQ ID NO: 443501 - RNA, 64 nt, Human; identical to SEQ ID NO: 240828

SEQ ID NO: 443502 - RNA, 64 nt, Human; identical to SEQ ID NO: 240829

SEQ ID NO: 443503 - RNA, 64 nt, Human; identical to SEQ ID NO: 240830

SEQ ID NO: 443504 - RNA, 64 nt, Human; identical to SEQ ID NO: 240831

SEQ ID NO: 443505 - RNA, 64 nt, Human; identical to SEQ ID NO: 240832

SEQ ID NO: 443506 - RNA, 64 nt, Human; identical to SEQ ID NO: 240833

SEQ ID NO: 443507 - RNA, 64 nt, Human; identical to SEQ ID NO: 240837

SEQ ID NO: 443508 - RNA, 64 nt, Human; identical to SEQ ID NO: 240838

SEQ ID NO: 443509 - RNA, 64 nt, Human; identical to SEQ ID NO: 240839

SEQ ID NO: 443510 - RNA, 64 nt, Human; identical to SEQ ID NO: 240840

SEQ ID NO: 443511 - RNA, 64 nt, Human; identical to SEQ ID NO: 240841

SEQ ID NO: 443512 - RNA, 64 nt, Human; identical to SEQ ID NO: 240842

SEQ ID NO: 443513 - RNA, 64 nt, Human; identical to SEQ ID NO: 240843

SEQ ID NO: 443514 - RNA, 62 nt, Human; identical to SEQ ID NO: 240844

SEQ ID NO: 443515 - RNA, 64 nt, Human; identical to SEQ ID NO: 240845

SEQ ID NO: 443516 - RNA, 64 nt, Human; identical to SEQ ID NO: 240846

SEQ ID NO: 443517 - RNA, 64 nt, Human; identical to SEQ ID NO: 240847

SEQ ID NO: 443518 - RNA, 64 nt, Human; identical to SEQ ID NO: 240848

SEQ ID NO: 443519 - RNA, 64 nt, Human; identical to SEQ ID NO: 240849

SEQ ID NO: 443520 - RNA, 64 nt, Human; identical to SEQ ID NO: 240850

SEQ ID NO: 443521 - RNA, 64 nt, Human; identical to SEQ ID NO: 240851

SEQ ID NO: 443522 - RNA, 64 nt, Human; identical to SEQ ID NO: 240854

SEQ ID NO: 443523 - RNA, 64 nt, Human; identical to SEQ ID NO: 240855

SEQ ID NO: 443524 - RNA, 64 nt, Human; identical to SEQ ID NO: 240856

SEQ ID NO: 443525 - RNA, 64 nt, Human; identical to SEQ ID NO: 240833

SEQ ID NO: 443526 - RNA, 64 nt, Human; identical to SEQ ID NO: 240858

SEQ ID NO: 443527 - RNA, 64 nt, Human; identical to SEQ ID NO: 240859

SEQ ID NO: 443528 - RNA, 64 nt, Human; identical to SEQ ID NO: 240860

SEQ ID NO: 443529 - RNA, 57 nt, Human; identical to SEQ ID NO: 240861

SEQ ID NO: 443530 - RNA, 64 nt, Human; identical to SEQ ID NO: 240862

SEQ ID NO: 443531 - RNA, 64 nt, Human; identical to SEQ ID NO: 240863

SEQ ID NO: 443532 - RNA, 64 nt, Human; identical to SEQ ID NO: 240864

SEQ ID NO: 443533 - RNA, 64 nt, Human; identical to SEQ ID NO: 240865

SEQ ID NO: 443534 - RNA, 64 nt, Human; identical to SEQ ID NO: 240866

SEQ ID NO: 443535 - RNA, 64 nt, Human; identical to SEQ ID NO: 240867

SEQ ID NO: 443536 - RNA, 64 nt, Human; identical to SEQ ID NO: 240868

SEQ ID NO: 443537 - RNA, 64 nt, Human; identical to SEQ ID NO: 240872

SEQ ID NO: 443538 - RNA, 64 nt, Human; identical to SEQ ID NO: 240873

SEQ ID NO: 443539 - RNA, 64 nt, Human; identical to SEQ ID NO: 240874

SEQ ID NO: 443540 - RNA, 64 nt, Human; identical to SEQ ID NO: 240875

SEQ ID NO: 443541 - RNA, 64 nt, Human; identical to SEQ ID NO: 240876

SEQ ID NO: 443542 - RNA, 64 nt, Human; identical to SEQ ID NO: 240877

SEQ ID NO: 443543 - RNA, 64 nt, Human; identical to SEQ ID NO: 240878

SEQ ID NO: 443544 - RNA, 64 nt, Human; identical to SEQ ID NO: 240879

SEQ ID NO: 443545 - RNA, 64 nt, Human; identical to SEQ ID NO: 240880

SEQ ID NO: 443546 - RNA, 64 nt, Human; identical to SEQ ID NO: 240881

SEQ ID NO: 443547 - RNA, 64 nt, Human; identical to SEQ ID NO: 240882

SEQ ID NO: 443548 - RNA, 64 nt, Human; identical to SEQ ID NO: 240883

SEQ ID NO: 443549 - RNA, 64 nt, Human; identical to SEQ ID NO: 240884

SEQ ID NO: 443550 - RNA, 64 nt, Human; identical to SEQ ID NO: 240885

SEQ ID NO: 443551 - RNA, 64 nt, Human; identical to SEQ ID NO: 240886

SEQ ID NO: 443552 - RNA, 64 nt, Human; identical to SEQ ID NO: 240890

SEQ ID NO: 443553 - RNA, 64 nt, Human; identical to SEQ ID NO: 240891

SEQ ID NO: 443554 - RNA, 59 nt, Human; identical to SEQ ID NO: 240892

SEQ ID NO: 443555 - RNA, 64 nt, Human; identical to SEQ ID NO: 240893

SEQ ID NO: 443556 - RNA, 64 nt, Human; identical to SEQ ID NO: 240894

SEQ ID NO: 443557 - RNA, 64 nt, Human; identical to SEQ ID NO: 240895

SEQ ID NO: 443558 - RNA, 64 nt, Human; identical to SEQ ID NO: 240896

SEQ ID NO: 443559 - RNA, 64 nt, Human; identical to SEQ ID NO: 240897

SEQ ID NO: 443560 - RNA, 64 nt, Human; identical to SEQ ID NO: 240898

SEQ ID NO: 443561 - RNA, 64 nt, Human; identical to SEQ ID NO: 240899

SEQ ID NO: 443562 - RNA, 64 nt, Human; identical to SEQ ID NO: 240900

SEQ ID NO: 443563 - RNA, 64 nt, Human; identical to SEQ ID NO: 240901

SEQ ID NO: 443564 - RNA, 64 nt, Human; identical to SEQ ID NO: 240902

SEQ ID NO: 443565 - RNA, 64 nt, Human; identical to SEQ ID NO: 240903

SEQ ID NO: 443566 - RNA, 64 nt, Human; identical to SEQ ID NO: 240904

SEQ ID NO: 443567 - RNA, 64 nt, Human; identical to SEQ ID NO: 240908

SEQ ID NO: 443568 - RNA, 64 nt, Human; identical to SEQ ID NO: 240909

SEQ ID NO: 443569 - RNA, 64 nt, Human; identical to SEQ ID NO: 240910

SEQ ID NO: 443570 - RNA, 64 nt, Human; identical to SEQ ID NO: 240911

SEQ ID NO: 443571 - RNA, 64 nt, Human; identical to SEQ ID NO: 240912

SEQ ID NO: 443572 - RNA, 64 nt, Human; identical to SEQ ID NO: 240913

SEQ ID NO: 443573 - RNA, 64 nt, Human; identical to SEQ ID NO: 240914

SEQ ID NO: 443574 - RNA, 64 nt, Human; identical to SEQ ID NO: 240915

SEQ ID NO: 443575 - RNA, 64 nt, Human; identical to SEQ ID NO: 240916

SEQ ID NO: 443576 - RNA, 64 nt, Human; identical to SEQ ID NO: 240917

SEQ ID NO: 443577 - RNA, 64 nt, Human; identical to SEQ ID NO: 240918

SEQ ID NO: 443578 - RNA, 64 nt, Human; identical to SEQ ID NO: 240919

SEQ ID NO: 443579 - RNA, 64 nt, Human; identical to SEQ ID NO: 240920

SEQ ID NO: 443580 - RNA, 64 nt, Human; identical to SEQ ID NO: 240921

SEQ ID NO: 443581 - RNA, 64 nt, Human; identical to SEQ ID NO: 240922

SEQ ID NO: 443582 - RNA, 64 nt, Human; identical to SEQ ID NO: 240926

SEQ ID NO: 443583 - RNA, 64 nt, Human; identical to SEQ ID NO: 240927

SEQ ID NO: 443584 - RNA, 64 nt, Human; identical to SEQ ID NO: 240928

SEQ ID NO: 443585 - RNA, 64 nt, Human; identical to SEQ ID NO: 240929

SEQ ID NO: 443586 - RNA, 64 nt, Human; identical to SEQ ID NO: 240930

SEQ ID NO: 443587 - RNA, 64 nt, Human; identical to SEQ ID NO: 240931

SEQ ID NO: 443588 - RNA, 64 nt, Human; identical to SEQ ID NO: 240932

SEQ ID NO: 443589 - RNA, 64 nt, Human; identical to SEQ ID NO: 240933

SEQ ID NO: 443590 - RNA, 64 nt, Human; identical to SEQ ID NO: 240934

SEQ ID NO: 443591 - RNA, 64 nt, Human; identical to SEQ ID NO: 240935

SEQ ID NO: 443592 - RNA, 64 nt, Human; identical to SEQ ID NO: 240936

SEQ ID NO: 443593 - RNA, 64 nt, Human; identical to SEQ ID NO: 240937

SEQ ID NO: 443594 - RNA, 64 nt, Human; identical to SEQ ID NO: 240938

SEQ ID NO: 443595 - RNA, 64 nt, Human; identical to SEQ ID NO: 240939

SEQ ID NO: 443596 - RNA, 64 nt, Human; identical to SEQ ID NO: 240940

SEQ ID NO: 443597 - RNA, 64 nt, Human; identical to SEQ ID NO: 240944

SEQ ID NO: 443598 - RNA, 64 nt, Human; identical to SEQ ID NO: 240945

SEQ ID NO: 443599 - RNA, 64 nt, Human; identical to SEQ ID NO: 240946

SEQ ID NO: 443600 - RNA, 64 nt, Human; identical to SEQ ID NO: 240947

SEQ ID NO: 443601 - RNA, 64 nt, Human; identical to SEQ ID NO: 240948

SEQ ID NO: 443602 - RNA, 64 nt, Human; identical to SEQ ID NO: 240949

SEQ ID NO: 443603 - RNA, 64 nt, Human; identical to SEQ ID NO: 240950

SEQ ID NO: 443604 - RNA, 64 nt, Human; identical to SEQ ID NO: 240951

SEQ ID NO: 443605 - RNA, 64 nt, Human; identical to SEQ ID NO: 240952

SEQ ID NO: 443606 - RNA, 64 nt, Human; identical to SEQ ID NO: 240953

SEQ ID NO: 443607 - RNA, 64 nt, Human; identical to SEQ ID NO: 240954

SEQ ID NO: 443608 - RNA, 64 nt, Human; identical to SEQ ID NO: 240955

SEQ ID NO: 443609 - RNA, 64 nt, Human; identical to SEQ ID NO: 240956

SEQ ID NO: 443610 - RNA, 64 nt, Human; identical to SEQ ID NO: 240957

SEQ ID NO: 443611 - RNA, 64 nt, Human; identical to SEQ ID NO: 240958

SEQ ID NO: 443612 - RNA, 63 nt, Human; identical to SEQ ID NO: 240962

SEQ ID NO: 443613 - RNA, 64 nt, Human; identical to SEQ ID NO: 240963

SEQ ID NO: 443614 - RNA, 64 nt, Human; identical to SEQ ID NO: 240964

SEQ ID NO: 443615 - RNA, 64 nt, Human; identical to SEQ ID NO: 240965

SEQ ID NO: 443616 - RNA, 64 nt, Human; identical to SEQ ID NO: 240966

SEQ ID NO: 443617 - RNA, 64 nt, Human; identical to SEQ ID NO: 240967

SEQ ID NO: 443618 - RNA, 64 nt, Human; identical to SEQ ID NO: 240968

SEQ ID NO: 443619 - RNA, 64 nt, Human; identical to SEQ ID NO: 240969

SEQ ID NO: 443620 - RNA, 64 nt, Human; identical to SEQ ID NO: 240970

SEQ ID NO: 443621 - RNA, 64 nt, Human; identical to SEQ ID NO: 240971

SEQ ID NO: 443622 - RNA, 64 nt, Human; identical to SEQ ID NO: 240972

SEQ ID NO: 443623 - RNA, 64 nt, Human; identical to SEQ ID NO: 240973

SEQ ID NO: 443624 - RNA, 64 nt, Human; identical to SEQ ID NO: 240974

SEQ ID NO: 443625 - RNA, 64 nt, Human; identical to SEQ ID NO: 240975

SEQ ID NO: 443626 - RNA, 64 nt, Human; identical to SEQ ID NO: 240976

SEQ ID NO: 443627 - RNA, 64 nt, Human; identical to SEQ ID NO: 240980

SEQ ID NO: 443628 - RNA, 64 nt, Human; identical to SEQ ID NO: 240981

SEQ ID NO: 443629 - RNA, 64 nt, Human; identical to SEQ ID NO: 240982

SEQ ID NO: 443630 - RNA, 64 nt, Human; identical to SEQ ID NO: 240983

SEQ ID NO: 443631 - RNA, 64 nt, Human; identical to SEQ ID NO: 240984

SEQ ID NO: 443632 - RNA, 64 nt, Human; identical to SEQ ID NO: 240985

SEQ ID NO: 443633 - RNA, 64 nt, Human; identical to SEQ ID NO: 240986

SEQ ID NO: 443634 - RNA, 64 nt, Human; identical to SEQ ID NO: 240987

SEQ ID NO: 443635 - RNA, 64 nt, Human; identical to SEQ ID NO: 240988

SEQ ID NO: 443636 - RNA, 64 nt, Human; identical to SEQ ID NO: 240989

SEQ ID NO: 443637 - RNA, 64 nt, Human; identical to SEQ ID NO: 240990

SEQ ID NO: 443638 - RNA, 64 nt, Human; identical to SEQ ID NO: 240991

SEQ ID NO: 443639 - RNA, 64 nt, Human; identical to SEQ ID NO: 240992

SEQ ID NO: 443640 - RNA, 64 nt, Human; identical to SEQ ID NO: 240993

SEQ ID NO: 443641 - RNA, 64 nt, Human; identical to SEQ ID NO: 240994

SEQ ID NO: 443642 - RNA, 64 nt, Human; identical to SEQ ID NO: 240997

SEQ ID NO: 443643 - RNA, 64 nt, Human; identical to SEQ ID NO: 240998

SEQ ID NO: 443644 - RNA, 64 nt, Human; identical to SEQ ID NO: 240999

SEQ ID NO: 443645 - RNA, 64 nt, Human; identical to SEQ ID NO: 241000

SEQ ID NO: 443646 - RNA, 64 nt, Human; identical to SEQ ID NO: 241001

SEQ ID NO: 443647 - RNA, 64 nt, Human; identical to SEQ ID NO: 241002

SEQ ID NO: 443648 - RNA, 64 nt, Human; identical to SEQ ID NO: 241003

SEQ ID NO: 443649 - RNA, 64 nt, Human; identical to SEQ ID NO: 241004

SEQ ID NO: 443650 - RNA, 64 nt, Human; identical to SEQ ID NO: 241005

SEQ ID NO: 443651 - RNA, 64 nt, Human; identical to SEQ ID NO: 241006

SEQ ID NO: 443652 - RNA, 52 nt, Human; identical to SEQ ID NO: 241007

SEQ ID NO: 443653 - RNA, 64 nt, Human; identical to SEQ ID NO: 241008

SEQ ID NO: 443654 - RNA, 64 nt, Human; identical to SEQ ID NO: 241009

SEQ ID NO: 443655 - RNA, 64 nt, Human; identical to SEQ ID NO: 241010

SEQ ID NO: 443656 - RNA, 64 nt, Human; identical to SEQ ID NO: 241011

SEQ ID NO: 443657 - RNA, 64 nt, Human; identical to SEQ ID NO: 241013

SEQ ID NO: 443658 - RNA, 64 nt, Human; identical to SEQ ID NO: 241014

SEQ ID NO: 443659 - RNA, 64 nt, Human; identical to SEQ ID NO: 241015

SEQ ID NO: 443660 - RNA, 64 nt, Human; identical to SEQ ID NO: 241016

SEQ ID NO: 443661 - RNA, 64 nt, Human; identical to SEQ ID NO: 241017

SEQ ID NO: 443662 - RNA, 64 nt, Human; identical to SEQ ID NO: 241018

SEQ ID NO: 443663 - RNA, 64 nt, Human; identical to SEQ ID NO: 241019

SEQ ID NO: 443664 - RNA, 64 nt, Human; identical to SEQ ID NO: 241020

SEQ ID NO: 443665 - RNA, 64 nt, Human; identical to SEQ ID NO: 241021

SEQ ID NO: 443666 - RNA, 64 nt, Human; identical to SEQ ID NO: 241022

SEQ ID NO: 443667 - RNA, 64 nt, Human; identical to SEQ ID NO: 241023

SEQ ID NO: 443668 - RNA, 62 nt, Human; identical to SEQ ID NO: 241024

SEQ ID NO: 443669 - RNA, 64 nt, Human; identical to SEQ ID NO: 241025

SEQ ID NO: 443670 - RNA, 64 nt, Human; identical to SEQ ID NO: 241026

SEQ ID NO: 443671 - RNA, 64 nt, Human; identical to SEQ ID NO: 241027

SEQ ID NO: 443672 - RNA, 64 nt, Human; identical to SEQ ID NO: 241031

SEQ ID NO: 443673 - RNA, 64 nt, Human; identical to SEQ ID NO: 241032

SEQ ID NO: 443674 - RNA, 64 nt, Human; identical to SEQ ID NO: 241033

SEQ ID NO: 443675 - RNA, 64 nt, Human; identical to SEQ ID NO: 241034

SEQ ID NO: 443676 - RNA, 64 nt, Human; identical to SEQ ID NO: 241035

SEQ ID NO: 443677 - RNA, 64 nt, Human; identical to SEQ ID NO: 241036

SEQ ID NO: 443678 - RNA, 64 nt, Human; identical to SEQ ID NO: 241037

SEQ ID NO: 443679 - RNA, 64 nt, Human; identical to SEQ ID NO: 241038

SEQ ID NO: 443680 - RNA, 64 nt, Human; identical to SEQ ID NO: 241039

SEQ ID NO: 443681 - RNA, 64 nt, Human; identical to SEQ ID NO: 241040

SEQ ID NO: 443682 - RNA, 64 nt, Human; identical to SEQ ID NO: 241041

SEQ ID NO: 443683 - RNA, 64 nt, Human; identical to SEQ ID NO: 241042

SEQ ID NO: 443684 - RNA, 64 nt, Human; identical to SEQ ID NO: 241043

SEQ ID NO: 443685 - RNA, 64 nt, Human; identical to SEQ ID NO: 241044

SEQ ID NO: 443686 - RNA, 64 nt, Human; identical to SEQ ID NO: 241045

SEQ ID NO: 443687 - RNA, 64 nt, Human; identical to SEQ ID NO: 241049

SEQ ID NO: 443688 - RNA, 64 nt, Human; identical to SEQ ID NO: 241050

SEQ ID NO: 443689 - RNA, 64 nt, Human; identical to SEQ ID NO: 241051

SEQ ID NO: 443690 - RNA, 64 nt, Human; identical to SEQ ID NO: 241052

SEQ ID NO: 443691 - RNA, 64 nt, Human; identical to SEQ ID NO: 241053

SEQ ID NO: 443692 - RNA, 64 nt, Human; identical to SEQ ID NO: 241054

SEQ ID NO: 443693 - RNA, 64 nt, Human; identical to SEQ ID NO: 241055

SEQ ID NO: 443694 - RNA, 64 nt, Human; identical to SEQ ID NO: 241056

SEQ ID NO: 443695 - RNA, 64 nt, Human; identical to SEQ ID NO: 241057

SEQ ID NO: 443696 - RNA, 64 nt, Human; identical to SEQ ID NO: 241058

SEQ ID NO: 443697 - RNA, 64 nt, Human; identical to SEQ ID NO: 241059

SEQ ID NO: 443698 - RNA, 64 nt, Human; identical to SEQ ID NO: 241060

SEQ ID NO: 443699 - RNA, 64 nt, Human; identical to SEQ ID NO: 241061

SEQ ID NO: 443700 - RNA, 64 nt, Human; identical to SEQ ID NO: 241062

SEQ ID NO: 443701 - RNA, 64 nt, Human; identical to SEQ ID NO: 241063

SEQ ID NO: 443702 - RNA, 64 nt, Human; identical to SEQ ID NO: 241067

SEQ ID NO: 443703 - RNA, 64 nt, Human; identical to SEQ ID NO: 241068

SEQ ID NO: 443704 - RNA, 64 nt, Human; identical to SEQ ID NO: 241069

SEQ ID NO: 443705 - RNA, 64 nt, Human; identical to SEQ ID NO: 241070

SEQ ID NO: 443706 - RNA, 64 nt, Human; identical to SEQ ID NO: 241071

SEQ ID NO: 443707 - RNA, 64 nt, Human; identical to SEQ ID NO: 241072

SEQ ID NO: 443708 - RNA, 64 nt, Human; identical to SEQ ID NO: 241073

SEQ ID NO: 443709 - RNA, 64 nt, Human; identical to SEQ ID NO: 241074

SEQ ID NO: 443710 - RNA, 64 nt, Human; identical to SEQ ID NO: 241075

SEQ ID NO: 443711 - RNA, 64 nt, Human; identical to SEQ ID NO: 241076

SEQ ID NO: 443712 - RNA, 64 nt, Human; identical to SEQ ID NO: 241077

SEQ ID NO: 443713 - RNA, 64 nt, Human; identical to SEQ ID NO: 241078

SEQ ID NO: 443714 - RNA, 64 nt, Human; identical to SEQ ID NO: 241079

SEQ ID NO: 443715 - RNA, 64 nt, Human; identical to SEQ ID NO: 241080

SEQ ID NO: 443716 - RNA, 64 nt, Human; identical to SEQ ID NO: 241081

SEQ ID NO: 443717 - RNA, 64 nt, Human; identical to SEQ ID NO: 241085

SEQ ID NO: 443718 - RNA, 64 nt, Human; identical to SEQ ID NO: 241086

SEQ ID NO: 443719 - RNA, 64 nt, Human; identical to SEQ ID NO: 241087

SEQ ID NO: 443720 - RNA, 64 nt, Human; identical to SEQ ID NO: 241088

SEQ ID NO: 443721 - RNA, 64 nt, Human; identical to SEQ ID NO: 241089

SEQ ID NO: 443722 - RNA, 64 nt, Human; identical to SEQ ID NO: 241090

SEQ ID NO: 443723 - RNA, 64 nt, Human; identical to SEQ ID NO: 241091

SEQ ID NO: 443724 - RNA, 64 nt, Human; identical to SEQ ID NO: 241092

SEQ ID NO: 443725 - RNA, 62 nt, Human; identical to SEQ ID NO: 241093

SEQ ID NO: 443726 - RNA, 64 nt, Human; identical to SEQ ID NO: 241094

SEQ ID NO: 443727 - RNA, 64 nt, Human; identical to SEQ ID NO: 241095

SEQ ID NO: 443728 - RNA, 64 nt, Human; identical to SEQ ID NO: 241096

SEQ ID NO: 443729 - RNA, 64 nt, Human; identical to SEQ ID NO: 241097

SEQ ID NO: 443730 - RNA, 64 nt, Human; identical to SEQ ID NO: 241098

SEQ ID NO: 443731 - RNA, 64 nt, Human; identical to SEQ ID NO: 241099

SEQ ID NO: 443732 - RNA, 64 nt, Human; identical to SEQ ID NO: 241103

SEQ ID NO: 443733 - RNA, 64 nt, Human; identical to SEQ ID NO: 241104

SEQ ID NO: 443734 - RNA, 64 nt, Human; identical to SEQ ID NO: 241105

SEQ ID NO: 443735 - RNA, 64 nt, Human; identical to SEQ ID NO: 241106

SEQ ID NO: 443736 - RNA, 64 nt, Human; identical to SEQ ID NO: 241107

SEQ ID NO: 443737 - RNA, 64 nt, Human; identical to SEQ ID NO: 241108

SEQ ID NO: 443738 - RNA, 64 nt, Human; identical to SEQ ID NO: 241109

SEQ ID NO: 443739 - RNA, 64 nt, Human; identical to SEQ ID NO: 241110

SEQ ID NO: 443740 - RNA, 64 nt, Human; identical to SEQ ID NO: 241111

SEQ ID NO: 443741 - RNA, 64 nt, Human; identical to SEQ ID NO: 241112

SEQ ID NO: 443742 - RNA, 64 nt, Human; identical to SEQ ID NO: 241113

SEQ ID NO: 443743 - RNA, 64 nt, Human; identical to SEQ ID NO: 241114

SEQ ID NO: 443744 - RNA, 64 nt, Human; identical to SEQ ID NO: 241115

SEQ ID NO: 443745 - RNA, 61 nt, Human; identical to SEQ ID NO: 241116

SEQ ID NO: 443746 - RNA, 64 nt, Human; identical to SEQ ID NO: 241117

SEQ ID NO: 443747 - RNA, 64 nt, Human; identical to SEQ ID NO: 241121

SEQ ID NO: 443748 - RNA, 64 nt, Human; identical to SEQ ID NO: 241122

SEQ ID NO: 443749 - RNA, 64 nt, Human; identical to SEQ ID NO: 241123

SEQ ID NO: 443750 - RNA, 64 nt, Human; identical to SEQ ID NO: 241124

SEQ ID NO: 443751 - RNA, 64 nt, Human; identical to SEQ ID NO: 241125

SEQ ID NO: 443752 - RNA, 64 nt, Human; identical to SEQ ID NO: 241126

SEQ ID NO: 443753 - RNA, 64 nt, Human; identical to SEQ ID NO: 241127

SEQ ID NO: 443754 - RNA, 64 nt, Human; identical to SEQ ID NO: 241128

SEQ ID NO: 443755 - RNA, 64 nt, Human; identical to SEQ ID NO: 241129

SEQ ID NO: 443756 - RNA, 64 nt, Human; identical to SEQ ID NO: 241130

SEQ ID NO: 443757 - RNA, 64 nt, Human; identical to SEQ ID NO: 241131

SEQ ID NO: 443758 - RNA, 64 nt, Human; identical to SEQ ID NO: 241132

SEQ ID NO: 443759 - RNA, 64 nt, Human; identical to SEQ ID NO: 241133

SEQ ID NO: 443760 - RNA, 64 nt, Human; identical to SEQ ID NO: 241134

SEQ ID NO: 443761 - RNA, 64 nt, Human; identical to SEQ ID NO: 241135

SEQ ID NO: 443762 - RNA, 64 nt, Human; identical to SEQ ID NO: 241139

SEQ ID NO: 443763 - RNA, 64 nt, Human; identical to SEQ ID NO: 241140

SEQ ID NO: 443764 - RNA, 64 nt, Human; identical to SEQ ID NO: 241141

SEQ ID NO: 443765 - RNA, 64 nt, Human; identical to SEQ ID NO: 241142

SEQ ID NO: 443766 - RNA, 64 nt, Human; identical to SEQ ID NO: 241143

SEQ ID NO: 443767 - RNA, 64 nt, Human; identical to SEQ ID NO: 241144

SEQ ID NO: 443768 - RNA, 64 nt, Human; identical to SEQ ID NO: 241145

SEQ ID NO: 443769 - RNA, 64 nt, Human; identical to SEQ ID NO: 241146

SEQ ID NO: 443770 - RNA, 64 nt, Human; identical to SEQ ID NO: 241147

SEQ ID NO: 443771 - RNA, 64 nt, Human; identical to SEQ ID NO: 241148

SEQ ID NO: 443772 - RNA, 64 nt, Human; identical to SEQ ID NO: 241149

SEQ ID NO: 443773 - RNA, 64 nt, Human; identical to SEQ ID NO: 241150

SEQ ID NO: 443774 - RNA, 64 nt, Human; identical to SEQ ID NO: 241151

SEQ ID NO: 443775 - RNA, 64 nt, Human; identical to SEQ ID NO: 241152

SEQ ID NO: 443776 - RNA, 64 nt, Human; identical to SEQ ID NO: 241153

SEQ ID NO: 443777 - RNA, 64 nt, Human; identical to SEQ ID NO: 241157

SEQ ID NO: 443778 - RNA, 64 nt, Human; identical to SEQ ID NO: 241158

SEQ ID NO: 443779 - RNA, 64 nt, Human; identical to SEQ ID NO: 241159

SEQ ID NO: 443780 - RNA, 64 nt, Human; identical to SEQ ID NO: 241160

SEQ ID NO: 443781 - RNA, 64 nt, Human; identical to SEQ ID NO: 241161

SEQ ID NO: 443782 - RNA, 64 nt, Human; identical to SEQ ID NO: 241162

SEQ ID NO: 443783 - RNA, 64 nt, Human; identical to SEQ ID NO: 241163

SEQ ID NO: 443784 - RNA, 64 nt, Human; identical to SEQ ID NO: 241164

SEQ ID NO: 443785 - RNA, 64 nt, Human; identical to SEQ ID NO: 241165

SEQ ID NO: 443786 - RNA, 64 nt, Human; identical to SEQ ID NO: 241166

SEQ ID NO: 443787 - RNA, 64 nt, Human; identical to SEQ ID NO: 241167

SEQ ID NO: 443788 - RNA, 64 nt, Human; identical to SEQ ID NO: 241168

SEQ ID NO: 443789 - RNA, 62 nt, Human; identical to SEQ ID NO: 241169

SEQ ID NO: 443790 - RNA, 64 nt, Human; identical to SEQ ID NO: 241170

SEQ ID NO: 443791 - RNA, 64 nt, Human; identical to SEQ ID NO: 241171

SEQ ID NO: 443792 - RNA, 54 nt, Human; identical to SEQ ID NO: 241175

SEQ ID NO: 443793 - RNA, 64 nt, Human; identical to SEQ ID NO: 241176

SEQ ID NO: 443794 - RNA, 64 nt, Human; identical to SEQ ID NO: 241177

SEQ ID NO: 443795 - RNA, 64 nt, Human; identical to SEQ ID NO: 241178

SEQ ID NO: 443796 - RNA, 64 nt, Human; identical to SEQ ID NO: 241179

SEQ ID NO: 443797 - RNA, 64 nt, Human; identical to SEQ ID NO: 241180

SEQ ID NO: 443798 - RNA, 64 nt, Human; identical to SEQ ID NO: 241181

SEQ ID NO: 443799 - RNA, 64 nt, Human; identical to SEQ ID NO: 241182

SEQ ID NO: 443800 - RNA, 64 nt, Human; identical to SEQ ID NO: 241183

SEQ ID NO: 443801 - RNA, 64 nt, Human; identical to SEQ ID NO: 241184

SEQ ID NO: 443802 - RNA, 64 nt, Human; identical to SEQ ID NO: 241185

SEQ ID NO: 443803 - RNA, 64 nt, Human; identical to SEQ ID NO: 241186

SEQ ID NO: 443804 - RNA, 53 nt, Human; identical to SEQ ID NO: 241187

SEQ ID NO: 443805 - RNA, 64 nt, Human; identical to SEQ ID NO: 241188

SEQ ID NO: 443806 - RNA, 64 nt, Human; identical to SEQ ID NO: 241189

SEQ ID NO: 443807 - RNA, 64 nt, Human; identical to SEQ ID NO: 241193

SEQ ID NO: 443808 - RNA, 64 nt, Human; identical to SEQ ID NO: 241194

SEQ ID NO: 443809 - RNA, 64 nt, Human; identical to SEQ ID NO: 241195

SEQ ID NO: 443810 - RNA, 64 nt, Human; identical to SEQ ID NO: 241196

SEQ ID NO: 443811 - RNA, 64 nt, Human; identical to SEQ ID NO: 241197

SEQ ID NO: 443812 - RNA, 64 nt, Human; identical to SEQ ID NO: 241198

SEQ ID NO: 443813 - RNA, 64 nt, Human; identical to SEQ ID NO: 241199

SEQ ID NO: 443814 - RNA, 64 nt, Human; identical to SEQ ID NO: 241200

SEQ ID NO: 443815 - RNA, 64 nt, Human; identical to SEQ ID NO: 241201

SEQ ID NO: 443816 - RNA, 64 nt, Human; identical to SEQ ID NO: 241202

SEQ ID NO: 443817 - RNA, 64 nt, Human; identical to SEQ ID NO: 241203

SEQ ID NO: 443818 - RNA, 64 nt, Human; identical to SEQ ID NO: 241204

SEQ ID NO: 443819 - RNA, 64 nt, Human; identical to SEQ ID NO: 241205

SEQ ID NO: 443820 - RNA, 64 nt, Human; identical to SEQ ID NO: 241206

SEQ ID NO: 443821 - RNA, 64 nt, Human; identical to SEQ ID NO: 241207

SEQ ID NO: 443822 - RNA, 64 nt, Human; identical to SEQ ID NO: 241211

SEQ ID NO: 443823 - RNA, 64 nt, Human; identical to SEQ ID NO: 241212

SEQ ID NO: 443824 - RNA, 64 nt, Human; identical to SEQ ID NO: 241213

SEQ ID NO: 443825 - RNA, 64 nt, Human; identical to SEQ ID NO: 241214

SEQ ID NO: 443826 - RNA, 64 nt, Human; identical to SEQ ID NO: 241215

SEQ ID NO: 443827 - RNA, 64 nt, Human; identical to SEQ ID NO: 241216

SEQ ID NO: 443828 - RNA, 64 nt, Human; identical to SEQ ID NO: 241217

SEQ ID NO: 443829 - RNA, 64 nt, Human; identical to SEQ ID NO: 241218

SEQ ID NO: 443830 - RNA, 64 nt, Human; identical to SEQ ID NO: 241219

SEQ ID NO: 443831 - RNA, 64 nt, Human; identical to SEQ ID NO: 241220

SEQ ID NO: 443832 - RNA, 64 nt, Human; identical to SEQ ID NO: 241221

SEQ ID NO: 443833 - RNA, 64 nt, Human; identical to SEQ ID NO: 241222

SEQ ID NO: 443834 - RNA, 64 nt, Human; identical to SEQ ID NO: 241223

SEQ ID NO: 443835 - RNA, 64 nt, Human; identical to SEQ ID NO: 241224

SEQ ID NO: 443836 - RNA, 64 nt, Human; identical to SEQ ID NO: 241225

SEQ ID NO: 443837 - RNA, 64 nt, Human; identical to SEQ ID NO: 241229

SEQ ID NO: 443838 - RNA, 64 nt, Human; identical to SEQ ID NO: 241230

SEQ ID NO: 443839 - RNA, 53 nt, Human; identical to SEQ ID NO: 241231

SEQ ID NO: 443840 - RNA, 64 nt, Human; identical to SEQ ID NO: 241232

SEQ ID NO: 443841 - RNA, 64 nt, Human; identical to SEQ ID NO: 241233

SEQ ID NO: 443842 - RNA, 64 nt, Human; identical to SEQ ID NO: 241234

SEQ ID NO: 443843 - RNA, 64 nt, Human; identical to SEQ ID NO: 241235

SEQ ID NO: 443844 - RNA, 64 nt, Human; identical to SEQ ID NO: 241236

SEQ ID NO: 443845 - RNA, 59 nt, Human; identical to SEQ ID NO: 241237

SEQ ID NO: 443846 - RNA, 64 nt, Human; identical to SEQ ID NO: 241238

SEQ ID NO: 443847 - RNA, 64 nt, Human; identical to SEQ ID NO: 241239

SEQ ID NO: 443848 - RNA, 64 nt, Human; identical to SEQ ID NO: 241240

SEQ ID NO: 443849 - RNA, 64 nt, Human; identical to SEQ ID NO: 241241

SEQ ID NO: 443850 - RNA, 64 nt, Human; identical to SEQ ID NO: 241242

SEQ ID NO: 443851 - RNA, 64 nt, Human; identical to SEQ ID NO: 241243

SEQ ID NO: 443852 - RNA, 64 nt, Human; identical to SEQ ID NO: 241247

SEQ ID NO: 443853 - RNA, 64 nt, Human; identical to SEQ ID NO: 241248

SEQ ID NO: 443854 - RNA, 64 nt, Human; identical to SEQ ID NO: 241249

SEQ ID NO: 443855 - RNA, 64 nt, Human; identical to SEQ ID NO: 241250

SEQ ID NO: 443856 - RNA, 64 nt, Human; identical to SEQ ID NO: 241251

SEQ ID NO: 443857 - RNA, 64 nt, Human; identical to SEQ ID NO: 241252

SEQ ID NO: 443858 - RNA, 64 nt, Human; identical to SEQ ID NO: 241253

SEQ ID NO: 443859 - RNA, 64 nt, Human; identical to SEQ ID NO: 241254

SEQ ID NO: 443860 - RNA, 64 nt, Human; identical to SEQ ID NO: 241255

SEQ ID NO: 443861 - RNA, 64 nt, Human; identical to SEQ ID NO: 241256

SEQ ID NO: 443862 - RNA, 64 nt, Human; identical to SEQ ID NO: 241257

SEQ ID NO: 443863 - RNA, 64 nt, Human; identical to SEQ ID NO: 241258

SEQ ID NO: 443864 - RNA, 64 nt, Human; identical to SEQ ID NO: 241259

SEQ ID NO: 443865 - RNA, 64 nt, Human; identical to SEQ ID NO: 241260

SEQ ID NO: 443866 - RNA, 64 nt, Human; identical to SEQ ID NO: 241261

SEQ ID NO: 443867 - RNA, 64 nt, Human; identical to SEQ ID NO: 241265

SEQ ID NO: 443868 - RNA, 64 nt, Human; identical to SEQ ID NO: 241266

SEQ ID NO: 443869 - RNA, 64 nt, Human; identical to SEQ ID NO: 241267

SEQ ID NO: 443870 - RNA, 64 nt, Human; identical to SEQ ID NO: 241268

SEQ ID NO: 443871 - RNA, 64 nt, Human; identical to SEQ ID NO: 241269

SEQ ID NO: 443872 - RNA, 64 nt, Human; identical to SEQ ID NO: 241270

SEQ ID NO: 443873 - RNA, 64 nt, Human; identical to SEQ ID NO: 241271

SEQ ID NO: 443874 - RNA, 64 nt, Human; identical to SEQ ID NO: 241272

SEQ ID NO: 443875 - RNA, 64 nt, Human; identical to SEQ ID NO: 241273

SEQ ID NO: 443876 - RNA, 64 nt, Human; identical to SEQ ID NO: 241274

SEQ ID NO: 443877 - RNA, 64 nt, Human; identical to SEQ ID NO: 241275

SEQ ID NO: 443878 - RNA, 64 nt, Human; identical to SEQ ID NO: 241276

SEQ ID NO: 443879 - RNA, 64 nt, Human; identical to SEQ ID NO: 241277

SEQ ID NO: 443880 - RNA, 64 nt, Human; identical to SEQ ID NO: 241278

SEQ ID NO: 443881 - RNA, 64 nt, Human; identical to SEQ ID NO: 241279

SEQ ID NO: 443882 - RNA, 64 nt, Human; identical to SEQ ID NO: 241282

SEQ ID NO: 443883 - RNA, 64 nt, Human; identical to SEQ ID NO: 241283

SEQ ID NO: 443884 - RNA, 64 nt, Human; identical to SEQ ID NO: 241284

SEQ ID NO: 443885 - RNA, 64 nt, Human; identical to SEQ ID NO: 241285

SEQ ID NO: 443886 - RNA, 64 nt, Human; identical to SEQ ID NO: 241286

SEQ ID NO: 443887 - RNA, 59 nt, Human; identical to SEQ ID NO: 241287

SEQ ID NO: 443888 - RNA, 64 nt, Human; identical to SEQ ID NO: 241288

SEQ ID NO: 443889 - RNA, 64 nt, Human; identical to SEQ ID NO: 241289

SEQ ID NO: 443890 - RNA, 64 nt, Human; identical to SEQ ID NO: 241290

SEQ ID NO: 443891 - RNA, 64 nt, Human; identical to SEQ ID NO: 241291

SEQ ID NO: 443892 - RNA, 64 nt, Human; identical to SEQ ID NO: 241292

SEQ ID NO: 443893 - RNA, 64 nt, Human; identical to SEQ ID NO: 241293

SEQ ID NO: 443894 - RNA, 64 nt, Human; identical to SEQ ID NO: 241294

SEQ ID NO: 443895 - RNA, 64 nt, Human; identical to SEQ ID NO: 241295

SEQ ID NO: 443896 - RNA, 64 nt, Human; identical to SEQ ID NO: 241296

SEQ ID NO: 443897 - RNA, 64 nt, Human; identical to SEQ ID NO: 241300

SEQ ID NO: 443898 - RNA, 55 nt, Human; identical to SEQ ID NO: 241301

SEQ ID NO: 443899 - RNA, 64 nt, Human; identical to SEQ ID NO: 241302

SEQ ID NO: 443900 - RNA, 64 nt, Human; identical to SEQ ID NO: 241303

SEQ ID NO: 443901 - RNA, 64 nt, Human; identical to SEQ ID NO: 241304

SEQ ID NO: 443902 - RNA, 64 nt, Human; identical to SEQ ID NO: 241305

SEQ ID NO: 443903 - RNA, 64 nt, Human; identical to SEQ ID NO: 241306

SEQ ID NO: 443904 - RNA, 64 nt, Human; identical to SEQ ID NO: 241307

SEQ ID NO: 443905 - RNA, 64 nt, Human; identical to SEQ ID NO: 241308

SEQ ID NO: 443906 - RNA, 64 nt, Human; identical to SEQ ID NO: 241309

SEQ ID NO: 443907 - RNA, 64 nt, Human; identical to SEQ ID NO: 241310

SEQ ID NO: 443908 - RNA, 64 nt, Human; identical to SEQ ID NO: 241311

SEQ ID NO: 443909 - RNA, 64 nt, Human; identical to SEQ ID NO: 241312

SEQ ID NO: 443910 - RNA, 64 nt, Human; identical to SEQ ID NO: 241313

SEQ ID NO: 443911 - RNA, 64 nt, Human; identical to SEQ ID NO: 241314

SEQ ID NO: 443912 - RNA, 64 nt, Human; identical to SEQ ID NO: 241319

SEQ ID NO: 443913 - RNA, 64 nt, Human; identical to SEQ ID NO: 241320

SEQ ID NO: 443914 - RNA, 64 nt, Human; identical to SEQ ID NO: 241321

SEQ ID NO: 443915 - RNA, 64 nt, Human; identical to SEQ ID NO: 241322

SEQ ID NO: 443916 - RNA, 64 nt, Human; identical to SEQ ID NO: 241323

SEQ ID NO: 443917 - RNA, 64 nt, Human; identical to SEQ ID NO: 241324

SEQ ID NO: 443918 - RNA, 64 nt, Human; identical to SEQ ID NO: 241325

SEQ ID NO: 443919 - RNA, 64 nt, Human; identical to SEQ ID NO: 241326

SEQ ID NO: 443920 - RNA, 64 nt, Human; identical to SEQ ID NO: 241327

SEQ ID NO: 443921 - RNA, 64 nt, Human; identical to SEQ ID NO: 241328

SEQ ID NO: 443922 - RNA, 56 nt, Human; identical to SEQ ID NO: 241329

SEQ ID NO: 443923 - RNA, 64 nt, Human; identical to SEQ ID NO: 241330

SEQ ID NO: 443924 - RNA, 64 nt, Human; identical to SEQ ID NO: 241331

SEQ ID NO: 443925 - RNA, 64 nt, Human; identical to SEQ ID NO: 241332

SEQ ID NO: 443926 - RNA, 64 nt, Human; identical to SEQ ID NO: 241333

SEQ ID NO: 443927 - RNA, 64 nt, Human; identical to SEQ ID NO: 241337

SEQ ID NO: 443928 - RNA, 64 nt, Human; identical to SEQ ID NO: 241338

SEQ ID NO: 443929 - RNA, 64 nt, Human; identical to SEQ ID NO: 241339

SEQ ID NO: 443930 - RNA, 64 nt, Human; identical to SEQ ID NO: 241340

SEQ ID NO: 443931 - RNA, 64 nt, Human; identical to SEQ ID NO: 241341

SEQ ID NO: 443932 - RNA, 64 nt, Human; identical to SEQ ID NO: 241342

SEQ ID NO: 443933 - RNA, 64 nt, Human; identical to SEQ ID NO: 241343

SEQ ID NO: 443934 - RNA, 64 nt, Human; identical to SEQ ID NO: 241344

SEQ ID NO: 443935 - RNA, 64 nt, Human; identical to SEQ ID NO: 241345

SEQ ID NO: 443936 - RNA, 64 nt, Human; identical to SEQ ID NO: 241346

SEQ ID NO: 443937 - RNA, 64 nt, Human; identical to SEQ ID NO: 241347

SEQ ID NO: 443938 - RNA, 54 nt, Human; identical to SEQ ID NO: 241348

SEQ ID NO: 443939 - RNA, 64 nt, Human; identical to SEQ ID NO: 241349

SEQ ID NO: 443940 - RNA, 64 nt, Human; identical to SEQ ID NO: 241350

SEQ ID NO: 443941 - RNA, 64 nt, Human; identical to SEQ ID NO: 241351

SEQ ID NO: 443942 - RNA, 64 nt, Human; identical to SEQ ID NO: 241356

SEQ ID NO: 443943 - RNA, 64 nt, Human; identical to SEQ ID NO: 241357

SEQ ID NO: 443944 - RNA, 64 nt, Human; identical to SEQ ID NO: 241358

SEQ ID NO: 443945 - RNA, 64 nt, Human; identical to SEQ ID NO: 241359

SEQ ID NO: 443946 - RNA, 64 nt, Human; identical to SEQ ID NO: 241360

SEQ ID NO: 443947 - RNA, 64 nt, Human; identical to SEQ ID NO: 241361

SEQ ID NO: 443948 - RNA, 64 nt, Human; identical to SEQ ID NO: 241362

SEQ ID NO: 443949 - RNA, 64 nt, Human; identical to SEQ ID NO: 241363

SEQ ID NO: 443950 - RNA, 64 nt, Human; identical to SEQ ID NO: 241364

SEQ ID NO: 443951 - RNA, 64 nt, Human; identical to SEQ ID NO: 241365

SEQ ID NO: 443952 - RNA, 64 nt, Human; identical to SEQ ID NO: 241366

SEQ ID NO: 443953 - RNA, 64 nt, Human; identical to SEQ ID NO: 241367

SEQ ID NO: 443954 - RNA, 64 nt, Human; identical to SEQ ID NO: 241368

SEQ ID NO: 443955 - RNA, 64 nt, Human; identical to SEQ ID NO: 241369

SEQ ID NO: 443956 - RNA, 64 nt, Human; identical to SEQ ID NO: 241370

SEQ ID NO: 443957 - RNA, 64 nt, Human; identical to SEQ ID NO: 241374

SEQ ID NO: 443958 - RNA, 64 nt, Human; identical to SEQ ID NO: 241375

SEQ ID NO: 443959 - RNA, 64 nt, Human; identical to SEQ ID NO: 241376

SEQ ID NO: 443960 - RNA, 64 nt, Human; identical to SEQ ID NO: 241377

SEQ ID NO: 443961 - RNA, 64 nt, Human; identical to SEQ ID NO: 241378

SEQ ID NO: 443962 - RNA, 64 nt, Human; identical to SEQ ID NO: 241379

SEQ ID NO: 443963 - RNA, 64 nt, Human; identical to SEQ ID NO: 241380

SEQ ID NO: 443964 - RNA, 64 nt, Human; identical to SEQ ID NO: 241381

SEQ ID NO: 443965 - RNA, 64 nt, Human; identical to SEQ ID NO: 241382

SEQ ID NO: 443966 - RNA, 64 nt, Human; identical to SEQ ID NO: 241383

SEQ ID NO: 443967 - RNA, 64 nt, Human; identical to SEQ ID NO: 241384

SEQ ID NO: 443968 - RNA, 64 nt, Human; identical to SEQ ID NO: 241385

SEQ ID NO: 443969 - RNA, 64 nt, Human; identical to SEQ ID NO: 241386

SEQ ID NO: 443970 - RNA, 64 nt, Human; identical to SEQ ID NO: 241387

SEQ ID NO: 443971 - RNA, 63 nt, Human; identical to SEQ ID NO: 241388

SEQ ID NO: 443972 - RNA, 64 nt, Human; identical to SEQ ID NO: 241392

SEQ ID NO: 443973 - RNA, 59 nt, Human; identical to SEQ ID NO: 241393

SEQ ID NO: 443974 - RNA, 64 nt, Human; identical to SEQ ID NO: 241394

SEQ ID NO: 443975 - RNA, 64 nt, Human; identical to SEQ ID NO: 241395

SEQ ID NO: 443976 - RNA, 64 nt, Human; identical to SEQ ID NO: 241396

SEQ ID NO: 443977 - RNA, 64 nt, Human; identical to SEQ ID NO: 241397

SEQ ID NO: 443978 - RNA, 64 nt, Human; identical to SEQ ID NO: 241398

SEQ ID NO: 443979 - RNA, 64 nt, Human; identical to SEQ ID NO: 241399

SEQ ID NO: 443980 - RNA, 64 nt, Human; identical to SEQ ID NO: 241400

SEQ ID NO: 443981 - RNA, 64 nt, Human; identical to SEQ ID NO: 241401

SEQ ID NO: 443982 - RNA, 64 nt, Human; identical to SEQ ID NO: 241402

SEQ ID NO: 443983 - RNA, 64 nt, Human; identical to SEQ ID NO: 241403

SEQ ID NO: 443984 - RNA, 64 nt, Human; identical to SEQ ID NO: 241404

SEQ ID NO: 443985 - RNA, 64 nt, Human; identical to SEQ ID NO: 241405

SEQ ID NO: 443986 - RNA, 64 nt, Human; identical to SEQ ID NO: 241406

SEQ ID NO: 443987 - RNA, 64 nt, Human; identical to SEQ ID NO: 241410

SEQ ID NO: 443988 - RNA, 64 nt, Human; identical to SEQ ID NO: 241411

SEQ ID NO: 443989 - RNA, 64 nt, Human; identical to SEQ ID NO: 241412

SEQ ID NO: 443990 - RNA, 64 nt, Human; identical to SEQ ID NO: 241413

SEQ ID NO: 443991 - RNA, 64 nt, Human; identical to SEQ ID NO: 241414

SEQ ID NO: 443992 - RNA, 64 nt, Human; identical to SEQ ID NO: 241415

SEQ ID NO: 443993 - RNA, 57 nt, Human; identical to SEQ ID NO: 241416

SEQ ID NO: 443994 - RNA, 64 nt, Human; identical to SEQ ID NO: 241417

SEQ ID NO: 443995 - RNA, 64 nt, Human; identical to SEQ ID NO: 241418

SEQ ID NO: 443996 - RNA, 64 nt, Human; identical to SEQ ID NO: 241419

SEQ ID NO: 443997 - RNA, 64 nt, Human; identical to SEQ ID NO: 241420

SEQ ID NO: 443998 - RNA, 64 nt, Human; identical to SEQ ID NO: 241421

SEQ ID NO: 443999 - RNA, 54 nt, Human; identical to SEQ ID NO: 241422

SEQ ID NO: 444000 - RNA, 64 nt, Human; identical to SEQ ID NO: 241423

SEQ ID NO: 444001 - RNA, 64 nt, Human; identical to SEQ ID NO: 241424

SEQ ID NO: 444002 - RNA, 64 nt, Human; identical to SEQ ID NO: 241428

SEQ ID NO: 444003 - RNA, 64 nt, Human; identical to SEQ ID NO: 241429

SEQ ID NO: 444004 - RNA, 64 nt, Human; identical to SEQ ID NO: 241430

SEQ ID NO: 444005 - RNA, 64 nt, Human; identical to SEQ ID NO: 241431

SEQ ID NO: 444006 - RNA, 64 nt, Human; identical to SEQ ID NO: 241432

SEQ ID NO: 444007 - RNA, 64 nt, Human; identical to SEQ ID NO: 241433

SEQ ID NO: 444008 - RNA, 64 nt, Human; identical to SEQ ID NO: 241434

SEQ ID NO: 444009 - RNA, 64 nt, Human; identical to SEQ ID NO: 241435

SEQ ID NO: 444010 - RNA, 64 nt, Human; identical to SEQ ID NO: 241436

SEQ ID NO: 444011 - RNA, 64 nt, Human; identical to SEQ ID NO: 241437

SEQ ID NO: 444012 - RNA, 64 nt, Human; identical to SEQ ID NO: 241438

SEQ ID NO: 444013 - RNA, 64 nt, Human; identical to SEQ ID NO: 241439

SEQ ID NO: 444014 - RNA, 64 nt, Human; identical to SEQ ID NO: 241440

SEQ ID NO: 444015 - RNA, 64 nt, Human; identical to SEQ ID NO: 241441

SEQ ID NO: 444016 - RNA, 64 nt, Human; identical to SEQ ID NO: 241442

SEQ ID NO: 444017 - RNA, 64 nt, Human; identical to SEQ ID NO: 241446

SEQ ID NO: 444018 - RNA, 64 nt, Human; identical to SEQ ID NO: 241447

SEQ ID NO: 444019 - RNA, 64 nt, Human; identical to SEQ ID NO: 241448

SEQ ID NO: 444020 - RNA, 64 nt, Human; identical to SEQ ID NO: 241449

SEQ ID NO: 444021 - RNA, 64 nt, Human; identical to SEQ ID NO: 241450

SEQ ID NO: 444022 - RNA, 64 nt, Human; identical to SEQ ID NO: 241451

SEQ ID NO: 444023 - RNA, 64 nt, Human; identical to SEQ ID NO: 241452

SEQ ID NO: 444024 - RNA, 64 nt, Human; identical to SEQ ID NO: 241453

SEQ ID NO: 444025 - RNA, 64 nt, Human; identical to SEQ ID NO: 241454

SEQ ID NO: 444026 - RNA, 64 nt, Human; identical to SEQ ID NO: 241455

SEQ ID NO: 444027 - RNA, 64 nt, Human; identical to SEQ ID NO: 241456

SEQ ID NO: 444028 - RNA, 64 nt, Human; identical to SEQ ID NO: 241457

SEQ ID NO: 444029 - RNA, 64 nt, Human; identical to SEQ ID NO: 241458

SEQ ID NO: 444030 - RNA, 64 nt, Human; identical to SEQ ID NO: 241459

SEQ ID NO: 444031 - RNA, 64 nt, Human; identical to SEQ ID NO: 241460

SEQ ID NO: 444032 - RNA, 64 nt, Human; identical to SEQ ID NO: 241462

SEQ ID NO: 444033 - RNA, 64 nt, Human; identical to SEQ ID NO: 241463

SEQ ID NO: 444034 - RNA, 64 nt, Human; identical to SEQ ID NO: 241464

SEQ ID NO: 444035 - RNA, 64 nt, Human; identical to SEQ ID NO: 241465

SEQ ID NO: 444036 - RNA, 64 nt, Human; identical to SEQ ID NO: 241466

SEQ ID NO: 444037 - RNA, 64 nt, Human; identical to SEQ ID NO: 241467

SEQ ID NO: 444038 - RNA, 64 nt, Human; identical to SEQ ID NO: 241468

SEQ ID NO: 444039 - RNA, 64 nt, Human; identical to SEQ ID NO: 241469

SEQ ID NO: 444040 - RNA, 64 nt, Human; identical to SEQ ID NO: 241470

SEQ ID NO: 444041 - RNA, 64 nt, Human; identical to SEQ ID NO: 241471

SEQ ID NO: 444042 - RNA, 64 nt, Human; identical to SEQ ID NO: 241472

SEQ ID NO: 444043 - RNA, 64 nt, Human; identical to SEQ ID NO: 241473

SEQ ID NO: 444044 - RNA, 64 nt, Human; identical to SEQ ID NO: 241474

SEQ ID NO: 444045 - RNA, 64 nt, Human; identical to SEQ ID NO: 241475

SEQ ID NO: 444046 - RNA, 64 nt, Human; identical to SEQ ID NO: 241476

SEQ ID NO: 444047 - RNA, 64 nt, Human; identical to SEQ ID NO: 241480

SEQ ID NO: 444048 - RNA, 64 nt, Human; identical to SEQ ID NO: 241481

SEQ ID NO: 444049 - RNA, 64 nt, Human; identical to SEQ ID NO: 241482

SEQ ID NO: 444050 - RNA, 64 nt, Human; identical to SEQ ID NO: 241483

SEQ ID NO: 444051 - RNA, 64 nt, Human; identical to SEQ ID NO: 241484

SEQ ID NO: 444052 - RNA, 64 nt, Human; identical to SEQ ID NO: 241485

SEQ ID NO: 444053 - RNA, 64 nt, Human; identical to SEQ ID NO: 241486

SEQ ID NO: 444054 - RNA, 64 nt, Human; identical to SEQ ID NO: 241487

SEQ ID NO: 444055 - RNA, 64 nt, Human; identical to SEQ ID NO: 241488

SEQ ID NO: 444056 - RNA, 64 nt, Human; identical to SEQ ID NO: 241489

SEQ ID NO: 444057 - RNA, 64 nt, Human; identical to SEQ ID NO: 241490

SEQ ID NO: 444058 - RNA, 64 nt, Human; identical to SEQ ID NO: 241491

SEQ ID NO: 444059 - RNA, 64 nt, Human; identical to SEQ ID NO: 241492

SEQ ID NO: 444060 - RNA, 64 nt, Human; identical to SEQ ID NO: 241493

SEQ ID NO: 444061 - RNA, 64 nt, Human; identical to SEQ ID NO: 241494

SEQ ID NO: 444062 - RNA, 64 nt, Human; identical to SEQ ID NO: 241497

SEQ ID NO: 444063 - RNA, 64 nt, Human; identical to SEQ ID NO: 241498

SEQ ID NO: 444064 - RNA, 64 nt, Human; identical to SEQ ID NO: 241499

SEQ ID NO: 444065 - RNA, 64 nt, Human; identical to SEQ ID NO: 241500

SEQ ID NO: 444066 - RNA, 64 nt, Human; identical to SEQ ID NO: 241501

SEQ ID NO: 444067 - RNA, 64 nt, Human; identical to SEQ ID NO: 241502

SEQ ID NO: 444068 - RNA, 64 nt, Human; identical to SEQ ID NO: 241503

SEQ ID NO: 444069 - RNA, 64 nt, Human; identical to SEQ ID NO: 241504

SEQ ID NO: 444070 - RNA, 64 nt, Human; identical to SEQ ID NO: 241505

SEQ ID NO: 444071 - RNA, 64 nt, Human; identical to SEQ ID NO: 241506

SEQ ID NO: 444072 - RNA, 64 nt, Human; identical to SEQ ID NO: 241507

SEQ ID NO: 444073 - RNA, 64 nt, Human; identical to SEQ ID NO: 241508

SEQ ID NO: 444074 - RNA, 64 nt, Human; identical to SEQ ID NO: 241509

SEQ ID NO: 444075 - RNA, 64 nt, Human; identical to SEQ ID NO: 241510

SEQ ID NO: 444076 - RNA, 64 nt, Human; identical to SEQ ID NO: 241511

SEQ ID NO: 444077 - RNA, 64 nt, Human; identical to SEQ ID NO: 241515

SEQ ID NO: 444078 - RNA, 64 nt, Human; identical to SEQ ID NO: 241516

SEQ ID NO: 444079 - RNA, 64 nt, Human; identical to SEQ ID NO: 241517

SEQ ID NO: 444080 - RNA, 64 nt, Human; identical to SEQ ID NO: 241518

SEQ ID NO: 444081 - RNA, 64 nt, Human; identical to SEQ ID NO: 241519

SEQ ID NO: 444082 - RNA, 64 nt, Human; identical to SEQ ID NO: 241520

SEQ ID NO: 444083 - RNA, 64 nt, Human; identical to SEQ ID NO: 241521

SEQ ID NO: 444084 - RNA, 64 nt, Human; identical to SEQ ID NO: 241522

SEQ ID NO: 444085 - RNA, 64 nt, Human; identical to SEQ ID NO: 241523

SEQ ID NO: 444086 - RNA, 64 nt, Human; identical to SEQ ID NO: 241524

SEQ ID NO: 444087 - RNA, 64 nt, Human; identical to SEQ ID NO: 241525

SEQ ID NO: 444088 - RNA, 64 nt, Human; identical to SEQ ID NO: 241526

SEQ ID NO: 444089 - RNA, 64 nt, Human; identical to SEQ ID NO: 241527

SEQ ID NO: 444090 - RNA, 64 nt, Human; identical to SEQ ID NO: 241528

SEQ ID NO: 444091 - RNA, 64 nt, Human; identical to SEQ ID NO: 241529

SEQ ID NO: 444092 - RNA, 64 nt, Human; identical to SEQ ID NO: 241533

SEQ ID NO: 444093 - RNA, 64 nt, Human; identical to SEQ ID NO: 241534

SEQ ID NO: 444094 - RNA, 64 nt, Human; identical to SEQ ID NO: 241535

SEQ ID NO: 444095 - RNA, 64 nt, Human; identical to SEQ ID NO: 241536

SEQ ID NO: 444096 - RNA, 64 nt, Human; identical to SEQ ID NO: 241537

SEQ ID NO: 444097 - RNA, 64 nt, Human; identical to SEQ ID NO: 241538

SEQ ID NO: 444098 - RNA, 64 nt, Human; identical to SEQ ID NO: 241539

SEQ ID NO: 444099 - RNA, 64 nt, Human; identical to SEQ ID NO: 241540

SEQ ID NO: 444100 - RNA, 64 nt, Human; identical to SEQ ID NO: 241541

SEQ ID NO: 444101 - RNA, 64 nt, Human; identical to SEQ ID NO: 241542

SEQ ID NO: 444102 - RNA, 64 nt, Human; identical to SEQ ID NO: 241543

SEQ ID NO: 444103 - RNA, 64 nt, Human; identical to SEQ ID NO: 241544

SEQ ID NO: 444104 - RNA, 64 nt, Human; identical to SEQ ID NO: 241545

SEQ ID NO: 444105 - RNA, 64 nt, Human; identical to SEQ ID NO: 241546

SEQ ID NO: 444106 - RNA, 64 nt, Human; identical to SEQ ID NO: 241547

SEQ ID NO: 444107 - RNA, 64 nt, Human; identical to SEQ ID NO: 241551

SEQ ID NO: 444108 - RNA, 64 nt, Human; identical to SEQ ID NO: 241552

SEQ ID NO: 444109 - RNA, 64 nt, Human; identical to SEQ ID NO: 241553

SEQ ID NO: 444110 - RNA, 64 nt, Human; identical to SEQ ID NO: 241554

SEQ ID NO: 444111 - RNA, 64 nt, Human; identical to SEQ ID NO: 241555

SEQ ID NO: 444112 - RNA, 64 nt, Human; identical to SEQ ID NO: 241556

SEQ ID NO: 444113 - RNA, 64 nt, Human; identical to SEQ ID NO: 241557

SEQ ID NO: 444114 - RNA, 64 nt, Human; identical to SEQ ID NO: 241558

SEQ ID NO: 444115 - RNA, 64 nt, Human; identical to SEQ ID NO: 241559

SEQ ID NO: 444116 - RNA, 64 nt, Human; identical to SEQ ID NO: 241560

SEQ ID NO: 444117 - RNA, 64 nt, Human; identical to SEQ ID NO: 241561

SEQ ID NO: 444118 - RNA, 64 nt, Human; identical to SEQ ID NO: 241562

SEQ ID NO: 444119 - RNA, 64 nt, Human; identical to SEQ ID NO: 241563

SEQ ID NO: 444120 - RNA, 64 nt, Human; identical to SEQ ID NO: 241564

SEQ ID NO: 444121 - RNA, 64 nt, Human; identical to SEQ ID NO: 241565

SEQ ID NO: 444122 - RNA, 64 nt, Human; identical to SEQ ID NO: 241569

SEQ ID NO: 444123 - RNA, 64 nt, Human; identical to SEQ ID NO: 241570

SEQ ID NO: 444124 - RNA, 64 nt, Human; identical to SEQ ID NO: 241571

SEQ ID NO: 444125 - RNA, 64 nt, Human; identical to SEQ ID NO: 241572

SEQ ID NO: 444126 - RNA, 64 nt, Human; identical to SEQ ID NO: 241573

SEQ ID NO: 444127 - RNA, 64 nt, Human; identical to SEQ ID NO: 241574

SEQ ID NO: 444128 - RNA, 64 nt, Human; identical to SEQ ID NO: 241575

SEQ ID NO: 444129 - RNA, 64 nt, Human; identical to SEQ ID NO: 241576

SEQ ID NO: 444130 - RNA, 64 nt, Human; identical to SEQ ID NO: 241577

SEQ ID NO: 444131 - RNA, 64 nt, Human; identical to SEQ ID NO: 241578

SEQ ID NO: 444132 - RNA, 64 nt, Human; identical to SEQ ID NO: 241579

SEQ ID NO: 444133 - RNA, 64 nt, Human; identical to SEQ ID NO: 241580

SEQ ID NO: 444134 - RNA, 64 nt, Human; identical to SEQ ID NO: 241581

SEQ ID NO: 444135 - RNA, 64 nt, Human; identical to SEQ ID NO: 241582

SEQ ID NO: 444136 - RNA, 64 nt, Human; identical to SEQ ID NO: 241583

SEQ ID NO: 444137 - RNA, 64 nt, Human; identical to SEQ ID NO: 241587

SEQ ID NO: 444138 - RNA, 57 nt, Human; identical to SEQ ID NO: 241588

SEQ ID NO: 444139 - RNA, 64 nt, Human; identical to SEQ ID NO: 241589

SEQ ID NO: 444140 - RNA, 64 nt, Human; identical to SEQ ID NO: 241590

SEQ ID NO: 444141 - RNA, 64 nt, Human; identical to SEQ ID NO: 241591

SEQ ID NO: 444142 - RNA, 64 nt, Human; identical to SEQ ID NO: 241592

SEQ ID NO: 444143 - RNA, 64 nt, Human; identical to SEQ ID NO: 241593

SEQ ID NO: 444144 - RNA, 64 nt, Human; identical to SEQ ID NO: 241594

SEQ ID NO: 444145 - RNA, 64 nt, Human; identical to SEQ ID NO: 241595

SEQ ID NO: 444146 - RNA, 64 nt, Human; identical to SEQ ID NO: 241596

SEQ ID NO: 444147 - RNA, 64 nt, Human; identical to SEQ ID NO: 241597

SEQ ID NO: 444148 - RNA, 64 nt, Human; identical to SEQ ID NO: 241598

SEQ ID NO: 444149 - RNA, 64 nt, Human; identical to SEQ ID NO: 241599

SEQ ID NO: 444150 - RNA, 64 nt, Human; identical to SEQ ID NO: 241600

SEQ ID NO: 444151 - RNA, 64 nt, Human; identical to SEQ ID NO: 241601

SEQ ID NO: 444152 - RNA, 64 nt, Human; identical to SEQ ID NO: 241605

SEQ ID NO: 444153 - RNA, 64 nt, Human; identical to SEQ ID NO: 241606

SEQ ID NO: 444154 - RNA, 64 nt, Human; identical to SEQ ID NO: 241607

SEQ ID NO: 444155 - RNA, 64 nt, Human; identical to SEQ ID NO: 241608

SEQ ID NO: 444156 - RNA, 64 nt, Human; identical to SEQ ID NO: 241609

SEQ ID NO: 444157 - RNA, 64 nt, Human; identical to SEQ ID NO: 241610

SEQ ID NO: 444158 - RNA, 64 nt, Human; identical to SEQ ID NO: 241611

SEQ ID NO: 444159 - RNA, 64 nt, Human; identical to SEQ ID NO: 241612

SEQ ID NO: 444160 - RNA, 64 nt, Human; identical to SEQ ID NO: 241613

SEQ ID NO: 444161 - RNA, 64 nt, Human; identical to SEQ ID NO: 241614

SEQ ID NO: 444162 - RNA, 64 nt, Human; identical to SEQ ID NO: 241615

SEQ ID NO: 444163 - RNA, 64 nt, Human; identical to SEQ ID NO: 241616

SEQ ID NO: 444164 - RNA, 64 nt, Human; identical to SEQ ID NO: 241617

SEQ ID NO: 444165 - RNA, 64 nt, Human; identical to SEQ ID NO: 241618

SEQ ID NO: 444166 - RNA, 64 nt, Human; identical to SEQ ID NO: 241619

SEQ ID NO: 444167 - RNA, 64 nt, Human; identical to SEQ ID NO: 241623

SEQ ID NO: 444168 - RNA, 64 nt, Human; identical to SEQ ID NO: 241624

SEQ ID NO: 444169 - RNA, 64 nt, Human; identical to SEQ ID NO: 241625

SEQ ID NO: 444170 - RNA, 64 nt, Human; identical to SEQ ID NO: 241626

SEQ ID NO: 444171 - RNA, 64 nt, Human; identical to SEQ ID NO: 241627

SEQ ID NO: 444172 - RNA, 64 nt, Human; identical to SEQ ID NO: 241628

SEQ ID NO: 444173 - RNA, 64 nt, Human; identical to SEQ ID NO: 241629

SEQ ID NO: 444174 - RNA, 64 nt, Human; identical to SEQ ID NO: 241630

SEQ ID NO: 444175 - RNA, 64 nt, Human; identical to SEQ ID NO: 241631

SEQ ID NO: 444176 - RNA, 64 nt, Human; identical to SEQ ID NO: 241632

SEQ ID NO: 444177 - RNA, 64 nt, Human; identical to SEQ ID NO: 241633

SEQ ID NO: 444178 - RNA, 64 nt, Human; identical to SEQ ID NO: 241634

SEQ ID NO: 444179 - RNA, 64 nt, Human; identical to SEQ ID NO: 241635

SEQ ID NO: 444180 - RNA, 64 nt, Human; identical to SEQ ID NO: 241636

SEQ ID NO: 444181 - RNA, 64 nt, Human; identical to SEQ ID NO: 241637

SEQ ID NO: 444182 - RNA, 64 nt, Human; identical to SEQ ID NO: 241641

SEQ ID NO: 444183 - RNA, 64 nt, Human; identical to SEQ ID NO: 241642

SEQ ID NO: 444184 - RNA, 64 nt, Human; identical to SEQ ID NO: 241643

SEQ ID NO: 444185 - RNA, 64 nt, Human; identical to SEQ ID NO: 241644

SEQ ID NO: 444186 - RNA, 64 nt, Human; identical to SEQ ID NO: 241645

SEQ ID NO: 444187 - RNA, 64 nt, Human; identical to SEQ ID NO: 241646

SEQ ID NO: 444188 - RNA, 64 nt, Human; identical to SEQ ID NO: 241647

SEQ ID NO: 444189 - RNA, 64 nt, Human; identical to SEQ ID NO: 241648

SEQ ID NO: 444190 - RNA, 64 nt, Human; identical to SEQ ID NO: 241649

SEQ ID NO: 444191 - RNA, 64 nt, Human; identical to SEQ ID NO: 241650

SEQ ID NO: 444192 - RNA, 64 nt, Human; identical to SEQ ID NO: 241651

SEQ ID NO: 444193 - RNA, 64 nt, Human; identical to SEQ ID NO: 241652

SEQ ID NO: 444194 - RNA, 64 nt, Human; identical to SEQ ID NO: 241653

SEQ ID NO: 444195 - RNA, 64 nt, Human; identical to SEQ ID NO: 241654

SEQ ID NO: 444196 - RNA, 64 nt, Human; identical to SEQ ID NO: 241655

SEQ ID NO: 444197 - RNA, 64 nt, Human; identical to SEQ ID NO: 241659

SEQ ID NO: 444198 - RNA, 64 nt, Human; identical to SEQ ID NO: 241660

SEQ ID NO: 444199 - RNA, 64 nt, Human; identical to SEQ ID NO: 241661

SEQ ID NO: 444200 - RNA, 64 nt, Human; identical to SEQ ID NO: 241662

SEQ ID NO: 444201 - RNA, 64 nt, Human; identical to SEQ ID NO: 241663

SEQ ID NO: 444202 - RNA, 64 nt, Human; identical to SEQ ID NO: 241664

SEQ ID NO: 444203 - RNA, 64 nt, Human; identical to SEQ ID NO: 241665

SEQ ID NO: 444204 - RNA, 64 nt, Human; identical to SEQ ID NO: 241666

SEQ ID NO: 444205 - RNA, 64 nt, Human; identical to SEQ ID NO: 241667

SEQ ID NO: 444206 - RNA, 64 nt, Human; identical to SEQ ID NO: 241668

SEQ ID NO: 444207 - RNA, 64 nt, Human; identical to SEQ ID NO: 241669

SEQ ID NO: 444208 - RNA, 64 nt, Human; identical to SEQ ID NO: 241670

SEQ ID NO: 444209 - RNA, 64 nt, Human; identical to SEQ ID NO: 241671

SEQ ID NO: 444210 - RNA, 64 nt, Human; identical to SEQ ID NO: 241672

SEQ ID NO: 444211 - RNA, 64 nt, Human; identical to SEQ ID NO: 241673

SEQ ID NO: 444212 - RNA, 64 nt, Human; identical to SEQ ID NO: 241677

SEQ ID NO: 444213 - RNA, 64 nt, Human; identical to SEQ ID NO: 241678

SEQ ID NO: 444214 - RNA, 64 nt, Human; identical to SEQ ID NO: 241679

SEQ ID NO: 444215 - RNA, 64 nt, Human; identical to SEQ ID NO: 241680

SEQ ID NO: 444216 - RNA, 64 nt, Human; identical to SEQ ID NO: 241681

SEQ ID NO: 444217 - RNA, 64 nt, Human; identical to SEQ ID NO: 241682

SEQ ID NO: 444218 - RNA, 64 nt, Human; identical to SEQ ID NO: 241683

SEQ ID NO: 444219 - RNA, 64 nt, Human; identical to SEQ ID NO: 241684

SEQ ID NO: 444220 - RNA, 64 nt, Human; identical to SEQ ID NO: 241685

SEQ ID NO: 444221 - RNA, 64 nt, Human; identical to SEQ ID NO: 241686

SEQ ID NO: 444222 - RNA, 55 nt, Human; identical to SEQ ID NO: 241687

SEQ ID NO: 444223 - RNA, 64 nt, Human; identical to SEQ ID NO: 241688

SEQ ID NO: 444224 - RNA, 64 nt, Human; identical to SEQ ID NO: 241689

SEQ ID NO: 444225 - RNA, 64 nt, Human; identical to SEQ ID NO: 241690

SEQ ID NO: 444226 - RNA, 64 nt, Human; identical to SEQ ID NO: 241691

SEQ ID NO: 444227 - RNA, 64 nt, Human; identical to SEQ ID NO: 241695

SEQ ID NO: 444228 - RNA, 64 nt, Human; identical to SEQ ID NO: 241696

SEQ ID NO: 444229 - RNA, 64 nt, Human; identical to SEQ ID NO: 241697

SEQ ID NO: 444230 - RNA, 64 nt, Human; identical to SEQ ID NO: 241698

SEQ ID NO: 444231 - RNA, 64 nt, Human; identical to SEQ ID NO: 241699

SEQ ID NO: 444232 - RNA, 64 nt, Human; identical to SEQ ID NO: 241700

SEQ ID NO: 444233 - RNA, 64 nt, Human; identical to SEQ ID NO: 241701

SEQ ID NO: 444234 - RNA, 64 nt, Human; identical to SEQ ID NO: 241702

SEQ ID NO: 444235 - RNA, 64 nt, Human; identical to SEQ ID NO: 241703

SEQ ID NO: 444236 - RNA, 64 nt, Human; identical to SEQ ID NO: 241704

SEQ ID NO: 444237 - RNA, 64 nt, Human; identical to SEQ ID NO: 241705

SEQ ID NO: 444238 - RNA, 64 nt, Human; identical to SEQ ID NO: 241706

SEQ ID NO: 444239 - RNA, 64 nt, Human; identical to SEQ ID NO: 241707

SEQ ID NO: 444240 - RNA, 64 nt, Human; identical to SEQ ID NO: 241708

SEQ ID NO: 444241 - RNA, 64 nt, Human; identical to SEQ ID NO: 241709

SEQ ID NO: 444242 - RNA, 64 nt, Human; identical to SEQ ID NO: 241713

SEQ ID NO: 444243 - RNA, 64 nt, Human; identical to SEQ ID NO: 241714

SEQ ID NO: 444244 - RNA, 64 nt, Human; identical to SEQ ID NO: 241715

SEQ ID NO: 444245 - RNA, 64 nt, Human; identical to SEQ ID NO: 241716

SEQ ID NO: 444246 - RNA, 64 nt, Human; identical to SEQ ID NO: 241717

SEQ ID NO: 444247 - RNA, 64 nt, Human; identical to SEQ ID NO: 241718

SEQ ID NO: 444248 - RNA, 64 nt, Human; identical to SEQ ID NO: 241719

SEQ ID NO: 444249 - RNA, 64 nt, Human; identical to SEQ ID NO: 241720

SEQ ID NO: 444250 - RNA, 64 nt, Human; identical to SEQ ID NO: 241721

SEQ ID NO: 444251 - RNA, 64 nt, Human; identical to SEQ ID NO: 241722

SEQ ID NO: 444252 - RNA, 64 nt, Human; identical to SEQ ID NO: 241723

SEQ ID NO: 444253 - RNA, 64 nt, Human; identical to SEQ ID NO: 241724

SEQ ID NO: 444254 - RNA, 64 nt, Human; identical to SEQ ID NO: 241725

SEQ ID NO: 444255 - RNA, 64 nt, Human; identical to SEQ ID NO: 241726

SEQ ID NO: 444256 - RNA, 64 nt, Human; identical to SEQ ID NO: 241727

SEQ ID NO: 444257 - RNA, 64 nt, Human; identical to SEQ ID NO: 241731

SEQ ID NO: 444258 - RNA, 64 nt, Human; identical to SEQ ID NO: 241732

SEQ ID NO: 444259 - RNA, 64 nt, Human; identical to SEQ ID NO: 241733

SEQ ID NO: 444260 - RNA, 64 nt, Human; identical to SEQ ID NO: 241734

SEQ ID NO: 444261 - RNA, 64 nt, Human; identical to SEQ ID NO: 241735

SEQ ID NO: 444262 - RNA, 64 nt, Human; identical to SEQ ID NO: 241736

SEQ ID NO: 444263 - RNA, 64 nt, Human; identical to SEQ ID NO: 241737

SEQ ID NO: 444264 - RNA, 64 nt, Human; identical to SEQ ID NO: 241738

SEQ ID NO: 444265 - RNA, 64 nt, Human; identical to SEQ ID NO: 241739

SEQ ID NO: 444266 - RNA, 64 nt, Human; identical to SEQ ID NO: 241740

SEQ ID NO: 444267 - RNA, 64 nt, Human; identical to SEQ ID NO: 241741

SEQ ID NO: 444268 - RNA, 64 nt, Human; identical to SEQ ID NO: 241742

SEQ ID NO: 444269 - RNA, 64 nt, Human; identical to SEQ ID NO: 241743

SEQ ID NO: 444270 - RNA, 64 nt, Human; identical to SEQ ID NO: 241744

SEQ ID NO: 444271 - RNA, 64 nt, Human; identical to SEQ ID NO: 241745

SEQ ID NO: 444272 - RNA, 64 nt, Human; identical to SEQ ID NO: 241749

SEQ ID NO: 444273 - RNA, 64 nt, Human; identical to SEQ ID NO: 241750

SEQ ID NO: 444274 - RNA, 64 nt, Human; identical to SEQ ID NO: 241751

SEQ ID NO: 444275 - RNA, 64 nt, Human; identical to SEQ ID NO: 241752

SEQ ID NO: 444276 - RNA, 64 nt, Human; identical to SEQ ID NO: 241753

SEQ ID NO: 444277 - RNA, 64 nt, Human; identical to SEQ ID NO: 241754

SEQ ID NO: 444278 - RNA, 64 nt, Human; identical to SEQ ID NO: 241755

SEQ ID NO: 444279 - RNA, 64 nt, Human; identical to SEQ ID NO: 241756

SEQ ID NO: 444280 - RNA, 64 nt, Human; identical to SEQ ID NO: 241757

SEQ ID NO: 444281 - RNA, 64 nt, Human; identical to SEQ ID NO: 241758

SEQ ID NO: 444282 - RNA, 64 nt, Human; identical to SEQ ID NO: 241759

SEQ ID NO: 444283 - RNA, 64 nt, Human; identical to SEQ ID NO: 241760

SEQ ID NO: 444284 - RNA, 64 nt, Human; identical to SEQ ID NO: 241761

SEQ ID NO: 444285 - RNA, 64 nt, Human; identical to SEQ ID NO: 241762

SEQ ID NO: 444286 - RNA, 64 nt, Human; identical to SEQ ID NO: 241763

SEQ ID NO: 444287 - RNA, 64 nt, Human; identical to SEQ ID NO: 241767

SEQ ID NO: 444288 - RNA, 64 nt, Human; identical to SEQ ID NO: 241768

SEQ ID NO: 444289 - RNA, 53 nt, Human; identical to SEQ ID NO: 241769

SEQ ID NO: 444290 - RNA, 64 nt, Human; identical to SEQ ID NO: 241770

SEQ ID NO: 444291 - RNA, 64 nt, Human; identical to SEQ ID NO: 241771

SEQ ID NO: 444292 - RNA, 64 nt, Human; identical to SEQ ID NO: 241772

SEQ ID NO: 444293 - RNA, 64 nt, Human; identical to SEQ ID NO: 241773

SEQ ID NO: 444294 - RNA, 64 nt, Human; identical to SEQ ID NO: 241774

SEQ ID NO: 444295 - RNA, 64 nt, Human; identical to SEQ ID NO: 241775

SEQ ID NO: 444296 - RNA, 64 nt, Human; identical to SEQ ID NO: 241776

SEQ ID NO: 444297 - RNA, 64 nt, Human; identical to SEQ ID NO: 241777

SEQ ID NO: 444298 - RNA, 64 nt, Human; identical to SEQ ID NO: 241778

SEQ ID NO: 444299 - RNA, 64 nt, Human; identical to SEQ ID NO: 241779

SEQ ID NO: 444300 - RNA, 64 nt, Human; identical to SEQ ID NO: 241780

SEQ ID NO: 444301 - RNA, 64 nt, Human; identical to SEQ ID NO: 241781

SEQ ID NO: 444302 - RNA, 64 nt, Human; identical to SEQ ID NO: 241785

SEQ ID NO: 444303 - RNA, 64 nt, Human; identical to SEQ ID NO: 241786

SEQ ID NO: 444304 - RNA, 64 nt, Human; identical to SEQ ID NO: 241787

SEQ ID NO: 444305 - RNA, 64 nt, Human; identical to SEQ ID NO: 241788

SEQ ID NO: 444306 - RNA, 64 nt, Human; identical to SEQ ID NO: 241789

SEQ ID NO: 444307 - RNA, 56 nt, Human; identical to SEQ ID NO: 241790

SEQ ID NO: 444308 - RNA, 64 nt, Human; identical to SEQ ID NO: 241791

SEQ ID NO: 444309 - RNA, 64 nt, Human; identical to SEQ ID NO: 241792

SEQ ID NO: 444310 - RNA, 64 nt, Human; identical to SEQ ID NO: 241793

SEQ ID NO: 444311 - RNA, 64 nt, Human; identical to SEQ ID NO: 241794

SEQ ID NO: 444312 - RNA, 64 nt, Human; identical to SEQ ID NO: 241795

SEQ ID NO: 444313 - RNA, 64 nt, Human; identical to SEQ ID NO: 241796

SEQ ID NO: 444314 - RNA, 64 nt, Human; identical to SEQ ID NO: 241797

SEQ ID NO: 444315 - RNA, 64 nt, Human; identical to SEQ ID NO: 241798

SEQ ID NO: 444316 - RNA, 64 nt, Human; identical to SEQ ID NO: 241799

SEQ ID NO: 444317 - RNA, 64 nt, Human; identical to SEQ ID NO: 241803

SEQ ID NO: 444318 - RNA, 64 nt, Human; identical to SEQ ID NO: 241804

SEQ ID NO: 444319 - RNA, 64 nt, Human; identical to SEQ ID NO: 241805

SEQ ID NO: 444320 - RNA, 64 nt, Human; identical to SEQ ID NO: 241806

SEQ ID NO: 444321 - RNA, 64 nt, Human; identical to SEQ ID NO: 241807

SEQ ID NO: 444322 - RNA, 64 nt, Human; identical to SEQ ID NO: 241808

SEQ ID NO: 444323 - RNA, 64 nt, Human; identical to SEQ ID NO: 241809

SEQ ID NO: 444324 - RNA, 64 nt, Human; identical to SEQ ID NO: 241810

SEQ ID NO: 444325 - RNA, 64 nt, Human; identical to SEQ ID NO: 241811

SEQ ID NO: 444326 - RNA, 64 nt, Human; identical to SEQ ID NO: 241812

SEQ ID NO: 444327 - RNA, 64 nt, Human; identical to SEQ ID NO: 241813

SEQ ID NO: 444328 - RNA, 64 nt, Human; identical to SEQ ID NO: 241814

SEQ ID NO: 444329 - RNA, 64 nt, Human; identical to SEQ ID NO: 241815

SEQ ID NO: 444330 - RNA, 64 nt, Human; identical to SEQ ID NO: 241816

SEQ ID NO: 444331 - RNA, 64 nt, Human; identical to SEQ ID NO: 241817

SEQ ID NO: 444332 - RNA, 64 nt, Human; identical to SEQ ID NO: 241821

SEQ ID NO: 444333 - RNA, 64 nt, Human; identical to SEQ ID NO: 241822

SEQ ID NO: 444334 - RNA, 64 nt, Human; identical to SEQ ID NO: 241823

SEQ ID NO: 444335 - RNA, 64 nt, Human; identical to SEQ ID NO: 241824

SEQ ID NO: 444336 - RNA, 64 nt, Human; identical to SEQ ID NO: 241825

SEQ ID NO: 444337 - RNA, 64 nt, Human; identical to SEQ ID NO: 241826

SEQ ID NO: 444338 - RNA, 64 nt, Human; identical to SEQ ID NO: 241827

SEQ ID NO: 444339 - RNA, 64 nt, Human; identical to SEQ ID NO: 241828

SEQ ID NO: 444340 - RNA, 64 nt, Human; identical to SEQ ID NO: 241829

SEQ ID NO: 444341 - RNA, 64 nt, Human; identical to SEQ ID NO: 241830

SEQ ID NO: 444342 - RNA, 64 nt, Human; identical to SEQ ID NO: 241831

SEQ ID NO: 444343 - RNA, 64 nt, Human; identical to SEQ ID NO: 241832

SEQ ID NO: 444344 - RNA, 64 nt, Human; identical to SEQ ID NO: 241833

SEQ ID NO: 444345 - RNA, 64 nt, Human; identical to SEQ ID NO: 241834

SEQ ID NO: 444346 - RNA, 64 nt, Human; identical to SEQ ID NO: 241835

SEQ ID NO: 444347 - RNA, 64 nt, Human; identical to SEQ ID NO: 241839

SEQ ID NO: 444348 - RNA, 64 nt, Human; identical to SEQ ID NO: 241840

SEQ ID NO: 444349 - RNA, 64 nt, Human; identical to SEQ ID NO: 241841

SEQ ID NO: 444350 - RNA, 64 nt, Human; identical to SEQ ID NO: 241842

SEQ ID NO: 444351 - RNA, 64 nt, Human; identical to SEQ ID NO: 241843

SEQ ID NO: 444352 - RNA, 64 nt, Human; identical to SEQ ID NO: 241844

SEQ ID NO: 444353 - RNA, 64 nt, Human; identical to SEQ ID NO: 241845

SEQ ID NO: 444354 - RNA, 64 nt, Human; identical to SEQ ID NO: 241846

SEQ ID NO: 444355 - RNA, 64 nt, Human; identical to SEQ ID NO: 241847

SEQ ID NO: 444356 - RNA, 59 nt, Human; identical to SEQ ID NO: 241848

SEQ ID NO: 444357 - RNA, 64 nt, Human; identical to SEQ ID NO: 241849

SEQ ID NO: 444358 - RNA, 64 nt, Human; identical to SEQ ID NO: 241850

SEQ ID NO: 444359 - RNA, 64 nt, Human; identical to SEQ ID NO: 241851

SEQ ID NO: 444360 - RNA, 64 nt, Human; identical to SEQ ID NO: 241852

SEQ ID NO: 444361 - RNA, 64 nt, Human; identical to SEQ ID NO: 241853

SEQ ID NO: 444362 - RNA, 64 nt, Human; identical to SEQ ID NO: 241857

SEQ ID NO: 444363 - RNA, 64 nt, Human; identical to SEQ ID NO: 241858

SEQ ID NO: 444364 - RNA, 64 nt, Human; identical to SEQ ID NO: 241859

SEQ ID NO: 444365 - RNA, 62 nt, Human; identical to SEQ ID NO: 241860

SEQ ID NO: 444366 - RNA, 63 nt, Human
gggguccagggcccuuccguucagcccaaaugcugccccaaugcuaacuccuuggauugucaa

SEQ ID NO: 444367 - RNA, 63 nt, Human
ucucccuguuagaaauguuagugccccgcacugugccccaaguucuaggccccccagaaagcu

SEQ ID NO: 444368 - RNA, 63 nt, Human
gggcuggaaguccuugcccacuucccacucuccugccccaaucuaucuaguacuucccaggca

SEQ ID NO: 444369 - RNA, 63 nt, Human
caggguuuggcccauggggcccccccaggccccugccccaacugauucugcccagauaaucgu

SEQ ID NO: 444370 - RNA, 63 nt, Human
guuuggggagcggagggccucuucuuggugcccugccccaaauaaaggaacuggacaaagaga

SEQ ID NO: 444371 - RNA, 63 nt, Human
caccugcaccgacuaggcugaggugcugguacuugccccaaccccuacuuuuguauuuauaug

SEQ ID NO: 444372 - RNA, 63 nt, Human
gaggccgaauagggaggaggugagaggcuggggugccccaagcuucccucggagaagugagag

SEQ ID NO: 444373 - RNA, 63 nt, Human
gacaggauuucuggauuuauacguaaucacuccugccccaacacacacacacacacacacaca

SEQ ID NO: 444374 - RNA, 63 nt, Human
cuuaaagucagugugcccucaaccagcacagccugccccaauucccccagccccugcuccagc

SEQ ID NO: 444375 - RNA, 63 nt, Human
aaaagacaaaaaaaauuuuacuacuuuugagauugccccaauguacagaauuauauaauucua

SEQ ID NO: 444376 - RNA, 63 nt, Human
acuugcuuuuagauuauagucccacaguugcacugccccaauugucuaccuuuguggguacau

SEQ ID NO: 444377 - RNA, 63 nt, Human
gccuuaagcccaaagggcagugggaauguccccugccccaaccaucggguggagcuccugcug

SEQ ID NO: 444378 - RNA, 63 nt, Human
gcucuuguuugacaugguguguggauggggacuugccccaagacugagcaggucugcccuuuc

SEQ ID NO: 444379 - RNA, 63 nt, Human
ggcugacuugaagcucccugucccccucacucuugccccaagaaaagaggccaaagcaagagc

SEQ ID NO: 444380 - RNA, 63 nt, Human
uacacaaggacuucucccagcugacccucaggaugccccaagucaggaagaccauuaagaaua

SEQ ID NO: 444381 - RNA, 63 nt, Human
gugucccacccagaggccaguggccccuucacaugccccaacaagaggaagacugucuggcuc

SEQ ID NO: 444382 - RNA, 63 nt, Human
cccagcuccuuuuguccccagggccccucccucugccccaagcagccagccagucuugccuag

SEQ ID NO: 444383 - RNA, 63 nt, Human
aacaagucacagcugcagcugggccccaugcucugccccaagcccccaaccccgcggugcucu

SEQ ID NO: 444384 - RNA, 63 nt, Human
aguguggagucagaaugcaaacccagaucagucugccccaaaguccacuacaccagcugccag

SEQ ID NO: 444385 - RNA, 63 nt, Human
caauuuguaaacauauacauucauauucucucuugccccaaguuuuaggaacauguuaggaua

SEQ ID NO: 444386 - RNA, 63 nt, Human
ccccuacuccgucucuaugccaugacagccuucugccccaaagccuggaagauuacucuuugg

SEQ ID NO: 444387 - RNA, 63 nt, Human
gcuggccguggcagaugcugugauugagaaguuugccccaauuaagcgugaaauugaaaaacu

SEQ ID NO: 444388 - RNA, 63 nt, Human
uuuacagcaauuaguguacccuaauuuuuagugugccccaaguuuggugugucccaauuuuug

SEQ ID NO: 444389 - RNA, 63 nt, Human
gggccuugcccagauagacagggcuggcucugcugccccaaccuuucaaggaggaaaccagac

SEQ ID NO: 444390 - RNA, 63 nt, Human
uggaaguguacaauaccaccuacaaauuauccaugccccaaguguuaaaacugaauccauuca

SEQ ID NO: 444391 - RNA, 63 nt, Human
ugacguguaaaaaaugauguuucauccucugauugccccaauaaaaaucuuuguuguccaucc

SEQ ID NO: 444392 - RNA, 63 nt, Human
cucccacuguccccuuuccacuuccccagcuucugccccaauacacauaccucccuuaagcca

SEQ ID NO: 444393 - RNA, 63 nt, Human
cuacucuuaacaauuaccuaaggcuuccucaacugccccaaaucucuuaauagcuucuagugc

SEQ ID NO: 444394 - RNA, 63 nt, Human
agcccuccccaccugcucaccaauuccacuuccugccccaacugcaggaaugcugacaaugcu

SEQ ID NO: 444395 - RNA, 63 nt, Human
ucccuuucaugaccugaggcacucugcgaugugugccccaaagcagaacuuacagggccugca

SEQ ID NO: 444396 - RNA, 63 nt, Human
caggaaagagaaaguagaagcagcaauaaauacugccccaacuuuccuggagcccgaggccuc

SEQ ID NO: 444397 - RNA, 63 nt, Human
cuccacucagggcuggcccggggaguccccgugugccccaagaggcuagccccagggugagca

SEQ ID NO: 444398 - RNA, 63 nt, Human
uuuuccaccaaagcuacaaaccuaaaaugcugcugccccaaagcacaagagggaagagcaccg

SEQ ID NO: 444399 - RNA, 63 nt, Human
cacgacgaaagcgacggaccaaaagaaauuuccugccccaagaagcaugggauccaggaaggg

SEQ ID NO: 444400 - RNA, 63 nt, Human
uaaaguuucucagggugggaaaugugggggcuuugccccaaugacuguagcauucaaggcuug

SEQ ID NO: 444401 - RNA, 63 nt, Human
ccccagggggcccucugccucauggcaaaggcuugccccaaaucucaacuucucagacguucc

SEQ ID NO: 444402 - RNA, 63 nt, Human
gccccuccuaggggcccaugagucagagaggcuugccccaagucacagccacucagauguucg

SEQ ID NO: 444403 - RNA, 63 nt, Human
gcaccugaccaagggaccaaugaggcagaggcuugccccaagucacagccacucagaugcuuc

SEQ ID NO: 444404 - RNA, 51 nt, Human
ccaggccccgguggcgguaacugccccaaggccccagggacagaggccaag

SEQ ID NO: 444405 - RNA, 63 nt, Human
uccucuuccugaguagcugcaacuacagacacaugccccaauacucagcuaauuuuuaaauuu

SEQ ID NO: 444406 - RNA, 63 nt, Human
aaacauacauguugggcaugauucuacccuuauugccccaagagaccuagcuaaggucuauaa

SEQ ID NO: 444407 - RNA, 63 nt, Human
uagacaauugguauaugaaauauacacauccugugccccaauauggugcauuaugaaaaacaa

SEQ ID NO: 444408 - RNA, 63 nt, Human
cagcugcagugguugggaggagcuugaccagugugccccaaggaguggaguagagcccaaucu

SEQ ID NO: 444409 - RNA, 63 nt, Human
auacaggcugaaccuggcccaacagaaaaacccugccccaaugcaccugcaggcaagguaccc

SEQ ID NO: 444410 - RNA, 63 nt, Human
uccccaggcagacauuuuuuagaaaucaauacaugccccaauauuggaaagacuuguucuucc

SEQ ID NO: 444411 - RNA, 63 nt, Human
ggcucugcagacccagagguaaggcugccuggcugccccaaaccccagacacuccucuccuug

SEQ ID NO: 444412 - RNA, 63 nt, Human
cuugcuagcugggcaagaaagcagcaguggaccugccccaaggccacacgugccuggucaggc

SEQ ID NO: 444413 - RNA, 63 nt, Human
aaggcauuccaggcagaggaacaggaugugcacugccccaaagugagaacuugcucuacgugg

SEQ ID NO: 444414 - RNA, 63 nt, Human
gguuggggaagccugucuagaugugggacucauugccccaaaccagggagaggaagagcuccc

SEQ ID NO: 444415 - RNA, 63 nt, Human
uuguuuacaaacagcgaccauauaaaagccuccugccccaaagcuugugggcacaugggcaca

SEQ ID NO: 444416 - RNA, 63 nt, Human
cuggacccugggcuauuggcugcucccaauccuugccccaaacacuuagcuggcuccccauga

SEQ ID NO: 444417 - RNA, 63 nt, Human
cuucucccuaguuccagcccugcccuggucugaugccccaacacugcccuugcuuuguuuucc

SEQ ID NO: 444418 - RNA, 63 nt, Human
gauacaaaagacgauuacaaugcucucagugucugccccaaguaccaccucaugaaggaugcc

SEQ ID NO: 444419 - RNA, 63 nt, Human
caagucugacgcagccaccacucucagggauccugccccaaaugcggucggagcgccagugac

SEQ ID NO: 444420 - RNA, 63 nt, Human
agguacauuucugauucugauugcuaucagcaaugccccaaacuuucucauaagcaccuaaaa

SEQ ID NO: 444421 - RNA, 63 nt, Human
ggagcucgugccuuacaugcugggcccacauucugccccaagcagaagcugcagggaccucag

SEQ ID NO: 444422 - RNA, 63 nt, Human
auucaugccauuuuuugggaaaacuuuaaaaauugccccaaauacugacauugagugcauuaa

SEQ ID NO: 444423 - RNA, 63 nt, Human
gaaaaaguacugagaacccaccugacccaggcuugccccaagcagaggcuagagaagaggcuc

SEQ ID NO: 444424 - RNA, 63 nt, Human
guggguccaggaccagaccucucuacaaaaaauugccccaacuacaguuugcaaccccaaacc

SEQ ID NO: 444425 - RNA, 63 nt, Human
ggagugaaaugcuggccaguacuuguucucccuugccccaacccuuuaccggauaucuugaca

SEQ ID NO: 444426 - RNA, 63 nt, Human
aauccugugaauugaauuucucuucaaucaaagugccccaaaacagaagcacaaguaaauaaa

SEQ ID NO: 444427 - RNA, 63 nt, Human
uguaguaggauagggauuuuuuuuuuuuuuuuuugccccaagaaaacguucacccagugaucu

SEQ ID NO: 444428 - RNA, 63 nt, Human
aacagccucaguguuacuucccaggauuugcucugccccaaacgagcuguucauaacagcgau

SEQ ID NO: 444429 - RNA, 63 nt, Human
cagaaggaguaggcacaucaagauauucaggggugccccaagagucugggacuuucaaaaaaa

SEQ ID NO: 444430 - RNA, 63 nt, Human
guguuguguauguauguguuuuaaguauaugagugccccaaccccaccucacaaucuucacaa

SEQ ID NO: 444431 - RNA, 63 nt, Human
guuuggcacugaugcaauguauggcuuuucucuugccccaaaucacaaacauauguaucuuug

SEQ ID NO: 444432 - RNA, 63 nt, Human
ugucuacgaauacacaauaaagagaugagacacugccccaauccuaaagaggccagaacugaa

SEQ ID NO: 444433 - RNA, 63 nt, Human
uggguccugccccacugccccucccccuguuccugccccaagccgucaaucagauuguggagc

SEQ ID NO: 444434 - RNA, 63 nt, Human
acaacuuguccugguccaaguccuuauucugcuugccccaacuuaccugcagacacuccuuuu

SEQ ID NO: 444435 - RNA, 63 nt, Human
acagcaacggaaauccauccacaaaggaugcagugccccaacuuguacugcgccugaauaguc

SEQ ID NO: 444436 - RNA, 63 nt, Human
gcuggcagguaggucggcacuuggacaauggagugccccaacucaacccuuggggcgacuggc

SEQ ID NO: 444437 - RNA, 63 nt, Human
cccuucuggaagcuuucugcuccugacguguugugccccaaacccuggggcuggcuuaggagg

SEQ ID NO: 444438 - RNA, 63 nt, Human
augccuucaaccaaaacacagcuaguauuucuaugccccaaauccaaucccagucuuucauga

SEQ ID NO: 444439 - RNA, 63 nt, Human
ggacgaacauccaaccuucccaaacgccuccccugccccaaucccuuuauuacccccuccuuc

SEQ ID NO: 444440 - RNA, 63 nt, Human
cccaccuugagugagggguggauaaacuaccccugccccaaaccucuaccccuaacuccaggu

SEQ ID NO: 444441 - RNA, 63 nt, Human
ccacagacugacccuguggccucagugacccacugccccaaguggugcuuucagagaauugau

SEQ ID NO: 444442 - RNA, 63 nt, Human
ucccaaaacuagaaagaaggaagcagggagcggugccccaagcauggcuccugccaacaccua

SEQ ID NO: 444443 - RNA, 63 nt, Human
ggucuacucaggugugagggggcaggucugaccugccccaaaguuggcuccauccuggacaac

SEQ ID NO: 444444 - RNA, 63 nt, Human
gccagagaccauccaggacguggagagaaagagugccccaaccagucuucaggaggaagagau

SEQ ID NO: 444445 - RNA, 63 nt, Human
uccugauguuccacuccacuuuguauagacaucugccccaacugaauguguucugucacucag

SEQ ID NO: 444446 - RNA, 63 nt, Human
caccaaagccgggagcucugcccugcagggaguugccccaacccuuuccggaacucagucuuu

SEQ ID NO: 444447 - RNA, 63 nt, Human
cuucuagggaccagaaacaccagacacuucuucugccccaagcacaccccacacuaauuucug

SEQ ID NO: 444448 - RNA, 63 nt, Human
cggccacagggcgguaccuugugcccaggguuuugccccaaguccucauuuaaaagcauaagg

SEQ ID NO: 444449 - RNA, 63 nt, Human
aacaacauggccagugccuguuccccacucccuugccccaaaaggaucuggaacacagguguu

SEQ ID NO: 444450 - RNA, 63 nt, Human
uagggaacagagcuggauuccuugugccucauaugccccaaugcuggucucaguaaaacacug

SEQ ID NO: 444451 - RNA, 63 nt, Human
cagcuucuccuucucggugacaugucaccucccugccccaauccuggcuccaacccucucugg

SEQ ID NO: 444452 - RNA, 63 nt, Human
guuccuuaacugucccaucugugcagaguccauugccccaacuagacugugagcuccuccucu

SEQ ID NO: 444453 - RNA, 63 nt, Human
uggcuguuuucuucaguuuuaugcauucucuccugccccaaagugccaagccauuugugaagg

SEQ ID NO: 444454 - RNA, 63 nt, Human
cacgucaucugauuguaagcacaauaugaguugugccccaaugcucguuaacagcugcuguaa

SEQ ID NO: 444455 - RNA, 63 nt, Human
ucuuuugcaauuggaauaaucacuuggucaccuugccccaagcuuuccccucugaauaaauac

SEQ ID NO: 444456 - RNA, 63 nt, Human
gagggacccugcucaggccaccugccuggcuccugccccaagugccuugcuuuuacaguggac

SEQ ID NO: 444457 - RNA, 63 nt, Human
uucucuuaaaauaaguaaaauuccaaggauauaugccccaacgaaugcugcugaagaggaggg

SEQ ID NO: 444458 - RNA, 63 nt, Human
caggguccccugggaagaugcccccaagacaccugccccaaguggguggauaucugccuuccu

SEQ ID NO: 444459 - RNA, 63 nt, Human
gugggaaaauauauuagaaguuacuaugaagaaugccccaaagacaaguuaccagcauauccu

SEQ ID NO: 444460 - RNA, 63 nt, Human
aagccuuuacaagacuuguuaaagaugucagagugccccaagcugccguuccuucccuuccug

SEQ ID NO: 444461 - RNA, 63 nt, Human
ucaccauauauggaucauuccucauguauaaugugccccaaaugcagcuucauuuuccagaua

SEQ ID NO: 444462 - RNA, 63 nt, Human
ugcccaaaaacuugcccaccagaccaagggcagugccccaaggccccugucuggaggaaaugg

SEQ ID NO: 444463 - RNA, 63 nt, Human
cagcaggugcaagagacagagcccccaagccucugccccaaggggcccacaaaggggagaagg

SEQ ID NO: 444464 - RNA, 63 nt, Human
cuggcuucuauuaaugugugcuggccaugauauugccccaaauccgccccacugaaguguucc

SEQ ID NO: 444465 - RNA, 63 nt, Human
aagcuaagcaguggugaacugaaaagggcauauugccccaagguuacacugaagcagcucaua

SEQ ID NO: 444466 - RNA, 63 nt, Human
agccacuaggccugaccuccccuuccccuuuccugccccaaggcagauccacaucaccgaagc

SEQ ID NO: 444467 - RNA, 63 nt, Human
caucuccaccuguaauccuguggccaacaccaaugccccaaccuucccccacagcuaucuuca

SEQ ID NO: 444468 - RNA, 55 nt, Human
uccuggcccauaaagccugaugacuugccccaagggccacccgaggaagcaguau

SEQ ID NO: 444469 - RNA, 63 nt, Human
augcacuagaagaccuucauccuccccuuccucugccccaagucacuacaguugguucuauug

SEQ ID NO: 444470 - RNA, 63 nt, Human
uucuuccagaacaucuggguccucccuccucugugccccaacagcacgcugucuuccuauugg

SEQ ID NO: 444471 - RNA, 63 nt, Human
ggagcgugguuuucugauugugaucugagguucugccccaacugcacagcaguugggcugcuu

SEQ ID NO: 444472 - RNA, 63 nt, Human
ugcuguguucccacagacagaaacgccugccccugccccaaguccuggugucuccagccuggc

SEQ ID NO: 444473 - RNA, 63 nt, Human
aagugcaugcuuugaaauagguuuuuaaugaugugccccaaagggccagcugauucugguacu

SEQ ID NO: 444474 - RNA, 63 nt, Human
gggaguuggagccaccagauccucuugcaagauugccccaacuuaaacgccacauaaaacagc

SEQ ID NO: 444475 - RNA, 63 nt, Human
cccugcaccuccaccugccccagccccugccucugccccaaguggggccagcugcccucacuu

SEQ ID NO: 444476 - RNA, 63 nt, Human
guugggguuucugccacuuccgggucuaggcccugccccaaauccagccaguccugccccagc

SEQ ID NO: 444477 - RNA, 63 nt, Human
ugcccggggccgcuugucccugcccggccucugugccccaacugugcuugguccucuggcuuc

SEQ ID NO: 444478 - RNA, 57 nt, Human
cagucuguacagugguauagcccucagugccccaacaggacugauucauagccauac

SEQ ID NO: 444479 - RNA, 63 nt, Human
ucuuuaguccuaaagggacaauaacucugagcaugccccaaaaaaguaguuuagcaaccuuuu

SEQ ID NO: 444480 - RNA, 63 nt, Human
cuccugcaccaccgugacucccuggcugcuccuugccccaaagaacccucuuccugcauggga

SEQ ID NO: 444481 - RNA, 63 nt, Human
cagccuggaagaaacaguccaguacuugacccaugccccaacaaacucuacuauccaauaugg

SEQ ID NO: 444482 - RNA, 63 nt, Human
auugucuuugaaucugaaucagccagucucagaugccccaaaguuucgguuccuaugagcccg

SEQ ID NO: 444483 - RNA, 63 nt, Human
gggugggggcccugccagcuccagcaccacccuugccccaagucuuuuaaccuggguguuagc

SEQ ID NO: 444484 - RNA, 63 nt, Human
agaagccuaccagcuuagcuccuggaguaggaaugccccaaauccagcaugaccaaaaguaaa

SEQ ID NO: 444485 - RNA, 63 nt, Human
uucccuaagaucuucaccucucugccucccuacugccccaacauagccuugaggaggcuucuc

SEQ ID NO: 444486 - RNA, 63 nt, Human
cugucauucacaaggcacagugccccaugaaauugccccaauagaaaacauggcaucccugac

SEQ ID NO: 444487 - RNA, 63 nt, Human
aggccaagcugcccucccugggaaucacucagaugccccaagauguccguugggaagcuccca

SEQ ID NO: 444488 - RNA, 63 nt, Human
uuaucagggacacuccaugggguggcuugucucugccccaaacagggucuucacguucuaacu

SEQ ID NO: 444489 - RNA, 63 nt, Human
cuggcugagcugcuguggccgggcugggcagugugccccaacagcucagugcuuuccugacac

SEQ ID NO: 444490 - RNA, 63 nt, Human
gaguggccacuggcacuugccugcugcuuggagugccccaaggagguggcuguuaaccacccg

SEQ ID NO: 444491 - RNA, 63 nt, Human
ccagauggauuuaacagcaccucaaagucaacaugccccaagucaaagucuucuuuacccaug

SEQ ID NO: 444492 - RNA, 63 nt, Human
guuguaucccuccuuucaguauuuuucacuuguugccccaaaugugaaagcauuucauuccuu

SEQ ID NO: 444493 - RNA, 63 nt, Human
augcccuguggacgaagguacagcucgccugccugccccaaucccagccccgacaaucacaug

SEQ ID NO: 444494 - RNA, 63 nt, Human
ugccuuaccugcaugguuuccccagaggaugugugccccaagguggcuggaauuuuugacaga

SEQ ID NO: 444495 - RNA, 63 nt, Human
aaggggaggauccuguccuggcuguagccuuccugccccaaucaucucgcuggaugccauugc

SEQ ID NO: 444496 - RNA, 63 nt, Human
ccacagguaagcacgcaagacacagguaccgugugccccaacggugucuugacucgcuguucc

SEQ ID NO: 444497 - RNA, 63 nt, Human
cccacuucucucuccguagagagccugaaaaacugccccaaugccacgguaaaggcgaggaag

SEQ ID NO: 444498 - RNA, 63 nt, Human
auuuucuugggaaaacauacuuuucauaucucuugccccaaagauugggcuguaagccauuuu

SEQ ID NO: 444499 - RNA, 63 nt, Human
uggguguccggcagccgcuccgagccucggcccugccccaaguagcccagaagccuccggcgg

SEQ ID NO: 444500 - RNA, 63 nt, Human
cacccccugccuuccccagcuugcccauuucccugccccaaggcccagagcuccccccagacu

SEQ ID NO: 444501 - RNA, 63 nt, Human
gagauguuuuauaguuacaugagcaaaagcuguugccccaaagugauggcccuggaggcgggg

SEQ ID NO: 444502 - RNA, 63 nt, Human
uaaaaucuaaaauuucauaauucugaaacaacuugccccaaggguuucagagaaaggacugug

SEQ ID NO: 444503 - RNA, 63 nt, Human
gggccagggucagagguccagccucuauacccgugccccaacgucagcccaauccaccuugca

SEQ ID NO: 444504 - RNA, 63 nt, Human
augauugccuccccuugcagcuuucccuacuccugccccaacugcaguaggaaauggaauccc

SEQ ID NO: 444505 - RNA, 63 nt, Human
cacacugcaggaggauuugucucuaagaggugcugccccaaagcuccccaagcaucaauacuc

SEQ ID NO: 444506 - RNA, 63 nt, Human
uuugagcuaaugacugucuccagaaaauaacugugccccaagaagugcuccagauuugcaagg

SEQ ID NO: 444507 - RNA, 63 nt, Human
gccugugccaccugcaagugcccgcccugccccugccccaacccccaccgaagagcccugagc

SEQ ID NO: 444508 - RNA, 63 nt, Human
agcacaaugcugggguucucuucacacuaucacugccccaaauugucuuucuaaauuucaacu

SEQ ID NO: 444509 - RNA, 63 nt, Human
aaccuccucugugccuuggcucugggcgggggcugccccaacccacccccguucuuuguacgu

SEQ ID NO: 444510 - RNA, 63 nt, Human
cccccaggcucuuucuccagcccugucuccaucugccccaaccucagcccaccuugucucuug

SEQ ID NO: 444511 - RNA, 63 nt, Human
gcaggugcugcuacccucccugcuguccccucuugccccaacccccagcacccgggcucaggg

SEQ ID NO: 444512 - RNA, 63 nt, Human
cuacccauuuuccccugagcauccucuagaugcugccccaaggaguugcugcaguucuggagc

SEQ ID NO: 444513 - RNA, 63 nt, Human
ugaaggcacagcccauaagacuauacuugauuuugccccaagauucugacuucuggcuacauu

SEQ ID NO: 444514 - RNA, 63 nt, Human
ugagucagaugagcaagaaggccccagaacccaugccccaaggcacaaagaggagcucagggu

SEQ ID NO: 444515 - RNA, 63 nt, Human
ugcagaaaucuuuacauuccucaagcuagccccugccccaauccugcccuggccugaacaccc

SEQ ID NO: 444516 - RNA, 63 nt, Human
cacugcccuccgcccuucccugacacugucugcugccccaaucaccgucacaauaaaagaaac

SEQ ID NO: 444517 - RNA, 63 nt, Human
gugugagggugauggagcacggggucacaccccugccccaagggccacuggucucccugggcu

SEQ ID NO: 444518 - RNA, 63 nt, Human
ggaggggcuggcagggccuccauagcacagaauugccccaaagccuuguuaagaugagucaag

SEQ ID NO: 444519 - RNA, 63 nt, Human
gcccaguggguggguggggugggguggggcaagugccccaacuccccucaccaggagaggcac

SEQ ID NO: 444520 - RNA, 63 nt, Human
ucagaauuccauaucuugcgaauccaagcucccugccccaaauaacuucaguccugcuccaga

SEQ ID NO: 444521 - RNA, 63 nt, Human
gccaggaggcaccugaguucucugcuguuauccugccccaagggccugggccgagccucuacc

SEQ ID NO: 444522 - RNA, 63 nt, Human
uggguuuugcuuccagacguuguuccauauuuuugccccaaauguuucauggcuuauacccca

SEQ ID NO: 444523 - RNA, 63 nt, Human
cacuuguuuuucuuuuuacaguuacuuccuuccugccccaaaauuauaaacucuaaguguaaa

SEQ ID NO: 444524 - RNA, 63 nt, Human
gcugagcuggguagccucucugagcugguuuccugccccaaaggcuggcuuccaccauccagg

SEQ ID NO: 444525 - RNA, 63 nt, Human
cauguaugacagagaacagaggaugccuguuuuugccccaaagcuggaaauucaucacaaccu

SEQ ID NO: 444526 - RNA, 63 nt, Human
uuaacaguugaauuauggagggaaauucccuuuugccccaagcauuucuauauuuaaagcaau

SEQ ID NO: 444527 - RNA, 63 nt, Human
gcaucccuaaucugaacaguuaaaacccccaaaugccccaaaauccaaaccuuccugaacgcu

SEQ ID NO: 444528 - RNA, 63 nt, Human
uuguuuuuaagugacugugguuuaaagcacaaaugccccaagguggggagacuucucucugug

SEQ ID NO: 444529 - RNA, 63 nt, Human
guguuucacaaggauccucugaaacccucucugugccccaaguacagaugccauuacuucugc

SEQ ID NO: 444530 - RNA, 63 nt, Human
gucuauuaagugguggcuuuucucuccuuggagugccccaauuuuauauucucaggggccaag

SEQ ID NO: 444531 - RNA, 63 nt, Human
auuaagcauuuucagauguggugguuguauuuuugccccaagaaguguuuggauaaccacaca

SEQ ID NO: 444532 - RNA, 63 nt, Human
ugucaccaauguacccaccgggccacuccuuccugccccaacuccuuccagcuagugacccac

SEQ ID NO: 444533 - RNA, 63 nt, Human
gccaaaugcagagaugaggcuaaggcaagaauaugccccaacuaaagcauagauuccccaaag

SEQ ID NO: 444534 - RNA, 63 nt, Human
uacuccugcugccugugugugccugggggcuacugccccaacuccugcggugacaccacccag

SEQ ID NO: 444535 - RNA, 63 nt, Human
agaggauauaggagaggaaaaguaaggugcaguugccccaaccucagacuuaccaggaagcag

SEQ ID NO: 444536 - RNA, 63 nt, Human
uuuaagguauaucauuauaacugaaggagaaggugccccaaaaugcaagauuuuccacaagau

SEQ ID NO: 444537 - RNA, 63 nt, Human
caccaggaauguuaaagucagugggaacgugacugccccaacuccuggaagcuguguccuugc

SEQ ID NO: 444538 - RNA, 63 nt, Human
acaacucugaagagaaacuaccaagacuccuccugccccaaaccucgccagagaagcucuuca

SEQ ID NO: 444539 - RNA, 63 nt, Human
cacacacacucacacucacacucccuugucugaugccccaaagccaauuccuggggcacccua

SEQ ID NO: 444540 - RNA, 63 nt, Human
gccaagggaguccucggcugaacuuacgauaucugccccaaaccucuguaaccccaacugaaa

SEQ ID NO: 444541 - RNA, 63 nt, Human
aacccccuuucccugcuagaaauaacaauuagaugccccaaagcgauuuuuuuuaaccaaaag

SEQ ID NO: 444542 - RNA, 63 nt, Human
ccgcuggccaucuugaauccuagggcaugaaguugccccaaaguucagcacuugguuaagccu

SEQ ID NO: 444543 - RNA, 63 nt, Human
cuguucugagaccugacaaagaguuuuuuuucaugccccaaccacccuggcagggagggccug

SEQ ID NO: 444544 - RNA, 63 nt, Human
acuagucagaauguuaaaggagugcaugcaggaugccccaaaugucgugaacucuuguuacuc

SEQ ID NO: 444545 - RNA, 63 nt, Human
cccuguugagaguagccuugcucaguacuaaaaugccccaaaguucuauacagcauuuccuuu

SEQ ID NO: 444546 - RNA, 63 nt, Human
gcaucaaaggacaaauuaaggcaucuuuccucuugccccaaaggcagcaacaacguacucaua

SEQ ID NO: 444547 - RNA, 63 nt, Human
uaauaauguguuccuugaggauaacuugucaaaugccccaaagcauaaagaauauaauucuga

SEQ ID NO: 444548 - RNA, 63 nt, Human
gccacuuuuauuuguauauugaacccuagcuagugccccaagcugcacuauugggaauggauu

SEQ ID NO: 444549 - RNA, 63 nt, Human
acuuuaccggcuuuccccaguccauaaaggucuugccccaacacucaccccuucuuuuuuucc

SEQ ID NO: 444550 - RNA, 63 nt, Human
cuagcaauguaucuucaggaaaacggcauugacugccccaaaugcaaguucucguacgcccug

SEQ ID NO: 444551 - RNA, 63 nt, Human
uccagcugcaugggaaagcaaagcagaaaacagugccccaaauggaaaaaagauacucacaca

SEQ ID NO: 444552 - RNA, 63 nt, Human
cuuggagagcuguuuucucauuucauguacacuugccccaaauugucuuugaagucgugugca

SEQ ID NO: 444553 - RNA, 63 nt, Human
gcaaugggacuggagucagaugagcaaggacauugccccaagauaggggcacacuacagagca

SEQ ID NO: 444554 - RNA, 63 nt, Human
cuccccagaggaccucgaaggcugcaacggcccugccccaagccccagaaaaagaaacucuug

SEQ ID NO: 444555 - RNA, 63 nt, Human
augcuauaaaauggugaaagcuuccuucuaaacugccccaaguguugaagucuucacuuuauu

SEQ ID NO: 444556 - RNA, 63 nt, Human
uguccugccugcccagucccuucacugcuuuccugccccaagauggcuugcuuuucacaaaua

SEQ ID NO: 444557 - RNA, 63 nt, Human
ccucauccuccccauggaaugggcuguauguccugccccaacuuggcccgcagcaggccagac

SEQ ID NO: 444558 - RNA, 63 nt, Human
acagugagcucuucauuagcacaauaugugguuugccccaagugugcacuauuuaauacuuug

SEQ ID NO: 444559 - RNA, 63 nt, Human
agauguggucuacaucucagccuuccugaccucugccccaaacacacgcugcaauuuugucuc

SEQ ID NO: 444560 - RNA, 63 nt, Human
caagagaauuucuagccucaccucuccaagcucugccccaaguccacaccaugggucugcuuc

SEQ ID NO: 444561 - RNA, 63 nt, Human
ggucuugugaugaacuacauuuauccccuuuccugccccaaccacaaacucuuuccuucaaag

SEQ ID NO: 444562 - RNA, 63 nt, Human
ugagggacuggccuggagugggaguugccacacugccccaacagugauucccuuucaaagagc

SEQ ID NO: 444563 - RNA, 63 nt, Human
gauauagaauuguggcuuuaguagcacagaggaugccccaacaaacucauggcguugaaacca

SEQ ID NO: 444564 - RNA, 63 nt, Human
ucauggaugaauggcgagccaccuguugucagcugccccaagccucugggauauguggauucg

SEQ ID NO: 444565 - RNA, 63 nt, Human; identical to SEQ ID NO: 444558

SEQ ID NO: 444566 - RNA, 63 nt, Human
agggccaggaaaagaaaaucgguguauccuaucugccccaauagcugagcuguagcauuuggg

SEQ ID NO: 444567 - RNA, 63 nt, Human
ggcccccaggacaagugguaugaccagugauaaugccccaaggacaaggggcgugccuggcgc

SEQ ID NO: 444568 - RNA, 63 nt, Human
caggaucuccucccuuguuuaaaugucaauaaaugccccaacugcuuuguaagugcaacuuuu

SEQ ID NO: 444569 - RNA, 63 nt, Human
gcacagcggugucaccccgcaggaccgcgggccugccccaacccccagcauucccgggugggc

SEQ ID NO: 444570 - RNA, 63 nt, Human
uuccuagcaucaguccgaaccaugcgcccgcccugccccaacugugugcugguccugcugugg

SEQ ID NO: 444571 - RNA, 63 nt, Human
agcagagaaaugcgaugguucaacagcucgcccugccccaaguaugcagacuugaccuuggcg

SEQ ID NO: 444572 - RNA, 63 nt, Human
uguggugaguggccugagcgcaucguccuguguugccccaagcagcuggccaacauguguaga

SEQ ID NO: 444573 - RNA, 63 nt, Human
cuccggccacacauccugcugggcccccuacccugccccaauucaauccugccaauaaauccu

SEQ ID NO: 444574 - RNA, 63 nt, Human
gugcggggccgcuaugaggcccgccagaggaagugccccaagugcaacgcggccuuuggugcc

SEQ ID NO: 444575 - RNA, 63 nt, Human
gagggaggagugagacuuaucagaugggacgcuugccccaagacugugggauaaaccaccauu

SEQ ID NO: 444576 - RNA, 63 nt, Human
cagcauucuguucugcacugugggcuggcucucugccccaacccugggcacuggccccuggcu

SEQ ID NO: 444577 - RNA, 63 nt, Human
cauuccuauucuucaguggaugccagccuucccugccccaacucccuccccagcacuggguca

SEQ ID NO: 444578 - RNA, 63 nt, Human
guugaucuucuaggacaucacuuguuuauucagugccccaaacacagauuucucuucuagcac

SEQ ID NO: 444579 - RNA, 63 nt, Human
ucugacggcgggcgagcacacggucucuuccccugccccaacuggcccucuccaccaccaacu

SEQ ID NO: 444580 - RNA, 63 nt, Human
gaggccguguccaugugugacagcagaaccacaugccccaagaccccagggcuucccccaaaa

SEQ ID NO: 444581 - RNA, 63 nt, Human
ggguggaugaacccugaagcgcaccgcacugucugccccaaugucuaacaaaggccggaggcg

SEQ ID NO: 444582 - RNA, 63 nt, Human
ucucuggcaguucuggaauggaaggguucuggcugccccaaccugcugaagggcagaggugga

SEQ ID NO: 444583 - RNA, 63 nt, Human
cugacuuucccagcccuuugguuuguggguaucugccccaacuacuguugggaucagccuccu

SEQ ID NO: 444584 - RNA, 63 nt, Human
uggacuuuuuaaaagacacaggacccuuaacuuugccccaaagugaggggcuccacaccaacc

SEQ ID NO: 444585 - RNA, 63 nt, Human
gagcugggggaaggcaggagccuuccuuucuccugccccaagggcccagacccugggcaaaca

SEQ ID NO: 444586 - RNA, 63 nt, Human
aggacugggcaccaagcuugcagccgaaggccuugccccaaacuaccagcguuucugcaagca

SEQ ID NO: 444587 - RNA, 63 nt, Human
cugaggccccugaagucugcagacccuucuccuugccccaaacacuggccuccauaauuccug

SEQ ID NO: 444588 - RNA, 63 nt, Human
ccagugauggcauuacucugcacuauagccauuugccccaacuuaaguuuagaaauuacaagu

SEQ ID NO: 444589 - RNA, 63 nt, Human
uccuaggacauguucccuucuccuuccaacugcugccccaaaggaagcuuucucugcuucagc

SEQ ID NO: 444590 - RNA, 63 nt, Human
aucccuguuuccccaggcuccuggcuguuuaucugccccaaaggagaagccucaugggguuga

SEQ ID NO: 444591 - RNA, 63 nt, Human
agagucugcauuugggcugugacgucucccaccugccccaauaagaucugcucugucugcgac

SEQ ID NO: 444592 - RNA, 63 nt, Human
caacuucuaccaccuagguucaagcgauucuugugccccaaacuuccgaguagcugggacuac

SEQ ID NO: 444593 - RNA, 63 nt, Human
cuuaaacguagggaggcccugagaacuaaauuuugccccaaaauaaaaacagaaauuaugaga

SEQ ID NO: 444594 - RNA, 63 nt, Human
ugagauggaguccucgacuuaucaccacaccacugccccaaggaccuuacaggcccucccugu

SEQ ID NO: 444595 - RNA, 51 nt, Human
gaaaacuacuacauccaugacugccccaacccccuugggguggggcagaag

SEQ ID NO: 444596 - RNA, 63 nt, Human
agugucuucuaucucauuguauuuuuuuuaacuugccccaaugauagaaaagucuuuugcuga

SEQ ID NO: 444597 - RNA, 63 nt, Human
acacacuacuacugauggccuuucgggggucccugccccaaccggagaggccggugcacaggg

SEQ ID NO: 444598 - RNA, 63 nt, Human
ugcaccugagcuccugcuucgcgccugcugcucugccccaacgcgaccgcugcccggcugccc

SEQ ID NO: 444599 - RNA, 63 nt, Human
cggugaucacacccucccauccuuccugccuccugccccaaaccccggguuccugggucugga

SEQ ID NO: 444600 - RNA, 63 nt, Human
gggcucccgccuucacagcccucgccaggggucugccccaauccuggccugcaucagggcagg

SEQ ID NO: 444601 - RNA, 63 nt, Human
ccccaucagacuggaugugccuuuauccucuaaugccccaaucucucucugaacacccccauu

SEQ ID NO: 444602 - RNA, 63 nt, Human
agcuuugcugaaggccuggccagccuccuggccugccccaaguggcaggcccugcgcagggcg

SEQ ID NO: 444603 - RNA, 63 nt, Human
uuccaagagccagagaugaauugugcugcaucuugccccaauucuuaggauuucuuuuccucc

SEQ ID NO: 444604 - RNA, 63 nt, Human
ucuacucacugagcuaggauuagggaggguuauugccccaaccauugcaaugggagguggagg

SEQ ID NO: 444605 - RNA, 63 nt, Human
ccaccccgggacacagaacuagugagcgcccccugccccaaucucccacagggugcugggugg

SEQ ID NO: 444606 - RNA, 63 nt, Human
accccuugcuuccagaaaggguuuuaaagcccaugccccaacucugccagcccccaccugcca

SEQ ID NO: 444607 - RNA, 63 nt, Human
gaucagauuaccaggaacauaggaguggauuccugccccaaccaaaccgcauucguguggauu

SEQ ID NO: 444608 - RNA, 63 nt, Human
augaugauugcguagauguugccuggugcaaagugccccaaacagcaauagaaaggcauaugu

SEQ ID NO: 444609 - RNA, 63 nt, Human
ggggaaguuccucagccagacucuucagccaaaugccccaacuuucagucuguaccccauccc

SEQ ID NO: 444610 - RNA, 63 nt, Human
gaggugccgucuggcccuucccugcaggccagcugccccaagcgggguagcagccuugaaccc

SEQ ID NO: 444611 - RNA, 63 nt, Human
ccaugauauaugucuucccuuccaccuuaacuuugccccaacuccucuuuuauccuaacaugg

SEQ ID NO: 444612 - RNA, 63 nt, Human
ccgaaacuaacuuuuagcuaacaauaagggcugugccccaauggaaacugaguucauuuucug

SEQ ID NO: 444613 - RNA, 63 nt, Human
caaacggaaagcgccaaauggcuguuuaaaaagugccccaaaucaaauugaauagccuucaga

SEQ ID NO: 444614 - RNA, 62 nt, Human
ccuaucugggccacaagugaagucaacaugccugccccaaacaaauaugcaaaagguucacu

SEQ ID NO: 444615 - RNA, 63 nt, Human
caaccuugcuuguguagucagcagggcuggcccugccccaaggacucacugcauguacccgga

SEQ ID NO: 444616 - RNA, 63 nt, Human
ccuucuucuaggugcagggcccucguccgggugugccccaaauaaacucaggaacgccccggu

SEQ ID NO: 444617 - RNA, 63 nt, Human
ccuggggccuguacaaaagggacaugaaauaaaugccccaaagccaaaugccagucuagaucc

SEQ ID NO: 444618 - RNA, 63 nt, Human
gcauuuguauacagucagcucagccaaaggagaugccccaagugggagcaacauggccaccca

SEQ ID NO: 444619 - RNA, 63 nt, Human
ugagccaagcccccagccccgaucugcagauccugccccaagaagcugggguggugggggcag

SEQ ID NO: 444620 - RNA, 63 nt, Human
uucuagaccaccuaaggagggaagguuauggaaugccccaaguauucaagaucaucuugauug

SEQ ID NO: 444621 - RNA, 63 nt, Human
ggggagcaccugccuguagcccccaucagacccugccccaagcaccauauggaaauaaaguuc

SEQ ID NO: 444622 - RNA, 63 nt, Human
cgauauucucccugaccuuagcguucuggacucugccccaaucggguccagagaccacaccac

SEQ ID NO: 444623 - RNA, 63 nt, Human
aggcuccucucugacacgccuuuaggcgaaacaugccccaagacacagggaccguuucucccc

SEQ ID NO: 444624 - RNA, 63 nt, Human
gagucacgaggaauguguugcugcugccaccccugccccaaaggcuaagggggacagccuucc

SEQ ID NO: 444625 - RNA, 63 nt, Human
cccagcauccagauccuggauccuagacuccuaugccccaaccacugggucaugcgaucccca

SEQ ID NO: 444626 - RNA, 63 nt, Human
cccaguacccagauccuggauccuagacuccuaugccccaaccauugggucaugggaucccag

SEQ ID NO: 444627 - RNA, 63 nt, Human
cagccacaccagacucuggaacccuuuuucgacugccccaacucuuggacaccaggccaacua

SEQ ID NO: 444628 - RNA, 63 nt, Human
ccaagcuaauuccacccucugccccuuccucucugccccaaacucuuccccgggaagggggac

SEQ ID NO: 444629 - RNA, 63 nt, Human
cuugcccaugggggcuguauuuaaggacacccgugccccaagcccaccuggggccccauuaaa

SEQ ID NO: 444630 - RNA, 63 nt, Human
cugccgcccccacucuggcuggcuucucuccccugccccaaaccucucuccucucucuuuucu

SEQ ID NO: 444631 - RNA, 63 nt, Human
agaaaaccaaaaauaaucacaacagaaaccagcugccccaaaggaaccagaggugaaaaacaa

SEQ ID NO: 444632 - RNA, 63 nt, Human
ccagcccaaggccagucggccugggaaguucacugccccaacucuuuucccgggaccauacug

SEQ ID NO: 444633 - RNA, 63 nt, Human
uucauuacaauggaaacaaucuuuuuuacucuaugccccaaauauagcguucccaacaacauc

SEQ ID NO: 444634 - RNA, 63 nt, Human
ucccucccuggccccccaacccucuuccucccuugccccaacccugagaaaggguccagccac

SEQ ID NO: 444635 - RNA, 63 nt, Human
ggggcucccagccugcacuugcaggaguggugaugccccaagucugcgaauccagggugcacg

SEQ ID NO: 444636 - RNA, 63 nt, Human
uccaaagcaggugcugcauggcucaccaucauaugccccaaacaacugaaaguuggcgguuau

SEQ ID NO: 444637 - RNA, 63 nt, Human
aaaaaaucuuaaagcccaaccuuaggaauauagugccccaaaaggcggaugcuucuuccauua

SEQ ID NO: 444638 - RNA, 63 nt, Human
acacgcuccuguuccaccuucacaagaccaugaugccccaaagcagugucucuauucacgguc

SEQ ID NO: 444639 - RNA, 63 nt, Human
uacugugaggagucuggguccauccuggucagcugccccaaugugaccuggggcagauaaaau

SEQ ID NO: 444640 - RNA, 63 nt, Human
caccugcucugugcccgcuccugaaacccagcaugccccaagugagcucugaagcccccuccu

SEQ ID NO: 444641 - RNA, 63 nt, Human
guacccugucuguuucauucaccacagucagcaugccccaagugcccagcauggggcggaugg

SEQ ID NO: 444642 - RNA, 63 nt, Human
cucuugaauguuuagacucuuaagaucauauccugccccaaauuucaaauuaaugaaaugaag

SEQ ID NO: 444643 - RNA, 63 nt, Human
guuuaaaacagaagccugaugcugacauucaccugccccaacucuccccugaccugugagccc

SEQ ID NO: 444644 - RNA, 63 nt, Human
ggcguaaacccugcugccaggcccucuccccacugccccaaaccggccuagacacgaagacca

SEQ ID NO: 444645 - RNA, 63 nt, Human
cacagccccgaaguucgccgggcccggccacccugccccaagggcaagcaaggaauacguucc

SEQ ID NO: 444646 - RNA, 63 nt, Human
aucggcgggagagagugccacgccuccacagcuugccccaagcgcucugccugcccguccacu

SEQ ID NO: 444647 - RNA, 63 nt, Human
ggaggggcgagcuguggagcagccacccacugcugccccaagcucacucaggaauucacaccc

SEQ ID NO: 444648 - RNA, 63 nt, Human
ccgccugccuauggugaaacccacggggugucaugccccaacgcgugcuagagaggcccaauc

SEQ ID NO: 444649 - RNA, 63 nt, Human
agguccucugugcaugggcccgggaggcagaccugccccaagggugaugcagaggccacaggu

SEQ ID NO: 444650 - RNA, 63 nt, Human
gguugggcugcucggcaacugcuugggucaccuugccccaaggaaaccagcccugggugccac

SEQ ID NO: 444651 - RNA, 63 nt, Human
ugggaggccaaggagaagcaagacuggcauaugugccccaacaucuucugagcgccacccuug

SEQ ID NO: 444652 - RNA, 63 nt, Human
uccuucacugagugauacccugcuccgggcccaugccccaaggagcccuucagagcccacacu

SEQ ID NO: 444653 - RNA, 63 nt, Human
uuaugucucccuaaaauguauaaaaccaagguaugccccaaccaucuuggccacaugucauca

SEQ ID NO: 444654 - RNA, 63 nt, Human
gugcuaagauggcccaggauggagguccgggccugccccaagggucccaccacagccagcggg

SEQ ID NO: 444655 - RNA, 63 nt, Human
aagcaagcacuaagcuccacagugccaguuccuugccccaaccuggccccauccaaguacaga

SEQ ID NO: 444656 - RNA, 63 nt, Human
gugacugucuaggaggaucccuugccuuguaggugccccaagaccgcaggguagaaaucagcc

SEQ ID NO: 444657 - RNA, 63 nt, Human
acagcgagagccccaggaagguuugcacagcugugccccaagcaccuuggccuccucucagcu

SEQ ID NO: 444658 - RNA, 63 nt, Human
ccccaagugaguccacaccucacucugcuaccuugccccaacccuucuucauguucaauuauu

SEQ ID NO: 444659 - RNA, 63 nt, Human
cuggcagcugcacuauccccaacuccccacuucugccccaaggguggucacugccugugauac

SEQ ID NO: 444660 - RNA, 63 nt, Human
cccugggugucugggaacugccucccucaucugugccccaaguuccgccaggcccugccccau

SEQ ID NO: 444661 - RNA, 63 nt, Human
ggcaggucaaucuucccaccccaccgugugggcugccccaaccccaaaugugcccagggaggg

SEQ ID NO: 444662 - RNA, 63 nt, Human
ugucuuggccggccccacugcccccccauucuaugccccaaccaccaaggcuuucccaucuug

SEQ ID NO: 444663 - RNA, 63 nt, Human
ugucuuagggcagcacagagccaggucaugucaugccccaaaguguggggacagagccucagg

SEQ ID NO: 444664 - RNA, 63 nt, Human
ccaacaaaaaaaaaaguuucccauacacuggccugccccaaaacccacuaacaauuuuagcaa

SEQ ID NO: 444665 - RNA, 63 nt, Human
gucagguccagcacacaccugggaaagggaugcugccccaagggggaccaaaagggccggacg

SEQ ID NO: 444666 - RNA, 63 nt, Human
gauugaggggucugcugcaggccuccucccugcugccccaaagguauggggaagcaaccccag

SEQ ID NO: 444667 - RNA, 63 nt, Human
guagaaacugaggcccagagagggaagaugaccugccccaaguggugagcaagcaccaaccuc

SEQ ID NO: 444668 - RNA, 63 nt, Human
accacccuuguaacccaguagacuugccccauaugccccaacucauagcaccuaaaauggguc

SEQ ID NO: 444669 - RNA, 63 nt, Human
uuuaacuuagagcuuuuuuuuuuuaauuuugucugccccaaguuuugugaaauuuuucauauu

SEQ ID NO: 444670 - RNA, 63 nt, Human
ugacucguggacaaauuuggcuguccccaguuuugccccaaguugcugucuccccuucccuca

SEQ ID NO: 444671 - RNA, 63 nt, Human
uguggucauaaucaaauacuuaguuguuuuugaugccccaaaauaaagugagaaugguaauuu

SEQ ID NO: 444672 - RNA, 63 nt, Human
gcuggcagccacccccucccccaucauauccuuugccccaaggcugcucagaggggccccggu

SEQ ID NO: 444673 - RNA, 63 nt, Human
aaucauuaucaaauguuccuucagcccugcaguugccccaaauaaccuuuuuucagcauccuc

SEQ ID NO: 444674 - RNA, 63 nt, Human
gugcuguuaaagauagggagccuuuuaaaaaugugccccaaauugaucagucaguaguguaag

SEQ ID NO: 444675 - RNA, 63 nt, Human
cucuggguguuugugaguuugguuucucugcccugccccaagcgugcugagacuuggugccga

SEQ ID NO: 444676 - RNA, 63 nt, Human
ggcuguaguaacccaguggaaugaauuuggacaugccccaaugcuucuauaugcuaagugaaa

SEQ ID NO: 444677 - RNA, 63 nt, Human
caugaaaauuauggaagacuauucugccaccugugccccaaguuggaugagcaaaccacuuug

SEQ ID NO: 444678 - RNA, 63 nt, Human
gaugaccgugcaggccggugacacggccgcaccugccccaaagcgggccgcccgagcguccac

SEQ ID NO: 444679 - RNA, 63 nt, Human
acauaaagacagaggcagagacugaagugaugcugccccaagcccagggaugccuggaguccc

SEQ ID NO: 444680 - RNA, 64 nt, Human
cuggaggcaggcccgggaaggcugcuguuuacucaucgggcagccacgugcucucuggaggaag

SEQ ID NO: 444681 - RNA, 62 nt, Human
ucuguuuucauuaauuuguuauuuuucaaaaaccgagccacaccuuuggaaguaaugauuug

SEQ ID NO: 444682 - RNA, 62 nt, Human
ccuuuggaucauccuggcugggagaagugggaccgagccacccagccccacuauccccaagc

SEQ ID NO: 444683 - RNA, 62 nt, Human
guucuugccugucaccugggccuacacaggucccgagccaacggggcuuucauacccaagga

SEQ ID NO: 444684 - RNA, 64 nt, Human
ucccaguuccagcuuccuaaaauagacaguggguaucgggcagcagucacuggggcucaagggc

SEQ ID NO: 444685 - RNA, 64 nt, Human
augcugcccaucgcuugcacuggggucuuuguggaucgggcaggaguuuucaguguguugggug

SEQ ID NO: 444686 - RNA, 64 nt, Human
uggcugcugccucagcacagagagccagaacucuaucgggcaccaggauaacaucucucaguga

SEQ ID NO: 444687 - RNA, 64 nt, Human
agcuuccauggucacugcuaagcaguagccagccaucgggcauuaauugauuuccuacuauauu

SEQ ID NO: 444688 - RNA, 64 nt, Human
guuggguuuggggggacggugcccccagcccaggaucgggcacucaguggagccgcacacggcc

SEQ ID NO: 444689 - RNA, 64 nt, Human
caaugagaacuuaucauguugguguguuagguaaaucgggcaaauaugauagugucuuacauug

SEQ ID NO: 444690 - RNA, 64 nt, Human
auugccauaaauuguaguuaagaacuguaaggcaaucgggcagugaaacuugauauuguauuaa

SEQ ID NO: 444691 - RNA, 64 nt, Human
aaguugaggcagguugaaggauucacaggguaagaucgggcacaguggcucccgccuguaaucc

SEQ ID NO: 444692 - RNA, 64 nt, Human
acagucuggcccuccagacaagagcagcgcuggcaucgggcaggugauuccugacaccugcugc

SEQ ID NO: 444693 - RNA, 64 nt, Human
accauuaucuguuuaaaggauccauuuaguuaaaaucgggcacucuauauucauuaagguuuau

SEQ ID NO: 444694 - RNA, 64 nt, Human
gaaauuaguuucaaauuuaccucagcguuuguguaucgggcaaaaaucguuuugcccgauuccg

SEQ ID NO: 444695 - RNA, 64 nt, Human
aacuccagaaccacucuuuuugcauaaauaccucaucgggcagcuuucuaagugugauuuuccu

SEQ ID NO: 444696 - RNA, 64 nt, Human
cuucuuggcuucucuggugaugggguuuguuuucaucgggcauacguuuucugcaaugguuuag

SEQ ID NO: 444697 - RNA, 64 nt, Human
gggcaccaggaacaccgucuggaacaggaaggacaucgggcaggacugacacugugucuuguga

SEQ ID NO: 444698 - RNA, 64 nt, Human
cacauauauccacucacaugucuucccucaggcuaucgggcagggggacuucaccaggggguuu

SEQ ID NO: 444699 - RNA, 62 nt, Human
caaucuccauuuucauuaacggggaaacauccccgagccacugagugcugugcuuugucacu

SEQ ID NO: 444700 - RNA, 62 nt, Human
acgcuacccucaucaucuuacucaucuuaagcccgagccauggaucaacuaggagcccauau

SEQ ID NO: 444701 - RNA, 62 nt, Human
aggccuggaggagggcagucccccauggggugccgagccaacgccucaggaaucaggaggcc

SEQ ID NO: 444702 - RNA, 62 nt, Human
cagggcugccagccaggccacucggcaccucuccgagccaugugagcccccugaugccaccg

SEQ ID NO: 444703 - RNA, 64 nt, Human
agccgggccucgccgcgacccuuccggcccaucuaucgggcaccggggcuccggcccgggaccc

SEQ ID NO: 444704 - RNA, 64 nt, Human
ggagaagugcauugaugugagaggagcagugccaaucgggcagaaguuugcaaauaggcagaau

SEQ ID NO: 444705 - RNA, 64 nt, Human
ggguuugggaugggugucuaaggcaggaguugacaucgggcaaccaaagaaaugaguuuugggg

SEQ ID NO: 444706 - RNA, 64 nt, Human
cccuugagugacagcccagggacuuaauguggccaucgggcaucaagcacaaggccaugcaggu

SEQ ID NO: 444707 - RNA, 64 nt, Human
ggggacgcagugccccagcugggaagagggcgggaucgggcacugguuccuccuuguccccgcu

SEQ ID NO: 444708 - RNA, 64 nt, Human
uccuucaguaaauguaacacagucgaggcacgucaucgggcagccuucccugugugccaacgcc

SEQ ID NO: 444709 - RNA, 64 nt, Human
gaagaggggccagaugacacccuaaagcaggcugaucgggcaaugggagguggccaggccugcc

SEQ ID NO: 444710 - RNA, 64 nt, Human
gggaucuggggagggcuagcccaaaaccucccgcaucgggcaggcacccccugaaguacuuccu

SEQ ID NO: 444711 - RNA, 64 nt, Human
uugcugcugcugaauccuuucuggggacuuucucaucgggcagggagcagagggcuucucguuc

SEQ ID NO: 444712 - RNA, 64 nt, Human
cugauggcaccaaaucuugacuccuuuggacgcgaucgggcacuguaucaagagcaugcaaaac

SEQ ID NO: 444713 - RNA, 62 nt, Human
aaguguguggaaggcagggacagagauggaggccgagccaauagacugaagagaccacagca

SEQ ID NO: 444714 - RNA, 62 nt, Human
cuggccuccccuggcuccugccuggaagaauuccgagccagcccauuucuagaaugucaugg

SEQ ID NO: 444715 - RNA, 62 nt, Human
cuaggcacaugugaggcaucuuuccuggagccccgagccagcccugucccuccccagugcag

SEQ ID NO: 444716 - RNA, 62 nt, Human
cagcaucugcugcccugaucacagagacgggaccgagccagguccauaccccuuccucucuc

SEQ ID NO: 444717 - RNA, 62 nt, Human
ugugccuggccgcagggcggggcugggggcugccgagccaccaugcuugccugaagcuucgg

SEQ ID NO: 444718 - RNA, 62 nt, Human
agugauuccccacguguguucaucugcacccaccgagccaggcagaggccagcccuccgugg

SEQ ID NO: 444719 - RNA, 62 nt, Human
cccaggcuaucugcaugcgcucucaggugcuaccgagccauccugggagagauggauggucc

SEQ ID NO: 444720 - RNA, 62 nt, Human
aagccccacugaggccccuacugaggccagccccgagccagccccagacccagccccggugg

SEQ ID NO: 444721 - RNA, 62 nt, Human
cagaugugggcucagauccugggcaugaugggccgagccaccucggaucccacugauuggcc

SEQ ID NO: 444722 - RNA, 62 nt, Human
uuggaagucugcgcccuugugcccugccuccaccgagccagcuuggucccuaugggcuuccg

SEQ ID NO: 444723 - RNA, 62 nt, Human
guguguucuucaagccagcucuaggcuucaggccgagccagguucacacucagaaagagguc

SEQ ID NO: 444724 - RNA, 62 nt, Human
uuccucuuccacaggugugcggccgccugagcccgagccaggagcacuagagagggaggggg

SEQ ID NO: 444725 - RNA, 62 nt, Human
aauggacaggaaauaaguccuuauugauuggaccgagccagggauggcgccagggcgguggc

SEQ ID NO: 444726 - RNA, 62 nt, Human
ccuugucaccugcuugggcacgugcauggaacccgagccaacuucaccccacccucgucauu

SEQ ID NO: 444727 - RNA, 62 nt, Human
gcuaaagcccucccgcgcccccaccccagaccccgagccaccccaggaaaagcacaaggacu

SEQ ID NO: 444728 - RNA, 62 nt, Human
uucauuuuaaauauggauacaaaaaggauacgccgagccaaucaaagacaagcuuuaacuuu

SEQ ID NO: 444729 - RNA, 62 nt, Human
cuuggagggucccugauuccugaggauccuccccgagccaggcacgggggaccacagggcug

SEQ ID NO: 444730 - RNA, 62 nt, Human
agcaggaaaguacagaugcagccgugcaggagccgagccaauuaauuucauuagaggaagaa

SEQ ID NO: 444731 - RNA, 62 nt, Human
uuucaacuauggggcuucaguacugcagcgccccgagccaggcucugugcuucugccuuuaa

SEQ ID NO: 444732 - RNA, 62 nt, Human
gcggugcggcuguuucacaacacuccuggccaccgagccaugguggaggagaugcagggcca

SEQ ID NO: 444733 - RNA, 62 nt, Human
uaaguugaagaaagguaacucguguaugaaccccgagccauuucccuguuguccugaggagg

SEQ ID NO: 444734 - RNA, 62 nt, Human
cuaaacaaauaauacccccgucggaaugguaaccgagccagcagcugaagucucuuuuucuu

SEQ ID NO: 444735 - RNA, 62 nt, Human
accgcagcccagcaugccggugggcccacagcccgagccagcccagagcugccggaagggcc

SEQ ID NO: 444736 - RNA, 62 nt, Human
agcugauguuugccucauuuaaaguaggcaagccgagccaacugcagccaucauucauuaag

SEQ ID NO: 444737 - RNA, 62 nt, Human
gccccuguagagcgucuccccagaaccagaccccgagccacucgcuuccucugugcugugac

SEQ ID NO: 444738 - RNA, 62 nt, Human
ggcaagggacccauccuaggcccgcuuucuugccgagccaagcagcuuagcuggggcugugc

SEQ ID NO: 444739 - RNA, 62 nt, Human
ucauccaacagcuccccgagcugccagccagcccgagccaggaggacgugagugcugauaug

SEQ ID NO: 444740 - RNA, 62 nt, Human
acaaaauaaagaagauaaaauaaauuauauacccgagccauuaaccacaauuuagugaucac

SEQ ID NO: 444741 - RNA, 62 nt, Human
gacccaggugguccugagcugggucccacccuccgagccauggugccccccugccagcuauu

SEQ ID NO: 444742 - RNA, 62 nt, Human
ggcacggccgaccccgccccgggcaccgcccaccgagccauccugccucgccuccccccacg

SEQ ID NO: 444743 - RNA, 62 nt, Human
aauugggccuggcccccauggggcuuggaggaccgagccacugacagguauccccugaaacu

SEQ ID NO: 444744 - RNA, 62 nt, Human
ccgccaggaucccuccccgcggcggcgauggcccgagccaugagagugaggacuuuccgcgc

SEQ ID NO: 444745 - RNA, 62 nt, Human
uugggauuacuggugugagcccccacaccuggccgagccagcgcuucucaacucccaagguu

SEQ ID NO: 444746 - RNA, 62 nt, Human
uucgcaacagccagcgcuaaaagagggggaggccgagccaagaggaccccaggagcccagag

SEQ ID NO: 444747 - RNA, 62 nt, Human
gacuggcagcuaaggaggaccucggaguggacccgagccaggaauaacgaaugacccaaggc

SEQ ID NO: 444748 - RNA, 62 nt, Human
cggacccccacagaccucgggaaggcgcugggccgagccaguguggcugagugaccggggug

SEQ ID NO: 444749 - RNA, 62 nt, Human
agugaaaaaggugccacaaaggaauuccagguccgagccaacagagagaaacaugaauuuuu

SEQ ID NO: 444750 - RNA, 62 nt, Human
agguggcaguggcagcacgucuuccucaugagccgagccagguccauggccaccacguggcu

SEQ ID NO: 444751 - RNA, 62 nt, Human
agagaaagugcugagugucccgagagaggcccccgagccagugcauggagguccuucggccu

SEQ ID NO: 444752 - RNA, 62 nt, Human
cuaucaggugccccucuuccaaaggcagcgugccgagccagcaagaggaaggggugcuguga

SEQ ID NO: 444753 - RNA, 62 nt, Human
gcuggggugggaagcccuguacgagcagcgggccgagccacgcagcggcuucgaggagcugg

SEQ ID NO: 444754 - RNA, 62 nt, Human
aaccuagcucuccagaacaugagaugagccagccgagccagacugugaccaggaaacagcuc

SEQ ID NO: 444755 - RNA, 62 nt, Human
gagauaacuuauuaaucugucgaaggcuuaugccgagccagaagccgaagccacuugcccuc

SEQ ID NO: 444756 - RNA, 62 nt, Human
uguccaaacccacucaugacugcaugacggagccgagccaugugucuuuacaccucgcuguu

SEQ ID NO: 444757 - RNA, 62 nt, Human
guucuuuuuauuccuagauggaacugcgacuuccgagccauggaaggguggauugauguuua

SEQ ID NO: 444758 - RNA, 62 nt, Human
cuuucagccuuaagcagccaccugagccaccaccgagccauggcaggaucgggagaccccaa

SEQ ID NO: 444759 - RNA, 62 nt, Human
uucacugugguauuuauaguauuggcuucaguccgagccacaggcaauaaaaggauaucagc

SEQ ID NO: 444760 - RNA, 62 nt, Human
caugggaccuggccccaggcugucacccuccaccgagccacgcagugccuggaguugacuga

SEQ ID NO: 444761 - RNA, 62 nt, Human
ccucccaagggcacuuaaagugaccugucauuccgagccagcgaaccccagcaguaggaauc

SEQ ID NO: 444762 - RNA, 62 nt, Human
gggcugggcggggcgccggugcuaguggaacgccgagccaguggcggcugguaucccgcggc

SEQ ID NO: 444763 - RNA, 62 nt, Human
caggcucucaucugggacauccagcaaaugccccgagccauugaggacccuauccuggccua

SEQ ID NO: 444764 - RNA, 62 nt, Human
agcgcccugcugccacccagugacuggcagggccgagccagcauuccaccccaccuuuuucc

SEQ ID NO: 444765 - RNA, 62 nt, Human
cugugaagugaaaccucacuccuguccagugaccgagccacugcaaagcacagcugauccug

SEQ ID NO: 444766 - RNA, 62 nt, Human
ccgccucugucuccggccaccggguggcgcugccgagccagagccgccgcgucccggcgcuu

SEQ ID NO: 444767 - RNA, 62 nt, Human
accucugguggccgaucggggcacugcaggggccgagccauuuuggggggccccccuccuug

SEQ ID NO: 444768 - RNA, 62 nt, Human
gcaucauaaagauagcaagcuaccuuccaaggccgagccagcccagagaggagcaugucuuc

SEQ ID NO: 444769 - RNA, 62 nt, Human
gucagaagugugaguuaucagccacucaggcuccgagccagcuggauucucugccugccacu

SEQ ID NO: 444770 - RNA, 62 nt, Human
gguaagaagguucugugcugucucauugaaaaccgagccagucaaccacaaggcuggcaggg

SEQ ID NO: 444771 - RNA, 62 nt, Human
cgcagacccucugugaagccaggccggccgggccgagccagcagccccucucccuagacuca

SEQ ID NO: 444772 - RNA, 62 nt, Human
cuccugcaccccaaagaagccacugaggcuggccgagccacacugucuccccaggggcgucg

SEQ ID NO: 444773 - RNA, 62 nt, Human
auuagcugggcaugauggcacacaccuguaguccgagccacuugggaggcugaggugggagg

SEQ ID NO: 444774 - RNA, 62 nt, Human
ggcccacaaacugucccuguccugucuuccucccgagccauggccucugcuagcuccaccuu

SEQ ID NO: 444775 - RNA, 62 nt, Human
ugauuugaacaccggcagugcuggggcaggacccgagccagcgguggggagagauauaguca

SEQ ID NO: 444776 - RNA, 62 nt, Human
uaaggcacuguaucccaggccucccaauguucccgagccaggaacucugggccccauggagu

SEQ ID NO: 444777 - RNA, 62 nt, Human
caggcagccucguucugcacaggcacuuuagcccgagccaggcacaccugcgagggggcagg

SEQ ID NO: 444778 - RNA, 62 nt, Human
caaccucuggcucccacaaggcccgguguugaccgagccacaggccacggacaggggccggg

SEQ ID NO: 444779 - RNA, 62 nt, Human
auuucaaauaaaccacaaaucaucauuuuccaccgagccacugggcagaauucacacugaag

SEQ ID NO: 444780 - RNA, 62 nt, Human
uucaggggaggccagaggagagcugcugggccccgagccacgaacuugcugggugguucucu

SEQ ID NO: 444781 - RNA, 62 nt, Human
gggccacccgaggccaggauggaggugggaggccgagccaagcagggggacguugccagagg

SEQ ID NO: 444782 - RNA, 53 nt, Human
agaagaguccagccucauaguggccgagccaucccuguccccgucagcagugu

SEQ ID NO: 444783 - RNA, 62 nt, Human
gggaccugccccucacguucucuuggggacacccgagccaggacacuacgcaucccugcuga

SEQ ID NO: 444784 - RNA, 62 nt, Human
ugugcucacugcccccacgccuccugccaaggccgagccacacacccgcuccaccugcauuu

SEQ ID NO: 444785 - RNA, 62 nt, Human
cuggaaaaagcaacuccaucagaacucgcaauccgagccagcucugggggcuccagcguggc

SEQ ID NO: 444786 - RNA, 62 nt, Human
agaauuacugcuugguacgcagagcaccgaggccgagccagggaugaagcugaaauggaaua

SEQ ID NO: 444787 - RNA, 62 nt, Human
aaaccuccacugcugcucccggguccugcugcccgagccaggaacuguguguguugcagggg

SEQ ID NO: 444788 - RNA, 62 nt, Human
caccaacaccgcagcgccuuaugaccccggaaccgagccagccacugaggggagcuggcaga

SEQ ID NO: 444789 - RNA, 62 nt, Human
cuuugugugggccauuccugggcuugaguaggccgagccagugacacugagcggcauggcug

SEQ ID NO: 444790 - RNA, 62 nt, Human
gccaggccaucccugggcgccacagacgagcuccgagccaggucaggcuucggaggccacaa

SEQ ID NO: 444791 - RNA, 64 nt, Human
uaaaugaggguuuacauuuguuuuguuuuguaaccguuaaaaagaaguuguuuccagcuaauua

SEQ ID NO: 444792 - RNA, 64 nt, Human
ucacauaauagaaugccuagucucauugaccaaucguuaaaaaaucauauuugugugucuuaag

SEQ ID NO: 444793 - RNA, 64 nt, Human
uggugaaaggagacuaguagcaucuuuucuacaacguuaaaauugcagaaguagcuuaucauua

SEQ ID NO: 444794 - RNA, 64 nt, Human
uuaccaaaaacaccaaaaggaacaaaggggccugcguuaaaaccuaauugcuaaugcuucacaa

SEQ ID NO: 444795 - RNA, 64 nt, Human
cuuuauauacuauucccaccauggggagcgaaaacguuaaaaucacaaggaauugcccaaucua

SEQ ID NO: 444796 - RNA, 64 nt, Human
uagguuaacacagcuuuauaaaccucaguggguucguuaaaaucauuuaauucucaggguguac

SEQ ID NO: 444797 - RNA, 64 nt, Human
agaucuaauguaaaauccagaacuuggacuccaucguuaaaauuauuuauguguaacauucaaa

SEQ ID NO: 444798 - RNA, 64 nt, Human
auaaauaaacuuucaaaaauuuauuuggcucuuucguuaaaaacugugcaaauuaaaaaaaaaa

SEQ ID NO: 444799 - RNA, 64 nt, Human
agaaagagaaaugaaauauuuuugaaugguugcacguuaaaaauuaaaagaaggaaugggggca

SEQ ID NO: 444800 - RNA, 64 nt, Human
aguguggcuggugugugugucaagcccucacucacccacgcacucacacacagcauucuguucu

SEQ ID NO: 444801 - RNA, 64 nt, Human
ugaagugcuucuuuaauaugcacugucuugucuucccacgcaagaugugacaauguuugagaaa

SEQ ID NO: 444802 - RNA, 64 nt, Human
cccaugcaugugugugcacucggaccgagcaucucccacgcaccucuaccccaccccaagcacc

SEQ ID NO: 444803 - RNA, 64 nt, Human
aaacacuaauaaauguguuuuuacuuuuuauucccguuaaaacugauguaaaacaggauaaagg

SEQ ID NO: 444804 - RNA, 64 nt, Human
uacaguuggcaagaucuccaagcugaaacuuccacguuaaaacuuuugccuguaagaauuugca

SEQ ID NO: 444805 - RNA, 64 nt, Human
aaaguuuuuaauuugaugcccaauauauucugaccguuaaaaaauucuuguucauaugggagaa

SEQ ID NO: 444806 - RNA, 64 nt, Human
agcuagccaguuucuuucaaguauggcaagcuaacguuaaaauguuuagagauuaacagauuuc

SEQ ID NO: 444807 - RNA, 64 nt, Human
gcauguaaauuuuaaauggguacuuugugcaauucguuaaaagaagauacucuaugaauaugau

SEQ ID NO: 444808 - RNA, 64 nt, Human
uguaacagaaagagaauguagccauucuagccaccguuaaaagauacacagugagguguugugu

SEQ ID NO: 444809 - RNA, 64 nt, Human
uuugguaaaugaacuguguauaaaauauuuaugccguuaaaacuguuuuuagaaaguauuuuua

SEQ ID NO: 444810 - RNA, 64 nt, Human
aauauaaauacaguuaacugcauuaagauaaucacguuaaaauuguuacuaugcagcacagaac

SEQ ID NO: 444811 - RNA, 64 nt, Human
aauugagauucaucaucaaagagcaaugcagcgucguuaaaauaaaaacugugccuuuuaaaaa

SEQ ID NO: 444812 - RNA, 64 nt, Human
cucaucagaugucagccuuugcucuccauuuugacguuaaaaaacaacaacagaucuagagaua

SEQ ID NO: 444813 - RNA, 64 nt, Human
gccuuuuugagguguagagauucucagguccaggcguuaaaaaauaauggucaaaagaauaaua

SEQ ID NO: 444814 - RNA, 64 nt, Human
aauagcgacuucaguauuguguuauguuuuacagcguuaaaacaacuaugaagaucugcagcua

SEQ ID NO: 444815 - RNA, 64 nt, Human
gcagaucccaaaggacaguaucaccguaaaccugcguuaaaauguggaagcugcugcuucauua

SEQ ID NO: 444816 - RNA, 64 nt, Human
aggaagaucuagaaguaaaagaaaaaauuagaugcguuaaaaugacaugagcaggcgacucagu

SEQ ID NO: 444817 - RNA, 64 nt, Human
cuguucgugugcagggaaagcagcucacagacgccguuaaaaccagcuucaucuuuccuucagg

SEQ ID NO: 444818 - RNA, 64 nt, Human
agauuaguuuuuuaugugugaagucauuaaauuauuacacgaccagaacuaaaaugcaauauac

SEQ ID NO: 444819 - RNA, 64 nt, Human
uuguauuauaaaagcucagaugacauuucguuuuuuacacgagauuucuuuuuuaugugaugcc

SEQ ID NO: 444820 - RNA, 64 nt, Human
aaaucacaaguccaaccacagagaguccucacucuuacacgaguacugcagugauaccgaacug

SEQ ID NO: 444821 - RNA, 62 nt, Human
aaguuucaguaacaugacacuaaaauggcagagacguuaaaaaaaguuuuucccuucuagag

SEQ ID NO: 444822 - RNA, 64 nt, Human
cuuuaccucagugguaucagcacauuguaaauuacguuaaaacacacaacucacugugaucuau

SEQ ID NO: 444823 - RNA, 64 nt, Human
aacauugcaugaccggaucauuuuagugucuuugcguuaaaaaaucauugcaaaaguauucuga

SEQ ID NO: 444824 - RNA, 64 nt, Human
ggcuauuuuucagaacuguuaaaggucauaugcacguuaaaaguugaccaaugaaaugaauuua

SEQ ID NO: 444825 - RNA, 64 nt, Human
augcuuguguauauguauaaauuaauacagaguacguuaaaagcaaaaagauguauauuugcau

SEQ ID NO: 444826 - RNA, 64 nt, Human
augggguauaguggccaaauagcacauccuccaacguuaaaagacaguggaucaugaaaagugc

SEQ ID NO: 444827 - RNA, 64 nt, Human
cacugaaacuggguauauuuaugauuucuuucagcguuaaaaagaaacauaguguugcccuuuu

SEQ ID NO: 444828 - RNA, 64 nt, Human
uaauuaauccuaaauauugucgcauguugaccuacguuaaaagaugaauaggucuagagccgug

SEQ ID NO: 444829 - RNA, 64 nt, Human
gccuuuuacuuaacugugcccagcaggcugggugcguuaaaaagcccaaguauuuugaaaaaac

SEQ ID NO: 444830 - RNA, 64 nt, Human
gugggagccacaacacccggccaugaauuaacuccguuaaaaaauaaacguauacauucuguga

SEQ ID NO: 444831 - RNA, 64 nt, Human
uaauacugguauuuuuacuuaaucuauaaaaugucguuaaaaaguuguuuguuuuuuucuuuuu

SEQ ID NO: 444832 - RNA, 64 nt, Human
ucacuggaaaggaaagaugaugcucaguuuuaaacguuaaaaguguacaaguugcuuuguuaca

SEQ ID NO: 444833 - RNA, 64 nt, Human
uuaauagaaagacaugauguauguauuuaagccacguuaaaagaaaaaauauaacuauggaccg

SEQ ID NO: 444834 - RNA, 64 nt, Human
uaucacuaauuauuuucuuaauguaggaauguaccguuaaaaaggaccaaaaguuuuuggucug

SEQ ID NO: 444835 - RNA, 64 nt, Human
ucgagaagggccugaccuaaaggucagguccccucguuaaaaaaauauguacgucuagcuccuc

SEQ ID NO: 444836 - RNA, 64 nt, Human
aagaugaagccccaugcucaguccccucccaucccccacgcagcuccaccccagucccaagcca

SEQ ID NO: 444837 - RNA, 64 nt, Human
cauuuucuuuugagaugggggucuugcucuguugcccacgcaggagugcaguggcaugcucuca

SEQ ID NO: 444838 - RNA, 64 nt, Human
cccuaaggacagggaaccaggucccugcacggcacccacgcaggugucccggucugcauaagcc

SEQ ID NO: 444839 - RNA, 64 nt, Human
acugaacuugcaauauuuuugcaaaaaaaucugucguuaaaacugaggauaaaauaccugcuca

SEQ ID NO: 444840 - RNA, 64 nt, Human
uuucugauuugaccuucaucccuuaguuuacuggcguuaaaaaaagucucagcaauuuucauua

SEQ ID NO: 444841 - RNA, 64 nt, Human
cacagccaaacuaggacacuccguucccugaaaccguuaaaaaaucaaacaaaaggaccccaaa

SEQ ID NO: 444842 - RNA, 64 nt, Human
augaagccuuuaagugcugcuucugucagucaaacguuaaaaacuuuaacauuuucaaagugcc

SEQ ID NO: 444843 - RNA, 64 nt, Human
uuuuuuucaccuucuugacauugugagugauacacguuaaaaggcuauuugcccgcauccuccu

SEQ ID NO: 444844 - RNA, 64 nt, Human
ggaaaacagacccaaauuccauaaacagaacugacguuaaaauaugcgaaagauucagaaccua

SEQ ID NO: 444845 - RNA, 64 nt, Human
ggaaaaaaggagguuuuuagacuuucuuaaaagacguuaaaauuuuaggacagaauuuucuuga

SEQ ID NO: 444846 - RNA, 64 nt, Human
gacaaaauggggcaggggagggagaaguuucugucguuaaaaacagauuuggaaagacuggacu

SEQ ID NO: 444847 - RNA, 64 nt, Human
aauauauuggcaaaauaaauguuuaaaccuuuuacguuaaaauuacuuugaaagaugaaaaguu

SEQ ID NO: 444848 - RNA, 64 nt, Human
uagaaaaaaaacaagaaaaaaauuuuaaaaauagcguuaaaaugcauuuuaggcuccuaauguc

SEQ ID NO: 444849 - RNA, 64 nt, Human
acaugaauggccuaaaacugauuuuuuuuuuuuccguuaaaaugugugugucaagauacggaga

SEQ ID NO: 444850 - RNA, 64 nt, Human
aguacauugauguuuugauggcggacuacauaagcguuaaaaauuguguuuuucagaaucuuua

SEQ ID NO: 444851 - RNA, 64 nt, Human
aaaauuauuuucugcaaaaaagaaaaaaaaguuacguuaaaaaccaaaaaacuacauauuuuau

SEQ ID NO: 444852 - RNA, 64 nt, Human
ccacgcuaggcugcauagcauuauaaccugggaacguuaaaaaaaauacagacauucuugauuc

SEQ ID NO: 444853 - RNA, 64 nt, Human
uuaucgucacugcuuaacuucacauauugauuuccguuaaaauaccagccaguaaaugggggug

SEQ ID NO: 444854 - RNA, 64 nt, Human
cugcuucccucccuucuccucugucuugcccuggcccacgcacgccugucucgucuuccuuguu

SEQ ID NO: 444855 - RNA, 64 nt, Human
gugccauguggccuucacugcagcccugcagccacccacgcaccaucugugggucuccaaaggc

SEQ ID NO: 444856 - RNA, 64 nt, Human
aaaaugcuucuuucucagaauucaaaggagacgagucagccaaccacagcuacauuucaggcuu

SEQ ID NO: 444857 - RNA, 64 nt, Human
cuauaaaugacacuuuuauaucuucuuuauucgucguuaaaacgcgguaggaaauuacccugaa

SEQ ID NO: 444858 - RNA, 64 nt, Human
cuuuuguauuaggcuguguauugauaguuaauuccguuaaaaauuacuuggaaaacagugggaa

SEQ ID NO: 444859 - RNA, 64 nt, Human
acaaaaauaacuucugaauuuaucaguguuuugccguuaaaaauauuccucuauaguaaauuau

SEQ ID NO: 444860 - RNA, 64 nt, Human
caccaucaugccacgcauuguuuuuaaagcauugcguuaaaaaaaaaauuaacuaaaccaagau

SEQ ID NO: 444861 - RNA, 64 nt, Human
uuuuugcucacugcaggcaggcaauccaggcagucguuaaaaacacagagagagguguccuccu

SEQ ID NO: 444862 - RNA, 64 nt, Human
gauauggaggaacaagcaaucuuauuuuggaaggcguuaaaaaauuaucugacaguuacauggu

SEQ ID NO: 444863 - RNA, 64 nt, Human
agaccuuaaaugauuucugucugcucugagcggacguuaaaaugggcccccgucccccgacccg

SEQ ID NO: 444864 - RNA, 64 nt, Human
agggcugggaccaggucaugcagcugaaagucuacguuaaaaaaaaaaaguuugggccaggcac

SEQ ID NO: 444865 - RNA, 64 nt, Human
guauucagauaccccuucugcucagccugcuuggcguuaaaauacaaaucauugaacugagggg

SEQ ID NO: 444866 - RNA, 64 nt, Human
aaauccuuuaauuuaccugaugcccucaucaggucguuaaaaauucaaaugguuuuaauagcua

SEQ ID NO: 444867 - RNA, 64 nt, Human
ucaccagguagcugucaggggccaccgagagugucguuaaaaaugggcaugguuguaauaaagg

SEQ ID NO: 444868 - RNA, 64 nt, Human
cuugucuuaaaacugaaaaaaaaauguaguuacacguuaaaaucugcaaaugguuuuuacaccu

SEQ ID NO: 444869 - RNA, 64 nt, Human
ccaucugguuuuauaaacugaguuucuuagcauucguuaaaauuaagggguuuguuuggaauaa

SEQ ID NO: 444870 - RNA, 64 nt, Human
uaccuuuaguuuaccuaaacuuuuguucagauaacguuaaaagguauacguacucuagccuuuu

SEQ ID NO: 444871 - RNA, 64 nt, Human
uaguuuucuuuagaucagaaacugauauuuuugggucagccauauguauuuuguuuaaaggauu

SEQ ID NO: 444872 - RNA, 64 nt, Human
gagaaucgcuugaacucgggagguggagguugcagucagccaagaucgugccacugcacaccau

SEQ ID NO: 444873 - RNA, 64 nt, Human
ggcuucccaagagccuguggcuguggugccgggcuccagacacuucacggaaggaagaucacau

SEQ ID NO: 444874 - RNA, 64 nt, Human
auaaaaucccacccaccugggacuugguaauuucuccagacaggaaagcuuuagaaaacuugag

SEQ ID NO: 444875 - RNA, 50 nt, Human
cgcaguguggggagauguaguccagacaaagacugaaucagguaagugug

SEQ ID NO: 444876 - RNA, 64 nt, Human
agcaauacccguuagacaaggauauuuuacuucuuccagacaccagaagaaauggccuucaauu

SEQ ID NO: 444877 - RNA, 64 nt, Human
uccuuuuggggugagagaccagcagcccaagggcuccagacacaccugaacacaucgugaugau

SEQ ID NO: 444878 - RNA, 64 nt, Human
ccccugugcaaauuuuaaaaaggaacccuuuuccuccagacagauacagccccaaaccagggug

SEQ ID NO: 444879 - RNA, 64 nt, Human
caggaaaaggccacggggcucugaacagccccgguccagacagcagccuguacauccaucccag

SEQ ID NO: 444880 - RNA, 64 nt, Human
ugagcagcuuggcaggucuccaaguggaacccgguccagacagggcugccucgacuucaccuuu

SEQ ID NO: 444881 - RNA, 64 nt, Human
auguacacccagccucagggggaaggcagcucucuccagacagagucucagggcccagcaaggu

SEQ ID NO: 444882 - RNA, 64 nt, Human
acaagguucuguugauauuacauagaacggguauuccagacacuucuuaugaugaaaguccaaa

SEQ ID NO: 444883 - RNA, 64 nt, Human
aggucagaaagagacggcgcuucagaguuuccuuuccagacaccccuccccgcacugugaaguu

SEQ ID NO: 444884 - RNA, 64 nt, Human
cggcaccccccugggccuggagggagagggccaauccagacacacucacacucucaucucuuuc

SEQ ID NO: 444885 - RNA, 64 nt, Human
cuucuacacccaccccaccgaggugcugaagccugucagccagcaccccagggacuucuucucu

SEQ ID NO: 444886 - RNA, 64 nt, Human
cuggaagauagaauccaaguauuuauaacucauugucagccaaaugcuaucaugaacguaggaa

SEQ ID NO: 444887 - RNA, 64 nt, Human
acacaaaagcacgguguuugugaauauaacaccugucagccaacuuuagacagaugguaaagac

SEQ ID NO: 444888 - RNA, 64 nt, Human
acucauaacuuagaaaccgauguuauucauagauuccagacauuguauagaagaacauuuggaa

SEQ ID NO: 444889 - RNA, 64 nt, Human
gcaacaaauagaggccuggccuccaggugccggauccagacaccugaccuagaaugccugcccg

SEQ ID NO: 444890 - RNA, 64 nt, Human
ugguugugacuuuaauuauauacaucucugucccuccagacagaucccucuguccucacucucu

SEQ ID NO: 444891 - RNA, 64 nt, Human
ggcacccacaaccagaggaaucuauaguuuaagcuccagacauacaaacauaaggcacauugug

SEQ ID NO: 444892 - RNA, 64 nt, Human
uuuaccuaucaauauucauugaacugcugcuacauccagacacugugcaaauaaauuauuucug

SEQ ID NO: 444893 - RNA, 64 nt, Human
auaccaacuccccuucuaguucccaaaggcgauguccagacacagacuuuaugauuauuauauu

SEQ ID NO: 444894 - RNA, 64 nt, Human
ccuugcacaggacagccccugcaacaaagaauuauccagacaaaaauaucaauggugcugaggu

SEQ ID NO: 444895 - RNA, 64 nt, Human
cagguuuuuuggaaacuguuaagauaaacuguaauccagacaccuaauucuucaguucacuacu

SEQ ID NO: 444896 - RNA, 64 nt, Human
uggccuggaugcacagugccugaugggaguaggcuccagacaggaggagugggacagacagcag

SEQ ID NO: 444897 - RNA, 64 nt, Human
ggacccagcuccaucgcgcuggaggagagucaccuccagacaacaucugcuccccccacagggg

SEQ ID NO: 444898 - RNA, 64 nt, Human
agccacauucucauagcagguaggacuucagccuuccagacacugcccuuagaaucuggaacag

SEQ ID NO: 444899 - RNA, 64 nt, Human
aaaaaaugccguuuucuuacacuaccaguggauguccagacaugcucuuagucuacuagagagg

SEQ ID NO: 444900 - RNA, 64 nt, Human
accgaaauguuguauucuuauuucaguguuuccuuccagacauuuuuaagguaauuggcuuuaa

SEQ ID NO: 444901 - RNA, 64 nt, Human
auguaccgggagccagcacgaugguccuacacauuccagacauuuuccuuuuugagccgccuga

SEQ ID NO: 444902 - RNA, 64 nt, Human
gaaacuuugccaaauauaaucucaccugcuuccuuccagacagugucgcuaagugcauuucaca

SEQ ID NO: 444903 - RNA, 64 nt, Human
uuuggaggaagcucuggaucacaguugccucaaauccagacagauguuguacuuccaucaugca

SEQ ID NO: 444904 - RNA, 64 nt, Human
gaaaacagauguuuaggagauuuccuguauagcagucagccaauucauaugcuuugucucugcu

SEQ ID NO: 444905 - RNA, 60 nt, Human
aaguaaccacauaucuguagggauuuauaagucagccaugacaauuauacaccacaggca

SEQ ID NO: 444906 - RNA, 64 nt, Human
gaaguccuaucucuauuuauuauauuugaaaguugucagccaccagucauccagaauuuccuuc

SEQ ID NO: 444907 - RNA, 64 nt, Human
acugaggugccaggagaaacugcagucccagguauccagacagccaccaggauggucccucgcc

SEQ ID NO: 444908 - RNA, 64 nt, Human
acuugaugauaacacuauuugaugagucuuagaguccagacacaaagagacaaagcuuugaaga

SEQ ID NO: 444909 - RNA, 64 nt, Human
cauacaggcucuuaccucuucuccugagggcugcuccagacaacauuuauuacccagaagaccu

SEQ ID NO: 444910 - RNA, 64 nt, Human
cagacagacucucaccucuucuccugaggucugcuccagacaacauuuauuacucacaagaccu

SEQ ID NO: 444911 - RNA, 64 nt, Human
acagaaaauguuuucuuugugcucauugaguaguuccagacagaagaagaauauacucuuuaaa

SEQ ID NO: 444912 - RNA, 64 nt, Human
accucaaguucaaguuaauggcauugauuuauguuccagacaaaaauaacacaaauaauaauau

SEQ ID NO: 444913 - RNA, 64 nt, Human
ucuaauuuuggaacaaagcagguuuuacugcuuuuccagacacaaggcugcuaaaccaauuaag

SEQ ID NO: 444914 - RNA, 64 nt, Human
uugcgaaugguuccauucucucuccuguacuuuuuccagacacuuuuuugaguggaugauguuu

SEQ ID NO: 444915 - RNA, 64 nt, Human
auucacaaaaauugacuccccauugcagugaacuuccagacagacugcuuuuccccagucgggg

SEQ ID NO: 444916 - RNA, 64 nt, Human
cucacauacauuccacggugggggacaccauuaguccagacaccgcuguggagauuagcauuuu

SEQ ID NO: 444917 - RNA, 64 nt, Human
ccuuucccaccucccuccugccaguuucccuugguccagacaguccuguuuguggagugcaauc

SEQ ID NO: 444918 - RNA, 64 nt, Human
aaaugguaaucaguuggaauucuccuaaaugucuuccagacacuaguaaaaaacgaccugaaaa

SEQ ID NO: 444919 - RNA, 64 nt, Human
auaccuuccaucucaaccuaccucgaguggcgaguccagacaccaucaccacgcagagagggga

SEQ ID NO: 444920 - RNA, 64 nt, Human
gccauucugauuggaccuggcccagugcaaucuguccagacaagcccugcuugcuggaaaacug

SEQ ID NO: 444921 - RNA, 64 nt, Human
aggaguggugggagcaggggguugauagaaaacauccagacacacauauaagcaaguggccgug

SEQ ID NO: 444922 - RNA, 64 nt, Human
uaagccgagaguuaauuuuucuacacaacauauuuccagacaucuuuuagucuuuuauugucuu

SEQ ID NO: 444923 - RNA, 64 nt, Human
cgcuguccugguguuuuacuacacuccaugucaggucagccaacugcccuaacuguacauuuca

SEQ ID NO: 444924 - RNA, 64 nt, Human
ugcaggugcacagcucuuaggcaucaagcaaagggucagccagucaguaguagugggaggaagc

SEQ ID NO: 444925 - RNA, 64 nt, Human
uaugaugguuuaugugaauaggauuuucucaguugucagccaugacuuauguuuauuacuaaau

SEQ ID NO: 444926 - RNA, 64 nt, Human
gccauccuaacuuauuauuuuccagagguucuccuccagacaagaccugcaguaagcaaagagu

SEQ ID NO: 444927 - RNA, 64 nt, Human
gaagcaaagcaccagcuucuccaggcucuuuggggucagccagggccaggggucucccuggagu

SEQ ID NO: 444928 - RNA, 64 nt, Human
uauuagaaaccacuguauauauguggaaagccaggucagccagaccuguuagaauuggugugca

SEQ ID NO: 444929 - RNA, 64 nt, Human
aggaguggaaggaaaccgcugccuuuaucuugaagucagccacacugggccuggagcccugggc

SEQ ID NO: 444930 - RNA, 64 nt, Human
ccauuaagagagaaggacaaacauuucugagagugucagccauucuugguagacaccucuccac

SEQ ID NO: 444931 - RNA, 64 nt, Human
uaccugggaaauaauuaaacagaagguuaccauugucagccaguuggcuauacugugguuaguu

SEQ ID NO: 444932 - RNA, 64 nt, Human
cucagguugcagacagcugagaaaagauggcccugucagccacccucucucagucugaaacauc

SEQ ID NO: 444933 - RNA, 64 nt, Human
augucuguagccaaaacuuguuuccacauuaagagucagccagcucuggaauggucuggaaaug

SEQ ID NO: 444934 - RNA, 64 nt, Human
uccggggcagcuccugacccuccacagccaccuggucagccaccagcuggggcaacgagggugg

SEQ ID NO: 444935 - RNA, 64 nt, Human
ggacagaccugggccuggcucuugagaggucccagucagccauggagagcuggggaaaccacau

SEQ ID NO: 444936 - RNA, 64 nt, Human
gagaaucgcuagaaccugggaggcggagguugcagucagccaagauagcaccacugcacuccag

SEQ ID NO: 444937 - RNA, 64 nt, Human
aaaauaauuccacuuacacagugggggacucaaagucagccacauuucacauacuguuacugaa

SEQ ID NO: 444938 - RNA, 64 nt, Human
agguucuuggugugaugggacugaaagaauuccagucagccagagccuuggcagcucugaagcu

SEQ ID NO: 444939 - RNA, 64 nt, Human
guagacagcugauauguuuucaugaauaaauauugucagccagaaaagguuggugucagguaau

SEQ ID NO: 444940 - RNA, 64 nt, Human
cgcaggcagcgcagggcuggcacgugacaggcucgucagccaccugggaacacaguucugggca

SEQ ID NO: 444941 - RNA, 64 nt, Human
uuugcagaucugcucacccucggugagcaacagugucagccaugcaagcaggacagaaugguga

SEQ ID NO: 444942 - RNA, 64 nt, Human
aaaacuauacuaucaaaaugugaauaaaauuauagucagccauaaauauugcauaaugacaaau

SEQ ID NO: 444943 - RNA, 64 nt, Human
ggggagugcacaagccgcccaugcaaagaguagggucagccauggcaaggccggaaguugaacu

SEQ ID NO: 444944 - RNA, 64 nt, Human
gagaaucacuugaacccaggaggcagagguugcagucagccaagaucaugcuacugcacuccag

SEQ ID NO: 444945 - RNA, 64 nt, Human
uacauccacuccccaugccacugacauccuaugggucagccaggcuugcuuugacugaggccga

SEQ ID NO: 444946 - RNA, 64 nt, Human
ggggcucguccccuccuccgguuucccagacaaauccagacaccagccuuuaggguggccuugg

SEQ ID NO: 444947 - RNA, 64 nt, Human
ggcuaaggcaggcggaucacuugagguccggaguuccagacaagccuggccaacaugaugaagc

SEQ ID NO: 444948 - RNA, 64 nt, Human
cuggugccaacaggggcaucccggcccauaccccuccagacaggaagcauggguuugcccacag

SEQ ID NO: 444949 - RNA, 64 nt, Human
cuguauauuuuaaugaacuuugauugguuacuuuuccagacauacagauuuaauuuggaauaug

SEQ ID NO: 444950 - RNA, 64 nt, Human
acacacaugcagauaugcugccuggacacacacuuccagacacacgugcacaggcgcagauaug

SEQ ID NO: 444951 - RNA, 64 nt, Human
aguuauuggguaccuccugcaugccuggucccauuccagacaggggccucuggccuggcugagu

SEQ ID NO: 444952 - RNA, 64 nt, Human
uccuuucaaggggaaaaugugaagcugaacccccuccagacacccagaauguagcaucugagaa

SEQ ID NO: 444953 - RNA, 64 nt, Human
agcacucccaccauucguggcaaccaaggaugucuccagacacugccccguguccaugggguua

SEQ ID NO: 444954 - RNA, 64 nt, Human
ggcuugucuuugucugguagaacaaaccuugaccuccagacagagucccuucucacuuauagag

SEQ ID NO: 444955 - RNA, 64 nt, Human
gaucaugggaauugagugucuaugaaaaccauauuccagacaagaauauagucuaagguaaaug

SEQ ID NO: 444956 - RNA, 64 nt, Human
cuuuuuuaauacacaugacuuuccucucccaguuuccagacagggcucuuugaauguaugucaa

SEQ ID NO: 444957 - RNA, 64 nt, Human
aacuauuuuugcacauuggaagccucaaaaacaguccagacauuuguuucaucaggacaccaaa

SEQ ID NO: 444958 - RNA, 64 nt, Human
ggugucagaggaccuugacuggguucauuuuauguccagacaucaccccugaaacacuguacug

SEQ ID NO: 444959 - RNA, 64 nt, Human
uuggcaaaauccugaguaguguaguccuauuaauuccagacaaaaggaguuuaacaaaaacacg

SEQ ID NO: 444960 - RNA, 64 nt, Human
ugguaaaucaagcauguuuguuuacauuaaaaaguccagacacacuguauugugaaaacugcug

SEQ ID NO: 444961 - RNA, 64 nt, Human
gaugcaucuacaguuauuuauuguuacauccuuuuccagacacuguagaugcuauaauaaaaau

SEQ ID NO: 444962 - RNA, 64 nt, Human
caauggcccggaggggcagcaaccccccgcacacgucagccaacagcagugccucugcaggcac

SEQ ID NO: 444963 - RNA, 64 nt, Human
aaggugccaggaggagcauggguguggaaguccugucagccaagaaauaaaaguuuaccucaga

SEQ ID NO: 444964 - RNA, 64 nt, Human
caggaucucucaugccuuuacuuacaaucaagaugucagccaaagcuauagucaucuaacaucu

SEQ ID NO: 444965 - RNA, 64 nt, Human
uccucucucccccaccagggggcgcgcuuaaauuuccagacagagaccagaaggaagguuuaga

SEQ ID NO: 444966 - RNA, 64 nt, Human
ggccucagcuuccuuggagaagccaccccagguuuccagacauagauguugaauuguuuguggg

SEQ ID NO: 444967 - RNA, 64 nt, Human
ggaauuuggcucaacuucaguugagagggugcaguccagacagcuugacugcuuuuaaaugacc

SEQ ID NO: 444968 - RNA, 64 nt, Human
aguauacaagaucacagaccuaaauugagccuguuccagacaaauuggggccuauggucaaccu

SEQ ID NO: 444969 - RNA, 64 nt, Human
cccacuaacagaccuuucuugaagacccacuagguccagacacugccgggacuugcagguaugg

SEQ ID NO: 444970 - RNA, 64 nt, Human
guguuucaaaauuaccuggggauguuguuccaaauccagacaacuggacugucccagacuugca

SEQ ID NO: 444971 - RNA, 64 nt, Human
gauauguguauguaaauuagaaaauacauaccuauccagacauaaaugcuaaguaacauuuuuu

SEQ ID NO: 444972 - RNA, 64 nt, Human
gagcccuguccgcagaucaaccagccuaccaacuuccagacacgaguaaagccauccuagacua

SEQ ID NO: 444973 - RNA, 64 nt, Human
caucuuuccuaggaugcugauccucccgcuggcuuccagacagaccugggacuuggcagucaug

SEQ ID NO: 444974 - RNA, 64 nt, Human
cugagacuuccucugcaguugaugugguccuggauccagacaccgcucaucccgaucucuuccu

SEQ ID NO: 444975 - RNA, 64 nt, Human
ucccacucucgucuccuuccccucgccauagaguuccagacauauuuuccgaucaagcuuuuau

SEQ ID NO: 444976 - RNA, 64 nt, Human
cuaucugacaaccagucccagccccugcuuacauuccagacagacacagacuacaccacaggag

SEQ ID NO: 444977 - RNA, 64 nt, Human
ggacagaggacugaccgguuccauuuuuuuuuuuuccagacaaucacucagcuggaaugucugc

SEQ ID NO: 444978 - RNA, 64 nt, Human
acucccuggagcuaucuguggucuuagggaaggauccagacauacacggcuuugggguacaagc

SEQ ID NO: 444979 - RNA, 64 nt, Human
aucucaaauagagaccuguugguugcuaggguaguccagacaccccuuagaugucuucauaaua

SEQ ID NO: 444980 - RNA, 64 nt, Human
aaauggagacaggcauauucaugggucaucaaaauccagacauacagucaacacugagaaucag

SEQ ID NO: 444981 - RNA, 64 nt, Human
aauguaauuauuaauauguuaggauuuauccucagucagccaguuuguuaugucuuuucuauuc

SEQ ID NO: 444982 - RNA, 64 nt, Human
accugcccaggguaggccuggcaugagggguuaggucagccaaugucagcugcuucucuugggg

SEQ ID NO: 444983 - RNA, 64 nt, Human
cuuguguaucccgggaaggaccugcgguacaggagucagccaugucugugcuguguggaaccac

SEQ ID NO: 444984 - RNA, 64 nt, Human
aacucucaguagauguuuguguuugucaagauucuccagacaaacuuccuuaaaaggauuggcu

SEQ ID NO: 444985 - RNA, 64 nt, Human
cuguagacuuccaguuuuucuuaaauugaagagcuccagacacuuuugagcaggguuugugaau

SEQ ID NO: 444986 - RNA, 64 nt, Human
uagaggcuccuuccgaacaaguaaaaagucuguauccagacaucuaugugcuuggacaacggga

SEQ ID NO: 444987 - RNA, 64 nt, Human
uggcuucugugauggugcaagaggcaggauggucuccagacaccuucuugcagagugauuuuga

SEQ ID NO: 444988 - RNA, 64 nt, Human
cgccaguagcaccccgaauugacaacccaaacucuccagacaucaccaacuguccccugcgagg

SEQ ID NO: 444989 - RNA, 64 nt, Human
aguagcacccccgcuagagcugugaaaaauucucuccagacauagucagaugucuccuggggcc

SEQ ID NO: 444990 - RNA, 64 nt, Human
uauuuauguucauaguacuuuuccucuugucuacuccagacaguuauuccauaaagcauuugua

SEQ ID NO: 444991 - RNA, 64 nt, Human
ucaacuaauuuuuucagaucaguaucuucuagauuccagacagaaaaaaauuacacuucagaaa

SEQ ID NO: 444992 - RNA, 64 nt, Human
uaguucacagcuguucagggugacagugagcagauccagacaccagauccagcuaggcuagaug

SEQ ID NO: 444993 - RNA, 64 nt, Human
uccucgcccauccugcagggauugcccaccgucuuccagacaccccaccugaggggggcaccag

SEQ ID NO: 444994 - RNA, 64 nt, Human
aaagaccucaggcaccaccuucgcauaaacuuuuuccagacaaggcuaaaugugcaugcuucau

SEQ ID NO: 444995 - RNA, 64 nt, Human
aauauacaguguuauccuauguuuaaaagggugauccagacaugagacgcaacuaguuggugca

SEQ ID NO: 444996 - RNA, 64 nt, Human
ucucucccccgcaacccauccucagccggggccguccagacagcaacaaggugggcaccauccc

SEQ ID NO: 444997 - RNA, 64 nt, Human
ggagggcacccuaggcucugggaucccgugucuuuccagacaauguuuuguuuccuuuccuuug

SEQ ID NO: 444998 - RNA, 64 nt, Human
uuuuuuauuagguggaugaggccucuugaacaauuccagacauucauaguggagaaguuauuca

SEQ ID NO: 444999 - RNA, 63 nt, Human
ggguuacuauuaaagcauagacaaguagcugucuccagacagugggaugugcuacauugucua

SEQ ID NO: 445000 - RNA, 64 nt, Human
agacaucucugcccaagcuuccugugcccagggugucagccacaauucagcgggugagggccuc

SEQ ID NO: 445001 - RNA, 62 nt, Human
gcaaugucuuauuaaaaaacaacaaaaaaagacaaauggaacaaagaagcugugaccccagc

SEQ ID NO: 445002 - RNA, 64 nt, Human
gaggacggcgccugugcccacggcugcugccugcuccagacauuuuguucuugaaucugugaga

SEQ ID NO: 445003 - RNA, 64 nt, Human
cucacauuuuugguaguguuucaaacguucuuuauccagacagacaauguuuaagagaaacaac

SEQ ID NO: 445004 - RNA, 64 nt, Human
agcuucaaaacagaacggguucucccaugggggcuccagacauuguauuuuacuuugugcaaua

SEQ ID NO: 445005 - RNA, 64 nt, Human
aaucucuuucagagaggagaauacaacaucuuaguccagacauuuaacauacugcauuucaagu

SEQ ID NO: 445006 - RNA, 64 nt, Human
cuaacccguuucccgaaaaaggugcuaccuccuuuccagacagaugagagagggcaggacuuca

SEQ ID NO: 445007 - RNA, 64 nt, Human
ggagaaccaugcucuuguucuguuccuguucgguuccagacacugguuucuugcuuuguuuucc

SEQ ID NO: 445008 - RNA, 64 nt, Human
agcugccucuucucuugacagucugaagcucgcauccagacagucgcucagucuguucacugca

SEQ ID NO: 445009 - RNA, 64 nt, Human
ggcaccaggacugcucuccaaggaacuggaccuguccagacaguuacacuccaaggucauugga

SEQ ID NO: 445010 - RNA, 64 nt, Human
aagaccagacuaauauauuaauauauaucugcuguccagacagccuguaucuugggggacaggg

SEQ ID NO: 445011 - RNA, 64 nt, Human
gggcugcaaguuucuggaggcccccaggaggccuuccagacaucugcguuccuucuggacucuc

SEQ ID NO: 445012 - RNA, 60 nt, Human
agcggaggaagauuaccuagacgcaugcuuuccagacagggcguuuuggcugcaucacag

SEQ ID NO: 445013 - RNA, 64 nt, Human
ccccccuucucuuccugagugauucucagccaaguccagacagugcucggcgggugaggaaggg

SEQ ID NO: 445014 - RNA, 64 nt, Human
aaccuucauaccuuuaucuggaaaaugccuucucuccagacaauaagacaguucacaucuggag

SEQ ID NO: 445015 - RNA, 64 nt, Human
ggcacugaggcuggagggacauggagcccccucuuccagacacuauacuuccaacugcccuuuc

SEQ ID NO: 445016 - RNA, 64 nt, Human
agcugucgucacugacuucaugacagucuggcccuccagacaagagcagcgcuggcaucgggca

SEQ ID NO: 445017 - RNA, 64 nt, Human
guccccuaauuauucaaggaagugacaaauauuguccagacaacuuacauacacuccauggcaa

SEQ ID NO: 445018 - RNA, 62 nt, Human
uggcuuaagccuuccagcugagugaagcuaggcaaauggagugggggcaggcaucuauuccu

SEQ ID NO: 445019 - RNA, 62 nt, Human
ccagcacauugacucucucuuugauaacuaagcaaauggaauuaugguugacagagaguuua

SEQ ID NO: 445020 - RNA, 62 nt, Human
cccuauguaaguuaagaucauaauauguggaacaaauggaauuguaagugcuuucaaagggu

SEQ ID NO: 445021 - RNA, 64 nt, Human
gauaaaauccauuuagaaaauguuaaacugcuuuuccagacaugguuguagcauauuuucaauu

SEQ ID NO: 445022 - RNA, 64 nt, Human
aagcccgagguagguggagggacuagaggacuucuccagacaugauucuucauagagugguaau

SEQ ID NO: 445023 - RNA, 64 nt, Human
gggcuucccuuggcuuccagaaggcagccuuccauccagacaagccagugagcucuccccuugg

SEQ ID NO: 445024 - RNA, 64 nt, Human
gcuauucccauuuugcagacaggacagcagaggcuccagacaaugccuuuccuuucuuuuucac

SEQ ID NO: 445025 - RNA, 64 nt, Human
aggcucuguugaggaaguagaaucccaaugggacuccagacaguaaaucuuuuucgcuguuuuc

SEQ ID NO: 445026 - RNA, 64 nt, Human
ccacgcccugugucagaccaucugggaauuaagcuccagacagacuuacagaugccuuccuuag

SEQ ID NO: 445027 - RNA, 64 nt, Human
ucugcaggacacccugguccccucuccacuggcauccagacaucugcuuugggucauccacauc

SEQ ID NO: 445028 - RNA, 64 nt, Human
cuuugcuuccccuaaggcaggcuguccgcuuaaauccagacaauggauauauuaagguucuccu

SEQ ID NO: 445029 - RNA, 64 nt, Human
uagcaugguaaaccuggguuuuguucauauuuucuccagacagaaaugcaaagaucaaacugug

SEQ ID NO: 445030 - RNA, 64 nt, Human
gguucuacuaccaugaucuuuauaaacuaugccuuccagacaauugauaaugcugcuauaauua

SEQ ID NO: 445031 - RNA, 64 nt, Human
cuuucaccucugcaccuaguuuuuucccauugguuccagacaaaggugacuuauaaauauauuu

SEQ ID NO: 445032 - RNA, 64 nt, Human
uacauauuaaaauuauaucacaaauauauaugcuuccagacaaagaaaaguuuguuaguccuga

SEQ ID NO: 445033 - RNA, 64 nt, Human
ccagccucugccaacaccggaacaagccgacgcuuccagacaaggcggaaaaggccuuuuguaa

SEQ ID NO: 445034 - RNA, 64 nt, Human
guuagaauaggcucucuacccagcuagaacaccuuccagacacuugcuggacagcuaucuucca

SEQ ID NO: 445035 - RNA, 64 nt, Human
aacgagcugacagcacacucccaggagaaauguuuccagacaacuccccaugauccugucacac

SEQ ID NO: 445036 - RNA, 64 nt, Human
uuucuuacuucuguuucugucauuuccccucuguuccagacagucaucauuuauccucuguucu

SEQ ID NO: 445037 - RNA, 62 nt, Human
ccuucaacucucacuagaaaaucuuuugaaaccaaauggauuaauuuauggcuauuuauaau

SEQ ID NO: 445038 - RNA, 62 nt, Human
ucccugaaagucagaagucaccauagagccugcaaauggauccuccugugagagugacguca

SEQ ID NO: 445039 - RNA, 62 nt, Human
gguguauuugagaagauaaucauugcuuaugucaaauggagcugaauuugauaaaaacccaa

SEQ ID NO: 445040 - RNA, 64 nt, Human
uaagggagaaaaaucucaaccaaaguuaugcucauccagacaagcugaccuuugaguuaauuuc

SEQ ID NO: 445041 - RNA, 64 nt, Human
ugcagucccaucccuucugugccacucaaugccauccagacaugguuuuucccuccaggggccu

SEQ ID NO: 445042 - RNA, 64 nt, Human
gguugaggcagggcaaaugacaugcacugacccuuccagacauacgaaacacaaaccacaacug

SEQ ID NO: 445043 - RNA, 64 nt, Human
aaagugccugcuuuacacucaugaguaaaagcacuccagacauuuuuauaauugcaagauuuuu

SEQ ID NO: 445044 - RNA, 64 nt, Human
aguaccuguagcacgccagugcuguuucccggccuccagacacaaggcucgagguuauggcagu

SEQ ID NO: 445045 - RNA, 64 nt, Human
guagacccuagacugguggggccucugaaaugcauccagacacugugcuggguguguugcaugg

SEQ ID NO: 445046 - RNA, 64 nt, Human
agcugagaaaaugggagcugugcuucagcuacccuccagacaagggcaagaguuagccagaugc

SEQ ID NO: 445047 - RNA, 64 nt, Human
uaguccuuucugugaagcuaauacaauggucauuuccagacaaauuuaaaggaaacacuaaggc

SEQ ID NO: 445048 - RNA, 64 nt, Human
acccccuucccuuuccuccaaaccccuaacucccuccagacacccagggaauacccucugcccc

SEQ ID NO: 445049 - RNA, 64 nt, Human
auaauaggggcuggaaagccagcagcugugguacuccagacaaaaggugagugaccaaucuggc

SEQ ID NO: 445050 - RNA, 64 nt, Human
agaggaagcccgugguucuggcuaggcucucauguccagacagcggggaccaggggaaaaccca

SEQ ID NO: 445051 - RNA, 64 nt, Human
aaaccauagcagggucauaggccccaagaaggcuuccagacagaacccggcacuguagagcuac

SEQ ID NO: 445052 - RNA, 64 nt, Human
gaaugauauagaaggugguuucgaaggaggagacuccagacaaggaaaacagaaaucuuauguu

SEQ ID NO: 445053 - RNA, 64 nt, Human
aaugcuacaggguuauaggccucuccuuucacauuccagacaauggagaguguuuaugguuuca

SEQ ID NO: 445054 - RNA, 64 nt, Human
cucacuguggaaucaggcaccagccacauaauguuccagacaaagccuggaaggguguggaccc

SEQ ID NO: 445055 - RNA, 64 nt, Human
ucuucuuucuccccagccuucucauuuccgccucuccagacacugcgcccuccacccucacucu

SEQ ID NO: 445056 - RNA, 62 nt, Human
uucuuaaaacacgagaguucuagggaggacagcaaauggagccauucugauucugacaaaaa

SEQ ID NO: 445057 - RNA, 62 nt, Human
aauucacgcugaaaugugcuucuuugugcuaucaaauggaauagaauacacuuauuuuuuaa

SEQ ID NO: 445058 - RNA, 62 nt, Human
uuuacaagagguaguagacuaguggaaauccccaaauggagccaagacuucugagcuauaac

SEQ ID NO: 445059 - RNA, 64 nt, Human
ugugccacugccaggggaggaaaggccuugauguuccagacaauaauaaaugcgccugugacuu

SEQ ID NO: 445060 - RNA, 64 nt, Human
gauuuggucuuagaauccaugucagauuggugcuuccagacaucuauucccaguccaucagagu

SEQ ID NO: 445061 - RNA, 64 nt, Human
ccccucccuggcucuuaccaggucacgugaucccuccagacaacauccugccccucgucaucug

SEQ ID NO: 445062 - RNA, 64 nt, Human
cccuggaacauucgagagcaaaucaaaaccucuauccagacaagacaaaauaaaacucaccauc

SEQ ID NO: 445063 - RNA, 64 nt, Human
agagccauaucacagaugcauucaucauaauaauuccagacauuuucaucacccuaaaaggaaa

SEQ ID NO: 445064 - RNA, 64 nt, Human
agugagaaaucaacaaaaagcaaaauaagacaauuccagacacuccugaauuuacuuggauuua

SEQ ID NO: 445065 - RNA, 64 nt, Human
uccaacuuugucagucuuuucugccucaacuucuuccagacaucagucaccaugagacuguuuu

SEQ ID NO: 445066 - RNA, 64 nt, Human
uguuuaagucgggauuuuuacagagggagcugucuccagacagcuccaucaggaaccaagcaaa

SEQ ID NO: 445067 - RNA, 64 nt, Human
caccaccucagagcuguucaggaagcugguccuguccagacacguccugcaguuccuccugcuc

SEQ ID NO: 445068 - RNA, 64 nt, Human
uuugggggugaauuugucaauaucuggauuuuaauccagacaucucugcuaacaagccuuuggu

SEQ ID NO: 445069 - RNA, 64 nt, Human
caugcuuuucggggaaaacuucauucacaaguauuccagacaccaggcuucaggcauggccaug

SEQ ID NO: 445070 - RNA, 64 nt, Human
gaaggucagauagccggagaggagccaagaucccuccagacagcaccagcucacagacgcucuu

SEQ ID NO: 445071 - RNA, 64 nt, Human
uagucauggcagaaggaggggaaaagacuuguuuuccagacagaaaaucuacuccccugucccc

SEQ ID NO: 445072 - RNA, 64 nt, Human
ccucgccagauuuugcacucugagguuucuaucuuccagacaagagcugggaggcaagauuucu

SEQ ID NO: 445073 - RNA, 64 nt, Human
gaaacuauacaucauuuuugcccucugccuguuuuccagacauacagguucuguggaauaagau

SEQ ID NO: 445074 - RNA, 64 nt, Human
agaugcgcgauacaggucuaguuucgguaacuguuccagacaucaagcaauaaaaaaaugaaua

SEQ ID NO: 445075 - RNA, 62 nt, Human
gagaaucucaaacaucucacauauauacaagccaaauggauuucuuacuugcacuuugacug

SEQ ID NO: 445076 - RNA, 62 nt, Human
auuucaaaagauauaagaauauuacuauccuucaaauggaaaaugcgaccuugacuuuaugg

SEQ ID NO: 445077 - RNA, 62 nt, Human
caccaauaaaauggcauaaaaauauuaaaucacaaauggauaagugagaccaaggcaauuua

SEQ ID NO: 445078 - RNA, 64 nt, Human
uuacaggggacucagaggccgugcuccugaccgauccagacacuauuacuggcuuuuuuuuuuu

SEQ ID NO: 445079 - RNA, 64 nt, Human
uuguucugugauuauugggggacacccggcucccuccagacaaugccagcauaaauccauccau

SEQ ID NO: 445080 - RNA, 64 nt, Human
gaaaauuuuucugaaauaugucauugaauuguauuccagacacagaauacaugauaaauacuga

SEQ ID NO: 445081 - RNA, 50 nt, Human
gagacagcaagagaucuugauccagacagagcagcauaucuuugcucaua

SEQ ID NO: 445082 - RNA, 64 nt, Human
uugcacguuggggcauuaggggcaauaauucuuauccagacaugggagccagugaauuuaauuu

SEQ ID NO: 445083 - RNA, 64 nt, Human
ggaaaaaguacuugagaccaaggccagcaucaauuccagacaucuucauguuccuaauaggcua

SEQ ID NO: 445084 - RNA, 64 nt, Human
aaugucacauucuauuuuggguauuaauauauaguccagacacuuaacucaauuucuugguauu

SEQ ID NO: 445085 - RNA, 64 nt, Human
ggcucugcagccgguucuccgggcccuggucaccuccagacagcugccuggccggggccacuag

SEQ ID NO: 445086 - RNA, 64 nt, Human
uuaauugguguuuucuuauugcacugaauucaacuccagacaccauacaaagggagaugauggc

SEQ ID NO: 445087 - RNA, 64 nt, Human
ggugaacagaacuuaaauugccauucuggauacuuccagacauuuuccacuaacaaagauauca

SEQ ID NO: 445088 - RNA, 64 nt, Human
acauaaguaguuuuuuuuucaauuacauguugcuuccagacauacuucucugcaacuuguugag

SEQ ID NO: 445089 - RNA, 64 nt, Human
gcuucaugaauaugccacucuguuaauuucuuguuccagacauuuuaauagagauugcuugagc

SEQ ID NO: 445090 - RNA, 64 nt, Human
acagacagagcuguauuaaguaaccuguuuugaauccagacauucacucccccacuugcuauga

SEQ ID NO: 445091 - RNA, 64 nt, Human
auacgcauuaagggccugcuggagaaaccuucacuccagacagacagggggcuaaggggcuagg

SEQ ID NO: 445092 - RNA, 64 nt, Human
ugacucccugguggacgcgcugccucaacacuuguccagacaccucuggccagguuggacccgc

SEQ ID NO: 445093 - RNA, 64 nt, Human
uccuugccccccucucuuucuucccucuuuccccuccagacauucuaguuuguggaggguuauu

SEQ ID NO: 445094 - RNA, 62 nt, Human
gauccuguguuucaaaacuagaauuuguaaugcaaauggagcucagucuaauaaaaaagagg

SEQ ID NO: 445095 - RNA, 62 nt, Human
aaaaccauuaccaaacuuuaucaaggacuuuccaaauggaguuuucaaauacuauugaccac

SEQ ID NO: 445096 - RNA, 62 nt, Human
gucuuuuuuuaaaaaguuaaggcacucugaaacaaauggaaaguccuaugaaacuguauugu

SEQ ID NO: 445097 - RNA, 64 nt, Human
ugaaacccggugucuaccaaaaauacaaaauguauccagacauggugguguguaccuguagucc

SEQ ID NO: 445098 - RNA, 64 nt, Human
agacccugacucagaaagaaccacuugcccacaguccagacagauggauuguagguggguuuuc

SEQ ID NO: 445099 - RNA, 64 nt, Human
cccugcuuuauaccauucacaucccagggcuguguccagacagcacaaaacggcaaggagagcc

SEQ ID NO: 445100 - RNA, 64 nt, Human
uaaaaacuuaaacucaccaaaugguguuuuguuauccagacagccuaguaugaaccguggagga

SEQ ID NO: 445101 - RNA, 64 nt, Human
aacaccagugaguguucaucugcagccuucccucuccagacagagcagcuacaccaguaauggc

SEQ ID NO: 445102 - RNA, 64 nt, Human
auuaucuagauuuuuguccacaguauaugauccauccagacauuugcaaacgucaggagaaaaa

SEQ ID NO: 445103 - RNA, 64 nt, Human
aacuuugaccagauguugacacuuaauaugaaauuccagacagcugugauuauuuuuuacuuuu

SEQ ID NO: 445104 - RNA, 64 nt, Human
cccacccucauugucaugccagauugucagaaguuccagacagaugagaaagcaaaaaguacuu

SEQ ID NO: 445105 - RNA, 64 nt, Human
agcuaugucacuccccucccacuccugaccauauuccagacaccugcccuaauccucagccugc

SEQ ID NO: 445106 - RNA, 64 nt, Human
cacgaaugaguaacuccugucaccacucugaagguccagacagaagguuuugacacauucuuag

SEQ ID NO: 445107 - RNA, 53 nt, Human
aaaagcugaggcaaaagugagccuccagacaggacaacccucuucaucacugg

SEQ ID NO: 445108 - RNA, 64 nt, Human
auaaauaugcucagccacccugugggccgggcaauccagacagcaggcauaaggcaccaguuac

SEQ ID NO: 445109 - RNA, 64 nt, Human
agucgccuccccucucugggcuagaguuuccuuauccagacaguggggaaggcaugacacaccu

SEQ ID NO: 445110 - RNA, 64 nt, Human
ugccucccaucacccgcuaagagggagggagggcuccagacacauguccaagaagcccaggaaa

SEQ ID NO: 445111 - RNA, 64 nt, Human
caggguguuuagaauuuucuaaauguaguucugcuccagacagggaauuaggcccccaucaucc

SEQ ID NO: 445112 - RNA, 64 nt, Human
ggagaagcagccgugcugccaggucacccagaccuccagacagccggcuagccccacugcccgu

SEQ ID NO: 445113 - RNA, 62 nt, Human
gaacagacaggaauuucuugugcaauguggagcaaauggaauggucuccuuccgcaagucuu

SEQ ID NO: 445114 - RNA, 62 nt, Human
ccuuuccuaucacucaaggccccagccuggcacaaauggaugcauacaguucuguguacugc

SEQ ID NO: 445115 - RNA, 62 nt, Human
uuuaguucuagcuacuaaaaccuguaugaacucaaauggauaggcaucuugugagggugugu

SEQ ID NO: 445116 - RNA, 64 nt, Human
ugcuguggcuaaaaaagcaaaaacaaaaaagcuauccagacaaaauacauagggaucagaaacu

SEQ ID NO: 445117 - RNA, 64 nt, Human
acccuuucugaaagcaaacagugcugcucuuuauuccagacaaggcaggaaagucugaguuggg

SEQ ID NO: 445118 - RNA, 64 nt, Human
cccccagcucucguguccuggaggaagagcuagcuccagacauggguugaucaccuagaggagc

SEQ ID NO: 445119 - RNA, 64 nt, Human
gagaggccuugggcccagaugagccaguacagacuccagacagaggggcccuuggggcccucca

SEQ ID NO: 445120 - RNA, 64 nt, Human
ucugaaugacacuuaaaaugauugcuuguuuauguccagacagacuuauuuuuuauucuaauga

SEQ ID NO: 445121 - RNA, 63 nt, Human
ugacaggcaguccagccugaccuuucugcacacuccagacaaacuucccagacaagcuccuuu

SEQ ID NO: 445122 - RNA, 64 nt, Human
cguuccagccacuugacuguccucgacggccuguuccagacagggcguuuguuuuguccaugcc

SEQ ID NO: 445123 - RNA, 64 nt, Human
cugaaugggccacuugggaccggaagugacuugcuccagacaagaggugaccaggcccggacag

SEQ ID NO: 445124 - RNA, 64 nt, Human
ugggcaccagccuugcccucuuagccuccauccauccagacagcccuucccaccuccugguggu

SEQ ID NO: 445125 - RNA, 64 nt, Human
guaagauaccaccaguauuacaacacaaugauuuuccagacaaaugguaugguguugaaaaaua

SEQ ID NO: 445126 - RNA, 64 nt, Human
acuggaguugccucaguugacacagcaggccccauccagacagaccagcaggugcuucuggaga

SEQ ID NO: 445127 - RNA, 64 nt, Human
cuccuccccuucccaguuaccaaagacucgaacuuccagacagggacccagggacaccccgaag

SEQ ID NO: 445128 - RNA, 64 nt, Human
ugcuucagccucccgaggccgaagccucagccccuccagacaggccgcugacauucagcaguuu

SEQ ID NO: 445129 - RNA, 64 nt, Human
agagccuucccauugaauugaaggggagaacgucuccagacagaauucuacaucggucuaaucu

SEQ ID NO: 445130 - RNA, 64 nt, Human
ccuaggaccucacuggccauaggagcugggccacuccagacauuaauccccaccccaacagagc

SEQ ID NO: 445131 - RNA, 64 nt, Human
ccagguccuccccacagucaagggagcucuuccuuccagacauccuugugugccucuugcuagu

SEQ ID NO: 445132 - RNA, 62 nt, Human
uauuuauuuauucuaacaaaaagcaauuacuacaaauggaugacacauuuaaugaacacaau

SEQ ID NO: 445133 - RNA, 62 nt, Human
cauuagguucuuugguuacugcacuguaguuucaaauggauccuccagauggcauucauguc

SEQ ID NO: 445134 - RNA, 62 nt, Human
ccuaugcauauuuuaugggggcaguauuauuacaaauggaucugaaaugucaguucuaguau

SEQ ID NO: 445135 - RNA, 64 nt, Human
auacugccacccaaaaaucuuuuugaaaaucauuuccagacaaccucuuacuuucuguguaguu

SEQ ID NO: 445136 - RNA, 64 nt, Human
uuuauucuugacccuacgugagucacccaugaaauccagacauucucacccccagcggaugcac

SEQ ID NO: 445137 - RNA, 64 nt, Human
uuggcagaugcaggcgggccuccucccaggcugcuccagacauggggguuggggauggggggca

SEQ ID NO: 445138 - RNA, 64 nt, Human
ccucacuccacucgugucugcuuuugugcagcgguccagacaguggcgacugcgcugacagaac

SEQ ID NO: 445139 - RNA, 64 nt, Human
uacacaaaaauauuuuccuuguagaaaauaguuuuccagacacuuagccuucugaagugcucau

SEQ ID NO: 445140 - RNA, 64 nt, Human
cuguguacagcgagugaauuaaaaugucugccucuccagacauuucuuaaugauuccacuuaau

SEQ ID NO: 445141 - RNA, 64 nt, Human
gcacuaugcuuuccuucuuugggauagagaauguuccagacauucucgcuucccugaaagacug

SEQ ID NO: 445142 - RNA, 64 nt, Human
uugcuucuguuauuucugucauugugaagacggauccagacacagaagaacaaagacccaguca

SEQ ID NO: 445143 - RNA, 64 nt, Human
uaaaacuuccuaagagacuaucugaacucuauacuccagacaguuaggugggaguauaaaucua

SEQ ID NO: 445144 - RNA, 64 nt, Human
augcuccgggcccacacccugcaggacaaggagcuccagacaggacguccauaagucaccgagg

SEQ ID NO: 445145 - RNA, 64 nt, Human
gagccugggcaaguagcaagggcuucccgcugccuccagacagcaccuggguccucgccacccu

SEQ ID NO: 445146 - RNA, 64 nt, Human
cagaaccagaagaagagaccugcaacugugagaguccagacaggaagcagagaaggcguccuug

SEQ ID NO: 445147 - RNA, 64 nt, Human
ccagauggccuccugagcuggacgaccccaggucuccagacaucuagggaccagagcagguuug

SEQ ID NO: 445148 - RNA, 64 nt, Human
uuuuuaaauaagugggucaaguacaccagccaccuccagacaccagugcgugcucccgaugcug

SEQ ID NO: 445149 - RNA, 64 nt, Human
agaugccauagacccucagaacuugaccuggaaguccagacacugaacgcaggccucaaaacug

SEQ ID NO: 445150 - RNA, 64 nt, Human
gaugguggagggugcugggagcuggcaggguccuuccagacagucucagccucuccccgccgcc

SEQ ID NO: 445151 - RNA, 62 nt, Human
cuuccgaaaaaggcauuaagggcuagagaugucaaauggaagagacuuaggaucaagacauu

SEQ ID NO: 445152 - RNA, 62 nt, Human
ugucucaggagcuugauccagaccucuacaagcaaauggagaaguucaggaagguaggaggu

SEQ ID NO: 445153 - RNA, 62 nt, Human
auaagcacauaguaaaaagggaacaucagggucaaauggaaaucaccugagacaggaaacag

SEQ ID NO: 445154 - RNA, 64 nt, Human
uaccacaggacuuugcagggagccuggacuccuguccagacaccuggugagagccugaggcugg

SEQ ID NO: 445155 - RNA, 64 nt, Human
agccucacacccccaaggaggggacggugccacuuccagacaagacccacaaaucucaggugga

SEQ ID NO: 445156 - RNA, 64 nt, Human
accuccaccugccccacucaccaccucugcuaguuccagacaccuccacgcccaccugguccuc

SEQ ID NO: 445157 - RNA, 64 nt, Human
ugaauucuauuuuauuuuuaauucucucuucuccuccagacacaauggcacugcuuaucuccga

SEQ ID NO: 445158 - RNA, 64 nt, Human
uguccaguccuuaauccuguguugcaauucucuguccagacaaucucaacucugagguugcuug

SEQ ID NO: 445159 - RNA, 64 nt, Human
ggcugccccuccccuccggcccucuccacugcuuuccagacacuaaccaaggcuuccaggccag

SEQ ID NO: 445160 - RNA, 64 nt, Human
gggaaaggggagagggggagaaaacuguacucuguccagacaugauagagggacagagccaaaa

SEQ ID NO: 445161 - RNA, 64 nt, Human
caagcccucccuccuacgaucaagacaccuuuuguccagacagcucccuuagcguugccuggaa

SEQ ID NO: 445162 - RNA, 64 nt, Human
aggccaccuccacuccuacaaaaucaaaguauuguccagacaagagucacuggccccugcucca

SEQ ID NO: 445163 - RNA, 64 nt, Human
cuggucccagcagguaugggcaguugcuugaggcuccagacauacucaccucuaccucgaccac

SEQ ID NO: 445164 - RNA, 64 nt, Human
ugcccccuccuggacgugcccauccccccucagauccagacaugccccucccccgcagacacac

SEQ ID NO: 445165 - RNA, 64 nt, Human
acauuuggcugcaugagcaagucggccgcacacuuccagacagugugcuguuugaauugacuau

SEQ ID NO: 445166 - RNA, 64 nt, Human
aucacugcuuagugucaacuugacaucuucagcuuccagacagaaaacccaugcuuuacuuugu

SEQ ID NO: 445167 - RNA, 64 nt, Human
uggugcuucuccucuccuagccccugucaugguguccagacagagcccugugaggcugggucca

SEQ ID NO: 445168 - RNA, 64 nt, Human
ugggugccugggauccuggcagacagagguuguguccagacagccagcauggaaguuucgggaa

SEQ ID NO: 445169 - RNA, 64 nt, Human
agggaaaguuaggaauaggccucccagaggauacuccagacaguugacaagcaucgcagccccu

SEQ ID NO: 445170 - RNA, 62 nt, Human
acacaaagcaaugcaaagacaagauugccaugcaaauggaugguuuuggacauacgagucuu

SEQ ID NO: 445171 - RNA, 62 nt, Human
uguauguguguuaaaucaccaauuauauuaaucaaauggaaauuaauugcauguuacuaucu

SEQ ID NO: 445172 - RNA, 62 nt, Human
auaugugaaaccuaaaggaagugguucuguugcaaauggacuauaaacagggacauuauauu

SEQ ID NO: 445173 - RNA, 64 nt, Human
ccccaacagaucugccauggagggaucuggugccuccagacaugugcacaugaauccauaugga

SEQ ID NO: 445174 - RNA, 64 nt, Human
ccugcuguaugcuauuuucuuagaucuugguacauccagacaggaugaggguggagggagagcu

SEQ ID NO: 445175 - RNA, 64 nt, Human
aagauaagaaaucccuuucagagccagggaaggguccagacaggagauuuggauauaggagcuc

SEQ ID NO: 445176 - RNA, 64 nt, Human
ccggauugaagcuuugaaauuagacuaacaaagcuccagacagcaagagcccaggugcacugcu

SEQ ID NO: 445177 - RNA, 64 nt, Human
ugcauuccuuagcgucuuguuugaccugcuugcuuccagacauaaccugcaugaaucaguuuug

SEQ ID NO: 445178 - RNA, 64 nt, Human
auaagggagaaaggcaccaagcuaacaucugacguccagacaugaagagaugccagugccacga

SEQ ID NO: 445179 - RNA, 64 nt, Human
guuaugaucagaucgaagugugaccccugugugguccagacagcccugcagagagaaaaccuuu

SEQ ID NO: 445180 - RNA, 64 nt, Human
gcgggcaggguugggcugaaucaaaugggagcccuccagacauaaggaggccagaggcugcaag

SEQ ID NO: 445181 - RNA, 64 nt, Human
agagaaagaaaauuauauauguauauacuaaagauccagacaucagggcugggcacagcgguuc

SEQ ID NO: 445182 - RNA, 64 nt, Human
gcgagcugcccaccacccccaguuguugcgccuuuccagacagaaccaguguacaucuuacacg

SEQ ID NO: 445183 - RNA, 64 nt, Human
ucugaaucccacccggucccaccuccugaaccuauccagacaccuucuccugacccaggcacca

SEQ ID NO: 445184 - RNA, 64 nt, Human
ggaucagugcucucuauugauguucuugcuggucuccagacacauuccuguugcauuaagacuu

SEQ ID NO: 445185 - RNA, 64 nt, Human
uuaacuggggaccaucugugaaauuaauuuuccauccagacagcugcugugagcaaaugaacau

SEQ ID NO: 445186 - RNA, 64 nt, Human
gagcagucuguaugguaggccaucagugaaucacuccagacaggaaauuuucuauuuuuguuua

SEQ ID NO: 445187 - RNA, 64 nt, Human
gcgguccccaugguggcagccccccgacugaucauccagacacaaaggucuugguucucccagg

SEQ ID NO: 445188 - RNA, 64 nt, Human
cuucuauccagccggcacccuaugcucuacagcuuccagacaucucugcccaagcuuccugugc

SEQ ID NO: 445189 - RNA, 62 nt, Human
auaaacaucauauuuuuuauuaauaccuacaucaaauggaaaauaucugaaauuuuuuuucc

SEQ ID NO: 445190 - RNA, 62 nt, Human
ggaggcugagaaaggggaagagaaaaacaaaccaaauggaugauguuagcuuuaggaucgug

SEQ ID NO: 445191 - RNA, 62 nt, Human
uguacauagcaccgugcuaggcucugggaucccaaauggacccuuuuaacuuucugaagaug

SEQ ID NO: 445192 - RNA, 64 nt, Human
ccuuaaaauucacacauuuaaaguuuuuagugucuccagacacagugguucaugccugugagac

SEQ ID NO: 445193 - RNA, 64 nt, Human
acuuucucaguacaagcaacuguuauccauugaguccagacaguugggaagugccuguaggaaa

SEQ ID NO: 445194 - RNA, 64 nt, Human
uucagcuggggaggggaagaggugcuggcuccuuuccagacaugcuuauguauaaguaaagggg

SEQ ID NO: 445195 - RNA, 64 nt, Human
ugccccuaaagagcauccugauaccauucuauucuccagacauggaggggaugauaaaggaaau

SEQ ID NO: 445196 - RNA, 64 nt, Human
acucacaguuugaaacugaagcaguaaacuuguuuccagacaucuuuuucagauugucuuaagc

SEQ ID NO: 445197 - RNA, 64 nt, Human
uauacuggguuggaugcuagagugaagaaagccguccagacaauucucccaguccauucauuuc

SEQ ID NO: 445198 - RNA, 64 nt, Human
gggacagugggcucugccagggcugccgcaccuguccagacacacauguucuguuccuccuccu

SEQ ID NO: 445199 - RNA, 64 nt, Human
agaagugggauucaggaaugggccaagccaggguuccagacaggguggggcuuagaauggggcu

SEQ ID NO: 445200 - RNA, 64 nt, Human
guguggaguggaggggucagcagggggguuggguuccagacagaguggaucuggagucugaagg

SEQ ID NO: 445201 - RNA, 64 nt, Human
gccucgcccugcaacguucuuauccugaucaaaguccagacagguuuuggggggggcucagguc

SEQ ID NO: 445202 - RNA, 64 nt, Human
uccccuguccuuccuucguggauugucuccauuguccagacagugcccccaccucccaccgccu

SEQ ID NO: 445203 - RNA, 64 nt, Human
aucauguuuagaccuucugguagaagaaauaauauccagacaggggaugauuuggcuucagcag

SEQ ID NO: 445204 - RNA, 64 nt, Human
aguaccauacacaccuaaaagaugagagaauucauccagacauauuacagccaguuuggggccc

SEQ ID NO: 445205 - RNA, 64 nt, Human
agagacucuaguuaagaggugcuggcugcggggauccagacagggcacauugggggcauggaag

SEQ ID NO: 445206 - RNA, 64 nt, Human
uaauuaaucuugugaauuacagaacagguugugguccagacaccaagaaucauagggguuuuuu

SEQ ID NO: 445207 - RNA, 64 nt, Human
ugcuaguuacuuuuaauaaaguaaucccugauucuauaccgaaguuuuauaucuuagaauuuua

SEQ ID NO: 445208 - RNA, 64 nt, Human
ggauuuggauuucuugaagcaggcagcuucauauuauaccgauuuguucucugucuuuuugugu

SEQ ID NO: 445209 - RNA, 60 nt, Human
ggaagcuccgagccuguuuucuguaguuuauaguuagagcucuauuuuguuaugguuuuu

SEQ ID NO: 445210 - RNA, 64 nt, Human
uaccacgaagccaccaccaccuucaguaacaaggguacgauaugggggucugccaagcugugag

SEQ ID NO: 445211 - RNA, 64 nt, Human
ugucacaacuguuauguuuuccaguaaacuagaaguacgauauuugauaauuauauuuguauuu

SEQ ID NO: 445212 - RNA, 64 nt, Human
gaggaaagugaggcugagagaauccaauuagcuuguacgauaucacuccauaagagaagcaaau

SEQ ID NO: 445213 - RNA, 64 nt, Human
gugcaauagagugaucacaucuuuguuucuucauguacgauagcuaucccuacagaagauaaug

SEQ ID NO: 445214 - RNA, 64 nt, Human
uuuauuuuauuuuauuuuauuuuaucgaggggggguacgauaccugccauuuaagaaaaugaau

SEQ ID NO: 445215 - RNA, 64 nt, Human
ucuuuuuaaucaacagucauuaauaaauguacauguacgauauucaaacuuuagaauuucagcu

SEQ ID NO: 445216 - RNA, 64 nt, Human
cagcuggccucuggacagagguaggcauaguacaguacgauauaucauuccucugguccuaaau

SEQ ID NO: 445217 - RNA, 64 nt, Human
ggaccugcuuggucagcugcagguuguaaauaguguacgauacuagcaucugguauuuuauuua

SEQ ID NO: 445218 - RNA, 64 nt, Human
aaaagaacaacccuaguaccuuuuuuuagaaacaguacgauaaauuauuuuugaggacuguaua

SEQ ID NO: 445219 - RNA, 64 nt, Human
ggagggcuggggcgggggccgggcuuggaacgauguacgauacccucauagugaccauuaaacc

SEQ ID NO: 445220 - RNA, 64 nt, Human
cagaagugggcuugucauggguagggcuuucggcguacgauaaaaggaucauuuguuuuuuaaa

SEQ ID NO: 445221 - RNA, 64 nt, Human
agcccuuuggugauaaguacuuccucuaggaaauguacgauagguagaauugugguucccuaaa

SEQ ID NO: 445222 - RNA, 64 nt, Human
caaugggugguauuugcuuuguaacuccccccagguacgauagggacugaauauggacccugcu

SEQ ID NO: 445223 - RNA, 60 nt, Human
uccugugcuuccccagcuucccaaaguagcuaguuagaacuuaagguaaauauuuauucu

SEQ ID NO: 445224 - RNA, 60 nt, Human
gcaauuuguaaauauugcuaaaagcauguauaguuagaacugauuacauccguaggacaa

SEQ ID NO: 445225 - RNA, 60 nt, Human
cuuggcacucggcacucauuggcacagugguaguuagaggugaaaaguagagcugucaag

SEQ ID NO: 445226 - RNA, 64 nt, Human
acuguuguccuuaaaauuccccuuuuuucucuauguacgauaaaguaacaguaugucagauaag

SEQ ID NO: 445227 - RNA, 64 nt, Human
uagugauacguuagaggguuccuauucuuccauuguacgauaaugucuuuaauaugaaaugcua

SEQ ID NO: 445228 - RNA, 64 nt, Human
gccgaauccaacaguagcugauuaaaagcuccaaguacgauaauuccucaagcaugagaccuug

SEQ ID NO: 445229 - RNA, 64 nt, Human
cacaucuccuuaaccacacuuaaucuccaaauaaguacgauaacauagucauagucccacccaa

SEQ ID NO: 445230 - RNA, 64 nt, Human
auaauguauuuugcaacgaauuuguaauuuuucuguacgauaguuuugauaauuuauaguacuu

SEQ ID NO: 445231 - RNA, 64 nt, Human
ccaugacuacagccauuuaaguguucagcacuguguacgauacauaauauuugguagcuuguaa

SEQ ID NO: 445232 - RNA, 64 nt, Human
cagaagcaaauuauuugaagcucucuaauuugugguacgauauugcuuauugugacuuuggcau

SEQ ID NO: 445233 - RNA, 64 nt, Human
aaaguugagcgucauuuuucuuagugugccaagaguacgauauuagcguuuccauuguauuuuc

SEQ ID NO: 445234 - RNA, 64 nt, Human
ugaaucaguauguagcuuaacaccauccacucacuccaacaaagaacacuuagaaugauaaaaa

SEQ ID NO: 445235 - RNA, 64 nt, Human
uuuguacgugagaaacgcucaugacagcaaagucuccaacaauaaaauacagccauguaccaca

SEQ ID NO: 445236 - RNA, 64 nt, Human
caccaaagaagugauaauuuccacaugauuaauuuccaacaagacacuugggaguuauuuacug

SEQ ID NO: 445237 - RNA, 64 nt, Human
ggcuuaccaucucuaccaucauccgguuuagucauccaacaagaagaaauaugaaauuccagca

SEQ ID NO: 445238 - RNA, 64 nt, Human
aguaaccaaaggguuugcuaacucugcuucaacauccaacaacacaaaacuauaugauuuuuaa

SEQ ID NO: 445239 - RNA, 64 nt, Human
ccucuugcuggccauuguugcuucuguugucaccuccaacaaaagggcaacucagggaaccuac

SEQ ID NO: 445240 - RNA, 64 nt, Human
uaggcugaauccuaaaauaaauuagucaaaaaauuccaacaaguagccaggacugcagagacac

SEQ ID NO: 445241 - RNA, 64 nt, Human
uuugucauacugcacauauaaaacgucuuuuguuuccaacaagaggauuuucuuuuucauucua

SEQ ID NO: 445242 - RNA, 62 nt, Human
uuucuugcaugcauaugcugaauuuuuuuaagcaaauggaucauggcaccccaaaaugaaag

SEQ ID NO: 445243 - RNA, 62 nt, Human
cacaugguaauuuuuaaugggacuuuuaucagcaaauggaguuacaggaauucucuguaaug

SEQ ID NO: 445244 - RNA, 62 nt, Human
uuucuuucuuccacaaagcagccguuucuauucaaauggaaauucaguaccagagaauaaau

SEQ ID NO: 445245 - RNA, 64 nt, Human
agaauacaaaugaaaccccuucuuucucuuuccguccaacaacucuguagagcucucugcaccc

SEQ ID NO: 445246 - RNA, 64 nt, Human
ucuuccacccauucccccauguggcugaagacauuccaacaauggggugggcccauaauaguua

SEQ ID NO: 445247 - RNA, 64 nt, Human
augugagaggaucucaugguucugaugaugauuauccaacaaacaucuggcccucucuacaucu

SEQ ID NO: 445248 - RNA, 64 nt, Human
ucuaauaagucaaggaaaccagaauuugacacacuccaacaauccgaaggggcauguugcuccu

SEQ ID NO: 445249 - RNA, 64 nt, Human
gaaggaagcauuucuaaaauguauccccuuucgguccaacaacaggaaaccugacuggggcagu

SEQ ID NO: 445250 - RNA, 64 nt, Human
acuggaaagauccagccuuacuugucuuaaauuguccaacaaggugacucauugcccggcaaac

SEQ ID NO: 445251 - RNA, 64 nt, Human
ucuaucgccauggauucauucuuucaauuacucauccaacaaauuuuuauuaaaucccacuccu

SEQ ID NO: 445252 - RNA, 64 nt, Human
uguucuguaucccccuuugcccuugccuugcccuuccaacaaacccuaggcccuugagaagcug

SEQ ID NO: 445253 - RNA, 64 nt, Human
cgagggcgacccggccuggcggggcgcagugcuguccaacaaggaagagcugcucacccugcgg

SEQ ID NO: 445254 - RNA, 64 nt, Human
ucugagcauuggugugcauuaagguacucaaucuuccaacaauaaauaccauaagugcaugucu

SEQ ID NO: 445255 - RNA, 64 nt, Human
guuacaauaaaaugcucucaaguccuuugaauguuccaacaaauucaaaacuucauuuucugaa

SEQ ID NO: 445256 - RNA, 64 nt, Human
uucuaccuggacacaaaggcgaggacccugggguuccaacaaagcucagcucccagauucucuu

SEQ ID NO: 445257 - RNA, 64 nt, Human
uaccgaggagcuaaacaugcugccaaccagcuuguccaacaacuccaggaaaacuguuuuucaa

SEQ ID NO: 445258 - RNA, 64 nt, Human
aaaacaaaaaaaagaaagaauugauaguacaaaauccaacaacaauacugagaugaucuaagaa

SEQ ID NO: 445259 - RNA, 64 nt, Human
ccuuuauuuauaauacauuuccuacgggcuguguuccaacaaccauuuuuuuucagcagacuau

SEQ ID NO: 445260 - RNA, 64 nt, Human
uuggccuguuugauguaugugugaaacaauguuguccaacaauaaacaggaauuuuauuuugcu

SEQ ID NO: 445261 - RNA, 62 nt, Human
acuaguaguaguauucuuacuaagacccaauacaaauggauuauuuaaaccaaguuuaugag

SEQ ID NO: 445262 - RNA, 62 nt, Human
ccaucagcagaaagucaccugucuacauagaccaaauggagcaccaaggccaagcggacaga

SEQ ID NO: 445263 - RNA, 62 nt, Human
caaacacaaaaccuugagugugcuuugggaaccaaauggaccuucugggacaagcugagcaa

SEQ ID NO: 445264 - RNA, 64 nt, Human
cuuaacagcaaaaugcaauggaaggaagaaaaguuccaacaaagaaugauuuugugaauucugu

SEQ ID NO: 445265 - RNA, 64 nt, Human
gcaacauguguaucugccgauuguucuccaugguuccaacaaauugcaaauaaaacuguaugga

SEQ ID NO: 445266 - RNA, 64 nt, Human
aggagcugguugaagcaucagagcaaugcuacaguccaacaauggagcauuagauccccagcua

SEQ ID NO: 445267 - RNA, 64 nt, Human
ucuuugcucauggcaugacacagcggagaccgccuccaacaacgaauuuggggcuacgaagagg

SEQ ID NO: 445268 - RNA, 64 nt, Human
auauuuuuagaaaacguuuaagaaucaauuaugguccaacaauuauagcuucugaggucaguuu

SEQ ID NO: 445269 - RNA, 64 nt, Human
aaaaaaguggcaaaucccguuggagguuuugaaguccaacaaauuuuaaacgaauccaaagugu

SEQ ID NO: 445270 - RNA, 64 nt, Human
ucugaggggaugcaacaaaaugauccuuaugauguccaacaaggaaauagaggacgaaggccug

SEQ ID NO: 445271 - RNA, 64 nt, Human
ggagauuggacuagaggaguccugagaggacacuuccaacaagagacauuuauucucugauuuu

SEQ ID NO: 445272 - RNA, 64 nt, Human
cugguguggccaagcacagucggaugcccaaagauccaacaaggccauggcucuguguccuuga

SEQ ID NO: 445273 - RNA, 64 nt, Human
accuguggcuacugguagagaauuggaauaagcuuccaacaauggacuguagagauuaauggag

SEQ ID NO: 445274 - RNA, 64 nt, Human
uuuuacuguauauauugugguagcauguucaaaauccaacaaguaaugugaauuuuagauguaa

SEQ ID NO: 445275 - RNA, 64 nt, Human
uugcaggcacacugcagugguuuuccugcagcucuccaacaaacgccugagucacaggccagag

SEQ ID NO: 445276 - RNA, 64 nt, Human
acguggagauauuaaauuauaccuaaagcagacguccaacaaauucuguacaugcugcuuuaca

SEQ ID NO: 445277 - RNA, 63 nt, Human
cccccucuguggucuccugaagggagcgccuccuccaacaacacguggaucugcaugguuugc

SEQ ID NO: 445278 - RNA, 64 nt, Human
aauuuuguuggucugaauacaaacauuucacuucuccaacaaguaccugugaacaguacaguau

SEQ ID NO: 445279 - RNA, 64 nt, Human
gcagugcaaauaugugaaaugucuuuugguuuauuccaacaauuauuuauuuuagaaaguaagu

SEQ ID NO: 445280 - RNA, 62 nt, Human
uacuuaaauacguuugauuucugaaaagccuacaaauggaggggaaaugagauugugcuaau

SEQ ID NO: 445281 - RNA, 62 nt, Human
aggaauguaucaucuuuuuuuuucucauauuacaaauggacaaauaacggacuuucuauuuu

SEQ ID NO: 445282 - RNA, 62 nt, Human
gaucugggggcccccccagcuggcgggaaccccaaauggacacaaacuguacauuugccaau

SEQ ID NO: 445283 - RNA, 64 nt, Human
guuuuuauaucuuugguucaaaacggcaugucucuccaacaauuuaagugccugauacaaaguc

SEQ ID NO: 445284 - RNA, 64 nt, Human
uuauuuuuauuuuuugaaaaacaaaaggcaagucuccaacaauuaacuuuugaugcuuucuguu

SEQ ID NO: 445285 - RNA, 64 nt, Human
agcuagggaggggggacucagcacccacaccuccuccaacaagcuccugcuggggagagggcug

SEQ ID NO: 445286 - RNA, 64 nt, Human
uuaacuucccucuaucccgcuuauaaaaaaauucuccaacaaaaauacuuguugacuugauguu

SEQ ID NO: 445287 - RNA, 64 nt, Human
ucuagccagcuagccuuaacaucuaagaaauuuuuccaacaagcaaaaaccuuuagaaaugaaa

SEQ ID NO: 445288 - RNA, 64 nt, Human
uuacuaaauuuuuaguaugcacugaaaguuuuuauccaacaauuauguucauuuuaagcaaaau

SEQ ID NO: 445289 - RNA, 64 nt, Human
gguaaacuguuacaaauccagaauggugaaagaguccaacaauggcugagggaaguagagguua

SEQ ID NO: 445290 - RNA, 64 nt, Human
uauuccuccuguugauauugcugcuuuuggaaguuccaacaaugacuuuauuuugcaucagcau

SEQ ID NO: 445291 - RNA, 64 nt, Human
ucacaauagccaagauauaggagcaaccuagguguccaacaacagaugaauggauaaagaaaau

SEQ ID NO: 445292 - RNA, 64 nt, Human
auaagacuuaguuaaggauaguuaacuauuauacuccaacaauucaugagcaacaguauauaca

SEQ ID NO: 445293 - RNA, 64 nt, Human
uugucuuuuuaugacaggauguuugcucagcuucuccaacaauaagaagcacgugguaaaacac

SEQ ID NO: 445294 - RNA, 64 nt, Human
ugaaugacaaucagaauuccacugcccaaaggaguccaacaauuaaauggauuucuaggaaaag

SEQ ID NO: 445295 - RNA, 64 nt, Human
aaaagauauaugaauaugacaaaguauugcugaguccaacaauguuguuuuaagacucuuaaaa

SEQ ID NO: 445296 - RNA, 64 nt, Human
augcagucuuucccagggaacuccgaugaaguguuccaacaaaaugagcgagugaaccaagaag

SEQ ID NO: 445297 - RNA, 64 nt, Human
gaaggcccaacaggaguuugcaacaggugugauguccaacaaaacuguccagaccgcagcugca

SEQ ID NO: 445298 - RNA, 64 nt, Human
cuucuuccgugguuuccuuuuggaaacuccuccuuccaacaagcagugggaucccggggcccag

SEQ ID NO: 445299 - RNA, 62 nt, Human
guggaaauuaagaagaaacuaggucugauauucaaauggacaaacugccaguuuuguuuccu

SEQ ID NO: 445300 - RNA, 62 nt, Human
gcagccauugggaaauugggagaaaugauaaacaaauggaaaaagaagaugucccuaaccua

SEQ ID NO: 445301 - RNA, 62 nt, Human
gugcaggaaaccgaguagaaaaugugacccuccaaauggagaagcugcaggcuuugccauug

SEQ ID NO: 445302 - RNA, 64 nt, Human; identical to SEQ ID NO: 445296

SEQ ID NO: 445303 - RNA, 64 nt, Human
caaucauuuaguauuuuaggaccugugaauaacuuccaacaaaauuaaugaauaccauauuagu

SEQ ID NO: 445304 - RNA, 64 nt, Human
uuaugcugcaucgaauuguaacugaaaguauagauccaacaaauagagacuggguucuagagag

SEQ ID NO: 445305 - RNA, 64 nt, Human
uuaauuagagccuccuuccuuucugugagauuuuuccaacaagcaugugauuuacguggaauuc

SEQ ID NO: 445306 - RNA, 64 nt, Human
gaaauagaggugcaguuagaggacggucacuuuuuccaacaaaacccacuccauagccaugugg

SEQ ID NO: 445307 - RNA, 64 nt, Human
ggcucacagauugugugucggcugcagcagugauuccaacaagcagcuauugggggggaaacac

SEQ ID NO: 445308 - RNA, 64 nt, Human
aaggguuuucauucucaaacaagaugcuuuguucuccaacaagauguucaucucaucacuugca

SEQ ID NO: 445309 - RNA, 64 nt, Human
agaaacuuccuaccuggucagcuuuuucagcuucuccaacaaaugggaguugaggcaguaggag

SEQ ID NO: 445310 - RNA, 64 nt, Human
augcacccagguagcccugggcauggagcaccuguccaacaaccgcuuugugcauaaggacuug

SEQ ID NO: 445311 - RNA, 64 nt, Human
gcauguaucaaaacaccuguggaguacuuuagacuccaacaaauaauaauguaacuaaaacugc

SEQ ID NO: 445312 - RNA, 64 nt, Human
gcauauuugugguugacauacucuagauagcuuuuccaacaaaucuuugaaaagcaaucuugga

SEQ ID NO: 445313 - RNA, 64 nt, Human
ggaggacuuuuuuauucuuauggaaauagugaauuccaacaacuaugaugaacuauguucuuug

SEQ ID NO: 445314 - RNA, 64 nt, Human
gggaagugcuccucaccuguguggcccagauggcuccaacaagcaaaaggaaggaugcagugac

SEQ ID NO: 445315 - RNA, 64 nt, Human
uuuguuugcuggaacagaagccgucuuugaauucuccaacaagaggcaucagccacugugucuu

SEQ ID NO: 445316 - RNA, 64 nt, Human
uauuuuuauuaaucucuguauccuuagauaguccuccaacaaccaaagguugggacucugucuu

SEQ ID NO: 445317 - RNA, 64 nt, Human
cauuaccucaaagcagucauuccuuaguaaaguuuccaacaaauagaaauuaaugacacuuugg

SEQ ID NO: 445318 - RNA, 62 nt, Human
cuuguuaacccaagaugcugcuacacagaugccaaauggaaaucuuccacagggcuuuuuca

SEQ ID NO: 445319 - RNA, 62 nt, Human
ugaauccgaagagauaaagcuuacuugacuuucaaauggagagaugaugaaaacccacucau

SEQ ID NO: 445320 - RNA, 62 nt, Human
aucucugcucugugcuccucaaaauauaauuucaaauggauccgaucuaaaucuauaccuag

SEQ ID NO: 445321 - RNA, 64 nt, Human
agccacauugaauuuuugccaaaugaaaaacacauccaacaaucaaguuucuaagaagguguca

SEQ ID NO: 445322 - RNA, 64 nt, Human
caaacaauauguuugcaaacuuguuagaucaaccuccaacaacgacacauucaggaguuaaaua

SEQ ID NO: 445323 - RNA, 64 nt, Human
auugucgcuauugauuuuuacuucaaugggcucuuccaacaaggaagaagcuugcugguagcac

SEQ ID NO: 445324 - RNA, 64 nt, Human
ugaccugcauguugaguucuguauugcuggggcuuccaacaaaaaccagagucacugacagagg

SEQ ID NO: 445325 - RNA, 64 nt, Human
aauaagcauguugugauaaugauagauguacaauuccaacaagguuauuauuuuuuaaauacau

SEQ ID NO: 445326 - RNA, 64 nt, Human
agccaagugaccuugggagagguaagaugguguuuccaacaaggugcuucucuacuuccaccaa

SEQ ID NO: 445327 - RNA, 64 nt, Human
aacaaacagaaccagccaccucaccauagaguacuccaacaagacaugcauaccauuggugccu

SEQ ID NO: 445328 - RNA, 64 nt, Human
agauuccgccaccucaagugaacugcaggaauccuccaacaaccacaaacacaugcuucgcugu

SEQ ID NO: 445329 - RNA, 64 nt, Human
aacaugccgcagggagggcuguggugccggugcuuccaacaaggacagcccuccuugacccuga

SEQ ID NO: 445330 - RNA, 64 nt, Human
guuugacuuucauaaugucucuguuuuuuguuuuuccaacaauuacagacucagguucucuuau

SEQ ID NO: 445331 - RNA, 64 nt, Human
cccuggugaagguucaggaagcacggagauucucuccaacaaagguccaguuaggaaacgacgc

SEQ ID NO: 445332 - RNA, 64 nt, Human
ccuuauagaaacaggaccagaaacaccucccuucuccaacaaaagguucauuuugguggcuguc

SEQ ID NO: 445333 - RNA, 64 nt, Human
gacacauaaaucugucugauucuaugccuguauuuccaacaaacuuacugucagagaauaugac

SEQ ID NO: 445334 - RNA, 64 nt, Human
cugugguuuguugauggccagguuuuccucaggcuccaacaacugugcuuauaccaagcagauc

SEQ ID NO: 445335 - RNA, 64 nt, Human
gcacaccuauguguguuaucucucuggcauacuuuccaacaaggauucuuuucuagucuauaca

SEQ ID NO: 445336 - RNA, 64 nt, Human
ucagugagauaucauagagacggagauccuaagguccaacaagaaugcauucccugaaucugug

SEQ ID NO: 445337 - RNA, 60 nt, Human
ucauuaaugaauucaauauccuguucauacuaguuagagcuggucagccuuuuuggguaa

SEQ ID NO: 445338 - RNA, 60 nt, Human
ucagagcucugaaauuaaaaagcacugaaauaguuagauguuuucaaacuuuuagaacuc

SEQ ID NO: 445339 - RNA, 60 nt, Human
aauguuaaccuuuuuuaaauacaauacugauaguuagaagaaaacuauuguacucuuuug

SEQ ID NO: 445340 - RNA, 64 nt, Human
uggagggccugcuggcugaacaugcugaaucaucuccaacaaaacccagccccaacuuucucuc

SEQ ID NO: 445341 - RNA, 64 nt, Human
gagaugauaauuuaagacacugaaugauuucuuuuccaacaaagcucuauguuaagugcaucaa

SEQ ID NO: 445342 - RNA, 64 nt, Human
gccagugcagaaguuucuccagguggccucccuuuccaacaauguacauaauaaaguguaugca

SEQ ID NO: 445343 - RNA, 64 nt, Human
ugauguuaguguuuuaagaaauguaguugauguauccaacaagccagaaucagcacagauaaaa

SEQ ID NO: 445344 - RNA, 64 nt, Human
cuaccccaauuagggcccagccugccauggcagcuccaacaaggaccgucugggauagcaccuc

SEQ ID NO: 445345 - RNA, 64 nt, Human
guaauccccacaguaagaaaguuguauggcauauuccaacaaguauugguucgucuggugucuu

SEQ ID NO: 445346 - RNA, 64 nt, Human
gggacagagagaaauggagagcaggaauuacaguuccaacaaacaucaugauagucugguaguc

SEQ ID NO: 445347 - RNA, 64 nt, Human
aguggggagacgccagaggagccucacggucacguccaacaacaccacugcaccagggaaaugg

SEQ ID NO: 445348 - RNA, 64 nt, Human
aggccuaucucugggucauaaauccugcaggcaguccaacaaacagggcuggcuccagcacaaa

SEQ ID NO: 445349 - RNA, 64 nt, Human
uuguuuucuucuuuuucuuuuccuuuaucuguuguccaacaacagugcugacuguccggauaag

SEQ ID NO: 445350 - RNA, 64 nt, Human
ccucaggccgagauccgugagagacccacuuugcuccaacaacuugaaacaagucacuuuaccc

SEQ ID NO: 445351 - RNA, 64 nt, Human
cacuacuucuacagaugauuaugcagcauuugaauccaacaaagacuacauuuuggaauccagu

SEQ ID NO: 445352 - RNA, 64 nt, Human
ggaaaccucagguagcuccugaagaucugugcuuuccaacaagugacuacccuugaagcacauc

SEQ ID NO: 445353 - RNA, 64 nt, Human
gauuccugauccaagaaggguccucugggguucuuccaacaaccuauucuaauagacaaaucca

SEQ ID NO: 445354 - RNA, 64 nt, Human
accucuggcacccaucugcaaauaucucccucucuccaacaaauggaguagcaucccccugggg

SEQ ID NO: 445355 - RNA, 64 nt, Human
ugccauuaacaaauguaucacuagcccuccuuuuuccaacaagaagggacugagagaugcagaa

SEQ ID NO: 445356 - RNA, 60 nt, Human
aaaauacaagccagugcaugcauuaauacuuaguuagaccgcagagagcuggcauucacu

SEQ ID NO: 445357 - RNA, 60 nt, Human
cucuuaaucuucuuccuuguugcuuucaaguaguuagaguugagcuguuaaggacagaau

SEQ ID NO: 445358 - RNA, 60 nt, Human
cuugcuaugauuugcacuauuaguacaguauaguuagaaaggaaagcugaacacuauaaa

SEQ ID NO: 445359 - RNA, 64 nt, Human
aaacuccaaagcagugcauccucaauccacagucuccaacaacaguuaaaacuuugauucucaa

SEQ ID NO: 445360 - RNA, 64 nt, Human
ucuagcauauccccacccuccacccacuaccuccuccaacaaaggagucaacucaguugaaaaa

SEQ ID NO: 445361 - RNA, 64 nt, Human
ucuacauagacucaaccucacccucuccuaguuuuccaacaagacacuccaaagccaacuggau

SEQ ID NO: 445362 - RNA, 64 nt, Human
uauuucucuacaacugaugaguaacaugaauaucuccaacaagaucaggaaccucuccaccaca

SEQ ID NO: 445363 - RNA, 64 nt, Human
aaagcaaugaggaguuaucaccucauccucaaacuccaacaagaucuaugccuuaguguuguuu

SEQ ID NO: 445364 - RNA, 64 nt, Human
uuuuaguuucuguucuguggaaaguguaaagcauuccaacaaaggguuuuaauguagauuuuuu

SEQ ID NO: 445365 - RNA, 64 nt, Human
ccugcccccaccccaguuccccaacccacucccuuccaacaacaaccagcuccaacugacucug

SEQ ID NO: 445366 - RNA, 64 nt, Human
ccuccucugcucuccucaaagacgcaaaacauuuuccaacaagagcugucacaguggcagcaaa

SEQ ID NO: 445367 - RNA, 64 nt, Human
ccagguccauccaggaggcucuccugaccucaaguccaacaacaguguccacacuagucaaggu

SEQ ID NO: 445368 - RNA, 64 nt, Human
ggauggggaagcauugcaaggaaauugugcuuuauccaacaaaauguaaggagccaauaaggga

SEQ ID NO: 445369 - RNA, 64 nt, Human
ucauucuuguacaacguagaauuacuuguuuacauccaacaaaugguuagcuagggaaaacagu

SEQ ID NO: 445370 - RNA, 64 nt, Human
ggcugggccugccuccuugucccugccaggaauuuccaacaaaccccaccacccugugagcacu

SEQ ID NO: 445371 - RNA, 64 nt, Human
aagcucugaacaucauuaaguaguuaauaauaauuccaacaaggaauucagaguaauguaaaag

SEQ ID NO: 445372 - RNA, 64 nt, Human
ccuguaacguggaaaucuuaucacacaccuguuauccaacaagucuaccugagggguuuuguua

SEQ ID NO: 445373 - RNA, 64 nt, Human
gaaccccaggccucaugauggucuacgguagagguccaacaacuacagccugugggccacaucu

SEQ ID NO: 445374 - RNA, 64 nt, Human
augcauuacuuuugcacauugauauuaacuguuguccaacaaauaaguaucggaguacgugaga

SEQ ID NO: 445375 - RNA, 60 nt, Human
gaaaagaaauuaccacugggaaaaucuuuuuaguuagauuguaggcuuccuggggccucc

SEQ ID NO: 445376 - RNA, 60 nt, Human
aguuauuaaauuuaagggacagagguaguauaguuagauauacuuucucuuaggaaaaau

SEQ ID NO: 445377 - RNA, 60 nt, Human
cugaaacauuuggaagccccauaauuguucuaguuagaaaggguucagggcauggggaga

SEQ ID NO: 445378 - RNA, 64 nt, Human
uaaguuaauucaauucuuaauacuuuaauuuugcuccaacaagggcuuuauguugcugguaaga

SEQ ID NO: 445379 - RNA, 64 nt, Human
ucagggaucauaaauuaugcauaucuaugaauuuuccaacaaauuccuacuuccugauuggauu

SEQ ID NO: 445380 - RNA, 64 nt, Human
uuuuaguuucuguucuguggaaaguguaaagcauuccaacaaaguguuuuaauguagauuuuuu

SEQ ID NO: 445381 - RNA, 64 nt, Human
uuuauuggacuucuugaaaauaaaaguuacaaaauccaacaacaacaacaacaaaacaauguuc

SEQ ID NO: 445382 - RNA, 64 nt, Human
gcaagucugugcaaaacccaccaaaaugcuccuauccaacaauuauuuuuauuuucucccugcu

SEQ ID NO: 445383 - RNA, 64 nt, Human
ugccaggucucaaaaauucaucaagcaauuucccuccaacaagggcugcaguucuagugauaaa

SEQ ID NO: 445384 - RNA, 64 nt, Human
gcuagaauuuuuuauagcuuagauauaaaaggucuccaacaaagaccuuugcaauauauuuuaa

SEQ ID NO: 445385 - RNA, 64 nt, Human
aguacuuagaaauacacguaugguuaauguucaguccaacaaaccacacacaguaaauguuuau

SEQ ID NO: 445386 - RNA, 64 nt, Human
auucccuucacaucuucaacgccaucagugggacuccaacaagcacaaugguucacgggaugac

SEQ ID NO: 445387 - RNA, 64 nt, Human
uaggaaguuuuuaaguucaugguauucucuugauuccaacaaaguuugauuuucucuuguauuu

SEQ ID NO: 445388 - RNA, 64 nt, Human
uguuuggccuaggaacuguggcugggaaggugccuccaacaaugggauccagggaagccaagga

SEQ ID NO: 445389 - RNA, 64 nt, Human
auuuuagcacuacagaauuuucaagauuucaauauccaacaacuagauagauuaggaccucuau

SEQ ID NO: 445390 - RNA, 64 nt, Human
cuccuccgcugucaugccugcuuccgcuuccauguccaacaauucuaaccaacaaaggaccuag

SEQ ID NO: 445391 - RNA, 64 nt, Human
cagauaucaagaguuuguuauuuucaaauacccauccaacaagagagauggggagguuuuuagu

SEQ ID NO: 445392 - RNA, 64 nt, Human
uuuauuguuugaacaggaagugaacauagucguuuccaacaaaguuuuacuuuuuguaggauuu

SEQ ID NO: 445393 - RNA, 64 nt, Human
gaccccaccccaaaucuuuguauuguccacauucuccaacaauaaagcacagaguggauuuaau

SEQ ID NO: 445394 - RNA, 62 nt, Human
uaagacauuuguuugcuguacagaaaguaucacaaauggaauauaucaguaccucucaagcu

SEQ ID NO: 445395 - RNA, 60 nt, Human
gacaauguagcuuuauuuuacaagaaggcauaguuagauuucuaugaaauauuuauucug

SEQ ID NO: 445396 - RNA, 60 nt, Human
guacugcuuugauuuuugaaguugggguaguaguuagaacuagauuuaacuagucuauaa

SEQ ID NO: 445397 - RNA, 64 nt, Human
ggauguuuaauuuacaaaauaguuggguaaauguuccaacaaacuuuaaaguaccuugaaguca

SEQ ID NO: 445398 - RNA, 64 nt, Human
ccgugagauuugcucccagacccucugaucucccuccaacaaacccuggcuccagcccccuuuc

SEQ ID NO: 445399 - RNA, 64 nt, Human
aggcgcccucggccgcccaucaugguuaauucuguccaacaaacacacacggguagauugcugg

SEQ ID NO: 445400 - RNA, 64 nt, Human
ggagaggaccaggggacguggcuugucccuuuuguccaacaaagcauuauauuuuuaagaaugg

SEQ ID NO: 445401 - RNA, 64 nt, Human
cagcccccuaaaauguacaauguaacuuguucaguccaacaaaaacagguuccuuauguuucug

SEQ ID NO: 445402 - RNA, 64 nt, Human
guuugacagcugccuuucugacuuggccgccguguccaacaaauuccgagaccucuugcaggua

SEQ ID NO: 445403 - RNA, 64 nt, Human
gaagcaucugagucuucuaauaagugggaagggauccaacaaagaagccaugaccaguuaaaga

SEQ ID NO: 445404 - RNA, 64 nt, Human
gugccuagccuccaggugggggcuccugcccuccuccaacaacccaggacacccacgccucacc

SEQ ID NO: 445405 - RNA, 64 nt, Human
ccauuuuaagguagcccucucaucgucuuuuaguuccaacaaagaaaggugccaugucuuuacu

SEQ ID NO: 445406 - RNA, 64 nt, Human
augauggacacacaauggauggacacauuauaucuccaacaagguguggguggaaagaucaaau

SEQ ID NO: 445407 - RNA, 64 nt, Human
acaacuuacagugauucuuccuguuggaagaauuuccaacaaaucagaaucacguuuuuaguug

SEQ ID NO: 445408 - RNA, 64 nt, Human
aagcagcauuucucucuuaacguuccugggagacuccaacaaauggagaccagaaacaaggcaa

SEQ ID NO: 445409 - RNA, 64 nt, Human
acuuaaagguuguguaacauacuuccaccagcaguccaacaauauauguuuaaaaauuuaaaac

SEQ ID NO: 445410 - RNA, 64 nt, Human
guaaauauuuacuauguuuuucuauuagcuaaauuccaacaauuuuguacuuuaauaaaauguu

SEQ ID NO: 445411 - RNA, 64 nt, Human
ggaggguugggcgugcuaccugcaccgccccuucuccaacaaguugccuccaagcuuuggguug

SEQ ID NO: 445412 - RNA, 64 nt, Human
aaauguuuaauuccgcaugauguuucccucuccuuccaacaaaagaaggucaaacugugggucg

SEQ ID NO: 445413 - RNA, 60 nt, Human
uccucagccagucgcagggucagcuuaaguuaguuagaucacucccagaagagaccagcu

SEQ ID NO: 445414 - RNA, 60 nt, Human
caacugggaaaaaacaaaaacaaaaaacuauaguuagaaaaauggaaguuccauagguuc

SEQ ID NO: 445415 - RNA, 60 nt, Human
cccuuuugacccguguguaacuuccucugguaguuagaccccaggcagcuccgaauuugu

SEQ ID NO: 445416 - RNA, 64 nt, Human
guugguguacauguggguacaggguguuuuuaaauccaacaagauagaguauaauaucaauacu

SEQ ID NO: 445417 - RNA, 64 nt, Human
accuggaccuugcuuagauauuccaucgauuuuguccaacaaacaauuucuggcuuggggagga

SEQ ID NO: 445418 - RNA, 64 nt, Human
uggugacucuuacaaucauaucacagugggccucuccaacaauuuaaaccucaugaccuaggug

SEQ ID NO: 445419 - RNA, 64 nt, Human
ggagcugaacauuaauaugugcaaagauuggcucuccaacaagaaggaaagcagggaggaaggg

SEQ ID NO: 445420 - RNA, 64 nt, Human
cguguccugguuucuuguucaguuuuacuucuaauccaacaacaaaagaaaugucuggcugguc

SEQ ID NO: 445421 - RNA, 64 nt, Human
uauuuuaguaauaaauaugcuggauaaauauuaguccaacaauagcuaaguuaugcuaauauca

SEQ ID NO: 445422 - RNA, 64 nt, Human
ucgucucauaugccugguaugugacacgugucucuccaacaauaaaagacuuggccuuggcugg

SEQ ID NO: 445423 - RNA, 64 nt, Human
aaauauuugucuuuccauuuugaaauguguuuaauccaacaaugaauuuaaauguguuucucau

SEQ ID NO: 445424 - RNA, 64 nt, Human
uaauaacauacaaugaccacauagugugagaacuuccaacaagccucaaagucccuugagacuc

SEQ ID NO: 445425 - RNA, 64 nt, Human
cccaggcagggagagcccgccugccuccacccuuuccaacaagccaucuugguaacugggaaca

SEQ ID NO: 445426 - RNA, 64 nt, Human
uaaagacaaauagagaagguuagauuuuuuuuuuuccaacaaguggauaaaagucugugacucg

SEQ ID NO: 445427 - RNA, 64 nt, Human
agcugggguaguuggugagcagagcgggacucuguccaacaagccccacagccccucaaagacu

SEQ ID NO: 445428 - RNA, 64 nt, Human
guuggcgauagacugucaauuagguuguuugugauccaacaagaacauuuccaaaaguaucuag

SEQ ID NO: 445429 - RNA, 64 nt, Human
gcuauauaauugaugcuuuauaguuuuaucauaauccaacaacuucaguuauauuuaauuauug

SEQ ID NO: 445430 - RNA, 64 nt, Human
uuuguuucaggaaugugugcacccagcuugcugauccaacaaagucuauugcuuaccagucuag

SEQ ID NO: 445431 - RNA, 64 nt, Human
auuccccacuucaauacaaagggugucguucuuuuccaacaaaauagcaaucccuuuuauuuca

SEQ ID NO: 445432 - RNA, 62 nt, Human
aucacucagccccugggugggguggggugguucaaauggaugacugaucuccugaguacacu

SEQ ID NO: 445433 - RNA, 62 nt, Human
gcccaggacaggugcucuagccauuaggaccacaaauggacaugucaguuauugcucugucu

SEQ ID NO: 445434 - RNA, 62 nt, Human
cucacucacuaggcaguucccacuuucuuuagcaaauggaggaaauuaagcaccgauguagc

SEQ ID NO: 445435 - RNA, 64 nt, Human
cccacaaggaauaaguuccaacaaaguaauaaauuccaacaaagcaacaaaucaaauaacuuac

SEQ ID NO: 445436 - RNA, 52 nt, Human
agaaaucccacaaggaauaaguuccaacaaaguaauaaauuccaacaaagca

SEQ ID NO: 445437 - RNA, 64 nt, Human
aacuucagauacuugugaacaugccuuauauuuguccaacaacugucagaauaaagaacauucu

SEQ ID NO: 445438 - RNA, 64 nt, Human
aggcuauaacucagaccaaauuauaccuaaaaguuccaacaaagucccuuuuucaauaucacau

SEQ ID NO: 445439 - RNA, 64 nt, Human
gcugcugcugacguuuaugcauuucaugaugggguccaacaagaacaccugacuugggugaagu

SEQ ID NO: 445440 - RNA, 64 nt, Human
aagugccuugggggcacccucauuuuguuuccauuccaacaacgagaacagagauguucuggca

SEQ ID NO: 445441 - RNA, 64 nt, Human
caucaauuaaaacugauuuauuuauguugguacauccaacaaaauaguuggagccacaaggccc

SEQ ID NO: 445442 - RNA, 64 nt, Human
cccuccucauaggugggccguaccuugucuaagguccaacaagugcugagcuggucguaugggg

SEQ ID NO: 445443 - RNA, 64 nt, Human
acggcuacuauugaaguguaauugugagauggacuccaacaagcaugugacugugagauugugu

SEQ ID NO: 445444 - RNA, 64 nt, Human
uuacaagugggaguuaagagaggucuggaaaguguccaacaaggaauucacaccucugccuccu

SEQ ID NO: 445445 - RNA, 64 nt, Human
aaucuaauucauuuucucuuuaguguuaguagacuccaacaacagaaguggcaucuguguauuc

SEQ ID NO: 445446 - RNA, 64 nt, Human
cuuuuccgugggagggaggcauucaucuacagacuccaacaaggccuccagcggagacaucucc

SEQ ID NO: 445447 - RNA, 64 nt, Human
accaauagucucaaaguaaaaacaaccaccaccauccaacaaaaggauuacgucugcaucuuuu

SEQ ID NO: 445448 - RNA, 64 nt, Human
auuuucccccuuggcucucaaugcuguuuggguuuccaacaauucagcauuagugggaaaaagu

SEQ ID NO: 445449 - RNA, 64 nt, Human
aaaccaugccuaaguacaggcggauuagcuaucuuccaacaaugcugaccaccagacaauuacu

SEQ ID NO: 445450 - RNA, 64 nt, Human
acgaugggcugaggccaggggagacaucacaaccuccaacaacacuuuuuuucaugcuuuaaua

SEQ ID NO: 445451 - RNA, 62 nt, Human
agcacuuuauucccucucccucucacugaucacaaauggaaucaccucccugggcagcgaga

SEQ ID NO: 445452 - RNA, 62 nt, Human
uuauuuaaaacucaccucccaaucaccccaaacaaauggaagagaagagaaaggacauggcg

SEQ ID NO: 445453 - RNA, 62 nt, Human
agguuuuaaauuguaaauauuccuuagaggagcaaauggauuguuuaauaccauagucucag

SEQ ID NO: 445454 - RNA, 53 nt, Human
cccaggaaaagucuguaugaccuuccaacaagguggauccagagcuuuucucc

SEQ ID NO: 445455 - RNA, 59 nt, Human
aauguaauccauuuuuacuucagcucauccaaaagcagccagcagaccgguugacugag

SEQ ID NO: 445456 - RNA, 59 nt, Human
gugcaugaaaucaagaaaaaagaaaugaacaaaagcaaagcauuaguggcuauggucug

SEQ ID NO: 445457 - RNA, 59 nt, Human
auguagcucaccccggucacgcaugaaggcaaaagcaggucagaagcgaauacucugcc

SEQ ID NO: 445458 - RNA, 59 nt, Human
ggagagacccuuucugaaagaaguauggccaaaagcacuuuaaugcugcugacauuguu

SEQ ID NO: 445459 - RNA, 59 nt, Human
gagauucaugcgauguguccaaucggagacaaaagcaguuucucuccaacucccucugg

SEQ ID NO: 445460 - RNA, 59 nt, Human
uugcuauguauuuacucuuuuuuaaaagacaaaagcaaaaccagacuuucuacguacua

SEQ ID NO: 445461 - RNA, 59 nt, Human
guuuccucauuuggcuguuggauuuuaagcaaaagcauccaagaaaaacaaggccuguu

SEQ ID NO: 445462 - RNA, 59 nt, Human
ugcaacaggcagguuugggaguuagaggucaaaagcagcugccugaaugaguuguuguu

SEQ ID NO: 445463 - RNA, 59 nt, Human
gauguaauauaguugugacagccuaugcacaaaagcauuaccugaucuuaagguuuggu

SEQ ID NO: 445464 - RNA, 59 nt, Human
ugggaaacuuugauucuugaaagagaaaacaaaagcaugugaauaaacuuugaaguguu

SEQ ID NO: 445465 - RNA, 59 nt, Human
ucaggaggggccaagaaccagggggccaucaaaagcaucgggauuuggcauugguucca

SEQ ID NO: 445466 - RNA, 59 nt, Human
uacaagaauauucauagcaacccuauucacaaaagcaaaagccuagaaauaacccagau

SEQ ID NO: 445467 - RNA, 59 nt, Human
gagucaucuagaagggaggguuggcuucccaaaagcauaaccuugaccaaaccaaacaa

SEQ ID NO: 445468 - RNA, 59 nt, Human
uuaguucuuuggaaacaaaugcuguaauucaaaagcauuugaccugucacuguacuauc

SEQ ID NO: 445469 - RNA, 59 nt, Human
cacagcuagucaacccugccauuuuaccacaaaagcagcaauagacauuauguaaacaa

SEQ ID NO: 445470 - RNA, 62 nt, Human
agccugccgcuugcucuaugccggaauaacaccaaauggaaucuccucaucucuugcuuguu

SEQ ID NO: 445471 - RNA, 62 nt, Human
cauuuaggaccaaagacggcuauagaaaaacucaaauggauugcuucccaaaccccucccca

SEQ ID NO: 445472 - RNA, 62 nt, Human
auaauuaaugagauucgcuccugugaccucagcaaauggacaggaaauaaguccuuauugau

SEQ ID NO: 445473 - RNA, 62 nt, Human
uuagcaaguagauaauguaagggauguggcagcaaauggaaaugacuacaaacacucuccua

SEQ ID NO: 445474 - RNA, 59 nt, Human
cagcgugcuuauuauugggcauuuagccucaaaagcauguaguaccaagcacuuguauu

SEQ ID NO: 445475 - RNA, 59 nt, Human
cucaucccuccaauucaagccucucaacucaaaagcacaagauccuugcaugcacaccu

SEQ ID NO: 445476 - RNA, 59 nt, Human
cuuuguugacuuugggaaauggugccacucaaaagcaacuuccuaacuugaggaauaac

SEQ ID NO: 445477 - RNA, 59 nt, Human
cccacuuccuacuguaauagaucagcauccaaaagcaggaacccaucuaaaccagaagg

SEQ ID NO: 445478 - RNA, 59 nt, Human
cuuuuuuuagaauugaagucugaaacaaacaaaagcaauucaaugucaauagacauuaa

SEQ ID NO: 445479 - RNA, 59 nt, Human
acuuuuaguuccuaaaaagaaacauauuucaaaagcaauggaaucuagaauucuuauaa

SEQ ID NO: 445480 - RNA, 59 nt, Human
augaaagagacaauguaauacuguugguccaaaagcauuuaaaaucaauagaucuggga

SEQ ID NO: 445481 - RNA, 59 nt, Human
cuccagguccuuuauuacugccuucuuuucaaaagcacaacucuccucuaacccucccc

SEQ ID NO: 445482 - RNA, 59 nt, Human
ugagaugagcagugaacuaagaggccacacaaaagcagagguuugggaauuccagaagg

SEQ ID NO: 445483 - RNA, 59 nt, Human
auaaaaaaugaaaaacauuauuuggauaucaaaagcaaauaaaaacccaauucagucuc

SEQ ID NO: 445484 - RNA, 59 nt, Human
ccgcuuucgauauuuucuaaacuuuaauucaaaagcacuuugugcuguguucuauauaa

SEQ ID NO: 445485 - RNA, 59 nt, Human
acuuagguucauugugccucaguuccucucaaaagcacuaaaucuaagugcaaacaagu

SEQ ID NO: 445486 - RNA, 59 nt, Human
gcaugucuauucuaacacaucagcuuauucaaaagcaagaauuuuaaaaauaagauaaa

SEQ ID NO: 445487 - RNA, 59 nt, Human
agcaauuggcugggguccaggaaacaaagcaaaagcacaauaugugaaugugcugauug

SEQ ID NO: 445488 - RNA, 59 nt, Human
uuuauguuggcgauagccaagaccacaagcaaaagcacauacuggaaaugaugaguuag

SEQ ID NO: 445489 - RNA, 59 nt, Human
agauaaucaaaauucaaaguugaaagaaucaaaagcagccacaguuauguaggucugau

SEQ ID NO: 445490 - RNA, 62 nt, Human
cucuuuggccugguguggacggaaaggguggccaaauggauugagugaugagcagacauguu

SEQ ID NO: 445491 - RNA, 62 nt, Human
ugccgaaaugcacagaggugaaaaugacaaaccaaauggaauuucucuucagaguucagaau

SEQ ID NO: 445492 - RNA, 62 nt, Human
aucucagaaauuguaucuuaguugguaucaaccaaauggagugacuuaguguacaugaaagc

SEQ ID NO: 445493 - RNA, 62 nt, Human
gagggaggaacucccagcauccccauugcccacaaauggaauccucacuguauccacuagga

SEQ ID NO: 445494 - RNA, 59 nt, Human
cgugugguuuuaaugaccagcacgcaaggcaaaagcauuuugcacaguguuuguuuucc

SEQ ID NO: 445495 - RNA, 59 nt, Human
aaauaugagucauccgcuaucacagcuuucaaaagcaagaacaccauccuacauaauac

SEQ ID NO: 445496 - RNA, 59 nt, Human
acaggacuuuuuacauaaaauaggagcugcaaaagcaaaaagaauaucuucuaaagauu

SEQ ID NO: 445497 - RNA, 59 nt, Human
agaagggucagauuaaaacaaaaaacugccaaaagcauccccucugccccccauguggc

SEQ ID NO: 445498 - RNA, 59 nt, Human; identical to SEQ ID NO: 445461

SEQ ID NO: 445499 - RNA, 59 nt, Human
uuugcuaaguguaucuugauaggaaacaacaaaagcagguugagauggggaagaugaca

SEQ ID NO: 445500 - RNA, 59 nt, Human
cuccucaaccacucuccuaaugauuggaacaaaagcaaacaaaaaagaaaucucucuau

SEQ ID NO: 445501 - RNA, 59 nt, Human
uucaggacuuaacggcuccaggauuuuaacaaaagcaagacuguugcucaaaucuauuc

SEQ ID NO: 445502 - RNA, 59 nt, Human
uaauccuucccaggcaccagucagcugaacaaaagcauaagccaaacauccuguuuaaa

SEQ ID NO: 445503 - RNA, 59 nt, Human
acuccauuuguuuggaccaaucccuuaaacaaaagcaaggcaaauuuuacauggauuua

SEQ ID NO: 445504 - RNA, 59 nt, Human
ugauuucauguuuguaaucuacaacuuuucaaaagcauucagucauggucugcuagguu

SEQ ID NO: 445505 - RNA, 59 nt, Human
aaaggaauguauagauguuuggauggaaacaaaagcacuagacugaguuuccucuuaua

SEQ ID NO: 445506 - RNA, 59 nt, Human
cuuuuggguuaaaucuggcccuuccuuggcaaaagcaaaaauucucccugugagagcuc

SEQ ID NO: 445507 - RNA, 59 nt, Human
aaagccacuucauauaggacuuaauaugucaaaagcacauuaugaagcagaaauuaaaa

SEQ ID NO: 445508 - RNA, 59 nt, Human
aaucauuacauuuaaaauauaccuuacagcaaaagcauccaaauaaguauaggguuuau

SEQ ID NO: 445509 - RNA, 59 nt, Human
uagagcacaccgcaugucagucuaugcagcaaaagcacagagacuuaagacuacugagu

SEQ ID NO: 445510 - RNA, 62 nt, Human
gguggggaauauaacauaucaaaauacaugaacaaauggaaaguuacuucuagaaaagcaaa

SEQ ID NO: 445511 - RNA, 62 nt, Human
uguuuuauagcuucaaaguguggcuugacauucaaauggaaggaaccaccugaauuauaucu

SEQ ID NO: 445512 - RNA, 62 nt, Human
caaaaaaagaaaagagaaaaaaagaaaaaaugcaaauggaauaauuuucuauuauauuuuag

SEQ ID NO: 445513 - RNA, 62 nt, Human
uauuuugaaucuccuuguuaguuaauaaccaccaaauggaaaggucauucuuucugcagacu

SEQ ID NO: 445514 - RNA, 59 nt, Human
gaaccagcggaucugcaaagaccuacaaucaaaagcaaauccccauuuuccuuuuauaa

SEQ ID NO: 445515 - RNA, 59 nt, Human
gcaaacaagagcaagaaacaaaaagaagccaaaagcagaaggcuccaauaugaacaaga

SEQ ID NO: 445516 - RNA, 59 nt, Human
cacccagagaaaaggagcauccuuaccuccaaaagcacagggacacaaagaggaaucua

SEQ ID NO: 445517 - RNA, 59 nt, Human
cuggagaugcaagcucuaggcugcgcuuccaaaagcaaaugauaauuauguuaauguca

SEQ ID NO: 445518 - RNA, 59 nt, Human
ccuguuugaaugauacguagguuccccaccaaaagcaggcuuucugcccugagggacau

SEQ ID NO: 445519 - RNA, 59 nt, Human
uucccuuuuuuuaaaaaaaaucaauaccucaaaagcaggcuuugggacaagaaaacccc

SEQ ID NO: 445520 - RNA, 59 nt, Human
cuggcaucguguauuccauaugucuauaacaaaagcaauauauacccagacuacacuag

SEQ ID NO: 445521 - RNA, 59 nt, Human
uucuaccaccuuauuagaacugcuauaaacaaaagcaucugaaauaauugugcacaucu

SEQ ID NO: 445522 - RNA, 59 nt, Human
ccuagacaaaguuugccaaccauaagugucaaaagcacaggccaguauuaagcagaagu

SEQ ID NO: 445523 - RNA, 59 nt, Human
gauccagaugauaaaccagugaacuaugucaaaagcacucucaauauuacauuugacaa

SEQ ID NO: 445524 - RNA, 59 nt, Human
ggcuuucauuaccaaauaauguaaaaccucaaaagcaagggcuucaacagccuuaacca

SEQ ID NO: 445525 - RNA, 59 nt, Human
acuuuaucgcugacugaauugcuacugaacaaaagcauuaacaguuauguuccuguuuc

SEQ ID NO: 445526 - RNA, 59 nt, Human
aaucaaucaccaccacgaggacaagagggcaaaagcaaaacagacaaaaagaaaaaaaa

SEQ ID NO: 445527 - RNA, 59 nt, Human
uuuccuuuuuuccaucccuucccuaccaucaaaagcauaccugcucuaauuaaaaaaaa

SEQ ID NO: 445528 - RNA, 59 nt, Human
aggcaagucagaaagagaacauggucacccaaaagcaacuguaacucagaaauuaaguu

SEQ ID NO: 445529 - RNA, 59 nt, Human
gagggauggggaaaauaaacuuaacucuacaaaagcaaacucuaaugcaugcaagaauc

SEQ ID NO: 445530 - RNA, 62 nt, Human
aauccugccucaucauucuuggcaggaaucugcaaauggaaacauugugaguaucagcaauc

SEQ ID NO: 445531 - RNA, 62 nt, Human
uucucauccccgaguucuuucaggccaaaaagcaaauggauuuccaccugacaaaucuucgg

SEQ ID NO: 445532 - RNA, 62 nt, Human
aaauguuguauuucauauuuauuuauauaauacaaauggaaaucaaaacugaaauagccucc

SEQ ID NO: 445533 - RNA, 62 nt, Human
aagcauaaggcauuaaaugacaauaaaaauuccaaauggacuauuuguuccacauuguauuu

SEQ ID NO: 445534 - RNA, 59 nt, Human
cccaaagcccagcccggcugaccaacauucaaaagcacaaacccuggggacucugcuug

SEQ ID NO: 445535 - RNA, 59 nt, Human
gcuuacucugaaagaggcagaucccaguucaaaagcagccaugagaaggaaggauucac

SEQ ID NO: 445536 - RNA, 59 nt, Human
gucacuaagaauuccuaagaacuuucuaucaaaagcauuggauccaagccauauauuga

SEQ ID NO: 445537 - RNA, 59 nt, Human
cauuauagaaauuacuggagccaugucuacaaaagcaaagugaagugaugagcugaaaa

SEQ ID NO: 445538 - RNA, 59 nt, Human
aaaauuaauacacaaauagaaaccauuuucaaaagcaauucagaaaggaugcacaguca

SEQ ID NO: 445539 - RNA, 59 nt, Human
auaguaaagauaaguuauccucacuuaggcaaaagcacagguccuuuccauaucaaguu

SEQ ID NO: 445540 - RNA, 59 nt, Human
caugggcaaggacuucaugucuaaaacaccaaaagcaauggcaacaaaagccaaaauug

SEQ ID NO: 445541 - RNA, 59 nt, Human
aagaauuuuguuguuucucagcuguuuuccaaaagcaaaggaagucuuuaugguuuuuu

SEQ ID NO: 445542 - RNA, 59 nt, Human
cucacaguggccucaagugugaugccuuacaaaagcaccacucagaugggcagcuggac

SEQ ID NO: 445543 - RNA, 59 nt, Human
cugcuugucuguuguuauaucuggauuaucaaaagcaauagugcaccaauuaagaugug

SEQ ID NO: 445544 - RNA, 59 nt, Human
gcuacuaaaagaucuaauuugaaaaacuacaaaagcauuaacuaaaaaaguuuauuuuc

SEQ ID NO: 445545 - RNA, 59 nt, Human
guuuuuaaaauaucuuuugaccuguggugcaaaagcagaaaauacagcuggauuggguu

SEQ ID NO: 445546 - RNA, 59 nt, Human
cauuguggcaagaaaaaaugaggaagaagcaaaagcagaaaccccugauaaacugauca

SEQ ID NO: 445547 - RNA, 59 nt, Human
agucccuuccaccuaugagccuguaaaaucaaaagcaagcuaguuacuuccuagauacc

SEQ ID NO: 445548 - RNA, 59 nt, Human
caacugaccagcuccagguuugaucaaaccaaaagcaacauuugucauguggucugacc

SEQ ID NO: 445549 - RNA, 59 nt, Human
gcucuuugaaagcuccaauuauugguccccaaaagcagcuuccaacguuugccaucugg

SEQ ID NO: 445550 - RNA, 62 nt, Human
gcaguggugaaaagaaauuacugaacuauugucaaauggacuuccugucauuuguuggccau

SEQ ID NO: 445551 - RNA, 62 nt, Human
uaaaaccaaccaccagcauuucacuacaggaccaaauggaaaccgagggaacccugggucuu

SEQ ID NO: 445552 - RNA, 62 nt, Human
uccaaaaaugcacccaacuagcucuauguuuacaaauggacauaggacucaaaguuucagag

SEQ ID NO: 445553 - RNA, 62 nt, Human
caguuuuugaaccacaguaaugggaagaaagacaaauggauucccuuagaaguaagauuucu

SEQ ID NO: 445554 - RNA, 59 nt, Human
uuuucaaaucaagaaaauaagugcucugucaaaagcacaaaaagaaacuuucaggcacu

SEQ ID NO: 445555 - RNA, 59 nt, Human
cauuaaaucacaaaguauguuaaaggucacaaaagcaaaauaacugucugaggcuaagg

SEQ ID NO: 445556 - RNA, 59 nt, Human
ggcauacacuguaguuuuugaaaauuaugcaaaagcagcuaaauguaacuuauuccaag

SEQ ID NO: 445557 - RNA, 59 nt, Human
ucuucucuaacauaguacuuucuuuccagcaaaagcaaaauguguuuucagauuuguua

SEQ ID NO: 445558 - RNA, 59 nt, Human
uggaaaggauuuagauuguaacccgcacacaaaagcacgguguuugugaauauaacacc

SEQ ID NO: 445559 - RNA, 59 nt, Human
ugguuucaaauccuuuugaacacguucgacaaaagcaguggagaagaggaagaccugga

SEQ ID NO: 445560 - RNA, 59 nt, Human
aauauucuggcaauuuaauauacccccuacaaaagcacuccacagcuuuuacacuauuu

SEQ ID NO: 445561 - RNA, 59 nt, Human
aauaaaaggcagcuaauggaaaggagagacaaaagcaugguuaauauauauacuuaaua

SEQ ID NO: 445562 - RNA, 59 nt, Human
gggaaggaccauuucguaauggucugacacaaaagcaaguuugauuuuugcagcacuag

SEQ ID NO: 445563 - RNA, 59 nt, Human
aucuucuugccagcaauagaucucauuuucaaaagcaauucuucggugcuguguagcug

SEQ ID NO: 445564 - RNA, 59 nt, Human
uuuuuuaauuuacaaagcgugaucgcuagcaaaagcauuagugcuuuuuaucugcaguc

SEQ ID NO: 445565 - RNA, 59 nt, Human
uugucauauacaccuccagggaccaaaaacaaaagcagcucggagucuguguugccuga

SEQ ID NO: 445566 - RNA, 55 nt, Human
cuucaaaagcaauggaauaaucuuucaaaagcaauagaauaaucuuccauuuggc

SEQ ID NO: 445567 - RNA, 59 nt, Human
ccaauucggaaaacaauaggggaaagccacaaaagcacaaacaugggucaaaggaaaau

SEQ ID NO: 445568 - RNA, 59 nt, Human
cagcccaaggucuuuuuaaugccuuuauccaaaagcacaucuugugcuccaugcaggau

SEQ ID NO: 445569 - RNA, 59 nt, Human
acagaagcacuggcugcugcuacagaccgcaaaagcagaaaguuucgugaaaaugucca

SEQ ID NO: 445570 - RNA, 62 nt, Human
uuaugggcuuaaauauuuugucacugauccugcaaauggacaucauuuuagcacacuagcgg

SEQ ID NO: 445571 - RNA, 62 nt, Human
auauccauaguagacaagaauuugauguaacgcaaauggaaaaacucgacaccacauuucag

SEQ ID NO: 445572 - RNA, 62 nt, Human
caaaauuuuuuacacguuugcagaggugcaaucaaauggaauuaagucucucgacuuuggaa

SEQ ID NO: 445573 - RNA, 62 nt, Human
uuaaaaagugugauagcgauauuagugccaaucaaauggaaaaaagguaguuuuaauaaaca

SEQ ID NO: 445574 - RNA, 59 nt, Human
cugucuuucccagcgucauguuugugucacaaaagcaguuauuuuaaaaucugaucccc

SEQ ID NO: 445575 - RNA, 59 nt, Human
acaggcgucccuuucccucuggauaacaacaaaagcaagccgggaggcuggcugccucu

SEQ ID NO: 445576 - RNA, 59 nt, Human
aucauuuuggaggcuuacuuuucaugauacaaaagcaauucugugugauuuuuuuuuuu

SEQ ID NO: 445577 - RNA, 59 nt, Human
auggaggguacgaucuaaguuaagugugucaaaagcaaggcuuaggauuuguuauggga

SEQ ID NO: 445578 - RNA, 59 nt, Human
aaacacaucuuuaaaagcauagucacagacaaaagcauacaguauaaaaauuuccuuga

SEQ ID NO: 445579 - RNA, 59 nt, Human
ggugaagggggagcaggcacaucacaugacaaaagcaggaacaagacucagagcaagaa

SEQ ID NO: 445580 - RNA, 59 nt, Human
uuuggaucaaaaggagaaaugauaagugacaaaagcagcacaaggaauuucccugugug

SEQ ID NO: 445581 - RNA, 59 nt, Human
aauuggaaaacacuuuuaacugaaaaaaacaaaagcacaacaaaccaaaacaugggaug

SEQ ID NO: 445582 - RNA, 59 nt, Human
aagcugaacucuauuauggggaauggauacaaaagcagagcucccaucuugacuuucaa

SEQ ID NO: 445583 - RNA, 59 nt, Human
ugaaguuccuacuuuccaacuggagguuccaaaagcauuugcugcaagucucuuggauu

SEQ ID NO: 445584 - RNA, 59 nt, Human
aaaaaagaagaaaaaccuguuuccgugugcaaaagcacacauauguaugucuguguuau

SEQ ID NO: 445585 - RNA, 59 nt, Human
uaaguggggcaaaaccuugcuaauuuucucaaaagcauuuaucauucuuguugccacag

SEQ ID NO: 445586 - RNA, 59 nt, Human
uuucugaccaauuaaaaaaacauagagaacaaaagcauauuugaccaagcaacaagcuu

SEQ ID NO: 445587 - RNA, 59 nt, Human
agccugggugacagagugagauucugucucaaaagcaaacuaacaaagaaaaacaauac

SEQ ID NO: 445588 - RNA, 59 nt, Human
gcauuuaugauuucuccagaaauuuaccacaaaagcaaaauuuuuaaaacugcauuuuu

SEQ ID NO: 445589 - RNA, 59 nt, Human
gcugcucuagcagcaaggcaguaacaccacaaaagcaaaaccacaugggaaaacucagc

SEQ ID NO: 445590 - RNA, 60 nt, Human
ucuccaaaugcccaagccuucuuucaaaauuaguuagaaacuuaaguaaaauacaagucc

SEQ ID NO: 445591 - RNA, 60 nt, Human
cccuggaaaaguguuagggauuccuuccaauaguuagaucuacccugccuguacuacucu

SEQ ID NO: 445592 - RNA, 62 nt, Human
ccuuguugggcagacaccagcggugugcagggagagaccaaguaccaucuuuaucuacacuu

SEQ ID NO: 445593 - RNA, 59 nt, Human
uucuacacugcugccagaggccuuuuugccaaaagcacugcugauugucacucuuuuac

SEQ ID NO: 445594 - RNA, 59 nt, Human
agccugggugacagagugagacccugucucaaaagcaaaacaaacagcaauaacaauau

SEQ ID NO: 445595 - RNA, 59 nt, Human
cuagagaugggggugagacuggggaaggacaaaagcagggaacagauaagugauggaaa

SEQ ID NO: 445596 - RNA, 59 nt, Human
cauuuaggagaaguuggucuuacuuugugcaaaagcaggcuugugcuuuauaccccauu

SEQ ID NO: 445597 - RNA, 59 nt, Human
ugggaaaauauuucagaugaaagggaugacaaaagcauguugcgcuuugcaucagcaag

SEQ ID NO: 445598 - RNA, 59 nt, Human
ugcguuaauuuuuuuuuuuuaauaauuuucaaaagcagugguagaaaauuugauaagaa

SEQ ID NO: 445599 - RNA, 59 nt, Human
uuuaggucuaagucuugcuaagggauaaacaaaagcaaugccuagacaucagggucagg

SEQ ID NO: 445600 - RNA, 59 nt, Human
gccuucccauauuggucccuugacauugacaaaagcacagugacugucagcagauuccu

SEQ ID NO: 445601 - RNA, 59 nt, Human
aauaaugacucuaaagaaacagaagauuacaaaagcaauuuucauuuaccuuuccagua

SEQ ID NO: 445602 - RNA, 59 nt, Human
cuuugauuccagagagggagcuuugcuggcaaaagcaguuuuugcacuagaaauuuuug

SEQ ID NO: 445603 - RNA, 59 nt, Human
guggacaaugcccagucucuguucagauccaaaagcacaaaauguuguauauagaguca

SEQ ID NO: 445604 - RNA, 59 nt, Human
uaaugaaguuguaauaaaaauaaaaugaccaaaagcaccuuuaaagugaauauacaauu

SEQ ID NO: 445605 - RNA, 59 nt, Human
aggucaaggaccuuccuguguaguuggugcaaaagcaaucuccacaggacagcacugcu

SEQ ID NO: 445606 - RNA, 59 nt, Human
agugauugucaguguaaggccuuuuaaaacaaaagcaaguucuuuguuaggaauugguc

SEQ ID NO: 445607 - RNA, 59 nt, Human
aaauagcaccauuauugggggaaguuauucaaaagcaggcuuuugagcaccauagucua

SEQ ID NO: 445608 - RNA, 59 nt, Human
caucauauggacucuauguaacacaaauucaaaagcaaacuaaaagcuauaugcagagu

SEQ ID NO: 445609 - RNA, 64 nt, Human
caagccaguacaagagggccuggggcacgauguggucagccaggaagcauaggaugccauuucu

SEQ ID NO: 445610 - RNA, 64 nt, Human
aauugaaguggcugaguggauaccacguugugaggucagccacugggucacuuguagucaaugc

SEQ ID NO: 445611 - RNA, 64 nt, Human
ucucaaagaccccaugguccauccccugaggguggucagccaaggcucccguuccgugggaugc

SEQ ID NO: 445612 - RNA, 64 nt, Human
uguguggcccuauaauucuggccuuuguuugagagucagccagccugcucaggaugaaaaugag

SEQ ID NO: 445613 - RNA, 59 nt, Human
auaaaaaauauuugucuccaccuuuuccccaaaagcaacagcaagacauauuuuguuag

SEQ ID NO: 445614 - RNA, 59 nt, Human
aaauguggugaugccgaagauguuuacuacaaaagcaugccaaaccuaggcuccagaaa

SEQ ID NO: 445615 - RNA, 59 nt, Human
uuucugaguaauagaaauucauuccucuccaaaagcaauaaaauucaagcacauuauua

SEQ ID NO: 445616 - RNA, 59 nt, Human
uuucugaguaauagaaauucauuccucuccaaaagcaauaaauuucuagcacauuauua

SEQ ID NO: 445617 - RNA, 59 nt, Human
aaauucuauaggauucaauacuuaguuugcaaaagcacuuugaaauuauggcacaguga

SEQ ID NO: 445618 - RNA, 59 nt, Human
agcagcaugauuugcacaaagucgaccaacaaaagcaucaacuuuucaacuucauuauc

SEQ ID NO: 445619 - RNA, 59 nt, Human
ugugaaugguagcuuuugcacagaacuuccaaaagcaaaacaaaaacaaaaucuauugu

SEQ ID NO: 445620 - RNA, 59 nt, Human
gcagauguucuucaccccuuuugguagaacaaaagcaggaugauaaccauaucccccca

SEQ ID NO: 445621 - RNA, 59 nt, Human
uuccaacaggaaggucagugauaaauuuucaaaagcauaaccuucaauauauuaucugu

SEQ ID NO: 445622 - RNA, 59 nt, Human
ggguggggcacuuagcacccagaagggaccaaaagcagggcauggcggugcagaggagu

SEQ ID NO: 445623 - RNA, 59 nt, Human
uuggccauguuccacuuggaaauggcaugcaaaagcaaucauagagaaaccugcguaac

SEQ ID NO: 445624 - RNA, 59 nt, Human
gagucaagguauaaacuuucguuuugacucaaaagcagugggucucaacuggggaugau

SEQ ID NO: 445625 - RNA, 59 nt, Human
ucuuauuucaaguucaaugaaagacuuuacaaaagcaaacaaagcagacuuuguccuuu

SEQ ID NO: 445626 - RNA, 59 nt, Human
agaugauuuguucuuuccagaagaggagacaaaagcaagauagccaaaugugacaucaa

SEQ ID NO: 445627 - RNA, 59 nt, Human
aaaaaugaaucuauuuuucucuuuggcuucaaaagcauucugacauuuggaggagucag

SEQ ID NO: 445628 - RNA, 59 nt, Human
auuauuacuggagucaagcccuuauaagucaaaagcaucuaugugucguaaaacauucc

SEQ ID NO: 445629 - RNA, 62 nt, Human
uagauuaguguugcuugguuuagagccucauacaaauggauucauuuacuauguguucuuuu

SEQ ID NO: 445630 - RNA, 62 nt, Human
ugaucagaacuauuaauagcauaaaucgaacucaaauggaagcaaaacugauuucaugcagg

SEQ ID NO: 445631 - RNA, 62 nt, Human
uguuucaacaagccaacuaaaauauauugcugcaaauggaagcuuuucuguucuauuauaaa

SEQ ID NO: 445632 - RNA, 59 nt, Human
acucaucugugggaggaguaaagaaaauccaaaagcauuuaauguuuuguuuuuguucu

SEQ ID NO: 445633 - RNA, 59 nt, Human
uuaucuaucaacucuaggacaagggagaacaaaagcaagccagaagcagaggagacuaa

SEQ ID NO: 445634 - RNA, 59 nt, Human
gaguugcuagcaaacaaauggcuuacuuacaaaagcagcuuuuaguucagacuuaguuu

SEQ ID NO: 445635 - RNA, 59 nt, Human
uuuuaguguguuacaauaguaacaguaugcaaaagcagcauucaggagccgaaagauag

SEQ ID NO: 445636 - RNA, 59 nt, Human
cuaaaaagucaagucuauuggcuuuggcccaaaagcacugguaucuuuguauuaaauuc

SEQ ID NO: 445637 - RNA, 59 nt, Human
gauuuguaauucaaugcuauuaaaucauacaaaagcaaauuuugcacaguaaaccaaua

SEQ ID NO: 445638 - RNA, 59 nt, Human
agauaaucaacguacaacucuuuguaaaacaaaagcaacuuugggugaguuuuauagau

SEQ ID NO: 445639 - RNA, 59 nt, Human
ggaauagaagcaaauuaaacgguaacauccaaaagcaaccacaaaccuaguacgacuuc

SEQ ID NO: 445640 - RNA, 59 nt, Human
agauuguaauuaaaaugauaguugauuuucaaaagcauuaauuuuuuuucauuguuuuu

SEQ ID NO: 445641 - RNA, 59 nt, Human
acuauuaacuaaaauaugaaacuuaaaaacaaaagcaaguuguccuuaaaaguucuuuu

SEQ ID NO: 445642 - RNA, 59 nt, Human
aaugggaaggauuucuuuaaagcaagacacaaaagcauacacaggaaaaaaugaugcau

SEQ ID NO: 445643 - RNA, 59 nt, Human
caaagcaaaaacuguauagagagauuuuucaaaagcaguaaucccucaauuuuaaaaaa

SEQ ID NO: 445644 - RNA, 59 nt, Human
aaacuuuaaagcauuuuuuaggaaauacucaaaagcaagguuggaaaauguuuuaucuu

SEQ ID NO: 445645 - RNA, 57 nt, Human
cagcuagcagccuaagauagaaaauaccaaaagcagaugaaaaggugaauccuuaaa

SEQ ID NO: 445646 - RNA, 59 nt, Human
aaaggccagauccuuuuccaauacuuaugcaaaagcaaaagaaaaccccgacaccucac

SEQ ID NO: 445647 - RNA, 59 nt, Human
accccuucccccccaggggguugaauaugcaaaagcaguuccgcugggaacccccaucc

SEQ ID NO: 445648 - RNA, 62 nt, Human
ggccacucaacacacguccucaccagucaccccaaauggagacacucgcagaccugcaguuc

SEQ ID NO: 445649 - RNA, 62 nt, Human
uauguguauauuuuuaugaucuuacaaaccugcaaauggaaaaaaugcaagcccauuggugg

SEQ ID NO: 445650 - RNA, 62 nt, Human
ccagagacaugcaagucaugggucacaccugacaaauggaaggaguuccucuaacauuugca

SEQ ID NO: 445651 - RNA, 62 nt, Human
ugcccugagcuuuggucguuggggagguggcucaaauggagccagcggcugugguugaccug

SEQ ID NO: 445652 - RNA, 59 nt, Human
aggacuuuuuucuuuaaagcuagucauuucaaaagcauauuguauuuuuuugaaugacu

SEQ ID NO: 445653 - RNA, 59 nt, Human
acuuaaauuuuaaguuaugagguuuaugucaaaagcaacauuucacaaauguacuuuua

SEQ ID NO: 445654 - RNA, 59 nt, Human
ccaugcugggcccccgccagggccuaucccaaaagcaggggccagggagggggcgacuu

SEQ ID NO: 445655 - RNA, 59 nt, Human
ggcagggagaagcugcccuuugaguuugucaaaagcaaucaaaguuuuuuuacuuugau

SEQ ID NO: 445656 - RNA, 59 nt, Human
aagaaauaugcuucaaaggucaaacauuacaaaagcauuaguaguuuguuuguuuguuu

SEQ ID NO: 445657 - RNA, 59 nt, Human
ugagaucacauacuuuuuaaauccaaauacaaaagcauagucucugcaagauuuuguuc

SEQ ID NO: 445658 - RNA, 59 nt, Human
uauguuauuaaucugaaugcaacagaagacaaaagcacaggcaugcacacacacagaac

SEQ ID NO: 445659 - RNA, 59 nt, Human
uaucaaauugcuacuuuuguuguggaagacaaaagcauuuccauuucaacgaguuuguc

SEQ ID NO: 445660 - RNA, 59 nt, Human
auauguuauuuaauucaucuaaugcuacacaaaagcauaaaauaaugauuuuucacucu

SEQ ID NO: 445661 - RNA, 59 nt, Human
acuaaugggaauuucuacauauaugcuuacaaaagcaauuuauuuaaguaaugcuaggg

SEQ ID NO: 445662 - RNA, 59 nt, Human
gugguguuacucugucauuuauauggugucaaaagcacuugaugaguaaacccaguagc

SEQ ID NO: 445663 - RNA, 59 nt, Human
agacuucaguuaucaucacaaacaugagccaaaagcacauaccuaccccaucccccacc

SEQ ID NO: 445664 - RNA, 59 nt, Human
caagcagguacgcuguacauuuuuacagacaaaagcaaaaaccuguacucgcuuugugg

SEQ ID NO: 445665 - RNA, 59 nt, Human
cauaacuggcaaaauccuuaguguacggacaaaagcaaauuggaaaagccagccauuua

SEQ ID NO: 445666 - RNA, 59 nt, Human
uguccgaugguaucuggguaagaagaaagcaaaagcaagggaccuucaugcccuucuga

SEQ ID NO: 445667 - RNA, 59 nt, Human
auuugggggauauauuuauucuguauugacaaaagcaaauccacuuuuucuuuuucuuu

SEQ ID NO: 445668 - RNA, 62 nt, Human
agcugguauggauggaaugacaagaauuaguccaaauggaaccccuugaaggauaaugagaa

SEQ ID NO: 445669 - RNA, 62 nt, Human
gguuuuuggaaguuacuauuuggccauuuuuacaaauggauuuugcauuaacaggaagauug

SEQ ID NO: 445670 - RNA, 62 nt, Human
acaaggcaaaacaugacaguggauucucuuuacaaauggaaaaaaaaaauccuuauuuugua

SEQ ID NO: 445671 - RNA, 62 nt, Human
ugagucaccccucugucuaaccagccccagcacaaauggaacucccgagggccucuaggacc

SEQ ID NO: 445672 - RNA, 59 nt, Human
cgaaacuacucaacucugccguccuagcacaaaagcagccauagacaacacacaaacga

SEQ ID NO: 445673 - RNA, 59 nt, Human
aauguauaugguugcaguucacauaaagacaaaagcaucuguuaugaaaugaguaguaa

SEQ ID NO: 445674 - RNA, 59 nt, Human
agguguuaaucuguaauuuuaaauuuugacaaaagcauuuucacagcccugccacauaa

SEQ ID NO: 445675 - RNA, 59 nt, Human
ucgagauuauuuucauuuauacuauaaaacaaaagcaaacuaguccaguuuaauuuuuu

SEQ ID NO: 445676 - RNA, 59 nt, Human
accccuuccuuccccaguggaagcauuuucaaaagcaaagauaauuuucgcuggugaac

SEQ ID NO: 445677 - RNA, 59 nt, Human
caccccggaccaguuacauucguuccuggcaaaagcaaauggaaauggucuccugucuc

SEQ ID NO: 445678 - RNA, 59 nt, Human
cacccucucccacaacaaauaccaagcaucaaaagcacuuucauuugaaaauuauuaug

SEQ ID NO: 445679 - RNA, 59 nt, Human
ucuauucugggaacaccagccgaugucaucaaaagcagaauaaugaaucaaccacgaga

SEQ ID NO: 445680 - RNA, 59 nt, Human
guaauaucuuuugaagaacuaugcuuuuucaaaagcaaaaucaacucuguauaauagca

SEQ ID NO: 445681 - RNA, 59 nt, Human
aaauucaagaugugugaaauaauauaagucaaaagcaagaaaaacguaaucccgucuga

SEQ ID NO: 445682 - RNA, 59 nt, Human
uauagacuuguauuuaguucauauuuugucaaaagcaaaacaagaagauacaucacuuu

SEQ ID NO: 445683 - RNA, 59 nt, Human
aguguaagcuauaugauuucuucaaaaagcaaaagcaauauaccuaauucauuuggauc

SEQ ID NO: 445684 - RNA, 59 nt, Human
gaaaaauuguauauuugucuuaaguauggcaaaagcauucguuggagagccuuacuugg

SEQ ID NO: 445685 - RNA, 59 nt, Human
gauaggaaaaaagaugaaaacagauucuucaaaagcaugaauaaaaaugacaugaagag

SEQ ID NO: 445686 - RNA, 59 nt, Human
agagguggagaaggggacacugaggugagcaaaagcaggaaggggcauccacugcgggu

SEQ ID NO: 445687 - RNA, 59 nt, Human
caggaauggucacaacaggggguagcccucaaaagcacuccuuuuucuauaccucuucu

SEQ ID NO: 445688 - RNA, 62 nt, Human
auaauuauuaccaauuuuuauucuuuauuucucaaauggaaacaccugaaaaagcauucugg

SEQ ID NO: 445689 - RNA, 62 nt, Human
aauacuguguuuuaaguuuuguguugcaagaacaaauggaauaaacuugaauugugcuacag

SEQ ID NO: 445690 - RNA, 62 nt, Human
ccacgcgugguuuguguuggugguauguuccacaaauggaagagaucauugcauuuugcuuu

SEQ ID NO: 445691 - RNA, 59 nt, Human
aaaaaaaaaugagagaauuagggaaacaccaaaagcaaagagagcagcucuauguucau

SEQ ID NO: 445692 - RNA, 59 nt, Human
agaggacaaugacuauugcaucuucauugcaaaagcacuggcucauccgcccuacuucc

SEQ ID NO: 445693 - RNA, 59 nt, Human
augcuguacauuucaguucaguguaugaccaaaagcaauauguuuauaagaagauguuu

SEQ ID NO: 445694 - RNA, 59 nt, Human
ggagacucuuuuuacuaacuugaaugagacaaaagcaguggugucaguuuauaauccug

SEQ ID NO: 445695 - RNA, 59 nt, Human
ugacucaauaugucagguuuaacucugcccaaaagcagcagacauguaagcagaugugc

SEQ ID NO: 445696 - RNA, 59 nt, Human
gagggaaaucuuuauauucuguauaaaaacaaaagcaaauuuauauacuaaaaucauuu

SEQ ID NO: 445697 - RNA, 59 nt, Human
uuaacucaaaauucauguaacaagauagccaaaagcauaggauuucuuaaaauucugaa

SEQ ID NO: 445698 - RNA, 59 nt, Human
cugucacauuuuucuugcaacuccuuuugcaaaagcagacuaaaauguuuuaaaaugug

SEQ ID NO: 445699 - RNA, 59 nt, Human
uguuucccaauccuuugaccauuccuccccaaaagcauuuuaaagaggcgguugcagga

SEQ ID NO: 445700 - RNA, 59 nt, Human
agaccaagauuuuuuaaaauucccaauuacaaaagcagcaucacacuugcuucugagaa

SEQ ID NO: 445701 - RNA, 59 nt, Human
aucauaaaaguacaucauaugugaacaugcaaaagcaaugcagccggaaagaacggaga

SEQ ID NO: 445702 - RNA, 59 nt, Human
gacuuggauauaugguugaagaaucaaaacaaaagcaaaaaaaaaaagcaaaaaaagaa

SEQ ID NO: 445703 - RNA, 59 nt, Human
caguauauauaaagacuauuauuaauagacaaaagcaaacccacguuuuugacaagcca

SEQ ID NO: 445704 - RNA, 59 nt, Human
gacaucuucccaauauuucaacuuuugaacaaaagcaugcuaaagaaugugguuuaauu

SEQ ID NO: 445705 - RNA, 59 nt, Human
uuuuuucccacgcuuuuccaguaacuuugcaaaagcauuaauuguucacuggcaauuac

SEQ ID NO: 445706 - RNA, 59 nt, Human
auauacaaugauccuggaaauugcaguaacaaaagcacacaacgauuauaguaacuaua

SEQ ID NO: 445707 - RNA, 64 nt, Human
ccacucugucuuguccuccuggaaguguaucucagucagccaguggcuucuugaugauggcggu

SEQ ID NO: 445708 - RNA, 64 nt, Human
ccacucucccuuguccucccggggguguaucugagucagccaguggcuucuugaugaugguggu

SEQ ID NO: 445709 - RNA, 64 nt, Human
ccacucucccuuguccuucuggggguguaucacagucagccaguggcuucuucaugaugguggu

SEQ ID NO: 445710 - RNA, 64 nt, Human
ccuccugccaaguuugagggcaaggcuaagaaaugucagccacggaaacaacucuauuaucugg

SEQ ID NO: 445711 - RNA, 59 nt, Human
agggaauuacuagggaggagagaaagggacaaaagcacccugcuucauacucuugagca

SEQ ID NO: 445712 - RNA, 59 nt, Human
ccagcauguccaucuuuucaaagauacaacaaaagcagaaguuacaagaauauugcgga

SEQ ID NO: 445713 - RNA, 59 nt, Human
cuccagccugggaacaagagugaaacucucaaaagcagaaacaaaaacccaacauauau

SEQ ID NO: 445714 - RNA, 59 nt, Human
auugugccacugcacuccagccugagcaacaaaagcaaaacucuaucuuuaaaaaaaaa

SEQ ID NO: 445715 - RNA, 59 nt, Human
gacuucuuuucuccuucugucccuuuucucaaaagcaucuuucccccaaauguaugucu

SEQ ID NO: 445716 - RNA, 59 nt, Human
aggaagggaacuuagaagaagcugaaauacaaaagcagaggauugaacaacugcagaga

SEQ ID NO: 445717 - RNA, 59 nt, Human
cacucuuuuugagacuguuuuugcaacaacaaaagcauuuguugacacucgugcuguua

SEQ ID NO: 445718 - RNA, 59 nt, Human
uuccaaaaaugaaacccauucaucguaaacaaaagcacaaacacuuguagcaguuuaua

SEQ ID NO: 445719 - RNA, 59 nt, Human
uuuauauucuuauguuaucaccuuccaaacaaaagcacuuacuuuuuuuggaaguuauu

SEQ ID NO: 445720 - RNA, 59 nt, Human
auaagcacaugagagugucuuacauuuuccaaaagcaggcuuuaauugcauaguugagu

SEQ ID NO: 445721 - RNA, 59 nt, Human
ccccauguccucagcauuucuuuucuggccaaaagcaguaaauuugcuagcaguaaaag

SEQ ID NO: 445722 - RNA, 59 nt, Human
caacagagucuagcucauggccaccagaccaaaagcauccagcuucugugcaccuccug

SEQ ID NO: 445723 - RNA, 59 nt, Human
acccuaauugacuuggaaaaaaaaaacagcaaaagcaaaaguagcaacauaugucaaca

SEQ ID NO: 445724 - RNA, 59 nt, Human
uauuuuucuuucuuuguggauaaaacuuucaaaagcaauuuaagauauucauaguguua

SEQ ID NO: 445725 - RNA, 59 nt, Human
uuuuuuuguuuguuuuguuuuuaaacauucaaaagcaauuaaugaucagacauaggaga

SEQ ID NO: 445726 - RNA, 59 nt, Human
uuagauagaagucuuugcuacauguaauucaaaagcaucucgcuuuucucaggaaccaa

SEQ ID NO: 445727 - RNA, 64 nt, Human
cccgggacccgcggcucaguggcccgcuagccacgucagccaagccacuuuagguccauuuuuu

SEQ ID NO: 445728 - RNA, 64 nt, Human
gugaguggggcugaaggccaggcugagugccugggucagccaaaccccuggcacccccagggug

SEQ ID NO: 445729 - RNA, 62 nt, Human
ugagucaccccucuguccagccagcuccugcacaaauggaacuccccagggccuccaggacu

SEQ ID NO: 445730 - RNA, 62 nt, Human
cuuugggaucccaggaaccauggaauuauucccaaauggacucugaccagauuuuugccaua

SEQ ID NO: 445731 - RNA, 59 nt, Human
ggcuauacaauugaaugaggaagcacuaacaaaagcaguaguucaguacaguggacagc

SEQ ID NO: 445732 - RNA, 57 nt, Human
cacgugaaaccagcaugugacuaguuacaaaagcaauaaauugaaacaaaacaaaac

SEQ ID NO: 445733 - RNA, 59 nt, Human
ugaccuggcaaauaagaucuugaauaggccaaaagcaaguaucuugcuguguguagucu

SEQ ID NO: 445734 - RNA, 59 nt, Human
auuauucauccagacuuagccacagugcacaaaagcaaaccugcuagagaggcagugaa

SEQ ID NO: 445735 - RNA, 59 nt, Human
aauacagaaaagcauuuuagaaauagcuucaaaagcacuuguguaucuugauuuuuucu

SEQ ID NO: 445736 - RNA, 59 nt, Human
uguauugaagaaaacaaauuuaccaaaagcaaaagcauaaaccccucccucuuuucagu

SEQ ID NO: 445737 - RNA, 59 nt, Human
auuauuuguauugaagaaaacaaauuuaccaaaagcaaaagcauaaaccccucccucuu

SEQ ID NO: 445738 - RNA, 59 nt, Human
cuuuuaccuuucuccaccauccagagccacaaaagcaaaccuucuaccuccuaccuacu

SEQ ID NO: 445739 - RNA, 59 nt, Human
ugggguguccccauccagcgagagaguuucaaaagcaaaacaucucugcaguuuuuccc

SEQ ID NO: 445740 - RNA, 59 nt, Human
augacagcugaucugucggaaccaggacacaaaagcagcaagaagcggggagagagagg

SEQ ID NO: 445741 - RNA, 59 nt, Human
gggcaggcuggcuggcccgucauguuccucaaaagcacccuugacgucaagucuccuuc

SEQ ID NO: 445742 - RNA, 59 nt, Human
gcgaccgugaccaggaacacccgacuccucaaaagcaaaugagaucccgccucuucuuc

SEQ ID NO: 445743 - RNA, 59 nt, Human
ggcgcccacuaguggggaauccgcacucacaaaagcacaggaugcuggaaaacagccug

SEQ ID NO: 445744 - RNA, 59 nt, Human
aagaucagccauaaguaaucagcaaucuucaaaagcacuuucaguggauuggucaucug

SEQ ID NO: 445745 - RNA, 59 nt, Human
uuugauauguuuuucuuucccuuaagaaucaaaagcagaaaacaaaaacaacaguccua

SEQ ID NO: 445746 - RNA, 59 nt, Human
uuuuuuuuuuuagauaauguugucaagaccaaaagcauggaugucaagugucaguaagg

SEQ ID NO: 445747 - RNA, 64 nt, Human
cgccucagccucccaaagugcugggauuacaggcgucagccaccgcgcccggcccugugccuug

SEQ ID NO: 445748 - RNA, 64 nt, Human
uuuuguauuuucaguagagauggaguuucacugugucagccaggauggucucgaucuccugacc

SEQ ID NO: 445749 - RNA, 64 nt, Human
uucuuacuucccagaauccccugacauucccagggucagccaggaccuguuacagcccugguca

SEQ ID NO: 445750 - RNA, 62 nt, Human
accccgucucuacaaagcacaacgaaaaacaacaaauggaguugugcuauguuguauugcuu

SEQ ID NO: 445751 - RNA, 59 nt, Human
aucaguguccuuuucuguuccaccccuaccaaaagcaaguagugguuugguuucuauca

SEQ ID NO: 445752 - RNA, 59 nt, Human
cugcggauguaauuuuuuuuaaaaaaguccaaaagcagcuaugggcaguugacaaaaga

SEQ ID NO: 445753 - RNA, 59 nt, Human
acauuauaacuaaaggaauccccucaauucaaaagcauagauggauacaaaugucagac

SEQ ID NO: 445754 - RNA, 59 nt, Human
ugugcauaugaugcuugagaugguuuuugcaaaagcagaaaucgcugcaagguaaucac

SEQ ID NO: 445755 - RNA, 59 nt, Human
gauuuuucuagcauccucuuaaugugcagcaaaagcaggcgacaaaaucuccuggcuuu

SEQ ID NO: 445756 - RNA, 59 nt, Human
auuuccccucaaguuuucuaagugauuuccaaaagcagagguguguggaaauuuccagu

SEQ ID NO: 445757 - RNA, 59 nt, Human
auaagcaaaaccaaauaccacuauaaauacaaaagcaucugguaaacuguaaaguuacu

SEQ ID NO: 445758 - RNA, 59 nt, Human
uaauucagaaccccaacuacuguguuaugcaaaagcaagcugauuaaaugacacucaua

SEQ ID NO: 445759 - RNA, 59 nt, Human
uuguuguuuguuuaaacccaagugcugcacaaaagcagauacuugaggaaaacacuauu

SEQ ID NO: 445760 - RNA, 59 nt, Human
aagcagauacuugaggaaaacacuauuuccaaaagcacauguauugacaacaguuuuau

SEQ ID NO: 445761 - RNA, 59 nt, Human
auucacaaaauauuuuugcaaccagaacacaaaagcaggcuagucagcuaagguaaauu

SEQ ID NO: 445762 - RNA, 59 nt, Human
cauagucauggaaugcaucaccauuaagacaaaagcaauguguucaugaagacuuaaga

SEQ ID NO: 445763 - RNA, 59 nt, Human
uacccaugccuuaaagaggggcaguuucucaaaagcagaaacaugccgccaguucucaa

SEQ ID NO: 445764 - RNA, 59 nt, Human
ggauaagaauuugaaccgaaagaauaauucaaaagcauauuugaugaaacaauaguggu

SEQ ID NO: 445765 - RNA, 59 nt, Human
guccuuagcuacuagcucuagaaaagucccaaaagcagcagaaggugaagcaggaagca

SEQ ID NO: 445766 - RNA, 59 nt, Human
cuuugccuuuccuggccuuuacuggaucccaaaagcauuuaagguacauguuccaaaaa

SEQ ID NO: 445767 - RNA, 62 nt, Human
uguuucugcucugacagguuuauauguucuuacaaauggauccauaguuugcagugauuuaa

SEQ ID NO: 445768 - RNA, 62 nt, Human
aagcacuaaguuaucuuuauccaacauuucuccaaauggacugaaagaaacuuuucaaggac

SEQ ID NO: 445769 - RNA, 62 nt, Human
uggccaaugaaauuugaacaucacuaaacaagcaaauggaaugacuuuggaccauaucuagu

SEQ ID NO: 445770 - RNA, 62 nt, Human
aauaaagcgucgccucucugccucgaaccagucaaauggaguauugcggcugcacgucacac

SEQ ID NO: 445771 - RNA, 59 nt, Human
gagguguacccccaaccccaaacuuucaccaaaagcaauaaagaggaacucuagaacug

SEQ ID NO: 445772 - RNA, 59 nt, Human
gaaaaauuguauauuugucuuacguauggcaaaagcauucauuggagagccuuacuugg

SEQ ID NO: 445773 - RNA, 59 nt, Human
aagaugaugguugugaauuacuguagcagcaaaagcaaauuggucuccacaccuaaaau

SEQ ID NO: 445774 - RNA, 59 nt, Human
guuuuguguguaugauuucugugcaaaaacaaaagcaacacuccugaguccuugcagcu

SEQ ID NO: 445775 - RNA, 59 nt, Human
cacaaccgcuaacacuuacaauuuuggugcaaaagcaaacaguuccagcaggcucucua

SEQ ID NO: 445776 - RNA, 59 nt, Human
ccgggagaaugauuccccucauagaaagacaaaagcauccauccccucauaguuaagua

SEQ ID NO: 445777 - RNA, 59 nt, Human
acaauucagacaaacugcuuucuccuguccaaaagcaaaaaggcaaaggaaagaaagaa

SEQ ID NO: 445778 - RNA, 59 nt, Human
aaucucacccaaacuccugcucacucaagcaaaagcagccucuggccuucccuccaccg

SEQ ID NO: 445779 - RNA, 59 nt, Human
ucaaaacuaccuacuucuuucucaggcaucaaaagcauuuugagcaggagaguauuacu

SEQ ID NO: 445780 - RNA, 59 nt, Human
ugcaaccacccaauucugccauuguagugcaaaagcagccauagacaacacauacauga

SEQ ID NO: 445781 - RNA, 50 nt, Human
ucuggaaagauaugguauagcaaaagcagcugaaauaugcuggcuggagu

SEQ ID NO: 445782 - RNA, 59 nt, Human
aggaacuuugccaaugauagugaccacagcaaaagcaaauaauaauaauauuaauaaua

SEQ ID NO: 445783 - RNA, 59 nt, Human
cccaaauuucuaaaauucugcuucucugccaaaagcaaugucuuucuugguugauauuu

SEQ ID NO: 445784 - RNA, 59 nt, Human
uugaccacuguucuaagacuaugugugcccaaaagcacauaagcaucuauguugagagu

SEQ ID NO: 445785 - RNA, 59 nt, Human
uugaucuuuaccaggucaguggauugcuucaaaagcagaguuuugugcaagcacucacu

SEQ ID NO: 445786 - RNA, 59 nt, Human
accauuuccauuuguuucuuuaacauuaccaaaagcagggaacaaagcucuuauucaac

SEQ ID NO: 445787 - RNA, 62 nt, Human
aucucgugggcggcucauguuagagcgacauucaaauggaagguuuggaaaggaaugccucu

SEQ ID NO: 445788 - RNA, 62 nt, Human
uuuauugcacuuugcaaauaaugcauuuuuuacaaauggaagguuuauggcaacucugcguu

SEQ ID NO: 445789 - RNA, 62 nt, Human
caguuuuucagcuccucuccacucugcuuucccaaauggauucuguugugagcaagaguuua

SEQ ID NO: 445790 - RNA, 62 nt, Human
auauauacacauacacaaauauaugcauauuucaaauggauuguaugcacuugcaaagcaaa

SEQ ID NO: 445791 - RNA, 59 nt, Human
cucauuuugacuauaacugugcuugguuucaaaagcaaaauuaaacaaaaaucucaguc

SEQ ID NO: 445792 - RNA, 59 nt, Human
aggaagaacuggauaaaaucuuccaaauccaaaagcaugagauuuuucuauccaaauau

SEQ ID NO: 445793 - RNA, 59 nt, Human
uguucgacucuaaaagauuugccaaauaacaaaagcauacaaugcauacuguuggagaa

SEQ ID NO: 445794 - RNA, 59 nt, Human
auaacauaaaauauugggcgcuaaaucaacaaaagcaauauauauuugggaucauauca

SEQ ID NO: 445795 - RNA, 59 nt, Human
cuuuggaguuauaacuauucaguuuagugcaaaagcauuaaacuauuuguguuuuucuu

SEQ ID NO: 445796 - RNA, 59 nt, Human
cguagaggguggccgacggcggcggcccucaaaagcacuuguuccuucugcuucucccu

SEQ ID NO: 445797 - RNA, 59 nt, Human
cuuagcuauuaguauauuuaaaaacuguucaaaagcaaaagagaaggaacaggaaugaa

SEQ ID NO: 445798 - RNA, 59 nt, Human
guaaggucuuuuagcuccuuagagugaagcaaaagcaagacuucaaccucaaccuaucu

SEQ ID NO: 445799 - RNA, 59 nt, Human
agaaagugaggauuuaggcaacaaggaggcaaaagcaaaucucagagaagucaucaaag

SEQ ID NO: 445800 - RNA, 59 nt, Human
uuagucaucagauauuuuagccaccuacacaaaagcaaacugcauuuuuaaaaaucuuu

SEQ ID NO: 445801 - RNA, 59 nt, Human
ggcugcagguccccaguggacaucagagucaaaagcacuggcaaaggguaccccugcaa

SEQ ID NO: 445802 - RNA, 59 nt, Human
agauguaccaaccuuuucauguauucugccaaaagcauuguuuuccagggcccuugacc

SEQ ID NO: 445803 - RNA, 59 nt, Human
caagcuuaugaaaacuaaacaugaugaaucaaaagcacuuggcaugugagggcuauuaa

SEQ ID NO: 445804 - RNA, 59 nt, Human
ucagccauuauuauuuauauauguauuaccaaaagcagucuaucugccugugaccucca

SEQ ID NO: 445805 - RNA, 59 nt, Human
uggauaaagaagaagauaagaaagagcgucaaaagcaguaccugagacauagacgacuu

SEQ ID NO: 445806 - RNA, 59 nt, Human
agaauaaauaaacgaguugaccucggucacaaaagcaguuuuacuaucgaaucaaucgc

SEQ ID NO: 445807 - RNA, 64 nt, Human
ucaugcugcccccgccggacuggcagagccaggggucagccaccugccuuugagucaucaagau

SEQ ID NO: 445808 - RNA, 64 nt, Human
uaacugccaagaauuguuaacacacuugugaugugucagccacagauucacccaggaggucaca

SEQ ID NO: 445809 - RNA, 64 nt, Human
ucuguacgaauuugggucccagccuuguuggguugucagccauggacauggauuucaaccccug

SEQ ID NO: 445810 - RNA, 62 nt, Human
uuucuuagauacccuuuacaagagaaaacuuccaaauggauuuuugcaucaauagcagugug

SEQ ID NO: 445811 - RNA, 59 nt, Human
uggcggggaggaaagugaaacgccugaaucaaaagcaguuuucuaauuuugacuuuaaa

SEQ ID NO: 445812 - RNA, 59 nt, Human
agauuaaguaaaaugcccaaggguauaaacaaaagcaacaugaaaguggaagccguauc

SEQ ID NO: 445813 - RNA, 59 nt, Human
ugcaagcaacagaaaucuaucauuuacaacaaaagcaacgaggagauuacaugaagcga

SEQ ID NO: 445814 - RNA, 59 nt, Human
aggguuguuggcuuguuguagcugaccaccaaaagcagucacugcaaaucuuuuaauuc

SEQ ID NO: 445815 - RNA, 59 nt, Human
caccucuguauccuuucuggccauuuggacaaaagcaguugccccgacuugggauuuuc

SEQ ID NO: 445816 - RNA, 59 nt, Human
ucucuugauuugccugacauugacuucagcaaaagcacggggcuguaaauuaccauuua

SEQ ID NO: 445817 - RNA, 59 nt, Human
gacucagugguuguuucagaggacuuugacaaaagcaaggccccuuuucacucuccaga

SEQ ID NO: 445818 - RNA, 59 nt, Human
cugaagcuuucccgcuguuucccugccugcaaaagcagccccaagagcugcgcauuggc

SEQ ID NO: 445819 - RNA, 59 nt, Human
aguuaacaaaguaugccccauuccugugacaaaagcacaaccauucugaaguuacugga

SEQ ID NO: 445820 - RNA, 59 nt, Human
cuaaagagcaucugauucuuguugcuguacaaaagcaaugguugaugauacuucccaca

SEQ ID NO: 445821 - RNA, 59 nt, Human
gaauuguuuuucuuugcaaaaccccuccacaaaagcaaauccuuucaagaauggcaugg

SEQ ID NO: 445822 - RNA, 59 nt, Human
cuggauucaaguguuaguagcugggauuacaaaagcauguggccccacgcccagcuaag

SEQ ID NO: 445823 - RNA, 59 nt, Human
ugaaggaagggagguaugagaccguaggucaaaagcaccauccucguacuguugucacu

SEQ ID NO: 445824 - RNA, 59 nt, Human
agccaacgaucucacagguuaacaaaauacaaaagcaauacccuguguuguggacucuu

SEQ ID NO: 445825 - RNA, 59 nt, Human
auguuuuuaaauaaaaacggauaaagugucaaaagcacagcaggcugucucucaguggu

SEQ ID NO: 445826 - RNA, 59 nt, Human
augaaauuuaauagagaauucacuccucccaaaagcaccuucauggaagauuccucauu

SEQ ID NO: 445827 - RNA, 62 nt, Human
gauacuuugaauacucugagguccuuacccaccaaauggauggaauucagcugcucaaucac

SEQ ID NO: 445828 - RNA, 62 nt, Human
ccggcacauagcaggcccugcauauugauggacaaauggauggccugccugccuucccuguc

SEQ ID NO: 445829 - RNA, 62 nt, Human
cuagggcaugaggggaguaucuuucagggauucaaauggaauuuuuaccuguuacuuguuua

SEQ ID NO: 445830 - RNA, 62 nt, Human
gaagcugccacggacaccaaugggaccaaguccaaauggauuaauccaggacagaauagcca

SEQ ID NO: 445831 - RNA, 59 nt, Human
acaauuacaacaugugcccuuacaaauaccaaaagcacuguaaggauauuugucuugac

SEQ ID NO: 445832 - RNA, 59 nt, Human
agagauuccuuuuuucaauaaucuuaauucaaaagcauuauuagacuugaaaggguuug

SEQ ID NO: 445833 - RNA, 59 nt, Human
auucacaaucuuugggguuuucuccucaucaaaagcauuucuuaagugccuaucuaaaa

SEQ ID NO: 445834 - RNA, 59 nt, Human
aaauuuguagaaauaguuuuugaggaagccaaaagcaaagcagaaaccuuuacaguauu

SEQ ID NO: 445835 - RNA, 59 nt, Human
acaucugggcacagcaacccagagauggccaaaagcauucaagccugggggaagauguu

SEQ ID NO: 445836 - RNA, 59 nt, Human
aguuccuucccuuccacaaaaugcaagagcaaaagcaaacuacaaacaggccuugugcu

SEQ ID NO: 445837 - RNA, 59 nt, Human
uugccccaagaaguguuuggauaaccacacaaaagcaugaugaaaaggcuucuuguagu

SEQ ID NO: 445838 - RNA, 59 nt, Human
uauguguuacaccuaggaugggcauuaugcaaaagcacaaagauuauauaugacaauca

SEQ ID NO: 445839 - RNA, 59 nt, Human
cugaauucuguuuacuucuucuggcugugcaaaagcacacucaagugaaugacuaaaaa

SEQ ID NO: 445840 - RNA, 59 nt, Human
gagucaaugcgcaaaaugcagcuugugugcaaaagcagugggcuccuggcagaagggag

SEQ ID NO: 445841 - RNA, 59 nt, Human
augaaaaacguuagcaguugauuuuuguccaaaagcaagucauggcuagaguauccaug

SEQ ID NO: 445842 - RNA, 59 nt, Human
ucacaugcagcucagagcucccaagagcucaaaagcagaaauggccaggccuucugaaa

SEQ ID NO: 445843 - RNA, 59 nt, Human
ccagugccauggaaaaccaaggauauuagcaaaagcagaaguugcuagugaccuuggga

SEQ ID NO: 445844 - RNA, 59 nt, Human
auuacagguguaagucacuguacccagcccaaaagcaguuuaaaaaaaaaaaagacaaa

SEQ ID NO: 445845 - RNA, 59 nt, Human
ucagccaucuugcuugagaaccaccaagccaaaagcaaaagcuuuuaucuaugaucucu

SEQ ID NO: 445846 - RNA, 59 nt, Human
agaagaccaaaaguccccaaugacaggaacaaaagcaaccaauuuuuaacuuucucuuc

SEQ ID NO: 445847 - RNA, 64 nt, Human
gcccagccccaccgaaaagcaaaaauuacacgucgucagccacucagcccuucucuccuccagc

SEQ ID NO: 445848 - RNA, 64 nt, Human
cagcaggaauaugguggaguucaguccaauucaggucagccauauccaaaagaccacaagucau

SEQ ID NO: 445849 - RNA, 64 nt, Human
cugccggggacucagacacucagggaacaaaauggucagccagagcuggggaaacccagaacug

SEQ ID NO: 445850 - RNA, 62 nt, Human
acaagaaugugacauggcaggaucuauggaaccaaauggaagguuuugaggugauguagguc

SEQ ID NO: 445851 - RNA, 59 nt, Human
gaaguuaaaccacccgauaggccuucgagcaaaagcaaagauccaccgagagaagaaga

SEQ ID NO: 445852 - RNA, 59 nt, Human
gucauccaaguccaggucuagaucacacucaaaagcaaagcauucucuucccagugccu

SEQ ID NO: 445853 - RNA, 59 nt, Human
ugguaaaggaaaaaugcugucauguguuacaaaagcaugauaaauaauuguuaauaugg

SEQ ID NO: 445854 - RNA, 59 nt, Human
aaaguggaaaaaaaaaaaaaggaaaaaaccaaaagcauaaaaaaccacagcaaauuucu

SEQ ID NO: 445855 - RNA, 59 nt, Human
auggcgccauugcacuccagccugggugacaaaagcaaaaguccaucuuaagaaauaua

SEQ ID NO: 445856 - RNA, 59 nt, Human
uuucuuucuaaacagggaaaauaauguuacaaaagcaucuuuuuuguuauuuguuugca

SEQ ID NO: 445857 - RNA, 59 nt, Human
aaacugaucuuuucauuuaggugaggaagcaaaagcaucuaugugagaccauuuagcac

SEQ ID NO: 445858 - RNA, 59 nt, Human
uuuauaacaccugcuuuagccuuuguuuucaaaagcacaaaggaaaagugaaagggaaa

SEQ ID NO: 445859 - RNA, 59 nt, Human
auuuuucuacuacccagcccaagaaaccucaaaagcaugccuuguuucuauccuucucu

SEQ ID NO: 445860 - RNA, 59 nt, Human
ccauguauagcagaaaaugaaacaugcaacaaaagcacuuugaaaaauauauaaggaau

SEQ ID NO: 445861 - RNA, 59 nt, Human
gauugguguucgcuguucaucugagcccccaaaagcauuauuacugauacuugcacaca

SEQ ID NO: 445862 - RNA, 59 nt, Human
ccugguucuagccuagauucuuaccuccccaaaagcagcauauuaggcccaggacauac

SEQ ID NO: 445863 - RNA, 59 nt, Human
gagcacauuucuauugucuucacuuggaucaaaagcaaaacagucucuccgccccgcac

SEQ ID NO: 445864 - RNA, 59 nt, Human
accuuuauauuugccgaauuuggccuccucaaaagcagcagcaagucgucaagaagcac

SEQ ID NO: 445865 - RNA, 59 nt, Human
gcaacagaauaugacaccaucuucccaggcaaaagcaacaucugguugaccaugauuuu

SEQ ID NO: 445866 - RNA, 59 nt, Human
ugaauuucuccuugccacguuaauaaagccaaaagcagcgggugcuauucguggcaaca

SEQ ID NO: 445867 - RNA, 64 nt, Human
cucuaggucugcagcaaugaagggaagugcaucugucagccagacuggacaggcaaagacugca

SEQ ID NO: 445868 - RNA, 64 nt, Human
gcuuaauauuuccuacuguguaggagaauuugcagucagccauagguauguaggaauagucacu

SEQ ID NO: 445869 - RNA, 64 nt, Human
aaaaaagaaggaaaaggaauuauagacccccagggucagccaguuaagagcucuacccacaccu

SEQ ID NO: 445870 - RNA, 64 nt, Human
guguaggggugauggaaaggcucacugcccaggggucagccagaggggaggugggcugcacucc

SEQ ID NO: 445871 - RNA, 59 nt, Human
aaguauugucagaguugaauaucaccucucaaaagcaucaccucuaucugccucaucuc

SEQ ID NO: 445872 - RNA, 59 nt, Human
uuuaccaaaacaaauggagaagaaacauccaaaagcacauuucauuucuccaaacuuug

SEQ ID NO: 445873 - RNA, 59 nt, Human
caggcacuauaauuucuguaacacacuaacaaaagcaugaaaaauaggaaccacaccaa

SEQ ID NO: 445874 - RNA, 59 nt, Human
uugauaguuuuacaaauucuuaauagguucaaaagcaaucuggucugaauaacacugga

SEQ ID NO: 445875 - RNA, 59 nt, Human
ugaaacuuuccuuugucauuauuagucuucaaaagcaugauuuuuaauaguuguugagu

SEQ ID NO: 445876 - RNA, 59 nt, Human
cuuucuuguuuaauauaccagauacauagcaaaagcagcuuggaauaauuauagcuguu

SEQ ID NO: 445877 - RNA, 59 nt, Human
ucuggugugauauuguaauaggcugaaugcaaaagcagauacaagauuccagcuuucgu

SEQ ID NO: 445878 - RNA, 59 nt, Human
caacuagaaauguuaaguggcuaugcaagcaaaagcauagauagguuaaaaaaaaggau

SEQ ID NO: 445879 - RNA, 59 nt, Human
uauuccuguguaaaaacaacaaaaacaaacaaaagcaagaaaaccacaacuaaaacugg

SEQ ID NO: 445880 - RNA, 59 nt, Human
ucuuaagugaccuacaggguauauguuggcaaaagcagacuguguauaugucuuauaaa

SEQ ID NO: 445881 - RNA, 59 nt, Human
agagauucuaguacaaaguuacuguuuaacaaaagcaacauaaacucugggaaagauuu

SEQ ID NO: 445882 - RNA, 59 nt, Human
augguaaagcugcacuuacuugaacagcccaaaagcauuaaaaaucuauuuccagagga

SEQ ID NO: 445883 - RNA, 59 nt, Human
guacaguauauucuuguaaauacauaaaacaaaagcauuuugcuaaggagaagcuaaua

SEQ ID NO: 445884 - RNA, 59 nt, Human
aagauguucccuguaggucacggcacucccaaaagcacacaagcacauacagacauaug

SEQ ID NO: 445885 - RNA, 59 nt, Human
auuuuuuaucaucuuauuuucaaaguaggcaaaagcaaaaucacuuaauuaguaccauu

SEQ ID NO: 445886 - RNA, 59 nt, Human
ucuauaaaacacuauaggacauuuguuuucaaaagcaguugaguaacagcaacauaaac

SEQ ID NO: 445887 - RNA, 64 nt, Human
cuucugcuguagccugggaccagaccuggccaaggucagccagcggggagggccgaggucugag

SEQ ID NO: 445888 - RNA, 64 nt, Human
gugguugugguguagacugugucaggccuacggagucagccaguggcuagcgcaagaccaguca

SEQ ID NO: 445889 - RNA, 64 nt, Human
ucauggguacaggaggccagcagggaccaggccagucagccaugcucaggaccccucggcuccu

SEQ ID NO: 445890 - RNA, 64 nt, Human
ccucgaacucuugggcuucaagcaauccuccugugucagccaccagaguagcugagacuacagg

SEQ ID NO: 445891 - RNA, 59 nt, Human
aaauaaagacaaacuaaaacaaaacagaacaaaagcaaaggaaaaugcuuuagaaauuu

SEQ ID NO: 445892 - RNA, 59 nt, Human
uuaaaaaguugccuucuccaguggcaguccaaaagcagaaaugagaggaaauuauuaca

SEQ ID NO: 445893 - RNA, 59 nt, Human
cacuaaucacaaacugaaugacuugacuucaaaagcaacaaccuuaaaggccgucauuu

SEQ ID NO: 445894 - RNA, 59 nt, Human
agcucaauaaaagaaucugauacuuagaccaaaagcaacauucguucucuaaccauucu

SEQ ID NO: 445895 - RNA, 59 nt, Human
uuuaaauccuuaaaaguuaccucccauaacaaaagcauguauauguauuuucaaaagua

SEQ ID NO: 445896 - RNA, 59 nt, Human
uuucagaggaagcagcucauagaaacauacaaaagcacacaaguauuuugggaaaaaau

SEQ ID NO: 445897 - RNA, 59 nt, Human
ucuaaauucagucuuuucaaaacaaaucacaaaagcagcauuagacauugccuuguuuc

SEQ ID NO: 445898 - RNA, 59 nt, Human
gucaguuuacgugguuuugugaauacuggcaaaagcaauuguuuuuaaauuaacaaugg

SEQ ID NO: 445899 - RNA, 59 nt, Human
cacuucgagucgaguguaagggcccuucacaaaagcagaaggaacacuggcccaaaccc

SEQ ID NO: 445900 - RNA, 59 nt, Human
ucauugguuauccugauuugcaaagugaucaaaagcauucuagccaugugcaaccaaac

SEQ ID NO: 445901 - RNA, 59 nt, Human
uaauguuaauagaggaaaugcagcaacgucaaaagcaaggcagguugguuaauuagauc

SEQ ID NO: 445902 - RNA, 59 nt, Human
ucaggaaaaccuguuugguuauccucauucaaaagcacuggacagagaauguuacugug

SEQ ID NO: 445903 - RNA, 59 nt, Human
agcaaaguaaucuuacaacuaugugcauacaaaagcaauacuauuuugugacuaaauau

SEQ ID NO: 445904 - RNA, 59 nt, Human
uuuaugaaagaugguauaguuuuuauugacaaaagcaaaguaaucuuacaacuaugugc

SEQ ID NO: 445905 - RNA, 59 nt, Human
gcaaaaccauggauaagggaggacuacuacaaaagcauuaaauugauacauauuuuuua

SEQ ID NO: 445906 - RNA, 59 nt, Human
aguuacauuuuauuuuuauuuaaacuggccaaaagcaaaauuauuuuauguuaaaaugu

SEQ ID NO: 445907 - RNA, 64 nt, Human
ugggcugcagcugcuaccccucgguuggggcugagucagccagauccucccccuacuucucccc

SEQ ID NO: 445908 - RNA, 64 nt, Human
acauuugagucccuuccaggccaucagaggccuagucagccacaugggaaacuuccaagaccug

SEQ ID NO: 445909 - RNA, 64 nt, Human
ugagggcaaaguagaggacaagcugucuuucccagucagccagggagcuccccgccaggccacg

SEQ ID NO: 445910 - RNA, 64 nt, Human
gugugaaguaccuaccuccuugccuugcuggacugucagccagucgcagggccggccacaagac

SEQ ID NO: 445911 - RNA, 59 nt, Human
auugugaggccaucucugagcaguggacucaaaagcauuuucaggcaugucagagaagg

SEQ ID NO: 445912 - RNA, 59 nt, Human
cuuuuuuuuaagggucagaguuuucaaaacaaaagcaucuucccuagaaauuuuuguga

SEQ ID NO: 445913 - RNA, 59 nt, Human
agggcaaaggcaaaacaagcccugauaagcaaaagcaguccccacaggugucugggcau

SEQ ID NO: 445914 - RNA, 59 nt, Human
acauuuagauaugccaaaagaauuaaaaucaaaagcacuaagaaauacauaguugugug

SEQ ID NO: 445915 - RNA, 59 nt, Human
ugaaaacacauuuuucuuagggaaggauacaaaagcaugugagacugguuccauggccu

SEQ ID NO: 445916 - RNA, 59 nt, Human
gguggacggagcggggcccauucucaggucaaaagcaagauuucuacugucauguggga

SEQ ID NO: 445917 - RNA, 59 nt, Human
cccauuagguuggguggaaaauuguuucucaaaagcaaauaaguaauaaaucugguauc

SEQ ID NO: 445918 - RNA, 59 nt, Human
auuacuuaauuuuaacuaaccaacaaccacaaaagcagcagcuacugcuaaauauugga

SEQ ID NO: 445919 - RNA, 59 nt, Human
gaggagggcuggaaggcagagcuuugggccaaaagcaggcguugggggguccccccuca

SEQ ID NO: 445920 - RNA, 59 nt, Human
cggccacuacccgcccgugggauaaaagccaaaagcaugcgucagcuaacuucagccug

SEQ ID NO: 445921 - RNA, 59 nt, Human
acuuugugauucucccugcucccuguggacaaaagcacauaauucugcuguuacgggua

SEQ ID NO: 445922 - RNA, 59 nt, Human
guggaugaugauaugcuuuugugagcaagcaaaagcagaaacgugaagccgugauacaa

SEQ ID NO: 445923 - RNA, 59 nt, Human
aauuuuguaacuuuuuauauuuuuuuaugcaaaagcagcuucuuaacagauggcauuuu

SEQ ID NO: 445924 - RNA, 59 nt, Human
cuggagcaaugagggucuaguccaggggccaaaagcagucugagguauuggguauacuu

SEQ ID NO: 445925 - RNA, 59 nt, Human
acaagcaaaaauccagcaaugcucaaauccaaaagcacucggcaggacauuucuuaacc

SEQ ID NO: 445926 - RNA, 59 nt, Human; identical to SEQ ID NO: 445920

SEQ ID NO: 445927 - RNA, 62 nt, Human
ucuccuggugucgccgguggcucauuuucuggcaaauggaggcacgaacgcaggggccaaau

SEQ ID NO: 445928 - RNA, 62 nt, Human
guacauuuuuaagcacauuguucuuuucaaagcaaauggaaaauaccuuuuuagacuuuacu

SEQ ID NO: 445929 - RNA, 62 nt, Human
uagggaaacaugaggccccuuaugggaccccccaaauggaacaacuucacuuucucuuuuau

SEQ ID NO: 445930 - RNA, 62 nt, Human
uucauuuauaaaacaugcuaguugagacuuuucaaauggauuuuuaugacccacuacugggu

SEQ ID NO: 445931 - RNA, 59 nt, Human
ucaagcaaaaacaaaaaacagcuuuacuucaaaagcaugugccucugguaaauuaucca

SEQ ID NO: 445932 - RNA, 59 nt, Human
cucccaugccucagcuuuguaccuguuuucaaaagcacaacugaggugugcgggcugga

SEQ ID NO: 445933 - RNA, 59 nt, Human
uugcccuguuuggccacccucuggccagccaaaagcacucugaaaccaagaccuuccca

SEQ ID NO: 445934 - RNA, 59 nt, Human
gaugccacagaagccuuuaucguuaggggcaaaagcagacaucucugguagcaggagcu

SEQ ID NO: 445935 - RNA, 59 nt, Human
uuuugcagaaaaaacaaaaaaacuacaaacaaaagcagcccucugccuccuccccaggg

SEQ ID NO: 445936 - RNA, 59 nt, Human
uaccuccuucuucuaacuugcccuauuugcaaaagcacuuuuguaguaacaacuauugg

SEQ ID NO: 445937 - RNA, 59 nt, Human
acugucaagcauccccuguccccaaguuccaaaagcacagacucaaagggaaacccccc

SEQ ID NO: 445938 - RNA, 59 nt, Human
uagcaaugaggcugugcauuccuaaaggacaaaagcaaagaagcuauuuaggaauuuac

SEQ ID NO: 445939 - RNA, 59 nt, Human
acaguaaccaaaacugcaugauacugguacaaaagcauggugcugguacaaaagcagac

SEQ ID NO: 445940 - RNA, 59 nt, Human
gauacugguacaaaagcauggugcugguacaaaagcagacacauagaucaauggaacag

SEQ ID NO: 445941 - RNA, 59 nt, Human
uuugguauuuuguaauugagagcucauuucaaaagcagaaaaagacaacaaauauuaaa

SEQ ID NO: 445942 - RNA, 59 nt, Human
cccuuuugaagagacagcaacagccguagcaaaagcagcugcugcuccugcuaugaggg

SEQ ID NO: 445943 - RNA, 59 nt, Human
aagacuuacuuauucuuccgucacauauacaaaagcaagacuuccagguagggccagcu

SEQ ID NO: 445944 - RNA, 59 nt, Human
ccuuuggccuugcacaacccauuugugagcaaaagcagaaguggaccaccaucagcucc

SEQ ID NO: 445945 - RNA, 59 nt, Human
ccugcugauggucucagcuuccagcagcacaaaagcagaugauguacuggaaaaugcuc

SEQ ID NO: 445946 - RNA, 59 nt, Human
gccucagaaagaagucaguuaacgucacccaaaagcacaaaauggauuuuagucaaaua

SEQ ID NO: 445947 - RNA, 64 nt, Human
auauugugcagagagaguauccuugacugcuuaagucagccaguucagcauggauaccaacauu

SEQ ID NO: 445948 - RNA, 56 nt, Human
uacagcauucuuacuccuaaacagcagucagccacaaacugacccagaguuuaauu

SEQ ID NO: 445949 - RNA, 64 nt, Human
cgccuuggccucccaaagugcugggauaauaggugucagccaccgcgcccagccuggaguggcc

SEQ ID NO: 445950 - RNA, 64 nt, Human
cuggagagggccggggucggggagguuggggggugucagccaaaacguggaggugucccucugc

SEQ ID NO: 445951 - RNA, 59 nt, Human
ugaggcgucaagauggcuguggcagcuagcaaaagcaaagaugcuuugugcauagccuu

SEQ ID NO: 445952 - RNA, 59 nt, Human
aaagaugcuaggcgugacaccguucccuccaaaagcagaccucggaaucacugccaaau

SEQ ID NO: 445953 - RNA, 59 nt, Human
agagucaaaauaccauuuacaaagaaaaucaaaagcauuucuauauuuugucuuuuuuu

SEQ ID NO: 445954 - RNA, 59 nt, Human
aggccccgagacuuuucuucugugauuuccaaaagcaaggcagccgugcuguucuaguu

SEQ ID NO: 445955 - RNA, 59 nt, Human
uuugaugugucaaaggcuuuuggagugaccaaaagcacagaggcagcggguggggcgcc

SEQ ID NO: 445956 - RNA, 59 nt, Human
ugccaucuauacaauuuucuuacagaugucaaaagcagucuaguuuauauaagcauucu

SEQ ID NO: 445957 - RNA, 59 nt, Human
gcacugccagcuugccaguuucugcccagcaaaagcacguaugcuucaggggccuucug

SEQ ID NO: 445958 - RNA, 59 nt, Human
uauggaacucgaauuaaauauccacaauucaaaagcaccuaaaaagaauaggcugagga

SEQ ID NO: 445959 - RNA, 59 nt, Human
uaaccagacccaucucuccuccaccuugacaaaagcagauuauaguauacaagguagga

SEQ ID NO: 445960 - RNA, 59 nt, Human
auguaauauuuaagguuggaaaaaaaacucaaaagcaaagauauuaacucuuauuagaa

SEQ ID NO: 445961 - RNA, 59 nt, Human
gugagcuccaaagaggggccaccuguucucaaaagcauguuggggaccaggagguaaaa

SEQ ID NO: 445962 - RNA, 59 nt, Human
aaaauaaguguucaauguuuguaguucuucaaaagcauguugcaguagccagccauacu

SEQ ID NO: 445963 - RNA, 59 nt, Human
gccuauuucacagcaaggaaauucaccuucaaaagcacugauuacccaaugcaccuccc

SEQ ID NO: 445964 - RNA, 59 nt, Human
aauauugagcugcauuucucaaagaaugacaaaagcauccuuauacugaugaguucuua

SEQ ID NO: 445965 - RNA, 59 nt, Human
uuauaaauuaaauguuuggguucauaccccaaaagcaauauguugucacuccuaauucu

SEQ ID NO: 445966 - RNA, 59 nt, Human
ugucaaaugaugauuaugaguucccuaaacaaaagcaaagaugcauuuucacugcaaug

SEQ ID NO: 445967 - RNA, 64 nt, Human
ugaugaacaugucaaaauugaugaccacuagaaugucagccacaugugucuuuguauuuuugcu

SEQ ID NO: 445968 - RNA, 64 nt, Human
aacuaggucuggggcacucccaaugcagcgccuugucagccaaggugggcaggcagggacugug

SEQ ID NO: 445969 - RNA, 64 nt, Human
gauguggcugaaccgagcuggagccaacagaugugucagccaggauugaccuuugcacgaacac

SEQ ID NO: 445970 - RNA, 64 nt, Human
uugauccucacauguuuccugggcaccuaacucugucagccacugccagggaccaaggauccag

SEQ ID NO: 445971 - RNA, 59 nt, Human
ggcuugaccugcagaagauacccaagguccaaaagcacaaggucugcggaaaguucugg

SEQ ID NO: 445972 - RNA, 59 nt, Human
cuugaauagcacaucaauagguuacuggacaaaagcagaaaaaccuguuacaggauagc

SEQ ID NO: 445973 - RNA, 59 nt, Human
cacucaugagauaacugcauuucacccaacaaaagcaggguauaaggcgauauugguga

SEQ ID NO: 445974 - RNA, 59 nt, Human
agggauaaugaugcccuuggcauaauucacaaaagcagcugugacaaccuccaaucagu

SEQ ID NO: 445975 - RNA, 59 nt, Human
uaaagaccuugagaugagccaggaagaaacaaaagcaaggggcauuuccucuccaacuu

SEQ ID NO: 445976 - RNA, 59 nt, Human
cuguuugagauuuuuaucucuugauucuucaaaagcauucugagaaggugagauaagcc

SEQ ID NO: 445977 - RNA, 59 nt, Human
ccccagaaggagugauuuuucuaucggcacaaaagcacuauauggacugguaaugguua

SEQ ID NO: 445978 - RNA, 59 nt, Human; identical to SEQ ID NO: 445540

SEQ ID NO: 445979 - RNA, 59 nt, Human
gggggaauccuggugcucaaauuacccuccaaaagcaaguagccaaagccguugccaaa

SEQ ID NO: 445980 - RNA, 59 nt, Human
gcccugggccgucccugugugaacgcaggcaaaagcagcccagucccccucacugcuug

SEQ ID NO: 445981 - RNA, 59 nt, Human
agccugggugaccgagggaggcucugucucaaaagcaaagcaaaaacaaaaacaaaaac

SEQ ID NO: 445982 - RNA, 59 nt, Human
cguuuugaaaagcuacagcuuccagcagccaaaagcaacuguuguuuuggcaagacggu

SEQ ID NO: 445983 - RNA, 59 nt, Human
uuggaaccagaaaagcccaaccuaaauagcaaaagcaauccuaagcaaaaagagcaaug

SEQ ID NO: 445984 - RNA, 59 nt, Human
cgugaucacuuccgccacagccuguuuaucaaaagcaagccccccaggcccagcccacg

SEQ ID NO: 445985 - RNA, 59 nt, Human
agagagaaaauccacaaauuccaaugucacaaaagcaauaaaacaaacuagaaaaaaaa

SEQ ID NO: 445986 - RNA, 59 nt, Human
ggccacagucuggacccgcacguccuguucaaaagcagacucgggaacugccugaaugu

SEQ ID NO: 445987 - RNA, 64 nt, Human
cugugccccgggauggagugaggguggagggcgcgucagccacgggugggccuugugucgccuu

SEQ ID NO: 445988 - RNA, 64 nt, Human
uucagaacauacucuaauaaugcagccaggagccgucagccagaucccaaaugagugccuuccg

SEQ ID NO: 445989 - RNA, 64 nt, Human
gguuuccagaccugaggcaucgaaugggcuaaaggucagccagaagucagagggcucucagccu

SEQ ID NO: 445990 - RNA, 64 nt, Human
uauucacauagguucuuuucuauuuucccuaagugucagccaacuugagaaauaaagggacaga

SEQ ID NO: 445991 - RNA, 59 nt, Human
gaucuuaagaaaccaauccuugccucaagcaaaagcauuucugaaucugugacgcaaga

SEQ ID NO: 445992 - RNA, 59 nt, Human
uccucccacugcugacggaggaauuaacacaaaagcagacaacacucuagaacuggaga

SEQ ID NO: 445993 - RNA, 59 nt, Human
aaucucacauagaugauaauauuaaguuccaaaagcaacucaaccugguagauucuaau

SEQ ID NO: 445994 - RNA, 59 nt, Human
gugaaagauuauuuuucuacaacaaauuccaaaagcaaaaguuuuuggcccacauuuuc

SEQ ID NO: 445995 - RNA, 59 nt, Human
aaauccaaggcaauuccugauggaaaaugcaaaagcacauauauguuuuaauaucuuua

SEQ ID NO: 445996 - RNA, 59 nt, Human
aaaaacuccauguuauuggacuaaauaaucaaaagcauaauguuuucauaauuuucuau

SEQ ID NO: 445997 - RNA, 59 nt, Human
uccugaaaacucgcucuuuauaaacgaggcaaaagcauuuaauucccacccccccaccc

SEQ ID NO: 445998 - RNA, 59 nt, Human
caacuuaaauaaauuugaacucgaaauugcaaaagcagucuagaggcuuugcuaguauc

SEQ ID NO: 445999 - RNA, 59 nt, Human
ggcuauuucuuugaguucucuggcacugucaaaagcagccaacccaccccccaguccac

SEQ ID NO: 446000 - RNA, 59 nt, Human
aauacauagccaccauugguaguacaccccaaaagcaaggauggcaugaugcuggugac

SEQ ID NO: 446001 - RNA, 59 nt, Human
gaaacaaauuauaucaagguaaaacugaucaaaagcauaauugaaaguucugaaaaaag

SEQ ID NO: 446002 - RNA, 59 nt, Human
ugcucccccaacuggaucagguagaacaacaaaagcacuuuuccaucuuguacacgaga

SEQ ID NO: 446003 - RNA, 59 nt, Human
acauugagggcaugggcagaaucugcucccaaaagcauugaaagccaauaugaggccag

SEQ ID NO: 446004 - RNA, 59 nt, Human
gcaacaucacucgaaauaauuuuuuuuuucaaaagcaccuuaacaaccaauugcgaugc

SEQ ID NO: 446005 - RNA, 59 nt, Human
gucuagacucuucuguaagacucacagaacaaaagcaaggaauugcugauuuggggggu

SEQ ID NO: 446006 - RNA, 59 nt, Human
caaaaaaagaaaaaagccccagcauguagcaaaagcauuucuuggugagugugggggcu

SEQ ID NO: 446007 - RNA, 64 nt, Human
gaugcaguaauugugagccuaucaacauaguguagucagccagaacauuaaaguuucuuuguuu

SEQ ID NO: 446008 - RNA, 64 nt, Human
agccauguguacaguaaaaagcaggcaacauagugucagccaaagcucauuugcauaauaagau

SEQ ID NO: 446009 - RNA, 64 nt, Human
ugugaaaaggguuauuuuuacuuagcuuagcuaugucagccaauccgauugccuuaggugaaag

SEQ ID NO: 446010 - RNA, 62 nt, Human
gagagacauggccccugccaagcuggucccuucaaauggauccuuuguggacuuuagcucau

SEQ ID NO: 446011 - RNA, 59 nt, Human
gaggugggagggguggguuuugagaaggucaaaagcaauaccagaaguaaagggaaaua

SEQ ID NO: 446012 - RNA, 59 nt, Human
guacugugugugaauagcaguagugggggcaaaagcaaucuucucauuuggaaauguug

SEQ ID NO: 446013 - RNA, 59 nt, Human
ccgaucacuagauacugccuccucaauuucaaaagcaauauaacguuuguauaugcugu

SEQ ID NO: 446014 - RNA, 59 nt, Human
ccgugaugccacguaacuuacccuauggacaaaagcaggaaugacuaacacauccuagg

SEQ ID NO: 446015 - RNA, 56 nt, Human
uuuaugagagaauacuguaauaauaucaaaagcacuuuuucuggaaacacauuuau

SEQ ID NO: 446016 - RNA, 59 nt, Human
uggcugacuaggucaauuuuuuuucugaacaaaagcagguuuuuauauguaaacaguga

SEQ ID NO: 446017 - RNA, 59 nt, Human
agaacuaccuccagaaccgacaguuccagcaaaagcagcggcccgagcagaagaucgag

SEQ ID NO: 446018 - RNA, 59 nt, Human
uucccuucucugcagccucuuggucauaacaaaagcagggcuucaucuucacuugaugg

SEQ ID NO: 446019 - RNA, 59 nt, Human
gaacggaaguguauuuauacugcucuuuacaaaagcaccggugcuccucucuaggcagc

SEQ ID NO: 446020 - RNA, 59 nt, Human
cccugggagacauaucaguaauggauguacaaaagcaggucuguuuuaugucuuaguau

SEQ ID NO: 446021 - RNA, 59 nt, Human
gagagacaaacauuauaaaaaucugauggcaaaagcaaaacaaaauggaaaguagggga

SEQ ID NO: 446022 - RNA, 59 nt, Human
acaugccaguuggaaggcugcaccagacucaaaagcaaacuaaacaauaaaggacagcu

SEQ ID NO: 446023 - RNA, 59 nt, Human
gggccauggccucaggcuugugucuaucacaaaagcacaaacuugcccuaacccacaug

SEQ ID NO: 446024 - RNA, 59 nt, Human
cgggcagucugcccaagugucuuaggaaccaaaagcaaauaaaaguguuuccauauaug

SEQ ID NO: 446025 - RNA, 59 nt, Human
gguggaacagagucauauuucucuucuuucaaaagcaaaugggagaaauaucgcugaau

SEQ ID NO: 446026 - RNA, 59 nt, Human
agacccagacccuccgcugggagaccuuccaaaagcaaaaacaaaaaacaaaaaaaaca

SEQ ID NO: 446027 - RNA, 64 nt, Human
ggucagaaguuugaaaccagcauggccaacagaugucagccacuuuucccagccuguuuuuuga

SEQ ID NO: 446028 - RNA, 64 nt, Human
ucccagaaccccaagaaugggcaagaaggaucaggucagccacucccuggagacacagccuucu

SEQ ID NO: 446029 - RNA, 64 nt, Human
uccuaaguuuaauuacaacagcacgugcagccacgucagccaaaugacuucauuucugauguga

SEQ ID NO: 446030 - RNA, 64 nt, Human
ucuauaaaugaaggcaccaggggugccgggggcugucagccacaccuguuccugaugggcugug

SEQ ID NO: 446031 - RNA, 59 nt, Human
ugugcaggccaugauggaggggucccacacaaaagcagaccugcgagaucucuuccaga

SEQ ID NO: 446032 - RNA, 59 nt, Human
guauucagcaaugauagguuaaucacuggcaaaagcaucagaucuuuguauaugcuaag

SEQ ID NO: 446033 - RNA, 59 nt, Human
ggccacgcacugacacugcccaggccaagcaaaagcagagugugguuaagagacaaggg

SEQ ID NO: 446034 - RNA, 59 nt, Human
gacacaucccccccaaccuacccccaccccaaaagcagcuccaacagaauggccagagg

SEQ ID NO: 446035 - RNA, 59 nt, Human
ugugugcuuuuggagagaauguugauuggcaaaagcagcacaguauuaauauuuagagu

SEQ ID NO: 446036 - RNA, 59 nt, Human
ugaucagaauagauauccuuuuacacgcacaaaagcaauagauucauucaguggacaag

SEQ ID NO: 446037 - RNA, 59 nt, Human
acauaguaaguuucacacuaccuuauuaccaaaagcaaacaccucuuacuuuaaacuac

SEQ ID NO: 446038 - RNA, 59 nt, Human
auuuucaaacuaccugguuaaccaaaauacaaaagcagcugacuaugugugauuucaua

SEQ ID NO: 446039 - RNA, 59 nt, Human
cugacucacacugcuaacucuguuacugacaaaagcaaaucaauaacucuaaauucugg

SEQ ID NO: 446040 - RNA, 59 nt, Human
cacaucuacucaacucugcuguugacaugcaaaagcagcaauagacaauaugcguguaa

SEQ ID NO: 446041 - RNA, 59 nt, Human
guggcuguaauccaagaaaacuuuauuuacaaaagcagguggagggcuggguuuggccu

SEQ ID NO: 446042 - RNA, 59 nt, Human
guaggguuggugagaaggaaagaugagaacaaaagcaacauuggguuaagggaacucgc

SEQ ID NO: 446043 - RNA, 59 nt, Human
cuuuauuuguaauaauuuagucugcugaucaaaagcauugucuuaauuuuugagaacug

SEQ ID NO: 446044 - RNA, 59 nt, Human
aaauugagcucagcuuccuaggcauuacccaaaagcaagguguuuaaguaauugccagc

SEQ ID NO: 446045 - RNA, 59 nt, Human
agcccaugcucuucccagagcagcacccacaaaagcaagcauugauuuugugcucagug

SEQ ID NO: 446046 - RNA, 59 nt, Human
ucuaacuuaaacggaugggauucacuuaacaaaagcaagaagaaaagcacacgaacagg

SEQ ID NO: 446047 - RNA, 64 nt, Human
uugacccucuaugauaugugcugcagauaucgaggucagccauucggaagcuggcagcauuuua

SEQ ID NO: 446048 - RNA, 64 nt, Human
cuugcacagcauggcucugccucacaaugaugcagucagccaccuggugaagaagugaccugcg

SEQ ID NO: 446049 - RNA, 64 nt, Human
cguggcugucuccgccccaucgaggaggaggcccgucagccauggcugccaucuggcuucugcc

SEQ ID NO: 446050 - RNA, 64 nt, Human
ggagcaucuaucagauuaaguuagaacauuugcugucagccacauauugagaugacacuaggug

SEQ ID NO: 446051 - RNA, 59 nt, Human
uauauuuguguuuuguuuguacuaaaaugcaaaagcaagagugcaauuuuuaaaaucua

SEQ ID NO: 446052 - RNA, 59 nt, Human
ggaaaucagcuaagaaaauggacuuuagacaaaagcaagaggaucagaugaagaaaagg

SEQ ID NO: 446053 - RNA, 59 nt, Human
aaguuuugcuguagcugucggguuuuguacaaaagcaaaaauaagucaggagcagcgaa

SEQ ID NO: 446054 - RNA, 59 nt, Human
uaaaaugaccugcgaauuacccuaauucucaaaagcaaaacaagagcacacaagcguga

SEQ ID NO: 446055 - RNA, 59 nt, Human
uuugauaaaacugcuagaggauggcuaugcaaaagcauaacgauucaaggaaacaaagu

SEQ ID NO: 446056 - RNA, 59 nt, Human
uagaaugaugucugcucuagggaaaccuucaaaagcaauaaaaaugcuguguugaaaug

SEQ ID NO: 446057 - RNA, 59 nt, Human
uguaacugcuaaucaagggugaugcacagcaaaagcaauggaccccaucccucuaaagc

SEQ ID NO: 446058 - RNA, 59 nt, Human
gcauuuaugauuuaucuagaaauuuaccucaaaagcagaauuuuuaaaacugcauuuuu

SEQ ID NO: 446059 - RNA, 59 nt, Human; identical to SEQ ID NO: 446058

SEQ ID NO: 446060 - RNA, 61 nt, Human
gaagugacacuuuuuccacaauuaacccaaguuguguuaauacuucaggucuguuucccag

SEQ ID NO: 446061 - RNA, 61 nt, Human
gaucuuaaauguuccuuuuuaaaaaaaagaauuguguuauagguuacaaaaucugauuuau

SEQ ID NO: 446062 - RNA, 61 nt, Human
guggugucuaagaagucggacaccuugguuuuuguguuagauugagcugggcagcugcaau

SEQ ID NO: 446063 - RNA, 61 nt, Human
agcuuaccuacuguuaucucuaaaauuuuuuuuguguuaauguaaaguugaauuucuagga

SEQ ID NO: 446064 - RNA, 61 nt, Human
uguaaaugcuccauuuuuaaaguuuuauaacuuguguuauuuaaugagucagucaaucggc

SEQ ID NO: 446065 - RNA, 64 nt, Human
aaccggagugaaaacuucaggggaaggguggggagucagccaagugccucagugugcccuguug

SEQ ID NO: 446066 - RNA, 64 nt, Human
cccucaggggcacugguguccugcagucuuacuagucagccacaguccagguuccagcaacacu

SEQ ID NO: 446067 - RNA, 64 nt, Human
uucuaaaaggugugaaggugauuuaagggcccaggucagccacuguuuguuuacaaaaucaggu

SEQ ID NO: 446068 - RNA, 61 nt, Human
gggcuauaggaaacuuucugaugccuccggauuguguuaguaguagccaucaggagggucu

SEQ ID NO: 446069 - RNA, 61 nt, Human
uauaagguugguaacauuagaggcugugagcuuguguuacaugguaauaaagccaaugaag

SEQ ID NO: 446070 - RNA, 61 nt, Human
aaguuauauuguuaaaaguguaaaagaauaauuguguuaugaagcugccuuauuuuuuuuc

SEQ ID NO: 446071 - RNA, 61 nt, Human
ugaggccaagggugacuuccagguuccugacuuguguuauaaguaacacagaagaagaaug

SEQ ID NO: 446072 - RNA, 61 nt, Human
cugauuucuucgcaagucucuuaauggucauuuguguuagauuacaucaaacugauggaua

SEQ ID NO: 446073 - RNA, 61 nt, Human
cugaacacauuuucuauagcccuuaauuuaguuguguuaauuuuucaaggugauguaucaa

SEQ ID NO: 446074 - RNA, 61 nt, Human
uuugaucucaaguuguauaaaaccaauaaauuuguguuacugcaguaguaaucuuaugcac

SEQ ID NO: 446075 - RNA, 61 nt, Human
cuaaaagugacuacuguuaauauuuuguauauuguguuaaauuaauuuuaauaaauuauau

SEQ ID NO: 446076 - RNA, 61 nt, Human
uggguauugcugucucauucuugguauauucuuguguuaacugcccauuggccugaaaaua

SEQ ID NO: 446077 - RNA, 61 nt, Human
gucucccuugaauuccucuguuccuuagagcuuguguuacuuggacggaauugccaacacc

SEQ ID NO: 446078 - RNA, 61 nt, Human
cugaggguuuggguuauacaccucuacugaauuguguuaauaacuguuuggcaguguguac

SEQ ID NO: 446079 - RNA, 61 nt, Human
auuaacugaucagcccuauaugaaacauaaguuguguuauaacuuaucagccguauaugga

SEQ ID NO: 446080 - RNA, 61 nt, Human
augcuacuuuauuaagaagaugcuggcugcuuuguguuagaauaggacaccccgcagcuuc

SEQ ID NO: 446081 - RNA, 64 nt, Human
aauggaagaccaaaaauuuuuccuagaccugguugucagccaaaguccuacaaugugaaaagag

SEQ ID NO: 446082 - RNA, 64 nt, Human
ccacccaugccuccuccuaccgcuguucuccuaggucagccaggccuccuccuggucuggacac

SEQ ID NO: 446083 - RNA, 64 nt, Human
uucuuccaagugucuaacuagucuucgcugcagcgucagccaaagcuggccccugaaccacugu

SEQ ID NO: 446084 - RNA, 64 nt, Human
ccaccgcagcaggcagaggggcuggacaggcacugucagccaaugugggggguccugaagacac

SEQ ID NO: 446085 - RNA, 61 nt, Human
ucauuucaagcaacaacaugguuguauuuuguuguguuaaaaguacuuuucuugauuuuug

SEQ ID NO: 446086 - RNA, 61 nt, Human
uaauauguagauuuuuuguauuauugccaauuuguguuaccagacaaucuguuaauguauc

SEQ ID NO: 446087 - RNA, 61 nt, Human
uccugugccucugugggagagggcagcugccuuguguuaugucuggggccacaguugcugc

SEQ ID NO: 446088 - RNA, 61 nt, Human
aaaaacaagugaagccccucuuuauuucauuuuguguuauugugauugcuggucaggaaaa

SEQ ID NO: 446089 - RNA, 61 nt, Human
gcauaaucuuauccccagaauugaggagggguuguguuaaccaauuaguuaaccaauuaug

SEQ ID NO: 446090 - RNA, 61 nt, Human
uccugugagacucuucccccugacucccccauuguguuaagaacccagcaacccaggagcc

SEQ ID NO: 446091 - RNA, 61 nt, Human
acacuacagaaaaacacaaaaaggugauggguuguguuaugcuuguauugaaugcugucuu

SEQ ID NO: 446092 - RNA, 61 nt, Human
ccaaggaaaagcaaaggcuuuucuuuucaguuuguguuauuuggaagacagaaaaacaucu

SEQ ID NO: 446093 - RNA, 61 nt, Human
uacccacaauacaguuaucuuuuuuauuguguuguguuaugccuacaugugauauaaauua

SEQ ID NO: 446094 - RNA, 61 nt, Human
uuuauauugugagaaaacagccccaucaggcuuguguuaaggcaauggacugaaugagugc

SEQ ID NO: 446095 - RNA, 61 nt, Human
aguugaacguguugaggcuuugcaauuucacuuguguuaaaggcucuggcauuuuuccauu

SEQ ID NO: 446096 - RNA, 61 nt, Human
gcgggaagugugccaaggaagcucuguggcguuguguuauugguagacacccucagccuca

SEQ ID NO: 446097 - RNA, 61 nt, Human
cuaucccagacauacggggugguaacugaguuuguguuauauguuguuuuaauaaaugcac

SEQ ID NO: 446098 - RNA, 62 nt, Human
uugucuguuagggaccacuaaaucaacaaccacaaauggauuuuuuuuuuaagaggagcugu

SEQ ID NO: 446099 - RNA, 62 nt, Human
uuucugucugccucuccuuccucucugcagcccaaauggaaaacaauuauuuacuccauugg

SEQ ID NO: 446100 - RNA, 62 nt, Human
cgggucacaggugauggcaaauagaaaagaagcaaauggaggaaauagucggauaaguaggu

SEQ ID NO: 446101 - RNA, 61 nt, Human
cauuuauuaaacacuuuucaugcuuaaagcuuuguguuagggagaggcuauggggguauag

SEQ ID NO: 446102 - RNA, 61 nt, Human
gccuuaagucuuuccucuguugcugaccagauuguguuaccauuugaauacacugacuaau

SEQ ID NO: 446103 - RNA, 61 nt, Human
caguguuuuacugccugguagaacacuaauauuguguuauuaaaaugauggcuuuugggua

SEQ ID NO: 446104 - RNA, 61 nt, Human
auaacuacccaaggacuacuaaaaggaaaaauuguguuaccuuuuuuaaauucccuguuaa

SEQ ID NO: 446105 - RNA, 61 nt, Human
gaugucaaauuucaggguuuuuuuguuguuguuguguuauuuugugguauugugcuuguuu

SEQ ID NO: 446106 - RNA, 61 nt, Human
ccauuuuugcugaauucaucuauuucgaguguuguguuaaaaggaaaaauaacaacuaacu

SEQ ID NO: 446107 - RNA, 61 nt, Human
uuaaugcucuuuguauggcaguauguauauauuguguuaaguuccucaagaaucuccuuaa

SEQ ID NO: 446108 - RNA, 61 nt, Human
uuggagaguagaguuaagacaaggcccaguuuuguguuagccgaccgucuuugcccaccuc

SEQ ID NO: 446109 - RNA, 61 nt, Human
cauuuuuaccaguguugcaaaguuuagaccuuuguguuaauaucagaaguguauuuguagc

SEQ ID NO: 446110 - RNA, 61 nt, Human
uuuaaugaaaauugggauaauauagaagaaauuguguuaaaauagaaguguuucauccuuu

SEQ ID NO: 446111 - RNA, 61 nt, Human
gagggacugauauaaguaaggagaugaguaguuguguuacaguucauuuucuuuaaaaaaa

SEQ ID NO: 446112 - RNA, 61 nt, Human
uaugcccaugcuuaaauuuuauagcuuuaauuuguguuauuucuuuauugacgggaagagg

SEQ ID NO: 446113 - RNA, 61 nt, Human
gaaugcggaaccauagcugguuauuucucccuuguguuaguaauaaacgucuugccacaau

SEQ ID NO: 446114 - RNA, 64 nt, Human
cuucucaccugugagaccaaauugagcuaggggggucagccagcccucuucugacacuaaaaca

SEQ ID NO: 446115 - RNA, 64 nt, Human
aucagguggaucccgcuucccccucccccaagaagucagccaacacgcagcugaggcgcaugug

SEQ ID NO: 446116 - RNA, 64 nt, Human
gcucugucucaggaauucacccaggcagccuggagucagccauggcucucugagccugaggaug

SEQ ID NO: 446117 - RNA, 64 nt, Human
guuuucucauucauccaucaagcaccaucaaccagucagccauuauuauuuauauauguauuac

SEQ ID NO: 446118 - RNA, 61 nt, Human
uucuucaguaacacaucucaugaucugaagauuguguuacaaaaaauauuaucaggccaaa

SEQ ID NO: 446119 - RNA, 61 nt, Human
aguuuucaaugucugaugguauauuugugaguuguguuaucuguaauauacaucccagaau

SEQ ID NO: 446120 - RNA, 61 nt, Human
gcugaccaaaccacaagaaacuuucuuuaaguuguguuaaagaggaaagaccuagaaucca

SEQ ID NO: 446121 - RNA, 61 nt, Human
agcauuaagaccuuguaaacaaaaauaauucuuguguuaaguuaaaucauuuuuguccuaa

SEQ ID NO: 446122 - RNA, 61 nt, Human
uucugaccuccacaacuauaaaauaauaaacuuguguuauuguaaaccucuaaguuugugg

SEQ ID NO: 446123 - RNA, 61 nt, Human
auuauagaaauuugcccugagcugaacuggguuguguuaacacauugguagagcuaugauu

SEQ ID NO: 446124 - RNA, 61 nt, Human
aaauaucuaagcaaugccuaucaacccuuuuuuguguuaugauuacuguagucauauuuau

SEQ ID NO: 446125 - RNA, 61 nt, Human
aaaugagauuucuuugaauguauuguucuguuuguguuauuucagaugauucaaauaucaa

SEQ ID NO: 446126 - RNA, 61 nt, Human
uaagguuuacacaggaauuccaccugaagacuuguguuaaaguucuacagcgcgcacuguu

SEQ ID NO: 446127 - RNA, 61 nt, Human
gcaauaaaguacaguaauuuuacuuuuuuucuuguguuacaucuaaauuacaacccuuaau

SEQ ID NO: 446128 - RNA, 61 nt, Human
aaaauguagccacauuuuuuaugggaagacuuuguguuaaaagugaacauuuugaagguuu

SEQ ID NO: 446129 - RNA, 61 nt, Human
aaacugagacuaaacuucucucuuuucaaaauuguguuaucuuccuuaauccuauuuucau

SEQ ID NO: 446130 - RNA, 61 nt, Human
ccaccauucuuaagaacguuaaauaaugcuguuguguuagcucugaguagaaaggaaaaag

SEQ ID NO: 446131 - RNA, 64 nt, Human
cagcacccuuggcguccccagcaggcuccccacugucagccacacaccugcccccaucacacca

SEQ ID NO: 446132 - RNA, 64 nt, Human
gcaccauggauacucgcccgugggcagggcuguggucagccaagaauagaggucauauaguugg

SEQ ID NO: 446133 - RNA, 64 nt, Human
gcagccugugaacuaaugcccagcauuccucaaggucagccagacaaaaaggaacuuaggucuu

SEQ ID NO: 446134 - RNA, 64 nt, Human
ucucauccauuuccuuuucaauggagacuacagcgucagccagcucagccuuggcuuuuaacuc

SEQ ID NO: 446135 - RNA, 61 nt, Human
auuaccaagacuauuauacuggaagugguuuuuguguuauaaagguuuaauuuuacauaag

SEQ ID NO: 446136 - RNA, 61 nt, Human
guauaaguauccaaagaaaaguuugaccugguuguguuauuuuaccagaccuugguaaaag

SEQ ID NO: 446137 - RNA, 61 nt, Human
cuucauuucuuuuccauacacugugugcuauuuguguuaacauggaagaggauucauuguu

SEQ ID NO: 446138 - RNA, 61 nt, Human
cuuuauguaucuauuauguaccucuuaucuauuguguuaucaucucuguuauagaagagcc

SEQ ID NO: 446139 - RNA, 61 nt, Human
ugccaaauuugucaguauugcauguaaauaauuguguuaauuauuuuacuguagcauagau

SEQ ID NO: 446140 - RNA, 61 nt, Human
uucuaugucuaaauauacaaauguuuuaccauuguguuacaguugccuacaguaugauuac

SEQ ID NO: 446141 - RNA, 61 nt, Human
acaauuuucgacuuaacuucaaaacacaguauuguguuaucuaucacauaacaggaccaug

SEQ ID NO: 446142 - RNA, 61 nt, Human
uucacagcaauagugaccuuuauuuaaauuguuguguuauaguuuaugcuucuuaaaucau

SEQ ID NO: 446143 - RNA, 61 nt, Human
auauuguuuacagccugugaaagugauuuauuuguguuaauaaaacucuuuugaggaaguc

SEQ ID NO: 446144 - RNA, 61 nt, Human
uaggaccagcuuaacuuauaaugaaugggcauuguguuaagaaaagaacauuuccagucau

SEQ ID NO: 446145 - RNA, 61 nt, Human
gaauagugaggugucuuuuauuuucucugcuuuguguuauuuuuucuuaucaaacaauuag

SEQ ID NO: 446146 - RNA, 61 nt, Human
acaccguggugagcauacagaguguccugauuuguguuaagugacugagaagauguuaauu

SEQ ID NO: 446147 - RNA, 61 nt, Human
aaaaagaacaguguugaaauuggaaaggacuuuguguuauuuagguuguuagaaugagccu

SEQ ID NO: 446148 - RNA, 64 nt, Human
ugagcuaugcacucuaauguggggccacucaccagucagccaaucuuuuauuguuccuuugcua

SEQ ID NO: 446149 - RNA, 64 nt, Human
acaaugcgcaaaggaaagcagucuuucagaaucugucagccaagugucuuucuaguuacugcua

SEQ ID NO: 446150 - RNA, 64 nt, Human
agacuuguuuccucagggcggcgaguagcggcaugucagccagccaccaugguuccuaccaaga

SEQ ID NO: 446151 - RNA, 64 nt, Human
gcaucgggggugaaucuugucuaacauucccgaggucagccaggcugcuaaccuggaaagcagg

SEQ ID NO: 446152 - RNA, 61 nt, Human
uuucuuuaagaggcaugaaaagcaacuauuguuguguuacaguguuaaaaauauucaguuu

SEQ ID NO: 446153 - RNA, 61 nt, Human
uaguuccuuuuauuuauagaaugcaugucuuuuguguuaagaaaccaaagagaaauaaaga

SEQ ID NO: 446154 - RNA, 61 nt, Human
uccucgcagagaaugugaacauguguguguguuguguuaauucuuucucauguugggagug

SEQ ID NO: 446155 - RNA, 61 nt, Human
cuuguauggagugauguuucauuuaccuggguuguguuaaugacugaauguugacaauaaa

SEQ ID NO: 446156 - RNA, 61 nt, Human
gacugacaaagacaucgauugauaugcuucuuuguguuauuucccucccaaguaaauguuu

SEQ ID NO: 446157 - RNA, 61 nt, Human
gauaagaguuaacauuuggcuauacugauguuuguguuacucaaaaaaacuacuggaugca

SEQ ID NO: 446158 - RNA, 61 nt, Human
uuagagagggaugaagaggugagaguaagccuuguguuagucagaacucuguguugugaau

SEQ ID NO: 446159 - RNA, 61 nt, Human
auggcucauuugcuuuugucacuaaacgguuuuguguuagaaccaccaaaauuauagcuuu

SEQ ID NO: 446160 - RNA, 61 nt, Human
uuuaaaucugaaaguuaccuuaauaguccucuuguguuauuaggacaguauuauuauagua

SEQ ID NO: 446161 - RNA, 61 nt, Human
ccuguguguccccuagugguuuucuuuccauuuguguuaugccacagagagaaauuuccug

SEQ ID NO: 446162 - RNA, 61 nt, Human
uccauuuuuguccuuccuaagacccuguuauuuguguuauuuccugccuuuccgaguccug

SEQ ID NO: 446163 - RNA, 61 nt, Human
ggggaggauggccccuagcuuaggaagacuguuguguuauuuguucaauuucaauaaaaug

SEQ ID NO: 446164 - RNA, 61 nt, Human
gaaugaaaacugguuggaaacuaaagguucauuguguuaagugcaauuaauacaaguuauu

SEQ ID NO: 446165 - RNA, 60 nt, Human
cagagagccagcgccacacaacaucaagaaggccgacaaccagguuggaaaccaagacgg

SEQ ID NO: 446166 - RNA, 61 nt, Human
uuaguaaaaugugcacaccugacuugcaauguuguguuaaacuagaauuauauucacuugg

SEQ ID NO: 446167 - RNA, 61 nt, Human
ucaggauuuagagaaggagccuaaacugaauuuguguuauuucaguaaaaguuauggaguu

SEQ ID NO: 446168 - RNA, 61 nt, Human
uauuucauuuucccaaagaaguuugcuauucuuguguuaauuguguauaccugauuguuuu

SEQ ID NO: 446169 - RNA, 61 nt, Human
cuaagauuacuggaaagccucuuaccagcauuuguguuagccagcucacagagaagaaaau

SEQ ID NO: 446170 - RNA, 61 nt, Human
aaacccucaaccaccuauucauugacuucuuuuguguuagagugaauaaaauuuuguucau

SEQ ID NO: 446171 - RNA, 61 nt, Human
auguguguuacagguuaaugccuucuuggaauuguguuaauguucucuugguuuauuaugc

SEQ ID NO: 446172 - RNA, 61 nt, Human
cagcacguuuuaacucuuaggaagcugaauguuguguuaucacuaauacuuuguacagguc

SEQ ID NO: 446173 - RNA, 61 nt, Human
auugucuugccaucaauaaaauaaugcauaguuguguuaaacuacaggcaaacauagccca

SEQ ID NO: 446174 - RNA, 61 nt, Human
uuuuuacucacuuuuuauuuauguguucuauuuguguuagucauaacuguuuauagugguu

SEQ ID NO: 446175 - RNA, 61 nt, Human
ggaccaauaauaaauuaucaauuacacauuuuuguguuaacuaauuaaaagcauaguguau

SEQ ID NO: 446176 - RNA, 61 nt, Human
auuugauagaaagaugagaucggagacaauguuguguuauagggcacacauugaagguaua

SEQ ID NO: 446177 - RNA, 61 nt, Human
aaauagguuuggacaauauuugcacccuuguuuguguuaugaaaaaaauuuuuccaaggug

SEQ ID NO: 446178 - RNA, 61 nt, Human
aauguuugucucaucccauucugcgucaugcuuguguuauaacuacuccggagacaggguu

SEQ ID NO: 446179 - RNA, 60 nt, Human
aggugagcacagccuggagccugugcccagggccgacaggcgcgacacccagcaaggcca

SEQ ID NO: 446180 - RNA, 60 nt, Human
uggggccgagacuauucagagccaguaggaggccgacagucacagcacugcacuguggug

SEQ ID NO: 446181 - RNA, 60 nt, Human
gccccagccccaggccgggaaggagccagcggccgacaaagcagaaacacccgcugcucc

SEQ ID NO: 446182 - RNA, 61 nt, Human
uaaagacaacuucagugguuaauuauaaaaguuguguuacuucguccuaaauuaaauugau

SEQ ID NO: 446183 - RNA, 61 nt, Human
gcugcuccuuugggggaauguuuggcaaccuuuguguuacagauuaaaaauucagcaauuc

SEQ ID NO: 446184 - RNA, 61 nt, Human
cauuaaaauaauaguggugaauuauauguuauuguguuaaaaccucacuugccaaauucug

SEQ ID NO: 446185 - RNA, 61 nt, Human
guuagggguuacuuucaggggaacauuucauuuguguuauuucuuaaacuucuauuuagga

SEQ ID NO: 446186 - RNA, 61 nt, Human
ucaucuuuuccugggguuuugcauucacugguuguguuaccuaguauugccuaugauaauc

SEQ ID NO: 446187 - RNA, 61 nt, Human
cccuugcacuuaacauaagcuauuuuuggcauuguguuaucaucggcuuauuuuauagauc

SEQ ID NO: 446188 - RNA, 61 nt, Human
ccuucacuggagcucaagaaaagcauuucuguuguguuauuugcagugcagaugaugucug

SEQ ID NO: 446189 - RNA, 61 nt, Human
gguccuaaaaggaauuguuaggcggcaggcuuuguguuacguguuacauggagugagggua

SEQ ID NO: 446190 - RNA, 61 nt, Human
uccuugguuuuuuaaaggugauaauuuugcuuuguguuacuuuuuugcucuugaauguauc

SEQ ID NO: 446191 - RNA, 61 nt, Human
uguauauuuuauuuaacaauaggcacuggguuuguguuacauauuuauauauuuuauuuua

SEQ ID NO: 446192 - RNA, 61 nt, Human
auucccccuuagaaagcaaguguuaccaaaguuguguuaucuugaaagcauuacagguaag

SEQ ID NO: 446193 - RNA, 61 nt, Human
uaaugggccagagccaugacccucacaggucuuguguuaguuguaucugaaacuguuaugu

SEQ ID NO: 446194 - RNA, 58 nt, Human
gacaccucuugccucuguagccuggucuuuguguuaucuuugguuuacuggauucagc

SEQ ID NO: 446195 - RNA, 64 nt, Human
ggagacagauggaggguacccuauuuacaacugagucagccaagccacugaugggaauauacag

SEQ ID NO: 446196 - RNA, 64 nt, Human
aauguuucugcacaguccugccucuuagauuacagucagccagaaaaacauacuuauaaaucau

SEQ ID NO: 446197 - RNA, 64 nt, Human
gggaagaccagccccgacagcaccuccugagaaagucagccaagggccuacccugaugccagag

SEQ ID NO: 446198 - RNA, 64 nt, Human
ggaaggaauccugguggaagucuuggguguuagugucagccaugggaaaugagccagcccaagg

SEQ ID NO: 446199 - RNA, 61 nt, Human
ucuuucaugcacuuuacucauagcacauuucuuguguuaaccaucccuuuuugagcgugac

SEQ ID NO: 446200 - RNA, 61 nt, Human
ugaguuuuauauuuucagugguuauuuuugcuuguguuagaucauuauuaaaauauaucca

SEQ ID NO: 446201 - RNA, 61 nt, Human
cguuucuagcaugggucagaggaaacaacauuuguguuauaacuucgucuugauaggcugu

SEQ ID NO: 446202 - RNA, 61 nt, Human
uucaaucuaacugugaaagaacuucugauauuuguguuauccuuaugauuuuaaauaaaca

SEQ ID NO: 446203 - RNA, 61 nt, Human
aauguauuuacuuuuuauuugcaacuuuaguuuguguuauuauuuuuuaauaagaacauua

SEQ ID NO: 446204 - RNA, 61 nt, Human
uucaaaacuaugccacuuuuucuuuuguccuuuguguuauuaaaauuuaauugauaauugu

SEQ ID NO: 446205 - RNA, 61 nt, Human
ugcccuuucccccaguauuguagagcaagucuuguguuaaaagcccagugugacaguguca

SEQ ID NO: 446206 - RNA, 61 nt, Human
ugaaaguauggaggagaugugcaauaaauauuuguguuauuaacuacacauacagcacucu

SEQ ID NO: 446207 - RNA, 61 nt, Human
aauucaguauuaucauuuugaagucuguaaauuguguuagucauuaacuuagucaccuguu

SEQ ID NO: 446208 - RNA, 61 nt, Human
gguaaagccugcaaaguauaauaguuaaggcuuguguuauuucgcguaagcauuguuguuc

SEQ ID NO: 446209 - RNA, 61 nt, Human
cauagugcuuuuuuccuauggccagugcaaauuguguuagcacacuugcauaugugccgua

SEQ ID NO: 446210 - RNA, 61 nt, Human
uugaacuuacuugaauggauuaaaaauugcauuguguuacagagcuagaaaauuuuaugua

SEQ ID NO: 446211 - RNA, 61 nt, Human
aagaacagacugaccaaagcucaccuguuuuuuguguuaggugcuuuggcugaacuugauu

SEQ ID NO: 446212 - RNA, 61 nt, Human
auuuuuaagguauaauaugguacugugaugauuguguuaaaauauuuauuuuuuaaagaug

SEQ ID NO: 446213 - RNA, 61 nt, Human
aauaauaaauagaguggugucuuuuccauaauuguguuaaagaacauuucuuuuccauuca

SEQ ID NO: 446214 - RNA, 61 nt, Human
uuggcaggacacugccccuugucaucugucuuuguguuagauccagaguugucggcagccg

SEQ ID NO: 446215 - RNA, 61 nt, Human
aaaauucuaaaugucuuucugugcauauuuuuuguguuaggaaucaaaaguauuuuauaaa

SEQ ID NO: 446216 - RNA, 61 nt, Human
aguuuuaacauuuacuucacaggacuugugauuguguuaaauucucacuauuguguuuucu

SEQ ID NO: 446217 - RNA, 61 nt, Human
uguccuuuauuugccuaguagaagugauaaauuguguuauauaugauaauuuauauaaaac

SEQ ID NO: 446218 - RNA, 61 nt, Human
cagacauuccuucuacauguaaugacacuucuuguguuaaacuaaaaauuuacaagagaag

SEQ ID NO: 446219 - RNA, 61 nt, Human
cagcuguaaaaguuuuacuauaacauuuacauuguguuagguauuuuaaguaauuuaaagg

SEQ ID NO: 446220 - RNA, 61 nt, Human
gagaggaugaggagagcuggucaaacauuccuuguguuaaaaaaaucaaacauucauaucc

SEQ ID NO: 446221 - RNA, 61 nt, Human
gaaacaaguuauguuuuguguuuuugucucauuguguuauugucugacuaaaucuaaaacc

SEQ ID NO: 446222 - RNA, 61 nt, Human
uagagauaccucaaggauaucauuuuugauuuuguguuacaguacacuuguagccaaaacu

SEQ ID NO: 446223 - RNA, 61 nt, Human
ugaaaaaugggacugucuuuugcccacuucguuguguuaaaaggggacauuuguccaaacu

SEQ ID NO: 446224 - RNA, 61 nt, Human
cucuucugcgugccccucuucugucucauaguuguguuaagcuugcguagaauugcagguc

SEQ ID NO: 446225 - RNA, 64 nt, Human
cucguagacugucauugcuccucaggugccugggccgcugaacaguccuugggucauugucagc

SEQ ID NO: 446226 - RNA, 64 nt, Human
aaaugaucaguuuuuuuuuauacacuguaaugaaccgcugaauaugaggcauuuggcauuuauu

SEQ ID NO: 446227 - RNA, 64 nt, Human
ggcaugggaaggauuuaacaccgauauauuguuaccgcugaaaaugaacuuuaugaaccuuuuc

SEQ ID NO: 446228 - RNA, 61 nt, Human
acugccauauuuauuuaguugaagaaugucuuuguguuaauucauucauauuuuuauaaau

SEQ ID NO: 446229 - RNA, 61 nt, Human
aaauuuuuccuguuaaauagcgacuucaguauuguguuauguuuuacagcguuaaaacaac

SEQ ID NO: 446230 - RNA, 61 nt, Human
acuaaauauuuuaguugguuuuauguuaacauuguguuagcuuuuauuuccuggauaguaa

SEQ ID NO: 446231 - RNA, 61 nt, Human
aaauaaauuaccaucuacucauggaauguuguuguguuagccagucugaaagcccaccuua

SEQ ID NO: 446232 - RNA, 61 nt, Human
uaugagauggauuauaauaaaauacuuaaauuuguguuauuuuuugaaccacagaugagua

SEQ ID NO: 446233 - RNA, 61 nt, Human
ucaaacuguguacuguguaguucuauauaguuuguguuaagcaugucauucauauaaacug

SEQ ID NO: 446234 - RNA, 61 nt, Human
ugaagauggacucggccccacauacacauuuuuguguuacagucauugauggacucuauuu

SEQ ID NO: 446235 - RNA, 61 nt, Human
ggguccagacuuuauucuuauucccagaauuuuguguuacguuuuuaccuccuaacauaug

SEQ ID NO: 446236 - RNA, 61 nt, Human
gaaaacuggggaccaguuccaaagucaguaauuguguuaaccacguguauaacagcucugc

SEQ ID NO: 446237 - RNA, 61 nt, Human
auaaaucauucaguugcacccauggggaagauuguguuacugcccuucacagugaaaaaaa

SEQ ID NO: 446238 - RNA, 61 nt, Human
aagcauuggggugggggagggagagggagcuuuguguuaagugccuacuggaaaugcacug

SEQ ID NO: 446239 - RNA, 61 nt, Human
cccuggaacuccucuuucauagaucgugacuuuguguuauuuuccguguuguuugaaagug

SEQ ID NO: 446240 - RNA, 61 nt, Human
ugaugacccacuccaagauauuauguguaaauuguguuauuauguauauggguaaagaugu

SEQ ID NO: 446241 - RNA, 60 nt, Human
cgucaucccauccacccuggccuucgcgcuggccgacacugucuucagcacccaggacuu

SEQ ID NO: 446242 - RNA, 60 nt, Human
cacuagaggucaggaguucaagaccagucuggccgacauggugaaacucagucucuauug

SEQ ID NO: 446243 - RNA, 60 nt, Human
auugaggaguguugaacuucaaccugagggggccgacagugcccuccaagacagagacga

SEQ ID NO: 446244 - RNA, 61 nt, Human
uucacagaaugauaauguaucuauuugucauuuguguuauauuugaaauuauuagaaauua

SEQ ID NO: 446245 - RNA, 61 nt, Human
auccauucagcucaugcccucaauguuuauauuguguuaucuguugggucugggacauuua

SEQ ID NO: 446246 - RNA, 61 nt, Human
auuacauaaauuaaaccuuaccaugaccaaauuguguuaggacggccugcuaucuacagca

SEQ ID NO: 446247 - RNA, 61 nt, Human
guauaucuugucgaucuuuaaguuguuacuauuguguuauucaugucuuuaaaucagauac

SEQ ID NO: 446248 - RNA, 61 nt, Human
accgaguaaaugugcuccagcaagauagacuuuguguuauucuaucuuuuauucugcuaag

SEQ ID NO: 446249 - RNA, 61 nt, Human
aaaaaaaauguuuugcuucuuacaaaaucauuuguguuaauaacaaaaacuuuauuuucgg

SEQ ID NO: 446250 - RNA, 61 nt, Human
agggauaaguuccugauuuuuguuuuuauuuuuguguuacaaaagaaagcccucccucccu

SEQ ID NO: 446251 - RNA, 61 nt, Human
cugcuucugacacugaaacuucccuuucugcuuguguuaaguauguguaaaaugugaagug

SEQ ID NO: 446252 - RNA, 61 nt, Human
uauuaaucacuuaaaaauuuuuuuuuguauuuuguguuauugauuauauacaaaggagacu

SEQ ID NO: 446253 - RNA, 61 nt, Human
cccagaauaacauucagacucucagcuggucuuguguuacacauccauggaccgguucacu

SEQ ID NO: 446254 - RNA, 61 nt, Human
agcuaccagcuacgccaaaccucggcauuuuuuguguuauuuucugacugcuggauucugu

SEQ ID NO: 446255 - RNA, 61 nt, Human
guaaauauaugaacauuagaaaaauagcaacuuguguuacaaaaauacaaacacauguuag

SEQ ID NO: 446256 - RNA, 61 nt, Human
aaaggcacaagaaagaaaauauccagcucucuuguguuaucucaguguggcgacugcagaa

SEQ ID NO: 446257 - RNA, 60 nt, Human
uaccugaggucaggaguucgagaccaaccuggccgacauggugaaacgcugucucuacua

SEQ ID NO: 446258 - RNA, 64 nt, Human
uccuuuucacaguucucuccuucuuccccccgcugucagccauuccuguucccaugagaugaug

SEQ ID NO: 446259 - RNA, 64 nt, Human
guggcgaugucucagcucuucgaagguuugccuugucagccauggauauggaacagaaagacua

SEQ ID NO: 446260 - RNA, 64 nt, Human
agggaucuggaaaaaauguuuaaaacucaguagugucagccacuguacaguguagaaagcagug

SEQ ID NO: 446261 - RNA, 61 nt, Human
agagaggggaaggaaauggaacaaguuguguuuguguuagcaugugggugauguaaacuuc

SEQ ID NO: 446262 - RNA, 61 nt, Human
aacauaaaucugugaacuugaaauuugaauuuuguguuagagauuuuuuuguuguuuguuu

SEQ ID NO: 446263 - RNA, 61 nt, Human
cauguaaucacauucucuagaaccauuuaguuuguguuaacuaugaaccaagcaguguggu

SEQ ID NO: 446264 - RNA, 61 nt, Human
ugugagcccauaaaacaguauuuuuuagaaguuguguuacaacuguagcaaauuuuccuuu

SEQ ID NO: 446265 - RNA, 61 nt, Human
accucuacucuguauuuucuacaguugguucuuguguuauaaauguugugagcaacagauu

SEQ ID NO: 446266 - RNA, 61 nt, Human
cguuuuaucuuuaugcaguacagugggcuuauuguguuaacacuucagaaagauucaaacu

SEQ ID NO: 446267 - RNA, 61 nt, Human
uucuuccucugggccuucaugcuuuucugcauuguguuaacauguuucaagugcauggccu

SEQ ID NO: 446268 - RNA, 61 nt, Human
aauauuaugaaaugugccuuuucugaagagauuguguuagcuccaaagcuuuuccuaucgc

SEQ ID NO: 446269 - RNA, 61 nt, Human
uaauauucaaagaauguuuuauuauaguccuuuguguuaaaauuuagccuuacuaauuaua

SEQ ID NO: 446270 - RNA, 61 nt, Human
ucauuaaagacuaauagaaauuuagaaaucauuguguuaaagagagcuauagagaaacaau

SEQ ID NO: 446271 - RNA, 61 nt, Human
uuagccaucaccccaaccccccaaaauuaguuuguguuacuuauggaagauaguuuucucc

SEQ ID NO: 446272 - RNA, 61 nt, Human
uuaaugaaauccugaacuuuauucuguguaauuguguuaauaaauccuaauaaauuuaaau

SEQ ID NO: 446273 - RNA, 61 nt, Human
auacauaccucaugaaagauuuuauucuuuauuguguuacagagcaguuucauuuucauau

SEQ ID NO: 446274 - RNA, 64 nt, Human
ucccucgucccuuuaccuggccagauaacuccagccgcugaauacaguguuaggacugggggcu

SEQ ID NO: 446275 - RNA, 64 nt, Human
cucucaacccuaacaccgucuggcacgauugugaccgcugaaguacaccacgagcuccaggcuu

SEQ ID NO: 446276 - RNA, 50 nt, Human
gccgcggguuauguucaugaccgcugaaccccaggcacggucguauccaa

SEQ ID NO: 446277 - RNA, 64 nt, Human
agugaaguuucauucugcuccagcgguggggaagccgcugaauccaccugcuucuccuuugcaa

SEQ ID NO: 446278 - RNA, 61 nt, Human
uuguuuuccuucauaaauauuuaucuuuuguuuguguuaaaacuggagaguguuuaaaaau

SEQ ID NO: 446279 - RNA, 61 nt, Human
agauuaaaauauguugcaaaauaucaaaaauuuguguuauuucagcaguaagauuaauuga

SEQ ID NO: 446280 - RNA, 61 nt, Human
ggucuuacucuaccaguuuucugacauuguauuguguuaccuaagucauuaacuuuguuuc

SEQ ID NO: 446281 - RNA, 61 nt, Human
aaggugauaucugugucuguauugacuugucuuguguuacauuaaacaguaggcagaacug

SEQ ID NO: 446282 - RNA, 61 nt, Human
uaaacucauaccucaguggacuuaaccaaaauuguguuagucucaauuccuaccacacuga

SEQ ID NO: 446283 - RNA, 61 nt, Human
auucuuucaaguaagagugcuagugaacaaauuguguuacuugccuugggauuuuuugaac

SEQ ID NO: 446284 - RNA, 61 nt, Human
aaggaaagaaacugucuuuuuaaagcuucuuuuguguuagauacuguauuagagaucugca

SEQ ID NO: 446285 - RNA, 61 nt, Human
ucacauuacaauaauauguguaguaguugaauuguguuaucaaagcauguccaacuucugu

SEQ ID NO: 446286 - RNA, 61 nt, Human
aaugugauggauggcacaaugaauguauauuuuguguuauucgugaauagucuuuugcaug

SEQ ID NO: 446287 - RNA, 61 nt, Human
cuauuaagggauuaguauuuuuccauguuuauuguguuaucagagugcauuagaaagauua

SEQ ID NO: 446288 - RNA, 61 nt, Human
auuaugcugaugguaucaccaucucuugaaauuguguuagguuugguuauuuugucugggg

SEQ ID NO: 446289 - RNA, 61 nt, Human
agagcugguauaggaaguuucuuucuuccuuuuguguuacaugugcauuaaacagaacaag

SEQ ID NO: 446290 - RNA, 61 nt, Human
acuugcuuaaacuauuugacauuuucuaucuuuguguuaacaguggacacagcaaggcuuu

SEQ ID NO: 446291 - RNA, 64 nt, Human
uugggauaagccagugucuagaggccugaaggaaccgcugaagaaccagaggagaucuccucuu

SEQ ID NO: 446292 - RNA, 64 nt, Human
ugguuuggccuuggggcacagagcugagcugaggccgcugaagcuguaggaagcgccauucuuc

SEQ ID NO: 446293 - RNA, 64 nt, Human
uguaaugguuuugcuguaaaaaauguuuccaacuccgcugaaauguugcugaaaagcauggugc

SEQ ID NO: 446294 - RNA, 61 nt, Human
aaauuauucaccuaagaauagaaucucagcauuguguuaaauaaaaaugaaagcuuuagaa

SEQ ID NO: 446295 - RNA, 61 nt, Human
agcaaauaaaacauggccuuaacaaaguuguuuguguuauuguacaauuugaaaauuaugu

SEQ ID NO: 446296 - RNA, 61 nt, Human
aauguuaaacaguauuaaauggcaccugauuuuguguuaaauuuuaguucccuguuguuua

SEQ ID NO: 446297 - RNA, 61 nt, Human
agauggcauuuaggaccacagcuugcuggauuuguguuagcuaugggaauaacuugauuuu

SEQ ID NO: 446298 - RNA, 61 nt, Human
acuaggcuucaguauaucaguguuuauuucauuguguuaaauguauacuuguaaauaaaau

SEQ ID NO: 446299 - RNA, 61 nt, Human
uuaaagcacccguucaccuucuugguugaaguuguguuaacaaugcaguagccagcacguu

SEQ ID NO: 446300 - RNA, 61 nt, Human
auguaaagaaaaauaaaacuguuuaugauacuuguguuagucacucgagcuagcuuauuuc

SEQ ID NO: 446301 - RNA, 61 nt, Human
agaagaccuuucagugugaacuguucuauuuuuguguuauaauuuaaacuucgauuuccuc

SEQ ID NO: 446302 - RNA, 61 nt, Human
guguuacaaguuagcugguguuuuacuauuauuguguuacauuuuuccagugucgucauua

SEQ ID NO: 446303 - RNA, 61 nt, Human
uugcagaaucaacagagacugaagugggcuuuuguguuauaauuuucccuuucuccaaccc

SEQ ID NO: 446304 - RNA, 61 nt, Human
cagaagcagugaccacuucaacagaauucuuuuguguuauguggagcaaugccaucucuca

SEQ ID NO: 446305 - RNA, 61 nt, Human
gaacauuuucucucguuacucagaagcaaauuuguguuacacuggaagugaccuaugcacu

SEQ ID NO: 446306 - RNA, 61 nt, Human
uuagugucauuaugcaauaaucacauugccuuuguguuaauagucaaauacuuaccuuugg

SEQ ID NO: 446307 - RNA, 64 nt, Human
uuagaggugaaugugaaugaagccucccaggcacccgcugaauuucugaggccuugcuuaaagc

SEQ ID NO: 446308 - RNA, 64 nt, Human
ggguucaccagagggagcuugggugcagguucacccgcugaaggcgcugauaaguccugugcug

SEQ ID NO: 446309 - RNA, 64 nt, Human
gguagauuaucagagcugucagcacuaccucuccccgcugaaaccagcaguucauggcuuccug

SEQ ID NO: 446310 - RNA, 61 nt, Human
agcuugagugcauauccuggaucaacggcauuuguguuaugggguaaaaguaaggguggga

SEQ ID NO: 446311 - RNA, 61 nt, Human
cuuuugcaaacuuuuuauguaagcaaacuuuuuguguuaucuggcacaggccuuugaaaag

SEQ ID NO: 446312 - RNA, 61 nt, Human
ucauuaccuugaagagugcauucgggguuccuuguguuagggacuuaagaaucugaggcga

SEQ ID NO: 446313 - RNA, 61 nt, Human
uucuuagucauuuguggaauauagugauauauuguguuaauuuggacaguagcgguuuuua

SEQ ID NO: 446314 - RNA, 61 nt, Human
uaaacaugauuuaaaagcuauuaagaguacuuuguguuagcacucuuaaaaacgcuaacag

SEQ ID NO: 446315 - RNA, 61 nt, Human
agacguucagcuagauuuguucccauuuccguuguguuaauucaaagcucaugcuccccua

SEQ ID NO: 446316 - RNA, 61 nt, Human
aaugaauaugucuuuggcuauguauguguccuuguguuauguuguacaguguuguuuugag

SEQ ID NO: 446317 - RNA, 61 nt, Human
agcacugcuuugcuggaugauuuucacugcuuuguguuaaugacuuugagcgaucucucac

SEQ ID NO: 446318 - RNA, 61 nt, Human
aaaauuuguucacauuacaugaaaguucagauuguguuacucaugaucugcuugacuguga

SEQ ID NO: 446319 - RNA, 61 nt, Human
gcuauguuauguauaacuuuucuaauaaaaguuguguuauaagcuguacuuuuuugaguau

SEQ ID NO: 446320 - RNA, 61 nt, Human
aauuccauaaugagcagagguguacgcgaaauuguguuaugacugauagccuucagcuaca

SEQ ID NO: 446321 - RNA, 61 nt, Human
ggcuuuguguagcuggaguaguuggguugcuuuguguuaggaggauccagaucauguuggc

SEQ ID NO: 446322 - RNA, 61 nt, Human
acuggcuuucucaagaguauggauugacauauuguguuaugaaugcacaucucucagaugu

SEQ ID NO: 446323 - RNA, 64 nt, Human
uacccaggcgcacgugcugcagcccccggaggccccgcugaaaccugggcugcccuucccccac

SEQ ID NO: 446324 - RNA, 64 nt, Human
gcucagggaaagaaggugauuuguauuugucuccccgcugaaaagaacaggauucaaguccaga

SEQ ID NO: 446325 - RNA, 64 nt, Human
gguggagugugccuucagggcaucuugaaaugucccgcugaaugauuugacucaguuugcucac

SEQ ID NO: 446326 - RNA, 61 nt, Human
gacucuguuccuaacaaugcaguauucucaauuguguuacugaaaaugcaacauuagcaaa

SEQ ID NO: 446327 - RNA, 61 nt, Human
ccagguugggagcacaccuagcuagaguuauuuguguuaaucuauucaggaugcucuaaga

SEQ ID NO: 446328 - RNA, 61 nt, Human
uaauugcacaacuccaaugcuaaagguuggauuguguuagaggaaucggcucuguauuugc

SEQ ID NO: 446329 - RNA, 61 nt, Human
agcuuaaaaugggcuugauuuaacauuguuuuuguguuauuuuugcuugaaacaacgcaca

SEQ ID NO: 446330 - RNA, 61 nt, Human
ggacacaggcugugccauugugccagaaacauuguguuaucuuuuauguuguuguuguugc

SEQ ID NO: 446331 - RNA, 61 nt, Human
cuuaaauuucaucacuguugaugugguucuuuuguguuaaaaaaaaaaagugcaacuauca

SEQ ID NO: 446332 - RNA, 61 nt, Human
uuuauucucuuuucuuuguuucauaggagucuuguguuauacaagguuaguccuucauggu

SEQ ID NO: 446333 - RNA, 61 nt, Human
uccccaaagucuuaauugcuuuauuuugguguuguguuaaauugaacagacagauguuuuc

SEQ ID NO: 446334 - RNA, 61 nt, Human
uuguccauguaauauuauguguacuuuuacauuguguuauaucaaaauauguuauuuauau

SEQ ID NO: 446335 - RNA, 61 nt, Human
augggucauuuuuuuuuaguuacagaagcaguuguguuaauauuuagaagaagauguauau

SEQ ID NO: 446336 - RNA, 61 nt, Human
uuuuugugcacagauuaugaugaagauuagauuguguuaucacucugccuguguauaguca

SEQ ID NO: 446337 - RNA, 61 nt, Human
ugccaagucugagaguauaauucuguagguauuguguuauuugcaacguaaauagugcauu

SEQ ID NO: 446338 - RNA, 61 nt, Human
ccuuccucucgaggagccacauuuuccuccuuuguguuaggggacauaacaagcucugcug

SEQ ID NO: 446339 - RNA, 60 nt, Human
acugccaucaccucccacuuggaaguguauggccgacagcaugaaauagcugagcccaga

SEQ ID NO: 446340 - RNA, 60 nt, Human
cugggauuacaggcgugagccaccgugccuggccgacauuuuuaaaaaaguuuuauuuug

SEQ ID NO: 446341 - RNA, 60 nt, Human
cacuugaugccaggaguuccagaccaggcuggccgacauggugaaaccccaucucuacua

SEQ ID NO: 446342 - RNA, 60 nt, Human
ucucugcuuaccguucaagaggcgugugcaggccgacagucggugaccccaucacucgca

SEQ ID NO: 446343 - RNA, 61 nt, Human
ugucagauuuuuuccuccaagaguugugcuuuuguguuauuuguuuucacucaaauauuuu

SEQ ID NO: 446344 - RNA, 61 nt, Human
guagcacaaaaauuuuccuuuuagucuagccuuguguuauagaaugaacuugcauaauuau

SEQ ID NO: 446345 - RNA, 61 nt, Human
auuacucucaucagcugaagaauauguacuauuguguuacucaaauuauguggcuuucauu

SEQ ID NO: 446346 - RNA, 61 nt, Human
ucuaaaauuuuaaauuaacaaaaauuauuucuuguguuauucagaguuacucaguuuugua

SEQ ID NO: 446347 - RNA, 61 nt, Human
ggaaaaaacuagcaugcuccccugcucccuguuguguuagggauguuuaggucauacuagg

SEQ ID NO: 446348 - RNA, 61 nt, Human
cuaagagguauugauuucugaauauucauaauuguguuaccuggguaugagaguguuggaa

SEQ ID NO: 446349 - RNA, 61 nt, Human
uuuguuuuuuuaaauacuuagaacuuagcacuuguguuauugauuagugaggagccaguaa

SEQ ID NO: 446350 - RNA, 61 nt, Human
ccuuuaaaugcagcacacugaguuuguacaauuguguuaacugcuggaagggacagaugca

SEQ ID NO: 446351 - RNA, 61 nt, Human
uuaaaaauucuaaccacuguaacaacaguuuuuguguuauuuucuguauuaaacaucuugu

SEQ ID NO: 446352 - RNA, 61 nt, Human
aauuuugcugguucuuuggauaauggaguucuuguguuaacaaauuacgugcuauaugauu

SEQ ID NO: 446353 - RNA, 61 nt, Human
uucuauaccagaauguaaauauuuuuguguuuuguguuaauuuguuagaauucuaacacac

SEQ ID NO: 446354 - RNA, 61 nt, Human
agaggugagacuauucagacuuuguuuauuuuuguguuaauuuugguaaauaugguuucag

SEQ ID NO: 446355 - RNA, 61 nt, Human
acaaaaaucucaguccccuccgaagugaacuuuguguuacccugcgucagaaaugccaagu

SEQ ID NO: 446356 - RNA, 64 nt, Human
aauuugcaauaaguuaucaugaaaaguuuuuagauuacacgaucgcauaugcugcauuucacgu

SEQ ID NO: 446357 - RNA, 64 nt, Human
ugauuuuuauauauugaguuuaagcaaggcauucuuacacgaggaagugaaguaaauuuuaguu

SEQ ID NO: 446358 - RNA, 64 nt, Human
uugaguuugugaccucaaaccauuguuuuuauucuuacacgacuacaguacuucaaauggcaca

SEQ ID NO: 446359 - RNA, 64 nt, Human
ccuuuugguaacauccgucauugcagaagaaaguuuacacgacgucaaaaagugacguucaugc

SEQ ID NO: 446360 - RNA, 61 nt, Human
ucucaagugccuuuuuguuuguacugguucauuguguuacauuaacgacccacucugcuuc

SEQ ID NO: 446361 - RNA, 61 nt, Human
aacugugcaccaagcaggaaaugaaaaugucuuguguuaccugaaaacacugugcacaucu

SEQ ID NO: 446362 - RNA, 61 nt, Human
cuggaaugauuuagcuuuguuauugcaugucuuguguuaaguguuuuguauaugauauugc

SEQ ID NO: 446363 - RNA, 61 nt, Human
auuugcuucaucaacuucaguguauaucauuuuguguuauuuuauacgaaaacauguuuau

SEQ ID NO: 446364 - RNA, 61 nt, Human
cuacagauacauuuuuuacagguuauuuucauuguguuauugacauccaugucucucguaa

SEQ ID NO: 446365 - RNA, 61 nt, Human
gaccuagucgauuauuuaagcauaaaauaaauuguguuaaacucuucaccuaucugugcuc

SEQ ID NO: 446366 - RNA, 61 nt, Human
gcauaaacauguucauucuuguugagcugcauuguguuaaaccaaauugugugaagcgagg

SEQ ID NO: 446367 - RNA, 61 nt, Human
ccucaccaauuugcccgucuuuaauaaaaucuuguguuaaaauuugcaucacgucgccuuc

SEQ ID NO: 446368 - RNA, 61 nt, Human
gaaagagagaugugggcuuccuuuuugagucuuguguuaggugcugagaccuuuuacaugg

SEQ ID NO: 446369 - RNA, 61 nt, Human
uuuagggaaagaauacaggcaggaugacacuuuguguuaaaguguuauuuuuauguauuac

SEQ ID NO: 446370 - RNA, 61 nt, Human
cugacuaccuugucauuuugguauaagaaauuuguguuauuugauaggccgggcauggugg

SEQ ID NO: 446371 - RNA, 61 nt, Human
uucaucuugagucggaauauauuuaaauaaauuguguuaucucuugccaaacauuuuguua

SEQ ID NO: 446372 - RNA, 61 nt, Human
gauuuaugaaggcugccauaguuaucuuuucuuguguuaaccaucuuaaaugauguuuugu

SEQ ID NO: 446373 - RNA, 64 nt, Human
ggaccccaucggcagggagaggaggcgcgggagggggacgcaaacaaaaaauggcuuucauauu

SEQ ID NO: 446374 - RNA, 64 nt, Human
uugggaagcugaggcgggagaaucaugugaacccgggacgcagggguugcagugagcggagauc

SEQ ID NO: 446375 - RNA, 64 nt, Human
cacgucaagguguuuucacagcccccugagggaagggacgcagggucuccgacaggugcucugg

SEQ ID NO: 446376 - RNA, 61 nt, Human
uauaaucuuuaaauuuaucaacuuuuuacauuuguguuauuuucagucagggcuucuuaga

SEQ ID NO: 446377 - RNA, 61 nt, Human
auuugucuaguacaaugcuugacauacagcauuguguuaugcccauuggggacacagaggu

SEQ ID NO: 446378 - RNA, 61 nt, Human
uucaaauuagaaaaguucaaaugaaguuuaauuguguuauuuuauaaaaccuucuaaaauu

SEQ ID NO: 446379 - RNA, 61 nt, Human
gcuguguacuaauaaagacugcagcaagcacuuguguuauuuaaauuauguaaguagauug

SEQ ID NO: 446380 - RNA, 61 nt, Human
uagaauauuuguuuuguguguaggaaccuaguuguguuaguuuaccuggguguuccacagc

SEQ ID NO: 446381 - RNA, 61 nt, Human
accugccugccccugucuuuuccccuugguuuuguguuacaagaguuguuggagacaguuu

SEQ ID NO: 446382 - RNA, 61 nt, Human
cagagcaaccgagaacugcauacauugaaccuuguguuagcauucucucucuaucucaucu

SEQ ID NO: 446383 - RNA, 61 nt, Human
auugccuucuaauguuaucaaaacucauuuauuguguuacuauuaaauaugcugaaaacgc

SEQ ID NO: 446384 - RNA, 61 nt, Human
aguuugucuuuuugugccucucaucuuucuuuuguguuauguaagauugauuauucauuuc

SEQ ID NO: 446385 - RNA, 61 nt, Human
uggcuugcugcuguaaucuuuuguuuuguuguuguguuacugaauguggcauuucaggguu

SEQ ID NO: 446386 - RNA, 61 nt, Human
cuaaacagcuugugaugcaagugugagccuauuguguuacuugaccuuauuuuggaaguuu

SEQ ID NO: 446387 - RNA, 61 nt, Human
guugaagcagugcauacgcaguagcuauuauuuguguuaucuuuauuucucuucauuguua

SEQ ID NO: 446388 - RNA, 61 nt, Human
ggacuucaguggggaggggccaaaaccguuguuguguuaaaauuuauuuuauuaaauuuug

SEQ ID NO: 446389 - RNA, 64 nt, Human
uuuuggaaacugaggacccaacaacuaaccacguuuacacgacuugaguuuugaaccccgauua

SEQ ID NO: 446390 - RNA, 64 nt, Human
uacuguucugaaauuaggaaaguacugcaugaucuuacacgaagaaauagaauaggcaaacuuu

SEQ ID NO: 446391 - RNA, 64 nt, Human
acauuuggagucccuuuucaacagugacaguuucuuacacgaagaauggauaugguuauugggc

SEQ ID NO: 446392 - RNA, 64 nt, Human
gcccccugugcccgccacacgcacgcacacacucuuacacgagagcacacucgaucccccuagg

SEQ ID NO: 446393 - RNA, 61 nt, Human
ccacuacucuuuucuguuuguugaguuugaauuguguuaacaucuuugaucagugggugua

SEQ ID NO: 446394 - RNA, 61 nt, Human
aacaagugaauuugaagacucauuuaaaauauuguguuauuuauaaagucauuugaagaau

SEQ ID NO: 446395 - RNA, 61 nt, Human
uuagaaaaugacuaaaauauuaaaaaccguguuguguuaaucuguuuuaagucauaccaug

SEQ ID NO: 446396 - RNA, 61 nt, Human
cuauuaacucauugaauguguuuccuuugucuuguguuaauaaauauugaugccugauucu

SEQ ID NO: 446397 - RNA, 61 nt, Human
ccccaaauauuguccugucccugucugggaguuguguuauuuaaagauauucuguauguug

SEQ ID NO: 446398 - RNA, 61 nt, Human
ugccaucccuuaagaugaaaaguuccuuuucuuguguuaauguacaaagcuuuucuuuugg

SEQ ID NO: 446399 - RNA, 61 nt, Human
cuguacuuuuugauacgagggcagucuuaacuuguguuaaggccuguguguagcauugaag

SEQ ID NO: 446400 - RNA, 61 nt, Human
acaguccuguucauguguguaggugguucuguuguguuaagaaagcauucauuauguccgg

SEQ ID NO: 446401 - RNA, 61 nt, Human
ucacauuuauuuuacagcaaucaugcugcauuuguguuaguguucuuuauaauaaaaaaca

SEQ ID NO: 446402 - RNA, 61 nt, Human
agaccauuuugaucaagaaccuguauauguguuguguuagaggcaucugccucaagucuau

SEQ ID NO: 446403 - RNA, 61 nt, Human
caggauagcgcaauuggcaaaucaugcuugguuguguuaggccaaaauacuaguuuugcuu

SEQ ID NO: 446404 - RNA, 61 nt, Human
gcaaaaaugagccagcaccagcgccuuggcuuuguguuagcauuuccuccugaaguguucu

SEQ ID NO: 446405 - RNA, 61 nt, Human
ccaacccacccccaaggagcugugggaggcuuuguguuaucugugaaacuccaaaacaggg

SEQ ID NO: 446406 - RNA, 64 nt, Human
guuauaaauagccuucaaaaagagagauucuccauuacacgaucaccugcaucacagcccaugg

SEQ ID NO: 446407 - RNA, 64 nt, Human
cuccacaagcucccucaugcuuccugucccccgcuuacacgacaacgggccagaccacaggaag

SEQ ID NO: 446408 - RNA, 64 nt, Human
cagcucucuuugcuaugggaacugggacacuuuuuuacacgauguugccgccguccccacccua

SEQ ID NO: 446409 - RNA, 61 nt, Human
auauuugaagcacaaauguaauacaguuuuauuguguuaccauuuguguuccauuugcuuc

SEQ ID NO: 446410 - RNA, 61 nt, Human
ugcugaguguguaaauauaaucgacuuuuguuuguguuacaugacuucugugacuucauug

SEQ ID NO: 446411 - RNA, 61 nt, Human
cuuaaucuacuaacagagaaggguagacaguuuguguuaaauguuggcauuuacuuguauu

SEQ ID NO: 446412 - RNA, 61 nt, Human
gccuuggaguccuacuauuucgugccuucauuuguguuacauacauagcugcaagcaaacc

SEQ ID NO: 446413 - RNA, 61 nt, Human
uuuuaucuaaauaacugcgcuguaacaaacuuuguguuagacaguugaaacuguuagaguu

SEQ ID NO: 446414 - RNA, 61 nt, Human
gugccuuuaagaaaauauuuuuugucauuuuuuguguuacagaacuauaaugugauucaag

SEQ ID NO: 446415 - RNA, 61 nt, Human
auuuugccaguuucuuuucacugaugcagauuuguguuaagauaguacugaauggaguauu

SEQ ID NO: 446416 - RNA, 61 nt, Human
auguaauguaaaauauucuuuucuugcuuucuuguguuaagguauauauucuauuuguaug

SEQ ID NO: 446417 - RNA, 61 nt, Human
aaaauauuuucucuauuuuccccuguucuuuuuguguuaugcacuuaauuuuaugacugcc

SEQ ID NO: 446418 - RNA, 61 nt, Human
ugguuuaaagacaaauucaugaagguauauuuuguguuauaguuguugaugaguucuuugg

SEQ ID NO: 446419 - RNA, 61 nt, Human
uuuuuguauuuuuaguacagacgggguuucauuguguuagccgggauggucuugaucuccu

SEQ ID NO: 446420 - RNA, 61 nt, Human
caaauuuuuuaaauaggagaaaauuaagaaauuguguuaaaggccuaaaguucaggagugu

SEQ ID NO: 446421 - RNA, 61 nt, Human
aguguguuagguucuaaugucaugacccaauuuguguuauucaucuuuaauccuguuuuca

SEQ ID NO: 446422 - RNA, 64 nt, Human
guugacuuugugaauguagaaaagcuuuuaucuauuacacgaaucuuuuucagcaucauuauac

SEQ ID NO: 446423 - RNA, 64 nt, Human
aucaccugccugucagccguggucagaauaaguuuuacacgaagcaggugaaagauuuaguucu

SEQ ID NO: 446424 - RNA, 64 nt, Human
acuuuucuccuguguaccaagguauugcuuuuauuuacacgacagcgacucaaaaggcacucga

SEQ ID NO: 446425 - RNA, 61 nt, Human
cagacgcuucuuuccugauuaucuuauuucauuguguuagcaaaauaugaccucccuaaaa

SEQ ID NO: 446426 - RNA, 61 nt, Human
guuguuuaagcauuuuaguuugaaccaggcauuguguuaggaauccagggauaaagaugaa

SEQ ID NO: 446427 - RNA, 61 nt, Human
ggaggcaaguaaauauagcuuucugagcgcuuuguguuaucacucgguguauauaguucau

SEQ ID NO: 446428 - RNA, 61 nt, Human
uuuagaaaauguuuggaauuuaagaaauaacuuguguuacuaauuuguauaacccauaucu

SEQ ID NO: 446429 - RNA, 61 nt, Human
gaauugaccccauccacaggcugauucaucuuuguguuaaggggcaaaugaaacgguauau

SEQ ID NO: 446430 - RNA, 61 nt, Human
ugaacuugccaaaaggggaagggaaaaaucuuuguguuacuucacucaaagaacauaagua

SEQ ID NO: 446431 - RNA, 61 nt, Human
auaguuucaaaguaugaauaagaauugguauuuguguuaucuuugaguaagaaacuguccg

SEQ ID NO: 446432 - RNA, 61 nt, Human
guuuuuaauuuuuuuguucuuaucagcagucuuguguuagcacuggguaagcuuuaauugu

SEQ ID NO: 446433 - RNA, 61 nt, Human
aauaaacaaaugggagguguucuccuuuauauuguguuagaggcugaggauauagaaauau

SEQ ID NO: 446434 - RNA, 61 nt, Human
acuuuaaaaacaucaaaaauuguuaaaaucauuguguuaucuaguaguuuauaauuaucgg

SEQ ID NO: 446435 - RNA, 61 nt, Human
aguaguuuuugcuaaaaaauuauuucuagaguuguguuauucuuagcaguaaucuuggcua

SEQ ID NO: 446436 - RNA, 61 nt, Human
aaaaacaguauuucguugauaucaguagucauuguguuaacuauaaagucaagugccagca

SEQ ID NO: 446437 - RNA, 61 nt, Human
auguauuguucucauguaagaaugacugauguuguguuaguuaagaauugaagauagguuu

SEQ ID NO: 446438 - RNA, 60 nt, Human
ccucacaugggcagaaaaaugguggucauuggccgacaucacaguuuuccuguuucccac

SEQ ID NO: 446439 - RNA, 60 nt, Human
guucugcaagacuacuugguauucuuguagggccgacacuaaauaaaagccaaaccuugg

SEQ ID NO: 446440 - RNA, 60 nt, Human
cugggauuaccggcaugagccacugcgccuggccgacaaaggcuuugauaucagaaugaa

SEQ ID NO: 446441 - RNA, 60 nt, Human
cuuuguuccuuucuuaccacucucuccuggggccgacacguugggacagcacaccauagc

SEQ ID NO: 446442 - RNA, 61 nt, Human
uacauaaucacauaagguccuuugcuuuucuuuguguuaagagggacuugccucuguaaau

SEQ ID NO: 446443 - RNA, 61 nt, Human
auuccuuuuuagcaaggauaaaaucauugccuuguguuacagauucagccugcugaagagu

SEQ ID NO: 446444 - RNA, 61 nt, Human
uaugccccuucuagcagggauaccuauaacuuuguguuagcaccauggagaauacaauguu

SEQ ID NO: 446445 - RNA, 61 nt, Human
guagggauuugaauacagguuauagucacuauuguguuauuucuugacuuuuguacuauua

SEQ ID NO: 446446 - RNA, 61 nt, Human
ccuagacuguuauuuaaaaaaaaaaaaaacauuguguuaggacagcauauaaauguaauaa

SEQ ID NO: 446447 - RNA, 61 nt, Human
aaguuaaggggauggucacauuuaccauguauuguguuauuagcaguuaaauuuuaugaau

SEQ ID NO: 446448 - RNA, 61 nt, Human
gcagccugagucagucuccccaaugucuacauuguguuauuuauacuagcaaaaaaauaga

SEQ ID NO: 446449 - RNA, 61 nt, Human
auuuacguugcaguuagcuauagacaucccauuguguuaucuuuuaaaaggcccuugacau

SEQ ID NO: 446450 - RNA, 61 nt, Human
ccuuuccucuucuuugcuuaacacaauuaucuuguguuaaggaucucaaagauuucaugag

SEQ ID NO: 446451 - RNA, 61 nt, Human
gacuggguguugcugaagcaaauguuggacuuuguguuagauagucuugcauaucuuaauc

SEQ ID NO: 446452 - RNA, 61 nt, Human
aauauuguuccuguccauucacccagccaaauuguguuaaagaggaaagccccacaaacua

SEQ ID NO: 446453 - RNA, 61 nt, Human
uacaguuuggcuguguccccaccaaauugaauuguguuaauaguucccauaaucccuacgu

SEQ ID NO: 446454 - RNA, 61 nt, Human
uuaguaugugaagccaggaguacuauuauuauuguguuagcaacaguugcauuaacuauuu

SEQ ID NO: 446455 - RNA, 64 nt, Human
uggguuuuccauaauguaguaguguguuauuuuauuacacgaaaugagggagcaauaacuucaa

SEQ ID NO: 446456 - RNA, 64 nt, Human
cucccugaccaaugacagagccugaaaaugcccugucagccaauggcagcucuucucggacucc

SEQ ID NO: 446457 - RNA, 64 nt, Human
gugcauuuuuauauuauguguuuguaaaugacaugucagccauuguuucauguuuccuaaaagc

SEQ ID NO: 446458 - RNA, 64 nt, Human
ugauggggguuuuuguuaaaaugcaucugagcaagucagccagccccgaaguccccucagugug

SEQ ID NO: 446459 - RNA, 61 nt, Human
auuagggaagauguccuuuuaaacaguagaauuguguuacaaaggggugaaagagagggaa

SEQ ID NO: 446460 - RNA, 61 nt, Human
ucacccugagcaaaucaguugcuuccuggacuuguguuacuucaucuaauucucaugugga

SEQ ID NO: 446461 - RNA, 61 nt, Human
aaaugaaaggaaaaauauaucccugguaguuuuguguuaaccacugauaacuguggaaaga

SEQ ID NO: 446462 - RNA, 61 nt, Human
uguggggugaaaaguuacuaccugucaagguuuguguuacccuccuguaaaugguguacau

SEQ ID NO: 446463 - RNA, 61 nt, Human
ucuuuauguuuagauaugcaaguacuuaccauuguguuacaguguccuacaguauucacua

SEQ ID NO: 446464 - RNA, 61 nt, Human
auauuguuuuaaguaaacacauuuuuaaaaauuguguuaagucuauguauaauacuacugu

SEQ ID NO: 446465 - RNA, 61 nt, Human
uuuuuaaauuguacacguuucagugccuuucuuguguuaugaaaggcagguagauauuaua

SEQ ID NO: 446466 - RNA, 61 nt, Human
uguaacuucuucauuugaaggauaagcugguuuguguuaagcaguauaguauugguugggu

SEQ ID NO: 446467 - RNA, 61 nt, Human
uuagcucuugucggccuucguggggagcuguuuguguuaauaugagcuacugcauguaauu

SEQ ID NO: 446468 - RNA, 61 nt, Human
guaucauucuuuuuauauaucacacuuaagcuuguguuagcuuuuuucuuuugccccagau

SEQ ID NO: 446469 - RNA, 61 nt, Human
uaauaaaaucacuguugugaggacuuaaauuuuguguuaccucccaagagauacuuuuuga

SEQ ID NO: 446470 - RNA, 61 nt, Human
ugaagauugccucuucuacagcuucugagaauuguguuauuucacuugccaagugaaggac

SEQ ID NO: 446471 - RNA, 61 nt, Human
accuaacaguggugcaaucauguugucuguguuguguuaugugagaauuuucuccuaaguc

SEQ ID NO: 446472 - RNA, 60 nt, Human
agccugccauucacguuugccaaggaagauggccgacacucucugaguguguucacuguu

SEQ ID NO: 446473 - RNA, 60 nt, Human
caaacccuuagcagcccagcauuucccgaaggccgacaccacuccugccagcccggcucg

SEQ ID NO: 446474 - RNA, 60 nt, Human
cugggauuacaggcgugagccacugugccuggccgacaauuuacuugucuuaguauuaua

SEQ ID NO: 446475 - RNA, 60 nt, Human
agagaaaaggcaccuugugccacagggcggggccgacacccugagcucacagguggcccc

SEQ ID NO: 446476 - RNA, 61 nt, Human
aguagggacuggaagauaugucaucugcugguuguguuaucacucccacccccuaccccag

SEQ ID NO: 446477 - RNA, 61 nt, Human
accuaaggcuuccaagcugauguuuguacuuuuguguuacugcagugaccugcccuacaua

SEQ ID NO: 446478 - RNA, 61 nt, Human
cucuggcacuguacagugaaugugucuguaguuguguuaguuugcauuaagcauguauaac

SEQ ID NO: 446479 - RNA, 61 nt, Human
gcaacauaaugaaaaagauggcuacugugccuuguguuacuuaaucauacaguaagcugac

SEQ ID NO: 446480 - RNA, 61 nt, Human
gauguguuugcaaaguuuuguuuuuuuaauguuguguuauuuugcuccagauuuucaucua

SEQ ID NO: 446481 - RNA, 61 nt, Human
ccucauguucuuaauucuuagcucauucuccuuguguuacuaaguuuuuauggcuuuugug

SEQ ID NO: 446482 - RNA, 61 nt, Human
gaauggaggaacuuuccaaacaccacuuuacuuguguuauauagccaauauaacuaucucu

SEQ ID NO: 446483 - RNA, 61 nt, Human
ugccucagccacuugccugugcuacaauucauuguguuaccuguagauucagguaauacaa

SEQ ID NO: 446484 - RNA, 61 nt, Human
auacaugacaaaguguaauuaacacugauguuuguguuaaauuugcagcagagcuugagaa

SEQ ID NO: 446485 - RNA, 61 nt, Human
uuucuucauauuaauacauauguauacuuuuuuguguuacugaauuaagcuugcccuugua

SEQ ID NO: 446486 - RNA, 61 nt, Human
uuuuaucaagaacaacacuuaucguuauguauuguguuaguuauauugccagucuguugcg

SEQ ID NO: 446487 - RNA, 61 nt, Human
gggggacggggaugucagggaggcaaguguguuguguuacugugucaauaaacugauuuaa

SEQ ID NO: 446488 - RNA, 61 nt, Human
uaggaagaaaggucaaaaauguuaucuucaguuguguuaaucccaguuuuagugcagcuua

SEQ ID NO: 446489 - RNA, 60 nt, Human
ucuuauuuauguaaauacuugcaucacaguggccgacaggcauuggaugcagaaccuaga

SEQ ID NO: 446490 - RNA, 60 nt, Human
ugaggcuguaacaugcccagaagcuguuguggccgacacuucaacaauagggaaaaaaag

SEQ ID NO: 446491 - RNA, 60 nt, Human
ucuguccacguggagagaaguugcccuccaggccgacaggaggccaugcccaccgccccu

SEQ ID NO: 446492 - RNA, 60 nt, Human
cucccaccacacuuacacacacgggacuguggccgacacccccuggccugugccaggcuc

SEQ ID NO: 446493 - RNA, 61 nt, Human
aaguuucuauaugugaaguuagugagucuuuuuguguuacuccaaaauaaaggcaaugauu

SEQ ID NO: 446494 - RNA, 61 nt, Human
uugcuuuucgaacaugguauaauagccuuguuuguguuagcaaaguggaaucuaucagcau

SEQ ID NO: 446495 - RNA, 61 nt, Human
ggcaaacgcuaaaugaaaaucgugacaacacuuguguuaugaagcauuuacuuuguguuca

SEQ ID NO: 446496 - RNA, 61 nt, Human
uuuugucaucuguaccagaucaguaguuggcuuguguuacauuuugugugugugugugcgu

SEQ ID NO: 446497 - RNA, 61 nt, Human
auuauuuuuuuaaaaagcguacuuuaaauguuuguguuaauaaauuaaaacaugcacaaaa

SEQ ID NO: 446498 - RNA, 61 nt, Human
auacucucuccacuuuauagcucuaauaaguuuguguuagaaaaguuucgacuuauuucuu

SEQ ID NO: 446499 - RNA, 61 nt, Human
uuguaucauugacuuaaaaugaagaauuaacuuguguuacaucuauaaagagcaaaauaac

SEQ ID NO: 446500 - RNA, 61 nt, Human
guuauuuauugaguauuguuugugcuaagcauuguguuagauuuaaaaaauuaguggauug

SEQ ID NO: 446501 - RNA, 61 nt, Human
uugauuuaaccuuaauuuuacagcccuuggcuuguguuaucggacauucuaaugcauauuu

SEQ ID NO: 446502 - RNA, 61 nt, Human
auuuugaaagauuaaaccuguacuguugguauuguguuaguguauggaccaauacugccug

SEQ ID NO: 446503 - RNA, 61 nt, Human
gaaggauuugcuuguuuaauauguacauuuuuuguguuaacagcuuuuugacacaauuacu

SEQ ID NO: 446504 - RNA, 61 nt, Human
gacugaugccuccacugcugugugccccauguuguguuaacaccugcguguggggacccca

SEQ ID NO: 446505 - RNA, 61 nt, Human
cagguagcacaaucuacuaauguugugugauuuguguuauacugguuguaauuaauuuuuu

SEQ ID NO: 446506 - RNA, 60 nt, Human
ugcucacugaaagggcugucaaccccagaaggccgacacaaaaaaaaugguaugugaaga

SEQ ID NO: 446507 - RNA, 60 nt, Human
caggcuuuucucaggagcuucaaugaguauggccgacagacauggacaaggagcuguguu

SEQ ID NO: 446508 - RNA, 60 nt, Human
ugggggaacgacacacacuucaccugcaagggccgacaacgcaggggacaccgugccggc

SEQ ID NO: 446509 - RNA, 60 nt, Human
guacaaaauuaugaauucauuuuuccuccaggccgacaaggaguuguagaaugaaaaugc

SEQ ID NO: 446510 - RNA, 61 nt, Human
gacuuugggcccagaaccaucuuucuauuguuuguguuagccuuacccugucccugcccca

SEQ ID NO: 446511 - RNA, 50 nt, Human
ugggguuugugaaacugugauuguguuauaaaaaguggcucccagcuugg

SEQ ID NO: 446512 - RNA, 61 nt, Human
guuuuuguuuucucuuccaagggccgucccguuguguuaggaagggugaguggcugguucc

SEQ ID NO: 446513 - RNA, 61 nt, Human
ugauggaagcaaacacuaauuucuaauaaaauuguguuaaacucaaugguacagagccaug

SEQ ID NO: 446514 - RNA, 61 nt, Human
uccagagauaucacuuaauuguuaacagcuuuuguguuaauccccuucagccccuagcucu

SEQ ID NO: 446515 - RNA, 61 nt, Human
gccucuuuccuccucaugaaagcagcacacauuguguuaacuuaugucucuuguuaaauga

SEQ ID NO: 446516 - RNA, 61 nt, Human
cauaaguagcugaaauaucuauucuguauuauuguguuaacauugagaauaagccuuggaa

SEQ ID NO: 446517 - RNA, 61 nt, Human
cuuuuuuuucuuuuuuucuuaaaaaaauauuuuguguuauuaacagaaauucauauuuggu

SEQ ID NO: 446518 - RNA, 61 nt, Human
aauccuguuguauuaacauuuaaaaacagaauuguguuaugugaucaguuuuggggguuaa

SEQ ID NO: 446519 - RNA, 61 nt, Human
cugucugauucuuucugacgaucacuuacauuuguguuaugcugauuagcagauauccaca

SEQ ID NO: 446520 - RNA, 61 nt, Human
ggacaguguuggccuuuggagucgggccuucuuguguuaaggggcacaagguccagaucac

SEQ ID NO: 446521 - RNA, 61 nt, Human
uuuacuuuuaaucaaugucagauaccaagaguuguguuaagcugaguguaguguguaacua

SEQ ID NO: 446522 - RNA, 61 nt, Human
uggggaccgguucccacaagccugccucgccuuguguuacgauauuucguuuggucuuagg

SEQ ID NO: 446523 - RNA, 60 nt, Human
ugcaggauuagcaagcccaccuggcuaccaggccgacagcuacauccuccaacugacccu

SEQ ID NO: 446524 - RNA, 60 nt, Human
ugagaugcuaggucugaccccacaaggccaggccgacauuccugagugaucacuaagaac

SEQ ID NO: 446525 - RNA, 60 nt, Human
ccagaacuaucuuuucaguugugaacuaaaggccgacaaagaugaucacuuuaaggugga

SEQ ID NO: 446526 - RNA, 64 nt, Human
acucagaagccucugggucagugguccacaucccgggacgcagcaggaggccaggccggcgagc

SEQ ID NO: 446527 - RNA, 61 nt, Human
aaucauugcaguuaagagaaauggaaauuaguuguguuaaucuugcagaauguuugcagga

SEQ ID NO: 446528 - RNA, 61 nt, Human
uccacacaccuucauuuugauguucggguuuuuguguuaaguuaaucuguacauucuguuu

SEQ ID NO: 446529 - RNA, 61 nt, Human
caugaacauuucccaugucauuauagcacuuuuguguuauauaauugcugcauuaauguua

SEQ ID NO: 446530 - RNA, 61 nt, Human
gucuguggaauuacuauguggaaauggaacuuuguguuaugcucuagacauuacaguuauu

SEQ ID NO: 446531 - RNA, 61 nt, Human
uguguuuugaauuugucagaucacacauauauuguguuauugggcgcugugguaucuuuua

SEQ ID NO: 446532 - RNA, 61 nt, Human
augguauuuuggcaguuuguauugaaucuguuuguguuauuaacagaagagggagaaaugu

SEQ ID NO: 446533 - RNA, 61 nt, Human
aacagaauggcagacuaaacacacauucccuuuguguuaauaauuuaguuuuaagacagua

SEQ ID NO: 446534 - RNA, 61 nt, Human
ugaccuucaauggauugaggcacuuuugcuuuuguguuaaauguagaugugcuaaaauaua

SEQ ID NO: 446535 - RNA, 61 nt, Human
gcccaguucuucucuguauagaaaggaaacauuguguuacuuaaugaauuauuuauacaga

SEQ ID NO: 446536 - RNA, 61 nt, Human
cuuuuaauauaauauuauauuuuauguaauauuguguuaaauuauauuguuuuauguaaua

SEQ ID NO: 446537 - RNA, 61 nt, Human
acggggucucgcaacauugcccagacuuccuuuguguuaguuaauaaagcuuucucaacug

SEQ ID NO: 446538 - RNA, 61 nt, Human
gugugcuagaaaacuuuugaggaauucuuauuuguguuagagcagaggaggucccagauac

SEQ ID NO: 446539 - RNA, 61 nt, Human
uucagaguuguacacuguguacauuuggcauuuguguuauuauuuugcacuguuuucuguc

SEQ ID NO: 446540 - RNA, 60 nt, Human
ccuucaggccccacagugcagcuucuccagggccgacagcugagggcugcucccugcauc

SEQ ID NO: 446541 - RNA, 60 nt, Human
uggggccguguccaaggugccaaugaugcgggccgacagagcgggccgcacugucugucu

SEQ ID NO: 446542 - RNA, 60 nt, Human
gcuggccaacaaggcggugcagcggggcucggccgacaacgucacugugaugguggugcg

SEQ ID NO: 446543 - RNA, 60 nt, Human
gucacccaccuaugugccagagucaggccuggccgacacaaggaucuaugcuuuuucugu

SEQ ID NO: 446544 - RNA, 61 nt, Human
uaaaaccuagaguuggaguuggaucucuggauuguguuaugucaguguugguagguuagga

SEQ ID NO: 446545 - RNA, 61 nt, Human
cuggaacuugucuuugugcauucguugcuguuuguguuacccucacuguccccauguccca

SEQ ID NO: 446546 - RNA, 61 nt, Human
ugagagacugagucauaacugauuuaaaaguuuguguuaucagguaucuuauuugaacaug

SEQ ID NO: 446547 - RNA, 61 nt, Human
uguaccauuauuauugacuauagucaccugguuguguuaucaaauaguaugucuuauucau

SEQ ID NO: 446548 - RNA, 61 nt, Human
caaauacacaucagcuauagcacaaauauacuuguguuacaagaaaggaauuaguaaucug

SEQ ID NO: 446549 - RNA, 61 nt, Human
gaggagaugaauccuuaauaauaaguaaaucuuguguuauccuauagucugguuuuccaaa

SEQ ID NO: 446550 - RNA, 61 nt, Human
ucucagacagccugccaccuauugcccugauuuguguuauaauaaaggccuuguugcuuaa

SEQ ID NO: 446551 - RNA, 61 nt, Human
ugccucgggcccuggcccuucgcuuccucucuuguguuauggaaauaaaaacaaauaaaac

SEQ ID NO: 446552 - RNA, 61 nt, Human
agagauucuucauuaucuucaugguguuuuguuguguuacuguaauaucacuuaugaaauc

SEQ ID NO: 446553 - RNA, 61 nt, Human
cuaauuucaaaacggguccauuagggcuucguuguguuaacaaguugacaccaugacuagu

SEQ ID NO: 446554 - RNA, 61 nt, Human
cugaagcagcagcgaauggcaauggguuguguuguguuaaugaagacucaauugguucaua

SEQ ID NO: 446555 - RNA, 61 nt, Human
accuaugaauauaacaaauauggaaguaaaauuguguuaguuuuuuaugaguguugcacca

SEQ ID NO: 446556 - RNA, 61 nt, Human
gauuagcuccugcauuucuuugguucuaaguuuguguuauuucagaauaacuaaaguacuu

SEQ ID NO: 446557 - RNA, 64 nt, Human
acagcucuggauucuggaucucuccugcuguaaccccacgcacaagccugcaacccccagagcu

SEQ ID NO: 446558 - RNA, 64 nt, Human
ggaucuggcuuggggugcccggcccucaucccugcccacgcagugagugcucaugugucuuggc

SEQ ID NO: 446559 - RNA, 64 nt, Human
ccgcaggaggaaguuccacggcagguggugcguucccacgcaggcaccaaguggaagcuugcac

SEQ ID NO: 446560 - RNA, 64 nt, Human
uauauagggauggcagagaguucccaucucaucugucagccacagucauuugguacuggcuacc

SEQ ID NO: 446561 - RNA, 61 nt, Human
cugccucucccucccuguuugaaucugcagauuguguuaggcccccagcugagggccugga

SEQ ID NO: 446562 - RNA, 61 nt, Human
uucuauauuuaacuggaaauaugcuuugauuuuguguuauuaauauaauucuuuugaugua

SEQ ID NO: 446563 - RNA, 61 nt, Human
ucaucaggcacacaacuucuguuuccuucucuuguguuaucugauagcgucccuccuugag

SEQ ID NO: 446564 - RNA, 61 nt, Human
uacaaccuauuuguaccuuuugagacaauauuuguguuacuuuugcagguuacgguuccac

SEQ ID NO: 446565 - RNA, 61 nt, Human
ggugauugacagagaggacucgugcgcuguuuuguguuagcagaggauuuguguuucacag

SEQ ID NO: 446566 - RNA, 61 nt, Human
ggccaagcagaacugcuguaccucugaccacuuguguuaggaaaacuaucggcucccugua

SEQ ID NO: 446567 - RNA, 61 nt, Human
uuauuggaaaugugaauaaguaaagaauuacuuguguuacuugccaagcagugcacauuuc

SEQ ID NO: 446568 - RNA, 61 nt, Human
gucaaaccaaaaugucaguauuuuuagggcauuguguuaaaauaagcaguuuagauuccga

SEQ ID NO: 446569 - RNA, 61 nt, Human
ugucauauuuucuagagaaacuugaauuuaauuguguuauucuuagcuuccacuggcagcc

SEQ ID NO: 446570 - RNA, 61 nt, Human
agugcguuuucuguuuucauuuaauucaguuuuguguuaaggguggaacaaagcucuguuc

SEQ ID NO: 446571 - RNA, 61 nt, Human
guacagaauaauugugcuugcuuuuucaggauuguguuacuaucacuaaguagcaaauugc

SEQ ID NO: 446572 - RNA, 61 nt, Human
cgcugccacccacaaacagacacacaugccguuguguuaugcccagccacucugauauacu

SEQ ID NO: 446573 - RNA, 61 nt, Human
guuucuguauacagcuguguugcuuuugauguuguguuacuguacacagaagugugugcac

SEQ ID NO: 446574 - RNA, 64 nt, Human
cguggcacgcacgcacgcacccacccacgcgcacuuacacgagaagacauucauggcuuugggc

SEQ ID NO: 446575 - RNA, 64 nt, Human
ugaaguacaauaauucauauucuucauauccuucuuacacgacuaaguugaauuaguaaaguua

SEQ ID NO: 446576 - RNA, 64 nt, Human
uuaccauuguucuuaucccaugggaagcaguugguuacacgauucuuauuuuauaagaaacagc

SEQ ID NO: 446577 - RNA, 64 nt, Human
uauguacaaauuguaaagaauauguauaaauguuuuacacgaauguaagagcauguagaagcca

SEQ ID NO: 446578 - RNA, 61 nt, Human
uuugauauaugaaaaccuauucuggucuaaauuguguuacuagccucaaaauacaucaaaa

SEQ ID NO: 446579 - RNA, 61 nt, Human
ugucucuuucugacauaguaaucccaaaggauuguguuacuccccgugaaaguuauuacuu

SEQ ID NO: 446580 - RNA, 61 nt, Human
gugcaaaaaaagaaaaagaacuguugguuauuuguguuauucuggauguauaaaaaucaau

SEQ ID NO: 446581 - RNA, 61 nt, Human
uaaugaaaacaugugcugaauguuguggauuuuguguuauaauuuacuuuguccaggaacu

SEQ ID NO: 446582 - RNA, 61 nt, Human
uucagaacuaugaugcuuuucuucucagaacuuguguuaaguagauaguaaacagauugau

SEQ ID NO: 446583 - RNA, 61 nt, Human
uuaagaaaguaauaccaauuuagacucuaguuuguguuacgagguauucuuucaaauuuuu

SEQ ID NO: 446584 - RNA, 61 nt, Human
uuuuaagguauuuuaccucaaaaaugaaucauuguguuaggauucuaauucuuuauaaaga

SEQ ID NO: 446585 - RNA, 61 nt, Human
aaaaucauuguuaauugcugaggcaugaaaauuguguuacuauaaugccuuauuuuaccuc

SEQ ID NO: 446586 - RNA, 61 nt, Human
uggguuuucuaagccacucucuggaaucucuuuguguuagggucucgauuugaggacauuc

SEQ ID NO: 446587 - RNA, 61 nt, Human
cagugaccucgacguugccuuuagacuacaguuguguuagccucuugcguauuggcuuuuu

SEQ ID NO: 446588 - RNA, 61 nt, Human
gaaaauauggccauuuuucauaaaauguuauuuguguuagcauguaauggguuuacuaugu

SEQ ID NO: 446589 - RNA, 61 nt, Human
gguaucaauucaucuauucaacagauauuuauuguguuauuacuaugagucaggcucuguu

SEQ ID NO: 446590 - RNA, 52 nt, Human
uccagaagccuaaauuuugauguuguguuacuugucaagaaagaagcaaugu

SEQ ID NO: 446591 - RNA, 64 nt, Human
gcaggaauccagauccuguggaaggcccuugguguuacacgauggaucccaaagucagauggga

SEQ ID NO: 446592 - RNA, 64 nt, Human
cuacacacagaacgccgagaagauaaaccaagcuuuacacgagcaggauggggaugggaaaacu

SEQ ID NO: 446593 - RNA, 64 nt, Human
uuacugaaaaaggugauuacuccugaagugaguuuuacacgaacugaaaugagcaugcauuuuc

SEQ ID NO: 446594 - RNA, 64 nt, Human
cagugugaaaauuugcucggguguguagcaguaauuacacgaggcaaacaguuccaaaacuguu

SEQ ID NO: 446595 - RNA, 61 nt, Human
ugauauuuuguuuuuccccaauuaauugcuauuguguuauuuuacuacuucucucuguauu

SEQ ID NO: 446596 - RNA, 61 nt, Human
uuucauuuuaguguaucuuuaaaaaaaaaucuuguguuaacuugccuccaucuuuuucuug

SEQ ID NO: 446597 - RNA, 61 nt, Human
auauagaacaaauucagggauuuuuaaaaaauuguguuacuacugauauaugcuaguuuua

SEQ ID NO: 446598 - RNA, 61 nt, Human
uuauaccaagcauaaaguacaccuaauaacguuguguuaaaaaaguguuugaagaaaaagg

SEQ ID NO: 446599 - RNA, 61 nt, Human
gguuguucauaauauuaaaaaucuuacguaguuguguuaaacugaaccaguucauuauacc

SEQ ID NO: 446600 - RNA, 61 nt, Human
agagaugaggaggaguucauugcuucccagcuuguguuauauggcuacagcaagucuucag

SEQ ID NO: 446601 - RNA, 61 nt, Human
cagaaguuuaaaucuuuguuaaaauauaguguuguguuacaauaaguguuggccaucauuu

SEQ ID NO: 446602 - RNA, 61 nt, Human
acaguggggugguucaaaguuauuucuauguuuguguuaccauguuaacuuuuccccgaga

SEQ ID NO: 446603 - RNA, 50 nt, Human
agcacaugagaaaaagauaauuguguuagugcaaagaccaaggagaaaca

SEQ ID NO: 446604 - RNA, 61 nt, Human
uuaccgaguauagccacuggguaucacuacuuuguguuaaagugccuucgcacuuuaagua

SEQ ID NO: 446605 - RNA, 61 nt, Human
ccaagcuccaaccacagagaguuugacaaguuuguguuaugauguuggcuuggcuuuguau

SEQ ID NO: 446606 - RNA, 61 nt, Human
gucaugcugcagaauauguuauacccuuauuuuguguuaaggauauauuuuauuaugugaa

SEQ ID NO: 446607 - RNA, 61 nt, Human
auaaguuugcaacuaaucucaugcugcaaacuuguguuaauucuguuuaauauacaaauuu

SEQ ID NO: 446608 - RNA, 60 nt, Human
agggcagaggccaugaagaagugcuuccguggccgacagucuggaaaugaauccaucaua

SEQ ID NO: 446609 - RNA, 59 nt, Human
gacgggagucagagaucugagccaaccuuggccgacaugcagcauccacccccggcugg

SEQ ID NO: 446610 - RNA, 60 nt, Human
cacaaacacacacacacuggacaguagaugggccgacacacacuuggcccgaguuccucc

SEQ ID NO: 446611 - RNA, 60 nt, Human
gcuggagguagaggagcuauguggagcaaaggccgacagaggggaaggaauggaccugug

SEQ ID NO: 446612 - RNA, 61 nt, Human
cuguuguuuuugucccugucuuuuucuuauguuguguuacuaauguaauuuauauuuuuuu

SEQ ID NO: 446613 - RNA, 61 nt, Human
cuagugaaauauugugcuuaauuuuuuucuauuguguuauucaugaaaauauuuaauauuc

SEQ ID NO: 446614 - RNA, 61 nt, Human
aagcguuacaaaaucaguucuuuccuugguuuuguguuaguguuggugguauuuuauuguu

SEQ ID NO: 446615 - RNA, 61 nt, Human
uacccaauccaauuuuagcacucaaguuccauuguguuaauuucugcacggucaacaaaca

SEQ ID NO: 446616 - RNA, 61 nt, Human
agugaaucucagauagaaauuaaaagugcaguuguguuaagacucuuucauacuacccuuu

SEQ ID NO: 446617 - RNA, 61 nt, Human
uugcuuucuuuucuauugagucugggcuuguuuguguuacugcauacugugauuagcauaa

SEQ ID NO: 446618 - RNA, 61 nt, Human
caguggaaaagcuuguuacagaaaaaacauuuuguguuauugcuguggugugcaugauuug

SEQ ID NO: 446619 - RNA, 61 nt, Human
uuaccgaaccuaaaacccacaaagagguuguuuguguuauuguucaaucuucaguuguaag

SEQ ID NO: 446620 - RNA, 61 nt, Human
guucacccuggcuuuaccucugguuaaugcuuuguguuaauaggaaggaaaaaucacuuua

SEQ ID NO: 446621 - RNA, 61 nt, Human
auaacuacccaaggacuacuaaaaggaaaaauuguguuacuuuuuuuaaauucccuguuaa

SEQ ID NO: 446622 - RNA, 61 nt, Human
auauggcacauuugauucuuccacauauauuuuguguuaauguuuagguaugauuuuuuuc

SEQ ID NO: 446623 - RNA, 61 nt, Human
ccauggaggguaguucccucguguggagcacuuguguuaggaucacugauuaucugacaaa

SEQ ID NO: 446624 - RNA, 61 nt, Human
uucuaucagcuccaaaaugugugaacuugacuuguguuagaguauauucugaaaccaacuu

SEQ ID NO: 446625 - RNA, 64 nt, Human
caagaaagcucacuguagcuuuuaggaauaacuuuuacacgaccauuugauagggaacugggga

SEQ ID NO: 446626 - RNA, 64 nt, Human
aaagcccaaagcuuucccaaacauuauucaaugguuacacgacgaaguagcuuuugaauaaugu

SEQ ID NO: 446627 - RNA, 64 nt, Human
gaagcaauuuugugaagaacagaacacuggaauauuacacgaugagauucugauucaugaagaa

SEQ ID NO: 446628 - RNA, 64 nt, Human
uuggcauugguguccauggcccuauaccgccaucuuacacgaaagccacagaguugaaagccac

SEQ ID NO: 446629 - RNA, 63 nt, Human
gagauggcaugugaaagcacuuugaaaauuguaaagcgcuauguaaauguaagguauuauaga

SEQ ID NO: 446630 - RNA, 63 nt, Human
ggugcuguguuuugguuguggucugaagcuuugaagcgcuacuuagcaucuccuuucuuccau

SEQ ID NO: 446631 - RNA, 63 nt, Human
guggacgccgacccuguuguggacagcucucagaagcgcuaccgggccgccagugccuucuuc

SEQ ID NO: 446632 - RNA, 63 nt, Human
cccccuccacacacaaaacaggaaacauaaucaaagcgcuagucagcuagucuaaccacuagg

SEQ ID NO: 446633 - RNA, 63 nt, Human
uauuaauuuugccuuuuuuuuuuuuuuuuuuuuaagcgcuacuaauguagagaaugaauugaa

SEQ ID NO: 446634 - RNA, 63 nt, Human
acagaaauuuggguaauguuugaguagauugccaagcgcuacugugauucaugaaugaauuuc

SEQ ID NO: 446635 - RNA, 63 nt, Human
ucaaucucuuuguguucagaacucguuaaagcaaagcgcuaaguaaaaauauuaacugacgaa

SEQ ID NO: 446636 - RNA, 63 nt, Human
acacuuauuacccuucugcagcaaaggcauuaaaagcgcuaagcauauauuaauaaaugcaag

SEQ ID NO: 446637 - RNA, 63 nt, Human
aucucccaugaagaaagggaacggugaaguacuaagcgcuagaggaagcagccaagucgguua

SEQ ID NO: 446638 - RNA, 63 nt, Human
auaaaggacucagcaaccagccagggacagauaaagcgcuauggaaaggggcuuccaaguucu

SEQ ID NO: 446639 - RNA, 63 nt, Human
uaaauguuuacaauuuuauaugaaagauggaauaagcgcuagagcuuccaacuguauauuuuu

SEQ ID NO: 446640 - RNA, 63 nt, Human
caccagcuccaaguaaacuaguuaccuggguaaaagcgcuaacgacccaaaggcucuucuaag

SEQ ID NO: 446641 - RNA, 63 nt, Human
acuaaagaaagcuuguuggaaugcagucuacaaaagcgcuauaagggcuaaaggauuauagua

SEQ ID NO: 446642 - RNA, 63 nt, Human
uagcaucagcaauagauuucaaagauaaguauuaagcgcuacccuaaaguguguaaguuuuuc

SEQ ID NO: 446643 - RNA, 63 nt, Human
ggccugcggagccucaagaagccagaccgcaagaagcgcuacaccguggugggcaaccccuac

SEQ ID NO: 446644 - RNA, 64 nt, Human
gaagaguaguucuuguuuguuacaaccuuugugagucagccaugcccgcaaagcgugcuguguu

SEQ ID NO: 446645 - RNA, 64 nt, Human
agaucuuaagcaucuggugacaucagaacucugugucagccacuuuuauuuguauauugaaccc

SEQ ID NO: 446646 - RNA, 64 nt, Human
gaguagaugccugaggccacaucugaacagaccugucagccaggccugccaggucuucacguug

SEQ ID NO: 446647 - RNA, 63 nt, Human
uuucugcaaauguaauugauuuauuuguuuaaaaagcgcuaauuucuauuugaucugauauca

SEQ ID NO: 446648 - RNA, 63 nt, Human
uuuugcucuugauuuaaaaaaaaguuuuguugaaagcgcuauugaauauugcaaucuauauag

SEQ ID NO: 446649 - RNA, 63 nt, Human
cacaccgcuucauugaugaggacaggagacuccaagcgcuaguauugcacgcugcacuuaaug

SEQ ID NO: 446650 - RNA, 63 nt, Human
cagaaagaugucaacaaggaaaagaggagagccaagcgcuagcaugccuuuugccucugcaua

SEQ ID NO: 446651 - RNA, 63 nt, Human
uuuuuguuuugucuuucuaccugauguguauucaagcgcuauaacacguauuuccuugacaaa

SEQ ID NO: 446652 - RNA, 63 nt, Human
ucaggcuuuuaaaaaaauaccacugugagaauaaagcgcuagcaagauacaucacuuacugau

SEQ ID NO: 446653 - RNA, 63 nt, Human
gacuccgaguucuauaaaaaccucaccuccaucaagcgcuaugauggggacaucacugaccug

SEQ ID NO: 446654 - RNA, 63 nt, Human
ggcuucaagagauccacccaccucagccucccaaagcgcuaggauuacaaguaugagacuuug

SEQ ID NO: 446655 - RNA, 63 nt, Human
uuuauaaagaacgugauuuccagugaucucuggaagcgcuaaagcuaaaauuucuguucuuga

SEQ ID NO: 446656 - RNA, 63 nt, Human
uguaagaacuguuaauaaaaguugucaaguaaaaagcgcuauaucuaaaaagacuuuaugaac

SEQ ID NO: 446657 - RNA, 63 nt, Human
cugcccaugaccugaaggcuccagguggcuuuaaagcgcuauguuuaccaacuaucccggugu

SEQ ID NO: 446658 - RNA, 63 nt, Human
gaaaacgugcuuuucggcaaagcccugaaccccaagcgcuaccagcagacucuggaggccugu

SEQ ID NO: 446659 - RNA, 63 nt, Human
uggccucaggaaucaacuuaggcaguucccaacaagcgcuagccuguaauuguagcuuuccac

SEQ ID NO: 446660 - RNA, 63 nt, Human
ccuuuucaauucccuucugguucaugaugcauaaagcgcuaggcccuagaacuccagaaacag

SEQ ID NO: 446661 - RNA, 63 nt, Human
agucuuaagcaaucuuccugcuuuggccucccaaagcgcuaggauuccaggugugagcuacug

SEQ ID NO: 446662 - RNA, 64 nt, Human
uguuaagucauguucucaugcucagaucaguagugucagccagagcuuucucugcagacaugua

SEQ ID NO: 446663 - RNA, 64 nt, Human
ucccacaaacugcugguggaggaagaagauguucgucagccaauucaaccuccagccagcuucu

SEQ ID NO: 446664 - RNA, 64 nt, Human
gcaacaaguagaauggggcauguugugucauguagucagccacuuaugcaccaaugugaggaaa

SEQ ID NO: 446665 - RNA, 63 nt, Human
gggaguggggagggcguggagacagucuacggaaagcgcuagcagacccccgagagggugcag

SEQ ID NO: 446666 - RNA, 63 nt, Human
aauuguguccacauaauccacgcucaucuugcaaagcgcuauuucaggcacaucauuggaaua

SEQ ID NO: 446667 - RNA, 63 nt, Human
acccagcgcgcagucuccaccucggccccagcaaagcgcuaagcagccggagagacagccagg

SEQ ID NO: 446668 - RNA, 63 nt, Human
gugacugugcccauuccugcauggaccuuucccaagcgcuagcacaggugcaaaauccaucag

SEQ ID NO: 446669 - RNA, 63 nt, Human
gggcucaugcaauccuccugccuuggccucccaaagcgcuaggauuagaggugugagccgcug

SEQ ID NO: 446670 - RNA, 64 nt, Human
cgaguagcugggauuacaggcaugugccaccacgcccggcuaauguuuguauuuuuaguagaga

SEQ ID NO: 446671 - RNA, 64 nt, Human
ggaguagcugagacuacaggcgcccaccaccaugcccggcuaauuuuguuuguauuuuuaguag

SEQ ID NO: 446672 - RNA, 64 nt, Human
caaagugcugggauuacaggugugagccaccacgcccggcuauguuuuuuuuuuuuuuuuuuuu

SEQ ID NO: 446673 - RNA, 64 nt, Human
ugaguaacuggaauuacaggugcacgccaccacgcccggcuaauuuuuguguuuuuagcagaga

SEQ ID NO: 446674 - RNA, 64 nt, Human
caaguagcugggauuacaggcacccacgagcaugcccggcuaauuuuuuguauuuucaguagag

SEQ ID NO: 446675 - RNA, 64 nt, Human
ugaguagcugggauuacaggugugcaccaacacacccggcuaauuuuuguauuuguagaagagg

SEQ ID NO: 446676 - RNA, 64 nt, Human
ccaguagaugggacuacaggcaccugccaacacgcccggcuaauuuuuuuguauuuuuaguaga

SEQ ID NO: 446677 - RNA, 64 nt, Human
agaguagcugggacuacaggugcccgccaccacacccggcuaauuuuuuguguuuuuacaaaau

SEQ ID NO: 446678 - RNA, 64 nt, Human
augggccggaaacgaaaagaacauggucaucaugcccggcuacugcgugcagggcaccgucggc

SEQ ID NO: 446679 - RNA, 64 nt, Human
cccucggaagccgucugacuccagagucugagcccccggcuaguacccuauagagagggggcuc

SEQ ID NO: 446680 - RNA, 64 nt, Human
agaguagcugggacuauagacaugcaccaccacgcccggcuaauuuuguauuuuuggucgagac

SEQ ID NO: 446681 - RNA, 64 nt, Human
ccgggcagguccugcccauguguccccucacucugucagccagccgcccugggcugucugucac

SEQ ID NO: 446682 - RNA, 64 nt, Human
gucgaggugagaggugaugugguauucagugcccgucagccaacugugggccuucaccucuacc

SEQ ID NO: 446683 - RNA, 64 nt, Human
aguucucccccaacaggaaacuuguuuuuuuaacgucagccagauauuuagaaaauaaccucaa

SEQ ID NO: 446684 - RNA, 64 nt, Human
aaauuagccaggcaugguggcaggugccuguaaucccggcuauucagaaggccgaggugggaga

SEQ ID NO: 446685 - RNA, 64 nt, Human
cgaguagcugggauuacaggcaccugccaccaugcccggcuaauuuuuguauuuuaguagagau

SEQ ID NO: 446686 - RNA, 64 nt, Human
ucugcggugucagggcgagaacccaucuuccaaccccggcuauuuggagacggaaaaacuggaa

SEQ ID NO: 446687 - RNA, 64 nt, Human
cgaguagcugagauuauaggcaccuaccaccacgcccggcuaauuuuuguauuuuuaguagaga

SEQ ID NO: 446688 - RNA, 64 nt, Human
ugaguagcugggauuacaggcuccugccaccacgcccggcuaauuuuuguuuuguuuuguuugg

SEQ ID NO: 446689 - RNA, 64 nt, Human
caaguagcuggaauuacagccaugcggcaccauucccggcuaauuuuuguauuuuugguagaga

SEQ ID NO: 446690 - RNA, 64 nt, Human
agcaggaagaauaaagccaccaacuuuuaccuagcccggcuaaucauggaaguguguccaggcu

SEQ ID NO: 446691 - RNA, 64 nt, Human
cgaguagcugggauuacaggcacacaccaccacgcccggcuaauuuuuugugucuuuuuaguag

SEQ ID NO: 446692 - RNA, 64 nt, Human
cuaguagcugggauuacaggcgcccgccaccaugcccggcuaauuuuguauuuuuaguagagac

SEQ ID NO: 446693 - RNA, 64 nt, Human
cgaguagcugggacuacaggcgcccaccaccacgcccggcuaauuuuuuguauuuuuuaguaga

SEQ ID NO: 446694 - RNA, 64 nt, Human
cugcagggacugccagucccccugccccagggcucccggcuaugggggcacugaggaccagcca

SEQ ID NO: 446695 - RNA, 64 nt, Human
ccguccgggagggaggugggggaucagccccccgcccggcuagccgccccguccgggaggcgag

SEQ ID NO: 446696 - RNA, 64 nt, Human
cgaguagccgggacuacaggcgcccaccaccgugcccggcuaauuuaguuguauuuuuaguaga

SEQ ID NO: 446697 - RNA, 64 nt, Human
ugaguagcugggauuacaggcaacugccaccaugcccggcuaauuuuuguauuuuuaguagaga

SEQ ID NO: 446698 - RNA, 64 nt, Human
cugguagcugggauaacaggcaugugccagcacgcccggcuaauuuuuuauuuuuaguagagac

SEQ ID NO: 446699 - RNA, 64 nt, Human
cgaguaccugggauuacaggcaugugccaccacgcccggcuaauuuuguauuuuuaguagagac

SEQ ID NO: 446700 - RNA, 64 nt, Human
gcuccgccucugcugauuggcugccacggugggagucagccaagauuuaaagggaugccagcga

SEQ ID NO: 446701 - RNA, 64 nt, Human
ggcagggucaagaagauaaguaauaaaagaggaagucagccaggcgcgguggcucaugccugua

SEQ ID NO: 446702 - RNA, 64 nt, Human
cgccucggccucccaaagugcugggauuacaggcgucagccaccgcgccuggccuauaccagua

SEQ ID NO: 446703 - RNA, 64 nt, Human
acccacuacugccaaagaacccagcaacaaaccucccggcuaggagcuuuagaagucuuuaugu

SEQ ID NO: 446704 - RNA, 64 nt, Human
cgaguagcugggaccacaggggcccaccaccgcgcccggcuaauuuuuuguauuuuuaguagag

SEQ ID NO: 446705 - RNA, 64 nt, Human
cgaguagcugggacuacaggcgcccaccaccaugcccggcuaauuuuuguuuuuguauuuuuag

SEQ ID NO: 446706 - RNA, 64 nt, Human
ugaguagcugggauuacaggugugugccuccacacccggcuaauuuuuuguauuuuuaguagag

SEQ ID NO: 446707 - RNA, 64 nt, Human
cgaguagcugggauuacaggugugugccaccacacccggcuaauuuuuguauuuuuaguagaga

SEQ ID NO: 446708 - RNA, 64 nt, Human
ccggggaccuggagccccauggacacacagauggcccggcuagccgccuggacugcaggggggc

SEQ ID NO: 446709 - RNA, 64 nt, Human
ugaguagcugggauuauaggugcgcaccaccacacccggcuaguuucuguauuuuuaguagaga

SEQ ID NO: 446710 - RNA, 64 nt, Human
caguuguggucgccccuccccaguugugcauguacccggcuacuuagguaugcuuaggggagcu

SEQ ID NO: 446711 - RNA, 64 nt, Human
caaguaggugggacuacaggugcccgccaccacacccggcuaauuuuugcauuuuuaguaauga

SEQ ID NO: 446712 - RNA, 64 nt, Human
ugaguagcugggacuacaggcgcccgccaccacgcccggcuaauuuuuuauuuggauuuuuagu

SEQ ID NO: 446713 - RNA, 64 nt, Human
ugaguagcugggauuagaggcgugugccacuacacccggcuaauuuuuguacuuuuuaaaguag

SEQ ID NO: 446714 - RNA, 64 nt, Human
caaguagcugggacuacaggugugugucaccacgcccggcuaauuuuuguauuuuuaguagaga

SEQ ID NO: 446715 - RNA, 64 nt, Human
cgaguaccugggacuacaggcaugugccacaguucccggcuaauuuuuguauuuuuaguagaga

SEQ ID NO: 446716 - RNA, 64 nt, Human
ugaguagcugggacuacaggcgcccgccaccacacccggcuaauuuuuuguauuuuuuguagag

SEQ ID NO: 446717 - RNA, 64 nt, Human
cgggcggaucacgaggucaggagaucgagaccaucccggcuaaaacggugaaaccccgucucua

SEQ ID NO: 446718 - RNA, 64 nt, Human
aaacuagccaggugugguucuccaugccuauaaucccggcuacucgggaggcugaggcaggaga

SEQ ID NO: 446719 - RNA, 64 nt, Human
gccacaaacauuacugagcccaaaagaucaaggagucagccaggacccuguggacauaaagaag

SEQ ID NO: 446720 - RNA, 64 nt, Human
ucccuccuuuuucuaguaaaagacccgugaucccgucagccacccagucugagaugcugacguu

SEQ ID NO: 446721 - RNA, 64 nt, Human
ucuaucaaauuacugaagaucucaucaugcaugugucagccacagcgaaucccaugucuugguu

SEQ ID NO: 446722 - RNA, 64 nt, Human
caaguagcugggacuacaggcgugcgccaccaugcccggcuacuucuuguauuuuuuguagaga

SEQ ID NO: 446723 - RNA, 64 nt, Human
ccaaguagcuuggacuacaggcccugccaccacgcccggcuaauuuguguauuuuuaguagaga

SEQ ID NO: 446724 - RNA, 64 nt, Human
uggguggaucacgaggucaggagaucgagaccaucccggcuaacauggugaaacccugccucua

SEQ ID NO: 446725 - RNA, 64 nt, Human
ugagaagcugggacuacaggcgcccgccaccacgcccggcuaauuuuuuuguauuuuuaguaga

SEQ ID NO: 446726 - RNA, 64 nt, Human
ugaguagcuggaacuacaggcgugugccaccacacccggcuaauuuuucguauuuuuaguguag

SEQ ID NO: 446727 - RNA, 64 nt, Human
cccaaguagcuaggaccaggugcgcgccaccacgcccggcuaauuuuuguauuuuguauuuuua

SEQ ID NO: 446728 - RNA, 64 nt, Human
auguuaccuacaaagacaugccugggguaagccacccggcuaccuaauuccucaguaaccucca

SEQ ID NO: 446729 - RNA, 64 nt, Human
cagguagcugggacuauaggcacgugccaccacacccggcuaauuuuuuguauuuuuaguagag

SEQ ID NO: 446730 - RNA, 64 nt, Human
caaagugcugggauuacaggcuugagccaccgcgcccggcuauauuuuaucuuuuaucuuuuuc

SEQ ID NO: 446731 - RNA, 64 nt, Human
cgaguagcugggacuacaggcgcccgccaccacgcccggcuaauuuuuuguauuuuuaguagag

SEQ ID NO: 446732 - RNA, 64 nt, Human
cgaguagcugggacuacaggggcccgccaccacgcccggcuaacuuuuuguguuuuuaguagag

SEQ ID NO: 446733 - RNA, 64 nt, Human
cccgugggugugaggccgggguaggaccaggcuucccggcuaggcacgccuggcuggcugccuc

SEQ ID NO: 446734 - RNA, 64 nt, Human
gagaugggcauaauaccaagcugggguggcaccacccggcuaguugaaauaaucggaaguagac

SEQ ID NO: 446735 - RNA, 64 nt, Human
ugaauagcugggguuacaggugcgcaccaccacgcccggcuaauuuuuguauuuuuaguagaga

SEQ ID NO: 446736 - RNA, 64 nt, Human
cguguagcugggacuacaggcacgcgccaccaugcccggcuaauuuuuguauuuuuaguagaga

SEQ ID NO: 446737 - RNA, 64 nt, Human
ugaguagcugggacuacaggugugcaccaccacgcccggcuaauuuuuguauuuuuaguagaga

SEQ ID NO: 446738 - RNA, 64 nt, Human
caacaaccaaaauuauuaagcucugugcgaggcugucagccacacuagguaucagggaucccga

SEQ ID NO: 446739 - RNA, 64 nt, Human
acugccaccacuggcggccugggaccagcugggugucagccacggaugagccgaauagccaguc

SEQ ID NO: 446740 - RNA, 64 nt, Human
uuuuuuuuaauuauuugagauggaaucuugcuuugucagccaggcuggagugcagugacacgau

SEQ ID NO: 446741 - RNA, 64 nt, Human
ccagcagcugggacuacaggcacacaucgccacacccggcuaauuuuuaguauuuuuaguagag

SEQ ID NO: 446742 - RNA, 64 nt, Human
cgaguagcugggauuauaggcgagugccaucaugcccggcuaauuuuuguauuuuuaguagagu

SEQ ID NO: 446743 - RNA, 64 nt, Human
cgagcagcugggacuacaggcaugcgccaccaugcccggcuaauuuuuguauuaguagagauga

SEQ ID NO: 446744 - RNA, 64 nt, Human
cgaauagcugggacuacaggcgcacaccaccauccccggcuaauuuuuguauuuuuuguagaga

SEQ ID NO: 446745 - RNA, 64 nt, Human
caaguagcugggacuacaggugcccgccaccgugcccggcuaauuuuuuuguauuuuuaguaga

SEQ ID NO: 446746 - RNA, 64 nt, Human
ucuuuagcugggacuacaggcgcacgccaccacgcccggcuaauuuuuguauuuuaguagagau

SEQ ID NO: 446747 - RNA, 64 nt, Human
caaagugcugggauuacagaugugagccauggugcccggcuacucuuaaugauguauugacauc

SEQ ID NO: 446748 - RNA, 64 nt, Human
uucaggugugacucuagcaaggcucaucuuucugcccggcuacaucagccuucaagaaucagaa

SEQ ID NO: 446749 - RNA, 64 nt, Human
agaguagcuaggauuacagauacgugccaccauacccggcuaauuuuuauauuuuuagagacag

SEQ ID NO: 446750 - RNA, 64 nt, Human
ugaguggcugggauuacaggcacaugccaccacacccggcuaauuuuuguauuuuuaguagaga

SEQ ID NO: 446751 - RNA, 64 nt, Human
ccaccuccagcacugccugaggcccaucugcuuccccggcuaugugcccaacuccgcggugcua

SEQ ID NO: 446752 - RNA, 64 nt, Human
caaauagcugggaccacaggugugcaccaccacgcccggcuaauuuuuuguauuuugucuagau

SEQ ID NO: 446753 - RNA, 64 nt, Human
gccuggaaacagagguaaaaaaaagaagugugcgcccggcuaaugcagcgguguggaccgagga

SEQ ID NO: 446754 - RNA, 64 nt, Human
cgaguagcuaggacuacaggcgcaugucaccaagcccggcuaauuuuuguauuuuuaguagaaa

SEQ ID NO: 446755 - RNA, 64 nt, Human
gaccucccacauguacaguuccccugccucuugccccggcuaguuucccuggagagaggccuag

SEQ ID NO: 446756 - RNA, 64 nt, Human
ugaguagcugggauuauaggcgucugccaccacgcccggcuaauuucuguauuuuuaguagaga

SEQ ID NO: 446757 - RNA, 64 nt, Human
aaggcggggggugcccaagcccagcccugugcccccgcugaaccuggcuggaccgcgugugaaa

SEQ ID NO: 446758 - RNA, 64 nt, Human
gaggcaaggaaaagccccacaaaauuccuguuacccgcugaacuccaagcucaccaaccagauu

SEQ ID NO: 446759 - RNA, 55 nt, Human
gucggcccgugucuccgcaggcgcuccgcugaaggggcaggggcuaggcugggag

SEQ ID NO: 446760 - RNA, 64 nt, Human
auuguagcguuuggguccuuuuaccccuaugucccccggcuauacuuuuaaaacagcuuuagcu

SEQ ID NO: 446761 - RNA, 64 nt, Human
caaauagcugugauuacaggcgugcaccaccacgcccggcuaauguuuguauuuuuaguagaga

SEQ ID NO: 446762 - RNA, 64 nt, Human
aaauuagccgggcgugguggcacacaccuguagucccggcuacucgggaggcugaggcaggaga

SEQ ID NO: 446763 - RNA, 64 nt, Human
cgaguaggugggauuauaggagcgugccaccaugcccggcuacuuuuuguauuuuuaguagaga

SEQ ID NO: 446764 - RNA, 64 nt, Human
cgaguagcugagauuacaggcgcccgccaccaugcccggcuaauuuuugcauuuuuaguagaga

SEQ ID NO: 446765 - RNA, 64 nt, Human
cgaguagcugggauuacagacacccgccaccacgcccggcuaauuuuuucuauuuuuaguagaa

SEQ ID NO: 446766 - RNA, 64 nt, Human
ugaguagcuggaacugcagaugugcgccaccaugcccggcuaauuuuuguauuauaaguagaca

SEQ ID NO: 446767 - RNA, 64 nt, Human
caaguagcugggauuacaggcgcaggccaccaugcccggcuaauuuuuuguauuuuuaguagag

SEQ ID NO: 446768 - RNA, 64 nt, Human
cgaguagcuaggacuacaggcgugugccaccucucccggcuaauuuuuuuguauuuuuaguaga

SEQ ID NO: 446769 - RNA, 64 nt, Human
uaauuaguugggauuacaggcgcccaccaccaugcccggcuaauuuuuguguuuuuuuaguaga

SEQ ID NO: 446770 - RNA, 64 nt, Human
cuaguagcugggacuacaggugcccgccaccaugcccggcuaaucuuuugcauuuuuaguagag

SEQ ID NO: 446771 - RNA, 64 nt, Human
cuuugagucagcccagaaucacacuccuguguaucccggcuacacuuuaaggaaagauugaauc

SEQ ID NO: 446772 - RNA, 64 nt, Human
cgagcagcugggacuacaggcgcccgccaccucgcccggcuaauauuuuguauuuuuaguagag

SEQ ID NO: 446773 - RNA, 64 nt, Human
gauggggagagacagggcacagaggaccugucuccccggcuacucuugccuuauggcucuagug

SEQ ID NO: 446774 - RNA, 64 nt, Human
caaguagcugggacuagaggcaugcgccaccacacccggcuaauuuuuguauuuucaguagaga

SEQ ID NO: 446775 - RNA, 64 nt, Human
cgaguagcugggauuacgggcgcccgccaccacgcccggcuaauuuuuuguauuuuuaguagag

SEQ ID NO: 446776 - RNA, 64 nt, Human
uggcguucaagauagucauucaaaaguucuuggcccgcugaagucuguuaacaguugaaacauu

SEQ ID NO: 446777 - RNA, 64 nt, Human
ugucacauuggugaucucacagaggagggccaugccgcugaaaagggaaggagauugaaacauu

SEQ ID NO: 446778 - RNA, 64 nt, Human
gcggcgccgcccuggugguuucugucuccuccucccgcugaacacguccucgcucccgcgcucc

SEQ ID NO: 446779 - RNA, 64 nt, Human
caaguagcugggaucacaggcgugcaccaucacgcccggcuaauuuuuguauuuucaguagaga

SEQ ID NO: 446780 - RNA, 64 nt, Human
cgaguagcugggacuauaggcgcccaccacgacgcccggcuaauuuuuuguauuuuuaguagag

SEQ ID NO: 446781 - RNA, 64 nt, Human
uagauaacugggauuacaggugcccaccaccaugcccggcuaauuuuuguauuuuugguagaga

SEQ ID NO: 446782 - RNA, 64 nt, Human
caaguagcugggauuacagucaggcaccaccacacccggcuaauuuuguauuuuuuuaguagag

SEQ ID NO: 446783 - RNA, 64 nt, Human
caaguagcuggguuuauaggugcccgccaccagacccggcuaauuuuuuaguuuuaguagagac

SEQ ID NO: 446784 - RNA, 64 nt, Human
caaguagcuggcacuacagacacgcgccaccaugcccggcuaauuuuuguauuuuuaguagaga

SEQ ID NO: 446785 - RNA, 64 nt, Human
ugaguagcugggacuacaggcaugcaccaccacacccggcuaauuuuuguauuuuuaguagcca

SEQ ID NO: 446786 - RNA, 64 nt, Human
gaguagcugggacuacgggcgccccaccaccacgcccggcuaauuuuuuguauuuuuaguacag

SEQ ID NO: 446787 - RNA, 64 nt, Human
cgaguagcugggauuagaggcgccagccaacacacccggcuaauuuuuguauuuuuaguagaga

SEQ ID NO: 446788 - RNA, 64 nt, Human
aggguaugauacuacugugacgggucuaacagcccccggcuacucuuguucugugaaaugugua

SEQ ID NO: 446789 - RNA, 64 nt, Human
ggaguggcugggauuacaggugugcgccaccaugcccggcuaauuuuuguauuuuuaguagaga

SEQ ID NO: 446790 - RNA, 64 nt, Human
caaagugcugggauuauaggcaugagccaccgugcccggcuauuuucaguucuuaugcugugac

SEQ ID NO: 446791 - RNA, 64 nt, Human
cgaguagcugggacuacaggcaccugccaccacacccggcuacuuuuuuauauuuuuaguagag

SEQ ID NO: 446792 - RNA, 64 nt, Human
cgaguagcugggacuacaggcaccugccaccaugcccggcuaaauuuuuguauuuuuaguagag

SEQ ID NO: 446793 - RNA, 64 nt, Human
caaagugcugggauuacaggcaugagccaccacgcccggcuagacuuuaccuuucuaaagaaau

SEQ ID NO: 446794 - RNA, 64 nt, Human
caaguagcugggauuacaggugugcaccaccaugcccggcuaauuuuuuguauuuuuaguggag

SEQ ID NO: 446795 - RNA, 64 nt, Human
cugugauguccacucugcuuaagccuuucaucugccgcugaaggccccagucuggacucucugc

SEQ ID NO: 446796 - RNA, 64 nt, Human
ggaccagaggagcagaccagcacuucaaccuaguccgcugaagauggagggggcuggggucaca

SEQ ID NO: 446797 - RNA, 64 nt, Human
ucauaguauucugucagauaaugccuaagaaugaccgcugaagaacguugacccauuugaguac

SEQ ID NO: 446798 - RNA, 64 nt, Human
cgaguagcugggauuacaggcauccgccaccaugcccggcuaauuuuuguauuuuuaauagaga

SEQ ID NO: 446799 - RNA, 64 nt, Human
aucauccgcaacgugggcaaguaccgggaggcugcccggcuagaaaucaacgugcucaaaaaaa

SEQ ID NO: 446800 - RNA, 64 nt, Human
ugaguagcugggauuacaggcacaugccaccacgcccggcuaauuuuuguauuuuuaguagaga

SEQ ID NO: 446801 - RNA, 64 nt, Human
caaguagcugggacuauaggcacgugccaccacacccggcuaauuuucauauuuuuaguagaga

SEQ ID NO: 446802 - RNA, 64 nt, Human
caaguagcugggacuauagucacuugccaccaugcccggcuaauuuauuuuuaguagagaugag

SEQ ID NO: 446803 - RNA, 64 nt, Human
caaguagcugggauuacaggcacccgccaccgugcccggcuaguuuuuuuuuguauuuuuuuua

SEQ ID NO: 446804 - RNA, 64 nt, Human
gcucugacaguaaaccucuccuaaagcacagggccccggcuaagaaaacgaucauuuucaggag

SEQ ID NO: 446805 - RNA, 64 nt, Human
caaguaccugggacuacaggcgugagcuaccaugcccggcuaauuuuuguauuuuuaguagaga

SEQ ID NO: 446806 - RNA, 64 nt, Human
ugaguagcugggaugacaggugcacgccaccacgcccggcuaauuuuuauauuuuugguagaga

SEQ ID NO: 446807 - RNA, 64 nt, Human
gaaguagcugggauuacaggcgcccgccaccaugcccggcuaauuuuuugcauuuuuaguagac

SEQ ID NO: 446808 - RNA, 64 nt, Human
cgaguagcugggacuacaggcgcccgccaucacgcccggcuaauguuuuguauuuuuaguagag

SEQ ID NO: 446809 - RNA, 64 nt, Human
caagcaguugggacuacaggcgugagccaccaugcccggcuaauuuuuguauuuuuaguagaga

SEQ ID NO: 446810 - RNA, 64 nt, Human
cgaguagcugggacuacaggcaugugccaccaugcccggcuaauuucuuucuuucuuuuuuuuu

SEQ ID NO: 446811 - RNA, 64 nt, Human
ugagguagaaaauauuguuaauuccguucaggaucccggcuacauaaucuguggggcucaauac

SEQ ID NO: 446812 - RNA, 64 nt, Human
uuucacacaguaaagcaggaagccuccaagguaacccggcuaugggacugcagugcccaaggaa

SEQ ID NO: 446813 - RNA, 64 nt, Human
accgccacgcacagggauacagggggcgccuccgcccggcuaaaaagcgcggccugcgccgccg

SEQ ID NO: 446814 - RNA, 64 nt, Human
gucccagccuucauccaugugauuaagauccaggccgcugaaguuccccaggaaaugaucuucc

SEQ ID NO: 446815 - RNA, 64 nt, Human
cggaaagcggggccugcggguccuugugucccugccgcugaagaauggggcugcucugagggaa

SEQ ID NO: 446816 - RNA, 64 nt, Human
ucugccuguucucagggcacagcaacugccaaucccgcugaagaggccucccugggcacagcac

SEQ ID NO: 446817 - RNA, 64 nt, Human
caaguagcuuggauuacaggugagcacuaccacgcccggcuaauuuuuguauuuuuaauagaga

SEQ ID NO: 446818 - RNA, 64 nt, Human
ugaguagcugggacuacaggugcucaccaccacacccggcuaauuuuuuguauuuuuaguagag

SEQ ID NO: 446819 - RNA, 64 nt, Human
aaauuagccagguguggcggugugcgccuguagacccggcuacucaggaggcugaggcaggaga

SEQ ID NO: 446820 - RNA, 64 nt, Human
cgccccucgcccacccgcucgcugcccggcccuccccggcuaugacgcccccggcccgugcuca

SEQ ID NO: 446821 - RNA, 64 nt, Human
cgaguagcuggaauuacaggcaugcgccagcacgcccggcuaaguuuuguauuuuuggcagaga

SEQ ID NO: 446822 - RNA, 64 nt, Human
uaucccuugggaguuguagcugcugucacugacucccggcuauacauggccugucgaccacguu

SEQ ID NO: 446823 - RNA, 64 nt, Human
ugaguagcugggauuacaggugugagccaacaagcccggcuaauuuuuguauuuuuaguagaga

SEQ ID NO: 446824 - RNA, 64 nt, Human
ugaguagcugggacuacaggcgcccaccaccacgcccggcuaauuuuuuguauuuuuaauagag

SEQ ID NO: 446825 - RNA, 64 nt, Human
ccugaguagcuaggacugcaggugcuccaccacgcccggcuaauuuuuguauuuuuaguagaga

SEQ ID NO: 446826 - RNA, 64 nt, Human
uugucauugucuguccccacccggucguggcccacccggcuagagacggcguccucaaggcauc

SEQ ID NO: 446827 - RNA, 64 nt, Human
cgaguagcugggacuacaggcacccgccaacacgcccggcuaauuuuuuguauuuuuaguaaag

SEQ ID NO: 446828 - RNA, 64 nt, Human
ugaguagcugggauuacaggcaugugccagcaugcccggcuaauuuuuuucuuuuuuugagaca

SEQ ID NO: 446829 - RNA, 64 nt, Human
ccuggugaaacccaaccuuaaagcugaagacagucccggcuaaauccucauacugaauugagaa

SEQ ID NO: 446830 - RNA, 64 nt, Human
caaguagcugggauuacaggugugugccaccacacccggcuaauuuuuauauuuuuaguagaga

SEQ ID NO: 446831 - RNA, 64 nt, Human
cgaguagcugggccuaaaggugcccaccacuauacccggcuaauuuuuguauuuuuaguagaga

SEQ ID NO: 446832 - RNA, 64 nt, Human
cgaguagcugggauuacagguaugaaccacuaugcccggcuaacuuuguuuuuuuuuuuuagaa

SEQ ID NO: 446833 - RNA, 56 nt, Human
aggauggcuccugugacuagaggguggucagccagagcucaugggacagcuagcca

SEQ ID NO: 446834 - RNA, 64 nt, Human
aggccaaguagagccccgcagggccuccagcagggucagccauucacacccauccacucaccuc

SEQ ID NO: 446835 - RNA, 64 nt, Human
gcuaaaagauguuaauauacaucauaaaagcaaagucagccagcugauauuuugguucucaaaa

SEQ ID NO: 446836 - RNA, 64 nt, Human
cgcugcccgaugacaugaacaacaacucgggcgccccggcuacagccccugacucugccggcca

SEQ ID NO: 446837 - RNA, 64 nt, Human
acagcagcuggaacuccaggugugaaucaccaugcccggcuaacuuuuaaauuuuuuguagaga

SEQ ID NO: 446838 - RNA, 64 nt, Human
ccagcagcugggacuacaggcacccaccgucacacccggcuaauuuuuuuguauuuuaguagag

SEQ ID NO: 446839 - RNA, 64 nt, Human
cgaguagcugagacuacaggcgugugccacuacgcccggcuaauuguuguauuuuuaguagaga

SEQ ID NO: 446840 - RNA, 64 nt, Human
cgaguagcuggaauuacaggcaggcgccaccagacccggcuaauuuuuuguauuuuuaguacag

SEQ ID NO: 446841 - RNA, 64 nt, Human
cgaguagcugggauuacaggugugcaccaccacacccggcuaauuuuuuuuauuuuuaauagag

SEQ ID NO: 446842 - RNA, 64 nt, Human
ugaguagcugggauuacaggcaugcgccaccaugcccggcuaauuuuguauuuuuaguagagac

SEQ ID NO: 446843 - RNA, 64 nt, Human
ugaguagcugggacuacaggcgccugccacaacgcccggcuaauuuuuuguauuuuuaguagag

SEQ ID NO: 446844 - RNA, 64 nt, Human
ugaguagcuaggacuacaggugcaugccaacacgcccggcuaauuuuuuuuuaaaaauauuuuu

SEQ ID NO: 446845 - RNA, 64 nt, Human
ugaguagcugggacuacaggcgcccgccaccacgcccggcuaauuuuuuuuguauuuuuaguag

SEQ ID NO: 446846 - RNA, 64 nt, Human
cgaguagcugggauuacaggcgcccaccaccaugcccggcuaguuuuuuuguauuuuuaguaga

SEQ ID NO: 446847 - RNA, 64 nt, Human
agguagcugccacuacaggugcugcaccaccacgcccggcuaauuuuuguauuuuuaguagaga

SEQ ID NO: 446848 - RNA, 64 nt, Human
caaguagcuggaauuacagggacccgccaccacgcccggcuaauuuuuuugugugguuuuagua

SEQ ID NO: 446849 - RNA, 64 nt, Human
uaugaacuccucuuaagaagacgacggcuucaggcccggcuaacucuggcaccccggaucgagg

SEQ ID NO: 446850 - RNA, 64 nt, Human
ugaguagcugggacuacaggcacccgccaccacacccggcuaauuuuuggauuuuuaguagaga

SEQ ID NO: 446851 - RNA, 64 nt, Human
ugaguagcugggauuacaggcaugcgccaccacacccggcuaauuuuguauuuuuaguagagau

SEQ ID NO: 446852 - RNA, 64 nt, Human
cccaccuuccaagacuggcacugcccaacagacaccgcugaaaucauguggguaucccuaggau

SEQ ID NO: 446853 - RNA, 60 nt, Human
ucgaggacuuuaccugcugagccccgcaggccgcugaaccaaaggccuagauggggagga

SEQ ID NO: 446854 - RNA, 64 nt, Human
ucuugauuccuaaccgcccccacauacugcuccaccgcugaacuucgggugccggggaggagaa

SEQ ID NO: 446855 - RNA, 64 nt, Human
cgaguaguugggauuacaggugacugccaccgugcccggcuaauguuuguauuuuuaguagaga

SEQ ID NO: 446856 - RNA, 64 nt, Human
uacucccuggucguacugcagucagcacccguaacccggcuaugaccagggaucuguaagcccu

SEQ ID NO: 446857 - RNA, 64 nt, Human
ccacuagcugggacuacaggcacaugccaccaugcccggcuaauuuuuuuguauuuuuaguaga

SEQ ID NO: 446858 - RNA, 64 nt, Human
cgaguagcugggacuacaggcaccugccaccacgcccggcuaauuuuuuuguauuuucacugga

SEQ ID NO: 446859 - RNA, 64 nt, Human
ugaguagcuaggauuacaggugccugccaccacacccggcuaauuuucauauuuuucaguagag

SEQ ID NO: 446860 - RNA, 64 nt, Human
ugaguagcugggacuacaggcacgugccaccacgcccggcuaauuuuuuguauuuuuaguagag

SEQ ID NO: 446861 - RNA, 64 nt, Human
caaagugcugggauuacaggcuugagccaccacgcccggcuaaaacauugcaaauuuaaaugag

SEQ ID NO: 446862 - RNA, 64 nt, Human
caaguagcugggacuacaggcgcgugccaccacgcccggcuaauuuuuguauuuuuaguagaga

SEQ ID NO: 446863 - RNA, 64 nt, Human
caaguaccugggaugacaggcgccugccaccacgcccggcuaauuuuuaauuuuuuguauuuuu

SEQ ID NO: 446864 - RNA, 64 nt, Human
cgaguagcugggacuacaggcaccugccaccacccccggcuaauuuuuuguauuuauaguagag

SEQ ID NO: 446865 - RNA, 64 nt, Human
cucucugugucaggggacagcuugugucaccacgcccggcuaauuuuuguauuuuuuuuaguag

SEQ ID NO: 446866 - RNA, 64 nt, Human
caaguagcugggauuacaggcaccugccaccaugcccggcuaauuuuuguaauuuuaguagaga

SEQ ID NO: 446867 - RNA, 64 nt, Human
acucauccgccuggcccgggaaugaauggggaggccgcugaacccacccggcccauaucccugg

SEQ ID NO: 446868 - RNA, 64 nt, Human
cccagaggccuacaggggcaccaugcugcacugcccgcugaacuucacuggcaccccgggcccc

SEQ ID NO: 446869 - RNA, 64 nt, Human
auauuaauuguaaaguuuauuguauaguauuuaaccgcugaaguuccuauuuuauguugugcuu

SEQ ID NO: 446870 - RNA, 64 nt, Human; identical to SEQ ID NO: 116523

SEQ ID NO: 446871 - RNA, 64 nt, Human; identical to SEQ ID NO: 116524

SEQ ID NO: 446872 - RNA, 64 nt, Human; identical to SEQ ID NO: 116525

SEQ ID NO: 446873 - RNA, 64 nt, Human; identical to SEQ ID NO: 116526

SEQ ID NO: 446874 - RNA, 64 nt, Human; identical to SEQ ID NO: 116527

SEQ ID NO: 446875 - RNA, 64 nt, Human; identical to SEQ ID NO: 116528

SEQ ID NO: 446876 - RNA, 64 nt, Human; identical to SEQ ID NO: 116529

SEQ ID NO: 446877 - RNA, 64 nt, Human; identical to SEQ ID NO: 116530

SEQ ID NO: 446878 - RNA, 64 nt, Human; identical to SEQ ID NO: 116532

SEQ ID NO: 446879 - RNA, 64 nt, Human; identical to SEQ ID NO: 116533

SEQ ID NO: 446880 - RNA, 64 nt, Human; identical to SEQ ID NO: 116534

SEQ ID NO: 446881 - RNA, 64 nt, Human; identical to SEQ ID NO: 116535

SEQ ID NO: 446882 - RNA, 64 nt, Human; identical to SEQ ID NO: 116523

SEQ ID NO: 446883 - RNA, 64 nt, Human; identical to SEQ ID NO: 116524

SEQ ID NO: 446884 - RNA, 64 nt, Human; identical to SEQ ID NO: 116525

SEQ ID NO: 446885 - RNA, 64 nt, Human
uuagacaagacugucuagaacuuaaguuugaucugucagccaguacucccauuaaauucagugu

SEQ ID NO: 446886 - RNA, 64 nt, Human
aaacuauuuugagcauuagaauggaggaaauccggucagccaagugcagaguucagacuucgcu

SEQ ID NO: 446887 - RNA, 64 nt, Human
uguccagcccucggugcuggaguggacguuaauugucagccaccagacugucccggcaccuaca

SEQ ID NO: 446888 - RNA, 64 nt, Human; identical to SEQ ID NO: 116526

SEQ ID NO: 446889 - RNA, 64 nt, Human; identical to SEQ ID NO: 116527

SEQ ID NO: 446890 - RNA, 64 nt, Human; identical to SEQ ID NO: 116528

SEQ ID NO: 446891 - RNA, 64 nt, Human; identical to SEQ ID NO: 116529

SEQ ID NO: 446892 - RNA, 64 nt, Human; identical to SEQ ID NO: 116530

SEQ ID NO: 446893 - RNA, 64 nt, Human; identical to SEQ ID NO: 116532

SEQ ID NO: 446894 - RNA, 64 nt, Human; identical to SEQ ID NO: 116533

SEQ ID NO: 446895 - RNA, 64 nt, Human; identical to SEQ ID NO: 116534

SEQ ID NO: 446896 - RNA, 64 nt, Human; identical to SEQ ID NO: 116535

SEQ ID NO: 446897 - RNA, 64 nt, Human
cacagccccccgggcccagccgccucccucucuugggacgcaacuucuuccccacucggauggg

SEQ ID NO: 446898 - RNA, 64 nt, Human
cgcaggccgcccuacccaccuucaggcagccuaugggacgcagggccccaucugucccucgguc

SEQ ID NO: 446899 - RNA, 64 nt, Human
uauaaauagagagaucuauacagguaugucugacgggacgcagcaccgugggcacgcaccaaau

SEQ ID NO: 446900 - RNA, 64 nt, Human
cucccuucuccacaggcugcgucaucaccaucucgggacgcaugaccuucacgagcaauaaguc

SEQ ID NO: 446901 - RNA, 64 nt, Human
ugacgaggagcccagauuugggccuaaucagguggggacgcaucucagccuggaaccaacaggg

SEQ ID NO: 446902 - RNA, 64 nt, Human
ggcaccauacucacuuuccagggcugggggaagggggacgcaggaucauccccucccaaggaga

SEQ ID NO: 446903 - RNA, 64 nt, Human
ucuuggcucguuugggcucaaggcaccgcagccugucagccaacauugccuugcauuuguaccu

SEQ ID NO: 446904 - RNA, 64 nt, Human
ccaaugcuuuuauaauguuuucaacuguaucugagucagccagagagauaaauauccauguaua

SEQ ID NO: 446905 - RNA, 64 nt, Human
ggaggacaagggcuuccaguuuuuuucagaacaggucagccaccauccgccuaucucugcgugu

SEQ ID NO: 446906 - RNA, 64 nt, Human
ucagcccugggggugggggguggugggcagggaugggacgcaccacacagaacugugauugugg

SEQ ID NO: 446907 - RNA, 64 nt, Human
agcagaggagagcucugggguuggggauggguuagggacgcaagcuugaguucuagcccuugcu

SEQ ID NO: 446908 - RNA, 64 nt, Human
cagacaagcugggacgucagggaaaugaacaaaagggacgcagguuauuuggggugagugggug

SEQ ID NO: 446909 - RNA, 64 nt, Human
caacaacuccagucaugggaccaggaggagcucugggacgcagacacauuccuuggauguugau

SEQ ID NO: 446910 - RNA, 64 nt, Human
ggagacgacgaaggaacaggcguuucugacgagcgggacgcaguucucggacgccgaggggcug

SEQ ID NO: 446911 - RNA, 64 nt, Human
gcgccucauagguagacaguucuuugggacuuuugggacgcagcacuugaagagagguuuaccu

SEQ ID NO: 446912 - RNA, 64 nt, Human
aaaacugcccuaggccauugcagcauccuuagaugggacgcauaaucauuaccuuaaagcauca

SEQ ID NO: 446913 - RNA, 64 nt, Human
ccgcaauaaagaugccuuaagucucccgguucuggggacgcagcuacggcgccuaguucgugcu

SEQ ID NO: 446914 - RNA, 64 nt, Human
ggcagccgugugaaggagucggagaucagagugagggacgcauccacaagccaaggaacccaag

SEQ ID NO: 446915 - RNA, 64 nt, Human
ccuaagacagcaaagacagcacuguuccugggcugggacgcaaggaaugagguccuuuaugaaa

SEQ ID NO: 446916 - RNA, 64 nt, Human
gaggccuuauccacucccacuuguccuguuuggagggacgcagucccuagggcccgagacuggg

SEQ ID NO: 446917 - RNA, 64 nt, Human
ugaaugaauucucaacaaaaugugcuagccacuggggacgcaaaacaaguaagaucccuguugc

SEQ ID NO: 446918 - RNA, 64 nt, Human
uuagccguucccaauccuuagcaaugccuuagcugggacgcauagcuaauacuuuagagaggau

SEQ ID NO: 446919 - RNA, 64 nt, Human
auuacauuguggacuuugaaugugagggcuggaugggacgcaggagaucaucugaucccagcca

SEQ ID NO: 446920 - RNA, 64 nt, Human
guaguccaaucagcugaaauuaaaucacuugggagggacgcauagaaggagcucuaggaacaca

SEQ ID NO: 446921 - RNA, 64 nt, Human
gcagauaccucgguccagaucuccggauugucgggggacgcaggacucuucgaggaaaaccagc

SEQ ID NO: 446922 - RNA, 64 nt, Human
ugaaauccuccccugccccgcgggucucuggauugggacgcacagugcaguugaggucugcguc

SEQ ID NO: 446923 - RNA, 64 nt, Human
acacgccgaaccucaccauauggagccagacauugggacgcacgcaugugauugugugugcacg

SEQ ID NO: 446924 - RNA, 64 nt, Human
cuccugcccuacccucucacuuaacuggagcuuugggacgcacccuccacagugggagguggug

SEQ ID NO: 446925 - RNA, 64 nt, Human
agauaaucucuguucuucuaacugaucuaggauggggacgcacccaggucugcugaacuuuacu

SEQ ID NO: 446926 - RNA, 64 nt, Human
acuucugcaaaccuacccugucaaggagaucaaagggacgcagguuucuguuuauucugaacaa

SEQ ID NO: 446927 - RNA, 64 nt, Human
gugcacuggugacuucauggccacgccagcugcggggacgcacuugggacuccucgagagggga

SEQ ID NO: 446928 - RNA, 64 nt, Human
agcaagcucagcgaggaccucauggaguuccggcgggacgcauccauguuaaaugugagcgggc

SEQ ID NO: 446929 - RNA, 64 nt, Human
acacacccacauucaccaaacccacccgcgcccugggacgcagccacgccaggaggaggacacg

SEQ ID NO: 446930 - RNA, 64 nt, Human
uugccccauccaguguccucugcagcagggccaggggacgcacaccugccugacucuuuccuca

SEQ ID NO: 446931 - RNA, 64 nt, Human
acaccuaggcuguuuuuccuuccuccacaccugagggacgcagcaacagcuaggaucugcauuu

SEQ ID NO: 446932 - RNA, 64 nt, Human
gacggcccggugaccgcgcggauucaggauugcggggacgcagaaagguuaaggcacuuuuaaa

SEQ ID NO: 446933 - RNA, 64 nt, Human
ucugccuaaucagacuuauuauugagacgucaaugggacgcauuuuucuguugagcuaugcagu

SEQ ID NO: 446934 - RNA, 64 nt, Human
ucggugccuccccgaccuugcugacuaggcacaugggacgcaaaggagggagggaagcaaggcc

SEQ ID NO: 446935 - RNA, 64 nt, Human
aggcgugcccuuuggggcuugaagagcacacugugggacgcacgugcuucugauuaaaggaauc

SEQ ID NO: 446936 - RNA, 64 nt, Human
ugcuuuuuuaccaagagcccgagccucgcucuaagggacgcaguccuagaggcgugcccuuugg

SEQ ID NO: 446937 - RNA, 64 nt, Human
gggaggguccugccuuuuucucugccccaggucugggacgcaggugaugccagccaggcccagg

SEQ ID NO: 446938 - RNA, 64 nt, Human
cccuaccccagaaguguaucccacgagggcaucagggacgcagugaguguugcucaagggaguc

SEQ ID NO: 446939 - RNA, 64 nt, Human
ucauuccaaggcugagggagggccuucucgccuggggacgcagccacuuucuccaguggagaca

SEQ ID NO: 446940 - RNA, 64 nt, Human
ggguaaagggcgcaaagggcaugggucgggagaggggacgcaggccccucuccuccguggcaca

SEQ ID NO: 446941 - RNA, 64 nt, Human
gccacuuuccucuucuaguagcuguugucugguggggacgcaguggcccuggacacggcucccc

SEQ ID NO: 446942 - RNA, 64 nt, Human
ugucccugcccagugcaucccccaggucaucacggggacgcaggaggcaggcccugcccugccc

SEQ ID NO: 446943 - RNA, 64 nt, Human
cccagguugacuuuuucaagccccaagauguugagucagccauucuccaaggaucucgauuucc

SEQ ID NO: 446944 - RNA, 64 nt, Human
uuccaagucuguaauuuccugacuuuuccuagaugucagccacuacuaugaauucaagcuugug

SEQ ID NO: 446945 - RNA, 64 nt, Human
ugccuggagagccugacucugagcucuugaaguagucagccaguuugugguaaaaugguaauug

SEQ ID NO: 446946 - RNA, 64 nt, Human
cucccagucccaccccuugccccacggaguccuggggacgcagugccccagcugggaagagggc

SEQ ID NO: 446947 - RNA, 64 nt, Human
accuccagauuccggcuucuacaugggacagacggggacgcacaggccaccuuccuucuggcag

SEQ ID NO: 446948 - RNA, 58 nt, Human; identical to SEQ ID NO: 141716

SEQ ID NO: 446949 - RNA, 64 nt, Human
gacugcacaguguggcugcuuuuccauaauuuuugggacgcacaaaugucugcaugauuuugag

SEQ ID NO: 446950 - RNA, 64 nt, Human
cuugccugggaagagggcgaggaggccagugguggggacgcagaggguccucagagcaggagug

SEQ ID NO: 446951 - RNA, 58 nt, Human; identical to SEQ ID NO: 141719

SEQ ID NO: 446952 - RNA, 64 nt, Human
gccuucauuagagcgaggcagcccuuggccgguggggacgcagagccccagcagguggugcacg

SEQ ID NO: 446953 - RNA, 64 nt, Human
gaagaagaauacagucauguaucucuuggugacagggacgcauucugauaaaugugucauuagg

SEQ ID NO: 446954 - RNA, 64 nt, Human
cuucuccaaggagcaugucacuccagcagcacaggggacgcaaugggaggcagggacaccugga

SEQ ID NO: 446955 - RNA, 64 nt, Human
aacuugaaggccugcugucuccuucugggggucagggacgcagcuccacccucaccacuagccc

SEQ ID NO: 446956 - RNA, 64 nt, Human
auacggaaguaaaccugaacaaacccuuuaaauggggacgcagaugaguccucgguaaaccgag

SEQ ID NO: 446957 - RNA, 64 nt, Human
gcccggaggagcugguggugggagaaugacggcagggacgcagccacaguucagacccuguccc

SEQ ID NO: 446958 - RNA, 64 nt, Human
caagagccccaaagaucccacgggagaggggagagggacgcacagcacugccugccaagcgaga

SEQ ID NO: 446959 - RNA, 64 nt, Human
cuuugggguugcucccuguucugccccgaggccggggacgcagggcagcccacgccuccguggg

SEQ ID NO: 446960 - RNA, 64 nt, Human
gagugaccggugcccgcgagacagaaagaacaaugucagccacaucaggaccgcuggggcuucg

SEQ ID NO: 446961 - RNA, 64 nt, Human
acuuuucaugaccucaaaugugggcccagccuaggucagccaacccccauccaacccuuagacu

SEQ ID NO: 446962 - RNA, 64 nt, Human
auugcaagacuccaucucuacaaaaaauauaaaagucagccaggcguuguggugcaugcuugug

SEQ ID NO: 446963 - RNA, 64 nt, Human
gugucacgcguggacaucuccucaggcuguccccagcggugacgggagguguccuggcugcucc

SEQ ID NO: 446964 - RNA, 64 nt, Human
cagggcgcccuggcuucuccccaaggagaugaggagcggugaugccagcaccgggaugcgcaga

SEQ ID NO: 446965 - RNA, 64 nt, Human
uuggcggagaacgccgccgcaguguuugaccucuagcggugaagggggaaggggaagaggaaag

SEQ ID NO: 446966 - RNA, 64 nt, Human
cauucagacgggcaguguuagaggaggagaugggagcggugacuacacacacacacacacacac

SEQ ID NO: 446967 - RNA, 64 nt, Human
ugaggcuuuucuucuccugcccccaagcaccuccagcggugaugagcuccacacccccacaccc

SEQ ID NO: 446968 - RNA, 64 nt, Human
cuuggaaauaauugguuuucuuauaaaugagugaagcggugauaaaauucuuuggcuaguuauu

SEQ ID NO: 446969 - RNA, 64 nt, Human
aggagcugcaguuggaggccguucugugcccagcagcggugagcggcucccaugggcccugugu

SEQ ID NO: 446970 - RNA, 64 nt, Human
ucuuuuuuuaaaugcaguuuuauaaaacccuaacagcggugauaucauuagacuguaugaauca

SEQ ID NO: 446971 - RNA, 64 nt, Human
ucucauuacugugcugaaagucagcccacgucggagcggugaggaggagccacagcacaugggg

SEQ ID NO: 446972 - RNA, 64 nt, Human
guugcaaugagccgagguugagccaucgcacuccagcggugaaacaagagugaaacuccaucuc

SEQ ID NO: 446973 - RNA, 64 nt, Human
uauacauuuggacugugcauucuccaagagaugaagcggugaaguugggauuuacauuggaagu

SEQ ID NO: 446974 - RNA, 64 nt, Human
augaagugcuguucuuuugccuagguuggaguacagcggugaaaucauagcgcacugcagccuu

SEQ ID NO: 446975 - RNA, 64 nt, Human
ggccuucaagggcuggcagucuuacagaggcuggagcggugagaaugagaggccagagggacca

SEQ ID NO: 446976 - RNA, 64 nt, Human
uuacuguuaaaaaacaaacaaaaaacaacaaaaaagcggugacaggaaacaguuaaggaaauga

SEQ ID NO: 446977 - RNA, 64 nt, Human
ucccaaagcgcucgccccgcaggguccaaaggccagcggugaccagccugucacccagcuccuc

SEQ ID NO: 446978 - RNA, 64 nt, Human
caucaacacugcgccggguaccauggacggccccgucagccacaccugucagcccaagcagagu

SEQ ID NO: 446979 - RNA, 64 nt, Human
guuuuauauuaauugugcuuauggaagaaacaaugucagccaaguccauuuuauaguuugagug

SEQ ID NO: 446980 - RNA, 64 nt, Human
uuugcagacacaaauaucuaugaaaagaugcuuugucagccacugugccuuuuuuucugugaag

SEQ ID NO: 446981 - RNA, 64 nt, Human
ccucauguuguuggcaacaggugaaugaaccuagagcggugacaugaaaauaaagcucacuguu

SEQ ID NO: 446982 - RNA, 64 nt, Human
cauagacccacacaaggagccugcacagcaagccagcggugacacaccugcaggugucaggcau

SEQ ID NO: 446983 - RNA, 64 nt, Human
cagccugcucugcggcccccugcggcugucagagagcggugagaccuggagcgaggugugggcc

SEQ ID NO: 446984 - RNA, 64 nt, Human
cucugggcaccaaggaaacuaacagcuuucucaaagcggugaccacucaggccagcccagacaa

SEQ ID NO: 446985 - RNA, 64 nt, Human
gaccgcgcuccugcugaagaguuuagaaugaggcagcggugagaagaagggugggagggcgugg

SEQ ID NO: 446986 - RNA, 64 nt, Human
gccucagugugccucucuggccgcccacuggaugagcggugagacgaacaaaagggaaaggaaa

SEQ ID NO: 446987 - RNA, 64 nt, Human
cuuaauuugcuuuuguuugcuuuagcuugguaacagcggugaauagaguguaguguaaguggag

SEQ ID NO: 446988 - RNA, 64 nt, Human
cuaggagugggauccaggcuccucucccacagaaagcggugacuucaccucauggagcccggga

SEQ ID NO: 446989 - RNA, 64 nt, Human
ucccgcauccuuugcucugccugucaguggucagagcggugagcgagguggguuggagacucag

SEQ ID NO: 446990 - RNA, 64 nt, Human
guugcgcaagaaagaagucacuguuacagaggcaagcggugaacuagguaagaguucacucaug

SEQ ID NO: 446991 - RNA, 64 nt, Human
ucacuggcgcccuuuggccgcgaccacgggaaccagcggugaggccugacccagcaccacguuc

SEQ ID NO: 446992 - RNA, 64 nt, Human
gaaugacuuccucgagaccauacagccaggaaauagcggugaaucuagugaucucgggucccua

SEQ ID NO: 446993 - RNA, 64 nt, Human
gucgcaguggcaaagccagcaccauggccagcagagcggugagcagcacucccaccagcagccc

SEQ ID NO: 446994 - RNA, 64 nt, Human
uuaguggcuuaaccaaacaaugacuccucauuccagcggugacagaagagaaagggucauuuac

SEQ ID NO: 446995 - RNA, 64 nt, Human
agagacuuccugcaucuucugccuuuccaacagaagcggugaucgucuaaguaugagccugugg

SEQ ID NO: 446996 - RNA, 64 nt, Human
agccaggagaauuaucuauagguggaaagucugugucagccaaagccaugucacucugagagaa

SEQ ID NO: 446997 - RNA, 64 nt, Human
aaauucagaacccccuguccugaaggaucucucugucagccagccuggagugcaauggcacaau

SEQ ID NO: 446998 - RNA, 64 nt, Human
cagcgucuucauuagguagcucuggcugggcuuugucagccagcgugugagaaaggagaaccaa

SEQ ID NO: 446999 - RNA, 64 nt, Human
ggaggaggcugagcagaaggagucaucauggaggagcggugagaacauggaaccggacuccaag

SEQ ID NO: 447000 - RNA, 64 nt, Human
uccacaaaggugggaggauguggggaagggggaaagcggugaggacgcagagugcaggcugugg

SEQ ID NO: 447001 - RNA, 64 nt, Human
uccccaggcuuucugugcccaggccucuguccccagcggugagguugcagugagugaaggagag

SEQ ID NO: 447002 - RNA, 64 nt, Human
gggggucugucuggauguggagaagcucugugugagcggugagggguggagggaugucgcggag

SEQ ID NO: 447003 - RNA, 64 nt, Human
ugaccucucuaaaccuugguuuucugcucucuggagcggugaaccggugguugucugcggggaa

SEQ ID NO: 447004 - RNA, 64 nt, Human
gccaucgccauccaccggggcauggcccaggaggagcggugagugcgagccgcccgccaaggcu

SEQ ID NO: 447005 - RNA, 64 nt, Human
aaagaugggucucauucuguuggccaggcaugagagcggugacaggaucagcccucacugaagc

SEQ ID NO: 447006 - RNA, 64 nt, Human
aauaggggaugaaauauagcagaagcuagaagaaagcggugaggugagagagaugcaucugcac

SEQ ID NO: 447007 - RNA, 64 nt, Human
agcagagggagcauggcccagggguguugaggccagcggugagagccguguuagccaagacaug

SEQ ID NO: 447008 - RNA, 64 nt, Human
ggugugugccaggcucuguccuguacacagguacagcggugaaagaaccaacaaagaccuaucc

SEQ ID NO: 447009 - RNA, 64 nt, Human
uggggauaggagccgggccaagcgcuggccccucagcggugagcccugcccacucuuaccgagc

SEQ ID NO: 447010 - RNA, 64 nt, Human
aagaaagcugagacccggcugugaggagcgccucagcggugaggugguuuagggauaaauguuu

SEQ ID NO: 447011 - RNA, 64 nt, Human
aaagaaucucuuguuucuucuccgagccccaggcagcggugauucagcccugcccaaccugauu

SEQ ID NO: 447012 - RNA, 64 nt, Human
aacacacacacgcuuaaccauguugauggcacaaagcggugagcaguagggagguagaauaucu

SEQ ID NO: 447013 - RNA, 64 nt, Human
uaauugcaugcauaccgauauuggagaaaucugggucagccaaguuucauguuauugcauuuag

SEQ ID NO: 447014 - RNA, 64 nt, Human
aggaaguuuggucagagugaauugaauauuguaagucagccacugggacccgaggauuucuggg

SEQ ID NO: 447015 - RNA, 64 nt, Human
gcacugauguaggagauacacgguacuuggagcagucagccagaaaucacagauacugcuuuca

SEQ ID NO: 447016 - RNA, 64 nt, Human
cccugugaggcaccagggcauucgggccacagggcggugcuagcuugacacagucagcaugcuu

SEQ ID NO: 447017 - RNA, 64 nt, Human
uaaccacugugcccugcugcaggagcaugcacagcggugcuauguccguggugagcaggagggc

SEQ ID NO: 447018 - RNA, 64 nt, Human
agcuacaggacugguacucaagccagccuguaaacggugcuauuucuauuccuuaugggaucau

SEQ ID NO: 447019 - RNA, 64 nt, Human
auaauugacacaguacauuaacaauccaugccaacggugcuaauacgauaggcugaaugucuga

SEQ ID NO: 447020 - RNA, 64 nt, Human
acagccuggagacacccacacagauggcuggauccggugcuacgggaaacauuuuccuaagaug

SEQ ID NO: 447021 - RNA, 64 nt, Human
cuucacuguaguuuuaaagaagaacuguaaaugacggugcuauacaagucaaaaaauacaugcc

SEQ ID NO: 447022 - RNA, 64 nt, Human
gcagcccagccgcuaucuuagcugucuuucccagcggugcuaagaguggucucagugagaaggu

SEQ ID NO: 447023 - RNA, 64 nt, Human
cugggccucuugugcuaagagggcagggggccuacggugcuauugcuuuaggggcccaccacgg

SEQ ID NO: 447024 - RNA, 64 nt, Human
aaggugcuaacauagauuuaagugaauacauuaacggugcuaaaaaugaaaauucuaacccaag

SEQ ID NO: 447025 - RNA, 64 nt, Human
gccauuuuucuuaacaccuucugccacuuucugucggugcuaauggauggaacuccugcacaag

SEQ ID NO: 447026 - RNA, 64 nt, Human
cagaaguccuacuugacaaucacauauagaagaacggugcuauucaguaaguucucuuuccuuu

SEQ ID NO: 447027 - RNA, 64 nt, Human
acugaugcuuacuuaggccggagagcaggggacacggugcuagguucccucgugcagugccugg

SEQ ID NO: 447028 - RNA, 64 nt, Human
uugcuuugaaauauguagaguuccucagaauugacggugcuagaaauauccaaguguuaaauaa

SEQ ID NO: 447029 - RNA, 64 nt, Human
uuuugcagaagaggguguguuugaaaucaucggagucagccaggagcugucaccaaggaaacgc

SEQ ID NO: 447030 - RNA, 64 nt, Human
caaucacaggaaaauguauccagaggaauugauugucagccaccucccucugccagucgggaga

SEQ ID NO: 447031 - RNA, 64 nt, Human
caauaugggaauuuucauaauaguucauacauuugucagccaacauuaaaagguaaccaacucc

SEQ ID NO: 447032 - RNA, 64 nt, Human
cccaucugcuuccccggcuaugugcccaacuccgcggugcuacagcagauguggcuaaaugcgg

SEQ ID NO: 447033 - RNA, 64 nt, Human
ccuguuguuccaauucuguggguuuuugauucaacggugcuauaaccaggguccugggugacag

SEQ ID NO: 447034 - RNA, 64 nt, Human
gaguaagagagggcccuuccccugccaggacccacggugcuauccauucagucucuuccucagu

SEQ ID NO: 447035 - RNA, 64 nt, Human
cuucaccucaacuaacccagcagcagcgggacggcggugcuaggucaaucuuaacgugacuaau

SEQ ID NO: 447036 - RNA, 64 nt, Human
ccagggcugguguugggcccggagcagcaucuuccggugcuauccuccccucccaccccucaca

SEQ ID NO: 447037 - RNA, 64 nt, Human
agcauuagguaugacuuguucugaguacugcuuccggugcuaaaaugaacaaagaauuuguacu

SEQ ID NO: 447038 - RNA, 64 nt, Human
ccuggaagccccuccuuucagugccuggcugcagcggugcuagccaggcuggaguccagcaccu

SEQ ID NO: 447039 - RNA, 64 nt, Human
ugauucccccccaaccccaccucgggccucacgacggugcuaccuaagaaagucuucccuccca

SEQ ID NO: 447040 - RNA, 64 nt, Human
ccagucauuacuaguaccucugcgggagaucauccggugcuaaaacauuacaguugccaaggag

SEQ ID NO: 447041 - RNA, 64 nt, Human
ugaaucaauguuccaguuagcuuuaaaagguauacggugcuaauuaguaaaauauugaaggcaa

SEQ ID NO: 447042 - RNA, 64 nt, Human
uguacacucaccagacacuggcugcugguugucacggugcuaagagcugugggaaacaugaaga

SEQ ID NO: 447043 - RNA, 64 nt, Human
ccagaaacaccaaaugucuuaacaaugcuugaggcggugcuacaaaugaaguccuucuccaaau

SEQ ID NO: 447044 - RNA, 64 nt, Human
gggaucccucuccacaggggcagccccaagggcucggugcuauuuguaacggaauaaaauuugu

SEQ ID NO: 447045 - RNA, 64 nt, Human
gcagcccugggcgggccgaccacacucgaggcugcggugcuacgggcuuagcccucgccucccu

SEQ ID NO: 447046 - RNA, 64 nt, Human
uccugcugcaguugccagucaccccggccaccugcggugcuaucucccccagccccauccucug

SEQ ID NO: 447047 - RNA, 64 nt, Human
agcaucugggggcacuccaaaaggggccugugaugucagccacugggguguugugcucacuuca

SEQ ID NO: 447048 - RNA, 64 nt, Human
ugcccaggacacccuguggcuuuacuugcucauggucagccaagcuuacccuucacacugagaa

SEQ ID NO: 447049 - RNA, 55 nt, Human
ucacuaucagugaccccugaggagcgucagccaugguagguacaugccucaccgc

SEQ ID NO: 447050 - RNA, 64 nt, Human
uggaagcacagccucggggauggggagggaaagacggugcuauauccaguuccugcucucugcu

SEQ ID NO: 447051 - RNA, 64 nt, Human
gccccgccuccggacccggggcugggcggggcgccggugcuaguggaacgccgagccaguggcg

SEQ ID NO: 447052 - RNA, 64 nt, Human
cccugcgggcccgcacguuuuaugagguugauaucggugcuauguguuugguuuauaauuugau

SEQ ID NO: 447053 - RNA, 64 nt, Human
cugccugaggaaggaaggacccgcuuccuguugucggugcuaauuccuuuguaauuccagcccc

SEQ ID NO: 447054 - RNA, 64 nt, Human
cucugacucuucuacccagucuuuuccuaaaguucggugcuacuccaguugggugcaucaggga

SEQ ID NO: 447055 - RNA, 64 nt, Human
gagauaauggaccacuauuaaaccugauucucuucggugcuaggaaagagugaugugugagauu

SEQ ID NO: 447056 - RNA, 64 nt, Human
aaaggucggugcgcucuucugugcaccauccucacggugcuauuuccgaauaucugaauauuga

SEQ ID NO: 447057 - RNA, 64 nt, Human
gcuucaucccuucuaaggcuguccaccaggagcccggugcuaggggaagcauccccaggccuga

SEQ ID NO: 447058 - RNA, 64 nt, Human
ccaccccccgccgcccagcauccuaccuggacugcggugcuacgagggccugcgggccuuugcu

SEQ ID NO: 447059 - RNA, 64 nt, Human
gaugcuccaugccccuaggauuuugcuuccuccccggugcuaaauuagcaagcuccuagagaag

SEQ ID NO: 447060 - RNA, 64 nt, Human
ucaggggaccagguggggcggguggggagcuguccggugcuaccacaccgugcccucaguggac

SEQ ID NO: 447061 - RNA, 64 nt, Human
gggcgcuggcugcacucaagacccucgagauuaacggugcuaaccccgucugcuccucccuccc

SEQ ID NO: 447062 - RNA, 64 nt, Human
ccuguccuguuucucacccagcaccuggggagaucggugcuaccaaggaagagagcacacagau

SEQ ID NO: 447063 - RNA, 64 nt, Human
ugcuuccugcucuccugugcggcgucugauuucucggugcuaaccuggcagcuguggggcccuu

SEQ ID NO: 447064 - RNA, 64 nt, Human
caguugggacagaggugcccacgagggcagaggccggugcuaaggggauggggaagaagggaca

SEQ ID NO: 447065 - RNA, 64 nt, Human
acucacaaaaggaaggccaaaguauccaucauuagucagccacaaaagacaaucaaaguggcag

SEQ ID NO: 447066 - RNA, 64 nt, Human
agcccagugcccuuuccuagaauucccgacaugugucagccaugccucuguggggagucugccu

SEQ ID NO: 447067 - RNA, 51 nt, Human
ggaucucuaauacauuuugaggucagccacuucuccaguggaacucugaag

SEQ ID NO: 447068 - RNA, 64 nt, Human
aaagacugcaguuugugggaagaauuauuuuucacggugcuacuaauccugcuguaucccgggu

SEQ ID NO: 447069 - RNA, 65 nt, Human
acccugugaggcaccagggcauucgggccacagggcggugcuagcuugacacagucagcaugcuu

SEQ ID NO: 447070 - RNA, 65 nt, Human
cuaaccacugugcccugcugcaggagcaugcacagcggugcuauguccguggugagcaggagggc

SEQ ID NO: 447071 - RNA, 65 nt, Human
aagcuacaggacugguacucaagccagccuguaaacggugcuauuucuauuccuuaugggaucau

SEQ ID NO: 447072 - RNA, 65 nt, Human
uauaauugacacaguacauuaacaauccaugccaacggugcuaauacgauaggcugaaugucuga

SEQ ID NO: 447073 - RNA, 65 nt, Human
cacagccuggagacacccacacagauggcuggauccggugcuacgggaaacauuuuccuaagaug

SEQ ID NO: 447074 - RNA, 65 nt, Human
ucuucacuguaguuuuaaagaagaacuguaaaugacggugcuauacaagucaaaaaauacaugcc

SEQ ID NO: 447075 - RNA, 65 nt, Human
ggcagcccagccgcuaucuuagcugucuuucccagcggugcuaagaguggucucagugagaaggu

SEQ ID NO: 447076 - RNA, 65 nt, Human
ccugggccucuugugcuaagagggcagggggccuacggugcuauugcuuuaggggcccaccacgg

SEQ ID NO: 447077 - RNA, 65 nt, Human
caaggugcuaacauagauuuaagugaauacauuaacggugcuaaaaaugaaaauucuaacccaag

SEQ ID NO: 447078 - RNA, 65 nt, Human
agccauuuuucuuaacaccuucugccacuuucugucggugcuaauggauggaacuccugcacaag

SEQ ID NO: 447079 - RNA, 65 nt, Human
acagaaguccuacuugacaaucacauauagaagaacggugcuauucaguaaguucucuuuccuuu

SEQ ID NO: 447080 - RNA, 65 nt, Human
cacugaugcuuacuuaggccggagagcaggggacacggugcuagguucccucgugcagugccugg

SEQ ID NO: 447081 - RNA, 64 nt, Human
ugccuuggccucccaaagugcugggauuacaggugucagccaccgcacccagccaagcaccccu

SEQ ID NO: 447082 - RNA, 64 nt, Human
ccugagaagcccgccuucucccucguggacaggagucagccaguugguugcugugguuacagcc

SEQ ID NO: 447083 - RNA, 64 nt, Human
aaauguccaugcacccagguggccgcguugggcugucagccaaggugccugaaacgauacgugu

SEQ ID NO: 447084 - RNA, 65 nt, Human
cuugcuuugaaauauguagaguuccucagaauugacggugcuagaaauauccaaguguuaaauaa

SEQ ID NO: 447085 - RNA, 65 nt, Human
gcccaucugcuuccccggcuaugugcccaacuccgcggugcuacagcagauguggcuaaaugcgg

SEQ ID NO: 447086 - RNA, 65 nt, Human
uccuguuguuccaauucuguggguuuuugauucaacggugcuauaaccaggguccugggugacag

SEQ ID NO: 447087 - RNA, 65 nt, Human
agaguaagagagggcccuuccccugccaggacccacggugcuauccauucagucucuuccucagu

SEQ ID NO: 447088 - RNA, 65 nt, Human
gcuucaccucaacuaacccagcagcagcgggacggcggugcuaggucaaucuuaacgugacuaau

SEQ ID NO: 447089 - RNA, 65 nt, Human
gccagggcugguguugggcccggagcagcaucuuccggugcuauccuccccucccaccccucaca

SEQ ID NO: 447090 - RNA, 65 nt, Human
cagcauuagguaugacuuguucugaguacugcuuccggugcuaaaaugaacaaagaauuuguacu

SEQ ID NO: 447091 - RNA, 65 nt, Human
uccuggaagccccuccuuucagugccuggcugcagcggugcuagccaggcuggaguccagcaccu

SEQ ID NO: 447092 - RNA, 65 nt, Human
uugauucccccccaaccccaccucgggccucacgacggugcuaccuaagaaagucuucccuccca

SEQ ID NO: 447093 - RNA, 65 nt, Human
gccagucauuacuaguaccucugcgggagaucauccggugcuaaaacauuacaguugccaaggag

SEQ ID NO: 447094 - RNA, 65 nt, Human
augaaucaauguuccaguuagcuuuaaaagguauacggugcuaauuaguaaaauauugaaggcaa

SEQ ID NO: 447095 - RNA, 65 nt, Human
cuguacacucaccagacacuggcugcugguugucacggugcuaagagcugugggaaacaugaaga

SEQ ID NO: 447096 - RNA, 65 nt, Human
gccagaaacaccaaaugucuuaacaaugcuugaggcggugcuacaaaugaaguccuucuccaaau

SEQ ID NO: 447097 - RNA, 65 nt, Human
ggggaucccucuccacaggggcagccccaagggcucggugcuauuuguaacggaauaaaauuugu

SEQ ID NO: 447098 - RNA, 65 nt, Human
agcagcccugggcgggccgaccacacucgaggcugcggugcuacgggcuuagcccucgccucccu

SEQ ID NO: 447099 - RNA, 60 nt, Human
ccucugugauggcagugugagcuggacugugucagccacgacucgagcacucauucugcu

SEQ ID NO: 447100 - RNA, 64 nt, Human
caaguuuagccaugacaaaccaaagagugcccaggucagccaagaaagauacauaaucucaugg

SEQ ID NO: 447101 - RNA, 64 nt, Human
cuaaagauguuuauuuccuuauagacugauuaaagucagccauucuuuuuccucaagucugugc

SEQ ID NO: 447102 - RNA, 65 nt, Human
guccugcugcaguugccagucaccccggccaccugcggugcuaucucccccagccccauccucug

SEQ ID NO: 447103 - RNA, 65 nt, Human
cuggaagcacagccucggggauggggagggaaagacggugcuauauccaguuccugcucucugcu

SEQ ID NO: 447104 - RNA, 65 nt, Human
ggccccgccuccggacccggggcugggcggggcgccggugcuaguggaacgccgagccaguggcg

SEQ ID NO: 447105 - RNA, 65 nt, Human
acccugcgggcccgcacguuuuaugagguugauaucggugcuauguguuugguuuauaauuugau

SEQ ID NO: 447106 - RNA, 65 nt, Human
gcugccugaggaaggaaggacccgcuuccuguugucggugcuaauuccuuuguaauuccagcccc

SEQ ID NO: 447107 - RNA, 65 nt, Human
ucucugacucuucuacccagucuuuuccuaaaguucggugcuacuccaguugggugcaucaggga

SEQ ID NO: 447108 - RNA, 65 nt, Human
ugagauaauggaccacuauuaaaccugauucucuucggugcuaggaaagagugaugugugagauu

SEQ ID NO: 447109 - RNA, 65 nt, Human
aaaaggucggugcgcucuucugugcaccauccucacggugcuauuuccgaauaucugaauauuga

SEQ ID NO: 447110 - RNA, 65 nt, Human
ggcuucaucccuucuaaggcuguccaccaggagcccggugcuaggggaagcauccccaggccuga

SEQ ID NO: 447111 - RNA, 65 nt, Human
accaccccccgccgcccagcauccuaccuggacugcggugcuacgagggccugcgggccuuugcu

SEQ ID NO: 447112 - RNA, 65 nt, Human
ggaugcuccaugccccuaggauuuugcuuccuccccggugcuaaauuagcaagcuccuagagaag

SEQ ID NO: 447113 - RNA, 65 nt, Human
cucaggggaccagguggggcggguggggagcuguccggugcuaccacaccgugcccucaguggac

SEQ ID NO: 447114 - RNA, 65 nt, Human
ggggcgcuggcugcacucaagacccucgagauuaacggugcuaaccccgucugcuccucccuccc

SEQ ID NO: 447115 - RNA, 65 nt, Human
cccuguccuguuucucacccagcaccuggggagaucggugcuaccaaggaagagagcacacagau

SEQ ID NO: 447116 - RNA, 65 nt, Human
uugcuuccugcucuccugugcggcgucugauuucucggugcuaaccuggcagcuguggggcccuu

SEQ ID NO: 447117 - RNA, 64 nt, Human
ucuacauagucuuuuuuaaauggaaggagaaaaugucagccacauuacugucuguguagugcca

SEQ ID NO: 447118 - RNA, 65 nt, Human
gcaguugggacagaggugcccacgagggcagaggccggugcuaaggggauggggaagaagggaca

SEQ ID NO: 447119 - RNA, 65 nt, Human
aaaagacugcaguuugugggaagaauuauuuuucacggugcuacuaauccugcuguaucccgggu

SEQ ID NO: 447120 - RNA, 64 nt, Human; identical to SEQ ID NO: 446963

SEQ ID NO: 447121 - RNA, 64 nt, Human; identical to SEQ ID NO: 446964

SEQ ID NO: 447122 - RNA, 64 nt, Human; identical to SEQ ID NO: 446965

SEQ ID NO: 447123 - RNA, 64 nt, Human; identical to SEQ ID NO: 446966

SEQ ID NO: 447124 - RNA, 64 nt, Human; identical to SEQ ID NO: 446967

SEQ ID NO: 447125 - RNA, 64 nt, Human; identical to SEQ ID NO: 446968

SEQ ID NO: 447126 - RNA, 64 nt, Human; identical to SEQ ID NO: 446969

SEQ ID NO: 447127 - RNA, 64 nt, Human; identical to SEQ ID NO: 446970

SEQ ID NO: 447128 - RNA, 64 nt, Human; identical to SEQ ID NO: 446971

SEQ ID NO: 447129 - RNA, 64 nt, Human; identical to SEQ ID NO: 446972

SEQ ID NO: 447130 - RNA, 64 nt, Human; identical to SEQ ID NO: 446973

SEQ ID NO: 447131 - RNA, 64 nt, Human
uuucaugaucuggggcaucaugucgguagcugaagucagccacggugggaguguuuauaccaug

SEQ ID NO: 447132 - RNA, 64 nt, Human
aaaauacacagagugugagaggcagggaggucgagucagccauguguaaugcccucagugcagg

SEQ ID NO: 447133 - RNA, 64 nt, Human
guuuauucauucuggaaacauguugauacuuacagucagccacugcuuuugauaagugauauug

SEQ ID NO: 447134 - RNA, 64 nt, Human; identical to SEQ ID NO: 446974

SEQ ID NO: 447135 - RNA, 64 nt, Human; identical to SEQ ID NO: 446975

SEQ ID NO: 447136 - RNA, 64 nt, Human; identical to SEQ ID NO: 446976

SEQ ID NO: 447137 - RNA, 64 nt, Human; identical to SEQ ID NO: 446977

SEQ ID NO: 447138 - RNA, 64 nt, Human; identical to SEQ ID NO: 446981

SEQ ID NO: 447139 - RNA, 64 nt, Human; identical to SEQ ID NO: 446982

SEQ ID NO: 447140 - RNA, 64 nt, Human; identical to SEQ ID NO: 446983

SEQ ID NO: 447141 - RNA, 64 nt, Human; identical to SEQ ID NO: 446984

SEQ ID NO: 447142 - RNA, 64 nt, Human; identical to SEQ ID NO: 446985

SEQ ID NO: 447143 - RNA, 64 nt, Human; identical to SEQ ID NO: 446986

SEQ ID NO: 447144 - RNA, 64 nt, Human; identical to SEQ ID NO: 446987

SEQ ID NO: 447145 - RNA, 64 nt, Human; identical to SEQ ID NO: 446988

SEQ ID NO: 447146 - RNA, 64 nt, Human; identical to SEQ ID NO: 446989

SEQ ID NO: 447147 - RNA, 64 nt, Human; identical to SEQ ID NO: 446990

SEQ ID NO: 447148 - RNA, 64 nt, Human; identical to SEQ ID NO: 446991

SEQ ID NO: 447149 - RNA, 64 nt, Human
uauuaguguucaucuguggaguaucagaauagcagucagccaacucugucucauaucauccuuc

SEQ ID NO: 447150 - RNA, 50 nt, Human
agccccauggcugcugcugagucagccaccuagcgcuggccccaugcagc

SEQ ID NO: 447151 - RNA, 64 nt, Human
aaauaaauauuguucugauuauuacugaaaagaugucagccauuucaaugucuugggaaacaau

SEQ ID NO: 447152 - RNA, 64 nt, Human; identical to SEQ ID NO: 446992

SEQ ID NO: 447153 - RNA, 64 nt, Human; identical to SEQ ID NO: 446993

SEQ ID NO: 447154 - RNA, 64 nt, Human; identical to SEQ ID NO: 446994

SEQ ID NO: 447155 - RNA, 64 nt, Human; identical to SEQ ID NO: 446995

SEQ ID NO: 447156 - RNA, 64 nt, Human; identical to SEQ ID NO: 446999

SEQ ID NO: 447157 - RNA, 64 nt, Human; identical to SEQ ID NO: 447000

SEQ ID NO: 447158 - RNA, 64 nt, Human; identical to SEQ ID NO: 447001

SEQ ID NO: 447159 - RNA, 64 nt, Human; identical to SEQ ID NO: 447002

SEQ ID NO: 447160 - RNA, 64 nt, Human; identical to SEQ ID NO: 447003

SEQ ID NO: 447161 - RNA, 64 nt, Human; identical to SEQ ID NO: 447004

SEQ ID NO: 447162 - RNA, 64 nt, Human; identical to SEQ ID NO: 447005

SEQ ID NO: 447163 - RNA, 64 nt, Human; identical to SEQ ID NO: 447006

SEQ ID NO: 447164 - RNA, 64 nt, Human; identical to SEQ ID NO: 447007

SEQ ID NO: 447165 - RNA, 64 nt, Human; identical to SEQ ID NO: 447008

SEQ ID NO: 447166 - RNA, 64 nt, Human; identical to SEQ ID NO: 447009

SEQ ID NO: 447167 - RNA, 64 nt, Human
cuacuggauucuuaucagaaauccugcauaaaaagucagccaucuggguucugaucugcuguaa

SEQ ID NO: 447168 - RNA, 64 nt, Human
ggccagccucacucaggcacguaccugcugaccagucagccacugccaacccauggcccagcca

SEQ ID NO: 447169 - RNA, 64 nt, Human
agagguacucccuggucagggacaaguguuuccugucagccaccgagugccugcagaagaucau

SEQ ID NO: 447170 - RNA, 64 nt, Human; identical to SEQ ID NO: 447010

SEQ ID NO: 447171 - RNA, 64 nt, Human; identical to SEQ ID NO: 447011

SEQ ID NO: 447172 - RNA, 64 nt, Human; identical to SEQ ID NO: 447012

SEQ ID NO: 447173 - RNA, 64 nt, Human; identical to SEQ ID NO: 447016

SEQ ID NO: 447174 - RNA, 64 nt, Human; identical to SEQ ID NO: 447017

SEQ ID NO: 447175 - RNA, 64 nt, Human; identical to SEQ ID NO: 447018

SEQ ID NO: 447176 - RNA, 64 nt, Human; identical to SEQ ID NO: 447019

SEQ ID NO: 447177 - RNA, 64 nt, Human; identical to SEQ ID NO: 447020

SEQ ID NO: 447178 - RNA, 64 nt, Human; identical to SEQ ID NO: 447021

SEQ ID NO: 447179 - RNA, 64 nt, Human; identical to SEQ ID NO: 447022

SEQ ID NO: 447180 - RNA, 64 nt, Human; identical to SEQ ID NO: 447023

SEQ ID NO: 447181 - RNA, 64 nt, Human; identical to SEQ ID NO: 447024

SEQ ID NO: 447182 - RNA, 64 nt, Human
cagagccuucuuagugugacaccaaaaccuucuggucagccacagaacacauacagaaaacaga

SEQ ID NO: 447183 - RNA, 64 nt, Human
ggccaaacucagggcucacaggccagcaguccaugucagccacaucaggcacauggaacacagu

SEQ ID NO: 447184 - RNA, 64 nt, Human
ccguggacaccagguggacugguucacuaaucaagucagccauauuguucucuggcuaaguuug

SEQ ID NO: 447185 - RNA, 64 nt, Human; identical to SEQ ID NO: 447025

SEQ ID NO: 447186 - RNA, 64 nt, Human; identical to SEQ ID NO: 447026

SEQ ID NO: 447187 - RNA, 64 nt, Human; identical to SEQ ID NO: 447027

SEQ ID NO: 447188 - RNA, 64 nt, Human; identical to SEQ ID NO: 447028

SEQ ID NO: 447189 - RNA, 64 nt, Human; identical to SEQ ID NO: 447032

SEQ ID NO: 447190 - RNA, 64 nt, Human; identical to SEQ ID NO: 447033

SEQ ID NO: 447191 - RNA, 64 nt, Human; identical to SEQ ID NO: 447034

SEQ ID NO: 447192 - RNA, 64 nt, Human; identical to SEQ ID NO: 447035

SEQ ID NO: 447193 - RNA, 64 nt, Human; identical to SEQ ID NO: 447036

SEQ ID NO: 447194 - RNA, 64 nt, Human; identical to SEQ ID NO: 447037

SEQ ID NO: 447195 - RNA, 64 nt, Human; identical to SEQ ID NO: 447038

SEQ ID NO: 447196 - RNA, 64 nt, Human; identical to SEQ ID NO: 447039

SEQ ID NO: 447197 - RNA, 64 nt, Human; identical to SEQ ID NO: 447040

SEQ ID NO: 447198 - RNA, 64 nt, Human; identical to SEQ ID NO: 447041

SEQ ID NO: 447199 - RNA, 64 nt, Human; identical to SEQ ID NO: 447042

SEQ ID NO: 447200 - RNA, 64 nt, Human
ugagaaccccaggggccgaggaggggcggggaaggucagccagguuugccagaaccaccgagcc

SEQ ID NO: 447201 - RNA, 64 nt, Human
gaaaugguacuucauaauaaacuacacaaggaaagucagccacugugucuuaugaggaauugga

SEQ ID NO: 447202 - RNA, 64 nt, Human
acccgcucuuccuuuucccuucauucccuugagagucagccaugaacggaauaccugcuagguu

SEQ ID NO: 447203 - RNA, 64 nt, Human; identical to SEQ ID NO: 447043

SEQ ID NO: 447204 - RNA, 64 nt, Human; identical to SEQ ID NO: 447044

SEQ ID NO: 447205 - RNA, 64 nt, Human; identical to SEQ ID NO: 447045

SEQ ID NO: 447206 - RNA, 64 nt, Human; identical to SEQ ID NO: 447046

SEQ ID NO: 447207 - RNA, 64 nt, Human; identical to SEQ ID NO: 447050

SEQ ID NO: 447208 - RNA, 64 nt, Human; identical to SEQ ID NO: 447051

SEQ ID NO: 447209 - RNA, 64 nt, Human; identical to SEQ ID NO: 447052

SEQ ID NO: 447210 - RNA, 64 nt, Human; identical to SEQ ID NO: 447053

SEQ ID NO: 447211 - RNA, 64 nt, Human; identical to SEQ ID NO: 447054

SEQ ID NO: 447212 - RNA, 64 nt, Human; identical to SEQ ID NO: 447055

SEQ ID NO: 447213 - RNA, 64 nt, Human; identical to SEQ ID NO: 447056

SEQ ID NO: 447214 - RNA, 64 nt, Human; identical to SEQ ID NO: 447057

SEQ ID NO: 447215 - RNA, 64 nt, Human; identical to SEQ ID NO: 447058

SEQ ID NO: 447216 - RNA, 64 nt, Human; identical to SEQ ID NO: 447059

SEQ ID NO: 447217 - RNA, 64 nt, Human; identical to SEQ ID NO: 447060

SEQ ID NO: 447218 - RNA, 64 nt, Human
uauggucaacacuuaaggguuuuagaaaacagccgucagccaaauguaauugaauaaaguugaa

SEQ ID NO: 447219 - RNA, 64 nt, Human
agaaugcuguuauugggguugugugugagugcccgucagccagugaugccucgggccacgcugu

SEQ ID NO: 447220 - RNA, 64 nt, Human
gccagcuagcccauaacugauagaugcauuagaagucagccagcgcauaggugcucccucuaua

SEQ ID NO: 447221 - RNA, 64 nt, Human; identical to SEQ ID NO: 447061

SEQ ID NO: 447222 - RNA, 64 nt, Human; identical to SEQ ID NO: 447062

SEQ ID NO: 447223 - RNA, 64 nt, Human; identical to SEQ ID NO: 447063

SEQ ID NO: 447224 - RNA, 64 nt, Human; identical to SEQ ID NO: 447064

SEQ ID NO: 447225 - RNA, 64 nt, Human; identical to SEQ ID NO: 447068

SEQ ID NO: 447226 - RNA, 65 nt, Human; identical to SEQ ID NO: 447069

SEQ ID NO: 447227 - RNA, 65 nt, Human; identical to SEQ ID NO: 447070

SEQ ID NO: 447228 - RNA, 65 nt, Human; identical to SEQ ID NO: 447071

SEQ ID NO: 447229 - RNA, 65 nt, Human; identical to SEQ ID NO: 447072

SEQ ID NO: 447230 - RNA, 65 nt, Human; identical to SEQ ID NO: 447073

SEQ ID NO: 447231 - RNA, 65 nt, Human; identical to SEQ ID NO: 447074

SEQ ID NO: 447232 - RNA, 65 nt, Human; identical to SEQ ID NO: 447075

SEQ ID NO: 447233 - RNA, 65 nt, Human; identical to SEQ ID NO: 447076

SEQ ID NO: 447234 - RNA, 64 nt, Human
aagugaggauuagaagugaaugacaauaaagucugucagccaagcacgaaccaagacuggcacu

SEQ ID NO: 447235 - RNA, 64 nt, Human
auauuacauagaguauguuuacaacaaauauccugucagccaaaugguuacccauauaaaaugu

SEQ ID NO: 447236 - RNA, 64 nt, Human
cauuaaacuaauauuuagugggagaccauaaugugucagccaccuugauaaaugacaggguggg

SEQ ID NO: 447237 - RNA, 65 nt, Human; identical to SEQ ID NO: 447077

SEQ ID NO: 447238 - RNA, 65 nt, Human; identical to SEQ ID NO: 447078

SEQ ID NO: 447239 - RNA, 65 nt, Human; identical to SEQ ID NO: 447079

SEQ ID NO: 447240 - RNA, 65 nt, Human; identical to SEQ ID NO: 447080

SEQ ID NO: 447241 - RNA, 65 nt, Human; identical to SEQ ID NO: 447084

SEQ ID NO: 447242 - RNA, 65 nt, Human; identical to SEQ ID NO: 447085

SEQ ID NO: 447243 - RNA, 65 nt, Human; identical to SEQ ID NO: 447086

SEQ ID NO: 447244 - RNA, 65 nt, Human; identical to SEQ ID NO: 447087

SEQ ID NO: 447245 - RNA, 65 nt, Human; identical to SEQ ID NO: 447088

SEQ ID NO: 447246 - RNA, 65 nt, Human; identical to SEQ ID NO: 447089

SEQ ID NO: 447247 - RNA, 65 nt, Human; identical to SEQ ID NO: 447090

SEQ ID NO: 447248 - RNA, 65 nt, Human; identical to SEQ ID NO: 447091

SEQ ID NO: 447249 - RNA, 65 nt, Human; identical to SEQ ID NO: 447092

SEQ ID NO: 447250 - RNA, 65 nt, Human; identical to SEQ ID NO: 447093

SEQ ID NO: 447251 - RNA, 65 nt, Human; identical to SEQ ID NO: 447094

SEQ ID NO: 447252 - RNA, 64 nt, Human
uuuguuaauauuucuucgugaugacauaucacaugucagccacugugauagaggcugaggaauc

SEQ ID NO: 447253 - RNA, 64 nt, Human
guuauuuucagauaacuaagguuuugcuacuaaugucagccauuuacucucccacuaauuggga

SEQ ID NO: 447254 - RNA, 64 nt, Human
agacuaaaaucugagaauuuuuuaacauaugcaagucagccaaacauaagcuaccaaaauaaag

SEQ ID NO: 447255 - RNA, 65 nt, Human; identical to SEQ ID NO: 447095

SEQ ID NO: 447256 - RNA, 65 nt, Human; identical to SEQ ID NO: 447096

SEQ ID NO: 447257 - RNA, 65 nt, Human; identical to SEQ ID NO: 447097

SEQ ID NO: 447258 - RNA, 65 nt, Human; identical to SEQ ID NO: 447098

SEQ ID NO: 447259 - RNA, 65 nt, Human; identical to SEQ ID NO: 447102

SEQ ID NO: 447260 - RNA, 65 nt, Human; identical to SEQ ID NO: 447103

SEQ ID NO: 447261 - RNA, 65 nt, Human; identical to SEQ ID NO: 447104

SEQ ID NO: 447262 - RNA, 65 nt, Human; identical to SEQ ID NO: 447105

SEQ ID NO: 447263 - RNA, 65 nt, Human; identical to SEQ ID NO: 447106

SEQ ID NO: 447264 - RNA, 65 nt, Human; identical to SEQ ID NO: 447107

SEQ ID NO: 447265 - RNA, 65 nt, Human; identical to SEQ ID NO: 447108

SEQ ID NO: 447266 - RNA, 65 nt, Human; identical to SEQ ID NO: 447109

SEQ ID NO: 447267 - RNA, 65 nt, Human; identical to SEQ ID NO: 447110

SEQ ID NO: 447268 - RNA, 65 nt, Human; identical to SEQ ID NO: 447111

SEQ ID NO: 447269 - RNA, 65 nt, Human; identical to SEQ ID NO: 447112

SEQ ID NO: 447270 - RNA, 64 nt, Human
ucucucucuggaaagacccaacuuucucacugcugucagccaagucaugguugguaaccaugua

SEQ ID NO: 447271 - RNA, 64 nt, Human
accuccagccagccucuuccugcagaggaguagugucagccaccuuguacuaagcugaaacaug

SEQ ID NO: 447272 - RNA, 64 nt, Human
cagcaucccgguucccccagacaagagagggcaagucagccaggaacugccuccucccugcucu

SEQ ID NO: 447273 - RNA, 65 nt, Human; identical to SEQ ID NO: 447113

SEQ ID NO: 447274 - RNA, 65 nt, Human; identical to SEQ ID NO: 447114

SEQ ID NO: 447275 - RNA, 65 nt, Human; identical to SEQ ID NO: 447115

SEQ ID NO: 447276 - RNA, 65 nt, Human; identical to SEQ ID NO: 447116

SEQ ID NO: 447277 - RNA, 65 nt, Human; identical to SEQ ID NO: 447118

SEQ ID NO: 447278 - RNA, 65 nt, Human; identical to SEQ ID NO: 447119

SEQ ID NO: 447279 - RNA, 64 nt, Human
gagauacagcugugagagccggauccggaguuaccugagggaggugagcuccuaccccuccacg

SEQ ID NO: 447280 - RNA, 64 nt, Human
aauucagguaugaaagaaaacaggcaaggaggcacugagggagaaagacacagacuuuaucgcu

SEQ ID NO: 447281 - RNA, 64 nt, Human
gauggguaccaggugggguuagguucccagaggacugagggaauccuguacaggaugucccagg

SEQ ID NO: 447282 - RNA, 64 nt, Human
aaugggcccccggcccuggcuuugggaccuugugcugagggaugauuugcuccugaccuugauu

SEQ ID NO: 447283 - RNA, 64 nt, Human
agcuucuucaauacguaaaauuaaauuuauaccacugagggagagacccuuucugaaagaagua

SEQ ID NO: 447284 - RNA, 64 nt, Human
cacaugccucagcgcuguuacuugaaugccuucccugagggaagaggcccuugagucacagacc

SEQ ID NO: 447285 - RNA, 64 nt, Human
cagccuccuugaaguuuacuaacaauugggauaacugagggaagagaagugacaauuccacuca

SEQ ID NO: 447286 - RNA, 64 nt, Human
gacuugaggggggucauauucccuccucagccugcccacgcacuggccuucccuccugccccac

SEQ ID NO: 447287 - RNA, 64 nt, Human
gagaacuacuugaaccugggaggucaaagcugcagucagccaagaucuugccacuguacuccag

SEQ ID NO: 447288 - RNA, 64 nt, Human
ccuaagagccgccaucacuucaggccgcugguuugucagccaucuguugcuucuuauugauaga

SEQ ID NO: 447289 - RNA, 64 nt, Human
guaguguagcucuagagggauauaccccagauggcugagggaagaaagggauugaggugguagg

SEQ ID NO: 447290 - RNA, 64 nt, Human
uccugucuacaucuacagcuguucacuggaagcgcugagggaacaaaugguuggcaugcagccc

SEQ ID NO: 447291 - RNA, 64 nt, Human
aaagccuccuuuuuaauacauuaagugggguagacugagggauuuuagccucuucccucugauu

SEQ ID NO: 447292 - RNA, 64 nt, Human
agugggggcggggaagggugcauagcuguuuuagcugagggacguggugccgacguccccaaac

SEQ ID NO: 447293 - RNA, 59 nt, Human
acauggauaugagugacugaauauugccucugagggaguccaacuguauaccugcauca

SEQ ID NO: 447294 - RNA, 64 nt, Human
gcagaugauaucaggaugugguuuccagcuuugccugagggaauuccaacaugagauuaugggc

SEQ ID NO: 447295 - RNA, 64 nt, Human
gccagugaccagagcacccagggcuggccagucacugagggaacagcgucucggaacugcuggu

SEQ ID NO: 447296 - RNA, 64 nt, Human
ggcaaccccuaagaauagacuaaguuuguguuggcugagggauucuauuugguuugcuuuuuuu

SEQ ID NO: 447297 - RNA, 64 nt, Human
auugcuuuccccagcagcaugaugggaacccaagcugagggauacagguccugauuugguagga

SEQ ID NO: 447298 - RNA, 64 nt, Human
aaggguuagaacagggugucccagacucucucuucugagggaagguugguugcaaaagugggau

SEQ ID NO: 447299 - RNA, 64 nt, Human
gccacugauggcugcgagcuugaagagagggauucugagggagagcuugguccaucuggucacc

SEQ ID NO: 447300 - RNA, 64 nt, Human
ccaggaggcccuggaauaaggaagaggcuucuuucugagggagcuuugaggaauuuugacagcu

SEQ ID NO: 447301 - RNA, 64 nt, Human
cggccacgacagggagagguguagaugccaccaucugagggagaggaacguggaacaggagcag

SEQ ID NO: 447302 - RNA, 64 nt, Human
uaaacaaguaggaacucccugagggcugggcaugcugagggauuuugggacuguucugucucau

SEQ ID NO: 447303 - RNA, 64 nt, Human
ucuucuaucccagacaugggccaaggugcuguaucugagggaugugcuguaauuugauuuacau

SEQ ID NO: 447304 - RNA, 64 nt, Human
cucuuucucuuggucaacucaggagccuuuuagucugagggaauggagaggcaaagaaagaagg

SEQ ID NO: 447305 - RNA, 64 nt, Human
uugaauuaugcuuuguagaguuuugucauucagagucagccaggaccauaccgggucuugauuc

SEQ ID NO: 447306 - RNA, 64 nt, Human
gcccaccuuaucuuccuguacuccagaggcccaagucagccaugcuggugugguccaagcuucu

SEQ ID NO: 447307 - RNA, 64 nt, Human
cuugucuguugcagagugaagcaacauggaugcagucagccaaguccccauggaagucgugcuu

SEQ ID NO: 447308 - RNA, 64 nt, Human
ccaccccagaggcuggcagagggaaagggguacacugagggagaaaggaaaaggaaacuucaaa

SEQ ID NO: 447309 - RNA, 64 nt, Human
agaucugugccguuaauaggcaucgucucucagccugagggaggcuggauucuggguuccugua

SEQ ID NO: 447310 - RNA, 64 nt, Human
uggaagagaggagaggggcuaagacauugcugaucugagggacagaccucuaucaaauagaaga

SEQ ID NO: 447311 - RNA, 64 nt, Human
ugguguauucugcccugcgcaucccacccgaggacugagggaaccuaggggggaccccugggcc

SEQ ID NO: 447312 - RNA, 64 nt, Human
ucucuuggcuucauaaacagcugugaacccuccccugagggauuaacagcaaugaugggcaguc

SEQ ID NO: 447313 - RNA, 64 nt, Human
aggagccuagaggccucaggggaaagucccaauccugagggacccucccaaacauuuccauggu

SEQ ID NO: 447314 - RNA, 64 nt, Human
acccuuucuugccuccccaccccggaagcugaaccugagggagacaacggcagagggagugagc

SEQ ID NO: 447315 - RNA, 64 nt, Human
gugcucagggguggguauccagagagccauacuucugagggaagacuggcuggcaauaaaguca

SEQ ID NO: 447316 - RNA, 64 nt, Human
auaccuggggugagaagaugagaaagaaaugaugcugagggaccuagugaaaucaaugaaacuc

SEQ ID NO: 447317 - RNA, 64 nt, Human
gccuaguucauagaaacugacuggaagcacauugcugagggagguuuguugaauugguuuuuaa

SEQ ID NO: 447318 - RNA, 64 nt, Human
acguagguuccccaccaaaagcaggcuuucugcccugagggacaucuucccacuccccugcucc

SEQ ID NO: 447319 - RNA, 64 nt, Human
cuguaaaggggccugccauagaaaagucacaugccugagggagacacucuguccucauucccug

SEQ ID NO: 447320 - RNA, 64 nt, Human
cacuguuguaggugcuuaggauauucucauguuucugagggauuacagccugggaggauuccac

SEQ ID NO: 447321 - RNA, 64 nt, Human
acacacgagggagggcgcccuugaggcaugcccucugagggagggagaccagagaugcagggau

SEQ ID NO: 447322 - RNA, 64 nt, Human
ucucucucucucucucucucucucuucuuucucucugagggagagggagcccuccaaacuucag

SEQ ID NO: 447323 - RNA, 64 nt, Human
gaaguaaagagacuccugcauuccuccuccccuccugagggaagcccauggacaagcucagucc

SEQ ID NO: 447324 - RNA, 64 nt, Human
agugaugguguugggguagaaauaagcucacucacccacgcaggguacuaaagaucuuacagga

SEQ ID NO: 447325 - RNA, 64 nt, Human
agaacucauuguugaucacacuguugccuuggaacccacgcagaaguaaacucagccacuuugc

SEQ ID NO: 447326 - RNA, 64 nt, Human
uuggucaguauccucuccgucugggugcccagcucccacgcacaccugagcuuucggcaugcuc

SEQ ID NO: 447327 - RNA, 64 nt, Human
ugaucaaaauuguagagcauuuuaaggugaguaccugagggagaacuuaaagacaucuuaguug

SEQ ID NO: 447328 - RNA, 64 nt, Human
ucccuuuccuggaggagccugcugcauucuccugcugagggaucccagagagggcaggugccca

SEQ ID NO: 447329 - RNA, 64 nt, Human
gagggggccgggcuggccaaugggagcugcuuuccugagggacucgaaauucuccggcgggugg

SEQ ID NO: 447330 - RNA, 64 nt, Human
uuguuggcguaggcuacagagaagccuucaagcucugagggaaagggcccuccuuccuaaauuu

SEQ ID NO: 447331 - RNA, 64 nt, Human
aggcuggucucccuccagcuggaauugcugcucucugagggagaggcugugguggcugucucug

SEQ ID NO: 447332 - RNA, 64 nt, Human
ugcccucuggcugccucccagcugggcuuguucucugagggagguuccggagacucauggacuu

SEQ ID NO: 447333 - RNA, 64 nt, Human
ucguugguggcuucagagacagugcugccuccuccugagggagggaagguaccagggagaaccu

SEQ ID NO: 447334 - RNA, 64 nt, Human
agcuuuaacuuaauuugggggauuaacacuuuugcugagggagaaaaagaaaacauacauuaug

SEQ ID NO: 447335 - RNA, 64 nt, Human
aaauucuguaguuugccguaucauccaggaaaaccugagggaaaaaaauuauagcaauuaacug

SEQ ID NO: 447336 - RNA, 64 nt, Human
uuuacuaucuuauaguaauucaggcucuaauuagcugagggaaugaaacacacaaaaaucacug

SEQ ID NO: 447337 - RNA, 64 nt, Human
ccugcgccuuuuuuagcuucagucauggcagcaccugagggacacaaggacuugggugcaucag

SEQ ID NO: 447338 - RNA, 64 nt, Human
gcuggcacuggcacacaccugucccaugcccacccugagggaucaggagcaaacagacccugca

SEQ ID NO: 447339 - RNA, 64 nt, Human
cgccuguuucuguccucacaccacagaaagaaaccugagggaaaacugagacgugagguuccug

SEQ ID NO: 447340 - RNA, 64 nt, Human
gagguccacucagugacaaacacacacugaaggccugagggaagacugaggacaugggcucagu

SEQ ID NO: 447341 - RNA, 64 nt, Human
gggcuggagaaugagagacugcgcucucuuggggcugagggagcaccaugcagcuucaccccuc

SEQ ID NO: 447342 - RNA, 64 nt, Human
ugauucugugucuacauguuauuuugaaguauaucugagggaaaaauaaaugaaaauuuucuuu

SEQ ID NO: 447343 - RNA, 64 nt, Human
gccugaggcucaagcugcccuuaccaccccaucccccacgcaggaccaacuaccuccgucagca

SEQ ID NO: 447344 - RNA, 64 nt, Human
cggccuggcccggccuccuaaaggccacacccuccccacgcacuucccaggccagaauccaaac

SEQ ID NO: 447345 - RNA, 64 nt, Human
ugccaggcgccagggacaccaggaauucgggggccccacgcaccaccuaccuggcuuccugcaa

SEQ ID NO: 447346 - RNA, 64 nt, Human
guagugauuucuaauauauaagaauaagguacuucugagggaauuuuauauuuucagaguuuaa

SEQ ID NO: 447347 - RNA, 64 nt, Human
gcuagcuuccguugccaagucugccucccgcugacugagggaggguaggguuaccuugaacgaa

SEQ ID NO: 447348 - RNA, 64 nt, Human
ggcuaaggauagggaaaggguggaugcucucaggcugagggaggcagaaagggaaaguauuagc

SEQ ID NO: 447349 - RNA, 64 nt, Human
aggaccuguggacagucggccuacuuacucugagcugagggaacacugaacaguaaaagcguca

SEQ ID NO: 447350 - RNA, 64 nt, Human
uggccacccuagacagagacccacccgugauacucugagggagccagacuuucacaugcaacgg

SEQ ID NO: 447351 - RNA, 64 nt, Human
ggcuggcaggggcagugacccuuccaggguaccacugagggaagggccuggguucaagccuccc

SEQ ID NO: 447352 - RNA, 64 nt, Human
cugccaacauuucccuucuuccaguugcacuauucugagggaaaaucugacaccuaagaaauuu

SEQ ID NO: 447353 - RNA, 64 nt, Human
aaccugguagcguguguguguguggcggggggugcugagggaggggagugagucacaggagccu

SEQ ID NO: 447354 - RNA, 64 nt, Human
gugguguuuucagggcacuguguuugccuugcagcugagggauuuucacagugugcuccagaug

SEQ ID NO: 447355 - RNA, 64 nt, Human
cucccaggaacagcuaggugggaaagucccaucacugagggagccuaaccaugucccugaacaa

SEQ ID NO: 447356 - RNA, 64 nt, Human
gucagucuggugggaggacggugcaacccaaggacugagggacucugaagccucugggaaauga

SEQ ID NO: 447357 - RNA, 64 nt, Human
auuucagcauccuggcuccccaggguggcaggagcugagggagggccacacacuggcaagauuu

SEQ ID NO: 447358 - RNA, 64 nt, Human
uggaccgggccuaccgcgaugcgcgcguggaacucugagggaagaguuagccccgguucccagc

SEQ ID NO: 447359 - RNA, 64 nt, Human
agguaugggcugaaugcagccaucugagcaagggcugagggaagccaucaccuaacaccucugg

SEQ ID NO: 447360 - RNA, 64 nt, Human
gcaguugugacucuggggacaaugcagccagaagcugagggaccagcacuuggugccuuggaaa

SEQ ID NO: 447361 - RNA, 64 nt, Human
cagccccagcccagauggcacucagcgcucuccccugagggagucccugggccuagccaucccc

SEQ ID NO: 447362 - RNA, 64 nt, Human
cuccucucccagccucccggagcucugagcacgccccacgcauggugcaggagggacuggacag

SEQ ID NO: 447363 - RNA, 64 nt, Human
gccacuuggcagcauauguagguaccagcucaaccccacgcaaguuccugagcugaacauggag

SEQ ID NO: 447364 - RNA, 64 nt, Human
gcuuuuaaaaaaugacaauuaaaugugcagauuccccacgcacccgaugaccuauuuuuucagc

SEQ ID NO: 447365 - RNA, 64 nt, Human
ccucuuccuccuuccucugggggaggagggguuccugagggaccugacuuccccugcuccaggc

SEQ ID NO: 447366 - RNA, 64 nt, Human
gagggcacagccuugaagugggagugaugagauucugagggacccaugaauuggauugaggcuu

SEQ ID NO: 447367 - RNA, 64 nt, Human
auuuauuuuguauuaacaauaaaaauuccuaagacugagggaaauaugucuuaacuuuugauga

SEQ ID NO: 447368 - RNA, 64 nt, Human
uuacauacagaauugcugacaggagcaggagacgcugagggaaacagcuggcaaugugacaaaa

SEQ ID NO: 447369 - RNA, 64 nt, Human
ucgcuaagacaguaaaaauaaugaucaauaaauacugagggaacucagaggccagcgccggugc

SEQ ID NO: 447370 - RNA, 64 nt, Human
gggcugcuaugccuguguguaaacuuggggauggcugagggaacauagacucacucuuccacau

SEQ ID NO: 447371 - RNA, 64 nt, Human
gggaugaggaaguaggguuaaacuccccaguuuccugagggaggcuccugacaggugcccuuug

SEQ ID NO: 447372 - RNA, 64 nt, Human
ucuguucucuggcaucaaguuucuugcagcugcucugagggagagacagugagcugcaagacug

SEQ ID NO: 447373 - RNA, 64 nt, Human
aguuccggaaagccuuccucaagauccugucuugcugagggagcagaagagggaacacucuuug

SEQ ID NO: 447374 - RNA, 64 nt, Human
aaaagugaugucuuugcacaggugagacuuugcacugagggaagggaaagggugaggauuuugg

SEQ ID NO: 447375 - RNA, 64 nt, Human
uucacaugauggagguaugaggccuccgagauagcugagggaaguucuuugccugcugucagag

SEQ ID NO: 447376 - RNA, 64 nt, Human
guaggagugagaagaaggaagaucuugagagcugcugagggaccuuggagagcucaggauggcu

SEQ ID NO: 447377 - RNA, 64 nt, Human
cuucauggacgagaugaaugaggauucugcugcccugagggaguucauuggaaaccugcguucu

SEQ ID NO: 447378 - RNA, 64 nt, Human
ggguuuccauccuugagauucugaaguaugaagucugagggaaaccagagucuguauuuuucua

SEQ ID NO: 447379 - RNA, 64 nt, Human
uggccagccauggcuuaggacuccaacagccacucugagggaggggagaagggagcagaggcca

SEQ ID NO: 447380 - RNA, 64 nt, Human
gaaguuuauuuguugaauagcacaacucuuuaaccugagggagucaucuacuuuuuuuuccucc

SEQ ID NO: 447381 - RNA, 64 nt, Human
ccgccccgggcaggggggcggcgggugggcccgccccacgcacgcacgcacacucggggacuuu

SEQ ID NO: 447382 - RNA, 64 nt, Human
cacgcaccacugcuucccacuggggccggcggggcccacgcacgacgucagccucuuaccuucc

SEQ ID NO: 447383 - RNA, 64 nt, Human
ggacaugggauuccucccugcgaugcgugucuuucccacgcagagaagcccagucucuucucug

SEQ ID NO: 447384 - RNA, 64 nt, Human
acaaauccagaauggugaaagaguccaacaauggcugagggaaguagagguuaagauauagcuc

SEQ ID NO: 447385 - RNA, 64 nt, Human
cgccccucccccuacagauccuccgcggaggccccugagggacgagcagagcgcagcccccacg

SEQ ID NO: 447386 - RNA, 64 nt, Human
cccucccccagccugccuagaaagggguggcugccugagggagucacuuguaugguccccaggg

SEQ ID NO: 447387 - RNA, 64 nt, Human
aauaauaaagaugaaaagagaagguacccuaaggcugagggaaagaauccuaacaaggaaaggc

SEQ ID NO: 447388 - RNA, 64 nt, Human
gauuagcagaguggaggagucggcucugagagcucugagggagaagcuguuugcucauucuuca

SEQ ID NO: 447389 - RNA, 64 nt, Human
ugaauccugguaaacaauaaagaagauucagacacugagggaaaaaaauaaagcuuuuuacuua

SEQ ID NO: 447390 - RNA, 64 nt, Human
uuuuuuaaagagaacacuggacaacauuuuacuacugagggaaauagccaaaaaggcaaauaau

SEQ ID NO: 447391 - RNA, 64 nt, Human
aaaucaauggcauuaaugaggagcacauucuuugcugagggaaauaacaguuuuuccaggcccu

SEQ ID NO: 447392 - RNA, 64 nt, Human
agaaaacuguccuaauuuagaauuucccucaaaucugagggacuuuuaagaaaugcuaacagau

SEQ ID NO: 447393 - RNA, 64 nt, Human
ugggccugagagaccauagggagguuggggcucacugagggauuggcugaggauguauaaagca

SEQ ID NO: 447394 - RNA, 64 nt, Human
ucuguguggagccuuuacgaggccaccugccucucugagggaucuaaacaacugggagggaggg

SEQ ID NO: 447395 - RNA, 64 nt, Human
gggugaaucauaaagccagugaaaauuucacccucugagggaguuccccaaucugaaggggaag

SEQ ID NO: 447396 - RNA, 64 nt, Human
ccauuccaauuccauuuucugaugcagauuuuagcugagggauuuggaagccauuuggggaggc

SEQ ID NO: 447397 - RNA, 64 nt, Human
aggcagaccuggucagacccagcgccccuccucccugagggagcauggcacagccucacacuug

SEQ ID NO: 447398 - RNA, 64 nt, Human
gaugcacuaaccucccaaccugauuuccccgaaucugagggaaggugagggagugggaaggggg

SEQ ID NO: 447399 - RNA, 64 nt, Human
acagagcugcccaggcuuucuggaagcuucuggucugagggaggugucuccgaggauccuuuug

SEQ ID NO: 447400 - RNA, 64 nt, Human
ugaccacagcuggcagucaagccacagcuggagggucagccaccaagcugggagcugagccaga

SEQ ID NO: 447401 - RNA, 64 nt, Human
gauuagagugagugugcucuguugcugugaugcugucagccacagcuuccugccguagagaaug

SEQ ID NO: 447402 - RNA, 64 nt, Human
accaaacgauuaacagugucaccgugucacuucagucagccaucucaauaagcucuuacugcua

SEQ ID NO: 447403 - RNA, 64 nt, Human
gaaguuucugcagcagaugcuuuugguccagguacugagggacaaguagaaagauuugaaacag

SEQ ID NO: 447404 - RNA, 64 nt, Human
ucuugcuuuucuuuccauuugacuugcuguaagccugagggagagccaacaagacuuacugcau

SEQ ID NO: 447405 - RNA, 64 nt, Human
ggauggguggcuuuaacaguuucacagcaggacacugagggaauauuucccuaucccuucaaau

SEQ ID NO: 447406 - RNA, 64 nt, Human
gacccuccccggcucuggggccagucgagagccacugagggacccagcacucagagacacaaca

SEQ ID NO: 447407 - RNA, 60 nt, Human
cuauuuuggggaagacaugaaagcgcugagcugagggacgaggaagagcuggagcccgca

SEQ ID NO: 447408 - RNA, 64 nt, Human
gcuacagcauggccaggccugguuugaagaccaucugagggaggcacagcgacagcagcugcau

SEQ ID NO: 447409 - RNA, 64 nt, Human
cuacguagcaacagugucuguguugcccgagcugcugagggaggcaucaccauugcaaucacuu

SEQ ID NO: 447410 - RNA, 64 nt, Human
gcucuucggguuccaccaaagagucuccugagcccugagggauggaugucuccugacccuucca

SEQ ID NO: 447411 - RNA, 64 nt, Human
cgggcugugccagcccucccagccccaggcccaucugagggaccaagacgcuguuacgcaggcc

SEQ ID NO: 447412 - RNA, 64 nt, Human
agaauaccauacuacacaaugaucucugauuuugcugagggaaggaauuauauaugugccacuu

SEQ ID NO: 447413 - RNA, 64 nt, Human
agaggguuguuuuaggagcaugccacgggaaagacugagggaucaugaucauuuguucagaaaa

SEQ ID NO: 447414 - RNA, 64 nt, Human
uuaauauucacuuuggugcuacuacccccauuaccugagggaaacuggccagguccuugaucau

SEQ ID NO: 447415 - RNA, 64 nt, Human
gagccuguugucuagaauauuuuccugaccaagacugagggaugggcuggagguuuucaacuuu

SEQ ID NO: 447416 - RNA, 64 nt, Human
cccacccaggccuggagcugggaugcaauguaggcugagggaaagacgucagguuccuuuaauc

SEQ ID NO: 447417 - RNA, 64 nt, Human
gugccaaacuugguguggccaggaaagggcaguccugagggagaagacaggauucagggcagug

SEQ ID NO: 447418 - RNA, 64 nt, Human
aggacccucccaccauccccuucugcuguaaccucugagggagcuggcugaaagggcaaaaugc

SEQ ID NO: 447419 - RNA, 64 nt, Human
aagguugggauucucugugcagagacuuugguuccccacgcagcccuggggcuuggaagaagca

SEQ ID NO: 447420 - RNA, 64 nt, Human
gcguuccuucgcacacugugauuuugcccuccugcccacgcagaccugcagcgggcaaagagcu

SEQ ID NO: 447421 - RNA, 64 nt, Human
agugacugaccccuguccugccccuccagaguaccccacgcacccccaggaccuucgccgucuc

SEQ ID NO: 447422 - RNA, 64 nt, Human
aacaaaauaaaauacaaauuuaccuuucuuuuaucugagggagugggcuggucuguugugacuu

SEQ ID NO: 447423 - RNA, 64 nt, Human
cuuacaucauagauaaauuuuagcuucccaguaacugagggauuuguuuccuaacgccauugga

SEQ ID NO: 447424 - RNA, 64 nt, Human
gcuggggccgcucugugcuggcgccugcuggccacugagggacagggacacgugccaccugcuc

SEQ ID NO: 447425 - RNA, 64 nt, Human
uuaucugggugggcucagugaccccuuggaauggcugagggaggcaggagagccuggaaagauu

SEQ ID NO: 447426 - RNA, 64 nt, Human
acguuugaaaaacacuauuagucuuucuaacacacugagggaaagauuaaaaucuguggaauaa

SEQ ID NO: 447427 - RNA, 64 nt, Human
uugcacacgccuguaaucccagcuacucaggaggcugagggaggagaaucccuugaacccggga

SEQ ID NO: 447428 - RNA, 64 nt, Human
ugccuugugugaacaccagugcacugguggcuuccugagggacugagguaagucugccagaaag

SEQ ID NO: 447429 - RNA, 64 nt, Human
agccucgucaacaccacuuugcagcauucagcugcugagggauuaucgggauggagaguaggag

SEQ ID NO: 447430 - RNA, 64 nt, Human
augaaaaccaucccguccccauuccuccuccucucugagggacuggagggaagccgugcuucug

SEQ ID NO: 447431 - RNA, 64 nt, Human
uuguuucccaggaaggccauugcaguuugacuggcugagggauacagagaugaaauuguaaacu

SEQ ID NO: 447432 - RNA, 64 nt, Human
aaccaaaauuguguuagucucaauuccuaccacacugagggagccucccaaauaacuauuuucu

SEQ ID NO: 447433 - RNA, 64 nt, Human
uaauaaacagcaaaccaauaucuaggaagaaugacugagggauaguauuggguauuggccccau

SEQ ID NO: 447434 - RNA, 64 nt, Human
accuuggccagaguggggaggguggccagccacucugagggacagaacguccucuuguguauaa

SEQ ID NO: 447435 - RNA, 64 nt, Human
guaaauuuuggggcuuugggaguacacaggacuacugagggacggggaguugguggcuuggugu

SEQ ID NO: 447436 - RNA, 64 nt, Human
uggugcugcuuuucagguuaggggagagguggcccugagggacagcccagcucugagucucagu

SEQ ID NO: 447437 - RNA, 64 nt, Human
uuugagcugcuggcuuuguucucucaagucaggucugagggaacccaucggcuucuguaauaau

SEQ ID NO: 447438 - RNA, 64 nt, Human
agacccugaacucagaaggcugugugucuucugccccacgcacgcacccguaucugcccuccuu

SEQ ID NO: 447439 - RNA, 64 nt, Human
cugcgcguuccuccgaaucccgucggcuucucgacccacgcagagaagccccgggcuuggcggc

SEQ ID NO: 447440 - RNA, 64 nt, Human
guaaacaaaagauaauuuucuagcauuaauaugccccacgcaauauuuggaacacuuaugugaa

SEQ ID NO: 447441 - RNA, 64 nt, Human
ucugaaucugucaagcuucaagaauaccagagaacugagggaaaauaccaaauguaguuuuaua

SEQ ID NO: 447442 - RNA, 64 nt, Human
guacaguuaggaaaguuuuuuucuuacaccgugacugagggaaacauugcuugucuuugagaaa

SEQ ID NO: 447443 - RNA, 64 nt, Human
aacuuaacaauuaauuuucuaugaauugcuaauucugagggaauuuaaccagcaacauugaccc

SEQ ID NO: 447444 - RNA, 64 nt, Human
uuccccugaccaaaacuccuucccuguaguccagcugagggacacacaucccugggcccucuuc

SEQ ID NO: 447445 - RNA, 64 nt, Human
cuccugggcuccuccccaucccccgugucucucacugagggaaagaaaauccccaagggcacug

SEQ ID NO: 447446 - RNA, 64 nt, Human
ugagcuuuuauauauggaacuuacuccaacaggacugagggaccaaggaaacaugaugggggag

SEQ ID NO: 447447 - RNA, 64 nt, Human
uguuguucacggguggccuggcucacacuuggcucugagggacagguguggcgagaccugauuu

SEQ ID NO: 447448 - RNA, 64 nt, Human
cuuuuuugacauauguaugccuuaauucuuaaaucugagggaccaugcuuugaaauagacugaa

SEQ ID NO: 447449 - RNA, 64 nt, Human
gugaguuuggucuggacugacagcaugugcccuccugagggaggaccuggggcacaguccagga

SEQ ID NO: 447450 - RNA, 64 nt, Human
uaggauuuggcagccuuccagaaugguauggaaucugagggaagauuuauguuucguuuuggag

SEQ ID NO: 447451 - RNA, 62 nt, Human
aguuccaaguucgaaccugaagggagcauuugcugagggaauagucuugcacauuuuuucau

SEQ ID NO: 447452 - RNA, 64 nt, Human
ccccacacugaagucuagggguugcgaaucccuccugagggagaugcuugaaggcaugccugga

SEQ ID NO: 447453 - RNA, 64 nt, Human
aaacauacugauguucauacaaaccagcagagugcugagggacgauauguacuauuacaaaacc

SEQ ID NO: 447454 - RNA, 64 nt, Human
auuuugcaaucccagucgguaugcuuucuaaaaacugagggaaacuuacuggggaaauagaaua

SEQ ID NO: 447455 - RNA, 64 nt, Human
gacacccagagcagaagcuagggcagagccaaugcugagggagccucgacuuccggcgccgccg

SEQ ID NO: 447456 - RNA, 64 nt, Human
gcaagcagaauuaugcauagaaauuguggcagggcugagggaguugacugcaggcaguuuuuag

SEQ ID NO: 447457 - RNA, 64 nt, Human
aaacacugcuaaaggccuugcaauugcugcuuuacccacgcaucucuugcuuucaagauggacu

SEQ ID NO: 447458 - RNA, 64 nt, Human
ggcucaguauugugaccgcggagccacaggggaccccacgcacauuccguugccuuacccgaug

SEQ ID NO: 447459 - RNA, 64 nt, Human
acuguggggguugcgcacagccagccgcguggaucccacgcagcgcugaaccgaaccgaguagg

SEQ ID NO: 447460 - RNA, 64 nt, Human
gagagauuaaaccuagguucagagcaugggugcucugagggacaaaguuggauuaguauaaggg

SEQ ID NO: 447461 - RNA, 64 nt, Human
acaauaguagucucaagaauggaaaccugaaugucugagggaaugggcugguagacuuuuucga

SEQ ID NO: 447462 - RNA, 64 nt, Human
gaaagggguuaacuucagccaggauugauggcagcugagggaaauucuugcccaacuaaaccca

SEQ ID NO: 447463 - RNA, 64 nt, Human
cacaccuggggugauggcuuaaagccagaaagagcugagggaguuaagagggccaaccuuaggg

SEQ ID NO: 447464 - RNA, 64 nt, Human
cccagccuuacagcagaugcugaaggcagagcagcugagggaggggcgcuggccacaugucacu

SEQ ID NO: 447465 - RNA, 64 nt, Human
cugugccucuguguaccccuccacccgcugcgggcugagggaggugcagggccuucucugaccc

SEQ ID NO: 447466 - RNA, 64 nt, Human
cccaacggcaucccaaggccaggugggcccucagcugagggaagguacgagcucccugcuggag

SEQ ID NO: 447467 - RNA, 64 nt, Human
aaggacacugauggguccugcugcucgggaaggccugagggaagcccacccgccccagagacug

SEQ ID NO: 447468 - RNA, 64 nt, Human
uuggagaaccuuuccuucaagcagaaacaagcaacugagggaaaaagaaacacaacaauaguuu

SEQ ID NO: 447469 - RNA, 64 nt, Human
gacauuccaggggucguuugcuuuucaggguuuucugagggaaagugcauaugaaauccuugac

SEQ ID NO: 447470 - RNA, 64 nt, Human
ccuguuguauuuuuuuuuuuccuguauuuugguucugagggaugaguaauguguuuuuaguugg

SEQ ID NO: 447471 - RNA, 64 nt, Human
ggaguaugaucccuaacuccugauuuggaugcaucugagggacaaggggggcggucuccgaagu

SEQ ID NO: 447472 - RNA, 64 nt, Human
agcagggaagaucugggggacagaggaaggccuccugagggaggggcaggagagcagugaggag

SEQ ID NO: 447473 - RNA, 64 nt, Human
gagacucacccccaccaacaccguccagagaggccugagggagggauuccaugcugccuucucc

SEQ ID NO: 447474 - RNA, 64 nt, Human
ggggaggguagcaccaggcauagccacuuuugcccugagggacuccuguguacuucacaucacu

SEQ ID NO: 447475 - RNA, 64 nt, Human
uuguggagaccagcacuuagggugggcggggcuccugagggagcuccaacucagaagggagcua

SEQ ID NO: 447476 - RNA, 64 nt, Human
acccaugguccagucucccagcagcagcaacauccccacgcagccccccagcaaguccucuggc

SEQ ID NO: 447477 - RNA, 64 nt, Human
agcucauagccacacacccagggccugacugaggcccacgcaggaaccgacacucagacacaag

SEQ ID NO: 447478 - RNA, 64 nt, Human
cagaaucaggcagaauccacuucccaaacagagccccacgcagguucaccaugaaccucagggu

SEQ ID NO: 447479 - RNA, 64 nt, Human
cuuacagccccugaguccuacacccagaaggcggcugagggaacugaggccagcauuuuuccuc

SEQ ID NO: 447480 - RNA, 64 nt, Human
cccuccauccacccgggggagcccagugaagccucugagggauugaggggcccuggccaggacc

SEQ ID NO: 447481 - RNA, 64 nt, Human
aguccagcguggccuacacggauauggggagccacugagggauguuuuccccccuugcuugugc

SEQ ID NO: 447482 - RNA, 64 nt, Human
gagcugcagcaguccuagaguuuuccaggggguucugagggaaucuuugguccccaguacucau

SEQ ID NO: 447483 - RNA, 64 nt, Human
cccacugccgaccgcacagcucccucucugggggcugagggacccaccuggccccuccucugac

SEQ ID NO: 447484 - RNA, 64 nt, Human
ccaggggucugagggcaccuggcuguguucccagcugagggagggcuggggcgggggccgggcu

SEQ ID NO: 447485 - RNA, 64 nt, Human
ccuucuucaguuuuaacgaguaauuggauaaacccugagggaaaacggagguagauucagcacc

SEQ ID NO: 447486 - RNA, 64 nt, Human
gacagcuuuuucugagacacagcugccagcaaaccugagggaaagagagaagauuagugcucgg

SEQ ID NO: 447487 - RNA, 64 nt, Human
ugaauaagucagcuagggauucuugcagucucagcugagggagaaagguagggcugugccuucu

SEQ ID NO: 447488 - RNA, 64 nt, Human
acugaacuuuugggguggagacuagaggcaggagcugagggacugauuccugugguuggaaaac

SEQ ID NO: 447489 - RNA, 64 nt, Human
cggaucaagucacuuagaucgcuccuugguauuccugagggacaaacuagagaucaguugacaa

SEQ ID NO: 447490 - RNA, 64 nt, Human
uuuccucuccacugcuggacaugagauggagaggcugagggacaggaucuauaggcagcuucua

SEQ ID NO: 447491 - RNA, 64 nt, Human
aaagcggugaccacucaggccagcccagacaaaucugagggauggccagugcacuccaaugaug

SEQ ID NO: 447492 - RNA, 64 nt, Human
ggugaauguacccuuucuuucccucccugcagcucugagggagccccugaccuuguagugggug

SEQ ID NO: 447493 - RNA, 64 nt, Human
cauugugcccagcugggacucuugggcucugugccugagggaaaauguuucacaacuaguggcu

SEQ ID NO: 447494 - RNA, 64 nt, Human
cugcaacuauuccggcuuuuuauauggcaccuuucugagggaggggauuuuacagccgagggac

SEQ ID NO: 447495 - RNA, 64 nt, Human
caggggaaaagagaguuaaggacacucacccccacccacgcacacacacaaggcagcgucgggu

SEQ ID NO: 447496 - RNA, 64 nt, Human
gccggcaucaccugcggccacaccugagauggaccccacgcagcccugaucgcaggaggccugg

SEQ ID NO: 447497 - RNA, 58 nt, Human
cggccagcauccgcgagugagcagucugcccacgcagaggacgcacgcucgcugccau

SEQ ID NO: 447498 - RNA, 64 nt, Human
gccuuggagcaccucacgcugggggaaucaaucccugagggacucagaaucuucuccgugcaac

SEQ ID NO: 447499 - RNA, 64 nt, Human
acuguugaguuagcgccgacucuuccuguggagucugagggaggggcuccauucaggcaaaggg

SEQ ID NO: 447500 - RNA, 64 nt, Human
cacuuugugugucuccucuuaauugaagggagggcugagggauguuuucucuucuugucuugug

SEQ ID NO: 447501 - RNA, 64 nt, Human
ggaagguguucaauaaaaauucaaauaauuuguacugagggaaacaguuauacuacaaaucaug

SEQ ID NO: 447502 - RNA, 64 nt, Human
ucaauccagcuauguuauauugaaaaaauagagccugagggaucuuuacuaguuauaaagauac

SEQ ID NO: 447503 - RNA, 64 nt, Human
guauucucugagcugugcagguggggagacugggcugagggagccuggccccauggucagcccu

SEQ ID NO: 447504 - RNA, 64 nt, Human
gcuggccuuggugucaugccagaaucuaccaggacugagggagccagaggaguccuauaggcag

SEQ ID NO: 447505 - RNA, 64 nt, Human
aggacagauguugccccacccacuggagauggugcugagggagguggguggggccuucugggaa

SEQ ID NO: 447506 - RNA, 64 nt, Human
uuuuuuuuuuguuguuguuguuguuuuacggucucugagggaauauaguaaaaaugcauaugca

SEQ ID NO: 447507 - RNA, 64 nt, Human
ugggagggugccccgucugacaccccugggguugcugagggaacgguuggaguggggaucggcc

SEQ ID NO: 447508 - RNA, 64 nt, Human
ccuugugucccugccgcugaagaauggggcugcucugagggaaacgcugucugcugccuucaua

SEQ ID NO: 447509 - RNA, 64 nt, Human
augccugucuaaaaaugaauccaguguugccuuucugagggauuucugcucaaugcaauacacu

SEQ ID NO: 447510 - RNA, 64 nt, Human
accggccuuccuuuggaggaaaguguggccuggacugagggaggaaaugagcgaguucccucug

SEQ ID NO: 447511 - RNA, 64 nt, Human
gggucacgagacugagucuacaggagcuuugggccugagggaaggcacaagagugcaaagguuc

SEQ ID NO: 447512 - RNA, 64 nt, Human
ggguccugggaccuucucgcgcuccuccuggccucugagggaugcguccuacccgcgccaucgc

SEQ ID NO: 447513 - RNA, 64 nt, Human
ugcugccggagccgggcuucggcagucuucuccacugagggacugggcugggaaguccugcguu

SEQ ID NO: 447514 - RNA, 64 nt, Human
gggaccugcaucugaugcuggggccagggacucucccacgcacgagcuagugaguggcacacca

SEQ ID NO: 447515 - RNA, 64 nt, Human
uaugcauauauauauauaaauuauaaauagauuccccacgcagugugguggcaucucuguacag

SEQ ID NO: 447516 - RNA, 64 nt, Human
caucuccauuugaucaucuccuccaaugaggaaacccacgcaccuuccuuaguaaugaaauccu

SEQ ID NO: 447517 - RNA, 64 nt, Human
accaggauguuggccuggggaggccacagcagggcugagggaacucugcuaugugauggggacu

SEQ ID NO: 447518 - RNA, 64 nt, Human
aaacacggucccugcccacagugcuuagggccuacugagggaaagaaguaaccaggcaacuaca

SEQ ID NO: 447519 - RNA, 64 nt, Human
ggggagcuccagaaggucaccagagagcuuucagcugagggagaguucucuagguuggaguggg

SEQ ID NO: 447520 - RNA, 64 nt, Human
uaaacuacuaacuaauguggggguuuaauaguaucugagggauuugguggcuucauguaauguu

SEQ ID NO: 447521 - RNA, 64 nt, Human
gccaacagaucugaacuaaugcuaacagaucccccugagggauucuugaugggcugagcagcug

SEQ ID NO: 447522 - RNA, 64 nt, Human
guucccagcacguuucucauauagcccucagucacugagggagucccccgcaggauuggagagg

SEQ ID NO: 447523 - RNA, 64 nt, Human
gaaugccugggagugggggugcaggcgggcagcacugagggacccugccccgccccucccccca

SEQ ID NO: 447524 - RNA, 64 nt, Human
ccgacgccgcccucggcccagaccucggugaucacugagggauuuccgcgagcucggccucacu

SEQ ID NO: 447525 - RNA, 64 nt, Human
acacaagccccacaggcuggggggcuccgguucccugagggaugagccuucagccucccuuugu

SEQ ID NO: 447526 - RNA, 64 nt, Human
gaggaugucuacgcccaggcgagcuccucgaccucugagggaccaucuccccgaccacugccca

SEQ ID NO: 447527 - RNA, 64 nt, Human
agaggcugggacuugguugggcaugcugugguugcugagggaugagggggaggagagagguagg

SEQ ID NO: 447528 - RNA, 64 nt, Human
acaggagcagugugacaugagguggccugaacaccugagggacuggacaucccauguucagcaa

SEQ ID NO: 447529 - RNA, 64 nt, Human
gcaggggaagaccaccuggcaugagggagaggggcugagggauggacuucagccccucugcucu

SEQ ID NO: 447530 - RNA, 64 nt, Human
aaucaaacccgcaucccagcauugggccacccaucugagggaggccaaaaucaucacagaugcu

SEQ ID NO: 447531 - RNA, 64 nt, Human
aguuagcaaaccuugaugaagcaccugcuggacacugagggacccaaagcucaaucagccauaa

SEQ ID NO: 447532 - RNA, 64 nt, Human
uagguuaccaacuaagcagcuuuugcucuuaguacugagggaugaaaguuccagagcauuauuu

SEQ ID NO: 447533 - RNA, 64 nt, Human
ugggggacaaaauaaaauuaaucuuuuaaaaugugucagccauauguauggggcuuccauuugg

SEQ ID NO: 447534 - RNA, 64 nt, Human
cagcaucuccuggccuggccugaccgggcuuccugucagccaggcugcccuuaucagcuguccc

SEQ ID NO: 447535 - RNA, 64 nt, Human
cacaggauccguuaacguuaauacccaauacucugucagccacuguaggcucuaagaaccacgu

SEQ ID NO: 447536 - RNA, 64 nt, Human
ucuaaaugcuuuaucauuuuuuccugagaugcuucugagggaugcugaccucccacuaugggga

SEQ ID NO: 447537 - RNA, 64 nt, Human
ucggcccgccgggucgguuccuggcuggugucugcugagggaguggggggcccagccccuucuc

SEQ ID NO: 447538 - RNA, 64 nt, Human
uuaagggaaggucaagagggagaugggcaaggcgcugagggaggaugcuuaggggacccccaga

SEQ ID NO: 447539 - RNA, 64 nt, Human
auuaucuagguaggagggcuuuucuauacauuuucugagggaaagcagaacaccgggguuauag

SEQ ID NO: 447540 - RNA, 64 nt, Human
ugcgagacuuacacucaagcaauccugaggaauacugagggagggccuggcuacugucucucug

SEQ ID NO: 447541 - RNA, 64 nt, Human
cacaccaugagaauggaggcaggaauugagcugacugagggaagaugcaccuugaucucacccu

SEQ ID NO: 447542 - RNA, 64 nt, Human
caucaacgaggagaugcagcgcaugcucaaccagcugagggaguaugauuuugaggacgacugu

SEQ ID NO: 447543 - RNA, 54 nt, Human
ugcugggaccccuuagauaggccucugagggagcucugacugccguuuccccaa

SEQ ID NO: 447544 - RNA, 64 nt, Human
uggagacagaaaguagaauagugguugccaaugucugagggagguugaaauaggagaugaccuc

SEQ ID NO: 447545 - RNA, 52 nt, Human
agcgccgagggaccaaaugagacugagggaagaaaaaaaaucucuuuuuuuc

SEQ ID NO: 447546 - RNA, 64 nt, Human
gggucaguagcagaagcagagggaggccucuugccugagggauuaaaauggcagcuugccaugc

SEQ ID NO: 447547 - RNA, 64 nt, Human
cuaaggucagggcccagggccccccacagcauggcugagggaccccuucccaguagggcugucc

SEQ ID NO: 447548 - RNA, 64 nt, Human
uauuacuguuuauuacuuccaugaauuuuaaaaucugagggaaauguuuuguaaacauuuauuu

SEQ ID NO: 447549 - RNA, 64 nt, Human
augggaauuuuguguaaaauaaaagauaacaugccugagggagagccuggugccuuugcuauga

SEQ ID NO: 447550 - RNA, 64 nt, Human
guaauucacagaauggccucuugugggggugggucugagggaagucagcuauaaaacauuugcu

SEQ ID NO: 447551 - RNA, 64 nt, Human
accuucuucaaaucuuuguauuucaaagaaggugcugagggaucuguuuccuugcccuggcuuc

SEQ ID NO: 447552 - RNA, 64 nt, Human
uugucccguccccacauacccucguccccauguccccacgcagggcucuccuucgucuuaggau

SEQ ID NO: 447553 - RNA, 64 nt, Human
gagaggccgucacagccccagaccacccgcuuggcccacgcagcagcagagccgccguuugcug

SEQ ID NO: 447554 - RNA, 64 nt, Human
uugagaggagagcgcuggccaugccaggagagaacccacgcacaugcacaccacaacacacaac

SEQ ID NO: 447555 - RNA, 64 nt, Human
agagacaagcacgucaagguguuuucacagcccccugagggaagggacgcagggucuccgacag

SEQ ID NO: 447556 - RNA, 64 nt, Human
gggagcuccggcuucucguccuccggucuccacccugagggagcaccgacccggugccgccgga

SEQ ID NO: 447557 - RNA, 64 nt, Human
augauuuuugagguccugucuaaacccugugucccugagggaucugucucacuggcaucuuguu

SEQ ID NO: 447558 - RNA, 64 nt, Human
aacauuuacuggugcucaccuaggauuggcuauucugagggauugcauagaaaccaagcuccac

SEQ ID NO: 447559 - RNA, 64 nt, Human
gacagaaacagagagagacagagacagagagagacugagggagagacucugaggacauggagag

SEQ ID NO: 447560 - RNA, 64 nt, Human
cugggcacuagugcuaguagauauuacuacccuccugagggaaaucagaaaugauuuaaccccg

SEQ ID NO: 447561 - RNA, 56 nt, Human
ccuugcaaauuacgaccugaaaauggcugagggagggggcuaagagaggagcaaag

SEQ ID NO: 447562 - RNA, 64 nt, Human
aaugagguucuauuauaaagguucuacuuuuaaucugagggaaaacauguucagggcuucuaga

SEQ ID NO: 447563 - RNA, 64 nt, Human
aagaaaugccuccccaggucugucucuggaggcucugagggagaugggcuugggggcuguagga

SEQ ID NO: 447564 - RNA, 64 nt, Human
gacuagaaauuuauccuaaacagauggucuuucucugagggaaaaaaaaaaaugugucauguga

SEQ ID NO: 447565 - RNA, 57 nt, Human
cuaucaaaaagcuaacaugacaaggaccugagggaaccaggauuccucccuccuacc

SEQ ID NO: 447566 - RNA, 64 nt, Human
aguucuugcugccccuucucuggcugugcuuugccugagggaagaguuggcaagaggccagaau

SEQ ID NO: 447567 - RNA, 57 nt, Human
gcauggaagaaguagacuaaucucuggcugagggaugacuuaccuguucaguacucu

SEQ ID NO: 447568 - RNA, 64 nt, Human
gucguggugcaggcaggcccuguggccugcugggcugagggaagucagagccccagggcgccac

SEQ ID NO: 447569 - RNA, 64 nt, Human
ccgaaaaguagucuucucugaggcugggccaagccugagggaaauggggcccuaggaggguggg

SEQ ID NO: 447570 - RNA, 64 nt, Human
guuaugcguuuugacaauugcgcuauccuacacucugagggaguuggcaacgcaugcgguauag

SEQ ID NO: 447571 - RNA, 64 nt, Human
gaugaauaugagcucauuaguaaaaaugacuucacccacgcauauacauaaaguauccaugcau

SEQ ID NO: 447572 - RNA, 64 nt, Human
cugcggggugugaggacugagccggcuuccccuucccacgcagcucugggaugcagcagccgcu

SEQ ID NO: 447573 - RNA, 64 nt, Human
uaauuuuugcuucaagcucuguagcaggaccugccccacgcacaccccuaccccucugugagga

SEQ ID NO: 447574 - RNA, 64 nt, Human
uuccccauuuguuggauggcugcaaucucagugccugagggaagaugccuaguagaggaaagcu

SEQ ID NO: 447575 - RNA, 64 nt, Human
gaguacaaagcccuaaguuuauuguaagugaaaacugagggaauuccugucuucuuuaggagua

SEQ ID NO: 447576 - RNA, 64 nt, Human
cauccaggcagucgggggcuggccuaggagauaucugagggaggaggccaccucuccaagggcu

SEQ ID NO: 447577 - RNA, 64 nt, Human
accgacagaccgcauuccacccccaacaucggcacugagggacaucgggggcaaguuugcagug

SEQ ID NO: 447578 - RNA, 64 nt, Human
gaccaacuaaaugacagaugugugagaacaagaacugagggaaagcaccuucccccaccccaga

SEQ ID NO: 447579 - RNA, 64 nt, Human
uggcucaugccuguaaucccagcacuuugggaggcugagggagguagaucaccugaggucagaa

SEQ ID NO: 447580 - RNA, 64 nt, Human
agguggguguugaacuaggggggauauugcuguccugagggacccucucauuucugacauuuga

SEQ ID NO: 447581 - RNA, 64 nt, Human
gugcuuuaugauggcagcaggggcuggggagccucugagggacucuuucauucugcaguugucu

SEQ ID NO: 447582 - RNA, 64 nt, Human
ggcuggaagccaguucuaggcuuccaggcgaaagcugagggaaggaagaaacuccccuccccgu

SEQ ID NO: 447583 - RNA, 64 nt, Human
acccccaguccucacuguccuguuuucuuaggcacugagggaucugaguaggucugggauggac

SEQ ID NO: 447584 - RNA, 64 nt, Human
aggcgacccuuguuguaaaaggcgaucagaacaccugagggaggaaggggcuugcaguuuuccc

SEQ ID NO: 447585 - RNA, 64 nt, Human
ggucaaggguguccugccugccuggguccagggccugagggagccacauggaucccgagacuug

SEQ ID NO: 447586 - RNA, 64 nt, Human
cgccuuucucugggacacaguugggggcuggcuucugagggauuccuuucuccccucuuugugu

SEQ ID NO: 447587 - RNA, 64 nt, Human
acauacaccuaggcuguuuuuccuuccuccacaccugagggacgcagcaacagcuaggaucugc

SEQ ID NO: 447588 - RNA, 64 nt, Human
caggacacucaccuggguguccuggagcugggaacugagggacgccacguccuuggccagcuua

SEQ ID NO: 447589 - RNA, 64 nt, Human
aauccucaggaaaccaaccaccgcccagguggcccugagggaggcauucaccuuuauguguuag

SEQ ID NO: 447590 - RNA, 64 nt, Human
uccccuggccucaguucccagcuccccccgcccacccacgcauacacacaugcccuccuggaca

SEQ ID NO: 447591 - RNA, 64 nt, Human
cagucuccuuuccuaggcuuuuuugggggccuaacccacgcagugaccccagagggcagggcua

SEQ ID NO: 447592 - RNA, 64 nt, Human
uuaccugagaacuugauaaugcauauuugcaggccccacgcaaaaccugcugaaucagaagcuc

SEQ ID NO: 447593 - RNA, 64 nt, Human
ccugucuccuuugcaggcucauagggaagaccugcugagggaccagccaagagggcugcaaaag

SEQ ID NO: 447594 - RNA, 64 nt, Human
agccuacacaucccaauagaagccccuucuuaugcugagggaagcagcccucagaacaugauag

SEQ ID NO: 447595 - RNA, 64 nt, Human
aaaggacauaaauguuacaagugucugguccuuucugagggaggcuggugccgcucugcagggu

SEQ ID NO: 447596 - RNA, 64 nt, Human
ucacauguuuacacacucagugcccuaauuuccccugagggaaucgcuuuuuaagugauccuua

SEQ ID NO: 447597 - RNA, 64 nt, Human
ugagccucucugaugauggagaugaagugaaggucugagggagcgggcccuggggcgaggccau

SEQ ID NO: 447598 - RNA, 64 nt, Human
uggccuuuuucugugugagaucugugcugcacaccugagggagggggagggaucggccaccucc

SEQ ID NO: 447599 - RNA, 64 nt, Human
cauggguggucccacagcaugggaccaggcuggccugagggaugcccaguuguaacaaugcugc

SEQ ID NO: 447600 - RNA, 64 nt, Human
aauccagcuggagugucuuaucaauccagaugaacugagggacaucuguuggucuauguauaac

SEQ ID NO: 447601 - RNA, 64 nt, Human
gaagacauucauuuucccucaugucguugguauucugagggagcugccuggcuucucugccucc

SEQ ID NO: 447602 - RNA, 64 nt, Human
uauuugcacagaccgucgucuucccuccagucuucugagggauaggggacauuccaucccaagc

SEQ ID NO: 447603 - RNA, 64 nt, Human
agaaauguauucugcacccccggccccgcccaugcugagggaaggggagcaguugccaauauuu

SEQ ID NO: 447604 - RNA, 64 nt, Human
aagaggaguucuuugcuauguuccaagccaucuacugagggaggcagaaaggccacaacccacc

SEQ ID NO: 447605 - RNA, 64 nt, Human
cccugagcagccaggucccacuaggugcucuacccugagggagccuaggggcugacugugacuu

SEQ ID NO: 447606 - RNA, 64 nt, Human
cagugaucaccggugugcaauugccuccuuggcucugagggauguuuugcgcucccuuuucuca

SEQ ID NO: 447607 - RNA, 64 nt, Human
cugagccugcaucugugccucccagcccccugcacugagggagcaaguugcccacaugcccgcc

SEQ ID NO: 447608 - RNA, 64 nt, Human
cuccauggaguugcuaaguggccggaaaacaagccugagggaggaggcaggaguuggaguuacc

SEQ ID NO: 447609 - RNA, 64 nt, Human
acaucaacagugcuguuucugacacuucagacaucccacgcaaagccacauugaauuuuugcca

SEQ ID NO: 447610 - RNA, 64 nt, Human
cuaaauguggaccaguaucaagaacccuccuguccccacgcaguguaaacccaguggcuucucu

SEQ ID NO: 447611 - RNA, 64 nt, Human
ugcuagauuaaugucaggaccauuucucuucugccccacgcagccccuagaaaguaguaagcug

SEQ ID NO: 447612 - RNA, 64 nt, Human
ucuacccuaauccccacuucccugcagaaucaaucugagggaggggauaaagaggaagcaauaa

SEQ ID NO: 447613 - RNA, 64 nt, Human
cuucugguugaccucugcccgaucuucugucucucugagggaaucagaguccagcauccagccc

SEQ ID NO: 447614 - RNA, 64 nt, Human
ggaggagccuggagagaaggggcagagcugggggcugagggagacccccccacaccccuucucu

SEQ ID NO: 447615 - RNA, 64 nt, Human
gggaccccucaccccacugcuucagggugcuaggcugagggauguuuuuccucccccuuaccgc

SEQ ID NO: 447616 - RNA, 64 nt, Human
guuuucuuccguuugauaauuaguugguuaaaagcugagggaaccggaaggaaagugcuaggug

SEQ ID NO: 447617 - RNA, 64 nt, Human
guggccuagacauugaugacuggagcucugaggucugagggaugacguucggaaagggucaugg

SEQ ID NO: 447618 - RNA, 64 nt, Human
agggcaucucugggcuggaugagcucccacaagccugagggaaaggccagcacucgcuagcagu

SEQ ID NO: 447619 - RNA, 64 nt, Human
gaaaaugccccgacaggggugcccagcacacugccugagggacaacagacaucagaacaaaccc

SEQ ID NO: 447620 - RNA, 64 nt, Human
gaaaaggucuaagcaagugagucugguggaggagcugagggagggagccauggaaggugccaga

SEQ ID NO: 447621 - RNA, 64 nt, Human
uaccucaccccugccuggugaggaugucuuguuccugagggaggccgguguggaaagccucgca

SEQ ID NO: 447622 - RNA, 64 nt, Human
ucagccuuucucccucccccgucucauuccaaggcugagggagggccuucucgccuggggacgc

SEQ ID NO: 447623 - RNA, 64 nt, Human
gggccuuaggagaccccguugccacggggggcugcugagggaacaccagugcucugucagcagc

SEQ ID NO: 447624 - RNA, 64 nt, Human
gcaaaucugagcuccggcuccgaccccacacacccugagggagcccuacccuagccucagccgc

SEQ ID NO: 447625 - RNA, 64 nt, Human
augugaaguacagcaauaucccaaguucuugugacugagggagauuuucuggaagggccacagg

SEQ ID NO: 447626 - RNA, 64 nt, Human
gaaauguauucugcaccccccggccccgcccaugcugagggaaggggagcaguugccaauauuu

SEQ ID NO: 447627 - RNA, 64 nt, Human
ggcagaugcuuuuuauuaguacugauaaaacaaacugagggaaacaucccucuuagcugggaaa

SEQ ID NO: 447628 - RNA, 64 nt, Human
ggugaugcuagauggauguguaccugguggauggcccacgcacgaagacucaagacccucagga

SEQ ID NO: 447629 - RNA, 64 nt, Human
ggccguggcacaccugcgggaggcagcgacggcccccacgcagacgccgggaacgcaggccgcu

SEQ ID NO: 447630 - RNA, 64 nt, Human
gcuagcgcaccccugcaguccagcgugcauccaccccacgcacgccccgugcuguguuccuggg

SEQ ID NO: 447631 - RNA, 64 nt, Human
uaaggucucuagggucccugccuaaaucccacuccugagggagggggaagaagagaggguggga

SEQ ID NO: 447632 - RNA, 64 nt, Human
uuugagcuaaugggcagcagucagcugggggcuucugagggaugcucaucuuuaacagucuccc

SEQ ID NO: 447633 - RNA, 64 nt, Human
agaaauguauucugcacccccggccccacccaugcugagggaaggggagcaguugccaauauuu

SEQ ID NO: 447634 - RNA, 64 nt, Human
agccuggggagcucuggccacugcuucccaugagcugagggagagggagaggggacccgaggcu

SEQ ID NO: 447635 - RNA, 64 nt, Human
ggccaggaagccuggagccaagaaccuucuggcucugagggagcaagagcuggcaggcggcagg

SEQ ID NO: 447636 - RNA, 64 nt, Human
acuagcuuucacgagggucucgacccuggaccuccugagggaaacauggaaaaagcagugccau

SEQ ID NO: 447637 - RNA, 64 nt, Human
gauggggguuaguugcuuggcagccugccugccacugagggaagucccauuagagauguaucac

SEQ ID NO: 447638 - RNA, 64 nt, Human
aaagccacauacucagccuggauggguggagaggcugagggacucacuggagggcaccaagcca

SEQ ID NO: 447639 - RNA, 64 nt, Human
aaggcgucccuucccgggagcugucggucuggaucugagggagcucucugugugggcucugcug

SEQ ID NO: 447640 - RNA, 64 nt, Human
augggauccaucuguuuuguaaacaauaaagcgucugagggaguguaguuuucugucucccggu

SEQ ID NO: 447641 - RNA, 64 nt, Human
uauuuuaagaauuucacaagcuauucccucaaaucugagggagcugaguaacaccaucgaucau

SEQ ID NO: 447642 - RNA, 64 nt, Human
ccacguuucuaauuuggagcaaaucuaaaaggugcugagggauuggacagcucugacuuuccuc

SEQ ID NO: 447643 - RNA, 64 nt, Human
uuaagugucuuagcacuuccucgaugugccugcccugagggagugaguucacauuugagacaac

SEQ ID NO: 447644 - RNA, 64 nt, Human
guuccccccuccgagcccuccuucccggcccaaccugagggauguggauuugggacugucuggg

SEQ ID NO: 447645 - RNA, 64 nt, Human
ggcggagagaacaggaggaauggcugggaaguggcugagggagccaggaggccggggggccggg

SEQ ID NO: 447646 - RNA, 64 nt, Human
ggcaugggcagagagggccacggggcagggcccacugagggaacaucaguggcccuccagucag

SEQ ID NO: 447647 - RNA, 64 nt, Human
uuagagugaacaugucuauggacuuuaaaaagaccccacgcaauuugacuuuguggcaauagaa

SEQ ID NO: 447648 - RNA, 64 nt, Human
gacagacagacagacggacgggacagcggcccggcccacgcagagccccggagcaccacggggu

SEQ ID NO: 447649 - RNA, 64 nt, Human
guuccaggggagauccagaaugcaugugucucuucccacgcauuuaugucauguugguagcuuu

SEQ ID NO: 447650 - RNA, 64 nt, Human
acgggccagaccacaggaaggacgguguuugugucugagggagcugcuggccacagugaacacc

SEQ ID NO: 447651 - RNA, 64 nt, Human
accggguagguuuccgcggugaccccgcggcggccugagggacgcucccugccccaucccggcu

SEQ ID NO: 447652 - RNA, 64 nt, Human
ucucgucuggcugaacucugggagugugucccagcugagggaagcacaaguagcaaagcucauu

SEQ ID NO: 447653 - RNA, 64 nt, Human
gccccuggccuguaccuguuuccucauuccuuggcugagggagaggcugagaacugggcagaca

SEQ ID NO: 447654 - RNA, 64 nt, Human
ccccacucacgaauauuaugcccaguuucugccucugagggaaagcccagaaaaggacagaaac

SEQ ID NO: 447655 - RNA, 64 nt, Human
guggagaugucgguccaugagcgcacacacaagacugagggacugucggcccucccagguggug

SEQ ID NO: 447656 - RNA, 55 nt, Human
uccgcuuccugccccgcugaaggggcugagggaagggggucaaaggauuccaggg

SEQ ID NO: 447657 - RNA, 64 nt, Human
uggggacaugagauuuuauuuuuugugagugagacugagggaucguagauuuuuacaaucugua

SEQ ID NO: 447658 - RNA, 64 nt, Human
aaucucuucucauccacccucuggcacccagccucugagggaaggagggauggggcauaguggg

SEQ ID NO: 447659 - RNA, 64 nt, Human
ccgcuaacuucagccucucaucugcugcuccgggcugagggacuagaggacaucucggucguuu

SEQ ID NO: 447660 - RNA, 64 nt, Human
gacucagggagacagagacuuuguggaaguaucucugagggagucccagacacaggcagagagg

SEQ ID NO: 447661 - RNA, 64 nt, Human
ccagcucuccagggagcuucuggcccaaggccgucugagggaucugcuccuuaaccccccagug

SEQ ID NO: 447662 - RNA, 64 nt, Human
ugaagccugcacgcggcaguucuuuguuaaagaucugagggacuccucaguccuggggcgucgc

SEQ ID NO: 447663 - RNA, 64 nt, Human
gccucccccugggccgaggccuuggcccacacagcugagggagaggcccagcccugagccuccc

SEQ ID NO: 447664 - RNA, 64 nt, Human
ccuccaacuucguggaagccaggguccccugcagcugagggacgccaagcagacacaccugccc

SEQ ID NO: 447665 - RNA, 64 nt, Human
ugggacacugauacugacagggagaugggacauucugagggacccggaggcagggagccaccuc

SEQ ID NO: 447666 - RNA, 64 nt, Human
ugagaaccgcugcucugagauggcaggaauggaucccacgcaaaugaaucgcaccccaagcaca

SEQ ID NO: 447667 - RNA, 64 nt, Human
ggcgcccgggccuuugcuaucucgccgucgcccgcccacgcacccacccguauuuauguuuuua

SEQ ID NO: 447668 - RNA, 56 nt, Human
aagaguuuauuuuuguguaaaggucacccacgcagaagucuuccugugcagggugc

SEQ ID NO: 447669 - RNA, 64 nt, Human
caccuggacauaguuugccccuguggcugccuuucugagggaguauacuaaauguuuacuuaag

SEQ ID NO: 447670 - RNA, 64 nt, Human
guagaugugggcuuguugccuucagccggcuucccugagggaggagaacacuggauuauuggaa

SEQ ID NO: 447671 - RNA, 64 nt, Human
cucugugggucucccccaacgcgccucgccggaucugagggagaacaagaccgaucggcggcca

SEQ ID NO: 447672 - RNA, 64 nt, Human
uugagccaaauauguagaggaccuaccaagcccacugagggacuagguuuucaugucucuaguc

SEQ ID NO: 447673 - RNA, 64 nt, Human
guuaauauacucuaaaagccauacuaaaaaugcucugagggaacuggcuaagaauagugggccu

SEQ ID NO: 447674 - RNA, 64 nt, Human
ccugauggcugcucagcaccacagagugcuugggcugagggacugacuguuggaacccgugcau

SEQ ID NO: 447675 - RNA, 64 nt, Human
cuauggaaucacccagaggggugccuugcccuggcugagggacauguacugccucucaucuaga

SEQ ID NO: 447676 - RNA, 64 nt, Human
augaguacccccucaaacccugcccuccuuagaccugagggacccuucgagaucaucacuuccu

SEQ ID NO: 447677 - RNA, 64 nt, Human
ucaugagccaaccuuagcuacaagguagggaguucugagggaagccgcgugcuccucaggagag

SEQ ID NO: 447678 - RNA, 64 nt, Human
gcccaaccuucuggccugggcugugcugauagugcugagggagauaggaauuugcugcuaagau

SEQ ID NO: 447679 - RNA, 64 nt, Human
cucccccguccccaucuggcagcuccugucucgccugagggacccagccgccuucuccgugcuc

SEQ ID NO: 447680 - RNA, 64 nt, Human
gcggccucuagcuccgucucccggggaccugggccugagggagggcuggagucgcacgcgcuuu

SEQ ID NO: 447681 - RNA, 64 nt, Human
ugauaugcacucaccauuagcuucgacacagggacugagggagacagguggggagcagcugaca

SEQ ID NO: 447682 - RNA, 64 nt, Human
uugccaguaccugagccggucgggucaucugccucugagggaccguccucaccgagcuccugca

SEQ ID NO: 447683 - RNA, 64 nt, Human
gucuugcuaccccaagucacuaccucacucaccucugagggauuuucaggaaaugucuugacuc

SEQ ID NO: 447684 - RNA, 64 nt, Human
uagucccuuccccucccuggcucccaugaccauacugagggaccaacugggcccaagacagaug

SEQ ID NO: 447685 - RNA, 64 nt, Human
gcggaccgugcaccagaacuccgucuuccacugccccacgcagagccaggugaagaggggcagg

SEQ ID NO: 447686 - RNA, 64 nt, Human
ugagugccacgacaggcccgugugacagcugcugcccacgcauguggaagcuaggugggacuca

SEQ ID NO: 447687 - RNA, 64 nt, Human
ccagcgacgacgccaccaucaaagccuggcgcuccccacgcaccaugcgcguccuccaggcacc

SEQ ID NO: 447688 - RNA, 64 nt, Human
gaggagaggaacaagggccuccgaaaccccaacccugagggagacuggauuggucuuggggccc

SEQ ID NO: 447689 - RNA, 64 nt, Human
cugggccuccaccgacugccugcucaccccugggcugagggaagggagaggagaggaacaaggg

SEQ ID NO: 447690 - RNA, 64 nt, Human
ucccuggcuagcccaaauggcacuaaggaggccacugagggaauccuccacguggcugucccag

SEQ ID NO: 447691 - RNA, 64 nt, Human
cgcacaaacgccuucacuggaucagccgcuggaacugagggagugagcuuggggacuuccuucg

SEQ ID NO: 447692 - RNA, 64 nt, Human
uggcgggcaccuggagucccagcuacuccggaggcugagggaggagaauggugugaacccggga

SEQ ID NO: 447693 - RNA, 64 nt, Human
cagugcggcucugucccugcugccgccuccaguccugagggaggggcuugccccaccuucuaca

SEQ ID NO: 447694 - RNA, 64 nt, Human
cagcggcggccuuucgaggcccuuucuggggggucugagggagaccugguugggaauuggggcu

SEQ ID NO: 447695 - RNA, 64 nt, Human
acuguccacgauccaguacaacgugguggauggccugagggaccgccggagcuuccacgggccg

SEQ ID NO: 447696 - RNA, 64 nt, Human
guauuaaaagguaauaauacauaaucuuuaaaaucugagggaucauugccagagauuguugcgg

SEQ ID NO: 447697 - RNA, 64 nt, Human
gggcaggcuucuccugcaccuuuugucugcugggcugagggacacgagggcaacccugugacaa

SEQ ID NO: 447698 - RNA, 64 nt, Human
cugacuccugugaaggcacagccagcguuguggccugagggaggcccugcugggacccugaucu

SEQ ID NO: 447699 - RNA, 64 nt, Human
ucaucugcugucugagcauccaggcccaaaggcacugagggagucaggagcuggggcucggcac

SEQ ID NO: 447700 - RNA, 64 nt, Human
cuguaacugccgagcugccugcugucacgugacacugagggauggcuuguuucuuccggguggg

SEQ ID NO: 447701 - RNA, 64 nt, Human
ccccggccccgucugggaagcucaucuugcgaagcugagggagcucagggcaaaggccaggcua

SEQ ID NO: 447702 - RNA, 64 nt, Human
uggaggacaguguggcuugucacaggccuagagucugagggaggggagugggagucucagcaau

SEQ ID NO: 447703 - RNA, 64 nt, Human
cuagcaccgcuggaugaaaggagaaggcuagaggcugagggaggaaagagcaguuaacaaacaa

SEQ ID NO: 447704 - RNA, 64 nt, Human
uuuaaaggcuucagauuaaacaagagcccuuaagcccacgcauagcauugccgcuucagcuugc

SEQ ID NO: 447705 - RNA, 64 nt, Human
uacggcuugagguuucagcauccaggcugcagaccccacgcagugucucauacaguggaaugug

SEQ ID NO: 447706 - RNA, 64 nt, Human
gcagcuuggaccgcaagggcaaauacacccugaccccacgcauguggccgccagccccaggagc

SEQ ID NO: 447707 - RNA, 64 nt, Human
ucccaccccagcauccauacacguaggccuguugcugagggaaggcccucuagggucaucuggu

SEQ ID NO: 447708 - RNA, 64 nt, Human
ggugaggguguggggugcgcccuucccuuuugggcugagggagagggggccgggagggguuguc

SEQ ID NO: 447709 - RNA, 64 nt, Human
cguuugugguuuaaagcaaacaugcaagaugaaccugagggaugauagaauacaaagaauauau

SEQ ID NO: 447710 - RNA, 64 nt, Human
gcauaaauauauucccagugcuggagagggugggcugagggacuggggccagcacggaccaccc

SEQ ID NO: 447711 - RNA, 64 nt, Human
agcaaaguuacaggccaguuuuuacuuguuugcccugagggaaaaauccuuuuaaaaaaaauuu

SEQ ID NO: 447712 - RNA, 64 nt, Human
gcaggggcagguugcuaagucaggugcagagguucugagggacccaggcucuuccucuggguaa

SEQ ID NO: 447713 - RNA, 64 nt, Human
agaucccacuacucucccaccaccugcccuuucucugagggacguuuaccacgaggccucaggc

SEQ ID NO: 447714 - RNA, 64 nt, Human
agccugcaccucagccaguagggcagccucugagcugagggaggacccugcaggggcgccuagc

SEQ ID NO: 447715 - RNA, 64 nt, Human
ccagcacagggggauucugagcagugccucuugucugagggacauaucagugaccucgacguug

SEQ ID NO: 447716 - RNA, 64 nt, Human
ccugcgugucuguccaccucaucccuccguguaucugagggaguaaaggugaggucuuuauugc

SEQ ID NO: 447717 - RNA, 64 nt, Human
aaggcccaaugcagaggagcccgcggagcaugugcugagggaagucugccuggugaggcuggca

SEQ ID NO: 447718 - RNA, 64 nt, Human
cuugucacccuugcccgauucccacaucccaguccugagggacucagcacaacaggauaagcgu

SEQ ID NO: 447719 - RNA, 64 nt, Human
uuuuaaaaagaaccgaagaagccacaggcagggccugagggagccccuggcuuuccccucagcc

SEQ ID NO: 447720 - RNA, 64 nt, Human
gcgguaugucuagauugacccuugauuuugcccccugagggacgguuuugcuuuauggcuagac

SEQ ID NO: 447721 - RNA, 64 nt, Human
agagaaaacuacuaagcuugacaucugugagugacugagggagacaggaggaauaccagguuau

SEQ ID NO: 447722 - RNA, 64 nt, Human
agcuccccuccccaagcuccugaagacccgguuucugagggagggaaauugcuacuuggauuga

SEQ ID NO: 447723 - RNA, 64 nt, Human
aaccgccagggagaagcagccggcucucaaagcucccacgcagcucucccgccacuggccacuc

SEQ ID NO: 447724 - RNA, 64 nt, Human
aaagcuggugcgaugcuucagggaaaauggaaaacccacgcaagaauaaugauugauuccgguu

SEQ ID NO: 447725 - RNA, 64 nt, Human
aagcauuuguuaugauuucccugaauuaauucaucccacgcauccucccugaggcaccugcccc

SEQ ID NO: 447726 - RNA, 64 nt, Human
auauagaugcuuuucauuauacacacaaaaaucccugagggacauuuugaggcaugaauauaaa

SEQ ID NO: 447727 - RNA, 64 nt, Human
uggaguuaaucuuaucaagaguugugacaacuuccugagggaucuauacuugcuuuguguucuu

SEQ ID NO: 447728 - RNA, 64 nt, Human
uuguucccauccucuucuuuuagcaguaaaauagcugagggaaaagggagggaaaaggaaguua

SEQ ID NO: 447729 - RNA, 64 nt, Human
guugagugcucugcaggccugugaagggugccaccugagggagccgccugcaagcggcccugca

SEQ ID NO: 447730 - RNA, 64 nt, Human
gccuugggcucagccacugggagacaguugggaccugagggacagaggaucggaauggaaacca

SEQ ID NO: 447731 - RNA, 64 nt, Human
gccuucuggauucuuggcccgcacagagcuggggcugagggauggacugaugcuuuuagcucaa

SEQ ID NO: 447732 - RNA, 64 nt, Human
uuuuguuuuuuaaaagguuggggguguucagccacugagggacaaaacuuagcaucuaauuuca

SEQ ID NO: 447733 - RNA, 64 nt, Human
cuccagucugugcaucaugaaugauaagcuguuucugagggaugccagcccccaagagacucag

SEQ ID NO: 447734 - RNA, 64 nt, Human
cuugugucaucucauaaugguuggucuuuccaggcugagggaaauguuucuuguuuccagagua

SEQ ID NO: 447735 - RNA, 64 nt, Human
cauccucagaaucucaugccauuuucccgcagagcugagggauguggucagcaguccccaccag

SEQ ID NO: 447736 - RNA, 64 nt, Human
cuuuguagcucuguggucagccuacuugucugcucugagggagagugcguggggagccaugcuc

SEQ ID NO: 447737 - RNA, 64 nt, Human
uguuuuccuuauugauuacaacucagcuauaauccugagggaacaugggaaggaaucaaaggua

SEQ ID NO: 447738 - RNA, 64 nt, Human
gaauggaaaauucaccaggacuccauucuuaagccuaugcgaguccccuagagagaggcauugu

SEQ ID NO: 447739 - RNA, 64 nt, Human
guuaaaaacuaaugaguguuugcgugugguguuucuaugcgagcacccauucucaauuuuuuuu

SEQ ID NO: 447740 - RNA, 64 nt, Human
agcggggggugggggggagaaauaauguuauuuccuaugcgaaugacguguaucccuguaccca

SEQ ID NO: 447741 - RNA, 63 nt, Human
guuguaucucugaugccugaugcccauggucaacccacgcagaagaaacagaagaacucaugc

SEQ ID NO: 447742 - RNA, 64 nt, Human
cugugacagagccuggugaacagugagccuggcucccacgcaaguggcacuuuaagcccugcau

SEQ ID NO: 447743 - RNA, 64 nt, Human
ugggguccccacuuuagggcgacuuugcccgaggcccacgcauccauccacuccuuuagugccu

SEQ ID NO: 447744 - RNA, 64 nt, Human
gaauuuguacuuaauggcauggacucuggagaaucuaugcgaaucaaccuuucuaccuuaauau

SEQ ID NO: 447745 - RNA, 64 nt, Human
ccuuggugacaauccugcuuuguuaaagcaaaaacuaugcgaaagggugagucuguuuagaaga

SEQ ID NO: 447746 - RNA, 64 nt, Human
aucccuuucuuccccccaccagcuguaaaagauccuaugcgaaagacacuggcucuuuuuuuua

SEQ ID NO: 447747 - RNA, 64 nt, Human
gagagagugugaguguguuuguaagugagugucccuaugcgauuaugucucuuuacguugcuaa

SEQ ID NO: 447748 - RNA, 64 nt, Human
aggcagggagaggauucuccagugagugcacacacuaugcgaggagcaagcauuucucuaaguc

SEQ ID NO: 447749 - RNA, 64 nt, Human
gaagaagaaaaguaaaagagcuuaccacuggcgccuaugcgaucacuucauuuuuaguuugagu

SEQ ID NO: 447750 - RNA, 64 nt, Human
uuggguugaccaguaaguagaaaaaggcuaaaggcuaugcgauaugaauuucagaaauggacug

SEQ ID NO: 447751 - RNA, 64 nt, Human
agccgggcgugguggcgggcgccuguagucccagcuaugcgagaggcugaggcaggagaauggc

SEQ ID NO: 447752 - RNA, 64 nt, Human
auuggaggucccaggagugucacccauggagaggcuaugcgacauggcuagggcugguucugcc

SEQ ID NO: 447753 - RNA, 64 nt, Human
aacugucccuccagagguucuuccagccccacuucuaugcgaugucaucuuuucuaaaagagac

SEQ ID NO: 447754 - RNA, 64 nt, Human
uccgauggcaggugguggacaggcgcaucccacucuaugcgaaccacaagacccuccuccagaa

SEQ ID NO: 447755 - RNA, 64 nt, Human
ccucgcugcucaugcccacagcccucccagagugcuaugcgaguggcugccgugcaguuggggg

SEQ ID NO: 447756 - RNA, 64 nt, Human
agacucagcacccccaauggugcgcggaagccaggcgggcgauuacaauccaauuaccuauugu

SEQ ID NO: 447757 - RNA, 64 nt, Human
ccgucugggagguguacccaacagcucauugagagcgggcgaugaugacaguggcggcuuugug

SEQ ID NO: 447758 - RNA, 64 nt, Human
cggcggcggcgacagcgggcgagccagggcccgggcgggcgagugggcgagcggguaggcccaa

SEQ ID NO: 447759 - RNA, 64 nt, Human
aucauggggugauugcagaaagggggaguggcggcccacgcagcuucugcugaggagcugaccg

SEQ ID NO: 447760 - RNA, 64 nt, Human
gcgcuaugucugcaagugaggcccugcccuccgccccacgcaggagcgaggacucugcucaagg

SEQ ID NO: 447761 - RNA, 64 nt, Human
cccccccacaccgcuacuaaggccuacaccucuccccacgcagagggggaauucugcccuggug

SEQ ID NO: 447762 - RNA, 64 nt, Human
agggaagggaggcuggggcugcagggcagugaaacccacgcagccuaggccagagcacuuuacu

SEQ ID NO: 447763 - RNA, 64 nt, Human
cuggaauccugcggcggcggcggcggcggcgacagcgggcgagccagggcccgggcgggcgagu

SEQ ID NO: 447764 - RNA, 64 nt, Human
cacaccuguaaucccagcacuuugggaggcugaggcgggcgaaucauuugaggugaggaauucg

SEQ ID NO: 447765 - RNA, 64 nt, Human
cacgccuguaaucccagcacuuugggaggccgaggcgggcgaaucacgaggucaggaguucaag

SEQ ID NO: 447766 - RNA, 56 nt, Human
agagcgaaacuaccgucuaagguggggcgggcgacgcgguagacgggcuggccacg

SEQ ID NO: 447767 - RNA, 64 nt, Human
uggaccccugcggcagggucgugcuccgucuccugcgggcgaggucugauggagcugcguuucc

SEQ ID NO: 447768 - RNA, 64 nt, Human
ggugcuacagggaauuuguacguuuauaccgcaggcgggcgagccgcgggcgcucgcucaggug

SEQ ID NO: 447769 - RNA, 64 nt, Human
cccagcugauuccaggcgaauucuucucugaugggcgggcgaggguguguucgugugauggguu

SEQ ID NO: 447770 - RNA, 64 nt, Human
agggagagaaaaccuuccagcagcccaguaaacugcgggcgaagagaucuacccgucucccucc

SEQ ID NO: 447771 - RNA, 64 nt, Human
caggcggggcaggaguggccaagcgcgcaagggcgcgggcgagcaggccugugaauucgcagga

SEQ ID NO: 447772 - RNA, 64 nt, Human
cgcccaccagcaggcccugcgggaggagagcggugcgggcgacaagggcugagcgcgggagcca

SEQ ID NO: 447773 - RNA, 64 nt, Human
ggcgcuaugcaaggagcgggcgcgcuucgaacaggcgggcgagccgcggcagccacaggcgcgg

SEQ ID NO: 447774 - RNA, 64 nt, Human
acacagcuaaggccucgcugccagccuucugacggcgggcgagcacacggucucuuccccugcc

SEQ ID NO: 447775 - RNA, 64 nt, Human
ggugcagacgcggcggggacucggagggugccgugcgggcgaggccgcccaaauuuggcaauaa

SEQ ID NO: 447776 - RNA, 64 nt, Human
ucgcuggagucaguaucggcccggcgcagccgcggcgggcgaggccaauggaaaggagacugag

SEQ ID NO: 447777 - RNA, 64 nt, Human
ccaggaggccagggcaggccugcgugggcuggaggcgggcgaggccggcccacccccucgcugg

SEQ ID NO: 447778 - RNA, 64 nt, Human
gcuucugaaugcugcuacuugauuucuuucucaucccacgcacuccaugagcaccccaaggcug

SEQ ID NO: 447779 - RNA, 64 nt, Human
gcuucugaaugcugcuacuuaauuccuuucucaucccacgcacuccaugagcaccccaaggcug

SEQ ID NO: 447780 - RNA, 64 nt, Human
acccugucccgcuacugcuuacacaggccggguucccacgcagaggggaggcugcuccaccccu

SEQ ID NO: 447781 - RNA, 64 nt, Human
aaucacaguuuuucauuauuauucaucuucuguacccacgcauaaccacuauacauaguuucuu

SEQ ID NO: 447782 - RNA, 64 nt, Human
ugagcuggacguggggcuaagccgagaggcacaggcgggcgaggcggccacaggcgaggguggg

SEQ ID NO: 447783 - RNA, 64 nt, Human
ccugcgccccccaguggacucgcgagagggugccgcgggcgagaagggcgcaggaaccgaggac

SEQ ID NO: 447784 - RNA, 64 nt, Human
cacguagacccucagcccugguggcggcagagaagcgggcgaggcacuguggucgcugaggggg

SEQ ID NO: 447785 - RNA, 64 nt, Human
gacuugagcgagagggaggaagggcgcgcgggccgcgggcgacgggcgggugcgcgggcgggca

SEQ ID NO: 447786 - RNA, 64 nt, Human
acagagggagucagcccgggaggucaggagcgcggcgggcgagggcccuguguggaccaccucc

SEQ ID NO: 447787 - RNA, 64 nt, Human
gaugcucacuggcuccucucugaccucccgccgggcgggcgagcccuggcuucuccucacggug

SEQ ID NO: 447788 - RNA, 64 nt, Human
gccagcuugagugggagugugugagugugagcaggcgggcgagugcgugagugcacgccagcgc

SEQ ID NO: 447789 - RNA, 64 nt, Human
cccaucccguuggucgaggccugacaggcgcuuagcgggcgacucccuccccauuggccgaguu

SEQ ID NO: 447790 - RNA, 64 nt, Human
cgaggccggguaccugggcugggauccggagcaagcgggcgagggcagcgcccuaagcagguac

SEQ ID NO: 447791 - RNA, 64 nt, Human
ugugcgcgaacccugaacccuacggucccgacccgcgggcgaggccggguaccugggcugggau

SEQ ID NO: 447792 - RNA, 64 nt, Human
gcagaaaaaacugagcagcgccaacucccugccagcgggcgagcaggacaguccgcgccugggg

SEQ ID NO: 447793 - RNA, 64 nt, Human
cuguagccagguauucugcugcucuuggccuuuucccacgcaucgucucgugucuucuccgaaa

SEQ ID NO: 447794 - RNA, 64 nt, Human
gcuucgaugugccuggaggauuuccccacagggacccacgcaccucccuguaucugcgcagcuu

SEQ ID NO: 447795 - RNA, 64 nt, Human
ccggcccgcagcaccugcacacacgaaguccggacccacgcagccuccaucccgcgugucuugc

SEQ ID NO: 447796 - RNA, 64 nt, Human
aagagaaaaaauauuuuccugccaggcaugguggcccacgcacuucgggaggucgaggcaggag

SEQ ID NO: 447797 - RNA, 64 nt, Human
agcuaacggacaagcuccccugccacacccagugcccacgcaugcucacauacauacagcagac

SEQ ID NO: 447798 - RNA, 64 nt, Human
gguaggauauuuuauauucugccgcaggauagaacccacgcaaggauuuucuuuaaauugagag

SEQ ID NO: 447799 - RNA, 64 nt, Human
aguuuugagcgcccggccgcgccccgcgccgccccccacgcaccaccggggcggccucgcgggu

SEQ ID NO: 447800 - RNA, 64 nt, Human
acagcuccaggacaucucagcccagguucuagcccccacgcaccccagaccccagguggaccau

SEQ ID NO: 447801 - RNA, 64 nt, Human
gaugucugcagcccucagcagcugcagaccgccccucaccaacccagagaaccugcuuuacuuu

SEQ ID NO: 447802 - RNA, 64 nt, Human
ugacacucuucccuccucccaccugccaccaggccucaccaaagcccacugccauggggccauc

SEQ ID NO: 447803 - RNA, 64 nt, Human
uugucgccggcucacggacucccaugcagccuuccucaccaauuuggcacaggcagcagucucc

SEQ ID NO: 447804 - RNA, 64 nt, Human
ugcagcugauccauaggacuaccgcaggcccggacucaccaacuugccacauguucuagguuuc

SEQ ID NO: 447805 - RNA, 64 nt, Human
ugaauucagguuuaacuucaccuuaguuauggugcucaccaaacgaaggguaucagcuauuuuu

SEQ ID NO: 447806 - RNA, 64 nt, Human
cuuucuaguuccccuaccucucuaucuuucuauucucaccaauaaucucuuuguugcaugaauu

SEQ ID NO: 447807 - RNA, 64 nt, Human
aguuucuugaaaugucuuuaaaacagacauuuuucucaccaaacaguuugaguaucuuuauuaa

SEQ ID NO: 447808 - RNA, 64 nt, Human
ucuaccuguguucuguuccagcgaauugggaagucucaccaagcuagauugucuaccaucagcc

SEQ ID NO: 447809 - RNA, 64 nt, Human
uguugagauguuucaugggacaguagaacucugacucaccaacugggcuaaauuuuaauuuaaa

SEQ ID NO: 447810 - RNA, 64 nt, Human
uguuggauguuuccucuuccucccuuaugucuaccucaccaaccucgcucaucauuuggcccuu

SEQ ID NO: 447811 - RNA, 64 nt, Human
uggcaggucgucaagagaacugugucauuccaaacucaccaagguggcuuauagaacagaagca

SEQ ID NO: 447812 - RNA, 64 nt, Human
gaggcucccuugucucccagccccauguacaaagcucaccaagccccugcccauguacagcccc

SEQ ID NO: 447813 - RNA, 64 nt, Human
gcccuggcauucuggcagagaauccucaccaguucucaccaaccuuccccccaggcaagggcag

SEQ ID NO: 447814 - RNA, 64 nt, Human
agcugauaauuuaaaucuggaugggcagcuugcacucaccaauagaccaaaagacaucuuuuga

SEQ ID NO: 447815 - RNA, 64 nt, Human
aauguagggauauauacuguauuuuuaaacauuucucaccaacuuucuuauguguguucuuuuu

SEQ ID NO: 447816 - RNA, 53 nt, Human
gucaggaguacagcuugugaaaacucaccaaaaugaauaguuguuucguuaca

SEQ ID NO: 447817 - RNA, 64 nt, Human
uugauucccaggagagauucucugacauucacgugucagccacuuuggcacggaagccuuacag

SEQ ID NO: 447818 - RNA, 64 nt, Human
uuaguucacuaauguuagccuuauuuaggacaaagucagccagacaccuuguacugggcacgcg

SEQ ID NO: 447819 - RNA, 64 nt, Human
agcaguacacaaagcacuuaccuugacuggugaagucagccagccaucucagcagggaagaaca

SEQ ID NO: 447820 - RNA, 64 nt, Human
caccgugacaugguuaugcauccuuuagauuaaccucaccaaaugaagcuuuuucuauccauuu

SEQ ID NO: 447821 - RNA, 64 nt, Human
cuuuuccagcuuuucauauuaauguaugcagagucucaccaagcucaaagacacugguuggggg

SEQ ID NO: 447822 - RNA, 64 nt, Human
gaaugagaaaaguuaaccaaggaauuauucuuuucucaccaaucaacacuuuuaagaaauauau

SEQ ID NO: 447823 - RNA, 64 nt, Human
ccacaugccugcaggcauuuguuuucagaacagucucaccaauuacaacacaccguguuuuagu

SEQ ID NO: 447824 - RNA, 64 nt, Human
agugcuucaggucuuaacgccuccauaccucuuccucaccaacuuuacuaguagcugagauuua

SEQ ID NO: 447825 - RNA, 64 nt, Human
uuggauccaggggaccugggcucauucuucuuggcucaccaacccugcaggccucaucuuuccc

SEQ ID NO: 447826 - RNA, 64 nt, Human
ccuuuuuaugcuguuaacagaugucagagugauucucaccaaaaaaaguuaaacuauguuguaa

SEQ ID NO: 447827 - RNA, 64 nt, Human
aauaagugcuuucuugcauucauuucaguuuagucucaccaacccccuaugaauuaggagaauu

SEQ ID NO: 447828 - RNA, 64 nt, Human
gucucuacugauuaucuugcugcuuaaaggccugcucaccaaucuuucuuucacaccguguggu

SEQ ID NO: 447829 - RNA, 64 nt, Human
ggcucaccucguuccacagcuccacuugcaucuucucaccaaagccuuccauggaugcacaggg

SEQ ID NO: 447830 - RNA, 64 nt, Human
ccagcaauguccucaaugagggucuuuucuuucccucaccaaaacccagccuugcccgugggga

SEQ ID NO: 447831 - RNA, 64 nt, Human
ucauuuuucuucaugggagaaacagcccacagagcucaccaacaaguacuccaaaacuaaguaa

SEQ ID NO: 447832 - RNA, 64 nt, Human
gaggggccucaucuuccccagcccuccccaccugcucaccaauuccacuuccugccccaacugc

SEQ ID NO: 447833 - RNA, 64 nt, Human
ugaagguucuauuuauuuacaauacauaggguuacucaccaaacuuuuugacaaggcaacacau

SEQ ID NO: 447834 - RNA, 64 nt, Human
gauuuguguuuuagaguguucagccugaccccgccucaccaauacacguaaguuuccaaauaca

SEQ ID NO: 447835 - RNA, 64 nt, Human
ccaauccuaugcaugguuucagcacuagccaaaccucaccaacuccuaguucuagaaaaacagg

SEQ ID NO: 447836 - RNA, 64 nt, Human
uucaguguagacagauuaaacaaagcccaagccugucagccacagaaacaggcucuccucuuac

SEQ ID NO: 447837 - RNA, 64 nt, Human
ugcaggauggagaugggagauuucauggagccuggucagccagcucuguaccagguugaacacc

SEQ ID NO: 447838 - RNA, 64 nt, Human
ucugccccugccucccuaauuagcuagggcuggggucagccacugccaauccugccuuacucag

SEQ ID NO: 447839 - RNA, 64 nt, Human
uucaaggauaugugccagggaauucaggaaccaccucaccaaccccaucucccacucagaaauc

SEQ ID NO: 447840 - RNA, 64 nt, Human
cuguuauccuguuaucuacugagaccccaaauuucucaccaauguuuugggagauccuggaaaa

SEQ ID NO: 447841 - RNA, 64 nt, Human
uuagcaauaccaccagacuaguuagaguuccccacucaccaagcaagacaugcaguuucaugcc

SEQ ID NO: 447842 - RNA, 64 nt, Human
ucacuugggggagcacagggccccgcugggccuccucaccaacggcagugccaaaaucagcccc

SEQ ID NO: 447843 - RNA, 64 nt, Human
gcuagauagucagcugcuguugcagguagaaaagcucaccaaugccacauuuguucauucuguu

SEQ ID NO: 447844 - RNA, 64 nt, Human
gccucuugggcuccuuuucaaggacauuaauaaccucaccaacauagcucaugcccuucagcuu

SEQ ID NO: 447845 - RNA, 64 nt, Human
cguugaaguccucaccaguacuacaccacuuuuccucaccaacccccauccuauucuugguaag

SEQ ID NO: 447846 - RNA, 64 nt, Human
cggaaaguggaccugccaggccgggagugugucccucaccaacuaugcacacagcacucgcucu

SEQ ID NO: 447847 - RNA, 64 nt, Human
cagauugguaaugccagaaaaaauuuuaagaggacucaccaaaaguacuagaucuauguaaguu

SEQ ID NO: 447848 - RNA, 64 nt, Human
aaauaagagaugccagaacuacuuccauaacuaacucaccaaaucaaaucaucaguccucauau

SEQ ID NO: 447849 - RNA, 64 nt, Human
aaugaacugugacaggaagcccaaggcaguguuccucaccaauaacuucagagaagucaguugg

SEQ ID NO: 447850 - RNA, 64 nt, Human
cuuuuaaaagaaaagacaaguuuguuguguuuaacucaccaacacgugguguauaaugaagaca

SEQ ID NO: 447851 - RNA, 64 nt, Human
caagugauuuuuuuuccccucugcuucuuagaaacucaccaagcagugugccuaaagcaaggug

SEQ ID NO: 447852 - RNA, 63 nt, Human
ggcaggcugggccauguccaaagaggcugccccucucaccaaagaacagaggcagcaggaagc

SEQ ID NO: 447853 - RNA, 64 nt, Human
gccacugaggacccgugugacucgccagcucauucucaccaaucgcuccccaauacggacccgu

SEQ ID NO: 447854 - RNA, 64 nt, Human
cuuauucaaaauacagugauagaaguucagaaagcucaccaaggucaaggagcagaucuucuag

SEQ ID NO: 447855 - RNA, 64 nt, Human
aaugucugggaauaucauagaguaacaagugcuggucagccaaagaaacauucacugcugguga

SEQ ID NO: 447856 - RNA, 64 nt, Human
uaauauguagugaaagauaauucuguagaaaaacgucagccaguaggguaaagucauucuacug

SEQ ID NO: 447857 - RNA, 64 nt, Human
gugcuguggagagaagcugauguuuugguguauugucagccaucguccugggacucggagacua

SEQ ID NO: 447858 - RNA, 64 nt, Human
agcccccugggacucccuggccccaaccugccaccucaccaaagcucugagcccugcuagccuu

SEQ ID NO: 447859 - RNA, 64 nt, Human
uaaaagccaaugaguuuuuuuuuaauucuccuuucucaccaaugggcaauagcccauaauugaa

SEQ ID NO: 447860 - RNA, 64 nt, Human
agggaagaaacagaagcaguguuccauuuucuuccucaccaaugacauucuuuucuuuucuccu

SEQ ID NO: 447861 - RNA, 64 nt, Human
uaaaaaggcuacaauuaaauuuuagccaaugccacucaccaaaucuuugcaccuaguagauaga

SEQ ID NO: 447862 - RNA, 64 nt, Human
acaucugaguaugauuacacauuuaaauacugcacucaccaagguuaaaguggguaaucauaag

SEQ ID NO: 447863 - RNA, 64 nt, Human
agugccagauguugucugaacuaaucgagcacuucucaccaaacuucauguauaaauaaaauac

SEQ ID NO: 447864 - RNA, 64 nt, Human
gguuggcaccuguccuauuccugaaacagccucucucaccaaguucccuugccuaagaaggcca

SEQ ID NO: 447865 - RNA, 64 nt, Human
gaaagagaaggaaugucaugccaggguguuacuccucaccaaaacuuggcaguucuuuuugggg

SEQ ID NO: 447866 - RNA, 64 nt, Human
aaacuucuagguaauuugccacgcuuuuugacugcucaccaauacccuguaaaaauacguaauu

SEQ ID NO: 447867 - RNA, 64 nt, Human
cccagguuucuucuucucuuaaggagagauuauucucaccaacccgcugccuucaugcugccuu

SEQ ID NO: 447868 - RNA, 64 nt, Human
agucuauuuaaauauucauuccauuacaucuagacucaccaagaacuacauguuaugauguuaa

SEQ ID NO: 447869 - RNA, 64 nt, Human
ggacucagccaccuuccuucuucaccccaugcuucucaccaaauuuuuguugucauugagggca

SEQ ID NO: 447870 - RNA, 64 nt, Human
acaugauuuucuuuuguuuucuucauuucucuugcucaccaagaaguaacaaaaguauaguuuu

SEQ ID NO: 447871 - RNA, 64 nt, Human
aaguaccgagaggcuaaacccacuggccuaagaucucaccaaaguucaugaaaaccaggacuag

SEQ ID NO: 447872 - RNA, 64 nt, Human
cuggugagccaagcaguuugaaauugagcuggaccucaccaagcugcuguggccaucaaccucu

SEQ ID NO: 447873 - RNA, 64 nt, Human
uauagaaucaagauagaaccuuuagauacuccaacucaccaaaauguaaaaaaacuaacaaaaa

SEQ ID NO: 447874 - RNA, 64 nt, Human
cuuugccaagagggaauuuuuaacucaaaguugugucagccagcacgggguagagccauggucc

SEQ ID NO: 447875 - RNA, 64 nt, Human
gcauuaauuguuuugaacauguaaauauaaaucugucagccacuacagccaucaaaagagagca

SEQ ID NO: 447876 - RNA, 64 nt, Human
acccauaagcauggugagcuccugcucucauaaggucagccaaagccccuuaagaagguacaca

SEQ ID NO: 447877 - RNA, 64 nt, Human
uuccuauccacagugaaccugguuacgaagaaaacucaccaaucaucuccuuccuguuaaucac

SEQ ID NO: 447878 - RNA, 64 nt, Human
uuuaagaacuuacaacucagaaaagauugcuagacucaccaaaauaauaaauguucuuuauuuu

SEQ ID NO: 447879 - RNA, 64 nt, Human
auaugcagaggcccagggaccagguguguuuccucucaccaagaagaaaguacacacugaugag

SEQ ID NO: 447880 - RNA, 64 nt, Human
gcuuuaauaggacugauaccauggaauauuucaucucaccaagaugugacauggauuauuuuuc

SEQ ID NO: 447881 - RNA, 64 nt, Human
gcuucuguuuaucacacauaggcccacacacagacucaccaacuuugcaauagaaauacuggug

SEQ ID NO: 447882 - RNA, 64 nt, Human
uguccuaucuccacugugccugccuaaauuuguucucaccaagcacugccugugcaugcagaga

SEQ ID NO: 447883 - RNA, 64 nt, Human
gucgggccuccgauuucauccucagcacguaaugcucaccaacagcacuugcacugaguugacu

SEQ ID NO: 447884 - RNA, 64 nt, Human
acaguucagacagaagucacaaaaaggccuucaacucaccaaagguaaauaucuguaucuauua

SEQ ID NO: 447885 - RNA, 64 nt, Human
gcauuauuuauuuuuugugccaugcauuuuuuuucucaccaaaugaccuuaccuguaauacagu

SEQ ID NO: 447886 - RNA, 64 nt, Human
agguagagaaaccguggagaucgcuuuucucagacucaccaacuuuuaaugggauuucaugggg

SEQ ID NO: 447887 - RNA, 64 nt, Human
cuucuccaauccuaucacugauaguguccaaauucucaccaaauugcuccuaagcuucaaauca

SEQ ID NO: 447888 - RNA, 64 nt, Human
cucaggcaguaaugcucacucaccugccucucagcucaccaacuguguggcccgauuccuaaca

SEQ ID NO: 447889 - RNA, 64 nt, Human
ggagguggggaaggcuuuguauaaucccacccaccucaccaaaacgaugaaguuaugcugucau

SEQ ID NO: 447890 - RNA, 64 nt, Human
guguuguuugaaagugccgaacaguuuagaccagcucaccaauggcuaaugugguccauuuuau

SEQ ID NO: 447891 - RNA, 64 nt, Human
auugaugaucacagucuucaguggugagucaguccucaccaaguuuuccagaucauuccuacaa

SEQ ID NO: 447892 - RNA, 64 nt, Human
cuuuccaggagccccucagauuguaccuugcuuucucaccaauagacaccuucccgacacuuuu

SEQ ID NO: 447893 - RNA, 64 nt, Human
cagguccccauguuuucaccaagcaaucugcuaugucagccaacccaacaucacuuucuacagg

SEQ ID NO: 447894 - RNA, 64 nt, Human
agaauuaauggccagcagugucagggaugagcccgucagccagggcacaggccuggcucacagu

SEQ ID NO: 447895 - RNA, 64 nt, Human
aaguaccaccuguauuaucucacuaaugugcuaugucagccagucaggaaguucugguuaauac

SEQ ID NO: 447896 - RNA, 64 nt, Human
ugcagaggcauguagggaacagcaggagauuauucucaccaaaguuaugucaagccccauuggu

SEQ ID NO: 447897 - RNA, 64 nt, Human
cccagcgaggucugaagggcucgccccguguccucucaccaacaccacaccccaacaagccagc

SEQ ID NO: 447898 - RNA, 64 nt, Human
ucuugacagggcggagggauuucucuuuccugagcucaccaaacuuauuccaguguugaucgca

SEQ ID NO: 447899 - RNA, 64 nt, Human
ucauucaaaugcucuuuucccuauaaccucuuuucucaccaaaaaggagauaaauuugaaaaca

SEQ ID NO: 447900 - RNA, 64 nt, Human
ccgaaggcaguuccuagacacaugggaaauuucccucaccaaagagcaauuaagaaaacaaaaa

SEQ ID NO: 447901 - RNA, 64 nt, Human
cccacaaaauuccuguuacccgcugaacuccaagcucaccaaccagauucaugagcuuucucac

SEQ ID NO: 447902 - RNA, 64 nt, Human
gcaauguaugagaauuccaauuucuguccacuuccucaccaacacuuauuauuuuccuuuuccu

SEQ ID NO: 447903 - RNA, 64 nt, Human
gaaggcaucaagacaaauugaaagaaagcaauaacucaccaaagcucaacgcugccccugccuc

SEQ ID NO: 447904 - RNA, 64 nt, Human
agcccaucaaaguuacuuccagccuggagagaaccucaccaaacagcugguguggccugagggu

SEQ ID NO: 447905 - RNA, 64 nt, Human
gucauugacagacggacuuguugaccacacgccccucaccaaacaaugcagcagcuacuggacc

SEQ ID NO: 447906 - RNA, 60 nt, Human
aacagcucagcaaccccugaauuugacagucucaccaauuucagaaaaucauuaaaaaga

SEQ ID NO: 447907 - RNA, 64 nt, Human
cacccauguuucagagcaucugauuugucagacccucaccaaaaaugggcuuuuaucaaaaugu

SEQ ID NO: 447908 - RNA, 64 nt, Human
guggugugcgugugugcccgucugugacuuucuacucaccaagguugaagaaaggaaacgggga

SEQ ID NO: 447909 - RNA, 64 nt, Human
cagguguguccaccugggcauauccaccaccucccucaccaacauugcuugugccacacccucc

SEQ ID NO: 447910 - RNA, 64 nt, Human
gaaggcgagggauucccagccggacggggguucucucaccaacagcugugauuucaucccgaag

SEQ ID NO: 447911 - RNA, 64 nt, Human
gaggacaagagaagggacacaccccugagagaugcucaccaagcuucuauuuaucuaauuuaaa

SEQ ID NO: 447912 - RNA, 64 nt, Human
cagccagcacugcacagacagcugcgaccaggacgucagccagcacugcacagacagcugcgac

SEQ ID NO: 447913 - RNA, 64 nt, Human
uccgguuuuccaguucuugcacaagcaaguuugugucagccacgcccuggggaggauccacugg

SEQ ID NO: 447914 - RNA, 64 nt, Human
agugcccuuaucucuccuguacagcuuccggaucgucagccaccuugccuuugccaaccaccuc

SEQ ID NO: 447915 - RNA, 64 nt, Human
gaaucaaguaugucccugaguagcaagauuaggccucaccaaagaagaaauuaaccugcacuuu

SEQ ID NO: 447916 - RNA, 64 nt, Human
aucucaucccuuuguagaaauucuugccugaauucucaccaaguuuugaauuccuaagguagcc

SEQ ID NO: 447917 - RNA, 64 nt, Human
cugccacaaaaggugaaaaaugagauccaauccucucaccaaaauuucaaaccuaggacacugg

SEQ ID NO: 447918 - RNA, 64 nt, Human
uccuuccuccuccuccuucucuuuccuccuccuccucaccaagggcccaaccgugugcauacau

SEQ ID NO: 447919 - RNA, 64 nt, Human
guaacauucucacacaguugaggauauucaucuccucaccaauuccagauuguaaauguaccau

SEQ ID NO: 447920 - RNA, 64 nt, Human
uauuuggacuccgucacaauaugguaggauaucccucaccaacucccgacacucagcagacuug

SEQ ID NO: 447921 - RNA, 64 nt, Human
caagacuuggaggaauuaagaguucacccuucaucucaccaaauuuuccccauuuuucucuuuc

SEQ ID NO: 447922 - RNA, 64 nt, Human
cuuccuuguccccgcagcugcuuguggcggauuccucaccaagcucaacggcuccaucaccagc

SEQ ID NO: 447923 - RNA, 64 nt, Human
uucuuggucugucuaugaguucuucaaguacuuucucaccaagcgccagcuggaaaaucgagcu

SEQ ID NO: 447924 - RNA, 64 nt, Human
cauggggucccccuuggggccccacaccccgucucucaccaagaguuacugauuuugcucaucc

SEQ ID NO: 447925 - RNA, 64 nt, Human
uguaugucuugagaaagaaaucacagaagcauuucucaccaauacucuuuggcuuaaaauguuc

SEQ ID NO: 447926 - RNA, 64 nt, Human
ggcugcccugcaaauuuguuucccuuaaggaacccucaccaacuaucucugcuggauuugggag

SEQ ID NO: 447927 - RNA, 64 nt, Human
ccacuggaauaguugguacucuuggauguguuuucucaccaagaugagcaaagaaagguuugca

SEQ ID NO: 447928 - RNA, 64 nt, Human
gacgccugcaggagagagcagcacuccgcaucaccucaccaaggaucggacucugccccuggac

SEQ ID NO: 447929 - RNA, 64 nt, Human
gagagugcauaaccagggagagguuauucacaaccucaccaaacuaguaucauuuuaggggugu

SEQ ID NO: 447930 - RNA, 64 nt, Human
uccccucuuugugcccaaguguuucccucucucccucaccaaaacaaaagggccaucucugccc

SEQ ID NO: 447931 - RNA, 64 nt, Human
ugccuuugccuccagaagcacugggaucacaggugucagccauugcacccagcccagauugucu

SEQ ID NO: 447932 - RNA, 64 nt, Human
gugugggggagcccugagggcugccucucugccagucagccacagagacccuccuccuuucacg

SEQ ID NO: 447933 - RNA, 64 nt, Human
ccaugggggcaagugugaagcagccagucccugggucagccagaggcuugaacuguuacagaag

SEQ ID NO: 447934 - RNA, 64 nt, Human
agugaggaaagccaagcuguauggaaaagcugcacucaccaaggaccacaaugcccccggccua

SEQ ID NO: 447935 - RNA, 64 nt, Human
uggacaaccucuugacuagguuaucaaaauuaaccucaccaauaaaggguggauguucaacaug

SEQ ID NO: 447936 - RNA, 64 nt, Human
cuauuaggaggaaugugcuuuuccaucuaaaauacucaccaaaauauaguuaauuguggcuuua

SEQ ID NO: 447937 - RNA, 64 nt, Human
caguaagcaaggucuuuguggggcaguugucgaccucaccaagacaucugaacauauucaguuu

SEQ ID NO: 447938 - RNA, 64 nt, Human
uacccugagcaggggcagcuggccacucccaguucucaccaagucaccucccuccuuguacaag

SEQ ID NO: 447939 - RNA, 64 nt, Human
guuguuuacgcauggaaucacuauuccugguuaucucaccaacgaaggcuaggaggcggcguca

SEQ ID NO: 447940 - RNA, 64 nt, Human
agguuuggguggugugaucuguccuaauuggccccucaccaaugcaucuaucugucugccacca

SEQ ID NO: 447941 - RNA, 64 nt, Human
uuuacugacuucucuuuauucaauucuccacgcccucaccaaaaaaaacugucucaaaaugaga

SEQ ID NO: 447942 - RNA, 64 nt, Human
acacuugucuccucuugucaacacagauucuacucucaccaauuuaaaugucuuuauauccaug

SEQ ID NO: 447943 - RNA, 64 nt, Human
ugagccacuccggccccgaauguugagguggacucucaccaaaugagaagaaaauggaaccagg

SEQ ID NO: 447944 - RNA, 64 nt, Human
aggcugcucacgccuccucacucucugucugucccucaccaacaccaaggccuccaucucacug

SEQ ID NO: 447945 - RNA, 64 nt, Human
gccucuuuggaagaggccucauggccuccuuacucucaccaaagcaauuuuucccucagggggg

SEQ ID NO: 447946 - RNA, 64 nt, Human
acggggacgacagggaucuucaggaacuucugaccucaccaagucaaguggaccacucuccacu

SEQ ID NO: 447947 - RNA, 64 nt, Human
agaaauacuuuuuauugcugggagucuucugaaccucaccaaacugaggccagagcugagcucc

SEQ ID NO: 447948 - RNA, 58 nt, Human
gccuuggacaagauuuauaauaaccuugcucaccaagcuguuccacuucucuagguag

SEQ ID NO: 447949 - RNA, 64 nt, Human
gagcuaggcaguagugaccuuaggauaugacuaacucaccaaacaaugccaaggagaaaggcgg

SEQ ID NO: 447950 - RNA, 64 nt, Human
gcaggggcaugggaaggugggcgggcaggggagggucagccagggccugcgagggcagcgggag

SEQ ID NO: 447951 - RNA, 64 nt, Human
agcagaggcccaugggauuaaauggcugguccaggucagccagcagguguagggccugacaaga

SEQ ID NO: 447952 - RNA, 64 nt, Human
agaucuuacgguuuggcaacugcagguaaccccagucagccaugucgccagcacaggucuaugu

SEQ ID NO: 447953 - RNA, 64 nt, Human
ugagagcuuguuagcuaagacccauugggcuuuccucaccaaaaaaggaaguguuauuccauua

SEQ ID NO: 447954 - RNA, 64 nt, Human
aaaauacaguuuuaaaaagagaaagcuuuauaaccucaccaaugaauacaaauguuuaaauaaa

SEQ ID NO: 447955 - RNA, 64 nt, Human
uuucauguuucugucucaaaacacuuugacaaagcucaccaacuuuaaaauauuaaguuuuuaa

SEQ ID NO: 447956 - RNA, 64 nt, Human
uuucauuugagauuuucuaaggguagaauuuggucucaccaacaagugaggauauagccuuauc

SEQ ID NO: 447957 - RNA, 64 nt, Human
ugagaagaagcagauccccuguguggucuccaugcucaccaaggaacucuacuucagucaauag

SEQ ID NO: 447958 - RNA, 64 nt, Human
agcaccuuacugcccaggccuaucuggaagccaccucaccaaggaccuuggaagagcaagggac

SEQ ID NO: 447959 - RNA, 64 nt, Human
uuugucucauggucagcucgccucucaaagauggcucaccaaucaccugccuguuuuuacuuag

SEQ ID NO: 447960 - RNA, 64 nt, Human
cuacagggagcacguagaggccaucaaaauuggccucaccaaggcccugacucagauggaggaa

SEQ ID NO: 447961 - RNA, 64 nt, Human
ccuuuacuccaaguccccacuccacgcauccuuccucaccaacucagagcuccccuucuacuug

SEQ ID NO: 447962 - RNA, 64 nt, Human
acgcauuuguauaucuccagaaauucagguaugccucaccaauuugcccgucuuuaauaaaauc

SEQ ID NO: 447963 - RNA, 64 nt, Human
uucuguugagcucuccauuaugugggacccauuccucaccaaaaugaggagagacagugacugu

SEQ ID NO: 447964 - RNA, 64 nt, Human
aaaauaccaugucugugauagggaagaaggccugcucaccaaugaugaggccugugaagccacg

SEQ ID NO: 447965 - RNA, 64 nt, Human
gagggaaacaaaggaggcuucugcaggacugcaucucaccaaagauuuccaugaaauguaauug

SEQ ID NO: 447966 - RNA, 64 nt, Human
uuaagggauugcuuucaucuaauucuggcaggaccucaccaaaagauccagccucauaccuaca

SEQ ID NO: 447967 - RNA, 64 nt, Human
gacuuuuauccugcuucauaacuuguauggagaacucaccaagaaagaauucaauacugugaaa

SEQ ID NO: 447968 - RNA, 64 nt, Human
gauggaacucauggagaaugaagcucuggaaauccucaccaaagcccuccggaguaagcucccc

SEQ ID NO: 447969 - RNA, 64 nt, Human
acccugcccucaugggaccugcccucccucagccgucagccaucagccauggcccucccagugc

SEQ ID NO: 447970 - RNA, 64 nt, Human
gcagagggcaggagggugggugaauuccaguguggucagccaguccuccacagcaccucguggc

SEQ ID NO: 447971 - RNA, 64 nt, Human
agauaauggauaaucuucggccaauuuaugcagagucagccauuccuguucucuuugccuugau

SEQ ID NO: 447972 - RNA, 64 nt, Human
uccagcaggcuccuucccucccugucaccucccucucaccaacccggggucugagccccucauu

SEQ ID NO: 447973 - RNA, 64 nt, Human
cagguggcacgugacagcuaggguucaaaacguucucaccaaauccaaugcuccucacauauua

SEQ ID NO: 447974 - RNA, 64 nt, Human
cacacccccuccuucucugcuuugggucccuucucucaccaaauucaaacuccauucccaccua

SEQ ID NO: 447975 - RNA, 64 nt, Human
gcauggaguuaagaucccucacaggacccagaagcucaccaaaaacuauuucuucagccccuuc

SEQ ID NO: 447976 - RNA, 64 nt, Human
agggcccagaggagacccaucaacucaucugguucucaccaaagccccuagcuagaggcagggc

SEQ ID NO: 447977 - RNA, 64 nt, Human
agcaaauauuuguaaaauuaaaaacggaggaccgcucaccaaauguuugaaauguugcuuuuuu

SEQ ID NO: 447978 - RNA, 64 nt, Human
cagccuguguggaaagacaggagugagaucuggacucaccaaaucccugaggauagauggcacc

SEQ ID NO: 447979 - RNA, 64 nt, Human
aauauauaguuuacaaaaugaaaauuacaauguucucaccaaauauaugccuucguguguccaa

SEQ ID NO: 447980 - RNA, 64 nt, Human
caaagguucaaaaguuuucaaauaacuguggcagcucaccaaaggugggggaaagcaugauuag

SEQ ID NO: 447981 - RNA, 64 nt, Human
aacuccugggcuuaaaugacucuucugccucagccucaccaaaguguugggauuacugguguga

SEQ ID NO: 447982 - RNA, 64 nt, Human
aguuacaagaaauuaccggagaaaagcuugugagcucaccaaacaaggauuucaguguagauuu

SEQ ID NO: 447983 - RNA, 64 nt, Human
ugggcuaccucuccuucagucccagaagacaagucucaccaacccagggagucaaggaccagca

SEQ ID NO: 447984 - RNA, 64 nt, Human
ucucaucaaaaugaaaauauaaaauuaaucauuucucaccaaagaguaugccugggagccucca

SEQ ID NO: 447985 - RNA, 64 nt, Human
uccuccuuaugaagccagcugcugaaauuagcuacucaccaagagugaggggcagagacuucca

SEQ ID NO: 447986 - RNA, 64 nt, Human
uccgcggggagagcaccccggcuucccgcgcgcccucaccaaaaggacccuacagcaaacgggu

SEQ ID NO: 447987 - RNA, 64 nt, Human
uaaagccuugggcaagcgacuucuuagaucagaacucaccaaauggaagccuagcagcugcucc

SEQ ID NO: 447988 - RNA, 64 nt, Human
caguguuauuuauguacagauaagaaaaccauaugucagccaaagauuuuaucucuucuucuaa

SEQ ID NO: 447989 - RNA, 64 nt, Human
cuccugucuuuccagcaugcccuggggugcaguggucagccaccugaagagagagccaauagca

SEQ ID NO: 447990 - RNA, 64 nt, Human
aaauauuaagucauaaucuguuacacuaaaauuugucagccaaauguuagaugaaaugucugca

SEQ ID NO: 447991 - RNA, 64 nt, Human
ggccucauuaucucccacaacuagaccgccaugccucaccaaccuaugucccuggaccuccugg

SEQ ID NO: 447992 - RNA, 64 nt, Human
uaaacuuccugcuaugguuuggauaugguuuguccucaccaaaacucaugcugaggccugaguc

SEQ ID NO: 447993 - RNA, 64 nt, Human
uuaguucugggaaauuguuauagcuuaaauggaacucaccaacauuauucauaguuuaagucuu

SEQ ID NO: 447994 - RNA, 57 nt, Human
ugcaggcugucauuauuuaaacacauucucaccaaaucuaaaauuaguuuaaugagc

SEQ ID NO: 447995 - RNA, 64 nt, Human
cuccgcacaacuaaccugcccugccucuccaucucucaccaaggcugcgucaaagcacagaggc

SEQ ID NO: 447996 - RNA, 64 nt, Human
agccacuaaguuauuugucuacucucacuuuaaacucaccaaagaagauucucuuaaagaaauu

SEQ ID NO: 447997 - RNA, 64 nt, Human
ucccugucugcuuacucacccacucuguccuuuccucaccaacuaacaugugccagccaggcag

SEQ ID NO: 447998 - RNA, 64 nt, Human
uugaguuaguuugugaaaauaaagaacucuguagcucaccaagguggagaaacgcaauucagaa

SEQ ID NO: 447999 - RNA, 64 nt, Human
aagcccacucuccuccaagacuguguugucuuuucucaccaagaguauuaacacuacuaagucu

SEQ ID NO: 448000 - RNA, 64 nt, Human
agguuuucuuucugcucuuuauugaagacaaacacucaccaaaaagaaaaauaaaaguuuucag

SEQ ID NO: 448001 - RNA, 64 nt, Human
aggcugccuuaguggaggugcgcguggccugcaccucaccaagccuagccacucucgcggcucu

SEQ ID NO: 448002 - RNA, 64 nt, Human
cugacucuaauuuuaaaaaauaaaaauuuuaucucucaccaauuuuaaaauggcucaaacaucu

SEQ ID NO: 448003 - RNA, 64 nt, Human
cuuacuuagaacccugauuagaggcaauguuauucucaccaaaaaaggcauuacaaaaaauugg

SEQ ID NO: 448004 - RNA, 64 nt, Human
uauuuagaaagaaauguggaaugggcuaaacuuucucaccaauuuauuagaaagcuaaauggau

SEQ ID NO: 448005 - RNA, 64 nt, Human
agagaggcgggguagguaggcagggcgucccuggcucaccaaugcgucugguccacauggcauu

SEQ ID NO: 448006 - RNA, 64 nt, Human
cuaaauuuugguguuguguaaugcauaaugcuuucucaccaacagaaaaaaggaaaaaaauugu

SEQ ID NO: 448007 - RNA, 64 nt, Human
ggaacccugugguccucaggcagguguaccuugagucagccaggagcccucuuuuccuguguca

SEQ ID NO: 448008 - RNA, 64 nt, Human
ccaucaauaagcugcgauacagcccuggagcucagucagccacaccuuccugcauccuauuggc

SEQ ID NO: 448009 - RNA, 64 nt, Human
auuuacauuuuauauuuuuguacauauuguuagggucagccauuuuuaaugaucucggaugacc

SEQ ID NO: 448010 - RNA, 64 nt, Human
gcuccagcgauuccaaacugcagccccucugccccucaccaaaaccugcggggcugcuuggagu

SEQ ID NO: 448011 - RNA, 64 nt, Human
aagguguuuauguacucagggugcccacaacucacucaccaagauguuuaacaguaaguaacag

SEQ ID NO: 448012 - RNA, 64 nt, Human
ggcacucuauaucugcuaugccuaaaaacuuaaacucaccaaaugguguuuuguuauccagaca

SEQ ID NO: 448013 - RNA, 64 nt, Human
cagcuuuguuucgccugaucucaaguuuuagcaacucaccaacuaaggcguaaccucauuuuau

SEQ ID NO: 448014 - RNA, 64 nt, Human
uccaaagugguugucugagacagaguuggaaacccucaccaacuggccucuucaccuuccacau

SEQ ID NO: 448015 - RNA, 64 nt, Human
aggugagggcccagacaucuggauguggucagaccucaccaaauauaugccuucgugguggucu

SEQ ID NO: 448016 - RNA, 64 nt, Human
cuucugagcccuccccugccccaggaacccuggccucaccaaaacagcagcagcucguuggcuc

SEQ ID NO: 448017 - RNA, 64 nt, Human
cagagcugacccuuccauuaccaauggccugucccucaccaacaagccaacugccacagaugac

SEQ ID NO: 448018 - RNA, 64 nt, Human
ccaucagggccaugagugucacccagaccugacccucaccaauuccagcccugacccucaggac

SEQ ID NO: 448019 - RNA, 64 nt, Human
ucccuguauuuccuaggaaaugaauauucaacagcucaccaacuacagaaagagcgucaugucc

SEQ ID NO: 448020 - RNA, 64 nt, Human
gcgaugacacagcaaggaugacucagcacugccccucaccaaggaugacucagcacugccgcuc

SEQ ID NO: 448021 - RNA, 64 nt, Human
uuuugccguugaaaaauacagugcccaaaauaaucucaccaacaaagcacugcucauacuagac

SEQ ID NO: 448022 - RNA, 64 nt, Human
cgcugaggcaggguuguuagaggacugugucauccucaccaagcucauuacaucugccagggcc

SEQ ID NO: 448023 - RNA, 64 nt, Human
ccuucccucucuuuccccagacaccuacuugagacucaccaauuucuggccuguucaggagccu

SEQ ID NO: 448024 - RNA, 64 nt, Human
aaguuaaagaaaaaaaucuaauguaugaaugugacucaccaauuuuuaucaacuaauuccuuuu

SEQ ID NO: 448025 - RNA, 64 nt, Human
gaaggggcaucuggaggguccaugagauggggcccucaccaaaugccuuggccaccggccagca

SEQ ID NO: 448026 - RNA, 64 nt, Human
ugcgucggcuucccagagugcugggauuacaggugucagccacugcgcucagcugggagaugaa

SEQ ID NO: 448027 - RNA, 64 nt, Human
uagucuuuucuaagagucaaccacaggcauuuaagucagccaaagaauauuguuaccuuaaagc

SEQ ID NO: 448028 - RNA, 64 nt, Human
ccagacucgccacuuugggugcacaggugguuaggucagccaacugguucugccugucgccuug

SEQ ID NO: 448029 - RNA, 64 nt, Human
gggaccucccagcucuuauuugcacccuccccaccucaccaacuuuggucccucucugggggca

SEQ ID NO: 448030 - RNA, 64 nt, Human
gucuucagcugcaacaccuguuuaugauccuggccucaccaagguauguggaccgagugacuga

SEQ ID NO: 448031 - RNA, 64 nt, Human
guaaggacauucagaauaaauaucugcugcucugcucaccaauugcugcuggcagccucucccg

SEQ ID NO: 448032 - RNA, 64 nt, Human
cgcauaauaaagacuggaacccucguucucagcucucaccaaguggacuuuuugcggggugugg

SEQ ID NO: 448033 - RNA, 64 nt, Human
gaacuugauugggaagaaguucaaagagcugaaccucaccaauaucuacgcucccccauugccu

SEQ ID NO: 448034 - RNA, 64 nt, Human
gccacccagcuuuucuuggccucaugauuucucccucaccaauuugcuuaaauuaguaugugcc

SEQ ID NO: 448035 - RNA, 64 nt, Human
acucauggccucagucaguucauucuuuaauuuccucaccaaauuauugacuuagagcauaacc

SEQ ID NO: 448036 - RNA, 64 nt, Human
ccagccugguggcagaggaagcagguggcaccaacucaccaaagggacuugggagccaccuucu

SEQ ID NO: 448037 - RNA, 64 nt, Human
uuaccuguauucccaucuccccagugucacuccccucaccaaucacuccagaugguuuuggggg

SEQ ID NO: 448038 - RNA, 64 nt, Human
ccaauucuuggauugaguuuggccuccaaauaugcucaccaaacacuauguugcuacccucuac

SEQ ID NO: 448039 - RNA, 64 nt, Human
agugucuggaagcugcuguugccaucuugaacaacucaccaaccuccaacccagagccccagug

SEQ ID NO: 448040 - RNA, 64 nt, Human
cuccacugcuuaaaccacaggaccugguuaacuccucaccaagcuucccacgacccugguugcc

SEQ ID NO: 448041 - RNA, 64 nt, Human
aaccuggauguaaagcugagccuacagaccuguccucaccaacuguuuugugauuucuacucaa

SEQ ID NO: 448042 - RNA, 64 nt, Human
caccaggaauguuuaaaacuagugucuucaaauccucaccaacauccaggauugugucuuuaug

SEQ ID NO: 448043 - RNA, 64 nt, Human
augaugauuuuuuucucaauuuugaauuaugcuacucaccaauuuauauuuuuaaagcaaguug

SEQ ID NO: 448044 - RNA, 64 nt, Human
uccuuagacuuguucugcauuuuauuuuuuauuucucaccaaaauaaaagcauuuaugagaauu

SEQ ID NO: 448045 - RNA, 64 nt, Human
uugcuagcacauacuuuauuaucccccaaggauggucagccauuucuucccacagccaaagccc

SEQ ID NO: 448046 - RNA, 64 nt, Human
uggacaugaagagcagaugaccaccaugcucugugucagccaggacgaagggagacaucugggu

SEQ ID NO: 448047 - RNA, 64 nt, Human
ccuccugcagugcggcauccccuuggcagcugccgucagccaggccagccccagggagcuuaaa

SEQ ID NO: 448048 - RNA, 64 nt, Human
caucuuacuggaagagaguuccgggaaacauagccucaccaaggugacacauuacaaagccacc

SEQ ID NO: 448049 - RNA, 64 nt, Human
cagccaggcagcccaccccacccuggggcccugccucaccaaggaaauaaagacucaagccauu

SEQ ID NO: 448050 - RNA, 64 nt, Human
aggacccggacacccugugggaccuggccucaaacucaccaaaucgcucaugguuuuuaaaacu

SEQ ID NO: 448051 - RNA, 64 nt, Human
cucuagaaggccuggcucugauccagugaccccucucaccaaagaacucgguuuaaccagggcu

SEQ ID NO: 448052 - RNA, 64 nt, Human
gaagcacuuagaacugauggccagcacaugagggcucaccaaguguaagccacaaauacacauc

SEQ ID NO: 448053 - RNA, 64 nt, Human
ucaugauuagguucugagcaaacaugaucuagcucucaccaaaaggaccugagcuagggucugc

SEQ ID NO: 448054 - RNA, 64 nt, Human
cagcagugcacaaggauugcaaucuauauacauccucaccaacauuguucauuuucuauuucug

SEQ ID NO: 448055 - RNA, 64 nt, Human
ggccaggggcuucugugagaggcagagggggacccucaccaaaucuugguggaagagcccaggg

SEQ ID NO: 448056 - RNA, 57 nt, Human
aagauuguggacaaauuugagucacuucucaccaaucagacuuuauggagaacagaa

SEQ ID NO: 448057 - RNA, 64 nt, Human
auuugccgagccucuacuguauaccaggggcuaacucaccaagcacauucuaggaauugggccc

SEQ ID NO: 448058 - RNA, 64 nt, Human
ggacuaugagcaguggcuggagaucaaagugugucucaccaagacagugagaccgacucccccc

SEQ ID NO: 448059 - RNA, 64 nt, Human
ccuguaucucagaagggaggggcacagcuacacacucaccaaaggccccccugcacauuguauc

SEQ ID NO: 448060 - RNA, 64 nt, Human
ugccuucuccuauuucuccaaagccuugugugaacucaccaaacacaagaaaaucaaauauaua

SEQ ID NO: 448061 - RNA, 64 nt, Human
aaauccuuguaccugaugucugagccacucagaacucaccaaaauguucaacaccauaacaaca

SEQ ID NO: 448062 - RNA, 64 nt, Human
aaacccuuguaccugacaugugagccacucagaacucaccaaaauguucgacaccauaacaaca

SEQ ID NO: 448063 - RNA, 64 nt, Human
aagaaaaacucuugaaaguaagaaaugauggcaacucaccaaauuaacucauguaucauacuuu

SEQ ID NO: 448064 - RNA, 64 nt, Human
uggccaacaucauauaccucuugaagaagaaggagucagccaucgccaacuugucucuguagaa

SEQ ID NO: 448065 - RNA, 64 nt, Human
agaggaggcacaggcccugccacggccaacucaggucagccagccugaggcuguggccuccaaa

SEQ ID NO: 448066 - RNA, 64 nt, Human
gcagaaagccacaaacuccauccagauccggaacgucagccagcucccagccacauggcgcaug

SEQ ID NO: 448067 - RNA, 64 nt, Human
acuguggggaaugaggcaucuuuuagcaagagcucucaccaauuguagauuggugugaauugcu

SEQ ID NO: 448068 - RNA, 64 nt, Human
cuguaaaccacuugucacuacaaaaauacaauuacucaccaaaaagcuuuaaaaaauaaagcug

SEQ ID NO: 448069 - RNA, 64 nt, Human
ccauguauuacaaacaguuggcaaccuugcccugcucaccaaaugggaguugcauaccaguauu

SEQ ID NO: 448070 - RNA, 64 nt, Human
aguuaaggaucccuuugcugugaggguagaaaaccucaccaacugcaccagugaggaagaagac

SEQ ID NO: 448071 - RNA, 64 nt, Human
caccccuucacguguauccccacacaaaugcaagcucaccaagguccccucucaguccccuucc

SEQ ID NO: 448072 - RNA, 64 nt, Human
cacaaaaucccucuccaaccacaggacccuucggcucaccaagaacagggcccaggggagucag

SEQ ID NO: 448073 - RNA, 64 nt, Human
ggaggugcacacgcgagguauaggcuccagacuccucaccaagaugggcuaugaguuuggcaag

SEQ ID NO: 448074 - RNA, 64 nt, Human
cugcacuccagccugggcgacagugagacccugucucaccaaagaaaaaaaaaaggugagauua

SEQ ID NO: 448075 - RNA, 64 nt, Human
ggcccugacuuugugcuggucuggccccuccugccucaccaacccgugcacaaccagacaccuu

SEQ ID NO: 448076 - RNA, 64 nt, Human
cugugaccauugggugugggaacuacggucuguccucaccaagggauggggguuuggggaggag

SEQ ID NO: 448077 - RNA, 64 nt, Human
uuccuaucauucagaucuuccuuccucccaaguacucaccaaccccuuccacuucccacuuccc

SEQ ID NO: 448078 - RNA, 64 nt, Human
gcaaguuucuuguggauccuguugggaccagccacucaccaaggcugaguagguccacaaauaa

SEQ ID NO: 448079 - RNA, 64 nt, Human
aaguguuugucccacauuuuccuaggguuaacaccucaccaaguucuuccagcaaaaugcuuau

SEQ ID NO: 448080 - RNA, 64 nt, Human
uacaccucagccugugaaaugaacgauccggacccucaccaacuuuccccaccucaggcagccc

SEQ ID NO: 448081 - RNA, 64 nt, Human
gaucguccagugcccuuuucagugcuaccggccucucaccaagcaguccuccaugugagcaacc

SEQ ID NO: 448082 - RNA, 64 nt, Human
aaagauuacacuguauuaacucucgaggaguuuccucaccaauaaacagacaaccucaacugcc

SEQ ID NO: 448083 - RNA, 64 nt, Human
uaccuggauccaguuauggugccucaggggcugcgucagccaaggaaagggaagugcugcuuag

SEQ ID NO: 448084 - RNA, 64 nt, Human
ucucccaaaaaacuacuucuuuuuucaaaagaaagucagccauaucuccauugugccuaagucc

SEQ ID NO: 448085 - RNA, 64 nt, Human
aagcagaauguauaggugucagagaagaaaccuagucagccagacgugcucuguauucagcaau

SEQ ID NO: 448086 - RNA, 64 nt, Human
ugggacuucaguggacccccagccccugcccccacucaccaaggccucgcucgucccucucguc

SEQ ID NO: 448087 - RNA, 64 nt, Human
uggcgggcagaugguggaaggcagcuuaggagaccucaccaaagagaagauggaccggcucuug

SEQ ID NO: 448088 - RNA, 64 nt, Human
acauggcaaaguuucaaagagcucuuggccaucccucaccaaacuuuggcaaaagaugguguua

SEQ ID NO: 448089 - RNA, 64 nt, Human
uuuuuguaagauaugugaaugaaguguugguguccucaccaagagguggcaccuaaggguucug

SEQ ID NO: 448090 - RNA, 62 nt, Human
gugcccuguguguaaguccuaauaaacucaccuacucaccaagcuggacuuauucgagucau

SEQ ID NO: 448091 - RNA, 62 nt, Human
uugaccuguguguaagucccaauaaacucaccuacucaccaagcuggacuuguucgagucau

SEQ ID NO: 448092 - RNA, 64 nt, Human
ugaaaggcgagcagaacucccccuggggaggaagcucaccaaaaguuuuucccaaagcucaaug

SEQ ID NO: 448093 - RNA, 64 nt, Human
acuucuaccuaaaucaccuggaaggagagcauuacucaccaaaauugcaaaacaaggguaucaa

SEQ ID NO: 448094 - RNA, 64 nt, Human
auggacccuuggagacucccauccucucuucccccucaccaagugcccaggagaccccuggcuc

SEQ ID NO: 448095 - RNA, 64 nt, Human
aaccucuucuugcccuuaagggucuuuuaccucccucaccaacuaagauuuggucauguugcgu

SEQ ID NO: 448096 - RNA, 64 nt, Human
caaugccccugcuuccauuucuccccaccucacucucaccaagucaccagagggugguucugua

SEQ ID NO: 448097 - RNA, 64 nt, Human
ugagggcuuccaaugugcugccccccucuuaauacucaccaauaaauucuacuuccuguccacc

SEQ ID NO: 448098 - RNA, 64 nt, Human
ugagcaugaaucccuggagaaaucguuuucguagcucaccaauggugaguaaagauacagcucu

SEQ ID NO: 448099 - RNA, 64 nt, Human
cuagugaagaagcaggagcuucuuguuuuaauugcucaccaaugguugguucuugaguggcuau

SEQ ID NO: 448100 - RNA, 64 nt, Human
uuggcuaugccuuuucagacauugauuuggacagcucaccaaccccugaaggggccguucagcc

SEQ ID NO: 448101 - RNA, 64 nt, Human
gaggcagaggcugcuggcugaccuccugcacaacgucagccagaacaucgcggccgagacccgg

SEQ ID NO: 448102 - RNA, 64 nt, Human
cagauuuucugacagcuguccauccugugucugggucagccagagguuccuccaggcaggagcu

SEQ ID NO: 448103 - RNA, 64 nt, Human
guuuuauagaauuucuuaauaccauccugguuuggucagccauuccuuugauuggaaaggucag

SEQ ID NO: 448104 - RNA, 64 nt, Human
ggcuccgcucuugggacaccggagaaccuaucaugucagccagcgggcccacacgucggacccc

SEQ ID NO: 448105 - RNA, 64 nt, Human
ccucagugagcugcagguaucucaccuggcagccguccaguacugcuggcuuccucuggaggcc

SEQ ID NO: 448106 - RNA, 64 nt, Human
cuaaaaaauguuuccuugggucagugguuuugagguccaguagcuaggcuuuucucuuuugucc

SEQ ID NO: 448107 - RNA, 64 nt, Human
aauugagaaccacuggucuagcuagaccugcacuguccaguacaguagccacuaaauacaugug

SEQ ID NO: 448108 - RNA, 64 nt, Human
gagaugauggaaauguucuaccucugcacucacuguccaguacauuagacacuaggcacauugg

SEQ ID NO: 448109 - RNA, 64 nt, Human
gagacugagaaagggguguauuuaauuccaucagguccaguacaguacuaggagucauaauacu

SEQ ID NO: 448110 - RNA, 64 nt, Human
gggagccucgccuuacaacuaauuccugccuuucguccaguaccaagucccccguugcuucugg

SEQ ID NO: 448111 - RNA, 64 nt, Human
cgacacguccacauauguauuuguguauguuaauguccaguaucacaucacccaugaaagucgu

SEQ ID NO: 448112 - RNA, 64 nt, Human
ggcuaauuugguauugaaagcaugcugauauaaaguccaguauuugaggauauaaagaggaugu

SEQ ID NO: 448113 - RNA, 64 nt, Human
guuuaucugugaacugcagugcuguaucaaagcaguccaguaaccugcaguacugaguauggug

SEQ ID NO: 448114 - RNA, 64 nt, Human
gaaggacccaagccaauauguuccuuugaaaagaguccaguacccaggccccauggaaaggucu

SEQ ID NO: 448115 - RNA, 64 nt, Human
uuauuaaguacauuugaauugucuccugacuacuguccaguaaggaggcccauugucacuuaga

SEQ ID NO: 448116 - RNA, 64 nt, Human
ccaccuucuuuagauuucacucagcauuuaguagguccaguaggaaaaacccaaaaugguacau

SEQ ID NO: 448117 - RNA, 64 nt, Human
agucauucuuauuuuagaaaaagugacagaagcaguccaguaagauuauauguuucuguuucug

SEQ ID NO: 448118 - RNA, 64 nt, Human
uuacuagguguucugauggagugggacaguccaaguccaguaacugacauuacguuuuaugcgu

SEQ ID NO: 448119 - RNA, 62 nt, Human
uuuuacuuagaugccagucuacuuuauaaagacaaauggauuauagacuuaaaaauagucau

SEQ ID NO: 448120 - RNA, 62 nt, Human
caggacacugagggaauauuucccuaucccuucaaauggacggucacuacagaaacguguag

SEQ ID NO: 448121 - RNA, 62 nt, Human
uguacagauuuuuuuuuuuaaccacucaaucccaaauggaggccuacaaagaacaucguaau

SEQ ID NO: 448122 - RNA, 64 nt, Human
caguaaaugucuaucuauaauauuucauuauagaguccaguagcuuaauacugacacugacuug

SEQ ID NO: 448123 - RNA, 64 nt, Human
auucuucggugcuguguagcuggcagaaaguucuguccaguaaacgcaggauggaauuuuccug

SEQ ID NO: 448124 - RNA, 64 nt, Human
aaugcuguauugccauaguggucacacccaagugguccaguaucucaauggugaggcagccaga

SEQ ID NO: 448125 - RNA, 64 nt, Human
augaguuucuuuuaugaaacuugauaccacgggaguccaguaauauuggccacaaaagccagag

SEQ ID NO: 448126 - RNA, 64 nt, Human
auauucgaauaauauacauaugagagguaugccuguccaguaaagagauugauuuguuuguaug

SEQ ID NO: 448127 - RNA, 64 nt, Human
gguguucuggccugagaagguaaagaagaggcauguccaguaugcuuugcaggguguguuugcu

SEQ ID NO: 448128 - RNA, 64 nt, Human
gcuaaagccauaggaagaaaaaugugauguauguguccaguauguacuauuuuguuuuuguuuu

SEQ ID NO: 448129 - RNA, 64 nt, Human
uucuaucggaaguaaauuaauuuguuguaauaaaguccaguauuuaauaaaauguacaauguua

SEQ ID NO: 448130 - RNA, 64 nt, Human
gcggucgguuauacuucuuaggugacagguuauuguccaguacuuuaauguauguauguauaau

SEQ ID NO: 448131 - RNA, 64 nt, Human
uauaucugaguuauugcucauuuaaaacuguuaaguccaguauaauuuucccugauaugaaaaa

SEQ ID NO: 448132 - RNA, 63 nt, Human
aaggguuuaguuuggccugaggcuucucagcuuguccaguauuucccuucguuccucaguguc

SEQ ID NO: 448133 - RNA, 64 nt, Human
ccccccaauuuaaaauugauucuaguaaaauuagguccaguaacaccuguauauauguauauau

SEQ ID NO: 448134 - RNA, 64 nt, Human
ucagggguuugcuuacagugaugccaugaagacaguccaguagacuugguagcgacccccuccc

SEQ ID NO: 448135 - RNA, 64 nt, Human
ccacuuuguaauuagaaaauuuuauggacaguaaguccaguaaagccuuaaguggcagaauaua

SEQ ID NO: 448136 - RNA, 62 nt, Human
gugcccagugguagcgauggaaaaaaguauaccaaauggacuuugaaggaccaaagguuuua

SEQ ID NO: 448137 - RNA, 62 nt, Human
agguggagccuccuggcugagaaauuguuuugcaaauggaucuauuuuuguaugaaaaaaaa

SEQ ID NO: 448138 - RNA, 62 nt, Human
agcaggcagagcuuaccaagucucuccgaacucaaauggaagaaauaccuuaugaauguaag

SEQ ID NO: 448139 - RNA, 64 nt, Human
guggaaaugaacuauauuagcuauuaugaauaauguccaguauaagaauaugcuucuggaauug

SEQ ID NO: 448140 - RNA, 64 nt, Human
cuggccacauccagcccaaagauaaauuuuguuuguccaguauagcauuuaacugcaucagaac

SEQ ID NO: 448141 - RNA, 64 nt, Human
ggaaaggagacaaggaggccaguauggacacuguguccaguauggcuuuccaggcuaaucacuu

SEQ ID NO: 448142 - RNA, 64 nt, Human
gacagcaccguuuuuucagugaagcucucagaauguccaguacagauguugcagauaauuccaa

SEQ ID NO: 448143 - RNA, 64 nt, Human
ugaaaaugaaucuucacaaaacacuucgagcacuguccaguauucuaccgugguacacaguggc

SEQ ID NO: 448144 - RNA, 64 nt, Human
gucacauugaccugcuggcugaauaccucaaauaguccaguagagggcaguccaccaggcagaa

SEQ ID NO: 448145 - RNA, 64 nt, Human
ugugcuuaauaaaaaacaaaaaaguuugacuuuuguccaguaaauugcuaaguaaugucaauaa

SEQ ID NO: 448146 - RNA, 64 nt, Human
ugggcgugaacggaaugggaggguugucuagcauguccaguaugagugguggauggggaaugua

SEQ ID NO: 448147 - RNA, 64 nt, Human
ccaauuuaaccucauuucccagaucauuuuucauguccaguaacacagaagccaccaaguacag

SEQ ID NO: 448148 - RNA, 64 nt, Human
ccaauuucauaucauuccccagaucauauuucaaguccaguaacacaggagcaaccaaguacag

SEQ ID NO: 448149 - RNA, 64 nt, Human
aaaguuguucaacaacaguuaccucauugaguguguccaguagugcaggaaaugaugucuuauc

SEQ ID NO: 448150 - RNA, 64 nt, Human
aagauaccucauugaaucccuaaauuuaaaagcaguccaguaaaagguuaacuguauaaagaau

SEQ ID NO: 448151 - RNA, 64 nt, Human
gagaucaucucuucuagaaauaucaaccuuuuuuguccaguaaauaauuguuaggggaucuuua

SEQ ID NO: 448152 - RNA, 64 nt, Human
aguaccacccaguaagucuggcugagcaucuuauguccaguagguucuugguaaacauuugcua

SEQ ID NO: 448153 - RNA, 62 nt, Human
uucuucauggaaacuucaaagcagcauuuaaacaaauggaaaacuuugaacccccacuauua

SEQ ID NO: 448154 - RNA, 62 nt, Human
ucccuaacuccucuuugauagagaaagagucucaaauggacaacuguccuguguugcuuucc

SEQ ID NO: 448155 - RNA, 62 nt, Human
uccuggaauucuccaauggggucgccaaacaacaaauggagaaaaaaaguuuuacuuccuug

SEQ ID NO: 448156 - RNA, 64 nt, Human
aagggauccccuucauugggaaaauggaaauggcguccaguacuucugcacagaauuugguaaa

SEQ ID NO: 448157 - RNA, 64 nt, Human
caaaaucugugcagagggccuuagcaugggauguguccaguauugaaaaggcugcacugccaac

SEQ ID NO: 448158 - RNA, 64 nt, Human
gugccuugucguccucuuugaaacaccccguguuguccaguauaccuuauaacacugagccacu

SEQ ID NO: 448159 - RNA, 64 nt, Human
ucucagugguugcugaaggcagguagagggugcuguccaguaucccccaugugaaggucacuuc

SEQ ID NO: 448160 - RNA, 64 nt, Human; identical to SEQ ID NO: 448157

SEQ ID NO: 448161 - RNA, 64 nt, Human
uaugcacuauuuaaaaaaaguuuuuuuuauuugaguccaguauaauucauguaaauguuaacaa

SEQ ID NO: 448162 - RNA, 64 nt, Human
cgugugaguucuguacaaaaagcccccacaagucguccaguagaaaugcaucuaugaggucagc

SEQ ID NO: 448163 - RNA, 64 nt, Human
augucuuaaauguucaguaaauaucuuucuuacaguccaguagcuuagagcauguuugcugauu

SEQ ID NO: 448164 - RNA, 64 nt, Human
aaaaauuaacugucguaccaucuagaacuauacuguccaguaccauagccucuagccguaugua

SEQ ID NO: 448165 - RNA, 64 nt, Human
uucuccuacaaagggaagcagccuggaagaaacaguccaguacuugacccaugccccaacaaac

SEQ ID NO: 448166 - RNA, 64 nt, Human
uuuauuuuaaauaaauaacuagucauaucauuagguccaguaauuguugacaggcaggaacggg

SEQ ID NO: 448167 - RNA, 64 nt, Human
ccgucucaaguuccgcauccucaggcgccagccuguccaguagcaugaacaccgcgaacagccu

SEQ ID NO: 448168 - RNA, 64 nt, Human
ugcagucugacaagcucaucacugaauucugcuaguccaguagcaaugucuuccucuuaugacc

SEQ ID NO: 448169 - RNA, 64 nt, Human
aaggaauauuguuucuaagacuguuuugagacauguccaguacaucacaaaggagaucggggcg

SEQ ID NO: 448170 - RNA, 62 nt, Human
caucaugauagcuguaagucaggcauuaaaaucaaauggaaauacaccuaaaauguccgcau

SEQ ID NO: 448171 - RNA, 62 nt, Human
aacuuugaaccaguuuuuuucucaggagcugucaaauggacacuuaauuaugacaugagaau

SEQ ID NO: 448172 - RNA, 56 nt, Human
cugacaacagugaccagugagguccucaaauggaaacaagccacuuagccaguuuu

SEQ ID NO: 448173 - RNA, 64 nt, Human
uaugaggauaaugggaagagguuugguuuccuguguccaguagugggaucauccagaggagcug

SEQ ID NO: 448174 - RNA, 64 nt, Human
aucuuaguuugugaugauuacauugcuuuuuguuguccaguaguuuaguuuguguacauauaua

SEQ ID NO: 448175 - RNA, 64 nt, Human
uauuauuauuuacagucauauuacugaacucaguguccaguauaaugcagaauugcagagugua

SEQ ID NO: 448176 - RNA, 63 nt, Human
cagucaccaaaauccagugaagaaacaccacccguccaguaccaccaaaguaguucucuguca

SEQ ID NO: 448177 - RNA, 64 nt, Human
cugguacccacucgaguugugccgugcacaaccuguccaguauaugcaugugguggcccuacug

SEQ ID NO: 448178 - RNA, 64 nt, Human
auuugcugugcaucauuuuuauauuuaauucuauguccaguaaaagugauggcaucucucauug

SEQ ID NO: 448179 - RNA, 64 nt, Human
gagccaagagggaagggcaggguagagaggguauguccaguagccuggagcuccaugguggcuu

SEQ ID NO: 448180 - RNA, 64 nt, Human
cuuugguuuuuguaaacggagaggacaguucuuaguccaguaaaaauaugcagauuguauguaa

SEQ ID NO: 448181 - RNA, 64 nt, Human
uugcuucacuauacaguauuccaagcucucugcuguccaguaggcugcuucucugagggucacc

SEQ ID NO: 448182 - RNA, 64 nt, Human
cuguaaacuggagagagcccagcacuuggcagguguccaguaccuaaucacgcucuguuccuug

SEQ ID NO: 448183 - RNA, 64 nt, Human
uuaaaagaagcagaguaugagagacagguacaugguccaguaggaagagaagcagcccugauuc

SEQ ID NO: 448184 - RNA, 64 nt, Human
uuuccuguaaagaccuugaaaagcaguaacuuggguccaguauuuacggaggcguugugaaugu

SEQ ID NO: 448185 - RNA, 64 nt, Human
caagaaaaaugccacuaaucaaagcauuaaguguguccaguaaugaagaacaucauauaaaauc

SEQ ID NO: 448186 - RNA, 64 nt, Human
caacaaucauauacugauuagcuacucugaccagguccaguacuaacucugaagaaguuaugcc

SEQ ID NO: 448187 - RNA, 62 nt, Human
aaauuuuccagcccagauacucuucaucuauucaaauggauugucuuauucugagcaaagac

SEQ ID NO: 448188 - RNA, 62 nt, Human
guccuuggcagaacuggacacuauugaccauccaaauggaaauuccccuuucuuggugucuc

SEQ ID NO: 448189 - RNA, 62 nt, Human
cuuugaguggguuugcuaucaaugaaaugcuacaaauggaauaaguugcagaaauuuuucuc

SEQ ID NO: 448190 - RNA, 64 nt, Human
acaggcucaguccugccucacacuagcauuucaaguccaguauuccugcuaaaugguccuugga

SEQ ID NO: 448191 - RNA, 64 nt, Human
aacuuaaaacaauucuccaauccccucuccuuugguccaguaggaggugcccuucacucuaagc

SEQ ID NO: 448192 - RNA, 64 nt, Human
uaaaaguuaggauuuuauggaguauggagauaggguccaguaucuauuuacccuguaauguuua

SEQ ID NO: 448193 - RNA, 64 nt, Human
cuuaccugcccccauccuuuuuuguauaugauguguccaguaaguauucaauaaauguaguuua

SEQ ID NO: 448194 - RNA, 64 nt, Human
cuucccaucucaggcucuccuguuuucccucaggguccaguaugccuuugagcuuuagcuguua

SEQ ID NO: 448195 - RNA, 64 nt, Human
cacgggcaggcucaggcgggaagaaggaggcaucguccaguaagaccgucccggacgggaagcu

SEQ ID NO: 448196 - RNA, 64 nt, Human
uucuuauucgggugugagucuuuucagcaacccgguccaguacugggagauacagccauccacc

SEQ ID NO: 448197 - RNA, 64 nt, Human
augagaauguacuguacaaccacaucuucaaaauguccaguagccaaguuccaccacuuuucac

SEQ ID NO: 448198 - RNA, 64 nt, Human
caaaucaaccuuuuaauaauuuucugugcuaaggguccaguauuuauuugauuauuuaguaugu

SEQ ID NO: 448199 - RNA, 64 nt, Human
cuggaucucugugguuccuucucagccgaaacagguccaguaucccagucauuucuucaaaugc

SEQ ID NO: 448200 - RNA, 64 nt, Human
ggugagaacuaaugccuagcuugaggggucugcaguccaguagggcaggcagucagguccaugu

SEQ ID NO: 448201 - RNA, 64 nt, Human
uccagcaagugucaucacuuuuacagaaaacaagguccaguaauagcaagucuuaguacauccu

SEQ ID NO: 448202 - RNA, 64 nt, Human
aggacagugaaaaauguuuccuugcaaacuuguaguccaguaucaguuacuuccuauuuuuauc

SEQ ID NO: 448203 - RNA, 64 nt, Human
gucuguucaagcaaaguugaucugcuccuggcacguccaguaaauuccagaaucauucuccuuu

SEQ ID NO: 448204 - RNA, 62 nt, Human
caguauuaaaaacaaagcaagcugagucugaacaaauggaucuuucugccaucauuuguaca

SEQ ID NO: 448205 - RNA, 62 nt, Human
ggaagugguagaauuucuggucuguacuuuuacaaauggagcccuugggagguggguuaggu

SEQ ID NO: 448206 - RNA, 62 nt, Human
gggagaaacaucuggaaggaugcucgagagaacaaauggagguggugaaaaucaagcuuugg

SEQ ID NO: 448207 - RNA, 64 nt, Human
ggggaggcgggguuaguauuuauaguccuaacaaguccaguaauuuuuuauaaaucuucagauu

SEQ ID NO: 448208 - RNA, 64 nt, Human
acagcagugucccggcacaggcccaucgagccggguccaguacccaaccuucgcacgagugugu

SEQ ID NO: 448209 - RNA, 64 nt, Human
aauauggucagguaguuauauguaagguuacgugguccaguaaugucuuagauugauaaauuag

SEQ ID NO: 448210 - RNA, 64 nt, Human
gacccugggucuggugaaugaggauguuagggugguccaguaccuggcugagcugcugaagcug

SEQ ID NO: 448211 - RNA, 64 nt, Human
ugcaauugaaaagccgaaaagauuauacugucaaguccaguaaaugacauuuuuagagaugcuu

SEQ ID NO: 448212 - RNA, 58 nt, Human
acagcauuuugaaaaacuaacaagacugguccaguacccuucaaccaugcugugaucg

SEQ ID NO: 448213 - RNA, 64 nt, Human
uagugcccugcugcuugcuuccagacuuugugcuguccaguaauuaugucuuccacuacccauc

SEQ ID NO: 448214 - RNA, 64 nt, Human
agaaugagacaauuuuguguaggcuuuuucuaaaguccaguacuuuguccagauuuuagauucu

SEQ ID NO: 448215 - RNA, 64 nt, Human
gucucaguguucacugcugucucuccagcucuuaguccaguagcugcauggugagugagcguag

SEQ ID NO: 448216 - RNA, 64 nt, Human
ugcccuggaccaggucagggccuacagcuguguuguccaguacaggagccacgagccaaaugug

SEQ ID NO: 448217 - RNA, 64 nt, Human
cuaauaagcuaguugaauacuugaaccauaaaauguccaguaagaucacuguuuagauuugcca

SEQ ID NO: 448218 - RNA, 64 nt, Human
uuccccaccucuccaggugucaaaggugaaccgaguccaguauuagcugaaugucauuucguac

SEQ ID NO: 448219 - RNA, 64 nt, Human
cugaucgagcgcugucuggcuuuaaccugagcugguccaguagacaucguuuuaugaaaaggua

SEQ ID NO: 448220 - RNA, 64 nt, Human
caagacccucaggacuggccauauaaucugcaagguccaguaugaaauaagaauaagcagccca

SEQ ID NO: 448221 - RNA, 62 nt, Human
gguuaaauaaauucugaguaaaauucuuaagccaaauggaaauucuuaaugcaaucaugagg

SEQ ID NO: 448222 - RNA, 62 nt, Human
gauuuuucuaaauacagccuuuaaauuugacucaaauggaaauugugcacuuuccuguuuau

SEQ ID NO: 448223 - RNA, 62 nt, Human
auuuucuuuuaguguuguguagccaaaaauuacaaauggaauaaaguuuuaucaaaauauug

SEQ ID NO: 448224 - RNA, 64 nt, Human
cugcaguagaguuggaguacuuaguucucuuguuguccaguauaucuaauaaguguuuuucaua

SEQ ID NO: 448225 - RNA, 64 nt, Human
guucugcaaaguaaaauuuuuugguuaagagcguguccaguaguaaugugcuuguuagcuguuu

SEQ ID NO: 448226 - RNA, 64 nt, Human
ugcuaaauacucucuuauuugcucuaguguacuaguccaguaguguuugcauguggaugucugu

SEQ ID NO: 448227 - RNA, 64 nt, Human
gggaacccuguuacacuauuaaaggcuuagggaaguccaguaaagaaaccuauuuuccgaauuu

SEQ ID NO: 448228 - RNA, 64 nt, Human
aguguuccaaagacuuugguauggauuaagcgcuguccaguaacaaaaugaaaucucaaaacag

SEQ ID NO: 448229 - RNA, 64 nt, Human
gacuugguuuuacaggucauuaccagucauuaaaguccaguauuacuaagguaagggauugagg

SEQ ID NO: 448230 - RNA, 64 nt, Human
ucaucuuaggauaguguuugauauaucuaagaaaguccaguaacagagaagaaaugucucaaau

SEQ ID NO: 448231 - RNA, 64 nt, Human
acauauauucugugagauaacugugccugcuaccaaguguuaauccugggaucguauuuuuaua

SEQ ID NO: 448232 - RNA, 64 nt, Human
uagcuuuaagaauuaggguggguugucugucuggaaguguuaaguggaaugggcuuuguccucc

SEQ ID NO: 448233 - RNA, 64 nt, Human
aaucauggaaagacucuuaaugcagacucuucuuaaguguuaauagggauuuuuucagcuuauu

SEQ ID NO: 448234 - RNA, 64 nt, Human
ggugcuaagggauacuuugucauuaugaugaaguaaguguuaagugucagauaaauagcacaca

SEQ ID NO: 448235 - RNA, 64 nt, Human
gcaguuggaauucuugcuguauuauuuuuuaagcaaguguuaggugcauuuaacugcuuucuuc

SEQ ID NO: 448236 - RNA, 64 nt, Human
uucccuccuuuagaacucauuuucucuucccaaaaaguguuaucuuuuccuuaaauaucccucu

SEQ ID NO: 448237 - RNA, 64 nt, Human
uaaccucgggugauccacccaccuuggccucccaaaguguuaggauuacaggcaugagccacug

SEQ ID NO: 448238 - RNA, 62 nt, Human
ucaacuacuguuuuucagaaggaagaaagaaucaaauggaagaagaaucaaguccaugccca

SEQ ID NO: 448239 - RNA, 62 nt, Human
uggcaccucagccagggguguagccaaguagacaaauggaauccugugcugaacccgaaucu

SEQ ID NO: 448240 - RNA, 62 nt, Human
cccggaccaguuacauucguuccuggcaaaagcaaauggaaauggucuccugucuccagccu

SEQ ID NO: 448241 - RNA, 64 nt, Human
ucuuguuauugcuccaguacauaggaauuguguaaaguguuaacagcagcuguauuuguuuaaa

SEQ ID NO: 448242 - RNA, 64 nt, Human
uaauguaagaauacuuuaaaucucuaagcuucugaaguguuagagguagagauggucuaguaaa

SEQ ID NO: 448243 - RNA, 64 nt, Human
uuguuuuagaaaauuagcgcaauguauuaaaaucaaguguuaggaaauuucauggucuuaccua

SEQ ID NO: 448244 - RNA, 64 nt, Human
acagcagagcauggcaugaccaagcaucuuuguaaaguguuagauggaaaaugcugugugcugc

SEQ ID NO: 448245 - RNA, 64 nt, Human
uguauauuuuuguguccaguuauauuauuuaaaaaaguguuacuuuguaaaaauuguauauaaa

SEQ ID NO: 448246 - RNA, 64 nt, Human
uaaugcuuuugccuuuuuaauauuauuaguucuuaaguguuacagccccuucagaauauaacuu

SEQ ID NO: 448247 - RNA, 64 nt, Human
uuagggaaaggaauggggaagcaacauuuuuauuaaguguuacuauuugccucuacuuuguauu

SEQ ID NO: 448248 - RNA, 64 nt, Human
auuugggcaucugccacauugguucauauucagaaaguguuaucucauugauuauauucuuguu

SEQ ID NO: 448249 - RNA, 64 nt, Human
uguuuuuaugaagaaaaaauacauuuuauauuagaaguguuaacuuagcuugaaggaucuguuu

SEQ ID NO: 448250 - RNA, 64 nt, Human
uaagaaaaugcaggcaguaucccucaucuuauguaaguguuaauuaauauuaagggaaaugacu

SEQ ID NO: 448251 - RNA, 64 nt, Human
cucuuucaauacauguacaucuuuacuguuugaaaaguguuacagcugucaaagaaucuucaug

SEQ ID NO: 448252 - RNA, 64 nt, Human
ggccggaccuccugcuggcucucgcccaccaaccaaguguuacaagccccagaaugcugcccgg

SEQ ID NO: 448253 - RNA, 64 nt, Human
gggcugggccugcgcuggaagcauaucccgugaaaaguguuagugccuuaggugaaagcaacau

SEQ ID NO: 448254 - RNA, 64 nt, Human
ugcgguagugccuccaggggcagaggaaaagaagaaguguuacugcauuuuguacaaaauaaau

SEQ ID NO: 448255 - RNA, 62 nt, Human
acuaaagucauguggaauaaagccauuggaaacaaauggaaagccugucgggacuucugggc

SEQ ID NO: 448256 - RNA, 62 nt, Human
ugguuucugaugcuuguacaaacacgcacacacaaauggauaaaacagcaccucuggcuguu

SEQ ID NO: 448257 - RNA, 62 nt, Human
gagugccguaguccuuuuuguaacuacccucucaaauggacaauaccagaagugaauuaucc

SEQ ID NO: 448258 - RNA, 64 nt, Human
ucuccgcagccuuuugucuauuuauauguguaccaaguguuaaacauaauuauuauugggcauu

SEQ ID NO: 448259 - RNA, 64 nt, Human
ugaugggugcugcccucagggacugcacccugacaaguguuaaggcaacauuccuuucuugugc

SEQ ID NO: 448260 - RNA, 64 nt, Human
uagugauggaggugaggucucccuaaucaugguaaaguguuaaccuuccaccuccucccuuccc

SEQ ID NO: 448261 - RNA, 64 nt, Human
gaaccccacagcuccagccuuaguuuuuggagucaaguguuaaagguuucuggccagaggaauu

SEQ ID NO: 448262 - RNA, 64 nt, Human
guguacaauaccaccuacaaauuauccaugccccaaguguuaaaacugaauccauucaagucuu

SEQ ID NO: 448263 - RNA, 64 nt, Human
caaaaggccacauuccaaguauuuguaaucuagaaaguguuauguaagugauguuauuagcauc

SEQ ID NO: 448264 - RNA, 63 nt, Human
augcaauuuugcauuugaauaaagccugcuuuuuaaguguuaacuaguuugccuaguuuguua

SEQ ID NO: 448265 - RNA, 64 nt, Human
aacauuuugauuuccucuaggacguauagcuaggaaguguuacuaucuugauuugaacaaauuu

SEQ ID NO: 448266 - RNA, 64 nt, Human
cugcuguauacuguacugagacauuacaguuuggaaguguuaacuauuuauucccuguuaaaau

SEQ ID NO: 448267 - RNA, 64 nt, Human
gcuuauuuuuuaaaauaauuuuaaaaguugggaaaaguguuauuauuuggcaugcuuaaauauu

SEQ ID NO: 448268 - RNA, 64 nt, Human
uuuuuuuuuuccaucucauaagaaaaaucagcugaaguguuaccaacuagccacaccaugaauu

SEQ ID NO: 448269 - RNA, 64 nt, Human
aucaaaucaucaggcauggagaaauaucuuuuagaaguguuaaaauaaauguuccuacuguaua

SEQ ID NO: 448270 - RNA, 50 nt, Human
ccaaaaagcuuaaauauugaaaguguuagccuuuuuuccccagacuuguu

SEQ ID NO: 448271 - RNA, 64 nt, Human
ggaauuuuaauuuaaaugacgcuuugcuaauuuuaaguguuaagcauuuugcauuaaaauauuc

SEQ ID NO: 448272 - RNA, 62 nt, Human
gggagagugugucuccuuccugaaggaacuuccaaauggaacucccgauuucaggugggcua

SEQ ID NO: 448273 - RNA, 62 nt, Human
gagagaaggagauggaaugugucugguaaccccaaauggaguacaaguagccuuuguuuucc

SEQ ID NO: 448274 - RNA, 62 nt, Human
ugagaacauuuucugggaagagguaagggugacaaauggaacaucagaaacguaucuugcuu

SEQ ID NO: 448275 - RNA, 64 nt, Human
uuggacaacuggcccuuugugacagggcugacucaaguguuaggcagggucucaggccuuugau

SEQ ID NO: 448276 - RNA, 64 nt, Human
acaagagucuuuuuauuugggagccagaggagggaaguguuacuugugcuauaacugcuuuugu

SEQ ID NO: 448277 - RNA, 64 nt, Human
acauguucccccuucuucacuuccuuggaacuggaaguguuauuccuaagucuagugcaaaaug

SEQ ID NO: 448278 - RNA, 64 nt, Human
cuggggauuccagcugucuugucuuuuuccaaaaaaguguuaaauaggcuugagggguuguugc

SEQ ID NO: 448279 - RNA, 64 nt, Human
augcagacaauguuuagguaaagacauacucauuaaguguuauuuauuuuacucaagaacugga

SEQ ID NO: 448280 - RNA, 64 nt, Human
aaaugcuuuuuuaaauugcuaagggaaaauaacaaaguguuaguaaucauugcuuucuguagaa

SEQ ID NO: 448281 - RNA, 64 nt, Human
ccaucaugauugguguaaaaccauguauugacaaaaguguuauggaaagcagugacagaugugc

SEQ ID NO: 448282 - RNA, 64 nt, Human
aaaauauguuggauagaaagucacucuuuggcaaaaguguuagaauuugcuuuugugccaucua

SEQ ID NO: 448283 - RNA, 64 nt, Human
auagauuuaucauuuacucauuggaauuuucuucaaguguuaaagguacauuuucacuaggaaa

SEQ ID NO: 448284 - RNA, 64 nt, Human
aucauaaaacggaccaggccauucauuauuccucaaguguuaauauacugacuuaugcaguauu

SEQ ID NO: 448285 - RNA, 64 nt, Human
gaagggaagagcauguaagaaauaaguuuuuuuaaaguguuauuuuguauaaaugggaagaaag

SEQ ID NO: 448286 - RNA, 64 nt, Human
guuucuguuuuuuacuguguucccaaaauuaaauaaguguuaaccaagucacaguguuuuuggu

SEQ ID NO: 448287 - RNA, 64 nt, Human
aaauaaauuuuaaaaauaaauaaauaauaaaaggaaguguuagacaauguaaugccaguacuac

SEQ ID NO: 448288 - RNA, 64 nt, Human
auucuucugggaaacacaaagcaauaauaaaaggaaguguuagacaauguaaugccaguacuac

SEQ ID NO: 448289 - RNA, 62 nt, Human
uguggcagaaggugaucagauaagcuccagcccaaauggaaccuguggggugguauuuugca

SEQ ID NO: 448290 - RNA, 62 nt, Human
uuagucaagguagaguguuuuuuuauacauaccaaauggagauagcagccucuccuaguuuu

SEQ ID NO: 448291 - RNA, 62 nt, Human
uaucaguggggggacuuaauucuaaucucauucaaauggagacgcccucugcaaaggccugg

SEQ ID NO: 448292 - RNA, 64 nt, Human
ccaucucuuccucagauguaaaugauaucugguuaaguguuauauggaauaaaguggacauuuu

SEQ ID NO: 448293 - RNA, 64 nt, Human
gagguuuuucaaguaucuuugaguuucauggccaaaguguuaacuaguuuuacuacaauguuug

SEQ ID NO: 448294 - RNA, 64 nt, Human
acaauuuugaaauacucauauaaaaugaacaggaaaguguuagugauugggugauuugagcuac

SEQ ID NO: 448295 - RNA, 64 nt, Human
guaugaaugcagucaaauaaacuaaaaacuaggaaaguguuaacuaucguugcccaccgaauuu

SEQ ID NO: 448296 - RNA, 64 nt, Human
gcuuucaugucccagaacuuagccuuuaccugugaaguguuacuacagccuuaauauuuuccua

SEQ ID NO: 448297 - RNA, 64 nt, Human
uguuuuucuucacgaaauacccuuuggauagcuaaaguguuaacuuugaaauaaagcccaaauu

SEQ ID NO: 448298 - RNA, 64 nt, Human
augaauuuauccauguuugcuuaaugcuucugcuaaguguuagccaaaaucuagccauuuauau

SEQ ID NO: 448299 - RNA, 64 nt, Human
cacauuuuccaacaugagccucaugaagccaacuaaguguuauugaacuguaauucucucaaua

SEQ ID NO: 448300 - RNA, 64 nt, Human
cuuggggauuuuuuacugcccuuucaaagcacuuaaguguuagaucuaacguguuccagugucu

SEQ ID NO: 448301 - RNA, 64 nt, Human
ggagcaggcuaaugcaaagcuuuuggagacugcuaaguguuaaaaagugauuaaacacacacuc

SEQ ID NO: 448302 - RNA, 64 nt, Human
auaauauagucauuuugccuauguuucuacaaugaaguguuaaauacuuuauaaaaaauuguug

SEQ ID NO: 448303 - RNA, 64 nt, Human
auauauugagaagaauuaagaaaacucuucaaugaaguguuaacaaccaaacccuacagacggu

SEQ ID NO: 448304 - RNA, 64 nt, Human
uacauauuccucccacagcaaguccguauccuggaaguguuauuuuauaauaaaauuuaaaaag

SEQ ID NO: 448305 - RNA, 64 nt, Human
aggaagaaacccaagcaagcucuagucugugcuuaaguguuagcauucuuauuuuuugaaccuu

SEQ ID NO: 448306 - RNA, 62 nt, Human
uauaaaaugaaugcagauugcgaaggucccugcaaauggauggcuugugaauuugcucucaa

SEQ ID NO: 448307 - RNA, 62 nt, Human
ugcuucuaugauacagagaugucuaaaaacuucaaauggacauguuuuguaguuuagcgacu

SEQ ID NO: 448308 - RNA, 62 nt, Human
ucacaagauugccuucuacagugugccauuuccaaauggaucuguuguuggaggaaacuggu

SEQ ID NO: 448309 - RNA, 64 nt, Human
uauaguugguauggaaaacauuuuucuuauuuuuaaguguuauuaauuauaucuauggaaaaac

SEQ ID NO: 448310 - RNA, 64 nt, Human
ggugucauauacaaugguaauaugccugucuuuaaaguguuauuuuauuaauuaaaaggauaug

SEQ ID NO: 448311 - RNA, 64 nt, Human
aaagggagaaaucuuauuccuucuugaaaauuuuaaguguuaugguuuuauauaguucaguucu

SEQ ID NO: 448312 - RNA, 64 nt, Human
aaaaaauguugagauaaaauugcugugcagaaaaaaguguuaaugaagccgaccugacuacuua

SEQ ID NO: 448313 - RNA, 64 nt, Human
accacuccuuagcuuuuauccaauauuaaacugcaaguguuagcacugaaauauugucauugau

SEQ ID NO: 448314 - RNA, 64 nt, Human
aguaguaagcauggcugccuaugcuuggagucauaaguguuauuuggacuauacccugagauaa

SEQ ID NO: 448315 - RNA, 64 nt, Human
uauuugaauaaauucaguugcuaaaguagauccaaaguguuaaaaaugcugaagucaugucaag

SEQ ID NO: 448316 - RNA, 64 nt, Human
gagaucuuugaccaacaggugcuauuggagugcaaaguguuacucuuacguguuuauuuugagu

SEQ ID NO: 448317 - RNA, 64 nt, Human
auuuaaguacccauaauaaaucauuucccucuauaaguguuauugauuauuuuaaauugaaaaa

SEQ ID NO: 448318 - RNA, 64 nt, Human
aggcauguguuggcaaaggcuguuaauaguaguuaaguguuaagacugcuuuucuuuaacguuu

SEQ ID NO: 448319 - RNA, 64 nt, Human
cccuuacauuuauaugauucugggguugcuucagaaguguuauuucaugaaucauucauaugau

SEQ ID NO: 448320 - RNA, 64 nt, Human
gcuuggcccugcccaagcuacuuccuguacuuaaaaguguuaauaaaaccagacuauucaggcc

SEQ ID NO: 448321 - RNA, 64 nt, Human
gugcuccaggaaaaguuauauucaguauaugaauaaguguuauucuccauuauuaauguguucu

SEQ ID NO: 448322 - RNA, 64 nt, Human
auuguuuucuucugguaaauaauaaauauaacagaaguguuaacuauuguauucccauuuuuuu

SEQ ID NO: 448323 - RNA, 56 nt, Human
uuuuuuuccagacucucugaaaacugcaaauggaaaggaauucaaaagaauuuaga

SEQ ID NO: 448324 - RNA, 62 nt, Human
gggaauuuuccuugcugcuaccgcgcugccaccaaauggaauugaccagcggcuguuacacu

SEQ ID NO: 448325 - RNA, 62 nt, Human
uucugguccuuuuuggucgaggaguaacaauacaaauggauuuugggagugacucaagaagu

SEQ ID NO: 448326 - RNA, 64 nt, Human
gggaguuaacgagggcugaguucagcaaaugcuaaaguguuaauuucaaauaugcaaauuuggu

SEQ ID NO: 448327 - RNA, 64 nt, Human
ucaagucaucuuagcagcuaggauucucaaauggaaguguuauauauaauauguuaaaaacauu

SEQ ID NO: 448328 - RNA, 64 nt, Human
cuuuccaagauuuggaauuuuauuuaauuccuuuaaguguuagcagugucuuaugaaacgugua

SEQ ID NO: 448329 - RNA, 64 nt, Human
cugauaaccuaguaaaucaucaaaaugagaucauaaguguuaauguacacuggacaugaaaaca

SEQ ID NO: 448330 - RNA, 64 nt, Human
acaaaaagccuagaaggacaggauacuuuguggaaaguguuaaauaaaguagguacuguggaaa

SEQ ID NO: 448331 - RNA, 64 nt, Human
cuuuaaagaauaauaugcugccaaauuuuggccaaaguguuaaucuuaggggagagcuuucugu

SEQ ID NO: 448332 - RNA, 64 nt, Human
uugaaagucauauuauaaaagguuugcuuucuuuaaguguuauuuaucuuaaauuauaaucguu

SEQ ID NO: 448333 - RNA, 64 nt, Human
auucccauuuuauuaauaauauuuauguugggucaaguguuaggucaauaacacuguauuuuaa

SEQ ID NO: 448334 - RNA, 64 nt, Human
ccaaaguuauaucaugccccauaaugcuacugucaaguguuacaacuggauauguguauauaga

SEQ ID NO: 448335 - RNA, 64 nt, Human
ugaugaugugcucuuacacuuguuaacauguauuaaguguuauuugcaaaagguagauuaugua

SEQ ID NO: 448336 - RNA, 64 nt, Human
uuuauugugguucuuacccccuuuuccuucucugaaguguuaaugcuuaagaaaagaguugcgc

SEQ ID NO: 448337 - RNA, 64 nt, Human
caugugauugauuaaugauucccccuuagaaagcaaguguuaccaaaguuguguuaucuugaaa

SEQ ID NO: 448338 - RNA, 64 nt, Human
ggcacacugcuuaucacuugaaaaauggaggaacaaguguuauauuuaucugugugucugacag

SEQ ID NO: 448339 - RNA, 64 nt, Human
cugucagauuggaggucaaagucaaaaguauaauaaguguuaauuugccuugaaaaacaaagac

SEQ ID NO: 448340 - RNA, 62 nt, Human
cacagucagcccaggaaaaagagaagcagggccaaauggaaagaacacauaauaaacaagaa

SEQ ID NO: 448341 - RNA, 62 nt, Human
ugaaaauuuucugguuugcaccaugaauuugucaaauggauauuuauaggaauauauucacu

SEQ ID NO: 448342 - RNA, 62 nt, Human
aagcaucaagcugauuuuauuggucaugagaacaaauggaugugaucaugaaggaaucagau

SEQ ID NO: 448343 - RNA, 64 nt, Human
ucaacugcuugccugaauuuacuccuuucacagcaaguguuagaagaaagauaacauuuucaaa

SEQ ID NO: 448344 - RNA, 64 nt, Human
uuaauugcccggcaucacaguuuacuagauuaccaaguguuacaucauauuaaauaaaauguag

SEQ ID NO: 448345 - RNA, 64 nt, Human
aacaugauuaaaaaggaaaaaauauuaaaucaauaaguguuaaaucaaaauggaauaucugauu

SEQ ID NO: 448346 - RNA, 64 nt, Human
guuaguaacuuuuagugguucugugccucuuaucaaguguuacagaggacauaccacugccaug

SEQ ID NO: 448347 - RNA, 64 nt, Human
guaaaaaaaaaaucuucugcugcacauuuuguuuaaguguuacuguuucugccuguuaaugcug

SEQ ID NO: 448348 - RNA, 64 nt, Human
cuccguuuacacaucucuucauaccacguguuugaaguguuaaaauucaaagggaucauugaau

SEQ ID NO: 448349 - RNA, 64 nt, Human
accaaauuucugcauucgagucuuaaccauauuuaaguguuacuguggcuucaaagaagcuauu

SEQ ID NO: 448350 - RNA, 64 nt, Human
ugauaaccucguagggagcaaccccaggauagcuaaguguuauguaauaugccuagaaggugau

SEQ ID NO: 448351 - RNA, 64 nt, Human
acuuguaaaaaaaaguauauauacauaucuuuugaaguguuaaaaggaaacuaguacuuuauau

SEQ ID NO: 448352 - RNA, 64 nt, Human
cccagcccgaauuggauaucuuuaagauaucuguaaguguuauaucccuaaccaagaagaaaaa

SEQ ID NO: 448353 - RNA, 64 nt, Human
ugucuuaauuugcauacuuaagcauuuaggaaugaaguguuagagugucuuaaaauguuucaaa

SEQ ID NO: 448354 - RNA, 64 nt, Human; identical to SEQ ID NO: 448353

SEQ ID NO: 448355 - RNA, 64 nt, Human
aagguauccuuuacauaccugucuguagguaagcaaguguuaguaaaaacaauuuugucaaaca

SEQ ID NO: 448356 - RNA, 64 nt, Human
uguuggguugucuucuuaaaagaauauaagacuaaaguguuaaugucacuugguguuacauuuc

SEQ ID NO: 448357 - RNA, 62 nt, Human
uaaaggguuuuuaagcccuaacacuugucuagcaaauggagagccuaauuuaccaaaaugaa

SEQ ID NO: 448358 - RNA, 62 nt, Human
uucccucucugggccucagucuguucaucucccaaauggauaaugaagccucuugggaggcc

SEQ ID NO: 448359 - RNA, 62 nt, Human
ccaauccaacugaccuagugaagguucagaugcaaauggaaggaaaaaggaaacuggaagga

SEQ ID NO: 448360 - RNA, 64 nt, Human
caacaggaaaacaauacagacucccagaauuagaaaguguuauuuuaaugcaaccuagguaacu

SEQ ID NO: 448361 - RNA, 64 nt, Human
uaguggagaaauaauagaugucuguucauguguuaaguguuauagcaaaaaaaauacacauaug

SEQ ID NO: 448362 - RNA, 64 nt, Human
aaaccagaaaaccuauauccuaugauacaacucuaaguguuaucacuugauucgaaagggucag

SEQ ID NO: 448363 - RNA, 64 nt, Human
uuuauuaaaugaugggagguggugaucaggacaaaaguguuagguucccaugauuucucauuuc

SEQ ID NO: 448364 - RNA, 64 nt, Human
uuauauuauuugcgucauacauuuccuguaacggaaguguuaauuuuacuguacuuuuugguac

SEQ ID NO: 448365 - RNA, 64 nt, Human
aucuuuguuucuaauuuaaagaaacaauuucagaaaguguuagaagaauucuauguuuaauaau

SEQ ID NO: 448366 - RNA, 64 nt, Human
gucuuucaugucuaaaagauuuaaguuaaaaacaaaguguuacuuggaagguuagcuucuauca

SEQ ID NO: 448367 - RNA, 64 nt, Human
caacuccugcucacuuagggagcuguagggcaagaaguguuacucccauuuuucuaauuagaaa

SEQ ID NO: 448368 - RNA, 64 nt, Human
uuaggaauaguuauucuagcaagaugaauguggaaaguguuagugugcaugugaugagucuuga

SEQ ID NO: 448369 - RNA, 64 nt, Human
cuguccuuggaaguuucauauauuguuugauaugaaguguuagauagaauuuccaauauuggag

SEQ ID NO: 448370 - RNA, 64 nt, Human
uaaaggaaauuaaaaauguauuugucauguuaaaaaguguuagccacaaaaggcuacuuacuuu

SEQ ID NO: 448371 - RNA, 64 nt, Human
uugccugcguguauauuuuuaaaaauucacucugaaguguuauggaugcuuuucuuugaguucu

SEQ ID NO: 448372 - RNA, 64 nt, Human
uauguucuuagaguuaaauuugucucagauaagaaaguguuaaagcauuagccugugucaaguu

SEQ ID NO: 448373 - RNA, 64 nt, Human
caguacaacagcagauuugggucaggcuuaaucuaaguguuaacuuuuuuuucuggugcuuuuu

SEQ ID NO: 448374 - RNA, 62 nt, Human
ucuugaaacaagcaacagauggauagucuguccaaauggacauaagacagacagcaguuucc

SEQ ID NO: 448375 - RNA, 62 nt, Human
aacguaacugucuuacagguaugagcugacuccaaauggacagcccagaagcugaugaugag

SEQ ID NO: 448376 - RNA, 62 nt, Human
uaaauguggcuugggccugguagaaguuugaccaaauggaauggaggcugugagcaauguga

SEQ ID NO: 448377 - RNA, 64 nt, Human
aacuacaaguaaaauaaauuuauuucuuaaaaauaaguguuaaaggaauaacuauucuaugaag

SEQ ID NO: 448378 - RNA, 64 nt, Human
aguauuuuuaauuuuuuaaaugaaaccauauuuuaaguguuaaaugaaucaaugcucacauuaa

SEQ ID NO: 448379 - RNA, 64 nt, Human
gucccugcacuaagaagaaucacuuuaaaaagcaaaguguuagcugcuguuguaugggacauuc

SEQ ID NO: 448380 - RNA, 64 nt, Human
auaucaagugauugucagacuugagggcucauagaaguguuagguacggcucucaaagauguua

SEQ ID NO: 448381 - RNA, 64 nt, Human
gcuacugaaaaaaauggaguuguuuugggugguaaaguguuaaggaauagggacagcuggucac

SEQ ID NO: 448382 - RNA, 64 nt, Human
auaaaccuuaaaacccaugaagaaaucugagguaaaguguuagcacacagacuguuaaaauguc

SEQ ID NO: 448383 - RNA, 64 nt, Human
uaacaucacuuauuuauuguuguuggaugcugcaaaguguuaguagguaugagguguuugcugc

SEQ ID NO: 448384 - RNA, 64 nt, Human
ggcagaaagcagucugauaggccccacucauuucaaguguuaugaaagugcuuauaggcauuuu

SEQ ID NO: 448385 - RNA, 64 nt, Human
uuuugaauauagguuuccaauuaaguacauggucaaguguuaacagcacaagugauaaguuaac

SEQ ID NO: 448386 - RNA, 64 nt, Human
guggaaaucuacauuugaagacaacaucacucugaaguguuaucagcaaaaaaaauucaguaga

SEQ ID NO: 448387 - RNA, 64 nt, Human
uuuauuuuaaaaauaaugguagguuuuaaauuaaaaguguuaucaaaaguuuccccucuauugu

SEQ ID NO: 448388 - RNA, 64 nt, Human
agcauauauuuuaaaaggagcaaaaauaaaaccaaaguguuaguaaauuuugauuuauuagaua

SEQ ID NO: 448389 - RNA, 64 nt, Human
gcuguugacaaguugguuugagggagaaaacuuuaaguguuaaagccaccucuauaauugauug

SEQ ID NO: 448390 - RNA, 64 nt, Human
uuagugaaaaaggacugcugucuuuccuugguucaaguguuagaauggagagcuggaguucguu

SEQ ID NO: 448391 - RNA, 62 nt, Human
aacuuugaaagguuaguguuuuauuuaccugacaaauggaaguuauagaagucuaauaaugu

SEQ ID NO: 448392 - RNA, 62 nt, Human
uuacauagaggaauauaauaauggagagacuucaaauggaaagacagaacauuacaagccua

SEQ ID NO: 448393 - RNA, 62 nt, Human
aaugggaaaagagauggccugagaagagagaucaaauggaaaggagaggaaagaacucagug

SEQ ID NO: 448394 - RNA, 64 nt, Human
gucauagccuccuuggcuguuggaaggauguauaaaguguuacugcaugaguaauguagacaaa

SEQ ID NO: 448395 - RNA, 64 nt, Human
accugugaaaugggcugaggcaggaaaugggaaaaaguguuagugcuuccaggcggcacugaca

SEQ ID NO: 448396 - RNA, 64 nt, Human
aguuuacauauguaucuugaguucuucauaggggaaguguuauuuuaaaaaauucuaaaaauga

SEQ ID NO: 448397 - RNA, 64 nt, Human
gugcucuauguccuaguaacucuuagacugaguaaaguguuaauaccauacccagauguuuuau

SEQ ID NO: 448398 - RNA, 64 nt, Human
aaaaaugccuaauugugagagaaucaauugcugaaaguguuaaaauuucugaaaauaaaugcuu

SEQ ID NO: 448399 - RNA, 64 nt, Human
gugguuccaagcuuucaaauagguuaugcuccaaaaguguuauuuguaaguuaauuuuuuuaca

SEQ ID NO: 448400 - RNA, 64 nt, Human
gcuuuuuuuaaggaaaaccacauugagaugugacaaguguuaggacuugucacagauuucuaac

SEQ ID NO: 448401 - RNA, 64 nt, Human
uucaaaaagauauuuacauagucuguaaacuagaaaguguuagguaaagcucuagguuacugug

SEQ ID NO: 448402 - RNA, 64 nt, Human
agacuuuauaaaugagauaucuacaaggcacuuaaaguguuacagauguuuuaccuuaagaauu

SEQ ID NO: 448403 - RNA, 64 nt, Human
uguaugaaugguuuguauuguacauaguuuaaccaaguguuauuugagcugcuuauuaauauua

SEQ ID NO: 448404 - RNA, 64 nt, Human
uuuagucaauaugacuuugaugucauuaacugcuaaguguuauuuucuaagaggaauuuuaucu

SEQ ID NO: 448405 - RNA, 64 nt, Human
uuuuggucuuuuuaggaaagauuguugugguaaaaaguguuaguauaaaaaugauaauuuacuu

SEQ ID NO: 448406 - RNA, 64 nt, Human
cccagccauggaugaauguacuaauuugaaagccaaguguuaagucggauguuuucccguuaca

SEQ ID NO: 448407 - RNA, 64 nt, Human
ccuggaaaucccuuucugcuaguggugagcauguaaguguuaaguuuuuaaucugggagcaggg

SEQ ID NO: 448408 - RNA, 62 nt, Human
auuuuuuuuuaaauaauaauugaaacuuaucucaaauggagauuuuggugggaggaggagaa

SEQ ID NO: 448409 - RNA, 62 nt, Human
uuucgcaguucuuucaauaggcccaguucuuccaaauggaaaaagaaaggucuggaagaggc

SEQ ID NO: 448410 - RNA, 62 nt, Human
ccagugcaaccacacaccucaccagaauugugcaaauggaagacaaaauguuuucuucaucu

SEQ ID NO: 448411 - RNA, 64 nt, Human
uuuaauaagucagugauuauaugugugcucaaauaaguguuauguaucagcuagauacugagcu

SEQ ID NO: 448412 - RNA, 64 nt, Human
uuaaaaaugcaaauuugcuuaguaucuaauaaugaaguguuauuacauauagccggaauugagg

SEQ ID NO: 448413 - RNA, 64 nt, Human
uuacucuaacugguuuugucgacguaaacauuuaaaguguuauauuuuuuauaaaaauguuuau

SEQ ID NO: 448414 - RNA, 64 nt, Human
uaaaccuuaaaccaccauuuauuuccaugugaaaaaguguuauauaugacaaguguuuuuugau

SEQ ID NO: 448415 - RNA, 64 nt, Human
auaugaaugacuuuggaaaauuuacaugaagcucaaguguuaggauugacuuaugaaaauaaau

SEQ ID NO: 448416 - RNA, 64 nt, Human
uguguguguaugugagagauucugugaucuuuuaaaguguuacuuuuuguaaacgacaagaaua

SEQ ID NO: 448417 - RNA, 64 nt, Human
acuuggugguguacuacuggaacuaaugacugcaaaguguuaaacgacugaaauauacaaacag

SEQ ID NO: 448418 - RNA, 64 nt, Human
gacuccuguaaaauaugaaauuauaaugcaauaaaaguguuaucuuucuuacaaaaguuuugua

SEQ ID NO: 448419 - RNA, 64 nt, Human
caaaagagcuguucuaaucugcguuuugcauguuaaguguuaauaucaaacauucuuuacgugc

SEQ ID NO: 448420 - RNA, 64 nt, Human
gaguuccucagaauugacggugcuagaaauauccaaguguuaaauaaccuuuuaaaagcaacaa

SEQ ID NO: 448421 - RNA, 64 nt, Human
ugcgugcuucacauccucuauugagaguuacagcaaguguuaaacgaggugaguucacauaaca

SEQ ID NO: 448422 - RNA, 64 nt, Human
guaaaaauaaacuucgguaucagugcaucuacagaaguguuauuugguaauccaaauauuagag

SEQ ID NO: 448423 - RNA, 64 nt, Human
caaacuaaaaggaagucauccagucuauucacagaaguguuaacuuuucuaacagaaagcauga

SEQ ID NO: 448424 - RNA, 64 nt, Human
gcaaauauagcugcauuuauaccucagaggggccaaguguuaaugcccaugcccuccguuaagg

SEQ ID NO: 448425 - RNA, 62 nt, Human
cuggcuguuggaaaccugaaugcuuuuagacccaaauggaaaauuucugaaaugcuggauua

SEQ ID NO: 448426 - RNA, 62 nt, Human
gagaaaugaguccugauagacugaaaauugagcaaauggaagaagauacaguauuguuuaga

SEQ ID NO: 448427 - RNA, 62 nt, Human
cucugccgcuuaccuagcuuggccuagaguggcaaauggaacuucucugaucucccccaacu

SEQ ID NO: 448428 - RNA, 64 nt, Human
uguauugguguaagaguuuugucauuaaguguuuaaguguuauucugaauuuucuaccuuaguu

SEQ ID NO: 448429 - RNA, 64 nt, Human
ugucauguuugugccacguuucaguucaguucugaaguguuauuaaauguguuccucagcgaca

SEQ ID NO: 448430 - RNA, 64 nt, Human
uuuuaaagguuauuugcucccgauuauaugauucaaguguuauaaguuuuagcuugaacuacuu

SEQ ID NO: 448431 - RNA, 64 nt, Human
caugaaugaguggcaugauccgugcuuaaugaucaaguguuacuuaucuaauaauccucuagaa

SEQ ID NO: 448432 - RNA, 64 nt, Human
guuaauguauuuuuaauuagauacauauuuuguaaaguguuacuauauuuuaaaguuauuuuua

SEQ ID NO: 448433 - RNA, 64 nt, Human
uuggugaauuccuucuaagauaaaaauaauaauaaaguguuacguuuuauugguuuccccccau

SEQ ID NO: 448434 - RNA, 64 nt, Human
auauccuccaguguagcacagggggagaagugagaaguguuaugacauuagugcccugauuggg

SEQ ID NO: 448435 - RNA, 64 nt, Human
agucugucuuucuauagaaauauugugcuuacucaaguguuaaauuauuuuuucuaugaacuag

SEQ ID NO: 448436 - RNA, 64 nt, Human
aucuaggagcagcaguuugugagauguuuauucaaaguguuagccuguuuuucuaccaacaaua

SEQ ID NO: 448437 - RNA, 64 nt, Human
uaaaacuuaguaaugagaaacugugaaaagagccaaguguuacauugagcuuggggugggagau

SEQ ID NO: 448438 - RNA, 64 nt, Human
gucauagcccaugucuugugcccucccacacagaaaguguuagauagggaaauuggcaaaaaga

SEQ ID NO: 448439 - RNA, 64 nt, Human
ucuguaccaaaacuugccaaauuccuccauggccaaguguuaaaaucuguguuuggaaaauagc

SEQ ID NO: 448440 - RNA, 64 nt, Human
gguauuuauuacagaaaagugcucaguuaaauguaaguguuauuccuucagcaaaauauucacu

SEQ ID NO: 448441 - RNA, 64 nt, Human
cugaaugaauuugucucuuaaugcauccauagaaaaguguuaauuguggguucaaagcauucuc

SEQ ID NO: 448442 - RNA, 62 nt, Human
gguuuaaaaaacaaacaucgaaaggcuuaugccaaauggaagauagaauauaaaauaaaacg

SEQ ID NO: 448443 - RNA, 62 nt, Human
uucagcccacggugccuuggucucuccacaaucaaauggaggaucccccaagcagcuucauu

SEQ ID NO: 448444 - RNA, 62 nt, Human
uauuuucaagucaucuuagcagcuaggauucucaaauggaaguguuauauauaauauguuaa

SEQ ID NO: 448445 - RNA, 64 nt, Human
aguggaucgacucaacucagaacacaagcuuggaaaguguuagggguuuugaacuagguggaua

SEQ ID NO: 448446 - RNA, 64 nt, Human
aguugaugauuuucuaucuuaauaaaugcaauggaaguguuacuauaguagauuccuuuaagca

SEQ ID NO: 448447 - RNA, 64 nt, Human
agcaauggugugaguuauuaauggguaaacuaagaaguguuauaggcaaugacuugaaaugguu

SEQ ID NO: 448448 - RNA, 64 nt, Human
uuuaacaucaugugcgucucuugggauccagcaaaaguguuaagccacaaugcccuugugccuu

SEQ ID NO: 448449 - RNA, 64 nt, Human
uuaauuaaacuauguauugaaaaaaaaguagccuaaguguuagagauggugaauauauuccauu

SEQ ID NO: 448450 - RNA, 64 nt, Human
ugguuuucuccuuccugauauagucaccuguuggaaguguuaaaauuuccucgacaggccuuaa

SEQ ID NO: 448451 - RNA, 64 nt, Human
uugugugaugaaugaaucacauguucguuguuauaaguguuaaccuuuuuuugacaauuuugug

SEQ ID NO: 448452 - RNA, 64 nt, Human
uguaaggucauuguaaaaguguagauaagcaagaaaguguuauaccaccacucagaaguaacca

SEQ ID NO: 448453 - RNA, 64 nt, Human
cuaagacccauugggcuuuccucaccaaaaaaggaaguguuauuccauuacuagcgucauggag

SEQ ID NO: 448454 - RNA, 64 nt, Human
uuacgugcuauaugauuuuuuguuacauuguuacaaguguuaaugacauuuucauuaauggaug

SEQ ID NO: 448455 - RNA, 64 nt, Human
uuauuaaggaucagugcaguuaagucguauuuuaaaguguuaccuccccuccuaacccuucccc

SEQ ID NO: 448456 - RNA, 64 nt, Human
uuauccauauguguucuuaauuuuuaacugcuggaaguguuaaaacacacacacacacacacac

SEQ ID NO: 448457 - RNA, 64 nt, Human
guggcagccaauaaaggugguuggugucuaauuuaaguguuaaaucaauuucuuucauucaguu

SEQ ID NO: 448458 - RNA, 64 nt, Human
uuuuuuuuuuuuuuuugaagcaguucucuuuauaaaguguuauuuugauaguuuguggauucua

SEQ ID NO: 448459 - RNA, 62 nt, Human
aaugggaacauugcugaagaacugagcauucucaaauggaacacagacaguguagaagaauu

SEQ ID NO: 448460 - RNA, 62 nt, Human
gggagugagugguaguuacuuaaguaauugaccaaauggaaaaggggaaguaauuaaggaaa

SEQ ID NO: 448461 - RNA, 62 nt, Human
aagugcuauucacccaguaaacccaaaaaaagcaaauggauaaugcuggccauuuugccuuu

SEQ ID NO: 448462 - RNA, 64 nt, Human
aggcauuccagcugacacagaggaauauuuuucuaaguguuaauguucuauaugguaauuaggg

SEQ ID NO: 448463 - RNA, 64 nt, Human
aguauauuuuuguaugcuuuguuuugugacuuaaaaguguuaccuuuguagucaaauuucagau

SEQ ID NO: 448464 - RNA, 64 nt, Human
uaauuuuagaugucuuuuaaaaaauugaaaaacaaaguguuagacugugugcgugugcguugau

SEQ ID NO: 448465 - RNA, 64 nt, Human
auugauugaagauuuuaaauaaacaggaaauuagaaguguuaggguuagauaaaggaaaaguga

SEQ ID NO: 448466 - RNA, 64 nt, Human
uagauccauuucuuuugugaaugugcuaaauaaaaaguguuauuaauugcugguucaguucuca

SEQ ID NO: 448467 - RNA, 64 nt, Human
ccuacagauuuuuagcacaaaaauagccauuguaaaguguuaaaauuuacgauaaguauucuau

SEQ ID NO: 448468 - RNA, 64 nt, Human
uucugucugcaauguuaucauucaugaacuguuaaaguguuaaagauuaggauugaagucacug

SEQ ID NO: 448469 - RNA, 64 nt, Human
ucuacaaugcaauuuacuguacaguuagaaagcaaaguguuaaauggagaagauacuuguuuuu

SEQ ID NO: 448470 - RNA, 64 nt, Human
ggaaagaauacaggcaggaugacacuuuguguuaaaguguuauuuuuauguauuaccuggaaug

SEQ ID NO: 448471 - RNA, 64 nt, Human
aagaucuacauacaaacaaugcaaccaacuauccaaguguuauaccaacuaaaacccccaauaa

SEQ ID NO: 448472 - RNA, 64 nt, Human
aaaauauguggacugucauuuuguugcagcaaaaaaguguuaauaaaaugcucuauuuauccuu

SEQ ID NO: 448473 - RNA, 64 nt, Human
ugcuuggaauaagcaugacagaaagauuuaaccuaaguguuagacaacaagugaugaaaacauc

SEQ ID NO: 448474 - RNA, 64 nt, Human
gaggcaggggaggguauauucuuuaaauaugcuuaaguguuauagggaaagacgggguuaccag

SEQ ID NO: 448475 - RNA, 64 nt, Human
gccgacaaggaguuguagaaugaaaaugcccucuaaguguuauuuugguuguucuaacuuacaa

SEQ ID NO: 448476 - RNA, 62 nt, Human
aagucacucucccucucugggcaugucugcuacaaauggacaagauuauuucagaggucacu

SEQ ID NO: 448477 - RNA, 62 nt, Human
gggaugucugcuuaguuggcagggguucaguccaaauggaagaauauugggaaauaaaccuc

SEQ ID NO: 448478 - RNA, 62 nt, Human
gaagugggagggaaucaauccggggauaauuucaaauggaauagaguauuuugauauuguuc

SEQ ID NO: 448479 - RNA, 64 nt, Human
uuuugcucuuuaaaaguuaauaauuauauuagcaaaguguuaaucuaaugaaguaaaaaacucc

SEQ ID NO: 448480 - RNA, 64 nt, Human
uuugcagguaauuguugacuuuuuuaacuauauuaaguguuaagcugacaacugucaaagaaga

SEQ ID NO: 448481 - RNA, 64 nt, Human
cugaaucagcuacaugcugaggaaacggccaaacaaguguuaaagagagacggugcuuuuauuu

SEQ ID NO: 448482 - RNA, 64 nt, Human
uauucauuuaaaaacuagaauaacagauauauaaaaguguuaaucuuugugcuauaugguauga

SEQ ID NO: 448483 - RNA, 64 nt, Human
auuauauaauugagaguuaagaaugaaauccuucaaguguuaaaaacucacauuuuaaaagcaa

SEQ ID NO: 448484 - RNA, 64 nt, Human
ccacuucagaacauggcaccccacccaacuggccaaguguuaagugaugugcuuauugagagca

SEQ ID NO: 448485 - RNA, 64 nt, Human
gaagacgaguuggggauuguuuaaucacaaccucaaguguuaaaacaaaaacaaacaaacacgu

SEQ ID NO: 448486 - RNA, 64 nt, Human
uggugcguauugacgaccccauggagauuuugaaaaguguuauuucucuuguccacaggcacuu

SEQ ID NO: 448487 - RNA, 64 nt, Human
caaucuauaaacacuggaaacgcuggguucagaaaaguguuacaagaguuuuauaguuuggcug

SEQ ID NO: 448488 - RNA, 64 nt, Human
aguagugguaaaccuaugaaaaauccuugcuuuuaaguguuagcaauaguucaaaaaauuaagu

SEQ ID NO: 448489 - RNA, 64 nt, Human
ugcccugugauuuuuaugauacuucuucaauacaaaguguuaauaugugucaucaguauaauaa

SEQ ID NO: 448490 - RNA, 64 nt, Human
gcucagcuuacuguaaccucugccuccuggauucaaguguuaguagcugggauuacaaaagcau

SEQ ID NO: 448491 - RNA, 64 nt, Human
auacuuagauauagugcauugucugugucccuuaaaguguuacaaagaguuucucucaaaaggu

SEQ ID NO: 448492 - RNA, 64 nt, Human
auuuaaagcuuacucuguccauuuauccacaggaaaguguuauuuuucaaggaagguucaugua

SEQ ID NO: 448493 - RNA, 62 nt, Human
gaaguuuauucuuccagaugaccagcaguagacaaauggauacugagcagagucuuagguaa

SEQ ID NO: 448494 - RNA, 62 nt, Human
gaggcgcaggagccugugcccauauggucauccaaauggacuggccagcguaaaugacccca

SEQ ID NO: 448495 - RNA, 62 nt, Human
accccaguccuauuuguccaaggcugcauggucaaauggaaucuugaagagaacaccuggac

SEQ ID NO: 448496 - RNA, 64 nt, Human
uaguguuaaagauuaagcauaguaacugacucuuaaguguuaaauaauguagaaguaaaaaaau

SEQ ID NO: 448497 - RNA, 64 nt, Human
agauaaugcaguugguggaaaugauaaacguuuuaaguguuaacauccuuugaaugcguuggau

SEQ ID NO: 448498 - RNA, 64 nt, Human
guuaaagaguacccaaauucuaggacaaugcuuaaaguguuaaaauacccuagauacuguguua

SEQ ID NO: 448499 - RNA, 64 nt, Human
uuagauauauuuaaaauuuuaacauuggcaucuaaaguguuauuugaaaauaaaauuauuuucc

SEQ ID NO: 448500 - RNA, 64 nt, Human
aaggagauauuaaacauuuguuuaauuuuuauuuaaguguuauaccuauuucagcaaauaaaau

SEQ ID NO: 448501 - RNA, 64 nt, Human
cggccucaagcaguccucccacuucggccuccugaaguguuaggauuacaggcgugagccugcg

SEQ ID NO: 448502 - RNA, 64 nt, Human
uguuacaucuuucugaaaccuucaaaccguaaggaaguguuaacuggcaagcaguuguacuuua

SEQ ID NO: 448503 - RNA, 64 nt, Human
uuaaauauuuucaguuauaagcagugagguccuaaaguguuacaagaguacagucuaccccaug

SEQ ID NO: 448504 - RNA, 64 nt, Human
aguguccugcauccacacaguagguacccaguaaaaguguuauuaaauauugucccaggagccc

SEQ ID NO: 448505 - RNA, 64 nt, Human
accaaccaaauggaaaugacaaauguuuuaugucaaguguuaauugcagaaauaaaucuuuuuu

SEQ ID NO: 448506 - RNA, 64 nt, Human
ggaauaaucuuuuauguuucauuuaccuuaugaaaaguguuaaaacauugccaacucaaaauaa

SEQ ID NO: 448507 - RNA, 64 nt, Human
ugagcuuuuuaucagaaagcuuuuuugauguuuuaaguguuaugugacuuguugaacuuuuuaa

SEQ ID NO: 448508 - RNA, 64 nt, Human
uuacaaaauguuucguaaauauuuuauacuguuuaaguguuaaacaccaacccugucuuucuuu

SEQ ID NO: 448509 - RNA, 64 nt, Human
agccgaaaacaguauuaaaaaaaguguguaaguaaaguguuaugguaggguucuucagauguaa

SEQ ID NO: 448510 - RNA, 62 nt, Human
guuguggcucucagccauguagacacacucuccaaauggaguguuggaaaauguucuuucug

SEQ ID NO: 448511 - RNA, 62 nt, Human
cuucugcugggcauagcuugugccuaaauggacaaauggaugcauacccuuccugaaaugac

SEQ ID NO: 448512 - RNA, 62 nt, Human
uacucauuugguuuaagcaggaauccuagaagcaaauggauggggauaagaauaggucauuu

SEQ ID NO: 448513 - RNA, 64 nt, Human
uuugaacagaaauaguguaauuaaaaauaauugaaaguguuaaaugugaacuugagcuguuuga

SEQ ID NO: 448514 - RNA, 64 nt, Human
acgggaaugaugucccauacuucccagcucucuaaaguguuaugcuguacaauuaaaauacccc

SEQ ID NO: 448515 - RNA, 64 nt, Human
auucuuaaguucucuccuuaaacuuaaugcugucaaguguuagaugugugcaugugaacuuguu

SEQ ID NO: 448516 - RNA, 64 nt, Human
aggaaacagugaaggggaacagaaggggguagcaaaguguuacagaaaagcggacuggauagac

SEQ ID NO: 448517 - RNA, 64 nt, Human
uugcuugcuuuuuaauuaaagcacaucaguuuuaaaguguuaacuauauguuaacaauauggag

SEQ ID NO: 448518 - RNA, 64 nt, Human
ugcucagugcugacugcagaaugaaauagaagcaaaguguuacaggaucaguguuuucuuuucu

SEQ ID NO: 448519 - RNA, 64 nt, Human
uagagccacacacaacuuuugaacuuuuaauuauaaguguuauggcuaaaguuauuuacugaaa

SEQ ID NO: 448520 - RNA, 64 nt, Human
guuuucugggaauuuuguaacaaguuacacgcacaaguguuagaaacuuuggcauaacucaauu

SEQ ID NO: 448521 - RNA, 64 nt, Human
aggagaggucaacuuggcaucagcuucugcuguuaaguguuagccacaaucugucauauauaug

SEQ ID NO: 448522 - RNA, 64 nt, Human
uugauccucauauacaauaauguuguuguaacacaaguguuauuagaccauagccacaaaauau

SEQ ID NO: 448523 - RNA, 64 nt, Human
aggguugcacaaugccacccauccacuccuugccaaguguuacccagaugguggaggaugugaa

SEQ ID NO: 448524 - RNA, 59 nt, Human
auucaauuaaacauucauaaucaugauuuaaguguuaucuaaauuuaccuuauuagugu

SEQ ID NO: 448525 - RNA, 64 nt, Human
uuuacaugauccucaauaucaacuccaguuuaaaaaguguuauuuuuaaaacauuugaaaccaa

SEQ ID NO: 448526 - RNA, 64 nt, Human
caugucucacacaaauauugaugugauuauucuuaaguguuaaaucauuaacacuuaaaugacu

SEQ ID NO: 448527 - RNA, 62 nt, Human
cuccucacuguuuaaauauuuauuuauugugacaaauggagcugguuuccuagauaugaaug

SEQ ID NO: 448528 - RNA, 62 nt, Human
gagaauacugacaucuucaaccuagcacauuucaaauggaaacuacuguucuauuugcaaua

SEQ ID NO: 448529 - RNA, 62 nt, Human
gaagauuuuuaaaaauguuuuguuucuucuuacaaauggagauuuuuuuguaccagcuuuac

SEQ ID NO: 448530 - RNA, 64 nt, Human
uccgguucuucuugucuuugucccuguugguuugaaguguuagacuauagccccugguguguaa

SEQ ID NO: 448531 - RNA, 64 nt, Human
cagucugauguuguagcaagaagacucccuuuaaaaguguuacuguucaaaucauauaucaggu

SEQ ID NO: 448532 - RNA, 64 nt, Human
auuauauagauguauagucaaaaauguucugcuuaaguguuaaauaaaacggaaacacuuauuc

SEQ ID NO: 448533 - RNA, 64 nt, Human
gcuuuuuagauuuugguugcuuucuugccaaaauaaguguuaacuguguuucaaacuugauuuu

SEQ ID NO: 448534 - RNA, 64 nt, Human
guuuuucuuuugcuauuguuaauauucaaaauuaaaguguuacauugguaccuguugucuuaau

SEQ ID NO: 448535 - RNA, 64 nt, Human
agugacaaaauucguaagugaauacuuaauuuaaaaguguuaacauuaaugcucaauaaacaaa

SEQ ID NO: 448536 - RNA, 64 nt, Human
gggagcugggcucuucugcccuggcucugcacauaaguguuagccagcagcuccagaaaaaucc

SEQ ID NO: 448537 - RNA, 64 nt, Human
cuaauauauacacauuuguuuaacauguaaacaaaaguguuaaauucacauauacaacauuaua

SEQ ID NO: 448538 - RNA, 64 nt, Human
uuacaaacaagauacguauauuuuuaacugcuucaaguguuaccuaacaauguuuuuuauacuu

SEQ ID NO: 448539 - RNA, 64 nt, Human
guuuuuguuuuguuguuguuguuguuguuuucuuaaguguuacauuaaaacucuaaccaaggaa

SEQ ID NO: 448540 - RNA, 64 nt, Human
cuauguccauaaucaaguugauguggauccugaaaaguguuaugaacaucugauugguauuugu

SEQ ID NO: 448541 - RNA, 64 nt, Human
uuuagguuuuuuaaauguauuuuugcccugaauuaaguguuaauuugauggaaacucugcuuuu

SEQ ID NO: 448542 - RNA, 64 nt, Human
uuuauaaauguucugguaugcauucuuuauagugaaguguuaauacaucacaucuuauuuauuu

SEQ ID NO: 448543 - RNA, 64 nt, Human
uuccaagcaguaaguacuacauacaguacuuguaaaguguuagcuguaaguaagcacaaaauac

SEQ ID NO: 448544 - RNA, 62 nt, Human
agacccuaagaaguaauuaagucaauguaaaucaaauggaaguuuucccaugaacuaagcau

SEQ ID NO: 448545 - RNA, 62 nt, Human
aggguaggagauauagugacccagacuucaugcaaauggaaaaaaaguuuuaacugaaauau

SEQ ID NO: 448546 - RNA, 62 nt, Human
gugucugguaacuggaaggccuuccacuguggcaaauggaggcuuuucacugccuguagaga

SEQ ID NO: 448547 - RNA, 64 nt, Human
gggaaguaauuauauuguuuuuacuuuuugaaaaaaguguuaacucuugaaauaaaauauucug

SEQ ID NO: 448548 - RNA, 64 nt, Human
auaauugguuuaaugcugguagugucaaauuuugaaguguuaauuuugucuuagaaccuuccag

SEQ ID NO: 448549 - RNA, 64 nt, Human
ccuuuauuauuauuauaauuauuuuuuugcgugaaaguguuacauauucuuucacuuguaugua

SEQ ID NO: 448550 - RNA, 64 nt, Human
uccagacagaugagaaagcaaaaaguacuuuguaaaguguuauacaaucagaaggugcuuugug

SEQ ID NO: 448551 - RNA, 64 nt, Human
cugcuuuccagugacuccaccaguuugaugugggaaguguuagcuuccuuuccuucuuccaucc

SEQ ID NO: 448552 - RNA, 64 nt, Human
gcacuauauaugauuugggcucuggguaauuuggaaguguuagguuugugucuuuguagcagua

SEQ ID NO: 448553 - RNA, 64 nt, Human
uugcauaaaugcuauaguguaaaaaaauuuaaacaaguguuaacuuuaaacaguucgcuacaag

SEQ ID NO: 448554 - RNA, 64 nt, Human
uggggaccucaguaucccagauuguaauuuugccaaguguuagauuugagucucucauguggau

SEQ ID NO: 448555 - RNA, 64 nt, Human
ucuccgcacaauacuugaacauucaucuguacugaaguguuacuugaaccgggggaaucucgga

SEQ ID NO: 448556 - RNA, 64 nt, Human
gagggaggugcuucgaagaauguugcccacaccuaaguguuagaagccuauguccguucauccc

SEQ ID NO: 448557 - RNA, 64 nt, Human
cuuacuguguguuugcuggagcuuucacucagccaaguguuagagucaggaaacccauugaggc

SEQ ID NO: 448558 - RNA, 64 nt, Human
auaaaagauggcacugcgugauuuuauuuuaaugaaguguuauacaaucaagaaaugggggcaa

SEQ ID NO: 448559 - RNA, 64 nt, Human
gggaaggugaugcauuuauucuggguuaugcuugaaguguuagauggcuaaguauuaaaauuau

SEQ ID NO: 448560 - RNA, 64 nt, Human
uuacuuacuguauuuuuauggcaggagggagaaaaaguguuacaacgguuucuaaugaaguccg

SEQ ID NO: 448561 - RNA, 62 nt, Human
uuaacgcaaucugccucaauuucuucaucugucaaauggaaccaauucugcuuggcuacaga

SEQ ID NO: 448562 - RNA, 62 nt, Human
auuccccagugcuuccacacccgggcucugagcaaauggaaaagacuuuucauuuaguagac

SEQ ID NO: 448563 - RNA, 62 nt, Human
gauuuaggaugagcccgauagguguggcagaccaaauggacauuucucuaaaaaaccaguau

SEQ ID NO: 448564 - RNA, 64 nt, Human
gcuccaauacaugggaagcuuugcugaaaaaguaaaguguuauugaaugugugggguuuccccu

SEQ ID NO: 448565 - RNA, 64 nt, Human
aagagagagacacaaguggccuuaagucuuuuugaaguguuauuucauccagggaaaugccucg

SEQ ID NO: 448566 - RNA, 64 nt, Human
aauuggaauuucuacuguauaaauguuuuacauuaaguguuacgagccacaaauuucauguaca

SEQ ID NO: 448567 - RNA, 64 nt, Human
uguuuuugagguaaaguuguuuuugaaauuucugaaguguuauauaccaaaaugccaacauuuc

SEQ ID NO: 448568 - RNA, 64 nt, Human
ccuuugguuaauucuuacuuccuguucaucucuaaaguguuaaauuauaaaaaugauuuuuaaa

SEQ ID NO: 448569 - RNA, 64 nt, Human
cagcccacaaaggcacccuggccuuggccugcugaaguguuaggaagagggugggugcccucca

SEQ ID NO: 448570 - RNA, 64 nt, Human
aaaccuuaaaccaccaauuuauuuccaugugaaaaaguguuacauaugacaaguguuuuuugac

SEQ ID NO: 448571 - RNA, 64 nt, Human
gacgccaggguaugaagaguguuauuuucauucaaaguguuauuuuguuuuuccuuccaauguc

SEQ ID NO: 448572 - RNA, 64 nt, Human
gccaaucaagucguuguaaacguggcuuuuuugaaaguguuauggcuauguuuuaugaugaugc

SEQ ID NO: 448573 - RNA, 64 nt, Human
ucuacacaccuaugcgccacauuuuacagcuguaaaguguuagaugaacugccguccucaguaa

SEQ ID NO: 448574 - RNA, 64 nt, Human
aucgcuucucuuuugaaacaauacucauaaugugaaguguuaauacuaguugugaccuuagugu

SEQ ID NO: 448575 - RNA, 64 nt, Human
acuuuaaaguccuguggcuugugaccucuuaauaaaguguuagaauccauuuuggcaaguugug

SEQ ID NO: 448576 - RNA, 64 nt, Human
uuuaaaauucaaacaguuccauuuucucucuuguaaguguuaaaugugauaaaaguacauauuu

SEQ ID NO: 448577 - RNA, 64 nt, Human
cggcuccguuucuuaaaguuaaaacgucaaacuaaaguguuauugacccugugaguaggagagu

SEQ ID NO: 448578 - RNA, 62 nt, Human
guuuuuuuuuuuuuuuuuaaagcgugugugaacaaauggaaauaaagcagggacugugaaca

SEQ ID NO: 448579 - RNA, 62 nt, Human
uuacuuuuuuuuugucaucgcacuauggaacacaaauggaauucucuuaauuuauaagaaga

SEQ ID NO: 448580 - RNA, 62 nt, Human
ccuugaucuuaacaaagccuuugcuuuguuaucaaauggacuuucagugcuuuuacuaucug

SEQ ID NO: 448581 - RNA, 64 nt, Human
guauacacuugggaaaauaauguccuccaggagaaaguguuagagggaacuaacauuuuaggaa

SEQ ID NO: 448582 - RNA, 64 nt, Human
uuuccucuagcauuccaaaagguuuuugcuuugaaaguguuagcagaagcauguugaugugaau

SEQ ID NO: 448583 - RNA, 64 nt, Human
uuucaguuccuucugcagccugugaaucuccacaaaguguuaccaguuuacaaaaauaagucuu

SEQ ID NO: 448584 - RNA, 64 nt, Human
uacaaauagucuucauaugccagaauauaagagcaaguguuaucuacuuuuuagaugggaauug

SEQ ID NO: 448585 - RNA, 64 nt, Human
acuacacaacugccuuccugacagguucugagauaaguguuauguuuguagauagagugaaaua

SEQ ID NO: 448586 - RNA, 64 nt, Human
accuuauuuuacagaagugaaagugagguaucagaaguguuaagugacaugccugaggcacccc

SEQ ID NO: 448587 - RNA, 64 nt, Human
agcaaagcacuuggaaucuccguuuuaaagcuucaaguguuaaaaaugcuacaauaguuuuuua

SEQ ID NO: 448588 - RNA, 64 nt, Human
aagcguaagauugaggcaugaaguucagaaaaaaaaguguuacaacacacagggaaguuuuuuc

SEQ ID NO: 448589 - RNA, 64 nt, Human
aguccgugauuuuaauugcugucuugaaguuaacaaguguuauaaugaaauaaucuaccugaug

SEQ ID NO: 448590 - RNA, 64 nt, Human
aauccucuucuaaaauagcaauaacugaaaaugaaaguguuaauuuuaccuuguuugaguuauc

SEQ ID NO: 448591 - RNA, 64 nt, Human
caugucaguuuaaaaauaaguucgguuaacaaggaaguguuaagcagauuuuuugaauacacuu

SEQ ID NO: 448592 - RNA, 64 nt, Human
aaaguuccauuccaacugccaguguagauuuuaaaaguguuaaauagugacucccuugauuaaa

SEQ ID NO: 448593 - RNA, 64 nt, Human
aagacugugaagauuuuuuacauugccagauaaaaaguguuacuuaaccaacaaacaaauguaa

SEQ ID NO: 448594 - RNA, 64 nt, Human
cucggucucacaaggaccucuuaaccccucaauaaaguguuacauuucuaaacauuggaaauuc

SEQ ID NO: 448595 - RNA, 62 nt, Human
auaauuugaagauuauagaagaagggaaauagcaaauggacacaaauuacaaaugugugugc

SEQ ID NO: 448596 - RNA, 62 nt, Human
gacaauauaauagcaaaagcuggacuaaagcccaaauggauugucuguggcaaugcagaagc

SEQ ID NO: 448597 - RNA, 62 nt, Human
uguggacaucucugaccauccaucgcuguauucaaauggauuguuuuauuccauucuggucu

SEQ ID NO: 448598 - RNA, 64 nt, Human
gucuuuucuagaauuuuauguaagucugccuauaaaguguuaauuuugcaugcugucuuucaug

SEQ ID NO: 448599 - RNA, 64 nt, Human
gguauguguuacacuuucuaacaugccauuuagaaaguguuagacuuucucaccugccauuuau

SEQ ID NO: 448600 - RNA, 64 nt, Human
gucacuggaacuugcauauuuucauuuuaauccuaaguguuauuacgcaccaguugggguucac

SEQ ID NO: 448601 - RNA, 64 nt, Human
uuuuaacauguuaaauacuauugugcauucagugaaguguuauuaugccacagacauuaaccua

SEQ ID NO: 448602 - RNA, 64 nt, Human
gcugcccuuccaggugcuuaacuccugucccugcaaguguuacugccaccaccagccacgccau

SEQ ID NO: 448603 - RNA, 64 nt, Human
ccugaccucgugauccgcccgccucagccucccaaaguguuaggauuaggggcaugagccaccg

SEQ ID NO: 448604 - RNA, 64 nt, Human
ggagauaggccaagcgagaggucaugggccaacuaaguguuauccaguagaaaagacaguacac

SEQ ID NO: 448605 - RNA, 64 nt, Human
agguauuauaaagguauuuaaaauaauaauaauaaaguguuauuuuccugggauucaugauauu

SEQ ID NO: 448606 - RNA, 64 nt, Human
gcugcaagggccagaguuccacaaaucuauauuaaaguguuauacccgguuuuaucccuugaau

SEQ ID NO: 448607 - RNA, 64 nt, Human
uggccuuuaaacaaagaggggcccauucauaagaaaguguuauaucuagguuuuuaaaacugaa

SEQ ID NO: 448608 - RNA, 64 nt, Human
gcgcagggcugcgcaggacccuuggaaauguugcaaguguuacuaguaccaguuucacuuuuug

SEQ ID NO: 448609 - RNA, 64 nt, Human
agcucucucuucucuguuacaaaacgagauaagcaaguguuagaauugccuuaaggccacacug

SEQ ID NO: 448610 - RNA, 64 nt, Human
cccucugugaaaugauuggucagaugucuuugagaaguguuaaacuaauucacaugguagugua

SEQ ID NO: 448611 - RNA, 64 nt, Human
gaugauuaguaugagaugaacaauagaugacuuaaaguguuauuucuauuauuuauauaacaug

SEQ ID NO: 448612 - RNA, 62 nt, Human
auguuaagcaaaggaaaccaaaggaaucguuucaaauggacucauggcuuagaaaucuuuau

SEQ ID NO: 448613 - RNA, 62 nt, Human
guuuauuacucuaaaaagagaauuacacaugccaaauggaccaauguccauuugcuuauugg

SEQ ID NO: 448614 - RNA, 62 nt, Human
cuugcauuucaaaaauaaaauugauggcauuacaaauggaauagaaaccauuuuuaaaauau

SEQ ID NO: 448615 - RNA, 64 nt, Human
cuugcgcgucccccccccacccccuuuuuuaaacaaguguuacuugugccgggaaaauuuugcu

SEQ ID NO: 448616 - RNA, 64 nt, Human
guaguuucuuacuuggccaagagaaugcuuauuuaaguguuagacuuccauucuggcaaaaucu

SEQ ID NO: 448617 - RNA, 64 nt, Human
aauauccuuugcaacuccccaagagugcuuauuuaaguguuaauacuuuuaagagaacugcgac

SEQ ID NO: 448618 - RNA, 64 nt, Human
cccuuuuuggacuagccagaauucuacccuggaaaaguguuagggauuccuuccaauaguuaga

SEQ ID NO: 448619 - RNA, 64 nt, Human
auauaugauuuaugaauuauaguaauauuaauaaaaguguuaaagcuuuuucucucuugacaau

SEQ ID NO: 448620 - RNA, 64 nt, Human
agauuguaaaugauaaaccgagcuuuaaaggauaaaguguuaauaaagaaaggaagcugggcac

SEQ ID NO: 448621 - RNA, 64 nt, Human
uaugagugggaaauaaaucagcacauuugaaagaaaguguuaaaacugaaggccucacuuaauu

SEQ ID NO: 448622 - RNA, 64 nt, Human
gacuuuaaauuuaaaguuuucuacaaggggagaaaaguguuaaaauuuuuaaaauauguuuucc

SEQ ID NO: 448623 - RNA, 64 nt, Human
guuuguguuaccauguuaacuuuuccccgagagaaaguguuaacauugagacucuggccccaga

SEQ ID NO: 448624 - RNA, 64 nt, Human
cuaucagugccaagggcuuccuguaguucuauucaaguguuacaauaaauauuuguagauaaua

SEQ ID NO: 448625 - RNA, 64 nt, Human
uuuuguuccauaaauguuuuucuuaauuauuaagaaguguuaccuuauuaaaaugaccaccauu

SEQ ID NO: 448626 - RNA, 64 nt, Human
agaccguaaauucacauauaugccaucuguccucaaguguuaucuacauaggaaauaaaaugga

SEQ ID NO: 448627 - RNA, 64 nt, Human
accaauauaguuuucuaacuccuguuuggggagcaaguguuaauaauaacuuauuccuaaagcu

SEQ ID NO: 448628 - RNA, 64 nt, Human
aacuuaguuauauugagguuauuguuugucggugaaguguuagucacaguauuuucaaaaguuu

SEQ ID NO: 448629 - RNA, 62 nt, Human
ugccacccacacagcagccuccaggauaccagcaaauggaugcggugacaaauggcagcuua

SEQ ID NO: 448630 - RNA, 62 nt, Human
caaaaguguacggcuuccugugcugcuugugucaaauggaaccugcccucuaaagcacuuuc

SEQ ID NO: 448631 - RNA, 62 nt, Human
guucugauauuaagcacacacacacaugcacacaaauggacuucucugaagcuguguuuagu

SEQ ID NO: 448632 - RNA, 64 nt, Human
uggucuacaucccacugugucaaccagaagagccaaguguuaucucaauuggcccaguguuucu

SEQ ID NO: 448633 - RNA, 64 nt, Human
uuugcuguauaugugugguguuugauuucaacuaaaguguuauuaguggggaacagaaguauau

SEQ ID NO: 448634 - RNA, 64 nt, Human
cauucuugguggauaaauuguucaucuguuuuugaaguguuaccuuacuauuuuguuuacaaga

SEQ ID NO: 448635 - RNA, 64 nt, Human
cuugccaaaaaaauaccuugaacgcuuauguggaaaguguuaacuuacggguauuuuuguggga

SEQ ID NO: 448636 - RNA, 64 nt, Human
aggagacccagaaugaaggugucaguugggcaugaaguguuauuuaguguccauucuugauccu

SEQ ID NO: 448637 - RNA, 62 nt, Human
gcuaacuccuuggauugucaacccccaucccccaaauggaaauuccgaaggaggccuccucg

SEQ ID NO: 448638 - RNA, 62 nt, Human
uguauuccugacaguuaaauucagaaacgugccaaauggaacucaaggugccccuucagaau

SEQ ID NO: 448639 - RNA, 62 nt, Human
caaauaaacuuauuugaaaaguugucucaagucaaauggauucaucaccugucaugcauuga

SEQ ID NO: 448640 - RNA, 62 nt, Human
ugagggaaaguaaauccucaugaggaaaaguacaaauggaaaucguauuaauuugugaggca

SEQ ID NO: 448641 - RNA, 62 nt, Human
ggcugguuagccggaaaaggccucgggcuuggcaaauggaagaacuugagugagaguucagu

SEQ ID NO: 448642 - RNA, 62 nt, Human
cuaaagugggagaagauacauacacaguauggcaaauggauaaaauauuguggcaucaacua

SEQ ID NO: 448643 - RNA, 62 nt, Human
cuguccccccaaccgcccccccugcaugcagccaaauggagcaucucuguucuuuuuaauaa

SEQ ID NO: 448644 - RNA, 62 nt, Human
gauggccggagggcugcgggcuccgcuauuugcaaauggaugccccaguguccgggaugugu

SEQ ID NO: 448645 - RNA, 62 nt, Human
uacuguauuaaaauaaguucgcugucuuuaaacaaauggagaugacuacuaagucacauuga

SEQ ID NO: 448646 - RNA, 62 nt, Human
auggcugagagcaacugaagggaaagggaaagcaaauggaacucugauuuaaacagcugggg

SEQ ID NO: 448647 - RNA, 62 nt, Human
cuccucaacucaccuaauguuuaugagccagacaaauggaggaauaugacggaagaacauag

SEQ ID NO: 448648 - RNA, 62 nt, Human
agaacaaauuuuauuauuugccggugccucaacaaauggaaauacaauccaaugaaaguacu

SEQ ID NO: 448649 - RNA, 62 nt, Human
uuuuuguguuuuguuaagcaugucccuuggcccaaauggaagaggaaauguuuaauuaaugc

SEQ ID NO: 448650 - RNA, 62 nt, Human
aguccaaaugaugaaggaaauguuuuaauucacaaauggagauuuguauguguuaucagguu

SEQ ID NO: 448651 - RNA, 62 nt, Human
augggguggaaacagcauuaagaauacugaaucaaauggaaaaacaaaugaauacaggaaga

SEQ ID NO: 448652 - RNA, 62 nt, Human
auaauaaaaccuuccaaaaaaagugccgggaccaaauggauucacugaugugcauuuuucga

SEQ ID NO: 448653 - RNA, 62 nt, Human
ccuaagguauuugcugagaugugggugaacuccaaauggagaaguagucacuguagacuuuc

SEQ ID NO: 448654 - RNA, 62 nt, Human
ucuucuuugcccacaaugcuuugccccugagacaaauggaggccuguccugaccugucucac

SEQ ID NO: 448655 - RNA, 62 nt, Human
cuacuucccagggacucucacaucucgggccccaaauggacagaucacccgaggagcuggag

SEQ ID NO: 448656 - RNA, 62 nt, Human
uucagcuugcugaggacugucuccaaggaggccaaauggaaaaggagaggcuacuucaagug

SEQ ID NO: 448657 - RNA, 62 nt, Human
gcagacccugcccagcgugcgcuuugauacagcaaauggagcagcugaccucauggcuccaa

SEQ ID NO: 448658 - RNA, 62 nt, Human
gcaccacugauaccuccccugaaaaaaccccccaaauggauuagaagaccaacagguguuuc

SEQ ID NO: 448659 - RNA, 62 nt, Human
gggaagcuaagaacaagcuaguuuuuacaacacaaauggaaauaaaugcaauuauuauaaaa

SEQ ID NO: 448660 - RNA, 62 nt, Human
cucuuuauuaggaaaauggacgaauugaauagcaaauggagcauuuccucccucugcuauuu

SEQ ID NO: 448661 - RNA, 62 nt, Human
ucacuguuguacagaaaagaaauccagagaaucaaauggacuggccuugggggucucugcua

SEQ ID NO: 448662 - RNA, 62 nt, Human
auuccccaggcuccacccgugcugcucaggugcaaauggacuugagagcaucuaugugcugg

SEQ ID NO: 448663 - RNA, 62 nt, Human
gguaccuagguuggaguccagccuaaucaagucaaauggagaaacaggcccagagaggaagg

SEQ ID NO: 448664 - RNA, 62 nt, Human
gcacuucuuucuaaauguaucggagaaaaaaucaaauggacuacaagcacguguuugcugug

SEQ ID NO: 448665 - RNA, 62 nt, Human
uaugucacuauuacucauuuuucuugacaguucaaauggauuuuugugcauauauagucaau

SEQ ID NO: 448666 - RNA, 62 nt, Human
gcacccaucugcaaauaucucccucucuccaacaaauggaguagcaucccccuggggcacuu

SEQ ID NO: 448667 - RNA, 62 nt, Human
ccuaaaucuagacucaagguucccagagaugacaaauggagaagaaaggccaucagagcaaa

SEQ ID NO: 448668 - RNA, 62 nt, Human
agcacuguaagugagugggucaggcaaagccccaaauggaggguugguuagauuccugacag

SEQ ID NO: 448669 - RNA, 62 nt, Human
acugucccugcagauugagcaggaaguaaaaacaaauggaaaugcuucggauaguggcaggg

SEQ ID NO: 448670 - RNA, 62 nt, Human
cagggucagugugagcagcuaacauccuaccucaaauggaacaggauuuuuugaugcuuugc

SEQ ID NO: 448671 - RNA, 62 nt, Human
aggucuacaaaauugggugugacuuuccuuugcaaauggauuucuccuggggaauuuucuug

SEQ ID NO: 448672 - RNA, 62 nt, Human
uccacauugccagugacaugagacugaacagccaaauggaggcuauguggaguuggcauugc

SEQ ID NO: 448673 - RNA, 62 nt, Human
ugugucuuuauagauguacauaccuccuugcacaaauggaggggaauucauuuucaucacug

SEQ ID NO: 448674 - RNA, 62 nt, Human
uugcugccacauucuaaaggcuugauauuuuccaaauggauccuguugggaaagaauaaaau

SEQ ID NO: 448675 - RNA, 62 nt, Human
uucuuugcccagcauaugugccauaaacagaacaaauggauccaggguauaccucuaauaac

SEQ ID NO: 448676 - RNA, 62 nt, Human
accagcauucugggggccauuuucucuacaggcaaauggaauugcuuuuccauaacauccaa

SEQ ID NO: 448677 - RNA, 62 nt, Human
cccguuuuuaagaugcauggccaagcucucugcaaauggaaaugcuuacacuggguguuggg

SEQ ID NO: 448678 - RNA, 62 nt, Human
cuugcagcuacacuuacuuucucccugacuaccaaauggagugacgguugaagaaucaagcu

SEQ ID NO: 448679 - RNA, 62 nt, Human
uaguauuauugaagauacuaaaugaugcaaaccaaauggauuuuuuccaugucaugauguaa

SEQ ID NO: 448680 - RNA, 62 nt, Human
acgauguaucugugaaaaugggaugauauugacaaauggagacuccuaccucaauaguuaau

SEQ ID NO: 448681 - RNA, 62 nt, Human
gaaaauuucaucuuggaccucagugcauaggucaaauggauuucagagguuuaaacuucccu

SEQ ID NO: 448682 - RNA, 62 nt, Human
ggcugccgggaccagcauauuuccguugcagccaaauggauuuuauuuuuucauuuuauuga

SEQ ID NO: 448683 - RNA, 62 nt, Human
uugacuagaucaagaacuguuuauagcuuuagcaaauggagacagcuuugugaaacuucuuc

SEQ ID NO: 448684 - RNA, 62 nt, Human
guauuuacacaaugcaagaaaacaccuuuuuacaaauggaauuauguagguugcguugaccu

SEQ ID NO: 448685 - RNA, 62 nt, Human
aacaaauccaagaggccaguccuccauaagcacaaauggaauugugcaaccaccagaaaaac

SEQ ID NO: 448686 - RNA, 62 nt, Human
gagccuuauuucagaaauauuucaaacuggugcaaauggaaaagacuuucucuuuuccuuua

SEQ ID NO: 448687 - RNA, 62 nt, Human
uugggcaagcgacuucuuagaucagaacucaccaaauggaagccuagcagcugcuccauaaa

SEQ ID NO: 448688 - RNA, 62 nt, Human
aaauaaaaauguauauaaagcauaugagcacacaaauggacaauaaaugccacagcgcaaaa

SEQ ID NO: 448689 - RNA, 62 nt, Human
uuggcccuuuaagaguuagcuuuuuaccugcacaaauggacuaaaaaaucuggcacaaaaca

SEQ ID NO: 448690 - RNA, 62 nt, Human
cucgguauaggaggcuguguugagcugacauucaaauggauucuuuaauaauaaugaaacug

SEQ ID NO: 448691 - RNA, 62 nt, Human
gcucuagagagaggucaugauaucauaccaaccaaauggaaaugacaaauguuuuaugucaa

SEQ ID NO: 448692 - RNA, 62 nt, Human
uuccaaauauuguugacaacugugacuguacccaaauggaaaguaacucauuuguuaaaauu

SEQ ID NO: 448693 - RNA, 62 nt, Human
uacauuauuggaaaauaaaugagauguccacacaaauggauuauccacauaaucaaagcuua

SEQ ID NO: 448694 - RNA, 62 nt, Human
ggaaaagaaacaagcaauuuuggaugaaaaugcaaauggaaaaauacacauaaccaguuauc

SEQ ID NO: 448695 - RNA, 62 nt, Human
ucuagcuggguucccuuuuuuacagaaacucacaaauggagauugcaaagucuuggggaacu

SEQ ID NO: 448696 - RNA, 62 nt, Human
gguagaaagguuuaauuaacccuggagaucugcaaauggagggaggggugaaggaggaaucu

SEQ ID NO: 448697 - RNA, 62 nt, Human
guucuuucuuauagggcuauugauauugacaccaaauggaguggcuucucagccucuuaaug

SEQ ID NO: 448698 - RNA, 62 nt, Human
ucaguuucauuuucaaaaacuauuuaccaaaacaaauggagaagaaacauccaaaagcacau

SEQ ID NO: 448699 - RNA, 62 nt, Human
uuuuacuuugaauguuuuucuucuggauaaaacaaauggaaucaaguuguaguuguuuuuuu

SEQ ID NO: 448700 - RNA, 62 nt, Human
uagaauuuguguucauaaguucagauggguagcaaauggaauagaacuuacuuaaaaauugg

SEQ ID NO: 448701 - RNA, 62 nt, Human
aauuuuuuuucacauacuuuccaaaagaccaacaaauggauguugacaacaacccaaugaaa

SEQ ID NO: 448702 - RNA, 62 nt, Human
aauagcaauguaaaaaugguuuuuugaaccuccaaauggaauuacagacucaguagccauau

SEQ ID NO: 448703 - RNA, 62 nt, Human
uauacccacuaaagggaaggcugccgggaaggcaaauggaacaggaauggagccugucucag

SEQ ID NO: 448704 - RNA, 62 nt, Human
cuguaagauuucucuuuauaugaauguuuugucaaauggauauugauuuuuaaaaacauuuc

SEQ ID NO: 448705 - RNA, 62 nt, Human
uacuaaauuugauuaaucuggucaaugagaaucaaauggaaacauaucauucuggaggugca

SEQ ID NO: 448706 - RNA, 62 nt, Human
uaacuuuguuucucaaauuuucguugucagaacaaauggaaggagaauauuauuuagacuaa

SEQ ID NO: 448707 - RNA, 62 nt, Human
cgugccucucugaauccagccugccauuccaucaaauggagcaggagaggugggaggagcuu

SEQ ID NO: 448708 - RNA, 62 nt, Human
gagagauccauugaguccagaagccagaucagcaaauggaggaaccucggaggugaccagaa

SEQ ID NO: 448709 - RNA, 62 nt, Human
gaauguauccccugccuauuuuccuuguguaacaaauggaaaacauucuccccugugagaaa

SEQ ID NO: 448710 - RNA, 62 nt, Human
ugcaugggaaagcaaagcagaaaacagugccccaaauggaaaaaagauacucacacagaaca

SEQ ID NO: 448711 - RNA, 62 nt, Human
cuccaucuguuugggguagguguugagcgaggcaaauggaucucgauauuucagaugggcuu

SEQ ID NO: 448712 - RNA, 62 nt, Human
aaagcacccugcccuucaucuucauguucucccaaauggaacuuaggaucuuuuaacauagg

SEQ ID NO: 448713 - RNA, 62 nt, Human
acuucagcugaaacaguaaagccugaugggugcaaauggaaccuggaugugugcacgugugu

SEQ ID NO: 448714 - RNA, 62 nt, Human
caagggccggagacccaaagaucaugauauuccaaauggauuguggaagagaaaccuuauau

SEQ ID NO: 448715 - RNA, 62 nt, Human
gucuuucacaucaccuaucccuacauacauaccaaauggaaaaguggccauccuuuuccccc

SEQ ID NO: 448716 - RNA, 62 nt, Human
gcauucugauagcauuucauuaauuuugauuucaaauggaagauaaauaauaucccaaauga

SEQ ID NO: 448717 - RNA, 62 nt, Human
accauguucaaccaucugucaugacuguuuggcaaauggaaaccgcuggagaaacaaaauug

SEQ ID NO: 448718 - RNA, 62 nt, Human
uucacuaaauaauauauaugacauuuaucacacaaauggauaaacaacuaauuauuguugau

SEQ ID NO: 448719 - RNA, 62 nt, Human
uauuauagaaaaaguauuuuuucuccaccagacaaauggaaaaaaagaggaaagauuaacua

SEQ ID NO: 448720 - RNA, 62 nt, Human
auuuaucgagggaaauauguacaaagaagcuucaaauggaauauuuaccgacauuccuuaua

SEQ ID NO: 448721 - RNA, 62 nt, Human
agaaugauuuuauugaagagggccgcaagccccaaauggaaaacuguuuuuagaaaauauga

SEQ ID NO: 448722 - RNA, 62 nt, Human
gaacuaguagcuuugugcuauaauagccuuaacaaauggacccuugcagggcuuugcagcug

SEQ ID NO: 448723 - RNA, 62 nt, Human
gaagauuuuuguaaaggcucaaguuugguugccaaauggaaggggccauagcugcagcaauu

SEQ ID NO: 448724 - RNA, 62 nt, Human
augcuuuauauuuuaauacugcaaaagcuuuacaaauggaaaccaugcaauuaccugccuua

SEQ ID NO: 448725 - RNA, 62 nt, Human
uuauuugcucaugggcacuucuggcaacuugacaaauggaccgaugcagauuuuagagagug

SEQ ID NO: 448726 - RNA, 62 nt, Human
aaacugcaggagacaagaugaauuugagaagccaaauggaauuuuuaauggaaaccauuuau

SEQ ID NO: 448727 - RNA, 62 nt, Human
gcaagucagggggccacucugccucauuuaugcaaauggagaaaggcgcccucccugggguc

SEQ ID NO: 448728 - RNA, 62 nt, Human
gcuugcacaacauccucagaaccauucacuggcaaauggaggggaacgugcugacugggacu

SEQ ID NO: 448729 - RNA, 62 nt, Human
aaugugauuuaaggaagaaaacagacuuuucucaaauggaccacaucaucucucacucacag

SEQ ID NO: 448730 - RNA, 62 nt, Human
gaaagauggagucuaaaaauuauuagcuguuacaaauggaacauuucauuauaacgugauca

SEQ ID NO: 448731 - RNA, 62 nt, Human
ugucagacaaagaauguauccuuuacuuuucucaaauggaauaaaauuauuucuucugugga

SEQ ID NO: 448732 - RNA, 62 nt, Human
uuguccaguguccucauucugaagacauucaccaaauggagcuuggcacuaaaauuuaugua

SEQ ID NO: 448733 - RNA, 62 nt, Human
cacaagugaugagauagucccuuuacuguccucaaauggacuuggccuuagagacgugguaa

SEQ ID NO: 448734 - RNA, 62 nt, Human
gucaucauuguggccaggaagauggaauacaccaaauggacaggccuggcauguacccacag

SEQ ID NO: 448735 - RNA, 62 nt, Human
gugaugguauuacuuuuuacaaagaaugaaaccaaauggacucagcccucucccacauuuuc

SEQ ID NO: 448736 - RNA, 62 nt, Human
gcagguuucucauccauggauucaaccaacugcaaauggaaaauacgauuuuuuuuaaaaaa

SEQ ID NO: 448737 - RNA, 62 nt, Human
guugauagcacagacccugcccugugggcccccaaauggaaaugggcagagcagagaccauc

SEQ ID NO: 448738 - RNA, 62 nt, Human
ucccuggugauguucucaagccucggaaguggcaaauggaaaugauauggccgguugcgguu

SEQ ID NO: 448739 - RNA, 62 nt, Human
ggucuccagcuucuucauccugccagaguuuccaaauggagcccggggcucugcagcauucc

SEQ ID NO: 448740 - RNA, 62 nt, Human
aggccucugccuagacacuucaacugccuaugcaaauggaacggcuucucaucuuucugccg

SEQ ID NO: 448741 - RNA, 62 nt, Human
uaaacuauuuuccuuaaagccgaaaauauugacaaauggauaugguuagccuuuauaaauaa

SEQ ID NO: 448742 - RNA, 62 nt, Human
aucuucucuuccuuaaaugaaaaguuauugaccaaauggacuuuuuaaaagacacaggaccc

SEQ ID NO: 448743 - RNA, 62 nt, Human
ugcccgaggacaguggguaggaauuucaucaacaaauggaccuauggcaucauggcuuuaga

SEQ ID NO: 448744 - RNA, 62 nt, Human
caccuuucuccuagaaugcuguuguaaauaaacaaauggaucccuggaaacuuucucaagcu

SEQ ID NO: 448745 - RNA, 62 nt, Human
gggugcccacauggccugccaacuagggccugcaaauggagugggggaguccuggccccuga

SEQ ID NO: 448746 - RNA, 62 nt, Human
ccagucagcuuuucaaacaagaauuuuguuuccaaauggaaacugaaauauuuguugaaaug

SEQ ID NO: 448747 - RNA, 62 nt, Human
uguugugccauguggaacugagaagaacuucacaaauggaaugguuaauggucacaugccau

SEQ ID NO: 448748 - RNA, 62 nt, Human
ggacacaacagacacacaucacaaggcgaacacaaauggacacacauaccuggccacgaacc

SEQ ID NO: 448749 - RNA, 62 nt, Human
caaaacacugcugaaagaaaucagagaugacacaaauggaaaaacauuccauacuuauggau

SEQ ID NO: 448750 - RNA, 62 nt, Human
uccuuagaguaauauguccuuaauaaaaaggacaaauggauacagccuugacccucccagug

SEQ ID NO: 448751 - RNA, 62 nt, Human
cuggcucagcauagggucacuuugccauuaugcaaauggagauaaaagcaauucugacuguc

SEQ ID NO: 448752 - RNA, 62 nt, Human
cuucagcuugcuucauugggcuguuuucucaacaaauggaaugccauuugcacuuacacaag

SEQ ID NO: 448753 - RNA, 62 nt, Human
caaguggaguguaaugguggcguagagaaucacaaauggaaaauaauuccauaauuauuuuu

SEQ ID NO: 448754 - RNA, 62 nt, Human
uaauuccauuuucuauccccucagggacugaacaaauggaaauaacucccaggcaguaucag

SEQ ID NO: 448755 - RNA, 62 nt, Human
aacaugggguagguauuuugucuuucaaacuacaaauggaauguggugacauaaacuagaca

SEQ ID NO: 448756 - RNA, 62 nt, Human
auuucucucuuaacguuccugggagacuccaacaaauggagaccagaaacaaggcaaccacg

SEQ ID NO: 448757 - RNA, 62 nt, Human
ugccaaauaggaagagguggccuugguguagccaaauggaucuuuuuaacagugugccuuug

SEQ ID NO: 448758 - RNA, 62 nt, Human
cuccgugccagauguggcaagaucaccauuagcaaauggaaauuacauuugaaagccauuag

SEQ ID NO: 448759 - RNA, 62 nt, Human
cuaaguggugugccagguuuucagugacauaccaaauggaaauaagaggauauugaucacga

SEQ ID NO: 448760 - RNA, 62 nt, Human
guguccuuaaagccaaguauaugcuuuaacaucaaauggaagucaaauuccuaaugcauaga

SEQ ID NO: 448761 - RNA, 62 nt, Human
ccaaaaaacagaaguagaaugccauuggaugucaaauggauuuuuccccaccauucugugac

SEQ ID NO: 448762 - RNA, 62 nt, Human
agccaggcagacaugagacauggcggaguguccaaauggauccuuuauuggugguagagcaa

SEQ ID NO: 448763 - RNA, 62 nt, Human
cucugcagaacugugauuucagaccauauaaacaaauggaaggauggagccacuucaucaca

SEQ ID NO: 448764 - RNA, 62 nt, Human
caacuaggucauuucauuugaaaucuaggagucaaauggaaagauccccuaauaauacaccu

SEQ ID NO: 448765 - RNA, 62 nt, Human
gaugggggaggcagagacugguccagagcccgcaaauggacucggagccgagggccucccag

SEQ ID NO: 448766 - RNA, 62 nt, Human
accugcuggagaugaagcugaagaaccuggcacaaauggagccccuccaugcagagauccug

SEQ ID NO: 448767 - RNA, 62 nt, Human
ucuguuggccucccuuuccuccacccuggccucaaauggaugccagaugccaaccccaguuc

SEQ ID NO: 448768 - RNA, 62 nt, Human
aaaggaaaaugugugcucuuuaguggguagaacaaauggaaauuugguuucagaauggcuga

SEQ ID NO: 448769 - RNA, 62 nt, Human
acauacccagaguuauacucaagcagaaugcacaaauggacaugucauaauuuuuguuacaa

SEQ ID NO: 448770 - RNA, 62 nt, Human
ugugugugugcguguguguguguguguguagacaaauggauauugcuauauccaucuauaua

SEQ ID NO: 448771 - RNA, 62 nt, Human
aaccaauuuguaaugauuuuggaacuguguuucaaauggacuguuacagacugaaaggugug

SEQ ID NO: 448772 - RNA, 62 nt, Human
uugaguucaacugugaaauccaucagaugugccaaauggagaagacagaaagcaacaaagug

SEQ ID NO: 448773 - RNA, 62 nt, Human
cuguguauuuaaguccugcauuuuguaagaggcaaauggagaguaacagaagagugucuuuu

SEQ ID NO: 448774 - RNA, 62 nt, Human
ccuuguuucugucugguagagaguuugcuucucaaauggagcaaacaaauuugauuauuuuu

SEQ ID NO: 448775 - RNA, 62 nt, Human
ggagccccaggcugaaaaggguccaauuaaaacaaauggagccaaauuuucugccugagaac

SEQ ID NO: 448776 - RNA, 62 nt, Human
cucucuggcccucugagauaucccgaugggcacaaauggaaggugcgcacuugccccuacua

SEQ ID NO: 448777 - RNA, 62 nt, Human
caaaauaaaaggauggaggaagaucuacgaagcaaauggaaaacaaacaaaaaaagaggcag

SEQ ID NO: 448778 - RNA, 62 nt, Human
cuuuggaaccaaacuuguaauaaaaggaauuccaaauggacaagcaguaaugauauuuaaau

SEQ ID NO: 448779 - RNA, 62 nt, Human
agcuuucuuaacuauccuaacaagccuuggaccaaauggaaauaaagcuuuuugaugcagcu

SEQ ID NO: 448780 - RNA, 62 nt, Human
aaaagaauuucugccuacccugaaagccuuaucaaauggacaccauccaugaagcagcuggc

SEQ ID NO: 448781 - RNA, 62 nt, Human
ggauucucugccuuuuuguaucaaagaacaagcaaauggacccccgcccgcugcaggcgccc

SEQ ID NO: 448782 - RNA, 62 nt, Human
gaccuccccagcaugaucaguuccuucaucagcaaauggagaagauggccaugacucugugu

SEQ ID NO: 448783 - RNA, 62 nt, Human
ucucccucccucccucccucucugucccuuggcaaauggacaccaggggcuucuccccucaa

SEQ ID NO: 448784 - RNA, 62 nt, Human
uuccuaaauauuucuuacuuuaagcucuuuagcaaauggaagugguuuuuaauuuuauuuua

SEQ ID NO: 448785 - RNA, 62 nt, Human
uuccuaaauauuucuuacuuuaaguucuuuagcaaauggaauugguuuuuaauuuucuuuua

SEQ ID NO: 448786 - RNA, 62 nt, Human
auguguuuguguuuuuuggggagcauaauuugcaaauggaauaucuguuauuuuacuaagau

SEQ ID NO: 448787 - RNA, 62 nt, Human
cagcccaggcuccugggccagugcucucuccucaaauggaggcagccauggccugaagugca

SEQ ID NO: 448788 - RNA, 54 nt, Human
aagcaucccaggaagauuagaaugcaaauggacauucucugggagguggggcau

SEQ ID NO: 448789 - RNA, 62 nt, Human
ggaaaaaaauggaugaggagggaaaacucugccaaauggaaaaugaccaaauuuaagagggu

SEQ ID NO: 448790 - RNA, 62 nt, Human
agcuuucuuaacuacccuaacaagccuuggaccaaauggaaauaaggcuuucugaugcaaaa

SEQ ID NO: 448791 - RNA, 62 nt, Human
ucuuccacaagacuuaaaaccaaauucagggacaaauggauagagaagaaaagggucaaaca

SEQ ID NO: 448792 - RNA, 62 nt, Human
ccagcaaaauauauguuuggcugaaauuaugucaaauggauguaauauaggguuuguuugcu

SEQ ID NO: 448793 - RNA, 62 nt, Human
cccauuaaaagaggaccaaacaauucuuuauacaaauggaguagcaacuaguuuuguagcac

SEQ ID NO: 448794 - RNA, 62 nt, Human
gguuuggauuuuuuuuuccuucuuuguuuuaacaaauggauccaggauggauaaauccaccg

SEQ ID NO: 448795 - RNA, 62 nt, Human
gaugaaugcuguccugugcuguaaacacuaugcaaauggaaguuaucgguuguggugcugug

SEQ ID NO: 448796 - RNA, 62 nt, Human
uggucaggagggaaggaccucacuuguuucaucaaauggagugguuuaaaacugaucaagca

SEQ ID NO: 448797 - RNA, 62 nt, Human
ccuccccuuggggaccuagccuggagucaggacaaauggaucgggcugcagaggguuagaag

SEQ ID NO: 448798 - RNA, 62 nt, Human
uuuuuguaugaucuaguaacuugcaaacagaccaaauggaugagaggcggggaccgugcagc

SEQ ID NO: 448799 - RNA, 62 nt, Human
uggguuccuuuuguuucaggcacggauaacagcaaauggaauucuguauuuauuauuauuua

SEQ ID NO: 448800 - RNA, 62 nt, Human
aaauagucuucauugccaauuuguucuuguagcaaauggaacaaugugguauggcuaauuuc

SEQ ID NO: 448801 - RNA, 62 nt, Human
uaaggccagaaacuucugagcagauaacuccacaaauggaaauuuaguacuuucuuccugau

SEQ ID NO: 448802 - RNA, 62 nt, Human
uaauuauccaaauaaauugcaagcauucuauccaaauggacauccauaaaaauucaucagag

SEQ ID NO: 448803 - RNA, 62 nt, Human
uuuuucucuaagucgagggcuaugccauaauacaaauggaaauguuaccuuugauuuucuua

SEQ ID NO: 448804 - RNA, 62 nt, Human
aauagagguagguugaguuuucuaggggaaaacaaauggagaaaagaggcaugaagaaaagu

SEQ ID NO: 448805 - RNA, 62 nt, Human
uuacaaauaucuguggaacauguaaauacugucaaauggaaaauaaaauaaguuauaauuuu

SEQ ID NO: 448806 - RNA, 60 nt, Human
aggagcaaccaucaggguaacagguaaaaacaaauggaaucucugauggcaaaagagaau

SEQ ID NO: 448807 - RNA, 62 nt, Human
uuguuugaaucaaaacugguuauagcaauacucaaauggaaaaaacuucaugauagcguaag

SEQ ID NO: 448808 - RNA, 62 nt, Human
acgagccaacugcuguauuuaacaucugccugcaaauggacaaaguacuugauaugguaagu

SEQ ID NO: 448809 - RNA, 62 nt, Human
ucaucuucaggcguaaagagaaacaugaaguacaaauggaucacagaccugaaucuguugug

SEQ ID NO: 448810 - RNA, 62 nt, Human
aaaagcagcccgugugcaucuugggccauccucaaauggacagacuuggucuugugagguuc

SEQ ID NO: 448811 - RNA, 62 nt, Human
guuuuaagaaaaagcacuucaaaacagaagggcaaauggaaaaggggaauauaaaacaaacc

SEQ ID NO: 448812 - RNA, 62 nt, Human
cagcccgaccccugggcauaacacuguguuugcaaauggagauucagguauuggggaugcag

SEQ ID NO: 448813 - RNA, 62 nt, Human
agcuggguucuugcagaaagcaucagugccuacaaauggagcuccacccuucagucuguguc

SEQ ID NO: 448814 - RNA, 62 nt, Human
auccucucugcaagucggucuccuuauccccccaaauggaaauuguauuugccuucuccacu

SEQ ID NO: 448815 - RNA, 62 nt, Human
ugaggcauaugcguugucaguuggaaucccuccaaauggauugcaagagaaauacuaaauug

SEQ ID NO: 448816 - RNA, 62 nt, Human
uuuuuuuaauaauuauuuuuaauuuaaaaaagcaaauggaaaauguauauuuugaugagcuu

SEQ ID NO: 448817 - RNA, 62 nt, Human
gguuggcaaauuuaggagcuuguucccauugccaaauggauuuagaaauucccuugugagug

SEQ ID NO: 448818 - RNA, 62 nt, Human
ggugaagcuacccuaaagcuaucuaucuuuaucaaauggaaugaaacuagauaauuucaaga

SEQ ID NO: 448819 - RNA, 62 nt, Human
uuccaugcugauuguguggaaccaguauguagcaaauggaaagccuagaaauaucuuauuuu

SEQ ID NO: 448820 - RNA, 62 nt, Human
ggggaacuuugugcaaguaccucaucgcugagcaaauggagcuugcuauguuuuaauuucag

SEQ ID NO: 448821 - RNA, 62 nt, Human
ucacuuaauuagaaacgugauaaauauauggacaaauggacuauacauacuauaagaggacu

SEQ ID NO: 448822 - RNA, 62 nt, Human
ucucaaagaugucccaguugccuagaaaggaucaaauggaacauuugacacacauacucaaa

SEQ ID NO: 448823 - RNA, 62 nt, Human
cuggauuuuuuauucuuuucagauaggcuuaacaaauggagcuuucuguauauaaaugugga

SEQ ID NO: 448824 - RNA, 62 nt, Human
cuucuaaaacuguacuuugauucacauguuuucaaauggaguuggaguucauucauauuaca

SEQ ID NO: 448825 - RNA, 62 nt, Human
ccauuggcuaaaaauguguuuuguugaguuuccaaauggaugaauuuucauuuggacauuac

SEQ ID NO: 448826 - RNA, 62 nt, Human
gauuugcaaauuauuauuuuucuuuuuuuuaacaaauggaaguaaauuuguuucacguaaau

SEQ ID NO: 448827 - RNA, 62 nt, Human
gaaaggucaccucacucagcaccacucaagaccaaauggaaacagaggaccagcacacuccc

SEQ ID NO: 448828 - RNA, 62 nt, Human
gaagaaucccgaauccugggccuguccagggucaaauggaguuuuugguauuaauacaucuc

SEQ ID NO: 448829 - RNA, 62 nt, Human
ugaauagccccccacugaaugcuugccuugcccaaauggaauggaggaagauugauuuucuc

SEQ ID NO: 448830 - RNA, 62 nt, Human
uugauugcgguauauguacuacuagaaaauaccaaauggauauauuuucuuuaggauaaccu

SEQ ID NO: 448831 - RNA, 62 nt, Human
uuuuaguaguuugacaagcaagaacacauauccaaauggaauuuuacccugagaaauuauca

SEQ ID NO: 448832 - RNA, 62 nt, Human
gagaauugguugcaaaugaggacuucccuccccaaauggacagucuucucuguugaucacag

SEQ ID NO: 448833 - RNA, 62 nt, Human
ugaauuauaguaaaauggucuucaauucuuaacaaauggacuucccugaugagaccaaaaug

SEQ ID NO: 448834 - RNA, 62 nt, Human
aaagugcuauucacccaguaaacccaaaaaagcaaauggauaaugcuggccauuuugccuuu

SEQ ID NO: 448835 - RNA, 62 nt, Human
ggccccccguuucccgcuaagccuggccugggcaaauggagcgaggucccacuuugcgucuc

SEQ ID NO: 448836 - RNA, 62 nt, Human
cugcugcagccagugugccagugugcguucgacaaauggaaaagcagauuggggccagggag

SEQ ID NO: 448837 - RNA, 62 nt, Human
uggaggaagcauccaaagauugcaacccagggcaaauggaaaacaggagauccuaauaugaa

SEQ ID NO: 448838 - RNA, 62 nt, Human; identical to SEQ ID NO: 448819

SEQ ID NO: 448839 - RNA, 62 nt, Human
guaagauuuucauuuguaggaauaugugaugucaaauggaagacucagaaguuuuguguggc

SEQ ID NO: 448840 - RNA, 64 nt, Human
gugcccuuuagacaggcuggccugccgguuccacaggguacaguuaggacuugagucuuucuuu

SEQ ID NO: 448841 - RNA, 64 nt, Human
cgcccacucccaccccacuccuaggcugccuuggaggguacaagauccacugaggguggccacc

SEQ ID NO: 448842 - RNA, 64 nt, Human
ccaccagccccucggaagcaugugacaacagcagaggguacaccagggacaacagaccaggagg

SEQ ID NO: 448843 - RNA, 55 nt, Human
agaaacucucugaauguuagaucucaggguacaaugauuaaacguacuuuguuuu

SEQ ID NO: 448844 - RNA, 64 nt, Human
gcacugucucagccaacccgcuccacuacccggcaggguacacauucgcaccccuacuucacag

SEQ ID NO: 448845 - RNA, 64 nt, Human
uaguucucuguauuaaaggagauauuuuuaaaacaggguacaacccccugcugcacacgcuagc

SEQ ID NO: 448846 - RNA, 64 nt, Human
aaacuaagagugucuuuaagaagaaaacuauagcaggguacaaugcuugggcucaggaaguuuc

SEQ ID NO: 448847 - RNA, 60 nt, Human
ucuuuuuuuuccucagagaaaucaggaggguaguuagagguauaaaacaggaggaaauau

SEQ ID NO: 448848 - RNA, 60 nt, Human
uacugggagaggguucaguuuggaugaugcuaguuagaucauuugcaucucuccaccauu

SEQ ID NO: 448849 - RNA, 60 nt, Human
uuucccuucccccaguaucgcacaugguucuaguuagaauccuguuagauagugagcauc

SEQ ID NO: 448850 - RNA, 64 nt, Human
guuuauuaaucaccucuaauacucauccacaugaaggguacacauuagguaagcugggcguuga

SEQ ID NO: 448851 - RNA, 64 nt, Human
ugcaccauaaccgccacacccuucggggggggggaggguacagagggucucuaagcacaggggu

SEQ ID NO: 448852 - RNA, 64 nt, Human
ccuaaugaagaaacuucuugcucagaggccuagaaggguacacaaaaugucuucuaaacuagaa

SEQ ID NO: 448853 - RNA, 64 nt, Human
ccugucacucauggccaggagagugacaccauggaggguacaauugccagcucccccgugucug

SEQ ID NO: 448854 - RNA, 64 nt, Human
acccacagagcuguguugcuuuaaagccaccacaaggguacagcauuaaauggcagaacuggaa

SEQ ID NO: 448855 - RNA, 64 nt, Human
cugcuguuggaggcaacaucuccucuuuuuacagaggguacauccuuuuuucuuacaaauucuu

SEQ ID NO: 448856 - RNA, 64 nt, Human
gcagcagaucaggagcccacugauaaggggcccuaggguacagggugcugcccagcaggucgcc

SEQ ID NO: 448857 - RNA, 64 nt, Human
agaagcaaauuuacaguaccauaacuaauaaagcaggguacagauauaaacuacugcaucuuuu

SEQ ID NO: 448858 - RNA, 64 nt, Human
cuuugugugugugccaguagacuuacgcaaggacaggguacaaacuuagcuggaagucugccca

SEQ ID NO: 448859 - RNA, 64 nt, Human
agauaauuguuuuaugggauuugggugugggacuaggguacaaugaaggccaagagcaucucag

SEQ ID NO: 448860 - RNA, 64 nt, Human
cgacaucaagaaggaaaggucucagaugaaagagaggguacaacuaaagggaaugagaaggagg

SEQ ID NO: 448861 - RNA, 64 nt, Human
cagucuaguccuggggguaaagcccucagaucccaggguacacucuucuccauucccuccaccc

SEQ ID NO: 448862 - RNA, 64 nt, Human
ggcacuguccccccaaccccaucucagagcucagaggguacaagcuccagaacaguaaccaagu

SEQ ID NO: 448863 - RNA, 64 nt, Human
guuucccaguucacugaaauguuagguuuccuaaaggguacagugccguauaaaacaaccugcc

SEQ ID NO: 448864 - RNA, 64 nt, Human
aaaaucugccauuuaauuagcugcauaucaccuuaggguacagcacuuaacgcaaucugccuca

SEQ ID NO: 448865 - RNA, 64 nt, Human
ucuuuuguacuuuucuucagaagaaaugaauuaaaggguacaguugcauaaaguggguuuuuau

SEQ ID NO: 448866 - RNA, 64 nt, Human
gaagcuuucaugauuagauuugagcuauaucaguuauaccgauuauaccuuauaauacacauuc

SEQ ID NO: 448867 - RNA, 64 nt, Human
aggaaaauucgacuccuguuuuucuuuaauuaacuauaccgacggggauggagucaucuuuagg

SEQ ID NO: 448868 - RNA, 58 nt, Human
gauccagauccgaccacuagaucauccuuauaccgacggggaaacggaggccagagag

SEQ ID NO: 448869 - RNA, 64 nt, Human
uuuucagugucuucucagaaaccaccagccuugaaggguacaagugacgaggaagauucuguuu

SEQ ID NO: 448870 - RNA, 64 nt, Human
uuauuauuauuauuauuauuauacuuuaaguuuuaggguacaugugcacauugugcagguuagu

SEQ ID NO: 448871 - RNA, 64 nt, Human
agaaaagcauacaugcaaaaagaaaugacuaauuaggguacauuuauaauugcaucuagguaau

SEQ ID NO: 448872 - RNA, 64 nt, Human
acaauuagaaaaguccucagaagcuuuuucuuggaggguacacuuucuucacugucccuauucc

SEQ ID NO: 448873 - RNA, 64 nt, Human
ccuuaaggagcugaagagucuggguagcuuguuuaggguacaagaagccuguucuguccagcuu

SEQ ID NO: 448874 - RNA, 64 nt, Human
auggucuugggcagcucugccccuguggcuuuguaggguacagccucccuccuggcugcuuuca

SEQ ID NO: 448875 - RNA, 64 nt, Human
cuguccccuguagccucgugagucagcccagaggaggguacaugcgacuguggccuggccucag

SEQ ID NO: 448876 - RNA, 64 nt, Human
uucuuguuuuuauuauuauuauacuuuaaguuuuaggguacaugugcacaaugugcagguuugu

SEQ ID NO: 448877 - RNA, 64 nt, Human
ccaccuguaaccccuuccuggcauuggccacugaaggguacaaaggcaaaaggaccacagcacc

SEQ ID NO: 448878 - RNA, 64 nt, Human
aagccacaccacccugguuguucucugggcuuggaggguacagugccagcagcuuccuugccca

SEQ ID NO: 448879 - RNA, 64 nt, Human
aaucccuaccaagugaaaauugauguguguuaagaggguacagaauuaucaacugauuugguca

SEQ ID NO: 448880 - RNA, 64 nt, Human
gcauugcucuagcccucagagcguccggagcagcaggguacaugggugggagguucauucagca

SEQ ID NO: 448881 - RNA, 64 nt, Human
ccucugucagggucaguaaggaaaacgguggccuaggguacaggcaacaaugagcagaccaacc

SEQ ID NO: 448882 - RNA, 64 nt, Human
aucaugucacugcauugcuuucaccauugcucuuaggguacaauacaaauuuaucuucaucuuu

SEQ ID NO: 448883 - RNA, 64 nt, Human
gggaggccccuucucucccugccagaggggaaggaggguacagcugggcuggggaggaccugac

SEQ ID NO: 448884 - RNA, 64 nt, Human
uauuuaauggugagcuuuuaaaaauguaggauagaggguacaguggcacuguauauacuauuua

SEQ ID NO: 448885 - RNA, 54 nt, Human
ugacacuuccagagagcugacaccagagaccaacaaagggacuuucugaaggaa

SEQ ID NO: 448886 - RNA, 62 nt, Human
accccagggagaacucgccagagacugagagcagagaccacuuauccucauugcuuaccccg

SEQ ID NO: 448887 - RNA, 62 nt, Human
ggcggccacucccauggccuugucuaggacucagagaccacucggcucugagcuuccaggcg

SEQ ID NO: 448888 - RNA, 64 nt, Human
ucauuuuuuuuuuuuuuauuauacucuaaguuuuaggguacaugugcacauugugcagguuagu

SEQ ID NO: 448889 - RNA, 64 nt, Human
ccagugucccucagacuuggauggaguuucugggaggguacacccaaaugaugcagauacuugu

SEQ ID NO: 448890 - RNA, 64 nt, Human
agaaaucagcacugauuauccagaaacauuggagaggguacagggaaaggaaaaauuuucacca

SEQ ID NO: 448891 - RNA, 64 nt, Human
agaguucuuuuauuaagauguaucugcuggauuaaggguacagguugaaauaguucuguggcug

SEQ ID NO: 448892 - RNA, 64 nt, Human
cuucucuuucccugaaaagccuugaaggggguugaggguacaggcaaccuuguguucucugugc

SEQ ID NO: 448893 - RNA, 64 nt, Human
uaguaauuucuaguaaaauuguuucaaaaucuacaggguacaaugauuacaaauuaaucuucua

SEQ ID NO: 448894 - RNA, 64 nt, Human
ugagaugggagaaucgcuugagcccaggaggucaaggguacagugagccgaggucaugccacug

SEQ ID NO: 448895 - RNA, 64 nt, Human
ccuuccuugcuggugggcaguguauccugauggcaggguacaaguaccauuaaugaagggucug

SEQ ID NO: 448896 - RNA, 64 nt, Human
ugcaaaaucucacacaagacugaggcaggagaauaggguacagagauagggaucuaaggaugac

SEQ ID NO: 448897 - RNA, 64 nt, Human
ccccacaauucuuuuuuauuacacuucgaauuuuaggguacacgagcacaacgugcagguuagu

SEQ ID NO: 448898 - RNA, 64 nt, Human
aaauuuaaaauuugguauaugcugaagucugccaaggguacauuauggccauuuuuaauuuaca

SEQ ID NO: 448899 - RNA, 64 nt, Human
aaauuuuaugugcuucacauaauuguauuuuagcaggguacauauuaggggauggagagggggu

SEQ ID NO: 448900 - RNA, 64 nt, Human
agacuucucacuggggaauaagggaauaauaaauaggguacaaacuccuaauagauuugucuuu

SEQ ID NO: 448901 - RNA, 64 nt, Human
ugauuuucauguuaggccaaaauaaacaacuuauaggguacauauguugucauaaaagguaaaa

SEQ ID NO: 448902 - RNA, 64 nt, Human
aaauuugugauuucaaaaauguccugccaguuuaaggguacauuguagagccgaacuuugaguu

SEQ ID NO: 448903 - RNA, 64 nt, Human
gagagugauauuugcucugguaggugagggccugaggguacauuucuccaccugugcccccuca

SEQ ID NO: 448904 - RNA, 62 nt, Human
ggaggagagagggucuccaguguuccccccauagagaccaggagggagagccucuguuuugu

SEQ ID NO: 448905 - RNA, 62 nt, Human
cagaguccccacuagacccaguggaagggguuagagaccaaguaggggccaguuuccaauuc

SEQ ID NO: 448906 - RNA, 62 nt, Human
cccgggacccccagguuuuugcgaaccccagaagagaccaaaggagucgucccaggcuccuc

SEQ ID NO: 448907 - RNA, 64 nt, Human
ccagcuaagcugguuggaguaggagcgauaccaaaggguacacccaucugugagucacaucuug

SEQ ID NO: 448908 - RNA, 64 nt, Human
guaaaacagaggaugauaccaauaccuuccucauaggguacauaagauuaaauaaauacaaacu

SEQ ID NO: 448909 - RNA, 64 nt, Human
gggcaacaauuuuuuaacuuuuauuuuaaguucaaggguacaugugcagguuuguuacauaggu

SEQ ID NO: 448910 - RNA, 64 nt, Human
cuuugaaauuuauuagauacuguuaugucccccaaggguacaggaggggcaucccucagccuau

SEQ ID NO: 448911 - RNA, 64 nt, Human
uuuauuaugcagacacacaaguggucuggacaugaggguacaguuucugccuaccaagacacua

SEQ ID NO: 448912 - RNA, 64 nt, Human
ugugagugggauccaaaacacucaauccuguaaaaggguacaguccuauuguauguuaacacac

SEQ ID NO: 448913 - RNA, 64 nt, Human
uaauuuuuuuaauggacaagucuuauggauacgaaggguacauuuuucauaaugauuccuuuau

SEQ ID NO: 448914 - RNA, 64 nt, Human
augcugugagagaguuuagcauugugucacuacaaggguacaguaaucccugcacuggacaugu

SEQ ID NO: 448915 - RNA, 64 nt, Human
ugaaaaaaaauguuugcaguacucagcaaaaaauaggguacauaaagcaggguggcuguccauc

SEQ ID NO: 448916 - RNA, 64 nt, Human
gaagaugguaccaccagucugacuguuuccaucaaggguacacugccuucucaacuccaaacug

SEQ ID NO: 448917 - RNA, 64 nt, Human
uuccaaaugcauucugggauugccuauuccagagaggguacagaaaaagcacacagauggcuug

SEQ ID NO: 448918 - RNA, 64 nt, Human
agccccggggggacagucgugccuggggaggagcaggguacagcccauucccccagcccuggcu

SEQ ID NO: 448919 - RNA, 64 nt, Human
uuacccauugggaaacacaauggcuacuucuguuaggguacauugaccuuggucaagcaucuua

SEQ ID NO: 448920 - RNA, 64 nt, Human
gaacaugaguagcaaagaaaagggagagacgaaaaggguacaggcucacguaaaguaaugaagc

SEQ ID NO: 448921 - RNA, 64 nt, Human
ccuaaauguccagcaggacauuagacagucguacaggguacagaauaauucuucguuguguggc

SEQ ID NO: 448922 - RNA, 64 nt, Human
auauuauuauuauuauuauuauacuuuaagguuuaggguacaugugcacaaugugcagguuagu

SEQ ID NO: 448923 - RNA, 62 nt, Human
aaauuucuagaaauguauccuucucacaaaguagagaccaagagaaaaacucauugauuggg

SEQ ID NO: 448924 - RNA, 61 nt, Human
cugucgaagaaagaagcucugucaaguuagagagagacaauguguaggaaauguucuuuuu

SEQ ID NO: 448925 - RNA, 61 nt, Human
uuauucuacauuucaccuacuuuguaagugagagagacaagaagcaaauuuuuuuuaaaga

SEQ ID NO: 448926 - RNA, 64 nt, Human
auuaaaacaacaacaauaagaucuuccuaucuggaggguacagaggugaauggcuuugguuuuc

SEQ ID NO: 448927 - RNA, 64 nt, Human
ugagguuaaguuucucuucaccccuacacugugaaggguacagauuagguuugucccagucaga

SEQ ID NO: 448928 - RNA, 64 nt, Human
gguaguuuuuauucucuccaaacacuuuuggauuaggguacaauauuagagcucuaaaaaggaa

SEQ ID NO: 448929 - RNA, 64 nt, Human
uuaucugucacccugagcccaugagcugccuuuuaggguacagauugccuacuugaggaccuug

SEQ ID NO: 448930 - RNA, 64 nt, Human
gccuuuuagggcagagauuccugagcugcguuuuaggguacagauucccuguuugaggagcuug

SEQ ID NO: 448931 - RNA, 64 nt, Human
auaucuacauaugcaaagcuuuccuuaacaguaaaggguacauaugcauagugggaggagauca

SEQ ID NO: 448932 - RNA, 64 nt, Human
aguaagacaaaaauuguuuugacauagguucccuaggguacacuugcucuagcauacuuuaaag

SEQ ID NO: 448933 - RNA, 64 nt, Human
aaaagacaggacauaaaugagcauaacugauuacaggguacaguucuucacagcugaaaugguu

SEQ ID NO: 448934 - RNA, 64 nt, Human
auuacugaauauuuuacugugcuuuucuucaugaaggguacaugcuuuguacucuucacugaaa

SEQ ID NO: 448935 - RNA, 64 nt, Human
uacacucuuucaaggugggggagauacucuuuagaggguacacugagcuaauacuaccaguucu

SEQ ID NO: 448936 - RNA, 64 nt, Human
aucaguauaccuaucugcugcaccuucacucuccaggguacaugcuuuaaaaccgacccgcaac

SEQ ID NO: 448937 - RNA, 64 nt, Human
cuaccuguggcucaugccaugccaugaagugccuaggguacauaugugaacauuccagccuuca

SEQ ID NO: 448938 - RNA, 64 nt, Human
aggaaagcaaaauccaacuaaugguauauauuguaggguacagaauagagcgugugcuguugau

SEQ ID NO: 448939 - RNA, 64 nt, Human
uuuccuacuauaauaaugcugaaucuuaauuuagaggguacaaggguaugguaaugcuuguaga

SEQ ID NO: 448940 - RNA, 64 nt, Human
ggaggacgagcuccguauuuacucaggagcagucaggguacauuacauaaaacaauggaggaug

SEQ ID NO: 448941 - RNA, 64 nt, Human
ccccaggggaacacuggggacuuggccucucucuaggguacauggugcugggagaggcagccca

SEQ ID NO: 448942 - RNA, 61 nt, Human
cugaggggcaacgaagaaaaaaaauaacacagagagacagacuugagaacuugacaaguug

SEQ ID NO: 448943 - RNA, 61 nt, Human
gcugagaucacaccacugcacuccagccugggagagacagagugagacuccaucucgaaaa

SEQ ID NO: 448944 - RNA, 61 nt, Human
gccaaguuucgucauagccaguuccagcugggagagacagugggcgucguccauccucagu

SEQ ID NO: 448945 - RNA, 64 nt, Human
ggaggggacaucugagggcuucacagggcugcaaaggguacagggauugcaccagggcagaaca

SEQ ID NO: 448946 - RNA, 64 nt, Human
ugaggcccucagggcagggauacaaagcggggagaggguacacaauggguaucuaauaaauacu

SEQ ID NO: 448947 - RNA, 64 nt, Human
ugucuuggguuggcuggcacuggggcgggcaucuaggguacagccucugcucauggcacugggc

SEQ ID NO: 448948 - RNA, 64 nt, Human
ucaggcucguucagcuaugaccaucugugcggucaggguacacucagcucuccuccccaacucc

SEQ ID NO: 448949 - RNA, 64 nt, Human
aagacugagguucugcaggauuaaagucagauuaaggguacagaaagcacaccuugauacugag

SEQ ID NO: 448950 - RNA, 64 nt, Human
ucauaaguugcaaauauuacuauuuuccuaaaccaggguacacaauuuaaguugccacuuauug

SEQ ID NO: 448951 - RNA, 64 nt, Human
gaccccaucacucucuuuguugcacuuagcccucaggguacagcucaaggagagcucuuucugg

SEQ ID NO: 448952 - RNA, 64 nt, Human
ggaaugaggaauaggggccugaggagagaggggaaggguacagagaaaccaucuacauuccaug

SEQ ID NO: 448953 - RNA, 64 nt, Human
acuaugauuuacugugugccaaaggaguuuugacaggguacagaguauuuuacuaaaaguauuu

SEQ ID NO: 448954 - RNA, 64 nt, Human
ugagauuuuaaaauuggauuuuugccuggacuugaggguacaagauguuucuauuugaagugaa

SEQ ID NO: 448955 - RNA, 64 nt, Human
agaaaccgcugauaaccaggacaaaacacaaccaaggguacacgcaggcaugcacggguuuccu

SEQ ID NO: 448956 - RNA, 64 nt, Human
guuaaaauaugcgaaagauucagaaccuagguuuaggguacauguuuuucucuguuucaugaac

SEQ ID NO: 448957 - RNA, 64 nt, Human
cagacuggauggauggucuuuuauaaggcauuuaaggguacacuacuguguuucacugaccaua

SEQ ID NO: 448958 - RNA, 64 nt, Human
agguguuuauacaagguucuauuaaccacuucuaaggguacaccucccuccaaacuacugcauu

SEQ ID NO: 448959 - RNA, 64 nt, Human
aguauaauuuauaaaauaaaauauacccauuuuaaggguacaguuugauuuuugaccagugaaa

SEQ ID NO: 448960 - RNA, 64 nt, Human
uggcaaacuucugcugggaauuaguuugagggugaggguacauaugugacauuugcccuagccu

SEQ ID NO: 448961 - RNA, 61 nt, Human
aauuucuaccaagcguuuucauggaugcuaugagagacaauccugaagcugcuguacauau

SEQ ID NO: 448962 - RNA, 61 nt, Human
cccccagcaagcucaccaccuccuuggaggagagagacauacaaggacagugggucauggg

SEQ ID NO: 448963 - RNA, 61 nt, Human
ugagagacacagcugcuacgugauagauguugagagacagaagccaacgaaggaggucauu

SEQ ID NO: 448964 - RNA, 64 nt, Human
caccucccaucaucccacucucucaccaggaucaaggguacaguaacacgaaugagcauacaga

SEQ ID NO: 448965 - RNA, 64 nt, Human
ccuguugucuucaaaugcuaaaaaaggagaauggaggguacaagacuagacaugacugaaaugg

SEQ ID NO: 448966 - RNA, 64 nt, Human
uagcuguaacccuuaaaaaugaaacgucaacucuaggguacauuugacauugaaagaauaguua

SEQ ID NO: 448967 - RNA, 64 nt, Human
agacucuacuccuaacugacuucaauauuucagcaggguacacaggcguuuccaaguuucagug

SEQ ID NO: 448968 - RNA, 64 nt, Human
ucaaguuagaagcauaccauuuuccuuucauggaaggguacaguauuacaaagauaauuuguuu

SEQ ID NO: 448969 - RNA, 59 nt, Human
caccuccuuugaggucauagccaaaccaaaggguacacucauauuugugcacuuuacug

SEQ ID NO: 448970 - RNA, 64 nt, Human
uguagaaaaggcugaugccaggguuggcacauggaggguacaaggaggacucgccuggaguauc

SEQ ID NO: 448971 - RNA, 64 nt, Human
gggguuuuucugggccagccuuuagaacacuguuaggguacauacgcuaccuugaugaaaggga

SEQ ID NO: 448972 - RNA, 64 nt, Human
ggagagaaauaaggggauguaaccagcaauggccaggguacaacagcccuggaaaacaguagua

SEQ ID NO: 448973 - RNA, 64 nt, Human
ugggaaaacggaccgcucuuggcuccugacucccaggguacagcgcccaguaacucauccuuca

SEQ ID NO: 448974 - RNA, 64 nt, Human
gaagagcucauagacugacugguccagaagacagaggguacaacaguggcaucacagugacagu

SEQ ID NO: 448975 - RNA, 64 nt, Human
gcucuaagugggugacuggccacaggccgagaaaaggguacagccucuaggugggguucccaaa

SEQ ID NO: 448976 - RNA, 64 nt, Human
caugacagugaguaagagacacucacaggcuaugaggguacaccccuagcugaauguucugugu

SEQ ID NO: 448977 - RNA, 64 nt, Human
agccauuuagcugaagcccagcuuaccagguucaaggguacaaacuucucaaaucuucaaaaca

SEQ ID NO: 448978 - RNA, 64 nt, Human
acaauuuaauuccucuuuuuagggcuaaaguuuuaggguacaguuuggcuagguaucauucaac

SEQ ID NO: 448979 - RNA, 64 nt, Human
gugguuuuucucuagcuuuuugccagaacaaaggaggguacauuacuuaaacccagggcaucag

SEQ ID NO: 448980 - RNA, 61 nt, Human
ggcccugcccuuauaggaacagaagaggaaagagagacacagcugcagaggccaccuggau

SEQ ID NO: 448981 - RNA, 61 nt, Human
aauacaguacacauuuuauuucuuggauuuugagagacauuguuaauuuugggggaauugg

SEQ ID NO: 448982 - RNA, 61 nt, Human
uaaaacccagagagagagagagagcgagagagagagacauguuacuaugaaagacuuguau

SEQ ID NO: 448983 - RNA, 64 nt, Human
gaaggagagcauaggaaaccacacagacuugggcaggguacagacacucccacuuggcaucauu

SEQ ID NO: 448984 - RNA, 61 nt, Human
ccucgcggcgggcgcccccagggccaggagagagagacagggcuggcuccucucgccccug

SEQ ID NO: 448985 - RNA, 61 nt, Human
ggugugguuccagaaauguuuuuggcaacaggagagacaggauugggccaacaaggacuca

SEQ ID NO: 448986 - RNA, 61 nt, Human
ccaccuauagaagaguccaucugcugugaaggagagacagagaacucuggguuccgucguc

SEQ ID NO: 448987 - RNA, 61 nt, Human
ucaauacguccaccuggaggcucaccacuuggagagacacaggaagguaauauuuacagcu

SEQ ID NO: 448988 - RNA, 61 nt, Human
ccccacucuccuuggucauucucaagaguaugagagacagagcuccaggcaugucccaucc

SEQ ID NO: 448989 - RNA, 61 nt, Human
uggagggaaggggcugucucuguuugugggagagagacauauggcuugagaagcggagaua

SEQ ID NO: 448990 - RNA, 61 nt, Human
uguaaugugcaggacccuucuccuuucaugggagagacagguaguuaccugaauauagguu

SEQ ID NO: 448991 - RNA, 61 nt, Human
ucucauauucuaccuggacuagguuuccuaugagagacaucuacuuguaaugccugaccuu

SEQ ID NO: 448992 - RNA, 61 nt, Human
aauuauuauuauauuaaaagaagcagaguaugagagacagguacaugguccaguaggaaga

SEQ ID NO: 448993 - RNA, 61 nt, Human
aagcucugcuguugucucacccuaucuuaaugagagacaagugagguggagggccugcccc

SEQ ID NO: 448994 - RNA, 61 nt, Human
aggaaauugccucaugggcagggccacagcagagagacacagcaugggcagugccuucccu

SEQ ID NO: 448995 - RNA, 61 nt, Human
gagagagagagaggagaaagagagagaaggagagagacaguagccaagagaaccccacgga

SEQ ID NO: 448996 - RNA, 61 nt, Human
cccacaaugcuccaauuuccugucuccuuuagagagacaugaaacuaucacaggugcugga

SEQ ID NO: 448997 - RNA, 61 nt, Human
ugggugagcauggcagcugguugcuccauuugagagacacgcuggcgacacacuccgucca

SEQ ID NO: 448998 - RNA, 61 nt, Human
cuuggccccccagggggcugcuggacuuugggagagacagcccacaccugugggaccgcgg

SEQ ID NO: 448999 - RNA, 61 nt, Human
agaagcuuugcccuccuaagagagagagacagagagacagagagagagaaagagagagugu

SEQ ID NO: 449000 - RNA, 61 nt, Human
aaucgccguguuacuguugcacugauguccggagagacagugacagccuccgucagacucc

SEQ ID NO: 449001 - RNA, 61 nt, Human
aggccuguauuuguggagcugauguucuagugagagacaguaaaugugacaaaaguaaaau

SEQ ID NO: 449002 - RNA, 61 nt, Human
ccacggugugcccagacucugcuaggcaccagagagacaagauacgagugacaugguucuc

SEQ ID NO: 449003 - RNA, 64 nt, Human
acccaugguaaaaaaaaaaaaaaaaacaaucccaaggguacagaagagcuuaugaauaaaagua

SEQ ID NO: 449004 - RNA, 64 nt, Human
uugucuuuuuaaauggcacaauuuuaaggguuugaggguacagucccuuaaccugccacgggag

SEQ ID NO: 449005 - RNA, 64 nt, Human
aagucaacccaucccaaagacaaacugcaugaaaaggguacagcuuagaccccaaugggaaggc

SEQ ID NO: 449006 - RNA, 64 nt, Human
uuacuuccuggcugggacggcaccuauagaaacuaggguacaaaucucccaaagaugguuugca

SEQ ID NO: 449007 - RNA, 64 nt, Human
ggguagaaauuugggagggaaaaaagaaauugggaggguacaggcaacaggagaaaggaaucaa

SEQ ID NO: 449008 - RNA, 64 nt, Human
ugaaaauguacgucuguagcauggagaagccuucaggguacauucagcucuuaacaaacacagg

SEQ ID NO: 449009 - RNA, 64 nt, Human
uucccaccuuccaucugcacacacccccaagguaaggguacagcccggcuggcggccuccuugg

SEQ ID NO: 449010 - RNA, 64 nt, Human
gguggcuuauaacuguaagggagauggcagccccaggguacagccagcaggcauugagcagccu

SEQ ID NO: 449011 - RNA, 64 nt, Human
ugggagccggccugggcagcuccaacuccagagaaggguacagcugaccccggcugcccuccug

SEQ ID NO: 449012 - RNA, 64 nt, Human
acagcugucuugucuguguguauauuguuugaucaggguacauggcagccagucacagauugga

SEQ ID NO: 449013 - RNA, 64 nt, Human
cagguccaaguucaagcccaggaccaccacuuauaggguacaggugggaucgacuguaaaugag

SEQ ID NO: 449014 - RNA, 64 nt, Human
uccuuugcagcuuucuguaugagcccaauagccaaggguacaaguacuaccgacagaagcugga

SEQ ID NO: 449015 - RNA, 64 nt, Human
aguccaggcccccagccccuccucccucaaaccaaggguacagauccccagccccuccucccuc

SEQ ID NO: 449016 - RNA, 64 nt, Human
cucuaaguuauuuaaauuauggcuggggucggggaggguacagggggcacugggaccuggauuu

SEQ ID NO: 449017 - RNA, 64 nt, Human
cagcugcugcucaggugccaugcccugaagaggcaggguacacauggggcugggagggcaaaga

SEQ ID NO: 449018 - RNA, 64 nt, Human
acagucucaccacgucuccuccagaggacggcagaggguacaggugguggccuggccgguuggc

SEQ ID NO: 449019 - RNA, 61 nt, Human
gggagcuuucccuguaggucuccuggguguugagagacaaguuggagaccaaccuccaaug

SEQ ID NO: 449020 - RNA, 61 nt, Human
ugaacuugauguuccugggauguuuaaucaagagagacaaaauugcugaggagcucagggc

SEQ ID NO: 449021 - RNA, 64 nt, Human; identical to SEQ ID NO: 189740

SEQ ID NO: 449022 - RNA, 64 nt, Human
uucuucccucugcuggaaccuuuggggacacucaaggguacaguuugacacugaucugguccau

SEQ ID NO: 449023 - RNA, 64 nt, Human
ucuuauuuuguuuucucuggaucuuuuccaucugaggguacaggaaguaccaggaccuguuuca

SEQ ID NO: 449024 - RNA, 64 nt, Human
auauucagggacuuaggggcgaugauuguagaacaggguacaguccuugacagaauugacuaua

SEQ ID NO: 449025 - RNA, 64 nt, Human
ucacuucuuuuagauccauccaauaugcgaaaaaaggguacauuuuaauuuaauguguuaaaaa

SEQ ID NO: 449026 - RNA, 64 nt, Human
gaaccugugaagcccaggaggugguguuggcugcaggguacacaaauacugagugguggucuuu

SEQ ID NO: 449027 - RNA, 64 nt, Human
gauuguuuuuuguuuuuaauguagaaaugagacaaggguacaaauuggaacuagaaauugacau

SEQ ID NO: 449028 - RNA, 64 nt, Human
cucagcucuccuugggggcuggcccagcugacugaggguacacaggauugggucuagaccuuga

SEQ ID NO: 449029 - RNA, 64 nt, Human
agcuauacugguccaacaucgccugcuuauugucaggguacagaaguuuaauacuuucuuaauc

SEQ ID NO: 449030 - RNA, 64 nt, Human
gaguggugugacuaauuccuuaccucucccaaggaggguacacaacuagcaccauucuugaugu

SEQ ID NO: 449031 - RNA, 64 nt, Human
guccacacaccuguaggccucugagccagcguccaggguacaggugcgggugguggggaugaag

SEQ ID NO: 449032 - RNA, 64 nt, Human
gcaccaggccccaccuuuguccccuagcaaauucaggguacagcuccaccuagaaccaggcugc

SEQ ID NO: 449033 - RNA, 64 nt, Human
auacuacuguaggcuuuauaaacacagcacacuuaggguacacaaaaugcauauuaaaacauuu

SEQ ID NO: 449034 - RNA, 64 nt, Human
gcggucuucuccaucuccgcuguuuuggggucuuaggguacagcccaggcggucacugcccacc

SEQ ID NO: 449035 - RNA, 64 nt, Human
agggcugucuuaaacaucacugccgucuugaagcaggguacacacguuagguauugugaagaac

SEQ ID NO: 449036 - RNA, 64 nt, Human
auuuugugcucagugugugccaagcacugugcagaggguacacaguuccugccagguuaacacc

SEQ ID NO: 449037 - RNA, 64 nt, Human
uaauuaaauuuauuaagaaaauagaugaaaaauuaggguacacagcuggccaccaaaugcgaag

SEQ ID NO: 449038 - RNA, 64 nt, Human; identical to SEQ ID NO: 189747

SEQ ID NO: 449039 - RNA, 64 nt, Human; identical to SEQ ID NO: 187018

SEQ ID NO: 449040 - RNA, 64 nt, Human; identical to SEQ ID NO: 189696

SEQ ID NO: 449041 - RNA, 64 nt, Human
aaucuugaaugcuuauaaagguuaccacaugacuaggguacagccagauuuggaaaccauagcu

SEQ ID NO: 449042 - RNA, 64 nt, Human
uuuuuuuucuuuuuuuuauuauacucuaaguuuuaggguacaugugcacauugugcagguuagu

SEQ ID NO: 449043 - RNA, 64 nt, Human
gccacaaggaagaaauuaacuuacccuguauaucaggguacaaaaaauucagugaugugccuaa

SEQ ID NO: 449044 - RNA, 64 nt, Human
ugauaggaaucugugauuaauaaaacauuugggaaggguacauguuacacuucacaaaaaggaa

SEQ ID NO: 449045 - RNA, 64 nt, Human
uauaauucacauaccuuacaauucacuuauuuuaaggguacaauuuagugguuuuuaguguauu

SEQ ID NO: 449046 - RNA, 64 nt, Human
agaggaugugcugccagcaggguguacggaguggaggguacagacgcuugccuaucugccacag

SEQ ID NO: 449047 - RNA, 64 nt, Human
gagugaaauugggauacauuuggcugucagaaauuauaccgagucuacuggguauaacaugucu

SEQ ID NO: 449048 - RNA, 64 nt, Human
ugacaccuuuucuuuuuguaaaaguuuaugguauuauaccgauagaccaaaacagcauguguaa

SEQ ID NO: 449049 - RNA, 64 nt, Human
uaaauaccuaccauguaugaagcuauacacagcauauaccgaaagaaccugcauugcacuagga

SEQ ID NO: 449050 - RNA, 64 nt, Human
uagauuccuugaguggaauagugggcuagauuaauauaccgaaauauuuccauuguuucccuuu

SEQ ID NO: 449051 - RNA, 64 nt, Human
cuaauguuucugaucaauaaaaucaaacucuuaauauaccgaguaaugaaaccauagugugauu

SEQ ID NO: 449052 - RNA, 64 nt, Human
ucuccccgcagcccucuccacccagaggucucccuauaccgagacccaccauccuuccauccug

SEQ ID NO: 449053 - RNA, 64 nt, Human
auacucagcuuuguagaaccaugcugcaaagccauauaccgaugggguuauccaugcaacuauc

SEQ ID NO: 449054 - RNA, 64 nt, Human
cugcacaggucucuguuuaguaaauacaucacuguauaccgaucaggaaucuugcuccaauaaa

SEQ ID NO: 449055 - RNA, 64 nt, Human
uguguuuagcuuccuaucagugggcuuuaaauuguauaccgagucauagauacgccacugauaa

SEQ ID NO: 449056 - RNA, 64 nt, Human
aaaaucacuugccagcaguagaaaaaggaccgacuauaccgaccuuucugauuaguaaacaguu

SEQ ID NO: 449057 - RNA, 64 nt, Human
agccaaggauaagugacucuccaauagguucuucuauaccgauuucauuuucuaaacuguauca

SEQ ID NO: 449058 - RNA, 64 nt, Human
cuuacagugauacaguuuuguauuuacauauaaauauaccgacaugaucaaaacccuuuuagcu

SEQ ID NO: 449059 - RNA, 64 nt, Human
gugggucucguucuuucuucauugcaggcuaguauauaccgagggggauacaaccguuuugcuc

SEQ ID NO: 449060 - RNA, 64 nt, Human
ggcugagccuacagaugaacucuuucuggccugccuucguuaacuguguauguacauauauaua

SEQ ID NO: 449061 - RNA, 64 nt, Human
gaccuuuuaaaauguuuugagggaucuguggaugcuucguuaauuuguucagccacaauuuauu

SEQ ID NO: 449062 - RNA, 64 nt, Human
gcaugaggcauccugggaauggucuggaguaacgcuucguuauuuuuauuuuuauuuuuauuua

SEQ ID NO: 449063 - RNA, 64 nt, Human
uguugcauagacuaguccuauggaaaaaaccaagcuucguuagaaugucugccuuacugguuuc

SEQ ID NO: 449064 - RNA, 64 nt, Human
guuuaaaaauaccaauuugccuccuccuuccucacuucguuagguuaugguagugcucagacau

SEQ ID NO: 449065 - RNA, 64 nt, Human
ugaguguccuuucucugaaaggauuuauguuuuucuucguuagauagugacuucugagcaagcu

SEQ ID NO: 449066 - RNA, 64 nt, Human
uguuccagacaaaaauaacacaaauaauaauauccuucguuauaaccacaaugagauaaguauu

SEQ ID NO: 449067 - RNA, 64 nt, Human
gagacuccuauuuacugcuuuuacuaaaccaguacuucguuaugaaaaugccuuccacgcaaau

SEQ ID NO: 449068 - RNA, 64 nt, Human
gugugggaucucugaaggcccuauuuaaguuuuucuucguuacuuugcugcuucauguguacuu

SEQ ID NO: 449069 - RNA, 64 nt, Human
cacugcaguugucugcauuuuuagccucuuuucucuucguuaguugucagaauaugccuucguc

SEQ ID NO: 449070 - RNA, 64 nt, Human
aaauguucagcccuccuaguuauguuccugaugucuucguuaugaaacuguugauguuugcauc

SEQ ID NO: 449071 - RNA, 64 nt, Human
cuuuuuuuuucuuuuuuuacaucugauuuuaaugcuucguuaacuucaaaaggaacugguagag

SEQ ID NO: 449072 - RNA, 64 nt, Human
gggaggagggggagggugaugcauuaauuaauggcuucguuaauuaaugucauguugcuugucg

SEQ ID NO: 449073 - RNA, 64 nt, Human
uguagaccugauucacugucugaaguauuguuuacuucguuacauauuuaauggggauucccac

SEQ ID NO: 449074 - RNA, 64 nt, Human; identical to SEQ ID NO: 189730

SEQ ID NO: 449075 - RNA, 64 nt, Human; identical to SEQ ID NO: 189427

SEQ ID NO: 449076 - RNA, 64 nt, Human; identical to SEQ ID NO: 189463

SEQ ID NO: 449077 - RNA, 64 nt, Human
cuaaaguucacagggcacggaugaguuuaucaaacuucguuauuuuaucuugucauuuacaaca

SEQ ID NO: 449078 - RNA, 64 nt, Human
ggccugaguuucuugugcauuacuccucucccuccuucguuagaauagguauaucagcugugua

SEQ ID NO: 449079 - RNA, 64 nt, Human
ugagcugguaacaucguugcaaccacugcaauaucuucguuaguaaucuguauaauacuuugua

SEQ ID NO: 449080 - RNA, 64 nt, Human
aucacuguuuaccccuuuuaaagauaugauuagacuucguuaguaauguucaacuuuucacaaa

SEQ ID NO: 449081 - RNA, 64 nt, Human
gaaugaagcugaugcacagggagcaccaaaggaccuucguuaagugauaauuguccuggccucu

SEQ ID NO: 449082 - RNA, 64 nt, Human
ucuccuucauuucaggcuggaaguacagcucaggcuucguuacugccgacaugaucaaggagca

SEQ ID NO: 449083 - RNA, 64 nt, Human
cucugguggauuguucuaguacuguauugggcuucuucguuaauagauuauuucauauacuaua

SEQ ID NO: 449084 - RNA, 64 nt, Human
uaacuccguagcaguugccaacucaguccuuguacuucguuaacacgaaucuguuucagagcuc

SEQ ID NO: 449085 - RNA, 64 nt, Human
uuaccaaauaugcaaaauuuuaaggcuuuugauacuucguuaugaguguauuuuugagauauuu

SEQ ID NO: 449086 - RNA, 64 nt, Human
ugcccccucccaaaaagaaauugauaaguaaaagcuucguuauacauuugacuaagaaaucacc

SEQ ID NO: 449087 - RNA, 64 nt, Human
acaugaacaucgacuuugacaguuucaucugcugcuucguuaggcuggagggcauguucaguaa

SEQ ID NO: 449088 - RNA, 64 nt, Human
caaccccacugaggccugcugcacaggucaaugccuucguuaucguuauuguacugucacuuug

SEQ ID NO: 449089 - RNA, 64 nt, Human
agaaagagaggaacucagaaggcaacaacagcagcuucguuaugaacaagaaaaaaggaauucc

SEQ ID NO: 449090 - RNA, 64 nt, Human
ugguuccaauuuaggugguggugaugaccucaaacuucguuaauuaauagcacagcagaugugu

SEQ ID NO: 449091 - RNA, 63 nt, Human
agcaacagcuuugcagcaaaauaauaaaauacuucuucguuaaucauguuuguuuugauguua

SEQ ID NO: 449092 - RNA, 64 nt, Human; identical to SEQ ID NO: 189496

SEQ ID NO: 449093 - RNA, 64 nt, Human; identical to SEQ ID NO: 189370

SEQ ID NO: 449094 - RNA, 64 nt, Human; identical to SEQ ID NO: 189569

SEQ ID NO: 449095 - RNA, 64 nt, Human
ccuaaugugcuccuguccuccauguucugcuuggcuucguuagugcauuacaugaaaugauuug

SEQ ID NO: 449096 - RNA, 64 nt, Human
gagaagaguugaggaacuguacagaaaagggcggcuucguuagaccgcucucuuuucuguacuu

SEQ ID NO: 449097 - RNA, 64 nt, Human
cacucagugugcucugcagcugugaggaaacagccuucguuagaggcgggagcagagacgagcc

SEQ ID NO: 449098 - RNA, 64 nt, Human
acuccaguccaggcuggacggcugccugagggcccuucguuaaagacacgcuuguguccugggc

SEQ ID NO: 449099 - RNA, 64 nt, Human
uauccuuagaucuuucuaucgcuaacuuaauucucuucguuauuuaucugacccucuaacucca

SEQ ID NO: 449100 - RNA, 64 nt, Human
agccuguguugcaggguuguauaaaaccaagguacuucguuaguuuugcccauucagccauggu

SEQ ID NO: 449101 - RNA, 64 nt, Human
cucuccccuggcuacugggaggagucacugagagcuucguuaccccugcugccuugcccagggc

SEQ ID NO: 449102 - RNA, 64 nt, Human
gacucccugguauucuuuuuuugauugcauucaacuucguuacuugagcuucagcaacuuaaga

SEQ ID NO: 449103 - RNA, 64 nt, Human
uuuaaguaaaucuuacaguggaguauauuuuuuaaagcacaaaauuggugccaagacuggguga

SEQ ID NO: 449104 - RNA, 64 nt, Human
cgccccucuugccccucagaccuugcauccacagaagcacaacccagccaaacaccacagccuu

SEQ ID NO: 449105 - RNA, 64 nt, Human
cuccacuugaccaagaaaaaagugauucucccagaagcacaaagcauacucuugccccucaggu

SEQ ID NO: 449106 - RNA, 64 nt, Human
gggcaggagggguccucaaggaacaaagaagauaaagcacaaaucgcagaacuugaauccaggc

SEQ ID NO: 449107 - RNA, 64 nt, Human
ucaaacuugcagaucucacaucaaggagagggaaaagcacaaugcaagaaccuaacuaacguga

SEQ ID NO: 449108 - RNA, 64 nt, Human; identical to SEQ ID NO: 189589

SEQ ID NO: 449109 - RNA, 64 nt, Human; identical to SEQ ID NO: 189642

SEQ ID NO: 449110 - RNA, 64 nt, Human; identical to SEQ ID NO: 189606

SEQ ID NO: 449111 - RNA, 64 nt, Human
cacucaucccuccaauucaagccucucaacucaaaagcacaagauccuugcaugcacaccuucc

SEQ ID NO: 449112 - RNA, 64 nt, Human
ccaaacuacgaccucagagcagaguauuaaugaaaagcacaaaaaaaggaacuaaguucagcga

SEQ ID NO: 449113 - RNA, 64 nt, Human
ggugcaggcccaggcccaugaccccaccuuuacuaagcacaaguacuugccacugccaucacug

SEQ ID NO: 449114 - RNA, 64 nt, Human
gaggaaaauggaagaccuaaggcagacaggaaggaagcacaaaagacaagcauugggucagacc

SEQ ID NO: 449115 - RNA, 54 nt, Human
aaauugaaguuaagagcugaucacaagcacaaaucuuucccacuagccauuuaa

SEQ ID NO: 449116 - RNA, 64 nt, Human
auuuguuggaaaaacaugaauucauaaauucaggaagcacaauauauaccaaacauauauuuaa

SEQ ID NO: 449117 - RNA, 64 nt, Human
aacuccagguccuuuauuacugccuucuuuucaaaagcacaacucuccucuaacccuccccucc

SEQ ID NO: 449118 - RNA, 64 nt, Human
gucacucaacagauguuggauuggggaaaauccaaagcacaacuucaaaauaaaauacauuuuu

SEQ ID NO: 449119 - RNA, 64 nt, Human
cuguguggcucauguuuuugcuuuucaacacacaaagcacaaauuuuuuuucgauuaaaaaugu

SEQ ID NO: 449120 - RNA, 64 nt, Human
auuuaggcaaaaccuuaaaucuccaggcuuuuuaaagcacaaaauauaaauaaaagcugggaaa

SEQ ID NO: 449121 - RNA, 64 nt, Human
accuaagguuuugguaaguaccuuaguugaauaaaagcacaagguuaucaccuuuuuuauccgu

SEQ ID NO: 449122 - RNA, 64 nt, Human
ccagcaauuggcugggguccaggaaacaaagcaaaagcacaauaugugaaugugcugauugugu

SEQ ID NO: 449123 - RNA, 64 nt, Human
cuguuuuucucuuaggagauuaaacaaaaacagaaagcacaagacgaacucaguagcagacccc

SEQ ID NO: 449124 - RNA, 64 nt, Human
cucugaaggugaaacugagcagaugaggccacagaagcacaaggggaaggugccgugucaagcc

SEQ ID NO: 449125 - RNA, 64 nt, Human
uuuuguucugugucccuuuuaaaaggcagauuaaaagcacaagcguguuucuagagaacaguug

SEQ ID NO: 449126 - RNA, 64 nt, Human; identical to SEQ ID NO: 188732

SEQ ID NO: 449127 - RNA, 64 nt, Human; identical to SEQ ID NO: 189278

SEQ ID NO: 449128 - RNA, 64 nt, Human; identical to SEQ ID NO: 189756

SEQ ID NO: 449129 - RNA, 64 nt, Human
cuuugagaaaaugcacaaagcccugggagaugacaagcacaaggacugacucaagcugugucuu

SEQ ID NO: 449130 - RNA, 64 nt, Human
ccgucccugcaccagcugagagagacuugccgcaaagcacaaggcuggcagagauuuauguaug

SEQ ID NO: 449131 - RNA, 64 nt, Human
cugcauagcuaauccuguuaaagacaacuucucaaagcacaacgugcuuguuuccuaucgggcu

SEQ ID NO: 449132 - RNA, 64 nt, Human
aguagggcugugaaaaccucaucacuggagguaaaagcacaagcaaugccuguggacaagaugu

SEQ ID NO: 449133 - RNA, 64 nt, Human
agcacaaacaacuuuguugaggauuuuggaaggaaagcacaacuggguccuuuauucauuucug

SEQ ID NO: 449134 - RNA, 64 nt, Human
agccacuggauauuuuauauccucccuuuuccuuaagcacaaugucagaccaaauugcuuguuu

SEQ ID NO: 449135 - RNA, 64 nt, Human
gaaaccaggcaucuggucaaaccagcagaucaaaaagcacaaagagcuggggcagaggcaggaa

SEQ ID NO: 449136 - RNA, 64 nt, Human
gauaaagagagagaaggacuguuaugaaaaacagaagcacaaauuuuggugaauugggauuugc

SEQ ID NO: 449137 - RNA, 61 nt, Human
cgaccaaauuauguaguuaaccauaaaugucaagcacaacccaaaaucuugaaggaguuuu

SEQ ID NO: 449138 - RNA, 64 nt, Human
uaggucagugggcagagaggcagaugugugcaaaaagcacaaccccaaucacacacagaaaccc

SEQ ID NO: 449139 - RNA, 64 nt, Human
uccacaacccuguuuggagcuacugcaggaccagaagcacaaagugcgguuucccaagccuuug

SEQ ID NO: 449140 - RNA, 64 nt, Human
ccuuuaguucuccacuggggaggaauccuggaccaagcacaaaaacuuaacaaaagugauguaa

SEQ ID NO: 449141 - RNA, 64 nt, Human
cauugauguggacuucauagacacaaaggcuucgaagcacaagccaaauaugucaauauuugua

SEQ ID NO: 449142 - RNA, 64 nt, Human
ccaguaaaugauauugcguucgugccucagcuuuaagcacaaguagcagcagcuccugcuugag

SEQ ID NO: 449143 - RNA, 64 nt, Human
gaugaauuuuuuuuuuaauugugaaacaauucauaagcacaauaugauuuacagaauaauaaac

SEQ ID NO: 449144 - RNA, 64 nt, Human; identical to SEQ ID NO: 189763

SEQ ID NO: 449145 - RNA, 64 nt, Human; identical to SEQ ID NO: 189770

SEQ ID NO: 449146 - RNA, 64 nt, Human; identical to SEQ ID NO: 189776

SEQ ID NO: 449147 - RNA, 64 nt, Human
uuugagacaauuaaaauccuucugggggcacuggaagcacaauacggugaccaaucuugcuuuc

SEQ ID NO: 449148 - RNA, 64 nt, Human
gaagcagugucgccgucccucugccuugcacaaaaagcacaagcauuccuuagcagcucaggcg

SEQ ID NO: 449149 - RNA, 64 nt, Human
gccccaaagcccagcccggcugaccaacauucaaaagcacaaacccuggggacucugcuuggcu

SEQ ID NO: 449150 - RNA, 64 nt, Human
cauugauugcaacuacaaagguggacucaaagcaaagcacaaucaugccagccaacauuccaga

SEQ ID NO: 449151 - RNA, 64 nt, Human
guuggucauagucugcacuuugugguggcaauuuaagcacaaagguacucauuuguaaucagau

SEQ ID NO: 449152 - RNA, 64 nt, Human
accaaagcuacaaaccuaaaaugcugcugccccaaagcacaagagggaagagcaccgccggggc

SEQ ID NO: 449153 - RNA, 64 nt, Human
gccacucugaauugcgccuuccgagcacacauaaaagcacaaagacagagacgcagagagagag

SEQ ID NO: 449154 - RNA, 64 nt, Human
ugccugucucguggaggugaucuauuagcuucacaagcacaaaaaaagucagcgucuucauuau

SEQ ID NO: 449155 - RNA, 64 nt, Human
acccuuugucuccaccacacauaguguacuuuggaagcacaacguccaggcugguaccgcagcg

SEQ ID NO: 449156 - RNA, 64 nt, Human
uuaguggucauuuuuuaagugcacaauuaauaagaagcacaacuuguucacaaacucauucaga

SEQ ID NO: 449157 - RNA, 64 nt, Human
gugcagcacugauugaccacaguugccaaucuaaaagcacaaagacagaaguaaagcuuuaugc

SEQ ID NO: 449158 - RNA, 64 nt, Human
uguuucuagucuuucaagcuuagugauaagguggaagcacaagaaaaauuucaguagaauacag

SEQ ID NO: 449159 - RNA, 64 nt, Human
agcuuggaguuuggggaguggggaugaguccgucaagcacaacuguucucugaguggaaccaaa

SEQ ID NO: 449160 - RNA, 64 nt, Human
uuguuaucaccuauguacaauggaaagggauuuuaagcacaaaccugcugcucaucuaacguug

SEQ ID NO: 449161 - RNA, 64 nt, Human
uuguaugcauuuguuaccuuuaaacauuuggaagaagcacaaaaaaauagauuuaguuaaccca

SEQ ID NO: 449162 - RNA, 64 nt, Human; identical to SEQ ID NO: 189783

SEQ ID NO: 449163 - RNA, 64 nt, Human; identical to SEQ ID NO: 189790

SEQ ID NO: 449164 - RNA, 64 nt, Human; identical to SEQ ID NO: 189796

SEQ ID NO: 449165 - RNA, 64 nt, Human
caauguugaaugacaaaaauaaacaguucaagugaagcacaaggauuaaguuggaaaagcugua

SEQ ID NO: 449166 - RNA, 64 nt, Human
ccuuggggucuuucucuagggucucuucucuacaaagcacaacacuaauguucguuuccuuaga

SEQ ID NO: 449167 - RNA, 64 nt, Human
aacauuggaaauucagaaguuaauguuuuuuuguaagcacaaaagaaguauuauagaaauuuau

SEQ ID NO: 449168 - RNA, 64 nt, Human
ccuuuucaaaucaagaaaauaagugcucugucaaaagcacaaaaagaaacuuucaggcacugga

SEQ ID NO: 449169 - RNA, 64 nt, Human
gacuaauuccuguguuuaauagcauuuauacuuuaagcacaacuagaaaauuguaagaauugca

SEQ ID NO: 449170 - RNA, 64 nt, Human
uucccucucaacucaaaaggaccaugaauaaauaaagcacaaaaaccucucuuauucuacaagg

SEQ ID NO: 449171 - RNA, 64 nt, Human
acugaaaaugcaggcauuacaccagcuguuacacaagcacaagcaugcucuguaagagcuuuac

SEQ ID NO: 449172 - RNA, 64 nt, Human
acuggaaaauaucccagguuucuaaauguuauaaaagcacaauagaguuauggaaauguuucca

SEQ ID NO: 449173 - RNA, 64 nt, Human
cacuacuacagaaauucugcaaguuucuguuucaaagcacaauaacuaguaauaccaaagacua

SEQ ID NO: 449174 - RNA, 64 nt, Human
cauauggcucagagcagagccggaucucccaaggaagcacaaauaguuuuugucgcuaacuuag

SEQ ID NO: 449175 - RNA, 64 nt, Human
aggagcuuaagaaagaacauuuugccugauugagaagcacaacugaaaccaguagccgcugggg

SEQ ID NO: 449176 - RNA, 64 nt, Human
cuaaccugacaucaccaaguguggaauuggagaaaagcacaaucaacuuuucugagcuggugua

SEQ ID NO: 449177 - RNA, 64 nt, Human
aagaagaaacuuucucuuguagugccucuugacaaagcacaauuucccgccuuuuuuuuuuuuu

SEQ ID NO: 449178 - RNA, 64 nt, Human
uggaagaaaaauugaguagugguaaguuuuguucaagcacaauguugaauguuaagcuuccugu

SEQ ID NO: 449179 - RNA, 64 nt, Human
gugcuuccagaaagcuuacagauaaauggguuucaagcacaagaauaugacuagauuucagaaa

SEQ ID NO: 449180 - RNA, 64 nt, Human; identical to SEQ ID NO: 189804

SEQ ID NO: 449181 - RNA, 64 nt, Human; identical to SEQ ID NO: 189812

SEQ ID NO: 449182 - RNA, 64 nt, Human; identical to SEQ ID NO: 189817

SEQ ID NO: 449183 - RNA, 64 nt, Human
uggaaauugcccucuuaugacauguugauguuauaagcacaauagauggggcaucuuuggauug

SEQ ID NO: 449184 - RNA, 64 nt, Human
gggaagccagaaagaaaagacggcccagccacagaagcacaauggcccuucgcucucccccagc

SEQ ID NO: 449185 - RNA, 64 nt, Human
uccagacaagcccugcuugcuggaaaacugccacaagcacaauugaucucuuuuuaucgccauu

SEQ ID NO: 449186 - RNA, 64 nt, Human
gcacucacuaaugagaauaauauucgggauuuuaaagcacaacuggaauagcuaauuacagucu

SEQ ID NO: 449187 - RNA, 64 nt, Human
aaaacuguaagacaagccuccuguaugaagccagaagcacaagugccuucagagggcaguugau

SEQ ID NO: 449188 - RNA, 64 nt, Human
uuccaauucggaaaacaauaggggaaagccacaaaagcacaaacaugggucaaaggaaaaucuu

SEQ ID NO: 449189 - RNA, 64 nt, Human
cccaaccccagccgcucggaggccccaaaggaaaaagcacaagaagcgugagacgccaccauuc

SEQ ID NO: 449190 - RNA, 64 nt, Human
gcaauaagaacaaauacaauacauaggaaguuaaaagcacaaaggaaugaacuuauuaauauuu

SEQ ID NO: 449191 - RNA, 64 nt, Human
guuuaaauuuugcacugcaauuuuauuuggugauaagcacaaaucucuacuccucaugacauga

SEQ ID NO: 449192 - RNA, 64 nt, Human
uaguucuuguuaauuuuuauuuguuauacaauggaagcacaauguuauaaggaaagguaauuuu

SEQ ID NO: 449193 - RNA, 64 nt, Human
uuauuuguguuuuucaugguuaaaaaaauaaaagaagcacaaugaccaguacaugaaaucagca

SEQ ID NO: 449194 - RNA, 64 nt, Human
aaaauuggaaaacacuuuuaacugaaaaaaacaaaagcacaacaaaccaaaacaugggaugaag

SEQ ID NO: 449195 - RNA, 64 nt, Human
aauuuauuuaccgaaucauuacauuguuuugacuaagcacaauuagaugacaaguuuuuuuaga

SEQ ID NO: 449196 - RNA, 64 nt, Human
uuuccccacaaagggaauuucucacucugguuggaagcacaaacacugaaaugucuacguuuca

SEQ ID NO: 449197 - RNA, 62 nt, Human
ggcuggcuaaaauugccugagaggcagcucuaaagcacaagaccuggaugugugacacacag

SEQ ID NO: 449198 - RNA, 64 nt, Human; identical to SEQ ID NO: 189825

SEQ ID NO: 449199 - RNA, 64 nt, Human; identical to SEQ ID NO: 189830

SEQ ID NO: 449200 - RNA, 64 nt, Human; identical to SEQ ID NO: 189838

SEQ ID NO: 449201 - RNA, 64 nt, Human
ugugugaguagcuuugauuuaaaaucaaugcaaaaagcacaacuaauaaauugaauguuuccau

SEQ ID NO: 449202 - RNA, 64 nt, Human
uuuaaacuuauaaaucauauugaugaaaagauuuaagcacaaacuuuaggguaaaaauugccau

SEQ ID NO: 449203 - RNA, 64 nt, Human
uaggggagguucagaagacagaguuuuagaagcaaagcacaaaaucucugggaggcauuauaau

SEQ ID NO: 449204 - RNA, 64 nt, Human
uauauauauauauaauucaaagcacaauaauugaaagcacaauaauugacagaaaaauacaggu

SEQ ID NO: 449205 - RNA, 64 nt, Human
acacacacacacauauauauauauauauaauucaaagcacaauaauugaaagcacaauaauuga

SEQ ID NO: 449206 - RNA, 64 nt, Human
aagggaaaggucucaaggaagagucaacuggaacaagcacaagcccaccggacauggccuuggu

SEQ ID NO: 449207 - RNA, 64 nt, Human
cugagaaggacaaccaaagugagcuggaucuuugaagcacaaaugcagcaaauccuucacccug

SEQ ID NO: 449208 - RNA, 64 nt, Human
cucucucucuuuuuuuuuuuuuuuuugguuuuaaaagcacaaucacuaaacuuuauuuguaaac

SEQ ID NO: 449209 - RNA, 64 nt, Human
aagauauaagcagaucacauguaaaucauuccuaaagcacaagaaaagaaugugccuugaugua

SEQ ID NO: 449210 - RNA, 50 nt, Human
ccaggguucagcuggaguaaaagcacaauuuuggcaauuuuaaaggaaga

SEQ ID NO: 449211 - RNA, 64 nt, Human
ugaauuucucuucaaucaaagugccccaaaacagaagcacaaguaaauaaaagaaauuuaaguc

SEQ ID NO: 449212 - RNA, 64 nt, Human
ccugcugccaagagccccgugcauccaggcggccaagcacaaacugggggagaggaggccgcca

SEQ ID NO: 449213 - RNA, 64 nt, Human
ggaggauuuucuuuagaaugcucuuuugcauguaaagcacaaaguauguuucaguuuaaaugca

SEQ ID NO: 449214 - RNA, 64 nt, Human
caaaaagaaaugauggcgacgugggaggccugccaagcacaagcuccccacugcccacacugag

SEQ ID NO: 449215 - RNA, 64 nt, Human
uaguaggaaguuaauaacugguucucuguguuccaagcacaauauuacaacuucuuuugaaccg

SEQ ID NO: 449216 - RNA, 64 nt, Human; identical to SEQ ID NO: 189843

SEQ ID NO: 449217 - RNA, 64 nt, Human; identical to SEQ ID NO: 189848

SEQ ID NO: 449218 - RNA, 64 nt, Human; identical to SEQ ID NO: 189853

SEQ ID NO: 449219 - RNA, 64 nt, Human
ucuuuccuacaacauuuuagcuuuugcccaucuaaagcacaauuaaaauuaggcuacauucuuu

SEQ ID NO: 449220 - RNA, 64 nt, Human
agauacuuuaagagaaauacaaaggaaauuucuaaagcacaagaaauagugagguaguaguuag

SEQ ID NO: 449221 - RNA, 64 nt, Human
cuguggacaaugcccagucucuguucagauccaaaagcacaaaauguuguauauagagucaaag

SEQ ID NO: 449222 - RNA, 64 nt, Human
auggugauuauuuugagguuuucauucucgcauaaagcacaaugcugucuucaucagaaaacag

SEQ ID NO: 449223 - RNA, 64 nt, Human
agacugggcaacauagcaagaccccgucucuacaaagcacaacgaaaaacaacaaauggaguug

SEQ ID NO: 449224 - RNA, 64 nt, Human
gacacgccuuccccucagccacacccaggcacuuaagcacaagcagagugcacagcuguccacu

SEQ ID NO: 449225 - RNA, 64 nt, Human
uguguaauaauguaacaugauuucccuccagagaaagcacaauuuaaaacaauccuuacuaagu

SEQ ID NO: 449226 - RNA, 64 nt, Human
acauugaauuuuacuuuaaaugcauuuuacuacaaagcacaauucauuuguaaugcauauccau

SEQ ID NO: 449227 - RNA, 64 nt, Human
uaaugaaauucuguggaauuaagauggcuguaaaaagcacaaaccuaaaaugcagaaauguauu

SEQ ID NO: 449228 - RNA, 64 nt, Human
cucaguggauuacaguauacuuuuguguguguaaaagcacaaagugcauguguacucacuucug

SEQ ID NO: 449229 - RNA, 64 nt, Human
gaaaccuuugaguuuggucccuaaauuugcaugaaagcacaagguaaauauucauuugcuucag

SEQ ID NO: 449230 - RNA, 64 nt, Human
guaaauggccucuaguagaugauaagccuaaaaaaagcacaauuauuaaaacaaacagauccau

SEQ ID NO: 449231 - RNA, 64 nt, Human
auucuuuaaaucaaaguaaauuagaauuuuuaaaaagcacaaaacugcaggacaguuuaugaaa

SEQ ID NO: 449232 - RNA, 64 nt, Human
uggccuugaggacgauguuuggaaauaugguuggaagcacaauucauucgcuacuaguuauuca

SEQ ID NO: 449233 - RNA, 64 nt, Human
cuaaaaauagguucuaaaguaauguaaaaauauaaagcacaaauauacuugaauauugcuuaaa

SEQ ID NO: 449234 - RNA, 64 nt, Human; identical to SEQ ID NO: 189860

SEQ ID NO: 449235 - RNA, 64 nt, Human; identical to SEQ ID NO: 189867

SEQ ID NO: 449236 - RNA, 64 nt, Human; identical to SEQ ID NO: 189874

SEQ ID NO: 449237 - RNA, 64 nt, Human
uaagugaugugugaccaguggcucccagauucccaagcacaaggaaggaugggcauuuuguggc

SEQ ID NO: 449238 - RNA, 64 nt, Human
auaugcagagggacuuggggcuuugccaaaggguaagcacaaagaaggagucacggguucuguu

SEQ ID NO: 449239 - RNA, 64 nt, Human
uuagagcaaaggaguugaccuucugauugaauauaagcacaaccauauuaaaugaaucaauaca

SEQ ID NO: 449240 - RNA, 64 nt, Human
agccuauggucccggaugacaucuguuuaaaaacaagcacaaccugcaacauacuuugauuacc

SEQ ID NO: 449241 - RNA, 51 nt, Human
uuggccauguggcugcauaaaaagcacaauugcuaggacuucaguuuuuac

SEQ ID NO: 449242 - RNA, 64 nt, Human
cuuugcaagcaguaauuaacacuaguaacagugaaagcacaagauuuccaaaucagucguuuuc

SEQ ID NO: 449243 - RNA, 64 nt, Human
augaacagcuuauguguuagccauagcugaaaauaagcacaaauagcuuauauucagauccuau

SEQ ID NO: 449244 - RNA, 64 nt, Human
uuuuggggucugugagaguacauguauuauauacaagcacaacagggcuugcacuaaagaauug

SEQ ID NO: 449245 - RNA, 64 nt, Human
uaggaagccuuuuauucgugggaacucgaacuugaagcacaaguuccugguuugaauccuggcu

SEQ ID NO: 449246 - RNA, 64 nt, Human
gaguuuagggucauuuuuagaaaggggcaguuuaaagcacaaugucucacaugggacaaaguuc

SEQ ID NO: 449247 - RNA, 64 nt, Human
uaguguaauaucaggccuaaaguuucagaagagcaagcacaaaguaauuuagcuuuccauacau

SEQ ID NO: 449248 - RNA, 64 nt, Human
cuuugaugugcuacaaaccugaaacugguaagacaagcacaaagcaacgugcaauacaaaaauc

SEQ ID NO: 449249 - RNA, 64 nt, Human
ccaaaguucauugguucaguggugugaagaaaggaagcacaauuggcagguuaucacuuuccag

SEQ ID NO: 449250 - RNA, 64 nt, Human
gcugguuugucaaacaacaugugagcauggucacaagcacaaagcucaagaugacagcucuucu

SEQ ID NO: 449251 - RNA, 64 nt, Human
aaacgauacccagccagagucuacucacugucacaagcacaacgaguuuauaugagaaagcacu

SEQ ID NO: 449252 - RNA, 64 nt, Human; identical to SEQ ID NO: 189882

SEQ ID NO: 449253 - RNA, 64 nt, Human; identical to SEQ ID NO: 189890

SEQ ID NO: 449254 - RNA, 64 nt, Human; identical to SEQ ID NO: 189895

SEQ ID NO: 449255 - RNA, 64 nt, Human
gaaugaauacugacaauauuccaugagggugugcaagcacaaauuuuaccaaucugaccucuuu

SEQ ID NO: 449256 - RNA, 64 nt, Human
auugacuccguaugcaugaguauuugugcaacacaagcacaacuaaguauguauauacacauga

SEQ ID NO: 449257 - RNA, 64 nt, Human
uuuacucaugccuuuuuguuuaggauaaauagguaagcacaaagagcucuucaaaaucagaaaa

SEQ ID NO: 449258 - RNA, 64 nt, Human
auaagggcacugagcccuucccaggcuggauacuaagcacaaagcccauagcacugggcucuga

SEQ ID NO: 449259 - RNA, 64 nt, Human
ugaccaaucucuauucagcaucgugugggucccuaagcacaauaaaagacauccacaauggaaa

SEQ ID NO: 449260 - RNA, 64 nt, Human
cauuuuuuaugacagaauuagaaacccauccuucaagcacaauaaucaucacagacuugaguuu

SEQ ID NO: 449261 - RNA, 64 nt, Human
gcauucgggccgguggggcguaaggguuaucguuaagcacaagacacagaauaguuuacacacu

SEQ ID NO: 449262 - RNA, 64 nt, Human
uaucucacugcaucauaucugauugcagaaauuaaagcacaauuuacaagcaauacuguacuug

SEQ ID NO: 449263 - RNA, 64 nt, Human
uuugucauuucauauuggauuuucuauagagaagaagcacaauggggaagauaggagcaagguc

SEQ ID NO: 449264 - RNA, 64 nt, Human
ggcuguuauuagagugccaaugaauaaauaacuuaagcacaaaauacauagaaauuggaaugug

SEQ ID NO: 449265 - RNA, 64 nt, Human
gauuuuuuucucuccacaucaggauaguuuacugaagcacaaucucuuauacuagugggacaaa

SEQ ID NO: 449266 - RNA, 64 nt, Human
uuuuauuuuuauuuuaucuuauuuucauuuucuuaagcacaacugugugagaguguagaaggga

SEQ ID NO: 449267 - RNA, 64 nt, Human
ggaaaguaaagcuacucagagcagcagguuccacaagcacaaacuuuacacauuuguacaauuu

SEQ ID NO: 449268 - RNA, 64 nt, Human
ucauaucaccagacacaccaggcaacagaaguugaagcacaaccacuguagcaaaauaccuuga

SEQ ID NO: 449269 - RNA, 64 nt, Human
ggaccuuggcauguggcuggccacaccaagcaggaagcacaaacucccccaagcugacucaucc

SEQ ID NO: 449270 - RNA, 64 nt, Human; identical to SEQ ID NO: 189900

SEQ ID NO: 449271 - RNA, 64 nt, Human; identical to SEQ ID NO: 189905

SEQ ID NO: 449272 - RNA, 64 nt, Human; identical to SEQ ID NO: 189913

SEQ ID NO: 449273 - RNA, 64 nt, Human
cuguuuuuuuuuuuuuuuuuuuuuuuuuuuuggaaagcacaaacuucuguaacgggucgugcuc

SEQ ID NO: 449274 - RNA, 64 nt, Human
agaaaacuugugugcuuuucaaaaaggcagugcuaagcacaagauuucaagaaagccucuucuu

SEQ ID NO: 449275 - RNA, 64 nt, Human
ggccagucccacuaaggugaccagagugggcuccaagcacaaacugccauuggcuauagauggg

SEQ ID NO: 449276 - RNA, 64 nt, Human
gaggugccagugauggacuggaucagcuugaaagaagcacaaagacuccgugaucacaauaguc

SEQ ID NO: 449277 - RNA, 64 nt, Human
ucauaugguuuaguuuucaaaaaacuucaccaugaagcacaauguauauauuuaugcaguuuuu

SEQ ID NO: 449278 - RNA, 64 nt, Human
aaaccauggcauaaagcugggaggccaaacacccaagcacaaacugucgucuuuuuccaaacaa

SEQ ID NO: 449279 - RNA, 64 nt, Human
ucagcauucugcuuuaaagcucauguuuuauucaaagcacaaggacgguuauaacuccuaagug

SEQ ID NO: 449280 - RNA, 64 nt, Human
uguccuugcuuuggagacuuuaagacauuuccuaaagcacaaauaaaagccucguauuucccca

SEQ ID NO: 449281 - RNA, 64 nt, Human
gaagccuucucugggaagaaagggaauucugacaaagcacaauuccauaugguauguaacuuuu

SEQ ID NO: 449282 - RNA, 64 nt, Human
auuuugaguaauggugaaaauuguugucuuuggaaagcacaaaagaaaccuggaaaggcaguuc

SEQ ID NO: 449283 - RNA, 64 nt, Human
uguggccauauguauaaauauaacagcucugacaaagcacaauauguucaaguggugauuaaac

SEQ ID NO: 449284 - RNA, 64 nt, Human
aaugacagaaccccgguugaaaguccgcuuguaaaagcacaagugagaggcagcaucaggcccc

SEQ ID NO: 449285 - RNA, 64 nt, Human
aauucuuuuuuuaaaaaaacccaaccuccuagagaagcacaacugucaagagucuuguacacac

SEQ ID NO: 449286 - RNA, 64 nt, Human
ccugcucagguauaugcgaucucuaccgagaagcaagcacaaaaguagacaaaaguauuaauga

SEQ ID NO: 449287 - RNA, 64 nt, Human
uccugauaugaccaagaaagcuucuuaucaaaagaagcacaauugccuucgguuaccucauuau

SEQ ID NO: 449288 - RNA, 64 nt, Human; identical to SEQ ID NO: 189918

SEQ ID NO: 449289 - RNA, 64 nt, Human; identical to SEQ ID NO: 189923

SEQ ID NO: 449290 - RNA, 64 nt, Human; identical to SEQ ID NO: 189929

SEQ ID NO: 449291 - RNA, 64 nt, Human
gcaggcuuccagaggacaaaccccaauacaggagaagcacaagacagagaagggccaauggggu

SEQ ID NO: 449292 - RNA, 64 nt, Human
acacacucaugcucacacacacagagauauauuaaagcacaaguuucuaucugaccugccagca

SEQ ID NO: 449293 - RNA, 64 nt, Human
ucauuaagcagaggagcccacuuugaggagagcaaagcacaagcuugccugaagaauggauccc

SEQ ID NO: 449294 - RNA, 64 nt, Human
cugcaaauaccugcauuucuuacccuggugagaaaagcacaagcgguguaggcuccaaugcugc

SEQ ID NO: 449295 - RNA, 64 nt, Human
aacuuauagucuaugccaauuuugaaaaaacuauaagcacaaggaauuaaauacuauugaguau

SEQ ID NO: 449296 - RNA, 64 nt, Human
aagcuggcagcaaagcuucagaaaauauauaugcaagcacaacuugaagcugaauucauuucug

SEQ ID NO: 449297 - RNA, 64 nt, Human
aauugaaacccuccaaaccacgucaucugauuguaagcacaauaugaguugugccccaaugcuc

SEQ ID NO: 449298 - RNA, 64 nt, Human
uguuuaaaacuuuuaagcugugccucacuuauuaaagcacaaaauguuuuaccuacuccuuauu

SEQ ID NO: 449299 - RNA, 64 nt, Human
ugaaucaucaugaaaugaacucuacuucuggccaaagcacaauguauuugcaguuuucucuuuu

SEQ ID NO: 449300 - RNA, 64 nt, Human
ccuuuggggcaugauguuuuaaccuuugcuuuagaagcacaagcuguaaaucuaaaaggcacuu

SEQ ID NO: 449301 - RNA, 64 nt, Human
gugggugcccgccaaacgcccugcgaccgcucagaagcacaaaugcuguccauggccgugaggc

SEQ ID NO: 449302 - RNA, 60 nt, Human
cggaaggugaggaaaauuaaauggcucaacaagcacaauaccuagguuaccacacaccac

SEQ ID NO: 449303 - RNA, 64 nt, Human
cuucaagcagaggccucggggugggggagcuacaaagcacaacaauguacauaguguagaaaca

SEQ ID NO: 449304 - RNA, 64 nt, Human
cgcccccaccccagaccccgagccaccccaggaaaagcacaaggacugccgccuucucgcuccc

SEQ ID NO: 449305 - RNA, 64 nt, Human
aguggcagcccuggggcccuuucccuucuggaggaagcacaagccucagggaaggggaagcagg

SEQ ID NO: 449306 - RNA, 58 nt, Human
aagccauguagaugaaguuagugcaucaacgggauacaguuccauauugccuuaaacc

SEQ ID NO: 449307 - RNA, 58 nt, Human
cuggauuuuagguguugauuucuggaucacgggauaccacuuccuguccacaccccga

SEQ ID NO: 449308 - RNA, 59 nt, Human
auugauuuccguuucuacagaccuggcucaagcacaaaccaauuuguguuguucugauu

SEQ ID NO: 449309 - RNA, 64 nt, Human
uagucuccaccugagacccugggagagaaguuugaagcacaacucccuuaaggucuccaaacca

SEQ ID NO: 449310 - RNA, 64 nt, Human
cuacaaccccagaguuuuaaggacuuggaaaggaaagcacaaucagagaagaaaacagcccccg

SEQ ID NO: 449311 - RNA, 64 nt, Human
ucuugacaucuuacauuccaauacauuaucaagcaagcacaaguaugcugguaguagccucuuu

SEQ ID NO: 449312 - RNA, 64 nt, Human
aggacgaggaggaggacuaagcucaggucgcucuaagcacaaacguggcucuuucuacaaccag

SEQ ID NO: 449313 - RNA, 64 nt, Human
ucauuuccacccacgcucccagccucuuagcugaaagcacaaauggugaaaucaguagucucgc

SEQ ID NO: 449314 - RNA, 64 nt, Human
uugcugagguaggcacaagaaaaagucaggcauaaagcacaaggcagacuguuugaguggauug

SEQ ID NO: 449315 - RNA, 64 nt, Human
ugcaagagcagguaccccccgccgccccccuggaaagcacaagugaugagcaagaaggcauuuu

SEQ ID NO: 449316 - RNA, 64 nt, Human
caccuucacagccaccccagaggacuucccuaaaaagcacaaggcgccugucaucgacauuggc

SEQ ID NO: 449317 - RNA, 64 nt, Human
auuuccaaaaaugaaacccauucaucguaaacaaaagcacaaacacuuguagcaguuuauaaug

SEQ ID NO: 449318 - RNA, 64 nt, Human
cucauuucuaggcagugcuuaugaagaaaaauuaaagcacaaacauucuggcauucaaucguug

SEQ ID NO: 449319 - RNA, 64 nt, Human
gauguaugcgaacauaugugauuuugggguacuaaagcacaaaaaaaucccccauaaaauaaac

SEQ ID NO: 449320 - RNA, 64 nt, Human
gccauuuucuguuuuuaaaucuagaagaucuucuaagcacaaauacagcuacaaugaaauauuu

SEQ ID NO: 449321 - RNA, 64 nt, Human
caauaagaaacaguuuaacagaaaaaugaaauuuaagcacaaaaaauuuaagagauuuuauguu

SEQ ID NO: 449322 - RNA, 64 nt, Human
ggcacauaacaacuuuuuuuuuaauuugggaggcaagcacaaacuaggaagacuagcuuuauua

SEQ ID NO: 449323 - RNA, 58 nt, Human
gagucaccaaggucacagugccacuuucacgggauagcaggcucuugggacuuuuaca

SEQ ID NO: 449324 - RNA, 64 nt, Human
ccgccuguaaucccagcacuuugggaggccgaggcgggcggaugaguugaggucgggaguuuga

SEQ ID NO: 449325 - RNA, 64 nt, Human
aagcccugguccagcugggugcccccucgagcuccgggcggacucgcacacacucgugucaucc

SEQ ID NO: 449326 - RNA, 64 nt, Human
uguuuaauaugaaaacauacaucggauaugugaaaagcacaacaaaauucuuaauguacacagu

SEQ ID NO: 449327 - RNA, 51 nt, Human
guaaugagaccaugccauaauaagcacaaaauuucugacuaucuugcggua

SEQ ID NO: 449328 - RNA, 64 nt, Human
ucucucagcagagaguacccauucuucgaguucaaagcacaauuuuaaacauguaaaauggaua

SEQ ID NO: 449329 - RNA, 64 nt, Human
gagguuggaagauacccuaucuuuuuuauucaaaaagcacaaucaaucuuuuguuugaaaaucu

SEQ ID NO: 449330 - RNA, 64 nt, Human
aucagcagagccacccuagaucagcugaaacucuaagcacaaaaauaaaaacuuaucacuguau

SEQ ID NO: 449331 - RNA, 64 nt, Human
ugauacgugcugcuuguucaucacaaaaaucaguaagcacaauaaaguggaugccaaaccauca

SEQ ID NO: 449332 - RNA, 64 nt, Human
auguauuaacauuccaaugaacuagcauuuaauaaagcacaauuuuggaaacccugguaaauga

SEQ ID NO: 449333 - RNA, 64 nt, Human
agaaauaugggcauuuucauucuuuaaagaaauaaagcacaagaauuuuaucucaaucuuuauu

SEQ ID NO: 449334 - RNA, 64 nt, Human
uuuuccucugaaugaaauuaucacagguugucucaagcacaaccaacugaaugucucuuaacug

SEQ ID NO: 449335 - RNA, 64 nt, Human
aaacauggcuguggagagacaacaaaacaaaacaaagcacaaaagucucugccaacaacucuuu

SEQ ID NO: 449336 - RNA, 64 nt, Human
uuuaacccaaaugaauaacuaagaaauauaaaacaagcacaaaaucuuagggaagucauaaaau

SEQ ID NO: 449337 - RNA, 64 nt, Human
auauacaaaucucccuguaggaaaugugaaagaaaagcacaacaaaacuaggguuuuuuguuca

SEQ ID NO: 449338 - RNA, 64 nt, Human
ucuucacauaacaauuucauccaauucaucuucaaagcacaacucuauuucaugcuuucuguua

SEQ ID NO: 449339 - RNA, 64 nt, Human
auggaguaauauccuucaccuucaguguguaaccaagcacaaaaacaguaucaauguugaaucu

SEQ ID NO: 449340 - RNA, 64 nt, Human
uuaacccuguaagaaaacuuauucuacauucugaaagcacaauuuuccauucaucuuuuuggau

SEQ ID NO: 449341 - RNA, 64 nt, Human
acaccuguaaucccagcacuuuggggagcugaggcgggcggaucacgaggucaagagaucgaga

SEQ ID NO: 449342 - RNA, 64 nt, Human
acgccuguaaucccagcacuuugggaggccgagccgggcggaucaccuguggucaggaguuuga

SEQ ID NO: 449343 - RNA, 64 nt, Human
acgcuuguaaucccagcacuuugggaggccgaggcgggcggaucacgaggucaggaguucgaga

SEQ ID NO: 449344 - RNA, 64 nt, Human
caagauacuauuauuauauuuucacagacuuuugaagcacaaauuuauuggcauuuaauauugg

SEQ ID NO: 449345 - RNA, 64 nt, Human
ucaaaaacugccuuccccagggugucucuaugaaaagcacaaggggccaaggucagggagcaag

SEQ ID NO: 449346 - RNA, 64 nt, Human
guuugagaugcauuugaggauuuuaauuuauggaaagcacaacauaugcaauuauauuuauuga

SEQ ID NO: 449347 - RNA, 60 nt, Human
gccaugcggcgcuccuaugaggccaucgccaagcacaaucaggugagcgaacgauggggc

SEQ ID NO: 449348 - RNA, 64 nt, Human
gucauuggggauuuuuaccucuaauuuggauggaaagcacaagaagccacacauucauuaauau

SEQ ID NO: 449349 - RNA, 64 nt, Human
uuagauaugaacaccuacugugaguucugcuacaaagcacaaaugaauuugucucaacuaugca

SEQ ID NO: 449350 - RNA, 64 nt, Human
ugucugagaguaacacugcauucuuauagaaacaaagcacaaauugcauucaagcucugaauug

SEQ ID NO: 449351 - RNA, 64 nt, Human
cugcaggguaguaacccagugauguuucuuacagaagcacaauauguugaaaauccugggugug

SEQ ID NO: 449352 - RNA, 64 nt, Human
agccuggucucucccaugaagaugucgugugcauaagcacaaucaucacugauuagaagaucac

SEQ ID NO: 449353 - RNA, 64 nt, Human
gcgagugauaccuauuuauaaaauaaaauaaaccaagcacaaguacgaacuuagcaacacuaua

SEQ ID NO: 449354 - RNA, 64 nt, Human
ucuuggcaaugagugagagauguuaauuucacagaagcacaacucccaacccaacccuuaggaa

SEQ ID NO: 449355 - RNA, 64 nt, Human
uuguuaugaaacacgcaagcauaaagcaggacucaagcacaaggcugacuguucuacuuugaau

SEQ ID NO: 449356 - RNA, 64 nt, Human
ccaguaggagagaaguuugcugaggaaugccuucaagcacaaagugaugaaugacugccuucaa

SEQ ID NO: 449357 - RNA, 64 nt, Human
ugaaaaauuggccauggaggcacaccaaagcuucaagcacaagucuuguacaugggccaucacu

SEQ ID NO: 449358 - RNA, 64 nt, Human
aaaauuaucagaaucucaguguuugaaaguacugaagcacaaacauauaucaucucuguaccau

SEQ ID NO: 449359 - RNA, 64 nt, Human
accggccgggccuggcaccaaucugcgcugcggucgggcggagcuucuguuucucccagccaau

SEQ ID NO: 449360 - RNA, 64 nt, Human
ucgccuguaaucccagcacuuugggaggccgaggcgggcggaucagaccauccuggcuaacacg

SEQ ID NO: 449361 - RNA, 64 nt, Human
acgccuauaaucccagcacuuugggaggccgaggcgggcggaucacuaggucaggaaauggaga

SEQ ID NO: 449362 - RNA, 64 nt, Human
cccuuucuuuguggaguuuccuaaccugcugcugaagcacaauguuuuggugcuuucuuuucuc

SEQ ID NO: 449363 - RNA, 64 nt, Human
aggguuuguuuguguuuucaucaaugucuuuguaaagcacaaauuaucugccuuaaaggggcuc

SEQ ID NO: 449364 - RNA, 64 nt, Human
aauuuccuuaaaauuucauagcaauuuaaagcacaagcacaauguucaggcauaaucccuaaua

SEQ ID NO: 449365 - RNA, 64 nt, Human
acaauaaauuuccuuaaaauuucauagcaauuuaaagcacaagcacaauguucaggcauaaucc

SEQ ID NO: 449366 - RNA, 64 nt, Human
uaucuuuagcaguuuguacuauauuauauaugcaaagcacaaaugagugaaucacagcacugag

SEQ ID NO: 449367 - RNA, 64 nt, Human
ucacagccuagaguuaaguaaagucaauucacagaagcacaauuuugcccuuugcgagacauug

SEQ ID NO: 449368 - RNA, 60 nt, Human
ugcaucgggauucagaaugaccaaccuaagaagcacaaauuuaguuuggguguuccucau

SEQ ID NO: 449369 - RNA, 64 nt, Human
ccaggcugggacagcccccuguuccugagauggaaagcacaaauuuaauacaccaccacaaugg

SEQ ID NO: 449370 - RNA, 64 nt, Human
ggacaguaccugauuguauuuuuuuuuuaaauaaaagcacaaguacuuuugaguuuguuauuuu

SEQ ID NO: 449371 - RNA, 64 nt, Human
cuggggguuuggggccggcuucuccccucuugugaagcacaaaguccccuccccaccuacccuu

SEQ ID NO: 449372 - RNA, 64 nt, Human
agcuaaacauuucauuguccccagucugcaaaagaagcacaauucuauugcuuugucuugcuua

SEQ ID NO: 449373 - RNA, 64 nt, Human
uguguagauauaacuuaaauauggagcuuucaaaaagcacaaauaggcuggacaugguggcuca

SEQ ID NO: 449374 - RNA, 64 nt, Human
aagggcaaaauucuagagagugguaaaucucagaaagcacaagcauaaaaugcagcucuggggg

SEQ ID NO: 449375 - RNA, 64 nt, Human
ucuuucugacagauuuuaaaaauugauaugauaaaagcacaacugcuauagauucugcugagac

SEQ ID NO: 449376 - RNA, 64 nt, Human
cacuugaguauuuugucaugguucauuauuauuaaagcacaaaauaaccuauuguuagaaaaua

SEQ ID NO: 449377 - RNA, 63 nt, Human
gcggcgggggcgccccgugacccgagcucggggcgggcggagcccgcguggccgaagcuggaa

SEQ ID NO: 449378 - RNA, 64 nt, Human
acgccuguaaucccagcacuuugggaggccgaagcgggcggaucaccugaggucgggaguucga

SEQ ID NO: 449379 - RNA, 64 nt, Human
acgccuguaaucccagcaauuugggaguccgaggcgggcggaucacucgaggucaggaguucca

SEQ ID NO: 449380 - RNA, 64 nt, Human
gagaccagcccacccaccaccacccaccacagaaaagcacaaaccucugggaaagacaacgucu

SEQ ID NO: 449381 - RNA, 64 nt, Human
accuaaauaaucauugaugaaguaugucaguuacaagcacaaaagaauauaacugcuuuuauaa

SEQ ID NO: 449382 - RNA, 64 nt, Human
gaaaaucagcuuuuuaauguagguuaccacuuauaagcacaaaagaaacauguauaagaaacca

SEQ ID NO: 449383 - RNA, 64 nt, Human
gccacccugcucagagcuuuccacccacagggagaagcacaaucaggaacagugagugcuccuc

SEQ ID NO: 449384 - RNA, 64 nt, Human
aaaaggcaguuaugaagccaauucauuuugaaggaagcacaauuuccaccuuauuuuuugaacu

SEQ ID NO: 449385 - RNA, 64 nt, Human
uuguacaucuuucaauucuggaauaucugugucuaagcacaauaucuucacacugugcuguauu

SEQ ID NO: 449386 - RNA, 64 nt, Human
aaggugcauuucaagaacuuggggggcaggaggaaagcacaauguuucuuagccaggaaagaca

SEQ ID NO: 449387 - RNA, 64 nt, Human
uucugauuuuuuaacuaaauuuucauuagaaagcaagcacaaaauaaaaucaaaacaaccuuua

SEQ ID NO: 449388 - RNA, 64 nt, Human
ugauuucuggaacugccauuccaaagaagaauaaaagcacaacucaagugaaauugaaguaguc

SEQ ID NO: 449389 - RNA, 64 nt, Human
uuucuaaaguuugauguguucucaagccugacagaagcacaaggaacaguuugauacacuuuua

SEQ ID NO: 449390 - RNA, 64 nt, Human
accugcaaaugucuacauauaugaagcuuuuaaaaagcacaaguuaucaggcaacaucauuaaa

SEQ ID NO: 449391 - RNA, 64 nt, Human
cccucagcuuccuaucgauuuaguuaccucuugaaagcacaaaaauuaaaacauugccauaugu

SEQ ID NO: 449392 - RNA, 64 nt, Human
cccacuucugcugaaaugcauugggagccugugaaagcacaaagcuggaggcugggcgccugcg

SEQ ID NO: 449393 - RNA, 64 nt, Human
cuccacuuuugugcauuuaucuuuguuaggaucaaagcacaagcucaccaucaaugagccugga

SEQ ID NO: 449394 - RNA, 64 nt, Human
auguucucuuuacugaaaagacaguggcaaggaaaagcacaagugcaugaguucuuuacuggau

SEQ ID NO: 449395 - RNA, 62 nt, Human
gccuucuuuugggauuugcauuguaauugagggcccuggaagaucucugagacucaaaauca

SEQ ID NO: 449396 - RNA, 62 nt, Human
ucagaauaggcgagguaaccuugaauuucagggcccuggaaacucuagcugaaaccugccuu

SEQ ID NO: 449397 - RNA, 62 nt, Human
aaccucuggaaugaccuuccucauuccaggaggcccuggaauaaggaagaggcuucuuucug

SEQ ID NO: 449398 - RNA, 64 nt, Human
gggaacauuacuucugcuuuuaggaaguuacugcaagcacaagcauuugugcuuuuaagcaaau

SEQ ID NO: 449399 - RNA, 64 nt, Human
gaaauuugggacuuuuucauguugaaaggagaaaaagcacaaguucccuaguuaccauuuaaua

SEQ ID NO: 449400 - RNA, 64 nt, Human
ucaaugaaggugcugaccagcucaauacaaaguuaagcacaagaucuaaagcucuugaaaaugc

SEQ ID NO: 449401 - RNA, 64 nt, Human
ugccaggaaguauuuccauaguugcugagaaucaaagcacaaaagaaaucccuaccuauguaaa

SEQ ID NO: 449402 - RNA, 64 nt, Human
auguaugguguaaaacacacaaacacacacaaaaaagcacaagcccgcugcaugacccgucucu

SEQ ID NO: 449403 - RNA, 64 nt, Human
gagacggagaccccgguggcaguggaaaaaucagaagcacaaaggaaaacucuuggccucugcu

SEQ ID NO: 449404 - RNA, 64 nt, Human
ugcugggauagccauuuccauggcucuguuaugcaagcacaaauuucaucuccuagauggacuu

SEQ ID NO: 449405 - RNA, 64 nt, Human
uuacacacacugccagagauacucuaggcauguaaagcacaaacauacauauaaaaucugcggg

SEQ ID NO: 449406 - RNA, 64 nt, Human
ugcagccaggagggcucuugggauuuccuuuccaaagcacaaaaauacugggacccaagaagaa

SEQ ID NO: 449407 - RNA, 64 nt, Human
uuaaauccuuaaaugaauugcuuucucccaaaaaaagcacaauauaaagaaacacaagauuuaa

SEQ ID NO: 449408 - RNA, 64 nt, Human
auucauaugagcuaaaacucaucacuauuuacuaaagcacaacaucucauccuacaaaaguuaa

SEQ ID NO: 449409 - RNA, 64 nt, Human
agauggugccuucucgcuguauccucaaugguagaagcacaaacaagcaagcuccuuccugccu

SEQ ID NO: 449410 - RNA, 64 nt, Human
cccuaacccuugccugaccaugugagguuaucugaagcacaaggcccacccucaccuaucuguc

SEQ ID NO: 449411 - RNA, 64 nt, Human
uuucucccauccuuucccuuuaacccucaguaucaagcacaaaaauugauggacugauaaaaga

SEQ ID NO: 449412 - RNA, 64 nt, Human
aaacuuugacuugaaauguuugcagaucaacuauaagcacaaagaagagauaacuuccaaaaga

SEQ ID NO: 449413 - RNA, 62 nt, Human
caggcacccucuggcacuguugcuugcccugugcccuggaccuuuuccugcccuucuccuuc

SEQ ID NO: 449414 - RNA, 62 nt, Human
agaccuccguugaacauucuguauggaaaagagcccuggagcaucagguuccccagauaggc

SEQ ID NO: 449415 - RNA, 62 nt, Human
gccuaaaugagaggcauucugacugguuggcugcccuggaaggcaagaaaauagauuuauuu

SEQ ID NO: 449416 - RNA, 64 nt, Human
agaauggcuugucccaucagcagaugaauguguuaagcacaaagcaucuuccuuaaagcacaaa

SEQ ID NO: 449417 - RNA, 64 nt, Human
agaugaauguguuaagcacaaagcaucuuccuuaaagcacaaagagagggacuaacugaugcug

SEQ ID NO: 449418 - RNA, 64 nt, Human
acagaaaccaaccccugacccagcgguaccggccaagcacaaacguccuuuuugcugcacacgu

SEQ ID NO: 449419 - RNA, 64 nt, Human
gggcacuagaucccuggaguucaggaaccaacacaagcacaaccacgggcauaaguuggccuug

SEQ ID NO: 449420 - RNA, 64 nt, Human
ggagaggaggaagauggugacaugauuugguuagaagcacaagcaaacugaucagccucccaga

SEQ ID NO: 449421 - RNA, 64 nt, Human
ugugcaucaauuuaaaucauauauccuaaacuaaaagcacaauucauacuucgggaauauuuua

SEQ ID NO: 449422 - RNA, 64 nt, Human
ccauaagaagcaaauuuauaccuauuuguguauuaagcacaagauaaagaacagcuguuaauau

SEQ ID NO: 449423 - RNA, 64 nt, Human
aaaugcuaaguguguguuuugcagucaugaacuaaagcacaaaaagaugcaugagacauuguag

SEQ ID NO: 449424 - RNA, 64 nt, Human
acugcaaguuuaaauaguuguacagauaguuuauaagcacaauauuuuaagaaaaaaaaguggc

SEQ ID NO: 449425 - RNA, 64 nt, Human
agguggccaagcagaugucacauggaguuagucaaagcacaaagucacgauuccacaauggagg

SEQ ID NO: 449426 - RNA, 64 nt, Human
ugccugucucguggagaugaucuauuagcuucacaagcacaacaaaagucagugucuucauuau

SEQ ID NO: 449427 - RNA, 64 nt, Human
accugaagcaacucugcucuuccugucagucucaaagcacaaggagguucagcccaggaggaag

SEQ ID NO: 449428 - RNA, 64 nt, Human
gaaguuaacaaaguaugccccauuccugugacaaaagcacaaccauucugaaguuacuggagca

SEQ ID NO: 449429 - RNA, 64 nt, Human
cugagaccugcuacagaucaaagacuccuccaaaaagcacaagcccagaacaugggucaccaau

SEQ ID NO: 449430 - RNA, 64 nt, Human
uuaugacuuugggccaagaauuaaguauuuuccuaagcacaaaucuuuuucuauauucucauuu

SEQ ID NO: 449431 - RNA, 62 nt, Human
cagagcagucaggagaaaugguggagccuggggcccuggaauggcugacccugugccuagag

SEQ ID NO: 449432 - RNA, 62 nt, Human
acucgggaggcugaggcacgagaaucgcuugagcccuggaguuggagguugcagugagcaga

SEQ ID NO: 449433 - RNA, 62 nt, Human
cuaauggggugccaucaauaagcugcgauacagcccuggagcucagucagccacaccuuccu

SEQ ID NO: 449434 - RNA, 64 nt, Human
cuggcuaacccaugggauuuagcuuauaagaacaaagcacaauuauucaggacugaacugcuuu

SEQ ID NO: 449435 - RNA, 64 nt, Human
uaguggugauccggcucauucuccugcaaguuggaagcacaauuuuccccccaaguggaggaaa

SEQ ID NO: 449436 - RNA, 64 nt, Human
uuuaguuguuuuguuuuuaagugacugugguuuaaagcacaaaugccccaagguggggagacuu

SEQ ID NO: 449437 - RNA, 64 nt, Human
uggugucuguacuguguacacacaucccucugagaagcacaaggagacgacacgcgcauuguaa

SEQ ID NO: 449438 - RNA, 64 nt, Human
aauauguguuacaccuaggaugggcauuaugcaaaagcacaaagauuauauaugacaaucagua

SEQ ID NO: 449439 - RNA, 64 nt, Human
auuccagaacaaauccaagaggccaguccuccauaagcacaaauggaauugugcaaccaccaga

SEQ ID NO: 449440 - RNA, 64 nt, Human
aucuuuucuuguaagaaauguaucuuuuaaauguaagcacaaaauaguacuuuguggaucauuu

SEQ ID NO: 449441 - RNA, 64 nt, Human
ugaaugcauuuuaaguuuaauucuucauagcugaaagcacaaauuuaacggcuucacuggacag

SEQ ID NO: 449442 - RNA, 64 nt, Human
uuuaucuaugaucucuugcuguuucaucaggggaaagcacaaagcuauuucugaaauuaggaaa

SEQ ID NO: 449443 - RNA, 64 nt, Human
ccaggauggucagugaaguuaccaggaauguuuaaagcacaaaggacuuugggugugugugcau

SEQ ID NO: 449444 - RNA, 64 nt, Human
accgagagaagaagagaaagaaaagaaaaagaaaaagcacaaaaaaagaucucgaacaagauca

SEQ ID NO: 449445 - RNA, 64 nt, Human
agcaaagccaaaucaagaccacagauaggaaccuaagcacaauggggugccugcuugggcuggg

SEQ ID NO: 449446 - RNA, 64 nt, Human
gcuuauuauguauacuguguucuuauauaugagaaagcacaaaugcgaaagaggucaugucuuc

SEQ ID NO: 449447 - RNA, 64 nt, Human
uuggacuauuguauauaauguauuguaauauuugaagcacaaauguaauacaguuuuauugugu

SEQ ID NO: 449448 - RNA, 64 nt, Human
aauuuauaacaccugcuuuagccuuuguuuucaaaagcacaaaggaaaagugaaagggaaagag

SEQ ID NO: 449449 - RNA, 62 nt, Human
gcaguagggcacagagggaagaggaggguggggcccuggaugacuuuccagccucuucaacu

SEQ ID NO: 449450 - RNA, 62 nt, Human
ggccucaagccugcagccacuggcuugauugggcccuggacguugagcccagauguuggagc

SEQ ID NO: 449451 - RNA, 62 nt, Human
ccaacgcagcacuagcaagcagguucgggacagcccuggacgauuucccgaccgcugcucag

SEQ ID NO: 449452 - RNA, 64 nt, Human
gcugucacagggcaauuucuuuauuuauaacaugaagcacaauggauuuacagcucuaggaacu

SEQ ID NO: 449453 - RNA, 64 nt, Human
agaaacagcuaauuuccaauguauuguugggaaaaagcacaaacuguguuuuuaacucaaauau

SEQ ID NO: 449454 - RNA, 64 nt, Human
guguugugaacccccacccaggcaguauccaugaaagcacaagugacuaguccuaugauguaca

SEQ ID NO: 449455 - RNA, 64 nt, Human
cugcuuagggucccugguuccaguuauuuucagaaagcacaaagagauucaauuucccuggagg

SEQ ID NO: 449456 - RNA, 64 nt, Human
cuuccucuuccccgacccacauuucaagcggacaaagcacaaguggcgaaucaucagucccacc

SEQ ID NO: 449457 - RNA, 64 nt, Human
aacuuaugucaucuauguugaauguaagcuuauaaagcacaaagcauacauuuccugacugguc

SEQ ID NO: 449458 - RNA, 64 nt, Human
agcaaccuguggccugcacuuguggccucgaaggaagcacaaacccuccauccacuucccauuu

SEQ ID NO: 449459 - RNA, 64 nt, Human
ccucuaccuuacgagagagcuaugcuccuccucaaagcacaaucauccugugacagaaguugcu

SEQ ID NO: 449460 - RNA, 64 nt, Human
agcugcauauugcauuguuagccacucuuggaaaaagcacaaccuaacaaacauguuuacuaua

SEQ ID NO: 449461 - RNA, 64 nt, Human
agugcugaccuuguaauguaugaguucacggaagaagcacaaccgaacgucuuguucagugaca

SEQ ID NO: 449462 - RNA, 64 nt, Human
uggguaagucccuaaauuacaaaugagaaaauugaagcacaaggaaaaaaauaacuaguuugaa

SEQ ID NO: 449463 - RNA, 64 nt, Human
uugaagcugaacaguagcaaaucagauuuuccagaagcacaaacuuuguagaauacaguuuagu

SEQ ID NO: 449464 - RNA, 64 nt, Human
cuguccugcaggucuaaaauuugaauggaaauucaagcacaaguacuggggacacaucaaagug

SEQ ID NO: 449465 - RNA, 64 nt, Human
gaaugucagagauguacucagaggguuaacagacaagcacaaggcaugcugacuacauuggugu

SEQ ID NO: 449466 - RNA, 64 nt, Human
auuuuacauugcuagauguacaaacuuuauacagaagcacaaccuuaucauuuuuaaauaaaaa

SEQ ID NO: 449467 - RNA, 51 nt, Human; identical to SEQ ID NO: 372025

SEQ ID NO: 449468 - RNA, 62 nt, Human
augggccaucuggaccaaaggugggguguggggcccuggauggcagcucuggcccagacaug

SEQ ID NO: 449469 - RNA, 62 nt, Human
uccccagggagggcucgaaggaagugcagggagcccuggacaccacugagucugcaugaaau

SEQ ID NO: 449470 - RNA, 64 nt, Human
cuauugcucuuacuugaaaacuuuuuuucaaaaaaagcacaaauuaaaguaguaaauucauauc

SEQ ID NO: 449471 - RNA, 64 nt, Human
cuuuugacguaucaguacuucuaagaagggaucuaagcacaauuaagugaauugagucccuggu

SEQ ID NO: 449472 - RNA, 64 nt, Human
uucacaucuucaacgccaucagugggacuccaacaagcacaaugguucacgggaugaccagcuc

SEQ ID NO: 449473 - RNA, 64 nt, Human
aagcccaagagaacaacauaaagcaaacaacauaaagcacaauaaaaaugcaaauaaauauuuc

SEQ ID NO: 449474 - RNA, 64 nt, Human
auguguaacuugugaugccuuagaaaaauauccuaagcacaaaauaaaccuuucuaaccacuuc

SEQ ID NO: 449475 - RNA, 64 nt, Human
ucauuuucuuuccccgaacgccaugacuguucagaagcacaauacuaucuccugaaagagauaa

SEQ ID NO: 449476 - RNA, 64 nt, Human
acaaaccauuuaugguuuaugauuucuaaaaagaaagcacaauuaauuuuauagagagguuuuu

SEQ ID NO: 449477 - RNA, 64 nt, Human
gcacagucccugcuuuugacuggguuccuauuuuaagcacaaaugagagcucuggagccagaau

SEQ ID NO: 449478 - RNA, 64 nt, Human
auguuuauugucuuguauccuuucucuggaguguaagcacaaugaagacaggaauuuuguauau

SEQ ID NO: 449479 - RNA, 64 nt, Human
uauuaaauuauagcauuugcaaauauuaauauaaaagcacaacaaaauguaguggaaaaugaca

SEQ ID NO: 449480 - RNA, 64 nt, Human
aagaaaaaaaaaagagcuauagaaauccuugucaaagcacaaagucauggcugguuuuguuuca

SEQ ID NO: 449481 - RNA, 64 nt, Human
ugaaucuaucacugagaaguuuuacuacucauugaagcacaaaaauauccgcuacacagguuca

SEQ ID NO: 449482 - RNA, 64 nt, Human
ggaauaaaccuguuuuccaggugucucuucucccaagcacaagaaguccuggagucuuuggaag

SEQ ID NO: 449483 - RNA, 64 nt, Human
augucuuguuuuguugcgacauaggaaaauaaccaagcacaaaguuauauuccauccuuuuuac

SEQ ID NO: 449484 - RNA, 64 nt, Human
ccccucggccuccaggaagccaccguggccggccaagcacaagcucacccacuuuggagcagca

SEQ ID NO: 449485 - RNA, 62 nt, Human
ucucaccccugaaaacaucagaugcagaaaaagcccuggacuuggagcugggaagccugggu

SEQ ID NO: 449486 - RNA, 62 nt, Human
uggggagaaaacauccuccucugauggccaaagcccuggaaucaaggguuuccacguacccu

SEQ ID NO: 449487 - RNA, 62 nt, Human
ucauuuggggugcccuuucacucccaggccaagcccuggagcaaucuucuucaggcagcugu

SEQ ID NO: 449488 - RNA, 64 nt, Human
gggaacaacaacagcaaauuagacaaaacccagaaagcacaaagcaugagguggaguuacugug

SEQ ID NO: 449489 - RNA, 64 nt, Human
ucuuauccccuccuccaagagcaguagagaauuuaagcacaagccuauuugugaaagaauauuu

SEQ ID NO: 449490 - RNA, 64 nt, Human
gaaaaauacauuaggaaaauguguuuagaaauaaaagcacaaggcagggcagugcucacgccug

SEQ ID NO: 449491 - RNA, 64 nt, Human
uacauacaguacuuguaaaguguuagcuguaaguaagcacaaaauacauuuaaaauacaaagac

SEQ ID NO: 449492 - RNA, 64 nt, Human
gcacuucccaaaccgcagacuacaucuuuagaggaagcacaacugugccuuuuucugaaaaucc

SEQ ID NO: 449493 - RNA, 64 nt, Human
auuucaagugaagugugcugaugaaguccucuauaagcacaagccaaaaagagaaagagaaaaa

SEQ ID NO: 449494 - RNA, 64 nt, Human
cacaaucaguguucaggcuucaguuauauaauguaagcacaacuaaaaugaaacuuguugacug

SEQ ID NO: 449495 - RNA, 64 nt, Human
auccagcgcacagaagcaagugcaaaaaugacacaagcacaacucuccagacguggcuccuucu

SEQ ID NO: 449496 - RNA, 64 nt, Human
aguccuuuguaaagcuguacagacuuugcaguuuaagcacaaugugcacauguuaguuuuauau

SEQ ID NO: 449497 - RNA, 64 nt, Human
gcccaagcagaagcacaggcccaguccuggcugcaagcacaauagccugaaugggauuucaggu

SEQ ID NO: 449498 - RNA, 64 nt, Human
uuuuuaaggccauauugcauugauaacaagcuaaaagcacaacuaaaauuucacaugcuaacga

SEQ ID NO: 449499 - RNA, 64 nt, Human
cuaccucaugugguugguugaugauugucugucaaagcacaaacucugaaauuauuaaaaacau

SEQ ID NO: 449500 - RNA, 64 nt, Human
cacauacuuaaaaaguagauaaugugccaaccagaagcacaagaguuccuacacaaaacucugu

SEQ ID NO: 449501 - RNA, 64 nt, Human
augcuuugaaaucucuggaugaaaggugcuuuggaagcacaaaccauuaucacuugucucauag

SEQ ID NO: 449502 - RNA, 64 nt, Human
gcuggugccagcaggggacacagacugcaaagagaagcacaaaguuugagccuugauuccugga

SEQ ID NO: 449503 - RNA, 62 nt, Human
gugccuuugacugucuucuauccauuaguucugcccuggagcacacuggggaagcaggcugc

SEQ ID NO: 449504 - RNA, 62 nt, Human
guccugccuuucagauccuuucuacugggugagcccuggagugcugguucuccucgcggugc

SEQ ID NO: 449505 - RNA, 62 nt, Human; identical to SEQ ID NO: 372079

SEQ ID NO: 449506 - RNA, 64 nt, Human
guacagccuccggaagcagcccuacaacaaccugaagcacaaguucccauggcugucggaggcc

SEQ ID NO: 449507 - RNA, 64 nt, Human
ggcgcggcgcgagcggccgggcagggcccugcagaagcacaacuccggccccuggacccgggcc

SEQ ID NO: 449508 - RNA, 64 nt, Human
gaaucuguuucccuaagugacuuaaccuuagagcaagcacaacauccagguuaauuuuuuguaa

SEQ ID NO: 449509 - RNA, 64 nt, Human
agcucccaugccucagcuuuguaccuguuuucaaaagcacaacugaggugugcgggcuggagcu

SEQ ID NO: 449510 - RNA, 64 nt, Human
gccuggccaccuagcgccuucccacuccuuaagcaagcacaaagaagaugaggcagagaauugu

SEQ ID NO: 449511 - RNA, 64 nt, Human
cagcgguuuccacuugugggcuucagguguuuucaagcacaacccaccacaacaagcaagugca

SEQ ID NO: 449512 - RNA, 64 nt, Human
ggcuauauauacuggaaguugaagguuaaaggaaaagcacaagaaacuuuggaagcacuuuuuc

SEQ ID NO: 449513 - RNA, 64 nt, Human
aggucuuugccauaacuuuaugaagugcuacagaaagcacaaagaauugauucauguucaucaa

SEQ ID NO: 449514 - RNA, 64 nt, Human
cuucuccccuaccuguuauauuuaaaacaaagaaaagcacaacuugagauuuuuguuguuacgg

SEQ ID NO: 449515 - RNA, 64 nt, Human
auggugaauuguuguucuuauagucuguuucaugaagcacaaguggaauuuaauacauaaaaga

SEQ ID NO: 449516 - RNA, 64 nt, Human
uggcgcuggugcauucuguuuccucuugaucucaaagcacaauguggauuuggggaccaaaggu

SEQ ID NO: 449517 - RNA, 64 nt, Human
uuaugaagauauucagauacucuucuaugccaggaagcacaaagacuuuguugagauuugccuc

SEQ ID NO: 449518 - RNA, 64 nt, Human
gaggccgaggcaggggcugggcagaggggagaggaagcacaagaagugggagugggagaggaag

SEQ ID NO: 449519 - RNA, 64 nt, Human
gagcuaacuugggugagacguucacuaaaguaccaagcacaauacaaaugcaucuucgaguucu

SEQ ID NO: 449520 - RNA, 64 nt, Human
aggccucagaaagaagucaguuaacgucacccaaaagcacaaaauggauuuuagucaaauauuu

SEQ ID NO: 449521 - RNA, 62 nt, Human
gccucgccguuccaccagaagcucagcuccaggcccuggaggggcugcugcuccucaguugc

SEQ ID NO: 449522 - RNA, 62 nt, Human
cuuaggugacaggaacuuccgcaccuccugaggcccuggaugauucuaauuguuagaaauuc

SEQ ID NO: 449523 - RNA, 62 nt, Human
cucccucccuggacccaccgaugccucucgaagcccuggagacagccguugggugagggugg

SEQ ID NO: 449524 - RNA, 64 nt, Human
augggucaagcaagcggccacaagggacugaggcaagcacaaugguuucaaagaaagacuguaa

SEQ ID NO: 449525 - RNA, 64 nt, Human
acagcccagggacuuaauguggccaucgggcaucaagcacaaggccaugcaggugaugauacgu

SEQ ID NO: 449526 - RNA, 64 nt, Human
ccagaauggcauuauauuuaaauaguucauaaagaagcacaaaagaauauuauuucauaacaug

SEQ ID NO: 449527 - RNA, 64 nt, Human
aauucacagaauagcacaaacuacaauuaaaacuaagcacaaagccauucuaagucauugggga

SEQ ID NO: 449528 - RNA, 64 nt, Human
gaccugcacaucugcagugagggcagaauucaacaagcacaacucacuggucuuucagucaacg

SEQ ID NO: 449529 - RNA, 64 nt, Human
gcugaagugcaaaacauagaugaccauuuuuaauaagcacaaucaaauuuuuaaccacagaaug

SEQ ID NO: 449530 - RNA, 64 nt, Human
ggucaccuggucaggacagagcaacugcaucuaaaagcacaagaagacagaaaccuguaagcuc

SEQ ID NO: 449531 - RNA, 64 nt, Human
gagauggggcuucaaccagggacauccaaaccggaagcacaaauccaggaggcucucauauccu

SEQ ID NO: 449532 - RNA, 64 nt, Human
aguucccaaucucguccucuguccccaacuucuuaagcacaauugggcuucuuccaucuccagg

SEQ ID NO: 449533 - RNA, 64 nt, Human
ggaggacauuacugguuguucuggcugguuugaaaagcacaaauaaacuugggaugugguuccu

SEQ ID NO: 449534 - RNA, 64 nt, Human
uccucuguccccggguuucagagacaacuucccaaagcacaaagcaguuuuucccccuaggggu

SEQ ID NO: 449535 - RNA, 64 nt, Human
uaauaaaacaugcaucauuuuucauuugccaaccaagcacaaaguuauuuuauacugacuguau

SEQ ID NO: 449536 - RNA, 64 nt, Human
aagcuaaauguaguuauuuuauccuguggcccugaagcacaaaauaaaaauucuaauuaaaaua

SEQ ID NO: 449537 - RNA, 64 nt, Human
cuugccugcagccuuugcgaccagagcccuuuucaagcacaauuaauaugggaguugcuaaauu

SEQ ID NO: 449538 - RNA, 64 nt, Human
gacgcaggccccucuccuccguggcacauggcacaagcacaagaagccaaccaggagagagucc

SEQ ID NO: 449539 - RNA, 62 nt, Human
agaagcugcuucugcccacaccgcagggacaagcccuggagaaaugggagcuuggggagagg

SEQ ID NO: 449540 - RNA, 62 nt, Human
aaagugcuuuaaaaaccagccuggcgaggacagcccuggacccacuccacugucucuaagua

SEQ ID NO: 449541 - RNA, 61 nt, Human; identical to SEQ ID NO: 372122

SEQ ID NO: 449542 - RNA, 64 nt, Human
ucccucucuuccccacccuucucucuucccugcaaagcacaaccuguaccccaggggcgccggg

SEQ ID NO: 449543 - RNA, 64 nt, Human
ggagggggcaagugacugaagagcaccggguaaaaagcacaacaugcaguuaaaaugcaacuag

SEQ ID NO: 449544 - RNA, 64 nt, Human
uuccugggaacgcucuuguugcuuggugcaacagaagcacaaaaaucaauaaacacugugauug

SEQ ID NO: 449545 - RNA, 64 nt, Human
ugaauaaugaggaucaacuguaccauauuuaauaaagcacaaaacccacacagauugucuuauu

SEQ ID NO: 449546 - RNA, 64 nt, Human
auggcuugaccugcagaagauacccaagguccaaaagcacaaggucugcggaaaguucugguug

SEQ ID NO: 449547 - RNA, 64 nt, Human
aucuguguucagguccaggguuacauaauugcagaagcacaagccauacaucgcagguaggaaa

SEQ ID NO: 449548 - RNA, 64 nt, Human
guaauuaauucaaguccuuauuauagacuauuugaagcacaaccuaauggaaaauuguagagac

SEQ ID NO: 449549 - RNA, 64 nt, Human
aaggguucacuucuagagcugagaagcagggucaaagcacaauacugggcaauucagagcaugg

SEQ ID NO: 449550 - RNA, 64 nt, Human
caaagucacacuagaccacagugacgaucucuguaagcacaaagggacuccgaugugggugggg

SEQ ID NO: 449551 - RNA, 64 nt, Human
cggccugagugggggauauugacacccccagcuaaagcacaagcaccuuagucaccccuccucu

SEQ ID NO: 449552 - RNA, 64 nt, Human
ccuggccugccaccccaccccagcguuuaccccaaagcacaaugcccuggucacuuggcaagcg

SEQ ID NO: 449553 - RNA, 64 nt, Human
cucacucuucuuuuuuaacuguuaaaccaaaggaaagcacaaaugaaggaaauccuguguaaag

SEQ ID NO: 449554 - RNA, 64 nt, Human
gaagggaauuucugcugaagaaccagaaaaaagaaagcacaacaccuuucccaugccuccucug

SEQ ID NO: 449555 - RNA, 64 nt, Human
uggcugaacucugggagugugucccagcugagggaagcacaaguagcaaagcucauuggucugg

SEQ ID NO: 449556 - RNA, 64 nt, Human
cuugggugccuaugccaccaaggcccuggguuucaagcacaaaacugggcggccauucgggcag

SEQ ID NO: 449557 - RNA, 62 nt, Human
gccucaccuccagcugucagagggugagcagggcccuggaggcaggcacccccuccuccucc

SEQ ID NO: 449558 - RNA, 62 nt, Human
auuugggaggcugaggcaggaggauugcuuuagcccuggaggucgaggcugcaguaagccau

SEQ ID NO: 449559 - RNA, 62 nt, Human
caguggcacagagagguaacuacggagcccaugcccuggaggaacucuguagcugugcauca

SEQ ID NO: 449560 - RNA, 64 nt, Human
gcuggcagcuuccugcugcucccugucagagucaaagcacaaauccucaggacgggcucaaggg

SEQ ID NO: 449561 - RNA, 64 nt, Human
cucacacgggaccacagccgcgcugccgagggccaagcacaaagguuccagugagcgcaugucc

SEQ ID NO: 449562 - RNA, 64 nt, Human
acccgcggaguggggggcccccuccgccacaaggaagcacaaccagcucgcccucccccuaccc

SEQ ID NO: 449563 - RNA, 64 nt, Human
ccaaugacccccucccuuggggcgacuccugaugaagcacaacuccccgcagggcccccagccc

SEQ ID NO: 449564 - RNA, 64 nt, Human
acggccagcuguggcccauaucuuggucacucugaagcacaauauuuaugaagcuauagaacgu

SEQ ID NO: 449565 - RNA, 64 nt, Human
gaccgcuccccaauacucuccuaaaauaaacaugaagcacaaaaacauuaugccagauccuugg

SEQ ID NO: 449566 - RNA, 64 nt, Human
acaccuuguaauucauaguggagagaaaccuuacaagcacaaugaaugugacaugguuuuuaau

SEQ ID NO: 449567 - RNA, 64 nt, Human
cuuuagaaaucccauccugccuugugauauuuagaagcacaaguacguuaaacaagugcuaaac

SEQ ID NO: 449568 - RNA, 64 nt, Human
ucugggaauuggcucaucauaaauuauccaagagaagcacaaaguuaugggcacaaagguuuuc

SEQ ID NO: 449569 - RNA, 64 nt, Human
ccauuccagguagcucggcaccaacuaagaaaaaaagcacaaaguucucagagcucucgaggaa

SEQ ID NO: 449570 - RNA, 64 nt, Human
aaauuagcugggcaucccagcuaugcagaagcugaagcacaagaauugcuugaacccuggaggu

SEQ ID NO: 449571 - RNA, 64 nt, Human
ugcugucagggagaggauggcagauggaggcaucaagcacaaggaaaaugcacaaccugugccc

SEQ ID NO: 449572 - RNA, 64 nt, Human
ccaacuccucuauccaagacugugcccacauccgaagcacaaggaccucaagucaccagcauaa

SEQ ID NO: 449573 - RNA, 64 nt, Human
uccauuugggagccugccuacauucuuguucuagaagcacaaaaaauccucagaugaauuagaa

SEQ ID NO: 449574 - RNA, 64 nt, Human
uaagaagggaacccccaaauuuaauuaaagccuuaagcacaauuaauuaaaagugaaacguaau

SEQ ID NO: 449575 - RNA, 62 nt, Human
guauccuuuagagaaaaaauauuagugaagaagcccuggaggcccagguugggagucagucg

SEQ ID NO: 449576 - RNA, 62 nt, Human
accucaccuggaaacucaccuucagcgccucagcccuggacuguuagaggugcugcagcugc

SEQ ID NO: 449577 - RNA, 62 nt, Human
cccaugcagcaaggcuuggaggaagcgucagugcccuggagaucccagcucgcucuccccac

SEQ ID NO: 449578 - RNA, 64 nt, Human
uggagaugccacuuucgugugacugcgaacauuaaagcacaaaaaaauccaaccuggaguugug

SEQ ID NO: 449579 - RNA, 64 nt, Human
uggugaacugaagcagagucaagcugaugaaguuaagcacaaccauguucuugagcagcugaau

SEQ ID NO: 449580 - RNA, 64 nt, Human
caggggguggggauuaucuuggggagaggcugaaaagcacaaaagauagucuucccuguacgua

SEQ ID NO: 449581 - RNA, 64 nt, Human
aaaccugagccuaucuggcugggaugguggaauuaagcacaaggucacauucucugugaucaca

SEQ ID NO: 449582 - RNA, 64 nt, Human
aauggcuacugugcauucuugagcuuuuucugcuaagcacaaaaugaacgcaaagcuaaaugca

SEQ ID NO: 449583 - RNA, 64 nt, Human
ucuggcuccucacguguccuucaggacagaacagaagcacaaagacucagccaagaguucucuu

SEQ ID NO: 449584 - RNA, 64 nt, Human
ugaacccuuccauccgagacugugcccacauccgaagcacaaggacaucaaaucaucagcacaa

SEQ ID NO: 449585 - RNA, 64 nt, Human
agaaacuaccccaccgacucaucuuuccuucucuaagcacaaagugauuugguuauuuugguac

SEQ ID NO: 449586 - RNA, 64 nt, Human
cucacagcacagaaaauggggcagggggagccucaagcacaaucuagcuguccuccuaaagacu

SEQ ID NO: 449587 - RNA, 64 nt, Human
aguuuguuauccuuucuaauuuuuacugaacugaaagcacaaagaagacuacacagaaaaucug

SEQ ID NO: 449588 - RNA, 64 nt, Human
gcacaaugagaacuccgacagggguggcagcagcaagcacaauaccauuaaaaagguacccagg

SEQ ID NO: 449589 - RNA, 64 nt, Human
ugucuuuaaaaugcagaagcuguggaaacacaucaagcacaaguaugagaacaaguaguuccuu

SEQ ID NO: 449590 - RNA, 64 nt, Human
ccguagguggaggcgaugggucacgagccauguuaagcacaaccggcuccuugguccaguucug

SEQ ID NO: 449591 - RNA, 64 nt, Human
cuggacccugcaggguggcucccuccuccccaucaagcacaagagagggcccaggaaaaaaggu

SEQ ID NO: 449592 - RNA, 64 nt, Human
uggggccauggccucaggcuugugucuaucacaaaagcacaaacuugcccuaacccacaugggc

SEQ ID NO: 449593 - RNA, 62 nt, Human
gugggagcuggccugggccaggacggcagguggcccuggagaugggaaagugucugugucga

SEQ ID NO: 449594 - RNA, 62 nt, Human
ugugcaggcugcgcuggccccaccugccuugugcccuggagugggguuucuccuuguugaag

SEQ ID NO: 449595 - RNA, 62 nt, Human
caggcucuuucucccuuuuccucuugcucacugcccuggaaucaacaggcugguugcugguu

SEQ ID NO: 449596 - RNA, 64 nt, Human
cgaccagcaggcuccucagcccucucuugccaaaaagcacaagauguugaggcgagcagggcag

SEQ ID NO: 449597 - RNA, 64 nt, Human
ugaucuuuuuugcuauauuuguauacaguacaguaagcacaauuggcacuguacaucuaaaaau

SEQ ID NO: 449598 - RNA, 64 nt, Human
aaggcauucucccagcucuagccucuggacuggaaagcacaagacuggcccagugccagcaagu

SEQ ID NO: 449599 - RNA, 64 nt, Human
accaaugugucugaaggccaaaauauauauccagaagcacaaugcaucauuccuuuguuguuga

SEQ ID NO: 449600 - RNA, 64 nt, Human
uuugugggcugggaucaagccugcagcuugaggaaagcacaaggaaaggaaagaagaucuggug

SEQ ID NO: 449601 - RNA, 64 nt, Human
ggacccuagaggagacucucauucgauuuuaaagaagcacaacgggucauuuuccuuuguaugu

SEQ ID NO: 449602 - RNA, 64 nt, Human
ugaagaaagaacuugaaccuauguuauaugauacaagcacaacuugagcuacaguaaacuacau

SEQ ID NO: 449603 - RNA, 64 nt, Human
uugugugccucuagcugaauugagccuaaaaauaaagcacaaaccacagcaugugaagccuuuu

SEQ ID NO: 449604 - RNA, 64 nt, Human
ccaaccccacgaagucuccuauuuaaugugauggaagcacaaccccucucucacuuugcuccua

SEQ ID NO: 449605 - RNA, 64 nt, Human
uccccacaauugucugauguaugaguccucucagaagcacaagugcauacuaggaaggcuuugu

SEQ ID NO: 449606 - RNA, 64 nt, Human
agugaccagagcaaguaugaaggugaugcugccaaagcacaagccaguuucuugggaaaauuca

SEQ ID NO: 449607 - RNA, 64 nt, Human
agucaaaacaaagcagcuuuaaaaaaauaauuggaagcacaagugcauggcacugacugaaugc

SEQ ID NO: 449608 - RNA, 64 nt, Human
guaacugaucuuuugucuaaggauuuuuaccugaaagcacaauguauugagucucuugaaaauc

SEQ ID NO: 449609 - RNA, 64 nt, Human
uauuauuaagacaacuuugccaaaaaaguccccuaagcacaacuauuuacauuucuuuauagcc

SEQ ID NO: 449610 - RNA, 64 nt, Human
aaaauuacggcugcaaaauggcuaaggucaaguaaagcacaacauuaugauuuaauaugcuuuu

SEQ ID NO: 449611 - RNA, 62 nt, Human
accagacucaguggacauuugugcaauugcucgcccuggagggaaccagaucauuuuuaaac

SEQ ID NO: 449612 - RNA, 62 nt, Human
caguagggcccccagcccccccccggagcugcgcccuggauccucacacuacagaucaggcc

SEQ ID NO: 449613 - RNA, 62 nt, Human
uggauggauuuagggugggagggccugugggggcccuggacagucacaccccagcagcagug

SEQ ID NO: 449614 - RNA, 64 nt, Human
gggagcugccugcagaagagccagcuggcgugucgggaaggauccaggaucugcaaacacaacu

SEQ ID NO: 449615 - RNA, 64 nt, Human
gaguggggcgggaggaagaauuggcaccuuccuagggaaggagacgagcgcuucgccuugauuc

SEQ ID NO: 449616 - RNA, 54 nt, Human; identical to SEQ ID NO: 380960

SEQ ID NO: 449617 - RNA, 64 nt, Human
gcgcugugucagugaagauguacgacuaccuguugggaaggacaaagggaugaggcuccagaga

SEQ ID NO: 449618 - RNA, 64 nt, Human
aaagcucuaauggaacauuuuuaguggugauuuggggaaggaaaguuaaugagguuuuuaaaau

SEQ ID NO: 449619 - RNA, 64 nt, Human
agagaagcuggagcagagagcuggcaugaguauagggaaggaggaaggacacauuuucaauccu

SEQ ID NO: 449620 - RNA, 64 nt, Human
guccaccggggacagacccaggggcgggcagagagggaaggagggaggaggcaucuucccugaa

SEQ ID NO: 449621 - RNA, 64 nt, Human
gaaagugaggggcuugagaaagugggugggaggagggaaggauuuuuuaggagccuuaaucaga

SEQ ID NO: 449622 - RNA, 64 nt, Human
agaagcauugguuuuuuuuugauccucugaguaagggaaggaagauuccuguggcauguugauu

SEQ ID NO: 449623 - RNA, 64 nt, Human
agaugggcaguguuauggcuacgugauauuugaagggaaggauaaguguugcuuucaguaguua

SEQ ID NO: 449624 - RNA, 64 nt, Human
uuuccaaaucauuuuuuuuuuucuuuuggggaaagggaaggaaaaauuauaaucacuaaucuug

SEQ ID NO: 449625 - RNA, 64 nt, Human
guuuucuagguaaacuucacuacugguaauuaaggggaaggauaugaggaagcaguuuaaauag

SEQ ID NO: 449626 - RNA, 64 nt, Human
ccagcucaaucugcccuggccauagggcuucccagggaaggaagaagagggaagaauccgacca

SEQ ID NO: 449627 - RNA, 62 nt, Human
auugucccgacauccuagagcaaguggucaacgcccuggaagaguccucuugacccugcuuu

SEQ ID NO: 449628 - RNA, 56 nt, Human; identical to SEQ ID NO: 372214

SEQ ID NO: 449629 - RNA, 62 nt, Human
gggaccggcagcagaggcaccguguucucucagcccuggauacgucuuguaaucuuucacac

SEQ ID NO: 449630 - RNA, 64 nt, Human
ggucagauggugguggugagaggccuuggggcuggggaaggagaguggacuuuggcucacucug

SEQ ID NO: 449631 - RNA, 64 nt, Human
gauagauggauggauggauggacggauggggugggggaaggaaggaaaggagggagaaaggagg

SEQ ID NO: 449632 - RNA, 64 nt, Human
cauugccuucacaccacuggguuugccagaaacagggaaggagggcguuaagggaaaaaaaaaa

SEQ ID NO: 449633 - RNA, 64 nt, Human
gggaccaugguguccuggcugguuccuuagcccugggaaggaguugucaggggauauaagaaac

SEQ ID NO: 449634 - RNA, 64 nt, Human
aaugacacaucaagcugcuaacaauugggggaaggggaaggaagaaaacucugaaaacaaaauc

SEQ ID NO: 449635 - RNA, 64 nt, Human
uuccuucuaagucaugucugcugccugugagccugggaaggagugcuuucaaaaccuguauuuu

SEQ ID NO: 449636 - RNA, 64 nt, Human
caguaacaacgcacccagcugcagcaaggagguggggaaggagggcaccccaaaggacagcgcc

SEQ ID NO: 449637 - RNA, 64 nt, Human
ucuuguugcucgggugcauuugaggauggauuuggggaaggaucaagugaaccaucccuagucu

SEQ ID NO: 449638 - RNA, 64 nt, Human
gccgccuccacccagggggcguggugggggcggagggaaggagggcggcggggcacagagacag

SEQ ID NO: 449639 - RNA, 64 nt, Human
aacucccgcacaugaccucccacccuaggagggagggaaggacaccguccuaggguauaaccug

SEQ ID NO: 449640 - RNA, 64 nt, Human
acccccaccccuguacccagccaccuuccugacugggaaggacauaaaagguuuaaugucaggg

SEQ ID NO: 449641 - RNA, 64 nt, Human
uccuauuaguaucgccugguugggccugggcaaugggaaggagccagaaaugccaucuucaccc

SEQ ID NO: 449642 - RNA, 64 nt, Human
gcuugcuuggugggaccugacgaguugguggcaugggaaggaugugggucucuagugccuugcc

SEQ ID NO: 449643 - RNA, 64 nt, Human
uaucuccuuuuagaccugggacggcaaaagggaagggaaggaaacuuagcagagugcuauugac

SEQ ID NO: 449644 - RNA, 64 nt, Human
cagaaauggaggacauuucauucuuuuuccugaggggaaggacugugaccugccauaaagacug

SEQ ID NO: 449645 - RNA, 62 nt, Human
agagggaggaguaaaacugggcaagacaaagagcccuggaucguugaauugauaguuuaauu

SEQ ID NO: 449646 - RNA, 62 nt, Human
agccacauuuccagcagggcaaaccaacugaugcccuggaagagucuuccgcacccucucca

SEQ ID NO: 449647 - RNA, 62 nt, Human
cgcgccuugucuccuacuccugacuccuaccugcccuggaacauccuuugcagggcagcccc

SEQ ID NO: 449648 - RNA, 64 nt, Human
acuaauugauuauccuggaacauuuugaauauuggggaaggaagaugauacuucuuucucaaga

SEQ ID NO: 449649 - RNA, 64 nt, Human
gaggcacccagguuguccaugcuugggauucugggggaaggagagaagggcagcucagggugga

SEQ ID NO: 449650 - RNA, 64 nt, Human
cagguguccgggggucuaggacuuuagggaucuggggaaggaccaacccaugcccugccaagcc

SEQ ID NO: 449651 - RNA, 64 nt, Human
cagacaucgcccuggcccugcuggcccggguaucgggaaggaggagcgagggaaugacggaggu

SEQ ID NO: 449652 - RNA, 64 nt, Human
gggaggaggguucacaguguuuuugugggggcgggggaaggaagaggcagccccgcccccgcca

SEQ ID NO: 449653 - RNA, 64 nt, Human
cugacgccuauaccugagcucuaggcugccuggagggaaggaacaggcccaugggaagaagggg

SEQ ID NO: 449654 - RNA, 64 nt, Human
ugcgguuuacugugggagacagcccaccuugaaggggaaggagauggggaaggccccuugcagc

SEQ ID NO: 449655 - RNA, 64 nt, Human
uuuggauggauggauggagggauggaaggagggagggaaggaugucugggaugugaagaggcaa

SEQ ID NO: 449656 - RNA, 64 nt, Human
cccugucauaaguaccucccuauuguagauagaagggaaggaaacuguugacuugagcuuggcu

SEQ ID NO: 449657 - RNA, 64 nt, Human
cgucacuuaauccagaguacaggggcuggggucagggaaggaagaucuaaagaacccacugugg

SEQ ID NO: 449658 - RNA, 64 nt, Human
gcagcugccacguggaggaagcucaauaucagcugggaaggaacugugccucugucugacuggc

SEQ ID NO: 449659 - RNA, 64 nt, Human
uaaguguaaggagcaaguggaauugaguccuucagggaaggaaccacagagucccuucccaagg

SEQ ID NO: 449660 - RNA, 64 nt, Human
ggacaucccaggagcagggucuggugggaggaaagggaaggaggaggcuaaggcugcccaggag

SEQ ID NO: 449661 - RNA, 64 nt, Human
uggucguugggugaccugcgauugucagaaagaggggaaggaagccagguugauacagcugccc

SEQ ID NO: 449662 - RNA, 64 nt, Human
ggggaccacugggccccucaggggaagcugcuaggggaaggacuggccguggcuccagaaugug

SEQ ID NO: 449663 - RNA, 62 nt, Human
guauguagggcccagggugggugucccugggagcccuggaaaugugcauaugugcauguguc

SEQ ID NO: 449664 - RNA, 62 nt, Human
ggauaccagcagcaagagagugcacccguuuagcccuggacccuguuucuuacugugugacu

SEQ ID NO: 449665 - RNA, 62 nt, Human
gcuccccauuuggacauuacuggcuaucuugugcccuggaacaacucugaauuaauuagacu

SEQ ID NO: 449666 - RNA, 64 nt, Human
ucugauucaguguuuuaugucuuucacuuucccugggaaggaguaaaguucuuuucuacagcuc

SEQ ID NO: 449667 - RNA, 64 nt, Human
ucaggcccagacagagccuggcaggcauccuggcgggaaggaccagguccccucuggguggaca

SEQ ID NO: 449668 - RNA, 64 nt, Human
ugggggagcaucugcuguuugaggacgggggguggggaaggaaggaacaugaucccuccagaag

SEQ ID NO: 449669 - RNA, 64 nt, Human
aggaagagauagugucgugagcuggaggaacauugggaaggaagcccgcggggagagaggagga

SEQ ID NO: 449670 - RNA, 64 nt, Human
ccucccauggaauagguaggcaagccaggacuccgggaaggaggugcagccaggaugcucuggu

SEQ ID NO: 449671 - RNA, 64 nt, Human
uugcguccugacggcgcccccagugugcacgagugggaaggacuuggcgcgcccucccuuggcg

SEQ ID NO: 449672 - RNA, 64 nt, Human
gauauuuuaaagauuucugagcuagcaggcaugugggaaggaaggcucugucuucaacucuuug

SEQ ID NO: 449673 - RNA, 64 nt, Human
cuccuccucaaaaacugauucagaaacugacuuggggaaggaauuuaauacuuugaagucauga

SEQ ID NO: 449674 - RNA, 64 nt, Human
cccuagacacuccccgcgucucccccaugcacaggggaaggauguugacauagcacugggcugu

SEQ ID NO: 449675 - RNA, 64 nt, Human
uggaauuuuucuaauggacaaaucaccaaacacugggaaggaggagagaggagggaucucuccc

SEQ ID NO: 449676 - RNA, 64 nt, Human
ggaagugcugauuccacagcaugcagccugguaggggaaggaaaauaaaagggugugaagaagg

SEQ ID NO: 449677 - RNA, 64 nt, Human
gccacuggaggagucagacuaccaugacaucguagggaaggaggggagauuuuuuuguaguuuu

SEQ ID NO: 449678 - RNA, 64 nt, Human
ccugcuguucuccccagaagcagccauaaaaccugggaaggauuuucugaccuuccccugaagu

SEQ ID NO: 449679 - RNA, 64 nt, Human
gcauuucacuggaauggguucuuggaucucugaggggaaggaacagcaaaagaggcccuucuuc

SEQ ID NO: 449680 - RNA, 64 nt, Human
guaccaguccauaaauuaaggcccgcucucuggagggaaggacauuacugaaccugucuugcug

SEQ ID NO: 449681 - RNA, 62 nt, Human
aggcaaauccuaucacccacucagccccaaaugcccuggauuauaugauuuuuaaaacauuu

SEQ ID NO: 449682 - RNA, 62 nt, Human
gaacgggcagccugggccuggguggaaauccugcccuggaggaaguuguggggagauccacu

SEQ ID NO: 449683 - RNA, 62 nt, Human
cacauugguuuaagcccagagauccugcuugagcccuggacucaucuugggaagggccaugg

SEQ ID NO: 449684 - RNA, 64 nt, Human
cccagccucuugcaguauucccauacuugaugcagggaaggaaccagaagcagaggggccucua

SEQ ID NO: 449685 - RNA, 64 nt, Human
cugcccggcacuggggacuuaggggugcggggaggggaaggacgccuccaagcccgcucccugc

SEQ ID NO: 449686 - RNA, 64 nt, Human
ccagagaauccuuccucagcucucuucuuuccaggggaaggaggugcucagggguggguaucca

SEQ ID NO: 449687 - RNA, 64 nt, Human
guggcucaggggagcaagcuuacacaagaagugagggaaggauguuuagcaguggcuggugccc

SEQ ID NO: 449688 - RNA, 64 nt, Human
ggagcaugucacuguguacagcuggccacacacagggaaggagcagcaucugguaugcagccac

SEQ ID NO: 449689 - RNA, 64 nt, Human
acugcacauggcccuccuccccacccucaugacugggaaggaagccugugaugaggcugagaua

SEQ ID NO: 449690 - RNA, 64 nt, Human
gauaugugauucauagcaauuuugaugugaagaagggaaggacaucauugacuuaauaauagua

SEQ ID NO: 449691 - RNA, 64 nt, Human
uggagcgcaaggauugagaggcccuguggacaaggggaaggagagcuugggggugggagaggga

SEQ ID NO: 449692 - RNA, 64 nt, Human
cgagugaucuggggguaccccuuggguugguguggggaaggagugccuccuuaguggugcuugc

SEQ ID NO: 449693 - RNA, 64 nt, Human
ugccuuauauguguguuuaccccuuccuggccuggggaaggaggcggggagggcuccuuucuac

SEQ ID NO: 449694 - RNA, 64 nt, Human
cuucguuagaaugucugccuuacugguuuccccagggaaggaaaaauacacuuccacccuuuuu

SEQ ID NO: 449695 - RNA, 64 nt, Human
ugagagugggcgugggcuucuucacauaagccuggggaaggaagaaaaaacggcuuucauuacc

SEQ ID NO: 449696 - RNA, 58 nt, Human; identical to SEQ ID NO: 381028

SEQ ID NO: 449697 - RNA, 64 nt, Human
gggggggauggcaugguguuuguggacugguucagggaaggaggggaaaagggaggugcagaga

SEQ ID NO: 449698 - RNA, 64 nt, Human
uccuucugucccccggggccguggagcugucggagggaaggaggacggugcggggccgcagggg

SEQ ID NO: 449699 - RNA, 62 nt, Human
uugucauuuuuuuaauaaagucaguucugguggcccuggacuuuggaggggaaggggaggcc

SEQ ID NO: 449700 - RNA, 62 nt, Human
ggagcuguaucgagggggaggcgccugguccagcccuggacagauugauuuccagcugaaua

SEQ ID NO: 449701 - RNA, 62 nt, Human
aagugcaauugcauaaaaacagaaagaacaacgcccuggagccaaucuucaagaaaggaauu

SEQ ID NO: 449702 - RNA, 64 nt, Human
aaggcccacgggugcaccagggcugaggucugaugggaaggacuugacuccaggugcagagaug

SEQ ID NO: 449703 - RNA, 64 nt, Human
gcacuguuagcauuuaacuucuuguuaggauucagggaaggaacaguuggccaagaauuuuuuu

SEQ ID NO: 449704 - RNA, 64 nt, Human
cugguuuggacaaaaacccucaguagagacaagcgggaaggauaauuagcugaaagcuaugaug

SEQ ID NO: 449705 - RNA, 64 nt, Human
uucaaaaaacccuugcuuuuaggggagggaagcggggaaggaaaggaaugagggaggaaauauu

SEQ ID NO: 449706 - RNA, 64 nt, Human
accauauuugaauuggccugaacagauguaaaucgggaaggaugggaaaaacugcagucaucaa

SEQ ID NO: 449707 - RNA, 64 nt, Human
ugagaccaggggaccagagggaugggagagucaagggaaggacaaucccaggaaguccuaagaa

SEQ ID NO: 449708 - RNA, 64 nt, Human
gaugagaucaauacuacugauccaucuguagccugggaaggagacaggacauuccuguacuaag

SEQ ID NO: 449709 - RNA, 64 nt, Human
cuagaaauagaaggcccagugguggaauauuagagggaaggaaacugacaacgugugaaaguua

SEQ ID NO: 449710 - RNA, 64 nt, Human
ugcaugccccaugaugaguuucuggccuaauugagggaaggaggaaauucauaccagcaguuuu

SEQ ID NO: 449711 - RNA, 64 nt, Human
cucaagcucccugccaaccucuggauacaucaaugggaaggaaaccagggaagcauagaccuau

SEQ ID NO: 449712 - RNA, 64 nt, Human
cuuuguguucaaaagaaaauuccaacugcuguuggggaaggacacagaaaagaaaaauaaccac

SEQ ID NO: 449713 - RNA, 64 nt, Human
cacauuugauaaguauaugccaaaaaaugaagccgggaaggaggacaaggcccaugggugggug

SEQ ID NO: 449714 - RNA, 64 nt, Human
guuacaaaucacaguauaagauuuaagugccugggggaaggauacaauuuuuagaaauuacaua

SEQ ID NO: 449715 - RNA, 64 nt, Human
gugaggaaaaggugguaaauaggaaaccaugaaugggaaggauggcaauaaguagcaacuauac

SEQ ID NO: 449716 - RNA, 64 nt, Human
aucagcgaguuauuguaacuggucaccacuggacgggaaggagaacagaggagagggaaagaga

SEQ ID NO: 449717 - RNA, 62 nt, Human
cccccgcccacccuccugaccgcagcucccaggcccuggagaccuccaggcuuuccugcccu

SEQ ID NO: 449718 - RNA, 62 nt, Human
caggauccaugggagcauucucaaaggcuuuagcccuggacccagcaggugaggcucggcuu

SEQ ID NO: 449719 - RNA, 62 nt, Human
ggggggcccuuggcugcgggagaaggcccagagcccuggaggagccaccaccccgccggccc

SEQ ID NO: 449720 - RNA, 64 nt, Human
auauaaauauguacauguguauauagauuuuuaggggaaggagagagggaagggucaggguaga

SEQ ID NO: 449721 - RNA, 64 nt, Human
cuccauccccaacuuccucaaagcccaaagccaagggaaggauaaaucaaggcucaaggcuucc

SEQ ID NO: 449722 - RNA, 64 nt, Human
aucuguuugucugucugugugucugugacagucagggaaggaugccucggagcugagguggggu

SEQ ID NO: 449723 - RNA, 64 nt, Human
uggagaccaggccaugggcccucacggagaggaagggaaggaaggagagggagggggaggauag

SEQ ID NO: 449724 - RNA, 64 nt, Human
ucucaucagccagggaagaguaagugggaucacagggaaggauguuggcagcgacaccauccca

SEQ ID NO: 449725 - RNA, 64 nt, Human
acucuccagcagaaugucugcuugugucuagauggggaaggagcagguucaucggguacuggga

SEQ ID NO: 449726 - RNA, 64 nt, Human
ucucaucaaccagggaagaggaacugagaucacagggaaggagauuggaggugauaccagcaca

SEQ ID NO: 449727 - RNA, 64 nt, Human
aagccugggcccacagcugcaccggcagcccaaggggaaggaccgguugggggagccgggcaug

SEQ ID NO: 449728 - RNA, 64 nt, Human
gaguccucccuaggagaggggcucgaugggcugggggaaggagccugaagguugccccugguug

SEQ ID NO: 449729 - RNA, 64 nt, Human
guggguccucuguggcugugcgauugaccucgaugggaaggagcguucuacccauuuuccuugu

SEQ ID NO: 449730 - RNA, 64 nt, Human
cuucaucuguuccuaagucagcauguuaguucuggggaaggaucauaagaaaggaaauacuuuu

SEQ ID NO: 449731 - RNA, 64 nt, Human
caccgguucugugccugugcucuguuguguuggagggaaggacuggcgguucugguuuuuacuc

SEQ ID NO: 449732 - RNA, 64 nt, Human
ucaugcuccuuagaaggauguggaguagagggaagggaaggauuggugauagcagagcuccagg

SEQ ID NO: 449733 - RNA, 64 nt, Human
ccuugagaaccuugggucuggagagccaugaagagggaaggaaaagagggcaaguccugaaccu

SEQ ID NO: 449734 - RNA, 64 nt, Human
uguugugcuuccuauaaacagcuccgcucuuucagggaaggaugguaacaaacuagaaggacaa

SEQ ID NO: 449735 - RNA, 62 nt, Human
agcuuucucccuagaucgcacugugggccggggcccuggagggcugcucuguguuaauaaga

SEQ ID NO: 449736 - RNA, 62 nt, Human
agccacugcgcccugggggccugggcucugcugcccuggaccccucuauuuauuucccuucc

SEQ ID NO: 449737 - RNA, 62 nt, Human
gucucagaaacuccccuggggguuucaccugggcccuggaggaauucagcucagcuucuucc

SEQ ID NO: 449738 - RNA, 64 nt, Human
cagugcacuggcccugacuccaggcgugaguauggggaaggauacggguucuucugacggggag

SEQ ID NO: 449739 - RNA, 64 nt, Human
aauggaaagaaugggguaaaccacagucuacauagggaaggacucuuuccuuagccuucucuua

SEQ ID NO: 449740 - RNA, 64 nt, Human
acucacaacaggcuggaugggugggugguaaaaagggaaggaugaggcucccccaaugucacau

SEQ ID NO: 449741 - RNA, 64 nt, Human
gaaccaugauccuccuaaaagcauuucuacugcggggaaggagagguaaauguuugaagcccua

SEQ ID NO: 449742 - RNA, 64 nt, Human
accuugaagcauggucagcagcagagagagcaacgggaaggacaaagaaagagguggggcaggg

SEQ ID NO: 449743 - RNA, 64 nt, Human
agaagggaagagaggaagaacgagaggaagagaagggaaggaaguguuuguguagaagagagag

SEQ ID NO: 449744 - RNA, 64 nt, Human
gggcccugggggcugggcuguagaagaguuguuggggaaggagggagcugaggagggggcaucu

SEQ ID NO: 449745 - RNA, 64 nt, Human
agauucaccauugcccgccugaagaagcccucaggggaaggaacuuagcagugugcaggugagc

SEQ ID NO: 449746 - RNA, 64 nt, Human
uuuucuuuacuucuuuugaaaaucuguuugcaaggggaaggaccauuucguaauggucugacac

SEQ ID NO: 449747 - RNA, 64 nt, Human
auacaguagcacaaguccuuguucucugaagagugggaaggagaggagugagugaaguagccug

SEQ ID NO: 449748 - RNA, 64 nt, Human
agcaggaaagauggaguuaccaguuacugaaauagggaaggaugggcuggguaaguauggaauu

SEQ ID NO: 449749 - RNA, 64 nt, Human
cguuugggaaacaagacuuuuccugcaauagccugggaaggaauaaaaggauagaguguuuggg

SEQ ID NO: 449750 - RNA, 64 nt, Human
ugccuaaccuauguguggcucagggaccagcuuggggaaggaaaggagguuuguucugcucccc

SEQ ID NO: 449751 - RNA, 64 nt, Human
gacugggaguagaggggcagguagaguuccuggagggaaggaugaaggagccuuggcuacugua

SEQ ID NO: 449752 - RNA, 64 nt, Human
aggauggccucugcuaagcucaaggcgugaggaugggaaggagggagguauucguaaggauggg

SEQ ID NO: 449753 - RNA, 62 nt, Human
aucccugugaccccuccccagugccucuccuggcccuggaaguugccacuccagugcccacc

SEQ ID NO: 449754 - RNA, 62 nt, Human
gaaaggccuccaccuguaucuacacucugagggcccuggacugggccugagcuugccacaga

SEQ ID NO: 449755 - RNA, 62 nt, Human
ccagggugcaguacagcagggccugaauacuggcccuggacucccuuuuccagaacaccagg

SEQ ID NO: 449756 - RNA, 64 nt, Human
ugaggaugggaaggagggagguauucguaaggaugggaaggagggagguauucgugcagcauau

SEQ ID NO: 449757 - RNA, 64 nt, Human
accauugcaacucacaguaagagacuggguuucggggaaggaggggcuagggacauuuuggcac

SEQ ID NO: 449758 - RNA, 64 nt, Human
aggaagaaagagacuauggucuucuauuuauugugggaaggaaaacaggguggggcgggugagu

SEQ ID NO: 449759 - RNA, 64 nt, Human
ugccauuggacagcuuucacaaguaacaggauuagggaaggacauaauguauuuaagaauaagu

SEQ ID NO: 449760 - RNA, 64 nt, Human
cauccuccauaucaaagacccuaagaaucagguggggaaggaggugaucugccaggugcugcac

SEQ ID NO: 449761 - RNA, 64 nt, Human
ugggcuugcucucauuuggccuguucucaggggugggaaggaagagcgucccuuccuucuccuu

SEQ ID NO: 449762 - RNA, 64 nt, Human
ggcaacacauuuauuaagugauccaacaugggaugggaaggaaugggcaaagagauuaaaauga

SEQ ID NO: 449763 - RNA, 64 nt, Human
aaacugagaugaggaccuugguacuagggagggagggaaggacgugggaauguuuucuuauugg

SEQ ID NO: 449764 - RNA, 64 nt, Human
auagcuguugaaauguuuuggccuuuuggagugggggaaggacaaaucugauccuguaaucuuu

SEQ ID NO: 449765 - RNA, 64 nt, Human
ccaacggcaauggcaugagaacucuuguuucuuggggaaggagaggagggaaaaggaccagggu

SEQ ID NO: 449766 - RNA, 64 nt, Human
cagugggcugcaguugcccaaccacaggaagaaagggaaggagguagagggaagaaacagaagc

SEQ ID NO: 449767 - RNA, 64 nt, Human
cacagcgaagcuguaacugaggacccugcugcucgggaaggaggugguuuccagugugacucgg

SEQ ID NO: 449768 - RNA, 64 nt, Human
ggaugacuguucacugccacuguccuguggcucggggaaggagagucgaugcuguucccgcugc

SEQ ID NO: 449769 - RNA, 64 nt, Human
uagcuccuccccuuccucuugucugauuucuuaggggaaggagaaguaagaggcuaccucuuac

SEQ ID NO: 449770 - RNA, 64 nt, Human
acaaaggagcaaauguagaugccaaagauaaguggggaaggacagcguugcauagagggguaag

SEQ ID NO: 449771 - RNA, 62 nt, Human
uccaugugaccccacaguggggcuggaccagggcccuggaggccaauaaagagcuuucuggg

SEQ ID NO: 449772 - RNA, 62 nt, Human
gugccuggcuggacaccgcacugcgcaaaggggcccuggagcuccaggcagggggcgcuggg

SEQ ID NO: 449773 - RNA, 62 nt, Human
uguuguacgcugcaucaucccgcuggcccugugcccuggagggugggcggcucauggugcca

SEQ ID NO: 449774 - RNA, 64 nt, Human
uuuaauuuccagaacugcacaaugaccagcaggagggaaggacagacaucaagugccagauguu

SEQ ID NO: 449775 - RNA, 64 nt, Human
acagccuuuauuccaggcccagggauguaggagggggaaggaggaaacaggaagcccagagagg

SEQ ID NO: 449776 - RNA, 64 nt, Human
gccccugggauggagugcagggagccagcuggaagggaaggagaggggccagggaggccacagg

SEQ ID NO: 449777 - RNA, 64 nt, Human
uuuuuuaauuuauuuaaaauuggggggagggcaugggaaggauuuaacaccgauauauuguuac

SEQ ID NO: 449778 - RNA, 64 nt, Human
augugugaugcugacaccagcggccuggagucgugggaaggaggggagccuuaccaagacuccu

SEQ ID NO: 449779 - RNA, 64 nt, Human
agaaaugcugcuggccaaauagcaaagacaaccugggaaggaaaggucuuugugggauaaucca

SEQ ID NO: 449780 - RNA, 64 nt, Human
caggaguccccuccauguacacacacacaacucagggaaggagguccugggacuccaaguucag

SEQ ID NO: 449781 - RNA, 64 nt, Human
auauuuuaaugaggaaaaaauaauggagaacccugggaaggaccugguucuuuugcuucucggg

SEQ ID NO: 449782 - RNA, 64 nt, Human
agucccugggaggccccuucucucccugccagaggggaaggaggguacagcugggcuggggagg

SEQ ID NO: 449783 - RNA, 64 nt, Human
cugcagguaucagcuugcucucuuugcacuuucggggaaggaggacucacagugaggaagcaaa

SEQ ID NO: 449784 - RNA, 64 nt, Human
ucacuuaccauggcuagagaugggggugagacuggggaaggacaaaagcagggaacagauaagu

SEQ ID NO: 449785 - RNA, 64 nt, Human
ccacauuuguucacaggaguuuuuggugcggggugggaaggauggaaggccuuggauuuauauu

SEQ ID NO: 449786 - RNA, 64 nt, Human
ugcuucauuaagggcuuggggcagagacagcauggggaaggagguccccuuccccaagaguccu

SEQ ID NO: 449787 - RNA, 64 nt, Human
ccuggcacccugggcugcuggccuggaggaguucgggaaggaggauagaccaggaaauaaaggg

SEQ ID NO: 449788 - RNA, 64 nt, Human
ccuuucauagauaacauuucuugaaggcugggaggggaaggagggccuggcagauggcagccuc

SEQ ID NO: 449789 - RNA, 62 nt, Human
cauuguaagagcuguccacauuuguauguugugcccuggaaucagccugguugagcucaaau

SEQ ID NO: 449790 - RNA, 62 nt, Human
ggacucagcguggagcacgugcacagcuucacgcccuggauccaggcccacgggggcugggu

SEQ ID NO: 449791 - RNA, 62 nt, Human
ccagcagccuguaaugggagggcuacagguuagcccuggaaccugcaaucaaaccaccuuug

SEQ ID NO: 449792 - RNA, 64 nt, Human
uuuuguuuuucaaaccuccugcuucucccaccuugggaaggagaaaugugaaacccggcagcgg

SEQ ID NO: 449793 - RNA, 64 nt, Human
uucacauggggacaggggauggagcaugaggcaagggaaggaaaagcagagcuuauuuuucacc

SEQ ID NO: 449794 - RNA, 64 nt, Human
cugcccaucgcggcugcgggucaagcaucuucaagggaaggacggacuggaggccucaccgugg

SEQ ID NO: 449795 - RNA, 64 nt, Human
acaucaaacaaccuugugauuauaaaacgauccugggaaggagccccuaacuagggcaagucag

SEQ ID NO: 449796 - RNA, 64 nt, Human
uuuuucaaauuggugucauaauauuguguaaaaagggaaggaaaaaaaaaaccacccccagcuu

SEQ ID NO: 449797 - RNA, 64 nt, Human
guuuccugccuauggugagaucagauguggccaagggaaggagcucugguuccagagaauuugc

SEQ ID NO: 449798 - RNA, 64 nt, Human
gaaucugcguuguugggaagccagcaguggccuugggaaggaagccauggcugugguucagaga

SEQ ID NO: 449799 - RNA, 64 nt, Human
agagggacuuuguauagaagguuugggggcuguggggaaggagaguccccugaaggucugacac

SEQ ID NO: 449800 - RNA, 64 nt, Human
ucucuuuuguguuuucugcugguauucuggaggugggaaggacuuggagagaguuaagaaacac

SEQ ID NO: 449801 - RNA, 64 nt, Human
cagugagcuuugccuugguggcuggggcuugauugggaaggaggggauuaccagcuuacugggu

SEQ ID NO: 449802 - RNA, 64 nt, Human
acgaggacacucgcuugccgggccugggccuccugggaaggagggagcugcucagaaugccgca

SEQ ID NO: 449803 - RNA, 64 nt, Human
gccccacccagaccugaaugcuucugagagcaaagggaaggacugacgagagauguauauuuaa

SEQ ID NO: 449804 - RNA, 64 nt, Human
cacugugaacauaccgggcgagaucauucuucaggggaaggagcugcccagagcaucacaggau

SEQ ID NO: 449805 - RNA, 64 nt, Human
auagcuuguaacaggagccuugggcuaggggcuggggaaggaaagccgagcuggcauucguucu

SEQ ID NO: 449806 - RNA, 64 nt, Human
uaagaacauguugggcauguggacccaagcaccugggaaggagguggcaucugagacagccuga

SEQ ID NO: 449807 - RNA, 62 nt, Human
gcgccuguagucccagcuacuugggaggcugagcccuggaggucgaggcuacagugagcuau

SEQ ID NO: 449808 - RNA, 62 nt, Human
agccugagugcuggcccaauuacugcugaguggcccuggacaaaguuguuucucucccuggg

SEQ ID NO: 449809 - RNA, 62 nt, Human
gcuguuuaaucacagauaagcuucuagaacaagcccuggaaugugcauuccugccacugguu

SEQ ID NO: 449810 - RNA, 64 nt, Human
gaagaguacagagguggcagaaugaagcuagagugggaaggacuaaagacugagccccagagug

SEQ ID NO: 449811 - RNA, 63 nt, Human; identical to SEQ ID NO: 381122

SEQ ID NO: 449812 - RNA, 64 nt, Human
ggugccuccuuuauaaacaguaauagcuacguuugggaaggaggaaacauuuaaauuauaaagg

SEQ ID NO: 449813 - RNA, 64 nt, Human
cauagagcacaguggaacgcaggcugagaacgcagggaaggagaaauaaagaguaaagccagag

SEQ ID NO: 449814 - RNA, 64 nt, Human
guccauaggccacacuuuaauaucacauuauaaagggaaggacagucuucauuccuccugguua

SEQ ID NO: 449815 - RNA, 64 nt, Human
cuaacauagaccccaaaauuagauauaaagaauugggaaggauaccuggagcacaaggaauaag

SEQ ID NO: 449816 - RNA, 64 nt, Human
accaggcaauguaaguguucgagguguugaagaugggaaggauuugcagggcugagucuaucca

SEQ ID NO: 449817 - RNA, 64 nt, Human
gucuguacagaucaaagaagacagaacaugucaggggaaggagggaaagaucuugaugcagggu

SEQ ID NO: 449818 - RNA, 64 nt, Human
ucaaugauuuuuaagcuaugaaaaauacaauggggggaaggauagcauuuggagauauaccuaa

SEQ ID NO: 449819 - RNA, 64 nt, Human
gggagggagggaguccuguguguuuguggggagagggaaggaggaagucaguuauuugaguaag

SEQ ID NO: 449820 - RNA, 64 nt, Human
caccaaggaagugaugaauaaauacaagguacacgggaaggaaauacuaagaacccugcaagau

SEQ ID NO: 449821 - RNA, 64 nt, Human
cgccugccuuucccaucugucugucuggcuggcagggaaggaaagaacuugcauguuggugaag

SEQ ID NO: 449822 - RNA, 64 nt, Human
ccacucucauuuguuaaugcuuucccacucucaggggaaggauuugcauuuugagcuuuaucuc

SEQ ID NO: 449823 - RNA, 64 nt, Human
aggcuggagcuugugauuuuaggaucuccauggugggaaggaaggcaggcccuuccuauccaca

SEQ ID NO: 449824 - RNA, 64 nt, Human
cuucauguuguuaauuuugaauacagcaaguguagggaaggaagcguucguguuugacuugucc

SEQ ID NO: 449825 - RNA, 62 nt, Human
ggggugucacagacccucugcagccccuggcugcccuggacugugcagagaugccugacucc

SEQ ID NO: 449826 - RNA, 62 nt, Human
uuuuuccuaccacuaccuuauaaaccugccuggcccuggaggggcucugggacgacuuuguc

SEQ ID NO: 449827 - RNA, 52 nt, Human; identical to SEQ ID NO: 372438

SEQ ID NO: 449828 - RNA, 64 nt, Human
gccuuuuuaaaaaauucauuacagcaaacagcuggggaaggacaugcaguccucccccagcucu

SEQ ID NO: 449829 - RNA, 64 nt, Human
gaaucuauaagguuauuuucaugauuuugcaaaugggaaggauuucuuuaaagcaagacacaaa

SEQ ID NO: 449830 - RNA, 64 nt, Human
uuucuuucugaugucaaaaaugucuuggguaggcgggaaggaggguuagggagggguaaaauuc

SEQ ID NO: 449831 - RNA, 64 nt, Human
aaccacaucugccuccacacacagcuccuccgcagggaaggagaagcugcucuguaacucauuc

SEQ ID NO: 449832 - RNA, 64 nt, Human
gugaguaucccugccaccaagagagcaaugggcagggaaggaaggggucugccgaccccagcuc

SEQ ID NO: 449833 - RNA, 64 nt, Human
uguacuuguggaaagguguguuugcguagccuuagggaaggaaggcaauugcuccuuaacagca

SEQ ID NO: 449834 - RNA, 64 nt, Human
uguucccuggggacuccucuuaauguuuccaaaugggaaggacaguugauuuccaacaugaggu

SEQ ID NO: 449835 - RNA, 64 nt, Human
cuuuggcuuaacuuccagaugcucagucggcuuggggaaggacugaagggcagcugccaagacc

SEQ ID NO: 449836 - RNA, 64 nt, Human
ggcaggagcuccacuucucucugccucuggcuaugggaaggagcaggcgguuggaaauccugug

SEQ ID NO: 449837 - RNA, 64 nt, Human
aguagguccugggacuugacaaaguaugugggaggggaaggaaggacagaacuugacuggcucc

SEQ ID NO: 449838 - RNA, 64 nt, Human
ugcgaaugacacaacucaaguugggaggggaacagggaaggaagggauggauggggguggugua

SEQ ID NO: 449839 - RNA, 64 nt, Human
gcucccugguuugcauuuaccucauauaaagaaugggaaggagaccauuggguaacccucaagu

SEQ ID NO: 449840 - RNA, 64 nt, Human
ccauguugacgagacagcagcagggggagagggagggaaggaaggugcggcugcaagaaggaag

SEQ ID NO: 449841 - RNA, 64 nt, Human
uaacugugccagugcccauguuuacagaagucaggggaaggaaggagccugugucccugggacg

SEQ ID NO: 449842 - RNA, 64 nt, Human
agaggcuggagaccugggcuggggccuuccuccagggaaggaggcuggggugggaacacuggcc

SEQ ID NO: 449843 - RNA, 62 nt, Human
gggagggguauucuucaugcaggagaccccaggcccuggaggcugcaacauaccucaauccu

SEQ ID NO: 449844 - RNA, 62 nt, Human
ggagggguugucaagcccacccgggaaacugagcccuggagaggggaagcagccagcccagg

SEQ ID NO: 449845 - RNA, 62 nt, Human
uaugugugucugugucuucuccuuaaacacucgcccuggagucuguucucacaccugugcgc

SEQ ID NO: 449846 - RNA, 64 nt, Human
aaacacuccacaguguuuauauugggaagauauugggaaggaaauauauuuguaaaagaugaag

SEQ ID NO: 449847 - RNA, 64 nt, Human
gaauuccuaagggaaccuuagcauaaagguuuuggggaaggaggccguaggccggcccggagga

SEQ ID NO: 449848 - RNA, 64 nt, Human
ggcucacacgugccauccccaccccggugcuccagggaaggaggacacggacccgacgugggag

SEQ ID NO: 449849 - RNA, 64 nt, Human
cuuuuuggcacaaguucuaucacuccuuuaccuagggaaggaaaaaaaaaauauauauauauau

SEQ ID NO: 449850 - RNA, 64 nt, Human
caugguacgaauggcagcauacacagaugaaggugggaaggaugguccagaauucacuuuuacu

SEQ ID NO: 449851 - RNA, 64 nt, Human
uuggggagggguggauuuuuaaaaugucaagacagggaaggaugacaaaauggaaauuuaaaug

SEQ ID NO: 449852 - RNA, 64 nt, Human
caugcuauuguuguuccuaaagcuaagcuuugcugggaaggaaaugaccuauaguuucuuaaag

SEQ ID NO: 449853 - RNA, 64 nt, Human
ggggaaggcggggcaggcagccuguugcaggcaggggaaggagaagagacugaggggcugugac

SEQ ID NO: 449854 - RNA, 64 nt, Human
ccaguuuguucuguauaggaacagaggugccuccgggaaggaggcagcgagguagguagcuaug

SEQ ID NO: 449855 - RNA, 64 nt, Human
gccaggcuucccucacgcagccugugguggaugugggaaggagaucaacuucuccucacucugg

SEQ ID NO: 449856 - RNA, 64 nt, Human
uuugaggugucaaauacaaauaaaucugggcuuagggaaggagagaccuuauuccaaagcacga

SEQ ID NO: 449857 - RNA, 64 nt, Human
ggggucugcgguggcuccugucuucccugcagcagggaaggagggccguguggugcuuugcuag

SEQ ID NO: 449858 - RNA, 64 nt, Human
aacgugagugacacgcagccugcagacucacugugggaaggagacaaaacuagagacucaaaga

SEQ ID NO: 449859 - RNA, 64 nt, Human
cugcacacugguucaucaaaagaagguuaccgaggggaaggaacuaaagguguuugcacuucau

SEQ ID NO: 449860 - RNA, 64 nt, Human
agcccugauugcgcaaaacugaaaggcaugugaagggaaggaagaggaagagugcaaaacauug

SEQ ID NO: 449861 - RNA, 62 nt, Human
cguaggcuaccacucuccgggcaccggcuggggcccuggagcccccuuuggggcggaguggg

SEQ ID NO: 449862 - RNA, 62 nt, Human
agccuguggccccgaggcugggacacuguguggcccuggacaagccacagccccugccuggg

SEQ ID NO: 449863 - RNA, 62 nt, Human
gucaacucuuggggcacuccuggauccuaucugcccuggacaaggugcugaggugcauuguc

SEQ ID NO: 449864 - RNA, 64 nt, Human
cucacucaguaacguuguuuaauucucugcccuggggaaggaggauggauugagagaaugucuu

SEQ ID NO: 449865 - RNA, 64 nt, Human
uguauaauaauaaaaacaauacagcauauggcuagggaaggacaugguguauauaauuguaaaa

SEQ ID NO: 449866 - RNA, 64 nt, Human
agugggguucuuugagugggggaggcagggacgagggaaggaaaguaacuccugacucuccaau

SEQ ID NO: 449867 - RNA, 64 nt, Human
cccccuccucugccugcugcguggaggcagccaugggaaggagcccaggggagcuggccugggg

SEQ ID NO: 449868 - RNA, 64 nt, Human
ccaauccaggugggagagacacucccagggacaagggaaggaagggacacacacacacacacac

SEQ ID NO: 449869 - RNA, 64 nt, Human
uuuaggcugugacucucucucuaaugcugcucucgggaaggacgaaagugaccugcaaggagag

SEQ ID NO: 449870 - RNA, 64 nt, Human
cugccccccucccuuccgcuccugcccagccugggggaaggagaaaggaggggagaaagcgggc

SEQ ID NO: 449871 - RNA, 64 nt, Human
ucucuguccgagugugccacacgagaaccugaaggggaaggaaauagcuuggguagcgcacucu

SEQ ID NO: 449872 - RNA, 64 nt, Human
uaugaccugccgcccugaccaggauagggcgggugggaaggagaggggugcaacaggaccgccu

SEQ ID NO: 449873 - RNA, 64 nt, Human
uauuuaauguaauuugaauuuaauuucuguaauugggaaggaggguaauaaugaacaaaaaguu

SEQ ID NO: 449874 - RNA, 64 nt, Human
uaccauacuacacaaugaucucugauuuugcugagggaaggaauuauauaugugccacuuuuuc

SEQ ID NO: 449875 - RNA, 64 nt, Human
agugcauuuugggaguuggggugggaagggguaugggaaggauagacucauaauuaaaaugucu

SEQ ID NO: 449876 - RNA, 64 nt, Human
ccucugaguguccuaccuccuuggagaugagauagggaaggagcagggaugagacuggcaaugg

SEQ ID NO: 449877 - RNA, 64 nt, Human
gguagcagcuguugaguaacuuucauuggagguugggaaggaagugaggagaaaguguucuugu

SEQ ID NO: 449878 - RNA, 64 nt, Human
ccgccaccgcccaucccagaccauggagcgcgcugggaaggacgcaccaaagccgggagcucug

SEQ ID NO: 449879 - RNA, 64 nt, Human
cgcuacugcugcugcugccuuaaguaggaagagagggaaggacaccaagcaaaaaauguuccag

SEQ ID NO: 449880 - RNA, 64 nt, Human
uggaaauugauuaucuacacucaguuucauuacagggaaggaacccaugaaaacaucaguguua

SEQ ID NO: 449881 - RNA, 64 nt, Human
ccaguagccaggccaguaggcaguuggggaaggugggaaggauccagcgaggccccugagccug

SEQ ID NO: 449882 - RNA, 64 nt, Human
auccugccuucuuugugggggaggggggagagaggggaaggaaauggaacaaguuguguuugug

SEQ ID NO: 449883 - RNA, 64 nt, Human
ugaucuuccccauucuggccagagcagggcuggagggaaggagccaggagggagagagccuccc

SEQ ID NO: 449884 - RNA, 64 nt, Human
agguggugucccuuucacacuguggugucucuuggggaaggaucuccccgaaucucaauaaacc

SEQ ID NO: 449885 - RNA, 64 nt, Human
gaggugggacucccuggagcuaucuguggucuuagggaaggauccagacauacacggcuuuggg

SEQ ID NO: 449886 - RNA, 64 nt, Human
accgaggcacagcccagcuggggcuaggcccggugggaaggagagcgucguuaauuuauuucuu

SEQ ID NO: 449887 - RNA, 64 nt, Human
ucccaggaggcugagccugauuguccugagaaaugggaaggaucagauaugacuccuccuuggc

SEQ ID NO: 449888 - RNA, 64 nt, Human
cuggccagggguaggauaguauaggaaguagaaggggaaggaggguuagauagagaaugcugaa

SEQ ID NO: 449889 - RNA, 64 nt, Human
ugaauuucuccuuuccuacaguuggguaggguaggggaaggaggauaagcuuuuguuuuuuaaa

SEQ ID NO: 449890 - RNA, 64 nt, Human
guuuucacuuucuuuaggaaagagaagcuuucaggggaaggagagaaugauuuugcugacuucc

SEQ ID NO: 449891 - RNA, 64 nt, Human
uuuauuuuuaccacaauaguuugaagcaguaagggggaaggagggugauuauauugcuuuguaa

SEQ ID NO: 449892 - RNA, 64 nt, Human
gcugcagguaccuugauagcccacagagagaucugggaaggaagggcuccuccucaggcugcug

SEQ ID NO: 449893 - RNA, 64 nt, Human
ccagaaugcagcagcagcugagcauguuaaaauggggaaggaugauagcuacauguaugccggu

SEQ ID NO: 449894 - RNA, 64 nt, Human; identical to SEQ ID NO: 135817

SEQ ID NO: 449895 - RNA, 64 nt, Human; identical to SEQ ID NO: 135824

SEQ ID NO: 449896 - RNA, 64 nt, Human
uauauugaaaaucaaaggaggcaaaauuuugacagggaaggaaguaacugcaaaacacuaggcu

SEQ ID NO: 449897 - RNA, 64 nt, Human
ugaaacaggaaagaagagagggagagagaggaaagggaaggaagaaaggaaggagggagaaggg

SEQ ID NO: 449898 - RNA, 64 nt, Human
uaaaagaaugaaggaaauaauaaagugauagacagggaaggauagaaaagacuuaacaauauac

SEQ ID NO: 449899 - RNA, 64 nt, Human
acaaaagguguagcuuuuauaagagugcagaaaagggaaggauguguuuuuuucucucacuaua

SEQ ID NO: 449900 - RNA, 64 nt, Human
uucagagagaaauagauaaaacacgccacagccugggaaggagcgugcucuacccugugcuaag

SEQ ID NO: 449901 - RNA, 64 nt, Human
acugagugcugggagugaguugguaauaugagaugggaaggaauguugacuugcuaacauuccu

SEQ ID NO: 449902 - RNA, 64 nt, Human
cauaguuaauuuuuuucuaaccuugccacuuugagggaaggaaggguugggggaagggcaagcu

SEQ ID NO: 449903 - RNA, 64 nt, Human
auguguagucaaucuuuuaagcuuugacuguuuugggaaggaagaguaccucuuaucgagguag

SEQ ID NO: 449904 - RNA, 64 nt, Human
uugaaggucacucuuccugcaaggacuacguuaagggaaggaacucuggcuuccagguaucucc

SEQ ID NO: 449905 - RNA, 64 nt, Human
aagauucaaaaguggguaaguaaaauggaucagugggaaggauaagguguccaacagaaagugu

SEQ ID NO: 449906 - RNA, 53 nt, Human; identical to SEQ ID NO: 381206

SEQ ID NO: 449907 - RNA, 64 nt, Human
ggugaggauggaaggauggagaaaaacagacugugggaaggaucagaaggaauccgccgaggca

SEQ ID NO: 449908 - RNA, 64 nt, Human
gaguuccagcuguucuggccacacugggcugguggggaaggagcggcggccucuuuccuuggag

SEQ ID NO: 449909 - RNA, 64 nt, Human
acaacuggaacuggaaauuauacaaaaguaaauugggaaggauacuccagcaucugacacuggc

SEQ ID NO: 449910 - RNA, 64 nt, Human
gugaucucacagaggagggccaugccgcugaaaagggaaggagauugaaacauuugauugccuu

SEQ ID NO: 449911 - RNA, 64 nt, Human; identical to SEQ ID NO: 135831

SEQ ID NO: 449912 - RNA, 64 nt, Human; identical to SEQ ID NO: 135838

SEQ ID NO: 449913 - RNA, 64 nt, Human; identical to SEQ ID NO: 135845

SEQ ID NO: 449914 - RNA, 64 nt, Human
ucucugggaucccgcugugggucugagauggccugggaaggaccuuguggacaaugguuuuauc

SEQ ID NO: 449915 - RNA, 64 nt, Human
cugccccuugggaaggggcagugaugccuuugaggggaaggaggagccccucuuucucccaugc

SEQ ID NO: 449916 - RNA, 64 nt, Human
gcaggaaauccacagcuccuccugcacccagaaugggaaggaaagaaggccaagggaauucaga

SEQ ID NO: 449917 - RNA, 64 nt, Human
aaaagaaagcccucuccuuagcugagcagaggaagggaaggaguguggcuaugagaauaugauu

SEQ ID NO: 449918 - RNA, 59 nt, Human; identical to SEQ ID NO: 381215

SEQ ID NO: 449919 - RNA, 64 nt, Human
aguaacagcagggcuggacuuccuccagcguuuugggaaggaaagagauguuccccugagcuga

SEQ ID NO: 449920 - RNA, 64 nt, Human
uucuggggagccagggagcucaggggacagauaagggaaggacgcccccugacuccaggccccu

SEQ ID NO: 449921 - RNA, 64 nt, Human
ggacacagccuuauuacugcuggggugggauaaggggaaggagaagagggagaauggagcagga

SEQ ID NO: 449922 - RNA, 64 nt, Human
uguccccagagggaggagcaggcaggagagagaggggaaggagguaugaaucccaguccccagg

SEQ ID NO: 449923 - RNA, 64 nt, Human
agaaaagcagucggacucuaccuuaaggagggaugggaaggaaagaguugaguugguuucuuuc

SEQ ID NO: 449924 - RNA, 64 nt, Human
augggaauuuaguuacagugcuuggaaugagaaggggaaggaaagaauuaacaaaugccaagau

SEQ ID NO: 449925 - RNA, 64 nt, Human
aacuaauaaauggacuacaguagcucacguuacagggaaggaggguaggcagggaggcucugug

SEQ ID NO: 449926 - RNA, 64 nt, Human
uuaggauugaaguggcuggaaagagugaugccuggggaaggagauggaguuaugaggguacugu

SEQ ID NO: 449927 - RNA, 64 nt, Human
cugucaggcacugaaugucaggcauugagacauagggaaggaaugguuuguacuaauacagacg

SEQ ID NO: 449928 - RNA, 64 nt, Human
uccccuucccacuccuuccggaguaagguuagaagggaaggaaggaaagaucaaggaaccaagc

SEQ ID NO: 449929 - RNA, 64 nt, Human; identical to SEQ ID NO: 135853

SEQ ID NO: 449930 - RNA, 64 nt, Human; identical to SEQ ID NO: 135859

SEQ ID NO: 449931 - RNA, 64 nt, Human
gugugguggaugggcacccaggaaggguugaccagggaaggaggcagcuaggcuguagauggaa

SEQ ID NO: 449932 - RNA, 64 nt, Human
uugugaagcaauuacugagcagaucaagaucuuugggaaggaacacuaaagauguuuugaauga

SEQ ID NO: 449933 - RNA, 64 nt, Human
uuuaaauggcccaccccaggcagacucagacacagggaaggaggcuuggaauuaggaugggauc

SEQ ID NO: 449934 - RNA, 64 nt, Human
aacucaaaugcugacaggggccagaggagauauggggaaggagcaucagaaaugaggcaagcua

SEQ ID NO: 449935 - RNA, 64 nt, Human
gcccguagcgggaugaucucgguuggugagugcagggaaggaggauguaauuccaucauauaua

SEQ ID NO: 449936 - RNA, 64 nt, Human
gugacucauguuucccuguuucaaagggauccuggggaaggaggggaacaugcuugcaguaucu

SEQ ID NO: 449937 - RNA, 64 nt, Human
gcccagcauguauguaugcacacauugugugugugggaaggacaaagccacucucacaagaaag

SEQ ID NO: 449938 - RNA, 64 nt, Human
gguagggcgauaauuuauauauuuuccacagucagggaaggacucucacuuauuuguuucaaau

SEQ ID NO: 449939 - RNA, 64 nt, Human
cccuucauuuugcuacugauuuuccuuaauuugugggaaggaguaggcaaagaauaugcuuaca

SEQ ID NO: 449940 - RNA, 64 nt, Human
cugugaacccuggaagacagaaggccacuccaaggggaaggaucccucuccucucugccauuuc

SEQ ID NO: 449941 - RNA, 64 nt, Human
augacaucaaagccuugucaagaugguucauauugggaaggagacaguauuuuaagccauuuuc

SEQ ID NO: 449942 - RNA, 64 nt, Human
caacagcccagagcucaggacacuuggcuuuggggggaaggaaacugaggcccagagaggggca

SEQ ID NO: 449943 - RNA, 64 nt, Human
uccugccucagccucucugguagcugggauuacagggaaggaaaauagcuggcauuucuugcug

SEQ ID NO: 449944 - RNA, 64 nt, Human
agaaaagucaggaagguagagagagaaaaagggagggaaggagaaagaaugggaauaaaauaag

SEQ ID NO: 449945 - RNA, 64 nt, Human
ugcagccagggcugggguugccagaggcccuggagggaaggacagucccugcuggggaagaaca

SEQ ID NO: 449946 - RNA, 64 nt, Human; identical to SEQ ID NO: 135819

SEQ ID NO: 449947 - RNA, 64 nt, Human; identical to SEQ ID NO: 135824

SEQ ID NO: 449948 - RNA, 64 nt, Human
cauuucaugaucaguguuaagcauuuuccuccaugggaaggaagcaugggauauagaaaagcga

SEQ ID NO: 449949 - RNA, 64 nt, Human
acuuuucuccacgagcccucuggccacugugggagggaaggacaaggguucccuuggaaaugug

SEQ ID NO: 449950 - RNA, 64 nt, Human
cauucagucgcuccucucacgcggcugccuuaucgggaaggaaauuuguuugccaaauaaagac

SEQ ID NO: 449951 - RNA, 64 nt, Human
gggcgaagggcagagcguuuguguguucuggggagggaaggaaaagguguuggaggccuuaauu

SEQ ID NO: 449952 - RNA, 64 nt, Human
uagcaguuagucuucauccccacgugaacaaaaugggaaggagccgugaggagaggagugaggc

SEQ ID NO: 449953 - RNA, 64 nt, Human
auggaaguauaggacguugcuuauuuuaaaacaagggaaggacacaaaauggaaugacugcuua

SEQ ID NO: 449954 - RNA, 64 nt, Human
uguggggaaguguagcaaggacggcugguggagggggaaggagggugcgaggugucugucugau

SEQ ID NO: 449955 - RNA, 64 nt, Human
ccuggccuucucuuggcucaaaggcugggagggagggaaggagagaagaguuccaggcaauccc

SEQ ID NO: 449956 - RNA, 64 nt, Human
ccacaccucuucucauccucagugaugugaaggugggaaggaaaggagcuuggcauugggagcc

SEQ ID NO: 449957 - RNA, 64 nt, Human
ccggcccuccgcacccuggaagcacacggccucugggaaggacagcccugaccuucgguuuucc

SEQ ID NO: 449958 - RNA, 64 nt, Human
acggggugugggaccccagcccggagagaacagagggaaggagccgcgcccccaccuggagcug

SEQ ID NO: 449959 - RNA, 64 nt, Human
gggugucggccugcagccaaguucacugucacgggggaaggagccaccagccaguccucagauu

SEQ ID NO: 449960 - RNA, 64 nt, Human
uaauuaguguucccugugaauucccccccucuaugggaaggaugccuuuacucuuuaucaguaa

SEQ ID NO: 449961 - RNA, 64 nt, Human
cugguuauuguucagacauuccauggugauuccugggaaggaagcuuggcugcucaguuucuga

SEQ ID NO: 449962 - RNA, 64 nt, Human
ucugacuauccauccaucauaaccaccccagccugggaaggagagcuugcuuuuguugcuucag

SEQ ID NO: 449963 - RNA, 64 nt, Human; identical to SEQ ID NO: 135830

SEQ ID NO: 449964 - RNA, 64 nt, Human; identical to SEQ ID NO: 135837

SEQ ID NO: 449965 - RNA, 64 nt, Human; identical to SEQ ID NO: 135844

SEQ ID NO: 449966 - RNA, 64 nt, Human
aaaagcacaccuacccuuuggcguaauccugccugggaaggagagagguuuagugccauguuca

SEQ ID NO: 449967 - RNA, 50 nt, Human; identical to SEQ ID NO: 381257

SEQ ID NO: 449968 - RNA, 64 nt, Human
gcugaccaguggggccuuagcaauuugaaggguugggaaggaggaauuauauuugcaaaggggc

SEQ ID NO: 449969 - RNA, 64 nt, Human
cuucgauuucggcaaagccugggcaggugccaccgggaaggaauggcauccgagaugcugggcg

SEQ ID NO: 449970 - RNA, 64 nt, Human
uuucaaccugcuuacucauuucucaggggauuuugggaaggaaucagcaggugacaguugcuaa

SEQ ID NO: 449971 - RNA, 64 nt, Human
gcaucuuaugaaacagucuuagcagugguagguugggaaggagauagcugcaaccaaaaaagaa

SEQ ID NO: 449972 - RNA, 64 nt, Human
guauuuuuuacuuuucacacugucuucccgaugagggaaggagcccagccagaaagcacuacaa

SEQ ID NO: 449973 - RNA, 64 nt, Human
caacagggaaggggccucucuugaaacaguaguugggaaggaggcagacaugcaccagugaugu

SEQ ID NO: 449974 - RNA, 64 nt, Human
uugcuuccuauuauaaaauggcguggggggaagggggaaggauggagaugggaggagaggguaa

SEQ ID NO: 449975 - RNA, 64 nt, Human
ccgggauagggcagaggaggugcuggcggccccagggaaggaggguguguaccccaaggccccc

SEQ ID NO: 449976 - RNA, 64 nt, Human
cgagccucgcuuuccccacuguucuggagggaaggggaaggagggggucuucaggcuggagcca

SEQ ID NO: 449977 - RNA, 64 nt, Human
gaccccacaaagccuucuggaccuggaaagccuggggaaggacugacagaccccaggaccagcc

SEQ ID NO: 449978 - RNA, 64 nt, Human
gcucaacgagaaggaggcccagcaaguguauggugggaaggaggccaggacgugaguggggcug

SEQ ID NO: 449979 - RNA, 64 nt, Human
auuggagggcagugccagggcauuugcagaagcugggaaggaccaagccucagcaccccagggc

SEQ ID NO: 449980 - RNA, 64 nt, Human
uuuuagaaaaggaaaacgugaacaaacuuagaaagggaaggaaaucccaucagugaauccugaa

SEQ ID NO: 449981 - RNA, 64 nt, Human; identical to SEQ ID NO: 135851

SEQ ID NO: 449982 - RNA, 64 nt, Human; identical to SEQ ID NO: 135858

SEQ ID NO: 449983 - RNA, 64 nt, Human
gguguguaggugguaaaaccuguucuccauaggagggaaggagcagucacugggagagguuacc

SEQ ID NO: 449984 - RNA, 64 nt, Human
caacguggggugauuguauugaucaaaacccacugggaaggacaaagaguuugccgccuuucgg

SEQ ID NO: 449985 - RNA, 64 nt, Human
ugcagcaguccuacuuauugccauguggacuugugggaaggacacgugugacccuuaagaaucc

SEQ ID NO: 449986 - RNA, 64 nt, Human
ccaccagugagaccacggggccacuguggggugagggaaggagcgcuuggagucagagcucuag

SEQ ID NO: 449987 - RNA, 64 nt, Human
ggcucagcgaugcucugggaacccuugggguuuggggaaggacaguguggugugacuauuggcu

SEQ ID NO: 449988 - RNA, 64 nt, Human
aggcuggagcuccaugcacguaguccagaugccugggaaggaacaucucccuuccagcaucugc

SEQ ID NO: 449989 - RNA, 64 nt, Human
uacaguucugaccuuuuuuguccaguuucuuugggggaaggaagacaaagaagguaggaacgga

SEQ ID NO: 449990 - RNA, 64 nt, Human
agauggcuguggcauuuccaaacauccaaaaaaagggaaggauuuaaggaggugaagucggguc

SEQ ID NO: 449991 - RNA, 64 nt, Human
aggucaccccacugaggaugcugcuggcagccuggggaaggagccaguuuuuuuugguuuuuuu

SEQ ID NO: 449992 - RNA, 64 nt, Human
ucccuacaguuugcugcugagcuggaagcugugggggaaggaguugacaggugggcccagugaa

SEQ ID NO: 449993 - RNA, 64 nt, Human
cugguggggcugccaggggagaccccgggagccggggaaggaggccguccaucccgucgacgua

SEQ ID NO: 449994 - RNA, 64 nt, Human
cuuuggagguauagaaggaaggaugugguccaacgggaaggaagugaagagucuauugguuuuu

SEQ ID NO: 449995 - RNA, 64 nt, Human
ccacagauuuuggaaacgaccuggacacacuauugggaaggagauguggacggccugucuccuc

SEQ ID NO: 449996 - RNA, 64 nt, Human
aggccagcucgcuccaaaacccuuggggaguagagggaaggagcaggccgcgugucacacccau

SEQ ID NO: 449997 - RNA, 64 nt, Human
ggaggauuucaguuaggucucccauuuggcugaugggaaggaggcccaguguugcagggaggca

SEQ ID NO: 449998 - RNA, 64 nt, Human; identical to SEQ ID NO: 185676

SEQ ID NO: 449999 - RNA, 64 nt, Human; identical to SEQ ID NO: 185683

SEQ ID NO: 450000 - RNA, 64 nt, Human
aggcaggggauuguaguagcagcugaccugaguggggaaggaaggaggauuucaguuaggucuc

SEQ ID NO: 450001 - RNA, 64 nt, Human
guucccucgucccugcccaggucucuugucucuugggaaggaacugauaggucgggccauuguu

SEQ ID NO: 450002 - RNA, 64 nt, Human
gggguggggguuguuaaggaugcuggggggccuggggaaggaaggaguucagaggaaggguguc

SEQ ID NO: 450003 - RNA, 64 nt, Human
gaaaguagaagucuguccgucuaugaacaugcgggggaaggauccggaaccaggacccagaagc

SEQ ID NO: 450004 - RNA, 64 nt, Human
aaauuagaagaaucaaaaagugauagaauauugggggaaggagggcagacuccaucguuuccuc

SEQ ID NO: 450005 - RNA, 64 nt, Human
aucacuccccacaguggaugccuuagaagggagagggaaggagggaggcaggcauagcaucuga

SEQ ID NO: 450006 - RNA, 64 nt, Human
ucuuucuccuuuuugcuuucuuaccccugaaagagggaaggacaagucaccucauaacuucugc

SEQ ID NO: 450007 - RNA, 64 nt, Human
cuugcugguggucaggaggcauagggaggcaggagggaaggaagcuuuaccuguaaaauggugu

SEQ ID NO: 450008 - RNA, 64 nt, Human
aauaacucuguacuuugguuucagggugacauuugggaaggauuuuguuuagaauuaauggagu

SEQ ID NO: 450009 - RNA, 64 nt, Human
gaggauuucuugagauuugauggaagugggaguugggaaggauucaccauacuuguguucuccu

SEQ ID NO: 450010 - RNA, 64 nt, Human
uguugggaaaggccacuuugcucgcaggggugaggggaaggauagagaaucuauuuuuaauaaa

SEQ ID NO: 450011 - RNA, 64 nt, Human
aagaagccaauggaaaugaaagagauuggcaaaggggaaggaugaugccauguagauccuguuu

SEQ ID NO: 450012 - RNA, 64 nt, Human
ggggagaggugagucuggaauuuuggucacaagagggaaggacuuggagaggagaauuaguuuu

SEQ ID NO: 450013 - RNA, 64 nt, Human
gcgguggcggucacucccucugccacuauccccagggaaggaaaggcuccgccauuugggaaag

SEQ ID NO: 450014 - RNA, 64 nt, Human
gacauaauuuauaccaaguuaugccaguuggggagggaaggacuaaaaauaauauugcaggcag

SEQ ID NO: 450015 - RNA, 64 nt, Human; identical to SEQ ID NO: 11976

SEQ ID NO: 450016 - RNA, 64 nt, Human; identical to SEQ ID NO: 112531

SEQ ID NO: 450017 - RNA, 64 nt, Human; identical to SEQ ID NO: 129640

SEQ ID NO: 450018 - RNA, 64 nt, Human
ucccuuccuacuccuuuugguuuuguggggagaggggaaggaucagggggccaggccagcagcu

SEQ ID NO: 450019 - RNA, 64 nt, Human
agcugaggucgccggcgccuuuuucuuuuuagaugggaaggaggccaggaaagggucagcuuaa

SEQ ID NO: 450020 - RNA, 64 nt, Human
acuuggcuuccuuccuggcaaggaccaggcaguggggaaggaggagguccuccgugguacauac

SEQ ID NO: 450021 - RNA, 64 nt, Human
ugugugccaugucacagcauggccucucggccuugggaaggaaggcagugccugcucugcugug

SEQ ID NO: 450022 - RNA, 64 nt, Human
uuggggucacaggagaagaaagcgggacuuuggugggaaggagucacacgguaaaugggcgaaa

SEQ ID NO: 450023 - RNA, 64 nt, Human
ggguccaggggaugggagguugugggcauugauggggaaggaggcuggcuuguccccuccucac

SEQ ID NO: 450024 - RNA, 64 nt, Human
uacuugaugccuucucugugagcaguggcucugugggaaggagggagccgggagccugguggga

SEQ ID NO: 450025 - RNA, 64 nt, Human
acuggaagucccauuauggauguugaaauggacagggaaggacucuggaagucucuuccuccuc

SEQ ID NO: 450026 - RNA, 64 nt, Human
guuguuuuuguuuuguuuuguucuguuuagguuugggaaggauuuuguauauuuuucccccugg

SEQ ID NO: 450027 - RNA, 64 nt, Human
guugccgcagugucaccucaguggaccagccugggggaaggagcuuaauugcugagacauuaau

SEQ ID NO: 450028 - RNA, 64 nt, Human
caggcucugaccaggcagaacaggcaagaggggagggaaggagaccccugcaggcucccuccac

SEQ ID NO: 450029 - RNA, 64 nt, Human
gucccacguauuuucuuuuuugucaguauuguuugggaaggagacaugccgggaugugucaucg

SEQ ID NO: 450030 - RNA, 64 nt, Human
uguauaucaaaaucauguaguuuguauaaaaugugggaaggauuuauuuacaguguguuguaau

SEQ ID NO: 450031 - RNA, 64 nt, Human
aacuccccuguuucaaucacuguccuccacacaagggaaggacagaaaggagaguggccauucu

SEQ ID NO: 450032 - RNA, 64 nt, Human
aaguagaaaaguggcauuuucuugauuggaaagggggaaggaucuuauugcacuugggcuguuc

SEQ ID NO: 450033 - RNA, 64 nt, Human; identical to SEQ ID NO: 185281

SEQ ID NO: 450034 - RNA, 64 nt, Human; identical to SEQ ID NO: 37010

SEQ ID NO: 450035 - RNA, 64 nt, Human; identical to SEQ ID NO: 37029

SEQ ID NO: 450036 - RNA, 64 nt, Human
ugcugccaguggccucuucugggugccaggagaggggaaggaccuuugucugggcguuaccaag

SEQ ID NO: 450037 - RNA, 64 nt, Human
ccggaguucaguuuuaccagaugaugggggaggggggaaggaguuuuauguuaaaccauccaug

SEQ ID NO: 450038 - RNA, 64 nt, Human
gccuugauugguguugccaguuguccuccuuccggggaaggauuuugcaguucuuuggcugaaa

SEQ ID NO: 450039 - RNA, 64 nt, Human
ccaaagugggggguggacacagaagucccuaggagggaaggagcuguuggggcagggguguaaa

SEQ ID NO: 450040 - RNA, 64 nt, Human
cgguacuuggcgcuuuguuuccuggcugaggucugggaaggaauagaaaggggcccccaauuuu

SEQ ID NO: 450041 - RNA, 64 nt, Human
uuaaggggguaguuuuauuuuggugggguugggugggaaggaaggcuggggguuuuguaaagug

SEQ ID NO: 450042 - RNA, 64 nt, Human
ucuaauuccaaaaaguaauuccacuggagcugcugggaaggaaaacgagcucuucugaugcaaa

SEQ ID NO: 450043 - RNA, 64 nt, Human
aagcacuacauuuuaaauucagcauuagugcauugggaaggaucuuuacugcuuugugcuuggc

SEQ ID NO: 450044 - RNA, 64 nt, Human
cuugggaguugugcagggacucuggcccaggcaggggaaggaagaccaggcgguaggggacugg

SEQ ID NO: 450045 - RNA, 64 nt, Human
ggggcuggguacacuggggaauguuagcaagacugggaaggaggccacauuccugucugcagca

SEQ ID NO: 450046 - RNA, 64 nt, Human
auucucaauacuugaauauggaacauaugcacaggggaaggaaauaacauugcacuuuauaaac

SEQ ID NO: 450047 - RNA, 64 nt, Human
agguucccuccaagaagacaaggacaggagacuugggaaggaccaaugguaauuuaaguggcuc

SEQ ID NO: 450048 - RNA, 64 nt, Human
ggccacagaagcuauuaauacacgacagcauguggggaaggacuuauggugggccagguggacc

SEQ ID NO: 450049 - RNA, 64 nt, Human
ucggauggggcgcgccugcgcccucagaacgugugggaaggagggggcguggacaggacacggg

SEQ ID NO: 450050 - RNA, 64 nt, Human
ccgccagccuugcucagcuguggguugcccugcugggaaggagggaaucacguccaccuggguc

SEQ ID NO: 450051 - RNA, 64 nt, Human; identical to SEQ ID NO: 109518

SEQ ID NO: 450052 - RNA, 64 nt, Human; identical to SEQ ID NO: 129758

SEQ ID NO: 450053 - RNA, 64 nt, Human; identical to SEQ ID NO: 185611

SEQ ID NO: 450054 - RNA, 64 nt, Human
ucaagaaggaauugaaauaaggagggacaugauggggaaggaguacaaaacaaucucucaacau

SEQ ID NO: 450055 - RNA, 64 nt, Human
cuuuccuccuuauccuuauuaagucaucugccuggggaaggaguuccacuguuucuuuccuucu

SEQ ID NO: 450056 - RNA, 64 nt, Human
gaaucaugaaagucugggaagcauauggaccagugggaaggauaggauuagcacugcaccucua

SEQ ID NO: 450057 - RNA, 64 nt, Human
agaggugaaggacauggagcagcugcuggcccuugggaaggaggcccgggccugucccuauuac

SEQ ID NO: 450058 - RNA, 64 nt, Human
guggcagaugggagccaaccuggauggggguuuggggaaggagggcauguguagcagagaacuu

SEQ ID NO: 450059 - RNA, 64 nt, Human
gugugggugccaguccuccucaggagaaggggaagggaaggaggccacuuugagagggcugaag

SEQ ID NO: 450060 - RNA, 64 nt, Human
uuacuagaaucauuucauuauuucugcuuccugggggaaggaugcagaaggagucugaugcuca

SEQ ID NO: 450061 - RNA, 64 nt, Human
cuuaucugaucuuccucaaacuucagauagguuagggaaggacaaaggcccccagccaugaagg

SEQ ID NO: 450062 - RNA, 64 nt, Human
aaauuccuagauccuaggaauucagugagacccugggaaggaccagcaugcuaaucagugucag

SEQ ID NO: 450063 - RNA, 64 nt, Human
ggccaaaaugugaggguggugggugggaugggcagggaaggaauccugguggaagucuugggug

SEQ ID NO: 450064 - RNA, 64 nt, Human
uagucuugggaagaaaaguuucuacucagaacuggggaaggaguggaacuuaugacuugggccu

SEQ ID NO: 450065 - RNA, 64 nt, Human
cccccaacccuaucccuccuaccucacccgcagggggaaggagggaggcugacaagccuugaau

SEQ ID NO: 450066 - RNA, 64 nt, Human
ucuuagauuaaagacguugccuuuaauaucuguugggaaggaaauguccagacuuuucaaaucu

SEQ ID NO: 450067 - RNA, 52 nt, Human; identical to SEQ ID NO: 381344

SEQ ID NO: 450068 - RNA, 64 nt, Human
uccuccugccccuuuugcuuuuuuaaagaaacuggggaaggauuuaugaauacaccaccaccag

SEQ ID NO: 450069 - RNA, 64 nt, Human; identical to SEQ ID NO: 37178

SEQ ID NO: 450070 - RNA, 64 nt, Human; identical to SEQ ID NO: 179730

SEQ ID NO: 450071 - RNA, 64 nt, Human; identical to SEQ ID NO: 129860

SEQ ID NO: 450072 - RNA, 64 nt, Human
acauuuaggaacccagaccgaaaaguugcugaaagggaaggagacacauucacaaagaaacguu

SEQ ID NO: 450073 - RNA, 64 nt, Human
gagaaagaacuccucauaggaauacugaagaagugggaaggaaccaagcugacacaggccucac

SEQ ID NO: 450074 - RNA, 64 nt, Human
aucuguguuuuacuugagacauguaaauaugauagggaaggaacugaauuucuccauucauauu

SEQ ID NO: 450075 - RNA, 64 nt, Human
gcagcauagugagaauuauuuaaaauccuucguagggaaggacagcugucuuugcaggggaaau

SEQ ID NO: 450076 - RNA, 64 nt, Human
ccugcauugucuuggaauguaagcacugucuugagggaaggaagaggucuguucuguauugccu

SEQ ID NO: 450077 - RNA, 64 nt, Human
ccucucaaccaucccacuaaguuauagccaagaagggaaggagacacggggauuugggguucuc

SEQ ID NO: 450078 - RNA, 64 nt, Human
gaaucagcagguucucugcccucccuagggguuggggaaggacccaccccggucagcacagugc

SEQ ID NO: 450079 - RNA, 52 nt, Human; identical to SEQ ID NO: 381351

SEQ ID NO: 450080 - RNA, 64 nt, Human
agcaaagcuucuaaaacugggggucggugcucaagggaaggauuugcuaugaccucauagaacc

SEQ ID NO: 450081 - RNA, 64 nt, Human
aggucuggcgucccaaaugaaagaagcaggcaaagggaaggagccccugagaacaaccaaucuc

SEQ ID NO: 450082 - RNA, 64 nt, Human
aacacggagcugggccaucgucagaacuaagucagggaaggagauggaugagaaggccagaauc

SEQ ID NO: 450083 - RNA, 64 nt, Human
cgaaaacagcaaacaagggcaagaaggucugagagggaaggagaaugacauuuacacauuuuac

SEQ ID NO: 450084 - RNA, 64 nt, Human
caaaagaagaggucucccucaauccuccccuuuagggaaggagucaacaguguaacuaaauuuc

SEQ ID NO: 450085 - RNA, 64 nt, Human
ccaaggagaugccacucugcucugccuuacuguugggaaggagagaggaacccacucacucuua

SEQ ID NO: 450086 - RNA, 64 nt, Human
acugacccuggccugugguggucugagcuggggagggaaggacaccaaugaaucagcuugggac

SEQ ID NO: 450087 - RNA, 64 nt, Human; identical to SEQ ID NO: 185366

SEQ ID NO: 450088 - RNA, 64 nt, Human; identical to SEQ ID NO: 37303

SEQ ID NO: 450089 - RNA, 64 nt, Human; identical to SEQ ID NO: 102543

SEQ ID NO: 450090 - RNA, 64 nt, Human
gaagacccagcaccagugaccuccagcugggggugggaaggaaaaaacuggacacugccaucug

SEQ ID NO: 450091 - RNA, 64 nt, Human
gcgccaggccaaggaacaccggccuguuuaugaggggaaggaugguaccaucgaggacaucauc

SEQ ID NO: 450092 - RNA, 64 nt, Human
ggcccuaaggaagcugugaucaucccuagaaagagggaaggagcaggagacgacaggggagggg

SEQ ID NO: 450093 - RNA, 64 nt, Human
cuucuugauuugggccuggugacccaccuggaaugggaaggaugucagcugaccucucaccucc

SEQ ID NO: 450094 - RNA, 64 nt, Human
cccagccuaccccuccugcgcugccccagagccugggaaggaggccgcuaugcaggguagcacu

SEQ ID NO: 450095 - RNA, 64 nt, Human
ucuguagcccccacccuccugccaagcugccucugggaaggaagaaacaggagcuaggcagaag

SEQ ID NO: 450096 - RNA, 54 nt, Human; identical to SEQ ID NO: 381367

SEQ ID NO: 450097 - RNA, 64 nt, Human
ccaacucauguccaauacugcuuugccugguguggggaaggauugggucuugucccccaacaca

SEQ ID NO: 450098 - RNA, 64 nt, Human
uuccucaccaccuagccauagucucaaaccuguggggaaggagguuuucucccugcccgggaag

SEQ ID NO: 450099 - RNA, 64 nt, Human
aacccuugacauacaaggaguuugaaaagcagaagggaaggacaauucaguaucuacaccaguu

SEQ ID NO: 450100 - RNA, 64 nt, Human
gccaguugugcuggcguaaguggcccacaucauggggaaggagugcugugauugacuaguaaug

SEQ ID NO: 450101 - RNA, 64 nt, Human
cuccugaugaguacauguggacucaccugaggaagggaaggaagggaauaaucuuuuauguuuc

SEQ ID NO: 450102 - RNA, 64 nt, Human
cuuccucggagaccccuggggauggggaucuucagggaaggaacucuggccacccaaacaggac

SEQ ID NO: 450103 - RNA, 64 nt, Human
caccucugagccacccaucaccgccaaagugugggggaaggauagcugcagauugacaggcgag

SEQ ID NO: 450104 - RNA, 64 nt, Human
auugucaggacuuccugaaggauuagauguggaagggaaggauaagaaacagaccaaggauaac

SEQ ID NO: 450105 - RNA, 59 nt, Human; identical to SEQ ID NO: 64109

SEQ ID NO: 450106 - RNA, 64 nt, Human; identical to SEQ ID NO: 64116

SEQ ID NO: 450107 - RNA, 64 nt, Human; identical to SEQ ID NO: 64123

SEQ ID NO: 450108 - RNA, 64 nt, Human
uuuaauacuuuaauguuuuaagugugggggguuugggaaggaaggaauguaauauuauggauuu

SEQ ID NO: 450109 - RNA, 64 nt, Human
gggaaagugcuauuuccuauuuucaccaaaauuggggaaggagugccacuuuccagcuccacuu

SEQ ID NO: 450110 - RNA, 64 nt, Human
caaaucagugacccaagggagggggggauuuaaagggaaggagugggcaaaacacauaaaauga

SEQ ID NO: 450111 - RNA, 64 nt, Human
uuuauagcuuuggagacgccuccccaauuccccagggaaggaaacuguuguguccaauccccau

SEQ ID NO: 450112 - RNA, 64 nt, Human
gccacgggauggggugggggagccccaugggccugggaaggagggugcuguggagggggcugca

SEQ ID NO: 450113 - RNA, 64 nt, Human
aggacaaagguagcaagaggauuuccuggcgggugggaaggaauggcuggggcggccaguuuug

SEQ ID NO: 450114 - RNA, 64 nt, Human
gacuguuuuuuucacacaucguugccgcagcggugggaaggaaaggcagauguaaaugaugugu

SEQ ID NO: 450115 - RNA, 64 nt, Human
cuacuacuugggagacaguggaaggaaagauagagggaaggaaguucacucacuugaauuugaa

SEQ ID NO: 450116 - RNA, 64 nt, Human
caagccccucuguccuaugcagaagggcgcucaagggaaggaagugucguugcuguuagagccu

SEQ ID NO: 450117 - RNA, 64 nt, Human
aggauuggagcaaaagagaacuggcaauaaguaggggaaggaagaauuucauuuugcauuggga

SEQ ID NO: 450118 - RNA, 64 nt, Human
uuugcaaaauguuacgcuuuggaccauuuuuccggggaaggagauccagaacuuuuuaccagau

SEQ ID NO: 450119 - RNA, 64 nt, Human
uaccucucaacauuaccaaaaucauuucuuuagagggaaggaauaaucauucaaaugaacuuua

SEQ ID NO: 450120 - RNA, 64 nt, Human
ucuccauuuccagugauuuguuccuaagguagaagggaaggaggauugcagcugggauuaaugu

SEQ ID NO: 450121 - RNA, 64 nt, Human
ucccagaaacguguaaaugaccccgagugugacugggaaggagaacuuauuccuuaccaggaaa

SEQ ID NO: 450122 - RNA, 64 nt, Human
gaauuaaagcuuagacuaaauaguaauauaucgugggaaggauuuugguuuugugauauuucug

SEQ ID NO: 450123 - RNA, 64 nt, Human; identical to SEQ ID NO: 64130

SEQ ID NO: 450124 - RNA, 64 nt, Human; identical to SEQ ID NO: 64137

SEQ ID NO: 450125 - RNA, 64 nt, Human; identical to SEQ ID NO: 64144

SEQ ID NO: 450126 - RNA, 64 nt, Human
aagggggggagcauucgggggaguggggaguggggggaaggaaagcggagacccgagcaggggu

SEQ ID NO: 450127 - RNA, 64 nt, Human
aucaaauuguauucaucauuauuaacauguccuggggaaggaagggaaacuuucuaggacagaa

SEQ ID NO: 450128 - RNA, 64 nt, Human
acacacacacaauggaaugcuauuaagccuuaacgggaaggaaauccuuuuaaagauuuaaacu

SEQ ID NO: 450129 - RNA, 64 nt, Human
ggcccucaggccuggugcugccuuggagggcugggggaaggaguguguggaggagggaggaggg

SEQ ID NO: 450130 - RNA, 64 nt, Human
ggcuacaauuuccuuuaaggcagccccuagcucugggaaggaauacugguagccaguggccagu

SEQ ID NO: 450131 - RNA, 64 nt, Human
gaagagcaacaucauagagugugaauuucuauuugggaaggagaaaauacaagagaaaauuaua

SEQ ID NO: 450132 - RNA, 64 nt, Human
guuccuuaggaagaaaauaacauucuuggguugagggaaggaaugccauacacuacugucucuu

SEQ ID NO: 450133 - RNA, 64 nt, Human
uuuuaaauuaacaauggagagaaugauaagaugagggaaggaaaaggcauucauuauugacuua

SEQ ID NO: 450134 - RNA, 64 nt, Human
ggugauagucagagagugguguuuuuguucaggugggaaggauuggaaacucuagucuuuucua

SEQ ID NO: 450135 - RNA, 64 nt, Human
auggagagcuguccaaccaagagagcgggagggagggaaggagggagggagagagauagagaga

SEQ ID NO: 450136 - RNA, 64 nt, Human
uggaaugggaguuggcgggcagugaacgaguguggggaaggauuggugcuggggcaacaggaag

SEQ ID NO: 450137 - RNA, 64 nt, Human
aagaaacgaaaaagaaagcccaaggcaaagaagggggaaggaaaacaaacuucgccacucucuc

SEQ ID NO: 450138 - RNA, 64 nt, Human
ggaagaaaauggccagggggaaggaaaggugagugggaaggagcagaaagcugggaaaggggau

SEQ ID NO: 450139 - RNA, 64 nt, Human
guuuuagacucugaugaggaagaaaauggccagggggaaggaaaggugagugggaaggagcaga

SEQ ID NO: 450140 - RNA, 64 nt, Human
gcagccacauaaaggcaguguacugggggugggagggaaggaaacaaucacauaaaaucagcug

SEQ ID NO: 450141 - RNA, 64 nt, Human; identical to SEQ ID NO: 64151

SEQ ID NO: 450142 - RNA, 64 nt, Human; identical to SEQ ID NO: 64158

SEQ ID NO: 450143 - RNA, 64 nt, Human; identical to SEQ ID NO: 64165

SEQ ID NO: 450144 - RNA, 64 nt, Human
cuccgugcccuacagaccuuuucucaacgaaugugggaaggaccuggcuuuaaaacacgcacac

SEQ ID NO: 450145 - RNA, 64 nt, Human
gcugaaugccucgcucccuucaagacgaggggcagggaaggacaggacccucaggaauucagug

SEQ ID NO: 450146 - RNA, 64 nt, Human
agucugggccacuugcuuaauugcauuucuggcagggaaggagaggagggauggagaagcucug

SEQ ID NO: 450147 - RNA, 64 nt, Human
ucuccagcuuggaccacacauugcccuuuucucagggaaggaaauggaaacaaaaagccaacag

SEQ ID NO: 450148 - RNA, 64 nt, Human
uccccuaagccagcacugcugcucccuggagcccgggaaggaggcugccuggcuggaggcccga

SEQ ID NO: 450149 - RNA, 64 nt, Human
cgcgcuggggucugggcugugcucccucacuaaagggaaggaaaggaagcugggcguccucugg

SEQ ID NO: 450150 - RNA, 64 nt, Human
cgagggugcguggggccugccccuuggaagggaagggaaggacgguguccuguggagaccagac

SEQ ID NO: 450151 - RNA, 64 nt, Human
uuaaaauaugaauacuguaaaggaaauaaauggugggaaggaaaaguagagaaagaaaugccaa

SEQ ID NO: 450152 - RNA, 64 nt, Human
uaaaaaugcauuaacgucuuuuuauauccaucaagggaaggaugaaauguugaauuugaagacu

SEQ ID NO: 450153 - RNA, 64 nt, Human
cgagcuacacuuuuuuuuuuccuaaauggaaaaugggaaggagauacugucucugaacaaaaau

SEQ ID NO: 450154 - RNA, 64 nt, Human
ccugagggaaauggggcccuaggagggugggggcgggaaggaggggcaaggucuuucaggaacc

SEQ ID NO: 450155 - RNA, 64 nt, Human
uuuuguuguuguuuauuuuugcuuuugugguugagggaaggacaagagauaagagguuguuacc

SEQ ID NO: 450156 - RNA, 64 nt, Human
uaauuugcccuugaauuggaaggaauggagauuagggaaggaaaacuacucuagaggccauuua

SEQ ID NO: 450157 - RNA, 64 nt, Human
uuuccuauggaaguccugcuuuauuccaggugaagggaaggaaguguauauacuuuuggcaagu

SEQ ID NO: 450158 - RNA, 64 nt, Human
acaauaagcaacagaugauauugagugucggguggggaaggaggcccagacucugcuucggcca

SEQ ID NO: 450159 - RNA, 64 nt, Human; identical to SEQ ID NO: 64172

SEQ ID NO: 450160 - RNA, 52 nt, Human; identical to SEQ ID NO: 64179

SEQ ID NO: 450161 - RNA, 64 nt, Human; identical to SEQ ID NO: 64186

SEQ ID NO: 450162 - RNA, 51 nt, Human; identical to SEQ ID NO: 381423

SEQ ID NO: 450163 - RNA, 64 nt, Human
ucccuccccucggagaggcugauucacugggucugggaaggagccuggggauuuuaauuuuuca

SEQ ID NO: 450164 - RNA, 64 nt, Human
agggaaacaguuuauuaaauagaaggauguuuuggggaaggaacuggauaucucuccugcagcc

SEQ ID NO: 450165 - RNA, 64 nt, Human
uuaaaauaugaauacuguaaaggaaauaaacggugggaaggaaaaguagagaaagaaaugccaa

SEQ ID NO: 450166 - RNA, 64 nt, Human
augacuuacuguacaugaaaacacauuuuucuuagggaaggauacaaaagcaugugagacuggu

SEQ ID NO: 450167 - RNA, 64 nt, Human
auauaaauccuguaguuuaaaaggaagaaauggugggaaggaaaaguagagaaagaaaugccaa

SEQ ID NO: 450168 - RNA, 64 nt, Human
gacuuaaccacgaauacccuugaguguccaaauugggaaggaacuuguuucuucuguuauacua

SEQ ID NO: 450169 - RNA, 64 nt, Human
ugcauccugagucagaaguggaaauguccagcaggggaaggacaggcagguggauggugugagc

SEQ ID NO: 450170 - RNA, 64 nt, Human
cccugggacagacgagagggcuccucgcugucuagggaaggacacugaggggcucagggugagg

SEQ ID NO: 450171 - RNA, 64 nt, Human
ugcaguccaggcccgugcuggcgggauugggcaugggaaggagcagggccugcugcuucccugg

SEQ ID NO: 450172 - RNA, 64 nt, Human
ucccaaaggguuuuggguauagccugcccuggaggggaaggaaguccaugcaagcaaagacaug

SEQ ID NO: 450173 - RNA, 64 nt, Human
cuauugauuuuugcuaggguccccgagguaaguggggaaggaaccucccuccuccuuucucccg

SEQ ID NO: 450174 - RNA, 64 nt, Human
ggaagccaguucuaggcuuccaggcgaaagcugagggaaggaagaaacuccccuccccguuccc

SEQ ID NO: 450175 - RNA, 64 nt, Human
ggcgauguccuaggggugcugcauuuugcuuccggggaaggauggacacuuuucagaagucacu

SEQ ID NO: 450176 - RNA, 64 nt, Human
ggcucccagacccucaccucggacaugguggugggggaaggacgggugggcaaggcuggugcgu

SEQ ID NO: 450177 - RNA, 64 nt, Human; identical to SEQ ID NO: 64193

SEQ ID NO: 450178 - RNA, 64 nt, Human; identical to SEQ ID NO: 64200

SEQ ID NO: 450179 - RNA, 64 nt, Human; identical to SEQ ID NO: 64207

SEQ ID NO: 450180 - RNA, 64 nt, Human
gcggccaaaucugucucccuucaugggccucccagggaaggaggaagcccugcugugcagacac

SEQ ID NO: 450181 - RNA, 64 nt, Human
agaccccaaggagcugcagcugaacugcaggggagggaaggaggagcagccugggcugccccuu

SEQ ID NO: 450182 - RNA, 64 nt, Human
aaacaggcugaggagguuccgaggcucaaaggaggggaaggagccccgaggaggcucugaguug

SEQ ID NO: 450183 - RNA, 64 nt, Human
uuuccugcagcucgcuaccuaaguguuucuguaggggaaggagccaauuaagaaaaaguguugg

SEQ ID NO: 450184 - RNA, 56 nt, Human; identical to SEQ ID NO: 381440

SEQ ID NO: 450185 - RNA, 64 nt, Human
ugaggacugaugcagcucuuuacgggucuugagagggaaggacucuuccaaagccccaaagccg

SEQ ID NO: 450186 - RNA, 64 nt, Human
uguccucaaaauacuuccagaagaacaaccagaugggaaggaccuugguugggacucuuuccag

SEQ ID NO: 450187 - RNA, 64 nt, Human
uuuaauugggaucagggcuggggcggggaaacaagggaaggaccuuggaaggggcugcucccag

SEQ ID NO: 450188 - RNA, 64 nt, Human
gcaggagucagcguucaaucuugaccuugaagaugggaaggauguucuuuuuacguaccaauuc

SEQ ID NO: 450189 - RNA, 64 nt, Human
agucugccacccaggauccccaaggcacuugagggggaaggauucugcuggccucugcgagugg

SEQ ID NO: 450190 - RNA, 64 nt, Human
uuggagaaguggcaucagucaacagagaggggcagggaaggagacaccaagcucacccuucguc

SEQ ID NO: 450191 - RNA, 64 nt, Human
ggcaugauggcccauacuuguaaucccagcuauugggaaggaugagaugggaggauggcuugag

SEQ ID NO: 450192 - RNA, 64 nt, Human
ucccaagagaguuuuuaauuguaaaugcauacuugggaaggacuuagaguuuuaaacuguuuuu

SEQ ID NO: 450193 - RNA, 64 nt, Human
gccaggcuugugagaugagaccaagagggaggaggggaaggacuccaugggccaucgugggcca

SEQ ID NO: 450194 - RNA, 64 nt, Human
aaccaggacccaggguccccuccccagcucccuugggaaggacacagcaguauuggacgguuuc

SEQ ID NO: 450195 - RNA, 64 nt, Human; identical to SEQ ID NO: 64214

SEQ ID NO: 450196 - RNA, 64 nt, Human
agccagccacaccaaccacgccagggggaggaaagggaaggacugggagagacacaaagaccag

SEQ ID NO: 450197 - RNA, 64 nt, Human
accugugucuugaagaaguuggcuuucuuuacaugggaaggaaaucaugccaaaaaaauccaaa

SEQ ID NO: 450198 - RNA, 64 nt, Human
auucuuggcucagggccuggguugagggagcuuagggaaggacguccgucugggugcuuuuccu

SEQ ID NO: 450199 - RNA, 64 nt, Human
acguucauuucauuuuauggagggucccagaaaagggaaggaggagccccaggucauacagggc

SEQ ID NO: 450200 - RNA, 53 nt, Human; identical to SEQ ID NO: 381453

SEQ ID NO: 450201 - RNA, 64 nt, Human
aaauguagucccaagcuuucacucgcgaguggaggggaaggauuuaugucaccaguggggauca

SEQ ID NO: 450202 - RNA, 64 nt, Human
ggauuggccuguccccuuucccuuucucggcuaugggaaggaaggauugcucauugguugccuu

SEQ ID NO: 450203 - RNA, 64 nt, Human
ccuucugugggucgcucccagagccauggcccaugggaaggacagaguguguguguccuugggg

SEQ ID NO: 450204 - RNA, 53 nt, Human; identical to SEQ ID NO: 381459

SEQ ID NO: 450205 - RNA, 64 nt, Human
cucauucuuuaucccacucaaucaaaggaacucugggaaggagguugugauugcuggcaagucc

SEQ ID NO: 450206 - RNA, 64 nt, Human
acuggaaaggcugucuggggucuucugacugcaggggaaggauguacuuuccaaacaaaugaua

SEQ ID NO: 450207 - RNA, 64 nt, Human
gagaaggaguaggagcugcugcuggcgcccgagagggaaggagccggccugcugggcagcgugg

SEQ ID NO: 450208 - RNA, 64 nt, Human
ccauuguggcccuggagagucaccagcagcucuugggaaggacuugcugggaggcugagagagg

SEQ ID NO: 450209 - RNA, 64 nt, Human
ugauuauuaccuccggugagaguaauugccugcagggaaggaugaugccagccccggauccggg

SEQ ID NO: 450210 - RNA, 64 nt, Human
cccccggcaggcaccuguggggggugcagcucccgggaaggaggcaacugccucacuuaacauc

SEQ ID NO: 450211 - RNA, 62 nt, Human
uagguccucccacaccugcccccuaauaaagugggcgcgagaggaggcugcuguguguuucc

SEQ ID NO: 450212 - RNA, 62 nt, Human
gcgacucaaccuugggggggggggcggggggagggcgcgaggcuuuuggagcggcugugggu

SEQ ID NO: 450213 - RNA, 64 nt, Human
cccauccaggcccuggccagugugggaccgggacgggaaggaagaaggaggcuaggagcagggg

SEQ ID NO: 450214 - RNA, 64 nt, Human
cccuccucugcccgggagcucaggaaccgaggcagggaaggaucccaugagcuccuuaaggcuc

SEQ ID NO: 450215 - RNA, 64 nt, Human
cagggcccucccagcccauugcugccaagguggagggaaggauaaagccacuucuggcuucagc

SEQ ID NO: 450216 - RNA, 64 nt, Human
ggauaaagccacuucuggcuucagcccccaccaggggaaggaaggagggcacauuaacucccuc

SEQ ID NO: 450217 - RNA, 64 nt, Human
cuaguauuucuggggcuggggggcggggcuggaggggaaggaguguccacgcaucaauaaagau

SEQ ID NO: 450218 - RNA, 64 nt, Human
gcagccuggccagcagcucagagugcaccgaggagggaaggauggcuaagcugggaccggcagu

SEQ ID NO: 450219 - RNA, 64 nt, Human
uggcuuccugggagaugagccgcgaccagguccugggaaggacuauggacucuuguugugugga

SEQ ID NO: 450220 - RNA, 64 nt, Human
agaggccuggguuacacagccugagucacaacgugggaaggaaucucugccacgggaaaggugg

SEQ ID NO: 450221 - RNA, 64 nt, Human
uaaaccuugagaaucuccaagagaaaaauauuuggggaaggagggaggaaauaugucccuugca

SEQ ID NO: 450222 - RNA, 64 nt, Human
ggcaggguccuggccagcagugugggagcaggaggggaaggauaguucuguguacuccuuuagg

SEQ ID NO: 450223 - RNA, 64 nt, Human
aggauugagaagggacaagccaccuugaccguaggggaaggaggaaugugggcugggggaagau

SEQ ID NO: 450224 - RNA, 64 nt, Human
gauguaauuuuugcucuagagagaagcaaguggugggaaggagguagcaugacguguggugugc

SEQ ID NO: 450225 - RNA, 64 nt, Human
uccaccgccucaguguagggaaggguccaggccagggaaggagcacccucuaguggaggcgggg

SEQ ID NO: 450226 - RNA, 64 nt, Human
ugauggaauugauuuucccugaguggagugcugggggaaggaggagguccaggccgguaguggc

SEQ ID NO: 450227 - RNA, 64 nt, Human
guagaggagcuauguggagcaaaggccgacagaggggaaggaauggaccugugagaggaaggga

SEQ ID NO: 450228 - RNA, 64 nt, Human; identical to SEQ ID NO: 116547

SEQ ID NO: 450229 - RNA, 64 nt, Human; identical to SEQ ID NO: 116554

SEQ ID NO: 450230 - RNA, 64 nt, Human; identical to SEQ ID NO: 116561

SEQ ID NO: 450231 - RNA, 64 nt, Human
uaaaaaagaguguccuggcaguuaucuugagguggggaaggaggugaugaaacauuaguuugug

SEQ ID NO: 450232 - RNA, 64 nt, Human
uggguucugccuuaaauugggaggacuccaagccgggaaggaaaauucccuuuuccaaccugua

SEQ ID NO: 450233 - RNA, 64 nt, Human
uccagcacggggugaacggaggcccagaguacuagggaaggaggaagggaggacaugccucuuc

SEQ ID NO: 450234 - RNA, 64 nt, Human
gaugaaugaagcaaaugucaugcugccuuauucagggaaggaggagccuguccugccuguggcc

SEQ ID NO: 450235 - RNA, 64 nt, Human
cacugaucuggagaucugcagaucuggaggagacgggaaggagucgauucuuaaauaaggauca

SEQ ID NO: 450236 - RNA, 64 nt, Human
aaaguuagauguagccaaggaaaguagugaucacgggaaggacugcucugagccggguaggaug

SEQ ID NO: 450237 - RNA, 64 nt, Human
ucugcuuucuuuccccagggcugggccauggggagggaaggacuuucucccaggggaagccccc

SEQ ID NO: 450238 - RNA, 64 nt, Human
uggaaccuugagaacccagggacgagccagugccgggaaggaacugccgggacucaccgagcug

SEQ ID NO: 450239 - RNA, 64 nt, Human
gagccaggccccgagggugagcgagauggagaaggggaaggaaggggcuuugggaucuggaaac

SEQ ID NO: 450240 - RNA, 64 nt, Human
ugggcucuggaccucaggagggcaggcugagguggggaaggagggacuuggcuguccuuccccu

SEQ ID NO: 450241 - RNA, 64 nt, Human
guuaaagcagcagugccaauaaugagacccagcugggaaggacucggugauacccacugggauc

SEQ ID NO: 450242 - RNA, 64 nt, Human
ucucgggaauuuucaucuaggauuuuaagggaaggggaaggauagggugauguuccgaagguga

SEQ ID NO: 450243 - RNA, 64 nt, Human
ugcccucugagaaaaggcaugguuucuuaauugagggaaggaagcagauucggagggguggaga

SEQ ID NO: 450244 - RNA, 64 nt, Human
ccaugggaucuugagggaccaagcugcugggauugggaaggaguuucacccugaccauugcccu

SEQ ID NO: 450245 - RNA, 64 nt, Human
uguccuuuggagggugucuucuggguagagggaugggaaggaagggacccuuacccccggcucu

SEQ ID NO: 450246 - RNA, 64 nt, Human; identical to SEQ ID NO: 116568

SEQ ID NO: 450247 - RNA, 64 nt, Human; identical to SEQ ID NO: 116575

SEQ ID NO: 450248 - RNA, 64 nt, Human; identical to SEQ ID NO: 116582

SEQ ID NO: 450249 - RNA, 64 nt, Human
gucccagaggaacgcuggagccaagagaagcccugggaaggagggguggggaacgacaugcaug

SEQ ID NO: 450250 - RNA, 64 nt, Human
aguguggguucuaaguacaggcauucaaggcugggggaaggaaagcuacgccauccuuccuuag

SEQ ID NO: 450251 - RNA, 64 nt, Human
gggaaucagaccuacuccccuaggucacaacucugggaaggauacagagcccccacccuucacu

SEQ ID NO: 450252 - RNA, 64 nt, Human
uagcccagacucugagcugcucaccggagucauugggaaggaaaaguggagaaauggcaagucu

SEQ ID NO: 450253 - RNA, 64 nt, Human
gcucugccuugcaucacccucagccuaagggagugggaaggaaaugggguguuuucuugcugac

SEQ ID NO: 450254 - RNA, 64 nt, Human
cccugaaccacugugugcccauuuccuagggaaggggaaggagaauaaacagaauauuuauuac

SEQ ID NO: 450255 - RNA, 64 nt, Human
cccuuccccggggcugagagggugaaaguguguggggaaggagaggacugguuuccuggguucu

SEQ ID NO: 450256 - RNA, 64 nt, Human
uggagcagcagcugaggccccagggcuguggguggggaaggaaggcguguccaggagaccuucc

SEQ ID NO: 450257 - RNA, 64 nt, Human
ugccacgaagagcugggcaggccugcaggguguggggaaggaggacacaaccucaagaaaggaa

SEQ ID NO: 450258 - RNA, 64 nt, Human
ccugucacaucugacuguggguuucaagugggaagggaaggaguucuacuugucuugacaccau

SEQ ID NO: 450259 - RNA, 64 nt, Human
ggccuguggggagccgagggcgucagagagacccgggaaggaaggcucucgggugggggagcca

SEQ ID NO: 450260 - RNA, 64 nt, Human
aggggugguagucagaggagggaggaggaauaaggggaaggaagagagagggagcaggcggagc

SEQ ID NO: 450261 - RNA, 64 nt, Human
agacugcccuucucacgggcucuaugccugcacugggaaggaaacaaauguguauaaacugcug

SEQ ID NO: 450262 - RNA, 64 nt, Human
aggagauacuacaugggagggggacacagaaaaagggaaggaaauuggcuagucuggcuuuuuu

SEQ ID NO: 450263 - RNA, 64 nt, Human
uggcuuaaaagcaggauugaagaaaagggacugggggaaggaaacuuauuggaaaacuugaugc

SEQ ID NO: 450264 - RNA, 64 nt, Human; identical to SEQ ID NO: 116589

SEQ ID NO: 450265 - RNA, 64 nt, Human; identical to SEQ ID NO: 116596

SEQ ID NO: 450266 - RNA, 64 nt, Human; identical to SEQ ID NO: 116603

SEQ ID NO: 450267 - RNA, 64 nt, Human
uggaaggggaaaagucagggccuucccggcgggggggaaggaggugggcaucgggggcaugggg

SEQ ID NO: 450268 - RNA, 64 nt, Human
ccagcuaagcauaguaagaaguccagccuaggaagggaaggauuuuggagguagguggcuuugg

SEQ ID NO: 450269 - RNA, 64 nt, Human
ucaggcccugggaggcucagccaccuccucuugugggaaggaggucucagccccaccucgcauc

SEQ ID NO: 450270 - RNA, 64 nt, Human
ccuccacucccgaguggccacaggcucgcgggcugggaaggauucacucucuuuagccccaggg

SEQ ID NO: 450271 - RNA, 64 nt, Human
gccuuguguuuccagcggccucugauaagaggcagggaaggaccugaaggauuuggaguugauu

SEQ ID NO: 450272 - RNA, 64 nt, Human
cucauuuguaagaauagcuacacacuaacauuuugggaaggagaggcacauaacuuuuuuuaac

SEQ ID NO: 450273 - RNA, 64 nt, Human
ucacugagauuuuaaaaauuucaccuuuauucgagggaaggaucaaugcuuauuaccauuugga

SEQ ID NO: 450274 - RNA, 64 nt, Human
cauccggggacccacuguugcccuggaccucagcgggaaggagcaggagagagcugcugucagu

SEQ ID NO: 450275 - RNA, 64 nt, Human
cucuccaugugcauuggggacaguuuuuauaagugggaaggacucaguauuauuauauuugaga

SEQ ID NO: 450276 - RNA, 64 nt, Human
gagagagggagcuggcggugcccagcgcaagggcgggaaggaggggcccaggcugcggagaacc

SEQ ID NO: 450277 - RNA, 64 nt, Human
aguuuuuaaaaugacuacccagaagggcacaagggggaaggaaaugguauuuguauauguauau

SEQ ID NO: 450278 - RNA, 64 nt, Human
aauuguaaauaaauuaaacuuuucugguuucugugggaaggaaauagggaauccaauggaacag

SEQ ID NO: 450279 - RNA, 64 nt, Human
ccacgacccuucuuaagacauguaucacuguagagggaaggaacagaggcccugggcccuuccu

SEQ ID NO: 450280 - RNA, 64 nt, Human
ugcccuugcuugacucaguuucccuccuuugaaagggaaggagcaaaacggccauuugggaugc

SEQ ID NO: 450281 - RNA, 64 nt, Human
uucggggugggggcgucaggugagaacguuugcugggaaggagaggacuuggggcauggccucu

SEQ ID NO: 450282 - RNA, 64 nt, Human; identical to SEQ ID NO: 116610

SEQ ID NO: 450283 - RNA, 64 nt, Human; identical to SEQ ID NO: 116617

SEQ ID NO: 450284 - RNA, 64 nt, Human; identical to SEQ ID NO: 116624

SEQ ID NO: 450285 - RNA, 64 nt, Human
ccuaaguuauucaucuccucuccgccugcugcucgggaaggacagacgccggccgcccgcccgc

SEQ ID NO: 450286 - RNA, 64 nt, Human
acaccuggcccaguccacguugagguccaggacugggaaggaccgggugagugcaccggggacc

SEQ ID NO: 450287 - RNA, 64 nt, Human
uugcccuucccuggcugacccagucgggaagguagggaaggaggucucccguugggagagucuc

SEQ ID NO: 450288 - RNA, 64 nt, Human
ugucucccaccagcggggcccuccuggcaggguagggaaggaggaccccgggcaccccccucag

SEQ ID NO: 450289 - RNA, 64 nt, Human
agugugugugcccaggugggggugucuccuggcugggaaggagggaaagggagggagaguuuug

SEQ ID NO: 450290 - RNA, 64 nt, Human
gccuuccucccccugaccccgccccggccuucuggggaaggaacaaaguccccaaacaaagcaa

SEQ ID NO: 450291 - RNA, 64 nt, Human
agucucguuucuuugccccugaagucaguuucaggggaaggaugugaaauuuuuccguguagag

SEQ ID NO: 450292 - RNA, 64 nt, Human
ugccuuaggagaauuguuuuguuucacaaaagcugggaaggaagaaguccauucugcagcuguu

SEQ ID NO: 450293 - RNA, 64 nt, Human
cugcucucuggagguacugagacagggugcugaugggaaggaggggagccuuuggggggccacc

SEQ ID NO: 450294 - RNA, 64 nt, Human
gaggcccugggcaggauguucacucuauuuauuggggaaggagggaggggggggacacuuaacu

SEQ ID NO: 450295 - RNA, 64 nt, Human
gugggaggggcggggcuaagaaugggggcagugggggaaggaaggggagaggugguuagaggga

SEQ ID NO: 450296 - RNA, 64 nt, Human
uggagcgucccugaagcccccagcccuggggauggggaaggacauggagccugagccagagaac

SEQ ID NO: 450297 - RNA, 64 nt, Human
uggagaguccccaaggcccccagcccuggggauggggaaggacaugaagccugagccagagaac

SEQ ID NO: 450298 - RNA, 64 nt, Human
ugggaucuagggcccugggaggagguugagccuggggaaggaaaaagcaggaaacugaaggaag

SEQ ID NO: 450299 - RNA, 64 nt, Human
ugcuggggaugcaccaaugaaccccacaggaagggggaaggaaggagggaauuucacauucccu

SEQ ID NO: 450300 - RNA, 64 nt, Human; identical to SEQ ID NO: 116631

SEQ ID NO: 450301 - RNA, 64 nt, Human; identical to SEQ ID NO: 116638

SEQ ID NO: 450302 - RNA, 64 nt, Human; identical to SEQ ID NO: 116645

SEQ ID NO: 450303 - RNA, 64 nt, Human
ucuucucauccacccucuggcacccagccucugagggaaggagggauggggcauagugggagac

SEQ ID NO: 450304 - RNA, 64 nt, Human
uguccugcagaggcccuaccacugcgaggccugcgggaaggacuuccucuuuacacccacagag

SEQ ID NO: 450305 - RNA, 64 nt, Human
uuggggagggacugaaggaugcaugcaagguucugggaaggagugagaaguagugaaggccaag

SEQ ID NO: 450306 - RNA, 64 nt, Human
ggggcgcccgcaguggacaggacccgcguggguugggaaggaaagcaguggaacuggccggacc

SEQ ID NO: 450307 - RNA, 64 nt, Human
cgcggagagcgcugaaccuggacaagcagcggcugggaaggacagguccaauaaacgcccucug

SEQ ID NO: 450308 - RNA, 64 nt, Human
gacccaaagguccugacgguugcguccgggggaggggaaggaagggccgcugucgccaagguuu

SEQ ID NO: 450309 - RNA, 64 nt, Human
ggcaggaaggaauggggggccccagccccaggccgggaaggagccagcggccgacaaagcagaa

SEQ ID NO: 450310 - RNA, 64 nt, Human
gcaaggccaacagggcaggggaggggaagaccuggggaaggaagaaugaggacagucccgucgu

SEQ ID NO: 450311 - RNA, 64 nt, Human
gcugagcguuccagguaaacugaggcucggggaggggaaggacaggcuggccucuccuucacug

SEQ ID NO: 450312 - RNA, 64 nt, Human
cgccaggcagaggucucaucugaaggccugaucggggaaggauuugcuucuuagaagcucaugu

SEQ ID NO: 450313 - RNA, 64 nt, Human
uugggccucacccggagcagacgagggcagggcugggaaggauggggagggacauagaggauuc

SEQ ID NO: 450314 - RNA, 64 nt, Human
augacaugaaauugcauggucgagggagucuguggggaaggaagcccagguccuggcugcaacc

SEQ ID NO: 450315 - RNA, 64 nt, Human
ccccagcuguccagagaagggggauucuggaacugggaaggacugauccccagaagcgauggcu

SEQ ID NO: 450316 - RNA, 64 nt, Human
cacaugccuguagucccagcuacucaggaggcuggggaaggaagaucacuuaaggccaugaguu

SEQ ID NO: 450317 - RNA, 64 nt, Human
aagcgccaaccuuccuuucggaguaauccugccugggaaggagagauuuuuagugacauguuca

SEQ ID NO: 450318 - RNA, 64 nt, Human; identical to SEQ ID NO: 116652

SEQ ID NO: 450319 - RNA, 64 nt, Human; identical to SEQ ID NO: 116659

SEQ ID NO: 450320 - RNA, 64 nt, Human; identical to SEQ ID NO: 116666

SEQ ID NO: 450321 - RNA, 64 nt, Human
gccagggcugaggucucaucugaaggcucaacuggggaaggauccacauccagacuaacauagu

SEQ ID NO: 450322 - RNA, 64 nt, Human
caagcugaagaugccuuccuuugggcuggcucgagggaaggaagcagaaguucaaggugaucgu

SEQ ID NO: 450323 - RNA, 64 nt, Human
uggagcguccccaaagcucccagcccuggggacggggaaggacauggagccugagccagagaac

SEQ ID NO: 450324 - RNA, 64 nt, Human
cucaggaauccuguggggaaggggggugauuauagggaaggacgcaggcauuccuaggucccca

SEQ ID NO: 450325 - RNA, 64 nt, Human
aggacagagaagggacgggguggcugggcagucagggaaggagggucgcccggauccgacauuu

SEQ ID NO: 450326 - RNA, 64 nt, Human
ccagaacauguugugugcuggggaugagaaguacgggaaggauuccugccaggugaggugaccc

SEQ ID NO: 450327 - RNA, 64 nt, Human
uggauggcugggcuauggguccugcccuugagcagggaaggaacuuacugucuaauauaggaaa

SEQ ID NO: 450328 - RNA, 64 nt, Human
uuuucaggacagagugcacaguuuccucuccugugggaaggagaguugacucuugaggaccccc

SEQ ID NO: 450329 - RNA, 64 nt, Human
gagcaugguuucaggaguuuauuuuaagacugcugggaaggaaacaggccccauuuuguauaua

SEQ ID NO: 450330 - RNA, 64 nt, Human
cagcugcaccccucccuuccuggagggauggccagggaaggagaaaacagagaacugacaccuu

SEQ ID NO: 450331 - RNA, 64 nt, Human
cugucucugccuucucugaugggacuggaguugagggaaggagcuguauuguggcacuucugaa

SEQ ID NO: 450332 - RNA, 64 nt, Human
caugacaagagauuuugcguuugacauugugucugggaaggaagggccagaccuuggaaccuuu

SEQ ID NO: 450333 - RNA, 64 nt, Human
uuggggaagacagcauuccacagccuggucaggagggaaggaccucacuuguuucaucaaaugg

SEQ ID NO: 450334 - RNA, 64 nt, Human
gagagugcacugcaugauagcguucuggugagcugggaaggacccaccacugccacugaggauu

SEQ ID NO: 450335 - RNA, 64 nt, Human
cagggguucuugagccagccaggcccugccaguggggaaggaggccaagcagugccugccuaug

SEQ ID NO: 450336 - RNA, 64 nt, Human; identical to SEQ ID NO: 116693

SEQ ID NO: 450337 - RNA, 64 nt, Human; identical to SEQ ID NO: 116700

SEQ ID NO: 450338 - RNA, 64 nt, Human; identical to SEQ ID NO: 116707

SEQ ID NO: 450339 - RNA, 64 nt, Human
gacgugaugccaggaccagucccagagcaggaaugggaaggaugaagggcccgagaacauggcc

SEQ ID NO: 450340 - RNA, 64 nt, Human
ccacugugaggagagggguugccccagaaggcaggggaaggaccugaugagaacagaauagcug

SEQ ID NO: 450341 - RNA, 64 nt, Human
agugccauguaaauccccacugggaccaacccuggggaaggagccaguuugccggauacaaacu

SEQ ID NO: 450342 - RNA, 64 nt, Human
gcuacaucuuguuuucuaggaagagggggaugcugggaaggaaugggugcuuugugauggauaa

SEQ ID NO: 450343 - RNA, 64 nt, Human
accacuguacaaaugacacugcacuaggauuauugggaaggaaucauuguuccaggcauccauc

SEQ ID NO: 450344 - RNA, 64 nt, Human
cuuugccaugggccugcugcgucagaccaguacugggaaggaggacgguuguaagcaguuguua

SEQ ID NO: 450345 - RNA, 64 nt, Human
aauaaaauuggaacgaagaaagguuaggagaguagggaaggaacaggacugcaaaaauccuucu

SEQ ID NO: 450346 - RNA, 64 nt, Human
cuaauuuggcacccuuccaaccugaguauuguaggggaaggaaauuuacaagauuuaauaggaa

SEQ ID NO: 450347 - RNA, 64 nt, Human
acccgccuuucccuguucccuucuaagcacguuugggaaggaacagccuaaagaugcuuuguaa

SEQ ID NO: 450348 - RNA, 64 nt, Human
aacauguggggugcccucuguaggccuucacacagggaaggaagcccuacccuuucaacuccug

SEQ ID NO: 450349 - RNA, 64 nt, Human
cucugucucuuuuccuuaaaauuggggguaaggagggaaggaagagggaaagagaugacuaacu

SEQ ID NO: 450350 - RNA, 64 nt, Human
cccugcuaggcaugcaggggcuggcgguuggcaggggaaggaggcccagugagccgggucccuu

SEQ ID NO: 450351 - RNA, 64 nt, Human
cuggcuaccgcuaggaggcugagcaagccaggaagggaaggagucugugugguguguaugugca

SEQ ID NO: 450352 - RNA, 64 nt, Human
ugagaucacagccuccagggccccccaaaucccagggaaggacuuggagagaaucaugcuguug

SEQ ID NO: 450353 - RNA, 64 nt, Human
uucuccacacucauuucagagccuccuaugguuugggaaggaauaacacacuggcccauuagua

SEQ ID NO: 450354 - RNA, 64 nt, Human; identical to SEQ ID NO: 116714

SEQ ID NO: 450355 - RNA, 64 nt, Human; identical to SEQ ID NO: 116721

SEQ ID NO: 450356 - RNA, 64 nt, Human; identical to SEQ ID NO: 116728

SEQ ID NO: 450357 - RNA, 64 nt, Human
ggagagaaagggcuuccaggccccuccaagccuggggaaggacguggcauccaagcugagccag

SEQ ID NO: 450358 - RNA, 64 nt, Human
uaaacucuucagcgggguagcaucaaaguucuuggggaaggaucguauaugugggucccuuccc

SEQ ID NO: 450359 - RNA, 64 nt, Human
aaucucugggccaagaucacaugcaggauaccaugggaaggagccaucuccacucuccuucucc

SEQ ID NO: 450360 - RNA, 64 nt, Human
caacaggagucagcaaucaaagaugaguccuggagggaaggaggaugaguccugggaggaagua

SEQ ID NO: 450361 - RNA, 64 nt, Human
uccuuucacagccggucucucugccaggaaaugggggaaggaacuagaaccaccugcaccuuga

SEQ ID NO: 450362 - RNA, 64 nt, Human
uggcaacccucagcugccucaucguggcugggaagggaaggaagcaagccggcagaaauagcua

SEQ ID NO: 450363 - RNA, 64 nt, Human
agccaccuacugccccaccucagagaagugcagcgggaaggaggcuggagguggugcggcgcug

SEQ ID NO: 450364 - RNA, 64 nt, Human
acuugcugccuuaucgucugcaaguguucuccaagggaaggaggaggaaacugugguguuccuu

SEQ ID NO: 450365 - RNA, 64 nt, Human
caaaugcaaaaacucuuugagaggguaggagggugggaaggaaacaaccaugucauuucagaag

SEQ ID NO: 450366 - RNA, 64 nt, Human
gaagauggaaggccuuuugcccguugagguagaggggaaggaaaucuccucuuuuguacccaau

SEQ ID NO: 450367 - RNA, 64 nt, Human
gagagguccucaguguguuuuuggucugguuguagggaaggacucaaguccuggaauguccucc

SEQ ID NO: 450368 - RNA, 64 nt, Human
gcagggaaaggugcccccacuccccgagagccaggggaaggaguggcucugggcagagagggac

SEQ ID NO: 450369 - RNA, 64 nt, Human
cucaagaggaaugaaaaaagcuuuacuggggcuggggaaggaagccggggaagagauccaaaga

SEQ ID NO: 450370 - RNA, 64 nt, Human
uagaagguacauuuucuuucuacucugaugcauggggaaggauguuuuuggacauuaucaacug

SEQ ID NO: 450371 - RNA, 64 nt, Human
ggauguuaaauuaacucacuaugguuuuucaccugggaaggaaacaaauuacguacuagagggc

SEQ ID NO: 450372 - RNA, 64 nt, Human; identical to SEQ ID NO: 116735

SEQ ID NO: 450373 - RNA, 64 nt, Human; identical to SEQ ID NO: 116742

SEQ ID NO: 450374 - RNA, 64 nt, Human; identical to SEQ ID NO: 116749

SEQ ID NO: 450375 - RNA, 64 nt, Human
gagggcauugacugguuaaaaacuuguguaucccgggaaggaccugcgguacaggagucagcca

SEQ ID NO: 450376 - RNA, 64 nt, Human
gacaccuucugugcucauguuuggaaagcugaaagggaaggacagcugugcccuccugggagcu

SEQ ID NO: 450377 - RNA, 64 nt, Human
guccugaugauucauggaguuugccccuuccuaagggaaggagaucuuuaucuuucugguuggc

SEQ ID NO: 450378 - RNA, 58 nt, Human; identical to SEQ ID NO: 381604

SEQ ID NO: 450379 - RNA, 64 nt, Human
gugucugucugugucugcauguaagagugagggagggaaggaaggaacuacaagagagucggag

SEQ ID NO: 450380 - RNA, 64 nt, Human
uauaggggccgcccaccuucagcugcccugggaugggaaggacccagcccgaccccugggcaua

SEQ ID NO: 450381 - RNA, 64 nt, Human
agagggagagagaaggugacacggauggaagagugggaaggagcuggccuggcucagcccuagg

SEQ ID NO: 450382 - RNA, 64 nt, Human
gagaauccucggggcggucaggggaugucaggaggggaaggagccgcccucccuaucuugcugc

SEQ ID NO: 450383 - RNA, 64 nt, Human
cauuccagcgggccccucucuuuaccuuuguugggggaaggaggcaagagagaaauuccuucuu

SEQ ID NO: 450384 - RNA, 64 nt, Human
cuagucuugaggcccagccuaggaugguagucaggggaaggagcgagauuccaacuucaacauc

SEQ ID NO: 450385 - RNA, 64 nt, Human; identical to SEQ ID NO: 450384

SEQ ID NO: 450386 - RNA, 64 nt, Human
cuguguccuccccagcuucaugccucugucaugggggaaggaauagcuuauguucugcucuggu

SEQ ID NO: 450387 - RNA, 64 nt, Human
ggucccaugaccagcauuaugaaaaugcgagagugggaaggacacagugugagacuuccacuag

SEQ ID NO: 450388 - RNA, 64 nt, Human
gaaagucacucgacauuggucucuuguguugauagggaaggaaaucaggcauuccuauuucuuu

SEQ ID NO: 450389 - RNA, 64 nt, Human
agcgugggaugcuguagcccccgggguugggcaagggaaggaugguggcccuccagaggucaug

SEQ ID NO: 450390 - RNA, 64 nt, Human; identical to SEQ ID NO: 116756

SEQ ID NO: 450391 - RNA, 64 nt, Human; identical to SEQ ID NO: 116763

SEQ ID NO: 450392 - RNA, 64 nt, Human; identical to SEQ ID NO: 116770

SEQ ID NO: 450393 - RNA, 64 nt, Human
caggugaggucugaggacagcaggccuucccuaggggaaggagcugggagugccaaggccccag

SEQ ID NO: 450394 - RNA, 64 nt, Human
guccuggcuucccuugggcuccucagagcuaguggggaaggaggcagucuaggcuguuuugaag

SEQ ID NO: 450395 - RNA, 64 nt, Human
ugaacuugcucugaacugcacccaggaggugacugggaaggagaaaaccagcaaaggaagcucu

SEQ ID NO: 450396 - RNA, 64 nt, Human
caggggugagguucuuggccucagcuccucccuggggaaggaacuagucuuucuccaagaagaa

SEQ ID NO: 450397 - RNA, 64 nt, Human
gauggacgugaggacguguccagcucugcucugugggaaggaguuggaauguucgacagcagug

SEQ ID NO: 450398 - RNA, 64 nt, Human
guggagaaacgcccuccagucugagagcaggggagggaaggaggcagcagaguuggggcagcug

SEQ ID NO: 450399 - RNA, 64 nt, Human
cucuuggggaggcagagaagccaccuucaggccugggaaggaagacacugggaggaggagaggc

SEQ ID NO: 450400 - RNA, 64 nt, Human
aauaugcagucugggaggccccacugcucucacugggaaggaccaauguugcaccucuguuaau

SEQ ID NO: 450401 - RNA, 64 nt, Human
ggauagaaugguuuccacugaggacauucagccugggaaggaggaagucaccagcucgaggcgu

SEQ ID NO: 450402 - RNA, 64 nt, Human
acaccaucaccuuugaaagugcuuguuugggggagggaaggacauacggguaacuagaacuacc

SEQ ID NO: 450403 - RNA, 64 nt, Human
uuacucuuuuagucaggauuucggucuuuucugcgggaaggaauuaagcuauguauuaggucca

SEQ ID NO: 450404 - RNA, 64 nt, Human
ugucacguggcucccccuagccgcacacuagugugggaaggaaaauauugagcuaggcacauua

SEQ ID NO: 450405 - RNA, 64 nt, Human
uucuacuaccccuaguguagcuuugacagagccugggaaggagagacgaggaggcaugccuuca

SEQ ID NO: 450406 - RNA, 64 nt, Human
ugccuuucccaucugucuaucuaucuggcuggcagggaaggaaagaacuugcauguuggugaag

SEQ ID NO: 450407 - RNA, 64 nt, Human
acuucuccacauguuggguguccauccuggggcagggaaggacagaguguuggauggcugggac

SEQ ID NO: 450408 - RNA, 64 nt, Human; identical to SEQ ID NO: 116777

SEQ ID NO: 450409 - RNA, 64 nt, Human; identical to SEQ ID NO: 116784

SEQ ID NO: 450410 - RNA, 64 nt, Human; identical to SEQ ID NO: 116791

SEQ ID NO: 450411 - RNA, 64 nt, Human
aaugggcaacuuucgccccuguggggaggggacggggaaggaagaaagaauuuaaaggaccgga

SEQ ID NO: 450412 - RNA, 64 nt, Human
uucaacuagaaucauagaguucuggauguaaagcgggaaggacauuacagaccauggauauguu

SEQ ID NO: 450413 - RNA, 64 nt, Human
gauaugcccaccccugccaaaagcccugaccccagggaaggaggcugcucacccagccuuggcc

SEQ ID NO: 450414 - RNA, 64 nt, Human
agggaagggacugggaggggagagaagagaaggagggaaggauuuaggaugguaaaguuaggua

SEQ ID NO: 450415 - RNA, 64 nt, Human
cuccauuuauugcuuuugguauaauuuuucccuggggaaggaggggaaauuaugaaagaacuag

SEQ ID NO: 450416 - RNA, 64 nt, Human
uucuuuaucauuccaguggguaggguuuagcugggggaaggacauuucauaaggguuaguugga

SEQ ID NO: 450417 - RNA, 64 nt, Human
ggcugagguuggcucuuagcucauugcuggggaugggaaggagaagcaguggcuuuugugggca

SEQ ID NO: 450418 - RNA, 64 nt, Human
ugccugugucuagagcucugggccucagggguaagggaaggaagccagccuuucagcaccccuu

SEQ ID NO: 450419 - RNA, 64 nt, Human
gaagcagcaguggcagcuugggaaaugugaggaagggaaggagggagagacgggagggaggaga

SEQ ID NO: 450420 - RNA, 64 nt, Human
guccaccuaugucuuuguaucuacauucuugacggggaaggaacuuccucugggaaccuuuggg

SEQ ID NO: 450421 - RNA, 64 nt, Human
gagccaaaauguuucccgguguuugcugguuucagggaaggaguuugauauagcagauuaacca

SEQ ID NO: 450422 - RNA, 64 nt, Human
ucccucugcccuacccgcucagcaacauagaagagggaaggaaagagagaaggaaagagagaga

SEQ ID NO: 450423 - RNA, 64 nt, Human
uacgcaaacugcgccugcuccugaaaagcucucugggaaggaaugggccuggcuuuccguuccu

SEQ ID NO: 450424 - RNA, 64 nt, Human
ggcucauuagcuggcuacaugcuucgcaggaagugggaaggacucacaucauaaaaaggaccau

SEQ ID NO: 450425 - RNA, 64 nt, Human
gcaauuguucaguuggaagacguauuaauauuuggggaaggaaaagaaaguaguuguuuuacaa

SEQ ID NO: 450426 - RNA, 64 nt, Human; identical to SEQ ID NO: 116798

SEQ ID NO: 450427 - RNA, 57 nt, Human; identical to SEQ ID NO: 116805

SEQ ID NO: 450428 - RNA, 64 nt, Human; identical to SEQ ID NO: 116812

SEQ ID NO: 450429 - RNA, 64 nt, Human
ggagucaucucuuccuauauuugguggggugggugggaaggaagggauuugggggggaaucuuc

SEQ ID NO: 450430 - RNA, 64 nt, Human
uauucuggugagaagaaccuuacuuccauaauuugggaaggaauggaagauggacaccaccgga

SEQ ID NO: 450431 - RNA, 64 nt, Human
ccugccccugugggacucauccuugcccaggugagggaaggagacaggaugaggucucgacccu

SEQ ID NO: 450432 - RNA, 64 nt, Human
gugcuuuuucuuaaacuuggccaauuuggaaagggggaaggagccaccccaaaacggugguuca

SEQ ID NO: 450433 - RNA, 64 nt, Human
aaccuggaccccagugagaggcggugggcugacugggaaggagaggcccccaaccuccucagga

SEQ ID NO: 450434 - RNA, 64 nt, Human
ugauuacaacucagcuauaauccugagggaacaugggaaggaaucaaagguaaagcccauucag

SEQ ID NO: 450435 - RNA, 64 nt, Human
cacgaguucagcccauuguacgugcaggucccgugggaaggaggcaaaagccccugcuucuuac

SEQ ID NO: 450436 - RNA, 64 nt, Human
acgccugcuucucccaucgccugucuggcuggcagggaaggaaaauagcuugaauguuggugaa

SEQ ID NO: 450437 - RNA, 64 nt, Human; identical to SEQ ID NO: 449614

SEQ ID NO: 450438 - RNA, 64 nt, Human; identical to SEQ ID NO: 449615

SEQ ID NO: 450439 - RNA, 54 nt, Human; identical to SEQ ID NO: 380960

SEQ ID NO: 450440 - RNA, 64 nt, Human; identical to SEQ ID NO: 449617

SEQ ID NO: 450441 - RNA, 64 nt, Human; identical to SEQ ID NO: 449618

SEQ ID NO: 450442 - RNA, 64 nt, Human; identical to SEQ ID NO: 116819

SEQ ID NO: 450443 - RNA, 64 nt, Human; identical to SEQ ID NO: 116826

SEQ ID NO: 450444 - RNA, 64 nt, Human; identical to SEQ ID NO: 116833

SEQ ID NO: 450445 - RNA, 64 nt, Human; identical to SEQ ID NO: 449619

SEQ ID NO: 450446 - RNA, 64 nt, Human; identical to SEQ ID NO: 449620

SEQ ID NO: 450447 - RNA, 64 nt, Human; identical to SEQ ID NO: 449621

SEQ ID NO: 450448 - RNA, 64 nt, Human; identical to SEQ ID NO: 449622

SEQ ID NO: 450449 - RNA, 64 nt, Human; identical to SEQ ID NO: 449623

SEQ ID NO: 450450 - RNA, 64 nt, Human; identical to SEQ ID NO: 449624

SEQ ID NO: 450451 - RNA, 64 nt, Human; identical to SEQ ID NO: 449625

SEQ ID NO: 450452 - RNA, 64 nt, Human; identical to SEQ ID NO: 449626

SEQ ID NO: 450453 - RNA, 64 nt, Human; identical to SEQ ID NO: 449630

SEQ ID NO: 450454 - RNA, 64 nt, Human; identical to SEQ ID NO: 449631

SEQ ID NO: 450455 - RNA, 64 nt, Human; identical to SEQ ID NO: 449632

SEQ ID NO: 450456 - RNA, 64 nt, Human; identical to SEQ ID NO: 449633

SEQ ID NO: 450457 - RNA, 64 nt, Human; identical to SEQ ID NO: 449634

SEQ ID NO: 450458 - RNA, 64 nt, Human; identical to SEQ ID NO: 449635

SEQ ID NO: 450459 - RNA, 64 nt, Human; identical to SEQ ID NO: 449636

SEQ ID NO: 450460 - RNA, 64 nt, Human; identical to SEQ ID NO: 116840

SEQ ID NO: 450461 - RNA, 64 nt, Human; identical to SEQ ID NO: 116847

SEQ ID NO: 450462 - RNA, 64 nt, Human; identical to SEQ ID NO: 116854

SEQ ID NO: 450463 - RNA, 64 nt, Human; identical to SEQ ID NO: 449637

SEQ ID NO: 450464 - RNA, 64 nt, Human; identical to SEQ ID NO: 449638

SEQ ID NO: 450465 - RNA, 64 nt, Human; identical to SEQ ID NO: 449639

SEQ ID NO: 450466 - RNA, 64 nt, Human; identical to SEQ ID NO: 449640

SEQ ID NO: 450467 - RNA, 64 nt, Human; identical to SEQ ID NO: 449641

SEQ ID NO: 450468 - RNA, 64 nt, Human; identical to SEQ ID NO: 449642

SEQ ID NO: 450469 - RNA, 64 nt, Human; identical to SEQ ID NO: 449643

SEQ ID NO: 450470 - RNA, 64 nt, Human; identical to SEQ ID NO: 449644

SEQ ID NO: 450471 - RNA, 64 nt, Human; identical to SEQ ID NO: 449648

SEQ ID NO: 450472 - RNA, 64 nt, Human; identical to SEQ ID NO: 449649

SEQ ID NO: 450473 - RNA, 64 nt, Human; identical to SEQ ID NO: 449650

SEQ ID NO: 450474 - RNA, 64 nt, Human; identical to SEQ ID NO: 449651

SEQ ID NO: 450475 - RNA, 64 nt, Human; identical to SEQ ID NO: 449652

SEQ ID NO: 450476 - RNA, 64 nt, Human; identical to SEQ ID NO: 449653

SEQ ID NO: 450477 - RNA, 64 nt, Human; identical to SEQ ID NO: 449654

SEQ ID NO: 450478 - RNA, 64 nt, Human; identical to SEQ ID NO: 116861

SEQ ID NO: 450479 - RNA, 64 nt, Human; identical to SEQ ID NO: 116868

SEQ ID NO: 450480 - RNA, 64 nt, Human; identical to SEQ ID NO: 116875

SEQ ID NO: 450481 - RNA, 64 nt, Human; identical to SEQ ID NO: 449655

SEQ ID NO: 450482 - RNA, 64 nt, Human; identical to SEQ ID NO: 449656

SEQ ID NO: 450483 - RNA, 64 nt, Human; identical to SEQ ID NO: 449657

SEQ ID NO: 450484 - RNA, 64 nt, Human; identical to SEQ ID NO: 449658

SEQ ID NO: 450485 - RNA, 64 nt, Human; identical to SEQ ID NO: 449659

SEQ ID NO: 450486 - RNA, 64 nt, Human; identical to SEQ ID NO: 449660

SEQ ID NO: 450487 - RNA, 64 nt, Human; identical to SEQ ID NO: 449661

SEQ ID NO: 450488 - RNA, 64 nt, Human; identical to SEQ ID NO: 449662

SEQ ID NO: 450489 - RNA, 64 nt, Human; identical to SEQ ID NO: 449666

SEQ ID NO: 450490 - RNA, 64 nt, Human; identical to SEQ ID NO: 449667

SEQ ID NO: 450491 - RNA, 64 nt, Human; identical to SEQ ID NO: 449668

SEQ ID NO: 450492 - RNA, 64 nt, Human; identical to SEQ ID NO: 449669

SEQ ID NO: 450493 - RNA, 64 nt, Human; identical to SEQ ID NO: 449670

SEQ ID NO: 450494 - RNA, 64 nt, Human; identical to SEQ ID NO: 449671

SEQ ID NO: 450495 - RNA, 64 nt, Human; identical to SEQ ID NO: 449672

SEQ ID NO: 450496 - RNA, 64 nt, Human; identical to SEQ ID NO: 116882

SEQ ID NO: 450497 - RNA, 64 nt, Human; identical to SEQ ID NO: 116889

SEQ ID NO: 450498 - RNA, 64 nt, Human; identical to SEQ ID NO: 116890

SEQ ID NO: 450499 - RNA, 64 nt, Human; identical to SEQ ID NO: 449673

SEQ ID NO: 450500 - RNA, 64 nt, Human; identical to SEQ ID NO: 449674

SEQ ID NO: 450501 - RNA, 64 nt, Human; identical to SEQ ID NO: 449675

SEQ ID NO: 450502 - RNA, 64 nt, Human; identical to SEQ ID NO: 449676

SEQ ID NO: 450503 - RNA, 64 nt, Human; identical to SEQ ID NO: 449677

SEQ ID NO: 450504 - RNA, 64 nt, Human; identical to SEQ ID NO: 449678

SEQ ID NO: 450505 - RNA, 64 nt, Human; identical to SEQ ID NO: 449679

SEQ ID NO: 450506 - RNA, 64 nt, Human; identical to SEQ ID NO: 449680

SEQ ID NO: 450507 - RNA, 64 nt, Human; identical to SEQ ID NO: 449684

SEQ ID NO: 450508 - RNA, 64 nt, Human; identical to SEQ ID NO: 449685

SEQ ID NO: 450509 - RNA, 64 nt, Human; identical to SEQ ID NO: 449686

SEQ ID NO: 450510 - RNA, 64 nt, Human; identical to SEQ ID NO: 449687

SEQ ID NO: 450511 - RNA, 64 nt, Human; identical to SEQ ID NO: 449688

SEQ ID NO: 450512 - RNA, 64 nt, Human; identical to SEQ ID NO: 449689

SEQ ID NO: 450513 - RNA, 64 nt, Human; identical to SEQ ID NO: 449690

SEQ ID NO: 450514 - RNA, 64 nt, Human; identical to SEQ ID NO: 116886

SEQ ID NO: 450515 - RNA, 64 nt, Human; identical to SEQ ID NO: 116887

SEQ ID NO: 450516 - RNA, 64 nt, Human; identical to SEQ ID NO: 116888

SEQ ID NO: 450517 - RNA, 64 nt, Human; identical to SEQ ID NO: 449691

SEQ ID NO: 450518 - RNA, 64 nt, Human; identical to SEQ ID NO: 449692

SEQ ID NO: 450519 - RNA, 64 nt, Human; identical to SEQ ID NO: 449693

SEQ ID NO: 450520 - RNA, 64 nt, Human; identical to SEQ ID NO: 449694

SEQ ID NO: 450521 - RNA, 64 nt, Human; identical to SEQ ID NO: 449695

SEQ ID NO: 450522 - RNA, 58 nt, Human; identical to SEQ ID NO: 381028

SEQ ID NO: 450523 - RNA, 64 nt, Human; identical to SEQ ID NO: 449697

SEQ ID NO: 450524 - RNA, 64 nt, Human; identical to SEQ ID NO: 449698

SEQ ID NO: 450525 - RNA, 64 nt, Human; identical to SEQ ID NO: 449702

SEQ ID NO: 450526 - RNA, 64 nt, Human; identical to SEQ ID NO: 449703

SEQ ID NO: 450527 - RNA, 64 nt, Human; identical to SEQ ID NO: 449704

SEQ ID NO: 450528 - RNA, 64 nt, Human; identical to SEQ ID NO: 449705

SEQ ID NO: 450529 - RNA, 64 nt, Human; identical to SEQ ID NO: 449706

SEQ ID NO: 450530 - RNA, 64 nt, Human; identical to SEQ ID NO: 449707

SEQ ID NO: 450531 - RNA, 64 nt, Human; identical to SEQ ID NO: 449708

SEQ ID NO: 450532 - RNA, 64 nt, Human; identical to SEQ ID NO: 116897

SEQ ID NO: 450533 - RNA, 64 nt, Human; identical to SEQ ID NO: 116898

SEQ ID NO: 450534 - RNA, 64 nt, Human; identical to SEQ ID NO: 116899

SEQ ID NO: 450535 - RNA, 64 nt, Human; identical to SEQ ID NO: 449709

SEQ ID NO: 450536 - RNA, 64 nt, Human; identical to SEQ ID NO: 449710

SEQ ID NO: 450537 - RNA, 64 nt, Human; identical to SEQ ID NO: 449711

SEQ ID NO: 450538 - RNA, 64 nt, Human; identical to SEQ ID NO: 449712

SEQ ID NO: 450539 - RNA, 64 nt, Human; identical to SEQ ID NO: 449713

SEQ ID NO: 450540 - RNA, 64 nt, Human; identical to SEQ ID NO: 449714

SEQ ID NO: 450541 - RNA, 64 nt, Human; identical to SEQ ID NO: 449715

SEQ ID NO: 450542 - RNA, 64 nt, Human; identical to SEQ ID NO: 449716

SEQ ID NO: 450543 - RNA, 64 nt, Human; identical to SEQ ID NO: 449720

SEQ ID NO: 450544 - RNA, 64 nt, Human; identical to SEQ ID NO: 449721

SEQ ID NO: 450545 - RNA, 64 nt, Human; identical to SEQ ID NO: 449722

SEQ ID NO: 450546 - RNA, 64 nt, Human; identical to SEQ ID NO: 449723

SEQ ID NO: 450547 - RNA, 64 nt, Human; identical to SEQ ID NO: 449724

SEQ ID NO: 450548 - RNA, 64 nt, Human; identical to SEQ ID NO: 449725

SEQ ID NO: 450549 - RNA, 64 nt, Human; identical to SEQ ID NO: 449726

SEQ ID NO: 450550 - RNA, 64 nt, Human; identical to SEQ ID NO: 116900

SEQ ID NO: 450551 - RNA, 64 nt, Human; identical to SEQ ID NO: 116901

SEQ ID NO: 450552 - RNA, 64 nt, Human; identical to SEQ ID NO: 116902

SEQ ID NO: 450553 - RNA, 64 nt, Human; identical to SEQ ID NO: 449727

SEQ ID NO: 450554 - RNA, 64 nt, Human; identical to SEQ ID NO: 449728

SEQ ID NO: 450555 - RNA, 64 nt, Human; identical to SEQ ID NO: 449729

SEQ ID NO: 450556 - RNA, 64 nt, Human; identical to SEQ ID NO: 449730

SEQ ID NO: 450557 - RNA, 64 nt, Human; identical to SEQ ID NO: 449731

SEQ ID NO: 450558 - RNA, 64 nt, Human; identical to SEQ ID NO: 449732

SEQ ID NO: 450559 - RNA, 64 nt, Human; identical to SEQ ID NO: 449733

SEQ ID NO: 450560 - RNA, 64 nt, Human; identical to SEQ ID NO: 449734

SEQ ID NO: 450561 - RNA, 64 nt, Human; identical to SEQ ID NO: 449738

SEQ ID NO: 450562 - RNA, 64 nt, Human; identical to SEQ ID NO: 449739

SEQ ID NO: 450563 - RNA, 64 nt, Human; identical to SEQ ID NO: 449740

SEQ ID NO: 450564 - RNA, 64 nt, Human; identical to SEQ ID NO: 449741

SEQ ID NO: 450565 - RNA, 64 nt, Human; identical to SEQ ID NO: 449742

SEQ ID NO: 450566 - RNA, 64 nt, Human; identical to SEQ ID NO: 449743

SEQ ID NO: 450567 - RNA, 64 nt, Human; identical to SEQ ID NO: 449744

SEQ ID NO: 450568 - RNA, 64 nt, Human; identical to SEQ ID NO: 116903

SEQ ID NO: 450569 - RNA, 64 nt, Human; identical to SEQ ID NO: 116904

SEQ ID NO: 450570 - RNA, 64 nt, Human; identical to SEQ ID NO: 116905

SEQ ID NO: 450571 - RNA, 64 nt, Human; identical to SEQ ID NO: 449745

SEQ ID NO: 450572 - RNA, 64 nt, Human; identical to SEQ ID NO: 449746

SEQ ID NO: 450573 - RNA, 64 nt, Human; identical to SEQ ID NO: 449747

SEQ ID NO: 450574 - RNA, 64 nt, Human; identical to SEQ ID NO: 449748

SEQ ID NO: 450575 - RNA, 64 nt, Human; identical to SEQ ID NO: 449749

SEQ ID NO: 450576 - RNA, 64 nt, Human; identical to SEQ ID NO: 449750

SEQ ID NO: 450577 - RNA, 64 nt, Human; identical to SEQ ID NO: 449751

SEQ ID NO: 450578 - RNA, 64 nt, Human; identical to SEQ ID NO: 449752

SEQ ID NO: 450579 - RNA, 64 nt, Human; identical to SEQ ID NO: 449756

SEQ ID NO: 450580 - RNA, 64 nt, Human; identical to SEQ ID NO: 449757

SEQ ID NO: 450581 - RNA, 64 nt, Human; identical to SEQ ID NO: 449758

SEQ ID NO: 450582 - RNA, 64 nt, Human; identical to SEQ ID NO: 449759

SEQ ID NO: 450583 - RNA, 64 nt, Human; identical to SEQ ID NO: 449760

SEQ ID NO: 450584 - RNA, 64 nt, Human; identical to SEQ ID NO: 449761

SEQ ID NO: 450585 - RNA, 64 nt, Human; identical to SEQ ID NO: 449762

SEQ ID NO: 450586 - RNA, 64 nt, Human; identical to SEQ ID NO: 116906

SEQ ID NO: 450587 - RNA, 64 nt, Human; identical to SEQ ID NO: 116907

SEQ ID NO: 450588 - RNA, 64 nt, Human; identical to SEQ ID NO: 116908

SEQ ID NO: 450589 - RNA, 64 nt, Human; identical to SEQ ID NO: 449763

SEQ ID NO: 450590 - RNA, 64 nt, Human; identical to SEQ ID NO: 449764

SEQ ID NO: 450591 - RNA, 64 nt, Human; identical to SEQ ID NO: 449765

SEQ ID NO: 450592 - RNA, 64 nt, Human; identical to SEQ ID NO: 449766

SEQ ID NO: 450593 - RNA, 64 nt, Human; identical to SEQ ID NO: 449767

SEQ ID NO: 450594 - RNA, 64 nt, Human; identical to SEQ ID NO: 449768

SEQ ID NO: 450595 - RNA, 64 nt, Human; identical to SEQ ID NO: 449769

SEQ ID NO: 450596 - RNA, 64 nt, Human; identical to SEQ ID NO: 449770

SEQ ID NO: 450597 - RNA, 64 nt, Human; identical to SEQ ID NO: 449774

SEQ ID NO: 450598 - RNA, 64 nt, Human; identical to SEQ ID NO: 449775

SEQ ID NO: 450599 - RNA, 64 nt, Human; identical to SEQ ID NO: 449776

SEQ ID NO: 450600 - RNA, 64 nt, Human; identical to SEQ ID NO: 449777

SEQ ID NO: 450601 - RNA, 64 nt, Human; identical to SEQ ID NO: 449778

SEQ ID NO: 450602 - RNA, 64 nt, Human; identical to SEQ ID NO: 449779

SEQ ID NO: 450603 - RNA, 64 nt, Human; identical to SEQ ID NO: 449780

SEQ ID NO: 450604 - RNA, 64 nt, Human; identical to SEQ ID NO: 174549

SEQ ID NO: 450605 - RNA, 53 nt, Human; identical to SEQ ID NO: 174556

SEQ ID NO: 450606 - RNA, 64 nt, Human; identical to SEQ ID NO: 174563

SEQ ID NO: 450607 - RNA, 64 nt, Human; identical to SEQ ID NO: 449781

SEQ ID NO: 450608 - RNA, 64 nt, Human; identical to SEQ ID NO: 449782

SEQ ID NO: 450609 - RNA, 64 nt, Human; identical to SEQ ID NO: 449783

SEQ ID NO: 450610 - RNA, 64 nt, Human; identical to SEQ ID NO: 449784

SEQ ID NO: 450611 - RNA, 64 nt, Human; identical to SEQ ID NO: 449785

SEQ ID NO: 450612 - RNA, 64 nt, Human; identical to SEQ ID NO: 449786

SEQ ID NO: 450613 - RNA, 64 nt, Human; identical to SEQ ID NO: 449787

SEQ ID NO: 450614 - RNA, 64 nt, Human; identical to SEQ ID NO: 449788

SEQ ID NO: 450615 - RNA, 64 nt, Human; identical to SEQ ID NO: 449792

SEQ ID NO: 450616 - RNA, 64 nt, Human; identical to SEQ ID NO: 449793

SEQ ID NO: 450617 - RNA, 64 nt, Human; identical to SEQ ID NO: 449794

SEQ ID NO: 450618 - RNA, 64 nt, Human; identical to SEQ ID NO: 449795

SEQ ID NO: 450619 - RNA, 64 nt, Human; identical to SEQ ID NO: 449796

SEQ ID NO: 450620 - RNA, 64 nt, Human; identical to SEQ ID NO: 449797

SEQ ID NO: 450621 - RNA, 64 nt, Human; identical to SEQ ID NO: 449798

SEQ ID NO: 450622 - RNA, 64 nt, Human; identical to SEQ ID NO: 174570

SEQ ID NO: 450623 - RNA, 64 nt, Human; identical to SEQ ID NO: 174577

SEQ ID NO: 450624 - RNA, 64 nt, Human; identical to SEQ ID NO: 174584

SEQ ID NO: 450625 - RNA, 64 nt, Human; identical to SEQ ID NO: 449799

SEQ ID NO: 450626 - RNA, 64 nt, Human; identical to SEQ ID NO: 449800

SEQ ID NO: 450627 - RNA, 64 nt, Human; identical to SEQ ID NO: 449801

SEQ ID NO: 450628 - RNA, 64 nt, Human; identical to SEQ ID NO: 449802

SEQ ID NO: 450629 - RNA, 64 nt, Human; identical to SEQ ID NO: 449803

SEQ ID NO: 450630 - RNA, 64 nt, Human; identical to SEQ ID NO: 449804

SEQ ID NO: 450631 - RNA, 64 nt, Human; identical to SEQ ID NO: 449805

SEQ ID NO: 450632 - RNA, 64 nt, Human; identical to SEQ ID NO: 449806

SEQ ID NO: 450633 - RNA, 64 nt, Human; identical to SEQ ID NO: 449810

SEQ ID NO: 450634 - RNA, 63 nt, Human; identical to SEQ ID NO: 381122

SEQ ID NO: 450635 - RNA, 64 nt, Human; identical to SEQ ID NO: 449812

SEQ ID NO: 450636 - RNA, 64 nt, Human; identical to SEQ ID NO: 449813

SEQ ID NO: 450637 - RNA, 64 nt, Human; identical to SEQ ID NO: 449814

SEQ ID NO: 450638 - RNA, 64 nt, Human; identical to SEQ ID NO: 449815

SEQ ID NO: 450639 - RNA, 64 nt, Human; identical to SEQ ID NO: 449816

SEQ ID NO: 450640 - RNA, 64 nt, Human; identical to SEQ ID NO: 174591

SEQ ID NO: 450641 - RNA, 64 nt, Human; identical to SEQ ID NO: 174598

SEQ ID NO: 450642 - RNA, 51 nt, Human; identical to SEQ ID NO: 174605

SEQ ID NO: 450643 - RNA, 64 nt, Human; identical to SEQ ID NO: 449817

SEQ ID NO: 450644 - RNA, 64 nt, Human; identical to SEQ ID NO: 449818

SEQ ID NO: 450645 - RNA, 64 nt, Human; identical to SEQ ID NO: 449819

SEQ ID NO: 450646 - RNA, 64 nt, Human; identical to SEQ ID NO: 449820

SEQ ID NO: 450647 - RNA, 64 nt, Human; identical to SEQ ID NO: 449821

SEQ ID NO: 450648 - RNA, 64 nt, Human; identical to SEQ ID NO: 449822

SEQ ID NO: 450649 - RNA, 64 nt, Human; identical to SEQ ID NO: 449823

SEQ ID NO: 450650 - RNA, 64 nt, Human; identical to SEQ ID NO: 449824

SEQ ID NO: 450651 - RNA, 64 nt, Human; identical to SEQ ID NO: 449828

SEQ ID NO: 450652 - RNA, 64 nt, Human; identical to SEQ ID NO: 449829

SEQ ID NO: 450653 - RNA, 64 nt, Human; identical to SEQ ID NO: 449830

SEQ ID NO: 450654 - RNA, 64 nt, Human; identical to SEQ ID NO: 449831

SEQ ID NO: 450655 - RNA, 64 nt, Human; identical to SEQ ID NO: 449832

SEQ ID NO: 450656 - RNA, 64 nt, Human; identical to SEQ ID NO: 449833

SEQ ID NO: 450657 - RNA, 64 nt, Human; identical to SEQ ID NO: 449834

SEQ ID NO: 450658 - RNA, 64 nt, Human; identical to SEQ ID NO: 174612

SEQ ID NO: 450659 - RNA, 64 nt, Human; identical to SEQ ID NO: 174619

SEQ ID NO: 450660 - RNA, 64 nt, Human; identical to SEQ ID NO: 174626

SEQ ID NO: 450661 - RNA, 64 nt, Human; identical to SEQ ID NO: 449835

SEQ ID NO: 450662 - RNA, 64 nt, Human; identical to SEQ ID NO: 449836

SEQ ID NO: 450663 - RNA, 64 nt, Human; identical to SEQ ID NO: 449837

SEQ ID NO: 450664 - RNA, 64 nt, Human; identical to SEQ ID NO: 449838

SEQ ID NO: 450665 - RNA, 64 nt, Human; identical to SEQ ID NO: 449839

SEQ ID NO: 450666 - RNA, 64 nt, Human; identical to SEQ ID NO: 449840

SEQ ID NO: 450667 - RNA, 64 nt, Human; identical to SEQ ID NO: 449841

SEQ ID NO: 450668 - RNA, 64 nt, Human; identical to SEQ ID NO: 449842

SEQ ID NO: 450669 - RNA, 64 nt, Human; identical to SEQ ID NO: 449846

SEQ ID NO: 450670 - RNA, 64 nt, Human; identical to SEQ ID NO: 449847

SEQ ID NO: 450671 - RNA, 64 nt, Human; identical to SEQ ID NO: 449848

SEQ ID NO: 450672 - RNA, 64 nt, Human; identical to SEQ ID NO: 449849

SEQ ID NO: 450673 - RNA, 64 nt, Human; identical to SEQ ID NO: 449850

SEQ ID NO: 450674 - RNA, 64 nt, Human; identical to SEQ ID NO: 449851

SEQ ID NO: 450675 - RNA, 64 nt, Human; identical to SEQ ID NO: 449852

SEQ ID NO: 450676 - RNA, 64 nt, Human; identical to SEQ ID NO: 174633

SEQ ID NO: 450677 - RNA, 64 nt, Human; identical to SEQ ID NO: 174640

SEQ ID NO: 450678 - RNA, 57 nt, Human; identical to SEQ ID NO: 174641

SEQ ID NO: 450679 - RNA, 64 nt, Human; identical to SEQ ID NO: 449853

SEQ ID NO: 450680 - RNA, 64 nt, Human; identical to SEQ ID NO: 449854

SEQ ID NO: 450681 - RNA, 64 nt, Human; identical to SEQ ID NO: 449855

SEQ ID NO: 450682 - RNA, 64 nt, Human; identical to SEQ ID NO: 449856

SEQ ID NO: 450683 - RNA, 64 nt, Human; identical to SEQ ID NO: 449857

SEQ ID NO: 450684 - RNA, 64 nt, Human; identical to SEQ ID NO: 449858

SEQ ID NO: 450685 - RNA, 64 nt, Human; identical to SEQ ID NO: 449859

SEQ ID NO: 450686 - RNA, 64 nt, Human; identical to SEQ ID NO: 449860

SEQ ID NO: 450687 - RNA, 64 nt, Human; identical to SEQ ID NO: 449864

SEQ ID NO: 450688 - RNA, 64 nt, Human; identical to SEQ ID NO: 449865

SEQ ID NO: 450689 - RNA, 64 nt, Human; identical to SEQ ID NO: 449866

SEQ ID NO: 450690 - RNA, 64 nt, Human; identical to SEQ ID NO: 449867

SEQ ID NO: 450691 - RNA, 64 nt, Human; identical to SEQ ID NO: 449868

SEQ ID NO: 450692 - RNA, 64 nt, Human; identical to SEQ ID NO: 449869

SEQ ID NO: 450693 - RNA, 64 nt, Human; identical to SEQ ID NO: 449870

SEQ ID NO: 450694 - RNA, 64 nt, Human; identical to SEQ ID NO: 174642

SEQ ID NO: 450695 - RNA, 64 nt, Human; identical to SEQ ID NO: 174643

SEQ ID NO: 450696 - RNA, 64 nt, Human; identical to SEQ ID NO: 174644

SEQ ID NO: 450697 - RNA, 64 nt, Human; identical to SEQ ID NO: 449871

SEQ ID NO: 450698 - RNA, 64 nt, Human; identical to SEQ ID NO: 449872

SEQ ID NO: 450699 - RNA, 64 nt, Human; identical to SEQ ID NO: 449873

SEQ ID NO: 450700 - RNA, 64 nt, Human; identical to SEQ ID NO: 449874

SEQ ID NO: 450701 - RNA, 64 nt, Human; identical to SEQ ID NO: 449875

SEQ ID NO: 450702 - RNA, 64 nt, Human; identical to SEQ ID NO: 449876

SEQ ID NO: 450703 - RNA, 64 nt, Human; identical to SEQ ID NO: 449877

SEQ ID NO: 450704 - RNA, 64 nt, Human; identical to SEQ ID NO: 449878

SEQ ID NO: 450705 - RNA, 64 nt, Human; identical to SEQ ID NO: 449879

SEQ ID NO: 450706 - RNA, 64 nt, Human; identical to SEQ ID NO: 449880

SEQ ID NO: 450707 - RNA, 64 nt, Human; identical to SEQ ID NO: 449881

SEQ ID NO: 450708 - RNA, 64 nt, Human; identical to SEQ ID NO: 449882

SEQ ID NO: 450709 - RNA, 64 nt, Human; identical to SEQ ID NO: 449883

SEQ ID NO: 450710 - RNA, 64 nt, Human; identical to SEQ ID NO: 449884

SEQ ID NO: 450711 - RNA, 64 nt, Human; identical to SEQ ID NO: 449885

SEQ ID NO: 450712 - RNA, 64 nt, Human
gcacuacccggccggagccgcccaccgucuugggucgcccuacccucacucaagucugucugcc

SEQ ID NO: 450713 - RNA, 64 nt, Human
guggcugccauucccuucuuccuccucaucaccaucgcccuagggaccaagacugaauccuccu

SEQ ID NO: 450714 - RNA, 64 nt, Human; identical to SEQ ID NO: 449886

SEQ ID NO: 450715 - RNA, 64 nt, Human; identical to SEQ ID NO: 449887

SEQ ID NO: 450716 - RNA, 64 nt, Human; identical to SEQ ID NO: 449888

SEQ ID NO: 450717 - RNA, 64 nt, Human; identical to SEQ ID NO: 449889

SEQ ID NO: 450718 - RNA, 64 nt, Human; identical to SEQ ID NO: 449890

SEQ ID NO: 450719 - RNA, 64 nt, Human; identical to SEQ ID NO: 449891

SEQ ID NO: 450720 - RNA, 64 nt, Human; identical to SEQ ID NO: 449892

SEQ ID NO: 450721 - RNA, 64 nt, Human; identical to SEQ ID NO: 449893

SEQ ID NO: 450722 - RNA, 64 nt, Human; identical to SEQ ID NO: 449896

SEQ ID NO: 450723 - RNA, 64 nt, Human; identical to SEQ ID NO: 449897

SEQ ID NO: 450724 - RNA, 64 nt, Human; identical to SEQ ID NO: 449898

SEQ ID NO: 450725 - RNA, 64 nt, Human; identical to SEQ ID NO: 449899

SEQ ID NO: 450726 - RNA, 64 nt, Human; identical to SEQ ID NO: 449900

SEQ ID NO: 450727 - RNA, 64 nt, Human; identical to SEQ ID NO: 449901

SEQ ID NO: 450728 - RNA, 64 nt, Human; identical to SEQ ID NO: 449902

SEQ ID NO: 450729 - RNA, 64 nt, Human
gcauuuuguagaccuuaauacucagguuaaauauucauugcauuuauaagaucuucugcaaaaa

SEQ ID NO: 450730 - RNA, 64 nt, Human
cacccaggcuggagugcaauggcaugaucucgguucauugcaaccuccgccucccgaguucaau

SEQ ID NO: 450731 - RNA, 64 nt, Human
uugugcuagaccgcugcccuacuuaacagcugccucauugcaagggcaguuuuucuugcauggg

SEQ ID NO: 450732 - RNA, 64 nt, Human; identical to SEQ ID NO: 449903

SEQ ID NO: 450733 - RNA, 64 nt, Human; identical to SEQ ID NO: 449904

SEQ ID NO: 450734 - RNA, 64 nt, Human; identical to SEQ ID NO: 449905

SEQ ID NO: 450735 - RNA, 53 nt, Human; identical to SEQ ID NO: 381206

SEQ ID NO: 450736 - RNA, 64 nt, Human; identical to SEQ ID NO: 449907

SEQ ID NO: 450737 - RNA, 64 nt, Human; identical to SEQ ID NO: 449908

SEQ ID NO: 450738 - RNA, 64 nt, Human; identical to SEQ ID NO: 449909

SEQ ID NO: 450739 - RNA, 64 nt, Human; identical to SEQ ID NO: 449910

SEQ ID NO: 450740 - RNA, 64 nt, Human; identical to SEQ ID NO: 449914

SEQ ID NO: 450741 - RNA, 64 nt, Human; identical to SEQ ID NO: 449915

SEQ ID NO: 450742 - RNA, 64 nt, Human; identical to SEQ ID NO: 449916

SEQ ID NO: 450743 - RNA, 64 nt, Human; identical to SEQ ID NO: 449917

SEQ ID NO: 450744 - RNA, 59 nt, Human; identical to SEQ ID NO: 381215

SEQ ID NO: 450745 - RNA, 64 nt, Human; identical to SEQ ID NO: 449919

SEQ ID NO: 450746 - RNA, 64 nt, Human; identical to SEQ ID NO: 449920

SEQ ID NO: 450747 - RNA, 64 nt, Human; identical to SEQ ID NO: 116841

SEQ ID NO: 450748 - RNA, 64 nt, Human; identical to SEQ ID NO: 116842

SEQ ID NO: 450749 - RNA, 64 nt, Human; identical to SEQ ID NO: 116843

SEQ ID NO: 450750 - RNA, 64 nt, Human; identical to SEQ ID NO: 449921

SEQ ID NO: 450751 - RNA, 64 nt, Human; identical to SEQ ID NO: 449922

SEQ ID NO: 450752 - RNA, 64 nt, Human; identical to SEQ ID NO: 449923

SEQ ID NO: 450753 - RNA, 64 nt, Human; identical to SEQ ID NO: 449924

SEQ ID NO: 450754 - RNA, 64 nt, Human; identical to SEQ ID NO: 449925

SEQ ID NO: 450755 - RNA, 64 nt, Human; identical to SEQ ID NO: 449926

SEQ ID NO: 450756 - RNA, 64 nt, Human; identical to SEQ ID NO: 449927

SEQ ID NO: 450757 - RNA, 64 nt, Human; identical to SEQ ID NO: 449928

SEQ ID NO: 450758 - RNA, 64 nt, Human; identical to SEQ ID NO: 449931

SEQ ID NO: 450759 - RNA, 64 nt, Human; identical to SEQ ID NO: 449932

SEQ ID NO: 450760 - RNA, 64 nt, Human; identical to SEQ ID NO: 449933

SEQ ID NO: 450761 - RNA, 64 nt, Human; identical to SEQ ID NO: 449934

SEQ ID NO: 450762 - RNA, 64 nt, Human; identical to SEQ ID NO: 449935

SEQ ID NO: 450763 - RNA, 64 nt, Human; identical to SEQ ID NO: 449936

SEQ ID NO: 450764 - RNA, 64 nt, Human; identical to SEQ ID NO: 449937

SEQ ID NO: 450765 - RNA, 64 nt, Human; identical to SEQ ID NO: 116844

SEQ ID NO: 450766 - RNA, 64 nt, Human; identical to SEQ ID NO: 116845

SEQ ID NO: 450767 - RNA, 64 nt, Human; identical to SEQ ID NO: 116846

SEQ ID NO: 450768 - RNA, 64 nt, Human; identical to SEQ ID NO: 449938

SEQ ID NO: 450769 - RNA, 64 nt, Human; identical to SEQ ID NO: 449939

SEQ ID NO: 450770 - RNA, 64 nt, Human; identical to SEQ ID NO: 449940

SEQ ID NO: 450771 - RNA, 64 nt, Human; identical to SEQ ID NO: 449941

SEQ ID NO: 450772 - RNA, 64 nt, Human; identical to SEQ ID NO: 449942

SEQ ID NO: 450773 - RNA, 64 nt, Human; identical to SEQ ID NO: 449943

SEQ ID NO: 450774 - RNA, 64 nt, Human; identical to SEQ ID NO: 449944

SEQ ID NO: 450775 - RNA, 64 nt, Human; identical to SEQ ID NO: 449945

SEQ ID NO: 450776 - RNA, 64 nt, Human; identical to SEQ ID NO: 449948

SEQ ID NO: 450777 - RNA, 64 nt, Human; identical to SEQ ID NO: 449949

SEQ ID NO: 450778 - RNA, 64 nt, Human; identical to SEQ ID NO: 449950

SEQ ID NO: 450779 - RNA, 64 nt, Human; identical to SEQ ID NO: 449951

SEQ ID NO: 450780 - RNA, 64 nt, Human; identical to SEQ ID NO: 449952

SEQ ID NO: 450781 - RNA, 64 nt, Human; identical to SEQ ID NO: 449953

SEQ ID NO: 450782 - RNA, 64 nt, Human; identical to SEQ ID NO: 449954

SEQ ID NO: 450783 - RNA, 64 nt, Human; identical to SEQ ID NO: 116848

SEQ ID NO: 450784 - RNA, 64 nt, Human; identical to SEQ ID NO: 116849

SEQ ID NO: 450785 - RNA, 64 nt, Human; identical to SEQ ID NO: 116850

SEQ ID NO: 450786 - RNA, 64 nt, Human; identical to SEQ ID NO: 449955

SEQ ID NO: 450787 - RNA, 64 nt, Human; identical to SEQ ID NO: 449956

SEQ ID NO: 450788 - RNA, 64 nt, Human; identical to SEQ ID NO: 449957

SEQ ID NO: 450789 - RNA, 64 nt, Human; identical to SEQ ID NO: 449958

SEQ ID NO: 450790 - RNA, 64 nt, Human; identical to SEQ ID NO: 449959

SEQ ID NO: 450791 - RNA, 64 nt, Human; identical to SEQ ID NO: 449960

SEQ ID NO: 450792 - RNA, 64 nt, Human; identical to SEQ ID NO: 449961

SEQ ID NO: 450793 - RNA, 64 nt, Human; identical to SEQ ID NO: 449962

SEQ ID NO: 450794 - RNA, 64 nt, Human; identical to SEQ ID NO: 449966

SEQ ID NO: 450795 - RNA, 50 nt, Human; identical to SEQ ID NO: 381257

SEQ ID NO: 450796 - RNA, 64 nt, Human; identical to SEQ ID NO: 449968

SEQ ID NO: 450797 - RNA, 64 nt, Human; identical to SEQ ID NO: 449969

SEQ ID NO: 450798 - RNA, 64 nt, Human; identical to SEQ ID NO: 449970

SEQ ID NO: 450799 - RNA, 64 nt, Human; identical to SEQ ID NO: 449971

SEQ ID NO: 450800 - RNA, 64 nt, Human; identical to SEQ ID NO: 449972

SEQ ID NO: 450801 - RNA, 64 nt, Human; identical to SEQ ID NO: 116851

SEQ ID NO: 450802 - RNA, 64 nt, Human; identical to SEQ ID NO: 116852

SEQ ID NO: 450803 - RNA, 64 nt, Human; identical to SEQ ID NO: 116853

SEQ ID NO: 450804 - RNA, 64 nt, Human; identical to SEQ ID NO: 449973

SEQ ID NO: 450805 - RNA, 64 nt, Human; identical to SEQ ID NO: 449974

SEQ ID NO: 450806 - RNA, 64 nt, Human; identical to SEQ ID NO: 449975

SEQ ID NO: 450807 - RNA, 64 nt, Human; identical to SEQ ID NO: 449976

SEQ ID NO: 450808 - RNA, 64 nt, Human; identical to SEQ ID NO: 449977

SEQ ID NO: 450809 - RNA, 64 nt, Human; identical to SEQ ID NO: 449978

SEQ ID NO: 450810 - RNA, 64 nt, Human; identical to SEQ ID NO: 449979

SEQ ID NO: 450811 - RNA, 64 nt, Human; identical to SEQ ID NO: 449980

SEQ ID NO: 450812 - RNA, 64 nt, Human; identical to SEQ ID NO: 449983

SEQ ID NO: 450813 - RNA, 64 nt, Human; identical to SEQ ID NO: 449984

SEQ ID NO: 450814 - RNA, 64 nt, Human; identical to SEQ ID NO: 449985

SEQ ID NO: 450815 - RNA, 64 nt, Human; identical to SEQ ID NO: 449986

SEQ ID NO: 450816 - RNA, 64 nt, Human; identical to SEQ ID NO: 449987

SEQ ID NO: 450817 - RNA, 64 nt, Human; identical to SEQ ID NO: 449988

SEQ ID NO: 450818 - RNA, 64 nt, Human; identical to SEQ ID NO: 449989

SEQ ID NO: 450819 - RNA, 64 nt, Human; identical to SEQ ID NO: 116855

SEQ ID NO: 450820 - RNA, 64 nt, Human; identical to SEQ ID NO: 116856

SEQ ID NO: 450821 - RNA, 64 nt, Human; identical to SEQ ID NO: 116857

SEQ ID NO: 450822 - RNA, 64 nt, Human; identical to SEQ ID NO: 449990

SEQ ID NO: 450823 - RNA, 64 nt, Human; identical to SEQ ID NO: 449991

SEQ ID NO: 450824 - RNA, 64 nt, Human; identical to SEQ ID NO: 449992

SEQ ID NO: 450825 - RNA, 64 nt, Human; identical to SEQ ID NO: 449993

SEQ ID NO: 450826 - RNA, 64 nt, Human; identical to SEQ ID NO: 449994

SEQ ID NO: 450827 - RNA, 64 nt, Human; identical to SEQ ID NO: 449995

SEQ ID NO: 450828 - RNA, 64 nt, Human; identical to SEQ ID NO: 449996

SEQ ID NO: 450829 - RNA, 64 nt, Human; identical to SEQ ID NO: 449997

SEQ ID NO: 450830 - RNA, 64 nt, Human; identical to SEQ ID NO: 450000

SEQ ID NO: 450831 - RNA, 64 nt, Human; identical to SEQ ID NO: 450001

SEQ ID NO: 450832 - RNA, 64 nt, Human; identical to SEQ ID NO: 450002

SEQ ID NO: 450833 - RNA, 64 nt, Human; identical to SEQ ID NO: 450003

SEQ ID NO: 450834 - RNA, 64 nt, Human; identical to SEQ ID NO: 450004

SEQ ID NO: 450835 - RNA, 64 nt, Human; identical to SEQ ID NO: 450005

SEQ ID NO: 450836 - RNA, 64 nt, Human; identical to SEQ ID NO: 450006

SEQ ID NO: 450837 - RNA, 64 nt, Human; identical to SEQ ID NO: 116858

SEQ ID NO: 450838 - RNA, 64 nt, Human; identical to SEQ ID NO: 116859

SEQ ID NO: 450839 - RNA, 64 nt, Human; identical to SEQ ID NO: 116860

SEQ ID NO: 450840 - RNA, 64 nt, Human; identical to SEQ ID NO: 450007

SEQ ID NO: 450841 - RNA, 64 nt, Human; identical to SEQ ID NO: 450008

SEQ ID NO: 450842 - RNA, 64 nt, Human; identical to SEQ ID NO: 450009

SEQ ID NO: 450843 - RNA, 64 nt, Human; identical to SEQ ID NO: 450010

SEQ ID NO: 450844 - RNA, 64 nt, Human; identical to SEQ ID NO: 450011

SEQ ID NO: 450845 - RNA, 64 nt, Human; identical to SEQ ID NO: 450012

SEQ ID NO: 450846 - RNA, 64 nt, Human; identical to SEQ ID NO: 450013

SEQ ID NO: 450847 - RNA, 64 nt, Human; identical to SEQ ID NO: 450014

SEQ ID NO: 450848 - RNA, 64 nt, Human; identical to SEQ ID NO: 450018

SEQ ID NO: 450849 - RNA, 64 nt, Human; identical to SEQ ID NO: 450019

SEQ ID NO: 450850 - RNA, 64 nt, Human; identical to SEQ ID NO: 450020

SEQ ID NO: 450851 - RNA, 64 nt, Human; identical to SEQ ID NO: 450021

SEQ ID NO: 450852 - RNA, 64 nt, Human; identical to SEQ ID NO: 450022

SEQ ID NO: 450853 - RNA, 64 nt, Human; identical to SEQ ID NO: 450023

SEQ ID NO: 450854 - RNA, 64 nt, Human; identical to SEQ ID NO: 450024

SEQ ID NO: 450855 - RNA, 64 nt, Human; identical to SEQ ID NO: 116891

SEQ ID NO: 450856 - RNA, 64 nt, Human; identical to SEQ ID NO: 116892

SEQ ID NO: 450857 - RNA, 64 nt, Human; identical to SEQ ID NO: 116893

SEQ ID NO: 450858 - RNA, 64 nt, Human; identical to SEQ ID NO: 450025

SEQ ID NO: 450859 - RNA, 64 nt, Human; identical to SEQ ID NO: 450026

SEQ ID NO: 450860 - RNA, 64 nt, Human; identical to SEQ ID NO: 450027

SEQ ID NO: 450861 - RNA, 64 nt, Human; identical to SEQ ID NO: 450028

SEQ ID NO: 450862 - RNA, 64 nt, Human; identical to SEQ ID NO: 450029

SEQ ID NO: 450863 - RNA, 64 nt, Human; identical to SEQ ID NO: 450030

SEQ ID NO: 450864 - RNA, 64 nt, Human; identical to SEQ ID NO: 450031

SEQ ID NO: 450865 - RNA, 64 nt, Human; identical to SEQ ID NO: 450032

SEQ ID NO: 450866 - RNA, 64 nt, Human; identical to SEQ ID NO: 450036

SEQ ID NO: 450867 - RNA, 64 nt, Human; identical to SEQ ID NO: 450037

SEQ ID NO: 450868 - RNA, 64 nt, Human; identical to SEQ ID NO: 450038

SEQ ID NO: 450869 - RNA, 64 nt, Human; identical to SEQ ID NO: 450039

SEQ ID NO: 450870 - RNA, 64 nt, Human; identical to SEQ ID NO: 450040

SEQ ID NO: 450871 - RNA, 64 nt, Human; identical to SEQ ID NO: 450041

SEQ ID NO: 450872 - RNA, 64 nt, Human; identical to SEQ ID NO: 450042

SEQ ID NO: 450873 - RNA, 64 nt, Human; identical to SEQ ID NO: 116862

SEQ ID NO: 450874 - RNA, 64 nt, Human; identical to SEQ ID NO: 116863

SEQ ID NO: 450875 - RNA, 64 nt, Human; identical to SEQ ID NO: 116864

SEQ ID NO: 450876 - RNA, 64 nt, Human; identical to SEQ ID NO: 450043

SEQ ID NO: 450877 - RNA, 64 nt, Human; identical to SEQ ID NO: 450044

SEQ ID NO: 450878 - RNA, 64 nt, Human; identical to SEQ ID NO: 450045

SEQ ID NO: 450879 - RNA, 64 nt, Human; identical to SEQ ID NO: 450046

SEQ ID NO: 450880 - RNA, 64 nt, Human; identical to SEQ ID NO: 450047

SEQ ID NO: 450881 - RNA, 64 nt, Human; identical to SEQ ID NO: 450048

SEQ ID NO: 450882 - RNA, 64 nt, Human; identical to SEQ ID NO: 450049

SEQ ID NO: 450883 - RNA, 64 nt, Human; identical to SEQ ID NO: 450050

SEQ ID NO: 450884 - RNA, 64 nt, Human; identical to SEQ ID NO: 450054

SEQ ID NO: 450885 - RNA, 64 nt, Human; identical to SEQ ID NO: 450055

SEQ ID NO: 450886 - RNA, 64 nt, Human; identical to SEQ ID NO: 450056

SEQ ID NO: 450887 - RNA, 64 nt, Human; identical to SEQ ID NO: 450057

SEQ ID NO: 450888 - RNA, 64 nt, Human; identical to SEQ ID NO: 450058

SEQ ID NO: 450889 - RNA, 64 nt, Human; identical to SEQ ID NO: 450059

SEQ ID NO: 450890 - RNA, 64 nt, Human; identical to SEQ ID NO: 450060

SEQ ID NO: 450891 - RNA, 64 nt, Human; identical to SEQ ID NO: 116865

SEQ ID NO: 450892 - RNA, 64 nt, Human; identical to SEQ ID NO: 116866

SEQ ID NO: 450893 - RNA, 64 nt, Human; identical to SEQ ID NO: 116867

SEQ ID NO: 450894 - RNA, 64 nt, Human; identical to SEQ ID NO: 450061

SEQ ID NO: 450895 - RNA, 64 nt, Human; identical to SEQ ID NO: 450062

SEQ ID NO: 450896 - RNA, 64 nt, Human; identical to SEQ ID NO: 450063

SEQ ID NO: 450897 - RNA, 64 nt, Human; identical to SEQ ID NO: 450064

SEQ ID NO: 450898 - RNA, 64 nt, Human; identical to SEQ ID NO: 450065

SEQ ID NO: 450899 - RNA, 64 nt, Human; identical to SEQ ID NO: 450066

SEQ ID NO: 450900 - RNA, 52 nt, Human; identical to SEQ ID NO: 381344

SEQ ID NO: 450901 - RNA, 64 nt, Human; identical to SEQ ID NO: 450068

SEQ ID NO: 450902 - RNA, 64 nt, Human; identical to SEQ ID NO: 450072

SEQ ID NO: 450903 - RNA, 64 nt, Human; identical to SEQ ID NO: 450073

SEQ ID NO: 450904 - RNA, 64 nt, Human; identical to SEQ ID NO: 450074

SEQ ID NO: 450905 - RNA, 64 nt, Human; identical to SEQ ID NO: 450075

SEQ ID NO: 450906 - RNA, 64 nt, Human; identical to SEQ ID NO: 450076

SEQ ID NO: 450907 - RNA, 64 nt, Human; identical to SEQ ID NO: 450077

SEQ ID NO: 450908 - RNA, 64 nt, Human; identical to SEQ ID NO: 450078

SEQ ID NO: 450909 - RNA, 64 nt, Human; identical to SEQ ID NO: 116869

SEQ ID NO: 450910 - RNA, 64 nt, Human; identical to SEQ ID NO: 116870

SEQ ID NO: 450911 - RNA, 64 nt, Human; identical to SEQ ID NO: 116871

SEQ ID NO: 450912 - RNA, 52 nt, Human; identical to SEQ ID NO: 381351

SEQ ID NO: 450913 - RNA, 64 nt, Human; identical to SEQ ID NO: 450080

SEQ ID NO: 450914 - RNA, 64 nt, Human; identical to SEQ ID NO: 450081

SEQ ID NO: 450915 - RNA, 64 nt, Human; identical to SEQ ID NO: 450082

SEQ ID NO: 450916 - RNA, 64 nt, Human; identical to SEQ ID NO: 450083

SEQ ID NO: 450917 - RNA, 64 nt, Human; identical to SEQ ID NO: 450084

SEQ ID NO: 450918 - RNA, 64 nt, Human; identical to SEQ ID NO: 450085

SEQ ID NO: 450919 - RNA, 64 nt, Human; identical to SEQ ID NO: 450086

SEQ ID NO: 450920 - RNA, 64 nt, Human; identical to SEQ ID NO: 450090

SEQ ID NO: 450921 - RNA, 64 nt, Human; identical to SEQ ID NO: 450091

SEQ ID NO: 450922 - RNA, 64 nt, Human; identical to SEQ ID NO: 450092

SEQ ID NO: 450923 - RNA, 64 nt, Human; identical to SEQ ID NO: 450093

SEQ ID NO: 450924 - RNA, 64 nt, Human; identical to SEQ ID NO: 450094

SEQ ID NO: 450925 - RNA, 64 nt, Human; identical to SEQ ID NO: 450095

SEQ ID NO: 450926 - RNA, 54 nt, Human; identical to SEQ ID NO: 381367

SEQ ID NO: 450927 - RNA, 64 nt, Human; identical to SEQ ID NO: 116872

SEQ ID NO: 450928 - RNA, 64 nt, Human; identical to SEQ ID NO: 116873

SEQ ID NO: 450929 - RNA, 64 nt, Human; identical to SEQ ID NO: 116874

SEQ ID NO: 450930 - RNA, 64 nt, Human; identical to SEQ ID NO: 450097

SEQ ID NO: 450931 - RNA, 64 nt, Human; identical to SEQ ID NO: 450098

SEQ ID NO: 450932 - RNA, 64 nt, Human; identical to SEQ ID NO: 450099

SEQ ID NO: 450933 - RNA, 64 nt, Human; identical to SEQ ID NO: 450100

SEQ ID NO: 450934 - RNA, 64 nt, Human; identical to SEQ ID NO: 450101

SEQ ID NO: 450935 - RNA, 64 nt, Human; identical to SEQ ID NO: 450102

SEQ ID NO: 450936 - RNA, 64 nt, Human; identical to SEQ ID NO: 450103

SEQ ID NO: 450937 - RNA, 64 nt, Human; identical to SEQ ID NO: 450104

SEQ ID NO: 450938 - RNA, 64 nt, Human; identical to SEQ ID NO: 450108

SEQ ID NO: 450939 - RNA, 64 nt, Human; identical to SEQ ID NO: 450109

SEQ ID NO: 450940 - RNA, 64 nt, Human; identical to SEQ ID NO: 450110

SEQ ID NO: 450941 - RNA, 64 nt, Human; identical to SEQ ID NO: 450111

SEQ ID NO: 450942 - RNA, 64 nt, Human; identical to SEQ ID NO: 450112

SEQ ID NO: 450943 - RNA, 64 nt, Human; identical to SEQ ID NO: 450113

SEQ ID NO: 450944 - RNA, 64 nt, Human; identical to SEQ ID NO: 450114

SEQ ID NO: 450945 - RNA, 64 nt, Human; identical to SEQ ID NO: 116876

SEQ ID NO: 450946 - RNA, 64 nt, Human; identical to SEQ ID NO: 116877

SEQ ID NO: 450947 - RNA, 64 nt, Human; identical to SEQ ID NO: 116878

SEQ ID NO: 450948 - RNA, 64 nt, Human; identical to SEQ ID NO: 450115

SEQ ID NO: 450949 - RNA, 64 nt, Human; identical to SEQ ID NO: 450116

SEQ ID NO: 450950 - RNA, 64 nt, Human; identical to SEQ ID NO: 450117

SEQ ID NO: 450951 - RNA, 64 nt, Human; identical to SEQ ID NO: 450118

SEQ ID NO: 450952 - RNA, 64 nt, Human; identical to SEQ ID NO: 450119

SEQ ID NO: 450953 - RNA, 64 nt, Human; identical to SEQ ID NO: 450120

SEQ ID NO: 450954 - RNA, 64 nt, Human; identical to SEQ ID NO: 450121

SEQ ID NO: 450955 - RNA, 64 nt, Human; identical to SEQ ID NO: 450122

SEQ ID NO: 450956 - RNA, 64 nt, Human; identical to SEQ ID NO: 450126

SEQ ID NO: 450957 - RNA, 64 nt, Human; identical to SEQ ID NO: 450127

SEQ ID NO: 450958 - RNA, 64 nt, Human; identical to SEQ ID NO: 450128

SEQ ID NO: 450959 - RNA, 64 nt, Human; identical to SEQ ID NO: 450129

SEQ ID NO: 450960 - RNA, 64 nt, Human; identical to SEQ ID NO: 450130

SEQ ID NO: 450961 - RNA, 64 nt, Human; identical to SEQ ID NO: 450131

SEQ ID NO: 450962 - RNA, 64 nt, Human; identical to SEQ ID NO: 450132

SEQ ID NO: 450963 - RNA, 64 nt, Human; identical to SEQ ID NO: 116879

SEQ ID NO: 450964 - RNA, 64 nt, Human; identical to SEQ ID NO: 116880

SEQ ID NO: 450965 - RNA, 64 nt, Human; identical to SEQ ID NO: 116881

SEQ ID NO: 450966 - RNA, 64 nt, Human; identical to SEQ ID NO: 450133

SEQ ID NO: 450967 - RNA, 64 nt, Human; identical to SEQ ID NO: 450134

SEQ ID NO: 450968 - RNA, 64 nt, Human; identical to SEQ ID NO: 450135

SEQ ID NO: 450969 - RNA, 64 nt, Human; identical to SEQ ID NO: 450136

SEQ ID NO: 450970 - RNA, 64 nt, Human; identical to SEQ ID NO: 450137

SEQ ID NO: 450971 - RNA, 64 nt, Human; identical to SEQ ID NO: 450138

SEQ ID NO: 450972 - RNA, 64 nt, Human; identical to SEQ ID NO: 450139

SEQ ID NO: 450973 - RNA, 64 nt, Human; identical to SEQ ID NO: 450140

SEQ ID NO: 450974 - RNA, 64 nt, Human; identical to SEQ ID NO: 450144

SEQ ID NO: 450975 - RNA, 64 nt, Human; identical to SEQ ID NO: 450145

SEQ ID NO: 450976 - RNA, 64 nt, Human; identical to SEQ ID NO: 450146

SEQ ID NO: 450977 - RNA, 64 nt, Human; identical to SEQ ID NO: 450147

SEQ ID NO: 450978 - RNA, 64 nt, Human; identical to SEQ ID NO: 450148

SEQ ID NO: 450979 - RNA, 64 nt, Human; identical to SEQ ID NO: 450149

SEQ ID NO: 450980 - RNA, 64 nt, Human; identical to SEQ ID NO: 450150

SEQ ID NO: 450981 - RNA, 64 nt, Human; identical to SEQ ID NO: 116792

SEQ ID NO: 450982 - RNA, 64 nt, Human; identical to SEQ ID NO: 116793

SEQ ID NO: 450983 - RNA, 64 nt, Human; identical to SEQ ID NO: 116794

SEQ ID NO: 450984 - RNA, 64 nt, Human; identical to SEQ ID NO: 450151

SEQ ID NO: 450985 - RNA, 64 nt, Human; identical to SEQ ID NO: 450152

SEQ ID NO: 450986 - RNA, 64 nt, Human; identical to SEQ ID NO: 450153

SEQ ID NO: 450987 - RNA, 64 nt, Human; identical to SEQ ID NO: 450154

SEQ ID NO: 450988 - RNA, 64 nt, Human; identical to SEQ ID NO: 450155

SEQ ID NO: 450989 - RNA, 64 nt, Human; identical to SEQ ID NO: 450156

SEQ ID NO: 450990 - RNA, 64 nt, Human; identical to SEQ ID NO: 450157

SEQ ID NO: 450991 - RNA, 64 nt, Human; identical to SEQ ID NO: 450158

SEQ ID NO: 450992 - RNA, 51 nt, Human; identical to SEQ ID NO: 381423

SEQ ID NO: 450993 - RNA, 64 nt, Human; identical to SEQ ID NO: 450163

SEQ ID NO: 450994 - RNA, 64 nt, Human; identical to SEQ ID NO: 450164

SEQ ID NO: 450995 - RNA, 64 nt, Human; identical to SEQ ID NO: 450165

SEQ ID NO: 450996 - RNA, 64 nt, Human; identical to SEQ ID NO: 450166

SEQ ID NO: 450997 - RNA, 64 nt, Human; identical to SEQ ID NO: 450167

SEQ ID NO: 450998 - RNA, 64 nt, Human; identical to SEQ ID NO: 450168

SEQ ID NO: 450999 - RNA, 64 nt, Human; identical to SEQ ID NO: 116795

SEQ ID NO: 451000 - RNA, 64 nt, Human; identical to SEQ ID NO: 116796

SEQ ID NO: 451001 - RNA, 64 nt, Human; identical to SEQ ID NO: 116797

SEQ ID NO: 451002 - RNA, 64 nt, Human; identical to SEQ ID NO: 450169

SEQ ID NO: 451003 - RNA, 64 nt, Human; identical to SEQ ID NO: 450170

SEQ ID NO: 451004 - RNA, 64 nt, Human; identical to SEQ ID NO: 450171

SEQ ID NO: 451005 - RNA, 64 nt, Human; identical to SEQ ID NO: 450172

SEQ ID NO: 451006 - RNA, 64 nt, Human; identical to SEQ ID NO: 450173

SEQ ID NO: 451007 - RNA, 64 nt, Human; identical to SEQ ID NO: 450174

SEQ ID NO: 451008 - RNA, 64 nt, Human; identical to SEQ ID NO: 450175

SEQ ID NO: 451009 - RNA, 64 nt, Human; identical to SEQ ID NO: 450176

SEQ ID NO: 451010 - RNA, 64 nt, Human; identical to SEQ ID NO: 450180

SEQ ID NO: 451011 - RNA, 64 nt, Human; identical to SEQ ID NO: 450181

SEQ ID NO: 451012 - RNA, 64 nt, Human; identical to SEQ ID NO: 450182

SEQ ID NO: 451013 - RNA, 64 nt, Human; identical to SEQ ID NO: 450183

SEQ ID NO: 451014 - RNA, 56 nt, Human; identical to SEQ ID NO: 381440

SEQ ID NO: 451015 - RNA, 64 nt, Human; identical to SEQ ID NO: 450185

SEQ ID NO: 451016 - RNA, 64 nt, Human; identical to SEQ ID NO: 450186

SEQ ID NO: 451017 - RNA, 64 nt, Human; identical to SEQ ID NO: 116894

SEQ ID NO: 451018 - RNA, 64 nt, Human; identical to SEQ ID NO: 116895

SEQ ID NO: 451019 - RNA, 64 nt, Human; identical to SEQ ID NO: 116896

SEQ ID NO: 451020 - RNA, 64 nt, Human; identical to SEQ ID NO: 450187

SEQ ID NO: 451021 - RNA, 64 nt, Human; identical to SEQ ID NO: 450188

SEQ ID NO: 451022 - RNA, 64 nt, Human; identical to SEQ ID NO: 450189

SEQ ID NO: 451023 - RNA, 64 nt, Human; identical to SEQ ID NO: 450190

SEQ ID NO: 451024 - RNA, 64 nt, Human; identical to SEQ ID NO: 450191

SEQ ID NO: 451025 - RNA, 64 nt, Human; identical to SEQ ID NO: 450192

SEQ ID NO: 451026 - RNA, 64 nt, Human; identical to SEQ ID NO: 450193

SEQ ID NO: 451027 - RNA, 64 nt, Human; identical to SEQ ID NO: 450194

SEQ ID NO: 451028 - RNA, 64 nt, Human; identical to SEQ ID NO: 450196

SEQ ID NO: 451029 - RNA, 64 nt, Human; identical to SEQ ID NO: 450197

SEQ ID NO: 451030 - RNA, 64 nt, Human; identical to SEQ ID NO: 450198

SEQ ID NO: 451031 - RNA, 64 nt, Human; identical to SEQ ID NO: 450199

SEQ ID NO: 451032 - RNA, 53 nt, Human; identical to SEQ ID NO: 381453

SEQ ID NO: 451033 - RNA, 64 nt, Human; identical to SEQ ID NO: 450201

SEQ ID NO: 451034 - RNA, 64 nt, Human; identical to SEQ ID NO: 450202

SEQ ID NO: 451035 - RNA, 64 nt, Human; identical to SEQ ID NO: 116799

SEQ ID NO: 451036 - RNA, 64 nt, Human; identical to SEQ ID NO: 116800

SEQ ID NO: 451037 - RNA, 64 nt, Human; identical to SEQ ID NO: 116801

SEQ ID NO: 451038 - RNA, 64 nt, Human; identical to SEQ ID NO: 450203

SEQ ID NO: 451039 - RNA, 53 nt, Human; identical to SEQ ID NO: 381459

SEQ ID NO: 451040 - RNA, 64 nt, Human; identical to SEQ ID NO: 450205

SEQ ID NO: 451041 - RNA, 64 nt, Human; identical to SEQ ID NO: 450206

SEQ ID NO: 451042 - RNA, 64 nt, Human; identical to SEQ ID NO: 450207

SEQ ID NO: 451043 - RNA, 64 nt, Human; identical to SEQ ID NO: 450208

SEQ ID NO: 451044 - RNA, 64 nt, Human; identical to SEQ ID NO: 450209

SEQ ID NO: 451045 - RNA, 64 nt, Human; identical to SEQ ID NO: 450210

SEQ ID NO: 451046 - RNA, 64 nt, Human; identical to SEQ ID NO: 450213

SEQ ID NO: 451047 - RNA, 64 nt, Human; identical to SEQ ID NO: 450214

SEQ ID NO: 451048 - RNA, 64 nt, Human; identical to SEQ ID NO: 450215

SEQ ID NO: 451049 - RNA, 64 nt, Human; identical to SEQ ID NO: 450216

SEQ ID NO: 451050 - RNA, 64 nt, Human; identical to SEQ ID NO: 450217

SEQ ID NO: 451051 - RNA, 64 nt, Human; identical to SEQ ID NO: 450218

SEQ ID NO: 451052 - RNA, 64 nt, Human; identical to SEQ ID NO: 450219

SEQ ID NO: 451053 - RNA, 64 nt, Human; identical to SEQ ID NO: 116802

SEQ ID NO: 451054 - RNA, 64 nt, Human; identical to SEQ ID NO: 116803

SEQ ID NO: 451055 - RNA, 64 nt, Human; identical to SEQ ID NO: 116804

SEQ ID NO: 451056 - RNA, 64 nt, Human; identical to SEQ ID NO: 450220

SEQ ID NO: 451057 - RNA, 64 nt, Human; identical to SEQ ID NO: 450221

SEQ ID NO: 451058 - RNA, 64 nt, Human; identical to SEQ ID NO: 450222

SEQ ID NO: 451059 - RNA, 64 nt, Human; identical to SEQ ID NO: 450223

SEQ ID NO: 451060 - RNA, 64 nt, Human; identical to SEQ ID NO: 450224

SEQ ID NO: 451061 - RNA, 64 nt, Human; identical to SEQ ID NO: 450225

SEQ ID NO: 451062 - RNA, 64 nt, Human; identical to SEQ ID NO: 450226

SEQ ID NO: 451063 - RNA, 64 nt, Human; identical to SEQ ID NO: 450227

SEQ ID NO: 451064 - RNA, 64 nt, Human; identical to SEQ ID NO: 450231

SEQ ID NO: 451065 - RNA, 64 nt, Human; identical to SEQ ID NO: 450232

SEQ ID NO: 451066 - RNA, 64 nt, Human; identical to SEQ ID NO: 450233

SEQ ID NO: 451067 - RNA, 64 nt, Human; identical to SEQ ID NO: 450234

SEQ ID NO: 451068 - RNA, 64 nt, Human; identical to SEQ ID NO: 450235

SEQ ID NO: 451069 - RNA, 64 nt, Human; identical to SEQ ID NO: 450236

SEQ ID NO: 451070 - RNA, 64 nt, Human; identical to SEQ ID NO: 450237

SEQ ID NO: 451071 - RNA, 64 nt, Human; identical to SEQ ID NO: 116806

SEQ ID NO: 451072 - RNA, 64 nt, Human; identical to SEQ ID NO: 116807

SEQ ID NO: 451073 - RNA, 64 nt, Human; identical to SEQ ID NO: 116808

SEQ ID NO: 451074 - RNA, 64 nt, Human; identical to SEQ ID NO: 450238

SEQ ID NO: 451075 - RNA, 64 nt, Human; identical to SEQ ID NO: 450239

SEQ ID NO: 451076 - RNA, 64 nt, Human; identical to SEQ ID NO: 450240

SEQ ID NO: 451077 - RNA, 64 nt, Human; identical to SEQ ID NO: 450241

SEQ ID NO: 451078 - RNA, 64 nt, Human; identical to SEQ ID NO: 450242

SEQ ID NO: 451079 - RNA, 64 nt, Human; identical to SEQ ID NO: 450243

SEQ ID NO: 451080 - RNA, 64 nt, Human; identical to SEQ ID NO: 450244

SEQ ID NO: 451081 - RNA, 64 nt, Human; identical to SEQ ID NO: 450245

SEQ ID NO: 451082 - RNA, 64 nt, Human; identical to SEQ ID NO: 450249

SEQ ID NO: 451083 - RNA, 64 nt, Human; identical to SEQ ID NO: 450250

SEQ ID NO: 451084 - RNA, 64 nt, Human; identical to SEQ ID NO: 450251

SEQ ID NO: 451085 - RNA, 64 nt, Human; identical to SEQ ID NO: 450252

SEQ ID NO: 451086 - RNA, 64 nt, Human; identical to SEQ ID NO: 450253

SEQ ID NO: 451087 - RNA, 64 nt, Human; identical to SEQ ID NO: 450254

SEQ ID NO: 451088 - RNA, 64 nt, Human; identical to SEQ ID NO: 450255

SEQ ID NO: 451089 - RNA, 64 nt, Human; identical to SEQ ID NO: 116809

SEQ ID NO: 451090 - RNA, 64 nt, Human; identical to SEQ ID NO: 116810

SEQ ID NO: 451091 - RNA, 64 nt, Human; identical to SEQ ID NO: 116811

SEQ ID NO: 451092 - RNA, 64 nt, Human; identical to SEQ ID NO: 450256

SEQ ID NO: 451093 - RNA, 64 nt, Human; identical to SEQ ID NO: 450257

SEQ ID NO: 451094 - RNA, 64 nt, Human; identical to SEQ ID NO: 450258

SEQ ID NO: 451095 - RNA, 64 nt, Human; identical to SEQ ID NO: 450259

SEQ ID NO: 451096 - RNA, 64 nt, Human; identical to SEQ ID NO: 450260

SEQ ID NO: 451097 - RNA, 64 nt, Human; identical to SEQ ID NO: 450261

SEQ ID NO: 451098 - RNA, 64 nt, Human; identical to SEQ ID NO: 450262

SEQ ID NO: 451099 - RNA, 64 nt, Human; identical to SEQ ID NO: 450263

SEQ ID NO: 451100 - RNA, 64 nt, Human; identical to SEQ ID NO: 450267

SEQ ID NO: 451101 - RNA, 64 nt, Human; identical to SEQ ID NO: 450268

SEQ ID NO: 451102 - RNA, 64 nt, Human; identical to SEQ ID NO: 450269

SEQ ID NO: 451103 - RNA, 64 nt, Human; identical to SEQ ID NO: 450270

SEQ ID NO: 451104 - RNA, 64 nt, Human; identical to SEQ ID NO: 450271

SEQ ID NO: 451105 - RNA, 64 nt, Human; identical to SEQ ID NO: 450272

SEQ ID NO: 451106 - RNA, 64 nt, Human; identical to SEQ ID NO: 450273

SEQ ID NO: 451107 - RNA, 64 nt, Human; identical to SEQ ID NO: 116813

SEQ ID NO: 451108 - RNA, 64 nt, Human; identical to SEQ ID NO: 116814

SEQ ID NO: 451109 - RNA, 64 nt, Human; identical to SEQ ID NO: 116815

SEQ ID NO: 451110 - RNA, 64 nt, Human; identical to SEQ ID NO: 450274

SEQ ID NO: 451111 - RNA, 64 nt, Human; identical to SEQ ID NO: 450275

SEQ ID NO: 451112 - RNA, 64 nt, Human; identical to SEQ ID NO: 450276

SEQ ID NO: 451113 - RNA, 64 nt, Human; identical to SEQ ID NO: 450277

SEQ ID NO: 451114 - RNA, 64 nt, Human; identical to SEQ ID NO: 450278

SEQ ID NO: 451115 - RNA, 64 nt, Human; identical to SEQ ID NO: 450279

SEQ ID NO: 451116 - RNA, 64 nt, Human; identical to SEQ ID NO: 450280

SEQ ID NO: 451117 - RNA, 64 nt, Human; identical to SEQ ID NO: 450281

SEQ ID NO: 451118 - RNA, 64 nt, Human; identical to SEQ ID NO: 450285

SEQ ID NO: 451119 - RNA, 64 nt, Human; identical to SEQ ID NO: 450286

SEQ ID NO: 451120 - RNA, 64 nt, Human; identical to SEQ ID NO: 450287

SEQ ID NO: 451121 - RNA, 64 nt, Human; identical to SEQ ID NO: 450288

SEQ ID NO: 451122 - RNA, 64 nt, Human; identical to SEQ ID NO: 450289

SEQ ID NO: 451123 - RNA, 64 nt, Human; identical to SEQ ID NO: 450290

SEQ ID NO: 451124 - RNA, 64 nt, Human; identical to SEQ ID NO: 450291

SEQ ID NO: 451125 - RNA, 64 nt, Human; identical to SEQ ID NO: 116816

SEQ ID NO: 451126 - RNA, 64 nt, Human; identical to SEQ ID NO: 116817

SEQ ID NO: 451127 - RNA, 64 nt, Human; identical to SEQ ID NO: 116818

SEQ ID NO: 451128 - RNA, 64 nt, Human; identical to SEQ ID NO: 450292

SEQ ID NO: 451129 - RNA, 64 nt, Human; identical to SEQ ID NO: 450293

SEQ ID NO: 451130 - RNA, 64 nt, Human; identical to SEQ ID NO: 450294

SEQ ID NO: 451131 - RNA, 64 nt, Human; identical to SEQ ID NO: 450295

SEQ ID NO: 451132 - RNA, 64 nt, Human; identical to SEQ ID NO: 450296

SEQ ID NO: 451133 - RNA, 64 nt, Human; identical to SEQ ID NO: 450297

SEQ ID NO: 451134 - RNA, 64 nt, Human; identical to SEQ ID NO: 450298

SEQ ID NO: 451135 - RNA, 64 nt, Human; identical to SEQ ID NO: 450299

SEQ ID NO: 451136 - RNA, 64 nt, Human; identical to SEQ ID NO: 450303

SEQ ID NO: 451137 - RNA, 64 nt, Human; identical to SEQ ID NO: 450304

SEQ ID NO: 451138 - RNA, 64 nt, Human; identical to SEQ ID NO: 450305

SEQ ID NO: 451139 - RNA, 64 nt, Human; identical to SEQ ID NO: 450306

SEQ ID NO: 451140 - RNA, 64 nt, Human; identical to SEQ ID NO: 450307

SEQ ID NO: 451141 - RNA, 64 nt, Human; identical to SEQ ID NO: 450308

SEQ ID NO: 451142 - RNA, 64 nt, Human; identical to SEQ ID NO: 450309

SEQ ID NO: 451143 - RNA, 64 nt, Human; identical to SEQ ID NO: 116883

SEQ ID NO: 451144 - RNA, 64 nt, Human; identical to SEQ ID NO: 116884

SEQ ID NO: 451145 - RNA, 64 nt, Human; identical to SEQ ID NO: 116885

SEQ ID NO: 451146 - RNA, 64 nt, Human; identical to SEQ ID NO: 450310

SEQ ID NO: 451147 - RNA, 64 nt, Human; identical to SEQ ID NO: 450311

SEQ ID NO: 451148 - RNA, 64 nt, Human; identical to SEQ ID NO: 450312

SEQ ID NO: 451149 - RNA, 64 nt, Human; identical to SEQ ID NO: 450313

SEQ ID NO: 451150 - RNA, 64 nt, Human; identical to SEQ ID NO: 450314

SEQ ID NO: 451151 - RNA, 64 nt, Human; identical to SEQ ID NO: 450315

SEQ ID NO: 451152 - RNA, 64 nt, Human; identical to SEQ ID NO: 450316

SEQ ID NO: 451153 - RNA, 64 nt, Human; identical to SEQ ID NO: 450317

SEQ ID NO: 451154 - RNA, 64 nt, Human; identical to SEQ ID NO: 450321

SEQ ID NO: 451155 - RNA, 64 nt, Human; identical to SEQ ID NO: 450322

SEQ ID NO: 451156 - RNA, 64 nt, Human; identical to SEQ ID NO: 450323

SEQ ID NO: 451157 - RNA, 64 nt, Human; identical to SEQ ID NO: 450324

SEQ ID NO: 451158 - RNA, 64 nt, Human; identical to SEQ ID NO: 450325

SEQ ID NO: 451159 - RNA, 64 nt, Human; identical to SEQ ID NO: 450326

SEQ ID NO: 451160 - RNA, 64 nt, Human; identical to SEQ ID NO: 450327

SEQ ID NO: 451161 - RNA, 64 nt, Human; identical to SEQ ID NO: 116820

SEQ ID NO: 451162 - RNA, 64 nt, Human; identical to SEQ ID NO: 116821

SEQ ID NO: 451163 - RNA, 64 nt, Human; identical to SEQ ID NO: 116822

SEQ ID NO: 451164 - RNA, 64 nt, Human; identical to SEQ ID NO: 450328

SEQ ID NO: 451165 - RNA, 64 nt, Human; identical to SEQ ID NO: 450329

SEQ ID NO: 451166 - RNA, 64 nt, Human; identical to SEQ ID NO: 450330

SEQ ID NO: 451167 - RNA, 64 nt, Human; identical to SEQ ID NO: 450331

SEQ ID NO: 451168 - RNA, 64 nt, Human; identical to SEQ ID NO: 450332

SEQ ID NO: 451169 - RNA, 64 nt, Human; identical to SEQ ID NO: 450333

SEQ ID NO: 451170 - RNA, 64 nt, Human; identical to SEQ ID NO: 450334

SEQ ID NO: 451171 - RNA, 64 nt, Human; identical to SEQ ID NO: 450335

SEQ ID NO: 451172 - RNA, 64 nt, Human; identical to SEQ ID NO: 450339

SEQ ID NO: 451173 - RNA, 64 nt, Human; identical to SEQ ID NO: 450340

SEQ ID NO: 451174 - RNA, 64 nt, Human; identical to SEQ ID NO: 450341

SEQ ID NO: 451175 - RNA, 64 nt, Human; identical to SEQ ID NO: 450342

SEQ ID NO: 451176 - RNA, 64 nt, Human; identical to SEQ ID NO: 450343

SEQ ID NO: 451177 - RNA, 64 nt, Human; identical to SEQ ID NO: 450344

SEQ ID NO: 451178 - RNA, 64 nt, Human; identical to SEQ ID NO: 450345

SEQ ID NO: 451179 - RNA, 64 nt, Human; identical to SEQ ID NO: 116823

SEQ ID NO: 451180 - RNA, 64 nt, Human; identical to SEQ ID NO: 116824

SEQ ID NO: 451181 - RNA, 64 nt, Human; identical to SEQ ID NO: 116825

SEQ ID NO: 451182 - RNA, 64 nt, Human; identical to SEQ ID NO: 450346

SEQ ID NO: 451183 - RNA, 64 nt, Human; identical to SEQ ID NO: 450347

SEQ ID NO: 451184 - RNA, 64 nt, Human; identical to SEQ ID NO: 450348

SEQ ID NO: 451185 - RNA, 64 nt, Human; identical to SEQ ID NO: 450349

SEQ ID NO: 451186 - RNA, 64 nt, Human; identical to SEQ ID NO: 450350

SEQ ID NO: 451187 - RNA, 64 nt, Human; identical to SEQ ID NO: 450351

SEQ ID NO: 451188 - RNA, 64 nt, Human; identical to SEQ ID NO: 450352

SEQ ID NO: 451189 - RNA, 64 nt, Human; identical to SEQ ID NO: 450353

SEQ ID NO: 451190 - RNA, 64 nt, Human; identical to SEQ ID NO: 450357

SEQ ID NO: 451191 - RNA, 64 nt, Human; identical to SEQ ID NO: 450358

SEQ ID NO: 451192 - RNA, 64 nt, Human; identical to SEQ ID NO: 450359

SEQ ID NO: 451193 - RNA, 64 nt, Human; identical to SEQ ID NO: 450360

SEQ ID NO: 451194 - RNA, 64 nt, Human; identical to SEQ ID NO: 450361

SEQ ID NO: 451195 - RNA, 64 nt, Human; identical to SEQ ID NO: 450362

SEQ ID NO: 451196 - RNA, 64 nt, Human; identical to SEQ ID NO: 450363

SEQ ID NO: 451197 - RNA, 64 nt, Human; identical to SEQ ID NO: 116827

SEQ ID NO: 451198 - RNA, 64 nt, Human; identical to SEQ ID NO: 116828

SEQ ID NO: 451199 - RNA, 64 nt, Human; identical to SEQ ID NO: 116829

SEQ ID NO: 451200 - RNA, 64 nt, Human; identical to SEQ ID NO: 450364

SEQ ID NO: 451201 - RNA, 64 nt, Human; identical to SEQ ID NO: 450365

SEQ ID NO: 451202 - RNA, 64 nt, Human; identical to SEQ ID NO: 450366

SEQ ID NO: 451203 - RNA, 64 nt, Human; identical to SEQ ID NO: 450367

SEQ ID NO: 451204 - RNA, 64 nt, Human; identical to SEQ ID NO: 450368

SEQ ID NO: 451205 - RNA, 64 nt, Human; identical to SEQ ID NO: 450369

SEQ ID NO: 451206 - RNA, 64 nt, Human; identical to SEQ ID NO: 450370

SEQ ID NO: 451207 - RNA, 64 nt, Human; identical to SEQ ID NO: 450371

SEQ ID NO: 451208 - RNA, 64 nt, Human; identical to SEQ ID NO: 450375

SEQ ID NO: 451209 - RNA, 64 nt, Human; identical to SEQ ID NO: 450376

SEQ ID NO: 451210 - RNA, 64 nt, Human; identical to SEQ ID NO: 450377

SEQ ID NO: 451211 - RNA, 58 nt, Human; identical to SEQ ID NO: 381604

SEQ ID NO: 451212 - RNA, 64 nt, Human; identical to SEQ ID NO: 450379

SEQ ID NO: 451213 - RNA, 64 nt, Human; identical to SEQ ID NO: 450380

SEQ ID NO: 451214 - RNA, 64 nt, Human; identical to SEQ ID NO: 450381

SEQ ID NO: 451215 - RNA, 64 nt, Human; identical to SEQ ID NO: 116830

SEQ ID NO: 451216 - RNA, 64 nt, Human; identical to SEQ ID NO: 116831

SEQ ID NO: 451217 - RNA, 64 nt, Human; identical to SEQ ID NO: 116832

SEQ ID NO: 451218 - RNA, 64 nt, Human; identical to SEQ ID NO: 450382

SEQ ID NO: 451219 - RNA, 64 nt, Human; identical to SEQ ID NO: 450383

SEQ ID NO: 451220 - RNA, 64 nt, Human; identical to SEQ ID NO: 450384

SEQ ID NO: 451221 - RNA, 64 nt, Human; identical to SEQ ID NO: 450384

SEQ ID NO: 451222 - RNA, 64 nt, Human; identical to SEQ ID NO: 450386

SEQ ID NO: 451223 - RNA, 64 nt, Human; identical to SEQ ID NO: 450387

SEQ ID NO: 451224 - RNA, 64 nt, Human; identical to SEQ ID NO: 450388

SEQ ID NO: 451225 - RNA, 64 nt, Human; identical to SEQ ID NO: 450389

SEQ ID NO: 451226 - RNA, 64 nt, Human; identical to SEQ ID NO: 450393

SEQ ID NO: 451227 - RNA, 64 nt, Human; identical to SEQ ID NO: 450394

SEQ ID NO: 451228 - RNA, 64 nt, Human; identical to SEQ ID NO: 450395

SEQ ID NO: 451229 - RNA, 64 nt, Human; identical to SEQ ID NO: 450396

SEQ ID NO: 451230 - RNA, 64 nt, Human; identical to SEQ ID NO: 450397

SEQ ID NO: 451231 - RNA, 64 nt, Human; identical to SEQ ID NO: 450398

SEQ ID NO: 451232 - RNA, 64 nt, Human; identical to SEQ ID NO: 450399

SEQ ID NO: 451233 - RNA, 64 nt, Human; identical to SEQ ID NO: 116743

SEQ ID NO: 451234 - RNA, 64 nt, Human; identical to SEQ ID NO: 116744

SEQ ID NO: 451235 - RNA, 64 nt, Human; identical to SEQ ID NO: 116745

SEQ ID NO: 451236 - RNA, 64 nt, Human; identical to SEQ ID NO: 450400

SEQ ID NO: 451237 - RNA, 64 nt, Human; identical to SEQ ID NO: 450401

SEQ ID NO: 451238 - RNA, 64 nt, Human; identical to SEQ ID NO: 450402

SEQ ID NO: 451239 - RNA, 64 nt, Human; identical to SEQ ID NO: 450403

SEQ ID NO: 451240 - RNA, 64 nt, Human; identical to SEQ ID NO: 450404

SEQ ID NO: 451241 - RNA, 64 nt, Human; identical to SEQ ID NO: 450405

SEQ ID NO: 451242 - RNA, 64 nt, Human; identical to SEQ ID NO: 450406

SEQ ID NO: 451243 - RNA, 64 nt, Human; identical to SEQ ID NO: 450407

SEQ ID NO: 451244 - RNA, 64 nt, Human; identical to SEQ ID NO: 450411

SEQ ID NO: 451245 - RNA, 64 nt, Human; identical to SEQ ID NO: 450412

SEQ ID NO: 451246 - RNA, 64 nt, Human; identical to SEQ ID NO: 450413

SEQ ID NO: 451247 - RNA, 64 nt, Human; identical to SEQ ID NO: 450414

SEQ ID NO: 451248 - RNA, 64 nt, Human; identical to SEQ ID NO: 450415

SEQ ID NO: 451249 - RNA, 64 nt, Human; identical to SEQ ID NO: 450416

SEQ ID NO: 451250 - RNA, 64 nt, Human; identical to SEQ ID NO: 450417

SEQ ID NO: 451251 - RNA, 64 nt, Human; identical to SEQ ID NO: 116746

SEQ ID NO: 451252 - RNA, 64 nt, Human; identical to SEQ ID NO: 116747

SEQ ID NO: 451253 - RNA, 64 nt, Human; identical to SEQ ID NO: 116748

SEQ ID NO: 451254 - RNA, 64 nt, Human; identical to SEQ ID NO: 450418

SEQ ID NO: 451255 - RNA, 64 nt, Human; identical to SEQ ID NO: 450419

SEQ ID NO: 451256 - RNA, 64 nt, Human; identical to SEQ ID NO: 450420

SEQ ID NO: 451257 - RNA, 64 nt, Human; identical to SEQ ID NO: 450421

SEQ ID NO: 451258 - RNA, 64 nt, Human; identical to SEQ ID NO: 450422

SEQ ID NO: 451259 - RNA, 64 nt, Human; identical to SEQ ID NO: 450423

SEQ ID NO: 451260 - RNA, 64 nt, Human; identical to SEQ ID NO: 450424

SEQ ID NO: 451261 - RNA, 64 nt, Human; identical to SEQ ID NO: 450425

SEQ ID NO: 451262 - RNA, 64 nt, Human; identical to SEQ ID NO: 450429

SEQ ID NO: 451263 - RNA, 64 nt, Human; identical to SEQ ID NO: 450430

SEQ ID NO: 451264 - RNA, 64 nt, Human; identical to SEQ ID NO: 450431

SEQ ID NO: 451265 - RNA, 64 nt, Human; identical to SEQ ID NO: 450432

SEQ ID NO: 451266 - RNA, 64 nt, Human; identical to SEQ ID NO: 450433

SEQ ID NO: 451267 - RNA, 64 nt, Human; identical to SEQ ID NO: 450434

SEQ ID NO: 451268 - RNA, 64 nt, Human; identical to SEQ ID NO: 450435

SEQ ID NO: 451269 - RNA, 64 nt, Human; identical to SEQ ID NO: 116750

SEQ ID NO: 451270 - RNA, 64 nt, Human; identical to SEQ ID NO: 116751

SEQ ID NO: 451271 - RNA, 64 nt, Human; identical to SEQ ID NO: 116752

SEQ ID NO: 451272 - RNA, 64 nt, Human; identical to SEQ ID NO: 450436

SEQ ID NO: 451273 - RNA, 64 nt, Human; identical to SEQ ID NO: 449614

SEQ ID NO: 451274 - RNA, 64 nt, Human; identical to SEQ ID NO: 449615

SEQ ID NO: 451275 - RNA, 54 nt, Human; identical to SEQ ID NO: 380960

SEQ ID NO: 451276 - RNA, 64 nt, Human; identical to SEQ ID NO: 449617

SEQ ID NO: 451277 - RNA, 64 nt, Human; identical to SEQ ID NO: 449618

SEQ ID NO: 451278 - RNA, 64 nt, Human; identical to SEQ ID NO: 449619

SEQ ID NO: 451279 - RNA, 64 nt, Human; identical to SEQ ID NO: 449620

SEQ ID NO: 451280 - RNA, 64 nt, Human; identical to SEQ ID NO: 449621

SEQ ID NO: 451281 - RNA, 64 nt, Human; identical to SEQ ID NO: 449622

SEQ ID NO: 451282 - RNA, 64 nt, Human; identical to SEQ ID NO: 449623

SEQ ID NO: 451283 - RNA, 64 nt, Human; identical to SEQ ID NO: 449624

SEQ ID NO: 451284 - RNA, 64 nt, Human; identical to SEQ ID NO: 449625

SEQ ID NO: 451285 - RNA, 64 nt, Human; identical to SEQ ID NO: 116753

SEQ ID NO: 451286 - RNA, 64 nt, Human; identical to SEQ ID NO: 116754

SEQ ID NO: 451287 - RNA, 64 nt, Human; identical to SEQ ID NO: 116755

SEQ ID NO: 451288 - RNA, 64 nt, Human; identical to SEQ ID NO: 449626

SEQ ID NO: 451289 - RNA, 64 nt, Human; identical to SEQ ID NO: 449630

SEQ ID NO: 451290 - RNA, 64 nt, Human; identical to SEQ ID NO: 449631

SEQ ID NO: 451291 - RNA, 64 nt, Human; identical to SEQ ID NO: 449632

SEQ ID NO: 451292 - RNA, 64 nt, Human; identical to SEQ ID NO: 449633

SEQ ID NO: 451293 - RNA, 64 nt, Human; identical to SEQ ID NO: 449634

SEQ ID NO: 451294 - RNA, 64 nt, Human; identical to SEQ ID NO: 449635

SEQ ID NO: 451295 - RNA, 64 nt, Human; identical to SEQ ID NO: 449636

SEQ ID NO: 451296 - RNA, 64 nt, Human; identical to SEQ ID NO: 449637

SEQ ID NO: 451297 - RNA, 64 nt, Human; identical to SEQ ID NO: 449638

SEQ ID NO: 451298 - RNA, 64 nt, Human; identical to SEQ ID NO: 449639

SEQ ID NO: 451299 - RNA, 64 nt, Human; identical to SEQ ID NO: 449640

SEQ ID NO: 451300 - RNA, 64 nt, Human; identical to SEQ ID NO: 449641

SEQ ID NO: 451301 - RNA, 64 nt, Human; identical to SEQ ID NO: 449642

SEQ ID NO: 451302 - RNA, 64 nt, Human; identical to SEQ ID NO: 449643

SEQ ID NO: 451303 - RNA, 64 nt, Human; identical to SEQ ID NO: 116834

SEQ ID NO: 451304 - RNA, 64 nt, Human; identical to SEQ ID NO: 116835

SEQ ID NO: 451305 - RNA, 64 nt, Human; identical to SEQ ID NO: 116836

SEQ ID NO: 451306 - RNA, 64 nt, Human; identical to SEQ ID NO: 449644

SEQ ID NO: 451307 - RNA, 64 nt, Human; identical to SEQ ID NO: 449648

SEQ ID NO: 451308 - RNA, 64 nt, Human; identical to SEQ ID NO: 449649

SEQ ID NO: 451309 - RNA, 64 nt, Human; identical to SEQ ID NO: 449650

SEQ ID NO: 451310 - RNA, 64 nt, Human; identical to SEQ ID NO: 449651

SEQ ID NO: 451311 - RNA, 64 nt, Human; identical to SEQ ID NO: 449652

SEQ ID NO: 451312 - RNA, 64 nt, Human; identical to SEQ ID NO: 449653

SEQ ID NO: 451313 - RNA, 64 nt, Human; identical to SEQ ID NO: 449654

SEQ ID NO: 451314 - RNA, 64 nt, Human; identical to SEQ ID NO: 449655

SEQ ID NO: 451315 - RNA, 64 nt, Human; identical to SEQ ID NO: 449656

SEQ ID NO: 451316 - RNA, 64 nt, Human; identical to SEQ ID NO: 449657

SEQ ID NO: 451317 - RNA, 64 nt, Human; identical to SEQ ID NO: 449658

SEQ ID NO: 451318 - RNA, 64 nt, Human; identical to SEQ ID NO: 449659

SEQ ID NO: 451319 - RNA, 64 nt, Human; identical to SEQ ID NO: 449660

SEQ ID NO: 451320 - RNA, 64 nt, Human; identical to SEQ ID NO: 449661

SEQ ID NO: 451321 - RNA, 64 nt, Human; identical to SEQ ID NO: 116757

SEQ ID NO: 451322 - RNA, 64 nt, Human; identical to SEQ ID NO: 116758

SEQ ID NO: 451323 - RNA, 64 nt, Human; identical to SEQ ID NO: 116759

SEQ ID NO: 451324 - RNA, 64 nt, Human; identical to SEQ ID NO: 449662

SEQ ID NO: 451325 - RNA, 64 nt, Human; identical to SEQ ID NO: 449666

SEQ ID NO: 451326 - RNA, 64 nt, Human; identical to SEQ ID NO: 449667

SEQ ID NO: 451327 - RNA, 64 nt, Human; identical to SEQ ID NO: 449668

SEQ ID NO: 451328 - RNA, 64 nt, Human; identical to SEQ ID NO: 449669

SEQ ID NO: 451329 - RNA, 64 nt, Human; identical to SEQ ID NO: 449670

SEQ ID NO: 451330 - RNA, 64 nt, Human; identical to SEQ ID NO: 449671

SEQ ID NO: 451331 - RNA, 64 nt, Human; identical to SEQ ID NO: 449672

SEQ ID NO: 451332 - RNA, 64 nt, Human; identical to SEQ ID NO: 449673

SEQ ID NO: 451333 - RNA, 64 nt, Human; identical to SEQ ID NO: 449674

SEQ ID NO: 451334 - RNA, 64 nt, Human; identical to SEQ ID NO: 449675

SEQ ID NO: 451335 - RNA, 64 nt, Human; identical to SEQ ID NO: 449676

SEQ ID NO: 451336 - RNA, 64 nt, Human; identical to SEQ ID NO: 449677

SEQ ID NO: 451337 - RNA, 64 nt, Human; identical to SEQ ID NO: 449678

SEQ ID NO: 451338 - RNA, 64 nt, Human; identical to SEQ ID NO: 449679

SEQ ID NO: 451339 - RNA, 64 nt, Human; identical to SEQ ID NO: 116760

SEQ ID NO: 451340 - RNA, 64 nt, Human; identical to SEQ ID NO: 116761

SEQ ID NO: 451341 - RNA, 64 nt, Human; identical to SEQ ID NO: 116762

SEQ ID NO: 451342 - RNA, 64 nt, Human; identical to SEQ ID NO: 449680

SEQ ID NO: 451343 - RNA, 64 nt, Human; identical to SEQ ID NO: 449684

SEQ ID NO: 451344 - RNA, 64 nt, Human; identical to SEQ ID NO: 449685

SEQ ID NO: 451345 - RNA, 64 nt, Human; identical to SEQ ID NO: 449686

SEQ ID NO: 451346 - RNA, 64 nt, Human; identical to SEQ ID NO: 449687

SEQ ID NO: 451347 - RNA, 64 nt, Human; identical to SEQ ID NO: 449688

SEQ ID NO: 451348 - RNA, 64 nt, Human; identical to SEQ ID NO: 449689

SEQ ID NO: 451349 - RNA, 64 nt, Human; identical to SEQ ID NO: 449690

SEQ ID NO: 451350 - RNA, 64 nt, Human; identical to SEQ ID NO: 449691

SEQ ID NO: 451351 - RNA, 64 nt, Human; identical to SEQ ID NO: 449692

SEQ ID NO: 451352 - RNA, 64 nt, Human; identical to SEQ ID NO: 449693

SEQ ID NO: 451353 - RNA, 64 nt, Human; identical to SEQ ID NO: 449694

SEQ ID NO: 451354 - RNA, 64 nt, Human; identical to SEQ ID NO: 449695

SEQ ID NO: 451355 - RNA, 58 nt, Human; identical to SEQ ID NO: 381028

SEQ ID NO: 451356 - RNA, 64 nt, Human; identical to SEQ ID NO: 449697

SEQ ID NO: 451357 - RNA, 64 nt, Human; identical to SEQ ID NO: 116764

SEQ ID NO: 451358 - RNA, 64 nt, Human; identical to SEQ ID NO: 116765

SEQ ID NO: 451359 - RNA, 64 nt, Human; identical to SEQ ID NO: 116766

SEQ ID NO: 451360 - RNA, 64 nt, Human; identical to SEQ ID NO: 449698

SEQ ID NO: 451361 - RNA, 64 nt, Human; identical to SEQ ID NO: 449702

SEQ ID NO: 451362 - RNA, 64 nt, Human; identical to SEQ ID NO: 449703

SEQ ID NO: 451363 - RNA, 64 nt, Human; identical to SEQ ID NO: 449704

SEQ ID NO: 451364 - RNA, 64 nt, Human; identical to SEQ ID NO: 449705

SEQ ID NO: 451365 - RNA, 64 nt, Human; identical to SEQ ID NO: 449706

SEQ ID NO: 451366 - RNA, 64 nt, Human; identical to SEQ ID NO: 449707

SEQ ID NO: 451367 - RNA, 64 nt, Human; identical to SEQ ID NO: 449708

SEQ ID NO: 451368 - RNA, 64 nt, Human; identical to SEQ ID NO: 449709

SEQ ID NO: 451369 - RNA, 64 nt, Human; identical to SEQ ID NO: 449710

SEQ ID NO: 451370 - RNA, 64 nt, Human; identical to SEQ ID NO: 449711

SEQ ID NO: 451371 - RNA, 64 nt, Human; identical to SEQ ID NO: 449712

SEQ ID NO: 451372 - RNA, 64 nt, Human; identical to SEQ ID NO: 449713

SEQ ID NO: 451373 - RNA, 64 nt, Human; identical to SEQ ID NO: 449714

SEQ ID NO: 451374 - RNA, 64 nt, Human; identical to SEQ ID NO: 449715

SEQ ID NO: 451375 - RNA, 64 nt, Human; identical to SEQ ID NO: 116767

SEQ ID NO: 451376 - RNA, 64 nt, Human; identical to SEQ ID NO: 116768

SEQ ID NO: 451377 - RNA, 64 nt, Human; identical to SEQ ID NO: 116769

SEQ ID NO: 451378 - RNA, 64 nt, Human; identical to SEQ ID NO: 449716

SEQ ID NO: 451379 - RNA, 64 nt, Human; identical to SEQ ID NO: 449720

SEQ ID NO: 451380 - RNA, 64 nt, Human; identical to SEQ ID NO: 449721

SEQ ID NO: 451381 - RNA, 64 nt, Human; identical to SEQ ID NO: 449722

SEQ ID NO: 451382 - RNA, 64 nt, Human; identical to SEQ ID NO: 449723

SEQ ID NO: 451383 - RNA, 64 nt, Human; identical to SEQ ID NO: 449724

SEQ ID NO: 451384 - RNA, 64 nt, Human; identical to SEQ ID NO: 449725

SEQ ID NO: 451385 - RNA, 64 nt, Human; identical to SEQ ID NO: 449726

SEQ ID NO: 451386 - RNA, 64 nt, Human; identical to SEQ ID NO: 449727

SEQ ID NO: 451387 - RNA, 64 nt, Human; identical to SEQ ID NO: 449728

SEQ ID NO: 451388 - RNA, 64 nt, Human; identical to SEQ ID NO: 449729

SEQ ID NO: 451389 - RNA, 64 nt, Human; identical to SEQ ID NO: 449730

SEQ ID NO: 451390 - RNA, 64 nt, Human; identical to SEQ ID NO: 449731

SEQ ID NO: 451391 - RNA, 64 nt, Human; identical to SEQ ID NO: 449732

SEQ ID NO: 451392 - RNA, 64 nt, Human; identical to SEQ ID NO: 449733

SEQ ID NO: 451393 - RNA, 51 nt, Human; identical to SEQ ID NO: 116771

SEQ ID NO: 451394 - RNA, 64 nt, Human; identical to SEQ ID NO: 116772

SEQ ID NO: 451395 - RNA, 64 nt, Human; identical to SEQ ID NO: 116773

SEQ ID NO: 451396 - RNA, 64 nt, Human; identical to SEQ ID NO: 449734

SEQ ID NO: 451397 - RNA, 64 nt, Human; identical to SEQ ID NO: 449738

SEQ ID NO: 451398 - RNA, 64 nt, Human; identical to SEQ ID NO: 449739

SEQ ID NO: 451399 - RNA, 64 nt, Human; identical to SEQ ID NO: 449740

SEQ ID NO: 451400 - RNA, 64 nt, Human; identical to SEQ ID NO: 449741

SEQ ID NO: 451401 - RNA, 64 nt, Human; identical to SEQ ID NO: 449742

SEQ ID NO: 451402 - RNA, 64 nt, Human; identical to SEQ ID NO: 449743

SEQ ID NO: 451403 - RNA, 64 nt, Human; identical to SEQ ID NO: 449744

SEQ ID NO: 451404 - RNA, 64 nt, Human; identical to SEQ ID NO: 449745

SEQ ID NO: 451405 - RNA, 64 nt, Human; identical to SEQ ID NO: 449746

SEQ ID NO: 451406 - RNA, 64 nt, Human; identical to SEQ ID NO: 449747

SEQ ID NO: 451407 - RNA, 64 nt, Human; identical to SEQ ID NO: 449748

SEQ ID NO: 451408 - RNA, 64 nt, Human; identical to SEQ ID NO: 449749

SEQ ID NO: 451409 - RNA, 64 nt, Human; identical to SEQ ID NO: 449750

SEQ ID NO: 451410 - RNA, 64 nt, Human; identical to SEQ ID NO: 449751

SEQ ID NO: 451411 - RNA, 64 nt, Human; identical to SEQ ID NO: 116774

SEQ ID NO: 451412 - RNA, 64 nt, Human; identical to SEQ ID NO: 116775

SEQ ID NO: 451413 - RNA, 64 nt, Human; identical to SEQ ID NO: 116776

SEQ ID NO: 451414 - RNA, 64 nt, Human; identical to SEQ ID NO: 449752

SEQ ID NO: 451415 - RNA, 64 nt, Human; identical to SEQ ID NO: 449756

SEQ ID NO: 451416 - RNA, 64 nt, Human; identical to SEQ ID NO: 449757

SEQ ID NO: 451417 - RNA, 64 nt, Human; identical to SEQ ID NO: 449758

SEQ ID NO: 451418 - RNA, 64 nt, Human; identical to SEQ ID NO: 449759

SEQ ID NO: 451419 - RNA, 64 nt, Human; identical to SEQ ID NO: 449760

SEQ ID NO: 451420 - RNA, 64 nt, Human; identical to SEQ ID NO: 449761

SEQ ID NO: 451421 - RNA, 64 nt, Human; identical to SEQ ID NO: 449762

SEQ ID NO: 451422 - RNA, 64 nt, Human; identical to SEQ ID NO: 449763

SEQ ID NO: 451423 - RNA, 64 nt, Human; identical to SEQ ID NO: 449764

SEQ ID NO: 451424 - RNA, 64 nt, Human; identical to SEQ ID NO: 449765

SEQ ID NO: 451425 - RNA, 64 nt, Human; identical to SEQ ID NO: 449766

SEQ ID NO: 451426 - RNA, 64 nt, Human; identical to SEQ ID NO: 449767

SEQ ID NO: 451427 - RNA, 64 nt, Human; identical to SEQ ID NO: 449768

SEQ ID NO: 451428 - RNA, 64 nt, Human; identical to SEQ ID NO: 449769

SEQ ID NO: 451429 - RNA, 64 nt, Human; identical to SEQ ID NO: 116837

SEQ ID NO: 451430 - RNA, 64 nt, Human; identical to SEQ ID NO: 116838

SEQ ID NO: 451431 - RNA, 64 nt, Human; identical to SEQ ID NO: 116839

SEQ ID NO: 451432 - RNA, 64 nt, Human; identical to SEQ ID NO: 449770

SEQ ID NO: 451433 - RNA, 64 nt, Human; identical to SEQ ID NO: 449774

SEQ ID NO: 451434 - RNA, 64 nt, Human; identical to SEQ ID NO: 449775

SEQ ID NO: 451435 - RNA, 64 nt, Human; identical to SEQ ID NO: 449776

SEQ ID NO: 451436 - RNA, 64 nt, Human; identical to SEQ ID NO: 449777

SEQ ID NO: 451437 - RNA, 64 nt, Human; identical to SEQ ID NO: 449778

SEQ ID NO: 451438 - RNA, 64 nt, Human; identical to SEQ ID NO: 449779

SEQ ID NO: 451439 - RNA, 64 nt, Human; identical to SEQ ID NO: 449780

SEQ ID NO: 451440 - RNA, 64 nt, Human; identical to SEQ ID NO: 449781

SEQ ID NO: 451441 - RNA, 64 nt, Human; identical to SEQ ID NO: 449782

SEQ ID NO: 451442 - RNA, 64 nt, Human; identical to SEQ ID NO: 449783

SEQ ID NO: 451443 - RNA, 64 nt, Human; identical to SEQ ID NO: 449784

SEQ ID NO: 451444 - RNA, 64 nt, Human; identical to SEQ ID NO: 449785

SEQ ID NO: 451445 - RNA, 64 nt, Human; identical to SEQ ID NO: 449786

SEQ ID NO: 451446 - RNA, 64 nt, Human; identical to SEQ ID NO: 449787

SEQ ID NO: 451447 - RNA, 64 nt, Human; identical to SEQ ID NO: 116778

SEQ ID NO: 451448 - RNA, 64 nt, Human; identical to SEQ ID NO: 116779

SEQ ID NO: 451449 - RNA, 64 nt, Human; identical to SEQ ID NO: 116780

SEQ ID NO: 451450 - RNA, 64 nt, Human; identical to SEQ ID NO: 449788

SEQ ID NO: 451451 - RNA, 64 nt, Human; identical to SEQ ID NO: 449792

SEQ ID NO: 451452 - RNA, 64 nt, Human; identical to SEQ ID NO: 449793

SEQ ID NO: 451453 - RNA, 64 nt, Human; identical to SEQ ID NO: 449794

SEQ ID NO: 451454 - RNA, 64 nt, Human; identical to SEQ ID NO: 449795

SEQ ID NO: 451455 - RNA, 64 nt, Human; identical to SEQ ID NO: 449796

SEQ ID NO: 451456 - RNA, 64 nt, Human; identical to SEQ ID NO: 449797

SEQ ID NO: 451457 - RNA, 64 nt, Human; identical to SEQ ID NO: 449798

SEQ ID NO: 451458 - RNA, 64 nt, Human; identical to SEQ ID NO: 449799

SEQ ID NO: 451459 - RNA, 64 nt, Human; identical to SEQ ID NO: 449800

SEQ ID NO: 451460 - RNA, 64 nt, Human; identical to SEQ ID NO: 449801

SEQ ID NO: 451461 - RNA, 64 nt, Human; identical to SEQ ID NO: 449802

SEQ ID NO: 451462 - RNA, 64 nt, Human; identical to SEQ ID NO: 449803

SEQ ID NO: 451463 - RNA, 64 nt, Human; identical to SEQ ID NO: 449804

SEQ ID NO: 451464 - RNA, 64 nt, Human; identical to SEQ ID NO: 449805

SEQ ID NO: 451465 - RNA, 64 nt, Human; identical to SEQ ID NO: 116781

SEQ ID NO: 451466 - RNA, 64 nt, Human; identical to SEQ ID NO: 116782

SEQ ID NO: 451467 - RNA, 64 nt, Human; identical to SEQ ID NO: 116783

SEQ ID NO: 451468 - RNA, 64 nt, Human; identical to SEQ ID NO: 449806

SEQ ID NO: 451469 - RNA, 64 nt, Human; identical to SEQ ID NO: 449810

SEQ ID NO: 451470 - RNA, 63 nt, Human; identical to SEQ ID NO: 381122

SEQ ID NO: 451471 - RNA, 64 nt, Human; identical to SEQ ID NO: 449812

SEQ ID NO: 451472 - RNA, 64 nt, Human; identical to SEQ ID NO: 449813

SEQ ID NO: 451473 - RNA, 64 nt, Human; identical to SEQ ID NO: 449814

SEQ ID NO: 451474 - RNA, 64 nt, Human; identical to SEQ ID NO: 449815

SEQ ID NO: 451475 - RNA, 64 nt, Human; identical to SEQ ID NO: 449816

SEQ ID NO: 451476 - RNA, 64 nt, Human; identical to SEQ ID NO: 449817

SEQ ID NO: 451477 - RNA, 64 nt, Human; identical to SEQ ID NO: 449818

SEQ ID NO: 451478 - RNA, 64 nt, Human; identical to SEQ ID NO: 449819

SEQ ID NO: 451479 - RNA, 64 nt, Human; identical to SEQ ID NO: 449820

SEQ ID NO: 451480 - RNA, 64 nt, Human; identical to SEQ ID NO: 449821

SEQ ID NO: 451481 - RNA, 64 nt, Human; identical to SEQ ID NO: 449822

SEQ ID NO: 451482 - RNA, 64 nt, Human; identical to SEQ ID NO: 449823

SEQ ID NO: 451483 - RNA, 64 nt, Human; identical to SEQ ID NO: 116694

SEQ ID NO: 451484 - RNA, 64 nt, Human; identical to SEQ ID NO: 116695

SEQ ID NO: 451485 - RNA, 64 nt, Human; identical to SEQ ID NO: 116696

SEQ ID NO: 451486 - RNA, 64 nt, Human; identical to SEQ ID NO: 449824

SEQ ID NO: 451487 - RNA, 64 nt, Human; identical to SEQ ID NO: 449828

SEQ ID NO: 451488 - RNA, 64 nt, Human; identical to SEQ ID NO: 449829

SEQ ID NO: 451489 - RNA, 64 nt, Human; identical to SEQ ID NO: 449830

SEQ ID NO: 451490 - RNA, 64 nt, Human; identical to SEQ ID NO: 449831

SEQ ID NO: 451491 - RNA, 64 nt, Human; identical to SEQ ID NO: 449832

SEQ ID NO: 451492 - RNA, 64 nt, Human; identical to SEQ ID NO: 449833

SEQ ID NO: 451493 - RNA, 64 nt, Human; identical to SEQ ID NO: 449834

SEQ ID NO: 451494 - RNA, 64 nt, Human; identical to SEQ ID NO: 449835

SEQ ID NO: 451495 - RNA, 64 nt, Human; identical to SEQ ID NO: 449836

SEQ ID NO: 451496 - RNA, 64 nt, Human; identical to SEQ ID NO: 449837

SEQ ID NO: 451497 - RNA, 64 nt, Human; identical to SEQ ID NO: 449838

SEQ ID NO: 451498 - RNA, 64 nt, Human; identical to SEQ ID NO: 449839

SEQ ID NO: 451499 - RNA, 64 nt, Human; identical to SEQ ID NO: 449840

SEQ ID NO: 451500 - RNA, 64 nt, Human; identical to SEQ ID NO: 449841

SEQ ID NO: 451501 - RNA, 64 nt, Human; identical to SEQ ID NO: 116697

SEQ ID NO: 451502 - RNA, 64 nt, Human; identical to SEQ ID NO: 116698

SEQ ID NO: 451503 - RNA, 64 nt, Human; identical to SEQ ID NO: 116699

SEQ ID NO: 451504 - RNA, 64 nt, Human; identical to SEQ ID NO: 449842

SEQ ID NO: 451505 - RNA, 64 nt, Human; identical to SEQ ID NO: 449846

SEQ ID NO: 451506 - RNA, 64 nt, Human; identical to SEQ ID NO: 449847

SEQ ID NO: 451507 - RNA, 64 nt, Human; identical to SEQ ID NO: 449848

SEQ ID NO: 451508 - RNA, 64 nt, Human; identical to SEQ ID NO: 449849

SEQ ID NO: 451509 - RNA, 64 nt, Human; identical to SEQ ID NO: 449850

SEQ ID NO: 451510 - RNA, 64 nt, Human; identical to SEQ ID NO: 449851

SEQ ID NO: 451511 - RNA, 64 nt, Human; identical to SEQ ID NO: 449852

SEQ ID NO: 451512 - RNA, 64 nt, Human; identical to SEQ ID NO: 449853

SEQ ID NO: 451513 - RNA, 64 nt, Human; identical to SEQ ID NO: 449854

SEQ ID NO: 451514 - RNA, 64 nt, Human; identical to SEQ ID NO: 449855

SEQ ID NO: 451515 - RNA, 64 nt, Human; identical to SEQ ID NO: 449856

SEQ ID NO: 451516 - RNA, 64 nt, Human; identical to SEQ ID NO: 449857

SEQ ID NO: 451517 - RNA, 64 nt, Human; identical to SEQ ID NO: 449858

SEQ ID NO: 451518 - RNA, 64 nt, Human; identical to SEQ ID NO: 449859

SEQ ID NO: 451519 - RNA, 64 nt, Human; identical to SEQ ID NO: 116701

SEQ ID NO: 451520 - RNA, 64 nt, Human; identical to SEQ ID NO: 116702

SEQ ID NO: 451521 - RNA, 64 nt, Human; identical to SEQ ID NO: 116703

SEQ ID NO: 451522 - RNA, 64 nt, Human; identical to SEQ ID NO: 449860

SEQ ID NO: 451523 - RNA, 64 nt, Human; identical to SEQ ID NO: 449864

SEQ ID NO: 451524 - RNA, 64 nt, Human; identical to SEQ ID NO: 449865

SEQ ID NO: 451525 - RNA, 64 nt, Human; identical to SEQ ID NO: 449866

SEQ ID NO: 451526 - RNA, 64 nt, Human; identical to SEQ ID NO: 449867

SEQ ID NO: 451527 - RNA, 64 nt, Human; identical to SEQ ID NO: 449868

SEQ ID NO: 451528 - RNA, 64 nt, Human; identical to SEQ ID NO: 449869

SEQ ID NO: 451529 - RNA, 64 nt, Human; identical to SEQ ID NO: 449870

SEQ ID NO: 451530 - RNA, 64 nt, Human; identical to SEQ ID NO: 449871

SEQ ID NO: 451531 - RNA, 64 nt, Human; identical to SEQ ID NO: 449872

SEQ ID NO: 451532 - RNA, 64 nt, Human; identical to SEQ ID NO: 449873

SEQ ID NO: 451533 - RNA, 64 nt, Human; identical to SEQ ID NO: 449874

SEQ ID NO: 451534 - RNA, 64 nt, Human; identical to SEQ ID NO: 449875

SEQ ID NO: 451535 - RNA, 64 nt, Human; identical to SEQ ID NO: 449876

SEQ ID NO: 451536 - RNA, 64 nt, Human; identical to SEQ ID NO: 449877

SEQ ID NO: 451537 - RNA, 64 nt, Human; identical to SEQ ID NO: 116704

SEQ ID NO: 451538 - RNA, 64 nt, Human; identical to SEQ ID NO: 116705

SEQ ID NO: 451539 - RNA, 64 nt, Human; identical to SEQ ID NO: 116706

SEQ ID NO: 451540 - RNA, 64 nt, Human; identical to SEQ ID NO: 449878

SEQ ID NO: 451541 - RNA, 64 nt, Human; identical to SEQ ID NO: 449879

SEQ ID NO: 451542 - RNA, 64 nt, Human; identical to SEQ ID NO: 449880

SEQ ID NO: 451543 - RNA, 64 nt, Human; identical to SEQ ID NO: 449881

SEQ ID NO: 451544 - RNA, 64 nt, Human; identical to SEQ ID NO: 449882

SEQ ID NO: 451545 - RNA, 64 nt, Human; identical to SEQ ID NO: 449883

SEQ ID NO: 451546 - RNA, 64 nt, Human; identical to SEQ ID NO: 449884

SEQ ID NO: 451547 - RNA, 64 nt, Human; identical to SEQ ID NO: 449885

SEQ ID NO: 451548 - RNA, 64 nt, Human; identical to SEQ ID NO: 449886

SEQ ID NO: 451549 - RNA, 64 nt, Human; identical to SEQ ID NO: 449887

SEQ ID NO: 451550 - RNA, 64 nt, Human; identical to SEQ ID NO: 449888

SEQ ID NO: 451551 - RNA, 64 nt, Human; identical to SEQ ID NO: 449889

SEQ ID NO: 451552 - RNA, 64 nt, Human; identical to SEQ ID NO: 449890

SEQ ID NO: 451553 - RNA, 64 nt, Human; identical to SEQ ID NO: 449891

SEQ ID NO: 451554 - RNA, 64 nt, Human; identical to SEQ ID NO: 449892

SEQ ID NO: 451555 - RNA, 64 nt, Human; identical to SEQ ID NO: 116708

SEQ ID NO: 451556 - RNA, 64 nt, Human; identical to SEQ ID NO: 116709

SEQ ID NO: 451557 - RNA, 64 nt, Human; identical to SEQ ID NO: 116710

SEQ ID NO: 451558 - RNA, 64 nt, Human; identical to SEQ ID NO: 449893

SEQ ID NO: 451559 - RNA, 64 nt, Human; identical to SEQ ID NO: 449896

SEQ ID NO: 451560 - RNA, 64 nt, Human; identical to SEQ ID NO: 449897

SEQ ID NO: 451561 - RNA, 64 nt, Human; identical to SEQ ID NO: 449898

SEQ ID NO: 451562 - RNA, 64 nt, Human; identical to SEQ ID NO: 449899

SEQ ID NO: 451563 - RNA, 64 nt, Human; identical to SEQ ID NO: 449900

SEQ ID NO: 451564 - RNA, 64 nt, Human; identical to SEQ ID NO: 449901

SEQ ID NO: 451565 - RNA, 64 nt, Human; identical to SEQ ID NO: 449902

SEQ ID NO: 451566 - RNA, 64 nt, Human; identical to SEQ ID NO: 449903

SEQ ID NO: 451567 - RNA, 64 nt, Human; identical to SEQ ID NO: 449904

SEQ ID NO: 451568 - RNA, 64 nt, Human; identical to SEQ ID NO: 449905

SEQ ID NO: 451569 - RNA, 53 nt, Human; identical to SEQ ID NO: 381206

SEQ ID NO: 451570 - RNA, 64 nt, Human; identical to SEQ ID NO: 449907

SEQ ID NO: 451571 - RNA, 64 nt, Human; identical to SEQ ID NO: 449908

SEQ ID NO: 451572 - RNA, 64 nt, Human; identical to SEQ ID NO: 449909

SEQ ID NO: 451573 - RNA, 64 nt, Human; identical to SEQ ID NO: 116711

SEQ ID NO: 451574 - RNA, 64 nt, Human; identical to SEQ ID NO: 116712

SEQ ID NO: 451575 - RNA, 64 nt, Human; identical to SEQ ID NO: 116713

SEQ ID NO: 451576 - RNA, 64 nt, Human; identical to SEQ ID NO: 449910

SEQ ID NO: 451577 - RNA, 64 nt, Human; identical to SEQ ID NO: 449914

SEQ ID NO: 451578 - RNA, 64 nt, Human; identical to SEQ ID NO: 449915

SEQ ID NO: 451579 - RNA, 64 nt, Human; identical to SEQ ID NO: 449916

SEQ ID NO: 451580 - RNA, 64 nt, Human; identical to SEQ ID NO: 449917

SEQ ID NO: 451581 - RNA, 59 nt, Human; identical to SEQ ID NO: 381215

SEQ ID NO: 451582 - RNA, 64 nt, Human; identical to SEQ ID NO: 449919

SEQ ID NO: 451583 - RNA, 64 nt, Human; identical to SEQ ID NO: 449920

SEQ ID NO: 451584 - RNA, 64 nt, Human; identical to SEQ ID NO: 449921

SEQ ID NO: 451585 - RNA, 64 nt, Human; identical to SEQ ID NO: 449922

SEQ ID NO: 451586 - RNA, 64 nt, Human; identical to SEQ ID NO: 449923

SEQ ID NO: 451587 - RNA, 64 nt, Human; identical to SEQ ID NO: 449924

SEQ ID NO: 451588 - RNA, 64 nt, Human; identical to SEQ ID NO: 449925

SEQ ID NO: 451589 - RNA, 64 nt, Human; identical to SEQ ID NO: 449926

SEQ ID NO: 451590 - RNA, 64 nt, Human; identical to SEQ ID NO: 449927

SEQ ID NO: 451591 - RNA, 64 nt, Human; identical to SEQ ID NO: 116785

SEQ ID NO: 451592 - RNA, 64 nt, Human; identical to SEQ ID NO: 116786

SEQ ID NO: 451593 - RNA, 64 nt, Human; identical to SEQ ID NO: 116787

SEQ ID NO: 451594 - RNA, 64 nt, Human; identical to SEQ ID NO: 449928

SEQ ID NO: 451595 - RNA, 64 nt, Human; identical to SEQ ID NO: 449931

SEQ ID NO: 451596 - RNA, 64 nt, Human; identical to SEQ ID NO: 449932

SEQ ID NO: 451597 - RNA, 64 nt, Human; identical to SEQ ID NO: 449933

SEQ ID NO: 451598 - RNA, 64 nt, Human; identical to SEQ ID NO: 449934

SEQ ID NO: 451599 - RNA, 64 nt, Human; identical to SEQ ID NO: 449935

SEQ ID NO: 451600 - RNA, 64 nt, Human; identical to SEQ ID NO: 449936

SEQ ID NO: 451601 - RNA, 64 nt, Human; identical to SEQ ID NO: 449937

SEQ ID NO: 451602 - RNA, 64 nt, Human; identical to SEQ ID NO: 449938

SEQ ID NO: 451603 - RNA, 64 nt, Human; identical to SEQ ID NO: 449939

SEQ ID NO: 451604 - RNA, 64 nt, Human; identical to SEQ ID NO: 449940

SEQ ID NO: 451605 - RNA, 64 nt, Human; identical to SEQ ID NO: 449941

SEQ ID NO: 451606 - RNA, 64 nt, Human; identical to SEQ ID NO: 449942

SEQ ID NO: 451607 - RNA, 64 nt, Human; identical to SEQ ID NO: 449943

SEQ ID NO: 451608 - RNA, 64 nt, Human; identical to SEQ ID NO: 449944

SEQ ID NO: 451609 - RNA, 64 nt, Human; identical to SEQ ID NO: 116715

SEQ ID NO: 451610 - RNA, 64 nt, Human; identical to SEQ ID NO: 116716

SEQ ID NO: 451611 - RNA, 64 nt, Human; identical to SEQ ID NO: 116717

SEQ ID NO: 451612 - RNA, 64 nt, Human; identical to SEQ ID NO: 449945

SEQ ID NO: 451613 - RNA, 64 nt, Human; identical to SEQ ID NO: 449948

SEQ ID NO: 451614 - RNA, 64 nt, Human; identical to SEQ ID NO: 449949

SEQ ID NO: 451615 - RNA, 64 nt, Human; identical to SEQ ID NO: 449950

SEQ ID NO: 451616 - RNA, 64 nt, Human; identical to SEQ ID NO: 449951

SEQ ID NO: 451617 - RNA, 64 nt, Human; identical to SEQ ID NO: 449952

SEQ ID NO: 451618 - RNA, 64 nt, Human; identical to SEQ ID NO: 449953

SEQ ID NO: 451619 - RNA, 64 nt, Human; identical to SEQ ID NO: 449954

SEQ ID NO: 451620 - RNA, 64 nt, Human; identical to SEQ ID NO: 449955

SEQ ID NO: 451621 - RNA, 64 nt, Human; identical to SEQ ID NO: 449956

SEQ ID NO: 451622 - RNA, 64 nt, Human; identical to SEQ ID NO: 449957

SEQ ID NO: 451623 - RNA, 64 nt, Human; identical to SEQ ID NO: 449958

SEQ ID NO: 451624 - RNA, 64 nt, Human; identical to SEQ ID NO: 449959

SEQ ID NO: 451625 - RNA, 64 nt, Human; identical to SEQ ID NO: 449960

SEQ ID NO: 451626 - RNA, 64 nt, Human; identical to SEQ ID NO: 449961

SEQ ID NO: 451627 - RNA, 64 nt, Human; identical to SEQ ID NO: 116718

SEQ ID NO: 451628 - RNA, 64 nt, Human; identical to SEQ ID NO: 116719

SEQ ID NO: 451629 - RNA, 64 nt, Human; identical to SEQ ID NO: 116720

SEQ ID NO: 451630 - RNA, 64 nt, Human; identical to SEQ ID NO: 449962

SEQ ID NO: 451631 - RNA, 64 nt, Human; identical to SEQ ID NO: 449966

SEQ ID NO: 451632 - RNA, 50 nt, Human; identical to SEQ ID NO: 381257

SEQ ID NO: 451633 - RNA, 64 nt, Human; identical to SEQ ID NO: 449968

SEQ ID NO: 451634 - RNA, 64 nt, Human; identical to SEQ ID NO: 449969

SEQ ID NO: 451635 - RNA, 64 nt, Human; identical to SEQ ID NO: 449970

SEQ ID NO: 451636 - RNA, 64 nt, Human; identical to SEQ ID NO: 449971

SEQ ID NO: 451637 - RNA, 64 nt, Human; identical to SEQ ID NO: 449972

SEQ ID NO: 451638 - RNA, 64 nt, Human; identical to SEQ ID NO: 449973

SEQ ID NO: 451639 - RNA, 64 nt, Human; identical to SEQ ID NO: 449974

SEQ ID NO: 451640 - RNA, 64 nt, Human; identical to SEQ ID NO: 449975

SEQ ID NO: 451641 - RNA, 64 nt, Human; identical to SEQ ID NO: 449976

SEQ ID NO: 451642 - RNA, 64 nt, Human; identical to SEQ ID NO: 449977

SEQ ID NO: 451643 - RNA, 64 nt, Human; identical to SEQ ID NO: 449978

SEQ ID NO: 451644 - RNA, 64 nt, Human; identical to SEQ ID NO: 449979

SEQ ID NO: 451645 - RNA, 64 nt, Human; identical to SEQ ID NO: 116722

SEQ ID NO: 451646 - RNA, 64 nt, Human; identical to SEQ ID NO: 116723

SEQ ID NO: 451647 - RNA, 64 nt, Human; identical to SEQ ID NO: 116724

SEQ ID NO: 451648 - RNA, 64 nt, Human; identical to SEQ ID NO: 449980

SEQ ID NO: 451649 - RNA, 64 nt, Human; identical to SEQ ID NO: 449983

SEQ ID NO: 451650 - RNA, 64 nt, Human; identical to SEQ ID NO: 449984

SEQ ID NO: 451651 - RNA, 64 nt, Human; identical to SEQ ID NO: 449985

SEQ ID NO: 451652 - RNA, 64 nt, Human; identical to SEQ ID NO: 449986

SEQ ID NO: 451653 - RNA, 64 nt, Human; identical to SEQ ID NO: 449987

SEQ ID NO: 451654 - RNA, 64 nt, Human; identical to SEQ ID NO: 449988

SEQ ID NO: 451655 - RNA, 64 nt, Human; identical to SEQ ID NO: 449989

SEQ ID NO: 451656 - RNA, 64 nt, Human; identical to SEQ ID NO: 449990

SEQ ID NO: 451657 - RNA, 64 nt, Human; identical to SEQ ID NO: 449991

SEQ ID NO: 451658 - RNA, 64 nt, Human; identical to SEQ ID NO: 449992

SEQ ID NO: 451659 - RNA, 64 nt, Human; identical to SEQ ID NO: 449993

SEQ ID NO: 451660 - RNA, 64 nt, Human; identical to SEQ ID NO: 449994

SEQ ID NO: 451661 - RNA, 64 nt, Human; identical to SEQ ID NO: 449995

SEQ ID NO: 451662 - RNA, 64 nt, Human; identical to SEQ ID NO: 449996

SEQ ID NO: 451663 - RNA, 64 nt, Human; identical to SEQ ID NO: 116725

SEQ ID NO: 451664 - RNA, 64 nt, Human; identical to SEQ ID NO: 116726

SEQ ID NO: 451665 - RNA, 64 nt, Human; identical to SEQ ID NO: 116727

SEQ ID NO: 451666 - RNA, 64 nt, Human; identical to SEQ ID NO: 449997

SEQ ID NO: 451667 - RNA, 64 nt, Human; identical to SEQ ID NO: 450000

SEQ ID NO: 451668 - RNA, 64 nt, Human; identical to SEQ ID NO: 450001

SEQ ID NO: 451669 - RNA, 64 nt, Human; identical to SEQ ID NO: 450002

SEQ ID NO: 451670 - RNA, 64 nt, Human; identical to SEQ ID NO: 450003

SEQ ID NO: 451671 - RNA, 64 nt, Human; identical to SEQ ID NO: 450004

SEQ ID NO: 451672 - RNA, 64 nt, Human; identical to SEQ ID NO: 450005

SEQ ID NO: 451673 - RNA, 64 nt, Human; identical to SEQ ID NO: 450006

SEQ ID NO: 451674 - RNA, 64 nt, Human; identical to SEQ ID NO: 450007

SEQ ID NO: 451675 - RNA, 64 nt, Human; identical to SEQ ID NO: 450008

SEQ ID NO: 451676 - RNA, 64 nt, Human; identical to SEQ ID NO: 450009

SEQ ID NO: 451677 - RNA, 64 nt, Human; identical to SEQ ID NO: 450010

SEQ ID NO: 451678 - RNA, 64 nt, Human; identical to SEQ ID NO: 450011

SEQ ID NO: 451679 - RNA, 64 nt, Human; identical to SEQ ID NO: 450012

SEQ ID NO: 451680 - RNA, 64 nt, Human; identical to SEQ ID NO: 450013

SEQ ID NO: 451681 - RNA, 64 nt, Human; identical to SEQ ID NO: 116729

SEQ ID NO: 451682 - RNA, 64 nt, Human; identical to SEQ ID NO: 116730

SEQ ID NO: 451683 - RNA, 64 nt, Human; identical to SEQ ID NO: 116731

SEQ ID NO: 451684 - RNA, 64 nt, Human; identical to SEQ ID NO: 450014

SEQ ID NO: 451685 - RNA, 64 nt, Human; identical to SEQ ID NO: 450018

SEQ ID NO: 451686 - RNA, 64 nt, Human; identical to SEQ ID NO: 450019

SEQ ID NO: 451687 - RNA, 64 nt, Human; identical to SEQ ID NO: 450020

SEQ ID NO: 451688 - RNA, 64 nt, Human; identical to SEQ ID NO: 450021

SEQ ID NO: 451689 - RNA, 64 nt, Human; identical to SEQ ID NO: 450022

SEQ ID NO: 451690 - RNA, 64 nt, Human; identical to SEQ ID NO: 450023

SEQ ID NO: 451691 - RNA, 64 nt, Human; identical to SEQ ID NO: 450024

SEQ ID NO: 451692 - RNA, 64 nt, Human; identical to SEQ ID NO: 450025

SEQ ID NO: 451693 - RNA, 64 nt, Human; identical to SEQ ID NO: 450026

SEQ ID NO: 451694 - RNA, 64 nt, Human; identical to SEQ ID NO: 450027

SEQ ID NO: 451695 - RNA, 64 nt, Human; identical to SEQ ID NO: 450028

SEQ ID NO: 451696 - RNA, 64 nt, Human; identical to SEQ ID NO: 450029

SEQ ID NO: 451697 - RNA, 64 nt, Human; identical to SEQ ID NO: 450030

SEQ ID NO: 451698 - RNA, 64 nt, Human; identical to SEQ ID NO: 450031

SEQ ID NO: 451699 - RNA, 64 nt, Human; identical to SEQ ID NO: 116732

SEQ ID NO: 451700 - RNA, 64 nt, Human; identical to SEQ ID NO: 116733

SEQ ID NO: 451701 - RNA, 64 nt, Human; identical to SEQ ID NO: 116734

SEQ ID NO: 451702 - RNA, 64 nt, Human; identical to SEQ ID NO: 450032

SEQ ID NO: 451703 - RNA, 64 nt, Human; identical to SEQ ID NO: 450036

SEQ ID NO: 451704 - RNA, 64 nt, Human; identical to SEQ ID NO: 450037

SEQ ID NO: 451705 - RNA, 64 nt, Human; identical to SEQ ID NO: 450038

SEQ ID NO: 451706 - RNA, 64 nt, Human; identical to SEQ ID NO: 450039

SEQ ID NO: 451707 - RNA, 64 nt, Human; identical to SEQ ID NO: 450040

SEQ ID NO: 451708 - RNA, 64 nt, Human; identical to SEQ ID NO: 450041

SEQ ID NO: 451709 - RNA, 64 nt, Human; identical to SEQ ID NO: 450042

SEQ ID NO: 451710 - RNA, 64 nt, Human; identical to SEQ ID NO: 450043

SEQ ID NO: 451711 - RNA, 64 nt, Human; identical to SEQ ID NO: 450044

SEQ ID NO: 451712 - RNA, 64 nt, Human; identical to SEQ ID NO: 450045

SEQ ID NO: 451713 - RNA, 64 nt, Human; identical to SEQ ID NO: 450046

SEQ ID NO: 451714 - RNA, 64 nt, Human; identical to SEQ ID NO: 450047

SEQ ID NO: 451715 - RNA, 64 nt, Human; identical to SEQ ID NO: 450048

SEQ ID NO: 451716 - RNA, 64 nt, Human; identical to SEQ ID NO: 450049

SEQ ID NO: 451717 - RNA, 64 nt, Human; identical to SEQ ID NO: 116788

SEQ ID NO: 451718 - RNA, 64 nt, Human; identical to SEQ ID NO: 116789

SEQ ID NO: 451719 - RNA, 64 nt, Human; identical to SEQ ID NO: 116790

SEQ ID NO: 451720 - RNA, 64 nt, Human; identical to SEQ ID NO: 450050

SEQ ID NO: 451721 - RNA, 64 nt, Human; identical to SEQ ID NO: 450054

SEQ ID NO: 451722 - RNA, 64 nt, Human; identical to SEQ ID NO: 450055

SEQ ID NO: 451723 - RNA, 64 nt, Human; identical to SEQ ID NO: 450056

SEQ ID NO: 451724 - RNA, 64 nt, Human; identical to SEQ ID NO: 450057

SEQ ID NO: 451725 - RNA, 64 nt, Human; identical to SEQ ID NO: 450058

SEQ ID NO: 451726 - RNA, 64 nt, Human; identical to SEQ ID NO: 450059

SEQ ID NO: 451727 - RNA, 64 nt, Human; identical to SEQ ID NO: 450060

SEQ ID NO: 451728 - RNA, 64 nt, Human; identical to SEQ ID NO: 450061

SEQ ID NO: 451729 - RNA, 64 nt, Human; identical to SEQ ID NO: 450062

SEQ ID NO: 451730 - RNA, 64 nt, Human; identical to SEQ ID NO: 450063

SEQ ID NO: 451731 - RNA, 64 nt, Human; identical to SEQ ID NO: 450064

SEQ ID NO: 451732 - RNA, 64 nt, Human; identical to SEQ ID NO: 450065

SEQ ID NO: 451733 - RNA, 64 nt, Human; identical to SEQ ID NO: 450066

SEQ ID NO: 451734 - RNA, 52 nt, Human; identical to SEQ ID NO: 381344

SEQ ID NO: 451735 - RNA, 64 nt, Human; identical to SEQ ID NO: 116628

SEQ ID NO: 451736 - RNA, 64 nt, Human; identical to SEQ ID NO: 116629

SEQ ID NO: 451737 - RNA, 64 nt, Human; identical to SEQ ID NO: 116630

SEQ ID NO: 451738 - RNA, 64 nt, Human; identical to SEQ ID NO: 450068

SEQ ID NO: 451739 - RNA, 64 nt, Human; identical to SEQ ID NO: 450072

SEQ ID NO: 451740 - RNA, 64 nt, Human; identical to SEQ ID NO: 450073

SEQ ID NO: 451741 - RNA, 64 nt, Human; identical to SEQ ID NO: 450074

SEQ ID NO: 451742 - RNA, 64 nt, Human; identical to SEQ ID NO: 450075

SEQ ID NO: 451743 - RNA, 64 nt, Human; identical to SEQ ID NO: 450076

SEQ ID NO: 451744 - RNA, 64 nt, Human; identical to SEQ ID NO: 450077

SEQ ID NO: 451745 - RNA, 64 nt, Human; identical to SEQ ID NO: 450078

SEQ ID NO: 451746 - RNA, 52 nt, Human; identical to SEQ ID NO: 381351

SEQ ID NO: 451747 - RNA, 64 nt, Human; identical to SEQ ID NO: 450080

SEQ ID NO: 451748 - RNA, 64 nt, Human; identical to SEQ ID NO: 450081

SEQ ID NO: 451749 - RNA, 64 nt, Human; identical to SEQ ID NO: 450082

SEQ ID NO: 451750 - RNA, 64 nt, Human; identical to SEQ ID NO: 450083

SEQ ID NO: 451751 - RNA, 64 nt, Human; identical to SEQ ID NO: 450084

SEQ ID NO: 451752 - RNA, 64 nt, Human; identical to SEQ ID NO: 450085

SEQ ID NO: 451753 - RNA, 64 nt, Human; identical to SEQ ID NO: 116632

SEQ ID NO: 451754 - RNA, 64 nt, Human; identical to SEQ ID NO: 116633

SEQ ID NO: 451755 - RNA, 64 nt, Human; identical to SEQ ID NO: 116634

SEQ ID NO: 451756 - RNA, 64 nt, Human; identical to SEQ ID NO: 450086

SEQ ID NO: 451757 - RNA, 64 nt, Human; identical to SEQ ID NO: 450090

SEQ ID NO: 451758 - RNA, 64 nt, Human; identical to SEQ ID NO: 450091

SEQ ID NO: 451759 - RNA, 64 nt, Human; identical to SEQ ID NO: 450092

SEQ ID NO: 451760 - RNA, 64 nt, Human; identical to SEQ ID NO: 450093

SEQ ID NO: 451761 - RNA, 64 nt, Human; identical to SEQ ID NO: 450094

SEQ ID NO: 451762 - RNA, 64 nt, Human; identical to SEQ ID NO: 450095

SEQ ID NO: 451763 - RNA, 54 nt, Human; identical to SEQ ID NO: 381367

SEQ ID NO: 451764 - RNA, 64 nt, Human; identical to SEQ ID NO: 450097

SEQ ID NO: 451765 - RNA, 64 nt, Human; identical to SEQ ID NO: 450098

SEQ ID NO: 451766 - RNA, 64 nt, Human; identical to SEQ ID NO: 450099

SEQ ID NO: 451767 - RNA, 64 nt, Human; identical to SEQ ID NO: 450100

SEQ ID NO: 451768 - RNA, 64 nt, Human; identical to SEQ ID NO: 450101

SEQ ID NO: 451769 - RNA, 64 nt, Human; identical to SEQ ID NO: 450102

SEQ ID NO: 451770 - RNA, 64 nt, Human; identical to SEQ ID NO: 450103

SEQ ID NO: 451771 - RNA, 64 nt, Human; identical to SEQ ID NO: 116635

SEQ ID NO: 451772 - RNA, 64 nt, Human; identical to SEQ ID NO: 116636

SEQ ID NO: 451773 - RNA, 64 nt, Human; identical to SEQ ID NO: 116637

SEQ ID NO: 451774 - RNA, 64 nt, Human; identical to SEQ ID NO: 450104

SEQ ID NO: 451775 - RNA, 64 nt, Human; identical to SEQ ID NO: 450108

SEQ ID NO: 451776 - RNA, 64 nt, Human; identical to SEQ ID NO: 450109

SEQ ID NO: 451777 - RNA, 64 nt, Human; identical to SEQ ID NO: 450110

SEQ ID NO: 451778 - RNA, 64 nt, Human; identical to SEQ ID NO: 450111

SEQ ID NO: 451779 - RNA, 64 nt, Human; identical to SEQ ID NO: 450112

SEQ ID NO: 451780 - RNA, 64 nt, Human; identical to SEQ ID NO: 450113

SEQ ID NO: 451781 - RNA, 64 nt, Human; identical to SEQ ID NO: 450114

SEQ ID NO: 451782 - RNA, 64 nt, Human; identical to SEQ ID NO: 450115

SEQ ID NO: 451783 - RNA, 64 nt, Human; identical to SEQ ID NO: 450116

SEQ ID NO: 451784 - RNA, 64 nt, Human; identical to SEQ ID NO: 450117

SEQ ID NO: 451785 - RNA, 64 nt, Human; identical to SEQ ID NO: 450118

SEQ ID NO: 451786 - RNA, 64 nt, Human; identical to SEQ ID NO: 450119

SEQ ID NO: 451787 - RNA, 64 nt, Human; identical to SEQ ID NO: 450120

SEQ ID NO: 451788 - RNA, 64 nt, Human; identical to SEQ ID NO: 450121

SEQ ID NO: 451789 - RNA, 64 nt, Human; identical to SEQ ID NO: 116639

SEQ ID NO: 451790 - RNA, 64 nt, Human; identical to SEQ ID NO: 116640

SEQ ID NO: 451791 - RNA, 64 nt, Human; identical to SEQ ID NO: 116641

SEQ ID NO: 451792 - RNA, 64 nt, Human; identical to SEQ ID NO: 450122

SEQ ID NO: 451793 - RNA, 64 nt, Human; identical to SEQ ID NO: 450126

SEQ ID NO: 451794 - RNA, 64 nt, Human; identical to SEQ ID NO: 450127

SEQ ID NO: 451795 - RNA, 64 nt, Human; identical to SEQ ID NO: 450128

SEQ ID NO: 451796 - RNA, 64 nt, Human; identical to SEQ ID NO: 450129

SEQ ID NO: 451797 - RNA, 64 nt, Human; identical to SEQ ID NO: 450130

SEQ ID NO: 451798 - RNA, 64 nt, Human; identical to SEQ ID NO: 450131

SEQ ID NO: 451799 - RNA, 64 nt, Human; identical to SEQ ID NO: 450132

SEQ ID NO: 451800 - RNA, 64 nt, Human; identical to SEQ ID NO: 450133

SEQ ID NO: 451801 - RNA, 64 nt, Human; identical to SEQ ID NO: 450134

SEQ ID NO: 451802 - RNA, 64 nt, Human; identical to SEQ ID NO: 450135

SEQ ID NO: 451803 - RNA, 64 nt, Human; identical to SEQ ID NO: 450136

SEQ ID NO: 451804 - RNA, 64 nt, Human; identical to SEQ ID NO: 450137

SEQ ID NO: 451805 - RNA, 64 nt, Human; identical to SEQ ID NO: 450138

SEQ ID NO: 451806 - RNA, 64 nt, Human; identical to SEQ ID NO: 450139

SEQ ID NO: 451807 - RNA, 64 nt, Human; identical to SEQ ID NO: 116642

SEQ ID NO: 451808 - RNA, 64 nt, Human; identical to SEQ ID NO: 116643

SEQ ID NO: 451809 - RNA, 64 nt, Human; identical to SEQ ID NO: 116644

SEQ ID NO: 451810 - RNA, 64 nt, Human; identical to SEQ ID NO: 450140

SEQ ID NO: 451811 - RNA, 64 nt, Human; identical to SEQ ID NO: 450144

SEQ ID NO: 451812 - RNA, 64 nt, Human; identical to SEQ ID NO: 450145

SEQ ID NO: 451813 - RNA, 64 nt, Human; identical to SEQ ID NO: 450146

SEQ ID NO: 451814 - RNA, 64 nt, Human; identical to SEQ ID NO: 450147

SEQ ID NO: 451815 - RNA, 64 nt, Human; identical to SEQ ID NO: 450148

SEQ ID NO: 451816 - RNA, 64 nt, Human; identical to SEQ ID NO: 450149

SEQ ID NO: 451817 - RNA, 64 nt, Human; identical to SEQ ID NO: 450150

SEQ ID NO: 451818 - RNA, 64 nt, Human; identical to SEQ ID NO: 450151

SEQ ID NO: 451819 - RNA, 64 nt, Human; identical to SEQ ID NO: 450152

SEQ ID NO: 451820 - RNA, 64 nt, Human; identical to SEQ ID NO: 450153

SEQ ID NO: 451821 - RNA, 64 nt, Human; identical to SEQ ID NO: 450154

SEQ ID NO: 451822 - RNA, 64 nt, Human; identical to SEQ ID NO: 450155

SEQ ID NO: 451823 - RNA, 64 nt, Human; identical to SEQ ID NO: 450156

SEQ ID NO: 451824 - RNA, 64 nt, Human; identical to SEQ ID NO: 450157

SEQ ID NO: 451825 - RNA, 64 nt, Human; identical to SEQ ID NO: 116646

SEQ ID NO: 451826 - RNA, 64 nt, Human; identical to SEQ ID NO: 116647

SEQ ID NO: 451827 - RNA, 64 nt, Human; identical to SEQ ID NO: 116648

SEQ ID NO: 451828 - RNA, 64 nt, Human; identical to SEQ ID NO: 450158

SEQ ID NO: 451829 - RNA, 51 nt, Human; identical to SEQ ID NO: 381423

SEQ ID NO: 451830 - RNA, 64 nt, Human; identical to SEQ ID NO: 450163

SEQ ID NO: 451831 - RNA, 64 nt, Human; identical to SEQ ID NO: 450164

SEQ ID NO: 451832 - RNA, 64 nt, Human; identical to SEQ ID NO: 450165

SEQ ID NO: 451833 - RNA, 64 nt, Human; identical to SEQ ID NO: 450166

SEQ ID NO: 451834 - RNA, 64 nt, Human; identical to SEQ ID NO: 450167

SEQ ID NO: 451835 - RNA, 64 nt, Human; identical to SEQ ID NO: 450168

SEQ ID NO: 451836 - RNA, 64 nt, Human; identical to SEQ ID NO: 450169

SEQ ID NO: 451837 - RNA, 64 nt, Human; identical to SEQ ID NO: 450170

SEQ ID NO: 451838 - RNA, 64 nt, Human; identical to SEQ ID NO: 450171

SEQ ID NO: 451839 - RNA, 64 nt, Human; identical to SEQ ID NO: 450172

SEQ ID NO: 451840 - RNA, 64 nt, Human; identical to SEQ ID NO: 450173

SEQ ID NO: 451841 - RNA, 64 nt, Human; identical to SEQ ID NO: 450174

SEQ ID NO: 451842 - RNA, 64 nt, Human; identical to SEQ ID NO: 450175

SEQ ID NO: 451843 - RNA, 64 nt, Human; identical to SEQ ID NO: 116649

SEQ ID NO: 451844 - RNA, 64 nt, Human; identical to SEQ ID NO: 116650

SEQ ID NO: 451845 - RNA, 64 nt, Human; identical to SEQ ID NO: 116651

SEQ ID NO: 451846 - RNA, 64 nt, Human; identical to SEQ ID NO: 450176

SEQ ID NO: 451847 - RNA, 64 nt, Human; identical to SEQ ID NO: 450180

SEQ ID NO: 451848 - RNA, 64 nt, Human; identical to SEQ ID NO: 450181

SEQ ID NO: 451849 - RNA, 64 nt, Human; identical to SEQ ID NO: 450182

SEQ ID NO: 451850 - RNA, 64 nt, Human; identical to SEQ ID NO: 450183

SEQ ID NO: 451851 - RNA, 56 nt, Human; identical to SEQ ID NO: 381440

SEQ ID NO: 451852 - RNA, 64 nt, Human; identical to SEQ ID NO: 450185

SEQ ID NO: 451853 - RNA, 64 nt, Human; identical to SEQ ID NO: 450186

SEQ ID NO: 451854 - RNA, 64 nt, Human; identical to SEQ ID NO: 450187

SEQ ID NO: 451855 - RNA, 64 nt, Human; identical to SEQ ID NO: 450188

SEQ ID NO: 451856 - RNA, 64 nt, Human; identical to SEQ ID NO: 450189

SEQ ID NO: 451857 - RNA, 64 nt, Human; identical to SEQ ID NO: 450190

SEQ ID NO: 451858 - RNA, 64 nt, Human; identical to SEQ ID NO: 450191

SEQ ID NO: 451859 - RNA, 64 nt, Human; identical to SEQ ID NO: 450192

SEQ ID NO: 451860 - RNA, 64 nt, Human; identical to SEQ ID NO: 450193

SEQ ID NO: 451861 - RNA, 64 nt, Human; identical to SEQ ID NO: 116736

SEQ ID NO: 451862 - RNA, 64 nt, Human; identical to SEQ ID NO: 116737

SEQ ID NO: 451863 - RNA, 64 nt, Human; identical to SEQ ID NO: 116738

SEQ ID NO: 451864 - RNA, 64 nt, Human; identical to SEQ ID NO: 450194

SEQ ID NO: 451865 - RNA, 64 nt, Human; identical to SEQ ID NO: 450196

SEQ ID NO: 451866 - RNA, 64 nt, Human; identical to SEQ ID NO: 450197

SEQ ID NO: 451867 - RNA, 64 nt, Human; identical to SEQ ID NO: 450198

SEQ ID NO: 451868 - RNA, 64 nt, Human; identical to SEQ ID NO: 450199

SEQ ID NO: 451869 - RNA, 53 nt, Human; identical to SEQ ID NO: 381453

SEQ ID NO: 451870 - RNA, 64 nt, Human; identical to SEQ ID NO: 450201

SEQ ID NO: 451871 - RNA, 64 nt, Human; identical to SEQ ID NO: 450202

SEQ ID NO: 451872 - RNA, 64 nt, Human; identical to SEQ ID NO: 450203

SEQ ID NO: 451873 - RNA, 53 nt, Human; identical to SEQ ID NO: 381459

SEQ ID NO: 451874 - RNA, 64 nt, Human; identical to SEQ ID NO: 450205

SEQ ID NO: 451875 - RNA, 64 nt, Human; identical to SEQ ID NO: 450206

SEQ ID NO: 451876 - RNA, 64 nt, Human; identical to SEQ ID NO: 450207

SEQ ID NO: 451877 - RNA, 64 nt, Human; identical to SEQ ID NO: 450208

SEQ ID NO: 451878 - RNA, 64 nt, Human; identical to SEQ ID NO: 450209

SEQ ID NO: 451879 - RNA, 64 nt, Human; identical to SEQ ID NO: 116653

SEQ ID NO: 451880 - RNA, 64 nt, Human; identical to SEQ ID NO: 116654

SEQ ID NO: 451881 - RNA, 64 nt, Human; identical to SEQ ID NO: 116655

SEQ ID NO: 451882 - RNA, 64 nt, Human; identical to SEQ ID NO: 450210

SEQ ID NO: 451883 - RNA, 64 nt, Human; identical to SEQ ID NO: 450213

SEQ ID NO: 451884 - RNA, 64 nt, Human; identical to SEQ ID NO: 450214

SEQ ID NO: 451885 - RNA, 64 nt, Human; identical to SEQ ID NO: 450215

SEQ ID NO: 451886 - RNA, 64 nt, Human; identical to SEQ ID NO: 450216

SEQ ID NO: 451887 - RNA, 64 nt, Human; identical to SEQ ID NO: 450217

SEQ ID NO: 451888 - RNA, 64 nt, Human; identical to SEQ ID NO: 450218

SEQ ID NO: 451889 - RNA, 64 nt, Human; identical to SEQ ID NO: 450219

SEQ ID NO: 451890 - RNA, 64 nt, Human; identical to SEQ ID NO: 450220

SEQ ID NO: 451891 - RNA, 64 nt, Human; identical to SEQ ID NO: 450221

SEQ ID NO: 451892 - RNA, 64 nt, Human; identical to SEQ ID NO: 450222

SEQ ID NO: 451893 - RNA, 64 nt, Human; identical to SEQ ID NO: 450223

SEQ ID NO: 451894 - RNA, 64 nt, Human; identical to SEQ ID NO: 450224

SEQ ID NO: 451895 - RNA, 64 nt, Human; identical to SEQ ID NO: 450225

SEQ ID NO: 451896 - RNA, 64 nt, Human; identical to SEQ ID NO: 450226

SEQ ID NO: 451897 - RNA, 64 nt, Human; identical to SEQ ID NO: 116656

SEQ ID NO: 451898 - RNA, 64 nt, Human; identical to SEQ ID NO: 116657

SEQ ID NO: 451899 - RNA, 64 nt, Human; identical to SEQ ID NO: 116658

SEQ ID NO: 451900 - RNA, 64 nt, Human; identical to SEQ ID NO: 450227

SEQ ID NO: 451901 - RNA, 64 nt, Human; identical to SEQ ID NO: 450231

SEQ ID NO: 451902 - RNA, 64 nt, Human; identical to SEQ ID NO: 450232

SEQ ID NO: 451903 - RNA, 64 nt, Human; identical to SEQ ID NO: 450233

SEQ ID NO: 451904 - RNA, 64 nt, Human; identical to SEQ ID NO: 450234

SEQ ID NO: 451905 - RNA, 64 nt, Human; identical to SEQ ID NO: 450235

SEQ ID NO: 451906 - RNA, 64 nt, Human; identical to SEQ ID NO: 450236

SEQ ID NO: 451907 - RNA, 64 nt, Human; identical to SEQ ID NO: 450237

SEQ ID NO: 451908 - RNA, 64 nt, Human; identical to SEQ ID NO: 450238

SEQ ID NO: 451909 - RNA, 64 nt, Human; identical to SEQ ID NO: 450239

SEQ ID NO: 451910 - RNA, 64 nt, Human; identical to SEQ ID NO: 450240

SEQ ID NO: 451911 - RNA, 64 nt, Human; identical to SEQ ID NO: 450241

SEQ ID NO: 451912 - RNA, 64 nt, Human; identical to SEQ ID NO: 450242

SEQ ID NO: 451913 - RNA, 64 nt, Human; identical to SEQ ID NO: 450243

SEQ ID NO: 451914 - RNA, 64 nt, Human; identical to SEQ ID NO: 450244

SEQ ID NO: 451915 - RNA, 64 nt, Human; identical to SEQ ID NO: 116660

SEQ ID NO: 451916 - RNA, 64 nt, Human; identical to SEQ ID NO: 116661

SEQ ID NO: 451917 - RNA, 64 nt, Human; identical to SEQ ID NO: 116662

SEQ ID NO: 451918 - RNA, 64 nt, Human; identical to SEQ ID NO: 450245

SEQ ID NO: 451919 - RNA, 64 nt, Human; identical to SEQ ID NO: 450249

SEQ ID NO: 451920 - RNA, 64 nt, Human; identical to SEQ ID NO: 450250

SEQ ID NO: 451921 - RNA, 64 nt, Human; identical to SEQ ID NO: 450251

SEQ ID NO: 451922 - RNA, 64 nt, Human; identical to SEQ ID NO: 450252

SEQ ID NO: 451923 - RNA, 64 nt, Human; identical to SEQ ID NO: 450253

SEQ ID NO: 451924 - RNA, 64 nt, Human; identical to SEQ ID NO: 450254

SEQ ID NO: 451925 - RNA, 64 nt, Human; identical to SEQ ID NO: 450255

SEQ ID NO: 451926 - RNA, 64 nt, Human; identical to SEQ ID NO: 450256

SEQ ID NO: 451927 - RNA, 64 nt, Human; identical to SEQ ID NO: 450257

SEQ ID NO: 451928 - RNA, 64 nt, Human; identical to SEQ ID NO: 450258

SEQ ID NO: 451929 - RNA, 64 nt, Human; identical to SEQ ID NO: 450259

SEQ ID NO: 451930 - RNA, 64 nt, Human; identical to SEQ ID NO: 450260

SEQ ID NO: 451931 - RNA, 64 nt, Human; identical to SEQ ID NO: 450261

SEQ ID NO: 451932 - RNA, 64 nt, Human; identical to SEQ ID NO: 450262

SEQ ID NO: 451933 - RNA, 64 nt, Human; identical to SEQ ID NO: 116663

SEQ ID NO: 451934 - RNA, 64 nt, Human; identical to SEQ ID NO: 116664

SEQ ID NO: 451935 - RNA, 64 nt, Human; identical to SEQ ID NO: 116665

SEQ ID NO: 451936 - RNA, 64 nt, Human; identical to SEQ ID NO: 450263

SEQ ID NO: 451937 - RNA, 64 nt, Human; identical to SEQ ID NO: 450267

SEQ ID NO: 451938 - RNA, 64 nt, Human; identical to SEQ ID NO: 450268

SEQ ID NO: 451939 - RNA, 64 nt, Human; identical to SEQ ID NO: 450269

SEQ ID NO: 451940 - RNA, 64 nt, Human; identical to SEQ ID NO: 450270

SEQ ID NO: 451941 - RNA, 64 nt, Human; identical to SEQ ID NO: 450271

SEQ ID NO: 451942 - RNA, 64 nt, Human; identical to SEQ ID NO: 450272

SEQ ID NO: 451943 - RNA, 64 nt, Human; identical to SEQ ID NO: 450273

SEQ ID NO: 451944 - RNA, 64 nt, Human; identical to SEQ ID NO: 450274

SEQ ID NO: 451945 - RNA, 64 nt, Human; identical to SEQ ID NO: 450275

SEQ ID NO: 451946 - RNA, 64 nt, Human; identical to SEQ ID NO: 450276

SEQ ID NO: 451947 - RNA, 64 nt, Human; identical to SEQ ID NO: 450277

SEQ ID NO: 451948 - RNA, 64 nt, Human; identical to SEQ ID NO: 450278

SEQ ID NO: 451949 - RNA, 64 nt, Human; identical to SEQ ID NO: 450279

SEQ ID NO: 451950 - RNA, 64 nt, Human; identical to SEQ ID NO: 450280

SEQ ID NO: 451951 - RNA, 64 nt, Human; identical to SEQ ID NO: 116667

SEQ ID NO: 451952 - RNA, 64 nt, Human; identical to SEQ ID NO: 116668

SEQ ID NO: 451953 - RNA, 64 nt, Human; identical to SEQ ID NO: 116669

SEQ ID NO: 451954 - RNA, 64 nt, Human; identical to SEQ ID NO: 450281

SEQ ID NO: 451955 - RNA, 64 nt, Human; identical to SEQ ID NO: 450285

SEQ ID NO: 451956 - RNA, 64 nt, Human; identical to SEQ ID NO: 450286

SEQ ID NO: 451957 - RNA, 64 nt, Human; identical to SEQ ID NO: 450287

SEQ ID NO: 451958 - RNA, 64 nt, Human; identical to SEQ ID NO: 450288

SEQ ID NO: 451959 - RNA, 64 nt, Human; identical to SEQ ID NO: 450289

SEQ ID NO: 451960 - RNA, 64 nt, Human; identical to SEQ ID NO: 450290

SEQ ID NO: 451961 - RNA, 64 nt, Human; identical to SEQ ID NO: 450291

SEQ ID NO: 451962 - RNA, 64 nt, Human; identical to SEQ ID NO: 450292

SEQ ID NO: 451963 - RNA, 64 nt, Human; identical to SEQ ID NO: 450293

SEQ ID NO: 451964 - RNA, 64 nt, Human; identical to SEQ ID NO: 450294

SEQ ID NO: 451965 - RNA, 64 nt, Human; identical to SEQ ID NO: 450295

SEQ ID NO: 451966 - RNA, 64 nt, Human; identical to SEQ ID NO: 450296

SEQ ID NO: 451967 - RNA, 64 nt, Human; identical to SEQ ID NO: 450297

SEQ ID NO: 451968 - RNA, 64 nt, Human; identical to SEQ ID NO: 450298

SEQ ID NO: 451969 - RNA, 64 nt, Human; identical to SEQ ID NO: 116583

SEQ ID NO: 451970 - RNA, 64 nt, Human; identical to SEQ ID NO: 116584

SEQ ID NO: 451971 - RNA, 64 nt, Human; identical to SEQ ID NO: 116585

SEQ ID NO: 451972 - RNA, 64 nt, Human; identical to SEQ ID NO: 450299

SEQ ID NO: 451973 - RNA, 64 nt, Human; identical to SEQ ID NO: 450303

SEQ ID NO: 451974 - RNA, 64 nt, Human; identical to SEQ ID NO: 450304

SEQ ID NO: 451975 - RNA, 64 nt, Human; identical to SEQ ID NO: 450305

SEQ ID NO: 451976 - RNA, 64 nt, Human; identical to SEQ ID NO: 450306

SEQ ID NO: 451977 - RNA, 64 nt, Human; identical to SEQ ID NO: 450307

SEQ ID NO: 451978 - RNA, 64 nt, Human; identical to SEQ ID NO: 450308

SEQ ID NO: 451979 - RNA, 64 nt, Human; identical to SEQ ID NO: 450309

SEQ ID NO: 451980 - RNA, 64 nt, Human; identical to SEQ ID NO: 450310

SEQ ID NO: 451981 - RNA, 64 nt, Human; identical to SEQ ID NO: 450311

SEQ ID NO: 451982 - RNA, 64 nt, Human; identical to SEQ ID NO: 450312

SEQ ID NO: 451983 - RNA, 64 nt, Human; identical to SEQ ID NO: 450313

SEQ ID NO: 451984 - RNA, 64 nt, Human; identical to SEQ ID NO: 450314

SEQ ID NO: 451985 - RNA, 64 nt, Human; identical to SEQ ID NO: 450315

SEQ ID NO: 451986 - RNA, 64 nt, Human; identical to SEQ ID NO: 450316

SEQ ID NO: 451987 - RNA, 64 nt, Human; identical to SEQ ID NO: 116579

SEQ ID NO: 451988 - RNA, 64 nt, Human; identical to SEQ ID NO: 116580

SEQ ID NO: 451989 - RNA, 64 nt, Human; identical to SEQ ID NO: 116581

SEQ ID NO: 451990 - RNA, 64 nt, Human; identical to SEQ ID NO: 450317

SEQ ID NO: 451991 - RNA, 64 nt, Human; identical to SEQ ID NO: 450321

SEQ ID NO: 451992 - RNA, 64 nt, Human; identical to SEQ ID NO: 450322

SEQ ID NO: 451993 - RNA, 64 nt, Human; identical to SEQ ID NO: 450323

SEQ ID NO: 451994 - RNA, 64 nt, Human; identical to SEQ ID NO: 450324

SEQ ID NO: 451995 - RNA, 64 nt, Human; identical to SEQ ID NO: 450325

SEQ ID NO: 451996 - RNA, 64 nt, Human; identical to SEQ ID NO: 450326

SEQ ID NO: 451997 - RNA, 64 nt, Human; identical to SEQ ID NO: 450327

SEQ ID NO: 451998 - RNA, 64 nt, Human; identical to SEQ ID NO: 450328

SEQ ID NO: 451999 - RNA, 64 nt, Human; identical to SEQ ID NO: 450329

SEQ ID NO: 452000 - RNA, 64 nt, Human; identical to SEQ ID NO: 450330

SEQ ID NO: 452001 - RNA, 64 nt, Human; identical to SEQ ID NO: 450331

SEQ ID NO: 452002 - RNA, 64 nt, Human; identical to SEQ ID NO: 450332

SEQ ID NO: 452003 - RNA, 64 nt, Human; identical to SEQ ID NO: 450333

SEQ ID NO: 452004 - RNA, 64 nt, Human; identical to SEQ ID NO: 450334

SEQ ID NO: 452005 - RNA, 64 nt, Human; identical to SEQ ID NO: 116586

SEQ ID NO: 452006 - RNA, 64 nt, Human; identical to SEQ ID NO: 116587

SEQ ID NO: 452007 - RNA, 64 nt, Human; identical to SEQ ID NO: 116588

SEQ ID NO: 452008 - RNA, 64 nt, Human; identical to SEQ ID NO: 450335

SEQ ID NO: 452009 - RNA, 64 nt, Human; identical to SEQ ID NO: 450339

SEQ ID NO: 452010 - RNA, 64 nt, Human; identical to SEQ ID NO: 450340

SEQ ID NO: 452011 - RNA, 64 nt, Human; identical to SEQ ID NO: 450341

SEQ ID NO: 452012 - RNA, 64 nt, Human; identical to SEQ ID NO: 450342

SEQ ID NO: 452013 - RNA, 64 nt, Human; identical to SEQ ID NO: 450343

SEQ ID NO: 452014 - RNA, 64 nt, Human; identical to SEQ ID NO: 450344

SEQ ID NO: 452015 - RNA, 64 nt, Human; identical to SEQ ID NO: 450345

SEQ ID NO: 452016 - RNA, 64 nt, Human; identical to SEQ ID NO: 450346

SEQ ID NO: 452017 - RNA, 64 nt, Human; identical to SEQ ID NO: 450347

SEQ ID NO: 452018 - RNA, 64 nt, Human; identical to SEQ ID NO: 450348

SEQ ID NO: 452019 - RNA, 64 nt, Human; identical to SEQ ID NO: 450349

SEQ ID NO: 452020 - RNA, 64 nt, Human; identical to SEQ ID NO: 450350

SEQ ID NO: 452021 - RNA, 64 nt, Human; identical to SEQ ID NO: 450351

SEQ ID NO: 452022 - RNA, 64 nt, Human; identical to SEQ ID NO: 450352

SEQ ID NO: 452023 - RNA, 64 nt, Human; identical to SEQ ID NO: 116670

SEQ ID NO: 452024 - RNA, 64 nt, Human; identical to SEQ ID NO: 116691

SEQ ID NO: 452025 - RNA, 64 nt, Human; identical to SEQ ID NO: 116692

SEQ ID NO: 452026 - RNA, 64 nt, Human; identical to SEQ ID NO: 450353

SEQ ID NO: 452027 - RNA, 64 nt, Human; identical to SEQ ID NO: 450357

SEQ ID NO: 452028 - RNA, 64 nt, Human; identical to SEQ ID NO: 450358

SEQ ID NO: 452029 - RNA, 64 nt, Human; identical to SEQ ID NO: 450359

SEQ ID NO: 452030 - RNA, 64 nt, Human; identical to SEQ ID NO: 450360

SEQ ID NO: 452031 - RNA, 64 nt, Human; identical to SEQ ID NO: 450361

SEQ ID NO: 452032 - RNA, 64 nt, Human; identical to SEQ ID NO: 450362

SEQ ID NO: 452033 - RNA, 64 nt, Human; identical to SEQ ID NO: 450363

SEQ ID NO: 452034 - RNA, 64 nt, Human; identical to SEQ ID NO: 450364

SEQ ID NO: 452035 - RNA, 64 nt, Human; identical to SEQ ID NO: 450365

SEQ ID NO: 452036 - RNA, 64 nt, Human; identical to SEQ ID NO: 450366

SEQ ID NO: 452037 - RNA, 64 nt, Human; identical to SEQ ID NO: 450367

SEQ ID NO: 452038 - RNA, 64 nt, Human; identical to SEQ ID NO: 450368

SEQ ID NO: 452039 - RNA, 64 nt, Human; identical to SEQ ID NO: 450369

SEQ ID NO: 452040 - RNA, 64 nt, Human; identical to SEQ ID NO: 450370

SEQ ID NO: 452041 - RNA, 64 nt, Human; identical to SEQ ID NO: 116590

SEQ ID NO: 452042 - RNA, 64 nt, Human; identical to SEQ ID NO: 116591

SEQ ID NO: 452043 - RNA, 64 nt, Human; identical to SEQ ID NO: 116592

SEQ ID NO: 452044 - RNA, 64 nt, Human; identical to SEQ ID NO: 450371

SEQ ID NO: 452045 - RNA, 64 nt, Human; identical to SEQ ID NO: 450375

SEQ ID NO: 452046 - RNA, 64 nt, Human; identical to SEQ ID NO: 450376

SEQ ID NO: 452047 - RNA, 64 nt, Human; identical to SEQ ID NO: 450377

SEQ ID NO: 452048 - RNA, 58 nt, Human; identical to SEQ ID NO: 381604

SEQ ID NO: 452049 - RNA, 64 nt, Human; identical to SEQ ID NO: 450379

SEQ ID NO: 452050 - RNA, 64 nt, Human; identical to SEQ ID NO: 450380

SEQ ID NO: 452051 - RNA, 64 nt, Human; identical to SEQ ID NO: 450381

SEQ ID NO: 452052 - RNA, 64 nt, Human; identical to SEQ ID NO: 450382

SEQ ID NO: 452053 - RNA, 64 nt, Human; identical to SEQ ID NO: 450383

SEQ ID NO: 452054 - RNA, 64 nt, Human; identical to SEQ ID NO: 450384

SEQ ID NO: 452055 - RNA, 64 nt, Human; identical to SEQ ID NO: 450384

SEQ ID NO: 452056 - RNA, 64 nt, Human; identical to SEQ ID NO: 450386

SEQ ID NO: 452057 - RNA, 64 nt, Human; identical to SEQ ID NO: 450387

SEQ ID NO: 452058 - RNA, 64 nt, Human; identical to SEQ ID NO: 450388

SEQ ID NO: 452059 - RNA, 64 nt, Human; identical to SEQ ID NO: 116593

SEQ ID NO: 452060 - RNA, 64 nt, Human; identical to SEQ ID NO: 116594

SEQ ID NO: 452061 - RNA, 64 nt, Human; identical to SEQ ID NO: 116595

SEQ ID NO: 452062 - RNA, 64 nt, Human; identical to SEQ ID NO: 450389

SEQ ID NO: 452063 - RNA, 64 nt, Human; identical to SEQ ID NO: 450393

SEQ ID NO: 452064 - RNA, 64 nt, Human; identical to SEQ ID NO: 450394

SEQ ID NO: 452065 - RNA, 64 nt, Human; identical to SEQ ID NO: 450395

SEQ ID NO: 452066 - RNA, 64 nt, Human; identical to SEQ ID NO: 450396

SEQ ID NO: 452067 - RNA, 64 nt, Human; identical to SEQ ID NO: 450397

SEQ ID NO: 452068 - RNA, 64 nt, Human; identical to SEQ ID NO: 450398

SEQ ID NO: 452069 - RNA, 64 nt, Human; identical to SEQ ID NO: 450399

SEQ ID NO: 452070 - RNA, 64 nt, Human; identical to SEQ ID NO: 450400

SEQ ID NO: 452071 - RNA, 64 nt, Human; identical to SEQ ID NO: 450401

SEQ ID NO: 452072 - RNA, 64 nt, Human; identical to SEQ ID NO: 450402

SEQ ID NO: 452073 - RNA, 64 nt, Human; identical to SEQ ID NO: 450403

SEQ ID NO: 452074 - RNA, 64 nt, Human; identical to SEQ ID NO: 450404

SEQ ID NO: 452075 - RNA, 64 nt, Human; identical to SEQ ID NO: 450405

SEQ ID NO: 452076 - RNA, 64 nt, Human; identical to SEQ ID NO: 450406

SEQ ID NO: 452077 - RNA, 64 nt, Human; identical to SEQ ID NO: 116597

SEQ ID NO: 452078 - RNA, 64 nt, Human; identical to SEQ ID NO: 116598

SEQ ID NO: 452079 - RNA, 64 nt, Human; identical to SEQ ID NO: 116599

SEQ ID NO: 452080 - RNA, 64 nt, Human; identical to SEQ ID NO: 450407

SEQ ID NO: 452081 - RNA, 64 nt, Human; identical to SEQ ID NO: 450411

SEQ ID NO: 452082 - RNA, 64 nt, Human; identical to SEQ ID NO: 450412

SEQ ID NO: 452083 - RNA, 64 nt, Human; identical to SEQ ID NO: 450413

SEQ ID NO: 452084 - RNA, 64 nt, Human; identical to SEQ ID NO: 450414

SEQ ID NO: 452085 - RNA, 64 nt, Human; identical to SEQ ID NO: 450415

SEQ ID NO: 452086 - RNA, 64 nt, Human; identical to SEQ ID NO: 450416

SEQ ID NO: 452087 - RNA, 64 nt, Human; identical to SEQ ID NO: 450417

SEQ ID NO: 452088 - RNA, 64 nt, Human; identical to SEQ ID NO: 450418

SEQ ID NO: 452089 - RNA, 64 nt, Human; identical to SEQ ID NO: 450419

SEQ ID NO: 452090 - RNA, 64 nt, Human; identical to SEQ ID NO: 450420

SEQ ID NO: 452091 - RNA, 64 nt, Human; identical to SEQ ID NO: 450421

SEQ ID NO: 452092 - RNA, 64 nt, Human; identical to SEQ ID NO: 450422

SEQ ID NO: 452093 - RNA, 64 nt, Human; identical to SEQ ID NO: 450423

SEQ ID NO: 452094 - RNA, 64 nt, Human; identical to SEQ ID NO: 450424

SEQ ID NO: 452095 - RNA, 64 nt, Human; identical to SEQ ID NO: 116600

SEQ ID NO: 452096 - RNA, 64 nt, Human; identical to SEQ ID NO: 116601

SEQ ID NO: 452097 - RNA, 64 nt, Human; identical to SEQ ID NO: 116602

SEQ ID NO: 452098 - RNA, 64 nt, Human; identical to SEQ ID NO: 450425

SEQ ID NO: 452099 - RNA, 64 nt, Human; identical to SEQ ID NO: 450429

SEQ ID NO: 452100 - RNA, 64 nt, Human; identical to SEQ ID NO: 450430

SEQ ID NO: 452101 - RNA, 64 nt, Human; identical to SEQ ID NO: 450431

SEQ ID NO: 452102 - RNA, 64 nt, Human; identical to SEQ ID NO: 450432

SEQ ID NO: 452103 - RNA, 64 nt, Human; identical to SEQ ID NO: 450433

SEQ ID NO: 452104 - RNA, 64 nt, Human; identical to SEQ ID NO: 450434

SEQ ID NO: 452105 - RNA, 64 nt, Human; identical to SEQ ID NO: 450435

SEQ ID NO: 452106 - RNA, 64 nt, Human; identical to SEQ ID NO: 450436

SEQ ID NO: 452107 - RNA, 64 nt, Human; identical to SEQ ID NO: 449614

SEQ ID NO: 452108 - RNA, 64 nt, Human; identical to SEQ ID NO: 449615

SEQ ID NO: 452109 - RNA, 54 nt, Human; identical to SEQ ID NO: 380960

SEQ ID NO: 452110 - RNA, 64 nt, Human; identical to SEQ ID NO: 449617

SEQ ID NO: 452111 - RNA, 64 nt, Human; identical to SEQ ID NO: 116604

SEQ ID NO: 452112 - RNA, 64 nt, Human; identical to SEQ ID NO: 116605

SEQ ID NO: 452113 - RNA, 64 nt, Human; identical to SEQ ID NO: 116606

SEQ ID NO: 452114 - RNA, 64 nt, Human; identical to SEQ ID NO: 449618

SEQ ID NO: 452115 - RNA, 64 nt, Human; identical to SEQ ID NO: 449619

SEQ ID NO: 452116 - RNA, 64 nt, Human; identical to SEQ ID NO: 449620

SEQ ID NO: 452117 - RNA, 64 nt, Human; identical to SEQ ID NO: 449621

SEQ ID NO: 452118 - RNA, 64 nt, Human; identical to SEQ ID NO: 449622

SEQ ID NO: 452119 - RNA, 64 nt, Human; identical to SEQ ID NO: 449623

SEQ ID NO: 452120 - RNA, 64 nt, Human; identical to SEQ ID NO: 449624

SEQ ID NO: 452121 - RNA, 64 nt, Human; identical to SEQ ID NO: 449625

SEQ ID NO: 452122 - RNA, 64 nt, Human; identical to SEQ ID NO: 449626

SEQ ID NO: 452123 - RNA, 64 nt, Human; identical to SEQ ID NO: 449630

SEQ ID NO: 452124 - RNA, 64 nt, Human; identical to SEQ ID NO: 449631

SEQ ID NO: 452125 - RNA, 64 nt, Human; identical to SEQ ID NO: 449632

SEQ ID NO: 452126 - RNA, 64 nt, Human; identical to SEQ ID NO: 449633

SEQ ID NO: 452127 - RNA, 64 nt, Human; identical to SEQ ID NO: 449634

SEQ ID NO: 452128 - RNA, 64 nt, Human; identical to SEQ ID NO: 449635

SEQ ID NO: 452129 - RNA, 64 nt, Human; identical to SEQ ID NO: 116607

SEQ ID NO: 452130 - RNA, 64 nt, Human; identical to SEQ ID NO: 116608

SEQ ID NO: 452131 - RNA, 64 nt, Human; identical to SEQ ID NO: 116609

SEQ ID NO: 452132 - RNA, 64 nt, Human; identical to SEQ ID NO: 449636

SEQ ID NO: 452133 - RNA, 64 nt, Human; identical to SEQ ID NO: 449637

SEQ ID NO: 452134 - RNA, 64 nt, Human; identical to SEQ ID NO: 449638

SEQ ID NO: 452135 - RNA, 64 nt, Human; identical to SEQ ID NO: 449639

SEQ ID NO: 452136 - RNA, 64 nt, Human; identical to SEQ ID NO: 449640

SEQ ID NO: 452137 - RNA, 64 nt, Human; identical to SEQ ID NO: 449641

SEQ ID NO: 452138 - RNA, 64 nt, Human; identical to SEQ ID NO: 449642

SEQ ID NO: 452139 - RNA, 64 nt, Human; identical to SEQ ID NO: 449643

SEQ ID NO: 452140 - RNA, 64 nt, Human; identical to SEQ ID NO: 449644

SEQ ID NO: 452141 - RNA, 64 nt, Human; identical to SEQ ID NO: 449648

SEQ ID NO: 452142 - RNA, 64 nt, Human; identical to SEQ ID NO: 449649

SEQ ID NO: 452143 - RNA, 64 nt, Human; identical to SEQ ID NO: 449650

SEQ ID NO: 452144 - RNA, 64 nt, Human; identical to SEQ ID NO: 449651

SEQ ID NO: 452145 - RNA, 64 nt, Human; identical to SEQ ID NO: 449652

SEQ ID NO: 452146 - RNA, 64 nt, Human; identical to SEQ ID NO: 449653

SEQ ID NO: 452147 - RNA, 64 nt, Human; identical to SEQ ID NO: 116739

SEQ ID NO: 452148 - RNA, 64 nt, Human; identical to SEQ ID NO: 116740

SEQ ID NO: 452149 - RNA, 64 nt, Human; identical to SEQ ID NO: 116741

SEQ ID NO: 452150 - RNA, 64 nt, Human; identical to SEQ ID NO: 449654

SEQ ID NO: 452151 - RNA, 64 nt, Human; identical to SEQ ID NO: 449655

SEQ ID NO: 452152 - RNA, 64 nt, Human; identical to SEQ ID NO: 449656

SEQ ID NO: 452153 - RNA, 64 nt, Human; identical to SEQ ID NO: 449657

SEQ ID NO: 452154 - RNA, 64 nt, Human; identical to SEQ ID NO: 449658

SEQ ID NO: 452155 - RNA, 64 nt, Human; identical to SEQ ID NO: 449659

SEQ ID NO: 452156 - RNA, 64 nt, Human; identical to SEQ ID NO: 449660

SEQ ID NO: 452157 - RNA, 64 nt, Human; identical to SEQ ID NO: 449661

SEQ ID NO: 452158 - RNA, 64 nt, Human; identical to SEQ ID NO: 449662

SEQ ID NO: 452159 - RNA, 64 nt, Human; identical to SEQ ID NO: 449666

SEQ ID NO: 452160 - RNA, 64 nt, Human; identical to SEQ ID NO: 449667

SEQ ID NO: 452161 - RNA, 64 nt, Human; identical to SEQ ID NO: 449668

SEQ ID NO: 452162 - RNA, 64 nt, Human; identical to SEQ ID NO: 449669

SEQ ID NO: 452163 - RNA, 64 nt, Human; identical to SEQ ID NO: 449670

SEQ ID NO: 452164 - RNA, 64 nt, Human; identical to SEQ ID NO: 449671

SEQ ID NO: 452165 - RNA, 64 nt, Human; identical to SEQ ID NO: 116611

SEQ ID NO: 452166 - RNA, 64 nt, Human; identical to SEQ ID NO: 116612

SEQ ID NO: 452167 - RNA, 64 nt, Human; identical to SEQ ID NO: 116613

SEQ ID NO: 452168 - RNA, 64 nt, Human; identical to SEQ ID NO: 449672

SEQ ID NO: 452169 - RNA, 64 nt, Human; identical to SEQ ID NO: 449673

SEQ ID NO: 452170 - RNA, 64 nt, Human; identical to SEQ ID NO: 449674

SEQ ID NO: 452171 - RNA, 64 nt, Human; identical to SEQ ID NO: 449675

SEQ ID NO: 452172 - RNA, 64 nt, Human; identical to SEQ ID NO: 449676

SEQ ID NO: 452173 - RNA, 64 nt, Human; identical to SEQ ID NO: 449677

SEQ ID NO: 452174 - RNA, 64 nt, Human; identical to SEQ ID NO: 449678

SEQ ID NO: 452175 - RNA, 64 nt, Human; identical to SEQ ID NO: 449679

SEQ ID NO: 452176 - RNA, 64 nt, Human; identical to SEQ ID NO: 449680

SEQ ID NO: 452177 - RNA, 64 nt, Human; identical to SEQ ID NO: 449684

SEQ ID NO: 452178 - RNA, 64 nt, Human; identical to SEQ ID NO: 449685

SEQ ID NO: 452179 - RNA, 64 nt, Human; identical to SEQ ID NO: 449686

SEQ ID NO: 452180 - RNA, 64 nt, Human; identical to SEQ ID NO: 449687

SEQ ID NO: 452181 - RNA, 64 nt, Human; identical to SEQ ID NO: 449688

SEQ ID NO: 452182 - RNA, 64 nt, Human; identical to SEQ ID NO: 449689

SEQ ID NO: 452183 - RNA, 64 nt, Human; identical to SEQ ID NO: 116614

SEQ ID NO: 452184 - RNA, 64 nt, Human; identical to SEQ ID NO: 116615

SEQ ID NO: 452185 - RNA, 64 nt, Human; identical to SEQ ID NO: 116616

SEQ ID NO: 452186 - RNA, 64 nt, Human; identical to SEQ ID NO: 449690

SEQ ID NO: 452187 - RNA, 64 nt, Human; identical to SEQ ID NO: 449691

SEQ ID NO: 452188 - RNA, 64 nt, Human; identical to SEQ ID NO: 449692

SEQ ID NO: 452189 - RNA, 64 nt, Human; identical to SEQ ID NO: 449693

SEQ ID NO: 452190 - RNA, 64 nt, Human; identical to SEQ ID NO: 449694

SEQ ID NO: 452191 - RNA, 64 nt, Human; identical to SEQ ID NO: 449695

SEQ ID NO: 452192 - RNA, 58 nt, Human; identical to SEQ ID NO: 381028

SEQ ID NO: 452193 - RNA, 64 nt, Human; identical to SEQ ID NO: 449697

SEQ ID NO: 452194 - RNA, 64 nt, Human; identical to SEQ ID NO: 449698

SEQ ID NO: 452195 - RNA, 64 nt, Human; identical to SEQ ID NO: 449702

SEQ ID NO: 452196 - RNA, 64 nt, Human; identical to SEQ ID NO: 449703

SEQ ID NO: 452197 - RNA, 64 nt, Human; identical to SEQ ID NO: 449704

SEQ ID NO: 452198 - RNA, 64 nt, Human; identical to SEQ ID NO: 449705

SEQ ID NO: 452199 - RNA, 64 nt, Human; identical to SEQ ID NO: 449706

SEQ ID NO: 452200 - RNA, 64 nt, Human; identical to SEQ ID NO: 449707

SEQ ID NO: 452201 - RNA, 64 nt, Human; identical to SEQ ID NO: 116618

SEQ ID NO: 452202 - RNA, 64 nt, Human; identical to SEQ ID NO: 116619

SEQ ID NO: 452203 - RNA, 64 nt, Human; identical to SEQ ID NO: 116620

SEQ ID NO: 452204 - RNA, 64 nt, Human; identical to SEQ ID NO: 449708

SEQ ID NO: 452205 - RNA, 64 nt, Human; identical to SEQ ID NO: 449709

SEQ ID NO: 452206 - RNA, 64 nt, Human; identical to SEQ ID NO: 449710

SEQ ID NO: 452207 - RNA, 64 nt, Human; identical to SEQ ID NO: 449711

SEQ ID NO: 452208 - RNA, 64 nt, Human; identical to SEQ ID NO: 449712

SEQ ID NO: 452209 - RNA, 64 nt, Human; identical to SEQ ID NO: 449713

SEQ ID NO: 452210 - RNA, 64 nt, Human; identical to SEQ ID NO: 449714

SEQ ID NO: 452211 - RNA, 64 nt, Human; identical to SEQ ID NO: 449715

SEQ ID NO: 452212 - RNA, 64 nt, Human; identical to SEQ ID NO: 449716

SEQ ID NO: 452213 - RNA, 64 nt, Human; identical to SEQ ID NO: 449720

SEQ ID NO: 452214 - RNA, 64 nt, Human; identical to SEQ ID NO: 449721

SEQ ID NO: 452215 - RNA, 64 nt, Human; identical to SEQ ID NO: 449722

SEQ ID NO: 452216 - RNA, 64 nt, Human; identical to SEQ ID NO: 449723

SEQ ID NO: 452217 - RNA, 64 nt, Human; identical to SEQ ID NO: 449724

SEQ ID NO: 452218 - RNA, 64 nt, Human; identical to SEQ ID NO: 449725

SEQ ID NO: 452219 - RNA, 62 nt, Human
cugugcauugguggcaucacagaccccagcuggggcgcgaugucaaaggucgggacagcugu

SEQ ID NO: 452220 - RNA, 62 nt, Human
uuuggaaucccgccccacauucuccaaauucagggcgcgaucuggcaaaggcucccuccccc

SEQ ID NO: 452221 - RNA, 62 nt, Human
ccccgaagcccgccagccacccugccggacucgggcgcgaccugcuggcgcgcgccggaugu

SEQ ID NO: 452222 - RNA, 64 nt, Human; identical to SEQ ID NO: 449726

SEQ ID NO: 452223 - RNA, 64 nt, Human; identical to SEQ ID NO: 449727

SEQ ID NO: 452224 - RNA, 64 nt, Human; identical to SEQ ID NO: 449728

SEQ ID NO: 452225 - RNA, 64 nt, Human; identical to SEQ ID NO: 449729

SEQ ID NO: 452226 - RNA, 64 nt, Human; identical to SEQ ID NO: 449730

SEQ ID NO: 452227 - RNA, 64 nt, Human; identical to SEQ ID NO: 449731

SEQ ID NO: 452228 - RNA, 64 nt, Human; identical to SEQ ID NO: 449732

SEQ ID NO: 452229 - RNA, 64 nt, Human; identical to SEQ ID NO: 449733

SEQ ID NO: 452230 - RNA, 64 nt, Human; identical to SEQ ID NO: 449734

SEQ ID NO: 452231 - RNA, 64 nt, Human; identical to SEQ ID NO: 449738

SEQ ID NO: 452232 - RNA, 64 nt, Human; identical to SEQ ID NO: 449739

SEQ ID NO: 452233 - RNA, 64 nt, Human; identical to SEQ ID NO: 449740

SEQ ID NO: 452234 - RNA, 64 nt, Human; identical to SEQ ID NO: 449741

SEQ ID NO: 452235 - RNA, 64 nt, Human; identical to SEQ ID NO: 449742

SEQ ID NO: 452236 - RNA, 64 nt, Human; identical to SEQ ID NO: 449743

SEQ ID NO: 452237 - RNA, 62 nt, Human
cagguucugccugcuuuggcgggcagacacgcgggcgcgaucccacacaggcuggcgggggc

SEQ ID NO: 452238 - RNA, 62 nt, Human
agaggcggggagaggaggcggcgagggucccggggcgcgaggaaggcgccugcccucuccca

SEQ ID NO: 452239 - RNA, 62 nt, Human
cugcugugugccuucgcgguggaaggcccgaggggcgcgaucuugacccuaagaccggcggc

SEQ ID NO: 452240 - RNA, 64 nt, Human; identical to SEQ ID NO: 449744

SEQ ID NO: 452241 - RNA, 64 nt, Human; identical to SEQ ID NO: 449745

SEQ ID NO: 452242 - RNA, 64 nt, Human; identical to SEQ ID NO: 449746

SEQ ID NO: 452243 - RNA, 64 nt, Human; identical to SEQ ID NO: 449747

SEQ ID NO: 452244 - RNA, 64 nt, Human; identical to SEQ ID NO: 449748

SEQ ID NO: 452245 - RNA, 64 nt, Human; identical to SEQ ID NO: 449749

SEQ ID NO: 452246 - RNA, 64 nt, Human; identical to SEQ ID NO: 449750

SEQ ID NO: 452247 - RNA, 64 nt, Human; identical to SEQ ID NO: 449751

SEQ ID NO: 452248 - RNA, 64 nt, Human; identical to SEQ ID NO: 449752

SEQ ID NO: 452249 - RNA, 64 nt, Human; identical to SEQ ID NO: 449756

SEQ ID NO: 452250 - RNA, 64 nt, Human; identical to SEQ ID NO: 449757

SEQ ID NO: 452251 - RNA, 64 nt, Human; identical to SEQ ID NO: 449758

SEQ ID NO: 452252 - RNA, 64 nt, Human; identical to SEQ ID NO: 449759

SEQ ID NO: 452253 - RNA, 64 nt, Human; identical to SEQ ID NO: 449760

SEQ ID NO: 452254 - RNA, 64 nt, Human; identical to SEQ ID NO: 449761

SEQ ID NO: 452255 - RNA, 62 nt, Human
agcccccugaaucuucuccgugcagccccuuggggcgcgaccuugugcgaggcccucggggc

SEQ ID NO: 452256 - RNA, 62 nt, Human
auuguccgggagcccuucauuuaggacaaaacgggcgcgaugaugcccuggcuuucagggug

SEQ ID NO: 452257 - RNA, 62 nt, Human
caauucuccaagugagggcgggccugggccuggggcgcgaccucggcccggccucccuucgc

SEQ ID NO: 452258 - RNA, 64 nt, Human; identical to SEQ ID NO: 449762

SEQ ID NO: 452259 - RNA, 64 nt, Human; identical to SEQ ID NO: 449763

SEQ ID NO: 452260 - RNA, 64 nt, Human; identical to SEQ ID NO: 449764

SEQ ID NO: 452261 - RNA, 64 nt, Human; identical to SEQ ID NO: 449765

SEQ ID NO: 452262 - RNA, 64 nt, Human; identical to SEQ ID NO: 449766

SEQ ID NO: 452263 - RNA, 64 nt, Human; identical to SEQ ID NO: 449767

SEQ ID NO: 452264 - RNA, 64 nt, Human; identical to SEQ ID NO: 449768

SEQ ID NO: 452265 - RNA, 64 nt, Human; identical to SEQ ID NO: 449769

SEQ ID NO: 452266 - RNA, 64 nt, Human; identical to SEQ ID NO: 449770

SEQ ID NO: 452267 - RNA, 64 nt, Human; identical to SEQ ID NO: 449774

SEQ ID NO: 452268 - RNA, 64 nt, Human; identical to SEQ ID NO: 449775

SEQ ID NO: 452269 - RNA, 64 nt, Human; identical to SEQ ID NO: 449776

SEQ ID NO: 452270 - RNA, 64 nt, Human; identical to SEQ ID NO: 449777

SEQ ID NO: 452271 - RNA, 64 nt, Human; identical to SEQ ID NO: 449778

SEQ ID NO: 452272 - RNA, 64 nt, Human; identical to SEQ ID NO: 449779

SEQ ID NO: 452273 - RNA, 64 nt, Human; identical to SEQ ID NO: 449780

SEQ ID NO: 452274 - RNA, 64 nt, Human; identical to SEQ ID NO: 449781

SEQ ID NO: 452275 - RNA, 64 nt, Human; identical to SEQ ID NO: 449782

SEQ ID NO: 452276 - RNA, 64 nt, Human; identical to SEQ ID NO: 449783

SEQ ID NO: 452277 - RNA, 64 nt, Human; identical to SEQ ID NO: 449784

SEQ ID NO: 452278 - RNA, 64 nt, Human; identical to SEQ ID NO: 449785

SEQ ID NO: 452279 - RNA, 64 nt, Human; identical to SEQ ID NO: 449786

SEQ ID NO: 452280 - RNA, 64 nt, Human; identical to SEQ ID NO: 449787

SEQ ID NO: 452281 - RNA, 64 nt, Human; identical to SEQ ID NO: 449788

SEQ ID NO: 452282 - RNA, 64 nt, Human; identical to SEQ ID NO: 449792

SEQ ID NO: 452283 - RNA, 64 nt, Human; identical to SEQ ID NO: 449793

SEQ ID NO: 452284 - RNA, 64 nt, Human; identical to SEQ ID NO: 449794

SEQ ID NO: 452285 - RNA, 64 nt, Human; identical to SEQ ID NO: 449795

SEQ ID NO: 452286 - RNA, 64 nt, Human; identical to SEQ ID NO: 449796

SEQ ID NO: 452287 - RNA, 64 nt, Human; identical to SEQ ID NO: 449797

SEQ ID NO: 452288 - RNA, 64 nt, Human; identical to SEQ ID NO: 449798

SEQ ID NO: 452289 - RNA, 64 nt, Human; identical to SEQ ID NO: 449799

SEQ ID NO: 452290 - RNA, 64 nt, Human; identical to SEQ ID NO: 449800

SEQ ID NO: 452291 - RNA, 64 nt, Human; identical to SEQ ID NO: 449801

SEQ ID NO: 452292 - RNA, 64 nt, Human; identical to SEQ ID NO: 449802

SEQ ID NO: 452293 - RNA, 64 nt, Human; identical to SEQ ID NO: 449803

SEQ ID NO: 452294 - RNA, 64 nt, Human; identical to SEQ ID NO: 449804

SEQ ID NO: 452295 - RNA, 64 nt, Human; identical to SEQ ID NO: 449805

SEQ ID NO: 452296 - RNA, 64 nt, Human; identical to SEQ ID NO: 449806

SEQ ID NO: 452297 - RNA, 64 nt, Human; identical to SEQ ID NO: 449810

SEQ ID NO: 452298 - RNA, 63 nt, Human; identical to SEQ ID NO: 381122

SEQ ID NO: 452299 - RNA, 64 nt, Human; identical to SEQ ID NO: 449812

SEQ ID NO: 452300 - RNA, 64 nt, Human; identical to SEQ ID NO: 449813

SEQ ID NO: 452301 - RNA, 64 nt, Human; identical to SEQ ID NO: 449814

SEQ ID NO: 452302 - RNA, 64 nt, Human; identical to SEQ ID NO: 449815

SEQ ID NO: 452303 - RNA, 64 nt, Human; identical to SEQ ID NO: 449816

SEQ ID NO: 452304 - RNA, 64 nt, Human; identical to SEQ ID NO: 449817

SEQ ID NO: 452305 - RNA, 64 nt, Human; identical to SEQ ID NO: 449818

SEQ ID NO: 452306 - RNA, 64 nt, Human; identical to SEQ ID NO: 449819

SEQ ID NO: 452307 - RNA, 64 nt, Human; identical to SEQ ID NO: 449820

SEQ ID NO: 452308 - RNA, 64 nt, Human; identical to SEQ ID NO: 449821

SEQ ID NO: 452309 - RNA, 64 nt, Human; identical to SEQ ID NO: 449822

SEQ ID NO: 452310 - RNA, 64 nt, Human; identical to SEQ ID NO: 449823

SEQ ID NO: 452311 - RNA, 64 nt, Human; identical to SEQ ID NO: 449824

SEQ ID NO: 452312 - RNA, 64 nt, Human; identical to SEQ ID NO: 449828

SEQ ID NO: 452313 - RNA, 64 nt, Human; identical to SEQ ID NO: 449829

SEQ ID NO: 452314 - RNA, 64 nt, Human; identical to SEQ ID NO: 449830

SEQ ID NO: 452315 - RNA, 64 nt, Human; identical to SEQ ID NO: 449831

SEQ ID NO: 452316 - RNA, 64 nt, Human; identical to SEQ ID NO: 449832

SEQ ID NO: 452317 - RNA, 64 nt, Human; identical to SEQ ID NO: 449833

SEQ ID NO: 452318 - RNA, 64 nt, Human; identical to SEQ ID NO: 116621

SEQ ID NO: 452319 - RNA, 64 nt, Human; identical to SEQ ID NO: 116622

SEQ ID NO: 452320 - RNA, 64 nt, Human; identical to SEQ ID NO: 116623

SEQ ID NO: 452321 - RNA, 64 nt, Human; identical to SEQ ID NO: 449834

SEQ ID NO: 452322 - RNA, 64 nt, Human; identical to SEQ ID NO: 449835

SEQ ID NO: 452323 - RNA, 64 nt, Human; identical to SEQ ID NO: 449836

SEQ ID NO: 452324 - RNA, 64 nt, Human; identical to SEQ ID NO: 449837

SEQ ID NO: 452325 - RNA, 64 nt, Human; identical to SEQ ID NO: 449838

SEQ ID NO: 452326 - RNA, 64 nt, Human; identical to SEQ ID NO: 449839

SEQ ID NO: 452327 - RNA, 64 nt, Human; identical to SEQ ID NO: 449840

SEQ ID NO: 452328 - RNA, 64 nt, Human; identical to SEQ ID NO: 449841

SEQ ID NO: 452329 - RNA, 64 nt, Human; identical to SEQ ID NO: 449842

SEQ ID NO: 452330 - RNA, 64 nt, Human; identical to SEQ ID NO: 449846

SEQ ID NO: 452331 - RNA, 64 nt, Human; identical to SEQ ID NO: 449847

SEQ ID NO: 452332 - RNA, 64 nt, Human; identical to SEQ ID NO: 449848

SEQ ID NO: 452333 - RNA, 64 nt, Human; identical to SEQ ID NO: 449849

SEQ ID NO: 452334 - RNA, 64 nt, Human; identical to SEQ ID NO: 449850

SEQ ID NO: 452335 - RNA, 64 nt, Human; identical to SEQ ID NO: 449851

SEQ ID NO: 452336 - RNA, 64 nt, Human; identical to SEQ ID NO: 116548

SEQ ID NO: 452337 - RNA, 64 nt, Human; identical to SEQ ID NO: 116549

SEQ ID NO: 452338 - RNA, 64 nt, Human; identical to SEQ ID NO: 116550

SEQ ID NO: 452339 - RNA, 64 nt, Human; identical to SEQ ID NO: 449852

SEQ ID NO: 452340 - RNA, 64 nt, Human; identical to SEQ ID NO: 449853

SEQ ID NO: 452341 - RNA, 64 nt, Human; identical to SEQ ID NO: 449854

SEQ ID NO: 452342 - RNA, 64 nt, Human; identical to SEQ ID NO: 449855

SEQ ID NO: 452343 - RNA, 64 nt, Human; identical to SEQ ID NO: 449856

SEQ ID NO: 452344 - RNA, 64 nt, Human; identical to SEQ ID NO: 449857

SEQ ID NO: 452345 - RNA, 64 nt, Human; identical to SEQ ID NO: 449858

SEQ ID NO: 452346 - RNA, 64 nt, Human; identical to SEQ ID NO: 449859

SEQ ID NO: 452347 - RNA, 64 nt, Human; identical to SEQ ID NO: 449860

SEQ ID NO: 452348 - RNA, 64 nt, Human; identical to SEQ ID NO: 449864

SEQ ID NO: 452349 - RNA, 64 nt, Human; identical to SEQ ID NO: 449865

SEQ ID NO: 452350 - RNA, 64 nt, Human; identical to SEQ ID NO: 449866

SEQ ID NO: 452351 - RNA, 64 nt, Human; identical to SEQ ID NO: 449867

SEQ ID NO: 452352 - RNA, 64 nt, Human; identical to SEQ ID NO: 449868

SEQ ID NO: 452353 - RNA, 64 nt, Human; identical to SEQ ID NO: 449869

SEQ ID NO: 452354 - RNA, 64 nt, Human; identical to SEQ ID NO: 116551

SEQ ID NO: 452355 - RNA, 64 nt, Human; identical to SEQ ID NO: 116552

SEQ ID NO: 452356 - RNA, 64 nt, Human; identical to SEQ ID NO: 116553

SEQ ID NO: 452357 - RNA, 64 nt, Human; identical to SEQ ID NO: 449870

SEQ ID NO: 452358 - RNA, 64 nt, Human; identical to SEQ ID NO: 449871

SEQ ID NO: 452359 - RNA, 64 nt, Human; identical to SEQ ID NO: 449872

SEQ ID NO: 452360 - RNA, 64 nt, Human; identical to SEQ ID NO: 449873

SEQ ID NO: 452361 - RNA, 64 nt, Human; identical to SEQ ID NO: 449874

SEQ ID NO: 452362 - RNA, 64 nt, Human; identical to SEQ ID NO: 449875

SEQ ID NO: 452363 - RNA, 64 nt, Human; identical to SEQ ID NO: 449876

SEQ ID NO: 452364 - RNA, 64 nt, Human; identical to SEQ ID NO: 449877

SEQ ID NO: 452365 - RNA, 64 nt, Human; identical to SEQ ID NO: 449878

SEQ ID NO: 452366 - RNA, 64 nt, Human; identical to SEQ ID NO: 449879

SEQ ID NO: 452367 - RNA, 64 nt, Human; identical to SEQ ID NO: 449880

SEQ ID NO: 452368 - RNA, 64 nt, Human; identical to SEQ ID NO: 449881

SEQ ID NO: 452369 - RNA, 64 nt, Human; identical to SEQ ID NO: 449882

SEQ ID NO: 452370 - RNA, 64 nt, Human; identical to SEQ ID NO: 449883

SEQ ID NO: 452371 - RNA, 64 nt, Human; identical to SEQ ID NO: 449884

SEQ ID NO: 452372 - RNA, 64 nt, Human; identical to SEQ ID NO: 116555

SEQ ID NO: 452373 - RNA, 64 nt, Human; identical to SEQ ID NO: 116556

SEQ ID NO: 452374 - RNA, 64 nt, Human; identical to SEQ ID NO: 116557

SEQ ID NO: 452375 - RNA, 64 nt, Human; identical to SEQ ID NO: 449885

SEQ ID NO: 452376 - RNA, 64 nt, Human; identical to SEQ ID NO: 449886

SEQ ID NO: 452377 - RNA, 64 nt, Human; identical to SEQ ID NO: 449887

SEQ ID NO: 452378 - RNA, 64 nt, Human; identical to SEQ ID NO: 449888

SEQ ID NO: 452379 - RNA, 64 nt, Human; identical to SEQ ID NO: 449889

SEQ ID NO: 452380 - RNA, 64 nt, Human; identical to SEQ ID NO: 449890

SEQ ID NO: 452381 - RNA, 64 nt, Human; identical to SEQ ID NO: 449891

SEQ ID NO: 452382 - RNA, 64 nt, Human; identical to SEQ ID NO: 449892

SEQ ID NO: 452383 - RNA, 64 nt, Human; identical to SEQ ID NO: 449893

SEQ ID NO: 452384 - RNA, 64 nt, Human; identical to SEQ ID NO: 449896

SEQ ID NO: 452385 - RNA, 64 nt, Human; identical to SEQ ID NO: 449897

SEQ ID NO: 452386 - RNA, 64 nt, Human; identical to SEQ ID NO: 449898

SEQ ID NO: 452387 - RNA, 64 nt, Human; identical to SEQ ID NO: 449899

SEQ ID NO: 452388 - RNA, 64 nt, Human; identical to SEQ ID NO: 449900

SEQ ID NO: 452389 - RNA, 64 nt, Human; identical to SEQ ID NO: 449901

SEQ ID NO: 452390 - RNA, 64 nt, Human; identical to SEQ ID NO: 116558

SEQ ID NO: 452391 - RNA, 64 nt, Human; identical to SEQ ID NO: 116559

SEQ ID NO: 452392 - RNA, 64 nt, Human; identical to SEQ ID NO: 116560

SEQ ID NO: 452393 - RNA, 64 nt, Human; identical to SEQ ID NO: 449902

SEQ ID NO: 452394 - RNA, 64 nt, Human; identical to SEQ ID NO: 449903

SEQ ID NO: 452395 - RNA, 64 nt, Human; identical to SEQ ID NO: 449904

SEQ ID NO: 452396 - RNA, 64 nt, Human; identical to SEQ ID NO: 449905

SEQ ID NO: 452397 - RNA, 53 nt, Human; identical to SEQ ID NO: 381206

SEQ ID NO: 452398 - RNA, 64 nt, Human; identical to SEQ ID NO: 449907

SEQ ID NO: 452399 - RNA, 64 nt, Human; identical to SEQ ID NO: 449908

SEQ ID NO: 452400 - RNA, 64 nt, Human; identical to SEQ ID NO: 449909

SEQ ID NO: 452401 - RNA, 64 nt, Human; identical to SEQ ID NO: 449910

SEQ ID NO: 452402 - RNA, 64 nt, Human; identical to SEQ ID NO: 449914

SEQ ID NO: 452403 - RNA, 64 nt, Human; identical to SEQ ID NO: 449915

SEQ ID NO: 452404 - RNA, 64 nt, Human; identical to SEQ ID NO: 449916

SEQ ID NO: 452405 - RNA, 64 nt, Human; identical to SEQ ID NO: 449917

SEQ ID NO: 452406 - RNA, 59 nt, Human; identical to SEQ ID NO: 381215

SEQ ID NO: 452407 - RNA, 64 nt, Human; identical to SEQ ID NO: 449919

SEQ ID NO: 452408 - RNA, 64 nt, Human; identical to SEQ ID NO: 116562

SEQ ID NO: 452409 - RNA, 64 nt, Human; identical to SEQ ID NO: 116563

SEQ ID NO: 452410 - RNA, 64 nt, Human; identical to SEQ ID NO: 116564

SEQ ID NO: 452411 - RNA, 64 nt, Human; identical to SEQ ID NO: 449920

SEQ ID NO: 452412 - RNA, 64 nt, Human; identical to SEQ ID NO: 449921

SEQ ID NO: 452413 - RNA, 64 nt, Human; identical to SEQ ID NO: 449922

SEQ ID NO: 452414 - RNA, 64 nt, Human; identical to SEQ ID NO: 449923

SEQ ID NO: 452415 - RNA, 64 nt, Human; identical to SEQ ID NO: 449924

SEQ ID NO: 452416 - RNA, 64 nt, Human; identical to SEQ ID NO: 449925

SEQ ID NO: 452417 - RNA, 64 nt, Human; identical to SEQ ID NO: 449926

SEQ ID NO: 452418 - RNA, 64 nt, Human; identical to SEQ ID NO: 449927

SEQ ID NO: 452419 - RNA, 64 nt, Human; identical to SEQ ID NO: 449928

SEQ ID NO: 452420 - RNA, 64 nt, Human; identical to SEQ ID NO: 449931

SEQ ID NO: 452421 - RNA, 64 nt, Human; identical to SEQ ID NO: 449932

SEQ ID NO: 452422 - RNA, 64 nt, Human; identical to SEQ ID NO: 449933

SEQ ID NO: 452423 - RNA, 64 nt, Human; identical to SEQ ID NO: 449934

SEQ ID NO: 452424 - RNA, 64 nt, Human; identical to SEQ ID NO: 449935

SEQ ID NO: 452425 - RNA, 64 nt, Human; identical to SEQ ID NO: 449936

SEQ ID NO: 452426 - RNA, 64 nt, Human; identical to SEQ ID NO: 116565

SEQ ID NO: 452427 - RNA, 64 nt, Human; identical to SEQ ID NO: 116566

SEQ ID NO: 452428 - RNA, 64 nt, Human; identical to SEQ ID NO: 116567

SEQ ID NO: 452429 - RNA, 64 nt, Human; identical to SEQ ID NO: 449937

SEQ ID NO: 452430 - RNA, 64 nt, Human; identical to SEQ ID NO: 449938

SEQ ID NO: 452431 - RNA, 64 nt, Human; identical to SEQ ID NO: 449939

SEQ ID NO: 452432 - RNA, 64 nt, Human; identical to SEQ ID NO: 449940

SEQ ID NO: 452433 - RNA, 64 nt, Human; identical to SEQ ID NO: 449941

SEQ ID NO: 452434 - RNA, 64 nt, Human; identical to SEQ ID NO: 449942

SEQ ID NO: 452435 - RNA, 64 nt, Human; identical to SEQ ID NO: 449943

SEQ ID NO: 452436 - RNA, 64 nt, Human; identical to SEQ ID NO: 449944

SEQ ID NO: 452437 - RNA, 64 nt, Human; identical to SEQ ID NO: 449945

SEQ ID NO: 452438 - RNA, 64 nt, Human; identical to SEQ ID NO: 449948

SEQ ID NO: 452439 - RNA, 64 nt, Human; identical to SEQ ID NO: 449949

SEQ ID NO: 452440 - RNA, 64 nt, Human; identical to SEQ ID NO: 449950

SEQ ID NO: 452441 - RNA, 64 nt, Human; identical to SEQ ID NO: 449951

SEQ ID NO: 452442 - RNA, 64 nt, Human; identical to SEQ ID NO: 449952

SEQ ID NO: 452443 - RNA, 64 nt, Human; identical to SEQ ID NO: 449953

SEQ ID NO: 452444 - RNA, 64 nt, Human; identical to SEQ ID NO: 116625

SEQ ID NO: 452445 - RNA, 64 nt, Human; identical to SEQ ID NO: 116626

SEQ ID NO: 452446 - RNA, 64 nt, Human; identical to SEQ ID NO: 116627

SEQ ID NO: 452447 - RNA, 64 nt, Human; identical to SEQ ID NO: 449954

SEQ ID NO: 452448 - RNA, 64 nt, Human; identical to SEQ ID NO: 449955

SEQ ID NO: 452449 - RNA, 64 nt, Human; identical to SEQ ID NO: 449956

SEQ ID NO: 452450 - RNA, 64 nt, Human; identical to SEQ ID NO: 449957

SEQ ID NO: 452451 - RNA, 64 nt, Human; identical to SEQ ID NO: 449958

SEQ ID NO: 452452 - RNA, 64 nt, Human; identical to SEQ ID NO: 449959

SEQ ID NO: 452453 - RNA, 64 nt, Human; identical to SEQ ID NO: 449960

SEQ ID NO: 452454 - RNA, 64 nt, Human; identical to SEQ ID NO: 449961

SEQ ID NO: 452455 - RNA, 64 nt, Human; identical to SEQ ID NO: 449962

SEQ ID NO: 452456 - RNA, 64 nt, Human; identical to SEQ ID NO: 449966

SEQ ID NO: 452457 - RNA, 50 nt, Human; identical to SEQ ID NO: 381257

SEQ ID NO: 452458 - RNA, 64 nt, Human; identical to SEQ ID NO: 449968

SEQ ID NO: 452459 - RNA, 64 nt, Human; identical to SEQ ID NO: 449969

SEQ ID NO: 452460 - RNA, 64 nt, Human; identical to SEQ ID NO: 449970

SEQ ID NO: 452461 - RNA, 64 nt, Human; identical to SEQ ID NO: 449971

SEQ ID NO: 452462 - RNA, 59 nt, Human; identical to SEQ ID NO: 64190

SEQ ID NO: 452463 - RNA, 64 nt, Human; identical to SEQ ID NO: 64191

SEQ ID NO: 452464 - RNA, 64 nt, Human; identical to SEQ ID NO: 64192

SEQ ID NO: 452465 - RNA, 64 nt, Human; identical to SEQ ID NO: 449972

SEQ ID NO: 452466 - RNA, 64 nt, Human; identical to SEQ ID NO: 449973

SEQ ID NO: 452467 - RNA, 64 nt, Human; identical to SEQ ID NO: 449974

SEQ ID NO: 452468 - RNA, 64 nt, Human; identical to SEQ ID NO: 449975

SEQ ID NO: 452469 - RNA, 64 nt, Human; identical to SEQ ID NO: 449976

SEQ ID NO: 452470 - RNA, 64 nt, Human; identical to SEQ ID NO: 449977

SEQ ID NO: 452471 - RNA, 64 nt, Human; identical to SEQ ID NO: 449978

SEQ ID NO: 452472 - RNA, 64 nt, Human; identical to SEQ ID NO: 449979

SEQ ID NO: 452473 - RNA, 64 nt, Human; identical to SEQ ID NO: 449980

SEQ ID NO: 452474 - RNA, 64 nt, Human; identical to SEQ ID NO: 449983

SEQ ID NO: 452475 - RNA, 64 nt, Human; identical to SEQ ID NO: 449984

SEQ ID NO: 452476 - RNA, 64 nt, Human; identical to SEQ ID NO: 449985

SEQ ID NO: 452477 - RNA, 64 nt, Human; identical to SEQ ID NO: 449986

SEQ ID NO: 452478 - RNA, 64 nt, Human; identical to SEQ ID NO: 449987

SEQ ID NO: 452479 - RNA, 64 nt, Human; identical to SEQ ID NO: 449988

SEQ ID NO: 452480 - RNA, 64 nt, Human; identical to SEQ ID NO: 64194

SEQ ID NO: 452481 - RNA, 64 nt, Human; identical to SEQ ID NO: 64195

SEQ ID NO: 452482 - RNA, 64 nt, Human; identical to SEQ ID NO: 64196

SEQ ID NO: 452483 - RNA, 64 nt, Human; identical to SEQ ID NO: 449989

SEQ ID NO: 452484 - RNA, 64 nt, Human; identical to SEQ ID NO: 449990

SEQ ID NO: 452485 - RNA, 64 nt, Human; identical to SEQ ID NO: 449991

SEQ ID NO: 452486 - RNA, 64 nt, Human; identical to SEQ ID NO: 449992

SEQ ID NO: 452487 - RNA, 64 nt, Human; identical to SEQ ID NO: 449993

SEQ ID NO: 452488 - RNA, 64 nt, Human; identical to SEQ ID NO: 449994

SEQ ID NO: 452489 - RNA, 64 nt, Human; identical to SEQ ID NO: 449995

SEQ ID NO: 452490 - RNA, 64 nt, Human; identical to SEQ ID NO: 449996

SEQ ID NO: 452491 - RNA, 64 nt, Human; identical to SEQ ID NO: 449997

SEQ ID NO: 452492 - RNA, 64 nt, Human; identical to SEQ ID NO: 450000

SEQ ID NO: 452493 - RNA, 64 nt, Human; identical to SEQ ID NO: 450001

SEQ ID NO: 452494 - RNA, 64 nt, Human; identical to SEQ ID NO: 450002

SEQ ID NO: 452495 - RNA, 64 nt, Human; identical to SEQ ID NO: 450003

SEQ ID NO: 452496 - RNA, 64 nt, Human; identical to SEQ ID NO: 450004

SEQ ID NO: 452497 - RNA, 64 nt, Human; identical to SEQ ID NO: 450005

SEQ ID NO: 452498 - RNA, 64 nt, Human; identical to SEQ ID NO: 64197

SEQ ID NO: 452499 - RNA, 64 nt, Human; identical to SEQ ID NO: 64198

SEQ ID NO: 452500 - RNA, 64 nt, Human; identical to SEQ ID NO: 64199

SEQ ID NO: 452501 - RNA, 64 nt, Human; identical to SEQ ID NO: 450006

SEQ ID NO: 452502 - RNA, 64 nt, Human; identical to SEQ ID NO: 450007

SEQ ID NO: 452503 - RNA, 64 nt, Human; identical to SEQ ID NO: 450008

SEQ ID NO: 452504 - RNA, 64 nt, Human; identical to SEQ ID NO: 450009

SEQ ID NO: 452505 - RNA, 64 nt, Human; identical to SEQ ID NO: 450010

SEQ ID NO: 452506 - RNA, 64 nt, Human; identical to SEQ ID NO: 450011

SEQ ID NO: 452507 - RNA, 64 nt, Human; identical to SEQ ID NO: 450012

SEQ ID NO: 452508 - RNA, 64 nt, Human; identical to SEQ ID NO: 450013

SEQ ID NO: 452509 - RNA, 64 nt, Human; identical to SEQ ID NO: 450014

SEQ ID NO: 452510 - RNA, 64 nt, Human; identical to SEQ ID NO: 450018

SEQ ID NO: 452511 - RNA, 64 nt, Human; identical to SEQ ID NO: 450019

SEQ ID NO: 452512 - RNA, 64 nt, Human; identical to SEQ ID NO: 450020

SEQ ID NO: 452513 - RNA, 64 nt, Human; identical to SEQ ID NO: 450021

SEQ ID NO: 452514 - RNA, 64 nt, Human; identical to SEQ ID NO: 450022

SEQ ID NO: 452515 - RNA, 64 nt, Human; identical to SEQ ID NO: 450023

SEQ ID NO: 452516 - RNA, 64 nt, Human; identical to SEQ ID NO: 64201

SEQ ID NO: 452517 - RNA, 64 nt, Human; identical to SEQ ID NO: 64202

SEQ ID NO: 452518 - RNA, 64 nt, Human; identical to SEQ ID NO: 64203

SEQ ID NO: 452519 - RNA, 64 nt, Human; identical to SEQ ID NO: 450024

SEQ ID NO: 452520 - RNA, 64 nt, Human; identical to SEQ ID NO: 450025

SEQ ID NO: 452521 - RNA, 64 nt, Human; identical to SEQ ID NO: 450026

SEQ ID NO: 452522 - RNA, 64 nt, Human; identical to SEQ ID NO: 450027

SEQ ID NO: 452523 - RNA, 64 nt, Human; identical to SEQ ID NO: 450028

SEQ ID NO: 452524 - RNA, 64 nt, Human; identical to SEQ ID NO: 450029

SEQ ID NO: 452525 - RNA, 64 nt, Human; identical to SEQ ID NO: 450030

SEQ ID NO: 452526 - RNA, 64 nt, Human; identical to SEQ ID NO: 450031

SEQ ID NO: 452527 - RNA, 64 nt, Human; identical to SEQ ID NO: 450032

SEQ ID NO: 452528 - RNA, 64 nt, Human; identical to SEQ ID NO: 450036

SEQ ID NO: 452529 - RNA, 64 nt, Human; identical to SEQ ID NO: 450037

SEQ ID NO: 452530 - RNA, 64 nt, Human; identical to SEQ ID NO: 450038

SEQ ID NO: 452531 - RNA, 64 nt, Human; identical to SEQ ID NO: 450039

SEQ ID NO: 452532 - RNA, 64 nt, Human; identical to SEQ ID NO: 450040

SEQ ID NO: 452533 - RNA, 64 nt, Human; identical to SEQ ID NO: 450041

SEQ ID NO: 452534 - RNA, 64 nt, Human; identical to SEQ ID NO: 64204

SEQ ID NO: 452535 - RNA, 64 nt, Human; identical to SEQ ID NO: 64205

SEQ ID NO: 452536 - RNA, 64 nt, Human; identical to SEQ ID NO: 64206

SEQ ID NO: 452537 - RNA, 64 nt, Human; identical to SEQ ID NO: 450042

SEQ ID NO: 452538 - RNA, 64 nt, Human; identical to SEQ ID NO: 450043

SEQ ID NO: 452539 - RNA, 64 nt, Human; identical to SEQ ID NO: 450044

SEQ ID NO: 452540 - RNA, 64 nt, Human; identical to SEQ ID NO: 450045

SEQ ID NO: 452541 - RNA, 64 nt, Human; identical to SEQ ID NO: 450046

SEQ ID NO: 452542 - RNA, 64 nt, Human; identical to SEQ ID NO: 450047

SEQ ID NO: 452543 - RNA, 64 nt, Human; identical to SEQ ID NO: 450048

SEQ ID NO: 452544 - RNA, 64 nt, Human; identical to SEQ ID NO: 450049

SEQ ID NO: 452545 - RNA, 64 nt, Human; identical to SEQ ID NO: 450050

SEQ ID NO: 452546 - RNA, 64 nt, Human; identical to SEQ ID NO: 450054

SEQ ID NO: 452547 - RNA, 64 nt, Human; identical to SEQ ID NO: 450055

SEQ ID NO: 452548 - RNA, 64 nt, Human; identical to SEQ ID NO: 450056

SEQ ID NO: 452549 - RNA, 64 nt, Human; identical to SEQ ID NO: 450057

SEQ ID NO: 452550 - RNA, 64 nt, Human; identical to SEQ ID NO: 450058

SEQ ID NO: 452551 - RNA, 64 nt, Human; identical to SEQ ID NO: 450059

SEQ ID NO: 452552 - RNA, 64 nt, Human; identical to SEQ ID NO: 64208

SEQ ID NO: 452553 - RNA, 64 nt, Human; identical to SEQ ID NO: 64209

SEQ ID NO: 452554 - RNA, 64 nt, Human; identical to SEQ ID NO: 64210

SEQ ID NO: 452555 - RNA, 64 nt, Human; identical to SEQ ID NO: 450060

SEQ ID NO: 452556 - RNA, 64 nt, Human; identical to SEQ ID NO: 450061

SEQ ID NO: 452557 - RNA, 64 nt, Human; identical to SEQ ID NO: 450062

SEQ ID NO: 452558 - RNA, 64 nt, Human; identical to SEQ ID NO: 450063

SEQ ID NO: 452559 - RNA, 64 nt, Human; identical to SEQ ID NO: 450064

SEQ ID NO: 452560 - RNA, 64 nt, Human; identical to SEQ ID NO: 450065

SEQ ID NO: 452561 - RNA, 64 nt, Human; identical to SEQ ID NO: 450066

SEQ ID NO: 452562 - RNA, 52 nt, Human; identical to SEQ ID NO: 381344

SEQ ID NO: 452563 - RNA, 64 nt, Human; identical to SEQ ID NO: 450068

SEQ ID NO: 452564 - RNA, 64 nt, Human; identical to SEQ ID NO: 450072

SEQ ID NO: 452565 - RNA, 64 nt, Human; identical to SEQ ID NO: 450073

SEQ ID NO: 452566 - RNA, 64 nt, Human; identical to SEQ ID NO: 450074

SEQ ID NO: 452567 - RNA, 64 nt, Human; identical to SEQ ID NO: 450075

SEQ ID NO: 452568 - RNA, 64 nt, Human; identical to SEQ ID NO: 450076

SEQ ID NO: 452569 - RNA, 64 nt, Human; identical to SEQ ID NO: 450077

SEQ ID NO: 452570 - RNA, 64 nt, Human; identical to SEQ ID NO: 64211

SEQ ID NO: 452571 - RNA, 64 nt, Human; identical to SEQ ID NO: 64212

SEQ ID NO: 452572 - RNA, 64 nt, Human; identical to SEQ ID NO: 64213

SEQ ID NO: 452573 - RNA, 64 nt, Human; identical to SEQ ID NO: 450078

SEQ ID NO: 452574 - RNA, 52 nt, Human; identical to SEQ ID NO: 381351

SEQ ID NO: 452575 - RNA, 64 nt, Human; identical to SEQ ID NO: 450080

SEQ ID NO: 452576 - RNA, 64 nt, Human; identical to SEQ ID NO: 450081

SEQ ID NO: 452577 - RNA, 64 nt, Human; identical to SEQ ID NO: 450082

SEQ ID NO: 452578 - RNA, 64 nt, Human; identical to SEQ ID NO: 450083

SEQ ID NO: 452579 - RNA, 64 nt, Human; identical to SEQ ID NO: 450084

SEQ ID NO: 452580 - RNA, 64 nt, Human; identical to SEQ ID NO: 450085

SEQ ID NO: 452581 - RNA, 64 nt, Human; identical to SEQ ID NO: 450086

SEQ ID NO: 452582 - RNA, 64 nt, Human; identical to SEQ ID NO: 450090

SEQ ID NO: 452583 - RNA, 64 nt, Human; identical to SEQ ID NO: 450091

SEQ ID NO: 452584 - RNA, 64 nt, Human; identical to SEQ ID NO: 450092

SEQ ID NO: 452585 - RNA, 64 nt, Human; identical to SEQ ID NO: 450093

SEQ ID NO: 452586 - RNA, 64 nt, Human; identical to SEQ ID NO: 450094

SEQ ID NO: 452587 - RNA, 64 nt, Human; identical to SEQ ID NO: 450095

SEQ ID NO: 452588 - RNA, 64 nt, Human; identical to SEQ ID NO: 116569

SEQ ID NO: 452589 - RNA, 64 nt, Human; identical to SEQ ID NO: 116570

SEQ ID NO: 452590 - RNA, 64 nt, Human; identical to SEQ ID NO: 116571

SEQ ID NO: 452591 - RNA, 54 nt, Human; identical to SEQ ID NO: 381367

SEQ ID NO: 452592 - RNA, 64 nt, Human; identical to SEQ ID NO: 450097

SEQ ID NO: 452593 - RNA, 64 nt, Human; identical to SEQ ID NO: 450098

SEQ ID NO: 452594 - RNA, 64 nt, Human; identical to SEQ ID NO: 450099

SEQ ID NO: 452595 - RNA, 64 nt, Human; identical to SEQ ID NO: 450100

SEQ ID NO: 452596 - RNA, 64 nt, Human; identical to SEQ ID NO: 450101

SEQ ID NO: 452597 - RNA, 64 nt, Human; identical to SEQ ID NO: 450102

SEQ ID NO: 452598 - RNA, 64 nt, Human; identical to SEQ ID NO: 450103

SEQ ID NO: 452599 - RNA, 64 nt, Human; identical to SEQ ID NO: 450104

SEQ ID NO: 452600 - RNA, 64 nt, Human; identical to SEQ ID NO: 450108

SEQ ID NO: 452601 - RNA, 64 nt, Human; identical to SEQ ID NO: 450109

SEQ ID NO: 452602 - RNA, 64 nt, Human; identical to SEQ ID NO: 450110

SEQ ID NO: 452603 - RNA, 64 nt, Human; identical to SEQ ID NO: 450111

SEQ ID NO: 452604 - RNA, 64 nt, Human; identical to SEQ ID NO: 450112

SEQ ID NO: 452605 - RNA, 64 nt, Human; identical to SEQ ID NO: 450113

SEQ ID NO: 452606 - RNA, 64 nt, Human; identical to SEQ ID NO: 64215

SEQ ID NO: 452607 - RNA, 64 nt, Human; identical to SEQ ID NO: 450114

SEQ ID NO: 452608 - RNA, 64 nt, Human; identical to SEQ ID NO: 450115

SEQ ID NO: 452609 - RNA, 64 nt, Human; identical to SEQ ID NO: 450116

SEQ ID NO: 452610 - RNA, 64 nt, Human; identical to SEQ ID NO: 450117

SEQ ID NO: 452611 - RNA, 64 nt, Human; identical to SEQ ID NO: 450118

SEQ ID NO: 452612 - RNA, 64 nt, Human; identical to SEQ ID NO: 450119

SEQ ID NO: 452613 - RNA, 64 nt, Human; identical to SEQ ID NO: 450120

SEQ ID NO: 452614 - RNA, 64 nt, Human; identical to SEQ ID NO: 450121

SEQ ID NO: 452615 - RNA, 64 nt, Human; identical to SEQ ID NO: 450122

SEQ ID NO: 452616 - RNA, 64 nt, Human; identical to SEQ ID NO: 450126

SEQ ID NO: 452617 - RNA, 64 nt, Human; identical to SEQ ID NO: 450127

SEQ ID NO: 452618 - RNA, 64 nt, Human; identical to SEQ ID NO: 450128

SEQ ID NO: 452619 - RNA, 64 nt, Human; identical to SEQ ID NO: 450129

SEQ ID NO: 452620 - RNA, 64 nt, Human; identical to SEQ ID NO: 450130

SEQ ID NO: 452621 - RNA, 64 nt, Human; identical to SEQ ID NO: 450131

SEQ ID NO: 452622 - RNA, 64 nt, Human; identical to SEQ ID NO: 450132

SEQ ID NO: 452623 - RNA, 64 nt, Human; identical to SEQ ID NO: 450133

SEQ ID NO: 452624 - RNA, 64 nt, Human; identical to SEQ ID NO: 450134

SEQ ID NO: 452625 - RNA, 64 nt, Human; identical to SEQ ID NO: 450135

SEQ ID NO: 452626 - RNA, 64 nt, Human; identical to SEQ ID NO: 450136

SEQ ID NO: 452627 - RNA, 64 nt, Human; identical to SEQ ID NO: 450137

SEQ ID NO: 452628 - RNA, 64 nt, Human; identical to SEQ ID NO: 450138

SEQ ID NO: 452629 - RNA, 64 nt, Human; identical to SEQ ID NO: 450139

SEQ ID NO: 452630 - RNA, 64 nt, Human; identical to SEQ ID NO: 450140

SEQ ID NO: 452631 - RNA, 64 nt, Human; identical to SEQ ID NO: 450144

SEQ ID NO: 452632 - RNA, 64 nt, Human; identical to SEQ ID NO: 450145

SEQ ID NO: 452633 - RNA, 64 nt, Human; identical to SEQ ID NO: 450146

SEQ ID NO: 452634 - RNA, 64 nt, Human; identical to SEQ ID NO: 450147

SEQ ID NO: 452635 - RNA, 64 nt, Human; identical to SEQ ID NO: 450148

SEQ ID NO: 452636 - RNA, 64 nt, Human; identical to SEQ ID NO: 450149

SEQ ID NO: 452637 - RNA, 64 nt, Human; identical to SEQ ID NO: 450150

SEQ ID NO: 452638 - RNA, 64 nt, Human; identical to SEQ ID NO: 450151

SEQ ID NO: 452639 - RNA, 64 nt, Human; identical to SEQ ID NO: 450152

SEQ ID NO: 452640 - RNA, 64 nt, Human; identical to SEQ ID NO: 450153

SEQ ID NO: 452641 - RNA, 64 nt, Human; identical to SEQ ID NO: 450154

SEQ ID NO: 452642 - RNA, 64 nt, Human; identical to SEQ ID NO: 450155

SEQ ID NO: 452643 - RNA, 64 nt, Human; identical to SEQ ID NO: 450156

SEQ ID NO: 452644 - RNA, 64 nt, Human; identical to SEQ ID NO: 450157

SEQ ID NO: 452645 - RNA, 64 nt, Human; identical to SEQ ID NO: 450158

SEQ ID NO: 452646 - RNA, 51 nt, Human; identical to SEQ ID NO: 381423

SEQ ID NO: 452647 - RNA, 64 nt, Human; identical to SEQ ID NO: 450163

SEQ ID NO: 452648 - RNA, 64 nt, Human; identical to SEQ ID NO: 450164

SEQ ID NO: 452649 - RNA, 64 nt, Human; identical to SEQ ID NO: 450165

SEQ ID NO: 452650 - RNA, 64 nt, Human; identical to SEQ ID NO: 450166

SEQ ID NO: 452651 - RNA, 64 nt, Human; identical to SEQ ID NO: 450167

SEQ ID NO: 452652 - RNA, 64 nt, Human; identical to SEQ ID NO: 450168

SEQ ID NO: 452653 - RNA, 64 nt, Human; identical to SEQ ID NO: 450169

SEQ ID NO: 452654 - RNA, 64 nt, Human; identical to SEQ ID NO: 450170

SEQ ID NO: 452655 - RNA, 64 nt, Human; identical to SEQ ID NO: 450171

SEQ ID NO: 452656 - RNA, 64 nt, Human; identical to SEQ ID NO: 450172

SEQ ID NO: 452657 - RNA, 64 nt, Human; identical to SEQ ID NO: 450173

SEQ ID NO: 452658 - RNA, 64 nt, Human; identical to SEQ ID NO: 450174

SEQ ID NO: 452659 - RNA, 64 nt, Human; identical to SEQ ID NO: 450175

SEQ ID NO: 452660 - RNA, 64 nt, Human; identical to SEQ ID NO: 450176

SEQ ID NO: 452661 - RNA, 64 nt, Human; identical to SEQ ID NO: 450180

SEQ ID NO: 452662 - RNA, 64 nt, Human; identical to SEQ ID NO: 450181

SEQ ID NO: 452663 - RNA, 64 nt, Human; identical to SEQ ID NO: 450182

SEQ ID NO: 452664 - RNA, 64 nt, Human; identical to SEQ ID NO: 450183

SEQ ID NO: 452665 - RNA, 56 nt, Human; identical to SEQ ID NO: 381440

SEQ ID NO: 452666 - RNA, 64 nt, Human; identical to SEQ ID NO: 450185

SEQ ID NO: 452667 - RNA, 62 nt, Human
cucagcaagaagggacuguuucuaggugggcugggcgcgagcagggacugucccgagcggua

SEQ ID NO: 452668 - RNA, 62 nt, Human
cgggagccuccugggggcuccggcggcggcgcgggcgcgacccaucccgcuggcgcuccccg

SEQ ID NO: 452669 - RNA, 64 nt, Human; identical to SEQ ID NO: 450186

SEQ ID NO: 452670 - RNA, 64 nt, Human; identical to SEQ ID NO: 450187

SEQ ID NO: 452671 - RNA, 64 nt, Human; identical to SEQ ID NO: 450188

SEQ ID NO: 452672 - RNA, 64 nt, Human; identical to SEQ ID NO: 450189

SEQ ID NO: 452673 - RNA, 64 nt, Human; identical to SEQ ID NO: 450190

SEQ ID NO: 452674 - RNA, 64 nt, Human; identical to SEQ ID NO: 450191

SEQ ID NO: 452675 - RNA, 64 nt, Human; identical to SEQ ID NO: 450192

SEQ ID NO: 452676 - RNA, 64 nt, Human; identical to SEQ ID NO: 450193

SEQ ID NO: 452677 - RNA, 64 nt, Human; identical to SEQ ID NO: 450194

SEQ ID NO: 452678 - RNA, 64 nt, Human; identical to SEQ ID NO: 450196

SEQ ID NO: 452679 - RNA, 64 nt, Human; identical to SEQ ID NO: 450197

SEQ ID NO: 452680 - RNA, 64 nt, Human; identical to SEQ ID NO: 450198

SEQ ID NO: 452681 - RNA, 64 nt, Human; identical to SEQ ID NO: 450199

SEQ ID NO: 452682 - RNA, 53 nt, Human; identical to SEQ ID NO: 381453

SEQ ID NO: 452683 - RNA, 64 nt, Human; identical to SEQ ID NO: 450201

SEQ ID NO: 452684 - RNA, 64 nt, Human; identical to SEQ ID NO: 64145

SEQ ID NO: 452685 - RNA, 64 nt, Human; identical to SEQ ID NO: 64146

SEQ ID NO: 452686 - RNA, 64 nt, Human; identical to SEQ ID NO: 64147

SEQ ID NO: 452687 - RNA, 64 nt, Human; identical to SEQ ID NO: 450202

SEQ ID NO: 452688 - RNA, 64 nt, Human; identical to SEQ ID NO: 450203

SEQ ID NO: 452689 - RNA, 53 nt, Human; identical to SEQ ID NO: 381459

SEQ ID NO: 452690 - RNA, 64 nt, Human; identical to SEQ ID NO: 450205

SEQ ID NO: 452691 - RNA, 64 nt, Human; identical to SEQ ID NO: 450206

SEQ ID NO: 452692 - RNA, 64 nt, Human; identical to SEQ ID NO: 450207

SEQ ID NO: 452693 - RNA, 64 nt, Human; identical to SEQ ID NO: 450208

SEQ ID NO: 452694 - RNA, 64 nt, Human; identical to SEQ ID NO: 450209

SEQ ID NO: 452695 - RNA, 64 nt, Human; identical to SEQ ID NO: 450210

SEQ ID NO: 452696 - RNA, 64 nt, Human; identical to SEQ ID NO: 450213

SEQ ID NO: 452697 - RNA, 64 nt, Human; identical to SEQ ID NO: 450214

SEQ ID NO: 452698 - RNA, 64 nt, Human; identical to SEQ ID NO: 450215

SEQ ID NO: 452699 - RNA, 64 nt, Human; identical to SEQ ID NO: 450216

SEQ ID NO: 452700 - RNA, 64 nt, Human; identical to SEQ ID NO: 450217

SEQ ID NO: 452701 - RNA, 64 nt, Human; identical to SEQ ID NO: 450218

SEQ ID NO: 452702 - RNA, 64 nt, Human; identical to SEQ ID NO: 64141

SEQ ID NO: 452703 - RNA, 64 nt, Human; identical to SEQ ID NO: 64142

SEQ ID NO: 452704 - RNA, 64 nt, Human; identical to SEQ ID NO: 64143

SEQ ID NO: 452705 - RNA, 64 nt, Human; identical to SEQ ID NO: 450219

SEQ ID NO: 452706 - RNA, 64 nt, Human; identical to SEQ ID NO: 450220

SEQ ID NO: 452707 - RNA, 64 nt, Human; identical to SEQ ID NO: 450221

SEQ ID NO: 452708 - RNA, 64 nt, Human; identical to SEQ ID NO: 450222

SEQ ID NO: 452709 - RNA, 64 nt, Human; identical to SEQ ID NO: 450223

SEQ ID NO: 452710 - RNA, 64 nt, Human; identical to SEQ ID NO: 450224

SEQ ID NO: 452711 - RNA, 64 nt, Human; identical to SEQ ID NO: 450225

SEQ ID NO: 452712 - RNA, 64 nt, Human; identical to SEQ ID NO: 450226

SEQ ID NO: 452713 - RNA, 64 nt, Human; identical to SEQ ID NO: 450227

SEQ ID NO: 452714 - RNA, 64 nt, Human; identical to SEQ ID NO: 450231

SEQ ID NO: 452715 - RNA, 64 nt, Human; identical to SEQ ID NO: 450232

SEQ ID NO: 452716 - RNA, 64 nt, Human; identical to SEQ ID NO: 450233

SEQ ID NO: 452717 - RNA, 64 nt, Human; identical to SEQ ID NO: 450234

SEQ ID NO: 452718 - RNA, 64 nt, Human; identical to SEQ ID NO: 450235

SEQ ID NO: 452719 - RNA, 64 nt, Human; identical to SEQ ID NO: 450236

SEQ ID NO: 452720 - RNA, 64 nt, Human; identical to SEQ ID NO: 64148

SEQ ID NO: 452721 - RNA, 64 nt, Human; identical to SEQ ID NO: 64149

SEQ ID NO: 452722 - RNA, 64 nt, Human; identical to SEQ ID NO: 64150

SEQ ID NO: 452723 - RNA, 64 nt, Human; identical to SEQ ID NO: 450237

SEQ ID NO: 452724 - RNA, 64 nt, Human; identical to SEQ ID NO: 450238

SEQ ID NO: 452725 - RNA, 64 nt, Human; identical to SEQ ID NO: 450239

SEQ ID NO: 452726 - RNA, 64 nt, Human; identical to SEQ ID NO: 450240

SEQ ID NO: 452727 - RNA, 64 nt, Human; identical to SEQ ID NO: 450241

SEQ ID NO: 452728 - RNA, 64 nt, Human; identical to SEQ ID NO: 450242

SEQ ID NO: 452729 - RNA, 64 nt, Human; identical to SEQ ID NO: 450243

SEQ ID NO: 452730 - RNA, 64 nt, Human; identical to SEQ ID NO: 450244

SEQ ID NO: 452731 - RNA, 64 nt, Human; identical to SEQ ID NO: 450245

SEQ ID NO: 452732 - RNA, 64 nt, Human; identical to SEQ ID NO: 450249

SEQ ID NO: 452733 - RNA, 64 nt, Human; identical to SEQ ID NO: 450250

SEQ ID NO: 452734 - RNA, 64 nt, Human; identical to SEQ ID NO: 450251

SEQ ID NO: 452735 - RNA, 64 nt, Human; identical to SEQ ID NO: 450252

SEQ ID NO: 452736 - RNA, 64 nt, Human; identical to SEQ ID NO: 450253

SEQ ID NO: 452737 - RNA, 64 nt, Human; identical to SEQ ID NO: 450254

SEQ ID NO: 452738 - RNA, 62 nt, Human
uggcugaacugcuacgggcagcgcugggcggcgggcgcgacgugaucguggaccugugggag

SEQ ID NO: 452739 - RNA, 62 nt, Human
ggaagcccagagagggcaaagggccuaccucggggcgcgaaccaugccccagacuauuaucu

SEQ ID NO: 452740 - RNA, 62 nt, Human
aagggccgcucacugcacgguggggcgaugcugggcgcgagccguguuuccgucuauuguug

SEQ ID NO: 452741 - RNA, 64 nt, Human; identical to SEQ ID NO: 450255

SEQ ID NO: 452742 - RNA, 64 nt, Human; identical to SEQ ID NO: 450256

SEQ ID NO: 452743 - RNA, 64 nt, Human; identical to SEQ ID NO: 450257

SEQ ID NO: 452744 - RNA, 64 nt, Human; identical to SEQ ID NO: 450258

SEQ ID NO: 452745 - RNA, 64 nt, Human; identical to SEQ ID NO: 450259

SEQ ID NO: 452746 - RNA, 64 nt, Human; identical to SEQ ID NO: 450260

SEQ ID NO: 452747 - RNA, 64 nt, Human; identical to SEQ ID NO: 450261

SEQ ID NO: 452748 - RNA, 64 nt, Human; identical to SEQ ID NO: 450262

SEQ ID NO: 452749 - RNA, 64 nt, Human; identical to SEQ ID NO: 450263

SEQ ID NO: 452750 - RNA, 64 nt, Human; identical to SEQ ID NO: 450267

SEQ ID NO: 452751 - RNA, 64 nt, Human; identical to SEQ ID NO: 450268

SEQ ID NO: 452752 - RNA, 64 nt, Human; identical to SEQ ID NO: 450269

SEQ ID NO: 452753 - RNA, 64 nt, Human; identical to SEQ ID NO: 450270

SEQ ID NO: 452754 - RNA, 64 nt, Human; identical to SEQ ID NO: 450271

SEQ ID NO: 452755 - RNA, 64 nt, Human; identical to SEQ ID NO: 450272

SEQ ID NO: 452756 - RNA, 64 nt, Human; identical to SEQ ID NO: 64152

SEQ ID NO: 452757 - RNA, 64 nt, Human; identical to SEQ ID NO: 64153

SEQ ID NO: 452758 - RNA, 64 nt, Human; identical to SEQ ID NO: 64154

SEQ ID NO: 452759 - RNA, 64 nt, Human; identical to SEQ ID NO: 450273

SEQ ID NO: 452760 - RNA, 64 nt, Human; identical to SEQ ID NO: 450274

SEQ ID NO: 452761 - RNA, 64 nt, Human; identical to SEQ ID NO: 450275

SEQ ID NO: 452762 - RNA, 64 nt, Human; identical to SEQ ID NO: 450276

SEQ ID NO: 452763 - RNA, 64 nt, Human; identical to SEQ ID NO: 450277

SEQ ID NO: 452764 - RNA, 64 nt, Human; identical to SEQ ID NO: 450278

SEQ ID NO: 452765 - RNA, 64 nt, Human; identical to SEQ ID NO: 450279

SEQ ID NO: 452766 - RNA, 64 nt, Human; identical to SEQ ID NO: 450280

SEQ ID NO: 452767 - RNA, 64 nt, Human; identical to SEQ ID NO: 450281

SEQ ID NO: 452768 - RNA, 64 nt, Human; identical to SEQ ID NO: 450285

SEQ ID NO: 452769 - RNA, 64 nt, Human; identical to SEQ ID NO: 450286

SEQ ID NO: 452770 - RNA, 64 nt, Human; identical to SEQ ID NO: 450287

SEQ ID NO: 452771 - RNA, 64 nt, Human; identical to SEQ ID NO: 450288

SEQ ID NO: 452772 - RNA, 64 nt, Human; identical to SEQ ID NO: 450289

SEQ ID NO: 452773 - RNA, 64 nt, Human; identical to SEQ ID NO: 450290

SEQ ID NO: 452774 - RNA, 64 nt, Human; identical to SEQ ID NO: 64155

SEQ ID NO: 452775 - RNA, 64 nt, Human; identical to SEQ ID NO: 64156

SEQ ID NO: 452776 - RNA, 64 nt, Human; identical to SEQ ID NO: 64157

SEQ ID NO: 452777 - RNA, 64 nt, Human; identical to SEQ ID NO: 450291

SEQ ID NO: 452778 - RNA, 64 nt, Human; identical to SEQ ID NO: 450292

SEQ ID NO: 452779 - RNA, 64 nt, Human; identical to SEQ ID NO: 450293

SEQ ID NO: 452780 - RNA, 64 nt, Human; identical to SEQ ID NO: 450294

SEQ ID NO: 452781 - RNA, 64 nt, Human; identical to SEQ ID NO: 450295

SEQ ID NO: 452782 - RNA, 64 nt, Human; identical to SEQ ID NO: 450296

SEQ ID NO: 452783 - RNA, 64 nt, Human; identical to SEQ ID NO: 450297

SEQ ID NO: 452784 - RNA, 64 nt, Human; identical to SEQ ID NO: 450298

SEQ ID NO: 452785 - RNA, 64 nt, Human; identical to SEQ ID NO: 450299

SEQ ID NO: 452786 - RNA, 64 nt, Human; identical to SEQ ID NO: 450303

SEQ ID NO: 452787 - RNA, 64 nt, Human; identical to SEQ ID NO: 450304

SEQ ID NO: 452788 - RNA, 64 nt, Human; identical to SEQ ID NO: 450305

SEQ ID NO: 452789 - RNA, 64 nt, Human; identical to SEQ ID NO: 450306

SEQ ID NO: 452790 - RNA, 64 nt, Human; identical to SEQ ID NO: 450307

SEQ ID NO: 452791 - RNA, 64 nt, Human; identical to SEQ ID NO: 450308

SEQ ID NO: 452792 - RNA, 64 nt, Human; identical to SEQ ID NO: 64159

SEQ ID NO: 452793 - RNA, 64 nt, Human; identical to SEQ ID NO: 64160

SEQ ID NO: 452794 - RNA, 64 nt, Human; identical to SEQ ID NO: 64161

SEQ ID NO: 452795 - RNA, 64 nt, Human; identical to SEQ ID NO: 450309

SEQ ID NO: 452796 - RNA, 64 nt, Human; identical to SEQ ID NO: 450310

SEQ ID NO: 452797 - RNA, 64 nt, Human; identical to SEQ ID NO: 450311

SEQ ID NO: 452798 - RNA, 64 nt, Human; identical to SEQ ID NO: 450312

SEQ ID NO: 452799 - RNA, 64 nt, Human; identical to SEQ ID NO: 450313

SEQ ID NO: 452800 - RNA, 64 nt, Human; identical to SEQ ID NO: 450314

SEQ ID NO: 452801 - RNA, 64 nt, Human; identical to SEQ ID NO: 450315

SEQ ID NO: 452802 - RNA, 64 nt, Human; identical to SEQ ID NO: 450316

SEQ ID NO: 452803 - RNA, 64 nt, Human; identical to SEQ ID NO: 450317

SEQ ID NO: 452804 - RNA, 64 nt, Human; identical to SEQ ID NO: 450321

SEQ ID NO: 452805 - RNA, 64 nt, Human; identical to SEQ ID NO: 450322

SEQ ID NO: 452806 - RNA, 64 nt, Human; identical to SEQ ID NO: 450323

SEQ ID NO: 452807 - RNA, 64 nt, Human; identical to SEQ ID NO: 450324

SEQ ID NO: 452808 - RNA, 64 nt, Human; identical to SEQ ID NO: 450325

SEQ ID NO: 452809 - RNA, 64 nt, Human; identical to SEQ ID NO: 450326

SEQ ID NO: 452810 - RNA, 64 nt, Human; identical to SEQ ID NO: 64162

SEQ ID NO: 452811 - RNA, 64 nt, Human; identical to SEQ ID NO: 64163

SEQ ID NO: 452812 - RNA, 64 nt, Human; identical to SEQ ID NO: 64164

SEQ ID NO: 452813 - RNA, 64 nt, Human; identical to SEQ ID NO: 450327

SEQ ID NO: 452814 - RNA, 64 nt, Human; identical to SEQ ID NO: 450328

SEQ ID NO: 452815 - RNA, 64 nt, Human; identical to SEQ ID NO: 450329

SEQ ID NO: 452816 - RNA, 64 nt, Human; identical to SEQ ID NO: 450330

SEQ ID NO: 452817 - RNA, 64 nt, Human; identical to SEQ ID NO: 450331

SEQ ID NO: 452818 - RNA, 64 nt, Human; identical to SEQ ID NO: 450332

SEQ ID NO: 452819 - RNA, 64 nt, Human; identical to SEQ ID NO: 450333

SEQ ID NO: 452820 - RNA, 64 nt, Human; identical to SEQ ID NO: 450334

SEQ ID NO: 452821 - RNA, 64 nt, Human; identical to SEQ ID NO: 450335

SEQ ID NO: 452822 - RNA, 64 nt, Human; identical to SEQ ID NO: 450339

SEQ ID NO: 452823 - RNA, 64 nt, Human; identical to SEQ ID NO: 450340

SEQ ID NO: 452824 - RNA, 64 nt, Human; identical to SEQ ID NO: 450341

SEQ ID NO: 452825 - RNA, 64 nt, Human; identical to SEQ ID NO: 450342

SEQ ID NO: 452826 - RNA, 64 nt, Human; identical to SEQ ID NO: 450343

SEQ ID NO: 452827 - RNA, 64 nt, Human; identical to SEQ ID NO: 450344

SEQ ID NO: 452828 - RNA, 64 nt, Human; identical to SEQ ID NO: 64166

SEQ ID NO: 452829 - RNA, 62 nt, Human; identical to SEQ ID NO: 64167

SEQ ID NO: 452830 - RNA, 64 nt, Human; identical to SEQ ID NO: 64168

SEQ ID NO: 452831 - RNA, 64 nt, Human; identical to SEQ ID NO: 450345

SEQ ID NO: 452832 - RNA, 64 nt, Human; identical to SEQ ID NO: 450346

SEQ ID NO: 452833 - RNA, 64 nt, Human; identical to SEQ ID NO: 450347

SEQ ID NO: 452834 - RNA, 64 nt, Human; identical to SEQ ID NO: 450348

SEQ ID NO: 452835 - RNA, 64 nt, Human; identical to SEQ ID NO: 450349

SEQ ID NO: 452836 - RNA, 64 nt, Human; identical to SEQ ID NO: 450350

SEQ ID NO: 452837 - RNA, 64 nt, Human; identical to SEQ ID NO: 450351

SEQ ID NO: 452838 - RNA, 64 nt, Human; identical to SEQ ID NO: 450352

SEQ ID NO: 452839 - RNA, 64 nt, Human; identical to SEQ ID NO: 450353

SEQ ID NO: 452840 - RNA, 64 nt, Human; identical to SEQ ID NO: 450357

SEQ ID NO: 452841 - RNA, 64 nt, Human; identical to SEQ ID NO: 450358

SEQ ID NO: 452842 - RNA, 64 nt, Human; identical to SEQ ID NO: 450359

SEQ ID NO: 452843 - RNA, 64 nt, Human; identical to SEQ ID NO: 450360

SEQ ID NO: 452844 - RNA, 64 nt, Human; identical to SEQ ID NO: 450361

SEQ ID NO: 452845 - RNA, 64 nt, Human; identical to SEQ ID NO: 450362

SEQ ID NO: 452846 - RNA, 64 nt, Human; identical to SEQ ID NO: 64169

SEQ ID NO: 452847 - RNA, 64 nt, Human; identical to SEQ ID NO: 64170

SEQ ID NO: 452848 - RNA, 58 nt, Human; identical to SEQ ID NO: 64171

SEQ ID NO: 452849 - RNA, 64 nt, Human; identical to SEQ ID NO: 450363

SEQ ID NO: 452850 - RNA, 64 nt, Human; identical to SEQ ID NO: 450364

SEQ ID NO: 452851 - RNA, 64 nt, Human; identical to SEQ ID NO: 450365

SEQ ID NO: 452852 - RNA, 64 nt, Human; identical to SEQ ID NO: 450366

SEQ ID NO: 452853 - RNA, 64 nt, Human; identical to SEQ ID NO: 450367

SEQ ID NO: 452854 - RNA, 64 nt, Human; identical to SEQ ID NO: 450368

SEQ ID NO: 452855 - RNA, 64 nt, Human; identical to SEQ ID NO: 450369

SEQ ID NO: 452856 - RNA, 64 nt, Human; identical to SEQ ID NO: 450370

SEQ ID NO: 452857 - RNA, 64 nt, Human; identical to SEQ ID NO: 450371

SEQ ID NO: 452858 - RNA, 64 nt, Human; identical to SEQ ID NO: 450375

SEQ ID NO: 452859 - RNA, 64 nt, Human; identical to SEQ ID NO: 450376

SEQ ID NO: 452860 - RNA, 64 nt, Human; identical to SEQ ID NO: 450377

SEQ ID NO: 452861 - RNA, 58 nt, Human; identical to SEQ ID NO: 381604

SEQ ID NO: 452862 - RNA, 64 nt, Human; identical to SEQ ID NO: 450379

SEQ ID NO: 452863 - RNA, 64 nt, Human; identical to SEQ ID NO: 450380

SEQ ID NO: 452864 - RNA, 64 nt, Human; identical to SEQ ID NO: 116572

SEQ ID NO: 452865 - RNA, 64 nt, Human; identical to SEQ ID NO: 116573

SEQ ID NO: 452866 - RNA, 64 nt, Human; identical to SEQ ID NO: 116574

SEQ ID NO: 452867 - RNA, 64 nt, Human; identical to SEQ ID NO: 450381

SEQ ID NO: 452868 - RNA, 64 nt, Human; identical to SEQ ID NO: 450382

SEQ ID NO: 452869 - RNA, 64 nt, Human; identical to SEQ ID NO: 450383

SEQ ID NO: 452870 - RNA, 64 nt, Human; identical to SEQ ID NO: 450384

SEQ ID NO: 452871 - RNA, 64 nt, Human; identical to SEQ ID NO: 450384

SEQ ID NO: 452872 - RNA, 64 nt, Human; identical to SEQ ID NO: 450386

SEQ ID NO: 452873 - RNA, 64 nt, Human; identical to SEQ ID NO: 450387

SEQ ID NO: 452874 - RNA, 64 nt, Human; identical to SEQ ID NO: 450388

SEQ ID NO: 452875 - RNA, 64 nt, Human; identical to SEQ ID NO: 450389

SEQ ID NO: 452876 - RNA, 64 nt, Human; identical to SEQ ID NO: 450393

SEQ ID NO: 452877 - RNA, 64 nt, Human; identical to SEQ ID NO: 450394

SEQ ID NO: 452878 - RNA, 64 nt, Human; identical to SEQ ID NO: 450395

SEQ ID NO: 452879 - RNA, 64 nt, Human; identical to SEQ ID NO: 450396

SEQ ID NO: 452880 - RNA, 64 nt, Human; identical to SEQ ID NO: 450397

SEQ ID NO: 452881 - RNA, 64 nt, Human; identical to SEQ ID NO: 450398

SEQ ID NO: 452882 - RNA, 64 nt, Human; identical to SEQ ID NO: 64173

SEQ ID NO: 452883 - RNA, 64 nt, Human; identical to SEQ ID NO: 64174

SEQ ID NO: 452884 - RNA, 64 nt, Human; identical to SEQ ID NO: 64175

SEQ ID NO: 452885 - RNA, 64 nt, Human; identical to SEQ ID NO: 450399

SEQ ID NO: 452886 - RNA, 64 nt, Human; identical to SEQ ID NO: 450400

SEQ ID NO: 452887 - RNA, 64 nt, Human; identical to SEQ ID NO: 450401

SEQ ID NO: 452888 - RNA, 64 nt, Human; identical to SEQ ID NO: 450402

SEQ ID NO: 452889 - RNA, 64 nt, Human; identical to SEQ ID NO: 450403

SEQ ID NO: 452890 - RNA, 64 nt, Human; identical to SEQ ID NO: 450404

SEQ ID NO: 452891 - RNA, 64 nt, Human; identical to SEQ ID NO: 450405

SEQ ID NO: 452892 - RNA, 64 nt, Human; identical to SEQ ID NO: 450406

SEQ ID NO: 452893 - RNA, 64 nt, Human; identical to SEQ ID NO: 450407

SEQ ID NO: 452894 - RNA, 64 nt, Human; identical to SEQ ID NO: 450411

SEQ ID NO: 452895 - RNA, 64 nt, Human; identical to SEQ ID NO: 450412

SEQ ID NO: 452896 - RNA, 64 nt, Human; identical to SEQ ID NO: 450413

SEQ ID NO: 452897 - RNA, 64 nt, Human; identical to SEQ ID NO: 450414

SEQ ID NO: 452898 - RNA, 64 nt, Human; identical to SEQ ID NO: 450415

SEQ ID NO: 452899 - RNA, 64 nt, Human; identical to SEQ ID NO: 450416

SEQ ID NO: 452900 - RNA, 64 nt, Human; identical to SEQ ID NO: 64176

SEQ ID NO: 452901 - RNA, 64 nt, Human; identical to SEQ ID NO: 64177

SEQ ID NO: 452902 - RNA, 64 nt, Human; identical to SEQ ID NO: 64178

SEQ ID NO: 452903 - RNA, 64 nt, Human; identical to SEQ ID NO: 450417

SEQ ID NO: 452904 - RNA, 64 nt, Human; identical to SEQ ID NO: 450418

SEQ ID NO: 452905 - RNA, 64 nt, Human; identical to SEQ ID NO: 450419

SEQ ID NO: 452906 - RNA, 64 nt, Human; identical to SEQ ID NO: 450420

SEQ ID NO: 452907 - RNA, 64 nt, Human; identical to SEQ ID NO: 450421

SEQ ID NO: 452908 - RNA, 64 nt, Human; identical to SEQ ID NO: 450422

SEQ ID NO: 452909 - RNA, 64 nt, Human; identical to SEQ ID NO: 450423

SEQ ID NO: 452910 - RNA, 64 nt, Human; identical to SEQ ID NO: 450424

SEQ ID NO: 452911 - RNA, 64 nt, Human; identical to SEQ ID NO: 450425

SEQ ID NO: 452912 - RNA, 64 nt, Human; identical to SEQ ID NO: 450429

SEQ ID NO: 452913 - RNA, 64 nt, Human; identical to SEQ ID NO: 450430

SEQ ID NO: 452914 - RNA, 64 nt, Human; identical to SEQ ID NO: 450431

SEQ ID NO: 452915 - RNA, 64 nt, Human; identical to SEQ ID NO: 450432

SEQ ID NO: 452916 - RNA, 64 nt, Human; identical to SEQ ID NO: 450433

SEQ ID NO: 452917 - RNA, 64 nt, Human; identical to SEQ ID NO: 450434

SEQ ID NO: 452918 - RNA, 64 nt, Human; identical to SEQ ID NO: 64180

SEQ ID NO: 452919 - RNA, 64 nt, Human; identical to SEQ ID NO: 64181

SEQ ID NO: 452920 - RNA, 64 nt, Human; identical to SEQ ID NO: 64182

SEQ ID NO: 452921 - RNA, 64 nt, Human; identical to SEQ ID NO: 450435

SEQ ID NO: 452922 - RNA, 64 nt, Human; identical to SEQ ID NO: 450436

SEQ ID NO: 452923 - RNA, 64 nt, Human; identical to SEQ ID NO: 449614

SEQ ID NO: 452924 - RNA, 64 nt, Human; identical to SEQ ID NO: 449615

SEQ ID NO: 452925 - RNA, 54 nt, Human; identical to SEQ ID NO: 380960

SEQ ID NO: 452926 - RNA, 64 nt, Human; identical to SEQ ID NO: 449617

SEQ ID NO: 452927 - RNA, 64 nt, Human; identical to SEQ ID NO: 449618

SEQ ID NO: 452928 - RNA, 64 nt, Human; identical to SEQ ID NO: 449619

SEQ ID NO: 452929 - RNA, 64 nt, Human; identical to SEQ ID NO: 449620

SEQ ID NO: 452930 - RNA, 64 nt, Human; identical to SEQ ID NO: 449621

SEQ ID NO: 452931 - RNA, 64 nt, Human; identical to SEQ ID NO: 449622

SEQ ID NO: 452932 - RNA, 64 nt, Human; identical to SEQ ID NO: 449623

SEQ ID NO: 452933 - RNA, 64 nt, Human; identical to SEQ ID NO: 449624

SEQ ID NO: 452934 - RNA, 64 nt, Human; identical to SEQ ID NO: 37285

SEQ ID NO: 452935 - RNA, 61 nt, Human; identical to SEQ ID NO: 103267

SEQ ID NO: 452936 - RNA, 64 nt, Human; identical to SEQ ID NO: 129910

SEQ ID NO: 452937 - RNA, 64 nt, Human; identical to SEQ ID NO: 449625

SEQ ID NO: 452938 - RNA, 64 nt, Human; identical to SEQ ID NO: 449626

SEQ ID NO: 452939 - RNA, 64 nt, Human; identical to SEQ ID NO: 449630

SEQ ID NO: 452940 - RNA, 64 nt, Human; identical to SEQ ID NO: 449631

SEQ ID NO: 452941 - RNA, 64 nt, Human; identical to SEQ ID NO: 449632

SEQ ID NO: 452942 - RNA, 64 nt, Human; identical to SEQ ID NO: 449633

SEQ ID NO: 452943 - RNA, 64 nt, Human; identical to SEQ ID NO: 449634

SEQ ID NO: 452944 - RNA, 64 nt, Human; identical to SEQ ID NO: 449635

SEQ ID NO: 452945 - RNA, 64 nt, Human; identical to SEQ ID NO: 449636

SEQ ID NO: 452946 - RNA, 64 nt, Human; identical to SEQ ID NO: 449637

SEQ ID NO: 452947 - RNA, 64 nt, Human; identical to SEQ ID NO: 449638

SEQ ID NO: 452948 - RNA, 64 nt, Human; identical to SEQ ID NO: 449639

SEQ ID NO: 452949 - RNA, 64 nt, Human; identical to SEQ ID NO: 449640

SEQ ID NO: 452950 - RNA, 64 nt, Human; identical to SEQ ID NO: 449641

SEQ ID NO: 452951 - RNA, 64 nt, Human; identical to SEQ ID NO: 449642

SEQ ID NO: 452952 - RNA, 64 nt, Human; identical to SEQ ID NO: 185440

SEQ ID NO: 452953 - RNA, 64 nt, Human; identical to SEQ ID NO: 185441

SEQ ID NO: 452954 - RNA, 64 nt, Human; identical to SEQ ID NO: 185442

SEQ ID NO: 452955 - RNA, 64 nt, Human; identical to SEQ ID NO: 449643

SEQ ID NO: 452956 - RNA, 64 nt, Human; identical to SEQ ID NO: 449644

SEQ ID NO: 452957 - RNA, 64 nt, Human; identical to SEQ ID NO: 449648

SEQ ID NO: 452958 - RNA, 64 nt, Human; identical to SEQ ID NO: 449649

SEQ ID NO: 452959 - RNA, 64 nt, Human; identical to SEQ ID NO: 449650

SEQ ID NO: 452960 - RNA, 64 nt, Human; identical to SEQ ID NO: 449651

SEQ ID NO: 452961 - RNA, 64 nt, Human; identical to SEQ ID NO: 449652

SEQ ID NO: 452962 - RNA, 64 nt, Human; identical to SEQ ID NO: 449653

SEQ ID NO: 452963 - RNA, 64 nt, Human; identical to SEQ ID NO: 449654

SEQ ID NO: 452964 - RNA, 64 nt, Human; identical to SEQ ID NO: 449655

SEQ ID NO: 452965 - RNA, 64 nt, Human; identical to SEQ ID NO: 449656

SEQ ID NO: 452966 - RNA, 64 nt, Human; identical to SEQ ID NO: 449657

SEQ ID NO: 452967 - RNA, 64 nt, Human; identical to SEQ ID NO: 449658

SEQ ID NO: 452968 - RNA, 64 nt, Human; identical to SEQ ID NO: 449659

SEQ ID NO: 452969 - RNA, 64 nt, Human; identical to SEQ ID NO: 449660

SEQ ID NO: 452970 - RNA, 64 nt, Human; identical to SEQ ID NO: 111524

SEQ ID NO: 452971 - RNA, 64 nt, Human; identical to SEQ ID NO: 129927

SEQ ID NO: 452972 - RNA, 64 nt, Human; identical to SEQ ID NO: 185573

SEQ ID NO: 452973 - RNA, 64 nt, Human; identical to SEQ ID NO: 449661

SEQ ID NO: 452974 - RNA, 64 nt, Human; identical to SEQ ID NO: 449662

SEQ ID NO: 452975 - RNA, 64 nt, Human; identical to SEQ ID NO: 449666

SEQ ID NO: 452976 - RNA, 64 nt, Human; identical to SEQ ID NO: 449667

SEQ ID NO: 452977 - RNA, 64 nt, Human; identical to SEQ ID NO: 449668

SEQ ID NO: 452978 - RNA, 64 nt, Human; identical to SEQ ID NO: 449669

SEQ ID NO: 452979 - RNA, 64 nt, Human; identical to SEQ ID NO: 449670

SEQ ID NO: 452980 - RNA, 64 nt, Human; identical to SEQ ID NO: 449671

SEQ ID NO: 452981 - RNA, 64 nt, Human; identical to SEQ ID NO: 449672

SEQ ID NO: 452982 - RNA, 64 nt, Human; identical to SEQ ID NO: 449673

SEQ ID NO: 452983 - RNA, 64 nt, Human; identical to SEQ ID NO: 449674

SEQ ID NO: 452984 - RNA, 64 nt, Human; identical to SEQ ID NO: 449675

SEQ ID NO: 452985 - RNA, 64 nt, Human; identical to SEQ ID NO: 449676

SEQ ID NO: 452986 - RNA, 64 nt, Human; identical to SEQ ID NO: 449677

SEQ ID NO: 452987 - RNA, 64 nt, Human; identical to SEQ ID NO: 449678

SEQ ID NO: 452988 - RNA, 64 nt, Human; identical to SEQ ID NO: 185574

SEQ ID NO: 452989 - RNA, 64 nt, Human; identical to SEQ ID NO: 185575

SEQ ID NO: 452990 - RNA, 64 nt, Human; identical to SEQ ID NO: 37338

SEQ ID NO: 452991 - RNA, 64 nt, Human; identical to SEQ ID NO: 449679

SEQ ID NO: 452992 - RNA, 64 nt, Human; identical to SEQ ID NO: 449680

SEQ ID NO: 452993 - RNA, 64 nt, Human; identical to SEQ ID NO: 449684

SEQ ID NO: 452994 - RNA, 64 nt, Human; identical to SEQ ID NO: 449685

SEQ ID NO: 452995 - RNA, 64 nt, Human; identical to SEQ ID NO: 449686

SEQ ID NO: 452996 - RNA, 64 nt, Human; identical to SEQ ID NO: 449687

SEQ ID NO: 452997 - RNA, 64 nt, Human; identical to SEQ ID NO: 449688

SEQ ID NO: 452998 - RNA, 64 nt, Human; identical to SEQ ID NO: 449689

SEQ ID NO: 452999 - RNA, 64 nt, Human; identical to SEQ ID NO: 449690

SEQ ID NO: 453000 - RNA, 64 nt, Human; identical to SEQ ID NO: 449691

SEQ ID NO: 453001 - RNA, 64 nt, Human; identical to SEQ ID NO: 449692

SEQ ID NO: 453002 - RNA, 64 nt, Human; identical to SEQ ID NO: 449693

SEQ ID NO: 453003 - RNA, 64 nt, Human; identical to SEQ ID NO: 449694

SEQ ID NO: 453004 - RNA, 64 nt, Human; identical to SEQ ID NO: 449695

SEQ ID NO: 453005 - RNA, 58 nt, Human; identical to SEQ ID NO: 381028

SEQ ID NO: 453006 - RNA, 64 nt, Human; identical to SEQ ID NO: 129944

SEQ ID NO: 453007 - RNA, 50 nt, Human; identical to SEQ ID NO: 179371

SEQ ID NO: 453008 - RNA, 64 nt, Human; identical to SEQ ID NO: 37356

SEQ ID NO: 453009 - RNA, 64 nt, Human; identical to SEQ ID NO: 449697

SEQ ID NO: 453010 - RNA, 64 nt, Human; identical to SEQ ID NO: 449698

SEQ ID NO: 453011 - RNA, 64 nt, Human; identical to SEQ ID NO: 449702

SEQ ID NO: 453012 - RNA, 64 nt, Human; identical to SEQ ID NO: 449703

SEQ ID NO: 453013 - RNA, 64 nt, Human; identical to SEQ ID NO: 449704

SEQ ID NO: 453014 - RNA, 64 nt, Human; identical to SEQ ID NO: 449705

SEQ ID NO: 453015 - RNA, 64 nt, Human; identical to SEQ ID NO: 449706

SEQ ID NO: 453016 - RNA, 64 nt, Human; identical to SEQ ID NO: 449707

SEQ ID NO: 453017 - RNA, 64 nt, Human; identical to SEQ ID NO: 449708

SEQ ID NO: 453018 - RNA, 64 nt, Human; identical to SEQ ID NO: 449709

SEQ ID NO: 453019 - RNA, 64 nt, Human; identical to SEQ ID NO: 449710

SEQ ID NO: 453020 - RNA, 64 nt, Human; identical to SEQ ID NO: 449711

SEQ ID NO: 453021 - RNA, 64 nt, Human; identical to SEQ ID NO: 449712

SEQ ID NO: 453022 - RNA, 64 nt, Human; identical to SEQ ID NO: 449713

SEQ ID NO: 453023 - RNA, 64 nt, Human; identical to SEQ ID NO: 449714

SEQ ID NO: 453024 - RNA, 64 nt, Human; identical to SEQ ID NO: 64106

SEQ ID NO: 453025 - RNA, 64 nt, Human; identical to SEQ ID NO: 64107

SEQ ID NO: 453026 - RNA, 64 nt, Human; identical to SEQ ID NO: 64108

SEQ ID NO: 453027 - RNA, 64 nt, Human; identical to SEQ ID NO: 449715

SEQ ID NO: 453028 - RNA, 64 nt, Human; identical to SEQ ID NO: 449716

SEQ ID NO: 453029 - RNA, 64 nt, Human; identical to SEQ ID NO: 449720

SEQ ID NO: 453030 - RNA, 64 nt, Human; identical to SEQ ID NO: 449721

SEQ ID NO: 453031 - RNA, 64 nt, Human; identical to SEQ ID NO: 449722

SEQ ID NO: 453032 - RNA, 64 nt, Human; identical to SEQ ID NO: 449723

SEQ ID NO: 453033 - RNA, 64 nt, Human; identical to SEQ ID NO: 449724

SEQ ID NO: 453034 - RNA, 64 nt, Human; identical to SEQ ID NO: 449725

SEQ ID NO: 453035 - RNA, 64 nt, Human; identical to SEQ ID NO: 449726

SEQ ID NO: 453036 - RNA, 64 nt, Human; identical to SEQ ID NO: 449727

SEQ ID NO: 453037 - RNA, 64 nt, Human; identical to SEQ ID NO: 449728

SEQ ID NO: 453038 - RNA, 64 nt, Human; identical to SEQ ID NO: 449729

SEQ ID NO: 453039 - RNA, 64 nt, Human; identical to SEQ ID NO: 449730

SEQ ID NO: 453040 - RNA, 64 nt, Human; identical to SEQ ID NO: 449731

SEQ ID NO: 453041 - RNA, 64 nt, Human; identical to SEQ ID NO: 449732

SEQ ID NO: 453042 - RNA, 64 nt, Human; identical to SEQ ID NO: 64183

SEQ ID NO: 453043 - RNA, 64 nt, Human; identical to SEQ ID NO: 64184

SEQ ID NO: 453044 - RNA, 59 nt, Human; identical to SEQ ID NO: 64185

SEQ ID NO: 453045 - RNA, 64 nt, Human; identical to SEQ ID NO: 449733

SEQ ID NO: 453046 - RNA, 64 nt, Human; identical to SEQ ID NO: 449734

SEQ ID NO: 453047 - RNA, 64 nt, Human; identical to SEQ ID NO: 449738

SEQ ID NO: 453048 - RNA, 64 nt, Human; identical to SEQ ID NO: 449739

SEQ ID NO: 453049 - RNA, 64 nt, Human; identical to SEQ ID NO: 449740

SEQ ID NO: 453050 - RNA, 64 nt, Human; identical to SEQ ID NO: 449741

SEQ ID NO: 453051 - RNA, 64 nt, Human; identical to SEQ ID NO: 449742

SEQ ID NO: 453052 - RNA, 64 nt, Human; identical to SEQ ID NO: 449743

SEQ ID NO: 453053 - RNA, 64 nt, Human; identical to SEQ ID NO: 449744

SEQ ID NO: 453054 - RNA, 64 nt, Human; identical to SEQ ID NO: 449745

SEQ ID NO: 453055 - RNA, 64 nt, Human; identical to SEQ ID NO: 449746

SEQ ID NO: 453056 - RNA, 64 nt, Human; identical to SEQ ID NO: 449747

SEQ ID NO: 453057 - RNA, 64 nt, Human; identical to SEQ ID NO: 449748

SEQ ID NO: 453058 - RNA, 64 nt, Human; identical to SEQ ID NO: 449749

SEQ ID NO: 453059 - RNA, 64 nt, Human; identical to SEQ ID NO: 449750

SEQ ID NO: 453060 - RNA, 64 nt, Human; identical to SEQ ID NO: 64110

SEQ ID NO: 453061 - RNA, 64 nt, Human; identical to SEQ ID NO: 64111

SEQ ID NO: 453062 - RNA, 64 nt, Human; identical to SEQ ID NO: 64112

SEQ ID NO: 453063 - RNA, 64 nt, Human; identical to SEQ ID NO: 449751

SEQ ID NO: 453064 - RNA, 64 nt, Human; identical to SEQ ID NO: 449752

SEQ ID NO: 453065 - RNA, 64 nt, Human; identical to SEQ ID NO: 449756

SEQ ID NO: 453066 - RNA, 64 nt, Human; identical to SEQ ID NO: 449757

SEQ ID NO: 453067 - RNA, 64 nt, Human; identical to SEQ ID NO: 449758

SEQ ID NO: 453068 - RNA, 64 nt, Human; identical to SEQ ID NO: 449759

SEQ ID NO: 453069 - RNA, 64 nt, Human; identical to SEQ ID NO: 449760

SEQ ID NO: 453070 - RNA, 64 nt, Human; identical to SEQ ID NO: 449761

SEQ ID NO: 453071 - RNA, 64 nt, Human; identical to SEQ ID NO: 449762

SEQ ID NO: 453072 - RNA, 64 nt, Human; identical to SEQ ID NO: 449763

SEQ ID NO: 453073 - RNA, 64 nt, Human; identical to SEQ ID NO: 449764

SEQ ID NO: 453074 - RNA, 64 nt, Human; identical to SEQ ID NO: 449765

SEQ ID NO: 453075 - RNA, 64 nt, Human; identical to SEQ ID NO: 449766

SEQ ID NO: 453076 - RNA, 64 nt, Human; identical to SEQ ID NO: 449767

SEQ ID NO: 453077 - RNA, 64 nt, Human; identical to SEQ ID NO: 449768

SEQ ID NO: 453078 - RNA, 64 nt, Human; identical to SEQ ID NO: 64113

SEQ ID NO: 453079 - RNA, 64 nt, Human; identical to SEQ ID NO: 64114

SEQ ID NO: 453080 - RNA, 61 nt, Human; identical to SEQ ID NO: 64115

SEQ ID NO: 453081 - RNA, 64 nt, Human; identical to SEQ ID NO: 449769

SEQ ID NO: 453082 - RNA, 64 nt, Human; identical to SEQ ID NO: 449770

SEQ ID NO: 453083 - RNA, 64 nt, Human; identical to SEQ ID NO: 449774

SEQ ID NO: 453084 - RNA, 64 nt, Human; identical to SEQ ID NO: 449775

SEQ ID NO: 453085 - RNA, 64 nt, Human; identical to SEQ ID NO: 449776

SEQ ID NO: 453086 - RNA, 64 nt, Human; identical to SEQ ID NO: 449777

SEQ ID NO: 453087 - RNA, 64 nt, Human; identical to SEQ ID NO: 449778

SEQ ID NO: 453088 - RNA, 64 nt, Human; identical to SEQ ID NO: 449779

SEQ ID NO: 453089 - RNA, 64 nt, Human; identical to SEQ ID NO: 449780

SEQ ID NO: 453090 - RNA, 64 nt, Human; identical to SEQ ID NO: 449781

SEQ ID NO: 453091 - RNA, 64 nt, Human; identical to SEQ ID NO: 449782

SEQ ID NO: 453092 - RNA, 64 nt, Human; identical to SEQ ID NO: 449783

SEQ ID NO: 453093 - RNA, 64 nt, Human; identical to SEQ ID NO: 449784

SEQ ID NO: 453094 - RNA, 64 nt, Human; identical to SEQ ID NO: 449785

SEQ ID NO: 453095 - RNA, 64 nt, Human; identical to SEQ ID NO: 449786

SEQ ID NO: 453096 - RNA, 64 nt, Human; identical to SEQ ID NO: 64117

SEQ ID NO: 453097 - RNA, 64 nt, Human; identical to SEQ ID NO: 64118

SEQ ID NO: 453098 - RNA, 64 nt, Human; identical to SEQ ID NO: 64119

SEQ ID NO: 453099 - RNA, 64 nt, Human; identical to SEQ ID NO: 449787

SEQ ID NO: 453100 - RNA, 64 nt, Human; identical to SEQ ID NO: 449788

SEQ ID NO: 453101 - RNA, 64 nt, Human; identical to SEQ ID NO: 449792

SEQ ID NO: 453102 - RNA, 64 nt, Human; identical to SEQ ID NO: 449793

SEQ ID NO: 453103 - RNA, 64 nt, Human; identical to SEQ ID NO: 449794

SEQ ID NO: 453104 - RNA, 64 nt, Human; identical to SEQ ID NO: 449795

SEQ ID NO: 453105 - RNA, 64 nt, Human; identical to SEQ ID NO: 449796

SEQ ID NO: 453106 - RNA, 64 nt, Human; identical to SEQ ID NO: 449797

SEQ ID NO: 453107 - RNA, 64 nt, Human; identical to SEQ ID NO: 449798

SEQ ID NO: 453108 - RNA, 64 nt, Human; identical to SEQ ID NO: 449799

SEQ ID NO: 453109 - RNA, 64 nt, Human; identical to SEQ ID NO: 449800

SEQ ID NO: 453110 - RNA, 64 nt, Human; identical to SEQ ID NO: 449801

SEQ ID NO: 453111 - RNA, 64 nt, Human; identical to SEQ ID NO: 449802

SEQ ID NO: 453112 - RNA, 64 nt, Human; identical to SEQ ID NO: 449803

SEQ ID NO: 453113 - RNA, 64 nt, Human; identical to SEQ ID NO: 449804

SEQ ID NO: 453114 - RNA, 64 nt, Human; identical to SEQ ID NO: 64120

SEQ ID NO: 453115 - RNA, 64 nt, Human; identical to SEQ ID NO: 64121

SEQ ID NO: 453116 - RNA, 64 nt, Human; identical to SEQ ID NO: 64122

SEQ ID NO: 453117 - RNA, 64 nt, Human; identical to SEQ ID NO: 449805

SEQ ID NO: 453118 - RNA, 64 nt, Human; identical to SEQ ID NO: 449806

SEQ ID NO: 453119 - RNA, 64 nt, Human; identical to SEQ ID NO: 449810

SEQ ID NO: 453120 - RNA, 63 nt, Human; identical to SEQ ID NO: 381122

SEQ ID NO: 453121 - RNA, 64 nt, Human; identical to SEQ ID NO: 449812

SEQ ID NO: 453122 - RNA, 64 nt, Human; identical to SEQ ID NO: 449813

SEQ ID NO: 453123 - RNA, 64 nt, Human; identical to SEQ ID NO: 449814

SEQ ID NO: 453124 - RNA, 64 nt, Human; identical to SEQ ID NO: 449815

SEQ ID NO: 453125 - RNA, 64 nt, Human; identical to SEQ ID NO: 449816

SEQ ID NO: 453126 - RNA, 64 nt, Human; identical to SEQ ID NO: 449817

SEQ ID NO: 453127 - RNA, 64 nt, Human; identical to SEQ ID NO: 449818

SEQ ID NO: 453128 - RNA, 64 nt, Human; identical to SEQ ID NO: 449819

SEQ ID NO: 453129 - RNA, 64 nt, Human; identical to SEQ ID NO: 449820

SEQ ID NO: 453130 - RNA, 64 nt, Human; identical to SEQ ID NO: 449821

SEQ ID NO: 453131 - RNA, 64 nt, Human; identical to SEQ ID NO: 449822

SEQ ID NO: 453132 - RNA, 64 nt, Human; identical to SEQ ID NO: 64124

SEQ ID NO: 453133 - RNA, 64 nt, Human; identical to SEQ ID NO: 64125

SEQ ID NO: 453134 - RNA, 53 nt, Human; identical to SEQ ID NO: 64126

SEQ ID NO: 453135 - RNA, 64 nt, Human; identical to SEQ ID NO: 449823

SEQ ID NO: 453136 - RNA, 64 nt, Human; identical to SEQ ID NO: 449824

SEQ ID NO: 453137 - RNA, 64 nt, Human; identical to SEQ ID NO: 449828

SEQ ID NO: 453138 - RNA, 64 nt, Human; identical to SEQ ID NO: 449829

SEQ ID NO: 453139 - RNA, 64 nt, Human; identical to SEQ ID NO: 449830

SEQ ID NO: 453140 - RNA, 64 nt, Human; identical to SEQ ID NO: 449831

SEQ ID NO: 453141 - RNA, 64 nt, Human; identical to SEQ ID NO: 449832

SEQ ID NO: 453142 - RNA, 64 nt, Human; identical to SEQ ID NO: 449833

SEQ ID NO: 453143 - RNA, 64 nt, Human; identical to SEQ ID NO: 449834

SEQ ID NO: 453144 - RNA, 64 nt, Human; identical to SEQ ID NO: 449835

SEQ ID NO: 453145 - RNA, 64 nt, Human; identical to SEQ ID NO: 449836

SEQ ID NO: 453146 - RNA, 64 nt, Human; identical to SEQ ID NO: 449837

SEQ ID NO: 453147 - RNA, 64 nt, Human; identical to SEQ ID NO: 449838

SEQ ID NO: 453148 - RNA, 64 nt, Human; identical to SEQ ID NO: 449839

SEQ ID NO: 453149 - RNA, 64 nt, Human; identical to SEQ ID NO: 449840

SEQ ID NO: 453150 - RNA, 64 nt, Human; identical to SEQ ID NO: 64127

SEQ ID NO: 453151 - RNA, 64 nt, Human; identical to SEQ ID NO: 64128

SEQ ID NO: 453152 - RNA, 64 nt, Human; identical to SEQ ID NO: 64129

SEQ ID NO: 453153 - RNA, 64 nt, Human; identical to SEQ ID NO: 449841

SEQ ID NO: 453154 - RNA, 64 nt, Human; identical to SEQ ID NO: 449842

SEQ ID NO: 453155 - RNA, 64 nt, Human; identical to SEQ ID NO: 449846

SEQ ID NO: 453156 - RNA, 64 nt, Human; identical to SEQ ID NO: 449847

SEQ ID NO: 453157 - RNA, 64 nt, Human; identical to SEQ ID NO: 449848

SEQ ID NO: 453158 - RNA, 64 nt, Human; identical to SEQ ID NO: 449849

SEQ ID NO: 453159 - RNA, 64 nt, Human; identical to SEQ ID NO: 449850

SEQ ID NO: 453160 - RNA, 64 nt, Human; identical to SEQ ID NO: 449851

SEQ ID NO: 453161 - RNA, 64 nt, Human; identical to SEQ ID NO: 449852

SEQ ID NO: 453162 - RNA, 64 nt, Human; identical to SEQ ID NO: 449853

SEQ ID NO: 453163 - RNA, 64 nt, Human; identical to SEQ ID NO: 449854

SEQ ID NO: 453164 - RNA, 64 nt, Human; identical to SEQ ID NO: 449855

SEQ ID NO: 453165 - RNA, 64 nt, Human; identical to SEQ ID NO: 449856

SEQ ID NO: 453166 - RNA, 64 nt, Human; identical to SEQ ID NO: 449857

SEQ ID NO: 453167 - RNA, 64 nt, Human; identical to SEQ ID NO: 449858

SEQ ID NO: 453168 - RNA, 64 nt, Human; identical to SEQ ID NO: 64187

SEQ ID NO: 453169 - RNA, 64 nt, Human; identical to SEQ ID NO: 64188

SEQ ID NO: 453170 - RNA, 64 nt, Human; identical to SEQ ID NO: 64189

SEQ ID NO: 453171 - RNA, 64 nt, Human; identical to SEQ ID NO: 449859

SEQ ID NO: 453172 - RNA, 64 nt, Human; identical to SEQ ID NO: 449860

SEQ ID NO: 453173 - RNA, 64 nt, Human; identical to SEQ ID NO: 449864

SEQ ID NO: 453174 - RNA, 64 nt, Human; identical to SEQ ID NO: 449865

SEQ ID NO: 453175 - RNA, 64 nt, Human; identical to SEQ ID NO: 449866

SEQ ID NO: 453176 - RNA, 64 nt, Human; identical to SEQ ID NO: 449867

SEQ ID NO: 453177 - RNA, 64 nt, Human; identical to SEQ ID NO: 449868

SEQ ID NO: 453178 - RNA, 64 nt, Human; identical to SEQ ID NO: 449869

SEQ ID NO: 453179 - RNA, 64 nt, Human; identical to SEQ ID NO: 449870

SEQ ID NO: 453180 - RNA, 64 nt, Human; identical to SEQ ID NO: 449871

SEQ ID NO: 453181 - RNA, 64 nt, Human; identical to SEQ ID NO: 449872

SEQ ID NO: 453182 - RNA, 64 nt, Human; identical to SEQ ID NO: 449873

SEQ ID NO: 453183 - RNA, 64 nt, Human; identical to SEQ ID NO: 449874

SEQ ID NO: 453184 - RNA, 64 nt, Human; identical to SEQ ID NO: 449875

SEQ ID NO: 453185 - RNA, 64 nt, Human; identical to SEQ ID NO: 449876

SEQ ID NO: 453186 - RNA, 64 nt, Human; identical to SEQ ID NO: 185422

SEQ ID NO: 453187 - RNA, 64 nt, Human; identical to SEQ ID NO: 185423

SEQ ID NO: 453188 - RNA, 64 nt, Human; identical to SEQ ID NO: 37089

SEQ ID NO: 453189 - RNA, 64 nt, Human; identical to SEQ ID NO: 449877

SEQ ID NO: 453190 - RNA, 64 nt, Human; identical to SEQ ID NO: 449878

SEQ ID NO: 453191 - RNA, 64 nt, Human; identical to SEQ ID NO: 449879

SEQ ID NO: 453192 - RNA, 64 nt, Human; identical to SEQ ID NO: 449880

SEQ ID NO: 453193 - RNA, 64 nt, Human; identical to SEQ ID NO: 449881

SEQ ID NO: 453194 - RNA, 64 nt, Human; identical to SEQ ID NO: 449882

SEQ ID NO: 453195 - RNA, 64 nt, Human; identical to SEQ ID NO: 449883

SEQ ID NO: 453196 - RNA, 64 nt, Human; identical to SEQ ID NO: 449884

SEQ ID NO: 453197 - RNA, 64 nt, Human; identical to SEQ ID NO: 449885

SEQ ID NO: 453198 - RNA, 64 nt, Human; identical to SEQ ID NO: 449886

SEQ ID NO: 453199 - RNA, 64 nt, Human; identical to SEQ ID NO: 449887

SEQ ID NO: 453200 - RNA, 64 nt, Human; identical to SEQ ID NO: 449888

SEQ ID NO: 453201 - RNA, 64 nt, Human; identical to SEQ ID NO: 449889

SEQ ID NO: 453202 - RNA, 64 nt, Human; identical to SEQ ID NO: 449890

SEQ ID NO: 453203 - RNA, 64 nt, Human; identical to SEQ ID NO: 449891

SEQ ID NO: 453204 - RNA, 64 nt, Human; identical to SEQ ID NO: 129741

SEQ ID NO: 453205 - RNA, 64 nt, Human; identical to SEQ ID NO: 185459

SEQ ID NO: 453206 - RNA, 64 nt, Human; identical to SEQ ID NO: 185460

SEQ ID NO: 453207 - RNA, 64 nt, Human; identical to SEQ ID NO: 449892

SEQ ID NO: 453208 - RNA, 64 nt, Human; identical to SEQ ID NO: 449893

SEQ ID NO: 453209 - RNA, 64 nt, Human; identical to SEQ ID NO: 449896

SEQ ID NO: 453210 - RNA, 64 nt, Human; identical to SEQ ID NO: 449897

SEQ ID NO: 453211 - RNA, 64 nt, Human; identical to SEQ ID NO: 449898

SEQ ID NO: 453212 - RNA, 64 nt, Human; identical to SEQ ID NO: 449899

SEQ ID NO: 453213 - RNA, 64 nt, Human; identical to SEQ ID NO: 449900

SEQ ID NO: 453214 - RNA, 64 nt, Human; identical to SEQ ID NO: 449901

SEQ ID NO: 453215 - RNA, 64 nt, Human; identical to SEQ ID NO: 449902

SEQ ID NO: 453216 - RNA, 64 nt, Human; identical to SEQ ID NO: 449903

SEQ ID NO: 453217 - RNA, 64 nt, Human; identical to SEQ ID NO: 449904

SEQ ID NO: 453218 - RNA, 64 nt, Human; identical to SEQ ID NO: 449905

SEQ ID NO: 453219 - RNA, 53 nt, Human; identical to SEQ ID NO: 381206

SEQ ID NO: 453220 - RNA, 64 nt, Human; identical to SEQ ID NO: 449907

SEQ ID NO: 453221 - RNA, 64 nt, Human; identical to SEQ ID NO: 449908

SEQ ID NO: 453222 - RNA, 64 nt, Human; identical to SEQ ID NO: 185461

SEQ ID NO: 453223 - RNA, 64 nt, Human; identical to SEQ ID NO: 37107

SEQ ID NO: 453224 - RNA, 64 nt, Human; identical to SEQ ID NO: 111410

SEQ ID NO: 453225 - RNA, 64 nt, Human; identical to SEQ ID NO: 449909

SEQ ID NO: 453226 - RNA, 64 nt, Human; identical to SEQ ID NO: 449910

SEQ ID NO: 453227 - RNA, 64 nt, Human; identical to SEQ ID NO: 449914

SEQ ID NO: 453228 - RNA, 64 nt, Human; identical to SEQ ID NO: 449915

SEQ ID NO: 453229 - RNA, 64 nt, Human; identical to SEQ ID NO: 449916

SEQ ID NO: 453230 - RNA, 64 nt, Human; identical to SEQ ID NO: 449917

SEQ ID NO: 453231 - RNA, 59 nt, Human; identical to SEQ ID NO: 381215

SEQ ID NO: 453232 - RNA, 64 nt, Human; identical to SEQ ID NO: 449919

SEQ ID NO: 453233 - RNA, 64 nt, Human; identical to SEQ ID NO: 449920

SEQ ID NO: 453234 - RNA, 64 nt, Human; identical to SEQ ID NO: 449921

SEQ ID NO: 453235 - RNA, 64 nt, Human; identical to SEQ ID NO: 449922

SEQ ID NO: 453236 - RNA, 64 nt, Human; identical to SEQ ID NO: 449923

SEQ ID NO: 453237 - RNA, 64 nt, Human; identical to SEQ ID NO: 449924

SEQ ID NO: 453238 - RNA, 64 nt, Human; identical to SEQ ID NO: 449925

SEQ ID NO: 453239 - RNA, 64 nt, Human; identical to SEQ ID NO: 449926

SEQ ID NO: 453240 - RNA, 64 nt, Human; identical to SEQ ID NO: 185535

SEQ ID NO: 453241 - RNA, 64 nt, Human; identical to SEQ ID NO: 185536

SEQ ID NO: 453242 - RNA, 64 nt, Human; identical to SEQ ID NO: 185537

SEQ ID NO: 453243 - RNA, 64 nt, Human; identical to SEQ ID NO: 449927

SEQ ID NO: 453244 - RNA, 64 nt, Human; identical to SEQ ID NO: 449928

SEQ ID NO: 453245 - RNA, 64 nt, Human; identical to SEQ ID NO: 449931

SEQ ID NO: 453246 - RNA, 64 nt, Human; identical to SEQ ID NO: 449932

SEQ ID NO: 453247 - RNA, 64 nt, Human; identical to SEQ ID NO: 449933

SEQ ID NO: 453248 - RNA, 64 nt, Human; identical to SEQ ID NO: 449934

SEQ ID NO: 453249 - RNA, 64 nt, Human; identical to SEQ ID NO: 449935

SEQ ID NO: 453250 - RNA, 64 nt, Human; identical to SEQ ID NO: 449936

SEQ ID NO: 453251 - RNA, 64 nt, Human; identical to SEQ ID NO: 449937

SEQ ID NO: 453252 - RNA, 64 nt, Human; identical to SEQ ID NO: 449938

SEQ ID NO: 453253 - RNA, 64 nt, Human; identical to SEQ ID NO: 449939

SEQ ID NO: 453254 - RNA, 64 nt, Human; identical to SEQ ID NO: 449940

SEQ ID NO: 453255 - RNA, 64 nt, Human; identical to SEQ ID NO: 449941

SEQ ID NO: 453256 - RNA, 64 nt, Human; identical to SEQ ID NO: 449942

SEQ ID NO: 453257 - RNA, 64 nt, Human; identical to SEQ ID NO: 449943

SEQ ID NO: 453258 - RNA, 64 nt, Human; identical to SEQ ID NO: 37142

SEQ ID NO: 453259 - RNA, 64 nt, Human; identical to SEQ ID NO: 111785

SEQ ID NO: 453260 - RNA, 64 nt, Human; identical to SEQ ID NO: 129775

SEQ ID NO: 453261 - RNA, 64 nt, Human; identical to SEQ ID NO: 449944

SEQ ID NO: 453262 - RNA, 64 nt, Human; identical to SEQ ID NO: 449945

SEQ ID NO: 453263 - RNA, 64 nt, Human; identical to SEQ ID NO: 449948

SEQ ID NO: 453264 - RNA, 64 nt, Human; identical to SEQ ID NO: 449949

SEQ ID NO: 453265 - RNA, 64 nt, Human; identical to SEQ ID NO: 449950

SEQ ID NO: 453266 - RNA, 64 nt, Human; identical to SEQ ID NO: 449951

SEQ ID NO: 453267 - RNA, 64 nt, Human; identical to SEQ ID NO: 449952

SEQ ID NO: 453268 - RNA, 64 nt, Human; identical to SEQ ID NO: 449953

SEQ ID NO: 453269 - RNA, 64 nt, Human; identical to SEQ ID NO: 449954

SEQ ID NO: 453270 - RNA, 64 nt, Human; identical to SEQ ID NO: 449955

SEQ ID NO: 453271 - RNA, 64 nt, Human; identical to SEQ ID NO: 449956

SEQ ID NO: 453272 - RNA, 64 nt, Human; identical to SEQ ID NO: 449957

SEQ ID NO: 453273 - RNA, 64 nt, Human; identical to SEQ ID NO: 449958

SEQ ID NO: 453274 - RNA, 64 nt, Human; identical to SEQ ID NO: 449959

SEQ ID NO: 453275 - RNA, 64 nt, Human; identical to SEQ ID NO: 449960

SEQ ID NO: 453276 - RNA, 64 nt, Human; identical to SEQ ID NO: 185612

SEQ ID NO: 453277 - RNA, 64 nt, Human; identical to SEQ ID NO: 185613

SEQ ID NO: 453278 - RNA, 64 nt, Human; identical to SEQ ID NO: 37160

SEQ ID NO: 453279 - RNA, 64 nt, Human; identical to SEQ ID NO: 449961

SEQ ID NO: 453280 - RNA, 64 nt, Human; identical to SEQ ID NO: 449962

SEQ ID NO: 453281 - RNA, 64 nt, Human; identical to SEQ ID NO: 449966

SEQ ID NO: 453282 - RNA, 50 nt, Human; identical to SEQ ID NO: 381257

SEQ ID NO: 453283 - RNA, 64 nt, Human; identical to SEQ ID NO: 449968

SEQ ID NO: 453284 - RNA, 64 nt, Human; identical to SEQ ID NO: 449969

SEQ ID NO: 453285 - RNA, 64 nt, Human; identical to SEQ ID NO: 449970

SEQ ID NO: 453286 - RNA, 64 nt, Human; identical to SEQ ID NO: 449971

SEQ ID NO: 453287 - RNA, 64 nt, Human; identical to SEQ ID NO: 449972

SEQ ID NO: 453288 - RNA, 64 nt, Human; identical to SEQ ID NO: 449973

SEQ ID NO: 453289 - RNA, 64 nt, Human; identical to SEQ ID NO: 449974

SEQ ID NO: 453290 - RNA, 64 nt, Human; identical to SEQ ID NO: 449975

SEQ ID NO: 453291 - RNA, 64 nt, Human; identical to SEQ ID NO: 449976

SEQ ID NO: 453292 - RNA, 64 nt, Human; identical to SEQ ID NO: 449977

SEQ ID NO: 453293 - RNA, 64 nt, Human; identical to SEQ ID NO: 449978

SEQ ID NO: 453294 - RNA, 64 nt, Human; identical to SEQ ID NO: 102789

SEQ ID NO: 453295 - RNA, 64 nt, Human; identical to SEQ ID NO: 129792

SEQ ID NO: 453296 - RNA, 64 nt, Human; identical to SEQ ID NO: 179569

SEQ ID NO: 453297 - RNA, 64 nt, Human; identical to SEQ ID NO: 449979

SEQ ID NO: 453298 - RNA, 64 nt, Human; identical to SEQ ID NO: 449980

SEQ ID NO: 453299 - RNA, 64 nt, Human; identical to SEQ ID NO: 449983

SEQ ID NO: 453300 - RNA, 64 nt, Human; identical to SEQ ID NO: 449984

SEQ ID NO: 453301 - RNA, 64 nt, Human; identical to SEQ ID NO: 449985

SEQ ID NO: 453302 - RNA, 64 nt, Human; identical to SEQ ID NO: 449986

SEQ ID NO: 453303 - RNA, 64 nt, Human; identical to SEQ ID NO: 449987

SEQ ID NO: 453304 - RNA, 64 nt, Human; identical to SEQ ID NO: 449988

SEQ ID NO: 453305 - RNA, 64 nt, Human; identical to SEQ ID NO: 449989

SEQ ID NO: 453306 - RNA, 64 nt, Human; identical to SEQ ID NO: 449990

SEQ ID NO: 453307 - RNA, 64 nt, Human; identical to SEQ ID NO: 449991

SEQ ID NO: 453308 - RNA, 64 nt, Human; identical to SEQ ID NO: 449992

SEQ ID NO: 453309 - RNA, 64 nt, Human; identical to SEQ ID NO: 449993

SEQ ID NO: 453310 - RNA, 64 nt, Human; identical to SEQ ID NO: 449994

SEQ ID NO: 453311 - RNA, 64 nt, Human; identical to SEQ ID NO: 449995

SEQ ID NO: 453312 - RNA, 64 nt, Human; identical to SEQ ID NO: 64131

SEQ ID NO: 453313 - RNA, 64 nt, Human; identical to SEQ ID NO: 64132

SEQ ID NO: 453314 - RNA, 64 nt, Human; identical to SEQ ID NO: 64133

SEQ ID NO: 453315 - RNA, 64 nt, Human; identical to SEQ ID NO: 449996

SEQ ID NO: 453316 - RNA, 64 nt, Human; identical to SEQ ID NO: 449997

SEQ ID NO: 453317 - RNA, 64 nt, Human; identical to SEQ ID NO: 450000

SEQ ID NO: 453318 - RNA, 64 nt, Human; identical to SEQ ID NO: 450001

SEQ ID NO: 453319 - RNA, 64 nt, Human; identical to SEQ ID NO: 450002

SEQ ID NO: 453320 - RNA, 64 nt, Human; identical to SEQ ID NO: 450003

SEQ ID NO: 453321 - RNA, 64 nt, Human; identical to SEQ ID NO: 450004

SEQ ID NO: 453322 - RNA, 64 nt, Human; identical to SEQ ID NO: 450005

SEQ ID NO: 453323 - RNA, 64 nt, Human; identical to SEQ ID NO: 450006

SEQ ID NO: 453324 - RNA, 64 nt, Human; identical to SEQ ID NO: 450007

SEQ ID NO: 453325 - RNA, 64 nt, Human; identical to SEQ ID NO: 450008

SEQ ID NO: 453326 - RNA, 64 nt, Human; identical to SEQ ID NO: 450009

SEQ ID NO: 453327 - RNA, 64 nt, Human; identical to SEQ ID NO: 450010

SEQ ID NO: 453328 - RNA, 64 nt, Human; identical to SEQ ID NO: 450011

SEQ ID NO: 453329 - RNA, 64 nt, Human; identical to SEQ ID NO: 450012

SEQ ID NO: 453330 - RNA, 64 nt, Human; identical to SEQ ID NO: 102825

SEQ ID NO: 453331 - RNA, 64 nt, Human; identical to SEQ ID NO: 129809

SEQ ID NO: 453332 - RNA, 64 nt, Human; identical to SEQ ID NO: 179640

SEQ ID NO: 453333 - RNA, 64 nt, Human; identical to SEQ ID NO: 450013

SEQ ID NO: 453334 - RNA, 64 nt, Human; identical to SEQ ID NO: 450014

SEQ ID NO: 453335 - RNA, 64 nt, Human; identical to SEQ ID NO: 450018

SEQ ID NO: 453336 - RNA, 64 nt, Human; identical to SEQ ID NO: 450019

SEQ ID NO: 453337 - RNA, 64 nt, Human; identical to SEQ ID NO: 450020

SEQ ID NO: 453338 - RNA, 64 nt, Human; identical to SEQ ID NO: 450021

SEQ ID NO: 453339 - RNA, 64 nt, Human; identical to SEQ ID NO: 450022

SEQ ID NO: 453340 - RNA, 64 nt, Human; identical to SEQ ID NO: 450023

SEQ ID NO: 453341 - RNA, 64 nt, Human; identical to SEQ ID NO: 450024

SEQ ID NO: 453342 - RNA, 64 nt, Human; identical to SEQ ID NO: 450025

SEQ ID NO: 453343 - RNA, 64 nt, Human; identical to SEQ ID NO: 450026

SEQ ID NO: 453344 - RNA, 64 nt, Human; identical to SEQ ID NO: 450027

SEQ ID NO: 453345 - RNA, 64 nt, Human; identical to SEQ ID NO: 450028

SEQ ID NO: 453346 - RNA, 64 nt, Human; identical to SEQ ID NO: 450029

SEQ ID NO: 453347 - RNA, 64 nt, Human; identical to SEQ ID NO: 450030

SEQ ID NO: 453348 - RNA, 64 nt, Human; identical to SEQ ID NO: 37196

SEQ ID NO: 453349 - RNA, 55 nt, Human; identical to SEQ ID NO: 102895

SEQ ID NO: 453350 - RNA, 64 nt, Human; identical to SEQ ID NO: 129826

SEQ ID NO: 453351 - RNA, 64 nt, Human; identical to SEQ ID NO: 450031

SEQ ID NO: 453352 - RNA, 64 nt, Human; identical to SEQ ID NO: 450032

SEQ ID NO: 453353 - RNA, 64 nt, Human; identical to SEQ ID NO: 450036

SEQ ID NO: 453354 - RNA, 64 nt, Human; identical to SEQ ID NO: 450037

SEQ ID NO: 453355 - RNA, 64 nt, Human; identical to SEQ ID NO: 450038

SEQ ID NO: 453356 - RNA, 64 nt, Human; identical to SEQ ID NO: 450039

SEQ ID NO: 453357 - RNA, 64 nt, Human; identical to SEQ ID NO: 450040

SEQ ID NO: 453358 - RNA, 64 nt, Human; identical to SEQ ID NO: 450041

SEQ ID NO: 453359 - RNA, 64 nt, Human; identical to SEQ ID NO: 450042

SEQ ID NO: 453360 - RNA, 64 nt, Human; identical to SEQ ID NO: 450043

SEQ ID NO: 453361 - RNA, 64 nt, Human; identical to SEQ ID NO: 450044

SEQ ID NO: 453362 - RNA, 64 nt, Human; identical to SEQ ID NO: 450045

SEQ ID NO: 453363 - RNA, 64 nt, Human; identical to SEQ ID NO: 450046

SEQ ID NO: 453364 - RNA, 64 nt, Human; identical to SEQ ID NO: 450047

SEQ ID NO: 453365 - RNA, 64 nt, Human; identical to SEQ ID NO: 450048

SEQ ID NO: 453366 - RNA, 64 nt, Human; identical to SEQ ID NO: 37214

SEQ ID NO: 453367 - RNA, 64 nt, Human; identical to SEQ ID NO: 102931

SEQ ID NO: 453368 - RNA, 64 nt, Human; identical to SEQ ID NO: 129843

SEQ ID NO: 453369 - RNA, 64 nt, Human; identical to SEQ ID NO: 450049

SEQ ID NO: 453370 - RNA, 64 nt, Human; identical to SEQ ID NO: 450050

SEQ ID NO: 453371 - RNA, 64 nt, Human; identical to SEQ ID NO: 450054

SEQ ID NO: 453372 - RNA, 64 nt, Human; identical to SEQ ID NO: 450055

SEQ ID NO: 453373 - RNA, 64 nt, Human; identical to SEQ ID NO: 450056

SEQ ID NO: 453374 - RNA, 64 nt, Human; identical to SEQ ID NO: 450057

SEQ ID NO: 453375 - RNA, 64 nt, Human; identical to SEQ ID NO: 450058

SEQ ID NO: 453376 - RNA, 64 nt, Human; identical to SEQ ID NO: 450059

SEQ ID NO: 453377 - RNA, 64 nt, Human; identical to SEQ ID NO: 450060

SEQ ID NO: 453378 - RNA, 64 nt, Human; identical to SEQ ID NO: 450061

SEQ ID NO: 453379 - RNA, 64 nt, Human; identical to SEQ ID NO: 450062

SEQ ID NO: 453380 - RNA, 64 nt, Human; identical to SEQ ID NO: 450063

SEQ ID NO: 453381 - RNA, 64 nt, Human; identical to SEQ ID NO: 450064

SEQ ID NO: 453382 - RNA, 64 nt, Human; identical to SEQ ID NO: 450065

SEQ ID NO: 453383 - RNA, 64 nt, Human; identical to SEQ ID NO: 450066

SEQ ID NO: 453384 - RNA, 64 nt, Human; identical to SEQ ID NO: 179802

SEQ ID NO: 453385 - RNA, 64 nt, Human; identical to SEQ ID NO: 37232

SEQ ID NO: 453386 - RNA, 64 nt, Human; identical to SEQ ID NO: 103002

SEQ ID NO: 453387 - RNA, 52 nt, Human; identical to SEQ ID NO: 381344

SEQ ID NO: 453388 - RNA, 64 nt, Human; identical to SEQ ID NO: 450068

SEQ ID NO: 453389 - RNA, 64 nt, Human; identical to SEQ ID NO: 450072

SEQ ID NO: 453390 - RNA, 64 nt, Human; identical to SEQ ID NO: 450073

SEQ ID NO: 453391 - RNA, 64 nt, Human; identical to SEQ ID NO: 450074

SEQ ID NO: 453392 - RNA, 64 nt, Human; identical to SEQ ID NO: 450075

SEQ ID NO: 453393 - RNA, 64 nt, Human; identical to SEQ ID NO: 450076

SEQ ID NO: 453394 - RNA, 64 nt, Human; identical to SEQ ID NO: 450077

SEQ ID NO: 453395 - RNA, 64 nt, Human; identical to SEQ ID NO: 450078

SEQ ID NO: 453396 - RNA, 52 nt, Human; identical to SEQ ID NO: 381351

SEQ ID NO: 453397 - RNA, 64 nt, Human; identical to SEQ ID NO: 450080

SEQ ID NO: 453398 - RNA, 64 nt, Human; identical to SEQ ID NO: 450081

SEQ ID NO: 453399 - RNA, 64 nt, Human; identical to SEQ ID NO: 450082

SEQ ID NO: 453400 - RNA, 64 nt, Human; identical to SEQ ID NO: 450083

SEQ ID NO: 453401 - RNA, 64 nt, Human; identical to SEQ ID NO: 450084

SEQ ID NO: 453402 - RNA, 64 nt, Human; identical to SEQ ID NO: 180108

SEQ ID NO: 453403 - RNA, 56 nt, Human; identical to SEQ ID NO: 37267

SEQ ID NO: 453404 - RNA, 64 nt, Human; identical to SEQ ID NO: 103108

SEQ ID NO: 453405 - RNA, 64 nt, Human; identical to SEQ ID NO: 450085

SEQ ID NO: 453406 - RNA, 64 nt, Human; identical to SEQ ID NO: 450086

SEQ ID NO: 453407 - RNA, 64 nt, Human; identical to SEQ ID NO: 450090

SEQ ID NO: 453408 - RNA, 64 nt, Human; identical to SEQ ID NO: 450091

SEQ ID NO: 453409 - RNA, 64 nt, Human; identical to SEQ ID NO: 450092

SEQ ID NO: 453410 - RNA, 64 nt, Human; identical to SEQ ID NO: 450093

SEQ ID NO: 453411 - RNA, 64 nt, Human; identical to SEQ ID NO: 450094

SEQ ID NO: 453412 - RNA, 64 nt, Human; identical to SEQ ID NO: 450095

SEQ ID NO: 453413 - RNA, 54 nt, Human; identical to SEQ ID NO: 381367

SEQ ID NO: 453414 - RNA, 64 nt, Human; identical to SEQ ID NO: 450097

SEQ ID NO: 453415 - RNA, 64 nt, Human; identical to SEQ ID NO: 450098

SEQ ID NO: 453416 - RNA, 64 nt, Human; identical to SEQ ID NO: 450099

SEQ ID NO: 453417 - RNA, 64 nt, Human; identical to SEQ ID NO: 450100

SEQ ID NO: 453418 - RNA, 64 nt, Human; identical to SEQ ID NO: 450101

SEQ ID NO: 453419 - RNA, 64 nt, Human; identical to SEQ ID NO: 450102

SEQ ID NO: 453420 - RNA, 64 nt, Human; identical to SEQ ID NO: 11938

SEQ ID NO: 453421 - RNA, 64 nt, Human; identical to SEQ ID NO: 111467

SEQ ID NO: 453422 - RNA, 64 nt, Human; identical to SEQ ID NO: 129589

SEQ ID NO: 453423 - RNA, 64 nt, Human; identical to SEQ ID NO: 450103

SEQ ID NO: 453424 - RNA, 64 nt, Human; identical to SEQ ID NO: 450104

SEQ ID NO: 453425 - RNA, 64 nt, Human; identical to SEQ ID NO: 450108

SEQ ID NO: 453426 - RNA, 64 nt, Human; identical to SEQ ID NO: 450109

SEQ ID NO: 453427 - RNA, 64 nt, Human; identical to SEQ ID NO: 450110

SEQ ID NO: 453428 - RNA, 64 nt, Human; identical to SEQ ID NO: 450111

SEQ ID NO: 453429 - RNA, 64 nt, Human; identical to SEQ ID NO: 450112

SEQ ID NO: 453430 - RNA, 64 nt, Human; identical to SEQ ID NO: 450113

SEQ ID NO: 453431 - RNA, 64 nt, Human; identical to SEQ ID NO: 450114

SEQ ID NO: 453432 - RNA, 64 nt, Human; identical to SEQ ID NO: 450115

SEQ ID NO: 453433 - RNA, 64 nt, Human; identical to SEQ ID NO: 450116

SEQ ID NO: 453434 - RNA, 64 nt, Human; identical to SEQ ID NO: 450117

SEQ ID NO: 453435 - RNA, 64 nt, Human; identical to SEQ ID NO: 450118

SEQ ID NO: 453436 - RNA, 64 nt, Human; identical to SEQ ID NO: 450119

SEQ ID NO: 453437 - RNA, 64 nt, Human; identical to SEQ ID NO: 450120

SEQ ID NO: 453438 - RNA, 64 nt, Human; identical to SEQ ID NO: 185680

SEQ ID NO: 453439 - RNA, 64 nt, Human; identical to SEQ ID NO: 185681

SEQ ID NO: 453440 - RNA, 64 nt, Human; identical to SEQ ID NO: 185682

SEQ ID NO: 453441 - RNA, 64 nt, Human; identical to SEQ ID NO: 450121

SEQ ID NO: 453442 - RNA, 64 nt, Human; identical to SEQ ID NO: 450122

SEQ ID NO: 453443 - RNA, 64 nt, Human; identical to SEQ ID NO: 450126

SEQ ID NO: 453444 - RNA, 64 nt, Human; identical to SEQ ID NO: 450127

SEQ ID NO: 453445 - RNA, 64 nt, Human; identical to SEQ ID NO: 450128

SEQ ID NO: 453446 - RNA, 64 nt, Human; identical to SEQ ID NO: 450129

SEQ ID NO: 453447 - RNA, 64 nt, Human; identical to SEQ ID NO: 450130

SEQ ID NO: 453448 - RNA, 64 nt, Human; identical to SEQ ID NO: 450131

SEQ ID NO: 453449 - RNA, 64 nt, Human; identical to SEQ ID NO: 450132

SEQ ID NO: 453450 - RNA, 64 nt, Human; identical to SEQ ID NO: 450133

SEQ ID NO: 453451 - RNA, 64 nt, Human; identical to SEQ ID NO: 450134

SEQ ID NO: 453452 - RNA, 64 nt, Human; identical to SEQ ID NO: 450135

SEQ ID NO: 453453 - RNA, 64 nt, Human; identical to SEQ ID NO: 450136

SEQ ID NO: 453454 - RNA, 64 nt, Human; identical to SEQ ID NO: 450137

SEQ ID NO: 453455 - RNA, 64 nt, Human; identical to SEQ ID NO: 450138

SEQ ID NO: 453456 - RNA, 64 nt, Human; identical to SEQ ID NO: 185554

SEQ ID NO: 453457 - RNA, 64 nt, Human; identical to SEQ ID NO: 185555

SEQ ID NO: 453458 - RNA, 64 nt, Human; identical to SEQ ID NO: 185556

SEQ ID NO: 453459 - RNA, 64 nt, Human; identical to SEQ ID NO: 450139

SEQ ID NO: 453460 - RNA, 64 nt, Human; identical to SEQ ID NO: 450140

SEQ ID NO: 453461 - RNA, 64 nt, Human; identical to SEQ ID NO: 450144

SEQ ID NO: 453462 - RNA, 64 nt, Human; identical to SEQ ID NO: 450145

SEQ ID NO: 453463 - RNA, 64 nt, Human; identical to SEQ ID NO: 450146

SEQ ID NO: 453464 - RNA, 64 nt, Human; identical to SEQ ID NO: 450147

SEQ ID NO: 453465 - RNA, 64 nt, Human; identical to SEQ ID NO: 450148

SEQ ID NO: 453466 - RNA, 64 nt, Human; identical to SEQ ID NO: 450149

SEQ ID NO: 453467 - RNA, 64 nt, Human; identical to SEQ ID NO: 450150

SEQ ID NO: 453468 - RNA, 64 nt, Human; identical to SEQ ID NO: 450151

SEQ ID NO: 453469 - RNA, 64 nt, Human; identical to SEQ ID NO: 450152

SEQ ID NO: 453470 - RNA, 64 nt, Human; identical to SEQ ID NO: 450153

SEQ ID NO: 453471 - RNA, 64 nt, Human; identical to SEQ ID NO: 450154

SEQ ID NO: 453472 - RNA, 64 nt, Human; identical to SEQ ID NO: 450155

SEQ ID NO: 453473 - RNA, 64 nt, Human; identical to SEQ ID NO: 450156

SEQ ID NO: 453474 - RNA, 64 nt, Human; identical to SEQ ID NO: 129893

SEQ ID NO: 453475 - RNA, 61 nt, Human; identical to SEQ ID NO: 185364

SEQ ID NO: 453476 - RNA, 64 nt, Human; identical to SEQ ID NO: 185365

SEQ ID NO: 453477 - RNA, 64 nt, Human; identical to SEQ ID NO: 450157

SEQ ID NO: 453478 - RNA, 64 nt, Human; identical to SEQ ID NO: 450158

SEQ ID NO: 453479 - RNA, 51 nt, Human; identical to SEQ ID NO: 381423

SEQ ID NO: 453480 - RNA, 64 nt, Human; identical to SEQ ID NO: 450163

SEQ ID NO: 453481 - RNA, 64 nt, Human; identical to SEQ ID NO: 450164

SEQ ID NO: 453482 - RNA, 64 nt, Human; identical to SEQ ID NO: 450165

SEQ ID NO: 453483 - RNA, 64 nt, Human; identical to SEQ ID NO: 450166

SEQ ID NO: 453484 - RNA, 64 nt, Human; identical to SEQ ID NO: 450167

SEQ ID NO: 453485 - RNA, 64 nt, Human; identical to SEQ ID NO: 450168

SEQ ID NO: 453486 - RNA, 64 nt, Human; identical to SEQ ID NO: 450169

SEQ ID NO: 453487 - RNA, 64 nt, Human; identical to SEQ ID NO: 450170

SEQ ID NO: 453488 - RNA, 64 nt, Human; identical to SEQ ID NO: 450171

SEQ ID NO: 453489 - RNA, 64 nt, Human; identical to SEQ ID NO: 450172

SEQ ID NO: 453490 - RNA, 64 nt, Human; identical to SEQ ID NO: 450173

SEQ ID NO: 453491 - RNA, 64 nt, Human; identical to SEQ ID NO: 450174

SEQ ID NO: 453492 - RNA, 64 nt, Human; identical to SEQ ID NO: 111690

SEQ ID NO: 453493 - RNA, 64 nt, Human; identical to SEQ ID NO: 129606

SEQ ID NO: 453494 - RNA, 64 nt, Human; identical to SEQ ID NO: 185592

SEQ ID NO: 453495 - RNA, 64 nt, Human; identical to SEQ ID NO: 450175

SEQ ID NO: 453496 - RNA, 64 nt, Human; identical to SEQ ID NO: 450176

SEQ ID NO: 453497 - RNA, 64 nt, Human; identical to SEQ ID NO: 450180

SEQ ID NO: 453498 - RNA, 64 nt, Human; identical to SEQ ID NO: 450181

SEQ ID NO: 453499 - RNA, 64 nt, Human; identical to SEQ ID NO: 450182

SEQ ID NO: 453500 - RNA, 64 nt, Human; identical to SEQ ID NO: 450183

SEQ ID NO: 453501 - RNA, 56 nt, Human; identical to SEQ ID NO: 381440

SEQ ID NO: 453502 - RNA, 64 nt, Human; identical to SEQ ID NO: 450185

SEQ ID NO: 453503 - RNA, 64 nt, Human; identical to SEQ ID NO: 450186

SEQ ID NO: 453504 - RNA, 64 nt, Human; identical to SEQ ID NO: 450187

SEQ ID NO: 453505 - RNA, 64 nt, Human; identical to SEQ ID NO: 450188

SEQ ID NO: 453506 - RNA, 64 nt, Human; identical to SEQ ID NO: 450189

SEQ ID NO: 453507 - RNA, 64 nt, Human; identical to SEQ ID NO: 450190

SEQ ID NO: 453508 - RNA, 64 nt, Human; identical to SEQ ID NO: 450191

SEQ ID NO: 453509 - RNA, 64 nt, Human; identical to SEQ ID NO: 450192

SEQ ID NO: 453510 - RNA, 64 nt, Human; identical to SEQ ID NO: 185593

SEQ ID NO: 453511 - RNA, 64 nt, Human; identical to SEQ ID NO: 185594

SEQ ID NO: 453512 - RNA, 64 nt, Human; identical to SEQ ID NO: 12063

SEQ ID NO: 453513 - RNA, 64 nt, Human; identical to SEQ ID NO: 450193

SEQ ID NO: 453514 - RNA, 64 nt, Human; identical to SEQ ID NO: 450194

SEQ ID NO: 453515 - RNA, 64 nt, Human; identical to SEQ ID NO: 450196

SEQ ID NO: 453516 - RNA, 64 nt, Human; identical to SEQ ID NO: 450197

SEQ ID NO: 453517 - RNA, 64 nt, Human; identical to SEQ ID NO: 450198

SEQ ID NO: 453518 - RNA, 64 nt, Human; identical to SEQ ID NO: 450199

SEQ ID NO: 453519 - RNA, 53 nt, Human; identical to SEQ ID NO: 381453

SEQ ID NO: 453520 - RNA, 64 nt, Human; identical to SEQ ID NO: 450201

SEQ ID NO: 453521 - RNA, 64 nt, Human; identical to SEQ ID NO: 450202

SEQ ID NO: 453522 - RNA, 64 nt, Human; identical to SEQ ID NO: 450203

SEQ ID NO: 453523 - RNA, 53 nt, Human; identical to SEQ ID NO: 381459

SEQ ID NO: 453524 - RNA, 64 nt, Human; identical to SEQ ID NO: 450205

SEQ ID NO: 453525 - RNA, 64 nt, Human; identical to SEQ ID NO: 450206

SEQ ID NO: 453526 - RNA, 64 nt, Human; identical to SEQ ID NO: 450207

SEQ ID NO: 453527 - RNA, 64 nt, Human; identical to SEQ ID NO: 450208

SEQ ID NO: 453528 - RNA, 64 nt, Human; identical to SEQ ID NO: 129623

SEQ ID NO: 453529 - RNA, 64 nt, Human; identical to SEQ ID NO: 185630

SEQ ID NO: 453530 - RNA, 64 nt, Human; identical to SEQ ID NO: 185631

SEQ ID NO: 453531 - RNA, 64 nt, Human; identical to SEQ ID NO: 450209

SEQ ID NO: 453532 - RNA, 64 nt, Human; identical to SEQ ID NO: 450210

SEQ ID NO: 453533 - RNA, 64 nt, Human; identical to SEQ ID NO: 450213

SEQ ID NO: 453534 - RNA, 64 nt, Human; identical to SEQ ID NO: 450214

SEQ ID NO: 453535 - RNA, 64 nt, Human; identical to SEQ ID NO: 450215

SEQ ID NO: 453536 - RNA, 64 nt, Human; identical to SEQ ID NO: 450216

SEQ ID NO: 453537 - RNA, 64 nt, Human; identical to SEQ ID NO: 450217

SEQ ID NO: 453538 - RNA, 64 nt, Human; identical to SEQ ID NO: 450218

SEQ ID NO: 453539 - RNA, 64 nt, Human; identical to SEQ ID NO: 450219

SEQ ID NO: 453540 - RNA, 64 nt, Human; identical to SEQ ID NO: 450220

SEQ ID NO: 453541 - RNA, 64 nt, Human; identical to SEQ ID NO: 450221

SEQ ID NO: 453542 - RNA, 64 nt, Human; identical to SEQ ID NO: 450222

SEQ ID NO: 453543 - RNA, 64 nt, Human; identical to SEQ ID NO: 450223

SEQ ID NO: 453544 - RNA, 64 nt, Human; identical to SEQ ID NO: 450224

SEQ ID NO: 453545 - RNA, 64 nt, Human; identical to SEQ ID NO: 450225

SEQ ID NO: 453546 - RNA, 64 nt, Human; identical to SEQ ID NO: 185632

SEQ ID NO: 453547 - RNA, 64 nt, Human; identical to SEQ ID NO: 36903

SEQ ID NO: 453548 - RNA, 64 nt, Human; identical to SEQ ID NO: 102967

SEQ ID NO: 453549 - RNA, 64 nt, Human; identical to SEQ ID NO: 450226

SEQ ID NO: 453550 - RNA, 64 nt, Human; identical to SEQ ID NO: 450227

SEQ ID NO: 453551 - RNA, 64 nt, Human; identical to SEQ ID NO: 450231

SEQ ID NO: 453552 - RNA, 64 nt, Human; identical to SEQ ID NO: 450232

SEQ ID NO: 453553 - RNA, 64 nt, Human; identical to SEQ ID NO: 450233

SEQ ID NO: 453554 - RNA, 64 nt, Human; identical to SEQ ID NO: 450234

SEQ ID NO: 453555 - RNA, 64 nt, Human; identical to SEQ ID NO: 450235

SEQ ID NO: 453556 - RNA, 64 nt, Human; identical to SEQ ID NO: 450236

SEQ ID NO: 453557 - RNA, 64 nt, Human; identical to SEQ ID NO: 450237

SEQ ID NO: 453558 - RNA, 64 nt, Human; identical to SEQ ID NO: 450238

SEQ ID NO: 453559 - RNA, 64 nt, Human; identical to SEQ ID NO: 450239

SEQ ID NO: 453560 - RNA, 64 nt, Human; identical to SEQ ID NO: 450240

SEQ ID NO: 453561 - RNA, 64 nt, Human; identical to SEQ ID NO: 450241

SEQ ID NO: 453562 - RNA, 64 nt, Human; identical to SEQ ID NO: 450242

SEQ ID NO: 453563 - RNA, 64 nt, Human; identical to SEQ ID NO: 450243

SEQ ID NO: 453564 - RNA, 64 nt, Human; identical to SEQ ID NO: 179964

SEQ ID NO: 453565 - RNA, 64 nt, Human; identical to SEQ ID NO: 36922

SEQ ID NO: 453566 - RNA, 60 nt, Human; identical to SEQ ID NO: 103020

SEQ ID NO: 453567 - RNA, 64 nt, Human; identical to SEQ ID NO: 450244

SEQ ID NO: 453568 - RNA, 64 nt, Human; identical to SEQ ID NO: 450245

SEQ ID NO: 453569 - RNA, 64 nt, Human; identical to SEQ ID NO: 450249

SEQ ID NO: 453570 - RNA, 64 nt, Human; identical to SEQ ID NO: 450250

SEQ ID NO: 453571 - RNA, 64 nt, Human; identical to SEQ ID NO: 450251

SEQ ID NO: 453572 - RNA, 64 nt, Human; identical to SEQ ID NO: 450252

SEQ ID NO: 453573 - RNA, 64 nt, Human; identical to SEQ ID NO: 450253

SEQ ID NO: 453574 - RNA, 64 nt, Human; identical to SEQ ID NO: 450254

SEQ ID NO: 453575 - RNA, 64 nt, Human; identical to SEQ ID NO: 450255

SEQ ID NO: 453576 - RNA, 64 nt, Human; identical to SEQ ID NO: 450256

SEQ ID NO: 453577 - RNA, 64 nt, Human; identical to SEQ ID NO: 450257

SEQ ID NO: 453578 - RNA, 64 nt, Human; identical to SEQ ID NO: 450258

SEQ ID NO: 453579 - RNA, 64 nt, Human; identical to SEQ ID NO: 450259

SEQ ID NO: 453580 - RNA, 64 nt, Human; identical to SEQ ID NO: 450260

SEQ ID NO: 453581 - RNA, 64 nt, Human; identical to SEQ ID NO: 450261

SEQ ID NO: 453582 - RNA, 64 nt, Human; identical to SEQ ID NO: 129673

SEQ ID NO: 453583 - RNA, 64 nt, Human; identical to SEQ ID NO: 185279

SEQ ID NO: 453584 - RNA, 60 nt, Human; identical to SEQ ID NO: 185280

SEQ ID NO: 453585 - RNA, 64 nt, Human; identical to SEQ ID NO: 450262

SEQ ID NO: 453586 - RNA, 64 nt, Human; identical to SEQ ID NO: 450263

SEQ ID NO: 453587 - RNA, 64 nt, Human; identical to SEQ ID NO: 450267

SEQ ID NO: 453588 - RNA, 64 nt, Human; identical to SEQ ID NO: 450268

SEQ ID NO: 453589 - RNA, 64 nt, Human; identical to SEQ ID NO: 450269

SEQ ID NO: 453590 - RNA, 64 nt, Human; identical to SEQ ID NO: 450270

SEQ ID NO: 453591 - RNA, 64 nt, Human; identical to SEQ ID NO: 450271

SEQ ID NO: 453592 - RNA, 64 nt, Human; identical to SEQ ID NO: 450272

SEQ ID NO: 453593 - RNA, 64 nt, Human; identical to SEQ ID NO: 450273

SEQ ID NO: 453594 - RNA, 64 nt, Human; identical to SEQ ID NO: 450274

SEQ ID NO: 453595 - RNA, 64 nt, Human; identical to SEQ ID NO: 450275

SEQ ID NO: 453596 - RNA, 64 nt, Human; identical to SEQ ID NO: 450276

SEQ ID NO: 453597 - RNA, 64 nt, Human; identical to SEQ ID NO: 450277

SEQ ID NO: 453598 - RNA, 64 nt, Human; identical to SEQ ID NO: 450278

SEQ ID NO: 453599 - RNA, 64 nt, Human; identical to SEQ ID NO: 450279

SEQ ID NO: 453600 - RNA, 64 nt, Human; identical to SEQ ID NO: 64134

SEQ ID NO: 453601 - RNA, 64 nt, Human; identical to SEQ ID NO: 64135

SEQ ID NO: 453602 - RNA, 64 nt, Human; identical to SEQ ID NO: 64136

SEQ ID NO: 453603 - RNA, 64 nt, Human; identical to SEQ ID NO: 450280

SEQ ID NO: 453604 - RNA, 64 nt, Human; identical to SEQ ID NO: 450281

SEQ ID NO: 453605 - RNA, 64 nt, Human; identical to SEQ ID NO: 450285

SEQ ID NO: 453606 - RNA, 64 nt, Human; identical to SEQ ID NO: 450286

SEQ ID NO: 453607 - RNA, 64 nt, Human; identical to SEQ ID NO: 450287

SEQ ID NO: 453608 - RNA, 64 nt, Human; identical to SEQ ID NO: 450288

SEQ ID NO: 453609 - RNA, 64 nt, Human; identical to SEQ ID NO: 450289

SEQ ID NO: 453610 - RNA, 64 nt, Human; identical to SEQ ID NO: 450290

SEQ ID NO: 453611 - RNA, 64 nt, Human; identical to SEQ ID NO: 450291

SEQ ID NO: 453612 - RNA, 64 nt, Human; identical to SEQ ID NO: 450292

SEQ ID NO: 453613 - RNA, 64 nt, Human; identical to SEQ ID NO: 450293

SEQ ID NO: 453614 - RNA, 64 nt, Human; identical to SEQ ID NO: 450294

SEQ ID NO: 453615 - RNA, 64 nt, Human; identical to SEQ ID NO: 450295

SEQ ID NO: 453616 - RNA, 64 nt, Human; identical to SEQ ID NO: 450296

SEQ ID NO: 453617 - RNA, 64 nt, Human; identical to SEQ ID NO: 450297

SEQ ID NO: 453618 - RNA, 64 nt, Human; identical to SEQ ID NO: 36983

SEQ ID NO: 453619 - RNA, 64 nt, Human; identical to SEQ ID NO: 103073

SEQ ID NO: 453620 - RNA, 64 nt, Human; identical to SEQ ID NO: 129690

SEQ ID NO: 453621 - RNA, 64 nt, Human; identical to SEQ ID NO: 450298

SEQ ID NO: 453622 - RNA, 64 nt, Human; identical to SEQ ID NO: 450299

SEQ ID NO: 453623 - RNA, 64 nt, Human; identical to SEQ ID NO: 450303

SEQ ID NO: 453624 - RNA, 64 nt, Human; identical to SEQ ID NO: 450304

SEQ ID NO: 453625 - RNA, 64 nt, Human; identical to SEQ ID NO: 450305

SEQ ID NO: 453626 - RNA, 64 nt, Human; identical to SEQ ID NO: 450306

SEQ ID NO: 453627 - RNA, 64 nt, Human; identical to SEQ ID NO: 450307

SEQ ID NO: 453628 - RNA, 64 nt, Human; identical to SEQ ID NO: 450308

SEQ ID NO: 453629 - RNA, 64 nt, Human; identical to SEQ ID NO: 450309

SEQ ID NO: 453630 - RNA, 64 nt, Human; identical to SEQ ID NO: 450310

SEQ ID NO: 453631 - RNA, 64 nt, Human; identical to SEQ ID NO: 450311

SEQ ID NO: 453632 - RNA, 64 nt, Human; identical to SEQ ID NO: 450312

SEQ ID NO: 453633 - RNA, 64 nt, Human; identical to SEQ ID NO: 450313

SEQ ID NO: 453634 - RNA, 64 nt, Human; identical to SEQ ID NO: 450314

SEQ ID NO: 453635 - RNA, 64 nt, Human; identical to SEQ ID NO: 450315

SEQ ID NO: 453636 - RNA, 64 nt, Human; identical to SEQ ID NO: 185345

SEQ ID NO: 453637 - RNA, 64 nt, Human; identical to SEQ ID NO: 185346

SEQ ID NO: 453638 - RNA, 64 nt, Human; identical to SEQ ID NO: 185347

SEQ ID NO: 453639 - RNA, 64 nt, Human; identical to SEQ ID NO: 450316

SEQ ID NO: 453640 - RNA, 64 nt, Human; identical to SEQ ID NO: 450317

SEQ ID NO: 453641 - RNA, 64 nt, Human; identical to SEQ ID NO: 450321

SEQ ID NO: 453642 - RNA, 64 nt, Human; identical to SEQ ID NO: 450322

SEQ ID NO: 453643 - RNA, 64 nt, Human; identical to SEQ ID NO: 450323

SEQ ID NO: 453644 - RNA, 64 nt, Human; identical to SEQ ID NO: 450324

SEQ ID NO: 453645 - RNA, 64 nt, Human; identical to SEQ ID NO: 450325

SEQ ID NO: 453646 - RNA, 64 nt, Human; identical to SEQ ID NO: 450326

SEQ ID NO: 453647 - RNA, 64 nt, Human; identical to SEQ ID NO: 450327

SEQ ID NO: 453648 - RNA, 64 nt, Human; identical to SEQ ID NO: 450328

SEQ ID NO: 453649 - RNA, 64 nt, Human; identical to SEQ ID NO: 450329

SEQ ID NO: 453650 - RNA, 64 nt, Human; identical to SEQ ID NO: 450330

SEQ ID NO: 453651 - RNA, 64 nt, Human; identical to SEQ ID NO: 450331

SEQ ID NO: 453652 - RNA, 64 nt, Human; identical to SEQ ID NO: 450332

SEQ ID NO: 453653 - RNA, 64 nt, Human; identical to SEQ ID NO: 450333

SEQ ID NO: 453654 - RNA, 64 nt, Human; identical to SEQ ID NO: 103126

SEQ ID NO: 453655 - RNA, 64 nt, Human; identical to SEQ ID NO: 129707

SEQ ID NO: 453656 - RNA, 64 nt, Human; identical to SEQ ID NO: 185383

SEQ ID NO: 453657 - RNA, 64 nt, Human; identical to SEQ ID NO: 450334

SEQ ID NO: 453658 - RNA, 64 nt, Human; identical to SEQ ID NO: 450335

SEQ ID NO: 453659 - RNA, 64 nt, Human; identical to SEQ ID NO: 450339

SEQ ID NO: 453660 - RNA, 64 nt, Human; identical to SEQ ID NO: 450340

SEQ ID NO: 453661 - RNA, 64 nt, Human; identical to SEQ ID NO: 450341

SEQ ID NO: 453662 - RNA, 64 nt, Human; identical to SEQ ID NO: 450342

SEQ ID NO: 453663 - RNA, 64 nt, Human; identical to SEQ ID NO: 450343

SEQ ID NO: 453664 - RNA, 64 nt, Human; identical to SEQ ID NO: 450344

SEQ ID NO: 453665 - RNA, 64 nt, Human; identical to SEQ ID NO: 450345

SEQ ID NO: 453666 - RNA, 64 nt, Human; identical to SEQ ID NO: 450346

SEQ ID NO: 453667 - RNA, 64 nt, Human; identical to SEQ ID NO: 450347

SEQ ID NO: 453668 - RNA, 64 nt, Human; identical to SEQ ID NO: 450348

SEQ ID NO: 453669 - RNA, 64 nt, Human; identical to SEQ ID NO: 450349

SEQ ID NO: 453670 - RNA, 64 nt, Human; identical to SEQ ID NO: 450350

SEQ ID NO: 453671 - RNA, 64 nt, Human; identical to SEQ ID NO: 450351

SEQ ID NO: 453672 - RNA, 64 nt, Human; identical to SEQ ID NO: 135838

SEQ ID NO: 453673 - RNA, 64 nt, Human; identical to SEQ ID NO: 135839

SEQ ID NO: 453674 - RNA, 64 nt, Human; identical to SEQ ID NO: 135840

SEQ ID NO: 453675 - RNA, 64 nt, Human; identical to SEQ ID NO: 450352

SEQ ID NO: 453676 - RNA, 64 nt, Human; identical to SEQ ID NO: 450353

SEQ ID NO: 453677 - RNA, 64 nt, Human; identical to SEQ ID NO: 450357

SEQ ID NO: 453678 - RNA, 64 nt, Human; identical to SEQ ID NO: 450358

SEQ ID NO: 453679 - RNA, 64 nt, Human; identical to SEQ ID NO: 450359

SEQ ID NO: 453680 - RNA, 64 nt, Human; identical to SEQ ID NO: 450360

SEQ ID NO: 453681 - RNA, 64 nt, Human; identical to SEQ ID NO: 450361

SEQ ID NO: 453682 - RNA, 64 nt, Human; identical to SEQ ID NO: 450362

SEQ ID NO: 453683 - RNA, 64 nt, Human; identical to SEQ ID NO: 450363

SEQ ID NO: 453684 - RNA, 64 nt, Human; identical to SEQ ID NO: 450364

SEQ ID NO: 453685 - RNA, 64 nt, Human; identical to SEQ ID NO: 450365

SEQ ID NO: 453686 - RNA, 64 nt, Human; identical to SEQ ID NO: 450366

SEQ ID NO: 453687 - RNA, 64 nt, Human; identical to SEQ ID NO: 450367

SEQ ID NO: 453688 - RNA, 64 nt, Human; identical to SEQ ID NO: 450368

SEQ ID NO: 453689 - RNA, 64 nt, Human; identical to SEQ ID NO: 450369

SEQ ID NO: 453690 - RNA, 64 nt, Human; identical to SEQ ID NO: 135834

SEQ ID NO: 453691 - RNA, 64 nt, Human; identical to SEQ ID NO: 135835

SEQ ID NO: 453692 - RNA, 64 nt, Human; identical to SEQ ID NO: 135836

SEQ ID NO: 453693 - RNA, 64 nt, Human; identical to SEQ ID NO: 450370

SEQ ID NO: 453694 - RNA, 64 nt, Human; identical to SEQ ID NO: 450371

SEQ ID NO: 453695 - RNA, 64 nt, Human; identical to SEQ ID NO: 450375

SEQ ID NO: 453696 - RNA, 64 nt, Human; identical to SEQ ID NO: 450376

SEQ ID NO: 453697 - RNA, 64 nt, Human; identical to SEQ ID NO: 450377

SEQ ID NO: 453698 - RNA, 58 nt, Human; identical to SEQ ID NO: 381604

SEQ ID NO: 453699 - RNA, 64 nt, Human; identical to SEQ ID NO: 450379

SEQ ID NO: 453700 - RNA, 64 nt, Human; identical to SEQ ID NO: 450380

SEQ ID NO: 453701 - RNA, 64 nt, Human; identical to SEQ ID NO: 450381

SEQ ID NO: 453702 - RNA, 64 nt, Human; identical to SEQ ID NO: 450382

SEQ ID NO: 453703 - RNA, 64 nt, Human; identical to SEQ ID NO: 450383

SEQ ID NO: 453704 - RNA, 64 nt, Human; identical to SEQ ID NO: 450384

SEQ ID NO: 453705 - RNA, 64 nt, Human; identical to SEQ ID NO: 450384

SEQ ID NO: 453706 - RNA, 64 nt, Human; identical to SEQ ID NO: 450386

SEQ ID NO: 453707 - RNA, 64 nt, Human; identical to SEQ ID NO: 450387

SEQ ID NO: 453708 - RNA, 59 nt, Human; identical to SEQ ID NO: 135841

SEQ ID NO: 453709 - RNA, 64 nt, Human; identical to SEQ ID NO: 135842

SEQ ID NO: 453710 - RNA, 64 nt, Human; identical to SEQ ID NO: 135843

SEQ ID NO: 453711 - RNA, 64 nt, Human; identical to SEQ ID NO: 450388

SEQ ID NO: 453712 - RNA, 64 nt, Human; identical to SEQ ID NO: 450389

SEQ ID NO: 453713 - RNA, 64 nt, Human; identical to SEQ ID NO: 450393

SEQ ID NO: 453714 - RNA, 64 nt, Human; identical to SEQ ID NO: 450394

SEQ ID NO: 453715 - RNA, 64 nt, Human; identical to SEQ ID NO: 450395

SEQ ID NO: 453716 - RNA, 64 nt, Human; identical to SEQ ID NO: 450396

SEQ ID NO: 453717 - RNA, 64 nt, Human; identical to SEQ ID NO: 450397

SEQ ID NO: 453718 - RNA, 64 nt, Human; identical to SEQ ID NO: 450398

SEQ ID NO: 453719 - RNA, 64 nt, Human; identical to SEQ ID NO: 450399

SEQ ID NO: 453720 - RNA, 64 nt, Human; identical to SEQ ID NO: 450400

SEQ ID NO: 453721 - RNA, 64 nt, Human; identical to SEQ ID NO: 450401

SEQ ID NO: 453722 - RNA, 64 nt, Human; identical to SEQ ID NO: 450402

SEQ ID NO: 453723 - RNA, 64 nt, Human; identical to SEQ ID NO: 450403

SEQ ID NO: 453724 - RNA, 64 nt, Human; identical to SEQ ID NO: 450404

SEQ ID NO: 453725 - RNA, 64 nt, Human; identical to SEQ ID NO: 450405

SEQ ID NO: 453726 - RNA, 64 nt, Human; identical to SEQ ID NO: 135845

SEQ ID NO: 453727 - RNA, 64 nt, Human; identical to SEQ ID NO: 135846

SEQ ID NO: 453728 - RNA, 59 nt, Human; identical to SEQ ID NO: 135847

SEQ ID NO: 453729 - RNA, 64 nt, Human; identical to SEQ ID NO: 450406

SEQ ID NO: 453730 - RNA, 64 nt, Human; identical to SEQ ID NO: 450407

SEQ ID NO: 453731 - RNA, 64 nt, Human; identical to SEQ ID NO: 450411

SEQ ID NO: 453732 - RNA, 64 nt, Human; identical to SEQ ID NO: 450412

SEQ ID NO: 453733 - RNA, 64 nt, Human; identical to SEQ ID NO: 450413

SEQ ID NO: 453734 - RNA, 64 nt, Human; identical to SEQ ID NO: 450414

SEQ ID NO: 453735 - RNA, 64 nt, Human; identical to SEQ ID NO: 450415

SEQ ID NO: 453736 - RNA, 64 nt, Human; identical to SEQ ID NO: 450416

SEQ ID NO: 453737 - RNA, 64 nt, Human; identical to SEQ ID NO: 450417

SEQ ID NO: 453738 - RNA, 64 nt, Human; identical to SEQ ID NO: 450418

SEQ ID NO: 453739 - RNA, 64 nt, Human; identical to SEQ ID NO: 450419

SEQ ID NO: 453740 - RNA, 64 nt, Human; identical to SEQ ID NO: 450420

SEQ ID NO: 453741 - RNA, 64 nt, Human; identical to SEQ ID NO: 450421

SEQ ID NO: 453742 - RNA, 64 nt, Human; identical to SEQ ID NO: 450422

SEQ ID NO: 453743 - RNA, 64 nt, Human; identical to SEQ ID NO: 450423

SEQ ID NO: 453744 - RNA, 64 nt, Human; identical to SEQ ID NO: 135848

SEQ ID NO: 453745 - RNA, 64 nt, Human; identical to SEQ ID NO: 135849

SEQ ID NO: 453746 - RNA, 64 nt, Human; identical to SEQ ID NO: 135850

SEQ ID NO: 453747 - RNA, 64 nt, Human; identical to SEQ ID NO: 450424

SEQ ID NO: 453748 - RNA, 64 nt, Human; identical to SEQ ID NO: 450425

SEQ ID NO: 453749 - RNA, 64 nt, Human; identical to SEQ ID NO: 450429

SEQ ID NO: 453750 - RNA, 64 nt, Human; identical to SEQ ID NO: 450430

SEQ ID NO: 453751 - RNA, 64 nt, Human; identical to SEQ ID NO: 450431

SEQ ID NO: 453752 - RNA, 64 nt, Human; identical to SEQ ID NO: 450432

SEQ ID NO: 453753 - RNA, 64 nt, Human; identical to SEQ ID NO: 450433

SEQ ID NO: 453754 - RNA, 64 nt, Human; identical to SEQ ID NO: 450434

SEQ ID NO: 453755 - RNA, 64 nt, Human; identical to SEQ ID NO: 450435

SEQ ID NO: 453756 - RNA, 64 nt, Human; identical to SEQ ID NO: 450436

SEQ ID NO: 453757 - RNA, 64 nt, Human; identical to SEQ ID NO: 449614

SEQ ID NO: 453758 - RNA, 64 nt, Human; identical to SEQ ID NO: 449615

SEQ ID NO: 453759 - RNA, 54 nt, Human; identical to SEQ ID NO: 380960

SEQ ID NO: 453760 - RNA, 64 nt, Human; identical to SEQ ID NO: 185384

SEQ ID NO: 453761 - RNA, 64 nt, Human; identical to SEQ ID NO: 185385

SEQ ID NO: 453762 - RNA, 64 nt, Human; identical to SEQ ID NO: 449617

SEQ ID NO: 453763 - RNA, 64 nt, Human; identical to SEQ ID NO: 449618

SEQ ID NO: 453764 - RNA, 64 nt, Human; identical to SEQ ID NO: 449619

SEQ ID NO: 453765 - RNA, 64 nt, Human; identical to SEQ ID NO: 449620

SEQ ID NO: 453766 - RNA, 64 nt, Human; identical to SEQ ID NO: 449621

SEQ ID NO: 453767 - RNA, 64 nt, Human; identical to SEQ ID NO: 449622

SEQ ID NO: 453768 - RNA, 64 nt, Human; identical to SEQ ID NO: 449623

SEQ ID NO: 453769 - RNA, 64 nt, Human; identical to SEQ ID NO: 449624

SEQ ID NO: 453770 - RNA, 64 nt, Human; identical to SEQ ID NO: 449625

SEQ ID NO: 453771 - RNA, 64 nt, Human; identical to SEQ ID NO: 449626

SEQ ID NO: 453772 - RNA, 64 nt, Human; identical to SEQ ID NO: 449630

SEQ ID NO: 453773 - RNA, 64 nt, Human; identical to SEQ ID NO: 449631

SEQ ID NO: 453774 - RNA, 64 nt, Human; identical to SEQ ID NO: 449632

SEQ ID NO: 453775 - RNA, 64 nt, Human; identical to SEQ ID NO: 449633

SEQ ID NO: 453776 - RNA, 64 nt, Human; identical to SEQ ID NO: 449634

SEQ ID NO: 453777 - RNA, 64 nt, Human; identical to SEQ ID NO: 135852

SEQ ID NO: 453778 - RNA, 64 nt, Human; identical to SEQ ID NO: 135853

SEQ ID NO: 453779 - RNA, 64 nt, Human; identical to SEQ ID NO: 135854

SEQ ID NO: 453780 - RNA, 64 nt, Human; identical to SEQ ID NO: 449635

SEQ ID NO: 453781 - RNA, 64 nt, Human; identical to SEQ ID NO: 449636

SEQ ID NO: 453782 - RNA, 64 nt, Human; identical to SEQ ID NO: 449637

SEQ ID NO: 453783 - RNA, 64 nt, Human; identical to SEQ ID NO: 449638

SEQ ID NO: 453784 - RNA, 64 nt, Human; identical to SEQ ID NO: 449639

SEQ ID NO: 453785 - RNA, 64 nt, Human; identical to SEQ ID NO: 449640

SEQ ID NO: 453786 - RNA, 64 nt, Human; identical to SEQ ID NO: 449641

SEQ ID NO: 453787 - RNA, 64 nt, Human; identical to SEQ ID NO: 449642

SEQ ID NO: 453788 - RNA, 64 nt, Human; identical to SEQ ID NO: 449643

SEQ ID NO: 453789 - RNA, 64 nt, Human; identical to SEQ ID NO: 449644

SEQ ID NO: 453790 - RNA, 64 nt, Human; identical to SEQ ID NO: 449648

SEQ ID NO: 453791 - RNA, 64 nt, Human; identical to SEQ ID NO: 449649

SEQ ID NO: 453792 - RNA, 64 nt, Human; identical to SEQ ID NO: 449650

SEQ ID NO: 453793 - RNA, 64 nt, Human; identical to SEQ ID NO: 449651

SEQ ID NO: 453794 - RNA, 64 nt, Human; identical to SEQ ID NO: 449652

SEQ ID NO: 453795 - RNA, 64 nt, Human; identical to SEQ ID NO: 135855

SEQ ID NO: 453796 - RNA, 64 nt, Human; identical to SEQ ID NO: 135856

SEQ ID NO: 453797 - RNA, 64 nt, Human; identical to SEQ ID NO: 135857

SEQ ID NO: 453798 - RNA, 64 nt, Human; identical to SEQ ID NO: 449653

SEQ ID NO: 453799 - RNA, 64 nt, Human; identical to SEQ ID NO: 449654

SEQ ID NO: 453800 - RNA, 64 nt, Human; identical to SEQ ID NO: 449655

SEQ ID NO: 453801 - RNA, 64 nt, Human; identical to SEQ ID NO: 449656

SEQ ID NO: 453802 - RNA, 64 nt, Human; identical to SEQ ID NO: 449657

SEQ ID NO: 453803 - RNA, 64 nt, Human; identical to SEQ ID NO: 449658

SEQ ID NO: 453804 - RNA, 64 nt, Human; identical to SEQ ID NO: 449659

SEQ ID NO: 453805 - RNA, 64 nt, Human; identical to SEQ ID NO: 449660

SEQ ID NO: 453806 - RNA, 64 nt, Human; identical to SEQ ID NO: 449661

SEQ ID NO: 453807 - RNA, 64 nt, Human; identical to SEQ ID NO: 449662

SEQ ID NO: 453808 - RNA, 64 nt, Human; identical to SEQ ID NO: 449666

SEQ ID NO: 453809 - RNA, 64 nt, Human; identical to SEQ ID NO: 449667

SEQ ID NO: 453810 - RNA, 64 nt, Human; identical to SEQ ID NO: 449668

SEQ ID NO: 453811 - RNA, 64 nt, Human; identical to SEQ ID NO: 449669

SEQ ID NO: 453812 - RNA, 64 nt, Human; identical to SEQ ID NO: 449670

SEQ ID NO: 453813 - RNA, 64 nt, Human; identical to SEQ ID NO: 135859

SEQ ID NO: 453814 - RNA, 64 nt, Human; identical to SEQ ID NO: 135860

SEQ ID NO: 453815 - RNA, 64 nt, Human; identical to SEQ ID NO: 135861

SEQ ID NO: 453816 - RNA, 64 nt, Human; identical to SEQ ID NO: 449671

SEQ ID NO: 453817 - RNA, 64 nt, Human; identical to SEQ ID NO: 449672

SEQ ID NO: 453818 - RNA, 64 nt, Human; identical to SEQ ID NO: 449673

SEQ ID NO: 453819 - RNA, 64 nt, Human; identical to SEQ ID NO: 449674

SEQ ID NO: 453820 - RNA, 64 nt, Human; identical to SEQ ID NO: 449675

SEQ ID NO: 453821 - RNA, 64 nt, Human; identical to SEQ ID NO: 449676

SEQ ID NO: 453822 - RNA, 64 nt, Human; identical to SEQ ID NO: 449677

SEQ ID NO: 453823 - RNA, 64 nt, Human; identical to SEQ ID NO: 449678

SEQ ID NO: 453824 - RNA, 64 nt, Human; identical to SEQ ID NO: 449679

SEQ ID NO: 453825 - RNA, 64 nt, Human; identical to SEQ ID NO: 449680

SEQ ID NO: 453826 - RNA, 64 nt, Human; identical to SEQ ID NO: 449684

SEQ ID NO: 453827 - RNA, 64 nt, Human; identical to SEQ ID NO: 449685

SEQ ID NO: 453828 - RNA, 64 nt, Human; identical to SEQ ID NO: 449686

SEQ ID NO: 453829 - RNA, 64 nt, Human; identical to SEQ ID NO: 449687

SEQ ID NO: 453830 - RNA, 64 nt, Human; identical to SEQ ID NO: 449688

SEQ ID NO: 453831 - RNA, 64 nt, Human; identical to SEQ ID NO: 135821

SEQ ID NO: 453832 - RNA, 64 nt, Human; identical to SEQ ID NO: 135822

SEQ ID NO: 453833 - RNA, 64 nt, Human; identical to SEQ ID NO: 135823

SEQ ID NO: 453834 - RNA, 64 nt, Human; identical to SEQ ID NO: 449689

SEQ ID NO: 453835 - RNA, 64 nt, Human; identical to SEQ ID NO: 449690

SEQ ID NO: 453836 - RNA, 64 nt, Human; identical to SEQ ID NO: 449691

SEQ ID NO: 453837 - RNA, 64 nt, Human; identical to SEQ ID NO: 449692

SEQ ID NO: 453838 - RNA, 64 nt, Human; identical to SEQ ID NO: 449693

SEQ ID NO: 453839 - RNA, 64 nt, Human; identical to SEQ ID NO: 449694

SEQ ID NO: 453840 - RNA, 64 nt, Human; identical to SEQ ID NO: 449695

SEQ ID NO: 453841 - RNA, 58 nt, Human; identical to SEQ ID NO: 381028

SEQ ID NO: 453842 - RNA, 64 nt, Human; identical to SEQ ID NO: 449697

SEQ ID NO: 453843 - RNA, 64 nt, Human; identical to SEQ ID NO: 449698

SEQ ID NO: 453844 - RNA, 64 nt, Human; identical to SEQ ID NO: 449702

SEQ ID NO: 453845 - RNA, 64 nt, Human; identical to SEQ ID NO: 449703

SEQ ID NO: 453846 - RNA, 64 nt, Human; identical to SEQ ID NO: 449704

SEQ ID NO: 453847 - RNA, 64 nt, Human; identical to SEQ ID NO: 449705

SEQ ID NO: 453848 - RNA, 64 nt, Human; identical to SEQ ID NO: 449706

SEQ ID NO: 453849 - RNA, 64 nt, Human; identical to SEQ ID NO: 449707

SEQ ID NO: 453850 - RNA, 64 nt, Human; identical to SEQ ID NO: 449708

SEQ ID NO: 453851 - RNA, 64 nt, Human; identical to SEQ ID NO: 449709

SEQ ID NO: 453852 - RNA, 64 nt, Human; identical to SEQ ID NO: 449710

SEQ ID NO: 453853 - RNA, 64 nt, Human; identical to SEQ ID NO: 449711

SEQ ID NO: 453854 - RNA, 64 nt, Human; identical to SEQ ID NO: 449712

SEQ ID NO: 453855 - RNA, 64 nt, Human; identical to SEQ ID NO: 449713

SEQ ID NO: 453856 - RNA, 64 nt, Human; identical to SEQ ID NO: 449714

SEQ ID NO: 453857 - RNA, 64 nt, Human; identical to SEQ ID NO: 449715

SEQ ID NO: 453858 - RNA, 64 nt, Human; identical to SEQ ID NO: 449716

SEQ ID NO: 453859 - RNA, 64 nt, Human; identical to SEQ ID NO: 449720

SEQ ID NO: 453860 - RNA, 64 nt, Human; identical to SEQ ID NO: 449721

SEQ ID NO: 453861 - RNA, 64 nt, Human; identical to SEQ ID NO: 449722

SEQ ID NO: 453862 - RNA, 64 nt, Human; identical to SEQ ID NO: 449723

SEQ ID NO: 453863 - RNA, 64 nt, Human; identical to SEQ ID NO: 449724

SEQ ID NO: 453864 - RNA, 61 nt, Human
gaguagaauuaagucagagccaacagguggggagagacagagaagugggcaggggcaccca

SEQ ID NO: 453865 - RNA, 54 nt, Human
ucucggagauggagguguaggcuggagagacauuguggguguguaucuucuuau

SEQ ID NO: 453866 - RNA, 61 nt, Human
guguaauuauacugaaggaguacaccugugagagagacaaguaccugauuuggaagcccca

SEQ ID NO: 453867 - RNA, 64 nt, Human; identical to SEQ ID NO: 449725

SEQ ID NO: 453868 - RNA, 64 nt, Human; identical to SEQ ID NO: 449726

SEQ ID NO: 453869 - RNA, 64 nt, Human; identical to SEQ ID NO: 449727

SEQ ID NO: 453870 - RNA, 64 nt, Human; identical to SEQ ID NO: 449728

SEQ ID NO: 453871 - RNA, 64 nt, Human; identical to SEQ ID NO: 449729

SEQ ID NO: 453872 - RNA, 64 nt, Human; identical to SEQ ID NO: 449730

SEQ ID NO: 453873 - RNA, 64 nt, Human; identical to SEQ ID NO: 449731

SEQ ID NO: 453874 - RNA, 64 nt, Human; identical to SEQ ID NO: 449732

SEQ ID NO: 453875 - RNA, 64 nt, Human; identical to SEQ ID NO: 449733

SEQ ID NO: 453876 - RNA, 64 nt, Human; identical to SEQ ID NO: 449734

SEQ ID NO: 453877 - RNA, 64 nt, Human; identical to SEQ ID NO: 449738

SEQ ID NO: 453878 - RNA, 64 nt, Human; identical to SEQ ID NO: 449739

SEQ ID NO: 453879 - RNA, 64 nt, Human; identical to SEQ ID NO: 449740

SEQ ID NO: 453880 - RNA, 64 nt, Human; identical to SEQ ID NO: 449741

SEQ ID NO: 453881 - RNA, 64 nt, Human; identical to SEQ ID NO: 449742

SEQ ID NO: 453882 - RNA, 61 nt, Human
agaaagggagguggcggauggagugggaagugagagacacugauuuuuaaauaucaaaauu

SEQ ID NO: 453883 - RNA, 61 nt, Human
ugcagggaggguagauggccccacccagaccgagagacacagugaugaccucagccuaggg

SEQ ID NO: 453884 - RNA, 61 nt, Human
gugacugacaaauauuguauuacuguacauagagagacaggugggcauuuuugggcuaccu

SEQ ID NO: 453885 - RNA, 64 nt, Human; identical to SEQ ID NO: 449743

SEQ ID NO: 453886 - RNA, 64 nt, Human; identical to SEQ ID NO: 449744

SEQ ID NO: 453887 - RNA, 64 nt, Human; identical to SEQ ID NO: 449745

SEQ ID NO: 453888 - RNA, 64 nt, Human; identical to SEQ ID NO: 449746

SEQ ID NO: 453889 - RNA, 64 nt, Human; identical to SEQ ID NO: 449747

SEQ ID NO: 453890 - RNA, 64 nt, Human; identical to SEQ ID NO: 449748

SEQ ID NO: 453891 - RNA, 64 nt, Human; identical to SEQ ID NO: 449749

SEQ ID NO: 453892 - RNA, 64 nt, Human; identical to SEQ ID NO: 449750

SEQ ID NO: 453893 - RNA, 64 nt, Human; identical to SEQ ID NO: 449751

SEQ ID NO: 453894 - RNA, 64 nt, Human; identical to SEQ ID NO: 449752

SEQ ID NO: 453895 - RNA, 64 nt, Human; identical to SEQ ID NO: 449756

SEQ ID NO: 453896 - RNA, 64 nt, Human; identical to SEQ ID NO: 449757

SEQ ID NO: 453897 - RNA, 64 nt, Human; identical to SEQ ID NO: 449758

SEQ ID NO: 453898 - RNA, 64 nt, Human; identical to SEQ ID NO: 449759

SEQ ID NO: 453899 - RNA, 64 nt, Human; identical to SEQ ID NO: 449760

SEQ ID NO: 453900 - RNA, 61 nt, Human
ccccaucccggucuccagagacccagcuucugagagacagggugugggcaucuccaugccc

SEQ ID NO: 453901 - RNA, 61 nt, Human
ccuuucuauacauaagagaggucauacaggugagagacaccaaguauauuaaaugaaagaa

SEQ ID NO: 453902 - RNA, 61 nt, Human
ccaggcccuugucuccccaguugggacggcagagagacaaguucuuauaucugaagaacuu

SEQ ID NO: 453903 - RNA, 64 nt, Human; identical to SEQ ID NO: 449761

SEQ ID NO: 453904 - RNA, 64 nt, Human; identical to SEQ ID NO: 449762

SEQ ID NO: 453905 - RNA, 64 nt, Human; identical to SEQ ID NO: 449763

SEQ ID NO: 453906 - RNA, 64 nt, Human; identical to SEQ ID NO: 449764

SEQ ID NO: 453907 - RNA, 64 nt, Human; identical to SEQ ID NO: 449765

SEQ ID NO: 453908 - RNA, 64 nt, Human; identical to SEQ ID NO: 449766

SEQ ID NO: 453909 - RNA, 64 nt, Human; identical to SEQ ID NO: 449767

SEQ ID NO: 453910 - RNA, 64 nt, Human; identical to SEQ ID NO: 449768

SEQ ID NO: 453911 - RNA, 64 nt, Human; identical to SEQ ID NO: 449769

SEQ ID NO: 453912 - RNA, 64 nt, Human; identical to SEQ ID NO: 449770

SEQ ID NO: 453913 - RNA, 64 nt, Human; identical to SEQ ID NO: 449774

SEQ ID NO: 453914 - RNA, 64 nt, Human; identical to SEQ ID NO: 449775

SEQ ID NO: 453915 - RNA, 64 nt, Human; identical to SEQ ID NO: 449776

SEQ ID NO: 453916 - RNA, 64 nt, Human; identical to SEQ ID NO: 449777

SEQ ID NO: 453917 - RNA, 64 nt, Human; identical to SEQ ID NO: 449778

SEQ ID NO: 453918 - RNA, 61 nt, Human
uuuauuugcuaucgacauucccguauaaagagagagacauaucacgcugcugucaugauuu

SEQ ID NO: 453919 - RNA, 61 nt, Human
ccaaaaagagaaaacagaaacccgagaaagagagagacagagagagagaaaaaaaaucacc

SEQ ID NO: 453920 - RNA, 61 nt, Human
guauauaaaaucugccccagccuccaacuuggagagacagauuugggccagacuccugugu

SEQ ID NO: 453921 - RNA, 64 nt, Human; identical to SEQ ID NO: 449779

SEQ ID NO: 453922 - RNA, 64 nt, Human; identical to SEQ ID NO: 449780

SEQ ID NO: 453923 - RNA, 64 nt, Human; identical to SEQ ID NO: 449781

SEQ ID NO: 453924 - RNA, 64 nt, Human; identical to SEQ ID NO: 449782

SEQ ID NO: 453925 - RNA, 64 nt, Human; identical to SEQ ID NO: 449783

SEQ ID NO: 453926 - RNA, 64 nt, Human; identical to SEQ ID NO: 449784

SEQ ID NO: 453927 - RNA, 64 nt, Human; identical to SEQ ID NO: 449785

SEQ ID NO: 453928 - RNA, 64 nt, Human; identical to SEQ ID NO: 449786

SEQ ID NO: 453929 - RNA, 64 nt, Human; identical to SEQ ID NO: 449787

SEQ ID NO: 453930 - RNA, 64 nt, Human; identical to SEQ ID NO: 449788

SEQ ID NO: 453931 - RNA, 64 nt, Human; identical to SEQ ID NO: 449792

SEQ ID NO: 453932 - RNA, 64 nt, Human; identical to SEQ ID NO: 449793

SEQ ID NO: 453933 - RNA, 64 nt, Human; identical to SEQ ID NO: 449794

SEQ ID NO: 453934 - RNA, 64 nt, Human; identical to SEQ ID NO: 449795

SEQ ID NO: 453935 - RNA, 64 nt, Human; identical to SEQ ID NO: 449796

SEQ ID NO: 453936 - RNA, 61 nt, Human
aaagagagagagagagagagaaggggcccaagagagacagcacaggcagccccacggacga

SEQ ID NO: 453937 - RNA, 61 nt, Human
ccuaggacacagaguuggaaauaacucuuaagagagacacaccuccaguaagaccuuaaga

SEQ ID NO: 453938 - RNA, 61 nt, Human
gaaaaauauugauuacucacacauagaucaagagagacacggcuccugccuucauggagcu

SEQ ID NO: 453939 - RNA, 64 nt, Human; identical to SEQ ID NO: 449797

SEQ ID NO: 453940 - RNA, 64 nt, Human; identical to SEQ ID NO: 449798

SEQ ID NO: 453941 - RNA, 64 nt, Human; identical to SEQ ID NO: 449799

SEQ ID NO: 453942 - RNA, 64 nt, Human; identical to SEQ ID NO: 449800

SEQ ID NO: 453943 - RNA, 64 nt, Human; identical to SEQ ID NO: 449801

SEQ ID NO: 453944 - RNA, 64 nt, Human; identical to SEQ ID NO: 449802

SEQ ID NO: 453945 - RNA, 64 nt, Human; identical to SEQ ID NO: 449803

SEQ ID NO: 453946 - RNA, 64 nt, Human; identical to SEQ ID NO: 449804

SEQ ID NO: 453947 - RNA, 64 nt, Human; identical to SEQ ID NO: 449805

SEQ ID NO: 453948 - RNA, 64 nt, Human; identical to SEQ ID NO: 449806

SEQ ID NO: 453949 - RNA, 64 nt, Human; identical to SEQ ID NO: 449810

SEQ ID NO: 453950 - RNA, 63 nt, Human; identical to SEQ ID NO: 381122

SEQ ID NO: 453951 - RNA, 64 nt, Human; identical to SEQ ID NO: 449812

SEQ ID NO: 453952 - RNA, 64 nt, Human; identical to SEQ ID NO: 449813

SEQ ID NO: 453953 - RNA, 64 nt, Human; identical to SEQ ID NO: 449814

SEQ ID NO: 453954 - RNA, 61 nt, Human
uaguacagagaacagggcuugggccacuuuggagagacagaaucuaguccugggcaacuuc

SEQ ID NO: 453955 - RNA, 61 nt, Human
agacccagaaaaaggaagagguggaaacccagagagacagagacccaaagggagagaaaca

SEQ ID NO: 453956 - RNA, 61 nt, Human
guucugugaauguguccauaugugucuguaagagagacagagaccaagaacuugcccaauu

SEQ ID NO: 453957 - RNA, 64 nt, Human; identical to SEQ ID NO: 449815

SEQ ID NO: 453958 - RNA, 64 nt, Human; identical to SEQ ID NO: 449816

SEQ ID NO: 453959 - RNA, 64 nt, Human; identical to SEQ ID NO: 449817

SEQ ID NO: 453960 - RNA, 64 nt, Human; identical to SEQ ID NO: 449818

SEQ ID NO: 453961 - RNA, 64 nt, Human; identical to SEQ ID NO: 449819

SEQ ID NO: 453962 - RNA, 64 nt, Human; identical to SEQ ID NO: 449820

SEQ ID NO: 453963 - RNA, 64 nt, Human; identical to SEQ ID NO: 449821

SEQ ID NO: 453964 - RNA, 64 nt, Human; identical to SEQ ID NO: 449822

SEQ ID NO: 453965 - RNA, 64 nt, Human; identical to SEQ ID NO: 449823

SEQ ID NO: 453966 - RNA, 64 nt, Human; identical to SEQ ID NO: 449824

SEQ ID NO: 453967 - RNA, 64 nt, Human; identical to SEQ ID NO: 449828

SEQ ID NO: 453968 - RNA, 64 nt, Human; identical to SEQ ID NO: 449829

SEQ ID NO: 453969 - RNA, 64 nt, Human; identical to SEQ ID NO: 449830

SEQ ID NO: 453970 - RNA, 64 nt, Human; identical to SEQ ID NO: 449831

SEQ ID NO: 453971 - RNA, 64 nt, Human; identical to SEQ ID NO: 449832

SEQ ID NO: 453972 - RNA, 64 nt, Human; identical to SEQ ID NO: 449833

SEQ ID NO: 453973 - RNA, 64 nt, Human; identical to SEQ ID NO: 449834

SEQ ID NO: 453974 - RNA, 64 nt, Human; identical to SEQ ID NO: 449835

SEQ ID NO: 453975 - RNA, 64 nt, Human; identical to SEQ ID NO: 449836

SEQ ID NO: 453976 - RNA, 64 nt, Human; identical to SEQ ID NO: 449837

SEQ ID NO: 453977 - RNA, 64 nt, Human; identical to SEQ ID NO: 449838

SEQ ID NO: 453978 - RNA, 64 nt, Human; identical to SEQ ID NO: 449839

SEQ ID NO: 453979 - RNA, 64 nt, Human; identical to SEQ ID NO: 449840

SEQ ID NO: 453980 - RNA, 64 nt, Human; identical to SEQ ID NO: 449841

SEQ ID NO: 453981 - RNA, 64 nt, Human; identical to SEQ ID NO: 449842

SEQ ID NO: 453982 - RNA, 64 nt, Human; identical to SEQ ID NO: 449846

SEQ ID NO: 453983 - RNA, 64 nt, Human; identical to SEQ ID NO: 449847

SEQ ID NO: 453984 - RNA, 64 nt, Human; identical to SEQ ID NO: 449848

SEQ ID NO: 453985 - RNA, 64 nt, Human; identical to SEQ ID NO: 449849

SEQ ID NO: 453986 - RNA, 64 nt, Human; identical to SEQ ID NO: 449850

SEQ ID NO: 453987 - RNA, 61 nt, Human
ucacuuuuuaaugcuauauaugggcaggggugagagacauuacugagcaccuuggugagca

SEQ ID NO: 453988 - RNA, 61 nt, Human
ggauggcaaagagagucgcaucucagugcaggagagacagugaggcugcacccacccagga

SEQ ID NO: 453989 - RNA, 61 nt, Human
aauuguuuuagcgcuggguuucccaaggugggagagacagacccagccuggagcuggcccc

SEQ ID NO: 453990 - RNA, 64 nt, Human; identical to SEQ ID NO: 449851

SEQ ID NO: 453991 - RNA, 64 nt, Human; identical to SEQ ID NO: 449852

SEQ ID NO: 453992 - RNA, 64 nt, Human; identical to SEQ ID NO: 449853

SEQ ID NO: 453993 - RNA, 64 nt, Human; identical to SEQ ID NO: 449854

SEQ ID NO: 453994 - RNA, 64 nt, Human; identical to SEQ ID NO: 449855

SEQ ID NO: 453995 - RNA, 64 nt, Human; identical to SEQ ID NO: 449856

SEQ ID NO: 453996 - RNA, 64 nt, Human; identical to SEQ ID NO: 449857

SEQ ID NO: 453997 - RNA, 64 nt, Human; identical to SEQ ID NO: 449858

SEQ ID NO: 453998 - RNA, 64 nt, Human; identical to SEQ ID NO: 449859

SEQ ID NO: 453999 - RNA, 64 nt, Human; identical to SEQ ID NO: 449860

SEQ ID NO: 454000 - RNA, 64 nt, Human; identical to SEQ ID NO: 449864

SEQ ID NO: 454001 - RNA, 64 nt, Human; identical to SEQ ID NO: 449865

SEQ ID NO: 454002 - RNA, 64 nt, Human; identical to SEQ ID NO: 449866

SEQ ID NO: 454003 - RNA, 64 nt, Human; identical to SEQ ID NO: 449867

SEQ ID NO: 454004 - RNA, 64 nt, Human; identical to SEQ ID NO: 449868

SEQ ID NO: 454005 - RNA, 61 nt, Human
cggcauuugaguggguguccagggccccguagagagacauuuaagaugguguaugacagag

SEQ ID NO: 454006 - RNA, 61 nt, Human
ugagugaccagucaagccucauguuaccccagagagacacauggggaguagacccugugua

SEQ ID NO: 454007 - RNA, 61 nt, Human
aauuuggaauuucugauaccuccagugggccgagagacacgguggguaaaggaugugggca

SEQ ID NO: 454008 - RNA, 64 nt, Human; identical to SEQ ID NO: 449869

SEQ ID NO: 454009 - RNA, 64 nt, Human; identical to SEQ ID NO: 449870

SEQ ID NO: 454010 - RNA, 64 nt, Human; identical to SEQ ID NO: 449871

SEQ ID NO: 454011 - RNA, 64 nt, Human; identical to SEQ ID NO: 449872

SEQ ID NO: 454012 - RNA, 64 nt, Human; identical to SEQ ID NO: 449873

SEQ ID NO: 454013 - RNA, 64 nt, Human; identical to SEQ ID NO: 449874

SEQ ID NO: 454014 - RNA, 64 nt, Human; identical to SEQ ID NO: 449875

SEQ ID NO: 454015 - RNA, 64 nt, Human; identical to SEQ ID NO: 449876

SEQ ID NO: 454016 - RNA, 64 nt, Human; identical to SEQ ID NO: 449877

SEQ ID NO: 454017 - RNA, 64 nt, Human; identical to SEQ ID NO: 449878

SEQ ID NO: 454018 - RNA, 64 nt, Human; identical to SEQ ID NO: 449879

SEQ ID NO: 454019 - RNA, 64 nt, Human; identical to SEQ ID NO: 449880

SEQ ID NO: 454020 - RNA, 64 nt, Human; identical to SEQ ID NO: 449881

SEQ ID NO: 454021 - RNA, 64 nt, Human; identical to SEQ ID NO: 449882

SEQ ID NO: 454022 - RNA, 64 nt, Human; identical to SEQ ID NO: 449883

SEQ ID NO: 454023 - RNA, 61 nt, Human
accucggccccagcaaagcgcuaagcagccggagagacagccagggcggcuuccugaagga

SEQ ID NO: 454024 - RNA, 61 nt, Human
cugccucuaaaaggccugucccugcagacaugagagacagcaggucucaugggggugacaa

SEQ ID NO: 454025 - RNA, 64 nt, Human; identical to SEQ ID NO: 449884

SEQ ID NO: 454026 - RNA, 64 nt, Human; identical to SEQ ID NO: 449885

SEQ ID NO: 454027 - RNA, 64 nt, Human; identical to SEQ ID NO: 449886

SEQ ID NO: 454028 - RNA, 64 nt, Human; identical to SEQ ID NO: 449887

SEQ ID NO: 454029 - RNA, 64 nt, Human; identical to SEQ ID NO: 449888

SEQ ID NO: 454030 - RNA, 64 nt, Human; identical to SEQ ID NO: 449889

SEQ ID NO: 454031 - RNA, 64 nt, Human; identical to SEQ ID NO: 449890

SEQ ID NO: 454032 - RNA, 64 nt, Human; identical to SEQ ID NO: 449891

SEQ ID NO: 454033 - RNA, 64 nt, Human; identical to SEQ ID NO: 449892

SEQ ID NO: 454034 - RNA, 64 nt, Human; identical to SEQ ID NO: 449893

SEQ ID NO: 454035 - RNA, 64 nt, Human; identical to SEQ ID NO: 449896

SEQ ID NO: 454036 - RNA, 64 nt, Human; identical to SEQ ID NO: 449897

SEQ ID NO: 454037 - RNA, 64 nt, Human; identical to SEQ ID NO: 449898

SEQ ID NO: 454038 - RNA, 64 nt, Human; identical to SEQ ID NO: 449899

SEQ ID NO: 454039 - RNA, 64 nt, Human; identical to SEQ ID NO: 449900

SEQ ID NO: 454040 - RNA, 63 nt, Human
cuagaggagacagcaagucccaguccccggagcagagagaaguggggccggcccggggcgcug

SEQ ID NO: 454041 - RNA, 64 nt, Human; identical to SEQ ID NO: 189738

SEQ ID NO: 454042 - RNA, 64 nt, Human; identical to SEQ ID NO: 189739

SEQ ID NO: 454043 - RNA, 64 nt, Human; identical to SEQ ID NO: 449901

SEQ ID NO: 454044 - RNA, 64 nt, Human; identical to SEQ ID NO: 449902

SEQ ID NO: 454045 - RNA, 64 nt, Human; identical to SEQ ID NO: 449903

SEQ ID NO: 454046 - RNA, 64 nt, Human; identical to SEQ ID NO: 449904

SEQ ID NO: 454047 - RNA, 64 nt, Human; identical to SEQ ID NO: 449905

SEQ ID NO: 454048 - RNA, 53 nt, Human; identical to SEQ ID NO: 381206

SEQ ID NO: 454049 - RNA, 64 nt, Human; identical to SEQ ID NO: 449907

SEQ ID NO: 454050 - RNA, 64 nt, Human; identical to SEQ ID NO: 449908

SEQ ID NO: 454051 - RNA, 64 nt, Human; identical to SEQ ID NO: 449909

SEQ ID NO: 454052 - RNA, 64 nt, Human; identical to SEQ ID NO: 449910

SEQ ID NO: 454053 - RNA, 64 nt, Human; identical to SEQ ID NO: 449914

SEQ ID NO: 454054 - RNA, 64 nt, Human; identical to SEQ ID NO: 449915

SEQ ID NO: 454055 - RNA, 64 nt, Human; identical to SEQ ID NO: 449916

SEQ ID NO: 454056 - RNA, 64 nt, Human; identical to SEQ ID NO: 449917

SEQ ID NO: 454057 - RNA, 59 nt, Human; identical to SEQ ID NO: 381215

SEQ ID NO: 454058 - RNA, 64 nt, Human; identical to SEQ ID NO: 103231

SEQ ID NO: 454059 - RNA, 64 nt, Human; identical to SEQ ID NO: 129724

SEQ ID NO: 454060 - RNA, 64 nt, Human; identical to SEQ ID NO: 185421

SEQ ID NO: 454061 - RNA, 64 nt, Human; identical to SEQ ID NO: 449919

SEQ ID NO: 454062 - RNA, 64 nt, Human; identical to SEQ ID NO: 449920

SEQ ID NO: 454063 - RNA, 64 nt, Human; identical to SEQ ID NO: 449921

SEQ ID NO: 454064 - RNA, 64 nt, Human; identical to SEQ ID NO: 449922

SEQ ID NO: 454065 - RNA, 64 nt, Human; identical to SEQ ID NO: 449923

SEQ ID NO: 454066 - RNA, 64 nt, Human; identical to SEQ ID NO: 449924

SEQ ID NO: 454067 - RNA, 64 nt, Human; identical to SEQ ID NO: 449925

SEQ ID NO: 454068 - RNA, 64 nt, Human; identical to SEQ ID NO: 449926

SEQ ID NO: 454069 - RNA, 64 nt, Human; identical to SEQ ID NO: 449927

SEQ ID NO: 454070 - RNA, 64 nt, Human; identical to SEQ ID NO: 449928

SEQ ID NO: 454071 - RNA, 64 nt, Human; identical to SEQ ID NO: 449931

SEQ ID NO: 454072 - RNA, 64 nt, Human; identical to SEQ ID NO: 449932

SEQ ID NO: 454073 - RNA, 64 nt, Human; identical to SEQ ID NO: 449933

SEQ ID NO: 454074 - RNA, 64 nt, Human; identical to SEQ ID NO: 449934

SEQ ID NO: 454075 - RNA, 64 nt, Human; identical to SEQ ID NO: 449935

SEQ ID NO: 454076 - RNA, 64 nt, Human; identical to SEQ ID NO: 135850

SEQ ID NO: 454077 - RNA, 64 nt, Human; identical to SEQ ID NO: 135851

SEQ ID NO: 454078 - RNA, 64 nt, Human; identical to SEQ ID NO: 135852

SEQ ID NO: 454079 - RNA, 64 nt, Human; identical to SEQ ID NO: 449936

SEQ ID NO: 454080 - RNA, 64 nt, Human; identical to SEQ ID NO: 449937

SEQ ID NO: 454081 - RNA, 64 nt, Human; identical to SEQ ID NO: 449938

SEQ ID NO: 454082 - RNA, 64 nt, Human; identical to SEQ ID NO: 449939

SEQ ID NO: 454083 - RNA, 64 nt, Human; identical to SEQ ID NO: 449940

SEQ ID NO: 454084 - RNA, 64 nt, Human; identical to SEQ ID NO: 449941

SEQ ID NO: 454085 - RNA, 64 nt, Human; identical to SEQ ID NO: 449942

SEQ ID NO: 454086 - RNA, 64 nt, Human; identical to SEQ ID NO: 449943

SEQ ID NO: 454087 - RNA, 64 nt, Human; identical to SEQ ID NO: 449944

SEQ ID NO: 454088 - RNA, 64 nt, Human; identical to SEQ ID NO: 449945

SEQ ID NO: 454089 - RNA, 64 nt, Human; identical to SEQ ID NO: 449948

SEQ ID NO: 454090 - RNA, 64 nt, Human; identical to SEQ ID NO: 449949

SEQ ID NO: 454091 - RNA, 64 nt, Human; identical to SEQ ID NO: 449950

SEQ ID NO: 454092 - RNA, 64 nt, Human; identical to SEQ ID NO: 449951

SEQ ID NO: 454093 - RNA, 64 nt, Human; identical to SEQ ID NO: 449952

SEQ ID NO: 454094 - RNA, 64 nt, Human; identical to SEQ ID NO: 135854

SEQ ID NO: 454095 - RNA, 64 nt, Human; identical to SEQ ID NO: 135855

SEQ ID NO: 454096 - RNA, 64 nt, Human; identical to SEQ ID NO: 135856

SEQ ID NO: 454097 - RNA, 64 nt, Human; identical to SEQ ID NO: 449953

SEQ ID NO: 454098 - RNA, 64 nt, Human; identical to SEQ ID NO: 449954

SEQ ID NO: 454099 - RNA, 64 nt, Human; identical to SEQ ID NO: 449955

SEQ ID NO: 454100 - RNA, 64 nt, Human; identical to SEQ ID NO: 449956

SEQ ID NO: 454101 - RNA, 64 nt, Human; identical to SEQ ID NO: 449957

SEQ ID NO: 454102 - RNA, 64 nt, Human; identical to SEQ ID NO: 449958

SEQ ID NO: 454103 - RNA, 64 nt, Human; identical to SEQ ID NO: 449959

SEQ ID NO: 454104 - RNA, 64 nt, Human; identical to SEQ ID NO: 449960

SEQ ID NO: 454105 - RNA, 64 nt, Human; identical to SEQ ID NO: 449961

SEQ ID NO: 454106 - RNA, 64 nt, Human; identical to SEQ ID NO: 449962

SEQ ID NO: 454107 - RNA, 64 nt, Human; identical to SEQ ID NO: 449966

SEQ ID NO: 454108 - RNA, 50 nt, Human; identical to SEQ ID NO: 381257

SEQ ID NO: 454109 - RNA, 64 nt, Human; identical to SEQ ID NO: 449968

SEQ ID NO: 454110 - RNA, 64 nt, Human; identical to SEQ ID NO: 449969

SEQ ID NO: 454111 - RNA, 64 nt, Human; identical to SEQ ID NO: 449970

SEQ ID NO: 454112 - RNA, 61 nt, Human
guuauguucuucuucauugaauuucauauuugagagacauuugucuucaugaagcagauuu

SEQ ID NO: 454113 - RNA, 61 nt, Human
aaguaagcaaugagcucaaauaauuaaaaaagagagacaaaauacacuugggagaacagaa

SEQ ID NO: 454114 - RNA, 61 nt, Human
aggauuagcacugcaccucuacauccaucaagagagacagagcgcacaauggagcaggaag

SEQ ID NO: 454115 - RNA, 64 nt, Human; identical to SEQ ID NO: 449971

SEQ ID NO: 454116 - RNA, 64 nt, Human; identical to SEQ ID NO: 449972

SEQ ID NO: 454117 - RNA, 64 nt, Human; identical to SEQ ID NO: 449973

SEQ ID NO: 454118 - RNA, 64 nt, Human; identical to SEQ ID NO: 449974

SEQ ID NO: 454119 - RNA, 64 nt, Human; identical to SEQ ID NO: 449975

SEQ ID NO: 454120 - RNA, 64 nt, Human; identical to SEQ ID NO: 449976

SEQ ID NO: 454121 - RNA, 64 nt, Human; identical to SEQ ID NO: 449977

SEQ ID NO: 454122 - RNA, 64 nt, Human; identical to SEQ ID NO: 449978

SEQ ID NO: 454123 - RNA, 64 nt, Human; identical to SEQ ID NO: 449979

SEQ ID NO: 454124 - RNA, 64 nt, Human; identical to SEQ ID NO: 449980

SEQ ID NO: 454125 - RNA, 64 nt, Human; identical to SEQ ID NO: 449983

SEQ ID NO: 454126 - RNA, 64 nt, Human; identical to SEQ ID NO: 449984

SEQ ID NO: 454127 - RNA, 64 nt, Human; identical to SEQ ID NO: 449985

SEQ ID NO: 454128 - RNA, 64 nt, Human; identical to SEQ ID NO: 449986

SEQ ID NO: 454129 - RNA, 64 nt, Human; identical to SEQ ID NO: 449987

SEQ ID NO: 454130 - RNA, 61 nt, Human
ugugugugugugugugugugugugugugaaagagagacagaagggaaugguuugagagggu

SEQ ID NO: 454131 - RNA, 61 nt, Human
guuagacuauaugauccauacaaauuaaagugagagacaugguuacuguguaauaaaagaa

SEQ ID NO: 454132 - RNA, 61 nt, Human
gcugccgcuuguuagguuaggguuagauggggagagacagggcacagaggaccugucuccc

SEQ ID NO: 454133 - RNA, 64 nt, Human; identical to SEQ ID NO: 449988

SEQ ID NO: 454134 - RNA, 64 nt, Human; identical to SEQ ID NO: 449989

SEQ ID NO: 454135 - RNA, 64 nt, Human; identical to SEQ ID NO: 449990

SEQ ID NO: 454136 - RNA, 64 nt, Human; identical to SEQ ID NO: 449991

SEQ ID NO: 454137 - RNA, 64 nt, Human; identical to SEQ ID NO: 449992

SEQ ID NO: 454138 - RNA, 64 nt, Human; identical to SEQ ID NO: 449993

SEQ ID NO: 454139 - RNA, 64 nt, Human; identical to SEQ ID NO: 449994

SEQ ID NO: 454140 - RNA, 64 nt, Human; identical to SEQ ID NO: 449995

SEQ ID NO: 454141 - RNA, 64 nt, Human; identical to SEQ ID NO: 449996

SEQ ID NO: 454142 - RNA, 64 nt, Human; identical to SEQ ID NO: 449997

SEQ ID NO: 454143 - RNA, 64 nt, Human; identical to SEQ ID NO: 450000

SEQ ID NO: 454144 - RNA, 64 nt, Human; identical to SEQ ID NO: 450001

SEQ ID NO: 454145 - RNA, 64 nt, Human; identical to SEQ ID NO: 450002

SEQ ID NO: 454146 - RNA, 64 nt, Human; identical to SEQ ID NO: 450003

SEQ ID NO: 454147 - RNA, 64 nt, Human; identical to SEQ ID NO: 450004

SEQ ID NO: 454148 - RNA, 61 nt, Human
gaaucuaucuuaaaauacugagguguggagagagagacaggaucaggagcgauagagagca

SEQ ID NO: 454149 - RNA, 61 nt, Human
uuuauuugauauuaaaguaugagauagaguugagagacaauuaauuauccccucuuacaca

SEQ ID NO: 454150 - RNA, 61 nt, Human
aaccccaucgccaacuaagcgaggcaugccugagagacauggcuuucagaaaacgggaagc

SEQ ID NO: 454151 - RNA, 64 nt, Human; identical to SEQ ID NO: 450005

SEQ ID NO: 454152 - RNA, 64 nt, Human; identical to SEQ ID NO: 450006

SEQ ID NO: 454153 - RNA, 64 nt, Human; identical to SEQ ID NO: 450007

SEQ ID NO: 454154 - RNA, 64 nt, Human; identical to SEQ ID NO: 450008

SEQ ID NO: 454155 - RNA, 64 nt, Human; identical to SEQ ID NO: 450009

SEQ ID NO: 454156 - RNA, 64 nt, Human; identical to SEQ ID NO: 450010

SEQ ID NO: 454157 - RNA, 64 nt, Human; identical to SEQ ID NO: 450011

SEQ ID NO: 454158 - RNA, 64 nt, Human; identical to SEQ ID NO: 450012

SEQ ID NO: 454159 - RNA, 64 nt, Human; identical to SEQ ID NO: 450013

SEQ ID NO: 454160 - RNA, 64 nt, Human; identical to SEQ ID NO: 450014

SEQ ID NO: 454161 - RNA, 64 nt, Human; identical to SEQ ID NO: 450018

SEQ ID NO: 454162 - RNA, 64 nt, Human; identical to SEQ ID NO: 450019

SEQ ID NO: 454163 - RNA, 64 nt, Human; identical to SEQ ID NO: 450020

SEQ ID NO: 454164 - RNA, 64 nt, Human; identical to SEQ ID NO: 450021

SEQ ID NO: 454165 - RNA, 64 nt, Human; identical to SEQ ID NO: 450022

SEQ ID NO: 454166 - RNA, 61 nt, Human
uguguguguguguguguaugagagagagagagagagacaacagagacagagagaggcagag

SEQ ID NO: 454167 - RNA, 61 nt, Human
caacagagacagagagaggcagagaggcauagagagacagagagagagacaagaaacagag

SEQ ID NO: 454168 - RNA, 61 nt, Human
agagaggcagagaggcauagagagacagagagagagacaagaaacagagauagacagaaaa

SEQ ID NO: 454169 - RNA, 64 nt, Human; identical to SEQ ID NO: 450023

SEQ ID NO: 454170 - RNA, 64 nt, Human; identical to SEQ ID NO: 450024

SEQ ID NO: 454171 - RNA, 64 nt, Human; identical to SEQ ID NO: 450025

SEQ ID NO: 454172 - RNA, 64 nt, Human; identical to SEQ ID NO: 450026

SEQ ID NO: 454173 - RNA, 64 nt, Human; identical to SEQ ID NO: 450027

SEQ ID NO: 454174 - RNA, 64 nt, Human; identical to SEQ ID NO: 450028

SEQ ID NO: 454175 - RNA, 64 nt, Human; identical to SEQ ID NO: 450029

SEQ ID NO: 454176 - RNA, 64 nt, Human; identical to SEQ ID NO: 450030

SEQ ID NO: 454177 - RNA, 64 nt, Human; identical to SEQ ID NO: 450031

SEQ ID NO: 454178 - RNA, 64 nt, Human; identical to SEQ ID NO: 450032

SEQ ID NO: 454179 - RNA, 64 nt, Human; identical to SEQ ID NO: 450036

SEQ ID NO: 454180 - RNA, 64 nt, Human; identical to SEQ ID NO: 450037

SEQ ID NO: 454181 - RNA, 64 nt, Human; identical to SEQ ID NO: 450038

SEQ ID NO: 454182 - RNA, 64 nt, Human; identical to SEQ ID NO: 450039

SEQ ID NO: 454183 - RNA, 64 nt, Human; identical to SEQ ID NO: 450040

SEQ ID NO: 454184 - RNA, 61 nt, Human
cauccccugccagagggaguucuucuuuugugagagacacuguaaacgacacaagagaaca

SEQ ID NO: 454185 - RNA, 61 nt, Human
ugcuguucucaggugaaaagagagagagagagagagacauaagaaauuuagagaaaaauau

SEQ ID NO: 454186 - RNA, 61 nt, Human
uugcccaagggccagcucaguuuauccuucggagagacaaggauaugcaugauucuuaacc

SEQ ID NO: 454187 - RNA, 64 nt, Human; identical to SEQ ID NO: 450041

SEQ ID NO: 454188 - RNA, 64 nt, Human; identical to SEQ ID NO: 450042

SEQ ID NO: 454189 - RNA, 64 nt, Human; identical to SEQ ID NO: 450043

SEQ ID NO: 454190 - RNA, 64 nt, Human; identical to SEQ ID NO: 450044

SEQ ID NO: 454191 - RNA, 64 nt, Human; identical to SEQ ID NO: 450045

SEQ ID NO: 454192 - RNA, 64 nt, Human; identical to SEQ ID NO: 450046

SEQ ID NO: 454193 - RNA, 64 nt, Human; identical to SEQ ID NO: 450047

SEQ ID NO: 454194 - RNA, 64 nt, Human; identical to SEQ ID NO: 450048

SEQ ID NO: 454195 - RNA, 64 nt, Human; identical to SEQ ID NO: 450049

SEQ ID NO: 454196 - RNA, 64 nt, Human; identical to SEQ ID NO: 450050

SEQ ID NO: 454197 - RNA, 64 nt, Human; identical to SEQ ID NO: 450054

SEQ ID NO: 454198 - RNA, 64 nt, Human; identical to SEQ ID NO: 450055

SEQ ID NO: 454199 - RNA, 64 nt, Human; identical to SEQ ID NO: 450056

SEQ ID NO: 454200 - RNA, 64 nt, Human; identical to SEQ ID NO: 450057

SEQ ID NO: 454201 - RNA, 64 nt, Human; identical to SEQ ID NO: 450058

SEQ ID NO: 454202 - RNA, 61 nt, Human
ccccgguugcgcugguauaguugcccagcgggagagacacccccauccccacgcgggccgg

SEQ ID NO: 454203 - RNA, 61 nt, Human
augcuuuauucacuucuguggaauuacaagugagagacacuuuuaggaccugauggacaaa

SEQ ID NO: 454204 - RNA, 61 nt, Human
guggcaaguuccgcagauagcuggguuagaagagagacaggggagugagcuagucaaaugu

SEQ ID NO: 454205 - RNA, 64 nt, Human; identical to SEQ ID NO: 450059

SEQ ID NO: 454206 - RNA, 64 nt, Human; identical to SEQ ID NO: 450060

SEQ ID NO: 454207 - RNA, 64 nt, Human; identical to SEQ ID NO: 450061

SEQ ID NO: 454208 - RNA, 64 nt, Human; identical to SEQ ID NO: 450062

SEQ ID NO: 454209 - RNA, 64 nt, Human; identical to SEQ ID NO: 450063

SEQ ID NO: 454210 - RNA, 64 nt, Human; identical to SEQ ID NO: 450064

SEQ ID NO: 454211 - RNA, 64 nt, Human; identical to SEQ ID NO: 450065

SEQ ID NO: 454212 - RNA, 64 nt, Human; identical to SEQ ID NO: 450066

SEQ ID NO: 454213 - RNA, 52 nt, Human; identical to SEQ ID NO: 381344

SEQ ID NO: 454214 - RNA, 64 nt, Human; identical to SEQ ID NO: 450068

SEQ ID NO: 454215 - RNA, 64 nt, Human; identical to SEQ ID NO: 450072

SEQ ID NO: 454216 - RNA, 64 nt, Human; identical to SEQ ID NO: 450073

SEQ ID NO: 454217 - RNA, 64 nt, Human; identical to SEQ ID NO: 450074

SEQ ID NO: 454218 - RNA, 64 nt, Human; identical to SEQ ID NO: 450075

SEQ ID NO: 454219 - RNA, 64 nt, Human; identical to SEQ ID NO: 450076

SEQ ID NO: 454220 - RNA, 61 nt, Human
aaaaaauaauaauaauaaaugccaagggggagagagacacaauauccgcagccuuacaccu

SEQ ID NO: 454221 - RNA, 61 nt, Human
agguggggagggagacagagacagaaacagagagagacagagacagagagagacugaggga

SEQ ID NO: 454222 - RNA, 61 nt, Human
ucagaugaggccgccccugaccuucuggccagagagacauugcugccagccagcucugccu

SEQ ID NO: 454223 - RNA, 64 nt, Human; identical to SEQ ID NO: 450077

SEQ ID NO: 454224 - RNA, 64 nt, Human; identical to SEQ ID NO: 450078

SEQ ID NO: 454225 - RNA, 52 nt, Human; identical to SEQ ID NO: 381351

SEQ ID NO: 454226 - RNA, 64 nt, Human; identical to SEQ ID NO: 450080

SEQ ID NO: 454227 - RNA, 64 nt, Human; identical to SEQ ID NO: 450081

SEQ ID NO: 454228 - RNA, 64 nt, Human; identical to SEQ ID NO: 450082

SEQ ID NO: 454229 - RNA, 64 nt, Human; identical to SEQ ID NO: 450083

SEQ ID NO: 454230 - RNA, 64 nt, Human; identical to SEQ ID NO: 450084

SEQ ID NO: 454231 - RNA, 64 nt, Human; identical to SEQ ID NO: 450085

SEQ ID NO: 454232 - RNA, 64 nt, Human; identical to SEQ ID NO: 450086

SEQ ID NO: 454233 - RNA, 64 nt, Human; identical to SEQ ID NO: 450090

SEQ ID NO: 454234 - RNA, 64 nt, Human; identical to SEQ ID NO: 450091

SEQ ID NO: 454235 - RNA, 64 nt, Human; identical to SEQ ID NO: 450092

SEQ ID NO: 454236 - RNA, 64 nt, Human; identical to SEQ ID NO: 450093

SEQ ID NO: 454237 - RNA, 64 nt, Human; identical to SEQ ID NO: 450094

SEQ ID NO: 454238 - RNA, 61 nt, Human
gagagaauucagccgaagauaugagaguaaugagagacauuuuccagucauuggaucgugu

SEQ ID NO: 454239 - RNA, 61 nt, Human
uuuuuuuuuuguuguuguuaaugagcagaaagagagacauaaugacagcugauguuaaacu

SEQ ID NO: 454240 - RNA, 61 nt, Human
uuuaaggaauugaaaccuagcaaucuuauuggagagacaagaauuggucuccagcugccuu

SEQ ID NO: 454241 - RNA, 64 nt, Human; identical to SEQ ID NO: 450095

SEQ ID NO: 454242 - RNA, 54 nt, Human; identical to SEQ ID NO: 381367

SEQ ID NO: 454243 - RNA, 64 nt, Human; identical to SEQ ID NO: 450097

SEQ ID NO: 454244 - RNA, 64 nt, Human; identical to SEQ ID NO: 450098

SEQ ID NO: 454245 - RNA, 64 nt, Human; identical to SEQ ID NO: 450099

SEQ ID NO: 454246 - RNA, 64 nt, Human; identical to SEQ ID NO: 450100

SEQ ID NO: 454247 - RNA, 64 nt, Human; identical to SEQ ID NO: 450101

SEQ ID NO: 454248 - RNA, 64 nt, Human; identical to SEQ ID NO: 450102

SEQ ID NO: 454249 - RNA, 64 nt, Human; identical to SEQ ID NO: 450103

SEQ ID NO: 454250 - RNA, 64 nt, Human; identical to SEQ ID NO: 450104

SEQ ID NO: 454251 - RNA, 64 nt, Human; identical to SEQ ID NO: 450108

SEQ ID NO: 454252 - RNA, 64 nt, Human; identical to SEQ ID NO: 450109

SEQ ID NO: 454253 - RNA, 64 nt, Human; identical to SEQ ID NO: 450110

SEQ ID NO: 454254 - RNA, 64 nt, Human; identical to SEQ ID NO: 450111

SEQ ID NO: 454255 - RNA, 64 nt, Human; identical to SEQ ID NO: 450112

SEQ ID NO: 454256 - RNA, 61 nt, Human
acaccauuggaaaguggauauauuagauugugagagacaacaguugccuccuuuugacaaa

SEQ ID NO: 454257 - RNA, 61 nt, Human
guaguggcuaaggcaugcuugaacuguguuugagagacagcaguucagucaguacauaauu

SEQ ID NO: 454258 - RNA, 61 nt, Human
augggaaccuugcuuagcgcccaagguagaugagagacagggcagggaaucugcguggugc

SEQ ID NO: 454259 - RNA, 64 nt, Human; identical to SEQ ID NO: 450113

SEQ ID NO: 454260 - RNA, 64 nt, Human; identical to SEQ ID NO: 450114

SEQ ID NO: 454261 - RNA, 64 nt, Human; identical to SEQ ID NO: 450115

SEQ ID NO: 454262 - RNA, 64 nt, Human; identical to SEQ ID NO: 450116

SEQ ID NO: 454263 - RNA, 64 nt, Human; identical to SEQ ID NO: 450117

SEQ ID NO: 454264 - RNA, 64 nt, Human; identical to SEQ ID NO: 450118

SEQ ID NO: 454265 - RNA, 64 nt, Human; identical to SEQ ID NO: 450119

SEQ ID NO: 454266 - RNA, 64 nt, Human; identical to SEQ ID NO: 450120

SEQ ID NO: 454267 - RNA, 64 nt, Human; identical to SEQ ID NO: 450121

SEQ ID NO: 454268 - RNA, 64 nt, Human; identical to SEQ ID NO: 450122

SEQ ID NO: 454269 - RNA, 64 nt, Human; identical to SEQ ID NO: 450126

SEQ ID NO: 454270 - RNA, 64 nt, Human; identical to SEQ ID NO: 450127

SEQ ID NO: 454271 - RNA, 64 nt, Human; identical to SEQ ID NO: 450128

SEQ ID NO: 454272 - RNA, 64 nt, Human; identical to SEQ ID NO: 450129

SEQ ID NO: 454273 - RNA, 64 nt, Human; identical to SEQ ID NO: 450130

SEQ ID NO: 454274 - RNA, 61 nt, Human
auggaguuguuuacauuaagcaugaccgaacgagagacaauacuauuucccacaggagucc

SEQ ID NO: 454275 - RNA, 61 nt, Human
auuauucuauuguuauuuaugagagaguaccgagagacacggucuggacagcccaaggcgc

SEQ ID NO: 454276 - RNA, 61 nt, Human
uuuguuggugcacagagauugacuugauucagagagacaauucacuccaucccuauggcag

SEQ ID NO: 454277 - RNA, 64 nt, Human; identical to SEQ ID NO: 450131

SEQ ID NO: 454278 - RNA, 64 nt, Human; identical to SEQ ID NO: 450132

SEQ ID NO: 454279 - RNA, 64 nt, Human; identical to SEQ ID NO: 450133

SEQ ID NO: 454280 - RNA, 64 nt, Human; identical to SEQ ID NO: 450134

SEQ ID NO: 454281 - RNA, 64 nt, Human; identical to SEQ ID NO: 450135

SEQ ID NO: 454282 - RNA, 64 nt, Human; identical to SEQ ID NO: 450136

SEQ ID NO: 454283 - RNA, 64 nt, Human; identical to SEQ ID NO: 450137

SEQ ID NO: 454284 - RNA, 64 nt, Human; identical to SEQ ID NO: 450138

SEQ ID NO: 454285 - RNA, 64 nt, Human; identical to SEQ ID NO: 450139

SEQ ID NO: 454286 - RNA, 64 nt, Human; identical to SEQ ID NO: 450140

SEQ ID NO: 454287 - RNA, 64 nt, Human; identical to SEQ ID NO: 450144

SEQ ID NO: 454288 - RNA, 64 nt, Human; identical to SEQ ID NO: 450145

SEQ ID NO: 454289 - RNA, 64 nt, Human; identical to SEQ ID NO: 450146

SEQ ID NO: 454290 - RNA, 64 nt, Human; identical to SEQ ID NO: 450147

SEQ ID NO: 454291 - RNA, 64 nt, Human; identical to SEQ ID NO: 450148

SEQ ID NO: 454292 - RNA, 61 nt, Human
uuuuauaacugaacuuguacauauguauaaagagagacacaucuuccuuuuacuaacugga

SEQ ID NO: 454293 - RNA, 61 nt, Human
uucagaaccagccuggccaaaaauuacaccagagagacagaguccuccccauugggaacag

SEQ ID NO: 454294 - RNA, 61 nt, Human
ggccugcccugcccugcuggcuuccugacuggagagacaggacccacagaaacagccugac

SEQ ID NO: 454295 - RNA, 64 nt, Human; identical to SEQ ID NO: 450149

SEQ ID NO: 454296 - RNA, 64 nt, Human; identical to SEQ ID NO: 450150

SEQ ID NO: 454297 - RNA, 64 nt, Human; identical to SEQ ID NO: 450151

SEQ ID NO: 454298 - RNA, 64 nt, Human; identical to SEQ ID NO: 450152

SEQ ID NO: 454299 - RNA, 64 nt, Human; identical to SEQ ID NO: 450153

SEQ ID NO: 454300 - RNA, 64 nt, Human; identical to SEQ ID NO: 450154

SEQ ID NO: 454301 - RNA, 64 nt, Human; identical to SEQ ID NO: 450155

SEQ ID NO: 454302 - RNA, 64 nt, Human; identical to SEQ ID NO: 450156

SEQ ID NO: 454303 - RNA, 64 nt, Human; identical to SEQ ID NO: 450157

SEQ ID NO: 454304 - RNA, 64 nt, Human; identical to SEQ ID NO: 450158

SEQ ID NO: 454305 - RNA, 51 nt, Human; identical to SEQ ID NO: 381423

SEQ ID NO: 454306 - RNA, 64 nt, Human; identical to SEQ ID NO: 450163

SEQ ID NO: 454307 - RNA, 64 nt, Human; identical to SEQ ID NO: 450164

SEQ ID NO: 454308 - RNA, 64 nt, Human; identical to SEQ ID NO: 450165

SEQ ID NO: 454309 - RNA, 64 nt, Human; identical to SEQ ID NO: 450166

SEQ ID NO: 454310 - RNA, 61 nt, Human
aauaugucucugagaagcuagaggcggcagagagagacaaucaaaaccuggaagacaaagu

SEQ ID NO: 454311 - RNA, 61 nt, Human
gugaaaaaagaaacaugccacuugauuaggagagagacagcaguguuugaacuacagcauc

SEQ ID NO: 454312 - RNA, 61 nt, Human
cccgaggggccccagcuuucaagggcgacgggagagacacaggauaaaagguuaaaagugc

SEQ ID NO: 454313 - RNA, 64 nt, Human; identical to SEQ ID NO: 450167

SEQ ID NO: 454314 - RNA, 64 nt, Human; identical to SEQ ID NO: 450168

SEQ ID NO: 454315 - RNA, 64 nt, Human; identical to SEQ ID NO: 450169

SEQ ID NO: 454316 - RNA, 64 nt, Human; identical to SEQ ID NO: 450170

SEQ ID NO: 454317 - RNA, 64 nt, Human; identical to SEQ ID NO: 450171

SEQ ID NO: 454318 - RNA, 64 nt, Human; identical to SEQ ID NO: 450172

SEQ ID NO: 454319 - RNA, 64 nt, Human; identical to SEQ ID NO: 450173

SEQ ID NO: 454320 - RNA, 64 nt, Human; identical to SEQ ID NO: 450174

SEQ ID NO: 454321 - RNA, 64 nt, Human; identical to SEQ ID NO: 450175

SEQ ID NO: 454322 - RNA, 64 nt, Human; identical to SEQ ID NO: 450176

SEQ ID NO: 454323 - RNA, 64 nt, Human; identical to SEQ ID NO: 450180

SEQ ID NO: 454324 - RNA, 64 nt, Human; identical to SEQ ID NO: 450181

SEQ ID NO: 454325 - RNA, 64 nt, Human; identical to SEQ ID NO: 450182

SEQ ID NO: 454326 - RNA, 64 nt, Human; identical to SEQ ID NO: 450183

SEQ ID NO: 454327 - RNA, 56 nt, Human; identical to SEQ ID NO: 381440

SEQ ID NO: 454328 - RNA, 61 nt, Human
ccccugccuggaacuggcugugaagacccaggagagacagagaugcgaaccacccaaaaca

SEQ ID NO: 454329 - RNA, 61 nt, Human
uuucuuucccauuaacuugagugaccugugugagagacagacagaugccccacgaggaugg

SEQ ID NO: 454330 - RNA, 61 nt, Human
uuguaaacucuuacucuaggugcucuuuggugagagacaggcuuuguucucuuguucauaa

SEQ ID NO: 454331 - RNA, 64 nt, Human; identical to SEQ ID NO: 450185

SEQ ID NO: 454332 - RNA, 64 nt, Human; identical to SEQ ID NO: 450186

SEQ ID NO: 454333 - RNA, 64 nt, Human; identical to SEQ ID NO: 450187

SEQ ID NO: 454334 - RNA, 64 nt, Human; identical to SEQ ID NO: 450188

SEQ ID NO: 454335 - RNA, 64 nt, Human; identical to SEQ ID NO: 450189

SEQ ID NO: 454336 - RNA, 64 nt, Human; identical to SEQ ID NO: 450190

SEQ ID NO: 454337 - RNA, 64 nt, Human; identical to SEQ ID NO: 450191

SEQ ID NO: 454338 - RNA, 64 nt, Human; identical to SEQ ID NO: 450192

SEQ ID NO: 454339 - RNA, 64 nt, Human; identical to SEQ ID NO: 450193

SEQ ID NO: 454340 - RNA, 64 nt, Human; identical to SEQ ID NO: 450194

SEQ ID NO: 454341 - RNA, 64 nt, Human; identical to SEQ ID NO: 450196

SEQ ID NO: 454342 - RNA, 64 nt, Human; identical to SEQ ID NO: 450197

SEQ ID NO: 454343 - RNA, 64 nt, Human; identical to SEQ ID NO: 450198

SEQ ID NO: 454344 - RNA, 64 nt, Human; identical to SEQ ID NO: 450199

SEQ ID NO: 454345 - RNA, 53 nt, Human; identical to SEQ ID NO: 381453

SEQ ID NO: 454346 - RNA, 61 nt, Human
auauuuaaagccaaacaaauccaucuuuucugagagacagaaacuaaaaaauucagaguua

SEQ ID NO: 454347 - RNA, 61 nt, Human
ggauaucaguuuuucccacagcagggacugugagagacaaccagcagcauccucuuuguaa

SEQ ID NO: 454348 - RNA, 61 nt, Human
ccggagugagaagcuuugcccuccuaagagagagagacagagagacagagagagagaaaga

SEQ ID NO: 454349 - RNA, 64 nt, Human; identical to SEQ ID NO: 450201

SEQ ID NO: 454350 - RNA, 64 nt, Human; identical to SEQ ID NO: 450202

SEQ ID NO: 454351 - RNA, 64 nt, Human; identical to SEQ ID NO: 450203

SEQ ID NO: 454352 - RNA, 53 nt, Human; identical to SEQ ID NO: 381459

SEQ ID NO: 454353 - RNA, 64 nt, Human; identical to SEQ ID NO: 450205

SEQ ID NO: 454354 - RNA, 64 nt, Human; identical to SEQ ID NO: 450206

SEQ ID NO: 454355 - RNA, 64 nt, Human; identical to SEQ ID NO: 450207

SEQ ID NO: 454356 - RNA, 64 nt, Human; identical to SEQ ID NO: 450208

SEQ ID NO: 454357 - RNA, 64 nt, Human; identical to SEQ ID NO: 450209

SEQ ID NO: 454358 - RNA, 64 nt, Human; identical to SEQ ID NO: 450210

SEQ ID NO: 454359 - RNA, 64 nt, Human; identical to SEQ ID NO: 450213

SEQ ID NO: 454360 - RNA, 64 nt, Human; identical to SEQ ID NO: 450214

SEQ ID NO: 454361 - RNA, 64 nt, Human; identical to SEQ ID NO: 450215

SEQ ID NO: 454362 - RNA, 64 nt, Human; identical to SEQ ID NO: 450216

SEQ ID NO: 454363 - RNA, 64 nt, Human; identical to SEQ ID NO: 450217

SEQ ID NO: 454364 - RNA, 61 nt, Human
gggcugaggaggacucaaaccguugcagucagagagacaccuauuuuggugaauauuuuuu

SEQ ID NO: 454365 - RNA, 61 nt, Human
ucuucagaaccccccuguaagagacagacaugagagacaagcaucuucuuucccccgcaag

SEQ ID NO: 454366 - RNA, 61 nt, Human
uggguugggggugggggggugccguuggugggagagacaaaaagagggagagugugcuuuu

SEQ ID NO: 454367 - RNA, 64 nt, Human; identical to SEQ ID NO: 450218

SEQ ID NO: 454368 - RNA, 64 nt, Human; identical to SEQ ID NO: 450219

SEQ ID NO: 454369 - RNA, 64 nt, Human; identical to SEQ ID NO: 450220

SEQ ID NO: 454370 - RNA, 64 nt, Human; identical to SEQ ID NO: 450221

SEQ ID NO: 454371 - RNA, 64 nt, Human; identical to SEQ ID NO: 450222

SEQ ID NO: 454372 - RNA, 64 nt, Human; identical to SEQ ID NO: 450223

SEQ ID NO: 454373 - RNA, 64 nt, Human; identical to SEQ ID NO: 450224

SEQ ID NO: 454374 - RNA, 64 nt, Human; identical to SEQ ID NO: 450225

SEQ ID NO: 454375 - RNA, 64 nt, Human; identical to SEQ ID NO: 450226

SEQ ID NO: 454376 - RNA, 64 nt, Human; identical to SEQ ID NO: 450227

SEQ ID NO: 454377 - RNA, 64 nt, Human; identical to SEQ ID NO: 450231

SEQ ID NO: 454378 - RNA, 64 nt, Human; identical to SEQ ID NO: 450232

SEQ ID NO: 454379 - RNA, 64 nt, Human; identical to SEQ ID NO: 450233

SEQ ID NO: 454380 - RNA, 64 nt, Human; identical to SEQ ID NO: 450234

SEQ ID NO: 454381 - RNA, 64 nt, Human; identical to SEQ ID NO: 450235

SEQ ID NO: 454382 - RNA, 61 nt, Human; identical to SEQ ID NO: 448985

SEQ ID NO: 454383 - RNA, 61 nt, Human
uaauguuaguaaauccaugguguuauuuucugagagacagaauucaaguggguauucuggg

SEQ ID NO: 454384 - RNA, 61 nt, Human
ugggguggggguggcagggagcugggaccuggagagacaacuccuguaaauaaaacacuuu

SEQ ID NO: 454385 - RNA, 64 nt, Human; identical to SEQ ID NO: 450236

SEQ ID NO: 454386 - RNA, 64 nt, Human; identical to SEQ ID NO: 450237

SEQ ID NO: 454387 - RNA, 64 nt, Human; identical to SEQ ID NO: 450238

SEQ ID NO: 454388 - RNA, 64 nt, Human; identical to SEQ ID NO: 450239

SEQ ID NO: 454389 - RNA, 64 nt, Human; identical to SEQ ID NO: 450240

SEQ ID NO: 454390 - RNA, 64 nt, Human; identical to SEQ ID NO: 450241

SEQ ID NO: 454391 - RNA, 64 nt, Human; identical to SEQ ID NO: 450242

SEQ ID NO: 454392 - RNA, 64 nt, Human; identical to SEQ ID NO: 450243

SEQ ID NO: 454393 - RNA, 64 nt, Human; identical to SEQ ID NO: 450244

SEQ ID NO: 454394 - RNA, 64 nt, Human; identical to SEQ ID NO: 450245

SEQ ID NO: 454395 - RNA, 64 nt, Human; identical to SEQ ID NO: 450249

SEQ ID NO: 454396 - RNA, 64 nt, Human; identical to SEQ ID NO: 450250

SEQ ID NO: 454397 - RNA, 64 nt, Human; identical to SEQ ID NO: 450251

SEQ ID NO: 454398 - RNA, 64 nt, Human; identical to SEQ ID NO: 450252

SEQ ID NO: 454399 - RNA, 64 nt, Human; identical to SEQ ID NO: 450253

SEQ ID NO: 454400 - RNA, 61 nt, Human
uuaaauauauauauuaaaguaucaaaauauagagagacauuugaacuguauucagguaaua

SEQ ID NO: 454401 - RNA, 61 nt, Human
agccaacccaucucagaacguuguggauugagagagacacuacaugacuccaaguauauga

SEQ ID NO: 454402 - RNA, 61 nt, Human
ggggaaugaauguggaagaugccuauauucugagagacaggacaguuucccaggaagaugg

SEQ ID NO: 454403 - RNA, 64 nt, Human; identical to SEQ ID NO: 450254

SEQ ID NO: 454404 - RNA, 64 nt, Human; identical to SEQ ID NO: 450255

SEQ ID NO: 454405 - RNA, 64 nt, Human; identical to SEQ ID NO: 450256

SEQ ID NO: 454406 - RNA, 64 nt, Human; identical to SEQ ID NO: 450257

SEQ ID NO: 454407 - RNA, 64 nt, Human; identical to SEQ ID NO: 450258

SEQ ID NO: 454408 - RNA, 64 nt, Human; identical to SEQ ID NO: 450259

SEQ ID NO: 454409 - RNA, 64 nt, Human; identical to SEQ ID NO: 450260

SEQ ID NO: 454410 - RNA, 64 nt, Human; identical to SEQ ID NO: 450261

SEQ ID NO: 454411 - RNA, 64 nt, Human; identical to SEQ ID NO: 450262

SEQ ID NO: 454412 - RNA, 64 nt, Human; identical to SEQ ID NO: 450263

SEQ ID NO: 454413 - RNA, 64 nt, Human; identical to SEQ ID NO: 450267

SEQ ID NO: 454414 - RNA, 64 nt, Human; identical to SEQ ID NO: 450268

SEQ ID NO: 454415 - RNA, 64 nt, Human; identical to SEQ ID NO: 450269

SEQ ID NO: 454416 - RNA, 64 nt, Human; identical to SEQ ID NO: 450270

SEQ ID NO: 454417 - RNA, 64 nt, Human; identical to SEQ ID NO: 450271

SEQ ID NO: 454418 - RNA, 61 nt, Human
ccaaauuguuuuucuagaauacuaauuuccagagagacauucacaaguauuuacagaagaa

SEQ ID NO: 454419 - RNA, 61 nt, Human
acagcagagguggaggcaagcagugacuccugagagacauuccccacucacuuugugugcu

SEQ ID NO: 454420 - RNA, 61 nt, Human
cuccuuuuaaugguggggggcuacuggagaggagagacagcaaguccacccuaacuuguua

SEQ ID NO: 454421 - RNA, 64 nt, Human; identical to SEQ ID NO: 450272

SEQ ID NO: 454422 - RNA, 64 nt, Human; identical to SEQ ID NO: 450273

SEQ ID NO: 454423 - RNA, 64 nt, Human; identical to SEQ ID NO: 450274

SEQ ID NO: 454424 - RNA, 64 nt, Human; identical to SEQ ID NO: 450275

SEQ ID NO: 454425 - RNA, 64 nt, Human; identical to SEQ ID NO: 450276

SEQ ID NO: 454426 - RNA, 64 nt, Human; identical to SEQ ID NO: 450277

SEQ ID NO: 454427 - RNA, 64 nt, Human; identical to SEQ ID NO: 450278

SEQ ID NO: 454428 - RNA, 64 nt, Human; identical to SEQ ID NO: 450279

SEQ ID NO: 454429 - RNA, 64 nt, Human; identical to SEQ ID NO: 450280

SEQ ID NO: 454430 - RNA, 64 nt, Human; identical to SEQ ID NO: 450281

SEQ ID NO: 454431 - RNA, 64 nt, Human; identical to SEQ ID NO: 450285

SEQ ID NO: 454432 - RNA, 64 nt, Human; identical to SEQ ID NO: 450286

SEQ ID NO: 454433 - RNA, 64 nt, Human; identical to SEQ ID NO: 450287

SEQ ID NO: 454434 - RNA, 64 nt, Human; identical to SEQ ID NO: 450288

SEQ ID NO: 454435 - RNA, 64 nt, Human; identical to SEQ ID NO: 450289

SEQ ID NO: 454436 - RNA, 61 nt, Human
uauuuguaguagcugcauuugucauuaauaagagagacauaauccuccuguuauacucagu

SEQ ID NO: 454437 - RNA, 61 nt, Human
agcacugagaggauggccugaacugaguggagagagacagaccaggaccaaaccaugcaga

SEQ ID NO: 454438 - RNA, 61 nt, Human
caggcaggacggcaggggugagcagcuuugggagagacaccuggccuuuuucuccuggagc

SEQ ID NO: 454439 - RNA, 64 nt, Human; identical to SEQ ID NO: 450290

SEQ ID NO: 454440 - RNA, 64 nt, Human; identical to SEQ ID NO: 450291

SEQ ID NO: 454441 - RNA, 64 nt, Human; identical to SEQ ID NO: 450292

SEQ ID NO: 454442 - RNA, 64 nt, Human; identical to SEQ ID NO: 450293

SEQ ID NO: 454443 - RNA, 64 nt, Human; identical to SEQ ID NO: 450294

SEQ ID NO: 454444 - RNA, 64 nt, Human; identical to SEQ ID NO: 450295

SEQ ID NO: 454445 - RNA, 64 nt, Human; identical to SEQ ID NO: 450296

SEQ ID NO: 454446 - RNA, 64 nt, Human; identical to SEQ ID NO: 450297

SEQ ID NO: 454447 - RNA, 64 nt, Human; identical to SEQ ID NO: 450298

SEQ ID NO: 454448 - RNA, 64 nt, Human; identical to SEQ ID NO: 450299

SEQ ID NO: 454449 - RNA, 64 nt, Human; identical to SEQ ID NO: 450303

SEQ ID NO: 454450 - RNA, 64 nt, Human; identical to SEQ ID NO: 450304

SEQ ID NO: 454451 - RNA, 64 nt, Human; identical to SEQ ID NO: 450305

SEQ ID NO: 454452 - RNA, 64 nt, Human; identical to SEQ ID NO: 450306

SEQ ID NO: 454453 - RNA, 64 nt, Human; identical to SEQ ID NO: 450307

SEQ ID NO: 454454 - RNA, 61 nt, Human
auaggaugugaggugagcaugagcuugagcugagagacagacacaacaguaucugaaaaga

SEQ ID NO: 454455 - RNA, 61 nt, Human
agcgccuuugucugucuaucuggugacaagagagagacaaguaaaugggggccguugggac

SEQ ID NO: 454456 - RNA, 61 nt, Human
cacuuucucagaagcccguggcccugcugacgagagacagcccacccccagccugcaagag

SEQ ID NO: 454457 - RNA, 64 nt, Human; identical to SEQ ID NO: 450308

SEQ ID NO: 454458 - RNA, 64 nt, Human; identical to SEQ ID NO: 450309

SEQ ID NO: 454459 - RNA, 64 nt, Human; identical to SEQ ID NO: 450310

SEQ ID NO: 454460 - RNA, 64 nt, Human; identical to SEQ ID NO: 450311

SEQ ID NO: 454461 - RNA, 64 nt, Human; identical to SEQ ID NO: 450312

SEQ ID NO: 454462 - RNA, 64 nt, Human; identical to SEQ ID NO: 450313

SEQ ID NO: 454463 - RNA, 64 nt, Human; identical to SEQ ID NO: 450314

SEQ ID NO: 454464 - RNA, 64 nt, Human; identical to SEQ ID NO: 450315

SEQ ID NO: 454465 - RNA, 64 nt, Human; identical to SEQ ID NO: 450316

SEQ ID NO: 454466 - RNA, 64 nt, Human; identical to SEQ ID NO: 450317

SEQ ID NO: 454467 - RNA, 64 nt, Human; identical to SEQ ID NO: 450321

SEQ ID NO: 454468 - RNA, 64 nt, Human; identical to SEQ ID NO: 450322

SEQ ID NO: 454469 - RNA, 64 nt, Human; identical to SEQ ID NO: 450323

SEQ ID NO: 454470 - RNA, 64 nt, Human; identical to SEQ ID NO: 450324

SEQ ID NO: 454471 - RNA, 64 nt, Human; identical to SEQ ID NO: 450325

SEQ ID NO: 454472 - RNA, 61 nt, Human
uaucugaagacaaacucauuuaaucaucuuugagagacaaaaugaccucugcaaacagaau

SEQ ID NO: 454473 - RNA, 61 nt, Human
uucacuuauacaacauagucagucuagaguugagagacaaagguaauuauaaaccuauuug

SEQ ID NO: 454474 - RNA, 61 nt, Human
cuguuguuccugucaccccuaauuaauaugugagagacaacagcuggguuuuccaucccua

SEQ ID NO: 454475 - RNA, 64 nt, Human; identical to SEQ ID NO: 450326

SEQ ID NO: 454476 - RNA, 64 nt, Human; identical to SEQ ID NO: 450327

SEQ ID NO: 454477 - RNA, 64 nt, Human; identical to SEQ ID NO: 450328

SEQ ID NO: 454478 - RNA, 64 nt, Human; identical to SEQ ID NO: 450329

SEQ ID NO: 454479 - RNA, 64 nt, Human; identical to SEQ ID NO: 450330

SEQ ID NO: 454480 - RNA, 64 nt, Human; identical to SEQ ID NO: 450331

SEQ ID NO: 454481 - RNA, 64 nt, Human; identical to SEQ ID NO: 450332

SEQ ID NO: 454482 - RNA, 64 nt, Human; identical to SEQ ID NO: 450333

SEQ ID NO: 454483 - RNA, 64 nt, Human; identical to SEQ ID NO: 450334

SEQ ID NO: 454484 - RNA, 64 nt, Human; identical to SEQ ID NO: 450335

SEQ ID NO: 454485 - RNA, 64 nt, Human; identical to SEQ ID NO: 450339

SEQ ID NO: 454486 - RNA, 64 nt, Human; identical to SEQ ID NO: 450340

SEQ ID NO: 454487 - RNA, 64 nt, Human; identical to SEQ ID NO: 450341

SEQ ID NO: 454488 - RNA, 64 nt, Human; identical to SEQ ID NO: 450342

SEQ ID NO: 454489 - RNA, 64 nt, Human; identical to SEQ ID NO: 450343

SEQ ID NO: 454490 - RNA, 61 nt, Human
ucaaauaggcuugguggccuguggaaaagaagagagacagagagacagugucugaaacagg

SEQ ID NO: 454491 - RNA, 61 nt, Human
gcuugguggccuguggaaaagaagagagacagagagacagugucugaaacaggauggcaga

SEQ ID NO: 454492 - RNA, 61 nt, Human
aaagaacauccugguguagccagaccucucugagagacauggauaucacaggaugaaggua

SEQ ID NO: 454493 - RNA, 64 nt, Human; identical to SEQ ID NO: 450344

SEQ ID NO: 454494 - RNA, 64 nt, Human; identical to SEQ ID NO: 450345

SEQ ID NO: 454495 - RNA, 64 nt, Human; identical to SEQ ID NO: 450346

SEQ ID NO: 454496 - RNA, 64 nt, Human; identical to SEQ ID NO: 450347

SEQ ID NO: 454497 - RNA, 64 nt, Human; identical to SEQ ID NO: 450348

SEQ ID NO: 454498 - RNA, 64 nt, Human; identical to SEQ ID NO: 450349

SEQ ID NO: 454499 - RNA, 64 nt, Human; identical to SEQ ID NO: 450350

SEQ ID NO: 454500 - RNA, 64 nt, Human; identical to SEQ ID NO: 450351

SEQ ID NO: 454501 - RNA, 64 nt, Human; identical to SEQ ID NO: 450352

SEQ ID NO: 454502 - RNA, 64 nt, Human; identical to SEQ ID NO: 450353

SEQ ID NO: 454503 - RNA, 64 nt, Human; identical to SEQ ID NO: 450357

SEQ ID NO: 454504 - RNA, 64 nt, Human; identical to SEQ ID NO: 450358

SEQ ID NO: 454505 - RNA, 64 nt, Human; identical to SEQ ID NO: 450359

SEQ ID NO: 454506 - RNA, 64 nt, Human; identical to SEQ ID NO: 450360

SEQ ID NO: 454507 - RNA, 64 nt, Human; identical to SEQ ID NO: 450361

SEQ ID NO: 454508 - RNA, 61 nt, Human
aauguaaaguuugaccuuuuuaaaacgaaaagagagacaaagucucagcacauuccaagga

SEQ ID NO: 454509 - RNA, 61 nt, Human
aagcgacccucgucuaaagaggcagcugagugagagacacagagagaaggagaaagaggga

SEQ ID NO: 454510 - RNA, 61 nt, Human
gguggccggaacucgcggucacaguacuggagagagacacacagaucuaagucgggggcca

SEQ ID NO: 454511 - RNA, 64 nt, Human; identical to SEQ ID NO: 450362

SEQ ID NO: 454512 - RNA, 64 nt, Human; identical to SEQ ID NO: 450363

SEQ ID NO: 454513 - RNA, 64 nt, Human; identical to SEQ ID NO: 450364

SEQ ID NO: 454514 - RNA, 64 nt, Human; identical to SEQ ID NO: 450365

SEQ ID NO: 454515 - RNA, 64 nt, Human; identical to SEQ ID NO: 450366

SEQ ID NO: 454516 - RNA, 64 nt, Human; identical to SEQ ID NO: 450367

SEQ ID NO: 454517 - RNA, 64 nt, Human; identical to SEQ ID NO: 450368

SEQ ID NO: 454518 - RNA, 64 nt, Human; identical to SEQ ID NO: 450369

SEQ ID NO: 454519 - RNA, 64 nt, Human; identical to SEQ ID NO: 450370

SEQ ID NO: 454520 - RNA, 64 nt, Human; identical to SEQ ID NO: 450371

SEQ ID NO: 454521 - RNA, 64 nt, Human; identical to SEQ ID NO: 450375

SEQ ID NO: 454522 - RNA, 64 nt, Human; identical to SEQ ID NO: 450376

SEQ ID NO: 454523 - RNA, 64 nt, Human; identical to SEQ ID NO: 450377

SEQ ID NO: 454524 - RNA, 58 nt, Human; identical to SEQ ID NO: 381604

SEQ ID NO: 454525 - RNA, 64 nt, Human; identical to SEQ ID NO: 450379

SEQ ID NO: 454526 - RNA, 61 nt, Human
uuuuuuuuuaagcgucuugaaugguuuucuggagagacagcauugguaaguggcacaugac

SEQ ID NO: 454527 - RNA, 61 nt, Human
gagaggcugcgggcuggcggcagucccaggggagagacaccacagaaggagacccagacau

SEQ ID NO: 454528 - RNA, 61 nt, Human
uuaugugggacccauuccucaccaaaaugaggagagacagugacuguuccugccacagucc

SEQ ID NO: 454529 - RNA, 64 nt, Human; identical to SEQ ID NO: 450380

SEQ ID NO: 454530 - RNA, 64 nt, Human; identical to SEQ ID NO: 450381

SEQ ID NO: 454531 - RNA, 64 nt, Human; identical to SEQ ID NO: 450382

SEQ ID NO: 454532 - RNA, 64 nt, Human; identical to SEQ ID NO: 450383

SEQ ID NO: 454533 - RNA, 64 nt, Human; identical to SEQ ID NO: 450384

SEQ ID NO: 454534 - RNA, 64 nt, Human; identical to SEQ ID NO: 450384

SEQ ID NO: 454535 - RNA, 64 nt, Human; identical to SEQ ID NO: 450386

SEQ ID NO: 454536 - RNA, 64 nt, Human; identical to SEQ ID NO: 450387

SEQ ID NO: 454537 - RNA, 64 nt, Human; identical to SEQ ID NO: 450388

SEQ ID NO: 454538 - RNA, 64 nt, Human; identical to SEQ ID NO: 450389

SEQ ID NO: 454539 - RNA, 64 nt, Human; identical to SEQ ID NO: 450393

SEQ ID NO: 454540 - RNA, 64 nt, Human; identical to SEQ ID NO: 450394

SEQ ID NO: 454541 - RNA, 64 nt, Human; identical to SEQ ID NO: 450395

SEQ ID NO: 454542 - RNA, 64 nt, Human; identical to SEQ ID NO: 450396

SEQ ID NO: 454543 - RNA, 64 nt, Human; identical to SEQ ID NO: 450397

SEQ ID NO: 454544 - RNA, 61 nt, Human
ccuccaucuggcguggggauauuccaggcaugagagacaugucauauucaacagggcacau

SEQ ID NO: 454545 - RNA, 61 nt, Human
caccagaaccauuuggccuuaauuccaaugugagagacagaaucccuggggugcuggacug

SEQ ID NO: 454546 - RNA, 61 nt, Human
agaggcugagccccccaacauccaaggacaggagagacauggaguggcgcuggacagucac

SEQ ID NO: 454547 - RNA, 64 nt, Human; identical to SEQ ID NO: 450398

SEQ ID NO: 454548 - RNA, 64 nt, Human; identical to SEQ ID NO: 450399

SEQ ID NO: 454549 - RNA, 64 nt, Human; identical to SEQ ID NO: 450400

SEQ ID NO: 454550 - RNA, 64 nt, Human; identical to SEQ ID NO: 450401

SEQ ID NO: 454551 - RNA, 64 nt, Human; identical to SEQ ID NO: 450402

SEQ ID NO: 454552 - RNA, 64 nt, Human; identical to SEQ ID NO: 450403

SEQ ID NO: 454553 - RNA, 64 nt, Human; identical to SEQ ID NO: 450404

SEQ ID NO: 454554 - RNA, 64 nt, Human; identical to SEQ ID NO: 450405

SEQ ID NO: 454555 - RNA, 64 nt, Human; identical to SEQ ID NO: 450406

SEQ ID NO: 454556 - RNA, 64 nt, Human; identical to SEQ ID NO: 450407

SEQ ID NO: 454557 - RNA, 64 nt, Human; identical to SEQ ID NO: 450411

SEQ ID NO: 454558 - RNA, 64 nt, Human; identical to SEQ ID NO: 450412

SEQ ID NO: 454559 - RNA, 64 nt, Human; identical to SEQ ID NO: 450413

SEQ ID NO: 454560 - RNA, 64 nt, Human; identical to SEQ ID NO: 450414

SEQ ID NO: 454561 - RNA, 64 nt, Human; identical to SEQ ID NO: 450415

SEQ ID NO: 454562 - RNA, 61 nt, Human
ccuggcccauagaaacaugacacugaccuuggagagacacagcgucccuagcagugaacua

SEQ ID NO: 454563 - RNA, 61 nt, Human
cgggaaaggaucaucgccguugaaaugaaaagagagacagagagaaaaaaaaaaagagaac

SEQ ID NO: 454564 - RNA, 61 nt, Human
gcugucucuccaggcacggggugucaggagggagagacagccuggguaugggcaagaaaug

SEQ ID NO: 454565 - RNA, 64 nt, Human; identical to SEQ ID NO: 450416

SEQ ID NO: 454566 - RNA, 64 nt, Human; identical to SEQ ID NO: 450417

SEQ ID NO: 454567 - RNA, 64 nt, Human; identical to SEQ ID NO: 450418

SEQ ID NO: 454568 - RNA, 64 nt, Human; identical to SEQ ID NO: 450419

SEQ ID NO: 454569 - RNA, 64 nt, Human; identical to SEQ ID NO: 450420

SEQ ID NO: 454570 - RNA, 64 nt, Human; identical to SEQ ID NO: 450421

SEQ ID NO: 454571 - RNA, 64 nt, Human; identical to SEQ ID NO: 450422

SEQ ID NO: 454572 - RNA, 64 nt, Human; identical to SEQ ID NO: 450423

SEQ ID NO: 454573 - RNA, 64 nt, Human; identical to SEQ ID NO: 450424

SEQ ID NO: 454574 - RNA, 64 nt, Human; identical to SEQ ID NO: 450425

SEQ ID NO: 454575 - RNA, 64 nt, Human; identical to SEQ ID NO: 450429

SEQ ID NO: 454576 - RNA, 64 nt, Human; identical to SEQ ID NO: 450430

SEQ ID NO: 454577 - RNA, 64 nt, Human; identical to SEQ ID NO: 450431

SEQ ID NO: 454578 - RNA, 64 nt, Human; identical to SEQ ID NO: 450432

SEQ ID NO: 454579 - RNA, 64 nt, Human; identical to SEQ ID NO: 450433

SEQ ID NO: 454580 - RNA, 61 nt, Human
gaaagauccaaacuaauauugcuguaaaaaggagagacaaauuaauauagcuuauucuaua

SEQ ID NO: 454581 - RNA, 61 nt, Human
cuucccugccucugcuccuugggagcggguggagagacacccauguggcuccccuuagggc

SEQ ID NO: 454582 - RNA, 61 nt, Human
cggccacacuuggugcucccagcaucccagggagagacacagcccacugaacaaggucuca

SEQ ID NO: 454583 - RNA, 64 nt, Human; identical to SEQ ID NO: 450434

SEQ ID NO: 454584 - RNA, 64 nt, Human; identical to SEQ ID NO: 450435

SEQ ID NO: 454585 - RNA, 64 nt, Human; identical to SEQ ID NO: 450436

SEQ ID NO: 454586 - RNA, 64 nt, Human
caugugccuguuucugccauguaaggaaggcucuucuagcaauacuagaucccacugagaaaau

SEQ ID NO: 454587 - RNA, 64 nt, Human
uuaaaacgugcaagaaaaaaauaaaauacucugcucuagcaaguuuuguguaacaaaggcauau

SEQ ID NO: 454588 - RNA, 64 nt, Human
acccuauuuaaaacugggucaucauuuguccuguucuagcaagauagucuucaguuucauuuuc

SEQ ID NO: 454589 - RNA, 64 nt, Human
gcugcaauacacaguguuauucuggggaaauaaaucuagcaaagccucgccuuccaugccgagc

SEQ ID NO: 454590 - RNA, 64 nt, Human
uaaauauaccucagcuuagacuugggcugcuccuucuagcaaagcaggcuccaguggggccuca

SEQ ID NO: 454591 - RNA, 64 nt, Human
cagaagaaaaacaagccuccucguccuagucuuuucuagcaaagggauaaaacuuagauggcag

SEQ ID NO: 454592 - RNA, 64 nt, Human
uuagugaaguugugcaacggccaggguugugcuuucuagcaaauaugcuguuauguccagaaau

SEQ ID NO: 454593 - RNA, 64 nt, Human
aagucuauuuaaaacuguagcaguaguuuacaguucuagcaaagaggaaaguugugggguuaaa

SEQ ID NO: 454594 - RNA, 64 nt, Human
ugcugucuguugaugacgugugugcaaagcaggcucuagcaacaugaucacuguccuugccuuc

SEQ ID NO: 454595 - RNA, 64 nt, Human
guuuuuugggggaaaauuuuuuuaaauggaagcuucuagcaagccccccaccccaaucaaccuc

SEQ ID NO: 454596 - RNA, 61 nt, Human
cugagauuacuuuugggguaauauuuaaaaugagagacauuuuguaacccuguaaaauaca

SEQ ID NO: 454597 - RNA, 61 nt, Human
cuuugcccgggggcagacuuagaaggaaggggagagacaaagggggacugaguuucauccc

SEQ ID NO: 454598 - RNA, 61 nt, Human
uguguccagcaaggaguuuacagucaaacaggagagacaugccuguaguuacauccagugu

SEQ ID NO: 454599 - RNA, 64 nt, Human
aagaucagaacccccacucacccccaagaucuuaucuagcaagccuguaguauucaguuucugu

SEQ ID NO: 454600 - RNA, 64 nt, Human
agccuucccaguugacugaaagaugaggcuaggcucuagcaaguugaagucaaaccagcuccuu

SEQ ID NO: 454601 - RNA, 64 nt, Human
acuugaggcuggagcucccucuguuaccuuuccaucuagcaaguucccaaaggcaagacucucu

SEQ ID NO: 454602 - RNA, 64 nt, Human
aacaguaccuuagguucuuucugaaaaggagguaucuagcaauggauaaauagauaccacugaa

SEQ ID NO: 454603 - RNA, 64 nt, Human
acacuagguuccugcacuuuuugguaacuuuaugucuagcaaauauuuuaugccaagaaaagca

SEQ ID NO: 454604 - RNA, 64 nt, Human
guuguucucaacuuaggaaguaauuuuggugugaucuagcaaaagaguaggaaucagcgauaca

SEQ ID NO: 454605 - RNA, 64 nt, Human
guuguguauaauacgguauuauacccgcaugugcucuagcaaggauaccaaggcaagcauacau

SEQ ID NO: 454606 - RNA, 64 nt, Human
caaucccaggcagcuuguguguacaaucagcuucucuagcaacucuguaucuguuggcuucaag

SEQ ID NO: 454607 - RNA, 64 nt, Human
acucaccuguaugaccagguugccaguguacuggucuagcaacauagggaaaugauccauaugg

SEQ ID NO: 454608 - RNA, 64 nt, Human
acaccucguguauuauaggacucacgggaugccaucuagcaaguggagaaauagcaguccauuu

SEQ ID NO: 454609 - RNA, 64 nt, Human
gaguguuucugagacuuugaucaccugaacuuucucuagcaaguguaagcagaauggagugugg

SEQ ID NO: 454610 - RNA, 64 nt, Human
ugucuggcuguacgucugguguucucaaugcuuuucuagcaacuguuggauaauaacuagaucu

SEQ ID NO: 454611 - RNA, 64 nt, Human
aauaaaaacucuuaaggcaacucacugauuuacuucuagcaauagcaugauguuacaggaauau

SEQ ID NO: 454612 - RNA, 64 nt, Human
aggaugcugagugagcaguuuccuaccccguggaucuagcaagccauggagacagguagcauuu

SEQ ID NO: 454613 - RNA, 64 nt, Human
uuugaugaaccaauucacaagaggcuaggcccucucuagcaaaguuaugggcugcuuuacugaa

SEQ ID NO: 454614 - RNA, 61 nt, Human
uguaaauaaauguauauguuuuauaauucuggagagacauaaggaguccuacccguugagg

SEQ ID NO: 454615 - RNA, 61 nt, Human
aauacugccggucacccaggcucuggagccagagagacagaccgggguucaagccauggcu

SEQ ID NO: 454616 - RNA, 61 nt, Human
cccgugccuccccuucccaauguggccuauggagagacaggccuuucucucagccucugga

SEQ ID NO: 454617 - RNA, 64 nt, Human
gagcuuacacucugagcaccuuguuuuagcgaacucuagcaaaacuuguuuagcuuagcaaaaa

SEQ ID NO: 454618 - RNA, 64 nt, Human
cagggcaccuccauggcuccauuauuaacacaacucuagcaauuauggaccauaagcacuuccc

SEQ ID NO: 454619 - RNA, 64 nt, Human
uaaaacuuacaacacuccgaguucugcuuuauucucuagcaauccacaguacaagaacaagcaa

SEQ ID NO: 454620 - RNA, 64 nt, Human
uauagccaaccuguggucuggcagaaacaacgucucuagcaauaguaccaaaguaaguaaugga

SEQ ID NO: 454621 - RNA, 64 nt, Human
gaggguccuuugggaaaggagaaguuaagcaacaucuagcaaauguuaugcauaaagucagugc

SEQ ID NO: 454622 - RNA, 64 nt, Human
cuaucuauuugaggaaacugaggaccucggaaucucuagcaagggcucaacuucgaaaauggca

SEQ ID NO: 454623 - RNA, 64 nt, Human
cauaauaaucaaacggugauucaucuaaaugacuucuagcaaccuaaguaaaaacauuccccuc

SEQ ID NO: 454624 - RNA, 64 nt, Human
cccaguugcuggcauucauauguacaggauuuguucuagcaagcuaugcuucaguaugugguug

SEQ ID NO: 454625 - RNA, 64 nt, Human
aauuuaauguuuuuucuuuguaccugaugugaauucuagcaaccuuuguuaggaaaaagcacag

SEQ ID NO: 454626 - RNA, 64 nt, Human
agagaacgcagcccuagagccugccuggagcguuucuagcaagugagagagaugggagcuccuc

SEQ ID NO: 454627 - RNA, 64 nt, Human
uauuaucuugcccuuuugaacauuuaccauguacucuagcaagacuggucccucuguucuauga

SEQ ID NO: 454628 - RNA, 64 nt, Human
auagccacgccaccuuggccuucaaugacagggaucuagcaaugcugcaucaucagccuuccaa

SEQ ID NO: 454629 - RNA, 64 nt, Human
ccccaaggaaacgaacaaaaugaacucuagaauaucuagcaaauaguuaaagaagcaauuuauu

SEQ ID NO: 454630 - RNA, 64 nt, Human
uuacuggacauaacauuuucagaauaguuggucaucuagcaaccgccucaaaauguguaagcag

SEQ ID NO: 454631 - RNA, 64 nt, Human
accugguguuacauuuaauauuuaauguaacuggucuagcaacauuaagggggauuucugaagc

SEQ ID NO: 454632 - RNA, 61 nt, Human
cgaccuuggcuaucagacuugaaauauucacgagagacaauaaacgcugaaaggccagugc

SEQ ID NO: 454633 - RNA, 61 nt, Human
gacuggaguuuuuccagcuggggugggaguggagagacaacaggaacaacgcugcaccaaa

SEQ ID NO: 454634 - RNA, 61 nt, Human
guacugcaaagagugaacuauauaugagauagagagacaauaauuucuugcaaaaaaaaaa

SEQ ID NO: 454635 - RNA, 64 nt, Human
cagggaccguguucuuagguucuuagucugugaaucuagcaauaggcaguccagauuucugagu

SEQ ID NO: 454636 - RNA, 64 nt, Human
gagugugcauuugcuaugcuuuaccugucuggcaucuagcaaacauucuucacauguuugcugu

SEQ ID NO: 454637 - RNA, 64 nt, Human
uaagcuuuuuauauugacauugccauugaauagcucuagcaacuauuauuauucccccaaaccc

SEQ ID NO: 454638 - RNA, 64 nt, Human
aagugggugugcccauagggccugggcacgugucucuagcaaaaccagggccugagcauaagaa

SEQ ID NO: 454639 - RNA, 64 nt, Human
cuucucagaucuauaaugggauacauugucauccucuagcaacuccuauauagaaaguuuuaac

SEQ ID NO: 454640 - RNA, 64 nt, Human
ccucugccuaggaggcuguaugccagagcucaucucuagcaaggaauuuaucuucaggugaaga

SEQ ID NO: 454641 - RNA, 64 nt, Human
aaaaggaacaauuaauauauaugcuacuggacauucuagcaagguaauuguaguuuaguuuuaa

SEQ ID NO: 454642 - RNA, 64 nt, Human
cacccaagucgcuggagccauucacucuggagauucuagcaagaagugccaagauuggcuuggc

SEQ ID NO: 454643 - RNA, 64 nt, Human
guugacuagaaacugccuuuuucuccacuucauuucuagcaauuauuuaccaaguaccaacagu

SEQ ID NO: 454644 - RNA, 64 nt, Human
aaugaauuuuaguuugguucacuuacagauaguaucuagcaaucacaacacuggcugagcggau

SEQ ID NO: 454645 - RNA, 64 nt, Human
cagaacaacccucuguaaauuauuaauuuaucucucuagcaacuuaauuuugugcacauucuaa

SEQ ID NO: 454646 - RNA, 64 nt, Human
aaucaugugggcucugaaauuguucuuuuaugugucuagcaaguauuuaauaaacccuuguaua

SEQ ID NO: 454647 - RNA, 64 nt, Human
acauuuuaaaauuaucuauggcuguuuuaaauugucuagcaauuuauaugguugugguuaacuc

SEQ ID NO: 454648 - RNA, 64 nt, Human
uugcugguuugaaagauuaugaugcauacaguuuucuagcaauuuucuuuguuucuuuuuacag

SEQ ID NO: 454649 - RNA, 64 nt, Human
aacuuuaaucagucugcacauccuguuucuaauaucuagcaacauuauauucuuucagacauuu

SEQ ID NO: 454650 - RNA, 61 nt, Human
augcuguguuugagcuuucaugaguuucccagagagacauagcuggaaaauuccuauugau

SEQ ID NO: 454651 - RNA, 61 nt, Human
acuuauuaaguucgaacauguuucacuuaaggagagacaccuagcuuagucauggcaaguu

SEQ ID NO: 454652 - RNA, 61 nt, Human
aauauaaauauuugguaauucuguguaacaagagagacauggaaaaggaaaaaaauccacu

SEQ ID NO: 454653 - RNA, 64 nt, Human
cauggugucuucagaauuguagcgcauuucugaaucuagcaaauccuccuuuuacccguugaau

SEQ ID NO: 454654 - RNA, 64 nt, Human
uugguauaauuguaaauaaugucaaacuccauuuucuagcaaguauuaauaauuaagggaagua

SEQ ID NO: 454655 - RNA, 64 nt, Human
uucuggucuuuucuuccacuucugcagaauuuccucuagcaaauacuucuuucuccuugcuugc

SEQ ID NO: 454656 - RNA, 64 nt, Human
ggugacaguuccuuauuggugugugugagauuacucuagcaacuauuacaguauaacacagaug

SEQ ID NO: 454657 - RNA, 64 nt, Human
agaggauuuaaaccagaauguuaggaauaguuauucuagcaagaugaauguggaaaguguuagu

SEQ ID NO: 454658 - RNA, 64 nt, Human
caaaacugacaguaaaucucacaaaugaucgcuaucuagcaacccuaacaguaagaaaucuugu

SEQ ID NO: 454659 - RNA, 64 nt, Human
acugaaauacagcagcccgucauugacaggcuggucuagcaauguuaaguauauuuacagaaua

SEQ ID NO: 454660 - RNA, 64 nt, Human
cauagcugacuucgcuaaaguuacuucaucuccaucuagcaaaugaggcacuguucucaaccaa

SEQ ID NO: 454661 - RNA, 64 nt, Human
guucaaggaaaguucuucucaguguaaugaacugucuagcaauauuauaguuauucuugaaagu

SEQ ID NO: 454662 - RNA, 64 nt, Human
agugacuugaguguuuuaguuaugcauaaguauuucuagcaaaggaaggguagaaaggaauuga

SEQ ID NO: 454663 - RNA, 64 nt, Human
ggaccaagucacccgucgugcugggaguguggauucuagcaaaagagcuggaaaaaagucagac

SEQ ID NO: 454664 - RNA, 64 nt, Human
accauccuaaaggguuuuuaagcccuaacacuugucuagcaaauggagagccuaauuuaccaaa

SEQ ID NO: 454665 - RNA, 64 nt, Human
aacccaggccugaugggaaaaaugauuccuuuauucuagcaacuuacuuucuguugguauggga

SEQ ID NO: 454666 - RNA, 64 nt, Human
aauuaucugacgaguaucugaaggcauuuucagcucuagcaauuuauuuauaauauauaaguuc

SEQ ID NO: 454667 - RNA, 64 nt, Human
uuuagauaaacaagagacauuuucauaauugcuuucuagcaaucagcuuuuauuugccuuaaua

SEQ ID NO: 454668 - RNA, 61 nt, Human
uuuugaaaaauaaucaaagauagcauucauugagagacagugacagauauaauuuacuaca

SEQ ID NO: 454669 - RNA, 61 nt, Human
uggcaucaaguuucuugcagcugcucugagggagagacagugagcugcaagacugccuccc

SEQ ID NO: 454670 - RNA, 61 nt, Human
cagaaagagaaugaaugacagaaaaaaaaaagagagacaaacucuaggaacaaugccgauu

SEQ ID NO: 454671 - RNA, 64 nt, Human
ggccucuguccucuuuuagucuagugucugguuuucuagcaaacaguaaauuuaaacaaguaaa

SEQ ID NO: 454672 - RNA, 64 nt, Human
uccaacguguguaucuacagcuuuucaaaaaaucucuagcaaugguaaaguucaguuguuuuua

SEQ ID NO: 454673 - RNA, 64 nt, Human
auuaaaaugggaucauacacagaagauagaaaaaucuagcaaaacuucucuuucuguaagccag

SEQ ID NO: 454674 - RNA, 64 nt, Human
cagacagacagacacgcacacacacccaucucugucuagcaagcagccuccuaagauagcuguu

SEQ ID NO: 454675 - RNA, 64 nt, Human
aagccagggcgugguuucuaguuccaguuuugcuucuagcaaguggacccaucaauagacccau

SEQ ID NO: 454676 - RNA, 64 nt, Human
aaaccaaauuaucccacccucauggagcuuauauucuagcaaggggagauggauaugauagauu

SEQ ID NO: 454677 - RNA, 64 nt, Human
ucauauuuuagcuggccacaaaaccaagaacauaucuagcaagaaaacuugaaaaaguauaagc

SEQ ID NO: 454678 - RNA, 64 nt, Human
cacaucucacaaauaacaggggugaauguuucucucuagcaaucuaggcaggugcugguguuuc

SEQ ID NO: 454679 - RNA, 64 nt, Human
uuaguggccuaacccagggucaaauacagcucuuucuagcaaaaucaggcagcucugccccauc

SEQ ID NO: 454680 - RNA, 64 nt, Human
uaaauuuuacauguagaaacauaaaaaaguaauuucuagcaagcacuugacaucuuacuggcuu

SEQ ID NO: 454681 - RNA, 64 nt, Human
uucuuuuaugcagauaaaauuauuuuacugaagaucuagcaauggccuuaauuagcaacuggug

SEQ ID NO: 454682 - RNA, 64 nt, Human
acagaacauaucuucacauuagaguuaagaauucucuagcaaacaacagauuuuuuuguuguug

SEQ ID NO: 454683 - RNA, 64 nt, Human
uguuuuccaugaaagguauacaaaugaagaauuuucuagcaaaacauguuuuuaaccaucagug

SEQ ID NO: 454684 - RNA, 64 nt, Human
agaugcuuggagcaaucagaacuucaggugugacucuagcaaggcucaucuuucugcccggcua

SEQ ID NO: 454685 - RNA, 64 nt, Human
uucucuuucuuguagaaggagagaaaccaugcucucuagcaacauugagcaaaaaucauaacca

SEQ ID NO: 454686 - RNA, 61 nt, Human
ggguaaaaucuaagaccugcacaagggcagugagagacauuuacagccuccucucuauuug

SEQ ID NO: 454687 - RNA, 61 nt, Human
ugcauaagccugggaugcugguggaggacuggagagacauggcagaugcuaccugcacacu

SEQ ID NO: 454688 - RNA, 61 nt, Human
ucaguaccuaguuuuauuaaauauuacacuugagagacacuuuuuaaaaauguguuaaugu

SEQ ID NO: 454689 - RNA, 64 nt, Human
ugagacaaaauuuaaugcacaacagugaguuggaucuagcaauaaagucuccuugguacugaaa

SEQ ID NO: 454690 - RNA, 64 nt, Human
auagguuuugggggagaccaagaacguuaacauuucuagcaaguuuccaggugaugcuguuguu

SEQ ID NO: 454691 - RNA, 64 nt, Human
uacuuucuggaaguggaguugacucuggaaguuuucuagcaacugaacaaaagcucagguuugu

SEQ ID NO: 454692 - RNA, 64 nt, Human
ucuagugccugccaagugauggauuauaauggucucuagcaaaugugugguaaacauucauaug

SEQ ID NO: 454693 - RNA, 64 nt, Human
gggcauuuuucuuuuaaugaaauauguggacugcucuagcaaacccuauuuucagcuacuauuu

SEQ ID NO: 454694 - RNA, 64 nt, Human
gaaaugcuaauggagauuugcugguacauaggaaucuagcaaauucaggaaccaaggggaaaug

SEQ ID NO: 454695 - RNA, 64 nt, Human
gauuucacaauuuaaauaguuauuuuaaugauuuucuagcaaauaauagagaauaauguuuaug

SEQ ID NO: 454696 - RNA, 64 nt, Human
cugaaaagaaaugcuaauguaaucauuuaucuuaucuagcaagaagauucuaaaacauucuuua

SEQ ID NO: 454697 - RNA, 64 nt, Human
aacuuugaaccuuauguaccgagcaaaugccaggucuagcaaacauaaugcuaguccuagauua

SEQ ID NO: 454698 - RNA, 64 nt, Human
ucgaacagauuugacaaggguagccagcuuggagucuagcaacuugccaauguguuuaccaauc

SEQ ID NO: 454699 - RNA, 64 nt, Human
aaauacggacguacuuugugcugggaacucuacaucuagcaauuucucuuuaaaaccauaucag

SEQ ID NO: 454700 - RNA, 64 nt, Human
uugcagagguacuuuucuugauuaaauagccuucucuagcaacaucauuuucagacuaacuaaa

SEQ ID NO: 454701 - RNA, 64 nt, Human
gagaucuuagagaggaaauauaaccggugugagaucuagcaaugcauuuugaaucuucacuccc

SEQ ID NO: 454702 - RNA, 64 nt, Human
cucacucucuaggucuccaggguaggaguguuuuucuagcaagaaucuuagucaggaguaagcu

SEQ ID NO: 454703 - RNA, 64 nt, Human
gaggaaaaucuucauuuguuggaaaugaaaacguucuagcaacuguauaaaagcguugggcaug

SEQ ID NO: 454704 - RNA, 61 nt, Human
cacugccuccagagaggugggugccuggguugagagacacagcugcuacgugauagauguu

SEQ ID NO: 454705 - RNA, 61 nt, Human
acugcauccgcuaaaaauguuaaagcuucuugagagacagacaugccagauuuucuuggua

SEQ ID NO: 454706 - RNA, 61 nt, Human
accauuaugauucaaguuagauuuuccucuggagagacagaucugaauguucaguucuagc

SEQ ID NO: 454707 - RNA, 64 nt, Human
gaggauuuaccugguggggcacuuccagacuguuucuagcaauauacacacacguucuuuccug

SEQ ID NO: 454708 - RNA, 64 nt, Human
uuaauauagaacagagguguugaguugcaggauaucuagcaauuuaagaaaauguggaaaaaau

SEQ ID NO: 454709 - RNA, 64 nt, Human
acuucccuacaucucugaagggcuccaccauuccucuagcaaccaugcucucaaagcucagagg

SEQ ID NO: 454710 - RNA, 64 nt, Human
gacacauuugucccuuucagauauuuuaggauauucuagcaaagcaggccauuucucccaccug

SEQ ID NO: 454711 - RNA, 64 nt, Human
aaauuuguagcaucugauacaaagccagagacauucuagcaagugcagcagccccuucuuucuc

SEQ ID NO: 454712 - RNA, 64 nt, Human
uucugcccuuucaucuuuguaagagauucuugccucuagcaaugacaaccugugaugucucaca

SEQ ID NO: 454713 - RNA, 64 nt, Human
uucaucccugucuuuaaacuggggguauguccacucuagcaaguaaaaaaacuacuguuacacg

SEQ ID NO: 454714 - RNA, 64 nt, Human
ucucuugccccaaagauugggcuguaagccauuuucuagcaaaugucucuaugaagguuucuaa

SEQ ID NO: 454715 - RNA, 64 nt, Human
auccaaguagaauguacgccaggagcuccuucccucuagcaauuucuacuaaaauguccaagua

SEQ ID NO: 454716 - RNA, 64 nt, Human
guuuuuagccuggcuccguucugguguaacccggucuagcaaaagcuaagccuggauugcaggg

SEQ ID NO: 454717 - RNA, 64 nt, Human
ugaaauuuucagaugcuuugaacuugacacauacucuagcaauucauuggaacaccaaggcaaa

SEQ ID NO: 454718 - RNA, 64 nt, Human
agaaagagaaacuugucaacucauauccacguuaucuagcaaaguacauaagaaucuaucacua

SEQ ID NO: 454719 - RNA, 64 nt, Human
uuguauuuucaugacugaccuuaacuguacuuuuucuagcaagagaugcuuuauucugcagcau

SEQ ID NO: 454720 - RNA, 64 nt, Human
uuuucucgccgcaagaagcccauuccuauggaagucuagcaaagcaauacgacucagcccagca

SEQ ID NO: 454721 - RNA, 64 nt, Human
gauugugcugauaggucaguccagauagguggguucuagcaauuuccccaggggauuaaggggc

SEQ ID NO: 454722 - RNA, 61 nt, Human
ggccgccaggcacugagcuggagcccgccuggagagacagacacgugugaguggucaggca

SEQ ID NO: 454723 - RNA, 61 nt, Human
ccacuccccggcaugagacucagugcagauggagagacagcuacacagagcuuuggucugu

SEQ ID NO: 454724 - RNA, 61 nt, Human
ucugagcugugggauauuucuugcuuuaagagagagacagaaucucucacugaaacucaug

SEQ ID NO: 454725 - RNA, 64 nt, Human
ggggugagggucugucugagucuguuuuugcugcucuagcaagaucccugagacgggguaaguu

SEQ ID NO: 454726 - RNA, 64 nt, Human
cuuugccagcuaaucuuaacauuuagcagaaagcucuagcaacaugaucuuaauuguauccaga

SEQ ID NO: 454727 - RNA, 64 nt, Human
ucucaaaaccugggugagaagacuauuccuggacucuagcaacuucaaaacugaggcuggguuu

SEQ ID NO: 454728 - RNA, 64 nt, Human
ucaccauccaauuaucuacccaccugucuuccucucuagcaaucuauuuacuguuuaucaaucu

SEQ ID NO: 454729 - RNA, 64 nt, Human
aaaauugguucagaaagugcaaucuugccagauuucuagcaaauagguucaguguuaccauaag

SEQ ID NO: 454730 - RNA, 64 nt, Human
guugaugggagcuguugaaacagguaaacagcauucuagcaauccuucgacuuuugugauagca

SEQ ID NO: 454731 - RNA, 64 nt, Human
gcacuuacauuggggcacacaggaaaucccagugucuagcaaugguuugguuugcagagaacac

SEQ ID NO: 454732 - RNA, 64 nt, Human
gcauucccacgugcugucgaucuuuggaccaguuucuagcaaaguuguguuugaaagauacucu

SEQ ID NO: 454733 - RNA, 64 nt, Human
augagggguucuucacgauucuccuggaacccagucuagcaaaaugagaggaaaggcccuaggg

SEQ ID NO: 454734 - RNA, 64 nt, Human
uaugaaaguacagggacacggagccaagacagagucuagcaaagaaggggauuuuggaaggugc

SEQ ID NO: 454735 - RNA, 64 nt, Human
gcacaaaugcgaaagaggucaugucuucucaaaaucuagcaaaggaaguagucugcauuggugu

SEQ ID NO: 454736 - RNA, 64 nt, Human
cuugguaauuaaaugaagcuacacauuuggguaaucuagcaaaugaaguauuuuuucccucuug

SEQ ID NO: 454737 - RNA, 64 nt, Human
accaaaaugucugaguaacuucuuaaaucccuguucuagcaaacuaauauugguucaugugcuu

SEQ ID NO: 454738 - RNA, 64 nt, Human
aauacauuaaaauaacuaagcaaguauauuuauuucuagcaaacagauguuuguuuucaaaaua

SEQ ID NO: 454739 - RNA, 64 nt, Human
aacuuugaaccuuauguaccgagcaaaugcaaggucuagcaaauauaaugcuaguccuagauua

SEQ ID NO: 454740 - RNA, 61 nt, Human
ugggcuuucaggcuugacaugcuggucuggggagagacagggccucugcugcccuguucuu

SEQ ID NO: 454741 - RNA, 61 nt, Human
caugcaugugucuguguaugugugaaugugagagagacacagcccuccuuucagaaggaaa

SEQ ID NO: 454742 - RNA, 61 nt, Human
uuacaggccaguucuccagcucuccaucuuagagagacaggucaccuugcaggccugcuug

SEQ ID NO: 454743 - RNA, 64 nt, Human
ugcagcacaacaccauugcccggaggcuuccgaaucuagcaaagcagcauauuaaaugacucca

SEQ ID NO: 454744 - RNA, 64 nt, Human
ucccaacuuuagaggauggaaaggggcagaguaaucuagcaaaggagacugaggccagugaagu

SEQ ID NO: 454745 - RNA, 64 nt, Human
agcaaaaggaugauuuaacauuaccaaaugccuuucuagcaauugcuucucuaaaacagcacua

SEQ ID NO: 454746 - RNA, 63 nt, Human
gacgugugcacaaaaugugaccugaggcccuagucuagcaagaggacauagcacccucaucug

SEQ ID NO: 454747 - RNA, 64 nt, Human
acauuuuacguguagaagcauuuuaaaaaucauuucuagcaagcacuugacaucuagucagcuc

SEQ ID NO: 454748 - RNA, 64 nt, Human
cuuggcaugagaugauauuguacuuguauaggauucuagcaauucauaauaaauauguaagacu

SEQ ID NO: 454749 - RNA, 64 nt, Human
gguaaaggacaaguuguaagcuuggauuuuuaggucuagcaauacacuguuuacaagagcauca

SEQ ID NO: 454750 - RNA, 64 nt, Human
accauucaaaaacuuuuuuaaaaaguuuaaaguuucuagcaauaaauacaauugguacagacau

SEQ ID NO: 454751 - RNA, 64 nt, Human
ucauuggauuuuuguuuugguuuguuguugccauucuagcaaugagcuuaguccuuguacaucu

SEQ ID NO: 454752 - RNA, 64 nt, Human
auuccacacauuccuuauaucccuuuuuugcuugucuagcaaagcuuguuuguauauaugcacc

SEQ ID NO: 454753 - RNA, 64 nt, Human
gccuuuguuuauaaaaucuucaggaaugacauucucuagcaauaaaaggaaugaaccguuaugu

SEQ ID NO: 454754 - RNA, 64 nt, Human
guggacaucuggacauauuuauggacuuugaguaucuagcaaguagaaaggaaaaaaauauuca

SEQ ID NO: 454755 - RNA, 64 nt, Human
uccccuggcccauccucuccugcaguggaucaucucuagcaacaggucacacauugucaaacua

SEQ ID NO: 454756 - RNA, 64 nt, Human
cauuuggcaccacucucugaaacaacacagucacucuagcaaggcccccaaagggcccugguuu

SEQ ID NO: 454757 - RNA, 64 nt, Human
aauguauaauuuuaucccauuuuuaauauuuuggucuagcaacuugugauacauagaugacaau

SEQ ID NO: 454758 - RNA, 61 nt, Human
cugcaguggagauaaccaccuuugcgauaaugagagacagaccagaggacugcuacucuuu

SEQ ID NO: 454759 - RNA, 61 nt, Human
cuagucuacuugaaggaaguggagacauaaggagagacaaaaacagguuugugccauaaag

SEQ ID NO: 454760 - RNA, 61 nt, Human
uguacggagacauggcaugaagccagagagugagagacauuaacucauuagacuggaacuu

SEQ ID NO: 454761 - RNA, 64 nt, Human
ucuuuccuuguuucccuuaauauuucaugaauugucuagcaaaaaugguaggaugcuucuguag

SEQ ID NO: 454762 - RNA, 64 nt, Human
cauucuuuaucuuuucuuugaauaagaaaaaguaucuagcaaggauauuacuugugccuugagg

SEQ ID NO: 454763 - RNA, 64 nt, Human
cauuuuguauauaaucauuauuuuuugagguuuuucuagcaaacguauuguuuccuuuaaaagc

SEQ ID NO: 454764 - RNA, 64 nt, Human
agcuaugacuaaaaauuugaaaaagauaaaaauuucuagcaagccuuugaaguuuaccaaguau

SEQ ID NO: 454765 - RNA, 64 nt, Human
cuaaaugcccacuugaaugaagcugagagagagaucuagcaaaagcuaaaacucauguugucua

SEQ ID NO: 454766 - RNA, 64 nt, Human
uuuauuauuaaaucaguuuuguguacaguaugugucuagcaaagccaccaagggccucaccuuu

SEQ ID NO: 454767 - RNA, 64 nt, Human
gggggcaaugaugagcauaugaauuuuuucucacucuagcaauucccuuuucuaaaugacacag

SEQ ID NO: 454768 - RNA, 64 nt, Human
uguauuugcugaacuaaggauuguauuggugauuucuagcaaaaacaaagugauagaauuuuug

SEQ ID NO: 454769 - RNA, 64 nt, Human
auacacucugcagacccaacagucccgcauuagcucuagcaaugagguucacuggauacagcug

SEQ ID NO: 454770 - RNA, 64 nt, Human
aacugaaaccccagacccaccagaaagacaagugucuagcaaugccuugguaccugaucuuuuu

SEQ ID NO: 454771 - RNA, 64 nt, Human
acagauuugaauagcagcauuagugguuugagugucuagcaaaggaaaaauugaugaauaaaau

SEQ ID NO: 454772 - RNA, 64 nt, Human
uaaguuuacauuugaacugaaaauauguauaaaaucuagcaauucacaaaaaugcccuagaaau

SEQ ID NO: 454773 - RNA, 64 nt, Human
uauuucugacccgcuuuagaacuuaagaccugauucuagcaauaaacguguccgagaugagcgg

SEQ ID NO: 454774 - RNA, 64 nt, Human
aaugaaugugaggaauaugaaaaaacuuucuuugucuagcaaacuuucaaaggugguuauuaua

SEQ ID NO: 454775 - RNA, 64 nt, Human
cucugcaggauauuauccaggagaacuuccccaaucuagcaaggcaggccaacauucagauuca

SEQ ID NO: 454776 - RNA, 61 nt, Human
guauguggcauuuccagguaugacugagugugagagacaugucagaggcucuucagugauu

SEQ ID NO: 454777 - RNA, 61 nt, Human
agagagagagagagagagagagagagagagagagagacaagcaggagcguggcugcucgcu

SEQ ID NO: 454778 - RNA, 61 nt, Human
augugaagugccauuucuuuauucuacuaaagagagacagcagaaauaaagaucagaagca

SEQ ID NO: 454779 - RNA, 64 nt, Human
aauacacuauuugguaagauaauguacugacaucucuagcaaucuuuuuugccaguggcuuuaa

SEQ ID NO: 454780 - RNA, 64 nt, Human
uaaagcuguuaauguaacaguuguggaaaaguguucuagcaacagcauauacuuaucaucauug

SEQ ID NO: 454781 - RNA, 64 nt, Human
acucucucuucaacacuccccugcguaccccgguucuagcaaacaccaauugauugacugagaa

SEQ ID NO: 454782 - RNA, 64 nt, Human
acacgaucuguguuccacucuauagcaacaugacucuagcaaugugacuuucgguuccaaaucu

SEQ ID NO: 454783 - RNA, 64 nt, Human
ugaaaugaagauagacacauuuggauuaaaauauucuagcaaaagaaauaauuggcaaagagag

SEQ ID NO: 454784 - RNA, 64 nt, Human
aaacgcuuacuucucuugacaucagauaauucagucuagcaauaugauagauaauucagucugu

SEQ ID NO: 454785 - RNA, 64 nt, Human
cagggcugugauuucagagguacucccuaaguguucuagcaauaugauuauggagugugauuca

SEQ ID NO: 454786 - RNA, 64 nt, Human
acacacaacacuaagugccuagacuuuaaauagaucuagcaauuggaaaguuaguaagccuaag

SEQ ID NO: 454787 - RNA, 64 nt, Human
acacucgucaagaguauuugcucccaagacacauucuagcaaauguuuugccuuuuucauauac

SEQ ID NO: 454788 - RNA, 64 nt, Human
aaucagauuagguaaaagcuguccuaccaaagagucuagcaaaacaauauaguauuuuuuugca

SEQ ID NO: 454789 - RNA, 64 nt, Human
ucacuuguguucugaaagaaagggcaccagaaguucuagcaaaauucaguuguguucugugagc

SEQ ID NO: 454790 - RNA, 64 nt, Human
aacagccugagccaaggccuagugguaguaagaaucuagcaagaauugaggaagaauggugugg

SEQ ID NO: 454791 - RNA, 64 nt, Human
auuucagaggucucugcuagccuugguaucauuuucuagcaauaacugagagccaguuaauuuu

SEQ ID NO: 454792 - RNA, 64 nt, Human
acugucaaaucugucauugcauaugccaucguuuucuagcaaaaucccaugauuggcuauaaac

SEQ ID NO: 454793 - RNA, 64 nt, Human
cagccccuaccccugcucaggagugggcucagagucuagcaaaugcuaaggccccucaggcugg

SEQ ID NO: 454794 - RNA, 61 nt, Human
cccucccuccuuuuuccuuuccauguuacaugagagacaucaaucagguucucuucucuuu

SEQ ID NO: 454795 - RNA, 61 nt, Human
guauauaugauacauacacauacacacacacgagagacagaaggaaagagaggaagagaga

SEQ ID NO: 454796 - RNA, 61 nt, Human
gagaaggugacacagcugggcccagacccuggagagacagcucugcaguuucccacacugu

SEQ ID NO: 454797 - RNA, 64 nt, Human
uaacagaaacuauccugggauuaggugaaaaaugucuagcaaaagaaacaaagucuuuaauaga

SEQ ID NO: 454798 - RNA, 64 nt, Human
uccaauuguucucuggcuguuuuuuucaguugugucuagcaaaauacuuaucugcccuuugaaa

SEQ ID NO: 454799 - RNA, 64 nt, Human
uaagccuaaaaggaaucuuugaggaaaaaagccuucuagcaaggaaauucaagauucuugaagu

SEQ ID NO: 454800 - RNA, 64 nt, Human
caggcgguugaaguaguuucucacugugauuaauucuagcaaucucuuuucaccccucugccuu

SEQ ID NO: 454801 - RNA, 64 nt, Human
cacaguucuggagccuggaagucugagaucagaaucuagcaagguuaggucuuggugacggccc

SEQ ID NO: 454802 - RNA, 64 nt, Human
cauccaagccagaaauuauuuaauaaaucagaguucuagcaauagaguccucucccaaguggcu

SEQ ID NO: 454803 - RNA, 64 nt, Human
aagugggaugccaaguaagcuuaaaauggcauucucuagcaaagagauuagacuuuuaaauaac

SEQ ID NO: 454804 - RNA, 64 nt, Human
cugaggucaccugcgauuugccccauuuccuaucucuagcaaccuccugggccccaugccccca

SEQ ID NO: 454805 - RNA, 64 nt, Human
aaugauggucccugugguauauacuuucuccuacucuagcaaacauguaguuuaaucuuaaugu

SEQ ID NO: 454806 - RNA, 64 nt, Human
cgcaacccuguccucugcugggcccccagcaaacucuagcaauagcagcugcugccgugucauu

SEQ ID NO: 454807 - RNA, 64 nt, Human
augcaaguuuuuuuuccccauuauaucacacuuaucuagcaagggaccuugugguuuguggcuu

SEQ ID NO: 454808 - RNA, 64 nt, Human
guucaguuuuaacaucgugacaaugagggcuuuuucuagcaaugauuuuuaaauuguguaaguu

SEQ ID NO: 454809 - RNA, 64 nt, Human
uuagacuacucuuugaauaacaaguaagaugcaaucuagcaaaagucagucagggugaaagaga

SEQ ID NO: 454810 - RNA, 64 nt, Human
uucauaguuaauacagguauaucuauuuuuauuuacuuuguaagaaacaagcucaaggagcuuc

SEQ ID NO: 454811 - RNA, 62 nt, Human
ugaguaggaaagaaccaaauguaaauuuccuuagagaccauccuggagaagacaguucuaaa

SEQ ID NO: 454812 - RNA, 62 nt, Human
ggacaaccaacacccggguugcuccuuugauuagagaccagaucagauaauuaugcuuuuaa

SEQ ID NO: 454813 - RNA, 62 nt, Human
uaaaguagaaagcacugucuggcuguguggguagagaccauccuuucccugcauauuaggcc

SEQ ID NO: 454814 - RNA, 64 nt, Human
auaguuaauaauaaaugcuguaaauaagcaucucacuuuguaaaaauaaaauauugugguuuug

SEQ ID NO: 454815 - RNA, 64 nt, Human
guguuuucagaggaaaucuuauuuucauauucagacuuuguauugcccacucauuuguauaagu

SEQ ID NO: 454816 - RNA, 63 nt, Human
gcucuaagaagcugcaauaaaguuuuuuuaagucacuuuguacaugaggucaagauguuguug

SEQ ID NO: 454817 - RNA, 64 nt, Human
aagagguuugcaugcugguaaugcaaccuuugaaacuuuguaaaggaaacauauauguauauau

SEQ ID NO: 454818 - RNA, 64 nt, Human
cugaaccagacagcgaagccaagaucauuguucuacuuuguauuuacuacugugugaaucaguu

SEQ ID NO: 454819 - RNA, 64 nt, Human
acacugcagcugaaugaaaaaggaaucaaaauccacuuuguacauaaguuaaaguccuaauugg

SEQ ID NO: 454820 - RNA, 64 nt, Human
gagcuguugcucuuuggcaagcucugugcuaagaacuuuguauacaucaucucauuuaaucuuc

SEQ ID NO: 454821 - RNA, 64 nt, Human
auguuagguaacuuaggggccagaaucuccaugcacuuuguagaccacauuuccuguuaugaaa

SEQ ID NO: 454822 - RNA, 64 nt, Human
cagggggcaaggaccaagggccauaucccaagugacuuuguacccagaaaauaacagcuguuca

SEQ ID NO: 454823 - RNA, 64 nt, Human
auugcauuauagaggaauguaguaugucauaaguacuuuguaaagauuugacauucaacuguag

SEQ ID NO: 454824 - RNA, 64 nt, Human
auuguaguauuugaauacugucaacuugacaguaacuuuguagacuuaaugguauuauuaaagu

SEQ ID NO: 454825 - RNA, 64 nt, Human
acuucagacaacugucugcacucacggcacacacacuuuguaucaugcaggccacacucagagc

SEQ ID NO: 454826 - RNA, 64 nt, Human
ugcaguucugugaauuuuuauaaaacauacaaaaacuuuguauauacacagaguauacuaaagu

SEQ ID NO: 454827 - RNA, 64 nt, Human
uacauaaugacauaauuuaguuucauguaaugaaacuuuguaaacagaauacauacauguguau

SEQ ID NO: 454828 - RNA, 64 nt, Human
aaguagguggacuauggaaagguugcccaucaugacuuuguauuuauauacaauuaacucuaaa

SEQ ID NO: 454829 - RNA, 62 nt, Human
acccuguccauguguaggucauuaucacacaaagagaccaauaaaaauaaaaaaaauaaaaa

SEQ ID NO: 454830 - RNA, 62 nt, Human
uagaugggaagccuguguaucguggagaaacaagagaccaacuuuuucauucccugccccca

SEQ ID NO: 454831 - RNA, 62 nt, Human
cuauuguaaguuugccuaggcuguugguguacagagaccagaggagagagacacacuaggac

SEQ ID NO: 454832 - RNA, 64 nt, Human
auguuuacuguuaugagguagaauaaaaaagaauacuuuguaauagccacaaguucuuguuuag

SEQ ID NO: 454833 - RNA, 64 nt, Human
uuuuguguccaguuauauuauuuaaaaaaguguuacuuuguaaaaauuguauauaaagaacugu

SEQ ID NO: 454834 - RNA, 64 nt, Human
guugaugaacacauuaauccguuaaguaaaauggacuuuguaauuguacagcauaccuaagaaa

SEQ ID NO: 454835 - RNA, 64 nt, Human
aaacaucuaaaguguauuaacagugcaugcuuuuacuuuguaaauguggugccaaaucccuguu

SEQ ID NO: 454836 - RNA, 64 nt, Human
cugcuacugauuuagacaagguauuauggucauuacuuuguaccccuauccuuccaagcacuuc

SEQ ID NO: 454837 - RNA, 64 nt, Human
cagggcucugugucagggaaaaccuucuggguggacuuuguaagaauccaguuuccaagguuag

SEQ ID NO: 454838 - RNA, 64 nt, Human
gcaacauuuuuauuaaguguuacuauuugccucuacuuuguauuguucagaaauggcaaauaca

SEQ ID NO: 454839 - RNA, 64 nt, Human
aaacaaagaagaagucccuggggccaugccuuucacuuuguagggugggggauuacugagaguc

SEQ ID NO: 454840 - RNA, 64 nt, Human
gauguaaaucaaccccucuuuuaguuuacuuuagacuuuguauuagcucaucuuuuuuguagua

SEQ ID NO: 454841 - RNA, 64 nt, Human
cuuuauucuuuccuguauucucuguauguccagcacuuuguagccaugggaggaaagggacuau

SEQ ID NO: 454842 - RNA, 64 nt, Human
aaaaacuuuggaucaauuuuggucaaacaugccaacuuuguagucugagugacaggcaaggauu

SEQ ID NO: 454843 - RNA, 64 nt, Human
uuugagauucauauauagccuuuaacacuaugcaacuuuguacuuugcguagcaggggcggggu

SEQ ID NO: 454844 - RNA, 64 nt, Human
cuuuaauuuuuuugagauuaucggcggcacaaucacuuuguagaaacuguaaaaaauaaaagua

SEQ ID NO: 454845 - RNA, 64 nt, Human
aaaaaaguugaaggccuuauucuacauuucaccuacuuuguaagugagagagacaagaagcaaa

SEQ ID NO: 454846 - RNA, 64 nt, Human
aaaucagccaaggacuaagcuuccauagaaauacacuuuguaucuggaccucaaaauuauggga

SEQ ID NO: 454847 - RNA, 62 nt, Human
gauaguuaugacucaaggcuuugagaauguaaagagaccaccuucacuuguugagaaauggu

SEQ ID NO: 454848 - RNA, 62 nt, Human
uuuuccauuuaaaaauccacuaaugguguaaaagagaccaguagauuuucaaugggaaaugu

SEQ ID NO: 454849 - RNA, 62 nt, Human
ccccaccagggggcgcgcuuaaauuuccagacagagaccagaaggaagguuuagaaagaaaa

SEQ ID NO: 454850 - RNA, 64 nt, Human
caaaaaaaaaaaaucacuuggcgcaggagggagaacuuuguaagaagcugcccucuguuuuuuu

SEQ ID NO: 454851 - RNA, 64 nt, Human
gauuccucuguguggguggaugcgugugggcacgacuuuguacucagaaauugaacucucaguc

SEQ ID NO: 454852 - RNA, 64 nt, Human
cuggacagaggcuguagccaacacaaucaccuuuacuuuguacucuguguguauguuuugguuu

SEQ ID NO: 454853 - RNA, 64 nt, Human
acaguucuagcaaagaggaaaguugugggguuaaacuuuguauuuucuuucuuauagaggcuuc

SEQ ID NO: 454854 - RNA, 64 nt, Human
cgugggaggcaccuuuggguucccagugcccagcacuuuguagucucaucccagauuacuaacc

SEQ ID NO: 454855 - RNA, 64 nt, Human
auguauuucuuguagugaaguuguuuuguaaucuacuuuguauacauucuaauuauauuauuuu

SEQ ID NO: 454856 - RNA, 64 nt, Human
cgcucucauuaaaaucuaugcagccaagcucggcacuuuguagcagccggccuugcgaagccuc

SEQ ID NO: 454857 - RNA, 64 nt, Human
guuuuguuuccuucucccuuccccuuuucccuguacuuuguaaugucaguguuuauaugaauau

SEQ ID NO: 454858 - RNA, 64 nt, Human
uguuugucaugaccuuuguacuugauuuaucaugacuuuguaugacugaguaauauguagucag

SEQ ID NO: 454859 - RNA, 64 nt, Human
uuuaauuuuuggaauuugggaagcagacagcuuuacuuuguaagguuggaacagcagcacuaua

SEQ ID NO: 454860 - RNA, 64 nt, Human
uugaugcaugucuuuuaaaaugcaauguaagcauacuuuguaaauaggauuuuuagaauuaaaa

SEQ ID NO: 454861 - RNA, 64 nt, Human
uauuuauaguuuacaaugaaugcacugcauaaaaacuuuguagcuucauuauuguaaaacauau

SEQ ID NO: 454862 - RNA, 64 nt, Human
aggaauacauuuggaaauucaaaacaauuggcaaacuuuguauuaauguguuaagugcaggaga

SEQ ID NO: 454863 - RNA, 64 nt, Human
uuauguuaaaagagaggugaaucuucuuugacagacuuuguauuuuccacuucuaacugggccu

SEQ ID NO: 454864 - RNA, 64 nt, Human
ccucguguaauacggugaauuagagugguauuucacuuuguauuauuuuguaaauaugucaaua

SEQ ID NO: 454865 - RNA, 62 nt, Human
aggaaguguuuauuugccucuaauugggccugagagaccauagggagguuggggcucacuga

SEQ ID NO: 454866 - RNA, 62 nt, Human
ugcuugacuaauuuuugugauuuuuuuuugguagagaccagggguuucacuauguugaccaa

SEQ ID NO: 454867 - RNA, 62 nt, Human
uccucuaaccagaaccagcuuccuagccucguagagaccaaaggccgcccccgccugcuggg

SEQ ID NO: 454868 - RNA, 64 nt, Human
aaaggaucauguuuugaagcagcagguccaggucacuuuguauauagaauuuugcuguauucaa

SEQ ID NO: 454869 - RNA, 64 nt, Human
caaaccaaagaguugccugcagguugguaaugugacuuuguagauauuccuugauuaaagccag

SEQ ID NO: 454870 - RNA, 64 nt, Human
guugucuuuucccucagcuggaguuauuggaaccacuuuguagucaagacgaaagcacugaauu

SEQ ID NO: 454871 - RNA, 64 nt, Human
uggcuuuuaaaacguauguuuguaugguagagaaacuuuguaaaagaagaauccaagagaaguu

SEQ ID NO: 454872 - RNA, 64 nt, Human
gaagagagacacucgccaauuuaaaugacacagaacuuuguacuuuucagcucuuaaaaaugua

SEQ ID NO: 454873 - RNA, 64 nt, Human
aaugauaaauaugaauggcuuuucaauucuguggacuuuguaccauuuggcuucaccuuguacu

SEQ ID NO: 454874 - RNA, 64 nt, Human
uaggcuccucacgggcgauggcugucuuuucuugacuuuguaucuucacugccaagcaaaaagu

SEQ ID NO: 454875 - RNA, 64 nt, Human
cccggucacuauauaaagcaaauaaacuuaaaacacuuuguaaccauguauuuacucugccagg

SEQ ID NO: 454876 - RNA, 64 nt, Human
cuaaagccucaaguacaugccuccugcuuaguucacuuuguaucacauuuccuaagcucccuuu

SEQ ID NO: 454877 - RNA, 64 nt, Human
ggaagaaaaugucccucccuuacccccauccuuaacuuuguauccuggcuuauaacaggccauc

SEQ ID NO: 454878 - RNA, 64 nt, Human
uguggguugugcauccccaauccagauaauaaagacuuuguaaaacaugaauaaaacacauuuu

SEQ ID NO: 454879 - RNA, 64 nt, Human
accugacugacccuccugaacugcacuacaagacacuuuguagaagaggagaugagaguuucua

SEQ ID NO: 454880 - RNA, 64 nt, Human
guguugcaucaaacagaagauuuugacugcugugacuuuguacugcaugaucaacuucaaaucu

SEQ ID NO: 454881 - RNA, 64 nt, Human
uguagcaugaaugcagacuggagucacugcacacacuuuguagcucaauguugugaccuggagc

SEQ ID NO: 454882 - RNA, 64 nt, Human
auuaaauauuuagaucaauguuuauaaaaugauuacuuuguauaucucauuauuccuauuuugg

SEQ ID NO: 454883 - RNA, 61 nt, Human
ugagggcagguugggaaggguagcagagagagagagacagaaagagagagagagagagaga

SEQ ID NO: 454884 - RNA, 61 nt, Human
ucaccaaugaacucccccaaacauggcuguggagagacaacaaaacaaaacaaagcacaaa

SEQ ID NO: 454885 - RNA, 61 nt, Human
gaaaagaaaaagauaaggaaagaagagagaagagagacaaagaucacuacagaccaaaaca

SEQ ID NO: 454886 - RNA, 64 nt, Human
acucagaaaaccacaguguguuuucauauuuggaacuuuguaauagcgggaguagcaguagucc

SEQ ID NO: 454887 - RNA, 64 nt, Human
cucucagaaguucagcuguugaaacgaaaacuguacuuuguacccucacauacaaagggaucaa

SEQ ID NO: 454888 - RNA, 64 nt, Human
ggggugguuuauuauuuuugcuggucccuagaccacuuuguaugaccguuugcagucugagcag

SEQ ID NO: 454889 - RNA, 64 nt, Human
uccccuggcuugcuucauggccacugaaccaaucacuuuguaugcuaugcuccuacugugaugg

SEQ ID NO: 454890 - RNA, 64 nt, Human
uguccuguggagcaggcagugauuuuguuccaaaacuuuguauacacauuuggagaaaaguacu

SEQ ID NO: 454891 - RNA, 64 nt, Human
auaucuggguuaaguguuuaucauauauauggguacuuuguaauaucuaaaaacuuagaaacgg

SEQ ID NO: 454892 - RNA, 64 nt, Human
auagacuguacuuauuuuccaauaaaauuuucaaacuuuguacuguuauccugagaaucuguuc

SEQ ID NO: 454893 - RNA, 64 nt, Human
acccaaaccauaccacacacauuaucauuguuaaacuuuguaaaguauuuaagguacauggaac

SEQ ID NO: 454894 - RNA, 64 nt, Human
uuugagcugugagauggauuuauuuuuaaaugcuacuuuguaaaggugaccuuuaaaaaauaaa

SEQ ID NO: 454895 - RNA, 64 nt, Human
uuguaucacaaagcugugaaaugugcaagaguauacuuuguacccaucaugugcucuguuuuga

SEQ ID NO: 454896 - RNA, 64 nt, Human
agaaucuuuacaccuccugugugguuacaaguuaacuuuguaaguagcguaccuuccuuccuua

SEQ ID NO: 454897 - RNA, 64 nt, Human
auuuagaacaaauaagguauauuuuuuagaaucaacuuuguaagcacuauaaaaucuuuaauaa

SEQ ID NO: 454898 - RNA, 64 nt, Human
uccccuuuacaaagccgcugaccccugaugugaaacuuuguagagcagcagaguggcugcguga

SEQ ID NO: 454899 - RNA, 64 nt, Human
uuuccucuuccuccuccacuucccacuuauugucacuuuguaauauucagagagcacuuggauu

SEQ ID NO: 454900 - RNA, 64 nt, Human
cuucgaaggaauuuuguuuuagccauauccaucaacuuuguauuuuacuugcaauuuggaagaa

SEQ ID NO: 454901 - RNA, 62 nt, Human
ugggcaggacaggcucuggagggaaaagccagagagaccaagauggaggcuguggagcagca

SEQ ID NO: 454902 - RNA, 62 nt, Human
gccaaggcggguggaucacaaggucaagagauagagaccaucuuugccaacauggugaaacu

SEQ ID NO: 454903 - RNA, 62 nt, Human
guccugcgaaaacccccaaaccagauacggacagagaccaagauggcccauccuguggucac

SEQ ID NO: 454904 - RNA, 64 nt, Human
auucuucaacguuuguuccuguguguacaauuguacuuuguaugaacagcuuuaucauuuuuau

SEQ ID NO: 454905 - RNA, 64 nt, Human
ucuaugccuaauacucacacgcaacauuucuuguacuuuguaagucguuugcgagaaugcagac

SEQ ID NO: 454906 - RNA, 64 nt, Human
auguuaacuuauugcuuuguaucuugggaaaaaaacuuuguaaauaaguuauaaaguuucuuug

SEQ ID NO: 454907 - RNA, 64 nt, Human
uaucuggcucuaaaaccuucugcugcccaaccugacuuuguaguucugauuuuuacuuguuuau

SEQ ID NO: 454908 - RNA, 64 nt, Human
acuccccaaaaagguaaaugcuaucaagaguagaacuuuguagcuguagauuaguuauguuuaa

SEQ ID NO: 454909 - RNA, 64 nt, Human
ugucacacuagcauagagaauguguugaaauuuaacuuuguaagcuuguaugugguuguugauc

SEQ ID NO: 454910 - RNA, 64 nt, Human
uauucacuagauuucuacguagugaucugcuuuuacuuuguaauuuguaguucucaaaagacuu

SEQ ID NO: 454911 - RNA, 64 nt, Human
aaaucuauguugaauccuuuuauaaaccaguaucacuuuguaauauaaacaccuauuuguacuu

SEQ ID NO: 454912 - RNA, 64 nt, Human
auaugggcaaagaagcuaugaagauacaugauacacuuuguacaacuauccugcagcccauugg

SEQ ID NO: 454913 - RNA, 64 nt, Human
acuuuuggaucucauuguugauauaccugaauuuacuuuguaagagauuuuaacuucacuucau

SEQ ID NO: 454914 - RNA, 64 nt, Human
uauauaaaaagagcugacugacauaucuuuaaauacuuuguacuaacuuuaucacacuuacugu

SEQ ID NO: 454915 - RNA, 64 nt, Human
caaguugcugugauacuucauuuuuaaauugugaacuuuguacaaauuuugucaugcuggaugu

SEQ ID NO: 454916 - RNA, 64 nt, Human
gcuguacaaaagcugcaguaaccugucuucaguuacuuuguaauuuauuguggcaugagauaag

SEQ ID NO: 454917 - RNA, 64 nt, Human
uauuuuacuuucuccaguauaccuugagaagcaaacuuuguaggaagccacucuucuccccuaa

SEQ ID NO: 454918 - RNA, 64 nt, Human
acucugaaauuccaagguugggggcaaugaugaaacuuuguacaguauaugaaacaguauauua

SEQ ID NO: 454919 - RNA, 62 nt, Human
cgggcgcagccacagcugucggagcgcaugcuagagaccaagguggccgagcugcuggccca

SEQ ID NO: 454920 - RNA, 62 nt, Human
ccuuuugggucaacuguuggucaaacuauaggagagaccagggaccaucacauggguaggga

SEQ ID NO: 454921 - RNA, 62 nt, Human
aaauacuugcucuugguaucuauaacuuuugcagagaccagaagcaaacaauuugugggcca

SEQ ID NO: 454922 - RNA, 64 nt, Human
cccaaucuaaauauggaauuugguaaauuagaauacuuuguaauuuguaagaccaaauucauac

SEQ ID NO: 454923 - RNA, 64 nt, Human
aacugcacagggcuuauagcugcuucauucugcuacuuuguaacuaggagccauugcauuuauu

SEQ ID NO: 454924 - RNA, 64 nt, Human
cauugauggcaucccuacagucuucuucacuugaacuuuguaaaacugcauauggaccuguaau

SEQ ID NO: 454925 - RNA, 64 nt, Human
guuuuagcaauuuaauauuuugcacaguuagcaaacuuuguaugucauuuccuucaaggcauca

SEQ ID NO: 454926 - RNA, 64 nt, Human
aggcuggggcagcgccaaggcggucucgcgcgggacuuuguacagcagugucuuauccagcagc

SEQ ID NO: 454927 - RNA, 64 nt, Human
uuaagauacauuuauaaaucauuucagcaguaguacuuuguauguguugagaguuuacagagcu

SEQ ID NO: 454928 - RNA, 64 nt, Human
aaacauguuccugggaucacugaugacuuuuuauacuuuguaaagacaauuguuggagagcccc

SEQ ID NO: 454929 - RNA, 64 nt, Human
ucuuuccuugcuccuaguuauucuguauaucuuuacuuuguagguaaaaauaaauguuuauuua

SEQ ID NO: 454930 - RNA, 64 nt, Human
cguaauguuacacuuuaaaggacagcaaauaagaacuuuguagaaucccaccaggacuuugcua

SEQ ID NO: 454931 - RNA, 64 nt, Human
ucuuuugaaaaauauaauauuuuuaugagaguggacuuuguauuucacuagguacaauggaaua

SEQ ID NO: 454932 - RNA, 64 nt, Human
aguuacaugauuuauaauuucacugauugagauuacuuuguaaguagcuguucagaagaauaaa

SEQ ID NO: 454933 - RNA, 64 nt, Human
ucccucucaauaaauaucuauuuuucauuuuuuuacuuuguaguuuauuuuuuagugaauguau

SEQ ID NO: 454934 - RNA, 64 nt, Human
uuacugauucaauuauaauuguaauggauuuuugacuuuguaauggauucuuuucaucaaaaag

SEQ ID NO: 454935 - RNA, 64 nt, Human
aguaacuugguuauacaugacacugaaaugccuuacuuuguaugauauuccauaguauauuaaa

SEQ ID NO: 454936 - RNA, 64 nt, Human
caucuuuauauuugucuuauuuugaaucuuauccacuuuguaagaacaaguuuauguuugagca

SEQ ID NO: 454937 - RNA, 62 nt, Human
acccgaccccaauggaugaagacccccuccaaagagaccagccucccucccugugccagacc

SEQ ID NO: 454938 - RNA, 62 nt, Human
ugucucaagcugccacccuucaaggacagggaagagaccacugugggaugacagccagagga

SEQ ID NO: 454939 - RNA, 62 nt, Human
cuguccuucugacagcucgguguucagcuuacagagaccaccccuuuccuccacagggagag

SEQ ID NO: 454940 - RNA, 64 nt, Human
gcuucaacuuuguaucaguauacuguauuuauaaacuuuguaccacaagagagaguguagcacc

SEQ ID NO: 454941 - RNA, 64 nt, Human
cauaguuguuauuaagcucuuuuuaauggcuucaacuuuguaucaguauacuguauuuauaaac

SEQ ID NO: 454942 - RNA, 64 nt, Human
ucuuguuaguagacagugguguccucaaaauuuuacuuuguaauucuucagaauugauuauuuu

SEQ ID NO: 454943 - RNA, 64 nt, Human
cagaagacacgcuaaauauuuauuauacuauccuacuuuguacauaaauaucucuauagacugg

SEQ ID NO: 454944 - RNA, 64 nt, Human
cuacaacuaauaacacgagguuccaaagcugaagacuuuguauaaaguauuuggguuuuguucu

SEQ ID NO: 454945 - RNA, 64 nt, Human
gagggacugggucacuauugugguuuuuacuauaacuuuguaaauuaacuuaauuuugcugacu

SEQ ID NO: 454946 - RNA, 64 nt, Human
aaacaaagaauuuguccuguauggaaaacgggagacuuuguacaguggccucucuaaaaguaca

SEQ ID NO: 454947 - RNA, 64 nt, Human
ucaaaaugauuuaccccugguuaaguuucugaagacuuuguacauacagaaguauggcucuguu

SEQ ID NO: 454948 - RNA, 64 nt, Human
gguuuacuucucccauccauuguaaacauuugaaacuuuguauuucaguuucuuuugaauuaug

SEQ ID NO: 454949 - RNA, 64 nt, Human
cucccugggccaccugcagagagcuuucccaccaacuuuguaccuugauugccuuacaaaguua

SEQ ID NO: 454950 - RNA, 64 nt, Human
uguaaaauauucaacuuuuuccuccuuuuuuuggacuuuguauuuuacugcauguuuucuucau

SEQ ID NO: 454951 - RNA, 64 nt, Human
caagaauaugcccgacuccccaugacaagacagaacuuuguaacaaacaguaccaauuuauuuu

SEQ ID NO: 454952 - RNA, 64 nt, Human
gggcagcggggccuggcgggaugggccaccgccgacuuuguaccccccaaccccugaggaagau

SEQ ID NO: 454953 - RNA, 64 nt, Human
uugucaaauggauauuuauaggaauauauucacuacuuuguauacuuugcaaauuugucucucu

SEQ ID NO: 454954 - RNA, 64 nt, Human
auguacacuguaccaaaauuucuauaaauaaauaacuuuguacauaaaaguaauacucccucuu

SEQ ID NO: 454955 - RNA, 62 nt, Human
ucuagggccugggaugaucauugcuagaacugagagaccagccuggcucagugaacuucagg

SEQ ID NO: 454956 - RNA, 62 nt, Human
uuagcguucuggacucugccccaaucggguccagagaccacaccacuaaccauccccaacuc

SEQ ID NO: 454957 - RNA, 62 nt, Human
ccaagacuuccuaggggccagccuagcagacaagagaccacaagggacuggggaucaggguc

SEQ ID NO: 454958 - RNA, 64 nt, Human
acgaucaacuaucuucuaauuugaaucuauaguuacuuuguaccauuugaaauauauguauaua

SEQ ID NO: 454959 - RNA, 64 nt, Human
gauuuguuccugccccacccuaacugaucaauguacuuuguaaucucccccacccuuaagaagg

SEQ ID NO: 454960 - RNA, 64 nt, Human
uguacuuuguaaucucccccacccuuaagaagguacuuuguaaucuuccccacccuuaagaagg

SEQ ID NO: 454961 - RNA, 64 nt, Human
uauggagaacauuaggacaaaaagucaccaacuuacuuuguaacauuuuaauaaugacuuaagg

SEQ ID NO: 454962 - RNA, 64 nt, Human
agaggugugugugugucuauguguguguuucagcacuuuguaaauagcaagaagcuguacagau

SEQ ID NO: 454963 - RNA, 64 nt, Human
gaaaaaauaauugcuuugacauugucuauaugguacuuuguaaagucaugcuuaaguacaaauu

SEQ ID NO: 454964 - RNA, 64 nt, Human
aauguucuaguaaauguguaccaaaaugugaauuacuuuguacgauuacagucuccacgucgac

SEQ ID NO: 454965 - RNA, 64 nt, Human
ggugggaauaaaaagcugugaaauuguucaaccuacuuuguaaccaaagaagcaaagcugugua

SEQ ID NO: 454966 - RNA, 64 nt, Human
uuuccggaaauccacugcacacuguugccuauacacuuuguacauuuaauugauauuugugcug

SEQ ID NO: 454967 - RNA, 64 nt, Human
uuuaaugacuagcuuuuaaaaauacaguacaaagacuuuguaaaugugauucagggcccccagc

SEQ ID NO: 454968 - RNA, 64 nt, Human
cccucuucccuugcuuccuuuaauaguuaaauagacuuuguauaccaccugaccagccuuugug

SEQ ID NO: 454969 - RNA, 64 nt, Human
uugcuacauuuuaaaagcaauuguauuaguaagaacuuuguaaauaaauaccuaaaacccaagu

SEQ ID NO: 454970 - RNA, 64 nt, Human
uauacaaaaaauuguauacuacuugauggaaccaacuuuguacaucuuggccaugucacugguc

SEQ ID NO: 454971 - RNA, 64 nt, Human
aacauugauauuuauuuuuguuugacauuuuaacacuuuguacugcaaagagugaacuauauau

SEQ ID NO: 454972 - RNA, 64 nt, Human
aaacaguaagauaucucaaugaaccauaaauucaacuuuguaaaaaucuuuugaagcauagaua

SEQ ID NO: 454973 - RNA, 62 nt, Human
gauccucaaccuccaugccuaaggcugguucaagagaccacauaauaucugccuuuuauuac

SEQ ID NO: 454974 - RNA, 61 nt, Human
uaugcacagucugaauguauaccaggagugugagagacacaugcccacuucaugcaacucc

SEQ ID NO: 454975 - RNA, 61 nt, Human
ucccagccccggcaagccacaggaaggaggggagagacaggcagcccagcaguguggagac

SEQ ID NO: 454976 - RNA, 64 nt, Human
gaaaaguguguauauauuuugugugaaauugcauacuuuguauuuugauuauuuuuuuuuucuu

SEQ ID NO: 454977 - RNA, 64 nt, Human
acuuaccuuguuuucacuugugcacugugaaugaacuuuguauuauuuuuuuaaaaccuucaca

SEQ ID NO: 454978 - RNA, 64 nt, Human
uccuuauguuggcaaaggagcucuauauaguuucacuuuguauaaaaguuaggaccagcuguug

SEQ ID NO: 454979 - RNA, 64 nt, Human
uaagcugcugccaagcacauaucccuaugacaacacuuuguaaaagccgcggggcccccauaca

SEQ ID NO: 454980 - RNA, 64 nt, Human
ccuuuugucugcuuucuuaagaccaguuguucacacuuuguagauauuagacaaauauauuucg

SEQ ID NO: 454981 - RNA, 64 nt, Human
ccauucuuguuuacaaaacacuuaccaagaaagcacuuuguaggggaacuuuaguaaguucuuc

SEQ ID NO: 454982 - RNA, 64 nt, Human
gcuuuuagccucuacaugcuaggaucacaggaagacuuuguaaggacaguuuaaguucuccugc

SEQ ID NO: 454983 - RNA, 64 nt, Human
guuggaaaaacaacagcgacaaaaaagucaagaaacuuuguaaaauaucgugugugugauuccu

SEQ ID NO: 454984 - RNA, 64 nt, Human
cccagggaucugggguggucagggcucaggcuucacuuuguaaaccaggugggggcaucucaca

SEQ ID NO: 454985 - RNA, 64 nt, Human
ugucuuuuuuuauauaaugaaccacucuuuuuuaacuuuguaaccuucccuugaagacagaauu

SEQ ID NO: 454986 - RNA, 64 nt, Human
gguuucauuuaccgaaugagaauucuucauuuucacuuuguaauuuuucuuaguauauagucag

SEQ ID NO: 454987 - RNA, 64 nt, Human
ugccaagguacuuuuuuauuuaaaaaaaaacauaacuuuguaaauauuacccuguaauauuaua

SEQ ID NO: 454988 - RNA, 64 nt, Human
uguuccauuccugauucuuggguaauaaagacaaacuuuguaccucucugugcuuaugucaucu

SEQ ID NO: 454989 - RNA, 64 nt, Human
ucuaugguuugacuccaggaucaaaacacaagggacuuuguauuauuucacuuauaauuguuuu

SEQ ID NO: 454990 - RNA, 64 nt, Human
uuacauaauuuuaaccuauaugauuuuauuuuuaacuuuguauuucucccuagaaaucuuaaua

SEQ ID NO: 454991 - RNA, 62 nt, Human
uaaauguuaagagcguaaguguaaggggguccagagaccaaaaguuuuagagcuacaggauu

SEQ ID NO: 454992 - RNA, 62 nt, Human
uuaagaguccuugcauuguuaacugauuugcaagagaccaugauuaucagacacuaaaacua

SEQ ID NO: 454993 - RNA, 62 nt, Human
caguggaugacuauggagaagagccugcaagcagagaccaacuacccuuaggucuacagcuc

SEQ ID NO: 454994 - RNA, 64 nt, Human
ccggcacacacggaguggcuuugacagauugauaacuuuguaagaugggagacaucugaaauau

SEQ ID NO: 454995 - RNA, 64 nt, Human
uucccuugucaaagugcuugacugcaugcuggaaacuuuguauuuuugaagcggcaaacucugu

SEQ ID NO: 454996 - RNA, 64 nt, Human
cucuuaggaagcugaauguuguguuaucacuaauacuuuguacaggucaccugccuacucuaau

SEQ ID NO: 454997 - RNA, 64 nt, Human
uaauuuauauauuucacuuguauucauuuguaaaacuuuguauuaguguaacauacuccccaca

SEQ ID NO: 454998 - RNA, 64 nt, Human
ugaacaaucuauuuugagccacuuuagggagaaaacuuuguauuuuuaaaacuugcauaaaagu

SEQ ID NO: 454999 - RNA, 64 nt, Human
uuuucaaauguguaaaagauaaugacuguauuaaacuuuguauaacugucuauugugaaaaacu

SEQ ID NO: 455000 - RNA, 64 nt, Human
aggguugauuaaaucuauaaguuuuuaugugaggacuuuguaagucagcauaaaaaugaaaagu

SEQ ID NO: 455001 - RNA, 64 nt, Human
auuguguuugcauuuuuuaagaaguacauuuuuaacuuuguauacacaagaaaugucauauuuu

SEQ ID NO: 455002 - RNA, 64 nt, Human
agaguuuugcugguuuuguaaaauggauggaagaacuuuguauuuauacugugauuuugaacag

SEQ ID NO: 455003 - RNA, 64 nt, Human
uucaauaggcugggaguuuuauuuaucucuucaaacuuuguacaagagcucauggcuugucuug

SEQ ID NO: 455004 - RNA, 64 nt, Human
aaguguccagagggcuguuugcaaacacuagugcacuuuguagcuuuucacccucugucccagg

SEQ ID NO: 455005 - RNA, 64 nt, Human
auccagaauugaccuuuugacuuaaagcagagggacuuuguauagaagguuugggggcuguggg

SEQ ID NO: 455006 - RNA, 64 nt, Human
uaucauuguaauaaucucauaauauauauuuguaacuuuguagcuaucuuugaaaucacuugac

SEQ ID NO: 455007 - RNA, 64 nt, Human
caaaacgaugacauguaaccuugcuguuuauuguacuuuguauauuauuuccucuucaaagucu

SEQ ID NO: 455008 - RNA, 64 nt, Human
aguaaugcaguuuuuaaaaaccuguaucugacccacuuuguaauuuuugcuccaauauccauuc

SEQ ID NO: 455009 - RNA, 62 nt, Human
ggccagagagggaaaaggcaggugcuuuuggcagagaccauaagagaaaccugccaaggagc

SEQ ID NO: 455010 - RNA, 61 nt, Human
cauguacaugggagugagagaaaaagagagagagagacagaguggcgggggcggggaggag

SEQ ID NO: 455011 - RNA, 61 nt, Human
uauguauguguguauggguguguguuugugugagagacagagaaagagagagaauucuuuc

SEQ ID NO: 455012 - RNA, 64 nt, Human
gaaugcugcuggacacguaccccuuucuauuauuacuuuguaguagaaagaaaguuaaugaaac

SEQ ID NO: 455013 - RNA, 64 nt, Human
aagccuuuugcuuuaugcuugagggauauuuagaacuuuguauuuucggaaaguuaaauaacag

SEQ ID NO: 455014 - RNA, 64 nt, Human
auaucuguggcuaaaaaguuugagauuugugauaacuuuguagucauguaaaacuuaagugcuu

SEQ ID NO: 455015 - RNA, 64 nt, Human
uguuacugcaucaucuguuuguaaucauuaucucacuuuguaaauaaaaacacaccuuaaaaca

SEQ ID NO: 455016 - RNA, 64 nt, Human
uauuucuugcucaguuguuucaggcaagcccaagacuuuguaauuuuuaaagggcccaagauuu

SEQ ID NO: 455017 - RNA, 64 nt, Human
aauuucuaccuuuacuacaucuuuucaacaaguaacuuuguagaaaugagccagaagccaaggc

SEQ ID NO: 455018 - RNA, 64 nt, Human
cagauuuaaaaagguuguauuacauauuguuuaaacuuuguaaguagaaauauaucuguuauaa

SEQ ID NO: 455019 - RNA, 64 nt, Human
aaacaguauuuugguugucuuaggauaauugcugacuuuguaucuuggauacaguguaaaccag

SEQ ID NO: 455020 - RNA, 64 nt, Human
gcaguuacuguuuacaagacugcuuuuaccuuaaacuuuguagauguuuacaucuuuuuguugu

SEQ ID NO: 455021 - RNA, 64 nt, Human
ugaauuuaugugcugccauuugcuauaaaguugaacuuuguauggcuugaaaaagaaaugacaa

SEQ ID NO: 455022 - RNA, 64 nt, Human
ugcuggcgcucaugggcccugguguuugcaccgcacuuuguaaucagucccgugguugucugua

SEQ ID NO: 455023 - RNA, 64 nt, Human
accauagcagaaaaaccuagacccaccuagugaaacuuuguaagaacuccagggcaaaaacgaa

SEQ ID NO: 455024 - RNA, 64 nt, Human
caaauguaauauauuaaagccuuauauauaaugaacuuuguacuauucacauuuuguaucagua

SEQ ID NO: 455025 - RNA, 64 nt, Human
uguaaaugucgcuucuucaagugaaugauucugcacuuuguaaacagcacugagauuuauuuua

SEQ ID NO: 455026 - RNA, 64 nt, Human
cauagcacaaaaaaagguuaagaaguccuaguugacuuuguauauauauaaagaaaucuauuac

SEQ ID NO: 455027 - RNA, 61 nt, Human
acuccuggugcccucucccuuuguccccccagagagacauaugcccccagagagagcaaau

SEQ ID NO: 455028 - RNA, 61 nt, Human
aggagccuuucuuauggaagaaaugggagaagagagacaggguucuuuucagcagagucua

SEQ ID NO: 455029 - RNA, 61 nt, Human
augccacuccaucuggacauuuaaugaaacugagagacagaggcuuguuugcuuugcccuc

SEQ ID NO: 455030 - RNA, 64 nt, Human
ccuuauaguaaaagugcaaucauauggauggcuaacuuuguaaucucuacaaauaauuuaccuu

SEQ ID NO: 455031 - RNA, 64 nt, Human
auugccuucuuauuuuacuucuuuuagcuguuuaacuuuguaagaugcaaagagguuggaucaa

SEQ ID NO: 455032 - RNA, 64 nt, Human
ugucuguuuuuguaucuuuaugcuguauuuuaacacuuuguauuacuuagguuauuuugcuuug

SEQ ID NO: 455033 - RNA, 64 nt, Human
auaugggaacauaaaagagcuuuaaauauuauagacuuuguaccuguuauauauaugaauauuc

SEQ ID NO: 455034 - RNA, 64 nt, Human
gaccuaaauaauaauaaaaaaaaaagcccuuuaaacuuuguaaggaaauauuuuuugauuuugc

SEQ ID NO: 455035 - RNA, 64 nt, Human
auuauuaaauauuagguagaaaucauaccaugcuacuuuguacauauaaguauuuuauuccugc

SEQ ID NO: 455036 - RNA, 64 nt, Human
aaagcuuuguagcagaauauauuugcagcuauugacuuuguaauuuaggaaaaauguauaauaa

SEQ ID NO: 455037 - RNA, 50 nt, Human
aucacaauaaacaggauugaacuuuguaaacaaccaaagucaggggccuu

SEQ ID NO: 455038 - RNA, 64 nt, Human
aagugcuacuauaauaaguuuuucacgagaacaaacuuuguaaaucuuccauaagcaaaaugac

SEQ ID NO: 455039 - RNA, 64 nt, Human
aaaaguuacuuuuaucuuggauuuauuaugaagaacuuuguaguugcuuuguaauuucccauaa

SEQ ID NO: 455040 - RNA, 64 nt, Human
agaucguguuacagucacaaucuacuuuucuuaaacuuuguaucucuaggaacgaagguggaaa

SEQ ID NO: 455041 - RNA, 64 nt, Human
caacuugaagcuuuccaauggcgcuucucuauggacuuuguaaauaaguuauaucuuuguaauu

SEQ ID NO: 455042 - RNA, 64 nt, Human
auugaauuugaugguugacuuaauuggcaccauaacuuuguaugauauuauacauuaaccuuua

SEQ ID NO: 455043 - RNA, 64 nt, Human
auggaaaaggaggaacagcguuuccguaaaauugacuuuguacucugaaaacgucaauuuauau

SEQ ID NO: 455044 - RNA, 64 nt, Human
auacacaugcacucaguguggacugggaagcauuacuuuguagauguauuuucaauaaagaaaa

SEQ ID NO: 455045 - RNA, 60 nt, Human
gaaagaaccuguuggcguaaggucuuccacuaguuagaugguuucuuuuggggaaauguu

SEQ ID NO: 455046 - RNA, 60 nt, Human
aguaagugacaaugcuuauggaaagccaguuaguuagaauuggaaaucugucuugucauu

SEQ ID NO: 455047 - RNA, 60 nt, Human
cuggaaauaguaaucacaccucucuguuuuuaguuagagucuaaugaaacucucaucuag

SEQ ID NO: 455048 - RNA, 64 nt, Human
uuaccaauuuguacauuuuaauuauucaauuucuacuuuguaaaaauagggaaauuauuugaag

SEQ ID NO: 455049 - RNA, 64 nt, Human
uagcaagcugguucuugcuuauauauagugauaaacuuuguagcugccucuuuaaccaagaauu

SEQ ID NO: 455050 - RNA, 64 nt, Human
auuuauugauuuguaacaacuuguuuuuaaccaaacuuuguagcauggaaaaaauuuuccaucc

SEQ ID NO: 455051 - RNA, 64 nt, Human
caugaauagcaaaugagaaaauguauauaaaagcacuuuguaaauuguaaaaguaguacagaug

SEQ ID NO: 455052 - RNA, 64 nt, Human
uuuucuacguauaaacacucuugaauagacuuccacuuuguaauuagaaaauuuuauggacagu

SEQ ID NO: 455053 - RNA, 64 nt, Human
uugacuccaaugccuguacugugucuacugcaccacuuuguaaacacuucaauuuacuaucuuu

SEQ ID NO: 455054 - RNA, 64 nt, Human
gaacaugcaguucauuauuuugugguucuauuuuacuuuguacuuguguuugcuuaaacaaagu

SEQ ID NO: 455055 - RNA, 64 nt, Human
uuuuuguuuuaucagaauggcaacagacagaaguacuuuguagagauugacuuccuaagcuacu

SEQ ID NO: 455056 - RNA, 64 nt, Human
auugauucuuacaaaauauauacuguaacaguauacuuuguacagauuuaaauuuuauuugaaa

SEQ ID NO: 455057 - RNA, 64 nt, Human
cgcccgcaccccccgggccgggcgccuguauuauacuuuguacuuuugcccaaacguguaaaua

SEQ ID NO: 455058 - RNA, 64 nt, Human
uuaaauauuuuaauuacuauuuaaauaucucuuuacuuuguaauccuaugcauuuuacgcauua

SEQ ID NO: 455059 - RNA, 64 nt, Human
gugcugguuuauguucuaggaacucuucaugagcacuuuguaaacacccucuugcuuaauccuc

SEQ ID NO: 455060 - RNA, 64 nt, Human
guucucaauaauaauauucaaguuuuagaguuucacuuuguacuauuuaaauuuauggaacuag

SEQ ID NO: 455061 - RNA, 64 nt, Human
ucucaucaguuucuuguaagaaaaaaacauuuucacuuuguagcacauuuuaguuauuuuugag

SEQ ID NO: 455062 - RNA, 64 nt, Human
uaugauauauauuuuuuuuaaugcaggaaaguauacuuuguaaggagcagauuuuuuuguucuc

SEQ ID NO: 455063 - RNA, 60 nt, Human
cugcuuuuugcuauuucugcaguuucaaguuaguuagaagcauguugucaacuaaagaca

SEQ ID NO: 455064 - RNA, 60 nt, Human
auuuuugaagcaagagaaaauuccauuuuauaguuagacccaaauucacuaaauagugug

SEQ ID NO: 455065 - RNA, 60 nt, Human
uggaucuuacugauccagaaauaguccccauaguuagaguaguuacuuaugaagugguua

SEQ ID NO: 455066 - RNA, 64 nt, Human
uaagcacauuccaaacuuuagcaacaguuaucacacuuuguaauuugcaaagaaaaguuucacc

SEQ ID NO: 455067 - RNA, 64 nt, Human
auucauucaguucccguguauuucuugugcuucuacuuuguaccaaacuuuaaaaggggggcca

SEQ ID NO: 455068 - RNA, 64 nt, Human
uauugagguucacagaugaaauauucuuuggcauacuuuguagacuuugaccacuuaaaauacu

SEQ ID NO: 455069 - RNA, 64 nt, Human
gugaacuugcuucccuuuucacuaauuuugcuaaacuuuguaaugcacauucuuagcauauaac

SEQ ID NO: 455070 - RNA, 64 nt, Human
ccgaugggggcacucggacaucuacaacccugcaacuuuguacagagaaacacaaucagcucuu

SEQ ID NO: 455071 - RNA, 64 nt, Human
caguggugauuaccggcauuuuauuaaacuuaaaacuuuguagaaagcaaacaaaauuguucuu

SEQ ID NO: 455072 - RNA, 64 nt, Human
guguaaaagaguuuauacaggccuuaaauaucagacuuuguaacagguagaaauauuacagaau

SEQ ID NO: 455073 - RNA, 64 nt, Human
uaccuggaggacuaaauguagaugucuuuaguauacuuuguauguucuuaauauuggaagauaa

SEQ ID NO: 455074 - RNA, 64 nt, Human
aauggcugcaaguggaagcggauaauauguaggcacuuuguaaauucauauugaguaaaugaau

SEQ ID NO: 455075 - RNA, 64 nt, Human
agaacaaggcuggugcuuccuucuaguccuugagacuuuguagcucuaacucaagcagaacccu

SEQ ID NO: 455076 - RNA, 64 nt, Human
cuuuuccuaguuuuauguuucuugggaaaauaucacuuuguauucucuguccagggcuucagau

SEQ ID NO: 455077 - RNA, 64 nt, Human
agaggauuuauuuaagcuauuauuuuaauaaagaacuuuguacauuuuuauuuuuauauuuuuu

SEQ ID NO: 455078 - RNA, 64 nt, Human
gauauauaauauguuaaugugucauguaauuuuuacuuuguacaaagcaaauaaagaucuuucu

SEQ ID NO: 455079 - RNA, 64 nt, Human
uaagaaguaaaucaaugcuaaaugaagaaucuguacuuuguauguauagaauuuaucuaauaaa

SEQ ID NO: 455080 - RNA, 64 nt, Human
ccaaaagggaaagaauuucuguaauugccaacccacuuuguagaagaggcaugagcccuugaau

SEQ ID NO: 455081 - RNA, 60 nt, Human
ggcuggacuacuauaaaaguuacaaauacguaguuagaccaauagauuuauauagucagg

SEQ ID NO: 455082 - RNA, 60 nt, Human
gugaaacucauuugaugguuucuuuugaauuaguuagacacuugaacgguguuuuuuaga

SEQ ID NO: 455083 - RNA, 60 nt, Human
acagugacauuugauucaauuguugagcuguaguuagaauacucaauuuuuaauuuuuuu

SEQ ID NO: 455084 - RNA, 64 nt, Human
cuaaauuugacauagaaaguaagaaggaaugucuacuuuguauugugguccuaaucuaagauca

SEQ ID NO: 455085 - RNA, 64 nt, Human
aauccauauggagcuuuuccugauguuccacuccacuuuguauagacaucugccccaacugaau

SEQ ID NO: 455086 - RNA, 64 nt, Human
gaauaguggguggauagcaaguauauucuaaaaaacuuuguaaauaaaguuuuguggcuaaaau

SEQ ID NO: 455087 - RNA, 64 nt, Human
uuuugaaauuacuguaccuagucuuuuuugcauuacuuuguaaccuuuuucuaugcaagagucu

SEQ ID NO: 455088 - RNA, 64 nt, Human
aagaaagaaacuuaaaauccagguuguugaaaagacuuuguacucccacuuccuccaaauccau

SEQ ID NO: 455089 - RNA, 64 nt, Human
gaucuuugaauauacuuaccuauuauaaaaucuuacuuuguauuuguauuuaaaaaagaaaaau

SEQ ID NO: 455090 - RNA, 64 nt, Human
aguuuuaaucauuuguacauaauuuuaaaaacuuacuuuguauugauuuugaauacagugaaaa

SEQ ID NO: 455091 - RNA, 64 nt, Human
uaugccaugaagaauacauuagaagaauugagggacuuuguagagaauuuuguggcuuuggucc

SEQ ID NO: 455092 - RNA, 64 nt, Human
uaagaaaacaaaaacagaaacacauaguauuugcacuuuguacuuuaaauguaaauucacuuug

SEQ ID NO: 455093 - RNA, 64 nt, Human
uaguauuugcacuuuguacuuuaaauguaaauucacuuuguagaaaugagcuauuuaaacagac

SEQ ID NO: 455094 - RNA, 64 nt, Human
cuaagagacagccuccuuggcaagggcaggcaccacuuuguagcaacuugggcaccagcuuuuc

SEQ ID NO: 455095 - RNA, 64 nt, Human
guuaccaacugcugagauuuuuauguauuuugugacuuuguaacaacugcuauuguaauaagug

SEQ ID NO: 455096 - RNA, 64 nt, Human
ugaaucuccuuguuguucuuuaacccucacugggacuuuguaaacuuccaagucauucucaccu

SEQ ID NO: 455097 - RNA, 64 nt, Human
agugaaaaggaaguaaaugagauucuuuugugugacuuuguagucucuuuguauuaccaaauag

SEQ ID NO: 455098 - RNA, 64 nt, Human
auggccuuuguucauuguauugugauccaauaacacuuuguauuaaauuguuuagcagccauuu

SEQ ID NO: 455099 - RNA, 60 nt, Human
ucauuuggcaaugucuagagacauuuuugguaguuagaauggggggaagauacuccugac

SEQ ID NO: 455100 - RNA, 60 nt, Human
uuacagauggaaugaauguggcaaaaucuuuaguuagaauucacaccuagcacaacauug

SEQ ID NO: 455101 - RNA, 60 nt, Human
aaaaaagucacucuugcuauuucuuuuuuuuaguuagagguggaacauuccuuggaccag

SEQ ID NO: 455102 - RNA, 64 nt, Human
augaauggaaggaaauaugauccuccugagacuaacuuuguauguuaagguuugaacuaaguga

SEQ ID NO: 455103 - RNA, 64 nt, Human
uauauggauuauguuuuagcauuuuauacagucaacuuuguaaugaacuuuuuaaaaauuaauu

SEQ ID NO: 455104 - RNA, 64 nt, Human
accaagugugucuuuaauaucuuguaucagaauaacuuuguauguuaccaacuuaaauugcuag

SEQ ID NO: 455105 - RNA, 64 nt, Human
ccacugcaauaucuucguuaguaaucuguauaauacuuuguauacaaguacugguaagauuguu

SEQ ID NO: 455106 - RNA, 64 nt, Human
aucuuugucacuggaugcuacuugaagagggaguacuuuguaaccacuuugauaugcuguuauc

SEQ ID NO: 455107 - RNA, 64 nt, Human
gaaaugcaaacagguuugaaaauauguauuaaguacuuuguauucuggaagcgugaauugcuuu

SEQ ID NO: 455108 - RNA, 64 nt, Human
auuuucauaucaauauuuucugugauaauuuauuacuuuguaucugaucagcuguuuguggauu

SEQ ID NO: 455109 - RNA, 64 nt, Human
ucuucaucuaaucuuaaaacuuugagccucagagacuuuguagccagcaugugucuguaauugu

SEQ ID NO: 455110 - RNA, 64 nt, Human
gaacuucuaggaaacauccaggagguaucauauaacuuuguagaacuuaaauacuugaauauuc

SEQ ID NO: 455111 - RNA, 64 nt, Human
uacugauacauaauuuaaaagcacacucccuuccacuuuguaauaccagaacucuaauuggaca

SEQ ID NO: 455112 - RNA, 64 nt, Human
aaucacugcuauuagacaauugaaguguucauuuacuuuguaauuccaauaaucauaguuaugg

SEQ ID NO: 455113 - RNA, 64 nt, Human
ucaaugugaaacccaugccuuacauuuacacagcacuuuguaguuugcaaauugguguguuuuc

SEQ ID NO: 455114 - RNA, 64 nt, Human
uaaaagaguaauguauuaccucaauuuuugacugacuuuguaaaagccaauaacugguuuaaug

SEQ ID NO: 455115 - RNA, 64 nt, Human
gggcagcggagaucagcguggacaggagcgaugcacuuuguagaugcuguggcuuuguguugcg

SEQ ID NO: 455116 - RNA, 64 nt, Human
uguggccuuucuuagcauuuuuaccugcagaaaaacuuuguaugguaccacuguguugguuaua

SEQ ID NO: 455117 - RNA, 60 nt, Human
cacaauuaguguauuaaguuacauuuuauuuaguuagaacacuucauuuuguuuuuaguu

SEQ ID NO: 455118 - RNA, 60 nt, Human
ccaggugauccccccgccauuaucucccccuaguuagagacaguccuuccgugaggccug

SEQ ID NO: 455119 - RNA, 60 nt, Human
uuuugauaacauuuggcugggucauuuuaauaguuagagaugaggaggaguaaaagugaa

SEQ ID NO: 455120 - RNA, 64 nt, Human
guguacuaauauauaauuuaucuuaauuuuucuaacuuuguauggauaaucuuucuauucauau

SEQ ID NO: 455121 - RNA, 64 nt, Human
ugcuuuacugguucagcaaaagccaggaagaacaacuuuguaguaaucaaaauguuauccaacu

SEQ ID NO: 455122 - RNA, 64 nt, Human
aggcaucaugucacugcaaagccguugcagauaaacuuuguauuuuaauuugcuuuggugauga

SEQ ID NO: 455123 - RNA, 64 nt, Human
ucaacaucuaauuuuuuuccauccauucuguuacacuuuguauuuucuaacuggagaaaagagu

SEQ ID NO: 455124 - RNA, 64 nt, Human
aggggguuauggguuaaguugcugccuuuuaacuacuuuguagcuguauuuaauagcuggaaac

SEQ ID NO: 455125 - RNA, 64 nt, Human
uaguucauaaaaaaaucaacauacugauaaaaugacuuuguacuccacaaaauuaugacugaaa

SEQ ID NO: 455126 - RNA, 64 nt, Human
augaaaaaaaaugaaguaggaaaauaagaugaagacuuuguauuuuggcuguaaaguuuuauug

SEQ ID NO: 455127 - RNA, 64 nt, Human
cuuuucuaauuaauagccaaagauuucauaucuaacuuuguaaccagaauuauacaguaaguug

SEQ ID NO: 455128 - RNA, 64 nt, Human
ccgugcccaggggcccacagggaacccugcuugcacuuuguaacauguuuacuuuucagggcau

SEQ ID NO: 455129 - RNA, 64 nt, Human
aauucagacuugaaccuuaaaccuaggaaaaguuacuuuguaucaggauucuaacaauuaugcu

SEQ ID NO: 455130 - RNA, 64 nt, Human
acucuaauuaguacacuuguguuuguagauuuacacuuuguauuauguauuaacauggcguguu

SEQ ID NO: 455131 - RNA, 64 nt, Human
gucuggagugauagcuacuguagaaaggaaauagacuuuguaugaacucuuuaaguugaaaagu

SEQ ID NO: 455132 - RNA, 64 nt, Human
uugggcauuuuucuuuuuaauuauucuuccucugacuuuguaucccuuaauaccuacacucucc

SEQ ID NO: 455133 - RNA, 64 nt, Human
caggauaagauagauacaggguaaaauguugagcacuuuguacaugcuuugagagcauaaucuu

SEQ ID NO: 455134 - RNA, 64 nt, Human
aagagacgaggggugaucugugagucccauguaaacuuuguacauuggaauauuuauguuugug

SEQ ID NO: 455135 - RNA, 60 nt, Human
ucauucaucaaguuaucuuuauaaucacuguaguuagauguuucauguccauucaaguga

SEQ ID NO: 455136 - RNA, 60 nt, Human
ugguaauuugucacggauuaguuguacaacuaguuagaaguuucagaauaaacaugcauu

SEQ ID NO: 455137 - RNA, 60 nt, Human
uagccuguuuaaguagguuguaaguuugaauaguuagacauggaaauuauuuuauaagca

SEQ ID NO: 455138 - RNA, 64 nt, Human
auuuaaaaacugaaaaaaaugugcaugaucugucacuuuguauaaaaacaagaaacgauuaguu

SEQ ID NO: 455139 - RNA, 64 nt, Human
cauauuuauucauuuuccacacacuugaccaucuacuuuguauaacacauucugcuaaggccca

SEQ ID NO: 455140 - RNA, 64 nt, Human
uucugccccucuuccuucuuccuucugugacuuaacuuuguaaaggggauauggacaaguaagu

SEQ ID NO: 455141 - RNA, 64 nt, Human
auaaaacauacaguuuauuccacacagcaguuugacuuuguaaaaguuuagcaaaauaacugau

SEQ ID NO: 455142 - RNA, 64 nt, Human
guuauaucuucaucuucagaugaaguuuuaaagcacuuuguaguucucuauugccaacaauuua

SEQ ID NO: 455143 - RNA, 64 nt, Human
aggggacagcucaggguuguuuuggagccuguugacuuuguaucucugccugugauuuucuuuu

SEQ ID NO: 455144 - RNA, 64 nt, Human
acaaaucuagcucuaguuguuauauuuaggcaaaacuuuguagucuucuuucccuuuuaugaug

SEQ ID NO: 455145 - RNA, 64 nt, Human
gacacagaaugaaagggcaucucagccucucugaacuuuguaaaaaucuguccccaguucuucc

SEQ ID NO: 455146 - RNA, 64 nt, Human
uaggcuguugaaucaaagugauuuuagcaauuaaacuuuguauuaauuuaccaccaauauuucu

SEQ ID NO: 455147 - RNA, 64 nt, Human
auagacugaaaauuaagggucaccaccuaauuuuacuuuguauucaguaucguaagugagguua

SEQ ID NO: 455148 - RNA, 64 nt, Human
ugaccuccucuuccccacugccaucuucuaagagacuuuguagcugccuccuagaagcacauuc

SEQ ID NO: 455149 - RNA, 64 nt, Human
cuugccucuuuccauaauccgugguuucaguuugacuuuguauauaaaguugggguuuuuuuuu

SEQ ID NO: 455150 - RNA, 64 nt, Human
agugauuaugcauucuucaucuauuuuaguuagcacuuuguaucguuauauacaguuuacaaua

SEQ ID NO: 455151 - RNA, 64 nt, Human
cuaugcaagguuuacuucucagaugaacaguaggacuuuguaguuuuauuuccacuaagugaaa

SEQ ID NO: 455152 - RNA, 64 nt, Human
cagcugugacuauaucaacugugugccaagugugacuuuguacaguuuuauguuuccacucucc

SEQ ID NO: 455153 - RNA, 61 nt, Human
guuccuaaaugauucucacaagcaacccugagagagacagucuugugagggagaucugggg

SEQ ID NO: 455154 - RNA, 61 nt, Human
caguagacagagacagaccgagagaggaauggagagacagagggggcgcgcgcacaggagc

SEQ ID NO: 455155 - RNA, 61 nt, Human
agccucagcagcugucuugguaaaggagagagagagacauggggccaguaauuccggggug

SEQ ID NO: 455156 - RNA, 64 nt, Human
ucuuuccagccaguuacccuuucaaccuacccauacuuuguacaacucuuacacaaauacuuag

SEQ ID NO: 455157 - RNA, 64 nt, Human
ugaugaaugggcuguugaauaaucauuguaaagcacuuuguauauauaaggugcuauauaagug

SEQ ID NO: 455158 - RNA, 64 nt, Human
cagcucuaaacuagccuugaaguuuacagacaugacuuuguaaauguauuguuuuucuuuguug

SEQ ID NO: 455159 - RNA, 64 nt, Human
acagggguucuaauuacugucugugagaguuacuacuuuguaacuuaugguuucugcuucagua

SEQ ID NO: 455160 - RNA, 64 nt, Human
uaugugauuuucaaauauguaaacuuuaacuuccacuuuguauaaauuuuuaagugucagacua

SEQ ID NO: 455161 - RNA, 64 nt, Human
augagugcauauccaguaguaccuuuaaaguaacacuuuguacauaacaaauacucagcaaaug

SEQ ID NO: 455162 - RNA, 64 nt, Human
aucagagcagucaguccagcaggaagaguggcagacuuuguagcuccaugggcacgucaauuac

SEQ ID NO: 455163 - RNA, 64 nt, Human
uuucuauaaauuuaagaaaacaaguauauaauuuacuuuguagacuguuucacauugcacucau

SEQ ID NO: 455164 - RNA, 64 nt, Human
uuccagggguugccucuccuuaucuacggggauuacuuuguacaugcagauaaguuuucgcaaa

SEQ ID NO: 455165 - RNA, 64 nt, Human
ugugagaaugccguguauaccucacguacuguguacuuuguacauauauuuuaccuuuuauacc

SEQ ID NO: 455166 - RNA, 64 nt, Human
gggagagagggaaaaucaagugguauuuuccagcacuuuguaugauuuuggaugaguuguacac

SEQ ID NO: 455167 - RNA, 64 nt, Human
uauucuauauuuuaauggaucuacugacauuagcacuuuguacaguacaaaauaaagucuacau

SEQ ID NO: 455168 - RNA, 64 nt, Human
auguuuugugaaguauguuuguauuuauuugccuacuuuguacuugauguguuuuguaaugugc

SEQ ID NO: 455169 - RNA, 64 nt, Human
uaagaugauuucaucuucucauaguauagaguuuacuuuguacacguuugaaaccaacuacugu

SEQ ID NO: 455170 - RNA, 64 nt, Human
cauccuuuuccuucugaccaacacuuagucuuuaacuuuguaagguucgguuuaagguuucagg

SEQ ID NO: 455171 - RNA, 60 nt, Human
ccaauuaccauuuuuucuuucaguccaaaauaguuagacccuugcauacagaagugguau

SEQ ID NO: 455172 - RNA, 60 nt, Human
aauugugugugggggguuuuuuguuuuaaguaguuagaagucugggaaaaugaauuuuug

SEQ ID NO: 455173 - RNA, 60 nt, Human
uggcuauuuuuaaaguuaaguuuguauaaauaguuagauauucuagauuuacauuaaauu

SEQ ID NO: 455174 - RNA, 64 nt, Human
acacuuugugauagguuuguacugugccuaauuuacuuuguaaaccagaaugauuccguuuuug

SEQ ID NO: 455175 - RNA, 64 nt, Human
auucaauuaacuacaaaauucuaaucuauguugaacuuuguauacuugaaaugauaauaaaaag

SEQ ID NO: 455176 - RNA, 64 nt, Human
uuugauaccuaacaagauuucaauaaaaauccaaacuuuguauguacguuuguauauauuuucc

SEQ ID NO: 455177 - RNA, 64 nt, Human
acuuuuguaaagaaguauauuuuuaugaaaagaaacuuuguaaaaguaugauguaaauuuucag

SEQ ID NO: 455178 - RNA, 64 nt, Human
uaucaggagacugaaaguucauacuaauuuacaaacuuuguaaagacuggugcuguucauucau

SEQ ID NO: 455179 - RNA, 64 nt, Human
gucacuggcugaccccuccuuguaauguagacagacuuuguauaguucacuuacucuuacaccc

SEQ ID NO: 455180 - RNA, 64 nt, Human
uaucccaccaaguucaagucaaaagaaauuccuaacuuuguauauuucuggagcuauaaaaccc

SEQ ID NO: 455181 - RNA, 64 nt, Human
ucauagauguuggaacuaccuuuuuacuccccauacuuuguaaguaaugcuuccagauuaaccu

SEQ ID NO: 455182 - RNA, 64 nt, Human
ucacaccacugccauaaacaugacaggcuuuuggacuuuguauuaccuguauguuuuauaaugg

SEQ ID NO: 455183 - RNA, 64 nt, Human
cauuuagagcuuugugcuuuucucucauuccaucacuuuguaaugaugauacuuaacaugagca

SEQ ID NO: 455184 - RNA, 64 nt, Human
gaaaguacguuuuuuaaguaaaaaacaaaggcaaacuuuguacuauccaguuaucuaaggaaca

SEQ ID NO: 455185 - RNA, 64 nt, Human
cagcacugcacacuggaaucauugcucuuccuggacuuuguagaaaucagucucaagugcuuca

SEQ ID NO: 455186 - RNA, 64 nt, Human
aacugucaauuugcucuagugucuuauuaguuaaacuuuguaaaauauauauauacuuguuuuu

SEQ ID NO: 455187 - RNA, 64 nt, Human
uguauuaaaacugggguuuguuaccaguugcuguacuuuguauauagaauuuuuauaaauugua

SEQ ID NO: 455188 - RNA, 64 nt, Human
cucaguuccugaccuuccucugagcccuugagacacuuuguaaugcucuuuuguaacuaucgac

SEQ ID NO: 455189 - RNA, 60 nt, Human
aaccaucgugauuugucuuuucaugcagauuaguuagaauucacugccagguuucuucug

SEQ ID NO: 455190 - RNA, 60 nt, Human
aguaauccggcagcuggugggcguuguguguaguuagacaauguccuguugggugguccu

SEQ ID NO: 455191 - RNA, 60 nt, Human
cuagagaauucugggccugaaauuucaaucuaguuagaaagaaaaaugaggcaaugauuu

SEQ ID NO: 455192 - RNA, 64 nt, Human
guaauuaagugcccaauauugaaaggcugcaaguacuuuguaaucacucuuuggcauggguaaa

SEQ ID NO: 455193 - RNA, 64 nt, Human
auuggucuccacaccuaaaaucgucugccuguguacuuuguagaugugaaugguacuauucaac

SEQ ID NO: 455194 - RNA, 64 nt, Human
uauugaagcccuucuguauuuuaaaauguaauauacuuuguaccauuuauaaaaauugugugau

SEQ ID NO: 455195 - RNA, 64 nt, Human
uuuuaauacaauagagacuuuucauuuaacuuuaacuuuguaaauauugaaguguguaauaaag

SEQ ID NO: 455196 - RNA, 64 nt, Human
aagaaugcccagaagaaccucagacacccccacaacuuuguacaaaugguuacuguagucacau

SEQ ID NO: 455197 - RNA, 64 nt, Human
auuugcuuuuaaaauuauaaaaagcaaagagaagacuuuguacacacugucaccaggguuauuu

SEQ ID NO: 455198 - RNA, 64 nt, Human
caaagagaguuuuuaauagaaccauguugguugcacuuuguaguguuuggugcucauuuaaaua

SEQ ID NO: 455199 - RNA, 57 nt, Human
agggaaauuacucugggugaagucagaacuuuguagaacacagaacauaaaggguga

SEQ ID NO: 455200 - RNA, 64 nt, Human
uuguacauauaagugauugcugguuuuaguugcaacuuuguauaaaagggacugagaaauuuau

SEQ ID NO: 455201 - RNA, 64 nt, Human
acugagaucauugguagccagggguugcuaccaaacuuuguaaccucaaggacaaaaugaggaa

SEQ ID NO: 455202 - RNA, 64 nt, Human
gaaauaaagaagacaugaauuguuuuaagucuacacuuuguaauuagcuaaguugugcaguauu

SEQ ID NO: 455203 - RNA, 64 nt, Human
accgcuuugugagccgugucguaugaccuaguaaacuuuguaccaauucaaagacccgagugau

SEQ ID NO: 455204 - RNA, 64 nt, Human
cauuucaauagaaauuuuuauuucauuuucaauuacuuuguaaauucguguguauuuaguacac

SEQ ID NO: 455205 - RNA, 64 nt, Human
ggggauuucagaagaaaauuguaaccaaauucauacuuuguauaauuuuugauaucaugaucac

SEQ ID NO: 455206 - RNA, 64 nt, Human
guucuuaaugggaacaggccuccuaucuuuagucacuuuguacaggaugauauccaugaguacu

SEQ ID NO: 455207 - RNA, 60 nt, Human
guugaaagacacugcauacguuuguauuauuaguuagaaggcaugaagacuuuuuucccu

SEQ ID NO: 455208 - RNA, 60 nt, Human
ugccacagaggugacgaugaacuauguauauaguuagauguuuugauuucguaaaaaaua

SEQ ID NO: 455209 - RNA, 62 nt, Human
uagcgggugggguuguauuuggaagccucugaagagaccaugucuuuuuaaaaucuaacucu

SEQ ID NO: 455210 - RNA, 64 nt, Human
auaucuacccauuuuucugucaucccuauaguucacuuuguauuaaauuggguuucauuuggga

SEQ ID NO: 455211 - RNA, 64 nt, Human
gugauacaguggguaccaagcuccucugcuccccacuuuguagagccuagcaugagguggcaug

SEQ ID NO: 455212 - RNA, 64 nt, Human
cuggauuuugacacagcaacuuccuguagugagcacuuuguaugaaucguggacuuccuguucu

SEQ ID NO: 455213 - RNA, 64 nt, Human
auguuggcaaaguagcaucuuggugacuaaggugacuuuguauauucaucuuaaaaauuauguu

SEQ ID NO: 455214 - RNA, 64 nt, Human
aggccucuuggagaccuuaccccuggcuguuuggacuuuguauacuuuaaauaauuuaacuacc

SEQ ID NO: 455215 - RNA, 64 nt, Human
agauauuuucaugguaaugucaacauggucaagcacuuuguaccaaguuauuaaguaacauaau

SEQ ID NO: 455216 - RNA, 64 nt, Human
aaagggcuagccagguggcaagaucaauuuagcuacuuuguauuuucagagucaaauuacagac

SEQ ID NO: 455217 - RNA, 64 nt, Human
aaaauuuugguggacaaugauuuuuaaaaaacuaacuuuguauaaccuaauauuuguauucucu

SEQ ID NO: 455218 - RNA, 64 nt, Human
augaagcgccaaagaugcaccauguagaauuuucacuuuguacuggcaggcucguuuuaccuca

SEQ ID NO: 455219 - RNA, 64 nt, Human
uuguaaacgagaccaccaggccuucuucacuaagacuuuguauucaacuuaguuuaauguagau

SEQ ID NO: 455220 - RNA, 64 nt, Human
gaaagguggcuggagagagcugaggauuuccaggacuuuguaaguucuuauucugggagaacau

SEQ ID NO: 455221 - RNA, 64 nt, Human
gaauauacauuuuucuuaauguuccaacaucuauacuuuguaaagucaaaacauuucccaugag

SEQ ID NO: 455222 - RNA, 64 nt, Human
cuaguacuugucuuauagguaaccaacacugaaaacuuuguagugaugacuaccaaagaaauac

SEQ ID NO: 455223 - RNA, 64 nt, Human
ggcuuccucaggcuucucaccuguggccaacuucacuuuguaagacccauauuuuuaacucuuc

SEQ ID NO: 455224 - RNA, 64 nt, Human
cuuuccucccaaggguucuggcaccuuaugauguacuuuguaaaaaaauugauugaagauuuua

SEQ ID NO: 455225 - RNA, 62 nt, Human
ggcuaaaugguuugaucagguuuucucuuugaagagaccacagccuuaggaaaugguucuug

SEQ ID NO: 455226 - RNA, 62 nt, Human
cuuacaaggcaggccuuuccuacaggggguggagagaccagccuuucuuccuuugguaggaa

SEQ ID NO: 455227 - RNA, 62 nt, Human
uaacugcaguuucaaugaggcagagggcaaagagagaccaagaucagagggguucauuauac

SEQ ID NO: 455228 - RNA, 64 nt, Human
gcugacagacugggauuuucuguacuaaaauguuacuuuguaucaaaaguuaaacaggcuuuag

SEQ ID NO: 455229 - RNA, 64 nt, Human
aagucaguaaaaaaacacaaaaacuguaugaaugacuuuguaaauuuuguucuauaugaauaaa

SEQ ID NO: 455230 - RNA, 64 nt, Human
uuuuaacucuaacacccuucagaaauuucuaacuacuuuguaacugcauggcuuaaccugguga

SEQ ID NO: 455231 - RNA, 64 nt, Human
gcucugagcauugccaauggccccuacucaccugacuuuguauccucuccuuuuagaggcuuug

SEQ ID NO: 455232 - RNA, 64 nt, Human
cuuguuaaugguuaauauaggcagggcgaauacuacuuuguaacuuuuaaagucuuaaacuuuu

SEQ ID NO: 455233 - RNA, 64 nt, Human
uaucuauuuguuuuguacauguauauaucuaggaacuuuguaacaacacaucuuuaauaauguu

SEQ ID NO: 455234 - RNA, 64 nt, Human
gcuuaagaagugggacuguaaauauguauauuuaacuuuguauagcccauguaccuaccuugua

SEQ ID NO: 455235 - RNA, 64 nt, Human
ucuccuguaaugacuguugguucaggcauguuguacuuuguagggacaaaugugcauuuguuug

SEQ ID NO: 455236 - RNA, 64 nt, Human
uuaucacugcuuaacuucaucuucaugaaaugaaacuuuguaacuuauuguaguuagaaauugu

SEQ ID NO: 455237 - RNA, 64 nt, Human
gcauauuccccuuguuagaucccauuuucauguuacuuuguagccuuggccagaggcucaaaaa

SEQ ID NO: 455238 - RNA, 64 nt, Human
auugugaauuagacuuguauaucccacugggagcacuuuguaggcauugcaugaaccaugggau

SEQ ID NO: 455239 - RNA, 64 nt, Human
uuuuacuuuagugucacucaccuuuuacaaagugacuuuguacucauuuagggcucuaucggaa

SEQ ID NO: 455240 - RNA, 64 nt, Human
aaaagaaauaaacuucaauguauuuuuuauuacaacuuuguacugguuguaacuugcauuagaa

SEQ ID NO: 455241 - RNA, 64 nt, Human
aggcaauaaacauguuuucauguaauacuggcuuacuuuguaauuuacaucuguaacuuucaua

SEQ ID NO: 455242 - RNA, 64 nt, Human
ugaacauguaacuucucucacaagaguacucuuuacuuuguaaucauauacaaugucaacuuuu

SEQ ID NO: 455243 - RNA, 62 nt, Human
agccucacuucuaggguaugggaaauccaaucagagaccaggcccuggcuaagacccaaaca

SEQ ID NO: 455244 - RNA, 62 nt, Human
agagaugccaccagggcuggucucccaggaguagagaccaugggaaaugggguggauuagga

SEQ ID NO: 455245 - RNA, 62 nt, Human
cacagaucccacuuacucuuuuuuuuuuuuucagagaccacagaccacagugauuuuucuuu

SEQ ID NO: 455246 - RNA, 64 nt, Human
uggacaggaagacuuggggcaugggacagcucagacuuuguauuuaaaaguuaaaaaggacaaa

SEQ ID NO: 455247 - RNA, 64 nt, Human
ugauuauuuuauugcuaauuuaaaaauaaaaaugacuuuguauugauugugaaacgguucuggc

SEQ ID NO: 455248 - RNA, 64 nt, Human
agcacaguuuuguaauucagaucaucaccccugcacuuuguaccacaugggcguauucuuucuu

SEQ ID NO: 455249 - RNA, 64 nt, Human
ccugcccagauggccaccucguggugcugcggugacuuuguagccaacuuuauaauaaagucca

SEQ ID NO: 455250 - RNA, 64 nt, Human
uuccuggguuuucucauugucuuuuugcaucaguacuuuguauugggauauuaaagagauuuaa

SEQ ID NO: 455251 - RNA, 64 nt, Human
ugugaacugugauggggugggcagggcugggagaacuuuguacaguggagaaauauuuauaaac

SEQ ID NO: 455252 - RNA, 64 nt, Human
caggacaccgcuguccuggcauuuguggccacucacuuuguaggaaacucaucuccuuccugag

SEQ ID NO: 455253 - RNA, 64 nt, Human
gaaaauucaagaaaauaaauguagcuggugggagacuuuguagauguugggcuauauguugggg

SEQ ID NO: 455254 - RNA, 64 nt, Human
gcucucuuuuuagcuacuaaguaacauacucaagacuuuguaucugugcagcauuuuauggaaa

SEQ ID NO: 455255 - RNA, 64 nt, Human
caaaaauaguuucuuuuccaaagguuguugcucuacuuuguaggaagucuuugcauauggcccu

SEQ ID NO: 455256 - RNA, 64 nt, Human
uuuuguugagaugaguuugcuguacugacgcugcacuuuguaaacagauuaccaguuuuuuacu

SEQ ID NO: 455257 - RNA, 64 nt, Human
gguuacacuguguuuuaaauuacuuuaaaaauaaacuuuguaagcagauuuuaauuuagucuuu

SEQ ID NO: 455258 - RNA, 64 nt, Human
gauguguuuauucuuuucuaagcagaaugguuuaacuuuguacucuuugaaaaauaaugcugau

SEQ ID NO: 455259 - RNA, 64 nt, Human
guaaaaccucauaaauaaguuauaauuucuguucacuuuguauuuguucaguaugcaaagugug

SEQ ID NO: 455260 - RNA, 64 nt, Human
uuauuauuauuauuauuuuuugagauggagucucacuuuguaacccaggcuggaaugcaauggc

SEQ ID NO: 455261 - RNA, 60 nt, Human
auuggaaucuagccagaaaugucugucagauaguuagaauuguaacaucuaaaccugcca

SEQ ID NO: 455262 - RNA, 60 nt, Human
uuuaguaaguaucaagagguagccugagccuaguuagaguuagaccugucuuuggaugaa

SEQ ID NO: 455263 - RNA, 60 nt, Human
aagcaacuuuaauaggugauaaauguacaguaguuagauuucaccugcauauacauuuuu

SEQ ID NO: 455264 - RNA, 64 nt, Human
aaguuguauacacuuuacaauguaaaagaaacaaacuuuguauaauagcaaaucgggaagggga

SEQ ID NO: 455265 - RNA, 64 nt, Human
uguauuuuucuuuguauaugaaauaauuuuuuguacuuuguaaaauauggagcccauuguaccu

SEQ ID NO: 455266 - RNA, 64 nt, Human
auaaugaaaugguucccuuuuaaaaaauaaaaauacuuuguagauuaaaaauaaaucagaauuu

SEQ ID NO: 455267 - RNA, 64 nt, Human
agcaaagggcacuucuuuuaaggcuacuuucagaacuuuguauuuucgcuaaacuauaaaugca

SEQ ID NO: 455268 - RNA, 64 nt, Human
uauacuguguugugcacucaugcacugaccuuacacuuuguacuuacacugugggcaugugguc

SEQ ID NO: 455269 - RNA, 64 nt, Human
ccucugaggagcgucuggggaggcacauuuaugcacuuuguaucacccuccgaacuccccccac

SEQ ID NO: 455270 - RNA, 64 nt, Human
auugagccucacuggugccaggaagccaaagcuuacuuuguagaacugacacuaaacuacccga

SEQ ID NO: 455271 - RNA, 64 nt, Human
ccauuugugccagaggaauccuggcagcccagagacuuuguagauccuuagagguccucuggag

SEQ ID NO: 455272 - RNA, 64 nt, Human
guauaauggaagcaagacuuccaaccucacggagacuuuguaauuuguuuucugagagcacagg

SEQ ID NO: 455273 - RNA, 64 nt, Human
uuaaauauuugaauugacaguuacauguuucauaacuuuguaugucuauugguugugcaggugu

SEQ ID NO: 455274 - RNA, 64 nt, Human
guaaaagaaagguugcguuuaauauauuuuuugaacuuuguaggacaaaacauagcugguuaac

SEQ ID NO: 455275 - RNA, 64 nt, Human
uucuguuuagugaaggcccaaagacuccucuaagacuuuguauauuuguuacauaaaaccaagu

SEQ ID NO: 455276 - RNA, 64 nt, Human
gucccauagaaaauuggguguguauacuuguauaacuuuguaaauaaguuuuuuuucuggguuc

SEQ ID NO: 455277 - RNA, 64 nt, Human
aagccaacuggauuucuccccugugcuccaaaugacuuuguacaagugcuggaguuagcaccuc

SEQ ID NO: 455278 - RNA, 64 nt, Human
uuaguaaaugcaaguaagaacaucaucaaaguucacuuuguauuguacccuguaaaacugugug

SEQ ID NO: 455279 - RNA, 60 nt, Human
uauuuugucuaggagaugcuuucucucuaguaguuagaaauuaaaucugugucagcauuc

SEQ ID NO: 455280 - RNA, 60 nt, Human
uguuaauggaugaauuguauuuugcaaagauaguuagagaaauaccuccuuccccuuagc

SEQ ID NO: 455281 - RNA, 60 nt, Human
aggaagggaaaaauuuauagcuacagaggguaguuagaaaaaucauaacuuauaugugaa

SEQ ID NO: 455282 - RNA, 64 nt, Human
gucaccaaauaaucuuaccucuagucuacuuacaacuuuguaaggguuucuaagcuaugcccau

SEQ ID NO: 455283 - RNA, 64 nt, Human
caugaaaaucaaaugaugcaaaauauauacaagcacuuuguaaauuguaaaaugauacaaaauu

SEQ ID NO: 455284 - RNA, 64 nt, Human
aguugugugaagcucuuggcuuuuuuccaacguuacuuuguaacuaaugaggguggauguucau

SEQ ID NO: 455285 - RNA, 64 nt, Human
gggccaccaagguuggaaaaggguuugguucuugacuuuguauuccuuccaauacagcaauaaa

SEQ ID NO: 455286 - RNA, 64 nt, Human
uuugugucccgacagcccuguuccugguccaaguacuuuguauuguauacgugagucauaauaa

SEQ ID NO: 455287 - RNA, 64 nt, Human
ccccaggacuuaccuuccaaaacaaacuuucuucacuuuguauuauagguacaagacagcgacu

SEQ ID NO: 455288 - RNA, 64 nt, Human
aaaaugguguacuguauacuuuaacaugccccauacuuuguauuggagaguacaauaauguaaa

SEQ ID NO: 455289 - RNA, 64 nt, Human
ucccaacaauuaaaucuugccuuuacacacccaaacuuuguaauuuuagucuuggugaaauaua

SEQ ID NO: 455290 - RNA, 64 nt, Human
auuacugucaccuugauggacaaguuucaauaaaacuuuguaaaaauaauuggacaugugccug

SEQ ID NO: 455291 - RNA, 64 nt, Human
uaagauagaaaggaacaagacuaaaauuguaaauacuuuguaaacaucagcauuuguacuugaa

SEQ ID NO: 455292 - RNA, 64 nt, Human
cgacaggaaaaagguuggagcagugcuuuucacuacuuuguaucaauccaggcuacaaucuuca

SEQ ID NO: 455293 - RNA, 64 nt, Human
uggaggguaggccucagaccagggggucuccaaaacuuuguaaaucaugcaucuuuucuccaua

SEQ ID NO: 455294 - RNA, 64 nt, Human
cuuugccuguaggauguacuguauguagucaugcacuuuguauuaauauauuagaaaucuacag

SEQ ID NO: 455295 - RNA, 64 nt, Human
gucaaacauugugaucuauaaaugcacagaaaauacuuuguaaaaaguagcauccuuauauaau

SEQ ID NO: 455296 - RNA, 64 nt, Human
uaauuuucugcuuuguauauuucuauauuguuuaacuuuguaagaaugcccauuacuuuuuuaa

SEQ ID NO: 455297 - RNA, 60 nt, Human
cgcguauuuugccuuugcugcuacuuuuucuaguuagauuucaaacuugccuguggacuu

SEQ ID NO: 455298 - RNA, 60 nt, Human
caaacugugaugacaaauauuacguuuaucuaguuagaagcuaauguuuuguacauuuuu

SEQ ID NO: 455299 - RNA, 60 nt, Human
cugcgacggaggcaggaccaggcauuuagcuaguuagagacucgccugggaaauugcucc

SEQ ID NO: 455300 - RNA, 64 nt, Human
gcaaauuugcaugagcuccuggaaagaguugcugacuuuguaucuaagaccugccagggaauac

SEQ ID NO: 455301 - RNA, 64 nt, Human
cauuuagguaacaucugucuuaccuuccucacagacuuuguacagaccaaagcaacaaauauuu

SEQ ID NO: 455302 - RNA, 64 nt, Human
ccuccugucuuucucauccaggucaggcauugacacuuuguaagaaaggggguaggggacacag

SEQ ID NO: 455303 - RNA, 64 nt, Human
uuaccuuuuaacauugccccuuucaggggaccccacuuuguagggaaucugcagaaggugugcu

SEQ ID NO: 455304 - RNA, 64 nt, Human
ucauggaaggugguauggaagaagguauggaaauacuuuguauucuaaaaacucacugacgugg

SEQ ID NO: 455305 - RNA, 64 nt, Human
aguuagaacuggauugccauuuucauuauauaauacuuuguaccucuagagcacucucccuuuc

SEQ ID NO: 455306 - RNA, 64 nt, Human
agcuuuauuuaaagucuucuguccagcuuuaagcacuuuguaagacauggcugaaaguagcuuu

SEQ ID NO: 455307 - RNA, 64 nt, Human
uagaaaaaauaagugauucaaaaugaaaauauuuacuuuguagaauaugacuuuagacauauca

SEQ ID NO: 455308 - RNA, 64 nt, Human
uaguuauaugaaucuuuauaacacauaauuacuaacuuuguagccauauauguaauugacuuug

SEQ ID NO: 455309 - RNA, 64 nt, Human
auuuaaaugaaauggggagauauuuacauuccguacuuuguaaacuugagcuauuggacuucac

SEQ ID NO: 455310 - RNA, 64 nt, Human
caucacuguguuugacuucuugugaaauuucuguacuuuguauauaaaauacauaaaacaauag

SEQ ID NO: 455311 - RNA, 64 nt, Human
uauuuauuuugcagucuuguugaaaguucaugaaacuuuguacuuuuuaauaagaugauacacu

SEQ ID NO: 455312 - RNA, 64 nt, Human
aguauaaaguguuuucuguaccuuagauucacaaacuuuguauuuuuaguacauauuuugaaga

SEQ ID NO: 455313 - RNA, 64 nt, Human
ucaucucugcaauaaacuaaacguaaauaauguaacuuuguauaauuuaguaguauguacuugg

SEQ ID NO: 455314 - RNA, 64 nt, Human
gaguuuauauuuucaaacgguuuuuacagcuuagacuuuguacuuacugcccugccugugacag

SEQ ID NO: 455315 - RNA, 61 nt, Human
gcggccgcggcugggcccugcaggagggagagagagacacagucauggcccccuuccuccc

SEQ ID NO: 455316 - RNA, 61 nt, Human
guauguguccacaggccauaacaggguagaagagagacaucgugcaacccaaugaguagug

SEQ ID NO: 455317 - RNA, 61 nt, Human
ugcuuugcccaagugugacagcacuggggaggagagacaggauaaagggcagaugucagca

SEQ ID NO: 455318 - RNA, 64 nt, Human
gugguucaacuuuuaaguuaagggaaaaacuuuuacuuuguagauaauauaaaauaaaaacuua

SEQ ID NO: 455319 - RNA, 64 nt, Human
caaugauuuguacugucuaauaaaaacaguguauacuuuguaugugucgugcauucaguggucu

SEQ ID NO: 455320 - RNA, 64 nt, Human
uaugcagaugaagaggguaggaacuaaauaaaggacuuuguaagccaaagugguugggcugcuu

SEQ ID NO: 455321 - RNA, 64 nt, Human
ucucccaccccagaucccagggacucauccugugacuuuguaaccacacucauuccuuucaaac

SEQ ID NO: 455322 - RNA, 64 nt, Human
caagcugagaaaaaaaaaaaaaaacacguuugauacuuuguacaucagaugcaucuuauuuaaa

SEQ ID NO: 455323 - RNA, 64 nt, Human
auguuuuaaauguacagacauauuuaacuggugcacuuuguaaauucccuggggaaaacuugca

SEQ ID NO: 455324 - RNA, 64 nt, Human
gaacaguagcaaaucagauuuuccagaagcacaaacuuuguagaauacaguuuaguauaauucc

SEQ ID NO: 455325 - RNA, 64 nt, Human
guguccaucuucauucacucauagucuccaaaugacuuuguauuuacaucacucccaacaaaug

SEQ ID NO: 455326 - RNA, 64 nt, Human
ggauauucugacuccuggcccagugcuuuuucuuacuuuguagcuacacuuugaaguaagauuc

SEQ ID NO: 455327 - RNA, 64 nt, Human
agaucacaugcuuagucauuuuuauguucauuccacuuuguauaucuuuucuauuuauugacuu

SEQ ID NO: 455328 - RNA, 64 nt, Human
acaaguauauuuuuaaaguuguuuuauaagagagacuuuguagaagugccuagauuuugccaga

SEQ ID NO: 455329 - RNA, 64 nt, Human
gccuuaaacucuguuacacuuuuuggaagugaaaacuuuguaguaugauagguuauuuugaugu

SEQ ID NO: 455330 - RNA, 64 nt, Human
gacccauuuauuucccaaggcacaaucacuaaagacuuuguacuuucacagucuguuaaugugg

SEQ ID NO: 455331 - RNA, 64 nt, Human
agcauaugugucauuacaugugaugcugugcaaaacuuuguauaauucuguguuauuaacaguu

SEQ ID NO: 455332 - RNA, 64 nt, Human
cuguauauuacuuuuauuuuuaggaccauaaucaacuuuguaauauucuuauauaauuaauuag

SEQ ID NO: 455333 - RNA, 60 nt, Human
cagucacccagggaauaacaacuuaagcuguaguuagauaacaccuagugauuaauuggc

SEQ ID NO: 455334 - RNA, 60 nt, Human
ucaaguauuagcaacuugcaguauauaaaauaguuagauaaugagaaguuguuaauuauc

SEQ ID NO: 455335 - RNA, 60 nt, Human
uugugauuucuagucuugcaaagcuguauguaguuagaugaugugacaaccucuaauauu

SEQ ID NO: 455336 - RNA, 64 nt, Human
cucagaauauucuucuaaguauuuugaugaaguaacuuuguaauuauuugaacauuguuuuaau

SEQ ID NO: 455337 - RNA, 64 nt, Human
uuaagguugaacuuugccaaaaaaaaaagaaguuacuuuguaauuuuuggggaaaaaagcacau

SEQ ID NO: 455338 - RNA, 64 nt, Human
gauaguuaauuuguucuuaccaaaaaauaaaauuacuuuguaaauagcaguucacauuuuucca

SEQ ID NO: 455339 - RNA, 64 nt, Human
auuuuaaaagcuuugcaaccuauauauuuauauaacuuuguaauauaacaugggcaaauaucug

SEQ ID NO: 455340 - RNA, 64 nt, Human
cuggggagagaagcaagagcaggcuggagucucuacuuuguauucuugugaggcacaaauauag

SEQ ID NO: 455341 - RNA, 64 nt, Human
agcuucuguauguaaaaugcuagguaauaaggacacuuuguacaggcuguuuugcaccugauuu

SEQ ID NO: 455342 - RNA, 64 nt, Human
ugaaaaucauaucaaaaguauguuguuucaggagacuuuguauuuagaauauucauguaaaacu

SEQ ID NO: 455343 - RNA, 64 nt, Human
auuuaaauugcauuuauuaaucuuuuuaucugaaacuuuguacacuuuuccacuuucaaaaccu

SEQ ID NO: 455344 - RNA, 64 nt, Human
uauaaaccucuugauaaaaaaugcacaaaaaaucacuuuguauaugugaguuucacugcauugu

SEQ ID NO: 455345 - RNA, 64 nt, Human
guauggaauguucuuauuuagcuuaucauaaucuacuuuguaaaacaugcugaaaccucacugu

SEQ ID NO: 455346 - RNA, 64 nt, Human
cuuuuauuaauuuaaaauagaacgcuugagaggcacuuuguaaagauuuguuaaacuggaaacg

SEQ ID NO: 455347 - RNA, 64 nt, Human
acuauuccauauuguauccacaauuuaugauaucacuuuguaacccauacauuuauacaauuau

SEQ ID NO: 455348 - RNA, 64 nt, Human
ggauuuucauauauuuaacuuugcaaaaagauuuacuuuguacauguuacaggcuugauuggug

SEQ ID NO: 455349 - RNA, 64 nt, Human
acauuaacaagcauuuuguguguacguaguaguuacuuuguacugagagaacuugcuuuggggu

SEQ ID NO: 455350 - RNA, 64 nt, Human
auuaucagcaacauaaauuuaucaaauuugcagcacuuuguaaaugaugagauugcuuccuacc

SEQ ID NO: 455351 - RNA, 60 nt, Human
auauguuuggacaauuagcaacaagucagauaguuagaaucgaaguuuuucaaauccauu

SEQ ID NO: 455352 - RNA, 60 nt, Human
uaaggucuuugaaauaggauuccuuacuuuuaguuagaaaccccuaaaacgcuaauauug

SEQ ID NO: 455353 - RNA, 60 nt, Human
uggaauggguggugguaaguucacagaguguaguuagaucccaacucccaugaccucugg

SEQ ID NO: 455354 - RNA, 64 nt, Human
ugaacaaagaggaaaucaucuucauaguaaugaaacuuuguaaaguguuuccuuauauugguaa

SEQ ID NO: 455355 - RNA, 64 nt, Human
cuuuguaaaacuuagauaauagagccuagcaguuacuuuguaucuaauugauacauuuuauguu

SEQ ID NO: 455356 - RNA, 64 nt, Human
gugauugaguacuaacuaggaagguauuaacaccacuuuguaguuguccuuuacguaacuacuc

SEQ ID NO: 455357 - RNA, 64 nt, Human
cauaacccuaaugaugcaagucauaugggggaacacuuuguaaauggucaggauaaaaaccaaa

SEQ ID NO: 455358 - RNA, 64 nt, Human
ugaccuccuuagaggcagauuaguaacuguuccuacuuuguauagcuaagugacagucacuuaa

SEQ ID NO: 455359 - RNA, 64 nt, Human
augcauaaccaaaacaauggcucaauuguguuuaacuuuguauuuugauuguugagaacaaaaa

SEQ ID NO: 455360 - RNA, 64 nt, Human
uucuacuuuaaauuuguccucacauuccucuucuacuuuguaugcaacaaguagaauggggcau

SEQ ID NO: 455361 - RNA, 64 nt, Human
guuuuuaaaucacuucaacauuauuugagcauuuacuuuguauuuuuacaaacacauaaacaca

SEQ ID NO: 455362 - RNA, 64 nt, Human
uucguuaagaauuuggggcaggaaauacuuuguaacuuuguauaugaaucaaaacaaacgagca

SEQ ID NO: 455363 - RNA, 64 nt, Human
cuuucauuuucguuaagaauuuggggcaggaaauacuuuguaacuuuguauaugaaucaaaaca

SEQ ID NO: 455364 - RNA, 64 nt, Human
ggcccuccaguguuguccaaggaaauguagaaucacuuuguagauauggagaugaagaagacaa

SEQ ID NO: 455365 - RNA, 64 nt, Human
auaugugguuugccccaagugugcacuauuuaauacuuuguaauaugccaccaagaguacugac

SEQ ID NO: 455366 - RNA, 64 nt, Human
cccacaucacucuaucucuggccucugauucucaacuuuguaccuguguggcuccucuuguuag

SEQ ID NO: 455367 - RNA, 64 nt, Human
cacaggaggaucucuaaagcaguagccaaacaccacuuuguaaaaggacucuuccaucagagau

SEQ ID NO: 455368 - RNA, 64 nt, Human
cuaucuaauucacaaauuaauuucuggaaauuaaacuuuguaaauuaaguuuuugccuauaaga

SEQ ID NO: 455369 - RNA, 60 nt, Human
uugaucauaccaaacauuuccuaaacucucuaguuagauaucugacuugggaguauuaaa

SEQ ID NO: 455370 - RNA, 60 nt, Human
cuuaaagagcucucuagucuaacggucuuguaguuagagaucuaaaugacauuuuaucau

SEQ ID NO: 455371 - RNA, 60 nt, Human
aagagcugugcauuauaaaaucaguuagaauaguuagaacaauucuuauuuaugcccaca

SEQ ID NO: 455372 - RNA, 64 nt, Human
uuaugaagauaauauuaucuauuuguaaauugcuacuuuguauuuuaugcaugcucuguaauuu

SEQ ID NO: 455373 - RNA, 64 nt, Human
uaugugguuugcccucaauugagcacuguuuauuacuuuguaauaugccacugugaguacugac

SEQ ID NO: 455374 - RNA, 64 nt, Human
aagcaggguucccccuucccuuuucuccuucccuacuuuguacaaaggaccagaguuauauaua

SEQ ID NO: 455375 - RNA, 64 nt, Human
uucuuauuaacaaaauuucauauuaaauugcuucacuuuguauuuaaaguuaaaaguuacuauu

SEQ ID NO: 455376 - RNA, 64 nt, Human
guguugcaucaaacagaagauucugacugcugugacuuuguaccgcaugaucaacuuagaaucu

SEQ ID NO: 455377 - RNA, 64 nt, Human
aaauguaacaauuuaacccacaggaaaaaaaauuacuuuguaugcuuguuugaacccuaugggu

SEQ ID NO: 455378 - RNA, 64 nt, Human; identical to SEQ ID NO: 455365

SEQ ID NO: 455379 - RNA, 64 nt, Human
uaugcgguuugcccucaagugugcacuguuuauuacuuuguaauaugccacugugaguacugac

SEQ ID NO: 455380 - RNA, 64 nt, Human
ucaagccucauuugcuaucccagcaucucuuaaaacuuuguagucuuggaauucaugacagagg

SEQ ID NO: 455381 - RNA, 64 nt, Human
ucaauacauuguacaugaaaaaaugaaaaguagaacuuuguaauacuuuaaucaauaaaauuaa

SEQ ID NO: 455382 - RNA, 64 nt, Human
ucagaaguuccagacagaugagaaagcaaaaaguacuuuguaaaguguuauacaaucagaaggu

SEQ ID NO: 455383 - RNA, 64 nt, Human
agcacugggguauuguuggcuucuuguguuggaaacuuuguaauguaaaaggaaaaacuggaaa

SEQ ID NO: 455384 - RNA, 64 nt, Human
uugugaggaauugaugagaugauguaugugaaacacuuuguaaccuguaaagcgcugugcacac

SEQ ID NO: 455385 - RNA, 64 nt, Human
auacauagaggugauaaguaauaaaacuaugaacacuuuguaaaacauugacauuuuauuuucc

SEQ ID NO: 455386 - RNA, 64 nt, Human
auagcgccuacuucacggaaacuugugccuuuaaacuuuguaaacuuaaacacagccgagaagu

SEQ ID NO: 455387 - RNA, 60 nt, Human
cuggaucagcaguaucacuaucacuugggcuaguuagagauccagauucuggauccauac

SEQ ID NO: 455388 - RNA, 60 nt, Human
gguccagaguuuaaguccagccuggaaacauaguuagaccucaucucuacaaaaauaaaa

SEQ ID NO: 455389 - RNA, 60 nt, Human
ucuucugcagacuuaacguguuuucugucauaguuagaugugauaauucuaagagugucu

SEQ ID NO: 455390 - RNA, 64 nt, Human
aaggcuucucaauuuguauuuuccaggcaagagaacuuuguaccccuucucuguguggauagac

SEQ ID NO: 455391 - RNA, 64 nt, Human
gauauguuacugccccacccuaacugaucaauguacuuuguaauccucccacccuuaagaaggu

SEQ ID NO: 455392 - RNA, 64 nt, Human
aaaugcugugcuuacaccuuaucuaugaacagucacuuuguaccauuaucuguggaacacagaa

SEQ ID NO: 455393 - RNA, 64 nt, Human
ucaccccugucucucaccuccaccaaccccacucacuuuguaacuucaucacugacccggccaa

SEQ ID NO: 455394 - RNA, 64 nt, Human
cuccccaccuuugccauucuuaaguauugaauguacuuuguauaauuuuaguggaauuguuauu

SEQ ID NO: 455395 - RNA, 64 nt, Human
uguuguguuguuuucauuguugaaaauaaauauaacuuuguauucgagucucgucaauaagugu

SEQ ID NO: 455396 - RNA, 64 nt, Human
ucguaauuggaaccuuugaccugaucuaaaguggacuuuguagcaacaagaggagcaucagcgg

SEQ ID NO: 455397 - RNA, 64 nt, Human
cccccuccuccccaccauccucccuaccuccuuaacuuuguacuagacuggccugggccugccc

SEQ ID NO: 455398 - RNA, 64 nt, Human
aacuaaacccgggucuccugcugcacagagcugaacuuuguaucuugcaaugcgcuggcugccu

SEQ ID NO: 455399 - RNA, 64 nt, Human
uuugaauaugucacaaggucuuuuuuuuuaaagcacuuuguauauaaaaauuuggguucucuau

SEQ ID NO: 455400 - RNA, 64 nt, Human
gaucuguguuagaaguguugcaaaugcuguacugacuuuguaaaauauaaaacuaaggaaaacu

SEQ ID NO: 455401 - RNA, 64 nt, Human
ccaacuucauguucccugcaauuuauuuaaagaaacuuuguauuucacuacauaaucugaaauc

SEQ ID NO: 455402 - RNA, 64 nt, Human
ucuguagucuuuagcaagacacaaguggauuuugacuuuguaucaugucaugauuucuaacaau

SEQ ID NO: 455403 - RNA, 64 nt, Human
agaaaacuagagaggaaaaaguggguguucaugaacuuuguaguugggagagugguuuuacaug

SEQ ID NO: 455404 - RNA, 64 nt, Human
aaugucaccuauaugggauuugccuguuuuaauaacuuuguaaggaauucuugcucuucuaggg

SEQ ID NO: 455405 - RNA, 60 nt, Human
gguaaagucugaugugcaaacguuuuaccauaguuagagccaaaagaaagacacuugcaa

SEQ ID NO: 455406 - RNA, 60 nt, Human
caggggacuugaaaauauggaagacccacauaguuagaagaauauauuuauaaagauucc

SEQ ID NO: 455407 - RNA, 60 nt, Human
aguacucuucucacuaauuuuuguugugguuaguuagaaaaaugguuauuuuuagugggu

SEQ ID NO: 455408 - RNA, 64 nt, Human
uuaacucccuccaccagccugcugacagacacuaacuuuguauccguucaauaagcauuucaua

SEQ ID NO: 455409 - RNA, 64 nt, Human
gucaaauacaaaaaugguaacuagguugacagauacuuuguauuuuucuuuugaauucagaccu

SEQ ID NO: 455410 - RNA, 64 nt, Human
cuuguuuaugucagagcuuuguuguaagccucucacuuuguaaggaaauucuuauuggguaggu

SEQ ID NO: 455411 - RNA, 64 nt, Human
agguuggucaauuaccguggcacacuuucuggucacuuuguacaauguagauuugaaguacagu

SEQ ID NO: 455412 - RNA, 64 nt, Human
uucuccaugccugugggaucuguuucuuuaaagcacuuuguacuguuauucaggagguugauaa

SEQ ID NO: 455413 - RNA, 64 nt, Human
gaauuuuuuugcauuuaugaacggcuguuuuucuacuuuguaauugugagacauuuucuugggg

SEQ ID NO: 455414 - RNA, 64 nt, Human
uugucacauaggaauuguucagcaacagaaagauacuuuguaaugagaagguacaaauuugagu

SEQ ID NO: 455415 - RNA, 64 nt, Human
aagugggggcagcccaggcgguuucacgccccacacuuuguacagaccgagaggccaguugauc

SEQ ID NO: 455416 - RNA, 64 nt, Human
agggagguggggaugagaagagggguuuuuuuguacuuuguacaaagaccacacauuuguguaa

SEQ ID NO: 455417 - RNA, 64 nt, Human
guucuuuuuacagagcaauuaucuuguauauacaacuuuguauccugccuuuuccaccuuaucg

SEQ ID NO: 455418 - RNA, 64 nt, Human; identical to SEQ ID NO: 455129

SEQ ID NO: 455419 - RNA, 64 nt, Human
uuucuccuaguaucaguguguuuaacaaauuuuaacuuuguauauuuguuaucuaucaggcuaa

SEQ ID NO: 455420 - RNA, 64 nt, Human
gugaucagugugcuaaaucucucugccuguuuggacuuuguaauuauuuuuuuagcaguaauua

SEQ ID NO: 455421 - RNA, 64 nt, Human
gcagcccagugaccacugcccagugggaggcgccacuuuguauauuucaggacugggaccuacu

SEQ ID NO: 455422 - RNA, 64 nt, Human
guugguuccuagugcuacuuguuuuacaaacuacacuuuguagaauugauuagauuaccuuguu

SEQ ID NO: 455423 - RNA, 60 nt, Human
uacuuuugcaccagccuaacaauaguugauuaguuagaccuuuucuggguuuuguauuga

SEQ ID NO: 455424 - RNA, 60 nt, Human
aagugagguugauuaauggguacgaaaauauaguuagaacgaauuuguuguaguauuuga

SEQ ID NO: 455425 - RNA, 60 nt, Human
gaguggugucuauuccuauggagaagccaguaguuagaaacggugagaauuccaacacug

SEQ ID NO: 455426 - RNA, 64 nt, Human
aaaggcugcaucuuuauauguuacauucauauaaacuuuguaacuuuuuggacauugaaagaug

SEQ ID NO: 455427 - RNA, 64 nt, Human
ccccagggagacgcccaggagcuggcugaaagccacuuuguacauguaauguauuauauggggu

SEQ ID NO: 455428 - RNA, 64 nt, Human
ccucgcccugcugcauuugcucuugucuggauuaacuuuguaauuuauggaguauugugcacaa

SEQ ID NO: 455429 - RNA, 64 nt, Human
agauuacaucaagcuaauugugcgagcucaauucacuuuguaagaaaacucucggagaaauaaa

SEQ ID NO: 455430 - RNA, 64 nt, Human
aacuacacaauucuccuucgggaccucaauuuccacuuuguaaaaugaggguggaggugggaau

SEQ ID NO: 455431 - RNA, 64 nt, Human
cuuccguuucuuaaguauugcgcagauuuguucaacuuuguaaauauggacaucacuuuuuuuu

SEQ ID NO: 455432 - RNA, 64 nt, Human
gcagccggugcacaguggacuuuuucacuucuauacuuuguaugcggccuuccacacuuccaga

SEQ ID NO: 455433 - RNA, 64 nt, Human
gagaaauucauguuuacuuuucuagguguaugauacuuuguaaaguugauacuuuccuaagaau

SEQ ID NO: 455434 - RNA, 64 nt, Human
uauaucacggucuucauuuuuaaaaguaacgcuaacuuuguacggacgaugucucauggauuaa

SEQ ID NO: 455435 - RNA, 64 nt, Human
aacauggaaaauguuaaggaagcaaaugguuguaacuuuguaaguacuuauaacaugguguauc

SEQ ID NO: 455436 - RNA, 64 nt, Human
gccaagggggaacacaguguuuuguuuccagcucacuuuguaccccucaccucugcagacacgg

SEQ ID NO: 455437 - RNA, 64 nt, Human
ccuuugccaucaaugaucauaucaauuggcagugacuuuguauagagaauuuaaguagaaaagu

SEQ ID NO: 455438 - RNA, 64 nt, Human
guugaucaguauuccuccucuaucaccuuuuuagacuuuguaagguaaauauuuggacuaacuu

SEQ ID NO: 455439 - RNA, 64 nt, Human
agaagagaguaguuuuauuauaaauauuguauggacuuuguauauuaagagaggagcucauuuc

SEQ ID NO: 455440 - RNA, 64 nt, Human
uaauaauaugaaauauacuuaaagagcuuuuaaaacuuuguauuuuuguacaaaauauuugucu

SEQ ID NO: 455441 - RNA, 62 nt, Human
uaaugucuacaguccacagcuucagcauuuccagagaccacaugugagcuucuuuuaggucc

SEQ ID NO: 455442 - RNA, 62 nt, Human
gggaaaggauauuuucuuccaagcaaaggugaagagaccaagacucugaaaucucagaauuc

SEQ ID NO: 455443 - RNA, 62 nt, Human
caacauacucacuagaguggcuccugugaagcagagaccaaaguucugacuuuucuuuuucc

SEQ ID NO: 455444 - RNA, 64 nt, Human
auuguucuguauuuuuaaauugccaagaaaaacaacuuuguaaauuuggagauauuuuccaaca

SEQ ID NO: 455445 - RNA, 64 nt, Human
uggagcucauggguuuucagcuacauuuuucauaacuuuguaguacauccaucuugaguaaauu

SEQ ID NO: 455446 - RNA, 64 nt, Human
cuuacugggauagucagguaaacaguuggucaagacuuuguaaagaaauugguuucuguaaauc

SEQ ID NO: 455447 - RNA, 64 nt, Human
auaugcaaaaacuacuuuuuagagaaacaaaacaacuuuguagcaacaaauuaaauauaguauu

SEQ ID NO: 455448 - RNA, 64 nt, Human
auaguuuaaagagcuuuauuaaugcaauaaauuaacuuuguacacauuuuuauauaaaaaaaca

SEQ ID NO: 455449 - RNA, 64 nt, Human
auauucccaaaaagcauucagaagcuaggcuuuaacuuuguagucuacuagcacagugcuugcu

SEQ ID NO: 455450 - RNA, 64 nt, Human
uucaguauuugguggucccuaugacuuauacauaacuuuguaaaaagaaaaaaaaauuuuuucu

SEQ ID NO: 455451 - RNA, 64 nt, Human
aggaagcacccaucuucacuuggugcugccaucaacuuuguaagauugcauucuauuuauugug

SEQ ID NO: 455452 - RNA, 64 nt, Human
uguacagauaguggggauuuuuuguuauguuugcacuuuguauauugguugaaacuguuaucac

SEQ ID NO: 455453 - RNA, 64 nt, Human
cuccccacccccgcuccccaagugucacacaggcacuuuguacacauccugguuuucuaagaag

SEQ ID NO: 455454 - RNA, 64 nt, Human
ugacauuucuuuuucugguuagugggcuuuccagacuuuguaccacugcuucuguuuauucauu

SEQ ID NO: 455455 - RNA, 64 nt, Human
uuucuugaaccccgaccacuaccccagguuucuaacuuuguaacuugcuucugauguggguccc

SEQ ID NO: 455456 - RNA, 64 nt, Human
ucuggugccuccagaggggcucaggucacauaaaacuuuguauaucaacgagcuucugucuccu

SEQ ID NO: 455457 - RNA, 64 nt, Human
aacccccacuuccugccccaggcuggcgcggggcacuuuguacaaauccuuguaaauaccccac

SEQ ID NO: 455458 - RNA, 64 nt, Human
agagagaggacagguccucaacaaauggcaugugacuuuguaaguguagaauugcugugaggua

SEQ ID NO: 455459 - RNA, 60 nt, Human
aauaaguugcuuugacuuuuaaaaaugacauaguuagauuauuuaaagucaauguauaua

SEQ ID NO: 455460 - RNA, 60 nt, Human
agugauccacaagauugagaaaauauuauauaguuagauaauaacauucuugucuacuuu

SEQ ID NO: 455461 - RNA, 60 nt, Human
gccuuuaauggaagguaaagaauguuuugcuaguuagaaguacauauugagguuuuaaug

SEQ ID NO: 455462 - RNA, 64 nt, Human
ggccccgccccagggcaauguuggacccccuuuuacuuuguaaaguuuguauuuauuccccuuu

SEQ ID NO: 455463 - RNA, 64 nt, Human
aaucccgccccaaacguccgcuuuccuuuucucuacuuuguaauuuauugaucaguuucuguug

SEQ ID NO: 455464 - RNA, 64 nt, Human
auguuaauucugauuauucuguaucaucaccaguacuuuguacuuugagucuuuuuaaauaugc

SEQ ID NO: 455465 - RNA, 64 nt, Human
uaguaagugcucaguaaacuuagcuguuuuaaaaacuuuguauuugaacauugaaaaguuacag

SEQ ID NO: 455466 - RNA, 64 nt, Human
cacauaugugggaggcuuucaugagguguguugcacuuuguaacugucuagagcucuugaugga

SEQ ID NO: 455467 - RNA, 64 nt, Human
aaaaaaggcaaccaaccacauuagaagucuuggcacuuuguaacggaacggguacuacacuuua

SEQ ID NO: 455468 - RNA, 64 nt, Human
ggagaaacccuaugaauguaaaaauguggaagcaacuuuguaucucaggucuuaaugaacacau

SEQ ID NO: 455469 - RNA, 64 nt, Human
acucuucuauagauugaguugguuuaagaggucuacuuuguauugcaagcauuguuguuucuac

SEQ ID NO: 455470 - RNA, 64 nt, Human
acuguugucuuaaugccauuucauuucacaugguacuuuguaaauuuugacgagaaaguugguu

SEQ ID NO: 455471 - RNA, 64 nt, Human
ucuggcacauaaaugccucaauaaagauuuaauuacuuuguauagugcuuuaaaggagucacuu

SEQ ID NO: 455472 - RNA, 64 nt, Human
uguauaauacauauguuguacuuuuauguauuucacuuuguaacaaaguaucuuucaguuuuau

SEQ ID NO: 455473 - RNA, 64 nt, Human
gauuaauugaaaaccaggaccauaaacuuucagaacuuuguauuaugcagagggaucugugaaa

SEQ ID NO: 455474 - RNA, 64 nt, Human
uuccucagaguucucacauauggaaaggauacacacuuuguagaaacaagaacuuuauguuauc

SEQ ID NO: 455475 - RNA, 64 nt, Human
uccaugaccauaggucacugucuacacuggguacacuuuguaccagugucggccuccacugaug

SEQ ID NO: 455476 - RNA, 64 nt, Human
caucuucagcuuccagacagaaaacccaugcuuuacuuuguacagcccugucccagaguuagua

SEQ ID NO: 455477 - RNA, 60 nt, Human
aaaacuuggccuugaagaaauuuacacaacuaguuagaacuuguuacuauuguaaaggaa

SEQ ID NO: 455478 - RNA, 60 nt, Human
acaucucccuuuccacuugccaguguuguguaguuagaaccugaaccacuaacuuccagg

SEQ ID NO: 455479 - RNA, 60 nt, Human
uauggccaaaagucagaguuaaaauauauauaguuagauuccaacuuccuccuucacucu

SEQ ID NO: 455480 - RNA, 64 nt, Human
aaauacaguauuuuccaugguucugccugcacuuacuuuguaaugccacgguugagauugagag

SEQ ID NO: 455481 - RNA, 64 nt, Human
aauccauauggagcuuuuccugauguuccacuccacuuuguauagacaucugcccugacugaau

SEQ ID NO: 455482 - RNA, 64 nt, Human
aaucuuguugguucaccauugagaccgugaagauacuuuguauuguccuauuaguguuauauga

SEQ ID NO: 455483 - RNA, 64 nt, Human
auuaauugugugaacuuggaagcacaccaaucuuacuuuguaaauucugauuucuuuucaccau

SEQ ID NO: 455484 - RNA, 64 nt, Human
ugaagaauuuaaagaaaaaaaugucaaaaguagaacuuuguauaguuauguaaauaauucuuuu

SEQ ID NO: 455485 - RNA, 64 nt, Human
uaaagagaaaaguacaagacagaaaucuucuagcacuuuguaaacacagugaauaaccucuugg

SEQ ID NO: 455486 - RNA, 64 nt, Human
caacccaacccuucucacucuccucagugcuagcacuuuguauuuuuugauacuuuuauacuug

SEQ ID NO: 455487 - RNA, 64 nt, Human
cagccccaccccggccucuuugagaauucucagaacuuuguaccuuuccccugauuuuuaaacc

SEQ ID NO: 455488 - RNA, 64 nt, Human
ucuugugucuggacuaaguuaaaagaauuaaaauacuuuguaauguccugggcuuugggaaaug

SEQ ID NO: 455489 - RNA, 64 nt, Human
uaaaugauuagacuaccagauguuacuagugcuaacuuuguauucuuagacauuaaaaugauug

SEQ ID NO: 455490 - RNA, 64 nt, Human
ugggggguuuucuugccuugguugucuggcaaggacuuuguacauuugggaguuuuuaugagaa

SEQ ID NO: 455491 - RNA, 64 nt, Human
auuuuucuuuuaauuuuuuacuuuaccagacuuuacuuuguacucagagaagaggccucacaug

SEQ ID NO: 455492 - RNA, 64 nt, Human
guugaaaaugcgucucagagagguauucacaugaacuuuguaugagacuuauuuauaucuuuaa

SEQ ID NO: 455493 - RNA, 64 nt, Human
ucaaagaacugaagaugagaauacuggucaucuaacuuuguaauuugauuugauuauacuguaa

SEQ ID NO: 455494 - RNA, 64 nt, Human
ucucgaggcuaacgauguagguuucauuucucagacuuuguaauauaaggcaagcccucucuca

SEQ ID NO: 455495 - RNA, 60 nt, Human
aaaagcaaaauucuuguuucaucccaauucuaguuagaacaaaguuaaacccccguaauc

SEQ ID NO: 455496 - RNA, 60 nt, Human
ggcaugaaguuguaaaaacuugaauguguauaguuagauauuuaaaugguugcuucuuca

SEQ ID NO: 455497 - RNA, 60 nt, Human
uguaacacuuacucuguuaccuaaauuuuauaguuagaucauauccaaucuacuuauuaa

SEQ ID NO: 455498 - RNA, 64 nt, Human
caacuucuaguuugcacugccuuggagcaagcacacuuuguagaggagggauuugcaguuacuu

SEQ ID NO: 455499 - RNA, 64 nt, Human
uauugaaccagacauuuuuauaaaauacugauugacuuuguacauuauggauauuauauaugaa

SEQ ID NO: 455500 - RNA, 64 nt, Human
uuccuaaguauuuuauagcagccaucaaaauuggacuuuguauuguuuauucauaaaagacacu

SEQ ID NO: 455501 - RNA, 64 nt, Human
ugguuuuaggacuggcacucuauaaaugacgcugacuuuguauagaaggauuuugcuaaggggg

SEQ ID NO: 455502 - RNA, 64 nt, Human
cacgccaggcggcauccuuuucuaugaaguguugacuuuguaaaucugcccacacccagcuggc

SEQ ID NO: 455503 - RNA, 64 nt, Human
gccagcccuaucggccucgucacuggccuuggucacuuuguauuucugucuugguuggaaauac

SEQ ID NO: 455504 - RNA, 64 nt, Human
uuuaaagaauacagaaggagccaagcuuuuuugcacuuuguauccagcugcaagcucagggcag

SEQ ID NO: 455505 - RNA, 64 nt, Human
auuauuaaguuugacuuggaaguggagcagcaggacuuuguaguuguaugcuugauuuggggaa

SEQ ID NO: 455506 - RNA, 64 nt, Human
uuuuuuuuuuaauuaaagagcaaagcuuuuuauuacuuuguaauuuaaaaaacugaaaaaaaaa

SEQ ID NO: 455507 - RNA, 64 nt, Human
guucaaagaccaguuuguaccgaugaaacgcgcaacuuuguaaucccaacacuuucuauuuucu

SEQ ID NO: 455508 - RNA, 64 nt, Human; identical to SEQ ID NO: 455031

SEQ ID NO: 455509 - RNA, 64 nt, Human
uguggaugacugaauguuacuaucuuuauauuugacuuuguaugucaguucccugguuuuuuug

SEQ ID NO: 455510 - RNA, 64 nt, Human
aacauacuuauauagaggaauuuauguaaccaugacuuuguaauuuugagaauuccucccagug

SEQ ID NO: 455511 - RNA, 64 nt, Human
ucucacccccaaugaggucuuaggcagauucuuuacuuuguaauucaaaaggccuguuaaccuu

SEQ ID NO: 455512 - RNA, 64 nt, Human
cuuuuuucuuccaucuuuccuuuuuauauuuuuuacuuuguauguauaacauacaugccuauau

SEQ ID NO: 455513 - RNA, 60 nt, Human
gguaggcuggauuccaucgccacaggacuuuaguuagaauuaaauuccugcuuguaauuu

SEQ ID NO: 455514 - RNA, 60 nt, Human
cuaauauaauuauuuucuaagauagccagauaguuagaaaaagauuuucauugaugacau

SEQ ID NO: 455515 - RNA, 60 nt, Human
uuucaauugaugcacacaaaaaauaacuuauaguuagacuuuucuauuucaaguaaagcu

SEQ ID NO: 455516 - RNA, 64 nt, Human
gcaaaugagauuuuguacauggaguugacauaauacuuuguaaauugaauuuuuuaaagaaaua

SEQ ID NO: 455517 - RNA, 64 nt, Human
agcccgacaugaagcugguuccccaaccacagaaacuuuguacuagugaaagaaaggggguccc

SEQ ID NO: 455518 - RNA, 64 nt, Human
gguacuccaaugguguacaaugucuuuugcacaaacuuuguaacuuuuguuacugugaauucaa

SEQ ID NO: 455519 - RNA, 64 nt, Human
aggguguuugacugugacuggggaagcucagacuacuuuguaugugaaugcuucaggguuuucu

SEQ ID NO: 455520 - RNA, 64 nt, Human
caguugaugaauuuguuauguaguaaaauguaugacuuuguauggguuucuucagcccuuuuuc

SEQ ID NO: 455521 - RNA, 64 nt, Human
aaccagccugucaucaaaugauucuaguucuaggacuuuguaggcuuaacuauaaaauauuucc

SEQ ID NO: 455522 - RNA, 64 nt, Human
augaaagcuauauacuugugcuaucuaaagcacuacuuuguaaagaugacuacccaagauugua

SEQ ID NO: 455523 - RNA, 64 nt, Human
gagguguuuugccagccugaacuauauuuaagagacuuuguaaaaaagaaaaauguauauagcu

SEQ ID NO: 455524 - RNA, 64 nt, Human
uuuuaguucuucaccuuuuaaauuaugucacuaaacuuuguaugaguucaaauaaauauuugac

SEQ ID NO: 455525 - RNA, 64 nt, Human
auuggaaaucagaguuugaaauaaaacuuggaccacuuuguauacacucuucucacuugacauu

SEQ ID NO: 455526 - RNA, 64 nt, Human
augguggaagguuaaacagcuuggauuuauucuuacuuuguauguuguguuguuguccccagug

SEQ ID NO: 455527 - RNA, 64 nt, Human
cucucucaaaaagcuuauuaagccugaaaagccaacuuuguaacauauuuaaaacugcuauuuu

SEQ ID NO: 455528 - RNA, 64 nt, Human
uaaggugaggccaguagcaggaauaauaaaucccacuuuguaggcuggaaaacugagcugucaa

SEQ ID NO: 455529 - RNA, 64 nt, Human
caagcaaagccaauggagaguauuucacaaaaauacuuuguaaaugagaugccaguaguguuca

SEQ ID NO: 455530 - RNA, 64 nt, Human
ugaaugaaaagcacauaaauguaaucuacuuugaacuuuguaaaaaugauguguggaggcuauu

SEQ ID NO: 455531 - RNA, 60 nt, Human
gaaacucaaaaacugagaaauuuacuacaguaguuagaauuauaucacuucacuguucuc

SEQ ID NO: 455532 - RNA, 60 nt, Human
cucuaguacacuuuagcaauaccaccagacuaguuagaguuccccacucaccaagcaaga

SEQ ID NO: 455533 - RNA, 60 nt, Human
aaugaggaggaauguggaaaguuucacauuuaguuagaagaacuuuaaaaaauugguuuc

SEQ ID NO: 455534 - RNA, 64 nt, Human
gaauacuuuuggacuugaaaauuauuucuucucuacuuuguaaccaaaugcaaucggugugccu

SEQ ID NO: 455535 - RNA, 64 nt, Human
agagacauucgcuugguuuagugaaacgcaggugacuuuguagcucuguggucagccuacuugu

SEQ ID NO: 455536 - RNA, 64 nt, Human
gaaaauccaugguuaucugagauaggagauacaaacuuuguaauucuaauaaugcacucaguuu

SEQ ID NO: 455537 - RNA, 64 nt, Human
gagguauucugccagccugaacuauauuuaagaaacuuuguaaaaaauaaaaauguauauagcu

SEQ ID NO: 455538 - RNA, 64 nt, Human
augcugaguaggauaguaaaucaggaugcucauaacuuuguaugucugacccaagugccaaagg

SEQ ID NO: 455539 - RNA, 64 nt, Human
agucuuaugagcuaucuacuaaaacuauggagaaacuuuguaugugcacacaaaaguauucaag

SEQ ID NO: 455540 - RNA, 64 nt, Human
guaccaggcuguagauuugauaagcuagaugcaguagaccgaaaccauccaaaaccuguuuagc

SEQ ID NO: 455541 - RNA, 64 nt, Human
uagaguuuaugacuaaauagucugugcagguucauagaccgaagauacuacacacuuuaaacca

SEQ ID NO: 455542 - RNA, 64 nt, Human
caguccacuaucugccagaggagcaagggugccuuagaccgaagccaggggaagaagcaucuuc

SEQ ID NO: 455543 - RNA, 60 nt, Human
auauuucugaguaagcuacuaucugaacauuaguuagauccaucucacuauuuaauaaug

SEQ ID NO: 455544 - RNA, 60 nt, Human
ugccccaccauucaugaccucuguauucucuaguuagaucccugaccauaagccugagcc

SEQ ID NO: 455545 - RNA, 60 nt, Human
ccaacauuuaauuguuugaaagccuccauauaguuagauugugcuuuguaauuuuguugu

SEQ ID NO: 455546 - RNA, 64 nt, Human
uauauuuaucugugugucugacagugugagauguuagaccgagagaaaagcaaacaaauaaauc

SEQ ID NO: 455547 - RNA, 64 nt, Human
ucacuuacgugcuuugauuauccccucugaauuauagaccgagucuuguuguuuagccuaagag

SEQ ID NO: 455548 - RNA, 64 nt, Human
gccaagaucgccccacugcacuccagccuggcaauagaccgagacuccgucuccaaaaaaaaaa

SEQ ID NO: 455549 - RNA, 64 nt, Human
acucucucucaaaaaaaaaaaaaaaaaaaaauucuagaccgaaguguacggcagugccaucugg

SEQ ID NO: 455550 - RNA, 64 nt, Human
gccaggugcucacgccguaaugccaacacuuugguagaccgaagugggcagaucaccugagguc

SEQ ID NO: 455551 - RNA, 64 nt, Human
cccuucccaggcccgcguaccugcaaggaccugcuagaccgagggcacuuccugagcggcuggc

SEQ ID NO: 455552 - RNA, 64 nt, Human
uuggcuuuagcagauguuuuuaaaguuucuuuuguagaccgaacuucugaagaguaauaccaaa

SEQ ID NO: 455553 - RNA, 64 nt, Human
aauuuuacacuuuaagguagcaaaugucaauuauuagaccgagcauauugugaagaauuaaacu

SEQ ID NO: 455554 - RNA, 64 nt, Human
gaggucgucacuggggugggagaagaggggcugguagaccgaagccuugugcauaaggauuuuu

SEQ ID NO: 455555 - RNA, 64 nt, Human
gguauuucacuacuucaagucagucagaacuucguagaccgaccugaaguuucuuuuugaauac

SEQ ID NO: 455556 - RNA, 64 nt, Human
aucaaaguaaaauccuaguuggcaggauuguaaguagaccgaauucuaauuuuucccaacacau

SEQ ID NO: 455557 - RNA, 64 nt, Human
uaagagcuuucauccuuucacggaauacaguuucuagaccgauucugugugaacaucaguuuug

SEQ ID NO: 455558 - RNA, 64 nt, Human
caguugaauggggcggcaauugcggggcccaccuuagaccgaaggggaaaacccgcucucucag

SEQ ID NO: 455559 - RNA, 64 nt, Human
gggauuggccgacagcgugguggugacuucuagguagaccgauggacccuaaauugggcagugg

SEQ ID NO: 455560 - RNA, 60 nt, Human
ccugagacacugcaucucgauuucuaucucuaguuagaguuguacuuuuaaaaaaauuaa

SEQ ID NO: 455561 - RNA, 60 nt, Human
auaccaauuuaguuuuacuuguggcuuaucuaguuagaacuuagcagacuuuacugggac

SEQ ID NO: 455562 - RNA, 60 nt, Human
guauagucaucacuuuuucauauuuuaguguaguuagaagaauuccuucuucaaacauua

SEQ ID NO: 455563 - RNA, 64 nt, Human
ccagccuccaucucucccacuguauggccgugccuagaccgauggcagccaucgaauauuccuc

SEQ ID NO: 455564 - RNA, 64 nt, Human
aaccuuggccaugagguuuguuucacaagguucuuagaccgaguugugcagguaagugcacuuu

SEQ ID NO: 455565 - RNA, 64 nt, Human
cacagggcccaacucuaaaguggaagaaccuuguuagaccgagagcuugccauccagccaagcu

SEQ ID NO: 455566 - RNA, 64 nt, Human
guauuacgacucauguuuacuuuuuaaaaugauuuagaccgauuuucagauuuuauuucguuau

SEQ ID NO: 455567 - RNA, 64 nt, Human
agaaacaguucaauuaacuguauaggucuuucauuagaccgagacaucacuagaaauucugggc

SEQ ID NO: 455568 - RNA, 64 nt, Human
uuuuuuuacugaagucauauaaugacuugggucagcucguaaugcauugugaugguuuuguaug

SEQ ID NO: 455569 - RNA, 64 nt, Human
cuauacuuguauuaaaugugcuuuuuaaauaaaagcucguaacacaacuaauuaaggacuugca

SEQ ID NO: 455570 - RNA, 64 nt, Human
cgguuuguuaaucuuauucaccaaauguucuaucgcucguaagguaaaacuguaauauaacuac

SEQ ID NO: 455571 - RNA, 64 nt, Human
uaaacuaugcauaaaaauaaaauuucauauuuucgcucguaaaaauuuaggcgcugaauaagaa

SEQ ID NO: 455572 - RNA, 64 nt, Human
uauuuuuaaaaaucauguuugacaucuuucuauugcucguaaccagucccuguagcugucuaag

SEQ ID NO: 455573 - RNA, 64 nt, Human
agaccccugggcacuagugucaacuccuccuuuggcucguaacucagaaagaaccaaagggcag

SEQ ID NO: 455574 - RNA, 64 nt, Human
uuccuucgugaaccauagugggcucuucacuccugcucguaauaaccaccuccaaauuuguuag

SEQ ID NO: 455575 - RNA, 64 nt, Human
agcuucacccacaaacucaggagaacauaagccugcucguaaagcucaauccuucuaucauggc

SEQ ID NO: 455576 - RNA, 64 nt, Human
uaaagaagcccugcugggcccaugugaggcuggggcucguaaauauucccugacgacacugaag

SEQ ID NO: 455577 - RNA, 64 nt, Human
auaugauguaggcacuugcuguauuuuuacuggagcucguaauuuuuuaacuguaagcuugucc

SEQ ID NO: 455578 - RNA, 60 nt, Human
cugucuuggucuuguuggaggagcuugcuuuaguuagaugucuuauuauuaaaguuaccu

SEQ ID NO: 455579 - RNA, 60 nt, Human
uuauaauaaugaagauacauuagagaauuuuaguuagauauugacuuuaucuuuaggcuu

SEQ ID NO: 455580 - RNA, 60 nt, Human
gauuugucugagcaaaucauuccuguguuuuaguuagaugauaaaccaggguuuuaaauc

SEQ ID NO: 455581 - RNA, 64 nt, Human
uucugaauauagacuuucugggaaaagguuuacugcucguaaggaaacauuuuauguauuaaaa

SEQ ID NO: 455582 - RNA, 64 nt, Human
ugcgauugacaugugcaagagauuaggaaguuuggcucguaacaguuucagcuuucuuguuaug

SEQ ID NO: 455583 - RNA, 64 nt, Human
gaggcccugggucucuccaagcagcugcagaccccagcucgaauuuugcacauggcgggguccc

SEQ ID NO: 455584 - RNA, 64 nt, Human
gaaccucuugggagacagaagaggcaucugugcacagcucgaucuucuacuugccuguggggag

SEQ ID NO: 455585 - RNA, 64 nt, Human
ccaguuccuaguccucaacuccagccaccugccccagcucgacggcacugggccaguucccccu

SEQ ID NO: 455586 - RNA, 64 nt, Human
gccccucgucaccuacuccccgaaguuaccagcucagcucgagucuucagggcugggcuccuag

SEQ ID NO: 455587 - RNA, 64 nt, Human
gcuacacagaccccuccccucgugucagcucaggcagcucgaggcccccgaccaacacuugcag

SEQ ID NO: 455588 - RNA, 64 nt, Human
aacaggcucacagcagucuggacucugcaccaagcagcucgauccaccaacacugucaaggugg

SEQ ID NO: 455589 - RNA, 64 nt, Human
aagaucauuaagaauguggagaaguacaaggaagcagcucgacuugagaucaacgugcuagaga

SEQ ID NO: 455590 - RNA, 64 nt, Human
uuccagugacuggcuccaggccaugucuaaugaccagcucgauucccugugcaguucagagggc

SEQ ID NO: 455591 - RNA, 64 nt, Human
ccaaaaaccauugucuuaccucccaacuggaagacagcucgagauccagaagggaagauuuauu

SEQ ID NO: 455592 - RNA, 64 nt, Human
uccaacagcauuagcaagugggaucagacacuggcagcucgaagacgcgacguccauuugucga

SEQ ID NO: 455593 - RNA, 64 nt, Human
uuugaaaguaacuuugggauuuuuuucuuaggugcagcucgauucuaaucuuuucaugcugcac

SEQ ID NO: 455594 - RNA, 64 nt, Human
ugccacacauugaccaagccagacccgguucacccagcucgaggaucccagguugaagaguggc

SEQ ID NO: 455595 - RNA, 60 nt, Human
uggauguuuggaugaacaacugauacauuuuaguuagaaugcuuuuucagcauuauggcu

SEQ ID NO: 455596 - RNA, 60 nt, Human
aagaaugcuuaaaaaagcuaaucccuaaaauaguuagaucuuuguaaaugcauauuaaau

SEQ ID NO: 455597 - RNA, 60 nt, Human
uggucuuaauuugguacuuguaaauagcacuaguuagacucuuuagaauacuccaagagu

SEQ ID NO: 455598 - RNA, 64 nt, Human
aaaauagauuaaauuaaagcaauuagauccuggccagcucgauucaaauuugacuuucauuuug

SEQ ID NO: 455599 - RNA, 64 nt, Human
uagguucaguaccagaagugucuuguggccucugcagcucgaggcaaggccuggggugcccagg

SEQ ID NO: 455600 - RNA, 64 nt, Human
cggcauaaagcaaaacaggaccuuggcacaccgucagcucgaacucaacacuggcagccaccgu

SEQ ID NO: 455601 - RNA, 64 nt, Human
cauauauguauauuuuggaaucaguucuuauaaacagcucgauucaguuuuagcuaaauuuaua

SEQ ID NO: 455602 - RNA, 64 nt, Human
cagucaaguucccuccugcagccugaccccuaggcagcucgagcaugcccugagcucucugaaa

SEQ ID NO: 455603 - RNA, 64 nt, Human
ccagucaaguucccuccugcagccugaccccaggcagcucgagcaugcccugagcucucugaaa

SEQ ID NO: 455604 - RNA, 64 nt, Human
ucagcuacaacuccacaucaacuccacaugcgcccagcucgagacugaugaguggaaucagcuu

SEQ ID NO: 455605 - RNA, 64 nt, Human
ucuggaaaccauaauucaacuuuucuuuuuaaaucagcucgaaagcauguacuuaaaugaagca

SEQ ID NO: 455606 - RNA, 64 nt, Human
augacuuaguucagugcagagagauaggugaggccagcucgagaucuuauaccacucuguauug

SEQ ID NO: 455607 - RNA, 64 nt, Human
ugaucuguguuaaaaaccugcauugccaacauugcagcucgaacuuaaacuuguuauucaaaua

SEQ ID NO: 455608 - RNA, 64 nt, Human
ucuccccacugccuccucucccuuccuacacucccagcucgagccguccagcugcggugggauc

SEQ ID NO: 455609 - RNA, 64 nt, Human
aaagcaaaaaucacccucuaguugaaagagcuuacagcucgagucaccuuuuagcuauuugucu

SEQ ID NO: 455610 - RNA, 64 nt, Human
guuuuggcuguauccuuuaucccagccagucauccagcucgaccuuaugagaagguaccuugcc

SEQ ID NO: 455611 - RNA, 64 nt, Human
aaaagggguaguuuauucccuccaaauuugacuacagcucgaaauugucuuuauuaaugcaaag

SEQ ID NO: 455612 - RNA, 60 nt, Human
gcuuggguccuccacuguccucugucaaucuaguuagacgugcuucugaaugacuguaga

SEQ ID NO: 455613 - RNA, 60 nt, Human
agauuaaccuuucauuuuuuuaggugacucuaguuagaaagucuuauuucacaaucugau

SEQ ID NO: 455614 - RNA, 60 nt, Human
gcaauacaaaggaaaauaugguacaggaguuaguuagaaaggucuuauugauuuuacuuc

SEQ ID NO: 455615 - RNA, 51 nt, Human
ucagaagacgucaaacguaaacagcucgaauuaagaauauguuuccuuguu

SEQ ID NO: 455616 - RNA, 64 nt, Human
uccaugggacgaucccagugggacugucagcccacagcucgaguggguuggaugcuugccucuu

SEQ ID NO: 455617 - RNA, 64 nt, Human
caguauuaaugcccccuuacagcagaagacacugcagcucgaagacagcuuaaguggcagaaua

SEQ ID NO: 455618 - RNA, 64 nt, Human
agagaagacuuucauuauuucucaucuggauuaccagcucgaucucuaaucugcuucaguucau

SEQ ID NO: 455619 - RNA, 64 nt, Human
ugguguaagccacuagucuguggcauuguuauagcagcucgagaagacuaaggcagaugggcuu

SEQ ID NO: 455620 - RNA, 64 nt, Human
gaaaucaguuacucuucaguuaagccuuuggaaacagcucgacuuuaaaaagcuccaaaugcag

SEQ ID NO: 455621 - RNA, 64 nt, Human
ugaagauggagcugcagccugcggggaagcagcucagcucgauggugggcccagccucugcugu

SEQ ID NO: 455622 - RNA, 64 nt, Human
gguuaaacuuaugaaaauguauuaagaaagagugcagcucgagagagauucagagauggaacac

SEQ ID NO: 455623 - RNA, 64 nt, Human; identical to SEQ ID NO: 455622

SEQ ID NO: 455624 - RNA, 64 nt, Human
ucacugacucuggagacugaagccccagugugcgcagcucgagccaccagccccagccuggaag

SEQ ID NO: 455625 - RNA, 64 nt, Human; identical to SEQ ID NO: 455622

SEQ ID NO: 455626 - RNA, 64 nt, Human
aucaaggcaccguagguaacucaguggcugugaccagcucgacuggcggccacuggcuguuccc

SEQ ID NO: 455627 - RNA, 64 nt, Human
cucagcccagaagaaaauucuccugauaaaacaacagcucgauccaaauugugcuucuccccag

SEQ ID NO: 455628 - RNA, 64 nt, Human
caaaagcacugauuacccaaugcaccucccuccccagcucgagaucauucuucacucaggacac

SEQ ID NO: 455629 - RNA, 60 nt, Human
aauggccaaaaugguugcaaucauucauacuaguuagaaaaauuauguguugaaauaagu

SEQ ID NO: 455630 - RNA, 60 nt, Human
auuuguuucuuaugaaucaucucucaaaucuaguuagacaauuugcacacauacuuuucu

SEQ ID NO: 455631 - RNA, 60 nt, Human
gguaauguauggagcauuuucacuucuaaauaguuagauacagaaauuaagugcauugua

SEQ ID NO: 455632 - RNA, 64 nt, Human
uuccgaccucaguccugucugcuccagucuugcccagcucgaaggagagcagaucugaccacuu

SEQ ID NO: 455633 - RNA, 64 nt, Human
ggcagcugacaaucgcugugucccggcagauccgcagcucgaaaaagaacaagccacagaaacg

SEQ ID NO: 455634 - RNA, 64 nt, Human
aaccuuuugaggacaaucuguaugguaaagcucucagcucgaauucucaccuucaugggcccag

SEQ ID NO: 455635 - RNA, 64 nt, Human
cucaaaggaccccacagcaccugggccagaccaacagcucgagggagaaccugaaggcccaggg

SEQ ID NO: 455636 - RNA, 64 nt, Human
ucacugauccagaacacuucaagaacucgucaaacagcucgauaagccuuuuugacuguguaca

SEQ ID NO: 455637 - RNA, 64 nt, Human
caccacaccggccagcaucuuccgcacaccccugcagcucgacccgcagcaggagcagcagcug

SEQ ID NO: 455638 - RNA, 64 nt, Human
ccuggucaugguacccguacagcguugauggccacagcucgaaggggggcuuucgugucccccu

SEQ ID NO: 455639 - RNA, 64 nt, Human
uccugagaugcugacccagcauggagcccaagagcagcucgaagaccauccuggccauagcagc

SEQ ID NO: 455640 - RNA, 64 nt, Human
cugaggacauucagccugggaaggaggaagucaccagcucgaggcguguggauugguuuccacc

SEQ ID NO: 455641 - RNA, 64 nt, Human
uccaacccagccccccaccucgggucccugaccccagcucgaugccccaucaccgccucucccu

SEQ ID NO: 455642 - RNA, 64 nt, Human; identical to SEQ ID NO: 70019

SEQ ID NO: 455643 - RNA, 60 nt, Human
gaaacugcuccaccucagaccaucaggcauuaguuagauucucauaaggagagugcaacc

SEQ ID NO: 455644 - RNA, 60 nt, Human
gaucacaaugauaucuuugcuguauuuguauaguuagaugcuaaaugcucauugaaacaa

SEQ ID NO: 455645 - RNA, 60 nt, Human
augauugucucuaacaaacaggcuacuugcuaguuagaaauucuuaucaauuuggcaagc

SEQ ID NO: 455646 - RNA, 64 nt, Human; identical to SEQ ID NO: 70020

SEQ ID NO: 455647 - RNA, 64 nt, Human; identical to SEQ ID NO: 70021

SEQ ID NO: 455648 - RNA, 64 nt, Human; identical to SEQ ID NO: 70022

SEQ ID NO: 455649 - RNA, 64 nt, Human; identical to SEQ ID NO: 70023

SEQ ID NO: 455650 - RNA, 64 nt, Human; identical to SEQ ID NO: 70024

SEQ ID NO: 455651 - RNA, 64 nt, Human; identical to SEQ ID NO: 70025

SEQ ID NO: 455652 - RNA, 64 nt, Human; identical to SEQ ID NO: 70026

SEQ ID NO: 455653 - RNA, 64 nt, Human; identical to SEQ ID NO: 70027

SEQ ID NO: 455654 - RNA, 64 nt, Human; identical to SEQ ID NO: 70028

SEQ ID NO: 455655 - RNA, 64 nt, Human; identical to SEQ ID NO: 70029

SEQ ID NO: 455656 - RNA, 64 nt, Human; identical to SEQ ID NO: 70030

SEQ ID NO: 455657 - RNA, 64 nt, Human; identical to SEQ ID NO: 70031

SEQ ID NO: 455658 - RNA, 64 nt, Human; identical to SEQ ID NO: 70032

SEQ ID NO: 455659 - RNA, 64 nt, Human; identical to SEQ ID NO: 70033

SEQ ID NO: 455660 - RNA, 64 nt, Human; identical to SEQ ID NO: 70034

SEQ ID NO: 455661 - RNA, 64 nt, Human; identical to SEQ ID NO: 70035

SEQ ID NO: 455662 - RNA, 60 nt, Human
ggucuguuuucuucgcugucauuuccuuaguaguuagacuagugcugagauuuuagugga

SEQ ID NO: 455663 - RNA, 60 nt, Human
gaaugggaacagaggaggcauuauauauucuaguuagaucagcucugguagguuccagag

SEQ ID NO: 455664 - RNA, 60 nt, Human
gauucagauuugguuuuguuguuucaaccauaguuagagacaaauucucauguacuuuca

SEQ ID NO: 455665 - RNA, 64 nt, Human; identical to SEQ ID NO: 70036

SEQ ID NO: 455666 - RNA, 64 nt, Human; identical to SEQ ID NO: 70037

SEQ ID NO: 455667 - RNA, 64 nt, Human; identical to SEQ ID NO: 70038

SEQ ID NO: 455668 - RNA, 64 nt, Human; identical to SEQ ID NO: 70039

SEQ ID NO: 455669 - RNA, 64 nt, Human; identical to SEQ ID NO: 70040

SEQ ID NO: 455670 - RNA, 64 nt, Human; identical to SEQ ID NO: 70041

SEQ ID NO: 455671 - RNA, 64 nt, Human; identical to SEQ ID NO: 70042

SEQ ID NO: 455672 - RNA, 64 nt, Human; identical to SEQ ID NO: 70043

SEQ ID NO: 455673 - RNA, 64 nt, Human; identical to SEQ ID NO: 70044

SEQ ID NO: 455674 - RNA, 64 nt, Human; identical to SEQ ID NO: 70045

SEQ ID NO: 455675 - RNA, 64 nt, Human; identical to SEQ ID NO: 70046

SEQ ID NO: 455676 - RNA, 64 nt, Human; identical to SEQ ID NO: 70047

SEQ ID NO: 455677 - RNA, 64 nt, Human; identical to SEQ ID NO: 70048

SEQ ID NO: 455678 - RNA, 64 nt, Human; identical to SEQ ID NO: 70049

SEQ ID NO: 455679 - RNA, 64 nt, Human; identical to SEQ ID NO: 70050

SEQ ID NO: 455680 - RNA, 64 nt, Human; identical to SEQ ID NO: 70051

SEQ ID NO: 455681 - RNA, 60 nt, Human
caauuauuugaacucgguaguuguuugaccuaguuagaugugguguuuauucaaguuugu

SEQ ID NO: 455682 - RNA, 60 nt, Human
agcaacgcuccuacaggacuugacauuugcuaguuagaauaucccuacucuucuaaauaa

SEQ ID NO: 455683 - RNA, 60 nt, Human
uucugaaaacaucuccugccagcugaacuguaguuagaaucucugggccucuccucaacu

SEQ ID NO: 455684 - RNA, 64 nt, Human; identical to SEQ ID NO: 70052

SEQ ID NO: 455685 - RNA, 64 nt, Human; identical to SEQ ID NO: 70053

SEQ ID NO: 455686 - RNA, 64 nt, Human; identical to SEQ ID NO: 70054

SEQ ID NO: 455687 - RNA, 64 nt, Human; identical to SEQ ID NO: 70055

SEQ ID NO: 455688 - RNA, 64 nt, Human; identical to SEQ ID NO: 70056

SEQ ID NO: 455689 - RNA, 64 nt, Human; identical to SEQ ID NO: 70057

SEQ ID NO: 455690 - RNA, 64 nt, Human; identical to SEQ ID NO: 70058

SEQ ID NO: 455691 - RNA, 64 nt, Human; identical to SEQ ID NO: 70059

SEQ ID NO: 455692 - RNA, 64 nt, Human; identical to SEQ ID NO: 70060

SEQ ID NO: 455693 - RNA, 64 nt, Human; identical to SEQ ID NO: 70061

SEQ ID NO: 455694 - RNA, 64 nt, Human; identical to SEQ ID NO: 70062

SEQ ID NO: 455695 - RNA, 64 nt, Human; identical to SEQ ID NO: 70063

SEQ ID NO: 455696 - RNA, 64 nt, Human; identical to SEQ ID NO: 70064

SEQ ID NO: 455697 - RNA, 64 nt, Human; identical to SEQ ID NO: 70065

SEQ ID NO: 455698 - RNA, 64 nt, Human; identical to SEQ ID NO: 70066

SEQ ID NO: 455699 - RNA, 64 nt, Human; identical to SEQ ID NO: 70067

SEQ ID NO: 455700 - RNA, 60 nt, Human
agauguuuuaaccugucuuuuaauaucuguuaguuagacaaagauguuugauauuaaguu

SEQ ID NO: 455701 - RNA, 60 nt, Human
auacaaccuucauuuaaaaagguuuaaaacuaguuagauucacuuugacacuuuucauau

SEQ ID NO: 455702 - RNA, 60 nt, Human
acugcucuaacaacaagcauaauauaaaauuaguuagauuuugcaagucuacaaaugagc

SEQ ID NO: 455703 - RNA, 64 nt, Human; identical to SEQ ID NO: 70068

SEQ ID NO: 455704 - RNA, 64 nt, Human; identical to SEQ ID NO: 70069

SEQ ID NO: 455705 - RNA, 64 nt, Human; identical to SEQ ID NO: 70070

SEQ ID NO: 455706 - RNA, 64 nt, Human; identical to SEQ ID NO: 70071

SEQ ID NO: 455707 - RNA, 64 nt, Human; identical to SEQ ID NO: 70072

SEQ ID NO: 455708 - RNA, 64 nt, Human; identical to SEQ ID NO: 70073

SEQ ID NO: 455709 - RNA, 64 nt, Human; identical to SEQ ID NO: 70074

SEQ ID NO: 455710 - RNA, 64 nt, Human; identical to SEQ ID NO: 70075

SEQ ID NO: 455711 - RNA, 64 nt, Human; identical to SEQ ID NO: 70076

SEQ ID NO: 455712 - RNA, 64 nt, Human; identical to SEQ ID NO: 70077

SEQ ID NO: 455713 - RNA, 58 nt, Human; identical to SEQ ID NO: 70078

SEQ ID NO: 455714 - RNA, 64 nt, Human; identical to SEQ ID NO: 70079

SEQ ID NO: 455715 - RNA, 64 nt, Human; identical to SEQ ID NO: 70080

SEQ ID NO: 455716 - RNA, 64 nt, Human; identical to SEQ ID NO: 70081

SEQ ID NO: 455717 - RNA, 64 nt, Human; identical to SEQ ID NO: 70082

SEQ ID NO: 455718 - RNA, 64 nt, Human; identical to SEQ ID NO: 70083

SEQ ID NO: 455719 - RNA, 60 nt, Human
uuuaacgucuucuuauguugacuaaaauuauaguuagagcugagaaaaaaaaaauagcau

SEQ ID NO: 455720 - RNA, 60 nt, Human
auuaaaucaauuguuacugaucaugaauguuaguuagaaaauguuagguuuuaacuuaaa

SEQ ID NO: 455721 - RNA, 60 nt, Human
ucaaacucuuauuucagagcuucaugaauuuaguuagacuaaacauaauucuuuaaguuc

SEQ ID NO: 455722 - RNA, 64 nt, Human; identical to SEQ ID NO: 70084

SEQ ID NO: 455723 - RNA, 64 nt, Human; identical to SEQ ID NO: 70085

SEQ ID NO: 455724 - RNA, 64 nt, Human; identical to SEQ ID NO: 70086

SEQ ID NO: 455725 - RNA, 64 nt, Human; identical to SEQ ID NO: 70087

SEQ ID NO: 455726 - RNA, 64 nt, Human; identical to SEQ ID NO: 70088

SEQ ID NO: 455727 - RNA, 64 nt, Human; identical to SEQ ID NO: 70089

SEQ ID NO: 455728 - RNA, 64 nt, Human; identical to SEQ ID NO: 70090

SEQ ID NO: 455729 - RNA, 64 nt, Human; identical to SEQ ID NO: 70091

SEQ ID NO: 455730 - RNA, 64 nt, Human; identical to SEQ ID NO: 70092

SEQ ID NO: 455731 - RNA, 64 nt, Human; identical to SEQ ID NO: 70093

SEQ ID NO: 455732 - RNA, 64 nt, Human; identical to SEQ ID NO: 70094

SEQ ID NO: 455733 - RNA, 64 nt, Human; identical to SEQ ID NO: 70095

SEQ ID NO: 455734 - RNA, 64 nt, Human; identical to SEQ ID NO: 70096

SEQ ID NO: 455735 - RNA, 64 nt, Human; identical to SEQ ID NO: 70097

SEQ ID NO: 455736 - RNA, 64 nt, Human; identical to SEQ ID NO: 70098

SEQ ID NO: 455737 - RNA, 60 nt, Human; identical to SEQ ID NO: 70099

SEQ ID NO: 455738 - RNA, 60 nt, Human
uucucugaacuuaucuuuccuauaaaaugguaguuagaucuggaggucugauuuuguggc

SEQ ID NO: 455739 - RNA, 60 nt, Human
uucagggaccaacaggggcuuagagagccuuaguuagauuaaagggagacccuaccucuu

SEQ ID NO: 455740 - RNA, 60 nt, Human
cugggcuacugacacacacacaguagccauuaguuagacucuucuuagugaauaucagga

SEQ ID NO: 455741 - RNA, 64 nt, Human; identical to SEQ ID NO: 70100

SEQ ID NO: 455742 - RNA, 64 nt, Human; identical to SEQ ID NO: 70101

SEQ ID NO: 455743 - RNA, 64 nt, Human; identical to SEQ ID NO: 70102

SEQ ID NO: 455744 - RNA, 64 nt, Human; identical to SEQ ID NO: 70103

SEQ ID NO: 455745 - RNA, 64 nt, Human; identical to SEQ ID NO: 70104

SEQ ID NO: 455746 - RNA, 64 nt, Human; identical to SEQ ID NO: 70105

SEQ ID NO: 455747 - RNA, 64 nt, Human; identical to SEQ ID NO: 70106

SEQ ID NO: 455748 - RNA, 64 nt, Human; identical to SEQ ID NO: 70107

SEQ ID NO: 455749 - RNA, 64 nt, Human; identical to SEQ ID NO: 70108

SEQ ID NO: 455750 - RNA, 64 nt, Human; identical to SEQ ID NO: 70109

SEQ ID NO: 455751 - RNA, 64 nt, Human; identical to SEQ ID NO: 70110

SEQ ID NO: 455752 - RNA, 64 nt, Human; identical to SEQ ID NO: 70111

SEQ ID NO: 455753 - RNA, 64 nt, Human; identical to SEQ ID NO: 70112

SEQ ID NO: 455754 - RNA, 64 nt, Human; identical to SEQ ID NO: 70113

SEQ ID NO: 455755 - RNA, 64 nt, Human; identical to SEQ ID NO: 70114

SEQ ID NO: 455756 - RNA, 64 nt, Human; identical to SEQ ID NO: 70115

SEQ ID NO: 455757 - RNA, 60 nt, Human
ugauguugcaugggcagacuucaaaaaggauaguuagaaagguuuggguugauggaguuu

SEQ ID NO: 455758 - RNA, 60 nt, Human
cuggcuugggguaucagcaaauuucagguauaguuagauaaacagguacagggccugcau

SEQ ID NO: 455759 - RNA, 60 nt, Human
ugacaggauaauaagcuugaagaccugcuguaguuagauaugggcuuuaauccuucccag

SEQ ID NO: 455760 - RNA, 64 nt, Human; identical to SEQ ID NO: 70116

SEQ ID NO: 455761 - RNA, 64 nt, Human; identical to SEQ ID NO: 70117

SEQ ID NO: 455762 - RNA, 64 nt, Human; identical to SEQ ID NO: 70118

SEQ ID NO: 455763 - RNA, 64 nt, Human; identical to SEQ ID NO: 70119

SEQ ID NO: 455764 - RNA, 64 nt, Human; identical to SEQ ID NO: 70120

SEQ ID NO: 455765 - RNA, 64 nt, Human; identical to SEQ ID NO: 70121

SEQ ID NO: 455766 - RNA, 64 nt, Human; identical to SEQ ID NO: 70122

SEQ ID NO: 455767 - RNA, 64 nt, Human; identical to SEQ ID NO: 70123

SEQ ID NO: 455768 - RNA, 64 nt, Human; identical to SEQ ID NO: 70124

SEQ ID NO: 455769 - RNA, 64 nt, Human; identical to SEQ ID NO: 70125

SEQ ID NO: 455770 - RNA, 64 nt, Human; identical to SEQ ID NO: 70126

SEQ ID NO: 455771 - RNA, 64 nt, Human; identical to SEQ ID NO: 70127

SEQ ID NO: 455772 - RNA, 64 nt, Human; identical to SEQ ID NO: 70128

SEQ ID NO: 455773 - RNA, 64 nt, Human; identical to SEQ ID NO: 70129

SEQ ID NO: 455774 - RNA, 64 nt, Human; identical to SEQ ID NO: 70130

SEQ ID NO: 455775 - RNA, 64 nt, Human; identical to SEQ ID NO: 70131

SEQ ID NO: 455776 - RNA, 60 nt, Human
ucucucucucucuaauucuaggcacacauuuaguuagaugugaagcauuuaauucauugg

SEQ ID NO: 455777 - RNA, 60 nt, Human
gaggccaacagggacgacagagacaguuucuaguuagagccuuggcuccauuuuuggaug

SEQ ID NO: 455778 - RNA, 60 nt, Human
guuugagcaguuuuuccaaggcaacauugauaguuagauucagggccaggcuguaagucu

SEQ ID NO: 455779 - RNA, 64 nt, Human; identical to SEQ ID NO: 70132

SEQ ID NO: 455780 - RNA, 64 nt, Human; identical to SEQ ID NO: 70133

SEQ ID NO: 455781 - RNA, 64 nt, Human; identical to SEQ ID NO: 70134

SEQ ID NO: 455782 - RNA, 64 nt, Human; identical to SEQ ID NO: 70135

SEQ ID NO: 455783 - RNA, 64 nt, Human; identical to SEQ ID NO: 70136

SEQ ID NO: 455784 - RNA, 64 nt, Human; identical to SEQ ID NO: 70137

SEQ ID NO: 455785 - RNA, 64 nt, Human; identical to SEQ ID NO: 70138

SEQ ID NO: 455786 - RNA, 64 nt, Human; identical to SEQ ID NO: 70139

SEQ ID NO: 455787 - RNA, 64 nt, Human; identical to SEQ ID NO: 70140

SEQ ID NO: 455788 - RNA, 56 nt, Human; identical to SEQ ID NO: 70141

SEQ ID NO: 455789 - RNA, 64 nt, Human; identical to SEQ ID NO: 70142

SEQ ID NO: 455790 - RNA, 64 nt, Human; identical to SEQ ID NO: 70143

SEQ ID NO: 455791 - RNA, 64 nt, Human; identical to SEQ ID NO: 70144

SEQ ID NO: 455792 - RNA, 64 nt, Human; identical to SEQ ID NO: 70145

SEQ ID NO: 455793 - RNA, 64 nt, Human; identical to SEQ ID NO: 70146

SEQ ID NO: 455794 - RNA, 64 nt, Human; identical to SEQ ID NO: 70147

SEQ ID NO: 455795 - RNA, 60 nt, Human
cugucuuuuuugaagcauguguguuauguguaguuagauauauuucacuuaugugaguca

SEQ ID NO: 455796 - RNA, 60 nt, Human
aaaguaaccaucagcaaauacugcagugauuaguuagaaucuguauuauuccuuauauau

SEQ ID NO: 455797 - RNA, 60 nt, Human
aggaggguccuaggcuagaggggguaucccuaguuagacuuugggaagccaccuucaacg

SEQ ID NO: 455798 - RNA, 64 nt, Human; identical to SEQ ID NO: 70148

SEQ ID NO: 455799 - RNA, 64 nt, Human; identical to SEQ ID NO: 70149

SEQ ID NO: 455800 - RNA, 64 nt, Human; identical to SEQ ID NO: 70150

SEQ ID NO: 455801 - RNA, 64 nt, Human; identical to SEQ ID NO: 70151

SEQ ID NO: 455802 - RNA, 64 nt, Human; identical to SEQ ID NO: 70152

SEQ ID NO: 455803 - RNA, 64 nt, Human; identical to SEQ ID NO: 70153

SEQ ID NO: 455804 - RNA, 64 nt, Human; identical to SEQ ID NO: 70154

SEQ ID NO: 455805 - RNA, 63 nt, Human; identical to SEQ ID NO: 70155

SEQ ID NO: 455806 - RNA, 64 nt, Human; identical to SEQ ID NO: 70156

SEQ ID NO: 455807 - RNA, 64 nt, Human; identical to SEQ ID NO: 70157

SEQ ID NO: 455808 - RNA, 64 nt, Human; identical to SEQ ID NO: 70158

SEQ ID NO: 455809 - RNA, 64 nt, Human; identical to SEQ ID NO: 70159

SEQ ID NO: 455810 - RNA, 64 nt, Human; identical to SEQ ID NO: 70160

SEQ ID NO: 455811 - RNA, 64 nt, Human; identical to SEQ ID NO: 70161

SEQ ID NO: 455812 - RNA, 64 nt, Human; identical to SEQ ID NO: 70162

SEQ ID NO: 455813 - RNA, 64 nt, Human; identical to SEQ ID NO: 70163

SEQ ID NO: 455814 - RNA, 60 nt, Human
auacuaaaacauucuuaaaauagaggaauauaguuagagacaucagguuuaagccaguau

SEQ ID NO: 455815 - RNA, 60 nt, Human
uuauucauaugcuucccagagaagcucauuuaguuagaaaauaaggcaaguuuugaagcc

SEQ ID NO: 455816 - RNA, 60 nt, Human
gugaguccuucaagagcaguuaucaauuguuaguuagauauuuucuauuuagagaaugcu

SEQ ID NO: 455817 - RNA, 64 nt, Human; identical to SEQ ID NO: 70164

SEQ ID NO: 455818 - RNA, 64 nt, Human; identical to SEQ ID NO: 70165

SEQ ID NO: 455819 - RNA, 64 nt, Human; identical to SEQ ID NO: 70166

SEQ ID NO: 455820 - RNA, 64 nt, Human; identical to SEQ ID NO: 70167

SEQ ID NO: 455821 - RNA, 64 nt, Human; identical to SEQ ID NO: 70168

SEQ ID NO: 455822 - RNA, 64 nt, Human; identical to SEQ ID NO: 70169

SEQ ID NO: 455823 - RNA, 64 nt, Human; identical to SEQ ID NO: 70170

SEQ ID NO: 455824 - RNA, 64 nt, Human; identical to SEQ ID NO: 70171

SEQ ID NO: 455825 - RNA, 60 nt, Human
uuucuaagugguaugugagauuuucuaauguaguuagaaguuucauugucugauggacac

SEQ ID NO: 455826 - RNA, 60 nt, Human
cagcauauaucagaacguccuguaaucauuuaguuagaaacuaacuacuaacuagucuuu

SEQ ID NO: 455827 - RNA, 60 nt, Human
cagagacuguuguggaggugaguucggcuguaguuagagugauuggacccuuccuauugg

SEQ ID NO: 455828 - RNA, 60 nt, Human
uugguaaggccaauguuauuuaaaugaaaguaguuagaaaaaugcucuccuauucuacca

SEQ ID NO: 455829 - RNA, 60 nt, Human
cuucaugaaaugaaacuuuguaacuuauuguaguuagaaauuguaacuuugauauugaau

SEQ ID NO: 455830 - RNA, 60 nt, Human
acugggaguguuauuagaaugaaaaguaauuaguuagaagggcauacaucucaguggcau

SEQ ID NO: 455831 - RNA, 60 nt, Human
uggucaacaggaaguugacuguaugucugcuaguuagauucaaaacaucauaaagaugau

SEQ ID NO: 455832 - RNA, 60 nt, Human
auugagugccaaagagaagagcuuacuggguaguuagaguucaucaggagacccaacccu

SEQ ID NO: 455833 - RNA, 60 nt, Human
cuuuucaggaagaacaaaaaugucagugcauaguuagauaaaaugguaaaauguuuuacu

SEQ ID NO: 455834 - RNA, 60 nt, Human
ugccaaagugauagagaugaaucaugucaguaguuagaauaacauuucaacuguuuucuu

SEQ ID NO: 455835 - RNA, 60 nt, Human
cugaauacaguguuuucaauuuguacagaauaguuagaauauucuauuaaaguggugaaa

SEQ ID NO: 455836 - RNA, 60 nt, Human
agggagaggauauagaccuuuuuaacuuuauaguuagaaaaauuggccucagugugaaau

SEQ ID NO: 455837 - RNA, 60 nt, Human
aguaaaaugcuuacaggaaaaccugcagaguaguuagagaauauguaugccugcaauaug

SEQ ID NO: 455838 - RNA, 60 nt, Human
cccuccuugguuaucauccacugcagcugcuaguuagaaagguuuggagggaugacuuuu

SEQ ID NO: 455839 - RNA, 60 nt, Human
ggcaguuuucuuugcccaagcauuuggugcuaguuagaggcuguucacucucuccugcuc

SEQ ID NO: 455840 - RNA, 60 nt, Human
uuucaaacuugaccaccuuuuccuaccagcuaguuagaagucaucaauauuucucuacau

SEQ ID NO: 455841 - RNA, 60 nt, Human
ucucugaagaagaagcuuggguuaacucaguaguuagaucaaagcaaauguggacugaau

SEQ ID NO: 455842 - RNA, 60 nt, Human
uacagaacaaacugcuuacacaggucucacuaguuagaaaccugugggccauggagguca

SEQ ID NO: 455843 - RNA, 60 nt, Human
uauaggauguggcuuuuguccagcugauaguaguuagaggcuuacaacuuaggagcagca

SEQ ID NO: 455844 - RNA, 60 nt, Human
gguuuaugcauguauaugccauuauuuuuguaguuagacaauaguuuuuaaaagaauuuc

SEQ ID NO: 455845 - RNA, 60 nt, Human
ucuucuccugccucauucccugacuuucucuaguuagaugucaguccuaaauagguuuuc

SEQ ID NO: 455846 - RNA, 60 nt, Human
guuuuugaaagaucuucucuccaaaccaguuaguuagagccagugacgccucuguguucu

SEQ ID NO: 455847 - RNA, 60 nt, Human
cccugcugaagcucuuugucaaauagguaguaguuagaacuggauugccauuuucauuau

SEQ ID NO: 455848 - RNA, 60 nt, Human
augguuugagaauguaaaacaaaaaggaacuaguuagagucaaguuuuaaaauuuuuacu

SEQ ID NO: 455849 - RNA, 60 nt, Human
uauaaaaauuguaaaacuacuacuuuguuuuaguuagaacaaagcucaaaacuacuuuag

SEQ ID NO: 455850 - RNA, 60 nt, Human
uggggaugcuuaauguguacaaaaacuauguaguuagaaaguauaaauaagaccuaguau

SEQ ID NO: 455851 - RNA, 60 nt, Human
aggguuggggguagagguuuugggaugucuuaguuagaaaccagauuaauagaagaguag

SEQ ID NO: 455852 - RNA, 60 nt, Human
uaugugcuuugcuuacuuuuuaaaaaaauguaguuagacugugaggaguuacuuuaugua

SEQ ID NO: 455853 - RNA, 60 nt, Human
cauuuccaaucacuuaguagccccucaaaguaguuagaaaauaaacagauuuuuccagug

SEQ ID NO: 455854 - RNA, 60 nt, Human
ugaaagcaagaauacuuagaauucuggcuuuaguuagaguaauauaacucaaaugggugc

SEQ ID NO: 455855 - RNA, 60 nt, Human
uacuuuuuguuaucagucaauauuuuuagauaguuagaaccugguccuaagccuaaaagu

SEQ ID NO: 455856 - RNA, 62 nt, Human
cgcuucccccaucuggugaugcuugagugcacagagaccaacucccugggcuucauacuggc

SEQ ID NO: 455857 - RNA, 62 nt, Human
accgaggcagguggaucacgaggucaggagauagagaccauccuggccaacacggugaaacc

SEQ ID NO: 455858 - RNA, 62 nt, Human
uggucucguguuacuuugcugugccugugcugagagaccaugugcccgagcaucugguugac

SEQ ID NO: 455859 - RNA, 62 nt, Human
ggcccuagguaccccagcugaucagugccaggagagaccagagccucuggaggcuacccagg

SEQ ID NO: 455860 - RNA, 62 nt, Human
cacuuugggagauggauugcuugagcucgggaagagaccaguucggucucuacaaaaaaaua

SEQ ID NO: 455861 - RNA, 62 nt, Human
ucucguacuugaacucacucccucacggggagagagaccacacgcaguauugagcugccuga

SEQ ID NO: 455862 - RNA, 62 nt, Human
gcuucccugccugcugcugccccauuugaucaagagaccauggaagugucagagauucagaa

SEQ ID NO: 455863 - RNA, 62 nt, Human
gccagagcugugccugcucagcagccagucucagagaccagcacucagccucauucagcaug

SEQ ID NO: 455864 - RNA, 62 nt, Human
gaauacuuuguaauagccacaaguucuuguuuagagaccagagcaggauuaauaauuuauuu

SEQ ID NO: 455865 - RNA, 62 nt, Human
ccaggaaaaagaaugcacauugaauggaugugagagaccacauugccucucccacugcuuug

SEQ ID NO: 455866 - RNA, 62 nt, Human
ucugagaggcuggagcagggucacccacggacagagaccaagagagguccugcgaaggcugg

SEQ ID NO: 455867 - RNA, 62 nt, Human
acaucacucuuaucaaaugugugagcaguagaagagaccacauuuacagucaauagaaauaa

SEQ ID NO: 455868 - RNA, 62 nt, Human
cuggcaaaugagggcuggacucucuucccuccagagaccaccccgcuccuugcugcagcuga

SEQ ID NO: 455869 - RNA, 62 nt, Human
gcacacagccuguuuguuuuaguauccaaggaagagaccaaggagccagcuggcgggaaggg

SEQ ID NO: 455870 - RNA, 62 nt, Human
uccacuuccucucauuccauucauugguuggcagagaccacaaagacucauggggcuuuccu

SEQ ID NO: 455871 - RNA, 62 nt, Human
cuggcaauaaaagucagugaaugguggaagucagagaccaacccuggggauugggugccauc

SEQ ID NO: 455872 - RNA, 62 nt, Human
agccuccucgucacccuucuccuuuuggggugagagaccagcagcccaagggcuccagacac

SEQ ID NO: 455873 - RNA, 62 nt, Human
auccagggaaaagcaguggggacggaaggcaaagagaccacucaacccccaccuggaagggg

SEQ ID NO: 455874 - RNA, 62 nt, Human
accucucacuuugcugugagcccgggaaccccagagaccacuccuguggagagcugaggggg

SEQ ID NO: 455875 - RNA, 62 nt, Human
gagcgagacaugagccuguagguucaguagguagagaccaagcaucuaucugauagaagcac

SEQ ID NO: 455876 - RNA, 62 nt, Human
gauuguaaagauugagcauuggaagggguaucagagaccauguaguucaacuuuccacucaa

SEQ ID NO: 455877 - RNA, 62 nt, Human
auuuuguuagccgacuucugguagcuuagcaaagagaccagcugacugucucucggcccagc

SEQ ID NO: 455878 - RNA, 62 nt, Human
caaaacuauuugugaucuacuguuugcauguaagagaccaggauauguaacucuuauauuuu

SEQ ID NO: 455879 - RNA, 62 nt, Human
uguauuuugucaaauuuguuacuuaaauauauagagaccaguuuucucuggaaguuuguuua

SEQ ID NO: 455880 - RNA, 62 nt, Human
uuuucauuugccuccgcuuucgccugauccaaagagaccaagucacuguacuggucccuugc

SEQ ID NO: 455881 - RNA, 62 nt, Human
uacucaguuacuaauucuuuugagaacuccuaagagaccaauuuguaagacuuauuuaguau

SEQ ID NO: 455882 - RNA, 62 nt, Human
ucagaaaauauuaaggaaaaaagcaaguuugaagagaccacauggggcguacuauuuuuauu

SEQ ID NO: 455883 - RNA, 62 nt, Human
uugugcuggucccaucccaagaauuguaggacagagaccacacugggucggcggacacaaag

SEQ ID NO: 455884 - RNA, 62 nt, Human
aagucaggucaggcuucaugccugcauccuccagagaccacaggagccaaagcgagccucca

SEQ ID NO: 455885 - RNA, 62 nt, Human
gaagggcauuccaggcagagggaaaccugugcagagaccaagagguguggaaggaaaagugg

SEQ ID NO: 455886 - RNA, 62 nt, Human
agaacccaggaucauccugucuggcugcagugagagaccaaccccuaacaagggcugggcca

SEQ ID NO: 455887 - RNA, 62 nt, Human
cacacaccucuccuucauucacguccuauggaagagaccauaaaggcuucaaaacuagaagu

SEQ ID NO: 455888 - RNA, 62 nt, Human
caccuuaucccaggaaccugcccuagaccuccagagaccauauuuucucucccuccauuucu

SEQ ID NO: 455889 - RNA, 62 nt, Human
uauguaaaagauuucuucaagcuccauuuugcagagaccaccacuuagagaaucaaaaaauu

SEQ ID NO: 455890 - RNA, 62 nt, Human
cgccuccuuuucugaccuucaaaguccccuguagagaccaugcaugcucuaagccuuaggga

SEQ ID NO: 455891 - RNA, 62 nt, Human
aucaugaagaaagaaauugauagguguaaaugagagaccauguaaaauauguaaauucuagu

SEQ ID NO: 455892 - RNA, 62 nt, Human
ugaucaugccacuguacuccagccugggcaacagagaccaucuuaaaaaaaaaaaauccuuc

SEQ ID NO: 455893 - RNA, 62 nt, Human
ggacagagauggaggccgagccaauagacugaagagaccacagcaauuggcuccuccaucua

SEQ ID NO: 455894 - RNA, 62 nt, Human
uaaaaaaauaauaaggucucauggcuucauuuagagaccacaguaacaacagcagcccacca

SEQ ID NO: 455895 - RNA, 62 nt, Human
caccacagcaucaauucccuugauccagcccaagagaccaggcagccauggccacugccuuc

SEQ ID NO: 455896 - RNA, 62 nt, Human
agguggacaaagggauccccagccagagagagagagaccagccaacagcuugauagaccagu

SEQ ID NO: 455897 - RNA, 62 nt, Human
cagccaacagcuugauagaccagugcagccagagagaccaccaaacagagcccccaaaagac

SEQ ID NO: 455898 - RNA, 62 nt, Human
uguugucuuuuucccugcuccuggugcccugaagagaccagcaagggggcagaccccgcacu

SEQ ID NO: 455899 - RNA, 62 nt, Human
ugcuggucuuauccugucccuccuccagguagagagaccacaagcaggcucaacauaacaua

SEQ ID NO: 455900 - RNA, 62 nt, Human
cucaccuauuuggguuaagcaugccaauuuaaagagaccaaguguauguacauuauguucua

SEQ ID NO: 455901 - RNA, 62 nt, Human
acccucgggauggccauccacugucuccagaaagagaccacuuagagggucucuaugccaag

SEQ ID NO: 455902 - RNA, 62 nt, Human
uccaguucugacacacguauuuauauuuggaaagagaccagcaccgagcucggcaccucccc

SEQ ID NO: 455903 - RNA, 62 nt, Human
gugcuucucaacuccaccccauaauuucucccagagaccaucuaucaccuuuuccccaaaga

SEQ ID NO: 455904 - RNA, 62 nt, Human
aggagagagaggcaauggcuccuucacaaaccagagaccaaaugucacguuuuguuuugugc

SEQ ID NO: 455905 - RNA, 62 nt, Human
agaaaaccuucagccagccuccagugcugucgagagaccaccuucccccgacccggaggcac

SEQ ID NO: 455906 - RNA, 62 nt, Human
guggguugaggcuugacuguagcauccugcuuagagaccaaucaacggacacugguuuuuag

SEQ ID NO: 455907 - RNA, 59 nt, Human
gcgcugauacuggucgcugacagcgccaaagagaccaacaagaugauuuuagcguggac

SEQ ID NO: 455908 - RNA, 62 nt, Human
uaaaacagccaucuucaagacagccccugaaaagagaccaguucagguccugcccugcuguu

SEQ ID NO: 455909 - RNA, 62 nt, Human
agcguccuuacagccagugacacaggacuuucagagaccaaggccagggucugcugcacugc

SEQ ID NO: 455910 - RNA, 62 nt, Human
acuuagcuguguguucgagccauggcaucuuuagagaccauuggcccacugaugaauggaau

SEQ ID NO: 455911 - RNA, 62 nt, Human
gcucuuggggacugcgagaagcagagagaaugagagaccaguggcaacugccugcacagcag

SEQ ID NO: 455912 - RNA, 62 nt, Human
ucccgcugcacggcccaccggcggccagccccagagaccagaacugauccagagcuggagaa

SEQ ID NO: 455913 - RNA, 62 nt, Human
ggcugaacacccaaaacgccauugccuuccgcagagaccagagaucucuguacuucaaggac

SEQ ID NO: 455914 - RNA, 62 nt, Human
cuauucaggucuccuuccacaacucugaagagagagaccacugcccuuugugguuggacaga

SEQ ID NO: 455915 - RNA, 62 nt, Human
uauuuuagagaaugaaugaagcaacaaggaagagagaccaugacucuaucgaugacacuguu

SEQ ID NO: 455916 - RNA, 62 nt, Human
uauuuuuccuuuuucuuuuuguguaccucuacagagaccaaaacucauucucuuaaagagau

SEQ ID NO: 455917 - RNA, 62 nt, Human
ccuuacaaggcguggcucauggccugcauuccagagaccaacaugauagcuuuuaauucagc

SEQ ID NO: 455918 - RNA, 62 nt, Human
uugucucuaauuugagcaguaacaugauugcaagagaccaaguuucacagcuuguaaaguuc

SEQ ID NO: 455919 - RNA, 62 nt, Human
auucuuagucaaggaauaauucaagucagccuagagaccauguugacuuuccucauguguuu

SEQ ID NO: 455920 - RNA, 62 nt, Human
aagugauacaaucaauuucaaaacaaucuuccagagaccacuugaagguucauaguuuuuac

SEQ ID NO: 455921 - RNA, 62 nt, Human
gauuguauuaacuaucuucuuuggacuucugaagagaccacucaauccauccauguacuucc

SEQ ID NO: 455922 - RNA, 62 nt, Human
caugauuuuuauaguugaagaaccuaagacacagagaccaaggcccaugagcucauagggcu

SEQ ID NO: 455923 - RNA, 62 nt, Human
cugcaauacuaacgaccgacgccccuccgggcagagaccaccgcgccccucugcgccccagc

SEQ ID NO: 455924 - RNA, 62 nt, Human
aagcugaaucccacacuccaggucugugcucaagagaccagaugguguauuuccaaaugggc

SEQ ID NO: 455925 - RNA, 62 nt, Human
ucaguaacuugaaguuuaaauuuaaaaugcagagagaccaaugguuaaaaugugaauaguau

SEQ ID NO: 455926 - RNA, 62 nt, Human
gcugauggagcaguuuacagaaaagaagauggagagaccaccuucacuggcagacuagauaa

SEQ ID NO: 455927 - RNA, 62 nt, Human
cuggaaacauuguaucgaaaccgauccaaccuagagaccauuuuuaggaucauagacaguga

SEQ ID NO: 455928 - RNA, 62 nt, Human
cagcucacugcaaccucugccuccugggcucaagagaccagcccaccuccgccuccaaguag

SEQ ID NO: 455929 - RNA, 62 nt, Human
cugauuucuauucuugucucaaucuuaaauuuagagaccaguuguuuuuaugauaucagcca

SEQ ID NO: 455930 - RNA, 62 nt, Human
ugugcauucacauacuauuacgcuucucaaagagagaccaacaucaugcuuuuaacacauuu

SEQ ID NO: 455931 - RNA, 62 nt, Human
cucugggccagaggaugcugagcugccugggcagagaccaagaggguuggagacacuaguuu

SEQ ID NO: 455932 - RNA, 62 nt, Human
uugguggacguuucuguuuacucagagcugcuagagaccauccugcccauccgaguucugag

SEQ ID NO: 455933 - RNA, 62 nt, Human
ugcaaggacacagagaguaccagauagguagcagagaccaaggcgcagggugcuucagauga

SEQ ID NO: 455934 - RNA, 62 nt, Human
aauguaauaauacuuccacagcaacaggugcuagagaccacuguuguuguuuugagugaaug

SEQ ID NO: 455935 - RNA, 62 nt, Human
ucauuggcguauggcacucauuaaaaaggaucagagaccauuaaaagaggaccauaccuauu

SEQ ID NO: 455936 - RNA, 62 nt, Human
guuguagguugagcgaaugcuaccagagugugagagaccauugucucguuggcuggcgcuca

SEQ ID NO: 455937 - RNA, 62 nt, Human
acaccugagagaaaggggaggggucaacaaugagagaccaggaguagguccuaucagugccc

SEQ ID NO: 455938 - RNA, 62 nt, Human
gcccacucccuacccccagcuucggaaaauacagagaccaccaccacguacccuguauuccc

SEQ ID NO: 455939 - RNA, 62 nt, Human
gggaugccacuuaccccaauagcccuugaaacagagaccaagcauaaauacaaaaguaacug

SEQ ID NO: 455940 - RNA, 62 nt, Human
uaaagcauccugggcuagccuaccggaggaucagagaccauguggaacauaaaugaaucauc

SEQ ID NO: 455941 - RNA, 62 nt, Human
agaugucacaggugugaugaagggagaguaggagagaccaugaguauguguaacaggaggac

SEQ ID NO: 455942 - RNA, 62 nt, Human
ucugcuaaacgcuuguugaaggagugaaauugagagaccaggaagggccugcaggcauugug

SEQ ID NO: 455943 - RNA, 62 nt, Human
uuggggggaaauagaagaguacggagaaaggaagagaccagaguucuuuaaagcucacauuu

SEQ ID NO: 455944 - RNA, 62 nt, Human
gugacuucaagaacccugacuccucuuugugcagagaccagcccaccccugugcccaccaug

SEQ ID NO: 455945 - RNA, 62 nt, Human
agaaagggaucaaggggguugggaggggggaaagagaccagccuuggucccuaagccuccag

SEQ ID NO: 455946 - RNA, 62 nt, Human
ccccagcgucuucccaggccagagaaaguggaagagaccacaaagcgcaggcaauuggcagg

SEQ ID NO: 455947 - RNA, 61 nt, Human
ucuugauaagaauuuacagauaagacacucagagagacauugugucauucucuaucaucac

SEQ ID NO: 455948 - RNA, 62 nt, Human
cugcugccagagacgaggcaggcacagcugccagagaccauccaggacguggagagaaagag

SEQ ID NO: 455949 - RNA, 62 nt, Human
uguauauuucaguggaaauacaaaaccacuucagagaccaggguaucuccucuggaaggauc

SEQ ID NO: 455950 - RNA, 62 nt, Human
uuagaggaggaaauauccuuuguccuguucagagagaccagggcccuaccauuaggcauacu

SEQ ID NO: 455951 - RNA, 62 nt, Human
guuggccugcagggagucagccuuaccccaucagagaccaacuugaaagauuuuuuucucug

SEQ ID NO: 455952 - RNA, 62 nt, Human
cgguggagaugacagccccaggucugggguacagagaccacuuaggauggcacaggguggcu

SEQ ID NO: 455953 - RNA, 62 nt, Human
uugauuaauuucugccauuucauguccauaaaagagaccacccauaucaugcacacaauuag

SEQ ID NO: 455954 - RNA, 62 nt, Human
uucucucuaaauuguauauaaguuguguauauagagaccauaauuauaugguccuuagaaaa

SEQ ID NO: 455955 - RNA, 62 nt, Human
uuugcuuuuugaggcaugugcugucaaauguuagagaccaaacuuagugauuagagguuggu

SEQ ID NO: 455956 - RNA, 62 nt, Human
guaucuuccuaggcaaaagcuguaauuuccagagagaccauuaggaacagguaguaucuauu

SEQ ID NO: 455957 - RNA, 62 nt, Human
agagaagucuuaagagaugacugcucagauggagagaccagagaagagaacaagcuguugau

SEQ ID NO: 455958 - RNA, 51 nt, Human
gacccuuaggaguucgaugagagagaccaugaggccacugggcuuuccccc

SEQ ID NO: 455959 - RNA, 62 nt, Human
cguuauuuauuggagguauuguuuaaccuuagagagaccauuaaauuauuuauaaaauauuu

SEQ ID NO: 455960 - RNA, 62 nt, Human
gauugcuuuuauuacauuaguuaagaugucugagagaccaucuccuaucuuuuauuucauuc

SEQ ID NO: 455961 - RNA, 62 nt, Human
ucuuccuuagacaugcagagaaaauguaugcaagagaccaaaaagauggcuccaagcuaugu

SEQ ID NO: 455962 - RNA, 62 nt, Human
gcaggcucucguggggcaggagaugggaggggagagaccagcucuccagccuggcaggaaag

SEQ ID NO: 455963 - RNA, 62 nt, Human
aaauuucuuucaggucucauaaaagcgaugaaagagaccaggauaacauucuaauauuuaaa

SEQ ID NO: 455964 - RNA, 62 nt, Human
gccccuuccccuuucugggguccuccauaccuagagaccacucugggagguuugcuaggccc

SEQ ID NO: 455965 - RNA, 62 nt, Human
auuaaagaaaaauuccuacagauuuucaaugcagagaccauaaucaaaaaguaaacuuucuu

SEQ ID NO: 455966 - RNA, 62 nt, Human
ugcaucgaaauguauucaccuuucuuuuguaaagagaccaucuucuaucuucuuuccaccuu

SEQ ID NO: 455967 - RNA, 62 nt, Human
cucagcagguccacagcaccugggcagaggucagagaccaggggaggccgggccuugcccuc

SEQ ID NO: 455968 - RNA, 62 nt, Human
accuaaugaccagagguuaaauccucaucaagagagaccaggcggcuggaggacaagcggcu

SEQ ID NO: 455969 - RNA, 62 nt, Human
gaaaccuuauaaauuaaacacauggcccccuuagagaccacaggugaugucugucuccaucc

SEQ ID NO: 455970 - RNA, 62 nt, Human
uguuuacaaauggacauaggacucaaaguuucagagaccauugcaaugaauccccaauaauu

SEQ ID NO: 455971 - RNA, 62 nt, Human
ugaauuuaagaccauauuauuaucaaaaaccuagagaccaaucauauaucugaaaagaaaua

SEQ ID NO: 455972 - RNA, 62 nt, Human
ccucaucugagagugcuuaaaaugggauccccagagaccauuaaccaauacuggaacuggua

SEQ ID NO: 455973 - RNA, 62 nt, Human
aaaauagagcaaaaucaacaugacugguggugagagaccacacauuuuaugagaguuuggaa

SEQ ID NO: 455974 - RNA, 62 nt, Human
caaguucccgauggcgaacggggcucagcaccagagaccagggaguauucacugccauccau

SEQ ID NO: 455975 - RNA, 62 nt, Human
uuggcaggccucccuuuggggagagggaggggagagaccacagccgggugugugucugcagc

SEQ ID NO: 455976 - RNA, 62 nt, Human
uaauugggaggaugaagugucuuaaaaauuguagagaccagcucacuggaauguuuuuccau

SEQ ID NO: 455977 - RNA, 62 nt, Human
caccagacuagaauuaauauauuuauaaagaaagagaccaaaacugucuagaauuugaaagg

SEQ ID NO: 455978 - RNA, 62 nt, Human
ugagacccaccagguccaguuuugguugguguagagaccauaugcauauuauuccugggaua

SEQ ID NO: 455979 - RNA, 62 nt, Human
gcuacugccccuuggcccuuagacaacaggacagagaccagagggacugggcggcuuguccc

SEQ ID NO: 455980 - RNA, 62 nt, Human
cgguaaccagagggcagcguagugucaacaccagagaccaggauccaaauuguggggaauca

SEQ ID NO: 455981 - RNA, 62 nt, Human
gcuucauguuuucucugacucauggaucugguagagaccauagacaugauauagacuaacuu

SEQ ID NO: 455982 - RNA, 62 nt, Human
ggacuuccugaccucuucugucuuugagggacagagaccaagcuagauccuuuuucucaccu

SEQ ID NO: 455983 - RNA, 62 nt, Human
aucuaucauagcacuuaaaaaaaaaaaaaaaaagagaccaaaaauaacuuuaggaaccacca

SEQ ID NO: 455984 - RNA, 62 nt, Human
ccgcugaguggacuggaguggagcauuggcugagagaccaggagggcacuggagcugucuug

SEQ ID NO: 455985 - RNA, 58 nt, Human
cccaccggggugggcacuaagcuaugggagagaccauagcugcagaaaccaacccugc

SEQ ID NO: 455986 - RNA, 62 nt, Human
cucugaggugugggcucccucaucucguaaccagagaccagcacaugucagggaagcaccca

SEQ ID NO: 455987 - RNA, 62 nt, Human
guugauaaaccuuaguacucagauaauaaauaagagaccaaaaguaggcuaucacccaaagc

SEQ ID NO: 455988 - RNA, 62 nt, Human
acugauaugaagucgacauauuuauagugcuuagagaccaaacuaauggaaggcagacuauu

SEQ ID NO: 455989 - RNA, 62 nt, Human
caauauaauacacugaagaauaacuuaguaucagagaccaauaaaucacuuuuuuaaggaug

SEQ ID NO: 455990 - RNA, 62 nt, Human
cgugccuuggacccagggcccagcuucccaggagagaccaaaggcuucugagcaggauuuuu

SEQ ID NO: 455991 - RNA, 62 nt, Human
cucuggcauguucacaaaaaguagaaacucuaagagaccauuaccauuuauucacagaugua

SEQ ID NO: 455992 - RNA, 62 nt, Human
gguuuaauguugcuucacuuaucccacccuacagagaccagcaagguucugccaggccucga

SEQ ID NO: 455993 - RNA, 62 nt, Human
gauuuacuguugcuucauuuaucccauccuucagagaccagcaagguucugccaggccccaa

SEQ ID NO: 455994 - RNA, 62 nt, Human
uaccuuauugcacugguuagcaaccccaauacagagaccaccagaucagguauagacuccug

SEQ ID NO: 455995 - RNA, 62 nt, Human
uagguugcagcagagaaaauaaaugugccuugagagaccacucagagaggguccaaggguga

SEQ ID NO: 455996 - RNA, 62 nt, Human
ggagaaagagauucacuagagaauaacuccuuagagaccaaugucuguagcagguguacagc

SEQ ID NO: 455997 - RNA, 62 nt, Human
ugugugugugugagagagagagagagagagagagagaccagcaucuucaagagaaguauucu

SEQ ID NO: 455998 - RNA, 62 nt, Human
caggugauggggcaugcugagaaauagagaaaagagaccauguuuauuuggguaggaggaag

SEQ ID NO: 455999 - RNA, 62 nt, Human
agucccccucuguccuggggccuggcuuggacagagaccaggauuuggggcugagcugguuu

SEQ ID NO: 456000 - RNA, 62 nt, Human
ucugauguguggauccugaggaaagacuuggaagagaccagcaugucuucaguagccaaacu

SEQ ID NO: 456001 - RNA, 62 nt, Human
caguggaaacacaugaacuucgaugcagguccagagaccauggacacucccacgaggcucag

SEQ ID NO: 456002 - RNA, 62 nt, Human
uggucuaggaccauaccuuauauaaagguauaagagaccaugacaaugucugaaaauggaau

SEQ ID NO: 456003 - RNA, 62 nt, Human
accaagacaaaggaagcaaaauuggucucuuuagagaccaauuugccuaaauuuuaaaaucu

SEQ ID NO: 456004 - RNA, 62 nt, Human
uuauuugcaaagaaaauauacaauuaucaagcagagaccaccucagauuaauagagaaugaa

SEQ ID NO: 456005 - RNA, 61 nt, Human
uguuaaggcucaggagugggcagcagucagggagagacagaacugggggaaagggaugguu

SEQ ID NO: 456006 - RNA, 61 nt, Human
ggccguggagguccuguccacagcuggacaggagagacaccgccugcggugguucauuccu

SEQ ID NO: 456007 - RNA, 61 nt, Human
gauaaauucagugauagcccaagcuggucaggagagacagaagugcuggcuaggaggucuc

SEQ ID NO: 456008 - RNA, 62 nt, Human
cccagcaacuggcccaggaugcaggcugcucuagagaccaaaggaacaccaggcccagcgcc

SEQ ID NO: 456009 - RNA, 62 nt, Human
cacagacaccccuuaccccacccccacuguacagagaccaagaacagaaauuguuuguaaau

SEQ ID NO: 456010 - RNA, 62 nt, Human
auacaaggaagggccuuucucggggccggagaagagaccaagagaccaggcccgggcagcag

SEQ ID NO: 456011 - RNA, 62 nt, Human
aagggccuuucucggggccggagaagagaccaagagaccaggcccgggcagcagccuaccgg

SEQ ID NO: 456012 - RNA, 62 nt, Human
cuggagcccuccuuggagcuggagagcaccucagagaccagugacaugccagaggugaggcu

SEQ ID NO: 456013 - RNA, 62 nt, Human
cauggcgagaauccagcuuugaccuuuauucaagagaccagauggguugccccaggauccgg

SEQ ID NO: 456014 - RNA, 62 nt, Human
gccgcgugcgugagaaccgcgccgguguccccagagaccaggcugugucccucuucucuucc

SEQ ID NO: 456015 - RNA, 62 nt, Human
gucugugugcuuacugaagagucccaaaaaccagagaccauuuucauuuacugccaucauaa

SEQ ID NO: 456016 - RNA, 62 nt, Human
uuucaucucuuggucauaauuccgagauccccagagaccacuguuucuggaguaucugucau

SEQ ID NO: 456017 - RNA, 62 nt, Human
ugagguagguagauugcuugagcccaggaguuagagaccagccugggcaacaugaugugaaa

SEQ ID NO: 456018 - RNA, 62 nt, Human
auuuucuaccuaaggaccagaauuuuuuaucuagagaccagcauguucuccccaaagaccaa

SEQ ID NO: 456019 - RNA, 62 nt, Human
auuuucuaccuaaggaccagaauuuuuugucuagagaccagcauguucuccccaaagaccag

SEQ ID NO: 456020 - RNA, 62 nt, Human
auuuucuaccuaaagaccaggacuuuuuaucuagagaccagcauguucuccccaaagacugg

SEQ ID NO: 456021 - RNA, 62 nt, Human
uacccaaaugucaggaccaggauuuucuacccagagaccaagguguucuucccaaagaccaa

SEQ ID NO: 456022 - RNA, 62 nt, Human
uacccauaugucaggaccaggauuuucuacccagagaccaagguuaucuuccuaaagaccaa

SEQ ID NO: 456023 - RNA, 62 nt, Human
ugcagagaaccaauauagcagugcccagggguagagaccauguguuccauacucggauauuu

SEQ ID NO: 456024 - RNA, 62 nt, Human
aaagggugugagguagagguaaaaauaaggugagagaccauuucagaaugcacuguugcuca

SEQ ID NO: 456025 - RNA, 61 nt, Human
acaacuucucagugucauccauugcugucgugagagacaacauagcaauaucugguauguu

SEQ ID NO: 456026 - RNA, 61 nt, Human
uuuugccccacacuaacucaguucuugugaugagagacaauuuaauaacaguauaguaaau

SEQ ID NO: 456027 - RNA, 61 nt, Human
gugcauauaaaaagaucacaucagguggauggagagacauuugaucccuuguuugcuuaau

SEQ ID NO: 456028 - RNA, 62 nt, Human
caggucuccgucugccccgccagguaccccacagagaccaaugacauuuugccacuugaaac

SEQ ID NO: 456029 - RNA, 62 nt, Human
agacugauacagacuugaccuuucagggccacagagaccagccuccgggaaggggucugccc

SEQ ID NO: 456030 - RNA, 62 nt, Human
uuuuucccuuuuugauuaggguuacaaaauuuagagaccaguaugauuaaguugaagcuccu

SEQ ID NO: 456031 - RNA, 62 nt, Human
aauuugugugggguuuaccccucacagguuuaagagaccaggucuuguuucucucucugugc

SEQ ID NO: 456032 - RNA, 62 nt, Human
uggcgugugucccugugguacccuggcagagaagagaccaagcuuguuucccugcuggccaa

SEQ ID NO: 456033 - RNA, 62 nt, Human
gugagucccuaucccaagauccuggggaaaggagagaccauggugugaauguagagaugcca

SEQ ID NO: 456034 - RNA, 62 nt, Human
gccagauguuuuuucuccuuuguccaaaggccagagaccaucccaggaagaguggugggugg

SEQ ID NO: 456035 - RNA, 62 nt, Human
uuuacugcaucccucuguaugaauaugaaaucagagaccagggcaugauguugcuaggauua

SEQ ID NO: 456036 - RNA, 62 nt, Human
uugaacuaauuacuugaaaacugguggaaaaaagagaccaacuuuguuauuuuuuaaauuau

SEQ ID NO: 456037 - RNA, 62 nt, Human
agaaagaggaacccccacaacccccuccacaaagagaccaggggcgggugaugagaccuggg

SEQ ID NO: 456038 - RNA, 62 nt, Human
agcuagcaagaggaccuggggcuuuggagugaagagaccaagaugaaguuucccaggcacag

SEQ ID NO: 456039 - RNA, 62 nt, Human
aaacaugaaaauagagaucuccucugcaguguagagaccagagcugggcagugcagggcaug

SEQ ID NO: 456040 - RNA, 62 nt, Human
acauagguuccacuuugggcacugucuuuuuaagagaccaaggcacaugcacagcuuuuaga

SEQ ID NO: 456041 - RNA, 62 nt, Human
gaggaagcacucaaccaguacucugucaucgaagagaccagcucugacacagacuaaaagca

SEQ ID NO: 456042 - RNA, 62 nt, Human
agugcagguaaaugcucauucccaaguagcaaagagaccauggagaaggugcguguaaagag

SEQ ID NO: 456043 - RNA, 62 nt, Human
uuaaaucaccuucucugaaguucuggcucugcagagaccaaaccuuacugacuuguacagac

SEQ ID NO: 456044 - RNA, 62 nt, Human
ggaucuuccacacgagugggauucuggccuucagagaccaggagggagugucugggccgcag

SEQ ID NO: 456045 - RNA, 62 nt, Human
aaauuacacucaugucaaaaaucagagaggagagagaccaaccauauuugggaugaguguaa

SEQ ID NO: 456046 - RNA, 61 nt, Human
uagcucccgucccuaaggucucugggacuuggagagacaucacuaacugauggcuccuccg

SEQ ID NO: 456047 - RNA, 61 nt, Human
caccuucucuugcugauuauuuauuuguuuggagagacagaaauguaaaaguguaucuaga

SEQ ID NO: 456048 - RNA, 62 nt, Human
gguuauguuccuuuuaccuccuuccuuaauaaagagaccacuugaaauaaucagacuuuuuc

SEQ ID NO: 456049 - RNA, 62 nt, Human
auuugggccaguuauagcuuauuagguguugaagagaccaagguugcaaggccaggcccugu

SEQ ID NO: 456050 - RNA, 62 nt, Human
ugggcccauuuucuuuccuucacaccgauggaagagaccauuaggacauauauuuagccuag

SEQ ID NO: 456051 - RNA, 62 nt, Human
ugcuuggcucucugagagcaaacaggaacacuagagaccaaaaaggggacaaaggagaaggg

SEQ ID NO: 456052 - RNA, 62 nt, Human
gagacggcguugggauagguaugacuggcuuaagagaccacaggcaagggaacaacaggggc

SEQ ID NO: 456053 - RNA, 62 nt, Human
agacacacugaauucuaaaguaccauuucuuuagagaccagaaaaacuaucuuaauacugua

SEQ ID NO: 456054 - RNA, 62 nt, Human
gauacugugaaacaucccauuuuuuccguauuagagaccagauauuuuucuaccuguucaug

SEQ ID NO: 456055 - RNA, 62 nt, Human
uauaaauguuggcaaccaauuugaacacuuucagagaccaugugcaggugagcuguguccuc

SEQ ID NO: 456056 - RNA, 62 nt, Human
ccacccagcccgcuccugacccuuaucuucccagagaccaggccaggaaggcccgagaugga

SEQ ID NO: 456057 - RNA, 62 nt, Human
gccgaggcagguggaucacaaggucaggagauagagaccaucauugcuaacauggugaaacc

SEQ ID NO: 456058 - RNA, 62 nt, Human
cgugucuaggaggcuggcacgacugcuucagcagagaccaaauaaagagaggauuaggcagc

SEQ ID NO: 456059 - RNA, 62 nt, Human
ucuguggaauuggugucccuguuagcaauggcagagaccagccuggagccuagaucuggugc

SEQ ID NO: 456060 - RNA, 58 nt, Human
ccgguguuccaacuguuuaaaauugaucagagaccacgaaaagaaauuugugcuucac

SEQ ID NO: 456061 - RNA, 62 nt, Human
agucaugucaaauugcaaucaggcucaaaaccagagaccaggcugugaaauccacacaucuu

SEQ ID NO: 456062 - RNA, 62 nt, Human
cugcuucucguuuggcacgcauguuagauggcagagaccaagaauucaagaugguugguggc

SEQ ID NO: 456063 - RNA, 62 nt, Human
aaaggcuuguuuuuucuugagcaguugaaaggagagaccaauauuugugacauggauaguuu

SEQ ID NO: 456064 - RNA, 62 nt, Human
ugaugagguucucucucagagagucuuggaaaagagaccacuugcucuuguuuaaaauaaau

SEQ ID NO: 456065 - RNA, 62 nt, Human
gaggggcucaguucugccuuaucuaaaucaccagagaccaaacaaggacuaauccaauaccu

SEQ ID NO: 456066 - RNA, 56 nt, Human
cacugcggccuggcugcugagggacgagagaccaggaugauuucgagguuggccuu

SEQ ID NO: 456067 - RNA, 62 nt, Human
uugcuugaaaauuagcaugccucugucuuaaaagagaccaucaaaccuauuaaguauucuua

SEQ ID NO: 456068 - RNA, 62 nt, Human
acuuuuccagcuugauaauuuucacaauagaaagagaccaaauauuuuguacuauauuuugu

SEQ ID NO: 456069 - RNA, 62 nt, Human
aggcgugaagggccuggagccacucugcuagaagagaccaauaaagggcagguguggaaacg

SEQ ID NO: 456070 - RNA, 62 nt, Human
gucccaauucuuggcuuaagccuguuuuagucagagaccacccaacuuagcgugcaggucac

SEQ ID NO: 456071 - RNA, 62 nt, Human
aaaauaaagugauucuacucuucuaagcuuacagagaccagaccaggugaauguaacugggg

SEQ ID NO: 456072 - RNA, 62 nt, Human
agccacacuguggcgggucggcggcccucaggagagaccaggaggacugacagcgaagaucg

SEQ ID NO: 456073 - RNA, 62 nt, Human
ggcugugcauguggcagcgcaccaugcuucacagagaccauucuguagcaagagaccggaac

SEQ ID NO: 456074 - RNA, 62 nt, Human
agggaacuuaugccccuucuguaggaaacagcagagaccagguggaaaccuuuuccugugga

SEQ ID NO: 456075 - RNA, 62 nt, Human
agcccagacuggaagugagaggcaugauggggagagaccagacugaaucuacgggugagccc

SEQ ID NO: 456076 - RNA, 62 nt, Human
cucuugccuguuucccaggcccacugugccucagagaccagggcuccagccccucuuggaga

SEQ ID NO: 456077 - RNA, 62 nt, Human
caaccaggaaacugcuacuuguggaccucaccagagaccaggaggguuugguuagcucacag

SEQ ID NO: 456078 - RNA, 62 nt, Human
gugcuuugcacauuuaccuuacagugguaagcagagaccaucugugaccauagccuagcuag

SEQ ID NO: 456079 - RNA, 62 nt, Human
gacccagcauuagcucagcaucugucagagcaagagaccagguaauuucuaagaacaggguu

SEQ ID NO: 456080 - RNA, 62 nt, Human
uugauucuugcaccucagcagcugaaggucucagagaccaguaaucagaaggcauccgacug

SEQ ID NO: 456081 - RNA, 62 nt, Human
gccgugggccugggguaccaagagacuccuugagagaccaggcaaagcaagugauugggaca

SEQ ID NO: 456082 - RNA, 55 nt, Human
ucagccggccucagaaauaagccugagagaccaucuuuagcagccucagcacugc

SEQ ID NO: 456083 - RNA, 62 nt, Human
cuuccacccaggggacucccagaagccaguagagagaccaggagccaccucaaucagcagga

SEQ ID NO: 456084 - RNA, 60 nt, Human
uccagguuuugcuucauuaauucaccauccagagaccaaauaauuaaaagaaaaacaaau

SEQ ID NO: 456085 - RNA, 61 nt, Human
agcacuguucugggacuccaggucuugaggagagagacagagagagagaauggauccucau

SEQ ID NO: 456086 - RNA, 61 nt, Human
ucacucugggagccuuggcccugcucacagagagagacaauagaaaauugaggaagguggc

SEQ ID NO: 456087 - RNA, 51 nt, Human
ugaucaagccuauugacugaagagagacacucgccaauuuaaaugacacag

SEQ ID NO: 456088 - RNA, 62 nt, Human
aauucacacaugaaagauuaaucugaaagaucagagaccauguuauuccugaccacgauaga

SEQ ID NO: 456089 - RNA, 62 nt, Human
aucuuuuguggaugaguuuugugagagaacagagagaccauuguaccuggcacaagggcugu

SEQ ID NO: 456090 - RNA, 62 nt, Human
cacgccacugcacuccagucugggugacagagagagaccauauccaaaaaaaaaaaaaguug

SEQ ID NO: 456091 - RNA, 62 nt, Human
uggcaccaaggcuuuaugugcccaucacucucagagaccacguuucccugacugucauagag

SEQ ID NO: 456092 - RNA, 62 nt, Human
uuuccugcugggguccugguuccucaggagagagagaccacagggugagagugagccaggaa

SEQ ID NO: 456093 - RNA, 62 nt, Human
agggugucccaaaaagaaaggaggggauagagagagaccacuuuucauaaccuagccuuaga

SEQ ID NO: 456094 - RNA, 62 nt, Human
ggucagcuuaaguuaguuagaucacucccagaagagaccagcugggaccuucuuugcaguac

SEQ ID NO: 456095 - RNA, 62 nt, Human
caucuuggaaccaggaagcccagcuaaagccaagagaccagagagucccugccacuaguuuu

SEQ ID NO: 456096 - RNA, 62 nt, Human
guaggguguaauugagugaaggaauccuggguagagaccauucucaggugguugggccaggc

SEQ ID NO: 456097 - RNA, 62 nt, Human
ccugugggcccccaaauggaaaugggcagagcagagaccaucccugaaggccccgcccaggc

SEQ ID NO: 456098 - RNA, 62 nt, Human
caugugccaccuccagugggaaacaaaacuaaagagaccacucugugccaagucgacuaugc

SEQ ID NO: 456099 - RNA, 62 nt, Human
cauugaagagaucucauucaggccagagacacagagaccacauagcccagugauuaaacccc

SEQ ID NO: 456100 - RNA, 62 nt, Human
gcuagugacuugaaaagaaagagagaaggaaaagagaccauauuaaguccaugccaguugcu

SEQ ID NO: 456101 - RNA, 54 nt, Human
gggguugccuuuugcacugaagauagagaccaccuuuuugagugacuugagccc

SEQ ID NO: 456102 - RNA, 62 nt, Human
ccccucccaccuuccuucuuccccacaacagaagagaccagcgacucccgcaaagggacaag

SEQ ID NO: 456103 - RNA, 62 nt, Human
uggagcuggcacugaagaucuccagggacuucagagaccaauaaaagcccauagggaagaga

SEQ ID NO: 456104 - RNA, 62 nt, Human
aauauagagaccaaguuuaccacuucugaugaagagaccaauuaagauucauuccucauucu

SEQ ID NO: 456105 - RNA, 62 nt, Human
cugcuuaaaaaacugucugacuucgugaauauagagaccaaguuuaccacuucugaugaaga

SEQ ID NO: 456106 - RNA, 62 nt, Human
gucaucuguuaggaagccauucuaaagagaagagagaccaggugugguggcucacgcaugua

SEQ ID NO: 456107 - RNA, 61 nt, Human
ugauauuuacaaagcaauuggcccauuuacagagagacauauauaauuucuccacaaagcc

SEQ ID NO: 456108 - RNA, 62 nt, Human
gccagccccuacccucagaguaucuggaccucagagaccauguugugccaggggugguccca

SEQ ID NO: 456109 - RNA, 62 nt, Human
uggcugcccacccaguggggggcuauagccucagagaccacucauccucuggaaucaaccuc

SEQ ID NO: 456110 - RNA, 62 nt, Human
augaacauguugagugagcaugcuggagaaugagagaccacaugaagcagaaacaugcuuuc

SEQ ID NO: 456111 - RNA, 62 nt, Human
accaccgagcagcguucucuugaugccagugcagagaccagagucagaugcccgaggacagu

SEQ ID NO: 456112 - RNA, 62 nt, Human
ggagaaagcccaggccagccugcuggacaagcagagaccaugagaaggagaguucagggguc

SEQ ID NO: 456113 - RNA, 62 nt, Human
uuagggccaggggcuuaccuuucaaccucuagagagaccagcugccuuugagaccaggagcu

SEQ ID NO: 456114 - RNA, 62 nt, Human
gucaaccuguucugcauugucacgcugacgcuagagaccagcgcucugggugggcagccucg

SEQ ID NO: 456115 - RNA, 62 nt, Human
ucccaccauuaccagagggucaaaggagaacaagagaccagguguggacgggacagugagug

SEQ ID NO: 456116 - RNA, 62 nt, Human
aaucagccaaagaaaauggugaucuggacccaagagaccaguagucacccugcuuguuucug

SEQ ID NO: 456117 - RNA, 62 nt, Human
aggugaggaucagccuuuuccagcauccugugagagaccagagagagaguuuggauuucaug

SEQ ID NO: 456118 - RNA, 62 nt, Human
guccccugccccccuccuuuuguuuuguacacagagaccaagaggccucaguuuagcaccuu

SEQ ID NO: 456119 - RNA, 62 nt, Human
gaaaguagagacagcagugcccgcugcccagaagagaccagcaagccaaacuggagccccca

SEQ ID NO: 456120 - RNA, 62 nt, Human
gaggcugcgaugccucaggaacuccaguuuacagagaccaguguguuuacuuguaaauaaag

SEQ ID NO: 456121 - RNA, 62 nt, Human
gcuggccgcacacggacauuccaaagaccuccagagaccaccccacccccacauuccuuuga

SEQ ID NO: 456122 - RNA, 62 nt, Human
aaagggugggcagggggcccuuaagaagguucagagaccagccuucuccagaggcugucacu

SEQ ID NO: 456123 - RNA, 62 nt, Human
caggguggaccacucugugucugucuccaagcagagaccaguaaaggagccuccugguccuc

SEQ ID NO: 456124 - RNA, 62 nt, Human
caaaacaaacaagcaaaaaacacaaaaaccucagagaccaaaacaccaaacaaacaaaaaaa

SEQ ID NO: 456125 - RNA, 62 nt, Human
cugacaucauacaaacugggcccugagcugugagagaccagcacagcagcguccagguuaaa

SEQ ID NO: 456126 - RNA, 62 nt, Human
caucauugcaucuauuuuccauauagucaucaagagaccauuuuauaaaacaugguaagacc

SEQ ID NO: 456127 - RNA, 59 nt, Human
cagucuggccgaccaacugauggcaguaaagagaccaccagcagugacaccugccaaug

SEQ ID NO: 456128 - RNA, 62 nt, Human
aggccagguagucccggcaccucucacucugcagagaccagcggcuucgugggaggccugug

SEQ ID NO: 456129 - RNA, 62 nt, Human
guaacgaccuuuguaagugaagaugcucuuccagagaccaccuucccagcucuugccaguuu

SEQ ID NO: 456130 - RNA, 62 nt, Human
gguacuaccacaaucacccccugcaaaaaaaaagagaccaagaaacuuucaaugaccauuca

SEQ ID NO: 456131 - RNA, 62 nt, Human
aggagaacuagggcaaguggcugugagacccuagagaccagcgaagggagaaguugggaagc

SEQ ID NO: 456132 - RNA, 62 nt, Human
ucuccuugcaucccagccucgucuaugcagcaagagaccagggacuucaccaaagucacccu

SEQ ID NO: 456133 - RNA, 62 nt, Human
cugagggucccaccccugccccacuuuaccauagagaccagugccuugguggcaggucccuc

SEQ ID NO: 456134 - RNA, 62 nt, Human
ccuugcuuggauuuaaaacuuuuuuggaagugagagaccaggagcacuacagagaauuucca

SEQ ID NO: 456135 - RNA, 62 nt, Human
uggugagagaugcaggacauacacauuauucaagagaccaccugacaugcaucuccuccgca

SEQ ID NO: 456136 - RNA, 62 nt, Human
caacucaggaagcauuugacucguuguacuucagagaccauaaaugacaagguuuugacauu

SEQ ID NO: 456137 - RNA, 62 nt, Human
ggcuucagcacgccguccagauccccaggauaagagaccacuuagccuucccuuuggucugu

SEQ ID NO: 456138 - RNA, 62 nt, Human
aacuggcuuuauagaguuaacaaaacagagucagagaccacugucuuaacaguggaagaugc

SEQ ID NO: 456139 - RNA, 62 nt, Human
aaaaucgaauaaaagacacauuuauauccaauagagaccacaccuguauucauaugggaaca

SEQ ID NO: 456140 - RNA, 50 nt, Human
ucauucagagcacagccugaagagaccagugagcucacugugacccaucc

SEQ ID NO: 456141 - RNA, 62 nt, Human
gguccaaguugccacauugcuucauuaaaacaagagaccacuuccuuaacagcuguauuauc

SEQ ID NO: 456142 - RNA, 62 nt, Human
gguuugcuguggauucagaagcaccaggagcaagagaccagaaggaugaucugcuccuuugu

SEQ ID NO: 456143 - RNA, 62 nt, Human
cccuaaugacaucaccaacagucaaagcaauuagagaccauaccuaauauuguuuaaauucu

SEQ ID NO: 456144 - RNA, 62 nt, Human
gcuguuuugugugcucucuugcuaaagaccgcagagaccauaccuguugucaaagagggugu

SEQ ID NO: 456145 - RNA, 62 nt, Human
cccagcacuuugggaggccgaggucaggaguuagagaccauucugaccaauaugaucaaacc

SEQ ID NO: 456146 - RNA, 62 nt, Human; identical to SEQ ID NO: 456145

SEQ ID NO: 456147 - RNA, 62 nt, Human
agacguggaccuggaugauguacucugggucaagagaccagggaugcaggguuaggcagaca

SEQ ID NO: 456148 - RNA, 62 nt, Human
cagacggccgugagcucugggcaaaccuaaacagagaccagugucucaugcucuuucuuccu

SEQ ID NO: 456149 - RNA, 62 nt, Human
ccgcgauacagacccacagagugccaucccugagagaccagaccgcuccccaauacucuccu

SEQ ID NO: 456150 - RNA, 62 nt, Human
ugucuuguuacaaagucuggcuacuuugcugaagagaccacaugaagaggcccugaaacuac

SEQ ID NO: 456151 - RNA, 62 nt, Human
cagagugcgggcuguguugccacaaacacugcagagaccaggugaagguagaauguaagaag

SEQ ID NO: 456152 - RNA, 62 nt, Human
aagcgaaacccaggggugaauuggauucuugaagagaccaaagccuguaacuguccagcuuc

SEQ ID NO: 456153 - RNA, 62 nt, Human
aagagaggaacagaaauccagaguggggagacagagaccaagagcaggggauagaagccggg

SEQ ID NO: 456154 - RNA, 62 nt, Human
aggccaaggcaagcagaucaccugaagucaggagagaccagccuggccagcauagugaaacc

SEQ ID NO: 456155 - RNA, 62 nt, Human
aaagaagaaaguaacagaaaaugaugaaauaaagagaccaucuuacaauaaucucaguuuuu

SEQ ID NO: 456156 - RNA, 62 nt, Human
gaagacucucgcuuuuaaacaucugguuugggagagaccaucgacuuggccagugagacuga

SEQ ID NO: 456157 - RNA, 62 nt, Human
uuuauuauaaaaggaaguauuuaaaggaugauagagaccaucagauagaagcagggaaggua

SEQ ID NO: 456158 - RNA, 62 nt, Human
augucaucacaaacauuugcucuuaaguuacaagagaccacauccacccagggauuaggguu

SEQ ID NO: 456159 - RNA, 62 nt, Human
gaggagguuggagagagaaagggugaaagcagagagaccagugcagggcuguuaacaggguu

SEQ ID NO: 456160 - RNA, 62 nt, Human
ugaauguguccauaugugucuguaagagagacagagaccaagaacuugcccaauuuuagaaa

SEQ ID NO: 456161 - RNA, 62 nt, Human
ggggcugauucggagagggcgccccgccgcgcagagaccagagcuccucagugccaguuugg

SEQ ID NO: 456162 - RNA, 62 nt, Human
ucucuggagacccagauccccuagagcaggucagagaccauccagaaucccagaauucuagg

SEQ ID NO: 456163 - RNA, 62 nt, Human
uccuugcaggccgguuagucuccaguuuccacagagaccaccuacccaccaccuucccaggu

SEQ ID NO: 456164 - RNA, 62 nt, Human
cuaagcaccuacugugugcugggacgcuguacagagaccagcucagucgucagagaaaccau

SEQ ID NO: 456165 - RNA, 57 nt, Human
agauccugggcaugcgcuagccagguagagagacacagagcuguguacaggauguaa

SEQ ID NO: 456166 - RNA, 61 nt, Human
gggaaccauauguuuugagaauuuguaaagugagagacaugauccuauuaaaauaagaagg

SEQ ID NO: 456167 - RNA, 61 nt, Human
gccacuugccaaagaagaggaaccacagaaagagagacaucaugaccaggagaaaaaugug

SEQ ID NO: 456168 - RNA, 62 nt, Human
uaucccccagugauuacuuucgauuacacugaagagaccaccuugucuuuaaagaucacuuu

SEQ ID NO: 456169 - RNA, 62 nt, Human
ucaccuccgugccugcuuugcuccagcacagcagagaccagcaggccccccaacccagagac

SEQ ID NO: 456170 - RNA, 62 nt, Human
gucuucaacuuuugaccggugcaggugugaccagagaccaccucuguggccaccucagauag

SEQ ID NO: 456171 - RNA, 62 nt, Human
cgccugaaaauuagcauauugauaguucuuagagagaccagauauaaucuaagaauuuauau

SEQ ID NO: 456172 - RNA, 62 nt, Human
ucggagcugcuagaguucugucuggacuuuccagagaccaguauucccuuuugcugccucua

SEQ ID NO: 456173 - RNA, 62 nt, Human
gaacguaagcccuguuuccagagcaaaguaacagagaccagguuuuucuagagagcuaagug

SEQ ID NO: 456174 - RNA, 62 nt, Human
ggaaauagcauaucuaauaucuagguuacuugagagaccagcuaaucaucucuguugcacau

SEQ ID NO: 456175 - RNA, 62 nt, Human
ugaaugugaagacacaagcucuuucuggauacagagaccaauuuaguuuggagauuacaggu

SEQ ID NO: 456176 - RNA, 62 nt, Human
uacgguacuugguaagagggagccgguuugggagagaccauugcaucgcuguccaaguguuu

SEQ ID NO: 456177 - RNA, 62 nt, Human
ucacgaaguucaugaagugccgcuggagagccagagaccagcugcgcaggagccggaggaac

SEQ ID NO: 456178 - RNA, 62 nt, Human
cagcugcccgcaggggguucccccugcugaggagagaccagguggaccccagcugccuguca

SEQ ID NO: 456179 - RNA, 62 nt, Human
gggcaucuaugguagacauggcacagccaugaagagaccagugggguggugcaggguggacu

SEQ ID NO: 456180 - RNA, 62 nt, Human
acucaaccacaaucuccucgagacauucauccagagaccauguggcacuugauugaaacccc

SEQ ID NO: 456181 - RNA, 62 nt, Human
cgcacgucacuggcgggcucgcguguguacauagagaccacagcccgccuucugccaaaaga

SEQ ID NO: 456182 - RNA, 62 nt, Human; identical to SEQ ID NO: 456178

SEQ ID NO: 456183 - RNA, 62 nt, Human
uguggaauugaaagagaagcugcugcgugagcagagaccaagaaggcggagguuaguugagg

SEQ ID NO: 456184 - RNA, 62 nt, Human
ccaugcccggcuaauuuuuuuguauuuuuaguagagaccaggcuucgccauguuggccaggc

SEQ ID NO: 456185 - RNA, 62 nt, Human
ugaccaccugggugccaguuacagguguuuccagagaccauagaaauguguuuuccugagag

SEQ ID NO: 456186 - RNA, 62 nt, Human
agaagauugagaaagugccugaugcccgcgucagagaccagaggagccaacugagaugaugg

SEQ ID NO: 456187 - RNA, 62 nt, Human
ugggccacugcagucgagccugggcgacacaaagagaccacccugucugauagauaacuaac

SEQ ID NO: 456188 - RNA, 62 nt, Human
aucugggcccuaggagcccuguaacucccaggagagaccacugaaaauacuggagcaacaau

SEQ ID NO: 456189 - RNA, 62 nt, Human
aggaaauuucacaugcaaagccacagucaugaagagaccauggugugucuggguaacuguga

SEQ ID NO: 456190 - RNA, 52 nt, Human
aggaacauggugacgaguagcaagagaccaaagguaauugacaauaggauau

SEQ ID NO: 456191 - RNA, 62 nt, Human
ccuaugggcucaugguuugacaaacagaguggagagaccauauuuuagccccacucacccuc

SEQ ID NO: 456192 - RNA, 62 nt, Human
cgaggcagguggauugcuugaggccaggaguuagagaccagccuggccaacaaggcaaaacc

SEQ ID NO: 456193 - RNA, 62 nt, Human
guggucucccuguccaagcgggaccgcuuugcagagaccagaggcauaucgcggcuugagcu

SEQ ID NO: 456194 - RNA, 62 nt, Human
auacuuacccggucagcuugguuuugaaccucagagaccauccacugucuuugacaccuaga

SEQ ID NO: 456195 - RNA, 61 nt, Human
gagcaacugauggcugccacuuccaggccccgagagacaggccucacguaacuuuacugca

SEQ ID NO: 456196 - RNA, 61 nt, Human
ggccccugccguggggcucacucugcagcuggagagacagcauaccugaaaccugcaagga

SEQ ID NO: 456197 - RNA, 61 nt, Human
aacaacagaacagccaggaaaauggugcuaggagagacaguggagaggccagagaagcaaa

SEQ ID NO: 456198 - RNA, 61 nt, Human
gaaacacuuucagaaaaacaaaugugaaggggagagacaggggccgcccuuggcuccuguc

SEQ ID NO: 456199 - RNA, 61 nt, Human
cuaugagggcggcggcgggacagggugagcggagagacagaacuguccccgccccaccccg

SEQ ID NO: 456200 - RNA, 61 nt, Human
gcaguuauuuggguaaggaaaaaaggggugggagagacagaaaauuugcccaucugcugcu

SEQ ID NO: 456201 - RNA, 61 nt, Human
ccugccugcccagccugggcccugcaguguggagagacacauaagccuuacuguccucugg

SEQ ID NO: 456202 - RNA, 61 nt, Human
acaaacucucuauggccuugagaagcaguuggagagacaugacuuguuaaaaccucaagga

SEQ ID NO: 456203 - RNA, 61 nt, Human
ggagagccugauccugaagccucuacuugaugagagacagaguuuuggguggugauaguga

SEQ ID NO: 456204 - RNA, 61 nt, Human
agaauuagcaacaggaaaagcagagccccaggagagacacucuacuauauauacucuucua

SEQ ID NO: 456205 - RNA, 61 nt, Human
cucacccucucuuaaagcggcaccaacgugagagagacaggcagacagacagaaagccaga

SEQ ID NO: 456206 - RNA, 61 nt, Human
uaaauguuuggggaaauuccuauggaaaaaagagagacauguagaagaaccucuaacaagg

SEQ ID NO: 456207 - RNA, 61 nt, Human
agccaugcaccacagacuucugggcagagcugagagacaaugguccugacauaauaaggau

SEQ ID NO: 456208 - RNA, 61 nt, Human
gaaacaagaaaggucucauucuuuaccuuuggagagacaauaucacguuuuuguuuucgaa

SEQ ID NO: 456209 - RNA, 61 nt, Human
ccugggccaaaagggccccuccuugccaggggagagacagccacgguccucuuuggccgau

SEQ ID NO: 456210 - RNA, 61 nt, Human
gguggcccaccaguccuaacgggacaggacagagagacagagcagcccugcacuguuuucc

SEQ ID NO: 456211 - RNA, 61 nt, Human
gugcucuguggcugacgcugucuacccgugggagagacacacucaggaguggccguuuggc

SEQ ID NO: 456212 - RNA, 61 nt, Human
cacucuguuccucuucugcagccaccagugggagagacaagccaguccuaagagaaaaggu

SEQ ID NO: 456213 - RNA, 61 nt, Human
cagauaggagcacaagcaggggacggaaagagagagacacucaggcggcagcauucccucc

SEQ ID NO: 456214 - RNA, 61 nt, Human
aaaagaaaugaagaaaaaaguacugugaccugagagacacccuccucuagaauuuaguggc

SEQ ID NO: 456215 - RNA, 61 nt, Human
aaggagggagggagcgcagggaaaagagcgagagagacagaaagagagccucagaauggac

SEQ ID NO: 456216 - RNA, 61 nt, Human
caaucagcccugggcagacacgagcaggagggagagacagagaaaagaaaaacacagcaug

SEQ ID NO: 456217 - RNA, 61 nt, Human
cuccugcauugcugcccuggcuauggucacagagagacacgggcucaaggaacccaagaga

SEQ ID NO: 456218 - RNA, 61 nt, Human
ucuuuauuaacauuuccuaaauaacugaauugagagacauacucugcuacuauguccucag

SEQ ID NO: 456219 - RNA, 61 nt, Human
ugguguaagcucaguugugguuuuuuagguggagagacacaccugcuccaauuuccccacc

SEQ ID NO: 456220 - RNA, 61 nt, Human
accaaaauaauaaaaggcagcuaauggaaaggagagacaaaagcaugguuaauauauauac

SEQ ID NO: 456221 - RNA, 61 nt, Human
agccucagagaccccaaucccaugccugggggagagacagcggcucaggagugggggagca

SEQ ID NO: 456222 - RNA, 61 nt, Human
ccuaggcuguugguguacagagaccagaggagagagacacacuaggacuaacaauguccua

SEQ ID NO: 456223 - RNA, 61 nt, Human
acgggcuuuugggaagagcugcccgcauacugagagacagcuucuuauaaacaaggagagu

SEQ ID NO: 456224 - RNA, 61 nt, Human
gaccccaggcaacagccagggccccacuccugagagacacuggcaacaccucuuaguugau

SEQ ID NO: 456225 - RNA, 61 nt, Human
uggguuacagccacagcaggaagaaccacuggagagacacucagaaggacuucccugacau

SEQ ID NO: 456226 - RNA, 61 nt, Human
agaaaugaauuuucuacuucuacacccauuugagagacaccaauaaaagaaagucauaugu

SEQ ID NO: 456227 - RNA, 61 nt, Human
acuaauaucaauuacauauuuugguaaacuagagagacauaauuagagaugcaugcuuugu

SEQ ID NO: 456228 - RNA, 61 nt, Human
ggagcgggcaaccaacagugaauguggagcugagagacaguaaaauaauaacugacaugcc

SEQ ID NO: 456229 - RNA, 61 nt, Human
ggcccugcccuuacaggaacagaagaggaaagagagacacagcugcagaggccaccuggau

SEQ ID NO: 456230 - RNA, 61 nt, Human
agauaccuugcaaagcaacuagugggugcuugagagacacugggacacugucagugcuaga

SEQ ID NO: 456231 - RNA, 61 nt, Human
gaggaaggcaacagagacaaggagagaagccgagagacaugucugcgugcugccacgcauu

SEQ ID NO: 456232 - RNA, 61 nt, Human
acuauauaaguaacuucuaguagcauugccugagagacaaauuauuguuugauaauuuuca

SEQ ID NO: 456233 - RNA, 61 nt, Human
aaugaaucaguaucaauuagggccugggguagagagacagaaacuugagagaagagaaguu

SEQ ID NO: 456234 - RNA, 61 nt, Human
cccggcgugggcgaauucagaagugcccagggagagacaagcuagaggcucugcggacuuc

SEQ ID NO: 456235 - RNA, 61 nt, Human
auucuauuuauguuguuuuaaaaugcauacugagagacaaacaucuugucauuuucacugu

SEQ ID NO: 456236 - RNA, 61 nt, Human
cuucccuuauggcauuaaucuuguugagggagagagacagaauccuggacucuccaaagua

SEQ ID NO: 456237 - RNA, 61 nt, Human
agacagcauucuugcacuucuuagcaacagagagagacaugaguaagacccagauugcuau

SEQ ID NO: 456238 - RNA, 61 nt, Human
augcaucugacaugugcgaugcauccccauggagagacagcauugcuccccagcccuccag

SEQ ID NO: 456239 - RNA, 61 nt, Human
auugccaacucuuccucuuucuucuucuugagagagacaagaugaaauuugaguuuguuuu

SEQ ID NO: 456240 - RNA, 61 nt, Human
ccucccugccucagcugcaucugauaaaguugagagacaguaacacaauuaaaugacuuag

SEQ ID NO: 456241 - RNA, 61 nt, Human
caggggcacccccuuccccagcccccaccuggagagacauggccccugccaagcugguccc

SEQ ID NO: 456242 - RNA, 61 nt, Human
acgaagaccccaggaagucauccugcaaugggagagacacgaacaaaccaaggaaaucuaa

SEQ ID NO: 456243 - RNA, 61 nt, Human
gguuuauggauuugacagggugcaugucacagagagacaguucucagucagcacuuccugu

SEQ ID NO: 456244 - RNA, 61 nt, Human
ccaagaaugugaaucuugccaagcuguccgugagagacacgggcuccccucgagggagacu

SEQ ID NO: 456245 - RNA, 61 nt, Human
aaaccaggaacaauugacucccggggugggcgagagacaggagggcucccugaucugccgg

SEQ ID NO: 456246 - RNA, 61 nt, Human
aguacaccaguuccaaguaacuuugccaagggagagacaugaagacagaggagaaaugaau

SEQ ID NO: 456247 - RNA, 61 nt, Human
ucucaaacugagagaacugcuucugucucuggagagacagaagugcagcuucaguaauucu

SEQ ID NO: 456248 - RNA, 61 nt, Human
gguuaauuaaaggagaagauuccugaaauuugagagacaaaauaaauggaagacaugagaa

SEQ ID NO: 456249 - RNA, 61 nt, Human
aguuaauuaaaggagaagauuccuaaaauuugagagacaaaauaaauggaagacaugagaa

SEQ ID NO: 456250 - RNA, 61 nt, Human
gagagugagcuuuccuucccagaagucucccgagagacauauuuguguggccuagaagucc

SEQ ID NO: 456251 - RNA, 61 nt, Human
uaaucacuugggguuuguacauuuuuggggggagagacacagauuuuuacacuaauauaug

SEQ ID NO: 456252 - RNA, 61 nt, Human
uugcugcaggccggguggccaauccaggugggagagacacucccagggacaagggaaggaa

SEQ ID NO: 456253 - RNA, 61 nt, Human
accugccacuuccaggagcccagagggccaagagagacauugccuccaccucuccuuggaa

SEQ ID NO: 456254 - RNA, 61 nt, Human
aaagauuauuguuaaaaaauucagaagaaaagagagacaagugcucuucucucuaucuaug

SEQ ID NO: 456255 - RNA, 61 nt, Human
acaaauaacuuugugcaguguucaucaaagagagagacagugaaccuaaaacugaaccugg

SEQ ID NO: 456256 - RNA, 61 nt, Human
gugaggagagugugugauagcuagaaagagagagagacagagagauggcaagcacugagau

SEQ ID NO: 456257 - RNA, 61 nt, Human
ucauucagcaugacugguucugggagaaggugagagacaaaaauggaaagauccuggccug

SEQ ID NO: 456258 - RNA, 61 nt, Human
uucccuguggucucugacccauuaggcuaaagagagacaagagaagcccccaaccugauuc

SEQ ID NO: 456259 - RNA, 61 nt, Human
accacaguuaggauuggguuguuucaauacugagagacagcuacaauaaaaggagagcaau

SEQ ID NO: 456260 - RNA, 61 nt, Human
gauccugauagacauggggcuccugggaguagagagacacacuaacagccacacccucugg

SEQ ID NO: 456261 - RNA, 61 nt, Human
ugcguuccuguuagcauaaugugaggagguggagagacagcccacccccguguccaccgug

SEQ ID NO: 456262 - RNA, 61 nt, Human
ugcgucccuguuagcauaaugugaggagguggagagacagcccacccuuguguccacugug

SEQ ID NO: 456263 - RNA, 61 nt, Human
gcucaggccuccaccugagagguuauaaccugagagacagcucuacccuuccucccaguaa

SEQ ID NO: 456264 - RNA, 61 nt, Human
uaagcagucauuguguuugccaguaauguuugagagacauguaaguugaaaguuuugcuaa

SEQ ID NO: 456265 - RNA, 61 nt, Human
cuucuuaagauauauagaggauuuuggagaagagagacaggagggguaaaaccagcuuaag

SEQ ID NO: 456266 - RNA, 61 nt, Human
cuguuuugugaagcaucccaggcuugcccaggagagacauuugccacuaugucaccuuauc

SEQ ID NO: 456267 - RNA, 61 nt, Human
aauugcugcaccaaugcacugagugaaggaagagagacagaggaucaagggcuuuagacag

SEQ ID NO: 456268 - RNA, 61 nt, Human
ccccccaacaucuggaccagcugcccuggcggagagacagcaaggggccggcaggugcucg

SEQ ID NO: 456269 - RNA, 61 nt, Human
aacaagcccuguacuuaccaaggagaaagaggagagacagcagugcugggagauucucaaa

SEQ ID NO: 456270 - RNA, 61 nt, Human
agcaguggacacgugaggggggggugggugagagagacaggcagcucggauucaacuaccu

SEQ ID NO: 456271 - RNA, 61 nt, Human
uaguacaauuucaacuacagugauucauguagagagacaggggaguugucaacuugggcua

SEQ ID NO: 456272 - RNA, 61 nt, Human
guacuucaugcugucuacacuaagagagaaugagagacacacugaagaagcaccaaucaug

SEQ ID NO: 456273 - RNA, 61 nt, Human
ugagaaagguggugggagaaagucagcagaugagagacacaaagagaagugguaauaggaa

SEQ ID NO: 456274 - RNA, 61 nt, Human
cuuucagauacuauuuauuuacuuuuuaagagagagacaggcucacucugucacccaggcc

SEQ ID NO: 456275 - RNA, 61 nt, Human
ccaauuaauuaaauaucacaauagcaucccagagagacaguaggaaauuucuccuuaguga

SEQ ID NO: 456276 - RNA, 61 nt, Human
caaaugcuuuagaaaucucugauaauggagagagagacagaggacccuccucacuacccua

SEQ ID NO: 456277 - RNA, 61 nt, Human
uuuagggauugugaguaaacaaguuuauauagagagacauugugaaguuaaaguuuucaga

SEQ ID NO: 456278 - RNA, 61 nt, Human
uuugcugcggccccgugggguaggagggacagagagacagggagagucagccuccacauuc

SEQ ID NO: 456279 - RNA, 61 nt, Human
gaagaaccaaaauaacgugaagaacaucacagagagacagugcaguguagcuuuaguuuaa

SEQ ID NO: 456280 - RNA, 61 nt, Human
uucagagacuucguaauuaaaggaacagagugagagacaucaucaaguggagagaaaucau

SEQ ID NO: 456281 - RNA, 61 nt, Human
cacuuagguuuuccuguugagaugggggacugagagacaggacuagcuggauuuccuaggc

SEQ ID NO: 456282 - RNA, 61 nt, Human
ugagcccguggggugaggaguuggcaauuuggagagacaggauuuggggguucugccauaa

SEQ ID NO: 456283 - RNA, 61 nt, Human
agagaagaccacuaaugagaagaccacuaaagagagacaucaagaauggauucagcagaau

SEQ ID NO: 456284 - RNA, 61 nt, Human
gguggcagccggaaggagggagcccuggcaggagagacacuccaucagguccccuuugccu

SEQ ID NO: 456285 - RNA, 61 nt, Human
ucacuuauuguacauguuggaaccaggacaugagagacauagaaaaacagaagucaugaau

SEQ ID NO: 456286 - RNA, 61 nt, Human
aggaaggugcucccuucacacacccaggcuggagagacacugcgcucagggacggcuugau

SEQ ID NO: 456287 - RNA, 61 nt, Human
auguuucuguauguaaaauaaccccuuauuagagagacaguguuauauguauuuacaaaau

SEQ ID NO: 456288 - RNA, 61 nt, Human
ccuuggcaguuauuuuuccaucaccgagagagagagacagagagagaaaauaaacuacccc

SEQ ID NO: 456289 - RNA, 61 nt, Human
uguggcaggaggacgcaucccaaucgggagggagagacagagacagagccgauggggccag

SEQ ID NO: 456290 - RNA, 61 nt, Human
gccaggacaaccuuucucccagauguaaacagagagacauguacaaaccuggauuuuuuuu

SEQ ID NO: 456291 - RNA, 61 nt, Human
ccagcucccugugcccccaggguccugggaggagagacacugguggggauaggccagccgc

SEQ ID NO: 456292 - RNA, 61 nt, Human
uuucuuguuuuucagugaacgagauaauugggagagacaugucccagauuucuguuuccca

SEQ ID NO: 456293 - RNA, 61 nt, Human
cuccucugugcuccauccacacaggaugccggagagacagccccuugugcugugagcagag

SEQ ID NO: 456294 - RNA, 61 nt, Human
ccacgccagggggaggaaagggaaggacugggagagacacaaagaccagagccagccucag

SEQ ID NO: 456295 - RNA, 61 nt, Human
ggaccacagccaugagcggccucuaagagcugagagacagccggcagggaaucggaacccu

SEQ ID NO: 456296 - RNA, 61 nt, Human
gggggcuggagggagccggggcagccacagggagagacaugggcgaaugagugagaaauuu

SEQ ID NO: 456297 - RNA, 61 nt, Human
aucaugccacugcacuccagccugguccacagagagacacugucacccccuuucccccaca

SEQ ID NO: 456298 - RNA, 61 nt, Human
ugcucuggcagguucuggagagaacauucaugagagacacaguaggucucuggggcuguug

SEQ ID NO: 456299 - RNA, 61 nt, Human
gaggccgcugguagacuuuuguuaaaagagagagagacagagacagagaaauaagcauuag

SEQ ID NO: 456300 - RNA, 61 nt, Human
ucgugggagccgcuucuccaagucugcugaugagagacagcgcaugcuggugcagcguaag

SEQ ID NO: 456301 - RNA, 61 nt, Human
cuuggaauuacugaaagucuguggcccaagagagagacacaaguggccuuaagucuuuuug

SEQ ID NO: 456302 - RNA, 61 nt, Human
uaacacaaaacaucuuauuaaaauuguacuugagagacaaaaaaaaaacucuguuguauuu

SEQ ID NO: 456303 - RNA, 61 nt, Human
uugacaccgcaguucuguucagccaucagaagagagacaaggaauuaaaaauuucuuuuua

SEQ ID NO: 456304 - RNA, 61 nt, Human
aauccuaaggaaauugaauacucugagagaagagagacagacccucucauacuguuuuaua

SEQ ID NO: 456305 - RNA, 61 nt, Human
guccuuggcuggggacccuccaggcacuggugagagacaugaacacugacuggccacuagc

SEQ ID NO: 456306 - RNA, 61 nt, Human
agagggagagaggcagagagggagagaggcagagagacagagagggagagagggacagaga

SEQ ID NO: 456307 - RNA, 61 nt, Human
agacagagagggagagagagacagagggagagagagacagaggggaagagaggcagagagg

SEQ ID NO: 456308 - RNA, 61 nt, Human
gggagagaaacagaggagacagagagggagagagagacagagggagagagagacagagggg

SEQ ID NO: 456309 - RNA, 61 nt, Human
gguggggagaggggagagagauaugaggagagagagacagaggaggcagagagggagagaa

SEQ ID NO: 456310 - RNA, 61 nt, Human
ucuucugucuuuuuuuuuuuuuuuuuuuuuugagagacagggucuaccucugucacccgag

SEQ ID NO: 456311 - RNA, 61 nt, Human
aauagaagauuccguggccuugggggcaggagagagacacucuccaugaacacuucuccag

SEQ ID NO: 456312 - RNA, 61 nt, Human
auccuggcuccagagcccauucuuuuaaucagagagacagagaauaaugcuggacuaccug

SEQ ID NO: 456313 - RNA, 61 nt, Human
ugaaaaagcaugaauaauuaaauauacaugugagagacaucucaucugcuguauuuuacuu

SEQ ID NO: 456314 - RNA, 61 nt, Human
gacugcugacugauugggaaagaaaauccuggagagacacuucacugcuccaaggcuuuug

SEQ ID NO: 456315 - RNA, 61 nt, Human
uccaggcaugcggagcugugagugccugcaggagagacacccaggaggaguuuuuacauuu

SEQ ID NO: 456316 - RNA, 61 nt, Human
uguuccagugacaguuggaaggccucugcuggagagacaccagcucucagggcagagauug

SEQ ID NO: 456317 - RNA, 61 nt, Human
auguccucaggccagauacugauugcuaguagagagacacccggcacccaguccgaagccc

SEQ ID NO: 456318 - RNA, 61 nt, Human
uuuauugagugccuaccggugcaggcgcugggagagacaauagcuuugaggagcucacaau

SEQ ID NO: 456319 - RNA, 61 nt, Human
uuccaucauccuuuuuuagccuguugcuucagagagacacaaagugaacacacugguguga

SEQ ID NO: 456320 - RNA, 61 nt, Human
ccaaugacacacagagagccgcuguugacuagagagacagucuguccuggacccgucugug

SEQ ID NO: 456321 - RNA, 61 nt, Human
uggaaucucuuuggucaaaugcacauuuacagagagacacuauaaacaaguacacaaauuu

SEQ ID NO: 456322 - RNA, 61 nt, Human
gagaauuauaaguaaagcuuucuguauuucagagagacauaaguuacuagaaagugaaaag

SEQ ID NO: 456323 - RNA, 61 nt, Human
aaccagagccgugcacuugugccugguaggagagagacaggacagacccgcuuuucccgag

SEQ ID NO: 456324 - RNA, 61 nt, Human
agaccgacgcagccugaaagagacccagacagagagacaggcagacacagccuaaaacaga

SEQ ID NO: 456325 - RNA, 61 nt, Human
ccccccuucuccaggagccagggggugacuggagagacagacccacccccaagcagggcuc

SEQ ID NO: 456326 - RNA, 61 nt, Human
aaaaacacggaugcugguauuuuaacagauggagagacaaggaaaggaaaggaaaggccug

SEQ ID NO: 456327 - RNA, 61 nt, Human
ugccauuucccugaacagauacauacauagagagagacaguuuuccaaacugugucacgca

SEQ ID NO: 456328 - RNA, 61 nt, Human
acauacccagggcucagcuuuugauugaagagagagacacgauggagaccauugguaagcu

SEQ ID NO: 456329 - RNA, 61 nt, Human
cucagcugcuggaugacuugagaugaaaaaggagagacauggaaagggagacagccaggug

SEQ ID NO: 456330 - RNA, 61 nt, Human
uugugagugcaacugcaaguaacucuggcuagagagacacaugugucuugugucaaggcag

SEQ ID NO: 456331 - RNA, 61 nt, Human
uaauggaaaacuguuaagggaagcugauacagagagacaacuugcuccuuuccaucagcuu

SEQ ID NO: 456332 - RNA, 61 nt, Human
uaagguuaacaugucacuagaguauuuuuaugagagacaaacauuauaaaaaucugauggc

SEQ ID NO: 456333 - RNA, 61 nt, Human
uuagauccucaguagaacaguccagaagccugagagacaguggccccuugauaaucugggu

SEQ ID NO: 456334 - RNA, 61 nt, Human
cagccaggucggcuccugggcuguggccguggagagacacugcccccaggaugacacaggc

SEQ ID NO: 456335 - RNA, 61 nt, Human
acccuggggaugcugugaauuucuccugcaggagagacaucauugaauuuuuucaacugua

SEQ ID NO: 456336 - RNA, 61 nt, Human
ucaaucacggaagaggcagucaaggaggaaggagagacauuaggagccgauaaaugcaucu

SEQ ID NO: 456337 - RNA, 61 nt, Human
acacagacacgggaccgaggggcggacaccggagagacacgggaaaggggucgggacagga

SEQ ID NO: 456338 - RNA, 61 nt, Human
aguacaggaugaauuuaaauguguuuuuccugagagacaaggaagacuuggguauuuccca

SEQ ID NO: 456339 - RNA, 61 nt, Human
uggugaacuugguuuuaauuagugaacugcugagagacagagcuauucuccauguacuggc

SEQ ID NO: 456340 - RNA, 61 nt, Human
cacaaguucuggcgacagguagcacguaucugagagacaccugcaagcacacacuguccca

SEQ ID NO: 456341 - RNA, 61 nt, Human
augacaccacugcacuccaaccuagguaacagagagacaccucugucucugaaaaaacaaa

SEQ ID NO: 456342 - RNA, 61 nt, Human
aaccacguugggacagggaggugugaggcaggagagacaguuggauucuuuagagaagaug

SEQ ID NO: 456343 - RNA, 61 nt, Human
uucccaagcaaaucgugcauuuuugucuaacgagagacaucaguuucucaggaugauccuc

SEQ ID NO: 456344 - RNA, 64 nt, Human; identical to SEQ ID NO: 135857

SEQ ID NO: 456345 - RNA, 64 nt, Human; identical to SEQ ID NO: 135858

SEQ ID NO: 456346 - RNA, 63 nt, Human
uaaaaguucuguugcuuguauuaacacgaaacuagagagaaauaguuucugaagccaguuuau

SEQ ID NO: 456347 - RNA, 63 nt, Human
ugcauugugaagaggaggaaaagugaaucacggagagagaaaggaaaggauagaaucacaggc

SEQ ID NO: 456348 - RNA, 63 nt, Human
guucuggugugugcucccgccuccuggguauacagagagaaggcaggaaucaggaguuccaga

SEQ ID NO: 456349 - RNA, 63 nt, Human
agggucucccaaggggugaguggacguguuggaagagagaagcaccaugguccagccaccagg

SEQ ID NO: 456350 - RNA, 63 nt, Human
cagagagauuagucacauaguugccuaaauaggagagagaaagauuauauaugcacauauaca

SEQ ID NO: 456351 - RNA, 63 nt, Human
ccccaguggacucuuuguacccuuccuacucucagagagaagugggcaggagggguccucaag

SEQ ID NO: 456352 - RNA, 63 nt, Human
aacaaaaaacucuuaggucuaaaaugagaaaaaagagagaaaacaaaauguuauuuuuauacc

SEQ ID NO: 456353 - RNA, 63 nt, Human
acacacgcgcgcacacacacacauacacgaaagagagagaaacaaacuuuucaaggcuuauau

SEQ ID NO: 456354 - RNA, 63 nt, Human
ggaauaacugauauaucuuuauuacaaacugaaagagagaagauuaucaaacaaaugaaacaa

SEQ ID NO: 456355 - RNA, 63 nt, Human
uacgauccaaaacauuguacccagcuuuuuaaaagagagaaauuaucacuacaacucccgagc

SEQ ID NO: 456356 - RNA, 63 nt, Human
agcccacagugguggccucugccucuuuccuggagagagaaggacagugcacggagagguuuc

SEQ ID NO: 456357 - RNA, 63 nt, Human
uguccaggggauuuaaaagaguuuucugcuuugagagagaaauagagaguuuagaaagcaauu

SEQ ID NO: 456358 - RNA, 63 nt, Human
accuggaggaaaaaaaaggugcaguuuuuaauaagagagaaaaugaaauuaucuuugauaaau

SEQ ID NO: 456359 - RNA, 63 nt, Human
cagcuuguaggugauuguacaagugagaauuaaagagagaacagauauuuaaacaggugcugu

SEQ ID NO: 456360 - RNA, 64 nt, Human; identical to SEQ ID NO: 135860

SEQ ID NO: 456361 - RNA, 64 nt, Human; identical to SEQ ID NO: 135861

SEQ ID NO: 456362 - RNA, 63 nt, Human
uuuugaagaaucagcacucauuaagagcugagaagagagaagaccugauugggugguugacua

SEQ ID NO: 456363 - RNA, 63 nt, Human
auucaaguauuuauugaauaccugccucaagcuagagagaaaagagagugcgcuuuggaaauu

SEQ ID NO: 456364 - RNA, 63 nt, Human
ccuuccauuugggauauguuacauuagagugagagagagaauaaggagccuuucuuauggaag

SEQ ID NO: 456365 - RNA, 63 nt, Human
agcucuguccugaguccaaaccaagcccuuccaagagagaacaaaggucagagauguugaaga

SEQ ID NO: 456366 - RNA, 63 nt, Human
uggauuuuucugaguaaauuugcugaaaauauaagagagaagcuaucuaauaccuuggaggua

SEQ ID NO: 456367 - RNA, 63 nt, Human
uguguguguguguguguguguguguaugacuaaagagagaauguagauauugugaaguacaua

SEQ ID NO: 456368 - RNA, 63 nt, Human
uguguacaugaaagaguacaccaugugaagagaagagagaaugauugaaaauguuuuaguaua

SEQ ID NO: 456369 - RNA, 63 nt, Human
gaugggaccucgaggcucgagcugaagcaggcgagagagaaacagcuacugcgugcgugcgcg

SEQ ID NO: 456370 - RNA, 56 nt, Human
aaaggggcaucugcuuauaagaagugagagagaagaaaaaucaugucccaaguucu

SEQ ID NO: 456371 - RNA, 63 nt, Human
auggguguguguuugugugagagacagagaaagagagagaauucuuucaagugaaucuaaaag

SEQ ID NO: 456372 - RNA, 63 nt, Human
aacuauuuccuaaaguauucuaaaagaguaggaagagagaaaugguagccugcugcuucucac

SEQ ID NO: 456373 - RNA, 63 nt, Human
agcugaaucccaaauuugaguuugggaagaaccagagagaaauggaucccugagcucugagcc

SEQ ID NO: 456374 - RNA, 63 nt, Human
gugucuggucuugggggcacugugcucacuucuagagagaagaaaaaggcuggguuuggacuu

SEQ ID NO: 456375 - RNA, 63 nt, Human
ccuccccgucgaccucagugccuuuuuguuuucagagagaaauaggaguagggcgaguuugcc

SEQ ID NO: 456376 - RNA, 63 nt, Human
gggaguaggugacgaaacacuagaccucuccugagagagaauugcugcuuccugaauccacuu

SEQ ID NO: 456377 - RNA, 63 nt, Human
ggauuugagaauaguuucaucucagcccccauuagagagaaguuggggugaauucuggaaaaa

SEQ ID NO: 456378 - RNA, 63 nt, Human
gagaaccacaaugcacauuagcauauuagucugagagagaacuuauaguaaggaaacucacuu

SEQ ID NO: 456379 - RNA, 63 nt, Human
accuaaggacacguggaagucaguuuaauugccagagagaaggaugcaaucacuagguaaaau

SEQ ID NO: 456380 - RNA, 63 nt, Human
cacaucccccaggacuugaugaccacacggggcagagagaaaccaaccaaggccagcaccucc

SEQ ID NO: 456381 - RNA, 63 nt, Human
cacaauuaugucugcuaauccucuucuuccuagagagagaaacugugcuccuucaguguugcu

SEQ ID NO: 456382 - RNA, 63 nt, Human
acuggacucuguucguuaugauuugucuguuuaagagagaaaacaaaguggacuugauuuuua

SEQ ID NO: 456383 - RNA, 63 nt, Human
aucccuugcuccgaucccagccccugagcagggagagagaaguuuuguuggcauagguuugcu

SEQ ID NO: 456384 - RNA, 63 nt, Human
cacccuggaaccgggaaggguggccuguucccuagagagaauaaauuggauuauuuucuaaug

SEQ ID NO: 456385 - RNA, 63 nt, Human
augaaauguccagaauaggcaaaucuguuugagagagagaaaguagaugaguacuugccuagg

SEQ ID NO: 456386 - RNA, 63 nt, Human
uaaaagcacaagcguguuucuagagaacaguugagagagaaucucaagauucuacuugguggu

SEQ ID NO: 456387 - RNA, 63 nt, Human
ggguucuccccccuacacccucugcagguggagagagagaagcugggcccagccgggccgugc

SEQ ID NO: 456388 - RNA, 63 nt, Human
gaaggggcuucuuaauguagaaagggaagaagaagagagaaaagaaggguaguaaaaacuaga

SEQ ID NO: 456389 - RNA, 63 nt, Human
agucucuagagguagaaauuugccuugcugcagagagagaaggaauggcgugggaugggggaa

SEQ ID NO: 456390 - RNA, 63 nt, Human
uuauguuuuguuuaaccuugaugaauuguauaaagagagaauuuaaaaaauuacauucuuuau

SEQ ID NO: 456391 - RNA, 62 nt, Human
gaggauugauugcugccuuuuaaaauuuuaugaagagagaaacuuauaauugacucuauuuu

SEQ ID NO: 456392 - RNA, 63 nt, Human
ucucaucagagaugaauaauaucuuuuuaccagagagagaacgaauguuagccacaugcccaa

SEQ ID NO: 456393 - RNA, 63 nt, Human
ucccccuggcucccuagugaugggacauauaugagagagaaguguuuuucuaucauagacacc

SEQ ID NO: 456394 - RNA, 63 nt, Human
accuuguucuaagcuaauauauagcaauuaaaaagagagaaagaggaaaugauuccugcguuu

SEQ ID NO: 456395 - RNA, 63 nt, Human
uguauuguguucuccugcauauaucauuccuggagagagaaggggagaagaauacuuuucuuc

SEQ ID NO: 456396 - RNA, 63 nt, Human
gaauaaauuuuuauuuaacacugcaaaggaaagagagagaaaacaagcaaagauagguaggac

SEQ ID NO: 456397 - RNA, 63 nt, Human
augaacaggguaugguaggauuggggaaaggggagagagaagcaguagauacacuccuuaucc

SEQ ID NO: 456398 - RNA, 63 nt, Human
caccagaucugauuuguaacccacugagaggacagagagaaauaagugcccucucccacccuc

SEQ ID NO: 456399 - RNA, 63 nt, Human
ugaaauaaaaagaagagagggaggaagaaagggagagagaagaaaagaaaaaugaagaaaagu

SEQ ID NO: 456400 - RNA, 63 nt, Human
cccuagggucugcuuuagagaagggggauaaagagagagaaggacuguuaugaaaaacagaag

SEQ ID NO: 456401 - RNA, 63 nt, Human
cccucagcuccuagggcugucgaauagaggaggagagagaaauggucuagccaggguuacaag

SEQ ID NO: 456402 - RNA, 63 nt, Human
gaagcugaggccuaugcagacaucucuggagccagagagaacaacaggcaggggcccacuugg

SEQ ID NO: 456403 - RNA, 63 nt, Human
cugggacuccaggucuugaggagagagacagagagagagaauggauccucauaggucagggag

SEQ ID NO: 456404 - RNA, 63 nt, Human
uagcaucucaugagugccaagcaaaaggagagaagagagaaauagccugcgcuguuuuuuagu

SEQ ID NO: 456405 - RNA, 63 nt, Human
ucuuuuaaaggggcagaaaaacucugggaaauaagagagaacaacuacugugaucaggcuaug

SEQ ID NO: 456406 - RNA, 63 nt, Human
gggaauuaggagagaagguagggguugggaaucagagagaauggcuuuggucucuugcuugug

SEQ ID NO: 456407 - RNA, 63 nt, Human
acacacacacacacacucuuuuaggggacuaagagagagaagcauguuauuacauuuuacuca

SEQ ID NO: 456408 - RNA, 63 nt, Human
uaaccaagauggaugcaaagaggcuagugccucagagagaacuguacgggguuugugacugga

SEQ ID NO: 456409 - RNA, 63 nt, Human
uuggaaaacaguuuuuauucuguuuuauaaaccagagagaaaugaguuuugacgucuuuuuac

SEQ ID NO: 456410 - RNA, 63 nt, Human
ugccaguggcugggcugggccugcccugaauugagagagaagaaggggagaggaacagcccuc

SEQ ID NO: 456411 - RNA, 63 nt, Human
uggugucugccucgccauccugggguaaggggcagagagaaggacuugucuuauguagggugu

SEQ ID NO: 456412 - RNA, 63 nt, Human
ucacagcuuugggaaucugaauggaagaagaaaagagagaaguuaacaaccuccacuggggca

SEQ ID NO: 456413 - RNA, 63 nt, Human
ggccaaguuaugucuuauuauacacccccagaaagagagaaagcugccuucuggaggacugau

SEQ ID NO: 456414 - RNA, 63 nt, Human
cuggaguucuccugcuugcacuagagaagguaaagagagaaucaguauucuuauauggcaauc

SEQ ID NO: 456415 - RNA, 63 nt, Human
gucuaagaaaugauauuuuucucaucuuaaaugagagagaauauucauaugaaaauacuugau

SEQ ID NO: 456416 - RNA, 63 nt, Human
accauacuguccccaaugacuaaggaaucaaagagagagaaccaacguuccuaaaaguacagu

SEQ ID NO: 456417 - RNA, 61 nt, Human
agcaauuguggaaauaaaacaauggauuuuuuaagagagaauuuauuuccuagaaacgccu

SEQ ID NO: 456418 - RNA, 63 nt, Human
aggugaaaggcacgucuuacauggcgguggacaagagagaaugagaacuaagugaaaagggaa

SEQ ID NO: 456419 - RNA, 63 nt, Human
uuagaacacgugaaaaaauuaaaaacucaaauuagagagaaacccaacacauguaaggaagau

SEQ ID NO: 456420 - RNA, 63 nt, Human
auagugcacacuuguauauugaaaagauagggaagagagaaacauuuauggaaucagucguug

SEQ ID NO: 456421 - RNA, 63 nt, Human
gaaacagccuccaagaacauucaagcagcagucagagagaaaaauguuucgacagccaaguuu

SEQ ID NO: 456422 - RNA, 63 nt, Human
aucucacuugacuagagaggaggugggaacagaagagagaaggaggcagggagauguauuucu

SEQ ID NO: 456423 - RNA, 63 nt, Human
gggagccuggcgcgucaucauuggccugacagcagagagaauugagaagcauuucuccccugc

SEQ ID NO: 456424 - RNA, 63 nt, Human
gugcuguguuucuuauuucauacgagauaaaacagagagaaguucucucuucuccagcuuguc

SEQ ID NO: 456425 - RNA, 56 nt, Human
uaccaucugauaacucuugaagauacagagagaaauccaucuuuucccaggucucc

SEQ ID NO: 456426 - RNA, 63 nt, Human
aaauuuuguauuuuccauccaacagcaguguguagagagaauauuaugcagaugccguuaauu

SEQ ID NO: 456427 - RNA, 63 nt, Human
ccaguauuucauuuuaaagaaucccagagcgggagagagaagagaaaaaaauugauaagagug

SEQ ID NO: 456428 - RNA, 63 nt, Human
uaguuaugggucuauuucuuccaugauuagaggagagagaacuugauucaagauacugaaaaa

SEQ ID NO: 456429 - RNA, 63 nt, Human
gugugcagguggcccuuccccuuggaggcgagaagagagaaugugcugucuaucuuccugguu

SEQ ID NO: 456430 - RNA, 63 nt, Human
ucacucuuguuacauuguguacauucaaaaggaagagagaaaauauauaugauaaucauuucc

SEQ ID NO: 456431 - RNA, 64 nt, Human; identical to SEQ ID NO: 185673

SEQ ID NO: 456432 - RNA, 63 nt, Human
uaggauuuaaaaaauauuuucaaagugaagcugagagagaaucuuggaaacacacauaccugu

SEQ ID NO: 456433 - RNA, 63 nt, Human
gcuggacacugcguuccagaaaugaggaagaggagagagaagagauggacagaccucagaucc

SEQ ID NO: 456434 - RNA, 63 nt, Human
uuggagaaggacugggucagagaucuguuggagagagagaauaaagagauuauuuuucauuau

SEQ ID NO: 456435 - RNA, 63 nt, Human
aaauuccauuucuucuucuuguuuaaauggugcagagagaaagguugcccagacauccaccag

SEQ ID NO: 456436 - RNA, 63 nt, Human
cugcccugaaccuguaagcaucaaauaagcaugagagagaaaaaaacaugauauauugcuuua

SEQ ID NO: 456437 - RNA, 63 nt, Human
aaucacaagaaggaggcaggaagggagagucagagagagaauggaagauaccaugcuucuaau

SEQ ID NO: 456438 - RNA, 63 nt, Human
gaaggaagagaguagggccagugaaggcugcccagagagaaugucacagaugaggcugccccu

SEQ ID NO: 456439 - RNA, 63 nt, Human
gaagucuuguuagcagaauuauuuaucagucacagagagaaaaaucugcuauuuuucuaagua

SEQ ID NO: 456440 - RNA, 63 nt, Human
cuauagcuuucccaugguagccugauaaggcugagagagaaaaauaugugcaguaucucaucc

SEQ ID NO: 456441 - RNA, 63 nt, Human
gguagaaagagggagcgagggcaaauggggaguagagagaaaacaggcgagaacaagcacucu

SEQ ID NO: 456442 - RNA, 63 nt, Human
guguguguguguguguguguguguguggcagagagagagaaagagagagagagagagaaauuc

SEQ ID NO: 456443 - RNA, 63 nt, Human
guguguguggcagagagagagaaagagagagagagagagaaauucuguuaaaaucuauucugu

SEQ ID NO: 456444 - RNA, 63 nt, Human
aaacuuauuugcuucugguuuugggaguucauaagagagaauagaacaaaauacaggacauca

SEQ ID NO: 456445 - RNA, 63 nt, Human
aucacuucacuguucucuacuugcaagccucaaagagagaaaguuucguuauauuaaaacacu

SEQ ID NO: 456446 - RNA, 63 nt, Human
agccccgcagaccuccccagccccuagcccaggagagagaaagccaggcagguagccaggggg

SEQ ID NO: 456447 - RNA, 63 nt, Human
gaauaguuuccaaauuauggcaaauucauguagagagagaaaaguaacuguuuugguuuugcu

SEQ ID NO: 456448 - RNA, 63 nt, Human
agguggaaaaauaaucgugucaaucuggaugauagagagaaauuaacuuuuccaaaugaaugu

SEQ ID NO: 456449 - RNA, 63 nt, Human
gccuauuuaaucuuaaguguaggaaugggcuccagagagaagacauuuauauuaugaaauaug

SEQ ID NO: 456450 - RNA, 63 nt, Human
uuuaaucagaaacccucauuguguuucuaccggagagagaauguauuugcugacaaccauuaa

SEQ ID NO: 456451 - RNA, 63 nt, Human
ugugugugugggguggggggaugguaagagaaaagagagaaacacugaaaagaaggaaagaug

SEQ ID NO: 456452 - RNA, 63 nt, Human
caggugucagcuuuucgucuaguaacuuaagugagagagaaagggcagcgccacagaagcccc

SEQ ID NO: 456453 - RNA, 63 nt, Human
gcaaauuauuuguaugcuucaaaaaaaaaaaaaagagagaaacaaaaaagugugacauuacag

SEQ ID NO: 456454 - RNA, 63 nt, Human
uuuccaguuccguucugagagaaaaagagagagagagagaaaaagaccaugcugcauacauuc

SEQ ID NO: 456455 - RNA, 63 nt, Human
cacucuucuuguuucaagguggccauaagacagagagagaauaaucgugcuuuguuuuaugcu

SEQ ID NO: 456456 - RNA, 63 nt, Human
uuuggaagggcaccgagggaguuuucuggguguagagagaauggaggggaccaaaaagagucc

SEQ ID NO: 456457 - RNA, 63 nt, Human
guugggauguggauggaugugugcauaagagagagagagaauaugugugugugugugugcguc

SEQ ID NO: 456458 - RNA, 63 nt, Human
gagggugaguaaagagguagaggagguuugaggagagagaacugcucggaagacauugguaga

SEQ ID NO: 456459 - RNA, 63 nt, Human
uguuggacuugacagcuucuuuugccacaagcaagagagaauuuaacacuguuucaaacccgg

SEQ ID NO: 456460 - RNA, 63 nt, Human
aacuuuccagagugugcccauauuuaccugaucagagagaaaagaaaaucugcagaggaagcu

SEQ ID NO: 456461 - RNA, 63 nt, Human
caagcaaaaaaccucaaauuuuuuucagcagugagagagaauaguaaagagaggcccaagcau

SEQ ID NO: 456462 - RNA, 63 nt, Human
aaaaugcagcccaccacccagucccccaauuccagagagaaacacaucacuagauugacgagg

SEQ ID NO: 456463 - RNA, 63 nt, Human
ucccuguacuauaucacagccaagagagauuagagagagaaaauguagaucaaggcgagcugc

SEQ ID NO: 456464 - RNA, 63 nt, Human
ugcuggcacauuuacuucugguaagcauaaagcagagagaacccagguuagaaggaugggaag

SEQ ID NO: 456465 - RNA, 63 nt, Human
ugcucugccuaauuacgauaaggaagaaacagaagagagaaggggcgggaauauuguuucuuu

SEQ ID NO: 456466 - RNA, 64 nt, Human; identical to SEQ ID NO: 135816

SEQ ID NO: 456467 - RNA, 64 nt, Human; identical to SEQ ID NO: 135817

SEQ ID NO: 456468 - RNA, 52 nt, Human; identical to SEQ ID NO: 135818

SEQ ID NO: 456469 - RNA, 64 nt, Human; identical to SEQ ID NO: 135820

SEQ ID NO: 456470 - RNA, 63 nt, Human
ggaagagaagggaaggaaguguuuguguagaagagagagaaagacgaauagaguuaggaaaag

SEQ ID NO: 456471 - RNA, 63 nt, Human
ggggaaaagagagagagagagagagagagagagagagagaaagauggaggagaagaacuugga

SEQ ID NO: 456472 - RNA, 63 nt, Human
gaacucaucugaaucaucaguuccuugauggagagagagaaggagauggaaugugucugguaa

SEQ ID NO: 456473 - RNA, 63 nt, Human
uuccaaagagcuuggauuagaagggcuggacaaagagagaauucaauggggcccaaauuagaa

SEQ ID NO: 456474 - RNA, 63 nt, Human
uguucgacugggagguucuggaaagaaagagagagagagaaaagagguaaaggagggagccaa

SEQ ID NO: 456475 - RNA, 63 nt, Human
uucaaaaagaaaaaaauaauaaaaauaaaagagagagagaaucagaccuggguggaacucucc

SEQ ID NO: 456476 - RNA, 63 nt, Human
uaacguauggccccauaggucacugggucauacagagagaagauucaguucagccuaaaucaa

SEQ ID NO: 456477 - RNA, 63 nt, Human
augaagucuuguucaggguauggggcuaggaugagagagaaugccacagaguaugaaggaaga

SEQ ID NO: 456478 - RNA, 63 nt, Human
uggagaaaaaaugagacccuaaaaaguuucuagagagagaaaacaaaagaucagaaaugaaag

SEQ ID NO: 456479 - RNA, 63 nt, Human
auaaaccuucggagaacgucacuaagcuuuuccagagagaagacccuagaugaaguuggaaaa

SEQ ID NO: 456480 - RNA, 63 nt, Human
aagucaacaaagaacuuaccuuggaggauagagagagagaagggaccaauuaugaggacugac

SEQ ID NO: 456481 - RNA, 63 nt, Human
uaaagccaauaccaaagaaaacagugacuaaacagagagaaacuagguccuuggugacaucuu

SEQ ID NO: 456482 - RNA, 63 nt, Human
acuuagaaauuuguuguucugcacuuaaccuagagagagaaaaaaugcuuuucuuugugaaaa

SEQ ID NO: 456483 - RNA, 63 nt, Human
auuuggguuggaagugagggucagagaggagucagagagaaucccuagucuucaagcagauug

SEQ ID NO: 456484 - RNA, 63 nt, Human
guuuugaugcuagagaggaaaaaggacuuggagagagagaaggaauggcugguccagaggcuu

SEQ ID NO: 456485 - RNA, 63 nt, Human
gaaaucauucuuuacaguuuugcauugcugaggagagagaaaaaacaauuuuuuugcaagaga

SEQ ID NO: 456486 - RNA, 63 nt, Human
uauaggccgaacuauuaucagcucugauguuucagagagaagaccucagaaaccgaaagaaaa

SEQ ID NO: 456487 - RNA, 63 nt, Human
ccaaaugaaauauuaaccuaaggucaagcugggagagagaaaugacugagaugaaugucuuua

SEQ ID NO: 456488 - RNA, 64 nt, Human; identical to SEQ ID NO: 185674

SEQ ID NO: 456489 - RNA, 64 nt, Human; identical to SEQ ID NO: 185675

SEQ ID NO: 456490 - RNA, 63 nt, Human
agggaauaagcaaagggggaagaauugaaagagagagagaagaaagaauacagagagcuuacc

SEQ ID NO: 456491 - RNA, 63 nt, Human
uuccucaaaagacuuaaaugaccuggauugaucagagagaauugaacugugaccuuuaagacu

SEQ ID NO: 456492 - RNA, 63 nt, Human
guguguaugugugucagagaaagagagagagagagagagaagggaggaugagaacgaaugggg

SEQ ID NO: 456493 - RNA, 63 nt, Human
accaaaagagaucacaauacucaaaagagagagagagagaaaaaagagagaucuugauccaca

SEQ ID NO: 456494 - RNA, 63 nt, Human
ggaggccagcgguguccacccuugcccucagcaagagagaaugcauucuuaaaagaaagcugu

SEQ ID NO: 456495 - RNA, 63 nt, Human
auuggaagcuuauucuuuuuguucacuggagagagagagaacuguuuacaguuaaucuguguc

SEQ ID NO: 456496 - RNA, 63 nt, Human
caggaccaucacagcuucugaacugagccggagagagagaauggaauugcugaccccuggaac

SEQ ID NO: 456497 - RNA, 63 nt, Human
auaaaaacauagacuggaggagguaauccauggagagagaaaaagaagagggcucaggacaag

SEQ ID NO: 456498 - RNA, 63 nt, Human
gcaacauggagaagcccugucucuacaaaauacagagagaaaaaaucagccagucaugguggc

SEQ ID NO: 456499 - RNA, 63 nt, Human
uugccccuuuuucuguuccuaaaaggaaggauaagagagaacauuccaggugaggcacuucaa

SEQ ID NO: 456500 - RNA, 63 nt, Human
gguugacuuuuugcacuucuguauauagucaaaagagagaaaccuguauaauaguaagaucuu

SEQ ID NO: 456501 - RNA, 63 nt, Human
aaacuacugcauguuuaaaacuucaacaaaaaaagagagaaagaacuauacuaagaacauaua

SEQ ID NO: 456502 - RNA, 63 nt, Human
uugugagacuauacugugucaauaucuguaaaaagagagaaaacauguuuuguuuuuuuuuga

SEQ ID NO: 456503 - RNA, 63 nt, Human
cuauuuuggcugcucuuggggacugcgagaagcagagagaaugagagaccaguggcaacugcc

SEQ ID NO: 456504 - RNA, 63 nt, Human
uucacccaugcaugagagacucuccuccuuuccagagagaaucggaucgcaccacguguggca

SEQ ID NO: 456505 - RNA, 63 nt, Human
ucuuuuuuaguugcaugaaauuuugccugcaacagagagaaaaagauuguauuacuuuaauga

SEQ ID NO: 456506 - RNA, 63 nt, Human
cgugguaguaaguucggcauuuguuacauguauagagagaagacuaauaaucucuauuuauaa

SEQ ID NO: 456507 - RNA, 54 nt, Human; identical to SEQ ID NO: 135825

SEQ ID NO: 456508 - RNA, 64 nt, Human; identical to SEQ ID NO: 135826

SEQ ID NO: 456509 - RNA, 64 nt, Human; identical to SEQ ID NO: 135827

SEQ ID NO: 456510 - RNA, 63 nt, Human
auuuugcauugguccagcccuuugaaaccccuuagagagaagcauauauggccacaaagcaca

SEQ ID NO: 456511 - RNA, 63 nt, Human
aggacaucagaagcaugucaaagcuauuuuuaaagagagaaacuguauaagauguuuacuuca

SEQ ID NO: 456512 - RNA, 63 nt, Human
gaccuuguauuagcauccaagaaaugaugagagagagagaaauuauauacuaugaaaagugca

SEQ ID NO: 456513 - RNA, 63 nt, Human
aaauugucuuacuugaaaauauugauccugaugagagagaagauggugccaaggcugucuuug

SEQ ID NO: 456514 - RNA, 63 nt, Human
uguccuuggcucagagguguugggaauuaaagcagagagaagccauucgugaugcuuagaacc

SEQ ID NO: 456515 - RNA, 63 nt, Human
ugguccuaccacagucaaaguauuccucauuaaagagagaaucucagguucucacuggaggca

SEQ ID NO: 456516 - RNA, 63 nt, Human
cuagugguuuucuuuccauuuguguuaugccacagagagaaauuuccugucugaacucuucug

SEQ ID NO: 456517 - RNA, 63 nt, Human
aggagccaucacugcuuggaagagauucuuggcagagagaagaggggacaaauuugguuguga

SEQ ID NO: 456518 - RNA, 63 nt, Human
gaggaacucaucuguguauugggaugguauuagagagagaaucaggaaagaccaacucaugaa

SEQ ID NO: 456519 - RNA, 63 nt, Human
gacaagaucuuuauagcccccuuucugauaaucagagagaacguuuugucuaguccgaccaag

SEQ ID NO: 456520 - RNA, 63 nt, Human
agaacaauuucauaauaaaacggcuauauuugaagagagaauacauuuuauauaaacaggaaa

SEQ ID NO: 456521 - RNA, 63 nt, Human
acucugggugucauaggucuauuuuaagggaagagagagaaaaacacccuuacuaucuuggaa

SEQ ID NO: 456522 - RNA, 63 nt, Human
guguggaaauaaagagaacugagauggaauucaagagagaagugucuccuccucguguagcag

SEQ ID NO: 456523 - RNA, 63 nt, Human
ugucagcaggcugcagggagugcacacgaugccagagagaacuuagcaggguguccccggagg

SEQ ID NO: 456524 - RNA, 63 nt, Human
aaucaccaguaacuugacugaccaauugauuuuagagagaaaguaaccaaaccaaauauuuau

SEQ ID NO: 456525 - RNA, 63 nt, Human
ccccucaccagcccuggggggaauccuaaacagagagagaaaaaggguaucugcccuucuugc

SEQ ID NO: 456526 - RNA, 63 nt, Human
cuguagcuuguuguuugggggaccaaauuuucuagagagaacuagagcacuuuuguuguguuu

SEQ ID NO: 456527 - RNA, 63 nt, Human
ggauauuuguguauuagcagugccuucaguauaagagagaaauauucauuaucugucauuuau

SEQ ID NO: 456528 - RNA, 64 nt, Human; identical to SEQ ID NO: 135828

SEQ ID NO: 456529 - RNA, 64 nt, Human; identical to SEQ ID NO: 135829

SEQ ID NO: 456530 - RNA, 63 nt, Human
aagagcaagaaaagagaaaauauuaaaacgaggagagagaaaaauaauauuaacacaaaaaaa

SEQ ID NO: 456531 - RNA, 63 nt, Human
uguguuaugaaaaaaauuuuuccaaggugagcuagagagaaagauguuuggcaugccaaauua

SEQ ID NO: 456532 - RNA, 51 nt, Human
agacaacauacagguucuaacagagagaagaaaauauauuagugcuuuuuu

SEQ ID NO: 456533 - RNA, 63 nt, Human
aggagcacaaagucagggauagggguuagcagaagagagaaauagugucacaucaagggcagg

SEQ ID NO: 456534 - RNA, 63 nt, Human
gguuuccuuaagggacaacauccuuaagucaaaagagagaagaggcaccacuaaaagaucgca

SEQ ID NO: 456535 - RNA, 63 nt, Human
uuuuuuuuaaacaugauucuaguuaaauguagaagagagaagaaagaggaaguguucacuuuu

SEQ ID NO: 456536 - RNA, 63 nt, Human
uagcauuuagaaguuuuggauaugaaaaacagaagagagaaaaauauacauuauaaaagcaga

SEQ ID NO: 456537 - RNA, 63 nt, Human
uaaaaaaaaaaaagaugacaaagaaaaacagagagagagaauauuggagauguccugaauuuu

SEQ ID NO: 456538 - RNA, 63 nt, Human
gacuaaacagugugccaaacaccagcuaaaccaagagagaaagcaagaaacuauaaugcacac

SEQ ID NO: 456539 - RNA, 63 nt, Human
cacacaauuaaguugcugcaaauucaaaagcuuagagagaauaagcuucuugguggugaaacu

SEQ ID NO: 456540 - RNA, 63 nt, Human
cgucaaucagccugguuuuggggaugcuaugaaagagagaaggaaaaucaugccgcucaguuc

SEQ ID NO: 456541 - RNA, 63 nt, Human
ucaaacuuuguuaaacauaagagaauuuauaccagagagaaacccuacacauguaaagaaugu

SEQ ID NO: 456542 - RNA, 63 nt, Human
uucugaauagagaauauuuauaacuuuuguaugagagagaauucacacucaacaagacacuac

SEQ ID NO: 456543 - RNA, 52 nt, Human
gcaacgauaaauacucuuaggaagagagaaaauaagguuucauaaguuugua

SEQ ID NO: 456544 - RNA, 63 nt, Human
gagccacaugaaggcagcacucagggccaggggagagagaagaggaucagcagugcagcccca

SEQ ID NO: 456545 - RNA, 63 nt, Human
aaagcacauuggugguugccagguacuggaggaagagagaagaggcaugacagcuaacaggga

SEQ ID NO: 456546 - RNA, 63 nt, Human
uuaaaaaugcagaacuaagauuuuugacucuaaagagagaaaauuacaaggguguugccuuau

SEQ ID NO: 456547 - RNA, 63 nt, Human
accaaauauugcaucgcaugcugcugauuuucaagagagaagcaauaaacacaacuucugcua

SEQ ID NO: 456548 - RNA, 63 nt, Human
ugcaggcuguaugauaaaacacacauaauuuaaagagagaaggcucuugauuccuuaugcaag

SEQ ID NO: 456549 - RNA, 63 nt, Human
ucuauuaauugccauguuuacaaacaaacacaaagagagaaguuagacagguagaucuuuagc

SEQ ID NO: 456550 - RNA, 63 nt, Human
agccuacugagggcaaagaaaguccuuagauaaagagagaauauuguaugggccaucaaccau

SEQ ID NO: 456551 - RNA, 63 nt, Human
uuccugcaauuccgcuuccuacuuaggcaguucagagagaacaauucuaauaaaaacacuccu

SEQ ID NO: 456552 - RNA, 63 nt, Human
ucuaguaaaaaaggaguugcaauagccaaguauagagagaauagugaaaaauuaaucuugccc

SEQ ID NO: 456553 - RNA, 63 nt, Human
uggaauuacuuuaauugauggaguaguggugguagagagaaauuaauaacaaaaagagugaaa

SEQ ID NO: 456554 - RNA, 63 nt, Human
caaagaaaaaggcuaugagaugagcugaguuauagagagaaagggagaggcauguacggugug

SEQ ID NO: 456555 - RNA, 63 nt, Human
ccuauccauggauaggucuagucauaacacuuuagagagaaugucagagcaggagggaggcaa

SEQ ID NO: 456556 - RNA, 63 nt, Human
gagaggacuggguagaguaccauggcagaucucagagagaagaaguagguacgggccuuuggu

SEQ ID NO: 456557 - RNA, 63 nt, Human
cauguuauguuuuuggcaugaacaaaagaaacaagagagaaaaaaaucaaaauaauuaaaaua

SEQ ID NO: 456558 - RNA, 63 nt, Human
cuuaaaaaaaaaaaaaaaaaaaaaaaaagagagagagagaauaaauagaaaagaauguggcug

SEQ ID NO: 456559 - RNA, 63 nt, Human
aaguuauaucaaacaggcacaguuauuacaacuagagagaaauuccagaaauauuuguuuuuu

SEQ ID NO: 456560 - RNA, 63 nt, Human
ucuaaaaaaaaaaggaucuguauucgugagaguagagagaaagguuguuuaggaagagucaac

SEQ ID NO: 456561 - RNA, 63 nt, Human
gguuggguaguagguugcauuaugaguaaaagcagagagaaguacuuuugauuauuuuccugg

SEQ ID NO: 456562 - RNA, 63 nt, Human
ucuguguguauaaauuuagcugcuauuaacagaagagagaacuuucugugaguagccaugugu

SEQ ID NO: 456563 - RNA, 63 nt, Human
ucaauaauguucaacugaaucucacagaugaggagagagaagaaacggaagaggaaguuuauu

SEQ ID NO: 456564 - RNA, 63 nt, Human
guggaauggaggaguuguuuggggagggaaaggagagagaaggaaaggagugagguauuuccc

SEQ ID NO: 456565 - RNA, 63 nt, Human
ugcaaaauaaaccaacuauaaaaaaagaaacuaagagagaauugguacuuuaauuacuugugu

SEQ ID NO: 456566 - RNA, 63 nt, Human
cuagaaaaugcauaagguuaguacaagaucaguagagagaaagucaaagauuacagaagugcu

SEQ ID NO: 456567 - RNA, 63 nt, Human
uagcccaagggaaagaccugcgggagcaucugaagagagaagggaugauuuucuccugcccgc

SEQ ID NO: 456568 - RNA, 63 nt, Human
ucugacaaauucaaaagagagagagagaucuugagagagaaaugcuguucguucaaaagugga

SEQ ID NO: 456569 - RNA, 63 nt, Human
aucugcaaaugcacauuaaugcaaauuaaaugcagagagaaaugauuauuuuuuucuuuaugu

SEQ ID NO: 456570 - RNA, 63 nt, Human
aaaaaagguagauaugaaaagaaaaaucacagaagagagaaugcaaauggccacuaaguauau

SEQ ID NO: 456571 - RNA, 63 nt, Human
gaagguaaaaaacucucaacaaucccuucuuucagagagaacuacuguuaacauuuuaacaga

SEQ ID NO: 456572 - RNA, 63 nt, Human
uggagaccacugucagaaaugggauauuagucuagagagaaggugaucuauucccacauguca

SEQ ID NO: 456573 - RNA, 63 nt, Human
gcaacagaaauauaaauuauauuccauucccagagagagaaugcgcuuuggauuguuuagucc

SEQ ID NO: 456574 - RNA, 63 nt, Human
ugggucccucucuguggaagaauacugaauagaagagagaaaucacucaauauguggaaugac

SEQ ID NO: 456575 - RNA, 63 nt, Human
ucagaaacuaaaugcugagucucucaaaggcguagagagaauuucagagggccuuaccaugac

SEQ ID NO: 456576 - RNA, 63 nt, Human
uauuauggagaauuggggcacccacaggaaugaagagagaaagcagcucccuaacuucaaaac

SEQ ID NO: 456577 - RNA, 63 nt, Human
auuuaauuuacgugcuucuguuauucagaauaaagagagaagacuacgcugcauauucaagag

SEQ ID NO: 456578 - RNA, 63 nt, Human
acacuuggucucaugaagccacugcugggcuccagagagaagggaaaacuaagagguuuuaaa

SEQ ID NO: 456579 - RNA, 63 nt, Human
cuuugaagucggccuagagagguccuucagaugagagagaaauagcuggcuugucugagucca

SEQ ID NO: 456580 - RNA, 63 nt, Human
uguugugauucauaguacauuaaaaagagagagagagagaaagaaucccacagggcacuauua

SEQ ID NO: 456581 - RNA, 63 nt, Human
agagugagagcacaaagauaacgcaggagagagagagagaaagaaugagaaagaaaaggaaug

SEQ ID NO: 456582 - RNA, 63 nt, Human
gauguaaugacagagaguucuggugagauacccagagagaaaaagagagagcaggguggggua

SEQ ID NO: 456583 - RNA, 63 nt, Human
uguuuuaaaauccaguuauuuaauaugaguuugagagagaaaauuguuuuuuaaaaauauaug

SEQ ID NO: 456584 - RNA, 63 nt, Human
aagaagauggaaccagacuggaauucugucuccagagagaaacccagcuguuugggucaaaga

SEQ ID NO: 456585 - RNA, 63 nt, Human
guucauuauuccuauaagaauuaaauugaguuuagagagaauggugguguugagcugauuauu

SEQ ID NO: 456586 - RNA, 63 nt, Human
auguggaagcuagucucccaaaacacaaucuuuagagagaaaagacaugaacgaacuccaaaa

SEQ ID NO: 456587 - RNA, 63 nt, Human
ugcaucaguggaaggggacauagcuucucucuuagagagaacagauuggaaagcaaucggaaa

SEQ ID NO: 456588 - RNA, 63 nt, Human
cagccacacacacagaaaauauacuguaaagaaagagagaaaauaaaaaguuaaaaaguuaaa

SEQ ID NO: 456589 - RNA, 63 nt, Human
cacgauggaaguugcuaaauucuccauggacauagagagaaaggaaugauauucucaucauca

SEQ ID NO: 456590 - RNA, 63 nt, Human
cuucugccuuuuuuauuuuuuuaagcuguaaaaagagagaaaacuuauuugagugauuauuug

SEQ ID NO: 456591 - RNA, 63 nt, Human
cuaauucacucuaagcauuuggccaaaaaaaggagagagaaauaacugaaauuguucaggugg

SEQ ID NO: 456592 - RNA, 63 nt, Human
cagacccuuaucuggaggaggaagagaagcaggagagagaaagccacagccagccugccauag

SEQ ID NO: 456593 - RNA, 63 nt, Human
aagagcaaagucaugucagaaggagacagaaugagagagaaaagagggggaagaugguucaaa

SEQ ID NO: 456594 - RNA, 63 nt, Human
uacagaacagcuccugagccagguggacaugccagagagaaaagcaguagagguccuccaugc

SEQ ID NO: 456595 - RNA, 63 nt, Human
gugcuggcuaggggccacagcguuagacagugcagagagaaagcacuuccaucgcugaggaaa

SEQ ID NO: 456596 - RNA, 63 nt, Human
ucgugcccuuaaaugccagaucugguggagggaagagagaagagguaggaagaaaggugauga

SEQ ID NO: 456597 - RNA, 64 nt, Human; identical to SEQ ID NO: 185677

SEQ ID NO: 456598 - RNA, 64 nt, Human; identical to SEQ ID NO: 185678

SEQ ID NO: 456599 - RNA, 64 nt, Human; identical to SEQ ID NO: 185679

SEQ ID NO: 456600 - RNA, 63 nt, Human
auccaaacuuccugcaacauuuucuuagaggagagagagaaauauuaaaagagaaaugaaaca

SEQ ID NO: 456601 - RNA, 63 nt, Human
gggcccaggaucccaugccugggaggagcugccagagagaagcaaaaaggcggcuguggaucg

SEQ ID NO: 456602 - RNA, 63 nt, Human
cgagacaccaucccagguguguguaagagagagagagagaacagggaggauacagaaguauug

SEQ ID NO: 456603 - RNA, 63 nt, Human
gaaaacaacagcaagucagaaaaaaaaaacaagagagagaaauucauauuauuauuauuauua

SEQ ID NO: 456604 - RNA, 63 nt, Human
uggcaucagcacuuuaaccaaugacguuugcauagagagaaaugauugacaguaaguuuauug

SEQ ID NO: 456605 - RNA, 63 nt, Human
gagcucauucacagaaguggucccuucacucugagagagaaaaucguggcgugcaucccaaac

SEQ ID NO: 456606 - RNA, 63 nt, Human
cucaccaggaaauucuguuuauguucuugcagcagagagaaauaaaacuccuugaaaccagcu

SEQ ID NO: 456607 - RNA, 63 nt, Human
ccccggcucugcugcacuugguauuucccugacagagagaaccagcaguuucgcccaaauccu

SEQ ID NO: 456608 - RNA, 63 nt, Human
uugauggcaaaaucgaccucuugucgcugaaggagagagaaaagaugugugucugauuggucc

SEQ ID NO: 456609 - RNA, 63 nt, Human
auccaguccucacauuuuuaaauauaaaacuaaagagagaaugcuucuuacaggaacaguuac

SEQ ID NO: 456610 - RNA, 63 nt, Human
cugagccagggaggacuugaaggaaucaugaugagagagaagguaaguggcuuugccagcaau

SEQ ID NO: 456611 - RNA, 63 nt, Human
aucaucggcauuaacgucaaguacacacuacugagagagaauuuauucucuguuuaccacuaa

SEQ ID NO: 456612 - RNA, 63 nt, Human
aguuucuugcagucuuuuucucagcuuaguuccagagagaaaaaagcuaauuuuccuaaggac

SEQ ID NO: 456613 - RNA, 63 nt, Human
gaguuucagaugccuuugagaaaugaaugaaguagagagaaaauaaaagaaaaaccagccagg

SEQ ID NO: 456614 - RNA, 63 nt, Human
ucuuauuuuuugccacugcaaacauauaucuacagagagaaaaauuaauggcauuuuaaaggu

SEQ ID NO: 456615 - RNA, 63 nt, Human
cucucugguaccccauccccgcaucagcacugcagagagaacacauuucggcgaggguuuucu

SEQ ID NO: 456616 - RNA, 63 nt, Human
ccauacauaucugacaucagaaaagcaggcccuagagagaaguauauacuaggguacuuuaga

SEQ ID NO: 456617 - RNA, 63 nt, Human
uaaggagaggaguccaaggggacaaauaaaggcagagagaagagacagaacuaaaaauacgag

SEQ ID NO: 456618 - RNA, 63 nt, Human
gcagaagcuaaaaagcuaaaguaccagucaucuagagagaaggaaauuaauguuucuuaauaa

SEQ ID NO: 456619 - RNA, 63 nt, Human
gggcuaacuuugaaaagaccgcuguucauaaggagagagaaaggaggaagagaugagaaagga

SEQ ID NO: 456620 - RNA, 63 nt, Human
ggccuuacuuagcuccuugcgauacugugagccagagagaaaguaaaagcacuucacaaaaaa

SEQ ID NO: 456621 - RNA, 63 nt, Human
ugucugcauauuagcuuuuaaugugugauuuuaagagagaauacuuugacaccuguaaaaauc

SEQ ID NO: 456622 - RNA, 63 nt, Human
aaucaugucuuauacauggauggcagcaggcaaagagagaacuugugcaggggaacucuuuau

SEQ ID NO: 456623 - RNA, 63 nt, Human
aagagugagagggcaugcgcacaaggcugaccaagagagaaagaaguaggcaugagggaucac

SEQ ID NO: 456624 - RNA, 63 nt, Human
gccuuucccagcuacgcaggaugcaggcucuggagagagaacaggaugcccuguggcaggguc

SEQ ID NO: 456625 - RNA, 63 nt, Human
augugugucuugcuauaggugaugguguuucuuagagagaagaucacugaagaaacuucugcu

SEQ ID NO: 456626 - RNA, 63 nt, Human
uuagacccaaggacccgauucuugggcuaggaaagagagaacaagcaagccggggcuaccugc

SEQ ID NO: 456627 - RNA, 63 nt, Human
cccaucuccugauuucucugaacagaaaacaaaagagagaaugagggaaauugcuauuuuauu

SEQ ID NO: 456628 - RNA, 63 nt, Human
ugcugcaguuaacacccuuguacauauaucuuuagagagaagauauuuuaaaaagaaauaccu

SEQ ID NO: 456629 - RNA, 63 nt, Human
cuuccucccgucccaccccagauauccuaaaugagagagaaaugacuuaaaaauaaaugauaa

SEQ ID NO: 456630 - RNA, 63 nt, Human
uaccuucuacagaauuuaagucugaagauguaaagagagaacaggccuuguguaacagaagau

SEQ ID NO: 456631 - RNA, 63 nt, Human
agaucuuuaguucaaauccacguauuuuuuaaaagagagaaccggagguagagcaaugaucag

SEQ ID NO: 456632 - RNA, 63 nt, Human
caccaaugaguacccgacccguugccaugauuaagagagaaugcuuucuauuggaguuucagg

SEQ ID NO: 456633 - RNA, 63 nt, Human
uuaaugacugaaagauaaguggguagcaccgucagagagaaaauguuggaucugcccuagguu

SEQ ID NO: 456634 - RNA, 63 nt, Human
gcugacgguaaaguuaagauuaaauuaagacagagagagaauacauaucacugccaggccuga

SEQ ID NO: 456635 - RNA, 64 nt, Human; identical to SEQ ID NO: 135816

SEQ ID NO: 456636 - RNA, 63 nt, Human
ggaugauuccaaaaaaaaaaaaaaaaagaagaaagagagaaagaaagaaacagaaaaaccuaa

SEQ ID NO: 456637 - RNA, 63 nt, Human
aacuauuuuuccaaaauaauuuuaagaaaucaaagagagaaaauaaagaccuugcuuaugauu

SEQ ID NO: 456638 - RNA, 62 nt, Human
ugggggugggaugggaauagcaauguguguucagagagaaugaauugcuuaaacuuugaaca

SEQ ID NO: 456639 - RNA, 63 nt, Human
ucaguuguguguagguuuuuuuguuuuguuuugagagagaauuuuucucuccuuaauagaagc

SEQ ID NO: 456640 - RNA, 63 nt, Human
ugcaauaucccacucccagauugcacauuuggaagagagaaauaaacauuuagaggauuuaau

SEQ ID NO: 456641 - RNA, 63 nt, Human
uuaaaauugcuuuucuuccauguuucucuuggcagagagaaaugccaucaugcuuacugcucu

SEQ ID NO: 456642 - RNA, 63 nt, Human
cauaagcaucuucuggacaggggaacugcuuucagagagaaaaccuuuccaagagaguuuugu

SEQ ID NO: 456643 - RNA, 63 nt, Human
caucaccugagcccccaccuagccauccaugggagagagaaggcccagccccuucuagaauga

SEQ ID NO: 456644 - RNA, 63 nt, Human
acaaacggaauaucacccgaccuccuuuaugugagagagaaauaaacaucuuauguaaaauac

SEQ ID NO: 456645 - RNA, 63 nt, Human
guggagcaacccuccuccuaccccucaggauagagagagaagacacacuugggacacagugaa

SEQ ID NO: 456646 - RNA, 63 nt, Human
cagcuccauaucugcauuccacuggggaaagagagagagaaaagagcagauuuuaaaaaaaag

SEQ ID NO: 456647 - RNA, 63 nt, Human
aauguuaagggguuguuguguaguugcauuggaagagagaaaggaaacacacucuuucauugc

SEQ ID NO: 456648 - RNA, 63 nt, Human
gaagugaggacuguccugcugggacaacuaagaagagagaauguggacucugaaucccuuuuu

SEQ ID NO: 456649 - RNA, 63 nt, Human
gcuugcaaaauacuuuguuaacaaaagcugcaaagagagaacaugccgugugccuuuaguuag

SEQ ID NO: 456650 - RNA, 63 nt, Human
auagcuguucuaauggauuauaaucagaauggaagagagaaagcauauugacuuuuuuugagc

SEQ ID NO: 456651 - RNA, 63 nt, Human
uuucaaauacaaaaauguacaauuuauccuuugagagagaaucaugaagaaaagaaggucaau

SEQ ID NO: 456652 - RNA, 54 nt, Human
aaguccaucagcugccuugaucagagagagaauucagguuaccaagacggaagg

SEQ ID NO: 456653 - RNA, 52 nt, Human; identical to SEQ ID NO: 135818

SEQ ID NO: 456654 - RNA, 64 nt, Human; identical to SEQ ID NO: 135819

SEQ ID NO: 456655 - RNA, 64 nt, Human; identical to SEQ ID NO: 135820

SEQ ID NO: 456656 - RNA, 63 nt, Human
uuucuugaguuuuuaguuugagaagcuggaaagagagagaagggccucacagugauggguuca

SEQ ID NO: 456657 - RNA, 63 nt, Human
uuuguuuaauuugcucuuucccugauuguguucagagagaaagguuaugauuaaaugggcucc

SEQ ID NO: 456658 - RNA, 63 nt, Human
aggaacaaugugcaauugauauguuuuuagaugagagagaaaaauuaaagcuaaaauuagcug

SEQ ID NO: 456659 - RNA, 63 nt, Human
cuguccuugccacaguuuuucuagagacaauggagagagaaagagagagagagcgcgagagag

SEQ ID NO: 456660 - RNA, 63 nt, Human
cccaguccugcagugucugugagcuguggaaugagagagaaaaccauggcugcucaggaagga

SEQ ID NO: 456661 - RNA, 63 nt, Human
acugaagaugaguuugaccuguggugaccugacagagagaacauucagauccucagauugcac

SEQ ID NO: 456662 - RNA, 63 nt, Human
aaacugcucuaaaaaaaauaucuuuuuuaaaaaagagagaauuagcauugugucugagguuaa

SEQ ID NO: 456663 - RNA, 63 nt, Human
acacacacacgagagacagaaggaaagagaggaagagagaagcaaacauguaggaaaaaauau

SEQ ID NO: 456664 - RNA, 63 nt, Human
uauacacuaugagguaaaauguaauaacaaaagagagagaaguaccacuguggcuagauauau

SEQ ID NO: 456665 - RNA, 63 nt, Human
guauuuguuugauaauuagaguuggaagaaaaaagagagaauuucuuuugggcagugaaaaua

SEQ ID NO: 456666 - RNA, 63 nt, Human
acuuuacagguaccuguuaucccuacgcuucccagagagaacaaugcugugagagaguuuagc

SEQ ID NO: 456667 - RNA, 63 nt, Human
ggggugaaaauagacuaacuacuggagaaacaaagagagaaagaaaacccaguguuuccauag

SEQ ID NO: 456668 - RNA, 63 nt, Human
agccaggacacagcucagcuugcucacgcccagagagagaaaaaguuaagcugcugacccuga

SEQ ID NO: 456669 - RNA, 63 nt, Human
uuccugagggccccgacuuuucagaauaggagcagagagaagcccagacuuccuucccuggag

SEQ ID NO: 456670 - RNA, 63 nt, Human
auccccuucuccaaacgauuagucuaaauuuucagagagaaauagauaaaacacgccacagcc

SEQ ID NO: 456671 - RNA, 63 nt, Human
uaacaacuuacugaacauaagaaaauuuacacuagagagaaagccuacaaaugugaagaaugu

SEQ ID NO: 456672 - RNA, 63 nt, Human
ucaaaccuuacuaaacacaagaagauucauacuagagagaaacccuacaaaugugaagaaugu

SEQ ID NO: 456673 - RNA, 64 nt, Human; identical to SEQ ID NO: 135821

SEQ ID NO: 456674 - RNA, 64 nt, Human; identical to SEQ ID NO: 135822

SEQ ID NO: 456675 - RNA, 64 nt, Human; identical to SEQ ID NO: 135823

SEQ ID NO: 456676 - RNA, 63 nt, Human
ggcgcgaguccaggaaggucauggggcaacuccagagagaagcauccccuggcccggugggaa

SEQ ID NO: 456677 - RNA, 63 nt, Human
aguaucucagcgugugaauuauagaggaaauacagagagaaccucuuccacuuuuacuuuucg

SEQ ID NO: 456678 - RNA, 63 nt, Human
ucagcccuuacuagacaucagagaauccauacuagagagaagcccuacaaauguaaagaaugu

SEQ ID NO: 456679 - RNA, 63 nt, Human
ucagccauugcucagcaucagauaauucacaccagagagaaacccucugaaugugacgaauga

SEQ ID NO: 456680 - RNA, 63 nt, Human
accagagagugcauuuacagaacgaggaggaagagagagaaaacgcaggagggagacagacug

SEQ ID NO: 456681 - RNA, 63 nt, Human
uauuuaucauauccuugcccuugagugcuuguuagagagaaagagaacuacuaaggaaaauaa

SEQ ID NO: 456682 - RNA, 63 nt, Human
aacaaacaaaaaaguaaaaaaagauuacuuucgagagagaaguuuaagcuucaccaaugcugc

SEQ ID NO: 456683 - RNA, 63 nt, Human
gcuagauguauguacuucaugcugucuacacuaagagagaaugagagacacacugaagaagca

SEQ ID NO: 456684 - RNA, 63 nt, Human
ugugugcuaaacugaagucugcacuagaaguacagagagaauggccagaaauccgccaaauac

SEQ ID NO: 456685 - RNA, 63 nt, Human
uccuggcccuuugcgaaguacuucagaaagccuagagagaagagagggcccucaaaucccauu

SEQ ID NO: 456686 - RNA, 63 nt, Human
guuugaaggaggugagggaugugaauugccugcagagagaagccuguuuuguuggaagguuug

SEQ ID NO: 456687 - RNA, 63 nt, Human
aaaaaaaauauaugcuccacaauuuauauuuagagagagaacacuuagucuugccugucaaaa

SEQ ID NO: 456688 - RNA, 63 nt, Human
ccuuugggucgacauaguauggaaguauuugagagagagaaccuuuccacucccacugccagg

SEQ ID NO: 456689 - RNA, 63 nt, Human
gaccacuuuuaaaggggaagucccuuauuuggaagagagaaaggauguguguagcacacacuc

SEQ ID NO: 456690 - RNA, 63 nt, Human
gagcagauuauuuugagaggugggugauaugugagagagaaaucuggaaccuucuucugggua

SEQ ID NO: 456691 - RNA, 63 nt, Human
auggggugggguuaaaguucagguaaguaaguuagagagaaaacauuguaugaucagcuccug

SEQ ID NO: 456692 - RNA, 63 nt, Human
agcaaauguacuuaagucaucauucagagugagagagagaaagcacggcugaggcugagucag

SEQ ID NO: 456693 - RNA, 54 nt, Human; identical to SEQ ID NO: 135825

SEQ ID NO: 456694 - RNA, 64 nt, Human; identical to SEQ ID NO: 135826

SEQ ID NO: 456695 - RNA, 64 nt, Human; identical to SEQ ID NO: 135827

SEQ ID NO: 456696 - RNA, 63 nt, Human
cugaaauacaaaagcagaggauugaacaacugcagagagaaaggcggcgggucuuagaagaaa

SEQ ID NO: 456697 - RNA, 63 nt, Human
auccgguuaagagucugugcugguugccacccaagagagaacaguuguccaggaugcuggcug

SEQ ID NO: 456698 - RNA, 63 nt, Human
ccauuugggcuuauuuagaaaaaaggguaagcuagagagaaaaagaaagaacuguccgucccc

SEQ ID NO: 456699 - RNA, 63 nt, Human
ccaucuuaaaggaaagaaaaggaauuggugugaagagagaaguuagagaagggaaaugcagug

SEQ ID NO: 456700 - RNA, 63 nt, Human
acugaggagaaugguagagaggagaggagagagagagagaaugugauuuuuggccuuguggca

SEQ ID NO: 456701 - RNA, 54 nt, Human
ucaucggcuuuuauauuuaaucggagagagaagggaaggggaguguccccagcc

SEQ ID NO: 456702 - RNA, 63 nt, Human
ugagacuccaucucaaaaaaaaaaaagagagagagagagaaagaaauagaagagaagagccau

SEQ ID NO: 456703 - RNA, 63 nt, Human
aaagaagagggagggagagagaaagacgaagggagagagaaagcaguuuccaaggauauguuu

SEQ ID NO: 456704 - RNA, 63 nt, Human
guacugaagagaaaugggaaagaagagggagggagagagaaagacgaagggagagagaaagca

SEQ ID NO: 456705 - RNA, 63 nt, Human
uuucuauugacuagucaggaguaacagguucacagagagaaguuggugcuuaguuauguguuu

SEQ ID NO: 456706 - RNA, 63 nt, Human
ccccuugcccuucucccagcucauugcuccaggagagagaagaguucaaaaaauaaaguaauc

SEQ ID NO: 456707 - RNA, 63 nt, Human
ugugcacugaacucgggauguuggggauuggagagagagaauugccaaaguaacagcaaaaau

SEQ ID NO: 456708 - RNA, 63 nt, Human
gugcauucuuaaaagccccagucucuggagaaaagagagaaagggauaaucaccuggaaggau

SEQ ID NO: 456709 - RNA, 63 nt, Human
gcuucucuuuggcacaucagccccuaguucuugagagagaagggcaggguggucuacucacca

SEQ ID NO: 456710 - RNA, 63 nt, Human
ugcaccucaagauuuuaaggagauaauguuuuuagagagaauuucugcuuccacuauagaaua

SEQ ID NO: 456711 - RNA, 63 nt, Human
aucaguaaaaaauucagcaauaaucuuaaggccagagagaacagguucaccauugcauagaca

SEQ ID NO: 456712 - RNA, 63 nt, Human
agauuagauaaauugucuuauuguacuuuauguagagagaaaauuucagcuucucuacccaag

SEQ ID NO: 456713 - RNA, 64 nt, Human; identical to SEQ ID NO: 135828

SEQ ID NO: 456714 - RNA, 64 nt, Human; identical to SEQ ID NO: 135829

SEQ ID NO: 456715 - RNA, 64 nt, Human; identical to SEQ ID NO: 135830

SEQ ID NO: 456716 - RNA, 63 nt, Human
cggcagcaggggggugggaagggaggguaaagcagagagaauguauucacaggaggccauaaa

SEQ ID NO: 456717 - RNA, 63 nt, Human
aaucauagccauaagccuguuaguaucauaugaagagagaacaguuaucuuaguaccuaugga

SEQ ID NO: 456718 - RNA, 63 nt, Human
ucuucagcuaaauacuuuaagaggggugaggggagagagaaauucauaacaaauccgacuacc

SEQ ID NO: 456719 - RNA, 63 nt, Human
gaaugcgguaauaagagcuggcaaguaaggcucagagagaagcaaccaacuggaguuaauugc

SEQ ID NO: 456720 - RNA, 63 nt, Human
cagaaaggaaauccuaauccuucuguuuugagaagagagaacuguaguugcuucacuuccuau

SEQ ID NO: 456721 - RNA, 63 nt, Human
uaccacuuugcucaaccuaaaugaauucaagguagagagaauccagauguauuuaauguuuau

SEQ ID NO: 456722 - RNA, 63 nt, Human
ucucguauucucauuuaaaggaguuuagcuuucagagagaaacagcaggauugcuuuugaccu

SEQ ID NO: 456723 - RNA, 63 nt, Human
cuuaucccugcucucccauuucucucuuguuugagagagaaugaggaagcaaagagugagaaa

SEQ ID NO: 456724 - RNA, 63 nt, Human
ccaucccaaucauuugaucuccagcuccacaguagagagaaaccuacaaaaugucaaaccagc

SEQ ID NO: 456725 - RNA, 63 nt, Human
uguauuugggagagaguuuaaaaauacauuaggagagagaaaccauuaaaaguuucacuguca

SEQ ID NO: 456726 - RNA, 63 nt, Human
aaauaaauagaugaauaaauaaagagugagagaagagagaaucagguaccuuuuuuaaauuaa

SEQ ID NO: 456727 - RNA, 63 nt, Human
ucugggaacaugggcauguauauauauauauggagagagaauuuugcacauauuauacauauu

SEQ ID NO: 456728 - RNA, 63 nt, Human
gacccaauaacucgccagguuacaugggucuugagagagaauuuuaauuacuaauugugcacg

SEQ ID NO: 456729 - RNA, 63 nt, Human
uuagguaagagaaaagaaaaagauaaggaaagaagagagaagagagacaaagaucacuacaga

SEQ ID NO: 456730 - RNA, 63 nt, Human
acuaacuucuuggggcauucugagagugugggcagagagaauuauguggccucauccuccccc

SEQ ID NO: 456731 - RNA, 63 nt, Human
auccuggaguguggaggcagcagcggcaccucgagagagaagggcccggagggugucucccca

SEQ ID NO: 456732 - RNA, 61 nt, Human
acagauucugcugccucugagggaugagaacagagagaaauauauucauaauuuacuuuau

SEQ ID NO: 456733 - RNA, 64 nt, Human; identical to SEQ ID NO: 135831

SEQ ID NO: 456734 - RNA, 64 nt, Human; identical to SEQ ID NO: 135832

SEQ ID NO: 456735 - RNA, 64 nt, Human; identical to SEQ ID NO: 135833

SEQ ID NO: 456736 - RNA, 63 nt, Human
agcuucuuucucgguggcagaaauuuugaagucagagagaaacgguccuuuguuggcuucuuu

SEQ ID NO: 456737 - RNA, 63 nt, Human
gaauuuccagguacuuggacuuuuuguagaaggagagagaagaagaugaaguuugccaggagg

SEQ ID NO: 456738 - RNA, 63 nt, Human
agcguuacuucuccuguggucaguaaguugcccagagagaaggaacaaaggucuggaguuuac

SEQ ID NO: 456739 - RNA, 63 nt, Human
uaauggguccccaaaauggguaaccuagacuucagagagaaugagcagagagcaaaggagaaa

SEQ ID NO: 456740 - RNA, 63 nt, Human
cuuuggucaaguagggauuaaugccauagguuuagagagaaggauuguuuucaguuuuuaaga

SEQ ID NO: 456741 - RNA, 63 nt, Human
gauuagaagaucacagcagaauacccuuggauuagagagaaguucguaccuugcauuucucug

SEQ ID NO: 456742 - RNA, 63 nt, Human
ugucuguuuggauuugcuuuaaagucuuguguaagagagaagaaacuauuucuauaauaaaaa

SEQ ID NO: 456743 - RNA, 63 nt, Human
uuagaugaauuauccuauuucaguacuucagcaagagagaaccuaacuguaucuugagguggu

SEQ ID NO: 456744 - RNA, 63 nt, Human
uggugucuucaaagacuugauaaaauaacacugagagagaauugguccauuuguaugcuguau

SEQ ID NO: 456745 - RNA, 63 nt, Human
uugcugauaaagaguuggagaacauuaugcuggagagagaauauaaagaaagggagauguugg

SEQ ID NO: 456746 - RNA, 63 nt, Human
aucgcugcaggccacagagcagcuuggguuggaagagagaagaugaagggacauccuuggggc

SEQ ID NO: 456747 - RNA, 63 nt, Human
gcuagaauggugggaaugucaguagugccagaaagagagaaccaagcuugucuuuaaaguuac

SEQ ID NO: 456748 - RNA, 63 nt, Human
aaauaauuugcuaacuaacuauuuugauucuucagagagaacuacuaauaaaaaucuaaaagg

SEQ ID NO: 456749 - RNA, 63 nt, Human
ugugggguuaccacauggagagauuuuccauuaagagagaaggacaaacauuucugagagugu

SEQ ID NO: 456750 - RNA, 63 nt, Human
cacucauccugagacuuucuuuuugcaguggagagagagaauaaucuaguuggggcaaacacu

SEQ ID NO: 456751 - RNA, 63 nt, Human
auaggcagaugaacaaauuaaauuuggccucaaagagagaacuuacucccuucuggauauuuu

SEQ ID NO: 456752 - RNA, 63 nt, Human
gcaaacccgagggaggaacuuggucugggaggaagagagaacucgcuccucaaccaccccaga

SEQ ID NO: 456753 - RNA, 64 nt, Human; identical to SEQ ID NO: 135832

SEQ ID NO: 456754 - RNA, 64 nt, Human; identical to SEQ ID NO: 135833

SEQ ID NO: 456755 - RNA, 64 nt, Human; identical to SEQ ID NO: 135834

SEQ ID NO: 456756 - RNA, 63 nt, Human
guaguaugaacuccaaggcaauuuuaaauaggcagagagaaguuuauaguuuugaaaacagcu

SEQ ID NO: 456757 - RNA, 63 nt, Human
cccagucauaaaucugcuuuuccauuauaaggcagagagaaguacauucguucauuuguccac

SEQ ID NO: 456758 - RNA, 63 nt, Human
aaaggaaacacgaaagaaaagucaggaagguagagagagaaaaagggagggaaggagaaagaa

SEQ ID NO: 456759 - RNA, 63 nt, Human
auaguugaaccucuucacuuuauaaaaaaggaaagagagaaaaucacugcuguauacuaaaua

SEQ ID NO: 456760 - RNA, 51 nt, Human
acuaccgcauaaauggauagaagagagaagcaccugugcuguggaguggca

SEQ ID NO: 456761 - RNA, 63 nt, Human
gggacccccacuaagacccuggucugaggauguagagagaacaggugggcuguauucacgcca

SEQ ID NO: 456762 - RNA, 63 nt, Human
gugagggcuacacccaauuccaaaagccugagaagagagaaguggagggggaggcgagugugu

SEQ ID NO: 456763 - RNA, 63 nt, Human
auuucaaagcccugccucuguguagccgcccugagagagaauagagcugccacugggcaccug

SEQ ID NO: 456764 - RNA, 63 nt, Human
uucaguguuuuguguuuccccacacgauuugucagagagaaaugaaagcaagccugaaaccaa

SEQ ID NO: 456765 - RNA, 63 nt, Human
uucaguggaagauauucuuuccuguuucccagaagagagaaauaaaaguccuaaauaacuaag

SEQ ID NO: 456766 - RNA, 63 nt, Human
ccagcacccugccccgcuucccagggcuggccaagagagaagacuggacggcagggaggucaa

SEQ ID NO: 456767 - RNA, 63 nt, Human
ccaagaauuuggucaugaaccauuaaagaauuuagagagaacuuagcucuuuuuagacucuuu

SEQ ID NO: 456768 - RNA, 63 nt, Human
augaagaauguuauugccccagaauauggggugagagagaacugcacuuuuuuaauauggaaa

SEQ ID NO: 456769 - RNA, 63 nt, Human
aaaguguaguagggauuaauucccauaaguuauagagagaauucuaauucccuguaauucgca

SEQ ID NO: 456770 - RNA, 63 nt, Human
cuccacuauggugugugccuuuuauaaaggaaaagagagaaaaaggcaaagcaagguuguggc

SEQ ID NO: 456771 - RNA, 63 nt, Human
cuggacauuaguguacagcccauguccaagcccagagagaaaacaaugggaacaauuucaagg

SEQ ID NO: 456772 - RNA, 63 nt, Human
cccucaaaggagaugccacgcaggacagacuggagagagaagccugggcaauacugcccgccu

SEQ ID NO: 456773 - RNA, 64 nt, Human; identical to SEQ ID NO: 135835

SEQ ID NO: 456774 - RNA, 64 nt, Human; identical to SEQ ID NO: 135836

SEQ ID NO: 456775 - RNA, 64 nt, Human; identical to SEQ ID NO: 135837

SEQ ID NO: 456776 - RNA, 63 nt, Human
aacaucacucccucucccucccuaacagugaaaagagagaagggagacucuauuuaagauucc

SEQ ID NO: 456777 - RNA, 63 nt, Human
uacgaaaucuuagugcccacggaggccucgagcagagagaaugaaagucuuuuuuuuuuuuuu

SEQ ID NO: 456778 - RNA, 63 nt, Human
ccaccgcuuaccccagcccuccccugggagcagagagagaaacccucuucauggaccagacuc

SEQ ID NO: 456779 - RNA, 63 nt, Human
guccugagaccacgggcaaagcucuucauuuugagagagaagaaaaacuguuuggaaccacac

SEQ ID NO: 456780 - RNA, 63 nt, Human
acugaaucacuuugcauuucaguuuauauauauagagagaaagaaggugucugcucuuacauu

SEQ ID NO: 456781 - RNA, 63 nt, Human
aauuaaaauaaccucacaagaaguuuaaugaguagagagaauucccauguacacuucaccaaa

SEQ ID NO: 456782 - RNA, 63 nt, Human
ucugagacacagcugccagcaaaccugagggaaagagagaagauuagugcucggggucaccau

SEQ ID NO: 456783 - RNA, 63 nt, Human
agccgagucaaaggaaagagaaaagacaagucaagagagaaagugggaccagggggccaaugc

SEQ ID NO: 456784 - RNA, 63 nt, Human
ucauaagugauuuggagcuuugguaaagggaccagagagaaggagucaccugcagucuuuugu

SEQ ID NO: 456785 - RNA, 63 nt, Human
ccauccccgcuaccguccuggccagcuaccgucagagagaaccagagcuccaagucuuuaauu

SEQ ID NO: 456786 - RNA, 63 nt, Human
accugcuaucaggaaaucuacaugugugcacagagagagaaaaguagaacaguucuuugcauu

SEQ ID NO: 456787 - RNA, 63 nt, Human
uccaccaguagggauaggggaaaaguaaccaaaagagagaaagagaaaggaaugcugguuuau

SEQ ID NO: 456788 - RNA, 63 nt, Human
ggcugccagcuuaaugaauuuagauguacuuuaagagagaaagacugguuauuucuccuuugu

SEQ ID NO: 456789 - RNA, 63 nt, Human
auuguaguaaugcauggcugaagcauaaaagggagagagaauuucuuuauauacacaaacaua

SEQ ID NO: 456790 - RNA, 63 nt, Human
gccacgugaacauccggcgaaggggacccaggcagagagaaaaggaaauccaagcccugaggu

SEQ ID NO: 456791 - RNA, 63 nt, Human
gucccuuuugcugucugccgucuuuuguacaagagagagaacagcggagcaugacuuaguuca

SEQ ID NO: 456792 - RNA, 63 nt, Human
gcucaucuguggugucagaauccuuggagcugaagagagaaaucaaaagagcaugaugauggc

SEQ ID NO: 456793 - RNA, 64 nt, Human; identical to SEQ ID NO: 135839

SEQ ID NO: 456794 - RNA, 64 nt, Human; identical to SEQ ID NO: 135840

SEQ ID NO: 456795 - RNA, 59 nt, Human; identical to SEQ ID NO: 135841

SEQ ID NO: 456796 - RNA, 63 nt, Human
auaagucacuaugcagacuaauaaacaucaacuagagagaacucccaacugcuguugugcguc

SEQ ID NO: 456797 - RNA, 63 nt, Human
gugggauguuguucccauucuucuuugugagacagagagaaugugauauagagaaaucuggcu

SEQ ID NO: 456798 - RNA, 63 nt, Human
ccucgucuaaagaggcagcugagugagagacacagagagaaggagaaagagggagggagagag

SEQ ID NO: 456799 - RNA, 63 nt, Human
gagacacagagagaaggagaaagagggagggagagagagaaagagagagaaagagagagagag

SEQ ID NO: 456800 - RNA, 63 nt, Human
gagaaggagaaagagggagggagagagagaaagagagagaaagagagagagagagagagagag

SEQ ID NO: 456801 - RNA, 63 nt, Human
gagaaagagagagaaagagagagagagagagagagagagaaagcugaacgugcacucugacaa

SEQ ID NO: 456802 - RNA, 63 nt, Human
auaauccaacgcugcuagucuuaaccccagaccagagagaacugcagaucugacugggccuaa

SEQ ID NO: 456803 - RNA, 63 nt, Human
acuucguacuuuccgagaguuuaacuggugcuuagagagaaaugcaucacuuccaaacccaug

SEQ ID NO: 456804 - RNA, 63 nt, Human
uugcucaacuacugcaggaucucaggacuaaggagagagaaggcuaaauagagaggaguuuag

SEQ ID NO: 456805 - RNA, 63 nt, Human
uguaugugguguuuuaaccuaauaaaguugaugagagagaaggggagaggaagcgaacauaaa

SEQ ID NO: 456806 - RNA, 63 nt, Human
aaagauuuggguuauauuuucaacuugggggacagagagaaauggagagcaggaauuacaguu

SEQ ID NO: 456807 - RNA, 63 nt, Human
gccaggggcugguagacaagaacugugaaagagagagagaaaaaaccucaacuguguauuuug

SEQ ID NO: 456808 - RNA, 63 nt, Human
cuggagagcccaggugggcacagagaaggguggagagagaaucugggaagagaaauggagaau

SEQ ID NO: 456809 - RNA, 63 nt, Human
augaacaccaaauuuaaagauuuuuaacaugucagagagaagagaguuaaaauuuaaaaaugc

SEQ ID NO: 456810 - RNA, 63 nt, Human
gaguauuuucaggauuuguuucuaugagacgagagagagaagccuccgcuccuuaaugugaaa

SEQ ID NO: 456811 - RNA, 63 nt, Human
ugugcagcagugccauugacugcccugauguucagagagaaacgcacacaagguuugcccaug

SEQ ID NO: 456812 - RNA, 63 nt, Human
aucagcccucaggcacaguugggccaagcagaaagagagaaacacuucugcugucaccuugaa

SEQ ID NO: 456813 - RNA, 63 nt, Human
uuuucccaauccaacagcauccuuuuuuuuaaaagagagaauuagaaaauauuaaauccugca

SEQ ID NO: 456814 - RNA, 62 nt, Human
gugugaaguuugcaagcuugcuuuagggcugagcccuggacucccagcagcagcacaguuca

SEQ ID NO: 456815 - RNA, 62 nt, Human
gccaguaggggcgggaggaaaggcggaggcgagcccuggaggagggaggccacaacuccgag

SEQ ID NO: 456816 - RNA, 63 nt, Human
uauuuccuuuauagguuuuauuucuggucauagagagagaaggaccuuugacuuuuucuucgu

SEQ ID NO: 456817 - RNA, 63 nt, Human
ccucauaaacauuuccccuaagacuccccucucagagagaaugcuccauucuuggcacuggcu

SEQ ID NO: 456818 - RNA, 63 nt, Human
auaauguaggugaucggagcucuuuccuuugauagagagaacagccccaaugauccuggcuuu

SEQ ID NO: 456819 - RNA, 63 nt, Human
uuuaaauugugaaauggauccaaucauuagaacagagagaauaguucuuugaaacugaaauac

SEQ ID NO: 456820 - RNA, 63 nt, Human
agccaauuguauuguauugauaauuggacaaagagagagaaagaaagaaggaaggaaggaaaa

SEQ ID NO: 456821 - RNA, 63 nt, Human
ugagagaacucagcaagccaaccugggaaucagagagagaaggagaaggaggggagccugucc

SEQ ID NO: 456822 - RNA, 63 nt, Human
ccucucugaaggaggccaccuccuaaaaggcccagagagaagagccccacucucagaggcccc

SEQ ID NO: 456823 - RNA, 63 nt, Human
cccgguggaccuugggguuggugaauccuaaacagagagaauucgagguugccugaaagcugg

SEQ ID NO: 456824 - RNA, 63 nt, Human
acugguacagcaaugggugagaugagaucauggagagagaacacagccauccccuauagaaag

SEQ ID NO: 456825 - RNA, 63 nt, Human
uuaaaguuauuuuagucaugaaauuuuauaugcagagagaaaaaguuaccgagacagaaaaca

SEQ ID NO: 456826 - RNA, 63 nt, Human
aaggaucaucgccguugaaaugaaaagagagacagagagaaaaaaaaaaagagaacccacaug

SEQ ID NO: 456827 - RNA, 63 nt, Human
ugauggacccuuuccuaaugagccuccucaauaagagagaaguucucauugugggaaucugac

SEQ ID NO: 456828 - RNA, 63 nt, Human
uuucauauuucuaaaaggggccaaugcaaaaggagagagaaggacuggauuuaagccaguuua

SEQ ID NO: 456829 - RNA, 63 nt, Human
uaauugcccugucugcucacuucuagcuauuuaagagagaacccagcuugguucuuuuuugcu

SEQ ID NO: 456830 - RNA, 63 nt, Human
auaugugagaggcagagagggcgaguggcugcgagagagaaugagccucccgccagacaggag

SEQ ID NO: 456831 - RNA, 63 nt, Human
aauauuuuucaucacaugccaaaaacgggggauagagagaaggaguggcaggccuaggccccu

SEQ ID NO: 456832 - RNA, 63 nt, Human
accuguagcuugaaaggggaaagauuggagguaagagagaaaaugaaagaacaccucuggguc

SEQ ID NO: 456833 - RNA, 62 nt, Human
agauuuggaugggacccagggcuccugacucugcccuggaagguucauggggaaacucgcuc

SEQ ID NO: 456834 - RNA, 62 nt, Human
aggugaaggccaaagcggguguugguggucaggcccuggauucuccguuagauacacuuggc

SEQ ID NO: 456835 - RNA, 62 nt, Human
ggagaggacccucaggccucugagggcaccaggcccuggagaagaggugcaauucagggugu

SEQ ID NO: 456836 - RNA, 63 nt, Human
ggcggguggggugcagggagggagaggcaggggagagagaauggcaucucgcguggagggcug

SEQ ID NO: 456837 - RNA, 63 nt, Human
agucccucuaucccuucuccuguccaggggcccagagagaaacacaccuaccccuggccuugc

SEQ ID NO: 456838 - RNA, 63 nt, Human
uccucuuuccguggcuggggguagacuuaauaaagagagaaauucaagaacugcuugcuuuau

SEQ ID NO: 456839 - RNA, 63 nt, Human
aagaaacagugcagggugcccagugcacacacuagagagaaauugugaacauuaaggacaagg

SEQ ID NO: 456840 - RNA, 63 nt, Human
caggucucagccuggggguggcagggguggggcagagagaauacugacagcagaggucuuggu

SEQ ID NO: 456841 - RNA, 63 nt, Human
aaagauuacccaaaaacugucuuuaaaagagagagagagaaaaaaaaaauaguauuugcauaa

SEQ ID NO: 456842 - RNA, 63 nt, Human
caucgccuuuuccuuccaucaguugaguggcugagagagaagugccucaucccugagccacac

SEQ ID NO: 456843 - RNA, 63 nt, Human
gcuucaggggaacacaggcgcuugaaaaagaaaagagagaacagcccauaaugcuccccggga

SEQ ID NO: 456844 - RNA, 63 nt, Human
aaucucauggaugguucucaaagguaaaaaaagagagagaaagagagagagcuagcuguggga

SEQ ID NO: 456845 - RNA, 63 nt, Human
gagaaugcgauggauuuuauuacacaugguggaagagagaagaggcguguagguuugcaaaca

SEQ ID NO: 456846 - RNA, 63 nt, Human
aaugaaguaaauaugggaaguuauugccaaaugagagagaaacuaugggaaagcugaucuaua

SEQ ID NO: 456847 - RNA, 63 nt, Human
acugcagagaggcuacuggaagguuaaggacccagagagaaaucgagaggugcccuacagcag

SEQ ID NO: 456848 - RNA, 63 nt, Human
guuuuguguaauccaguugauugcuccucuggcagagagaaggagcucaaaagauacuugaug

SEQ ID NO: 456849 - RNA, 63 nt, Human
ucccuguuuccugggcuagucuuggaccccacgagagagaaucguuccucagccucaugguga

SEQ ID NO: 456850 - RNA, 63 nt, Human
gcaucuccguaaaugugcucugcuccucagcugagagagaaaaaaauaaacuguauuuggcug

SEQ ID NO: 456851 - RNA, 63 nt, Human
agaguacuugucaucuugaauauagccuccccaagagagaacagggugguauucuaaguaugu

SEQ ID NO: 456852 - RNA, 63 nt, Human
ccgacagggaaagaggauuccuccaaugcuccuagagagaaagccugagcaggagaugaugca

SEQ ID NO: 456853 - RNA, 62 nt, Human
agggcggggcuggccccacccccaugaccacugcccuggagguggcggccugcugcuguuau

SEQ ID NO: 456854 - RNA, 62 nt, Human
ugcuucugaaaggcuuuggccuuccucagugagcccuggagggguuggccuucucuccuccc

SEQ ID NO: 456855 - RNA, 62 nt, Human
uuucuguguccccaugcugccucugaaauagcgcccuggaacaacccugccccugcacccag

SEQ ID NO: 456856 - RNA, 63 nt, Human
accugagacauagacgacuuuucauggauauugagagagaacaaguuaaagaacaacaaaggc

SEQ ID NO: 456857 - RNA, 63 nt, Human
gggucucacagaccccuccaggggcugacaccuagagagaaccaucaccuugucccucauucc

SEQ ID NO: 456858 - RNA, 63 nt, Human
uugagggaagagggagacuggggagaagggaaaagagagaaggcagggagaguagggagagaa

SEQ ID NO: 456859 - RNA, 63 nt, Human
cacuagugccaugggaaccaggucugaaaaaguagagagaagugaaaguagagucugggaagu

SEQ ID NO: 456860 - RNA, 63 nt, Human
acuugaaaagauuaggaaucuacgcauacacugagagagaaaaaagugagaggaagacuauaa

SEQ ID NO: 456861 - RNA, 63 nt, Human
uugaauaaggauuuaaaauaccugcacaaggauagagagaaacuaugugacucauucugugaa

SEQ ID NO: 456862 - RNA, 63 nt, Human
cagcaguaaauccaaguagguauauccgugcucagagagaauucuccauaguucugacuccug

SEQ ID NO: 456863 - RNA, 63 nt, Human
gugcagaauucuuuugguucuuugguuccagagagagagaagaugcuugugccagguggcacc

SEQ ID NO: 456864 - RNA, 60 nt, Human
agacccuugugguugacuagggcugggagcagagagaagccuggcgcccucggcccuccc

SEQ ID NO: 456865 - RNA, 63 nt, Human
uucuaguuuggcacaugcagguaguuggugaacagagagaaccaggaggguaacagaagagga

SEQ ID NO: 456866 - RNA, 63 nt, Human
gacuuguuuuuuaagaaaauauauauuauauauagagagaauuggucucguuuaaacacgccg

SEQ ID NO: 456867 - RNA, 63 nt, Human
ccccugcauuuguccugggaaacacgguauuuaagagagaacuauauugguauuaaagcuggu

SEQ ID NO: 456868 - RNA, 63 nt, Human
guggguuuccccuuugauucuguaaauagucccagagagaauucgugggcugagggcaauucu

SEQ ID NO: 456869 - RNA, 63 nt, Human
ccugcaucuccccuucuuuccuucccccucaggagagagaaaacuuagugcuuccagcccuuc

SEQ ID NO: 456870 - RNA, 63 nt, Human
ugacaagcaaaccacaugcuaaggcuuggagcaagagagaauuugugucuauuggcaaagaac

SEQ ID NO: 456871 - RNA, 59 nt, Human
gcuccagcccugaagacugaacuguuggcagagagaagcugguggaguccuguggcuuu

SEQ ID NO: 456872 - RNA, 63 nt, Human
ccuuaucucaaaaaaaaaaaaaaaaagagagagagagagaaaaagaaaugcuguguuuaaucu

SEQ ID NO: 456873 - RNA, 62 nt, Human
ggaauaaagacuaguuuacaaaggagaaagaggcccuggacuucccaaggaaagggucaggu

SEQ ID NO: 456874 - RNA, 62 nt, Human
cucuccagccuccaaguucaaccugcagggaagcccuggaaauccugucucccucugcccug

SEQ ID NO: 456875 - RNA, 62 nt, Human
ggaaggugcucccaucggaggggacccucagagcccuggagacugccaggugggccugcugc

SEQ ID NO: 456876 - RNA, 63 nt, Human
agucucucugaaaaugaaaagcuuaggaccagaagagagaauuggagcuguacgagugugucu

SEQ ID NO: 456877 - RNA, 63 nt, Human
aagccaaagaucuaugccucuguuuuuucagugagagagaaauagcaaauguucuuucuaugc

SEQ ID NO: 456878 - RNA, 63 nt, Human
aaugauucaucauccuccaaagcaagaggcuuaagagagaaacaccgaaauucagauagcuca

SEQ ID NO: 456879 - RNA, 63 nt, Human
ccuacucugaucacucuguucucuuuguuuuaaagagagaauuuuguaaaccauuuauugaau

SEQ ID NO: 456880 - RNA, 63 nt, Human
uguguguguguguguacucuguguguguaugagagagagaaaugcuaaccuuguagcauguga

SEQ ID NO: 456881 - RNA, 63 nt, Human
ccuggagggguguuguauggcugagcaagagagagagagaaugagagagagacugugugugug

SEQ ID NO: 456882 - RNA, 63 nt, Human
gguuucauuguuuccuucugacuuaagcaauagagagagaauuuguuuugguacucuucagag

SEQ ID NO: 456883 - RNA, 63 nt, Human
ggggggaggcaggaggcacaugugaggguccccagagagaagggagugggugggcagggguag

SEQ ID NO: 456884 - RNA, 63 nt, Human
acucuucucucagccaaagccuccaaagggacuagagagaagccuccugcuccccucgccugc

SEQ ID NO: 456885 - RNA, 63 nt, Human
ugcacccccucaccgccaacucuguuauucaguagagagaaguguacggcuuucugauuggug

SEQ ID NO: 456886 - RNA, 63 nt, Human
ccaagaaaaauuuccaaaacuauugagagagagagagagaaaguauugaaauuuuguucugcc

SEQ ID NO: 456887 - RNA, 63 nt, Human
acugcagaagcucacugccuauaagaggaaauaagagagaaaguggaggagagggacaaaagg

SEQ ID NO: 456888 - RNA, 63 nt, Human
ucaugcagaugaaacauccagguagcaagcuucagagagaauagacugugaauguuaaugcca

SEQ ID NO: 456889 - RNA, 63 nt, Human
auggagcaggaaggauaaaaaauaaagaaagacagagagaaacaaauuugcugggagagggaa

SEQ ID NO: 456890 - RNA, 63 nt, Human
gcuucauauuacuggaaugaauuuauucucuucagagagaaauauuagguuagugcaaaagua

SEQ ID NO: 456891 - RNA, 63 nt, Human
uuucugaguaugcuuaagacaucuuaaaaauauagagagaauucuaaauucagcugaaggcaa

SEQ ID NO: 456892 - RNA, 63 nt, Human
ccuggucuacauaggaccucuagauaguguuagagagagaacauguagugguaaugagugcuu

SEQ ID NO: 456893 - RNA, 62 nt, Human
ccugcccagagcugaguuggggguguggcucugcccuggaaagggggugaccucuugccucg

SEQ ID NO: 456894 - RNA, 62 nt, Human
uggaggccaucgagcgugccgcuuucuucguggcccuggaugaggaauccuacuccuaugac

SEQ ID NO: 456895 - RNA, 62 nt, Human
gcuccaucccuacagacuccuccccgaguccugcccuggaaccaaaggaaggaggaacacug

SEQ ID NO: 456896 - RNA, 63 nt, Human
uauugaaguaacuggagaauugccaauacagccagagagaaagggacuacagcuuuuuagagg

SEQ ID NO: 456897 - RNA, 63 nt, Human
aaaaaaggaaaaaaaagagggaaaauuacaaaaagagagaaaaaaagugaaugacguuuguuu

SEQ ID NO: 456898 - RNA, 63 nt, Human
cuuccugaaacuauauuuugucauaucaaauaaagagagaacaggacuaaagaugcaguggcu

SEQ ID NO: 456899 - RNA, 63 nt, Human
accuggcccucaucccaacagcccagcaaggggagagagaaagagaauucuuuucuauagaac

SEQ ID NO: 456900 - RNA, 63 nt, Human
guucggggauauauuaagauauuuuuguacauaagagagaaagagagagaaaaauuuauagaa

SEQ ID NO: 456901 - RNA, 63 nt, Human
auauuaagauauuuuuguacauaagagagaaagagagagaaaaauuuauagaaguuuuguaca

SEQ ID NO: 456902 - RNA, 63 nt, Human
uucauuccaccuauucucugaaaauauucccugagagagaacagagagauuuagauaagagaa

SEQ ID NO: 456903 - RNA, 63 nt, Human
cagagccgacggaggaggaggagccuuccaaacagagagaaaaaaaugaggccgaaaauuuag

SEQ ID NO: 456904 - RNA, 63 nt, Human
cagguaaacuagaaauuuccccuucaugaagguagagagaaggggucucucccaacauauuuc

SEQ ID NO: 456905 - RNA, 63 nt, Human
uguucaauggaaauagaaaauaaacaccauaaaagagagaagagagguaauuuguuagcauca

SEQ ID NO: 456906 - RNA, 63 nt, Human
ucugucucagaaaaaaaaaaaaaaaagagagagagagagaaagagaacaauauuugggagaga

SEQ ID NO: 456907 - RNA, 63 nt, Human
aaguuuucaauguaagaggaaggguggagaaggagagagaaauaugugagguaguaaggagga

SEQ ID NO: 456908 - RNA, 63 nt, Human
uguugaccaugauaaugcaaauaacagaaggagagagagaaugaacccuuucuggguguuuca

SEQ ID NO: 456909 - RNA, 63 nt, Human
auaacuuucaggauguauuuuaaaugagcugcaagagagaaaaaucugacaggagaugggauu

SEQ ID NO: 456910 - RNA, 63 nt, Human
cuccuucucuuuucucagggacaaaugaggcccagagagaauacgaccuguguaaggucaaac

SEQ ID NO: 456911 - RNA, 63 nt, Human
cuugcgagacugaagugcuaucuucucuggacuagagagaagagggagaggacuggaagggau

SEQ ID NO: 456912 - RNA, 63 nt, Human
aggagccaggcccggcaugaggaccugacgcugagagagaaccaucauaccccaagccaggca

SEQ ID NO: 456913 - RNA, 62 nt, Human
ugcagaaaugagugauaaauuuggccaugaaagcccuggaauuuuaggaaaguugugauucu

SEQ ID NO: 456914 - RNA, 62 nt, Human
gcugaccacagcaaugaccagcccucauuagggcccuggaugauuuuuggucuaauaacgca

SEQ ID NO: 456915 - RNA, 62 nt, Human
gcagugagaggaaggcagugcagagcuggccagcccuggagguaggcugggaccaagcucug

SEQ ID NO: 456916 - RNA, 63 nt, Human
gagaggaggcugaauuucucaagccauuaggagagagagaaauugggagugguccccaaagac

SEQ ID NO: 456917 - RNA, 63 nt, Human
uacucuguguaccugcuccagccccacccccacagagagaacuuguggcucuggggcuggggu

SEQ ID NO: 456918 - RNA, 63 nt, Human
acauacuaccucaagugaacuuuuauuuaaaagagagagaaucuuauguuuuuuaaauggagu

SEQ ID NO: 456919 - RNA, 63 nt, Human
acaguauuagaauuacugaauuaacaaugagaaagagagaaguguaucuguuacguggauaua

SEQ ID NO: 456920 - RNA, 63 nt, Human
aaaaaaaaaauucauuuucuuuggguuagagcuagagagaaggccccaagcuucuaugguuuc

SEQ ID NO: 456921 - RNA, 63 nt, Human
uuuugaaauguuuuuuuaaugaaaaugaaggucagagagaauaauugcccugaccacauuugc

SEQ ID NO: 456922 - RNA, 63 nt, Human
augccuccaaauaaacagugucacaaguacagaagagagaaauauuguuuaaggcuagcacau

SEQ ID NO: 456923 - RNA, 63 nt, Human
cagauaaggaggccaggugcaaggcagggaggcagagagaauguugugcuuccuuuagcuuuu

SEQ ID NO: 456924 - RNA, 63 nt, Human
cauuugguuuuaugaauacaaagauaagugaaaagagagaaaggaaaagaaaaaggagaaaaa

SEQ ID NO: 456925 - RNA, 63 nt, Human
uuacuggcaugguaucauuccuagaagaaaaaaagagagaaacuugacugcacauuaaaaaaa

SEQ ID NO: 456926 - RNA, 63 nt, Human
cucaacuuugaggaaagacagggccuuggucagagagagaaugcucugaacucugcuaaggac

SEQ ID NO: 456927 - RNA, 63 nt, Human
cuuuugccuuuauuucguaaaguuuuauacagaagagagaagagcaugucuuuacuugaaaaa

SEQ ID NO: 456928 - RNA, 63 nt, Human
ucuucugagaggaucuguggaggucaacccaggagagagaagacaggacugaagcacugaaag

SEQ ID NO: 456929 - RNA, 63 nt, Human
ggaaaccuggcuuugcucuggacaaaggguuccagagagaagcuagaagucccccuugaauga

SEQ ID NO: 456930 - RNA, 63 nt, Human
ccuugcuagcuaguucuuacuucauaagguuuuagagagaaauaaacgcaguaaugcaugaag

SEQ ID NO: 456931 - RNA, 63 nt, Human
uuuccuagagaaagagagagagagaggagaaagagagagaaggagagagacaguagccaagag

SEQ ID NO: 456932 - RNA, 63 nt, Human
uauuugugguuuuuauuuugaacgcuugcuuuuagagagaaaacaauauagcccccuacccuu

SEQ ID NO: 456933 - RNA, 64 nt, Human; identical to SEQ ID NO: 135842

SEQ ID NO: 456934 - RNA, 64 nt, Human; identical to SEQ ID NO: 135843

SEQ ID NO: 456935 - RNA, 64 nt, Human; identical to SEQ ID NO: 135844

SEQ ID NO: 456936 - RNA, 63 nt, Human
ucaaggccuguuugaauguggcagguuagaaagagagagaaugucuuucauuugaagaguguu

SEQ ID NO: 456937 - RNA, 63 nt, Human
agaguaagaauaaaaacuaccaaagugauauacagagagaaaaaaagacuuagagaagaggaa

SEQ ID NO: 456938 - RNA, 63 nt, Human
ccccaaaauagcugcccuuaaagaguuguuagcagagagaaaaauaacagugaaugugcuccu

SEQ ID NO: 456939 - RNA, 63 nt, Human
aaguauacacucagcaauaauuagaaaaaaaggagagagaaaagugauuuaaacaggguggau

SEQ ID NO: 456940 - RNA, 63 nt, Human
agaauuaaugaugcuuaaagagaaaagaaaaaaagagagaagaaaaaggagagaugaaaaagg

SEQ ID NO: 456941 - RNA, 63 nt, Human
uguugcucauauauuacucaaguauuuaaauuuagagagaaugccgcucuguuuaaagcaaug

SEQ ID NO: 456942 - RNA, 63 nt, Human
ccuucagcuaucuguggggaccuuguuuauucuagagagaauucuuacucaaauuuuucguac

SEQ ID NO: 456943 - RNA, 63 nt, Human
ugugauaaccaggcucccauuuaacugaguauaagagagaauaaaugauuucucuaaggucau

SEQ ID NO: 456944 - RNA, 63 nt, Human
ucuccuguuaugagaauaucaguugguauaaagagagagaaagagaaaaacauuucagcccuu

SEQ ID NO: 456945 - RNA, 63 nt, Human
uccucaauagcuacagagaacuugcaaaggaguagagagaauguuugagguccagccuuggug

SEQ ID NO: 456946 - RNA, 63 nt, Human
cgaaugugcuuuuuauuguaauucaacagcuauagagagaaagauaacuuauuguguguuuga

SEQ ID NO: 456947 - RNA, 63 nt, Human
acacuuuuuagaacacgcagauccuuugucuacagagagaaaaauugccuucaucccccaaga

SEQ ID NO: 456948 - RNA, 63 nt, Human
auuagcagaugacuuuuuuccauuguuuucuccagagagaaugugcuauauuuuuguauauac

SEQ ID NO: 456949 - RNA, 63 nt, Human
uuccccugcccuuguccugaugccucaaggcuuagagagaaacauuguauccagaccgagggc

SEQ ID NO: 456950 - RNA, 63 nt, Human
uccuauauaagaucuguggaguguguguuucaaagagagaacuacagaaauguuaaagcagga

SEQ ID NO: 456951 - RNA, 63 nt, Human
cuucauggaucuucccuugccugucuuagucacagagagaaauaagaggagguuguuugcauc

SEQ ID NO: 456952 - RNA, 63 nt, Human
acuggaagaaugaaaauaauuuuuuucuguggaagagagaaaaugagugaauauucuucucac

SEQ ID NO: 456953 - RNA, 63 nt, Human
gaaagaucucucucgagcguaccauaaaccugcagagagaagucucgaaaggcuccaccaggu

SEQ ID NO: 456954 - RNA, 55 nt, Human
aggccaaaaacaaccagugaaaagaagagagaagacccuucucgaccacgggaag

SEQ ID NO: 456955 - RNA, 63 nt, Human
agaggcauuggcgagguucgcagcgccccagggagagagaaaaagcugagacuccuggggaau

SEQ ID NO: 456956 - RNA, 63 nt, Human
gagcgagagagaguacgugcacacgcgcacaaaagagagaaacggacaccagaggaaugaacu

SEQ ID NO: 456957 - RNA, 63 nt, Human
ggccucuccuagacugcaggcugcagccaguccagagagaauagagccugcccaggccuuaag

SEQ ID NO: 456958 - RNA, 63 nt, Human
ggggguuugucuggcauagccaugcugguagcaagagagaaaaaaucaacagcaaacaaaacc

SEQ ID NO: 456959 - RNA, 63 nt, Human
cuuggagggaaaagauucuuuauuccaauuuccagagagaagagaaaacucacccaggaaguu

SEQ ID NO: 456960 - RNA, 63 nt, Human
cugguacuccuuuaguuuuaaaauuaggaguuaagagagaagaggugauaaacauaguaggga

SEQ ID NO: 456961 - RNA, 63 nt, Human
aguuuaugggagaagggcaaagacuucaugggaagagagaaggaaggcccuggguagaaacgc

SEQ ID NO: 456962 - RNA, 63 nt, Human
gaaaaggcagaauacuggcaagaaaugaggaagagagagaaaaacaauauaacuuucuugagu

SEQ ID NO: 456963 - RNA, 63 nt, Human
ggugccacaaaggaauuccagguccgagccaacagagagaaacaugaauuuuuagacacaugc

SEQ ID NO: 456964 - RNA, 63 nt, Human
aggacuuuugauagaaauucagcuacaacccaaagagagaaagauugagucuuccugucacca

SEQ ID NO: 456965 - RNA, 63 nt, Human
agauugcgccauugcacuccagccugggcaacaagagagaaacucugucucaaaaaaaaaaaa

SEQ ID NO: 456966 - RNA, 63 nt, Human
caggaauucagugccuucaacaacgugagagaaagagagaagccagccacagaccccugggag

SEQ ID NO: 456967 - RNA, 63 nt, Human
uagcugagaccccacgugcgacagagagaggggagagagaaccaccacugccugacugcccgc

SEQ ID NO: 456968 - RNA, 63 nt, Human
acacacacacacacacacacacacgaaggagagagagagaaaacugauggggaaaacaagcug

SEQ ID NO: 456969 - RNA, 63 nt, Human
ggcaccaagggacaggagaagagaggaaauaacagagagaaugagagcgacacagacguuagg

SEQ ID NO: 456970 - RNA, 63 nt, Human
ucccuggccuuuccuuuuguaauaagaaagaagagagagaacuugaugcaaaguccacgaaaa

SEQ ID NO: 456971 - RNA, 63 nt, Human
uuuauuuuuauuuuuauuucuaucaaagacgguagagagaaacagcuugaugcuguuucuaca

SEQ ID NO: 456972 - RNA, 63 nt, Human
cuaacuggacagccucuucugucccaagucuccagagagaaaucaggccugaugagggggaau

SEQ ID NO: 456973 - RNA, 62 nt, Human
auuacguacuuguugaguacaaacugcaccaagcccuggagacccauuaccaccguuaaccc

SEQ ID NO: 456974 - RNA, 62 nt, Human
gucauuucuuuuugguuugcaaaaagagcacagcccuggacuacaaguuuggagauuuaaau

SEQ ID NO: 456975 - RNA, 62 nt, Human
cucauacugugcuggagccacuaacuagagcagcccuggagucaugccaagcauuuaaugua

SEQ ID NO: 456976 - RNA, 63 nt, Human
ucaaacaugauagaaauuuucuaaauuuuaguaagagagaagcuuuuaaaacaguacauuccu

SEQ ID NO: 456977 - RNA, 63 nt, Human
aguguugaggagcagaggugagaagagagagagagagagaaagucaaauaaagucaaagacca

SEQ ID NO: 456978 - RNA, 63 nt, Human
cagauuucugcaugugcacuuuuguuuacugaaagagagaaaggggggggucacagcaacaug

SEQ ID NO: 456979 - RNA, 63 nt, Human
aaauuauguaaaauguuuacuuauucugagcuuagagagaauggggaggguauuuuuaaauuu

SEQ ID NO: 456980 - RNA, 63 nt, Human
cacugcgcccagccacugccaucaucuuuaggaagagagaagugaccaugccugaaccaguca

SEQ ID NO: 456981 - RNA, 63 nt, Human
ccuggcugggauccucaggaccugaggcuccacagagagaaauuccuggaaucuggaccccau

SEQ ID NO: 456982 - RNA, 63 nt, Human
ggcguggacuaucuaccuccagacuguuuuacaagagagaaauuagcauauuccaucuaauac

SEQ ID NO: 456983 - RNA, 63 nt, Human
aagaggcuaaauaaaaugagacuaguuuaauauagagagaaaaauaccuuuauggaguaaacg

SEQ ID NO: 456984 - RNA, 63 nt, Human
cccacccaagacauuuuaauaguaaauagagagagagagaagaguuaaugaacaugagguagu

SEQ ID NO: 456985 - RNA, 63 nt, Human; identical to SEQ ID NO: 456971

SEQ ID NO: 456986 - RNA, 63 nt, Human
gccucacuucccugggcucugcagagaacacacagagagaagacuuucagagcucacaggagc

SEQ ID NO: 456987 - RNA, 63 nt, Human
cccuuuuggcagacucuccaccugaguucagugagagagaaaaugauuuagaucuuggugcug

SEQ ID NO: 456988 - RNA, 63 nt, Human
caccuuucacauauaguucaacaacauuaauccagagagaauuuuauguuuuaugauaugggu

SEQ ID NO: 456989 - RNA, 63 nt, Human
uucagaaauguauuuauucucagaaacagaaccagagagaaguuaaacaaaagguuauguaac

SEQ ID NO: 456990 - RNA, 63 nt, Human
acaucauaguaauuugucaugggcaacaugaccagagagaagauuuuugucaugauuuuaaau

SEQ ID NO: 456991 - RNA, 63 nt, Human
gcgccuagaaauugaaaggcaaaaacuagagagagagagaauggaacgcgaacgcuuggaaag

SEQ ID NO: 456992 - RNA, 63 nt, Human
ggggacaaauggggacaggaaggaucaaguuguagagagaaaaagaaaacaagagauauacau

SEQ ID NO: 456993 - RNA, 62 nt, Human
agaaggugcacauacucccaagggccacucuugcccuggagaucuuggccuuggggccaaag

SEQ ID NO: 456994 - RNA, 62 nt, Human
cuucucaagcuucccuccaaagaaacugauuggcccuggaaccuccaucccacucuuguuau

SEQ ID NO: 456995 - RNA, 62 nt, Human
gccuccuuguucaugaccaagaccaaaccugggcccuggauggccuuggccugucccgagga

SEQ ID NO: 456996 - RNA, 63 nt, Human
guuuugagggggauggggccggccaagccauucagagagaacauggguccagaggacauucuc

SEQ ID NO: 456997 - RNA, 63 nt, Human
uuuacugguuuggcaugcgguauggaaauucuaagagagaaaguuuuaaggcaaugaaucaca

SEQ ID NO: 456998 - RNA, 50 nt, Human
gaugccucauggagaauuaaagagagaagccuccuuaaggagccacagga

SEQ ID NO: 456999 - RNA, 63 nt, Human
guuuuacaggucgagucuaugcugucuugucaaagagagaaggucggguacuucaagaagaaa

SEQ ID NO: 457000 - RNA, 63 nt, Human
gaauguccaccagacaccagccccggggggcacagagagaacaacauuccucucugucaacau

SEQ ID NO: 457001 - RNA, 57 nt, Human
cuggaagaacaaugcagugagaucaacagagagaaggagaagaacacgcagcugaag

SEQ ID NO: 457002 - RNA, 63 nt, Human
auuaaaauauuucauccagauuuguuuacaucuagagagaaccccuuguagguuauaaggaaa

SEQ ID NO: 457003 - RNA, 63 nt, Human
ccagaauauugaguuauuucuuaacaaguuucgagagagaagggagcaagacaagagcaagca

SEQ ID NO: 457004 - RNA, 63 nt, Human
uaagucucugcagagagcaaggaguaacuacugagagagaaucaggacaauccugcagguggc

SEQ ID NO: 457005 - RNA, 63 nt, Human
agaugaugccauugcacuccagccugggcaacaagagagaagguccuucucaaaaaaaaaaaa

SEQ ID NO: 457006 - RNA, 63 nt, Human
guguuuuacaucuguaaacgguuucaaacagguagagagaaaaacaccacaauuaacacuguu

SEQ ID NO: 457007 - RNA, 63 nt, Human
aguuauuuuuccaucaccgagagagagagacagagagagaaaauaaacuaccccuccuauuca

SEQ ID NO: 457008 - RNA, 63 nt, Human
caacaagagcgagacuccguuuccaaaaaaauaagagagaauagaagaagcuacugcaugaug

SEQ ID NO: 457009 - RNA, 63 nt, Human
uaaaaacaugcugggugaugaaagauuaguuuuagagagaaaauguucaucugugcagaggau

SEQ ID NO: 457010 - RNA, 63 nt, Human
agcaccuuguaugauggcaggacaggcuccagcagagagaacugcacagugaccacuguauuu

SEQ ID NO: 457011 - RNA, 63 nt, Human
ccccgacaucaccccaaggacaacggcacaaguagagagaaacuaccuaccucacuucaaauu

SEQ ID NO: 457012 - RNA, 63 nt, Human
ccccgacaucaccccaaggacaacggcagaaguagagagaaacuaccuaccucacuucaaauu

SEQ ID NO: 457013 - RNA, 62 nt, Human
ggauucugugugcugccaucccaccugcagcugcccuggaauucccuucgcuguuugccuuc

SEQ ID NO: 457014 - RNA, 62 nt, Human
guggcuggcucaagccuggguccccgggcugagcccuggauuggguaucguggggcagguca

SEQ ID NO: 457015 - RNA, 62 nt, Human
uauucauguuucuuuaugcugcuggcuuuugugcccuggaagaucauaauagugaccaaaau

SEQ ID NO: 457016 - RNA, 63 nt, Human
agucuuuccuuugagcuagugacuugaaaagaaagagagaaggaaaagagaccauauuaaguc

SEQ ID NO: 457017 - RNA, 63 nt, Human
cacucacuucccgccucucuuuaguggcucuuuagagagaaacucuuucucccuuugcaaaaa

SEQ ID NO: 457018 - RNA, 63 nt, Human
gagcuuuuguuaucaguuccacgggguugcccuagagagaaaacaggcaaacucacagguuag

SEQ ID NO: 457019 - RNA, 63 nt, Human
aaggggagggaacaggguggguuuucucacugaagagagaaagcagaagguucuagauccugg

SEQ ID NO: 457020 - RNA, 63 nt, Human
cagagagugagagagagaaagagagugagagagagagagaaagagagagagagaugcuguuga

SEQ ID NO: 457021 - RNA, 63 nt, Human
gaguaaccaguuuccagagagccagagagugagagagagaaagagagugagagagagagagaa

SEQ ID NO: 457022 - RNA, 63 nt, Human
aaaaaaaaagaaaaaagaaaaaaaaaauccaaaagagagaagaguuuuugcauucuugagauc

SEQ ID NO: 457023 - RNA, 63 nt, Human
ugugugacucuuaacaauugcugucugaaaaugagagagaagacuucggaagcacauuguguu

SEQ ID NO: 457024 - RNA, 63 nt, Human
augaaggauguagaagcuuagcugccucagagaagagagaaccugaagaucugaggcaagcug

SEQ ID NO: 457025 - RNA, 63 nt, Human
auuagcaugaaacuugugggugugggaggauggagagagaacucuaacacaaaacaucuuauu

SEQ ID NO: 457026 - RNA, 63 nt, Human
cacuuuacaaaggaaauuugaauaaauggagagagagagaagccuuguuguuggauaggaaaa

SEQ ID NO: 457027 - RNA, 63 nt, Human
auucaugacuuugggaguggguaggaucauuggagagagaauugcacagaaaguccugaaguu

SEQ ID NO: 457028 - RNA, 63 nt, Human
aauaaaauucuaguaauuugaaaaaaaaaaaaaagagagaaaguuaaacaacauuauggugaa

SEQ ID NO: 457029 - RNA, 63 nt, Human
cccacuguaucugggcccaaggccagagggcccagagagaagccugagcaccguguuaccucc

SEQ ID NO: 457030 - RNA, 63 nt, Human
auugagcuaacagcaaaaaaaaaaaaaaaaaaaagagagaaagaaaggaguaaacagugguaa

SEQ ID NO: 457031 - RNA, 63 nt, Human
cuuaauguuuggagcuugccuuguaaucaacagagagagaaacuaaacacauacguaagaugg

SEQ ID NO: 457032 - RNA, 63 nt, Human
gauggaagaagcugagcaugucuuaccaaaaacagagagaacgagccugaauacagcagaugu

SEQ ID NO: 457033 - RNA, 62 nt, Human
cuuacaguaacugaguguggcgggaagggugggcccuggaggggcccaugugggcugaagga

SEQ ID NO: 457034 - RNA, 62 nt, Human
ggcaggggcuccaagccccagcguggggaagggcccuggagaagcccucauccucaugggaa

SEQ ID NO: 457035 - RNA, 62 nt, Human
gacccaggccauguucccaaaggccagcgggggcccuggauugugaugcagccucgggacag

SEQ ID NO: 457036 - RNA, 63 nt, Human
cagaagugcuggggcagggaggcccaggagaugagagagaagguccgaguaggugauagaaga

SEQ ID NO: 457037 - RNA, 63 nt, Human
auucuuuucuguguuuguuuugcacuuuaaaaaagagagaacacaugcaaaugaacuugcuug

SEQ ID NO: 457038 - RNA, 63 nt, Human
aguguuuggaauuuucuguucauagauauuggaagagagaauuugcuuuaucuguugucuaga

SEQ ID NO: 457039 - RNA, 63 nt, Human
acacauccugguagucccagugauguguaaaugagagagaagaauagacaggcuuccaaaccc

SEQ ID NO: 457040 - RNA, 63 nt, Human
auuugaccuuuaaccuucaccuguccaagaaagagagagaagccagagauagccugauccugc

SEQ ID NO: 457041 - RNA, 63 nt, Human
gaggaugcuguucucaguuugacuguggggaggagagagaaugggguacuagcaccccugaag

SEQ ID NO: 457042 - RNA, 63 nt, Human
gaugugugcugucuaaaauccaauguuguggguagagagaaugaguuugugacuaggagagac

SEQ ID NO: 457043 - RNA, 63 nt, Human
uuauuaguucauugccugcacuuacugaucggaagagagaaagaacaguuucaguauugagau

SEQ ID NO: 457044 - RNA, 63 nt, Human
aaagucuucaagggcugcuucaaacucaaacacagagagaaacucuauggguaucaaacagcu

SEQ ID NO: 457045 - RNA, 63 nt, Human
gcccuccuaagagagagagacagagagacagagagagagaaagagagagugugugggucuaug

SEQ ID NO: 457046 - RNA, 63 nt, Human
gaaaggguuacuugccuauggguucugguggcuagagagaaaaguagaaaaccagagugcacg

SEQ ID NO: 457047 - RNA, 63 nt, Human
uguacuuccaggcuuggauguaauuuuugcucuagagagaagcaaguggugggaaggagguag

SEQ ID NO: 457048 - RNA, 63 nt, Human
ugagaccugcacaacagcucauggucaugcaugagagagaaguggcuggccacagccagaggg

SEQ ID NO: 457049 - RNA, 63 nt, Human
uuccucccaucggagggagaagggguccuggggagagagaauuuauccagaggccugcugcag

SEQ ID NO: 457050 - RNA, 63 nt, Human
gccccuucacuucugaccacacuuccuguccagagagagaagugccccugcugccuccccaac

SEQ ID NO: 457051 - RNA, 63 nt, Human
uauugugguguuuuagaucacugaguguacagaagagagaaauucaaacaaaauauugcuguu

SEQ ID NO: 457052 - RNA, 63 nt, Human
gagaaauaucucauacaagugaaaggauacuggagagagaaauuacccauuucuaaaaaaaaa

SEQ ID NO: 457053 - RNA, 62 nt, Human
acguuuugcagggcucaguacgaggcugcccggcccuggagggcuccguaggucucagcaac

SEQ ID NO: 457054 - RNA, 62 nt, Human
ggaggcagagguggugggggcagggaugauaggcccuggaugugcccacagggaccaagaag

SEQ ID NO: 457055 - RNA, 62 nt, Human
acagaugaugccagcagcaggcgcggcugggggcccuggaucccggccaccagggggcuccu

SEQ ID NO: 457056 - RNA, 63 nt, Human
uucuagacuguuacaggugacggacgccucaagagagagaagagaaaaugaaagcagcugguu

SEQ ID NO: 457057 - RNA, 63 nt, Human
ccugagggacaacagacaucagaacaaacccccagagagaaacagucaaaaucagggcccggu

SEQ ID NO: 457058 - RNA, 63 nt, Human
gggcaaaugcuucuggaaaacccuucccugaagagagagaacgugugugugugugucggugau

SEQ ID NO: 457059 - RNA, 63 nt, Human
ugugugaggagccagaaacgcugaauccaauuaagagagaaaaauaauaauaacaauaaauga

SEQ ID NO: 457060 - RNA, 63 nt, Human
acugagacagggguauggggaagagcugagcaaagagagaaaggagguaguuuaagagucccu

SEQ ID NO: 457061 - RNA, 63 nt, Human
ugaacaaagccauauccuuuugcaguggggucgagagagaaaguagcacgcccgcccccugcu

SEQ ID NO: 457062 - RNA, 63 nt, Human
gccucaggguucugggaaagcaacagcuaucagagagagaagggccagaccccauagccucuu

SEQ ID NO: 457063 - RNA, 63 nt, Human
gaaaggaggagggagagagauggagaggaggggagagagaaagagagguggggagaggggaga

SEQ ID NO: 457064 - RNA, 63 nt, Human
guucuuuuccauguuuguuuugcacuuuaaaaaagagagaacacaugcaaaugaacuugcuug

SEQ ID NO: 457065 - RNA, 63 nt, Human
gugccugauuggaaaaaaaaaaaaaagagagagagagagaagaagaagaagaagagacacaaa

SEQ ID NO: 457066 - RNA, 63 nt, Human
cauguugaaaacgaaacgcagggaaaccgugcaagagagaacaguagaaaagauuuaacaugu

SEQ ID NO: 457067 - RNA, 63 nt, Human
uaucagcaucuggcauccaaagcaacaucagagagagagaacacagaagaaaagcaauugccc

SEQ ID NO: 457068 - RNA, 63 nt, Human
cccucuggcugccucugagucugaaucucccaaagagagaaaccaauuucuaagaggacugga

SEQ ID NO: 457069 - RNA, 63 nt, Human
aaguuauuuggaaagaaagaaagaaagagagagagagagaaagaaagaaagaaaggcugccuu

SEQ ID NO: 457070 - RNA, 63 nt, Human
aggauccuguacaauugcauuauucuaaauaucagagagaauauacacacuuuuuacuuuuaa

SEQ ID NO: 457071 - RNA, 63 nt, Human
aaauuauagccaagugacauuccucaagucaccagagagaauggaagcucaucacccaacauu

SEQ ID NO: 457072 - RNA, 63 nt, Human
aaaaggaaaauaggagaagguggaaaugggugaagagagaaguccccucacuagcugcaugag

SEQ ID NO: 457073 - RNA, 63 nt, Human
gaaugggcagaggugagagagagagagagaaagagagagaaugaaugcaguugcauugauuca

SEQ ID NO: 457074 - RNA, 63 nt, Human
agugccuuuugaaugggcagaggugagagagagagagagaaagagagagaaugaaugcaguug

SEQ ID NO: 457075 - RNA, 63 nt, Human
ugccuuuuccacaagcuuuucacaaagaaggugagagagaaggaaaccuugggaggaggacau

SEQ ID NO: 457076 - RNA, 63 nt, Human
gggcuagggaggaccaaagggaugguauugagaagagagaaagaagauagugagauuuaaguu

SEQ ID NO: 457077 - RNA, 63 nt, Human
aaaaaacacacaaaacaaaaacagaacaaaagaagagagaaggaaauuuuaucaauuaaaaau

SEQ ID NO: 457078 - RNA, 63 nt, Human
auauauaguaaguuuuuuuuuuuuaagagcaacagagagaagcagccuccucccugcugcggu

SEQ ID NO: 457079 - RNA, 63 nt, Human
uuuugugaagagugcaugaccuuaugguuuaacagagagaaaacauguccacucugcagaacu

SEQ ID NO: 457080 - RNA, 63 nt, Human
guucuuuucuguguuugucuugcacuuuaaaaaagagagaacacaugcaaaugaacuugcuug

SEQ ID NO: 457081 - RNA, 63 nt, Human
uaacuuuucaauuguaaauguuauuuucuaagcagagagaaaugcauauauuuuaaauggaau

SEQ ID NO: 457082 - RNA, 63 nt, Human
cuaggagggggauaaaugggaugcccuugccccagagagaacccaguucuagguacugucugg

SEQ ID NO: 457083 - RNA, 63 nt, Human
uuuuaugacccugauggcuucugaaacaggaaaagagagaaggaagacagaggccugugccca

SEQ ID NO: 457084 - RNA, 63 nt, Human
cacauacuauaaagaucuauuuuuuuuuuuuuaagagagaacguagggcuguucaggugcauu

SEQ ID NO: 457085 - RNA, 63 nt, Human
cuauuugugugguuauauagcccuuuauuuaaaagagagaaguuccuuuuacaaaguuauuaa

SEQ ID NO: 457086 - RNA, 63 nt, Human
gugcugugggaacggacuagagagaguugcgggagagagaaggagcaggcacgcugggccucg

SEQ ID NO: 457087 - RNA, 63 nt, Human
acucgguuguaacggggcugggaagaaaagcagagagagaauugcagagaaucagacuccuuu

SEQ ID NO: 457088 - RNA, 63 nt, Human
gcccgaacaugaagaaaaaugaccugacccuguagagagaacacagugugaauguuuccccuc

SEQ ID NO: 457089 - RNA, 63 nt, Human
ugcuuuccuaaggacucccauuuccaguauuaaagagagaaucaucaucaaggcaccguaggu

SEQ ID NO: 457090 - RNA, 63 nt, Human
auauauauauauauauauauauauauaaaguauagagagaaguucauacaaagcgugcacaag

SEQ ID NO: 457091 - RNA, 63 nt, Human
cuccagacggcuuucucaguuccaagauuuugcagagagaaggagcaaaccuuuucauuggaa

SEQ ID NO: 457092 - RNA, 62 nt, Human
gucauuucuuuuugguuugcaaaaagagcacagcccuggacuaugaguuuggagaucuaaau

SEQ ID NO: 457093 - RNA, 62 nt, Human
caacacuggagccgcugggagucacuggcuuugcccuggaauuugccagaugcaucucaagu

SEQ ID NO: 457094 - RNA, 62 nt, Human
ucacuuucucagaggaaaucccaagcuuaggagcccuggagccuuugugcucccacucaaua

SEQ ID NO: 457095 - RNA, 63 nt, Human
cugugccucaguuuccuucuccuuugaggggggagagagaacagugcagccccauuuccgguc

SEQ ID NO: 457096 - RNA, 63 nt, Human
caaaauacaguaugucacagucaugcacauucaagagagaaaauauaacaaguucuuuuauga

SEQ ID NO: 457097 - RNA, 63 nt, Human
guauaguuacugaacugauucugagaaaucuuuagagagaaaaaacucaacaguacaaauuaa

SEQ ID NO: 457098 - RNA, 63 nt, Human
gucccuauggacuguuuacuauccaaaaguucaagagagaaaacagcacuugaggucucauca

SEQ ID NO: 457099 - RNA, 63 nt, Human
uucucauuggaaauuuagcauuguagugcuuugagagagaaaggacuccugaaaaaaaaccug

SEQ ID NO: 457100 - RNA, 63 nt, Human
uugcuuucaagaucaugcuaaacaagaauuaauagagagaaaaaaaucuauaaagcauguguu

SEQ ID NO: 457101 - RNA, 63 nt, Human
uguccaacuauucgcaggacaccaggucccuucagagagaaauguggagagucaaggugucua

SEQ ID NO: 457102 - RNA, 63 nt, Human
cuacaaaguguugauccccuucuuucccaugagagagagaacuggugauacuccaacaccguc

SEQ ID NO: 457103 - RNA, 63 nt, Human
uuacaggccuuuccaaguuuccauucuccuuagagagagaacugugcuuccaaacagaaauca

SEQ ID NO: 457104 - RNA, 63 nt, Human
ucacuugauuccucaugacggaaaucacacuaaagagagaaaucagugaaguaaggaacgugg

SEQ ID NO: 457105 - RNA, 63 nt, Human
ucuguaacagcauuaacugucuuaaagagagagagagagaauuccgaauuggggaacacacga

SEQ ID NO: 457106 - RNA, 63 nt, Human
ucuuccuugcauauacaugaaaggacucauacgagagagaauccguaugaauguaaggauugu

SEQ ID NO: 457107 - RNA, 63 nt, Human
gucagugccuuuuuuaauacaugaaagaauucuagagagaagccauauacauguaaguaacau

SEQ ID NO: 457108 - RNA, 63 nt, Human
uauggacccuuccugccauuuguauuuugucccagagagaaaggcucuuuggggggccccucu

SEQ ID NO: 457109 - RNA, 63 nt, Human
ccucuggagccuucgccuggggagacagaacccagagagaaacaagagaguccagaagucccu

SEQ ID NO: 457110 - RNA, 63 nt, Human
guugaaaugaaggaaaaaauguuaagggcagccagagagaaaggucggguuacccacaaaggg

SEQ ID NO: 457111 - RNA, 63 nt, Human
auugauagaccgcuagcaagacuaaugaagaaaagagagaagaaucaaauagaugcaauaaaa

SEQ ID NO: 457112 - RNA, 62 nt, Human
uagauccccaaccccagauccccaugccucgagcccuggaucuccaagcucagcugcuggau

SEQ ID NO: 457113 - RNA, 61 nt, Human; identical to SEQ ID NO: 372403

SEQ ID NO: 457114 - RNA, 62 nt, Human
uggaaccucgaacccgagcuccugcagaaguggcccuggagauugagggucccuggacacuc

SEQ ID NO: 457115 - RNA, 63 nt, Human
cugcgggacagagugagacccugucugaaagaaagagagaaagaaagaaagaaagagagagaa

SEQ ID NO: 457116 - RNA, 63 nt, Human
gucugaaagaaagagagaaagaaagaaagaaagagagagaaagaaagaaagaaagaaagggaa

SEQ ID NO: 457117 - RNA, 63 nt, Human
aggaaggaaggaaaaagaaagagaaagagagagagagagaaagaaaaagaaagaaaaguaaga

SEQ ID NO: 457118 - RNA, 63 nt, Human
cgugcuuggccaaugacuguggagaggacugugagagagaaggucccagcgggggccagugaa

SEQ ID NO: 457119 - RNA, 63 nt, Human
ugcuucaaucagcugguccuuugugaagaacguagagagaaugcggcauaaccaccaauaaag

SEQ ID NO: 457120 - RNA, 63 nt, Human
cugacaacuaaauauccuuauccaaaucaauaaagagagaauccucccuccagaaggguuucu

SEQ ID NO: 457121 - RNA, 63 nt, Human
accauuuggaagcuugagagaaaccaaaauuaaagagagaaagagagagcgugcacgcuccug

SEQ ID NO: 457122 - RNA, 63 nt, Human
aagccucugagaugcagccgggaggugaacagcagagagaagaauguacccuucagaguggug

SEQ ID NO: 457123 - RNA, 63 nt, Human
uguggaguccgacaaagcuacuugaaggacacaagagagaaaagcucacuaagaagcuugaau

SEQ ID NO: 457124 - RNA, 63 nt, Human
ugcuacccucuauuucccacucagggcugucccagagagaaggcagccgaacugaggauuuag

SEQ ID NO: 457125 - RNA, 63 nt, Human
ccguggaaccccgaagccuggcgggagagagagagagagaagucuccucugcauuuuggguuu

SEQ ID NO: 457126 - RNA, 63 nt, Human
cccacgcacacacacaaggcagcgucgggugggagagagaaggccguuucuccuucuguagcc

SEQ ID NO: 457127 - RNA, 63 nt, Human
agcuuaucucguguucaaucgucugaucucuacagagagaaguggaaaaugcuguaucaaggg

SEQ ID NO: 457128 - RNA, 63 nt, Human
cccagggucuggugauggcagggauggggggagagagagaaaauccacaaauuccaaugucac

SEQ ID NO: 457129 - RNA, 63 nt, Human
gaaaacagaaacccgagaaagagagagacagagagagagaaaaaaaaucacccaccacccccc

SEQ ID NO: 457130 - RNA, 63 nt, Human
cugggaucuggcguuuauaaauaacuaguuuacagagagaaucacaaacaggauaacuuagua

SEQ ID NO: 457131 - RNA, 63 nt, Human
gccaacuugagaaauaaagggacagaguacaaaagagagaaauuuuaaagcuggguguccggg

SEQ ID NO: 457132 - RNA, 62 nt, Human
agccagccagcccagcgcccgcucacccaggagcccuggaucccggcgcgggaaagucacag

SEQ ID NO: 457133 - RNA, 62 nt, Human
gcaggggccucaggcuccucuccucaaaucaagcccuggacaggucucgcacccacaaguac

SEQ ID NO: 457134 - RNA, 62 nt, Human
agcgguacaagaguucugugccuguguguccagcccuggagccagccagugcauuuauuuua

SEQ ID NO: 457135 - RNA, 63 nt, Human
cuguauuccucaccccaccugugaacuccuaccagagagaaaccuuuuguauguaaagaauuu

SEQ ID NO: 457136 - RNA, 63 nt, Human
agccagauaucagcacaaacuuauuuaaaugggagagagaaggggagaaccaaucucaacuuc

SEQ ID NO: 457137 - RNA, 63 nt, Human
agcagagagagagagagagaaagagagagagagagagagaaggggcccaagagagacagcaca

SEQ ID NO: 457138 - RNA, 63 nt, Human
cucccacccccuccccgggcagcagagagagagagagagaaagagagagagagagagagaagg

SEQ ID NO: 457139 - RNA, 63 nt, Human
cuuuacuuuuacuuuuuuuuuuuuuucuuuggaagagagaagaacagaguguucgauucugcc

SEQ ID NO: 457140 - RNA, 63 nt, Human
uuaauccuuaugaaacaaaagauaauucauacuagagagaaacccuacaaauguaaagaaugu

SEQ ID NO: 457141 - RNA, 63 nt, Human
ucaauuccuaacagacauaagauaauucauacuagagagaaauucuacaaaccagaaagaugu

SEQ ID NO: 457142 - RNA, 63 nt, Human
uuuccauuaaguacaugugccaggaaacaagagagagagaaaguaaaggcaguaaugccuucu

SEQ ID NO: 457143 - RNA, 63 nt, Human
auggacguaauaagucuuauguacuuauuggugagagagaaaauccgugcauuguuuucaaaa

SEQ ID NO: 457144 - RNA, 63 nt, Human
aauuuguaaaaugagucaguuagguagucuggaagagagaauccagcguucucauuggaaaug

SEQ ID NO: 457145 - RNA, 58 nt, Human
gccccugcguccuccuguagcccaggcaagagagaagcaaccaccacaagcucucggg

SEQ ID NO: 457146 - RNA, 63 nt, Human
uuaaauccugugagucaucaaagaauuuauaucagagagaaaccauacaaguauaauaaaugu

SEQ ID NO: 457147 - RNA, 55 nt, Human
aagcugcagcuggaaggugaacagaagagagaacaaugcaccauugaaugcugga

SEQ ID NO: 457148 - RNA, 63 nt, Human
aaagauacagagagucaaauagagagaauggagagagagaaacauauauuauauauuauauag

SEQ ID NO: 457149 - RNA, 63 nt, Human
ugccuccuagaauaaagauacagagagucaaauagagagaauggagagagagaaacauauauu

SEQ ID NO: 457150 - RNA, 63 nt, Human
gaaugaaaugugcaaacaugggggugacaccacagagagaaccugugaaugcauucagaacau

SEQ ID NO: 457151 - RNA, 63 nt, Human
ugcuuucuaauuaaaaaaauaauaaccauggcaagagagaaagaaagagaaaguacucagagg

SEQ ID NO: 457152 - RNA, 62 nt, Human
auggugagaggccaggagaccuugucuggaaggcccuggaaggagaagcaccaccuuaccca

SEQ ID NO: 457153 - RNA, 62 nt, Human
gcuuaccucugcaggaggccgagugacagccagcccuggaaccccccgacccccgcagcugc

SEQ ID NO: 457154 - RNA, 62 nt, Human
cuuguggcccagcgcguccuuggaaaucuguggcccuggaggaggaacaggagggcccuggg

SEQ ID NO: 457155 - RNA, 63 nt, Human
acuagguucaauucccugaagguggccacuuuaagagagaaaucugaaaaccccauuugcuuu

SEQ ID NO: 457156 - RNA, 63 nt, Human
aauaaggagagaaaugaauguagagagagguagagagagaaauaugaacucuaacaaaggacu

SEQ ID NO: 457157 - RNA, 63 nt, Human
accucucuagcuggccagugcugaggagguuggagagagaaagggugaaagcagagagaccag

SEQ ID NO: 457158 - RNA, 63 nt, Human
cagaaaauaguuuccagcacauggauugaucugagagagaaugaggcucaguuguggauaguc

SEQ ID NO: 457159 - RNA, 63 nt, Human
cuugcucuaagaccugaaagacuuuugucacuaagagagaaacugucuucugggacuggacau

SEQ ID NO: 457160 - RNA, 63 nt, Human
caaguauaagcugaucugcuauagcuguccaucagagagaauacacguggcuauaacaucuau

SEQ ID NO: 457161 - RNA, 63 nt, Human
gcucuacuaaaagagagagaggaagcgagagagagagagaaaaaacaaaaaacagaaaacacg

SEQ ID NO: 457162 - RNA, 63 nt, Human
uuaucuccauuuuguaguugaagaaauaaguucagagagaaagauuccuucccaaggucaugc

SEQ ID NO: 457163 - RNA, 63 nt, Human
agccacaauaccugucaccagccuguuguuuuaagagagaaaaaaaaucaaggauaucugauu

SEQ ID NO: 457164 - RNA, 63 nt, Human
cgcugccuuuugugauacuuccugugcucccucagagagaaacggagugaccuuuuguccuuu

SEQ ID NO: 457165 - RNA, 63 nt, Human
uaaaauguguuugaaaaccugcuuuguagaugcagagagaagcuauaggaaacccaguaccac

SEQ ID NO: 457166 - RNA, 63 nt, Human
gggcaccagcaguuguggguggggagcaagggaagagagaaacucuucagcgaauccuucuag

SEQ ID NO: 457167 - RNA, 63 nt, Human
augugcuguuuggcaccguggcaagaugguaucagagagaaacccaucaauugcucaaauacu

SEQ ID NO: 457168 - RNA, 63 nt, Human
ucaggugucucacgucugggcugcaccaggcgaagagagaaauuaaagauuugagguuuuucc

SEQ ID NO: 457169 - RNA, 63 nt, Human
guguguaucugugcgugagugugagugugugugagagagaauuggugaguuuaaaauaaaagc

SEQ ID NO: 457170 - RNA, 63 nt, Human
uauccaaauguuuuaggauguauguuacuucuuagagagaaauaaagcauuuuugggaagaau

SEQ ID NO: 457171 - RNA, 63 nt, Human
cccucaucccacaucucaaagcagacaauguaaagagagaacaucucacacacccagcucgcc

SEQ ID NO: 457172 - RNA, 63 nt, Human
cucccucuuagaaucucuuaugaaaaaaugaucagagagaaaagugggguuuuguuuccccac

SEQ ID NO: 457173 - RNA, 62 nt, Human
acucaguggacacucagaccagcucccagauggcccuggacagcaggagagggugugggaug

SEQ ID NO: 457174 - RNA, 62 nt, Human
gugguccccuggagccuggccacgcccuugaagcccuggacacuggccacauucccuguggu

SEQ ID NO: 457175 - RNA, 63 nt, Human
cagagggaggagagaguuagaaaaauuuuugguagagagaaucaggugaaagagaugcccuaa

SEQ ID NO: 457176 - RNA, 63 nt, Human
cucgcuuuaguuuucaaccuuguuggugcugagagagagaaccgagaggucccaguacaaggg

SEQ ID NO: 457177 - RNA, 63 nt, Human
caggagcucucuacccaggggcaaggagagcccagagagaagcgcccuggucucuugagcuuc

SEQ ID NO: 457178 - RNA, 63 nt, Human
gcaaaugagguuccaggggggaguacuccaagcagagagaauggcaugugugaaggugugugu

SEQ ID NO: 457179 - RNA, 63 nt, Human
gagugagaugaguaauucagggaagagaagggaagagagaagagucuauuaugagcugguuac

SEQ ID NO: 457180 - RNA, 63 nt, Human
cucuucccccacauuaauaccuuuuccuuccucagagagaaaucuccccuaaccugaauugca

SEQ ID NO: 457181 - RNA, 63 nt, Human
aacucuggaacagaaaggcccuguaaagcccucagagagaagagagacuccagagaaggcucc

SEQ ID NO: 457182 - RNA, 63 nt, Human
auuagcacuguucacuacauuaacaugcaagagagagagaagccuuguuacauuuccugcuau

SEQ ID NO: 457183 - RNA, 63 nt, Human
ucuucagugugaaagaaaacacguuucuguaacagagagaacacaaaggccuguggauacucu

SEQ ID NO: 457184 - RNA, 63 nt, Human
caaagagaggaaucgccaaaacaaaucacgagaagagagaaggggacagaacagcgagagcaa

SEQ ID NO: 457185 - RNA, 63 nt, Human
gucuccaaaaaaagaaaauagagcuuuauaagcagagagaagaaaauaaucaucuaagaccau

SEQ ID NO: 457186 - RNA, 57 nt, Human
uggaacauccagaauguuaaccaugugagagagaauauguuuaauccauguauuggu

SEQ ID NO: 457187 - RNA, 63 nt, Human
ucaucugucaagaaauuaaaagaacaacacccuagagagaagucauccacacacaauccacac

SEQ ID NO: 457188 - RNA, 63 nt, Human
agugugaccccugugugguccagacagcccugcagagagaaaaccuuuauuccauuaucacca

SEQ ID NO: 457189 - RNA, 63 nt, Human
gauuggcaaccaagacuaaguuuuaaauccagaagagagaaauguuucacgcaagcagucccc

SEQ ID NO: 457190 - RNA, 63 nt, Human
ccuccuuaccacccaccaggccagauuuacaggagagagaaauccacuccacucuuccuuaag

SEQ ID NO: 457191 - RNA, 63 nt, Human
ggcaaugacugcgcagaguggauuaaaggcaaaagagagaagaguccaggaaggggcggggag

SEQ ID NO: 457192 - RNA, 63 nt, Human
uuccucuuaggauguuucaccaaggaaauauugagagagaagucggccagguaggaugaacac

SEQ ID NO: 457193 - RNA, 63 nt, Human
uuucuuuggacaacaggaagugaaccuuaaggaagagagaauucuguucuaaaacuccaaaau

SEQ ID NO: 457194 - RNA, 52 nt, Human; identical to SEQ ID NO: 372411

SEQ ID NO: 457195 - RNA, 63 nt, Human
cagugguucugauggguucagcccuagagagagagagagaagcggggagaauaagagugcacu

SEQ ID NO: 457196 - RNA, 63 nt, Human
gggcauaaguggcuguucugggagucauuccaaagagagaauaaaacuccugauccaacucgu

SEQ ID NO: 457197 - RNA, 63 nt, Human
cucucugcaagggagggggagagaagcagagggagagagaaggugacacggauggaagagugg

SEQ ID NO: 457198 - RNA, 63 nt, Human
aaaacuucaaguauuaaaauaauuuguacauguagagagaaaaaugacuuuuucaaaaauaua

SEQ ID NO: 457199 - RNA, 63 nt, Human
cccucucuuuaccuuuguugggggaaggaggcaagagagaaauuccuucuucccagccagaga

SEQ ID NO: 457200 - RNA, 63 nt, Human
cuuuccagagcaguccacggauauuuugauccaagagagaauuacucugacaaggagucccug

SEQ ID NO: 457201 - RNA, 63 nt, Human
gcugcuucagcagugacgauugagccauuugugagagagaauccggaagcguuagguauuaca

SEQ ID NO: 457202 - RNA, 63 nt, Human
caauagggcgagacuccgucucaauuuaaaacaagagagaaccagacugagucucugaagacc

SEQ ID NO: 457203 - RNA, 63 nt, Human
cccacccugcccgugggcauaaccuugacgaagagagagaaugauuggcaucugcuuuucucu

SEQ ID NO: 457204 - RNA, 63 nt, Human
aacacauaaaagguguuugugugugugugugugagagagaaagguauuaauuuauuuuuuuaa

SEQ ID NO: 457205 - RNA, 63 nt, Human
uggucuccccacagaccgcaggacugagccuggagagagaaguugcuugacggaugccacuug

SEQ ID NO: 457206 - RNA, 63 nt, Human
ugccguuuccuuuuuauggaucuguugggaaccagagagaaucaacagaucaaugacauagga

SEQ ID NO: 457207 - RNA, 63 nt, Human
cuccguucuuggugcuguauuugaaacggguguagagagaagcuuguguuuuuguuuguaaug

SEQ ID NO: 457208 - RNA, 63 nt, Human
gcaggcgaguuucuagaaccagagucuauauaaagagagaacuaacgccacgcuccugugccu

SEQ ID NO: 457209 - RNA, 63 nt, Human
uuuaugcucaccauuaugaauuggggucuucaaagagagaagguugaaaguggaaagcacuug

SEQ ID NO: 457210 - RNA, 63 nt, Human
aaucaccuuguguguuguagcucauuuguuucaagagagaaucaacagaucauauucaguguc

SEQ ID NO: 457211 - RNA, 63 nt, Human
ccucuccggaucugucgauuuggagaccuuccgagagagaaccaagggugcagucagcuuaaa

SEQ ID NO: 457212 - RNA, 62 nt, Human
aaagaccuuuuacaaaugauaccaauuaaacugcccuggaaagggcauaggugggcaucggc

SEQ ID NO: 457213 - RNA, 62 nt, Human
ccaugcuucuuuugcugccuuaagcccccuaugcccuggaggugagggcagcucucuugucu

SEQ ID NO: 457214 - RNA, 62 nt, Human
aaaauaaccaguggccuggccgaccugcucuggcccuggauuccccauccaucucauugucu

SEQ ID NO: 457215 - RNA, 63 nt, Human
ucauauuuagaaguaaaacacaaaacaaaaaagagagagaaaagaaaagaaaucacaauguau

SEQ ID NO: 457216 - RNA, 63 nt, Human
uagaauagguuuugaaugggagagguagaacagagagagaauuaagaagggaucugacuuaua

SEQ ID NO: 457217 - RNA, 63 nt, Human
uuaacuguaggguuuuuacuuuuuucuuggagcagagagaacaggcuguaaauggguugccaa

SEQ ID NO: 457218 - RNA, 63 nt, Human
gguggggcugcguggaggagggggccacgugugagagagaagaaaaugguggccggagauggg

SEQ ID NO: 457219 - RNA, 63 nt, Human
ggauaaaaaacaugucugcuucucauuuaaauaagagagaaaugaugccguuuuuuaaaugug

SEQ ID NO: 457220 - RNA, 63 nt, Human
ugucaugugaagcaggcugguaggcagacaggcagagagaaggucauggccaccgugaugggg

SEQ ID NO: 457221 - RNA, 63 nt, Human
uuacaccacagcauuguguggaauuugaggucuagagagaaccaauaaaagugguaauuggga

SEQ ID NO: 457222 - RNA, 63 nt, Human
uguucuccagaagggugcuaagucaccuacugaagagagaaccaacugacuuuccuauugacu

SEQ ID NO: 457223 - RNA, 63 nt, Human
aaggaggaggugucuggggugagggaguuagggagagagaagcaggcagauaaguuggagcag

SEQ ID NO: 457224 - RNA, 63 nt, Human
gaaaagaucuaauuucugucucagcugucuuaaagagagaacugaagcuuuugaugaaggugc

SEQ ID NO: 457225 - RNA, 63 nt, Human
uuucuacucauucaaagcacauuguagauauucagagagaagaacaaauggcuggcuuggcaa

SEQ ID NO: 457226 - RNA, 63 nt, Human
gucaaacagaggcaucagccugcuguugaucacagagagaaauugaguagaaagaccaaaaga

SEQ ID NO: 457227 - RNA, 63 nt, Human
auggugacauuguugaucaagacugggaauauaagagagaagcagguuuggagagaucaauuu

SEQ ID NO: 457228 - RNA, 63 nt, Human
guagggacuauuagagauggcaucucaucgaugagagagaaucacaaucagaauggaagcacu

SEQ ID NO: 457229 - RNA, 63 nt, Human
uuaucaauacaaugauaagacaccuuaauccugagagagaaaauuaaguacuguauauaggug

SEQ ID NO: 457230 - RNA, 63 nt, Human
ugccuccccuccauagucuuguuggagaagcccagagagaaugggacuccaacuaagggaacc

SEQ ID NO: 457231 - RNA, 63 nt, Human
ugagauuuugcccagcacauggagcuguaauccagagagaaggaaacguagaaauuuauuauu

SEQ ID NO: 457232 - RNA, 62 nt, Human
cugcagccccgaccucucagguuagacccugggcccuggagcuuaggggauucuccccaccc

SEQ ID NO: 457233 - RNA, 62 nt, Human
cuuucucuggcuccagaauaugcauaaucagcgcccuggaguccccugggccuggaccgcuu

SEQ ID NO: 457234 - RNA, 62 nt, Human
aacccuuucugugcaggagcagagccaggugggcccuggacauuuuuuuuuuuuuuaauaua

SEQ ID NO: 457235 - RNA, 63 nt, Human
auagaagagggaaggaaagagagaaggaaagagagagagaaagaaagucuccagaccaggaau

SEQ ID NO: 457236 - RNA, 63 nt, Human
cuacccgcucagcaacauagaagagggaaggaaagagagaaggaaagagagagagaaagaaag

SEQ ID NO: 457237 - RNA, 63 nt, Human
guuggauuuuuguguaugucugucacauuauuuagagagaaguaaucuuguaaaaauguuuug

SEQ ID NO: 457238 - RNA, 63 nt, Human
ucgaucaugcuuucuucaaggugacaggucuaaagagagaagaauccagggaacagguagagg

SEQ ID NO: 457239 - RNA, 63 nt, Human
gugauauggcuuguagggugaggcgugggauccagagagaagcaccccaccacacacacccuu

SEQ ID NO: 457240 - RNA, 63 nt, Human
uggaaaaaaacaucagaaauaauaaaaaauuucagagagaaucaagauaccuuuuuuuuucuu

SEQ ID NO: 457241 - RNA, 63 nt, Human
acccugccccuuucugucccauccuucccaagaagagagaacuuuuucgauaaacuaacuacu

SEQ ID NO: 457242 - RNA, 63 nt, Human
auuuguuucauuuuuugaaauucaggaauacacagagagaaggccuagagguuagagcacuag

SEQ ID NO: 457243 - RNA, 63 nt, Human
ggacuagauccaaagacuuguuucagaaagaugagagagaacucuguggauacucauggguac

SEQ ID NO: 457244 - RNA, 63 nt, Human
aguguauaacacguaguuuggaagugggaagcuagagagaauugagugugugcuguuuuguau

SEQ ID NO: 457245 - RNA, 63 nt, Human
aagcaauccagaggugccuucagggcaaagaauagagagaaagggagccgcugugcugguggg

SEQ ID NO: 457246 - RNA, 63 nt, Human
ugcauaauacaaucaaauuacuagauuuuuuaaagagagaaauaauuaccugcacaaagcaga

SEQ ID NO: 457247 - RNA, 63 nt, Human
aauaagaguacuugggcccucuuaagggagcucagagagaauuacuaaauuagggacaguuuc

SEQ ID NO: 457248 - RNA, 63 nt, Human
cucgucugggugugcgcacagggcuuuguuagcagagagaagccccugaggagaagggacgcu

SEQ ID NO: 457249 - RNA, 63 nt, Human
gugggcgcugcccagaaaauauauuucaauaaaagagagaagcaagcuugggucccuucuacu

SEQ ID NO: 457250 - RNA, 63 nt, Human
aaacacacugauggucaacacaggucaaaaccaagagagaauguguaguuuucaaggucuugg

SEQ ID NO: 457251 - RNA, 63 nt, Human
ugcaugauuggcauuaguuaccacagccugcccagagagaaacuaucuucucccaacauuuac

SEQ ID NO: 457252 - RNA, 63 nt, Human
aaaauguuacaaccgcuguaaaaugacggagagagagagaaagaaucccagacauuaacggua

SEQ ID NO: 457253 - RNA, 62 nt, Human
guucucguagggucccagccucaaugguucccgcccuggaccuccagcugcccugacucccc

SEQ ID NO: 457254 - RNA, 62 nt, Human
cccuucacgcccuugacacuaaggaguggggggcccuggacugccccuuccucccccaucgc

SEQ ID NO: 457255 - RNA, 64 nt, Human
aaggucaaggggcaggugcagagguggcagggauggcuccgaagccagaaaugccuuaaacugc

SEQ ID NO: 457256 - RNA, 64 nt, Human
cccccgugcuguccccgaccggcucacggggcugggcuccgaucuuccgugucucuuaucagug

SEQ ID NO: 457257 - RNA, 64 nt, Human
cuuaaccaccgcauaugcaugccaggcugggcacggcuccgagggcggccagggacagacgcuu

SEQ ID NO: 457258 - RNA, 64 nt, Human
gcgaggagggagggugaaggaacggagggcgggcggcuccgaggagcgagagucgggcugaggg

SEQ ID NO: 457259 - RNA, 64 nt, Human
ucccugagaauaaagccgauagccacccuccuccggcuccgagccugcuucugccacaccucgc

SEQ ID NO: 457260 - RNA, 64 nt, Human
ggacccuaacaaccuucaagaccagugaugggccggcuccgaggcuccgggcgggaaugggacc

SEQ ID NO: 457261 - RNA, 64 nt, Human
aagucaaacaucauagcuuagccuaccuuaaaagggcuccgaacacuacauuagccuacaguug

SEQ ID NO: 457262 - RNA, 64 nt, Human
ccagcggcuucugcgccgcccuccgcccuccgcuggcuccgagguggugggggcgccgcacgcu

SEQ ID NO: 457263 - RNA, 64 nt, Human
uugagaccagcagagacugcugugaguuucucccggcuccgaggcugaacggggacugugagcg

SEQ ID NO: 457264 - RNA, 64 nt, Human
cucacccagagaccuuggacuccggacuauccauggcuccgaaucuaagugcugcccacuccca

SEQ ID NO: 457265 - RNA, 64 nt, Human
aaccaucagucugugcuuaguuaacaugugucauggcuccgaucuucaucuugaagaagaguga

SEQ ID NO: 457266 - RNA, 64 nt, Human
gugugacgggggcaccuucggccgcuacugcgagggcuccgaggaugccugugaggagccgugc

SEQ ID NO: 457267 - RNA, 64 nt, Human
accccgugggcgacagcagguguggccaggguggggcuccgagccccgggucaccgcccgccca

SEQ ID NO: 457268 - RNA, 64 nt, Human
ccgcaagcugcagugcuagucccggcauccugauggcuccgacaggccugcuccagagcacggc

SEQ ID NO: 457269 - RNA, 64 nt, Human
ugggggccgagccugggaaugggggugaguggagggcuccgacucagggcagcuggaaaucuuc

SEQ ID NO: 457270 - RNA, 64 nt, Human
gggcagggaaggucagggcuacagaggcucuugaggcuccgaggcccuggggaucaaaggucaa

SEQ ID NO: 457271 - RNA, 54 nt, Human
ccuuccucucccgcaggugacaccggcuccgacacgccgcuaaccggccgcucg

SEQ ID NO: 457272 - RNA, 62 nt, Human
cagggugagaagcuagaugccccugcaguuuggcccuggagccagggcagaggaauguaggg

SEQ ID NO: 457273 - RNA, 62 nt, Human
gcucuccucagaguuggcuuuugaaccaaagugcccuggaccaggucagggccuacagcugu

SEQ ID NO: 457274 - RNA, 64 nt, Human
cgggcucgcgggcacucucggcggcagccucgggggcuccgacuccagcucugggcaagaucca

SEQ ID NO: 457275 - RNA, 64 nt, Human
ugugugcccaguuccuccugugggcacuuuagcaggcuccgagcuuuccuggcauaggucaauc

SEQ ID NO: 457276 - RNA, 64 nt, Human
agaccuucauaccuagaccuguuccgcacaccacggcuccgacacaucucacugugcugcgugg

SEQ ID NO: 457277 - RNA, 64 nt, Human
guuuuaaccuccccucuccccgggaccgcgcuagggcuccgaggagcuggggcgggcuaggagg

SEQ ID NO: 457278 - RNA, 64 nt, Human
uuguuuggaguuuucuguuggaaccgccggcguuggcuccgaagacuuagcgacgccacuggcg

SEQ ID NO: 457279 - RNA, 64 nt, Human
auucacuaaagcagcacauagcacugggaacucuggcuccgaaaaacuuuguuauauauaucaa

SEQ ID NO: 457280 - RNA, 64 nt, Human
ucaacuccaggggcaagauggggagugagcugauggcuccgagacuggucaggagcccaggcca

SEQ ID NO: 457281 - RNA, 64 nt, Human
uucucugacugcggaggcccugacccugccagcuggcuccgagggcaacacaggggccuggccu

SEQ ID NO: 457282 - RNA, 64 nt, Human
ucaaggacuugccuugccugauaaccagccagcaggcuccgaaucaccaucucccucacauguu

SEQ ID NO: 457283 - RNA, 64 nt, Human
caagcaguggccucucucacuuuagccauggaauggcuccgaucuaccucacagcagugucaga

SEQ ID NO: 457284 - RNA, 64 nt, Human
guccuacccaccuucccccggaagugucccaagaggcuccgaaggccuccccuccgagcccagc

SEQ ID NO: 457285 - RNA, 64 nt, Human
gaccacggcagggcccgugcugggugagggccggggcuccgaugccuucuucgacgcgcuggac

SEQ ID NO: 457286 - RNA, 64 nt, Human
ugcguggccgccuguggugugcacgugugcucugggcuccgaggcuucuccagagcugggagcu

SEQ ID NO: 457287 - RNA, 64 nt, Human
aggaagugugucaacuauuucuuuaggccuguuuggcuccgaagccuauaugugccuggauccu

SEQ ID NO: 457288 - RNA, 64 nt, Human
gcgcgggcccugcccuuuccucccgcgccccaccggcuccgacgcgcaaccccgcucagcaguc

SEQ ID NO: 457289 - RNA, 64 nt, Human
gaagaccaaucucuucuagcugccggccucuggaggcuccgagccugcccccagagacgucccu

SEQ ID NO: 457290 - RNA, 64 nt, Human; identical to SEQ ID NO: 135846

SEQ ID NO: 457291 - RNA, 59 nt, Human; identical to SEQ ID NO: 135847

SEQ ID NO: 457292 - RNA, 64 nt, Human; identical to SEQ ID NO: 135848

SEQ ID NO: 457293 - RNA, 64 nt, Human; identical to SEQ ID NO: 135849

SEQ ID NO: 457294 - RNA, 64 nt, Human
aagaggaugguguucgugguuuggcuaaaggaugggcuccgacuuuccuuggcuacuccaugca

SEQ ID NO: 457295 - RNA, 64 nt, Human
uugacuggcagggcggucacgggaccugcgggcuggcuccgaguggcagcccaugccuucugcg

SEQ ID NO: 457296 - RNA, 64 nt, Human
cauguccucaugagguggagcugaagagccaagaggcuccgagucugcagcagcagccagacca

SEQ ID NO: 457297 - RNA, 64 nt, Human
ucuacccggggcuuggcugucuguucugggcacuggcuccgaguuccccuccugggauuugcag

SEQ ID NO: 457298 - RNA, 64 nt, Human
uccguuuuggggcaugcagcccucuaucauuuuuggcuccgagaagagggcaaggggcccccgc

SEQ ID NO: 457299 - RNA, 64 nt, Human
guucugguucccacaugaguacauauuggccagcggcuccgagaugaugaacuccggggucuga

SEQ ID NO: 457300 - RNA, 64 nt, Human
ccacucaguggagcugggccugcagcagacucaaggcuccgagugcccugggggucaccccucc

SEQ ID NO: 457301 - RNA, 64 nt, Human
cccagggccacuggaacagccccacuggagucaaggcuccgagggaggagagaggggcucggga

SEQ ID NO: 457302 - RNA, 64 nt, Human
cggccuccugucugcaugcccccuguggccaccaggcuccgaggggccguggugacucuugauc

SEQ ID NO: 457303 - RNA, 64 nt, Human
ggggcagcucaguacccucccugaggcucacgguggcuccgagcaugagguccgccuccugggc

SEQ ID NO: 457304 - RNA, 64 nt, Human
uugcgggccggacgaaggaugcuuucuuccuagaggcuccgagcugagcugcgaacucgccccc

SEQ ID NO: 457305 - RNA, 64 nt, Human
ggucaucccugagcucauccacggcucaugcuguggcuccgaguagugguuugagugggcagga

SEQ ID NO: 457306 - RNA, 64 nt, Human
ccuuugggaaggccaucccccucaggacuguccuggcuccgaccuuuguguacacugcagacgc

SEQ ID NO: 457307 - RNA, 64 nt, Human
ggacuggggcaggcgagcccggacagggaagaggggcuccgaucaaagccggccgugcugcugg

SEQ ID NO: 457308 - RNA, 64 nt, Human
cauaguaggagagaccugugcaaaucugagcuccggcuccgaccccacacacccugagggagcc

SEQ ID NO: 457309 - RNA, 64 nt, Human
ccugaaagacacugcuccuuccucucauggaguuggcuccgacagcccgucugccaccaggcca

SEQ ID NO: 457310 - RNA, 62 nt, Human
gagaggcacagauguucugggggcugcccugagcccuggaaggguggggguggggcggggga

SEQ ID NO: 457311 - RNA, 62 nt, Human
cucccacccccaagguguccuccacaggcagggcccuggagagacgcucccugcucuccaua

SEQ ID NO: 457312 - RNA, 62 nt, Human
aguggacuaaccacagcagcagccagggaugggcccuggagguucccggccggagagugccu

SEQ ID NO: 457313 - RNA, 62 nt, Human
accuucagcugcuucuucacuguugaaaccaugcccuggaagacauauuuugaacuccugaa

SEQ ID NO: 457314 - RNA, 64 nt, Human
ucuggagucagaagugugaguuaucagccacucaggcuccgagccagcuggauucucugccugc

SEQ ID NO: 457315 - RNA, 64 nt, Human
aauccucucuguacuggaugugcggcagagggguggcuccgagccucggcucuaugcagaccuu

SEQ ID NO: 457316 - RNA, 64 nt, Human
ggucugacccuagaaugccaaggaacugagaaugggcuccgaugaaaaccuuccuuuucagauu

SEQ ID NO: 457317 - RNA, 64 nt, Human
gggcgagccuguacucugccugacgaggaacgcuggcuccgaagaggcccuguguagaaggcug

SEQ ID NO: 457318 - RNA, 64 nt, Human
gagucucgcucugacgcacaggcuggagugcaguggcuccgaucucugcucacugaaagcuccg

SEQ ID NO: 457319 - RNA, 64 nt, Human
cguggggacuacccauuuuauagcuggggaaacaggcuccgagaaauugcacaaccgaccucag

SEQ ID NO: 457320 - RNA, 64 nt, Human
cacagaaaugccuuuguccuuuguauaaucagcaggcuccgaggaaaaaguuucuucuuuugug

SEQ ID NO: 457321 - RNA, 64 nt, Human
cugggaccugguuccagccguuugcaggggaggcggcuccgagaggcgugugcuuuccgugggu

SEQ ID NO: 457322 - RNA, 64 nt, Human
gcccccggguccccggcaccauggcuacuaccggggcuccgacuacgacgaggccgauggcccg

SEQ ID NO: 457323 - RNA, 64 nt, Human
cggcugccccuuuguacaccgcgccgcggaagggggcuccgagggggcgcagccucaaacccug

SEQ ID NO: 457324 - RNA, 64 nt, Human
ugucccauccacaccagcuccccaugccagcuguggcuccgaggaaaaucacuccuacacgcua

SEQ ID NO: 457325 - RNA, 58 nt, Human
ccaccuucucccagcgcugaaacuugauggcuccgaacacccucgaagcgcgccacuc

SEQ ID NO: 457326 - RNA, 64 nt, Human
gccugggggaccccuggcucugggccgggccuggggcuccgaaauuccaaggcccagacuugcg

SEQ ID NO: 457327 - RNA, 64 nt, Human
ggaaccaccacagcagugccuucucgucgaagcgggcuccgaugcagggcagcucccccaugcg

SEQ ID NO: 457328 - RNA, 64 nt, Human
ugagucagacacggguuucgcagccauguuuccuggcuccgaggacacggguggcaggcccguu

SEQ ID NO: 457329 - RNA, 64 nt, Human
gacugggagagcccagcaggcaccuguauugcagggcuccgacugcauguggcaggggcuccug

SEQ ID NO: 457330 - RNA, 62 nt, Human
ggguuuccagagaugcucaccuugucucugcagcccuggagcccccugucccuggccguccu

SEQ ID NO: 457331 - RNA, 62 nt, Human
cacccuucagaccccaguucuaggggagaagagcccuggacaccccugcucuacccaugagc

SEQ ID NO: 457332 - RNA, 62 nt, Human
uccuccugccgcugaccagagcaugggaaauagcccuggauuggguaguggguguguggugc

SEQ ID NO: 457333 - RNA, 62 nt, Human
auggguguccgguuggguccuguguuuggucugcccuggaggugcugggcccuccugggaug

SEQ ID NO: 457334 - RNA, 64 nt, Human
aaggaccucuuugauuuggugugccggacucuggggcuccgagaaaccugguucuuuggacugc

SEQ ID NO: 457335 - RNA, 64 nt, Human
gaagccaagcccgguuccugcuacgccccauggaggcuccgagaccaucugcccagccucacug

SEQ ID NO: 457336 - RNA, 64 nt, Human
ccagcagcagcugugcagcauggaacucaggccaggcuccgaggcugggggaucugcuuggagu

SEQ ID NO: 457337 - RNA, 64 nt, Human
cgggcaggagcgcucccuggccccaacacaucggggcuccgaggcagugaccagaacguggucu

SEQ ID NO: 457338 - RNA, 64 nt, Human; identical to SEQ ID NO: 457255

SEQ ID NO: 457339 - RNA, 64 nt, Human; identical to SEQ ID NO: 457256

SEQ ID NO: 457340 - RNA, 64 nt, Human; identical to SEQ ID NO: 457257

SEQ ID NO: 457341 - RNA, 64 nt, Human; identical to SEQ ID NO: 457258

SEQ ID NO: 457342 - RNA, 64 nt, Human; identical to SEQ ID NO: 457259

SEQ ID NO: 457343 - RNA, 64 nt, Human; identical to SEQ ID NO: 457260

SEQ ID NO: 457344 - RNA, 64 nt, Human; identical to SEQ ID NO: 457261

SEQ ID NO: 457345 - RNA, 64 nt, Human; identical to SEQ ID NO: 457262

SEQ ID NO: 457346 - RNA, 64 nt, Human; identical to SEQ ID NO: 457263

SEQ ID NO: 457347 - RNA, 64 nt, Human; identical to SEQ ID NO: 457264

SEQ ID NO: 457348 - RNA, 64 nt, Human; identical to SEQ ID NO: 457265

SEQ ID NO: 457349 - RNA, 64 nt, Human; identical to SEQ ID NO: 457266

SEQ ID NO: 457350 - RNA, 64 nt, Human; identical to SEQ ID NO: 457267

SEQ ID NO: 457351 - RNA, 64 nt, Human; identical to SEQ ID NO: 457268

SEQ ID NO: 457352 - RNA, 64 nt, Human; identical to SEQ ID NO: 457269

SEQ ID NO: 457353 - RNA, 64 nt, Human; identical to SEQ ID NO: 457270

SEQ ID NO: 457354 - RNA, 54 nt, Human; identical to SEQ ID NO: 457271

SEQ ID NO: 457355 - RNA, 64 nt, Human; identical to SEQ ID NO: 457274

SEQ ID NO: 457356 - RNA, 64 nt, Human; identical to SEQ ID NO: 457275

SEQ ID NO: 457357 - RNA, 64 nt, Human; identical to SEQ ID NO: 457276

SEQ ID NO: 457358 - RNA, 64 nt, Human; identical to SEQ ID NO: 457277

SEQ ID NO: 457359 - RNA, 64 nt, Human; identical to SEQ ID NO: 457278

SEQ ID NO: 457360 - RNA, 64 nt, Human; identical to SEQ ID NO: 457279

SEQ ID NO: 457361 - RNA, 64 nt, Human; identical to SEQ ID NO: 457280

SEQ ID NO: 457362 - RNA, 64 nt, Human; identical to SEQ ID NO: 457281

SEQ ID NO: 457363 - RNA, 62 nt, Human
ugcuggugaccggccuggaccuuggcccuacagcccuggaggccgcugcugaccagcacuga

SEQ ID NO: 457364 - RNA, 62 nt, Human
aaggcacagcauauacagcauggucgccccuugcccuggagucugggaacaaagagaggagc

SEQ ID NO: 457365 - RNA, 62 nt, Human
gauuuugcugauggguucuuagagccuuagcagcccuggaugguggccagaaauaaagggac

SEQ ID NO: 457366 - RNA, 52 nt, Human; identical to SEQ ID NO: 372438

SEQ ID NO: 457367 - RNA, 64 nt, Human; identical to SEQ ID NO: 457282

SEQ ID NO: 457368 - RNA, 64 nt, Human; identical to SEQ ID NO: 457283

SEQ ID NO: 457369 - RNA, 64 nt, Human; identical to SEQ ID NO: 457284

SEQ ID NO: 457370 - RNA, 64 nt, Human; identical to SEQ ID NO: 457285

SEQ ID NO: 457371 - RNA, 64 nt, Human; identical to SEQ ID NO: 457286

SEQ ID NO: 457372 - RNA, 64 nt, Human; identical to SEQ ID NO: 457287

SEQ ID NO: 457373 - RNA, 64 nt, Human; identical to SEQ ID NO: 457288

SEQ ID NO: 457374 - RNA, 64 nt, Human; identical to SEQ ID NO: 457289

SEQ ID NO: 457375 - RNA, 64 nt, Human; identical to SEQ ID NO: 457294

SEQ ID NO: 457376 - RNA, 64 nt, Human; identical to SEQ ID NO: 457295

SEQ ID NO: 457377 - RNA, 64 nt, Human; identical to SEQ ID NO: 457296

SEQ ID NO: 457378 - RNA, 64 nt, Human; identical to SEQ ID NO: 457297

SEQ ID NO: 457379 - RNA, 64 nt, Human; identical to SEQ ID NO: 457298

SEQ ID NO: 457380 - RNA, 64 nt, Human; identical to SEQ ID NO: 457299

SEQ ID NO: 457381 - RNA, 64 nt, Human; identical to SEQ ID NO: 457300

SEQ ID NO: 457382 - RNA, 64 nt, Human; identical to SEQ ID NO: 457301

SEQ ID NO: 457383 - RNA, 62 nt, Human
gcucugaugcucugaggcuucugggaggcugggcccuggaggcaacgugcugcaggcgcacu

SEQ ID NO: 457384 - RNA, 62 nt, Human
ucucaaaagaggucauccggggacccacuguugcccuggaccucagcgggaaggagcaggag

SEQ ID NO: 457385 - RNA, 62 nt, Human
ggagccggggguggguacugaggccugcucaggcccuggaagugaggcucuaugggguuccc

SEQ ID NO: 457386 - RNA, 64 nt, Human; identical to SEQ ID NO: 457302

SEQ ID NO: 457387 - RNA, 64 nt, Human; identical to SEQ ID NO: 457303

SEQ ID NO: 457388 - RNA, 64 nt, Human; identical to SEQ ID NO: 457304

SEQ ID NO: 457389 - RNA, 64 nt, Human; identical to SEQ ID NO: 457305

SEQ ID NO: 457390 - RNA, 64 nt, Human; identical to SEQ ID NO: 457306

SEQ ID NO: 457391 - RNA, 64 nt, Human; identical to SEQ ID NO: 457307

SEQ ID NO: 457392 - RNA, 64 nt, Human; identical to SEQ ID NO: 457308

SEQ ID NO: 457393 - RNA, 64 nt, Human; identical to SEQ ID NO: 457309

SEQ ID NO: 457394 - RNA, 64 nt, Human; identical to SEQ ID NO: 457314

SEQ ID NO: 457395 - RNA, 64 nt, Human; identical to SEQ ID NO: 457315

SEQ ID NO: 457396 - RNA, 64 nt, Human; identical to SEQ ID NO: 457316

SEQ ID NO: 457397 - RNA, 64 nt, Human; identical to SEQ ID NO: 457317

SEQ ID NO: 457398 - RNA, 64 nt, Human; identical to SEQ ID NO: 457318

SEQ ID NO: 457399 - RNA, 64 nt, Human; identical to SEQ ID NO: 457319

SEQ ID NO: 457400 - RNA, 64 nt, Human; identical to SEQ ID NO: 457320

SEQ ID NO: 457401 - RNA, 64 nt, Human; identical to SEQ ID NO: 457321

SEQ ID NO: 457402 - RNA, 58 nt, Human
accggcuaauuuuauauuuuuaguagagacgggauaucuccguguuggucagucuggu

SEQ ID NO: 457403 - RNA, 58 nt, Human
acuggccccugacccagggacucuccaaacgggauacaggagagaagcuggucuagac

SEQ ID NO: 457404 - RNA, 58 nt, Human
aguaccuacugaggacuccauaaacagaacgggauacagagauaaacaauuuggguuc

SEQ ID NO: 457405 - RNA, 62 nt, Human
ggaauggcaagggcaagguagagugccuaggagcccuggacucaggcuggcagaggggcugg

SEQ ID NO: 457406 - RNA, 64 nt, Human; identical to SEQ ID NO: 457322

SEQ ID NO: 457407 - RNA, 64 nt, Human; identical to SEQ ID NO: 457323

SEQ ID NO: 457408 - RNA, 64 nt, Human; identical to SEQ ID NO: 457324

SEQ ID NO: 457409 - RNA, 58 nt, Human; identical to SEQ ID NO: 457325

SEQ ID NO: 457410 - RNA, 64 nt, Human; identical to SEQ ID NO: 457326

SEQ ID NO: 457411 - RNA, 64 nt, Human; identical to SEQ ID NO: 457327

SEQ ID NO: 457412 - RNA, 64 nt, Human; identical to SEQ ID NO: 457328

SEQ ID NO: 457413 - RNA, 64 nt, Human; identical to SEQ ID NO: 457329

SEQ ID NO: 457414 - RNA, 64 nt, Human; identical to SEQ ID NO: 457334

SEQ ID NO: 457415 - RNA, 64 nt, Human; identical to SEQ ID NO: 457335

SEQ ID NO: 457416 - RNA, 64 nt, Human; identical to SEQ ID NO: 457336

SEQ ID NO: 457417 - RNA, 64 nt, Human; identical to SEQ ID NO: 457337

SEQ ID NO: 457418 - RNA, 64 nt, Human
ccggacucuuaauuuccucaggacagacuagcuggcacauuaucccuaccuuaguucuuucucu

SEQ ID NO: 457419 - RNA, 62 nt, Human
gacuccgagagccccggagagaacguggcccagcccuggagggcaggcggccacucccccag

SEQ ID NO: 457420 - RNA, 62 nt, Human
gugguaggaccccggcggguguggcagcaacugcccuggagccccagccccugcguccaucu

SEQ ID NO: 457421 - RNA, 62 nt, Human
ccccaggaugcuguugcuguaggacgccugcugcccuggagcccuccccaggaugugagcca

SEQ ID NO: 457422 - RNA, 64 nt, Human
ccuucccacuguccuuucuccaggcccucagauggcacauuagggugggcgugcugcggguggg

SEQ ID NO: 457423 - RNA, 64 nt, Human
uuucagaaauguuaaaauagacuaaccucuaccagcacauuaaaagugauuguuucugggugau

SEQ ID NO: 457424 - RNA, 64 nt, Human
ugggagggggccagauacugacuaccugggguaggcacauuauguguuaaagcaagacagaggc

SEQ ID NO: 457425 - RNA, 64 nt, Human
accauaccauaauaucugcuuggagaaccacaaugcacauuagcauauuagucugagagagaac

SEQ ID NO: 457426 - RNA, 64 nt, Human
aacgguacuuuccaaugaaugguaacugauccaggcacauuaucacacuuccuagucaucucca

SEQ ID NO: 457427 - RNA, 64 nt, Human
aaagccacuucauauaggacuuaauaugucaaaagcacauuaugaagcagaaauuaaaaauagc

SEQ ID NO: 457428 - RNA, 64 nt, Human
ggcuagugugguuuucccgugcaucuucagccuggcacauuauggacacuuaaauacuacguau

SEQ ID NO: 457429 - RNA, 64 nt, Human
uuuggugguacccuccucccccagcccaucuguugcacauuauacuccguguguucuucaacuu

SEQ ID NO: 457430 - RNA, 64 nt, Human
aguccccucuccuccacauuuguuuugccaauuugcacauuaaaugacucuucccucaaaugug

SEQ ID NO: 457431 - RNA, 64 nt, Human
agcucugauuauucauccagggccuucucaaugagcacauuaccuccaugaucaauaaccaaga

SEQ ID NO: 457432 - RNA, 64 nt, Human
ccauauacuauguauguuuacauauacuauacaugcacauuagguguuuucauuuguguuuugc

SEQ ID NO: 457433 - RNA, 64 nt, Human
uuaaguauauuuuuuucuuuuucucauuuucaaugcacauuaguuuugcaucuguuuugugacc

SEQ ID NO: 457434 - RNA, 64 nt, Human
aguuagcaggaaauaguguucuuuuuaaaaaguugcacauuaggaacagaguauauauguacag

SEQ ID NO: 457435 - RNA, 64 nt, Human
ggauuucacuguuuuuggacugccuauaauaauagcacauuaaccuucacauaauaagaaaucu

SEQ ID NO: 457436 - RNA, 64 nt, Human
uccucaaaauaaguccuucuguuaauuuguaaaagcacauuagugcuuuaccugugaaauuccc

SEQ ID NO: 457437 - RNA, 64 nt, Human
uuuugaugucuuuuauuuuacaacugggccaaaggcacauuauguauauaauuaguuuauauuu

SEQ ID NO: 457438 - RNA, 62 nt, Human
cccugcagguauauugcaggggccugggggcggcccuggacuggcgggcgguuccccagugg

SEQ ID NO: 457439 - RNA, 62 nt, Human
cccuggacuggcgggcgguuccccaguggggugcccuggaggcugccgggcagaguggagca

SEQ ID NO: 457440 - RNA, 62 nt, Human
gucacacgguccugcccuagaguccccaucuggcccuggagcugcagaagcagcuucugagg

SEQ ID NO: 457441 - RNA, 64 nt, Human
cgaaaaaaaaaaaagugaagugaaaacaaucagggcacauuaaaaugauacaagucaaauaaau

SEQ ID NO: 457442 - RNA, 64 nt, Human
gaaagaugacauguauuugcacaaaaauucucaggcacauuaaauuauuguaaacugaaguaaa

SEQ ID NO: 457443 - RNA, 64 nt, Human
ugcaacgguauccagggacuaugaugagaggccagcacauuaucuucauaugucaccuuugcua

SEQ ID NO: 457444 - RNA, 64 nt, Human
uucuugcaauaagauauuacccucagaauauuaagcacauuauuguagagaaaaaaaaauaugu

SEQ ID NO: 457445 - RNA, 64 nt, Human
acacuguuguacaagaugucagcuuugcugaaacgcacauuaccuggaauaagugcuuuaauug

SEQ ID NO: 457446 - RNA, 64 nt, Human
ugacugugucucuugaacauacuuaggauauucugcacauuauggaaaaagguaaauuuuagaa

SEQ ID NO: 457447 - RNA, 64 nt, Human
ugggaagauggccaggaauggacucauaccauuggcacauuaggcuaauccugguuuuauguga

SEQ ID NO: 457448 - RNA, 64 nt, Human
ugauuggcaggaguuggaagugugugaucugugggcacauuagccuaugugcaugcagcaucua

SEQ ID NO: 457449 - RNA, 64 nt, Human
guauauauaauauaauauauauguuauauaaacugcacauuauauucaaacuuaaaauugagcu

SEQ ID NO: 457450 - RNA, 64 nt, Human
acuuuauuugaauaacaaggaaaacaguaacuaagcacauuauguuugcaacugguauauauuu

SEQ ID NO: 457451 - RNA, 64 nt, Human
ccuuugcaccagcccgagucuaggucugggccaagcacauuacaagugggaccgguggagcagc

SEQ ID NO: 457452 - RNA, 64 nt, Human
aguuucuuuugaaaagaacuauguuaauuuuuuugcacauuaaaaugcccuagcaguaucuaau

SEQ ID NO: 457453 - RNA, 64 nt, Human
guuuauauuuuuuuaacugugauaauccccacaggcacauuaacuguugcacuuuugaaugucc

SEQ ID NO: 457454 - RNA, 64 nt, Human
ccgaguuaaggaggggccuggcaggcguaucagagcacauuagugaugcccuucaccccaggga

SEQ ID NO: 457455 - RNA, 64 nt, Human
accacauauauucauuugugaguuuggauauagagcacauuaucuaaaccauuuuguaguucca

SEQ ID NO: 457456 - RNA, 64 nt, Human
ugagguuaacacugaaauauuaaaaucugcaaaugcacauuaaugcaaauuaaaugcagagaga

SEQ ID NO: 457457 - RNA, 62 nt, Human
uuugugcaaguagacggggucugugggugcaggcccuggaggggcacacaauugccuggagg

SEQ ID NO: 457458 - RNA, 62 nt, Human
ccugucugcccccugcccugagaguugcccgugcccuggacuugggcauguccuuguugcug

SEQ ID NO: 457459 - RNA, 62 nt, Human
ccuccccugcugcuggaaacccuucugaguuggcccuggaguggcucacgggcagagaaggg

SEQ ID NO: 457460 - RNA, 64 nt, Human
acuugagaaagaauccucuaaaaaucccggcucugcacauuauucaucuccuggaauuuccaug

SEQ ID NO: 457461 - RNA, 64 nt, Human
agccaccgugauagaaaaaaaaucuuuuugauaagcacauuaaaguuaauagaacuuacugaua

SEQ ID NO: 457462 - RNA, 64 nt, Human
aaguuaccucaucuuugaauuuagaauaaaaguggcacauuacauaucggaucuaagagauuaa

SEQ ID NO: 457463 - RNA, 64 nt, Human
cacauuccagcuacaauacuuccauuuauuagaagcacauuaaccauuucuauagcaugauuuc

SEQ ID NO: 457464 - RNA, 64 nt, Human
ccauuccugcucucccacugcacacagggugguggcacauuaucccucugggggguggggacgc

SEQ ID NO: 457465 - RNA, 64 nt, Human
aauggaucuucagcaaaccuuaacuucauugucugcacauuacauugaaguauuauaaaugcaa

SEQ ID NO: 457466 - RNA, 64 nt, Human
auguauacaaagauacgauuugaugaugacacuggcacauuauucuaaacuauucauucagcau

SEQ ID NO: 457467 - RNA, 64 nt, Human
uuauaccuuucuugguuugacgugcaauaaagaagcacauuauuuuagcuucuggcuacuguga

SEQ ID NO: 457468 - RNA, 64 nt, Human
auaccacaguuguuuuccuggauuauaaggaaaggcacauuacauuuagucuuccuuucgauau

SEQ ID NO: 457469 - RNA, 64 nt, Human
ccuuuccucauucauccuggagaggauugugcaggcacauuaauauugugaccaaucacagaau

SEQ ID NO: 457470 - RNA, 64 nt, Human
cccaaagguagaacuuagcucccuuuuaaaaggagcacauuaaaauucucagaggacuuggcaa

SEQ ID NO: 457471 - RNA, 64 nt, Human
uaacucuuguuuaccauucauguaacaaaacccagcacauuaucugcacuauaagcucaaagaa

SEQ ID NO: 457472 - RNA, 64 nt, Human
gguuuaauauuuaaauaucaaccaguguaauucagcacauuaauaaaguaaaaaagaaaaccau

SEQ ID NO: 457473 - RNA, 64 nt, Human
gcuacgcaaaguuacuggacaugcggucugcagugcacauuauaaggaauggaacaugaaaaua

SEQ ID NO: 457474 - RNA, 64 nt, Human
aucuguuuggaugagggaaaguaccucaugaguugcacauuacuucuacaacagggugugugug

SEQ ID NO: 457475 - RNA, 64 nt, Human
gagaauugcaaauuuuaccaaaagauggagaaaagcacauuaaaaagauaccaacauucagaaa

SEQ ID NO: 457476 - RNA, 62 nt, Human
uuucauuuccuuggugggggaggggggcgguugcccuggagagggccggggucggggagguu

SEQ ID NO: 457477 - RNA, 62 nt, Human
auugauucgaccugacugccguuggaccguaggcccuggacugcagagacccccgcccccga

SEQ ID NO: 457478 - RNA, 62 nt, Human
gccguuuuagguagagccuuaaaaaugcuucugcccuggaaucucaaccauugucuuccaag

SEQ ID NO: 457479 - RNA, 64 nt, Human
cacauuuguuguguuccuagggcuucucuauagugcacauuaggacguuucauuuguugcugaa

SEQ ID NO: 457480 - RNA, 64 nt, Human
uuuggagaaagcaaagcagugacccagugaccaggcacauuacucgugagcgagguauucccag

SEQ ID NO: 457481 - RNA, 64 nt, Human
ucaccucuucuuuaccagaacgguucuuugaccagcacauuaacuucuggacugccggcucuag

SEQ ID NO: 457482 - RNA, 64 nt, Human
uuacucuugccugugaaccucaugcaugaaagcagcacauuaaauuguaaaaauacaaacagau

SEQ ID NO: 457483 - RNA, 64 nt, Human
guguuacucagcugcauaguuacgcagauguaaugcacauuauuggcguaucuuuaaguuggau

SEQ ID NO: 457484 - RNA, 64 nt, Human
uguaucuagaugacacaaacgauauucugauuuugcacauuauuauagaagaaucuauaauccu

SEQ ID NO: 457485 - RNA, 64 nt, Human
auccaaccucuuuccucucuggccacucugcucugcacauuagagggacagccaaaaguaagug

SEQ ID NO: 457486 - RNA, 64 nt, Human
ggguaaauguauucacauauuaccaagagaagaagcacauuaucuaugaucuuuuggcccaguu

SEQ ID NO: 457487 - RNA, 64 nt, Human
caucacuuucauucaauuugcgacugcucugauggcacauuagaugaaguuacuguugauccug

SEQ ID NO: 457488 - RNA, 64 nt, Human
gaaagagaagacauggacaauuauggcugugacugcacauuagaaauuauuucacuggccgggu

SEQ ID NO: 457489 - RNA, 64 nt, Human
gugaaagucagaaucgccucagcauuuccaugacgcacauuaugcaaaucucuuuagcacuauu

SEQ ID NO: 457490 - RNA, 64 nt, Human
uuuuuuaacugaaaaaccuaguuaccugauuauugcacauuauaaaauuguuuuucuaauacuu

SEQ ID NO: 457491 - RNA, 64 nt, Human
gaauauccaauuuuggguggcaauaaauauauucgcacauuaagaaaaaaaagacuuaagcauu

SEQ ID NO: 457492 - RNA, 64 nt, Human
gcauuuagugaacgugacuaacaaagacuaaugugcacauuaacagauguacuuuuuaagguuu

SEQ ID NO: 457493 - RNA, 64 nt, Human
aagacucaaguguaaauaugucuauauggagaaagcacauuauauuuauugguuacuuacauuc

SEQ ID NO: 457494 - RNA, 64 nt, Human
uaacaaauaccagguauggcaaguugugaagacagcacauuaaaacauaccuaauuucacagua

SEQ ID NO: 457495 - RNA, 64 nt, Human; identical to SEQ ID NO: 189930

SEQ ID NO: 457496 - RNA, 64 nt, Human; identical to SEQ ID NO: 189931

SEQ ID NO: 457497 - RNA, 64 nt, Human; identical to SEQ ID NO: 189932

SEQ ID NO: 457498 - RNA, 64 nt, Human
caauucucuggggcagcaguucuaagcucugguugcacauuaggauuccuagagauucagauug

SEQ ID NO: 457499 - RNA, 64 nt, Human
aggauuuucuagcauguugcugcacuguucccaugcacauuauucuaacuuuuuaguaacucac

SEQ ID NO: 457500 - RNA, 64 nt, Human
aggugagaauuucaaggauuaucgacuucauauugcacauuaaaguuacaaauuaaaguggcuu

SEQ ID NO: 457501 - RNA, 64 nt, Human
ggguaauggaaaacauuaccuagaguugccaguggcacauuacaccaguacagagcacauucca

SEQ ID NO: 457502 - RNA, 64 nt, Human
aaauuauauuuucauauguuuuguuggggacagagcacauuaagucugaaagcaacagagguuu

SEQ ID NO: 457503 - RNA, 64 nt, Human
accacuuuacaaaaguauuaucagaugcuuuccugcacauuaaggagaaaucuauagaacugaa

SEQ ID NO: 457504 - RNA, 64 nt, Human
agaagacacaguuuuagaaucuacugcugcuaaagcacauuaaaaacaaauccugguuuuuaau

SEQ ID NO: 457505 - RNA, 64 nt, Human
cugacaauaugaugcugugcgagaaauauuuacagcacauuaaaacgaucuguauuauuaaaua

SEQ ID NO: 457506 - RNA, 64 nt, Human
gcugcauucacuauugaguaaaaacuuguagaaagcacauuauagagcuuauguuggaauccau

SEQ ID NO: 457507 - RNA, 64 nt, Human
aaaaggcucagaucuuaauuaaaagguaauuguagcacauuaccaauuauaaggugaagaaaug

SEQ ID NO: 457508 - RNA, 64 nt, Human
agcgugaagaucguaggauugagaacuuagggaagcacauuagcuugcuugaagugcugauucc

SEQ ID NO: 457509 - RNA, 64 nt, Human
gucuccacacgaugccuagagaaugcugcagucugcacauuagacgcuuuuuagaaguuuugaa

SEQ ID NO: 457510 - RNA, 64 nt, Human
aacugauggcuacauggaaaaagaggacuuucuugcacauuaggaagcagaauauccuccagug

SEQ ID NO: 457511 - RNA, 64 nt, Human
ucaugguugaguuucagaacaaaagauauucauugcacauuaaccauuuagaggucauuuaaau

SEQ ID NO: 457512 - RNA, 64 nt, Human
uaucuuuaacagcucuuuguugaagccugugguagcacauuauguuuauaauugcacaugugca

SEQ ID NO: 457513 - RNA, 64 nt, Human
uucuaagccuccuguugguuacuaaucucacuuggcacauuauaacuaaaggaauccccucaau

SEQ ID NO: 457514 - RNA, 64 nt, Human; identical to SEQ ID NO: 189926

SEQ ID NO: 457515 - RNA, 64 nt, Human; identical to SEQ ID NO: 189927

SEQ ID NO: 457516 - RNA, 64 nt, Human; identical to SEQ ID NO: 189928

SEQ ID NO: 457517 - RNA, 64 nt, Human
cacacccugaagacgugcugucuaugcaguuauggcacauuauauggaaacucucaugacauga

SEQ ID NO: 457518 - RNA, 64 nt, Human
uagcuggucacuuggaacuuuggagcagaauccugcacauuaaaggaugggguugggggggaua

SEQ ID NO: 457519 - RNA, 64 nt, Human
ugaauacaguuucaugguuuuuaauucuuucaaagcacauuaaaaauggugugcugauaaaccc

SEQ ID NO: 457520 - RNA, 64 nt, Human
uaaagagaggcauuauuuauacacccugcaaugugcacauuaaaauauggaaauuuuaaaauua

SEQ ID NO: 457521 - RNA, 64 nt, Human
aggaagccugggaggcuucugugaggaaugugaggcacauuauuggggaaauugaggagacagc

SEQ ID NO: 457522 - RNA, 64 nt, Human
cccaggacaauuagaaaaauucacccaccaugccgcacauuacuggguaaaagcagggcagcag

SEQ ID NO: 457523 - RNA, 64 nt, Human
aaaaauuuuaucaaaaguuacuggaacuggaaaagcacauuagggucacuauucaaaaaacaga

SEQ ID NO: 457524 - RNA, 64 nt, Human
uuugccaaugcaaaauacaguugucauuaauccugcacauuagaaauuauuagaaacauauuac

SEQ ID NO: 457525 - RNA, 64 nt, Human
gccauacauagaaugcuucaagcuaucuugcuaugcacauuauacuuguacuguuuugugcagu

SEQ ID NO: 457526 - RNA, 64 nt, Human
accucuccaugaagcggccacagaaacuguuggugcacauuaucuacauuuuccucagccucua

SEQ ID NO: 457527 - RNA, 64 nt, Human
uuaguucaguaacuauuauguguaugaagauguugcacauuaagucucaguagugacucugguu

SEQ ID NO: 457528 - RNA, 64 nt, Human
uggcagaaaagaaaauaaggucuaaaggaaaguagcacauuagcauugauggcuguucauuuca

SEQ ID NO: 457529 - RNA, 64 nt, Human
gccugggagcuagacccuccccaagcccauccaugcacauuacuuagcuaacaauuagggagac

SEQ ID NO: 457530 - RNA, 59 nt, Human
cuccucugaagauaacuugaagauucuaggcacauuaugaggagggaaacaaaggaggc

SEQ ID NO: 457531 - RNA, 64 nt, Human
uucucucuggcagcuggccuucugcuucugaguugcacauuaaucagauuagccuguauucucu

SEQ ID NO: 457532 - RNA, 64 nt, Human
ggacacuucgugaucugcaaugacuguugauucagcacauuagcaucugacacagccaaccuga

SEQ ID NO: 457533 - RNA, 64 nt, Human; identical to SEQ ID NO: 189933

SEQ ID NO: 457534 - RNA, 64 nt, Human
auaagauuccaaugaccauauuuugugagauauggcacauuauucacagaccaugaucuuugug

SEQ ID NO: 457535 - RNA, 64 nt, Human
ucccucucuuuaucagagguucacaugccugucugcacauuaaaagcucugggaagaccuguug

SEQ ID NO: 457536 - RNA, 64 nt, Human
gaaacaagauaagauuugcauuuuacuagaacuugcacauuaugauauuguccuuuuaugaaac

SEQ ID NO: 457537 - RNA, 64 nt, Human
auuuuauaaauugccaccugugaaaaugguuuuugcacauuauuuguauuuuucuuuguauaug

SEQ ID NO: 457538 - RNA, 64 nt, Human
uaucuuuauauuuuuauuagaaugcaagaauuuugcacauuaacuggaaaagauguuaacagua

SEQ ID NO: 457539 - RNA, 64 nt, Human
acagcaugaacaccugcuuguccaauuagccucagcacauuacuaaucucaguuuguuccugcu

SEQ ID NO: 457540 - RNA, 64 nt, Human
ggcaggggucucuucccaaccagaccccacccaggcacauuagcgaccaggcuugggcuucccc

SEQ ID NO: 457541 - RNA, 64 nt, Human
ucguuuuucguccucaucuaagcaacaguuuaaagcacauuacgugcaauggcauagaaagugu

SEQ ID NO: 457542 - RNA, 64 nt, Human
gucuuagucacugacaauggguuuagggaaaguugcacauuagagucaaccccuucuuuuuuuu

SEQ ID NO: 457543 - RNA, 64 nt, Human
uuugguagacaugugcuuugacauagcgugagcagcacauuacuaaagcaauuacaugcauguu

SEQ ID NO: 457544 - RNA, 64 nt, Human
cagauuucacaccuacaauaauuccaaaagguuugcacauuagaguuuguaacaaaauauuuua

SEQ ID NO: 457545 - RNA, 64 nt, Human
ucuauccauagaccauucuugaccaagcaagcaugcacauuaugggcaguuacauucucaaguu

SEQ ID NO: 457546 - RNA, 64 nt, Human
aggauuuuauauuuuggggugaaagaauuaucuggcacauuagguauuggaguuuaaaaaaaaa

SEQ ID NO: 457547 - RNA, 64 nt, Human
guggaaaugcuuucagucuuguuacuauccuauugcacauuagagaauugguccuggaagggaa

SEQ ID NO: 457548 - RNA, 64 nt, Human
aagcccuaacugguucauccuuaccaguggccaagcacauuaacuuucucauacacugacuguu

SEQ ID NO: 457549 - RNA, 64 nt, Human
cauuuuuuaaauagaaguuacuucauuauauuuugcacauuauauuuaauaaaaugugucaauu

SEQ ID NO: 457550 - RNA, 62 nt, Human
agcccuggacucaggcuggcagaggggcuggugcccuggagaaaauaaagagaaggcuggag

SEQ ID NO: 457551 - RNA, 62 nt, Human
gggccggggcggcccccaggggccaggagagagcccuggagucccgcagccaccaugcacgc

SEQ ID NO: 457552 - RNA, 62 nt, Human
cuccccuguggccucuuugagugucugcagcagcccuggacuuccagacuucuaucacauga

SEQ ID NO: 457553 - RNA, 64 nt, Human
ugauuacauagaauuuguauuucuuuuuuagccagcacauuaaauuuuagauuuuauuuuuuaa

SEQ ID NO: 457554 - RNA, 64 nt, Human
uauuaucacuuguugcuguuuuuguugcacaauagcacauuaauuauauuaaauauucucuuug

SEQ ID NO: 457555 - RNA, 64 nt, Human
agcccagacaucuucaguccuuuggugauuaaaugcacauuagcaaaucuaugucuuguccuga

SEQ ID NO: 457556 - RNA, 64 nt, Human
acauuggcaaauagaguagcuaagagauugacaagcacauuacguuuagauaagcaugugaugc

SEQ ID NO: 457557 - RNA, 64 nt, Human
cucauuuuagaaaugaguagugcugauggcacuggcacauuacaguggugucuuguuuaauacu

SEQ ID NO: 457558 - RNA, 64 nt, Human
cauuccuagaagaaaaaaagagagaaacuugacugcacauuaaaaaaaaaaaaaaauccacauu

SEQ ID NO: 457559 - RNA, 64 nt, Human
guucuagaagcacaugguuguccuccuguuguuggcacauuaaaugauaaaaagcaccucauga

SEQ ID NO: 457560 - RNA, 64 nt, Human
acugcacccugucacacccagcaccccccgccccgcacauuauuugaaagacugggaauuuaau

SEQ ID NO: 457561 - RNA, 64 nt, Human
cuaaaucagauuuguaggucauguuaagcuucuugcacauuaauaugauuauggaaggaaaggc

SEQ ID NO: 457562 - RNA, 64 nt, Human
gggagauuaacuuuuuuuaacgcaaaaauauucugcacauuacccauauauuguugaauuuuac

SEQ ID NO: 457563 - RNA, 64 nt, Human
aaacaagaucauaguauuucagucauggugucaagcacauuaauacuuuucuguuacucagcau

SEQ ID NO: 457564 - RNA, 64 nt, Human
cuggguguguugucaucagcugugauauguuugugcacauuacguauagcagaggauguaagca

SEQ ID NO: 457565 - RNA, 64 nt, Human
gaaguacuaaaaucugucaaguguuuucaguauagcacauuauuuacugagugccaguuguaaa

SEQ ID NO: 457566 - RNA, 64 nt, Human
augauacuguaaugaccuuccaaagugaagaguagcacauuaaagugauuuuauuguuuccugu

SEQ ID NO: 457567 - RNA, 64 nt, Human
auugaauucggaacuguccuuuccuuggcuuuaugcacauuaaacagaugugaauauucuuuuu

SEQ ID NO: 457568 - RNA, 64 nt, Human
agcagggaguuagcacugaacugcuuuuaaaagugcacauuaaaaaggaaaguuugccaggagg

SEQ ID NO: 457569 - RNA, 64 nt, Human; identical to SEQ ID NO: 189920

SEQ ID NO: 457570 - RNA, 64 nt, Human; identical to SEQ ID NO: 189921

SEQ ID NO: 457571 - RNA, 64 nt, Human; identical to SEQ ID NO: 189922

SEQ ID NO: 457572 - RNA, 64 nt, Human
guagacuguuaaagacaauuuuaugacuauuuaugcacauuauaaugguuacaucugcuuuuug

SEQ ID NO: 457573 - RNA, 64 nt, Human
cuggcauuuucugcuuuacguggagggagaacaggcacauuagccuugaagcugaagcucauuu

SEQ ID NO: 457574 - RNA, 64 nt, Human
cuggcuucagcccccaccaggggaaggaaggagggcacauuaacucccuccaccagccugcuga

SEQ ID NO: 457575 - RNA, 64 nt, Human
cuucuaggcuaugaaacuuacaggguaugggugggcacauuauccuuuauuuuaugaaaaauaa

SEQ ID NO: 457576 - RNA, 64 nt, Human
ggauuuucuccaacagaaaguggauucacuacuggcacauuaacaagcaccaauagguuuuuau

SEQ ID NO: 457577 - RNA, 64 nt, Human
acaaauuuugaauaaaagaucaugggcaaugcaugcacauuaugaaacuuaugucauuauguau

SEQ ID NO: 457578 - RNA, 64 nt, Human
cgaggguccccuguggcaccuagcauggugcacagcacauuagaagugcucaaaaacaucugau

SEQ ID NO: 457579 - RNA, 64 nt, Human
aagagccagauaaauggauucgagccacuuguaggcacauuagcuccgcucauguucccugagc

SEQ ID NO: 457580 - RNA, 64 nt, Human
accuguguuguaaagauaaacugacgauauacaggcacauuauguaaacauacacacgcaauga

SEQ ID NO: 457581 - RNA, 64 nt, Human
acauaauugacuugccauuuuaugguuaaaaacggcacauuaggcaguugaauaugacguuacc

SEQ ID NO: 457582 - RNA, 64 nt, Human
gugaaacauuuuauguucaauccauauuugucuugcacauuauaaauauauuuuuauuuuuuag

SEQ ID NO: 457583 - RNA, 64 nt, Human
uguuuugaauguaguuuuccuuuucuauuuauuugcacauuaaaguuaauaauugaauauugac

SEQ ID NO: 457584 - RNA, 64 nt, Human
ugaauccauuuccaucccaucauccuuguccaaugcacauuaauauauuugacaugggauacuc

SEQ ID NO: 457585 - RNA, 64 nt, Human
acauuuccucccuccccuccuuugaauugaaauggcacauuaagacuugucacggcuucucacu

SEQ ID NO: 457586 - RNA, 64 nt, Human
gaaaagucuugagccaucauucaucccuuaacaggcacauuagaucuuacaccagacacaaacu

SEQ ID NO: 457587 - RNA, 64 nt, Human
uggcaaggccaucugaaggaauuaacaccucauugcacauuacaugaucacuuccagaguagaa

SEQ ID NO: 457588 - RNA, 58 nt, Human
ggguggcuguggcacagacagguggaaaacgggauagccuggccagucccucuguugu

SEQ ID NO: 457589 - RNA, 58 nt, Human
ugaauaauuagauauauauauucauucuacgggauauuauucaguaguggaaaugagu

SEQ ID NO: 457590 - RNA, 58 nt, Human
uuauaucugugugguguuuuguaccggcacgggauauggaacgaaaacugcuuuguaa

SEQ ID NO: 457591 - RNA, 58 nt, Human
cacuuaaguguaucacaaucaacaccagacgggauauuuuaacuaucagauuuucgga

SEQ ID NO: 457592 - RNA, 64 nt, Human
cgaguuccagagauuaacucagaacuccuuguuugcacauuauuauggaacacuuuccuacuua

SEQ ID NO: 457593 - RNA, 64 nt, Human
agaaggcgcgguggccggguucccuuccccuagggcacauuacuaagggggucaggcacugcau

SEQ ID NO: 457594 - RNA, 64 nt, Human
ccauuuccuugauuguguaaggaacuugcuggacgcacauuagagaauaaagcuccuguuucua

SEQ ID NO: 457595 - RNA, 64 nt, Human
auuguguuacuaucacuaaguagcaaauugcccagcacauuaguccuaaacgucccauguauuu

SEQ ID NO: 457596 - RNA, 64 nt, Human
ugugccuugaggcugagugauugacaucuuuuuggcacauuacacuuugcagaguaagggauca

SEQ ID NO: 457597 - RNA, 64 nt, Human
ggugugauuuuugacgugccuggcccugagcgaagcacauuacauauaucaucaaauuuaucuc

SEQ ID NO: 457598 - RNA, 64 nt, Human
uccaacauaccaauuuucugcuaauacagguccugcacauuacaugacugaaggacaucugaca

SEQ ID NO: 457599 - RNA, 64 nt, Human
agaguaucccaguauuagcaauacuggaauauaggcacauuaccauucauaguaagaauucugg

SEQ ID NO: 457600 - RNA, 64 nt, Human
cuauuuguauuaagugucauaauagcaucaaugugcacauuaccaguauagacuguuggaguuc

SEQ ID NO: 457601 - RNA, 64 nt, Human
cacacacacacacacacacacacacacacucugagcacauuaucugugauucuuucauccuccc

SEQ ID NO: 457602 - RNA, 64 nt, Human
uggaugauuaacgggccuuuuucacuuagaagcugcacauuauggagcauuaaacacuuuuguc

SEQ ID NO: 457603 - RNA, 64 nt, Human
gcacacuagugugggaaggaaaauauugagcuaggcacauuacucucugaacgaaauucauauu

SEQ ID NO: 457604 - RNA, 64 nt, Human
uauacacugaggguagcccauuuauaaauuaagagcacauuauauucagaagguucuaacaggg

SEQ ID NO: 457605 - RNA, 64 nt, Human
guuuuugaaaauguuucaagucuaguuuuuacaagcacauuacaguaauugcagguuguccaga

SEQ ID NO: 457606 - RNA, 64 nt, Human
ucaggauuacaacuuuuaggaauuacuugguuuugcacauuaagaggcccauaaguuuaucagc

SEQ ID NO: 457607 - RNA, 64 nt, Human
auguugugaauugugaauuaucugcugucguacagcacauuagcaaauugucaucggacaauga

SEQ ID NO: 457608 - RNA, 58 nt, Human
cuaaaaacauuaaaaucagcuuauuaauacgggauagagaaagaaaucuggugccugg

SEQ ID NO: 457609 - RNA, 58 nt, Human
gggggauagaaaacaaaguaccuaugaaacgggauaucuggauuuuacuugcaguggc

SEQ ID NO: 457610 - RNA, 58 nt, Human
ugaacauuuuuaggcacacuuuucacugacgggauaucucuuuaugcaauaccucaau

SEQ ID NO: 457611 - RNA, 58 nt, Human
gggugugaguguuuacacugugcccuucacgggauacuucuuuuaucugcagauggcc

SEQ ID NO: 457612 - RNA, 64 nt, Human
gcucgucaucucggcccuuguccacacucuccaagcacauuacaggggaccugauugcuacacg

SEQ ID NO: 457613 - RNA, 62 nt, Human
ugcauuguagagaaaggcuucuuauauccuuuucaauagacugcccuggcucuuuccuaggc

SEQ ID NO: 457614 - RNA, 62 nt, Human
uacuuguaaaccuuuaaagaugguuaauucauucaauagauauuuauuaagaaccuaugcgg

SEQ ID NO: 457615 - RNA, 62 nt, Human
ugaagucugaaacaaacaaaagcaauucaaugucaauagacauuaagcaacauaauagacaa

SEQ ID NO: 457616 - RNA, 62 nt, Human
auguaauacuguugguccaaaagcauuuaaaaucaauagaucugggauuauguggccuuagg

SEQ ID NO: 457617 - RNA, 62 nt, Human
auuauuaggaauacaucuugacccuuuuccacucaauagaccagggaaagggguuacagaga

SEQ ID NO: 457618 - RNA, 62 nt, Human
ccccacucauuggagugaacagugacgcaagcucaauagacuucauaaguguucauagaauu

SEQ ID NO: 457619 - RNA, 62 nt, Human
uuagcacauauagauagauucaucucguuuuuucaauagaagcagaguauucguuuuacuca

SEQ ID NO: 457620 - RNA, 62 nt, Human
ucucugcaggugaaaacucugggggaugcugaucaauagagcuuggucccaagcucuacugg

SEQ ID NO: 457621 - RNA, 62 nt, Human
cugagauggaaaaguguccuucuugcucccccucaauagaucuccagcgucagcugcucccu

SEQ ID NO: 457622 - RNA, 62 nt, Human
ccagguagcccacugaguuaauauuuaaguugucaauagauaagugucccuguuuuguggca

SEQ ID NO: 457623 - RNA, 62 nt, Human
gaugguauuguagcauguauuguuuauuuuagucaauagacccucuccuuauaaaugguguu

SEQ ID NO: 457624 - RNA, 62 nt, Human
uuauggcugaaaccgcaacacccaucaccacuucaauagaucaaaguccagcaggcaaggac

SEQ ID NO: 457625 - RNA, 62 nt, Human
uuaaaauuguagcacauguuucccugacauuuucaauagaggauacaacaucacagaaucuu

SEQ ID NO: 457626 - RNA, 62 nt, Human
agcucuguuuguauuaugauuuuuaaucaaaaucaauagauuaaaaauaguuugacauucaa

SEQ ID NO: 457627 - RNA, 64 nt, Human; identical to SEQ ID NO: 189915

SEQ ID NO: 457628 - RNA, 64 nt, Human; identical to SEQ ID NO: 189916

SEQ ID NO: 457629 - RNA, 64 nt, Human; identical to SEQ ID NO: 189917

SEQ ID NO: 457630 - RNA, 58 nt, Human
uugaaaauccucaggcucaugauaacuuacgggauaacaauaguagguaacaccgagu

SEQ ID NO: 457631 - RNA, 62 nt, Human
auagaguaaccuaucacuagaguucaccucuaucaauagaguaaccucauucucugccugau

SEQ ID NO: 457632 - RNA, 62 nt, Human
agcuagucuuuccagauguuaaagaacuucuaucaauagaguaaccuaucacuagaguucac

SEQ ID NO: 457633 - RNA, 62 nt, Human
gaacgaugucaauucaugcuuuuaauuuagcaucaauagaaaauugcuguagguaaaucuca

SEQ ID NO: 457634 - RNA, 62 nt, Human
gcaccaaauucauguacagcaugcaucacggaucaauagacuguacuuauuuuccaauaaaa

SEQ ID NO: 457635 - RNA, 62 nt, Human
gauggaauugagauguuugagccucauuuacaucaauagagguguaauguacugcauuucuu

SEQ ID NO: 457636 - RNA, 62 nt, Human
ucugcagcuuauugugaauaccuugguucuguucaauagaaacauuuuguauauauuaaaua

SEQ ID NO: 457637 - RNA, 62 nt, Human
aauaguucaaggaguuuuugccucuuuguuuuucaauagauuauucugccauuuuuuaaagg

SEQ ID NO: 457638 - RNA, 62 nt, Human
ucacuguguguagaaauaguaugaguacgauuucaauagacuguucaguuuuuaauauuagc

SEQ ID NO: 457639 - RNA, 62 nt, Human
uacaugacugcuugacagcccaacagccacucucaauagagagcuaugucuuacauucuuuc

SEQ ID NO: 457640 - RNA, 62 nt, Human
auaaauauggcaagaaauaaacaugaccaauaucaauagacuucuugaggcuacuauaaguu

SEQ ID NO: 457641 - RNA, 62 nt, Human
cuuauuuuguuggaguauuauugaagaugugaucaauagauuguaauacacauaucuaaaaa

SEQ ID NO: 457642 - RNA, 62 nt, Human
uccuuaaauuaucuaaaaucugcuagggaauaucaauagauauuuaccuuuuauuuuaaugu

SEQ ID NO: 457643 - RNA, 62 nt, Human
auugaaugcaguccaauuugcaguaguaaucuucaauagacaagcagcuuuguugcugccuu

SEQ ID NO: 457644 - RNA, 62 nt, Human
ugugugagcaguagaagagaccacauuuacagucaauagaaauaaugaaaaaaaauuaggug

SEQ ID NO: 457645 - RNA, 62 nt, Human
uggucuuccauguaaauacaaguugguacaaaucaauagaaaccauuuuaccuacauaggca

SEQ ID NO: 457646 - RNA, 62 nt, Human
uguuuguuauggcuuaaugacacuagcuaauaucaauagaaggauguacauuuccaaauuca

SEQ ID NO: 457647 - RNA, 62 nt, Human
accccacccugagccgcaagagcaguccuggggcccuggaccccucuguacaguccguagga

SEQ ID NO: 457648 - RNA, 62 nt, Human
ccaguaugugccccucacccaggccuggcugggcccuggagaguccuguuugcacagcccag

SEQ ID NO: 457649 - RNA, 62 nt, Human
aauagaauuggcauauuuaugugauugcagcagcccuggacuauuuauuucuggauguccca

SEQ ID NO: 457650 - RNA, 62 nt, Human
gagaucccugcagggacucccuggagauucaggcccuggaauggggcugaauggaggucccg

SEQ ID NO: 457651 - RNA, 62 nt, Human
caucuuuguuuauuucuugacuaaucagauuuucaauagagugaaguuaaauugggggucau

SEQ ID NO: 457652 - RNA, 62 nt, Human
cuuucguuccccuucacucaguugugcugaggucaauagaguguagaguuucagaaaggauu

SEQ ID NO: 457653 - RNA, 62 nt, Human
acccucaaccccugcaaccuucccuagcccccucaauagaugagcaggucaggcuguggccc

SEQ ID NO: 457654 - RNA, 62 nt, Human
cggcauaauggacuugguaguuuuucuauuuuucaauagauuuguacuugaauaaggugaag

SEQ ID NO: 457655 - RNA, 62 nt, Human
gcuuuaucuccuugggcauucguacuuaggauucaauagaaacauguacaggguaaacaauu

SEQ ID NO: 457656 - RNA, 62 nt, Human
cuaacuuuuuuuaaaggcccacugcuuuauuuucaauagauuaaaccugauuucugagaggu

SEQ ID NO: 457657 - RNA, 62 nt, Human
uggucuggcaguuuccuaguuuuguaucugguucaauagaaauaugugaaagugguaauguc

SEQ ID NO: 457658 - RNA, 62 nt, Human
caauugauuuuugacaagguucccaagacaauucaauagagaaaggagagucuuuucaacaa

SEQ ID NO: 457659 - RNA, 62 nt, Human
ggccauccagggcaaggaacugucuuucugguucaauagacugccccgacagucuacaagcc

SEQ ID NO: 457660 - RNA, 62 nt, Human
ucacuggggaucuuguuaauacagcuucuaacucaauagaucugggagauccugcauuucua

SEQ ID NO: 457661 - RNA, 62 nt, Human
uuuaaagauaugggacuuuauuuucacauaagucaauagauguuucucuagaacaaaauauu

SEQ ID NO: 457662 - RNA, 62 nt, Human
uuauccuguuuuauucugaaaaaugaaagugcucaauagaauuuuuaacguuggcaacacca

SEQ ID NO: 457663 - RNA, 62 nt, Human
gugugaaaauguaacauuuuaugcuuuuaaaaucaauagauucaucaccuuaguuuuuuaaa

SEQ ID NO: 457664 - RNA, 62 nt, Human
uaaugauuuugcagcucuguuuuucugcacacucaauagaaaauauugugggucugagaugc

SEQ ID NO: 457665 - RNA, 62 nt, Human
cugauccccaaauagcucauacaauaauccauucaauagaauggaauuaaaacuguucagaa

SEQ ID NO: 457666 - RNA, 62 nt, Human
auagauguuuauagcagagaagaaaugucucaucaauagaaaacuaucagauaaaguuuagg

SEQ ID NO: 457667 - RNA, 58 nt, Human
uggacauauucuuuaugccacaccuaccacgggauaauaaaagggaaaauaauuugag

SEQ ID NO: 457668 - RNA, 58 nt, Human
ccagggaaaagcagagaguaaauuagagacgggauaggaaggccgugggagaacucga

SEQ ID NO: 457669 - RNA, 62 nt, Human
cuuuuggggacugcaggaaucaucuccccugggcccuggacucggacuggggccuccccacc

SEQ ID NO: 457670 - RNA, 62 nt, Human
cuugaagggcagccuccugcccaggccccguggcccuggagccucaauaaagugucccuuuc

SEQ ID NO: 457671 - RNA, 62 nt, Human
ucauaugguaugacauauuucuuaaaagcuuaucaauagaugucaucauauguguaggcaga

SEQ ID NO: 457672 - RNA, 62 nt, Human
cgccuguggaccuugauuucuagauuucagugucaauagaccugucuuccugcacacuuuca

SEQ ID NO: 457673 - RNA, 62 nt, Human
ggcaaaaggaaauggaauaguauaaacacugaucaauagaguaaaauaucugcugcauaaaa

SEQ ID NO: 457674 - RNA, 62 nt, Human
ugcagugcaacaaaguacgugaaaaucagguuucaauagaaugugacacaacgugcaaggaa

SEQ ID NO: 457675 - RNA, 62 nt, Human
guuugcaaaggaaaaguuuaaauagcuuaauaucaauagaaugauccugaagacagaaaaaa

SEQ ID NO: 457676 - RNA, 62 nt, Human
uaccugccaugaacaugacaaaagguuagucuucaauagacugaaauguauaagagaagaac

SEQ ID NO: 457677 - RNA, 62 nt, Human
aauugggcacuauuuauuuacaaauguuuugcucaauagauugcucaaaucagguuuucuuu

SEQ ID NO: 457678 - RNA, 54 nt, Human
ggcuaaugguuaauacuuaaauggucaauagaaaaaguaggcugggcgcggugg

SEQ ID NO: 457679 - RNA, 55 nt, Human
ucucuucugcuuaggcauaaugacaucaauagaaaaaugaagaaauccuacagca

SEQ ID NO: 457680 - RNA, 62 nt, Human
acuaguauugcaauaagcaaaugcaaaaauauucaauagaugcacuauucuuguuuuuacug

SEQ ID NO: 457681 - RNA, 61 nt, Human
gcauguaccaccuguccuaaggaagaccagaucaauagacuccaugauggaugcuuguuuc

SEQ ID NO: 457682 - RNA, 62 nt, Human
agauuugauugcucaacaugcauaacuugaauucaauagacuuuugcugguuauaaaacaga

SEQ ID NO: 457683 - RNA, 62 nt, Human
cuuagcauuaacuuaaugauggagaagagugcucaauagacaguucccaguaagguaaugag

SEQ ID NO: 457684 - RNA, 62 nt, Human
uaaauauauuuauguuuguacgaaaucuuauuucaauagauggaaauuuuaauuuuuuuuuc

SEQ ID NO: 457685 - RNA, 62 nt, Human
aaucaaccugcacaccuaccgccaucuaaucuucaauagaaaugggcaaugugggaaagacu

SEQ ID NO: 457686 - RNA, 62 nt, Human
gcccacaaguguaacuaugcuguuaacagcugucaauagauaauuaaaauucauacuguaug

SEQ ID NO: 457687 - RNA, 64 nt, Human; identical to SEQ ID NO: 189897

SEQ ID NO: 457688 - RNA, 64 nt, Human; identical to SEQ ID NO: 189898

SEQ ID NO: 457689 - RNA, 64 nt, Human; identical to SEQ ID NO: 189899

SEQ ID NO: 457690 - RNA, 64 nt, Human
cacgccuguaauccaacacuuugagaggcugaggcgggcggaucaccugagucaggaguucgag

SEQ ID NO: 457691 - RNA, 62 nt, Human
ggcaaaauugaccuuggccccaaagauauuccucaauagauuucaaacaccacuccccugua

SEQ ID NO: 457692 - RNA, 62 nt, Human
cucagcuuaucugaucaaggugaacuugcccuucaauagacuugcccuuguuacugcccagu

SEQ ID NO: 457693 - RNA, 62 nt, Human
aguuccaguuuugcuucuagcaaguggacccaucaauagacccaucugagccuguuuccuca

SEQ ID NO: 457694 - RNA, 62 nt, Human
aggaaagugauuacaaauauuaccuccaggguucaauagaaauccucaauuuagggugagga

SEQ ID NO: 457695 - RNA, 62 nt, Human
cuacuccuuauuuacgacgcaauaaaauaacaucaauagauuuuuaggcugaauuaauuuga

SEQ ID NO: 457696 - RNA, 62 nt, Human
uuauuuucauguuguuauguaaucaauauuuuucaauagaaguauuagagguuuuuuuuauu

SEQ ID NO: 457697 - RNA, 62 nt, Human
caacauucuuuuaacaacauuuuucugaauccucaauagaaaaucacauuaaucuuauuuua

SEQ ID NO: 457698 - RNA, 62 nt, Human
cucagaugaggacagagugguuuccaauguguucaauagauuuaggagcagaaaugcaaggg

SEQ ID NO: 457699 - RNA, 62 nt, Human
cugucucuaccagggucaagagcaugaacgcaucaauagaaagaacucggggaaacauccca

SEQ ID NO: 457700 - RNA, 62 nt, Human
ccauagggagugaaguggaguuaugguuucauucaauagaguauugcugauuauacuugagu

SEQ ID NO: 457701 - RNA, 62 nt, Human
acagacaauaagccagacaacacaaucaaagcucaauagaugauuucuugcuuuuuucaguc

SEQ ID NO: 457702 - RNA, 62 nt, Human
cuauugaauuucucuuaagaauuccuaauaggucaauagauuuacccuccagugauaucuau

SEQ ID NO: 457703 - RNA, 62 nt, Human
cuaacuaguagccugcuacuccauaguauggcucaauagaugacacaucauuuugacauuau

SEQ ID NO: 457704 - RNA, 62 nt, Human
acagcgacaugcuaaaguccccuucuucagagucaauagaguaguuguuaaagguuuuaaau

SEQ ID NO: 457705 - RNA, 62 nt, Human
uuacuagaugaaggaaugcagguggcuguguuucaauagagcuuuauuucugcaaacugaaa

SEQ ID NO: 457706 - RNA, 62 nt, Human
uaucauauucuaguuuacagaacacauuuuaaucaauagaagaauuaagaugaaaaacaugg

SEQ ID NO: 457707 - RNA, 58 nt, Human
ucccaggucucccuggggagguagaggcacgggauaaggggccagggucagaggucca

SEQ ID NO: 457708 - RNA, 58 nt, Human
aaguguucagaaauugguaaaccaacacacgggauacaauaacucucuguuaaccaga

SEQ ID NO: 457709 - RNA, 58 nt, Human
ccccucaggaguuuccacacugcuguggacgggauagccagggcagaccugcauccca

SEQ ID NO: 457710 - RNA, 62 nt, Human
uuaaaccuggcuucugaaacgauggcaucagagcccuggagagccagcuggagacacaggcg

SEQ ID NO: 457711 - RNA, 62 nt, Human
caaaaauucauaaucuaauaguuuaucaguuuucaauagauuaaauaaaaugauuacuuuaa

SEQ ID NO: 457712 - RNA, 62 nt, Human
aauguaauauuacauauugauagaggaauaggucaauagagaagauacaaaagagugguuag

SEQ ID NO: 457713 - RNA, 62 nt, Human
uaggguagaaauaagagcuauacuuacaagagucaauagaucacugacuucucuuuaacugu

SEQ ID NO: 457714 - RNA, 62 nt, Human
caugcuaaccaguugcuucucaguguuucucuucaauagaaaaauaagguuuuauaugccag

SEQ ID NO: 457715 - RNA, 62 nt, Human
cuuaaaugccaauuaaacaagaauauaacauuucaauagaaauuuuuauuucauuuucaauu

SEQ ID NO: 457716 - RNA, 62 nt, Human
ugucuauccacaggcuaaccccacucuaugaaucaauagaagaagcuaugaccuuuugcuga

SEQ ID NO: 457717 - RNA, 62 nt, Human
uucauuuuuaaaagcaauuauugaagccauuuucaauagauuggccauuuuaauguucagca

SEQ ID NO: 457718 - RNA, 62 nt, Human
gcuguuauaggaucuacagaugaauauuuaacucaauagaaaaauuauuuuagaacacauug

SEQ ID NO: 457719 - RNA, 62 nt, Human
uucuuagguauuccaaaccaaauaugaugacaucaauagauugcauuuuaaaaauauuguuu

SEQ ID NO: 457720 - RNA, 62 nt, Human
auucacacaagagguacaccuuaugaaucgcaucaauagagggaaauuuucagcuacaaucu

SEQ ID NO: 457721 - RNA, 62 nt, Human
gugguuuucaguaaaguguucuugcacauccuucaauagauuuauucuuagacguuuuauau

SEQ ID NO: 457722 - RNA, 62 nt, Human
acugguucauguuaucuauucuaaacuaauaaucaauagauggacaaaagaaacaacaaccc

SEQ ID NO: 457723 - RNA, 62 nt, Human
caauugucaccaaggaguuaaaagcuucuucuucaauagaggaauuguucuggggguccugg

SEQ ID NO: 457724 - RNA, 62 nt, Human
uggaagauaaaugaaggauuuuaauaaaauuuucaauagaauaaaccuaaucuguauggaua

SEQ ID NO: 457725 - RNA, 62 nt, Human
cuuuccuugggucucuuggccuccagacccccucaauagacacugacuaaagucaggcugga

SEQ ID NO: 457726 - RNA, 62 nt, Human
gcuucuuguccauggcuuuuguuugaugguuuucaauagaggugacugagauuguagggggg

SEQ ID NO: 457727 - RNA, 64 nt, Human; identical to SEQ ID NO: 189910

SEQ ID NO: 457728 - RNA, 64 nt, Human; identical to SEQ ID NO: 189911

SEQ ID NO: 457729 - RNA, 64 nt, Human; identical to SEQ ID NO: 189912

SEQ ID NO: 457730 - RNA, 62 nt, Human
uggggcuuggggcaccaugagaagguuggcgugcccuggaggcugacacagaggcuggcacu

SEQ ID NO: 457731 - RNA, 62 nt, Human
guuugggaauaugggaagggucuccuauuuauucaauagaguuuucucaguuauuuuccucc

SEQ ID NO: 457732 - RNA, 62 nt, Human
aaacgguugugguuuccuuuuuccacggagguucaauagaagccgcugcaggagaguuuuac

SEQ ID NO: 457733 - RNA, 62 nt, Human
uuaaucuuucucuaaaagcauauaagagcuugucaauagagcaaucaaucaaaaagauuuug

SEQ ID NO: 457734 - RNA, 62 nt, Human
cuguuugugacauugaguugugacuucuauauucaauagauuuuuguaaauguuaaaacauc

SEQ ID NO: 457735 - RNA, 62 nt, Human
cugcaauaguguuucccacucucugcuuggcaucaauagaugcauaagggucaaccacauuu

SEQ ID NO: 457736 - RNA, 62 nt, Human
ggaagauggcguucccagaaaguauuuuaauaucaauagaccacagccaaagccuuaaauca

SEQ ID NO: 457737 - RNA, 62 nt, Human
aggccguccauuagagauuuaacuagauauguucaauagaaagagucugaggcaaguggaaa

SEQ ID NO: 457738 - RNA, 62 nt, Human
auuguuacuguacauacuauccuguuuccuccucaauagaauugccacaaacugcaugcuaa

SEQ ID NO: 457739 - RNA, 62 nt, Human
cugugaccuuucuuucccuggaacucuuuaucucaauagagaccuuaaaagaaaacaugaga

SEQ ID NO: 457740 - RNA, 62 nt, Human
auccagcuguuaacauuuuguaaucagucaauucaauagaauuauucuggauaauucuauau

SEQ ID NO: 457741 - RNA, 62 nt, Human
cugaguucccacaaagcauggguaacuuagucucaauagaguaucuguuauuagaauaauaa

SEQ ID NO: 457742 - RNA, 62 nt, Human
uaaagcccccuucuccauggaguguuggcuucucaauagaguguuguugcugaccagcugga

SEQ ID NO: 457743 - RNA, 62 nt, Human
gcuaauaccgugugcgucagagcuuuauguauucaauagaucucuacaacuaugccccuucu

SEQ ID NO: 457744 - RNA, 62 nt, Human
uuguuuuugagauuuaaaguucuaagggauugucaauagauaucaaaauauuaaucauugga

SEQ ID NO: 457745 - RNA, 62 nt, Human
aggagcuaggagacaugauuuuaaaaaaggaaucaauagaugcuuugaagaaaauaaaacuu

SEQ ID NO: 457746 - RNA, 62 nt, Human
guauucuuacuaugguugcuuucccuauuuguucaauagacugauaauacuggaauuuauag

SEQ ID NO: 457747 - RNA, 64 nt, Human; identical to SEQ ID NO: 189868

SEQ ID NO: 457748 - RNA, 64 nt, Human; identical to SEQ ID NO: 189869

SEQ ID NO: 457749 - RNA, 64 nt, Human; identical to SEQ ID NO: 189870

SEQ ID NO: 457750 - RNA, 64 nt, Human; identical to SEQ ID NO: 189871

SEQ ID NO: 457751 - RNA, 62 nt, Human
agaaagacaugggcuaucagggaggaagauguucaauagaacaugcaagaauuucuggaaga

SEQ ID NO: 457752 - RNA, 62 nt, Human
uuuuuaguuccccuggcaauaauaauggcacuucaauagaagauggacaaauuccagaaauc

SEQ ID NO: 457753 - RNA, 62 nt, Human
cgugcucagaacugaauuaaaauggcauuaugucaauagagaauucagcuaccaaacaagaa

SEQ ID NO: 457754 - RNA, 62 nt, Human
cuagcuguuagguagaccuaaauaaaaaguucucaauagauuccucuuuugaguaaauauaa

SEQ ID NO: 457755 - RNA, 62 nt, Human
guuauuuugacuugaugccuuuugaauaacuuucaauagaauugucuaaaauuaucuuacug

SEQ ID NO: 457756 - RNA, 62 nt, Human
ggucccgagcgccacuccuagccuugccgccuucaauagagaagaaaucccuuugcuagaua

SEQ ID NO: 457757 - RNA, 62 nt, Human
ugaaucugggcuggcacugugacuugauuugaucaauagaauguggaagaagugacuguaug

SEQ ID NO: 457758 - RNA, 62 nt, Human
ggcagaacuaaaaacaaaacucacguaucaucucaauagauacagaaaaggcuuuugauaaa

SEQ ID NO: 457759 - RNA, 62 nt, Human
ggguuucggggugaagcaaguucacuacagcaucaauagaaagucaucuuugagauaauuua

SEQ ID NO: 457760 - RNA, 62 nt, Human
aacacuuuggcugugucuauaacuugacacagucaauagaaugaagaaaauuagaguaguua

SEQ ID NO: 457761 - RNA, 62 nt, Human
caguccccacaacaucaaagaaccaccacaagucaauagauuugaguuuaauuggaaaaaug

SEQ ID NO: 457762 - RNA, 62 nt, Human
acucaguaauugauuuguucugauguuguaacucaauagaaguguuuuggaaggaagcaugg

SEQ ID NO: 457763 - RNA, 62 nt, Human
cucgcuccucgcccugggccucagcuuccucaucaauagaaaggauguguucgggguggggg

SEQ ID NO: 457764 - RNA, 62 nt, Human
acagaaccaaagacagaaaccacaugauuaucucaauagaaaaccacugcuuaacgaaauaa

SEQ ID NO: 457765 - RNA, 62 nt, Human
gcaugguacugguaccaaaacagagauauagaucaauagaacagaacagagcccucagaaau

SEQ ID NO: 457766 - RNA, 62 nt, Human
uauuuuaacaaaaggaaugaaaaauuaucaucucaauagacaaagcuuuugucugagcaccu

SEQ ID NO: 457767 - RNA, 64 nt, Human; identical to SEQ ID NO: 189864

SEQ ID NO: 457768 - RNA, 64 nt, Human; identical to SEQ ID NO: 189865

SEQ ID NO: 457769 - RNA, 64 nt, Human; identical to SEQ ID NO: 189866

SEQ ID NO: 457770 - RNA, 64 nt, Human; identical to SEQ ID NO: 189872

SEQ ID NO: 457771 - RNA, 62 nt, Human
acaagaaaacaaaugauaaaggaacucauuuaucaauagaggugaaaggaaauuauuaaacu

SEQ ID NO: 457772 - RNA, 62 nt, Human
acggaaccugacaguggucaacuacucaagcaucaauagacucaugaaguggaucauguucc

SEQ ID NO: 457773 - RNA, 62 nt, Human
uauuguaaaaauguucaugaacgacauuuuacucaauagagauucuucauuaucuucauggu

SEQ ID NO: 457774 - RNA, 62 nt, Human
uugucggaauaugugcucucuucaugucauauucaauagaaguuucuaguuuaagauugauu

SEQ ID NO: 457775 - RNA, 62 nt, Human
caggcugccuggucacugccccucucucagugucaauagaugaaaguacauugggagucugu

SEQ ID NO: 457776 - RNA, 62 nt, Human
uuguggcaaagcguuuacuucacauucacaccucaauagacaucagagaauccaugcuggac

SEQ ID NO: 457777 - RNA, 62 nt, Human
uuuucuuaauuguuagcuauuuauagaaagcuucaauagaacuguuucaacuguauaacuau

SEQ ID NO: 457778 - RNA, 62 nt, Human
uguuguuugcacaugccccucuuacuguacugucaauagauauuuuugagauuuauuuuuaa

SEQ ID NO: 457779 - RNA, 62 nt, Human
auuggaaacugaaauucagagaaauggaguguucaauagauaccacgaauugugaacaaagg

SEQ ID NO: 457780 - RNA, 62 nt, Human
gcauuuucucaaauaaaacucugcaagaguuaucaauagaugguuuauuaaaucgauauauu

SEQ ID NO: 457781 - RNA, 62 nt, Human
aaccugaucaucccacccagaagaccuucucaucaauagaucgcccuuaaagacccauugua

SEQ ID NO: 457782 - RNA, 62 nt, Human
cugccgcccgcauuauaaacacaggagaauaaucaauagaauaaaagugaccgacugucacu

SEQ ID NO: 457783 - RNA, 62 nt, Human
ggaggaagccuggucuaagaagauacugucuuucaauagaaaugauuucuaaacugcuacag

SEQ ID NO: 457784 - RNA, 62 nt, Human
uaaaaauaguacauucugucucaugucacguaucaauagaucaauugguauuuccuugugaa

SEQ ID NO: 457785 - RNA, 62 nt, Human
uuuuauuucuuuuugauuuuuaaaucauucauucaauagauaccaccgugugaccuauaauu

SEQ ID NO: 457786 - RNA, 62 nt, Human
cucuauguucuuuacuguuucacuggaaagugucaauagaguugccuaagaauaaaaauuga

SEQ ID NO: 457787 - RNA, 64 nt, Human; identical to SEQ ID NO: 189875

SEQ ID NO: 457788 - RNA, 64 nt, Human; identical to SEQ ID NO: 189876

SEQ ID NO: 457789 - RNA, 64 nt, Human; identical to SEQ ID NO: 189877

SEQ ID NO: 457790 - RNA, 64 nt, Human; identical to SEQ ID NO: 189878

SEQ ID NO: 457791 - RNA, 62 nt, Human
ccucuugagcuaggaacccagaggaggaggccucaauagagcacugccuauuugguauccag

SEQ ID NO: 457792 - RNA, 62 nt, Human
cagcuucuuaagaguagcaugacauuuuuaucucaauagaauagcccucuuuugcuuuugua

SEQ ID NO: 457793 - RNA, 62 nt, Human
agagucacauuguguaauuuaauuucagucagucaauagauggcaucccucaucaggguugc

SEQ ID NO: 457794 - RNA, 62 nt, Human
aggagaaaacaagaugaauagcagaggccaauucaauagaaucaguuuuuugauagcuuuuu

SEQ ID NO: 457795 - RNA, 62 nt, Human
aagaaaagggaccaaaaguuauuuuagcuuccucaauagauugcauguugcuuauuaggaua

SEQ ID NO: 457796 - RNA, 62 nt, Human
cuuauugcugugaaagggagugguugguaaaaucaauagauuucaggcaagagggccagaua

SEQ ID NO: 457797 - RNA, 60 nt, Human
ugggauuacaggcaugagccagcaugccuggccugugaacgcagaauucuuauaaggugu

SEQ ID NO: 457798 - RNA, 60 nt, Human
acgcaccuucucacuuaauccucacgacaagccugugaggcagaugcucauuguucccau

SEQ ID NO: 457799 - RNA, 60 nt, Human
accuucuauuaucgucuucggaaguuaccagccugugagauccaagcccccccacccagg

SEQ ID NO: 457800 - RNA, 60 nt, Human
accucccaggauuugcugacagcgguagaugccugugaggagcuacuacaagaaauagac

SEQ ID NO: 457801 - RNA, 60 nt, Human
ggaucugccuuuuucauccagagcucugaugccugugaacacugaaagagaaagccuaau

SEQ ID NO: 457802 - RNA, 60 nt, Human
gaguucaaggcuauagugugcuaugaucaugccugugaauagccacugcacuugagccuc

SEQ ID NO: 457803 - RNA, 60 nt, Human
cuuccauuacaccuucuuuauauuuuaaaggccugugaauauacuuauaaccugcauauc

SEQ ID NO: 457804 - RNA, 60 nt, Human
cauguuucaacaacuauugaaauaugaaaugccugugaacucuuaaagcuucaugagcag

SEQ ID NO: 457805 - RNA, 60 nt, Human
caaguuggucaggcaacagcuggggugauggccugugagccacaggccacaucaggaacu

SEQ ID NO: 457806 - RNA, 60 nt, Human
acucuggucccagucagccuguggcuuguggccugugaccugugaccuucugccagaauu

SEQ ID NO: 457807 - RNA, 64 nt, Human; identical to SEQ ID NO: 189873

SEQ ID NO: 457808 - RNA, 64 nt, Human; identical to SEQ ID NO: 189879

SEQ ID NO: 457809 - RNA, 64 nt, Human; identical to SEQ ID NO: 189880

SEQ ID NO: 457810 - RNA, 64 nt, Human; identical to SEQ ID NO: 189881

SEQ ID NO: 457811 - RNA, 60 nt, Human
ugcccuuuuuccuucuaagucaugucugcugccugugagccugggaaggagugcuuucaa

SEQ ID NO: 457812 - RNA, 60 nt, Human
uuugcuuccacauuuucccaauaaauacuugccugugacauuuugccacuggaacacuaa

SEQ ID NO: 457813 - RNA, 60 nt, Human
gauaaugcuggcagccaaaggggcaaaauggccugugacauuauccuguucagagcuugg

SEQ ID NO: 457814 - RNA, 60 nt, Human
acuccuauucccccugaagucaggaccagugccugugaucuccauuacuuuauuuuccug

SEQ ID NO: 457815 - RNA, 60 nt, Human
gaugauaccucuuacaaacuuuaccucauagccugugaagcagguuggcauguggauuac

SEQ ID NO: 457816 - RNA, 60 nt, Human
ccaagaagucuggcuccugcuuuucuacaugccugugaaggagacuuuucaugaaacuga

SEQ ID NO: 457817 - RNA, 60 nt, Human
cugucccugaagggaaugucagggaagugugccugugagcugaauuaaaggacuggccuu

SEQ ID NO: 457818 - RNA, 60 nt, Human
ccuuuguugcacaaauagaguuuggaaaaagccugugaaaggugucuucuuugacuuaau

SEQ ID NO: 457819 - RNA, 60 nt, Human
ugaaugacaggcagcuccccaugguggucugccugugagcucuucaaguucuaauccuua

SEQ ID NO: 457820 - RNA, 60 nt, Human
gagaggguauucccugcaaguuucuggcuugccugugaugggugaugaggcuuuuagaga

SEQ ID NO: 457821 - RNA, 60 nt, Human
guggaaaguaucugccagccacagcaugaggccugugaaggcugacugagaaauccucug

SEQ ID NO: 457822 - RNA, 60 nt, Human
ugaauguacugguaaugccuaauguggucugccugugaaucuccccauguagaauuugcc

SEQ ID NO: 457823 - RNA, 60 nt, Human
cagagcaccacucugcugccccaccacgcggccugugaggagccacuaaaccuuuccgug

SEQ ID NO: 457824 - RNA, 60 nt, Human
gacauaaagaagacggagacuguucaggaggccugugagcgggagcucgcccugcgccug

SEQ ID NO: 457825 - RNA, 60 nt, Human
ugcagucaaggauucuucauuuuuagaaaugccugugaagaccuuggcagcgacguggcu

SEQ ID NO: 457826 - RNA, 60 nt, Human
guuuucccacauacuaggugcucaauucaugccugugaauggcgugagcccauaauggau

SEQ ID NO: 457827 - RNA, 64 nt, Human; identical to SEQ ID NO: 189859

SEQ ID NO: 457828 - RNA, 62 nt, Human
ccucaugcguugccugcccuuccuccauuguugcccuggaauguacgggacccaggggcagc

SEQ ID NO: 457829 - RNA, 60 nt, Human
ggaggacuggagcagucccuccucauggcggccugugaccaaggucggggaggaguggag

SEQ ID NO: 457830 - RNA, 60 nt, Human
ucucccucgcuggccugcuccuccugcagggccugugagcugcucacaacugggucaacg

SEQ ID NO: 457831 - RNA, 60 nt, Human
auaaaugucuuacucaaguucaaaccuccagccugugaaucaacugugucucuuuuuuga

SEQ ID NO: 457832 - RNA, 60 nt, Human
gaugcccagcagcccuguccugugucuugggccugugagucaaagaaaagguccuuuuca

SEQ ID NO: 457833 - RNA, 60 nt, Human
cugcccgagcauguaucggcaacaugggcagccugugaccgggucuggggcgaggccagg

SEQ ID NO: 457834 - RNA, 60 nt, Human
gcaagaaaggugcaagaaagugagcagucugccugugagugagcacagaugccggggugu

SEQ ID NO: 457835 - RNA, 60 nt, Human
ggucaccuuuugugaccugaggaaucccaggccugugagaaaagcaaaaauucacauugc

SEQ ID NO: 457836 - RNA, 60 nt, Human
gaaaugauacuguagacaaauguaaauaaagccugugagucaagcaucaagugguguuug

SEQ ID NO: 457837 - RNA, 60 nt, Human
gcauuccacaucagauuuaaagcaucaaaugccugugaaacagcaaagaugguugaagau

SEQ ID NO: 457838 - RNA, 60 nt, Human
uagcaaguuugagcauaggcucuuuuugcugccugugagcagucccucuggaaagaaaca

SEQ ID NO: 457839 - RNA, 60 nt, Human
gggagcuucuuucuccuuaaccuguggccugccugugaugaucugugacagcaaaagauu

SEQ ID NO: 457840 - RNA, 60 nt, Human
uuuacagcucuuggcauuuuccucgccuaggccugugagguaacugggaucgcaccuuuu

SEQ ID NO: 457841 - RNA, 60 nt, Human
aacagucugacugaugagaugcugcuccaagccugugaggggcgaacagcacacaaguaa

SEQ ID NO: 457842 - RNA, 60 nt, Human
cuccuccccacccucaugacugggaaggaagccugugaugaggcugagauaaagcacagg

SEQ ID NO: 457843 - RNA, 60 nt, Human
ccaugcgagauauuuauaccucaaacacuggccugugagcccuuuccaagucaguggaga

SEQ ID NO: 457844 - RNA, 60 nt, Human
ggguggguauuuggguccgacugagacuuggccugugaccaucauggcaguuggaguucu

SEQ ID NO: 457845 - RNA, 64 nt, Human; identical to SEQ ID NO: 189883

SEQ ID NO: 457846 - RNA, 64 nt, Human; identical to SEQ ID NO: 189884

SEQ ID NO: 457847 - RNA, 64 nt, Human; identical to SEQ ID NO: 189885

SEQ ID NO: 457848 - RNA, 64 nt, Human; identical to SEQ ID NO: 189886

SEQ ID NO: 457849 - RNA, 60 nt, Human
cucccaccugcaggacauuaaaaucuccaggccugugacacuggcaacuggccucugcuu

SEQ ID NO: 457850 - RNA, 60 nt, Human
agggcccauguagcuggcaagcugcaaaaggccugugauccaggaaagaugucccacagg

SEQ ID NO: 457851 - RNA, 60 nt, Human
uggugcuaggagcugacaauuuccaaagcagccugugaaguccuaggggcugggggccac

SEQ ID NO: 457852 - RNA, 60 nt, Human
cgggagucauuggcugggcuugagcccucagccugugauauguggaugcagcuguccagc

SEQ ID NO: 457853 - RNA, 60 nt, Human
cccaucacucaccuuugucugcaucccugggccugugaaugaugacagcaccugacauuc

SEQ ID NO: 457854 - RNA, 60 nt, Human
cccuucagcugcagguuccugagauuuggugccugugagcucugauuguaggaaugcaug

SEQ ID NO: 457855 - RNA, 60 nt, Human
aggggugcgccuccucugcccugcccaccagccugugauuugauggggucuucauugucc

SEQ ID NO: 457856 - RNA, 60 nt, Human
caagauacugaaaaauagagcugggacugagccugugaaugacaggaaugaucuauuacc

SEQ ID NO: 457857 - RNA, 60 nt, Human
cuaggcuucuccugcugaguccuggucuuggccugugaaugugccucguucaucccuggu

SEQ ID NO: 457858 - RNA, 60 nt, Human
aaguuuucugcucuacuuuccuuggcagcagccugugaacuacucaaaagaguccccuug

SEQ ID NO: 457859 - RNA, 60 nt, Human
uagggauguuaauaauuuuaguggaacaaagccugugaaaugauuguacauaguguuaau

SEQ ID NO: 457860 - RNA, 60 nt, Human
gagacccaagcuggguaugguggugugagagccugugaguccuagcuaccuggaggugag

SEQ ID NO: 457861 - RNA, 60 nt, Human
cuagcuucuguguggcccacagaguucacugccugugagacuuagcaccaagugcugagg

SEQ ID NO: 457862 - RNA, 60 nt, Human
cucuuaggggcucaccuaggugagugcacagccugugacgcuacagggagaggcugagua

SEQ ID NO: 457863 - RNA, 60 nt, Human
ccaguugguguucaaauagcacuugacucugccugugauaucuguaucuuuucucuaauc

SEQ ID NO: 457864 - RNA, 60 nt, Human
ggauguguuuguuaugaagaaaaucuggaugccugugauucgagaauugaaccugaaacc

SEQ ID NO: 457865 - RNA, 64 nt, Human; identical to SEQ ID NO: 189840

SEQ ID NO: 457866 - RNA, 64 nt, Human; identical to SEQ ID NO: 189841

SEQ ID NO: 457867 - RNA, 64 nt, Human; identical to SEQ ID NO: 189842

SEQ ID NO: 457868 - RNA, 64 nt, Human; identical to SEQ ID NO: 189858

SEQ ID NO: 457869 - RNA, 60 nt, Human
gcaucuggguccaucugacccauggggccugccugugagaaacagugggucccuucaaau

SEQ ID NO: 457870 - RNA, 60 nt, Human
ugugcgccccaugggacccccaguguucuugccugugaccucuuauugcgacaugcaggu

SEQ ID NO: 457871 - RNA, 60 nt, Human
uccacaccucggcaacagucuaagaugagagccugugacagguggcagcgcccccaggug

SEQ ID NO: 457872 - RNA, 60 nt, Human
uccuuugaggacgcccggggucucccacaggccugugaguugccucggcauaugacgcag

SEQ ID NO: 457873 - RNA, 60 nt, Human
uagagcuucauuuuugauauauuguuuacagccugugaaagugauuuauuuguguuaaua

SEQ ID NO: 457874 - RNA, 60 nt, Human
aucucagaacauuccucaccaucacugcaggccugugaacagauaacuuucaucaauuag

SEQ ID NO: 457875 - RNA, 60 nt, Human
uuuguccaugugcaaacgcuguauuccaaggccugugaauggcagccugaggaaguuuug

SEQ ID NO: 457876 - RNA, 60 nt, Human
cugggucagguuaaugguggugaacuaugugccugugagcucuucagagcugguuggguu

SEQ ID NO: 457877 - RNA, 60 nt, Human
agaagcagauguugccacgcuuccuauauagccugugagcuaauuaaaccccuuuucuua

SEQ ID NO: 457878 - RNA, 60 nt, Human
ucucccugguguuguagguucauuuuguuggccugugaugggcucuucaaggucuuuacc

SEQ ID NO: 457879 - RNA, 60 nt, Human
gcaucucagagaaggaggugaguucuuccugccugugauuucucuuggcgcuccccuccu

SEQ ID NO: 457880 - RNA, 60 nt, Human
cauaguugugcaugccuggcacaacaucaagccugugauuguguuuauugaugauguuga

SEQ ID NO: 457881 - RNA, 60 nt, Human
guugccauggugaccagggaccacguugcugccugugaaugcugagugagcgaguaaggg

SEQ ID NO: 457882 - RNA, 60 nt, Human
uucaggggaaacuugauuugagauuuuuaugccugugacuuccuuggaaaucaaauguaa

SEQ ID NO: 457883 - RNA, 60 nt, Human
aacuuuccuuuuuuaaaaucagcaugaugugccugugagcauggaagaguccucucagaa

SEQ ID NO: 457884 - RNA, 60 nt, Human
augaaaaagcgagcagauacuguuggucuagccugugaagcaauuaaucgaauguuucag

SEQ ID NO: 457885 - RNA, 64 nt, Human; identical to SEQ ID NO: 189887

SEQ ID NO: 457886 - RNA, 64 nt, Human; identical to SEQ ID NO: 189888

SEQ ID NO: 457887 - RNA, 64 nt, Human; identical to SEQ ID NO: 189889

SEQ ID NO: 457888 - RNA, 64 nt, Human; identical to SEQ ID NO: 189891

SEQ ID NO: 457889 - RNA, 60 nt, Human
uuggaaugaaagauacuugaauuauugugcgccugugagcgcccagcuucuguuucauag

SEQ ID NO: 457890 - RNA, 60 nt, Human
gggaaauucggcugggugcagugacucaaugccugugaucccaguacuuugggagguuga

SEQ ID NO: 457891 - RNA, 60 nt, Human
acuggccuccacucaaugggaaacugacucgccugugaaagacacagugggagagcugaa

SEQ ID NO: 457892 - RNA, 60 nt, Human
uugaaaucuccauccuaucauuuccguuuugccugugacuguaaagaguagccauucuuu

SEQ ID NO: 457893 - RNA, 60 nt, Human
ugcagggcaugggcucugguucugccaggagccugugacacccccaggaaggggguggaa

SEQ ID NO: 457894 - RNA, 60 nt, Human
guggcucccccaaacgaaguacugacuucagccugugaggggaggguugagggaggcucu

SEQ ID NO: 457895 - RNA, 60 nt, Human
cuuaucuguaaagcaaagcgacaccagcaagccugugagcauuguguauauagcagacau

SEQ ID NO: 457896 - RNA, 60 nt, Human
ucuccaggcacaaaggcccgaacacaggaagccugugaccauggcagccuugucuuaugg

SEQ ID NO: 457897 - RNA, 60 nt, Human
gacuggcgucugacccgccccuugacccaagccugugaugacauggugcugauucugggg

SEQ ID NO: 457898 - RNA, 60 nt, Human
uggacuuaacaacauaccaaggcagcucuggccugugacucaggcguuuguuggagagcu

SEQ ID NO: 457899 - RNA, 60 nt, Human
cugagcagagcaugugggaacuguucaguggccugugaacugucuuccuuguucuagcca

SEQ ID NO: 457900 - RNA, 60 nt, Human
uacuacuagcuauuguucaauucaggugaggccugugaugacauauauguagcaugugcu

SEQ ID NO: 457901 - RNA, 60 nt, Human
gaggacaucccagauuugcuuauacucagugccugugauauugaguuuaaggauuugagg

SEQ ID NO: 457902 - RNA, 60 nt, Human
uucuguaugcggugacggcggggugugguggccugugaggggccccuggcccaggaggag

SEQ ID NO: 457903 - RNA, 60 nt, Human
cuaaagccugaucuucccacuggacugucggccugugaggaugaggacgugucuaucaca

SEQ ID NO: 457904 - RNA, 60 nt, Human
acugggccucaacuugaucuucuaccccgugccugugacucagacugggaaauacugagc

SEQ ID NO: 457905 - RNA, 64 nt, Human; identical to SEQ ID NO: 189827

SEQ ID NO: 457906 - RNA, 64 nt, Human; identical to SEQ ID NO: 189828

SEQ ID NO: 457907 - RNA, 64 nt, Human; identical to SEQ ID NO: 189829

SEQ ID NO: 457908 - RNA, 64 nt, Human; identical to SEQ ID NO: 189896

SEQ ID NO: 457909 - RNA, 60 nt, Human
cuggcacagcagacuggagacugaggcagggccugugaguggacagagcaccccuggcug

SEQ ID NO: 457910 - RNA, 60 nt, Human
uucggccgcuacugcgagggcuccgaggaugccugugaggagccgugcuucccgaguguc

SEQ ID NO: 457911 - RNA, 60 nt, Human
aaacuguacaaaugugaagaauauggcaaagccugugaaugguccacaaaccugaaugag

SEQ ID NO: 457912 - RNA, 60 nt, Human
ccuuaacuguuuuuaacauggauccucugugccugugaauuuacuugcaugcuuguacuu

SEQ ID NO: 457913 - RNA, 60 nt, Human
acucccuggcacugaagagucugaacacuggccugugauugguccauuccaggaccuuca

SEQ ID NO: 457914 - RNA, 60 nt, Human
auaaauagagggccaggugugguggcucacgccugugaucccagcacuuugggaggccaa

SEQ ID NO: 457915 - RNA, 60 nt, Human
uguguagagaauagaaagauuuagauauaugccugugacaggaauagauucuggguucag

SEQ ID NO: 457916 - RNA, 60 nt, Human
agugcugccuuuucacaccaaauccaagaagccugugaugucuuaugaaccuuaugagaa

SEQ ID NO: 457917 - RNA, 60 nt, Human
uugccucuuugugugugucccgauguuccugccugugagucggccuuacuccguuuccuu

SEQ ID NO: 457918 - RNA, 60 nt, Human
aauugguacauaugcauuuuucuggagagagccugugaaacugaacagauuuucaguggg

SEQ ID NO: 457919 - RNA, 60 nt, Human
guuucauuuaaaaaguaacuuuuuuuuuuugccugugaauugagugcucugauguaaaac

SEQ ID NO: 457920 - RNA, 60 nt, Human
uaauauaauuaaaagcaacagcaagcagcagccugugaagauuuugcucaucuuuuuuau

SEQ ID NO: 457921 - RNA, 60 nt, Human
aagauaaauaggccaggcaugguggcucacgccugugaucccagcacuuugggaggccga

SEQ ID NO: 457922 - RNA, 60 nt, Human
uuccuuugugacucaagguugaauuaaaaugccugugaacugcaaacuugcuuaugauug

SEQ ID NO: 457923 - RNA, 60 nt, Human
gaaaacgcuucggucaguuuuagugacauagccugugaugaugggucuggugacuauuau

SEQ ID NO: 457924 - RNA, 60 nt, Human
uuacguaucuucuaucuacgcccuuccugugccugugacucuccccaaauugcccuguug

SEQ ID NO: 457925 - RNA, 62 nt, Human
cauccacagcagcugggucaccugauagggccgcccuggacuuggggucccuccaccugggg

SEQ ID NO: 457926 - RNA, 62 nt, Human
cagauggaugccaugggcuaugggagcaaauugcccuggaccuuugccugaaugggggcagg

SEQ ID NO: 457927 - RNA, 62 nt, Human
gagguuggcagaaacguucccaaacucccccagcccuggaccccagcagaugaggaaacggc

SEQ ID NO: 457928 - RNA, 62 nt, Human
cuucccugcggcuccgugcccgcugggaaagugcccuggaccggcagcuggcgcaccaggcc

SEQ ID NO: 457929 - RNA, 60 nt, Human
agauacaacagaggagauaaucuccaggaugccugugaagaaagaucccuggaucccagg

SEQ ID NO: 457930 - RNA, 60 nt, Human
gaggucuccuggcccuggugugcccuuaaugccugugacaguuggccucugugaauauug

SEQ ID NO: 457931 - RNA, 60 nt, Human
cuagcaggccacaggaagcaaagccuuggugccugugagcucaucucccaggauggugac

SEQ ID NO: 457932 - RNA, 60 nt, Human
acaaaaaauuagcugggcaugguggugcaugccugugauuccagcuacuugggagguuga

SEQ ID NO: 457933 - RNA, 60 nt, Human
ccccagccuugaggugcccugcccggcggggccugugaauaugcaaugggagucccaggc

SEQ ID NO: 457934 - RNA, 60 nt, Human
gaguuccagccugaaguaugcugugaucaugccugugaauaaccacugcacuccagccag

SEQ ID NO: 457935 - RNA, 60 nt, Human
gccugugccaaaguggccagagauugggcugccugugauacccaucagcccacugccccg

SEQ ID NO: 457936 - RNA, 60 nt, Human
guuuucuaccagaggcucagaauacgcugagccugugaccagaggaugauggauggucgg

SEQ ID NO: 457937 - RNA, 60 nt, Human
cuggaguguaaugcucggugggagccgucagccugugaacugccaggcagcugcaguuag

SEQ ID NO: 457938 - RNA, 60 nt, Human
aaauaaugugacuucugaggcccuuauguagccugugacauuaagcauucucgcaauuag

SEQ ID NO: 457939 - RNA, 60 nt, Human
aaaucagaugcagcuguuuuaacuaucccugccugugacuuucaagguuuguaucuguga

SEQ ID NO: 457940 - RNA, 60 nt, Human; identical to SEQ ID NO: 457929

SEQ ID NO: 457941 - RNA, 60 nt, Human
ugcucacaccaaagccuuggaccccucccagccugugaccuuugggaccaacuccaccua

SEQ ID NO: 457942 - RNA, 60 nt, Human
aucagaguacauauauucuugcuguacaaugccugugauguugaggaggguucuuuuuua

SEQ ID NO: 457943 - RNA, 60 nt, Human
ugccaggagguggaggaaggagcaggugcugccugugacucugaacagcaggaccuuggu

SEQ ID NO: 457944 - RNA, 60 nt, Human
uuccacacucggugugugcauacaguuucugccugugaucauuucuuuauguuauuauuu

SEQ ID NO: 457945 - RNA, 64 nt, Human; identical to SEQ ID NO: 189850

SEQ ID NO: 457946 - RNA, 64 nt, Human; identical to SEQ ID NO: 189851

SEQ ID NO: 457947 - RNA, 64 nt, Human; identical to SEQ ID NO: 189852

SEQ ID NO: 457948 - RNA, 64 nt, Human; identical to SEQ ID NO: 189901

SEQ ID NO: 457949 - RNA, 60 nt, Human
cuacacauguccccguucagccuuuuccgugccugugaggcccuucuucagguuggggug

SEQ ID NO: 457950 - RNA, 60 nt, Human
uaaaauauuuaauccuaauucuuaguccuugccugugagauaugaggucuuacaggagac

SEQ ID NO: 457951 - RNA, 58 nt, Human
cauguuaaaauugccaaauaaaguaccucugccugugauauuuucuggauguccuuua

SEQ ID NO: 457952 - RNA, 60 nt, Human
aguuuuacuucauuuccugccccuuucagggccugugaggaugcccaugagcuaccgcug

SEQ ID NO: 457953 - RNA, 60 nt, Human
caaaaaggaccaacuggcuucugugcacuagccugugauuaacuugcuuaguaugguucu

SEQ ID NO: 457954 - RNA, 60 nt, Human
aaaagcauaugaauccuaggaaagggcucagccugugauaggcauucaauaaauacucca

SEQ ID NO: 457955 - RNA, 60 nt, Human
caucauguugggcauuucuuuuccagauuggccugugauggaaaggaaggcuucuaauua

SEQ ID NO: 457956 - RNA, 60 nt, Human
uuaauuuaaaaagccuaauuuuaaagugcugccugugaguaacucuugaauaaaaacaaa

SEQ ID NO: 457957 - RNA, 60 nt, Human
agaccagugccaaucugaacauuguuaauggccugugacaugaugagcacaggaacaggc

SEQ ID NO: 457958 - RNA, 60 nt, Human
guuuaguugagaggcugugauuuuacucuugccugugaaccucaugcaugaaagcagcac

SEQ ID NO: 457959 - RNA, 60 nt, Human
caccaagucuacgggugccagaucaguagggccugugauuuccugucaguguccucagcu

SEQ ID NO: 457960 - RNA, 60 nt, Human
gucggggauguuaaggguggggaguauccugccugugaccucuagguuaugaaaacuauc

SEQ ID NO: 457961 - RNA, 60 nt, Human
cuagcaggguuugaagucuguggcuuaucagccugugacacagaguacccagugaaagug

SEQ ID NO: 457962 - RNA, 60 nt, Human
uaaaaggaacaauuuuuucccacuuuugaugccugugaugcaauuuuuuauugccuacaa

SEQ ID NO: 457963 - RNA, 60 nt, Human
gcaaucccaaacugcaagugccauaagugggccugugaggucacaccgcccggcccgagg

SEQ ID NO: 457964 - RNA, 60 nt, Human
ggugacuugucagugucugugucugugugugccugugagccagcaucucuguaucagugu

SEQ ID NO: 457965 - RNA, 64 nt, Human; identical to SEQ ID NO: 189906

SEQ ID NO: 457966 - RNA, 64 nt, Human; identical to SEQ ID NO: 189907

SEQ ID NO: 457967 - RNA, 64 nt, Human; identical to SEQ ID NO: 189908

SEQ ID NO: 457968 - RNA, 64 nt, Human; identical to SEQ ID NO: 189909

SEQ ID NO: 457969 - RNA, 60 nt, Human
acaggucugugugugcaaucucacauaucugccugugagacuggauugagacccauucgu

SEQ ID NO: 457970 - RNA, 60 nt, Human
uaauuaucuuacuaauuccaucccagaaaagccugugaucccugaggccagaauugacuc

SEQ ID NO: 457971 - RNA, 60 nt, Human
cccaggcccccucccugccuccuccuuccugccugugaugcuccgucucaaacagccgaa

SEQ ID NO: 457972 - RNA, 55 nt, Human
gaccacgcccuuuaaccuaagaccugccugugacuugaggguuaagaagaaagag

SEQ ID NO: 457973 - RNA, 60 nt, Human
uuacaccuucauguaaggaugucuuauuaagccugugaccuggcaaguguuuuguuuggu

SEQ ID NO: 457974 - RNA, 60 nt, Human
aacauuuaaaucacugucaauugcagagcugccugugaucuucuuagguuauagccaagu

SEQ ID NO: 457975 - RNA, 60 nt, Human
caggacaaagcaaaaacaaacaaaaagcaagccugugaauauaauuuaauuugaaacugc

SEQ ID NO: 457976 - RNA, 60 nt, Human
cuauuguauguuaacacacugaugaugugagccugugagaugagccaaucaccaguuguu

SEQ ID NO: 457977 - RNA, 60 nt, Human
gcuggcucaggcucagagccucucaucaccgccugugaaauggggaccacccuccuaauc

SEQ ID NO: 457978 - RNA, 60 nt, Human
agcagucacuucagacaggagccacagggagccugugagggaguagugcgguggugguga

SEQ ID NO: 457979 - RNA, 60 nt, Human
uggagcccaguccagcgacaccuugguuuggccugugagacugagaagagagccagccac

SEQ ID NO: 457980 - RNA, 60 nt, Human
agugccugggggggcggggacuccgcacaugccugugaugucacaguuacugucaguuca

SEQ ID NO: 457981 - RNA, 60 nt, Human
uucuacaggacuucuacgugugugauaaaagccugugaaucgugagucccugaaauaugg

SEQ ID NO: 457982 - RNA, 60 nt, Human
cauugaaaagggacaggacccuucggaggugccugugaggagaggggagcaggaccucuc

SEQ ID NO: 457983 - RNA, 60 nt, Human
agucagcagaauggaagcuuagaggaacuugccugugagcgcuggucuuuguguuugguu

SEQ ID NO: 457984 - RNA, 60 nt, Human
caaccucacggaccaagaggaucccuggcugccugugaauggcccacauuugaguggugc

SEQ ID NO: 457985 - RNA, 64 nt, Human; identical to SEQ ID NO: 189797

SEQ ID NO: 457986 - RNA, 64 nt, Human; identical to SEQ ID NO: 189798

SEQ ID NO: 457987 - RNA, 64 nt, Human; identical to SEQ ID NO: 189799

SEQ ID NO: 457988 - RNA, 64 nt, Human; identical to SEQ ID NO: 189800

SEQ ID NO: 457989 - RNA, 60 nt, Human
gaugccgcuguccugggggagcccgcgggagccugugaauguugauacgagcuggccagu

SEQ ID NO: 457990 - RNA, 60 nt, Human
gggcgagcugggcgagcugggcuggggagagccugugaggaccgagaggagaaaugagaa

SEQ ID NO: 457991 - RNA, 60 nt, Human
uguuuuggagccuguugacuuuguaucucugccugugauuuucuuuucuaaaugaaacuc

SEQ ID NO: 457992 - RNA, 60 nt, Human
ucaugugacuggagucaucuuguccaaacugccugugaauauaucuucucucaauuggaa

SEQ ID NO: 457993 - RNA, 60 nt, Human
uugaguaggggccagagggggcucugcucggccugugagccccguuccuaccugugccug

SEQ ID NO: 457994 - RNA, 60 nt, Human
gaguagcuuccccgaggacccccaggcuuggccugugauugcgcaaacccacauuuccua

SEQ ID NO: 457995 - RNA, 60 nt, Human
cuucugauuugaaauuguaccuuuucucaggccugugauucacagacuuuaacaugaauc

SEQ ID NO: 457996 - RNA, 60 nt, Human
gaacaagacugacugggcgugguggcucaugccugugauccuagcacuuugcgaggccga

SEQ ID NO: 457997 - RNA, 60 nt, Human
gguaacucacaugaccaaacaaaccaaagugccugugacggggcggguggcgucuaccca

SEQ ID NO: 457998 - RNA, 60 nt, Human
auuaauaaaaauaaaggcauuuuaaggauggccugugauuaucuugggaagcagagugau

SEQ ID NO: 457999 - RNA, 60 nt, Human
ucuguacuggccauuuguggccagggccaagccugugacucaacuccaggggcaagaugg

SEQ ID NO: 458000 - RNA, 60 nt, Human
cuggagacccagcacucugguucucucucugccugugagaagcggaauggguacugucua

SEQ ID NO: 458001 - RNA, 60 nt, Human
cuuuuuuuuuuuuuguuuuuuuuuuuaagagccugugauaguuacuguggagcagccagu

SEQ ID NO: 458002 - RNA, 60 nt, Human
gggugaggcucagcaacugagcaaauaugugccugugaguuugccaguagagcugugaag

SEQ ID NO: 458003 - RNA, 60 nt, Human
aacuuguuucuuaaaaaugcgguuaauaaugccugugaacuaaaaaaaugggaagcccuc

SEQ ID NO: 458004 - RNA, 60 nt, Human
caaaucuugggucuuggggacuaacccaaugccugugaagcagucagcccuuauggccaa

SEQ ID NO: 458005 - RNA, 64 nt, Human; identical to SEQ ID NO: 189801

SEQ ID NO: 458006 - RNA, 64 nt, Human; identical to SEQ ID NO: 189802

SEQ ID NO: 458007 - RNA, 64 nt, Human; identical to SEQ ID NO: 189803

SEQ ID NO: 458008 - RNA, 64 nt, Human; identical to SEQ ID NO: 189914

SEQ ID NO: 458009 - RNA, 60 nt, Human
ugggcagcccagcacuucccgcugcugccugccugugauguccacucugcuuaagccuuu

SEQ ID NO: 458010 - RNA, 60 nt, Human
cuacuauaaaaagacaaccaacggccgacugccugugaaguggauggcacccgaggcauu

SEQ ID NO: 458011 - RNA, 60 nt, Human
cuggucauuggucuccgagagaggagguuugccugugauuuccuaauuaucgcuagggcc

SEQ ID NO: 458012 - RNA, 60 nt, Human
ccuccacgucagaggcccccuggccgcggggccugugagcggagaggggcccugcuuccc

SEQ ID NO: 458013 - RNA, 60 nt, Human
agucuccaguuacugaacagaugaaaaggagccugugagagggcuguuaacauuagcaaa

SEQ ID NO: 458014 - RNA, 60 nt, Human
cucuagcaacccagaagacaacccuggguagccugugaucagugucuggagacguuucuu

SEQ ID NO: 458015 - RNA, 60 nt, Human
aguccuuccacuuugaccccauggaggauugccugugaggaacuuaaacgagucuaccag

SEQ ID NO: 458016 - RNA, 60 nt, Human
auaaaaccuguucugucccaaauaaaaccagccugugauguucaagggacuggaauaaag

SEQ ID NO: 458017 - RNA, 60 nt, Human
ggcuggcacaggcuuuggggaagcccuggagccugugaagacccuggaaaccucaugagg

SEQ ID NO: 458018 - RNA, 60 nt, Human
gcauuuuaaagagaccccacaggaguucuggccugugacuaacuaacugccccaccccag

SEQ ID NO: 458019 - RNA, 60 nt, Human
uacuuucaaaugccugaggggcucaucgacgccugugacagggagaaaggauacuucuga

SEQ ID NO: 458020 - RNA, 60 nt, Human
gugcguuugcugucaggagcuaguuuaccagccugugacaacugagugcuuccacaaugu

SEQ ID NO: 458021 - RNA, 60 nt, Human
gauucuuaucacauaaugugcaggccaugugccugugaacuugaaguuugcgcaaaaugu

SEQ ID NO: 458022 - RNA, 60 nt, Human
uacuaaaauuagcuggucgcgguggcuucugccugugauuccggcuacuugggaggcuga

SEQ ID NO: 458023 - RNA, 60 nt, Human
agagaagcaucugggggcacuccaaaaggggccugugaugucagccacugggguguugug

SEQ ID NO: 458024 - RNA, 60 nt, Human
uguaugugaggcacccauaacaguaguuuugccugugagucgucuucacacaugcuguuu

SEQ ID NO: 458025 - RNA, 64 nt, Human; identical to SEQ ID NO: 189805

SEQ ID NO: 458026 - RNA, 64 nt, Human; identical to SEQ ID NO: 189806

SEQ ID NO: 458027 - RNA, 64 nt, Human; identical to SEQ ID NO: 189807

SEQ ID NO: 458028 - RNA, 64 nt, Human; identical to SEQ ID NO: 189808

SEQ ID NO: 458029 - RNA, 60 nt, Human
uaucaggggugcauucuggccaaggggugggccugugaaucaauccugggcaaucagaca

SEQ ID NO: 458030 - RNA, 60 nt, Human
augacagccacucacuaggggauggagcaagccugugacuccaagcugggcccaagccca

SEQ ID NO: 458031 - RNA, 60 nt, Human
aggagaacaggugggcgugcuggugaccccgccugugaugcucugccaacuacaaaugcu

SEQ ID NO: 458032 - RNA, 60 nt, Human
agaacccaaaccucaggucucaccccuguggccugugauuaugaauaaagauuaucuuug

SEQ ID NO: 458033 - RNA, 60 nt, Human
ccucugcacuuccacacauggcacaguucugccugugaccugccgccuaagcuuuacugg

SEQ ID NO: 458034 - RNA, 60 nt, Human
uaaguaaguuacacuacaguucucacaagagccugugaggggaugucaggugcaucauua

SEQ ID NO: 458035 - RNA, 60 nt, Human
uaauuccuggacuggugagauuggugguaggccugugaaauuugcccuaguuacuaccau

SEQ ID NO: 458036 - RNA, 60 nt, Human
ggcuguuuugagucuaauuuccucugugcggccugugaccggcgcugggaggaacacgag

SEQ ID NO: 458037 - RNA, 60 nt, Human
guugcaauggcuaaaucccaaacauccuuggccugugaagucuucauuuccagaauacug

SEQ ID NO: 458038 - RNA, 60 nt, Human
aguccucuugucuauuuucucuuggguugagccugugacuugguuucucuuuguccuuuu

SEQ ID NO: 458039 - RNA, 60 nt, Human
cauuucugagaucaggaugcuuguauaguggccugugaggugacagauuggcagggccca

SEQ ID NO: 458040 - RNA, 60 nt, Human
cuugguggccaucaagagggagccagucaggccugugagggccguagaccuuguauauac

SEQ ID NO: 458041 - RNA, 60 nt, Human
guggugggaugggagagagccccugugaaagccugugaggaucugaagaguaaagggcug

SEQ ID NO: 458042 - RNA, 60 nt, Human
ggaguuuaagguuguagugcgcuagacggcgccugugaauagccacugcacucuagucug

SEQ ID NO: 458043 - RNA, 60 nt, Human
acugcaguucucucaugcccacaggcacuggccugugaccuucgcaggggucccggcccc

SEQ ID NO: 458044 - RNA, 60 nt, Human
guagacaguuucaaacaucacaguuugaaugccugugaaugacaagucagugggaaagag

SEQ ID NO: 458045 - RNA, 64 nt, Human; identical to SEQ ID NO: 189809

SEQ ID NO: 458046 - RNA, 64 nt, Human; identical to SEQ ID NO: 189810

SEQ ID NO: 458047 - RNA, 64 nt, Human; identical to SEQ ID NO: 189811

SEQ ID NO: 458048 - RNA, 64 nt, Human; identical to SEQ ID NO: 189813

SEQ ID NO: 458049 - RNA, 60 nt, Human
ucaaauccagccugcugccugcuuuuuauggccugugagcuaggaauuguguuuauaauu

SEQ ID NO: 458050 - RNA, 60 nt, Human
caugaugucacccaccccuugucaagcauugccugugauugcccagcccagauucaucug

SEQ ID NO: 458051 - RNA, 60 nt, Human
augguuuccaucuccgauuuccucaucagggccugugaauacccaggugccuguaucuuu

SEQ ID NO: 458052 - RNA, 60 nt, Human
cuacuggccuucccccaccacagcagcccugccugugaagcucuuguuucugacauuuca

SEQ ID NO: 458053 - RNA, 60 nt, Human
guccccugagucugcuguuuaccucauugggccugugauguuaacauuucgugcgacugc

SEQ ID NO: 458054 - RNA, 60 nt, Human
uuaagccugguuucucaguuacugagagaggccugugaacaguucuagcuaugaucauga

SEQ ID NO: 458055 - RNA, 60 nt, Human
ccugccggaggacacuguaguuuuugagaagccugugaagaccauccacuggaacggguc

SEQ ID NO: 458056 - RNA, 60 nt, Human
agguacgugcagcacuacggccugggcagugccugugacaacguagagcgcgugcugaag

SEQ ID NO: 458057 - RNA, 60 nt, Human
aucuccaguuaaagggccuguuucuuacuggccugugaggugcaccguagugccuugggc

SEQ ID NO: 458058 - RNA, 60 nt, Human
accacccacuucugcugaaaugcauugggagccugugaaagcacaaagcuggaggcuggg

SEQ ID NO: 458059 - RNA, 60 nt, Human
agauguauaacuaggagcuuugacucaggagccugugacauacccccucccccaccguug

SEQ ID NO: 458060 - RNA, 60 nt, Human
agggaagaaggccugcucaccaaugaugaggccugugaagccacgggcugggucauaagg

SEQ ID NO: 458061 - RNA, 60 nt, Human
cuccuccucacugccccacugugcuccugggccugugaccccagugcucaggcaccuugc

SEQ ID NO: 458062 - RNA, 60 nt, Human
ucaccaugcccggggccucccuucccaccugccugugagaauuggagguuagugccugaa

SEQ ID NO: 458063 - RNA, 60 nt, Human
cucucacggcaugacagccuucgucacccagccugugaggguccugacuggagcaccuuc

SEQ ID NO: 458064 - RNA, 60 nt, Human
ucuguguccuugcugccuucauccccuggggccugugaauaaagcugcagaacccccuuc

SEQ ID NO: 458065 - RNA, 64 nt, Human; identical to SEQ ID NO: 189818

SEQ ID NO: 458066 - RNA, 64 nt, Human; identical to SEQ ID NO: 189819

SEQ ID NO: 458067 - RNA, 64 nt, Human; identical to SEQ ID NO: 189820

SEQ ID NO: 458068 - RNA, 64 nt, Human; identical to SEQ ID NO: 189821

SEQ ID NO: 458069 - RNA, 60 nt, Human
gacuacuguugggucccugauuccaggcuggccugugaaggauugccccagguguccccu

SEQ ID NO: 458070 - RNA, 60 nt, Human
uuuuaauaaaacuuuuaaaccauauauuuagccugugaccaggggggccaaacccuaaga

SEQ ID NO: 458071 - RNA, 60 nt, Human
ggggaaaucccuuuuccugccugccugucugccugugaccuguguacguauuacaggcuu

SEQ ID NO: 458072 - RNA, 60 nt, Human
gugaauggccugcucucccuggcccuaucagccugugaacuucacuuaggccccaagcug

SEQ ID NO: 458073 - RNA, 60 nt, Human
augggaggagaccagcgguccaugggucuggccugugagucuccccuugcagccugguca

SEQ ID NO: 458074 - RNA, 60 nt, Human
gggccccauuccaccgccuccccaacuugagccugugaccuugggaccaaagggggaguc

SEQ ID NO: 458075 - RNA, 60 nt, Human
uuuauauuguauuguucuaaauaauggguagccugugaaauaagaucuugccacccaugu

SEQ ID NO: 458076 - RNA, 60 nt, Human
gcguagcgugcccgugugcauguccuuugcgccugugaccaccaccccaacaaaccaucc

SEQ ID NO: 458077 - RNA, 60 nt, Human
accaggcugugucccucuucucuucccugcgccugugaugcugggcacuucaucugaucg

SEQ ID NO: 458078 - RNA, 60 nt, Human
uaguuugcuguggccuucccgguugugagagccugugauccuuagaugugucuccuguuu

SEQ ID NO: 458079 - RNA, 60 nt, Human
uauauauguauuaccaaaagcagucuaucugccugugaccuccaauguacacugccaaac

SEQ ID NO: 458080 - RNA, 51 nt, Human
agcugagcagaccccugugaugccugugaccucaauuaaagcaauuccuuu

SEQ ID NO: 458081 - RNA, 60 nt, Human
uaucucucgggugcccucagagccaccucugccugugaucgucugaugaggcucccuccc

SEQ ID NO: 458082 - RNA, 60 nt, Human
uggaugcagagagagugugacagaggaucugccugugaaccaccugggauuagucaaguc

SEQ ID NO: 458083 - RNA, 60 nt, Human
ucagcaucugggccaggcaagauggcucacgccugugaucccagcauuuugggaggccga

SEQ ID NO: 458084 - RNA, 60 nt, Human
cuucuuccuguguggcaggaggcugcggcugccugugaccugaugagcucauguuggcug

SEQ ID NO: 458085 - RNA, 64 nt, Human; identical to SEQ ID NO: 189892

SEQ ID NO: 458086 - RNA, 64 nt, Human; identical to SEQ ID NO: 189893

SEQ ID NO: 458087 - RNA, 64 nt, Human; identical to SEQ ID NO: 189894

SEQ ID NO: 458088 - RNA, 62 nt, Human
ccauguccuucccccacuaaauggccagagaggcccuggacaaccucuugcggcccuggcuu

SEQ ID NO: 458089 - RNA, 60 nt, Human
gggucaccucauauuuauuuaucccuucuugccugugaggacugcggcuuuucgcugugg

SEQ ID NO: 458090 - RNA, 60 nt, Human
gggugucagaugcucucaggagggugcccagccugugaggcacuggcaagguagggggca

SEQ ID NO: 458091 - RNA, 60 nt, Human
ugaccacaguaccuuaauuucuaggugggugccugugaugguucauuguagguaaggaca

SEQ ID NO: 458092 - RNA, 60 nt, Human
gacaguaaaggcucucugccugcugccaaggccugugacuuucuaaccuggccucacgcu

SEQ ID NO: 458093 - RNA, 60 nt, Human
ugaagcagugugggccugaagugugauuuggccugugaacuugggcugugccagggcuuc

SEQ ID NO: 458094 - RNA, 60 nt, Human
aaagaugcccaauuguacuuuuguucuauagccugugaaauggcuaguugaucauuuuuc

SEQ ID NO: 458095 - RNA, 60 nt, Human
uucauuuuaaaucuaugcaaaaaagcgaaugccugugaugcuaccauauuccugguaaaa

SEQ ID NO: 458096 - RNA, 60 nt, Human
guuaaagcagugcuucucaaaccuugaugugccugugaaucaccuaggggucuuguuaag

SEQ ID NO: 458097 - RNA, 60 nt, Human
ggucuuagcccccaguuccacucuggaugggccugugacaccccaaagagaagaagggga

SEQ ID NO: 458098 - RNA, 60 nt, Human
gucccagagcaaacucucucugcucucggagccugugacacuggcuaugugcuccacagu

SEQ ID NO: 458099 - RNA, 60 nt, Human
auucaucauggguaccacaggaaccugggggccugugaaacuacaaccaaaaggcacaca

SEQ ID NO: 458100 - RNA, 60 nt, Human
aagucuagagucuuuguugguuagaggacugccugugauccuggccacuaggccaagagg

SEQ ID NO: 458101 - RNA, 60 nt, Human
ggccuugauguuccagacaauaauaaaugcgccugugacuuagccuuggugucagucucu

SEQ ID NO: 458102 - RNA, 60 nt, Human
ccagucugaagugccuacuggggggcuuuggccugugagccauugucccucuuuggaaca

SEQ ID NO: 458103 - RNA, 60 nt, Human
cugcuggcagccaccuugagaccucaccgggccugugauauuugcucuccugaacucuca

SEQ ID NO: 458104 - RNA, 60 nt, Human
aagcauuggaggcccagugcaauggcucacgccugugaucccagcacuuugggaggccaa

SEQ ID NO: 458105 - RNA, 64 nt, Human; identical to SEQ ID NO: 189814

SEQ ID NO: 458106 - RNA, 64 nt, Human; identical to SEQ ID NO: 189815

SEQ ID NO: 458107 - RNA, 64 nt, Human; identical to SEQ ID NO: 189816

SEQ ID NO: 458108 - RNA, 64 nt, Human; identical to SEQ ID NO: 189826

SEQ ID NO: 458109 - RNA, 60 nt, Human
uguugaaauaaacccaacucuucaugauuugccugugacuuauuuuuaaaacuuuuuuaa

SEQ ID NO: 458110 - RNA, 58 nt, Human
ugucacucacugacaaauagaccuuucagccugugagccucugcacaaagcagaggcu

SEQ ID NO: 458111 - RNA, 60 nt, Human
guccugagcacugccaggagggacaaaggagccugugaacccaggacaagcaugguccca

SEQ ID NO: 458112 - RNA, 60 nt, Human
gguuagagaagaaccgggaugcaaggagcugccugugacaccuggccugcccuuucucag

SEQ ID NO: 458113 - RNA, 60 nt, Human
acaguuguaagucagaguuaauauaauagggccugugaaaacagaggcuuuugcauuguc

SEQ ID NO: 458114 - RNA, 60 nt, Human
augauucaaaaucuaagcaguuucgauuuugccugugaauauggugucugucauucaggg

SEQ ID NO: 458115 - RNA, 60 nt, Human
ucccagaguuuugguuuuugaacuagcaaugccugugaaaaagaaacugaauaccuaaga

SEQ ID NO: 458116 - RNA, 60 nt, Human
ucucacuccaccacccaaaagucaaaaggugccugugaggcaggggcggagugauacaac

SEQ ID NO: 458117 - RNA, 60 nt, Human
ugcccucugccacccaggcugcguccaacagccugugacucuucccuggagaccccuucu

SEQ ID NO: 458118 - RNA, 60 nt, Human
gagaauuucaggcucuucucuccggcuccagccugugauuguccagguguggccuaggcc

SEQ ID NO: 458119 - RNA, 60 nt, Human
gacaguaccuuucaaugauuaauuuuaauagccugugaguccaaguaaaugaucacuuua

SEQ ID NO: 458120 - RNA, 60 nt, Human
ccucucugggaaaacccagggugagguucagccugugagggcugggauggguuucguggg

SEQ ID NO: 458121 - RNA, 60 nt, Human
uuacagcuuagacuuuguacuuacugcccugccugugacaguuguaugccuucauuuugu

SEQ ID NO: 458122 - RNA, 60 nt, Human
uaauuguucuuuuaucuuacaauuguuuaagccugugaucuuucuucucccagcuaagag

SEQ ID NO: 458123 - RNA, 60 nt, Human
cugggagaguggaguucccguagggcauaggccugugaaguaacacuggggcagauaugu

SEQ ID NO: 458124 - RNA, 60 nt, Human
uuguacuauaugcaacuccuacuucacauugccugugaccauucagaauagaaaaagguc

SEQ ID NO: 458125 - RNA, 57 nt, Human; identical to SEQ ID NO: 189831

SEQ ID NO: 458126 - RNA, 64 nt, Human; identical to SEQ ID NO: 189832

SEQ ID NO: 458127 - RNA, 64 nt, Human; identical to SEQ ID NO: 189833

SEQ ID NO: 458128 - RNA, 64 nt, Human; identical to SEQ ID NO: 189834

SEQ ID NO: 458129 - RNA, 60 nt, Human
gguguuugcauguggccauuaccgucauuggccugugaagcauuggacauuuauagauaa

SEQ ID NO: 458130 - RNA, 60 nt, Human
ggccaagcgcgcaagggcgcgggcgagcaggccugugaauucgcaggaucauuucagacc

SEQ ID NO: 458131 - RNA, 60 nt, Human
cugagccuauucacagugccuaaccuggaagccugugaggaacaggccucaggcccuugc

SEQ ID NO: 458132 - RNA, 60 nt, Human
aauaauuuggguucuuaaacuuaauuucuggccugugacuagaauguuuaaaaaaaaaaa

SEQ ID NO: 458133 - RNA, 60 nt, Human
ccagugaauuggcacaagaacuaugccaucgccugugagcggaugcugcgucuucaggca

SEQ ID NO: 458134 - RNA, 60 nt, Human
ggcugaaacuugagggugacuaaaaguaaugccugugaaacaugauaucuaucugggaug

SEQ ID NO: 458135 - RNA, 60 nt, Human
gguugguuagcuuuuccuguggccugaccugccugugagugcccagcaagccuugggcac

SEQ ID NO: 458136 - RNA, 60 nt, Human
gcuggacccagaggcaagaucugcagagaugccugugagauauuugcuuuccuagagggg

SEQ ID NO: 458137 - RNA, 60 nt, Human
cagcugaaacucuucaauguuugaauggcugccugugaagguagugagugccccaucacu

SEQ ID NO: 458138 - RNA, 60 nt, Human
ccccaguggcugcagguagcuggacuuccugccugugacgcacagagagcagcggacucc

SEQ ID NO: 458139 - RNA, 60 nt, Human
ccaaucuccauuacauagggacuguacagagccugugaagauguaugaaugguaucuuuu

SEQ ID NO: 458140 - RNA, 60 nt, Human
uauccagaugcaugucaucucaaggacaaagccugugaaaguacaagugagaugguugca

SEQ ID NO: 458141 - RNA, 60 nt, Human
ugaaaugcagaucccagagucaguaaaucugccugugaaguaugauagucugcauuugua

SEQ ID NO: 458142 - RNA, 60 nt, Human
uuucccuucucucucugguagcuccaggaggccugugauccagcucccugccuagcaucc

SEQ ID NO: 458143 - RNA, 60 nt, Human
aguguuugaaucauaugcugauaacuguuugccugugacccucacaccuuguucuucagg

SEQ ID NO: 458144 - RNA, 60 nt, Human
uacuaggcagaacagcccccgaucugcauagccugugaaagcccacggggacaucaguaa

SEQ ID NO: 458145 - RNA, 64 nt, Human; identical to SEQ ID NO: 189835

SEQ ID NO: 458146 - RNA, 64 nt, Human; identical to SEQ ID NO: 189836

SEQ ID NO: 458147 - RNA, 64 nt, Human; identical to SEQ ID NO: 189837

SEQ ID NO: 458148 - RNA, 64 nt, Human; identical to SEQ ID NO: 189839

SEQ ID NO: 458149 - RNA, 60 nt, Human
ccauucgcagaugugggagacucugcucaggccugugaggcugggcagcccuucaccaga

SEQ ID NO: 458150 - RNA, 60 nt, Human
aaaccuauagccuuugugcuguucugccuugccugugagcuaugucacuccccucccacu

SEQ ID NO: 458151 - RNA, 60 nt, Human
agcaaaaaaaaaaccuuaaccaggaagggggccugugaagguuaggacccuucccacagc

SEQ ID NO: 458152 - RNA, 60 nt, Human
guagaauauuaauuaaaauggaggcuaucagccugugauuuucagcuuaacuuccuggug

SEQ ID NO: 458153 - RNA, 60 nt, Human
aggacaaagucuccagcccacguucucucugccugugagccagucuaguuccugaugacc

SEQ ID NO: 458154 - RNA, 60 nt, Human
acagcgcgcuucucucuggccuuucccgaggccugugagugccucaggaagcagcugggc

SEQ ID NO: 458155 - RNA, 60 nt, Human
ccuggccuucaaugacagugugcugggcuagccugugaccccucgggacugccuggugca

SEQ ID NO: 458156 - RNA, 60 nt, Human
uggcugcugcugugugagagcugcaugugagccugugaccgugagcuggggugagcuggg

SEQ ID NO: 458157 - RNA, 60 nt, Human
aucuccggggcuuugugggaucagggcauugccugugacugaggcggagcccagcccucc

SEQ ID NO: 458158 - RNA, 60 nt, Human
aauaaaguauuauauccucaccccacccgugccugugagugaggugggugggagaggaag

SEQ ID NO: 458159 - RNA, 56 nt, Human
guggugguggcaaggacugaguccaggccugugaggugcagagugcccagaacugg

SEQ ID NO: 458160 - RNA, 60 nt, Human
ggugaccggugccuguucuccccugaccgagccugugagcacaucgcccccugcuggcga

SEQ ID NO: 458161 - RNA, 60 nt, Human
ucaaacggccucacuaggcuucugguugaugccugugaacugaacucugacaacagacuu

SEQ ID NO: 458162 - RNA, 60 nt, Human
uccuuuucaugcuuuuccuucccaggugcagccugugauucugauggggacugguaaauc

SEQ ID NO: 458163 - RNA, 60 nt, Human
uuuuuuaauuagccaggcacaguggcaugcgccugugaucccagcuacuuggaaggcuga

SEQ ID NO: 458164 - RNA, 60 nt, Human
cccuggcaaaugccugacucagugaccagugccugugagcauggggccaggaaagucugg

SEQ ID NO: 458165 - RNA, 64 nt, Human; identical to SEQ ID NO: 189902

SEQ ID NO: 458166 - RNA, 64 nt, Human; identical to SEQ ID NO: 189903

SEQ ID NO: 458167 - RNA, 64 nt, Human; identical to SEQ ID NO: 189904

SEQ ID NO: 458168 - RNA, 64 nt, Human; identical to SEQ ID NO: 189919

SEQ ID NO: 458169 - RNA, 60 nt, Human
agcauaaggacgcugaccucuccuggcugugccugugacuccagaguccuaucuuacugu

SEQ ID NO: 458170 - RNA, 60 nt, Human
ggcgggucaaggcaaaaggaguaaugcaacgccugugaagccagccccacgcgcgcacca

SEQ ID NO: 458171 - RNA, 60 nt, Human
cucugcccggcccaccccuccaaggggcuggccugugagccuugacugggauucaugaug

SEQ ID NO: 458172 - RNA, 60 nt, Human
ugggucugcagggaacuggacugucccauggccugugagcaccggagcgccuggcugccu

SEQ ID NO: 458173 - RNA, 60 nt, Human
ggccuuggaggaaagcagaggaugaucccugccugugagccacaccuccuagcucugggg

SEQ ID NO: 458174 - RNA, 60 nt, Human
agcuaaccuuacucccuggcucuaggaauagccugugagccagcccuggacugcccugga

SEQ ID NO: 458175 - RNA, 60 nt, Human
gaaaaguccagucuucucaugagcugucuggccugugauacuugggcugugauccucuag

SEQ ID NO: 458176 - RNA, 60 nt, Human
ugcgagcccauaccuucugcauuuuuccaggccugugagggauauaggccuccccuugga

SEQ ID NO: 458177 - RNA, 60 nt, Human
auuacacugucuuuuugccaucaaaaugaggccugugaaauacaagguucccuucugcac

SEQ ID NO: 458178 - RNA, 60 nt, Human
cuaagcugggaccggcaguccucacagggugccugugagaaaggacauuuuacccccaca

SEQ ID NO: 458179 - RNA, 60 nt, Human
ucugcacacuuggacagcagggugggaccagccugugaccucucagucagacuggggugc

SEQ ID NO: 458180 - RNA, 60 nt, Human
ugaaccaccugcaucccagcccuucaggaagccugugaaaaacgugauuccugggcccca

SEQ ID NO: 458181 - RNA, 60 nt, Human
gagaagaugggggcuggagggggcagaguggccugugagcaagagccaggggugucccag

SEQ ID NO: 458182 - RNA, 60 nt, Human
ucagcuacuaagacaggugugguggcucacgccugugauuauaaucuucaguuacuaaga

SEQ ID NO: 458183 - RNA, 60 nt, Human
cucuacccacauccauguuugaaugcuauugccugugaucuuuacgcuuaacuguugugu

SEQ ID NO: 458184 - RNA, 60 nt, Human
gcguguguguguguuuccuucuucccuucagccugugacuguugcugacuccaggggugg

SEQ ID NO: 458185 - RNA, 64 nt, Human; identical to SEQ ID NO: 189822

SEQ ID NO: 458186 - RNA, 64 nt, Human; identical to SEQ ID NO: 189823

SEQ ID NO: 458187 - RNA, 64 nt, Human; identical to SEQ ID NO: 189824

SEQ ID NO: 458188 - RNA, 64 nt, Human; identical to SEQ ID NO: 189844

SEQ ID NO: 458189 - RNA, 60 nt, Human
ccaagaggaaggaaguacugaccaucggcugccugugagcagcuuagcaaggagcccuug

SEQ ID NO: 458190 - RNA, 60 nt, Human
uucuguuccagaaggggagaagcauagagggccugugagcucacguguguucuuugucau

SEQ ID NO: 458191 - RNA, 60 nt, Human
uuuuauugugcaugcagaauguacauugaugccugugaccuuagguuuauuaaaggcuag

SEQ ID NO: 458192 - RNA, 60 nt, Human
gggaggcuguuugccuccacgucuaggaaggccugugagaggagcagucaggacuuccgg

SEQ ID NO: 458193 - RNA, 60 nt, Human
guauguaauaugcacguguguauccaaucugccugugacaugcauuuuacucuuugcaga

SEQ ID NO: 458194 - RNA, 60 nt, Human
guuugggagggcuuuagcaaugagacugcagccugugacaccgaaagagacuuuagcuga

SEQ ID NO: 458195 - RNA, 60 nt, Human
ccggucacacaggaaccacccgccaggggagccugugacugucaguuccugucccaggcu

SEQ ID NO: 458196 - RNA, 56 nt, Human
acaucuucccgccgcacugacugcuggccugugacuggggcggcggccgcgguccu

SEQ ID NO: 458197 - RNA, 60 nt, Human
gggcaggagccuggccuggggagggcuugggccugugaggauucuccccgaaggugcccu

SEQ ID NO: 458198 - RNA, 60 nt, Human
agcugugugacgauuucuaaauguaggaaggccugugaaacaugacacugcaguuaaauu

SEQ ID NO: 458199 - RNA, 60 nt, Human
aaugggaaaaccagacuacuugggagcaccgccugugaaauaccaaccugaagacaccgu

SEQ ID NO: 458200 - RNA, 60 nt, Human
aauuaaacccacaagcugccucugacagcagccugugagggagugcagaacaccuggccg

SEQ ID NO: 458201 - RNA, 60 nt, Human
gguuaaggcgggguuuuucuggggcgugaggccugugagauccugacccaagcucaggca

SEQ ID NO: 458202 - RNA, 60 nt, Human
uaaaaugccaaagugaucuuacagaacagugccugugacaccggaggggauuguucuguc

SEQ ID NO: 458203 - RNA, 60 nt, Human
cuugucugacugcuugguggcaggcacccugccugugagggccacuuuccucuucuagua

SEQ ID NO: 458204 - RNA, 60 nt, Human
auggauuuccucauuucaguuccuucugcagccugugaaucuccacaaaguguuaccagu

SEQ ID NO: 458205 - RNA, 64 nt, Human; identical to SEQ ID NO: 189845

SEQ ID NO: 458206 - RNA, 64 nt, Human; identical to SEQ ID NO: 189846

SEQ ID NO: 458207 - RNA, 64 nt, Human; identical to SEQ ID NO: 189847

SEQ ID NO: 458208 - RNA, 64 nt, Human; identical to SEQ ID NO: 189849

SEQ ID NO: 458209 - RNA, 60 nt, Human
uuguuuuugaaaguuagcauaauuuuagaugccugugaaauaguacugcacuuacauaaa

SEQ ID NO: 458210 - RNA, 60 nt, Human
cgguuguuuggcagcagcuuugaacguagcgccugugaacucaggaaugcacaguugacu

SEQ ID NO: 458211 - RNA, 60 nt, Human
uguggccaucuuugcaaaugacuaccuauagccugugaaaauacauuucaaaaaauguua

SEQ ID NO: 458212 - RNA, 60 nt, Human
aucaccuagcauguguaauuuuuuuuccuugccugugacuuggacuuuugauaguucuau

SEQ ID NO: 458213 - RNA, 60 nt, Human
ggucaacccaggcgggcauuuuaauaaauggccugugauucuuuuuugaaagaugcucuu

SEQ ID NO: 458214 - RNA, 60 nt, Human
gucugagugaggguccugcuuagcucuuuggccugugagaugcuuugaaaauuuuuauuu

SEQ ID NO: 458215 - RNA, 60 nt, Human
agcuggggugaccgcaggagacccuguaaggccugugagcggagcccucgaccccgugac

SEQ ID NO: 458216 - RNA, 54 nt, Human
cgggaccggggccagccuaggggggccugugaccucccauggagcccagccccg

SEQ ID NO: 458217 - RNA, 60 nt, Human
gggguagcucacucccccuccugcugcuaugccugugacccccgcggcccacacacugga

SEQ ID NO: 458218 - RNA, 60 nt, Human
guuaaaaaucagcuggguacgguggcacgugccugugaucccagcuacuugggaggcuga

SEQ ID NO: 458219 - RNA, 60 nt, Human
ucuaaaaauuagcugggugugguggugcaugccugugauccuggcuacuucagaggcuga

SEQ ID NO: 458220 - RNA, 60 nt, Human
ccgcgcuaacgccccggcccuuccagauucgccugugagcgaugaggcccgcccaugcgg

SEQ ID NO: 458221 - RNA, 60 nt, Human
gcucccucucuuggcuacaccacucucccagccugugaccaccgauguccacacaccccc

SEQ ID NO: 458222 - RNA, 60 nt, Human
uuccuucaagcaagcuggccugggccaugugccugugaaaggcaggcucuggccccuuuc

SEQ ID NO: 458223 - RNA, 60 nt, Human
agucaucgauuuuccagguguuggugaacugccugugacuccucuccuccccggccccua

SEQ ID NO: 458224 - RNA, 60 nt, Human
cuggcugauuuguuugugauguuguuagccgccugugaggggugcagagagauaaucacc

SEQ ID NO: 458225 - RNA, 64 nt, Human; identical to SEQ ID NO: 189854

SEQ ID NO: 458226 - RNA, 64 nt, Human; identical to SEQ ID NO: 189855

SEQ ID NO: 458227 - RNA, 64 nt, Human; identical to SEQ ID NO: 189856

SEQ ID NO: 458228 - RNA, 64 nt, Human; identical to SEQ ID NO: 189857

SEQ ID NO: 458229 - RNA, 60 nt, Human
cuggcugauuuguuugugauguuguuagccgccugugaggggugcagagagaucaucacg

SEQ ID NO: 458230 - RNA, 60 nt, Human
agcuuaucugggagagaaacaaggccuggugccugugaggaagagaggucaccccuaccc

SEQ ID NO: 458231 - RNA, 60 nt, Human
caggagcccggaggaagggugaaagagaaagccugugaaauaggcagggccagaucaccc

SEQ ID NO: 458232 - RNA, 60 nt, Human
gaguuugacccacauauuuauugacaguaagccugugauaaacauuauuucuauagauua

SEQ ID NO: 458233 - RNA, 60 nt, Human
gaguuugacccacauauuuauugacaguaagccugugauaaacauuauuccuauagauug

SEQ ID NO: 458234 - RNA, 60 nt, Human
uaaaaaauuuggccuggugugguggcucaugccugugauccuagcacuuugggaguuaaa

SEQ ID NO: 458235 - RNA, 60 nt, Human
uuaucuguuccaguuuucucaguguuuucagccugugagauagauguuuauggcaagaaa

SEQ ID NO: 458236 - RNA, 60 nt, Human
uuuucugggacauuguuggucucauguuaugccugugaaggauuuguccagccuucaugu

SEQ ID NO: 458237 - RNA, 60 nt, Human
ggcuccuggcccuacuuggggugauggcccgccugugagcugcugaccgugggccacguu

SEQ ID NO: 458238 - RNA, 60 nt, Human
uaaccacagggcuccuguggggaggccuuggccugugacagcccccaggccugggggcac

SEQ ID NO: 458239 - RNA, 60 nt, Human
gaaacuuggcuauauuaguuuccuagggcugccugugauaaauuauuacaaacuuuauaa

SEQ ID NO: 458240 - RNA, 60 nt, Human
agacuuguucuagagaggaccagguuugaugccugugaagaacccugcagggcccuuaug

SEQ ID NO: 458241 - RNA, 60 nt, Human
uacaaaaauuagcugagugugguggcacaugccugugaucccagcuacucaggaagcuga

SEQ ID NO: 458242 - RNA, 60 nt, Human
aaauacaaaaauuagucaggugugguggacgccugugaucucaaucucagcuacucggga

SEQ ID NO: 458243 - RNA, 60 nt, Human
cuggaucuugagucccauuagcugugagaugccugugagagccuucccgcacccgucaga

SEQ ID NO: 458244 - RNA, 60 nt, Human
agaucccgcaucuaugcaaaggugcaggcugccugugaggcuccaggcgguggaggugcg

SEQ ID NO: 458245 - RNA, 64 nt, Human
gcccgggcauccacguagggggcaggggcaggggcgggcggagggaggggaggggugaaaucca

SEQ ID NO: 458246 - RNA, 62 nt, Human
cccgcagagcacagagcaggagaagggcuugggcccuggaggagaaagccauucuggacacc

SEQ ID NO: 458247 - RNA, 62 nt, Human
ugugaaaacgcaaacaugaauaugguuggagagcccuggauuaggagggugacauggggaag

SEQ ID NO: 458248 - RNA, 62 nt, Human
uccucuaccccaacacaugcaggcuaggccuugcccuggaacauggaggcccugcccggggc

SEQ ID NO: 458249 - RNA, 60 nt, Human
accaucccucucugcaaucaauaaacacuugccugugaugccugccgucuggagucucuu

SEQ ID NO: 458250 - RNA, 60 nt, Human
aggcucaagcccugugguuguaggaauaaagccugugaucucaagaaguggugacuuguu

SEQ ID NO: 458251 - RNA, 60 nt, Human
gagugagcgcgaagugcuggugagcagugggccugugauuggaugggaagaugugcaucc

SEQ ID NO: 458252 - RNA, 60 nt, Human
gcuugcugggaggugggcugcagcacagaggccugugacugcguuccagcggccaguuca

SEQ ID NO: 458253 - RNA, 60 nt, Human
uggauguaggacagugccauguuucaagaugccugugagcuaggucuucaagauuuauag

SEQ ID NO: 458254 - RNA, 60 nt, Human
cucuccuccuuacucuuggauaaauaaacagccugugagcacacaggcagcccggcccag

SEQ ID NO: 458255 - RNA, 60 nt, Human
aggacccagacgcaggacagaguggacucugccugugaugggguggccuuccugcugccc

SEQ ID NO: 458256 - RNA, 60 nt, Human
gggugucacauuccugacggcgccuuuuuggccugugauguuuuauccuuacaaugugaa

SEQ ID NO: 458257 - RNA, 60 nt, Human
aacugcugcuggucacccccacccccgggugccugugaccgggguccugaggcuggggcu

SEQ ID NO: 458258 - RNA, 60 nt, Human
gaggggcggggccaggauggcguguccccugccugugagugacaucgguucaggaggaga

SEQ ID NO: 458259 - RNA, 60 nt, Human
accagcucagaaccugucacuaauacagcugccugugacccugggacccgcaaccuucca

SEQ ID NO: 458260 - RNA, 60 nt, Human
uaaacuugucagaauuucuuugucauucaagccugugaauaaaaacccuguauggcacuu

SEQ ID NO: 458261 - RNA, 60 nt, Human
guucgaccgugacugucuuccucagucugugccugugauuccagucacccuguaguuacu

SEQ ID NO: 458262 - RNA, 60 nt, Human
ucaacuugagcucuugaacuccuccugugggccugugaauguauucauucauuccacaac

SEQ ID NO: 458263 - RNA, 60 nt, Human
cgcgcggcccccgcagccuagaccucccaggccugugacccuccacaccagcccucagaa

SEQ ID NO: 458264 - RNA, 60 nt, Human
ccugccccucuccccuucacaccugcuggagccugugagggagguggcggguccccacug

SEQ ID NO: 458265 - RNA, 64 nt, Human; identical to SEQ ID NO: 189279

SEQ ID NO: 458266 - RNA, 64 nt, Human; identical to SEQ ID NO: 189296

SEQ ID NO: 458267 - RNA, 64 nt, Human; identical to SEQ ID NO: 189297

SEQ ID NO: 458268 - RNA, 64 nt, Human; identical to SEQ ID NO: 189753

SEQ ID NO: 458269 - RNA, 60 nt, Human
ccagcugaguucuguuguuguuuucaugccgccugugaucucagauuccugcuuuucuca

SEQ ID NO: 458270 - RNA, 60 nt, Human
aguguagcccauucuugauccagagcuguugccugugacagcgguuucucuggaugucaa

SEQ ID NO: 458271 - RNA, 60 nt, Human
ugugacuguugcccuuagccagccagaugcgccugugaaccaaagcuucgugcacaugug

SEQ ID NO: 458272 - RNA, 60 nt, Human
agccuuaccaugagucagaguguuaagggggccugugaaccagucguuugguggaggagg

SEQ ID NO: 458273 - RNA, 60 nt, Human
cagagacucgcagcauagccauacaccucagccugugaaaugaacgauccggacccucac

SEQ ID NO: 458274 - RNA, 60 nt, Human
accugcugggcaggaucccagggugaaccugccugugaacucugaagucacuaguccagc

SEQ ID NO: 458275 - RNA, 60 nt, Human
acaucugaggacauccgcagauucuugucagccugugaacuaggcccugccucugucacc

SEQ ID NO: 458276 - RNA, 60 nt, Human
gguucaagugugcacugggaggaggcugaggccugugaagccaaacaauaugcuccugcc

SEQ ID NO: 458277 - RNA, 60 nt, Human
caggauucaaguccagaguuuucaucuucagccugugaucuguccagggacccuugggau

SEQ ID NO: 458278 - RNA, 60 nt, Human
cuaccuccgcauugcuguguagugaccccugccugugacguggaggaucccagccucuga

SEQ ID NO: 458279 - RNA, 60 nt, Human
guuuggggggccucaacccucuccuggagcgccugugagauggucagcguggagcgcaag

SEQ ID NO: 458280 - RNA, 60 nt, Human
cuccccacuucugccccaaggguggucacugccugugauacauuccucagugucgccucu

SEQ ID NO: 458281 - RNA, 60 nt, Human
uuucacucaccccuuaccgcucgcccaccggccugugauuuauuugguugguuuggguuu

SEQ ID NO: 458282 - RNA, 60 nt, Human
cccccugccaucucgcacucagcccugggugccugugaagccuggccccacugccugccg

SEQ ID NO: 458283 - RNA, 60 nt, Human
ucgccguaaacuggaccgugaagaaaucaagccugugauggcacugggcauagugccuau

SEQ ID NO: 458284 - RNA, 60 nt, Human
uuuuuagugucuccagacacagugguucaugccugugagacuggggcaggaggaucacuu

SEQ ID NO: 458285 - RNA, 54 nt, Human; identical to SEQ ID NO: 189259

SEQ ID NO: 458286 - RNA, 64 nt, Human; identical to SEQ ID NO: 189260

SEQ ID NO: 458287 - RNA, 64 nt, Human; identical to SEQ ID NO: 189261

SEQ ID NO: 458288 - RNA, 64 nt, Human; identical to SEQ ID NO: 189754

SEQ ID NO: 458289 - RNA, 60 nt, Human
aaaucaaauuuuguucuuuauuuugugugugccugugauguuuuucuagagugaauuaua

SEQ ID NO: 458290 - RNA, 60 nt, Human
ggggcauaugaucaccagggcacacagugugccugugaaaauuuggcaccuacauuugua

SEQ ID NO: 458291 - RNA, 60 nt, Human
ugaggcuugccugcuggugacaagcagagcgccugugauuuggcucaagacuccuauaug

SEQ ID NO: 458292 - RNA, 60 nt, Human
cuguuucuuggaaguuaugcuguagaggcagccugugauccguaguaugcuaggguguga

SEQ ID NO: 458293 - RNA, 60 nt, Human
aauaacauccuuugaaugaguuugcucugagccugugacuccuucugcuaggcagagagc

SEQ ID NO: 458294 - RNA, 60 nt, Human
aaaaaaaaaaaaaaguugagugcucugcaggccugugaagggugccaccugagggagccg

SEQ ID NO: 458295 - RNA, 60 nt, Human
augaauacaugacugggaauaauggggacugccugugaggguaagauggaaucuucgagg

SEQ ID NO: 458296 - RNA, 60 nt, Human
acccucugcuaugucugugaugucaguagugccugugaucguguguugccauuuugucug

SEQ ID NO: 458297 - RNA, 60 nt, Human
aacuguauuucccaauacacuugagcaguugccugugaauguaagaggugucaacaaacu

SEQ ID NO: 458298 - RNA, 60 nt, Human
aggaggaugaugauaucuaggcauaaccuagccugugaggaaccuaguuaggaaagacaa

SEQ ID NO: 458299 - RNA, 60 nt, Human
gccagcucugcaucaccacacacagccagagccugugaggagcugccuucuuccccaugu

SEQ ID NO: 458300 - RNA, 64 nt, Human
gguggggguggggagaacacuuaacaacauggggaccagucaggggaauccccuuauuucuguu

SEQ ID NO: 458301 - RNA, 64 nt, Human
auuucuuauauaucauaaucuggcaauuucugaaaccagucagaaaagacauauauuuccaugc

SEQ ID NO: 458302 - RNA, 64 nt, Human
uggacugucguggcuccccucaucagcuccccacaccagucaaggcuucucagcuggagaaccg

SEQ ID NO: 458303 - RNA, 64 nt, Human
cguuaagggaaaaaaaaaauccucaaauuuauuuaccagucagcuucuugcuguucccaguaga

SEQ ID NO: 458304 - RNA, 64 nt, Human; identical to SEQ ID NO: 189757

SEQ ID NO: 458305 - RNA, 64 nt, Human; identical to SEQ ID NO: 189758

SEQ ID NO: 458306 - RNA, 64 nt, Human; identical to SEQ ID NO: 189759

SEQ ID NO: 458307 - RNA, 64 nt, Human
aaaaaacuauccagugauuuauauccugauuucaaccagucacuuagcugauaaucacaguaag

SEQ ID NO: 458308 - RNA, 64 nt, Human
uuccaggggacacaucuuuauucuguuucaggaaaccagucacgacacguccacauauguauuu

SEQ ID NO: 458309 - RNA, 64 nt, Human
ucuggucacacuuuggucacucauuagcucuaggaccagucacuaaucucugagacuccauuuu

SEQ ID NO: 458310 - RNA, 64 nt, Human
uaucagagaagaggaaguaaaggacaaucagaacaccagucaaacccaccaaauugcuuuauuc

SEQ ID NO: 458311 - RNA, 64 nt, Human
caggaccagaaguggccacucaacacacguccucaccagucaccccaaauggagacacucgcag

SEQ ID NO: 458312 - RNA, 64 nt, Human
aaugggccauccuuuccugagcucuggguauacuaccagucacagaacgucagagcuggaagaa

SEQ ID NO: 458313 - RNA, 64 nt, Human
cugcuuucccuuaaauaacacuuagauuuauuggaccagucagcacagcaugccugguuguauu

SEQ ID NO: 458314 - RNA, 64 nt, Human
aaaaagugagagaccucugccuacaaaaccucaaaccagucacuuuugucaauugcuaauaccc

SEQ ID NO: 458315 - RNA, 64 nt, Human
aaagccacguaaauaaauugguuagguuccuuauaccagucacauggggaaguugaaaagaauu

SEQ ID NO: 458316 - RNA, 64 nt, Human
uguaguuagauaugggcuuuaauccuucccaggcaccagucagcugaacaaaagcauaagccaa

SEQ ID NO: 458317 - RNA, 64 nt, Human
aggacaucugaguaccuaucucacacacuggaccaccagucacaaagucuggaaaaguuuacau

SEQ ID NO: 458318 - RNA, 64 nt, Human
uuuuucugauucaaaagugaacuugauuuuaaaaaccagucaagagcaaucaaagcagcacaug

SEQ ID NO: 458319 - RNA, 64 nt, Human
uagaaggccacaugucaccguggaccuuccugccaccagucacugucccucaaaugacccaaag

SEQ ID NO: 458320 - RNA, 64 nt, Human
uauagaucuggcucaaauucagccuccaucacuuaccagucaggaacccuggcgauaucacuuu

SEQ ID NO: 458321 - RNA, 64 nt, Human
aagagugaggaaauuguccuguagucuauugaaaaccagucaaggugguuuuaguucauagauu

SEQ ID NO: 458322 - RNA, 64 nt, Human
uugucccgguuugaguuauaacugccaguagaugaccagucacaagugaaccacuucucaguug

SEQ ID NO: 458323 - RNA, 64 nt, Human; identical to SEQ ID NO: 189760

SEQ ID NO: 458324 - RNA, 64 nt, Human; identical to SEQ ID NO: 189761

SEQ ID NO: 458325 - RNA, 64 nt, Human; identical to SEQ ID NO: 189762

SEQ ID NO: 458326 - RNA, 64 nt, Human
gguucuccaaggauccccucgagacuacucuguuaccagucaugaaacauuaaaaccuacaagc

SEQ ID NO: 458327 - RNA, 64 nt, Human
gacuuugcccggccucaucugccuggcacgcaccaccagucacaaccuaugcagcgccccacuu

SEQ ID NO: 458328 - RNA, 64 nt, Human
uguaaugauuuguguccauuucaaguguuuucacaccagucacacauuauagaaauuacuggag

SEQ ID NO: 458329 - RNA, 64 nt, Human
ggccugagauauuuuucuacagcuucauagagcaaccagucaaaaccagagcgagaacccucaa

SEQ ID NO: 458330 - RNA, 64 nt, Human
cacaucaaaauagaccagccauuugcacauaguuaccagucacucuguuucugaaaccaaucca

SEQ ID NO: 458331 - RNA, 64 nt, Human
cuguacauaugaccauguuucuugacauggaaauaccagucaguguuccuauguauuugucuau

SEQ ID NO: 458332 - RNA, 64 nt, Human
cauaggcauuucaggccaaauccaugaaagggggaccagucauuuauuuuccauuuuguugcuu

SEQ ID NO: 458333 - RNA, 64 nt, Human
cucauugucuggccucaggacuuagccauacuagaccagucagcuugccuggaagagggagguc

SEQ ID NO: 458334 - RNA, 64 nt, Human
uuaaauaugcuauuuuaauaaauuauugaaacucaccagucauggacuuccaguuuuaaagguu

SEQ ID NO: 458335 - RNA, 64 nt, Human
gcacugguuggggacaagggccaaauuggugaccaccagucaugccuaggaccuggggcccaaa

SEQ ID NO: 458336 - RNA, 58 nt, Human
ggguccagaaaaaccagugagcugccacaccagucacaugaccugaucacuagccugu

SEQ ID NO: 458337 - RNA, 64 nt, Human
ccuccuuccugcuaaaagcuuagccuaccacacuaccagucauucccaucgcuuugcaaucaca

SEQ ID NO: 458338 - RNA, 64 nt, Human
caggguacaugggugggagguucauucagcacccaccagucagguauguucugagugaacccac

SEQ ID NO: 458339 - RNA, 64 nt, Human
uuauuacccaaauacuaugaacauauuuuuguaaaccagucauucugaauuauagugaugagaa

SEQ ID NO: 458340 - RNA, 64 nt, Human
uuuuuuuuuuguuacaguuuaguaauuuauauucaccagucacuucauaugucuugaacaucug

SEQ ID NO: 458341 - RNA, 64 nt, Human
augacugucucaaagaguaauuuuucuagauuagaccagucagguuuuugaagacauauaggua

SEQ ID NO: 458342 - RNA, 64 nt, Human; identical to SEQ ID NO: 189795

SEQ ID NO: 458343 - RNA, 64 nt, Human; identical to SEQ ID NO: 189924

SEQ ID NO: 458344 - RNA, 64 nt, Human; identical to SEQ ID NO: 189925

SEQ ID NO: 458345 - RNA, 64 nt, Human
agucuggacuucuuuuugccagagaacuccagaaaccagucaggcucucagucagccuuguggc

SEQ ID NO: 458346 - RNA, 64 nt, Human
gacaggccagccucacucaggcacguaccugcugaccagucagccacugccaacccauggccca

SEQ ID NO: 458347 - RNA, 64 nt, Human
cauuuuugagaaguugcuucuuuuacaucagaaaaccagucaaucauauggagacuucuuuugu

SEQ ID NO: 458348 - RNA, 64 nt, Human
ucccuuugcuuucgugugaccacauguuuucuguaccagucacuggggaaagaagugaguuuau

SEQ ID NO: 458349 - RNA, 64 nt, Human
aagccaccccugcaagcagcacagcagggcauauaccagucaggaaugcccguuaccugguucc

SEQ ID NO: 458350 - RNA, 64 nt, Human
uacccagaccccgagguugucugguucaaagaugaccagucaaucagggagucccgccacuucc

SEQ ID NO: 458351 - RNA, 64 nt, Human
cagaauuggcaccauuacccaggucugacugaccaccagucagaggcacuuuauuuguaucaug

SEQ ID NO: 458352 - RNA, 64 nt, Human
uggucuugucagucauguacacacagaaaaaaaaaccagucauuuuuauuuuuauuuuuugaga

SEQ ID NO: 458353 - RNA, 64 nt, Human
cuccucgggcacagacgacugucguucuccacccaccagucagggacagcagccucccugucac

SEQ ID NO: 458354 - RNA, 64 nt, Human
ccuuuauaaaccaaagauggccagcacacugcuaaccagucaccaaauguaagacccauaagaa

SEQ ID NO: 458355 - RNA, 64 nt, Human
uaucucuauuuauuauauuugaaaguugucagccaccagucauccagaauuuccuuccugaauc

SEQ ID NO: 458356 - RNA, 64 nt, Human
gccugaaauuuuaaaaaaguuguguaauacgccaaccagucaaguuguguuuuggccagagauu

SEQ ID NO: 458357 - RNA, 64 nt, Human
uuuccaucugucacccucuucccucuccuuucauaccagucacuaucuuggguaacaaauuuau

SEQ ID NO: 458358 - RNA, 64 nt, Human
uucuauggaauaaagcgucgccucucugccucgaaccagucaaauggaguauugcggcugcacg

SEQ ID NO: 458359 - RNA, 64 nt, Human
uuacuuuggugauuugcaaacuuggaaugaagccaccagucauuuuuuaagaaugcaagaugaa

SEQ ID NO: 458360 - RNA, 64 nt, Human
auggacuaguccucauuagcauguuugcauagcaaccagucaagagcauuuacacuauuucugc

SEQ ID NO: 458361 - RNA, 64 nt, Human; identical to SEQ ID NO: 189764

SEQ ID NO: 458362 - RNA, 64 nt, Human; identical to SEQ ID NO: 189765

SEQ ID NO: 458363 - RNA, 64 nt, Human; identical to SEQ ID NO: 189766

SEQ ID NO: 458364 - RNA, 64 nt, Human
cuuauuguucagaaauggguaauguggccauuucaccagucacugccaacaacaacgagguucc

SEQ ID NO: 458365 - RNA, 64 nt, Human
gauuuugaugcacaacuaguuaaaagccuuucauaccagucaguauucccagccuugagcgcac

SEQ ID NO: 458366 - RNA, 64 nt, Human
gaguuuagucugccugcccgccuugguaguagugaccagucagugucagcaucagugucccaac

SEQ ID NO: 458367 - RNA, 64 nt, Human
cauggcuugaugugaagacagcaaggaaagaagcaccagucaaguugugaacaagcaccaaauu

SEQ ID NO: 458368 - RNA, 64 nt, Human
ugggggagggagggacaaacacucccaaucauccaccagucagacugaauguguagcuggcgag

SEQ ID NO: 458369 - RNA, 64 nt, Human
uauucaguuaaugacccuuuaauucucacaaccaaccagucauguugcuugaagccauuuauag

SEQ ID NO: 458370 - RNA, 64 nt, Human
cuuugccagcaaugaaacagcugacauaaugguaaccagucagaggagggcauaacuaugaaac

SEQ ID NO: 458371 - RNA, 64 nt, Human
auauuauucaauugcauauauuucagaggaaaguaccagucaguaaagaaaaaugccaacuaaa

SEQ ID NO: 458372 - RNA, 64 nt, Human
aauggacucagaaaaaugugauuuguauuaaugcaccagucaucauaaaagauggucaugauag

SEQ ID NO: 458373 - RNA, 64 nt, Human
guguuaauuugaaaugccuuaauggcaggcaaaaaccagucauuucauuuuuguaaauuacaga

SEQ ID NO: 458374 - RNA, 64 nt, Human
acgcauuuuauugcagaagcuaaaaagcuaaaguaccagucaucuagagagaaggaaauuaaug

SEQ ID NO: 458375 - RNA, 64 nt, Human
ggguggggggagacacucauuucuaggccccaucaccagucacuugauuucgugaccuugauuu

SEQ ID NO: 458376 - RNA, 64 nt, Human
gcugauggauacuuuucccucacugccauggcacaccagucauggaucuuguaaucaugccaag

SEQ ID NO: 458377 - RNA, 64 nt, Human
ggugggccugguugccccauguuaggaaaucacuaccagucagguggggcuggggcugggugga

SEQ ID NO: 458378 - RNA, 64 nt, Human
auuuuguuauguuggauaaauacuguuaaaagaaaccagucaguaacuauauuguuaauccaug

SEQ ID NO: 458379 - RNA, 64 nt, Human
gcugucucccaggaagugccuuacucaucccgcaaccagucagcgcaccaguggucucccggug

SEQ ID NO: 458380 - RNA, 64 nt, Human; identical to SEQ ID NO: 189767

SEQ ID NO: 458381 - RNA, 64 nt, Human; identical to SEQ ID NO: 189768

SEQ ID NO: 458382 - RNA, 64 nt, Human; identical to SEQ ID NO: 189769

SEQ ID NO: 458383 - RNA, 64 nt, Human
agaacuaucacauuuagcuuaagagaaaaaggugaccagucauauuuacauauauuagaggagc

SEQ ID NO: 458384 - RNA, 64 nt, Human
uggaagaggaacuuugagcacaggaggaaaugcaaccagucagggcccagaaucaugcaaaucu

SEQ ID NO: 458385 - RNA, 64 nt, Human
cauaggaacuuuucacuuaucucauguuagcuguaccagucagugauuaaguagaacuacaagu

SEQ ID NO: 458386 - RNA, 64 nt, Human
ugcaaaucaaaacugcaaugaguuaccaucucuuaccagucacaaagucagagaugguggugag

SEQ ID NO: 458387 - RNA, 64 nt, Human
acccacagagcuagacagauaagaugcauaguugaccagucauaaaaggcgguguuuaggugau

SEQ ID NO: 458388 - RNA, 64 nt, Human
aaggagauaaauuugaaaacagauaaauguaacaaccagucaaagaagcaggggaaaaguaagc

SEQ ID NO: 458389 - RNA, 64 nt, Human
ugaaggacuagaauacagcagcuguuauaacacgaccagucaauguggaacaaacuguuucugu

SEQ ID NO: 458390 - RNA, 64 nt, Human
cugcccaacuccauccucuguuacuagaucccuuaccagucacauuuguggacugguggccagu

SEQ ID NO: 458391 - RNA, 64 nt, Human
auuuucuugcccaguguggcaagaccucagaaaaaccagucaauuacgccuaagaucauuuugc

SEQ ID NO: 458392 - RNA, 64 nt, Human
uugcugcacuuuauuaccaagccucugggauuuuaccagucaaacauauuugugcauuacauuu

SEQ ID NO: 458393 - RNA, 64 nt, Human
uaaugagcauagguagcuuguccaaggucucaugaccagucaagggcaagcuggaguuaauaau

SEQ ID NO: 458394 - RNA, 64 nt, Human
cagagcauuaaagacuaaucaauuguuuugccucaccagucauuuuaaauaguagaauacuuau

SEQ ID NO: 458395 - RNA, 64 nt, Human
aaugaaaacaucagcuuacugguuuguaguucauaccagucauacauuccaaaacauguuuuga

SEQ ID NO: 458396 - RNA, 64 nt, Human
aaguaaucugccagcugaccuuugucgcaccuuaaccagucaccacuugcuaugguauaggauu

SEQ ID NO: 458397 - RNA, 64 nt, Human
aucagcauuacuugggaaaacguguugcaagucaaccagucacuaggauauuucuacccaugca

SEQ ID NO: 458398 - RNA, 64 nt, Human
ggcuugauuaaaagacuccuuuuaaauggaagccaccagucagcagaauggaagcuuagaggaa

SEQ ID NO: 458399 - RNA, 64 nt, Human; identical to SEQ ID NO: 189755

SEQ ID NO: 458400 - RNA, 64 nt, Human; identical to SEQ ID NO: 189771

SEQ ID NO: 458401 - RNA, 64 nt, Human; identical to SEQ ID NO: 189772

SEQ ID NO: 458402 - RNA, 64 nt, Human
ugcagcagcccuaaaugucagugcagcaguguuaaccagucauggugcuagauuguuuacuugg

SEQ ID NO: 458403 - RNA, 64 nt, Human
gccagagggguguuggagcccagcccacccacauaccagucaagcucuuaggggagcagaagaa

SEQ ID NO: 458404 - RNA, 64 nt, Human
aggaaagagcagaccaaaaucagcccuagagccaaccagucagucccaaagcugugaccucugu

SEQ ID NO: 458405 - RNA, 64 nt, Human
uguguguaaccuaggagcaggaaacuucagcuuaaccagucagaaacuaccgacuaaccucuaa

SEQ ID NO: 458406 - RNA, 64 nt, Human
uuuuccuucugauuuucccuuuucaacauuccuuaccagucaccaaaguuuccuguuauaauuu

SEQ ID NO: 458407 - RNA, 64 nt, Human
gauggauggaagaggcuucccacaggaaggugccaccagucaguugugccuaugucccuuuggc

SEQ ID NO: 458408 - RNA, 64 nt, Human
uuuccugaucugggaugauguuuaccagcccaaaaccagucauguucuuccaaaagcuucucuu

SEQ ID NO: 458409 - RNA, 64 nt, Human
gaauuucugaaagagaaagagaaguagauggucaaccagucacuaguugguuggcaugaggugg

SEQ ID NO: 458410 - RNA, 64 nt, Human
aggaugacuguuacaggcuuagcuuugugugaaaaccagucaccuuucuccuagguaaugagua

SEQ ID NO: 458411 - RNA, 64 nt, Human
uugccaacaggguccuuuuaggcagaacccagaaaccagucaaaucuguagagaagcaguguga

SEQ ID NO: 458412 - RNA, 64 nt, Human
uaagaucuuugaauccaagaugcccagaucuuuuaccagucacacccuauggccauggcuauac

SEQ ID NO: 458413 - RNA, 64 nt, Human
ucuggcccccguggggcugggccuccgccccugcaccagucacaugcacuggacgagggccgaa

SEQ ID NO: 458414 - RNA, 64 nt, Human
gaccccacagauguauuccagcagagagcaacacaccagucaucaaaacccacuggcuccugug

SEQ ID NO: 458415 - RNA, 64 nt, Human
uuaguagacauguuucccuauugcuuucauaggcaccagucagaauaaagaaucauaauucaca

SEQ ID NO: 458416 - RNA, 64 nt, Human
aaacacaaccuacucugcaaaccuugguaaaggaaccagucagcuggccagauuuccucacuac

SEQ ID NO: 458417 - RNA, 64 nt, Human
uacgcugaaugaacauuuauaugauugcauugggaccagucauuuccuaagcuacauauggcca

SEQ ID NO: 458418 - RNA, 64 nt, Human; identical to SEQ ID NO: 189773

SEQ ID NO: 458419 - RNA, 64 nt, Human; identical to SEQ ID NO: 189774

SEQ ID NO: 458420 - RNA, 64 nt, Human; identical to SEQ ID NO: 189775

SEQ ID NO: 458421 - RNA, 64 nt, Human
uguauggauuguguacugcacaaccccagagaauaccagucacaucaaucaggguacgauugca

SEQ ID NO: 458422 - RNA, 64 nt, Human
agugagugacccggagucucugguguacccucuuaccagucagcugccugcgagcagucauuuu

SEQ ID NO: 458423 - RNA, 64 nt, Human
cauuguuaagaucugugaacgcguguugucucaaaccagucagggccgucaugacuacgcagca

SEQ ID NO: 458424 - RNA, 64 nt, Human
auagcuuuaaugcauggaaaaacuucaguuacugaccagucaagagaauuucucaagaaaaauc

SEQ ID NO: 458425 - RNA, 64 nt, Human
guugagagagaccuuugaucugcaguguaaaucuaccagucaugggccagaagggcaaaagccc

SEQ ID NO: 458426 - RNA, 64 nt, Human
gugucccuguuccucacucagagaggaaggcagaaccagucaggcuuauuucaguaaguuccac

SEQ ID NO: 458427 - RNA, 64 nt, Human
uaggaaucaccguuuugagagaaccugcauauauaccagucauuaucuguuugguccuuauaca

SEQ ID NO: 458428 - RNA, 64 nt, Human
acgguuucuggagcaaaccugucccccaccugugaccagucacucuggggcaagcaucacuggg

SEQ ID NO: 458429 - RNA, 64 nt, Human
gcugcugcugccgccccgcuacagaggcaaugugaccagucacagggacagaucacaucucccc

SEQ ID NO: 458430 - RNA, 64 nt, Human
uguccugucauccauauggugccuggaaauauuuaccagucaaggucaaggucagcaucugugg

SEQ ID NO: 458431 - RNA, 64 nt, Human
ggucuuguagaagacaguccuguaagaucgagcaaccagucaugaugaaaccaagugguggccg

SEQ ID NO: 458432 - RNA, 64 nt, Human
ccgccuggugggcauuugccgccgccuccccaccaccagucacugccucgcagagcccuacacu

SEQ ID NO: 458433 - RNA, 64 nt, Human
ugaauuucaguaaaaaucaaaacuuaaaauucuaaccagucauauacacuggauaauuugguaa

SEQ ID NO: 458434 - RNA, 64 nt, Human
agagccaccaagagggacgccugggggugccaggaccagucaaccugggcaaagccuagugaag

SEQ ID NO: 458435 - RNA, 64 nt, Human
ugauucaggaacucacaaagcuaugugaccuuacaccagucacuuaacuuguuagccauccauu

SEQ ID NO: 458436 - RNA, 64 nt, Human
gggauggguggacuguaugauuuccaaggacucuaccagucagugguucugaugucaucgggug

SEQ ID NO: 458437 - RNA, 64 nt, Human; identical to SEQ ID NO: 189777

SEQ ID NO: 458438 - RNA, 64 nt, Human; identical to SEQ ID NO: 189778

SEQ ID NO: 458439 - RNA, 64 nt, Human; identical to SEQ ID NO: 189779

SEQ ID NO: 458440 - RNA, 64 nt, Human
ucucugugcccaaguuuucccuuuuuauuaagacaccagucauacuggcucagggcccaccgcu

SEQ ID NO: 458441 - RNA, 64 nt, Human
cacuauauauaacuuccuaugcaaauauuuuaccaccagucaauaauacauuuuugccaagaca

SEQ ID NO: 458442 - RNA, 64 nt, Human
cuggguuuucucauucauccaucaagcaccaucaaccagucagccauuauuauuuauauaugua

SEQ ID NO: 458443 - RNA, 64 nt, Human
cugaugagcuaugcacucuaauguggggccacucaccagucagccaaucuuuuauuguuccuuu

SEQ ID NO: 458444 - RNA, 64 nt, Human
uuagaagaaggagagguggcaguuuauuucucaaaccagucauuuucaaagaacaggugccuaa

SEQ ID NO: 458445 - RNA, 64 nt, Human
ugaaaccagggagcaggggaguuaggaaucgaacaccagucaugccuacuggcucucugcucga

SEQ ID NO: 458446 - RNA, 64 nt, Human
ccccucuggagccagcacagugcuccuccauaucaccagucauacacagccucauuauuaaggu

SEQ ID NO: 458447 - RNA, 64 nt, Human
cgaugauauucugauggacugguuuggucuuaauaccagucaaccguuguccuucuggaaauau

SEQ ID NO: 458448 - RNA, 63 nt, Human
agcagccccgggaaaccugaggacaugcaaacaaccagucauguuccaacuucaagccgguaa

SEQ ID NO: 458449 - RNA, 64 nt, Human
cggauccugcuuuuguccagaugggccucggagcaccagucacuuacuccaagaagucguuucc

SEQ ID NO: 458450 - RNA, 64 nt, Human
gucugauccaagagcugagacacggccacccagcaccagucacuccucuguucaccuuaaguaa

SEQ ID NO: 458451 - RNA, 64 nt, Human
ggagcacaggcacugcaggagagaaugcccagugaccagucacugacccugugcagaaccuccu

SEQ ID NO: 458452 - RNA, 64 nt, Human
cugccaucugaguguccaucuacauucugcugccaccagucaccaaaggcccuucccagugagg

SEQ ID NO: 458453 - RNA, 64 nt, Human
cucuuccugccccccuuggcaugggugagaccugaccagucagaugguaguugagggugacuuu

SEQ ID NO: 458454 - RNA, 64 nt, Human
uccaaguuccuagaccucauggcuguccccucccaccagucaccuccacugcacaacucgggcg

SEQ ID NO: 458455 - RNA, 64 nt, Human
auugaaaguguuaaaugugaacuugagcuguuugaccagucacauuuuuguauuguuacuguac

SEQ ID NO: 458456 - RNA, 64 nt, Human; identical to SEQ ID NO: 189780

SEQ ID NO: 458457 - RNA, 64 nt, Human; identical to SEQ ID NO: 189781

SEQ ID NO: 458458 - RNA, 64 nt, Human; identical to SEQ ID NO: 189782

SEQ ID NO: 458459 - RNA, 64 nt, Human
aagagaacaucaccuuguaaaacugaagauugugaccagucagaauaaugucaaagugcuuaca

SEQ ID NO: 458460 - RNA, 64 nt, Human
ugagugaucuaugcugaauaaacaguggaaugugaccagucaaguagaaaucuugaguaaucag

SEQ ID NO: 458461 - RNA, 64 nt, Human
auaggaaccaacaugaacaauuuuaauugaaaacaccagucauaaacuauuaccacccccacuc

SEQ ID NO: 458462 - RNA, 64 nt, Human
cuauagagacaggugcauucagaacauccugggcaccagucaugagucuuacugugucaaaaau

SEQ ID NO: 458463 - RNA, 64 nt, Human
gccauugcuuuuccauugggagaagaaagaauuaaccagucauuaaaccauuugguaaguugca

SEQ ID NO: 458464 - RNA, 64 nt, Human
uuguaagccagucucuucaugccuaaaagacacuaccagucaccuuugauucgcgacuuuuaau

SEQ ID NO: 458465 - RNA, 64 nt, Human
uuuuuaagcucuggcacauugaccucuauguguuaccagucauuaaugagcugcugcagaggug

SEQ ID NO: 458466 - RNA, 64 nt, Human
agaugaaaaaccuaaugcauagaaagauaaguagaccagucaaggucuacagcuaguaaaaugc

SEQ ID NO: 458467 - RNA, 64 nt, Human
uuuugagauauuaaugcccagacaaaaagcuaauaccagucacucgauaauaaaguauucgcau

SEQ ID NO: 458468 - RNA, 64 nt, Human
ucaucuuuaggaagagagaagugaccaugccugaaccagucauuggcaagaggaacgguguuau

SEQ ID NO: 458469 - RNA, 64 nt, Human
aaugccagaagaagaauaguacagcccaugauugaccagucaaaucgagcaggcaaguuccaag

SEQ ID NO: 458470 - RNA, 64 nt, Human
ggucaggaggaugugcaccaucuugccuuugcacaccagucaccugaacaaggaaacuugucac

SEQ ID NO: 458471 - RNA, 64 nt, Human
gcccuccagacuuccugcccuuagcaagugcgcaaccagucaggaucucccaaagaagauaaag

SEQ ID NO: 458472 - RNA, 64 nt, Human
ccaacacuguggaucagcaaacacgauagaggagaccagucaguacuucuuggagggggcagga

SEQ ID NO: 458473 - RNA, 64 nt, Human
uuucacuuuuaagacuuaaucuuugcugaagaagaccagucacagccauuucaaauaaagagga

SEQ ID NO: 458474 - RNA, 64 nt, Human
ccuacaagcuuccuaaccucuuaagcaucauggaaccagucagcccucuguggagucauugugc

SEQ ID NO: 458475 - RNA, 64 nt, Human; identical to SEQ ID NO: 189861

SEQ ID NO: 458476 - RNA, 64 nt, Human; identical to SEQ ID NO: 189862

SEQ ID NO: 458477 - RNA, 64 nt, Human; identical to SEQ ID NO: 189863

SEQ ID NO: 458478 - RNA, 64 nt, Human
aaaagccuuucacccucacgugguuucuuuuuuaaccagucaucaagcgaggcucgcgcgcagg

SEQ ID NO: 458479 - RNA, 64 nt, Human
gucagucaaaaccaaauucagaauuguuuuguguaccagucagcuguugucugcacauuuucgu

SEQ ID NO: 458480 - RNA, 64 nt, Human
cucccgcccccaccuggcguguaguacuguauaaaccagucagcugucggguuagugguaguau

SEQ ID NO: 458481 - RNA, 64 nt, Human
caauguggcuauuuguuuuagaggcaaguuuagcaccagucaucuauaaacucaaccacauuuu

SEQ ID NO: 458482 - RNA, 64 nt, Human
caggccuacggagucagccaguggcuagcgcaagaccagucacucccucugccuucaggcuucu

SEQ ID NO: 458483 - RNA, 64 nt, Human
uuguuuuugccauuguguuuacguuugagacacaaccagucauugguggcaggggcauagagug

SEQ ID NO: 458484 - RNA, 64 nt, Human
acuauauuguccaggcugaguggcucuuuuauuaaccagucauuacacugcggaacagccaaca

SEQ ID NO: 458485 - RNA, 64 nt, Human
aaaacaucaagaaugacagucuuauauuuaaggcaccagucauuguuuccauuuuuuuuuuaau

SEQ ID NO: 458486 - RNA, 64 nt, Human
aggcccucaggaucugacacccucuugucccaacaccagucagcccuauacccuaacucacucc

SEQ ID NO: 458487 - RNA, 64 nt, Human
aggcagcccagcccaggggacccguuccucuugaaccagucauugccuguggcaaaugugugua

SEQ ID NO: 458488 - RNA, 64 nt, Human
cuggggagucuccccaggcugcuuuucuaggaauaccagucacauaguuuuuauuuuugugucu

SEQ ID NO: 458489 - RNA, 64 nt, Human
gccaggccagcuuccccucacuuaaccaccccauaccagucaccuccugcuccuuuuccucuuu

SEQ ID NO: 458490 - RNA, 64 nt, Human
uuguuuuugccguuguguuuauguuugagauacaaccagucauugguggcaggggcauagagug

SEQ ID NO: 458491 - RNA, 64 nt, Human
uuguuuuugccguuguauuuauguuugagacacaaccagucauugguggcaggggcauauagug

SEQ ID NO: 458492 - RNA, 64 nt, Human
gguuguguccagggugaugaguguggacgggggcaccagucaguucucccuugaaguaaaccuc

SEQ ID NO: 458493 - RNA, 64 nt, Human
gacugcaaccucaggucucccccuacauauuaauaccagucaccaggagcccaccaccucccuc

SEQ ID NO: 458494 - RNA, 64 nt, Human; identical to SEQ ID NO: 189784

SEQ ID NO: 458495 - RNA, 64 nt, Human; identical to SEQ ID NO: 189785

SEQ ID NO: 458496 - RNA, 64 nt, Human; identical to SEQ ID NO: 189786

SEQ ID NO: 458497 - RNA, 64 nt, Human
ggaaacaugguggcaacgucucuuuggauguuuuaccagucaaagguccucaggguucuccucu

SEQ ID NO: 458498 - RNA, 64 nt, Human
aucccuuaccaacucagugccagcaucgguagacaccagucagugcugaucgcuuuuuaacccu

SEQ ID NO: 458499 - RNA, 64 nt, Human
aaagcaaaaccgagaaaaacgacgggcaccuggaaccagucacggcuugggaggugcaggugcc

SEQ ID NO: 458500 - RNA, 64 nt, Human
guuuuaaaaacccuuugaacaaagugugugcauaaccagucaugagauaaaacaacacaaugca

SEQ ID NO: 458501 - RNA, 57 nt, Human
guggggaccugugugucugacccucccaccagucaugcaaccugagauuuuauuuau

SEQ ID NO: 458502 - RNA, 64 nt, Human
ccgggccuggaugggagggagaaaaaaaugaggaaccagucauuaaaggagcuguuuccugggu

SEQ ID NO: 458503 - RNA, 64 nt, Human
uacaaguguaaugaguguggcaaagccuuuagugaccagucaacacuuaccaucaggccauuca

SEQ ID NO: 458504 - RNA, 64 nt, Human
cauguuccugucucuccuuuuccuuccacaucccaccagucaccagcgcuauuguuuuaaccua

SEQ ID NO: 458505 - RNA, 64 nt, Human
gucccacucggggauggagugggccggcggccaaaccagucacucggggaggaaugcggaggag

SEQ ID NO: 458506 - RNA, 64 nt, Human
uggcccuguagggggugcaccccccacccuauggaccagucaaauaaaagccuucaggccccuc

SEQ ID NO: 458507 - RNA, 64 nt, Human
cuucugugagccucugauccaaacauuuuuaucaaccagucaacacauaaccuucuucuauggg

SEQ ID NO: 458508 - RNA, 64 nt, Human
cuggccagggaaccuucuuuauaccaaguaccacaccagucagagucaagucaggaaauagaaa

SEQ ID NO: 458509 - RNA, 64 nt, Human
aguggaucgauggauguauugauaaauagauagaaccagucaucugaagcaacuuaagaauugu

SEQ ID NO: 458510 - RNA, 64 nt, Human
aauaugaccucauuaaaugugcuguuuuauuuggaccagucacacaaaaugucucucuagaguu

SEQ ID NO: 458511 - RNA, 64 nt, Human
uguguaugcaggggucaugaacaagaccugagugaccagucaagccucauguuaccccagagag

SEQ ID NO: 458512 - RNA, 64 nt, Human
gccggugugaugaguauagagugccacccaaggcaccagucacacaagcugaugggcgucuugg

SEQ ID NO: 458513 - RNA, 64 nt, Human; identical to SEQ ID NO: 189787

SEQ ID NO: 458514 - RNA, 64 nt, Human; identical to SEQ ID NO: 189788

SEQ ID NO: 458515 - RNA, 64 nt, Human; identical to SEQ ID NO: 189789

SEQ ID NO: 458516 - RNA, 64 nt, Human
agggcuucaguccuggggcagaggcauaaacagaaccagucacuauggaggucgaggauuccca

SEQ ID NO: 458517 - RNA, 64 nt, Human
uuauuaaacagaaauaauguuuuaccaucucuucaccagucaaguugacacguaaaauuaacca

SEQ ID NO: 458518 - RNA, 64 nt, Human
agggaaggagaucuuuaucuuucugguuggcuugaccagucacguugggagaagagagagagug

SEQ ID NO: 458519 - RNA, 64 nt, Human
ugcagguacuggaucaugauguuucaaaggaagaaccagucaccuuucacuucuuggccaaauu

SEQ ID NO: 458520 - RNA, 64 nt, Human
uggaagguugggcuucaaguuaacaggaucagacaccagucaagcagccucaggucaucuugcg

SEQ ID NO: 458521 - RNA, 64 nt, Human
caccccugaccaaggugcccagcagccugucuucaccagucaaggaauccgccaucuuggcugu

SEQ ID NO: 458522 - RNA, 64 nt, Human
ucgacauggccaagugaacuguggcagguccagaaccagucagagacuugccccuaagagggau

SEQ ID NO: 458523 - RNA, 63 nt, Human
uucuggaaaaugcuggagaagcaauaaagguuguaccagucagacucugcuugcucaggaaga

SEQ ID NO: 458524 - RNA, 64 nt, Human
agacuggagaaaaccccucccacggugcccaaacaccagucaccucgucucccuggugccucug

SEQ ID NO: 458525 - RNA, 64 nt, Human
aaaaugcugccccccucacagggugaccaugaggaccagucacagugaugugugaaagggcucg

SEQ ID NO: 458526 - RNA, 64 nt, Human
agaugagaagaacacuuguucauaggagggccccaccagucagagcccugaaucucuuccuugu

SEQ ID NO: 458527 - RNA, 64 nt, Human
agugcuaugguuaugaguguaugugccaguacuuaccagucaaugcauuguggauaugagcuuu

SEQ ID NO: 458528 - RNA, 64 nt, Human
auuuucuccugauauagaucacauaacagaaugcaccagucaucagcuauucaguugguaagcu

SEQ ID NO: 458529 - RNA, 64 nt, Human
cuguuuugguucuagcuuuagauuuuggauuuucaccagucauguguuaauuuacauuagauag

SEQ ID NO: 458530 - RNA, 64 nt, Human
uccucaguucuugccacuuuuuuuuuuaaucuccaccagucauuuuucagaccuuuuaacuccu

SEQ ID NO: 458531 - RNA, 64 nt, Human
uauuccauuuugcagccagaccgauguguauuuaaccagucacuauugauggacauuuggguug

SEQ ID NO: 458532 - RNA, 64 nt, Human; identical to SEQ ID NO: 189497

SEQ ID NO: 458533 - RNA, 62 nt, Human; identical to SEQ ID NO: 189498

SEQ ID NO: 458534 - RNA, 64 nt, Human; identical to SEQ ID NO: 189623

SEQ ID NO: 458535 - RNA, 64 nt, Human
auggacauuuguugacuugguuuuacaggucauuaccagucauuaaaguccaguauuacuaagg

SEQ ID NO: 458536 - RNA, 64 nt, Human
ccuccccugggacuuucccacccaggaaaggaggaccagucaggaugaggccccgccuuuuccc

SEQ ID NO: 458537 - RNA, 64 nt, Human
cauacaaccauuauuccugacacugagccgcacaaccagucacugggccucucugcagaccucu

SEQ ID NO: 458538 - RNA, 64 nt, Human
cccuaaguacucuguuuacuucuggugaaacaaaaccagucauuagaaauggucugugcuuuua

SEQ ID NO: 458539 - RNA, 64 nt, Human
uggguccuggcgccuggcggucaccuggugccuacuguccgacaggaugccuugauccucgugc

SEQ ID NO: 458540 - RNA, 64 nt, Human
cucuccgcgauggcaaugccgagagugcccucuacuguccgacuccagcacugcaacagcuuca

SEQ ID NO: 458541 - RNA, 64 nt, Human
guaacaccaugauuaaccacuucagcugacuuuucuguccgagcuuugaaaauucagugguguu

SEQ ID NO: 458542 - RNA, 64 nt, Human
ucuuuuugcccacacugcuuuggauacuuaucuacuguccgaaggccuucuuuccccacucaau

SEQ ID NO: 458543 - RNA, 64 nt, Human
agggaggggggagggggguaggcugggccgggaacuguccgaggugcugagcuggggcgggacc

SEQ ID NO: 458544 - RNA, 64 nt, Human
caaaauaguuguaggggaaaucaaggugaaggaucuguccgacagucaagacggauccacagua

SEQ ID NO: 458545 - RNA, 64 nt, Human
ugcgcugaucguuucuuccaguuagagucuucaucuguccgacaaguucacucgccucgguugc

SEQ ID NO: 458546 - RNA, 64 nt, Human; identical to SEQ ID NO: 188563

SEQ ID NO: 458547 - RNA, 64 nt, Human; identical to SEQ ID NO: 189515

SEQ ID NO: 458548 - RNA, 64 nt, Human; identical to SEQ ID NO: 189516

SEQ ID NO: 458549 - RNA, 64 nt, Human
uaaaucucaugucagacccagaaaggaccaaucacuguccgauuguaagcuauguugggccaau

SEQ ID NO: 458550 - RNA, 64 nt, Human
gagcuggaggacagguuugugguugaggacuucucuguccgaugucuacauucagguucugacu

SEQ ID NO: 458551 - RNA, 64 nt, Human
gcuguggcucugccaugccgggcuguguuugcagcuguccgagucuccauccaccuuuagaaaa

SEQ ID NO: 458552 - RNA, 64 nt, Human
cggugugcuggugggggcuguggccuuuggauaucuguccgacagguggggugaggcacugggc

SEQ ID NO: 458553 - RNA, 64 nt, Human
ugguacuuuggcucguuggcuagauuaaccuucucuguccgagugugccacacgagaaccugaa

SEQ ID NO: 458554 - RNA, 64 nt, Human
gagcucucaggauacgaagacauuugacguugcgcuguccgaggagcuccaugcggcacugagu

SEQ ID NO: 458555 - RNA, 64 nt, Human
uaaggagauccagagccagcagcggcuggagagccuguccgagacacccgggccuagcucuccg

SEQ ID NO: 458556 - RNA, 64 nt, Human
uuucacaguucagaccggucuucaaaggaaaagccuguccgauuuuuccauggguuccaguuuc

SEQ ID NO: 458557 - RNA, 64 nt, Human
uauugauuuuguaacagcaccugguguuucacggcuguccgagugagcuaacguggcggugugg

SEQ ID NO: 458558 - RNA, 64 nt, Human
cucuguaagucaggcugggguugaaguuuggagucuguccgaguuugcagggugcugagcugua

SEQ ID NO: 458559 - RNA, 64 nt, Human
gcugguuuuucuggagguucccccagaggcccuccuguccgaaaagaaaaggaccuugauucug

SEQ ID NO: 458560 - RNA, 64 nt, Human
gugaucgagaugguacaagaggcugguagaguaacuguccgagaugggaugccugagcucuuga

SEQ ID NO: 458561 - RNA, 64 nt, Human
cuggaugggcgccaugugccuucugcacgccucgcuguccgaguaugugcugcucuucggcacc

SEQ ID NO: 458562 - RNA, 64 nt, Human
gagcagaugggaggaccccgaggccagacgcacacuguccgagcccucugcucagccgccuggg

SEQ ID NO: 458563 - RNA, 64 nt, Human
auuuuuaccgucacuagcccagccaggcuucagucuguccgacaggaagcugcugggugggggu

SEQ ID NO: 458564 - RNA, 64 nt, Human
gaccacgcugucccaggcacagcugaacaugccgcuguccgaggucugcgagggcuucgacgag

SEQ ID NO: 458565 - RNA, 64 nt, Human; identical to SEQ ID NO: 188675

SEQ ID NO: 458566 - RNA, 64 nt, Human; identical to SEQ ID NO: 189551

SEQ ID NO: 458567 - RNA, 64 nt, Human; identical to SEQ ID NO: 189552

SEQ ID NO: 458568 - RNA, 64 nt, Human
agauagauagauuugcacauagccaugaaaccuccuguccgaguuguggaagguccuuggacuc

SEQ ID NO: 458569 - RNA, 64 nt, Human
aauuaggacacgacaugaaaccagaguggugccucuguccgagaacuuguaaguucucaacuug

SEQ ID NO: 458570 - RNA, 64 nt, Human
agaauugguauuuguguuaucuuugaguaagaaacuguccgauaugaaucacaacgugggugaa

SEQ ID NO: 458571 - RNA, 64 nt, Human
aggcccccacgggacgcggcaggcuucucagucucuguccgagacagccgggaggagccugggg

SEQ ID NO: 458572 - RNA, 64 nt, Human
ccaauuccccaggccccugcuggauuggcaggcccuguccgaggaguugggggaccaucccagc

SEQ ID NO: 458573 - RNA, 64 nt, Human
gggacucuccuuccaucuguggccaccucccgggcuguccgagggaccccaggguaccucacac

SEQ ID NO: 458574 - RNA, 64 nt, Human
agagacaggcuccagaugaggaauccuccauuuucuguccgaagcugacauuccucuggcaguc

SEQ ID NO: 458575 - RNA, 64 nt, Human
uuucuuacacauauuuuguauauuuauaugcucucuguccgaucugugcauguuauuuuucuuu

SEQ ID NO: 458576 - RNA, 64 nt, Human
agccaucuguccggcguaaggacgacaccgucagcuguccgacucgcacacauuuaauaaacug

SEQ ID NO: 458577 - RNA, 64 nt, Human
gccgucucccuuccguggcccagggagguguuugcuguccgaaggaccugggccggcccauggg

SEQ ID NO: 458578 - RNA, 64 nt, Human
ucugcuccacguggggccaggcgugugacugacgcuguccgacgaaggcggccacggacggacg

SEQ ID NO: 458579 - RNA, 64 nt, Human
uccacaaugugcuccugcccacccggguuccgcacuguccgaccccugcacaccacucauguca

SEQ ID NO: 458580 - RNA, 64 nt, Human
ugcauuguggguggggggagaaagcuuguggcuccuguccgaggggguguuuggggucccuugg

SEQ ID NO: 458581 - RNA, 64 nt, Human
cucggcuacucaggacagggcuggaauuuaaagccuguccgauucugaggucucuucucucauc

SEQ ID NO: 458582 - RNA, 64 nt, Human
cuguucugauuccacuguggccaacccaauaauucuguccgaggagggguaagggaauaggagg

SEQ ID NO: 458583 - RNA, 64 nt, Human
cucugccugcccguggaaggagcuuugccgcagccuguccgaguccauccguccguccccuccu

SEQ ID NO: 458584 - RNA, 64 nt, Human; identical to SEQ ID NO: 189553

SEQ ID NO: 458585 - RNA, 64 nt, Human; identical to SEQ ID NO: 189624

SEQ ID NO: 458586 - RNA, 64 nt, Human; identical to SEQ ID NO: 188676

SEQ ID NO: 458587 - RNA, 64 nt, Human
caggcacagaagcggccuccucccgugccccagacuguccgaauugcuuuuauuuucuuauacu

SEQ ID NO: 458588 - RNA, 64 nt, Human
uagccgacacacagcgccuaccaugugcagcugccuguccgaccccaucuuacagacgagaaaa

SEQ ID NO: 458589 - RNA, 64 nt, Human
gcuguccaugcugcccgccuccccccaccccgcccuguccgacuguaacagaccaggagggugg

SEQ ID NO: 458590 - RNA, 64 nt, Human
ugugacccagccccuuacaccacuuuccaccuuccuguccgaaguacacggacacuagcugccc

SEQ ID NO: 458591 - RNA, 64 nt, Human
cagcuuaaaguuguguaauacuaaaaucacgagaacaccuaaacaacaaccaaaaaucuauugu

SEQ ID NO: 458592 - RNA, 64 nt, Human
guuagaagucacacuauuacuccaaugucaucagacaccuaaggucugccagccaggcuccugg

SEQ ID NO: 458593 - RNA, 64 nt, Human
gagguggaaacagugguccugaaucauugugcucacaccuaacuugaaaucuggucuuacuuuc

SEQ ID NO: 458594 - RNA, 64 nt, Human
uaggaaauguuacuuuuguuaaucuuuaaaaaauacaccuaaugaaagacauuccacuauuaug

SEQ ID NO: 458595 - RNA, 64 nt, Human
cauugaaaagauauuacuguuaauuuuuuauuuaacaccuaaagcauuuccaacaucacuuugc

SEQ ID NO: 458596 - RNA, 64 nt, Human
cagucuugcuuacaaggagggguuaccauguaucacaccuaaucuucccaauguuugggauauu

SEQ ID NO: 458597 - RNA, 64 nt, Human
uucugguacuucagucguuuuuacugauccaccaacaccuaaagaggcuaugcuacagucucua

SEQ ID NO: 458598 - RNA, 64 nt, Human
gauuguuuuucaauuuuucccacuuugaaaacuuacaccuaaaggccuguaggccucuaacucu

SEQ ID NO: 458599 - RNA, 64 nt, Human; identical to SEQ ID NO: 189570

SEQ ID NO: 458600 - RNA, 64 nt, Human; identical to SEQ ID NO: 189571

SEQ ID NO: 458601 - RNA, 64 nt, Human; identical to SEQ ID NO: 189390

SEQ ID NO: 458602 - RNA, 64 nt, Human
ggcugauuccuugaaaauguaauuuuccagaaaaacaccuaaagaaaauaaaacauggacaugc

SEQ ID NO: 458603 - RNA, 64 nt, Human
ucuaucauugcucagccccaaugagaaagcagauacaccuaagccaucaucaaccacuaacauc

SEQ ID NO: 458604 - RNA, 64 nt, Human
auuaaaaaaaaaaagacugucauucauaccauucacaccuaaagacugaauuuuaucuguuuua

SEQ ID NO: 458605 - RNA, 64 nt, Human
guaaggauuagaaacauagacucccaaguuuuaaacaccuaaaugugaauaacccauauauaca

SEQ ID NO: 458606 - RNA, 52 nt, Human
uuauuacaguuccuaauugaggacaccuaagaaggcaugguacucugacaaa

SEQ ID NO: 458607 - RNA, 64 nt, Human
aggccuuuuguuuauuaauggaagaguacuccccacaccuaagaccagauucuuauaucucccu

SEQ ID NO: 458608 - RNA, 64 nt, Human
guccuucggacuuaaaccugccuaccugagucaaacaccuaaggauaacaucauuuccagcaug

SEQ ID NO: 458609 - RNA, 64 nt, Human
acacucaaucuuuuugcuccacccugaauuccucacaccuaacccugauaguuaccuaaaguga

SEQ ID NO: 458610 - RNA, 64 nt, Human
uuaguguacgaguguaagauacacuuuaagccagacaccuaauucuucaguucacugcccaugu

SEQ ID NO: 458611 - RNA, 64 nt, Human
uuuuuggaaacuguuaagauaaacuguaauccagacaccuaauucuucaguucacuacucaugu

SEQ ID NO: 458612 - RNA, 64 nt, Human
uugggaugacuuggugucuaauguguagugcuacacaccuaacuuauggggccaaaauagcaug

SEQ ID NO: 458613 - RNA, 64 nt, Human
gacccaugggaggaggagguggggcccacucaacacaccuaagccaguggcccucuaggagggg

SEQ ID NO: 458614 - RNA, 64 nt, Human
aaccugguagacaguauaaaagcagugcaaauaaacaccuaaccuucugcaaacuucaggcuuu

SEQ ID NO: 458615 - RNA, 64 nt, Human
aaacgcagccaauuuuuuuaagcagaauaugagaacaccuaaguauucucuucauagcaguucc

SEQ ID NO: 458616 - RNA, 64 nt, Human
auauguaguaguuugaugaauaauuuaaagaaaaacaccuaaaauuugaaaaaugauuguagga

SEQ ID NO: 458617 - RNA, 64 nt, Human; identical to SEQ ID NO: 188677

SEQ ID NO: 458618 - RNA, 64 nt, Human; identical to SEQ ID NO: 189587

SEQ ID NO: 458619 - RNA, 64 nt, Human; identical to SEQ ID NO: 189588

SEQ ID NO: 458620 - RNA, 64 nt, Human
auuguuuucacccaaauuugaguagauauuuuaaacaccuaacaaaguaaagggcuaaaagcca

SEQ ID NO: 458621 - RNA, 64 nt, Human
gcuuucccuuuuucuucuguuaauacuuaugguaacaccuaacugagccucacucacauuaaau

SEQ ID NO: 458622 - RNA, 64 nt, Human
gaucuuugcuuccuugcuuuuauguuuguacacaacaccuaaaaccaguuuugcugcuauaauu

SEQ ID NO: 458623 - RNA, 64 nt, Human
gguggggaccggggccggcgggcuccaggccagcacaccuaacccauggauguggaaccuacgg

SEQ ID NO: 458624 - RNA, 64 nt, Human
auuuucugagcaagaggaagucaaaauuuauuuaacaccuaagccuuuuuguagacucuuuucu

SEQ ID NO: 458625 - RNA, 64 nt, Human
caugcuuuaaauuaucuggcuguauucuaaaucaacaccuaaccccucaaggaaacugaagaau

SEQ ID NO: 458626 - RNA, 64 nt, Human
auacagcuacggauauaaugaaaauuaucugcaaacaccuaaauuaaagagaaaaaaaaguagu

SEQ ID NO: 458627 - RNA, 64 nt, Human
uucuccgcacugaucugagagcugggcggcguccacaccuaagaacagcagcuccaccaaauga

SEQ ID NO: 458628 - RNA, 64 nt, Human
uucuuccaguugcacuauucugagggaaaaucugacaccuaagaaauuuacugugaaaaagcau

SEQ ID NO: 458629 - RNA, 64 nt, Human
gaauuacuuuaaaaggagguaacagccagccauuacaccuaaauuuaauuuauuuuauuaaaau

SEQ ID NO: 458630 - RNA, 64 nt, Human
ccauagcuuuagucuuccuaaauaagauccacccacaccuaagucacagaauuucuaaguuccc

SEQ ID NO: 458631 - RNA, 64 nt, Human
auuuucacaaauuauacuuuauauaaggcauuccacaccuaagaacuaguuuugggaaauguag

SEQ ID NO: 458632 - RNA, 64 nt, Human
gauuuuacaucuggauuuuuagucauucuaaaaaacaccuaauuauuaaaacauuuauagagug

SEQ ID NO: 458633 - RNA, 64 nt, Human
uguaacacauaaaaaaauggaagaaacugauaccacaccuaaggaccaaagauaagaaagacuu

SEQ ID NO: 458634 - RNA, 64 nt, Human
cauauggccaucccauuggccagaauccacagacacaccuaagccuguggcacugggacagaau

SEQ ID NO: 458635 - RNA, 64 nt, Human; identical to SEQ ID NO: 189791

SEQ ID NO: 458636 - RNA, 64 nt, Human; identical to SEQ ID NO: 189792

SEQ ID NO: 458637 - RNA, 64 nt, Human; identical to SEQ ID NO: 189793

SEQ ID NO: 458638 - RNA, 64 nt, Human
ugaguuuuagcaagaguccugagggcggggccgaacaccuaacuccgggaggcucccaggcgcc

SEQ ID NO: 458639 - RNA, 64 nt, Human
aaccaguagugucuuuuacaugaagagaugauuuacaccuaauagacauugaauaugauagaca

SEQ ID NO: 458640 - RNA, 64 nt, Human
gcuuucucacacuuggauccuucuguucuuccuuacaccuaaauaauacaagagauuaaugaau

SEQ ID NO: 458641 - RNA, 64 nt, Human
cuaggauuggaaaaaaauguuaaagguuuaggacacaccuaauaguauguccuuugaaugggaa

SEQ ID NO: 458642 - RNA, 64 nt, Human
gacuuucagugcacuguauauagaagucuaaaacacaccuaagagaaaaagaucgaauuuuuca

SEQ ID NO: 458643 - RNA, 64 nt, Human
uuauauuauuuuacuuauuuggaauuuacagagcacaccuaagcaauuaggauauaacaaaacu

SEQ ID NO: 458644 - RNA, 64 nt, Human
uggcuucaaucuacgauguuaaaacaaauuaaaaacaccuaagugacuaccacuuauuucuaaa

SEQ ID NO: 458645 - RNA, 64 nt, Human
auaucaaaacaucucauguaccccauaaauauauacaccuaauacccacaaaacuuaaaauaua

SEQ ID NO: 458646 - RNA, 64 nt, Human
uccccccuccacaccauccuagcgaggcaccagcacaccuaaucacagcaaagcccagaucccc

SEQ ID NO: 458647 - RNA, 64 nt, Human
agggaacuaaaagucugagggggacacaaaugucacaccuaagaggacaaucaaucauuuugua

SEQ ID NO: 458648 - RNA, 64 nt, Human
cuauggcuacaugguucuucuggccgaugguaugacaccuaaguuagaacacagccuuggcugg

SEQ ID NO: 458649 - RNA, 64 nt, Human
gguguuauauuuaaaaaagcaaguuuggauuuuuacaccuaauuuacuaggaaaauauuuuauu

SEQ ID NO: 458650 - RNA, 64 nt, Human
uccaguucuccacuccaaugauaauaguucacuuacaccuaaacccaaaggaaaaaccagcucu

SEQ ID NO: 458651 - RNA, 64 nt, Human
ccauuguacacagguguacaccaugcaugcaccaacaccuaaaacucaaaacuaaauggcuauu

SEQ ID NO: 458652 - RNA, 64 nt, Human
gaguagacaugauugguggccaaguuauuuggggacaccuaaacagaucagugaccugaaugac

SEQ ID NO: 458653 - RNA, 64 nt, Human; identical to SEQ ID NO: 189295

SEQ ID NO: 458654 - RNA, 64 nt, Human; identical to SEQ ID NO: 188693

SEQ ID NO: 458655 - RNA, 64 nt, Human; identical to SEQ ID NO: 189625

SEQ ID NO: 458656 - RNA, 64 nt, Human
ugugcacuuggcgagccuccugcccacccuguccacaccuaauaagugcaaucauuuugagucu

SEQ ID NO: 458657 - RNA, 64 nt, Human
gaauauauuauuuuagguauaauuuacaaaugucacaccuaauaaucuuuuauaauauaccaua

SEQ ID NO: 458658 - RNA, 64 nt, Human
acauugaucaaguucgggggaauaaagacagaccacaccuaaaacugccuuucugcuucucuua

SEQ ID NO: 458659 - RNA, 64 nt, Human
uuccaaagaugucaauggaaacuaaucgagucuuacaccuaauuuucaguuuacaguaaauaca

SEQ ID NO: 458660 - RNA, 64 nt, Human
cagcuccaaguaaacauuccaaguaagcgucuuaacaccuaaccccaaaggcucuuuuaagagc

SEQ ID NO: 458661 - RNA, 64 nt, Human
uuaagauaacagaagugaccaauguaauuucacaacaccuaaggauuuuuugguugaucagguu

SEQ ID NO: 458662 - RNA, 64 nt, Human
uauuuacaaaauccuagauggcauagccuacuacacaccuaauguguaugguauagacuguugc

SEQ ID NO: 458663 - RNA, 64 nt, Human
auauaguuuagcaguaaaaaaaaaaaaaaaaaccacaccuaaaauagaccacugaggagaccau

SEQ ID NO: 458664 - RNA, 64 nt, Human
aaugugguaaaacuuacaauccucaaaacuucuuacaccuaaaauucaugcaggagagaaacac

SEQ ID NO: 458665 - RNA, 64 nt, Human
cugccagcacagugcuggacauagugaguacugaacaccuaagaggcacucauucagacugacu

SEQ ID NO: 458666 - RNA, 64 nt, Human
aagauccgacauuuuuuguauucuuuaagauuuuacaccuaaaaaaucucuccuaucccaaaaa

SEQ ID NO: 458667 - RNA, 64 nt, Human
cugaaaauccgagugaugauguugugaauacggaacaccuaaucacacagcuugcuuugcuuuu

SEQ ID NO: 458668 - RNA, 64 nt, Human
cuucgugugugaugucauucuucccuaaucgcuuacaccuaauauaagcuuguccucccuccca

SEQ ID NO: 458669 - RNA, 64 nt, Human
aaauauguagaaauaaaaauguugccauaaaauaacaccuaagcauauacuauucuaugcuuua

SEQ ID NO: 458670 - RNA, 64 nt, Human
ucgugguucaggcaguaugggccgcugugacaaaacaccuaagacuggguaguuuauaaagaac

SEQ ID NO: 458671 - RNA, 64 nt, Human; identical to SEQ ID NO: 188748

SEQ ID NO: 458672 - RNA, 64 nt, Human; identical to SEQ ID NO: 188694

SEQ ID NO: 458673 - RNA, 64 nt, Human; identical to SEQ ID NO: 189641

SEQ ID NO: 458674 - RNA, 64 nt, Human
uccuacuacuuugguuuuccuagcuccauaccacacaccuaaaccuguauuaugaauuacauau

SEQ ID NO: 458675 - RNA, 64 nt, Human
acugcaaucagcaugaacaccaggcaccccugggacaccuaacgcccaguucccgugaccccaa

SEQ ID NO: 458676 - RNA, 64 nt, Human
uagaaauacuuuuagauuugauuauguauacaugacaccuaaagagggaacaaaaguuaguuuu

SEQ ID NO: 458677 - RNA, 64 nt, Human
gaauuacuguagcagcaaaagcaaauuggucuccacaccuaaaaucgucugccuguguacuuug

SEQ ID NO: 458678 - RNA, 64 nt, Human
guguuuccuuuuuuuaaaagccaauugacagauuacaccuaaauacuccuccuuuuguaucauu

SEQ ID NO: 458679 - RNA, 64 nt, Human
ccagauaucagggugguuuauaaagccuguaaacacaccuaagaaaauaaacauuuuacaaaug

SEQ ID NO: 458680 - RNA, 64 nt, Human
ccguggagggucccuuuuacgcaccccaaggcccacaccuaagcuuccauguagcccucaucca

SEQ ID NO: 458681 - RNA, 64 nt, Human
uucaaaaaagauuuaagauguacgacauuaccgaacaccuaaaauagaaccagagaaacgaaag

SEQ ID NO: 458682 - RNA, 64 nt, Human
gccccaggugggcagcuguggcagagcagucccgacaccuaaauaaaagucuugcugcaggaga

SEQ ID NO: 458683 - RNA, 64 nt, Human
auaaacaaucuucacacgaaaccaaaaauagcauacaccuaauguuggguuagggaauugcaau

SEQ ID NO: 458684 - RNA, 64 nt, Human
auaucaaaugaauauagaacuaauauugucgggaacaccuaauagaaaggaauacuauuauagc

SEQ ID NO: 458685 - RNA, 64 nt, Human
acagacuccucuaguacuuggagaucuuggacguacaccuaaucccauggggccucggcuuccu

SEQ ID NO: 458686 - RNA, 64 nt, Human
gaugcuacuucugcaugcaucuacagggcaucugacaccuaacaugagacguggcaugugagau

SEQ ID NO: 458687 - RNA, 64 nt, Human
gugauaccacuuaaaaucucuagagaacuacugaacaccuaaagauuuucuguagcguagauau

SEQ ID NO: 458688 - RNA, 64 nt, Human
uucaauaucuagaaauuuuuaauugaguguaaacacaccuaacuuuaagaaaaagaaccgcuug

SEQ ID NO: 458689 - RNA, 64 nt, Human; identical to SEQ ID NO: 189643

SEQ ID NO: 458690 - RNA, 64 nt, Human; identical to SEQ ID NO: 189678

SEQ ID NO: 458691 - RNA, 64 nt, Human; identical to SEQ ID NO: 188695

SEQ ID NO: 458692 - RNA, 64 nt, Human
cacauucuuuaaaaguguguuccuaaguagaaauacaccuaaaugaagauucucuuauuuuauc

SEQ ID NO: 458693 - RNA, 64 nt, Human
agagggcagagcccauguuuccugacauagcucuacaccuaaauaagggacugaacccucccaa

SEQ ID NO: 458694 - RNA, 64 nt, Human
uuuugguagaaauguguuuauuuaacacacacacacaccuaauacuacauucaaaguauuuuau

SEQ ID NO: 458695 - RNA, 64 nt, Human
ccugaacgcuaugacaccaugaguggaaaauuccacaccuaacaaacacauuugcuuucuuaug

SEQ ID NO: 458696 - RNA, 64 nt, Human
caccauuuaaggggauggcauucuuuauaccuaaacaccuaagagcugaagucaggucuuuuaa

SEQ ID NO: 458697 - RNA, 64 nt, Human
ugggacaugcaugcuauggggacccucuuguuggacaccuaauuggaugccucuucaugagagg

SEQ ID NO: 458698 - RNA, 64 nt, Human
uuuaauagccauggguucuuuugggguaauguacacaccuaacugcauuuguuuugacuucuuu

SEQ ID NO: 458699 - RNA, 64 nt, Human
gauuacaggcaugagccaccacgcuuggcuaagaacaccuaaauuuuuauguuucuuggcucaa

SEQ ID NO: 458700 - RNA, 64 nt, Human
aaucaaaucuauucagguuucuucacuguugagaacaccuaaauguuuuuauuuuugagaagug

SEQ ID NO: 458701 - RNA, 64 nt, Human
uauauuuuuuucugaaauguuuuaaaauagaaguacaccuaauuguuauugguuaaaaaaaaag

SEQ ID NO: 458702 - RNA, 64 nt, Human
ugucucacuuggccaaguuugcagccuugagccaacaccuaaaagggagaggugggcucuucug

SEQ ID NO: 458703 - RNA, 64 nt, Human
ccccagcagucaauuaacaauaagccaguauaaaacaccuaaauaaccaaucuacaaucucccu

SEQ ID NO: 458704 - RNA, 64 nt, Human
ugcauuagaaaaagaggcgcuucuccccuccccuacaccuaaagguguauuuaaacuaucuugu

SEQ ID NO: 458705 - RNA, 64 nt, Human
agguaugaugaauaacaacacuuaaaaacucaucacaccuaaagacauggaaagcugccaauua

SEQ ID NO: 458706 - RNA, 64 nt, Human
agaucuacauaaaaacugcuacaugacaaaaaccacaccuaaagaaauuuuaagaauuuggcac

SEQ ID NO: 458707 - RNA, 64 nt, Human; identical to SEQ ID NO: 189679

SEQ ID NO: 458708 - RNA, 64 nt, Human; identical to SEQ ID NO: 189605

SEQ ID NO: 458709 - RNA, 64 nt, Human; identical to SEQ ID NO: 188711

SEQ ID NO: 458710 - RNA, 64 nt, Human
agggacccuggugguaccugugcuuucccagaggacaccuaaugucccgaugccucccuugagg

SEQ ID NO: 458711 - RNA, 64 nt, Human
uuuugaaaauugagauuacuucagagccuuagccacaccuaaaauaccuccuaguuaauagugg

SEQ ID NO: 458712 - RNA, 64 nt, Human
uucaaaugaauuuaaauaucuuuuaaagaaaaaaacaccuaaaaauaaaucuuaacagaaaauu

SEQ ID NO: 458713 - RNA, 64 nt, Human
guggagaguccagggaggcaggauggaucaccagacaccuaaccuucagcguugcccauggccc

SEQ ID NO: 458714 - RNA, 64 nt, Human
uauuucuaggaagaauuuuaaaaaugaauccuacacaccuaagggacauguuuugauaaaguag

SEQ ID NO: 458715 - RNA, 64 nt, Human
ggaacuugauaguuuuuuaaauuaaaaaauguauacaccuaacauagaaaauuaaagauagcug

SEQ ID NO: 458716 - RNA, 64 nt, Human
uauucuucaucugaggagcaucuauauguuuaauacaccuaauguauuaugcuggaguauuuaa

SEQ ID NO: 458717 - RNA, 64 nt, Human
cagccuccuugccucugcucugaccucagcagcuacaccuaaccccaccgcacccuacccagug

SEQ ID NO: 458718 - RNA, 64 nt, Human
cuguugcucuaacaaaauaaaccuuagacauaucacaccuaaaauaugcugcagauuuuauaau

SEQ ID NO: 458719 - RNA, 64 nt, Human
acucauuuguagucuaggaaauugagauuuugauacaccuaaggucacgcagcuggguagauau

SEQ ID NO: 458720 - RNA, 64 nt, Human
acaggccugauggagcuuguggcuggccucagauacaccuaagaagcuuaggggcaagguucau

SEQ ID NO: 458721 - RNA, 64 nt, Human
gucaggccugugcugagagccgcagccccugugcacaccuaacacagggcgcucccccugcugc

SEQ ID NO: 458722 - RNA, 64 nt, Human
gggagaaguagggagcuguucguuuaagcagcauacaccuaaauuggggguuuaaacauuaagu

SEQ ID NO: 458723 - RNA, 64 nt, Human
ugcauggcccuauguggcucugcauucuagucagacaccuaacaccuccccaagcuucugcuau

SEQ ID NO: 458724 - RNA, 64 nt, Human
cacuuugagggaggugcuucgaagaauguugcccacaccuaaguguuagaagccuauguccguu

SEQ ID NO: 458725 - RNA, 64 nt, Human; identical to SEQ ID NO: 189607

SEQ ID NO: 458726 - RNA, 64 nt, Human; identical to SEQ ID NO: 188712

SEQ ID NO: 458727 - RNA, 64 nt, Human; identical to SEQ ID NO: 188713

SEQ ID NO: 458728 - RNA, 64 nt, Human
uaguguguuggcaauacuuuucaaauggcugaaaacaccuaaaaauuguucauucagaaauauc

SEQ ID NO: 458729 - RNA, 64 nt, Human
agauguaaucggcagugaacucagaacgcacugcacaccuaaggcaaaucccuggccacuuuag

SEQ ID NO: 458730 - RNA, 64 nt, Human
gggcugggaugcucugugaccccagcuggagcccacaccuaagggcuggcauccacaucauuuc

SEQ ID NO: 458731 - RNA, 64 nt, Human
caaacccaggucaccucauuccccuucucuguucacaccuaaugucuugaagaguagguagcag

SEQ ID NO: 458732 - RNA, 64 nt, Human
guccauccuuaucccucuucuggcuugggcccugacaccuaagucuuucccacgguuuaugugu

SEQ ID NO: 458733 - RNA, 64 nt, Human
ccagacaaagaugucuuaaccucagggagugcagacaccuaaccccagggcacugccagcccac

SEQ ID NO: 458734 - RNA, 64 nt, Human
uagauaugauaaauauaacaucuaugaaaagcccacaccuaacauuauacuucauggugauaga

SEQ ID NO: 458735 - RNA, 64 nt, Human
gguccgucauaacccaagguaccauccuaggcugacaccuaacucuucuuucauuucuucuaca

SEQ ID NO: 458736 - RNA, 64 nt, Human
cagauacaacagcauuuggggccaugguaccugcacaccuaaaacacuaggccacgcaucugau

SEQ ID NO: 458737 - RNA, 64 nt, Human
uacaaacuugaaagaugugacagugcuuuugacaacaccuaaaacuuuuaaacauaaaaaauca

SEQ ID NO: 458738 - RNA, 64 nt, Human
uuugcuucuugguaccucagcuguaaaaugaaacacaccuaaaagugugguuguuuccaacaug

SEQ ID NO: 458739 - RNA, 64 nt, Human
uccaguucucaauggccaacgaaggugcuuggaaacaccuaaccuugcaaguuuuaccgccuuu

SEQ ID NO: 458740 - RNA, 64 nt, Human
cugucucaaaagcaaagcaaaaacaaaaacaaaaacaccuaaaaaaccugcaguuuuguuugua

SEQ ID NO: 458741 - RNA, 64 nt, Human
ucucaaguagcugggacuacaggcaugugccaccacaccuaauuucuauauuuuuuguagagac

SEQ ID NO: 458742 - RNA, 64 nt, Human
auguguguuugcaugaggaacucuuuaguggcagacaccuaagagacggcugcggucaccccac

SEQ ID NO: 458743 - RNA, 64 nt, Human; identical to SEQ ID NO: 188729

SEQ ID NO: 458744 - RNA, 64 nt, Human; identical to SEQ ID NO: 188730

SEQ ID NO: 458745 - RNA, 64 nt, Human; identical to SEQ ID NO: 188731

SEQ ID NO: 458746 - RNA, 64 nt, Human
ugacaucagaguccaugcuaaagagaaaucauauacaccuaacuguguggcagaggcuucauuu

SEQ ID NO: 458747 - RNA, 64 nt, Human
ucuucuucaucauggaaaccucaguuuuguucauacaccuaaauacuucaguaugucuuuccua

SEQ ID NO: 458748 - RNA, 64 nt, Human
uaaggacuuuuuaauuaaccacaauaccacuaucacaccuaauaauaguaauuccuuauggauc

SEQ ID NO: 458749 - RNA, 64 nt, Human
gagaagccaugugauucccagagccaggcgcuuuacaccuaaaguaguuugacuuucuucugua

SEQ ID NO: 458750 - RNA, 64 nt, Human
uuaaacuuacucuugguuuagagcauguguagaaacaccuaagguagcucuaugcuaaauaaug

SEQ ID NO: 458751 - RNA, 64 nt, Human
caaccacaucuggucucugccuucgguggcccacacaccuaagcgucaucgucauugccauagc

SEQ ID NO: 458752 - RNA, 64 nt, Human
guucccuaggccacaagagaggccccccauccucacaccuaaccugcauggggcuucgcccaca

SEQ ID NO: 458753 - RNA, 64 nt, Human
ugucuggccccaguggucuggggagcccccaggcacaccuaagcgucguggagcauuguucugc

SEQ ID NO: 458754 - RNA, 64 nt, Human
ugagccgcgcggggaccggccaccuggagccuccacaccuaagcugcgccuccugucauuuccc

SEQ ID NO: 458755 - RNA, 64 nt, Human
cugaacuugcuauuuuaaacaaauaguucugucgacaccuaaaauauaaucuggcuucuugugu

SEQ ID NO: 458756 - RNA, 64 nt, Human
gaauaguuagacauggaaauuauuuuauaagcacacaccuaaagauaucuuuuuagaugauaaa

SEQ ID NO: 458757 - RNA, 64 nt, Human
cauuaaaaauaagccaaaauaagacuauugguaaacaccuaaauuuuuguaagaaaauuuaaaa

SEQ ID NO: 458758 - RNA, 64 nt, Human
guugccugccccugaagaccuuugaguucagucuacaccuaagcagguagacauccgcgagguc

SEQ ID NO: 458759 - RNA, 64 nt, Human
uuggcaagaagucuauuaggucaguuuagcaagaacaccuaacccccccauaucuguucaaccu

SEQ ID NO: 458760 - RNA, 64 nt, Human
cugcugauauuggauauaaugcugcuuuuuagagacaccuaaauugcaguaucagaaugaaugu

SEQ ID NO: 458761 - RNA, 64 nt, Human; identical to SEQ ID NO: 189741

SEQ ID NO: 458762 - RNA, 64 nt, Human; identical to SEQ ID NO: 189742

SEQ ID NO: 458763 - RNA, 64 nt, Human; identical to SEQ ID NO: 189743

SEQ ID NO: 458764 - RNA, 64 nt, Human
ccccuccucccuuuuuccuuguccccacacuccuacaccuaacucaccuaacucauacugugcu

SEQ ID NO: 458765 - RNA, 64 nt, Human
gcauagagaauuucuguuauaccaagcauaaaguacaccuaauaacguuguguuaaaaaagugu

SEQ ID NO: 458766 - RNA, 64 nt, Human
acuggcucucuaguucagcaguucuuccccuccuacaccuaaguuagcguucaauauacgagac

SEQ ID NO: 458767 - RNA, 64 nt, Human
gaaugaggcacaugacagugguuauauuucaaccacaccuaaauuaacaaauucaguggacauu

SEQ ID NO: 458768 - RNA, 64 nt, Human
uuuuagauugucuaucuguauaacacacacacacacaccuaagagucucuauuucacaauuaua

SEQ ID NO: 458769 - RNA, 64 nt, Human
ucccauacuuuaagucaucucucgauuauuuguaacaccuaauacaaugucagugcuauguaaa

SEQ ID NO: 458770 - RNA, 64 nt, Human
ccauacacaggcuaucaacauguuauucaaugugacaccuaacucuuuucuauuuuguuuuuua

SEQ ID NO: 458771 - RNA, 57 nt, Human
ucuauguccacucaguuugacaucgucacaccuaaaugcugucugguccccugcaca

SEQ ID NO: 458772 - RNA, 64 nt, Human
agugggcaagaggaaagauaaguaaguaccauacacaccuaaaagaugagagaauucauccaga

SEQ ID NO: 458773 - RNA, 64 nt, Human
aguguagcuucuccuuugucucccauccacucugacaccuaagccccacucuuuucccauuaga

SEQ ID NO: 458774 - RNA, 64 nt, Human
uuggguguaccaaugccccucaucucccacuuucacaccuaacccugacuccuucaccaagaag

SEQ ID NO: 458775 - RNA, 64 nt, Human
gaagcugccguucauguguuggaggccaaauguggcaaaccaaccccaggcccacccagagcga

SEQ ID NO: 458776 - RNA, 64 nt, Human
uggugcuaggagagacaguggagaggccagagaagcaaaccacuguggcuccucacuggggguu

SEQ ID NO: 458777 - RNA, 64 nt, Human
accuggcucacacacagccucauggguagggucagcaaaccagauggcuuguuguuggaaugua

SEQ ID NO: 458778 - RNA, 64 nt, Human; identical to SEQ ID NO: 189744

SEQ ID NO: 458779 - RNA, 64 nt, Human; identical to SEQ ID NO: 189745

SEQ ID NO: 458780 - RNA, 64 nt, Human; identical to SEQ ID NO: 189746

SEQ ID NO: 458781 - RNA, 64 nt, Human; identical to SEQ ID NO: 189794

SEQ ID NO: 458782 - RNA, 64 nt, Human
accugagaagcggugggcuaagauagguccuacugcaaaccaccccuccauauuuccguaccau

SEQ ID NO: 458783 - RNA, 64 nt, Human
ccuauccugaaucaagccuugagccuaaaucaaagcaaaccaauaccauugauaagaagaagau

SEQ ID NO: 458784 - RNA, 64 nt, Human
caaaacaaagugaaaaccgaauggauuaacuuuugcaaaccaagggagauuucuuagcaaauga

SEQ ID NO: 458785 - RNA, 64 nt, Human
ucacuucaucccaaaaaugggauugugaaugucagcaaaccauaaaaaaagugcuuagaaguau

SEQ ID NO: 458786 - RNA, 64 nt, Human
augguaacaauaguucuuagcuuugaaacuccaugcaaaccaugccuuuuuuuuaaggagcaaa

SEQ ID NO: 458787 - RNA, 64 nt, Human
uaguuguggauaaaggggagaauuuauugcucuugcaaaccaauuauggaaagcaacuuaagaa

SEQ ID NO: 458788 - RNA, 64 nt, Human
cccugacauaaggaacagaacacaacaaaacacagcaaaccaugugcccaaacugcuccccaaa

SEQ ID NO: 458789 - RNA, 64 nt, Human
uguuuagagggauccacuacucaagaaaaaguuagcaaaccacuccuuuuguugcaaaggagcu

SEQ ID NO: 458790 - RNA, 64 nt, Human
uuguucauccauuauaaauauaucuuuagccacagcaaaccacacuuaaccuaucuauaauaaa

SEQ ID NO: 458791 - RNA, 64 nt, Human
auggauaauucucacugauggaucucaagcuaaagcaaaccaucuuauacagagaucuagaauc

SEQ ID NO: 458792 - RNA, 64 nt, Human
cauguauaauccucacugaugauuucaagcuaaagcaaaccaccuuauacagagaucuagaauc

SEQ ID NO: 458793 - RNA, 64 nt, Human
uaaagagaucaggacagcaagcaagacuucaguagcaaaccacuacagucaguaccuggacucg

SEQ ID NO: 458794 - RNA, 64 nt, Human
uauuaucuuuuaaaaauuacaaaaauuuguauaggcaaaccauuucuuaaaguugauggccaaa

SEQ ID NO: 458795 - RNA, 64 nt, Human
gaacaagugggcuuggggaauugaauagcagagagcaaaccaaucagucccucaggaaagggaa

SEQ ID NO: 458796 - RNA, 64 nt, Human
gagcaguauauguucuaagaccccuaguagauucgcaaaccacagauaguaccaaacuccauuc

SEQ ID NO: 458797 - RNA, 64 nt, Human
uaaguacuguaauccacacaacacauuauaagaagcaaaccagcaucuuaaggaauuauaaaau

SEQ ID NO: 458798 - RNA, 64 nt, Human; identical to SEQ ID NO: 189748

SEQ ID NO: 458799 - RNA, 64 nt, Human; identical to SEQ ID NO: 189749

SEQ ID NO: 458800 - RNA, 64 nt, Human; identical to SEQ ID NO: 189750

SEQ ID NO: 458801 - RNA, 64 nt, Human
ucucucucucucuuuuuuuuuuuuuuuuuuuaaagcaaaccauuguauguguaaguguuuaagu

SEQ ID NO: 458802 - RNA, 64 nt, Human
gagggcgacgaggaggacagaggcugcugcugcugcaaaccaggccacuugccucaccugcugu

SEQ ID NO: 458803 - RNA, 64 nt, Human
uguuuguguagguaaauaaaggcagacaugguuugcaaaccacaagaaucauuaguuguagaga

SEQ ID NO: 458804 - RNA, 64 nt, Human
aauuugcagagaaaugaugguuguaaguggacaugcaaaccaaaauuggggauuggagaaguca

SEQ ID NO: 458805 - RNA, 64 nt, Human
cuccccggucagcucugcaucagguguuuucugagcaaaccaaggggguuuauagucaucuguc

SEQ ID NO: 458806 - RNA, 64 nt, Human
cuguuggguucugucuucuauuggguucugugaagcaaaccacuguagcuuuagcuggguucag

SEQ ID NO: 458807 - RNA, 64 nt, Human
aagcucuguaagaaagaaaaggucagccucccaggcaaaccaguaguggagguuuuacauuugu

SEQ ID NO: 458808 - RNA, 64 nt, Human
aaagguaucagggauuuuuaaguccguuuagagagcaaaccauauugugccucuucaucuugac

SEQ ID NO: 458809 - RNA, 64 nt, Human
uccacaaauguauuuggauuguuuucuaugugaagcaaaccaauuauaauuaaccacauguugu

SEQ ID NO: 458810 - RNA, 64 nt, Human
uacuagugaaguaagaaauuuugcuuguuguuuugcaaaccaaauaguuuccucaaacacaaau

SEQ ID NO: 458811 - RNA, 64 nt, Human
cagcaaccagauuaucuaagugccacugcccucugcaaaccaccacuggccccuaauggcaggg

SEQ ID NO: 458812 - RNA, 64 nt, Human
uuugaauacauaauucucuucaaagacuucagcagcaaaccaaaacagcagguuaaaaaaaaag

SEQ ID NO: 458813 - RNA, 64 nt, Human
uuuucauaagacaauguuucagauauguaauggggcaaaccacuauagauuucuguuggauaga

SEQ ID NO: 458814 - RNA, 64 nt, Human
guugagccuugcuggacaagugguuuguuugugugcaaaccaaacuuucuuuacccagugcaau

SEQ ID NO: 458815 - RNA, 64 nt, Human
gucaucagucaucucuuuauggugacuucccuuugcaaaccaggcugugaccaacacaugugag

SEQ ID NO: 458816 - RNA, 64 nt, Human
acguuucacauuaaauggugugaagcguuguuuggcaaaccaacagcuuuggcuucuggugugg

SEQ ID NO: 458817 - RNA, 64 nt, Human; identical to SEQ ID NO: 189659

SEQ ID NO: 458818 - RNA, 64 nt, Human; identical to SEQ ID NO: 189660

SEQ ID NO: 458819 - RNA, 64 nt, Human; identical to SEQ ID NO: 189661

SEQ ID NO: 458820 - RNA, 51 nt, Human
ucaccggagccagucuauagcgcaaaccacacaccugccaaggagcaacag

SEQ ID NO: 458821 - RNA, 64 nt, Human
ugagccuacaucaggguggguccuaagaaacauggcaaaccaggcugucucauuccacuagacu

SEQ ID NO: 458822 - RNA, 64 nt, Human
ucagggggcugagaagauccugaguacacuaggugcaaaccagaacucuugguggaacagacca

SEQ ID NO: 458823 - RNA, 64 nt, Human
guauugacuuucacaaaauuuaaaucauaaacaggcaaaccaaacagcacacuguagcuauagu

SEQ ID NO: 458824 - RNA, 64 nt, Human
gucauaucauugagaucaccguaccagcaaaucugcaaaccaagcacuuuguuaaucuccagag

SEQ ID NO: 458825 - RNA, 64 nt, Human
uuagggaggauuccccgcccggaguccuagcacagcaaaccaggagguggaacugaaucagccu

SEQ ID NO: 458826 - RNA, 64 nt, Human
acauucccaaguuggucuagugugcugcccaguagcaaaccauggcagacucaccaccuauucu

SEQ ID NO: 458827 - RNA, 64 nt, Human
uacaaagagccuuccuauuccccucgcuguuggagcaaaccauuauaccuuacuuccagcaagc

SEQ ID NO: 458828 - RNA, 64 nt, Human
uuaaugcagucaucccuuuucaggugggaagagagcaaaccaguugauuuuuuaauucauccuu

SEQ ID NO: 458829 - RNA, 64 nt, Human
aaacccacuaaaaagaugcgaaaaccugaugagggcaaaccaguuaaaccuaacacccugccuu

SEQ ID NO: 458830 - RNA, 64 nt, Human
ucugagguauaaauauagucugugggagugagaggcaaaccaguccuacccaauuugauuugaa

SEQ ID NO: 458831 - RNA, 64 nt, Human
uuuguacacacuuuuaaauauugucuuagccucggcaaaccaauuuggggaagaagcaagauac

SEQ ID NO: 458832 - RNA, 64 nt, Human
agaaugagaccaaacgcagccagccagaucgggagcaaaccaaagaccaucugaggaaugagaa

SEQ ID NO: 458833 - RNA, 64 nt, Human
agauuuagaaguuauauaaaaaauuaauuuaaaagcaaaccaaaagagguuuccauuaacauua

SEQ ID NO: 458834 - RNA, 64 nt, Human
uuuuuguuuuaaguuaaccucagucaugaagaaugcaaaccaggugaugguuucaaugccuaag

SEQ ID NO: 458835 - RNA, 64 nt, Human
cuacuguaguuuuccaguuuucauugcugcuuuagcaaaccacgcugucuuacagugguacuuu

SEQ ID NO: 458836 - RNA, 64 nt, Human; identical to SEQ ID NO: 189751

SEQ ID NO: 458837 - RNA, 64 nt, Human; identical to SEQ ID NO: 189752

SEQ ID NO: 458838 - RNA, 64 nt, Human; identical to SEQ ID NO: 189277

SEQ ID NO: 458839 - RNA, 64 nt, Human
cuaugaccuguguucacucugguuacagggaggugcaaaccauucugucucccagccuuucuuc

SEQ ID NO: 458840 - RNA, 64 nt, Human
aucaaaagcugaaauucucagaauuacaggaaaugcaaaccaucauuuaauuucuaauuucaag

SEQ ID NO: 458841 - RNA, 64 nt, Human
auguguucuucaauggauaucaaaggaagagguugcaaaccaaagccauuuggcaagcccugua

SEQ ID NO: 458842 - RNA, 64 nt, Human
uggaaggcagcucccgcauaccaggauaacccccgcaaaccacauagcagacccccgccauccu

SEQ ID NO: 458843 - RNA, 64 nt, Human
gaggacugggggcaccugaccagaaugcgcaagggcaaaccauuucaaauggcagcaguuccau

SEQ ID NO: 458844 - RNA, 64 nt, Human
gaugauuugcuaucaaaauaaauugaaauauaaugcaaaccauaaauaugacugagaauuaugu

SEQ ID NO: 458845 - RNA, 64 nt, Human
gccccacacagccgucucccagggaaucccuucugcaaaccaaacguuacuuagacugcaagcu

SEQ ID NO: 458846 - RNA, 64 nt, Human
aucagguggcuuuugcgguucaggaaaauugaaugcaaaccauagcacaggcuaauuuuuuguu

SEQ ID NO: 458847 - RNA, 64 nt, Human
aucuuguaaugaacuuaaaucuggacuguuccaggcaaaccagacuuaucuugcaauaugagaa

SEQ ID NO: 458848 - RNA, 64 nt, Human
cuaacugccagauguggccaaccuuuguccauaugcaaaccacugaaaaaugaucuggauuucu

SEQ ID NO: 458849 - RNA, 64 nt, Human
cucacuugggggaaaaaaaaaaaagaaaagccaagcaaaccaauggugauccucuauuuuguga

SEQ ID NO: 458850 - RNA, 64 nt, Human
cucuguguaaagacuugagaagucuaauucacaggcaaaccaauacagaauugacugcaguuga

SEQ ID NO: 458851 - RNA, 64 nt, Human
aauguguauuugugaauaacaaacugcacaaccugcaaaccaggagagagggacagguucuguc

SEQ ID NO: 458852 - RNA, 64 nt, Human
uugguaccaaagauuacacuuguguuucuacacagcaaaccauuuuucuuucaugaaaauaaua

SEQ ID NO: 458853 - RNA, 64 nt, Human
ccaggcucgcacacacagggucugcugccacgucgcaaaccacucaguaaaggaaauuaaaaau

SEQ ID NO: 458854 - RNA, 64 nt, Human
auggccaaacccaagauuauuaaaagaugucucugcaaaccaacaggcuaccaacuuguaucca

SEQ ID NO: 458855 - RNA, 64 nt, Human; identical to SEQ ID NO: 189514

SEQ ID NO: 458856 - RNA, 64 nt, Human; identical to SEQ ID NO: 187019

SEQ ID NO: 458857 - RNA, 64 nt, Human; identical to SEQ ID NO: 189695

SEQ ID NO: 458858 - RNA, 64 nt, Human
aucuuccaccacuuauuggguuucuccagugucagcaaaccaaagaauuggaucuuaccaaugc

SEQ ID NO: 458859 - RNA, 64 nt, Human
cucacaggguacgcucauggagagagggcgcagagcaaaccaugucacgccauccaaugacacc

SEQ ID NO: 458860 - RNA, 64 nt, Human
caccaaagaaguuucugauagugucugcacaacagcaaaccaacauuuggugaggaauuagcaa

SEQ ID NO: 458861 - RNA, 64 nt, Human
agucuuuagaaaagaaacgccagguucaagaauugcaaaccagccugugcuuggaaagaugguu

SEQ ID NO: 458862 - RNA, 64 nt, Human
ugacuccuuguaaaauguauuuguccuucucaaagcaaaccagaggcccuccacugucacccua

SEQ ID NO: 458863 - RNA, 64 nt, Human
uucauuguuucaguucugauuucagcaaacaugagcaaaccacuuugacugaaagcagaaagag

SEQ ID NO: 458864 - RNA, 64 nt, Human
agaaaucagcuggccaagugacuccauuugacuugcaaaccagccuuuucuaauaggcuaauau

SEQ ID NO: 458865 - RNA, 64 nt, Human
gccccugggcaggagacguggcugcugaacagccgcaaaccaucuucaccugggggcauugagu

SEQ ID NO: 458866 - RNA, 64 nt, Human
guuaauaauauagauauaauguuaaaaacaauuugcaaaccagcagaauuuuaagcuuuuaaaa

SEQ ID NO: 458867 - RNA, 64 nt, Human
gcugaauuuaccagggauccucauaccucacaaugcaaaccacuuacuaccaggccuuuuucug

SEQ ID NO: 458868 - RNA, 64 nt, Human
ugagcugcuguuaaggaauuucuugcuuauagaggcaaaccacaguaucauuuuaacucuagaa

SEQ ID NO: 458869 - RNA, 64 nt, Human
accccccaugucuacaaaaaugaaaaaccaaaaagcaaaccaaaagaaaaaucugaaauuucca

SEQ ID NO: 458870 - RNA, 64 nt, Human
uuucuccccacucccugcccugcuuuaauaaacagcaaaccaauaucuaggaagaaugacugag

SEQ ID NO: 458871 - RNA, 64 nt, Human
uacuuuauuuuucccuuuucagaaaguccuuagugcaaaccaccauuggaaucuagccagaaau

SEQ ID NO: 458872 - RNA, 64 nt, Human
uguuucaggcugggcaucgccaggcggccucccugcaaaccaagggcugggggcaaaggggcau

SEQ ID NO: 458873 - RNA, 64 nt, Human
cauaaaacuuguuaccuuuaagaagguggaaguggcaaaccauacuucuuuuuuuuccucugau

SEQ ID NO: 458874 - RNA, 64 nt, Human; identical to SEQ ID NO: 189697

SEQ ID NO: 458875 - RNA, 64 nt, Human; identical to SEQ ID NO: 189462

SEQ ID NO: 458876 - RNA, 64 nt, Human; identical to SEQ ID NO: 187020

SEQ ID NO: 458877 - RNA, 64 nt, Human
aauuagaaugacuugagaacgggcaaauaacaaagcaaaccaauauaauuauauggucauucug

SEQ ID NO: 458878 - RNA, 64 nt, Human
ccuagcaagaaucacauucguuucccagugaaaagcaaaccagaacaaaacaaaaagccaccgc

SEQ ID NO: 458879 - RNA, 64 nt, Human
ugaaggggcuggauugggcguggugaggauguuggcaaaccagugcaugcaccugguuggaaga

SEQ ID NO: 458880 - RNA, 64 nt, Human
cagccuuguguauaugaaaaacaauaaauacuaugcaaaccaauagaaacauuuagcaguacgu

SEQ ID NO: 458881 - RNA, 64 nt, Human
auuagccaaaaagccuacaacauagaugcauuuagcaaaccauguacaaaucaaucacuauaau

SEQ ID NO: 458882 - RNA, 64 nt, Human
uagaugaccucauuaaccgaugcuuuaccaaacagcaaaccaagagauugcuaauugcuguuga

SEQ ID NO: 458883 - RNA, 64 nt, Human
ucaaaggaaaauagacagaaugauuuccaaaauugcaaaccacgccaugacccauauacgccaa

SEQ ID NO: 458884 - RNA, 64 nt, Human
uacauuugcaacucugcccaacaaaaacaagcaagcaaaccacaaugguaaagugguuaauuca

SEQ ID NO: 458885 - RNA, 64 nt, Human
acaaugcuaaaauugagcagauugauaacugccagcaaaccauagauuuaagauaaaugaauga

SEQ ID NO: 458886 - RNA, 64 nt, Human
ucagcagaaggaucagacaauaaaaugaguuagugcaaaccauuuaguaaaaauaacuaucagc

SEQ ID NO: 458887 - RNA, 64 nt, Human
agccauucccugugauguucacucuccucccaaagcaaaccacagccaagccugucugagcugg

SEQ ID NO: 458888 - RNA, 64 nt, Human
uuacuucucucucccuggcucugcccuucuuacugcaaaccaugcugugccuuagggcccuucu

SEQ ID NO: 458889 - RNA, 64 nt, Human
ccagucaucaucucuugauaaaggagagguuaaagcaaaccagccucagcggaccacucuucuc

SEQ ID NO: 458890 - RNA, 64 nt, Human
ucuaugagcuucucccgauggccacugggucucugcaaaccaauagacuguccugcaaauaacc

SEQ ID NO: 458891 - RNA, 64 nt, Human
uaguauuaauaagguuuuaaugugagauauuccugcaaaccaucccauuucuacugauuguaag

SEQ ID NO: 458892 - RNA, 64 nt, Human
auuuuuaagcaguacuuuaccuguuuuuucuuuagcaaaccagguuaugugguguaaagguuug

SEQ ID NO: 458893 - RNA, 64 nt, Human; identical to SEQ ID NO: 189713

SEQ ID NO: 458894 - RNA, 64 nt, Human; identical to SEQ ID NO: 189714

SEQ ID NO: 458895 - RNA, 64 nt, Human; identical to SEQ ID NO: 189715

SEQ ID NO: 458896 - RNA, 64 nt, Human
aauuucaggaaacagaacucauuaaaacuccuuagcaaaccaggucuacauccuguuuuguuug

SEQ ID NO: 458897 - RNA, 64 nt, Human
gggugagaagagucagggccgcaccucugucccugcaaaccaacaggugcauggugaguguggc

SEQ ID NO: 458898 - RNA, 64 nt, Human
guaggcuggggcggggcccaggagaccacggggagcaaaccagcuuguucugggcucagggagg

SEQ ID NO: 458899 - RNA, 64 nt, Human
uuuauaggacagggagacagcacagccaucccuugcaaaccaccaagguguguggcugaccucc

SEQ ID NO: 458900 - RNA, 64 nt, Human
ccuggagaaaaggaacguugcucuuggacagcaagcaaaccauuucucuccgucuguucuguuu

SEQ ID NO: 458901 - RNA, 64 nt, Human
aguccacuaaauaaacacuacucaaguacagacugcaaaccaaaauguaucuguguuacgacau

SEQ ID NO: 458902 - RNA, 64 nt, Human
gccuuuuggcaaacagugucuauuuuacagagaggcaaaccaagccuccuuagugcccuggggc

SEQ ID NO: 458903 - RNA, 64 nt, Human
uuuuuaauuuucuaaauuaaauaaaagaaagaaugcaaaccaggagugaauuucaaaugagaug

SEQ ID NO: 458904 - RNA, 64 nt, Human
cccauaaucacugaccagccuugacacuccccuugcaaaccaucccagcacugcaccccaggca

SEQ ID NO: 458905 - RNA, 64 nt, Human
cuguauuggcuaauguguuuccuggucuuuagaugcaaaccauuaauaacacuaucuuaucuca

SEQ ID NO: 458906 - RNA, 64 nt, Human
agcacuacugcacuuaguagcuaugugauuuugagcaaaccacauaaucucucuagguccauuu

SEQ ID NO: 458907 - RNA, 64 nt, Human
augcuaggugaaaucuaggaggaaggcauacuuggcaaaccacauguauaauaugcuacuugga

SEQ ID NO: 458908 - RNA, 64 nt, Human
gcaggguauggugagaaaccaacuacggauugcugcaaaccacaccuucucuuucuuaugucuu

SEQ ID NO: 458909 - RNA, 64 nt, Human
cugacgcugagccugucaugagaaugcaacaggagcaaaccaaguguugcugugacauugauuc

SEQ ID NO: 458910 - RNA, 64 nt, Human
aggcccagacccagguccuugugcucaguccugcgcaaaccaggcccagacccugcaagcauuu

SEQ ID NO: 458911 - RNA, 64 nt, Human
gcauaaaaacauuuuaaaaacauagaaaaauucagcaaaccauuuuuaaaguagaagaggguuu

SEQ ID NO: 458912 - RNA, 64 nt, Human; identical to SEQ ID NO: 188749

SEQ ID NO: 458913 - RNA, 64 nt, Human; identical to SEQ ID NO: 188750

SEQ ID NO: 458914 - RNA, 64 nt, Human; identical to SEQ ID NO: 188751

SEQ ID NO: 458915 - RNA, 64 nt, Human
auacgguagauauuaucugaugaauuggaaaggagcaaaccagaaauggcuuuauuuucucccu

SEQ ID NO: 458916 - RNA, 64 nt, Human
aagguaccagcuuuucuguuucuuugaaccuacugcaaaccaagaauaacucaugaggugguac

SEQ ID NO: 458917 - RNA, 64 nt, Human
caagaaguucauucugugcaauauggacauguuugcaaaccauaccaagggucagguuguugua

SEQ ID NO: 458918 - RNA, 64 nt, Human
ucuuagacaaucuuuggcaucuuaaaauaaaauagcaaaccaacauuuuuuuuuccagaaaaug

SEQ ID NO: 458919 - RNA, 64 nt, Human
cccagguguacuguuuguggccuuuguuaauaucgcaaaccauugguugggagucagauugguu

SEQ ID NO: 458920 - RNA, 64 nt, Human
aguggcagaacugggccgccucucugguugacaagcaaaccacaugcuaaggcuuggagcaaga

SEQ ID NO: 458921 - RNA, 64 nt, Human
gacaagucucaccaacccagggagucaaggaccagcaaaccaaaguggauaauggacuuuuuca

SEQ ID NO: 458922 - RNA, 64 nt, Human
uccauaucacagacuuuaaucuacacugcggagagcaaaccagcuugggcuucuuuuuguuuuu

SEQ ID NO: 458923 - RNA, 64 nt, Human
acagcauucuagcaauccuucgacuuuugugauagcaaaccauaaaaacaauuuuaguggcugu

SEQ ID NO: 458924 - RNA, 64 nt, Human
ucauugaauaguauuauugaagauacuaaaugaugcaaaccaaauggauuuuuuccaugucaug

SEQ ID NO: 458925 - RNA, 64 nt, Human
augcccaaugccuuguuuccuauuaccuuagauugcaaaccagucuagggaagucuaugagaaa

SEQ ID NO: 458926 - RNA, 64 nt, Human
aaaaacaaaaacacacacacaugaacucagauuugcaaaccagguuucugaaacuuuggguaag

SEQ ID NO: 458927 - RNA, 64 nt, Human
guuaagccccaguguggaugcuguugccaagacugcaaaccacuggcucguuuccgugcccaaa

SEQ ID NO: 458928 - RNA, 64 nt, Human
aagucagagcgaugcuugcagcuuccaaaaaccugcaaaccagcgcuuccugagacggggccag

SEQ ID NO: 458929 - RNA, 64 nt, Human
cgugccuucauuuguguuacauacauagcugcaagcaaaccauuuuuccccuuucuuuuauuca

SEQ ID NO: 458930 - RNA, 64 nt, Human
gcuuuagcuucucugccaagcccucaauaagccagcaaaccaggacucugccccuucuguuucc

SEQ ID NO: 458931 - RNA, 64 nt, Human; identical to SEQ ID NO: 187021

SEQ ID NO: 458932 - RNA, 64 nt, Human; identical to SEQ ID NO: 189731

SEQ ID NO: 458933 - RNA, 64 nt, Human; identical to SEQ ID NO: 189732

SEQ ID NO: 458934 - RNA, 64 nt, Human
ggaggggccagcaaguagaguguugguggcccaagcaaaccaguguugccaauaccauugccaa

SEQ ID NO: 458935 - RNA, 64 nt, Human
acgcccugagagucccggauguccgaggcgggaugcaaaccaucccguccugagcacggguccu

SEQ ID NO: 458936 - RNA, 64 nt, Human
cacguccccgacucguggccacauggagaaacaggcaaaccagaaucacugugaaucaagucgg

SEQ ID NO: 458937 - RNA, 64 nt, Human
aacgcucaagccuuacgaccagagaaggauuucagcaaaccaccaccucccacucagugucccc

SEQ ID NO: 458938 - RNA, 64 nt, Human
gcucggucggcgaccucugaagagagugcaccgagcaaaccaagugccggagcaccagcgccgc

SEQ ID NO: 458939 - RNA, 64 nt, Human
uuuauuugaaccucuuagccacauuuccagcagggcaaaccaacugaugcccuggaagagucuu

SEQ ID NO: 458940 - RNA, 64 nt, Human
gaaauaagugucaucuuuuaagagucaguguauagcaaaccaaaagaucacauuuauacccaaa

SEQ ID NO: 458941 - RNA, 64 nt, Human
ucuuucuguaggguagaaagaagccuccuacccagcaaaccaguagacccaaaaguugaaaaaa

SEQ ID NO: 458942 - RNA, 64 nt, Human
cauaggcugaaagcacgaauuacucaaaaaguaagcaaaccaauaccuggugaaucuauggaca

SEQ ID NO: 458943 - RNA, 64 nt, Human
ccaagggugauccugaaacaguguaaaaggaggggcaaaccagaaauccuggaauuagaggguu

SEQ ID NO: 458944 - RNA, 64 nt, Human
agggcuuuuuacuugaauaaaacaaugcaacuuagcaaaccaauuuauggccuuagagaaacau

SEQ ID NO: 458945 - RNA, 64 nt, Human
uucuguaucuucagccagcaaacgaaaccauaucgcaaaccagagcugcuggaaaccagcacac

SEQ ID NO: 458946 - RNA, 64 nt, Human
cacuguauaaaauuggaaagucucuaagacacaggcaaaccaggggacuuaaugauuugguucg

SEQ ID NO: 458947 - RNA, 64 nt, Human
aaaguucaaaacagccacaauaaucagagauggagcaaaccagugccauccagucuuuaugcaa

SEQ ID NO: 458948 - RNA, 64 nt, Human
uguccuuguucuuuuuggaaacucucggcaaagggcaaaccagcaaguauugaggguacccauc

SEQ ID NO: 458949 - RNA, 64 nt, Human
uuccaucaugucaaggucacaggcauccaugugugcaaaccaucugccccagcugccuccacag

SEQ ID NO: 458950 - RNA, 64 nt, Human; identical to SEQ ID NO: 189677

SEQ ID NO: 458951 - RNA, 64 nt, Human; identical to SEQ ID NO: 187172

SEQ ID NO: 458952 - RNA, 64 nt, Human; identical to SEQ ID NO: 189426

SEQ ID NO: 458953 - RNA, 64 nt, Human
uugaauaacuucaacuaucaggauaauuaaaacugcaaaccacuggacaaacaggacauuguuu

SEQ ID NO: 458954 - RNA, 64 nt, Human
auggggaagaauugagugggugauuuaaucaacugcaaaccaucugccccugucccaaaaugau

SEQ ID NO: 458955 - RNA, 63 nt, Human
uagagguuuuaaagugauuaaacgugcagacuaugcaaaccaggcccagucuccaguguggua

SEQ ID NO: 458956 - RNA, 64 nt, Human
acauguaggccaggcaggucacugcacaacuaaagcaaaccagcuggguacaguuucuuggcac

SEQ ID NO: 458957 - RNA, 57 nt, Human
cuccaagucaccuccaguaacaagauggcaaaccaaguaugcucagauaagcuuuuu

SEQ ID NO: 458958 - RNA, 64 nt, Human
uucaauaaggccuuauuuaacaagcaagcaaaaugcaaaccaaaccauuauucauuuauuggcu

SEQ ID NO: 458959 - RNA, 64 nt, Human
auacaauccucagguguaagcuuccugcaaagcugcaaaccacuguaccugccucagucaggcc

SEQ ID NO: 458960 - RNA, 64 nt, Human
ccucugaggccaggccugaaccuucuuggcuggggcaaaccacucuucaagugguggcagaguc

SEQ ID NO: 458961 - RNA, 64 nt, Human
uggagaggccaggagagaguauaaggggauagcagcaaaccaccuaucuggccccaacacaccu

SEQ ID NO: 458962 - RNA, 64 nt, Human
uggccagggcugggcgcaaggcacgcagugaugggcaaaccaauugcugcccaucuggccugug

SEQ ID NO: 458963 - RNA, 64 nt, Human
auuucucccuucugaguuauucucucuguugguggcaaaccacuucauagcaccaacagagaug

SEQ ID NO: 458964 - RNA, 64 nt, Human
aaugagggauuuauagcaucuugaauagagagcugcaaaccaccagggggcagaguugcauuuu

SEQ ID NO: 458965 - RNA, 64 nt, Human
gguucuguacagaguaaugagaugugugacggcugcaaaccagguguuuuuuucugaggcugug

SEQ ID NO: 458966 - RNA, 64 nt, Human; identical to SEQ ID NO: 458965

SEQ ID NO: 458967 - RNA, 64 nt, Human
gacaguuccaggcacuggagauaaaacaaacaaagcaaaccaaagccccggcccucaugcagcu

SEQ ID NO: 458968 - RNA, 64 nt, Human
cccucgacucgucccguggccgccuguuuuuccagcaaaccacgcuaacuagcugaccacagac

SEQ ID NO: 458969 - RNA, 64 nt, Human; identical to SEQ ID NO: 189428

SEQ ID NO: 458970 - RNA, 64 nt, Human; identical to SEQ ID NO: 189389

SEQ ID NO: 458971 - RNA, 64 nt, Human; identical to SEQ ID NO: 187173

SEQ ID NO: 458972 - RNA, 64 nt, Human
agagucccagagcucauccccccugcugcccagugcaaaccacuucuccaugcugcaaaggaga

SEQ ID NO: 458973 - RNA, 64 nt, Human
cugaggaaaggaagagggcacggaguugccaggagcaaaccaaagugaagagagagauaggaag

SEQ ID NO: 458974 - RNA, 64 nt, Human
gguaucuuuugccacauccagggcgaggguugaggcaaaccagcccucccucugacuuccuugu

SEQ ID NO: 458975 - RNA, 64 nt, Human
aaaauuaagcuguucauaucuuuaaauuaggauugcaaaccaaggaaagaacgcauuugagauu

SEQ ID NO: 458976 - RNA, 64 nt, Human
cuuuaauuguugcuuuuacggugauauugugcaugcaaaccaggagcauuuugugucuuaagaa

SEQ ID NO: 458977 - RNA, 64 nt, Human
uggacaguuuguuuccugucugauagcaccacacgcaaaccaaccuuucugacaucagcacuuu

SEQ ID NO: 458978 - RNA, 64 nt, Human
aaaggcaaauagagcuggaagcauuuuucccuuagcaaaccauaacagaaaaaaauaagaccca

SEQ ID NO: 458979 - RNA, 64 nt, Human
agccccaacucaucacugggaaagaacucccccugcaaaccagcuaaauuugauaauuuaaacc

SEQ ID NO: 458980 - RNA, 64 nt, Human
gccagaggaaaaaaaacuauugauaaguuuauaggcaaaccaccauaaggggugagucagacag

SEQ ID NO: 458981 - RNA, 64 nt, Human
cacuucucucuccuuuacgagacgaaaaggaaaagcaaaccagaaucuuauuuauauuguuaua

SEQ ID NO: 458982 - RNA, 61 nt, Human
gccagucucuaugcugcuagcccaucugcuggcaaaccaccugcuacaggaccaccugcug

SEQ ID NO: 458983 - RNA, 64 nt, Human
ucugcguucuaucuucucucuccuccuuguuccugcaaaccacaagauaaagguaguggugugu

SEQ ID NO: 458984 - RNA, 64 nt, Human
uccaccucccuaccaaaaauugccaagugccuaugcaaaccagcuuuaggucccaauucggggc

SEQ ID NO: 458985 - RNA, 61 nt, Human
guaugaacugcauguuuuaaagaagacaaaugcaaaccaaagcaacuuaguaaaauaauag

SEQ ID NO: 458986 - RNA, 64 nt, Human
uguuuuguuuucugacauauucugacaaagagcagcaaaccacugcuguguggcauucuuggag

SEQ ID NO: 458987 - RNA, 64 nt, Human
aauccaagacuauuuuuuauugcugaagauucuugcaaaccaugaagagauguucucacagaac

SEQ ID NO: 458988 - RNA, 64 nt, Human; identical to SEQ ID NO: 189444

SEQ ID NO: 458989 - RNA, 64 nt, Human; identical to SEQ ID NO: 189445

SEQ ID NO: 458990 - RNA, 64 nt, Human; identical to SEQ ID NO: 189446

SEQ ID NO: 458991 - RNA, 64 nt, Human
aacaaaaaagggacauuuaugugcaguugggacagcaaaccaaguccuggacguaaaaucgaau

SEQ ID NO: 458992 - RNA, 64 nt, Human
agcacagugcuugcuggaggcuuuggcauaggcugcaaaccaauuugggcucagagggaauauc

SEQ ID NO: 458993 - RNA, 64 nt, Human
ugaaguaaggaacguggaaggucaugaaugggccgcaaaccacggccagcugcuugucuuugua

SEQ ID NO: 458994 - RNA, 64 nt, Human
gcggugggcacccacccugggaccuaggggcgccgcaaaccacacuggacuccggcccuccuac

SEQ ID NO: 458995 - RNA, 64 nt, Human
aaaaaagaaaaaaaaaaaaacccaaaccaaaaacgcaaaccaaagcaggcaggcagacagcugc

SEQ ID NO: 458996 - RNA, 64 nt, Human
ucagagacuucaccuaacuagagacaggcaaacugcaaaccauggugagaaauugacgacuuca

SEQ ID NO: 458997 - RNA, 64 nt, Human
uuuugagauaacuguucccaaugcagugaguauagcaaaccaucaagcauuaauugacauugga

SEQ ID NO: 458998 - RNA, 64 nt, Human
uggaugugauuaauagggaguaggcgagauuauagcaaaccagcagaaauggaacucugcuaaa

SEQ ID NO: 458999 - RNA, 64 nt, Human
auugccuccacccacucacccccuacagccugaagcaaaccagcagcccagccuugccucucug

SEQ ID NO: 459000 - RNA, 64 nt, Human
uuuugagauaaccguucccaaugaaaugaguauagcaaaccaucaagcauuaauugacauugga

SEQ ID NO: 459001 - RNA, 64 nt, Human
uuuugagauaacuguucccaaugcagugaguauagcaaaccaucaagcauuaauugacacuaga

SEQ ID NO: 459002 - RNA, 64 nt, Human
uuuggagacaguuguuucaaaugcagugaguauagcaaaccaucaagcauuaauugacauuaga

SEQ ID NO: 459003 - RNA, 64 nt, Human
aggccuaaauaauuaaaaacgguccuaaaaacuagcaaaccagauaagaaaagauguuaaugcc

SEQ ID NO: 459004 - RNA, 64 nt, Human
aagagagaaaaaaaaucaaggauaucugauuggagcaaaccacuucuuuagucaucugucuuac

SEQ ID NO: 459005 - RNA, 64 nt, Human
augaaguugaaaacccuuguaaauaggagagguugcaaaccaaaucaagaguauuuauuacuau

SEQ ID NO: 459006 - RNA, 64 nt, Human
ucuugaaugcuuaaaugaucaaggagggagaaaggcaaaccaauuuguucugugcaacaaacuc

SEQ ID NO: 459007 - RNA, 64 nt, Human; identical to SEQ ID NO: 188561

SEQ ID NO: 459008 - RNA, 64 nt, Human; identical to SEQ ID NO: 189480

SEQ ID NO: 459009 - RNA, 64 nt, Human; identical to SEQ ID NO: 189481

SEQ ID NO: 459010 - RNA, 64 nt, Human
uuaaagaucacauuuuccaugaacgccucuaguagcaaaccauucuuuugcacaccacaauguu

SEQ ID NO: 459011 - RNA, 64 nt, Human
auauauucuuuccccucuuuuaaaacaaaugguagcaaaccaaccacacacuguucuguaucuu

SEQ ID NO: 459012 - RNA, 64 nt, Human
uuagaucuguauaaaaguguguuguguugaagcagcaaaccaaugagugcugcauuuuggauau

SEQ ID NO: 459013 - RNA, 64 nt, Human
cggcugcagugugucuccccuggccucgccuucugcaaaccaccgcagccaccacagcgucagg

SEQ ID NO: 459014 - RNA, 64 nt, Human
accaguucuucaucuggagacaguucaacguucugcaaaccagaucuucaggaauuuuacuggg

SEQ ID NO: 459015 - RNA, 64 nt, Human
gcagugugcauaucuugaggggugaugaacacaagcaaaccaaguugcaccuggcuucugcaca

SEQ ID NO: 459016 - RNA, 64 nt, Human
uuuuagcaucagaacuagcuuucugggauuggaggcaaaccaucaagguggucccucuccaguc

SEQ ID NO: 459017 - RNA, 64 nt, Human
cauucaacucccuauuuccaugcaaagacgcugggcaaaccacauguucugucugagccucagu

SEQ ID NO: 459018 - RNA, 64 nt, Human
cuuauuucacuuucacacugccuucaggccagaagcaaaccaaauuuaccagguuuggcuggag

SEQ ID NO: 459019 - RNA, 64 nt, Human
uuaacaguaauacaggaagcauggcaggcaccaugcaaaccaaggauggauggugcagucccug

SEQ ID NO: 459020 - RNA, 64 nt, Human
uagagucugaacaggugcucugcugcuagaaacagcaaaccaucuagauuaaacuccuaaagcc

SEQ ID NO: 459021 - RNA, 64 nt, Human
caguucagaaaacacuagacccaggauugaaaaagcaaaccacagcagaaccauccuuuuguca

SEQ ID NO: 459022 - RNA, 64 nt, Human
acugcuucuaacaccucuuuucccuugugugagggcaaaccaggcugcaggugggguuuucacu

SEQ ID NO: 459023 - RNA, 64 nt, Human
uucuuuuaggauauuuagaccacccuuguuccacgcaaaccagagugugucaguguuugugugu

SEQ ID NO: 459024 - RNA, 64 nt, Human
agauuggcauauuuuuaacauuuuacuuaagauagcaaaccaguucguuuuaaguaagcuaacu

SEQ ID NO: 459025 - RNA, 64 nt, Human
cuuuuuaaaacaaacaaacaaacaaaacaaaaaagcaaaccacauuuguuaucucaaauuuuga

SEQ ID NO: 459026 - RNA, 64 nt, Human; identical to SEQ ID NO: 189482

SEQ ID NO: 459027 - RNA, 64 nt, Human; identical to SEQ ID NO: 189532

SEQ ID NO: 459028 - RNA, 64 nt, Human; identical to SEQ ID NO: 188562

SEQ ID NO: 459029 - RNA, 64 nt, Human
augggcuuuguuagcacuuucaaaaaaaaaaaaagcaaaccauacuuguccacuguccugugcu

SEQ ID NO: 459030 - RNA, 64 nt, Human
uaccucaaucuauucuguaaaauuaaacaaauaugcaaaccaggauuuccuugacuucuuugag

SEQ ID NO: 459031 - RNA, 64 nt, Human
gaggaaaagauaagcuacagauugagaugaauuugcaaaccauauaucugaucaauuuggaaua

SEQ ID NO: 459032 - RNA, 64 nt, Human
guuuuucuaccuggaacuccauagaaugauguuugcaaaccaacaugugcucuuuucagucauu

SEQ ID NO: 459033 - RNA, 64 nt, Human
acaauugcccuuuaccuagggcuaccauuuccuagcaaaccaaacauaguucgagaacagcugg

SEQ ID NO: 459034 - RNA, 64 nt, Human
uuuuuguuuaaaaaaaacuguucccauaggugcagcaaaccaccauggcacauguauaccuaug

SEQ ID NO: 459035 - RNA, 64 nt, Human
uuuuccaacugugaucucgccuuguuucuuacaagcaaaccagggucccuucuuggcacguaac

SEQ ID NO: 459036 - RNA, 64 nt, Human; identical to SEQ ID NO: 459030

SEQ ID NO: 459037 - RNA, 64 nt, Human
gaguuagcugacuuuacacggagcggauugcaaagcaaaccaacaagaauaaaggcagcuguug

SEQ ID NO: 459038 - RNA, 64 nt, Human
gacuauucugccaccugugccccaaguuggaugagcaaaccacuuuggaucaguucacagcauu

SEQ ID NO: 459039 - RNA, 64 nt, Human
uucauacuuuuacuuaauuuucuuuaucuguauggcaaaccacugcaauccugaaugacaugga

SEQ ID NO: 459040 - RNA, 64 nt, Human
uuauauugagagcgcucuucugauucaaauguaagcaaaccacugaugaccacugguccguaua

SEQ ID NO: 459041 - RNA, 64 nt, Human
gugaguaguacaaugaguguuauaacagggaacagcaaaccaaugcuauugugauuauuggauu

SEQ ID NO: 459042 - RNA, 64 nt, Human; identical to SEQ ID NO: 189733

SEQ ID NO: 459043 - RNA, 64 nt, Human; identical to SEQ ID NO: 189734

SEQ ID NO: 459044 - RNA, 64 nt, Human; identical to SEQ ID NO: 189735

SEQ ID NO: 459045 - RNA, 64 nt, Human; identical to SEQ ID NO: 189736

SEQ ID NO: 459046 - RNA, 64 nt, Human; identical to SEQ ID NO: 189737

SEQ ID NO: 459047 - RNA, 64 nt, Human
ccccauggacaguggagagcgggauucgaaccaagggcuggacucccacaccucuggccugcgu

SEQ ID NO: 459048 - RNA, 64 nt, Human
ggagggaggccugacuucagcaacagcugugggugggcuggaggccggcgcagcuuggggcccc

SEQ ID NO: 459049 - RNA, 64 nt, Human
uuggcagcaugugcagauuccaggcaccgaggcagggcuggaggaguaaguggcuuugcaauaa

SEQ ID NO: 459050 - RNA, 64 nt, Human
cucacugccuggucacauggugccuagggaugcagggcuggaggccagaggugucagcaacacu

SEQ ID NO: 459051 - RNA, 64 nt, Human
gcuaacgcccugcaggaggaccccggccucucgagggcuggaucagcagccgccugcccugagg

SEQ ID NO: 459052 - RNA, 64 nt, Human
cacauccugcucugcugcaggagagggggcuaaggggcuggauccaccaaggcagcucacagcg

SEQ ID NO: 459053 - RNA, 64 nt, Human
acaccuucagguagaccccgaagccucaaggccggggcuggagcggagaccccagggccucuca

SEQ ID NO: 459054 - RNA, 64 nt, Human
cauuccagcgccccaaggaggauucaaacuguuggggcuggaagaacuugguggccuggguccc

SEQ ID NO: 459055 - RNA, 64 nt, Human
acagauugaggaggaagugggcucugaggcugcagggcuggaaguccuugcccacuucccacuc

SEQ ID NO: 459056 - RNA, 64 nt, Human
guuacccuccuucccugcaggccuggagccuguagggcuggacugagguucaggucucccccca

SEQ ID NO: 459057 - RNA, 64 nt, Human
uaaugcagagcccuacaauuaaggcgggaaugaggggcuggaggcagcaaacggaaucugcccu

SEQ ID NO: 459058 - RNA, 64 nt, Human
ucccgccuuguggcugagaacuggacaguggcaggggcuggagaugggugugugugugugugug

SEQ ID NO: 459059 - RNA, 64 nt, Human
agaaccuguuccccaagcccagagauguccaccugggcuggacugcccucaagcuuauacuaga

SEQ ID NO: 459060 - RNA, 64 nt, Human
ccagauacagggaagacucaggaugagggugcccgggcuggacggcuaagggcacgaagacgau

SEQ ID NO: 459061 - RNA, 64 nt, Human
uacagccucauuccuuaguucccggagcuggcaagggcuggagccccgccugggucagacgcca

SEQ ID NO: 459062 - RNA, 62 nt, Human
accccuuaccccacugcugcugacugggcagggcccuggaccccuuuauuugcacgucaggg

SEQ ID NO: 459063 - RNA, 62 nt, Human
cccuguccuccagccucccugcuucccuucuggcccuggaagacugagucuggacggcagag

SEQ ID NO: 459064 - RNA, 62 nt, Human
cacuguuggaagcaguuccuucuaaaaggguagcccuggacuuaauaccagccggauaccuc

SEQ ID NO: 459065 - RNA, 64 nt, Human
cuaugaggaugagggaagcggcugauaccauguggggcuggagacauagauggacuuaugaaug

SEQ ID NO: 459066 - RNA, 64 nt, Human
gagggggcugaguuuggugccagcuggcaaaugagggcuggacucucuucccuccagagaccac

SEQ ID NO: 459067 - RNA, 64 nt, Human
guaccuuuuccuuucauacugaugcugcaguucagggcuggaguuguuaaggcauugaccucca

SEQ ID NO: 459068 - RNA, 64 nt, Human
gccuccuugaacaugcuuauuccaacgcuuugaggggcuggaagccuugacacauggaaucagg

SEQ ID NO: 459069 - RNA, 64 nt, Human
uuuuuuuuucaggcgcagucucacucugucgcccgggcuggagugcugugagcuguccguggug

SEQ ID NO: 459070 - RNA, 64 nt, Human
aucaauuccuggauuccuuaguccugcuggccuugggcuggagccuaggaaaguggcccccaaa

SEQ ID NO: 459071 - RNA, 64 nt, Human
ugcugaacuacagccuugggacaggcaggcuuuggggcuggacgcuguccaggcauuccuggug

SEQ ID NO: 459072 - RNA, 64 nt, Human
uuuuuuuugagguggaguuucgcucuuguugcccgggcuggagugcaauggugagaucucaacu

SEQ ID NO: 459073 - RNA, 64 nt, Human
cuucaaaccgacgaucauugugcccacuuacccugggcuggagaguugguuucagguuccuaca

SEQ ID NO: 459074 - RNA, 64 nt, Human
ucauuuauggguuaguuggggaauaaauggauaugggcuggauauucgguaauaucauuaauga

SEQ ID NO: 459075 - RNA, 64 nt, Human
caagugaagccagaggagggucccccagcugggugggcuggaauggaacuccucacuagcugcu

SEQ ID NO: 459076 - RNA, 58 nt, Human
cguccauugaaaagcccuagugucuuuagggcuggaaggcagcaucccucugacaggg

SEQ ID NO: 459077 - RNA, 64 nt, Human
ccccaaucgaggauacagugugggugguggugcugggcuggacuagcagguagacugcuguagg

SEQ ID NO: 459078 - RNA, 64 nt, Human
gagcaggcucugaugcugagaggcuugccuccgggggcuggaagccuggguggccggggccccu

SEQ ID NO: 459079 - RNA, 64 nt, Human
aagccauggccaugcccuuuuucucaaaugggaggggcuggagggugugugggauuugucuuca

SEQ ID NO: 459080 - RNA, 62 nt, Human
aagcaugccaaugugaucaaucccuaguaaaagcccuggacaccuaggcaugggugagcuac

SEQ ID NO: 459081 - RNA, 62 nt, Human
gcuucucccucuuuaaggugcuaugccaaccagcccuggaggcugggaucugccgcucccuc

SEQ ID NO: 459082 - RNA, 62 nt, Human
cauguuccagccugaccuagaagcguuugucagcccuggagcccagagcgguggccuugcuc

SEQ ID NO: 459083 - RNA, 64 nt, Human
uuuguguuuucugcccuuuuccucuccagccgaugggcuggagcugggagaggugcugagcuaa

SEQ ID NO: 459084 - RNA, 64 nt, Human
uuuaaaauaguuuaugucaucucuucauuauuuagggcuggauggucaacucagucagugauuu

SEQ ID NO: 459085 - RNA, 64 nt, Human
aaguacguggaggacgggaccggaagacgagagagggcuggacauccugcccaccgugucccag

SEQ ID NO: 459086 - RNA, 64 nt, Human
ucugacccugacaccccucccuuggacucugccugggcuggagucuagggcuggggcuacauuu

SEQ ID NO: 459087 - RNA, 64 nt, Human
gggcuuaggagagagggaccagcgcccagcguuagggcuggaagacggcaguguucagaauucc

SEQ ID NO: 459088 - RNA, 64 nt, Human
ccucggagccguuuacgcggcccuggagcgcauggggcuggacggcugcguggaagacuugcgc

SEQ ID NO: 459089 - RNA, 64 nt, Human
ggccuugcuuugggcuuugcaggcucugggcucagggcuggagugcgcucuuggucccuggucc

SEQ ID NO: 459090 - RNA, 64 nt, Human
ccgaggcgaugccacgcuuugcugcuaccgcccugggcuggacuggaggugggcaugccacccu

SEQ ID NO: 459091 - RNA, 64 nt, Human
ggagcgacagucucugcccccauucccuugagaggggcuggauguaaucaccuuugguuggacu

SEQ ID NO: 459092 - RNA, 64 nt, Human
gagacacuugccuucuucacccagcuaaucuguagggcuggaccuauguccuaaggacacacua

SEQ ID NO: 459093 - RNA, 64 nt, Human
acaggccgaaccuggagggccuggauuucuuuuugggcuggaaugcugcccugaggguggggcu

SEQ ID NO: 459094 - RNA, 64 nt, Human
cugagcuuuguauguguccuuuugggggauaacagggcuggaccaugcuucccugcccuuaaac

SEQ ID NO: 459095 - RNA, 64 nt, Human
uccacccucauguuucuguaggauucucaccguggggcuggaagaaaagagcaucgacuugauu

SEQ ID NO: 459096 - RNA, 64 nt, Human
cccucugcucuccaucuccccaccccuagaaacagggcuggaaaucucccccacagcaguguga

SEQ ID NO: 459097 - RNA, 64 nt, Human
ggaccaauggcugagccucguguccagacucagagggcuggauuuugguucccuuguaaagaca

SEQ ID NO: 459098 - RNA, 62 nt, Human
ucccagucccagccucuggggcagagcuuguagcccuggauggccucuggggcaggaccacu

SEQ ID NO: 459099 - RNA, 62 nt, Human
cuucuuccacuggagccccugacaccacaggugcccuggagcccuugugugacucagccucu

SEQ ID NO: 459100 - RNA, 62 nt, Human
ccaggggugggagcaucggagggagucccagagcccuggaccuugggccuagaccgcgugau

SEQ ID NO: 459101 - RNA, 64 nt, Human
aguugaggcaguuuuugugaagauaauaugguuagggcuggagugcacuagucuuuuugcuuau

SEQ ID NO: 459102 - RNA, 64 nt, Human
ccuaccacaaacugaguccccucaccugaacucugggcuggaggcagggagacacugcccugcu

SEQ ID NO: 459103 - RNA, 64 nt, Human
ugugugucugucuggcaugcaugcacucacuuuggggcuggaggugacaguaggugagggcaga

SEQ ID NO: 459104 - RNA, 64 nt, Human
acaggagugcugccaggcuggcaagagcaggucggggcuggauggcaccucaggggcuguacua

SEQ ID NO: 459105 - RNA, 64 nt, Human
acugagcuagccccuggggcugaguacuccugcagggcuggaggaacagguucuuagaagauga

SEQ ID NO: 459106 - RNA, 64 nt, Human
cccuaucugccuaacagugccucacaaggcuugggggcuggacucccucuacucccucuggcca

SEQ ID NO: 459107 - RNA, 64 nt, Human
aaggacgaauagcacccuaccuguggguguuugggggcuggacaauuuggguggcaguguuugg

SEQ ID NO: 459108 - RNA, 64 nt, Human
cuggaggcccaggaguguggcugcaagagaaaaggggcuggaggaagauccggagggcaggggu

SEQ ID NO: 459109 - RNA, 64 nt, Human
ugggugacucacuuuccccucuagguggugccaggggcuggaggccccuagaaaaagaucagua

SEQ ID NO: 459110 - RNA, 64 nt, Human
auuccuaggagucccugccccuagaguaggagcagggcuggaccccaagccccucccucuucca

SEQ ID NO: 459111 - RNA, 64 nt, Human
uuuguuuggagacagagucucgcuauugucaccagggcuggaaugauuucagcucacugcaacc

SEQ ID NO: 459112 - RNA, 64 nt, Human
ucuccuaccucugcucuuggaggagauggggacagggcuggagucaaaacacuuguaauuuugu

SEQ ID NO: 459113 - RNA, 64 nt, Human
uuuucuguacauauuucacuaaagacaaguuuuugggcuggaugugguagcuuacaccuauaau

SEQ ID NO: 459114 - RNA, 64 nt, Human
aucagugacucugcucccugaccacacaucggaagggcuggaugaccccaaucaaaagaaagaa

SEQ ID NO: 459115 - RNA, 64 nt, Human
aaggcugagaggguuugcaguggagcccugagcagggcuggauaugggaaguaggcaaaugaaa

SEQ ID NO: 459116 - RNA, 62 nt, Human
cagaggaugaggucaauuuccugaugcauauugcccuggagaagaucgccuucauccccuuu

SEQ ID NO: 459117 - RNA, 62 nt, Human
ucaaacugacagccagcgagacugggugggaggcccuggaucuguucucccugacugcggga

SEQ ID NO: 459118 - RNA, 62 nt, Human
gccucuaccgauugauuuuccucccuucucuagcccuggauguccacuuagggauaaaaaga

SEQ ID NO: 459119 - RNA, 64 nt, Human
ucccucccuaagucacagcgaggugucugucccagggcuggagaugcuucccaaggaggagucu

SEQ ID NO: 459120 - RNA, 64 nt, Human
aacucaggaggcagaaaucaaaagaaauccuugagggcuggaaccugaggauagagcgaaaaug

SEQ ID NO: 459121 - RNA, 64 nt, Human
gggaacgugccagggggaacaaaguaagcuugaugggcuggaacuuuugacuuuggguccccaa

SEQ ID NO: 459122 - RNA, 64 nt, Human
cuccccuugagguuccuccacucuaggguuugaggggcuggaaucagggccagggccuaacagu

SEQ ID NO: 459123 - RNA, 64 nt, Human
ggccccucccugccuaccuagaaucugccugaaagggcuggagaggggcaguauugggggacug

SEQ ID NO: 459124 - RNA, 64 nt, Human
cuagcaacauauuauaguaaaaaaugaggugggagggcuggaucuuuucccccaccaaaaggcu

SEQ ID NO: 459125 - RNA, 64 nt, Human
uggacuguggcugcauuucuuggguccuuagagugggcuggagagaccuagagggcccagcaug

SEQ ID NO: 459126 - RNA, 64 nt, Human
ccagggucccugcucaaguuuucuuugaaaaggagggcuggaaugguacaucacauaggcaagu

SEQ ID NO: 459127 - RNA, 64 nt, Human
uuuuucagacagagccauuccuaagaacacugaagggcuggaaugcuggcuggccacucucugc

SEQ ID NO: 459128 - RNA, 64 nt, Human
ccacaccccuuauccccaggcuggugccccgggagggcuggagaccaggccaugggcccucacg

SEQ ID NO: 459129 - RNA, 64 nt, Human
cauccauggaaucuacuauacaggaggaugcagugggcuggaggggaugggcgaaaaugggagc

SEQ ID NO: 459130 - RNA, 64 nt, Human
ucuucuuaguggaaaugcauuugagauggugacagggcuggaugaacgugugacccugggagau

SEQ ID NO: 459131 - RNA, 64 nt, Human
cagggcuggaugaacgugugacccugggagauccgggcuggacuguggaccccgaugggccaga

SEQ ID NO: 459132 - RNA, 64 nt, Human
gugcagccuugaugacaccugccgcugccccucggggcuggaauaaaacuccccacccagaguc

SEQ ID NO: 459133 - RNA, 64 nt, Human
ggccccagacccaucucuuggauugagggugugugggcuggaaccagugggucacuguggcagc

SEQ ID NO: 459134 - RNA, 62 nt, Human
ccugaaggguccaaggaggggcccuccccauggcccuggagagugggccugggugguaccug

SEQ ID NO: 459135 - RNA, 62 nt, Human
ugggaagggggacagagagggcccuccccucugcccuggacuuucccaugagccuccuggaa

SEQ ID NO: 459136 - RNA, 62 nt, Human
caggaggggacuucuggcccaccuugccuucagcccuggagugggcagagaguauugugggg

SEQ ID NO: 459137 - RNA, 64 nt, Human
cuccguuagcuccuguggccccacccugggcccugggcuggaaucaggaauauuuuccaaagag

SEQ ID NO: 459138 - RNA, 64 nt, Human
aaggacagcaccagcgggacagcccacaaggcuggggcuggagaaugagagacugcgcucucuu

SEQ ID NO: 459139 - RNA, 64 nt, Human
uuauuuucaacaaguuacuuuuaggauccuuuuggggcuggagacugagucuugaaccacagaa

SEQ ID NO: 459140 - RNA, 64 nt, Human
gcuucgagugucaggggagccgcguucccucccagggcuggagcagaggaccacaaggcagcag

SEQ ID NO: 459141 - RNA, 64 nt, Human
cucuuucuacaccucccucuugggcaugggcugagggcuggagcgagucccucagaaauuccac

SEQ ID NO: 459142 - RNA, 64 nt, Human
uuugagacugcagagugagagugacguuuucuuagggcuggagggccaguucccacucaaggcu

SEQ ID NO: 459143 - RNA, 64 nt, Human
cggcuagugucuaaaggaaacgccaugaggcagggggcuggacuucaggcggggacccauugcc

SEQ ID NO: 459144 - RNA, 64 nt, Human
augagagaacagggcugaagcuguguccucaugagggcuggaugcucucguugacccucacagg

SEQ ID NO: 459145 - RNA, 64 nt, Human
ucguaccccccaucaccugcacaugggacagaccgggcuggagggugaccuuggcugugugcgu

SEQ ID NO: 459146 - RNA, 64 nt, Human
cuugugggugaguuccaaagagcuuggauuagaagggcuggacaaagagagaauucaauggggc

SEQ ID NO: 459147 - RNA, 64 nt, Human
ggcuggggaccccucccgccucuggcucccugaugggcuggauguaacuugugucuucuagccc

SEQ ID NO: 459148 - RNA, 64 nt, Human
ccaaaguuugaugcuauguagucagugguuuguggggcuggaugccagaagguucuuugagcca

SEQ ID NO: 459149 - RNA, 64 nt, Human
ucacacccaguggacagugcugagcacggggucagggcuggagggcacaggcagagggcagcuc

SEQ ID NO: 459150 - RNA, 64 nt, Human
accagugcuucacuguguggaguggggcaggcaggggcuggaccccagggacuugccuucccca

SEQ ID NO: 459151 - RNA, 61 nt, Human
agugggagacagucaugugaccaggcgcugggggcuggaccugcugacauaguggauggac

SEQ ID NO: 459152 - RNA, 50 nt, Human; identical to SEQ ID NO: 372396

SEQ ID NO: 459153 - RNA, 62 nt, Human
gggaggccaccgaggccgccgaguaccaggaggcccuggagggcuggacggugagcagggcg

SEQ ID NO: 459154 - RNA, 62 nt, Human
caugcugaucccccugcccaggugagggcccugcccuggaagacuggagggaggccccaagc

SEQ ID NO: 459155 - RNA, 64 nt, Human
ccuggugcuggguuugcucucccgcuguugccaggggcuggaagcuggaggggucucuugggcc

SEQ ID NO: 459156 - RNA, 64 nt, Human
uaggaggcucaaaggacugugagccaggagaucugggcuggagcuagggggucaauggaugcuc

SEQ ID NO: 459157 - RNA, 64 nt, Human
guuugccacuugauggggccuggguuuguuccuggggcuggaaugcuggguaugcucugugaca

SEQ ID NO: 459158 - RNA, 64 nt, Human
uccuaacugugcagcaccugggagcucuggccuggggcuggaggcccugguaggagcugcaguu

SEQ ID NO: 459159 - RNA, 64 nt, Human
caggcaggcagcuguacccaagcuggugggcagggggcuggaaggcaccaggccucaggaggag

SEQ ID NO: 459160 - RNA, 64 nt, Human
aacugggaagucuuugucccuaggaaauccaaaggggcuggaauaugguguugguuuggcuuuc

SEQ ID NO: 459161 - RNA, 64 nt, Human
augaguggcaggcuagagauuucacccauuuugugggcuggaguuaccaguagcuccagcaguu

SEQ ID NO: 459162 - RNA, 64 nt, Human
cccauccugacuguggaguugggauguggaaguggggcuggaacaaagcuucugccuagggagg

SEQ ID NO: 459163 - RNA, 64 nt, Human
uucauuuaagccucagggcuggucccugcccaaagggcuggacccuccuaauccucuccuaggu

SEQ ID NO: 459164 - RNA, 64 nt, Human
gcugacagcacaguaacgugcauacauaucugcagggcuggaauggaagcuuuaaaggugguag

SEQ ID NO: 459165 - RNA, 64 nt, Human
ggcugcuccuaaccuaccucgccgagcugucggagggcuggacauuuguggcagugcugaaggg

SEQ ID NO: 459166 - RNA, 64 nt, Human
aagcauucccucuucuacaggggucuggucacaagggcuggauucucugacaaaaauuucuucu

SEQ ID NO: 459167 - RNA, 64 nt, Human
caguguuggauggaccacccaagggugaggagaggggcuggaagcccugggcauuaggagaagg

SEQ ID NO: 459168 - RNA, 60 nt, Human
agccuccucggcccacuugacuuaguucuugggcuggaccugcuuagcugccuugagcua

SEQ ID NO: 459169 - RNA, 64 nt, Human
cguugaauguuugugauucuguguggccuuuuuggggcuggaaaauguaugaauucuucaacug

SEQ ID NO: 459170 - RNA, 62 nt, Human
gcccacccgagccugagggcuggcggggagcagcccuggacguguccgcuguuguguugaga

SEQ ID NO: 459171 - RNA, 62 nt, Human
acuuagcucguccuacccccauguugaguucugcccuggaaaacccaaagcaaguagugauc

SEQ ID NO: 459172 - RNA, 62 nt, Human
ccacagcacccccugccggcgggcuccguggggcccuggagcugaugacgggggaggcccgu

SEQ ID NO: 459173 - RNA, 64 nt, Human
gagugcuuuaagagaaacuguaaauggugcucuggggcuggaggcuaguaaggaaacugcauca

SEQ ID NO: 459174 - RNA, 64 nt, Human
aauggcacuguggacugauguuuccuucuccgaggggcuggagcggggaucugaugaaaagguc

SEQ ID NO: 459175 - RNA, 64 nt, Human
cccgcgucccugggggcugggccccaggcgcacggggcuggaggcaggccuucgugccuucgug

SEQ ID NO: 459176 - RNA, 64 nt, Human
cagagguaucacagugacaaaagagccagggcuagggcuggaggggccaggugaucuuccuuag

SEQ ID NO: 459177 - RNA, 64 nt, Human
ucagccaguguugggacuggcucagagcccaugggggcuggaggggggcagcugggacucugga

SEQ ID NO: 459178 - RNA, 64 nt, Human
uauaugugagaggcgugauaucuggauggaaguugggcuggaugaucuccaaagucguuucaac

SEQ ID NO: 459179 - RNA, 64 nt, Human
uuuccaacaggaugaugcauuugcucaauucucagggcuggaaugagccggcuggucccccaga

SEQ ID NO: 459180 - RNA, 64 nt, Human
ccagaugucuuugugcauaggcacaagugggccagggcuggagggaggugggaaaccucaucau

SEQ ID NO: 459181 - RNA, 64 nt, Human
aguggcugaagagccagccucgguggcccagcuggggcuggaaccaggucuccugcccuuguuc

SEQ ID NO: 459182 - RNA, 64 nt, Human
cauucucuggcggggaccagggcccaaggccccagggcuggaaggagaccaaggggcagccgcc

SEQ ID NO: 459183 - RNA, 64 nt, Human
guggaaaccaagcugggagaggcugaggauggcagggcuggaagggccaucagcgugacccuca

SEQ ID NO: 459184 - RNA, 64 nt, Human
guugaauauuggcaaugauuccugguuccagaaagggcuggagcagaagggccaagagggccug

SEQ ID NO: 459185 - RNA, 64 nt, Human
uauuucuuuaagauggagucuugcucuguugcccgggcuggaguacaauggcaugaucucagcu

SEQ ID NO: 459186 - RNA, 64 nt, Human
auaaacaccaacuucucgaagcgugccaggcucugggcuggaugcuggggauaagcgggaaccc

SEQ ID NO: 459187 - RNA, 64 nt, Human
uaauuuucugauuuccuauuuuauaaugauacaugggcuggaaaaauguagaacguuuuuauau

SEQ ID NO: 459188 - RNA, 62 nt, Human
ggaggccgguggagaagccccaccuggcuuaugcccuggagaggguuuagcgggcugggugg

SEQ ID NO: 459189 - RNA, 62 nt, Human
acccccacagggucacgcaggacucggacacugcccuggaaacauggauggacaagggcuuu

SEQ ID NO: 459190 - RNA, 62 nt, Human
uuuuacauuuuucuuuugauggguuuagucuugcccuggagugccgaugaugauucucccuc

SEQ ID NO: 459191 - RNA, 64 nt, Human
cugcuggugccccugguggcagucccuccagguggggcuggagccugcuggcgcccaauacaaa

SEQ ID NO: 459192 - RNA, 64 nt, Human
acuuucacuuuacacuugcauguucuacuugucagggcuggaacuauuguauagaagauaauau

SEQ ID NO: 459193 - RNA, 64 nt, Human
aggucaacugcaguguugcuucccucccccuauagggcuggaaucugucuaggagcccucucuc

SEQ ID NO: 459194 - RNA, 64 nt, Human
gccugguguggggauggggucccccucuuugugagggcuggagcauggcacggcauggauuaac

SEQ ID NO: 459195 - RNA, 64 nt, Human
cuuggccucgcuggccacauuggccaaugagccagggcuggagucugagaccuuugguuguucu

SEQ ID NO: 459196 - RNA, 64 nt, Human
cccuuuuaggucaccccauugccaccgugccccugggcuggacucccgugcuccucagggccca

SEQ ID NO: 459197 - RNA, 64 nt, Human
guacuccuccuaacccuaaacccucuaugcucaggggcuggaacuggggaauggaguaagucac

SEQ ID NO: 459198 - RNA, 64 nt, Human
uuuuuuuugagacaggguuucgcucuuguugccagggcuggagugcaauggcgugaucuuggcu

SEQ ID NO: 459199 - RNA, 64 nt, Human
aggcuugucuuguucagaagacucuagcaucuuggggcuggaagguccuuugacggguaugaaa

SEQ ID NO: 459200 - RNA, 64 nt, Human
uccaucucaaaacaaacaaaaaaaggauggggcugggcuggagaggguggcaggcagugguugu

SEQ ID NO: 459201 - RNA, 64 nt, Human
gauuguguguucagagaucauaugcauauguguagggcuggagcgugugugugucuugagauug

SEQ ID NO: 459202 - RNA, 64 nt, Human
ugguuuccagccauaccuguucuggaagggagaggggcuggaggcacccacaggcacaagcuga

SEQ ID NO: 459203 - RNA, 64 nt, Human
cucuguccucauuguuuggccucaugggaccgaggggcuggaggagaggcggagcugugcccca

SEQ ID NO: 459204 - RNA, 64 nt, Human
ggucaggggaccaggcuggguuggggguuggguggggcuggacggggacgaggcgcggagaggc

SEQ ID NO: 459205 - RNA, 64 nt, Human
gaacuggagacucuugcuuagcuauucaggcacagggcuggagaguacuuuaauuuauucaaga

SEQ ID NO: 459206 - RNA, 62 nt, Human
gagcgaggggcagauucuagucgggagcccaugcccuggaaauccaucuuucuucaucuuuc

SEQ ID NO: 459207 - RNA, 62 nt, Human
gaguuuuguaggggucacugucacaugcuugugcccuggaagccccaaggcucuuccuccag

SEQ ID NO: 459208 - RNA, 62 nt, Human
gcaucaacagccagcauccugagccuccucaugcccuggaccagccuggaacacacuagcag

SEQ ID NO: 459209 - RNA, 64 nt, Human
ugugucccaaggaauuucuuuucaccucuugguugggcuggagggaaaaggaguggcuccuaga

SEQ ID NO: 459210 - RNA, 64 nt, Human
ccuaucuaggguggugaaaugccugaaaucucuggggcuggaaaccauccaucaaggucucuag

SEQ ID NO: 459211 - RNA, 64 nt, Human
aaaaaagaaagcauuguuuuaauugagaggggcagggcuggagaaggagcaaguuguggggagc

SEQ ID NO: 459212 - RNA, 64 nt, Human
guacacacgagggagcaggcuggucauugacuucgggcuggaccguugcccucugagcagagaa

SEQ ID NO: 459213 - RNA, 64 nt, Human
gcuucccauugcuucugcucuccucagaggucccgggcuggauggaggcugguacuuacccacc

SEQ ID NO: 459214 - RNA, 64 nt, Human
aagcacugcugaugaaguccccgugggcucauccgggcuggaauucuugguuuuucagccauuc

SEQ ID NO: 459215 - RNA, 64 nt, Human
ccuggccugggggaauuaaaggaauuccccguaagggcuggacccagcuccuuucugggcuugg

SEQ ID NO: 459216 - RNA, 64 nt, Human
acuguggagccaaaggugaccgcagggggccccagggcuggagccacaaggauacccucacuuu

SEQ ID NO: 459217 - RNA, 64 nt, Human
cacuuggggguucaggcccggcagggcgggcagagggcuggaggcccaggcugggaacucaucu

SEQ ID NO: 459218 - RNA, 64 nt, Human
aagcuggcaggaacagggagcagcccugugucgggggcuggaauaguucuggccagaccccguu

SEQ ID NO: 459219 - RNA, 64 nt, Human
uaggaugguuuuguguggagggggagguaggacugggcuggaugagagagcacagcugugacuu

SEQ ID NO: 459220 - RNA, 64 nt, Human
gggagguucagcagacccaugcagugugcugccagggcuggaagaagcggcacccgggggcgcu

SEQ ID NO: 459221 - RNA, 64 nt, Human
uuggaucucucccuucaggcugggauuucacuaagggcuggagaaggggggaauaugggaggau

SEQ ID NO: 459222 - RNA, 64 nt, Human
uguuugguugaucuuccccauucuggccagagcagggcuggagggaaggagccaggagggagag

SEQ ID NO: 459223 - RNA, 52 nt, Human
acaaggccaagggcaaguagcggggcuggagcaguucauuacucauaccucg

SEQ ID NO: 459224 - RNA, 62 nt, Human
gcaaccaccucgggccgcugggccaccgagcugcccuggaugggcugcuggcaugccaacuc

SEQ ID NO: 459225 - RNA, 62 nt, Human
auucccccuaagaggcagugagauguagccuggcccuggaacuagaaacagagguggcugcu

SEQ ID NO: 459226 - RNA, 62 nt, Human
agacagaagccuggacucugccccacgcuguggcccuggagggucccgguuugucaguucuu

SEQ ID NO: 459227 - RNA, 64 nt, Human
gucuagaauauuuuccugaccaagacugagggaugggcuggagguuuucaacuuugcuacccaa

SEQ ID NO: 459228 - RNA, 64 nt, Human
ccuccccgaucaucuuuccuguuccagagagguggggcuggaugucuccaucucugucucaaau

SEQ ID NO: 459229 - RNA, 64 nt, Human
ccuccccagucaucuuucuuguuccagagagguggggcuggaugucuccaucucugucucaacu

SEQ ID NO: 459230 - RNA, 64 nt, Human
caccuucccucccaguguagccuccugucagugggggcuggacccuucuaauucagaggucuca

SEQ ID NO: 459231 - RNA, 64 nt, Human
cucucaucccccuucuucccacaacccuugggcagggcuggacucaguaauuuugaggaaauug

SEQ ID NO: 459232 - RNA, 64 nt, Human
uucagugaguuugaccauugugcucuuggcucuugggcuggaguaccguggugagggaguaaac

SEQ ID NO: 459233 - RNA, 64 nt, Human
ggcuuuaggaguugagaggggaagagcugagugcgggcuggagcagcgagaaugcuucacggag

SEQ ID NO: 459234 - RNA, 64 nt, Human
gauuacuuguacucuucuuaugcuaauaugcucugggcuggagaaaugaaauccucaagccauc

SEQ ID NO: 459235 - RNA, 64 nt, Human
auuugaugacaauuuuauugaggaaagaaaacaagggcuggagcaguuuauaaacaaguaagug

SEQ ID NO: 459236 - RNA, 64 nt, Human
agcaccaacccggaaguggcaggcacagaaggaagggcuggauugggccccuuugguguaaaga

SEQ ID NO: 459237 - RNA, 64 nt, Human
ggcuggggugaccuggcaucccggggcuccccacgggcuggaugacgggguuggcacuguggcg

SEQ ID NO: 459238 - RNA, 64 nt, Human
ugacagguacagcaucccaggagcccggccugaggggcuggacccgagccggcugugaacaucc

SEQ ID NO: 459239 - RNA, 64 nt, Human
gcuggcccagagccggcagugugagcccaaguccgggcuggagccgaggccggagcagcugucu

SEQ ID NO: 459240 - RNA, 64 nt, Human
uccuaguggcuggagguagggacaguugguuguggggcuggagagagguuguggggaggaagcg

SEQ ID NO: 459241 - RNA, 64 nt, Human
ccaccuuccuugcuugcaggguuaucuucucacagggcuggaaugcaaauuucagaggcuucuu

SEQ ID NO: 459242 - RNA, 62 nt, Human
uggccguagguuuguaacuguuucauagaagagcccuggagaagacaguagaaugagccuau

SEQ ID NO: 459243 - RNA, 62 nt, Human
agguggguguugggaagaauaaaugucuguaugcccuggaagaggggauaguccgcuacacu

SEQ ID NO: 459244 - RNA, 62 nt, Human
cccuucugccacccuucccagucccaggacgggcccuggagggagaaaggagccugugcccc

SEQ ID NO: 459245 - RNA, 64 nt, Human
auucccauguaaauuaccacagaccgcaguaccggggcuggagcggagugaagcugucugcugu

SEQ ID NO: 459246 - RNA, 64 nt, Human
cagcgcagccguggcagccaccuuccaggagcaggggcuggaauguccuguggccgcaucucuc

SEQ ID NO: 459247 - RNA, 64 nt, Human
ucauuaggggagaugggggucuccccuaaugcgggggcuggaccaggcugaguccccacagggu

SEQ ID NO: 459248 - RNA, 64 nt, Human
aaaguaucucuguuuuggcaaaauucagguucaggggcuggaugguauguguuucugcugccuu

SEQ ID NO: 459249 - RNA, 64 nt, Human
ccagggcaccguauuccucucccagguguuuguggggcuggaaggaccugcucccacaggggcc

SEQ ID NO: 459250 - RNA, 64 nt, Human
agugagccaagauuguaccacuguacuccagccugggcuggacagugagacuuuugacagugag

SEQ ID NO: 459251 - RNA, 64 nt, Human
gguggauuauccacacaggucccggccccugcccgggcuggaguugccacagccugugcuccug

SEQ ID NO: 459252 - RNA, 64 nt, Human
cugcaaccuggggggacauuccuuuguaaaaccugggcuggaagucaaagccgucgguuacaga

SEQ ID NO: 459253 - RNA, 64 nt, Human
gcuggaucugggccccaccuacagagagggcucagggcuggaccgggggcauugugugcuuggg

SEQ ID NO: 459254 - RNA, 64 nt, Human
aaucaaauuugucuugaccaaauaaguuuccugagggcuggaauuaugccuuaacuauaucuau

SEQ ID NO: 459255 - RNA, 64 nt, Human
ccuccccuucucacugaggcagaagcacugaggugggcuggacaugggugcccuccacgucccu

SEQ ID NO: 459256 - RNA, 64 nt, Human
acuggggucaagagccugcacacaugagccuuccgggcuggaaggcuggcguaggacuuggggc

SEQ ID NO: 459257 - RNA, 64 nt, Human
gucccgggcaggggugaaacuccagcagguggcugggcuggaaaggagggcagggcuacauccu

SEQ ID NO: 459258 - RNA, 64 nt, Human
aguggccaaguaaaccgagacaccaguaacagcagggcuggacuuccuccagcguuuugggaag

SEQ ID NO: 459259 - RNA, 64 nt, Human
cuccagcaucacuccucugccaccuugggguguggggcuggauuaaaagucauucaucugacag

SEQ ID NO: 459260 - RNA, 62 nt, Human
acagaugaaggagaacuauuaacuggcuuucagcccuggauauuuaaaucuccuccucuucu

SEQ ID NO: 459261 - RNA, 62 nt, Human
cugaccuaacugcucagggaucuuucuucccagcccuggagccuggagggagaccacccucu

SEQ ID NO: 459262 - RNA, 62 nt, Human
cugugaccgaccccuccccagugccucuccuggcccuggaaggugccacuccagugcccauc

SEQ ID NO: 459263 - RNA, 64 nt, Human
cgaccgccgccccauggaccccucgcccaggccggggcuggagggauucggccgcggcuccggu

SEQ ID NO: 459264 - RNA, 64 nt, Human
gaaaagcagaguuggucuagagaggaggagggcggggcuggaggaaugugggggauugaaacua

SEQ ID NO: 459265 - RNA, 64 nt, Human
aucuccaucugcaucccugaaaaaugaagaaacagggcuggaugauuuugcagguccaaugcaa

SEQ ID NO: 459266 - RNA, 64 nt, Human
uggaaaggcuucucagccucuguaguuggcagcugggcuggacuucuggagaacuuccccuuuc

SEQ ID NO: 459267 - RNA, 64 nt, Human
ccaaccuuucacgccggccagcggucaggggccagggcuggaggcgccuuccccucgcgguccc

SEQ ID NO: 459268 - RNA, 64 nt, Human
aaguggaaaggccucuucucaacuuuuuucccuugggcuggagaauuuagaaucagaaguuucc

SEQ ID NO: 459269 - RNA, 59 nt, Human
ugucacaaagugucagaugagaauuuuaggggcuggaggaagauguaaaagaugaaaau

SEQ ID NO: 459270 - RNA, 64 nt, Human
ggagggcccagguaggcgaugucagugugugaaggggcuggauugggcguggugaggauguugg

SEQ ID NO: 459271 - RNA, 64 nt, Human
acaaaauccagaaagcauuuaagaauugaacuaggggcuggaagaagugaaagggaagcaucua

SEQ ID NO: 459272 - RNA, 64 nt, Human
acaaaacucaguauacacagccgcuauucauugagggcuggauaccucaacaagacugagagcc

SEQ ID NO: 459273 - RNA, 64 nt, Human
agaaugagggaggggaaaguuuaaaaucccagcugggcuggacuguugccaacaucaccuuaaa

SEQ ID NO: 459274 - RNA, 64 nt, Human
uuggcuuaaauccaguuuucaaucuucgacagcugggcuggaacgugaacucaguagcugaacc

SEQ ID NO: 459275 - RNA, 64 nt, Human
cagggucccagacacguuuggggguccugauucugggcuggacacgguuguggauccagagaag

SEQ ID NO: 459276 - RNA, 64 nt, Human
agcaauuccuaguuaguuaccaccuccagcugaggggcuggaggaaaacagguauagccaaauu

SEQ ID NO: 459277 - RNA, 64 nt, Human
cacugcccccuucgcuagcacgaguugcugugcagggcuggagguagcuaccauggcuuguuuc

SEQ ID NO: 459278 - RNA, 53 nt, Human; identical to SEQ ID NO: 372387

SEQ ID NO: 459279 - RNA, 62 nt, Human
agaaggccuuguccuuaaccaccuccuugccugcccuggaggcuugugccucuaggccccac

SEQ ID NO: 459280 - RNA, 62 nt, Human
caccuggugagagccugaggcugguguucagggcccuggacacagacacagagcagccgcau

SEQ ID NO: 459281 - RNA, 64 nt, Human
ggacaaaaaguagauucauguuugcaaggggcuggggcuggaagcugguagugacugcuaaugg

SEQ ID NO: 459282 - RNA, 64 nt, Human
guaccuggaugguguguccaccaucgacacggaggggcuggauuuguuucucaggcaauccugu

SEQ ID NO: 459283 - RNA, 64 nt, Human
ugcaggggcauggggaaaugcauauauuaaucaggggcuggaggaguauacaugauucuugugu

SEQ ID NO: 459284 - RNA, 64 nt, Human
augugaaaaggaaaaaaugcaaacguuggaguuugggcuggagcuccucccuccagcugcgacu

SEQ ID NO: 459285 - RNA, 64 nt, Human
uuuuuuuugagacagaguuucgcuuuuguugcccgggcuggaaugcaauggcgcgauucagcuc

SEQ ID NO: 459286 - RNA, 64 nt, Human
cugaucaggcaucaagcuacccucaagaguuucugggcuggauguuucagaacaacaucuacac

SEQ ID NO: 459287 - RNA, 64 nt, Human
augacaccaccagucugaaugguccugggggcuggggcuggagaggccgcugcaccaccacccg

SEQ ID NO: 459288 - RNA, 64 nt, Human
gaggugccucucacugugaauuuguggugggcgggggcuggaggagagggugggggacuggcuc

SEQ ID NO: 459289 - RNA, 64 nt, Human
ugcacucugcccucuuugcccaggauacugaggagggcuggagcucgggaaguuguccuuccug

SEQ ID NO: 459290 - RNA, 64 nt, Human
gggccuucucugaccccugccugagcuguucccagggcuggagcagguguacccugagcagggg

SEQ ID NO: 459291 - RNA, 64 nt, Human
uucccaggccaugccgggguggccaucuaugguagggcuggaagcugaggcuggccgccagcug

SEQ ID NO: 459292 - RNA, 64 nt, Human
guucacugacuugaaguauacucaguuaaaaucggggcuggaggugcagacggugucugaccgg

SEQ ID NO: 459293 - RNA, 64 nt, Human
gugaccugauaccaccacccuuuguggcagcaccgggcuggacugcccugaucccugggacgug

SEQ ID NO: 459294 - RNA, 64 nt, Human
ugacugugcucugugacauggacacggacggagggggcuggaccgugaguguggggcugggcag

SEQ ID NO: 459295 - RNA, 64 nt, Human
acaagugucaccacuucccugaaccccccuaggugggcuggaaucagcaucuggugcaaagcuc

SEQ ID NO: 459296 - RNA, 62 nt, Human
cuucacuagccucucugaagguguccuggccagcccuggagaagcacuggugucugcagcac

SEQ ID NO: 459297 - RNA, 62 nt, Human
ggcccaggcuggggccagggccagaggggaaggcccuggauucucacucaugugagaucuug

SEQ ID NO: 459298 - RNA, 62 nt, Human
gcauuucuccucuccucuugcugcucagcacagcccuggauugcagccccgaggcugagacc

SEQ ID NO: 459299 - RNA, 64 nt, Human
gggauccuccuggccgccccgcagggggcuuggagggcuggacggcaaguccgucuagcucacg

SEQ ID NO: 459300 - RNA, 64 nt, Human
ccacccaccaaagacccccucacccuggccccuugggcuggacccuccaaugccagcgacuccc

SEQ ID NO: 459301 - RNA, 64 nt, Human
cagcccugacuccgccgccccucugccuccgccagggcuggaccacgagcuggccuucucucgu

SEQ ID NO: 459302 - RNA, 64 nt, Human
gagguauugauuacauuguggacuuugaaugugagggcuggaugggacgcaggagaucaucuga

SEQ ID NO: 459303 - RNA, 64 nt, Human
cugcaugucucuagaaugcuguugccacuuacgggggcuggagaaggccuggauaaagacagaa

SEQ ID NO: 459304 - RNA, 64 nt, Human; identical to SEQ ID NO: 459281

SEQ ID NO: 459305 - RNA, 64 nt, Human
ugcaagaguuauugccuagcacagggcccagacagggcuggacuagacacgaugaaaacagccu

SEQ ID NO: 459306 - RNA, 64 nt, Human
gacccacucaaggacacacagcagguccguggaugggcuggaugagugaccagggccagccucu

SEQ ID NO: 459307 - RNA, 64 nt, Human
aagcuuccagcacagcccucuacccagaacauccgggcuggagggaggcucccagugacuuuuc

SEQ ID NO: 459308 - RNA, 64 nt, Human
ggugggugggcagguggccugccaggccaggagugggcuggagcugcugaggcccagaaggccc

SEQ ID NO: 459309 - RNA, 64 nt, Human
guaguuuauggauuuaaacauuagagcuggaguggggcuggaaaucuuuguaaaggaaguucuu

SEQ ID NO: 459310 - RNA, 64 nt, Human
cagguagcuugggguugaaguuaggacuccuccugggcuggaggauuuaccugguggggcacuu

SEQ ID NO: 459311 - RNA, 64 nt, Human
uuccugcuugugccaagggcuggacacugcuggggggcuggaaagccccucccuuccuguccuu

SEQ ID NO: 459312 - RNA, 64 nt, Human
ggggcugguuuugggguuuuccugcuugugccaagggcuggacacugcuggggggcuggaaagc

SEQ ID NO: 459313 - RNA, 64 nt, Human
gaggaguggacgcuguccauugccacggccaugagggcuggagaccagaacagcauggcccgaa

SEQ ID NO: 459314 - RNA, 62 nt, Human
gggauguaaccagcaauggccaggguacaacagcccuggaaaacaguaguaggagcacuagg

SEQ ID NO: 459315 - RNA, 62 nt, Human
uaauuuuacaaauaggcaaacaacauaacuuugcccuggauugacuacauauuuuuaaaccu

SEQ ID NO: 459316 - RNA, 62 nt, Human
ugcaggaggaggccgccggcggggagcaggaugcccuggaccuguaccagcacagccugggg

SEQ ID NO: 459317 - RNA, 63 nt, Human
uugugauugaaagccauugaggagcagguguccgggcuggagaagaguccugcuuucucugga

SEQ ID NO: 459318 - RNA, 64 nt, Human
ccaggcgguguauggcgugcugcgugugauggaggggcuggaugcguucgaugaccugaugcag

SEQ ID NO: 459319 - RNA, 64 nt, Human
aagccggcuacugucagcaaagccugaagaaguggggcuggauacccugcccccaccauauccc

SEQ ID NO: 459320 - RNA, 64 nt, Human
cucuucaggcagccaggcccauggcuggaaggccgggcuggaggcccagggaaucgguuacuga

SEQ ID NO: 459321 - RNA, 64 nt, Human
uuuuccaaggccuccugauggggggccuccgaaagggcuggagucagccuuggggagcugccua

SEQ ID NO: 459322 - RNA, 64 nt, Human
ccgcaggcucccaggaccagcagccacaagggcagggcuggagccggguccucagcugucugcu

SEQ ID NO: 459323 - RNA, 64 nt, Human
ugccucuggaagguggguggggcccugcaccguggggcuggacugcgcuaaugggaagcucuug

SEQ ID NO: 459324 - RNA, 64 nt, Human
cccacagaaggcuacggggaggacugagaggacagggcuggaggcagccaaguaacguagucau

SEQ ID NO: 459325 - RNA, 64 nt, Human
uugcugaggcccagcccagcccagcauagcccgagggcuggaaaaacgcuuucaucucuaaaac

SEQ ID NO: 459326 - RNA, 64 nt, Human
ccgcagcccuggcagggggcaugcggucgggcaggggcuggagggaggcgggggcugcccuugg

SEQ ID NO: 459327 - RNA, 64 nt, Human
gggggggccuggggguagugucaaugccccuccagggcuggaggggaagaggggccccgaggau

SEQ ID NO: 459328 - RNA, 64 nt, Human
ccgucugggauagcaccucucagucaacaucguggggcuggacagggcugcggccccucugccc

SEQ ID NO: 459329 - RNA, 64 nt, Human
aguugagcuggcaggggaggggcugagagggugggggcuggaaccccuccccgggaggagugcc

SEQ ID NO: 459330 - RNA, 64 nt, Human
gaacucugcugugaucccaugaugugacccugaugggcuggacuugccccuccgguagccuucc

SEQ ID NO: 459331 - RNA, 64 nt, Human
gaggugccauuuuguugcauauguacaggauuaugggcuggaaagcauuuguuauaaaccuaua

SEQ ID NO: 459332 - RNA, 62 nt, Human
agauggcccgggacaagccacgccuccuagcugcccuggaaguggcuucagcugccauggcc

SEQ ID NO: 459333 - RNA, 62 nt, Human
gaacuuuucccaaaggguuuuggguauagccugcccuggaggggaaggaaguccaugcaagc

SEQ ID NO: 459334 - RNA, 62 nt, Human
aagguggaggcaggcuuaaguucaguccuccugcccuggagcugguuugggcugucaaaacc

SEQ ID NO: 459335 - RNA, 64 nt, Human
uuggagugggguggguagacuacaguagacacaagggcuggacaugcagaugcuuaggggauua

SEQ ID NO: 459336 - RNA, 64 nt, Human
uaagaguugcuuaaacuugacacuguugacauuugggcuggauaaaaccccugugguggggucu

SEQ ID NO: 459337 - RNA, 64 nt, Human
gaagggaaaagugccuuuaaaauuaccucacugugggcuggaagaagcgaaaaucucugcccag

SEQ ID NO: 459338 - RNA, 64 nt, Human
cagcucuccucggccuggggcucuggccaaggaugggcuggaggucauucaguuggucugucuc

SEQ ID NO: 459339 - RNA, 64 nt, Human
auuagaaacauacuagcuauuuuuucuuuaauuagggcuggaauaggaagccagugucucaacc

SEQ ID NO: 459340 - RNA, 64 nt, Human
uucccaggucuauccucauccuacgccucccugggggcuggagggauccaagagcuuggggauu

SEQ ID NO: 459341 - RNA, 64 nt, Human
accguuuuauuuauugaaguguuuguucaguuaggggcuggagagagggagcuugcugccuccu

SEQ ID NO: 459342 - RNA, 64 nt, Human
gaccgccauucugcguguguuccccagcugggcagggcuggaagccuuacguaugaagcaugga

SEQ ID NO: 459343 - RNA, 64 nt, Human
acaggcuguggaccccuucaggugcacuauaauggggcuggaggggcccccacaucucucagcc

SEQ ID NO: 459344 - RNA, 64 nt, Human
cucuguuguuccuguccugucuucacugagcgcagggcuggaggccucuuagacauucuccuug

SEQ ID NO: 459345 - RNA, 64 nt, Human
cuccccgccccgccgccccacaccucuccccuuugggcuggacgggaacacacguguguggcuc

SEQ ID NO: 459346 - RNA, 64 nt, Human
cugagcuggcagcgauucagagcccuggggcugggggcuggaauccaccuccucccacacaagc

SEQ ID NO: 459347 - RNA, 64 nt, Human
gagaccuugcugaagcuccugggguguggggugugggcuggaagcacuggcucccugguaggga

SEQ ID NO: 459348 - RNA, 64 nt, Human
gcugauuuaaacuguaauuguauugccguacugugggcuggaaaucccaaaucuagauuccagc

SEQ ID NO: 459349 - RNA, 64 nt, Human
uucugcagguuuuaugggcuugucacaacgugaagggcuggaauguauauuaccaaaugggaau

SEQ ID NO: 459350 - RNA, 62 nt, Human
aagccaggcuucacucccaaaagugcagccaggcccuggagggugauccugccagcagcccu

SEQ ID NO: 459351 - RNA, 62 nt, Human
uuugaggcaaugccauuucuagaguugaaaaagcccuggacccaaacugcggcacuguugaa

SEQ ID NO: 459352 - RNA, 62 nt, Human
cgaagccugagcaugcggcucaccccgggguggcccuggaggccccugaccccaccccaccc

SEQ ID NO: 459353 - RNA, 64 nt, Human
gaaaaaugcuccccacagcgucccuggcgcaggugggcuggacuucuaccugcccucaagggug

SEQ ID NO: 459354 - RNA, 64 nt, Human
cccaugccgcccccuaaggagccgcccagaccuagggcuggacucaggagcugggggggccuca

SEQ ID NO: 459355 - RNA, 64 nt, Human
ccuggccgcagcagaugcccucccaggaguggaggggcuggagagggggaggccuucgggaaga

SEQ ID NO: 459356 - RNA, 64 nt, Human
uuuuuuuuugagacugagucucacucugucgccugggcuggaguacaguggugcgaucucagcu

SEQ ID NO: 459357 - RNA, 54 nt, Human
agaauccccugacuggauaacucagggcuggagaaacaaagauuauaaagcacg

SEQ ID NO: 459358 - RNA, 64 nt, Human
ggaccaggguggagcugagaagaggaggaggugggggcuggaggugcugguagcugaggggacg

SEQ ID NO: 459359 - RNA, 64 nt, Human
gccaggggauccaggaccugggauccagggcccugggcuggaccucaggacaggcauggaggcc

SEQ ID NO: 459360 - RNA, 64 nt, Human
aggggcagggcgcugaccugcugcugagcuggcugggcuggacccggucccuaggcugugaccg

SEQ ID NO: 459361 - RNA, 64 nt, Human
gugcucuggcaguagggccacgaccugccugccugggcuggagcucuugcccgaagccugaagc

SEQ ID NO: 459362 - RNA, 64 nt, Human
aagaucucaggagcuuuagggagaagacuugguggggcuggagcacaccuugggccucaguggu

SEQ ID NO: 459363 - RNA, 57 nt, Human
gccaggcauugcugacaugacuguggugggcuggagcaggggugagaggaggcuagc

SEQ ID NO: 459364 - RNA, 64 nt, Human
aagcaggcugucuuguaaaagcccagaucacugugggcuggagaggagaaggaaagggucugcg

SEQ ID NO: 459365 - RNA, 64 nt, Human
gggucuauauauuugcaccuccucauucaacacagggcuggagguucuacaacaggaaaucagg

SEQ ID NO: 459366 - RNA, 64 nt, Human
cuacccaccucucccugggccuucccuguccacugggcuggauucauguucaaaccacuggacu

SEQ ID NO: 459367 - RNA, 64 nt, Human
gcuccaccccagccagcugggcagggccgguguggggcuggagccaggcagcuagcccaggacg

SEQ ID NO: 459368 - RNA, 62 nt, Human
cacguugcucguugcucggcuuaugggaggccgcccuggagggcccggaggucccaaggucc

SEQ ID NO: 459369 - RNA, 62 nt, Human
gccugggcagaagacucaccuuggaggagugggcccuggaguccugucccucccagaagccc

SEQ ID NO: 459370 - RNA, 62 nt, Human
auccaggccaggcugugguuuccccugaaccagcccuggaccuuucugagccaggcuggcca

SEQ ID NO: 459371 - RNA, 64 nt, Human
cuuuugggugugggccuaacaaaaagggcucaaggggcuggagacuggcugcuggggccuccuu

SEQ ID NO: 459372 - RNA, 64 nt, Human
cagucugggguauuuccccugcugaggagugacagggcuggagacugugucugcuuucugccuc

SEQ ID NO: 459373 - RNA, 64 nt, Human
gagaggggaaggaccuuugucugggcguuaccaagggcuggaaacuuuaccugguaccuaaagg

SEQ ID NO: 459374 - RNA, 64 nt, Human
auauuggaacaccugugagagagauuguucuauagggcuggaauauucagaguuacauucuugg

SEQ ID NO: 459375 - RNA, 64 nt, Human
ggggcugggcaugcacuggggggcuggaggagcugggcuggacccuucccaccugagcaugcug

SEQ ID NO: 459376 - RNA, 64 nt, Human
cuggguaacuuauuggggcugggcaugcacuggggggcuggaggagcugggcuggacccuuccc

SEQ ID NO: 459377 - RNA, 64 nt, Human
acaccaaucuggauugagcggguggugauaauaggggcuggaaagccagcagcugugguacucc

SEQ ID NO: 459378 - RNA, 64 nt, Human
cccgggaaagaggaaaacccgcugccuccagggagggcuggacggcgagcugggagccagcccc

SEQ ID NO: 459379 - RNA, 64 nt, Human
uauuagcucccguucccaaguguggacuccagaggggcuggaggcaagcuaugaacuugcucgc

SEQ ID NO: 459380 - RNA, 64 nt, Human
ggcugugaagugcugggcuuugucuggggcuccagggcuggacaugcagacaguggucacagug

SEQ ID NO: 459381 - RNA, 64 nt, Human
accugcucaccccaccggguucacuguccuuguggggcuggagagaugggcauaagucaggaac

SEQ ID NO: 459382 - RNA, 64 nt, Human
uuuuuuuuuugagauggaaucuuacucugucaccgggcuggagugcaguggcaugaucucagcu

SEQ ID NO: 459383 - RNA, 64 nt, Human
guaggaagaaguggcuuccuuuggaggugggagugggcuggaggccucuggagaagaccugggg

SEQ ID NO: 459384 - RNA, 62 nt, Human
uggccaaccugcccuucuagaagucgcugccagggcuggagccggggcaauguugcaaauac

SEQ ID NO: 459385 - RNA, 64 nt, Human
ggggccugcccuaacccgccagccuccuccucucgggcuggaucugggggcuagcagugaguac

SEQ ID NO: 459386 - RNA, 62 nt, Human
gcaccuggggaucccccuaaacugugaauucugcccuggacagggcuuugcccuuggaggau

SEQ ID NO: 459387 - RNA, 62 nt, Human
aaaucauuuucuccccuuggcagugucccagggcccuggaugguccucuuaccaacaucugg

SEQ ID NO: 459388 - RNA, 62 nt, Human
cucuucacucugaauccucaugaggcuucucagcccuggauuuccugcugccauccucaccc

SEQ ID NO: 459389 - RNA, 64 nt, Human
uggagcaccuuagacaaacuacccagcacaggcggggcuggaauucuggcggagggcaugagcc

SEQ ID NO: 459390 - RNA, 64 nt, Human
gagggggaggcuugaccuuuuguccugaccaggugggcuggaggggacaagcccuaucccuggc

SEQ ID NO: 459391 - RNA, 64 nt, Human
ugacuucuagggcacugaggagugaaagcgccuagggcuggagaauagcgcugaguuggguuug

SEQ ID NO: 459392 - RNA, 64 nt, Human
ggugggccgccuuccuggagacccguagaugccagggcuggaagcuuucauuugccgggacacu

SEQ ID NO: 459393 - RNA, 64 nt, Human
accuuuggacuucccccacucuuuauuuguuugggggcuggaggggggagacggagaaacagug

SEQ ID NO: 459394 - RNA, 64 nt, Human
gcaggucugggugccccuuuuccuccccugggaagggcuggaauaggauagaaagcuggggguu

SEQ ID NO: 459395 - RNA, 64 nt, Human
ggccuggguuggacucagggucuccuccagcugggggcuggaccgcagcaccuaucugagcagu

SEQ ID NO: 459396 - RNA, 64 nt, Human
cucccugucuccagggcccccaccgagguucccagggcuggagacuuccucugguaaacauucc

SEQ ID NO: 459397 - RNA, 64 nt, Human
ggauaugggaagcuucugugagugcauaggaugggggcuggagucauucuuagcuguuucccuu

SEQ ID NO: 459398 - RNA, 64 nt, Human
cagaaggcagaagauuuugaauuauuauccagcagggcuggaagcacuagaugcagcaugagca

SEQ ID NO: 459399 - RNA, 64 nt, Human
uuuuuuuuuugagauggaguuucucuugucaaccgggcuggagugcaguggugcaaucuuggcu

SEQ ID NO: 459400 - RNA, 64 nt, Human
uguggaugggagacagcaggauuagcuucagcuugggcuggagcagucaauauaggaucucagg

SEQ ID NO: 459401 - RNA, 64 nt, Human
cuggcccgacgcaguggcacugcuguggcuuucagggcuggagcuggcuuugcucagaagccuc

SEQ ID NO: 459402 - RNA, 64 nt, Human
uuuuuuuuuuugacagagucucgcacuguugccugggcuggaaugcaguggugcgaucucggcu

SEQ ID NO: 459403 - RNA, 53 nt, Human
agucgcccaccugcgugugaacagggcuggagggaagggcacaggggcgcccg

SEQ ID NO: 459404 - RNA, 62 nt, Human
cauuucuggaacaacuggagaaaccggaguaugcccuggacuggauauuaaauaaaaauuua

SEQ ID NO: 459405 - RNA, 62 nt, Human
ucugggaaauugaggggacggcaggcccggcugcccuggaacugggagacagggagaauccc

SEQ ID NO: 459406 - RNA, 62 nt, Human
guguggagaaggagcugacgcugcgcagccaagcccuggagcucaacaagcggaaggugagg

SEQ ID NO: 459407 - RNA, 59 nt, Human
ccauacuggacgcuuuauaagagguccaugggcuggaaucugaugagguuguaugaugg

SEQ ID NO: 459408 - RNA, 64 nt, Human
auacuauaaccucaaauggugcagauccagaacugggcuggaugacaucccuacugugccaugu

SEQ ID NO: 459409 - RNA, 64 nt, Human
ccuuguuuuuuugggggcuccagggaccaaucuggggcuggaaauguuaggagguugccuuggu

SEQ ID NO: 459410 - RNA, 64 nt, Human
cauuuuccuuguacucuucucuccacccuucuuagggcuggaggauggcauuuaucucuagaug

SEQ ID NO: 459411 - RNA, 64 nt, Human
uuuggccuggguggggcugggcccaggaaggggugggcuggauuuuguaaagcuggaggcagcc

SEQ ID NO: 459412 - RNA, 64 nt, Human
cccagggagggagcaugggaagagggugagcugagggcuggaggagggcaacagccacugggug

SEQ ID NO: 459413 - RNA, 64 nt, Human
uugaccucaaggucagaagguucccaaaccccuggggcuggaacaugggaucuccucuuccacc

SEQ ID NO: 459414 - RNA, 64 nt, Human
ccaagguguguucaaagaggcuugccuugagggagggcuggaaucugucuucccugacucggcu

SEQ ID NO: 459415 - RNA, 64 nt, Human
gguagcuagaguaaagaaccuagggccuggaccugggcuggacaguguaucccuuuaggugugg

SEQ ID NO: 459416 - RNA, 64 nt, Human
ggggugggguccuagccucaguuugaagaagugggggcuggagcgggguugggggugguaggga

SEQ ID NO: 459417 - RNA, 64 nt, Human
uuuuuuuugagaugaagucucgcgguugucacccgggcuggagugcaguggcgugaucucggcu

SEQ ID NO: 459418 - RNA, 64 nt, Human
auuguuugcagggguuaaguuuuccuuccagugagggcuggagggaugaauuagcugguaccug

SEQ ID NO: 459419 - RNA, 64 nt, Human
uggaacaugcucuccugcucaaggcacaaccucugggcuggaguagaggacucuggugggaagg

SEQ ID NO: 459420 - RNA, 64 nt, Human
cccccuugaaugacccccagagccccucugagaagggcuggaguuugggggaaggggauggcug

SEQ ID NO: 459421 - RNA, 64 nt, Human
aucugugcucuccuagcccaagagaccccuggaggggcuggaguuuuauccagcgccucgucgu

SEQ ID NO: 459422 - RNA, 62 nt, Human
ggguaucuuuguauauauguguauauaugugugcccuggacuguuucaagguccauggagua

SEQ ID NO: 459423 - RNA, 62 nt, Human
ucucagccccucccugccccaccccagcuccugcccuggaaaucuggagccccuuggagcug

SEQ ID NO: 459424 - RNA, 62 nt, Human
gcugccgagcagagcguccucugccaggccccgcccuggauuccuagagacuagcuucagcu

SEQ ID NO: 459425 - RNA, 64 nt, Human
ugaauggggguuaugggguggggguggggacucagggcuggaccgacguccuaguggaccugau

SEQ ID NO: 459426 - RNA, 64 nt, Human
uuuagaaaaaaaugaauggcuuccugccauuguggggcuggacucuugggcuuucuugguggga

SEQ ID NO: 459427 - RNA, 64 nt, Human
gcccaggccaguguuguuuccagccucaggccacgggcuggacgggccuggccgccucuuccgc

SEQ ID NO: 459428 - RNA, 64 nt, Human
ucuuuggacuacauuaguccccuguggagcagcagggcuggagaucucugcagucccuuccccg

SEQ ID NO: 459429 - RNA, 64 nt, Human
cucugagacgagacggguucccaaggcccugguggggcuggagucucaccuguuugcauggaga

SEQ ID NO: 459430 - RNA, 64 nt, Human
cucccuugugugagugaccacggccccaagcccagggcuggaggcaggucccaggacgcgccgc

SEQ ID NO: 459431 - RNA, 64 nt, Human
cucccuugugugagugaccgcggccccgagccuggggcuggacgcaggucccaggacgugcugc

SEQ ID NO: 459432 - RNA, 64 nt, Human
ugcuaaccggugagugaccgcggccccgagccuggggcuggacgcaggucccaggacaugcugc

SEQ ID NO: 459433 - RNA, 64 nt, Human
ucuagaagaaauaugaaaugcuuaauuuauaagcgggcuggagauuuuuuccaauauuguuuuc

SEQ ID NO: 459434 - RNA, 64 nt, Human
gagaaggugagcgcugaagaaccaggaugggacggggcuggaacagcuggguucagcuuuugca

SEQ ID NO: 459435 - RNA, 64 nt, Human
aagacaagcacacaggagguagaauaucagaguggggcuggaucaagggcaaaaacuggucauu

SEQ ID NO: 459436 - RNA, 64 nt, Human
uggaaaagagcaauaaauugcccggugcucugcagggcuggaauuucaaacagaaagagggaau

SEQ ID NO: 459437 - RNA, 64 nt, Human
uaaguguauuuuaaaugugaccuuucguaaauuugggcuggaacauguaaaagggugaaaguua

SEQ ID NO: 459438 - RNA, 64 nt, Human
ggcgauacauccuuccccaccgcaggcaccccgggggcuggaggggcguguacccaaauccccg

SEQ ID NO: 459439 - RNA, 64 nt, Human
uuuuguaaugcuguuuaucagaggagggugacaggggcuggaaauaaagagaggggacauggug

SEQ ID NO: 459440 - RNA, 62 nt, Human
cacgugcuggcacaccucacagaagcacccuggcccuggaugccugcaaccucagaagagug

SEQ ID NO: 459441 - RNA, 62 nt, Human
cugcuugcuaggggcaggaucucauucaggcugcccuggaagcaccugcuuggcccugccac

SEQ ID NO: 459442 - RNA, 62 nt, Human
ucagcaagggaggagagucuguugcuggcauagcccuggaaggagcccccagccucuccccu

SEQ ID NO: 459443 - RNA, 64 nt, Human
cugugggggugggauuuggaagggggguuggguugggcuggauaucuuuguagauguggaccac

SEQ ID NO: 459444 - RNA, 64 nt, Human
aaacagccuuuccuagggaagaggaaggggaggugggcuggaucugugacugauugaaaugcau

SEQ ID NO: 459445 - RNA, 64 nt, Human
ccuguggucgaugaccucucgguaguuucaaagggggcuggagggggauauuugacuuguuuuu

SEQ ID NO: 459446 - RNA, 64 nt, Human
agagaaaccugagugacgacgugguggaggaacagggcuggaaagaggcugcuggcugucuggc

SEQ ID NO: 459447 - RNA, 64 nt, Human
accugagcuagaagcuggaggacuagaaccuggagggcuggaaucuggagagcuagaaccugga

SEQ ID NO: 459448 - RNA, 64 nt, Human
ggagagcuagaaccuagaagggcuagaaccuggagggcuggaaucuggagagcuagaaccugga

SEQ ID NO: 459449 - RNA, 64 nt, Human
ggagggcuagaaccuagaagggcuagaaccuggagggcuggaaucuggagagcuagaaccugga

SEQ ID NO: 459450 - RNA, 64 nt, Human
uuauuuuugaacuuuagguccuuccucuucuuuggggcuggaacagaauuaaauuuguuuggaa

SEQ ID NO: 459451 - RNA, 64 nt, Human
gaaccucuuuuugugggugauuuuuaaauauacugggcuggacauuccaguuuuagccaggcau

SEQ ID NO: 459452 - RNA, 64 nt, Human
gucucaccaucccgcacccaccagacaacagccagggcuggaguccaggccacuuucagcugcu

SEQ ID NO: 459453 - RNA, 64 nt, Human
guuuagcuuuaauagaaacccccagccccuggaggggcuggauuccuuugggagcaguguucca

SEQ ID NO: 459454 - RNA, 64 nt, Human
gacugugugcgaggcaaugcucuagguccuguaggggcuggaaaauaaaccgcaugcuggccua

SEQ ID NO: 459455 - RNA, 64 nt, Human
gcccccccuaagagacacauacagagugggccccgggcuggagaaagagcugccuggaugagaa

SEQ ID NO: 459456 - RNA, 55 nt, Human
ugucgcaguacccauucugagccucgggcuggagccuccgacgcugccucucauu

SEQ ID NO: 459457 - RNA, 64 nt, Human
ugcugagcuggcccuuggggagaggugauucucagggcuggagccugggguguccuacagugac

SEQ ID NO: 459458 - RNA, 62 nt, Human
aauccuauggcuggccuucucauuccacaagggcccuggaaaggguugacagccagccuugg

SEQ ID NO: 459459 - RNA, 62 nt, Human
uuuggggucaagaggaguagggaucccaggcugcccuggacuuagaccagugucugaggugg

SEQ ID NO: 459460 - RNA, 62 nt, Human
gggauuuggggcuuucuugaaagacaguccaagcccuggauaaugcuuuacuuucuguguug

SEQ ID NO: 459461 - RNA, 64 nt, Human
auuuuuuuagagacagggccuugcucuguugccugggcuggagaacaguggcaccaucauagcu

SEQ ID NO: 459462 - RNA, 64 nt, Human
uaggccuuggcccuggcccugagacucugugagggggcuggagcagccugguuauuuccuaucu

SEQ ID NO: 459463 - RNA, 64 nt, Human
gagagagggggccaaugagggcagggccuccugugggcuggaaaaccacugggugcgucucuug

SEQ ID NO: 459464 - RNA, 64 nt, Human
cgggcuggucagaggucacgccuacucugucacggggcuggaugagguaagccugguggggcuu

SEQ ID NO: 459465 - RNA, 64 nt, Human
auaaagcagaauugggagggacuuuguggagacagggcuggacuugaaaggaagaagaagucua

SEQ ID NO: 459466 - RNA, 64 nt, Human
cuacugcagguuuccgagcagagggucauacacagggcuggaccucacgcagacuggcauggcc

SEQ ID NO: 459467 - RNA, 64 nt, Human
ggcacaguguaucgacaaucugucagccgacgcagggcuggaggcccuccauuucccuccccuu

SEQ ID NO: 459468 - RNA, 64 nt, Human
ccagggaaaucugggcucgaggccuacaacuuaggggcuggaaucacaggucucacauagagaa

SEQ ID NO: 459469 - RNA, 64 nt, Human
augucugugccucccuucuuuauuggggacaugugggcuggaacagcagauuucagcuacauau

SEQ ID NO: 459470 - RNA, 64 nt, Human
gcucugcaggccuucugcaaaucagugcuggccugggcuggaaacagcucugugugugaaggug

SEQ ID NO: 459471 - RNA, 64 nt, Human
caggcuguugucuugacacugaagcagcuggugugggcuggaacuggcccagcauugaccuggg

SEQ ID NO: 459472 - RNA, 64 nt, Human
aaggccaagaagguaggaggaaaauggcagaccugggcuggagaagaaccuucuccguauccca

SEQ ID NO: 459473 - RNA, 64 nt, Human
cuggaucauucguagugccagcacaguccuaaaagggcuggaguaccacaccaacacagguagg

SEQ ID NO: 459474 - RNA, 64 nt, Human
ccuagccacaggcuuugagcgccugcauuccugggggcuggaggguggggugccaaaggcccug

SEQ ID NO: 459475 - RNA, 64 nt, Human
cacagggagugcacauauccaggcaccaggacuagggcuggagugagggggggguauuucaauu

SEQ ID NO: 459476 - RNA, 62 nt, Human
cuugccccugcugcugccccgagggcugcccugcccuggaagggccccucugccuccacacc

SEQ ID NO: 459477 - RNA, 62 nt, Human
uuccccucuucccuacacgauccgcaacccaugcccuggaccagccgcccagaucaugccgc

SEQ ID NO: 459478 - RNA, 62 nt, Human
uagucucccuaucccacgagggggcuuugauggcccuggagauccuacaguaaauaaaccag

SEQ ID NO: 459479 - RNA, 64 nt, Human
ccugggggacagcacagucaguggagagagccaggggcuggagguggggcccaccccagccucu

SEQ ID NO: 459480 - RNA, 64 nt, Human
caggguuucucagccuuagcacuauggacauuuugggcuggauaaauauguguugguacagaau

SEQ ID NO: 459481 - RNA, 64 nt, Human
agccgcugaccccagucugcccacugaggggcuagggcuggaagccaguucuaggcuuccaggc

SEQ ID NO: 459482 - RNA, 64 nt, Human
ggccaugaacgcguacacuucaguucagcaggaugggcuggagagccucucugugcagcggugu

SEQ ID NO: 459483 - RNA, 64 nt, Human
uuuccugguccuagguggccaguggguaugaggagggcuggaaggcagagcuuugggccaaaag

SEQ ID NO: 459484 - RNA, 64 nt, Human
ucgcuuuugcugggccgugaucgucccccuuugugggcuggaaaagcaggugagggugggcugg

SEQ ID NO: 459485 - RNA, 64 nt, Human
caucagccgcucccugacagcgcgcuuucgccgugggcuggacaaugacuacguggagucacca

SEQ ID NO: 459486 - RNA, 64 nt, Human
ucagcacauuugccgcaguggauguguacugagggggcuggaggcgaagggugggagcauagca

SEQ ID NO: 459487 - RNA, 64 nt, Human
gaucccuuauccuacuuagcaguguuggucucuggggcuggaagccgagcgcaugcugggagcg

SEQ ID NO: 459488 - RNA, 64 nt, Human
cugucagugccuugucacgccuggcauagagguugggcuggaggccuguccacuggcuucugga

SEQ ID NO: 459489 - RNA, 64 nt, Human
acuauacauuuucucugagacuccagcagaguuggggcuggaacuuggcacuggggacucaugu

SEQ ID NO: 459490 - RNA, 64 nt, Human
gauggcaaagggagugccugggccuggugacccagggcuggauccaccccugcggagcccuggg

SEQ ID NO: 459491 - RNA, 64 nt, Human
ucuccgagaccggagguagugggaaccaacagcugggcuggagaguuggugcuggcaaaacagu

SEQ ID NO: 459492 - RNA, 64 nt, Human
uuuaaccagguccuagggcugagguuuuaagccagggcuggagggcaaaggucauaaccucacc

SEQ ID NO: 459493 - RNA, 64 nt, Human
gagaugaccaacagggggcaggaccuggggaccugggcuggagggaagggcagaagcuuccuac

SEQ ID NO: 459494 - RNA, 62 nt, Human
acucugccuuuuuucacagcccgggugugccugcccuggagggaggcucuucagugcgguag

SEQ ID NO: 459495 - RNA, 62 nt, Human
uugggguggcccaccuguggagaggacuggcugcccuggaggaggaaagggaggaagucuac

SEQ ID NO: 459496 - RNA, 62 nt, Human
uacucugcucacacaagcgacugggccggccggcccuggaccccuagaccccgagccgccug

SEQ ID NO: 459497 - RNA, 64 nt, Human
ggcacuggaggcugcuggccguuuccuacugccugggcuggaggaggagcuggaagaggccgug

SEQ ID NO: 459498 - RNA, 64 nt, Human
aggugucgggaaaugugugacuuaaccguggugagggcuggaaauccaaacucaccaccaugau

SEQ ID NO: 459499 - RNA, 64 nt, Human
ccacagcagaaucuaaagaaagcauugaguccuggggcuggaagagguuaccagggaaggcuug

SEQ ID NO: 459500 - RNA, 64 nt, Human
uucagucuaacugggguuccuuagcuggaagccagggcuggaagcuacaggccugaccuuccug

SEQ ID NO: 459501 - RNA, 64 nt, Human
auugaggauaccccgagacuaccaggagagcccugggcuggaggcugagcugcaucccugcucc

SEQ ID NO: 459502 - RNA, 64 nt, Human
gcaucggcaccccagggcggggccucggccccgggggcuggaggaagcugacacggagaugccu

SEQ ID NO: 459503 - RNA, 64 nt, Human
cugacuacccccccagcccuccucucccuucugggggcuggagggagccggggcagccacaggg

SEQ ID NO: 459504 - RNA, 64 nt, Human
auccacaaggucguaaaugcaugcuagaaaaauagggcuggaucuuaucacugcccugucuccc

SEQ ID NO: 459505 - RNA, 53 nt, Human
cuggggccacagggaggugaggugggcuggaugccacacagauggucuccgug

SEQ ID NO: 459506 - RNA, 61 nt, Human
ggcaggacgcuuacuucugaccucugcccuggggcuggacugcauggccccccucuuuccc

SEQ ID NO: 459507 - RNA, 64 nt, Human
auaagguaacaccacagugccacuacaccuucuggggcuggacuuguuucagcagcuuugguug

SEQ ID NO: 459508 - RNA, 64 nt, Human
ucccccuucuccacccucuacuucccgcccaguggggcuggaauguggcccagccggcuggaac

SEQ ID NO: 459509 - RNA, 64 nt, Human
uguaccuguuuucaaaagcacaacugaggugugcgggcuggagcugucuugcagugauucuggc

SEQ ID NO: 459510 - RNA, 58 nt, Human
aggagaucgucacgaguuaaagcagcucgggcuggagacauagcauucauuccuguuc

SEQ ID NO: 459511 - RNA, 64 nt, Human
gagugggaaaggcaccugggggagcccuggugaagggcuggaccugacccauggaggcaggagg

SEQ ID NO: 459512 - RNA, 62 nt, Human
ucaggaauaaaguauuauguguguuuucugcggcccuggauaaugcuguagcauucaggguc

SEQ ID NO: 459513 - RNA, 62 nt, Human
ggacaggaccccagcucugcgucgguccuggugcccuggaugcccaggaaucuguauauauu

SEQ ID NO: 459514 - RNA, 62 nt, Human
ucuaggaauagccugugagccagcccuggacugcccuggacuuguucucagagguaucagga

SEQ ID NO: 459515 - RNA, 64 nt, Human
cuggcuggcucuggcuggcccuccacuggccccagggcuggagcugcccugcccuccauaggca

SEQ ID NO: 459516 - RNA, 64 nt, Human
gggcccuagccggcguccccugccuccagaacgcgggcuggaccccaauggagaacagguggug

SEQ ID NO: 459517 - RNA, 64 nt, Human
caugcaccacgggcccggguugggucaccagacggggcuggagugugaggguccugcagccugc

SEQ ID NO: 459518 - RNA, 64 nt, Human
aggcuugccaagagguuggaagggaaauggcucugggcuggaacugucuucccuugguccuucu

SEQ ID NO: 459519 - RNA, 64 nt, Human
gugcuucuggccgagcaggcggccuacuugggcagggcuggacgcugggaccuggagcugccgc

SEQ ID NO: 459520 - RNA, 64 nt, Human
cacauuccuuugcugggguucagcgccucuccuggggcuggaagugccaaagccuggggcaaag

SEQ ID NO: 459521 - RNA, 64 nt, Human
auguaugggagcuaggacaguccccauggcaauggggcuggagcaucccucaucuggaagaauc

SEQ ID NO: 459522 - RNA, 64 nt, Human
uggguccagaagaccccacuucaggcacuaagaggggcuggaccuggcggcaggaagccaaaga

SEQ ID NO: 459523 - RNA, 64 nt, Human
ugccccggcguggcaggccauuccaagcccuuccgggcuggaacuggugucggaggagccucgg

SEQ ID NO: 459524 - RNA, 64 nt, Human
gcagcuucucuaguauuucuggggcuggggggcggggcuggaggggaaggaguguccacgcauc

SEQ ID NO: 459525 - RNA, 64 nt, Human
augguagguaugguguguuuguucugucccccaggggcuggagucaccuggugccccugaagga

SEQ ID NO: 459526 - RNA, 64 nt, Human
guuaaugucauucaggugugcccauggauuuugagggcuggaaaugcaaagacacauuuuucua

SEQ ID NO: 459527 - RNA, 64 nt, Human
acguguugggaaccugguuggggcugugcaguuugggcuggaaggagagaugccagcccucgug

SEQ ID NO: 459528 - RNA, 64 nt, Human
ggccccuguggggaacaggucuuggggucaugaagggcuggaaacaagugaccccagggccugu

SEQ ID NO: 459529 - RNA, 50 nt, Human
agcugccgccuccccccugagggcuggaggcccaaggucggggaggggag

SEQ ID NO: 459530 - RNA, 62 nt, Human
uguaaugccuuuccuggacuuuuuuggccacugcccuggacuagugaaagaauggacucuau

SEQ ID NO: 459531 - RNA, 62 nt, Human
uccccagguggcugacccagucccugggggaagcccuggauuucagaaagagcaagucugga

SEQ ID NO: 459532 - RNA, 62 nt, Human
agcuucauccuauccggaggcacagcacaugagcccuggacaggucccaaaguuccaagcag

SEQ ID NO: 459533 - RNA, 64 nt, Human
gccugucccugcggggaaaucuuuuauggaagaagggcuggacccacuuuaccugcaguuucuu

SEQ ID NO: 459534 - RNA, 64 nt, Human
acaagcugagcuuguaaaagcccacagauguugggggcuggagaaggggcaggagagcaucaca

SEQ ID NO: 459535 - RNA, 64 nt, Human
gauggaacgggcaugggccucucugggggaggcagggcuggaaugggagaccuguuggccugug

SEQ ID NO: 459536 - RNA, 64 nt, Human
cauccccgcuggcugggggccucacuccaggaaggggcuggacuggcuguccuuuccaguggcc

SEQ ID NO: 459537 - RNA, 64 nt, Human
cuccugcuccuuuuccucuuuugugagaagaugggggcuggagggggcagaguggccugugagc

SEQ ID NO: 459538 - RNA, 64 nt, Human
ccccugcucaaacacaguggggaucagagaaaaggggcuggaaaggggggaauggcccacaucu

SEQ ID NO: 459539 - RNA, 64 nt, Human
ggguuugaagcccaccaagaccgaaacuggagaagggcuggaccuggaccuggaccuggaccua

SEQ ID NO: 459540 - RNA, 64 nt, Human
gggugacccggggcaggccacagaggccaggccagggcuggaaggacaggccugcccaugcagg

SEQ ID NO: 459541 - RNA, 58 nt, Human
uggugacucagcaagaauaggauggauggggcuggagaugagcugguuuggccuuggg

SEQ ID NO: 459542 - RNA, 64 nt, Human
ccuuccaaugucuggagaccaccagggcaucucugggcuggaugagcucccacaagccugaggg

SEQ ID NO: 459543 - RNA, 64 nt, Human
cugucugcuuuccuggggcaugccugaucagcgugggcuggagcuccuagaccaaccccagcuu

SEQ ID NO: 459544 - RNA, 64 nt, Human
cugccccaacgcgaccgcugcccggcugcccagagggcuggaugccugccgguccccgagcaag

SEQ ID NO: 459545 - RNA, 64 nt, Human
acagcgccccugagcugcaacaagguggaaacaagggcuggagcugcguuuguuuugccaucac

SEQ ID NO: 459546 - RNA, 64 nt, Human
uuauugcugccaaaaccacaugggcugggggccagggcuggauggacagacaccucccccuacc

SEQ ID NO: 459547 - RNA, 64 nt, Human
cugugaaaggggcuuuggaaagaguaggaggggugggcuggaucggaagcaacacccauuuggg

SEQ ID NO: 459548 - RNA, 62 nt, Human
agacauccaggagacagagccccugccccauggcccuggaugucacacucccaccagggcug

SEQ ID NO: 459549 - RNA, 62 nt, Human
uuaacucccaagugugucgcgccggacaccgggcccuggacaugcugcuuccauguucaguc

SEQ ID NO: 459550 - RNA, 62 nt, Human
aaagaaaaaagaaagaaagaaaaaaggcagaagcccuggauucaaauccgccacacauucag

SEQ ID NO: 459551 - RNA, 64 nt, Human
agcacaacaaguggcaaaggacacagcuagcaacgggcuggaaaaaggcagagaacguggagug

SEQ ID NO: 459552 - RNA, 64 nt, Human
aaaaugcacacagccaagaguugcuuucugaauagggcuggaaacuuucaaagaaaacccccaa

SEQ ID NO: 459553 - RNA, 64 nt, Human
aggacuucacucagcagcaaagagaagagcauuggggcuggaguguuccggcaaagacagagcc

SEQ ID NO: 459554 - RNA, 64 nt, Human
gaugcaggccuaccagucccuggcuuuuugucuggggcuggaauaaagaggugccuucagcugg

SEQ ID NO: 459555 - RNA, 64 nt, Human
cauccugugugcugacaggagacccagagagcuagggcuggagggacagggagcagggcagaaa

SEQ ID NO: 459556 - RNA, 64 nt, Human
gcagagaagaaagugaggccgggagccugagccugggcuggagccuucuccccuccccaguugg

SEQ ID NO: 459557 - RNA, 64 nt, Human
cugucaccagcccacccucuguguucaugaaccugggcuggagcuuggggaccccucccugccc

SEQ ID NO: 459558 - RNA, 64 nt, Human
cagccuggcuuagcaaggagccaacauaacagaugggcuggaaguaaggaaacauguaaugaua

SEQ ID NO: 459559 - RNA, 64 nt, Human
gcccuccgcccgcgucucggugcccccgcccccugggcuggagggcugugugugguccuucccu

SEQ ID NO: 459560 - RNA, 64 nt, Human
cuuuaaaaaaaaaaaaaaauacgguggggguagggggcuggaggagcccaggccaggacucugc

SEQ ID NO: 459561 - RNA, 64 nt, Human
ccgggguggcgcgcccgggggaggggggaguugggggcuggauagcuucccagcacccucagag

SEQ ID NO: 459562 - RNA, 64 nt, Human
uuuuuuuuugaggcagagucuuguucuguugccugggcuggagugcaguggcgugaucuuggcu

SEQ ID NO: 459563 - RNA, 64 nt, Human
gcaaauggcgacucuauacucuccgcccgccccagggcuggauggauuagaaaaaugccuauuu

SEQ ID NO: 459564 - RNA, 64 nt, Human
gcauaguuuucuucuaaccccuguuggaguccaggggcuggagaaaaggacagauuuaugcagc

SEQ ID NO: 459565 - RNA, 64 nt, Human
ucauacugugaaaucaaaaccauguuguuuuggggggcuggaauuugcauugaaacacuggucc

SEQ ID NO: 459566 - RNA, 62 nt, Human
acucccuggcucuaggaauagccugugagccagcccuggacugcccuggacuuguucucaga

SEQ ID NO: 459567 - RNA, 62 nt, Human
uggggcugcugugaggaaaaccugccauuguggcccuggagagucaccagcagcucuuggga

SEQ ID NO: 459568 - RNA, 62 nt, Human
gcggccucccucagcuggugucggagugcgcggcccuggaggaguucauccacgagggguag

SEQ ID NO: 459569 - RNA, 64 nt, Human
aucauaaccaauuggaaaccugcaguuugggguagggcuggaggaucgcuccuguggaaaggga

SEQ ID NO: 459570 - RNA, 64 nt, Human
cuaaacaaacacaaaguauucugugucagguauugggcuggacagggcaguuguguguuggggu

SEQ ID NO: 459571 - RNA, 64 nt, Human
uagcucgcuccugccucacagcccacacucccuggggcuggaccacaacucagcccuucaccug

SEQ ID NO: 459572 - RNA, 64 nt, Human
uugcccuucccucccuaucacuccauacuggggugggcuggaggaggccacaggccagcuauug

SEQ ID NO: 459573 - RNA, 64 nt, Human
ucgggcuggggggucagguggacgccgcccuccggggcuggacgcgcaucccucagucccucgg

SEQ ID NO: 459574 - RNA, 64 nt, Human
cuggugccagugccccaggggccuccugggccacgggcuggaggggcugcccagggaccuuggu

SEQ ID NO: 459575 - RNA, 64 nt, Human
ggagcucgaaggauauugucagucuuuagggguugggcuggaugccgagguaaaaguucuuuuu

SEQ ID NO: 459576 - RNA, 64 nt, Human
cuuuuucucguguuuuuguaaagagcuuccaucugggcuggacccaguucuugcacauacaaga

SEQ ID NO: 459577 - RNA, 64 nt, Human
gcccugccucgcugcuugccagccucaccugcuggggcuggaggccauggaucccucauaguau

SEQ ID NO: 459578 - RNA, 64 nt, Human
uucagguauuucuuuaccccucuggauuccccacgggcuggaucgagaugguccaguuaugccc

SEQ ID NO: 459579 - RNA, 64 nt, Human
gacccccagcuuucagagcccagccaccagcuuggggcuggaugaaggggucuccgccagcuca

SEQ ID NO: 459580 - RNA, 64 nt, Human
ggcagcugcccaucccauaaccaaagagcucaaugggcuggagggugagacccagccaauccuu

SEQ ID NO: 459581 - RNA, 64 nt, Human
ggcuuuaagagcacaaggagggaaaguaacgaaagggcuggacuacuauaaaaguuacaaauac

SEQ ID NO: 459582 - RNA, 64 nt, Human
agcuccuggaaggagaagggaggaacugggccuggggcuggaggccugggaucccuccuuugug

SEQ ID NO: 459583 - RNA, 64 nt, Human
uauuuaaagccuuuggaaaauacaggaagcuccagggcuggagcaccucugagauggaauugau

SEQ ID NO: 459584 - RNA, 62 nt, Human
uauagcccugcuuugagcugucagccucaccugcccuggaaccccggcacccggcuugggca

SEQ ID NO: 459585 - RNA, 54 nt, Human; identical to SEQ ID NO: 372231

SEQ ID NO: 459586 - RNA, 62 nt, Human
aguuuuuuacugaauuaaucugaaauguacaagcccuggauuugcuacagagugagaaguua

SEQ ID NO: 459587 - RNA, 64 nt, Human
gggagguucgggggccuuccggcaggugaacgcagggcuggagaguauuuggugccagaugagg

SEQ ID NO: 459588 - RNA, 64 nt, Human
ucagaggcucaccacaagccuggcauuucagccagggcuggagaaggcagggacgccuggguga

SEQ ID NO: 459589 - RNA, 64 nt, Human
uccccagccuggguuuccaugugaccccacaguggggcuggaccagggcccuggaggccaauaa

SEQ ID NO: 459590 - RNA, 64 nt, Human
accuguuggagggcggaugggaucugccuagccugggcuggaguccuugcuuugcugcugcuga

SEQ ID NO: 459591 - RNA, 64 nt, Human
gagauggcuaauagcuguuuaauggaaaccugcugggcuggagggaguuaggcugaauuucccg

SEQ ID NO: 459592 - RNA, 64 nt, Human
auugggagagggagggaggaaggaagggagggaggggcuggaagauacugaaggauuccuuuuu

SEQ ID NO: 459593 - RNA, 64 nt, Human
ggccaaggacgagcuguagagaggccugccuccagggcuggacugaggccugagcgcuccugcc

SEQ ID NO: 459594 - RNA, 64 nt, Human
cugggcccugccagcaucucuggcucggcuuucugggcuggaugcagcccacgacgcacuggug

SEQ ID NO: 459595 - RNA, 64 nt, Human
ggaugcagcccacgacgcacuggugucugagauggggcuggagcuggggcuggggcugcauucc

SEQ ID NO: 459596 - RNA, 64 nt, Human
cugcccguggccuggguaggacauuucccagcaagggcuggaggaguugccgugccuucagccu

SEQ ID NO: 459597 - RNA, 64 nt, Human
ccuguguuccccaagaauucagagaacagcacuggggcuggaaugaucuuuaaugggcccaagg

SEQ ID NO: 459598 - RNA, 64 nt, Human
gccugccccgcccagacugcccaggcagagggcagggcuggaccaugggugagggcaggggagc

SEQ ID NO: 459599 - RNA, 64 nt, Human
cuagaauccuagccuagaagcccucucucccucugggcuggagcucagugagggacaacucucu

SEQ ID NO: 459600 - RNA, 64 nt, Human
uucuagcucaaauuuguguauuuuuugugugccugggcuggagaugagagacugagucauaacu

SEQ ID NO: 459601 - RNA, 64 nt, Human
cuccucccugccuggcggcaggggucgcgaugaugggcuggagcaguuuggggcaggggguucu

SEQ ID NO: 459602 - RNA, 62 nt, Human
ggcuggggcggccaguuuugacacgccccagugcccuggagaacaaccagggucaucugcac

SEQ ID NO: 459603 - RNA, 62 nt, Human
ucugggugugggccccuggccgccucccuccagcccuggagaggagggcagggcugcgggga

SEQ ID NO: 459604 - RNA, 62 nt, Human
cagggaaugguucauuuacucuuaaucuuuaugcccuggagaagaccuacuugaacagggca

SEQ ID NO: 459605 - RNA, 64 nt, Human
agggggaguucaugcaccccuuuuuuccccagaggggcuggacucagguuaguuuggggguggg

SEQ ID NO: 459606 - RNA, 64 nt, Human
ucaagugugaggagaugaggcuggggauagucaggggcuggaucacccagggccuugugggccc

SEQ ID NO: 459607 - RNA, 64 nt, Human
gggcacccagaugugcugcucaagggagccccaagggcuggaaggggguugugaaaccgaaaua

SEQ ID NO: 459608 - RNA, 64 nt, Human
aaguugacaggucagaagaucaggaaagaggucggggcuggacagauggggagagcgcagauag

SEQ ID NO: 459609 - RNA, 64 nt, Human
uuaagggacgggggugggagguaggcuguggggugggcuggaguccucuccagagaggcucaac

SEQ ID NO: 459610 - RNA, 64 nt, Human
aaacccccaauauuuuuggacuggcagacucaaggggcuggaaucucaugauuccaugcccgag

SEQ ID NO: 459611 - RNA, 63 nt, Human
caccaaggugccggaacugaucagaaccaucaugggcuggacauuggacuuccuccgggagcg

SEQ ID NO: 459612 - RNA, 64 nt, Human
gcuggacauuggacuuccuccgggagcggcuguugggcuggauccaagaccagggugguugggu
